United States Patent 11,421,016 (CANCER NEOEPITOPES) - sequence listing, part 19

SEQ ID NO: 833472 - protein, 9 aa, Homo Sapiens
WKKQEERPL

SEQ ID NO: 833473 - protein, 9 aa, Homo Sapiens
SLKADEGNK

SEQ ID NO: 833474 - protein, 9 aa, Homo Sapiens
NMACIIYSV

SEQ ID NO: 833475 - protein, 9 aa, Homo Sapiens
RSRLYVGAQ

SEQ ID NO: 833476 - protein, 9 aa, Homo Sapiens
KCVTQQQYR

SEQ ID NO: 833477 - protein, 9 aa, Homo Sapiens
ILLCTDNCP

SEQ ID NO: 833478 - protein, 9 aa, Homo Sapiens
ILSSVLQTS

SEQ ID NO: 833479 - protein, 9 aa, Homo Sapiens
KLKMNYRVV

SEQ ID NO: 833480 - protein, 9 aa, Homo Sapiens
SDVGGYYYD

SEQ ID NO: 833481 - protein, 9 aa, Homo Sapiens
VWKYFGFNT

SEQ ID NO: 833482 - protein, 9 aa, Homo Sapiens
YFKHYRSII

SEQ ID NO: 833483 - protein, 9 aa, Homo Sapiens
VTQEQVDTG

SEQ ID NO: 833484 - protein, 9 aa, Homo Sapiens
ATLCAPKAV

SEQ ID NO: 833485 - protein, 9 aa, Homo Sapiens
VVLLKKANV

SEQ ID NO: 833486 - protein, 9 aa, Homo Sapiens
TSIVWVGGR

SEQ ID NO: 833487 - protein, 9 aa, Homo Sapiens
DNALAIVNS

SEQ ID NO: 833488 - protein, 9 aa, Homo Sapiens
FFDQNRLDW

SEQ ID NO: 833489 - protein, 9 aa, Homo Sapiens
YLPALEPFI

SEQ ID NO: 833490 - protein, 9 aa, Homo Sapiens
LFTFHLDSL

SEQ ID NO: 833491 - protein, 9 aa, Homo Sapiens
TGNVWWQKL

SEQ ID NO: 833492 - protein, 9 aa, Homo Sapiens
QNLSLSGHV

SEQ ID NO: 833493 - protein, 9 aa, Homo Sapiens
GQDGRRWLT

SEQ ID NO: 833494 - protein, 9 aa, Homo Sapiens
PQLFMEQYK

SEQ ID NO: 833495 - protein, 9 aa, Homo Sapiens
EEIDLENVD

SEQ ID NO: 833496 - protein, 9 aa, Homo Sapiens
VQEPPNFVV

SEQ ID NO: 833497 - protein, 9 aa, Homo Sapiens
DVVKIEFED

SEQ ID NO: 833498 - protein, 9 aa, Homo Sapiens
GKDEIKAAV

SEQ ID NO: 833499 - protein, 9 aa, Homo Sapiens
ELSLQKSYE

SEQ ID NO: 833500 - protein, 9 aa, Homo Sapiens
RYQKEMKNS

SEQ ID NO: 833501 - protein, 9 aa, Homo Sapiens
EPGDYFSLI

SEQ ID NO: 833502 - protein, 9 aa, Homo Sapiens
PEKEDYIVY

SEQ ID NO: 833503 - protein, 9 aa, Homo Sapiens
VYDLSQKPG

SEQ ID NO: 833504 - protein, 9 aa, Homo Sapiens
AEKIMLTEV

SEQ ID NO: 833505 - protein, 9 aa, Homo Sapiens
KEVHTINEM

SEQ ID NO: 833506 - protein, 9 aa, Homo Sapiens
CASIWLQKS

SEQ ID NO: 833507 - protein, 9 aa, Homo Sapiens
EKAILQAWT

SEQ ID NO: 833508 - protein, 9 aa, Homo Sapiens
KDDANLLPE

SEQ ID NO: 833509 - protein, 9 aa, Homo Sapiens
GVFAFGPFA

SEQ ID NO: 833510 - protein, 9 aa, Homo Sapiens
LTHKTMPHI

SEQ ID NO: 833511 - protein, 9 aa, Homo Sapiens
QINSIKLLQ

SEQ ID NO: 833512 - protein, 9 aa, Homo Sapiens
ATVEVSPPF

SEQ ID NO: 833513 - protein, 9 aa, Homo Sapiens
YVCLKYAYE

SEQ ID NO: 833514 - protein, 9 aa, Homo Sapiens
DHSVFLLTT

SEQ ID NO: 833515 - protein, 9 aa, Homo Sapiens
GNTLGYFGG

SEQ ID NO: 833516 - protein, 9 aa, Homo Sapiens
SLSFSTNLH

SEQ ID NO: 833517 - protein, 9 aa, Homo Sapiens
SIITPTLNY

SEQ ID NO: 833518 - protein, 9 aa, Homo Sapiens
EMSNAFAHL

SEQ ID NO: 833519 - protein, 9 aa, Homo Sapiens
SPGGDWEVN

SEQ ID NO: 833520 - protein, 9 aa, Homo Sapiens
LEERKSSAL

SEQ ID NO: 833521 - protein, 9 aa, Homo Sapiens
KMVIAACSL

SEQ ID NO: 833522 - protein, 9 aa, Homo Sapiens
DWMNVLPHL

SEQ ID NO: 833523 - protein, 9 aa, Homo Sapiens
EDDLNKPLK

SEQ ID NO: 833524 - protein, 9 aa, Homo Sapiens
AGCIFRFGR

SEQ ID NO: 833525 - protein, 9 aa, Homo Sapiens
QAPQLKISD

SEQ ID NO: 833526 - protein, 9 aa, Homo Sapiens
SWSLRMVGD

SEQ ID NO: 833527 - protein, 9 aa, Homo Sapiens
KRHFKLEKH

SEQ ID NO: 833528 - protein, 9 aa, Homo Sapiens
GVASSQFLP

SEQ ID NO: 833529 - protein, 9 aa, Homo Sapiens
ISFALTFRS

SEQ ID NO: 833530 - protein, 9 aa, Homo Sapiens
PNPPPDNVQ

SEQ ID NO: 833531 - protein, 9 aa, Homo Sapiens
PWQQVDKAS

SEQ ID NO: 833532 - protein, 9 aa, Homo Sapiens
LELYQGIKV

SEQ ID NO: 833533 - protein, 9 aa, Homo Sapiens
VMSSPTENY

SEQ ID NO: 833534 - protein, 9 aa, Homo Sapiens
LTESVRWIS

SEQ ID NO: 833535 - protein, 9 aa, Homo Sapiens
GSVMAYQLG

SEQ ID NO: 833536 - protein, 9 aa, Homo Sapiens
APVTEGRAH

SEQ ID NO: 833537 - protein, 9 aa, Homo Sapiens
IIRIAACNL

SEQ ID NO: 833538 - protein, 9 aa, Homo Sapiens
YVVKHHLSK

SEQ ID NO: 833539 - protein, 9 aa, Homo Sapiens
DGLIDKEDL

SEQ ID NO: 833540 - protein, 9 aa, Homo Sapiens
DTCLANVLA

SEQ ID NO: 833541 - protein, 9 aa, Homo Sapiens
IHLALGGCT

SEQ ID NO: 833542 - protein, 9 aa, Homo Sapiens
INLFGSIFV

SEQ ID NO: 833543 - protein, 9 aa, Homo Sapiens
RFLFSIRKG

SEQ ID NO: 833544 - protein, 9 aa, Homo Sapiens
KESKVEQQD

SEQ ID NO: 833545 - protein, 9 aa, Homo Sapiens
SLCSRLSSI

SEQ ID NO: 833546 - protein, 9 aa, Homo Sapiens
SHKREAVIE

SEQ ID NO: 833547 - protein, 9 aa, Homo Sapiens
QRLSAARRA

SEQ ID NO: 833548 - protein, 9 aa, Homo Sapiens
HQGEIYVPE

SEQ ID NO: 833549 - protein, 9 aa, Homo Sapiens
NVVDCNQVQ

SEQ ID NO: 833550 - protein, 9 aa, Homo Sapiens
SMTRSPLRV

SEQ ID NO: 833551 - protein, 9 aa, Homo Sapiens
HTILLGYLA

SEQ ID NO: 833552 - protein, 9 aa, Homo Sapiens
GVRVRVIIL

SEQ ID NO: 833553 - protein, 9 aa, Homo Sapiens
IAVEYSDLE

SEQ ID NO: 833554 - protein, 9 aa, Homo Sapiens
YHYMLTAGL

SEQ ID NO: 833555 - protein, 9 aa, Homo Sapiens
RTGYWIMMN

SEQ ID NO: 833556 - protein, 9 aa, Homo Sapiens
LAPETTKTP

SEQ ID NO: 833557 - protein, 9 aa, Homo Sapiens
VEGNLEFRA

SEQ ID NO: 833558 - protein, 9 aa, Homo Sapiens
GVRLGKHLQ

SEQ ID NO: 833559 - protein, 9 aa, Homo Sapiens
LIEGVKINQ

SEQ ID NO: 833560 - protein, 9 aa, Homo Sapiens
TSSSSFKLE

SEQ ID NO: 833561 - protein, 9 aa, Homo Sapiens
QHNVMISTE

SEQ ID NO: 833562 - protein, 9 aa, Homo Sapiens
KATIENKNY

SEQ ID NO: 833563 - protein, 9 aa, Homo Sapiens
LNLDPLPTH

SEQ ID NO: 833564 - protein, 9 aa, Homo Sapiens
VCTEDSYTA

SEQ ID NO: 833565 - protein, 9 aa, Homo Sapiens
TRQKAFDWD

SEQ ID NO: 833566 - protein, 9 aa, Homo Sapiens
EFKNDLLKK

SEQ ID NO: 833567 - protein, 9 aa, Homo Sapiens
RRLLSQEEH

SEQ ID NO: 833568 - protein, 9 aa, Homo Sapiens
QRIKDILPQ

SEQ ID NO: 833569 - protein, 9 aa, Homo Sapiens
TPQNKLECL

SEQ ID NO: 833570 - protein, 9 aa, Homo Sapiens
GADIIKVGS

SEQ ID NO: 833571 - protein, 9 aa, Homo Sapiens
INPSMADYE

SEQ ID NO: 833572 - protein, 9 aa, Homo Sapiens
VNITSPMSI

SEQ ID NO: 833573 - protein, 9 aa, Homo Sapiens
PPASKRVVS

SEQ ID NO: 833574 - protein, 9 aa, Homo Sapiens
MTSSGLCQS

SEQ ID NO: 833575 - protein, 9 aa, Homo Sapiens
RLTVLLNTK

SEQ ID NO: 833576 - protein, 9 aa, Homo Sapiens
GYNNRNQDM

SEQ ID NO: 833577 - protein, 9 aa, Homo Sapiens
GVVLADSSR

SEQ ID NO: 833578 - protein, 9 aa, Homo Sapiens
RGTKKDEMR

SEQ ID NO: 833579 - protein, 9 aa, Homo Sapiens
HFFKESWPQ

SEQ ID NO: 833580 - protein, 9 aa, Homo Sapiens
IWTEGLLQE

SEQ ID NO: 833581 - protein, 9 aa, Homo Sapiens
KNEVQDYAS

SEQ ID NO: 833582 - protein, 9 aa, Homo Sapiens
IVVSYGNII

SEQ ID NO: 833583 - protein, 9 aa, Homo Sapiens
FVFDRNKQT

SEQ ID NO: 833584 - protein, 9 aa, Homo Sapiens
LKWLYGLLP

SEQ ID NO: 833585 - protein, 9 aa, Homo Sapiens
EYLHCKFYQ

SEQ ID NO: 833586 - protein, 9 aa, Homo Sapiens
TFPARERIG

SEQ ID NO: 833587 - protein, 9 aa, Homo Sapiens
SQLSTLSHS

SEQ ID NO: 833588 - protein, 9 aa, Homo Sapiens
YPSPYCIVA

SEQ ID NO: 833589 - protein, 9 aa, Homo Sapiens
FEECNGKPD

SEQ ID NO: 833590 - protein, 9 aa, Homo Sapiens
ETLFQPSFL

SEQ ID NO: 833591 - protein, 9 aa, Homo Sapiens
TQQLNDLDK

SEQ ID NO: 833592 - protein, 9 aa, Homo Sapiens
SDTNGDGEI

SEQ ID NO: 833593 - protein, 9 aa, Homo Sapiens
SIAGLDYLC

SEQ ID NO: 833594 - protein, 9 aa, Homo Sapiens
SMKETLQIR

SEQ ID NO: 833595 - protein, 9 aa, Homo Sapiens
AVQYAEDQG

SEQ ID NO: 833596 - protein, 9 aa, Homo Sapiens
EHEKIHPGE

SEQ ID NO: 833597 - protein, 9 aa, Homo Sapiens
PRCRYPVLI

SEQ ID NO: 833598 - protein, 9 aa, Homo Sapiens
LYELVTSTD

SEQ ID NO: 833599 - protein, 9 aa, Homo Sapiens
SVPPDFQGA

SEQ ID NO: 833600 - protein, 9 aa, Homo Sapiens
KALKKKIHR

SEQ ID NO: 833601 - protein, 9 aa, Homo Sapiens
SLLHRARMH

SEQ ID NO: 833602 - protein, 9 aa, Homo Sapiens
KCSEEINNY

SEQ ID NO: 833603 - protein, 9 aa, Homo Sapiens
TDSDEDILE

SEQ ID NO: 833604 - protein, 9 aa, Homo Sapiens
LFVGLHWME

SEQ ID NO: 833605 - protein, 9 aa, Homo Sapiens
MFPEGKSFI

SEQ ID NO: 833606 - protein, 9 aa, Homo Sapiens
HSDDEELLL

SEQ ID NO: 833607 - protein, 9 aa, Homo Sapiens
CLKMKMTFC

SEQ ID NO: 833608 - protein, 9 aa, Homo Sapiens
VCISYPSLH

SEQ ID NO: 833609 - protein, 9 aa, Homo Sapiens
SRDFGIWML

SEQ ID NO: 833610 - protein, 9 aa, Homo Sapiens
ALKQSLVAA

SEQ ID NO: 833611 - protein, 9 aa, Homo Sapiens
AACHGNLTE

SEQ ID NO: 833612 - protein, 9 aa, Homo Sapiens
DNLLLGSAG

SEQ ID NO: 833613 - protein, 9 aa, Homo Sapiens
YKGICTEDR

SEQ ID NO: 833614 - protein, 9 aa, Homo Sapiens
MYSQSNISK

SEQ ID NO: 833615 - protein, 9 aa, Homo Sapiens
KHVMPFWRI

SEQ ID NO: 833616 - protein, 9 aa, Homo Sapiens
QELRYEESS

SEQ ID NO: 833617 - protein, 9 aa, Homo Sapiens
EFLGMIGIF

SEQ ID NO: 833618 - protein, 9 aa, Homo Sapiens
MAQQELDHI

SEQ ID NO: 833619 - protein, 9 aa, Homo Sapiens
RFQNTLLVL

SEQ ID NO: 833620 - protein, 9 aa, Homo Sapiens
NNYYSLVLD

SEQ ID NO: 833621 - protein, 9 aa, Homo Sapiens
WLRPPGILK

SEQ ID NO: 833622 - protein, 9 aa, Homo Sapiens
LQKLFLTSN

SEQ ID NO: 833623 - protein, 9 aa, Homo Sapiens
SDSFIAGTI

SEQ ID NO: 833624 - protein, 9 aa, Homo Sapiens
LEFKAHKGE

SEQ ID NO: 833625 - protein, 9 aa, Homo Sapiens
RKIQEHWTG

SEQ ID NO: 833626 - protein, 9 aa, Homo Sapiens
DCSIVSLLA

SEQ ID NO: 833627 - protein, 9 aa, Homo Sapiens
EVRPRKCET

SEQ ID NO: 833628 - protein, 9 aa, Homo Sapiens
MHNYQISGL

SEQ ID NO: 833629 - protein, 9 aa, Homo Sapiens
TCFDSLKGR

SEQ ID NO: 833630 - protein, 9 aa, Homo Sapiens
QAKLDQEAE

SEQ ID NO: 833631 - protein, 9 aa, Homo Sapiens
QYICKDLKI

SEQ ID NO: 833632 - protein, 9 aa, Homo Sapiens
EESPQGKVV

SEQ ID NO: 833633 - protein, 9 aa, Homo Sapiens
SAAIQSGRM

SEQ ID NO: 833634 - protein, 9 aa, Homo Sapiens
RDTCTYATA

SEQ ID NO: 833635 - protein, 9 aa, Homo Sapiens
RDQVLQVQA

SEQ ID NO: 833636 - protein, 9 aa, Homo Sapiens
IEDPFYLNH

SEQ ID NO: 833637 - protein, 9 aa, Homo Sapiens
TLREFLKLL

SEQ ID NO: 833638 - protein, 9 aa, Homo Sapiens
PGIADRMQT

SEQ ID NO: 833639 - protein, 9 aa, Homo Sapiens
SLKNTLKSV

SEQ ID NO: 833640 - protein, 9 aa, Homo Sapiens
VKHCTDQIY

SEQ ID NO: 833641 - protein, 9 aa, Homo Sapiens
HSMRKLITD

SEQ ID NO: 833642 - protein, 9 aa, Homo Sapiens
QTPVPSHPY

SEQ ID NO: 833643 - protein, 9 aa, Homo Sapiens
HLTIHLALG

SEQ ID NO: 833644 - protein, 9 aa, Homo Sapiens
VPKMLINFL

SEQ ID NO: 833645 - protein, 9 aa, Homo Sapiens
IATFQDVYF

SEQ ID NO: 833646 - protein, 9 aa, Homo Sapiens
TDVINFDDI

SEQ ID NO: 833647 - protein, 9 aa, Homo Sapiens
AYDHYIAIS

SEQ ID NO: 833648 - protein, 9 aa, Homo Sapiens
WLITLKNII

SEQ ID NO: 833649 - protein, 9 aa, Homo Sapiens
DELINQSQG

SEQ ID NO: 833650 - protein, 9 aa, Homo Sapiens
KDNNTPSPF

SEQ ID NO: 833651 - protein, 9 aa, Homo Sapiens
ANVIVTGGK

SEQ ID NO: 833652 - protein, 9 aa, Homo Sapiens
LGVSILYQK

SEQ ID NO: 833653 - protein, 9 aa, Homo Sapiens
TKDLSEADL

SEQ ID NO: 833654 - protein, 9 aa, Homo Sapiens
STDAVLAAD

SEQ ID NO: 833655 - protein, 9 aa, Homo Sapiens
SRIDSTGVL

SEQ ID NO: 833656 - protein, 9 aa, Homo Sapiens
DAQAKNECY

SEQ ID NO: 833657 - protein, 9 aa, Homo Sapiens
NLHSKKQAK

SEQ ID NO: 833658 - protein, 9 aa, Homo Sapiens
AEHLASVVI

SEQ ID NO: 833659 - protein, 9 aa, Homo Sapiens
HKTQSLEGK

SEQ ID NO: 833660 - protein, 9 aa, Homo Sapiens
GQSEVSAVQ

SEQ ID NO: 833661 - protein, 9 aa, Homo Sapiens
PSLGAIPQA

SEQ ID NO: 833662 - protein, 9 aa, Homo Sapiens
EITDNPFMT

SEQ ID NO: 833663 - protein, 9 aa, Homo Sapiens
QPKGPMSIP

SEQ ID NO: 833664 - protein, 9 aa, Homo Sapiens
RSARLTRGE

SEQ ID NO: 833665 - protein, 9 aa, Homo Sapiens
HIADLRAYC

SEQ ID NO: 833666 - protein, 9 aa, Homo Sapiens
LDNSYLPII

SEQ ID NO: 833667 - protein, 9 aa, Homo Sapiens
DNITTPKTE

SEQ ID NO: 833668 - protein, 9 aa, Homo Sapiens
DPHHCSFSK

SEQ ID NO: 833669 - protein, 9 aa, Homo Sapiens
SRSFKDELL

SEQ ID NO: 833670 - protein, 9 aa, Homo Sapiens
EPQKNAVAH

SEQ ID NO: 833671 - protein, 9 aa, Homo Sapiens
PQVAFTTKI

SEQ ID NO: 833672 - protein, 9 aa, Homo Sapiens
ALYNPVNFA

SEQ ID NO: 833673 - protein, 9 aa, Homo Sapiens
AYPAQAQSL

SEQ ID NO: 833674 - protein, 9 aa, Homo Sapiens
ESKNELEKF

SEQ ID NO: 833675 - protein, 9 aa, Homo Sapiens
KIDVVYEAP

SEQ ID NO: 833676 - protein, 9 aa, Homo Sapiens
SQQPKLKRV

SEQ ID NO: 833677 - protein, 9 aa, Homo Sapiens
SLTIDNVTL

SEQ ID NO: 833678 - protein, 9 aa, Homo Sapiens
KGRNIYEPP

SEQ ID NO: 833679 - protein, 9 aa, Homo Sapiens
EFIYCLALN

SEQ ID NO: 833680 - protein, 9 aa, Homo Sapiens
APEPSSSNA

SEQ ID NO: 833681 - protein, 9 aa, Homo Sapiens
AKTGSLNAY

SEQ ID NO: 833682 - protein, 9 aa, Homo Sapiens
LQANSSQVP

SEQ ID NO: 833683 - protein, 9 aa, Homo Sapiens
ADKELVQSL

SEQ ID NO: 833684 - protein, 9 aa, Homo Sapiens
QIAAHTNLT

SEQ ID NO: 833685 - protein, 9 aa, Homo Sapiens
QLKLSNMYV

SEQ ID NO: 833686 - protein, 9 aa, Homo Sapiens
EPEAKTDTK

SEQ ID NO: 833687 - protein, 9 aa, Homo Sapiens
QFSDRIILQ

SEQ ID NO: 833688 - protein, 9 aa, Homo Sapiens
PGLYMGRPT

SEQ ID NO: 833689 - protein, 9 aa, Homo Sapiens
GYQVKESKV

SEQ ID NO: 833690 - protein, 9 aa, Homo Sapiens
AKLADTMRT

SEQ ID NO: 833691 - protein, 9 aa, Homo Sapiens
PDTLEEDQQ

SEQ ID NO: 833692 - protein, 9 aa, Homo Sapiens
FISYCLKCA

SEQ ID NO: 833693 - protein, 9 aa, Homo Sapiens
YELRYRKCP

SEQ ID NO: 833694 - protein, 9 aa, Homo Sapiens
QDELLKMQL

SEQ ID NO: 833695 - protein, 9 aa, Homo Sapiens
EALQAFKFR

SEQ ID NO: 833696 - protein, 9 aa, Homo Sapiens
HMTYDLASD

SEQ ID NO: 833697 - protein, 9 aa, Homo Sapiens
LKQLILAHK

SEQ ID NO: 833698 - protein, 9 aa, Homo Sapiens
SVLRSADTM

SEQ ID NO: 833699 - protein, 9 aa, Homo Sapiens
QSHNPATTN

SEQ ID NO: 833700 - protein, 9 aa, Homo Sapiens
PNLRANPLH

SEQ ID NO: 833701 - protein, 9 aa, Homo Sapiens
ALLYRLWKG

SEQ ID NO: 833702 - protein, 9 aa, Homo Sapiens
VKNNSYIKA

SEQ ID NO: 833703 - protein, 9 aa, Homo Sapiens
SQDHVKKDY

SEQ ID NO: 833704 - protein, 9 aa, Homo Sapiens
RLFSGTQIA

SEQ ID NO: 833705 - protein, 9 aa, Homo Sapiens
YAAQLAVTR

SEQ ID NO: 833706 - protein, 9 aa, Homo Sapiens
KTEVAIQII

SEQ ID NO: 833707 - protein, 9 aa, Homo Sapiens
LEGDHVFCA

SEQ ID NO: 833708 - protein, 9 aa, Homo Sapiens
RIFLADSGR

SEQ ID NO: 833709 - protein, 9 aa, Homo Sapiens
QKITGREYF

SEQ ID NO: 833710 - protein, 9 aa, Homo Sapiens
NLFCFLTDT

SEQ ID NO: 833711 - protein, 9 aa, Homo Sapiens
NALLQLPDL

SEQ ID NO: 833712 - protein, 9 aa, Homo Sapiens
RKPQKAHKY

SEQ ID NO: 833713 - protein, 9 aa, Homo Sapiens
LEFSETDFV

SEQ ID NO: 833714 - protein, 9 aa, Homo Sapiens
PELQPILFS

SEQ ID NO: 833715 - protein, 9 aa, Homo Sapiens
SQQYSSCLT

SEQ ID NO: 833716 - protein, 9 aa, Homo Sapiens
KHAFARTVN

SEQ ID NO: 833717 - protein, 9 aa, Homo Sapiens
FSSVLSTST

SEQ ID NO: 833718 - protein, 9 aa, Homo Sapiens
WNVSRFINH

SEQ ID NO: 833719 - protein, 9 aa, Homo Sapiens
GTVEVKVQG

SEQ ID NO: 833720 - protein, 9 aa, Homo Sapiens
HDVTERKLR

SEQ ID NO: 833721 - protein, 9 aa, Homo Sapiens
LISTPTATV

SEQ ID NO: 833722 - protein, 9 aa, Homo Sapiens
MKIQFSRIT

SEQ ID NO: 833723 - protein, 9 aa, Homo Sapiens
ANILYSVLT

SEQ ID NO: 833724 - protein, 9 aa, Homo Sapiens
LKNLLCLDA

SEQ ID NO: 833725 - protein, 9 aa, Homo Sapiens
EEIDKMAET

SEQ ID NO: 833726 - protein, 9 aa, Homo Sapiens
HQIIHAVEK

SEQ ID NO: 833727 - protein, 9 aa, Homo Sapiens
GQGQPTGNV

SEQ ID NO: 833728 - protein, 9 aa, Homo Sapiens
KTRYCSMLC

SEQ ID NO: 833729 - protein, 9 aa, Homo Sapiens
GLSAQWKQL

SEQ ID NO: 833730 - protein, 9 aa, Homo Sapiens
RVRIIAMRT

SEQ ID NO: 833731 - protein, 9 aa, Homo Sapiens
WFVDSEDPH

SEQ ID NO: 833732 - protein, 9 aa, Homo Sapiens
LWANQFRFS

SEQ ID NO: 833733 - protein, 9 aa, Homo Sapiens
MVTTFKNIK

SEQ ID NO: 833734 - protein, 9 aa, Homo Sapiens
VRLKTSMKF

SEQ ID NO: 833735 - protein, 9 aa, Homo Sapiens
AFIHYLPGC

SEQ ID NO: 833736 - protein, 9 aa, Homo Sapiens
HHYQRTPCY

SEQ ID NO: 833737 - protein, 9 aa, Homo Sapiens
LRAEIDNLH

SEQ ID NO: 833738 - protein, 9 aa, Homo Sapiens
RIYYSWEGN

SEQ ID NO: 833739 - protein, 9 aa, Homo Sapiens
ELQNHEKQE

SEQ ID NO: 833740 - protein, 9 aa, Homo Sapiens
ASFDFGSGI

SEQ ID NO: 833741 - protein, 9 aa, Homo Sapiens
KPVFIMPQI

SEQ ID NO: 833742 - protein, 9 aa, Homo Sapiens
SNKLVEELM

SEQ ID NO: 833743 - protein, 9 aa, Homo Sapiens
TEFVSSLPL

SEQ ID NO: 833744 - protein, 9 aa, Homo Sapiens
FQGIVKHLR

SEQ ID NO: 833745 - protein, 9 aa, Homo Sapiens
LNRYMIVSF

SEQ ID NO: 833746 - protein, 9 aa, Homo Sapiens
RHEEQSGMY

SEQ ID NO: 833747 - protein, 9 aa, Homo Sapiens
VKRAKKECP

SEQ ID NO: 833748 - protein, 9 aa, Homo Sapiens
HLFWSFTLY

SEQ ID NO: 833749 - protein, 9 aa, Homo Sapiens
ADRVSEANP

SEQ ID NO: 833750 - protein, 9 aa, Homo Sapiens
VADIYCGNC

SEQ ID NO: 833751 - protein, 9 aa, Homo Sapiens
QPELYRCSI

SEQ ID NO: 833752 - protein, 9 aa, Homo Sapiens
YFIWNMEES

SEQ ID NO: 833753 - protein, 9 aa, Homo Sapiens
SSSPGPLAS

SEQ ID NO: 833754 - protein, 9 aa, Homo Sapiens
LDEAFLRLA

SEQ ID NO: 833755 - protein, 9 aa, Homo Sapiens
REIEYIKNV

SEQ ID NO: 833756 - protein, 9 aa, Homo Sapiens
MFDVGGQIS

SEQ ID NO: 833757 - protein, 9 aa, Homo Sapiens
CCYVLSAQQ

SEQ ID NO: 833758 - protein, 9 aa, Homo Sapiens
VNINISEVV

SEQ ID NO: 833759 - protein, 9 aa, Homo Sapiens
CIFLFFETG

SEQ ID NO: 833760 - protein, 9 aa, Homo Sapiens
DNYSSLVSL

SEQ ID NO: 833761 - protein, 9 aa, Homo Sapiens
VTLNGVDKL

SEQ ID NO: 833762 - protein, 9 aa, Homo Sapiens
AAASSPGED

SEQ ID NO: 833763 - protein, 9 aa, Homo Sapiens
HVGIFLDAD

SEQ ID NO: 833764 - protein, 9 aa, Homo Sapiens
TLPIFDKEE

SEQ ID NO: 833765 - protein, 9 aa, Homo Sapiens
PRIFKIIVI

SEQ ID NO: 833766 - protein, 9 aa, Homo Sapiens
SMDSKGQKA

SEQ ID NO: 833767 - protein, 9 aa, Homo Sapiens
AKGFWDNYD

SEQ ID NO: 833768 - protein, 9 aa, Homo Sapiens
RIKDILPQY

SEQ ID NO: 833769 - protein, 9 aa, Homo Sapiens
VTSSKCFLP

SEQ ID NO: 833770 - protein, 9 aa, Homo Sapiens
LQPWHYFGA

SEQ ID NO: 833771 - protein, 9 aa, Homo Sapiens
FIGINFGLL

SEQ ID NO: 833772 - protein, 9 aa, Homo Sapiens
LSLTTILVQ

SEQ ID NO: 833773 - protein, 9 aa, Homo Sapiens
ITVGGAHEA

SEQ ID NO: 833774 - protein, 9 aa, Homo Sapiens
LDSRDSGFQ

SEQ ID NO: 833775 - protein, 9 aa, Homo Sapiens
KRKHQHDFQ

SEQ ID NO: 833776 - protein, 9 aa, Homo Sapiens
SENTSSRAR

SEQ ID NO: 833777 - protein, 9 aa, Homo Sapiens
FCGNKYYRF

SEQ ID NO: 833778 - protein, 9 aa, Homo Sapiens
LFKTHDKDL

SEQ ID NO: 833779 - protein, 9 aa, Homo Sapiens
FCLYLVSRY

SEQ ID NO: 833780 - protein, 9 aa, Homo Sapiens
QHPEVVYTN

SEQ ID NO: 833781 - protein, 9 aa, Homo Sapiens
PFYLQYLTH

SEQ ID NO: 833782 - protein, 9 aa, Homo Sapiens
SHKTGDHVQ

SEQ ID NO: 833783 - protein, 9 aa, Homo Sapiens
ETLHNLQAR

SEQ ID NO: 833784 - protein, 9 aa, Homo Sapiens
KNKGKNNGK

SEQ ID NO: 833785 - protein, 9 aa, Homo Sapiens
LSIVIIILM

SEQ ID NO: 833786 - protein, 9 aa, Homo Sapiens
DYDVFQYLA

SEQ ID NO: 833787 - protein, 9 aa, Homo Sapiens
DARKIILCP

SEQ ID NO: 833788 - protein, 9 aa, Homo Sapiens
CGNIRITGI

SEQ ID NO: 833789 - protein, 9 aa, Homo Sapiens
NRIQSFKLP

SEQ ID NO: 833790 - protein, 9 aa, Homo Sapiens
NEGKLKREK

SEQ ID NO: 833791 - protein, 9 aa, Homo Sapiens
FCVEDNGNH

SEQ ID NO: 833792 - protein, 9 aa, Homo Sapiens
TIYECLTVH

SEQ ID NO: 833793 - protein, 9 aa, Homo Sapiens
MPNTLVVLD

SEQ ID NO: 833794 - protein, 9 aa, Homo Sapiens
ILSTYLEMG

SEQ ID NO: 833795 - protein, 9 aa, Homo Sapiens
GLALDGQLK

SEQ ID NO: 833796 - protein, 9 aa, Homo Sapiens
DNQFGLDEA

SEQ ID NO: 833797 - protein, 9 aa, Homo Sapiens
WGRYGEYIC

SEQ ID NO: 833798 - protein, 9 aa, Homo Sapiens
ESFSSLFKN

SEQ ID NO: 833799 - protein, 9 aa, Homo Sapiens
SGSLCAGCK

SEQ ID NO: 833800 - protein, 9 aa, Homo Sapiens
QISDAIYRP

SEQ ID NO: 833801 - protein, 9 aa, Homo Sapiens
DNFDKSMDP

SEQ ID NO: 833802 - protein, 9 aa, Homo Sapiens
TTTTAGVLL

SEQ ID NO: 833803 - protein, 9 aa, Homo Sapiens
HYKDPSLCM

SEQ ID NO: 833804 - protein, 9 aa, Homo Sapiens
ELLFTLLSE

SEQ ID NO: 833805 - protein, 9 aa, Homo Sapiens
VPRAAPATR

SEQ ID NO: 833806 - protein, 9 aa, Homo Sapiens
NNPINAVTT

SEQ ID NO: 833807 - protein, 9 aa, Homo Sapiens
GEEFALVED

SEQ ID NO: 833808 - protein, 9 aa, Homo Sapiens
YAAKIINTN

SEQ ID NO: 833809 - protein, 9 aa, Homo Sapiens
LITRQIYGK

SEQ ID NO: 833810 - protein, 9 aa, Homo Sapiens
FLPRPVDLS

SEQ ID NO: 833811 - protein, 9 aa, Homo Sapiens
LLTNTGAPH

SEQ ID NO: 833812 - protein, 9 aa, Homo Sapiens
TSRQISGGF

SEQ ID NO: 833813 - protein, 9 aa, Homo Sapiens
LYKSADHQT

SEQ ID NO: 833814 - protein, 9 aa, Homo Sapiens
EYKIADRGH

SEQ ID NO: 833815 - protein, 9 aa, Homo Sapiens
LEDALSLIH

SEQ ID NO: 833816 - protein, 9 aa, Homo Sapiens
EYHYPDSDK

SEQ ID NO: 833817 - protein, 9 aa, Homo Sapiens
LAILDNTVV

SEQ ID NO: 833818 - protein, 9 aa, Homo Sapiens
SPERNHSTF

SEQ ID NO: 833819 - protein, 9 aa, Homo Sapiens
RYKMVIAAC

SEQ ID NO: 833820 - protein, 9 aa, Homo Sapiens
KTFIDKNFW

SEQ ID NO: 833821 - protein, 9 aa, Homo Sapiens
EGTTYSPKM

SEQ ID NO: 833822 - protein, 9 aa, Homo Sapiens
SSNSDVSVK

SEQ ID NO: 833823 - protein, 9 aa, Homo Sapiens
EMVQHYMEV

SEQ ID NO: 833824 - protein, 9 aa, Homo Sapiens
SSNRSNHYS

SEQ ID NO: 833825 - protein, 9 aa, Homo Sapiens
KHPDICKDK

SEQ ID NO: 833826 - protein, 9 aa, Homo Sapiens
TTVKGVTFY

SEQ ID NO: 833827 - protein, 9 aa, Homo Sapiens
YVVLRGVEE

SEQ ID NO: 833828 - protein, 9 aa, Homo Sapiens
KNIPITPVR

SEQ ID NO: 833829 - protein, 9 aa, Homo Sapiens
QIVTSALRM

SEQ ID NO: 833830 - protein, 9 aa, Homo Sapiens
QPKKRVETL

SEQ ID NO: 833831 - protein, 9 aa, Homo Sapiens
ICDIIVVVI

SEQ ID NO: 833832 - protein, 9 aa, Homo Sapiens
ISATRGLNP

SEQ ID NO: 833833 - protein, 9 aa, Homo Sapiens
WTVFRSSQE

SEQ ID NO: 833834 - protein, 9 aa, Homo Sapiens
ITSEDMADK

SEQ ID NO: 833835 - protein, 9 aa, Homo Sapiens
ATQICASYF

SEQ ID NO: 833836 - protein, 9 aa, Homo Sapiens
LPSCRKSFH

SEQ ID NO: 833837 - protein, 9 aa, Homo Sapiens
PLTLLILVR

SEQ ID NO: 833838 - protein, 9 aa, Homo Sapiens
VLRKIEQPF

SEQ ID NO: 833839 - protein, 9 aa, Homo Sapiens
GAVQIGIID

SEQ ID NO: 833840 - protein, 9 aa, Homo Sapiens
WSDNLREVN

SEQ ID NO: 833841 - protein, 9 aa, Homo Sapiens
PISFSKFAS

SEQ ID NO: 833842 - protein, 9 aa, Homo Sapiens
NAPEELSSP

SEQ ID NO: 833843 - protein, 9 aa, Homo Sapiens
YRCKKCEKA

SEQ ID NO: 833844 - protein, 9 aa, Homo Sapiens
LGLKNIFYI

SEQ ID NO: 833845 - protein, 9 aa, Homo Sapiens
QDAQPNPGL

SEQ ID NO: 833846 - protein, 9 aa, Homo Sapiens
LKLSTSALK

SEQ ID NO: 833847 - protein, 9 aa, Homo Sapiens
YKVYKDVLY

SEQ ID NO: 833848 - protein, 9 aa, Homo Sapiens
EKHRKKRSS

SEQ ID NO: 833849 - protein, 9 aa, Homo Sapiens
LILAVLTTL

SEQ ID NO: 833850 - protein, 9 aa, Homo Sapiens
SDVVEKLYI

SEQ ID NO: 833851 - protein, 9 aa, Homo Sapiens
TLNIGDYNM

SEQ ID NO: 833852 - protein, 9 aa, Homo Sapiens
CCSLCVEHI

SEQ ID NO: 833853 - protein, 9 aa, Homo Sapiens
HSVHPASLN

SEQ ID NO: 833854 - protein, 9 aa, Homo Sapiens
GGSAGGSIL

SEQ ID NO: 833855 - protein, 9 aa, Homo Sapiens
GWNKFYAVL

SEQ ID NO: 833856 - protein, 9 aa, Homo Sapiens
SDAETYGED

SEQ ID NO: 833857 - protein, 9 aa, Homo Sapiens
NYTDPINGL

SEQ ID NO: 833858 - protein, 9 aa, Homo Sapiens
SYGQQRYTQ

SEQ ID NO: 833859 - protein, 9 aa, Homo Sapiens
TPEENKEYA

SEQ ID NO: 833860 - protein, 9 aa, Homo Sapiens
DQFQTQKVQ

SEQ ID NO: 833861 - protein, 9 aa, Homo Sapiens
NFARQDLTQ

SEQ ID NO: 833862 - protein, 9 aa, Homo Sapiens
FTDLNNGSL

SEQ ID NO: 833863 - protein, 9 aa, Homo Sapiens
SVPLETVSC

SEQ ID NO: 833864 - protein, 9 aa, Homo Sapiens
HQPGTLGEI

SEQ ID NO: 833865 - protein, 9 aa, Homo Sapiens
RKETNRKLY

SEQ ID NO: 833866 - protein, 9 aa, Homo Sapiens
QCNRENNRT

SEQ ID NO: 833867 - protein, 9 aa, Homo Sapiens
KDPSGLDKN

SEQ ID NO: 833868 - protein, 9 aa, Homo Sapiens
DPNSAAWAV

SEQ ID NO: 833869 - protein, 9 aa, Homo Sapiens
EALYSVPHN

SEQ ID NO: 833870 - protein, 9 aa, Homo Sapiens
FGHKYSSGQ

SEQ ID NO: 833871 - protein, 9 aa, Homo Sapiens
QRKKICEQE

SEQ ID NO: 833872 - protein, 9 aa, Homo Sapiens
LRVSSQAES

SEQ ID NO: 833873 - protein, 9 aa, Homo Sapiens
CNPREGKQT

SEQ ID NO: 833874 - protein, 9 aa, Homo Sapiens
AVPFEMVVE

SEQ ID NO: 833875 - protein, 9 aa, Homo Sapiens
KIMKKLDQQ

SEQ ID NO: 833876 - protein, 9 aa, Homo Sapiens
VPGQEYHVR

SEQ ID NO: 833877 - protein, 9 aa, Homo Sapiens
TNLNESHYL

SEQ ID NO: 833878 - protein, 9 aa, Homo Sapiens
WQFFQGGPI

SEQ ID NO: 833879 - protein, 9 aa, Homo Sapiens
DWITIKEGS

SEQ ID NO: 833880 - protein, 9 aa, Homo Sapiens
LEHQLHREI

SEQ ID NO: 833881 - protein, 9 aa, Homo Sapiens
TYNNFFYLI

SEQ ID NO: 833882 - protein, 9 aa, Homo Sapiens
GVCIRCDAG

SEQ ID NO: 833883 - protein, 9 aa, Homo Sapiens
VWYLQSTQA

SEQ ID NO: 833884 - protein, 9 aa, Homo Sapiens
RYLVHSNKK

SEQ ID NO: 833885 - protein, 9 aa, Homo Sapiens
LHSVVRLPP

SEQ ID NO: 833886 - protein, 9 aa, Homo Sapiens
VKITSPEEL

SEQ ID NO: 833887 - protein, 9 aa, Homo Sapiens
GMWICQICQ

SEQ ID NO: 833888 - protein, 9 aa, Homo Sapiens
PNIQQALVN

SEQ ID NO: 833889 - protein, 9 aa, Homo Sapiens
PNSTNLPIN

SEQ ID NO: 833890 - protein, 9 aa, Homo Sapiens
RNNVTGFIL

SEQ ID NO: 833891 - protein, 9 aa, Homo Sapiens
CMLKWLYGL

SEQ ID NO: 833892 - protein, 9 aa, Homo Sapiens
LSRLLKEAM

SEQ ID NO: 833893 - protein, 9 aa, Homo Sapiens
QAQSLRERG

SEQ ID NO: 833894 - protein, 9 aa, Homo Sapiens
FIEPAPAPG

SEQ ID NO: 833895 - protein, 9 aa, Homo Sapiens
QGQSSHYIK

SEQ ID NO: 833896 - protein, 9 aa, Homo Sapiens
PIFSSQALT

SEQ ID NO: 833897 - protein, 9 aa, Homo Sapiens
VFTGELERG

SEQ ID NO: 833898 - protein, 9 aa, Homo Sapiens
GNIKTDTTG

SEQ ID NO: 833899 - protein, 9 aa, Homo Sapiens
VDKLADELH

SEQ ID NO: 833900 - protein, 9 aa, Homo Sapiens
FGAVFRRPH

SEQ ID NO: 833901 - protein, 9 aa, Homo Sapiens
TSQLEKMAV

SEQ ID NO: 833902 - protein, 9 aa, Homo Sapiens
PEPQTEDGI

SEQ ID NO: 833903 - protein, 9 aa, Homo Sapiens
KILEIKNNE

SEQ ID NO: 833904 - protein, 9 aa, Homo Sapiens
WMPSPVSPK

SEQ ID NO: 833905 - protein, 9 aa, Homo Sapiens
ADRIRHKEA

SEQ ID NO: 833906 - protein, 9 aa, Homo Sapiens
NDSVCGLEH

SEQ ID NO: 833907 - protein, 9 aa, Homo Sapiens
NAIFSVACA

SEQ ID NO: 833908 - protein, 9 aa, Homo Sapiens
FPPGQITNL

SEQ ID NO: 833909 - protein, 9 aa, Homo Sapiens
REDNITTPK

SEQ ID NO: 833910 - protein, 9 aa, Homo Sapiens
RMMTWLANK

SEQ ID NO: 833911 - protein, 9 aa, Homo Sapiens
MAIRNPQEW

SEQ ID NO: 833912 - protein, 9 aa, Homo Sapiens
RHILLPKNV

SEQ ID NO: 833913 - protein, 9 aa, Homo Sapiens
GKDYFGNDY

SEQ ID NO: 833914 - protein, 9 aa, Homo Sapiens
AMPKHLNSP

SEQ ID NO: 833915 - protein, 9 aa, Homo Sapiens
PFLIFDHLY

SEQ ID NO: 833916 - protein, 9 aa, Homo Sapiens
FQLWLKKKH

SEQ ID NO: 833917 - protein, 9 aa, Homo Sapiens
RTEVVAGAF

SEQ ID NO: 833918 - protein, 9 aa, Homo Sapiens
TTVLECAPK

SEQ ID NO: 833919 - protein, 9 aa, Homo Sapiens
VGSPNKKHV

SEQ ID NO: 833920 - protein, 9 aa, Homo Sapiens
SQSSISFQT

SEQ ID NO: 833921 - protein, 9 aa, Homo Sapiens
GAAASSFVA

SEQ ID NO: 833922 - protein, 9 aa, Homo Sapiens
FQQIQTVMK

SEQ ID NO: 833923 - protein, 9 aa, Homo Sapiens
HHLIEGVKI

SEQ ID NO: 833924 - protein, 9 aa, Homo Sapiens
EVRWDLHVS

SEQ ID NO: 833925 - protein, 9 aa, Homo Sapiens
DWPPQIQGI

SEQ ID NO: 833926 - protein, 9 aa, Homo Sapiens
GLQDKQGVI

SEQ ID NO: 833927 - protein, 9 aa, Homo Sapiens
EGLGHSAKL

SEQ ID NO: 833928 - protein, 9 aa, Homo Sapiens
KATFWKEHK

SEQ ID NO: 833929 - protein, 9 aa, Homo Sapiens
CWAKGLGAD

SEQ ID NO: 833930 - protein, 9 aa, Homo Sapiens
TIPSDNAVN

SEQ ID NO: 833931 - protein, 9 aa, Homo Sapiens
SSAQCLPPT

SEQ ID NO: 833932 - protein, 9 aa, Homo Sapiens
LQQGKIVLT

SEQ ID NO: 833933 - protein, 9 aa, Homo Sapiens
EEEKVVQPA

SEQ ID NO: 833934 - protein, 9 aa, Homo Sapiens
EVFASISSQ

SEQ ID NO: 833935 - protein, 9 aa, Homo Sapiens
IHTQERRYK

SEQ ID NO: 833936 - protein, 9 aa, Homo Sapiens
IKYIPHNSA

SEQ ID NO: 833937 - protein, 9 aa, Homo Sapiens
VLECAPKSP

SEQ ID NO: 833938 - protein, 9 aa, Homo Sapiens
SSSSARALG

SEQ ID NO: 833939 - protein, 9 aa, Homo Sapiens
WIRKEINQY

SEQ ID NO: 833940 - protein, 9 aa, Homo Sapiens
PLREPFANK

SEQ ID NO: 833941 - protein, 9 aa, Homo Sapiens
TDARRPSNN

SEQ ID NO: 833942 - protein, 9 aa, Homo Sapiens
GNTFECDCK

SEQ ID NO: 833943 - protein, 9 aa, Homo Sapiens
GDQSEDFGV

SEQ ID NO: 833944 - protein, 9 aa, Homo Sapiens
NKYEPSGIN

SEQ ID NO: 833945 - protein, 9 aa, Homo Sapiens
LCLWEQFSD

SEQ ID NO: 833946 - protein, 9 aa, Homo Sapiens
HFKFLGSSD

SEQ ID NO: 833947 - protein, 9 aa, Homo Sapiens
RRQNAGKDR

SEQ ID NO: 833948 - protein, 9 aa, Homo Sapiens
PFMLFRLAA

SEQ ID NO: 833949 - protein, 9 aa, Homo Sapiens
VAEFSVSLL

SEQ ID NO: 833950 - protein, 9 aa, Homo Sapiens
PADVVSPKL

SEQ ID NO: 833951 - protein, 9 aa, Homo Sapiens
QDNARLDTL

SEQ ID NO: 833952 - protein, 9 aa, Homo Sapiens
KNNVFVFPG

SEQ ID NO: 833953 - protein, 9 aa, Homo Sapiens
YELCKQGKD

SEQ ID NO: 833954 - protein, 9 aa, Homo Sapiens
SQEEHTSKI

SEQ ID NO: 833955 - protein, 9 aa, Homo Sapiens
DDYHYDKFK

SEQ ID NO: 833956 - protein, 9 aa, Homo Sapiens
IIDGSQVWG

SEQ ID NO: 833957 - protein, 9 aa, Homo Sapiens
YAGVCEEMT

SEQ ID NO: 833958 - protein, 9 aa, Homo Sapiens
MNILKFMAK

SEQ ID NO: 833959 - protein, 9 aa, Homo Sapiens
AKFRQIVLA

SEQ ID NO: 833960 - protein, 9 aa, Homo Sapiens
QLEIISNGP

SEQ ID NO: 833961 - protein, 9 aa, Homo Sapiens
DLRFQEEYS

SEQ ID NO: 833962 - protein, 9 aa, Homo Sapiens
LEEYVRFNS

SEQ ID NO: 833963 - protein, 9 aa, Homo Sapiens
MVPQAADPA

SEQ ID NO: 833964 - protein, 9 aa, Homo Sapiens
LSVPLNTAG

SEQ ID NO: 833965 - protein, 9 aa, Homo Sapiens
LDFLVPKVG

SEQ ID NO: 833966 - protein, 9 aa, Homo Sapiens
QITPKQNGL

SEQ ID NO: 833967 - protein, 9 aa, Homo Sapiens
HAPMAGGDK

SEQ ID NO: 833968 - protein, 9 aa, Homo Sapiens
LLRNLGLYT

SEQ ID NO: 833969 - protein, 9 aa, Homo Sapiens
RFDLQNPSQ

SEQ ID NO: 833970 - protein, 9 aa, Homo Sapiens
FISGFNMGQ

SEQ ID NO: 833971 - protein, 9 aa, Homo Sapiens
AQQELDHIK

SEQ ID NO: 833972 - protein, 9 aa, Homo Sapiens
RCELWAGPC

SEQ ID NO: 833973 - protein, 9 aa, Homo Sapiens
LNNHFKFLG

SEQ ID NO: 833974 - protein, 9 aa, Homo Sapiens
LFLSFFFVR

SEQ ID NO: 833975 - protein, 9 aa, Homo Sapiens
CAELTAIQK

SEQ ID NO: 833976 - protein, 9 aa, Homo Sapiens
LPDSLTFNL

SEQ ID NO: 833977 - protein, 9 aa, Homo Sapiens
LAPSCTGFL

SEQ ID NO: 833978 - protein, 9 aa, Homo Sapiens
NVTPADEAD

SEQ ID NO: 833979 - protein, 9 aa, Homo Sapiens
KLREDCALF

SEQ ID NO: 833980 - protein, 9 aa, Homo Sapiens
KKDEDEEED

SEQ ID NO: 833981 - protein, 9 aa, Homo Sapiens
RKKIIEEQP

SEQ ID NO: 833982 - protein, 9 aa, Homo Sapiens
GSNPNRVCM

SEQ ID NO: 833983 - protein, 9 aa, Homo Sapiens
RSSLAAFQL

SEQ ID NO: 833984 - protein, 9 aa, Homo Sapiens
EGDDDDEDV

SEQ ID NO: 833985 - protein, 9 aa, Homo Sapiens
AESFHPGSA

SEQ ID NO: 833986 - protein, 9 aa, Homo Sapiens
PDAVSDKPL

SEQ ID NO: 833987 - protein, 9 aa, Homo Sapiens
VAQSLNSDV

SEQ ID NO: 833988 - protein, 9 aa, Homo Sapiens
IPGNTLGYF

SEQ ID NO: 833989 - protein, 9 aa, Homo Sapiens
KRIKALHAK

SEQ ID NO: 833990 - protein, 9 aa, Homo Sapiens
MPGGTLSLT

SEQ ID NO: 833991 - protein, 9 aa, Homo Sapiens
SCSARNCKK

SEQ ID NO: 833992 - protein, 9 aa, Homo Sapiens
IRKSGYFPM

SEQ ID NO: 833993 - protein, 9 aa, Homo Sapiens
QWLANKDNG

SEQ ID NO: 833994 - protein, 9 aa, Homo Sapiens
IMLGAICDI

SEQ ID NO: 833995 - protein, 9 aa, Homo Sapiens
TMPHINDCR

SEQ ID NO: 833996 - protein, 9 aa, Homo Sapiens
QVPFQDMHI

SEQ ID NO: 833997 - protein, 9 aa, Homo Sapiens
LDIFGNTFE

SEQ ID NO: 833998 - protein, 9 aa, Homo Sapiens
KQLIISCLL

SEQ ID NO: 833999 - protein, 9 aa, Homo Sapiens
GLDKTCHQC

SEQ ID NO: 834000 - protein, 9 aa, Homo Sapiens
IKGMVQVVR

SEQ ID NO: 834001 - protein, 9 aa, Homo Sapiens
LGVELFDEK

SEQ ID NO: 834002 - protein, 9 aa, Homo Sapiens
DFLSVKKII

SEQ ID NO: 834003 - protein, 9 aa, Homo Sapiens
YKAINSNGE

SEQ ID NO: 834004 - protein, 9 aa, Homo Sapiens
VWFMNYCWC

SEQ ID NO: 834005 - protein, 9 aa, Homo Sapiens
DLSNDAEYE

SEQ ID NO: 834006 - protein, 9 aa, Homo Sapiens
WQDQEHLVL

SEQ ID NO: 834007 - protein, 9 aa, Homo Sapiens
LFGSLSNAY

SEQ ID NO: 834008 - protein, 9 aa, Homo Sapiens
LRPKYNGLL

SEQ ID NO: 834009 - protein, 9 aa, Homo Sapiens
VPEGNLTLR

SEQ ID NO: 834010 - protein, 9 aa, Homo Sapiens
EKHNHQSEF

SEQ ID NO: 834011 - protein, 9 aa, Homo Sapiens
GLTALHLAA

SEQ ID NO: 834012 - protein, 9 aa, Homo Sapiens
KLIISCLGR

SEQ ID NO: 834013 - protein, 9 aa, Homo Sapiens
VRTLIAVLW

SEQ ID NO: 834014 - protein, 9 aa, Homo Sapiens
SLALLANQR

SEQ ID NO: 834015 - protein, 9 aa, Homo Sapiens
KRSSRRVQI

SEQ ID NO: 834016 - protein, 9 aa, Homo Sapiens
NFNAYQRAQ

SEQ ID NO: 834017 - protein, 9 aa, Homo Sapiens
AGRYVCENC

SEQ ID NO: 834018 - protein, 9 aa, Homo Sapiens
RKLQESKLD

SEQ ID NO: 834019 - protein, 9 aa, Homo Sapiens
PTASTCINL

SEQ ID NO: 834020 - protein, 9 aa, Homo Sapiens
DKHFMQNVA

SEQ ID NO: 834021 - protein, 9 aa, Homo Sapiens
LQKTLEEME

SEQ ID NO: 834022 - protein, 9 aa, Homo Sapiens
LRAQMLIST

SEQ ID NO: 834023 - protein, 9 aa, Homo Sapiens
NFMEKRIEK

SEQ ID NO: 834024 - protein, 9 aa, Homo Sapiens
LDIRNKRLQ

SEQ ID NO: 834025 - protein, 9 aa, Homo Sapiens
NFKKIRNSL

SEQ ID NO: 834026 - protein, 9 aa, Homo Sapiens
YPNRTYIFT

SEQ ID NO: 834027 - protein, 9 aa, Homo Sapiens
RKVVVVCCK

SEQ ID NO: 834028 - protein, 9 aa, Homo Sapiens
VTFSQRVAN

SEQ ID NO: 834029 - protein, 9 aa, Homo Sapiens
WRWWGRLSI

SEQ ID NO: 834030 - protein, 9 aa, Homo Sapiens
SFADVVQKL

SEQ ID NO: 834031 - protein, 9 aa, Homo Sapiens
GPPPQETLQ

SEQ ID NO: 834032 - protein, 9 aa, Homo Sapiens
DFRGKTVIE

SEQ ID NO: 834033 - protein, 9 aa, Homo Sapiens
ETPRPTWKP

SEQ ID NO: 834034 - protein, 9 aa, Homo Sapiens
RSLIYYKSY

SEQ ID NO: 834035 - protein, 9 aa, Homo Sapiens
IPLAFLKPT

SEQ ID NO: 834036 - protein, 9 aa, Homo Sapiens
KDRESHQDN

SEQ ID NO: 834037 - protein, 9 aa, Homo Sapiens
HVDMLTLVF

SEQ ID NO: 834038 - protein, 9 aa, Homo Sapiens
ANQIINTIS

SEQ ID NO: 834039 - protein, 9 aa, Homo Sapiens
SQDDPLRAD

SEQ ID NO: 834040 - protein, 9 aa, Homo Sapiens
KLFWDLIYL

SEQ ID NO: 834041 - protein, 9 aa, Homo Sapiens
TSIKGTSQK

SEQ ID NO: 834042 - protein, 9 aa, Homo Sapiens
NATNQIISH

SEQ ID NO: 834043 - protein, 9 aa, Homo Sapiens
NSKVTFSAV

SEQ ID NO: 834044 - protein, 9 aa, Homo Sapiens
SSYDVDANQ

SEQ ID NO: 834045 - protein, 9 aa, Homo Sapiens
FRESDTNGD

SEQ ID NO: 834046 - protein, 9 aa, Homo Sapiens
RLVKGEITN

SEQ ID NO: 834047 - protein, 9 aa, Homo Sapiens
KILAHFYND

SEQ ID NO: 834048 - protein, 9 aa, Homo Sapiens
SQAWTPPTD

SEQ ID NO: 834049 - protein, 9 aa, Homo Sapiens
GDYMEIFME

SEQ ID NO: 834050 - protein, 9 aa, Homo Sapiens
KAKYTTSAV

SEQ ID NO: 834051 - protein, 9 aa, Homo Sapiens
INTQEGGIN

SEQ ID NO: 834052 - protein, 9 aa, Homo Sapiens
VQVYRNKYV

SEQ ID NO: 834053 - protein, 9 aa, Homo Sapiens
SLSYNDNCW

SEQ ID NO: 834054 - protein, 9 aa, Homo Sapiens
ERIHMRDKS

SEQ ID NO: 834055 - protein, 9 aa, Homo Sapiens
LLGNDTRTF

SEQ ID NO: 834056 - protein, 9 aa, Homo Sapiens
TAEIIDEFI

SEQ ID NO: 834057 - protein, 9 aa, Homo Sapiens
ISSLHYELL

SEQ ID NO: 834058 - protein, 9 aa, Homo Sapiens
SPQSGVVSA

SEQ ID NO: 834059 - protein, 9 aa, Homo Sapiens
RTLPLMQIF

SEQ ID NO: 834060 - protein, 9 aa, Homo Sapiens
FWRAMLAMF

SEQ ID NO: 834061 - protein, 9 aa, Homo Sapiens
LFLSWFAGL

SEQ ID NO: 834062 - protein, 9 aa, Homo Sapiens
SPGSITKET

SEQ ID NO: 834063 - protein, 9 aa, Homo Sapiens
IVRLKTSMK

SEQ ID NO: 834064 - protein, 9 aa, Homo Sapiens
CGNVAHTVI

SEQ ID NO: 834065 - protein, 9 aa, Homo Sapiens
MFVHGGDRD

SEQ ID NO: 834066 - protein, 9 aa, Homo Sapiens
HKVLLNIRC

SEQ ID NO: 834067 - protein, 9 aa, Homo Sapiens
CRKAMTKFE

SEQ ID NO: 834068 - protein, 9 aa, Homo Sapiens
TNTTLSSLK

SEQ ID NO: 834069 - protein, 9 aa, Homo Sapiens
LSADPLPNS

SEQ ID NO: 834070 - protein, 9 aa, Homo Sapiens
YECKECGVA

SEQ ID NO: 834071 - protein, 9 aa, Homo Sapiens
PVVSDEDSD

SEQ ID NO: 834072 - protein, 9 aa, Homo Sapiens
CFVLCVITV

SEQ ID NO: 834073 - protein, 9 aa, Homo Sapiens
DGHSLPPID

SEQ ID NO: 834074 - protein, 9 aa, Homo Sapiens
RLDHGTESK

SEQ ID NO: 834075 - protein, 9 aa, Homo Sapiens
AKSRTFIYL

SEQ ID NO: 834076 - protein, 9 aa, Homo Sapiens
SVTQNCRVT

SEQ ID NO: 834077 - protein, 9 aa, Homo Sapiens
LVAKCDEIY

SEQ ID NO: 834078 - protein, 9 aa, Homo Sapiens
YYFDMDKIV

SEQ ID NO: 834079 - protein, 9 aa, Homo Sapiens
SYLYQLLQG

SEQ ID NO: 834080 - protein, 9 aa, Homo Sapiens
DALHQVKQH

SEQ ID NO: 834081 - protein, 9 aa, Homo Sapiens
RSVLDNHHL

SEQ ID NO: 834082 - protein, 9 aa, Homo Sapiens
LLAFEDMLD

SEQ ID NO: 834083 - protein, 9 aa, Homo Sapiens
IQEWDEKIE

SEQ ID NO: 834084 - protein, 9 aa, Homo Sapiens
SQLTVHQII

SEQ ID NO: 834085 - protein, 9 aa, Homo Sapiens
DALRNTKQE

SEQ ID NO: 834086 - protein, 9 aa, Homo Sapiens
SGIQTPPVR

SEQ ID NO: 834087 - protein, 9 aa, Homo Sapiens
DQAHIYIQT

SEQ ID NO: 834088 - protein, 9 aa, Homo Sapiens
EQVKELLNE

SEQ ID NO: 834089 - protein, 9 aa, Homo Sapiens
KDYLGKVTV

SEQ ID NO: 834090 - protein, 9 aa, Homo Sapiens
FWTIWCGAR

SEQ ID NO: 834091 - protein, 9 aa, Homo Sapiens
HQITHKGEN

SEQ ID NO: 834092 - protein, 9 aa, Homo Sapiens
ELVTSTDFA

SEQ ID NO: 834093 - protein, 9 aa, Homo Sapiens
GHIHLPYWR

SEQ ID NO: 834094 - protein, 9 aa, Homo Sapiens
HDTLNATLN

SEQ ID NO: 834095 - protein, 9 aa, Homo Sapiens
VLRDQCNTN

SEQ ID NO: 834096 - protein, 9 aa, Homo Sapiens
SVRVEGDCF

SEQ ID NO: 834097 - protein, 9 aa, Homo Sapiens
FALRPAPMQ

SEQ ID NO: 834098 - protein, 9 aa, Homo Sapiens
NGLSGIKKP

SEQ ID NO: 834099 - protein, 9 aa, Homo Sapiens
KTKNILMCT

SEQ ID NO: 834100 - protein, 9 aa, Homo Sapiens
MASVSMPSE

SEQ ID NO: 834101 - protein, 9 aa, Homo Sapiens
RVKCGRDGR

SEQ ID NO: 834102 - protein, 9 aa, Homo Sapiens
HRAGLLTAV

SEQ ID NO: 834103 - protein, 9 aa, Homo Sapiens
SGFSSPRTR

SEQ ID NO: 834104 - protein, 9 aa, Homo Sapiens
DVLVQFKGM

SEQ ID NO: 834105 - protein, 9 aa, Homo Sapiens
TVHQRINTG

SEQ ID NO: 834106 - protein, 9 aa, Homo Sapiens
LGISPFHDH

SEQ ID NO: 834107 - protein, 9 aa, Homo Sapiens
AETALLIQA

SEQ ID NO: 834108 - protein, 9 aa, Homo Sapiens
VLLNIRCEH

SEQ ID NO: 834109 - protein, 9 aa, Homo Sapiens
IKTGQQTTT

SEQ ID NO: 834110 - protein, 9 aa, Homo Sapiens
SDEWERCQS

SEQ ID NO: 834111 - protein, 9 aa, Homo Sapiens
ALLSTGLDT

SEQ ID NO: 834112 - protein, 9 aa, Homo Sapiens
CGRCIPMQV

SEQ ID NO: 834113 - protein, 9 aa, Homo Sapiens
KHNIRNIEK

SEQ ID NO: 834114 - protein, 9 aa, Homo Sapiens
ILMGEGSYT

SEQ ID NO: 834115 - protein, 9 aa, Homo Sapiens
MLRQFSTEI

SEQ ID NO: 834116 - protein, 9 aa, Homo Sapiens
GEFNELFND

SEQ ID NO: 834117 - protein, 9 aa, Homo Sapiens
RGATLGEEE

SEQ ID NO: 834118 - protein, 9 aa, Homo Sapiens
VPPPVGMVA

SEQ ID NO: 834119 - protein, 9 aa, Homo Sapiens
AQGEMGLQR

SEQ ID NO: 834120 - protein, 9 aa, Homo Sapiens
QLLPGYEAP

SEQ ID NO: 834121 - protein, 9 aa, Homo Sapiens
NKEILRVIG

SEQ ID NO: 834122 - protein, 9 aa, Homo Sapiens
DWRDFFWST

SEQ ID NO: 834123 - protein, 9 aa, Homo Sapiens
ILPYKELFG

SEQ ID NO: 834124 - protein, 9 aa, Homo Sapiens
LQHGSLLFS

SEQ ID NO: 834125 - protein, 9 aa, Homo Sapiens
FWDLIYLGR

SEQ ID NO: 834126 - protein, 9 aa, Homo Sapiens
VRVDITLKG

SEQ ID NO: 834127 - protein, 9 aa, Homo Sapiens
QRLGKTQKA

SEQ ID NO: 834128 - protein, 9 aa, Homo Sapiens
EKLFKCNEC

SEQ ID NO: 834129 - protein, 9 aa, Homo Sapiens
VLSQCVTHC

SEQ ID NO: 834130 - protein, 9 aa, Homo Sapiens
VHEIIHSGE

SEQ ID NO: 834131 - protein, 9 aa, Homo Sapiens
RRHTYFYAP

SEQ ID NO: 834132 - protein, 9 aa, Homo Sapiens
AEPQNLPLS

SEQ ID NO: 834133 - protein, 9 aa, Homo Sapiens
AAVGMLYGS

SEQ ID NO: 834134 - protein, 9 aa, Homo Sapiens
PENMSLFDE

SEQ ID NO: 834135 - protein, 9 aa, Homo Sapiens
LILHDALCL

SEQ ID NO: 834136 - protein, 9 aa, Homo Sapiens
QERCPERQS

SEQ ID NO: 834137 - protein, 9 aa, Homo Sapiens
AITGEIWLR

SEQ ID NO: 834138 - protein, 9 aa, Homo Sapiens
GRKTEDTHQ

SEQ ID NO: 834139 - protein, 9 aa, Homo Sapiens
TQHSLTWGL

SEQ ID NO: 834140 - protein, 9 aa, Homo Sapiens
KQVNKAIND

SEQ ID NO: 834141 - protein, 9 aa, Homo Sapiens
TGVDRGQPL

SEQ ID NO: 834142 - protein, 9 aa, Homo Sapiens
CSTFLTSYS

SEQ ID NO: 834143 - protein, 9 aa, Homo Sapiens
DFSDGDEEE

SEQ ID NO: 834144 - protein, 9 aa, Homo Sapiens
PQNLKKEKP

SEQ ID NO: 834145 - protein, 9 aa, Homo Sapiens
ERIYTRDNS

SEQ ID NO: 834146 - protein, 9 aa, Homo Sapiens
NTYFNIHPK

SEQ ID NO: 834147 - protein, 9 aa, Homo Sapiens
EITKEQLFF

SEQ ID NO: 834148 - protein, 9 aa, Homo Sapiens
YPKKNRRWH

SEQ ID NO: 834149 - protein, 9 aa, Homo Sapiens
QEKHNHQSE

SEQ ID NO: 834150 - protein, 9 aa, Homo Sapiens
DATQKIAKA

SEQ ID NO: 834151 - protein, 9 aa, Homo Sapiens
LENALYFDQ

SEQ ID NO: 834152 - protein, 9 aa, Homo Sapiens
NHFFGTVLV

SEQ ID NO: 834153 - protein, 9 aa, Homo Sapiens
DLLSCLLRH

SEQ ID NO: 834154 - protein, 9 aa, Homo Sapiens
DPSTDFDTI

SEQ ID NO: 834155 - protein, 9 aa, Homo Sapiens
YLKRVKKET

SEQ ID NO: 834156 - protein, 9 aa, Homo Sapiens
EIEEYVPSI

SEQ ID NO: 834157 - protein, 9 aa, Homo Sapiens
TTMPESDLG

SEQ ID NO: 834158 - protein, 9 aa, Homo Sapiens
GFMLYQTYM

SEQ ID NO: 834159 - protein, 9 aa, Homo Sapiens
YTYSSGNKK

SEQ ID NO: 834160 - protein, 9 aa, Homo Sapiens
EIGKIFGPF

SEQ ID NO: 834161 - protein, 9 aa, Homo Sapiens
YVCENCKPL

SEQ ID NO: 834162 - protein, 9 aa, Homo Sapiens
QRRHQSPDC

SEQ ID NO: 834163 - protein, 9 aa, Homo Sapiens
TYLFFKTRY

SEQ ID NO: 834164 - protein, 9 aa, Homo Sapiens
DPKSKLFEL

SEQ ID NO: 834165 - protein, 9 aa, Homo Sapiens
PVEEKINSE

SEQ ID NO: 834166 - protein, 9 aa, Homo Sapiens
LLSTGLDTM

SEQ ID NO: 834167 - protein, 9 aa, Homo Sapiens
LHCIRQNVA

SEQ ID NO: 834168 - protein, 9 aa, Homo Sapiens
ILPLCWTGD

SEQ ID NO: 834169 - protein, 9 aa, Homo Sapiens
GDPLIAEKP

SEQ ID NO: 834170 - protein, 9 aa, Homo Sapiens
GKTDSIEIL

SEQ ID NO: 834171 - protein, 9 aa, Homo Sapiens
GKFTQQDIN

SEQ ID NO: 834172 - protein, 9 aa, Homo Sapiens
THSVVCMTN

SEQ ID NO: 834173 - protein, 9 aa, Homo Sapiens
IPIPITLNI

SEQ ID NO: 834174 - protein, 9 aa, Homo Sapiens
AHTVIRSLN

SEQ ID NO: 834175 - protein, 9 aa, Homo Sapiens
HEIIHTGEE

SEQ ID NO: 834176 - protein, 9 aa, Homo Sapiens
ITHTGEKTY

SEQ ID NO: 834177 - protein, 9 aa, Homo Sapiens
NVRELFFRV

SEQ ID NO: 834178 - protein, 9 aa, Homo Sapiens
VFIHFQRKK

SEQ ID NO: 834179 - protein, 9 aa, Homo Sapiens
IVLAVHYCH

SEQ ID NO: 834180 - protein, 9 aa, Homo Sapiens
DTDDEGAPQ

SEQ ID NO: 834181 - protein, 9 aa, Homo Sapiens
SFAALPCGC

SEQ ID NO: 834182 - protein, 9 aa, Homo Sapiens
VTTGPLFTF

SEQ ID NO: 834183 - protein, 9 aa, Homo Sapiens
LISTVEGGQ

SEQ ID NO: 834184 - protein, 9 aa, Homo Sapiens
QIINSIYNA

SEQ ID NO: 834185 - protein, 9 aa, Homo Sapiens
THVWYRTCM

SEQ ID NO: 834186 - protein, 9 aa, Homo Sapiens
INKESLINC

SEQ ID NO: 834187 - protein, 9 aa, Homo Sapiens
CSSLPRVIC

SEQ ID NO: 834188 - protein, 9 aa, Homo Sapiens
RQQREADAA

SEQ ID NO: 834189 - protein, 9 aa, Homo Sapiens
TSVRKTLFL

SEQ ID NO: 834190 - protein, 9 aa, Homo Sapiens
YNYPELQGQ

SEQ ID NO: 834191 - protein, 9 aa, Homo Sapiens
INVKEILTS

SEQ ID NO: 834192 - protein, 9 aa, Homo Sapiens
PSSLSLTVL

SEQ ID NO: 834193 - protein, 9 aa, Homo Sapiens
WLLSPGTLD

SEQ ID NO: 834194 - protein, 9 aa, Homo Sapiens
KEVAENQQS

SEQ ID NO: 834195 - protein, 9 aa, Homo Sapiens
WIGRLLKEG

SEQ ID NO: 834196 - protein, 9 aa, Homo Sapiens
KRKFPGVAA

SEQ ID NO: 834197 - protein, 9 aa, Homo Sapiens
DLLDALHLQ

SEQ ID NO: 834198 - protein, 9 aa, Homo Sapiens
LYFKIFDSL

SEQ ID NO: 834199 - protein, 9 aa, Homo Sapiens
RYTSLLCKA

SEQ ID NO: 834200 - protein, 9 aa, Homo Sapiens
NQTKLECES

SEQ ID NO: 834201 - protein, 9 aa, Homo Sapiens
IPENLEYKL

SEQ ID NO: 834202 - protein, 9 aa, Homo Sapiens
VTTECPHKG

SEQ ID NO: 834203 - protein, 9 aa, Homo Sapiens
SFYRFSRDD

SEQ ID NO: 834204 - protein, 9 aa, Homo Sapiens
NSSSSPIIN

SEQ ID NO: 834205 - protein, 9 aa, Homo Sapiens
IRQLIKKSP

SEQ ID NO: 834206 - protein, 9 aa, Homo Sapiens
DDVTETVNL

SEQ ID NO: 834207 - protein, 9 aa, Homo Sapiens
ENYQDAMEY

SEQ ID NO: 834208 - protein, 9 aa, Homo Sapiens
LKIIPLPGR

SEQ ID NO: 834209 - protein, 9 aa, Homo Sapiens
CLTKCADDS

SEQ ID NO: 834210 - protein, 9 aa, Homo Sapiens
GWVYGSNRL

SEQ ID NO: 834211 - protein, 9 aa, Homo Sapiens
TIKSERIKN

SEQ ID NO: 834212 - protein, 9 aa, Homo Sapiens
DGSQIPYIE

SEQ ID NO: 834213 - protein, 9 aa, Homo Sapiens
KCNVQFNIL

SEQ ID NO: 834214 - protein, 9 aa, Homo Sapiens
MFSEYISYF

SEQ ID NO: 834215 - protein, 9 aa, Homo Sapiens
IWDNKDYGS

SEQ ID NO: 834216 - protein, 9 aa, Homo Sapiens
EIHFSQWEM

SEQ ID NO: 834217 - protein, 9 aa, Homo Sapiens
QMLFHSPTE

SEQ ID NO: 834218 - protein, 9 aa, Homo Sapiens
LGEEARGTP

SEQ ID NO: 834219 - protein, 9 aa, Homo Sapiens
LSEGWKETD

SEQ ID NO: 834220 - protein, 9 aa, Homo Sapiens
ASFLNNSVL

SEQ ID NO: 834221 - protein, 9 aa, Homo Sapiens
IWNYKAPAP

SEQ ID NO: 834222 - protein, 9 aa, Homo Sapiens
LKKGNCSGC

SEQ ID NO: 834223 - protein, 9 aa, Homo Sapiens
DISTNTEQL

SEQ ID NO: 834224 - protein, 9 aa, Homo Sapiens
SQKPQICDH

SEQ ID NO: 834225 - protein, 9 aa, Homo Sapiens
LVDGIYRLS

SEQ ID NO: 834226 - protein, 9 aa, Homo Sapiens
STLPKLEEV

SEQ ID NO: 834227 - protein, 9 aa, Homo Sapiens
HLGADLKSI

SEQ ID NO: 834228 - protein, 9 aa, Homo Sapiens
SFSTNLHKI

SEQ ID NO: 834229 - protein, 9 aa, Homo Sapiens
EEVKKLITA

SEQ ID NO: 834230 - protein, 9 aa, Homo Sapiens
KLSDGGTET

SEQ ID NO: 834231 - protein, 9 aa, Homo Sapiens
INNQVFLSL

SEQ ID NO: 834232 - protein, 9 aa, Homo Sapiens
KLVKDNKCP

SEQ ID NO: 834233 - protein, 9 aa, Homo Sapiens
SVDDEIEET

SEQ ID NO: 834234 - protein, 9 aa, Homo Sapiens
PNQTGSEGL

SEQ ID NO: 834235 - protein, 9 aa, Homo Sapiens
KPTLLNLKD

SEQ ID NO: 834236 - protein, 9 aa, Homo Sapiens
TKGKALESL

SEQ ID NO: 834237 - protein, 9 aa, Homo Sapiens
KEVAHRITA

SEQ ID NO: 834238 - protein, 9 aa, Homo Sapiens
GLFDGLLTL

SEQ ID NO: 834239 - protein, 9 aa, Homo Sapiens
NLKNLKQAC

SEQ ID NO: 834240 - protein, 9 aa, Homo Sapiens
VLVGIQYFY

SEQ ID NO: 834241 - protein, 9 aa, Homo Sapiens
EEKLLDIRN

SEQ ID NO: 834242 - protein, 9 aa, Homo Sapiens
VPEGFAVGV

SEQ ID NO: 834243 - protein, 9 aa, Homo Sapiens
NEKTLDKLD

SEQ ID NO: 834244 - protein, 9 aa, Homo Sapiens
PVTSHQCHH

SEQ ID NO: 834245 - protein, 9 aa, Homo Sapiens
NGRRINTLQ

SEQ ID NO: 834246 - protein, 9 aa, Homo Sapiens
LPQNVHVLK

SEQ ID NO: 834247 - protein, 9 aa, Homo Sapiens
TQNDFGHPT

SEQ ID NO: 834248 - protein, 9 aa, Homo Sapiens
KYLDYEDAT

SEQ ID NO: 834249 - protein, 9 aa, Homo Sapiens
FGSEGKNCE

SEQ ID NO: 834250 - protein, 9 aa, Homo Sapiens
ESVKILCDW

SEQ ID NO: 834251 - protein, 9 aa, Homo Sapiens
CVHVCLCMC

SEQ ID NO: 834252 - protein, 9 aa, Homo Sapiens
LLHNLRTLW

SEQ ID NO: 834253 - protein, 9 aa, Homo Sapiens
MAQDLGEKH

SEQ ID NO: 834254 - protein, 9 aa, Homo Sapiens
LQRKSITCQ

SEQ ID NO: 834255 - protein, 9 aa, Homo Sapiens
EPICVVWGR

SEQ ID NO: 834256 - protein, 9 aa, Homo Sapiens
TPEALICSF

SEQ ID NO: 834257 - protein, 9 aa, Homo Sapiens
HMKYIHLPD

SEQ ID NO: 834258 - protein, 9 aa, Homo Sapiens
LNTSFEEWG

SEQ ID NO: 834259 - protein, 9 aa, Homo Sapiens
NKTITEFVL

SEQ ID NO: 834260 - protein, 9 aa, Homo Sapiens
FDLCIVDEA

SEQ ID NO: 834261 - protein, 9 aa, Homo Sapiens
SLFERYGSP

SEQ ID NO: 834262 - protein, 9 aa, Homo Sapiens
VARKLDIYC

SEQ ID NO: 834263 - protein, 9 aa, Homo Sapiens
GQQQEEEGL

SEQ ID NO: 834264 - protein, 9 aa, Homo Sapiens
GYTCEDNSL

SEQ ID NO: 834265 - protein, 9 aa, Homo Sapiens
NGSYLSVLE

SEQ ID NO: 834266 - protein, 9 aa, Homo Sapiens
LMLKNCNSF

SEQ ID NO: 834267 - protein, 9 aa, Homo Sapiens
AIEMQKYVP

SEQ ID NO: 834268 - protein, 9 aa, Homo Sapiens
DNGTGVVSQ

SEQ ID NO: 834269 - protein, 9 aa, Homo Sapiens
TQEDMEVLK

SEQ ID NO: 834270 - protein, 9 aa, Homo Sapiens
VFEQLEDKL

SEQ ID NO: 834271 - protein, 9 aa, Homo Sapiens
YPAAAASET

SEQ ID NO: 834272 - protein, 9 aa, Homo Sapiens
LFITAAWSI

SEQ ID NO: 834273 - protein, 9 aa, Homo Sapiens
LSNWGNLWW

SEQ ID NO: 834274 - protein, 9 aa, Homo Sapiens
DSFIQEMPN

SEQ ID NO: 834275 - protein, 9 aa, Homo Sapiens
YFIKTTMPE

SEQ ID NO: 834276 - protein, 9 aa, Homo Sapiens
QREALSNGQ

SEQ ID NO: 834277 - protein, 9 aa, Homo Sapiens
TCICSGAFA

SEQ ID NO: 834278 - protein, 9 aa, Homo Sapiens
FIILLLVYR

SEQ ID NO: 834279 - protein, 9 aa, Homo Sapiens
EEQLHPKLL

SEQ ID NO: 834280 - protein, 9 aa, Homo Sapiens
FTHKEELEG

SEQ ID NO: 834281 - protein, 9 aa, Homo Sapiens
YNVDKKQGI

SEQ ID NO: 834282 - protein, 9 aa, Homo Sapiens
HPNVQKYLE

SEQ ID NO: 834283 - protein, 9 aa, Homo Sapiens
RSGKWLNTW

SEQ ID NO: 834284 - protein, 9 aa, Homo Sapiens
DAASRRRNA

SEQ ID NO: 834285 - protein, 9 aa, Homo Sapiens
PFSIYEGQE

SEQ ID NO: 834286 - protein, 9 aa, Homo Sapiens
TITLVFLVA

SEQ ID NO: 834287 - protein, 9 aa, Homo Sapiens
NVSSRMDNT

SEQ ID NO: 834288 - protein, 9 aa, Homo Sapiens
DFFIGKQTV

SEQ ID NO: 834289 - protein, 9 aa, Homo Sapiens
PNRTYIFTF

SEQ ID NO: 834290 - protein, 9 aa, Homo Sapiens
KHMKYIHLP

SEQ ID NO: 834291 - protein, 9 aa, Homo Sapiens
KPVINVRIG

SEQ ID NO: 834292 - protein, 9 aa, Homo Sapiens
MDRLPRDIT

SEQ ID NO: 834293 - protein, 9 aa, Homo Sapiens
EDGIVPLCY

SEQ ID NO: 834294 - protein, 9 aa, Homo Sapiens
DEELLLANT

SEQ ID NO: 834295 - protein, 9 aa, Homo Sapiens
GNLQTLKGL

SEQ ID NO: 834296 - protein, 9 aa, Homo Sapiens
IANCQRQFC

SEQ ID NO: 834297 - protein, 9 aa, Homo Sapiens
FDFVRLQNY

SEQ ID NO: 834298 - protein, 9 aa, Homo Sapiens
SRYFVIRIK

SEQ ID NO: 834299 - protein, 9 aa, Homo Sapiens
QKCKAVGKF

SEQ ID NO: 834300 - protein, 9 aa, Homo Sapiens
RLGILVFLS

SEQ ID NO: 834301 - protein, 9 aa, Homo Sapiens
IEQIKCDKY

SEQ ID NO: 834302 - protein, 9 aa, Homo Sapiens
GGQDKIQPL

SEQ ID NO: 834303 - protein, 9 aa, Homo Sapiens
LFGSGTSGM

SEQ ID NO: 834304 - protein, 9 aa, Homo Sapiens
ANTEQETLL

SEQ ID NO: 834305 - protein, 9 aa, Homo Sapiens
KESYFDAVF

SEQ ID NO: 834306 - protein, 9 aa, Homo Sapiens
CLKSWHRLK

SEQ ID NO: 834307 - protein, 9 aa, Homo Sapiens
QNYFSLELS

SEQ ID NO: 834308 - protein, 9 aa, Homo Sapiens
CRGNPSERL

SEQ ID NO: 834309 - protein, 9 aa, Homo Sapiens
QHNIKGEIH

SEQ ID NO: 834310 - protein, 9 aa, Homo Sapiens
DVLLGAKLY

SEQ ID NO: 834311 - protein, 9 aa, Homo Sapiens
KSSPEKNKV

SEQ ID NO: 834312 - protein, 9 aa, Homo Sapiens
PLADQIPLG

SEQ ID NO: 834313 - protein, 9 aa, Homo Sapiens
ISSSWGNPG

SEQ ID NO: 834314 - protein, 9 aa, Homo Sapiens
SITVSVYQY

SEQ ID NO: 834315 - protein, 9 aa, Homo Sapiens
IPDNAPIGT

SEQ ID NO: 834316 - protein, 9 aa, Homo Sapiens
GSYMLVDSS

SEQ ID NO: 834317 - protein, 9 aa, Homo Sapiens
HLWTGIRPS

SEQ ID NO: 834318 - protein, 9 aa, Homo Sapiens
RENNFDEFS

SEQ ID NO: 834319 - protein, 9 aa, Homo Sapiens
VFSFFPAGG

SEQ ID NO: 834320 - protein, 9 aa, Homo Sapiens
KTGIEEANE

SEQ ID NO: 834321 - protein, 9 aa, Homo Sapiens
HFVAHKYKK

SEQ ID NO: 834322 - protein, 9 aa, Homo Sapiens
VKEWIRKIS

SEQ ID NO: 834323 - protein, 9 aa, Homo Sapiens
CLRSSYCIE

SEQ ID NO: 834324 - protein, 9 aa, Homo Sapiens
VYVRKERRR

SEQ ID NO: 834325 - protein, 9 aa, Homo Sapiens
FAALPCGCL

SEQ ID NO: 834326 - protein, 9 aa, Homo Sapiens
FDGGPVISK

SEQ ID NO: 834327 - protein, 9 aa, Homo Sapiens
MTQLFFFCL

SEQ ID NO: 834328 - protein, 9 aa, Homo Sapiens
LPTHLPNAS

SEQ ID NO: 834329 - protein, 9 aa, Homo Sapiens
LLQTPVVRP

SEQ ID NO: 834330 - protein, 9 aa, Homo Sapiens
KMENKVSKR

SEQ ID NO: 834331 - protein, 9 aa, Homo Sapiens
QEICTMMTQ

SEQ ID NO: 834332 - protein, 9 aa, Homo Sapiens
PKSSIVYLY

SEQ ID NO: 834333 - protein, 9 aa, Homo Sapiens
HQLFHTGKT

SEQ ID NO: 834334 - protein, 9 aa, Homo Sapiens
GRYRIISGD

SEQ ID NO: 834335 - protein, 9 aa, Homo Sapiens
SFQIVCTFK

SEQ ID NO: 834336 - protein, 9 aa, Homo Sapiens
PCFPETTSK

SEQ ID NO: 834337 - protein, 9 aa, Homo Sapiens
KSLYQENIE

SEQ ID NO: 834338 - protein, 9 aa, Homo Sapiens
EGIVTTCSL

SEQ ID NO: 834339 - protein, 9 aa, Homo Sapiens
MMTWLANKL

SEQ ID NO: 834340 - protein, 9 aa, Homo Sapiens
GSLDDSFSA

SEQ ID NO: 834341 - protein, 9 aa, Homo Sapiens
LLNKELVPL

SEQ ID NO: 834342 - protein, 9 aa, Homo Sapiens
VQSNAFNGT

SEQ ID NO: 834343 - protein, 9 aa, Homo Sapiens
FMYLLFTTG

SEQ ID NO: 834344 - protein, 9 aa, Homo Sapiens
RGRNVCRVP

SEQ ID NO: 834345 - protein, 9 aa, Homo Sapiens
LFYHAHMAS

SEQ ID NO: 834346 - protein, 9 aa, Homo Sapiens
STSNHVVRN

SEQ ID NO: 834347 - protein, 9 aa, Homo Sapiens
EQDIKTLHG

SEQ ID NO: 834348 - protein, 9 aa, Homo Sapiens
GGEMVLLVL

SEQ ID NO: 834349 - protein, 9 aa, Homo Sapiens
TRDVRPNVL

SEQ ID NO: 834350 - protein, 9 aa, Homo Sapiens
QPLQSSRPS

SEQ ID NO: 834351 - protein, 9 aa, Homo Sapiens
CWDEYNGFW

SEQ ID NO: 834352 - protein, 9 aa, Homo Sapiens
ADCGEAFRT

SEQ ID NO: 834353 - protein, 9 aa, Homo Sapiens
KGKYDAVNY

SEQ ID NO: 834354 - protein, 9 aa, Homo Sapiens
RLKTVQGIG

SEQ ID NO: 834355 - protein, 9 aa, Homo Sapiens
AISAPFLLF

SEQ ID NO: 834356 - protein, 9 aa, Homo Sapiens
NSNDGPERA

SEQ ID NO: 834357 - protein, 9 aa, Homo Sapiens
AFIQHQIIH

SEQ ID NO: 834358 - protein, 9 aa, Homo Sapiens
LYSELSKWS

SEQ ID NO: 834359 - protein, 9 aa, Homo Sapiens
TISSLFPPG

SEQ ID NO: 834360 - protein, 9 aa, Homo Sapiens
WDAAIILST

SEQ ID NO: 834361 - protein, 9 aa, Homo Sapiens
HHSSGSILF

SEQ ID NO: 834362 - protein, 9 aa, Homo Sapiens
ASNVEDNCV

SEQ ID NO: 834363 - protein, 9 aa, Homo Sapiens
LTAMMAQNN

SEQ ID NO: 834364 - protein, 9 aa, Homo Sapiens
VSSSSTRDY

SEQ ID NO: 834365 - protein, 9 aa, Homo Sapiens
HVNVMMPPW

SEQ ID NO: 834366 - protein, 9 aa, Homo Sapiens
VHIGAKVMF

SEQ ID NO: 834367 - protein, 9 aa, Homo Sapiens
TFMAVTENE

SEQ ID NO: 834368 - protein, 9 aa, Homo Sapiens
LHQVDSDLL

SEQ ID NO: 834369 - protein, 9 aa, Homo Sapiens
HYRIENHIC

SEQ ID NO: 834370 - protein, 9 aa, Homo Sapiens
ADKIYNLCN

SEQ ID NO: 834371 - protein, 9 aa, Homo Sapiens
PNIFLKRII

SEQ ID NO: 834372 - protein, 9 aa, Homo Sapiens
YSENDSTPT

SEQ ID NO: 834373 - protein, 9 aa, Homo Sapiens
PKGQGKYSG

SEQ ID NO: 834374 - protein, 9 aa, Homo Sapiens
QEVIDFISG

SEQ ID NO: 834375 - protein, 9 aa, Homo Sapiens
PLTHFFKLK

SEQ ID NO: 834376 - protein, 9 aa, Homo Sapiens
QRVKSVLPI

SEQ ID NO: 834377 - protein, 9 aa, Homo Sapiens
IAFSLLSHE

SEQ ID NO: 834378 - protein, 9 aa, Homo Sapiens
TKFSDHVTF

SEQ ID NO: 834379 - protein, 9 aa, Homo Sapiens
IFSSQPHQV

SEQ ID NO: 834380 - protein, 9 aa, Homo Sapiens
CISYPSLHE

SEQ ID NO: 834381 - protein, 9 aa, Homo Sapiens
MAAYLDLLL

SEQ ID NO: 834382 - protein, 9 aa, Homo Sapiens
KKRQNGHVI

SEQ ID NO: 834383 - protein, 9 aa, Homo Sapiens
NKHPQLKIT

SEQ ID NO: 834384 - protein, 9 aa, Homo Sapiens
DNPLNSTQW

SEQ ID NO: 834385 - protein, 9 aa, Homo Sapiens
PHLETVYTL

SEQ ID NO: 834386 - protein, 9 aa, Homo Sapiens
WIYQQEWQR

SEQ ID NO: 834387 - protein, 9 aa, Homo Sapiens
QATAANYLL

SEQ ID NO: 834388 - protein, 9 aa, Homo Sapiens
APVVPAMAA

SEQ ID NO: 834389 - protein, 9 aa, Homo Sapiens
LRGNELFCE

SEQ ID NO: 834390 - protein, 9 aa, Homo Sapiens
NDGYDLVQE

SEQ ID NO: 834391 - protein, 9 aa, Homo Sapiens
QENIEAQVK

SEQ ID NO: 834392 - protein, 9 aa, Homo Sapiens
SVCHLFTSS

SEQ ID NO: 834393 - protein, 9 aa, Homo Sapiens
VLTAAVAQA

SEQ ID NO: 834394 - protein, 9 aa, Homo Sapiens
QQIEQDRGE

SEQ ID NO: 834395 - protein, 9 aa, Homo Sapiens
FELFDRTET

SEQ ID NO: 834396 - protein, 9 aa, Homo Sapiens
SSLGHTSIR

SEQ ID NO: 834397 - protein, 9 aa, Homo Sapiens
KPLMTPTAS

SEQ ID NO: 834398 - protein, 9 aa, Homo Sapiens
PAEGLKGVL

SEQ ID NO: 834399 - protein, 9 aa, Homo Sapiens
DKIMFGFRV

SEQ ID NO: 834400 - protein, 9 aa, Homo Sapiens
IGMKRWIIP

SEQ ID NO: 834401 - protein, 9 aa, Homo Sapiens
QGSYMLVDS

SEQ ID NO: 834402 - protein, 9 aa, Homo Sapiens
GEGKISKYL

SEQ ID NO: 834403 - protein, 9 aa, Homo Sapiens
IPTNLCVLR

SEQ ID NO: 834404 - protein, 9 aa, Homo Sapiens
LQESHLKDT

SEQ ID NO: 834405 - protein, 9 aa, Homo Sapiens
CIRRAGGKV

SEQ ID NO: 834406 - protein, 9 aa, Homo Sapiens
LDLSDQFSA

SEQ ID NO: 834407 - protein, 9 aa, Homo Sapiens
CFSACSDSW

SEQ ID NO: 834408 - protein, 9 aa, Homo Sapiens
QKHSSSLFK

SEQ ID NO: 834409 - protein, 9 aa, Homo Sapiens
PRWAEYQNS

SEQ ID NO: 834410 - protein, 9 aa, Homo Sapiens
PYKITSTID

SEQ ID NO: 834411 - protein, 9 aa, Homo Sapiens
GSGALAFED

SEQ ID NO: 834412 - protein, 9 aa, Homo Sapiens
LCNPKHSAI

SEQ ID NO: 834413 - protein, 9 aa, Homo Sapiens
EEEEVLNHV

SEQ ID NO: 834414 - protein, 9 aa, Homo Sapiens
HKNLEAIVS

SEQ ID NO: 834415 - protein, 9 aa, Homo Sapiens
SYPQTNVFA

SEQ ID NO: 834416 - protein, 9 aa, Homo Sapiens
LRKTNYVDN

SEQ ID NO: 834417 - protein, 9 aa, Homo Sapiens
SPQGKVVQI

SEQ ID NO: 834418 - protein, 9 aa, Homo Sapiens
YLAGQDAKD

SEQ ID NO: 834419 - protein, 9 aa, Homo Sapiens
DPVYPSLVQ

SEQ ID NO: 834420 - protein, 9 aa, Homo Sapiens
QAAAPTPTN

SEQ ID NO: 834421 - protein, 9 aa, Homo Sapiens
CLEDRHDFG

SEQ ID NO: 834422 - protein, 9 aa, Homo Sapiens
NIVPRHLFQ

SEQ ID NO: 834423 - protein, 9 aa, Homo Sapiens
LPKDLGTEH

SEQ ID NO: 834424 - protein, 9 aa, Homo Sapiens
STSLGTLYT

SEQ ID NO: 834425 - protein, 9 aa, Homo Sapiens
EYKILEGTE

SEQ ID NO: 834426 - protein, 9 aa, Homo Sapiens
AVDSLHTGP

SEQ ID NO: 834427 - protein, 9 aa, Homo Sapiens
NSDVSVKKP

SEQ ID NO: 834428 - protein, 9 aa, Homo Sapiens
WQMLQLLMN

SEQ ID NO: 834429 - protein, 9 aa, Homo Sapiens
GQGKYSGSW

SEQ ID NO: 834430 - protein, 9 aa, Homo Sapiens
NCDVQGALR

SEQ ID NO: 834431 - protein, 9 aa, Homo Sapiens
TELLVQMQG

SEQ ID NO: 834432 - protein, 9 aa, Homo Sapiens
AAMQGQTDC

SEQ ID NO: 834433 - protein, 9 aa, Homo Sapiens
SSLGRVPSL

SEQ ID NO: 834434 - protein, 9 aa, Homo Sapiens
SINPMYRVL

SEQ ID NO: 834435 - protein, 9 aa, Homo Sapiens
YAHAGDSKA

SEQ ID NO: 834436 - protein, 9 aa, Homo Sapiens
AQKQLTQMT

SEQ ID NO: 834437 - protein, 9 aa, Homo Sapiens
ASIWDLLLN

SEQ ID NO: 834438 - protein, 9 aa, Homo Sapiens
PGDPGLPDR

SEQ ID NO: 834439 - protein, 9 aa, Homo Sapiens
KDNGTGVVS

SEQ ID NO: 834440 - protein, 9 aa, Homo Sapiens
SDAPETTHK

SEQ ID NO: 834441 - protein, 9 aa, Homo Sapiens
IGTVPFHLW

SEQ ID NO: 834442 - protein, 9 aa, Homo Sapiens
RAKKECPFP

SEQ ID NO: 834443 - protein, 9 aa, Homo Sapiens
MEIVSTGNK

SEQ ID NO: 834444 - protein, 9 aa, Homo Sapiens
AESTELVPL

SEQ ID NO: 834445 - protein, 9 aa, Homo Sapiens
LDYFSEISN

SEQ ID NO: 834446 - protein, 9 aa, Homo Sapiens
LAFLKPTIA

SEQ ID NO: 834447 - protein, 9 aa, Homo Sapiens
RRITRVQRP

SEQ ID NO: 834448 - protein, 9 aa, Homo Sapiens
AANSKVTFS

SEQ ID NO: 834449 - protein, 9 aa, Homo Sapiens
IKVTVNTPK

SEQ ID NO: 834450 - protein, 9 aa, Homo Sapiens
NMKTADKVE

SEQ ID NO: 834451 - protein, 9 aa, Homo Sapiens
KGDKATVKD

SEQ ID NO: 834452 - protein, 9 aa, Homo Sapiens
SIWKAKFLP

SEQ ID NO: 834453 - protein, 9 aa, Homo Sapiens
SENSPGQLS

SEQ ID NO: 834454 - protein, 9 aa, Homo Sapiens
QVPRAAPAT

SEQ ID NO: 834455 - protein, 9 aa, Homo Sapiens
KYCFHKTRS

SEQ ID NO: 834456 - protein, 9 aa, Homo Sapiens
MDNLLRGDN

SEQ ID NO: 834457 - protein, 9 aa, Homo Sapiens
QICQPRKKG

SEQ ID NO: 834458 - protein, 9 aa, Homo Sapiens
NPHRVDLDM

SEQ ID NO: 834459 - protein, 9 aa, Homo Sapiens
QGHLQIFYM

SEQ ID NO: 834460 - protein, 9 aa, Homo Sapiens
CHLFTSSNP

SEQ ID NO: 834461 - protein, 9 aa, Homo Sapiens
VFNPSWKTS

SEQ ID NO: 834462 - protein, 9 aa, Homo Sapiens
WKNKGAIYE

SEQ ID NO: 834463 - protein, 9 aa, Homo Sapiens
YAAELEACR

SEQ ID NO: 834464 - protein, 9 aa, Homo Sapiens
VGAVQIGII

SEQ ID NO: 834465 - protein, 9 aa, Homo Sapiens
PFAKGFWDN

SEQ ID NO: 834466 - protein, 9 aa, Homo Sapiens
NDTSTFEEV

SEQ ID NO: 834467 - protein, 9 aa, Homo Sapiens
LEFNVNSNE

SEQ ID NO: 834468 - protein, 9 aa, Homo Sapiens
SASAKKHED

SEQ ID NO: 834469 - protein, 9 aa, Homo Sapiens
QKRSYSSSS

SEQ ID NO: 834470 - protein, 9 aa, Homo Sapiens
NGSEKETMP

SEQ ID NO: 834471 - protein, 9 aa, Homo Sapiens
LRELTKSLD

SEQ ID NO: 834472 - protein, 9 aa, Homo Sapiens
DCSEACLKM

SEQ ID NO: 834473 - protein, 9 aa, Homo Sapiens
AHRCCNKTR

SEQ ID NO: 834474 - protein, 9 aa, Homo Sapiens
HGPDTLPQG

SEQ ID NO: 834475 - protein, 9 aa, Homo Sapiens
LNRSKCLEK

SEQ ID NO: 834476 - protein, 9 aa, Homo Sapiens
TSPRRTTLC

SEQ ID NO: 834477 - protein, 9 aa, Homo Sapiens
MDAGGVRMD

SEQ ID NO: 834478 - protein, 9 aa, Homo Sapiens
DVLHDYTIF

SEQ ID NO: 834479 - protein, 9 aa, Homo Sapiens
CLQLQRKSI

SEQ ID NO: 834480 - protein, 9 aa, Homo Sapiens
NDRSVLDNH

SEQ ID NO: 834481 - protein, 9 aa, Homo Sapiens
ACQYVYGVL

SEQ ID NO: 834482 - protein, 9 aa, Homo Sapiens
PNLSEIKCN

SEQ ID NO: 834483 - protein, 9 aa, Homo Sapiens
MLYGSTAFM

SEQ ID NO: 834484 - protein, 9 aa, Homo Sapiens
GKAPQSLLT

SEQ ID NO: 834485 - protein, 9 aa, Homo Sapiens
TSPIPDNAP

SEQ ID NO: 834486 - protein, 9 aa, Homo Sapiens
IEETLWGAI

SEQ ID NO: 834487 - protein, 9 aa, Homo Sapiens
EHLKAPGHV

SEQ ID NO: 834488 - protein, 9 aa, Homo Sapiens
SIMPAWQKL

SEQ ID NO: 834489 - protein, 9 aa, Homo Sapiens
AAPNFSFSK

SEQ ID NO: 834490 - protein, 9 aa, Homo Sapiens
QDVLCAAVF

SEQ ID NO: 834491 - protein, 9 aa, Homo Sapiens
NTLMMDANQ

SEQ ID NO: 834492 - protein, 9 aa, Homo Sapiens
LKPTMKMLE

SEQ ID NO: 834493 - protein, 9 aa, Homo Sapiens
DQASRLDLD

SEQ ID NO: 834494 - protein, 9 aa, Homo Sapiens
TGYNYYIKM

SEQ ID NO: 834495 - protein, 9 aa, Homo Sapiens
TGILDGMMT

SEQ ID NO: 834496 - protein, 9 aa, Homo Sapiens
LSCLLRHRL

SEQ ID NO: 834497 - protein, 9 aa, Homo Sapiens
QGKIIFEDG

SEQ ID NO: 834498 - protein, 9 aa, Homo Sapiens
GNYNIMCLS

SEQ ID NO: 834499 - protein, 9 aa, Homo Sapiens
IGNKIKYDF

SEQ ID NO: 834500 - protein, 9 aa, Homo Sapiens
GRQFDYRDP

SEQ ID NO: 834501 - protein, 9 aa, Homo Sapiens
SKVKLRIRD

SEQ ID NO: 834502 - protein, 9 aa, Homo Sapiens
ELFLLQKTL

SEQ ID NO: 834503 - protein, 9 aa, Homo Sapiens
ISDLNNLFF

SEQ ID NO: 834504 - protein, 9 aa, Homo Sapiens
SALHKLEQH

SEQ ID NO: 834505 - protein, 9 aa, Homo Sapiens
YLLQAATPK

SEQ ID NO: 834506 - protein, 9 aa, Homo Sapiens
LYFPIRSKL

SEQ ID NO: 834507 - protein, 9 aa, Homo Sapiens
KAARKQDVR

SEQ ID NO: 834508 - protein, 9 aa, Homo Sapiens
RSSDEEKVI

SEQ ID NO: 834509 - protein, 9 aa, Homo Sapiens
VILAGTNQP

SEQ ID NO: 834510 - protein, 9 aa, Homo Sapiens
LIPALSPGS

SEQ ID NO: 834511 - protein, 9 aa, Homo Sapiens
ECVQKVEEK

SEQ ID NO: 834512 - protein, 9 aa, Homo Sapiens
YSLEMKMSL

SEQ ID NO: 834513 - protein, 9 aa, Homo Sapiens
VSIISNIRQ

SEQ ID NO: 834514 - protein, 9 aa, Homo Sapiens
STDGDDSLE

SEQ ID NO: 834515 - protein, 9 aa, Homo Sapiens
KKLATKNLH

SEQ ID NO: 834516 - protein, 9 aa, Homo Sapiens
ICTDPMSKQ

SEQ ID NO: 834517 - protein, 9 aa, Homo Sapiens
DILQVITSK

SEQ ID NO: 834518 - protein, 9 aa, Homo Sapiens
DEHLFGVAL

SEQ ID NO: 834519 - protein, 9 aa, Homo Sapiens
QIHQLQLIK

SEQ ID NO: 834520 - protein, 9 aa, Homo Sapiens
RSWGALGSG

SEQ ID NO: 834521 - protein, 9 aa, Homo Sapiens
ISYYMTYGK

SEQ ID NO: 834522 - protein, 9 aa, Homo Sapiens
NILEIPGPG

SEQ ID NO: 834523 - protein, 9 aa, Homo Sapiens
VARGEIARI

SEQ ID NO: 834524 - protein, 9 aa, Homo Sapiens
NSLEIIAVL

SEQ ID NO: 834525 - protein, 9 aa, Homo Sapiens
DKFGQGVHH

SEQ ID NO: 834526 - protein, 9 aa, Homo Sapiens
RQSLLLLPA

SEQ ID NO: 834527 - protein, 9 aa, Homo Sapiens
EIITQMQRL

SEQ ID NO: 834528 - protein, 9 aa, Homo Sapiens
TLNILGKIT

SEQ ID NO: 834529 - protein, 9 aa, Homo Sapiens
GKGFTQISY

SEQ ID NO: 834530 - protein, 9 aa, Homo Sapiens
LSSTLSSPS

SEQ ID NO: 834531 - protein, 9 aa, Homo Sapiens
TFLTWVKEV

SEQ ID NO: 834532 - protein, 9 aa, Homo Sapiens
RSKDPHSQV

SEQ ID NO: 834533 - protein, 9 aa, Homo Sapiens
HVKVILYQI

SEQ ID NO: 834534 - protein, 9 aa, Homo Sapiens
VEAAKRADE

SEQ ID NO: 834535 - protein, 9 aa, Homo Sapiens
NCIDILLER

SEQ ID NO: 834536 - protein, 9 aa, Homo Sapiens
QAQSINYTD

SEQ ID NO: 834537 - protein, 9 aa, Homo Sapiens
KGRGSPEEK

SEQ ID NO: 834538 - protein, 9 aa, Homo Sapiens
PNALIGSDV

SEQ ID NO: 834539 - protein, 9 aa, Homo Sapiens
AVCNMQNNT

SEQ ID NO: 834540 - protein, 9 aa, Homo Sapiens
KTTEHTRKL

SEQ ID NO: 834541 - protein, 9 aa, Homo Sapiens
VYALLKDLE

SEQ ID NO: 834542 - protein, 9 aa, Homo Sapiens
RYQHLFEAC

SEQ ID NO: 834543 - protein, 9 aa, Homo Sapiens
GEAFNCRIY

SEQ ID NO: 834544 - protein, 9 aa, Homo Sapiens
QGQDVVPPP

SEQ ID NO: 834545 - protein, 9 aa, Homo Sapiens
DEPFTIQFY

SEQ ID NO: 834546 - protein, 9 aa, Homo Sapiens
LFSYCLAQQ

SEQ ID NO: 834547 - protein, 9 aa, Homo Sapiens
IPRNGTKNR

SEQ ID NO: 834548 - protein, 9 aa, Homo Sapiens
EATQIITTR

SEQ ID NO: 834549 - protein, 9 aa, Homo Sapiens
CRCPAHAGA

SEQ ID NO: 834550 - protein, 9 aa, Homo Sapiens
HFLEEIEEQ

SEQ ID NO: 834551 - protein, 9 aa, Homo Sapiens
LHFPHKSLR

SEQ ID NO: 834552 - protein, 9 aa, Homo Sapiens
RVQLISNKG

SEQ ID NO: 834553 - protein, 9 aa, Homo Sapiens
RTDSGSLQR

SEQ ID NO: 834554 - protein, 9 aa, Homo Sapiens
LADQIPLGS

SEQ ID NO: 834555 - protein, 9 aa, Homo Sapiens
PPSADDYLK

SEQ ID NO: 834556 - protein, 9 aa, Homo Sapiens
KGEEVEAGT

SEQ ID NO: 834557 - protein, 9 aa, Homo Sapiens
ETTSSSSFK

SEQ ID NO: 834558 - protein, 9 aa, Homo Sapiens
MVGMSFQKA

SEQ ID NO: 834559 - protein, 9 aa, Homo Sapiens
ESTTCQAGG

SEQ ID NO: 834560 - protein, 9 aa, Homo Sapiens
PLKLRINEN

SEQ ID NO: 834561 - protein, 9 aa, Homo Sapiens
VQIHTGEKP

SEQ ID NO: 834562 - protein, 9 aa, Homo Sapiens
PQYSVALST

SEQ ID NO: 834563 - protein, 9 aa, Homo Sapiens
RKCGYENVQ

SEQ ID NO: 834564 - protein, 9 aa, Homo Sapiens
LVLGMVRVA

SEQ ID NO: 834565 - protein, 9 aa, Homo Sapiens
RAFPISHIH

SEQ ID NO: 834566 - protein, 9 aa, Homo Sapiens
EPEMGMRLI

SEQ ID NO: 834567 - protein, 9 aa, Homo Sapiens
TQGPPGSVG

SEQ ID NO: 834568 - protein, 9 aa, Homo Sapiens
SAKTWWRGL

SEQ ID NO: 834569 - protein, 9 aa, Homo Sapiens
NVAEIPFNS

SEQ ID NO: 834570 - protein, 9 aa, Homo Sapiens
NLNEIKIFS

SEQ ID NO: 834571 - protein, 9 aa, Homo Sapiens
VVGCVSCFV

SEQ ID NO: 834572 - protein, 9 aa, Homo Sapiens
GQQLHKNQQ

SEQ ID NO: 834573 - protein, 9 aa, Homo Sapiens
GAKPSLLPG

SEQ ID NO: 834574 - protein, 9 aa, Homo Sapiens
NQGVVSQAG

SEQ ID NO: 834575 - protein, 9 aa, Homo Sapiens
LAKLKGLHR

SEQ ID NO: 834576 - protein, 9 aa, Homo Sapiens
KEKKQSGRY

SEQ ID NO: 834577 - protein, 9 aa, Homo Sapiens
GKTNALLKY

SEQ ID NO: 834578 - protein, 9 aa, Homo Sapiens
ADGDFPDTT

SEQ ID NO: 834579 - protein, 9 aa, Homo Sapiens
GGPVISKGQ

SEQ ID NO: 834580 - protein, 9 aa, Homo Sapiens
NNFTLGVDI

SEQ ID NO: 834581 - protein, 9 aa, Homo Sapiens
ETPVYSMDY

SEQ ID NO: 834582 - protein, 9 aa, Homo Sapiens
LIKGVNMVL

SEQ ID NO: 834583 - protein, 9 aa, Homo Sapiens
SILEILFTT

SEQ ID NO: 834584 - protein, 9 aa, Homo Sapiens
DGVKFMVEM

SEQ ID NO: 834585 - protein, 9 aa, Homo Sapiens
EMQRRDSYY

SEQ ID NO: 834586 - protein, 9 aa, Homo Sapiens
YLMAHIKRV

SEQ ID NO: 834587 - protein, 9 aa, Homo Sapiens
IINGDGTAL

SEQ ID NO: 834588 - protein, 9 aa, Homo Sapiens
PRYLERQRV

SEQ ID NO: 834589 - protein, 9 aa, Homo Sapiens
YLIHSVIVI

SEQ ID NO: 834590 - protein, 9 aa, Homo Sapiens
DRMRRGGDE

SEQ ID NO: 834591 - protein, 9 aa, Homo Sapiens
VDNACFSSE

SEQ ID NO: 834592 - protein, 9 aa, Homo Sapiens
REHLHNLEN

SEQ ID NO: 834593 - protein, 9 aa, Homo Sapiens
FGFNTNAEG

SEQ ID NO: 834594 - protein, 9 aa, Homo Sapiens
SFLASLDGD

SEQ ID NO: 834595 - protein, 9 aa, Homo Sapiens
PLKVVKKPK

SEQ ID NO: 834596 - protein, 9 aa, Homo Sapiens
QNELRETVD

SEQ ID NO: 834597 - protein, 9 aa, Homo Sapiens
QIESSSLQG

SEQ ID NO: 834598 - protein, 9 aa, Homo Sapiens
LVPKVGFFC

SEQ ID NO: 834599 - protein, 9 aa, Homo Sapiens
KAQEIEITP

SEQ ID NO: 834600 - protein, 9 aa, Homo Sapiens
NKIKLAVLE

SEQ ID NO: 834601 - protein, 9 aa, Homo Sapiens
TSIPSPQTS

SEQ ID NO: 834602 - protein, 9 aa, Homo Sapiens
EGTTPQNKL

SEQ ID NO: 834603 - protein, 9 aa, Homo Sapiens
LLEWTHHNM

SEQ ID NO: 834604 - protein, 9 aa, Homo Sapiens
LHKNQQLQR

SEQ ID NO: 834605 - protein, 9 aa, Homo Sapiens
VQITLPRAE

SEQ ID NO: 834606 - protein, 9 aa, Homo Sapiens
LEGQLIIRP

SEQ ID NO: 834607 - protein, 9 aa, Homo Sapiens
GQRGAWTMS

SEQ ID NO: 834608 - protein, 9 aa, Homo Sapiens
SALEHMHSQ

SEQ ID NO: 834609 - protein, 9 aa, Homo Sapiens
MLENVGMLL

SEQ ID NO: 834610 - protein, 9 aa, Homo Sapiens
ASTMSVCFS

SEQ ID NO: 834611 - protein, 9 aa, Homo Sapiens
NSAEVAKHY

SEQ ID NO: 834612 - protein, 9 aa, Homo Sapiens
SSIPVDYIV

SEQ ID NO: 834613 - protein, 9 aa, Homo Sapiens
CEPASTMLT

SEQ ID NO: 834614 - protein, 9 aa, Homo Sapiens
ELLDPSHQK

SEQ ID NO: 834615 - protein, 9 aa, Homo Sapiens
TLPKHESPS

SEQ ID NO: 834616 - protein, 9 aa, Homo Sapiens
HNLLFGSLI

SEQ ID NO: 834617 - protein, 9 aa, Homo Sapiens
SNDPRSKHK

SEQ ID NO: 834618 - protein, 9 aa, Homo Sapiens
RRKMASPPS

SEQ ID NO: 834619 - protein, 9 aa, Homo Sapiens
EGVDEDADI

SEQ ID NO: 834620 - protein, 9 aa, Homo Sapiens
SKHSHRLYY

SEQ ID NO: 834621 - protein, 9 aa, Homo Sapiens
QLIIMLLKI

SEQ ID NO: 834622 - protein, 9 aa, Homo Sapiens
DDLSEVRGV

SEQ ID NO: 834623 - protein, 9 aa, Homo Sapiens
YLSTVMHNY

SEQ ID NO: 834624 - protein, 9 aa, Homo Sapiens
DGFWKYVAT

SEQ ID NO: 834625 - protein, 9 aa, Homo Sapiens
EKLDILEQE

SEQ ID NO: 834626 - protein, 9 aa, Homo Sapiens
VQDVSRPVA

SEQ ID NO: 834627 - protein, 9 aa, Homo Sapiens
YHKQLVNSG

SEQ ID NO: 834628 - protein, 9 aa, Homo Sapiens
ALVEDKVLC

SEQ ID NO: 834629 - protein, 9 aa, Homo Sapiens
LVILRFSVT

SEQ ID NO: 834630 - protein, 9 aa, Homo Sapiens
STETLTKQL

SEQ ID NO: 834631 - protein, 9 aa, Homo Sapiens
FIMIIIKTN

SEQ ID NO: 834632 - protein, 9 aa, Homo Sapiens
NMKNVFFPL

SEQ ID NO: 834633 - protein, 9 aa, Homo Sapiens
AIPGFTNLD

SEQ ID NO: 834634 - protein, 9 aa, Homo Sapiens
DYEQLRTFK

SEQ ID NO: 834635 - protein, 9 aa, Homo Sapiens
WSQYTGIPL

SEQ ID NO: 834636 - protein, 9 aa, Homo Sapiens
MLIIHQQTH

SEQ ID NO: 834637 - protein, 9 aa, Homo Sapiens
EKDEDTFFS

SEQ ID NO: 834638 - protein, 9 aa, Homo Sapiens
INHKRYRPI

SEQ ID NO: 834639 - protein, 9 aa, Homo Sapiens
ADLVEAIYG

SEQ ID NO: 834640 - protein, 9 aa, Homo Sapiens
GALTRVSQI

SEQ ID NO: 834641 - protein, 9 aa, Homo Sapiens
LYAPWCGHC

SEQ ID NO: 834642 - protein, 9 aa, Homo Sapiens
NALIGSDVV

SEQ ID NO: 834643 - protein, 9 aa, Homo Sapiens
NLQMRLGGS

SEQ ID NO: 834644 - protein, 9 aa, Homo Sapiens
DTLFWWEQD

SEQ ID NO: 834645 - protein, 9 aa, Homo Sapiens
RHLEKSEEP

SEQ ID NO: 834646 - protein, 9 aa, Homo Sapiens
IGLLFKKSL

SEQ ID NO: 834647 - protein, 9 aa, Homo Sapiens
SSPKSTGSV

SEQ ID NO: 834648 - protein, 9 aa, Homo Sapiens
DNEDRNSEL

SEQ ID NO: 834649 - protein, 9 aa, Homo Sapiens
DTTIKMWEV

SEQ ID NO: 834650 - protein, 9 aa, Homo Sapiens
GQVFISDIK

SEQ ID NO: 834651 - protein, 9 aa, Homo Sapiens
YTDYIFVLV

SEQ ID NO: 834652 - protein, 9 aa, Homo Sapiens
PRELAEAEL

SEQ ID NO: 834653 - protein, 9 aa, Homo Sapiens
ATYPKSGTA

SEQ ID NO: 834654 - protein, 9 aa, Homo Sapiens
ELQKRLGRN

SEQ ID NO: 834655 - protein, 9 aa, Homo Sapiens
KLRDSNEGR

SEQ ID NO: 834656 - protein, 9 aa, Homo Sapiens
NIFVDVNKH

SEQ ID NO: 834657 - protein, 9 aa, Homo Sapiens
ANLFGSNAQ

SEQ ID NO: 834658 - protein, 9 aa, Homo Sapiens
DNFCSDTEY

SEQ ID NO: 834659 - protein, 9 aa, Homo Sapiens
DPHSQVGAC

SEQ ID NO: 834660 - protein, 9 aa, Homo Sapiens
IEYRGNSLA

SEQ ID NO: 834661 - protein, 9 aa, Homo Sapiens
RVASVLAKK

SEQ ID NO: 834662 - protein, 9 aa, Homo Sapiens
FPGKSGNSK

SEQ ID NO: 834663 - protein, 9 aa, Homo Sapiens
KKNREKFCN

SEQ ID NO: 834664 - protein, 9 aa, Homo Sapiens
ELNGVARTS

SEQ ID NO: 834665 - protein, 9 aa, Homo Sapiens
AFLLKKLLL

SEQ ID NO: 834666 - protein, 9 aa, Homo Sapiens
PNECHEYGD

SEQ ID NO: 834667 - protein, 9 aa, Homo Sapiens
LVNFPTSIP

SEQ ID NO: 834668 - protein, 9 aa, Homo Sapiens
NVVLDVGSG

SEQ ID NO: 834669 - protein, 9 aa, Homo Sapiens
AQKLERDSL

SEQ ID NO: 834670 - protein, 9 aa, Homo Sapiens
TTGRFMGHR

SEQ ID NO: 834671 - protein, 9 aa, Homo Sapiens
QLNMYHLGT

SEQ ID NO: 834672 - protein, 9 aa, Homo Sapiens
INFLKLLKP

SEQ ID NO: 834673 - protein, 9 aa, Homo Sapiens
IKHSEEAEF

SEQ ID NO: 834674 - protein, 9 aa, Homo Sapiens
EPQEPNYAT

SEQ ID NO: 834675 - protein, 9 aa, Homo Sapiens
GMMAFMDIS

SEQ ID NO: 834676 - protein, 9 aa, Homo Sapiens
IQEWLRSQH

SEQ ID NO: 834677 - protein, 9 aa, Homo Sapiens
TFSLLNNLI

SEQ ID NO: 834678 - protein, 9 aa, Homo Sapiens
LLQKFCQMR

SEQ ID NO: 834679 - protein, 9 aa, Homo Sapiens
PFYHLPSNK

SEQ ID NO: 834680 - protein, 9 aa, Homo Sapiens
NKIDLVCNA

SEQ ID NO: 834681 - protein, 9 aa, Homo Sapiens
PQEAFQGKR

SEQ ID NO: 834682 - protein, 9 aa, Homo Sapiens
LLTTCGTLK

SEQ ID NO: 834683 - protein, 9 aa, Homo Sapiens
SFGCASCPK

SEQ ID NO: 834684 - protein, 9 aa, Homo Sapiens
RSLRSQRLA

SEQ ID NO: 834685 - protein, 9 aa, Homo Sapiens
QQQQIAPCH

SEQ ID NO: 834686 - protein, 9 aa, Homo Sapiens
SDTISPHCN

SEQ ID NO: 834687 - protein, 9 aa, Homo Sapiens
ERKLRTLWG

SEQ ID NO: 834688 - protein, 9 aa, Homo Sapiens
LLHRARMHI

SEQ ID NO: 834689 - protein, 9 aa, Homo Sapiens
SYFMFTEKT

SEQ ID NO: 834690 - protein, 9 aa, Homo Sapiens
IGKQEGRHI

SEQ ID NO: 834691 - protein, 9 aa, Homo Sapiens
AHHDKRLNA

SEQ ID NO: 834692 - protein, 9 aa, Homo Sapiens
TIDINNVDG

SEQ ID NO: 834693 - protein, 9 aa, Homo Sapiens
CQKTSIVWV

SEQ ID NO: 834694 - protein, 9 aa, Homo Sapiens
GIIKGYIIR

SEQ ID NO: 834695 - protein, 9 aa, Homo Sapiens
TSIPFSVKD

SEQ ID NO: 834696 - protein, 9 aa, Homo Sapiens
EDHPNVQKY

SEQ ID NO: 834697 - protein, 9 aa, Homo Sapiens
VLLDALFNE

SEQ ID NO: 834698 - protein, 9 aa, Homo Sapiens
PRNPSTLCS

SEQ ID NO: 834699 - protein, 9 aa, Homo Sapiens
DRFFVMEAI

SEQ ID NO: 834700 - protein, 9 aa, Homo Sapiens
SEELKEKAN

SEQ ID NO: 834701 - protein, 9 aa, Homo Sapiens
SISKTSTEL

SEQ ID NO: 834702 - protein, 9 aa, Homo Sapiens
FNERNVNMS

SEQ ID NO: 834703 - protein, 9 aa, Homo Sapiens
RMTITGDDV

SEQ ID NO: 834704 - protein, 9 aa, Homo Sapiens
VFLGTEASS

SEQ ID NO: 834705 - protein, 9 aa, Homo Sapiens
YRSPEHGVW

SEQ ID NO: 834706 - protein, 9 aa, Homo Sapiens
ASQINDIQE

SEQ ID NO: 834707 - protein, 9 aa, Homo Sapiens
PKFFKVEDM

SEQ ID NO: 834708 - protein, 9 aa, Homo Sapiens
VSGSDDATC

SEQ ID NO: 834709 - protein, 9 aa, Homo Sapiens
HPHTQKFTH

SEQ ID NO: 834710 - protein, 9 aa, Homo Sapiens
TYVLQYNSF

SEQ ID NO: 834711 - protein, 9 aa, Homo Sapiens
VPATGLLCD

SEQ ID NO: 834712 - protein, 9 aa, Homo Sapiens
KVCCNYSLH

SEQ ID NO: 834713 - protein, 9 aa, Homo Sapiens
ERFFLISSN

SEQ ID NO: 834714 - protein, 9 aa, Homo Sapiens
GEEARGTPQ

SEQ ID NO: 834715 - protein, 9 aa, Homo Sapiens
GTKRYEDRY

SEQ ID NO: 834716 - protein, 9 aa, Homo Sapiens
DEMRKRDQT

SEQ ID NO: 834717 - protein, 9 aa, Homo Sapiens
RGSVEAVVM

SEQ ID NO: 834718 - protein, 9 aa, Homo Sapiens
CTLPKHESP

SEQ ID NO: 834719 - protein, 9 aa, Homo Sapiens
VFSEEDLQL

SEQ ID NO: 834720 - protein, 9 aa, Homo Sapiens
LTKAIASHR

SEQ ID NO: 834721 - protein, 9 aa, Homo Sapiens
VTSEENNLV

SEQ ID NO: 834722 - protein, 9 aa, Homo Sapiens
DQVFPINPP

SEQ ID NO: 834723 - protein, 9 aa, Homo Sapiens
LLLFTSNSL

SEQ ID NO: 834724 - protein, 9 aa, Homo Sapiens
CKQERAAAA

SEQ ID NO: 834725 - protein, 9 aa, Homo Sapiens
SLVILRFSV

SEQ ID NO: 834726 - protein, 9 aa, Homo Sapiens
LVAHQIIHA

SEQ ID NO: 834727 - protein, 9 aa, Homo Sapiens
KRGEARALC

SEQ ID NO: 834728 - protein, 9 aa, Homo Sapiens
QRQRHLEKS

SEQ ID NO: 834729 - protein, 9 aa, Homo Sapiens
SWITVSALC

SEQ ID NO: 834730 - protein, 9 aa, Homo Sapiens
LVDSSWAIG

SEQ ID NO: 834731 - protein, 9 aa, Homo Sapiens
RGNGIKLIM

SEQ ID NO: 834732 - protein, 9 aa, Homo Sapiens
WRQSSSQDE

SEQ ID NO: 834733 - protein, 9 aa, Homo Sapiens
MNISVAAIP

SEQ ID NO: 834734 - protein, 9 aa, Homo Sapiens
FSNAWLLVK

SEQ ID NO: 834735 - protein, 9 aa, Homo Sapiens
NTINEVITE

SEQ ID NO: 834736 - protein, 9 aa, Homo Sapiens
DMHIPYFPS

SEQ ID NO: 834737 - protein, 9 aa, Homo Sapiens
LNTSDLSDW

SEQ ID NO: 834738 - protein, 9 aa, Homo Sapiens
KLQRRQDKA

SEQ ID NO: 834739 - protein, 9 aa, Homo Sapiens
SMVIPVPET

SEQ ID NO: 834740 - protein, 9 aa, Homo Sapiens
TPESMGSED

SEQ ID NO: 834741 - protein, 9 aa, Homo Sapiens
VFVSHVIYP

SEQ ID NO: 834742 - protein, 9 aa, Homo Sapiens
PGQVNISVL

SEQ ID NO: 834743 - protein, 9 aa, Homo Sapiens
LNHVIYGVR

SEQ ID NO: 834744 - protein, 9 aa, Homo Sapiens
KELDVLEEM

SEQ ID NO: 834745 - protein, 9 aa, Homo Sapiens
EGAELESVP

SEQ ID NO: 834746 - protein, 9 aa, Homo Sapiens
TAACNATNQ

SEQ ID NO: 834747 - protein, 9 aa, Homo Sapiens
TPNQVASMH

SEQ ID NO: 834748 - protein, 9 aa, Homo Sapiens
NGEKVKHEI

SEQ ID NO: 834749 - protein, 9 aa, Homo Sapiens
QVPLKELDV

SEQ ID NO: 834750 - protein, 9 aa, Homo Sapiens
ARLDTLWIP

SEQ ID NO: 834751 - protein, 9 aa, Homo Sapiens
QPDEFEHTP

SEQ ID NO: 834752 - protein, 9 aa, Homo Sapiens
HMEPICKQN

SEQ ID NO: 834753 - protein, 9 aa, Homo Sapiens
QYCIPSPGQ

SEQ ID NO: 834754 - protein, 9 aa, Homo Sapiens
VPSLKRRGQ

SEQ ID NO: 834755 - protein, 9 aa, Homo Sapiens
IGVANVDMS

SEQ ID NO: 834756 - protein, 9 aa, Homo Sapiens
TGPKVAFPG

SEQ ID NO: 834757 - protein, 9 aa, Homo Sapiens
AVDRTIEKI

SEQ ID NO: 834758 - protein, 9 aa, Homo Sapiens
KSNLIVHQG

SEQ ID NO: 834759 - protein, 9 aa, Homo Sapiens
DKLLTEKGK

SEQ ID NO: 834760 - protein, 9 aa, Homo Sapiens
VFQDTVHML

SEQ ID NO: 834761 - protein, 9 aa, Homo Sapiens
KYCLGCISN

SEQ ID NO: 834762 - protein, 9 aa, Homo Sapiens
VSDKHPEYG

SEQ ID NO: 834763 - protein, 9 aa, Homo Sapiens
TRLLSQSDS

SEQ ID NO: 834764 - protein, 9 aa, Homo Sapiens
INMYVSIVF

SEQ ID NO: 834765 - protein, 9 aa, Homo Sapiens
SSAEITSDL

SEQ ID NO: 834766 - protein, 9 aa, Homo Sapiens
ATLVKEVIS

SEQ ID NO: 834767 - protein, 9 aa, Homo Sapiens
GKKPYTCEE

SEQ ID NO: 834768 - protein, 9 aa, Homo Sapiens
LVKLICLSI

SEQ ID NO: 834769 - protein, 9 aa, Homo Sapiens
DNPKHSTRG

SEQ ID NO: 834770 - protein, 9 aa, Homo Sapiens
ECGHCFGRQ

SEQ ID NO: 834771 - protein, 9 aa, Homo Sapiens
PINNQVFLS

SEQ ID NO: 834772 - protein, 9 aa, Homo Sapiens
LFAATFSAF

SEQ ID NO: 834773 - protein, 9 aa, Homo Sapiens
TLLNYPDRA

SEQ ID NO: 834774 - protein, 9 aa, Homo Sapiens
LNENSTPDK

SEQ ID NO: 834775 - protein, 9 aa, Homo Sapiens
LRVVKYFEH

SEQ ID NO: 834776 - protein, 9 aa, Homo Sapiens
EDEFRYQMY

SEQ ID NO: 834777 - protein, 9 aa, Homo Sapiens
SGNYWLEMF

SEQ ID NO: 834778 - protein, 9 aa, Homo Sapiens
EATSSHRYG

SEQ ID NO: 834779 - protein, 9 aa, Homo Sapiens
NNFYIRANY

SEQ ID NO: 834780 - protein, 9 aa, Homo Sapiens
KKEKPVATN

SEQ ID NO: 834781 - protein, 9 aa, Homo Sapiens
HEEVRKLTQ

SEQ ID NO: 834782 - protein, 9 aa, Homo Sapiens
VVSDEDSDL

SEQ ID NO: 834783 - protein, 9 aa, Homo Sapiens
RQSYFALLG

SEQ ID NO: 834784 - protein, 9 aa, Homo Sapiens
IIKVLFIKK

SEQ ID NO: 834785 - protein, 9 aa, Homo Sapiens
TLTYDTQNI

SEQ ID NO: 834786 - protein, 9 aa, Homo Sapiens
EEANIGLPI

SEQ ID NO: 834787 - protein, 9 aa, Homo Sapiens
LAYRNLIKV

SEQ ID NO: 834788 - protein, 9 aa, Homo Sapiens
QHLLGKRAD

SEQ ID NO: 834789 - protein, 9 aa, Homo Sapiens
YIELALTSL

SEQ ID NO: 834790 - protein, 9 aa, Homo Sapiens
KHKTEPYWS

SEQ ID NO: 834791 - protein, 9 aa, Homo Sapiens
SLIILDILE

SEQ ID NO: 834792 - protein, 9 aa, Homo Sapiens
GTVPFHLWI

SEQ ID NO: 834793 - protein, 9 aa, Homo Sapiens
PASQSTSQQ

SEQ ID NO: 834794 - protein, 9 aa, Homo Sapiens
DSWNHSTTV

SEQ ID NO: 834795 - protein, 9 aa, Homo Sapiens
GRSNKRSSC

SEQ ID NO: 834796 - protein, 9 aa, Homo Sapiens
LCLLAAALQ

SEQ ID NO: 834797 - protein, 9 aa, Homo Sapiens
DHRYIHSKD

SEQ ID NO: 834798 - protein, 9 aa, Homo Sapiens
GGALQGCDC

SEQ ID NO: 834799 - protein, 9 aa, Homo Sapiens
LITHQIIHS

SEQ ID NO: 834800 - protein, 9 aa, Homo Sapiens
KYKEGTYII

SEQ ID NO: 834801 - protein, 9 aa, Homo Sapiens
SATDFQVFK

SEQ ID NO: 834802 - protein, 9 aa, Homo Sapiens
EIYKFHKTL

SEQ ID NO: 834803 - protein, 9 aa, Homo Sapiens
GPLFRFFER

SEQ ID NO: 834804 - protein, 9 aa, Homo Sapiens
QCYVRDKEV

SEQ ID NO: 834805 - protein, 9 aa, Homo Sapiens
RSRRERQQA

SEQ ID NO: 834806 - protein, 9 aa, Homo Sapiens
IADLRAYCE

SEQ ID NO: 834807 - protein, 9 aa, Homo Sapiens
DYFQKVLLR

SEQ ID NO: 834808 - protein, 9 aa, Homo Sapiens
QGLINKYEP

SEQ ID NO: 834809 - protein, 9 aa, Homo Sapiens
SKGVDTVVA

SEQ ID NO: 834810 - protein, 9 aa, Homo Sapiens
RSLTPDYDV

SEQ ID NO: 834811 - protein, 9 aa, Homo Sapiens
RMPGGGYPH

SEQ ID NO: 834812 - protein, 9 aa, Homo Sapiens
GPQLNPATT

SEQ ID NO: 834813 - protein, 9 aa, Homo Sapiens
EEDGEEDNQ

SEQ ID NO: 834814 - protein, 9 aa, Homo Sapiens
RETVRNKST

SEQ ID NO: 834815 - protein, 9 aa, Homo Sapiens
QIIHTVVKS

SEQ ID NO: 834816 - protein, 9 aa, Homo Sapiens
DGQNNGDAI

SEQ ID NO: 834817 - protein, 9 aa, Homo Sapiens
SVPLNTAGH

SEQ ID NO: 834818 - protein, 9 aa, Homo Sapiens
KVLPKWGRE

SEQ ID NO: 834819 - protein, 9 aa, Homo Sapiens
KKYSNPMVI

SEQ ID NO: 834820 - protein, 9 aa, Homo Sapiens
PRDQAVMPC

SEQ ID NO: 834821 - protein, 9 aa, Homo Sapiens
IYSENDSTP

SEQ ID NO: 834822 - protein, 9 aa, Homo Sapiens
HWCIMPFWI

SEQ ID NO: 834823 - protein, 9 aa, Homo Sapiens
SKLSGDYAD

SEQ ID NO: 834824 - protein, 9 aa, Homo Sapiens
PSGDLGPWN

SEQ ID NO: 834825 - protein, 9 aa, Homo Sapiens
GFMEQLHTY

SEQ ID NO: 834826 - protein, 9 aa, Homo Sapiens
NYHNMTTTL

SEQ ID NO: 834827 - protein, 9 aa, Homo Sapiens
LFVGEALLG

SEQ ID NO: 834828 - protein, 9 aa, Homo Sapiens
AEAQRGLCE

SEQ ID NO: 834829 - protein, 9 aa, Homo Sapiens
LLKEHQKDL

SEQ ID NO: 834830 - protein, 9 aa, Homo Sapiens
MWICQICQP

SEQ ID NO: 834831 - protein, 9 aa, Homo Sapiens
FVLTLLTNT

SEQ ID NO: 834832 - protein, 9 aa, Homo Sapiens
CNFRSHDMT

SEQ ID NO: 834833 - protein, 9 aa, Homo Sapiens
VIQMWDLQF

SEQ ID NO: 834834 - protein, 9 aa, Homo Sapiens
VDVPFDEGL

SEQ ID NO: 834835 - protein, 9 aa, Homo Sapiens
SCTMHSLTI

SEQ ID NO: 834836 - protein, 9 aa, Homo Sapiens
ENLEYKLYG

SEQ ID NO: 834837 - protein, 9 aa, Homo Sapiens
LPFSSPSLP

SEQ ID NO: 834838 - protein, 9 aa, Homo Sapiens
SLCYKQIIK

SEQ ID NO: 834839 - protein, 9 aa, Homo Sapiens
PFYQVCHET

SEQ ID NO: 834840 - protein, 9 aa, Homo Sapiens
NGSLTPGLP

SEQ ID NO: 834841 - protein, 9 aa, Homo Sapiens
VQPFECNEC

SEQ ID NO: 834842 - protein, 9 aa, Homo Sapiens
QDLPILAEV

SEQ ID NO: 834843 - protein, 9 aa, Homo Sapiens
HVFCAVHLH

SEQ ID NO: 834844 - protein, 9 aa, Homo Sapiens
YILKLYDKI

SEQ ID NO: 834845 - protein, 9 aa, Homo Sapiens
TVLECAPKS

SEQ ID NO: 834846 - protein, 9 aa, Homo Sapiens
ASQPRTTTG

SEQ ID NO: 834847 - protein, 9 aa, Homo Sapiens
HQKKLVLGD

SEQ ID NO: 834848 - protein, 9 aa, Homo Sapiens
DSNAHTTEK

SEQ ID NO: 834849 - protein, 9 aa, Homo Sapiens
GHKYSSGQS

SEQ ID NO: 834850 - protein, 9 aa, Homo Sapiens
YANIFYYIP

SEQ ID NO: 834851 - protein, 9 aa, Homo Sapiens
AFAQLIIGI

SEQ ID NO: 834852 - protein, 9 aa, Homo Sapiens
LAWEVLRMR

SEQ ID NO: 834853 - protein, 9 aa, Homo Sapiens
SAHIHYFPS

SEQ ID NO: 834854 - protein, 9 aa, Homo Sapiens
DGGVYSYSG

SEQ ID NO: 834855 - protein, 9 aa, Homo Sapiens
RGPPPQETL

SEQ ID NO: 834856 - protein, 9 aa, Homo Sapiens
ALMGHQRVH

SEQ ID NO: 834857 - protein, 9 aa, Homo Sapiens
QIALMASLA

SEQ ID NO: 834858 - protein, 9 aa, Homo Sapiens
KASEEPRKM

SEQ ID NO: 834859 - protein, 9 aa, Homo Sapiens
LTCMMCNKQ

SEQ ID NO: 834860 - protein, 9 aa, Homo Sapiens
LFDDDLVLG

SEQ ID NO: 834861 - protein, 9 aa, Homo Sapiens
NYLQDRIDR

SEQ ID NO: 834862 - protein, 9 aa, Homo Sapiens
AKECTNKCS

SEQ ID NO: 834863 - protein, 9 aa, Homo Sapiens
KTLFLCSPQ

SEQ ID NO: 834864 - protein, 9 aa, Homo Sapiens
YHDHRSVCS

SEQ ID NO: 834865 - protein, 9 aa, Homo Sapiens
SSSFKLEMA

SEQ ID NO: 834866 - protein, 9 aa, Homo Sapiens
VTFYGPRSE

SEQ ID NO: 834867 - protein, 9 aa, Homo Sapiens
VLENILFGV

SEQ ID NO: 834868 - protein, 9 aa, Homo Sapiens
RQLFFYHFH

SEQ ID NO: 834869 - protein, 9 aa, Homo Sapiens
IDLMQLRRQ

SEQ ID NO: 834870 - protein, 9 aa, Homo Sapiens
YCQGMTFIA

SEQ ID NO: 834871 - protein, 9 aa, Homo Sapiens
QKFFHAILQ

SEQ ID NO: 834872 - protein, 9 aa, Homo Sapiens
MNSVILQVF

SEQ ID NO: 834873 - protein, 9 aa, Homo Sapiens
PLRCQELLD

SEQ ID NO: 834874 - protein, 9 aa, Homo Sapiens
MEVPNVAYS

SEQ ID NO: 834875 - protein, 9 aa, Homo Sapiens
NHVNTTLYT

SEQ ID NO: 834876 - protein, 9 aa, Homo Sapiens
NALQKQANR

SEQ ID NO: 834877 - protein, 9 aa, Homo Sapiens
ELSCSKAPL

SEQ ID NO: 834878 - protein, 9 aa, Homo Sapiens
HEEQSGMYV

SEQ ID NO: 834879 - protein, 9 aa, Homo Sapiens
KQILSLSEE

SEQ ID NO: 834880 - protein, 9 aa, Homo Sapiens
LGYLAMVIE

SEQ ID NO: 834881 - protein, 9 aa, Homo Sapiens
SIQVVPRMH

SEQ ID NO: 834882 - protein, 9 aa, Homo Sapiens
ELMVEKHKR

SEQ ID NO: 834883 - protein, 9 aa, Homo Sapiens
KCCGFVTNR

SEQ ID NO: 834884 - protein, 9 aa, Homo Sapiens
MRKRRRDSL

SEQ ID NO: 834885 - protein, 9 aa, Homo Sapiens
QQQQQHQEY

SEQ ID NO: 834886 - protein, 9 aa, Homo Sapiens
GLFRIVAIV

SEQ ID NO: 834887 - protein, 9 aa, Homo Sapiens
LTDAQVVMG

SEQ ID NO: 834888 - protein, 9 aa, Homo Sapiens
SPEIIITYL

SEQ ID NO: 834889 - protein, 9 aa, Homo Sapiens
LVENLYRRH

SEQ ID NO: 834890 - protein, 9 aa, Homo Sapiens
HEMNRADEV

SEQ ID NO: 834891 - protein, 9 aa, Homo Sapiens
PNPLATLGV

SEQ ID NO: 834892 - protein, 9 aa, Homo Sapiens
RQDTALEGS

SEQ ID NO: 834893 - protein, 9 aa, Homo Sapiens
LKSQTIQNV

SEQ ID NO: 834894 - protein, 9 aa, Homo Sapiens
LSKKEHNVT

SEQ ID NO: 834895 - protein, 9 aa, Homo Sapiens
VLQHVVKVD

SEQ ID NO: 834896 - protein, 9 aa, Homo Sapiens
ILALLIQVH

SEQ ID NO: 834897 - protein, 9 aa, Homo Sapiens
LKEGCEIGF

SEQ ID NO: 834898 - protein, 9 aa, Homo Sapiens
WKQLLFSDN

SEQ ID NO: 834899 - protein, 9 aa, Homo Sapiens
ALGSGRTST

SEQ ID NO: 834900 - protein, 9 aa, Homo Sapiens
GQRGELGFH

SEQ ID NO: 834901 - protein, 9 aa, Homo Sapiens
SFKNISDKL

SEQ ID NO: 834902 - protein, 9 aa, Homo Sapiens
SNFGKTWGV

SEQ ID NO: 834903 - protein, 9 aa, Homo Sapiens
SKLFEHHPI

SEQ ID NO: 834904 - protein, 9 aa, Homo Sapiens
ELKPQSLQS

SEQ ID NO: 834905 - protein, 9 aa, Homo Sapiens
EEELKGKNQ

SEQ ID NO: 834906 - protein, 9 aa, Homo Sapiens
VLDQGDLYS

SEQ ID NO: 834907 - protein, 9 aa, Homo Sapiens
STCIHIYKY

SEQ ID NO: 834908 - protein, 9 aa, Homo Sapiens
KQGTSRGHS

SEQ ID NO: 834909 - protein, 9 aa, Homo Sapiens
SPVPYKDLK

SEQ ID NO: 834910 - protein, 9 aa, Homo Sapiens
SITSNTYPP

SEQ ID NO: 834911 - protein, 9 aa, Homo Sapiens
VPQLMINLC

SEQ ID NO: 834912 - protein, 9 aa, Homo Sapiens
WFIRANPGK

SEQ ID NO: 834913 - protein, 9 aa, Homo Sapiens
FERQMQEKT

SEQ ID NO: 834914 - protein, 9 aa, Homo Sapiens
WFCVEDNGN

SEQ ID NO: 834915 - protein, 9 aa, Homo Sapiens
VPRHLFQIK

SEQ ID NO: 834916 - protein, 9 aa, Homo Sapiens
EHTSKILMQ

SEQ ID NO: 834917 - protein, 9 aa, Homo Sapiens
ISKRPKSNQ

SEQ ID NO: 834918 - protein, 9 aa, Homo Sapiens
VVQMPEYTV

SEQ ID NO: 834919 - protein, 9 aa, Homo Sapiens
ESFTAYESQ

SEQ ID NO: 834920 - protein, 9 aa, Homo Sapiens
LSFNETSPE

SEQ ID NO: 834921 - protein, 9 aa, Homo Sapiens
IRIRCSPQK

SEQ ID NO: 834922 - protein, 9 aa, Homo Sapiens
ICQVESLNL

SEQ ID NO: 834923 - protein, 9 aa, Homo Sapiens
PQDFINLFT

SEQ ID NO: 834924 - protein, 9 aa, Homo Sapiens
FGYMQMTIT

SEQ ID NO: 834925 - protein, 9 aa, Homo Sapiens
PHCGRCIPM

SEQ ID NO: 834926 - protein, 9 aa, Homo Sapiens
DQALRESFQ

SEQ ID NO: 834927 - protein, 9 aa, Homo Sapiens
DRFFSMVCL

SEQ ID NO: 834928 - protein, 9 aa, Homo Sapiens
IIWAVMDSI

SEQ ID NO: 834929 - protein, 9 aa, Homo Sapiens
WKALRSYIL

SEQ ID NO: 834930 - protein, 9 aa, Homo Sapiens
RLAGGAGCS

SEQ ID NO: 834931 - protein, 9 aa, Homo Sapiens
DAGEDEEKR

SEQ ID NO: 834932 - protein, 9 aa, Homo Sapiens
RCMLQADSE

SEQ ID NO: 834933 - protein, 9 aa, Homo Sapiens
RQLCTYLPL

SEQ ID NO: 834934 - protein, 9 aa, Homo Sapiens
EWDSRKSKH

SEQ ID NO: 834935 - protein, 9 aa, Homo Sapiens
DKVLKYFYV

SEQ ID NO: 834936 - protein, 9 aa, Homo Sapiens
ADISDDEPS

SEQ ID NO: 834937 - protein, 9 aa, Homo Sapiens
YISYFGYPS

SEQ ID NO: 834938 - protein, 9 aa, Homo Sapiens
PYIFLFIGI

SEQ ID NO: 834939 - protein, 9 aa, Homo Sapiens
KAQMQSPTT

SEQ ID NO: 834940 - protein, 9 aa, Homo Sapiens
SSLLLAPRN

SEQ ID NO: 834941 - protein, 9 aa, Homo Sapiens
ITGPGILQQ

SEQ ID NO: 834942 - protein, 9 aa, Homo Sapiens
LARDKHHLT

SEQ ID NO: 834943 - protein, 9 aa, Homo Sapiens
EEDSNPNGS

SEQ ID NO: 834944 - protein, 9 aa, Homo Sapiens
SNIILTDDN

SEQ ID NO: 834945 - protein, 9 aa, Homo Sapiens
SSCLSIHRG

SEQ ID NO: 834946 - protein, 9 aa, Homo Sapiens
RDGDKKNHY

SEQ ID NO: 834947 - protein, 9 aa, Homo Sapiens
LEDYFSGDS

SEQ ID NO: 834948 - protein, 9 aa, Homo Sapiens
FAMYGEECI

SEQ ID NO: 834949 - protein, 9 aa, Homo Sapiens
NLLCLDASE

SEQ ID NO: 834950 - protein, 9 aa, Homo Sapiens
LDDSHEVEK

SEQ ID NO: 834951 - protein, 9 aa, Homo Sapiens
HKAKKPACQ

SEQ ID NO: 834952 - protein, 9 aa, Homo Sapiens
IPREPRQIV

SEQ ID NO: 834953 - protein, 9 aa, Homo Sapiens
VLYSCLETY

SEQ ID NO: 834954 - protein, 9 aa, Homo Sapiens
DNFKNALTG

SEQ ID NO: 834955 - protein, 9 aa, Homo Sapiens
GIPMKKAQN

SEQ ID NO: 834956 - protein, 9 aa, Homo Sapiens
HNLTAVNVQ

SEQ ID NO: 834957 - protein, 9 aa, Homo Sapiens
NLSKIETLR

SEQ ID NO: 834958 - protein, 9 aa, Homo Sapiens
IIQASLALD

SEQ ID NO: 834959 - protein, 9 aa, Homo Sapiens
SRITYKMPL

SEQ ID NO: 834960 - protein, 9 aa, Homo Sapiens
SSWAIGEEH

SEQ ID NO: 834961 - protein, 9 aa, Homo Sapiens
VKAFHTFSN

SEQ ID NO: 834962 - protein, 9 aa, Homo Sapiens
SLHVRQNNW

SEQ ID NO: 834963 - protein, 9 aa, Homo Sapiens
GRALLLQTP

SEQ ID NO: 834964 - protein, 9 aa, Homo Sapiens
EHAGCIFRF

SEQ ID NO: 834965 - protein, 9 aa, Homo Sapiens
SLQEVIDVE

SEQ ID NO: 834966 - protein, 9 aa, Homo Sapiens
GNCFIMIII

SEQ ID NO: 834967 - protein, 9 aa, Homo Sapiens
TPVCERNSR

SEQ ID NO: 834968 - protein, 9 aa, Homo Sapiens
KAIHAIMEN

SEQ ID NO: 834969 - protein, 9 aa, Homo Sapiens
EVDMYTGYT

SEQ ID NO: 834970 - protein, 9 aa, Homo Sapiens
DLYNVLEDF

SEQ ID NO: 834971 - protein, 9 aa, Homo Sapiens
KVVQCREDE

SEQ ID NO: 834972 - protein, 9 aa, Homo Sapiens
FDANGDGAI

SEQ ID NO: 834973 - protein, 9 aa, Homo Sapiens
ARRNRQMTR

SEQ ID NO: 834974 - protein, 9 aa, Homo Sapiens
LENSTQENL

SEQ ID NO: 834975 - protein, 9 aa, Homo Sapiens
HFYAKCRAL

SEQ ID NO: 834976 - protein, 9 aa, Homo Sapiens
FKLHVLCKQ

SEQ ID NO: 834977 - protein, 9 aa, Homo Sapiens
TQETVQRII

SEQ ID NO: 834978 - protein, 9 aa, Homo Sapiens
NVTAKFKET

SEQ ID NO: 834979 - protein, 9 aa, Homo Sapiens
LKTMRKVMQ

SEQ ID NO: 834980 - protein, 9 aa, Homo Sapiens
GGKIHSKGI

SEQ ID NO: 834981 - protein, 9 aa, Homo Sapiens
WSESFDELL

SEQ ID NO: 834982 - protein, 9 aa, Homo Sapiens
IEEFENIQK

SEQ ID NO: 834983 - protein, 9 aa, Homo Sapiens
NLVWLGLSM

SEQ ID NO: 834984 - protein, 9 aa, Homo Sapiens
RLNISINDY

SEQ ID NO: 834985 - protein, 9 aa, Homo Sapiens
EHCQDSMDV

SEQ ID NO: 834986 - protein, 9 aa, Homo Sapiens
RQQIYYKTL

SEQ ID NO: 834987 - protein, 9 aa, Homo Sapiens
GVDSGLYLV

SEQ ID NO: 834988 - protein, 9 aa, Homo Sapiens
APKFISNQR

SEQ ID NO: 834989 - protein, 9 aa, Homo Sapiens
AFISLAFLD

SEQ ID NO: 834990 - protein, 9 aa, Homo Sapiens
QSCCVYVNN

SEQ ID NO: 834991 - protein, 9 aa, Homo Sapiens
MCSKKEDSS

SEQ ID NO: 834992 - protein, 9 aa, Homo Sapiens
LAVSTISSL

SEQ ID NO: 834993 - protein, 9 aa, Homo Sapiens
VYTKEGEQV

SEQ ID NO: 834994 - protein, 9 aa, Homo Sapiens
NVCLPASSL

SEQ ID NO: 834995 - protein, 9 aa, Homo Sapiens
EGTIKQSSP

SEQ ID NO: 834996 - protein, 9 aa, Homo Sapiens
KVKKKSKEE

SEQ ID NO: 834997 - protein, 9 aa, Homo Sapiens
IAFHRDQRS

SEQ ID NO: 834998 - protein, 9 aa, Homo Sapiens
TERDNVFGK

SEQ ID NO: 834999 - protein, 9 aa, Homo Sapiens
AVQLQERLA

SEQ ID NO: 835000 - protein, 9 aa, Homo Sapiens
LIDYFVFWE

SEQ ID NO: 835001 - protein, 9 aa, Homo Sapiens
WDNYDTIYT

SEQ ID NO: 835002 - protein, 9 aa, Homo Sapiens
RCLKADALG

SEQ ID NO: 835003 - protein, 9 aa, Homo Sapiens
LSIIRIAAC

SEQ ID NO: 835004 - protein, 9 aa, Homo Sapiens
QYELREYEE

SEQ ID NO: 835005 - protein, 9 aa, Homo Sapiens
TFIVRDFQY

SEQ ID NO: 835006 - protein, 9 aa, Homo Sapiens
DTVYLASSI

SEQ ID NO: 835007 - protein, 9 aa, Homo Sapiens
PNCEKMLDN

SEQ ID NO: 835008 - protein, 9 aa, Homo Sapiens
DNALLDKVT

SEQ ID NO: 835009 - protein, 9 aa, Homo Sapiens
LWLERGAGL

SEQ ID NO: 835010 - protein, 9 aa, Homo Sapiens
PRGRNVCRV

SEQ ID NO: 835011 - protein, 9 aa, Homo Sapiens
VKTAIYAMV

SEQ ID NO: 835012 - protein, 9 aa, Homo Sapiens
ARHQTIHTG

SEQ ID NO: 835013 - protein, 9 aa, Homo Sapiens
AVPGSSGSR

SEQ ID NO: 835014 - protein, 9 aa, Homo Sapiens
QLIQNLEEV

SEQ ID NO: 835015 - protein, 9 aa, Homo Sapiens
SYTCDTEFR

SEQ ID NO: 835016 - protein, 9 aa, Homo Sapiens
ETNSSSNQR

SEQ ID NO: 835017 - protein, 9 aa, Homo Sapiens
VHCSLKEED

SEQ ID NO: 835018 - protein, 9 aa, Homo Sapiens
MLLIGTVPF

SEQ ID NO: 835019 - protein, 9 aa, Homo Sapiens
QQANLLKGK

SEQ ID NO: 835020 - protein, 9 aa, Homo Sapiens
VKSWQITIR

SEQ ID NO: 835021 - protein, 9 aa, Homo Sapiens
LLQEYRLVV

SEQ ID NO: 835022 - protein, 9 aa, Homo Sapiens
FANTSMALL

SEQ ID NO: 835023 - protein, 9 aa, Homo Sapiens
VECYNSREN

SEQ ID NO: 835024 - protein, 9 aa, Homo Sapiens
ALLDKVANN

SEQ ID NO: 835025 - protein, 9 aa, Homo Sapiens
YEEQKKQNK

SEQ ID NO: 835026 - protein, 9 aa, Homo Sapiens
RDASRPQTT

SEQ ID NO: 835027 - protein, 9 aa, Homo Sapiens
DFDLEEFKG

SEQ ID NO: 835028 - protein, 9 aa, Homo Sapiens
MRTRLAQVG

SEQ ID NO: 835029 - protein, 9 aa, Homo Sapiens
DDVVKIEFE

SEQ ID NO: 835030 - protein, 9 aa, Homo Sapiens
ITVHLVGLL

SEQ ID NO: 835031 - protein, 9 aa, Homo Sapiens
SKLRFHQII

SEQ ID NO: 835032 - protein, 9 aa, Homo Sapiens
GLLLCPPII

SEQ ID NO: 835033 - protein, 9 aa, Homo Sapiens
INKRLCYIP

SEQ ID NO: 835034 - protein, 9 aa, Homo Sapiens
MIMLGAICD

SEQ ID NO: 835035 - protein, 9 aa, Homo Sapiens
VKNMNRYST

SEQ ID NO: 835036 - protein, 9 aa, Homo Sapiens
KPQAGLKEV

SEQ ID NO: 835037 - protein, 9 aa, Homo Sapiens
KPLNYVVIM

SEQ ID NO: 835038 - protein, 9 aa, Homo Sapiens
ASTSFMMTP

SEQ ID NO: 835039 - protein, 9 aa, Homo Sapiens
NNVTGFILL

SEQ ID NO: 835040 - protein, 9 aa, Homo Sapiens
FGNPLNTAT

SEQ ID NO: 835041 - protein, 9 aa, Homo Sapiens
CPDPNILAH

SEQ ID NO: 835042 - protein, 9 aa, Homo Sapiens
SDSISKFQN

SEQ ID NO: 835043 - protein, 9 aa, Homo Sapiens
AVIHLHHLK

SEQ ID NO: 835044 - protein, 9 aa, Homo Sapiens
ASGGEQDQE

SEQ ID NO: 835045 - protein, 9 aa, Homo Sapiens
EHSSLNTHL

SEQ ID NO: 835046 - protein, 9 aa, Homo Sapiens
IIVQPMIDQ

SEQ ID NO: 835047 - protein, 9 aa, Homo Sapiens
RKDILQVIT

SEQ ID NO: 835048 - protein, 9 aa, Homo Sapiens
QHNINECDV

SEQ ID NO: 835049 - protein, 9 aa, Homo Sapiens
LSYMISLTS

SEQ ID NO: 835050 - protein, 9 aa, Homo Sapiens
LVDNSACRM

SEQ ID NO: 835051 - protein, 9 aa, Homo Sapiens
VPLKDKLCQ

SEQ ID NO: 835052 - protein, 9 aa, Homo Sapiens
HQIKRTAGD

SEQ ID NO: 835053 - protein, 9 aa, Homo Sapiens
DGKDCAIFF

SEQ ID NO: 835054 - protein, 9 aa, Homo Sapiens
VEVKSWQIT

SEQ ID NO: 835055 - protein, 9 aa, Homo Sapiens
NLLRQHHKL

SEQ ID NO: 835056 - protein, 9 aa, Homo Sapiens
DKNTFEFLK

SEQ ID NO: 835057 - protein, 9 aa, Homo Sapiens
IDSHISQSN

SEQ ID NO: 835058 - protein, 9 aa, Homo Sapiens
SEEEEEAHK

SEQ ID NO: 835059 - protein, 9 aa, Homo Sapiens
KPPQVAFTT

SEQ ID NO: 835060 - protein, 9 aa, Homo Sapiens
HEERGRFWS

SEQ ID NO: 835061 - protein, 9 aa, Homo Sapiens
RAMSTTELR

SEQ ID NO: 835062 - protein, 9 aa, Homo Sapiens
KIPKSTRQK

SEQ ID NO: 835063 - protein, 9 aa, Homo Sapiens
TQTLPYRGP

SEQ ID NO: 835064 - protein, 9 aa, Homo Sapiens
MLGDDGVLL

SEQ ID NO: 835065 - protein, 9 aa, Homo Sapiens
GSQIPYIEQ

SEQ ID NO: 835066 - protein, 9 aa, Homo Sapiens
KDIMKILNK

SEQ ID NO: 835067 - protein, 9 aa, Homo Sapiens
VSTSPSRPK

SEQ ID NO: 835068 - protein, 9 aa, Homo Sapiens
RRVVMNSRD

SEQ ID NO: 835069 - protein, 9 aa, Homo Sapiens
HYSRKIIHA

SEQ ID NO: 835070 - protein, 9 aa, Homo Sapiens
ACLQYLKMA

SEQ ID NO: 835071 - protein, 9 aa, Homo Sapiens
NFLCCGCLR

SEQ ID NO: 835072 - protein, 9 aa, Homo Sapiens
LVKRYLTPG

SEQ ID NO: 835073 - protein, 9 aa, Homo Sapiens
NAEAATNIL

SEQ ID NO: 835074 - protein, 9 aa, Homo Sapiens
TIDDPSIFG

SEQ ID NO: 835075 - protein, 9 aa, Homo Sapiens
KNWNRDKVE

SEQ ID NO: 835076 - protein, 9 aa, Homo Sapiens
DIAERISER

SEQ ID NO: 835077 - protein, 9 aa, Homo Sapiens
VRNSLIHNN

SEQ ID NO: 835078 - protein, 9 aa, Homo Sapiens
QSNPKREPA

SEQ ID NO: 835079 - protein, 9 aa, Homo Sapiens
AEGDINTDP

SEQ ID NO: 835080 - protein, 9 aa, Homo Sapiens
IIVIVSYFN

SEQ ID NO: 835081 - protein, 9 aa, Homo Sapiens
RHPQGAWKK

SEQ ID NO: 835082 - protein, 9 aa, Homo Sapiens
GRGACNNLP

SEQ ID NO: 835083 - protein, 9 aa, Homo Sapiens
GRQAEYVIR

SEQ ID NO: 835084 - protein, 9 aa, Homo Sapiens
VLNTLESTH

SEQ ID NO: 835085 - protein, 9 aa, Homo Sapiens
VASHSPACN

SEQ ID NO: 835086 - protein, 9 aa, Homo Sapiens
VCRFAHLLN

SEQ ID NO: 835087 - protein, 9 aa, Homo Sapiens
GDPASDAGD

SEQ ID NO: 835088 - protein, 9 aa, Homo Sapiens
ANVLRGFEE

SEQ ID NO: 835089 - protein, 9 aa, Homo Sapiens
TSRATRGIK

SEQ ID NO: 835090 - protein, 9 aa, Homo Sapiens
AHYWRFPNN

SEQ ID NO: 835091 - protein, 9 aa, Homo Sapiens
SMSLEVCQL

SEQ ID NO: 835092 - protein, 9 aa, Homo Sapiens
GIYSIIVAL

SEQ ID NO: 835093 - protein, 9 aa, Homo Sapiens
LAKYHLKQI

SEQ ID NO: 835094 - protein, 9 aa, Homo Sapiens
IALVSVRVL

SEQ ID NO: 835095 - protein, 9 aa, Homo Sapiens
EPKLDLKAA

SEQ ID NO: 835096 - protein, 9 aa, Homo Sapiens
LIVRRGQSL

SEQ ID NO: 835097 - protein, 9 aa, Homo Sapiens
SLMELLDPD

SEQ ID NO: 835098 - protein, 9 aa, Homo Sapiens
LGEPFELKV

SEQ ID NO: 835099 - protein, 9 aa, Homo Sapiens
DQLIEQRTV

SEQ ID NO: 835100 - protein, 9 aa, Homo Sapiens
LEEMQQRAD

SEQ ID NO: 835101 - protein, 9 aa, Homo Sapiens
SVVEENLKL

SEQ ID NO: 835102 - protein, 9 aa, Homo Sapiens
GVQEQTTAF

SEQ ID NO: 835103 - protein, 9 aa, Homo Sapiens
EIGRQAEYV

SEQ ID NO: 835104 - protein, 9 aa, Homo Sapiens
SEVLQLCSY

SEQ ID NO: 835105 - protein, 9 aa, Homo Sapiens
SLNRRIFIP

SEQ ID NO: 835106 - protein, 9 aa, Homo Sapiens
ENNYTNSPE

SEQ ID NO: 835107 - protein, 9 aa, Homo Sapiens
LENDPSVNY

SEQ ID NO: 835108 - protein, 9 aa, Homo Sapiens
LEREKQARI

SEQ ID NO: 835109 - protein, 9 aa, Homo Sapiens
RSKGEGDMA

SEQ ID NO: 835110 - protein, 9 aa, Homo Sapiens
SAGGSILSG

SEQ ID NO: 835111 - protein, 9 aa, Homo Sapiens
GTLQEYQKI

SEQ ID NO: 835112 - protein, 9 aa, Homo Sapiens
KPDPPVSHW

SEQ ID NO: 835113 - protein, 9 aa, Homo Sapiens
SAFQRSAIL

SEQ ID NO: 835114 - protein, 9 aa, Homo Sapiens
REVEYLSKA

SEQ ID NO: 835115 - protein, 9 aa, Homo Sapiens
LQIIFVSYP

SEQ ID NO: 835116 - protein, 9 aa, Homo Sapiens
DKICDLLVT

SEQ ID NO: 835117 - protein, 9 aa, Homo Sapiens
PPATREKKT

SEQ ID NO: 835118 - protein, 9 aa, Homo Sapiens
VEAEAEDGE

SEQ ID NO: 835119 - protein, 9 aa, Homo Sapiens
ASFRRRRTE

SEQ ID NO: 835120 - protein, 9 aa, Homo Sapiens
ETLTLTYGS

SEQ ID NO: 835121 - protein, 9 aa, Homo Sapiens
CKLQVIGLC

SEQ ID NO: 835122 - protein, 9 aa, Homo Sapiens
SFLLCGVIY

SEQ ID NO: 835123 - protein, 9 aa, Homo Sapiens
CRVPGSQVP

SEQ ID NO: 835124 - protein, 9 aa, Homo Sapiens
KVKDATQKI

SEQ ID NO: 835125 - protein, 9 aa, Homo Sapiens
EAPAVQDVS

SEQ ID NO: 835126 - protein, 9 aa, Homo Sapiens
IIRGTKRYE

SEQ ID NO: 835127 - protein, 9 aa, Homo Sapiens
TVERERALQ

SEQ ID NO: 835128 - protein, 9 aa, Homo Sapiens
CVCIMMNEG

SEQ ID NO: 835129 - protein, 9 aa, Homo Sapiens
KETDDRKCL

SEQ ID NO: 835130 - protein, 9 aa, Homo Sapiens
FSFLQDPWN

SEQ ID NO: 835131 - protein, 9 aa, Homo Sapiens
QCGNTYTTG

SEQ ID NO: 835132 - protein, 9 aa, Homo Sapiens
TIFYGTLMF

SEQ ID NO: 835133 - protein, 9 aa, Homo Sapiens
IEITPPTNF

SEQ ID NO: 835134 - protein, 9 aa, Homo Sapiens
ALTSLFSLN

SEQ ID NO: 835135 - protein, 9 aa, Homo Sapiens
LIAPPRYVI

SEQ ID NO: 835136 - protein, 9 aa, Homo Sapiens
NQLQNTTSK

SEQ ID NO: 835137 - protein, 9 aa, Homo Sapiens
QTLCLDDNF

SEQ ID NO: 835138 - protein, 9 aa, Homo Sapiens
LKDEFNNTG

SEQ ID NO: 835139 - protein, 9 aa, Homo Sapiens
MLNNPINAV

SEQ ID NO: 835140 - protein, 9 aa, Homo Sapiens
IEKQLGGKI

SEQ ID NO: 835141 - protein, 9 aa, Homo Sapiens
VRQVLAVDE

SEQ ID NO: 835142 - protein, 9 aa, Homo Sapiens
IKICIIGPP

SEQ ID NO: 835143 - protein, 9 aa, Homo Sapiens
STVPQLMIN

SEQ ID NO: 835144 - protein, 9 aa, Homo Sapiens
FPVTSHQCH

SEQ ID NO: 835145 - protein, 9 aa, Homo Sapiens
KASTEMRLI

SEQ ID NO: 835146 - protein, 9 aa, Homo Sapiens
SDADIQKRL

SEQ ID NO: 835147 - protein, 9 aa, Homo Sapiens
LKKLVKDNK

SEQ ID NO: 835148 - protein, 9 aa, Homo Sapiens
RVAKTGSLN

SEQ ID NO: 835149 - protein, 9 aa, Homo Sapiens
ATHRQNYEE

SEQ ID NO: 835150 - protein, 9 aa, Homo Sapiens
YCIEGFCCA

SEQ ID NO: 835151 - protein, 9 aa, Homo Sapiens
EEGHIIPQS

SEQ ID NO: 835152 - protein, 9 aa, Homo Sapiens
CEQEKKEME

SEQ ID NO: 835153 - protein, 9 aa, Homo Sapiens
NAKECTNKC

SEQ ID NO: 835154 - protein, 9 aa, Homo Sapiens
QEDRGVVSV

SEQ ID NO: 835155 - protein, 9 aa, Homo Sapiens
DKIYLSAPA

SEQ ID NO: 835156 - protein, 9 aa, Homo Sapiens
VYFVSNYSH

SEQ ID NO: 835157 - protein, 9 aa, Homo Sapiens
WKEPPVYAA

SEQ ID NO: 835158 - protein, 9 aa, Homo Sapiens
VTEWLPMAS

SEQ ID NO: 835159 - protein, 9 aa, Homo Sapiens
DSIVRDDGI

SEQ ID NO: 835160 - protein, 9 aa, Homo Sapiens
LIVEGAKVT

SEQ ID NO: 835161 - protein, 9 aa, Homo Sapiens
PEHEMNRAD

SEQ ID NO: 835162 - protein, 9 aa, Homo Sapiens
VMWTKLPCT

SEQ ID NO: 835163 - protein, 9 aa, Homo Sapiens
LGSKRSFGD

SEQ ID NO: 835164 - protein, 9 aa, Homo Sapiens
KTHQTIPRI

SEQ ID NO: 835165 - protein, 9 aa, Homo Sapiens
ADPEKEDCV

SEQ ID NO: 835166 - protein, 9 aa, Homo Sapiens
EDMETKCFT

SEQ ID NO: 835167 - protein, 9 aa, Homo Sapiens
LYRTAEELD

SEQ ID NO: 835168 - protein, 9 aa, Homo Sapiens
GLYMGRPTY

SEQ ID NO: 835169 - protein, 9 aa, Homo Sapiens
QDINEAKLS

SEQ ID NO: 835170 - protein, 9 aa, Homo Sapiens
DFGSGINPE

SEQ ID NO: 835171 - protein, 9 aa, Homo Sapiens
HCSFSKHHL

SEQ ID NO: 835172 - protein, 9 aa, Homo Sapiens
FKPNEGSDG

SEQ ID NO: 835173 - protein, 9 aa, Homo Sapiens
HDNNIPGEY

SEQ ID NO: 835174 - protein, 9 aa, Homo Sapiens
SCKYCNFRS

SEQ ID NO: 835175 - protein, 9 aa, Homo Sapiens
DQSTWDASV

SEQ ID NO: 835176 - protein, 9 aa, Homo Sapiens
VRNDYLWHR

SEQ ID NO: 835177 - protein, 9 aa, Homo Sapiens
TYYMKYFKN

SEQ ID NO: 835178 - protein, 9 aa, Homo Sapiens
AHCGHPILQ

SEQ ID NO: 835179 - protein, 9 aa, Homo Sapiens
RSGRSCEKF

SEQ ID NO: 835180 - protein, 9 aa, Homo Sapiens
EECTFMAVT

SEQ ID NO: 835181 - protein, 9 aa, Homo Sapiens
AIEKDDCDK

SEQ ID NO: 835182 - protein, 9 aa, Homo Sapiens
KDIAANEDN

SEQ ID NO: 835183 - protein, 9 aa, Homo Sapiens
ADIQKRLKT

SEQ ID NO: 835184 - protein, 9 aa, Homo Sapiens
PSNEELQNL

SEQ ID NO: 835185 - protein, 9 aa, Homo Sapiens
LEDKLQPQR

SEQ ID NO: 835186 - protein, 9 aa, Homo Sapiens
MKRWIIPAS

SEQ ID NO: 835187 - protein, 9 aa, Homo Sapiens
ISHMWQSAG

SEQ ID NO: 835188 - protein, 9 aa, Homo Sapiens
HQNTPLQST

SEQ ID NO: 835189 - protein, 9 aa, Homo Sapiens
KDHKVSYLR

SEQ ID NO: 835190 - protein, 9 aa, Homo Sapiens
NGQWEGKVN

SEQ ID NO: 835191 - protein, 9 aa, Homo Sapiens
AIHTENKSH

SEQ ID NO: 835192 - protein, 9 aa, Homo Sapiens
SESFSSLFK

SEQ ID NO: 835193 - protein, 9 aa, Homo Sapiens
FAKAIPGFT

SEQ ID NO: 835194 - protein, 9 aa, Homo Sapiens
VSFAPIMNQ

SEQ ID NO: 835195 - protein, 9 aa, Homo Sapiens
LTTILVQWK

SEQ ID NO: 835196 - protein, 9 aa, Homo Sapiens
LKREKKPKN

SEQ ID NO: 835197 - protein, 9 aa, Homo Sapiens
LQDCLQAAH

SEQ ID NO: 835198 - protein, 9 aa, Homo Sapiens
VDTGLECPV

SEQ ID NO: 835199 - protein, 9 aa, Homo Sapiens
HLANHRIIH

SEQ ID NO: 835200 - protein, 9 aa, Homo Sapiens
EIYSKEEKY

SEQ ID NO: 835201 - protein, 9 aa, Homo Sapiens
AIANLKASL

SEQ ID NO: 835202 - protein, 9 aa, Homo Sapiens
VGNYLGVQD

SEQ ID NO: 835203 - protein, 9 aa, Homo Sapiens
LTRIKTEEE

SEQ ID NO: 835204 - protein, 9 aa, Homo Sapiens
RALALNLLV

SEQ ID NO: 835205 - protein, 9 aa, Homo Sapiens
ELFNDVRLL

SEQ ID NO: 835206 - protein, 9 aa, Homo Sapiens
IPLLLVVGC

SEQ ID NO: 835207 - protein, 9 aa, Homo Sapiens
ACKNLDTLW

SEQ ID NO: 835208 - protein, 9 aa, Homo Sapiens
INLGNYTVI

SEQ ID NO: 835209 - protein, 9 aa, Homo Sapiens
FQLHIQFTR

SEQ ID NO: 835210 - protein, 9 aa, Homo Sapiens
EITAKQKHL

SEQ ID NO: 835211 - protein, 9 aa, Homo Sapiens
DGVLLYPSH

SEQ ID NO: 835212 - protein, 9 aa, Homo Sapiens
DLGAYSYRK

SEQ ID NO: 835213 - protein, 9 aa, Homo Sapiens
IFVIPSILI

SEQ ID NO: 835214 - protein, 9 aa, Homo Sapiens
SHYIKSQTG

SEQ ID NO: 835215 - protein, 9 aa, Homo Sapiens
LFQIKHLPY

SEQ ID NO: 835216 - protein, 9 aa, Homo Sapiens
AGYIENLKK

SEQ ID NO: 835217 - protein, 9 aa, Homo Sapiens
EENLKLLQL

SEQ ID NO: 835218 - protein, 9 aa, Homo Sapiens
LRRSQSNYM

SEQ ID NO: 835219 - protein, 9 aa, Homo Sapiens
GAISKMDPT

SEQ ID NO: 835220 - protein, 9 aa, Homo Sapiens
PVYDWPPQI

SEQ ID NO: 835221 - protein, 9 aa, Homo Sapiens
CKPNRTPSI

SEQ ID NO: 835222 - protein, 9 aa, Homo Sapiens
CASHLKKIY

SEQ ID NO: 835223 - protein, 9 aa, Homo Sapiens
THDFTPVSG

SEQ ID NO: 835224 - protein, 9 aa, Homo Sapiens
LGVHTNGAD

SEQ ID NO: 835225 - protein, 9 aa, Homo Sapiens
EIMDGKIFE

SEQ ID NO: 835226 - protein, 9 aa, Homo Sapiens
FQREECGKR

SEQ ID NO: 835227 - protein, 9 aa, Homo Sapiens
IESHCSIIH

SEQ ID NO: 835228 - protein, 9 aa, Homo Sapiens
AHTERLQIV

SEQ ID NO: 835229 - protein, 9 aa, Homo Sapiens
VPKDAENPT

SEQ ID NO: 835230 - protein, 9 aa, Homo Sapiens
TGLGHISDH

SEQ ID NO: 835231 - protein, 9 aa, Homo Sapiens
WAGFKYYNL

SEQ ID NO: 835232 - protein, 9 aa, Homo Sapiens
YFVLTIVIS

SEQ ID NO: 835233 - protein, 9 aa, Homo Sapiens
FDHMFQIYQ

SEQ ID NO: 835234 - protein, 9 aa, Homo Sapiens
DKGGFIPGS

SEQ ID NO: 835235 - protein, 9 aa, Homo Sapiens
IISEGTETV

SEQ ID NO: 835236 - protein, 9 aa, Homo Sapiens
MKKEQYSNV

SEQ ID NO: 835237 - protein, 9 aa, Homo Sapiens
ATLHHCLLP

SEQ ID NO: 835238 - protein, 9 aa, Homo Sapiens
TKKQCRPSK

SEQ ID NO: 835239 - protein, 9 aa, Homo Sapiens
EKKYLSNKA

SEQ ID NO: 835240 - protein, 9 aa, Homo Sapiens
MWRDGKGQV

SEQ ID NO: 835241 - protein, 9 aa, Homo Sapiens
VREKLAREE

SEQ ID NO: 835242 - protein, 9 aa, Homo Sapiens
DIVNINISE

SEQ ID NO: 835243 - protein, 9 aa, Homo Sapiens
VECREKRRE

SEQ ID NO: 835244 - protein, 9 aa, Homo Sapiens
LHYLSNLIP

SEQ ID NO: 835245 - protein, 9 aa, Homo Sapiens
SECFFQNFV

SEQ ID NO: 835246 - protein, 9 aa, Homo Sapiens
VLSYKSICY

SEQ ID NO: 835247 - protein, 9 aa, Homo Sapiens
PDMALCQNA

SEQ ID NO: 835248 - protein, 9 aa, Homo Sapiens
AAVLSSADN

SEQ ID NO: 835249 - protein, 9 aa, Homo Sapiens
LFGRQFDYR

SEQ ID NO: 835250 - protein, 9 aa, Homo Sapiens
AQLYYKRNV

SEQ ID NO: 835251 - protein, 9 aa, Homo Sapiens
IWAVMDSIP

SEQ ID NO: 835252 - protein, 9 aa, Homo Sapiens
WQQTYTYNS

SEQ ID NO: 835253 - protein, 9 aa, Homo Sapiens
WIIPASQEE

SEQ ID NO: 835254 - protein, 9 aa, Homo Sapiens
LPVSNKTLL

SEQ ID NO: 835255 - protein, 9 aa, Homo Sapiens
HYQPSAELF

SEQ ID NO: 835256 - protein, 9 aa, Homo Sapiens
GATSTFNLF

SEQ ID NO: 835257 - protein, 9 aa, Homo Sapiens
EGPEKVKQL

SEQ ID NO: 835258 - protein, 9 aa, Homo Sapiens
RKQLQFEGE

SEQ ID NO: 835259 - protein, 9 aa, Homo Sapiens
EGQLPIYSE

SEQ ID NO: 835260 - protein, 9 aa, Homo Sapiens
QNISLGDCK

SEQ ID NO: 835261 - protein, 9 aa, Homo Sapiens
GNATVGRQY

SEQ ID NO: 835262 - protein, 9 aa, Homo Sapiens
WVYVELKFT

SEQ ID NO: 835263 - protein, 9 aa, Homo Sapiens
ILMTNHLYA

SEQ ID NO: 835264 - protein, 9 aa, Homo Sapiens
SLNAYLHSK

SEQ ID NO: 835265 - protein, 9 aa, Homo Sapiens
LLLRDYKSP

SEQ ID NO: 835266 - protein, 9 aa, Homo Sapiens
GGGGHNALK

SEQ ID NO: 835267 - protein, 9 aa, Homo Sapiens
IQPILDMAA

SEQ ID NO: 835268 - protein, 9 aa, Homo Sapiens
ESFRAQYGT

SEQ ID NO: 835269 - protein, 9 aa, Homo Sapiens
QQNTVLETK

SEQ ID NO: 835270 - protein, 9 aa, Homo Sapiens
GTGNYCGIS

SEQ ID NO: 835271 - protein, 9 aa, Homo Sapiens
FTSVMCTVM

SEQ ID NO: 835272 - protein, 9 aa, Homo Sapiens
VKNSPPEES

SEQ ID NO: 835273 - protein, 9 aa, Homo Sapiens
RVCQNFHPD

SEQ ID NO: 835274 - protein, 9 aa, Homo Sapiens
MMLRYHTGE

SEQ ID NO: 835275 - protein, 9 aa, Homo Sapiens
EDQLRGTWE

SEQ ID NO: 835276 - protein, 9 aa, Homo Sapiens
DCYVSKKPA

SEQ ID NO: 835277 - protein, 9 aa, Homo Sapiens
ECYPKVALR

SEQ ID NO: 835278 - protein, 9 aa, Homo Sapiens
ISGNCPENC

SEQ ID NO: 835279 - protein, 9 aa, Homo Sapiens
QQKERIALS

SEQ ID NO: 835280 - protein, 9 aa, Homo Sapiens
AIEDISGQT

SEQ ID NO: 835281 - protein, 9 aa, Homo Sapiens
TRRHSWRSW

SEQ ID NO: 835282 - protein, 9 aa, Homo Sapiens
HWFVLSVYL

SEQ ID NO: 835283 - protein, 9 aa, Homo Sapiens
CQVSTFEQC

SEQ ID NO: 835284 - protein, 9 aa, Homo Sapiens
VETFTSDNN

SEQ ID NO: 835285 - protein, 9 aa, Homo Sapiens
CLISSGNLL

SEQ ID NO: 835286 - protein, 9 aa, Homo Sapiens
AWIFIAWSP

SEQ ID NO: 835287 - protein, 9 aa, Homo Sapiens
GGGRKPQGL

SEQ ID NO: 835288 - protein, 9 aa, Homo Sapiens
GMGGDGDYM

SEQ ID NO: 835289 - protein, 9 aa, Homo Sapiens
LDSEQVWYE

SEQ ID NO: 835290 - protein, 9 aa, Homo Sapiens
YLGITPSMT

SEQ ID NO: 835291 - protein, 9 aa, Homo Sapiens
CLGTGYIFS

SEQ ID NO: 835292 - protein, 9 aa, Homo Sapiens
DKMYSFKHQ

SEQ ID NO: 835293 - protein, 9 aa, Homo Sapiens
SYLDNMLAE

SEQ ID NO: 835294 - protein, 9 aa, Homo Sapiens
TLAKLEQVE

SEQ ID NO: 835295 - protein, 9 aa, Homo Sapiens
PLLDFPVTD

SEQ ID NO: 835296 - protein, 9 aa, Homo Sapiens
RYWKVFEDS

SEQ ID NO: 835297 - protein, 9 aa, Homo Sapiens
NHKELKTDG

SEQ ID NO: 835298 - protein, 9 aa, Homo Sapiens
EHREKECGD

SEQ ID NO: 835299 - protein, 9 aa, Homo Sapiens
LSKWSFESI

SEQ ID NO: 835300 - protein, 9 aa, Homo Sapiens
PSILNVFCC

SEQ ID NO: 835301 - protein, 9 aa, Homo Sapiens
HKWENCMAI

SEQ ID NO: 835302 - protein, 9 aa, Homo Sapiens
FNCSTIVIG

SEQ ID NO: 835303 - protein, 9 aa, Homo Sapiens
SPTISDNTS

SEQ ID NO: 835304 - protein, 9 aa, Homo Sapiens
MSVLRSADT

SEQ ID NO: 835305 - protein, 9 aa, Homo Sapiens
GSLYLDNLD

SEQ ID NO: 835306 - protein, 9 aa, Homo Sapiens
KCIAVNIKD

SEQ ID NO: 835307 - protein, 9 aa, Homo Sapiens
REEERYAAE

SEQ ID NO: 835308 - protein, 9 aa, Homo Sapiens
KPKYQNQVY

SEQ ID NO: 835309 - protein, 9 aa, Homo Sapiens
DIGNMPAIS

SEQ ID NO: 835310 - protein, 9 aa, Homo Sapiens
EMSPSKNYF

SEQ ID NO: 835311 - protein, 9 aa, Homo Sapiens
TFNNYYSLV

SEQ ID NO: 835312 - protein, 9 aa, Homo Sapiens
KTICHYLDP

SEQ ID NO: 835313 - protein, 9 aa, Homo Sapiens
VAVVTEPWL

SEQ ID NO: 835314 - protein, 9 aa, Homo Sapiens
MIFAMCLVR

SEQ ID NO: 835315 - protein, 9 aa, Homo Sapiens
SYFPSEATS

SEQ ID NO: 835316 - protein, 9 aa, Homo Sapiens
ESQRQATKD

SEQ ID NO: 835317 - protein, 9 aa, Homo Sapiens
GFLIDDIRK

SEQ ID NO: 835318 - protein, 9 aa, Homo Sapiens
RQELLDIIN

SEQ ID NO: 835319 - protein, 9 aa, Homo Sapiens
LPPGLKRFS

SEQ ID NO: 835320 - protein, 9 aa, Homo Sapiens
DTGANVIVT

SEQ ID NO: 835321 - protein, 9 aa, Homo Sapiens
MGWFCVEDN

SEQ ID NO: 835322 - protein, 9 aa, Homo Sapiens
SRKVSRKRS

SEQ ID NO: 835323 - protein, 9 aa, Homo Sapiens
EINKILNNL

SEQ ID NO: 835324 - protein, 9 aa, Homo Sapiens
RGSQPACLD

SEQ ID NO: 835325 - protein, 9 aa, Homo Sapiens
QNVLLTENV

SEQ ID NO: 835326 - protein, 9 aa, Homo Sapiens
SCSTDFDCK

SEQ ID NO: 835327 - protein, 9 aa, Homo Sapiens
QARGRQTQW

SEQ ID NO: 835328 - protein, 9 aa, Homo Sapiens
LSSLGHTSI

SEQ ID NO: 835329 - protein, 9 aa, Homo Sapiens
LLFVSKLFE

SEQ ID NO: 835330 - protein, 9 aa, Homo Sapiens
TIKSWVDTM

SEQ ID NO: 835331 - protein, 9 aa, Homo Sapiens
KGTTSEKLS

SEQ ID NO: 835332 - protein, 9 aa, Homo Sapiens
PVNTCRDHT

SEQ ID NO: 835333 - protein, 9 aa, Homo Sapiens
LSQQLRIKG

SEQ ID NO: 835334 - protein, 9 aa, Homo Sapiens
WLNTWKKKY

SEQ ID NO: 835335 - protein, 9 aa, Homo Sapiens
VGDSLRTST

SEQ ID NO: 835336 - protein, 9 aa, Homo Sapiens
LMLINNAGS

SEQ ID NO: 835337 - protein, 9 aa, Homo Sapiens
PQCKKEENN

SEQ ID NO: 835338 - protein, 9 aa, Homo Sapiens
SNMGAWTLP

SEQ ID NO: 835339 - protein, 9 aa, Homo Sapiens
CINRQEKPL

SEQ ID NO: 835340 - protein, 9 aa, Homo Sapiens
CLDILVNWL

SEQ ID NO: 835341 - protein, 9 aa, Homo Sapiens
SLRPDQTRG

SEQ ID NO: 835342 - protein, 9 aa, Homo Sapiens
TAWVSEIVY

SEQ ID NO: 835343 - protein, 9 aa, Homo Sapiens
IYSTNTKTT

SEQ ID NO: 835344 - protein, 9 aa, Homo Sapiens
VSDAGTYTC

SEQ ID NO: 835345 - protein, 9 aa, Homo Sapiens
LEEEAAFPL

SEQ ID NO: 835346 - protein, 9 aa, Homo Sapiens
KIPVSGVGD

SEQ ID NO: 835347 - protein, 9 aa, Homo Sapiens
AQSLASRRL

SEQ ID NO: 835348 - protein, 9 aa, Homo Sapiens
FLRACFVWF

SEQ ID NO: 835349 - protein, 9 aa, Homo Sapiens
CARIGAHIT

SEQ ID NO: 835350 - protein, 9 aa, Homo Sapiens
RDLTDYLMQ

SEQ ID NO: 835351 - protein, 9 aa, Homo Sapiens
SLRERGRLQ

SEQ ID NO: 835352 - protein, 9 aa, Homo Sapiens
LEKEQIQNA

SEQ ID NO: 835353 - protein, 9 aa, Homo Sapiens
KKIKTATKK

SEQ ID NO: 835354 - protein, 9 aa, Homo Sapiens
FYMFVVEKW

SEQ ID NO: 835355 - protein, 9 aa, Homo Sapiens
VKKTEALWL

SEQ ID NO: 835356 - protein, 9 aa, Homo Sapiens
VGGYYYDKI

SEQ ID NO: 835357 - protein, 9 aa, Homo Sapiens
FKFLGKNEN

SEQ ID NO: 835358 - protein, 9 aa, Homo Sapiens
QVEIGDFKR

SEQ ID NO: 835359 - protein, 9 aa, Homo Sapiens
HYFGADSVP

SEQ ID NO: 835360 - protein, 9 aa, Homo Sapiens
VADAERSIV

SEQ ID NO: 835361 - protein, 9 aa, Homo Sapiens
QVDYFLCDI

SEQ ID NO: 835362 - protein, 9 aa, Homo Sapiens
STLSSHKIS

SEQ ID NO: 835363 - protein, 9 aa, Homo Sapiens
SKLNILETS

SEQ ID NO: 835364 - protein, 9 aa, Homo Sapiens
HFMHQTLGI

SEQ ID NO: 835365 - protein, 9 aa, Homo Sapiens
LDKGHAKHW

SEQ ID NO: 835366 - protein, 9 aa, Homo Sapiens
LYLDNLDSL

SEQ ID NO: 835367 - protein, 9 aa, Homo Sapiens
CVLGLDPNL

SEQ ID NO: 835368 - protein, 9 aa, Homo Sapiens
AFARHRIIH

SEQ ID NO: 835369 - protein, 9 aa, Homo Sapiens
RKEEELRQK

SEQ ID NO: 835370 - protein, 9 aa, Homo Sapiens
VWQDIIYGM

SEQ ID NO: 835371 - protein, 9 aa, Homo Sapiens
VRALNVLFG

SEQ ID NO: 835372 - protein, 9 aa, Homo Sapiens
AFIHKKRLI

SEQ ID NO: 835373 - protein, 9 aa, Homo Sapiens
VIDSIDHVQ

SEQ ID NO: 835374 - protein, 9 aa, Homo Sapiens
AAPVVPAMA

SEQ ID NO: 835375 - protein, 9 aa, Homo Sapiens
QHFNIHTGE

SEQ ID NO: 835376 - protein, 9 aa, Homo Sapiens
NLGGLLAAA

SEQ ID NO: 835377 - protein, 9 aa, Homo Sapiens
QQLEKTAAK

SEQ ID NO: 835378 - protein, 9 aa, Homo Sapiens
EHQCDPKTG

SEQ ID NO: 835379 - protein, 9 aa, Homo Sapiens
RNKEKRGSQ

SEQ ID NO: 835380 - protein, 9 aa, Homo Sapiens
YHGIPTVGI

SEQ ID NO: 835381 - protein, 9 aa, Homo Sapiens
KLYAIGGRY

SEQ ID NO: 835382 - protein, 9 aa, Homo Sapiens
YYYHIIIPV

SEQ ID NO: 835383 - protein, 9 aa, Homo Sapiens
LRTIKTLQI

SEQ ID NO: 835384 - protein, 9 aa, Homo Sapiens
LLGTFILIV

SEQ ID NO: 835385 - protein, 9 aa, Homo Sapiens
NVDGFKTCI

SEQ ID NO: 835386 - protein, 9 aa, Homo Sapiens
SENPGQITF

SEQ ID NO: 835387 - protein, 9 aa, Homo Sapiens
AGVQVGMWV

SEQ ID NO: 835388 - protein, 9 aa, Homo Sapiens
VVEYKIADR

SEQ ID NO: 835389 - protein, 9 aa, Homo Sapiens
SALQTIGVE

SEQ ID NO: 835390 - protein, 9 aa, Homo Sapiens
QFKRKAINL

SEQ ID NO: 835391 - protein, 9 aa, Homo Sapiens
ELHGFWMDI

SEQ ID NO: 835392 - protein, 9 aa, Homo Sapiens
VGFLEVLKE

SEQ ID NO: 835393 - protein, 9 aa, Homo Sapiens
TDTTGGQEI

SEQ ID NO: 835394 - protein, 9 aa, Homo Sapiens
KEKERYAEK

SEQ ID NO: 835395 - protein, 9 aa, Homo Sapiens
HKFLQVYDG

SEQ ID NO: 835396 - protein, 9 aa, Homo Sapiens
KLGSCKRIE

SEQ ID NO: 835397 - protein, 9 aa, Homo Sapiens
QGQIHSTSG

SEQ ID NO: 835398 - protein, 9 aa, Homo Sapiens
IHAIARSLS

SEQ ID NO: 835399 - protein, 9 aa, Homo Sapiens
LEIHQYGYR

SEQ ID NO: 835400 - protein, 9 aa, Homo Sapiens
EAIKCINRQ

SEQ ID NO: 835401 - protein, 9 aa, Homo Sapiens
LRHQYLRRK

SEQ ID NO: 835402 - protein, 9 aa, Homo Sapiens
DPAHRDHLQ

SEQ ID NO: 835403 - protein, 9 aa, Homo Sapiens
NVLNASISK

SEQ ID NO: 835404 - protein, 9 aa, Homo Sapiens
DNFLSTLTS

SEQ ID NO: 835405 - protein, 9 aa, Homo Sapiens
LIIKGKYAL

SEQ ID NO: 835406 - protein, 9 aa, Homo Sapiens
AQHSYVGSF

SEQ ID NO: 835407 - protein, 9 aa, Homo Sapiens
PVSVLNWLI

SEQ ID NO: 835408 - protein, 9 aa, Homo Sapiens
VEHLKAPGH

SEQ ID NO: 835409 - protein, 9 aa, Homo Sapiens
ILLFCLFIF

SEQ ID NO: 835410 - protein, 9 aa, Homo Sapiens
CLLLIKCRF

SEQ ID NO: 835411 - protein, 9 aa, Homo Sapiens
LSWLQNTNE

SEQ ID NO: 835412 - protein, 9 aa, Homo Sapiens
SLYLATFDL

SEQ ID NO: 835413 - protein, 9 aa, Homo Sapiens
YSRLSEHAK

SEQ ID NO: 835414 - protein, 9 aa, Homo Sapiens
TPLLTLYSA

SEQ ID NO: 835415 - protein, 9 aa, Homo Sapiens
VVCEAIQNE

SEQ ID NO: 835416 - protein, 9 aa, Homo Sapiens
NVDSVSARQ

SEQ ID NO: 835417 - protein, 9 aa, Homo Sapiens
SEPVSSLED

SEQ ID NO: 835418 - protein, 9 aa, Homo Sapiens
KAWRCHVAV

SEQ ID NO: 835419 - protein, 9 aa, Homo Sapiens
EKLECYPKV

SEQ ID NO: 835420 - protein, 9 aa, Homo Sapiens
INRAYQCAG

SEQ ID NO: 835421 - protein, 9 aa, Homo Sapiens
EKRHRNKLY

SEQ ID NO: 835422 - protein, 9 aa, Homo Sapiens
HKNQQLQRF

SEQ ID NO: 835423 - protein, 9 aa, Homo Sapiens
VVTNHWAVL

SEQ ID NO: 835424 - protein, 9 aa, Homo Sapiens
LDTVRALSH

SEQ ID NO: 835425 - protein, 9 aa, Homo Sapiens
PGQITNLKA

SEQ ID NO: 835426 - protein, 9 aa, Homo Sapiens
GGKAFRAHS

SEQ ID NO: 835427 - protein, 9 aa, Homo Sapiens
QFLIQLRKE

SEQ ID NO: 835428 - protein, 9 aa, Homo Sapiens
SNWEGIPGL

SEQ ID NO: 835429 - protein, 9 aa, Homo Sapiens
GLLVSLTSR

SEQ ID NO: 835430 - protein, 9 aa, Homo Sapiens
TYIIEMSHM

SEQ ID NO: 835431 - protein, 9 aa, Homo Sapiens
EERKLQENL

SEQ ID NO: 835432 - protein, 9 aa, Homo Sapiens
LGKVGITSA

SEQ ID NO: 835433 - protein, 9 aa, Homo Sapiens
DKDLRENGE

SEQ ID NO: 835434 - protein, 9 aa, Homo Sapiens
YKVKANLNA

SEQ ID NO: 835435 - protein, 9 aa, Homo Sapiens
FFIISYLTI

SEQ ID NO: 835436 - protein, 9 aa, Homo Sapiens
QEHQIIHTG

SEQ ID NO: 835437 - protein, 9 aa, Homo Sapiens
QDCLAQLCL

SEQ ID NO: 835438 - protein, 9 aa, Homo Sapiens
IGSLHPMKQ

SEQ ID NO: 835439 - protein, 9 aa, Homo Sapiens
GVVFVTKEE

SEQ ID NO: 835440 - protein, 9 aa, Homo Sapiens
EKRQGDRGQ

SEQ ID NO: 835441 - protein, 9 aa, Homo Sapiens
QHLIESSKV

SEQ ID NO: 835442 - protein, 9 aa, Homo Sapiens
APKRMIMAA

SEQ ID NO: 835443 - protein, 9 aa, Homo Sapiens
ILGRRWHVL

SEQ ID NO: 835444 - protein, 9 aa, Homo Sapiens
KVLFVFSTL

SEQ ID NO: 835445 - protein, 9 aa, Homo Sapiens
SISICTGIK

SEQ ID NO: 835446 - protein, 9 aa, Homo Sapiens
PPLSVVCRF

SEQ ID NO: 835447 - protein, 9 aa, Homo Sapiens
RYFKHYRSI

SEQ ID NO: 835448 - protein, 9 aa, Homo Sapiens
CDWMYKHRF

SEQ ID NO: 835449 - protein, 9 aa, Homo Sapiens
VTFPAPFYY

SEQ ID NO: 835450 - protein, 9 aa, Homo Sapiens
MPSTLGLQC

SEQ ID NO: 835451 - protein, 9 aa, Homo Sapiens
DKNKKTSKS

SEQ ID NO: 835452 - protein, 9 aa, Homo Sapiens
VHRIIHTGE

SEQ ID NO: 835453 - protein, 9 aa, Homo Sapiens
IKLLKILRK

SEQ ID NO: 835454 - protein, 9 aa, Homo Sapiens
FVEDLLPNS

SEQ ID NO: 835455 - protein, 9 aa, Homo Sapiens
GQRPSLYWW

SEQ ID NO: 835456 - protein, 9 aa, Homo Sapiens
AEPLLVSFP

SEQ ID NO: 835457 - protein, 9 aa, Homo Sapiens
ETISDVLNN

SEQ ID NO: 835458 - protein, 9 aa, Homo Sapiens
PISKKPTML

SEQ ID NO: 835459 - protein, 9 aa, Homo Sapiens
AQQVEEWWA

SEQ ID NO: 835460 - protein, 9 aa, Homo Sapiens
CPAHAGAVA

SEQ ID NO: 835461 - protein, 9 aa, Homo Sapiens
MLTFTIALT

SEQ ID NO: 835462 - protein, 9 aa, Homo Sapiens
NKETSPESS

SEQ ID NO: 835463 - protein, 9 aa, Homo Sapiens
SHLKKIYTV

SEQ ID NO: 835464 - protein, 9 aa, Homo Sapiens
GSIVANVVS

SEQ ID NO: 835465 - protein, 9 aa, Homo Sapiens
RVALAKYHL

SEQ ID NO: 835466 - protein, 9 aa, Homo Sapiens
ICVAFTTFL

SEQ ID NO: 835467 - protein, 9 aa, Homo Sapiens
FASPTYDLS

SEQ ID NO: 835468 - protein, 9 aa, Homo Sapiens
IIIAKPEMN

SEQ ID NO: 835469 - protein, 9 aa, Homo Sapiens
IFDKFSSYD

SEQ ID NO: 835470 - protein, 9 aa, Homo Sapiens
CECKDCWIT

SEQ ID NO: 835471 - protein, 9 aa, Homo Sapiens
FLTIRMIMK

SEQ ID NO: 835472 - protein, 9 aa, Homo Sapiens
LPLFQLVFS

SEQ ID NO: 835473 - protein, 9 aa, Homo Sapiens
TSLLTFWHP

SEQ ID NO: 835474 - protein, 9 aa, Homo Sapiens
SKEVLKEFI

SEQ ID NO: 835475 - protein, 9 aa, Homo Sapiens
GSCIFLLLI

SEQ ID NO: 835476 - protein, 9 aa, Homo Sapiens
KPLVLGAMV

SEQ ID NO: 835477 - protein, 9 aa, Homo Sapiens
EIFTTEILG

SEQ ID NO: 835478 - protein, 9 aa, Homo Sapiens
NQPDILDPA

SEQ ID NO: 835479 - protein, 9 aa, Homo Sapiens
HLVKHQKLH

SEQ ID NO: 835480 - protein, 9 aa, Homo Sapiens
IRKCLTKCA

SEQ ID NO: 835481 - protein, 9 aa, Homo Sapiens
RLTCHILLH

SEQ ID NO: 835482 - protein, 9 aa, Homo Sapiens
DTPSFNKLY

SEQ ID NO: 835483 - protein, 9 aa, Homo Sapiens
SIVYTKEGE

SEQ ID NO: 835484 - protein, 9 aa, Homo Sapiens
AMALPFFNI

SEQ ID NO: 835485 - protein, 9 aa, Homo Sapiens
IRTCINPVH

SEQ ID NO: 835486 - protein, 9 aa, Homo Sapiens
LRLNGCHLP

SEQ ID NO: 835487 - protein, 9 aa, Homo Sapiens
QGLMNSGKV

SEQ ID NO: 835488 - protein, 9 aa, Homo Sapiens
IHLPCVQVL

SEQ ID NO: 835489 - protein, 9 aa, Homo Sapiens
PKASEEPRK

SEQ ID NO: 835490 - protein, 9 aa, Homo Sapiens
EQGFYVRLI

SEQ ID NO: 835491 - protein, 9 aa, Homo Sapiens
ANYVDPIFY

SEQ ID NO: 835492 - protein, 9 aa, Homo Sapiens
PDPVGEEFH

SEQ ID NO: 835493 - protein, 9 aa, Homo Sapiens
DLHDYVNVP

SEQ ID NO: 835494 - protein, 9 aa, Homo Sapiens
NTNFKKIYW

SEQ ID NO: 835495 - protein, 9 aa, Homo Sapiens
KRFTPRKGD

SEQ ID NO: 835496 - protein, 9 aa, Homo Sapiens
HGALSPSGS

SEQ ID NO: 835497 - protein, 9 aa, Homo Sapiens
KTVIQTIHK

SEQ ID NO: 835498 - protein, 9 aa, Homo Sapiens
PEYTVTSTV

SEQ ID NO: 835499 - protein, 9 aa, Homo Sapiens
IMYSFRNKD

SEQ ID NO: 835500 - protein, 9 aa, Homo Sapiens
FRAQQCAKH

SEQ ID NO: 835501 - protein, 9 aa, Homo Sapiens
KIKTKRNTL

SEQ ID NO: 835502 - protein, 9 aa, Homo Sapiens
STSIKGTSQ

SEQ ID NO: 835503 - protein, 9 aa, Homo Sapiens
QLFATYCLL

SEQ ID NO: 835504 - protein, 9 aa, Homo Sapiens
ATKVEDMMK

SEQ ID NO: 835505 - protein, 9 aa, Homo Sapiens
ARKIIIRCK

SEQ ID NO: 835506 - protein, 9 aa, Homo Sapiens
RRKYKSSGL

SEQ ID NO: 835507 - protein, 9 aa, Homo Sapiens
GQISERKKW

SEQ ID NO: 835508 - protein, 9 aa, Homo Sapiens
FSVDYDNTT

SEQ ID NO: 835509 - protein, 9 aa, Homo Sapiens
TTNMKTADK

SEQ ID NO: 835510 - protein, 9 aa, Homo Sapiens
VLRHQYLRR

SEQ ID NO: 835511 - protein, 9 aa, Homo Sapiens
QTLVTPAAL

SEQ ID NO: 835512 - protein, 9 aa, Homo Sapiens
WQGLLITTS

SEQ ID NO: 835513 - protein, 9 aa, Homo Sapiens
TYPYVEVNS

SEQ ID NO: 835514 - protein, 9 aa, Homo Sapiens
VVSAPLEAA

SEQ ID NO: 835515 - protein, 9 aa, Homo Sapiens
VLAGLRGLP

SEQ ID NO: 835516 - protein, 9 aa, Homo Sapiens
ALMTLGPTV

SEQ ID NO: 835517 - protein, 9 aa, Homo Sapiens
NTSSRARSF

SEQ ID NO: 835518 - protein, 9 aa, Homo Sapiens
DVALLMGVA

SEQ ID NO: 835519 - protein, 9 aa, Homo Sapiens
GIRLTAAEE

SEQ ID NO: 835520 - protein, 9 aa, Homo Sapiens
SIRARFGGW

SEQ ID NO: 835521 - protein, 9 aa, Homo Sapiens
FGKDTKDRD

SEQ ID NO: 835522 - protein, 9 aa, Homo Sapiens
HNECIGETR

SEQ ID NO: 835523 - protein, 9 aa, Homo Sapiens
TYVTLKVQD

SEQ ID NO: 835524 - protein, 9 aa, Homo Sapiens
KTLFARCIL

SEQ ID NO: 835525 - protein, 9 aa, Homo Sapiens
PGLLQASVI

SEQ ID NO: 835526 - protein, 9 aa, Homo Sapiens
SPRAANNVP

SEQ ID NO: 835527 - protein, 9 aa, Homo Sapiens
FWSGNYRFD

SEQ ID NO: 835528 - protein, 9 aa, Homo Sapiens
IDRIKYNVE

SEQ ID NO: 835529 - protein, 9 aa, Homo Sapiens
GRGIVIYFA

SEQ ID NO: 835530 - protein, 9 aa, Homo Sapiens
CEQGLVGFG

SEQ ID NO: 835531 - protein, 9 aa, Homo Sapiens
MQAKRRYFI

SEQ ID NO: 835532 - protein, 9 aa, Homo Sapiens
DNTYVFGRV

SEQ ID NO: 835533 - protein, 9 aa, Homo Sapiens
CLIMGLFNG

SEQ ID NO: 835534 - protein, 9 aa, Homo Sapiens
KIGNLFVIV

SEQ ID NO: 835535 - protein, 9 aa, Homo Sapiens
LAGLEVLCT

SEQ ID NO: 835536 - protein, 9 aa, Homo Sapiens
QKMNPPKFF

SEQ ID NO: 835537 - protein, 9 aa, Homo Sapiens
FSNKVLEKA

SEQ ID NO: 835538 - protein, 9 aa, Homo Sapiens
AGDHAHGLL

SEQ ID NO: 835539 - protein, 9 aa, Homo Sapiens
VHGYIFVYS

SEQ ID NO: 835540 - protein, 9 aa, Homo Sapiens
VPPKKSGIL

SEQ ID NO: 835541 - protein, 9 aa, Homo Sapiens
LSAYQLYQD

SEQ ID NO: 835542 - protein, 9 aa, Homo Sapiens
SIAYSPKLE

SEQ ID NO: 835543 - protein, 9 aa, Homo Sapiens
RRGGGGHNA

SEQ ID NO: 835544 - protein, 9 aa, Homo Sapiens
IPASPRLRH

SEQ ID NO: 835545 - protein, 9 aa, Homo Sapiens
TELNDRSKD

SEQ ID NO: 835546 - protein, 9 aa, Homo Sapiens
SGQPPMDSA

SEQ ID NO: 835547 - protein, 9 aa, Homo Sapiens
ERDNVFGKT

SEQ ID NO: 835548 - protein, 9 aa, Homo Sapiens
GNAIISNVE

SEQ ID NO: 835549 - protein, 9 aa, Homo Sapiens
DFLTRQNKL

SEQ ID NO: 835550 - protein, 9 aa, Homo Sapiens
KPDSVLKME

SEQ ID NO: 835551 - protein, 9 aa, Homo Sapiens
KIVCNPGQG

SEQ ID NO: 835552 - protein, 9 aa, Homo Sapiens
DEVAKSTHY

SEQ ID NO: 835553 - protein, 9 aa, Homo Sapiens
HPKMSLAQK

SEQ ID NO: 835554 - protein, 9 aa, Homo Sapiens
LTEHEKIHP

SEQ ID NO: 835555 - protein, 9 aa, Homo Sapiens
EVLFNVIKA

SEQ ID NO: 835556 - protein, 9 aa, Homo Sapiens
VYDLIDLMQ

SEQ ID NO: 835557 - protein, 9 aa, Homo Sapiens
FTDCYGYRD

SEQ ID NO: 835558 - protein, 9 aa, Homo Sapiens
YSKTQNLSK

SEQ ID NO: 835559 - protein, 9 aa, Homo Sapiens
CVIGYPYYS

SEQ ID NO: 835560 - protein, 9 aa, Homo Sapiens
RRHKTDPSA

SEQ ID NO: 835561 - protein, 9 aa, Homo Sapiens
LNGHKFDFI

SEQ ID NO: 835562 - protein, 9 aa, Homo Sapiens
FVDSEDPHL

SEQ ID NO: 835563 - protein, 9 aa, Homo Sapiens
AIFGPDGSQ

SEQ ID NO: 835564 - protein, 9 aa, Homo Sapiens
LDKLDVKQT

SEQ ID NO: 835565 - protein, 9 aa, Homo Sapiens
KQGLSLIDY

SEQ ID NO: 835566 - protein, 9 aa, Homo Sapiens
EAHKIMKYL

SEQ ID NO: 835567 - protein, 9 aa, Homo Sapiens
TKAVREMLA

SEQ ID NO: 835568 - protein, 9 aa, Homo Sapiens
MQAMWLGYP

SEQ ID NO: 835569 - protein, 9 aa, Homo Sapiens
EICQLLGAP

SEQ ID NO: 835570 - protein, 9 aa, Homo Sapiens
HNKSSIHFY

SEQ ID NO: 835571 - protein, 9 aa, Homo Sapiens
QPSPDQSGI

SEQ ID NO: 835572 - protein, 9 aa, Homo Sapiens
IQEKHNHQS

SEQ ID NO: 835573 - protein, 9 aa, Homo Sapiens
GLACEAINQ

SEQ ID NO: 835574 - protein, 9 aa, Homo Sapiens
LPAMAIFKL

SEQ ID NO: 835575 - protein, 9 aa, Homo Sapiens
LLTAKLFLL

SEQ ID NO: 835576 - protein, 9 aa, Homo Sapiens
AHKYKKQID

SEQ ID NO: 835577 - protein, 9 aa, Homo Sapiens
HPLENNPSL

SEQ ID NO: 835578 - protein, 9 aa, Homo Sapiens
NILKELTSN

SEQ ID NO: 835579 - protein, 9 aa, Homo Sapiens
ILSMQGQIT

SEQ ID NO: 835580 - protein, 9 aa, Homo Sapiens
DGVLEAKKI

SEQ ID NO: 835581 - protein, 9 aa, Homo Sapiens
HPFEPNTFR

SEQ ID NO: 835582 - protein, 9 aa, Homo Sapiens
DRIMDFRRV

SEQ ID NO: 835583 - protein, 9 aa, Homo Sapiens
DYMEIFMEE

SEQ ID NO: 835584 - protein, 9 aa, Homo Sapiens
LSMARMEAS

SEQ ID NO: 835585 - protein, 9 aa, Homo Sapiens
ENKPGKPQK

SEQ ID NO: 835586 - protein, 9 aa, Homo Sapiens
LYDVNTSEI

SEQ ID NO: 835587 - protein, 9 aa, Homo Sapiens
LFFPQRDST

SEQ ID NO: 835588 - protein, 9 aa, Homo Sapiens
QNVSQENMC

SEQ ID NO: 835589 - protein, 9 aa, Homo Sapiens
IGDSSEEVD

SEQ ID NO: 835590 - protein, 9 aa, Homo Sapiens
VKDKFDYGN

SEQ ID NO: 835591 - protein, 9 aa, Homo Sapiens
LTASFDSYY

SEQ ID NO: 835592 - protein, 9 aa, Homo Sapiens
FYLKQSVSI

SEQ ID NO: 835593 - protein, 9 aa, Homo Sapiens
RKMHADMDG

SEQ ID NO: 835594 - protein, 9 aa, Homo Sapiens
LQAIQIIQE

SEQ ID NO: 835595 - protein, 9 aa, Homo Sapiens
LVPTQSVPS

SEQ ID NO: 835596 - protein, 9 aa, Homo Sapiens
HSIVISSLK

SEQ ID NO: 835597 - protein, 9 aa, Homo Sapiens
GSSSPQKRS

SEQ ID NO: 835598 - protein, 9 aa, Homo Sapiens
IMYSLRNKN

SEQ ID NO: 835599 - protein, 9 aa, Homo Sapiens
KALLHPLES

SEQ ID NO: 835600 - protein, 9 aa, Homo Sapiens
QIAEFLGFI

SEQ ID NO: 835601 - protein, 9 aa, Homo Sapiens
TPCYACPQS

SEQ ID NO: 835602 - protein, 9 aa, Homo Sapiens
KLINRNISS

SEQ ID NO: 835603 - protein, 9 aa, Homo Sapiens
KFIDNRPGK

SEQ ID NO: 835604 - protein, 9 aa, Homo Sapiens
INHNSLDIL

SEQ ID NO: 835605 - protein, 9 aa, Homo Sapiens
APQNLPSTG

SEQ ID NO: 835606 - protein, 9 aa, Homo Sapiens
ISEALKKCG

SEQ ID NO: 835607 - protein, 9 aa, Homo Sapiens
NLNNFISMD

SEQ ID NO: 835608 - protein, 9 aa, Homo Sapiens
KECVQKVEE

SEQ ID NO: 835609 - protein, 9 aa, Homo Sapiens
CQCEMVLAN

SEQ ID NO: 835610 - protein, 9 aa, Homo Sapiens
HLHNLENSA

SEQ ID NO: 835611 - protein, 9 aa, Homo Sapiens
FETAGLNKL

SEQ ID NO: 835612 - protein, 9 aa, Homo Sapiens
PNYATSTTI

SEQ ID NO: 835613 - protein, 9 aa, Homo Sapiens
QKDLQNFLK

SEQ ID NO: 835614 - protein, 9 aa, Homo Sapiens
EGGINKEIL

SEQ ID NO: 835615 - protein, 9 aa, Homo Sapiens
DRMQTEITA

SEQ ID NO: 835616 - protein, 9 aa, Homo Sapiens
LLNYQVTLH

SEQ ID NO: 835617 - protein, 9 aa, Homo Sapiens
FKLVSTFNN

SEQ ID NO: 835618 - protein, 9 aa, Homo Sapiens
KKTRQYLNY

SEQ ID NO: 835619 - protein, 9 aa, Homo Sapiens
KIYLSNHYK

SEQ ID NO: 835620 - protein, 9 aa, Homo Sapiens
SQIPYIEQV

SEQ ID NO: 835621 - protein, 9 aa, Homo Sapiens
ANVLARLQQ

SEQ ID NO: 835622 - protein, 9 aa, Homo Sapiens
LVLDDTNHA

SEQ ID NO: 835623 - protein, 9 aa, Homo Sapiens
SSTINTHKR

SEQ ID NO: 835624 - protein, 9 aa, Homo Sapiens
KECRPKFAN

SEQ ID NO: 835625 - protein, 9 aa, Homo Sapiens
GDKNRLAGE

SEQ ID NO: 835626 - protein, 9 aa, Homo Sapiens
NMAGNVAEH

SEQ ID NO: 835627 - protein, 9 aa, Homo Sapiens
KELNVAHNR

SEQ ID NO: 835628 - protein, 9 aa, Homo Sapiens
ERVIGSTSG

SEQ ID NO: 835629 - protein, 9 aa, Homo Sapiens
FVPEPSNLQ

SEQ ID NO: 835630 - protein, 9 aa, Homo Sapiens
DEWQASEEN

SEQ ID NO: 835631 - protein, 9 aa, Homo Sapiens
TLNYCNLED

SEQ ID NO: 835632 - protein, 9 aa, Homo Sapiens
PHHCSFSKH

SEQ ID NO: 835633 - protein, 9 aa, Homo Sapiens
CNAIKINIF

SEQ ID NO: 835634 - protein, 9 aa, Homo Sapiens
GIKNAEIYN

SEQ ID NO: 835635 - protein, 9 aa, Homo Sapiens
QSNSHANIL

SEQ ID NO: 835636 - protein, 9 aa, Homo Sapiens
ESGINFLEK

SEQ ID NO: 835637 - protein, 9 aa, Homo Sapiens
RINFDVARP

SEQ ID NO: 835638 - protein, 9 aa, Homo Sapiens
LFSIRKGYR

SEQ ID NO: 835639 - protein, 9 aa, Homo Sapiens
LIDKETDDR

SEQ ID NO: 835640 - protein, 9 aa, Homo Sapiens
CVCCGSCRD

SEQ ID NO: 835641 - protein, 9 aa, Homo Sapiens
QNAAAAAFQ

SEQ ID NO: 835642 - protein, 9 aa, Homo Sapiens
TRTVVCVWE

SEQ ID NO: 835643 - protein, 9 aa, Homo Sapiens
LNDLDKSVE

SEQ ID NO: 835644 - protein, 9 aa, Homo Sapiens
NLETFTMGS

SEQ ID NO: 835645 - protein, 9 aa, Homo Sapiens
NNYFTLDAQ

SEQ ID NO: 835646 - protein, 9 aa, Homo Sapiens
DLPYNEMET

SEQ ID NO: 835647 - protein, 9 aa, Homo Sapiens
EVVEVKSWQ

SEQ ID NO: 835648 - protein, 9 aa, Homo Sapiens
MSYKRRIST

SEQ ID NO: 835649 - protein, 9 aa, Homo Sapiens
GEECIFYDY

SEQ ID NO: 835650 - protein, 9 aa, Homo Sapiens
NVCTFQKRE

SEQ ID NO: 835651 - protein, 9 aa, Homo Sapiens
LRQFSTEIT

SEQ ID NO: 835652 - protein, 9 aa, Homo Sapiens
YINNVVSDC

SEQ ID NO: 835653 - protein, 9 aa, Homo Sapiens
NLDAKKYER

SEQ ID NO: 835654 - protein, 9 aa, Homo Sapiens
AQRLLQNVN

SEQ ID NO: 835655 - protein, 9 aa, Homo Sapiens
VDSTLRYFC

SEQ ID NO: 835656 - protein, 9 aa, Homo Sapiens
AIIVNNHTS

SEQ ID NO: 835657 - protein, 9 aa, Homo Sapiens
ARGTPQPSS

SEQ ID NO: 835658 - protein, 9 aa, Homo Sapiens
APTREGVDN

SEQ ID NO: 835659 - protein, 9 aa, Homo Sapiens
SAFLHCIRQ

SEQ ID NO: 835660 - protein, 9 aa, Homo Sapiens
TQLLTLIFS

SEQ ID NO: 835661 - protein, 9 aa, Homo Sapiens
VNVASRIDS

SEQ ID NO: 835662 - protein, 9 aa, Homo Sapiens
GGHRPHKGP

SEQ ID NO: 835663 - protein, 9 aa, Homo Sapiens
CLCVCTCVC

SEQ ID NO: 835664 - protein, 9 aa, Homo Sapiens
AFDWDVWEK

SEQ ID NO: 835665 - protein, 9 aa, Homo Sapiens
IFLFFETGS

SEQ ID NO: 835666 - protein, 9 aa, Homo Sapiens
DLVDLVREG

SEQ ID NO: 835667 - protein, 9 aa, Homo Sapiens
IQSGRMTAA

SEQ ID NO: 835668 - protein, 9 aa, Homo Sapiens
KVVKSRSNS

SEQ ID NO: 835669 - protein, 9 aa, Homo Sapiens
SDLVRVDII

SEQ ID NO: 835670 - protein, 9 aa, Homo Sapiens
AKTEAPGGV

SEQ ID NO: 835671 - protein, 9 aa, Homo Sapiens
QLFVVNQVK

SEQ ID NO: 835672 - protein, 9 aa, Homo Sapiens
SMKYSCNPG

SEQ ID NO: 835673 - protein, 9 aa, Homo Sapiens
RTFNEFLER

SEQ ID NO: 835674 - protein, 9 aa, Homo Sapiens
EHQKRQKIN

SEQ ID NO: 835675 - protein, 9 aa, Homo Sapiens
SDKHFMQNV

SEQ ID NO: 835676 - protein, 9 aa, Homo Sapiens
SNGYSVTSF

SEQ ID NO: 835677 - protein, 9 aa, Homo Sapiens
EGKLWSWGQ

SEQ ID NO: 835678 - protein, 9 aa, Homo Sapiens
MLITCLQSG

SEQ ID NO: 835679 - protein, 9 aa, Homo Sapiens
ILLDQKDKE

SEQ ID NO: 835680 - protein, 9 aa, Homo Sapiens
KGVVFVTKE

SEQ ID NO: 835681 - protein, 9 aa, Homo Sapiens
FDIDRGRQL

SEQ ID NO: 835682 - protein, 9 aa, Homo Sapiens
RHTQKMQHN

SEQ ID NO: 835683 - protein, 9 aa, Homo Sapiens
NGNSFMVVN

SEQ ID NO: 835684 - protein, 9 aa, Homo Sapiens
EAGVLKMTI

SEQ ID NO: 835685 - protein, 9 aa, Homo Sapiens
KYLQTDDRV

SEQ ID NO: 835686 - protein, 9 aa, Homo Sapiens
IIELLDSKL

SEQ ID NO: 835687 - protein, 9 aa, Homo Sapiens
PDRPTKAPV

SEQ ID NO: 835688 - protein, 9 aa, Homo Sapiens
NLENYLESI

SEQ ID NO: 835689 - protein, 9 aa, Homo Sapiens
KARKGYGMM

SEQ ID NO: 835690 - protein, 9 aa, Homo Sapiens
YKFLVGCVP

SEQ ID NO: 835691 - protein, 9 aa, Homo Sapiens
PSVGVKAGR

SEQ ID NO: 835692 - protein, 9 aa, Homo Sapiens
LMGLMFASV

SEQ ID NO: 835693 - protein, 9 aa, Homo Sapiens
EGTETVEEV

SEQ ID NO: 835694 - protein, 9 aa, Homo Sapiens
DAILYYKIF

SEQ ID NO: 835695 - protein, 9 aa, Homo Sapiens
IVCNPGQGL

SEQ ID NO: 835696 - protein, 9 aa, Homo Sapiens
SPKLPSGFP

SEQ ID NO: 835697 - protein, 9 aa, Homo Sapiens
IYNRYQKEM

SEQ ID NO: 835698 - protein, 9 aa, Homo Sapiens
PKGPMSIPI

SEQ ID NO: 835699 - protein, 9 aa, Homo Sapiens
FVPYIFLFI

SEQ ID NO: 835700 - protein, 9 aa, Homo Sapiens
SKKGDVWNM

SEQ ID NO: 835701 - protein, 9 aa, Homo Sapiens
PQEINCKEA

SEQ ID NO: 835702 - protein, 9 aa, Homo Sapiens
KMQNTGDEE

SEQ ID NO: 835703 - protein, 9 aa, Homo Sapiens
AAIIVGVEL

SEQ ID NO: 835704 - protein, 9 aa, Homo Sapiens
SELPVKLLL

SEQ ID NO: 835705 - protein, 9 aa, Homo Sapiens
LEKNILKEL

SEQ ID NO: 835706 - protein, 9 aa, Homo Sapiens
SDNTSQERD

SEQ ID NO: 835707 - protein, 9 aa, Homo Sapiens
SSSLATLPI

SEQ ID NO: 835708 - protein, 9 aa, Homo Sapiens
FYSHPHFVN

SEQ ID NO: 835709 - protein, 9 aa, Homo Sapiens
FTLLSELVP

SEQ ID NO: 835710 - protein, 9 aa, Homo Sapiens
FVDEEEETG

SEQ ID NO: 835711 - protein, 9 aa, Homo Sapiens
EGDTNSNDG

SEQ ID NO: 835712 - protein, 9 aa, Homo Sapiens
CCAVCPHPP

SEQ ID NO: 835713 - protein, 9 aa, Homo Sapiens
GALSLINNF

SEQ ID NO: 835714 - protein, 9 aa, Homo Sapiens
LRKVIYCRK

SEQ ID NO: 835715 - protein, 9 aa, Homo Sapiens
RYELCKQGK

SEQ ID NO: 835716 - protein, 9 aa, Homo Sapiens
LKLMEEQYR

SEQ ID NO: 835717 - protein, 9 aa, Homo Sapiens
SSHRYGQYT

SEQ ID NO: 835718 - protein, 9 aa, Homo Sapiens
IQLKLENIQ

SEQ ID NO: 835719 - protein, 9 aa, Homo Sapiens
ASKHAFART

SEQ ID NO: 835720 - protein, 9 aa, Homo Sapiens
YTIKTDVFS

SEQ ID NO: 835721 - protein, 9 aa, Homo Sapiens
DYCGIHLSS

SEQ ID NO: 835722 - protein, 9 aa, Homo Sapiens
GNTFEKLGI

SEQ ID NO: 835723 - protein, 9 aa, Homo Sapiens
VRGMAVREF

SEQ ID NO: 835724 - protein, 9 aa, Homo Sapiens
KDIAEIDDL

SEQ ID NO: 835725 - protein, 9 aa, Homo Sapiens
VSSYLILRN

SEQ ID NO: 835726 - protein, 9 aa, Homo Sapiens
DDNINPPAL

SEQ ID NO: 835727 - protein, 9 aa, Homo Sapiens
YLSVQRDAS

SEQ ID NO: 835728 - protein, 9 aa, Homo Sapiens
RMRTLADVL

SEQ ID NO: 835729 - protein, 9 aa, Homo Sapiens
YRFMSSHIK

SEQ ID NO: 835730 - protein, 9 aa, Homo Sapiens
KPRVATPDV

SEQ ID NO: 835731 - protein, 9 aa, Homo Sapiens
GTLSLTLHL

SEQ ID NO: 835732 - protein, 9 aa, Homo Sapiens
PTCYLAPQN

SEQ ID NO: 835733 - protein, 9 aa, Homo Sapiens
CKTPHKSER

SEQ ID NO: 835734 - protein, 9 aa, Homo Sapiens
KVKPEQLTC

SEQ ID NO: 835735 - protein, 9 aa, Homo Sapiens
PKYFDWNLK

SEQ ID NO: 835736 - protein, 9 aa, Homo Sapiens
LLLQMAKSV

SEQ ID NO: 835737 - protein, 9 aa, Homo Sapiens
INEMVIYLM

SEQ ID NO: 835738 - protein, 9 aa, Homo Sapiens
ASSPSVSGP

SEQ ID NO: 835739 - protein, 9 aa, Homo Sapiens
KGLYFAKLY

SEQ ID NO: 835740 - protein, 9 aa, Homo Sapiens
RNMKNVFFP

SEQ ID NO: 835741 - protein, 9 aa, Homo Sapiens
SNQSRVKCG

SEQ ID NO: 835742 - protein, 9 aa, Homo Sapiens
KSVSSTNFS

SEQ ID NO: 835743 - protein, 9 aa, Homo Sapiens
RMRRGGDEY

SEQ ID NO: 835744 - protein, 9 aa, Homo Sapiens
VMSVAFSPT

SEQ ID NO: 835745 - protein, 9 aa, Homo Sapiens
CNPGQGLGD

SEQ ID NO: 835746 - protein, 9 aa, Homo Sapiens
SEWDALFDI

SEQ ID NO: 835747 - protein, 9 aa, Homo Sapiens
FSACSDSWQ

SEQ ID NO: 835748 - protein, 9 aa, Homo Sapiens
ANQEDKGNC

SEQ ID NO: 835749 - protein, 9 aa, Homo Sapiens
CMHVAENVS

SEQ ID NO: 835750 - protein, 9 aa, Homo Sapiens
NEGLLKVAQ

SEQ ID NO: 835751 - protein, 9 aa, Homo Sapiens
ESYMSTLLA

SEQ ID NO: 835752 - protein, 9 aa, Homo Sapiens
QSKVMGEPH

SEQ ID NO: 835753 - protein, 9 aa, Homo Sapiens
LVREGLSAS

SEQ ID NO: 835754 - protein, 9 aa, Homo Sapiens
NNNTYWCLC

SEQ ID NO: 835755 - protein, 9 aa, Homo Sapiens
DHFQVDNLD

SEQ ID NO: 835756 - protein, 9 aa, Homo Sapiens
RCLGQKPVL

SEQ ID NO: 835757 - protein, 9 aa, Homo Sapiens
ADKSTQLTN

SEQ ID NO: 835758 - protein, 9 aa, Homo Sapiens
IINLKSDEH

SEQ ID NO: 835759 - protein, 9 aa, Homo Sapiens
EVGWDLGRL

SEQ ID NO: 835760 - protein, 9 aa, Homo Sapiens
GGFGVVFKA

SEQ ID NO: 835761 - protein, 9 aa, Homo Sapiens
DNEKQKKKE

SEQ ID NO: 835762 - protein, 9 aa, Homo Sapiens
ELNDRSKDL

SEQ ID NO: 835763 - protein, 9 aa, Homo Sapiens
FKIYFLQLL

SEQ ID NO: 835764 - protein, 9 aa, Homo Sapiens
CNTPPPPYK

SEQ ID NO: 835765 - protein, 9 aa, Homo Sapiens
GLATVFWYN

SEQ ID NO: 835766 - protein, 9 aa, Homo Sapiens
IKCFMDDVS

SEQ ID NO: 835767 - protein, 9 aa, Homo Sapiens
IEITIIKIE

SEQ ID NO: 835768 - protein, 9 aa, Homo Sapiens
AGTKAVREM

SEQ ID NO: 835769 - protein, 9 aa, Homo Sapiens
QQQAQQQLP

SEQ ID NO: 835770 - protein, 9 aa, Homo Sapiens
HVGQSGAKV

SEQ ID NO: 835771 - protein, 9 aa, Homo Sapiens
NYFITHSLK

SEQ ID NO: 835772 - protein, 9 aa, Homo Sapiens
AQIGLSVGL

SEQ ID NO: 835773 - protein, 9 aa, Homo Sapiens
DNVVLDVGS

SEQ ID NO: 835774 - protein, 9 aa, Homo Sapiens
LSVVKGIYL

SEQ ID NO: 835775 - protein, 9 aa, Homo Sapiens
RLQSDFTAL

SEQ ID NO: 835776 - protein, 9 aa, Homo Sapiens
WPMKAQHLL

SEQ ID NO: 835777 - protein, 9 aa, Homo Sapiens
LQTIHFSPD

SEQ ID NO: 835778 - protein, 9 aa, Homo Sapiens
LGNEKLKNT

SEQ ID NO: 835779 - protein, 9 aa, Homo Sapiens
EKVTKEKTS

SEQ ID NO: 835780 - protein, 9 aa, Homo Sapiens
VENDIPFEK

SEQ ID NO: 835781 - protein, 9 aa, Homo Sapiens
MKTKEPVKN

SEQ ID NO: 835782 - protein, 9 aa, Homo Sapiens
FKFLFTCLN

SEQ ID NO: 835783 - protein, 9 aa, Homo Sapiens
QPQALYQNN

SEQ ID NO: 835784 - protein, 9 aa, Homo Sapiens
TLPDEMGDM

SEQ ID NO: 835785 - protein, 9 aa, Homo Sapiens
GDKLTGVCY

SEQ ID NO: 835786 - protein, 9 aa, Homo Sapiens
GVELFDEKL

SEQ ID NO: 835787 - protein, 9 aa, Homo Sapiens
EPPRSATVT

SEQ ID NO: 835788 - protein, 9 aa, Homo Sapiens
NYSMELQVW

SEQ ID NO: 835789 - protein, 9 aa, Homo Sapiens
CIGLIVHEE

SEQ ID NO: 835790 - protein, 9 aa, Homo Sapiens
CDEIYGTLH

SEQ ID NO: 835791 - protein, 9 aa, Homo Sapiens
ETFTSDNNE

SEQ ID NO: 835792 - protein, 9 aa, Homo Sapiens
LPPPPDLIP

SEQ ID NO: 835793 - protein, 9 aa, Homo Sapiens
PQPLLHSFL

SEQ ID NO: 835794 - protein, 9 aa, Homo Sapiens
LVEAIYGTP

SEQ ID NO: 835795 - protein, 9 aa, Homo Sapiens
TAAEERDKR

SEQ ID NO: 835796 - protein, 9 aa, Homo Sapiens
KMPYSPGLQ

SEQ ID NO: 835797 - protein, 9 aa, Homo Sapiens
IQYIILRSG

SEQ ID NO: 835798 - protein, 9 aa, Homo Sapiens
QTIQNVVLM

SEQ ID NO: 835799 - protein, 9 aa, Homo Sapiens
PPPPMEPNH

SEQ ID NO: 835800 - protein, 9 aa, Homo Sapiens
LRAESVTNT

SEQ ID NO: 835801 - protein, 9 aa, Homo Sapiens
GQRGATLGE

SEQ ID NO: 835802 - protein, 9 aa, Homo Sapiens
QIAGGQVMT

SEQ ID NO: 835803 - protein, 9 aa, Homo Sapiens
CYENMKRAL

SEQ ID NO: 835804 - protein, 9 aa, Homo Sapiens
LTASTLAHL

SEQ ID NO: 835805 - protein, 9 aa, Homo Sapiens
IDLRGISDL

SEQ ID NO: 835806 - protein, 9 aa, Homo Sapiens
TYSPKMEDW

SEQ ID NO: 835807 - protein, 9 aa, Homo Sapiens
ALAGTPWPS

SEQ ID NO: 835808 - protein, 9 aa, Homo Sapiens
DRERCSAYF

SEQ ID NO: 835809 - protein, 9 aa, Homo Sapiens
NWWVMARVI

SEQ ID NO: 835810 - protein, 9 aa, Homo Sapiens
LGSWNPTSQ

SEQ ID NO: 835811 - protein, 9 aa, Homo Sapiens
DEASFQTEV

SEQ ID NO: 835812 - protein, 9 aa, Homo Sapiens
FHAEQDKFL

SEQ ID NO: 835813 - protein, 9 aa, Homo Sapiens
NNNFSLSSK

SEQ ID NO: 835814 - protein, 9 aa, Homo Sapiens
CIFPSIYIN

SEQ ID NO: 835815 - protein, 9 aa, Homo Sapiens
APEKTIDQL

SEQ ID NO: 835816 - protein, 9 aa, Homo Sapiens
LLEETTVVY

SEQ ID NO: 835817 - protein, 9 aa, Homo Sapiens
YKYCDAKSW

SEQ ID NO: 835818 - protein, 9 aa, Homo Sapiens
QLVHEGYTF

SEQ ID NO: 835819 - protein, 9 aa, Homo Sapiens
ELWELRGHR

SEQ ID NO: 835820 - protein, 9 aa, Homo Sapiens
LDPWEHQWN

SEQ ID NO: 835821 - protein, 9 aa, Homo Sapiens
DTEWNMFID

SEQ ID NO: 835822 - protein, 9 aa, Homo Sapiens
SPMMCPQAF

SEQ ID NO: 835823 - protein, 9 aa, Homo Sapiens
TRWDEASFQ

SEQ ID NO: 835824 - protein, 9 aa, Homo Sapiens
YHYLVSQGK

SEQ ID NO: 835825 - protein, 9 aa, Homo Sapiens
QAILGSVER

SEQ ID NO: 835826 - protein, 9 aa, Homo Sapiens
MAHLSGTVG

SEQ ID NO: 835827 - protein, 9 aa, Homo Sapiens
PKKCFPEPH

SEQ ID NO: 835828 - protein, 9 aa, Homo Sapiens
IFAIKYWAK

SEQ ID NO: 835829 - protein, 9 aa, Homo Sapiens
LKCHVFCCE

SEQ ID NO: 835830 - protein, 9 aa, Homo Sapiens
QLKSKLLDH

SEQ ID NO: 835831 - protein, 9 aa, Homo Sapiens
GLSFETTKE

SEQ ID NO: 835832 - protein, 9 aa, Homo Sapiens
SVRNSKIDI

SEQ ID NO: 835833 - protein, 9 aa, Homo Sapiens
YLVKAVNYT

SEQ ID NO: 835834 - protein, 9 aa, Homo Sapiens
QARRHHQFI

SEQ ID NO: 835835 - protein, 9 aa, Homo Sapiens
GLQESHLKD

SEQ ID NO: 835836 - protein, 9 aa, Homo Sapiens
TVSFPKMSV

SEQ ID NO: 835837 - protein, 9 aa, Homo Sapiens
CQIQEPGSS

SEQ ID NO: 835838 - protein, 9 aa, Homo Sapiens
QKRDQYLQV

SEQ ID NO: 835839 - protein, 9 aa, Homo Sapiens
ILYYKIFSD

SEQ ID NO: 835840 - protein, 9 aa, Homo Sapiens
TVLVFPYTL

SEQ ID NO: 835841 - protein, 9 aa, Homo Sapiens
MQLLYCIAL

SEQ ID NO: 835842 - protein, 9 aa, Homo Sapiens
VEQRKKICE

SEQ ID NO: 835843 - protein, 9 aa, Homo Sapiens
HGIGTDSWN

SEQ ID NO: 835844 - protein, 9 aa, Homo Sapiens
LPSIANMIN

SEQ ID NO: 835845 - protein, 9 aa, Homo Sapiens
VTHRPPRAG

SEQ ID NO: 835846 - protein, 9 aa, Homo Sapiens
WSLSCTVVE

SEQ ID NO: 835847 - protein, 9 aa, Homo Sapiens
LECKYITKN

SEQ ID NO: 835848 - protein, 9 aa, Homo Sapiens
SRSPRASSS

SEQ ID NO: 835849 - protein, 9 aa, Homo Sapiens
GLGTGPEKR

SEQ ID NO: 835850 - protein, 9 aa, Homo Sapiens
SLARHWIIH

SEQ ID NO: 835851 - protein, 9 aa, Homo Sapiens
FQNDQNSSG

SEQ ID NO: 835852 - protein, 9 aa, Homo Sapiens
MEYSGDLNQ

SEQ ID NO: 835853 - protein, 9 aa, Homo Sapiens
LNNYLHFAQ

SEQ ID NO: 835854 - protein, 9 aa, Homo Sapiens
ELSEAQDMY

SEQ ID NO: 835855 - protein, 9 aa, Homo Sapiens
IEGHDFVLQ

SEQ ID NO: 835856 - protein, 9 aa, Homo Sapiens
IQVEIPDFS

SEQ ID NO: 835857 - protein, 9 aa, Homo Sapiens
YSSDVQITL

SEQ ID NO: 835858 - protein, 9 aa, Homo Sapiens
FENETEETT

SEQ ID NO: 835859 - protein, 9 aa, Homo Sapiens
LIHSVIVIL

SEQ ID NO: 835860 - protein, 9 aa, Homo Sapiens
SWNSYSALS

SEQ ID NO: 835861 - protein, 9 aa, Homo Sapiens
PDDLSYCWL

SEQ ID NO: 835862 - protein, 9 aa, Homo Sapiens
VFWYNNRER

SEQ ID NO: 835863 - protein, 9 aa, Homo Sapiens
EEIFPQIKE

SEQ ID NO: 835864 - protein, 9 aa, Homo Sapiens
GKLLNKEWK

SEQ ID NO: 835865 - protein, 9 aa, Homo Sapiens
VMVRAMEGK

SEQ ID NO: 835866 - protein, 9 aa, Homo Sapiens
SSDYYIWNY

SEQ ID NO: 835867 - protein, 9 aa, Homo Sapiens
NLGNYTVIA

SEQ ID NO: 835868 - protein, 9 aa, Homo Sapiens
PELPEQTTT

SEQ ID NO: 835869 - protein, 9 aa, Homo Sapiens
IFAFKDLQR

SEQ ID NO: 835870 - protein, 9 aa, Homo Sapiens
NQTLDLIRP

SEQ ID NO: 835871 - protein, 9 aa, Homo Sapiens
LDKLLHYQP

SEQ ID NO: 835872 - protein, 9 aa, Homo Sapiens
GDDGVLLYP

SEQ ID NO: 835873 - protein, 9 aa, Homo Sapiens
SITKETTTV

SEQ ID NO: 835874 - protein, 9 aa, Homo Sapiens
VSNLSHKLI

SEQ ID NO: 835875 - protein, 9 aa, Homo Sapiens
VPAAVCHHH

SEQ ID NO: 835876 - protein, 9 aa, Homo Sapiens
RSKGDRCDN

SEQ ID NO: 835877 - protein, 9 aa, Homo Sapiens
KKDPVKIVQ

SEQ ID NO: 835878 - protein, 9 aa, Homo Sapiens
IPLVLEAAT

SEQ ID NO: 835879 - protein, 9 aa, Homo Sapiens
RIMDFRRVP

SEQ ID NO: 835880 - protein, 9 aa, Homo Sapiens
RKGYRRITY

SEQ ID NO: 835881 - protein, 9 aa, Homo Sapiens
LINWWVMAR

SEQ ID NO: 835882 - protein, 9 aa, Homo Sapiens
SLSKQNLVD

SEQ ID NO: 835883 - protein, 9 aa, Homo Sapiens
RISLFSCLE

SEQ ID NO: 835884 - protein, 9 aa, Homo Sapiens
DNDEDTTPS

SEQ ID NO: 835885 - protein, 9 aa, Homo Sapiens
VRLWRDSKE

SEQ ID NO: 835886 - protein, 9 aa, Homo Sapiens
FFRIKCFMD

SEQ ID NO: 835887 - protein, 9 aa, Homo Sapiens
DFLRACFVW

SEQ ID NO: 835888 - protein, 9 aa, Homo Sapiens
QEWQRFGVR

SEQ ID NO: 835889 - protein, 9 aa, Homo Sapiens
TDKAVNPIW

SEQ ID NO: 835890 - protein, 9 aa, Homo Sapiens
TMLRVGLIL

SEQ ID NO: 835891 - protein, 9 aa, Homo Sapiens
KLSKRLTHK

SEQ ID NO: 835892 - protein, 9 aa, Homo Sapiens
DGDLSPTKD

SEQ ID NO: 835893 - protein, 9 aa, Homo Sapiens
FQLNRIKAR

SEQ ID NO: 835894 - protein, 9 aa, Homo Sapiens
KKEVSGDKS

SEQ ID NO: 835895 - protein, 9 aa, Homo Sapiens
PHKSLREWK

SEQ ID NO: 835896 - protein, 9 aa, Homo Sapiens
KPVQVQQYI

SEQ ID NO: 835897 - protein, 9 aa, Homo Sapiens
IHLPYWRQK

SEQ ID NO: 835898 - protein, 9 aa, Homo Sapiens
MFLSVTLVT

SEQ ID NO: 835899 - protein, 9 aa, Homo Sapiens
HSNLYRRDV

SEQ ID NO: 835900 - protein, 9 aa, Homo Sapiens
EEEEDAGED

SEQ ID NO: 835901 - protein, 9 aa, Homo Sapiens
IPPLFSYCL

SEQ ID NO: 835902 - protein, 9 aa, Homo Sapiens
QMYQTQVSD

SEQ ID NO: 835903 - protein, 9 aa, Homo Sapiens
VILIAYMFL

SEQ ID NO: 835904 - protein, 9 aa, Homo Sapiens
INVNHEFNL

SEQ ID NO: 835905 - protein, 9 aa, Homo Sapiens
KKCLEEKNK

SEQ ID NO: 835906 - protein, 9 aa, Homo Sapiens
MCLSQLFIQ

SEQ ID NO: 835907 - protein, 9 aa, Homo Sapiens
RHQIIHSGD

SEQ ID NO: 835908 - protein, 9 aa, Homo Sapiens
KSGNENGEL

SEQ ID NO: 835909 - protein, 9 aa, Homo Sapiens
LQSDAPKMH

SEQ ID NO: 835910 - protein, 9 aa, Homo Sapiens
VDIAKKHII

SEQ ID NO: 835911 - protein, 9 aa, Homo Sapiens
EDEDDLNKP

SEQ ID NO: 835912 - protein, 9 aa, Homo Sapiens
NNLSPKENI

SEQ ID NO: 835913 - protein, 9 aa, Homo Sapiens
ICKPLNYVV

SEQ ID NO: 835914 - protein, 9 aa, Homo Sapiens
AKLAFAVEP

SEQ ID NO: 835915 - protein, 9 aa, Homo Sapiens
NKDTSENAG

SEQ ID NO: 835916 - protein, 9 aa, Homo Sapiens
KLEILEKCK

SEQ ID NO: 835917 - protein, 9 aa, Homo Sapiens
CLDYKPIQS

SEQ ID NO: 835918 - protein, 9 aa, Homo Sapiens
IKFYFNRNP

SEQ ID NO: 835919 - protein, 9 aa, Homo Sapiens
APPLALNAV

SEQ ID NO: 835920 - protein, 9 aa, Homo Sapiens
CAKTDPSEQ

SEQ ID NO: 835921 - protein, 9 aa, Homo Sapiens
IFEHKGCQI

SEQ ID NO: 835922 - protein, 9 aa, Homo Sapiens
LQYELREYE

SEQ ID NO: 835923 - protein, 9 aa, Homo Sapiens
ELYGPNKRG

SEQ ID NO: 835924 - protein, 9 aa, Homo Sapiens
NKTNILEEK

SEQ ID NO: 835925 - protein, 9 aa, Homo Sapiens
IGQGYCVFL

SEQ ID NO: 835926 - protein, 9 aa, Homo Sapiens
SAFNWVKAS

SEQ ID NO: 835927 - protein, 9 aa, Homo Sapiens
GQPDNDIDR

SEQ ID NO: 835928 - protein, 9 aa, Homo Sapiens
YGQQAWVLQ

SEQ ID NO: 835929 - protein, 9 aa, Homo Sapiens
KCGTFGATY

SEQ ID NO: 835930 - protein, 9 aa, Homo Sapiens
EIIKLENMQ

SEQ ID NO: 835931 - protein, 9 aa, Homo Sapiens
FILTCMLGY

SEQ ID NO: 835932 - protein, 9 aa, Homo Sapiens
NHIQVPESI

SEQ ID NO: 835933 - protein, 9 aa, Homo Sapiens
LVMAAYDKR

SEQ ID NO: 835934 - protein, 9 aa, Homo Sapiens
ILNEIYAGV

SEQ ID NO: 835935 - protein, 9 aa, Homo Sapiens
PFQDMHITQ

SEQ ID NO: 835936 - protein, 9 aa, Homo Sapiens
LTDVLLQTK

SEQ ID NO: 835937 - protein, 9 aa, Homo Sapiens
LSSLATGAL

SEQ ID NO: 835938 - protein, 9 aa, Homo Sapiens
FYVPHAETE

SEQ ID NO: 835939 - protein, 9 aa, Homo Sapiens
VASEESQIL

SEQ ID NO: 835940 - protein, 9 aa, Homo Sapiens
EKKNKGKRK

SEQ ID NO: 835941 - protein, 9 aa, Homo Sapiens
KGKCPDNGW

SEQ ID NO: 835942 - protein, 9 aa, Homo Sapiens
EGDNKMVTT

SEQ ID NO: 835943 - protein, 9 aa, Homo Sapiens
LSGHINIFV

SEQ ID NO: 835944 - protein, 9 aa, Homo Sapiens
VAGLRWFSM

SEQ ID NO: 835945 - protein, 9 aa, Homo Sapiens
WTIWCGARP

SEQ ID NO: 835946 - protein, 9 aa, Homo Sapiens
WKQPKGINS

SEQ ID NO: 835947 - protein, 9 aa, Homo Sapiens
AMVIYTSGT

SEQ ID NO: 835948 - protein, 9 aa, Homo Sapiens
DNESWYLDD

SEQ ID NO: 835949 - protein, 9 aa, Homo Sapiens
VTVGTAEEF

SEQ ID NO: 835950 - protein, 9 aa, Homo Sapiens
HTYSNRTLM

SEQ ID NO: 835951 - protein, 9 aa, Homo Sapiens
HTDITMKHK

SEQ ID NO: 835952 - protein, 9 aa, Homo Sapiens
SVLSTSTGF

SEQ ID NO: 835953 - protein, 9 aa, Homo Sapiens
IPRAVPSAE

SEQ ID NO: 835954 - protein, 9 aa, Homo Sapiens
DIIVVVIVI

SEQ ID NO: 835955 - protein, 9 aa, Homo Sapiens
AFINQAFLQ

SEQ ID NO: 835956 - protein, 9 aa, Homo Sapiens
RFVAKSGAC

SEQ ID NO: 835957 - protein, 9 aa, Homo Sapiens
CPGQYTISM

SEQ ID NO: 835958 - protein, 9 aa, Homo Sapiens
AHANGRAQY

SEQ ID NO: 835959 - protein, 9 aa, Homo Sapiens
ISGFLFLRL

SEQ ID NO: 835960 - protein, 9 aa, Homo Sapiens
ISQRDNLRL

SEQ ID NO: 835961 - protein, 9 aa, Homo Sapiens
DILVNWLHI

SEQ ID NO: 835962 - protein, 9 aa, Homo Sapiens
AKLHEIELK

SEQ ID NO: 835963 - protein, 9 aa, Homo Sapiens
ASDGVQNLF

SEQ ID NO: 835964 - protein, 9 aa, Homo Sapiens
YLFLRNFSF

SEQ ID NO: 835965 - protein, 9 aa, Homo Sapiens
LEPYMDDNF

SEQ ID NO: 835966 - protein, 9 aa, Homo Sapiens
HNLENSAFT

SEQ ID NO: 835967 - protein, 9 aa, Homo Sapiens
PMLAAPQIP

SEQ ID NO: 835968 - protein, 9 aa, Homo Sapiens
SLSNHQIFH

SEQ ID NO: 835969 - protein, 9 aa, Homo Sapiens
LSKEERDPV

SEQ ID NO: 835970 - protein, 9 aa, Homo Sapiens
LHLYVLVST

SEQ ID NO: 835971 - protein, 9 aa, Homo Sapiens
ELKDDRTET

SEQ ID NO: 835972 - protein, 9 aa, Homo Sapiens
LTPPKMDIP

SEQ ID NO: 835973 - protein, 9 aa, Homo Sapiens
RIYIQGVDA

SEQ ID NO: 835974 - protein, 9 aa, Homo Sapiens
TTILCLSLD

SEQ ID NO: 835975 - protein, 9 aa, Homo Sapiens
ADAYSSFCS

SEQ ID NO: 835976 - protein, 9 aa, Homo Sapiens
DSRITRNFS

SEQ ID NO: 835977 - protein, 9 aa, Homo Sapiens
PKREPAQKT

SEQ ID NO: 835978 - protein, 9 aa, Homo Sapiens
RKIIIRCKR

SEQ ID NO: 835979 - protein, 9 aa, Homo Sapiens
VSSDLQKEV

SEQ ID NO: 835980 - protein, 9 aa, Homo Sapiens
RTKNGTSSK

SEQ ID NO: 835981 - protein, 9 aa, Homo Sapiens
VVSIVALVV

SEQ ID NO: 835982 - protein, 9 aa, Homo Sapiens
VTQGYNETD

SEQ ID NO: 835983 - protein, 9 aa, Homo Sapiens
EQQNVLKVL

SEQ ID NO: 835984 - protein, 9 aa, Homo Sapiens
NMMVLIENK

SEQ ID NO: 835985 - protein, 9 aa, Homo Sapiens
PVPPTQHFP

SEQ ID NO: 835986 - protein, 9 aa, Homo Sapiens
KDTPRKQLQ

SEQ ID NO: 835987 - protein, 9 aa, Homo Sapiens
ENSYGQERC

SEQ ID NO: 835988 - protein, 9 aa, Homo Sapiens
NNINIRHIA

SEQ ID NO: 835989 - protein, 9 aa, Homo Sapiens
LGAMVHRDE

SEQ ID NO: 835990 - protein, 9 aa, Homo Sapiens
SNPTELQNH

SEQ ID NO: 835991 - protein, 9 aa, Homo Sapiens
MESAASSQT

SEQ ID NO: 835992 - protein, 9 aa, Homo Sapiens
DVERDEDAV

SEQ ID NO: 835993 - protein, 9 aa, Homo Sapiens
YAKKKRIHQ

SEQ ID NO: 835994 - protein, 9 aa, Homo Sapiens
FQFVDEEEE

SEQ ID NO: 835995 - protein, 9 aa, Homo Sapiens
NTHEIESII

SEQ ID NO: 835996 - protein, 9 aa, Homo Sapiens
RRVASVLAK

SEQ ID NO: 835997 - protein, 9 aa, Homo Sapiens
VATPDVVSK

SEQ ID NO: 835998 - protein, 9 aa, Homo Sapiens
LFLTSNRSV

SEQ ID NO: 835999 - protein, 9 aa, Homo Sapiens
TCLANVLAR

SEQ ID NO: 836000 - protein, 9 aa, Homo Sapiens
KAPQSLLTM

SEQ ID NO: 836001 - protein, 9 aa, Homo Sapiens
IIVYLYTKK

SEQ ID NO: 836002 - protein, 9 aa, Homo Sapiens
RSDRDKLVI

SEQ ID NO: 836003 - protein, 9 aa, Homo Sapiens
LYSFAATVV

SEQ ID NO: 836004 - protein, 9 aa, Homo Sapiens
SYLIQHKII

SEQ ID NO: 836005 - protein, 9 aa, Homo Sapiens
TDVFSYALC

SEQ ID NO: 836006 - protein, 9 aa, Homo Sapiens
NESDLPYNE

SEQ ID NO: 836007 - protein, 9 aa, Homo Sapiens
ENIYIIIYF

SEQ ID NO: 836008 - protein, 9 aa, Homo Sapiens
KERPKRNVI

SEQ ID NO: 836009 - protein, 9 aa, Homo Sapiens
NCSNTTSNS

SEQ ID NO: 836010 - protein, 9 aa, Homo Sapiens
RLMWYKHKG

SEQ ID NO: 836011 - protein, 9 aa, Homo Sapiens
EDEMDIYGY

SEQ ID NO: 836012 - protein, 9 aa, Homo Sapiens
RYRKCPFNS

SEQ ID NO: 836013 - protein, 9 aa, Homo Sapiens
GVMLDGATF

SEQ ID NO: 836014 - protein, 9 aa, Homo Sapiens
DRDLVCSNS

SEQ ID NO: 836015 - protein, 9 aa, Homo Sapiens
SWKNGILPA

SEQ ID NO: 836016 - protein, 9 aa, Homo Sapiens
EELEVKIIE

SEQ ID NO: 836017 - protein, 9 aa, Homo Sapiens
WSPVLSGGI

SEQ ID NO: 836018 - protein, 9 aa, Homo Sapiens
GIITVKQVY

SEQ ID NO: 836019 - protein, 9 aa, Homo Sapiens
IIRPSNGIW

SEQ ID NO: 836020 - protein, 9 aa, Homo Sapiens
NNAIQGGVE

SEQ ID NO: 836021 - protein, 9 aa, Homo Sapiens
CTLENVQVL

SEQ ID NO: 836022 - protein, 9 aa, Homo Sapiens
LYKENKTKE

SEQ ID NO: 836023 - protein, 9 aa, Homo Sapiens
LMSKMRDMR

SEQ ID NO: 836024 - protein, 9 aa, Homo Sapiens
ENTVLNSEV

SEQ ID NO: 836025 - protein, 9 aa, Homo Sapiens
PRLFHQRRH

SEQ ID NO: 836026 - protein, 9 aa, Homo Sapiens
VAKHYLSTL

SEQ ID NO: 836027 - protein, 9 aa, Homo Sapiens
QPQPQQSLA

SEQ ID NO: 836028 - protein, 9 aa, Homo Sapiens
PTFAARPFS

SEQ ID NO: 836029 - protein, 9 aa, Homo Sapiens
GHNLGGLLA

SEQ ID NO: 836030 - protein, 9 aa, Homo Sapiens
CQFEEGQDV

SEQ ID NO: 836031 - protein, 9 aa, Homo Sapiens
NNFSLSSKE

SEQ ID NO: 836032 - protein, 9 aa, Homo Sapiens
VGTQVAAPG

SEQ ID NO: 836033 - protein, 9 aa, Homo Sapiens
HLLVHKLPE

SEQ ID NO: 836034 - protein, 9 aa, Homo Sapiens
KARQEIKNK

SEQ ID NO: 836035 - protein, 9 aa, Homo Sapiens
YKNNFDNLD

SEQ ID NO: 836036 - protein, 9 aa, Homo Sapiens
INQMFQKEQ

SEQ ID NO: 836037 - protein, 9 aa, Homo Sapiens
LLVAMPLLP

SEQ ID NO: 836038 - protein, 9 aa, Homo Sapiens
IQRQSDTVY

SEQ ID NO: 836039 - protein, 9 aa, Homo Sapiens
TEWPFHFYY

SEQ ID NO: 836040 - protein, 9 aa, Homo Sapiens
EVAIQIIDK

SEQ ID NO: 836041 - protein, 9 aa, Homo Sapiens
WVPYPGCGS

SEQ ID NO: 836042 - protein, 9 aa, Homo Sapiens
KRVKKETFR

SEQ ID NO: 836043 - protein, 9 aa, Homo Sapiens
TVYGLNKFR

SEQ ID NO: 836044 - protein, 9 aa, Homo Sapiens
WSFTLYMTY

SEQ ID NO: 836045 - protein, 9 aa, Homo Sapiens
NSKLRFHQI

SEQ ID NO: 836046 - protein, 9 aa, Homo Sapiens
IEWIDYALA

SEQ ID NO: 836047 - protein, 9 aa, Homo Sapiens
GITHLKLIA

SEQ ID NO: 836048 - protein, 9 aa, Homo Sapiens
SEKETMPFL

SEQ ID NO: 836049 - protein, 9 aa, Homo Sapiens
KVDPSKLMT

SEQ ID NO: 836050 - protein, 9 aa, Homo Sapiens
GALILATNI

SEQ ID NO: 836051 - protein, 9 aa, Homo Sapiens
PRPAFSLMG

SEQ ID NO: 836052 - protein, 9 aa, Homo Sapiens
LEANNLGFN

SEQ ID NO: 836053 - protein, 9 aa, Homo Sapiens
GPISQRDNL

SEQ ID NO: 836054 - protein, 9 aa, Homo Sapiens
QMLISTPTA

SEQ ID NO: 836055 - protein, 9 aa, Homo Sapiens
EDKPGRMNM

SEQ ID NO: 836056 - protein, 9 aa, Homo Sapiens
EGLMLKNCN

SEQ ID NO: 836057 - protein, 9 aa, Homo Sapiens
LFPPRNPST

SEQ ID NO: 836058 - protein, 9 aa, Homo Sapiens
YSVEVIITA

SEQ ID NO: 836059 - protein, 9 aa, Homo Sapiens
LPRRVAVPV

SEQ ID NO: 836060 - protein, 9 aa, Homo Sapiens
LSRKRRQNA

SEQ ID NO: 836061 - protein, 9 aa, Homo Sapiens
RINLAAAAH

SEQ ID NO: 836062 - protein, 9 aa, Homo Sapiens
KFREQILRV

SEQ ID NO: 836063 - protein, 9 aa, Homo Sapiens
TWFQILLNT

SEQ ID NO: 836064 - protein, 9 aa, Homo Sapiens
CSSDNLFKK

SEQ ID NO: 836065 - protein, 9 aa, Homo Sapiens
NSITRNLSY

SEQ ID NO: 836066 - protein, 9 aa, Homo Sapiens
LVYNASVIY

SEQ ID NO: 836067 - protein, 9 aa, Homo Sapiens
KVVDERRYW

SEQ ID NO: 836068 - protein, 9 aa, Homo Sapiens
ADEVHYLLQ

SEQ ID NO: 836069 - protein, 9 aa, Homo Sapiens
RERRLKQNL

SEQ ID NO: 836070 - protein, 9 aa, Homo Sapiens
GSNGSGCTL

SEQ ID NO: 836071 - protein, 9 aa, Homo Sapiens
NKKAHPDME

SEQ ID NO: 836072 - protein, 9 aa, Homo Sapiens
TITNLNKAI

SEQ ID NO: 836073 - protein, 9 aa, Homo Sapiens
VESITYIRA

SEQ ID NO: 836074 - protein, 9 aa, Homo Sapiens
CAVCPHPPT

SEQ ID NO: 836075 - protein, 9 aa, Homo Sapiens
IYHDQVPDL

SEQ ID NO: 836076 - protein, 9 aa, Homo Sapiens
ARSPDPSSP

SEQ ID NO: 836077 - protein, 9 aa, Homo Sapiens
SGSEKKKKS

SEQ ID NO: 836078 - protein, 9 aa, Homo Sapiens
KNCSRWKCI

SEQ ID NO: 836079 - protein, 9 aa, Homo Sapiens
TVASFSNKI

SEQ ID NO: 836080 - protein, 9 aa, Homo Sapiens
PILAPFLEY

SEQ ID NO: 836081 - protein, 9 aa, Homo Sapiens
DVVYEAPQE

SEQ ID NO: 836082 - protein, 9 aa, Homo Sapiens
GRKRTLPAF

SEQ ID NO: 836083 - protein, 9 aa, Homo Sapiens
LFYLGAGDR

SEQ ID NO: 836084 - protein, 9 aa, Homo Sapiens
ATRGIKNRS

SEQ ID NO: 836085 - protein, 9 aa, Homo Sapiens
IQGVLCGAV

SEQ ID NO: 836086 - protein, 9 aa, Homo Sapiens
KEDKFWMNK

SEQ ID NO: 836087 - protein, 9 aa, Homo Sapiens
CHKVQCFVV

SEQ ID NO: 836088 - protein, 9 aa, Homo Sapiens
IKTTDFGLS

SEQ ID NO: 836089 - protein, 9 aa, Homo Sapiens
VPLNTAGHP

SEQ ID NO: 836090 - protein, 9 aa, Homo Sapiens
LKLQEAAND

SEQ ID NO: 836091 - protein, 9 aa, Homo Sapiens
SKLQNQIAA

SEQ ID NO: 836092 - protein, 9 aa, Homo Sapiens
QRAKRDLPK

SEQ ID NO: 836093 - protein, 9 aa, Homo Sapiens
LLGSSNYRA

SEQ ID NO: 836094 - protein, 9 aa, Homo Sapiens
WWLNGPLVH

SEQ ID NO: 836095 - protein, 9 aa, Homo Sapiens
GVTHRPPRA

SEQ ID NO: 836096 - protein, 9 aa, Homo Sapiens
TRELFSECF

SEQ ID NO: 836097 - protein, 9 aa, Homo Sapiens
QPSPPSSPL

SEQ ID NO: 836098 - protein, 9 aa, Homo Sapiens
RSELYLQDT

SEQ ID NO: 836099 - protein, 9 aa, Homo Sapiens
RKSITCQKV

SEQ ID NO: 836100 - protein, 9 aa, Homo Sapiens
YTKEFFRRS

SEQ ID NO: 836101 - protein, 9 aa, Homo Sapiens
FSDLTNHKI

SEQ ID NO: 836102 - protein, 9 aa, Homo Sapiens
RGFVALQTS

SEQ ID NO: 836103 - protein, 9 aa, Homo Sapiens
GRCHGCLKW

SEQ ID NO: 836104 - protein, 9 aa, Homo Sapiens
FQLKADRDY

SEQ ID NO: 836105 - protein, 9 aa, Homo Sapiens
PSNVKMEKL

SEQ ID NO: 836106 - protein, 9 aa, Homo Sapiens
SSSLFHPEK

SEQ ID NO: 836107 - protein, 9 aa, Homo Sapiens
IHFSPDIFS

SEQ ID NO: 836108 - protein, 9 aa, Homo Sapiens
IRKQILKLL

SEQ ID NO: 836109 - protein, 9 aa, Homo Sapiens
HNGIEACYC

SEQ ID NO: 836110 - protein, 9 aa, Homo Sapiens
ILNNLESKK

SEQ ID NO: 836111 - protein, 9 aa, Homo Sapiens
QSLSWIWKM

SEQ ID NO: 836112 - protein, 9 aa, Homo Sapiens
LEYYDIEAD

SEQ ID NO: 836113 - protein, 9 aa, Homo Sapiens
TIIKIELEE

SEQ ID NO: 836114 - protein, 9 aa, Homo Sapiens
KTFKCHRTY

SEQ ID NO: 836115 - protein, 9 aa, Homo Sapiens
SISLDLTSQ

SEQ ID NO: 836116 - protein, 9 aa, Homo Sapiens
YTHLVDEDT

SEQ ID NO: 836117 - protein, 9 aa, Homo Sapiens
IEEKYSIIN

SEQ ID NO: 836118 - protein, 9 aa, Homo Sapiens
LRHFHYSRK

SEQ ID NO: 836119 - protein, 9 aa, Homo Sapiens
GFPSNVLQD

SEQ ID NO: 836120 - protein, 9 aa, Homo Sapiens
QTILFYDRV

SEQ ID NO: 836121 - protein, 9 aa, Homo Sapiens
RFNSDVGMF

SEQ ID NO: 836122 - protein, 9 aa, Homo Sapiens
MSEKKKCKN

SEQ ID NO: 836123 - protein, 9 aa, Homo Sapiens
ASRRRNAPL

SEQ ID NO: 836124 - protein, 9 aa, Homo Sapiens
GYNYYIKMS

SEQ ID NO: 836125 - protein, 9 aa, Homo Sapiens
TINEVITEN

SEQ ID NO: 836126 - protein, 9 aa, Homo Sapiens
QGEIYVPEL

SEQ ID NO: 836127 - protein, 9 aa, Homo Sapiens
INTVLVFPY

SEQ ID NO: 836128 - protein, 9 aa, Homo Sapiens
KPLRASTAS

SEQ ID NO: 836129 - protein, 9 aa, Homo Sapiens
SIGVWQDII

SEQ ID NO: 836130 - protein, 9 aa, Homo Sapiens
APQTLEVIY

SEQ ID NO: 836131 - protein, 9 aa, Homo Sapiens
GVWYSEPTS

SEQ ID NO: 836132 - protein, 9 aa, Homo Sapiens
PGCQKPLPR

SEQ ID NO: 836133 - protein, 9 aa, Homo Sapiens
VHAERVQAA

SEQ ID NO: 836134 - protein, 9 aa, Homo Sapiens
RSAKKYVID

SEQ ID NO: 836135 - protein, 9 aa, Homo Sapiens
KLLDIRNKR

SEQ ID NO: 836136 - protein, 9 aa, Homo Sapiens
RIGFYQIRG

SEQ ID NO: 836137 - protein, 9 aa, Homo Sapiens
NKLNILDSK

SEQ ID NO: 836138 - protein, 9 aa, Homo Sapiens
CLDCPSFSQ

SEQ ID NO: 836139 - protein, 9 aa, Homo Sapiens
VERHFRTTG

SEQ ID NO: 836140 - protein, 9 aa, Homo Sapiens
AFIQPEIMD

SEQ ID NO: 836141 - protein, 9 aa, Homo Sapiens
GSHEGPQLP

SEQ ID NO: 836142 - protein, 9 aa, Homo Sapiens
PDSRDYPAS

SEQ ID NO: 836143 - protein, 9 aa, Homo Sapiens
YKIRLNNAI

SEQ ID NO: 836144 - protein, 9 aa, Homo Sapiens
EPPNFVVKP

SEQ ID NO: 836145 - protein, 9 aa, Homo Sapiens
RSGKLLNKE

SEQ ID NO: 836146 - protein, 9 aa, Homo Sapiens
FLWKKAQIL

SEQ ID NO: 836147 - protein, 9 aa, Homo Sapiens
FSCGSGLIR

SEQ ID NO: 836148 - protein, 9 aa, Homo Sapiens
VECGKGFQH

SEQ ID NO: 836149 - protein, 9 aa, Homo Sapiens
RPKKTRAMC

SEQ ID NO: 836150 - protein, 9 aa, Homo Sapiens
PIFCLFADN

SEQ ID NO: 836151 - protein, 9 aa, Homo Sapiens
SPQTSSLPL

SEQ ID NO: 836152 - protein, 9 aa, Homo Sapiens
KELKTTRFC

SEQ ID NO: 836153 - protein, 9 aa, Homo Sapiens
QTVSERNDQ

SEQ ID NO: 836154 - protein, 9 aa, Homo Sapiens
SALTVHCKV

SEQ ID NO: 836155 - protein, 9 aa, Homo Sapiens
LLLTYMAKQ

SEQ ID NO: 836156 - protein, 9 aa, Homo Sapiens
LNVDMWDKP

SEQ ID NO: 836157 - protein, 9 aa, Homo Sapiens
RAHEEERRR

SEQ ID NO: 836158 - protein, 9 aa, Homo Sapiens
FGSIFVLTC

SEQ ID NO: 836159 - protein, 9 aa, Homo Sapiens
GDLGPWNQY

SEQ ID NO: 836160 - protein, 9 aa, Homo Sapiens
GVCFGAGCG

SEQ ID NO: 836161 - protein, 9 aa, Homo Sapiens
ESKLDVLLA

SEQ ID NO: 836162 - protein, 9 aa, Homo Sapiens
YKNSKPDSV

SEQ ID NO: 836163 - protein, 9 aa, Homo Sapiens
LCFSFIIGV

SEQ ID NO: 836164 - protein, 9 aa, Homo Sapiens
LLRSFKVTK

SEQ ID NO: 836165 - protein, 9 aa, Homo Sapiens
GDALRNTKQ

SEQ ID NO: 836166 - protein, 9 aa, Homo Sapiens
ELVMAAYDK

SEQ ID NO: 836167 - protein, 9 aa, Homo Sapiens
GVVEEWWSE

SEQ ID NO: 836168 - protein, 9 aa, Homo Sapiens
LDASENRLE

SEQ ID NO: 836169 - protein, 9 aa, Homo Sapiens
ELAWLQHQK

SEQ ID NO: 836170 - protein, 9 aa, Homo Sapiens
PCLALPVKL

SEQ ID NO: 836171 - protein, 9 aa, Homo Sapiens
SALQSINKW

SEQ ID NO: 836172 - protein, 9 aa, Homo Sapiens
LLLFIIMFI

SEQ ID NO: 836173 - protein, 9 aa, Homo Sapiens
YKTGDIVDI

SEQ ID NO: 836174 - protein, 9 aa, Homo Sapiens
EDTEQDKDE

SEQ ID NO: 836175 - protein, 9 aa, Homo Sapiens
KIFFESLEE

SEQ ID NO: 836176 - protein, 9 aa, Homo Sapiens
SENVISQPD

SEQ ID NO: 836177 - protein, 9 aa, Homo Sapiens
PLVSITTRL

SEQ ID NO: 836178 - protein, 9 aa, Homo Sapiens
ILQGLRSQP

SEQ ID NO: 836179 - protein, 9 aa, Homo Sapiens
IEEEVAELF

SEQ ID NO: 836180 - protein, 9 aa, Homo Sapiens
VTDINYHAP

SEQ ID NO: 836181 - protein, 9 aa, Homo Sapiens
GGSGKGTTS

SEQ ID NO: 836182 - protein, 9 aa, Homo Sapiens
ASPAPAAEP

SEQ ID NO: 836183 - protein, 9 aa, Homo Sapiens
MDFINDATN

SEQ ID NO: 836184 - protein, 9 aa, Homo Sapiens
EQARLRLYT

SEQ ID NO: 836185 - protein, 9 aa, Homo Sapiens
KSTFSILNF

SEQ ID NO: 836186 - protein, 9 aa, Homo Sapiens
HIRRFVHDQ

SEQ ID NO: 836187 - protein, 9 aa, Homo Sapiens
IDGPISQRD

SEQ ID NO: 836188 - protein, 9 aa, Homo Sapiens
SKLASNART

SEQ ID NO: 836189 - protein, 9 aa, Homo Sapiens
IWKGQAVTL

SEQ ID NO: 836190 - protein, 9 aa, Homo Sapiens
ERKEHIKEY

SEQ ID NO: 836191 - protein, 9 aa, Homo Sapiens
LSETCTYLY

SEQ ID NO: 836192 - protein, 9 aa, Homo Sapiens
PLPGRLGPW

SEQ ID NO: 836193 - protein, 9 aa, Homo Sapiens
IAPCHLRAS

SEQ ID NO: 836194 - protein, 9 aa, Homo Sapiens
QYRTTDFVV

SEQ ID NO: 836195 - protein, 9 aa, Homo Sapiens
SPGEDGSLL

SEQ ID NO: 836196 - protein, 9 aa, Homo Sapiens
PGQGLSMAR

SEQ ID NO: 836197 - protein, 9 aa, Homo Sapiens
ITRVQRPIV

SEQ ID NO: 836198 - protein, 9 aa, Homo Sapiens
EKPINWQRA

SEQ ID NO: 836199 - protein, 9 aa, Homo Sapiens
DYFPPPPPH

SEQ ID NO: 836200 - protein, 9 aa, Homo Sapiens
SLSKYEAIM

SEQ ID NO: 836201 - protein, 9 aa, Homo Sapiens
YPSQDNARL

SEQ ID NO: 836202 - protein, 9 aa, Homo Sapiens
VVKIEFEDV

SEQ ID NO: 836203 - protein, 9 aa, Homo Sapiens
DLKVVAHNK

SEQ ID NO: 836204 - protein, 9 aa, Homo Sapiens
EPNHPFYSN

SEQ ID NO: 836205 - protein, 9 aa, Homo Sapiens
TLFFRIKCF

SEQ ID NO: 836206 - protein, 9 aa, Homo Sapiens
VTEVCRFLF

SEQ ID NO: 836207 - protein, 9 aa, Homo Sapiens
LSQLFIQVE

SEQ ID NO: 836208 - protein, 9 aa, Homo Sapiens
QGNQKDSIK

SEQ ID NO: 836209 - protein, 9 aa, Homo Sapiens
LQSDFTALL

SEQ ID NO: 836210 - protein, 9 aa, Homo Sapiens
MVLGVKGNY

SEQ ID NO: 836211 - protein, 9 aa, Homo Sapiens
TEAGLNELS

SEQ ID NO: 836212 - protein, 9 aa, Homo Sapiens
VDLVSIPGM

SEQ ID NO: 836213 - protein, 9 aa, Homo Sapiens
TRLKKLLLV

SEQ ID NO: 836214 - protein, 9 aa, Homo Sapiens
NVMWMITIS

SEQ ID NO: 836215 - protein, 9 aa, Homo Sapiens
IDQFGFNNE

SEQ ID NO: 836216 - protein, 9 aa, Homo Sapiens
KITRKPVTV

SEQ ID NO: 836217 - protein, 9 aa, Homo Sapiens
EFRRKYEEA

SEQ ID NO: 836218 - protein, 9 aa, Homo Sapiens
TNCIDVDKC

SEQ ID NO: 836219 - protein, 9 aa, Homo Sapiens
ISLAIYFRC

SEQ ID NO: 836220 - protein, 9 aa, Homo Sapiens
HCLHSKAVA

SEQ ID NO: 836221 - protein, 9 aa, Homo Sapiens
RTVNALKIE

SEQ ID NO: 836222 - protein, 9 aa, Homo Sapiens
ESYPRKTSL

SEQ ID NO: 836223 - protein, 9 aa, Homo Sapiens
EEAQKEVHN

SEQ ID NO: 836224 - protein, 9 aa, Homo Sapiens
VEDSNRGKY

SEQ ID NO: 836225 - protein, 9 aa, Homo Sapiens
NLIMEVYHL

SEQ ID NO: 836226 - protein, 9 aa, Homo Sapiens
DKPFLIFDH

SEQ ID NO: 836227 - protein, 9 aa, Homo Sapiens
VETTKCVVV

SEQ ID NO: 836228 - protein, 9 aa, Homo Sapiens
LQWLGQQGG

SEQ ID NO: 836229 - protein, 9 aa, Homo Sapiens
HETAFSKLS

SEQ ID NO: 836230 - protein, 9 aa, Homo Sapiens
ITVPAYFNE

SEQ ID NO: 836231 - protein, 9 aa, Homo Sapiens
HEGPQLPQY

SEQ ID NO: 836232 - protein, 9 aa, Homo Sapiens
GEQVVSVVN

SEQ ID NO: 836233 - protein, 9 aa, Homo Sapiens
NIIVSSKYT

SEQ ID NO: 836234 - protein, 9 aa, Homo Sapiens
PSVTKLFPE

SEQ ID NO: 836235 - protein, 9 aa, Homo Sapiens
YQALCSIYG

SEQ ID NO: 836236 - protein, 9 aa, Homo Sapiens
VIVTGGKVA

SEQ ID NO: 836237 - protein, 9 aa, Homo Sapiens
ESSQDGDND

SEQ ID NO: 836238 - protein, 9 aa, Homo Sapiens
VAAERRRMH

SEQ ID NO: 836239 - protein, 9 aa, Homo Sapiens
EGQASPVNT

SEQ ID NO: 836240 - protein, 9 aa, Homo Sapiens
CGGSIIGSQ

SEQ ID NO: 836241 - protein, 9 aa, Homo Sapiens
LCDIPAVLR

SEQ ID NO: 836242 - protein, 9 aa, Homo Sapiens
AGGDPGLRG

SEQ ID NO: 836243 - protein, 9 aa, Homo Sapiens
YLPKLTSLY

SEQ ID NO: 836244 - protein, 9 aa, Homo Sapiens
FDQNRLDWK

SEQ ID NO: 836245 - protein, 9 aa, Homo Sapiens
TSDFFPRPS

SEQ ID NO: 836246 - protein, 9 aa, Homo Sapiens
RGKTGSGGV

SEQ ID NO: 836247 - protein, 9 aa, Homo Sapiens
DILAGLPAP

SEQ ID NO: 836248 - protein, 9 aa, Homo Sapiens
GQFGRPVAV

SEQ ID NO: 836249 - protein, 9 aa, Homo Sapiens
ITLYLVVAV

SEQ ID NO: 836250 - protein, 9 aa, Homo Sapiens
SLYQENIEA

SEQ ID NO: 836251 - protein, 9 aa, Homo Sapiens
TSQKDKNCN

SEQ ID NO: 836252 - protein, 9 aa, Homo Sapiens
MYRKYDLTR

SEQ ID NO: 836253 - protein, 9 aa, Homo Sapiens
SMDEEELHP

SEQ ID NO: 836254 - protein, 9 aa, Homo Sapiens
WLEDLLMGM

SEQ ID NO: 836255 - protein, 9 aa, Homo Sapiens
QGIYEHISL

SEQ ID NO: 836256 - protein, 9 aa, Homo Sapiens
LIRPLRIHT

SEQ ID NO: 836257 - protein, 9 aa, Homo Sapiens
GLRWFSMYD

SEQ ID NO: 836258 - protein, 9 aa, Homo Sapiens
KQGKTQQSQ

SEQ ID NO: 836259 - protein, 9 aa, Homo Sapiens
RPKLRKDSA

SEQ ID NO: 836260 - protein, 9 aa, Homo Sapiens
VAIGMKNGK

SEQ ID NO: 836261 - protein, 9 aa, Homo Sapiens
LVGTQSLTY

SEQ ID NO: 836262 - protein, 9 aa, Homo Sapiens
QNVDFRGKT

SEQ ID NO: 836263 - protein, 9 aa, Homo Sapiens
IMHKRPLVY

SEQ ID NO: 836264 - protein, 9 aa, Homo Sapiens
VKSLIQVIG

SEQ ID NO: 836265 - protein, 9 aa, Homo Sapiens
NLHKILRRK

SEQ ID NO: 836266 - protein, 9 aa, Homo Sapiens
PAKVVSHLV

SEQ ID NO: 836267 - protein, 9 aa, Homo Sapiens
TLEAGYTKE

SEQ ID NO: 836268 - protein, 9 aa, Homo Sapiens
LQTGGDPGE

SEQ ID NO: 836269 - protein, 9 aa, Homo Sapiens
LRGNDSVCG

SEQ ID NO: 836270 - protein, 9 aa, Homo Sapiens
RETSSICTE

SEQ ID NO: 836271 - protein, 9 aa, Homo Sapiens
TVPNTPQIF

SEQ ID NO: 836272 - protein, 9 aa, Homo Sapiens
FRKLGFYNS

SEQ ID NO: 836273 - protein, 9 aa, Homo Sapiens
MYGLEYLVY

SEQ ID NO: 836274 - protein, 9 aa, Homo Sapiens
VLASKLKEF

SEQ ID NO: 836275 - protein, 9 aa, Homo Sapiens
LHEEHMAEN

SEQ ID NO: 836276 - protein, 9 aa, Homo Sapiens
VTRLLSQSD

SEQ ID NO: 836277 - protein, 9 aa, Homo Sapiens
LQHQKKHLR

SEQ ID NO: 836278 - protein, 9 aa, Homo Sapiens
LLTEKESKK

SEQ ID NO: 836279 - protein, 9 aa, Homo Sapiens
SGDGHIDPY

SEQ ID NO: 836280 - protein, 9 aa, Homo Sapiens
SSSPPPVQR

SEQ ID NO: 836281 - protein, 9 aa, Homo Sapiens
HPHFVNTVE

SEQ ID NO: 836282 - protein, 9 aa, Homo Sapiens
QFRSILIDK

SEQ ID NO: 836283 - protein, 9 aa, Homo Sapiens
LLTVGSECL

SEQ ID NO: 836284 - protein, 9 aa, Homo Sapiens
ALIGWLFLI

SEQ ID NO: 836285 - protein, 9 aa, Homo Sapiens
SSADNIAVG

SEQ ID NO: 836286 - protein, 9 aa, Homo Sapiens
NKENLPSHF

SEQ ID NO: 836287 - protein, 9 aa, Homo Sapiens
MEVCKENDF

SEQ ID NO: 836288 - protein, 9 aa, Homo Sapiens
MPNGCDLLF

SEQ ID NO: 836289 - protein, 9 aa, Homo Sapiens
VKRTKKRLR

SEQ ID NO: 836290 - protein, 9 aa, Homo Sapiens
TISFGNVDC

SEQ ID NO: 836291 - protein, 9 aa, Homo Sapiens
VAPYNIQYT

SEQ ID NO: 836292 - protein, 9 aa, Homo Sapiens
NCFIMIIIK

SEQ ID NO: 836293 - protein, 9 aa, Homo Sapiens
NRSIRQGFC

SEQ ID NO: 836294 - protein, 9 aa, Homo Sapiens
WRSKSKEEE

SEQ ID NO: 836295 - protein, 9 aa, Homo Sapiens
FLDQASRLD

SEQ ID NO: 836296 - protein, 9 aa, Homo Sapiens
QNLIISAQQ

SEQ ID NO: 836297 - protein, 9 aa, Homo Sapiens
VQTALRSEE

SEQ ID NO: 836298 - protein, 9 aa, Homo Sapiens
ASQYCGCLE

SEQ ID NO: 836299 - protein, 9 aa, Homo Sapiens
LELGRRTWR

SEQ ID NO: 836300 - protein, 9 aa, Homo Sapiens
KDLIQHFNI

SEQ ID NO: 836301 - protein, 9 aa, Homo Sapiens
ICEVDSSED

SEQ ID NO: 836302 - protein, 9 aa, Homo Sapiens
YGQERCCHL

SEQ ID NO: 836303 - protein, 9 aa, Homo Sapiens
KNFNNFEIT

SEQ ID NO: 836304 - protein, 9 aa, Homo Sapiens
GPAGRWKRP

SEQ ID NO: 836305 - protein, 9 aa, Homo Sapiens
KYLSIAVQM

SEQ ID NO: 836306 - protein, 9 aa, Homo Sapiens
NVENLQIYW

SEQ ID NO: 836307 - protein, 9 aa, Homo Sapiens
YPKRDIYET

SEQ ID NO: 836308 - protein, 9 aa, Homo Sapiens
ATLFIVLLH

SEQ ID NO: 836309 - protein, 9 aa, Homo Sapiens
HSVVSEFLL

SEQ ID NO: 836310 - protein, 9 aa, Homo Sapiens
ETMPFLNDR

SEQ ID NO: 836311 - protein, 9 aa, Homo Sapiens
FFGPEIKLN

SEQ ID NO: 836312 - protein, 9 aa, Homo Sapiens
IALSSFNSK

SEQ ID NO: 836313 - protein, 9 aa, Homo Sapiens
ELGRRTWRF

SEQ ID NO: 836314 - protein, 9 aa, Homo Sapiens
PVFEQLEDK

SEQ ID NO: 836315 - protein, 9 aa, Homo Sapiens
FNGKYMKTP

SEQ ID NO: 836316 - protein, 9 aa, Homo Sapiens
KVLEVPEMS

SEQ ID NO: 836317 - protein, 9 aa, Homo Sapiens
SAATATAPT

SEQ ID NO: 836318 - protein, 9 aa, Homo Sapiens
SAIENDPLF

SEQ ID NO: 836319 - protein, 9 aa, Homo Sapiens
DQIYFKKRL

SEQ ID NO: 836320 - protein, 9 aa, Homo Sapiens
IMPQIPQTE

SEQ ID NO: 836321 - protein, 9 aa, Homo Sapiens
MQVALFIFF

SEQ ID NO: 836322 - protein, 9 aa, Homo Sapiens
FDVRSYLLV

SEQ ID NO: 836323 - protein, 9 aa, Homo Sapiens
KRASKIYFR

SEQ ID NO: 836324 - protein, 9 aa, Homo Sapiens
GDSEDKPEE

SEQ ID NO: 836325 - protein, 9 aa, Homo Sapiens
EKSLYQENI

SEQ ID NO: 836326 - protein, 9 aa, Homo Sapiens
LTIVCEGSI

SEQ ID NO: 836327 - protein, 9 aa, Homo Sapiens
GSTQSQGRV

SEQ ID NO: 836328 - protein, 9 aa, Homo Sapiens
TLRERYLRS

SEQ ID NO: 836329 - protein, 9 aa, Homo Sapiens
QLTASFDSY

SEQ ID NO: 836330 - protein, 9 aa, Homo Sapiens
DIIPPGPDV

SEQ ID NO: 836331 - protein, 9 aa, Homo Sapiens
ATDDEIDED

SEQ ID NO: 836332 - protein, 9 aa, Homo Sapiens
STFQNKKKT

SEQ ID NO: 836333 - protein, 9 aa, Homo Sapiens
APGHFDYIG

SEQ ID NO: 836334 - protein, 9 aa, Homo Sapiens
SLSVPHRHG

SEQ ID NO: 836335 - protein, 9 aa, Homo Sapiens
SGRSTTIRI

SEQ ID NO: 836336 - protein, 9 aa, Homo Sapiens
MQEIVCDIN

SEQ ID NO: 836337 - protein, 9 aa, Homo Sapiens
SLGPVATFL

SEQ ID NO: 836338 - protein, 9 aa, Homo Sapiens
PIQIVITMS

SEQ ID NO: 836339 - protein, 9 aa, Homo Sapiens
ATIENKNYV

SEQ ID NO: 836340 - protein, 9 aa, Homo Sapiens
STKSQRKQV

SEQ ID NO: 836341 - protein, 9 aa, Homo Sapiens
DLIQDKYSV

SEQ ID NO: 836342 - protein, 9 aa, Homo Sapiens
NTGPCLEKT

SEQ ID NO: 836343 - protein, 9 aa, Homo Sapiens
FTAYESQGA

SEQ ID NO: 836344 - protein, 9 aa, Homo Sapiens
ERSSNFGKT

SEQ ID NO: 836345 - protein, 9 aa, Homo Sapiens
EIGPVTNQK

SEQ ID NO: 836346 - protein, 9 aa, Homo Sapiens
KLLNKEWKK

SEQ ID NO: 836347 - protein, 9 aa, Homo Sapiens
SSQDGDNDE

SEQ ID NO: 836348 - protein, 9 aa, Homo Sapiens
DNLHRTFDP

SEQ ID NO: 836349 - protein, 9 aa, Homo Sapiens
ELSKKEHNV

SEQ ID NO: 836350 - protein, 9 aa, Homo Sapiens
WGKIMRTPN

SEQ ID NO: 836351 - protein, 9 aa, Homo Sapiens
YLQARINSL

SEQ ID NO: 836352 - protein, 9 aa, Homo Sapiens
IQRQLAREK

SEQ ID NO: 836353 - protein, 9 aa, Homo Sapiens
WRQNTKSSI

SEQ ID NO: 836354 - protein, 9 aa, Homo Sapiens
GKIIRQRFP

SEQ ID NO: 836355 - protein, 9 aa, Homo Sapiens
ENNRTSSII

SEQ ID NO: 836356 - protein, 9 aa, Homo Sapiens
EVRNEEHAC

SEQ ID NO: 836357 - protein, 9 aa, Homo Sapiens
KLEDEDGQT

SEQ ID NO: 836358 - protein, 9 aa, Homo Sapiens
PKEHTLQVL

SEQ ID NO: 836359 - protein, 9 aa, Homo Sapiens
PEMFTKKSE

SEQ ID NO: 836360 - protein, 9 aa, Homo Sapiens
NKSSDTLKL

SEQ ID NO: 836361 - protein, 9 aa, Homo Sapiens
EEQFQSDAA

SEQ ID NO: 836362 - protein, 9 aa, Homo Sapiens
DENLKRCFR

SEQ ID NO: 836363 - protein, 9 aa, Homo Sapiens
MDRVDSEIE

SEQ ID NO: 836364 - protein, 9 aa, Homo Sapiens
EQVDTGLEC

SEQ ID NO: 836365 - protein, 9 aa, Homo Sapiens
AAASSFVAG

SEQ ID NO: 836366 - protein, 9 aa, Homo Sapiens
ILTPQITRN

SEQ ID NO: 836367 - protein, 9 aa, Homo Sapiens
SFQKHSNLT

SEQ ID NO: 836368 - protein, 9 aa, Homo Sapiens
INGDGTALF

SEQ ID NO: 836369 - protein, 9 aa, Homo Sapiens
YAKRNISVN

SEQ ID NO: 836370 - protein, 9 aa, Homo Sapiens
ISYFTQERL

SEQ ID NO: 836371 - protein, 9 aa, Homo Sapiens
SPLELYKDV

SEQ ID NO: 836372 - protein, 9 aa, Homo Sapiens
RVFQGKWER

SEQ ID NO: 836373 - protein, 9 aa, Homo Sapiens
HKICEGLGP

SEQ ID NO: 836374 - protein, 9 aa, Homo Sapiens
WKTIGSLHP

SEQ ID NO: 836375 - protein, 9 aa, Homo Sapiens
NAVDPVLNY

SEQ ID NO: 836376 - protein, 9 aa, Homo Sapiens
SAEFLTVKE

SEQ ID NO: 836377 - protein, 9 aa, Homo Sapiens
QYPQLNVSQ

SEQ ID NO: 836378 - protein, 9 aa, Homo Sapiens
QPHPHLVLT

SEQ ID NO: 836379 - protein, 9 aa, Homo Sapiens
EAVRGSLNV

SEQ ID NO: 836380 - protein, 9 aa, Homo Sapiens
YRYQNEKNV

SEQ ID NO: 836381 - protein, 9 aa, Homo Sapiens
QLQTHTVYK

SEQ ID NO: 836382 - protein, 9 aa, Homo Sapiens
EIIHNFVRV

SEQ ID NO: 836383 - protein, 9 aa, Homo Sapiens
GADTIGQIS

SEQ ID NO: 836384 - protein, 9 aa, Homo Sapiens
YLVSQGKPQ

SEQ ID NO: 836385 - protein, 9 aa, Homo Sapiens
QLESGKLPQ

SEQ ID NO: 836386 - protein, 9 aa, Homo Sapiens
EVLPGAKYK

SEQ ID NO: 836387 - protein, 9 aa, Homo Sapiens
KDILQVITS

SEQ ID NO: 836388 - protein, 9 aa, Homo Sapiens
ANVFTANTA

SEQ ID NO: 836389 - protein, 9 aa, Homo Sapiens
IVQKRDTKT

SEQ ID NO: 836390 - protein, 9 aa, Homo Sapiens
INYVIKEIN

SEQ ID NO: 836391 - protein, 9 aa, Homo Sapiens
RIRHKEAQF

SEQ ID NO: 836392 - protein, 9 aa, Homo Sapiens
FINNEWQTS

SEQ ID NO: 836393 - protein, 9 aa, Homo Sapiens
SFQILKQFQ

SEQ ID NO: 836394 - protein, 9 aa, Homo Sapiens
SSDHVKVIL

SEQ ID NO: 836395 - protein, 9 aa, Homo Sapiens
WVLQEARVP

SEQ ID NO: 836396 - protein, 9 aa, Homo Sapiens
PLELVFVIN

SEQ ID NO: 836397 - protein, 9 aa, Homo Sapiens
IDKNFWSGL

SEQ ID NO: 836398 - protein, 9 aa, Homo Sapiens
AHLEIENKV

SEQ ID NO: 836399 - protein, 9 aa, Homo Sapiens
KRMLTKDLQ

SEQ ID NO: 836400 - protein, 9 aa, Homo Sapiens
SLQRKGLEK

SEQ ID NO: 836401 - protein, 9 aa, Homo Sapiens
SLRAMALPP

SEQ ID NO: 836402 - protein, 9 aa, Homo Sapiens
SVQSHERTH

SEQ ID NO: 836403 - protein, 9 aa, Homo Sapiens
NSRLYKWIP

SEQ ID NO: 836404 - protein, 9 aa, Homo Sapiens
INFFLLNKT

SEQ ID NO: 836405 - protein, 9 aa, Homo Sapiens
DLIRLQELR

SEQ ID NO: 836406 - protein, 9 aa, Homo Sapiens
KCFLPIKES

SEQ ID NO: 836407 - protein, 9 aa, Homo Sapiens
QSLPKYLIY

SEQ ID NO: 836408 - protein, 9 aa, Homo Sapiens
EDKREGYER

SEQ ID NO: 836409 - protein, 9 aa, Homo Sapiens
REGGSGKGT

SEQ ID NO: 836410 - protein, 9 aa, Homo Sapiens
PDVLHDYTI

SEQ ID NO: 836411 - protein, 9 aa, Homo Sapiens
LADVLHTLR

SEQ ID NO: 836412 - protein, 9 aa, Homo Sapiens
LKYAELAGL

SEQ ID NO: 836413 - protein, 9 aa, Homo Sapiens
ETCEFNITK

SEQ ID NO: 836414 - protein, 9 aa, Homo Sapiens
MLASRIVLF

SEQ ID NO: 836415 - protein, 9 aa, Homo Sapiens
KREAVIETL

SEQ ID NO: 836416 - protein, 9 aa, Homo Sapiens
YHLPPYKLS

SEQ ID NO: 836417 - protein, 9 aa, Homo Sapiens
VTLGNTFEK

SEQ ID NO: 836418 - protein, 9 aa, Homo Sapiens
NKEQQLKEI

SEQ ID NO: 836419 - protein, 9 aa, Homo Sapiens
VCKECGKAV

SEQ ID NO: 836420 - protein, 9 aa, Homo Sapiens
MGLFNGCFI

SEQ ID NO: 836421 - protein, 9 aa, Homo Sapiens
GDKPYGCIL

SEQ ID NO: 836422 - protein, 9 aa, Homo Sapiens
NMDEYNLFL

SEQ ID NO: 836423 - protein, 9 aa, Homo Sapiens
PPKRKKRKY

SEQ ID NO: 836424 - protein, 9 aa, Homo Sapiens
LNNAIFDED

SEQ ID NO: 836425 - protein, 9 aa, Homo Sapiens
PKGIHLDKN

SEQ ID NO: 836426 - protein, 9 aa, Homo Sapiens
DSVINILIQ

SEQ ID NO: 836427 - protein, 9 aa, Homo Sapiens
DVWMSSNLH

SEQ ID NO: 836428 - protein, 9 aa, Homo Sapiens
HGRPNYPGS

SEQ ID NO: 836429 - protein, 9 aa, Homo Sapiens
CRFAHLLNQ

SEQ ID NO: 836430 - protein, 9 aa, Homo Sapiens
FGGIYCLCH

SEQ ID NO: 836431 - protein, 9 aa, Homo Sapiens
QEEVSESSL

SEQ ID NO: 836432 - protein, 9 aa, Homo Sapiens
PITLKLCMN

SEQ ID NO: 836433 - protein, 9 aa, Homo Sapiens
VHSIVRLVA

SEQ ID NO: 836434 - protein, 9 aa, Homo Sapiens
RDQGPSSFY

SEQ ID NO: 836435 - protein, 9 aa, Homo Sapiens
QVFVDDVTI

SEQ ID NO: 836436 - protein, 9 aa, Homo Sapiens
RRLFKVTPP

SEQ ID NO: 836437 - protein, 9 aa, Homo Sapiens
TMFNPCGYL

SEQ ID NO: 836438 - protein, 9 aa, Homo Sapiens
KMQMLSEAE

SEQ ID NO: 836439 - protein, 9 aa, Homo Sapiens
KIVHLGEKP

SEQ ID NO: 836440 - protein, 9 aa, Homo Sapiens
TVIDQMKKF

SEQ ID NO: 836441 - protein, 9 aa, Homo Sapiens
ISDIKSECR

SEQ ID NO: 836442 - protein, 9 aa, Homo Sapiens
RCSCWAWQG

SEQ ID NO: 836443 - protein, 8 aa, Homo Sapiens
IVFGGEDR

SEQ ID NO: 836444 - protein, 9 aa, Homo Sapiens
EFKPDSEDK

SEQ ID NO: 836445 - protein, 9 aa, Homo Sapiens
EETCTYADK

SEQ ID NO: 836446 - protein, 9 aa, Homo Sapiens
ARKMKERWE

SEQ ID NO: 836447 - protein, 9 aa, Homo Sapiens
LQNTTSKRI

SEQ ID NO: 836448 - protein, 9 aa, Homo Sapiens
LAVLTAGLS

SEQ ID NO: 836449 - protein, 9 aa, Homo Sapiens
KAVLNDEQY

SEQ ID NO: 836450 - protein, 9 aa, Homo Sapiens
KTKRNTLFG

SEQ ID NO: 836451 - protein, 9 aa, Homo Sapiens
PSRYHSLLR

SEQ ID NO: 836452 - protein, 9 aa, Homo Sapiens
SYSERHSSS

SEQ ID NO: 836453 - protein, 9 aa, Homo Sapiens
NNGNMTELE

SEQ ID NO: 836454 - protein, 9 aa, Homo Sapiens
GTSFIMDQA

SEQ ID NO: 836455 - protein, 9 aa, Homo Sapiens
EVPIIYHDV

SEQ ID NO: 836456 - protein, 9 aa, Homo Sapiens
KIPNKSSVR

SEQ ID NO: 836457 - protein, 9 aa, Homo Sapiens
IPNSKDILT

SEQ ID NO: 836458 - protein, 9 aa, Homo Sapiens
NVSQLLKSS

SEQ ID NO: 836459 - protein, 9 aa, Homo Sapiens
HPDRARRAQ

SEQ ID NO: 836460 - protein, 9 aa, Homo Sapiens
KLVSTFNNY

SEQ ID NO: 836461 - protein, 9 aa, Homo Sapiens
EEEAHKKFN

SEQ ID NO: 836462 - protein, 9 aa, Homo Sapiens
IMFAFFPDK

SEQ ID NO: 836463 - protein, 9 aa, Homo Sapiens
DDTNHARER

SEQ ID NO: 836464 - protein, 9 aa, Homo Sapiens
EINVVRQLV

SEQ ID NO: 836465 - protein, 9 aa, Homo Sapiens
SSFVNFQMW

SEQ ID NO: 836466 - protein, 9 aa, Homo Sapiens
LPTSGDLYN

SEQ ID NO: 836467 - protein, 9 aa, Homo Sapiens
EHGEHGCRT

SEQ ID NO: 836468 - protein, 9 aa, Homo Sapiens
AKYMNHLID

SEQ ID NO: 836469 - protein, 9 aa, Homo Sapiens
PSMYIQAME

SEQ ID NO: 836470 - protein, 9 aa, Homo Sapiens
YVSLPDAAT

SEQ ID NO: 836471 - protein, 9 aa, Homo Sapiens
NSIKLLQTR

SEQ ID NO: 836472 - protein, 9 aa, Homo Sapiens
DSIDIWIGA

SEQ ID NO: 836473 - protein, 9 aa, Homo Sapiens
RSYQRTFNE

SEQ ID NO: 836474 - protein, 9 aa, Homo Sapiens
PLLAENDTY

SEQ ID NO: 836475 - protein, 9 aa, Homo Sapiens
SSHRAVEDQ

SEQ ID NO: 836476 - protein, 9 aa, Homo Sapiens
YFSEISNPF

SEQ ID NO: 836477 - protein, 9 aa, Homo Sapiens
KNEQSLPHL

SEQ ID NO: 836478 - protein, 9 aa, Homo Sapiens
FETTKESLR

SEQ ID NO: 836479 - protein, 9 aa, Homo Sapiens
TVGTFVVNK

SEQ ID NO: 836480 - protein, 9 aa, Homo Sapiens
WFVLANQSL

SEQ ID NO: 836481 - protein, 9 aa, Homo Sapiens
LLQSAKNSL

SEQ ID NO: 836482 - protein, 9 aa, Homo Sapiens
TWEEVKQQL

SEQ ID NO: 836483 - protein, 9 aa, Homo Sapiens
ALHTWSKMF

SEQ ID NO: 836484 - protein, 9 aa, Homo Sapiens
VVAMHYSFA

SEQ ID NO: 836485 - protein, 9 aa, Homo Sapiens
SQVKGFVQK

SEQ ID NO: 836486 - protein, 9 aa, Homo Sapiens
QRGQFVGDG

SEQ ID NO: 836487 - protein, 9 aa, Homo Sapiens
DKAQNFRTE

SEQ ID NO: 836488 - protein, 9 aa, Homo Sapiens
PYSFIECDT

SEQ ID NO: 836489 - protein, 9 aa, Homo Sapiens
GQERCCHLM

SEQ ID NO: 836490 - protein, 9 aa, Homo Sapiens
SPSDSVHFE

SEQ ID NO: 836491 - protein, 9 aa, Homo Sapiens
HLWEAGKEK

SEQ ID NO: 836492 - protein, 9 aa, Homo Sapiens
YTPEMILKI

SEQ ID NO: 836493 - protein, 9 aa, Homo Sapiens
WHRITIIYL

SEQ ID NO: 836494 - protein, 9 aa, Homo Sapiens
SSGSRSSSS

SEQ ID NO: 836495 - protein, 9 aa, Homo Sapiens
RAGYPRDIH

SEQ ID NO: 836496 - protein, 9 aa, Homo Sapiens
QQKLFFFLQ

SEQ ID NO: 836497 - protein, 9 aa, Homo Sapiens
LQNQIAALN

SEQ ID NO: 836498 - protein, 9 aa, Homo Sapiens
PFVAVVIDS

SEQ ID NO: 836499 - protein, 9 aa, Homo Sapiens
RQQANLLKG

SEQ ID NO: 836500 - protein, 9 aa, Homo Sapiens
MQLKLSNMY

SEQ ID NO: 836501 - protein, 9 aa, Homo Sapiens
QSSKLIMHQ

SEQ ID NO: 836502 - protein, 9 aa, Homo Sapiens
RWKNHGCQH

SEQ ID NO: 836503 - protein, 9 aa, Homo Sapiens
PLKQAAALS

SEQ ID NO: 836504 - protein, 9 aa, Homo Sapiens
ELGFESDTQ

SEQ ID NO: 836505 - protein, 9 aa, Homo Sapiens
PSCGVPDVG

SEQ ID NO: 836506 - protein, 9 aa, Homo Sapiens
SGCIKRPDV

SEQ ID NO: 836507 - protein, 9 aa, Homo Sapiens
PNILLALTD

SEQ ID NO: 836508 - protein, 9 aa, Homo Sapiens
WKLLITIHN

SEQ ID NO: 836509 - protein, 9 aa, Homo Sapiens
RLNLCARRI

SEQ ID NO: 836510 - protein, 9 aa, Homo Sapiens
KLIAKERQK

SEQ ID NO: 836511 - protein, 9 aa, Homo Sapiens
ANAQKNKLL

SEQ ID NO: 836512 - protein, 9 aa, Homo Sapiens
QNQMDALLE

SEQ ID NO: 836513 - protein, 9 aa, Homo Sapiens
QNVIIIQPP

SEQ ID NO: 836514 - protein, 9 aa, Homo Sapiens
YDLASDVVR

SEQ ID NO: 836515 - protein, 9 aa, Homo Sapiens
LHWFPYCQS

SEQ ID NO: 836516 - protein, 9 aa, Homo Sapiens
YNLFLRGGV

SEQ ID NO: 836517 - protein, 9 aa, Homo Sapiens
PGSQGKALQ

SEQ ID NO: 836518 - protein, 9 aa, Homo Sapiens
PEPDRKKLG

SEQ ID NO: 836519 - protein, 9 aa, Homo Sapiens
TGNITIIPL

SEQ ID NO: 836520 - protein, 9 aa, Homo Sapiens
DTLCHFGFE

SEQ ID NO: 836521 - protein, 9 aa, Homo Sapiens
AERATKVED

SEQ ID NO: 836522 - protein, 9 aa, Homo Sapiens
RGAPLISAK

SEQ ID NO: 836523 - protein, 9 aa, Homo Sapiens
KKSGILLDY

SEQ ID NO: 836524 - protein, 9 aa, Homo Sapiens
KVAKACSCQ

SEQ ID NO: 836525 - protein, 9 aa, Homo Sapiens
KTCIKSTVG

SEQ ID NO: 836526 - protein, 9 aa, Homo Sapiens
MLFPDIVGF

SEQ ID NO: 836527 - protein, 9 aa, Homo Sapiens
IPALSPGST

SEQ ID NO: 836528 - protein, 9 aa, Homo Sapiens
GQRCLNPKL

SEQ ID NO: 836529 - protein, 9 aa, Homo Sapiens
QERRTPLRA

SEQ ID NO: 836530 - protein, 9 aa, Homo Sapiens
DKEEEEENK

SEQ ID NO: 836531 - protein, 9 aa, Homo Sapiens
VAAVQDHGQ

SEQ ID NO: 836532 - protein, 9 aa, Homo Sapiens
VFVTKEEKN

SEQ ID NO: 836533 - protein, 9 aa, Homo Sapiens
CTLGGLTAV

SEQ ID NO: 836534 - protein, 9 aa, Homo Sapiens
HLLGKRADN

SEQ ID NO: 836535 - protein, 9 aa, Homo Sapiens
FSNYIFLYL

SEQ ID NO: 836536 - protein, 9 aa, Homo Sapiens
EAKARAEAR

SEQ ID NO: 836537 - protein, 9 aa, Homo Sapiens
RCGPATQNR

SEQ ID NO: 836538 - protein, 9 aa, Homo Sapiens
PTCDVFCKH

SEQ ID NO: 836539 - protein, 9 aa, Homo Sapiens
LKTVLRSKG

SEQ ID NO: 836540 - protein, 9 aa, Homo Sapiens
QVTGSAWVS

SEQ ID NO: 836541 - protein, 9 aa, Homo Sapiens
LNYGEVQTN

SEQ ID NO: 836542 - protein, 9 aa, Homo Sapiens
MALPFFNIS

SEQ ID NO: 836543 - protein, 9 aa, Homo Sapiens
RPLVMTLNY

SEQ ID NO: 836544 - protein, 9 aa, Homo Sapiens
LLSGKWLHS

SEQ ID NO: 836545 - protein, 9 aa, Homo Sapiens
ELHFKLMRK

SEQ ID NO: 836546 - protein, 9 aa, Homo Sapiens
DRICTKGIE

SEQ ID NO: 836547 - protein, 9 aa, Homo Sapiens
KLLYKKMKG

SEQ ID NO: 836548 - protein, 9 aa, Homo Sapiens
LTYPTKCTV

SEQ ID NO: 836549 - protein, 9 aa, Homo Sapiens
DPKINVRVL

SEQ ID NO: 836550 - protein, 9 aa, Homo Sapiens
QQCQAPVCG

SEQ ID NO: 836551 - protein, 9 aa, Homo Sapiens
QELAVQVKQ

SEQ ID NO: 836552 - protein, 9 aa, Homo Sapiens
TTFPKTTPL

SEQ ID NO: 836553 - protein, 9 aa, Homo Sapiens
TLSNVKYFY

SEQ ID NO: 836554 - protein, 9 aa, Homo Sapiens
TKVEDMMKK

SEQ ID NO: 836555 - protein, 9 aa, Homo Sapiens
LNNLIYLKL

SEQ ID NO: 836556 - protein, 9 aa, Homo Sapiens
YLVMQKLFP

SEQ ID NO: 836557 - protein, 9 aa, Homo Sapiens
IYHDALQNY

SEQ ID NO: 836558 - protein, 9 aa, Homo Sapiens
EANLFGSNA

SEQ ID NO: 836559 - protein, 9 aa, Homo Sapiens
WLGLGEGAE

SEQ ID NO: 836560 - protein, 9 aa, Homo Sapiens
KTAAKMENK

SEQ ID NO: 836561 - protein, 9 aa, Homo Sapiens
THYCQGPKE

SEQ ID NO: 836562 - protein, 9 aa, Homo Sapiens
LILIISMIF

SEQ ID NO: 836563 - protein, 9 aa, Homo Sapiens
LPFWNEEIF

SEQ ID NO: 836564 - protein, 9 aa, Homo Sapiens
EKMHNAKKS

SEQ ID NO: 836565 - protein, 9 aa, Homo Sapiens
SVQCLPSRL

SEQ ID NO: 836566 - protein, 9 aa, Homo Sapiens
EQFILGRAP

SEQ ID NO: 836567 - protein, 9 aa, Homo Sapiens
KITHTGEKT

SEQ ID NO: 836568 - protein, 9 aa, Homo Sapiens
VSQWAFCMD

SEQ ID NO: 836569 - protein, 9 aa, Homo Sapiens
DLGKCILDP

SEQ ID NO: 836570 - protein, 9 aa, Homo Sapiens
WTLPYVCFH

SEQ ID NO: 836571 - protein, 9 aa, Homo Sapiens
RERNKNVAE

SEQ ID NO: 836572 - protein, 9 aa, Homo Sapiens
PNNSWNSYS

SEQ ID NO: 836573 - protein, 9 aa, Homo Sapiens
IDLDTILLL

SEQ ID NO: 836574 - protein, 9 aa, Homo Sapiens
RRATALAGT

SEQ ID NO: 836575 - protein, 9 aa, Homo Sapiens
ELFARFDQL

SEQ ID NO: 836576 - protein, 9 aa, Homo Sapiens
YIYFKLFRA

SEQ ID NO: 836577 - protein, 9 aa, Homo Sapiens
KDEIKAAVK

SEQ ID NO: 836578 - protein, 9 aa, Homo Sapiens
TCNITVFRQ

SEQ ID NO: 836579 - protein, 9 aa, Homo Sapiens
LDRNKLEQL

SEQ ID NO: 836580 - protein, 9 aa, Homo Sapiens
TDYPPTTKP

SEQ ID NO: 836581 - protein, 9 aa, Homo Sapiens
GLCGLTITE

SEQ ID NO: 836582 - protein, 9 aa, Homo Sapiens
LYFAKLYYE

SEQ ID NO: 836583 - protein, 9 aa, Homo Sapiens
RCSIGGGSV

SEQ ID NO: 836584 - protein, 9 aa, Homo Sapiens
DLKRTGLKV

SEQ ID NO: 836585 - protein, 9 aa, Homo Sapiens
PIYHQGQPQ

SEQ ID NO: 836586 - protein, 9 aa, Homo Sapiens
ETEVKTRAQ

SEQ ID NO: 836587 - protein, 9 aa, Homo Sapiens
SGFILQCTH

SEQ ID NO: 836588 - protein, 9 aa, Homo Sapiens
LIHLWEAGK

SEQ ID NO: 836589 - protein, 9 aa, Homo Sapiens
MTKNWSLIG

SEQ ID NO: 836590 - protein, 9 aa, Homo Sapiens
QVFCGLSNM

SEQ ID NO: 836591 - protein, 9 aa, Homo Sapiens
LNSDVNNLM

SEQ ID NO: 836592 - protein, 9 aa, Homo Sapiens
GTPLPNYYS

SEQ ID NO: 836593 - protein, 9 aa, Homo Sapiens
NMSIGEGRF

SEQ ID NO: 836594 - protein, 9 aa, Homo Sapiens
VYAFKTWKC

SEQ ID NO: 836595 - protein, 9 aa, Homo Sapiens
IQPVQKKYK

SEQ ID NO: 836596 - protein, 9 aa, Homo Sapiens
WGMSHSPSV

SEQ ID NO: 836597 - protein, 9 aa, Homo Sapiens
SHNAPAKLQ

SEQ ID NO: 836598 - protein, 9 aa, Homo Sapiens
EMLLQFNAI

SEQ ID NO: 836599 - protein, 9 aa, Homo Sapiens
IPMKKAQND

SEQ ID NO: 836600 - protein, 9 aa, Homo Sapiens
TLADVLHTL

SEQ ID NO: 836601 - protein, 9 aa, Homo Sapiens
IMIIIKTNP

SEQ ID NO: 836602 - protein, 9 aa, Homo Sapiens
GCGGNRNTF

SEQ ID NO: 836603 - protein, 9 aa, Homo Sapiens
VVYEAPQEE

SEQ ID NO: 836604 - protein, 9 aa, Homo Sapiens
CNKVYTKSY

SEQ ID NO: 836605 - protein, 9 aa, Homo Sapiens
PMRMLYDLH

SEQ ID NO: 836606 - protein, 9 aa, Homo Sapiens
RLICGIIIC

SEQ ID NO: 836607 - protein, 9 aa, Homo Sapiens
LPTASTCIN

SEQ ID NO: 836608 - protein, 9 aa, Homo Sapiens
QHEDKPGRM

SEQ ID NO: 836609 - protein, 9 aa, Homo Sapiens
NIIVTGSVI

SEQ ID NO: 836610 - protein, 9 aa, Homo Sapiens
VEAATNASN

SEQ ID NO: 836611 - protein, 9 aa, Homo Sapiens
DHVFCAVHL

SEQ ID NO: 836612 - protein, 9 aa, Homo Sapiens
EEYVPSILI

SEQ ID NO: 836613 - protein, 9 aa, Homo Sapiens
KTDSLTTLP

SEQ ID NO: 836614 - protein, 9 aa, Homo Sapiens
VGLALVSRD

SEQ ID NO: 836615 - protein, 9 aa, Homo Sapiens
PFGMMGTFA

SEQ ID NO: 836616 - protein, 9 aa, Homo Sapiens
TCKQECLIA

SEQ ID NO: 836617 - protein, 9 aa, Homo Sapiens
WKHNKFHNR

SEQ ID NO: 836618 - protein, 9 aa, Homo Sapiens
RMLKYTSVF

SEQ ID NO: 836619 - protein, 9 aa, Homo Sapiens
AQKSAVAGF

SEQ ID NO: 836620 - protein, 9 aa, Homo Sapiens
ISKEESKLL

SEQ ID NO: 836621 - protein, 9 aa, Homo Sapiens
KIQIVTTVD

SEQ ID NO: 836622 - protein, 9 aa, Homo Sapiens
GPDASTGRV

SEQ ID NO: 836623 - protein, 9 aa, Homo Sapiens
GFYYIGPGY

SEQ ID NO: 836624 - protein, 9 aa, Homo Sapiens
NSSPATIID

SEQ ID NO: 836625 - protein, 9 aa, Homo Sapiens
WQGLGVPCV

SEQ ID NO: 836626 - protein, 9 aa, Homo Sapiens
VEFILIKSE

SEQ ID NO: 836627 - protein, 9 aa, Homo Sapiens
DIRRRSKNK

SEQ ID NO: 836628 - protein, 9 aa, Homo Sapiens
IIIQPPSTT

SEQ ID NO: 836629 - protein, 9 aa, Homo Sapiens
RCLIKSPDC

SEQ ID NO: 836630 - protein, 9 aa, Homo Sapiens
RPYILKIDS

SEQ ID NO: 836631 - protein, 9 aa, Homo Sapiens
RVDITLKGK

SEQ ID NO: 836632 - protein, 9 aa, Homo Sapiens
REGMRMNYE

SEQ ID NO: 836633 - protein, 9 aa, Homo Sapiens
EPQYSVALS

SEQ ID NO: 836634 - protein, 9 aa, Homo Sapiens
GTMVTTVGG

SEQ ID NO: 836635 - protein, 9 aa, Homo Sapiens
GSLENEKYE

SEQ ID NO: 836636 - protein, 9 aa, Homo Sapiens
KIKDNDIIG

SEQ ID NO: 836637 - protein, 9 aa, Homo Sapiens
ICDLLVTNN

SEQ ID NO: 836638 - protein, 9 aa, Homo Sapiens
AQSLNSDVN

SEQ ID NO: 836639 - protein, 9 aa, Homo Sapiens
YRSPSMISN

SEQ ID NO: 836640 - protein, 9 aa, Homo Sapiens
LKDHKVSYL

SEQ ID NO: 836641 - protein, 9 aa, Homo Sapiens
RPPASLHYR

SEQ ID NO: 836642 - protein, 9 aa, Homo Sapiens
AFDKQVMEQ

SEQ ID NO: 836643 - protein, 9 aa, Homo Sapiens
EETLWGAIN

SEQ ID NO: 836644 - protein, 9 aa, Homo Sapiens
AANAQKNKL

SEQ ID NO: 836645 - protein, 9 aa, Homo Sapiens
AVRHSKAQI

SEQ ID NO: 836646 - protein, 9 aa, Homo Sapiens
QAVMPCWVP

SEQ ID NO: 836647 - protein, 9 aa, Homo Sapiens
SEENNLVKK

SEQ ID NO: 836648 - protein, 9 aa, Homo Sapiens
DIMKGLTLG

SEQ ID NO: 836649 - protein, 9 aa, Homo Sapiens
SLKSLELHD

SEQ ID NO: 836650 - protein, 9 aa, Homo Sapiens
TVIQACRGR

SEQ ID NO: 836651 - protein, 9 aa, Homo Sapiens
GADKGPASN

SEQ ID NO: 836652 - protein, 9 aa, Homo Sapiens
PDVDHCCKT

SEQ ID NO: 836653 - protein, 9 aa, Homo Sapiens
ELTCLAFEL

SEQ ID NO: 836654 - protein, 9 aa, Homo Sapiens
IISIHASPQ

SEQ ID NO: 836655 - protein, 9 aa, Homo Sapiens
GLQRLMLIN

SEQ ID NO: 836656 - protein, 9 aa, Homo Sapiens
DRVNKQCVG

SEQ ID NO: 836657 - protein, 9 aa, Homo Sapiens
LFPPGYQVS

SEQ ID NO: 836658 - protein, 9 aa, Homo Sapiens
YEPDLDIKI

SEQ ID NO: 836659 - protein, 9 aa, Homo Sapiens
VLPARSVDV

SEQ ID NO: 836660 - protein, 9 aa, Homo Sapiens
FNNTWSNTH

SEQ ID NO: 836661 - protein, 9 aa, Homo Sapiens
VMLGKVGIT

SEQ ID NO: 836662 - protein, 9 aa, Homo Sapiens
KFQMKQISS

SEQ ID NO: 836663 - protein, 9 aa, Homo Sapiens
CREENKSST

SEQ ID NO: 836664 - protein, 9 aa, Homo Sapiens
ANFLTRIAD

SEQ ID NO: 836665 - protein, 9 aa, Homo Sapiens
LRIIRGTKR

SEQ ID NO: 836666 - protein, 9 aa, Homo Sapiens
WASPEVLSF

SEQ ID NO: 836667 - protein, 9 aa, Homo Sapiens
IVNIKVQEL

SEQ ID NO: 836668 - protein, 9 aa, Homo Sapiens
WDGFKCQCP

SEQ ID NO: 836669 - protein, 9 aa, Homo Sapiens
NQQRQQCQA

SEQ ID NO: 836670 - protein, 9 aa, Homo Sapiens
GRKEHTLFI

SEQ ID NO: 836671 - protein, 9 aa, Homo Sapiens
LGNTVIHLY

SEQ ID NO: 836672 - protein, 9 aa, Homo Sapiens
FDDVPVVQM

SEQ ID NO: 836673 - protein, 9 aa, Homo Sapiens
IFIPQLCVG

SEQ ID NO: 836674 - protein, 9 aa, Homo Sapiens
TFDFNIKFA

SEQ ID NO: 836675 - protein, 9 aa, Homo Sapiens
RLGVHTNGA

SEQ ID NO: 836676 - protein, 9 aa, Homo Sapiens
LNGIQLAIN

SEQ ID NO: 836677 - protein, 9 aa, Homo Sapiens
APTGEPLHL

SEQ ID NO: 836678 - protein, 9 aa, Homo Sapiens
IATKALCAF

SEQ ID NO: 836679 - protein, 9 aa, Homo Sapiens
SNGQGSRML

SEQ ID NO: 836680 - protein, 9 aa, Homo Sapiens
NKRLTVSQR

SEQ ID NO: 836681 - protein, 9 aa, Homo Sapiens
YCFHKTRSR

SEQ ID NO: 836682 - protein, 9 aa, Homo Sapiens
VSLFLHYLV

SEQ ID NO: 836683 - protein, 9 aa, Homo Sapiens
QNQIAALNQ

SEQ ID NO: 836684 - protein, 9 aa, Homo Sapiens
VNLDSLGLS

SEQ ID NO: 836685 - protein, 9 aa, Homo Sapiens
GAYRARVLE

SEQ ID NO: 836686 - protein, 9 aa, Homo Sapiens
YKMDTVLRS

SEQ ID NO: 836687 - protein, 9 aa, Homo Sapiens
NGIPMKKAQ

SEQ ID NO: 836688 - protein, 9 aa, Homo Sapiens
LNASISKTS

SEQ ID NO: 836689 - protein, 9 aa, Homo Sapiens
SAKNSLKNM

SEQ ID NO: 836690 - protein, 9 aa, Homo Sapiens
SYSSSSARR

SEQ ID NO: 836691 - protein, 9 aa, Homo Sapiens
PILPYVFKS

SEQ ID NO: 836692 - protein, 9 aa, Homo Sapiens
ASIWLQKSG

SEQ ID NO: 836693 - protein, 9 aa, Homo Sapiens
EFQFVDEEE

SEQ ID NO: 836694 - protein, 9 aa, Homo Sapiens
FFGFITFMY

SEQ ID NO: 836695 - protein, 9 aa, Homo Sapiens
YAFSNGKTF

SEQ ID NO: 836696 - protein, 9 aa, Homo Sapiens
PGEKPFECN

SEQ ID NO: 836697 - protein, 9 aa, Homo Sapiens
PRLQDSNNK

SEQ ID NO: 836698 - protein, 9 aa, Homo Sapiens
ILRTRIAAL

SEQ ID NO: 836699 - protein, 9 aa, Homo Sapiens
QTLSNKPEI

SEQ ID NO: 836700 - protein, 9 aa, Homo Sapiens
TPIFYGIFY

SEQ ID NO: 836701 - protein, 9 aa, Homo Sapiens
NKNLEEAKI

SEQ ID NO: 836702 - protein, 9 aa, Homo Sapiens
RPHTPTPGL

SEQ ID NO: 836703 - protein, 9 aa, Homo Sapiens
QTLEVIYPQ

SEQ ID NO: 836704 - protein, 9 aa, Homo Sapiens
TRAGEPILT

SEQ ID NO: 836705 - protein, 9 aa, Homo Sapiens
LHFSAFRML

SEQ ID NO: 836706 - protein, 9 aa, Homo Sapiens
GENQIITRE

SEQ ID NO: 836707 - protein, 9 aa, Homo Sapiens
GYIEDFDGR

SEQ ID NO: 836708 - protein, 9 aa, Homo Sapiens
FRMLGTPSK

SEQ ID NO: 836709 - protein, 9 aa, Homo Sapiens
IAKEITVGQ

SEQ ID NO: 836710 - protein, 9 aa, Homo Sapiens
SLATLPITF

SEQ ID NO: 836711 - protein, 9 aa, Homo Sapiens
VMRLTRHSL

SEQ ID NO: 836712 - protein, 9 aa, Homo Sapiens
TTGFQYEMV

SEQ ID NO: 836713 - protein, 9 aa, Homo Sapiens
TFPDHTLSH

SEQ ID NO: 836714 - protein, 9 aa, Homo Sapiens
KLEDALSLI

SEQ ID NO: 836715 - protein, 9 aa, Homo Sapiens
VVVHKHALH

SEQ ID NO: 836716 - protein, 9 aa, Homo Sapiens
ASGEHSLKC

SEQ ID NO: 836717 - protein, 9 aa, Homo Sapiens
ILLLLFLKS

SEQ ID NO: 836718 - protein, 9 aa, Homo Sapiens
PQLSAKTWW

SEQ ID NO: 836719 - protein, 9 aa, Homo Sapiens
TKESLRNYY

SEQ ID NO: 836720 - protein, 9 aa, Homo Sapiens
FTIIYKWNG

SEQ ID NO: 836721 - protein, 9 aa, Homo Sapiens
LGTLYTSSS

SEQ ID NO: 836722 - protein, 9 aa, Homo Sapiens
GDKLYECKQ

SEQ ID NO: 836723 - protein, 9 aa, Homo Sapiens
HGQGGNQLF

SEQ ID NO: 836724 - protein, 9 aa, Homo Sapiens
TIAAMEDRL

SEQ ID NO: 836725 - protein, 9 aa, Homo Sapiens
HRQNYEEKG

SEQ ID NO: 836726 - protein, 9 aa, Homo Sapiens
VVHQITHTG

SEQ ID NO: 836727 - protein, 9 aa, Homo Sapiens
KQMLLNLGV

SEQ ID NO: 836728 - protein, 9 aa, Homo Sapiens
HYDKFKKMN

SEQ ID NO: 836729 - protein, 9 aa, Homo Sapiens
EFSVRDDLF

SEQ ID NO: 836730 - protein, 9 aa, Homo Sapiens
KHLRKDLDE

SEQ ID NO: 836731 - protein, 9 aa, Homo Sapiens
IPNYHNMTT

SEQ ID NO: 836732 - protein, 9 aa, Homo Sapiens
AMGIILYKF

SEQ ID NO: 836733 - protein, 9 aa, Homo Sapiens
YKYPSKVAF

SEQ ID NO: 836734 - protein, 9 aa, Homo Sapiens
DPNERGSWR

SEQ ID NO: 836735 - protein, 9 aa, Homo Sapiens
DLQQNSALP

SEQ ID NO: 836736 - protein, 9 aa, Homo Sapiens
NTLSTVEHM

SEQ ID NO: 836737 - protein, 9 aa, Homo Sapiens
RVNINFSLS

SEQ ID NO: 836738 - protein, 9 aa, Homo Sapiens
QSAKNSLKN

SEQ ID NO: 836739 - protein, 9 aa, Homo Sapiens
YKGNGLWCS

SEQ ID NO: 836740 - protein, 9 aa, Homo Sapiens
LYDGFHIQS

SEQ ID NO: 836741 - protein, 9 aa, Homo Sapiens
LAGLSAYQL

SEQ ID NO: 836742 - protein, 9 aa, Homo Sapiens
NWVLSYRRN

SEQ ID NO: 836743 - protein, 9 aa, Homo Sapiens
IKHKDETVD

SEQ ID NO: 836744 - protein, 9 aa, Homo Sapiens
SDCSLQKHD

SEQ ID NO: 836745 - protein, 9 aa, Homo Sapiens
EELLMVMSS

SEQ ID NO: 836746 - protein, 9 aa, Homo Sapiens
EINQIFHEV

SEQ ID NO: 836747 - protein, 9 aa, Homo Sapiens
IIHVGDKSY

SEQ ID NO: 836748 - protein, 9 aa, Homo Sapiens
KEGLEHQLH

SEQ ID NO: 836749 - protein, 9 aa, Homo Sapiens
SEDREPLSL

SEQ ID NO: 836750 - protein, 9 aa, Homo Sapiens
AIPEQILSS

SEQ ID NO: 836751 - protein, 9 aa, Homo Sapiens
GFFMKDAIN

SEQ ID NO: 836752 - protein, 9 aa, Homo Sapiens
KNKSNFKKK

SEQ ID NO: 836753 - protein, 9 aa, Homo Sapiens
KKSNNSFLQ

SEQ ID NO: 836754 - protein, 9 aa, Homo Sapiens
YFSLELSVV

SEQ ID NO: 836755 - protein, 9 aa, Homo Sapiens
FMRTTVFIA

SEQ ID NO: 836756 - protein, 9 aa, Homo Sapiens
TPVVGLTIR

SEQ ID NO: 836757 - protein, 9 aa, Homo Sapiens
QKERIALSR

SEQ ID NO: 836758 - protein, 9 aa, Homo Sapiens
HSVFLLTTQ

SEQ ID NO: 836759 - protein, 9 aa, Homo Sapiens
EDWARWAKL

SEQ ID NO: 836760 - protein, 9 aa, Homo Sapiens
NHLCVGCCV

SEQ ID NO: 836761 - protein, 9 aa, Homo Sapiens
PQLFHQDKQ

SEQ ID NO: 836762 - protein, 9 aa, Homo Sapiens
YCNFRSHDM

SEQ ID NO: 836763 - protein, 9 aa, Homo Sapiens
EVKTRAQGS

SEQ ID NO: 836764 - protein, 9 aa, Homo Sapiens
HQVDSDLLG

SEQ ID NO: 836765 - protein, 9 aa, Homo Sapiens
EAMLEAPYT

SEQ ID NO: 836766 - protein, 9 aa, Homo Sapiens
EGPGMEITN

SEQ ID NO: 836767 - protein, 9 aa, Homo Sapiens
PAVVIQQRK

SEQ ID NO: 836768 - protein, 9 aa, Homo Sapiens
TPQYYTQNL

SEQ ID NO: 836769 - protein, 9 aa, Homo Sapiens
RSSYLIQHK

SEQ ID NO: 836770 - protein, 9 aa, Homo Sapiens
NALVILAII

SEQ ID NO: 836771 - protein, 9 aa, Homo Sapiens
KMKKIDKIL

SEQ ID NO: 836772 - protein, 9 aa, Homo Sapiens
SAAHVIKRY

SEQ ID NO: 836773 - protein, 9 aa, Homo Sapiens
EKDIAANED

SEQ ID NO: 836774 - protein, 9 aa, Homo Sapiens
RLNVPYNHI

SEQ ID NO: 836775 - protein, 9 aa, Homo Sapiens
VGKYETLED

SEQ ID NO: 836776 - protein, 9 aa, Homo Sapiens
LFVSKLFEH

SEQ ID NO: 836777 - protein, 9 aa, Homo Sapiens
FWYIKGIMY

SEQ ID NO: 836778 - protein, 9 aa, Homo Sapiens
DPGTSMKYS

SEQ ID NO: 836779 - protein, 9 aa, Homo Sapiens
MSFQSLFQD

SEQ ID NO: 836780 - protein, 9 aa, Homo Sapiens
LFPLIPALS

SEQ ID NO: 836781 - protein, 9 aa, Homo Sapiens
DEQLEHCML

SEQ ID NO: 836782 - protein, 9 aa, Homo Sapiens
FERDVGTNT

SEQ ID NO: 836783 - protein, 9 aa, Homo Sapiens
GLDLDDFAG

SEQ ID NO: 836784 - protein, 9 aa, Homo Sapiens
DLGEEEDKA

SEQ ID NO: 836785 - protein, 9 aa, Homo Sapiens
ELALSMIKC

SEQ ID NO: 836786 - protein, 9 aa, Homo Sapiens
CPAYPQSPS

SEQ ID NO: 836787 - protein, 9 aa, Homo Sapiens
DLVRVDIIS

SEQ ID NO: 836788 - protein, 9 aa, Homo Sapiens
SGPLKPMPF

SEQ ID NO: 836789 - protein, 9 aa, Homo Sapiens
GIWLLGTTH

SEQ ID NO: 836790 - protein, 9 aa, Homo Sapiens
LTMESAASS

SEQ ID NO: 836791 - protein, 9 aa, Homo Sapiens
ENNLEEAKK

SEQ ID NO: 836792 - protein, 9 aa, Homo Sapiens
LNDWWNNTE

SEQ ID NO: 836793 - protein, 9 aa, Homo Sapiens
WVEHRGWGL

SEQ ID NO: 836794 - protein, 9 aa, Homo Sapiens
DPNKKLICS

SEQ ID NO: 836795 - protein, 9 aa, Homo Sapiens
LDYISPGKE

SEQ ID NO: 836796 - protein, 9 aa, Homo Sapiens
SEGDQQLLT

SEQ ID NO: 836797 - protein, 9 aa, Homo Sapiens
YNYILALAA

SEQ ID NO: 836798 - protein, 9 aa, Homo Sapiens
QSLNENSAR

SEQ ID NO: 836799 - protein, 9 aa, Homo Sapiens
LATGALGGP

SEQ ID NO: 836800 - protein, 9 aa, Homo Sapiens
KNGKFVILL

SEQ ID NO: 836801 - protein, 9 aa, Homo Sapiens
QYSNVTEFV

SEQ ID NO: 836802 - protein, 9 aa, Homo Sapiens
NGTRPPLIQ

SEQ ID NO: 836803 - protein, 9 aa, Homo Sapiens
SYNDQLFGY

SEQ ID NO: 836804 - protein, 9 aa, Homo Sapiens
QGGNQLFEY

SEQ ID NO: 836805 - protein, 9 aa, Homo Sapiens
ITSDLTVIN

SEQ ID NO: 836806 - protein, 9 aa, Homo Sapiens
DKKQEQEDN

SEQ ID NO: 836807 - protein, 9 aa, Homo Sapiens
CWDELQKVF

SEQ ID NO: 836808 - protein, 9 aa, Homo Sapiens
DLFLSDRHR

SEQ ID NO: 836809 - protein, 9 aa, Homo Sapiens
MVLLLPLID

SEQ ID NO: 836810 - protein, 9 aa, Homo Sapiens
LCTRAGEPI

SEQ ID NO: 836811 - protein, 9 aa, Homo Sapiens
AAIAHIIAA

SEQ ID NO: 836812 - protein, 9 aa, Homo Sapiens
ICCGLDRFK

SEQ ID NO: 836813 - protein, 9 aa, Homo Sapiens
TDSKIITGH

SEQ ID NO: 836814 - protein, 9 aa, Homo Sapiens
NERGSWRAV

SEQ ID NO: 836815 - protein, 9 aa, Homo Sapiens
VDTGGDGES

SEQ ID NO: 836816 - protein, 9 aa, Homo Sapiens
PLALWSILV

SEQ ID NO: 836817 - protein, 9 aa, Homo Sapiens
IQYDKCYIH

SEQ ID NO: 836818 - protein, 9 aa, Homo Sapiens
GSTPTTFST

SEQ ID NO: 836819 - protein, 9 aa, Homo Sapiens
KVLEKAFSI

SEQ ID NO: 836820 - protein, 9 aa, Homo Sapiens
TPSFNKLYR

SEQ ID NO: 836821 - protein, 9 aa, Homo Sapiens
TVLSWLPKY

SEQ ID NO: 836822 - protein, 9 aa, Homo Sapiens
DNKRWETNR

SEQ ID NO: 836823 - protein, 9 aa, Homo Sapiens
HNPWLQEAP

SEQ ID NO: 836824 - protein, 9 aa, Homo Sapiens
IHNRTNTTL

SEQ ID NO: 836825 - protein, 9 aa, Homo Sapiens
VLYILKLYD

SEQ ID NO: 836826 - protein, 9 aa, Homo Sapiens
SPGSLDIPK

SEQ ID NO: 836827 - protein, 9 aa, Homo Sapiens
HFVLCVVFS

SEQ ID NO: 836828 - protein, 9 aa, Homo Sapiens
GMQLPCKLR

SEQ ID NO: 836829 - protein, 9 aa, Homo Sapiens
EDGAGLGFK

SEQ ID NO: 836830 - protein, 9 aa, Homo Sapiens
GKIHSKGIF

SEQ ID NO: 836831 - protein, 9 aa, Homo Sapiens
LGLLEDKLQ

SEQ ID NO: 836832 - protein, 9 aa, Homo Sapiens
LQDSNNKVN

SEQ ID NO: 836833 - protein, 9 aa, Homo Sapiens
TFKGNAIIS

SEQ ID NO: 836834 - protein, 9 aa, Homo Sapiens
SIYFLLDSS

SEQ ID NO: 836835 - protein, 9 aa, Homo Sapiens
RSDLNRFWL

SEQ ID NO: 836836 - protein, 9 aa, Homo Sapiens
AMEDRLRKE

SEQ ID NO: 836837 - protein, 9 aa, Homo Sapiens
TFGQLILPG

SEQ ID NO: 836838 - protein, 9 aa, Homo Sapiens
HTRHYQSYM

SEQ ID NO: 836839 - protein, 9 aa, Homo Sapiens
KKISHYMKK

SEQ ID NO: 836840 - protein, 9 aa, Homo Sapiens
WLGQQGGWR

SEQ ID NO: 836841 - protein, 9 aa, Homo Sapiens
SGLPLGYMG

SEQ ID NO: 836842 - protein, 9 aa, Homo Sapiens
TLFLMLVST

SEQ ID NO: 836843 - protein, 9 aa, Homo Sapiens
SFLQYFGRL

SEQ ID NO: 836844 - protein, 9 aa, Homo Sapiens
ITPTPFKNA

SEQ ID NO: 836845 - protein, 9 aa, Homo Sapiens
KAFKQLLYD

SEQ ID NO: 836846 - protein, 9 aa, Homo Sapiens
IIFKCLSKD

SEQ ID NO: 836847 - protein, 9 aa, Homo Sapiens
EETVYGLNK

SEQ ID NO: 836848 - protein, 9 aa, Homo Sapiens
LLDFPVTDS

SEQ ID NO: 836849 - protein, 9 aa, Homo Sapiens
NYQLQIVIF

SEQ ID NO: 836850 - protein, 9 aa, Homo Sapiens
LNTKDKHLS

SEQ ID NO: 836851 - protein, 9 aa, Homo Sapiens
GNELFCEVD

SEQ ID NO: 836852 - protein, 9 aa, Homo Sapiens
YFDNTQKSG

SEQ ID NO: 836853 - protein, 9 aa, Homo Sapiens
YSGVILGIT

SEQ ID NO: 836854 - protein, 9 aa, Homo Sapiens
HFPHKSLRE

SEQ ID NO: 836855 - protein, 9 aa, Homo Sapiens
LQELQRCLR

SEQ ID NO: 836856 - protein, 9 aa, Homo Sapiens
GAVVVDHKG

SEQ ID NO: 836857 - protein, 9 aa, Homo Sapiens
IISKQYNNE

SEQ ID NO: 836858 - protein, 9 aa, Homo Sapiens
ALSGPGLVC

SEQ ID NO: 836859 - protein, 9 aa, Homo Sapiens
CSIPKSNIV

SEQ ID NO: 836860 - protein, 9 aa, Homo Sapiens
PQIRIETRQ

SEQ ID NO: 836861 - protein, 9 aa, Homo Sapiens
KLSKAQCEQ

SEQ ID NO: 836862 - protein, 9 aa, Homo Sapiens
SEILFGTPL

SEQ ID NO: 836863 - protein, 9 aa, Homo Sapiens
KNLKQACLP

SEQ ID NO: 836864 - protein, 9 aa, Homo Sapiens
VKFLIKTKA

SEQ ID NO: 836865 - protein, 9 aa, Homo Sapiens
QKTLQQLRH

SEQ ID NO: 836866 - protein, 9 aa, Homo Sapiens
LPACLQWLG

SEQ ID NO: 836867 - protein, 9 aa, Homo Sapiens
RFTYEDTNF

SEQ ID NO: 836868 - protein, 9 aa, Homo Sapiens
RQKNKCVCD

SEQ ID NO: 836869 - protein, 9 aa, Homo Sapiens
HECKIKYSE

SEQ ID NO: 836870 - protein, 9 aa, Homo Sapiens
PSKHLSWED

SEQ ID NO: 836871 - protein, 9 aa, Homo Sapiens
QIPSCLYQD

SEQ ID NO: 836872 - protein, 9 aa, Homo Sapiens
VYPFRSCTI

SEQ ID NO: 836873 - protein, 9 aa, Homo Sapiens
SNGIRTEQG

SEQ ID NO: 836874 - protein, 9 aa, Homo Sapiens
SKKVGTYNN

SEQ ID NO: 836875 - protein, 9 aa, Homo Sapiens
VQTCLKLIR

SEQ ID NO: 836876 - protein, 9 aa, Homo Sapiens
NIQKDLETR

SEQ ID NO: 836877 - protein, 9 aa, Homo Sapiens
LLEKLIELE

SEQ ID NO: 836878 - protein, 9 aa, Homo Sapiens
MLKSEWDAL

SEQ ID NO: 836879 - protein, 9 aa, Homo Sapiens
GNETQHYPA

SEQ ID NO: 836880 - protein, 9 aa, Homo Sapiens
MFCTKLNDL

SEQ ID NO: 836881 - protein, 9 aa, Homo Sapiens
TGKKPYKCP

SEQ ID NO: 836882 - protein, 9 aa, Homo Sapiens
EHEKQKNEL

SEQ ID NO: 836883 - protein, 9 aa, Homo Sapiens
YYGKKHKKN

SEQ ID NO: 836884 - protein, 9 aa, Homo Sapiens
PGLRGAGLL

SEQ ID NO: 836885 - protein, 9 aa, Homo Sapiens
RNTIDINNV

SEQ ID NO: 836886 - protein, 9 aa, Homo Sapiens
LLYKAINSN

SEQ ID NO: 836887 - protein, 9 aa, Homo Sapiens
KHTQSITSQ

SEQ ID NO: 836888 - protein, 9 aa, Homo Sapiens
TTRPNGPNT

SEQ ID NO: 836889 - protein, 9 aa, Homo Sapiens
NNFLNYLPE

SEQ ID NO: 836890 - protein, 9 aa, Homo Sapiens
LKNTLKSVF

SEQ ID NO: 836891 - protein, 9 aa, Homo Sapiens
LIKATYNRT

SEQ ID NO: 836892 - protein, 9 aa, Homo Sapiens
FNKEQQLQI

SEQ ID NO: 836893 - protein, 9 aa, Homo Sapiens
CCGSCRDSR

SEQ ID NO: 836894 - protein, 9 aa, Homo Sapiens
WLCGESQEK

SEQ ID NO: 836895 - protein, 9 aa, Homo Sapiens
SMSASLNSL

SEQ ID NO: 836896 - protein, 9 aa, Homo Sapiens
SECLFSVVA

SEQ ID NO: 836897 - protein, 9 aa, Homo Sapiens
SSRSIFGTM

SEQ ID NO: 836898 - protein, 9 aa, Homo Sapiens
NTHGLTPLL

SEQ ID NO: 836899 - protein, 9 aa, Homo Sapiens
GSYAIIVSS

SEQ ID NO: 836900 - protein, 9 aa, Homo Sapiens
CDAKSWTQR

SEQ ID NO: 836901 - protein, 9 aa, Homo Sapiens
IKYDFPLNR

SEQ ID NO: 836902 - protein, 9 aa, Homo Sapiens
AVSADSKGV

SEQ ID NO: 836903 - protein, 9 aa, Homo Sapiens
WFGRKRTLP

SEQ ID NO: 836904 - protein, 9 aa, Homo Sapiens
ETCTYLYLL

SEQ ID NO: 836905 - protein, 9 aa, Homo Sapiens
CSRYMHDLF

SEQ ID NO: 836906 - protein, 9 aa, Homo Sapiens
PLVNFCVTV

SEQ ID NO: 836907 - protein, 9 aa, Homo Sapiens
FRSRCQKVE

SEQ ID NO: 836908 - protein, 9 aa, Homo Sapiens
KPGTDEAED

SEQ ID NO: 836909 - protein, 9 aa, Homo Sapiens
HDHRSVCSG

SEQ ID NO: 836910 - protein, 9 aa, Homo Sapiens
VIKYDFQKD

SEQ ID NO: 836911 - protein, 9 aa, Homo Sapiens
NVRGNAIYG

SEQ ID NO: 836912 - protein, 9 aa, Homo Sapiens
INYAKVWKM

SEQ ID NO: 836913 - protein, 9 aa, Homo Sapiens
NNLQKEKSK

SEQ ID NO: 836914 - protein, 9 aa, Homo Sapiens
SQASELSTD

SEQ ID NO: 836915 - protein, 9 aa, Homo Sapiens
SKSPKNKLG

SEQ ID NO: 836916 - protein, 9 aa, Homo Sapiens
INTHKRIHT

SEQ ID NO: 836917 - protein, 9 aa, Homo Sapiens
ISPEPPIVQ

SEQ ID NO: 836918 - protein, 9 aa, Homo Sapiens
NLFNKLVEL

SEQ ID NO: 836919 - protein, 9 aa, Homo Sapiens
DLTSRLMIF

SEQ ID NO: 836920 - protein, 9 aa, Homo Sapiens
EFSETDFVA

SEQ ID NO: 836921 - protein, 9 aa, Homo Sapiens
AQHQIVHTG

SEQ ID NO: 836922 - protein, 9 aa, Homo Sapiens
VARQVCKQL

SEQ ID NO: 836923 - protein, 9 aa, Homo Sapiens
WPQSRSVMS

SEQ ID NO: 836924 - protein, 9 aa, Homo Sapiens
VNSGYDSMG

SEQ ID NO: 836925 - protein, 9 aa, Homo Sapiens
SLRAPAQFT

SEQ ID NO: 836926 - protein, 9 aa, Homo Sapiens
IDQSECEGF

SEQ ID NO: 836927 - protein, 9 aa, Homo Sapiens
QQLIETSPV

SEQ ID NO: 836928 - protein, 9 aa, Homo Sapiens
KRTEVVLTI

SEQ ID NO: 836929 - protein, 9 aa, Homo Sapiens
SLSHLEARR

SEQ ID NO: 836930 - protein, 9 aa, Homo Sapiens
VYFKQFCIT

SEQ ID NO: 836931 - protein, 9 aa, Homo Sapiens
RTYRHASSL

SEQ ID NO: 836932 - protein, 9 aa, Homo Sapiens
NRTIFQKGD

SEQ ID NO: 836933 - protein, 9 aa, Homo Sapiens
GLEPVCFEM

SEQ ID NO: 836934 - protein, 9 aa, Homo Sapiens
LDGVSNEMY

SEQ ID NO: 836935 - protein, 9 aa, Homo Sapiens
LITERDNVF

SEQ ID NO: 836936 - protein, 9 aa, Homo Sapiens
LYLVSRYLG

SEQ ID NO: 836937 - protein, 9 aa, Homo Sapiens
KCEIHNGIE

SEQ ID NO: 836938 - protein, 9 aa, Homo Sapiens
DKLVELQEQ

SEQ ID NO: 836939 - protein, 9 aa, Homo Sapiens
HSVTQNCRV

SEQ ID NO: 836940 - protein, 9 aa, Homo Sapiens
MRLLILREI

SEQ ID NO: 836941 - protein, 9 aa, Homo Sapiens
GQGFALVYA

SEQ ID NO: 836942 - protein, 9 aa, Homo Sapiens
REARIRRLL

SEQ ID NO: 836943 - protein, 9 aa, Homo Sapiens
DIYALQSFN

SEQ ID NO: 836944 - protein, 9 aa, Homo Sapiens
EIEEQEVVD

SEQ ID NO: 836945 - protein, 9 aa, Homo Sapiens
NHEKLQEAL

SEQ ID NO: 836946 - protein, 9 aa, Homo Sapiens
RVEGADDEE

SEQ ID NO: 836947 - protein, 9 aa, Homo Sapiens
VDATRKCYR

SEQ ID NO: 836948 - protein, 9 aa, Homo Sapiens
CNVCTFQKR

SEQ ID NO: 836949 - protein, 9 aa, Homo Sapiens
QQGKIVLTA

SEQ ID NO: 836950 - protein, 9 aa, Homo Sapiens
KRLIEHQRI

SEQ ID NO: 836951 - protein, 9 aa, Homo Sapiens
KKKAAARYV

SEQ ID NO: 836952 - protein, 9 aa, Homo Sapiens
IYSLRNGSM

SEQ ID NO: 836953 - protein, 9 aa, Homo Sapiens
LEQDKISLH

SEQ ID NO: 836954 - protein, 9 aa, Homo Sapiens
FQNKKKTGS

SEQ ID NO: 836955 - protein, 9 aa, Homo Sapiens
EQLLEREED

SEQ ID NO: 836956 - protein, 9 aa, Homo Sapiens
KLQESKLDV

SEQ ID NO: 836957 - protein, 9 aa, Homo Sapiens
TLSFNETSP

SEQ ID NO: 836958 - protein, 9 aa, Homo Sapiens
PDEPFTIQF

SEQ ID NO: 836959 - protein, 9 aa, Homo Sapiens
WYNLIELPY

SEQ ID NO: 836960 - protein, 9 aa, Homo Sapiens
SFDKMIEAS

SEQ ID NO: 836961 - protein, 9 aa, Homo Sapiens
ICYFKVRQL

SEQ ID NO: 836962 - protein, 9 aa, Homo Sapiens
GKKAHHDFG

SEQ ID NO: 836963 - protein, 9 aa, Homo Sapiens
LECGSAVSL

SEQ ID NO: 836964 - protein, 9 aa, Homo Sapiens
YPVGTGRDM

SEQ ID NO: 836965 - protein, 9 aa, Homo Sapiens
VSTRASGMT

SEQ ID NO: 836966 - protein, 9 aa, Homo Sapiens
RGTPQPSSP

SEQ ID NO: 836967 - protein, 9 aa, Homo Sapiens
FYINMYVSI

SEQ ID NO: 836968 - protein, 9 aa, Homo Sapiens
YSVPLETVS

SEQ ID NO: 836969 - protein, 9 aa, Homo Sapiens
HRPGPRPPN

SEQ ID NO: 836970 - protein, 9 aa, Homo Sapiens
FEISTDKET

SEQ ID NO: 836971 - protein, 9 aa, Homo Sapiens
DFFMYSQSN

SEQ ID NO: 836972 - protein, 9 aa, Homo Sapiens
GRYCIFNNN

SEQ ID NO: 836973 - protein, 9 aa, Homo Sapiens
GRAVSKPDV

SEQ ID NO: 836974 - protein, 9 aa, Homo Sapiens
TLNYLIYTL

SEQ ID NO: 836975 - protein, 9 aa, Homo Sapiens
PKETNSSSN

SEQ ID NO: 836976 - protein, 9 aa, Homo Sapiens
LTQVVSKLW

SEQ ID NO: 836977 - protein, 9 aa, Homo Sapiens
LVFILRNQK

SEQ ID NO: 836978 - protein, 9 aa, Homo Sapiens
LAFAQLIIG

SEQ ID NO: 836979 - protein, 9 aa, Homo Sapiens
RINSLKLQA

SEQ ID NO: 836980 - protein, 9 aa, Homo Sapiens
FKLTLQARD

SEQ ID NO: 836981 - protein, 9 aa, Homo Sapiens
QDSFLHENL

SEQ ID NO: 836982 - protein, 9 aa, Homo Sapiens
GPWRQSSSQ

SEQ ID NO: 836983 - protein, 9 aa, Homo Sapiens
SEAASVNKQ

SEQ ID NO: 836984 - protein, 9 aa, Homo Sapiens
AFSNGKTFE

SEQ ID NO: 836985 - protein, 9 aa, Homo Sapiens
RKLSNSSLS

SEQ ID NO: 836986 - protein, 9 aa, Homo Sapiens
YSALSLLKY

SEQ ID NO: 836987 - protein, 9 aa, Homo Sapiens
EENHIQVPE

SEQ ID NO: 836988 - protein, 9 aa, Homo Sapiens
FHPEKLHFV

SEQ ID NO: 836989 - protein, 9 aa, Homo Sapiens
INDVEIEEE

SEQ ID NO: 836990 - protein, 9 aa, Homo Sapiens
HLGANEVLL

SEQ ID NO: 836991 - protein, 9 aa, Homo Sapiens
YSNFHAVKR

SEQ ID NO: 836992 - protein, 9 aa, Homo Sapiens
MKKICDDAY

SEQ ID NO: 836993 - protein, 9 aa, Homo Sapiens
YVVMVIDRI

SEQ ID NO: 836994 - protein, 9 aa, Homo Sapiens
HFEESGQDI

SEQ ID NO: 836995 - protein, 9 aa, Homo Sapiens
INDSKDNQA

SEQ ID NO: 836996 - protein, 9 aa, Homo Sapiens
TSIPQQLAN

SEQ ID NO: 836997 - protein, 9 aa, Homo Sapiens
GTTYSPKME

SEQ ID NO: 836998 - protein, 9 aa, Homo Sapiens
LGQVFISDI

SEQ ID NO: 836999 - protein, 9 aa, Homo Sapiens
LLNANSGGR

SEQ ID NO: 837000 - protein, 9 aa, Homo Sapiens
STLKNEQSL

SEQ ID NO: 837001 - protein, 9 aa, Homo Sapiens
ICRISHHHP

SEQ ID NO: 837002 - protein, 9 aa, Homo Sapiens
RTSKLLRDS

SEQ ID NO: 837003 - protein, 9 aa, Homo Sapiens
VIRSEEPEV

SEQ ID NO: 837004 - protein, 9 aa, Homo Sapiens
MLYNTCYSS

SEQ ID NO: 837005 - protein, 9 aa, Homo Sapiens
MTLFEVGGS

SEQ ID NO: 837006 - protein, 9 aa, Homo Sapiens
SSSQPEVSR

SEQ ID NO: 837007 - protein, 9 aa, Homo Sapiens
EICTMMTQL

SEQ ID NO: 837008 - protein, 9 aa, Homo Sapiens
NYFSLELSV

SEQ ID NO: 837009 - protein, 9 aa, Homo Sapiens
IRRVRKTDT

SEQ ID NO: 837010 - protein, 9 aa, Homo Sapiens
PDRTGAPGP

SEQ ID NO: 837011 - protein, 9 aa, Homo Sapiens
LWNNLIDEH

SEQ ID NO: 837012 - protein, 9 aa, Homo Sapiens
GTTEKTDEE

SEQ ID NO: 837013 - protein, 9 aa, Homo Sapiens
KRFVTTSYL

SEQ ID NO: 837014 - protein, 9 aa, Homo Sapiens
RYDLELIVN

SEQ ID NO: 837015 - protein, 9 aa, Homo Sapiens
LQCTHGVGR

SEQ ID NO: 837016 - protein, 9 aa, Homo Sapiens
LTRINEEID

SEQ ID NO: 837017 - protein, 9 aa, Homo Sapiens
QTSHLNDHW

SEQ ID NO: 837018 - protein, 9 aa, Homo Sapiens
RKPDTLQTG

SEQ ID NO: 837019 - protein, 9 aa, Homo Sapiens
AVNAILTVA

SEQ ID NO: 837020 - protein, 9 aa, Homo Sapiens
EHPNPGKRH

SEQ ID NO: 837021 - protein, 9 aa, Homo Sapiens
LAVREFICL

SEQ ID NO: 837022 - protein, 9 aa, Homo Sapiens
QRGALGETV

SEQ ID NO: 837023 - protein, 9 aa, Homo Sapiens
EQTTHEPVL

SEQ ID NO: 837024 - protein, 9 aa, Homo Sapiens
KLSNSSLSV

SEQ ID NO: 837025 - protein, 9 aa, Homo Sapiens
SCGRVQPAA

SEQ ID NO: 837026 - protein, 9 aa, Homo Sapiens
EDQNSLERQ

SEQ ID NO: 837027 - protein, 9 aa, Homo Sapiens
QPILDMAAG

SEQ ID NO: 837028 - protein, 9 aa, Homo Sapiens
CRAPHFHIN

SEQ ID NO: 837029 - protein, 9 aa, Homo Sapiens
VETPGCSVS

SEQ ID NO: 837030 - protein, 9 aa, Homo Sapiens
GEQDQEERR

SEQ ID NO: 837031 - protein, 9 aa, Homo Sapiens
FSQSFPQPL

SEQ ID NO: 837032 - protein, 9 aa, Homo Sapiens
PIIELSHIW

SEQ ID NO: 837033 - protein, 9 aa, Homo Sapiens
NPNINDSKD

SEQ ID NO: 837034 - protein, 9 aa, Homo Sapiens
ISGDCDDMD

SEQ ID NO: 837035 - protein, 9 aa, Homo Sapiens
EEIWSLLLL

SEQ ID NO: 837036 - protein, 9 aa, Homo Sapiens
ARMLSLTTI

SEQ ID NO: 837037 - protein, 9 aa, Homo Sapiens
PKPMEPPMN

SEQ ID NO: 837038 - protein, 9 aa, Homo Sapiens
SNVSGLACD

SEQ ID NO: 837039 - protein, 9 aa, Homo Sapiens
RLWRCQVAR

SEQ ID NO: 837040 - protein, 9 aa, Homo Sapiens
VQHILLDQK

SEQ ID NO: 837041 - protein, 9 aa, Homo Sapiens
QTSINTAII

SEQ ID NO: 837042 - protein, 9 aa, Homo Sapiens
VIKKSSSII

SEQ ID NO: 837043 - protein, 9 aa, Homo Sapiens
EEAQQLLHN

SEQ ID NO: 837044 - protein, 9 aa, Homo Sapiens
LAIINLGNY

SEQ ID NO: 837045 - protein, 9 aa, Homo Sapiens
DLLKTVEGR

SEQ ID NO: 837046 - protein, 9 aa, Homo Sapiens
KWGGCSKDI

SEQ ID NO: 837047 - protein, 9 aa, Homo Sapiens
QHLPAGFLY

SEQ ID NO: 837048 - protein, 9 aa, Homo Sapiens
WQTVANHVN

SEQ ID NO: 837049 - protein, 9 aa, Homo Sapiens
CCRDEFLLP

SEQ ID NO: 837050 - protein, 9 aa, Homo Sapiens
DCMDPTMDN

SEQ ID NO: 837051 - protein, 9 aa, Homo Sapiens
TKPLRASTA

SEQ ID NO: 837052 - protein, 9 aa, Homo Sapiens
EFNQLRLQG

SEQ ID NO: 837053 - protein, 9 aa, Homo Sapiens
KFNEPESVI

SEQ ID NO: 837054 - protein, 9 aa, Homo Sapiens
FSRTRNIRD

SEQ ID NO: 837055 - protein, 9 aa, Homo Sapiens
EYYIIVCEN

SEQ ID NO: 837056 - protein, 9 aa, Homo Sapiens
LHYPVAGYR

SEQ ID NO: 837057 - protein, 9 aa, Homo Sapiens
RSKNKIAAQ

SEQ ID NO: 837058 - protein, 9 aa, Homo Sapiens
STNLHKILR

SEQ ID NO: 837059 - protein, 9 aa, Homo Sapiens
LQKRPLMPF

SEQ ID NO: 837060 - protein, 9 aa, Homo Sapiens
WKKIKTATK

SEQ ID NO: 837061 - protein, 9 aa, Homo Sapiens
ETVNSVTTD

SEQ ID NO: 837062 - protein, 9 aa, Homo Sapiens
LVTVVDYGK

SEQ ID NO: 837063 - protein, 9 aa, Homo Sapiens
SLFVVSTVF

SEQ ID NO: 837064 - protein, 9 aa, Homo Sapiens
SLVLLVRII

SEQ ID NO: 837065 - protein, 9 aa, Homo Sapiens
GVSILYQKP

SEQ ID NO: 837066 - protein, 9 aa, Homo Sapiens
RGGFSFDNC

SEQ ID NO: 837067 - protein, 9 aa, Homo Sapiens
YIRANRQLC

SEQ ID NO: 837068 - protein, 9 aa, Homo Sapiens
ILALMPLFS

SEQ ID NO: 837069 - protein, 9 aa, Homo Sapiens
QPQQEWENN

SEQ ID NO: 837070 - protein, 9 aa, Homo Sapiens
PTLPQESMS

SEQ ID NO: 837071 - protein, 9 aa, Homo Sapiens
VSRPVATHP

SEQ ID NO: 837072 - protein, 9 aa, Homo Sapiens
KSVHFYAKC

SEQ ID NO: 837073 - protein, 9 aa, Homo Sapiens
LEKIVCNPG

SEQ ID NO: 837074 - protein, 9 aa, Homo Sapiens
KGVKHQPPP

SEQ ID NO: 837075 - protein, 9 aa, Homo Sapiens
QIDTPSLEE

SEQ ID NO: 837076 - protein, 9 aa, Homo Sapiens
AWINLNKEE

SEQ ID NO: 837077 - protein, 9 aa, Homo Sapiens
PVIELYKNR

SEQ ID NO: 837078 - protein, 9 aa, Homo Sapiens
PDWCKCKKV

SEQ ID NO: 837079 - protein, 9 aa, Homo Sapiens
FIGISLVIL

SEQ ID NO: 837080 - protein, 9 aa, Homo Sapiens
YKCTECEQS

SEQ ID NO: 837081 - protein, 9 aa, Homo Sapiens
SCRPFSDRV

SEQ ID NO: 837082 - protein, 9 aa, Homo Sapiens
LVKSSFPEK

SEQ ID NO: 837083 - protein, 9 aa, Homo Sapiens
SRMYKELKQ

SEQ ID NO: 837084 - protein, 9 aa, Homo Sapiens
GTTPITPTP

SEQ ID NO: 837085 - protein, 9 aa, Homo Sapiens
TQEDHMKLK

SEQ ID NO: 837086 - protein, 9 aa, Homo Sapiens
ICRPCEIKK

SEQ ID NO: 837087 - protein, 9 aa, Homo Sapiens
EWIRKISES

SEQ ID NO: 837088 - protein, 9 aa, Homo Sapiens
LKDFTTKGV

SEQ ID NO: 837089 - protein, 9 aa, Homo Sapiens
ISLSILLSE

SEQ ID NO: 837090 - protein, 9 aa, Homo Sapiens
SVASMNSAT

SEQ ID NO: 837091 - protein, 9 aa, Homo Sapiens
KDPGANNRL

SEQ ID NO: 837092 - protein, 9 aa, Homo Sapiens
SAWGMPSPS

SEQ ID NO: 837093 - protein, 9 aa, Homo Sapiens
ALALNLLVK

SEQ ID NO: 837094 - protein, 9 aa, Homo Sapiens
SLDEMATYD

SEQ ID NO: 837095 - protein, 9 aa, Homo Sapiens
VGNAFIPHL

SEQ ID NO: 837096 - protein, 9 aa, Homo Sapiens
DVQYFGETG

SEQ ID NO: 837097 - protein, 9 aa, Homo Sapiens
LFQRDSLVQ

SEQ ID NO: 837098 - protein, 9 aa, Homo Sapiens
TQNKIAILD

SEQ ID NO: 837099 - protein, 9 aa, Homo Sapiens
IICGSRKMP

SEQ ID NO: 837100 - protein, 9 aa, Homo Sapiens
TKHPEKTTS

SEQ ID NO: 837101 - protein, 9 aa, Homo Sapiens
QRTPCYACP

SEQ ID NO: 837102 - protein, 9 aa, Homo Sapiens
LGAKLYSTS

SEQ ID NO: 837103 - protein, 9 aa, Homo Sapiens
YVVVMPKKK

SEQ ID NO: 837104 - protein, 9 aa, Homo Sapiens
PRYLLGVIN

SEQ ID NO: 837105 - protein, 9 aa, Homo Sapiens
TSAKPSDCP

SEQ ID NO: 837106 - protein, 9 aa, Homo Sapiens
FLFTLLSEL

SEQ ID NO: 837107 - protein, 9 aa, Homo Sapiens
LKGAQEQQV

SEQ ID NO: 837108 - protein, 9 aa, Homo Sapiens
DGANNYFEH

SEQ ID NO: 837109 - protein, 9 aa, Homo Sapiens
EEWLFTKTE

SEQ ID NO: 837110 - protein, 9 aa, Homo Sapiens
DHVKVILYQ

SEQ ID NO: 837111 - protein, 9 aa, Homo Sapiens
AIHHLIEGV

SEQ ID NO: 837112 - protein, 9 aa, Homo Sapiens
VPEGLLTSY

SEQ ID NO: 837113 - protein, 9 aa, Homo Sapiens
KGICELVSE

SEQ ID NO: 837114 - protein, 9 aa, Homo Sapiens
ELAEDKREG

SEQ ID NO: 837115 - protein, 9 aa, Homo Sapiens
GMRESFTAY

SEQ ID NO: 837116 - protein, 9 aa, Homo Sapiens
QFDQARGVL

SEQ ID NO: 837117 - protein, 9 aa, Homo Sapiens
AKESWVNTV

SEQ ID NO: 837118 - protein, 9 aa, Homo Sapiens
CCKGINISG

SEQ ID NO: 837119 - protein, 9 aa, Homo Sapiens
RERVALAKY

SEQ ID NO: 837120 - protein, 9 aa, Homo Sapiens
SIPASLSTF

SEQ ID NO: 837121 - protein, 9 aa, Homo Sapiens
ETIKNYMME

SEQ ID NO: 837122 - protein, 9 aa, Homo Sapiens
LPEKLEETK

SEQ ID NO: 837123 - protein, 9 aa, Homo Sapiens
SNYRASASR

SEQ ID NO: 837124 - protein, 9 aa, Homo Sapiens
CHHHHHHPY

SEQ ID NO: 837125 - protein, 9 aa, Homo Sapiens
LKSFSNLAN

SEQ ID NO: 837126 - protein, 9 aa, Homo Sapiens
SVERHMGTA

SEQ ID NO: 837127 - protein, 9 aa, Homo Sapiens
PPRIRKTQK

SEQ ID NO: 837128 - protein, 9 aa, Homo Sapiens
SLIHNNYKS

SEQ ID NO: 837129 - protein, 9 aa, Homo Sapiens
FPKDVLVQF

SEQ ID NO: 837130 - protein, 9 aa, Homo Sapiens
EDNRKWMRE

SEQ ID NO: 837131 - protein, 9 aa, Homo Sapiens
LNYLFRAIQ

SEQ ID NO: 837132 - protein, 9 aa, Homo Sapiens
RVDLDMLTF

SEQ ID NO: 837133 - protein, 9 aa, Homo Sapiens
LDRYYTALY

SEQ ID NO: 837134 - protein, 9 aa, Homo Sapiens
PGKLDKLEN

SEQ ID NO: 837135 - protein, 9 aa, Homo Sapiens
NLTLIPNQK

SEQ ID NO: 837136 - protein, 9 aa, Homo Sapiens
KDVLYKLSP

SEQ ID NO: 837137 - protein, 9 aa, Homo Sapiens
RKRRQNAGK

SEQ ID NO: 837138 - protein, 9 aa, Homo Sapiens
VVAHMTRSE

SEQ ID NO: 837139 - protein, 9 aa, Homo Sapiens
SARFVTDFL

SEQ ID NO: 837140 - protein, 9 aa, Homo Sapiens
LDLIRPLRI

SEQ ID NO: 837141 - protein, 9 aa, Homo Sapiens
GCNSGSEKS

SEQ ID NO: 837142 - protein, 9 aa, Homo Sapiens
RYPVMSTLL

SEQ ID NO: 837143 - protein, 9 aa, Homo Sapiens
QLSLIILDI

SEQ ID NO: 837144 - protein, 9 aa, Homo Sapiens
VEYMEKEKK

SEQ ID NO: 837145 - protein, 9 aa, Homo Sapiens
VVSVFVKVS

SEQ ID NO: 837146 - protein, 9 aa, Homo Sapiens
KLFKNKSSG

SEQ ID NO: 837147 - protein, 9 aa, Homo Sapiens
SVSSTDGDD

SEQ ID NO: 837148 - protein, 9 aa, Homo Sapiens
QEDGGVYSY

SEQ ID NO: 837149 - protein, 9 aa, Homo Sapiens
LCLIPTGLP

SEQ ID NO: 837150 - protein, 9 aa, Homo Sapiens
VANHVNTTL

SEQ ID NO: 837151 - protein, 9 aa, Homo Sapiens
WETMKMRYK

SEQ ID NO: 837152 - protein, 9 aa, Homo Sapiens
RFWSGNYRF

SEQ ID NO: 837153 - protein, 9 aa, Homo Sapiens
KYANVFHQC

SEQ ID NO: 837154 - protein, 9 aa, Homo Sapiens
VFIVFTGNE

SEQ ID NO: 837155 - protein, 9 aa, Homo Sapiens
VQGVSDSLL

SEQ ID NO: 837156 - protein, 9 aa, Homo Sapiens
SSLCYKQII

SEQ ID NO: 837157 - protein, 9 aa, Homo Sapiens
VLAPSGGEG

SEQ ID NO: 837158 - protein, 9 aa, Homo Sapiens
EILLSHHAN

SEQ ID NO: 837159 - protein, 9 aa, Homo Sapiens
EEEDAGEDE

SEQ ID NO: 837160 - protein, 9 aa, Homo Sapiens
ILPCRHLLH

SEQ ID NO: 837161 - protein, 9 aa, Homo Sapiens
ESINKTLTD

SEQ ID NO: 837162 - protein, 9 aa, Homo Sapiens
YINMYVSIV

SEQ ID NO: 837163 - protein, 9 aa, Homo Sapiens
KEEIKKIKY

SEQ ID NO: 837164 - protein, 9 aa, Homo Sapiens
LSKEIKRLT

SEQ ID NO: 837165 - protein, 9 aa, Homo Sapiens
VTFSAVRST

SEQ ID NO: 837166 - protein, 9 aa, Homo Sapiens
ECSDTISPH

SEQ ID NO: 837167 - protein, 9 aa, Homo Sapiens
QMKIVDVIG

SEQ ID NO: 837168 - protein, 9 aa, Homo Sapiens
YECHKCGKT

SEQ ID NO: 837169 - protein, 9 aa, Homo Sapiens
NHNKIRNIL

SEQ ID NO: 837170 - protein, 9 aa, Homo Sapiens
ERKVFVGRF

SEQ ID NO: 837171 - protein, 9 aa, Homo Sapiens
MHSLEGFLD

SEQ ID NO: 837172 - protein, 9 aa, Homo Sapiens
GDLRAESVT

SEQ ID NO: 837173 - protein, 9 aa, Homo Sapiens
CGNKYYRFN

SEQ ID NO: 837174 - protein, 9 aa, Homo Sapiens
SHVKISASR

SEQ ID NO: 837175 - protein, 9 aa, Homo Sapiens
KEGSKPVLF

SEQ ID NO: 837176 - protein, 9 aa, Homo Sapiens
IHQLQLIKQ

SEQ ID NO: 837177 - protein, 9 aa, Homo Sapiens
KPTTIIKKN

SEQ ID NO: 837178 - protein, 9 aa, Homo Sapiens
AAKIINTNK

SEQ ID NO: 837179 - protein, 9 aa, Homo Sapiens
VPINSVNLD

SEQ ID NO: 837180 - protein, 9 aa, Homo Sapiens
TVHQIIHTV

SEQ ID NO: 837181 - protein, 9 aa, Homo Sapiens
SPDIIPPGP

SEQ ID NO: 837182 - protein, 9 aa, Homo Sapiens
KAKEEGAEL

SEQ ID NO: 837183 - protein, 9 aa, Homo Sapiens
DINLKEYAD

SEQ ID NO: 837184 - protein, 9 aa, Homo Sapiens
LMDNNRIEE

SEQ ID NO: 837185 - protein, 9 aa, Homo Sapiens
ITSPEELLN

SEQ ID NO: 837186 - protein, 9 aa, Homo Sapiens
RAGLLTAVE

SEQ ID NO: 837187 - protein, 9 aa, Homo Sapiens
TVHQIIHTG

SEQ ID NO: 837188 - protein, 9 aa, Homo Sapiens
KGYGMMSKS

SEQ ID NO: 837189 - protein, 9 aa, Homo Sapiens
HIIAIVFFR

SEQ ID NO: 837190 - protein, 9 aa, Homo Sapiens
APIPRAVPS

SEQ ID NO: 837191 - protein, 9 aa, Homo Sapiens
ANGEAGLEG

SEQ ID NO: 837192 - protein, 9 aa, Homo Sapiens
RTPPPTYRT

SEQ ID NO: 837193 - protein, 9 aa, Homo Sapiens
NALYFDQKY

SEQ ID NO: 837194 - protein, 9 aa, Homo Sapiens
NDGPERARE

SEQ ID NO: 837195 - protein, 9 aa, Homo Sapiens
QNVTFVFDA

SEQ ID NO: 837196 - protein, 9 aa, Homo Sapiens
LRAMALPPL

SEQ ID NO: 837197 - protein, 9 aa, Homo Sapiens
VAKSLEAPI

SEQ ID NO: 837198 - protein, 9 aa, Homo Sapiens
KKVDPSKLM

SEQ ID NO: 837199 - protein, 9 aa, Homo Sapiens
TVLRSKGEG

SEQ ID NO: 837200 - protein, 9 aa, Homo Sapiens
HMSQTTISH

SEQ ID NO: 837201 - protein, 9 aa, Homo Sapiens
EKEKKTWGT

SEQ ID NO: 837202 - protein, 9 aa, Homo Sapiens
MGIVHQDLK

SEQ ID NO: 837203 - protein, 9 aa, Homo Sapiens
SLRCISKMN

SEQ ID NO: 837204 - protein, 9 aa, Homo Sapiens
LQLQELRYE

SEQ ID NO: 837205 - protein, 9 aa, Homo Sapiens
SLSNVKLNE

SEQ ID NO: 837206 - protein, 9 aa, Homo Sapiens
EDDVKLLSI

SEQ ID NO: 837207 - protein, 9 aa, Homo Sapiens
IVQDSKLQL

SEQ ID NO: 837208 - protein, 9 aa, Homo Sapiens
VQVNLTAHE

SEQ ID NO: 837209 - protein, 9 aa, Homo Sapiens
LITVDDKLD

SEQ ID NO: 837210 - protein, 9 aa, Homo Sapiens
GLKHYAEYQ

SEQ ID NO: 837211 - protein, 9 aa, Homo Sapiens
SEGIYAIAV

SEQ ID NO: 837212 - protein, 9 aa, Homo Sapiens
GNNLETFTM

SEQ ID NO: 837213 - protein, 9 aa, Homo Sapiens
AEIIDEFIV

SEQ ID NO: 837214 - protein, 9 aa, Homo Sapiens
SDTRRLSSS

SEQ ID NO: 837215 - protein, 9 aa, Homo Sapiens
KELARQISC

SEQ ID NO: 837216 - protein, 9 aa, Homo Sapiens
PENGNPQQT

SEQ ID NO: 837217 - protein, 9 aa, Homo Sapiens
TSDPCAMNC

SEQ ID NO: 837218 - protein, 9 aa, Homo Sapiens
GNYIKTPPG

SEQ ID NO: 837219 - protein, 9 aa, Homo Sapiens
INQYGEVMV

SEQ ID NO: 837220 - protein, 9 aa, Homo Sapiens
SGCTLAQWP

SEQ ID NO: 837221 - protein, 9 aa, Homo Sapiens
CLLELGRRT

SEQ ID NO: 837222 - protein, 9 aa, Homo Sapiens
DKSVNKMQE

SEQ ID NO: 837223 - protein, 9 aa, Homo Sapiens
VSANLVVKE

SEQ ID NO: 837224 - protein, 9 aa, Homo Sapiens
FGKQCNLSD

SEQ ID NO: 837225 - protein, 9 aa, Homo Sapiens
WQTSESGRV

SEQ ID NO: 837226 - protein, 9 aa, Homo Sapiens
LFWSFTLYM

SEQ ID NO: 837227 - protein, 9 aa, Homo Sapiens
KSFCWSTSL

SEQ ID NO: 837228 - protein, 9 aa, Homo Sapiens
IQRGRLRDY

SEQ ID NO: 837229 - protein, 9 aa, Homo Sapiens
RKILLQKFC

SEQ ID NO: 837230 - protein, 9 aa, Homo Sapiens
SEESQILVL

SEQ ID NO: 837231 - protein, 9 aa, Homo Sapiens
SADEEHLEV

SEQ ID NO: 837232 - protein, 9 aa, Homo Sapiens
KLVIFLDVK

SEQ ID NO: 837233 - protein, 9 aa, Homo Sapiens
RYRRNVKIT

SEQ ID NO: 837234 - protein, 9 aa, Homo Sapiens
QDRYKKLQE

SEQ ID NO: 837235 - protein, 9 aa, Homo Sapiens
SVRPLPHIA

SEQ ID NO: 837236 - protein, 9 aa, Homo Sapiens
HRIDLDTFI

SEQ ID NO: 837237 - protein, 9 aa, Homo Sapiens
IDLENVDGA

SEQ ID NO: 837238 - protein, 9 aa, Homo Sapiens
LIQTSILRD

SEQ ID NO: 837239 - protein, 9 aa, Homo Sapiens
SSWISDGKK

SEQ ID NO: 837240 - protein, 9 aa, Homo Sapiens
YSALMIRAE

SEQ ID NO: 837241 - protein, 9 aa, Homo Sapiens
EKTMIYFVG

SEQ ID NO: 837242 - protein, 9 aa, Homo Sapiens
IKDRFAFVA

SEQ ID NO: 837243 - protein, 9 aa, Homo Sapiens
RITIIYLLS

SEQ ID NO: 837244 - protein, 9 aa, Homo Sapiens
TSPDYSPTS

SEQ ID NO: 837245 - protein, 9 aa, Homo Sapiens
FSLDEMATY

SEQ ID NO: 837246 - protein, 9 aa, Homo Sapiens
NEGGGSANT

SEQ ID NO: 837247 - protein, 9 aa, Homo Sapiens
YEQTIIFPG

SEQ ID NO: 837248 - protein, 9 aa, Homo Sapiens
PALLYKAIN

SEQ ID NO: 837249 - protein, 9 aa, Homo Sapiens
FDSAYQGFT

SEQ ID NO: 837250 - protein, 9 aa, Homo Sapiens
LDENLKRCF

SEQ ID NO: 837251 - protein, 9 aa, Homo Sapiens
ELSGNPIKV

SEQ ID NO: 837252 - protein, 9 aa, Homo Sapiens
FEKYYVTYS

SEQ ID NO: 837253 - protein, 9 aa, Homo Sapiens
NNKNKFVSL

SEQ ID NO: 837254 - protein, 9 aa, Homo Sapiens
KRMHILHAN

SEQ ID NO: 837255 - protein, 9 aa, Homo Sapiens
AEVAESQFN

SEQ ID NO: 837256 - protein, 9 aa, Homo Sapiens
NTDDKPYEC

SEQ ID NO: 837257 - protein, 9 aa, Homo Sapiens
KINISKNET

SEQ ID NO: 837258 - protein, 9 aa, Homo Sapiens
DNLRLFKER

SEQ ID NO: 837259 - protein, 9 aa, Homo Sapiens
VYTNQNVVW

SEQ ID NO: 837260 - protein, 9 aa, Homo Sapiens
VNTPKEKEE

SEQ ID NO: 837261 - protein, 9 aa, Homo Sapiens
KKIINLKSD

SEQ ID NO: 837262 - protein, 9 aa, Homo Sapiens
KQEDAHEFI

SEQ ID NO: 837263 - protein, 9 aa, Homo Sapiens
IWSLLLLAA

SEQ ID NO: 837264 - protein, 9 aa, Homo Sapiens
GEFILLGGS

SEQ ID NO: 837265 - protein, 9 aa, Homo Sapiens
VAGFIPLLE

SEQ ID NO: 837266 - protein, 9 aa, Homo Sapiens
NFSRPKRKA

SEQ ID NO: 837267 - protein, 9 aa, Homo Sapiens
YHTDIVFAR

SEQ ID NO: 837268 - protein, 9 aa, Homo Sapiens
ASALNTNIR

SEQ ID NO: 837269 - protein, 9 aa, Homo Sapiens
LNIHQQTHT

SEQ ID NO: 837270 - protein, 9 aa, Homo Sapiens
SLNVLQNKS

SEQ ID NO: 837271 - protein, 9 aa, Homo Sapiens
AGTYTCEMS

SEQ ID NO: 837272 - protein, 9 aa, Homo Sapiens
YTGIPLPDQ

SEQ ID NO: 837273 - protein, 9 aa, Homo Sapiens
QEKLKQDEQ

SEQ ID NO: 837274 - protein, 9 aa, Homo Sapiens
WLSYCLLKA

SEQ ID NO: 837275 - protein, 9 aa, Homo Sapiens
IKDVFNSKN

SEQ ID NO: 837276 - protein, 9 aa, Homo Sapiens
GDFKRPFST

SEQ ID NO: 837277 - protein, 9 aa, Homo Sapiens
QEEIHRFSY

SEQ ID NO: 837278 - protein, 9 aa, Homo Sapiens
QCWVFTSVM

SEQ ID NO: 837279 - protein, 9 aa, Homo Sapiens
FSMAIRHNP

SEQ ID NO: 837280 - protein, 9 aa, Homo Sapiens
PIFHCQQED

SEQ ID NO: 837281 - protein, 9 aa, Homo Sapiens
DVPNIIITP

SEQ ID NO: 837282 - protein, 9 aa, Homo Sapiens
MYRIIHEAI

SEQ ID NO: 837283 - protein, 9 aa, Homo Sapiens
NKLSSTPFP

SEQ ID NO: 837284 - protein, 9 aa, Homo Sapiens
SIYLKGMYR

SEQ ID NO: 837285 - protein, 9 aa, Homo Sapiens
ATWQIIQAA

SEQ ID NO: 837286 - protein, 9 aa, Homo Sapiens
TTSSSSFKL

SEQ ID NO: 837287 - protein, 9 aa, Homo Sapiens
QTFLQTYSQ

SEQ ID NO: 837288 - protein, 9 aa, Homo Sapiens
SSHHRSQSS

SEQ ID NO: 837289 - protein, 9 aa, Homo Sapiens
EACLKMKMT

SEQ ID NO: 837290 - protein, 9 aa, Homo Sapiens
LVLTPTQEL

SEQ ID NO: 837291 - protein, 9 aa, Homo Sapiens
FILQCTHGV

SEQ ID NO: 837292 - protein, 9 aa, Homo Sapiens
DGIQRVFFG

SEQ ID NO: 837293 - protein, 9 aa, Homo Sapiens
HPDMEAGPP

SEQ ID NO: 837294 - protein, 9 aa, Homo Sapiens
SYLYIILTI

SEQ ID NO: 837295 - protein, 9 aa, Homo Sapiens
EGHPVLREL

SEQ ID NO: 837296 - protein, 9 aa, Homo Sapiens
LKEVDATRK

SEQ ID NO: 837297 - protein, 9 aa, Homo Sapiens
SSLTVHQII

SEQ ID NO: 837298 - protein, 9 aa, Homo Sapiens
NGLTVASFS

SEQ ID NO: 837299 - protein, 9 aa, Homo Sapiens
TTLRKVLSL

SEQ ID NO: 837300 - protein, 9 aa, Homo Sapiens
EEKEDKEED

SEQ ID NO: 837301 - protein, 9 aa, Homo Sapiens
LNYVVIMNN

SEQ ID NO: 837302 - protein, 9 aa, Homo Sapiens
RNPGIVGLL

SEQ ID NO: 837303 - protein, 9 aa, Homo Sapiens
KSGLDLHSV

SEQ ID NO: 837304 - protein, 9 aa, Homo Sapiens
KSDSFIQEM

SEQ ID NO: 837305 - protein, 9 aa, Homo Sapiens
PVYPHNPWL

SEQ ID NO: 837306 - protein, 9 aa, Homo Sapiens
EPQWAGRYR

SEQ ID NO: 837307 - protein, 9 aa, Homo Sapiens
QDNEVLFTM

SEQ ID NO: 837308 - protein, 9 aa, Homo Sapiens
SYQEKPRLL

SEQ ID NO: 837309 - protein, 9 aa, Homo Sapiens
RLFEHEVKL

SEQ ID NO: 837310 - protein, 9 aa, Homo Sapiens
FWGPSSYMW

SEQ ID NO: 837311 - protein, 9 aa, Homo Sapiens
YLYDVTRNS

SEQ ID NO: 837312 - protein, 9 aa, Homo Sapiens
IRNCWSPVL

SEQ ID NO: 837313 - protein, 9 aa, Homo Sapiens
LPALPHAIY

SEQ ID NO: 837314 - protein, 9 aa, Homo Sapiens
DLVMSEVDC

SEQ ID NO: 837315 - protein, 9 aa, Homo Sapiens
PNSKDILTF

SEQ ID NO: 837316 - protein, 9 aa, Homo Sapiens
RQQGKNEDV

SEQ ID NO: 837317 - protein, 9 aa, Homo Sapiens
DQVQKVAHL

SEQ ID NO: 837318 - protein, 9 aa, Homo Sapiens
LFLTTLPLP

SEQ ID NO: 837319 - protein, 9 aa, Homo Sapiens
KVRTEGNEN

SEQ ID NO: 837320 - protein, 9 aa, Homo Sapiens
ALWSEGKGR

SEQ ID NO: 837321 - protein, 9 aa, Homo Sapiens
NAGGSTEYL

SEQ ID NO: 837322 - protein, 9 aa, Homo Sapiens
DLIVEGAKV

SEQ ID NO: 837323 - protein, 9 aa, Homo Sapiens
EYLSKATQL

SEQ ID NO: 837324 - protein, 9 aa, Homo Sapiens
IMFIHDLVS

SEQ ID NO: 837325 - protein, 9 aa, Homo Sapiens
ITMKKLKGE

SEQ ID NO: 837326 - protein, 9 aa, Homo Sapiens
LLKYLPELA

SEQ ID NO: 837327 - protein, 9 aa, Homo Sapiens
YQESVCQRY

SEQ ID NO: 837328 - protein, 9 aa, Homo Sapiens
ADVDKLADE

SEQ ID NO: 837329 - protein, 9 aa, Homo Sapiens
NKKTSKSKA

SEQ ID NO: 837330 - protein, 9 aa, Homo Sapiens
KHRCVTNPA

SEQ ID NO: 837331 - protein, 9 aa, Homo Sapiens
KILHSLLNK

SEQ ID NO: 837332 - protein, 9 aa, Homo Sapiens
DHLFCEVPA

SEQ ID NO: 837333 - protein, 9 aa, Homo Sapiens
KGESGFRGP

SEQ ID NO: 837334 - protein, 9 aa, Homo Sapiens
FGPQLNPAT

SEQ ID NO: 837335 - protein, 9 aa, Homo Sapiens
HHNMKPHEI

SEQ ID NO: 837336 - protein, 9 aa, Homo Sapiens
NPDFREIII

SEQ ID NO: 837337 - protein, 9 aa, Homo Sapiens
MLEAGPEAE

SEQ ID NO: 837338 - protein, 9 aa, Homo Sapiens
KRQQGKNED

SEQ ID NO: 837339 - protein, 9 aa, Homo Sapiens
HKTIASLRA

SEQ ID NO: 837340 - protein, 9 aa, Homo Sapiens
TENASETLV

SEQ ID NO: 837341 - protein, 9 aa, Homo Sapiens
AEENEKLVK

SEQ ID NO: 837342 - protein, 9 aa, Homo Sapiens
SYSGPSKMR

SEQ ID NO: 837343 - protein, 9 aa, Homo Sapiens
VVKWHYNKQ

SEQ ID NO: 837344 - protein, 9 aa, Homo Sapiens
QTPPIVESL

SEQ ID NO: 837345 - protein, 9 aa, Homo Sapiens
SNGQNPLPI

SEQ ID NO: 837346 - protein, 9 aa, Homo Sapiens
PSERAHFIR

SEQ ID NO: 837347 - protein, 9 aa, Homo Sapiens
NVKLVDCYV

SEQ ID NO: 837348 - protein, 9 aa, Homo Sapiens
HSDPENMSL

SEQ ID NO: 837349 - protein, 9 aa, Homo Sapiens
PYRYQNEKN

SEQ ID NO: 837350 - protein, 9 aa, Homo Sapiens
EALWLQYRY

SEQ ID NO: 837351 - protein, 9 aa, Homo Sapiens
ILRLSQSNP

SEQ ID NO: 837352 - protein, 9 aa, Homo Sapiens
YCGCLEYWN

SEQ ID NO: 837353 - protein, 9 aa, Homo Sapiens
LLRQTIAAT

SEQ ID NO: 837354 - protein, 9 aa, Homo Sapiens
RPALGLLDG

SEQ ID NO: 837355 - protein, 9 aa, Homo Sapiens
KGKKLPEAS

SEQ ID NO: 837356 - protein, 9 aa, Homo Sapiens
AHVKCKAFS

SEQ ID NO: 837357 - protein, 9 aa, Homo Sapiens
KKIHRFQPT

SEQ ID NO: 837358 - protein, 9 aa, Homo Sapiens
KLALRLQTL

SEQ ID NO: 837359 - protein, 9 aa, Homo Sapiens
HYIKDKTHQ

SEQ ID NO: 837360 - protein, 9 aa, Homo Sapiens
PTASGTMFT

SEQ ID NO: 837361 - protein, 9 aa, Homo Sapiens
YQEEIQEWD

SEQ ID NO: 837362 - protein, 9 aa, Homo Sapiens
CYRTTGPEL

SEQ ID NO: 837363 - protein, 9 aa, Homo Sapiens
VHMGEKHYN

SEQ ID NO: 837364 - protein, 9 aa, Homo Sapiens
MIPDYPGLF

SEQ ID NO: 837365 - protein, 9 aa, Homo Sapiens
LLGSGALAF

SEQ ID NO: 837366 - protein, 9 aa, Homo Sapiens
YLDNLDSLG

SEQ ID NO: 837367 - protein, 9 aa, Homo Sapiens
NLKRCFREF

SEQ ID NO: 837368 - protein, 9 aa, Homo Sapiens
SCYLNELTY

SEQ ID NO: 837369 - protein, 9 aa, Homo Sapiens
ILDSMKAKI

SEQ ID NO: 837370 - protein, 9 aa, Homo Sapiens
VQDSKLQLP

SEQ ID NO: 837371 - protein, 9 aa, Homo Sapiens
QMPETFLPT

SEQ ID NO: 837372 - protein, 9 aa, Homo Sapiens
NKSMSQWEE

SEQ ID NO: 837373 - protein, 9 aa, Homo Sapiens
TSPSELAKY

SEQ ID NO: 837374 - protein, 9 aa, Homo Sapiens
SAGFMPGIM

SEQ ID NO: 837375 - protein, 9 aa, Homo Sapiens
QAMLHYIQD

SEQ ID NO: 837376 - protein, 9 aa, Homo Sapiens
STGSSTNKI

SEQ ID NO: 837377 - protein, 9 aa, Homo Sapiens
SGNHWFVLS

SEQ ID NO: 837378 - protein, 9 aa, Homo Sapiens
RFHVMRDKH

SEQ ID NO: 837379 - protein, 9 aa, Homo Sapiens
DCGDTEAWT

SEQ ID NO: 837380 - protein, 9 aa, Homo Sapiens
TQNRESPPA

SEQ ID NO: 837381 - protein, 9 aa, Homo Sapiens
ASHLKKIYT

SEQ ID NO: 837382 - protein, 9 aa, Homo Sapiens
ELMFWGLHW

SEQ ID NO: 837383 - protein, 9 aa, Homo Sapiens
DIIYRVRGG

SEQ ID NO: 837384 - protein, 9 aa, Homo Sapiens
GLGSCAVSR

SEQ ID NO: 837385 - protein, 9 aa, Homo Sapiens
ENRTINPDV

SEQ ID NO: 837386 - protein, 9 aa, Homo Sapiens
ERDEDAVKT

SEQ ID NO: 837387 - protein, 9 aa, Homo Sapiens
VTINFSGDD

SEQ ID NO: 837388 - protein, 9 aa, Homo Sapiens
QTTISHLEN

SEQ ID NO: 837389 - protein, 9 aa, Homo Sapiens
RGLSKKTHA

SEQ ID NO: 837390 - protein, 9 aa, Homo Sapiens
VKSAVDFHM

SEQ ID NO: 837391 - protein, 9 aa, Homo Sapiens
MACTDQKSH

SEQ ID NO: 837392 - protein, 9 aa, Homo Sapiens
LSGTKNNFS

SEQ ID NO: 837393 - protein, 9 aa, Homo Sapiens
YNLRVEDYE

SEQ ID NO: 837394 - protein, 9 aa, Homo Sapiens
NRQQIVRAQ

SEQ ID NO: 837395 - protein, 9 aa, Homo Sapiens
TEYFTFKHE

SEQ ID NO: 837396 - protein, 9 aa, Homo Sapiens
FMESGGTVV

SEQ ID NO: 837397 - protein, 9 aa, Homo Sapiens
TLGEIWSIF

SEQ ID NO: 837398 - protein, 9 aa, Homo Sapiens
CRSTCCQTT

SEQ ID NO: 837399 - protein, 9 aa, Homo Sapiens
EIYNTLSTV

SEQ ID NO: 837400 - protein, 9 aa, Homo Sapiens
SEPLKDEFN

SEQ ID NO: 837401 - protein, 9 aa, Homo Sapiens
YKYNSQIQP

SEQ ID NO: 837402 - protein, 9 aa, Homo Sapiens
IIENAAPSS

SEQ ID NO: 837403 - protein, 9 aa, Homo Sapiens
TDSRITRNF

SEQ ID NO: 837404 - protein, 9 aa, Homo Sapiens
NNLTIEDPV

SEQ ID NO: 837405 - protein, 9 aa, Homo Sapiens
KFLGSSDLK

SEQ ID NO: 837406 - protein, 9 aa, Homo Sapiens
QSDSAKESK

SEQ ID NO: 837407 - protein, 9 aa, Homo Sapiens
KHLNMKKTA

SEQ ID NO: 837408 - protein, 9 aa, Homo Sapiens
RYDSHVLWA

SEQ ID NO: 837409 - protein, 9 aa, Homo Sapiens
GNSPLFFLK

SEQ ID NO: 837410 - protein, 9 aa, Homo Sapiens
SFSGLFAII

SEQ ID NO: 837411 - protein, 9 aa, Homo Sapiens
KCTFGRGYT

SEQ ID NO: 837412 - protein, 9 aa, Homo Sapiens
EDIPGDTYG

SEQ ID NO: 837413 - protein, 9 aa, Homo Sapiens
LAPLEPDYG

SEQ ID NO: 837414 - protein, 9 aa, Homo Sapiens
QVKEINEDF

SEQ ID NO: 837415 - protein, 9 aa, Homo Sapiens
SHTAEQPYK

SEQ ID NO: 837416 - protein, 9 aa, Homo Sapiens
SPSFDAILY

SEQ ID NO: 837417 - protein, 9 aa, Homo Sapiens
TFQNKKKTG

SEQ ID NO: 837418 - protein, 9 aa, Homo Sapiens
EEKRGFIHE

SEQ ID NO: 837419 - protein, 9 aa, Homo Sapiens
IYRVRGGSS

SEQ ID NO: 837420 - protein, 9 aa, Homo Sapiens
YLLGTYSVP

SEQ ID NO: 837421 - protein, 9 aa, Homo Sapiens
EEWWSEFKT

SEQ ID NO: 837422 - protein, 9 aa, Homo Sapiens
KPINWQRAR

SEQ ID NO: 837423 - protein, 9 aa, Homo Sapiens
VAILISYID

SEQ ID NO: 837424 - protein, 9 aa, Homo Sapiens
MEDDKLEAR

SEQ ID NO: 837425 - protein, 9 aa, Homo Sapiens
FKNISDKLN

SEQ ID NO: 837426 - protein, 9 aa, Homo Sapiens
ADRGLVHMI

SEQ ID NO: 837427 - protein, 9 aa, Homo Sapiens
HSQAPDKVT

SEQ ID NO: 837428 - protein, 9 aa, Homo Sapiens
TEKKSSGMY

SEQ ID NO: 837429 - protein, 9 aa, Homo Sapiens
QKQLKSKLL

SEQ ID NO: 837430 - protein, 9 aa, Homo Sapiens
ASKIIMLLG

SEQ ID NO: 837431 - protein, 9 aa, Homo Sapiens
DQSVSSQSS

SEQ ID NO: 837432 - protein, 9 aa, Homo Sapiens
VKNRMGRQP

SEQ ID NO: 837433 - protein, 9 aa, Homo Sapiens
MDGKIFELT

SEQ ID NO: 837434 - protein, 9 aa, Homo Sapiens
KPHTVLKPR

SEQ ID NO: 837435 - protein, 9 aa, Homo Sapiens
QPPSHFSIS

SEQ ID NO: 837436 - protein, 9 aa, Homo Sapiens
QDLLKEIIN

SEQ ID NO: 837437 - protein, 9 aa, Homo Sapiens
WARWAKLEE

SEQ ID NO: 837438 - protein, 9 aa, Homo Sapiens
GAMVIYTSG

SEQ ID NO: 837439 - protein, 9 aa, Homo Sapiens
ANQFRFSTD

SEQ ID NO: 837440 - protein, 9 aa, Homo Sapiens
ISLEQPPHG

SEQ ID NO: 837441 - protein, 9 aa, Homo Sapiens
GGLHVHMEV

SEQ ID NO: 837442 - protein, 9 aa, Homo Sapiens
LKMLQCGYY

SEQ ID NO: 837443 - protein, 9 aa, Homo Sapiens
QWTQREPNA

SEQ ID NO: 837444 - protein, 9 aa, Homo Sapiens
ANNQLFLLS

SEQ ID NO: 837445 - protein, 9 aa, Homo Sapiens
TINMLKEGM

SEQ ID NO: 837446 - protein, 9 aa, Homo Sapiens
IKCSLFEYH

SEQ ID NO: 837447 - protein, 9 aa, Homo Sapiens
SYLRSGTKL

SEQ ID NO: 837448 - protein, 9 aa, Homo Sapiens
DSTVYYYAG

SEQ ID NO: 837449 - protein, 9 aa, Homo Sapiens
SSKAMSIIN

SEQ ID NO: 837450 - protein, 9 aa, Homo Sapiens
TEYLSSLDE

SEQ ID NO: 837451 - protein, 9 aa, Homo Sapiens
FELKVYEID

SEQ ID NO: 837452 - protein, 9 aa, Homo Sapiens
RAQQCAKHN

SEQ ID NO: 837453 - protein, 9 aa, Homo Sapiens
MEKQEEGKG

SEQ ID NO: 837454 - protein, 9 aa, Homo Sapiens
HGKFIESHA

SEQ ID NO: 837455 - protein, 9 aa, Homo Sapiens
PQGKRKTVT

SEQ ID NO: 837456 - protein, 9 aa, Homo Sapiens
VGICAMTKN

SEQ ID NO: 837457 - protein, 9 aa, Homo Sapiens
LKLPGKRYV

SEQ ID NO: 837458 - protein, 9 aa, Homo Sapiens
IKTTPGAQE

SEQ ID NO: 837459 - protein, 9 aa, Homo Sapiens
AEAEELFKQ

SEQ ID NO: 837460 - protein, 9 aa, Homo Sapiens
WSLRMVGDS

SEQ ID NO: 837461 - protein, 9 aa, Homo Sapiens
WAWQGLGVP

SEQ ID NO: 837462 - protein, 9 aa, Homo Sapiens
MLHIEFKCC

SEQ ID NO: 837463 - protein, 9 aa, Homo Sapiens
YLPWPEKRT

SEQ ID NO: 837464 - protein, 9 aa, Homo Sapiens
AKYLKEPQC

SEQ ID NO: 837465 - protein, 9 aa, Homo Sapiens
YLIPSTSKQ

SEQ ID NO: 837466 - protein, 9 aa, Homo Sapiens
ATSSHRYGQ

SEQ ID NO: 837467 - protein, 9 aa, Homo Sapiens
NNFISMDPK

SEQ ID NO: 837468 - protein, 9 aa, Homo Sapiens
SNPDCVIYS

SEQ ID NO: 837469 - protein, 9 aa, Homo Sapiens
VSCCPTGLT

SEQ ID NO: 837470 - protein, 9 aa, Homo Sapiens
YRGTMVTTV

SEQ ID NO: 837471 - protein, 9 aa, Homo Sapiens
ILQATPSSV

SEQ ID NO: 837472 - protein, 9 aa, Homo Sapiens
TTSTVPQLM

SEQ ID NO: 837473 - protein, 9 aa, Homo Sapiens
NTGEKPYRC

SEQ ID NO: 837474 - protein, 9 aa, Homo Sapiens
QNRLDWKVN

SEQ ID NO: 837475 - protein, 9 aa, Homo Sapiens
VAYGPEGIL

SEQ ID NO: 837476 - protein, 9 aa, Homo Sapiens
YCLPCCRST

SEQ ID NO: 837477 - protein, 9 aa, Homo Sapiens
RFLATTSNS

SEQ ID NO: 837478 - protein, 9 aa, Homo Sapiens
RHASYNISY

SEQ ID NO: 837479 - protein, 9 aa, Homo Sapiens
VACTTPYMI

SEQ ID NO: 837480 - protein, 9 aa, Homo Sapiens
SHNMLHGDD

SEQ ID NO: 837481 - protein, 9 aa, Homo Sapiens
EKSKECVQK

SEQ ID NO: 837482 - protein, 9 aa, Homo Sapiens
LEHDRIAKF

SEQ ID NO: 837483 - protein, 9 aa, Homo Sapiens
HCSLKEEDN

SEQ ID NO: 837484 - protein, 9 aa, Homo Sapiens
FQVIESGIL

SEQ ID NO: 837485 - protein, 9 aa, Homo Sapiens
KTLQQLRHD

SEQ ID NO: 837486 - protein, 9 aa, Homo Sapiens
TEGNIYECN

SEQ ID NO: 837487 - protein, 9 aa, Homo Sapiens
LLKLISIWN

SEQ ID NO: 837488 - protein, 9 aa, Homo Sapiens
KKLRQNQNY

SEQ ID NO: 837489 - protein, 9 aa, Homo Sapiens
KELIRQQRE

SEQ ID NO: 837490 - protein, 9 aa, Homo Sapiens
YLGGASRDV

SEQ ID NO: 837491 - protein, 9 aa, Homo Sapiens
NCLSNSFQT

SEQ ID NO: 837492 - protein, 9 aa, Homo Sapiens
VFHLNCLTC

SEQ ID NO: 837493 - protein, 9 aa, Homo Sapiens
QTRHLPLQF

SEQ ID NO: 837494 - protein, 9 aa, Homo Sapiens
SASKIELLD

SEQ ID NO: 837495 - protein, 9 aa, Homo Sapiens
VIIVRRNLL

SEQ ID NO: 837496 - protein, 9 aa, Homo Sapiens
MLISTPTAT

SEQ ID NO: 837497 - protein, 9 aa, Homo Sapiens
FQVDNLDEI

SEQ ID NO: 837498 - protein, 9 aa, Homo Sapiens
ITNIGIQEF

SEQ ID NO: 837499 - protein, 9 aa, Homo Sapiens
IPQGKRKTV

SEQ ID NO: 837500 - protein, 9 aa, Homo Sapiens
EQLRKKRRQ

SEQ ID NO: 837501 - protein, 9 aa, Homo Sapiens
TAFLPFEKN

SEQ ID NO: 837502 - protein, 9 aa, Homo Sapiens
KDFAAHCGM

SEQ ID NO: 837503 - protein, 9 aa, Homo Sapiens
IRAYTEDQN

SEQ ID NO: 837504 - protein, 9 aa, Homo Sapiens
RPRQQKEEQ

SEQ ID NO: 837505 - protein, 9 aa, Homo Sapiens
PLKTVIIEE

SEQ ID NO: 837506 - protein, 9 aa, Homo Sapiens
IAEAEELFK

SEQ ID NO: 837507 - protein, 9 aa, Homo Sapiens
KAWLNGHRK

SEQ ID NO: 837508 - protein, 9 aa, Homo Sapiens
KGFQHPSEL

SEQ ID NO: 837509 - protein, 9 aa, Homo Sapiens
RQRVRGHEA

SEQ ID NO: 837510 - protein, 9 aa, Homo Sapiens
EQHEDKPGR

SEQ ID NO: 837511 - protein, 9 aa, Homo Sapiens
AEGYHSVTQ

SEQ ID NO: 837512 - protein, 9 aa, Homo Sapiens
KYHEQLGMQ

SEQ ID NO: 837513 - protein, 9 aa, Homo Sapiens
SLEVCQLCL

SEQ ID NO: 837514 - protein, 9 aa, Homo Sapiens
PKVIKLLKI

SEQ ID NO: 837515 - protein, 9 aa, Homo Sapiens
AVLAADSAN

SEQ ID NO: 837516 - protein, 9 aa, Homo Sapiens
YTCAKCEHK

SEQ ID NO: 837517 - protein, 9 aa, Homo Sapiens
EEQDQHMVQ

SEQ ID NO: 837518 - protein, 9 aa, Homo Sapiens
PEDLIVEGA

SEQ ID NO: 837519 - protein, 9 aa, Homo Sapiens
QSEKSKSTP

SEQ ID NO: 837520 - protein, 9 aa, Homo Sapiens
GSGQTFGRE

SEQ ID NO: 837521 - protein, 9 aa, Homo Sapiens
DVIIKETQV

SEQ ID NO: 837522 - protein, 9 aa, Homo Sapiens
HAFIQPEIM

SEQ ID NO: 837523 - protein, 9 aa, Homo Sapiens
TSMSLEVCQ

SEQ ID NO: 837524 - protein, 9 aa, Homo Sapiens
LYRRHCPRT

SEQ ID NO: 837525 - protein, 9 aa, Homo Sapiens
ECWGKPNAK

SEQ ID NO: 837526 - protein, 9 aa, Homo Sapiens
TNQIISHFS

SEQ ID NO: 837527 - protein, 9 aa, Homo Sapiens
STENFQRTL

SEQ ID NO: 837528 - protein, 9 aa, Homo Sapiens
TNKTGQNYF

SEQ ID NO: 837529 - protein, 9 aa, Homo Sapiens
VMNLFEEVF

SEQ ID NO: 837530 - protein, 9 aa, Homo Sapiens
GGMCQPCEC

SEQ ID NO: 837531 - protein, 9 aa, Homo Sapiens
KRQPHLPWV

SEQ ID NO: 837532 - protein, 9 aa, Homo Sapiens
VGYRSPSMI

SEQ ID NO: 837533 - protein, 9 aa, Homo Sapiens
ISNPFYDRT

SEQ ID NO: 837534 - protein, 9 aa, Homo Sapiens
TVNKDAFLP

SEQ ID NO: 837535 - protein, 9 aa, Homo Sapiens
PATLPPSTS

SEQ ID NO: 837536 - protein, 9 aa, Homo Sapiens
GQVNISVLL

SEQ ID NO: 837537 - protein, 9 aa, Homo Sapiens
PFVLFTGFK

SEQ ID NO: 837538 - protein, 9 aa, Homo Sapiens
TLPLTEGNA

SEQ ID NO: 837539 - protein, 9 aa, Homo Sapiens
TVVLAEMLE

SEQ ID NO: 837540 - protein, 9 aa, Homo Sapiens
RPDQTVTDG

SEQ ID NO: 837541 - protein, 9 aa, Homo Sapiens
EKAKVPTGV

SEQ ID NO: 837542 - protein, 9 aa, Homo Sapiens
NQLRYINNL

SEQ ID NO: 837543 - protein, 9 aa, Homo Sapiens
LRCISKMNR

SEQ ID NO: 837544 - protein, 9 aa, Homo Sapiens
PKHSAIKIV

SEQ ID NO: 837545 - protein, 9 aa, Homo Sapiens
DYAGIYRCY

SEQ ID NO: 837546 - protein, 9 aa, Homo Sapiens
IHLFYKFYP

SEQ ID NO: 837547 - protein, 9 aa, Homo Sapiens
RLYEDAEAV

SEQ ID NO: 837548 - protein, 9 aa, Homo Sapiens
RELGEQVVS

SEQ ID NO: 837549 - protein, 9 aa, Homo Sapiens
GCPPQKLRA

SEQ ID NO: 837550 - protein, 9 aa, Homo Sapiens
LEQERPRQQ

SEQ ID NO: 837551 - protein, 9 aa, Homo Sapiens
ERKEDQYIK

SEQ ID NO: 837552 - protein, 9 aa, Homo Sapiens
LSGFALQSD

SEQ ID NO: 837553 - protein, 9 aa, Homo Sapiens
TAYTYATVL

SEQ ID NO: 837554 - protein, 9 aa, Homo Sapiens
WAFIHYLPG

SEQ ID NO: 837555 - protein, 9 aa, Homo Sapiens
SSCCKSCCS

SEQ ID NO: 837556 - protein, 9 aa, Homo Sapiens
SLNTSTAPN

SEQ ID NO: 837557 - protein, 9 aa, Homo Sapiens
LEGKQFENT

SEQ ID NO: 837558 - protein, 9 aa, Homo Sapiens
NYIGQLLPG

SEQ ID NO: 837559 - protein, 9 aa, Homo Sapiens
NIPTNLCVL

SEQ ID NO: 837560 - protein, 9 aa, Homo Sapiens
QTPPALESS

SEQ ID NO: 837561 - protein, 9 aa, Homo Sapiens
LADVDCVLD

SEQ ID NO: 837562 - protein, 9 aa, Homo Sapiens
PITLNIGDY

SEQ ID NO: 837563 - protein, 9 aa, Homo Sapiens
DQSEASGKT

SEQ ID NO: 837564 - protein, 9 aa, Homo Sapiens
DKFKKMNRR

SEQ ID NO: 837565 - protein, 9 aa, Homo Sapiens
WEVLTLTGV

SEQ ID NO: 837566 - protein, 9 aa, Homo Sapiens
QTIGVEAHQ

SEQ ID NO: 837567 - protein, 9 aa, Homo Sapiens
KKPYTCQDC

SEQ ID NO: 837568 - protein, 9 aa, Homo Sapiens
SLKHLTDPF

SEQ ID NO: 837569 - protein, 9 aa, Homo Sapiens
VKDISAANR

SEQ ID NO: 837570 - protein, 9 aa, Homo Sapiens
LLDAVRNIR

SEQ ID NO: 837571 - protein, 9 aa, Homo Sapiens
HYMLTAGLT

SEQ ID NO: 837572 - protein, 9 aa, Homo Sapiens
RSVDVSSKQ

SEQ ID NO: 837573 - protein, 9 aa, Homo Sapiens
SRKGKLYRS

SEQ ID NO: 837574 - protein, 9 aa, Homo Sapiens
KKICDDAYK

SEQ ID NO: 837575 - protein, 9 aa, Homo Sapiens
LNFLNKSRG

SEQ ID NO: 837576 - protein, 9 aa, Homo Sapiens
FKRVLGPCS

SEQ ID NO: 837577 - protein, 9 aa, Homo Sapiens
RVASAIVDK

SEQ ID NO: 837578 - protein, 9 aa, Homo Sapiens
NINFSLSYS

SEQ ID NO: 837579 - protein, 9 aa, Homo Sapiens
LAQKNSITR

SEQ ID NO: 837580 - protein, 9 aa, Homo Sapiens
ILFPPSYPY

SEQ ID NO: 837581 - protein, 9 aa, Homo Sapiens
HLQGFKPPG

SEQ ID NO: 837582 - protein, 9 aa, Homo Sapiens
YELVTSTDF

SEQ ID NO: 837583 - protein, 9 aa, Homo Sapiens
DFEKALNAR

SEQ ID NO: 837584 - protein, 9 aa, Homo Sapiens
QNTLLVLHK

SEQ ID NO: 837585 - protein, 9 aa, Homo Sapiens
RKTVTAMGV

SEQ ID NO: 837586 - protein, 9 aa, Homo Sapiens
MAVREFNMN

SEQ ID NO: 837587 - protein, 9 aa, Homo Sapiens
AARKQDVRL

SEQ ID NO: 837588 - protein, 9 aa, Homo Sapiens
DFLDSTSSV

SEQ ID NO: 837589 - protein, 9 aa, Homo Sapiens
QCQAPVCGF

SEQ ID NO: 837590 - protein, 9 aa, Homo Sapiens
KNRSQGNIM

SEQ ID NO: 837591 - protein, 9 aa, Homo Sapiens
LFEHEVKLN

SEQ ID NO: 837592 - protein, 9 aa, Homo Sapiens
IVKVVKPLD

SEQ ID NO: 837593 - protein, 9 aa, Homo Sapiens
HAHGLLQPH

SEQ ID NO: 837594 - protein, 9 aa, Homo Sapiens
DHRSVCSGY

SEQ ID NO: 837595 - protein, 9 aa, Homo Sapiens
TGDIVDIKG

SEQ ID NO: 837596 - protein, 9 aa, Homo Sapiens
YCRRQNGYR

SEQ ID NO: 837597 - protein, 9 aa, Homo Sapiens
DKLVIFLDV

SEQ ID NO: 837598 - protein, 9 aa, Homo Sapiens
SVINHQRVH

SEQ ID NO: 837599 - protein, 9 aa, Homo Sapiens
SVRRDCNDF

SEQ ID NO: 837600 - protein, 9 aa, Homo Sapiens
QCVWLDSDA

SEQ ID NO: 837601 - protein, 9 aa, Homo Sapiens
SNSCSNNEI

SEQ ID NO: 837602 - protein, 9 aa, Homo Sapiens
HSISAMPKH

SEQ ID NO: 837603 - protein, 9 aa, Homo Sapiens
NKSSIHFYL

SEQ ID NO: 837604 - protein, 9 aa, Homo Sapiens
EEVTKERYQ

SEQ ID NO: 837605 - protein, 9 aa, Homo Sapiens
FKVPTPITK

SEQ ID NO: 837606 - protein, 9 aa, Homo Sapiens
DARLFTSVL

SEQ ID NO: 837607 - protein, 9 aa, Homo Sapiens
GTKVLLLLR

SEQ ID NO: 837608 - protein, 9 aa, Homo Sapiens
EDACWIIED

SEQ ID NO: 837609 - protein, 9 aa, Homo Sapiens
LTDLAERTV

SEQ ID NO: 837610 - protein, 9 aa, Homo Sapiens
EETTEFQLL

SEQ ID NO: 837611 - protein, 9 aa, Homo Sapiens
EEGMMGTFI

SEQ ID NO: 837612 - protein, 9 aa, Homo Sapiens
NSSVDKTSF

SEQ ID NO: 837613 - protein, 9 aa, Homo Sapiens
TSALSNVCA

SEQ ID NO: 837614 - protein, 9 aa, Homo Sapiens
TFKHECKIK

SEQ ID NO: 837615 - protein, 9 aa, Homo Sapiens
IVAIVSPFI

SEQ ID NO: 837616 - protein, 9 aa, Homo Sapiens
TEDKFYKIE

SEQ ID NO: 837617 - protein, 9 aa, Homo Sapiens
NNDMNNKLE

SEQ ID NO: 837618 - protein, 9 aa, Homo Sapiens
DKTHQTIPR

SEQ ID NO: 837619 - protein, 9 aa, Homo Sapiens
KLKEIYSKE

SEQ ID NO: 837620 - protein, 9 aa, Homo Sapiens
EFIMFTVDA

SEQ ID NO: 837621 - protein, 9 aa, Homo Sapiens
LIPKMPYEP

SEQ ID NO: 837622 - protein, 9 aa, Homo Sapiens
EPFLQRLGM

SEQ ID NO: 837623 - protein, 9 aa, Homo Sapiens
MAALRRGGR

SEQ ID NO: 837624 - protein, 9 aa, Homo Sapiens
KLQDTENET

SEQ ID NO: 837625 - protein, 9 aa, Homo Sapiens
LSAPNPDGK

SEQ ID NO: 837626 - protein, 9 aa, Homo Sapiens
LHWQFFQGG

SEQ ID NO: 837627 - protein, 9 aa, Homo Sapiens
DFDAKSSVD

SEQ ID NO: 837628 - protein, 9 aa, Homo Sapiens
MDTFSGLFS

SEQ ID NO: 837629 - protein, 9 aa, Homo Sapiens
YESVQTPGT

SEQ ID NO: 837630 - protein, 9 aa, Homo Sapiens
LQDEFDCRY

SEQ ID NO: 837631 - protein, 9 aa, Homo Sapiens
LGMGHCLFV

SEQ ID NO: 837632 - protein, 9 aa, Homo Sapiens
FCLGTGYIF

SEQ ID NO: 837633 - protein, 9 aa, Homo Sapiens
LANTNQHIK

SEQ ID NO: 837634 - protein, 9 aa, Homo Sapiens
FGEAGKPTF

SEQ ID NO: 837635 - protein, 9 aa, Homo Sapiens
RLYVGRDKK

SEQ ID NO: 837636 - protein, 9 aa, Homo Sapiens
DSFQGSVMA

SEQ ID NO: 837637 - protein, 9 aa, Homo Sapiens
QLNRIKARI

SEQ ID NO: 837638 - protein, 9 aa, Homo Sapiens
ISTGNKIIA

SEQ ID NO: 837639 - protein, 9 aa, Homo Sapiens
MNSNTPLVS

SEQ ID NO: 837640 - protein, 9 aa, Homo Sapiens
SCGREKKPR

SEQ ID NO: 837641 - protein, 9 aa, Homo Sapiens
QIFPAMAKK

SEQ ID NO: 837642 - protein, 9 aa, Homo Sapiens
NINSRFGYL

SEQ ID NO: 837643 - protein, 9 aa, Homo Sapiens
EQDKISLHF

SEQ ID NO: 837644 - protein, 9 aa, Homo Sapiens
LQLIKQIRH

SEQ ID NO: 837645 - protein, 9 aa, Homo Sapiens
IPRKLVAHK

SEQ ID NO: 837646 - protein, 9 aa, Homo Sapiens
ESMLRFPHL

SEQ ID NO: 837647 - protein, 9 aa, Homo Sapiens
ALVYAITAQ

SEQ ID NO: 837648 - protein, 9 aa, Homo Sapiens
APKIIYFIA

SEQ ID NO: 837649 - protein, 9 aa, Homo Sapiens
QKLQEEIDT

SEQ ID NO: 837650 - protein, 9 aa, Homo Sapiens
FLPTMSPTL

SEQ ID NO: 837651 - protein, 9 aa, Homo Sapiens
INRGNCWII

SEQ ID NO: 837652 - protein, 9 aa, Homo Sapiens
RKGKLYRSP

SEQ ID NO: 837653 - protein, 9 aa, Homo Sapiens
PRLIQQMES

SEQ ID NO: 837654 - protein, 9 aa, Homo Sapiens
SKATLVPSE

SEQ ID NO: 837655 - protein, 9 aa, Homo Sapiens
KDLETIVNL

SEQ ID NO: 837656 - protein, 9 aa, Homo Sapiens
IIVSSILKV

SEQ ID NO: 837657 - protein, 9 aa, Homo Sapiens
MYKIILNDY

SEQ ID NO: 837658 - protein, 9 aa, Homo Sapiens
APEQRKIMT

SEQ ID NO: 837659 - protein, 9 aa, Homo Sapiens
KVMQKIQMK

SEQ ID NO: 837660 - protein, 9 aa, Homo Sapiens
PQVIAHLGA

SEQ ID NO: 837661 - protein, 9 aa, Homo Sapiens
ADVLHTLRN

SEQ ID NO: 837662 - protein, 9 aa, Homo Sapiens
VVDKQLQQG

SEQ ID NO: 837663 - protein, 9 aa, Homo Sapiens
EHSLKCMIY

SEQ ID NO: 837664 - protein, 9 aa, Homo Sapiens
GLKNIFYIV

SEQ ID NO: 837665 - protein, 9 aa, Homo Sapiens
QEIREENMD

SEQ ID NO: 837666 - protein, 9 aa, Homo Sapiens
KLRARLTYN

SEQ ID NO: 837667 - protein, 9 aa, Homo Sapiens
WLINNLTIE

SEQ ID NO: 837668 - protein, 9 aa, Homo Sapiens
CISLICAYR

SEQ ID NO: 837669 - protein, 9 aa, Homo Sapiens
LTSNSLNRD

SEQ ID NO: 837670 - protein, 9 aa, Homo Sapiens
EAQKQLTQM

SEQ ID NO: 837671 - protein, 9 aa, Homo Sapiens
ISPHVCKRM

SEQ ID NO: 837672 - protein, 9 aa, Homo Sapiens
HSDPEETTE

SEQ ID NO: 837673 - protein, 9 aa, Homo Sapiens
ADNVFLCLM

SEQ ID NO: 837674 - protein, 9 aa, Homo Sapiens
FVTKEEKNK

SEQ ID NO: 837675 - protein, 9 aa, Homo Sapiens
KNRQKNKCV

SEQ ID NO: 837676 - protein, 9 aa, Homo Sapiens
PQKSYLVGC

SEQ ID NO: 837677 - protein, 9 aa, Homo Sapiens
LQSINKWAA

SEQ ID NO: 837678 - protein, 9 aa, Homo Sapiens
LHSGGEGLE

SEQ ID NO: 837679 - protein, 9 aa, Homo Sapiens
AWQKLSDGG

SEQ ID NO: 837680 - protein, 9 aa, Homo Sapiens
LELGNDQLQ

SEQ ID NO: 837681 - protein, 9 aa, Homo Sapiens
LLVKSSFPE

SEQ ID NO: 837682 - protein, 9 aa, Homo Sapiens
TIWAANTGV

SEQ ID NO: 837683 - protein, 9 aa, Homo Sapiens
CKLCKYEFI

SEQ ID NO: 837684 - protein, 9 aa, Homo Sapiens
CSYLDTKRI

SEQ ID NO: 837685 - protein, 9 aa, Homo Sapiens
QEEIQEWDE

SEQ ID NO: 837686 - protein, 9 aa, Homo Sapiens
EVNETPVVG

SEQ ID NO: 837687 - protein, 9 aa, Homo Sapiens
LLEKKLSKA

SEQ ID NO: 837688 - protein, 9 aa, Homo Sapiens
SPQKAKIIV

SEQ ID NO: 837689 - protein, 9 aa, Homo Sapiens
ARPRDSLLR

SEQ ID NO: 837690 - protein, 9 aa, Homo Sapiens
TKKDEMRKR

SEQ ID NO: 837691 - protein, 9 aa, Homo Sapiens
TDNYQLQIV

SEQ ID NO: 837692 - protein, 9 aa, Homo Sapiens
MLGLLCFPI

SEQ ID NO: 837693 - protein, 9 aa, Homo Sapiens
SENRISTFK

SEQ ID NO: 837694 - protein, 9 aa, Homo Sapiens
SVRDLADVD

SEQ ID NO: 837695 - protein, 9 aa, Homo Sapiens
LPEKNWQML

SEQ ID NO: 837696 - protein, 9 aa, Homo Sapiens
VQRGFGKSG

SEQ ID NO: 837697 - protein, 9 aa, Homo Sapiens
NVVMGHQQS

SEQ ID NO: 837698 - protein, 9 aa, Homo Sapiens
IPNALIGSD

SEQ ID NO: 837699 - protein, 9 aa, Homo Sapiens
IHVTRYVVK

SEQ ID NO: 837700 - protein, 9 aa, Homo Sapiens
PLKPMPFSI

SEQ ID NO: 837701 - protein, 9 aa, Homo Sapiens
RDVLNRCLE

SEQ ID NO: 837702 - protein, 9 aa, Homo Sapiens
EYRGRLLNA

SEQ ID NO: 837703 - protein, 9 aa, Homo Sapiens
QKRDTKTMY

SEQ ID NO: 837704 - protein, 9 aa, Homo Sapiens
TYFRNSSCL

SEQ ID NO: 837705 - protein, 9 aa, Homo Sapiens
FSDGDEEEV

SEQ ID NO: 837706 - protein, 9 aa, Homo Sapiens
LGHTSIRRG

SEQ ID NO: 837707 - protein, 9 aa, Homo Sapiens
DVVQRQIHN

SEQ ID NO: 837708 - protein, 9 aa, Homo Sapiens
ALVRYIKER

SEQ ID NO: 837709 - protein, 9 aa, Homo Sapiens
DEEKYPPKS

SEQ ID NO: 837710 - protein, 9 aa, Homo Sapiens
WQRGEIWDA

SEQ ID NO: 837711 - protein, 9 aa, Homo Sapiens
AVSLSGSSN

SEQ ID NO: 837712 - protein, 9 aa, Homo Sapiens
IVVADLITT

SEQ ID NO: 837713 - protein, 9 aa, Homo Sapiens
LTYLPYYML

SEQ ID NO: 837714 - protein, 9 aa, Homo Sapiens
EVSSYLILR

SEQ ID NO: 837715 - protein, 9 aa, Homo Sapiens
VLGLELWSM

SEQ ID NO: 837716 - protein, 9 aa, Homo Sapiens
KCTECEQSF

SEQ ID NO: 837717 - protein, 9 aa, Homo Sapiens
FPIMNLLIA

SEQ ID NO: 837718 - protein, 9 aa, Homo Sapiens
KQSEYIEEH

SEQ ID NO: 837719 - protein, 9 aa, Homo Sapiens
IPVMALIIY

SEQ ID NO: 837720 - protein, 9 aa, Homo Sapiens
LDHIKKASD

SEQ ID NO: 837721 - protein, 9 aa, Homo Sapiens
HLTESLLFE

SEQ ID NO: 837722 - protein, 9 aa, Homo Sapiens
SRTPPDIAK

SEQ ID NO: 837723 - protein, 9 aa, Homo Sapiens
DLDAFLTEQ

SEQ ID NO: 837724 - protein, 9 aa, Homo Sapiens
WAINMKKLF

SEQ ID NO: 837725 - protein, 9 aa, Homo Sapiens
QNTTSKRII

SEQ ID NO: 837726 - protein, 9 aa, Homo Sapiens
PIADVVREK

SEQ ID NO: 837727 - protein, 9 aa, Homo Sapiens
IKLEPGDYF

SEQ ID NO: 837728 - protein, 9 aa, Homo Sapiens
SFKDELLCA

SEQ ID NO: 837729 - protein, 9 aa, Homo Sapiens
WKNLAVLDA

SEQ ID NO: 837730 - protein, 9 aa, Homo Sapiens
VRVNNVNEF

SEQ ID NO: 837731 - protein, 9 aa, Homo Sapiens
LKEITAKQK

SEQ ID NO: 837732 - protein, 9 aa, Homo Sapiens
LDEDQKVWP

SEQ ID NO: 837733 - protein, 9 aa, Homo Sapiens
NKDNKVDFN

SEQ ID NO: 837734 - protein, 9 aa, Homo Sapiens
YITSPLLEE

SEQ ID NO: 837735 - protein, 9 aa, Homo Sapiens
YTDVMLENY

SEQ ID NO: 837736 - protein, 9 aa, Homo Sapiens
APVETELLL

SEQ ID NO: 837737 - protein, 9 aa, Homo Sapiens
HGCVSKIIC

SEQ ID NO: 837738 - protein, 9 aa, Homo Sapiens
TVLETKWAL

SEQ ID NO: 837739 - protein, 9 aa, Homo Sapiens
LYTDLFLSL

SEQ ID NO: 837740 - protein, 9 aa, Homo Sapiens
IDNVTPADE

SEQ ID NO: 837741 - protein, 9 aa, Homo Sapiens
FDVGASCTE

SEQ ID NO: 837742 - protein, 9 aa, Homo Sapiens
KTYYGTKDP

SEQ ID NO: 837743 - protein, 9 aa, Homo Sapiens
VSRISKVLQ

SEQ ID NO: 837744 - protein, 9 aa, Homo Sapiens
QLIEQRTVS

SEQ ID NO: 837745 - protein, 9 aa, Homo Sapiens
NRLQDIAER

SEQ ID NO: 837746 - protein, 9 aa, Homo Sapiens
VVELFGVWK

SEQ ID NO: 837747 - protein, 9 aa, Homo Sapiens
IFIAFILLI

SEQ ID NO: 837748 - protein, 9 aa, Homo Sapiens
EGLVEFGTA

SEQ ID NO: 837749 - protein, 9 aa, Homo Sapiens
APQCLQYYD

SEQ ID NO: 837750 - protein, 9 aa, Homo Sapiens
PSRLWSGTA

SEQ ID NO: 837751 - protein, 9 aa, Homo Sapiens
SLNKLQKLE

SEQ ID NO: 837752 - protein, 9 aa, Homo Sapiens
EFLTVKEDR

SEQ ID NO: 837753 - protein, 9 aa, Homo Sapiens
ACTDQKSHS

SEQ ID NO: 837754 - protein, 9 aa, Homo Sapiens
TPRVRKQTC

SEQ ID NO: 837755 - protein, 9 aa, Homo Sapiens
PNAGQVWRP

SEQ ID NO: 837756 - protein, 9 aa, Homo Sapiens
INNVVSDCM

SEQ ID NO: 837757 - protein, 9 aa, Homo Sapiens
HNNYKALFG

SEQ ID NO: 837758 - protein, 9 aa, Homo Sapiens
GTCSPINGS

SEQ ID NO: 837759 - protein, 9 aa, Homo Sapiens
LFFIRHHSS

SEQ ID NO: 837760 - protein, 9 aa, Homo Sapiens
RMDNTGVPD

SEQ ID NO: 837761 - protein, 9 aa, Homo Sapiens
GCLTQMYLF

SEQ ID NO: 837762 - protein, 9 aa, Homo Sapiens
KRFPLVNFC

SEQ ID NO: 837763 - protein, 9 aa, Homo Sapiens
LNGHRKNPY

SEQ ID NO: 837764 - protein, 9 aa, Homo Sapiens
PHKWENCMA

SEQ ID NO: 837765 - protein, 9 aa, Homo Sapiens
LMIALLGGH

SEQ ID NO: 837766 - protein, 9 aa, Homo Sapiens
CYNDPKCCG

SEQ ID NO: 837767 - protein, 9 aa, Homo Sapiens
ALGQMLGGF

SEQ ID NO: 837768 - protein, 9 aa, Homo Sapiens
AHFDKKKEI

SEQ ID NO: 837769 - protein, 9 aa, Homo Sapiens
TVIIHPHLS

SEQ ID NO: 837770 - protein, 9 aa, Homo Sapiens
STFSILNFL

SEQ ID NO: 837771 - protein, 9 aa, Homo Sapiens
EKTLDKLDV

SEQ ID NO: 837772 - protein, 9 aa, Homo Sapiens
SDAGDGLPG

SEQ ID NO: 837773 - protein, 9 aa, Homo Sapiens
ECKECGVAF

SEQ ID NO: 837774 - protein, 9 aa, Homo Sapiens
FLYPSCTGS

SEQ ID NO: 837775 - protein, 9 aa, Homo Sapiens
TSVRDLADV

SEQ ID NO: 837776 - protein, 9 aa, Homo Sapiens
TCLAFELFA

SEQ ID NO: 837777 - protein, 9 aa, Homo Sapiens
QIAALNQQI

SEQ ID NO: 837778 - protein, 9 aa, Homo Sapiens
MDIYGYNLS

SEQ ID NO: 837779 - protein, 9 aa, Homo Sapiens
RNYSEAKSE

SEQ ID NO: 837780 - protein, 9 aa, Homo Sapiens
WSLAPQDSH

SEQ ID NO: 837781 - protein, 9 aa, Homo Sapiens
DYLWHRSDS

SEQ ID NO: 837782 - protein, 9 aa, Homo Sapiens
FHNIFWSSL

SEQ ID NO: 837783 - protein, 9 aa, Homo Sapiens
TDSDFGSTK

SEQ ID NO: 837784 - protein, 9 aa, Homo Sapiens
DQQIGDSSE

SEQ ID NO: 837785 - protein, 9 aa, Homo Sapiens
GRNRSWGAL

SEQ ID NO: 837786 - protein, 9 aa, Homo Sapiens
ADMNRLIIN

SEQ ID NO: 837787 - protein, 9 aa, Homo Sapiens
YGNIISNIL

SEQ ID NO: 837788 - protein, 9 aa, Homo Sapiens
MEDSFLQYF

SEQ ID NO: 837789 - protein, 9 aa, Homo Sapiens
EIIDQLFAV

SEQ ID NO: 837790 - protein, 9 aa, Homo Sapiens
VVLLFVPCI

SEQ ID NO: 837791 - protein, 9 aa, Homo Sapiens
GCRLSPRNT

SEQ ID NO: 837792 - protein, 9 aa, Homo Sapiens
GDNFRKNLT

SEQ ID NO: 837793 - protein, 9 aa, Homo Sapiens
QKYLFANSK

SEQ ID NO: 837794 - protein, 9 aa, Homo Sapiens
YKVDVVPIN

SEQ ID NO: 837795 - protein, 9 aa, Homo Sapiens
EKLRRSQSN

SEQ ID NO: 837796 - protein, 9 aa, Homo Sapiens
LQLRIAFRS

SEQ ID NO: 837797 - protein, 9 aa, Homo Sapiens
AQVFQELEY

SEQ ID NO: 837798 - protein, 9 aa, Homo Sapiens
CNGIPDSRP

SEQ ID NO: 837799 - protein, 9 aa, Homo Sapiens
GTQSLTYDN

SEQ ID NO: 837800 - protein, 9 aa, Homo Sapiens
VDHLFCEVP

SEQ ID NO: 837801 - protein, 9 aa, Homo Sapiens
GYFVLTIVI

SEQ ID NO: 837802 - protein, 9 aa, Homo Sapiens
FEGITLDLF

SEQ ID NO: 837803 - protein, 9 aa, Homo Sapiens
EKALNARFP

SEQ ID NO: 837804 - protein, 9 aa, Homo Sapiens
RTTTGTLSI

SEQ ID NO: 837805 - protein, 9 aa, Homo Sapiens
ETASCLLQN

SEQ ID NO: 837806 - protein, 9 aa, Homo Sapiens
LFLMLVSTV

SEQ ID NO: 837807 - protein, 9 aa, Homo Sapiens
LRPKLRKDS

SEQ ID NO: 837808 - protein, 9 aa, Homo Sapiens
LTIRMIMKI

SEQ ID NO: 837809 - protein, 9 aa, Homo Sapiens
DIESPDRET

SEQ ID NO: 837810 - protein, 9 aa, Homo Sapiens
KGLTNYYVG

SEQ ID NO: 837811 - protein, 9 aa, Homo Sapiens
KKENSKLTF

SEQ ID NO: 837812 - protein, 9 aa, Homo Sapiens
LKKLDQLIE

SEQ ID NO: 837813 - protein, 9 aa, Homo Sapiens
IQDKYSVNM

SEQ ID NO: 837814 - protein, 9 aa, Homo Sapiens
LAFKLQHGV

SEQ ID NO: 837815 - protein, 9 aa, Homo Sapiens
PQIDEKNKS

SEQ ID NO: 837816 - protein, 9 aa, Homo Sapiens
EHNLAKYMF

SEQ ID NO: 837817 - protein, 9 aa, Homo Sapiens
TYYESVQTP

SEQ ID NO: 837818 - protein, 9 aa, Homo Sapiens
QECLGKQLK

SEQ ID NO: 837819 - protein, 9 aa, Homo Sapiens
MGIQSGKHF

SEQ ID NO: 837820 - protein, 9 aa, Homo Sapiens
MAYQLGEFI

SEQ ID NO: 837821 - protein, 9 aa, Homo Sapiens
FNLGSKVIR

SEQ ID NO: 837822 - protein, 9 aa, Homo Sapiens
PTRQDTALE

SEQ ID NO: 837823 - protein, 9 aa, Homo Sapiens
DEDDLNKPL

SEQ ID NO: 837824 - protein, 9 aa, Homo Sapiens
CQRYNKIAY

SEQ ID NO: 837825 - protein, 9 aa, Homo Sapiens
QELEYYDVS

SEQ ID NO: 837826 - protein, 9 aa, Homo Sapiens
RFHKNLEAI

SEQ ID NO: 837827 - protein, 9 aa, Homo Sapiens
STRQKKERM

SEQ ID NO: 837828 - protein, 9 aa, Homo Sapiens
NKALPALPI

SEQ ID NO: 837829 - protein, 9 aa, Homo Sapiens
LLDEDQKVW

SEQ ID NO: 837830 - protein, 9 aa, Homo Sapiens
NNLHLPKMA

SEQ ID NO: 837831 - protein, 9 aa, Homo Sapiens
ADIFESKRG

SEQ ID NO: 837832 - protein, 9 aa, Homo Sapiens
YGTSIWKAE

SEQ ID NO: 837833 - protein, 9 aa, Homo Sapiens
RLPLRLQMR

SEQ ID NO: 837834 - protein, 9 aa, Homo Sapiens
EQKIKINDV

SEQ ID NO: 837835 - protein, 9 aa, Homo Sapiens
DSVHFEVDT

SEQ ID NO: 837836 - protein, 9 aa, Homo Sapiens
IPGAALGQM

SEQ ID NO: 837837 - protein, 9 aa, Homo Sapiens
LATEPTKLP

SEQ ID NO: 837838 - protein, 9 aa, Homo Sapiens
LTIPYFRDK

SEQ ID NO: 837839 - protein, 9 aa, Homo Sapiens
TLLVKSSFP

SEQ ID NO: 837840 - protein, 9 aa, Homo Sapiens
KIDISELNR

SEQ ID NO: 837841 - protein, 9 aa, Homo Sapiens
SRSLTPDYD

SEQ ID NO: 837842 - protein, 9 aa, Homo Sapiens
EAIIPCFGA

SEQ ID NO: 837843 - protein, 9 aa, Homo Sapiens
HLLLPGELA

SEQ ID NO: 837844 - protein, 9 aa, Homo Sapiens
ARIELPWGS

SEQ ID NO: 837845 - protein, 9 aa, Homo Sapiens
LLQWRVTAE

SEQ ID NO: 837846 - protein, 9 aa, Homo Sapiens
SPIKLSPTY

SEQ ID NO: 837847 - protein, 9 aa, Homo Sapiens
QYQAIETSI

SEQ ID NO: 837848 - protein, 9 aa, Homo Sapiens
EEEDARKII

SEQ ID NO: 837849 - protein, 9 aa, Homo Sapiens
FGNSKYQNW

SEQ ID NO: 837850 - protein, 9 aa, Homo Sapiens
NSLADTLFW

SEQ ID NO: 837851 - protein, 9 aa, Homo Sapiens
AIKYIPHNS

SEQ ID NO: 837852 - protein, 9 aa, Homo Sapiens
NVNMSRVDV

SEQ ID NO: 837853 - protein, 9 aa, Homo Sapiens
VVDEKISTM

SEQ ID NO: 837854 - protein, 9 aa, Homo Sapiens
RYRVVDSAD

SEQ ID NO: 837855 - protein, 9 aa, Homo Sapiens
HRSFTNMSS

SEQ ID NO: 837856 - protein, 9 aa, Homo Sapiens
LVAVGLSVD

SEQ ID NO: 837857 - protein, 9 aa, Homo Sapiens
GIRCLHYEI

SEQ ID NO: 837858 - protein, 9 aa, Homo Sapiens
ISDADLDAF

SEQ ID NO: 837859 - protein, 9 aa, Homo Sapiens
PVTIKEEVL

SEQ ID NO: 837860 - protein, 9 aa, Homo Sapiens
PTLNYLIYT

SEQ ID NO: 837861 - protein, 9 aa, Homo Sapiens
EIHNEHLSP

SEQ ID NO: 837862 - protein, 9 aa, Homo Sapiens
TVQEPPNFV

SEQ ID NO: 837863 - protein, 9 aa, Homo Sapiens
LNEAVYTCI

SEQ ID NO: 837864 - protein, 9 aa, Homo Sapiens
TSFENMKEN

SEQ ID NO: 837865 - protein, 9 aa, Homo Sapiens
KHLYDVNTS

SEQ ID NO: 837866 - protein, 9 aa, Homo Sapiens
ENAKKYLQT

SEQ ID NO: 837867 - protein, 9 aa, Homo Sapiens
KEDVKGMED

SEQ ID NO: 837868 - protein, 9 aa, Homo Sapiens
LVAPCLLLI

SEQ ID NO: 837869 - protein, 9 aa, Homo Sapiens
REQEDKIRE

SEQ ID NO: 837870 - protein, 9 aa, Homo Sapiens
LGNGSLTPG

SEQ ID NO: 837871 - protein, 9 aa, Homo Sapiens
VHTDEKPYT

SEQ ID NO: 837872 - protein, 9 aa, Homo Sapiens
EWIDYALAT

SEQ ID NO: 837873 - protein, 9 aa, Homo Sapiens
LQNIENVPL

SEQ ID NO: 837874 - protein, 9 aa, Homo Sapiens
QLIDKETDD

SEQ ID NO: 837875 - protein, 9 aa, Homo Sapiens
FDFTELDAK

SEQ ID NO: 837876 - protein, 9 aa, Homo Sapiens
ERLQIYREK

SEQ ID NO: 837877 - protein, 9 aa, Homo Sapiens
PGGGYPHGP

SEQ ID NO: 837878 - protein, 9 aa, Homo Sapiens
GGPPKCCNL

SEQ ID NO: 837879 - protein, 9 aa, Homo Sapiens
CLYLVSRYL

SEQ ID NO: 837880 - protein, 9 aa, Homo Sapiens
KHSYPNVYF

SEQ ID NO: 837881 - protein, 9 aa, Homo Sapiens
TLPKLEEVC

SEQ ID NO: 837882 - protein, 9 aa, Homo Sapiens
PMGGNTTEN

SEQ ID NO: 837883 - protein, 9 aa, Homo Sapiens
QDKAGPSPS

SEQ ID NO: 837884 - protein, 9 aa, Homo Sapiens
LERYGEFLN

SEQ ID NO: 837885 - protein, 9 aa, Homo Sapiens
LAIFWYDIR

SEQ ID NO: 837886 - protein, 9 aa, Homo Sapiens
HQDNEDRNS

SEQ ID NO: 837887 - protein, 9 aa, Homo Sapiens
LLFSGIFPG

SEQ ID NO: 837888 - protein, 9 aa, Homo Sapiens
EVKPYVCHL

SEQ ID NO: 837889 - protein, 9 aa, Homo Sapiens
FMEKRIEKG

SEQ ID NO: 837890 - protein, 9 aa, Homo Sapiens
TIRMIMKIS

SEQ ID NO: 837891 - protein, 9 aa, Homo Sapiens
DLGNGLTVA

SEQ ID NO: 837892 - protein, 9 aa, Homo Sapiens
RISGLFSEA

SEQ ID NO: 837893 - protein, 9 aa, Homo Sapiens
PEQTTTALP

SEQ ID NO: 837894 - protein, 9 aa, Homo Sapiens
QKYKEGTYI

SEQ ID NO: 837895 - protein, 9 aa, Homo Sapiens
LFGLRTKAK

SEQ ID NO: 837896 - protein, 9 aa, Homo Sapiens
RFLQINPIP

SEQ ID NO: 837897 - protein, 9 aa, Homo Sapiens
TKENNGVLK

SEQ ID NO: 837898 - protein, 9 aa, Homo Sapiens
LINRIAQKT

SEQ ID NO: 837899 - protein, 9 aa, Homo Sapiens
DWSKTEEAF

SEQ ID NO: 837900 - protein, 9 aa, Homo Sapiens
SAELKILVS

SEQ ID NO: 837901 - protein, 9 aa, Homo Sapiens
GHRKNPYPT

SEQ ID NO: 837902 - protein, 9 aa, Homo Sapiens
KVLDMYQNY

SEQ ID NO: 837903 - protein, 9 aa, Homo Sapiens
GADRVSEAN

SEQ ID NO: 837904 - protein, 9 aa, Homo Sapiens
HFFFTLGRA

SEQ ID NO: 837905 - protein, 9 aa, Homo Sapiens
LCRYKIRLN

SEQ ID NO: 837906 - protein, 9 aa, Homo Sapiens
IYHGIPTVG

SEQ ID NO: 837907 - protein, 9 aa, Homo Sapiens
YQKEMKNSI

SEQ ID NO: 837908 - protein, 9 aa, Homo Sapiens
ASPVNTCRD

SEQ ID NO: 837909 - protein, 9 aa, Homo Sapiens
LREFLKLLP

SEQ ID NO: 837910 - protein, 9 aa, Homo Sapiens
ERRWRHRNL

SEQ ID NO: 837911 - protein, 9 aa, Homo Sapiens
DNSARFQPH

SEQ ID NO: 837912 - protein, 9 aa, Homo Sapiens
TENFQRTLN

SEQ ID NO: 837913 - protein, 9 aa, Homo Sapiens
RDSNEGRKY

SEQ ID NO: 837914 - protein, 9 aa, Homo Sapiens
VQETDHDQE

SEQ ID NO: 837915 - protein, 9 aa, Homo Sapiens
IIEWIDYAL

SEQ ID NO: 837916 - protein, 9 aa, Homo Sapiens
VHLQGFKPP

SEQ ID NO: 837917 - protein, 9 aa, Homo Sapiens
KEGERYFLQ

SEQ ID NO: 837918 - protein, 9 aa, Homo Sapiens
RWKGYNCNV

SEQ ID NO: 837919 - protein, 9 aa, Homo Sapiens
IAQSLASRR

SEQ ID NO: 837920 - protein, 9 aa, Homo Sapiens
EDHGSLENE

SEQ ID NO: 837921 - protein, 9 aa, Homo Sapiens
LKPSALPST

SEQ ID NO: 837922 - protein, 9 aa, Homo Sapiens
PGEKISATW

SEQ ID NO: 837923 - protein, 9 aa, Homo Sapiens
PRMSFPYCG

SEQ ID NO: 837924 - protein, 9 aa, Homo Sapiens
YKEAIHAMN

SEQ ID NO: 837925 - protein, 9 aa, Homo Sapiens
SLNPEQLNK

SEQ ID NO: 837926 - protein, 9 aa, Homo Sapiens
YGTLTFMYL

SEQ ID NO: 837927 - protein, 9 aa, Homo Sapiens
LEVAARSIP

SEQ ID NO: 837928 - protein, 9 aa, Homo Sapiens
EKGSSYREG

SEQ ID NO: 837929 - protein, 9 aa, Homo Sapiens
TKSSIIEAI

SEQ ID NO: 837930 - protein, 9 aa, Homo Sapiens
FGVVFKAKN

SEQ ID NO: 837931 - protein, 9 aa, Homo Sapiens
PTFGIEPNA

SEQ ID NO: 837932 - protein, 9 aa, Homo Sapiens
SVINILIQS

SEQ ID NO: 837933 - protein, 9 aa, Homo Sapiens
HVSQMFLIN

SEQ ID NO: 837934 - protein, 9 aa, Homo Sapiens
NNITEYCRD

SEQ ID NO: 837935 - protein, 9 aa, Homo Sapiens
HRRMTITGD

SEQ ID NO: 837936 - protein, 9 aa, Homo Sapiens
IYLMGAIFG

SEQ ID NO: 837937 - protein, 9 aa, Homo Sapiens
LNKSLLKII

SEQ ID NO: 837938 - protein, 9 aa, Homo Sapiens
EFILLGFYN

SEQ ID NO: 837939 - protein, 9 aa, Homo Sapiens
KNESKRMIY

SEQ ID NO: 837940 - protein, 9 aa, Homo Sapiens
RHDKIMFGF

SEQ ID NO: 837941 - protein, 9 aa, Homo Sapiens
TAMSSRQPS

SEQ ID NO: 837942 - protein, 9 aa, Homo Sapiens
NKLECLKEP

SEQ ID NO: 837943 - protein, 9 aa, Homo Sapiens
KSVQKSITQ

SEQ ID NO: 837944 - protein, 9 aa, Homo Sapiens
GGSQGDAGV

SEQ ID NO: 837945 - protein, 9 aa, Homo Sapiens
PKHPGGKHK

SEQ ID NO: 837946 - protein, 9 aa, Homo Sapiens
LTTFEEDQR

SEQ ID NO: 837947 - protein, 9 aa, Homo Sapiens
DAWLMTSNT

SEQ ID NO: 837948 - protein, 9 aa, Homo Sapiens
VYGLLTLGM

SEQ ID NO: 837949 - protein, 9 aa, Homo Sapiens
ALKQAEVFQ

SEQ ID NO: 837950 - protein, 9 aa, Homo Sapiens
YEMPEFSLD

SEQ ID NO: 837951 - protein, 9 aa, Homo Sapiens
RSNLTVHHI

SEQ ID NO: 837952 - protein, 9 aa, Homo Sapiens
LNRDVSLGG

SEQ ID NO: 837953 - protein, 9 aa, Homo Sapiens
HKETATTPK

SEQ ID NO: 837954 - protein, 9 aa, Homo Sapiens
ISAKPLDNW

SEQ ID NO: 837955 - protein, 9 aa, Homo Sapiens
GLGEHYNLV

SEQ ID NO: 837956 - protein, 9 aa, Homo Sapiens
ACPNNCRCD

SEQ ID NO: 837957 - protein, 9 aa, Homo Sapiens
NGPDALIAS

SEQ ID NO: 837958 - protein, 9 aa, Homo Sapiens
QTTTALPVR

SEQ ID NO: 837959 - protein, 9 aa, Homo Sapiens
IYQITNDLA

SEQ ID NO: 837960 - protein, 9 aa, Homo Sapiens
NSITLNILG

SEQ ID NO: 837961 - protein, 9 aa, Homo Sapiens
DQLRGTWEC

SEQ ID NO: 837962 - protein, 9 aa, Homo Sapiens
VNFQMWDFP

SEQ ID NO: 837963 - protein, 9 aa, Homo Sapiens
EASQYCGCL

SEQ ID NO: 837964 - protein, 9 aa, Homo Sapiens
GVKGEAKIA

SEQ ID NO: 837965 - protein, 9 aa, Homo Sapiens
HSRKKYCFH

SEQ ID NO: 837966 - protein, 9 aa, Homo Sapiens
SYGVILHSH

SEQ ID NO: 837967 - protein, 9 aa, Homo Sapiens
LAAFQLQML

SEQ ID NO: 837968 - protein, 9 aa, Homo Sapiens
VGRPQPGHE

SEQ ID NO: 837969 - protein, 9 aa, Homo Sapiens
YSLVPLQII

SEQ ID NO: 837970 - protein, 9 aa, Homo Sapiens
RTKVQKQQK

SEQ ID NO: 837971 - protein, 9 aa, Homo Sapiens
FKIFDSLSM

SEQ ID NO: 837972 - protein, 9 aa, Homo Sapiens
SAESHGLCS

SEQ ID NO: 837973 - protein, 9 aa, Homo Sapiens
AFCHDCEFH

SEQ ID NO: 837974 - protein, 9 aa, Homo Sapiens
DIKSECRKV

SEQ ID NO: 837975 - protein, 9 aa, Homo Sapiens
GIEFIRKPE

SEQ ID NO: 837976 - protein, 9 aa, Homo Sapiens
AFQLHIQFT

SEQ ID NO: 837977 - protein, 9 aa, Homo Sapiens
GPGDSARDV

SEQ ID NO: 837978 - protein, 9 aa, Homo Sapiens
RLYNSEESH

SEQ ID NO: 837979 - protein, 9 aa, Homo Sapiens
HFSMAIRHN

SEQ ID NO: 837980 - protein, 9 aa, Homo Sapiens
VKILCDWMY

SEQ ID NO: 837981 - protein, 9 aa, Homo Sapiens
KVPKDAENP

SEQ ID NO: 837982 - protein, 9 aa, Homo Sapiens
ALDGQLKHE

SEQ ID NO: 837983 - protein, 9 aa, Homo Sapiens
IGLHYPKKN

SEQ ID NO: 837984 - protein, 9 aa, Homo Sapiens
NVPDQADLV

SEQ ID NO: 837985 - protein, 9 aa, Homo Sapiens
IMQTMAQKN

SEQ ID NO: 837986 - protein, 9 aa, Homo Sapiens
EVISVETRV

SEQ ID NO: 837987 - protein, 9 aa, Homo Sapiens
PSQMIVLTY

SEQ ID NO: 837988 - protein, 9 aa, Homo Sapiens
SSPGEDGSL

SEQ ID NO: 837989 - protein, 9 aa, Homo Sapiens
MGGDGDYME

SEQ ID NO: 837990 - protein, 9 aa, Homo Sapiens
LTQKNQLIS

SEQ ID NO: 837991 - protein, 9 aa, Homo Sapiens
VKQRPTSSF

SEQ ID NO: 837992 - protein, 9 aa, Homo Sapiens
FSCDVAEGT

SEQ ID NO: 837993 - protein, 9 aa, Homo Sapiens
DKELHPNTD

SEQ ID NO: 837994 - protein, 9 aa, Homo Sapiens
NAKSICCCL

SEQ ID NO: 837995 - protein, 9 aa, Homo Sapiens
VTERKLRTL

SEQ ID NO: 837996 - protein, 9 aa, Homo Sapiens
FFCLFVNSE

SEQ ID NO: 837997 - protein, 9 aa, Homo Sapiens
NTPGYLVGR

SEQ ID NO: 837998 - protein, 9 aa, Homo Sapiens
DQSYGIFWY

SEQ ID NO: 837999 - protein, 9 aa, Homo Sapiens
LFYDRVCSP

SEQ ID NO: 838000 - protein, 9 aa, Homo Sapiens
NPQQFDVLF

SEQ ID NO: 838001 - protein, 9 aa, Homo Sapiens
RTATPQTFS

SEQ ID NO: 838002 - protein, 9 aa, Homo Sapiens
LNKQKIAFE

SEQ ID NO: 838003 - protein, 9 aa, Homo Sapiens
ARPQPRAHF

SEQ ID NO: 838004 - protein, 9 aa, Homo Sapiens
RNVIQKKYD

SEQ ID NO: 838005 - protein, 9 aa, Homo Sapiens
WLQSRDILA

SEQ ID NO: 838006 - protein, 9 aa, Homo Sapiens
TNQTGLKLI

SEQ ID NO: 838007 - protein, 9 aa, Homo Sapiens
EDKENYNKF

SEQ ID NO: 838008 - protein, 9 aa, Homo Sapiens
PMPFQTHYR

SEQ ID NO: 838009 - protein, 9 aa, Homo Sapiens
VLSGCSWIT

SEQ ID NO: 838010 - protein, 9 aa, Homo Sapiens
GNAQNGVAL

SEQ ID NO: 838011 - protein, 9 aa, Homo Sapiens
TGIYGLFVV

SEQ ID NO: 838012 - protein, 9 aa, Homo Sapiens
LTVHQIIHT

SEQ ID NO: 838013 - protein, 9 aa, Homo Sapiens
NYHQVTESK

SEQ ID NO: 838014 - protein, 9 aa, Homo Sapiens
GHKHRKYSH

SEQ ID NO: 838015 - protein, 9 aa, Homo Sapiens
CVVFSLVIL

SEQ ID NO: 838016 - protein, 9 aa, Homo Sapiens
NKLLAYTNS

SEQ ID NO: 838017 - protein, 9 aa, Homo Sapiens
DNGIFYEDS

SEQ ID NO: 838018 - protein, 9 aa, Homo Sapiens
DLYSELSKW

SEQ ID NO: 838019 - protein, 9 aa, Homo Sapiens
LQNPSQMDR

SEQ ID NO: 838020 - protein, 9 aa, Homo Sapiens
TKGLSVDDF

SEQ ID NO: 838021 - protein, 9 aa, Homo Sapiens
QGKDINLNK

SEQ ID NO: 838022 - protein, 9 aa, Homo Sapiens
TCRRILFMK

SEQ ID NO: 838023 - protein, 9 aa, Homo Sapiens
TNNHFAHFF

SEQ ID NO: 838024 - protein, 9 aa, Homo Sapiens
TKEDKFWMN

SEQ ID NO: 838025 - protein, 9 aa, Homo Sapiens
EITHLAGRS

SEQ ID NO: 838026 - protein, 9 aa, Homo Sapiens
DEKLQRRQD

SEQ ID NO: 838027 - protein, 9 aa, Homo Sapiens
GCLEYWNPD

SEQ ID NO: 838028 - protein, 9 aa, Homo Sapiens
GEGTEAVNK

SEQ ID NO: 838029 - protein, 9 aa, Homo Sapiens
PSPRPDNYF

SEQ ID NO: 838030 - protein, 9 aa, Homo Sapiens
YLGHNENQQ

SEQ ID NO: 838031 - protein, 9 aa, Homo Sapiens
KAKLDKFSS

SEQ ID NO: 838032 - protein, 9 aa, Homo Sapiens
QVYDAMADT

SEQ ID NO: 838033 - protein, 9 aa, Homo Sapiens
KTKADGSFH

SEQ ID NO: 838034 - protein, 9 aa, Homo Sapiens
SSLARHWII

SEQ ID NO: 838035 - protein, 9 aa, Homo Sapiens
AAPVTEGRA

SEQ ID NO: 838036 - protein, 9 aa, Homo Sapiens
ADEISLSSN

SEQ ID NO: 838037 - protein, 9 aa, Homo Sapiens
DLPVPSGVA

SEQ ID NO: 838038 - protein, 9 aa, Homo Sapiens
LSCNDTSTF

SEQ ID NO: 838039 - protein, 9 aa, Homo Sapiens
YIGCGLSSM

SEQ ID NO: 838040 - protein, 9 aa, Homo Sapiens
IHYLPGCQD

SEQ ID NO: 838041 - protein, 9 aa, Homo Sapiens
WNGEDRLLS

SEQ ID NO: 838042 - protein, 9 aa, Homo Sapiens
TAAWLLFLF

SEQ ID NO: 838043 - protein, 9 aa, Homo Sapiens
LNFANLIME

SEQ ID NO: 838044 - protein, 9 aa, Homo Sapiens
VSREHGSGV

SEQ ID NO: 838045 - protein, 9 aa, Homo Sapiens
LDPYSAFLS

SEQ ID NO: 838046 - protein, 9 aa, Homo Sapiens
PKPSPNNSP

SEQ ID NO: 838047 - protein, 9 aa, Homo Sapiens
EVIDVESLV

SEQ ID NO: 838048 - protein, 9 aa, Homo Sapiens
EQGELVAKE

SEQ ID NO: 838049 - protein, 9 aa, Homo Sapiens
QMFLGGLAF

SEQ ID NO: 838050 - protein, 9 aa, Homo Sapiens
RGQEIEAIL

SEQ ID NO: 838051 - protein, 9 aa, Homo Sapiens
IKAECSIQL

SEQ ID NO: 838052 - protein, 9 aa, Homo Sapiens
TKNPYAASN

SEQ ID NO: 838053 - protein, 9 aa, Homo Sapiens
ENGCAYFHK

SEQ ID NO: 838054 - protein, 9 aa, Homo Sapiens
PGTSPSQNN

SEQ ID NO: 838055 - protein, 9 aa, Homo Sapiens
RTNTTLSSL

SEQ ID NO: 838056 - protein, 9 aa, Homo Sapiens
EKLKESAVT

SEQ ID NO: 838057 - protein, 9 aa, Homo Sapiens
TVGMKPLSY

SEQ ID NO: 838058 - protein, 9 aa, Homo Sapiens
LKVSFLLHN

SEQ ID NO: 838059 - protein, 9 aa, Homo Sapiens
AAAQGTWSW

SEQ ID NO: 838060 - protein, 9 aa, Homo Sapiens
PSTIVIACY

SEQ ID NO: 838061 - protein, 9 aa, Homo Sapiens
GRGFAHQKL

SEQ ID NO: 838062 - protein, 9 aa, Homo Sapiens
NGDFLSSKI

SEQ ID NO: 838063 - protein, 9 aa, Homo Sapiens
TPCLKNDIG

SEQ ID NO: 838064 - protein, 9 aa, Homo Sapiens
ALLVLALAG

SEQ ID NO: 838065 - protein, 9 aa, Homo Sapiens
MHSSDYPSR

SEQ ID NO: 838066 - protein, 9 aa, Homo Sapiens
RNEDIKSLW

SEQ ID NO: 838067 - protein, 9 aa, Homo Sapiens
SRLDPNFSI

SEQ ID NO: 838068 - protein, 9 aa, Homo Sapiens
IQADLANKL

SEQ ID NO: 838069 - protein, 9 aa, Homo Sapiens
YFNRNPYFQ

SEQ ID NO: 838070 - protein, 9 aa, Homo Sapiens
QIMEGMHLS

SEQ ID NO: 838071 - protein, 9 aa, Homo Sapiens
LQTLKGLKD

SEQ ID NO: 838072 - protein, 9 aa, Homo Sapiens
YAPPLALNA

SEQ ID NO: 838073 - protein, 9 aa, Homo Sapiens
YIQTLCGSL

SEQ ID NO: 838074 - protein, 9 aa, Homo Sapiens
SQECPIKEA

SEQ ID NO: 838075 - protein, 9 aa, Homo Sapiens
RHVDNIMLE

SEQ ID NO: 838076 - protein, 9 aa, Homo Sapiens
FYSVEVIIT

SEQ ID NO: 838077 - protein, 9 aa, Homo Sapiens
ANHKIIHTG

SEQ ID NO: 838078 - protein, 9 aa, Homo Sapiens
GVYSYSGLK

SEQ ID NO: 838079 - protein, 9 aa, Homo Sapiens
TRNIRDGSE

SEQ ID NO: 838080 - protein, 9 aa, Homo Sapiens
SHSGSLQIH

SEQ ID NO: 838081 - protein, 9 aa, Homo Sapiens
STPKTKERS

SEQ ID NO: 838082 - protein, 9 aa, Homo Sapiens
DHDQEVIPM

SEQ ID NO: 838083 - protein, 9 aa, Homo Sapiens
EHKTSDSTL

SEQ ID NO: 838084 - protein, 9 aa, Homo Sapiens
SKVLQKLQN

SEQ ID NO: 838085 - protein, 9 aa, Homo Sapiens
IQEPKSAVY

SEQ ID NO: 838086 - protein, 9 aa, Homo Sapiens
LLLPALNYK

SEQ ID NO: 838087 - protein, 9 aa, Homo Sapiens
IWVTDTFPN

SEQ ID NO: 838088 - protein, 9 aa, Homo Sapiens
SFLLHNPSN

SEQ ID NO: 838089 - protein, 9 aa, Homo Sapiens
SSPSLPWSS

SEQ ID NO: 838090 - protein, 9 aa, Homo Sapiens
CLAFELFAE

SEQ ID NO: 838091 - protein, 9 aa, Homo Sapiens
LCRSPCLDC

SEQ ID NO: 838092 - protein, 9 aa, Homo Sapiens
DNDDREESL

SEQ ID NO: 838093 - protein, 9 aa, Homo Sapiens
FIWPGQMMP

SEQ ID NO: 838094 - protein, 9 aa, Homo Sapiens
IWKEPPVYA

SEQ ID NO: 838095 - protein, 9 aa, Homo Sapiens
HHVGLWLVW

SEQ ID NO: 838096 - protein, 9 aa, Homo Sapiens
PLSLHEPIQ

SEQ ID NO: 838097 - protein, 9 aa, Homo Sapiens
AEFINNYMK

SEQ ID NO: 838098 - protein, 9 aa, Homo Sapiens
EIIAVLAAA

SEQ ID NO: 838099 - protein, 9 aa, Homo Sapiens
FDHIWQKNL

SEQ ID NO: 838100 - protein, 9 aa, Homo Sapiens
KDMDLYSIN

SEQ ID NO: 838101 - protein, 9 aa, Homo Sapiens
QDIAERISE

SEQ ID NO: 838102 - protein, 9 aa, Homo Sapiens
DNYLSRTPP

SEQ ID NO: 838103 - protein, 9 aa, Homo Sapiens
KGDQSEDFG

SEQ ID NO: 838104 - protein, 9 aa, Homo Sapiens
AHMFFEGLR

SEQ ID NO: 838105 - protein, 9 aa, Homo Sapiens
DSLDSDRDL

SEQ ID NO: 838106 - protein, 9 aa, Homo Sapiens
AVQVPQHKL

SEQ ID NO: 838107 - protein, 9 aa, Homo Sapiens
AYRARVLEL

SEQ ID NO: 838108 - protein, 9 aa, Homo Sapiens
KTACDEAIA

SEQ ID NO: 838109 - protein, 9 aa, Homo Sapiens
QDDWKYVVM

SEQ ID NO: 838110 - protein, 9 aa, Homo Sapiens
NCMPSTLGL

SEQ ID NO: 838111 - protein, 9 aa, Homo Sapiens
FRVRKITCT

SEQ ID NO: 838112 - protein, 9 aa, Homo Sapiens
FLNLNNAVS

SEQ ID NO: 838113 - protein, 9 aa, Homo Sapiens
DRVLTELMS

SEQ ID NO: 838114 - protein, 9 aa, Homo Sapiens
PPTTPQYYT

SEQ ID NO: 838115 - protein, 9 aa, Homo Sapiens
QNFQSGIGE

SEQ ID NO: 838116 - protein, 9 aa, Homo Sapiens
KRQSKINEG

SEQ ID NO: 838117 - protein, 9 aa, Homo Sapiens
AYWENTFKI

SEQ ID NO: 838118 - protein, 9 aa, Homo Sapiens
QRGEIWDAC

SEQ ID NO: 838119 - protein, 9 aa, Homo Sapiens
HFVGASEML

SEQ ID NO: 838120 - protein, 9 aa, Homo Sapiens
PALHSATVT

SEQ ID NO: 838121 - protein, 9 aa, Homo Sapiens
RMATMGILL

SEQ ID NO: 838122 - protein, 9 aa, Homo Sapiens
LWQKHAYRY

SEQ ID NO: 838123 - protein, 9 aa, Homo Sapiens
VLIAIWKHN

SEQ ID NO: 838124 - protein, 9 aa, Homo Sapiens
LLITALAAL

SEQ ID NO: 838125 - protein, 9 aa, Homo Sapiens
VANIFHLRL

SEQ ID NO: 838126 - protein, 9 aa, Homo Sapiens
RIKYNVEHS

SEQ ID NO: 838127 - protein, 9 aa, Homo Sapiens
AKTWWRGLR

SEQ ID NO: 838128 - protein, 9 aa, Homo Sapiens
FITKKFPNH

SEQ ID NO: 838129 - protein, 9 aa, Homo Sapiens
CTGETEATK

SEQ ID NO: 838130 - protein, 9 aa, Homo Sapiens
RVPSDGVAG

SEQ ID NO: 838131 - protein, 9 aa, Homo Sapiens
IVNELYEQG

SEQ ID NO: 838132 - protein, 9 aa, Homo Sapiens
GKFKQFCLL

SEQ ID NO: 838133 - protein, 9 aa, Homo Sapiens
PENKLEFKP

SEQ ID NO: 838134 - protein, 9 aa, Homo Sapiens
TKHLKSVED

SEQ ID NO: 838135 - protein, 9 aa, Homo Sapiens
DLDKSVEKI

SEQ ID NO: 838136 - protein, 9 aa, Homo Sapiens
NLCVLRSIL

SEQ ID NO: 838137 - protein, 9 aa, Homo Sapiens
YKGPGVSCC

SEQ ID NO: 838138 - protein, 9 aa, Homo Sapiens
ITECRNPQE

SEQ ID NO: 838139 - protein, 9 aa, Homo Sapiens
VIYTSGTTG

SEQ ID NO: 838140 - protein, 9 aa, Homo Sapiens
LQEDTRKFQ

SEQ ID NO: 838141 - protein, 9 aa, Homo Sapiens
KLFDELRMN

SEQ ID NO: 838142 - protein, 9 aa, Homo Sapiens
IIHFVLCVV

SEQ ID NO: 838143 - protein, 9 aa, Homo Sapiens
SEANAPEEL

SEQ ID NO: 838144 - protein, 9 aa, Homo Sapiens
TLDKLDVKQ

SEQ ID NO: 838145 - protein, 9 aa, Homo Sapiens
FLYTDLFLS

SEQ ID NO: 838146 - protein, 9 aa, Homo Sapiens
AIPQHFCKL

SEQ ID NO: 838147 - protein, 9 aa, Homo Sapiens
LILGEITCA

SEQ ID NO: 838148 - protein, 9 aa, Homo Sapiens
SQPQALYQN

SEQ ID NO: 838149 - protein, 9 aa, Homo Sapiens
TVLHLAVET

SEQ ID NO: 838150 - protein, 9 aa, Homo Sapiens
SKLSHDADP

SEQ ID NO: 838151 - protein, 9 aa, Homo Sapiens
IVGGYTCED

SEQ ID NO: 838152 - protein, 9 aa, Homo Sapiens
LVELHFKLM

SEQ ID NO: 838153 - protein, 9 aa, Homo Sapiens
DQDDDDIQG

SEQ ID NO: 838154 - protein, 9 aa, Homo Sapiens
LEKTYPYVE

SEQ ID NO: 838155 - protein, 9 aa, Homo Sapiens
QSFQVALHI

SEQ ID NO: 838156 - protein, 9 aa, Homo Sapiens
TDDSSAAWE

SEQ ID NO: 838157 - protein, 9 aa, Homo Sapiens
PPPHLSCLP

SEQ ID NO: 838158 - protein, 9 aa, Homo Sapiens
LIMDFHSVP

SEQ ID NO: 838159 - protein, 9 aa, Homo Sapiens
KAFSKPSTP

SEQ ID NO: 838160 - protein, 9 aa, Homo Sapiens
DKSEEELEE

SEQ ID NO: 838161 - protein, 9 aa, Homo Sapiens
NYATSTTIA

SEQ ID NO: 838162 - protein, 9 aa, Homo Sapiens
LLTEVSQHA

SEQ ID NO: 838163 - protein, 9 aa, Homo Sapiens
SAYFLRYKN

SEQ ID NO: 838164 - protein, 9 aa, Homo Sapiens
LRRTVNALK

SEQ ID NO: 838165 - protein, 9 aa, Homo Sapiens
SKNKDKLIK

SEQ ID NO: 838166 - protein, 9 aa, Homo Sapiens
TCQAGGRDA

SEQ ID NO: 838167 - protein, 9 aa, Homo Sapiens
RGPDTNPRP

SEQ ID NO: 838168 - protein, 9 aa, Homo Sapiens
FSQVTRLLD

SEQ ID NO: 838169 - protein, 9 aa, Homo Sapiens
TKTLPDSLT

SEQ ID NO: 838170 - protein, 9 aa, Homo Sapiens
SLPFKDMDT

SEQ ID NO: 838171 - protein, 9 aa, Homo Sapiens
CKREQKQRD

SEQ ID NO: 838172 - protein, 9 aa, Homo Sapiens
DPEETTEFQ

SEQ ID NO: 838173 - protein, 9 aa, Homo Sapiens
TMTKMPSAL

SEQ ID NO: 838174 - protein, 9 aa, Homo Sapiens
ELCKQGKDL

SEQ ID NO: 838175 - protein, 9 aa, Homo Sapiens
VYDFDCFSK

SEQ ID NO: 838176 - protein, 9 aa, Homo Sapiens
TKQQASSLT

SEQ ID NO: 838177 - protein, 9 aa, Homo Sapiens
GITCLIQLL

SEQ ID NO: 838178 - protein, 9 aa, Homo Sapiens
QEYERIVLV

SEQ ID NO: 838179 - protein, 9 aa, Homo Sapiens
MPVSGAETV

SEQ ID NO: 838180 - protein, 9 aa, Homo Sapiens
TDPTRRLFK

SEQ ID NO: 838181 - protein, 9 aa, Homo Sapiens
RIDTSRKLP

SEQ ID NO: 838182 - protein, 9 aa, Homo Sapiens
FGSINPLKT

SEQ ID NO: 838183 - protein, 9 aa, Homo Sapiens
SKCGVMTSS

SEQ ID NO: 838184 - protein, 9 aa, Homo Sapiens
LNKLRQSEV

SEQ ID NO: 838185 - protein, 9 aa, Homo Sapiens
GMWVVRGVD

SEQ ID NO: 838186 - protein, 9 aa, Homo Sapiens
ENLPATSFS

SEQ ID NO: 838187 - protein, 9 aa, Homo Sapiens
TGHLIYTCG

SEQ ID NO: 838188 - protein, 9 aa, Homo Sapiens
QALKQILSL

SEQ ID NO: 838189 - protein, 9 aa, Homo Sapiens
RRSWLSYSY

SEQ ID NO: 838190 - protein, 9 aa, Homo Sapiens
VASMHCYLD

SEQ ID NO: 838191 - protein, 9 aa, Homo Sapiens
EEEECIEEE

SEQ ID NO: 838192 - protein, 9 aa, Homo Sapiens
NLDPLPTHF

SEQ ID NO: 838193 - protein, 9 aa, Homo Sapiens
EWTLQTLQE

SEQ ID NO: 838194 - protein, 9 aa, Homo Sapiens
KELHPNTDP

SEQ ID NO: 838195 - protein, 9 aa, Homo Sapiens
NGMLLNDHK

SEQ ID NO: 838196 - protein, 9 aa, Homo Sapiens
VVPVSYFIW

SEQ ID NO: 838197 - protein, 9 aa, Homo Sapiens
AAYLDLLLG

SEQ ID NO: 838198 - protein, 9 aa, Homo Sapiens
SPTYDLSKS

SEQ ID NO: 838199 - protein, 9 aa, Homo Sapiens
RRYLTINSM

SEQ ID NO: 838200 - protein, 9 aa, Homo Sapiens
TIRITGSGR

SEQ ID NO: 838201 - protein, 9 aa, Homo Sapiens
TVVDYGKLL

SEQ ID NO: 838202 - protein, 9 aa, Homo Sapiens
ARIQAAAPT

SEQ ID NO: 838203 - protein, 9 aa, Homo Sapiens
RGVQEQTTA

SEQ ID NO: 838204 - protein, 9 aa, Homo Sapiens
DPINGLSAL

SEQ ID NO: 838205 - protein, 9 aa, Homo Sapiens
QAGGTKVLL

SEQ ID NO: 838206 - protein, 9 aa, Homo Sapiens
CCLSRGMRA

SEQ ID NO: 838207 - protein, 9 aa, Homo Sapiens
NVESIVKLY

SEQ ID NO: 838208 - protein, 9 aa, Homo Sapiens
RINRAQEHL

SEQ ID NO: 838209 - protein, 9 aa, Homo Sapiens
AAQDDDFFN

SEQ ID NO: 838210 - protein, 9 aa, Homo Sapiens
SFTESLTRG

SEQ ID NO: 838211 - protein, 9 aa, Homo Sapiens
ILQICQRKS

SEQ ID NO: 838212 - protein, 9 aa, Homo Sapiens
LFSWQEDPG

SEQ ID NO: 838213 - protein, 9 aa, Homo Sapiens
GLRLTTSFF

SEQ ID NO: 838214 - protein, 9 aa, Homo Sapiens
EAWTTGPFC

SEQ ID NO: 838215 - protein, 9 aa, Homo Sapiens
HMSQSSRYG

SEQ ID NO: 838216 - protein, 9 aa, Homo Sapiens
EPSASAPIP

SEQ ID NO: 838217 - protein, 9 aa, Homo Sapiens
DWRIQKGVD

SEQ ID NO: 838218 - protein, 9 aa, Homo Sapiens
CYKMDTVLR

SEQ ID NO: 838219 - protein, 9 aa, Homo Sapiens
IQRAITGTI

SEQ ID NO: 838220 - protein, 9 aa, Homo Sapiens
SFSKFASSI

SEQ ID NO: 838221 - protein, 9 aa, Homo Sapiens
SLKSVECYN

SEQ ID NO: 838222 - protein, 9 aa, Homo Sapiens
QPTGNVWWQ

SEQ ID NO: 838223 - protein, 9 aa, Homo Sapiens
QPNPGLLQA

SEQ ID NO: 838224 - protein, 9 aa, Homo Sapiens
GQAQVKQES

SEQ ID NO: 838225 - protein, 9 aa, Homo Sapiens
MYVQPFWIV

SEQ ID NO: 838226 - protein, 9 aa, Homo Sapiens
HHLTDLSHL

SEQ ID NO: 838227 - protein, 9 aa, Homo Sapiens
LDEMATYDL

SEQ ID NO: 838228 - protein, 9 aa, Homo Sapiens
AHKPLNDRS

SEQ ID NO: 838229 - protein, 9 aa, Homo Sapiens
TPQIFPAMA

SEQ ID NO: 838230 - protein, 9 aa, Homo Sapiens
LLFGRQFDY

SEQ ID NO: 838231 - protein, 9 aa, Homo Sapiens
SAEESNFPE

SEQ ID NO: 838232 - protein, 9 aa, Homo Sapiens
PLVLEGTIK

SEQ ID NO: 838233 - protein, 9 aa, Homo Sapiens
FRDGVMLDG

SEQ ID NO: 838234 - protein, 9 aa, Homo Sapiens
LAKYLDFIN

SEQ ID NO: 838235 - protein, 9 aa, Homo Sapiens
VRHSKAQIT

SEQ ID NO: 838236 - protein, 9 aa, Homo Sapiens
SQVSQFVAC

SEQ ID NO: 838237 - protein, 9 aa, Homo Sapiens
EVKQQLENK

SEQ ID NO: 838238 - protein, 9 aa, Homo Sapiens
KKRKGSRKE

SEQ ID NO: 838239 - protein, 9 aa, Homo Sapiens
QIHTQNKIA

SEQ ID NO: 838240 - protein, 9 aa, Homo Sapiens
RAAFLPLPA

SEQ ID NO: 838241 - protein, 9 aa, Homo Sapiens
RTCIQFYMK

SEQ ID NO: 838242 - protein, 9 aa, Homo Sapiens
NNKIYDGGA

SEQ ID NO: 838243 - protein, 9 aa, Homo Sapiens
DGLLVFNKI

SEQ ID NO: 838244 - protein, 9 aa, Homo Sapiens
RITRVQRPI

SEQ ID NO: 838245 - protein, 9 aa, Homo Sapiens
EDIVTILQA

SEQ ID NO: 838246 - protein, 9 aa, Homo Sapiens
FCCALGRLG

SEQ ID NO: 838247 - protein, 9 aa, Homo Sapiens
EIDKVCFVV

SEQ ID NO: 838248 - protein, 9 aa, Homo Sapiens
SSPLHYAAC

SEQ ID NO: 838249 - protein, 9 aa, Homo Sapiens
KEIQELNGV

SEQ ID NO: 838250 - protein, 9 aa, Homo Sapiens
IVHQDLKPR

SEQ ID NO: 838251 - protein, 9 aa, Homo Sapiens
PAKTPPTPK

SEQ ID NO: 838252 - protein, 9 aa, Homo Sapiens
CFVNKQHKR

SEQ ID NO: 838253 - protein, 9 aa, Homo Sapiens
TSLFSLNAL

SEQ ID NO: 838254 - protein, 9 aa, Homo Sapiens
CVGETQSRT

SEQ ID NO: 838255 - protein, 9 aa, Homo Sapiens
SQPPGPVLL

SEQ ID NO: 838256 - protein, 9 aa, Homo Sapiens
ASSSRSSSP

SEQ ID NO: 838257 - protein, 9 aa, Homo Sapiens
LGEVGNYLG

SEQ ID NO: 838258 - protein, 9 aa, Homo Sapiens
IVSAGMRTE

SEQ ID NO: 838259 - protein, 9 aa, Homo Sapiens
NYLGLQPKM

SEQ ID NO: 838260 - protein, 9 aa, Homo Sapiens
KLLKILRKY

SEQ ID NO: 838261 - protein, 9 aa, Homo Sapiens
SAAWAVYYA

SEQ ID NO: 838262 - protein, 9 aa, Homo Sapiens
ELRKNKRQY

SEQ ID NO: 838263 - protein, 9 aa, Homo Sapiens
SRMLHVVQT

SEQ ID NO: 838264 - protein, 9 aa, Homo Sapiens
ARQVCKQLI

SEQ ID NO: 838265 - protein, 9 aa, Homo Sapiens
SCCSGLHSL

SEQ ID NO: 838266 - protein, 9 aa, Homo Sapiens
VKIWKGQAV

SEQ ID NO: 838267 - protein, 9 aa, Homo Sapiens
YALERATVF

SEQ ID NO: 838268 - protein, 9 aa, Homo Sapiens
REDEFSPLN

SEQ ID NO: 838269 - protein, 9 aa, Homo Sapiens
FYWNVSRFI

SEQ ID NO: 838270 - protein, 9 aa, Homo Sapiens
YKCTICGQA

SEQ ID NO: 838271 - protein, 9 aa, Homo Sapiens
SHYIKDKTH

SEQ ID NO: 838272 - protein, 9 aa, Homo Sapiens
PNTLVVLDT

SEQ ID NO: 838273 - protein, 9 aa, Homo Sapiens
EPVKNIFVG

SEQ ID NO: 838274 - protein, 9 aa, Homo Sapiens
HALYAMCDV

SEQ ID NO: 838275 - protein, 9 aa, Homo Sapiens
FLKGRCFRG

SEQ ID NO: 838276 - protein, 9 aa, Homo Sapiens
NKKNTWRQH

SEQ ID NO: 838277 - protein, 9 aa, Homo Sapiens
LSFTNSDLR

SEQ ID NO: 838278 - protein, 9 aa, Homo Sapiens
RAFLQTYFQ

SEQ ID NO: 838279 - protein, 9 aa, Homo Sapiens
LYQLLQGIV

SEQ ID NO: 838280 - protein, 9 aa, Homo Sapiens
ETCYWDSGN

SEQ ID NO: 838281 - protein, 9 aa, Homo Sapiens
YLSRTPPDI

SEQ ID NO: 838282 - protein, 9 aa, Homo Sapiens
EYCFYGYLV

SEQ ID NO: 838283 - protein, 9 aa, Homo Sapiens
TRGEYFLYK

SEQ ID NO: 838284 - protein, 9 aa, Homo Sapiens
QVQKVAHLE

SEQ ID NO: 838285 - protein, 9 aa, Homo Sapiens
GKRHPGIQR

SEQ ID NO: 838286 - protein, 9 aa, Homo Sapiens
IHMRDKSYE

SEQ ID NO: 838287 - protein, 9 aa, Homo Sapiens
LVETPRPTW

SEQ ID NO: 838288 - protein, 9 aa, Homo Sapiens
IMLLNIAYE

SEQ ID NO: 838289 - protein, 9 aa, Homo Sapiens
VYGSGKTYI

SEQ ID NO: 838290 - protein, 9 aa, Homo Sapiens
PHTVLKPRK

SEQ ID NO: 838291 - protein, 9 aa, Homo Sapiens
YIVLIVEKG

SEQ ID NO: 838292 - protein, 9 aa, Homo Sapiens
ISKQYNNEP

SEQ ID NO: 838293 - protein, 9 aa, Homo Sapiens
PFPPLRCQE

SEQ ID NO: 838294 - protein, 9 aa, Homo Sapiens
YVAFAMYMV

SEQ ID NO: 838295 - protein, 9 aa, Homo Sapiens
YMQKEGLYE

SEQ ID NO: 838296 - protein, 9 aa, Homo Sapiens
DEMYKIILN

SEQ ID NO: 838297 - protein, 9 aa, Homo Sapiens
DRKEDVKGM

SEQ ID NO: 838298 - protein, 9 aa, Homo Sapiens
TDNGIFYED

SEQ ID NO: 838299 - protein, 9 aa, Homo Sapiens
PRLKICFIN

SEQ ID NO: 838300 - protein, 9 aa, Homo Sapiens
GVVDAIGLA

SEQ ID NO: 838301 - protein, 9 aa, Homo Sapiens
KYITNKLYS

SEQ ID NO: 838302 - protein, 9 aa, Homo Sapiens
CEVDIYECQ

SEQ ID NO: 838303 - protein, 9 aa, Homo Sapiens
TAWIYTSEN

SEQ ID NO: 838304 - protein, 9 aa, Homo Sapiens
NTQRAYTSE

SEQ ID NO: 838305 - protein, 9 aa, Homo Sapiens
ICEGKNQNG

SEQ ID NO: 838306 - protein, 9 aa, Homo Sapiens
IVKRTKKRL

SEQ ID NO: 838307 - protein, 9 aa, Homo Sapiens
YMASFLVFY

SEQ ID NO: 838308 - protein, 9 aa, Homo Sapiens
QNILHEVIT

SEQ ID NO: 838309 - protein, 9 aa, Homo Sapiens
QWRIKLGFT

SEQ ID NO: 838310 - protein, 9 aa, Homo Sapiens
LTPGLPAPE

SEQ ID NO: 838311 - protein, 9 aa, Homo Sapiens
LPYRGPRGG

SEQ ID NO: 838312 - protein, 9 aa, Homo Sapiens
DVEEALSYT

SEQ ID NO: 838313 - protein, 9 aa, Homo Sapiens
DCGLEANNL

SEQ ID NO: 838314 - protein, 9 aa, Homo Sapiens
KVQSLKEQH

SEQ ID NO: 838315 - protein, 9 aa, Homo Sapiens
KIARIAVRM

SEQ ID NO: 838316 - protein, 9 aa, Homo Sapiens
VRIICGSRK

SEQ ID NO: 838317 - protein, 9 aa, Homo Sapiens
FPPRNPSTL

SEQ ID NO: 838318 - protein, 9 aa, Homo Sapiens
IIYSLWNCD

SEQ ID NO: 838319 - protein, 9 aa, Homo Sapiens
ENMKENPMT

SEQ ID NO: 838320 - protein, 9 aa, Homo Sapiens
SVQTPPALE

SEQ ID NO: 838321 - protein, 9 aa, Homo Sapiens
RKSEWSDKS

SEQ ID NO: 838322 - protein, 9 aa, Homo Sapiens
NSYGVLEFQ

SEQ ID NO: 838323 - protein, 9 aa, Homo Sapiens
IENKNYVLN

SEQ ID NO: 838324 - protein, 9 aa, Homo Sapiens
KEDKEEDKE

SEQ ID NO: 838325 - protein, 9 aa, Homo Sapiens
KRPVIVHQA

SEQ ID NO: 838326 - protein, 9 aa, Homo Sapiens
YIKKNGEDK

SEQ ID NO: 838327 - protein, 9 aa, Homo Sapiens
SPVAVQVGI

SEQ ID NO: 838328 - protein, 9 aa, Homo Sapiens
ENIKLQQFS

SEQ ID NO: 838329 - protein, 9 aa, Homo Sapiens
VLYTVPSTI

SEQ ID NO: 838330 - protein, 9 aa, Homo Sapiens
GGCSKDIEF

SEQ ID NO: 838331 - protein, 9 aa, Homo Sapiens
KGHMEYLVK

SEQ ID NO: 838332 - protein, 9 aa, Homo Sapiens
VLTQEERYK

SEQ ID NO: 838333 - protein, 9 aa, Homo Sapiens
TDGEGAGKE

SEQ ID NO: 838334 - protein, 9 aa, Homo Sapiens
FRDPLDWSK

SEQ ID NO: 838335 - protein, 9 aa, Homo Sapiens
VDPYYYKKI

SEQ ID NO: 838336 - protein, 9 aa, Homo Sapiens
KEYGTFSLA

SEQ ID NO: 838337 - protein, 9 aa, Homo Sapiens
DSDIAFQFQ

SEQ ID NO: 838338 - protein, 9 aa, Homo Sapiens
YEQFFREAE

SEQ ID NO: 838339 - protein, 9 aa, Homo Sapiens
LDCAGNTTV

SEQ ID NO: 838340 - protein, 9 aa, Homo Sapiens
FISAQASCS

SEQ ID NO: 838341 - protein, 9 aa, Homo Sapiens
FILKTVLRS

SEQ ID NO: 838342 - protein, 9 aa, Homo Sapiens
PSQDNARLD

SEQ ID NO: 838343 - protein, 9 aa, Homo Sapiens
HSTSNHQLF

SEQ ID NO: 838344 - protein, 9 aa, Homo Sapiens
QDRRFNDEL

SEQ ID NO: 838345 - protein, 9 aa, Homo Sapiens
IPLEDDIIV

SEQ ID NO: 838346 - protein, 9 aa, Homo Sapiens
KTGCVYLTI

SEQ ID NO: 838347 - protein, 9 aa, Homo Sapiens
IYYSNFHAV

SEQ ID NO: 838348 - protein, 9 aa, Homo Sapiens
LADRDNQSI

SEQ ID NO: 838349 - protein, 9 aa, Homo Sapiens
MKSDSFIQE

SEQ ID NO: 838350 - protein, 9 aa, Homo Sapiens
PNKMDGASG

SEQ ID NO: 838351 - protein, 9 aa, Homo Sapiens
EYEELPTSF

SEQ ID NO: 838352 - protein, 9 aa, Homo Sapiens
ILRLFGSLS

SEQ ID NO: 838353 - protein, 9 aa, Homo Sapiens
KYFNMRVFS

SEQ ID NO: 838354 - protein, 9 aa, Homo Sapiens
KVCLAQKMM

SEQ ID NO: 838355 - protein, 9 aa, Homo Sapiens
FQLTAEDIK

SEQ ID NO: 838356 - protein, 9 aa, Homo Sapiens
EIQSSLSEK

SEQ ID NO: 838357 - protein, 9 aa, Homo Sapiens
RSLETLEII

SEQ ID NO: 838358 - protein, 9 aa, Homo Sapiens
QICDTLLVE

SEQ ID NO: 838359 - protein, 9 aa, Homo Sapiens
IRRSDLYES

SEQ ID NO: 838360 - protein, 9 aa, Homo Sapiens
SLQKQVLST

SEQ ID NO: 838361 - protein, 9 aa, Homo Sapiens
NAAAAAFQR

SEQ ID NO: 838362 - protein, 9 aa, Homo Sapiens
EERYAAELE

SEQ ID NO: 838363 - protein, 9 aa, Homo Sapiens
GVGFHTLSF

SEQ ID NO: 838364 - protein, 9 aa, Homo Sapiens
RRCTKLDMA

SEQ ID NO: 838365 - protein, 9 aa, Homo Sapiens
TKNNKIYDG

SEQ ID NO: 838366 - protein, 9 aa, Homo Sapiens
RRNMTIKAE

SEQ ID NO: 838367 - protein, 9 aa, Homo Sapiens
LPKLEEVCT

SEQ ID NO: 838368 - protein, 9 aa, Homo Sapiens
ALIVHQITH

SEQ ID NO: 838369 - protein, 9 aa, Homo Sapiens
IVMAIAVNK

SEQ ID NO: 838370 - protein, 9 aa, Homo Sapiens
NYTNGNFGS

SEQ ID NO: 838371 - protein, 9 aa, Homo Sapiens
WIDYALATW

SEQ ID NO: 838372 - protein, 9 aa, Homo Sapiens
INMLSEEKQ

SEQ ID NO: 838373 - protein, 9 aa, Homo Sapiens
LPTYHLPPY

SEQ ID NO: 838374 - protein, 9 aa, Homo Sapiens
YLTAHQRRH

SEQ ID NO: 838375 - protein, 9 aa, Homo Sapiens
YNFIEDQGG

SEQ ID NO: 838376 - protein, 9 aa, Homo Sapiens
EPPPSWTGI

SEQ ID NO: 838377 - protein, 9 aa, Homo Sapiens
GMCQPCECH

SEQ ID NO: 838378 - protein, 9 aa, Homo Sapiens
SLTVHQIIH

SEQ ID NO: 838379 - protein, 9 aa, Homo Sapiens
HCFGRQSTL

SEQ ID NO: 838380 - protein, 9 aa, Homo Sapiens
KNLFKKAAA

SEQ ID NO: 838381 - protein, 9 aa, Homo Sapiens
MTAETLLQQ

SEQ ID NO: 838382 - protein, 9 aa, Homo Sapiens
SSFVSVRPE

SEQ ID NO: 838383 - protein, 9 aa, Homo Sapiens
ASDSNVYAL

SEQ ID NO: 838384 - protein, 9 aa, Homo Sapiens
YLTRKVKMP

SEQ ID NO: 838385 - protein, 9 aa, Homo Sapiens
PITKMEISV

SEQ ID NO: 838386 - protein, 9 aa, Homo Sapiens
QSINYTDCL

SEQ ID NO: 838387 - protein, 9 aa, Homo Sapiens
FWKNLAVLD

SEQ ID NO: 838388 - protein, 9 aa, Homo Sapiens
NNIFIHEGL

SEQ ID NO: 838389 - protein, 9 aa, Homo Sapiens
RDTTIKMWE

SEQ ID NO: 838390 - protein, 9 aa, Homo Sapiens
DLDANKDNK

SEQ ID NO: 838391 - protein, 9 aa, Homo Sapiens
YYEQQLLRK

SEQ ID NO: 838392 - protein, 9 aa, Homo Sapiens
PTPGARSPD

SEQ ID NO: 838393 - protein, 9 aa, Homo Sapiens
ECLGKQLKL

SEQ ID NO: 838394 - protein, 9 aa, Homo Sapiens
DIWLFGAWH

SEQ ID NO: 838395 - protein, 9 aa, Homo Sapiens
NPRSSSKIA

SEQ ID NO: 838396 - protein, 9 aa, Homo Sapiens
YCNETCYPG

SEQ ID NO: 838397 - protein, 9 aa, Homo Sapiens
DLDALTEKF

SEQ ID NO: 838398 - protein, 9 aa, Homo Sapiens
PNINVITGI

SEQ ID NO: 838399 - protein, 9 aa, Homo Sapiens
QLHQVDSDL

SEQ ID NO: 838400 - protein, 9 aa, Homo Sapiens
ELTKSLDSP

SEQ ID NO: 838401 - protein, 9 aa, Homo Sapiens
SIKHETLPY

SEQ ID NO: 838402 - protein, 9 aa, Homo Sapiens
TATTPKRQT

SEQ ID NO: 838403 - protein, 9 aa, Homo Sapiens
QPGGKVWEP

SEQ ID NO: 838404 - protein, 9 aa, Homo Sapiens
PAGTKVLEV

SEQ ID NO: 838405 - protein, 9 aa, Homo Sapiens
EDLLNYQVT

SEQ ID NO: 838406 - protein, 9 aa, Homo Sapiens
CIAAEFNTL

SEQ ID NO: 838407 - protein, 9 aa, Homo Sapiens
KDLLKTVEG

SEQ ID NO: 838408 - protein, 9 aa, Homo Sapiens
DLPLTMESA

SEQ ID NO: 838409 - protein, 9 aa, Homo Sapiens
KQLSDVCQL

SEQ ID NO: 838410 - protein, 9 aa, Homo Sapiens
GSILQEHPQ

SEQ ID NO: 838411 - protein, 9 aa, Homo Sapiens
FQYPQLNVS

SEQ ID NO: 838412 - protein, 9 aa, Homo Sapiens
QYEIRNCWS

SEQ ID NO: 838413 - protein, 9 aa, Homo Sapiens
EYLHCQKLV

SEQ ID NO: 838414 - protein, 9 aa, Homo Sapiens
LFRFIVLFY

SEQ ID NO: 838415 - protein, 9 aa, Homo Sapiens
SDNKSEYLF

SEQ ID NO: 838416 - protein, 9 aa, Homo Sapiens
GDSKMNLNN

SEQ ID NO: 838417 - protein, 9 aa, Homo Sapiens
RLDWKVNKD

SEQ ID NO: 838418 - protein, 9 aa, Homo Sapiens
DLLSSIAYS

SEQ ID NO: 838419 - protein, 9 aa, Homo Sapiens
KPSPHPVTP

SEQ ID NO: 838420 - protein, 9 aa, Homo Sapiens
DICKDKRVL

SEQ ID NO: 838421 - protein, 9 aa, Homo Sapiens
FIQVPVRRR

SEQ ID NO: 838422 - protein, 9 aa, Homo Sapiens
RFIFLGFPT

SEQ ID NO: 838423 - protein, 9 aa, Homo Sapiens
LFGPQLNPA

SEQ ID NO: 838424 - protein, 9 aa, Homo Sapiens
TDKEITSED

SEQ ID NO: 838425 - protein, 9 aa, Homo Sapiens
NKLEFKPDS

SEQ ID NO: 838426 - protein, 9 aa, Homo Sapiens
IDIYIPEAQ

SEQ ID NO: 838427 - protein, 9 aa, Homo Sapiens
GCYNVLNNT

SEQ ID NO: 838428 - protein, 9 aa, Homo Sapiens
LGEITCALN

SEQ ID NO: 838429 - protein, 9 aa, Homo Sapiens
GDMDCNEFD

SEQ ID NO: 838430 - protein, 9 aa, Homo Sapiens
GKTPVYAKV

SEQ ID NO: 838431 - protein, 9 aa, Homo Sapiens
PRGPSVPTG

SEQ ID NO: 838432 - protein, 9 aa, Homo Sapiens
QLEGDNKMV

SEQ ID NO: 838433 - protein, 9 aa, Homo Sapiens
KKLSKAQCE

SEQ ID NO: 838434 - protein, 9 aa, Homo Sapiens
LFSTSKITS

SEQ ID NO: 838435 - protein, 9 aa, Homo Sapiens
RAANSKVTF

SEQ ID NO: 838436 - protein, 9 aa, Homo Sapiens
AKCEIHNGI

SEQ ID NO: 838437 - protein, 9 aa, Homo Sapiens
RYDELHNSS

SEQ ID NO: 838438 - protein, 9 aa, Homo Sapiens
RSNLIRHQI

SEQ ID NO: 838439 - protein, 9 aa, Homo Sapiens
ATLRERYLR

SEQ ID NO: 838440 - protein, 9 aa, Homo Sapiens
NNEVKEKGH

SEQ ID NO: 838441 - protein, 9 aa, Homo Sapiens
LGVKGNYLR

SEQ ID NO: 838442 - protein, 9 aa, Homo Sapiens
QPDILDPAL

SEQ ID NO: 838443 - protein, 9 aa, Homo Sapiens
SLGGVTFLG

SEQ ID NO: 838444 - protein, 9 aa, Homo Sapiens
KLFFFLQRE

SEQ ID NO: 838445 - protein, 9 aa, Homo Sapiens
CSPFVLIMS

SEQ ID NO: 838446 - protein, 9 aa, Homo Sapiens
DNFRRNSDL

SEQ ID NO: 838447 - protein, 9 aa, Homo Sapiens
RQNGYRALM

SEQ ID NO: 838448 - protein, 9 aa, Homo Sapiens
SRVYLMTLG

SEQ ID NO: 838449 - protein, 9 aa, Homo Sapiens
SQKELVNIL

SEQ ID NO: 838450 - protein, 9 aa, Homo Sapiens
DTDNQNSQN

SEQ ID NO: 838451 - protein, 9 aa, Homo Sapiens
ILKLLDAEK

SEQ ID NO: 838452 - protein, 9 aa, Homo Sapiens
WLNLHELGP

SEQ ID NO: 838453 - protein, 9 aa, Homo Sapiens
WWEQDEIPS

SEQ ID NO: 838454 - protein, 9 aa, Homo Sapiens
IHSSDFVKD

SEQ ID NO: 838455 - protein, 9 aa, Homo Sapiens
GQELMFWGL

SEQ ID NO: 838456 - protein, 9 aa, Homo Sapiens
ECYMYRIIH

SEQ ID NO: 838457 - protein, 9 aa, Homo Sapiens
NPPTFVQGV

SEQ ID NO: 838458 - protein, 9 aa, Homo Sapiens
AFYDISQIF

SEQ ID NO: 838459 - protein, 9 aa, Homo Sapiens
DEILWVTEW

SEQ ID NO: 838460 - protein, 9 aa, Homo Sapiens
LSEEQNKPY

SEQ ID NO: 838461 - protein, 9 aa, Homo Sapiens
LERAIRAAV

SEQ ID NO: 838462 - protein, 9 aa, Homo Sapiens
KCFTCGIGN

SEQ ID NO: 838463 - protein, 9 aa, Homo Sapiens
AKQVPRAAP

SEQ ID NO: 838464 - protein, 9 aa, Homo Sapiens
LNAELLTEK

SEQ ID NO: 838465 - protein, 9 aa, Homo Sapiens
GKAESRNSN

SEQ ID NO: 838466 - protein, 9 aa, Homo Sapiens
GQLDCFKRW

SEQ ID NO: 838467 - protein, 9 aa, Homo Sapiens
ILALPLSTQ

SEQ ID NO: 838468 - protein, 9 aa, Homo Sapiens
GNPGFIGSI

SEQ ID NO: 838469 - protein, 9 aa, Homo Sapiens
DLYPNINVI

SEQ ID NO: 838470 - protein, 9 aa, Homo Sapiens
YNEVEIEVE

SEQ ID NO: 838471 - protein, 9 aa, Homo Sapiens
IHKEVKPYV

SEQ ID NO: 838472 - protein, 9 aa, Homo Sapiens
YYSDIGNMP

SEQ ID NO: 838473 - protein, 9 aa, Homo Sapiens
VPGEQTSYG

SEQ ID NO: 838474 - protein, 9 aa, Homo Sapiens
GECGKFFQM

SEQ ID NO: 838475 - protein, 9 aa, Homo Sapiens
AVYFLLPEE

SEQ ID NO: 838476 - protein, 9 aa, Homo Sapiens
QHKRKLKRK

SEQ ID NO: 838477 - protein, 9 aa, Homo Sapiens
KLKESAVTV

SEQ ID NO: 838478 - protein, 9 aa, Homo Sapiens
AAKRADEEL

SEQ ID NO: 838479 - protein, 9 aa, Homo Sapiens
IMKKLDQQY

SEQ ID NO: 838480 - protein, 9 aa, Homo Sapiens
SHFFFTLGR

SEQ ID NO: 838481 - protein, 9 aa, Homo Sapiens
NSMGGKEQN

SEQ ID NO: 838482 - protein, 9 aa, Homo Sapiens
LSQSNPKRE

SEQ ID NO: 838483 - protein, 9 aa, Homo Sapiens
RLLKEGCEI

SEQ ID NO: 838484 - protein, 9 aa, Homo Sapiens
CKHEDYMQD

SEQ ID NO: 838485 - protein, 9 aa, Homo Sapiens
ELKKLQQSG

SEQ ID NO: 838486 - protein, 9 aa, Homo Sapiens
CPNNCRCDG

SEQ ID NO: 838487 - protein, 9 aa, Homo Sapiens
TGENVRELF

SEQ ID NO: 838488 - protein, 9 aa, Homo Sapiens
DMYQNYIAE

SEQ ID NO: 838489 - protein, 9 aa, Homo Sapiens
DGQLKHEDT

SEQ ID NO: 838490 - protein, 9 aa, Homo Sapiens
LVEVLEDVP

SEQ ID NO: 838491 - protein, 9 aa, Homo Sapiens
STPMNVQSS

SEQ ID NO: 838492 - protein, 9 aa, Homo Sapiens
MPIAPTGEP

SEQ ID NO: 838493 - protein, 9 aa, Homo Sapiens
DLTQTANKN

SEQ ID NO: 838494 - protein, 9 aa, Homo Sapiens
PPRYVITTT

SEQ ID NO: 838495 - protein, 9 aa, Homo Sapiens
VAHQRKSME

SEQ ID NO: 838496 - protein, 9 aa, Homo Sapiens
ELLDIINEL

SEQ ID NO: 838497 - protein, 9 aa, Homo Sapiens
APSRTQRAK

SEQ ID NO: 838498 - protein, 9 aa, Homo Sapiens
VDLTTVYGL

SEQ ID NO: 838499 - protein, 9 aa, Homo Sapiens
EEVTYNVAQ

SEQ ID NO: 838500 - protein, 9 aa, Homo Sapiens
GPTLNEQQR

SEQ ID NO: 838501 - protein, 9 aa, Homo Sapiens
KFPGVAAAV

SEQ ID NO: 838502 - protein, 9 aa, Homo Sapiens
KLDIKLRHF

SEQ ID NO: 838503 - protein, 9 aa, Homo Sapiens
ALSRIWQEA

SEQ ID NO: 838504 - protein, 9 aa, Homo Sapiens
CWAWQGLGV

SEQ ID NO: 838505 - protein, 9 aa, Homo Sapiens
GRHKCRLCA

SEQ ID NO: 838506 - protein, 9 aa, Homo Sapiens
GVLQALLGI

SEQ ID NO: 838507 - protein, 9 aa, Homo Sapiens
MSRRSWLSY

SEQ ID NO: 838508 - protein, 9 aa, Homo Sapiens
SMNLESDNE

SEQ ID NO: 838509 - protein, 9 aa, Homo Sapiens
SFTNSDLRN

SEQ ID NO: 838510 - protein, 9 aa, Homo Sapiens
GLLITTSLL

SEQ ID NO: 838511 - protein, 9 aa, Homo Sapiens
IQLLNSSGE

SEQ ID NO: 838512 - protein, 9 aa, Homo Sapiens
HNQQGSMSP

SEQ ID NO: 838513 - protein, 9 aa, Homo Sapiens
QQHYYGKKH

SEQ ID NO: 838514 - protein, 9 aa, Homo Sapiens
MTPVKNYQV

SEQ ID NO: 838515 - protein, 9 aa, Homo Sapiens
YYCKAENSL

SEQ ID NO: 838516 - protein, 9 aa, Homo Sapiens
YVGMKTRSP

SEQ ID NO: 838517 - protein, 9 aa, Homo Sapiens
LCTVEYVRQ

SEQ ID NO: 838518 - protein, 9 aa, Homo Sapiens
ALPRSSYYF

SEQ ID NO: 838519 - protein, 9 aa, Homo Sapiens
AMNYSTVEQ

SEQ ID NO: 838520 - protein, 9 aa, Homo Sapiens
KDVPKKCFP

SEQ ID NO: 838521 - protein, 9 aa, Homo Sapiens
QQKFIKEPS

SEQ ID NO: 838522 - protein, 9 aa, Homo Sapiens
QTLQEQLNE

SEQ ID NO: 838523 - protein, 9 aa, Homo Sapiens
FLVFNDNES

SEQ ID NO: 838524 - protein, 9 aa, Homo Sapiens
IVGVELPVY

SEQ ID NO: 838525 - protein, 9 aa, Homo Sapiens
SDLQKEVEN

SEQ ID NO: 838526 - protein, 9 aa, Homo Sapiens
MKISFALTF

SEQ ID NO: 838527 - protein, 9 aa, Homo Sapiens
AQQISDAIY

SEQ ID NO: 838528 - protein, 9 aa, Homo Sapiens
ILEPLILKH

SEQ ID NO: 838529 - protein, 9 aa, Homo Sapiens
HQRKSMEAS

SEQ ID NO: 838530 - protein, 9 aa, Homo Sapiens
PCFYDIDID

SEQ ID NO: 838531 - protein, 9 aa, Homo Sapiens
YLRLHEITH

SEQ ID NO: 838532 - protein, 9 aa, Homo Sapiens
IIPQSLDLL

SEQ ID NO: 838533 - protein, 9 aa, Homo Sapiens
SSARRPSLD

SEQ ID NO: 838534 - protein, 9 aa, Homo Sapiens
HKNKGKNNG

SEQ ID NO: 838535 - protein, 9 aa, Homo Sapiens
DKIIHRLLE

SEQ ID NO: 838536 - protein, 9 aa, Homo Sapiens
DPLQQVLSV

SEQ ID NO: 838537 - protein, 9 aa, Homo Sapiens
GNYFTYYYI

SEQ ID NO: 838538 - protein, 9 aa, Homo Sapiens
SVLEKTYPY

SEQ ID NO: 838539 - protein, 9 aa, Homo Sapiens
QGHPEVNSL

SEQ ID NO: 838540 - protein, 9 aa, Homo Sapiens
VTMNDFNYL

SEQ ID NO: 838541 - protein, 9 aa, Homo Sapiens
RNTPNWYFH

SEQ ID NO: 838542 - protein, 9 aa, Homo Sapiens
VKTLRKRAS

SEQ ID NO: 838543 - protein, 9 aa, Homo Sapiens
LVYLIHSVI

SEQ ID NO: 838544 - protein, 9 aa, Homo Sapiens
RYNCYKVPE

SEQ ID NO: 838545 - protein, 9 aa, Homo Sapiens
QLYAMELHG

SEQ ID NO: 838546 - protein, 9 aa, Homo Sapiens
DQIYCGAGV

SEQ ID NO: 838547 - protein, 9 aa, Homo Sapiens
TLTLTRRPT

SEQ ID NO: 838548 - protein, 9 aa, Homo Sapiens
EGEEPKLDL

SEQ ID NO: 838549 - protein, 9 aa, Homo Sapiens
PGPRPPNSP

SEQ ID NO: 838550 - protein, 9 aa, Homo Sapiens
GCNKGFTGT

SEQ ID NO: 838551 - protein, 9 aa, Homo Sapiens
QPPPATREK

SEQ ID NO: 838552 - protein, 9 aa, Homo Sapiens
YVLVVHQIT

SEQ ID NO: 838553 - protein, 9 aa, Homo Sapiens
QIGIIDGEY

SEQ ID NO: 838554 - protein, 9 aa, Homo Sapiens
LCPSGHNNS

SEQ ID NO: 838555 - protein, 9 aa, Homo Sapiens
AMSSYLQND

SEQ ID NO: 838556 - protein, 9 aa, Homo Sapiens
VFSSVLSTS

SEQ ID NO: 838557 - protein, 9 aa, Homo Sapiens
ADVISVGSG

SEQ ID NO: 838558 - protein, 9 aa, Homo Sapiens
EQRKKEEHE

SEQ ID NO: 838559 - protein, 9 aa, Homo Sapiens
YYYIAGYLF

SEQ ID NO: 838560 - protein, 9 aa, Homo Sapiens
LLLVVGCVS

SEQ ID NO: 838561 - protein, 9 aa, Homo Sapiens
RWDLMDKEL

SEQ ID NO: 838562 - protein, 9 aa, Homo Sapiens
TNLKAEIHG

SEQ ID NO: 838563 - protein, 9 aa, Homo Sapiens
PKGLQRLML

SEQ ID NO: 838564 - protein, 9 aa, Homo Sapiens
QPFYQVCHE

SEQ ID NO: 838565 - protein, 9 aa, Homo Sapiens
TFAWSHESP

SEQ ID NO: 838566 - protein, 9 aa, Homo Sapiens
SGAKVMSEP

SEQ ID NO: 838567 - protein, 9 aa, Homo Sapiens
SLQFDGALN

SEQ ID NO: 838568 - protein, 9 aa, Homo Sapiens
TLTVHQRIN

SEQ ID NO: 838569 - protein, 9 aa, Homo Sapiens
PDVEKEVKQ

SEQ ID NO: 838570 - protein, 9 aa, Homo Sapiens
SSSDPKSKL

SEQ ID NO: 838571 - protein, 9 aa, Homo Sapiens
LAERTVRLT

SEQ ID NO: 838572 - protein, 9 aa, Homo Sapiens
VTVNTPKEK

SEQ ID NO: 838573 - protein, 9 aa, Homo Sapiens
YGLFRAISL

SEQ ID NO: 838574 - protein, 9 aa, Homo Sapiens
QRMNIDREF

SEQ ID NO: 838575 - protein, 9 aa, Homo Sapiens
LPSLKWILS

SEQ ID NO: 838576 - protein, 9 aa, Homo Sapiens
DLAPSCTGF

SEQ ID NO: 838577 - protein, 9 aa, Homo Sapiens
DHITKAIKL

SEQ ID NO: 838578 - protein, 9 aa, Homo Sapiens
PYLTPYTDS

SEQ ID NO: 838579 - protein, 9 aa, Homo Sapiens
EAGVNPSDH

SEQ ID NO: 838580 - protein, 9 aa, Homo Sapiens
LTRHILLPK

SEQ ID NO: 838581 - protein, 9 aa, Homo Sapiens
SLGRAEYGW

SEQ ID NO: 838582 - protein, 9 aa, Homo Sapiens
ENVKLVDCY

SEQ ID NO: 838583 - protein, 9 aa, Homo Sapiens
VLGVKGNYL

SEQ ID NO: 838584 - protein, 9 aa, Homo Sapiens
EVSRSLLEI

SEQ ID NO: 838585 - protein, 9 aa, Homo Sapiens
YRRCYLFSH

SEQ ID NO: 838586 - protein, 9 aa, Homo Sapiens
VLQNLYSFQ

SEQ ID NO: 838587 - protein, 9 aa, Homo Sapiens
NRVAAQISR

SEQ ID NO: 838588 - protein, 9 aa, Homo Sapiens
TLQADFNKT

SEQ ID NO: 838589 - protein, 9 aa, Homo Sapiens
IGALILATN

SEQ ID NO: 838590 - protein, 9 aa, Homo Sapiens
AEYVIRHGA

SEQ ID NO: 838591 - protein, 9 aa, Homo Sapiens
DCLRFLQPY

SEQ ID NO: 838592 - protein, 9 aa, Homo Sapiens
SYRLGVHTN

SEQ ID NO: 838593 - protein, 9 aa, Homo Sapiens
PFITYSFIL

SEQ ID NO: 838594 - protein, 9 aa, Homo Sapiens
ASGEMWRQT

SEQ ID NO: 838595 - protein, 9 aa, Homo Sapiens
HQVPKLQPQ

SEQ ID NO: 838596 - protein, 9 aa, Homo Sapiens
TFKFKAESN

SEQ ID NO: 838597 - protein, 9 aa, Homo Sapiens
LATKNLHVI

SEQ ID NO: 838598 - protein, 9 aa, Homo Sapiens
LARHWIIHT

SEQ ID NO: 838599 - protein, 9 aa, Homo Sapiens
SSPEKNKVP

SEQ ID NO: 838600 - protein, 9 aa, Homo Sapiens
NLEEIKDIL

SEQ ID NO: 838601 - protein, 9 aa, Homo Sapiens
TILQKSQKP

SEQ ID NO: 838602 - protein, 9 aa, Homo Sapiens
ANTNQHIKI

SEQ ID NO: 838603 - protein, 9 aa, Homo Sapiens
AYVALYRAR

SEQ ID NO: 838604 - protein, 9 aa, Homo Sapiens
SVLRDQCNT

SEQ ID NO: 838605 - protein, 9 aa, Homo Sapiens
QGAVAVTML

SEQ ID NO: 838606 - protein, 9 aa, Homo Sapiens
NIFAIKYWA

SEQ ID NO: 838607 - protein, 9 aa, Homo Sapiens
YQNEKNVSI

SEQ ID NO: 838608 - protein, 9 aa, Homo Sapiens
SLYDLDIEA

SEQ ID NO: 838609 - protein, 9 aa, Homo Sapiens
KQDKIKTNI

SEQ ID NO: 838610 - protein, 9 aa, Homo Sapiens
FAELDQFMK

SEQ ID NO: 838611 - protein, 9 aa, Homo Sapiens
ALTQLVKED

SEQ ID NO: 838612 - protein, 9 aa, Homo Sapiens
VGLIDGSFK

SEQ ID NO: 838613 - protein, 9 aa, Homo Sapiens
NKKEKGNGM

SEQ ID NO: 838614 - protein, 9 aa, Homo Sapiens
SSVDDEIEE

SEQ ID NO: 838615 - protein, 9 aa, Homo Sapiens
VSQQRAEEL

SEQ ID NO: 838616 - protein, 9 aa, Homo Sapiens
SSKSRTAEK

SEQ ID NO: 838617 - protein, 9 aa, Homo Sapiens
VQYHYFKGY

SEQ ID NO: 838618 - protein, 9 aa, Homo Sapiens
KTLFERQMQ

SEQ ID NO: 838619 - protein, 9 aa, Homo Sapiens
KLSRSPLKV

SEQ ID NO: 838620 - protein, 9 aa, Homo Sapiens
DKFDISDNA

SEQ ID NO: 838621 - protein, 9 aa, Homo Sapiens
TKKEKCEYK

SEQ ID NO: 838622 - protein, 9 aa, Homo Sapiens
SWDKAHVKC

SEQ ID NO: 838623 - protein, 9 aa, Homo Sapiens
MSHQNSRTN

SEQ ID NO: 838624 - protein, 9 aa, Homo Sapiens
TPGLYMGRP

SEQ ID NO: 838625 - protein, 9 aa, Homo Sapiens
QQEEMHHLQ

SEQ ID NO: 838626 - protein, 9 aa, Homo Sapiens
ASEFGLNIS

SEQ ID NO: 838627 - protein, 9 aa, Homo Sapiens
AEDKREGYE

SEQ ID NO: 838628 - protein, 9 aa, Homo Sapiens
LRLKEHIAR

SEQ ID NO: 838629 - protein, 9 aa, Homo Sapiens
LDILPRLQQ

SEQ ID NO: 838630 - protein, 9 aa, Homo Sapiens
QWAINMKKL

SEQ ID NO: 838631 - protein, 9 aa, Homo Sapiens
DVHAELDKI

SEQ ID NO: 838632 - protein, 9 aa, Homo Sapiens
THKNLCSLK

SEQ ID NO: 838633 - protein, 9 aa, Homo Sapiens
ADKPYKCEE

SEQ ID NO: 838634 - protein, 9 aa, Homo Sapiens
KMVCKAPIK

SEQ ID NO: 838635 - protein, 9 aa, Homo Sapiens
ENRISTFKR

SEQ ID NO: 838636 - protein, 9 aa, Homo Sapiens
DKVQDEAQT

SEQ ID NO: 838637 - protein, 9 aa, Homo Sapiens
LGLAVKHDL

SEQ ID NO: 838638 - protein, 9 aa, Homo Sapiens
ASAVPCTQE

SEQ ID NO: 838639 - protein, 9 aa, Homo Sapiens
KEAMEERKK

SEQ ID NO: 838640 - protein, 9 aa, Homo Sapiens
LHYELLEDK

SEQ ID NO: 838641 - protein, 9 aa, Homo Sapiens
INKDLTSRL

SEQ ID NO: 838642 - protein, 9 aa, Homo Sapiens
GKIIFEDGN

SEQ ID NO: 838643 - protein, 9 aa, Homo Sapiens
LIWKKHLFE

SEQ ID NO: 838644 - protein, 9 aa, Homo Sapiens
AHLGANEVL

SEQ ID NO: 838645 - protein, 9 aa, Homo Sapiens
KAAARYVTL

SEQ ID NO: 838646 - protein, 9 aa, Homo Sapiens
YKIKFYFNR

SEQ ID NO: 838647 - protein, 9 aa, Homo Sapiens
IKGQTYEKR

SEQ ID NO: 838648 - protein, 9 aa, Homo Sapiens
KDTKDRDSS

SEQ ID NO: 838649 - protein, 9 aa, Homo Sapiens
ENVEVKLVD

SEQ ID NO: 838650 - protein, 9 aa, Homo Sapiens
NNNKFVPYR

SEQ ID NO: 838651 - protein, 9 aa, Homo Sapiens
YQRGLDIEE

SEQ ID NO: 838652 - protein, 9 aa, Homo Sapiens
PVNKKNTWR

SEQ ID NO: 838653 - protein, 9 aa, Homo Sapiens
EIIEWIDYA

SEQ ID NO: 838654 - protein, 9 aa, Homo Sapiens
KLSSTPFPF

SEQ ID NO: 838655 - protein, 9 aa, Homo Sapiens
INKDAGLFR

SEQ ID NO: 838656 - protein, 9 aa, Homo Sapiens
DRPDIKVAT

SEQ ID NO: 838657 - protein, 9 aa, Homo Sapiens
SPYYCYGGY

SEQ ID NO: 838658 - protein, 9 aa, Homo Sapiens
QQDGELHDF

SEQ ID NO: 838659 - protein, 9 aa, Homo Sapiens
HRECDEGRK

SEQ ID NO: 838660 - protein, 9 aa, Homo Sapiens
DVKGMEDEG

SEQ ID NO: 838661 - protein, 9 aa, Homo Sapiens
KKAPEKTID

SEQ ID NO: 838662 - protein, 9 aa, Homo Sapiens
NSKPDSVLK

SEQ ID NO: 838663 - protein, 9 aa, Homo Sapiens
DLQTLLNET

SEQ ID NO: 838664 - protein, 9 aa, Homo Sapiens
ENMPLSHSI

SEQ ID NO: 838665 - protein, 9 aa, Homo Sapiens
RKTDFDEEP

SEQ ID NO: 838666 - protein, 9 aa, Homo Sapiens
MNVNIPENI

SEQ ID NO: 838667 - protein, 9 aa, Homo Sapiens
PDCGYAVIS

SEQ ID NO: 838668 - protein, 9 aa, Homo Sapiens
TIKSPSKLS

SEQ ID NO: 838669 - protein, 9 aa, Homo Sapiens
FTQQDINEA

SEQ ID NO: 838670 - protein, 9 aa, Homo Sapiens
NSQLQMPGG

SEQ ID NO: 838671 - protein, 9 aa, Homo Sapiens
EGHRLNNSE

SEQ ID NO: 838672 - protein, 9 aa, Homo Sapiens
DVDHCCKTN

SEQ ID NO: 838673 - protein, 9 aa, Homo Sapiens
QIDNFRRNS

SEQ ID NO: 838674 - protein, 9 aa, Homo Sapiens
EWRGEGKAP

SEQ ID NO: 838675 - protein, 9 aa, Homo Sapiens
KAFIYSNSI

SEQ ID NO: 838676 - protein, 9 aa, Homo Sapiens
YYFSCHVEK

SEQ ID NO: 838677 - protein, 9 aa, Homo Sapiens
KKELFNVRP

SEQ ID NO: 838678 - protein, 9 aa, Homo Sapiens
LYQNRSNLE

SEQ ID NO: 838679 - protein, 9 aa, Homo Sapiens
RKIMTSQDC

SEQ ID NO: 838680 - protein, 9 aa, Homo Sapiens
YYHIIIPVL

SEQ ID NO: 838681 - protein, 9 aa, Homo Sapiens
YRTAEELDN

SEQ ID NO: 838682 - protein, 9 aa, Homo Sapiens
SSPAKNLFK

SEQ ID NO: 838683 - protein, 9 aa, Homo Sapiens
WHVLSREEQ

SEQ ID NO: 838684 - protein, 9 aa, Homo Sapiens
KCMIYELFT

SEQ ID NO: 838685 - protein, 9 aa, Homo Sapiens
LLNTKDKHL

SEQ ID NO: 838686 - protein, 9 aa, Homo Sapiens
DDIPQGKRK

SEQ ID NO: 838687 - protein, 9 aa, Homo Sapiens
SAVVFGGFS

SEQ ID NO: 838688 - protein, 9 aa, Homo Sapiens
SYSLGRDQA

SEQ ID NO: 838689 - protein, 9 aa, Homo Sapiens
SEPTSFKHG

SEQ ID NO: 838690 - protein, 9 aa, Homo Sapiens
KYGQLGTGD

SEQ ID NO: 838691 - protein, 9 aa, Homo Sapiens
KLFYLGAGD

SEQ ID NO: 838692 - protein, 9 aa, Homo Sapiens
VDNLYAETA

SEQ ID NO: 838693 - protein, 9 aa, Homo Sapiens
MNTGKAESR

SEQ ID NO: 838694 - protein, 9 aa, Homo Sapiens
NMTAVVRLN

SEQ ID NO: 838695 - protein, 9 aa, Homo Sapiens
TNCSRNGGW

SEQ ID NO: 838696 - protein, 9 aa, Homo Sapiens
SDIRLVRWL

SEQ ID NO: 838697 - protein, 9 aa, Homo Sapiens
LTPQSVLLE

SEQ ID NO: 838698 - protein, 9 aa, Homo Sapiens
SQEVMGLFT

SEQ ID NO: 838699 - protein, 9 aa, Homo Sapiens
ALGRLGLVD

SEQ ID NO: 838700 - protein, 9 aa, Homo Sapiens
KHSTSNHQL

SEQ ID NO: 838701 - protein, 9 aa, Homo Sapiens
NRGQRSSPL

SEQ ID NO: 838702 - protein, 9 aa, Homo Sapiens
KDLMPKAEK

SEQ ID NO: 838703 - protein, 9 aa, Homo Sapiens
EYTEFIDKF

SEQ ID NO: 838704 - protein, 9 aa, Homo Sapiens
VASLHVRQN

SEQ ID NO: 838705 - protein, 9 aa, Homo Sapiens
FFKIIRNED

SEQ ID NO: 838706 - protein, 9 aa, Homo Sapiens
RPEAWSDAL

SEQ ID NO: 838707 - protein, 9 aa, Homo Sapiens
FPFLQLYYS

SEQ ID NO: 838708 - protein, 9 aa, Homo Sapiens
DSYNRARED

SEQ ID NO: 838709 - protein, 9 aa, Homo Sapiens
GTWSWEWYL

SEQ ID NO: 838710 - protein, 9 aa, Homo Sapiens
MEMDAIQAK

SEQ ID NO: 838711 - protein, 9 aa, Homo Sapiens
SEKSICITA

SEQ ID NO: 838712 - protein, 9 aa, Homo Sapiens
CPPNGKSFC

SEQ ID NO: 838713 - protein, 9 aa, Homo Sapiens
LGDCYKFYL

SEQ ID NO: 838714 - protein, 9 aa, Homo Sapiens
SANEMIEAA

SEQ ID NO: 838715 - protein, 9 aa, Homo Sapiens
AINNLWVDP

SEQ ID NO: 838716 - protein, 9 aa, Homo Sapiens
ARPKLWKSF

SEQ ID NO: 838717 - protein, 9 aa, Homo Sapiens
NKELSADQM

SEQ ID NO: 838718 - protein, 9 aa, Homo Sapiens
FCEKSFHQL

SEQ ID NO: 838719 - protein, 9 aa, Homo Sapiens
RVNARVCIS

SEQ ID NO: 838720 - protein, 9 aa, Homo Sapiens
YPEVFVLLG

SEQ ID NO: 838721 - protein, 9 aa, Homo Sapiens
RSSLPCHRI

SEQ ID NO: 838722 - protein, 9 aa, Homo Sapiens
TKCVVVGDN

SEQ ID NO: 838723 - protein, 9 aa, Homo Sapiens
RILPCRHLL

SEQ ID NO: 838724 - protein, 9 aa, Homo Sapiens
NMALGLMRG

SEQ ID NO: 838725 - protein, 9 aa, Homo Sapiens
AARYVTLEN

SEQ ID NO: 838726 - protein, 9 aa, Homo Sapiens
YFTVGTFVV

SEQ ID NO: 838727 - protein, 9 aa, Homo Sapiens
NDDLFMMPQ

SEQ ID NO: 838728 - protein, 9 aa, Homo Sapiens
SRLAHRTCL

SEQ ID NO: 838729 - protein, 9 aa, Homo Sapiens
LSPTYPVYR

SEQ ID NO: 838730 - protein, 9 aa, Homo Sapiens
EAGGNTTAG

SEQ ID NO: 838731 - protein, 9 aa, Homo Sapiens
VPALRESSA

SEQ ID NO: 838732 - protein, 9 aa, Homo Sapiens
DAFVSGSDD

SEQ ID NO: 838733 - protein, 9 aa, Homo Sapiens
DLTDDNINP

SEQ ID NO: 838734 - protein, 9 aa, Homo Sapiens
PLLNAGGEK

SEQ ID NO: 838735 - protein, 9 aa, Homo Sapiens
LKGKNQLLE

SEQ ID NO: 838736 - protein, 9 aa, Homo Sapiens
VLANQSLRY

SEQ ID NO: 838737 - protein, 9 aa, Homo Sapiens
SVSQTNIQH

SEQ ID NO: 838738 - protein, 9 aa, Homo Sapiens
GYPNDTVYL

SEQ ID NO: 838739 - protein, 9 aa, Homo Sapiens
LVDYILLKG

SEQ ID NO: 838740 - protein, 9 aa, Homo Sapiens
RYSLTLCQA

SEQ ID NO: 838741 - protein, 9 aa, Homo Sapiens
VIMEKSTMV

SEQ ID NO: 838742 - protein, 9 aa, Homo Sapiens
VVRVNARVC

SEQ ID NO: 838743 - protein, 9 aa, Homo Sapiens
YNKQSLHES

SEQ ID NO: 838744 - protein, 9 aa, Homo Sapiens
FKTKFLSQI

SEQ ID NO: 838745 - protein, 9 aa, Homo Sapiens
ESLTNFHEE

SEQ ID NO: 838746 - protein, 9 aa, Homo Sapiens
QHYYGKKHK

SEQ ID NO: 838747 - protein, 9 aa, Homo Sapiens
GSRDLSRHE

SEQ ID NO: 838748 - protein, 9 aa, Homo Sapiens
ELYPPLIHL

SEQ ID NO: 838749 - protein, 9 aa, Homo Sapiens
VCFYNDLES

SEQ ID NO: 838750 - protein, 9 aa, Homo Sapiens
HEFIMFTVD

SEQ ID NO: 838751 - protein, 9 aa, Homo Sapiens
LSNSFQTLN

SEQ ID NO: 838752 - protein, 9 aa, Homo Sapiens
QSDTVYHNS

SEQ ID NO: 838753 - protein, 9 aa, Homo Sapiens
AIQYGEYLE

SEQ ID NO: 838754 - protein, 9 aa, Homo Sapiens
SYSDESEDG

SEQ ID NO: 838755 - protein, 9 aa, Homo Sapiens
TRTMFGEFI

SEQ ID NO: 838756 - protein, 9 aa, Homo Sapiens
KKRRQAKLE

SEQ ID NO: 838757 - protein, 9 aa, Homo Sapiens
LQPEWGSPK

SEQ ID NO: 838758 - protein, 9 aa, Homo Sapiens
NVEDSNRGK

SEQ ID NO: 838759 - protein, 9 aa, Homo Sapiens
MELTMNKNT

SEQ ID NO: 838760 - protein, 9 aa, Homo Sapiens
GFSPRSYLF

SEQ ID NO: 838761 - protein, 9 aa, Homo Sapiens
DNVTPADEA

SEQ ID NO: 838762 - protein, 9 aa, Homo Sapiens
TFVPINSVN

SEQ ID NO: 838763 - protein, 9 aa, Homo Sapiens
IKDRRHHPK

SEQ ID NO: 838764 - protein, 9 aa, Homo Sapiens
SEEKRAKLH

SEQ ID NO: 838765 - protein, 9 aa, Homo Sapiens
MHTPVEEKI

SEQ ID NO: 838766 - protein, 9 aa, Homo Sapiens
NDLKVVSVE

SEQ ID NO: 838767 - protein, 9 aa, Homo Sapiens
MPSPRILNT

SEQ ID NO: 838768 - protein, 9 aa, Homo Sapiens
GGRWVEHRG

SEQ ID NO: 838769 - protein, 9 aa, Homo Sapiens
SSVQHPLGM

SEQ ID NO: 838770 - protein, 9 aa, Homo Sapiens
QYYGQQAWV

SEQ ID NO: 838771 - protein, 9 aa, Homo Sapiens
DNILGLNLP

SEQ ID NO: 838772 - protein, 9 aa, Homo Sapiens
SQSSDPEEE

SEQ ID NO: 838773 - protein, 9 aa, Homo Sapiens
YVFGRVMQI

SEQ ID NO: 838774 - protein, 9 aa, Homo Sapiens
AVMGINLCD

SEQ ID NO: 838775 - protein, 9 aa, Homo Sapiens
LWGQHFVPI

SEQ ID NO: 838776 - protein, 9 aa, Homo Sapiens
SVECYNSRE

SEQ ID NO: 838777 - protein, 9 aa, Homo Sapiens
GNQESDQSD

SEQ ID NO: 838778 - protein, 9 aa, Homo Sapiens
ACEMLLQFN

SEQ ID NO: 838779 - protein, 9 aa, Homo Sapiens
DSNLQNIIR

SEQ ID NO: 838780 - protein, 9 aa, Homo Sapiens
IEKVKDATQ

SEQ ID NO: 838781 - protein, 9 aa, Homo Sapiens
LACFLLLQS

SEQ ID NO: 838782 - protein, 9 aa, Homo Sapiens
LEEHNLAKY

SEQ ID NO: 838783 - protein, 9 aa, Homo Sapiens
RILYLNEKG

SEQ ID NO: 838784 - protein, 9 aa, Homo Sapiens
GRGTKKDEM

SEQ ID NO: 838785 - protein, 9 aa, Homo Sapiens
PAKAFKRCV

SEQ ID NO: 838786 - protein, 9 aa, Homo Sapiens
DEELSCSAR

SEQ ID NO: 838787 - protein, 9 aa, Homo Sapiens
GKTTQEDHM

SEQ ID NO: 838788 - protein, 9 aa, Homo Sapiens
ASNKPVTIK

SEQ ID NO: 838789 - protein, 9 aa, Homo Sapiens
RPVIVHQAI

SEQ ID NO: 838790 - protein, 9 aa, Homo Sapiens
CADCGEAFR

SEQ ID NO: 838791 - protein, 9 aa, Homo Sapiens
EIWLRKALD

SEQ ID NO: 838792 - protein, 9 aa, Homo Sapiens
VAPSRLDLT

SEQ ID NO: 838793 - protein, 9 aa, Homo Sapiens
LIEQSNLRA

SEQ ID NO: 838794 - protein, 9 aa, Homo Sapiens
HIWQKNLTV

SEQ ID NO: 838795 - protein, 9 aa, Homo Sapiens
QVNLTAHEV

SEQ ID NO: 838796 - protein, 9 aa, Homo Sapiens
GLMAALCPR

SEQ ID NO: 838797 - protein, 9 aa, Homo Sapiens
DLGNVIRSE

SEQ ID NO: 838798 - protein, 9 aa, Homo Sapiens
DDSNYVLQL

SEQ ID NO: 838799 - protein, 9 aa, Homo Sapiens
AKDTTKNET

SEQ ID NO: 838800 - protein, 9 aa, Homo Sapiens
RSRGVLLGR

SEQ ID NO: 838801 - protein, 9 aa, Homo Sapiens
CLDKLLHYQ

SEQ ID NO: 838802 - protein, 9 aa, Homo Sapiens
EPLQTVEIE

SEQ ID NO: 838803 - protein, 9 aa, Homo Sapiens
TQIKTYYWD

SEQ ID NO: 838804 - protein, 9 aa, Homo Sapiens
YPVLIIEAH

SEQ ID NO: 838805 - protein, 9 aa, Homo Sapiens
IDLVCNAMR

SEQ ID NO: 838806 - protein, 9 aa, Homo Sapiens
EKDKRQQGK

SEQ ID NO: 838807 - protein, 9 aa, Homo Sapiens
SQYCGCLEY

SEQ ID NO: 838808 - protein, 9 aa, Homo Sapiens
EVKQLLSTD

SEQ ID NO: 838809 - protein, 9 aa, Homo Sapiens
QNLKRNYSY

SEQ ID NO: 838810 - protein, 9 aa, Homo Sapiens
EGAPQISLA

SEQ ID NO: 838811 - protein, 9 aa, Homo Sapiens
DGKKAHHDF

SEQ ID NO: 838812 - protein, 9 aa, Homo Sapiens
PRAGNTGGL

SEQ ID NO: 838813 - protein, 9 aa, Homo Sapiens
CNSILREML

SEQ ID NO: 838814 - protein, 9 aa, Homo Sapiens
GEIILAIQS

SEQ ID NO: 838815 - protein, 9 aa, Homo Sapiens
IPTPNPLAT

SEQ ID NO: 838816 - protein, 9 aa, Homo Sapiens
FQRARKKPQ

SEQ ID NO: 838817 - protein, 9 aa, Homo Sapiens
AVQYLKKQP

SEQ ID NO: 838818 - protein, 9 aa, Homo Sapiens
VKAGRGTVM

SEQ ID NO: 838819 - protein, 9 aa, Homo Sapiens
SQTRCAPFL

SEQ ID NO: 838820 - protein, 9 aa, Homo Sapiens
DIIRNFCKY

SEQ ID NO: 838821 - protein, 9 aa, Homo Sapiens
KCTLIHKPH

SEQ ID NO: 838822 - protein, 9 aa, Homo Sapiens
ERNKNVAEI

SEQ ID NO: 838823 - protein, 9 aa, Homo Sapiens
PLAVYSKNR

SEQ ID NO: 838824 - protein, 9 aa, Homo Sapiens
GDLQWLKLI

SEQ ID NO: 838825 - protein, 9 aa, Homo Sapiens
YFMFTEKTL

SEQ ID NO: 838826 - protein, 9 aa, Homo Sapiens
QPVVVVVIV

SEQ ID NO: 838827 - protein, 9 aa, Homo Sapiens
NISCYLNEL

SEQ ID NO: 838828 - protein, 9 aa, Homo Sapiens
PHKRYVLLF

SEQ ID NO: 838829 - protein, 9 aa, Homo Sapiens
HKSSAIDTS

SEQ ID NO: 838830 - protein, 9 aa, Homo Sapiens
EIILALMFL

SEQ ID NO: 838831 - protein, 9 aa, Homo Sapiens
YIEETLWGA

SEQ ID NO: 838832 - protein, 9 aa, Homo Sapiens
ANSSFKPVK

SEQ ID NO: 838833 - protein, 9 aa, Homo Sapiens
DEYDGGYGG

SEQ ID NO: 838834 - protein, 9 aa, Homo Sapiens
SEFWSKPFN

SEQ ID NO: 838835 - protein, 9 aa, Homo Sapiens
GTGEALIHL

SEQ ID NO: 838836 - protein, 9 aa, Homo Sapiens
CLQTIHFSP

SEQ ID NO: 838837 - protein, 9 aa, Homo Sapiens
KELGFESDT

SEQ ID NO: 838838 - protein, 9 aa, Homo Sapiens
ESSKGTNNE

SEQ ID NO: 838839 - protein, 9 aa, Homo Sapiens
RYFCGRCIR

SEQ ID NO: 838840 - protein, 9 aa, Homo Sapiens
QHALRNEKP

SEQ ID NO: 838841 - protein, 9 aa, Homo Sapiens
APQDSHGCC

SEQ ID NO: 838842 - protein, 9 aa, Homo Sapiens
GFYQIRGEI

SEQ ID NO: 838843 - protein, 9 aa, Homo Sapiens
LCLLLGWLH

SEQ ID NO: 838844 - protein, 9 aa, Homo Sapiens
AESPSRTVA

SEQ ID NO: 838845 - protein, 9 aa, Homo Sapiens
KDRELIHKV

SEQ ID NO: 838846 - protein, 9 aa, Homo Sapiens
ASPTYDLSK

SEQ ID NO: 838847 - protein, 9 aa, Homo Sapiens
FRDQVLHEH

SEQ ID NO: 838848 - protein, 9 aa, Homo Sapiens
VTVVSTVMM

SEQ ID NO: 838849 - protein, 9 aa, Homo Sapiens
PLHYAACFG

SEQ ID NO: 838850 - protein, 9 aa, Homo Sapiens
RIALASRSH

SEQ ID NO: 838851 - protein, 9 aa, Homo Sapiens
CHLLTVHGR

SEQ ID NO: 838852 - protein, 9 aa, Homo Sapiens
HKSLREWKL

SEQ ID NO: 838853 - protein, 9 aa, Homo Sapiens
FPKMSVPMR

SEQ ID NO: 838854 - protein, 9 aa, Homo Sapiens
RDFVSILPV

SEQ ID NO: 838855 - protein, 9 aa, Homo Sapiens
EVSHNFQTT

SEQ ID NO: 838856 - protein, 9 aa, Homo Sapiens
YDYAKNILS

SEQ ID NO: 838857 - protein, 9 aa, Homo Sapiens
TPKRQTAVT

SEQ ID NO: 838858 - protein, 9 aa, Homo Sapiens
TDEDKLFVE

SEQ ID NO: 838859 - protein, 9 aa, Homo Sapiens
LAFTDSRIT

SEQ ID NO: 838860 - protein, 9 aa, Homo Sapiens
VDVVPINNQ

SEQ ID NO: 838861 - protein, 9 aa, Homo Sapiens
YDELHNSSG

SEQ ID NO: 838862 - protein, 9 aa, Homo Sapiens
NRAFSICFT

SEQ ID NO: 838863 - protein, 9 aa, Homo Sapiens
AMKEIMYGT

SEQ ID NO: 838864 - protein, 9 aa, Homo Sapiens
FQSLAGLEV

SEQ ID NO: 838865 - protein, 9 aa, Homo Sapiens
QGDTPLHWA

SEQ ID NO: 838866 - protein, 9 aa, Homo Sapiens
HVQDSGKLQ

SEQ ID NO: 838867 - protein, 9 aa, Homo Sapiens
LKQDEQRNS

SEQ ID NO: 838868 - protein, 9 aa, Homo Sapiens
IQNLKRNYS

SEQ ID NO: 838869 - protein, 9 aa, Homo Sapiens
DTNHARERL

SEQ ID NO: 838870 - protein, 9 aa, Homo Sapiens
LSRTTASTP

SEQ ID NO: 838871 - protein, 9 aa, Homo Sapiens
KVYASQQMR

SEQ ID NO: 838872 - protein, 9 aa, Homo Sapiens
RKNQTTKIF

SEQ ID NO: 838873 - protein, 9 aa, Homo Sapiens
DKLTKPELF

SEQ ID NO: 838874 - protein, 9 aa, Homo Sapiens
SIANMINKT

SEQ ID NO: 838875 - protein, 9 aa, Homo Sapiens
FHSILSIKS

SEQ ID NO: 838876 - protein, 9 aa, Homo Sapiens
AACFGEISI

SEQ ID NO: 838877 - protein, 9 aa, Homo Sapiens
LIYFGAVLG

SEQ ID NO: 838878 - protein, 9 aa, Homo Sapiens
PLLPVRGFG

SEQ ID NO: 838879 - protein, 9 aa, Homo Sapiens
NELEKFPLN

SEQ ID NO: 838880 - protein, 9 aa, Homo Sapiens
GVGVFLRDF

SEQ ID NO: 838881 - protein, 9 aa, Homo Sapiens
KEDQYIKMT

SEQ ID NO: 838882 - protein, 9 aa, Homo Sapiens
AVNTILRNH

SEQ ID NO: 838883 - protein, 9 aa, Homo Sapiens
VNPIIYGLF

SEQ ID NO: 838884 - protein, 9 aa, Homo Sapiens
RPQPGHENF

SEQ ID NO: 838885 - protein, 9 aa, Homo Sapiens
RKILGTNEE

SEQ ID NO: 838886 - protein, 9 aa, Homo Sapiens
KLTNNKGVS

SEQ ID NO: 838887 - protein, 9 aa, Homo Sapiens
NGDGDITLV

SEQ ID NO: 838888 - protein, 9 aa, Homo Sapiens
AVTMLLGVF

SEQ ID NO: 838889 - protein, 9 aa, Homo Sapiens
IGRQIYHHV

SEQ ID NO: 838890 - protein, 9 aa, Homo Sapiens
YTLIQTDTS

SEQ ID NO: 838891 - protein, 9 aa, Homo Sapiens
KFISGTPQR

SEQ ID NO: 838892 - protein, 9 aa, Homo Sapiens
DTLQTGGDP

SEQ ID NO: 838893 - protein, 9 aa, Homo Sapiens
TVLLNTKDK

SEQ ID NO: 838894 - protein, 9 aa, Homo Sapiens
KQLSEHQII

SEQ ID NO: 838895 - protein, 9 aa, Homo Sapiens
DEAVLRCFI

SEQ ID NO: 838896 - protein, 9 aa, Homo Sapiens
YDVDANQII

SEQ ID NO: 838897 - protein, 9 aa, Homo Sapiens
RRPYILKID

SEQ ID NO: 838898 - protein, 9 aa, Homo Sapiens
GTLTPRDHH

SEQ ID NO: 838899 - protein, 9 aa, Homo Sapiens
REVQGVREL

SEQ ID NO: 838900 - protein, 9 aa, Homo Sapiens
YTCKECGKL

SEQ ID NO: 838901 - protein, 9 aa, Homo Sapiens
DPGSSTDNP

SEQ ID NO: 838902 - protein, 9 aa, Homo Sapiens
TWKVISSLE

SEQ ID NO: 838903 - protein, 9 aa, Homo Sapiens
SLGALCFVC

SEQ ID NO: 838904 - protein, 9 aa, Homo Sapiens
GGNTTENIN

SEQ ID NO: 838905 - protein, 9 aa, Homo Sapiens
WGRLSIKGH

SEQ ID NO: 838906 - protein, 9 aa, Homo Sapiens
RLGRNKKRR

SEQ ID NO: 838907 - protein, 9 aa, Homo Sapiens
PAPVIPPAA

SEQ ID NO: 838908 - protein, 9 aa, Homo Sapiens
KRDLDAQAK

SEQ ID NO: 838909 - protein, 9 aa, Homo Sapiens
KDNFKNALT

SEQ ID NO: 838910 - protein, 9 aa, Homo Sapiens
RGHLAKAQR

SEQ ID NO: 838911 - protein, 9 aa, Homo Sapiens
MEVPGADGC

SEQ ID NO: 838912 - protein, 9 aa, Homo Sapiens
LPATSFSNL

SEQ ID NO: 838913 - protein, 9 aa, Homo Sapiens
ALGLLDGVR

SEQ ID NO: 838914 - protein, 9 aa, Homo Sapiens
ADKIDFTTG

SEQ ID NO: 838915 - protein, 9 aa, Homo Sapiens
GLMELGTVE

SEQ ID NO: 838916 - protein, 9 aa, Homo Sapiens
WLFTKTEEL

SEQ ID NO: 838917 - protein, 9 aa, Homo Sapiens
AHKLYFPER

SEQ ID NO: 838918 - protein, 9 aa, Homo Sapiens
KFLKRADNS

SEQ ID NO: 838919 - protein, 9 aa, Homo Sapiens
QLCIVLGYL

SEQ ID NO: 838920 - protein, 9 aa, Homo Sapiens
VSLIIHQGA

SEQ ID NO: 838921 - protein, 9 aa, Homo Sapiens
EKSLEKARK

SEQ ID NO: 838922 - protein, 9 aa, Homo Sapiens
LKVESEEHD

SEQ ID NO: 838923 - protein, 9 aa, Homo Sapiens
VAGLALIKT

SEQ ID NO: 838924 - protein, 9 aa, Homo Sapiens
ENLKKFLKP

SEQ ID NO: 838925 - protein, 9 aa, Homo Sapiens
RDQAASVFY

SEQ ID NO: 838926 - protein, 9 aa, Homo Sapiens
SRPNAIIVI

SEQ ID NO: 838927 - protein, 9 aa, Homo Sapiens
ERYFLQRPG

SEQ ID NO: 838928 - protein, 9 aa, Homo Sapiens
HSSDFVKDS

SEQ ID NO: 838929 - protein, 9 aa, Homo Sapiens
LQAYVTPII

SEQ ID NO: 838930 - protein, 9 aa, Homo Sapiens
TFNALPRSI

SEQ ID NO: 838931 - protein, 9 aa, Homo Sapiens
RRERQQANL

SEQ ID NO: 838932 - protein, 9 aa, Homo Sapiens
AEITKEQLF

SEQ ID NO: 838933 - protein, 9 aa, Homo Sapiens
RAVLNFLCC

SEQ ID NO: 838934 - protein, 9 aa, Homo Sapiens
VFPINPPKY

SEQ ID NO: 838935 - protein, 9 aa, Homo Sapiens
SLHLEIRDL

SEQ ID NO: 838936 - protein, 9 aa, Homo Sapiens
SYNISYFTQ

SEQ ID NO: 838937 - protein, 9 aa, Homo Sapiens
SLAEILLSH

SEQ ID NO: 838938 - protein, 9 aa, Homo Sapiens
CNSGLKQNV

SEQ ID NO: 838939 - protein, 9 aa, Homo Sapiens
VLLFVPCIF

SEQ ID NO: 838940 - protein, 9 aa, Homo Sapiens
ESFTEEQLH

SEQ ID NO: 838941 - protein, 9 aa, Homo Sapiens
NGRCHVVRK

SEQ ID NO: 838942 - protein, 9 aa, Homo Sapiens
VQTSLAMQW

SEQ ID NO: 838943 - protein, 9 aa, Homo Sapiens
CNFCEKSFH

SEQ ID NO: 838944 - protein, 9 aa, Homo Sapiens
NRPLIKPKQ

SEQ ID NO: 838945 - protein, 9 aa, Homo Sapiens
QAYVTPIIQ

SEQ ID NO: 838946 - protein, 9 aa, Homo Sapiens
QAVTYAAVK

SEQ ID NO: 838947 - protein, 9 aa, Homo Sapiens
RCKKCEKAF

SEQ ID NO: 838948 - protein, 9 aa, Homo Sapiens
KDDTEKERP

SEQ ID NO: 838949 - protein, 9 aa, Homo Sapiens
IAPVRSRSK

SEQ ID NO: 838950 - protein, 9 aa, Homo Sapiens
DYKSPTLIT

SEQ ID NO: 838951 - protein, 9 aa, Homo Sapiens
DLIKVDDNK

SEQ ID NO: 838952 - protein, 9 aa, Homo Sapiens
KWVRDINLK

SEQ ID NO: 838953 - protein, 9 aa, Homo Sapiens
VWKMPETFS

SEQ ID NO: 838954 - protein, 9 aa, Homo Sapiens
GPVGAVQIG

SEQ ID NO: 838955 - protein, 9 aa, Homo Sapiens
ATRAVLCCQ

SEQ ID NO: 838956 - protein, 9 aa, Homo Sapiens
RPILKLTGP

SEQ ID NO: 838957 - protein, 9 aa, Homo Sapiens
HVVSVLEKT

SEQ ID NO: 838958 - protein, 9 aa, Homo Sapiens
IPASQPPGP

SEQ ID NO: 838959 - protein, 9 aa, Homo Sapiens
RDPKIPKST

SEQ ID NO: 838960 - protein, 9 aa, Homo Sapiens
YPSQRDEVI

SEQ ID NO: 838961 - protein, 9 aa, Homo Sapiens
MFRKDSVIN

SEQ ID NO: 838962 - protein, 9 aa, Homo Sapiens
QVCKQLIQS

SEQ ID NO: 838963 - protein, 9 aa, Homo Sapiens
KRSGKWLNT

SEQ ID NO: 838964 - protein, 9 aa, Homo Sapiens
HTRPSQRCV

SEQ ID NO: 838965 - protein, 9 aa, Homo Sapiens
LEHREKECG

SEQ ID NO: 838966 - protein, 9 aa, Homo Sapiens
SLLNNAIQG

SEQ ID NO: 838967 - protein, 9 aa, Homo Sapiens
ESEDEEEDD

SEQ ID NO: 838968 - protein, 9 aa, Homo Sapiens
LTKQLSDVC

SEQ ID NO: 838969 - protein, 9 aa, Homo Sapiens
FMHQTLGIA

SEQ ID NO: 838970 - protein, 9 aa, Homo Sapiens
KLITDLQPN

SEQ ID NO: 838971 - protein, 9 aa, Homo Sapiens
TMAPVANIF

SEQ ID NO: 838972 - protein, 9 aa, Homo Sapiens
KQSGRYSSS

SEQ ID NO: 838973 - protein, 9 aa, Homo Sapiens
LSDIGRQIY

SEQ ID NO: 838974 - protein, 9 aa, Homo Sapiens
QENLEKAFS

SEQ ID NO: 838975 - protein, 9 aa, Homo Sapiens
DTSRGASPI

SEQ ID NO: 838976 - protein, 9 aa, Homo Sapiens
ISNPYNKTI

SEQ ID NO: 838977 - protein, 9 aa, Homo Sapiens
AYYRIYVTV

SEQ ID NO: 838978 - protein, 9 aa, Homo Sapiens
GRRGWNKFY

SEQ ID NO: 838979 - protein, 9 aa, Homo Sapiens
QRQATDDAS

SEQ ID NO: 838980 - protein, 9 aa, Homo Sapiens
DTPFSGTRR

SEQ ID NO: 838981 - protein, 9 aa, Homo Sapiens
ILKLTGPKE

SEQ ID NO: 838982 - protein, 9 aa, Homo Sapiens
TMSALKRHN

SEQ ID NO: 838983 - protein, 9 aa, Homo Sapiens
FKSPVKMIR

SEQ ID NO: 838984 - protein, 9 aa, Homo Sapiens
QLASKQSMI

SEQ ID NO: 838985 - protein, 9 aa, Homo Sapiens
RHGHEYYGD

SEQ ID NO: 838986 - protein, 9 aa, Homo Sapiens
QNKDKNKKS

SEQ ID NO: 838987 - protein, 9 aa, Homo Sapiens
SEREQQLVD

SEQ ID NO: 838988 - protein, 9 aa, Homo Sapiens
QISWPLWTT

SEQ ID NO: 838989 - protein, 9 aa, Homo Sapiens
EDAGRMIQR

SEQ ID NO: 838990 - protein, 9 aa, Homo Sapiens
KLEAMMHIL

SEQ ID NO: 838991 - protein, 9 aa, Homo Sapiens
SGEICQLLG

SEQ ID NO: 838992 - protein, 9 aa, Homo Sapiens
RQKRRIYDM

SEQ ID NO: 838993 - protein, 9 aa, Homo Sapiens
LGAYSYRKF

SEQ ID NO: 838994 - protein, 9 aa, Homo Sapiens
SIFILYQNR

SEQ ID NO: 838995 - protein, 9 aa, Homo Sapiens
GPPGLPGPL

SEQ ID NO: 838996 - protein, 9 aa, Homo Sapiens
IDNRPGKLK

SEQ ID NO: 838997 - protein, 9 aa, Homo Sapiens
DKLELLKND

SEQ ID NO: 838998 - protein, 9 aa, Homo Sapiens
PLCEQGLVG

SEQ ID NO: 838999 - protein, 9 aa, Homo Sapiens
IPPKETETS

SEQ ID NO: 839000 - protein, 9 aa, Homo Sapiens
SQDSSPVRT

SEQ ID NO: 839001 - protein, 9 aa, Homo Sapiens
CLFADNVDL

SEQ ID NO: 839002 - protein, 9 aa, Homo Sapiens
MTAIISLPP

SEQ ID NO: 839003 - protein, 9 aa, Homo Sapiens
GEDKLLPGL

SEQ ID NO: 839004 - protein, 9 aa, Homo Sapiens
LLPVPPTQH

SEQ ID NO: 839005 - protein, 9 aa, Homo Sapiens
MPVTSMTIL

SEQ ID NO: 839006 - protein, 9 aa, Homo Sapiens
NVIVQFSCD

SEQ ID NO: 839007 - protein, 9 aa, Homo Sapiens
FDDVTMLFP

SEQ ID NO: 839008 - protein, 9 aa, Homo Sapiens
QNRESPPAE

SEQ ID NO: 839009 - protein, 9 aa, Homo Sapiens
EANQLNDTL

SEQ ID NO: 839010 - protein, 9 aa, Homo Sapiens
FSLHFLAQG

SEQ ID NO: 839011 - protein, 9 aa, Homo Sapiens
VLIIVFLFA

SEQ ID NO: 839012 - protein, 9 aa, Homo Sapiens
QICASYFSS

SEQ ID NO: 839013 - protein, 9 aa, Homo Sapiens
LGEIWSIFY

SEQ ID NO: 839014 - protein, 9 aa, Homo Sapiens
AGSPLSVTV

SEQ ID NO: 839015 - protein, 9 aa, Homo Sapiens
LPVNQPKEV

SEQ ID NO: 839016 - protein, 9 aa, Homo Sapiens
DTSDQTSTE

SEQ ID NO: 839017 - protein, 9 aa, Homo Sapiens
TRSSHIPPW

SEQ ID NO: 839018 - protein, 9 aa, Homo Sapiens
FLFFIRHHS

SEQ ID NO: 839019 - protein, 9 aa, Homo Sapiens
AGIYRCYYR

SEQ ID NO: 839020 - protein, 9 aa, Homo Sapiens
WDINKDAGL

SEQ ID NO: 839021 - protein, 9 aa, Homo Sapiens
LGLQRAMST

SEQ ID NO: 839022 - protein, 9 aa, Homo Sapiens
RLFHQRRHQ

SEQ ID NO: 839023 - protein, 9 aa, Homo Sapiens
SSLGSWNPT

SEQ ID NO: 839024 - protein, 9 aa, Homo Sapiens
CVELFRTTY

SEQ ID NO: 839025 - protein, 9 aa, Homo Sapiens
NLNKVKTKT

SEQ ID NO: 839026 - protein, 9 aa, Homo Sapiens
ILHDALCLA

SEQ ID NO: 839027 - protein, 9 aa, Homo Sapiens
EVKLKEIYS

SEQ ID NO: 839028 - protein, 9 aa, Homo Sapiens
SDPDSQFPA

SEQ ID NO: 839029 - protein, 9 aa, Homo Sapiens
DPAIANLKA

SEQ ID NO: 839030 - protein, 9 aa, Homo Sapiens
EKRIEKGSS

SEQ ID NO: 839031 - protein, 9 aa, Homo Sapiens
SMQLMFGDP

SEQ ID NO: 839032 - protein, 9 aa, Homo Sapiens
KLKEFVKEK

SEQ ID NO: 839033 - protein, 9 aa, Homo Sapiens
PPQVAFTTK

SEQ ID NO: 839034 - protein, 9 aa, Homo Sapiens
GFLQELSKE

SEQ ID NO: 839035 - protein, 9 aa, Homo Sapiens
KDVTVGSLV

SEQ ID NO: 839036 - protein, 9 aa, Homo Sapiens
EPGQPDNDI

SEQ ID NO: 839037 - protein, 9 aa, Homo Sapiens
VFALIVLLG

SEQ ID NO: 839038 - protein, 9 aa, Homo Sapiens
YNYDITLYL

SEQ ID NO: 839039 - protein, 9 aa, Homo Sapiens
LKTIYVIPG

SEQ ID NO: 839040 - protein, 9 aa, Homo Sapiens
WVTTGITPV

SEQ ID NO: 839041 - protein, 9 aa, Homo Sapiens
DAKTTPPNS

SEQ ID NO: 839042 - protein, 9 aa, Homo Sapiens
VFNDNESWY

SEQ ID NO: 839043 - protein, 9 aa, Homo Sapiens
KGFSVDYDN

SEQ ID NO: 839044 - protein, 9 aa, Homo Sapiens
GNFGSNFVS

SEQ ID NO: 839045 - protein, 9 aa, Homo Sapiens
VDVSSKQSP

SEQ ID NO: 839046 - protein, 9 aa, Homo Sapiens
DNACFSSEE

SEQ ID NO: 839047 - protein, 9 aa, Homo Sapiens
NYFTLDADF

SEQ ID NO: 839048 - protein, 9 aa, Homo Sapiens
SISAMPKHL

SEQ ID NO: 839049 - protein, 9 aa, Homo Sapiens
GKSTLLQQI

SEQ ID NO: 839050 - protein, 9 aa, Homo Sapiens
LMPIKICII

SEQ ID NO: 839051 - protein, 9 aa, Homo Sapiens
TSDGRITLS

SEQ ID NO: 839052 - protein, 9 aa, Homo Sapiens
MSKMRDMRM

SEQ ID NO: 839053 - protein, 9 aa, Homo Sapiens
VTWQGITHL

SEQ ID NO: 839054 - protein, 9 aa, Homo Sapiens
KTVTYLAWR

SEQ ID NO: 839055 - protein, 9 aa, Homo Sapiens
ELFTRKLCG

SEQ ID NO: 839056 - protein, 9 aa, Homo Sapiens
VLWELNKPF

SEQ ID NO: 839057 - protein, 9 aa, Homo Sapiens
RLLILREIV

SEQ ID NO: 839058 - protein, 9 aa, Homo Sapiens
ARVPVNSSS

SEQ ID NO: 839059 - protein, 9 aa, Homo Sapiens
RVNTGEKPY

SEQ ID NO: 839060 - protein, 9 aa, Homo Sapiens
LAVKHDLIL

SEQ ID NO: 839061 - protein, 9 aa, Homo Sapiens
ATPLLMGKI

SEQ ID NO: 839062 - protein, 9 aa, Homo Sapiens
VAKRKTKAN

SEQ ID NO: 839063 - protein, 9 aa, Homo Sapiens
MYLQAAIVC

SEQ ID NO: 839064 - protein, 9 aa, Homo Sapiens
PEVSRSLLE

SEQ ID NO: 839065 - protein, 9 aa, Homo Sapiens
VKGLKSALD

SEQ ID NO: 839066 - protein, 9 aa, Homo Sapiens
MGDAKDKVQ

SEQ ID NO: 839067 - protein, 9 aa, Homo Sapiens
PAITTLVVK

SEQ ID NO: 839068 - protein, 9 aa, Homo Sapiens
FSFHPVCKA

SEQ ID NO: 839069 - protein, 9 aa, Homo Sapiens
IRDGDKMYV

SEQ ID NO: 839070 - protein, 9 aa, Homo Sapiens
YVLIMDFHS

SEQ ID NO: 839071 - protein, 9 aa, Homo Sapiens
YTCKTVEKP

SEQ ID NO: 839072 - protein, 9 aa, Homo Sapiens
QKEIQELNG

SEQ ID NO: 839073 - protein, 9 aa, Homo Sapiens
AAVLWELNK

SEQ ID NO: 839074 - protein, 9 aa, Homo Sapiens
SEGWKETDK

SEQ ID NO: 839075 - protein, 9 aa, Homo Sapiens
TSTPKTKER

SEQ ID NO: 839076 - protein, 9 aa, Homo Sapiens
QYPVVAVNS

SEQ ID NO: 839077 - protein, 9 aa, Homo Sapiens
KINHKRYRP

SEQ ID NO: 839078 - protein, 9 aa, Homo Sapiens
TTLDAKIEK

SEQ ID NO: 839079 - protein, 9 aa, Homo Sapiens
ATVGRQYLW

SEQ ID NO: 839080 - protein, 9 aa, Homo Sapiens
QVKEYQIQE

SEQ ID NO: 839081 - protein, 9 aa, Homo Sapiens
NSCPSLCSR

SEQ ID NO: 839082 - protein, 9 aa, Homo Sapiens
RDSLSHLEA

SEQ ID NO: 839083 - protein, 9 aa, Homo Sapiens
QYILAQIGL

SEQ ID NO: 839084 - protein, 9 aa, Homo Sapiens
DPCQKGKCS

SEQ ID NO: 839085 - protein, 9 aa, Homo Sapiens
RVRDITIAT

SEQ ID NO: 839086 - protein, 9 aa, Homo Sapiens
FKTPKEITL

SEQ ID NO: 839087 - protein, 9 aa, Homo Sapiens
DTQLITVDD

SEQ ID NO: 839088 - protein, 9 aa, Homo Sapiens
SWLSTFCGR

SEQ ID NO: 839089 - protein, 9 aa, Homo Sapiens
PRAPFAMIN

SEQ ID NO: 839090 - protein, 9 aa, Homo Sapiens
TYFCVDFSS

SEQ ID NO: 839091 - protein, 9 aa, Homo Sapiens
EKKKCKNSS

SEQ ID NO: 839092 - protein, 9 aa, Homo Sapiens
AHHDFGYFY

SEQ ID NO: 839093 - protein, 9 aa, Homo Sapiens
ALPLLLDLG

SEQ ID NO: 839094 - protein, 9 aa, Homo Sapiens
DKFSSALQP

SEQ ID NO: 839095 - protein, 9 aa, Homo Sapiens
NEQQRSSPT

SEQ ID NO: 839096 - protein, 9 aa, Homo Sapiens
EQKREQHED

SEQ ID NO: 839097 - protein, 9 aa, Homo Sapiens
LKASLKQKD

SEQ ID NO: 839098 - protein, 9 aa, Homo Sapiens
AVRDYYHCY

SEQ ID NO: 839099 - protein, 9 aa, Homo Sapiens
EGMMGTFIE

SEQ ID NO: 839100 - protein, 9 aa, Homo Sapiens
LANTEQETL

SEQ ID NO: 839101 - protein, 9 aa, Homo Sapiens
NGSQSVITS

SEQ ID NO: 839102 - protein, 9 aa, Homo Sapiens
GTKKDEMRK

SEQ ID NO: 839103 - protein, 9 aa, Homo Sapiens
ISREDNITT

SEQ ID NO: 839104 - protein, 9 aa, Homo Sapiens
VSGITEIVT

SEQ ID NO: 839105 - protein, 9 aa, Homo Sapiens
GLRGNELFC

SEQ ID NO: 839106 - protein, 9 aa, Homo Sapiens
PIKFEDVYA

SEQ ID NO: 839107 - protein, 9 aa, Homo Sapiens
HLPPYKLSL

SEQ ID NO: 839108 - protein, 9 aa, Homo Sapiens
LLCPPIINL

SEQ ID NO: 839109 - protein, 9 aa, Homo Sapiens
HRHKTVIQA

SEQ ID NO: 839110 - protein, 9 aa, Homo Sapiens
VIALRYVAP

SEQ ID NO: 839111 - protein, 9 aa, Homo Sapiens
ERMMTWLAN

SEQ ID NO: 839112 - protein, 9 aa, Homo Sapiens
SVFPQQSLR

SEQ ID NO: 839113 - protein, 9 aa, Homo Sapiens
DCRVIPWKQ

SEQ ID NO: 839114 - protein, 9 aa, Homo Sapiens
MDFQHRPRG

SEQ ID NO: 839115 - protein, 9 aa, Homo Sapiens
AVGKSRGKP

SEQ ID NO: 839116 - protein, 9 aa, Homo Sapiens
AHVKKDVTV

SEQ ID NO: 839117 - protein, 9 aa, Homo Sapiens
AEIFLKLIL

SEQ ID NO: 839118 - protein, 9 aa, Homo Sapiens
KGLSVDDFY

SEQ ID NO: 839119 - protein, 9 aa, Homo Sapiens
VILGASDKE

SEQ ID NO: 839120 - protein, 9 aa, Homo Sapiens
NRTATPQTF

SEQ ID NO: 839121 - protein, 9 aa, Homo Sapiens
IRNTFQGGA

SEQ ID NO: 839122 - protein, 9 aa, Homo Sapiens
PTYRTHDGS

SEQ ID NO: 839123 - protein, 9 aa, Homo Sapiens
STSSTKHLK

SEQ ID NO: 839124 - protein, 9 aa, Homo Sapiens
QKLEKECQY

SEQ ID NO: 839125 - protein, 9 aa, Homo Sapiens
MALGLMRGT

SEQ ID NO: 839126 - protein, 9 aa, Homo Sapiens
FNEAEKLHP

SEQ ID NO: 839127 - protein, 9 aa, Homo Sapiens
HLRLKEHIA

SEQ ID NO: 839128 - protein, 9 aa, Homo Sapiens
RHKRKHDED

SEQ ID NO: 839129 - protein, 9 aa, Homo Sapiens
NGNYIKTPP

SEQ ID NO: 839130 - protein, 9 aa, Homo Sapiens
IMQYFPAEI

SEQ ID NO: 839131 - protein, 9 aa, Homo Sapiens
RHQYLRRKH

SEQ ID NO: 839132 - protein, 9 aa, Homo Sapiens
VPKKCFPEP

SEQ ID NO: 839133 - protein, 9 aa, Homo Sapiens
DTTQCAYIH

SEQ ID NO: 839134 - protein, 9 aa, Homo Sapiens
EKERTRAEM

SEQ ID NO: 839135 - protein, 9 aa, Homo Sapiens
FVTKTPLEG

SEQ ID NO: 839136 - protein, 9 aa, Homo Sapiens
DHGSLENEK

SEQ ID NO: 839137 - protein, 9 aa, Homo Sapiens
QSILSRHWI

SEQ ID NO: 839138 - protein, 9 aa, Homo Sapiens
NFTATAHSA

SEQ ID NO: 839139 - protein, 9 aa, Homo Sapiens
EGLKGVLIN

SEQ ID NO: 839140 - protein, 9 aa, Homo Sapiens
ALWGRHTNP

SEQ ID NO: 839141 - protein, 9 aa, Homo Sapiens
PFYLNHNLG

SEQ ID NO: 839142 - protein, 9 aa, Homo Sapiens
LHGSTDSDF

SEQ ID NO: 839143 - protein, 9 aa, Homo Sapiens
QLLMDSGLP

SEQ ID NO: 839144 - protein, 9 aa, Homo Sapiens
LAGTLFLML

SEQ ID NO: 839145 - protein, 9 aa, Homo Sapiens
SKDGDPRKD

SEQ ID NO: 839146 - protein, 9 aa, Homo Sapiens
CRTSFRQRA

SEQ ID NO: 839147 - protein, 9 aa, Homo Sapiens
DEPQKLYPK

SEQ ID NO: 839148 - protein, 9 aa, Homo Sapiens
RGCSKLVDN

SEQ ID NO: 839149 - protein, 9 aa, Homo Sapiens
AVSEDSSVA

SEQ ID NO: 839150 - protein, 9 aa, Homo Sapiens
EGTPELHLL

SEQ ID NO: 839151 - protein, 9 aa, Homo Sapiens
TLCCDRNLC

SEQ ID NO: 839152 - protein, 9 aa, Homo Sapiens
KHQNLAALV

SEQ ID NO: 839153 - protein, 9 aa, Homo Sapiens
LRGFVSISS

SEQ ID NO: 839154 - protein, 9 aa, Homo Sapiens
ISLLLRVEP

SEQ ID NO: 839155 - protein, 9 aa, Homo Sapiens
YTSLLCKAA

SEQ ID NO: 839156 - protein, 9 aa, Homo Sapiens
LMNGMKSDG

SEQ ID NO: 839157 - protein, 9 aa, Homo Sapiens
LIGWLFLII

SEQ ID NO: 839158 - protein, 9 aa, Homo Sapiens
AAMGFDRYM

SEQ ID NO: 839159 - protein, 9 aa, Homo Sapiens
EITAEIFTT

SEQ ID NO: 839160 - protein, 9 aa, Homo Sapiens
PFSGTRRVS

SEQ ID NO: 839161 - protein, 9 aa, Homo Sapiens
GEEDNQKRY

SEQ ID NO: 839162 - protein, 9 aa, Homo Sapiens
DNVFFPSGQ

SEQ ID NO: 839163 - protein, 9 aa, Homo Sapiens
HNRKVQSLK

SEQ ID NO: 839164 - protein, 9 aa, Homo Sapiens
INTTDGSTI

SEQ ID NO: 839165 - protein, 9 aa, Homo Sapiens
KGIEAPLQQ

SEQ ID NO: 839166 - protein, 9 aa, Homo Sapiens
YQVKESKVE

SEQ ID NO: 839167 - protein, 9 aa, Homo Sapiens
LDLDDNDDR

SEQ ID NO: 839168 - protein, 9 aa, Homo Sapiens
RFHKAPVGQ

SEQ ID NO: 839169 - protein, 9 aa, Homo Sapiens
VGTEPLRSM

SEQ ID NO: 839170 - protein, 9 aa, Homo Sapiens
LPYKELFGG

SEQ ID NO: 839171 - protein, 9 aa, Homo Sapiens
VYYAHYYQQ

SEQ ID NO: 839172 - protein, 9 aa, Homo Sapiens
HLKITSNMF

SEQ ID NO: 839173 - protein, 9 aa, Homo Sapiens
ITNLKAEIH

SEQ ID NO: 839174 - protein, 9 aa, Homo Sapiens
RSEKYSSHS

SEQ ID NO: 839175 - protein, 9 aa, Homo Sapiens
QLRYINNLV

SEQ ID NO: 839176 - protein, 9 aa, Homo Sapiens
RYKVAHSQG

SEQ ID NO: 839177 - protein, 9 aa, Homo Sapiens
KTVIELGAG

SEQ ID NO: 839178 - protein, 9 aa, Homo Sapiens
VRNSKIDIS

SEQ ID NO: 839179 - protein, 9 aa, Homo Sapiens
GADGTQGPP

SEQ ID NO: 839180 - protein, 9 aa, Homo Sapiens
QVLLSICSL

SEQ ID NO: 839181 - protein, 9 aa, Homo Sapiens
DISDNVPTL

SEQ ID NO: 839182 - protein, 9 aa, Homo Sapiens
LQVIGLCKE

SEQ ID NO: 839183 - protein, 9 aa, Homo Sapiens
FTKHQRINT

SEQ ID NO: 839184 - protein, 9 aa, Homo Sapiens
MFLLVGDLR

SEQ ID NO: 839185 - protein, 9 aa, Homo Sapiens
KFDKLLEER

SEQ ID NO: 839186 - protein, 9 aa, Homo Sapiens
YIRADIDKK

SEQ ID NO: 839187 - protein, 9 aa, Homo Sapiens
TPVKNYQVH

SEQ ID NO: 839188 - protein, 9 aa, Homo Sapiens
ALRGTLTPR

SEQ ID NO: 839189 - protein, 9 aa, Homo Sapiens
EEPNLGKKP

SEQ ID NO: 839190 - protein, 9 aa, Homo Sapiens
KNTSKKVTR

SEQ ID NO: 839191 - protein, 9 aa, Homo Sapiens
LGLEGQLII

SEQ ID NO: 839192 - protein, 9 aa, Homo Sapiens
SPEDLIVEG

SEQ ID NO: 839193 - protein, 9 aa, Homo Sapiens
AIECLAQSS

SEQ ID NO: 839194 - protein, 9 aa, Homo Sapiens
HVKAQEYER

SEQ ID NO: 839195 - protein, 9 aa, Homo Sapiens
KRSSQTQDK

SEQ ID NO: 839196 - protein, 9 aa, Homo Sapiens
TSTAPNSLL

SEQ ID NO: 839197 - protein, 9 aa, Homo Sapiens
EHEEELRLA

SEQ ID NO: 839198 - protein, 9 aa, Homo Sapiens
TPDVVSKIA

SEQ ID NO: 839199 - protein, 9 aa, Homo Sapiens
IIIDELSKK

SEQ ID NO: 839200 - protein, 9 aa, Homo Sapiens
KSIMNKRDG

SEQ ID NO: 839201 - protein, 9 aa, Homo Sapiens
FGYLFDEAI

SEQ ID NO: 839202 - protein, 9 aa, Homo Sapiens
QDTVTDVDT

SEQ ID NO: 839203 - protein, 9 aa, Homo Sapiens
DAVFIKDGF

SEQ ID NO: 839204 - protein, 9 aa, Homo Sapiens
NQLCYSESM

SEQ ID NO: 839205 - protein, 9 aa, Homo Sapiens
PPQHLLPVP

SEQ ID NO: 839206 - protein, 9 aa, Homo Sapiens
LHTADKPYK

SEQ ID NO: 839207 - protein, 9 aa, Homo Sapiens
HNLIRRDLA

SEQ ID NO: 839208 - protein, 9 aa, Homo Sapiens
TWRRKGSFI

SEQ ID NO: 839209 - protein, 9 aa, Homo Sapiens
VGKSRGKPL

SEQ ID NO: 839210 - protein, 9 aa, Homo Sapiens
LQVLWVDRA

SEQ ID NO: 839211 - protein, 9 aa, Homo Sapiens
CGYHSTIYN

SEQ ID NO: 839212 - protein, 9 aa, Homo Sapiens
RSCPSWAGL

SEQ ID NO: 839213 - protein, 9 aa, Homo Sapiens
HMSLWRGFL

SEQ ID NO: 839214 - protein, 9 aa, Homo Sapiens
KYSVNMVTL

SEQ ID NO: 839215 - protein, 9 aa, Homo Sapiens
PTKAVRTTG

SEQ ID NO: 839216 - protein, 9 aa, Homo Sapiens
GIHLPCVQV

SEQ ID NO: 839217 - protein, 9 aa, Homo Sapiens
ELFKQALKA

SEQ ID NO: 839218 - protein, 9 aa, Homo Sapiens
TNVNDNPPK

SEQ ID NO: 839219 - protein, 9 aa, Homo Sapiens
KELVELHFK

SEQ ID NO: 839220 - protein, 9 aa, Homo Sapiens
LTCSRASSL

SEQ ID NO: 839221 - protein, 9 aa, Homo Sapiens
VCFAQEFFI

SEQ ID NO: 839222 - protein, 9 aa, Homo Sapiens
ESMKETLQI

SEQ ID NO: 839223 - protein, 9 aa, Homo Sapiens
EDDPRLKCK

SEQ ID NO: 839224 - protein, 9 aa, Homo Sapiens
LDIKLRHFE

SEQ ID NO: 839225 - protein, 9 aa, Homo Sapiens
TLLMVLTHI

SEQ ID NO: 839226 - protein, 9 aa, Homo Sapiens
ISFQTEKLV

SEQ ID NO: 839227 - protein, 9 aa, Homo Sapiens
NVSQGRLAI

SEQ ID NO: 839228 - protein, 9 aa, Homo Sapiens
WMHICSALM

SEQ ID NO: 839229 - protein, 9 aa, Homo Sapiens
KKKKIKHSE

SEQ ID NO: 839230 - protein, 9 aa, Homo Sapiens
QRSHTAEQP

SEQ ID NO: 839231 - protein, 9 aa, Homo Sapiens
HNMKCCIHG

SEQ ID NO: 839232 - protein, 9 aa, Homo Sapiens
YTDCLTQIC

SEQ ID NO: 839233 - protein, 9 aa, Homo Sapiens
VREFICLDD

SEQ ID NO: 839234 - protein, 9 aa, Homo Sapiens
TVVVPCLSS

SEQ ID NO: 839235 - protein, 9 aa, Homo Sapiens
WIYPEGKLI

SEQ ID NO: 839236 - protein, 9 aa, Homo Sapiens
FANLIMEVY

SEQ ID NO: 839237 - protein, 9 aa, Homo Sapiens
GLKMATNRT

SEQ ID NO: 839238 - protein, 9 aa, Homo Sapiens
QVRRQRLRS

SEQ ID NO: 839239 - protein, 9 aa, Homo Sapiens
LLLQTPVVR

SEQ ID NO: 839240 - protein, 9 aa, Homo Sapiens
MFIRYGNYS

SEQ ID NO: 839241 - protein, 9 aa, Homo Sapiens
QIPNYHNMT

SEQ ID NO: 839242 - protein, 9 aa, Homo Sapiens
WSPNFQTCK

SEQ ID NO: 839243 - protein, 9 aa, Homo Sapiens
GWLSLAKVR

SEQ ID NO: 839244 - protein, 9 aa, Homo Sapiens
ELTTAIHTY

SEQ ID NO: 839245 - protein, 9 aa, Homo Sapiens
AHKSERSSR

SEQ ID NO: 839246 - protein, 9 aa, Homo Sapiens
AFRAGLPQD

SEQ ID NO: 839247 - protein, 9 aa, Homo Sapiens
ADKGPASND

SEQ ID NO: 839248 - protein, 9 aa, Homo Sapiens
SKDVMEKIE

SEQ ID NO: 839249 - protein, 9 aa, Homo Sapiens
FPSDLYDGF

SEQ ID NO: 839250 - protein, 9 aa, Homo Sapiens
CHHKLHTAD

SEQ ID NO: 839251 - protein, 9 aa, Homo Sapiens
GDLRNKRFE

SEQ ID NO: 839252 - protein, 9 aa, Homo Sapiens
LTKSLDSPR

SEQ ID NO: 839253 - protein, 9 aa, Homo Sapiens
ADAKIASSL

SEQ ID NO: 839254 - protein, 9 aa, Homo Sapiens
APETTHKSS

SEQ ID NO: 839255 - protein, 9 aa, Homo Sapiens
TCDTEFRQT

SEQ ID NO: 839256 - protein, 9 aa, Homo Sapiens
SKYIATILE

SEQ ID NO: 839257 - protein, 9 aa, Homo Sapiens
IGGGSVWGH

SEQ ID NO: 839258 - protein, 9 aa, Homo Sapiens
TMDCFEMCA

SEQ ID NO: 839259 - protein, 9 aa, Homo Sapiens
CQERPSKYI

SEQ ID NO: 839260 - protein, 9 aa, Homo Sapiens
PCYACPQSF

SEQ ID NO: 839261 - protein, 9 aa, Homo Sapiens
KQRKDILQV

SEQ ID NO: 839262 - protein, 9 aa, Homo Sapiens
IDVVDARPL

SEQ ID NO: 839263 - protein, 9 aa, Homo Sapiens
LGKHTERIG

SEQ ID NO: 839264 - protein, 9 aa, Homo Sapiens
ACGPGPHRL

SEQ ID NO: 839265 - protein, 9 aa, Homo Sapiens
AWNNEVKEK

SEQ ID NO: 839266 - protein, 9 aa, Homo Sapiens
ASQGAKPSL

SEQ ID NO: 839267 - protein, 9 aa, Homo Sapiens
GGVGDGGPF

SEQ ID NO: 839268 - protein, 9 aa, Homo Sapiens
WRLMALRER

SEQ ID NO: 839269 - protein, 9 aa, Homo Sapiens
SFTPKTNTK

SEQ ID NO: 839270 - protein, 9 aa, Homo Sapiens
SYFDFVRLQ

SEQ ID NO: 839271 - protein, 9 aa, Homo Sapiens
PPDLAFNKE

SEQ ID NO: 839272 - protein, 9 aa, Homo Sapiens
TPYWALILQ

SEQ ID NO: 839273 - protein, 9 aa, Homo Sapiens
AYSPGGDWE

SEQ ID NO: 839274 - protein, 9 aa, Homo Sapiens
FLELAPDIV

SEQ ID NO: 839275 - protein, 9 aa, Homo Sapiens
EQEMEEAKD

SEQ ID NO: 839276 - protein, 9 aa, Homo Sapiens
AKGDQLEII

SEQ ID NO: 839277 - protein, 9 aa, Homo Sapiens
PSLCSRLSS

SEQ ID NO: 839278 - protein, 9 aa, Homo Sapiens
YLVANYPYD

SEQ ID NO: 839279 - protein, 9 aa, Homo Sapiens
IKDKTHQTI

SEQ ID NO: 839280 - protein, 9 aa, Homo Sapiens
DNLDYTLSK

SEQ ID NO: 839281 - protein, 9 aa, Homo Sapiens
AHGRRPPPA

SEQ ID NO: 839282 - protein, 9 aa, Homo Sapiens
KLLETSAKS

SEQ ID NO: 839283 - protein, 9 aa, Homo Sapiens
GYRISHMWQ

SEQ ID NO: 839284 - protein, 9 aa, Homo Sapiens
LKERLNMAL

SEQ ID NO: 839285 - protein, 9 aa, Homo Sapiens
IFSSITILD

SEQ ID NO: 839286 - protein, 9 aa, Homo Sapiens
HRCCNKTRI

SEQ ID NO: 839287 - protein, 9 aa, Homo Sapiens
GQVMTINSV

SEQ ID NO: 839288 - protein, 9 aa, Homo Sapiens
LNATDRDDG

SEQ ID NO: 839289 - protein, 9 aa, Homo Sapiens
AYMDAACFG

SEQ ID NO: 839290 - protein, 9 aa, Homo Sapiens
LANHKIIHT

SEQ ID NO: 839291 - protein, 9 aa, Homo Sapiens
NKTLDKMEK

SEQ ID NO: 839292 - protein, 9 aa, Homo Sapiens
IPLPGRLGP

SEQ ID NO: 839293 - protein, 9 aa, Homo Sapiens
VTLCCDRNL

SEQ ID NO: 839294 - protein, 9 aa, Homo Sapiens
TKAIVETIR

SEQ ID NO: 839295 - protein, 9 aa, Homo Sapiens
PAPEQRKIM

SEQ ID NO: 839296 - protein, 9 aa, Homo Sapiens
MLESRGLYY

SEQ ID NO: 839297 - protein, 9 aa, Homo Sapiens
EIELPEKLE

SEQ ID NO: 839298 - protein, 9 aa, Homo Sapiens
SEFCFNDNL

SEQ ID NO: 839299 - protein, 9 aa, Homo Sapiens
AFYTGNLQT

SEQ ID NO: 839300 - protein, 9 aa, Homo Sapiens
GKYANVFHQ

SEQ ID NO: 839301 - protein, 9 aa, Homo Sapiens
FNNFEITIK

SEQ ID NO: 839302 - protein, 9 aa, Homo Sapiens
LFFFRRVQV

SEQ ID NO: 839303 - protein, 9 aa, Homo Sapiens
AQEIEITPP

SEQ ID NO: 839304 - protein, 9 aa, Homo Sapiens
QTQQELQRK

SEQ ID NO: 839305 - protein, 9 aa, Homo Sapiens
EKLWKEMSA

SEQ ID NO: 839306 - protein, 9 aa, Homo Sapiens
DVSASMHNH

SEQ ID NO: 839307 - protein, 9 aa, Homo Sapiens
ITAFAIERY

SEQ ID NO: 839308 - protein, 9 aa, Homo Sapiens
IISLNKEFL

SEQ ID NO: 839309 - protein, 9 aa, Homo Sapiens
LQTLSTEAP

SEQ ID NO: 839310 - protein, 9 aa, Homo Sapiens
RMISLSYSQ

SEQ ID NO: 839311 - protein, 9 aa, Homo Sapiens
EDYAGIYRC

SEQ ID NO: 839312 - protein, 9 aa, Homo Sapiens
LDQVQKVAH

SEQ ID NO: 839313 - protein, 9 aa, Homo Sapiens
EPDYGTSSA

SEQ ID NO: 839314 - protein, 9 aa, Homo Sapiens
NFDFVTKTP

SEQ ID NO: 839315 - protein, 9 aa, Homo Sapiens
EEADKMFLI

SEQ ID NO: 839316 - protein, 9 aa, Homo Sapiens
APEKIIKES

SEQ ID NO: 839317 - protein, 9 aa, Homo Sapiens
IYLLRDAIV

SEQ ID NO: 839318 - protein, 9 aa, Homo Sapiens
LSLLDKVCK

SEQ ID NO: 839319 - protein, 9 aa, Homo Sapiens
EVKVFDFFG

SEQ ID NO: 839320 - protein, 9 aa, Homo Sapiens
DRFQDTVLQ

SEQ ID NO: 839321 - protein, 9 aa, Homo Sapiens
NYRVVGGIM

SEQ ID NO: 839322 - protein, 9 aa, Homo Sapiens
EMELIIETQ

SEQ ID NO: 839323 - protein, 9 aa, Homo Sapiens
DQLAHEHHC

SEQ ID NO: 839324 - protein, 9 aa, Homo Sapiens
ERRYLTINS

SEQ ID NO: 839325 - protein, 9 aa, Homo Sapiens
NTNIRALQG

SEQ ID NO: 839326 - protein, 9 aa, Homo Sapiens
VGDITKEDL

SEQ ID NO: 839327 - protein, 9 aa, Homo Sapiens
ALEVPFIWP

SEQ ID NO: 839328 - protein, 9 aa, Homo Sapiens
LDGEELLVE

SEQ ID NO: 839329 - protein, 9 aa, Homo Sapiens
ATLLNIPRN

SEQ ID NO: 839330 - protein, 9 aa, Homo Sapiens
MDNFILFDE

SEQ ID NO: 839331 - protein, 9 aa, Homo Sapiens
HHCCDLLIG

SEQ ID NO: 839332 - protein, 9 aa, Homo Sapiens
WGLVATLQS

SEQ ID NO: 839333 - protein, 9 aa, Homo Sapiens
DWARWAKLE

SEQ ID NO: 839334 - protein, 9 aa, Homo Sapiens
KKIARIAVR

SEQ ID NO: 839335 - protein, 9 aa, Homo Sapiens
KSRGKPLPL

SEQ ID NO: 839336 - protein, 9 aa, Homo Sapiens
YLVHSNKKE

SEQ ID NO: 839337 - protein, 9 aa, Homo Sapiens
LGFNSMGGK

SEQ ID NO: 839338 - protein, 9 aa, Homo Sapiens
KLSSYLGNG

SEQ ID NO: 839339 - protein, 9 aa, Homo Sapiens
NDEIEANLE

SEQ ID NO: 839340 - protein, 9 aa, Homo Sapiens
VWNMGVVLY

SEQ ID NO: 839341 - protein, 9 aa, Homo Sapiens
NSILLSHQI

SEQ ID NO: 839342 - protein, 9 aa, Homo Sapiens
LVFQDIQDE

SEQ ID NO: 839343 - protein, 9 aa, Homo Sapiens
LDGYYRTIQ

SEQ ID NO: 839344 - protein, 9 aa, Homo Sapiens
TLPKLYYLR

SEQ ID NO: 839345 - protein, 9 aa, Homo Sapiens
WRAMLAMFK

SEQ ID NO: 839346 - protein, 9 aa, Homo Sapiens
MLQDLLSDL

SEQ ID NO: 839347 - protein, 9 aa, Homo Sapiens
LKESAVTVM

SEQ ID NO: 839348 - protein, 9 aa, Homo Sapiens
MAQIGSYAP

SEQ ID NO: 839349 - protein, 9 aa, Homo Sapiens
RSCEKFGPG

SEQ ID NO: 839350 - protein, 9 aa, Homo Sapiens
RTEPSPALL

SEQ ID NO: 839351 - protein, 9 aa, Homo Sapiens
VIMVQDVSF

SEQ ID NO: 839352 - protein, 9 aa, Homo Sapiens
IRLQNIPFN

SEQ ID NO: 839353 - protein, 9 aa, Homo Sapiens
WAKYTTCET

SEQ ID NO: 839354 - protein, 9 aa, Homo Sapiens
PMKRLSPMK

SEQ ID NO: 839355 - protein, 9 aa, Homo Sapiens
DILNKRLTV

SEQ ID NO: 839356 - protein, 9 aa, Homo Sapiens
RMKICMNED

SEQ ID NO: 839357 - protein, 9 aa, Homo Sapiens
EDHRFDNTP

SEQ ID NO: 839358 - protein, 9 aa, Homo Sapiens
CTVWYFPST

SEQ ID NO: 839359 - protein, 9 aa, Homo Sapiens
DQRSMPSMG

SEQ ID NO: 839360 - protein, 9 aa, Homo Sapiens
WCIMPFWIV

SEQ ID NO: 839361 - protein, 9 aa, Homo Sapiens
STELVPLVC

SEQ ID NO: 839362 - protein, 9 aa, Homo Sapiens
TEDDNPLLR

SEQ ID NO: 839363 - protein, 9 aa, Homo Sapiens
IKVEASQKK

SEQ ID NO: 839364 - protein, 9 aa, Homo Sapiens
LLLRNNGLN

SEQ ID NO: 839365 - protein, 9 aa, Homo Sapiens
LTEVSQHAA

SEQ ID NO: 839366 - protein, 9 aa, Homo Sapiens
QYKHPDICK

SEQ ID NO: 839367 - protein, 9 aa, Homo Sapiens
EPLASHSEK

SEQ ID NO: 839368 - protein, 9 aa, Homo Sapiens
SEIISKQYN

SEQ ID NO: 839369 - protein, 9 aa, Homo Sapiens
REINKIAAA

SEQ ID NO: 839370 - protein, 9 aa, Homo Sapiens
KRNTVLDEA

SEQ ID NO: 839371 - protein, 9 aa, Homo Sapiens
VNKVKQENT

SEQ ID NO: 839372 - protein, 9 aa, Homo Sapiens
DIIYGMAVL

SEQ ID NO: 839373 - protein, 9 aa, Homo Sapiens
FKVIENNTT

SEQ ID NO: 839374 - protein, 9 aa, Homo Sapiens
SMLSTDTNK

SEQ ID NO: 839375 - protein, 9 aa, Homo Sapiens
RANPGKIIT

SEQ ID NO: 839376 - protein, 9 aa, Homo Sapiens
QHALYLDIT

SEQ ID NO: 839377 - protein, 9 aa, Homo Sapiens
TQQSQQELS

SEQ ID NO: 839378 - protein, 9 aa, Homo Sapiens
NNAIFDEDH

SEQ ID NO: 839379 - protein, 9 aa, Homo Sapiens
TLLMSIQMY

SEQ ID NO: 839380 - protein, 9 aa, Homo Sapiens
SNLIPSIKT

SEQ ID NO: 839381 - protein, 9 aa, Homo Sapiens
ICQICQPRK

SEQ ID NO: 839382 - protein, 9 aa, Homo Sapiens
TIILRHLIE

SEQ ID NO: 839383 - protein, 9 aa, Homo Sapiens
DLESLDATV

SEQ ID NO: 839384 - protein, 9 aa, Homo Sapiens
GLQVWLQLF

SEQ ID NO: 839385 - protein, 9 aa, Homo Sapiens
VLLKVPKDA

SEQ ID NO: 839386 - protein, 9 aa, Homo Sapiens
GTPSQTTAN

SEQ ID NO: 839387 - protein, 9 aa, Homo Sapiens
LHSLLNKEL

SEQ ID NO: 839388 - protein, 9 aa, Homo Sapiens
IDHVQQVEK

SEQ ID NO: 839389 - protein, 9 aa, Homo Sapiens
SLQPLPPGL

SEQ ID NO: 839390 - protein, 9 aa, Homo Sapiens
LPRPNVCLP

SEQ ID NO: 839391 - protein, 9 aa, Homo Sapiens
QPRQISAIS

SEQ ID NO: 839392 - protein, 9 aa, Homo Sapiens
EDDDDVETN

SEQ ID NO: 839393 - protein, 9 aa, Homo Sapiens
MSLEYYDIE

SEQ ID NO: 839394 - protein, 9 aa, Homo Sapiens
CKWYQDNAL

SEQ ID NO: 839395 - protein, 9 aa, Homo Sapiens
IGLAVILMT

SEQ ID NO: 839396 - protein, 9 aa, Homo Sapiens
DNLDSLGGE

SEQ ID NO: 839397 - protein, 9 aa, Homo Sapiens
PKHSTRGIL

SEQ ID NO: 839398 - protein, 9 aa, Homo Sapiens
HSAKLAFAV

SEQ ID NO: 839399 - protein, 9 aa, Homo Sapiens
VVRLIAEGK

SEQ ID NO: 839400 - protein, 9 aa, Homo Sapiens
KFSYGYSLK

SEQ ID NO: 839401 - protein, 9 aa, Homo Sapiens
GCSTVSLII

SEQ ID NO: 839402 - protein, 9 aa, Homo Sapiens
LKKYSNPMV

SEQ ID NO: 839403 - protein, 9 aa, Homo Sapiens
LLREQSIDG

SEQ ID NO: 839404 - protein, 9 aa, Homo Sapiens
EWTHHNMKP

SEQ ID NO: 839405 - protein, 9 aa, Homo Sapiens
HSHVLRQQE

SEQ ID NO: 839406 - protein, 9 aa, Homo Sapiens
TIQVQSSEA

SEQ ID NO: 839407 - protein, 9 aa, Homo Sapiens
PKPVQLLLD

SEQ ID NO: 839408 - protein, 9 aa, Homo Sapiens
VPYPGCGSL

SEQ ID NO: 839409 - protein, 9 aa, Homo Sapiens
EEPEEDVHA

SEQ ID NO: 839410 - protein, 9 aa, Homo Sapiens
TYRGFIFKQ

SEQ ID NO: 839411 - protein, 9 aa, Homo Sapiens
KVYEGEVTE

SEQ ID NO: 839412 - protein, 9 aa, Homo Sapiens
QLDISIVRL

SEQ ID NO: 839413 - protein, 9 aa, Homo Sapiens
YIENLKKFL

SEQ ID NO: 839414 - protein, 9 aa, Homo Sapiens
IHLKRYSFS

SEQ ID NO: 839415 - protein, 9 aa, Homo Sapiens
MAGQLFSNS

SEQ ID NO: 839416 - protein, 9 aa, Homo Sapiens
IIAYNACVI

SEQ ID NO: 839417 - protein, 9 aa, Homo Sapiens
RNEELGDED

SEQ ID NO: 839418 - protein, 9 aa, Homo Sapiens
LVRIICGSR

SEQ ID NO: 839419 - protein, 9 aa, Homo Sapiens
SEKANPNIN

SEQ ID NO: 839420 - protein, 9 aa, Homo Sapiens
EMSEVLQLC

SEQ ID NO: 839421 - protein, 9 aa, Homo Sapiens
ATRQKRKFS

SEQ ID NO: 839422 - protein, 9 aa, Homo Sapiens
QQGAPGCTL

SEQ ID NO: 839423 - protein, 9 aa, Homo Sapiens
KKVYLSSDT

SEQ ID NO: 839424 - protein, 9 aa, Homo Sapiens
NERIAPKVL

SEQ ID NO: 839425 - protein, 9 aa, Homo Sapiens
KLMEEQYRT

SEQ ID NO: 839426 - protein, 9 aa, Homo Sapiens
REALSNGQN

SEQ ID NO: 839427 - protein, 9 aa, Homo Sapiens
AEVAEGVFE

SEQ ID NO: 839428 - protein, 9 aa, Homo Sapiens
SLPHLIQTT

SEQ ID NO: 839429 - protein, 9 aa, Homo Sapiens
PSRTVLFEW

SEQ ID NO: 839430 - protein, 9 aa, Homo Sapiens
LKNDTSDVL

SEQ ID NO: 839431 - protein, 9 aa, Homo Sapiens
TGALQLYFR

SEQ ID NO: 839432 - protein, 9 aa, Homo Sapiens
QPIDRQAFK

SEQ ID NO: 839433 - protein, 9 aa, Homo Sapiens
DLLFVSKLF

SEQ ID NO: 839434 - protein, 9 aa, Homo Sapiens
DTLRTLSLV

SEQ ID NO: 839435 - protein, 9 aa, Homo Sapiens
EILLNINGI

SEQ ID NO: 839436 - protein, 9 aa, Homo Sapiens
VSRLKTVIS

SEQ ID NO: 839437 - protein, 9 aa, Homo Sapiens
CLHPWNTWP

SEQ ID NO: 839438 - protein, 9 aa, Homo Sapiens
AEQVLSDKE

SEQ ID NO: 839439 - protein, 9 aa, Homo Sapiens
HAAKCIPAM

SEQ ID NO: 839440 - protein, 9 aa, Homo Sapiens
LDIAHAFTK

SEQ ID NO: 839441 - protein, 9 aa, Homo Sapiens
LLKTVEGRE

SEQ ID NO: 839442 - protein, 9 aa, Homo Sapiens
KAMENFMQQ

SEQ ID NO: 839443 - protein, 9 aa, Homo Sapiens
YTVPSTIVI

SEQ ID NO: 839444 - protein, 9 aa, Homo Sapiens
SLIQDNEVL

SEQ ID NO: 839445 - protein, 9 aa, Homo Sapiens
FSPLNNADS

SEQ ID NO: 839446 - protein, 9 aa, Homo Sapiens
IKNKSSDTL

SEQ ID NO: 839447 - protein, 9 aa, Homo Sapiens
VLVQFKGMC

SEQ ID NO: 839448 - protein, 9 aa, Homo Sapiens
YKIIYTGEE

SEQ ID NO: 839449 - protein, 9 aa, Homo Sapiens
QTIQGAHAA

SEQ ID NO: 839450 - protein, 9 aa, Homo Sapiens
QHMVQNGYY

SEQ ID NO: 839451 - protein, 9 aa, Homo Sapiens
EEAVCTTIQ

SEQ ID NO: 839452 - protein, 9 aa, Homo Sapiens
IVSASRDTT

SEQ ID NO: 839453 - protein, 9 aa, Homo Sapiens
VHASKISRN

SEQ ID NO: 839454 - protein, 9 aa, Homo Sapiens
SMIKCLDYK

SEQ ID NO: 839455 - protein, 9 aa, Homo Sapiens
VYLSSRDRH

SEQ ID NO: 839456 - protein, 9 aa, Homo Sapiens
KVGTEPLRS

SEQ ID NO: 839457 - protein, 9 aa, Homo Sapiens
VLHTLRNYL

SEQ ID NO: 839458 - protein, 9 aa, Homo Sapiens
TIFRKSRIS

SEQ ID NO: 839459 - protein, 9 aa, Homo Sapiens
ENFHFMLRD

SEQ ID NO: 839460 - protein, 9 aa, Homo Sapiens
QLNKSLLKI

SEQ ID NO: 839461 - protein, 9 aa, Homo Sapiens
HPASKLVVT

SEQ ID NO: 839462 - protein, 9 aa, Homo Sapiens
WRGLRLQKR

SEQ ID NO: 839463 - protein, 9 aa, Homo Sapiens
ARRSKSQYS

SEQ ID NO: 839464 - protein, 9 aa, Homo Sapiens
WLEKLSSNI

SEQ ID NO: 839465 - protein, 9 aa, Homo Sapiens
VPKVGFFCP

SEQ ID NO: 839466 - protein, 9 aa, Homo Sapiens
DPGSFVEND

SEQ ID NO: 839467 - protein, 9 aa, Homo Sapiens
VDMLTLVFL

SEQ ID NO: 839468 - protein, 9 aa, Homo Sapiens
HRPNQHNAV

SEQ ID NO: 839469 - protein, 9 aa, Homo Sapiens
KNKILQGKL

SEQ ID NO: 839470 - protein, 9 aa, Homo Sapiens
ASKESKNGK

SEQ ID NO: 839471 - protein, 9 aa, Homo Sapiens
PAYPAAAAS

SEQ ID NO: 839472 - protein, 9 aa, Homo Sapiens
VTYNVAQYI

SEQ ID NO: 839473 - protein, 9 aa, Homo Sapiens
NVLKVLTNK

SEQ ID NO: 839474 - protein, 9 aa, Homo Sapiens
IILSVIYPG

SEQ ID NO: 839475 - protein, 9 aa, Homo Sapiens
WQYPEAVLL

SEQ ID NO: 839476 - protein, 9 aa, Homo Sapiens
SHFHNIFWS

SEQ ID NO: 839477 - protein, 9 aa, Homo Sapiens
DIGNKIKYD

SEQ ID NO: 839478 - protein, 9 aa, Homo Sapiens
SYTMKPNTK

SEQ ID NO: 839479 - protein, 9 aa, Homo Sapiens
NAYQFMLAD

SEQ ID NO: 839480 - protein, 9 aa, Homo Sapiens
LKQRKDILQ

SEQ ID NO: 839481 - protein, 9 aa, Homo Sapiens
ILTSSVTVG

SEQ ID NO: 839482 - protein, 9 aa, Homo Sapiens
GGNQLFEYT

SEQ ID NO: 839483 - protein, 9 aa, Homo Sapiens
ISKKPTMLA

SEQ ID NO: 839484 - protein, 9 aa, Homo Sapiens
LLDKNTFEF

SEQ ID NO: 839485 - protein, 9 aa, Homo Sapiens
IPPELQIAL

SEQ ID NO: 839486 - protein, 9 aa, Homo Sapiens
LNPKCRNVF

SEQ ID NO: 839487 - protein, 9 aa, Homo Sapiens
STNQSHNPA

SEQ ID NO: 839488 - protein, 9 aa, Homo Sapiens
EEGLYPDPG

SEQ ID NO: 839489 - protein, 9 aa, Homo Sapiens
GPSGSTGFG

SEQ ID NO: 839490 - protein, 9 aa, Homo Sapiens
TTNGRGCTD

SEQ ID NO: 839491 - protein, 9 aa, Homo Sapiens
KEITVGQLI

SEQ ID NO: 839492 - protein, 9 aa, Homo Sapiens
NHLYAAILG

SEQ ID NO: 839493 - protein, 9 aa, Homo Sapiens
LLDTCFTLH

SEQ ID NO: 839494 - protein, 9 aa, Homo Sapiens
KAAEEQGYD

SEQ ID NO: 839495 - protein, 9 aa, Homo Sapiens
GNAQKAVEF

SEQ ID NO: 839496 - protein, 9 aa, Homo Sapiens
LENFSSKII

SEQ ID NO: 839497 - protein, 9 aa, Homo Sapiens
CQDSMDVMV

SEQ ID NO: 839498 - protein, 9 aa, Homo Sapiens
NLVKEWIRK

SEQ ID NO: 839499 - protein, 9 aa, Homo Sapiens
MNLNNFISM

SEQ ID NO: 839500 - protein, 9 aa, Homo Sapiens
KQIKEEIKK

SEQ ID NO: 839501 - protein, 9 aa, Homo Sapiens
QSFKKTKTS

SEQ ID NO: 839502 - protein, 9 aa, Homo Sapiens
TLQIRRLGE

SEQ ID NO: 839503 - protein, 9 aa, Homo Sapiens
WNFPSMSKL

SEQ ID NO: 839504 - protein, 9 aa, Homo Sapiens
FDIFNSDSD

SEQ ID NO: 839505 - protein, 9 aa, Homo Sapiens
QVLAPAWHL

SEQ ID NO: 839506 - protein, 9 aa, Homo Sapiens
GQSQVKEIN

SEQ ID NO: 839507 - protein, 9 aa, Homo Sapiens
DSVRNSKID

SEQ ID NO: 839508 - protein, 9 aa, Homo Sapiens
DFSRTRNIR

SEQ ID NO: 839509 - protein, 9 aa, Homo Sapiens
LSNASSQRT

SEQ ID NO: 839510 - protein, 9 aa, Homo Sapiens
LEIKRRYHF

SEQ ID NO: 839511 - protein, 9 aa, Homo Sapiens
HYPAFTRGV

SEQ ID NO: 839512 - protein, 9 aa, Homo Sapiens
DKLYGVKFR

SEQ ID NO: 839513 - protein, 9 aa, Homo Sapiens
GVMQKHSSS

SEQ ID NO: 839514 - protein, 9 aa, Homo Sapiens
TATFYHRYY

SEQ ID NO: 839515 - protein, 9 aa, Homo Sapiens
PLRVSKRKS

SEQ ID NO: 839516 - protein, 9 aa, Homo Sapiens
CLEHDRIAK

SEQ ID NO: 839517 - protein, 9 aa, Homo Sapiens
ALEARIHKE

SEQ ID NO: 839518 - protein, 9 aa, Homo Sapiens
PPSTSSQEK

SEQ ID NO: 839519 - protein, 9 aa, Homo Sapiens
ALFGGEPKH

SEQ ID NO: 839520 - protein, 9 aa, Homo Sapiens
DVAKEASNI

SEQ ID NO: 839521 - protein, 9 aa, Homo Sapiens
KEIRDQIQR

SEQ ID NO: 839522 - protein, 9 aa, Homo Sapiens
EILEKCKRL

SEQ ID NO: 839523 - protein, 9 aa, Homo Sapiens
LEIMKEWKN

SEQ ID NO: 839524 - protein, 9 aa, Homo Sapiens
ENINMLSEE

SEQ ID NO: 839525 - protein, 9 aa, Homo Sapiens
ISCGNVRGN

SEQ ID NO: 839526 - protein, 9 aa, Homo Sapiens
AVNTFLRQL

SEQ ID NO: 839527 - protein, 9 aa, Homo Sapiens
KESAVTVMF

SEQ ID NO: 839528 - protein, 9 aa, Homo Sapiens
PTPDQDTGY

SEQ ID NO: 839529 - protein, 9 aa, Homo Sapiens
LKTPYFDVG

SEQ ID NO: 839530 - protein, 9 aa, Homo Sapiens
ITEEERRVA

SEQ ID NO: 839531 - protein, 9 aa, Homo Sapiens
QNNNPPNND

SEQ ID NO: 839532 - protein, 9 aa, Homo Sapiens
NKRFEQAQH

SEQ ID NO: 839533 - protein, 9 aa, Homo Sapiens
SNSWDKAHV

SEQ ID NO: 839534 - protein, 9 aa, Homo Sapiens
QAGAWGFPR

SEQ ID NO: 839535 - protein, 9 aa, Homo Sapiens
VSTFEGCPA

SEQ ID NO: 839536 - protein, 9 aa, Homo Sapiens
VTAKFKETR

SEQ ID NO: 839537 - protein, 9 aa, Homo Sapiens
AKLYISDLW

SEQ ID NO: 839538 - protein, 9 aa, Homo Sapiens
GVWQDIIYG

SEQ ID NO: 839539 - protein, 9 aa, Homo Sapiens
VFEFMVYKV

SEQ ID NO: 839540 - protein, 9 aa, Homo Sapiens
QEHIHRERE

SEQ ID NO: 839541 - protein, 9 aa, Homo Sapiens
PVYISPEVL

SEQ ID NO: 839542 - protein, 9 aa, Homo Sapiens
SPEPPIVQP

SEQ ID NO: 839543 - protein, 9 aa, Homo Sapiens
NVKAVKFPN

SEQ ID NO: 839544 - protein, 9 aa, Homo Sapiens
HMVILFTHK

SEQ ID NO: 839545 - protein, 9 aa, Homo Sapiens
RDVLTPFPG

SEQ ID NO: 839546 - protein, 9 aa, Homo Sapiens
IQLARRICG

SEQ ID NO: 839547 - protein, 9 aa, Homo Sapiens
EFWLGLKNI

SEQ ID NO: 839548 - protein, 9 aa, Homo Sapiens
VRFYMEKET

SEQ ID NO: 839549 - protein, 9 aa, Homo Sapiens
RLSHCTVHI

SEQ ID NO: 839550 - protein, 9 aa, Homo Sapiens
ASFGVCRLI

SEQ ID NO: 839551 - protein, 9 aa, Homo Sapiens
TVKGVTFYG

SEQ ID NO: 839552 - protein, 9 aa, Homo Sapiens
NTKDLSEAD

SEQ ID NO: 839553 - protein, 9 aa, Homo Sapiens
TMPREVEEI

SEQ ID NO: 839554 - protein, 9 aa, Homo Sapiens
SKIKKIVYS

SEQ ID NO: 839555 - protein, 9 aa, Homo Sapiens
RINYYCTTG

SEQ ID NO: 839556 - protein, 9 aa, Homo Sapiens
RCDAGMCRA

SEQ ID NO: 839557 - protein, 9 aa, Homo Sapiens
SRKEEKPTD

SEQ ID NO: 839558 - protein, 9 aa, Homo Sapiens
ESEVSRISK

SEQ ID NO: 839559 - protein, 9 aa, Homo Sapiens
FNVETVEYN

SEQ ID NO: 839560 - protein, 9 aa, Homo Sapiens
SECEGFEYI

SEQ ID NO: 839561 - protein, 9 aa, Homo Sapiens
PCFIVYSYK

SEQ ID NO: 839562 - protein, 9 aa, Homo Sapiens
QKFLGSKRS

SEQ ID NO: 839563 - protein, 9 aa, Homo Sapiens
ALNTNIRAL

SEQ ID NO: 839564 - protein, 9 aa, Homo Sapiens
QEEPAENSV

SEQ ID NO: 839565 - protein, 9 aa, Homo Sapiens
TDYDIQFYM

SEQ ID NO: 839566 - protein, 9 aa, Homo Sapiens
FVSGCTISM

SEQ ID NO: 839567 - protein, 9 aa, Homo Sapiens
YCGNCKTTL

SEQ ID NO: 839568 - protein, 9 aa, Homo Sapiens
CSLQKHDIP

SEQ ID NO: 839569 - protein, 9 aa, Homo Sapiens
AHIIAAVKD

SEQ ID NO: 839570 - protein, 9 aa, Homo Sapiens
ANVTQTVHC

SEQ ID NO: 839571 - protein, 9 aa, Homo Sapiens
KCLEEKNKI

SEQ ID NO: 839572 - protein, 9 aa, Homo Sapiens
PPRNPSTLC

SEQ ID NO: 839573 - protein, 9 aa, Homo Sapiens
AGNDLYDGS

SEQ ID NO: 839574 - protein, 9 aa, Homo Sapiens
YDSSSWPQS

SEQ ID NO: 839575 - protein, 9 aa, Homo Sapiens
RAFSICFTD

SEQ ID NO: 839576 - protein, 9 aa, Homo Sapiens
THHLRDCMD

SEQ ID NO: 839577 - protein, 9 aa, Homo Sapiens
FKIQRTEPS

SEQ ID NO: 839578 - protein, 9 aa, Homo Sapiens
MSHKNFHAD

SEQ ID NO: 839579 - protein, 9 aa, Homo Sapiens
PSSCLMGRH

SEQ ID NO: 839580 - protein, 9 aa, Homo Sapiens
KTSSLIPTH

SEQ ID NO: 839581 - protein, 9 aa, Homo Sapiens
LCHFGFEVY

SEQ ID NO: 839582 - protein, 9 aa, Homo Sapiens
MFFGPEIKL

SEQ ID NO: 839583 - protein, 9 aa, Homo Sapiens
TGSWSRAAF

SEQ ID NO: 839584 - protein, 9 aa, Homo Sapiens
LFRAIQELM

SEQ ID NO: 839585 - protein, 9 aa, Homo Sapiens
MAQQHHVGK

SEQ ID NO: 839586 - protein, 9 aa, Homo Sapiens
LSSNTLQVS

SEQ ID NO: 839587 - protein, 9 aa, Homo Sapiens
LKMATNRTG

SEQ ID NO: 839588 - protein, 9 aa, Homo Sapiens
TLCHFGFEV

SEQ ID NO: 839589 - protein, 9 aa, Homo Sapiens
LDAVLICFD

SEQ ID NO: 839590 - protein, 9 aa, Homo Sapiens
WFVLSVYLL

SEQ ID NO: 839591 - protein, 9 aa, Homo Sapiens
QQKVISLFY

SEQ ID NO: 839592 - protein, 9 aa, Homo Sapiens
KQFLIQLRK

SEQ ID NO: 839593 - protein, 9 aa, Homo Sapiens
PAHRDHLQF

SEQ ID NO: 839594 - protein, 9 aa, Homo Sapiens
SEFIQALHP

SEQ ID NO: 839595 - protein, 9 aa, Homo Sapiens
FHNVQQIGI

SEQ ID NO: 839596 - protein, 9 aa, Homo Sapiens
DALCLAYQT

SEQ ID NO: 839597 - protein, 9 aa, Homo Sapiens
VCSCKAESS

SEQ ID NO: 839598 - protein, 9 aa, Homo Sapiens
RSAGDHAHG

SEQ ID NO: 839599 - protein, 9 aa, Homo Sapiens
RCHVVRKLG

SEQ ID NO: 839600 - protein, 9 aa, Homo Sapiens
IIPLIWIDH

SEQ ID NO: 839601 - protein, 9 aa, Homo Sapiens
VQETSFENM

SEQ ID NO: 839602 - protein, 9 aa, Homo Sapiens
KQKQTNLNE

SEQ ID NO: 839603 - protein, 9 aa, Homo Sapiens
NMDNFCSDT

SEQ ID NO: 839604 - protein, 9 aa, Homo Sapiens
ELDHIKKAS

SEQ ID NO: 839605 - protein, 9 aa, Homo Sapiens
HFHPESRSS

SEQ ID NO: 839606 - protein, 9 aa, Homo Sapiens
TYNVDKKQG

SEQ ID NO: 839607 - protein, 9 aa, Homo Sapiens
LGSGALAFE

SEQ ID NO: 839608 - protein, 9 aa, Homo Sapiens
ELKTDGSPN

SEQ ID NO: 839609 - protein, 9 aa, Homo Sapiens
IMPAWQKLS

SEQ ID NO: 839610 - protein, 9 aa, Homo Sapiens
HQYPGVCYP

SEQ ID NO: 839611 - protein, 9 aa, Homo Sapiens
TDEFKNDLL

SEQ ID NO: 839612 - protein, 9 aa, Homo Sapiens
FYYEQQLLR

SEQ ID NO: 839613 - protein, 9 aa, Homo Sapiens
TLYRDVTKN

SEQ ID NO: 839614 - protein, 9 aa, Homo Sapiens
RRSTSIDRL

SEQ ID NO: 839615 - protein, 9 aa, Homo Sapiens
SFHSRTLGK

SEQ ID NO: 839616 - protein, 9 aa, Homo Sapiens
NSSSAWSAV

SEQ ID NO: 839617 - protein, 9 aa, Homo Sapiens
NMPLTHFFK

SEQ ID NO: 839618 - protein, 9 aa, Homo Sapiens
MIWTIILHF

SEQ ID NO: 839619 - protein, 9 aa, Homo Sapiens
QGLLITTSL

SEQ ID NO: 839620 - protein, 9 aa, Homo Sapiens
LIYPRHCDP

SEQ ID NO: 839621 - protein, 9 aa, Homo Sapiens
DVYGHHHSQ

SEQ ID NO: 839622 - protein, 9 aa, Homo Sapiens
SLDGDKLEL

SEQ ID NO: 839623 - protein, 9 aa, Homo Sapiens
PPIHAYGNI

SEQ ID NO: 839624 - protein, 9 aa, Homo Sapiens
LFPDAVSDK

SEQ ID NO: 839625 - protein, 9 aa, Homo Sapiens
LEGADYVSS

SEQ ID NO: 839626 - protein, 9 aa, Homo Sapiens
GFLEVLKED

SEQ ID NO: 839627 - protein, 9 aa, Homo Sapiens
QGEKQYYSD

SEQ ID NO: 839628 - protein, 9 aa, Homo Sapiens
GLQEQQEHE

SEQ ID NO: 839629 - protein, 9 aa, Homo Sapiens
IFGKVKKIQ

SEQ ID NO: 839630 - protein, 9 aa, Homo Sapiens
ALDKEPVPM

SEQ ID NO: 839631 - protein, 9 aa, Homo Sapiens
PAKNLFKKA

SEQ ID NO: 839632 - protein, 9 aa, Homo Sapiens
GHVVKCYRG

SEQ ID NO: 839633 - protein, 9 aa, Homo Sapiens
QMCLTSDIY

SEQ ID NO: 839634 - protein, 9 aa, Homo Sapiens
FCDKSHLLR

SEQ ID NO: 839635 - protein, 9 aa, Homo Sapiens
IDWDPQPLG

SEQ ID NO: 839636 - protein, 9 aa, Homo Sapiens
KRKEEELRQ

SEQ ID NO: 839637 - protein, 9 aa, Homo Sapiens
SLEQPPHGS

SEQ ID NO: 839638 - protein, 9 aa, Homo Sapiens
IKTLHGSVH

SEQ ID NO: 839639 - protein, 9 aa, Homo Sapiens
NTIAAEFKK

SEQ ID NO: 839640 - protein, 9 aa, Homo Sapiens
YDTLFRKYN

SEQ ID NO: 839641 - protein, 9 aa, Homo Sapiens
TTKCVVVGD

SEQ ID NO: 839642 - protein, 9 aa, Homo Sapiens
HFLPGKDLT

SEQ ID NO: 839643 - protein, 9 aa, Homo Sapiens
QSIAAQEEM

SEQ ID NO: 839644 - protein, 9 aa, Homo Sapiens
IHKEMMPRR

SEQ ID NO: 839645 - protein, 9 aa, Homo Sapiens
ITFHAVKKH

SEQ ID NO: 839646 - protein, 9 aa, Homo Sapiens
DKPEAFTAN

SEQ ID NO: 839647 - protein, 9 aa, Homo Sapiens
QKTMYLQQY

SEQ ID NO: 839648 - protein, 9 aa, Homo Sapiens
PRAGPSVGV

SEQ ID NO: 839649 - protein, 9 aa, Homo Sapiens
VSPGSITKE

SEQ ID NO: 839650 - protein, 9 aa, Homo Sapiens
DTSESSAAD

SEQ ID NO: 839651 - protein, 9 aa, Homo Sapiens
MELIIETQK

SEQ ID NO: 839652 - protein, 9 aa, Homo Sapiens
ETNSNAYML

SEQ ID NO: 839653 - protein, 9 aa, Homo Sapiens
GTNFTKLEN

SEQ ID NO: 839654 - protein, 9 aa, Homo Sapiens
QNYEEKGKR

SEQ ID NO: 839655 - protein, 9 aa, Homo Sapiens
QETTDIKEL

SEQ ID NO: 839656 - protein, 9 aa, Homo Sapiens
ILEKVAATL

SEQ ID NO: 839657 - protein, 9 aa, Homo Sapiens
GSLRAMALP

SEQ ID NO: 839658 - protein, 9 aa, Homo Sapiens
SVTVGTAEE

SEQ ID NO: 839659 - protein, 9 aa, Homo Sapiens
RAANNVPRQ

SEQ ID NO: 839660 - protein, 9 aa, Homo Sapiens
INMAGNVAE

SEQ ID NO: 839661 - protein, 9 aa, Homo Sapiens
IDILNKRLT

SEQ ID NO: 839662 - protein, 9 aa, Homo Sapiens
TSLVTTPTS

SEQ ID NO: 839663 - protein, 9 aa, Homo Sapiens
SIKQVGNGS

SEQ ID NO: 839664 - protein, 9 aa, Homo Sapiens
MELAHGPDT

SEQ ID NO: 839665 - protein, 9 aa, Homo Sapiens
WPTLVAAVH

SEQ ID NO: 839666 - protein, 9 aa, Homo Sapiens
QSKGITFEI

SEQ ID NO: 839667 - protein, 9 aa, Homo Sapiens
PLKDKLCQY

SEQ ID NO: 839668 - protein, 9 aa, Homo Sapiens
QSPKSLRLK

SEQ ID NO: 839669 - protein, 9 aa, Homo Sapiens
ESVRWISQG

SEQ ID NO: 839670 - protein, 9 aa, Homo Sapiens
QLMLIRQDL

SEQ ID NO: 839671 - protein, 9 aa, Homo Sapiens
MVLLVLMAY

SEQ ID NO: 839672 - protein, 9 aa, Homo Sapiens
EVGVHGIQI

SEQ ID NO: 839673 - protein, 9 aa, Homo Sapiens
AGFTIIYKW

SEQ ID NO: 839674 - protein, 9 aa, Homo Sapiens
SERVVDYIV

SEQ ID NO: 839675 - protein, 9 aa, Homo Sapiens
ECFGGKEAV

SEQ ID NO: 839676 - protein, 9 aa, Homo Sapiens
VPINNQVFL

SEQ ID NO: 839677 - protein, 9 aa, Homo Sapiens
AVVITVGGA

SEQ ID NO: 839678 - protein, 9 aa, Homo Sapiens
RCVTFHLPE

SEQ ID NO: 839679 - protein, 9 aa, Homo Sapiens
CTHTHTHTV

SEQ ID NO: 839680 - protein, 9 aa, Homo Sapiens
LAIVQDILH

SEQ ID NO: 839681 - protein, 9 aa, Homo Sapiens
KRYKCDVCG

SEQ ID NO: 839682 - protein, 9 aa, Homo Sapiens
LDDRIIRTY

SEQ ID NO: 839683 - protein, 9 aa, Homo Sapiens
QDKFLTCDE

SEQ ID NO: 839684 - protein, 9 aa, Homo Sapiens
IEQKCKAVG

SEQ ID NO: 839685 - protein, 9 aa, Homo Sapiens
IKAELPLGA

SEQ ID NO: 839686 - protein, 9 aa, Homo Sapiens
VAGQLQEPR

SEQ ID NO: 839687 - protein, 9 aa, Homo Sapiens
VKIVQCHEH

SEQ ID NO: 839688 - protein, 9 aa, Homo Sapiens
EDTAGSQTG

SEQ ID NO: 839689 - protein, 9 aa, Homo Sapiens
FALVYAITA

SEQ ID NO: 839690 - protein, 9 aa, Homo Sapiens
GLNPTDAPH

SEQ ID NO: 839691 - protein, 9 aa, Homo Sapiens
SKKNLLEGE

SEQ ID NO: 839692 - protein, 9 aa, Homo Sapiens
LDPLHPDAN

SEQ ID NO: 839693 - protein, 9 aa, Homo Sapiens
FDQKYLFAN

SEQ ID NO: 839694 - protein, 9 aa, Homo Sapiens
RETLYSNAS

SEQ ID NO: 839695 - protein, 9 aa, Homo Sapiens
FILQNVMWF

SEQ ID NO: 839696 - protein, 9 aa, Homo Sapiens
LIELENWTE

SEQ ID NO: 839697 - protein, 9 aa, Homo Sapiens
PSIYINNVV

SEQ ID NO: 839698 - protein, 9 aa, Homo Sapiens
VDLVREGLS

SEQ ID NO: 839699 - protein, 9 aa, Homo Sapiens
SFTAYESQG

SEQ ID NO: 839700 - protein, 9 aa, Homo Sapiens
KHPERRMEG

SEQ ID NO: 839701 - protein, 9 aa, Homo Sapiens
NGEGSTFST

SEQ ID NO: 839702 - protein, 9 aa, Homo Sapiens
KIQEFANLT

SEQ ID NO: 839703 - protein, 9 aa, Homo Sapiens
LQEICTLKK

SEQ ID NO: 839704 - protein, 9 aa, Homo Sapiens
SECSNVMIC

SEQ ID NO: 839705 - protein, 9 aa, Homo Sapiens
GGLTAVVWT

SEQ ID NO: 839706 - protein, 9 aa, Homo Sapiens
ENIKGPLFR

SEQ ID NO: 839707 - protein, 9 aa, Homo Sapiens
CQAALLPSD

SEQ ID NO: 839708 - protein, 9 aa, Homo Sapiens
PRRWLHSSC

SEQ ID NO: 839709 - protein, 9 aa, Homo Sapiens
LYGLLPWTN

SEQ ID NO: 839710 - protein, 9 aa, Homo Sapiens
MSCSENCLS

SEQ ID NO: 839711 - protein, 9 aa, Homo Sapiens
RERMMTWLA

SEQ ID NO: 839712 - protein, 9 aa, Homo Sapiens
DSPPALIVS

SEQ ID NO: 839713 - protein, 9 aa, Homo Sapiens
EIKNNEIEE

SEQ ID NO: 839714 - protein, 9 aa, Homo Sapiens
MTMYYPGIV

SEQ ID NO: 839715 - protein, 9 aa, Homo Sapiens
NNEGSLNIL

SEQ ID NO: 839716 - protein, 9 aa, Homo Sapiens
PPGPPGSPF

SEQ ID NO: 839717 - protein, 9 aa, Homo Sapiens
EDMDTHVKT

SEQ ID NO: 839718 - protein, 9 aa, Homo Sapiens
TRITLLVHT

SEQ ID NO: 839719 - protein, 9 aa, Homo Sapiens
LKIADIFES

SEQ ID NO: 839720 - protein, 9 aa, Homo Sapiens
GCYALVTSF

SEQ ID NO: 839721 - protein, 9 aa, Homo Sapiens
KLILLLLFL

SEQ ID NO: 839722 - protein, 9 aa, Homo Sapiens
PLRLQMRLK

SEQ ID NO: 839723 - protein, 9 aa, Homo Sapiens
RVRSHSWKI

SEQ ID NO: 839724 - protein, 9 aa, Homo Sapiens
IINHFFGTV

SEQ ID NO: 839725 - protein, 9 aa, Homo Sapiens
KHSHRLYYN

SEQ ID NO: 839726 - protein, 9 aa, Homo Sapiens
EGTVEIKLE

SEQ ID NO: 839727 - protein, 9 aa, Homo Sapiens
IIHRLLETS

SEQ ID NO: 839728 - protein, 9 aa, Homo Sapiens
CDQLSTTVN

SEQ ID NO: 839729 - protein, 9 aa, Homo Sapiens
KTYTGHNNE

SEQ ID NO: 839730 - protein, 9 aa, Homo Sapiens
TALAQASAV

SEQ ID NO: 839731 - protein, 9 aa, Homo Sapiens
LEYYQNKMA

SEQ ID NO: 839732 - protein, 9 aa, Homo Sapiens
EGMHLSQET

SEQ ID NO: 839733 - protein, 9 aa, Homo Sapiens
YSEERLLRG

SEQ ID NO: 839734 - protein, 9 aa, Homo Sapiens
QLRENNFDE

SEQ ID NO: 839735 - protein, 9 aa, Homo Sapiens
DRDDGVNGE

SEQ ID NO: 839736 - protein, 9 aa, Homo Sapiens
VPELCNHSE

SEQ ID NO: 839737 - protein, 9 aa, Homo Sapiens
PGMVADAER

SEQ ID NO: 839738 - protein, 9 aa, Homo Sapiens
KPTDDTPSS

SEQ ID NO: 839739 - protein, 9 aa, Homo Sapiens
DVDDTQCVW

SEQ ID NO: 839740 - protein, 9 aa, Homo Sapiens
LQILPVLNF

SEQ ID NO: 839741 - protein, 9 aa, Homo Sapiens
PFKPPQVAF

SEQ ID NO: 839742 - protein, 9 aa, Homo Sapiens
KEADKLLTE

SEQ ID NO: 839743 - protein, 9 aa, Homo Sapiens
ELFDRTETR

SEQ ID NO: 839744 - protein, 9 aa, Homo Sapiens
RSWLQDGLK

SEQ ID NO: 839745 - protein, 9 aa, Homo Sapiens
RDIHTLGFP

SEQ ID NO: 839746 - protein, 9 aa, Homo Sapiens
DLEPFLQRL

SEQ ID NO: 839747 - protein, 9 aa, Homo Sapiens
KVWSRTAYL

SEQ ID NO: 839748 - protein, 9 aa, Homo Sapiens
EYEEQKKYN

SEQ ID NO: 839749 - protein, 9 aa, Homo Sapiens
AKNSAESHG

SEQ ID NO: 839750 - protein, 9 aa, Homo Sapiens
SYDAILYYK

SEQ ID NO: 839751 - protein, 9 aa, Homo Sapiens
VFRIKDDIV

SEQ ID NO: 839752 - protein, 9 aa, Homo Sapiens
KQLQFEGER

SEQ ID NO: 839753 - protein, 9 aa, Homo Sapiens
LQWLLSKAN

SEQ ID NO: 839754 - protein, 9 aa, Homo Sapiens
ASLEGLMKH

SEQ ID NO: 839755 - protein, 9 aa, Homo Sapiens
AKTDTKKES

SEQ ID NO: 839756 - protein, 9 aa, Homo Sapiens
KSYLRKNSS

SEQ ID NO: 839757 - protein, 9 aa, Homo Sapiens
AQEASASEV

SEQ ID NO: 839758 - protein, 9 aa, Homo Sapiens
RVFLGRESP

SEQ ID NO: 839759 - protein, 9 aa, Homo Sapiens
IGPVTNQKA

SEQ ID NO: 839760 - protein, 9 aa, Homo Sapiens
AGQGSHSQQ

SEQ ID NO: 839761 - protein, 9 aa, Homo Sapiens
LEKSSVLHH

SEQ ID NO: 839762 - protein, 9 aa, Homo Sapiens
LQPQPQQSL

SEQ ID NO: 839763 - protein, 9 aa, Homo Sapiens
LQEEIDTVL

SEQ ID NO: 839764 - protein, 9 aa, Homo Sapiens
FSDHVTFSQ

SEQ ID NO: 839765 - protein, 9 aa, Homo Sapiens
ESVLNLGKV

SEQ ID NO: 839766 - protein, 9 aa, Homo Sapiens
LQFASSPLR

SEQ ID NO: 839767 - protein, 9 aa, Homo Sapiens
VNLNGSKKE

SEQ ID NO: 839768 - protein, 9 aa, Homo Sapiens
EWQCTACKK

SEQ ID NO: 839769 - protein, 9 aa, Homo Sapiens
YRTCMMEYP

SEQ ID NO: 839770 - protein, 9 aa, Homo Sapiens
VKKLITAQQ

SEQ ID NO: 839771 - protein, 9 aa, Homo Sapiens
LLGEVKRRL

SEQ ID NO: 839772 - protein, 9 aa, Homo Sapiens
CDVAGCSKV

SEQ ID NO: 839773 - protein, 9 aa, Homo Sapiens
ENASCGLCG

SEQ ID NO: 839774 - protein, 9 aa, Homo Sapiens
RRGRGCPPQ

SEQ ID NO: 839775 - protein, 9 aa, Homo Sapiens
STRASGMTK

SEQ ID NO: 839776 - protein, 9 aa, Homo Sapiens
LDQFMKLTF

SEQ ID NO: 839777 - protein, 9 aa, Homo Sapiens
CSNVMICET

SEQ ID NO: 839778 - protein, 9 aa, Homo Sapiens
INFWDKVLE

SEQ ID NO: 839779 - protein, 9 aa, Homo Sapiens
CLIQLLNSS

SEQ ID NO: 839780 - protein, 9 aa, Homo Sapiens
LMEYLDRNK

SEQ ID NO: 839781 - protein, 9 aa, Homo Sapiens
IFEDPDWRD

SEQ ID NO: 839782 - protein, 9 aa, Homo Sapiens
LRHVGIFLD

SEQ ID NO: 839783 - protein, 9 aa, Homo Sapiens
PEYGDTAIL

SEQ ID NO: 839784 - protein, 9 aa, Homo Sapiens
HLARHQTIH

SEQ ID NO: 839785 - protein, 9 aa, Homo Sapiens
ASDVVRIFN

SEQ ID NO: 839786 - protein, 9 aa, Homo Sapiens
AALCPRKFP

SEQ ID NO: 839787 - protein, 9 aa, Homo Sapiens
SKIMKSIGE

SEQ ID NO: 839788 - protein, 9 aa, Homo Sapiens
IQGSLFKLC

SEQ ID NO: 839789 - protein, 9 aa, Homo Sapiens
SVLDNHHLS

SEQ ID NO: 839790 - protein, 9 aa, Homo Sapiens
MELHGFWMD

SEQ ID NO: 839791 - protein, 9 aa, Homo Sapiens
QGENQIITR

SEQ ID NO: 839792 - protein, 9 aa, Homo Sapiens
GNTVIHLYQ

SEQ ID NO: 839793 - protein, 9 aa, Homo Sapiens
QLLEAWNNE

SEQ ID NO: 839794 - protein, 9 aa, Homo Sapiens
ILKGSGVDA

SEQ ID NO: 839795 - protein, 9 aa, Homo Sapiens
LYQYFENFY

SEQ ID NO: 839796 - protein, 9 aa, Homo Sapiens
ARVPLGITM

SEQ ID NO: 839797 - protein, 9 aa, Homo Sapiens
LEQIIRTCS

SEQ ID NO: 839798 - protein, 9 aa, Homo Sapiens
SEKKKKSDD

SEQ ID NO: 839799 - protein, 9 aa, Homo Sapiens
SCINHEKMH

SEQ ID NO: 839800 - protein, 9 aa, Homo Sapiens
CTFETARHN

SEQ ID NO: 839801 - protein, 9 aa, Homo Sapiens
VKYQSLNKQ

SEQ ID NO: 839802 - protein, 9 aa, Homo Sapiens
RMLHVVQTL

SEQ ID NO: 839803 - protein, 9 aa, Homo Sapiens
MVPVSQPFV

SEQ ID NO: 839804 - protein, 9 aa, Homo Sapiens
FPDDLSYCW

SEQ ID NO: 839805 - protein, 9 aa, Homo Sapiens
GIVIYFARA

SEQ ID NO: 839806 - protein, 9 aa, Homo Sapiens
VLFFFRRVQ

SEQ ID NO: 839807 - protein, 9 aa, Homo Sapiens
LCVCTCVCV

SEQ ID NO: 839808 - protein, 9 aa, Homo Sapiens
LSRGLVLKI

SEQ ID NO: 839809 - protein, 9 aa, Homo Sapiens
EILENNSSV

SEQ ID NO: 839810 - protein, 9 aa, Homo Sapiens
FRELAEDKR

SEQ ID NO: 839811 - protein, 9 aa, Homo Sapiens
GTLYTSSSP

SEQ ID NO: 839812 - protein, 9 aa, Homo Sapiens
QLCLAQEAA

SEQ ID NO: 839813 - protein, 9 aa, Homo Sapiens
GFLPPARPR

SEQ ID NO: 839814 - protein, 9 aa, Homo Sapiens
ACWDLTLFL

SEQ ID NO: 839815 - protein, 9 aa, Homo Sapiens
SGLSCAGRY

SEQ ID NO: 839816 - protein, 9 aa, Homo Sapiens
ILRFHENHC

SEQ ID NO: 839817 - protein, 9 aa, Homo Sapiens
DGSRSKDDT

SEQ ID NO: 839818 - protein, 9 aa, Homo Sapiens
LTISELDDI

SEQ ID NO: 839819 - protein, 9 aa, Homo Sapiens
RQDKSDTNF

SEQ ID NO: 839820 - protein, 9 aa, Homo Sapiens
DGDGLIIGE

SEQ ID NO: 839821 - protein, 9 aa, Homo Sapiens
LSLIEDLQN

SEQ ID NO: 839822 - protein, 9 aa, Homo Sapiens
DFFINDSKL

SEQ ID NO: 839823 - protein, 9 aa, Homo Sapiens
DVKKQIKHT

SEQ ID NO: 839824 - protein, 9 aa, Homo Sapiens
KSGVHKLHY

SEQ ID NO: 839825 - protein, 9 aa, Homo Sapiens
MKLHWQFFQ

SEQ ID NO: 839826 - protein, 9 aa, Homo Sapiens
DFVRLQNYF

SEQ ID NO: 839827 - protein, 9 aa, Homo Sapiens
RWDEASFQT

SEQ ID NO: 839828 - protein, 9 aa, Homo Sapiens
KINDVEIEE

SEQ ID NO: 839829 - protein, 9 aa, Homo Sapiens
YAISADLGR

SEQ ID NO: 839830 - protein, 9 aa, Homo Sapiens
PISKFTCSR

SEQ ID NO: 839831 - protein, 9 aa, Homo Sapiens
QCLLSGPTS

SEQ ID NO: 839832 - protein, 9 aa, Homo Sapiens
LDPDFFIGK

SEQ ID NO: 839833 - protein, 9 aa, Homo Sapiens
LTPQSDQQD

SEQ ID NO: 839834 - protein, 9 aa, Homo Sapiens
GDTNSNDGP

SEQ ID NO: 839835 - protein, 9 aa, Homo Sapiens
PEYPALSLQ

SEQ ID NO: 839836 - protein, 9 aa, Homo Sapiens
EEARGTPQP

SEQ ID NO: 839837 - protein, 9 aa, Homo Sapiens
AHYTVITIA

SEQ ID NO: 839838 - protein, 9 aa, Homo Sapiens
IYLSAPAKK

SEQ ID NO: 839839 - protein, 9 aa, Homo Sapiens
QQSLATEPR

SEQ ID NO: 839840 - protein, 9 aa, Homo Sapiens
FLRNFSFLK

SEQ ID NO: 839841 - protein, 9 aa, Homo Sapiens
GITHEQMQT

SEQ ID NO: 839842 - protein, 9 aa, Homo Sapiens
GLDEAENDI

SEQ ID NO: 839843 - protein, 9 aa, Homo Sapiens
LSHKGMFSF

SEQ ID NO: 839844 - protein, 9 aa, Homo Sapiens
VEGIVTTCS

SEQ ID NO: 839845 - protein, 9 aa, Homo Sapiens
GVQPPPDPH

SEQ ID NO: 839846 - protein, 9 aa, Homo Sapiens
SLYLDNLDS

SEQ ID NO: 839847 - protein, 9 aa, Homo Sapiens
FLKRIIPLR

SEQ ID NO: 839848 - protein, 9 aa, Homo Sapiens
KAHKGEIED

SEQ ID NO: 839849 - protein, 9 aa, Homo Sapiens
FIIILTFVS

SEQ ID NO: 839850 - protein, 9 aa, Homo Sapiens
YLKKGNCSG

SEQ ID NO: 839851 - protein, 9 aa, Homo Sapiens
SPDYSPTSP

SEQ ID NO: 839852 - protein, 9 aa, Homo Sapiens
ADKSVAKKE

SEQ ID NO: 839853 - protein, 9 aa, Homo Sapiens
SNVCFAQEF

SEQ ID NO: 839854 - protein, 9 aa, Homo Sapiens
PGAPGAAPG

SEQ ID NO: 839855 - protein, 9 aa, Homo Sapiens
YTKDKKWNY

SEQ ID NO: 839856 - protein, 9 aa, Homo Sapiens
LISMQLMFG

SEQ ID NO: 839857 - protein, 9 aa, Homo Sapiens
NMESLNSTQ

SEQ ID NO: 839858 - protein, 9 aa, Homo Sapiens
SQSQYLIVH

SEQ ID NO: 839859 - protein, 9 aa, Homo Sapiens
FLNILQPGH

SEQ ID NO: 839860 - protein, 9 aa, Homo Sapiens
SESRRDSLS

SEQ ID NO: 839861 - protein, 9 aa, Homo Sapiens
TKENPLKTS

SEQ ID NO: 839862 - protein, 9 aa, Homo Sapiens
ATSTRITLL

SEQ ID NO: 839863 - protein, 9 aa, Homo Sapiens
LFRRCQRRL

SEQ ID NO: 839864 - protein, 9 aa, Homo Sapiens
KLFKDEFSP

SEQ ID NO: 839865 - protein, 9 aa, Homo Sapiens
RELENKLKA

SEQ ID NO: 839866 - protein, 9 aa, Homo Sapiens
IGLCKEAFD

SEQ ID NO: 839867 - protein, 9 aa, Homo Sapiens
AGKAKIEDL

SEQ ID NO: 839868 - protein, 9 aa, Homo Sapiens
PSEDVRVAA

SEQ ID NO: 839869 - protein, 9 aa, Homo Sapiens
IPAFSNQTY

SEQ ID NO: 839870 - protein, 9 aa, Homo Sapiens
DFYKDLTYL

SEQ ID NO: 839871 - protein, 9 aa, Homo Sapiens
LARDVHNQI

SEQ ID NO: 839872 - protein, 9 aa, Homo Sapiens
HESPPCLHR

SEQ ID NO: 839873 - protein, 9 aa, Homo Sapiens
IDLVIFLDN

SEQ ID NO: 839874 - protein, 9 aa, Homo Sapiens
HTIQGTLSY

SEQ ID NO: 839875 - protein, 9 aa, Homo Sapiens
GDCGNGGDE

SEQ ID NO: 839876 - protein, 9 aa, Homo Sapiens
HPPADWQPP

SEQ ID NO: 839877 - protein, 9 aa, Homo Sapiens
HAGHITKML

SEQ ID NO: 839878 - protein, 9 aa, Homo Sapiens
QSSEQNWAN

SEQ ID NO: 839879 - protein, 9 aa, Homo Sapiens
TACGEIKTT

SEQ ID NO: 839880 - protein, 9 aa, Homo Sapiens
VDVLERLDP

SEQ ID NO: 839881 - protein, 9 aa, Homo Sapiens
YDQIYCGAG

SEQ ID NO: 839882 - protein, 9 aa, Homo Sapiens
GFEIFELIH

SEQ ID NO: 839883 - protein, 9 aa, Homo Sapiens
VPEPSNLQS

SEQ ID NO: 839884 - protein, 9 aa, Homo Sapiens
QGQTDCIRA

SEQ ID NO: 839885 - protein, 9 aa, Homo Sapiens
YGTLMFMYL

SEQ ID NO: 839886 - protein, 9 aa, Homo Sapiens
PKGTSESLF

SEQ ID NO: 839887 - protein, 9 aa, Homo Sapiens
GSFHLENIT

SEQ ID NO: 839888 - protein, 9 aa, Homo Sapiens
RNGPDALIA

SEQ ID NO: 839889 - protein, 9 aa, Homo Sapiens
KNHSKLLFL

SEQ ID NO: 839890 - protein, 9 aa, Homo Sapiens
LGMVRVASA

SEQ ID NO: 839891 - protein, 9 aa, Homo Sapiens
QEIIHNFVR

SEQ ID NO: 839892 - protein, 9 aa, Homo Sapiens
SSCGREKKP

SEQ ID NO: 839893 - protein, 9 aa, Homo Sapiens
CKRSNIDSN

SEQ ID NO: 839894 - protein, 9 aa, Homo Sapiens
VPVPAEELC

SEQ ID NO: 839895 - protein, 9 aa, Homo Sapiens
PTLKQRKDI

SEQ ID NO: 839896 - protein, 9 aa, Homo Sapiens
EPITLKLCM

SEQ ID NO: 839897 - protein, 9 aa, Homo Sapiens
PSPRTLKTN

SEQ ID NO: 839898 - protein, 9 aa, Homo Sapiens
QCYWLCQQN

SEQ ID NO: 839899 - protein, 9 aa, Homo Sapiens
VERHMGTAV

SEQ ID NO: 839900 - protein, 9 aa, Homo Sapiens
INGQWEGKV

SEQ ID NO: 839901 - protein, 9 aa, Homo Sapiens
EHPSRTIFR

SEQ ID NO: 839902 - protein, 9 aa, Homo Sapiens
AIKNTSKKV

SEQ ID NO: 839903 - protein, 9 aa, Homo Sapiens
QEVMGLFTK

SEQ ID NO: 839904 - protein, 9 aa, Homo Sapiens
TYNQINYVI

SEQ ID NO: 839905 - protein, 9 aa, Homo Sapiens
LTSFGGQNR

SEQ ID NO: 839906 - protein, 9 aa, Homo Sapiens
IRCQVSTFE

SEQ ID NO: 839907 - protein, 9 aa, Homo Sapiens
KGCYALVTS

SEQ ID NO: 839908 - protein, 9 aa, Homo Sapiens
AALTPPKMD

SEQ ID NO: 839909 - protein, 9 aa, Homo Sapiens
LLTYPMFQI

SEQ ID NO: 839910 - protein, 9 aa, Homo Sapiens
LRVGLILPL

SEQ ID NO: 839911 - protein, 9 aa, Homo Sapiens
LSADTFKSG

SEQ ID NO: 839912 - protein, 9 aa, Homo Sapiens
FKLKYGWKK

SEQ ID NO: 839913 - protein, 9 aa, Homo Sapiens
DSSKNIFIG

SEQ ID NO: 839914 - protein, 9 aa, Homo Sapiens
LCNGIPDSR

SEQ ID NO: 839915 - protein, 9 aa, Homo Sapiens
LRVHPLFKD

SEQ ID NO: 839916 - protein, 9 aa, Homo Sapiens
HGKERSIFL

SEQ ID NO: 839917 - protein, 9 aa, Homo Sapiens
QLDVESLME

SEQ ID NO: 839918 - protein, 9 aa, Homo Sapiens
QLFHTGKTS

SEQ ID NO: 839919 - protein, 9 aa, Homo Sapiens
NERKVFVGR

SEQ ID NO: 839920 - protein, 9 aa, Homo Sapiens
RKNRDKVIL

SEQ ID NO: 839921 - protein, 9 aa, Homo Sapiens
SSNVIGGLK

SEQ ID NO: 839922 - protein, 9 aa, Homo Sapiens
QIRQFHSHG

SEQ ID NO: 839923 - protein, 9 aa, Homo Sapiens
HANILYSVL

SEQ ID NO: 839924 - protein, 9 aa, Homo Sapiens
DPVDSTLRY

SEQ ID NO: 839925 - protein, 9 aa, Homo Sapiens
IPKMPYEPL

SEQ ID NO: 839926 - protein, 9 aa, Homo Sapiens
NMDRLQGEE

SEQ ID NO: 839927 - protein, 9 aa, Homo Sapiens
YLLRHPEER

SEQ ID NO: 839928 - protein, 9 aa, Homo Sapiens
GDQLEIISN

SEQ ID NO: 839929 - protein, 9 aa, Homo Sapiens
LANQFFSSP

SEQ ID NO: 839930 - protein, 9 aa, Homo Sapiens
EKAIRDKLQ

SEQ ID NO: 839931 - protein, 9 aa, Homo Sapiens
LYSFQKQCI

SEQ ID NO: 839932 - protein, 9 aa, Homo Sapiens
SHLTVVAMH

SEQ ID NO: 839933 - protein, 9 aa, Homo Sapiens
PAASCPDKC

SEQ ID NO: 839934 - protein, 9 aa, Homo Sapiens
PVSPGSITK

SEQ ID NO: 839935 - protein, 9 aa, Homo Sapiens
RLFSTKGKA

SEQ ID NO: 839936 - protein, 9 aa, Homo Sapiens
WHIQLDKYL

SEQ ID NO: 839937 - protein, 9 aa, Homo Sapiens
RFDNTPEIA

SEQ ID NO: 839938 - protein, 9 aa, Homo Sapiens
HKSERHAHL

SEQ ID NO: 839939 - protein, 9 aa, Homo Sapiens
WLLTASFSV

SEQ ID NO: 839940 - protein, 9 aa, Homo Sapiens
KSGSGSESG

SEQ ID NO: 839941 - protein, 9 aa, Homo Sapiens
IFHCQQEDI

SEQ ID NO: 839942 - protein, 9 aa, Homo Sapiens
SKGQECLKQ

SEQ ID NO: 839943 - protein, 9 aa, Homo Sapiens
WEQFILGRA

SEQ ID NO: 839944 - protein, 9 aa, Homo Sapiens
QTVFVSIDI

SEQ ID NO: 839945 - protein, 9 aa, Homo Sapiens
GINVKEILT

SEQ ID NO: 839946 - protein, 9 aa, Homo Sapiens
QNVLKVLTN

SEQ ID NO: 839947 - protein, 9 aa, Homo Sapiens
LYREGMRMN

SEQ ID NO: 839948 - protein, 9 aa, Homo Sapiens
LCLSLDYPQ

SEQ ID NO: 839949 - protein, 9 aa, Homo Sapiens
GRRTWRFGV

SEQ ID NO: 839950 - protein, 9 aa, Homo Sapiens
AASCPDKCA

SEQ ID NO: 839951 - protein, 9 aa, Homo Sapiens
SLWRGFLNE

SEQ ID NO: 839952 - protein, 9 aa, Homo Sapiens
NSYSALSLL

SEQ ID NO: 839953 - protein, 9 aa, Homo Sapiens
RFWAPGRSC

SEQ ID NO: 839954 - protein, 9 aa, Homo Sapiens
RTYYESVQT

SEQ ID NO: 839955 - protein, 9 aa, Homo Sapiens
RSCDLREGR

SEQ ID NO: 839956 - protein, 9 aa, Homo Sapiens
EVLPLLLPL

SEQ ID NO: 839957 - protein, 9 aa, Homo Sapiens
FELLDKNTF

SEQ ID NO: 839958 - protein, 9 aa, Homo Sapiens
QFLACIIID

SEQ ID NO: 839959 - protein, 9 aa, Homo Sapiens
RDYLSDSEF

SEQ ID NO: 839960 - protein, 9 aa, Homo Sapiens
QWLVKFIHG

SEQ ID NO: 839961 - protein, 9 aa, Homo Sapiens
YFENFYTRN

SEQ ID NO: 839962 - protein, 9 aa, Homo Sapiens
VSGDKSFQL

SEQ ID NO: 839963 - protein, 9 aa, Homo Sapiens
TLPYRGPRG

SEQ ID NO: 839964 - protein, 9 aa, Homo Sapiens
VYLYKKLEM

SEQ ID NO: 839965 - protein, 9 aa, Homo Sapiens
RTGVCIRCD

SEQ ID NO: 839966 - protein, 9 aa, Homo Sapiens
VLDNCEDVA

SEQ ID NO: 839967 - protein, 9 aa, Homo Sapiens
YIDRDPDTI

SEQ ID NO: 839968 - protein, 9 aa, Homo Sapiens
NWEGIPGLA

SEQ ID NO: 839969 - protein, 9 aa, Homo Sapiens
NQHNAVKLG

SEQ ID NO: 839970 - protein, 9 aa, Homo Sapiens
YPENATTNG

SEQ ID NO: 839971 - protein, 9 aa, Homo Sapiens
NRAYQCAGR

SEQ ID NO: 839972 - protein, 9 aa, Homo Sapiens
YVKNNLSII

SEQ ID NO: 839973 - protein, 9 aa, Homo Sapiens
QGLQTLSTE

SEQ ID NO: 839974 - protein, 9 aa, Homo Sapiens
CACSLDTST

SEQ ID NO: 839975 - protein, 9 aa, Homo Sapiens
FGVDLKTVD

SEQ ID NO: 839976 - protein, 9 aa, Homo Sapiens
IDGSQVWGG

SEQ ID NO: 839977 - protein, 9 aa, Homo Sapiens
LAKLEQVEG

SEQ ID NO: 839978 - protein, 9 aa, Homo Sapiens
KAIVETIRV

SEQ ID NO: 839979 - protein, 9 aa, Homo Sapiens
NDTLQDVLS

SEQ ID NO: 839980 - protein, 9 aa, Homo Sapiens
WCFPDSDDI

SEQ ID NO: 839981 - protein, 9 aa, Homo Sapiens
LLKITDKYR

SEQ ID NO: 839982 - protein, 9 aa, Homo Sapiens
QKVDKPEAF

SEQ ID NO: 839983 - protein, 9 aa, Homo Sapiens
WGVEVGWDL

SEQ ID NO: 839984 - protein, 9 aa, Homo Sapiens
NTFNALPRS

SEQ ID NO: 839985 - protein, 9 aa, Homo Sapiens
CSANVQSNL

SEQ ID NO: 839986 - protein, 9 aa, Homo Sapiens
LMFWGLHWV

SEQ ID NO: 839987 - protein, 9 aa, Homo Sapiens
PEFIILWWN

SEQ ID NO: 839988 - protein, 9 aa, Homo Sapiens
HLIMTCKTF

SEQ ID NO: 839989 - protein, 9 aa, Homo Sapiens
LYSITQVVI

SEQ ID NO: 839990 - protein, 9 aa, Homo Sapiens
FDLLVRTHN

SEQ ID NO: 839991 - protein, 9 aa, Homo Sapiens
REEKNSSKC

SEQ ID NO: 839992 - protein, 9 aa, Homo Sapiens
DVGASCTEQ

SEQ ID NO: 839993 - protein, 9 aa, Homo Sapiens
GCNVLLIQT

SEQ ID NO: 839994 - protein, 9 aa, Homo Sapiens
VPPPNPGDQ

SEQ ID NO: 839995 - protein, 9 aa, Homo Sapiens
SDLSDWSSF

SEQ ID NO: 839996 - protein, 9 aa, Homo Sapiens
AMGAAECMI

SEQ ID NO: 839997 - protein, 9 aa, Homo Sapiens
LESLNVGEH

SEQ ID NO: 839998 - protein, 9 aa, Homo Sapiens
ELLQRKQNV

SEQ ID NO: 839999 - protein, 9 aa, Homo Sapiens
DKQRNRFFS

SEQ ID NO: 840000 - protein, 9 aa, Homo Sapiens
AKSVHILSW

SEQ ID NO: 840001 - protein, 9 aa, Homo Sapiens
ERERRWRHR

SEQ ID NO: 840002 - protein, 9 aa, Homo Sapiens
RYHSLLRDP

SEQ ID NO: 840003 - protein, 9 aa, Homo Sapiens
TGVFAFGPF

SEQ ID NO: 840004 - protein, 9 aa, Homo Sapiens
PKAEKNGVK

SEQ ID NO: 840005 - protein, 9 aa, Homo Sapiens
RKHPDCSIN

SEQ ID NO: 840006 - protein, 9 aa, Homo Sapiens
FYLVADTRE

SEQ ID NO: 840007 - protein, 9 aa, Homo Sapiens
DQVQGLINK

SEQ ID NO: 840008 - protein, 9 aa, Homo Sapiens
VKVEGSKYG

SEQ ID NO: 840009 - protein, 9 aa, Homo Sapiens
NMLSEEKQR

SEQ ID NO: 840010 - protein, 9 aa, Homo Sapiens
DGEDDTNDG

SEQ ID NO: 840011 - protein, 9 aa, Homo Sapiens
LFLNKTNIL

SEQ ID NO: 840012 - protein, 9 aa, Homo Sapiens
VDITLKGKM

SEQ ID NO: 840013 - protein, 9 aa, Homo Sapiens
DEPEVPEMF

SEQ ID NO: 840014 - protein, 9 aa, Homo Sapiens
DTNNADRLF

SEQ ID NO: 840015 - protein, 9 aa, Homo Sapiens
KLLKCRLIH

SEQ ID NO: 840016 - protein, 9 aa, Homo Sapiens
EARKLIKKK

SEQ ID NO: 840017 - protein, 9 aa, Homo Sapiens
SNLFLAEHH

SEQ ID NO: 840018 - protein, 9 aa, Homo Sapiens
VLLIQTSIL

SEQ ID NO: 840019 - protein, 9 aa, Homo Sapiens
GNVGYRLPL

SEQ ID NO: 840020 - protein, 9 aa, Homo Sapiens
IMEVYHLSY

SEQ ID NO: 840021 - protein, 9 aa, Homo Sapiens
FHDNLENYL

SEQ ID NO: 840022 - protein, 9 aa, Homo Sapiens
RLTYNLKKL

SEQ ID NO: 840023 - protein, 9 aa, Homo Sapiens
WFMNYCWCW

SEQ ID NO: 840024 - protein, 9 aa, Homo Sapiens
GMLLGEEKF

SEQ ID NO: 840025 - protein, 9 aa, Homo Sapiens
KIITISFQD

SEQ ID NO: 840026 - protein, 9 aa, Homo Sapiens
MHVAENVSK

SEQ ID NO: 840027 - protein, 9 aa, Homo Sapiens
GDGGPSLRR

SEQ ID NO: 840028 - protein, 9 aa, Homo Sapiens
DWFSLASVV

SEQ ID NO: 840029 - protein, 9 aa, Homo Sapiens
PADSPGTPL

SEQ ID NO: 840030 - protein, 9 aa, Homo Sapiens
FIQLYAVCT

SEQ ID NO: 840031 - protein, 9 aa, Homo Sapiens
KSFCHEQCE

SEQ ID NO: 840032 - protein, 9 aa, Homo Sapiens
KVVSPGPDN

SEQ ID NO: 840033 - protein, 9 aa, Homo Sapiens
VFVEYAHAG

SEQ ID NO: 840034 - protein, 9 aa, Homo Sapiens
TMGRGIVIY

SEQ ID NO: 840035 - protein, 9 aa, Homo Sapiens
NLLRNKEKR

SEQ ID NO: 840036 - protein, 9 aa, Homo Sapiens
SSDFVKDSQ

SEQ ID NO: 840037 - protein, 9 aa, Homo Sapiens
CHGNLTEKL

SEQ ID NO: 840038 - protein, 9 aa, Homo Sapiens
SSLMVHQIT

SEQ ID NO: 840039 - protein, 9 aa, Homo Sapiens
LPREYAFHI

SEQ ID NO: 840040 - protein, 9 aa, Homo Sapiens
TRQYLNYPP

SEQ ID NO: 840041 - protein, 9 aa, Homo Sapiens
NYLHFAQVR

SEQ ID NO: 840042 - protein, 9 aa, Homo Sapiens
NENGELYLR

SEQ ID NO: 840043 - protein, 9 aa, Homo Sapiens
GNLTEKLKL

SEQ ID NO: 840044 - protein, 9 aa, Homo Sapiens
HNNMISLKP

SEQ ID NO: 840045 - protein, 9 aa, Homo Sapiens
TVEVSPPFA

SEQ ID NO: 840046 - protein, 9 aa, Homo Sapiens
KKRRREINK

SEQ ID NO: 840047 - protein, 9 aa, Homo Sapiens
IFYVSSITA

SEQ ID NO: 840048 - protein, 9 aa, Homo Sapiens
FFHDAEESK

SEQ ID NO: 840049 - protein, 9 aa, Homo Sapiens
CAENSRLVS

SEQ ID NO: 840050 - protein, 9 aa, Homo Sapiens
KAVNPIWKI

SEQ ID NO: 840051 - protein, 9 aa, Homo Sapiens
VQATFPDNA

SEQ ID NO: 840052 - protein, 9 aa, Homo Sapiens
FRGKLLLKL

SEQ ID NO: 840053 - protein, 9 aa, Homo Sapiens
GEDEIRLRR

SEQ ID NO: 840054 - protein, 9 aa, Homo Sapiens
LPPSDINEF

SEQ ID NO: 840055 - protein, 9 aa, Homo Sapiens
SVTVLQPTW

SEQ ID NO: 840056 - protein, 9 aa, Homo Sapiens
SKPKRQPHL

SEQ ID NO: 840057 - protein, 9 aa, Homo Sapiens
PAGSTPTTF

SEQ ID NO: 840058 - protein, 9 aa, Homo Sapiens
TEKFRTMES

SEQ ID NO: 840059 - protein, 9 aa, Homo Sapiens
AGETMVREL

SEQ ID NO: 840060 - protein, 9 aa, Homo Sapiens
GSKDGKYAL

SEQ ID NO: 840061 - protein, 9 aa, Homo Sapiens
ILPAWCHIL

SEQ ID NO: 840062 - protein, 9 aa, Homo Sapiens
CDGNGNSFM

SEQ ID NO: 840063 - protein, 9 aa, Homo Sapiens
KTPYFDVGA

SEQ ID NO: 840064 - protein, 9 aa, Homo Sapiens
WRGLFAATF

SEQ ID NO: 840065 - protein, 9 aa, Homo Sapiens
HMKIFLFML

SEQ ID NO: 840066 - protein, 9 aa, Homo Sapiens
LPKKVYLSS

SEQ ID NO: 840067 - protein, 9 aa, Homo Sapiens
ERKDLSDTV

SEQ ID NO: 840068 - protein, 9 aa, Homo Sapiens
KPLVLRHQY

SEQ ID NO: 840069 - protein, 9 aa, Homo Sapiens
FPAKVVSHL

SEQ ID NO: 840070 - protein, 9 aa, Homo Sapiens
CTYVVLRGV

SEQ ID NO: 840071 - protein, 9 aa, Homo Sapiens
RLHEITHLA

SEQ ID NO: 840072 - protein, 9 aa, Homo Sapiens
KCRALSKRL

SEQ ID NO: 840073 - protein, 9 aa, Homo Sapiens
LIQNLEEVR

SEQ ID NO: 840074 - protein, 9 aa, Homo Sapiens
EFGLNISFV

SEQ ID NO: 840075 - protein, 9 aa, Homo Sapiens
MKLIFLGSR

SEQ ID NO: 840076 - protein, 9 aa, Homo Sapiens
LQNPLLSTF

SEQ ID NO: 840077 - protein, 9 aa, Homo Sapiens
DRNCLWYVP

SEQ ID NO: 840078 - protein, 9 aa, Homo Sapiens
AEDDIPQGK

SEQ ID NO: 840079 - protein, 9 aa, Homo Sapiens
NIITGALQL

SEQ ID NO: 840080 - protein, 9 aa, Homo Sapiens
YSFKKKPIS

SEQ ID NO: 840081 - protein, 9 aa, Homo Sapiens
ESADKLYGV

SEQ ID NO: 840082 - protein, 9 aa, Homo Sapiens
MTDLIYADK

SEQ ID NO: 840083 - protein, 9 aa, Homo Sapiens
MQLQAIQII

SEQ ID NO: 840084 - protein, 9 aa, Homo Sapiens
TAFLSITTI

SEQ ID NO: 840085 - protein, 9 aa, Homo Sapiens
KSCGRVQPA

SEQ ID NO: 840086 - protein, 9 aa, Homo Sapiens
RNSERCKEL

SEQ ID NO: 840087 - protein, 9 aa, Homo Sapiens
YHLPSNKKY

SEQ ID NO: 840088 - protein, 9 aa, Homo Sapiens
MAFHTEMGL

SEQ ID NO: 840089 - protein, 9 aa, Homo Sapiens
YINNLVKHV

SEQ ID NO: 840090 - protein, 9 aa, Homo Sapiens
SENKIPFKI

SEQ ID NO: 840091 - protein, 9 aa, Homo Sapiens
SFQTEVSYL

SEQ ID NO: 840092 - protein, 9 aa, Homo Sapiens
VGCCLTREV

SEQ ID NO: 840093 - protein, 9 aa, Homo Sapiens
PPSDINEFD

SEQ ID NO: 840094 - protein, 9 aa, Homo Sapiens
QTAPRPRLG

SEQ ID NO: 840095 - protein, 9 aa, Homo Sapiens
RGQSEVSAV

SEQ ID NO: 840096 - protein, 9 aa, Homo Sapiens
FSRPKRKAT

SEQ ID NO: 840097 - protein, 9 aa, Homo Sapiens
VWWQKLQIM

SEQ ID NO: 840098 - protein, 9 aa, Homo Sapiens
GTYRPHVYV

SEQ ID NO: 840099 - protein, 9 aa, Homo Sapiens
LQIPSCLYQ

SEQ ID NO: 840100 - protein, 9 aa, Homo Sapiens
FYPPEMYMT

SEQ ID NO: 840101 - protein, 9 aa, Homo Sapiens
IVIEDPFYL

SEQ ID NO: 840102 - protein, 9 aa, Homo Sapiens
KIKHSEEAE

SEQ ID NO: 840103 - protein, 9 aa, Homo Sapiens
TSYSSVQHP

SEQ ID NO: 840104 - protein, 9 aa, Homo Sapiens
LSVSPLILS

SEQ ID NO: 840105 - protein, 9 aa, Homo Sapiens
NIEAPISKF

SEQ ID NO: 840106 - protein, 9 aa, Homo Sapiens
VMAVYDFDC

SEQ ID NO: 840107 - protein, 9 aa, Homo Sapiens
HDNLENYLE

SEQ ID NO: 840108 - protein, 9 aa, Homo Sapiens
INTNKLSAR

SEQ ID NO: 840109 - protein, 9 aa, Homo Sapiens
MFMEYVPGG

SEQ ID NO: 840110 - protein, 9 aa, Homo Sapiens
IIYGMAVLS

SEQ ID NO: 840111 - protein, 9 aa, Homo Sapiens
GLKHIHDRT

SEQ ID NO: 840112 - protein, 9 aa, Homo Sapiens
YTTSIPRPQ

SEQ ID NO: 840113 - protein, 9 aa, Homo Sapiens
LPQSSLSAF

SEQ ID NO: 840114 - protein, 9 aa, Homo Sapiens
NKKQQHKLQ

SEQ ID NO: 840115 - protein, 9 aa, Homo Sapiens
RFTMLRAQY

SEQ ID NO: 840116 - protein, 9 aa, Homo Sapiens
AEASSRIRR

SEQ ID NO: 840117 - protein, 9 aa, Homo Sapiens
KVYFRTVER

SEQ ID NO: 840118 - protein, 9 aa, Homo Sapiens
NHSESSSNQ

SEQ ID NO: 840119 - protein, 9 aa, Homo Sapiens
SKTVIQHCR

SEQ ID NO: 840120 - protein, 9 aa, Homo Sapiens
QGEQLRDDG

SEQ ID NO: 840121 - protein, 9 aa, Homo Sapiens
IISEAASLE

SEQ ID NO: 840122 - protein, 9 aa, Homo Sapiens
IKLAIKAVL

SEQ ID NO: 840123 - protein, 9 aa, Homo Sapiens
GIYSRHHSL

SEQ ID NO: 840124 - protein, 9 aa, Homo Sapiens
RRRSKNKIA

SEQ ID NO: 840125 - protein, 9 aa, Homo Sapiens
TRHRIIHTG

SEQ ID NO: 840126 - protein, 9 aa, Homo Sapiens
AVLLTAPFS

SEQ ID NO: 840127 - protein, 9 aa, Homo Sapiens
ALRKLINRN

SEQ ID NO: 840128 - protein, 9 aa, Homo Sapiens
ESNTSRHNL

SEQ ID NO: 840129 - protein, 9 aa, Homo Sapiens
ISSETSRYN

SEQ ID NO: 840130 - protein, 9 aa, Homo Sapiens
LHKSNASKD

SEQ ID NO: 840131 - protein, 9 aa, Homo Sapiens
HSGSDYSGR

SEQ ID NO: 840132 - protein, 9 aa, Homo Sapiens
TVVVLLFVP

SEQ ID NO: 840133 - protein, 9 aa, Homo Sapiens
AINPILYDI

SEQ ID NO: 840134 - protein, 9 aa, Homo Sapiens
LCSPTFRLS

SEQ ID NO: 840135 - protein, 9 aa, Homo Sapiens
DSRDYPASA

SEQ ID NO: 840136 - protein, 9 aa, Homo Sapiens
TYDSSSSSS

SEQ ID NO: 840137 - protein, 9 aa, Homo Sapiens
DNTGVPDRI

SEQ ID NO: 840138 - protein, 9 aa, Homo Sapiens
INAGKADLQ

SEQ ID NO: 840139 - protein, 9 aa, Homo Sapiens
DCGKCFTQC

SEQ ID NO: 840140 - protein, 9 aa, Homo Sapiens
EHKLRREVE

SEQ ID NO: 840141 - protein, 9 aa, Homo Sapiens
YVVLWLICV

SEQ ID NO: 840142 - protein, 9 aa, Homo Sapiens
TMLITVSYI

SEQ ID NO: 840143 - protein, 9 aa, Homo Sapiens
SFLATVIHT

SEQ ID NO: 840144 - protein, 9 aa, Homo Sapiens
KIILCPLDP

SEQ ID NO: 840145 - protein, 9 aa, Homo Sapiens
DLGRLSLGS

SEQ ID NO: 840146 - protein, 9 aa, Homo Sapiens
FALVTAYGD

SEQ ID NO: 840147 - protein, 9 aa, Homo Sapiens
RRGYLLGIH

SEQ ID NO: 840148 - protein, 9 aa, Homo Sapiens
EICYQNKYT

SEQ ID NO: 840149 - protein, 9 aa, Homo Sapiens
GVFLRDFVS

SEQ ID NO: 840150 - protein, 9 aa, Homo Sapiens
LGHISDHYN

SEQ ID NO: 840151 - protein, 9 aa, Homo Sapiens
IAFILLIIK

SEQ ID NO: 840152 - protein, 9 aa, Homo Sapiens
NSEGTCIHR

SEQ ID NO: 840153 - protein, 9 aa, Homo Sapiens
LECWDELQK

SEQ ID NO: 840154 - protein, 9 aa, Homo Sapiens
ILSRHWIIH

SEQ ID NO: 840155 - protein, 9 aa, Homo Sapiens
QVESLNLPL

SEQ ID NO: 840156 - protein, 9 aa, Homo Sapiens
IEDSVLSGC

SEQ ID NO: 840157 - protein, 9 aa, Homo Sapiens
QAWVWATVR

SEQ ID NO: 840158 - protein, 9 aa, Homo Sapiens
QKFCQMRKR

SEQ ID NO: 840159 - protein, 9 aa, Homo Sapiens
FSNLANNFV

SEQ ID NO: 840160 - protein, 9 aa, Homo Sapiens
IDKEKPIHL

SEQ ID NO: 840161 - protein, 9 aa, Homo Sapiens
KLYFPERVM

SEQ ID NO: 840162 - protein, 9 aa, Homo Sapiens
VAYILEPLI

SEQ ID NO: 840163 - protein, 9 aa, Homo Sapiens
HIRLEKEMS

SEQ ID NO: 840164 - protein, 9 aa, Homo Sapiens
FCTLTATMR

SEQ ID NO: 840165 - protein, 9 aa, Homo Sapiens
RIGCGLDCL

SEQ ID NO: 840166 - protein, 9 aa, Homo Sapiens
SAIISVPPQ

SEQ ID NO: 840167 - protein, 9 aa, Homo Sapiens
VCHLFTSSN

SEQ ID NO: 840168 - protein, 9 aa, Homo Sapiens
CDDAYKSQL

SEQ ID NO: 840169 - protein, 9 aa, Homo Sapiens
ALRLLRSFK

SEQ ID NO: 840170 - protein, 9 aa, Homo Sapiens
LTLIFSYNR

SEQ ID NO: 840171 - protein, 9 aa, Homo Sapiens
YGKSFKNIS

SEQ ID NO: 840172 - protein, 9 aa, Homo Sapiens
PKNRAFSIC

SEQ ID NO: 840173 - protein, 9 aa, Homo Sapiens
DEAENDICR

SEQ ID NO: 840174 - protein, 9 aa, Homo Sapiens
FTPEKIIAI

SEQ ID NO: 840175 - protein, 9 aa, Homo Sapiens
PVSRTPRLP

SEQ ID NO: 840176 - protein, 9 aa, Homo Sapiens
VKKMQMLSE

SEQ ID NO: 840177 - protein, 9 aa, Homo Sapiens
PTKKEKCEY

SEQ ID NO: 840178 - protein, 9 aa, Homo Sapiens
INYHAPEFI

SEQ ID NO: 840179 - protein, 9 aa, Homo Sapiens
SRINYYCTT

SEQ ID NO: 840180 - protein, 9 aa, Homo Sapiens
VATSQISDA

SEQ ID NO: 840181 - protein, 9 aa, Homo Sapiens
MESKYKEII

SEQ ID NO: 840182 - protein, 9 aa, Homo Sapiens
SHLAKVTAD

SEQ ID NO: 840183 - protein, 9 aa, Homo Sapiens
LLLLPALNY

SEQ ID NO: 840184 - protein, 9 aa, Homo Sapiens
DYALATWSL

SEQ ID NO: 840185 - protein, 9 aa, Homo Sapiens
DRGRDRSSK

SEQ ID NO: 840186 - protein, 9 aa, Homo Sapiens
TVNSVTTDS

SEQ ID NO: 840187 - protein, 9 aa, Homo Sapiens
KSQTGEIQG

SEQ ID NO: 840188 - protein, 9 aa, Homo Sapiens
QEASASEVL

SEQ ID NO: 840189 - protein, 9 aa, Homo Sapiens
VQEPQGEGG

SEQ ID NO: 840190 - protein, 9 aa, Homo Sapiens
DQEERIMEI

SEQ ID NO: 840191 - protein, 9 aa, Homo Sapiens
KNQQIIGQL

SEQ ID NO: 840192 - protein, 9 aa, Homo Sapiens
PIPRKLVAH

SEQ ID NO: 840193 - protein, 9 aa, Homo Sapiens
LAVLNGEVN

SEQ ID NO: 840194 - protein, 9 aa, Homo Sapiens
EEPTNISTD

SEQ ID NO: 840195 - protein, 9 aa, Homo Sapiens
DSNRGKYHC

SEQ ID NO: 840196 - protein, 9 aa, Homo Sapiens
YDVVHCWYT

SEQ ID NO: 840197 - protein, 9 aa, Homo Sapiens
FKEHQQIHT

SEQ ID NO: 840198 - protein, 9 aa, Homo Sapiens
ALVAKCDEI

SEQ ID NO: 840199 - protein, 9 aa, Homo Sapiens
SLDYVKITL

SEQ ID NO: 840200 - protein, 9 aa, Homo Sapiens
VFTGNETFA

SEQ ID NO: 840201 - protein, 9 aa, Homo Sapiens
LELKKPHKI

SEQ ID NO: 840202 - protein, 9 aa, Homo Sapiens
HQAQVELNA

SEQ ID NO: 840203 - protein, 9 aa, Homo Sapiens
ERTFKRFTP

SEQ ID NO: 840204 - protein, 9 aa, Homo Sapiens
STEAPGLIP

SEQ ID NO: 840205 - protein, 9 aa, Homo Sapiens
LDWALCQEI

SEQ ID NO: 840206 - protein, 9 aa, Homo Sapiens
YALLTSANE

SEQ ID NO: 840207 - protein, 9 aa, Homo Sapiens
VLSHKGMFS

SEQ ID NO: 840208 - protein, 9 aa, Homo Sapiens
VDLGLQDKQ

SEQ ID NO: 840209 - protein, 9 aa, Homo Sapiens
NPLKTTPMI

SEQ ID NO: 840210 - protein, 9 aa, Homo Sapiens
LGQQGGWRC

SEQ ID NO: 840211 - protein, 9 aa, Homo Sapiens
FSVYLLQPA

SEQ ID NO: 840212 - protein, 9 aa, Homo Sapiens
VEAGTAKDK

SEQ ID NO: 840213 - protein, 9 aa, Homo Sapiens
RKLKQKEAN

SEQ ID NO: 840214 - protein, 9 aa, Homo Sapiens
SLSYYQVKN

SEQ ID NO: 840215 - protein, 9 aa, Homo Sapiens
KTPVYAKVK

SEQ ID NO: 840216 - protein, 9 aa, Homo Sapiens
PPSHFSIST

SEQ ID NO: 840217 - protein, 9 aa, Homo Sapiens
LEHKLRREV

SEQ ID NO: 840218 - protein, 9 aa, Homo Sapiens
AEGCLLNLS

SEQ ID NO: 840219 - protein, 9 aa, Homo Sapiens
QSRETSSIC

SEQ ID NO: 840220 - protein, 9 aa, Homo Sapiens
NNQVFLSLG

SEQ ID NO: 840221 - protein, 9 aa, Homo Sapiens
GNVAKHISK

SEQ ID NO: 840222 - protein, 9 aa, Homo Sapiens
HLLVHQRTH

SEQ ID NO: 840223 - protein, 9 aa, Homo Sapiens
PLIQLSCSS

SEQ ID NO: 840224 - protein, 9 aa, Homo Sapiens
QSSTNQTGM

SEQ ID NO: 840225 - protein, 9 aa, Homo Sapiens
GPPMLQEDT

SEQ ID NO: 840226 - protein, 9 aa, Homo Sapiens
PAFLCLGGL

SEQ ID NO: 840227 - protein, 9 aa, Homo Sapiens
QRTHGKNYL

SEQ ID NO: 840228 - protein, 9 aa, Homo Sapiens
EVNNEAVMS

SEQ ID NO: 840229 - protein, 9 aa, Homo Sapiens
STGNKIIAY

SEQ ID NO: 840230 - protein, 9 aa, Homo Sapiens
RKKPQSRGK

SEQ ID NO: 840231 - protein, 9 aa, Homo Sapiens
KKTMEMTTR

SEQ ID NO: 840232 - protein, 9 aa, Homo Sapiens
VRKTDTNRI

SEQ ID NO: 840233 - protein, 9 aa, Homo Sapiens
SRDSGFQFK

SEQ ID NO: 840234 - protein, 9 aa, Homo Sapiens
IKEYTEIPS

SEQ ID NO: 840235 - protein, 9 aa, Homo Sapiens
NLVWEEKAC

SEQ ID NO: 840236 - protein, 9 aa, Homo Sapiens
TLLIAMPQL

SEQ ID NO: 840237 - protein, 9 aa, Homo Sapiens
KVNKYFDFS

SEQ ID NO: 840238 - protein, 9 aa, Homo Sapiens
TTTAQETLA

SEQ ID NO: 840239 - protein, 9 aa, Homo Sapiens
PFEEKVAQA

SEQ ID NO: 840240 - protein, 9 aa, Homo Sapiens
KNKKTSKSK

SEQ ID NO: 840241 - protein, 9 aa, Homo Sapiens
EEELRQKAL

SEQ ID NO: 840242 - protein, 9 aa, Homo Sapiens
IRRTWGNES

SEQ ID NO: 840243 - protein, 9 aa, Homo Sapiens
LFQLVFSDL

SEQ ID NO: 840244 - protein, 9 aa, Homo Sapiens
TCHRKLHTG

SEQ ID NO: 840245 - protein, 9 aa, Homo Sapiens
KYHTDIVFA

SEQ ID NO: 840246 - protein, 9 aa, Homo Sapiens
RSADTMQSA

SEQ ID NO: 840247 - protein, 9 aa, Homo Sapiens
IFPQLLCVF

SEQ ID NO: 840248 - protein, 9 aa, Homo Sapiens
RLVFKMCFY

SEQ ID NO: 840249 - protein, 9 aa, Homo Sapiens
EGKAPQSLL

SEQ ID NO: 840250 - protein, 9 aa, Homo Sapiens
ENMDNFCSD

SEQ ID NO: 840251 - protein, 9 aa, Homo Sapiens
RVAHMMPNI

SEQ ID NO: 840252 - protein, 9 aa, Homo Sapiens
QKQPPWDFL

SEQ ID NO: 840253 - protein, 9 aa, Homo Sapiens
WDIPNSKDI

SEQ ID NO: 840254 - protein, 9 aa, Homo Sapiens
YVNRRFHCP

SEQ ID NO: 840255 - protein, 9 aa, Homo Sapiens
GEKQYYSDP

SEQ ID NO: 840256 - protein, 9 aa, Homo Sapiens
NVFFPSGQP

SEQ ID NO: 840257 - protein, 9 aa, Homo Sapiens
LKHQFTRQE

SEQ ID NO: 840258 - protein, 9 aa, Homo Sapiens
VSFPEHPKR

SEQ ID NO: 840259 - protein, 9 aa, Homo Sapiens
NLIRHQIIH

SEQ ID NO: 840260 - protein, 9 aa, Homo Sapiens
DNAQPILQI

SEQ ID NO: 840261 - protein, 9 aa, Homo Sapiens
VLHYFVEFI

SEQ ID NO: 840262 - protein, 9 aa, Homo Sapiens
FQQCYWLCQ

SEQ ID NO: 840263 - protein, 9 aa, Homo Sapiens
PPEIMEFSG

SEQ ID NO: 840264 - protein, 9 aa, Homo Sapiens
QSLNKQNVF

SEQ ID NO: 840265 - protein, 9 aa, Homo Sapiens
KKLLYKKMK

SEQ ID NO: 840266 - protein, 9 aa, Homo Sapiens
IYHKQNLTK

SEQ ID NO: 840267 - protein, 9 aa, Homo Sapiens
KVCTCTSQK

SEQ ID NO: 840268 - protein, 9 aa, Homo Sapiens
RLDPNNYFT

SEQ ID NO: 840269 - protein, 9 aa, Homo Sapiens
PSPSAAYTT

SEQ ID NO: 840270 - protein, 9 aa, Homo Sapiens
PIHAYGNIT

SEQ ID NO: 840271 - protein, 9 aa, Homo Sapiens
SCAPSPQGL

SEQ ID NO: 840272 - protein, 9 aa, Homo Sapiens
IDSTRTISA

SEQ ID NO: 840273 - protein, 9 aa, Homo Sapiens
VSLMGFGKD

SEQ ID NO: 840274 - protein, 9 aa, Homo Sapiens
TTATFYHRY

SEQ ID NO: 840275 - protein, 9 aa, Homo Sapiens
SIGHPVTIT

SEQ ID NO: 840276 - protein, 9 aa, Homo Sapiens
LGIAVGLSL

SEQ ID NO: 840277 - protein, 9 aa, Homo Sapiens
KDAINKFVV

SEQ ID NO: 840278 - protein, 9 aa, Homo Sapiens
PESLDFSDG

SEQ ID NO: 840279 - protein, 9 aa, Homo Sapiens
TDNSYQCKD

SEQ ID NO: 840280 - protein, 9 aa, Homo Sapiens
QTQLEGAQE

SEQ ID NO: 840281 - protein, 9 aa, Homo Sapiens
ERVRSHIMH

SEQ ID NO: 840282 - protein, 9 aa, Homo Sapiens
TYRDYVHRK

SEQ ID NO: 840283 - protein, 9 aa, Homo Sapiens
GVLLYPSHP

SEQ ID NO: 840284 - protein, 9 aa, Homo Sapiens
LLALIQGYA

SEQ ID NO: 840285 - protein, 9 aa, Homo Sapiens
LSNPGLMNN

SEQ ID NO: 840286 - protein, 9 aa, Homo Sapiens
PLALAPLPP

SEQ ID NO: 840287 - protein, 9 aa, Homo Sapiens
EKEVTELLM

SEQ ID NO: 840288 - protein, 9 aa, Homo Sapiens
EINNSKDIQ

SEQ ID NO: 840289 - protein, 9 aa, Homo Sapiens
DDSQRVKSV

SEQ ID NO: 840290 - protein, 9 aa, Homo Sapiens
FGIPVMALI

SEQ ID NO: 840291 - protein, 9 aa, Homo Sapiens
HSLPPIDRR

SEQ ID NO: 840292 - protein, 9 aa, Homo Sapiens
QNGMIIPSM

SEQ ID NO: 840293 - protein, 9 aa, Homo Sapiens
CSASHFALV

SEQ ID NO: 840294 - protein, 9 aa, Homo Sapiens
FIGYFFSIY

SEQ ID NO: 840295 - protein, 9 aa, Homo Sapiens
HCFRPILKL

SEQ ID NO: 840296 - protein, 9 aa, Homo Sapiens
TEILYTKTE

SEQ ID NO: 840297 - protein, 9 aa, Homo Sapiens
QADLANKLA

SEQ ID NO: 840298 - protein, 9 aa, Homo Sapiens
NARKFNEPE

SEQ ID NO: 840299 - protein, 9 aa, Homo Sapiens
QSLATEPRE

SEQ ID NO: 840300 - protein, 9 aa, Homo Sapiens
LLSAQLAPG

SEQ ID NO: 840301 - protein, 9 aa, Homo Sapiens
GEYSQVFCG

SEQ ID NO: 840302 - protein, 9 aa, Homo Sapiens
GDKRDASLK

SEQ ID NO: 840303 - protein, 9 aa, Homo Sapiens
SVPHNHNQI

SEQ ID NO: 840304 - protein, 9 aa, Homo Sapiens
TTFPLKNAK

SEQ ID NO: 840305 - protein, 9 aa, Homo Sapiens
GIHLSSGSR

SEQ ID NO: 840306 - protein, 9 aa, Homo Sapiens
VEYLLCLAA

SEQ ID NO: 840307 - protein, 9 aa, Homo Sapiens
HSSPASSPS

SEQ ID NO: 840308 - protein, 9 aa, Homo Sapiens
KLDYLTYKI

SEQ ID NO: 840309 - protein, 9 aa, Homo Sapiens
TGQHNAIIS

SEQ ID NO: 840310 - protein, 9 aa, Homo Sapiens
AELAWLQHQ

SEQ ID NO: 840311 - protein, 9 aa, Homo Sapiens
ASPQGNLCH

SEQ ID NO: 840312 - protein, 9 aa, Homo Sapiens
LALLANQRR

SEQ ID NO: 840313 - protein, 9 aa, Homo Sapiens
RGNDSVCGL

SEQ ID NO: 840314 - protein, 9 aa, Homo Sapiens
KGTSESLFE

SEQ ID NO: 840315 - protein, 9 aa, Homo Sapiens
LCSYLDTKR

SEQ ID NO: 840316 - protein, 9 aa, Homo Sapiens
MFEPSGPFR

SEQ ID NO: 840317 - protein, 9 aa, Homo Sapiens
APYKYPSKV

SEQ ID NO: 840318 - protein, 9 aa, Homo Sapiens
FLGFPTRPA

SEQ ID NO: 840319 - protein, 9 aa, Homo Sapiens
SQSELQVLW

SEQ ID NO: 840320 - protein, 9 aa, Homo Sapiens
NPFMTSIPV

SEQ ID NO: 840321 - protein, 9 aa, Homo Sapiens
TMVYNKFKN

SEQ ID NO: 840322 - protein, 9 aa, Homo Sapiens
YAFKTWKCP

SEQ ID NO: 840323 - protein, 9 aa, Homo Sapiens
SSTGDAGEM

SEQ ID NO: 840324 - protein, 9 aa, Homo Sapiens
DGFKCQCPN

SEQ ID NO: 840325 - protein, 9 aa, Homo Sapiens
HVNQNGFNR

SEQ ID NO: 840326 - protein, 9 aa, Homo Sapiens
IFVYSAKRK

SEQ ID NO: 840327 - protein, 9 aa, Homo Sapiens
VDLKSGLED

SEQ ID NO: 840328 - protein, 9 aa, Homo Sapiens
TKNILMCTG

SEQ ID NO: 840329 - protein, 9 aa, Homo Sapiens
ENFSSKIIS

SEQ ID NO: 840330 - protein, 9 aa, Homo Sapiens
IGISCIFPA

SEQ ID NO: 840331 - protein, 9 aa, Homo Sapiens
INNLTIEDP

SEQ ID NO: 840332 - protein, 9 aa, Homo Sapiens
QEEQINARD

SEQ ID NO: 840333 - protein, 9 aa, Homo Sapiens
SVYSLFLLS

SEQ ID NO: 840334 - protein, 9 aa, Homo Sapiens
SQGAVVNAN

SEQ ID NO: 840335 - protein, 9 aa, Homo Sapiens
HTTPLPVTN

SEQ ID NO: 840336 - protein, 9 aa, Homo Sapiens
NDYGDNEKQ

SEQ ID NO: 840337 - protein, 9 aa, Homo Sapiens
LNNNKCPYF

SEQ ID NO: 840338 - protein, 9 aa, Homo Sapiens
MVLIENKAF

SEQ ID NO: 840339 - protein, 9 aa, Homo Sapiens
NDDREESLM

SEQ ID NO: 840340 - protein, 9 aa, Homo Sapiens
GKIYLLSSA

SEQ ID NO: 840341 - protein, 9 aa, Homo Sapiens
LQTLCLDDN

SEQ ID NO: 840342 - protein, 9 aa, Homo Sapiens
DPLKHVRFS

SEQ ID NO: 840343 - protein, 9 aa, Homo Sapiens
MTNQKIQMD

SEQ ID NO: 840344 - protein, 9 aa, Homo Sapiens
HESDEEQLF

SEQ ID NO: 840345 - protein, 9 aa, Homo Sapiens
ALVTTECPH

SEQ ID NO: 840346 - protein, 9 aa, Homo Sapiens
KRRGGGGHN

SEQ ID NO: 840347 - protein, 9 aa, Homo Sapiens
PLSRVVHLY

SEQ ID NO: 840348 - protein, 9 aa, Homo Sapiens
AFLPCSFNV

SEQ ID NO: 840349 - protein, 9 aa, Homo Sapiens
HSSTSSGRS

SEQ ID NO: 840350 - protein, 9 aa, Homo Sapiens
DEEEDQDPP

SEQ ID NO: 840351 - protein, 9 aa, Homo Sapiens
PVAYILEPL

SEQ ID NO: 840352 - protein, 9 aa, Homo Sapiens
MQQRADQLA

SEQ ID NO: 840353 - protein, 9 aa, Homo Sapiens
AAHIALLVA

SEQ ID NO: 840354 - protein, 9 aa, Homo Sapiens
VSAQRAFDH

SEQ ID NO: 840355 - protein, 9 aa, Homo Sapiens
STDLDRPES

SEQ ID NO: 840356 - protein, 9 aa, Homo Sapiens
TPLKFLVET

SEQ ID NO: 840357 - protein, 9 aa, Homo Sapiens
LLGSPTLLS

SEQ ID NO: 840358 - protein, 9 aa, Homo Sapiens
LRSPPAKAE

SEQ ID NO: 840359 - protein, 9 aa, Homo Sapiens
LDKFSSALQ

SEQ ID NO: 840360 - protein, 9 aa, Homo Sapiens
NTIAWPLCG

SEQ ID NO: 840361 - protein, 9 aa, Homo Sapiens
ISLTNVCGK

SEQ ID NO: 840362 - protein, 9 aa, Homo Sapiens
REEQPHPHL

SEQ ID NO: 840363 - protein, 9 aa, Homo Sapiens
QDIHKEMMP

SEQ ID NO: 840364 - protein, 9 aa, Homo Sapiens
IHTRTHSGE

SEQ ID NO: 840365 - protein, 9 aa, Homo Sapiens
PLRINFDVA

SEQ ID NO: 840366 - protein, 9 aa, Homo Sapiens
KTEEHILKR

SEQ ID NO: 840367 - protein, 9 aa, Homo Sapiens
QTTGSNGSG

SEQ ID NO: 840368 - protein, 9 aa, Homo Sapiens
DYMVLLIMK

SEQ ID NO: 840369 - protein, 9 aa, Homo Sapiens
LQLQRKSIT

SEQ ID NO: 840370 - protein, 9 aa, Homo Sapiens
VRDDLFGMG

SEQ ID NO: 840371 - protein, 9 aa, Homo Sapiens
MYGTNEKEP

SEQ ID NO: 840372 - protein, 9 aa, Homo Sapiens
FVGLFRIVA

SEQ ID NO: 840373 - protein, 9 aa, Homo Sapiens
AQLNRYMIV

SEQ ID NO: 840374 - protein, 9 aa, Homo Sapiens
QLHTYQEGK

SEQ ID NO: 840375 - protein, 9 aa, Homo Sapiens
FLPTNKLEN

SEQ ID NO: 840376 - protein, 9 aa, Homo Sapiens
LNIQSVNRL

SEQ ID NO: 840377 - protein, 9 aa, Homo Sapiens
GRGYTGLGH

SEQ ID NO: 840378 - protein, 9 aa, Homo Sapiens
LSATSGELL

SEQ ID NO: 840379 - protein, 9 aa, Homo Sapiens
QLFHQDKQL

SEQ ID NO: 840380 - protein, 9 aa, Homo Sapiens
QKRRQVLKD

SEQ ID NO: 840381 - protein, 9 aa, Homo Sapiens
VQNNVSPKG

SEQ ID NO: 840382 - protein, 9 aa, Homo Sapiens
GHQLLDTCF

SEQ ID NO: 840383 - protein, 9 aa, Homo Sapiens
ATPQTFSNY

SEQ ID NO: 840384 - protein, 9 aa, Homo Sapiens
IFSHLHKLS

SEQ ID NO: 840385 - protein, 9 aa, Homo Sapiens
QLPPQCLLS

SEQ ID NO: 840386 - protein, 9 aa, Homo Sapiens
SKYHEQLGM

SEQ ID NO: 840387 - protein, 9 aa, Homo Sapiens
CQHVKYGQC

SEQ ID NO: 840388 - protein, 9 aa, Homo Sapiens
LHQKTHTGE

SEQ ID NO: 840389 - protein, 9 aa, Homo Sapiens
RQRHLEKSE

SEQ ID NO: 840390 - protein, 9 aa, Homo Sapiens
LQRLMLINN

SEQ ID NO: 840391 - protein, 9 aa, Homo Sapiens
KERYQLLSE

SEQ ID NO: 840392 - protein, 9 aa, Homo Sapiens
HPDTGACVC

SEQ ID NO: 840393 - protein, 9 aa, Homo Sapiens
FFDRNSPSF

SEQ ID NO: 840394 - protein, 9 aa, Homo Sapiens
PWLQEAPAA

SEQ ID NO: 840395 - protein, 9 aa, Homo Sapiens
DKNWPAGGE

SEQ ID NO: 840396 - protein, 9 aa, Homo Sapiens
PALLDIAHA

SEQ ID NO: 840397 - protein, 9 aa, Homo Sapiens
SADNIAVGL

SEQ ID NO: 840398 - protein, 9 aa, Homo Sapiens
KSILSTMLT

SEQ ID NO: 840399 - protein, 9 aa, Homo Sapiens
WNCDVQGAL

SEQ ID NO: 840400 - protein, 9 aa, Homo Sapiens
SPNLSEIKC

SEQ ID NO: 840401 - protein, 9 aa, Homo Sapiens
CSGSSHFVL

SEQ ID NO: 840402 - protein, 9 aa, Homo Sapiens
CRRINSSVT

SEQ ID NO: 840403 - protein, 9 aa, Homo Sapiens
DNEYAYLKV

SEQ ID NO: 840404 - protein, 9 aa, Homo Sapiens
SSYYFDMDK

SEQ ID NO: 840405 - protein, 9 aa, Homo Sapiens
AKAIPGFTN

SEQ ID NO: 840406 - protein, 9 aa, Homo Sapiens
AMSIINSFV

SEQ ID NO: 840407 - protein, 9 aa, Homo Sapiens
WALILQGLR

SEQ ID NO: 840408 - protein, 9 aa, Homo Sapiens
TTDIKEANL

SEQ ID NO: 840409 - protein, 9 aa, Homo Sapiens
QIHSTSGLN

SEQ ID NO: 840410 - protein, 9 aa, Homo Sapiens
RSQLQILSS

SEQ ID NO: 840411 - protein, 9 aa, Homo Sapiens
VVLLFYITI

SEQ ID NO: 840412 - protein, 9 aa, Homo Sapiens
VLHIARVLK

SEQ ID NO: 840413 - protein, 9 aa, Homo Sapiens
NITPVPLLQ

SEQ ID NO: 840414 - protein, 9 aa, Homo Sapiens
NTTSKRIIK

SEQ ID NO: 840415 - protein, 9 aa, Homo Sapiens
AKVVSHLVK

SEQ ID NO: 840416 - protein, 9 aa, Homo Sapiens
RTPPDIAKL

SEQ ID NO: 840417 - protein, 9 aa, Homo Sapiens
ALTRVSQII

SEQ ID NO: 840418 - protein, 9 aa, Homo Sapiens
PSPAHIVIP

SEQ ID NO: 840419 - protein, 9 aa, Homo Sapiens
QFHSHGWPE

SEQ ID NO: 840420 - protein, 9 aa, Homo Sapiens
VNSEGGSGR

SEQ ID NO: 840421 - protein, 9 aa, Homo Sapiens
LNSMLCPAH

SEQ ID NO: 840422 - protein, 9 aa, Homo Sapiens
RNHQNLQDC

SEQ ID NO: 840423 - protein, 9 aa, Homo Sapiens
NLKLHIRIK

SEQ ID NO: 840424 - protein, 9 aa, Homo Sapiens
STQREILKQ

SEQ ID NO: 840425 - protein, 9 aa, Homo Sapiens
DAILLYLTR

SEQ ID NO: 840426 - protein, 9 aa, Homo Sapiens
YRLDPNNYF

SEQ ID NO: 840427 - protein, 9 aa, Homo Sapiens
SAEITSDLT

SEQ ID NO: 840428 - protein, 9 aa, Homo Sapiens
CGRGACNNL

SEQ ID NO: 840429 - protein, 9 aa, Homo Sapiens
SARFQPHQD

SEQ ID NO: 840430 - protein, 9 aa, Homo Sapiens
FKINSVINC

SEQ ID NO: 840431 - protein, 9 aa, Homo Sapiens
TMDKTPSYF

SEQ ID NO: 840432 - protein, 9 aa, Homo Sapiens
TQSGYCAMI

SEQ ID NO: 840433 - protein, 9 aa, Homo Sapiens
PNISQRLLL

SEQ ID NO: 840434 - protein, 9 aa, Homo Sapiens
VLQYLVEVE

SEQ ID NO: 840435 - protein, 9 aa, Homo Sapiens
ELTWENFHF

SEQ ID NO: 840436 - protein, 9 aa, Homo Sapiens
FKSALQTIG

SEQ ID NO: 840437 - protein, 9 aa, Homo Sapiens
AFLDENLKR

SEQ ID NO: 840438 - protein, 9 aa, Homo Sapiens
AIQADLANK

SEQ ID NO: 840439 - protein, 9 aa, Homo Sapiens
PGEKCHPDT

SEQ ID NO: 840440 - protein, 9 aa, Homo Sapiens
DVTMFFQNI

SEQ ID NO: 840441 - protein, 9 aa, Homo Sapiens
TSPQRVPQV

SEQ ID NO: 840442 - protein, 9 aa, Homo Sapiens
TKVVQCRED

SEQ ID NO: 840443 - protein, 9 aa, Homo Sapiens
VQSNLIESH

SEQ ID NO: 840444 - protein, 9 aa, Homo Sapiens
HKEMMPRRL

SEQ ID NO: 840445 - protein, 9 aa, Homo Sapiens
PSGHNNSPQ

SEQ ID NO: 840446 - protein, 9 aa, Homo Sapiens
CLNKPGHVA

SEQ ID NO: 840447 - protein, 9 aa, Homo Sapiens
YNKEQQLKE

SEQ ID NO: 840448 - protein, 9 aa, Homo Sapiens
TWSHSYMLW

SEQ ID NO: 840449 - protein, 9 aa, Homo Sapiens
NLTFSLFGL

SEQ ID NO: 840450 - protein, 9 aa, Homo Sapiens
IIPRDLAMC

SEQ ID NO: 840451 - protein, 9 aa, Homo Sapiens
PGPDGDLSP

SEQ ID NO: 840452 - protein, 9 aa, Homo Sapiens
HPQGAWKKL

SEQ ID NO: 840453 - protein, 9 aa, Homo Sapiens
LVVHQITHT

SEQ ID NO: 840454 - protein, 9 aa, Homo Sapiens
HSQQKKTFF

SEQ ID NO: 840455 - protein, 9 aa, Homo Sapiens
NKQKIAFED

SEQ ID NO: 840456 - protein, 9 aa, Homo Sapiens
EGDIPKAPD

SEQ ID NO: 840457 - protein, 9 aa, Homo Sapiens
SAIQADLAN

SEQ ID NO: 840458 - protein, 9 aa, Homo Sapiens
SESLFRRCQ

SEQ ID NO: 840459 - protein, 9 aa, Homo Sapiens
LGETVLHIA

SEQ ID NO: 840460 - protein, 9 aa, Homo Sapiens
VRLGKHLQF

SEQ ID NO: 840461 - protein, 9 aa, Homo Sapiens
KSEEPPERR

SEQ ID NO: 840462 - protein, 9 aa, Homo Sapiens
DREEINVDV

SEQ ID NO: 840463 - protein, 9 aa, Homo Sapiens
VNTGEKPYK

SEQ ID NO: 840464 - protein, 9 aa, Homo Sapiens
NFIGYFFSI

SEQ ID NO: 840465 - protein, 9 aa, Homo Sapiens
SWSFFCSDE

SEQ ID NO: 840466 - protein, 9 aa, Homo Sapiens
ALNLLVKAE

SEQ ID NO: 840467 - protein, 9 aa, Homo Sapiens
ETETSKIKR

SEQ ID NO: 840468 - protein, 9 aa, Homo Sapiens
VETVEYNNL

SEQ ID NO: 840469 - protein, 9 aa, Homo Sapiens
RSVARQVCK

SEQ ID NO: 840470 - protein, 9 aa, Homo Sapiens
ESNLRKKAF

SEQ ID NO: 840471 - protein, 9 aa, Homo Sapiens
VERDEDAVK

SEQ ID NO: 840472 - protein, 9 aa, Homo Sapiens
EKLIELENW

SEQ ID NO: 840473 - protein, 9 aa, Homo Sapiens
VGDKTKWII

SEQ ID NO: 840474 - protein, 9 aa, Homo Sapiens
VLLILLFCL

SEQ ID NO: 840475 - protein, 9 aa, Homo Sapiens
TNTNKLLAY

SEQ ID NO: 840476 - protein, 9 aa, Homo Sapiens
ERLVFKMCF

SEQ ID NO: 840477 - protein, 9 aa, Homo Sapiens
YERQISELP

SEQ ID NO: 840478 - protein, 9 aa, Homo Sapiens
FRYQMYQTQ

SEQ ID NO: 840479 - protein, 9 aa, Homo Sapiens
SIRPLDTVR

SEQ ID NO: 840480 - protein, 9 aa, Homo Sapiens
VKPEQLTCM

SEQ ID NO: 840481 - protein, 9 aa, Homo Sapiens
RLQGEEEER

SEQ ID NO: 840482 - protein, 9 aa, Homo Sapiens
IIGVCSESV

SEQ ID NO: 840483 - protein, 9 aa, Homo Sapiens
GLFRAISLW

SEQ ID NO: 840484 - protein, 9 aa, Homo Sapiens
TLSSGLCRE

SEQ ID NO: 840485 - protein, 9 aa, Homo Sapiens
TLSNQIISF

SEQ ID NO: 840486 - protein, 9 aa, Homo Sapiens
KQIGLLFKK

SEQ ID NO: 840487 - protein, 9 aa, Homo Sapiens
KDALRTSGG

SEQ ID NO: 840488 - protein, 9 aa, Homo Sapiens
GLLSGLQAS

SEQ ID NO: 840489 - protein, 9 aa, Homo Sapiens
DPLHPDANP

SEQ ID NO: 840490 - protein, 9 aa, Homo Sapiens
AAPGSLIGV

SEQ ID NO: 840491 - protein, 9 aa, Homo Sapiens
PVKIVQCHE

SEQ ID NO: 840492 - protein, 9 aa, Homo Sapiens
TPVYISPEV

SEQ ID NO: 840493 - protein, 9 aa, Homo Sapiens
FKEKTVTFL

SEQ ID NO: 840494 - protein, 9 aa, Homo Sapiens
TVLTPMLNT

SEQ ID NO: 840495 - protein, 9 aa, Homo Sapiens
GELFTKTPI

SEQ ID NO: 840496 - protein, 9 aa, Homo Sapiens
LPCKLREDC

SEQ ID NO: 840497 - protein, 9 aa, Homo Sapiens
CPKKNKLTF

SEQ ID NO: 840498 - protein, 9 aa, Homo Sapiens
ESLPVLRNQ

SEQ ID NO: 840499 - protein, 9 aa, Homo Sapiens
QECLKQLFV

SEQ ID NO: 840500 - protein, 9 aa, Homo Sapiens
NVFTANTAF

SEQ ID NO: 840501 - protein, 9 aa, Homo Sapiens
HLFCEVPAL

SEQ ID NO: 840502 - protein, 9 aa, Homo Sapiens
KIIDKLTKE

SEQ ID NO: 840503 - protein, 9 aa, Homo Sapiens
WSWGQNEKG

SEQ ID NO: 840504 - protein, 9 aa, Homo Sapiens
TEDQNSLER

SEQ ID NO: 840505 - protein, 9 aa, Homo Sapiens
AAGNDTLQD

SEQ ID NO: 840506 - protein, 9 aa, Homo Sapiens
ADEDLPVHG

SEQ ID NO: 840507 - protein, 9 aa, Homo Sapiens
TLKQRKDIL

SEQ ID NO: 840508 - protein, 9 aa, Homo Sapiens
GVQALGIIS

SEQ ID NO: 840509 - protein, 9 aa, Homo Sapiens
IQCYVRDKE

SEQ ID NO: 840510 - protein, 9 aa, Homo Sapiens
SKSSSTRES

SEQ ID NO: 840511 - protein, 9 aa, Homo Sapiens
AQKARIRYF

SEQ ID NO: 840512 - protein, 9 aa, Homo Sapiens
IFAIVFSIF

SEQ ID NO: 840513 - protein, 9 aa, Homo Sapiens
VMCKVIGSF

SEQ ID NO: 840514 - protein, 9 aa, Homo Sapiens
NVSLRVKCQ

SEQ ID NO: 840515 - protein, 9 aa, Homo Sapiens
LYLQGLSGD

SEQ ID NO: 840516 - protein, 9 aa, Homo Sapiens
SLDSIVRDD

SEQ ID NO: 840517 - protein, 9 aa, Homo Sapiens
PPVQRGASS

SEQ ID NO: 840518 - protein, 9 aa, Homo Sapiens
VTTRFIFLG

SEQ ID NO: 840519 - protein, 9 aa, Homo Sapiens
RSFEILTKQ

SEQ ID NO: 840520 - protein, 9 aa, Homo Sapiens
VFKMCFYRL

SEQ ID NO: 840521 - protein, 9 aa, Homo Sapiens
LSDQFSAIQ

SEQ ID NO: 840522 - protein, 9 aa, Homo Sapiens
SVYLLQPAQ

SEQ ID NO: 840523 - protein, 9 aa, Homo Sapiens
EDYGLFRAI

SEQ ID NO: 840524 - protein, 9 aa, Homo Sapiens
MNLLSDACS

SEQ ID NO: 840525 - protein, 9 aa, Homo Sapiens
NGVVDAIGL

SEQ ID NO: 840526 - protein, 9 aa, Homo Sapiens
RKLINRNIS

SEQ ID NO: 840527 - protein, 9 aa, Homo Sapiens
QSGYCAMIS

SEQ ID NO: 840528 - protein, 9 aa, Homo Sapiens
THLIMTCKT

SEQ ID NO: 840529 - protein, 9 aa, Homo Sapiens
LLKEGCEIG

SEQ ID NO: 840530 - protein, 9 aa, Homo Sapiens
VFPQSLPKY

SEQ ID NO: 840531 - protein, 9 aa, Homo Sapiens
NTLLNELER

SEQ ID NO: 840532 - protein, 9 aa, Homo Sapiens
CYVPYVAFA

SEQ ID NO: 840533 - protein, 9 aa, Homo Sapiens
IHSVIVILM

SEQ ID NO: 840534 - protein, 9 aa, Homo Sapiens
DDQEFLKGC

SEQ ID NO: 840535 - protein, 9 aa, Homo Sapiens
ELLIKMKGL

SEQ ID NO: 840536 - protein, 9 aa, Homo Sapiens
LPRPVDLSK

SEQ ID NO: 840537 - protein, 9 aa, Homo Sapiens
VSNKLFMAD

SEQ ID NO: 840538 - protein, 9 aa, Homo Sapiens
RAHFLPGKD

SEQ ID NO: 840539 - protein, 9 aa, Homo Sapiens
HKKQVSKNC

SEQ ID NO: 840540 - protein, 9 aa, Homo Sapiens
HKLEAMMHI

SEQ ID NO: 840541 - protein, 9 aa, Homo Sapiens
QNHSLDSKP

SEQ ID NO: 840542 - protein, 9 aa, Homo Sapiens
LSYLAATHH

SEQ ID NO: 840543 - protein, 9 aa, Homo Sapiens
HCFIDYPEK

SEQ ID NO: 840544 - protein, 9 aa, Homo Sapiens
GFEEVQSNA

SEQ ID NO: 840545 - protein, 9 aa, Homo Sapiens
MEKETHRGL

SEQ ID NO: 840546 - protein, 9 aa, Homo Sapiens
AVRLFEEFY

SEQ ID NO: 840547 - protein, 9 aa, Homo Sapiens
MAIFKLLDY

SEQ ID NO: 840548 - protein, 9 aa, Homo Sapiens
WTPESNTSR

SEQ ID NO: 840549 - protein, 9 aa, Homo Sapiens
ASMHCYLDL

SEQ ID NO: 840550 - protein, 9 aa, Homo Sapiens
GFQYIYVGE

SEQ ID NO: 840551 - protein, 9 aa, Homo Sapiens
SLYQKIAKE

SEQ ID NO: 840552 - protein, 9 aa, Homo Sapiens
HKRFHITDN

SEQ ID NO: 840553 - protein, 9 aa, Homo Sapiens
PEMEMDAIQ

SEQ ID NO: 840554 - protein, 9 aa, Homo Sapiens
TEAIDESKK

SEQ ID NO: 840555 - protein, 9 aa, Homo Sapiens
QTEGNIYEC

SEQ ID NO: 840556 - protein, 9 aa, Homo Sapiens
SIISLEFKN

SEQ ID NO: 840557 - protein, 9 aa, Homo Sapiens
VGCDVAYST

SEQ ID NO: 840558 - protein, 9 aa, Homo Sapiens
KPPSPIKPN

SEQ ID NO: 840559 - protein, 9 aa, Homo Sapiens
LKLARDVVS

SEQ ID NO: 840560 - protein, 9 aa, Homo Sapiens
PPSSPLPGS

SEQ ID NO: 840561 - protein, 9 aa, Homo Sapiens
LLNNAIQGG

SEQ ID NO: 840562 - protein, 9 aa, Homo Sapiens
QMAAFAINY

SEQ ID NO: 840563 - protein, 9 aa, Homo Sapiens
STCTAIRTD

SEQ ID NO: 840564 - protein, 9 aa, Homo Sapiens
LNKQVLEHE

SEQ ID NO: 840565 - protein, 9 aa, Homo Sapiens
SALKRHNLY

SEQ ID NO: 840566 - protein, 9 aa, Homo Sapiens
SHLVKWVTV

SEQ ID NO: 840567 - protein, 9 aa, Homo Sapiens
ISRIKTLQA

SEQ ID NO: 840568 - protein, 9 aa, Homo Sapiens
VVGLTIRDV

SEQ ID NO: 840569 - protein, 9 aa, Homo Sapiens
PQGAWKKLD

SEQ ID NO: 840570 - protein, 9 aa, Homo Sapiens
SGVHKLHYL

SEQ ID NO: 840571 - protein, 9 aa, Homo Sapiens
ADLDAFLTE

SEQ ID NO: 840572 - protein, 9 aa, Homo Sapiens
NISVRFGKD

SEQ ID NO: 840573 - protein, 9 aa, Homo Sapiens
GSQWILTAA

SEQ ID NO: 840574 - protein, 9 aa, Homo Sapiens
TIHFSPDIF

SEQ ID NO: 840575 - protein, 9 aa, Homo Sapiens
KTKERSEKD

SEQ ID NO: 840576 - protein, 9 aa, Homo Sapiens
QGQEDEMDI

SEQ ID NO: 840577 - protein, 9 aa, Homo Sapiens
HARERLEQL

SEQ ID NO: 840578 - protein, 9 aa, Homo Sapiens
VITKFLRLF

SEQ ID NO: 840579 - protein, 9 aa, Homo Sapiens
KALIYRIWE

SEQ ID NO: 840580 - protein, 9 aa, Homo Sapiens
LGTGYIFSA

SEQ ID NO: 840581 - protein, 9 aa, Homo Sapiens
SQKLRINAK

SEQ ID NO: 840582 - protein, 9 aa, Homo Sapiens
PAAPTECFS

SEQ ID NO: 840583 - protein, 9 aa, Homo Sapiens
AFPGEIIMR

SEQ ID NO: 840584 - protein, 9 aa, Homo Sapiens
VSQQINSIK

SEQ ID NO: 840585 - protein, 9 aa, Homo Sapiens
TSGELLLRQ

SEQ ID NO: 840586 - protein, 9 aa, Homo Sapiens
DEIRLRRLG

SEQ ID NO: 840587 - protein, 9 aa, Homo Sapiens
EYVKRKDPD

SEQ ID NO: 840588 - protein, 9 aa, Homo Sapiens
HKRKHDEDR

SEQ ID NO: 840589 - protein, 9 aa, Homo Sapiens
PYFKKHNMT

SEQ ID NO: 840590 - protein, 9 aa, Homo Sapiens
IVLEHPNFF

SEQ ID NO: 840591 - protein, 9 aa, Homo Sapiens
DHLQFDQAR

SEQ ID NO: 840592 - protein, 9 aa, Homo Sapiens
SFVLQELGT

SEQ ID NO: 840593 - protein, 9 aa, Homo Sapiens
SMRGNGKKQ

SEQ ID NO: 840594 - protein, 9 aa, Homo Sapiens
DLIQDLRWT

SEQ ID NO: 840595 - protein, 9 aa, Homo Sapiens
MLADRDNQS

SEQ ID NO: 840596 - protein, 9 aa, Homo Sapiens
QRERMMTWL

SEQ ID NO: 840597 - protein, 9 aa, Homo Sapiens
SLQYELREY

SEQ ID NO: 840598 - protein, 9 aa, Homo Sapiens
GECRYRENV

SEQ ID NO: 840599 - protein, 9 aa, Homo Sapiens
VHYLLQAAT

SEQ ID NO: 840600 - protein, 9 aa, Homo Sapiens
LTATSEDYT

SEQ ID NO: 840601 - protein, 9 aa, Homo Sapiens
NYVCLKYAY

SEQ ID NO: 840602 - protein, 9 aa, Homo Sapiens
YLMDLLSKM

SEQ ID NO: 840603 - protein, 9 aa, Homo Sapiens
TWRFGVAAP

SEQ ID NO: 840604 - protein, 9 aa, Homo Sapiens
VDDTQCVWL

SEQ ID NO: 840605 - protein, 9 aa, Homo Sapiens
KLWTISMKV

SEQ ID NO: 840606 - protein, 9 aa, Homo Sapiens
LFLSDRHRC

SEQ ID NO: 840607 - protein, 9 aa, Homo Sapiens
VRQNVSQEN

SEQ ID NO: 840608 - protein, 9 aa, Homo Sapiens
IITREEFIA

SEQ ID NO: 840609 - protein, 9 aa, Homo Sapiens
YSAFLSAVK

SEQ ID NO: 840610 - protein, 9 aa, Homo Sapiens
SSHVDQRSM

SEQ ID NO: 840611 - protein, 9 aa, Homo Sapiens
ATCLYFICK

SEQ ID NO: 840612 - protein, 9 aa, Homo Sapiens
LVQNNVSPK

SEQ ID NO: 840613 - protein, 9 aa, Homo Sapiens
VNVMMPPWR

SEQ ID NO: 840614 - protein, 9 aa, Homo Sapiens
VKHMKYIHL

SEQ ID NO: 840615 - protein, 9 aa, Homo Sapiens
FKTWKCPEN

SEQ ID NO: 840616 - protein, 9 aa, Homo Sapiens
LRTRGIFKT

SEQ ID NO: 840617 - protein, 9 aa, Homo Sapiens
YGPNKRGPK

SEQ ID NO: 840618 - protein, 9 aa, Homo Sapiens
QDLLSDLNK

SEQ ID NO: 840619 - protein, 9 aa, Homo Sapiens
DNTPNNYLS

SEQ ID NO: 840620 - protein, 9 aa, Homo Sapiens
DQEAAKRTI

SEQ ID NO: 840621 - protein, 9 aa, Homo Sapiens
KIEDTLCHF

SEQ ID NO: 840622 - protein, 9 aa, Homo Sapiens
VQWVYVELK

SEQ ID NO: 840623 - protein, 9 aa, Homo Sapiens
SQLFIQVEA

SEQ ID NO: 840624 - protein, 9 aa, Homo Sapiens
SRQEHERMS

SEQ ID NO: 840625 - protein, 9 aa, Homo Sapiens
FTNYIQALR

SEQ ID NO: 840626 - protein, 9 aa, Homo Sapiens
GLTLGRSPI

SEQ ID NO: 840627 - protein, 9 aa, Homo Sapiens
LRLFAPAIL

SEQ ID NO: 840628 - protein, 9 aa, Homo Sapiens
QIHTGESSV

SEQ ID NO: 840629 - protein, 9 aa, Homo Sapiens
ERRRMHLVY

SEQ ID NO: 840630 - protein, 9 aa, Homo Sapiens
EQQLKEITA

SEQ ID NO: 840631 - protein, 9 aa, Homo Sapiens
GQLGVELFD

SEQ ID NO: 840632 - protein, 9 aa, Homo Sapiens
YLNDLKVVS

SEQ ID NO: 840633 - protein, 9 aa, Homo Sapiens
IQYTCSPGF

SEQ ID NO: 840634 - protein, 9 aa, Homo Sapiens
ATEILYTKT

SEQ ID NO: 840635 - protein, 9 aa, Homo Sapiens
LKNMEIPST

SEQ ID NO: 840636 - protein, 9 aa, Homo Sapiens
TQTLDVSSK

SEQ ID NO: 840637 - protein, 9 aa, Homo Sapiens
SYSVPCQRT

SEQ ID NO: 840638 - protein, 9 aa, Homo Sapiens
RIEEPIKGS

SEQ ID NO: 840639 - protein, 9 aa, Homo Sapiens
FVAHKYKKQ

SEQ ID NO: 840640 - protein, 9 aa, Homo Sapiens
IKKNGEDKL

SEQ ID NO: 840641 - protein, 9 aa, Homo Sapiens
WISDGKKQE

SEQ ID NO: 840642 - protein, 9 aa, Homo Sapiens
TIHSTVRSL

SEQ ID NO: 840643 - protein, 9 aa, Homo Sapiens
YKMVIAACS

SEQ ID NO: 840644 - protein, 9 aa, Homo Sapiens
ALAQNKSLN

SEQ ID NO: 840645 - protein, 9 aa, Homo Sapiens
DVINHDPVV

SEQ ID NO: 840646 - protein, 9 aa, Homo Sapiens
MFPATLPPS

SEQ ID NO: 840647 - protein, 9 aa, Homo Sapiens
DTMLRGDNN

SEQ ID NO: 840648 - protein, 9 aa, Homo Sapiens
HYFHKPCAS

SEQ ID NO: 840649 - protein, 9 aa, Homo Sapiens
CNEAENKRM

SEQ ID NO: 840650 - protein, 9 aa, Homo Sapiens
TFIAGYLIL

SEQ ID NO: 840651 - protein, 9 aa, Homo Sapiens
LAFISLAFL

SEQ ID NO: 840652 - protein, 9 aa, Homo Sapiens
GPGLQTHCY

SEQ ID NO: 840653 - protein, 9 aa, Homo Sapiens
LLPSVTKLF

SEQ ID NO: 840654 - protein, 9 aa, Homo Sapiens
TKQTTSLLH

SEQ ID NO: 840655 - protein, 9 aa, Homo Sapiens
PKGLSERVV

SEQ ID NO: 840656 - protein, 9 aa, Homo Sapiens
LQNTVASLH

SEQ ID NO: 840657 - protein, 9 aa, Homo Sapiens
TYCSENKIP

SEQ ID NO: 840658 - protein, 9 aa, Homo Sapiens
GAKEKNKEE

SEQ ID NO: 840659 - protein, 9 aa, Homo Sapiens
CLLAAALQW

SEQ ID NO: 840660 - protein, 9 aa, Homo Sapiens
LPGGALNRV

SEQ ID NO: 840661 - protein, 9 aa, Homo Sapiens
GLEHQLHRE

SEQ ID NO: 840662 - protein, 9 aa, Homo Sapiens
RDDGCNSGS

SEQ ID NO: 840663 - protein, 9 aa, Homo Sapiens
KEGPVRLYE

SEQ ID NO: 840664 - protein, 9 aa, Homo Sapiens
WFRDGVMLD

SEQ ID NO: 840665 - protein, 9 aa, Homo Sapiens
SMVSGFSSP

SEQ ID NO: 840666 - protein, 9 aa, Homo Sapiens
SSLLGGFQA

SEQ ID NO: 840667 - protein, 9 aa, Homo Sapiens
VLIVEKGMD

SEQ ID NO: 840668 - protein, 9 aa, Homo Sapiens
IIHSGDRPY

SEQ ID NO: 840669 - protein, 9 aa, Homo Sapiens
KPPRFLQIN

SEQ ID NO: 840670 - protein, 9 aa, Homo Sapiens
LEELTCLAF

SEQ ID NO: 840671 - protein, 9 aa, Homo Sapiens
LCVEHINLH

SEQ ID NO: 840672 - protein, 9 aa, Homo Sapiens
LLWCRNEKK

SEQ ID NO: 840673 - protein, 9 aa, Homo Sapiens
KLLQRIKDI

SEQ ID NO: 840674 - protein, 9 aa, Homo Sapiens
SYVRSQLNA

SEQ ID NO: 840675 - protein, 9 aa, Homo Sapiens
GLYFAKLYY

SEQ ID NO: 840676 - protein, 9 aa, Homo Sapiens
FIVFTGNET

SEQ ID NO: 840677 - protein, 9 aa, Homo Sapiens
KESLINCPG

SEQ ID NO: 840678 - protein, 9 aa, Homo Sapiens
ITILPGFQR

SEQ ID NO: 840679 - protein, 9 aa, Homo Sapiens
FSSPSLPWS

SEQ ID NO: 840680 - protein, 9 aa, Homo Sapiens
IMFTVDAMK

SEQ ID NO: 840681 - protein, 9 aa, Homo Sapiens
VNDNKWKKT

SEQ ID NO: 840682 - protein, 9 aa, Homo Sapiens
WLRGNDSVC

SEQ ID NO: 840683 - protein, 9 aa, Homo Sapiens
EKVKEIRDQ

SEQ ID NO: 840684 - protein, 9 aa, Homo Sapiens
IGVWQDIIY

SEQ ID NO: 840685 - protein, 9 aa, Homo Sapiens
LACFLHSGK

SEQ ID NO: 840686 - protein, 9 aa, Homo Sapiens
PKMLKCDKF

SEQ ID NO: 840687 - protein, 9 aa, Homo Sapiens
EARIRRLLK

SEQ ID NO: 840688 - protein, 9 aa, Homo Sapiens
QILLLRNNG

SEQ ID NO: 840689 - protein, 9 aa, Homo Sapiens
CDKCDKLFR

SEQ ID NO: 840690 - protein, 9 aa, Homo Sapiens
YKKMKGGER

SEQ ID NO: 840691 - protein, 9 aa, Homo Sapiens
LTYRGFIFK

SEQ ID NO: 840692 - protein, 9 aa, Homo Sapiens
GNMTELERA

SEQ ID NO: 840693 - protein, 9 aa, Homo Sapiens
NKSEYTVKW

SEQ ID NO: 840694 - protein, 9 aa, Homo Sapiens
PCFQLRYRT

SEQ ID NO: 840695 - protein, 9 aa, Homo Sapiens
RTISCDQLS

SEQ ID NO: 840696 - protein, 9 aa, Homo Sapiens
MGLKNMKGL

SEQ ID NO: 840697 - protein, 9 aa, Homo Sapiens
VGHQVLQIS

SEQ ID NO: 840698 - protein, 9 aa, Homo Sapiens
GQATAADQD

SEQ ID NO: 840699 - protein, 9 aa, Homo Sapiens
NPLIYTLIN

SEQ ID NO: 840700 - protein, 9 aa, Homo Sapiens
QMAVAQVHL

SEQ ID NO: 840701 - protein, 9 aa, Homo Sapiens
DCDKTGIEE

SEQ ID NO: 840702 - protein, 9 aa, Homo Sapiens
LRAVSDASA

SEQ ID NO: 840703 - protein, 9 aa, Homo Sapiens
SSSEKKREI

SEQ ID NO: 840704 - protein, 9 aa, Homo Sapiens
DGRRWLTLK

SEQ ID NO: 840705 - protein, 9 aa, Homo Sapiens
PAYSGRETL

SEQ ID NO: 840706 - protein, 9 aa, Homo Sapiens
TECFELLEE

SEQ ID NO: 840707 - protein, 9 aa, Homo Sapiens
QQMKSQWML

SEQ ID NO: 840708 - protein, 9 aa, Homo Sapiens
KQLEEKKTC

SEQ ID NO: 840709 - protein, 9 aa, Homo Sapiens
RYQNEKNVS

SEQ ID NO: 840710 - protein, 9 aa, Homo Sapiens
RLILKRASA

SEQ ID NO: 840711 - protein, 9 aa, Homo Sapiens
PLYQRVGVP

SEQ ID NO: 840712 - protein, 9 aa, Homo Sapiens
VRDQVLQVQ

SEQ ID NO: 840713 - protein, 9 aa, Homo Sapiens
NTTAGGGPP

SEQ ID NO: 840714 - protein, 9 aa, Homo Sapiens
YWDWWDAEK

SEQ ID NO: 840715 - protein, 9 aa, Homo Sapiens
MPMLDLDDN

SEQ ID NO: 840716 - protein, 9 aa, Homo Sapiens
LYAIGGRYG

SEQ ID NO: 840717 - protein, 9 aa, Homo Sapiens
KFLVETFHD

SEQ ID NO: 840718 - protein, 9 aa, Homo Sapiens
PDTSDQTST

SEQ ID NO: 840719 - protein, 9 aa, Homo Sapiens
KSALPTLTW

SEQ ID NO: 840720 - protein, 9 aa, Homo Sapiens
STDAVDCMS

SEQ ID NO: 840721 - protein, 9 aa, Homo Sapiens
DPFDLFDVQ

SEQ ID NO: 840722 - protein, 9 aa, Homo Sapiens
CSLKKYSNP

SEQ ID NO: 840723 - protein, 9 aa, Homo Sapiens
QTSIDAYDN

SEQ ID NO: 840724 - protein, 9 aa, Homo Sapiens
DTSTFEEVI

SEQ ID NO: 840725 - protein, 9 aa, Homo Sapiens
QRVIIVRRN

SEQ ID NO: 840726 - protein, 9 aa, Homo Sapiens
AKRADEELL

SEQ ID NO: 840727 - protein, 9 aa, Homo Sapiens
QMLKCHVFC

SEQ ID NO: 840728 - protein, 9 aa, Homo Sapiens
KCYRGKETL

SEQ ID NO: 840729 - protein, 9 aa, Homo Sapiens
VNHEFNLLD

SEQ ID NO: 840730 - protein, 9 aa, Homo Sapiens
VGVEEVQTF

SEQ ID NO: 840731 - protein, 9 aa, Homo Sapiens
TPERTDIAQ

SEQ ID NO: 840732 - protein, 9 aa, Homo Sapiens
IETYNVDKK

SEQ ID NO: 840733 - protein, 9 aa, Homo Sapiens
DTLDNNEAV

SEQ ID NO: 840734 - protein, 9 aa, Homo Sapiens
TTHVLVHDV

SEQ ID NO: 840735 - protein, 9 aa, Homo Sapiens
AKNKECVAN

SEQ ID NO: 840736 - protein, 9 aa, Homo Sapiens
SSKIISFKS

SEQ ID NO: 840737 - protein, 9 aa, Homo Sapiens
RHISALEDD

SEQ ID NO: 840738 - protein, 9 aa, Homo Sapiens
NYILVYGNI

SEQ ID NO: 840739 - protein, 9 aa, Homo Sapiens
FLFTCLNFE

SEQ ID NO: 840740 - protein, 9 aa, Homo Sapiens
DKLANGSLE

SEQ ID NO: 840741 - protein, 9 aa, Homo Sapiens
RDMIMKILK

SEQ ID NO: 840742 - protein, 9 aa, Homo Sapiens
DVIDCCVNL

SEQ ID NO: 840743 - protein, 9 aa, Homo Sapiens
IKVSYSERH

SEQ ID NO: 840744 - protein, 9 aa, Homo Sapiens
MILNKAMLL

SEQ ID NO: 840745 - protein, 9 aa, Homo Sapiens
GALGSGRTS

SEQ ID NO: 840746 - protein, 9 aa, Homo Sapiens
SGRINVYGF

SEQ ID NO: 840747 - protein, 9 aa, Homo Sapiens
RKNVNVSFN

SEQ ID NO: 840748 - protein, 9 aa, Homo Sapiens
LFTFPSDVP

SEQ ID NO: 840749 - protein, 9 aa, Homo Sapiens
NKGKEFGFI

SEQ ID NO: 840750 - protein, 9 aa, Homo Sapiens
YNQGGYNQY

SEQ ID NO: 840751 - protein, 9 aa, Homo Sapiens
RSGLTKHVQ

SEQ ID NO: 840752 - protein, 9 aa, Homo Sapiens
YLTAETVKN

SEQ ID NO: 840753 - protein, 9 aa, Homo Sapiens
YWLLTHRTL

SEQ ID NO: 840754 - protein, 9 aa, Homo Sapiens
SASEANAPE

SEQ ID NO: 840755 - protein, 9 aa, Homo Sapiens
VINFDDIAS

SEQ ID NO: 840756 - protein, 9 aa, Homo Sapiens
VIVHQAILG

SEQ ID NO: 840757 - protein, 9 aa, Homo Sapiens
EVNSDIFLC

SEQ ID NO: 840758 - protein, 9 aa, Homo Sapiens
AMLLIGTVP

SEQ ID NO: 840759 - protein, 9 aa, Homo Sapiens
RSSISKHNL

SEQ ID NO: 840760 - protein, 9 aa, Homo Sapiens
IEIIDQLFA

SEQ ID NO: 840761 - protein, 9 aa, Homo Sapiens
CPVCRQPSQ

SEQ ID NO: 840762 - protein, 9 aa, Homo Sapiens
ITALAQASA

SEQ ID NO: 840763 - protein, 9 aa, Homo Sapiens
YCESEINSL

SEQ ID NO: 840764 - protein, 9 aa, Homo Sapiens
ILVKRYLTP

SEQ ID NO: 840765 - protein, 9 aa, Homo Sapiens
PTSGDLYNV

SEQ ID NO: 840766 - protein, 9 aa, Homo Sapiens
VINHQRVHT

SEQ ID NO: 840767 - protein, 9 aa, Homo Sapiens
SFLSADYNK

SEQ ID NO: 840768 - protein, 9 aa, Homo Sapiens
TALLIQALS

SEQ ID NO: 840769 - protein, 9 aa, Homo Sapiens
GAHITTPEQ

SEQ ID NO: 840770 - protein, 9 aa, Homo Sapiens
GSSFVSVRP

SEQ ID NO: 840771 - protein, 9 aa, Homo Sapiens
QIVIRGLNT

SEQ ID NO: 840772 - protein, 9 aa, Homo Sapiens
LSQSPEIDK

SEQ ID NO: 840773 - protein, 9 aa, Homo Sapiens
MEDGGLTTF

SEQ ID NO: 840774 - protein, 9 aa, Homo Sapiens
NTAIVHMHR

SEQ ID NO: 840775 - protein, 9 aa, Homo Sapiens
DCLFNEDSL

SEQ ID NO: 840776 - protein, 9 aa, Homo Sapiens
VSSWTAEGD

SEQ ID NO: 840777 - protein, 9 aa, Homo Sapiens
HAVRVARQR

SEQ ID NO: 840778 - protein, 9 aa, Homo Sapiens
SSSMTRSPL

SEQ ID NO: 840779 - protein, 9 aa, Homo Sapiens
MIQCFWVKS

SEQ ID NO: 840780 - protein, 9 aa, Homo Sapiens
RLWSGTAYC

SEQ ID NO: 840781 - protein, 9 aa, Homo Sapiens
QISVADEAQ

SEQ ID NO: 840782 - protein, 9 aa, Homo Sapiens
EMMGPRMVG

SEQ ID NO: 840783 - protein, 9 aa, Homo Sapiens
VKHLCHSAW

SEQ ID NO: 840784 - protein, 9 aa, Homo Sapiens
LILISPHNP

SEQ ID NO: 840785 - protein, 9 aa, Homo Sapiens
SESSAADFD

SEQ ID NO: 840786 - protein, 9 aa, Homo Sapiens
ALLSETRDL

SEQ ID NO: 840787 - protein, 9 aa, Homo Sapiens
TETLTKQLS

SEQ ID NO: 840788 - protein, 9 aa, Homo Sapiens
EKIIDKLTK

SEQ ID NO: 840789 - protein, 9 aa, Homo Sapiens
VFWNFDVDG

SEQ ID NO: 840790 - protein, 9 aa, Homo Sapiens
DAAFTIYEM

SEQ ID NO: 840791 - protein, 9 aa, Homo Sapiens
TSLCCGGVL

SEQ ID NO: 840792 - protein, 9 aa, Homo Sapiens
LAFNKEQQL

SEQ ID NO: 840793 - protein, 9 aa, Homo Sapiens
VNFCVTVSF

SEQ ID NO: 840794 - protein, 9 aa, Homo Sapiens
SSTNQTGMS

SEQ ID NO: 840795 - protein, 9 aa, Homo Sapiens
QVLGHTLRA

SEQ ID NO: 840796 - protein, 9 aa, Homo Sapiens
SLAAEINTA

SEQ ID NO: 840797 - protein, 9 aa, Homo Sapiens
CVTALIGWL

SEQ ID NO: 840798 - protein, 9 aa, Homo Sapiens
KSRLLFFSQ

SEQ ID NO: 840799 - protein, 9 aa, Homo Sapiens
SVYRDAFNS

SEQ ID NO: 840800 - protein, 9 aa, Homo Sapiens
TIRKCLTKC

SEQ ID NO: 840801 - protein, 9 aa, Homo Sapiens
ALESSEEVD

SEQ ID NO: 840802 - protein, 9 aa, Homo Sapiens
NNARNDFLK

SEQ ID NO: 840803 - protein, 9 aa, Homo Sapiens
TFYNRKDGT

SEQ ID NO: 840804 - protein, 9 aa, Homo Sapiens
KEKAKAEGR

SEQ ID NO: 840805 - protein, 9 aa, Homo Sapiens
DTISPHCNL

SEQ ID NO: 840806 - protein, 9 aa, Homo Sapiens
NAGQVWRPE

SEQ ID NO: 840807 - protein, 9 aa, Homo Sapiens
YLKYTKYTK

SEQ ID NO: 840808 - protein, 9 aa, Homo Sapiens
QVFVEYAHA

SEQ ID NO: 840809 - protein, 9 aa, Homo Sapiens
DVNKLTPSN

SEQ ID NO: 840810 - protein, 9 aa, Homo Sapiens
VVHGKERSI

SEQ ID NO: 840811 - protein, 9 aa, Homo Sapiens
VDGLKNQKL

SEQ ID NO: 840812 - protein, 9 aa, Homo Sapiens
TLTRRPTLQ

SEQ ID NO: 840813 - protein, 9 aa, Homo Sapiens
TMPGPSSES

SEQ ID NO: 840814 - protein, 9 aa, Homo Sapiens
IQFYMYEIL

SEQ ID NO: 840815 - protein, 9 aa, Homo Sapiens
VKITKPNKR

SEQ ID NO: 840816 - protein, 9 aa, Homo Sapiens
AKARAAQSD

SEQ ID NO: 840817 - protein, 9 aa, Homo Sapiens
ATESADSID

SEQ ID NO: 840818 - protein, 9 aa, Homo Sapiens
AQRNLYTDV

SEQ ID NO: 840819 - protein, 9 aa, Homo Sapiens
WGRHTNPPP

SEQ ID NO: 840820 - protein, 9 aa, Homo Sapiens
YKNRDAILA

SEQ ID NO: 840821 - protein, 9 aa, Homo Sapiens
YEEPFPAEI

SEQ ID NO: 840822 - protein, 9 aa, Homo Sapiens
ERLVTEEVI

SEQ ID NO: 840823 - protein, 9 aa, Homo Sapiens
KLFFSGSAK

SEQ ID NO: 840824 - protein, 9 aa, Homo Sapiens
YDSVINHQR

SEQ ID NO: 840825 - protein, 9 aa, Homo Sapiens
LVMVECFGG

SEQ ID NO: 840826 - protein, 9 aa, Homo Sapiens
QFNILDPLK

SEQ ID NO: 840827 - protein, 9 aa, Homo Sapiens
NTGVPDRIQ

SEQ ID NO: 840828 - protein, 9 aa, Homo Sapiens
GNSFMVVNA

SEQ ID NO: 840829 - protein, 9 aa, Homo Sapiens
CFSFWYHLH

SEQ ID NO: 840830 - protein, 9 aa, Homo Sapiens
VYDWPPQIQ

SEQ ID NO: 840831 - protein, 9 aa, Homo Sapiens
TQVPAYLID

SEQ ID NO: 840832 - protein, 9 aa, Homo Sapiens
STVLIALKS

SEQ ID NO: 840833 - protein, 9 aa, Homo Sapiens
LLCENYHSH

SEQ ID NO: 840834 - protein, 9 aa, Homo Sapiens
YSITQVVIL

SEQ ID NO: 840835 - protein, 9 aa, Homo Sapiens
VACSNVSQV

SEQ ID NO: 840836 - protein, 9 aa, Homo Sapiens
VPYNHIDDL

SEQ ID NO: 840837 - protein, 9 aa, Homo Sapiens
RIIRGTKRY

SEQ ID NO: 840838 - protein, 9 aa, Homo Sapiens
GWHHCPHLP

SEQ ID NO: 840839 - protein, 9 aa, Homo Sapiens
KAKKREVLS

SEQ ID NO: 840840 - protein, 9 aa, Homo Sapiens
VTTVPEVIN

SEQ ID NO: 840841 - protein, 9 aa, Homo Sapiens
QLCVGTMAL

SEQ ID NO: 840842 - protein, 9 aa, Homo Sapiens
RPPETAQTE

SEQ ID NO: 840843 - protein, 9 aa, Homo Sapiens
VPMILQLGG

SEQ ID NO: 840844 - protein, 9 aa, Homo Sapiens
EKNIEAPIS

SEQ ID NO: 840845 - protein, 9 aa, Homo Sapiens
CRFEVSSYL

SEQ ID NO: 840846 - protein, 9 aa, Homo Sapiens
PASDGVQNL

SEQ ID NO: 840847 - protein, 9 aa, Homo Sapiens
FINKGKEFG

SEQ ID NO: 840848 - protein, 9 aa, Homo Sapiens
RPQTTQADI

SEQ ID NO: 840849 - protein, 9 aa, Homo Sapiens
NYRLGILVF

SEQ ID NO: 840850 - protein, 9 aa, Homo Sapiens
TFDNVAVDF

SEQ ID NO: 840851 - protein, 9 aa, Homo Sapiens
IINKTQNVS

SEQ ID NO: 840852 - protein, 9 aa, Homo Sapiens
VDQALRESF

SEQ ID NO: 840853 - protein, 9 aa, Homo Sapiens
IFTGLDVYG

SEQ ID NO: 840854 - protein, 9 aa, Homo Sapiens
EWEKKHRDR

SEQ ID NO: 840855 - protein, 9 aa, Homo Sapiens
HLKSYLRKN

SEQ ID NO: 840856 - protein, 9 aa, Homo Sapiens
KNHCSRLTL

SEQ ID NO: 840857 - protein, 9 aa, Homo Sapiens
LIMTCKTFR

SEQ ID NO: 840858 - protein, 9 aa, Homo Sapiens
NNIETHLKE

SEQ ID NO: 840859 - protein, 9 aa, Homo Sapiens
SSVFIPRRL

SEQ ID NO: 840860 - protein, 9 aa, Homo Sapiens
NEYAYLKVI

SEQ ID NO: 840861 - protein, 9 aa, Homo Sapiens
LHENLLHQE

SEQ ID NO: 840862 - protein, 9 aa, Homo Sapiens
LKVFLGTAS

SEQ ID NO: 840863 - protein, 9 aa, Homo Sapiens
QQYDIEITI

SEQ ID NO: 840864 - protein, 9 aa, Homo Sapiens
GAKVMSEPL

SEQ ID NO: 840865 - protein, 9 aa, Homo Sapiens
EAAESFHPG

SEQ ID NO: 840866 - protein, 9 aa, Homo Sapiens
VVSHLVKWV

SEQ ID NO: 840867 - protein, 9 aa, Homo Sapiens
KWASPEVLS

SEQ ID NO: 840868 - protein, 9 aa, Homo Sapiens
IFWGRILGL

SEQ ID NO: 840869 - protein, 9 aa, Homo Sapiens
IKTATKKGT

SEQ ID NO: 840870 - protein, 9 aa, Homo Sapiens
FCRERSTFR

SEQ ID NO: 840871 - protein, 9 aa, Homo Sapiens
YYDVSDSFG

SEQ ID NO: 840872 - protein, 9 aa, Homo Sapiens
RAEYFKGLT

SEQ ID NO: 840873 - protein, 9 aa, Homo Sapiens
DVFNPSWKT

SEQ ID NO: 840874 - protein, 9 aa, Homo Sapiens
SCLSIHRGV

SEQ ID NO: 840875 - protein, 9 aa, Homo Sapiens
ACLQWLGQQ

SEQ ID NO: 840876 - protein, 9 aa, Homo Sapiens
QLFQEAVPP

SEQ ID NO: 840877 - protein, 9 aa, Homo Sapiens
VKEYQIQEP

SEQ ID NO: 840878 - protein, 9 aa, Homo Sapiens
DVESLVRLN

SEQ ID NO: 840879 - protein, 9 aa, Homo Sapiens
SGDCKRSNI

SEQ ID NO: 840880 - protein, 9 aa, Homo Sapiens
AYSLNGHKF

SEQ ID NO: 840881 - protein, 9 aa, Homo Sapiens
PFDHMFQIY

SEQ ID NO: 840882 - protein, 9 aa, Homo Sapiens
PNHAPMAGG

SEQ ID NO: 840883 - protein, 9 aa, Homo Sapiens
KELFEENIK

SEQ ID NO: 840884 - protein, 9 aa, Homo Sapiens
LRRPASYWA

SEQ ID NO: 840885 - protein, 9 aa, Homo Sapiens
VEVAQVVKL

SEQ ID NO: 840886 - protein, 9 aa, Homo Sapiens
WPNEENNKD

SEQ ID NO: 840887 - protein, 9 aa, Homo Sapiens
NHDEEPTVS

SEQ ID NO: 840888 - protein, 9 aa, Homo Sapiens
LHSGVQPFE

SEQ ID NO: 840889 - protein, 9 aa, Homo Sapiens
GMKEMLRQF

SEQ ID NO: 840890 - protein, 9 aa, Homo Sapiens
MKQNKLLEP

SEQ ID NO: 840891 - protein, 9 aa, Homo Sapiens
PDPELFDPN

SEQ ID NO: 840892 - protein, 9 aa, Homo Sapiens
DANPMEHFA

SEQ ID NO: 840893 - protein, 9 aa, Homo Sapiens
DTTDCSFIV

SEQ ID NO: 840894 - protein, 9 aa, Homo Sapiens
EVKPMWPKG

SEQ ID NO: 840895 - protein, 9 aa, Homo Sapiens
EDVHAERVQ

SEQ ID NO: 840896 - protein, 9 aa, Homo Sapiens
NEKDKRQQG

SEQ ID NO: 840897 - protein, 9 aa, Homo Sapiens
ALIQGYAEG

SEQ ID NO: 840898 - protein, 9 aa, Homo Sapiens
QNIPFNLTK

SEQ ID NO: 840899 - protein, 9 aa, Homo Sapiens
AGCHLLTVH

SEQ ID NO: 840900 - protein, 9 aa, Homo Sapiens
QTTKIFIYN

SEQ ID NO: 840901 - protein, 9 aa, Homo Sapiens
LESLRQRDA

SEQ ID NO: 840902 - protein, 9 aa, Homo Sapiens
FTVHPESGD

SEQ ID NO: 840903 - protein, 9 aa, Homo Sapiens
DGKYALLTS

SEQ ID NO: 840904 - protein, 9 aa, Homo Sapiens
AYQRAQMEM

SEQ ID NO: 840905 - protein, 9 aa, Homo Sapiens
DKFDYGNKY

SEQ ID NO: 840906 - protein, 9 aa, Homo Sapiens
TTTGHLIYT

SEQ ID NO: 840907 - protein, 9 aa, Homo Sapiens
DIAYANDFA

SEQ ID NO: 840908 - protein, 9 aa, Homo Sapiens
ESKLLKKAQ

SEQ ID NO: 840909 - protein, 9 aa, Homo Sapiens
TNILTELRR

SEQ ID NO: 840910 - protein, 9 aa, Homo Sapiens
KNKLSGSHR

SEQ ID NO: 840911 - protein, 9 aa, Homo Sapiens
LHHCCDLLI

SEQ ID NO: 840912 - protein, 9 aa, Homo Sapiens
FGHNECIGE

SEQ ID NO: 840913 - protein, 9 aa, Homo Sapiens
LELVHLLCC

SEQ ID NO: 840914 - protein, 9 aa, Homo Sapiens
LSSSSARAL

SEQ ID NO: 840915 - protein, 9 aa, Homo Sapiens
SKNEVQDYA

SEQ ID NO: 840916 - protein, 9 aa, Homo Sapiens
KTAIYAMVE

SEQ ID NO: 840917 - protein, 9 aa, Homo Sapiens
MMHILQAET

SEQ ID NO: 840918 - protein, 9 aa, Homo Sapiens
QEMYDCVSQ

SEQ ID NO: 840919 - protein, 9 aa, Homo Sapiens
GKRKTVTDF

SEQ ID NO: 840920 - protein, 9 aa, Homo Sapiens
KQSLNENSA

SEQ ID NO: 840921 - protein, 9 aa, Homo Sapiens
ANYLQDRID

SEQ ID NO: 840922 - protein, 9 aa, Homo Sapiens
HLIEHQKIH

SEQ ID NO: 840923 - protein, 9 aa, Homo Sapiens
LDREGTPEL

SEQ ID NO: 840924 - protein, 9 aa, Homo Sapiens
NKPYACKEC

SEQ ID NO: 840925 - protein, 9 aa, Homo Sapiens
VEALQGEKQ

SEQ ID NO: 840926 - protein, 9 aa, Homo Sapiens
RLQPEWGSP

SEQ ID NO: 840927 - protein, 9 aa, Homo Sapiens
ESKSSSTRE

SEQ ID NO: 840928 - protein, 9 aa, Homo Sapiens
KLCKYEFIM

SEQ ID NO: 840929 - protein, 9 aa, Homo Sapiens
PMPAYRGSY

SEQ ID NO: 840930 - protein, 9 aa, Homo Sapiens
GLSERVVDY

SEQ ID NO: 840931 - protein, 9 aa, Homo Sapiens
VTSCPGCQK

SEQ ID NO: 840932 - protein, 9 aa, Homo Sapiens
PYGKKCTYA

SEQ ID NO: 840933 - protein, 9 aa, Homo Sapiens
GGTVVSTNW

SEQ ID NO: 840934 - protein, 9 aa, Homo Sapiens
SQALRGTLT

SEQ ID NO: 840935 - protein, 9 aa, Homo Sapiens
AQDDDFFNE

SEQ ID NO: 840936 - protein, 9 aa, Homo Sapiens
WRCSCWAWQ

SEQ ID NO: 840937 - protein, 9 aa, Homo Sapiens
NWSTFHPRT

SEQ ID NO: 840938 - protein, 9 aa, Homo Sapiens
LALAFLAYI

SEQ ID NO: 840939 - protein, 9 aa, Homo Sapiens
PHLTSVLER

SEQ ID NO: 840940 - protein, 9 aa, Homo Sapiens
CVISNHPKI

SEQ ID NO: 840941 - protein, 9 aa, Homo Sapiens
HCSRLTLEQ

SEQ ID NO: 840942 - protein, 9 aa, Homo Sapiens
KTSDIEPKN

SEQ ID NO: 840943 - protein, 9 aa, Homo Sapiens
RCTKLDMAR

SEQ ID NO: 840944 - protein, 9 aa, Homo Sapiens
LAMSRRSWL

SEQ ID NO: 840945 - protein, 9 aa, Homo Sapiens
FKKIRNSLL

SEQ ID NO: 840946 - protein, 9 aa, Homo Sapiens
KLDEPHEKH

SEQ ID NO: 840947 - protein, 9 aa, Homo Sapiens
NLKELCVYH

SEQ ID NO: 840948 - protein, 9 aa, Homo Sapiens
IGIPEQALS

SEQ ID NO: 840949 - protein, 9 aa, Homo Sapiens
DRPPPRHQN

SEQ ID NO: 840950 - protein, 9 aa, Homo Sapiens
SLEISLSVG

SEQ ID NO: 840951 - protein, 9 aa, Homo Sapiens
ITTFILQNV

SEQ ID NO: 840952 - protein, 9 aa, Homo Sapiens
FSNMTNCEV

SEQ ID NO: 840953 - protein, 9 aa, Homo Sapiens
QALQTSIDA

SEQ ID NO: 840954 - protein, 9 aa, Homo Sapiens
ATGAYRARV

SEQ ID NO: 840955 - protein, 9 aa, Homo Sapiens
ACFDHQGEI

SEQ ID NO: 840956 - protein, 9 aa, Homo Sapiens
KASYPSAMN

SEQ ID NO: 840957 - protein, 9 aa, Homo Sapiens
HIKHVNVMM

SEQ ID NO: 840958 - protein, 9 aa, Homo Sapiens
PLENEQSIN

SEQ ID NO: 840959 - protein, 9 aa, Homo Sapiens
YNHFFKESW

SEQ ID NO: 840960 - protein, 9 aa, Homo Sapiens
GPASNDPRS

SEQ ID NO: 840961 - protein, 9 aa, Homo Sapiens
QVFSFFPAG

SEQ ID NO: 840962 - protein, 9 aa, Homo Sapiens
FILLIIKGK

SEQ ID NO: 840963 - protein, 9 aa, Homo Sapiens
LYPIPMMPM

SEQ ID NO: 840964 - protein, 9 aa, Homo Sapiens
LESGKLPQS

SEQ ID NO: 840965 - protein, 9 aa, Homo Sapiens
FPVADYLVV

SEQ ID NO: 840966 - protein, 9 aa, Homo Sapiens
AGSAVLIRE

SEQ ID NO: 840967 - protein, 9 aa, Homo Sapiens
CEDNSLPYQ

SEQ ID NO: 840968 - protein, 9 aa, Homo Sapiens
FIEPPEIME

SEQ ID NO: 840969 - protein, 9 aa, Homo Sapiens
ALLEFNVNS

SEQ ID NO: 840970 - protein, 9 aa, Homo Sapiens
SLIGVGTKI

SEQ ID NO: 840971 - protein, 9 aa, Homo Sapiens
NKFVVTQCI

SEQ ID NO: 840972 - protein, 9 aa, Homo Sapiens
RDNLRLFKE

SEQ ID NO: 840973 - protein, 9 aa, Homo Sapiens
VHPCILSQA

SEQ ID NO: 840974 - protein, 9 aa, Homo Sapiens
LEDLEQDKI

SEQ ID NO: 840975 - protein, 9 aa, Homo Sapiens
RLAKDSDKL

SEQ ID NO: 840976 - protein, 9 aa, Homo Sapiens
ALRIKSYNK

SEQ ID NO: 840977 - protein, 9 aa, Homo Sapiens
LPTHFEEDT

SEQ ID NO: 840978 - protein, 9 aa, Homo Sapiens
WYRKLKVFL

SEQ ID NO: 840979 - protein, 9 aa, Homo Sapiens
DGYGDGDSD

SEQ ID NO: 840980 - protein, 9 aa, Homo Sapiens
SVIRNRMAP

SEQ ID NO: 840981 - protein, 9 aa, Homo Sapiens
PGPDNKYDP

SEQ ID NO: 840982 - protein, 9 aa, Homo Sapiens
HEKMHNAKK

SEQ ID NO: 840983 - protein, 9 aa, Homo Sapiens
KRTVENIKG

SEQ ID NO: 840984 - protein, 9 aa, Homo Sapiens
NKPGHVAEV

SEQ ID NO: 840985 - protein, 9 aa, Homo Sapiens
AAKNKECVA

SEQ ID NO: 840986 - protein, 9 aa, Homo Sapiens
LKRHNLYNN

SEQ ID NO: 840987 - protein, 9 aa, Homo Sapiens
KTEALWLQY

SEQ ID NO: 840988 - protein, 9 aa, Homo Sapiens
AVCHHHHHH

SEQ ID NO: 840989 - protein, 9 aa, Homo Sapiens
SSSKMKAPV

SEQ ID NO: 840990 - protein, 9 aa, Homo Sapiens
INAELTANK

SEQ ID NO: 840991 - protein, 9 aa, Homo Sapiens
ANILVAANG

SEQ ID NO: 840992 - protein, 9 aa, Homo Sapiens
NPGKRHPGI

SEQ ID NO: 840993 - protein, 9 aa, Homo Sapiens
KCNLQYHFE

SEQ ID NO: 840994 - protein, 9 aa, Homo Sapiens
GLEFILKSQ

SEQ ID NO: 840995 - protein, 9 aa, Homo Sapiens
HWKIHTEDN

SEQ ID NO: 840996 - protein, 9 aa, Homo Sapiens
TMVFSLDCV

SEQ ID NO: 840997 - protein, 9 aa, Homo Sapiens
KYKEIILLT

SEQ ID NO: 840998 - protein, 9 aa, Homo Sapiens
IRANPGKII

SEQ ID NO: 840999 - protein, 9 aa, Homo Sapiens
KLEFKPDSE

SEQ ID NO: 841000 - protein, 9 aa, Homo Sapiens
CERNPAKAF

SEQ ID NO: 841001 - protein, 9 aa, Homo Sapiens
LKSQSGESK

SEQ ID NO: 841002 - protein, 9 aa, Homo Sapiens
WKNRKKLKK

SEQ ID NO: 841003 - protein, 9 aa, Homo Sapiens
VLWLICVAF

SEQ ID NO: 841004 - protein, 9 aa, Homo Sapiens
VFLRAITPP

SEQ ID NO: 841005 - protein, 9 aa, Homo Sapiens
SLATEPREN

SEQ ID NO: 841006 - protein, 9 aa, Homo Sapiens
IVTLDEFIE

SEQ ID NO: 841007 - protein, 9 aa, Homo Sapiens
RFQDQVCRL

SEQ ID NO: 841008 - protein, 9 aa, Homo Sapiens
RQQCQAPVC

SEQ ID NO: 841009 - protein, 9 aa, Homo Sapiens
QEELESTKV

SEQ ID NO: 841010 - protein, 9 aa, Homo Sapiens
RRNNTHVPD

SEQ ID NO: 841011 - protein, 9 aa, Homo Sapiens
LKLVDRPQE

SEQ ID NO: 841012 - protein, 9 aa, Homo Sapiens
IVGCDVAYS

SEQ ID NO: 841013 - protein, 9 aa, Homo Sapiens
FIMAGIDLK

SEQ ID NO: 841014 - protein, 9 aa, Homo Sapiens
MLAWEVLRM

SEQ ID NO: 841015 - protein, 9 aa, Homo Sapiens
CQIILFINN

SEQ ID NO: 841016 - protein, 9 aa, Homo Sapiens
SYCEKLYLF

SEQ ID NO: 841017 - protein, 9 aa, Homo Sapiens
STAADSGTE

SEQ ID NO: 841018 - protein, 9 aa, Homo Sapiens
DTQEDMEVL

SEQ ID NO: 841019 - protein, 9 aa, Homo Sapiens
ILFSFSTKL

SEQ ID NO: 841020 - protein, 9 aa, Homo Sapiens
HFALSFMNV

SEQ ID NO: 841021 - protein, 9 aa, Homo Sapiens
PLPDRPTKA

SEQ ID NO: 841022 - protein, 9 aa, Homo Sapiens
LLANFSCNK

SEQ ID NO: 841023 - protein, 9 aa, Homo Sapiens
DISVIVNNP

SEQ ID NO: 841024 - protein, 9 aa, Homo Sapiens
LLPSPLTVL

SEQ ID NO: 841025 - protein, 9 aa, Homo Sapiens
VFIPRRLID

SEQ ID NO: 841026 - protein, 9 aa, Homo Sapiens
IKHVNVMMP

SEQ ID NO: 841027 - protein, 9 aa, Homo Sapiens
QYLWLKDCK

SEQ ID NO: 841028 - protein, 9 aa, Homo Sapiens
KAKKQKKGA

SEQ ID NO: 841029 - protein, 9 aa, Homo Sapiens
VNTGNRTII

SEQ ID NO: 841030 - protein, 9 aa, Homo Sapiens
FAATVVVPC

SEQ ID NO: 841031 - protein, 9 aa, Homo Sapiens
PQCLVMAGA

SEQ ID NO: 841032 - protein, 9 aa, Homo Sapiens
TKSGRINVY

SEQ ID NO: 841033 - protein, 9 aa, Homo Sapiens
LIQVIGKQN

SEQ ID NO: 841034 - protein, 9 aa, Homo Sapiens
LFRYVEKIT

SEQ ID NO: 841035 - protein, 9 aa, Homo Sapiens
LVPNEELLM

SEQ ID NO: 841036 - protein, 9 aa, Homo Sapiens
VAKACSCQR

SEQ ID NO: 841037 - protein, 9 aa, Homo Sapiens
TRQKRKFSS

SEQ ID NO: 841038 - protein, 9 aa, Homo Sapiens
TAALVEHVF

SEQ ID NO: 841039 - protein, 9 aa, Homo Sapiens
AVSPYYCYG

SEQ ID NO: 841040 - protein, 9 aa, Homo Sapiens
LPNDGYDLV

SEQ ID NO: 841041 - protein, 9 aa, Homo Sapiens
PGYLRSAGD

SEQ ID NO: 841042 - protein, 9 aa, Homo Sapiens
VKDPVSNTP

SEQ ID NO: 841043 - protein, 9 aa, Homo Sapiens
FEINAFKLK

SEQ ID NO: 841044 - protein, 9 aa, Homo Sapiens
HKAEASSRI

SEQ ID NO: 841045 - protein, 9 aa, Homo Sapiens
IKRRYHFDT

SEQ ID NO: 841046 - protein, 9 aa, Homo Sapiens
SSMFLSVTL

SEQ ID NO: 841047 - protein, 9 aa, Homo Sapiens
NQFFSSPIT

SEQ ID NO: 841048 - protein, 9 aa, Homo Sapiens
WENQPAGAG

SEQ ID NO: 841049 - protein, 9 aa, Homo Sapiens
ASYFRYYLM

SEQ ID NO: 841050 - protein, 9 aa, Homo Sapiens
SLYQYFENF

SEQ ID NO: 841051 - protein, 9 aa, Homo Sapiens
ITSVQLIWK

SEQ ID NO: 841052 - protein, 9 aa, Homo Sapiens
WVVRGVDWK

SEQ ID NO: 841053 - protein, 9 aa, Homo Sapiens
GPEMEMDAI

SEQ ID NO: 841054 - protein, 9 aa, Homo Sapiens
YDVNLNNNF

SEQ ID NO: 841055 - protein, 9 aa, Homo Sapiens
SRYAFVVPA

SEQ ID NO: 841056 - protein, 9 aa, Homo Sapiens
IYSNSIRYH

SEQ ID NO: 841057 - protein, 9 aa, Homo Sapiens
KLGNGALLC

SEQ ID NO: 841058 - protein, 9 aa, Homo Sapiens
QNIKKKGIL

SEQ ID NO: 841059 - protein, 9 aa, Homo Sapiens
CLAQLCLAQ

SEQ ID NO: 841060 - protein, 9 aa, Homo Sapiens
QEQEVLFKM

SEQ ID NO: 841061 - protein, 9 aa, Homo Sapiens
LHTPMYFSL

SEQ ID NO: 841062 - protein, 9 aa, Homo Sapiens
QRRTLFKEY

SEQ ID NO: 841063 - protein, 9 aa, Homo Sapiens
LEYTCAKCE

SEQ ID NO: 841064 - protein, 9 aa, Homo Sapiens
CRYLVHSNK

SEQ ID NO: 841065 - protein, 9 aa, Homo Sapiens
VRVFECGGP

SEQ ID NO: 841066 - protein, 9 aa, Homo Sapiens
GPVATFLDI

SEQ ID NO: 841067 - protein, 9 aa, Homo Sapiens
GRFGVSHRR

SEQ ID NO: 841068 - protein, 9 aa, Homo Sapiens
IDTSRKLPH

SEQ ID NO: 841069 - protein, 9 aa, Homo Sapiens
VLNAQKLER

SEQ ID NO: 841070 - protein, 9 aa, Homo Sapiens
MFLTIVCEG

SEQ ID NO: 841071 - protein, 9 aa, Homo Sapiens
IKGEIHSDY

SEQ ID NO: 841072 - protein, 9 aa, Homo Sapiens
PLIWIDHRL

SEQ ID NO: 841073 - protein, 9 aa, Homo Sapiens
PPLALNAVT

SEQ ID NO: 841074 - protein, 9 aa, Homo Sapiens
CGTLKISDL

SEQ ID NO: 841075 - protein, 9 aa, Homo Sapiens
RILCFVLCV

SEQ ID NO: 841076 - protein, 9 aa, Homo Sapiens
VLQNQDNKL

SEQ ID NO: 841077 - protein, 9 aa, Homo Sapiens
GPSNMISYA

SEQ ID NO: 841078 - protein, 9 aa, Homo Sapiens
SIVWVGGRS

SEQ ID NO: 841079 - protein, 9 aa, Homo Sapiens
YAIQSLQKS

SEQ ID NO: 841080 - protein, 9 aa, Homo Sapiens
LGCFDHAHR

SEQ ID NO: 841081 - protein, 9 aa, Homo Sapiens
LMGVALGQY

SEQ ID NO: 841082 - protein, 9 aa, Homo Sapiens
VETLSNALN

SEQ ID NO: 841083 - protein, 9 aa, Homo Sapiens
KKQEERPLI

SEQ ID NO: 841084 - protein, 9 aa, Homo Sapiens
LTEELLRET

SEQ ID NO: 841085 - protein, 9 aa, Homo Sapiens
FWSSPSDSV

SEQ ID NO: 841086 - protein, 9 aa, Homo Sapiens
VNNEAVMST

SEQ ID NO: 841087 - protein, 9 aa, Homo Sapiens
RYIEHNARK

SEQ ID NO: 841088 - protein, 9 aa, Homo Sapiens
ITNLNKAIT

SEQ ID NO: 841089 - protein, 9 aa, Homo Sapiens
LSLLHRARM

SEQ ID NO: 841090 - protein, 9 aa, Homo Sapiens
VTVNQSILT

SEQ ID NO: 841091 - protein, 9 aa, Homo Sapiens
EEDRSGSGN

SEQ ID NO: 841092 - protein, 9 aa, Homo Sapiens
KSKECVQKV

SEQ ID NO: 841093 - protein, 9 aa, Homo Sapiens
TVTLHVLLV

SEQ ID NO: 841094 - protein, 9 aa, Homo Sapiens
INPLKTTPM

SEQ ID NO: 841095 - protein, 9 aa, Homo Sapiens
TSAPTRAGA

SEQ ID NO: 841096 - protein, 9 aa, Homo Sapiens
SILAKLQAN

SEQ ID NO: 841097 - protein, 9 aa, Homo Sapiens
GSRFQYSGK

SEQ ID NO: 841098 - protein, 9 aa, Homo Sapiens
QRVFFGNNL

SEQ ID NO: 841099 - protein, 9 aa, Homo Sapiens
PPPPPHLSC

SEQ ID NO: 841100 - protein, 9 aa, Homo Sapiens
PTDGVLLCC

SEQ ID NO: 841101 - protein, 9 aa, Homo Sapiens
LTAEDIKAI

SEQ ID NO: 841102 - protein, 9 aa, Homo Sapiens
ILASQVLSP

SEQ ID NO: 841103 - protein, 9 aa, Homo Sapiens
SSITKRITE

SEQ ID NO: 841104 - protein, 9 aa, Homo Sapiens
EKNESKRMI

SEQ ID NO: 841105 - protein, 9 aa, Homo Sapiens
FKMLPYTFP

SEQ ID NO: 841106 - protein, 9 aa, Homo Sapiens
GVKNNTTVL

SEQ ID NO: 841107 - protein, 9 aa, Homo Sapiens
ANKDATAEI

SEQ ID NO: 841108 - protein, 9 aa, Homo Sapiens
PDPSLDMKE

SEQ ID NO: 841109 - protein, 9 aa, Homo Sapiens
MRQLLMDSG

SEQ ID NO: 841110 - protein, 9 aa, Homo Sapiens
LAHCPSPTM

SEQ ID NO: 841111 - protein, 9 aa, Homo Sapiens
HDSFRPKLE

SEQ ID NO: 841112 - protein, 9 aa, Homo Sapiens
DNAVTKRVK

SEQ ID NO: 841113 - protein, 9 aa, Homo Sapiens
QVYFHCLHL

SEQ ID NO: 841114 - protein, 9 aa, Homo Sapiens
ITLISWTKG

SEQ ID NO: 841115 - protein, 9 aa, Homo Sapiens
SYLIPSTSK

SEQ ID NO: 841116 - protein, 9 aa, Homo Sapiens
GKYETLEDD

SEQ ID NO: 841117 - protein, 9 aa, Homo Sapiens
DHECCKRVV

SEQ ID NO: 841118 - protein, 9 aa, Homo Sapiens
LRRNMTIKA

SEQ ID NO: 841119 - protein, 9 aa, Homo Sapiens
AYSYRKFFY

SEQ ID NO: 841120 - protein, 9 aa, Homo Sapiens
NAPVETELL

SEQ ID NO: 841121 - protein, 9 aa, Homo Sapiens
CSNTHEIES

SEQ ID NO: 841122 - protein, 9 aa, Homo Sapiens
IQGRDISTK

SEQ ID NO: 841123 - protein, 9 aa, Homo Sapiens
NLVKKKERS

SEQ ID NO: 841124 - protein, 9 aa, Homo Sapiens
ADILKGEHL

SEQ ID NO: 841125 - protein, 9 aa, Homo Sapiens
ASCPDKCAL

SEQ ID NO: 841126 - protein, 9 aa, Homo Sapiens
SKAFVCAFF

SEQ ID NO: 841127 - protein, 9 aa, Homo Sapiens
LYCQDIRAY

SEQ ID NO: 841128 - protein, 9 aa, Homo Sapiens
DIFNSDSDP

SEQ ID NO: 841129 - protein, 9 aa, Homo Sapiens
PFSNVLTFY

SEQ ID NO: 841130 - protein, 9 aa, Homo Sapiens
GLLVSDEPS

SEQ ID NO: 841131 - protein, 9 aa, Homo Sapiens
VGPYRRCYL

SEQ ID NO: 841132 - protein, 9 aa, Homo Sapiens
RGNAGVVLF

SEQ ID NO: 841133 - protein, 9 aa, Homo Sapiens
LFVVNQVKV

SEQ ID NO: 841134 - protein, 9 aa, Homo Sapiens
ELSNLLNFD

SEQ ID NO: 841135 - protein, 9 aa, Homo Sapiens
KITGREYFP

SEQ ID NO: 841136 - protein, 9 aa, Homo Sapiens
RLECIAHDA

SEQ ID NO: 841137 - protein, 9 aa, Homo Sapiens
FSSLQRKGL

SEQ ID NO: 841138 - protein, 9 aa, Homo Sapiens
VIVSYFNIV

SEQ ID NO: 841139 - protein, 9 aa, Homo Sapiens
DRTHSHGTR

SEQ ID NO: 841140 - protein, 9 aa, Homo Sapiens
EEKLCKREQ

SEQ ID NO: 841141 - protein, 9 aa, Homo Sapiens
ITRQIYGKR

SEQ ID NO: 841142 - protein, 9 aa, Homo Sapiens
EKSVLLWDK

SEQ ID NO: 841143 - protein, 9 aa, Homo Sapiens
SSGLSCAGR

SEQ ID NO: 841144 - protein, 9 aa, Homo Sapiens
RRTQAAAPV

SEQ ID NO: 841145 - protein, 9 aa, Homo Sapiens
IISEGIYAI

SEQ ID NO: 841146 - protein, 9 aa, Homo Sapiens
HKKSKKNKN

SEQ ID NO: 841147 - protein, 9 aa, Homo Sapiens
DYYRRPLWV

SEQ ID NO: 841148 - protein, 9 aa, Homo Sapiens
RDASLKNTL

SEQ ID NO: 841149 - protein, 9 aa, Homo Sapiens
LIQTDTSRG

SEQ ID NO: 841150 - protein, 9 aa, Homo Sapiens
ATQIPSYTK

SEQ ID NO: 841151 - protein, 9 aa, Homo Sapiens
KTRSKAKQE

SEQ ID NO: 841152 - protein, 9 aa, Homo Sapiens
NKRKLEDEC

SEQ ID NO: 841153 - protein, 9 aa, Homo Sapiens
YIPYILEAL

SEQ ID NO: 841154 - protein, 9 aa, Homo Sapiens
QLDECRLYY

SEQ ID NO: 841155 - protein, 9 aa, Homo Sapiens
LQWLKLIIS

SEQ ID NO: 841156 - protein, 9 aa, Homo Sapiens
NEAEKLHPG

SEQ ID NO: 841157 - protein, 9 aa, Homo Sapiens
RDTSGLEIS

SEQ ID NO: 841158 - protein, 9 aa, Homo Sapiens
LIVHQITHK

SEQ ID NO: 841159 - protein, 9 aa, Homo Sapiens
PHNFYSHPH

SEQ ID NO: 841160 - protein, 9 aa, Homo Sapiens
IFVDWKYNE

SEQ ID NO: 841161 - protein, 9 aa, Homo Sapiens
TSLVNFPTS

SEQ ID NO: 841162 - protein, 9 aa, Homo Sapiens
YKVPGQDLE

SEQ ID NO: 841163 - protein, 9 aa, Homo Sapiens
ETSIRRTAD

SEQ ID NO: 841164 - protein, 9 aa, Homo Sapiens
SMLCPAHIL

SEQ ID NO: 841165 - protein, 9 aa, Homo Sapiens
ERIKNFAEE

SEQ ID NO: 841166 - protein, 9 aa, Homo Sapiens
NHYITSPLL

SEQ ID NO: 841167 - protein, 9 aa, Homo Sapiens
EDAENASCG

SEQ ID NO: 841168 - protein, 9 aa, Homo Sapiens
YHSVTQNCR

SEQ ID NO: 841169 - protein, 9 aa, Homo Sapiens
FWIIKLSRR

SEQ ID NO: 841170 - protein, 9 aa, Homo Sapiens
YICYRQMLF

SEQ ID NO: 841171 - protein, 9 aa, Homo Sapiens
CGKLFLDSY

SEQ ID NO: 841172 - protein, 9 aa, Homo Sapiens
QELRIVGAQ

SEQ ID NO: 841173 - protein, 9 aa, Homo Sapiens
SENDIFEIH

SEQ ID NO: 841174 - protein, 9 aa, Homo Sapiens
SVTSEENNL

SEQ ID NO: 841175 - protein, 9 aa, Homo Sapiens
AVVTNHWAV

SEQ ID NO: 841176 - protein, 9 aa, Homo Sapiens
HLKLIALTA

SEQ ID NO: 841177 - protein, 9 aa, Homo Sapiens
TTISHLENA

SEQ ID NO: 841178 - protein, 9 aa, Homo Sapiens
LAIQLNQGK

SEQ ID NO: 841179 - protein, 9 aa, Homo Sapiens
VNAILTVAD

SEQ ID NO: 841180 - protein, 9 aa, Homo Sapiens
CPDPVGEEF

SEQ ID NO: 841181 - protein, 9 aa, Homo Sapiens
LHTYQEGKE

SEQ ID NO: 841182 - protein, 9 aa, Homo Sapiens
TPLMLDFNF

SEQ ID NO: 841183 - protein, 9 aa, Homo Sapiens
ELICQRLMQ

SEQ ID NO: 841184 - protein, 9 aa, Homo Sapiens
LNNSGSCFI

SEQ ID NO: 841185 - protein, 9 aa, Homo Sapiens
PVYPSLVQG

SEQ ID NO: 841186 - protein, 9 aa, Homo Sapiens
SNEPSSADI

SEQ ID NO: 841187 - protein, 9 aa, Homo Sapiens
IVPLIQLSC

SEQ ID NO: 841188 - protein, 9 aa, Homo Sapiens
HNYDIPNLA

SEQ ID NO: 841189 - protein, 9 aa, Homo Sapiens
TPGPAGRWK

SEQ ID NO: 841190 - protein, 9 aa, Homo Sapiens
DSKMNLNNF

SEQ ID NO: 841191 - protein, 9 aa, Homo Sapiens
LDMYQNYIA

SEQ ID NO: 841192 - protein, 9 aa, Homo Sapiens
QVKELLNEK

SEQ ID NO: 841193 - protein, 9 aa, Homo Sapiens
EAILLKWHV

SEQ ID NO: 841194 - protein, 9 aa, Homo Sapiens
KPQSLQSQI

SEQ ID NO: 841195 - protein, 9 aa, Homo Sapiens
DIPQGKRKT

SEQ ID NO: 841196 - protein, 9 aa, Homo Sapiens
GDYISKRPK

SEQ ID NO: 841197 - protein, 9 aa, Homo Sapiens
LYCIALSLA

SEQ ID NO: 841198 - protein, 9 aa, Homo Sapiens
HKLFSMVSW

SEQ ID NO: 841199 - protein, 9 aa, Homo Sapiens
AFNKEQQLQ

SEQ ID NO: 841200 - protein, 9 aa, Homo Sapiens
HQNGIIKGY

SEQ ID NO: 841201 - protein, 9 aa, Homo Sapiens
KPAIHFRLE

SEQ ID NO: 841202 - protein, 9 aa, Homo Sapiens
VLAEMLELK

SEQ ID NO: 841203 - protein, 9 aa, Homo Sapiens
KITFQEEMP

SEQ ID NO: 841204 - protein, 9 aa, Homo Sapiens
KHLDVPNII

SEQ ID NO: 841205 - protein, 9 aa, Homo Sapiens
RSLLIQAAR

SEQ ID NO: 841206 - protein, 9 aa, Homo Sapiens
YFSLIQQEI

SEQ ID NO: 841207 - protein, 9 aa, Homo Sapiens
STRNECTTQ

SEQ ID NO: 841208 - protein, 9 aa, Homo Sapiens
IAWMVYFVS

SEQ ID NO: 841209 - protein, 9 aa, Homo Sapiens
TVIFSNQTN

SEQ ID NO: 841210 - protein, 9 aa, Homo Sapiens
ETRRQKIEM

SEQ ID NO: 841211 - protein, 9 aa, Homo Sapiens
DNNGRLDPQ

SEQ ID NO: 841212 - protein, 9 aa, Homo Sapiens
TLVVLDYIS

SEQ ID NO: 841213 - protein, 9 aa, Homo Sapiens
SRPQERVIG

SEQ ID NO: 841214 - protein, 9 aa, Homo Sapiens
KPSLHSRNT

SEQ ID NO: 841215 - protein, 9 aa, Homo Sapiens
DLIKAALDI

SEQ ID NO: 841216 - protein, 9 aa, Homo Sapiens
VCCVKSIIR

SEQ ID NO: 841217 - protein, 9 aa, Homo Sapiens
VPFDEGLPP

SEQ ID NO: 841218 - protein, 9 aa, Homo Sapiens
RNNYFITHS

SEQ ID NO: 841219 - protein, 9 aa, Homo Sapiens
VEEVAARLK

SEQ ID NO: 841220 - protein, 9 aa, Homo Sapiens
SQGRVPCVM

SEQ ID NO: 841221 - protein, 9 aa, Homo Sapiens
HTLEMEKQE

SEQ ID NO: 841222 - protein, 9 aa, Homo Sapiens
LRALLGTLC

SEQ ID NO: 841223 - protein, 9 aa, Homo Sapiens
FTRKLCGLD

SEQ ID NO: 841224 - protein, 9 aa, Homo Sapiens
LCGVIYVVY

SEQ ID NO: 841225 - protein, 9 aa, Homo Sapiens
DRDPDTIRR

SEQ ID NO: 841226 - protein, 9 aa, Homo Sapiens
TTSNSFICE

SEQ ID NO: 841227 - protein, 9 aa, Homo Sapiens
WNEEIFPQI

SEQ ID NO: 841228 - protein, 9 aa, Homo Sapiens
VIHSIKYCL

SEQ ID NO: 841229 - protein, 9 aa, Homo Sapiens
PNATLGSLE

SEQ ID NO: 841230 - protein, 9 aa, Homo Sapiens
QLLHNGKSG

SEQ ID NO: 841231 - protein, 9 aa, Homo Sapiens
FNLFVTAPK

SEQ ID NO: 841232 - protein, 9 aa, Homo Sapiens
IARSLSYND

SEQ ID NO: 841233 - protein, 9 aa, Homo Sapiens
DNIMLENHT

SEQ ID NO: 841234 - protein, 9 aa, Homo Sapiens
PAQEFQTAH

SEQ ID NO: 841235 - protein, 9 aa, Homo Sapiens
RKKICEQEK

SEQ ID NO: 841236 - protein, 9 aa, Homo Sapiens
EEHKKQVSK

SEQ ID NO: 841237 - protein, 9 aa, Homo Sapiens
RDAHANGRA

SEQ ID NO: 841238 - protein, 9 aa, Homo Sapiens
CNCRKTIPC

SEQ ID NO: 841239 - protein, 9 aa, Homo Sapiens
CNVLLIQTS

SEQ ID NO: 841240 - protein, 9 aa, Homo Sapiens
MQQTRTEVV

SEQ ID NO: 841241 - protein, 9 aa, Homo Sapiens
LNKKVYTGV

SEQ ID NO: 841242 - protein, 9 aa, Homo Sapiens
SDSINPMYR

SEQ ID NO: 841243 - protein, 9 aa, Homo Sapiens
ADRGHLKYY

SEQ ID NO: 841244 - protein, 9 aa, Homo Sapiens
PKFAKRNVK

SEQ ID NO: 841245 - protein, 9 aa, Homo Sapiens
SMTNWSPAG

SEQ ID NO: 841246 - protein, 9 aa, Homo Sapiens
AATDDPTRR

SEQ ID NO: 841247 - protein, 9 aa, Homo Sapiens
IVKDFAAHC

SEQ ID NO: 841248 - protein, 9 aa, Homo Sapiens
SGYPPDISD

SEQ ID NO: 841249 - protein, 9 aa, Homo Sapiens
RLIHKSIDL

SEQ ID NO: 841250 - protein, 9 aa, Homo Sapiens
LWLQYRYLD

SEQ ID NO: 841251 - protein, 9 aa, Homo Sapiens
PASDAGDGL

SEQ ID NO: 841252 - protein, 9 aa, Homo Sapiens
PLHAWPKCL

SEQ ID NO: 841253 - protein, 9 aa, Homo Sapiens
GLLEDKLQP

SEQ ID NO: 841254 - protein, 9 aa, Homo Sapiens
ENSKLTFKP

SEQ ID NO: 841255 - protein, 9 aa, Homo Sapiens
LSAFNWVKA

SEQ ID NO: 841256 - protein, 9 aa, Homo Sapiens
DTIKLIVGR

SEQ ID NO: 841257 - protein, 9 aa, Homo Sapiens
MNYSTVEQL

SEQ ID NO: 841258 - protein, 9 aa, Homo Sapiens
LICQRLMQG

SEQ ID NO: 841259 - protein, 9 aa, Homo Sapiens
RHLSMRDRA

SEQ ID NO: 841260 - protein, 9 aa, Homo Sapiens
LKDAETGAF

SEQ ID NO: 841261 - protein, 9 aa, Homo Sapiens
LDWSKTEEA

SEQ ID NO: 841262 - protein, 9 aa, Homo Sapiens
FFWDKNWPA

SEQ ID NO: 841263 - protein, 9 aa, Homo Sapiens
ISQFFRPHY

SEQ ID NO: 841264 - protein, 9 aa, Homo Sapiens
SLNWYEHNN

SEQ ID NO: 841265 - protein, 9 aa, Homo Sapiens
CDKLRVHPL

SEQ ID NO: 841266 - protein, 9 aa, Homo Sapiens
DPQIISEGI

SEQ ID NO: 841267 - protein, 9 aa, Homo Sapiens
KVDVNKTVD

SEQ ID NO: 841268 - protein, 9 aa, Homo Sapiens
NIFVGGLSP

SEQ ID NO: 841269 - protein, 9 aa, Homo Sapiens
RTTGVLSSP

SEQ ID NO: 841270 - protein, 9 aa, Homo Sapiens
GICTEDRGN

SEQ ID NO: 841271 - protein, 9 aa, Homo Sapiens
YTFGQLILP

SEQ ID NO: 841272 - protein, 9 aa, Homo Sapiens
KGMGKFSSV

SEQ ID NO: 841273 - protein, 9 aa, Homo Sapiens
LEFILKSQL

SEQ ID NO: 841274 - protein, 9 aa, Homo Sapiens
YVPHAETER

SEQ ID NO: 841275 - protein, 9 aa, Homo Sapiens
LFGDHVRAF

SEQ ID NO: 841276 - protein, 9 aa, Homo Sapiens
MKKIQGKDL

SEQ ID NO: 841277 - protein, 9 aa, Homo Sapiens
PTTMRTLGM

SEQ ID NO: 841278 - protein, 9 aa, Homo Sapiens
RFQYSGKVA

SEQ ID NO: 841279 - protein, 9 aa, Homo Sapiens
CLSLLREQS

SEQ ID NO: 841280 - protein, 9 aa, Homo Sapiens
YFTVHPESG

SEQ ID NO: 841281 - protein, 9 aa, Homo Sapiens
EDYLAALSS

SEQ ID NO: 841282 - protein, 9 aa, Homo Sapiens
PTQSSTLET

SEQ ID NO: 841283 - protein, 9 aa, Homo Sapiens
LSFHLNHAI

SEQ ID NO: 841284 - protein, 9 aa, Homo Sapiens
KTLNRKNIL

SEQ ID NO: 841285 - protein, 9 aa, Homo Sapiens
IYNTLSTVE

SEQ ID NO: 841286 - protein, 9 aa, Homo Sapiens
NDSKDNQAK

SEQ ID NO: 841287 - protein, 9 aa, Homo Sapiens
HFHYSRKII

SEQ ID NO: 841288 - protein, 9 aa, Homo Sapiens
FAHQKLFRH

SEQ ID NO: 841289 - protein, 9 aa, Homo Sapiens
EQLRTFKLT

SEQ ID NO: 841290 - protein, 9 aa, Homo Sapiens
DIYGYNLSR

SEQ ID NO: 841291 - protein, 9 aa, Homo Sapiens
LEAIARPVT

SEQ ID NO: 841292 - protein, 9 aa, Homo Sapiens
HSGENPFQC

SEQ ID NO: 841293 - protein, 9 aa, Homo Sapiens
GGEKGSHMP

SEQ ID NO: 841294 - protein, 9 aa, Homo Sapiens
RRARRDHSS

SEQ ID NO: 841295 - protein, 9 aa, Homo Sapiens
DEKRQIAAH

SEQ ID NO: 841296 - protein, 9 aa, Homo Sapiens
TLDARMPRK

SEQ ID NO: 841297 - protein, 9 aa, Homo Sapiens
FLEFAELDQ

SEQ ID NO: 841298 - protein, 9 aa, Homo Sapiens
ELINIPLVH

SEQ ID NO: 841299 - protein, 9 aa, Homo Sapiens
ETIVNLKKT

SEQ ID NO: 841300 - protein, 9 aa, Homo Sapiens
SQYLEPLTI

SEQ ID NO: 841301 - protein, 9 aa, Homo Sapiens
GKNFSRPKR

SEQ ID NO: 841302 - protein, 9 aa, Homo Sapiens
QETSLPPLH

SEQ ID NO: 841303 - protein, 9 aa, Homo Sapiens
HVMPFWRIS

SEQ ID NO: 841304 - protein, 9 aa, Homo Sapiens
YSIINYTFT

SEQ ID NO: 841305 - protein, 9 aa, Homo Sapiens
EGCLLNLSC

SEQ ID NO: 841306 - protein, 9 aa, Homo Sapiens
SDGEGAASA

SEQ ID NO: 841307 - protein, 9 aa, Homo Sapiens
ISCYLNELT

SEQ ID NO: 841308 - protein, 9 aa, Homo Sapiens
NADRLFRSH

SEQ ID NO: 841309 - protein, 9 aa, Homo Sapiens
RELTKSLDS

SEQ ID NO: 841310 - protein, 9 aa, Homo Sapiens
LWKWIAYYS

SEQ ID NO: 841311 - protein, 9 aa, Homo Sapiens
NPIMYSFRN

SEQ ID NO: 841312 - protein, 9 aa, Homo Sapiens
DDLLSSIAY

SEQ ID NO: 841313 - protein, 9 aa, Homo Sapiens
TNISRQNEY

SEQ ID NO: 841314 - protein, 9 aa, Homo Sapiens
LPKDDANLL

SEQ ID NO: 841315 - protein, 9 aa, Homo Sapiens
RRRQQRSEK

SEQ ID NO: 841316 - protein, 9 aa, Homo Sapiens
NLRALRKGD

SEQ ID NO: 841317 - protein, 9 aa, Homo Sapiens
SSFKLEMAQ

SEQ ID NO: 841318 - protein, 9 aa, Homo Sapiens
ILGKSVFPY

SEQ ID NO: 841319 - protein, 9 aa, Homo Sapiens
VINSAGKAT

SEQ ID NO: 841320 - protein, 9 aa, Homo Sapiens
CTGIKEFKM

SEQ ID NO: 841321 - protein, 9 aa, Homo Sapiens
GWHEMDADN

SEQ ID NO: 841322 - protein, 9 aa, Homo Sapiens
HIRKYSHLS

SEQ ID NO: 841323 - protein, 9 aa, Homo Sapiens
GDCDDMDSP

SEQ ID NO: 841324 - protein, 9 aa, Homo Sapiens
GRWNLFLPL

SEQ ID NO: 841325 - protein, 9 aa, Homo Sapiens
ECGGHYLNV

SEQ ID NO: 841326 - protein, 9 aa, Homo Sapiens
WCISLICAY

SEQ ID NO: 841327 - protein, 9 aa, Homo Sapiens
QDLTFNLRQ

SEQ ID NO: 841328 - protein, 9 aa, Homo Sapiens
KTQKAMLDP

SEQ ID NO: 841329 - protein, 9 aa, Homo Sapiens
QKRPLMPFH

SEQ ID NO: 841330 - protein, 9 aa, Homo Sapiens
PVTEGRAHP

SEQ ID NO: 841331 - protein, 9 aa, Homo Sapiens
SQFFRPHYM

SEQ ID NO: 841332 - protein, 9 aa, Homo Sapiens
VFEELICQR

SEQ ID NO: 841333 - protein, 9 aa, Homo Sapiens
ETCYPGFYG

SEQ ID NO: 841334 - protein, 9 aa, Homo Sapiens
YGIDKEKPI

SEQ ID NO: 841335 - protein, 9 aa, Homo Sapiens
VFMAIRNPQ

SEQ ID NO: 841336 - protein, 9 aa, Homo Sapiens
LYYAAVPSA

SEQ ID NO: 841337 - protein, 9 aa, Homo Sapiens
CGCVDKYGM

SEQ ID NO: 841338 - protein, 9 aa, Homo Sapiens
MKDPLPSEV

SEQ ID NO: 841339 - protein, 9 aa, Homo Sapiens
SKRLTHKDD

SEQ ID NO: 841340 - protein, 9 aa, Homo Sapiens
IPPVLTPLM

SEQ ID NO: 841341 - protein, 9 aa, Homo Sapiens
PGRKWDFSP

SEQ ID NO: 841342 - protein, 9 aa, Homo Sapiens
RSGFDQGIN

SEQ ID NO: 841343 - protein, 9 aa, Homo Sapiens
KITCTNPEP

SEQ ID NO: 841344 - protein, 9 aa, Homo Sapiens
SKSLQSSNI

SEQ ID NO: 841345 - protein, 9 aa, Homo Sapiens
PGKQSQEAS

SEQ ID NO: 841346 - protein, 9 aa, Homo Sapiens
GCVDKYGMK

SEQ ID NO: 841347 - protein, 9 aa, Homo Sapiens
YTYNSGIHS

SEQ ID NO: 841348 - protein, 9 aa, Homo Sapiens
LSYFMFTEK

SEQ ID NO: 841349 - protein, 9 aa, Homo Sapiens
AHGFYPPEM

SEQ ID NO: 841350 - protein, 9 aa, Homo Sapiens
PSCTGFLFG

SEQ ID NO: 841351 - protein, 9 aa, Homo Sapiens
QLTQCYLET

SEQ ID NO: 841352 - protein, 9 aa, Homo Sapiens
LAALASRHE

SEQ ID NO: 841353 - protein, 9 aa, Homo Sapiens
KDSTITRKL

SEQ ID NO: 841354 - protein, 9 aa, Homo Sapiens
DSEFNQLRL

SEQ ID NO: 841355 - protein, 9 aa, Homo Sapiens
DVPALVAKC

SEQ ID NO: 841356 - protein, 9 aa, Homo Sapiens
QDSSPVRTL

SEQ ID NO: 841357 - protein, 9 aa, Homo Sapiens
DMYTGYTTR

SEQ ID NO: 841358 - protein, 9 aa, Homo Sapiens
AGGSILSGL

SEQ ID NO: 841359 - protein, 9 aa, Homo Sapiens
FLCSPQPDG

SEQ ID NO: 841360 - protein, 9 aa, Homo Sapiens
KKLVKDNKC

SEQ ID NO: 841361 - protein, 9 aa, Homo Sapiens
QRLQPEWGS

SEQ ID NO: 841362 - protein, 9 aa, Homo Sapiens
FASVANVAC

SEQ ID NO: 841363 - protein, 9 aa, Homo Sapiens
AIPQAHFLL

SEQ ID NO: 841364 - protein, 9 aa, Homo Sapiens
PDELQCLDD

SEQ ID NO: 841365 - protein, 9 aa, Homo Sapiens
TERIGHRYI

SEQ ID NO: 841366 - protein, 9 aa, Homo Sapiens
GVAFSRSKN

SEQ ID NO: 841367 - protein, 9 aa, Homo Sapiens
RDQCNTNCC

SEQ ID NO: 841368 - protein, 9 aa, Homo Sapiens
DYGIKLLET

SEQ ID NO: 841369 - protein, 9 aa, Homo Sapiens
VIIFFDPDA

SEQ ID NO: 841370 - protein, 9 aa, Homo Sapiens
SEGNYLICL

SEQ ID NO: 841371 - protein, 9 aa, Homo Sapiens
YTWTKGPDK

SEQ ID NO: 841372 - protein, 9 aa, Homo Sapiens
DSQTVSERN

SEQ ID NO: 841373 - protein, 9 aa, Homo Sapiens
TVADVISVG

SEQ ID NO: 841374 - protein, 9 aa, Homo Sapiens
EECVQKFIK

SEQ ID NO: 841375 - protein, 9 aa, Homo Sapiens
IEPLYQRVG

SEQ ID NO: 841376 - protein, 9 aa, Homo Sapiens
LMVDIYLLL

SEQ ID NO: 841377 - protein, 9 aa, Homo Sapiens
KMLQCGYYV

SEQ ID NO: 841378 - protein, 9 aa, Homo Sapiens
AAARYVTLE

SEQ ID NO: 841379 - protein, 9 aa, Homo Sapiens
SYLSVLEGQ

SEQ ID NO: 841380 - protein, 9 aa, Homo Sapiens
DGAARGTND

SEQ ID NO: 841381 - protein, 9 aa, Homo Sapiens
HAYSSSELD

SEQ ID NO: 841382 - protein, 9 aa, Homo Sapiens
AYRVRIGCG

SEQ ID NO: 841383 - protein, 9 aa, Homo Sapiens
DTYDSTSEQ

SEQ ID NO: 841384 - protein, 9 aa, Homo Sapiens
CYKFYLENL

SEQ ID NO: 841385 - protein, 9 aa, Homo Sapiens
EESGYFVLT

SEQ ID NO: 841386 - protein, 9 aa, Homo Sapiens
KVGQVILIN

SEQ ID NO: 841387 - protein, 9 aa, Homo Sapiens
GTPTYKRRA

SEQ ID NO: 841388 - protein, 9 aa, Homo Sapiens
KIHMQLIKY

SEQ ID NO: 841389 - protein, 9 aa, Homo Sapiens
PQPGKQSQE

SEQ ID NO: 841390 - protein, 9 aa, Homo Sapiens
QKYLAEINE

SEQ ID NO: 841391 - protein, 9 aa, Homo Sapiens
TRYCSMLCK

SEQ ID NO: 841392 - protein, 9 aa, Homo Sapiens
DYNKIVETI

SEQ ID NO: 841393 - protein, 9 aa, Homo Sapiens
HGRFLGDKS

SEQ ID NO: 841394 - protein, 9 aa, Homo Sapiens
YFFLGASLK

SEQ ID NO: 841395 - protein, 9 aa, Homo Sapiens
GPDTLPQGS

SEQ ID NO: 841396 - protein, 9 aa, Homo Sapiens
GYVDTDSKF

SEQ ID NO: 841397 - protein, 9 aa, Homo Sapiens
SLLFGDVAV

SEQ ID NO: 841398 - protein, 9 aa, Homo Sapiens
QFEEGQDVL

SEQ ID NO: 841399 - protein, 9 aa, Homo Sapiens
PKRSGRSCE

SEQ ID NO: 841400 - protein, 9 aa, Homo Sapiens
SFSQRGRCH

SEQ ID NO: 841401 - protein, 9 aa, Homo Sapiens
EFILKSQLV

SEQ ID NO: 841402 - protein, 9 aa, Homo Sapiens
IWKMEASYY

SEQ ID NO: 841403 - protein, 9 aa, Homo Sapiens
CELCSCGWH

SEQ ID NO: 841404 - protein, 9 aa, Homo Sapiens
EAAHFDKKK

SEQ ID NO: 841405 - protein, 9 aa, Homo Sapiens
KTVTAMGVV

SEQ ID NO: 841406 - protein, 9 aa, Homo Sapiens
MTFKGNAII

SEQ ID NO: 841407 - protein, 9 aa, Homo Sapiens
YYRRPLWVL

SEQ ID NO: 841408 - protein, 9 aa, Homo Sapiens
GEEPKLDLK

SEQ ID NO: 841409 - protein, 9 aa, Homo Sapiens
ATTNGHDFQ

SEQ ID NO: 841410 - protein, 9 aa, Homo Sapiens
SCTSLDTKT

SEQ ID NO: 841411 - protein, 9 aa, Homo Sapiens
KKPQSRGKT

SEQ ID NO: 841412 - protein, 9 aa, Homo Sapiens
APIPLELFA

SEQ ID NO: 841413 - protein, 9 aa, Homo Sapiens
ALLANQRRY

SEQ ID NO: 841414 - protein, 9 aa, Homo Sapiens
PKEVFSEFK

SEQ ID NO: 841415 - protein, 9 aa, Homo Sapiens
MTKNSKSKP

SEQ ID NO: 841416 - protein, 9 aa, Homo Sapiens
LKVLTNKTL

SEQ ID NO: 841417 - protein, 9 aa, Homo Sapiens
GMSLEYYDI

SEQ ID NO: 841418 - protein, 9 aa, Homo Sapiens
WGQHFVPIV

SEQ ID NO: 841419 - protein, 9 aa, Homo Sapiens
LYNTCYSSK

SEQ ID NO: 841420 - protein, 9 aa, Homo Sapiens
VVCGTYFRN

SEQ ID NO: 841421 - protein, 9 aa, Homo Sapiens
DACSARMYR

SEQ ID NO: 841422 - protein, 9 aa, Homo Sapiens
AAIVCIMKA

SEQ ID NO: 841423 - protein, 9 aa, Homo Sapiens
EALCRDEPV

SEQ ID NO: 841424 - protein, 9 aa, Homo Sapiens
HGIQIEFIN

SEQ ID NO: 841425 - protein, 9 aa, Homo Sapiens
RCISKMNRL

SEQ ID NO: 841426 - protein, 9 aa, Homo Sapiens
RNVMTAIIS

SEQ ID NO: 841427 - protein, 9 aa, Homo Sapiens
METKDNRWV

SEQ ID NO: 841428 - protein, 9 aa, Homo Sapiens
RKKYYYIAG

SEQ ID NO: 841429 - protein, 9 aa, Homo Sapiens
LAPLPPSTS

SEQ ID NO: 841430 - protein, 9 aa, Homo Sapiens
GAGLLGRLR

SEQ ID NO: 841431 - protein, 9 aa, Homo Sapiens
YFNVPMKKN

SEQ ID NO: 841432 - protein, 9 aa, Homo Sapiens
TSLIRHAII

SEQ ID NO: 841433 - protein, 9 aa, Homo Sapiens
AESTAVQFK

SEQ ID NO: 841434 - protein, 9 aa, Homo Sapiens
RYSHNELEK

SEQ ID NO: 841435 - protein, 9 aa, Homo Sapiens
RVLSGDPHN

SEQ ID NO: 841436 - protein, 9 aa, Homo Sapiens
QKNEWPLDK

SEQ ID NO: 841437 - protein, 9 aa, Homo Sapiens
EAKSRTFIY

SEQ ID NO: 841438 - protein, 9 aa, Homo Sapiens
RQNVSQENM

SEQ ID NO: 841439 - protein, 9 aa, Homo Sapiens
LALCTLVAT

SEQ ID NO: 841440 - protein, 9 aa, Homo Sapiens
HNHNQIPTL

SEQ ID NO: 841441 - protein, 9 aa, Homo Sapiens
IKSYNKYVQ

SEQ ID NO: 841442 - protein, 9 aa, Homo Sapiens
TLYMTYFIL

SEQ ID NO: 841443 - protein, 9 aa, Homo Sapiens
ELFRTTYFC

SEQ ID NO: 841444 - protein, 9 aa, Homo Sapiens
TGNRTIIGR

SEQ ID NO: 841445 - protein, 9 aa, Homo Sapiens
THSSEGRCK

SEQ ID NO: 841446 - protein, 9 aa, Homo Sapiens
LVHIGAKVM

SEQ ID NO: 841447 - protein, 9 aa, Homo Sapiens
STLTNHKII

SEQ ID NO: 841448 - protein, 9 aa, Homo Sapiens
PGTMDSIQS

SEQ ID NO: 841449 - protein, 9 aa, Homo Sapiens
PPRRWLHSS

SEQ ID NO: 841450 - protein, 9 aa, Homo Sapiens
EESYPRKTS

SEQ ID NO: 841451 - protein, 9 aa, Homo Sapiens
YYEGFLYPS

SEQ ID NO: 841452 - protein, 9 aa, Homo Sapiens
LQYHKHHDK

SEQ ID NO: 841453 - protein, 9 aa, Homo Sapiens
LFLLQKTLE

SEQ ID NO: 841454 - protein, 9 aa, Homo Sapiens
VDSEDPHLT

SEQ ID NO: 841455 - protein, 9 aa, Homo Sapiens
AYVLIMDFH

SEQ ID NO: 841456 - protein, 9 aa, Homo Sapiens
RDLVCSNSN

SEQ ID NO: 841457 - protein, 9 aa, Homo Sapiens
TSKIQEFAN

SEQ ID NO: 841458 - protein, 9 aa, Homo Sapiens
LETSIRRTA

SEQ ID NO: 841459 - protein, 9 aa, Homo Sapiens
HLNLKLPLQ

SEQ ID NO: 841460 - protein, 9 aa, Homo Sapiens
ASAKKHEDE

SEQ ID NO: 841461 - protein, 9 aa, Homo Sapiens
KAVRTTGVL

SEQ ID NO: 841462 - protein, 9 aa, Homo Sapiens
TDSIGEKLE

SEQ ID NO: 841463 - protein, 9 aa, Homo Sapiens
LNVLFGALA

SEQ ID NO: 841464 - protein, 9 aa, Homo Sapiens
PTREGVDNA

SEQ ID NO: 841465 - protein, 9 aa, Homo Sapiens
PPIDRRLGH

SEQ ID NO: 841466 - protein, 9 aa, Homo Sapiens
KIREQEDKI

SEQ ID NO: 841467 - protein, 9 aa, Homo Sapiens
YLQQDAKER

SEQ ID NO: 841468 - protein, 9 aa, Homo Sapiens
AREQINSSS

SEQ ID NO: 841469 - protein, 9 aa, Homo Sapiens
YLKPVTLHH

SEQ ID NO: 841470 - protein, 9 aa, Homo Sapiens
PRLDLKLVD

SEQ ID NO: 841471 - protein, 9 aa, Homo Sapiens
AKVPTGVII

SEQ ID NO: 841472 - protein, 9 aa, Homo Sapiens
HCHFGHPDR

SEQ ID NO: 841473 - protein, 9 aa, Homo Sapiens
HTPMYFSLS

SEQ ID NO: 841474 - protein, 9 aa, Homo Sapiens
QDVSFKYTK

SEQ ID NO: 841475 - protein, 9 aa, Homo Sapiens
EGDKRDASL

SEQ ID NO: 841476 - protein, 9 aa, Homo Sapiens
ADVEKIITK

SEQ ID NO: 841477 - protein, 9 aa, Homo Sapiens
MFDVGGQGS

SEQ ID NO: 841478 - protein, 9 aa, Homo Sapiens
TQVSNELFQ

SEQ ID NO: 841479 - protein, 9 aa, Homo Sapiens
GQVLAAHIL

SEQ ID NO: 841480 - protein, 9 aa, Homo Sapiens
VLAVLSVTL

SEQ ID NO: 841481 - protein, 9 aa, Homo Sapiens
LTLFLTTLP

SEQ ID NO: 841482 - protein, 9 aa, Homo Sapiens
KAIKLKNVD

SEQ ID NO: 841483 - protein, 9 aa, Homo Sapiens
ERRYWKVFE

SEQ ID NO: 841484 - protein, 9 aa, Homo Sapiens
TDHLIYPRH

SEQ ID NO: 841485 - protein, 9 aa, Homo Sapiens
SSISFQTEK

SEQ ID NO: 841486 - protein, 9 aa, Homo Sapiens
QPRTTTGTL

SEQ ID NO: 841487 - protein, 9 aa, Homo Sapiens
GNQLFEYTS

SEQ ID NO: 841488 - protein, 9 aa, Homo Sapiens
ICTGIKEFK

SEQ ID NO: 841489 - protein, 9 aa, Homo Sapiens
DRTLPLMQI

SEQ ID NO: 841490 - protein, 9 aa, Homo Sapiens
DDSNDYGDN

SEQ ID NO: 841491 - protein, 9 aa, Homo Sapiens
HPALAEIHP

SEQ ID NO: 841492 - protein, 9 aa, Homo Sapiens
NNKKVGVKR

SEQ ID NO: 841493 - protein, 9 aa, Homo Sapiens
AAVSPYYCY

SEQ ID NO: 841494 - protein, 9 aa, Homo Sapiens
AGGSQKLFY

SEQ ID NO: 841495 - protein, 9 aa, Homo Sapiens
TYDTINTTD

SEQ ID NO: 841496 - protein, 9 aa, Homo Sapiens
MDSKGQKAY

SEQ ID NO: 841497 - protein, 9 aa, Homo Sapiens
ENGEKVKHE

SEQ ID NO: 841498 - protein, 9 aa, Homo Sapiens
VSLTIDNVT

SEQ ID NO: 841499 - protein, 9 aa, Homo Sapiens
KLQEQEVLF

SEQ ID NO: 841500 - protein, 9 aa, Homo Sapiens
DIKENPFFQ

SEQ ID NO: 841501 - protein, 9 aa, Homo Sapiens
LAPRNPDPQ

SEQ ID NO: 841502 - protein, 9 aa, Homo Sapiens
SAYQGFTSG

SEQ ID NO: 841503 - protein, 9 aa, Homo Sapiens
LVHYYFSAL

SEQ ID NO: 841504 - protein, 9 aa, Homo Sapiens
YRKCPFNSE

SEQ ID NO: 841505 - protein, 9 aa, Homo Sapiens
FQYIYVGEL

SEQ ID NO: 841506 - protein, 9 aa, Homo Sapiens
RRRATALAG

SEQ ID NO: 841507 - protein, 9 aa, Homo Sapiens
NQIDLMDMA

SEQ ID NO: 841508 - protein, 9 aa, Homo Sapiens
KNVVTPLLN

SEQ ID NO: 841509 - protein, 9 aa, Homo Sapiens
PNTFRDSLE

SEQ ID NO: 841510 - protein, 9 aa, Homo Sapiens
YQNRSNLET

SEQ ID NO: 841511 - protein, 9 aa, Homo Sapiens
EGNANVTVL

SEQ ID NO: 841512 - protein, 9 aa, Homo Sapiens
INVTLLDLS

SEQ ID NO: 841513 - protein, 9 aa, Homo Sapiens
SKLLKKAQK

SEQ ID NO: 841514 - protein, 9 aa, Homo Sapiens
CGSALHGSL

SEQ ID NO: 841515 - protein, 9 aa, Homo Sapiens
TLDLIRPLR

SEQ ID NO: 841516 - protein, 9 aa, Homo Sapiens
FANQLDAQK

SEQ ID NO: 841517 - protein, 9 aa, Homo Sapiens
IEAQLIGEP

SEQ ID NO: 841518 - protein, 9 aa, Homo Sapiens
VFIMPQIPQ

SEQ ID NO: 841519 - protein, 9 aa, Homo Sapiens
LSRHEQRYR

SEQ ID NO: 841520 - protein, 9 aa, Homo Sapiens
SRTIIFVIT

SEQ ID NO: 841521 - protein, 9 aa, Homo Sapiens
GPIACDNVE

SEQ ID NO: 841522 - protein, 9 aa, Homo Sapiens
SVRVYFNKC

SEQ ID NO: 841523 - protein, 9 aa, Homo Sapiens
KHREVCKVK

SEQ ID NO: 841524 - protein, 9 aa, Homo Sapiens
ARKYNFPID

SEQ ID NO: 841525 - protein, 9 aa, Homo Sapiens
DVQEQDIKT

SEQ ID NO: 841526 - protein, 9 aa, Homo Sapiens
KATNDDIFS

SEQ ID NO: 841527 - protein, 9 aa, Homo Sapiens
NIYPENATT

SEQ ID NO: 841528 - protein, 9 aa, Homo Sapiens
LAEPQNLPL

SEQ ID NO: 841529 - protein, 9 aa, Homo Sapiens
RWRHRNLSS

SEQ ID NO: 841530 - protein, 9 aa, Homo Sapiens
KKRTALTKV

SEQ ID NO: 841531 - protein, 9 aa, Homo Sapiens
SDGDLVSLT

SEQ ID NO: 841532 - protein, 9 aa, Homo Sapiens
SLASRRLTR

SEQ ID NO: 841533 - protein, 9 aa, Homo Sapiens
VGDLRAESV

SEQ ID NO: 841534 - protein, 9 aa, Homo Sapiens
LSDGGTETS

SEQ ID NO: 841535 - protein, 9 aa, Homo Sapiens
SSSAILRAV

SEQ ID NO: 841536 - protein, 9 aa, Homo Sapiens
VGKHYRDFS

SEQ ID NO: 841537 - protein, 9 aa, Homo Sapiens
DNYFHENNV

SEQ ID NO: 841538 - protein, 9 aa, Homo Sapiens
DQSEDFGVN

SEQ ID NO: 841539 - protein, 9 aa, Homo Sapiens
YNKIGIKLY

SEQ ID NO: 841540 - protein, 9 aa, Homo Sapiens
LQKYLETRP

SEQ ID NO: 841541 - protein, 9 aa, Homo Sapiens
SLKYAVPFV

SEQ ID NO: 841542 - protein, 9 aa, Homo Sapiens
IMKILNKKS

SEQ ID NO: 841543 - protein, 9 aa, Homo Sapiens
VRSCDLREG

SEQ ID NO: 841544 - protein, 9 aa, Homo Sapiens
IRVLTSRKT

SEQ ID NO: 841545 - protein, 9 aa, Homo Sapiens
IVLMGTYND

SEQ ID NO: 841546 - protein, 9 aa, Homo Sapiens
HGLHTAGFF

SEQ ID NO: 841547 - protein, 9 aa, Homo Sapiens
HPVCKAEMS

SEQ ID NO: 841548 - protein, 9 aa, Homo Sapiens
VLEPGQPDN

SEQ ID NO: 841549 - protein, 9 aa, Homo Sapiens
SIINYTFTS

SEQ ID NO: 841550 - protein, 9 aa, Homo Sapiens
GIQRVFFGN

SEQ ID NO: 841551 - protein, 9 aa, Homo Sapiens
GYQRCCETC

SEQ ID NO: 841552 - protein, 9 aa, Homo Sapiens
TPIKDGPKR

SEQ ID NO: 841553 - protein, 9 aa, Homo Sapiens
TWDASVLAA

SEQ ID NO: 841554 - protein, 9 aa, Homo Sapiens
LMKIQFSRI

SEQ ID NO: 841555 - protein, 9 aa, Homo Sapiens
QNLPLSTFP

SEQ ID NO: 841556 - protein, 9 aa, Homo Sapiens
QDTALEGST

SEQ ID NO: 841557 - protein, 9 aa, Homo Sapiens
SHLENAIET

SEQ ID NO: 841558 - protein, 9 aa, Homo Sapiens
ITYLSDQIL

SEQ ID NO: 841559 - protein, 9 aa, Homo Sapiens
SIAVENQVS

SEQ ID NO: 841560 - protein, 9 aa, Homo Sapiens
KMYVESKTK

SEQ ID NO: 841561 - protein, 9 aa, Homo Sapiens
IPTHTTITA

SEQ ID NO: 841562 - protein, 9 aa, Homo Sapiens
PQHCQQKCP

SEQ ID NO: 841563 - protein, 9 aa, Homo Sapiens
PVETELLLA

SEQ ID NO: 841564 - protein, 9 aa, Homo Sapiens
NPKHSAIKI

SEQ ID NO: 841565 - protein, 9 aa, Homo Sapiens
CTISMIKVC

SEQ ID NO: 841566 - protein, 9 aa, Homo Sapiens
DTFPDENFK

SEQ ID NO: 841567 - protein, 9 aa, Homo Sapiens
CLSPDTQPP

SEQ ID NO: 841568 - protein, 9 aa, Homo Sapiens
DFVKDSQSP

SEQ ID NO: 841569 - protein, 9 aa, Homo Sapiens
HCQQKCPPV

SEQ ID NO: 841570 - protein, 9 aa, Homo Sapiens
RALRLLRSF

SEQ ID NO: 841571 - protein, 9 aa, Homo Sapiens
RRQAKLELR

SEQ ID NO: 841572 - protein, 9 aa, Homo Sapiens
GRFAPQLSG

SEQ ID NO: 841573 - protein, 9 aa, Homo Sapiens
ASRLDLDVS

SEQ ID NO: 841574 - protein, 9 aa, Homo Sapiens
ETVEYNNLK

SEQ ID NO: 841575 - protein, 9 aa, Homo Sapiens
VTSHDTSTN

SEQ ID NO: 841576 - protein, 9 aa, Homo Sapiens
IIYVSLPDA

SEQ ID NO: 841577 - protein, 9 aa, Homo Sapiens
WLPYKTCNI

SEQ ID NO: 841578 - protein, 9 aa, Homo Sapiens
IFRLINIIH

SEQ ID NO: 841579 - protein, 9 aa, Homo Sapiens
KINEGYFCK

SEQ ID NO: 841580 - protein, 9 aa, Homo Sapiens
GPDGSQIPY

SEQ ID NO: 841581 - protein, 9 aa, Homo Sapiens
GPRCVLNLI

SEQ ID NO: 841582 - protein, 9 aa, Homo Sapiens
NLELVVTVV

SEQ ID NO: 841583 - protein, 9 aa, Homo Sapiens
QLCRATDEM

SEQ ID NO: 841584 - protein, 9 aa, Homo Sapiens
PGEILLIPV

SEQ ID NO: 841585 - protein, 9 aa, Homo Sapiens
IFRYLIGKY

SEQ ID NO: 841586 - protein, 9 aa, Homo Sapiens
AWSHESPPC

SEQ ID NO: 841587 - protein, 9 aa, Homo Sapiens
CGREKKPRQ

SEQ ID NO: 841588 - protein, 9 aa, Homo Sapiens
DNLFKKVEY

SEQ ID NO: 841589 - protein, 9 aa, Homo Sapiens
PVSSLEDIS

SEQ ID NO: 841590 - protein, 9 aa, Homo Sapiens
QVLCYAARV

SEQ ID NO: 841591 - protein, 9 aa, Homo Sapiens
LEEIKDILP

SEQ ID NO: 841592 - protein, 9 aa, Homo Sapiens
PLYPIPMMP

SEQ ID NO: 841593 - protein, 9 aa, Homo Sapiens
PTGEPLHLI

SEQ ID NO: 841594 - protein, 9 aa, Homo Sapiens
QTDCIRALM

SEQ ID NO: 841595 - protein, 9 aa, Homo Sapiens
SHLLVHQRT

SEQ ID NO: 841596 - protein, 9 aa, Homo Sapiens
GAACLVIIF

SEQ ID NO: 841597 - protein, 9 aa, Homo Sapiens
PTSSFLANK

SEQ ID NO: 841598 - protein, 9 aa, Homo Sapiens
LLGIRGSVE

SEQ ID NO: 841599 - protein, 9 aa, Homo Sapiens
VGGVRSMPS

SEQ ID NO: 841600 - protein, 9 aa, Homo Sapiens
FQNTLLVLH

SEQ ID NO: 841601 - protein, 9 aa, Homo Sapiens
LDDESVCIE

SEQ ID NO: 841602 - protein, 9 aa, Homo Sapiens
KAENSLGSP

SEQ ID NO: 841603 - protein, 9 aa, Homo Sapiens
NGRVYLIMN

SEQ ID NO: 841604 - protein, 9 aa, Homo Sapiens
MKKPSCGVP

SEQ ID NO: 841605 - protein, 9 aa, Homo Sapiens
VIILTFTCY

SEQ ID NO: 841606 - protein, 9 aa, Homo Sapiens
EYDNREEHT

SEQ ID NO: 841607 - protein, 9 aa, Homo Sapiens
PSALPSTLR

SEQ ID NO: 841608 - protein, 9 aa, Homo Sapiens
MPHVVACSV

SEQ ID NO: 841609 - protein, 9 aa, Homo Sapiens
LKVLAEVNT

SEQ ID NO: 841610 - protein, 9 aa, Homo Sapiens
DLNNHFKFL

SEQ ID NO: 841611 - protein, 9 aa, Homo Sapiens
PVSYSSSSA

SEQ ID NO: 841612 - protein, 9 aa, Homo Sapiens
SGILKTLLW

SEQ ID NO: 841613 - protein, 9 aa, Homo Sapiens
YNNLSDKTS

SEQ ID NO: 841614 - protein, 9 aa, Homo Sapiens
RKRMRNHIA

SEQ ID NO: 841615 - protein, 9 aa, Homo Sapiens
NHHVIISEA

SEQ ID NO: 841616 - protein, 9 aa, Homo Sapiens
GAYTILQKS

SEQ ID NO: 841617 - protein, 9 aa, Homo Sapiens
MDNNKLNIL

SEQ ID NO: 841618 - protein, 9 aa, Homo Sapiens
QKQETSLLK

SEQ ID NO: 841619 - protein, 9 aa, Homo Sapiens
NSSSANEFS

SEQ ID NO: 841620 - protein, 9 aa, Homo Sapiens
AAESFHPGS

SEQ ID NO: 841621 - protein, 9 aa, Homo Sapiens
YNTLSTVEH

SEQ ID NO: 841622 - protein, 9 aa, Homo Sapiens
TLKGLKDLD

SEQ ID NO: 841623 - protein, 9 aa, Homo Sapiens
GISPHVCKR

SEQ ID NO: 841624 - protein, 9 aa, Homo Sapiens
AQSFENVMA

SEQ ID NO: 841625 - protein, 9 aa, Homo Sapiens
SSFQKHSNL

SEQ ID NO: 841626 - protein, 9 aa, Homo Sapiens
KQMWGDLFT

SEQ ID NO: 841627 - protein, 9 aa, Homo Sapiens
LRENKINIS

SEQ ID NO: 841628 - protein, 9 aa, Homo Sapiens
SKWSFESIC

SEQ ID NO: 841629 - protein, 9 aa, Homo Sapiens
LHGDDTNRW

SEQ ID NO: 841630 - protein, 9 aa, Homo Sapiens
GYYRTIQGF

SEQ ID NO: 841631 - protein, 9 aa, Homo Sapiens
KATPCLELE

SEQ ID NO: 841632 - protein, 9 aa, Homo Sapiens
DFHKNVIQS

SEQ ID NO: 841633 - protein, 9 aa, Homo Sapiens
EQPSFSQRG

SEQ ID NO: 841634 - protein, 9 aa, Homo Sapiens
YLTIALNKF

SEQ ID NO: 841635 - protein, 9 aa, Homo Sapiens
ELMLLANMA

SEQ ID NO: 841636 - protein, 9 aa, Homo Sapiens
HHQFIEPAP

SEQ ID NO: 841637 - protein, 9 aa, Homo Sapiens
KQIYYSGKY

SEQ ID NO: 841638 - protein, 9 aa, Homo Sapiens
RVKAAMAGV

SEQ ID NO: 841639 - protein, 9 aa, Homo Sapiens
ITQNLFTGV

SEQ ID NO: 841640 - protein, 9 aa, Homo Sapiens
VMPKKKQAL

SEQ ID NO: 841641 - protein, 9 aa, Homo Sapiens
LLLPSEAVF

SEQ ID NO: 841642 - protein, 9 aa, Homo Sapiens
PVTEAEMLR

SEQ ID NO: 841643 - protein, 9 aa, Homo Sapiens
EVDHLFCEV

SEQ ID NO: 841644 - protein, 9 aa, Homo Sapiens
PRVLAPKAS

SEQ ID NO: 841645 - protein, 9 aa, Homo Sapiens
SNPNRVCMF

SEQ ID NO: 841646 - protein, 9 aa, Homo Sapiens
SAGSVSVPG

SEQ ID NO: 841647 - protein, 9 aa, Homo Sapiens
TSSYTLILS

SEQ ID NO: 841648 - protein, 9 aa, Homo Sapiens
VTLHVLLVD

SEQ ID NO: 841649 - protein, 9 aa, Homo Sapiens
GVLYVNKKI

SEQ ID NO: 841650 - protein, 9 aa, Homo Sapiens
ERYELCKQG

SEQ ID NO: 841651 - protein, 9 aa, Homo Sapiens
FYIIKAWLF

SEQ ID NO: 841652 - protein, 9 aa, Homo Sapiens
LCGESQEKQ

SEQ ID NO: 841653 - protein, 9 aa, Homo Sapiens
LAAGGSHPD

SEQ ID NO: 841654 - protein, 9 aa, Homo Sapiens
VGYCQGMTF

SEQ ID NO: 841655 - protein, 9 aa, Homo Sapiens
AVEDIIYRV

SEQ ID NO: 841656 - protein, 9 aa, Homo Sapiens
SIDRLDDII

SEQ ID NO: 841657 - protein, 9 aa, Homo Sapiens
EKPRAQELR

SEQ ID NO: 841658 - protein, 9 aa, Homo Sapiens
ITAYNRCTF

SEQ ID NO: 841659 - protein, 9 aa, Homo Sapiens
CGKGTQCNN

SEQ ID NO: 841660 - protein, 9 aa, Homo Sapiens
NMQLKLSNM

SEQ ID NO: 841661 - protein, 9 aa, Homo Sapiens
YRLPQVIAH

SEQ ID NO: 841662 - protein, 9 aa, Homo Sapiens
EPSTPAFLW

SEQ ID NO: 841663 - protein, 9 aa, Homo Sapiens
LRLPLGATG

SEQ ID NO: 841664 - protein, 9 aa, Homo Sapiens
QLHIQFTRH

SEQ ID NO: 841665 - protein, 9 aa, Homo Sapiens
IPTTTNNNY

SEQ ID NO: 841666 - protein, 9 aa, Homo Sapiens
NNENIQETC

SEQ ID NO: 841667 - protein, 9 aa, Homo Sapiens
DQQLIETSP

SEQ ID NO: 841668 - protein, 9 aa, Homo Sapiens
QSCAKVRKT

SEQ ID NO: 841669 - protein, 9 aa, Homo Sapiens
TLRQQFSCP

SEQ ID NO: 841670 - protein, 9 aa, Homo Sapiens
VCGEYGRAW

SEQ ID NO: 841671 - protein, 9 aa, Homo Sapiens
GELHDFRAP

SEQ ID NO: 841672 - protein, 9 aa, Homo Sapiens
TLISHKIVH

SEQ ID NO: 841673 - protein, 9 aa, Homo Sapiens
GNLKVHEII

SEQ ID NO: 841674 - protein, 9 aa, Homo Sapiens
DILEVATAR

SEQ ID NO: 841675 - protein, 9 aa, Homo Sapiens
ATTLDAKIE

SEQ ID NO: 841676 - protein, 9 aa, Homo Sapiens
LKLCMNLPY

SEQ ID NO: 841677 - protein, 9 aa, Homo Sapiens
CLNPKLKQA

SEQ ID NO: 841678 - protein, 9 aa, Homo Sapiens
KEQRVKSAR

SEQ ID NO: 841679 - protein, 9 aa, Homo Sapiens
EEINVDVES

SEQ ID NO: 841680 - protein, 9 aa, Homo Sapiens
NLQERVRRK

SEQ ID NO: 841681 - protein, 9 aa, Homo Sapiens
TDAVLAADS

SEQ ID NO: 841682 - protein, 9 aa, Homo Sapiens
FLGKNENGK

SEQ ID NO: 841683 - protein, 9 aa, Homo Sapiens
CLQDLRLNG

SEQ ID NO: 841684 - protein, 9 aa, Homo Sapiens
GSSGSRSSS

SEQ ID NO: 841685 - protein, 9 aa, Homo Sapiens
TVLAKQTGR

SEQ ID NO: 841686 - protein, 9 aa, Homo Sapiens
LPRVICTCC

SEQ ID NO: 841687 - protein, 9 aa, Homo Sapiens
RSQHRDLKI

SEQ ID NO: 841688 - protein, 9 aa, Homo Sapiens
TWLANKLRG

SEQ ID NO: 841689 - protein, 9 aa, Homo Sapiens
EGSSRNVPA

SEQ ID NO: 841690 - protein, 9 aa, Homo Sapiens
STSQNHSCT

SEQ ID NO: 841691 - protein, 9 aa, Homo Sapiens
LTYDTQNIN

SEQ ID NO: 841692 - protein, 9 aa, Homo Sapiens
RQYLNYPPS

SEQ ID NO: 841693 - protein, 9 aa, Homo Sapiens
TRIEERSQT

SEQ ID NO: 841694 - protein, 9 aa, Homo Sapiens
IILCPLDPK

SEQ ID NO: 841695 - protein, 9 aa, Homo Sapiens
EVQTCLKLI

SEQ ID NO: 841696 - protein, 9 aa, Homo Sapiens
ATDGTSELP

SEQ ID NO: 841697 - protein, 9 aa, Homo Sapiens
CNHMRFWAP

SEQ ID NO: 841698 - protein, 9 aa, Homo Sapiens
APFAMINVC

SEQ ID NO: 841699 - protein, 9 aa, Homo Sapiens
GKNKELSAD

SEQ ID NO: 841700 - protein, 9 aa, Homo Sapiens
KIINKESLI

SEQ ID NO: 841701 - protein, 9 aa, Homo Sapiens
ASRDTTIKM

SEQ ID NO: 841702 - protein, 9 aa, Homo Sapiens
DQVCRLCGN

SEQ ID NO: 841703 - protein, 9 aa, Homo Sapiens
TEDLPLTME

SEQ ID NO: 841704 - protein, 9 aa, Homo Sapiens
SIKSLPDSN

SEQ ID NO: 841705 - protein, 9 aa, Homo Sapiens
PDFQGAQEP

SEQ ID NO: 841706 - protein, 9 aa, Homo Sapiens
YCQSHVLSH

SEQ ID NO: 841707 - protein, 9 aa, Homo Sapiens
IFFCCFEDC

SEQ ID NO: 841708 - protein, 9 aa, Homo Sapiens
GGNTTAGGG

SEQ ID NO: 841709 - protein, 9 aa, Homo Sapiens
SHSITQGAQ

SEQ ID NO: 841710 - protein, 9 aa, Homo Sapiens
DDDNDNAPQ

SEQ ID NO: 841711 - protein, 9 aa, Homo Sapiens
QTTETASCL

SEQ ID NO: 841712 - protein, 9 aa, Homo Sapiens
LKHLRAYMK

SEQ ID NO: 841713 - protein, 9 aa, Homo Sapiens
NLCNGYTSG

SEQ ID NO: 841714 - protein, 9 aa, Homo Sapiens
IQPCILIIE

SEQ ID NO: 841715 - protein, 9 aa, Homo Sapiens
VLINGAWEI

SEQ ID NO: 841716 - protein, 9 aa, Homo Sapiens
HKSTQIYLK

SEQ ID NO: 841717 - protein, 9 aa, Homo Sapiens
SRYQNHSST

SEQ ID NO: 841718 - protein, 9 aa, Homo Sapiens
GKLEDWARW

SEQ ID NO: 841719 - protein, 9 aa, Homo Sapiens
NYLPEEMES

SEQ ID NO: 841720 - protein, 9 aa, Homo Sapiens
PKEITLELS

SEQ ID NO: 841721 - protein, 9 aa, Homo Sapiens
FIVLFYLWG

SEQ ID NO: 841722 - protein, 9 aa, Homo Sapiens
STPPSNLRL

SEQ ID NO: 841723 - protein, 9 aa, Homo Sapiens
HKSERSSRL

SEQ ID NO: 841724 - protein, 9 aa, Homo Sapiens
ISSNVCFAQ

SEQ ID NO: 841725 - protein, 9 aa, Homo Sapiens
LGPVATFLD

SEQ ID NO: 841726 - protein, 9 aa, Homo Sapiens
IVEGAKVTL

SEQ ID NO: 841727 - protein, 9 aa, Homo Sapiens
DVVDEKIST

SEQ ID NO: 841728 - protein, 9 aa, Homo Sapiens
DLEVFYPEL

SEQ ID NO: 841729 - protein, 9 aa, Homo Sapiens
SPRNQFNLI

SEQ ID NO: 841730 - protein, 9 aa, Homo Sapiens
KAKKQGEGS

SEQ ID NO: 841731 - protein, 9 aa, Homo Sapiens
PVSNTPALV

SEQ ID NO: 841732 - protein, 9 aa, Homo Sapiens
LNATLNNMR

SEQ ID NO: 841733 - protein, 9 aa, Homo Sapiens
RKFNEPESV

SEQ ID NO: 841734 - protein, 9 aa, Homo Sapiens
ANGRAQYTF

SEQ ID NO: 841735 - protein, 9 aa, Homo Sapiens
FLSSKIKQI

SEQ ID NO: 841736 - protein, 9 aa, Homo Sapiens
MHNHIEKLN

SEQ ID NO: 841737 - protein, 9 aa, Homo Sapiens
SDEPSTKQS

SEQ ID NO: 841738 - protein, 9 aa, Homo Sapiens
EELASQGLN

SEQ ID NO: 841739 - protein, 9 aa, Homo Sapiens
GPHNRYALI

SEQ ID NO: 841740 - protein, 9 aa, Homo Sapiens
QALREGDHE

SEQ ID NO: 841741 - protein, 9 aa, Homo Sapiens
KLYLFPLKM

SEQ ID NO: 841742 - protein, 9 aa, Homo Sapiens
EEEEECIEE

SEQ ID NO: 841743 - protein, 9 aa, Homo Sapiens
TETVNLQNN

SEQ ID NO: 841744 - protein, 9 aa, Homo Sapiens
SCPDKCALF

SEQ ID NO: 841745 - protein, 9 aa, Homo Sapiens
QITNLKAEI

SEQ ID NO: 841746 - protein, 9 aa, Homo Sapiens
FSSLREDQL

SEQ ID NO: 841747 - protein, 9 aa, Homo Sapiens
WVTKSEPSV

SEQ ID NO: 841748 - protein, 9 aa, Homo Sapiens
NKDHSVFLL

SEQ ID NO: 841749 - protein, 9 aa, Homo Sapiens
FMETKSTQE

SEQ ID NO: 841750 - protein, 9 aa, Homo Sapiens
WTTGPFCVN

SEQ ID NO: 841751 - protein, 9 aa, Homo Sapiens
DQPGRLKTV

SEQ ID NO: 841752 - protein, 9 aa, Homo Sapiens
GTKNNFSSL

SEQ ID NO: 841753 - protein, 9 aa, Homo Sapiens
SCEKFGPGP

SEQ ID NO: 841754 - protein, 9 aa, Homo Sapiens
FFGTYFCVD

SEQ ID NO: 841755 - protein, 9 aa, Homo Sapiens
NYLLKNDTS

SEQ ID NO: 841756 - protein, 9 aa, Homo Sapiens
GEKGNPGFI

SEQ ID NO: 841757 - protein, 9 aa, Homo Sapiens
LFPDIVGFT

SEQ ID NO: 841758 - protein, 9 aa, Homo Sapiens
TYTPETLLE

SEQ ID NO: 841759 - protein, 9 aa, Homo Sapiens
YSNLVSLGR

SEQ ID NO: 841760 - protein, 9 aa, Homo Sapiens
HQRQEIIQH

SEQ ID NO: 841761 - protein, 9 aa, Homo Sapiens
KVIAEKYHQ

SEQ ID NO: 841762 - protein, 9 aa, Homo Sapiens
NRSNHYSLS

SEQ ID NO: 841763 - protein, 9 aa, Homo Sapiens
RMQQQLGEY

SEQ ID NO: 841764 - protein, 9 aa, Homo Sapiens
SGTQTYPVG

SEQ ID NO: 841765 - protein, 9 aa, Homo Sapiens
ITEQLHRQF

SEQ ID NO: 841766 - protein, 9 aa, Homo Sapiens
DEKDEDTFF

SEQ ID NO: 841767 - protein, 9 aa, Homo Sapiens
PIHFHPESR

SEQ ID NO: 841768 - protein, 9 aa, Homo Sapiens
SCNDTSTFE

SEQ ID NO: 841769 - protein, 9 aa, Homo Sapiens
RNPRSYNPQ

SEQ ID NO: 841770 - protein, 9 aa, Homo Sapiens
PEETLLTYQ

SEQ ID NO: 841771 - protein, 9 aa, Homo Sapiens
LDEPHEKHR

SEQ ID NO: 841772 - protein, 9 aa, Homo Sapiens
TEIVTKPIK

SEQ ID NO: 841773 - protein, 9 aa, Homo Sapiens
PILDMAAGT

SEQ ID NO: 841774 - protein, 9 aa, Homo Sapiens
HVKKDYLRE

SEQ ID NO: 841775 - protein, 9 aa, Homo Sapiens
DPAKRMAAH

SEQ ID NO: 841776 - protein, 9 aa, Homo Sapiens
NIMLENHTV

SEQ ID NO: 841777 - protein, 9 aa, Homo Sapiens
SGVTGSGLA

SEQ ID NO: 841778 - protein, 9 aa, Homo Sapiens
VFSLDCVLK

SEQ ID NO: 841779 - protein, 9 aa, Homo Sapiens
QKSDKLPSS

SEQ ID NO: 841780 - protein, 9 aa, Homo Sapiens
ALQTSIDAY

SEQ ID NO: 841781 - protein, 9 aa, Homo Sapiens
FDELNAPQS

SEQ ID NO: 841782 - protein, 9 aa, Homo Sapiens
RSCKAKQQL

SEQ ID NO: 841783 - protein, 9 aa, Homo Sapiens
TASRKGKLY

SEQ ID NO: 841784 - protein, 9 aa, Homo Sapiens
SELRTKVQK

SEQ ID NO: 841785 - protein, 9 aa, Homo Sapiens
QLSPTEINV

SEQ ID NO: 841786 - protein, 9 aa, Homo Sapiens
QEAQIIVEK

SEQ ID NO: 841787 - protein, 9 aa, Homo Sapiens
SKSGRSRNE

SEQ ID NO: 841788 - protein, 9 aa, Homo Sapiens
KKKIKHSEE

SEQ ID NO: 841789 - protein, 9 aa, Homo Sapiens
GRDQAASVF

SEQ ID NO: 841790 - protein, 9 aa, Homo Sapiens
GVDTTNIVL

SEQ ID NO: 841791 - protein, 9 aa, Homo Sapiens
SSFQVASQN

SEQ ID NO: 841792 - protein, 9 aa, Homo Sapiens
MAPEARNVS

SEQ ID NO: 841793 - protein, 9 aa, Homo Sapiens
WNKKLLYKK

SEQ ID NO: 841794 - protein, 9 aa, Homo Sapiens
LFVPCIFLY

SEQ ID NO: 841795 - protein, 9 aa, Homo Sapiens
EKKSSGMYK

SEQ ID NO: 841796 - protein, 9 aa, Homo Sapiens
EQFFREAEE

SEQ ID NO: 841797 - protein, 9 aa, Homo Sapiens
VSTTDRDSG

SEQ ID NO: 841798 - protein, 9 aa, Homo Sapiens
YGEDNDEQG

SEQ ID NO: 841799 - protein, 9 aa, Homo Sapiens
AFEDMLDNP

SEQ ID NO: 841800 - protein, 9 aa, Homo Sapiens
KKRWNHPKM

SEQ ID NO: 841801 - protein, 9 aa, Homo Sapiens
TRASGMTKN

SEQ ID NO: 841802 - protein, 9 aa, Homo Sapiens
SKDILTFKE

SEQ ID NO: 841803 - protein, 9 aa, Homo Sapiens
KNNAPKEAS

SEQ ID NO: 841804 - protein, 9 aa, Homo Sapiens
ATYVIYHDA

SEQ ID NO: 841805 - protein, 9 aa, Homo Sapiens
GGSEIKEIG

SEQ ID NO: 841806 - protein, 9 aa, Homo Sapiens
GMAVREFNM

SEQ ID NO: 841807 - protein, 9 aa, Homo Sapiens
ELFRNIFGN

SEQ ID NO: 841808 - protein, 9 aa, Homo Sapiens
PFYYKNTHR

SEQ ID NO: 841809 - protein, 9 aa, Homo Sapiens
TDCSIVSLL

SEQ ID NO: 841810 - protein, 9 aa, Homo Sapiens
LYYPSQDNA

SEQ ID NO: 841811 - protein, 9 aa, Homo Sapiens
SPDCLADIN

SEQ ID NO: 841812 - protein, 9 aa, Homo Sapiens
VSAPSEHVI

SEQ ID NO: 841813 - protein, 9 aa, Homo Sapiens
SSSPQKRSY

SEQ ID NO: 841814 - protein, 9 aa, Homo Sapiens
HKREQNYMK

SEQ ID NO: 841815 - protein, 9 aa, Homo Sapiens
LPILSRLQG

SEQ ID NO: 841816 - protein, 9 aa, Homo Sapiens
WSLGCISYY

SEQ ID NO: 841817 - protein, 9 aa, Homo Sapiens
AQSFLMNKH

SEQ ID NO: 841818 - protein, 9 aa, Homo Sapiens
MQEVIDFIS

SEQ ID NO: 841819 - protein, 9 aa, Homo Sapiens
VLHKNRDKK

SEQ ID NO: 841820 - protein, 9 aa, Homo Sapiens
AGKNALHLA

SEQ ID NO: 841821 - protein, 9 aa, Homo Sapiens
EGVHVHTCH

SEQ ID NO: 841822 - protein, 9 aa, Homo Sapiens
SFLAPWLGD

SEQ ID NO: 841823 - protein, 9 aa, Homo Sapiens
KVYTKSYHL

SEQ ID NO: 841824 - protein, 9 aa, Homo Sapiens
KKLDIKLRH

SEQ ID NO: 841825 - protein, 9 aa, Homo Sapiens
YDMTNVLEG

SEQ ID NO: 841826 - protein, 9 aa, Homo Sapiens
EERLKYYQI

SEQ ID NO: 841827 - protein, 9 aa, Homo Sapiens
THSHGTRAR

SEQ ID NO: 841828 - protein, 9 aa, Homo Sapiens
HKRLHTGVK

SEQ ID NO: 841829 - protein, 9 aa, Homo Sapiens
TLYGTSIWK

SEQ ID NO: 841830 - protein, 9 aa, Homo Sapiens
SQPEHYSPV

SEQ ID NO: 841831 - protein, 9 aa, Homo Sapiens
SQFPAWRES

SEQ ID NO: 841832 - protein, 9 aa, Homo Sapiens
VQKRDTKTM

SEQ ID NO: 841833 - protein, 9 aa, Homo Sapiens
NISVAAIPF

SEQ ID NO: 841834 - protein, 9 aa, Homo Sapiens
MKPDEKAKV

SEQ ID NO: 841835 - protein, 9 aa, Homo Sapiens
HRFSYQEKP

SEQ ID NO: 841836 - protein, 9 aa, Homo Sapiens
DVKINNATI

SEQ ID NO: 841837 - protein, 9 aa, Homo Sapiens
HCKVHMGEK

SEQ ID NO: 841838 - protein, 9 aa, Homo Sapiens
SISSEDLHD

SEQ ID NO: 841839 - protein, 9 aa, Homo Sapiens
GQKCGGAYP

SEQ ID NO: 841840 - protein, 9 aa, Homo Sapiens
GPVGTQVAA

SEQ ID NO: 841841 - protein, 9 aa, Homo Sapiens
PIIAPVRSR

SEQ ID NO: 841842 - protein, 9 aa, Homo Sapiens
RKISDSISK

SEQ ID NO: 841843 - protein, 9 aa, Homo Sapiens
MLLQEYRLV

SEQ ID NO: 841844 - protein, 9 aa, Homo Sapiens
SVISGVGKL

SEQ ID NO: 841845 - protein, 9 aa, Homo Sapiens
HHARCCNVT

SEQ ID NO: 841846 - protein, 9 aa, Homo Sapiens
AANETYKNN

SEQ ID NO: 841847 - protein, 9 aa, Homo Sapiens
RQIAAHTNL

SEQ ID NO: 841848 - protein, 9 aa, Homo Sapiens
FSSRRPQND

SEQ ID NO: 841849 - protein, 9 aa, Homo Sapiens
RLIEEQLTN

SEQ ID NO: 841850 - protein, 9 aa, Homo Sapiens
PKEAGPSQR

SEQ ID NO: 841851 - protein, 9 aa, Homo Sapiens
YDKIERTTK

SEQ ID NO: 841852 - protein, 9 aa, Homo Sapiens
TSEPIFHCQ

SEQ ID NO: 841853 - protein, 9 aa, Homo Sapiens
ILCLSLDYP

SEQ ID NO: 841854 - protein, 9 aa, Homo Sapiens
LEKAIRDKL

SEQ ID NO: 841855 - protein, 9 aa, Homo Sapiens
IIDKSRRDP

SEQ ID NO: 841856 - protein, 9 aa, Homo Sapiens
LGSVTALRF

SEQ ID NO: 841857 - protein, 9 aa, Homo Sapiens
IKYLRKLKR

SEQ ID NO: 841858 - protein, 9 aa, Homo Sapiens
PLNNADSQN

SEQ ID NO: 841859 - protein, 9 aa, Homo Sapiens
WTTYRGPDT

SEQ ID NO: 841860 - protein, 9 aa, Homo Sapiens
CTFISGRFP

SEQ ID NO: 841861 - protein, 9 aa, Homo Sapiens
REGVIRTAS

SEQ ID NO: 841862 - protein, 9 aa, Homo Sapiens
GAVVNANST

SEQ ID NO: 841863 - protein, 9 aa, Homo Sapiens
YSCKYCNFR

SEQ ID NO: 841864 - protein, 9 aa, Homo Sapiens
AFGPFATDI

SEQ ID NO: 841865 - protein, 9 aa, Homo Sapiens
PLRHARHAQ

SEQ ID NO: 841866 - protein, 9 aa, Homo Sapiens
PCYRTTGPE

SEQ ID NO: 841867 - protein, 9 aa, Homo Sapiens
VMAGAPNSR

SEQ ID NO: 841868 - protein, 9 aa, Homo Sapiens
LSAGFMPGI

SEQ ID NO: 841869 - protein, 9 aa, Homo Sapiens
LLQEDYGLF

SEQ ID NO: 841870 - protein, 9 aa, Homo Sapiens
SLGTLYTSS

SEQ ID NO: 841871 - protein, 9 aa, Homo Sapiens
CSQLMALVR

SEQ ID NO: 841872 - protein, 9 aa, Homo Sapiens
DFGIWMLEE

SEQ ID NO: 841873 - protein, 9 aa, Homo Sapiens
TSQLPLKSD

SEQ ID NO: 841874 - protein, 9 aa, Homo Sapiens
DTTIQELKE

SEQ ID NO: 841875 - protein, 9 aa, Homo Sapiens
FTANTAFSA

SEQ ID NO: 841876 - protein, 9 aa, Homo Sapiens
LRANNQLFL

SEQ ID NO: 841877 - protein, 9 aa, Homo Sapiens
ECQYSEESM

SEQ ID NO: 841878 - protein, 9 aa, Homo Sapiens
APGTRRQFS

SEQ ID NO: 841879 - protein, 9 aa, Homo Sapiens
QQQLPRRVA

SEQ ID NO: 841880 - protein, 9 aa, Homo Sapiens
ECGKGFQHP

SEQ ID NO: 841881 - protein, 9 aa, Homo Sapiens
EKYFFPGLG

SEQ ID NO: 841882 - protein, 9 aa, Homo Sapiens
LSNMYVVDI

SEQ ID NO: 841883 - protein, 9 aa, Homo Sapiens
LSSWCLNKP

SEQ ID NO: 841884 - protein, 9 aa, Homo Sapiens
KLIELENWT

SEQ ID NO: 841885 - protein, 9 aa, Homo Sapiens
STPTATVAT

SEQ ID NO: 841886 - protein, 9 aa, Homo Sapiens
RYVEKITRK

SEQ ID NO: 841887 - protein, 9 aa, Homo Sapiens
DNDIDRILH

SEQ ID NO: 841888 - protein, 9 aa, Homo Sapiens
YYSSKPNNL

SEQ ID NO: 841889 - protein, 9 aa, Homo Sapiens
GGTHRPPAL

SEQ ID NO: 841890 - protein, 9 aa, Homo Sapiens
LTLEQAKKE

SEQ ID NO: 841891 - protein, 9 aa, Homo Sapiens
GLQPRSLLI

SEQ ID NO: 841892 - protein, 9 aa, Homo Sapiens
VSENPGQIT

SEQ ID NO: 841893 - protein, 9 aa, Homo Sapiens
LSLIQLVGP

SEQ ID NO: 841894 - protein, 9 aa, Homo Sapiens
VGSLIIVIV

SEQ ID NO: 841895 - protein, 9 aa, Homo Sapiens
CCNKTRIEE

SEQ ID NO: 841896 - protein, 9 aa, Homo Sapiens
DEDISDEEG

SEQ ID NO: 841897 - protein, 9 aa, Homo Sapiens
HGSITHGTP

SEQ ID NO: 841898 - protein, 9 aa, Homo Sapiens
PRYWELLIY

SEQ ID NO: 841899 - protein, 9 aa, Homo Sapiens
AAGQGSHSQ

SEQ ID NO: 841900 - protein, 9 aa, Homo Sapiens
LEPQKQALF

SEQ ID NO: 841901 - protein, 9 aa, Homo Sapiens
SHLSYLKHH

SEQ ID NO: 841902 - protein, 9 aa, Homo Sapiens
LSHQIIHTG

SEQ ID NO: 841903 - protein, 9 aa, Homo Sapiens
EWNMFIDAM

SEQ ID NO: 841904 - protein, 9 aa, Homo Sapiens
GGAGCSGPV

SEQ ID NO: 841905 - protein, 9 aa, Homo Sapiens
WFSMYDQRP

SEQ ID NO: 841906 - protein, 9 aa, Homo Sapiens
FVKKCSETW

SEQ ID NO: 841907 - protein, 9 aa, Homo Sapiens
ANVDMSRDS

SEQ ID NO: 841908 - protein, 9 aa, Homo Sapiens
CGIPLCHLQ

SEQ ID NO: 841909 - protein, 9 aa, Homo Sapiens
LCIPYGAGR

SEQ ID NO: 841910 - protein, 9 aa, Homo Sapiens
NVGEHKEAF

SEQ ID NO: 841911 - protein, 9 aa, Homo Sapiens
ILFGTPLPN

SEQ ID NO: 841912 - protein, 9 aa, Homo Sapiens
AFLLIPEKL

SEQ ID NO: 841913 - protein, 9 aa, Homo Sapiens
AKKMDNLLR

SEQ ID NO: 841914 - protein, 9 aa, Homo Sapiens
VWGQYGNEE

SEQ ID NO: 841915 - protein, 9 aa, Homo Sapiens
GRTYRHASS

SEQ ID NO: 841916 - protein, 9 aa, Homo Sapiens
FLYLEVAAR

SEQ ID NO: 841917 - protein, 9 aa, Homo Sapiens
KECGKAVIH

SEQ ID NO: 841918 - protein, 9 aa, Homo Sapiens
TSVVPKMLI

SEQ ID NO: 841919 - protein, 9 aa, Homo Sapiens
VITENLEAA

SEQ ID NO: 841920 - protein, 9 aa, Homo Sapiens
DNAAICTTE

SEQ ID NO: 841921 - protein, 9 aa, Homo Sapiens
LSCNSTPRL

SEQ ID NO: 841922 - protein, 9 aa, Homo Sapiens
KTGEIMDNL

SEQ ID NO: 841923 - protein, 9 aa, Homo Sapiens
ISQVLYSCL

SEQ ID NO: 841924 - protein, 9 aa, Homo Sapiens
GFLTHFLRK

SEQ ID NO: 841925 - protein, 9 aa, Homo Sapiens
AVVVWKKSC

SEQ ID NO: 841926 - protein, 9 aa, Homo Sapiens
LKGRVALLL

SEQ ID NO: 841927 - protein, 9 aa, Homo Sapiens
DLIYADKEL

SEQ ID NO: 841928 - protein, 9 aa, Homo Sapiens
EYGFIYQTL

SEQ ID NO: 841929 - protein, 9 aa, Homo Sapiens
QTLDVSSKS

SEQ ID NO: 841930 - protein, 9 aa, Homo Sapiens
MDKTPSYFV

SEQ ID NO: 841931 - protein, 9 aa, Homo Sapiens
GIPDNAPIG

SEQ ID NO: 841932 - protein, 9 aa, Homo Sapiens
KYFVESNLR

SEQ ID NO: 841933 - protein, 9 aa, Homo Sapiens
ALIVSERNE

SEQ ID NO: 841934 - protein, 9 aa, Homo Sapiens
LGTPQPGVF

SEQ ID NO: 841935 - protein, 9 aa, Homo Sapiens
KAGQTVKHV

SEQ ID NO: 841936 - protein, 9 aa, Homo Sapiens
FSKCGVMTS

SEQ ID NO: 841937 - protein, 9 aa, Homo Sapiens
HGGFCYKMD

SEQ ID NO: 841938 - protein, 9 aa, Homo Sapiens
ASKIMKSIG

SEQ ID NO: 841939 - protein, 9 aa, Homo Sapiens
CMDNILGLN

SEQ ID NO: 841940 - protein, 9 aa, Homo Sapiens
DFILMNKMG

SEQ ID NO: 841941 - protein, 9 aa, Homo Sapiens
VLCIPYGAG

SEQ ID NO: 841942 - protein, 9 aa, Homo Sapiens
LVACTTPYM

SEQ ID NO: 841943 - protein, 9 aa, Homo Sapiens
CVNSGSGSI

SEQ ID NO: 841944 - protein, 9 aa, Homo Sapiens
AIISLPPGD

SEQ ID NO: 841945 - protein, 9 aa, Homo Sapiens
LTSDGRITL

SEQ ID NO: 841946 - protein, 9 aa, Homo Sapiens
MVCLSPLLF

SEQ ID NO: 841947 - protein, 9 aa, Homo Sapiens
KTQKLTFYR

SEQ ID NO: 841948 - protein, 9 aa, Homo Sapiens
KSNKRTPSA

SEQ ID NO: 841949 - protein, 9 aa, Homo Sapiens
YTVEQHNRK

SEQ ID NO: 841950 - protein, 9 aa, Homo Sapiens
RKDLSDTVR

SEQ ID NO: 841951 - protein, 9 aa, Homo Sapiens
VIQSKDTTI

SEQ ID NO: 841952 - protein, 9 aa, Homo Sapiens
ELNKHFPLE

SEQ ID NO: 841953 - protein, 9 aa, Homo Sapiens
FIFLGFPTR

SEQ ID NO: 841954 - protein, 9 aa, Homo Sapiens
KTDTKKESK

SEQ ID NO: 841955 - protein, 9 aa, Homo Sapiens
IILVANVTI

SEQ ID NO: 841956 - protein, 9 aa, Homo Sapiens
HFSQPIRLQ

SEQ ID NO: 841957 - protein, 9 aa, Homo Sapiens
GNYLGVQDA

SEQ ID NO: 841958 - protein, 9 aa, Homo Sapiens
YWAKRRTST

SEQ ID NO: 841959 - protein, 9 aa, Homo Sapiens
QPWHYFGAD

SEQ ID NO: 841960 - protein, 9 aa, Homo Sapiens
PPEKHIPGY

SEQ ID NO: 841961 - protein, 9 aa, Homo Sapiens
SGKGTTSEK

SEQ ID NO: 841962 - protein, 9 aa, Homo Sapiens
TKNSKSKPM

SEQ ID NO: 841963 - protein, 9 aa, Homo Sapiens
LKAIPVANI

SEQ ID NO: 841964 - protein, 9 aa, Homo Sapiens
QRRQDKAGP

SEQ ID NO: 841965 - protein, 9 aa, Homo Sapiens
EKLAEEIPT

SEQ ID NO: 841966 - protein, 9 aa, Homo Sapiens
VWMDEYKNL

SEQ ID NO: 841967 - protein, 9 aa, Homo Sapiens
ESRTDKEME

SEQ ID NO: 841968 - protein, 9 aa, Homo Sapiens
VFLGTASPS

SEQ ID NO: 841969 - protein, 9 aa, Homo Sapiens
DPHTAPSRA

SEQ ID NO: 841970 - protein, 9 aa, Homo Sapiens
DLSDWSSFN

SEQ ID NO: 841971 - protein, 9 aa, Homo Sapiens
GKKRKGSRK

SEQ ID NO: 841972 - protein, 9 aa, Homo Sapiens
GWIRYLPKL

SEQ ID NO: 841973 - protein, 9 aa, Homo Sapiens
RYMEENNIE

SEQ ID NO: 841974 - protein, 9 aa, Homo Sapiens
GEKHKALKM

SEQ ID NO: 841975 - protein, 9 aa, Homo Sapiens
EEMYCKSCY

SEQ ID NO: 841976 - protein, 9 aa, Homo Sapiens
SIVEWKPFK

SEQ ID NO: 841977 - protein, 9 aa, Homo Sapiens
ALKLASQNT

SEQ ID NO: 841978 - protein, 9 aa, Homo Sapiens
LTRGASLLT

SEQ ID NO: 841979 - protein, 9 aa, Homo Sapiens
EHISLAYSE

SEQ ID NO: 841980 - protein, 9 aa, Homo Sapiens
QLQNTTSKR

SEQ ID NO: 841981 - protein, 9 aa, Homo Sapiens
LKLIISCLG

SEQ ID NO: 841982 - protein, 9 aa, Homo Sapiens
QGYNETDWS

SEQ ID NO: 841983 - protein, 9 aa, Homo Sapiens
IERLNEMLQ

SEQ ID NO: 841984 - protein, 9 aa, Homo Sapiens
SIHQIKRTA

SEQ ID NO: 841985 - protein, 9 aa, Homo Sapiens
AGCIHSLSN

SEQ ID NO: 841986 - protein, 9 aa, Homo Sapiens
EELDNEDLK

SEQ ID NO: 841987 - protein, 9 aa, Homo Sapiens
LRFHQIIHT

SEQ ID NO: 841988 - protein, 9 aa, Homo Sapiens
VGSTAADSG

SEQ ID NO: 841989 - protein, 9 aa, Homo Sapiens
ETLQYLQQD

SEQ ID NO: 841990 - protein, 9 aa, Homo Sapiens
PLMTPTASG

SEQ ID NO: 841991 - protein, 9 aa, Homo Sapiens
PLAPLEPDY

SEQ ID NO: 841992 - protein, 9 aa, Homo Sapiens
QNGTKLEPP

SEQ ID NO: 841993 - protein, 9 aa, Homo Sapiens
DEQQGPIAC

SEQ ID NO: 841994 - protein, 9 aa, Homo Sapiens
PLNTATLFI

SEQ ID NO: 841995 - protein, 9 aa, Homo Sapiens
RRRTEQTAP

SEQ ID NO: 841996 - protein, 9 aa, Homo Sapiens
TFDLKVVAH

SEQ ID NO: 841997 - protein, 9 aa, Homo Sapiens
GEAAIMGDH

SEQ ID NO: 841998 - protein, 9 aa, Homo Sapiens
RCLHYEIKD

SEQ ID NO: 841999 - protein, 9 aa, Homo Sapiens
GDIMIDSRI

SEQ ID NO: 842000 - protein, 9 aa, Homo Sapiens
FVLCVITVL

SEQ ID NO: 842001 - protein, 9 aa, Homo Sapiens
SKVQEMTSQ

SEQ ID NO: 842002 - protein, 9 aa, Homo Sapiens
NNYIEERSG

SEQ ID NO: 842003 - protein, 9 aa, Homo Sapiens
DYILLKGKW

SEQ ID NO: 842004 - protein, 9 aa, Homo Sapiens
SSYMWRDGK

SEQ ID NO: 842005 - protein, 9 aa, Homo Sapiens
CVGQEVLLK

SEQ ID NO: 842006 - protein, 9 aa, Homo Sapiens
YTKHNFMMS

SEQ ID NO: 842007 - protein, 9 aa, Homo Sapiens
TRRPTLQPE

SEQ ID NO: 842008 - protein, 9 aa, Homo Sapiens
QKLCWEYYD

SEQ ID NO: 842009 - protein, 9 aa, Homo Sapiens
KTVDSTKDS

SEQ ID NO: 842010 - protein, 9 aa, Homo Sapiens
NVEHLKAPG

SEQ ID NO: 842011 - protein, 9 aa, Homo Sapiens
PQNDRRNAP

SEQ ID NO: 842012 - protein, 9 aa, Homo Sapiens
YGLGEHYNL

SEQ ID NO: 842013 - protein, 9 aa, Homo Sapiens
KVGQGENQI

SEQ ID NO: 842014 - protein, 9 aa, Homo Sapiens
TQTANKNND

SEQ ID NO: 842015 - protein, 9 aa, Homo Sapiens
KHTERIGHR

SEQ ID NO: 842016 - protein, 9 aa, Homo Sapiens
KLPWFPSDL

SEQ ID NO: 842017 - protein, 9 aa, Homo Sapiens
VEGADDEEE

SEQ ID NO: 842018 - protein, 9 aa, Homo Sapiens
IQAKLDQEA

SEQ ID NO: 842019 - protein, 9 aa, Homo Sapiens
GILCLCSHC

SEQ ID NO: 842020 - protein, 9 aa, Homo Sapiens
RLAILDNTV

SEQ ID NO: 842021 - protein, 9 aa, Homo Sapiens
SPLSVTVLQ

SEQ ID NO: 842022 - protein, 9 aa, Homo Sapiens
TDNPFMTSI

SEQ ID NO: 842023 - protein, 9 aa, Homo Sapiens
AEFSVSLLI

SEQ ID NO: 842024 - protein, 9 aa, Homo Sapiens
FSDSSQTKK

SEQ ID NO: 842025 - protein, 9 aa, Homo Sapiens
RGEGKAPQS

SEQ ID NO: 842026 - protein, 9 aa, Homo Sapiens
MTFNVQSKK

SEQ ID NO: 842027 - protein, 9 aa, Homo Sapiens
KAVREMLAS

SEQ ID NO: 842028 - protein, 9 aa, Homo Sapiens
WRDFFWSTV

SEQ ID NO: 842029 - protein, 9 aa, Homo Sapiens
NLFADEDLP

SEQ ID NO: 842030 - protein, 9 aa, Homo Sapiens
RKIKHLRVL

SEQ ID NO: 842031 - protein, 9 aa, Homo Sapiens
LFITPPIIC

SEQ ID NO: 842032 - protein, 9 aa, Homo Sapiens
QGDMEIPFE

SEQ ID NO: 842033 - protein, 9 aa, Homo Sapiens
HNSLDILKE

SEQ ID NO: 842034 - protein, 9 aa, Homo Sapiens
RRVAGDKLT

SEQ ID NO: 842035 - protein, 9 aa, Homo Sapiens
TKEKTSAIN

SEQ ID NO: 842036 - protein, 9 aa, Homo Sapiens
KVLKSLPGQ

SEQ ID NO: 842037 - protein, 9 aa, Homo Sapiens
YRIWEPQTS

SEQ ID NO: 842038 - protein, 9 aa, Homo Sapiens
SFSCYHDHR

SEQ ID NO: 842039 - protein, 9 aa, Homo Sapiens
EHNCREENK

SEQ ID NO: 842040 - protein, 9 aa, Homo Sapiens
TLLFRSCSR

SEQ ID NO: 842041 - protein, 9 aa, Homo Sapiens
GAVTILPKQ

SEQ ID NO: 842042 - protein, 9 aa, Homo Sapiens
NMKGLSYDE

SEQ ID NO: 842043 - protein, 9 aa, Homo Sapiens
ILAKSKGFG

SEQ ID NO: 842044 - protein, 9 aa, Homo Sapiens
RHWIIHTGE

SEQ ID NO: 842045 - protein, 9 aa, Homo Sapiens
GQEAEGDKY

SEQ ID NO: 842046 - protein, 9 aa, Homo Sapiens
GLTLHQTIY

SEQ ID NO: 842047 - protein, 9 aa, Homo Sapiens
QDYCNAIKI

SEQ ID NO: 842048 - protein, 9 aa, Homo Sapiens
LLCGVIYVV

SEQ ID NO: 842049 - protein, 9 aa, Homo Sapiens
PNDGYDLVQ

SEQ ID NO: 842050 - protein, 9 aa, Homo Sapiens
YGNQCNDPG

SEQ ID NO: 842051 - protein, 9 aa, Homo Sapiens
RLLDWALCQ

SEQ ID NO: 842052 - protein, 9 aa, Homo Sapiens
LMALVRYIK

SEQ ID NO: 842053 - protein, 9 aa, Homo Sapiens
VLLSGKWLH

SEQ ID NO: 842054 - protein, 9 aa, Homo Sapiens
AKTDPSEQV

SEQ ID NO: 842055 - protein, 9 aa, Homo Sapiens
ELVVTVVST

SEQ ID NO: 842056 - protein, 9 aa, Homo Sapiens
CPDCGERFS

SEQ ID NO: 842057 - protein, 9 aa, Homo Sapiens
NISRQNEYL

SEQ ID NO: 842058 - protein, 9 aa, Homo Sapiens
RKFVRPGAS

SEQ ID NO: 842059 - protein, 9 aa, Homo Sapiens
RWAHGPGHI

SEQ ID NO: 842060 - protein, 9 aa, Homo Sapiens
TVPPFYGEY

SEQ ID NO: 842061 - protein, 9 aa, Homo Sapiens
FFPSGQPPH

SEQ ID NO: 842062 - protein, 9 aa, Homo Sapiens
KLLSTFDVI

SEQ ID NO: 842063 - protein, 9 aa, Homo Sapiens
RCDNCGGLD

SEQ ID NO: 842064 - protein, 9 aa, Homo Sapiens
FPAEIYRQK

SEQ ID NO: 842065 - protein, 9 aa, Homo Sapiens
RIRAEYFKG

SEQ ID NO: 842066 - protein, 9 aa, Homo Sapiens
AAWCHQPPS

SEQ ID NO: 842067 - protein, 9 aa, Homo Sapiens
VISSSTKNY

SEQ ID NO: 842068 - protein, 9 aa, Homo Sapiens
EHIEKLEQR

SEQ ID NO: 842069 - protein, 9 aa, Homo Sapiens
EDKEEAIIP

SEQ ID NO: 842070 - protein, 9 aa, Homo Sapiens
RRAKFCKQE

SEQ ID NO: 842071 - protein, 9 aa, Homo Sapiens
RLDFILMNK

SEQ ID NO: 842072 - protein, 9 aa, Homo Sapiens
SFIECDTFI

SEQ ID NO: 842073 - protein, 9 aa, Homo Sapiens
FWLGLKNIF

SEQ ID NO: 842074 - protein, 9 aa, Homo Sapiens
FSSRLFSRQ

SEQ ID NO: 842075 - protein, 9 aa, Homo Sapiens
VNNLESFPR

SEQ ID NO: 842076 - protein, 9 aa, Homo Sapiens
SNNSFLQSE

SEQ ID NO: 842077 - protein, 9 aa, Homo Sapiens
SFDKLKLAR

SEQ ID NO: 842078 - protein, 9 aa, Homo Sapiens
KSMKGLYFA

SEQ ID NO: 842079 - protein, 9 aa, Homo Sapiens
TFGRGYTGL

SEQ ID NO: 842080 - protein, 9 aa, Homo Sapiens
SWSRAVFSS

SEQ ID NO: 842081 - protein, 9 aa, Homo Sapiens
INNMWAAFP

SEQ ID NO: 842082 - protein, 9 aa, Homo Sapiens
KMNILKFMA

SEQ ID NO: 842083 - protein, 9 aa, Homo Sapiens
SLPLPILAP

SEQ ID NO: 842084 - protein, 9 aa, Homo Sapiens
MELDGRRIW

SEQ ID NO: 842085 - protein, 9 aa, Homo Sapiens
EYQAHAGHI

SEQ ID NO: 842086 - protein, 9 aa, Homo Sapiens
LRIKETKKV

SEQ ID NO: 842087 - protein, 9 aa, Homo Sapiens
ISDDEEKNH

SEQ ID NO: 842088 - protein, 9 aa, Homo Sapiens
GHRLNNSEN

SEQ ID NO: 842089 - protein, 9 aa, Homo Sapiens
CRQPSQMIV

SEQ ID NO: 842090 - protein, 9 aa, Homo Sapiens
YQLLSEVVK

SEQ ID NO: 842091 - protein, 9 aa, Homo Sapiens
ASIYQSSDM

SEQ ID NO: 842092 - protein, 9 aa, Homo Sapiens
VATFLDIPE

SEQ ID NO: 842093 - protein, 9 aa, Homo Sapiens
KLRAEIDNL

SEQ ID NO: 842094 - protein, 9 aa, Homo Sapiens
NNGVVLCKL

SEQ ID NO: 842095 - protein, 9 aa, Homo Sapiens
HLSMRDRAA

SEQ ID NO: 842096 - protein, 9 aa, Homo Sapiens
VQDVLCAAV

SEQ ID NO: 842097 - protein, 9 aa, Homo Sapiens
LSAGCVGEI

SEQ ID NO: 842098 - protein, 9 aa, Homo Sapiens
ANETYKNNF

SEQ ID NO: 842099 - protein, 9 aa, Homo Sapiens
CAVINQSCC

SEQ ID NO: 842100 - protein, 9 aa, Homo Sapiens
SISKPDLIT

SEQ ID NO: 842101 - protein, 9 aa, Homo Sapiens
LLVSDEPST

SEQ ID NO: 842102 - protein, 9 aa, Homo Sapiens
MMLASGNSS

SEQ ID NO: 842103 - protein, 9 aa, Homo Sapiens
SHKTQSLEG

SEQ ID NO: 842104 - protein, 9 aa, Homo Sapiens
NVETVEYNN

SEQ ID NO: 842105 - protein, 9 aa, Homo Sapiens
FPISSILEG

SEQ ID NO: 842106 - protein, 9 aa, Homo Sapiens
DALLNRARK

SEQ ID NO: 842107 - protein, 9 aa, Homo Sapiens
VPEDMRCVD

SEQ ID NO: 842108 - protein, 9 aa, Homo Sapiens
GAVIMNGRI

SEQ ID NO: 842109 - protein, 9 aa, Homo Sapiens
DKPGRMNMI

SEQ ID NO: 842110 - protein, 9 aa, Homo Sapiens
AVASVPPDF

SEQ ID NO: 842111 - protein, 9 aa, Homo Sapiens
RHYRGEKLT

SEQ ID NO: 842112 - protein, 9 aa, Homo Sapiens
IENNTTFLN

SEQ ID NO: 842113 - protein, 9 aa, Homo Sapiens
EGVPVFIHF

SEQ ID NO: 842114 - protein, 9 aa, Homo Sapiens
KSKLPIIEL

SEQ ID NO: 842115 - protein, 9 aa, Homo Sapiens
IQQMESGYE

SEQ ID NO: 842116 - protein, 9 aa, Homo Sapiens
WLQKIKAIK

SEQ ID NO: 842117 - protein, 9 aa, Homo Sapiens
RDVWMSSNL

SEQ ID NO: 842118 - protein, 9 aa, Homo Sapiens
DSVGDITKE

SEQ ID NO: 842119 - protein, 9 aa, Homo Sapiens
YPAQAQSLR

SEQ ID NO: 842120 - protein, 9 aa, Homo Sapiens
YWCLCTVNE

SEQ ID NO: 842121 - protein, 9 aa, Homo Sapiens
CDNVEGLFF

SEQ ID NO: 842122 - protein, 9 aa, Homo Sapiens
RDAFGIYLK

SEQ ID NO: 842123 - protein, 9 aa, Homo Sapiens
IIKLEPGDY

SEQ ID NO: 842124 - protein, 9 aa, Homo Sapiens
EYFVRSITP

SEQ ID NO: 842125 - protein, 9 aa, Homo Sapiens
CMNFLAENV

SEQ ID NO: 842126 - protein, 9 aa, Homo Sapiens
SSMLSTDTN

SEQ ID NO: 842127 - protein, 9 aa, Homo Sapiens
ILPYVFKSI

SEQ ID NO: 842128 - protein, 9 aa, Homo Sapiens
MLRYHTGEG

SEQ ID NO: 842129 - protein, 9 aa, Homo Sapiens
IFRFGRQDE

SEQ ID NO: 842130 - protein, 9 aa, Homo Sapiens
ASSPGEDGS

SEQ ID NO: 842131 - protein, 9 aa, Homo Sapiens
EKVVQPAGA

SEQ ID NO: 842132 - protein, 9 aa, Homo Sapiens
HGNLELVVT

SEQ ID NO: 842133 - protein, 9 aa, Homo Sapiens
IYSKEEKYV

SEQ ID NO: 842134 - protein, 9 aa, Homo Sapiens
YRPMGFGDD

SEQ ID NO: 842135 - protein, 9 aa, Homo Sapiens
HQMTMDDSK

SEQ ID NO: 842136 - protein, 9 aa, Homo Sapiens
RTESINERT

SEQ ID NO: 842137 - protein, 9 aa, Homo Sapiens
EDDEEEEEY

SEQ ID NO: 842138 - protein, 9 aa, Homo Sapiens
HGSTDSDFG

SEQ ID NO: 842139 - protein, 9 aa, Homo Sapiens
RLSLSNHQI

SEQ ID NO: 842140 - protein, 9 aa, Homo Sapiens
STVSFPKMS

SEQ ID NO: 842141 - protein, 9 aa, Homo Sapiens
LTPMLNTFI

SEQ ID NO: 842142 - protein, 9 aa, Homo Sapiens
GLFNGCFIS

SEQ ID NO: 842143 - protein, 9 aa, Homo Sapiens
PWKQPKGIN

SEQ ID NO: 842144 - protein, 9 aa, Homo Sapiens
TEINVVRQL

SEQ ID NO: 842145 - protein, 9 aa, Homo Sapiens
KKSFETNTY

SEQ ID NO: 842146 - protein, 9 aa, Homo Sapiens
ILKYHTDIV

SEQ ID NO: 842147 - protein, 9 aa, Homo Sapiens
GTVVSTNWS

SEQ ID NO: 842148 - protein, 9 aa, Homo Sapiens
FGTGSVQKS

SEQ ID NO: 842149 - protein, 9 aa, Homo Sapiens
HIIIPVLLM

SEQ ID NO: 842150 - protein, 9 aa, Homo Sapiens
EQVWYEHRF

SEQ ID NO: 842151 - protein, 9 aa, Homo Sapiens
DLLSDLNKQ

SEQ ID NO: 842152 - protein, 9 aa, Homo Sapiens
SIVKLYKET

SEQ ID NO: 842153 - protein, 9 aa, Homo Sapiens
ESGFRGPPG

SEQ ID NO: 842154 - protein, 9 aa, Homo Sapiens
SLLIQAARG

SEQ ID NO: 842155 - protein, 9 aa, Homo Sapiens
LLNRSAPQT

SEQ ID NO: 842156 - protein, 9 aa, Homo Sapiens
QNDSVLDMA

SEQ ID NO: 842157 - protein, 9 aa, Homo Sapiens
FLYKENKTK

SEQ ID NO: 842158 - protein, 9 aa, Homo Sapiens
TPVDVILDS

SEQ ID NO: 842159 - protein, 9 aa, Homo Sapiens
RMPQWRCRH

SEQ ID NO: 842160 - protein, 9 aa, Homo Sapiens
VIQALYFCR

SEQ ID NO: 842161 - protein, 9 aa, Homo Sapiens
QPCRCPAHA

SEQ ID NO: 842162 - protein, 9 aa, Homo Sapiens
PRKNVNVSF

SEQ ID NO: 842163 - protein, 9 aa, Homo Sapiens
ALKDEANQE

SEQ ID NO: 842164 - protein, 9 aa, Homo Sapiens
AKGDKATVK

SEQ ID NO: 842165 - protein, 9 aa, Homo Sapiens
NKSNFKKKM

SEQ ID NO: 842166 - protein, 9 aa, Homo Sapiens
LPSGFPIED

SEQ ID NO: 842167 - protein, 9 aa, Homo Sapiens
ALQSSHRAV

SEQ ID NO: 842168 - protein, 9 aa, Homo Sapiens
LKVYEIDDV

SEQ ID NO: 842169 - protein, 9 aa, Homo Sapiens
TTQSHTTAT

SEQ ID NO: 842170 - protein, 9 aa, Homo Sapiens
RCHVAVRKY

SEQ ID NO: 842171 - protein, 9 aa, Homo Sapiens
LIENKAFKQ

SEQ ID NO: 842172 - protein, 9 aa, Homo Sapiens
LRKCCDQYP

SEQ ID NO: 842173 - protein, 9 aa, Homo Sapiens
CFTLHLCST

SEQ ID NO: 842174 - protein, 9 aa, Homo Sapiens
AHKITRYTT

SEQ ID NO: 842175 - protein, 9 aa, Homo Sapiens
FGTPLPNYY

SEQ ID NO: 842176 - protein, 9 aa, Homo Sapiens
DPNDEGAVL

SEQ ID NO: 842177 - protein, 9 aa, Homo Sapiens
IREAVEEIQ

SEQ ID NO: 842178 - protein, 9 aa, Homo Sapiens
CCLTREVQG

SEQ ID NO: 842179 - protein, 9 aa, Homo Sapiens
SKNKIAAQR

SEQ ID NO: 842180 - protein, 9 aa, Homo Sapiens
DTTNIVLTG

SEQ ID NO: 842181 - protein, 9 aa, Homo Sapiens
HGNCSNTTS

SEQ ID NO: 842182 - protein, 9 aa, Homo Sapiens
PQTLEVIYP

SEQ ID NO: 842183 - protein, 9 aa, Homo Sapiens
CKQECLIAT

SEQ ID NO: 842184 - protein, 9 aa, Homo Sapiens
YWALAYQGL

SEQ ID NO: 842185 - protein, 9 aa, Homo Sapiens
LNIWDYRHP

SEQ ID NO: 842186 - protein, 9 aa, Homo Sapiens
LVEGMDFHT

SEQ ID NO: 842187 - protein, 9 aa, Homo Sapiens
PRTLKTNLP

SEQ ID NO: 842188 - protein, 9 aa, Homo Sapiens
VDVCVNVTD

SEQ ID NO: 842189 - protein, 9 aa, Homo Sapiens
AVHVQDSGK

SEQ ID NO: 842190 - protein, 9 aa, Homo Sapiens
LHSATVTPQ

SEQ ID NO: 842191 - protein, 9 aa, Homo Sapiens
RPPLIQNLP

SEQ ID NO: 842192 - protein, 9 aa, Homo Sapiens
DMLIKIHIG

SEQ ID NO: 842193 - protein, 9 aa, Homo Sapiens
FIERENMEL

SEQ ID NO: 842194 - protein, 9 aa, Homo Sapiens
NIFLQPPKL

SEQ ID NO: 842195 - protein, 9 aa, Homo Sapiens
KTTRIRDIA

SEQ ID NO: 842196 - protein, 9 aa, Homo Sapiens
VPICTDPMS

SEQ ID NO: 842197 - protein, 9 aa, Homo Sapiens
DAQKSAVAG

SEQ ID NO: 842198 - protein, 9 aa, Homo Sapiens
TIQERCPER

SEQ ID NO: 842199 - protein, 9 aa, Homo Sapiens
GETGLGTPP

SEQ ID NO: 842200 - protein, 9 aa, Homo Sapiens
DSGSLQRDM

SEQ ID NO: 842201 - protein, 9 aa, Homo Sapiens
GYIYYSNFH

SEQ ID NO: 842202 - protein, 9 aa, Homo Sapiens
HPPTTPQYY

SEQ ID NO: 842203 - protein, 9 aa, Homo Sapiens
NTTDGSTIC

SEQ ID NO: 842204 - protein, 9 aa, Homo Sapiens
PFQSELHPA

SEQ ID NO: 842205 - protein, 9 aa, Homo Sapiens
TSSWTPESN

SEQ ID NO: 842206 - protein, 9 aa, Homo Sapiens
INFDVARPK

SEQ ID NO: 842207 - protein, 9 aa, Homo Sapiens
ELVDQLSHM

SEQ ID NO: 842208 - protein, 9 aa, Homo Sapiens
VRYAMGAKS

SEQ ID NO: 842209 - protein, 9 aa, Homo Sapiens
TNSQGHKLF

SEQ ID NO: 842210 - protein, 9 aa, Homo Sapiens
LLKCRLIHN

SEQ ID NO: 842211 - protein, 9 aa, Homo Sapiens
TCGICGNFN

SEQ ID NO: 842212 - protein, 9 aa, Homo Sapiens
PFTRAHEEE

SEQ ID NO: 842213 - protein, 9 aa, Homo Sapiens
VSTISSLFP

SEQ ID NO: 842214 - protein, 9 aa, Homo Sapiens
ETSFENMKE

SEQ ID NO: 842215 - protein, 9 aa, Homo Sapiens
DKMGGAGTV

SEQ ID NO: 842216 - protein, 9 aa, Homo Sapiens
DIKLRHFEE

SEQ ID NO: 842217 - protein, 9 aa, Homo Sapiens
ATSQISDAH

SEQ ID NO: 842218 - protein, 9 aa, Homo Sapiens
CFICMEKLW

SEQ ID NO: 842219 - protein, 9 aa, Homo Sapiens
PFCLGTGYI

SEQ ID NO: 842220 - protein, 9 aa, Homo Sapiens
TGEKPCECQ

SEQ ID NO: 842221 - protein, 9 aa, Homo Sapiens
LLLQHNIRK

SEQ ID NO: 842222 - protein, 9 aa, Homo Sapiens
HKLTIDNVT

SEQ ID NO: 842223 - protein, 9 aa, Homo Sapiens
TVGRQYLWL

SEQ ID NO: 842224 - protein, 9 aa, Homo Sapiens
RFWLAVQYL

SEQ ID NO: 842225 - protein, 9 aa, Homo Sapiens
SVLLMLNMF

SEQ ID NO: 842226 - protein, 9 aa, Homo Sapiens
ALKEFEQLW

SEQ ID NO: 842227 - protein, 9 aa, Homo Sapiens
AYEHHLEAH

SEQ ID NO: 842228 - protein, 9 aa, Homo Sapiens
YRDVMLDNY

SEQ ID NO: 842229 - protein, 9 aa, Homo Sapiens
YREGMRMNY

SEQ ID NO: 842230 - protein, 9 aa, Homo Sapiens
SLPQVFSFF

SEQ ID NO: 842231 - protein, 9 aa, Homo Sapiens
IVQFSCDMH

SEQ ID NO: 842232 - protein, 9 aa, Homo Sapiens
YRDVMLDNL

SEQ ID NO: 842233 - protein, 9 aa, Homo Sapiens
SVREPGHSG

SEQ ID NO: 842234 - protein, 9 aa, Homo Sapiens
AALSCDTGL

SEQ ID NO: 842235 - protein, 9 aa, Homo Sapiens
NSKNEAPVV

SEQ ID NO: 842236 - protein, 9 aa, Homo Sapiens
SSYLQNDSV

SEQ ID NO: 842237 - protein, 9 aa, Homo Sapiens
DNIIVSSKY

SEQ ID NO: 842238 - protein, 9 aa, Homo Sapiens
WPFHFYYPR

SEQ ID NO: 842239 - protein, 9 aa, Homo Sapiens
GRRQRAPPW

SEQ ID NO: 842240 - protein, 9 aa, Homo Sapiens
NPRSRQIIP

SEQ ID NO: 842241 - protein, 9 aa, Homo Sapiens
LESTKVGVQ

SEQ ID NO: 842242 - protein, 9 aa, Homo Sapiens
LPSLLKKYQ

SEQ ID NO: 842243 - protein, 9 aa, Homo Sapiens
RERRQKSEW

SEQ ID NO: 842244 - protein, 9 aa, Homo Sapiens
TPTSLQVPE

SEQ ID NO: 842245 - protein, 9 aa, Homo Sapiens
EYTVTSTVG

SEQ ID NO: 842246 - protein, 9 aa, Homo Sapiens
ADKRIPQIR

SEQ ID NO: 842247 - protein, 9 aa, Homo Sapiens
TCTYATALN

SEQ ID NO: 842248 - protein, 9 aa, Homo Sapiens
YHDKTGEIM

SEQ ID NO: 842249 - protein, 9 aa, Homo Sapiens
QKAAMQDKY

SEQ ID NO: 842250 - protein, 9 aa, Homo Sapiens
AQEILARNL

SEQ ID NO: 842251 - protein, 9 aa, Homo Sapiens
EGRTLDARM

SEQ ID NO: 842252 - protein, 9 aa, Homo Sapiens
SEGTETVEE

SEQ ID NO: 842253 - protein, 9 aa, Homo Sapiens
AEIARLMEY

SEQ ID NO: 842254 - protein, 9 aa, Homo Sapiens
KALVTMPGP

SEQ ID NO: 842255 - protein, 9 aa, Homo Sapiens
NKINNGTSP

SEQ ID NO: 842256 - protein, 9 aa, Homo Sapiens
DKIREQEEM

SEQ ID NO: 842257 - protein, 9 aa, Homo Sapiens
IDHLNKHSY

SEQ ID NO: 842258 - protein, 9 aa, Homo Sapiens
CKQFLIQLR

SEQ ID NO: 842259 - protein, 9 aa, Homo Sapiens
ETQHYPAFT

SEQ ID NO: 842260 - protein, 9 aa, Homo Sapiens
LQITDVRLS

SEQ ID NO: 842261 - protein, 9 aa, Homo Sapiens
KANSFTAQF

SEQ ID NO: 842262 - protein, 9 aa, Homo Sapiens
TKNYPSTRV

SEQ ID NO: 842263 - protein, 9 aa, Homo Sapiens
HSGGEGLET

SEQ ID NO: 842264 - protein, 9 aa, Homo Sapiens
TDYCGIHLS

SEQ ID NO: 842265 - protein, 9 aa, Homo Sapiens
PQLILALLI

SEQ ID NO: 842266 - protein, 9 aa, Homo Sapiens
RKTSSRLDH

SEQ ID NO: 842267 - protein, 9 aa, Homo Sapiens
IRITGRDVV

SEQ ID NO: 842268 - protein, 9 aa, Homo Sapiens
YGLLDLIQD

SEQ ID NO: 842269 - protein, 9 aa, Homo Sapiens
HPKIHYMAS

SEQ ID NO: 842270 - protein, 9 aa, Homo Sapiens
LIMGLFNGC

SEQ ID NO: 842271 - protein, 9 aa, Homo Sapiens
EPPIVQPLH

SEQ ID NO: 842272 - protein, 9 aa, Homo Sapiens
EFIWTEGLL

SEQ ID NO: 842273 - protein, 9 aa, Homo Sapiens
FQKHSNLTQ

SEQ ID NO: 842274 - protein, 9 aa, Homo Sapiens
VPESPKFVR

SEQ ID NO: 842275 - protein, 9 aa, Homo Sapiens
LSCTVVEML

SEQ ID NO: 842276 - protein, 9 aa, Homo Sapiens
RVAGQLQEP

SEQ ID NO: 842277 - protein, 9 aa, Homo Sapiens
NGKTMTKMP

SEQ ID NO: 842278 - protein, 9 aa, Homo Sapiens
FILGRAPYP

SEQ ID NO: 842279 - protein, 9 aa, Homo Sapiens
FTESLTRGA

SEQ ID NO: 842280 - protein, 9 aa, Homo Sapiens
GGSGMGNFN

SEQ ID NO: 842281 - protein, 9 aa, Homo Sapiens
SFTALEVRH

SEQ ID NO: 842282 - protein, 9 aa, Homo Sapiens
KHQFTRQEW

SEQ ID NO: 842283 - protein, 9 aa, Homo Sapiens
ASMSLMAPT

SEQ ID NO: 842284 - protein, 9 aa, Homo Sapiens
INVPIFKDN

SEQ ID NO: 842285 - protein, 9 aa, Homo Sapiens
EDNSCSHGR

SEQ ID NO: 842286 - protein, 9 aa, Homo Sapiens
SEEHEDISV

SEQ ID NO: 842287 - protein, 9 aa, Homo Sapiens
FRVDLVQAA

SEQ ID NO: 842288 - protein, 9 aa, Homo Sapiens
GGRDAERKS

SEQ ID NO: 842289 - protein, 9 aa, Homo Sapiens
NCKWYQDNA

SEQ ID NO: 842290 - protein, 9 aa, Homo Sapiens
SLKQLQIVH

SEQ ID NO: 842291 - protein, 9 aa, Homo Sapiens
GGAYPIGTT

SEQ ID NO: 842292 - protein, 9 aa, Homo Sapiens
YQSSDMKGW

SEQ ID NO: 842293 - protein, 9 aa, Homo Sapiens
LCFVLCVIT

SEQ ID NO: 842294 - protein, 9 aa, Homo Sapiens
ADAETLWKA

SEQ ID NO: 842295 - protein, 9 aa, Homo Sapiens
GLSCAHTQV

SEQ ID NO: 842296 - protein, 9 aa, Homo Sapiens
LIELPYHGE

SEQ ID NO: 842297 - protein, 9 aa, Homo Sapiens
TATGQSRVT

SEQ ID NO: 842298 - protein, 9 aa, Homo Sapiens
PSWKTSANI

SEQ ID NO: 842299 - protein, 9 aa, Homo Sapiens
PFASAYEHH

SEQ ID NO: 842300 - protein, 9 aa, Homo Sapiens
WMDEYKNLY

SEQ ID NO: 842301 - protein, 9 aa, Homo Sapiens
DQKYSDEDN

SEQ ID NO: 842302 - protein, 9 aa, Homo Sapiens
PGKPQKRKK

SEQ ID NO: 842303 - protein, 9 aa, Homo Sapiens
SYIAAISVR

SEQ ID NO: 842304 - protein, 9 aa, Homo Sapiens
TRQKKERML

SEQ ID NO: 842305 - protein, 9 aa, Homo Sapiens
REFRKLGFY

SEQ ID NO: 842306 - protein, 9 aa, Homo Sapiens
IGIFGAFFS

SEQ ID NO: 842307 - protein, 9 aa, Homo Sapiens
KPYIRHKYV

SEQ ID NO: 842308 - protein, 9 aa, Homo Sapiens
GGVCAVINQ

SEQ ID NO: 842309 - protein, 9 aa, Homo Sapiens
SAPFQSELH

SEQ ID NO: 842310 - protein, 9 aa, Homo Sapiens
TILCLSLDY

SEQ ID NO: 842311 - protein, 9 aa, Homo Sapiens
GKHYRDFSL

SEQ ID NO: 842312 - protein, 9 aa, Homo Sapiens
TVHHIIHVG

SEQ ID NO: 842313 - protein, 9 aa, Homo Sapiens
HRNYVTHYC

SEQ ID NO: 842314 - protein, 9 aa, Homo Sapiens
TDRDDGVNG

SEQ ID NO: 842315 - protein, 9 aa, Homo Sapiens
CTLAKTACD

SEQ ID NO: 842316 - protein, 9 aa, Homo Sapiens
SRFQYSGKV

SEQ ID NO: 842317 - protein, 9 aa, Homo Sapiens
QCIDSLNRR

SEQ ID NO: 842318 - protein, 9 aa, Homo Sapiens
TSCMSEQSE

SEQ ID NO: 842319 - protein, 9 aa, Homo Sapiens
ESGGTVVST

SEQ ID NO: 842320 - protein, 9 aa, Homo Sapiens
AQQQLPRRV

SEQ ID NO: 842321 - protein, 9 aa, Homo Sapiens
QETVQRIIL

SEQ ID NO: 842322 - protein, 9 aa, Homo Sapiens
SQQLEQPFA

SEQ ID NO: 842323 - protein, 9 aa, Homo Sapiens
SYVLVVHQI

SEQ ID NO: 842324 - protein, 9 aa, Homo Sapiens
DAEEWLFTK

SEQ ID NO: 842325 - protein, 9 aa, Homo Sapiens
VSASMHNHI

SEQ ID NO: 842326 - protein, 9 aa, Homo Sapiens
FPAGGDPGL

SEQ ID NO: 842327 - protein, 9 aa, Homo Sapiens
LEIMRMCKN

SEQ ID NO: 842328 - protein, 9 aa, Homo Sapiens
NLWVDPCYV

SEQ ID NO: 842329 - protein, 9 aa, Homo Sapiens
SAPTPLCCD

SEQ ID NO: 842330 - protein, 9 aa, Homo Sapiens
TRQHELLYT

SEQ ID NO: 842331 - protein, 9 aa, Homo Sapiens
DKGQQLHKN

SEQ ID NO: 842332 - protein, 9 aa, Homo Sapiens
HGAGNAKNN

SEQ ID NO: 842333 - protein, 9 aa, Homo Sapiens
HRVDLDMLT

SEQ ID NO: 842334 - protein, 9 aa, Homo Sapiens
SASHFALVT

SEQ ID NO: 842335 - protein, 9 aa, Homo Sapiens
QQVFEELIC

SEQ ID NO: 842336 - protein, 9 aa, Homo Sapiens
TGIFTIRLP

SEQ ID NO: 842337 - protein, 9 aa, Homo Sapiens
IGSHNMTLQ

SEQ ID NO: 842338 - protein, 9 aa, Homo Sapiens
VHLWTGIRP

SEQ ID NO: 842339 - protein, 9 aa, Homo Sapiens
RRIRKGHME

SEQ ID NO: 842340 - protein, 9 aa, Homo Sapiens
NYYEGFLYP

SEQ ID NO: 842341 - protein, 9 aa, Homo Sapiens
YISKAKGTG

SEQ ID NO: 842342 - protein, 9 aa, Homo Sapiens
GEEVEAGTA

SEQ ID NO: 842343 - protein, 9 aa, Homo Sapiens
ERQRVRGHE

SEQ ID NO: 842344 - protein, 9 aa, Homo Sapiens
FESNFPRGC

SEQ ID NO: 842345 - protein, 9 aa, Homo Sapiens
APGSLIGVG

SEQ ID NO: 842346 - protein, 9 aa, Homo Sapiens
SGYFPMPEL

SEQ ID NO: 842347 - protein, 9 aa, Homo Sapiens
IYAIAVVLS

SEQ ID NO: 842348 - protein, 9 aa, Homo Sapiens
EEGQDKQRN

SEQ ID NO: 842349 - protein, 9 aa, Homo Sapiens
TYVFGRVMQ

SEQ ID NO: 842350 - protein, 9 aa, Homo Sapiens
HEQGKDINL

SEQ ID NO: 842351 - protein, 9 aa, Homo Sapiens
ALPSLKWIL

SEQ ID NO: 842352 - protein, 9 aa, Homo Sapiens
QLCALTQVV

SEQ ID NO: 842353 - protein, 9 aa, Homo Sapiens
RTPNATLGS

SEQ ID NO: 842354 - protein, 9 aa, Homo Sapiens
PFRLFIPVT

SEQ ID NO: 842355 - protein, 9 aa, Homo Sapiens
IPQKSRLLF

SEQ ID NO: 842356 - protein, 9 aa, Homo Sapiens
QPPWDFLQV

SEQ ID NO: 842357 - protein, 9 aa, Homo Sapiens
LNTLALFDN

SEQ ID NO: 842358 - protein, 9 aa, Homo Sapiens
SYMWRDGKG

SEQ ID NO: 842359 - protein, 9 aa, Homo Sapiens
GVVDLTTVY

SEQ ID NO: 842360 - protein, 9 aa, Homo Sapiens
VCYVLPRLM

SEQ ID NO: 842361 - protein, 9 aa, Homo Sapiens
HGCQHVKYG

SEQ ID NO: 842362 - protein, 9 aa, Homo Sapiens
EWSDKSEEE

SEQ ID NO: 842363 - protein, 9 aa, Homo Sapiens
KTQNVSSIL

SEQ ID NO: 842364 - protein, 9 aa, Homo Sapiens
HDTGECWLE

SEQ ID NO: 842365 - protein, 9 aa, Homo Sapiens
QSINLLTWT

SEQ ID NO: 842366 - protein, 9 aa, Homo Sapiens
EYNNGYEIY

SEQ ID NO: 842367 - protein, 9 aa, Homo Sapiens
QYLTHWPEY

SEQ ID NO: 842368 - protein, 9 aa, Homo Sapiens
ERELYGPNK

SEQ ID NO: 842369 - protein, 9 aa, Homo Sapiens
PTYTDYIFV

SEQ ID NO: 842370 - protein, 9 aa, Homo Sapiens
GSPLSVTVL

SEQ ID NO: 842371 - protein, 9 aa, Homo Sapiens
SFIHVEDYT

SEQ ID NO: 842372 - protein, 9 aa, Homo Sapiens
ADDYLKTPP

SEQ ID NO: 842373 - protein, 9 aa, Homo Sapiens
GVINAGKAD

SEQ ID NO: 842374 - protein, 9 aa, Homo Sapiens
EKHKALKMI

SEQ ID NO: 842375 - protein, 9 aa, Homo Sapiens
NAAQYLHQF

SEQ ID NO: 842376 - protein, 9 aa, Homo Sapiens
PIGTTANED

SEQ ID NO: 842377 - protein, 9 aa, Homo Sapiens
VCIMMNEGK

SEQ ID NO: 842378 - protein, 9 aa, Homo Sapiens
LEGLPPFSS

SEQ ID NO: 842379 - protein, 9 aa, Homo Sapiens
SNPNKATPC

SEQ ID NO: 842380 - protein, 9 aa, Homo Sapiens
VPLGITMVL

SEQ ID NO: 842381 - protein, 9 aa, Homo Sapiens
NLKKTIRIS

SEQ ID NO: 842382 - protein, 9 aa, Homo Sapiens
LDCLQWENV

SEQ ID NO: 842383 - protein, 9 aa, Homo Sapiens
ILGTTPITP

SEQ ID NO: 842384 - protein, 9 aa, Homo Sapiens
DITLYLVVA

SEQ ID NO: 842385 - protein, 9 aa, Homo Sapiens
DKNKKSKPI

SEQ ID NO: 842386 - protein, 9 aa, Homo Sapiens
IMGNILIVT

SEQ ID NO: 842387 - protein, 9 aa, Homo Sapiens
NREVDMYTG

SEQ ID NO: 842388 - protein, 9 aa, Homo Sapiens
ILLPPSIIS

SEQ ID NO: 842389 - protein, 9 aa, Homo Sapiens
NKSEYLFKF

SEQ ID NO: 842390 - protein, 9 aa, Homo Sapiens
LSHSHCFQT

SEQ ID NO: 842391 - protein, 9 aa, Homo Sapiens
PAPIPRAVP

SEQ ID NO: 842392 - protein, 9 aa, Homo Sapiens
NPSWKTSAN

SEQ ID NO: 842393 - protein, 9 aa, Homo Sapiens
MLSLTTILV

SEQ ID NO: 842394 - protein, 9 aa, Homo Sapiens
EKDMQAVRQ

SEQ ID NO: 842395 - protein, 9 aa, Homo Sapiens
GDKSLPHKK

SEQ ID NO: 842396 - protein, 9 aa, Homo Sapiens
KDPLPSEVT

SEQ ID NO: 842397 - protein, 9 aa, Homo Sapiens
KTTKMPCKS

SEQ ID NO: 842398 - protein, 9 aa, Homo Sapiens
NSEESHPYT

SEQ ID NO: 842399 - protein, 9 aa, Homo Sapiens
GQSHRRQSC

SEQ ID NO: 842400 - protein, 9 aa, Homo Sapiens
QQCEPASTM

SEQ ID NO: 842401 - protein, 9 aa, Homo Sapiens
YFKGLTKLK

SEQ ID NO: 842402 - protein, 9 aa, Homo Sapiens
GKKTPPRSV

SEQ ID NO: 842403 - protein, 9 aa, Homo Sapiens
LNLIMYSLR

SEQ ID NO: 842404 - protein, 9 aa, Homo Sapiens
TDTGCPAII

SEQ ID NO: 842405 - protein, 9 aa, Homo Sapiens
RKTDTNRIA

SEQ ID NO: 842406 - protein, 9 aa, Homo Sapiens
HYQGQSRGC

SEQ ID NO: 842407 - protein, 9 aa, Homo Sapiens
IAKETTIFL

SEQ ID NO: 842408 - protein, 9 aa, Homo Sapiens
AGIDLKFWH

SEQ ID NO: 842409 - protein, 9 aa, Homo Sapiens
GFINYAKVW

SEQ ID NO: 842410 - protein, 9 aa, Homo Sapiens
LFDSNGNFL

SEQ ID NO: 842411 - protein, 9 aa, Homo Sapiens
FMQQVIGKY

SEQ ID NO: 842412 - protein, 9 aa, Homo Sapiens
FSDLPCEED

SEQ ID NO: 842413 - protein, 9 aa, Homo Sapiens
WLYGVNNVL

SEQ ID NO: 842414 - protein, 9 aa, Homo Sapiens
SPGTLDQFI

SEQ ID NO: 842415 - protein, 9 aa, Homo Sapiens
QERPSKYIA

SEQ ID NO: 842416 - protein, 9 aa, Homo Sapiens
SFDKLLKYL

SEQ ID NO: 842417 - protein, 9 aa, Homo Sapiens
SEFKDLIGQ

SEQ ID NO: 842418 - protein, 9 aa, Homo Sapiens
WKWGGCSKD

SEQ ID NO: 842419 - protein, 9 aa, Homo Sapiens
TLRKRASKI

SEQ ID NO: 842420 - protein, 9 aa, Homo Sapiens
WTTKMNECV

SEQ ID NO: 842421 - protein, 9 aa, Homo Sapiens
LEANISCYL

SEQ ID NO: 842422 - protein, 9 aa, Homo Sapiens
MNQWWRVGA

SEQ ID NO: 842423 - protein, 9 aa, Homo Sapiens
TPCRTLILC

SEQ ID NO: 842424 - protein, 9 aa, Homo Sapiens
SNTHDFTPV

SEQ ID NO: 842425 - protein, 9 aa, Homo Sapiens
VKDPEARKL

SEQ ID NO: 842426 - protein, 9 aa, Homo Sapiens
DPDNFDKSM

SEQ ID NO: 842427 - protein, 9 aa, Homo Sapiens
RSQKVNKRS

SEQ ID NO: 842428 - protein, 9 aa, Homo Sapiens
HGMDRVDSE

SEQ ID NO: 842429 - protein, 9 aa, Homo Sapiens
ICAMTKNSK

SEQ ID NO: 842430 - protein, 9 aa, Homo Sapiens
VLLVVAIIL

SEQ ID NO: 842431 - protein, 9 aa, Homo Sapiens
MMAFMDISV

SEQ ID NO: 842432 - protein, 9 aa, Homo Sapiens
MSEVDCCGE

SEQ ID NO: 842433 - protein, 9 aa, Homo Sapiens
VPHNHNQIP

SEQ ID NO: 842434 - protein, 9 aa, Homo Sapiens
EGITHEQMQ

SEQ ID NO: 842435 - protein, 9 aa, Homo Sapiens
PGDGPSYGR

SEQ ID NO: 842436 - protein, 9 aa, Homo Sapiens
TRRLFKVTP

SEQ ID NO: 842437 - protein, 9 aa, Homo Sapiens
PDRVATSQI

SEQ ID NO: 842438 - protein, 9 aa, Homo Sapiens
LPKSSIVYL

SEQ ID NO: 842439 - protein, 9 aa, Homo Sapiens
ALGVWRRDQ

SEQ ID NO: 842440 - protein, 9 aa, Homo Sapiens
RITRDNAAI

SEQ ID NO: 842441 - protein, 9 aa, Homo Sapiens
IQTLCGSLC

SEQ ID NO: 842442 - protein, 9 aa, Homo Sapiens
EHLTESLLF

SEQ ID NO: 842443 - protein, 9 aa, Homo Sapiens
EGKGRVKHH

SEQ ID NO: 842444 - protein, 9 aa, Homo Sapiens
TDKEELNKL

SEQ ID NO: 842445 - protein, 9 aa, Homo Sapiens
TLGKSNRNG

SEQ ID NO: 842446 - protein, 9 aa, Homo Sapiens
TQLIPALVK

SEQ ID NO: 842447 - protein, 9 aa, Homo Sapiens
LKRLDSERP

SEQ ID NO: 842448 - protein, 9 aa, Homo Sapiens
HNKRLKQLS

SEQ ID NO: 842449 - protein, 9 aa, Homo Sapiens
SGQFTHESD

SEQ ID NO: 842450 - protein, 9 aa, Homo Sapiens
LAPGHFDYI

SEQ ID NO: 842451 - protein, 9 aa, Homo Sapiens
LTATMRYEP

SEQ ID NO: 842452 - protein, 9 aa, Homo Sapiens
FEFEVKLAG

SEQ ID NO: 842453 - protein, 9 aa, Homo Sapiens
YSLFTSFFS

SEQ ID NO: 842454 - protein, 9 aa, Homo Sapiens
KIMFGFRVW

SEQ ID NO: 842455 - protein, 9 aa, Homo Sapiens
VIGAVVDVP

SEQ ID NO: 842456 - protein, 9 aa, Homo Sapiens
IKETQVPAY

SEQ ID NO: 842457 - protein, 9 aa, Homo Sapiens
FYHYMLTAG

SEQ ID NO: 842458 - protein, 9 aa, Homo Sapiens
GKIVLTATF

SEQ ID NO: 842459 - protein, 9 aa, Homo Sapiens
AELPLGARR

SEQ ID NO: 842460 - protein, 9 aa, Homo Sapiens
PQIISEGIY

SEQ ID NO: 842461 - protein, 9 aa, Homo Sapiens
FFQGGPIQN

SEQ ID NO: 842462 - protein, 9 aa, Homo Sapiens
ASTLLSDIG

SEQ ID NO: 842463 - protein, 9 aa, Homo Sapiens
SRTFIYLGV

SEQ ID NO: 842464 - protein, 9 aa, Homo Sapiens
VKKSAVVYM

SEQ ID NO: 842465 - protein, 9 aa, Homo Sapiens
RAIRAAVEQ

SEQ ID NO: 842466 - protein, 9 aa, Homo Sapiens
NRVILARIL

SEQ ID NO: 842467 - protein, 9 aa, Homo Sapiens
KSSVMTTEV

SEQ ID NO: 842468 - protein, 9 aa, Homo Sapiens
EEYVRFNSD

SEQ ID NO: 842469 - protein, 9 aa, Homo Sapiens
SGGALKLAS

SEQ ID NO: 842470 - protein, 9 aa, Homo Sapiens
TTLKEYETV

SEQ ID NO: 842471 - protein, 9 aa, Homo Sapiens
NLNTGMQTT

SEQ ID NO: 842472 - protein, 9 aa, Homo Sapiens
AMAVLGHWP

SEQ ID NO: 842473 - protein, 9 aa, Homo Sapiens
QPEVSRSLL

SEQ ID NO: 842474 - protein, 9 aa, Homo Sapiens
YVTLENRLQ

SEQ ID NO: 842475 - protein, 9 aa, Homo Sapiens
VFPTDWMNV

SEQ ID NO: 842476 - protein, 9 aa, Homo Sapiens
KNTWRQHLN

SEQ ID NO: 842477 - protein, 9 aa, Homo Sapiens
DCVQDVLCA

SEQ ID NO: 842478 - protein, 9 aa, Homo Sapiens
ECRLYYEGL

SEQ ID NO: 842479 - protein, 9 aa, Homo Sapiens
IIHTGDKFY

SEQ ID NO: 842480 - protein, 9 aa, Homo Sapiens
LIERQDKSD

SEQ ID NO: 842481 - protein, 9 aa, Homo Sapiens
FDNTQKSGL

SEQ ID NO: 842482 - protein, 9 aa, Homo Sapiens
VKATTAFPF

SEQ ID NO: 842483 - protein, 9 aa, Homo Sapiens
VGITSAFSM

SEQ ID NO: 842484 - protein, 9 aa, Homo Sapiens
SEDYLSSIY

SEQ ID NO: 842485 - protein, 9 aa, Homo Sapiens
EGREKRHRN

SEQ ID NO: 842486 - protein, 9 aa, Homo Sapiens
TGLDTMLIT

SEQ ID NO: 842487 - protein, 9 aa, Homo Sapiens
DGPYNYDIT

SEQ ID NO: 842488 - protein, 9 aa, Homo Sapiens
ASRKGKLYR

SEQ ID NO: 842489 - protein, 9 aa, Homo Sapiens
LQRCLRDPD

SEQ ID NO: 842490 - protein, 9 aa, Homo Sapiens
LALMPLFSE

SEQ ID NO: 842491 - protein, 9 aa, Homo Sapiens
SPLMQTGDN

SEQ ID NO: 842492 - protein, 9 aa, Homo Sapiens
KAAMQGQTD

SEQ ID NO: 842493 - protein, 9 aa, Homo Sapiens
CDQYPKGRS

SEQ ID NO: 842494 - protein, 9 aa, Homo Sapiens
EQQILNKRK

SEQ ID NO: 842495 - protein, 9 aa, Homo Sapiens
QKPQICDHC

SEQ ID NO: 842496 - protein, 9 aa, Homo Sapiens
NYFISYSRG

SEQ ID NO: 842497 - protein, 9 aa, Homo Sapiens
SDEEVYSVL

SEQ ID NO: 842498 - protein, 9 aa, Homo Sapiens
NPGLMNNAS

SEQ ID NO: 842499 - protein, 9 aa, Homo Sapiens
IFLGSRVAE

SEQ ID NO: 842500 - protein, 9 aa, Homo Sapiens
LGSTQSQGR

SEQ ID NO: 842501 - protein, 9 aa, Homo Sapiens
FATYCLLLF

SEQ ID NO: 842502 - protein, 9 aa, Homo Sapiens
FLDSTSSVS

SEQ ID NO: 842503 - protein, 9 aa, Homo Sapiens
SGKGVDIYS

SEQ ID NO: 842504 - protein, 9 aa, Homo Sapiens
VIIGFVLKI

SEQ ID NO: 842505 - protein, 9 aa, Homo Sapiens
ATKQHLTPK

SEQ ID NO: 842506 - protein, 9 aa, Homo Sapiens
QRARKKPQS

SEQ ID NO: 842507 - protein, 9 aa, Homo Sapiens
FRCASSVQS

SEQ ID NO: 842508 - protein, 9 aa, Homo Sapiens
PGKVRLDLL

SEQ ID NO: 842509 - protein, 9 aa, Homo Sapiens
DSIECSTFL

SEQ ID NO: 842510 - protein, 9 aa, Homo Sapiens
DGDTGGINL

SEQ ID NO: 842511 - protein, 9 aa, Homo Sapiens
EKGMAAYLD

SEQ ID NO: 842512 - protein, 9 aa, Homo Sapiens
YPTKCTVSV

SEQ ID NO: 842513 - protein, 9 aa, Homo Sapiens
PPMLQEDTR

SEQ ID NO: 842514 - protein, 9 aa, Homo Sapiens
SSFHSRTLG

SEQ ID NO: 842515 - protein, 9 aa, Homo Sapiens
CRSEAPTFW

SEQ ID NO: 842516 - protein, 9 aa, Homo Sapiens
VSKGYGLVS

SEQ ID NO: 842517 - protein, 9 aa, Homo Sapiens
RLPVSNKTL

SEQ ID NO: 842518 - protein, 9 aa, Homo Sapiens
GDPSAPFQS

SEQ ID NO: 842519 - protein, 9 aa, Homo Sapiens
RTLHKAFTG

SEQ ID NO: 842520 - protein, 9 aa, Homo Sapiens
SQHRKFVRP

SEQ ID NO: 842521 - protein, 9 aa, Homo Sapiens
NKLCSVPCT

SEQ ID NO: 842522 - protein, 9 aa, Homo Sapiens
VGAYTILQK

SEQ ID NO: 842523 - protein, 9 aa, Homo Sapiens
SNASPQGNL

SEQ ID NO: 842524 - protein, 9 aa, Homo Sapiens
TGLDVYGHH

SEQ ID NO: 842525 - protein, 9 aa, Homo Sapiens
TPTYKRRAI

SEQ ID NO: 842526 - protein, 9 aa, Homo Sapiens
TQELWIYQQ

SEQ ID NO: 842527 - protein, 9 aa, Homo Sapiens
LTHKEMETL

SEQ ID NO: 842528 - protein, 9 aa, Homo Sapiens
AERTVRLTW

SEQ ID NO: 842529 - protein, 9 aa, Homo Sapiens
LGGVTFLGL

SEQ ID NO: 842530 - protein, 9 aa, Homo Sapiens
LCVIALRYV

SEQ ID NO: 842531 - protein, 9 aa, Homo Sapiens
PAIKFAYLG

SEQ ID NO: 842532 - protein, 9 aa, Homo Sapiens
YENVQLRKG

SEQ ID NO: 842533 - protein, 9 aa, Homo Sapiens
GAPSHGALS

SEQ ID NO: 842534 - protein, 9 aa, Homo Sapiens
TRLNVPYNH

SEQ ID NO: 842535 - protein, 9 aa, Homo Sapiens
LAGLEFPPK

SEQ ID NO: 842536 - protein, 9 aa, Homo Sapiens
TNTVQQARS

SEQ ID NO: 842537 - protein, 9 aa, Homo Sapiens
GVQPFECNE

SEQ ID NO: 842538 - protein, 9 aa, Homo Sapiens
LYVGRDKKL

SEQ ID NO: 842539 - protein, 9 aa, Homo Sapiens
GFILTGEQI

SEQ ID NO: 842540 - protein, 9 aa, Homo Sapiens
RKCLTKCAD

SEQ ID NO: 842541 - protein, 9 aa, Homo Sapiens
TCGTLKISD

SEQ ID NO: 842542 - protein, 9 aa, Homo Sapiens
GFHGQTGPP

SEQ ID NO: 842543 - protein, 9 aa, Homo Sapiens
RVPVEVRPR

SEQ ID NO: 842544 - protein, 9 aa, Homo Sapiens
AVTVSYLYD

SEQ ID NO: 842545 - protein, 9 aa, Homo Sapiens
APGAPGAAP

SEQ ID NO: 842546 - protein, 9 aa, Homo Sapiens
CIEEEDQEE

SEQ ID NO: 842547 - protein, 9 aa, Homo Sapiens
LIFDMHIPY

SEQ ID NO: 842548 - protein, 9 aa, Homo Sapiens
EAWSDALSL

SEQ ID NO: 842549 - protein, 9 aa, Homo Sapiens
DLLENAMLC

SEQ ID NO: 842550 - protein, 9 aa, Homo Sapiens
QKSITQWIV

SEQ ID NO: 842551 - protein, 9 aa, Homo Sapiens
SIIGSQWIL

SEQ ID NO: 842552 - protein, 9 aa, Homo Sapiens
QSILGTPLS

SEQ ID NO: 842553 - protein, 9 aa, Homo Sapiens
KYLPELALD

SEQ ID NO: 842554 - protein, 9 aa, Homo Sapiens
AEGLGTGPE

SEQ ID NO: 842555 - protein, 9 aa, Homo Sapiens
DRLQGEEEE

SEQ ID NO: 842556 - protein, 9 aa, Homo Sapiens
CVARAGEPC

SEQ ID NO: 842557 - protein, 9 aa, Homo Sapiens
TALINFWDK

SEQ ID NO: 842558 - protein, 9 aa, Homo Sapiens
LYLFPLKMI

SEQ ID NO: 842559 - protein, 9 aa, Homo Sapiens
KERDKSSLD

SEQ ID NO: 842560 - protein, 9 aa, Homo Sapiens
AELVGRVEL

SEQ ID NO: 842561 - protein, 9 aa, Homo Sapiens
MREINQIFH

SEQ ID NO: 842562 - protein, 9 aa, Homo Sapiens
NIPAHTRHY

SEQ ID NO: 842563 - protein, 9 aa, Homo Sapiens
VEFIFHISR

SEQ ID NO: 842564 - protein, 9 aa, Homo Sapiens
STDNPKHST

SEQ ID NO: 842565 - protein, 9 aa, Homo Sapiens
GYLRSAGDH

SEQ ID NO: 842566 - protein, 9 aa, Homo Sapiens
DRIQGVLCG

SEQ ID NO: 842567 - protein, 9 aa, Homo Sapiens
VLPGAKYKV

SEQ ID NO: 842568 - protein, 9 aa, Homo Sapiens
KAMLLGALA

SEQ ID NO: 842569 - protein, 9 aa, Homo Sapiens
FLSWFAGLS

SEQ ID NO: 842570 - protein, 9 aa, Homo Sapiens
EQSGMYVIY

SEQ ID NO: 842571 - protein, 9 aa, Homo Sapiens
SLYWWLCWK

SEQ ID NO: 842572 - protein, 9 aa, Homo Sapiens
VTQCNCRKT

SEQ ID NO: 842573 - protein, 9 aa, Homo Sapiens
FEQYGKVLD

SEQ ID NO: 842574 - protein, 9 aa, Homo Sapiens
HLEKSEEPP

SEQ ID NO: 842575 - protein, 9 aa, Homo Sapiens
SIAAQEEML

SEQ ID NO: 842576 - protein, 9 aa, Homo Sapiens
SETSSSFSL

SEQ ID NO: 842577 - protein, 9 aa, Homo Sapiens
VSDAFGSLS

SEQ ID NO: 842578 - protein, 9 aa, Homo Sapiens
PFRDEGEHR

SEQ ID NO: 842579 - protein, 9 aa, Homo Sapiens
ILQLGGGPL

SEQ ID NO: 842580 - protein, 9 aa, Homo Sapiens
NGSCQCFPG

SEQ ID NO: 842581 - protein, 9 aa, Homo Sapiens
NVHEETTFE

SEQ ID NO: 842582 - protein, 9 aa, Homo Sapiens
LVQQLRENN

SEQ ID NO: 842583 - protein, 9 aa, Homo Sapiens
AWPKCLTKA

SEQ ID NO: 842584 - protein, 9 aa, Homo Sapiens
EFKYFFYII

SEQ ID NO: 842585 - protein, 9 aa, Homo Sapiens
LPYKYTCEG

SEQ ID NO: 842586 - protein, 9 aa, Homo Sapiens
AKTHMMSAV

SEQ ID NO: 842587 - protein, 9 aa, Homo Sapiens
LISYLYIIL

SEQ ID NO: 842588 - protein, 9 aa, Homo Sapiens
LNVLQNKSM

SEQ ID NO: 842589 - protein, 9 aa, Homo Sapiens
LQTLQSNGI

SEQ ID NO: 842590 - protein, 9 aa, Homo Sapiens
LVFNKIVEV

SEQ ID NO: 842591 - protein, 9 aa, Homo Sapiens
MDDNFISRA

SEQ ID NO: 842592 - protein, 9 aa, Homo Sapiens
IQATAANYL

SEQ ID NO: 842593 - protein, 9 aa, Homo Sapiens
RLRISGLFS

SEQ ID NO: 842594 - protein, 9 aa, Homo Sapiens
SEEKRGFIH

SEQ ID NO: 842595 - protein, 9 aa, Homo Sapiens
ILSVIYPGV

SEQ ID NO: 842596 - protein, 9 aa, Homo Sapiens
CCSLIKWLE

SEQ ID NO: 842597 - protein, 9 aa, Homo Sapiens
CQTRQHELL

SEQ ID NO: 842598 - protein, 9 aa, Homo Sapiens
NYIVQDSKL

SEQ ID NO: 842599 - protein, 9 aa, Homo Sapiens
APLISAKPL

SEQ ID NO: 842600 - protein, 9 aa, Homo Sapiens
DDYSFTTFF

SEQ ID NO: 842601 - protein, 9 aa, Homo Sapiens
SCPSWAGLS

SEQ ID NO: 842602 - protein, 9 aa, Homo Sapiens
EGKVNGRKG

SEQ ID NO: 842603 - protein, 9 aa, Homo Sapiens
SKPKKPFFL

SEQ ID NO: 842604 - protein, 9 aa, Homo Sapiens
KKKPTLLNL

SEQ ID NO: 842605 - protein, 9 aa, Homo Sapiens
VKVLLYSLG

SEQ ID NO: 842606 - protein, 9 aa, Homo Sapiens
QIQYSSDVQ

SEQ ID NO: 842607 - protein, 9 aa, Homo Sapiens
LNDDVVKIE

SEQ ID NO: 842608 - protein, 9 aa, Homo Sapiens
PHTAPSRAL

SEQ ID NO: 842609 - protein, 9 aa, Homo Sapiens
REKYFFPGL

SEQ ID NO: 842610 - protein, 9 aa, Homo Sapiens
SEEQGTRLA

SEQ ID NO: 842611 - protein, 9 aa, Homo Sapiens
RASKIYFRN

SEQ ID NO: 842612 - protein, 9 aa, Homo Sapiens
ENPGVFLSV

SEQ ID NO: 842613 - protein, 9 aa, Homo Sapiens
VFFPSGQPP

SEQ ID NO: 842614 - protein, 9 aa, Homo Sapiens
MVLAMMGAL

SEQ ID NO: 842615 - protein, 9 aa, Homo Sapiens
KLLLAHLKR

SEQ ID NO: 842616 - protein, 9 aa, Homo Sapiens
KAWSTGDCG

SEQ ID NO: 842617 - protein, 9 aa, Homo Sapiens
QHPLGMRLP

SEQ ID NO: 842618 - protein, 9 aa, Homo Sapiens
IPELINFLI

SEQ ID NO: 842619 - protein, 9 aa, Homo Sapiens
FIESCQEDD

SEQ ID NO: 842620 - protein, 9 aa, Homo Sapiens
RITQLPVRT

SEQ ID NO: 842621 - protein, 9 aa, Homo Sapiens
RALQQPDDR

SEQ ID NO: 842622 - protein, 9 aa, Homo Sapiens
TLEIIPASQ

SEQ ID NO: 842623 - protein, 9 aa, Homo Sapiens
YYIQEGSGK

SEQ ID NO: 842624 - protein, 9 aa, Homo Sapiens
ERLRQKRIN

SEQ ID NO: 842625 - protein, 9 aa, Homo Sapiens
EEEGPFDHM

SEQ ID NO: 842626 - protein, 9 aa, Homo Sapiens
TVMHNYQIS

SEQ ID NO: 842627 - protein, 9 aa, Homo Sapiens
CCAIQNSRD

SEQ ID NO: 842628 - protein, 9 aa, Homo Sapiens
KDPEARKLI

SEQ ID NO: 842629 - protein, 9 aa, Homo Sapiens
LNPPIKKAE

SEQ ID NO: 842630 - protein, 9 aa, Homo Sapiens
INEDVIINS

SEQ ID NO: 842631 - protein, 9 aa, Homo Sapiens
FGPIADVVR

SEQ ID NO: 842632 - protein, 9 aa, Homo Sapiens
PLGLGNKCP

SEQ ID NO: 842633 - protein, 9 aa, Homo Sapiens
VENVKLVDC

SEQ ID NO: 842634 - protein, 9 aa, Homo Sapiens
DRSKDLEKQ

SEQ ID NO: 842635 - protein, 9 aa, Homo Sapiens
RVLRVFTQQ

SEQ ID NO: 842636 - protein, 9 aa, Homo Sapiens
SQENGEKVK

SEQ ID NO: 842637 - protein, 9 aa, Homo Sapiens
SYRSGITQL

SEQ ID NO: 842638 - protein, 9 aa, Homo Sapiens
MFEILDRLI

SEQ ID NO: 842639 - protein, 9 aa, Homo Sapiens
EEHDQTFSE

SEQ ID NO: 842640 - protein, 9 aa, Homo Sapiens
LYLDITNGM

SEQ ID NO: 842641 - protein, 9 aa, Homo Sapiens
GDAFVSGSD

SEQ ID NO: 842642 - protein, 9 aa, Homo Sapiens
AIKYWAKRK

SEQ ID NO: 842643 - protein, 9 aa, Homo Sapiens
DYATCLYFI

SEQ ID NO: 842644 - protein, 9 aa, Homo Sapiens
VCLAQKMMI

SEQ ID NO: 842645 - protein, 9 aa, Homo Sapiens
LTVHHIIHV

SEQ ID NO: 842646 - protein, 9 aa, Homo Sapiens
PVEGNLEFR

SEQ ID NO: 842647 - protein, 9 aa, Homo Sapiens
NEKMTYTPE

SEQ ID NO: 842648 - protein, 9 aa, Homo Sapiens
FSPECSKHS

SEQ ID NO: 842649 - protein, 9 aa, Homo Sapiens
KIVYSIVSS

SEQ ID NO: 842650 - protein, 9 aa, Homo Sapiens
EQQLVDKSG

SEQ ID NO: 842651 - protein, 9 aa, Homo Sapiens
WVHRECDEG

SEQ ID NO: 842652 - protein, 9 aa, Homo Sapiens
TDLDRPESQ

SEQ ID NO: 842653 - protein, 9 aa, Homo Sapiens
RKMNLSERE

SEQ ID NO: 842654 - protein, 9 aa, Homo Sapiens
QHEGRKVCA

SEQ ID NO: 842655 - protein, 9 aa, Homo Sapiens
GSVTALRFT

SEQ ID NO: 842656 - protein, 9 aa, Homo Sapiens
RNQTRHLPL

SEQ ID NO: 842657 - protein, 9 aa, Homo Sapiens
VCSKLKMLE

SEQ ID NO: 842658 - protein, 9 aa, Homo Sapiens
VVCRFAHLL

SEQ ID NO: 842659 - protein, 9 aa, Homo Sapiens
VVMGHQQSF

SEQ ID NO: 842660 - protein, 9 aa, Homo Sapiens
SDLRTFRVL

SEQ ID NO: 842661 - protein, 9 aa, Homo Sapiens
FACVVCGTY

SEQ ID NO: 842662 - protein, 9 aa, Homo Sapiens
DLDPDFFIG

SEQ ID NO: 842663 - protein, 9 aa, Homo Sapiens
IMDFHSVPH

SEQ ID NO: 842664 - protein, 9 aa, Homo Sapiens
ATFAWSHES

SEQ ID NO: 842665 - protein, 9 aa, Homo Sapiens
ELILHDALC

SEQ ID NO: 842666 - protein, 9 aa, Homo Sapiens
VEQGELVAK

SEQ ID NO: 842667 - protein, 9 aa, Homo Sapiens
LHTQEGAQD

SEQ ID NO: 842668 - protein, 9 aa, Homo Sapiens
FLKHHDGQN

SEQ ID NO: 842669 - protein, 9 aa, Homo Sapiens
HWMHICSAL

SEQ ID NO: 842670 - protein, 9 aa, Homo Sapiens
AKIINTNKL

SEQ ID NO: 842671 - protein, 9 aa, Homo Sapiens
IRKWVTTVG

SEQ ID NO: 842672 - protein, 9 aa, Homo Sapiens
ICLALSLPF

SEQ ID NO: 842673 - protein, 9 aa, Homo Sapiens
NVPEGFAVG

SEQ ID NO: 842674 - protein, 9 aa, Homo Sapiens
TIISVLAYR

SEQ ID NO: 842675 - protein, 9 aa, Homo Sapiens
GRINVYGFS

SEQ ID NO: 842676 - protein, 9 aa, Homo Sapiens
DLSSNKICS

SEQ ID NO: 842677 - protein, 9 aa, Homo Sapiens
LCAGCKCSY

SEQ ID NO: 842678 - protein, 9 aa, Homo Sapiens
EEIEEQEVV

SEQ ID NO: 842679 - protein, 9 aa, Homo Sapiens
LTKTLPDSL

SEQ ID NO: 842680 - protein, 9 aa, Homo Sapiens
TALGNGSYL

SEQ ID NO: 842681 - protein, 9 aa, Homo Sapiens
ILKLYDKID

SEQ ID NO: 842682 - protein, 9 aa, Homo Sapiens
FYLGAGDRQ

SEQ ID NO: 842683 - protein, 9 aa, Homo Sapiens
IECLAQSSL

SEQ ID NO: 842684 - protein, 9 aa, Homo Sapiens
KELSADQMS

SEQ ID NO: 842685 - protein, 9 aa, Homo Sapiens
DQQQNEILV

SEQ ID NO: 842686 - protein, 9 aa, Homo Sapiens
LHGIRNTFQ

SEQ ID NO: 842687 - protein, 9 aa, Homo Sapiens
SLELHDEFG

SEQ ID NO: 842688 - protein, 9 aa, Homo Sapiens
ESFICKDKL

SEQ ID NO: 842689 - protein, 9 aa, Homo Sapiens
KTFDECQQN

SEQ ID NO: 842690 - protein, 9 aa, Homo Sapiens
GKHFINTNA

SEQ ID NO: 842691 - protein, 9 aa, Homo Sapiens
TFAKVRRQE

SEQ ID NO: 842692 - protein, 9 aa, Homo Sapiens
QIIQAAGTQ

SEQ ID NO: 842693 - protein, 9 aa, Homo Sapiens
QGSIVANVV

SEQ ID NO: 842694 - protein, 9 aa, Homo Sapiens
LQLSLIILD

SEQ ID NO: 842695 - protein, 9 aa, Homo Sapiens
IWKAKFLPR

SEQ ID NO: 842696 - protein, 9 aa, Homo Sapiens
KIPDTLEED

SEQ ID NO: 842697 - protein, 9 aa, Homo Sapiens
LHYIQDKTA

SEQ ID NO: 842698 - protein, 9 aa, Homo Sapiens
LEAGVNPSD

SEQ ID NO: 842699 - protein, 9 aa, Homo Sapiens
GRHAVRVAR

SEQ ID NO: 842700 - protein, 9 aa, Homo Sapiens
IKDLLEDTP

SEQ ID NO: 842701 - protein, 9 aa, Homo Sapiens
FLEAIWNNI

SEQ ID NO: 842702 - protein, 9 aa, Homo Sapiens
ALEPMPFQT

SEQ ID NO: 842703 - protein, 9 aa, Homo Sapiens
EHREESYPR

SEQ ID NO: 842704 - protein, 9 aa, Homo Sapiens
QQLGEYQEL

SEQ ID NO: 842705 - protein, 9 aa, Homo Sapiens
PVDYIVLIV

SEQ ID NO: 842706 - protein, 9 aa, Homo Sapiens
DVSSKSRTA

SEQ ID NO: 842707 - protein, 9 aa, Homo Sapiens
VWYFPSTAE

SEQ ID NO: 842708 - protein, 9 aa, Homo Sapiens
LLYSFAATV

SEQ ID NO: 842709 - protein, 9 aa, Homo Sapiens
EANKNIIED

SEQ ID NO: 842710 - protein, 9 aa, Homo Sapiens
CRHLLHKSC

SEQ ID NO: 842711 - protein, 9 aa, Homo Sapiens
SNYIFLYLK

SEQ ID NO: 842712 - protein, 9 aa, Homo Sapiens
SKLPIIELS

SEQ ID NO: 842713 - protein, 9 aa, Homo Sapiens
TVNTPKEKE

SEQ ID NO: 842714 - protein, 9 aa, Homo Sapiens
EVSAPSEHV

SEQ ID NO: 842715 - protein, 9 aa, Homo Sapiens
QEELSGDKN

SEQ ID NO: 842716 - protein, 9 aa, Homo Sapiens
VILSICSLL

SEQ ID NO: 842717 - protein, 9 aa, Homo Sapiens
KNYMMEEPN

SEQ ID NO: 842718 - protein, 9 aa, Homo Sapiens
SKLEENHIQ

SEQ ID NO: 842719 - protein, 9 aa, Homo Sapiens
PLPGHRVRE

SEQ ID NO: 842720 - protein, 9 aa, Homo Sapiens
VHILCAILN

SEQ ID NO: 842721 - protein, 9 aa, Homo Sapiens
GTLLFRSCS

SEQ ID NO: 842722 - protein, 9 aa, Homo Sapiens
TKIISVFIQ

SEQ ID NO: 842723 - protein, 9 aa, Homo Sapiens
PEEMSEVLQ

SEQ ID NO: 842724 - protein, 9 aa, Homo Sapiens
GSDGHGRLL

SEQ ID NO: 842725 - protein, 9 aa, Homo Sapiens
FGLARTAST

SEQ ID NO: 842726 - protein, 9 aa, Homo Sapiens
PSSFYFTVT

SEQ ID NO: 842727 - protein, 9 aa, Homo Sapiens
FTAQEMYDC

SEQ ID NO: 842728 - protein, 9 aa, Homo Sapiens
VRQHHRQNS

SEQ ID NO: 842729 - protein, 9 aa, Homo Sapiens
DGLSNASSQ

SEQ ID NO: 842730 - protein, 9 aa, Homo Sapiens
YLASSIATQ

SEQ ID NO: 842731 - protein, 9 aa, Homo Sapiens
LEIIAVLAA

SEQ ID NO: 842732 - protein, 9 aa, Homo Sapiens
DPELFDPNS

SEQ ID NO: 842733 - protein, 9 aa, Homo Sapiens
ADDEEEEES

SEQ ID NO: 842734 - protein, 9 aa, Homo Sapiens
NTSLQSAVI

SEQ ID NO: 842735 - protein, 9 aa, Homo Sapiens
AGIYTEDIP

SEQ ID NO: 842736 - protein, 9 aa, Homo Sapiens
NVLRGFEEK

SEQ ID NO: 842737 - protein, 9 aa, Homo Sapiens
SNTTSNSFI

SEQ ID NO: 842738 - protein, 9 aa, Homo Sapiens
KADGSFHLE

SEQ ID NO: 842739 - protein, 9 aa, Homo Sapiens
LLSYFMFTE

SEQ ID NO: 842740 - protein, 9 aa, Homo Sapiens
LDKMEKHRK

SEQ ID NO: 842741 - protein, 9 aa, Homo Sapiens
EKEYFTVHP

SEQ ID NO: 842742 - protein, 9 aa, Homo Sapiens
SKESKNGKK

SEQ ID NO: 842743 - protein, 9 aa, Homo Sapiens
QRSRINDEE

SEQ ID NO: 842744 - protein, 9 aa, Homo Sapiens
DKGLISRMY

SEQ ID NO: 842745 - protein, 9 aa, Homo Sapiens
NLFEEVFIY

SEQ ID NO: 842746 - protein, 9 aa, Homo Sapiens
QLLRKVFEE

SEQ ID NO: 842747 - protein, 9 aa, Homo Sapiens
EYEEQKKQN

SEQ ID NO: 842748 - protein, 9 aa, Homo Sapiens
NKRFTEEAT

SEQ ID NO: 842749 - protein, 9 aa, Homo Sapiens
QSRGKTAVE

SEQ ID NO: 842750 - protein, 9 aa, Homo Sapiens
YRQANTINM

SEQ ID NO: 842751 - protein, 9 aa, Homo Sapiens
QHCQQKCPP

SEQ ID NO: 842752 - protein, 9 aa, Homo Sapiens
VAFPGPQGK

SEQ ID NO: 842753 - protein, 9 aa, Homo Sapiens
RQSGHQESE

SEQ ID NO: 842754 - protein, 9 aa, Homo Sapiens
SPVLSGGIS

SEQ ID NO: 842755 - protein, 9 aa, Homo Sapiens
KYQGGHSGE

SEQ ID NO: 842756 - protein, 9 aa, Homo Sapiens
HLAMWTTAL

SEQ ID NO: 842757 - protein, 9 aa, Homo Sapiens
IELRELENK

SEQ ID NO: 842758 - protein, 9 aa, Homo Sapiens
VGAETALLI

SEQ ID NO: 842759 - protein, 9 aa, Homo Sapiens
DRMIFAATL

SEQ ID NO: 842760 - protein, 9 aa, Homo Sapiens
SDEDILEVA

SEQ ID NO: 842761 - protein, 9 aa, Homo Sapiens
MNNASSGLL

SEQ ID NO: 842762 - protein, 9 aa, Homo Sapiens
KHLRVLFIT

SEQ ID NO: 842763 - protein, 9 aa, Homo Sapiens
TMKMRYKHI

SEQ ID NO: 842764 - protein, 9 aa, Homo Sapiens
DQETSLPPL

SEQ ID NO: 842765 - protein, 9 aa, Homo Sapiens
TFPNTWLLA

SEQ ID NO: 842766 - protein, 9 aa, Homo Sapiens
LLLLAHIIL

SEQ ID NO: 842767 - protein, 9 aa, Homo Sapiens
EEHILKRVR

SEQ ID NO: 842768 - protein, 9 aa, Homo Sapiens
EISRVNRNV

SEQ ID NO: 842769 - protein, 9 aa, Homo Sapiens
SFTNVQSHM

SEQ ID NO: 842770 - protein, 9 aa, Homo Sapiens
NTKNNKIYD

SEQ ID NO: 842771 - protein, 9 aa, Homo Sapiens
SMLFWDELW

SEQ ID NO: 842772 - protein, 9 aa, Homo Sapiens
ICGIIICLD

SEQ ID NO: 842773 - protein, 9 aa, Homo Sapiens
MLPSWPTCL

SEQ ID NO: 842774 - protein, 9 aa, Homo Sapiens
LDFETMSLY

SEQ ID NO: 842775 - protein, 9 aa, Homo Sapiens
LDSTSIPQK

SEQ ID NO: 842776 - protein, 9 aa, Homo Sapiens
PHRAYAEKI

SEQ ID NO: 842777 - protein, 9 aa, Homo Sapiens
HNIKGEIHS

SEQ ID NO: 842778 - protein, 9 aa, Homo Sapiens
DLILYALER

SEQ ID NO: 842779 - protein, 9 aa, Homo Sapiens
YVPYVAFAM

SEQ ID NO: 842780 - protein, 9 aa, Homo Sapiens
VLLMGLMFA

SEQ ID NO: 842781 - protein, 9 aa, Homo Sapiens
LMGAIFGCL

SEQ ID NO: 842782 - protein, 9 aa, Homo Sapiens
EDSELESSI

SEQ ID NO: 842783 - protein, 9 aa, Homo Sapiens
YGNEEMGGI

SEQ ID NO: 842784 - protein, 9 aa, Homo Sapiens
LIQINLHDN

SEQ ID NO: 842785 - protein, 9 aa, Homo Sapiens
SDINEFDPE

SEQ ID NO: 842786 - protein, 9 aa, Homo Sapiens
NFSILEILF

SEQ ID NO: 842787 - protein, 9 aa, Homo Sapiens
NEGSLNILG

SEQ ID NO: 842788 - protein, 9 aa, Homo Sapiens
NANFLTRIA

SEQ ID NO: 842789 - protein, 9 aa, Homo Sapiens
QNGGYIFTL

SEQ ID NO: 842790 - protein, 9 aa, Homo Sapiens
TPAFIQHQI

SEQ ID NO: 842791 - protein, 9 aa, Homo Sapiens
LKKQFFNRA

SEQ ID NO: 842792 - protein, 9 aa, Homo Sapiens
AKSTHYADL

SEQ ID NO: 842793 - protein, 9 aa, Homo Sapiens
LTVIILTFT

SEQ ID NO: 842794 - protein, 9 aa, Homo Sapiens
LIRKISDSI

SEQ ID NO: 842795 - protein, 9 aa, Homo Sapiens
SEEAHPSNV

SEQ ID NO: 842796 - protein, 9 aa, Homo Sapiens
LFDPTGTIY

SEQ ID NO: 842797 - protein, 9 aa, Homo Sapiens
FVKKSKQKM

SEQ ID NO: 842798 - protein, 9 aa, Homo Sapiens
QFNKLKIKA

SEQ ID NO: 842799 - protein, 9 aa, Homo Sapiens
VHRELLRRT

SEQ ID NO: 842800 - protein, 9 aa, Homo Sapiens
KFDMIKDQC

SEQ ID NO: 842801 - protein, 9 aa, Homo Sapiens
EVWMDEFKY

SEQ ID NO: 842802 - protein, 9 aa, Homo Sapiens
DDKLIGNCL

SEQ ID NO: 842803 - protein, 9 aa, Homo Sapiens
KRPKSNQYP

SEQ ID NO: 842804 - protein, 9 aa, Homo Sapiens
LSHLEARRI

SEQ ID NO: 842805 - protein, 9 aa, Homo Sapiens
VLDWRIQKG

SEQ ID NO: 842806 - protein, 9 aa, Homo Sapiens
PRKLVAHKP

SEQ ID NO: 842807 - protein, 9 aa, Homo Sapiens
KLEQIIRTC

SEQ ID NO: 842808 - protein, 9 aa, Homo Sapiens
ILNKRLTVS

SEQ ID NO: 842809 - protein, 9 aa, Homo Sapiens
HPIPTQSST

SEQ ID NO: 842810 - protein, 9 aa, Homo Sapiens
LYHEVHRPS

SEQ ID NO: 842811 - protein, 9 aa, Homo Sapiens
VAIPKSFNL

SEQ ID NO: 842812 - protein, 9 aa, Homo Sapiens
SSNFGKTWG

SEQ ID NO: 842813 - protein, 9 aa, Homo Sapiens
RPLMPFHHR

SEQ ID NO: 842814 - protein, 9 aa, Homo Sapiens
MVTTVGGLP

SEQ ID NO: 842815 - protein, 9 aa, Homo Sapiens
TKPTKSEFT

SEQ ID NO: 842816 - protein, 9 aa, Homo Sapiens
SFQTEKLVE

SEQ ID NO: 842817 - protein, 9 aa, Homo Sapiens
ILNLHFLGK

SEQ ID NO: 842818 - protein, 9 aa, Homo Sapiens
EKFPLNTIQ

SEQ ID NO: 842819 - protein, 9 aa, Homo Sapiens
SERDTHKLW

SEQ ID NO: 842820 - protein, 9 aa, Homo Sapiens
IMKEWKNNP

SEQ ID NO: 842821 - protein, 9 aa, Homo Sapiens
KQDEQRNST

SEQ ID NO: 842822 - protein, 9 aa, Homo Sapiens
NSSPNSLDP

SEQ ID NO: 842823 - protein, 9 aa, Homo Sapiens
IGIIYILFA

SEQ ID NO: 842824 - protein, 9 aa, Homo Sapiens
GLRYYKAAN

SEQ ID NO: 842825 - protein, 9 aa, Homo Sapiens
PPAPEPSSS

SEQ ID NO: 842826 - protein, 9 aa, Homo Sapiens
NLREVNITI

SEQ ID NO: 842827 - protein, 9 aa, Homo Sapiens
SYTAEVVGP

SEQ ID NO: 842828 - protein, 9 aa, Homo Sapiens
IIGSQWILT

SEQ ID NO: 842829 - protein, 9 aa, Homo Sapiens
FMSASQNLE

SEQ ID NO: 842830 - protein, 9 aa, Homo Sapiens
ISSNRSNHY

SEQ ID NO: 842831 - protein, 9 aa, Homo Sapiens
NMNCINANF

SEQ ID NO: 842832 - protein, 9 aa, Homo Sapiens
SLHFLAQGT

SEQ ID NO: 842833 - protein, 9 aa, Homo Sapiens
YYGNQCNDP

SEQ ID NO: 842834 - protein, 9 aa, Homo Sapiens
ISGDKVEIG

SEQ ID NO: 842835 - protein, 9 aa, Homo Sapiens
LTCHILLHL

SEQ ID NO: 842836 - protein, 9 aa, Homo Sapiens
RFLKQVIEI

SEQ ID NO: 842837 - protein, 9 aa, Homo Sapiens
LHDGIQRVF

SEQ ID NO: 842838 - protein, 9 aa, Homo Sapiens
ESVVQWCDC

SEQ ID NO: 842839 - protein, 9 aa, Homo Sapiens
IKGDYVLGG

SEQ ID NO: 842840 - protein, 9 aa, Homo Sapiens
QDKASEKVY

SEQ ID NO: 842841 - protein, 9 aa, Homo Sapiens
FCLFVNSEC

SEQ ID NO: 842842 - protein, 9 aa, Homo Sapiens
ARCWDTAET

SEQ ID NO: 842843 - protein, 9 aa, Homo Sapiens
VYYYHIIIP

SEQ ID NO: 842844 - protein, 9 aa, Homo Sapiens
ELAEAELVG

SEQ ID NO: 842845 - protein, 9 aa, Homo Sapiens
VTEEVISVE

SEQ ID NO: 842846 - protein, 9 aa, Homo Sapiens
GVNPSDHVI

SEQ ID NO: 842847 - protein, 9 aa, Homo Sapiens
FYRINRAQE

SEQ ID NO: 842848 - protein, 9 aa, Homo Sapiens
ISLAAQTFI

SEQ ID NO: 842849 - protein, 9 aa, Homo Sapiens
LQWTQREPN

SEQ ID NO: 842850 - protein, 9 aa, Homo Sapiens
GSRGQEIEA

SEQ ID NO: 842851 - protein, 9 aa, Homo Sapiens
VLFNVIKAY

SEQ ID NO: 842852 - protein, 9 aa, Homo Sapiens
GRVPCVMFV

SEQ ID NO: 842853 - protein, 9 aa, Homo Sapiens
THTHTVTHV

SEQ ID NO: 842854 - protein, 9 aa, Homo Sapiens
DLNKPLKLD

SEQ ID NO: 842855 - protein, 9 aa, Homo Sapiens
EYPTSKDPQ

SEQ ID NO: 842856 - protein, 9 aa, Homo Sapiens
PLSYSQLDA

SEQ ID NO: 842857 - protein, 9 aa, Homo Sapiens
QVCRLCGNY

SEQ ID NO: 842858 - protein, 9 aa, Homo Sapiens
IEDTACLEA

SEQ ID NO: 842859 - protein, 9 aa, Homo Sapiens
TSKETDVIN

SEQ ID NO: 842860 - protein, 9 aa, Homo Sapiens
IYFPPRRWL

SEQ ID NO: 842861 - protein, 9 aa, Homo Sapiens
EMYMTWMKN

SEQ ID NO: 842862 - protein, 9 aa, Homo Sapiens
RRPASYWAQ

SEQ ID NO: 842863 - protein, 9 aa, Homo Sapiens
DELVELHWR

SEQ ID NO: 842864 - protein, 9 aa, Homo Sapiens
CCDQYPKGR

SEQ ID NO: 842865 - protein, 9 aa, Homo Sapiens
ISHKIVHLG

SEQ ID NO: 842866 - protein, 9 aa, Homo Sapiens
QHSETYCMF

SEQ ID NO: 842867 - protein, 9 aa, Homo Sapiens
GVGKLDLDK

SEQ ID NO: 842868 - protein, 9 aa, Homo Sapiens
NQPAGAGSS

SEQ ID NO: 842869 - protein, 9 aa, Homo Sapiens
ELQNTVASL

SEQ ID NO: 842870 - protein, 9 aa, Homo Sapiens
VDRIKKDED

SEQ ID NO: 842871 - protein, 9 aa, Homo Sapiens
DQREALSNG

SEQ ID NO: 842872 - protein, 9 aa, Homo Sapiens
GYTQPSAII

SEQ ID NO: 842873 - protein, 9 aa, Homo Sapiens
LMVLTHIIA

SEQ ID NO: 842874 - protein, 9 aa, Homo Sapiens
KTSAINQLE

SEQ ID NO: 842875 - protein, 9 aa, Homo Sapiens
SPPALIVSE

SEQ ID NO: 842876 - protein, 9 aa, Homo Sapiens
PQCPVGLIT

SEQ ID NO: 842877 - protein, 9 aa, Homo Sapiens
LRERGRLQT

SEQ ID NO: 842878 - protein, 9 aa, Homo Sapiens
RDYQTNIGL

SEQ ID NO: 842879 - protein, 9 aa, Homo Sapiens
GNRSKQHLW

SEQ ID NO: 842880 - protein, 9 aa, Homo Sapiens
LCNEAENKR

SEQ ID NO: 842881 - protein, 9 aa, Homo Sapiens
KMLRADANN

SEQ ID NO: 842882 - protein, 9 aa, Homo Sapiens
ILQANSSQV

SEQ ID NO: 842883 - protein, 9 aa, Homo Sapiens
SEDLHDYVN

SEQ ID NO: 842884 - protein, 9 aa, Homo Sapiens
TTKLYQYLL

SEQ ID NO: 842885 - protein, 9 aa, Homo Sapiens
LENEKYEQF

SEQ ID NO: 842886 - protein, 9 aa, Homo Sapiens
APAWHLLFD

SEQ ID NO: 842887 - protein, 9 aa, Homo Sapiens
MISKLLSYF

SEQ ID NO: 842888 - protein, 9 aa, Homo Sapiens
VQGVRELPP

SEQ ID NO: 842889 - protein, 9 aa, Homo Sapiens
SVLNPTSWE

SEQ ID NO: 842890 - protein, 9 aa, Homo Sapiens
KKINRLGKK

SEQ ID NO: 842891 - protein, 9 aa, Homo Sapiens
ELGEQVVSV

SEQ ID NO: 842892 - protein, 9 aa, Homo Sapiens
IQEQQNVLK

SEQ ID NO: 842893 - protein, 9 aa, Homo Sapiens
LKDKKSAAE

SEQ ID NO: 842894 - protein, 9 aa, Homo Sapiens
KGYNCNVRL

SEQ ID NO: 842895 - protein, 9 aa, Homo Sapiens
LPSNKKYPD

SEQ ID NO: 842896 - protein, 9 aa, Homo Sapiens
KLFQYASTN

SEQ ID NO: 842897 - protein, 9 aa, Homo Sapiens
NGVIIAGYG

SEQ ID NO: 842898 - protein, 9 aa, Homo Sapiens
TEEDSNPNG

SEQ ID NO: 842899 - protein, 9 aa, Homo Sapiens
DTSENAGGQ

SEQ ID NO: 842900 - protein, 9 aa, Homo Sapiens
AKALIYRIW

SEQ ID NO: 842901 - protein, 9 aa, Homo Sapiens
TPITKMEIS

SEQ ID NO: 842902 - protein, 9 aa, Homo Sapiens
FKREYGFIY

SEQ ID NO: 842903 - protein, 9 aa, Homo Sapiens
MEKELKTTR

SEQ ID NO: 842904 - protein, 9 aa, Homo Sapiens
TSNTSGEIC

SEQ ID NO: 842905 - protein, 9 aa, Homo Sapiens
TKLAEVKRG

SEQ ID NO: 842906 - protein, 9 aa, Homo Sapiens
PTDHLGIEL

SEQ ID NO: 842907 - protein, 9 aa, Homo Sapiens
QIQEQQNVL

SEQ ID NO: 842908 - protein, 9 aa, Homo Sapiens
LSVGVWGQY

SEQ ID NO: 842909 - protein, 9 aa, Homo Sapiens
KKSITNTVQ

SEQ ID NO: 842910 - protein, 9 aa, Homo Sapiens
KLEQERPRQ

SEQ ID NO: 842911 - protein, 9 aa, Homo Sapiens
SNSLNRDVS

SEQ ID NO: 842912 - protein, 9 aa, Homo Sapiens
MTSDRTYQR

SEQ ID NO: 842913 - protein, 9 aa, Homo Sapiens
GAANQETSN

SEQ ID NO: 842914 - protein, 9 aa, Homo Sapiens
PTWKPWRTL

SEQ ID NO: 842915 - protein, 9 aa, Homo Sapiens
ERPRQQKEE

SEQ ID NO: 842916 - protein, 9 aa, Homo Sapiens
LASIFHLAM

SEQ ID NO: 842917 - protein, 9 aa, Homo Sapiens
MKVKKSAVV

SEQ ID NO: 842918 - protein, 9 aa, Homo Sapiens
REKPGLREL

SEQ ID NO: 842919 - protein, 9 aa, Homo Sapiens
KHQHDFQKV

SEQ ID NO: 842920 - protein, 9 aa, Homo Sapiens
RYAFVVPAS

SEQ ID NO: 842921 - protein, 9 aa, Homo Sapiens
GKRCDTPAN

SEQ ID NO: 842922 - protein, 9 aa, Homo Sapiens
EGGKTEQVQ

SEQ ID NO: 842923 - protein, 9 aa, Homo Sapiens
ISAMPKHLN

SEQ ID NO: 842924 - protein, 9 aa, Homo Sapiens
PRLTISELD

SEQ ID NO: 842925 - protein, 9 aa, Homo Sapiens
IREENMDNF

SEQ ID NO: 842926 - protein, 9 aa, Homo Sapiens
FGHPDRARR

SEQ ID NO: 842927 - protein, 9 aa, Homo Sapiens
VMRRVAGDK

SEQ ID NO: 842928 - protein, 9 aa, Homo Sapiens
AGYNVVLLY

SEQ ID NO: 842929 - protein, 9 aa, Homo Sapiens
TSNTEVMLL

SEQ ID NO: 842930 - protein, 9 aa, Homo Sapiens
KKIKYFEVV

SEQ ID NO: 842931 - protein, 9 aa, Homo Sapiens
KPLKKLCFD

SEQ ID NO: 842932 - protein, 9 aa, Homo Sapiens
YFPAEIFLQ

SEQ ID NO: 842933 - protein, 9 aa, Homo Sapiens
YLTHWPEYF

SEQ ID NO: 842934 - protein, 9 aa, Homo Sapiens
KAPVYDWPP

SEQ ID NO: 842935 - protein, 9 aa, Homo Sapiens
SSGQTKVLS

SEQ ID NO: 842936 - protein, 9 aa, Homo Sapiens
VPSPRPDNY

SEQ ID NO: 842937 - protein, 9 aa, Homo Sapiens
LDILFPPSY

SEQ ID NO: 842938 - protein, 9 aa, Homo Sapiens
HQPGGKVWE

SEQ ID NO: 842939 - protein, 9 aa, Homo Sapiens
SNVCALANH

SEQ ID NO: 842940 - protein, 9 aa, Homo Sapiens
DASLSNNST

SEQ ID NO: 842941 - protein, 9 aa, Homo Sapiens
ITLKLCMNL

SEQ ID NO: 842942 - protein, 9 aa, Homo Sapiens
EYWMRLHFP

SEQ ID NO: 842943 - protein, 9 aa, Homo Sapiens
HIPMYLLIG

SEQ ID NO: 842944 - protein, 9 aa, Homo Sapiens
LRQSSDLQH

SEQ ID NO: 842945 - protein, 9 aa, Homo Sapiens
KMDTVLRSF

SEQ ID NO: 842946 - protein, 9 aa, Homo Sapiens
WIQEKHNHQ

SEQ ID NO: 842947 - protein, 9 aa, Homo Sapiens
TNYSHTDAH

SEQ ID NO: 842948 - protein, 9 aa, Homo Sapiens
EATIAAMED

SEQ ID NO: 842949 - protein, 9 aa, Homo Sapiens
RKAMTKFER

SEQ ID NO: 842950 - protein, 9 aa, Homo Sapiens
LAELMVHGY

SEQ ID NO: 842951 - protein, 9 aa, Homo Sapiens
PPRSESSSE

SEQ ID NO: 842952 - protein, 9 aa, Homo Sapiens
TENKSHECK

SEQ ID NO: 842953 - protein, 9 aa, Homo Sapiens
SLIALTQKN

SEQ ID NO: 842954 - protein, 9 aa, Homo Sapiens
TSIPQKSRL

SEQ ID NO: 842955 - protein, 9 aa, Homo Sapiens
KADALGVWR

SEQ ID NO: 842956 - protein, 9 aa, Homo Sapiens
HITKAIKLK

SEQ ID NO: 842957 - protein, 9 aa, Homo Sapiens
VTFDNVAVD

SEQ ID NO: 842958 - protein, 9 aa, Homo Sapiens
ISVTMMALS

SEQ ID NO: 842959 - protein, 9 aa, Homo Sapiens
PLCYVKFQN

SEQ ID NO: 842960 - protein, 9 aa, Homo Sapiens
QLLTTTAEH

SEQ ID NO: 842961 - protein, 9 aa, Homo Sapiens
SGGAQINRI

SEQ ID NO: 842962 - protein, 9 aa, Homo Sapiens
LQEHPQVVY

SEQ ID NO: 842963 - protein, 9 aa, Homo Sapiens
THASLYFAE

SEQ ID NO: 842964 - protein, 9 aa, Homo Sapiens
DAKSWTQRS

SEQ ID NO: 842965 - protein, 9 aa, Homo Sapiens
AVSCVPIST

SEQ ID NO: 842966 - protein, 9 aa, Homo Sapiens
HQNSRTNIK

SEQ ID NO: 842967 - protein, 9 aa, Homo Sapiens
HVRVNNVNE

SEQ ID NO: 842968 - protein, 9 aa, Homo Sapiens
LITALAALT

SEQ ID NO: 842969 - protein, 9 aa, Homo Sapiens
FSNGKTFEN

SEQ ID NO: 842970 - protein, 9 aa, Homo Sapiens
VSKRMLVGG

SEQ ID NO: 842971 - protein, 9 aa, Homo Sapiens
RVLFPGIEG

SEQ ID NO: 842972 - protein, 9 aa, Homo Sapiens
NNMWAAFPP

SEQ ID NO: 842973 - protein, 9 aa, Homo Sapiens
LWYRQDLGH

SEQ ID NO: 842974 - protein, 9 aa, Homo Sapiens
ITQQLNDLD

SEQ ID NO: 842975 - protein, 9 aa, Homo Sapiens
EVWKVNCYG

SEQ ID NO: 842976 - protein, 9 aa, Homo Sapiens
LLNAEDENR

SEQ ID NO: 842977 - protein, 9 aa, Homo Sapiens
PTLSTTNMK

SEQ ID NO: 842978 - protein, 9 aa, Homo Sapiens
KMNKEAVWF

SEQ ID NO: 842979 - protein, 9 aa, Homo Sapiens
SYPGRAVPI

SEQ ID NO: 842980 - protein, 9 aa, Homo Sapiens
RTPSAPNLA

SEQ ID NO: 842981 - protein, 9 aa, Homo Sapiens
TCIQFYMKL

SEQ ID NO: 842982 - protein, 9 aa, Homo Sapiens
SSSMVLRYR

SEQ ID NO: 842983 - protein, 9 aa, Homo Sapiens
GGHYLNVPL

SEQ ID NO: 842984 - protein, 9 aa, Homo Sapiens
LQALLGINL

SEQ ID NO: 842985 - protein, 9 aa, Homo Sapiens
KEVTELLMG

SEQ ID NO: 842986 - protein, 9 aa, Homo Sapiens
VMFRKDSVI

SEQ ID NO: 842987 - protein, 9 aa, Homo Sapiens
HQLSHLQQH

SEQ ID NO: 842988 - protein, 9 aa, Homo Sapiens
WGFLGVYQN

SEQ ID NO: 842989 - protein, 9 aa, Homo Sapiens
DPAAQITTQ

SEQ ID NO: 842990 - protein, 9 aa, Homo Sapiens
KVKHEIINE

SEQ ID NO: 842991 - protein, 9 aa, Homo Sapiens
PTTTKQTTS

SEQ ID NO: 842992 - protein, 9 aa, Homo Sapiens
RLIQQMESG

SEQ ID NO: 842993 - protein, 9 aa, Homo Sapiens
LKNEQSLPH

SEQ ID NO: 842994 - protein, 9 aa, Homo Sapiens
QKRGEARAL

SEQ ID NO: 842995 - protein, 9 aa, Homo Sapiens
AHQNTPLQS

SEQ ID NO: 842996 - protein, 9 aa, Homo Sapiens
VYLSSDTTR

SEQ ID NO: 842997 - protein, 9 aa, Homo Sapiens
CTACKKFNS

SEQ ID NO: 842998 - protein, 9 aa, Homo Sapiens
NDLYDGSYD

SEQ ID NO: 842999 - protein, 9 aa, Homo Sapiens
NVNVLTFIG

SEQ ID NO: 843000 - protein, 9 aa, Homo Sapiens
KLIGNCLPT

SEQ ID NO: 843001 - protein, 9 aa, Homo Sapiens
DMPVDPNKP

SEQ ID NO: 843002 - protein, 9 aa, Homo Sapiens
ADKEVFSYF

SEQ ID NO: 843003 - protein, 9 aa, Homo Sapiens
DYDKNKLVK

SEQ ID NO: 843004 - protein, 9 aa, Homo Sapiens
ETMKMRYKH

SEQ ID NO: 843005 - protein, 9 aa, Homo Sapiens
NNRTIQASE

SEQ ID NO: 843006 - protein, 9 aa, Homo Sapiens
LCLCVCTCV

SEQ ID NO: 843007 - protein, 9 aa, Homo Sapiens
LPCSFNVSQ

SEQ ID NO: 843008 - protein, 9 aa, Homo Sapiens
LGDKSLPHK

SEQ ID NO: 843009 - protein, 9 aa, Homo Sapiens
HFMQNVACS

SEQ ID NO: 843010 - protein, 9 aa, Homo Sapiens
VPYDGIPCV

SEQ ID NO: 843011 - protein, 9 aa, Homo Sapiens
IFSAIENDP

SEQ ID NO: 843012 - protein, 9 aa, Homo Sapiens
YIFLFIGIS

SEQ ID NO: 843013 - protein, 9 aa, Homo Sapiens
LDKGICELV

SEQ ID NO: 843014 - protein, 9 aa, Homo Sapiens
INQIFHEVP

SEQ ID NO: 843015 - protein, 9 aa, Homo Sapiens
KDSRYQHLF

SEQ ID NO: 843016 - protein, 9 aa, Homo Sapiens
KGLISRMYK

SEQ ID NO: 843017 - protein, 9 aa, Homo Sapiens
VAKEKYIVY

SEQ ID NO: 843018 - protein, 9 aa, Homo Sapiens
QEVTVNQSI

SEQ ID NO: 843019 - protein, 9 aa, Homo Sapiens
SKKVECREK

SEQ ID NO: 843020 - protein, 9 aa, Homo Sapiens
CCGGVLIDH

SEQ ID NO: 843021 - protein, 9 aa, Homo Sapiens
VTKREHSKV

SEQ ID NO: 843022 - protein, 9 aa, Homo Sapiens
CLTQMYLFL

SEQ ID NO: 843023 - protein, 9 aa, Homo Sapiens
IHQQGQGDD

SEQ ID NO: 843024 - protein, 9 aa, Homo Sapiens
PSSTSTDVE

SEQ ID NO: 843025 - protein, 9 aa, Homo Sapiens
LSLLKTMHR

SEQ ID NO: 843026 - protein, 9 aa, Homo Sapiens
LFLRNFSFL

SEQ ID NO: 843027 - protein, 9 aa, Homo Sapiens
IGCIAFSTN

SEQ ID NO: 843028 - protein, 9 aa, Homo Sapiens
AILIKTPLA

SEQ ID NO: 843029 - protein, 9 aa, Homo Sapiens
TSGPEDQGI

SEQ ID NO: 843030 - protein, 9 aa, Homo Sapiens
VHAELDKIT

SEQ ID NO: 843031 - protein, 9 aa, Homo Sapiens
ELSGGAQIN

SEQ ID NO: 843032 - protein, 9 aa, Homo Sapiens
LKLENIQSI

SEQ ID NO: 843033 - protein, 9 aa, Homo Sapiens
AEEYEGRDV

SEQ ID NO: 843034 - protein, 9 aa, Homo Sapiens
PIMFENHMY

SEQ ID NO: 843035 - protein, 9 aa, Homo Sapiens
RDDGVNGEV

SEQ ID NO: 843036 - protein, 9 aa, Homo Sapiens
PSNKKYPDY

SEQ ID NO: 843037 - protein, 9 aa, Homo Sapiens
TKDDIGNLN

SEQ ID NO: 843038 - protein, 9 aa, Homo Sapiens
LTKLAEVKR

SEQ ID NO: 843039 - protein, 9 aa, Homo Sapiens
RLGSHTMDC

SEQ ID NO: 843040 - protein, 9 aa, Homo Sapiens
QEDMEVLKR

SEQ ID NO: 843041 - protein, 9 aa, Homo Sapiens
EAFAAGERT

SEQ ID NO: 843042 - protein, 9 aa, Homo Sapiens
PEEKDLLKT

SEQ ID NO: 843043 - protein, 9 aa, Homo Sapiens
LVKEACKLY

SEQ ID NO: 843044 - protein, 9 aa, Homo Sapiens
KKQQHKLQE

SEQ ID NO: 843045 - protein, 9 aa, Homo Sapiens
RQIHTLQDW

SEQ ID NO: 843046 - protein, 9 aa, Homo Sapiens
SKEEEEEEI

SEQ ID NO: 843047 - protein, 9 aa, Homo Sapiens
ASHSEKTKP

SEQ ID NO: 843048 - protein, 9 aa, Homo Sapiens
FENVMATKY

SEQ ID NO: 843049 - protein, 9 aa, Homo Sapiens
LDLIQDLRW

SEQ ID NO: 843050 - protein, 9 aa, Homo Sapiens
RAHFQRRAL

SEQ ID NO: 843051 - protein, 9 aa, Homo Sapiens
LYLTAETVK

SEQ ID NO: 843052 - protein, 9 aa, Homo Sapiens
APQLSGYQQ

SEQ ID NO: 843053 - protein, 9 aa, Homo Sapiens
RQFFLFNYI

SEQ ID NO: 843054 - protein, 9 aa, Homo Sapiens
HPVERGAFI

SEQ ID NO: 843055 - protein, 9 aa, Homo Sapiens
CIKLIEKPM

SEQ ID NO: 843056 - protein, 9 aa, Homo Sapiens
VASSQFLPK

SEQ ID NO: 843057 - protein, 9 aa, Homo Sapiens
VLQVHDNNI

SEQ ID NO: 843058 - protein, 9 aa, Homo Sapiens
FNMRVFSQR

SEQ ID NO: 843059 - protein, 9 aa, Homo Sapiens
LNMSRSMTF

SEQ ID NO: 843060 - protein, 9 aa, Homo Sapiens
NQGQEDEMD

SEQ ID NO: 843061 - protein, 9 aa, Homo Sapiens
KMTYTPETL

SEQ ID NO: 843062 - protein, 9 aa, Homo Sapiens
KGSRKESYS

SEQ ID NO: 843063 - protein, 9 aa, Homo Sapiens
GSLTPGLPA

SEQ ID NO: 843064 - protein, 9 aa, Homo Sapiens
QDGELHDFR

SEQ ID NO: 843065 - protein, 9 aa, Homo Sapiens
AVLRCFIKR

SEQ ID NO: 843066 - protein, 9 aa, Homo Sapiens
YLKKQPLQD

SEQ ID NO: 843067 - protein, 9 aa, Homo Sapiens
KGMAAYLDL

SEQ ID NO: 843068 - protein, 9 aa, Homo Sapiens
ASKIYFRNP

SEQ ID NO: 843069 - protein, 9 aa, Homo Sapiens
HTSVIRNRM

SEQ ID NO: 843070 - protein, 9 aa, Homo Sapiens
IITGPAPVI

SEQ ID NO: 843071 - protein, 9 aa, Homo Sapiens
QNTKSSIIE

SEQ ID NO: 843072 - protein, 9 aa, Homo Sapiens
TSLQEVIDV

SEQ ID NO: 843073 - protein, 9 aa, Homo Sapiens
THVPDFILT

SEQ ID NO: 843074 - protein, 9 aa, Homo Sapiens
ALEHMHSQR

SEQ ID NO: 843075 - protein, 9 aa, Homo Sapiens
DPPFNTQRA

SEQ ID NO: 843076 - protein, 9 aa, Homo Sapiens
AEEEKLWKE

SEQ ID NO: 843077 - protein, 9 aa, Homo Sapiens
GLPINDLSR

SEQ ID NO: 843078 - protein, 9 aa, Homo Sapiens
HHPKTYPNC

SEQ ID NO: 843079 - protein, 9 aa, Homo Sapiens
LPGPRGSRG

SEQ ID NO: 843080 - protein, 9 aa, Homo Sapiens
QNLFTGVDR

SEQ ID NO: 843081 - protein, 9 aa, Homo Sapiens
DLEEFKGNS

SEQ ID NO: 843082 - protein, 9 aa, Homo Sapiens
TNLADRGLV

SEQ ID NO: 843083 - protein, 9 aa, Homo Sapiens
HRPPALARI

SEQ ID NO: 843084 - protein, 9 aa, Homo Sapiens
IMELTMNKN

SEQ ID NO: 843085 - protein, 9 aa, Homo Sapiens
LVRVDIISW

SEQ ID NO: 843086 - protein, 9 aa, Homo Sapiens
LYAQTSAGS

SEQ ID NO: 843087 - protein, 9 aa, Homo Sapiens
LVGSPLAAM

SEQ ID NO: 843088 - protein, 9 aa, Homo Sapiens
LYLTRKVKM

SEQ ID NO: 843089 - protein, 9 aa, Homo Sapiens
GIHQYPGVC

SEQ ID NO: 843090 - protein, 9 aa, Homo Sapiens
LAFSLHSLL

SEQ ID NO: 843091 - protein, 9 aa, Homo Sapiens
CWLEKLSSN

SEQ ID NO: 843092 - protein, 9 aa, Homo Sapiens
HKPCASIWL

SEQ ID NO: 843093 - protein, 9 aa, Homo Sapiens
SSRLPEHEM

SEQ ID NO: 843094 - protein, 9 aa, Homo Sapiens
RIHMRDKSY

SEQ ID NO: 843095 - protein, 9 aa, Homo Sapiens
SFNWHQSAM

SEQ ID NO: 843096 - protein, 9 aa, Homo Sapiens
IFKLDYNYL

SEQ ID NO: 843097 - protein, 9 aa, Homo Sapiens
PPGFSDSSQ

SEQ ID NO: 843098 - protein, 9 aa, Homo Sapiens
SSDTRCCKL

SEQ ID NO: 843099 - protein, 9 aa, Homo Sapiens
GSSSEASFI

SEQ ID NO: 843100 - protein, 9 aa, Homo Sapiens
QKGKCSRHK

SEQ ID NO: 843101 - protein, 9 aa, Homo Sapiens
KCKQFLIQL

SEQ ID NO: 843102 - protein, 9 aa, Homo Sapiens
AQSIIFICA

SEQ ID NO: 843103 - protein, 9 aa, Homo Sapiens
INKIAAAKC

SEQ ID NO: 843104 - protein, 9 aa, Homo Sapiens
VFIKKVAKT

SEQ ID NO: 843105 - protein, 9 aa, Homo Sapiens
QVTSHDTST

SEQ ID NO: 843106 - protein, 9 aa, Homo Sapiens
NLENSCLAK

SEQ ID NO: 843107 - protein, 9 aa, Homo Sapiens
PPTSSCCAP

SEQ ID NO: 843108 - protein, 9 aa, Homo Sapiens
RNPAKAFKR

SEQ ID NO: 843109 - protein, 9 aa, Homo Sapiens
GIIHTGEKP

SEQ ID NO: 843110 - protein, 9 aa, Homo Sapiens
VNLCIFLFF

SEQ ID NO: 843111 - protein, 9 aa, Homo Sapiens
HLSQETQQY

SEQ ID NO: 843112 - protein, 9 aa, Homo Sapiens
KTVDTIKRP

SEQ ID NO: 843113 - protein, 9 aa, Homo Sapiens
LAYQGLGST

SEQ ID NO: 843114 - protein, 9 aa, Homo Sapiens
VQRIILEPY

SEQ ID NO: 843115 - protein, 9 aa, Homo Sapiens
DLDAQAKNE

SEQ ID NO: 843116 - protein, 9 aa, Homo Sapiens
RPKFANTSM

SEQ ID NO: 843117 - protein, 9 aa, Homo Sapiens
SEQAQVFVD

SEQ ID NO: 843118 - protein, 9 aa, Homo Sapiens
HSRNTIFTL

SEQ ID NO: 843119 - protein, 9 aa, Homo Sapiens
YGIFYSQWE

SEQ ID NO: 843120 - protein, 9 aa, Homo Sapiens
EEPAENSVD

SEQ ID NO: 843121 - protein, 9 aa, Homo Sapiens
PPVATVPPT

SEQ ID NO: 843122 - protein, 9 aa, Homo Sapiens
ASDTKKNKI

SEQ ID NO: 843123 - protein, 9 aa, Homo Sapiens
NGLRYYKAA

SEQ ID NO: 843124 - protein, 9 aa, Homo Sapiens
PENYLLKND

SEQ ID NO: 843125 - protein, 9 aa, Homo Sapiens
YSFVQYSNQ

SEQ ID NO: 843126 - protein, 9 aa, Homo Sapiens
DEKAKVPTG

SEQ ID NO: 843127 - protein, 9 aa, Homo Sapiens
PCCRSTCCQ

SEQ ID NO: 843128 - protein, 9 aa, Homo Sapiens
CDKSGKAFG

SEQ ID NO: 843129 - protein, 9 aa, Homo Sapiens
NKKLICSVC

SEQ ID NO: 843130 - protein, 9 aa, Homo Sapiens
EIIQHVDVI

SEQ ID NO: 843131 - protein, 9 aa, Homo Sapiens
RSYLFDNPR

SEQ ID NO: 843132 - protein, 9 aa, Homo Sapiens
RSKSQYSGQ

SEQ ID NO: 843133 - protein, 9 aa, Homo Sapiens
PPPETFDFN

SEQ ID NO: 843134 - protein, 9 aa, Homo Sapiens
FVSSLPLKM

SEQ ID NO: 843135 - protein, 9 aa, Homo Sapiens
PRDITQERM

SEQ ID NO: 843136 - protein, 9 aa, Homo Sapiens
QGVSPQPLQ

SEQ ID NO: 843137 - protein, 9 aa, Homo Sapiens
MPLSHSITQ

SEQ ID NO: 843138 - protein, 9 aa, Homo Sapiens
TWTRPTSHT

SEQ ID NO: 843139 - protein, 9 aa, Homo Sapiens
AKDNFKNAL

SEQ ID NO: 843140 - protein, 9 aa, Homo Sapiens
NVVDVLAIL

SEQ ID NO: 843141 - protein, 9 aa, Homo Sapiens
SSDSFNFNS

SEQ ID NO: 843142 - protein, 9 aa, Homo Sapiens
QRRKQKQTN

SEQ ID NO: 843143 - protein, 9 aa, Homo Sapiens
LWKLAGRAQ

SEQ ID NO: 843144 - protein, 9 aa, Homo Sapiens
TYMKGQWPE

SEQ ID NO: 843145 - protein, 9 aa, Homo Sapiens
CLSIHRGVH

SEQ ID NO: 843146 - protein, 9 aa, Homo Sapiens
NTAGHPEPC

SEQ ID NO: 843147 - protein, 9 aa, Homo Sapiens
FSYCLAQQQ

SEQ ID NO: 843148 - protein, 9 aa, Homo Sapiens
QDVSRPVAT

SEQ ID NO: 843149 - protein, 9 aa, Homo Sapiens
VYISPEVLK

SEQ ID NO: 843150 - protein, 9 aa, Homo Sapiens
AVPFASVAN

SEQ ID NO: 843151 - protein, 9 aa, Homo Sapiens
ASLKNTLKS

SEQ ID NO: 843152 - protein, 9 aa, Homo Sapiens
EPRFVEDLL

SEQ ID NO: 843153 - protein, 9 aa, Homo Sapiens
SPYLYTLWN

SEQ ID NO: 843154 - protein, 9 aa, Homo Sapiens
FDGDYISKR

SEQ ID NO: 843155 - protein, 9 aa, Homo Sapiens
APTPGARSP

SEQ ID NO: 843156 - protein, 9 aa, Homo Sapiens
GRPLNIVCK

SEQ ID NO: 843157 - protein, 9 aa, Homo Sapiens
EDCKDIEHL

SEQ ID NO: 843158 - protein, 9 aa, Homo Sapiens
TKDKKWNYC

SEQ ID NO: 843159 - protein, 9 aa, Homo Sapiens
LPQDLTFNL

SEQ ID NO: 843160 - protein, 9 aa, Homo Sapiens
SKILQKDIW

SEQ ID NO: 843161 - protein, 9 aa, Homo Sapiens
QWLGQQGGW

SEQ ID NO: 843162 - protein, 9 aa, Homo Sapiens
FIKIDQAWK

SEQ ID NO: 843163 - protein, 9 aa, Homo Sapiens
YIIKAWLFS

SEQ ID NO: 843164 - protein, 9 aa, Homo Sapiens
NMGVVLYVM

SEQ ID NO: 843165 - protein, 9 aa, Homo Sapiens
TNISTDRNA

SEQ ID NO: 843166 - protein, 9 aa, Homo Sapiens
FLQPYISIG

SEQ ID NO: 843167 - protein, 9 aa, Homo Sapiens
ELLIDKFCD

SEQ ID NO: 843168 - protein, 9 aa, Homo Sapiens
PTISDNTSQ

SEQ ID NO: 843169 - protein, 9 aa, Homo Sapiens
GTLMTFFLA

SEQ ID NO: 843170 - protein, 9 aa, Homo Sapiens
VILMLNPLV

SEQ ID NO: 843171 - protein, 9 aa, Homo Sapiens
ENYCDPVLD

SEQ ID NO: 843172 - protein, 9 aa, Homo Sapiens
GNLNIHQQT

SEQ ID NO: 843173 - protein, 9 aa, Homo Sapiens
TCELCDGNG

SEQ ID NO: 843174 - protein, 9 aa, Homo Sapiens
FVAQGADRV

SEQ ID NO: 843175 - protein, 9 aa, Homo Sapiens
LNLDAKKYE

SEQ ID NO: 843176 - protein, 9 aa, Homo Sapiens
LRGLPELLP

SEQ ID NO: 843177 - protein, 9 aa, Homo Sapiens
CNVENLQIY

SEQ ID NO: 843178 - protein, 9 aa, Homo Sapiens
KCISQALLT

SEQ ID NO: 843179 - protein, 9 aa, Homo Sapiens
GFKCQCPNL

SEQ ID NO: 843180 - protein, 9 aa, Homo Sapiens
LNLEKGDIG

SEQ ID NO: 843181 - protein, 9 aa, Homo Sapiens
QKRKKRDSE

SEQ ID NO: 843182 - protein, 9 aa, Homo Sapiens
KVTVVASVV

SEQ ID NO: 843183 - protein, 9 aa, Homo Sapiens
HCYIIPKAT

SEQ ID NO: 843184 - protein, 9 aa, Homo Sapiens
FTMAEMKVV

SEQ ID NO: 843185 - protein, 9 aa, Homo Sapiens
DLYSLLSKL

SEQ ID NO: 843186 - protein, 9 aa, Homo Sapiens
HINHNSLDI

SEQ ID NO: 843187 - protein, 9 aa, Homo Sapiens
GDGYVDTDS

SEQ ID NO: 843188 - protein, 9 aa, Homo Sapiens
LNIAYEKIA

SEQ ID NO: 843189 - protein, 9 aa, Homo Sapiens
VCCRSLASV

SEQ ID NO: 843190 - protein, 9 aa, Homo Sapiens
FSYNRLRCI

SEQ ID NO: 843191 - protein, 9 aa, Homo Sapiens
QLKEITAKQ

SEQ ID NO: 843192 - protein, 9 aa, Homo Sapiens
PRVRKQTCH

SEQ ID NO: 843193 - protein, 9 aa, Homo Sapiens
RGHRYLHQE

SEQ ID NO: 843194 - protein, 9 aa, Homo Sapiens
APTDGVLLC

SEQ ID NO: 843195 - protein, 9 aa, Homo Sapiens
IVHSRKKYC

SEQ ID NO: 843196 - protein, 9 aa, Homo Sapiens
LGFQGAWAT

SEQ ID NO: 843197 - protein, 9 aa, Homo Sapiens
HVEDYTSPS

SEQ ID NO: 843198 - protein, 9 aa, Homo Sapiens
YKSQTRCAP

SEQ ID NO: 843199 - protein, 9 aa, Homo Sapiens
GKFFQMKMT

SEQ ID NO: 843200 - protein, 9 aa, Homo Sapiens
FRQIVLAVH

SEQ ID NO: 843201 - protein, 9 aa, Homo Sapiens
CDNCSTQRE

SEQ ID NO: 843202 - protein, 9 aa, Homo Sapiens
ILKKVNDLD

SEQ ID NO: 843203 - protein, 9 aa, Homo Sapiens
LNLHFLGKL

SEQ ID NO: 843204 - protein, 9 aa, Homo Sapiens
EPHEKHRKK

SEQ ID NO: 843205 - protein, 9 aa, Homo Sapiens
PIHLTLKVV

SEQ ID NO: 843206 - protein, 9 aa, Homo Sapiens
QNLAALVSE

SEQ ID NO: 843207 - protein, 9 aa, Homo Sapiens
KVQQARKMV

SEQ ID NO: 843208 - protein, 9 aa, Homo Sapiens
GARKMKERW

SEQ ID NO: 843209 - protein, 9 aa, Homo Sapiens
PRDKYWLQF

SEQ ID NO: 843210 - protein, 9 aa, Homo Sapiens
RVPSLKRRG

SEQ ID NO: 843211 - protein, 9 aa, Homo Sapiens
EDTIISVLA

SEQ ID NO: 843212 - protein, 9 aa, Homo Sapiens
KFPLNTIQH

SEQ ID NO: 843213 - protein, 9 aa, Homo Sapiens
GSGMGNFNS

SEQ ID NO: 843214 - protein, 9 aa, Homo Sapiens
IESEVRWDL

SEQ ID NO: 843215 - protein, 9 aa, Homo Sapiens
YWIMMNIPP

SEQ ID NO: 843216 - protein, 9 aa, Homo Sapiens
RNSLIHNNY

SEQ ID NO: 843217 - protein, 9 aa, Homo Sapiens
TIEKIIDKL

SEQ ID NO: 843218 - protein, 9 aa, Homo Sapiens
RFIIRWCLL

SEQ ID NO: 843219 - protein, 9 aa, Homo Sapiens
LLSELVPFE

SEQ ID NO: 843220 - protein, 9 aa, Homo Sapiens
ENVIDKELE

SEQ ID NO: 843221 - protein, 9 aa, Homo Sapiens
EEDNQKRYY

SEQ ID NO: 843222 - protein, 9 aa, Homo Sapiens
PQITRNKEF

SEQ ID NO: 843223 - protein, 9 aa, Homo Sapiens
VKPMWPKGW

SEQ ID NO: 843224 - protein, 9 aa, Homo Sapiens
TRHSLGLQT

SEQ ID NO: 843225 - protein, 9 aa, Homo Sapiens
VRQLFFYHF

SEQ ID NO: 843226 - protein, 9 aa, Homo Sapiens
LRKKELFNV

SEQ ID NO: 843227 - protein, 9 aa, Homo Sapiens
YIKRKAPFF

SEQ ID NO: 843228 - protein, 9 aa, Homo Sapiens
TSDSELEPM

SEQ ID NO: 843229 - protein, 9 aa, Homo Sapiens
DTPQKTLVL

SEQ ID NO: 843230 - protein, 9 aa, Homo Sapiens
ARPDKSVNK

SEQ ID NO: 843231 - protein, 9 aa, Homo Sapiens
MNCINANFL

SEQ ID NO: 843232 - protein, 9 aa, Homo Sapiens
SKHAFARTV

SEQ ID NO: 843233 - protein, 9 aa, Homo Sapiens
HNLYNNPFN

SEQ ID NO: 843234 - protein, 9 aa, Homo Sapiens
EAQRGLCEP

SEQ ID NO: 843235 - protein, 9 aa, Homo Sapiens
LLSTFKSTR

SEQ ID NO: 843236 - protein, 9 aa, Homo Sapiens
RMRNHIAAS

SEQ ID NO: 843237 - protein, 9 aa, Homo Sapiens
KSYNKYVQG

SEQ ID NO: 843238 - protein, 9 aa, Homo Sapiens
VGPSGSRPD

SEQ ID NO: 843239 - protein, 9 aa, Homo Sapiens
RGTMVTTVG

SEQ ID NO: 843240 - protein, 9 aa, Homo Sapiens
GIQTPPVRR

SEQ ID NO: 843241 - protein, 9 aa, Homo Sapiens
WEVLRMRGT

SEQ ID NO: 843242 - protein, 9 aa, Homo Sapiens
RFSQEEINN

SEQ ID NO: 843243 - protein, 9 aa, Homo Sapiens
FDKWTTKMN

SEQ ID NO: 843244 - protein, 9 aa, Homo Sapiens
LFRKIIPAV

SEQ ID NO: 843245 - protein, 9 aa, Homo Sapiens
IFKVIFGKV

SEQ ID NO: 843246 - protein, 9 aa, Homo Sapiens
LRKEHEKQK

SEQ ID NO: 843247 - protein, 9 aa, Homo Sapiens
FPQIKEGKR

SEQ ID NO: 843248 - protein, 9 aa, Homo Sapiens
TLQLLDAVK

SEQ ID NO: 843249 - protein, 9 aa, Homo Sapiens
NVDYVTLKH

SEQ ID NO: 843250 - protein, 9 aa, Homo Sapiens
YVYFSLLLM

SEQ ID NO: 843251 - protein, 9 aa, Homo Sapiens
FKMCFYRLL

SEQ ID NO: 843252 - protein, 9 aa, Homo Sapiens
ANAVVQELA

SEQ ID NO: 843253 - protein, 9 aa, Homo Sapiens
LKQARLIIK

SEQ ID NO: 843254 - protein, 9 aa, Homo Sapiens
CIRCDAGMC

SEQ ID NO: 843255 - protein, 9 aa, Homo Sapiens
PVVLKDVDS

SEQ ID NO: 843256 - protein, 9 aa, Homo Sapiens
SRQRLQESR

SEQ ID NO: 843257 - protein, 9 aa, Homo Sapiens
KIKAIKLAE

SEQ ID NO: 843258 - protein, 9 aa, Homo Sapiens
LPKTPKMLR

SEQ ID NO: 843259 - protein, 9 aa, Homo Sapiens
EKVKQLCNS

SEQ ID NO: 843260 - protein, 9 aa, Homo Sapiens
GMVNKKGIA

SEQ ID NO: 843261 - protein, 9 aa, Homo Sapiens
IAAMEDRLR

SEQ ID NO: 843262 - protein, 9 aa, Homo Sapiens
FQRESQILK

SEQ ID NO: 843263 - protein, 9 aa, Homo Sapiens
SSDYPSRSP

SEQ ID NO: 843264 - protein, 9 aa, Homo Sapiens
IHKSIDLGY

SEQ ID NO: 843265 - protein, 9 aa, Homo Sapiens
INLATQPKG

SEQ ID NO: 843266 - protein, 9 aa, Homo Sapiens
NNDPNFTEA

SEQ ID NO: 843267 - protein, 9 aa, Homo Sapiens
YSHTDAHEI

SEQ ID NO: 843268 - protein, 9 aa, Homo Sapiens
PDNAPETVV

SEQ ID NO: 843269 - protein, 9 aa, Homo Sapiens
QLIGEPPIN

SEQ ID NO: 843270 - protein, 9 aa, Homo Sapiens
ENCLSAQGD

SEQ ID NO: 843271 - protein, 9 aa, Homo Sapiens
TIIGGIVAF

SEQ ID NO: 843272 - protein, 9 aa, Homo Sapiens
ILVNILLYF

SEQ ID NO: 843273 - protein, 9 aa, Homo Sapiens
ETINGNYNI

SEQ ID NO: 843274 - protein, 9 aa, Homo Sapiens
FVMGSSRVP

SEQ ID NO: 843275 - protein, 9 aa, Homo Sapiens
PVWTAEDQL

SEQ ID NO: 843276 - protein, 9 aa, Homo Sapiens
PRATVSTEQ

SEQ ID NO: 843277 - protein, 9 aa, Homo Sapiens
LQEDKSLNL

SEQ ID NO: 843278 - protein, 9 aa, Homo Sapiens
DKAFINQAF

SEQ ID NO: 843279 - protein, 9 aa, Homo Sapiens
VTALRFTML

SEQ ID NO: 843280 - protein, 9 aa, Homo Sapiens
GFITFMYFK

SEQ ID NO: 843281 - protein, 9 aa, Homo Sapiens
TPPALESSE

SEQ ID NO: 843282 - protein, 9 aa, Homo Sapiens
LQAALQQAN

SEQ ID NO: 843283 - protein, 9 aa, Homo Sapiens
NHENIFLQP

SEQ ID NO: 843284 - protein, 9 aa, Homo Sapiens
NGQEQRMNI

SEQ ID NO: 843285 - protein, 9 aa, Homo Sapiens
ALLVYLIHS

SEQ ID NO: 843286 - protein, 9 aa, Homo Sapiens
MFLIKCRDM

SEQ ID NO: 843287 - protein, 9 aa, Homo Sapiens
STTDRDSGT

SEQ ID NO: 843288 - protein, 9 aa, Homo Sapiens
IKPKQRLSA

SEQ ID NO: 843289 - protein, 9 aa, Homo Sapiens
EYGDTAILF

SEQ ID NO: 843290 - protein, 9 aa, Homo Sapiens
EKNIPITPV

SEQ ID NO: 843291 - protein, 9 aa, Homo Sapiens
KKYYYIAGY

SEQ ID NO: 843292 - protein, 9 aa, Homo Sapiens
GYIASTSYL

SEQ ID NO: 843293 - protein, 9 aa, Homo Sapiens
HINIFVDVN

SEQ ID NO: 843294 - protein, 9 aa, Homo Sapiens
CTAFRATPL

SEQ ID NO: 843295 - protein, 9 aa, Homo Sapiens
EEASKSVSS

SEQ ID NO: 843296 - protein, 9 aa, Homo Sapiens
HPQVVYKSQ

SEQ ID NO: 843297 - protein, 9 aa, Homo Sapiens
CAAVFLQML

SEQ ID NO: 843298 - protein, 9 aa, Homo Sapiens
PRSAMSTTT

SEQ ID NO: 843299 - protein, 9 aa, Homo Sapiens
VFGGFSLFF

SEQ ID NO: 843300 - protein, 9 aa, Homo Sapiens
SARLTRGEA

SEQ ID NO: 843301 - protein, 9 aa, Homo Sapiens
TWLSFYEKN

SEQ ID NO: 843302 - protein, 9 aa, Homo Sapiens
FPPASVEAS

SEQ ID NO: 843303 - protein, 9 aa, Homo Sapiens
EKTPDENKD

SEQ ID NO: 843304 - protein, 9 aa, Homo Sapiens
KRFEQAQHM

SEQ ID NO: 843305 - protein, 9 aa, Homo Sapiens
ESLAVLNGE

SEQ ID NO: 843306 - protein, 9 aa, Homo Sapiens
DYLKTPPEC

SEQ ID NO: 843307 - protein, 9 aa, Homo Sapiens
RAQELRISR

SEQ ID NO: 843308 - protein, 9 aa, Homo Sapiens
EPENNQGVV

SEQ ID NO: 843309 - protein, 9 aa, Homo Sapiens
RCSGNIKTD

SEQ ID NO: 843310 - protein, 9 aa, Homo Sapiens
EARVRDITI

SEQ ID NO: 843311 - protein, 9 aa, Homo Sapiens
IPQITPKQN

SEQ ID NO: 843312 - protein, 9 aa, Homo Sapiens
QVWAYIRHL

SEQ ID NO: 843313 - protein, 9 aa, Homo Sapiens
TPSVFDQQI

SEQ ID NO: 843314 - protein, 9 aa, Homo Sapiens
CYLAPQNLP

SEQ ID NO: 843315 - protein, 9 aa, Homo Sapiens
ELYEMFERN

SEQ ID NO: 843316 - protein, 9 aa, Homo Sapiens
LAGDHLSDT

SEQ ID NO: 843317 - protein, 9 aa, Homo Sapiens
NLSDRQAEL

SEQ ID NO: 843318 - protein, 9 aa, Homo Sapiens
TLNKLSSTP

SEQ ID NO: 843319 - protein, 9 aa, Homo Sapiens
LFKMYPLPE

SEQ ID NO: 843320 - protein, 9 aa, Homo Sapiens
KKIKHSEEA

SEQ ID NO: 843321 - protein, 9 aa, Homo Sapiens
DKLQPQRSG

SEQ ID NO: 843322 - protein, 9 aa, Homo Sapiens
CVEAQDGEL

SEQ ID NO: 843323 - protein, 9 aa, Homo Sapiens
NLKSGDASI

SEQ ID NO: 843324 - protein, 9 aa, Homo Sapiens
YEHNNYKAL

SEQ ID NO: 843325 - protein, 9 aa, Homo Sapiens
ELSLLHNLR

SEQ ID NO: 843326 - protein, 9 aa, Homo Sapiens
RYFPESLDF

SEQ ID NO: 843327 - protein, 9 aa, Homo Sapiens
NNFSSLKDL

SEQ ID NO: 843328 - protein, 9 aa, Homo Sapiens
PQLPPQCLL

SEQ ID NO: 843329 - protein, 9 aa, Homo Sapiens
GIHGNAPVE

SEQ ID NO: 843330 - protein, 9 aa, Homo Sapiens
ALYRLSTED

SEQ ID NO: 843331 - protein, 9 aa, Homo Sapiens
YYYFICPLL

SEQ ID NO: 843332 - protein, 9 aa, Homo Sapiens
RGYYFLRDT

SEQ ID NO: 843333 - protein, 9 aa, Homo Sapiens
RILFMKESS

SEQ ID NO: 843334 - protein, 9 aa, Homo Sapiens
GALAYRNLI

SEQ ID NO: 843335 - protein, 9 aa, Homo Sapiens
SCHRVRQNV

SEQ ID NO: 843336 - protein, 9 aa, Homo Sapiens
DTSRKLPHS

SEQ ID NO: 843337 - protein, 9 aa, Homo Sapiens
QDAVAFEDV

SEQ ID NO: 843338 - protein, 9 aa, Homo Sapiens
KISTMGKAL

SEQ ID NO: 843339 - protein, 9 aa, Homo Sapiens
LQNGMIIPS

SEQ ID NO: 843340 - protein, 9 aa, Homo Sapiens
LLSAATATA

SEQ ID NO: 843341 - protein, 9 aa, Homo Sapiens
GCSLVCGEY

SEQ ID NO: 843342 - protein, 9 aa, Homo Sapiens
IHLQLFKEN

SEQ ID NO: 843343 - protein, 9 aa, Homo Sapiens
AEVHAKSLQ

SEQ ID NO: 843344 - protein, 9 aa, Homo Sapiens
GFKEAVCYV

SEQ ID NO: 843345 - protein, 9 aa, Homo Sapiens
CFKHTNGGT

SEQ ID NO: 843346 - protein, 9 aa, Homo Sapiens
IIMLLGAEA

SEQ ID NO: 843347 - protein, 9 aa, Homo Sapiens
NTLGYFGGV

SEQ ID NO: 843348 - protein, 9 aa, Homo Sapiens
RQESWKNGI

SEQ ID NO: 843349 - protein, 9 aa, Homo Sapiens
KGVLINSKP

SEQ ID NO: 843350 - protein, 9 aa, Homo Sapiens
RQGFCFNIL

SEQ ID NO: 843351 - protein, 9 aa, Homo Sapiens
PASNDPRSK

SEQ ID NO: 843352 - protein, 9 aa, Homo Sapiens
ISIHASPQP

SEQ ID NO: 843353 - protein, 9 aa, Homo Sapiens
KNIQHINII

SEQ ID NO: 843354 - protein, 9 aa, Homo Sapiens
KSYDDPTNI

SEQ ID NO: 843355 - protein, 9 aa, Homo Sapiens
QGPAYLRDI

SEQ ID NO: 843356 - protein, 9 aa, Homo Sapiens
VKLDRPRFK

SEQ ID NO: 843357 - protein, 9 aa, Homo Sapiens
LSEAQDMYY

SEQ ID NO: 843358 - protein, 9 aa, Homo Sapiens
VAHEIYQIT

SEQ ID NO: 843359 - protein, 9 aa, Homo Sapiens
TISKGCIKV

SEQ ID NO: 843360 - protein, 9 aa, Homo Sapiens
AIISNVEFY

SEQ ID NO: 843361 - protein, 9 aa, Homo Sapiens
TTDSWSIWK

SEQ ID NO: 843362 - protein, 9 aa, Homo Sapiens
QFPGCFSPQ

SEQ ID NO: 843363 - protein, 9 aa, Homo Sapiens
PCLLLIKCR

SEQ ID NO: 843364 - protein, 9 aa, Homo Sapiens
SNTEVMLLN

SEQ ID NO: 843365 - protein, 9 aa, Homo Sapiens
RMRKMLQEI

SEQ ID NO: 843366 - protein, 9 aa, Homo Sapiens
FQISTDNFF

SEQ ID NO: 843367 - protein, 9 aa, Homo Sapiens
CPNAKGVLV

SEQ ID NO: 843368 - protein, 9 aa, Homo Sapiens
NNFFYLIKW

SEQ ID NO: 843369 - protein, 9 aa, Homo Sapiens
ELFPVPESI

SEQ ID NO: 843370 - protein, 9 aa, Homo Sapiens
AVYEMIQCF

SEQ ID NO: 843371 - protein, 9 aa, Homo Sapiens
SNFVDNRYG

SEQ ID NO: 843372 - protein, 9 aa, Homo Sapiens
LIINYLVTE

SEQ ID NO: 843373 - protein, 9 aa, Homo Sapiens
LAEGGKLMK

SEQ ID NO: 843374 - protein, 9 aa, Homo Sapiens
DLFETQGND

SEQ ID NO: 843375 - protein, 9 aa, Homo Sapiens
IILRLPFCG

SEQ ID NO: 843376 - protein, 9 aa, Homo Sapiens
MVLFMITSV

SEQ ID NO: 843377 - protein, 9 aa, Homo Sapiens
EEEKLWKEM

SEQ ID NO: 843378 - protein, 9 aa, Homo Sapiens
ADEGNKETS

SEQ ID NO: 843379 - protein, 9 aa, Homo Sapiens
TGHYSTVKD

SEQ ID NO: 843380 - protein, 9 aa, Homo Sapiens
VGQMFLGGL

SEQ ID NO: 843381 - protein, 9 aa, Homo Sapiens
KNEAPVVHS

SEQ ID NO: 843382 - protein, 9 aa, Homo Sapiens
QEDYGLFRA

SEQ ID NO: 843383 - protein, 9 aa, Homo Sapiens
LCPIKEVIE

SEQ ID NO: 843384 - protein, 9 aa, Homo Sapiens
EQWLQKIKA

SEQ ID NO: 843385 - protein, 9 aa, Homo Sapiens
PSGSRPDGC

SEQ ID NO: 843386 - protein, 9 aa, Homo Sapiens
ERKETNRKL

SEQ ID NO: 843387 - protein, 9 aa, Homo Sapiens
YRRHCPRTY

SEQ ID NO: 843388 - protein, 9 aa, Homo Sapiens
LDTCFTLHL

SEQ ID NO: 843389 - protein, 9 aa, Homo Sapiens
GIPLCHLQV

SEQ ID NO: 843390 - protein, 9 aa, Homo Sapiens
SGSKDGKYA

SEQ ID NO: 843391 - protein, 9 aa, Homo Sapiens
REIMLKDEV

SEQ ID NO: 843392 - protein, 9 aa, Homo Sapiens
GSSFSSDSF

SEQ ID NO: 843393 - protein, 9 aa, Homo Sapiens
VQSDSAVIG

SEQ ID NO: 843394 - protein, 9 aa, Homo Sapiens
DPSQSKVMG

SEQ ID NO: 843395 - protein, 9 aa, Homo Sapiens
SEEACQQNN

SEQ ID NO: 843396 - protein, 9 aa, Homo Sapiens
LRISGLFSE

SEQ ID NO: 843397 - protein, 9 aa, Homo Sapiens
KFLGSKRSF

SEQ ID NO: 843398 - protein, 9 aa, Homo Sapiens
LWIYQQEWQ

SEQ ID NO: 843399 - protein, 9 aa, Homo Sapiens
KNIGFEWNY

SEQ ID NO: 843400 - protein, 9 aa, Homo Sapiens
QIQPIIAVA

SEQ ID NO: 843401 - protein, 9 aa, Homo Sapiens
RVRQNVSQE

SEQ ID NO: 843402 - protein, 9 aa, Homo Sapiens
ISTDRNASV

SEQ ID NO: 843403 - protein, 9 aa, Homo Sapiens
AQRQDNALA

SEQ ID NO: 843404 - protein, 9 aa, Homo Sapiens
KLVETPRPT

SEQ ID NO: 843405 - protein, 9 aa, Homo Sapiens
IRYLPKLTS

SEQ ID NO: 843406 - protein, 9 aa, Homo Sapiens
FPNSTNLPI

SEQ ID NO: 843407 - protein, 9 aa, Homo Sapiens
ASDLQVEVQ

SEQ ID NO: 843408 - protein, 9 aa, Homo Sapiens
GTLTFMYLQ

SEQ ID NO: 843409 - protein, 9 aa, Homo Sapiens
SMGGKEQNS

SEQ ID NO: 843410 - protein, 9 aa, Homo Sapiens
FNKNNTFNA

SEQ ID NO: 843411 - protein, 9 aa, Homo Sapiens
DVGTNTSFY

SEQ ID NO: 843412 - protein, 9 aa, Homo Sapiens
ADAMAHLSG

SEQ ID NO: 843413 - protein, 9 aa, Homo Sapiens
QDDRVLLGN

SEQ ID NO: 843414 - protein, 9 aa, Homo Sapiens
RYRENVCVY

SEQ ID NO: 843415 - protein, 9 aa, Homo Sapiens
DFINDATNV

SEQ ID NO: 843416 - protein, 9 aa, Homo Sapiens
KSLREWKLF

SEQ ID NO: 843417 - protein, 9 aa, Homo Sapiens
TYFSNLQRQ

SEQ ID NO: 843418 - protein, 9 aa, Homo Sapiens
SLNRDVSLG

SEQ ID NO: 843419 - protein, 9 aa, Homo Sapiens
KHDLILNTI

SEQ ID NO: 843420 - protein, 9 aa, Homo Sapiens
CSQCIDSLN

SEQ ID NO: 843421 - protein, 9 aa, Homo Sapiens
FQNLAHEEV

SEQ ID NO: 843422 - protein, 9 aa, Homo Sapiens
PDTTQCAYI

SEQ ID NO: 843423 - protein, 9 aa, Homo Sapiens
IAVQYAEDQ

SEQ ID NO: 843424 - protein, 9 aa, Homo Sapiens
SHGLIDEQL

SEQ ID NO: 843425 - protein, 9 aa, Homo Sapiens
SSSAASPYF

SEQ ID NO: 843426 - protein, 9 aa, Homo Sapiens
VKKDYLREL

SEQ ID NO: 843427 - protein, 9 aa, Homo Sapiens
FEKALNARF

SEQ ID NO: 843428 - protein, 9 aa, Homo Sapiens
YPDRARRLQ

SEQ ID NO: 843429 - protein, 9 aa, Homo Sapiens
MQIFRDSAT

SEQ ID NO: 843430 - protein, 9 aa, Homo Sapiens
LECPDPNIL

SEQ ID NO: 843431 - protein, 9 aa, Homo Sapiens
SFTKHQRIN

SEQ ID NO: 843432 - protein, 9 aa, Homo Sapiens
LSYLIVSIL

SEQ ID NO: 843433 - protein, 9 aa, Homo Sapiens
IQEPGSSLP

SEQ ID NO: 843434 - protein, 9 aa, Homo Sapiens
WDSRKSKHF

SEQ ID NO: 843435 - protein, 9 aa, Homo Sapiens
QMLLNLGVI

SEQ ID NO: 843436 - protein, 9 aa, Homo Sapiens
LPAPIPLEL

SEQ ID NO: 843437 - protein, 9 aa, Homo Sapiens
KPQSRGKTA

SEQ ID NO: 843438 - protein, 9 aa, Homo Sapiens
EGEVGEELE

SEQ ID NO: 843439 - protein, 9 aa, Homo Sapiens
DAVNYPLRD

SEQ ID NO: 843440 - protein, 9 aa, Homo Sapiens
GEGHINLNQ

SEQ ID NO: 843441 - protein, 9 aa, Homo Sapiens
GTSQSSTNQ

SEQ ID NO: 843442 - protein, 9 aa, Homo Sapiens
PAGAGSSPE

SEQ ID NO: 843443 - protein, 9 aa, Homo Sapiens
SLGIIANIN

SEQ ID NO: 843444 - protein, 9 aa, Homo Sapiens
RMSRIHEEF

SEQ ID NO: 843445 - protein, 9 aa, Homo Sapiens
SLLLLAAEQ

SEQ ID NO: 843446 - protein, 9 aa, Homo Sapiens
APEARNVSV

SEQ ID NO: 843447 - protein, 9 aa, Homo Sapiens
VSKRLAILD

SEQ ID NO: 843448 - protein, 9 aa, Homo Sapiens
VKGSLGSDM

SEQ ID NO: 843449 - protein, 9 aa, Homo Sapiens
RRYLVMQKL

SEQ ID NO: 843450 - protein, 9 aa, Homo Sapiens
PLKDAETGA

SEQ ID NO: 843451 - protein, 9 aa, Homo Sapiens
HCQQEDIKT

SEQ ID NO: 843452 - protein, 9 aa, Homo Sapiens
QISTDNFFL

SEQ ID NO: 843453 - protein, 9 aa, Homo Sapiens
ELKSQSGES

SEQ ID NO: 843454 - protein, 9 aa, Homo Sapiens
PIWKIYHNG

SEQ ID NO: 843455 - protein, 9 aa, Homo Sapiens
SNTSRHNLE

SEQ ID NO: 843456 - protein, 9 aa, Homo Sapiens
YLKTPPECL

SEQ ID NO: 843457 - protein, 9 aa, Homo Sapiens
KYMFFLMYL

SEQ ID NO: 843458 - protein, 9 aa, Homo Sapiens
HLETMLITC

SEQ ID NO: 843459 - protein, 9 aa, Homo Sapiens
TTCETARTP

SEQ ID NO: 843460 - protein, 9 aa, Homo Sapiens
AFWIIKLSR

SEQ ID NO: 843461 - protein, 9 aa, Homo Sapiens
VDLKTVDST

SEQ ID NO: 843462 - protein, 9 aa, Homo Sapiens
VLQYNSFPL

SEQ ID NO: 843463 - protein, 9 aa, Homo Sapiens
IHQNLANTN

SEQ ID NO: 843464 - protein, 9 aa, Homo Sapiens
IATIAESED

SEQ ID NO: 843465 - protein, 9 aa, Homo Sapiens
LNNADSQNG

SEQ ID NO: 843466 - protein, 9 aa, Homo Sapiens
TLQDVLSLL

SEQ ID NO: 843467 - protein, 9 aa, Homo Sapiens
SSEVVKCGR

SEQ ID NO: 843468 - protein, 9 aa, Homo Sapiens
DPQYLALFR

SEQ ID NO: 843469 - protein, 9 aa, Homo Sapiens
FHTEMGLYY

SEQ ID NO: 843470 - protein, 9 aa, Homo Sapiens
KEYTEIPSP

SEQ ID NO: 843471 - protein, 9 aa, Homo Sapiens
ANKKFWRAM

SEQ ID NO: 843472 - protein, 9 aa, Homo Sapiens
DRLFRSHSS

SEQ ID NO: 843473 - protein, 9 aa, Homo Sapiens
VDIWSVGCT

SEQ ID NO: 843474 - protein, 9 aa, Homo Sapiens
AEEAHKICE

SEQ ID NO: 843475 - protein, 9 aa, Homo Sapiens
GGAKNVNMK

SEQ ID NO: 843476 - protein, 9 aa, Homo Sapiens
NRICRISHH

SEQ ID NO: 843477 - protein, 9 aa, Homo Sapiens
YCDNTLLNE

SEQ ID NO: 843478 - protein, 9 aa, Homo Sapiens
RGELGFHGQ

SEQ ID NO: 843479 - protein, 9 aa, Homo Sapiens
YFQHLLGKR

SEQ ID NO: 843480 - protein, 9 aa, Homo Sapiens
RSAYAKRNI

SEQ ID NO: 843481 - protein, 9 aa, Homo Sapiens
TPEAKAAKL

SEQ ID NO: 843482 - protein, 9 aa, Homo Sapiens
VRTDSGSLQ

SEQ ID NO: 843483 - protein, 9 aa, Homo Sapiens
SHKIVHLGE

SEQ ID NO: 843484 - protein, 9 aa, Homo Sapiens
LSYCWLLNE

SEQ ID NO: 843485 - protein, 9 aa, Homo Sapiens
EINQGIQNL

SEQ ID NO: 843486 - protein, 9 aa, Homo Sapiens
DDKGVLFVS

SEQ ID NO: 843487 - protein, 9 aa, Homo Sapiens
SGEGFGKTT

SEQ ID NO: 843488 - protein, 9 aa, Homo Sapiens
HCWCVDDKG

SEQ ID NO: 843489 - protein, 9 aa, Homo Sapiens
TTYFCRDLV

SEQ ID NO: 843490 - protein, 9 aa, Homo Sapiens
LIISMIFIK

SEQ ID NO: 843491 - protein, 9 aa, Homo Sapiens
QIKCDKYIL

SEQ ID NO: 843492 - protein, 9 aa, Homo Sapiens
PVRTFKLPR

SEQ ID NO: 843493 - protein, 9 aa, Homo Sapiens
TVSNFVDNR

SEQ ID NO: 843494 - protein, 9 aa, Homo Sapiens
HSHCFQTHE

SEQ ID NO: 843495 - protein, 9 aa, Homo Sapiens
RLKKDNKVT

SEQ ID NO: 843496 - protein, 9 aa, Homo Sapiens
IIKGYIIRY

SEQ ID NO: 843497 - protein, 9 aa, Homo Sapiens
ERQELLDII

SEQ ID NO: 843498 - protein, 9 aa, Homo Sapiens
KYELRYRKC

SEQ ID NO: 843499 - protein, 9 aa, Homo Sapiens
SLLLVSMYY

SEQ ID NO: 843500 - protein, 9 aa, Homo Sapiens
NAQKNKLLI

SEQ ID NO: 843501 - protein, 9 aa, Homo Sapiens
GLQRAMSTT

SEQ ID NO: 843502 - protein, 9 aa, Homo Sapiens
REPLSSNTL

SEQ ID NO: 843503 - protein, 9 aa, Homo Sapiens
ARHRRIHAG

SEQ ID NO: 843504 - protein, 9 aa, Homo Sapiens
KSADVDKLA

SEQ ID NO: 843505 - protein, 9 aa, Homo Sapiens
HIEVMNSFE

SEQ ID NO: 843506 - protein, 9 aa, Homo Sapiens
SSFVAGAVG

SEQ ID NO: 843507 - protein, 9 aa, Homo Sapiens
PLELYKDVR

SEQ ID NO: 843508 - protein, 9 aa, Homo Sapiens
DELPERQPC

SEQ ID NO: 843509 - protein, 9 aa, Homo Sapiens
PASPRLRHV

SEQ ID NO: 843510 - protein, 9 aa, Homo Sapiens
QTEKLVEGK

SEQ ID NO: 843511 - protein, 9 aa, Homo Sapiens
KELEQLATK

SEQ ID NO: 843512 - protein, 9 aa, Homo Sapiens
IPKSNIVLL

SEQ ID NO: 843513 - protein, 9 aa, Homo Sapiens
LYFKLQSMI

SEQ ID NO: 843514 - protein, 9 aa, Homo Sapiens
DTAVGTPVY

SEQ ID NO: 843515 - protein, 9 aa, Homo Sapiens
KQLEEETRR

SEQ ID NO: 843516 - protein, 9 aa, Homo Sapiens
HRKFRLMED

SEQ ID NO: 843517 - protein, 9 aa, Homo Sapiens
LVSLGRAVS

SEQ ID NO: 843518 - protein, 9 aa, Homo Sapiens
AHPSNVKME

SEQ ID NO: 843519 - protein, 9 aa, Homo Sapiens
NIQGSLFKL

SEQ ID NO: 843520 - protein, 9 aa, Homo Sapiens
YSSKPNNLR

SEQ ID NO: 843521 - protein, 9 aa, Homo Sapiens
GEIITQMQR

SEQ ID NO: 843522 - protein, 9 aa, Homo Sapiens
PPPYKQVVK

SEQ ID NO: 843523 - protein, 9 aa, Homo Sapiens
VYFLLPEES

SEQ ID NO: 843524 - protein, 9 aa, Homo Sapiens
DLASLAFIS

SEQ ID NO: 843525 - protein, 9 aa, Homo Sapiens
SSVLPNDLF

SEQ ID NO: 843526 - protein, 9 aa, Homo Sapiens
DPAAIPKDK

SEQ ID NO: 843527 - protein, 9 aa, Homo Sapiens
EHIKHVNVM

SEQ ID NO: 843528 - protein, 9 aa, Homo Sapiens
TYRTHDGSR

SEQ ID NO: 843529 - protein, 9 aa, Homo Sapiens
DTFHPEILE

SEQ ID NO: 843530 - protein, 9 aa, Homo Sapiens
QSDAAMQKD

SEQ ID NO: 843531 - protein, 9 aa, Homo Sapiens
HSGSLQIHE

SEQ ID NO: 843532 - protein, 9 aa, Homo Sapiens
FIETYNVDK

SEQ ID NO: 843533 - protein, 9 aa, Homo Sapiens
SPVVSDEDS

SEQ ID NO: 843534 - protein, 9 aa, Homo Sapiens
AHAGAVAVF

SEQ ID NO: 843535 - protein, 9 aa, Homo Sapiens
GKYFILFTK

SEQ ID NO: 843536 - protein, 9 aa, Homo Sapiens
GKYFNFIGY

SEQ ID NO: 843537 - protein, 9 aa, Homo Sapiens
FHLENITTG

SEQ ID NO: 843538 - protein, 9 aa, Homo Sapiens
WYRPPLSRV

SEQ ID NO: 843539 - protein, 9 aa, Homo Sapiens
EELSWLQNT

SEQ ID NO: 843540 - protein, 9 aa, Homo Sapiens
NVDEFVKII

SEQ ID NO: 843541 - protein, 9 aa, Homo Sapiens
RQKSMKGLY

SEQ ID NO: 843542 - protein, 9 aa, Homo Sapiens
QYSGKVAKE

SEQ ID NO: 843543 - protein, 9 aa, Homo Sapiens
IIDEFIVKL

SEQ ID NO: 843544 - protein, 9 aa, Homo Sapiens
YAIDDQDLN

SEQ ID NO: 843545 - protein, 9 aa, Homo Sapiens
RLAEDDDPQ

SEQ ID NO: 843546 - protein, 9 aa, Homo Sapiens
RNTNFCHGL

SEQ ID NO: 843547 - protein, 9 aa, Homo Sapiens
WRSAKKYVI

SEQ ID NO: 843548 - protein, 9 aa, Homo Sapiens
NSQQTILDR

SEQ ID NO: 843549 - protein, 9 aa, Homo Sapiens
FNNNTNSKD

SEQ ID NO: 843550 - protein, 9 aa, Homo Sapiens
GSMKAALRK

SEQ ID NO: 843551 - protein, 9 aa, Homo Sapiens
LQSGSARAT

SEQ ID NO: 843552 - protein, 9 aa, Homo Sapiens
SFIVLYILC

SEQ ID NO: 843553 - protein, 9 aa, Homo Sapiens
TWNLALPLL

SEQ ID NO: 843554 - protein, 9 aa, Homo Sapiens
DIMSKKYRV

SEQ ID NO: 843555 - protein, 9 aa, Homo Sapiens
PVPYKDLKT

SEQ ID NO: 843556 - protein, 9 aa, Homo Sapiens
AMGVVYALK

SEQ ID NO: 843557 - protein, 9 aa, Homo Sapiens
ARRDHSSIE

SEQ ID NO: 843558 - protein, 9 aa, Homo Sapiens
AKEDNSCSH

SEQ ID NO: 843559 - protein, 9 aa, Homo Sapiens
GLEKTTTKA

SEQ ID NO: 843560 - protein, 9 aa, Homo Sapiens
MFSMLKTSM

SEQ ID NO: 843561 - protein, 9 aa, Homo Sapiens
ALPHAIYLL

SEQ ID NO: 843562 - protein, 9 aa, Homo Sapiens
CEQEDKMQE

SEQ ID NO: 843563 - protein, 9 aa, Homo Sapiens
AVLGHWPQK

SEQ ID NO: 843564 - protein, 9 aa, Homo Sapiens
LQELRIVGA

SEQ ID NO: 843565 - protein, 9 aa, Homo Sapiens
DQNSLERQI

SEQ ID NO: 843566 - protein, 9 aa, Homo Sapiens
IDHNQMLQY

SEQ ID NO: 843567 - protein, 9 aa, Homo Sapiens
VDTIKRPSP

SEQ ID NO: 843568 - protein, 9 aa, Homo Sapiens
THRMAKKNA

SEQ ID NO: 843569 - protein, 9 aa, Homo Sapiens
HRCVTNPAY

SEQ ID NO: 843570 - protein, 9 aa, Homo Sapiens
VFDQQIGDS

SEQ ID NO: 843571 - protein, 9 aa, Homo Sapiens
SCVYHAKPA

SEQ ID NO: 843572 - protein, 9 aa, Homo Sapiens
KPTCYLAPQ

SEQ ID NO: 843573 - protein, 9 aa, Homo Sapiens
SAIRRTIGQ

SEQ ID NO: 843574 - protein, 9 aa, Homo Sapiens
HVAHLEDYE

SEQ ID NO: 843575 - protein, 9 aa, Homo Sapiens
AVVTVWDSN

SEQ ID NO: 843576 - protein, 9 aa, Homo Sapiens
ECGDKVNLL

SEQ ID NO: 843577 - protein, 9 aa, Homo Sapiens
FCDKSFSHL

SEQ ID NO: 843578 - protein, 9 aa, Homo Sapiens
REKFCNRER

SEQ ID NO: 843579 - protein, 9 aa, Homo Sapiens
WKVFEDSVR

SEQ ID NO: 843580 - protein, 9 aa, Homo Sapiens
RRIYPQLIL

SEQ ID NO: 843581 - protein, 9 aa, Homo Sapiens
DDKLDITTL

SEQ ID NO: 843582 - protein, 9 aa, Homo Sapiens
FTKSKLPII

SEQ ID NO: 843583 - protein, 9 aa, Homo Sapiens
KREYEVKRL

SEQ ID NO: 843584 - protein, 9 aa, Homo Sapiens
IKIDFPRAA

SEQ ID NO: 843585 - protein, 9 aa, Homo Sapiens
KYYIVENEK

SEQ ID NO: 843586 - protein, 9 aa, Homo Sapiens
TLLTYQGAS

SEQ ID NO: 843587 - protein, 9 aa, Homo Sapiens
LQHSQVPSS

SEQ ID NO: 843588 - protein, 9 aa, Homo Sapiens
VILFSFSTK

SEQ ID NO: 843589 - protein, 9 aa, Homo Sapiens
LFSGTQIAT

SEQ ID NO: 843590 - protein, 9 aa, Homo Sapiens
AFKLQHGVI

SEQ ID NO: 843591 - protein, 9 aa, Homo Sapiens
AMPMLYNTC

SEQ ID NO: 843592 - protein, 9 aa, Homo Sapiens
KTMYAMKYM

SEQ ID NO: 843593 - protein, 9 aa, Homo Sapiens
FNAFWTIPG

SEQ ID NO: 843594 - protein, 9 aa, Homo Sapiens
LENLPATSF

SEQ ID NO: 843595 - protein, 9 aa, Homo Sapiens
SLIKWLEAN

SEQ ID NO: 843596 - protein, 9 aa, Homo Sapiens
RLTYSNLKV

SEQ ID NO: 843597 - protein, 9 aa, Homo Sapiens
LDSATGNWL

SEQ ID NO: 843598 - protein, 9 aa, Homo Sapiens
VEDNCVNSG

SEQ ID NO: 843599 - protein, 9 aa, Homo Sapiens
TSALPRKYI

SEQ ID NO: 843600 - protein, 9 aa, Homo Sapiens
NEENPTNNE

SEQ ID NO: 843601 - protein, 9 aa, Homo Sapiens
VKCGRNSNI

SEQ ID NO: 843602 - protein, 9 aa, Homo Sapiens
SRPIHCGVC

SEQ ID NO: 843603 - protein, 9 aa, Homo Sapiens
HYITSPLLE

SEQ ID NO: 843604 - protein, 9 aa, Homo Sapiens
DNPFMTSIP

SEQ ID NO: 843605 - protein, 9 aa, Homo Sapiens
IVVVAGNIF

SEQ ID NO: 843606 - protein, 9 aa, Homo Sapiens
PQEWHCKQM

SEQ ID NO: 843607 - protein, 9 aa, Homo Sapiens
LAKLRTRVH

SEQ ID NO: 843608 - protein, 9 aa, Homo Sapiens
SQPPGFSDS

SEQ ID NO: 843609 - protein, 9 aa, Homo Sapiens
CNGYTSGKE

SEQ ID NO: 843610 - protein, 9 aa, Homo Sapiens
HPKEKMNKE

SEQ ID NO: 843611 - protein, 9 aa, Homo Sapiens
ESRGLYYNF

SEQ ID NO: 843612 - protein, 9 aa, Homo Sapiens
QSYFALLGD

SEQ ID NO: 843613 - protein, 9 aa, Homo Sapiens
DFGVFIGWN

SEQ ID NO: 843614 - protein, 9 aa, Homo Sapiens
MLALLVLVA

SEQ ID NO: 843615 - protein, 9 aa, Homo Sapiens
EVVNLGGLS

SEQ ID NO: 843616 - protein, 9 aa, Homo Sapiens
ATNILTELR

SEQ ID NO: 843617 - protein, 9 aa, Homo Sapiens
VYLTITNLL

SEQ ID NO: 843618 - protein, 9 aa, Homo Sapiens
AEPQWAGRY

SEQ ID NO: 843619 - protein, 9 aa, Homo Sapiens
LAIQSFQVA

SEQ ID NO: 843620 - protein, 9 aa, Homo Sapiens
LFTNLFQYE

SEQ ID NO: 843621 - protein, 9 aa, Homo Sapiens
GKAQMQSPT

SEQ ID NO: 843622 - protein, 9 aa, Homo Sapiens
GNLELVVTV

SEQ ID NO: 843623 - protein, 9 aa, Homo Sapiens
LEKTAAKLR

SEQ ID NO: 843624 - protein, 9 aa, Homo Sapiens
QTGRSEVEM

SEQ ID NO: 843625 - protein, 9 aa, Homo Sapiens
GFQYEMVRR

SEQ ID NO: 843626 - protein, 9 aa, Homo Sapiens
GTFILKVLE

SEQ ID NO: 843627 - protein, 9 aa, Homo Sapiens
KQYNNEPSN

SEQ ID NO: 843628 - protein, 9 aa, Homo Sapiens
GVDNACFSS

SEQ ID NO: 843629 - protein, 9 aa, Homo Sapiens
DDGCNSGSE

SEQ ID NO: 843630 - protein, 9 aa, Homo Sapiens
VMTINSVTT

SEQ ID NO: 843631 - protein, 9 aa, Homo Sapiens
GTYTCEMSN

SEQ ID NO: 843632 - protein, 9 aa, Homo Sapiens
HRLHQLFRD

SEQ ID NO: 843633 - protein, 9 aa, Homo Sapiens
YSQWEGATI

SEQ ID NO: 843634 - protein, 9 aa, Homo Sapiens
KTLDKLDVK

SEQ ID NO: 843635 - protein, 9 aa, Homo Sapiens
GINKEILRV

SEQ ID NO: 843636 - protein, 9 aa, Homo Sapiens
CKDLKINDA

SEQ ID NO: 843637 - protein, 9 aa, Homo Sapiens
AMAAQVVGG

SEQ ID NO: 843638 - protein, 9 aa, Homo Sapiens
STSIPSPQT

SEQ ID NO: 843639 - protein, 9 aa, Homo Sapiens
ILAGTNQPD

SEQ ID NO: 843640 - protein, 9 aa, Homo Sapiens
KQRATFKSG

SEQ ID NO: 843641 - protein, 9 aa, Homo Sapiens
RRQEANARK

SEQ ID NO: 843642 - protein, 9 aa, Homo Sapiens
QSLASRRLT

SEQ ID NO: 843643 - protein, 9 aa, Homo Sapiens
DAETYGEDN

SEQ ID NO: 843644 - protein, 9 aa, Homo Sapiens
AFPFLQLYY

SEQ ID NO: 843645 - protein, 9 aa, Homo Sapiens
RRGKKGAVT

SEQ ID NO: 843646 - protein, 9 aa, Homo Sapiens
DTLGLNSRL

SEQ ID NO: 843647 - protein, 9 aa, Homo Sapiens
VSKLASNAR

SEQ ID NO: 843648 - protein, 9 aa, Homo Sapiens
YMMEEPNIN

SEQ ID NO: 843649 - protein, 9 aa, Homo Sapiens
DPGAKELPA

SEQ ID NO: 843650 - protein, 9 aa, Homo Sapiens
LICGIIICL

SEQ ID NO: 843651 - protein, 9 aa, Homo Sapiens
SMQDGPKAG

SEQ ID NO: 843652 - protein, 9 aa, Homo Sapiens
KLGGLPSIA

SEQ ID NO: 843653 - protein, 9 aa, Homo Sapiens
FRRRRTEQT

SEQ ID NO: 843654 - protein, 9 aa, Homo Sapiens
YSYEQHNQQ

SEQ ID NO: 843655 - protein, 9 aa, Homo Sapiens
IYIQTLCGS

SEQ ID NO: 843656 - protein, 9 aa, Homo Sapiens
GDIPKAPDE

SEQ ID NO: 843657 - protein, 9 aa, Homo Sapiens
VFTPVCERN

SEQ ID NO: 843658 - protein, 9 aa, Homo Sapiens
RHFRTTGQS

SEQ ID NO: 843659 - protein, 9 aa, Homo Sapiens
KTYFFCGNK

SEQ ID NO: 843660 - protein, 9 aa, Homo Sapiens
CNGRSFHNT

SEQ ID NO: 843661 - protein, 9 aa, Homo Sapiens
GICKIHPPA

SEQ ID NO: 843662 - protein, 9 aa, Homo Sapiens
LSLNLDAKK

SEQ ID NO: 843663 - protein, 9 aa, Homo Sapiens
DTRCCKLCK

SEQ ID NO: 843664 - protein, 9 aa, Homo Sapiens
PQRTFPEMQ

SEQ ID NO: 843665 - protein, 9 aa, Homo Sapiens
GRYFKHYRS

SEQ ID NO: 843666 - protein, 9 aa, Homo Sapiens
WFICISLAQ

SEQ ID NO: 843667 - protein, 9 aa, Homo Sapiens
SLNLVQNNV

SEQ ID NO: 843668 - protein, 9 aa, Homo Sapiens
REPLKQAAA

SEQ ID NO: 843669 - protein, 9 aa, Homo Sapiens
RTTSFPCTV

SEQ ID NO: 843670 - protein, 9 aa, Homo Sapiens
MNVMWMITI

SEQ ID NO: 843671 - protein, 9 aa, Homo Sapiens
KFEDLIKYL

SEQ ID NO: 843672 - protein, 9 aa, Homo Sapiens
FLQYFGRLS

SEQ ID NO: 843673 - protein, 9 aa, Homo Sapiens
GKNALHLAA

SEQ ID NO: 843674 - protein, 9 aa, Homo Sapiens
FFLFAAICL

SEQ ID NO: 843675 - protein, 9 aa, Homo Sapiens
PKLDLKAAR

SEQ ID NO: 843676 - protein, 9 aa, Homo Sapiens
VVFKAKNKV

SEQ ID NO: 843677 - protein, 9 aa, Homo Sapiens
DFAFNQNLA

SEQ ID NO: 843678 - protein, 9 aa, Homo Sapiens
TEWTSFVLQ

SEQ ID NO: 843679 - protein, 9 aa, Homo Sapiens
STNPRLAKA

SEQ ID NO: 843680 - protein, 9 aa, Homo Sapiens
KFETQKYIS

SEQ ID NO: 843681 - protein, 9 aa, Homo Sapiens
IRDVISLKV

SEQ ID NO: 843682 - protein, 9 aa, Homo Sapiens
SQFARVPGL

SEQ ID NO: 843683 - protein, 9 aa, Homo Sapiens
KKEEHEEEL

SEQ ID NO: 843684 - protein, 9 aa, Homo Sapiens
KGDPSAPFQ

SEQ ID NO: 843685 - protein, 9 aa, Homo Sapiens
CLVSLFLHY

SEQ ID NO: 843686 - protein, 9 aa, Homo Sapiens
HVTVGEAHN

SEQ ID NO: 843687 - protein, 9 aa, Homo Sapiens
FLEEIEEQE

SEQ ID NO: 843688 - protein, 9 aa, Homo Sapiens
HRPKLTDIV

SEQ ID NO: 843689 - protein, 9 aa, Homo Sapiens
FCDKAFINQ

SEQ ID NO: 843690 - protein, 9 aa, Homo Sapiens
HRGERYKYM

SEQ ID NO: 843691 - protein, 9 aa, Homo Sapiens
LPLPILAPF

SEQ ID NO: 843692 - protein, 9 aa, Homo Sapiens
RKETEFVSS

SEQ ID NO: 843693 - protein, 9 aa, Homo Sapiens
DTSTDKEIT

SEQ ID NO: 843694 - protein, 9 aa, Homo Sapiens
EKMTYTPET

SEQ ID NO: 843695 - protein, 9 aa, Homo Sapiens
LNSHMWKKI

SEQ ID NO: 843696 - protein, 9 aa, Homo Sapiens
IYSLWNCDV

SEQ ID NO: 843697 - protein, 9 aa, Homo Sapiens
VSHTTILCL

SEQ ID NO: 843698 - protein, 9 aa, Homo Sapiens
GKIMRTPNS

SEQ ID NO: 843699 - protein, 9 aa, Homo Sapiens
RYYKAANIH

SEQ ID NO: 843700 - protein, 9 aa, Homo Sapiens
EVPFIWPGQ

SEQ ID NO: 843701 - protein, 9 aa, Homo Sapiens
LTLVNDLIG

SEQ ID NO: 843702 - protein, 9 aa, Homo Sapiens
LFSNHQSSY

SEQ ID NO: 843703 - protein, 9 aa, Homo Sapiens
GDIYALQSF

SEQ ID NO: 843704 - protein, 9 aa, Homo Sapiens
WRVARSING

SEQ ID NO: 843705 - protein, 9 aa, Homo Sapiens
AEKRQGDRG

SEQ ID NO: 843706 - protein, 9 aa, Homo Sapiens
SESELPHKR

SEQ ID NO: 843707 - protein, 9 aa, Homo Sapiens
HLGEKRYKC

SEQ ID NO: 843708 - protein, 9 aa, Homo Sapiens
PAFLWPWWY

SEQ ID NO: 843709 - protein, 9 aa, Homo Sapiens
ASMNSATPD

SEQ ID NO: 843710 - protein, 9 aa, Homo Sapiens
PVTSMTILY

SEQ ID NO: 843711 - protein, 9 aa, Homo Sapiens
GCGLSSMFL

SEQ ID NO: 843712 - protein, 9 aa, Homo Sapiens
QHVRRMFHP

SEQ ID NO: 843713 - protein, 9 aa, Homo Sapiens
LNDPSQSKV

SEQ ID NO: 843714 - protein, 9 aa, Homo Sapiens
VLTLVNDLI

SEQ ID NO: 843715 - protein, 9 aa, Homo Sapiens
LTREVQGVR

SEQ ID NO: 843716 - protein, 9 aa, Homo Sapiens
REGKQTWRR

SEQ ID NO: 843717 - protein, 9 aa, Homo Sapiens
GYYLDAELS

SEQ ID NO: 843718 - protein, 9 aa, Homo Sapiens
IGIGCSLVC

SEQ ID NO: 843719 - protein, 9 aa, Homo Sapiens
QTLLQYHKH

SEQ ID NO: 843720 - protein, 9 aa, Homo Sapiens
FFFCLFVNS

SEQ ID NO: 843721 - protein, 9 aa, Homo Sapiens
LAAALQWES

SEQ ID NO: 843722 - protein, 9 aa, Homo Sapiens
DLNNLFFSR

SEQ ID NO: 843723 - protein, 9 aa, Homo Sapiens
HNQQNGDSG

SEQ ID NO: 843724 - protein, 9 aa, Homo Sapiens
EWQQTYTYN

SEQ ID NO: 843725 - protein, 9 aa, Homo Sapiens
VFWQDQEHL

SEQ ID NO: 843726 - protein, 9 aa, Homo Sapiens
AESHNQIDL

SEQ ID NO: 843727 - protein, 9 aa, Homo Sapiens
RADVGIYAN

SEQ ID NO: 843728 - protein, 9 aa, Homo Sapiens
PRSLETLEI

SEQ ID NO: 843729 - protein, 9 aa, Homo Sapiens
RKLQEQEVL

SEQ ID NO: 843730 - protein, 9 aa, Homo Sapiens
LKNLKQACL

SEQ ID NO: 843731 - protein, 9 aa, Homo Sapiens
HNALKGPNV

SEQ ID NO: 843732 - protein, 9 aa, Homo Sapiens
EVQLCRATD

SEQ ID NO: 843733 - protein, 9 aa, Homo Sapiens
GTSESLFEL

SEQ ID NO: 843734 - protein, 9 aa, Homo Sapiens
LIIFAVFIV

SEQ ID NO: 843735 - protein, 9 aa, Homo Sapiens
HAFARTVNK

SEQ ID NO: 843736 - protein, 9 aa, Homo Sapiens
RDGDKMYVE

SEQ ID NO: 843737 - protein, 9 aa, Homo Sapiens
LMGAANQET

SEQ ID NO: 843738 - protein, 9 aa, Homo Sapiens
LKSDAVECL

SEQ ID NO: 843739 - protein, 9 aa, Homo Sapiens
SYNAFVKKS

SEQ ID NO: 843740 - protein, 9 aa, Homo Sapiens
ETAGLNKLF

SEQ ID NO: 843741 - protein, 9 aa, Homo Sapiens
AAAAYLSVQ

SEQ ID NO: 843742 - protein, 9 aa, Homo Sapiens
NLIRRDLAC

SEQ ID NO: 843743 - protein, 9 aa, Homo Sapiens
LTLIPNQKL

SEQ ID NO: 843744 - protein, 9 aa, Homo Sapiens
PVFPWIIHA

SEQ ID NO: 843745 - protein, 9 aa, Homo Sapiens
RDHLQFDQA

SEQ ID NO: 843746 - protein, 9 aa, Homo Sapiens
RSTDDQIIV

SEQ ID NO: 843747 - protein, 9 aa, Homo Sapiens
LLSDACSAR

SEQ ID NO: 843748 - protein, 9 aa, Homo Sapiens
TVRLTWIPG

SEQ ID NO: 843749 - protein, 9 aa, Homo Sapiens
ASGMTKNIY

SEQ ID NO: 843750 - protein, 9 aa, Homo Sapiens
FSEEQGTRL

SEQ ID NO: 843751 - protein, 9 aa, Homo Sapiens
ANPSERAHF

SEQ ID NO: 843752 - protein, 9 aa, Homo Sapiens
FAMINVCPL

SEQ ID NO: 843753 - protein, 9 aa, Homo Sapiens
GLLTAVELL

SEQ ID NO: 843754 - protein, 9 aa, Homo Sapiens
FDSSKNIFI

SEQ ID NO: 843755 - protein, 9 aa, Homo Sapiens
SMHGRPNYP

SEQ ID NO: 843756 - protein, 9 aa, Homo Sapiens
VKWASPEVL

SEQ ID NO: 843757 - protein, 9 aa, Homo Sapiens
GQCWVFTSV

SEQ ID NO: 843758 - protein, 9 aa, Homo Sapiens
GIVLMTAEI

SEQ ID NO: 843759 - protein, 9 aa, Homo Sapiens
IIFLASIFH

SEQ ID NO: 843760 - protein, 9 aa, Homo Sapiens
YELREYEER

SEQ ID NO: 843761 - protein, 9 aa, Homo Sapiens
RLFLECERK

SEQ ID NO: 843762 - protein, 9 aa, Homo Sapiens
YLNVPLSVN

SEQ ID NO: 843763 - protein, 9 aa, Homo Sapiens
DQDNTENPD

SEQ ID NO: 843764 - protein, 9 aa, Homo Sapiens
LKIKKNQLK

SEQ ID NO: 843765 - protein, 9 aa, Homo Sapiens
QLPANILTA

SEQ ID NO: 843766 - protein, 9 aa, Homo Sapiens
IPVANINSR

SEQ ID NO: 843767 - protein, 9 aa, Homo Sapiens
MMTTASMSL

SEQ ID NO: 843768 - protein, 9 aa, Homo Sapiens
MDNCPHKFL

SEQ ID NO: 843769 - protein, 9 aa, Homo Sapiens
YTCSPGFVL

SEQ ID NO: 843770 - protein, 9 aa, Homo Sapiens
GNVIRSEEP

SEQ ID NO: 843771 - protein, 9 aa, Homo Sapiens
VPCVGGDGG

SEQ ID NO: 843772 - protein, 9 aa, Homo Sapiens
VVKCYRGKE

SEQ ID NO: 843773 - protein, 9 aa, Homo Sapiens
NPSERAHFI

SEQ ID NO: 843774 - protein, 9 aa, Homo Sapiens
ASISKTSTE

SEQ ID NO: 843775 - protein, 9 aa, Homo Sapiens
VVPPTLNHV

SEQ ID NO: 843776 - protein, 9 aa, Homo Sapiens
DVRPNVLLG

SEQ ID NO: 843777 - protein, 9 aa, Homo Sapiens
VASQNVGQL

SEQ ID NO: 843778 - protein, 9 aa, Homo Sapiens
ELRKCCDQY

SEQ ID NO: 843779 - protein, 9 aa, Homo Sapiens
THKIIHTGD

SEQ ID NO: 843780 - protein, 9 aa, Homo Sapiens
YMKYFKNSS

SEQ ID NO: 843781 - protein, 9 aa, Homo Sapiens
RDVMMDNYS

SEQ ID NO: 843782 - protein, 9 aa, Homo Sapiens
VIHRDIKPD

SEQ ID NO: 843783 - protein, 9 aa, Homo Sapiens
LVAMKEIMY

SEQ ID NO: 843784 - protein, 9 aa, Homo Sapiens
RTLKSFSNL

SEQ ID NO: 843785 - protein, 9 aa, Homo Sapiens
LQEPNTDQQ

SEQ ID NO: 843786 - protein, 9 aa, Homo Sapiens
WADPKVCCN

SEQ ID NO: 843787 - protein, 9 aa, Homo Sapiens
HHRQNSWTQ

SEQ ID NO: 843788 - protein, 9 aa, Homo Sapiens
YGTKIDYIL

SEQ ID NO: 843789 - protein, 9 aa, Homo Sapiens
CSFALHTWS

SEQ ID NO: 843790 - protein, 9 aa, Homo Sapiens
DETCDKLRV

SEQ ID NO: 843791 - protein, 9 aa, Homo Sapiens
QNYFKKEEL

SEQ ID NO: 843792 - protein, 9 aa, Homo Sapiens
LGSNLHVKV

SEQ ID NO: 843793 - protein, 9 aa, Homo Sapiens
KDAGLFRSW

SEQ ID NO: 843794 - protein, 9 aa, Homo Sapiens
NELYEQGDE

SEQ ID NO: 843795 - protein, 9 aa, Homo Sapiens
CMMEYPSGL

SEQ ID NO: 843796 - protein, 9 aa, Homo Sapiens
DIEIWKEST

SEQ ID NO: 843797 - protein, 9 aa, Homo Sapiens
HIQLDKYLP

SEQ ID NO: 843798 - protein, 9 aa, Homo Sapiens
LCGFNERNV

SEQ ID NO: 843799 - protein, 9 aa, Homo Sapiens
KRKTKANVK

SEQ ID NO: 843800 - protein, 9 aa, Homo Sapiens
SFSQVTVSS

SEQ ID NO: 843801 - protein, 9 aa, Homo Sapiens
PGAWALPCF

SEQ ID NO: 843802 - protein, 9 aa, Homo Sapiens
LITLKNIIQ

SEQ ID NO: 843803 - protein, 9 aa, Homo Sapiens
TSNNKHLNN

SEQ ID NO: 843804 - protein, 9 aa, Homo Sapiens
DFITAAWLL

SEQ ID NO: 843805 - protein, 9 aa, Homo Sapiens
YRARSLQGL

SEQ ID NO: 843806 - protein, 9 aa, Homo Sapiens
CVLNLIKIF

SEQ ID NO: 843807 - protein, 9 aa, Homo Sapiens
ILAHFYNDF

SEQ ID NO: 843808 - protein, 9 aa, Homo Sapiens
EGHINLNQV

SEQ ID NO: 843809 - protein, 9 aa, Homo Sapiens
SAELDDESV

SEQ ID NO: 843810 - protein, 9 aa, Homo Sapiens
ATLVLAPSG

SEQ ID NO: 843811 - protein, 9 aa, Homo Sapiens
ITENASETL

SEQ ID NO: 843812 - protein, 9 aa, Homo Sapiens
FNFGSRPLH

SEQ ID NO: 843813 - protein, 9 aa, Homo Sapiens
YYFTSSRHT

SEQ ID NO: 843814 - protein, 9 aa, Homo Sapiens
GYCYTFGQL

SEQ ID NO: 843815 - protein, 9 aa, Homo Sapiens
ADKKVSLMG

SEQ ID NO: 843816 - protein, 9 aa, Homo Sapiens
GDIFRDQVL

SEQ ID NO: 843817 - protein, 9 aa, Homo Sapiens
LEQIVETLS

SEQ ID NO: 843818 - protein, 9 aa, Homo Sapiens
GGPLHLGYI

SEQ ID NO: 843819 - protein, 9 aa, Homo Sapiens
PPTLNHVIY

SEQ ID NO: 843820 - protein, 9 aa, Homo Sapiens
NLTDNGLMC

SEQ ID NO: 843821 - protein, 9 aa, Homo Sapiens
DSHGCCSQN

SEQ ID NO: 843822 - protein, 9 aa, Homo Sapiens
FGEALFLSW

SEQ ID NO: 843823 - protein, 9 aa, Homo Sapiens
ELSADQMSE

SEQ ID NO: 843824 - protein, 9 aa, Homo Sapiens
GETKGPEME

SEQ ID NO: 843825 - protein, 9 aa, Homo Sapiens
SPLKYLETP

SEQ ID NO: 843826 - protein, 9 aa, Homo Sapiens
YFGNDYIEN

SEQ ID NO: 843827 - protein, 9 aa, Homo Sapiens
GGKKGDKKK

SEQ ID NO: 843828 - protein, 9 aa, Homo Sapiens
VVGSDFVQK

SEQ ID NO: 843829 - protein, 9 aa, Homo Sapiens
FSKPSLHSR

SEQ ID NO: 843830 - protein, 9 aa, Homo Sapiens
HSIESSLGV

SEQ ID NO: 843831 - protein, 9 aa, Homo Sapiens
ITKPNKRKR

SEQ ID NO: 843832 - protein, 9 aa, Homo Sapiens
KAMTKFERH

SEQ ID NO: 843833 - protein, 9 aa, Homo Sapiens
LESPQQTFP

SEQ ID NO: 843834 - protein, 9 aa, Homo Sapiens
SKQEFQFVD

SEQ ID NO: 843835 - protein, 9 aa, Homo Sapiens
KWLLYLVKL

SEQ ID NO: 843836 - protein, 9 aa, Homo Sapiens
LRSKGEGDM

SEQ ID NO: 843837 - protein, 9 aa, Homo Sapiens
AFVFGRKYR

SEQ ID NO: 843838 - protein, 9 aa, Homo Sapiens
IIVGIDYNC

SEQ ID NO: 843839 - protein, 9 aa, Homo Sapiens
GILPAWCHI

SEQ ID NO: 843840 - protein, 9 aa, Homo Sapiens
VLEEIKNLK

SEQ ID NO: 843841 - protein, 9 aa, Homo Sapiens
STARITFQN

SEQ ID NO: 843842 - protein, 9 aa, Homo Sapiens
GCSWITVSA

SEQ ID NO: 843843 - protein, 9 aa, Homo Sapiens
RQKRKNRQK

SEQ ID NO: 843844 - protein, 9 aa, Homo Sapiens
CTPLRYNCI

SEQ ID NO: 843845 - protein, 9 aa, Homo Sapiens
NDDVVKIEF

SEQ ID NO: 843846 - protein, 9 aa, Homo Sapiens
IILYKFLVG

SEQ ID NO: 843847 - protein, 9 aa, Homo Sapiens
LPSISLDLT

SEQ ID NO: 843848 - protein, 9 aa, Homo Sapiens
KQLGGKIHS

SEQ ID NO: 843849 - protein, 9 aa, Homo Sapiens
TGLSLTESV

SEQ ID NO: 843850 - protein, 9 aa, Homo Sapiens
RDRWRNPRR

SEQ ID NO: 843851 - protein, 9 aa, Homo Sapiens
NLKPSVFHG

SEQ ID NO: 843852 - protein, 9 aa, Homo Sapiens
ISHYMKKIP

SEQ ID NO: 843853 - protein, 9 aa, Homo Sapiens
TYYKIKRTK

SEQ ID NO: 843854 - protein, 9 aa, Homo Sapiens
KCHPDTGAC

SEQ ID NO: 843855 - protein, 9 aa, Homo Sapiens
DTQPPNNIH

SEQ ID NO: 843856 - protein, 9 aa, Homo Sapiens
KSRTFIYLG

SEQ ID NO: 843857 - protein, 9 aa, Homo Sapiens
LDTILLLNP

SEQ ID NO: 843858 - protein, 9 aa, Homo Sapiens
RITVPPKKS

SEQ ID NO: 843859 - protein, 9 aa, Homo Sapiens
LGNNGNMTE

SEQ ID NO: 843860 - protein, 9 aa, Homo Sapiens
EAAIMGDHN

SEQ ID NO: 843861 - protein, 9 aa, Homo Sapiens
VVMVIDRIF

SEQ ID NO: 843862 - protein, 9 aa, Homo Sapiens
SPVNTCRDH

SEQ ID NO: 843863 - protein, 9 aa, Homo Sapiens
QDIKALKYA

SEQ ID NO: 843864 - protein, 9 aa, Homo Sapiens
TCYCCYLYA

SEQ ID NO: 843865 - protein, 9 aa, Homo Sapiens
RGLGEPFEL

SEQ ID NO: 843866 - protein, 9 aa, Homo Sapiens
GRRIWVDYS

SEQ ID NO: 843867 - protein, 9 aa, Homo Sapiens
QVGYRSPSM

SEQ ID NO: 843868 - protein, 9 aa, Homo Sapiens
SPLQSGNAT

SEQ ID NO: 843869 - protein, 9 aa, Homo Sapiens
QACHDLIKA

SEQ ID NO: 843870 - protein, 9 aa, Homo Sapiens
LYTDVMLEN

SEQ ID NO: 843871 - protein, 9 aa, Homo Sapiens
SVLSGVIKK

SEQ ID NO: 843872 - protein, 9 aa, Homo Sapiens
NKSSTKLRM

SEQ ID NO: 843873 - protein, 9 aa, Homo Sapiens
VDKYLAGQD

SEQ ID NO: 843874 - protein, 9 aa, Homo Sapiens
LIPTHTTIT

SEQ ID NO: 843875 - protein, 9 aa, Homo Sapiens
AVMSVAFSP

SEQ ID NO: 843876 - protein, 9 aa, Homo Sapiens
LKLHIRIKH

SEQ ID NO: 843877 - protein, 9 aa, Homo Sapiens
YFTQERLPL

SEQ ID NO: 843878 - protein, 9 aa, Homo Sapiens
RIRSTFQGE

SEQ ID NO: 843879 - protein, 9 aa, Homo Sapiens
KYARDMIMK

SEQ ID NO: 843880 - protein, 9 aa, Homo Sapiens
SGSRSSSSS

SEQ ID NO: 843881 - protein, 9 aa, Homo Sapiens
DVRGIAGVD

SEQ ID NO: 843882 - protein, 9 aa, Homo Sapiens
LQCLDDPVL

SEQ ID NO: 843883 - protein, 9 aa, Homo Sapiens
LSYGVLSFS

SEQ ID NO: 843884 - protein, 9 aa, Homo Sapiens
TNEETLREE

SEQ ID NO: 843885 - protein, 9 aa, Homo Sapiens
CFLHSGKTG

SEQ ID NO: 843886 - protein, 9 aa, Homo Sapiens
MDEKSLEKA

SEQ ID NO: 843887 - protein, 9 aa, Homo Sapiens
IKRTKQEPS

SEQ ID NO: 843888 - protein, 9 aa, Homo Sapiens
LYKNEIQPI

SEQ ID NO: 843889 - protein, 9 aa, Homo Sapiens
LVLKIADIF

SEQ ID NO: 843890 - protein, 9 aa, Homo Sapiens
MIELNKHFP

SEQ ID NO: 843891 - protein, 9 aa, Homo Sapiens
CSARMYRDE

SEQ ID NO: 843892 - protein, 9 aa, Homo Sapiens
NVLLTENVE

SEQ ID NO: 843893 - protein, 9 aa, Homo Sapiens
RIQAAAPTP

SEQ ID NO: 843894 - protein, 9 aa, Homo Sapiens
KLNATDRDD

SEQ ID NO: 843895 - protein, 9 aa, Homo Sapiens
KQSSEQNWA

SEQ ID NO: 843896 - protein, 9 aa, Homo Sapiens
WLLYLVKLE

SEQ ID NO: 843897 - protein, 9 aa, Homo Sapiens
TPDENKDEI

SEQ ID NO: 843898 - protein, 9 aa, Homo Sapiens
IRLAEDDDP

SEQ ID NO: 843899 - protein, 9 aa, Homo Sapiens
LFMHYQIYK

SEQ ID NO: 843900 - protein, 9 aa, Homo Sapiens
IIHLGEKRY

SEQ ID NO: 843901 - protein, 9 aa, Homo Sapiens
AFDWIRKEI

SEQ ID NO: 843902 - protein, 9 aa, Homo Sapiens
QQLRENNFD

SEQ ID NO: 843903 - protein, 9 aa, Homo Sapiens
HAMNFSNED

SEQ ID NO: 843904 - protein, 9 aa, Homo Sapiens
ECDVEPCKN

SEQ ID NO: 843905 - protein, 9 aa, Homo Sapiens
LAEVLGRCV

SEQ ID NO: 843906 - protein, 9 aa, Homo Sapiens
RQMQEKTDI

SEQ ID NO: 843907 - protein, 9 aa, Homo Sapiens
NGRVITCFD

SEQ ID NO: 843908 - protein, 9 aa, Homo Sapiens
SNQRIYYSW

SEQ ID NO: 843909 - protein, 9 aa, Homo Sapiens
VLWVDRAYA

SEQ ID NO: 843910 - protein, 9 aa, Homo Sapiens
KMKIKVSYS

SEQ ID NO: 843911 - protein, 9 aa, Homo Sapiens
AIYLAKQNI

SEQ ID NO: 843912 - protein, 9 aa, Homo Sapiens
CFPACSPFV

SEQ ID NO: 843913 - protein, 9 aa, Homo Sapiens
TPMFNPIIY

SEQ ID NO: 843914 - protein, 9 aa, Homo Sapiens
QSMINSLPT

SEQ ID NO: 843915 - protein, 9 aa, Homo Sapiens
FTRAHEEER

SEQ ID NO: 843916 - protein, 9 aa, Homo Sapiens
RANNQLFLL

SEQ ID NO: 843917 - protein, 9 aa, Homo Sapiens
SRKIIHAIC

SEQ ID NO: 843918 - protein, 9 aa, Homo Sapiens
GYRSPSMIS

SEQ ID NO: 843919 - protein, 9 aa, Homo Sapiens
EVQSNAFNG

SEQ ID NO: 843920 - protein, 9 aa, Homo Sapiens
PTLVAAVHR

SEQ ID NO: 843921 - protein, 9 aa, Homo Sapiens
SLSCTVVEM

SEQ ID NO: 843922 - protein, 9 aa, Homo Sapiens
FIDVVQRQI

SEQ ID NO: 843923 - protein, 9 aa, Homo Sapiens
WSRAVFSSL

SEQ ID NO: 843924 - protein, 9 aa, Homo Sapiens
LPLKSDAVE

SEQ ID NO: 843925 - protein, 9 aa, Homo Sapiens
KSQTRCAPF

SEQ ID NO: 843926 - protein, 9 aa, Homo Sapiens
KEEVEVTQV

SEQ ID NO: 843927 - protein, 9 aa, Homo Sapiens
LSSTPFPFR

SEQ ID NO: 843928 - protein, 9 aa, Homo Sapiens
ATLGSLENN

SEQ ID NO: 843929 - protein, 9 aa, Homo Sapiens
TDKGQQLHK

SEQ ID NO: 843930 - protein, 9 aa, Homo Sapiens
WGIPAHTAE

SEQ ID NO: 843931 - protein, 9 aa, Homo Sapiens
GSHTMDCFE

SEQ ID NO: 843932 - protein, 9 aa, Homo Sapiens
SLCVEHINL

SEQ ID NO: 843933 - protein, 9 aa, Homo Sapiens
VGNTVFPVL

SEQ ID NO: 843934 - protein, 9 aa, Homo Sapiens
KHSAIKIVD

SEQ ID NO: 843935 - protein, 9 aa, Homo Sapiens
SFLPVNQPK

SEQ ID NO: 843936 - protein, 9 aa, Homo Sapiens
KHIHELEKI

SEQ ID NO: 843937 - protein, 9 aa, Homo Sapiens
LVVFKLENF

SEQ ID NO: 843938 - protein, 9 aa, Homo Sapiens
RDRICTKGI

SEQ ID NO: 843939 - protein, 9 aa, Homo Sapiens
NQAAGNDTL

SEQ ID NO: 843940 - protein, 9 aa, Homo Sapiens
QIIVSYLWI

SEQ ID NO: 843941 - protein, 9 aa, Homo Sapiens
QRLFLPVVL

SEQ ID NO: 843942 - protein, 9 aa, Homo Sapiens
AIIFKCLSK

SEQ ID NO: 843943 - protein, 9 aa, Homo Sapiens
GHSIESSLG

SEQ ID NO: 843944 - protein, 9 aa, Homo Sapiens
KRQNGHVIY

SEQ ID NO: 843945 - protein, 9 aa, Homo Sapiens
SFQSHMITH

SEQ ID NO: 843946 - protein, 9 aa, Homo Sapiens
KIKYEFFRR

SEQ ID NO: 843947 - protein, 9 aa, Homo Sapiens
SLGRVPSLK

SEQ ID NO: 843948 - protein, 9 aa, Homo Sapiens
LRLTTSFFR

SEQ ID NO: 843949 - protein, 9 aa, Homo Sapiens
IYSLINKQV

SEQ ID NO: 843950 - protein, 9 aa, Homo Sapiens
LLLYLIILV

SEQ ID NO: 843951 - protein, 9 aa, Homo Sapiens
EAAHMFFEG

SEQ ID NO: 843952 - protein, 9 aa, Homo Sapiens
HWFPYCQSH

SEQ ID NO: 843953 - protein, 9 aa, Homo Sapiens
NFISMDPKV

SEQ ID NO: 843954 - protein, 9 aa, Homo Sapiens
DKFSSYDTG

SEQ ID NO: 843955 - protein, 9 aa, Homo Sapiens
EHLFWSFTL

SEQ ID NO: 843956 - protein, 9 aa, Homo Sapiens
RISLEQPPH

SEQ ID NO: 843957 - protein, 9 aa, Homo Sapiens
AFVCAFFKA

SEQ ID NO: 843958 - protein, 9 aa, Homo Sapiens
NPIVGKWSQ

SEQ ID NO: 843959 - protein, 9 aa, Homo Sapiens
PKGLEGERS

SEQ ID NO: 843960 - protein, 9 aa, Homo Sapiens
LIMFIHDLV

SEQ ID NO: 843961 - protein, 9 aa, Homo Sapiens
IPLELFAVV

SEQ ID NO: 843962 - protein, 9 aa, Homo Sapiens
INLNKVKTK

SEQ ID NO: 843963 - protein, 9 aa, Homo Sapiens
AKARAEART

SEQ ID NO: 843964 - protein, 9 aa, Homo Sapiens
KLKREYEVK

SEQ ID NO: 843965 - protein, 9 aa, Homo Sapiens
YPFRSCTIR

SEQ ID NO: 843966 - protein, 9 aa, Homo Sapiens
LSPTEINVV

SEQ ID NO: 843967 - protein, 9 aa, Homo Sapiens
QLTEDDLIL

SEQ ID NO: 843968 - protein, 9 aa, Homo Sapiens
ALICSFHPS

SEQ ID NO: 843969 - protein, 9 aa, Homo Sapiens
DRNSPSFDA

SEQ ID NO: 843970 - protein, 9 aa, Homo Sapiens
LLEAWNNEV

SEQ ID NO: 843971 - protein, 9 aa, Homo Sapiens
IFNEAEKLH

SEQ ID NO: 843972 - protein, 9 aa, Homo Sapiens
SQFENSVYE

SEQ ID NO: 843973 - protein, 9 aa, Homo Sapiens
REQWLQKIK

SEQ ID NO: 843974 - protein, 9 aa, Homo Sapiens
PIENMVNPR

SEQ ID NO: 843975 - protein, 9 aa, Homo Sapiens
EFTRDEWQH

SEQ ID NO: 843976 - protein, 9 aa, Homo Sapiens
GEITCALNN

SEQ ID NO: 843977 - protein, 9 aa, Homo Sapiens
SCWDEYNGF

SEQ ID NO: 843978 - protein, 9 aa, Homo Sapiens
QTDADPAKE

SEQ ID NO: 843979 - protein, 9 aa, Homo Sapiens
LCSSILGPI

SEQ ID NO: 843980 - protein, 9 aa, Homo Sapiens
RYKHIDHTF

SEQ ID NO: 843981 - protein, 9 aa, Homo Sapiens
CNKCEFLVG

SEQ ID NO: 843982 - protein, 9 aa, Homo Sapiens
FPEERYDSH

SEQ ID NO: 843983 - protein, 9 aa, Homo Sapiens
YVGAQDHIF

SEQ ID NO: 843984 - protein, 9 aa, Homo Sapiens
TDTKKESKK

SEQ ID NO: 843985 - protein, 9 aa, Homo Sapiens
ITTLTFPFR

SEQ ID NO: 843986 - protein, 9 aa, Homo Sapiens
VLPSLLKKY

SEQ ID NO: 843987 - protein, 9 aa, Homo Sapiens
DNPMVGALC

SEQ ID NO: 843988 - protein, 9 aa, Homo Sapiens
QSRTDNGIF

SEQ ID NO: 843989 - protein, 9 aa, Homo Sapiens
GCTLVLDTM

SEQ ID NO: 843990 - protein, 9 aa, Homo Sapiens
TETTSTTLK

SEQ ID NO: 843991 - protein, 9 aa, Homo Sapiens
YWAKRKFGF

SEQ ID NO: 843992 - protein, 9 aa, Homo Sapiens
MCNFAEKVF

SEQ ID NO: 843993 - protein, 9 aa, Homo Sapiens
IRTASEPYH

SEQ ID NO: 843994 - protein, 9 aa, Homo Sapiens
KLRIQSSFV

SEQ ID NO: 843995 - protein, 9 aa, Homo Sapiens
LENAMLCAG

SEQ ID NO: 843996 - protein, 9 aa, Homo Sapiens
GGASRDVWM

SEQ ID NO: 843997 - protein, 9 aa, Homo Sapiens
QRPVNHSYP

SEQ ID NO: 843998 - protein, 9 aa, Homo Sapiens
DEMDIYGYN

SEQ ID NO: 843999 - protein, 9 aa, Homo Sapiens
EDMLDNPLN

SEQ ID NO: 844000 - protein, 9 aa, Homo Sapiens
QNISEELQI

SEQ ID NO: 844001 - protein, 9 aa, Homo Sapiens
GEIIEWIDY

SEQ ID NO: 844002 - protein, 9 aa, Homo Sapiens
ALRFTMLRA

SEQ ID NO: 844003 - protein, 9 aa, Homo Sapiens
LCAAVFLQM

SEQ ID NO: 844004 - protein, 9 aa, Homo Sapiens
LSEEKANGP

SEQ ID NO: 844005 - protein, 9 aa, Homo Sapiens
WHEMDADNP

SEQ ID NO: 844006 - protein, 9 aa, Homo Sapiens
VCKQCKNLT

SEQ ID NO: 844007 - protein, 9 aa, Homo Sapiens
SVIQALYFC

SEQ ID NO: 844008 - protein, 9 aa, Homo Sapiens
KGANGEAGL

SEQ ID NO: 844009 - protein, 9 aa, Homo Sapiens
PGLYQPICS

SEQ ID NO: 844010 - protein, 9 aa, Homo Sapiens
LIQNLPKPI

SEQ ID NO: 844011 - protein, 9 aa, Homo Sapiens
KQTEWIANC

SEQ ID NO: 844012 - protein, 9 aa, Homo Sapiens
RKNEQSVSA

SEQ ID NO: 844013 - protein, 9 aa, Homo Sapiens
LLSSLLGGF

SEQ ID NO: 844014 - protein, 9 aa, Homo Sapiens
TMNPLLYSI

SEQ ID NO: 844015 - protein, 9 aa, Homo Sapiens
IYLSNHYKN

SEQ ID NO: 844016 - protein, 9 aa, Homo Sapiens
LFKDEFSPM

SEQ ID NO: 844017 - protein, 9 aa, Homo Sapiens
LNTFIYSLR

SEQ ID NO: 844018 - protein, 9 aa, Homo Sapiens
RDLDAQAKN

SEQ ID NO: 844019 - protein, 9 aa, Homo Sapiens
LQTVEIETQ

SEQ ID NO: 844020 - protein, 9 aa, Homo Sapiens
KLQVIGLCK

SEQ ID NO: 844021 - protein, 9 aa, Homo Sapiens
EYLSKQEVD

SEQ ID NO: 844022 - protein, 9 aa, Homo Sapiens
NQSQQLEQP

SEQ ID NO: 844023 - protein, 9 aa, Homo Sapiens
GTLQLLDAV

SEQ ID NO: 844024 - protein, 9 aa, Homo Sapiens
FDKMIEASK

SEQ ID NO: 844025 - protein, 9 aa, Homo Sapiens
AEPSASAPI

SEQ ID NO: 844026 - protein, 9 aa, Homo Sapiens
DNPLHQPSP

SEQ ID NO: 844027 - protein, 9 aa, Homo Sapiens
YLAPQNLPS

SEQ ID NO: 844028 - protein, 9 aa, Homo Sapiens
NFGKTWGVY

SEQ ID NO: 844029 - protein, 9 aa, Homo Sapiens
QLGMQALVE

SEQ ID NO: 844030 - protein, 9 aa, Homo Sapiens
EDKTLELEG

SEQ ID NO: 844031 - protein, 9 aa, Homo Sapiens
HIYNRYQKE

SEQ ID NO: 844032 - protein, 9 aa, Homo Sapiens
CYHDHRSVC

SEQ ID NO: 844033 - protein, 9 aa, Homo Sapiens
ANIEDEKKD

SEQ ID NO: 844034 - protein, 9 aa, Homo Sapiens
SATVTLHVL

SEQ ID NO: 844035 - protein, 9 aa, Homo Sapiens
DSHKTIASL

SEQ ID NO: 844036 - protein, 9 aa, Homo Sapiens
GFYNSNPAQ

SEQ ID NO: 844037 - protein, 9 aa, Homo Sapiens
RTGHYSTVK

SEQ ID NO: 844038 - protein, 9 aa, Homo Sapiens
KIIPLPGRL

SEQ ID NO: 844039 - protein, 9 aa, Homo Sapiens
KRDLINFLK

SEQ ID NO: 844040 - protein, 9 aa, Homo Sapiens
DKEKEEKES

SEQ ID NO: 844041 - protein, 9 aa, Homo Sapiens
VVPTPPLPS

SEQ ID NO: 844042 - protein, 9 aa, Homo Sapiens
KQCNRENNR

SEQ ID NO: 844043 - protein, 9 aa, Homo Sapiens
FFKTRYCSM

SEQ ID NO: 844044 - protein, 9 aa, Homo Sapiens
TNCCQESAA

SEQ ID NO: 844045 - protein, 9 aa, Homo Sapiens
IFKANDLFE

SEQ ID NO: 844046 - protein, 9 aa, Homo Sapiens
CELWLERGA

SEQ ID NO: 844047 - protein, 9 aa, Homo Sapiens
VQQQFCGKY

SEQ ID NO: 844048 - protein, 9 aa, Homo Sapiens
VEAGGVTGK

SEQ ID NO: 844049 - protein, 9 aa, Homo Sapiens
TTPEQLYAA

SEQ ID NO: 844050 - protein, 9 aa, Homo Sapiens
RYAAELEAC

SEQ ID NO: 844051 - protein, 9 aa, Homo Sapiens
GFYVRLIDS

SEQ ID NO: 844052 - protein, 9 aa, Homo Sapiens
CKRLSPDWC

SEQ ID NO: 844053 - protein, 9 aa, Homo Sapiens
LGFHGQTGP

SEQ ID NO: 844054 - protein, 9 aa, Homo Sapiens
VTSIPFSVK

SEQ ID NO: 844055 - protein, 9 aa, Homo Sapiens
YYMLICLVL

SEQ ID NO: 844056 - protein, 9 aa, Homo Sapiens
QVKHRCVTN

SEQ ID NO: 844057 - protein, 9 aa, Homo Sapiens
GKFRTTFDS

SEQ ID NO: 844058 - protein, 9 aa, Homo Sapiens
FIMFTVDAM

SEQ ID NO: 844059 - protein, 9 aa, Homo Sapiens
DEFILKKVN

SEQ ID NO: 844060 - protein, 9 aa, Homo Sapiens
DMATHPAGQ

SEQ ID NO: 844061 - protein, 9 aa, Homo Sapiens
HPGMGDALN

SEQ ID NO: 844062 - protein, 9 aa, Homo Sapiens
EELCNEGQI

SEQ ID NO: 844063 - protein, 9 aa, Homo Sapiens
SVVFLLLFA

SEQ ID NO: 844064 - protein, 9 aa, Homo Sapiens
FLDVPTNNQ

SEQ ID NO: 844065 - protein, 9 aa, Homo Sapiens
NMSLFDEYF

SEQ ID NO: 844066 - protein, 9 aa, Homo Sapiens
DFGQKRATI

SEQ ID NO: 844067 - protein, 9 aa, Homo Sapiens
IVQCHEHIE

SEQ ID NO: 844068 - protein, 9 aa, Homo Sapiens
EEKKTCHAR

SEQ ID NO: 844069 - protein, 9 aa, Homo Sapiens
MYLGFKRGA

SEQ ID NO: 844070 - protein, 9 aa, Homo Sapiens
GVDTVVALL

SEQ ID NO: 844071 - protein, 9 aa, Homo Sapiens
NNNPPNNDD

SEQ ID NO: 844072 - protein, 9 aa, Homo Sapiens
TRERKGLYI

SEQ ID NO: 844073 - protein, 9 aa, Homo Sapiens
EDIYLDTPF

SEQ ID NO: 844074 - protein, 9 aa, Homo Sapiens
TVLTFTLCS

SEQ ID NO: 844075 - protein, 9 aa, Homo Sapiens
KPMWPKGWM

SEQ ID NO: 844076 - protein, 9 aa, Homo Sapiens
TNQSHNPAT

SEQ ID NO: 844077 - protein, 9 aa, Homo Sapiens
GADTVGMST

SEQ ID NO: 844078 - protein, 9 aa, Homo Sapiens
YKDLKTKLN

SEQ ID NO: 844079 - protein, 9 aa, Homo Sapiens
QFNMFASVF

SEQ ID NO: 844080 - protein, 9 aa, Homo Sapiens
YAKIKEEII

SEQ ID NO: 844081 - protein, 9 aa, Homo Sapiens
CAGRSKKET

SEQ ID NO: 844082 - protein, 9 aa, Homo Sapiens
WGAINGEVG

SEQ ID NO: 844083 - protein, 8 aa, Homo Sapiens
DSDFSHAF

SEQ ID NO: 844084 - protein, 9 aa, Homo Sapiens
IIDPNYRFP

SEQ ID NO: 844085 - protein, 9 aa, Homo Sapiens
TVNVASRID

SEQ ID NO: 844086 - protein, 9 aa, Homo Sapiens
FKLCGSGNG

SEQ ID NO: 844087 - protein, 9 aa, Homo Sapiens
FMLYQTYMT

SEQ ID NO: 844088 - protein, 9 aa, Homo Sapiens
SEKLNLQKY

SEQ ID NO: 844089 - protein, 9 aa, Homo Sapiens
AANTGVTAS

SEQ ID NO: 844090 - protein, 9 aa, Homo Sapiens
RLFKWQHQN

SEQ ID NO: 844091 - protein, 9 aa, Homo Sapiens
YAGYIENLK

SEQ ID NO: 844092 - protein, 9 aa, Homo Sapiens
LEDRVEDLW

SEQ ID NO: 844093 - protein, 9 aa, Homo Sapiens
HVKYGQCWV

SEQ ID NO: 844094 - protein, 9 aa, Homo Sapiens
SHLYWLDSK

SEQ ID NO: 844095 - protein, 9 aa, Homo Sapiens
ELQAVSPSQ

SEQ ID NO: 844096 - protein, 9 aa, Homo Sapiens
ESRGREGAK

SEQ ID NO: 844097 - protein, 9 aa, Homo Sapiens
KESEIIYFF

SEQ ID NO: 844098 - protein, 9 aa, Homo Sapiens
WDKAHVKCK

SEQ ID NO: 844099 - protein, 9 aa, Homo Sapiens
EEDADEWQA

SEQ ID NO: 844100 - protein, 9 aa, Homo Sapiens
WLYLTAETV

SEQ ID NO: 844101 - protein, 9 aa, Homo Sapiens
PLKDEFNNT

SEQ ID NO: 844102 - protein, 9 aa, Homo Sapiens
ARKMCNYNK

SEQ ID NO: 844103 - protein, 9 aa, Homo Sapiens
LERLQIYRE

SEQ ID NO: 844104 - protein, 9 aa, Homo Sapiens
VVRRQIGEL

SEQ ID NO: 844105 - protein, 9 aa, Homo Sapiens
NPYNKTISP

SEQ ID NO: 844106 - protein, 9 aa, Homo Sapiens
KLWKEMSAK

SEQ ID NO: 844107 - protein, 9 aa, Homo Sapiens
YIKRYFELY

SEQ ID NO: 844108 - protein, 9 aa, Homo Sapiens
ELDILFPPS

SEQ ID NO: 844109 - protein, 9 aa, Homo Sapiens
KFLARTKFK

SEQ ID NO: 844110 - protein, 9 aa, Homo Sapiens
KGLMRQRQQ

SEQ ID NO: 844111 - protein, 9 aa, Homo Sapiens
PVATFLDIP

SEQ ID NO: 844112 - protein, 9 aa, Homo Sapiens
RGASLLTLN

SEQ ID NO: 844113 - protein, 9 aa, Homo Sapiens
CNECGKLFL

SEQ ID NO: 844114 - protein, 9 aa, Homo Sapiens
LVTEEVISV

SEQ ID NO: 844115 - protein, 9 aa, Homo Sapiens
RELCTLENV

SEQ ID NO: 844116 - protein, 9 aa, Homo Sapiens
NYQVHQSRV

SEQ ID NO: 844117 - protein, 9 aa, Homo Sapiens
STSSGRSGR

SEQ ID NO: 844118 - protein, 9 aa, Homo Sapiens
LDYLTYKID

SEQ ID NO: 844119 - protein, 9 aa, Homo Sapiens
TNHWAVLSP

SEQ ID NO: 844120 - protein, 9 aa, Homo Sapiens
NENRTINPD

SEQ ID NO: 844121 - protein, 9 aa, Homo Sapiens
QTDNLQSLT

SEQ ID NO: 844122 - protein, 9 aa, Homo Sapiens
NQIIKLEIL

SEQ ID NO: 844123 - protein, 9 aa, Homo Sapiens
NTGQLDCFK

SEQ ID NO: 844124 - protein, 9 aa, Homo Sapiens
SHQDNEDRN

SEQ ID NO: 844125 - protein, 9 aa, Homo Sapiens
HGEEMYCKS

SEQ ID NO: 844126 - protein, 9 aa, Homo Sapiens
NVWIGLHYP

SEQ ID NO: 844127 - protein, 9 aa, Homo Sapiens
DSKKIARIA

SEQ ID NO: 844128 - protein, 9 aa, Homo Sapiens
DEDWHYMQK

SEQ ID NO: 844129 - protein, 9 aa, Homo Sapiens
GCFDHAHRQ

SEQ ID NO: 844130 - protein, 9 aa, Homo Sapiens
GLSLIDYFV

SEQ ID NO: 844131 - protein, 9 aa, Homo Sapiens
FCYVFTGEL

SEQ ID NO: 844132 - protein, 9 aa, Homo Sapiens
KITKPNKRK

SEQ ID NO: 844133 - protein, 9 aa, Homo Sapiens
TLTYGSLDE

SEQ ID NO: 844134 - protein, 9 aa, Homo Sapiens
IKDLSAIQA

SEQ ID NO: 844135 - protein, 9 aa, Homo Sapiens
LHVHMEVPG

SEQ ID NO: 844136 - protein, 9 aa, Homo Sapiens
MLKWLYGLL

SEQ ID NO: 844137 - protein, 9 aa, Homo Sapiens
ILLLRNNGL

SEQ ID NO: 844138 - protein, 9 aa, Homo Sapiens
RKNLTCAHT

SEQ ID NO: 844139 - protein, 9 aa, Homo Sapiens
NDQLFGYMQ

SEQ ID NO: 844140 - protein, 9 aa, Homo Sapiens
NPDPQGLPG

SEQ ID NO: 844141 - protein, 9 aa, Homo Sapiens
NIFELEAIM

SEQ ID NO: 844142 - protein, 9 aa, Homo Sapiens
LDLIKSHLY

SEQ ID NO: 844143 - protein, 9 aa, Homo Sapiens
WVTDTFPNT

SEQ ID NO: 844144 - protein, 9 aa, Homo Sapiens
SFTATAKFR

SEQ ID NO: 844145 - protein, 9 aa, Homo Sapiens
VNHTNIISL

SEQ ID NO: 844146 - protein, 9 aa, Homo Sapiens
HMRDKSYEC

SEQ ID NO: 844147 - protein, 9 aa, Homo Sapiens
NTPKEKEEF

SEQ ID NO: 844148 - protein, 9 aa, Homo Sapiens
PVGTQVAAP

SEQ ID NO: 844149 - protein, 9 aa, Homo Sapiens
VVASVSLLM

SEQ ID NO: 844150 - protein, 9 aa, Homo Sapiens
FGQKRATIQ

SEQ ID NO: 844151 - protein, 9 aa, Homo Sapiens
QYGKVLDCD

SEQ ID NO: 844152 - protein, 9 aa, Homo Sapiens
DILEQEYNK

SEQ ID NO: 844153 - protein, 9 aa, Homo Sapiens
PGAKELPAR

SEQ ID NO: 844154 - protein, 9 aa, Homo Sapiens
CTMHSLTIQ

SEQ ID NO: 844155 - protein, 9 aa, Homo Sapiens
ACFGEISIG

SEQ ID NO: 844156 - protein, 9 aa, Homo Sapiens
KMNYRVVGG

SEQ ID NO: 844157 - protein, 9 aa, Homo Sapiens
TNNLSPKEN

SEQ ID NO: 844158 - protein, 9 aa, Homo Sapiens
KRTITFHLD

SEQ ID NO: 844159 - protein, 9 aa, Homo Sapiens
SIYGDTFPD

SEQ ID NO: 844160 - protein, 9 aa, Homo Sapiens
KKVYTGVKP

SEQ ID NO: 844161 - protein, 9 aa, Homo Sapiens
ERSFEILTK

SEQ ID NO: 844162 - protein, 9 aa, Homo Sapiens
QVHQSRVTM

SEQ ID NO: 844163 - protein, 9 aa, Homo Sapiens
WFINARRII

SEQ ID NO: 844164 - protein, 9 aa, Homo Sapiens
IVLGYLGCY

SEQ ID NO: 844165 - protein, 9 aa, Homo Sapiens
RTENRREMG

SEQ ID NO: 844166 - protein, 9 aa, Homo Sapiens
HPDANPMEH

SEQ ID NO: 844167 - protein, 9 aa, Homo Sapiens
LWVLRARQQ

SEQ ID NO: 844168 - protein, 9 aa, Homo Sapiens
HSLRHGNWY

SEQ ID NO: 844169 - protein, 9 aa, Homo Sapiens
AQNKSLNLK

SEQ ID NO: 844170 - protein, 9 aa, Homo Sapiens
VNKQCVGET

SEQ ID NO: 844171 - protein, 9 aa, Homo Sapiens
TVHLVGLLS

SEQ ID NO: 844172 - protein, 9 aa, Homo Sapiens
PPRWAEYQN

SEQ ID NO: 844173 - protein, 9 aa, Homo Sapiens
CCEECTFMA

SEQ ID NO: 844174 - protein, 9 aa, Homo Sapiens
VCQCRRNNY

SEQ ID NO: 844175 - protein, 9 aa, Homo Sapiens
IKAIDGLDR

SEQ ID NO: 844176 - protein, 9 aa, Homo Sapiens
WPKMLKCDK

SEQ ID NO: 844177 - protein, 9 aa, Homo Sapiens
TSINTAIIE

SEQ ID NO: 844178 - protein, 9 aa, Homo Sapiens
FTLYNNNIE

SEQ ID NO: 844179 - protein, 9 aa, Homo Sapiens
CLSPLLFLE

SEQ ID NO: 844180 - protein, 9 aa, Homo Sapiens
EDMQEIIHN

SEQ ID NO: 844181 - protein, 9 aa, Homo Sapiens
IHLYQALAR

SEQ ID NO: 844182 - protein, 9 aa, Homo Sapiens
ASALGMVLL

SEQ ID NO: 844183 - protein, 9 aa, Homo Sapiens
DTGCPAIIQ

SEQ ID NO: 844184 - protein, 9 aa, Homo Sapiens
DLKTVDSTK

SEQ ID NO: 844185 - protein, 9 aa, Homo Sapiens
ATYDLPATI

SEQ ID NO: 844186 - protein, 9 aa, Homo Sapiens
SALPTLTWF

SEQ ID NO: 844187 - protein, 9 aa, Homo Sapiens
RASLNPRAK

SEQ ID NO: 844188 - protein, 9 aa, Homo Sapiens
SKERPKRNV

SEQ ID NO: 844189 - protein, 9 aa, Homo Sapiens
KNLCKAMEN

SEQ ID NO: 844190 - protein, 9 aa, Homo Sapiens
HAERVQAAN

SEQ ID NO: 844191 - protein, 9 aa, Homo Sapiens
NLEYKLYGG

SEQ ID NO: 844192 - protein, 9 aa, Homo Sapiens
YNNVSEDLP

SEQ ID NO: 844193 - protein, 9 aa, Homo Sapiens
QTEVSYLEI

SEQ ID NO: 844194 - protein, 9 aa, Homo Sapiens
FKCQCPNLY

SEQ ID NO: 844195 - protein, 9 aa, Homo Sapiens
KKFYFPQCG

SEQ ID NO: 844196 - protein, 9 aa, Homo Sapiens
NQAVDIWSV

SEQ ID NO: 844197 - protein, 9 aa, Homo Sapiens
LEEKKTCHA

SEQ ID NO: 844198 - protein, 9 aa, Homo Sapiens
MLSDLNCVD

SEQ ID NO: 844199 - protein, 9 aa, Homo Sapiens
VQRYDNSAH

SEQ ID NO: 844200 - protein, 9 aa, Homo Sapiens
MEGSVPAVT

SEQ ID NO: 844201 - protein, 9 aa, Homo Sapiens
QFYMKLLYF

SEQ ID NO: 844202 - protein, 9 aa, Homo Sapiens
RERRKEQEH

SEQ ID NO: 844203 - protein, 9 aa, Homo Sapiens
KRTCSIPKS

SEQ ID NO: 844204 - protein, 9 aa, Homo Sapiens
APMQAMWLG

SEQ ID NO: 844205 - protein, 9 aa, Homo Sapiens
EREFGAVFR

SEQ ID NO: 844206 - protein, 9 aa, Homo Sapiens
RVAEELTLE

SEQ ID NO: 844207 - protein, 9 aa, Homo Sapiens
IKSLSDQVL

SEQ ID NO: 844208 - protein, 9 aa, Homo Sapiens
MLDLDDNDD

SEQ ID NO: 844209 - protein, 9 aa, Homo Sapiens
KNVVSEPIK

SEQ ID NO: 844210 - protein, 9 aa, Homo Sapiens
SKGYGLVSF

SEQ ID NO: 844211 - protein, 9 aa, Homo Sapiens
MHSQRVMHR

SEQ ID NO: 844212 - protein, 9 aa, Homo Sapiens
YVEQRKKIC

SEQ ID NO: 844213 - protein, 9 aa, Homo Sapiens
ETPTKSLLD

SEQ ID NO: 844214 - protein, 9 aa, Homo Sapiens
NQYTIDYSH

SEQ ID NO: 844215 - protein, 9 aa, Homo Sapiens
CGLPREYAF

SEQ ID NO: 844216 - protein, 9 aa, Homo Sapiens
QRHLEKSEE

SEQ ID NO: 844217 - protein, 9 aa, Homo Sapiens
HPEVVYTNQ

SEQ ID NO: 844218 - protein, 9 aa, Homo Sapiens
KLHTADKPY

SEQ ID NO: 844219 - protein, 9 aa, Homo Sapiens
SSKIKQISR

SEQ ID NO: 844220 - protein, 9 aa, Homo Sapiens
NIQHINIIY

SEQ ID NO: 844221 - protein, 9 aa, Homo Sapiens
VPPDLAFNK

SEQ ID NO: 844222 - protein, 9 aa, Homo Sapiens
LQATPSSVS

SEQ ID NO: 844223 - protein, 9 aa, Homo Sapiens
GSLTPCLYT

SEQ ID NO: 844224 - protein, 9 aa, Homo Sapiens
HMHSQRVMH

SEQ ID NO: 844225 - protein, 9 aa, Homo Sapiens
GGYTCEDNS

SEQ ID NO: 844226 - protein, 9 aa, Homo Sapiens
KISNPTELQ

SEQ ID NO: 844227 - protein, 9 aa, Homo Sapiens
IMEISAPLP

SEQ ID NO: 844228 - protein, 9 aa, Homo Sapiens
RTSTIRKVQ

SEQ ID NO: 844229 - protein, 9 aa, Homo Sapiens
EALEPMPFQ

SEQ ID NO: 844230 - protein, 9 aa, Homo Sapiens
HECCKRVVI

SEQ ID NO: 844231 - protein, 9 aa, Homo Sapiens
PKTNHHMQC

SEQ ID NO: 844232 - protein, 9 aa, Homo Sapiens
IQTIHKYAF

SEQ ID NO: 844233 - protein, 9 aa, Homo Sapiens
LEQQNTVLE

SEQ ID NO: 844234 - protein, 9 aa, Homo Sapiens
PTVDYYPNR

SEQ ID NO: 844235 - protein, 9 aa, Homo Sapiens
YQPSAELFP

SEQ ID NO: 844236 - protein, 9 aa, Homo Sapiens
TINMPNTLV

SEQ ID NO: 844237 - protein, 9 aa, Homo Sapiens
VETPRPTWK

SEQ ID NO: 844238 - protein, 9 aa, Homo Sapiens
SKPLEEDIH

SEQ ID NO: 844239 - protein, 9 aa, Homo Sapiens
RKALESMDL

SEQ ID NO: 844240 - protein, 9 aa, Homo Sapiens
ANVSYPEVF

SEQ ID NO: 844241 - protein, 9 aa, Homo Sapiens
SLLGSQKSD

SEQ ID NO: 844242 - protein, 9 aa, Homo Sapiens
LFTSNSLSV

SEQ ID NO: 844243 - protein, 9 aa, Homo Sapiens
MTDFKLHVL

SEQ ID NO: 844244 - protein, 9 aa, Homo Sapiens
RDKHHLTDL

SEQ ID NO: 844245 - protein, 9 aa, Homo Sapiens
RRSLMPVSG

SEQ ID NO: 844246 - protein, 9 aa, Homo Sapiens
NKVYTKSYH

SEQ ID NO: 844247 - protein, 9 aa, Homo Sapiens
RQAQEKSGK

SEQ ID NO: 844248 - protein, 9 aa, Homo Sapiens
QKDAERRYL

SEQ ID NO: 844249 - protein, 9 aa, Homo Sapiens
VYSEERLLR

SEQ ID NO: 844250 - protein, 9 aa, Homo Sapiens
IITQMQRLT

SEQ ID NO: 844251 - protein, 9 aa, Homo Sapiens
TSCPGCQKP

SEQ ID NO: 844252 - protein, 9 aa, Homo Sapiens
MCDVFTQFY

SEQ ID NO: 844253 - protein, 9 aa, Homo Sapiens
VLSTSTGFG

SEQ ID NO: 844254 - protein, 9 aa, Homo Sapiens
QSNLRALRK

SEQ ID NO: 844255 - protein, 9 aa, Homo Sapiens
WLCWKLVSP

SEQ ID NO: 844256 - protein, 9 aa, Homo Sapiens
EELAFTDSR

SEQ ID NO: 844257 - protein, 9 aa, Homo Sapiens
SHNPATTNQ

SEQ ID NO: 844258 - protein, 9 aa, Homo Sapiens
GKVHSIVRL

SEQ ID NO: 844259 - protein, 9 aa, Homo Sapiens
TSSLIPTHT

SEQ ID NO: 844260 - protein, 9 aa, Homo Sapiens
SCQTLKLHK

SEQ ID NO: 844261 - protein, 9 aa, Homo Sapiens
SFKKTKTSE

SEQ ID NO: 844262 - protein, 9 aa, Homo Sapiens
DRVVAISCP

SEQ ID NO: 844263 - protein, 9 aa, Homo Sapiens
HTNGADIDA

SEQ ID NO: 844264 - protein, 9 aa, Homo Sapiens
DEEEEECIE

SEQ ID NO: 844265 - protein, 9 aa, Homo Sapiens
PNSVDGLLN

SEQ ID NO: 844266 - protein, 9 aa, Homo Sapiens
HRLLETSNA

SEQ ID NO: 844267 - protein, 9 aa, Homo Sapiens
GNTTAGGGP

SEQ ID NO: 844268 - protein, 9 aa, Homo Sapiens
ETMSKIVEL

SEQ ID NO: 844269 - protein, 9 aa, Homo Sapiens
SELLGTFIL

SEQ ID NO: 844270 - protein, 9 aa, Homo Sapiens
MPVKKKRKF

SEQ ID NO: 844271 - protein, 9 aa, Homo Sapiens
QVENSKRVR

SEQ ID NO: 844272 - protein, 9 aa, Homo Sapiens
SKALKKKIH

SEQ ID NO: 844273 - protein, 9 aa, Homo Sapiens
HIKRVTLHE

SEQ ID NO: 844274 - protein, 9 aa, Homo Sapiens
PVCRQPSQM

SEQ ID NO: 844275 - protein, 9 aa, Homo Sapiens
FTINMVTDE

SEQ ID NO: 844276 - protein, 9 aa, Homo Sapiens
QNKMAECEA

SEQ ID NO: 844277 - protein, 9 aa, Homo Sapiens
KQIDTPSLE

SEQ ID NO: 844278 - protein, 9 aa, Homo Sapiens
SEYIEEHVE

SEQ ID NO: 844279 - protein, 9 aa, Homo Sapiens
GLDTMLITV

SEQ ID NO: 844280 - protein, 9 aa, Homo Sapiens
MLPFHHRNP

SEQ ID NO: 844281 - protein, 9 aa, Homo Sapiens
LPVKLAQCQ

SEQ ID NO: 844282 - protein, 9 aa, Homo Sapiens
DSGRKILSA

SEQ ID NO: 844283 - protein, 9 aa, Homo Sapiens
VIPSILIIL

SEQ ID NO: 844284 - protein, 9 aa, Homo Sapiens
YTSPLINMF

SEQ ID NO: 844285 - protein, 9 aa, Homo Sapiens
DTIISVLAY

SEQ ID NO: 844286 - protein, 9 aa, Homo Sapiens
ASLHYRFAR

SEQ ID NO: 844287 - protein, 9 aa, Homo Sapiens
NGNFGSNFV

SEQ ID NO: 844288 - protein, 9 aa, Homo Sapiens
VTSGTRTVV

SEQ ID NO: 844289 - protein, 9 aa, Homo Sapiens
AGQSQVKEI

SEQ ID NO: 844290 - protein, 9 aa, Homo Sapiens
PLSVTVLQP

SEQ ID NO: 844291 - protein, 9 aa, Homo Sapiens
WDHTQCRKI

SEQ ID NO: 844292 - protein, 9 aa, Homo Sapiens
MKHLNAITG

SEQ ID NO: 844293 - protein, 9 aa, Homo Sapiens
CSGPVDEGE

SEQ ID NO: 844294 - protein, 9 aa, Homo Sapiens
TFLDIIDAV

SEQ ID NO: 844295 - protein, 9 aa, Homo Sapiens
IHYMASFLV

SEQ ID NO: 844296 - protein, 9 aa, Homo Sapiens
VRVIILAFS

SEQ ID NO: 844297 - protein, 9 aa, Homo Sapiens
FHSANGVIL

SEQ ID NO: 844298 - protein, 9 aa, Homo Sapiens
QHVLYKLNN

SEQ ID NO: 844299 - protein, 9 aa, Homo Sapiens
HYFKGYFLE

SEQ ID NO: 844300 - protein, 9 aa, Homo Sapiens
CTEDSYTAE

SEQ ID NO: 844301 - protein, 9 aa, Homo Sapiens
LVHEGYTFM

SEQ ID NO: 844302 - protein, 9 aa, Homo Sapiens
FANLTRVET

SEQ ID NO: 844303 - protein, 9 aa, Homo Sapiens
LNPTDAPHA

SEQ ID NO: 844304 - protein, 9 aa, Homo Sapiens
QLDQLSCLG

SEQ ID NO: 844305 - protein, 9 aa, Homo Sapiens
VKATQICAS

SEQ ID NO: 844306 - protein, 9 aa, Homo Sapiens
EVPGADGCN

SEQ ID NO: 844307 - protein, 9 aa, Homo Sapiens
LLVVAIILA

SEQ ID NO: 844308 - protein, 9 aa, Homo Sapiens
QMPGGTLSL

SEQ ID NO: 844309 - protein, 9 aa, Homo Sapiens
EKEDYIVYL

SEQ ID NO: 844310 - protein, 9 aa, Homo Sapiens
FCSVRAIRI

SEQ ID NO: 844311 - protein, 9 aa, Homo Sapiens
KNFSQSQYL

SEQ ID NO: 844312 - protein, 9 aa, Homo Sapiens
HKEVDHLFC

SEQ ID NO: 844313 - protein, 9 aa, Homo Sapiens
EAGETMVRE

SEQ ID NO: 844314 - protein, 9 aa, Homo Sapiens
SFSAFQELP

SEQ ID NO: 844315 - protein, 9 aa, Homo Sapiens
SLIIVIVSY

SEQ ID NO: 844316 - protein, 9 aa, Homo Sapiens
HSQRVMHRD

SEQ ID NO: 844317 - protein, 9 aa, Homo Sapiens
NKECSILLS

SEQ ID NO: 844318 - protein, 9 aa, Homo Sapiens
NTCYCNSVI

SEQ ID NO: 844319 - protein, 9 aa, Homo Sapiens
ATQIKNTNR

SEQ ID NO: 844320 - protein, 9 aa, Homo Sapiens
AELLTEKES

SEQ ID NO: 844321 - protein, 9 aa, Homo Sapiens
LIQPLNRRA

SEQ ID NO: 844322 - protein, 9 aa, Homo Sapiens
NFNLPAENL

SEQ ID NO: 844323 - protein, 9 aa, Homo Sapiens
RAEYGWLGL

SEQ ID NO: 844324 - protein, 9 aa, Homo Sapiens
KVKAMQSNG

SEQ ID NO: 844325 - protein, 9 aa, Homo Sapiens
HYEIKDIHV

SEQ ID NO: 844326 - protein, 9 aa, Homo Sapiens
KYGYSTVTV

SEQ ID NO: 844327 - protein, 9 aa, Homo Sapiens
TFALLFGRQ

SEQ ID NO: 844328 - protein, 9 aa, Homo Sapiens
YILEVVQTG

SEQ ID NO: 844329 - protein, 9 aa, Homo Sapiens
LNLGKVHSI

SEQ ID NO: 844330 - protein, 9 aa, Homo Sapiens
FTFHLDSLP

SEQ ID NO: 844331 - protein, 9 aa, Homo Sapiens
TIFLFKFLF

SEQ ID NO: 844332 - protein, 9 aa, Homo Sapiens
LSANALGKY

SEQ ID NO: 844333 - protein, 9 aa, Homo Sapiens
DASENRLER

SEQ ID NO: 844334 - protein, 9 aa, Homo Sapiens
PEETTEFQL

SEQ ID NO: 844335 - protein, 9 aa, Homo Sapiens
LELLQRKQN

SEQ ID NO: 844336 - protein, 9 aa, Homo Sapiens
KCSDCGKCF

SEQ ID NO: 844337 - protein, 9 aa, Homo Sapiens
ISFNLFVTA

SEQ ID NO: 844338 - protein, 9 aa, Homo Sapiens
DDEKMQNTG

SEQ ID NO: 844339 - protein, 9 aa, Homo Sapiens
PQVFSFFPA

SEQ ID NO: 844340 - protein, 9 aa, Homo Sapiens
DTLQDVLSL

SEQ ID NO: 844341 - protein, 9 aa, Homo Sapiens
GNITIIPLI

SEQ ID NO: 844342 - protein, 9 aa, Homo Sapiens
AQTTEWSAC

SEQ ID NO: 844343 - protein, 9 aa, Homo Sapiens
HKQGDKSKE

SEQ ID NO: 844344 - protein, 9 aa, Homo Sapiens
SRLKTVISS

SEQ ID NO: 844345 - protein, 9 aa, Homo Sapiens
KRRREINKI

SEQ ID NO: 844346 - protein, 9 aa, Homo Sapiens
EALIHLDDM

SEQ ID NO: 844347 - protein, 9 aa, Homo Sapiens
TPEYTVADV

SEQ ID NO: 844348 - protein, 9 aa, Homo Sapiens
ECVGQEVLL

SEQ ID NO: 844349 - protein, 9 aa, Homo Sapiens
GEVSSDDDL

SEQ ID NO: 844350 - protein, 9 aa, Homo Sapiens
GIYAIAVVL

SEQ ID NO: 844351 - protein, 9 aa, Homo Sapiens
SRQIRQFHS

SEQ ID NO: 844352 - protein, 9 aa, Homo Sapiens
HNFARQDLT

SEQ ID NO: 844353 - protein, 9 aa, Homo Sapiens
GEKVKHEII

SEQ ID NO: 844354 - protein, 9 aa, Homo Sapiens
ERCPERQSG

SEQ ID NO: 844355 - protein, 9 aa, Homo Sapiens
VSIKNMKEI

SEQ ID NO: 844356 - protein, 9 aa, Homo Sapiens
IKAAVKAAR

SEQ ID NO: 844357 - protein, 9 aa, Homo Sapiens
LFALRPAPM

SEQ ID NO: 844358 - protein, 9 aa, Homo Sapiens
LYAFLDENL

SEQ ID NO: 844359 - protein, 9 aa, Homo Sapiens
GIFWSNYHQ

SEQ ID NO: 844360 - protein, 9 aa, Homo Sapiens
STVYYYAGK

SEQ ID NO: 844361 - protein, 9 aa, Homo Sapiens
VPISTELDM

SEQ ID NO: 844362 - protein, 9 aa, Homo Sapiens
TGNSGEEVV

SEQ ID NO: 844363 - protein, 9 aa, Homo Sapiens
LQFEGERVT

SEQ ID NO: 844364 - protein, 9 aa, Homo Sapiens
TLNRKNILN

SEQ ID NO: 844365 - protein, 9 aa, Homo Sapiens
TDDPVLENI

SEQ ID NO: 844366 - protein, 9 aa, Homo Sapiens
FICYFKVRQ

SEQ ID NO: 844367 - protein, 9 aa, Homo Sapiens
NLIVHQITH

SEQ ID NO: 844368 - protein, 9 aa, Homo Sapiens
HNRYALICQ

SEQ ID NO: 844369 - protein, 9 aa, Homo Sapiens
LKELEQLAT

SEQ ID NO: 844370 - protein, 9 aa, Homo Sapiens
SEHSHFYLK

SEQ ID NO: 844371 - protein, 9 aa, Homo Sapiens
SQQLRIKGD

SEQ ID NO: 844372 - protein, 9 aa, Homo Sapiens
FQVVISIIC

SEQ ID NO: 844373 - protein, 9 aa, Homo Sapiens
KHEFKRFIL

SEQ ID NO: 844374 - protein, 9 aa, Homo Sapiens
KEKRSQTQE

SEQ ID NO: 844375 - protein, 9 aa, Homo Sapiens
VPGMQDILL

SEQ ID NO: 844376 - protein, 9 aa, Homo Sapiens
WPPPWGIPA

SEQ ID NO: 844377 - protein, 9 aa, Homo Sapiens
VLLSLLDKV

SEQ ID NO: 844378 - protein, 9 aa, Homo Sapiens
FFQNISLGD

SEQ ID NO: 844379 - protein, 9 aa, Homo Sapiens
IKARNLKDM

SEQ ID NO: 844380 - protein, 9 aa, Homo Sapiens
PFSSLREDQ

SEQ ID NO: 844381 - protein, 9 aa, Homo Sapiens
NHMYIFKTL

SEQ ID NO: 844382 - protein, 9 aa, Homo Sapiens
FDEKHLQSS

SEQ ID NO: 844383 - protein, 9 aa, Homo Sapiens
PQKLPSVRP

SEQ ID NO: 844384 - protein, 9 aa, Homo Sapiens
IITGALQLY

SEQ ID NO: 844385 - protein, 9 aa, Homo Sapiens
LVLMAYDRY

SEQ ID NO: 844386 - protein, 9 aa, Homo Sapiens
NVKITSPEE

SEQ ID NO: 844387 - protein, 9 aa, Homo Sapiens
QLVFSDLPC

SEQ ID NO: 844388 - protein, 9 aa, Homo Sapiens
SANALGKYV

SEQ ID NO: 844389 - protein, 9 aa, Homo Sapiens
AYGPEGILG

SEQ ID NO: 844390 - protein, 9 aa, Homo Sapiens
YQGLPVCCV

SEQ ID NO: 844391 - protein, 9 aa, Homo Sapiens
PSLHGDVWL

SEQ ID NO: 844392 - protein, 9 aa, Homo Sapiens
SYCFKEKSC

SEQ ID NO: 844393 - protein, 9 aa, Homo Sapiens
ILVFQFFSW

SEQ ID NO: 844394 - protein, 9 aa, Homo Sapiens
RTRIAALKT

SEQ ID NO: 844395 - protein, 9 aa, Homo Sapiens
GIYNASKNI

SEQ ID NO: 844396 - protein, 9 aa, Homo Sapiens
VSAIRRSDL

SEQ ID NO: 844397 - protein, 9 aa, Homo Sapiens
GHMEYLVKW

SEQ ID NO: 844398 - protein, 9 aa, Homo Sapiens
FTYTMPHSL

SEQ ID NO: 844399 - protein, 9 aa, Homo Sapiens
SSFKPVKSH

SEQ ID NO: 844400 - protein, 9 aa, Homo Sapiens
SQGFNEQQQ

SEQ ID NO: 844401 - protein, 9 aa, Homo Sapiens
RTKLSPVAV

SEQ ID NO: 844402 - protein, 9 aa, Homo Sapiens
DSDVSDAGT

SEQ ID NO: 844403 - protein, 9 aa, Homo Sapiens
GLIDGSFKI

SEQ ID NO: 844404 - protein, 9 aa, Homo Sapiens
PQQRVPVEV

SEQ ID NO: 844405 - protein, 9 aa, Homo Sapiens
KYVNVRVSS

SEQ ID NO: 844406 - protein, 9 aa, Homo Sapiens
WTCIGDLHR

SEQ ID NO: 844407 - protein, 9 aa, Homo Sapiens
AYTSYSDES

SEQ ID NO: 844408 - protein, 9 aa, Homo Sapiens
KHRDRTAKK

SEQ ID NO: 844409 - protein, 9 aa, Homo Sapiens
MSYLFASFS

SEQ ID NO: 844410 - protein, 9 aa, Homo Sapiens
KKPHKIKFM

SEQ ID NO: 844411 - protein, 9 aa, Homo Sapiens
VPRMHEGNI

SEQ ID NO: 844412 - protein, 9 aa, Homo Sapiens
LYVGAQDHI

SEQ ID NO: 844413 - protein, 9 aa, Homo Sapiens
FLKVPQIHW

SEQ ID NO: 844414 - protein, 9 aa, Homo Sapiens
VLFMITSVF

SEQ ID NO: 844415 - protein, 9 aa, Homo Sapiens
PVVPALRES

SEQ ID NO: 844416 - protein, 9 aa, Homo Sapiens
TSNAEHLED

SEQ ID NO: 844417 - protein, 9 aa, Homo Sapiens
YLNYPPSPG

SEQ ID NO: 844418 - protein, 9 aa, Homo Sapiens
IKARNVKAM

SEQ ID NO: 844419 - protein, 9 aa, Homo Sapiens
PSAIISVPP

SEQ ID NO: 844420 - protein, 9 aa, Homo Sapiens
FVVNQVKVE

SEQ ID NO: 844421 - protein, 9 aa, Homo Sapiens
GCQVWAYIR

SEQ ID NO: 844422 - protein, 9 aa, Homo Sapiens
CPEGQLPIY

SEQ ID NO: 844423 - protein, 9 aa, Homo Sapiens
VFRESSSKG

SEQ ID NO: 844424 - protein, 9 aa, Homo Sapiens
PLPGGALNR

SEQ ID NO: 844425 - protein, 9 aa, Homo Sapiens
ELWKLAGRA

SEQ ID NO: 844426 - protein, 9 aa, Homo Sapiens
YRDAFNSAE

SEQ ID NO: 844427 - protein, 9 aa, Homo Sapiens
PKSGTAWVS

SEQ ID NO: 844428 - protein, 9 aa, Homo Sapiens
GNGMKNAMN

SEQ ID NO: 844429 - protein, 9 aa, Homo Sapiens
ELQIALMAS

SEQ ID NO: 844430 - protein, 9 aa, Homo Sapiens
FDPNSCPGE

SEQ ID NO: 844431 - protein, 9 aa, Homo Sapiens
LSKTAVHVQ

SEQ ID NO: 844432 - protein, 9 aa, Homo Sapiens
DAYSSFCSV

SEQ ID NO: 844433 - protein, 9 aa, Homo Sapiens
EVLKEFIYC

SEQ ID NO: 844434 - protein, 9 aa, Homo Sapiens
KEKMNKEAV

SEQ ID NO: 844435 - protein, 9 aa, Homo Sapiens
KHNLFQTGS

SEQ ID NO: 844436 - protein, 9 aa, Homo Sapiens
IEALKLARR

SEQ ID NO: 844437 - protein, 9 aa, Homo Sapiens
PYIPYILEA

SEQ ID NO: 844438 - protein, 9 aa, Homo Sapiens
ILLDMATHP

SEQ ID NO: 844439 - protein, 9 aa, Homo Sapiens
ISSSQMVLL

SEQ ID NO: 844440 - protein, 9 aa, Homo Sapiens
VGRRQRAPP

SEQ ID NO: 844441 - protein, 9 aa, Homo Sapiens
LRPGETLNI

SEQ ID NO: 844442 - protein, 9 aa, Homo Sapiens
MTLGPTVVS

SEQ ID NO: 844443 - protein, 9 aa, Homo Sapiens
RLANTEQET

SEQ ID NO: 844444 - protein, 9 aa, Homo Sapiens
EPAIHWIYP

SEQ ID NO: 844445 - protein, 9 aa, Homo Sapiens
ILDLRQQLC

SEQ ID NO: 844446 - protein, 9 aa, Homo Sapiens
SSGKPSTKK

SEQ ID NO: 844447 - protein, 9 aa, Homo Sapiens
KADAKIASS

SEQ ID NO: 844448 - protein, 9 aa, Homo Sapiens
ALRAACLQY

SEQ ID NO: 844449 - protein, 9 aa, Homo Sapiens
ALLQLPDLW

SEQ ID NO: 844450 - protein, 9 aa, Homo Sapiens
HCKVKKKSK

SEQ ID NO: 844451 - protein, 9 aa, Homo Sapiens
THQIIHSGE

SEQ ID NO: 844452 - protein, 9 aa, Homo Sapiens
HAAPFSNVL

SEQ ID NO: 844453 - protein, 9 aa, Homo Sapiens
DRTGAPGPQ

SEQ ID NO: 844454 - protein, 9 aa, Homo Sapiens
KLSKTAVHV

SEQ ID NO: 844455 - protein, 9 aa, Homo Sapiens
TAFLRWKGY

SEQ ID NO: 844456 - protein, 9 aa, Homo Sapiens
DDPLALTST

SEQ ID NO: 844457 - protein, 9 aa, Homo Sapiens
ELFDSNGNF

SEQ ID NO: 844458 - protein, 9 aa, Homo Sapiens
WSSLGRVPS

SEQ ID NO: 844459 - protein, 9 aa, Homo Sapiens
QVFEELICQ

SEQ ID NO: 844460 - protein, 9 aa, Homo Sapiens
AWVSEIVYM

SEQ ID NO: 844461 - protein, 9 aa, Homo Sapiens
ADTNNADRL

SEQ ID NO: 844462 - protein, 9 aa, Homo Sapiens
CASGATYVI

SEQ ID NO: 844463 - protein, 9 aa, Homo Sapiens
YVPSILILM

SEQ ID NO: 844464 - protein, 9 aa, Homo Sapiens
RRWRHRNLS

SEQ ID NO: 844465 - protein, 9 aa, Homo Sapiens
LDLKAARSI

SEQ ID NO: 844466 - protein, 9 aa, Homo Sapiens
VATLVLAPS

SEQ ID NO: 844467 - protein, 9 aa, Homo Sapiens
EPFPAEIYR

SEQ ID NO: 844468 - protein, 9 aa, Homo Sapiens
TTIGKYLDF

SEQ ID NO: 844469 - protein, 9 aa, Homo Sapiens
KEHQKDLKF

SEQ ID NO: 844470 - protein, 9 aa, Homo Sapiens
LIIVIVSYF

SEQ ID NO: 844471 - protein, 9 aa, Homo Sapiens
LFAIFIILL

SEQ ID NO: 844472 - protein, 9 aa, Homo Sapiens
LQKQVLSTE

SEQ ID NO: 844473 - protein, 9 aa, Homo Sapiens
SDIAFQFQL

SEQ ID NO: 844474 - protein, 9 aa, Homo Sapiens
AEIGLAVIL

SEQ ID NO: 844475 - protein, 9 aa, Homo Sapiens
HTQKMQHNG

SEQ ID NO: 844476 - protein, 9 aa, Homo Sapiens
DRGHLKYYL

SEQ ID NO: 844477 - protein, 9 aa, Homo Sapiens
IQACRGRND

SEQ ID NO: 844478 - protein, 9 aa, Homo Sapiens
FQELEYYDV

SEQ ID NO: 844479 - protein, 9 aa, Homo Sapiens
DVQWVYVEL

SEQ ID NO: 844480 - protein, 9 aa, Homo Sapiens
GLLDLIQDL

SEQ ID NO: 844481 - protein, 9 aa, Homo Sapiens
LEQFIKEIV

SEQ ID NO: 844482 - protein, 9 aa, Homo Sapiens
ALQWTGASG

SEQ ID NO: 844483 - protein, 9 aa, Homo Sapiens
LDFFPDGAH

SEQ ID NO: 844484 - protein, 9 aa, Homo Sapiens
TGNKIIAYN

SEQ ID NO: 844485 - protein, 9 aa, Homo Sapiens
RLISLAAQT

SEQ ID NO: 844486 - protein, 9 aa, Homo Sapiens
PKTGECLCY

SEQ ID NO: 844487 - protein, 9 aa, Homo Sapiens
GYKTVTYLA

SEQ ID NO: 844488 - protein, 9 aa, Homo Sapiens
SGVQPFECN

SEQ ID NO: 844489 - protein, 9 aa, Homo Sapiens
SLTVKVDVN

SEQ ID NO: 844490 - protein, 9 aa, Homo Sapiens
SQILAGRED

SEQ ID NO: 844491 - protein, 9 aa, Homo Sapiens
DWKYVVMVI

SEQ ID NO: 844492 - protein, 9 aa, Homo Sapiens
NLFVTAPKN

SEQ ID NO: 844493 - protein, 9 aa, Homo Sapiens
FDKIIHRLL

SEQ ID NO: 844494 - protein, 9 aa, Homo Sapiens
RGGGGHNAL

SEQ ID NO: 844495 - protein, 9 aa, Homo Sapiens
IDRRLGHHP

SEQ ID NO: 844496 - protein, 9 aa, Homo Sapiens
PQRVPQVRI

SEQ ID NO: 844497 - protein, 9 aa, Homo Sapiens
FQTQKVQDF

SEQ ID NO: 844498 - protein, 9 aa, Homo Sapiens
HPIPANTLN

SEQ ID NO: 844499 - protein, 9 aa, Homo Sapiens
RMSKGLDAR

SEQ ID NO: 844500 - protein, 9 aa, Homo Sapiens
LTWGLTLTL

SEQ ID NO: 844501 - protein, 9 aa, Homo Sapiens
FDNVAVDFT

SEQ ID NO: 844502 - protein, 9 aa, Homo Sapiens
KFTAQEMYD

SEQ ID NO: 844503 - protein, 9 aa, Homo Sapiens
YLGKFSEIT

SEQ ID NO: 844504 - protein, 9 aa, Homo Sapiens
LIRYQWKHD

SEQ ID NO: 844505 - protein, 9 aa, Homo Sapiens
YTILTPMFN

SEQ ID NO: 844506 - protein, 9 aa, Homo Sapiens
DLFIDDKGV

SEQ ID NO: 844507 - protein, 9 aa, Homo Sapiens
NKKMQMLKL

SEQ ID NO: 844508 - protein, 9 aa, Homo Sapiens
GDVFNDCKY

SEQ ID NO: 844509 - protein, 9 aa, Homo Sapiens
YPKCLFDDD

SEQ ID NO: 844510 - protein, 9 aa, Homo Sapiens
RCHGCLKWS

SEQ ID NO: 844511 - protein, 9 aa, Homo Sapiens
RILFYQRWP

SEQ ID NO: 844512 - protein, 9 aa, Homo Sapiens
NDHWRIHTG

SEQ ID NO: 844513 - protein, 9 aa, Homo Sapiens
VHRIDLDTF

SEQ ID NO: 844514 - protein, 9 aa, Homo Sapiens
LLVFNKIVE

SEQ ID NO: 844515 - protein, 9 aa, Homo Sapiens
GNLLLTTCG

SEQ ID NO: 844516 - protein, 9 aa, Homo Sapiens
HARDKDKRG

SEQ ID NO: 844517 - protein, 9 aa, Homo Sapiens
NAPPICLRH

SEQ ID NO: 844518 - protein, 9 aa, Homo Sapiens
TQSVPSGSE

SEQ ID NO: 844519 - protein, 9 aa, Homo Sapiens
ALTAFTALM

SEQ ID NO: 844520 - protein, 9 aa, Homo Sapiens
KFCDPQMCF

SEQ ID NO: 844521 - protein, 9 aa, Homo Sapiens
NDIIGDIYS

SEQ ID NO: 844522 - protein, 9 aa, Homo Sapiens
CHEYGDKPH

SEQ ID NO: 844523 - protein, 9 aa, Homo Sapiens
EKKSFETNT

SEQ ID NO: 844524 - protein, 9 aa, Homo Sapiens
SLINKQVID

SEQ ID NO: 844525 - protein, 9 aa, Homo Sapiens
SFLENKRFT

SEQ ID NO: 844526 - protein, 9 aa, Homo Sapiens
NLIGLIPVS

SEQ ID NO: 844527 - protein, 9 aa, Homo Sapiens
EIPPKETET

SEQ ID NO: 844528 - protein, 9 aa, Homo Sapiens
VNNVNEFAP

SEQ ID NO: 844529 - protein, 9 aa, Homo Sapiens
APKEYDYET

SEQ ID NO: 844530 - protein, 9 aa, Homo Sapiens
DCYKFYLEN

SEQ ID NO: 844531 - protein, 9 aa, Homo Sapiens
IHTENKSHE

SEQ ID NO: 844532 - protein, 9 aa, Homo Sapiens
MRYPVMSTL

SEQ ID NO: 844533 - protein, 9 aa, Homo Sapiens
DVPATGLLC

SEQ ID NO: 844534 - protein, 9 aa, Homo Sapiens
AQGHPEVNS

SEQ ID NO: 844535 - protein, 9 aa, Homo Sapiens
VLAAETGME

SEQ ID NO: 844536 - protein, 9 aa, Homo Sapiens
TNSSFQVAS

SEQ ID NO: 844537 - protein, 9 aa, Homo Sapiens
PFATDIFVN

SEQ ID NO: 844538 - protein, 9 aa, Homo Sapiens
CGSCRDSRE

SEQ ID NO: 844539 - protein, 9 aa, Homo Sapiens
TDAQVVMGN

SEQ ID NO: 844540 - protein, 9 aa, Homo Sapiens
LSTLSHSNR

SEQ ID NO: 844541 - protein, 9 aa, Homo Sapiens
NMTELERAF

SEQ ID NO: 844542 - protein, 9 aa, Homo Sapiens
ALLPSDEWE

SEQ ID NO: 844543 - protein, 9 aa, Homo Sapiens
IGKGLAALD

SEQ ID NO: 844544 - protein, 9 aa, Homo Sapiens
HTNKRVSSF

SEQ ID NO: 844545 - protein, 9 aa, Homo Sapiens
GKPSDAESL

SEQ ID NO: 844546 - protein, 9 aa, Homo Sapiens
VFGLGGAGL

SEQ ID NO: 844547 - protein, 9 aa, Homo Sapiens
QKEVKPPAL

SEQ ID NO: 844548 - protein, 9 aa, Homo Sapiens
LTLGGDHTL

SEQ ID NO: 844549 - protein, 9 aa, Homo Sapiens
PFDLFDVQD

SEQ ID NO: 844550 - protein, 9 aa, Homo Sapiens
CIVLGYLGC

SEQ ID NO: 844551 - protein, 9 aa, Homo Sapiens
QILTCQKTE

SEQ ID NO: 844552 - protein, 9 aa, Homo Sapiens
TSSVLPNDL

SEQ ID NO: 844553 - protein, 9 aa, Homo Sapiens
VDAQSLAGE

SEQ ID NO: 844554 - protein, 9 aa, Homo Sapiens
SDYLMKLSA

SEQ ID NO: 844555 - protein, 9 aa, Homo Sapiens
RQISELPIR

SEQ ID NO: 844556 - protein, 9 aa, Homo Sapiens
GMVADAERS

SEQ ID NO: 844557 - protein, 9 aa, Homo Sapiens
EAVNYHDKT

SEQ ID NO: 844558 - protein, 9 aa, Homo Sapiens
GKVLPKWGR

SEQ ID NO: 844559 - protein, 9 aa, Homo Sapiens
RGPSVPTGM

SEQ ID NO: 844560 - protein, 9 aa, Homo Sapiens
EQVRVNYLT

SEQ ID NO: 844561 - protein, 9 aa, Homo Sapiens
LLTAPFSLH

SEQ ID NO: 844562 - protein, 9 aa, Homo Sapiens
SCNQNVHEE

SEQ ID NO: 844563 - protein, 9 aa, Homo Sapiens
NEFLDFTAL

SEQ ID NO: 844564 - protein, 9 aa, Homo Sapiens
PAPEPSSSN

SEQ ID NO: 844565 - protein, 9 aa, Homo Sapiens
GQEYHVRIS

SEQ ID NO: 844566 - protein, 9 aa, Homo Sapiens
KHKKKGKVK

SEQ ID NO: 844567 - protein, 9 aa, Homo Sapiens
KSSQLSTLS

SEQ ID NO: 844568 - protein, 9 aa, Homo Sapiens
PYATDVARV

SEQ ID NO: 844569 - protein, 9 aa, Homo Sapiens
YDLIDLMQL

SEQ ID NO: 844570 - protein, 9 aa, Homo Sapiens
LWELRGHRY

SEQ ID NO: 844571 - protein, 9 aa, Homo Sapiens
FFTEDDNPL

SEQ ID NO: 844572 - protein, 9 aa, Homo Sapiens
HSLTWGLTL

SEQ ID NO: 844573 - protein, 9 aa, Homo Sapiens
GTKAVREML

SEQ ID NO: 844574 - protein, 9 aa, Homo Sapiens
GLALVSRDL

SEQ ID NO: 844575 - protein, 9 aa, Homo Sapiens
QNHSCTPDP

SEQ ID NO: 844576 - protein, 9 aa, Homo Sapiens
FLEACIKIG

SEQ ID NO: 844577 - protein, 9 aa, Homo Sapiens
RVLSHKGMF

SEQ ID NO: 844578 - protein, 9 aa, Homo Sapiens
TNGNFGSNF

SEQ ID NO: 844579 - protein, 9 aa, Homo Sapiens
NAACSSQPE

SEQ ID NO: 844580 - protein, 9 aa, Homo Sapiens
PYKYPSKVA

SEQ ID NO: 844581 - protein, 9 aa, Homo Sapiens
YLETRPTQH

SEQ ID NO: 844582 - protein, 9 aa, Homo Sapiens
PTNISTDRN

SEQ ID NO: 844583 - protein, 9 aa, Homo Sapiens
PNVAYSLLK

SEQ ID NO: 844584 - protein, 9 aa, Homo Sapiens
AVGIFFGFI

SEQ ID NO: 844585 - protein, 9 aa, Homo Sapiens
MSELRQVPG

SEQ ID NO: 844586 - protein, 9 aa, Homo Sapiens
QDCLFNEDS

SEQ ID NO: 844587 - protein, 9 aa, Homo Sapiens
LLEDNNKLI

SEQ ID NO: 844588 - protein, 9 aa, Homo Sapiens
HLAIHTENK

SEQ ID NO: 844589 - protein, 9 aa, Homo Sapiens
RVYTLRTES

SEQ ID NO: 844590 - protein, 9 aa, Homo Sapiens
TKVMNLFEE

SEQ ID NO: 844591 - protein, 9 aa, Homo Sapiens
PPDFKIQRT

SEQ ID NO: 844592 - protein, 9 aa, Homo Sapiens
FNLKRHMRT

SEQ ID NO: 844593 - protein, 9 aa, Homo Sapiens
HVTVAGFIP

SEQ ID NO: 844594 - protein, 9 aa, Homo Sapiens
GYRHISALE

SEQ ID NO: 844595 - protein, 9 aa, Homo Sapiens
DNTVRSCDL

SEQ ID NO: 844596 - protein, 9 aa, Homo Sapiens
LDDLSPRNQ

SEQ ID NO: 844597 - protein, 9 aa, Homo Sapiens
PPSSLSLTV

SEQ ID NO: 844598 - protein, 9 aa, Homo Sapiens
EAKRKSPTK

SEQ ID NO: 844599 - protein, 9 aa, Homo Sapiens
LKTTRFCLI

SEQ ID NO: 844600 - protein, 9 aa, Homo Sapiens
SWQSRHSGA

SEQ ID NO: 844601 - protein, 9 aa, Homo Sapiens
KKGKALLHP

SEQ ID NO: 844602 - protein, 9 aa, Homo Sapiens
STGDAGEMV

SEQ ID NO: 844603 - protein, 9 aa, Homo Sapiens
NQNLAEKTS

SEQ ID NO: 844604 - protein, 9 aa, Homo Sapiens
TLFIDLSFL

SEQ ID NO: 844605 - protein, 9 aa, Homo Sapiens
NVFWMTGLF

SEQ ID NO: 844606 - protein, 9 aa, Homo Sapiens
KLTLDNFYS

SEQ ID NO: 844607 - protein, 9 aa, Homo Sapiens
HPEKLHFVF

SEQ ID NO: 844608 - protein, 9 aa, Homo Sapiens
ACFLHSGKT

SEQ ID NO: 844609 - protein, 9 aa, Homo Sapiens
EIGDFKRPF

SEQ ID NO: 844610 - protein, 9 aa, Homo Sapiens
NLAAAAHSA

SEQ ID NO: 844611 - protein, 9 aa, Homo Sapiens
SKRSFGDDR

SEQ ID NO: 844612 - protein, 9 aa, Homo Sapiens
TTSNSLLVS

SEQ ID NO: 844613 - protein, 9 aa, Homo Sapiens
TSMVSGFSS

SEQ ID NO: 844614 - protein, 9 aa, Homo Sapiens
FQRTLNIQS

SEQ ID NO: 844615 - protein, 9 aa, Homo Sapiens
ELFQEMAIY

SEQ ID NO: 844616 - protein, 9 aa, Homo Sapiens
FCAANTVDN

SEQ ID NO: 844617 - protein, 9 aa, Homo Sapiens
TGDEERPQL

SEQ ID NO: 844618 - protein, 9 aa, Homo Sapiens
PIDRQAFKG

SEQ ID NO: 844619 - protein, 9 aa, Homo Sapiens
EEREVKEKI

SEQ ID NO: 844620 - protein, 9 aa, Homo Sapiens
KFKIYFLQL

SEQ ID NO: 844621 - protein, 9 aa, Homo Sapiens
ISLSGCFLQ

SEQ ID NO: 844622 - protein, 9 aa, Homo Sapiens
RSTTKKSKK

SEQ ID NO: 844623 - protein, 9 aa, Homo Sapiens
SRLSDDPRI

SEQ ID NO: 844624 - protein, 9 aa, Homo Sapiens
TSENDLNGS

SEQ ID NO: 844625 - protein, 9 aa, Homo Sapiens
YKFTVGVDF

SEQ ID NO: 844626 - protein, 9 aa, Homo Sapiens
PWHYFGADS

SEQ ID NO: 844627 - protein, 9 aa, Homo Sapiens
LDEFIESCQ

SEQ ID NO: 844628 - protein, 9 aa, Homo Sapiens
SRQLDQLSC

SEQ ID NO: 844629 - protein, 9 aa, Homo Sapiens
ADALGVWRR

SEQ ID NO: 844630 - protein, 9 aa, Homo Sapiens
CHPDTGACV

SEQ ID NO: 844631 - protein, 9 aa, Homo Sapiens
PPDVLLGAK

SEQ ID NO: 844632 - protein, 9 aa, Homo Sapiens
HPRTSSNAS

SEQ ID NO: 844633 - protein, 9 aa, Homo Sapiens
NHSSTSSGR

SEQ ID NO: 844634 - protein, 9 aa, Homo Sapiens
KKSKKNKNR

SEQ ID NO: 844635 - protein, 9 aa, Homo Sapiens
TGANEYNNG

SEQ ID NO: 844636 - protein, 9 aa, Homo Sapiens
KAVVFGLLT

SEQ ID NO: 844637 - protein, 9 aa, Homo Sapiens
VWLDSDATS

SEQ ID NO: 844638 - protein, 9 aa, Homo Sapiens
SFADTIRLP

SEQ ID NO: 844639 - protein, 9 aa, Homo Sapiens
FWTLLFTSE

SEQ ID NO: 844640 - protein, 9 aa, Homo Sapiens
FKTHDKDLR

SEQ ID NO: 844641 - protein, 9 aa, Homo Sapiens
FEYLHCKFY

SEQ ID NO: 844642 - protein, 9 aa, Homo Sapiens
DIKLSIPVY

SEQ ID NO: 844643 - protein, 9 aa, Homo Sapiens
RVLSVYIFS

SEQ ID NO: 844644 - protein, 9 aa, Homo Sapiens
TICGQAFYF

SEQ ID NO: 844645 - protein, 9 aa, Homo Sapiens
SDVRGIAGV

SEQ ID NO: 844646 - protein, 9 aa, Homo Sapiens
ILAQIGLSV

SEQ ID NO: 844647 - protein, 9 aa, Homo Sapiens
DALKEKVIR

SEQ ID NO: 844648 - protein, 9 aa, Homo Sapiens
PWPGKSSYS

SEQ ID NO: 844649 - protein, 9 aa, Homo Sapiens
CLRDPDWLA

SEQ ID NO: 844650 - protein, 9 aa, Homo Sapiens
SNPFTRAHE

SEQ ID NO: 844651 - protein, 9 aa, Homo Sapiens
PPRYLGDCY

SEQ ID NO: 844652 - protein, 9 aa, Homo Sapiens
EIIYFFLGA

SEQ ID NO: 844653 - protein, 9 aa, Homo Sapiens
LTTLPLPVA

SEQ ID NO: 844654 - protein, 9 aa, Homo Sapiens
QTEWIANCQ

SEQ ID NO: 844655 - protein, 9 aa, Homo Sapiens
FIGSTSNHV

SEQ ID NO: 844656 - protein, 9 aa, Homo Sapiens
HFPAGEFTF

SEQ ID NO: 844657 - protein, 9 aa, Homo Sapiens
NMSFWSSIL

SEQ ID NO: 844658 - protein, 9 aa, Homo Sapiens
GPNQTGSEG

SEQ ID NO: 844659 - protein, 9 aa, Homo Sapiens
QMYLFLMFG

SEQ ID NO: 844660 - protein, 9 aa, Homo Sapiens
RNSSLWNNL

SEQ ID NO: 844661 - protein, 9 aa, Homo Sapiens
AVIFSDYRL

SEQ ID NO: 844662 - protein, 9 aa, Homo Sapiens
ATVNYRQAK

SEQ ID NO: 844663 - protein, 9 aa, Homo Sapiens
ETLYGTSIW

SEQ ID NO: 844664 - protein, 9 aa, Homo Sapiens
DQHVDVKIN

SEQ ID NO: 844665 - protein, 9 aa, Homo Sapiens
RIHAGDKFY

SEQ ID NO: 844666 - protein, 9 aa, Homo Sapiens
QKLTFYRPD

SEQ ID NO: 844667 - protein, 9 aa, Homo Sapiens
SVVDLVSIP

SEQ ID NO: 844668 - protein, 9 aa, Homo Sapiens
VSGALNKCK

SEQ ID NO: 844669 - protein, 9 aa, Homo Sapiens
QMDLEVKRV

SEQ ID NO: 844670 - protein, 9 aa, Homo Sapiens
LRYKVAHSQ

SEQ ID NO: 844671 - protein, 9 aa, Homo Sapiens
YCSENKIPF

SEQ ID NO: 844672 - protein, 9 aa, Homo Sapiens
LPYEQTIIF

SEQ ID NO: 844673 - protein, 9 aa, Homo Sapiens
YNSGDGHID

SEQ ID NO: 844674 - protein, 9 aa, Homo Sapiens
PKETETSKI

SEQ ID NO: 844675 - protein, 9 aa, Homo Sapiens
TSQLLVNYP

SEQ ID NO: 844676 - protein, 9 aa, Homo Sapiens
NAITGEIWL

SEQ ID NO: 844677 - protein, 9 aa, Homo Sapiens
KLSPIFRDV

SEQ ID NO: 844678 - protein, 9 aa, Homo Sapiens
GGAGLAVIM

SEQ ID NO: 844679 - protein, 9 aa, Homo Sapiens
SHGCVSKII

SEQ ID NO: 844680 - protein, 9 aa, Homo Sapiens
ASQQMRAGK

SEQ ID NO: 844681 - protein, 9 aa, Homo Sapiens
VARQRRHES

SEQ ID NO: 844682 - protein, 9 aa, Homo Sapiens
TTAAHIALL

SEQ ID NO: 844683 - protein, 9 aa, Homo Sapiens
LPKLYYLRI

SEQ ID NO: 844684 - protein, 9 aa, Homo Sapiens
GVPGPLPYF

SEQ ID NO: 844685 - protein, 9 aa, Homo Sapiens
LMTSNTEVM

SEQ ID NO: 844686 - protein, 9 aa, Homo Sapiens
FAADAMAHL

SEQ ID NO: 844687 - protein, 9 aa, Homo Sapiens
PQVRIPKAL

SEQ ID NO: 844688 - protein, 9 aa, Homo Sapiens
NKLSTIPAG

SEQ ID NO: 844689 - protein, 9 aa, Homo Sapiens
HQIIHTSDK

SEQ ID NO: 844690 - protein, 9 aa, Homo Sapiens
VGRQYLWLK

SEQ ID NO: 844691 - protein, 9 aa, Homo Sapiens
LHNNIAGRK

SEQ ID NO: 844692 - protein, 9 aa, Homo Sapiens
KKYCFHKTR

SEQ ID NO: 844693 - protein, 9 aa, Homo Sapiens
PDTLPQGSA

SEQ ID NO: 844694 - protein, 9 aa, Homo Sapiens
LEPGDYFSL

SEQ ID NO: 844695 - protein, 9 aa, Homo Sapiens
HRKTSSRLD

SEQ ID NO: 844696 - protein, 9 aa, Homo Sapiens
HHISQFFRP

SEQ ID NO: 844697 - protein, 9 aa, Homo Sapiens
SGQPPHLEE

SEQ ID NO: 844698 - protein, 9 aa, Homo Sapiens
IRRVGPFGP

SEQ ID NO: 844699 - protein, 9 aa, Homo Sapiens
FIDHLNKHS

SEQ ID NO: 844700 - protein, 9 aa, Homo Sapiens
AQIIVEKLE

SEQ ID NO: 844701 - protein, 9 aa, Homo Sapiens
KAKQQLEYA

SEQ ID NO: 844702 - protein, 9 aa, Homo Sapiens
DIPNSKDIL

SEQ ID NO: 844703 - protein, 9 aa, Homo Sapiens
GEDEEKREE

SEQ ID NO: 844704 - protein, 9 aa, Homo Sapiens
KDDRTETYV

SEQ ID NO: 844705 - protein, 9 aa, Homo Sapiens
NPTYVGKEE

SEQ ID NO: 844706 - protein, 9 aa, Homo Sapiens
EHNNGVLEE

SEQ ID NO: 844707 - protein, 9 aa, Homo Sapiens
ISTITRIYR

SEQ ID NO: 844708 - protein, 9 aa, Homo Sapiens
DGAQTLHRA

SEQ ID NO: 844709 - protein, 9 aa, Homo Sapiens
QHFVPIVAE

SEQ ID NO: 844710 - protein, 9 aa, Homo Sapiens
ENNDMNNKL

SEQ ID NO: 844711 - protein, 9 aa, Homo Sapiens
MESVTEAGP

SEQ ID NO: 844712 - protein, 9 aa, Homo Sapiens
LTIFLDDST

SEQ ID NO: 844713 - protein, 9 aa, Homo Sapiens
NEGGKAFRA

SEQ ID NO: 844714 - protein, 9 aa, Homo Sapiens
EFLKSSLNN

SEQ ID NO: 844715 - protein, 9 aa, Homo Sapiens
VCRDRIICF

SEQ ID NO: 844716 - protein, 9 aa, Homo Sapiens
LRFRASEHL

SEQ ID NO: 844717 - protein, 9 aa, Homo Sapiens
SFFWYRQYY

SEQ ID NO: 844718 - protein, 9 aa, Homo Sapiens
IKNLKHNTP

SEQ ID NO: 844719 - protein, 9 aa, Homo Sapiens
SDSSKKLDF

SEQ ID NO: 844720 - protein, 9 aa, Homo Sapiens
LQGHATKEE

SEQ ID NO: 844721 - protein, 9 aa, Homo Sapiens
KANKETLDN

SEQ ID NO: 844722 - protein, 9 aa, Homo Sapiens
LLSPGTLDQ

SEQ ID NO: 844723 - protein, 9 aa, Homo Sapiens
SVCIECNCN

SEQ ID NO: 844724 - protein, 9 aa, Homo Sapiens
NTEDLPLTM

SEQ ID NO: 844725 - protein, 9 aa, Homo Sapiens
EELESTKVG

SEQ ID NO: 844726 - protein, 9 aa, Homo Sapiens
WKGYNCNVR

SEQ ID NO: 844727 - protein, 9 aa, Homo Sapiens
RCLNPKLKQ

SEQ ID NO: 844728 - protein, 9 aa, Homo Sapiens
NVGSWDNGK

SEQ ID NO: 844729 - protein, 9 aa, Homo Sapiens
TPENKNYYV

SEQ ID NO: 844730 - protein, 9 aa, Homo Sapiens
GMVLLLPLI

SEQ ID NO: 844731 - protein, 9 aa, Homo Sapiens
SSPKRNLFS

SEQ ID NO: 844732 - protein, 9 aa, Homo Sapiens
SLAKGDQSE

SEQ ID NO: 844733 - protein, 9 aa, Homo Sapiens
RYTYNYEAE

SEQ ID NO: 844734 - protein, 9 aa, Homo Sapiens
QHQEYQELF

SEQ ID NO: 844735 - protein, 9 aa, Homo Sapiens
AGERTLQRL

SEQ ID NO: 844736 - protein, 9 aa, Homo Sapiens
KYVKVKVNC

SEQ ID NO: 844737 - protein, 9 aa, Homo Sapiens
KTPAGASET

SEQ ID NO: 844738 - protein, 9 aa, Homo Sapiens
VEKLYIQQI

SEQ ID NO: 844739 - protein, 9 aa, Homo Sapiens
PQSLQSQIG

SEQ ID NO: 844740 - protein, 9 aa, Homo Sapiens
KSTQLTNKG

SEQ ID NO: 844741 - protein, 9 aa, Homo Sapiens
NTILRNHLI

SEQ ID NO: 844742 - protein, 9 aa, Homo Sapiens
SAKSEVSLV

SEQ ID NO: 844743 - protein, 9 aa, Homo Sapiens
QGTWSWEWY

SEQ ID NO: 844744 - protein, 9 aa, Homo Sapiens
EAPGGVKTT

SEQ ID NO: 844745 - protein, 9 aa, Homo Sapiens
LPLLSVSVD

SEQ ID NO: 844746 - protein, 9 aa, Homo Sapiens
WFVFDRNKQ

SEQ ID NO: 844747 - protein, 9 aa, Homo Sapiens
FMGQSDIET

SEQ ID NO: 844748 - protein, 9 aa, Homo Sapiens
CGLSNMYHL

SEQ ID NO: 844749 - protein, 9 aa, Homo Sapiens
DVDSKSPDV

SEQ ID NO: 844750 - protein, 9 aa, Homo Sapiens
IFSSQALTQ

SEQ ID NO: 844751 - protein, 9 aa, Homo Sapiens
STQKKISHY

SEQ ID NO: 844752 - protein, 9 aa, Homo Sapiens
SLLLMQLVL

SEQ ID NO: 844753 - protein, 9 aa, Homo Sapiens
PTTPQYYTQ

SEQ ID NO: 844754 - protein, 9 aa, Homo Sapiens
AQEFQTAHL

SEQ ID NO: 844755 - protein, 9 aa, Homo Sapiens
TGIQSELFI

SEQ ID NO: 844756 - protein, 9 aa, Homo Sapiens
VAKSGACNL

SEQ ID NO: 844757 - protein, 9 aa, Homo Sapiens
TSQKYKEGT

SEQ ID NO: 844758 - protein, 9 aa, Homo Sapiens
CVQKVEEKS

SEQ ID NO: 844759 - protein, 9 aa, Homo Sapiens
DEFNNTGSG

SEQ ID NO: 844760 - protein, 9 aa, Homo Sapiens
PLKYLETPT

SEQ ID NO: 844761 - protein, 9 aa, Homo Sapiens
SCGLPREYA

SEQ ID NO: 844762 - protein, 9 aa, Homo Sapiens
KLEMAQEGF

SEQ ID NO: 844763 - protein, 9 aa, Homo Sapiens
AGLVGRRQR

SEQ ID NO: 844764 - protein, 9 aa, Homo Sapiens
GSNPNKATP

SEQ ID NO: 844765 - protein, 9 aa, Homo Sapiens
NQRIYYSWE

SEQ ID NO: 844766 - protein, 9 aa, Homo Sapiens
CMSEQSERP

SEQ ID NO: 844767 - protein, 9 aa, Homo Sapiens
GRQHSAVLP

SEQ ID NO: 844768 - protein, 9 aa, Homo Sapiens
EEYGLVDGI

SEQ ID NO: 844769 - protein, 9 aa, Homo Sapiens
ASASEVLPL

SEQ ID NO: 844770 - protein, 9 aa, Homo Sapiens
ITIIKARNV

SEQ ID NO: 844771 - protein, 9 aa, Homo Sapiens
KEYFTVHPE

SEQ ID NO: 844772 - protein, 9 aa, Homo Sapiens
KAQKGTAFL

SEQ ID NO: 844773 - protein, 9 aa, Homo Sapiens
VNEVSHNFQ

SEQ ID NO: 844774 - protein, 9 aa, Homo Sapiens
KIIKESINK

SEQ ID NO: 844775 - protein, 9 aa, Homo Sapiens
KKQALVEFE

SEQ ID NO: 844776 - protein, 9 aa, Homo Sapiens
ECVQKFIKI

SEQ ID NO: 844777 - protein, 9 aa, Homo Sapiens
EHIRKILGT

SEQ ID NO: 844778 - protein, 9 aa, Homo Sapiens
NLPLSTFPT

SEQ ID NO: 844779 - protein, 9 aa, Homo Sapiens
SNYQGLPVC

SEQ ID NO: 844780 - protein, 9 aa, Homo Sapiens
KKQYQDSPN

SEQ ID NO: 844781 - protein, 9 aa, Homo Sapiens
NYIFLYLKW

SEQ ID NO: 844782 - protein, 9 aa, Homo Sapiens
AVNKCDLSD

SEQ ID NO: 844783 - protein, 9 aa, Homo Sapiens
EASNIILTD

SEQ ID NO: 844784 - protein, 9 aa, Homo Sapiens
GPMSIPIIP

SEQ ID NO: 844785 - protein, 9 aa, Homo Sapiens
ANCQRQFCK

SEQ ID NO: 844786 - protein, 9 aa, Homo Sapiens
FYAKCRALS

SEQ ID NO: 844787 - protein, 9 aa, Homo Sapiens
PVFIHFQRK

SEQ ID NO: 844788 - protein, 9 aa, Homo Sapiens
KGCQIILFI

SEQ ID NO: 844789 - protein, 9 aa, Homo Sapiens
NDHKVFVGR

SEQ ID NO: 844790 - protein, 9 aa, Homo Sapiens
DQVLQVQAP

SEQ ID NO: 844791 - protein, 9 aa, Homo Sapiens
DDVPVVQMY

SEQ ID NO: 844792 - protein, 9 aa, Homo Sapiens
EDLVSAIRR

SEQ ID NO: 844793 - protein, 9 aa, Homo Sapiens
QLIPALVKV

SEQ ID NO: 844794 - protein, 9 aa, Homo Sapiens
FCDIVPLIQ

SEQ ID NO: 844795 - protein, 9 aa, Homo Sapiens
VEITEQLHR

SEQ ID NO: 844796 - protein, 9 aa, Homo Sapiens
QHPRLIQQM

SEQ ID NO: 844797 - protein, 9 aa, Homo Sapiens
GGGHRPHKG

SEQ ID NO: 844798 - protein, 9 aa, Homo Sapiens
LQKQEAICE

SEQ ID NO: 844799 - protein, 9 aa, Homo Sapiens
SVSSQFSGA

SEQ ID NO: 844800 - protein, 9 aa, Homo Sapiens
TKLEELPKD

SEQ ID NO: 844801 - protein, 9 aa, Homo Sapiens
QKDKNCNLP

SEQ ID NO: 844802 - protein, 9 aa, Homo Sapiens
NGHFEISTD

SEQ ID NO: 844803 - protein, 9 aa, Homo Sapiens
EEKYSIINY

SEQ ID NO: 844804 - protein, 9 aa, Homo Sapiens
AQITTQKWE

SEQ ID NO: 844805 - protein, 9 aa, Homo Sapiens
GYLVANYPY

SEQ ID NO: 844806 - protein, 9 aa, Homo Sapiens
FIFQLNMYH

SEQ ID NO: 844807 - protein, 9 aa, Homo Sapiens
YFDVGASCT

SEQ ID NO: 844808 - protein, 9 aa, Homo Sapiens
NDGVKVCTC

SEQ ID NO: 844809 - protein, 9 aa, Homo Sapiens
KNNLSIIRI

SEQ ID NO: 844810 - protein, 9 aa, Homo Sapiens
VHCKVHMGE

SEQ ID NO: 844811 - protein, 9 aa, Homo Sapiens
QTHERPHTR

SEQ ID NO: 844812 - protein, 9 aa, Homo Sapiens
WPEQSMEDY

SEQ ID NO: 844813 - protein, 9 aa, Homo Sapiens
KEVKVFDFF

SEQ ID NO: 844814 - protein, 9 aa, Homo Sapiens
ALVSVRVLY

SEQ ID NO: 844815 - protein, 9 aa, Homo Sapiens
AHVKGIKKE

SEQ ID NO: 844816 - protein, 9 aa, Homo Sapiens
GNLCRQSIL

SEQ ID NO: 844817 - protein, 9 aa, Homo Sapiens
TVAKNNTLQ

SEQ ID NO: 844818 - protein, 9 aa, Homo Sapiens
EEHNLAKYM

SEQ ID NO: 844819 - protein, 9 aa, Homo Sapiens
SCIDCNPAE

SEQ ID NO: 844820 - protein, 9 aa, Homo Sapiens
EALKKCGIS

SEQ ID NO: 844821 - protein, 9 aa, Homo Sapiens
LSKCQNSWG

SEQ ID NO: 844822 - protein, 9 aa, Homo Sapiens
EGKDSKPRY

SEQ ID NO: 844823 - protein, 9 aa, Homo Sapiens
LFFIISYLT

SEQ ID NO: 844824 - protein, 9 aa, Homo Sapiens
GRKVCAIYD

SEQ ID NO: 844825 - protein, 9 aa, Homo Sapiens
NAILIKTPL

SEQ ID NO: 844826 - protein, 9 aa, Homo Sapiens
SIVSLLARL

SEQ ID NO: 844827 - protein, 9 aa, Homo Sapiens
DIAQLLDMD

SEQ ID NO: 844828 - protein, 9 aa, Homo Sapiens
ICMEKLWDA

SEQ ID NO: 844829 - protein, 9 aa, Homo Sapiens
KIISFKSME

SEQ ID NO: 844830 - protein, 9 aa, Homo Sapiens
VTYLAWRCC

SEQ ID NO: 844831 - protein, 9 aa, Homo Sapiens
VSQEDSLFL

SEQ ID NO: 844832 - protein, 9 aa, Homo Sapiens
SGAPGTRRQ

SEQ ID NO: 844833 - protein, 9 aa, Homo Sapiens
MGDAKTTPP

SEQ ID NO: 844834 - protein, 9 aa, Homo Sapiens
NRGEHNNGV

SEQ ID NO: 844835 - protein, 9 aa, Homo Sapiens
GRDISTKHL

SEQ ID NO: 844836 - protein, 9 aa, Homo Sapiens
CRLSPRNTY

SEQ ID NO: 844837 - protein, 9 aa, Homo Sapiens
PFYLIHLQL

SEQ ID NO: 844838 - protein, 9 aa, Homo Sapiens
GIVRQVRLW

SEQ ID NO: 844839 - protein, 9 aa, Homo Sapiens
SYDVKYAIG

SEQ ID NO: 844840 - protein, 9 aa, Homo Sapiens
TNYIQALRE

SEQ ID NO: 844841 - protein, 9 aa, Homo Sapiens
RQHHKLCDI

SEQ ID NO: 844842 - protein, 9 aa, Homo Sapiens
KPYVYICLF

SEQ ID NO: 844843 - protein, 9 aa, Homo Sapiens
LGEQVVSVV

SEQ ID NO: 844844 - protein, 9 aa, Homo Sapiens
EGQLAATTL

SEQ ID NO: 844845 - protein, 9 aa, Homo Sapiens
TSQLHQVDS

SEQ ID NO: 844846 - protein, 9 aa, Homo Sapiens
QEEEGLYPD

SEQ ID NO: 844847 - protein, 9 aa, Homo Sapiens
KDCWITFLN

SEQ ID NO: 844848 - protein, 9 aa, Homo Sapiens
LIRFQSVES

SEQ ID NO: 844849 - protein, 9 aa, Homo Sapiens
LYMSTEISI

SEQ ID NO: 844850 - protein, 9 aa, Homo Sapiens
HLDDMHSDM

SEQ ID NO: 844851 - protein, 9 aa, Homo Sapiens
QYLKKQPLQ

SEQ ID NO: 844852 - protein, 9 aa, Homo Sapiens
RLSATSGEL

SEQ ID NO: 844853 - protein, 9 aa, Homo Sapiens
IDIPRNGTK

SEQ ID NO: 844854 - protein, 9 aa, Homo Sapiens
KVLEFKAHK

SEQ ID NO: 844855 - protein, 9 aa, Homo Sapiens
APFILRFHE

SEQ ID NO: 844856 - protein, 9 aa, Homo Sapiens
CGPATQNRE

SEQ ID NO: 844857 - protein, 9 aa, Homo Sapiens
KTRIEERSQ

SEQ ID NO: 844858 - protein, 9 aa, Homo Sapiens
NTFECDCKA

SEQ ID NO: 844859 - protein, 9 aa, Homo Sapiens
AQKNKLLID

SEQ ID NO: 844860 - protein, 9 aa, Homo Sapiens
SSKSWSSYL

SEQ ID NO: 844861 - protein, 9 aa, Homo Sapiens
MAQHLIESS

SEQ ID NO: 844862 - protein, 9 aa, Homo Sapiens
YKSICYLGC

SEQ ID NO: 844863 - protein, 9 aa, Homo Sapiens
SSSLGGRTV

SEQ ID NO: 844864 - protein, 9 aa, Homo Sapiens
FDQGINGEG

SEQ ID NO: 844865 - protein, 9 aa, Homo Sapiens
HDTSTNGLI

SEQ ID NO: 844866 - protein, 9 aa, Homo Sapiens
LEGTIKQSS

SEQ ID NO: 844867 - protein, 9 aa, Homo Sapiens
VHNCLISSG

SEQ ID NO: 844868 - protein, 9 aa, Homo Sapiens
GKLDTTNEY

SEQ ID NO: 844869 - protein, 9 aa, Homo Sapiens
RLLKEAMLQ

SEQ ID NO: 844870 - protein, 9 aa, Homo Sapiens
GLPQDIHKE

SEQ ID NO: 844871 - protein, 9 aa, Homo Sapiens
AGGRDAERK

SEQ ID NO: 844872 - protein, 9 aa, Homo Sapiens
PADKRIPQI

SEQ ID NO: 844873 - protein, 9 aa, Homo Sapiens
MLHVDMLTL

SEQ ID NO: 844874 - protein, 9 aa, Homo Sapiens
NMQNNTFPP

SEQ ID NO: 844875 - protein, 9 aa, Homo Sapiens
KKVDSHTPS

SEQ ID NO: 844876 - protein, 9 aa, Homo Sapiens
WSTFHPRTS

SEQ ID NO: 844877 - protein, 9 aa, Homo Sapiens
WRHRNLSST

SEQ ID NO: 844878 - protein, 9 aa, Homo Sapiens
FPPRRWLHS

SEQ ID NO: 844879 - protein, 9 aa, Homo Sapiens
ILENNSSVL

SEQ ID NO: 844880 - protein, 9 aa, Homo Sapiens
FGLIALWSE

SEQ ID NO: 844881 - protein, 9 aa, Homo Sapiens
WERTGLTYR

SEQ ID NO: 844882 - protein, 9 aa, Homo Sapiens
EFHPDTGNI

SEQ ID NO: 844883 - protein, 9 aa, Homo Sapiens
CNAFTFLPE

SEQ ID NO: 844884 - protein, 9 aa, Homo Sapiens
HQRTHMKDK

SEQ ID NO: 844885 - protein, 9 aa, Homo Sapiens
APNNRYSHN

SEQ ID NO: 844886 - protein, 9 aa, Homo Sapiens
LGNEAVDQL

SEQ ID NO: 844887 - protein, 9 aa, Homo Sapiens
AGLNKLFSE

SEQ ID NO: 844888 - protein, 9 aa, Homo Sapiens
STSYLIDTV

SEQ ID NO: 844889 - protein, 9 aa, Homo Sapiens
QGGWRCSCW

SEQ ID NO: 844890 - protein, 9 aa, Homo Sapiens
TLFRKYNHM

SEQ ID NO: 844891 - protein, 9 aa, Homo Sapiens
EKGNGMKNA

SEQ ID NO: 844892 - protein, 9 aa, Homo Sapiens
QKSYLVGCS

SEQ ID NO: 844893 - protein, 9 aa, Homo Sapiens
NGACNVLSP

SEQ ID NO: 844894 - protein, 9 aa, Homo Sapiens
HGSAKLYIS

SEQ ID NO: 844895 - protein, 9 aa, Homo Sapiens
WLHSMTDYP

SEQ ID NO: 844896 - protein, 9 aa, Homo Sapiens
NTATLFIVL

SEQ ID NO: 844897 - protein, 9 aa, Homo Sapiens
DVGAKGEAG

SEQ ID NO: 844898 - protein, 9 aa, Homo Sapiens
HQEYQELFR

SEQ ID NO: 844899 - protein, 9 aa, Homo Sapiens
DGCNSGSEK

SEQ ID NO: 844900 - protein, 9 aa, Homo Sapiens
PHPGMGDAL

SEQ ID NO: 844901 - protein, 9 aa, Homo Sapiens
AKYLTDPSQ

SEQ ID NO: 844902 - protein, 9 aa, Homo Sapiens
MACIIYSVE

SEQ ID NO: 844903 - protein, 9 aa, Homo Sapiens
PRVATPDVV

SEQ ID NO: 844904 - protein, 9 aa, Homo Sapiens
YLIRYQWKH

SEQ ID NO: 844905 - protein, 9 aa, Homo Sapiens
AILYYKIFS

SEQ ID NO: 844906 - protein, 9 aa, Homo Sapiens
DANQIINTI

SEQ ID NO: 844907 - protein, 9 aa, Homo Sapiens
HNQIHAANV

SEQ ID NO: 844908 - protein, 9 aa, Homo Sapiens
VRVNARVCI

SEQ ID NO: 844909 - protein, 9 aa, Homo Sapiens
EEHEDISVI

SEQ ID NO: 844910 - protein, 9 aa, Homo Sapiens
AINSNGENI

SEQ ID NO: 844911 - protein, 9 aa, Homo Sapiens
EDVSQEDSL

SEQ ID NO: 844912 - protein, 9 aa, Homo Sapiens
YCLAQQQLK

SEQ ID NO: 844913 - protein, 9 aa, Homo Sapiens
VNQPKEVWC

SEQ ID NO: 844914 - protein, 9 aa, Homo Sapiens
YSSFCSVRA

SEQ ID NO: 844915 - protein, 9 aa, Homo Sapiens
NATDRDDGV

SEQ ID NO: 844916 - protein, 9 aa, Homo Sapiens
NGHRKNPYP

SEQ ID NO: 844917 - protein, 9 aa, Homo Sapiens
HMTAETLLQ

SEQ ID NO: 844918 - protein, 9 aa, Homo Sapiens
LPQLHGHFE

SEQ ID NO: 844919 - protein, 9 aa, Homo Sapiens
PMSIGHPVT

SEQ ID NO: 844920 - protein, 9 aa, Homo Sapiens
TLENVQVLD

SEQ ID NO: 844921 - protein, 9 aa, Homo Sapiens
VILSLLLVS

SEQ ID NO: 844922 - protein, 9 aa, Homo Sapiens
CGICGNFNS

SEQ ID NO: 844923 - protein, 9 aa, Homo Sapiens
TFLLLGLSD

SEQ ID NO: 844924 - protein, 9 aa, Homo Sapiens
MSFIFRLIN

SEQ ID NO: 844925 - protein, 9 aa, Homo Sapiens
PPLLKKKLW

SEQ ID NO: 844926 - protein, 9 aa, Homo Sapiens
EFKELVQKD

SEQ ID NO: 844927 - protein, 9 aa, Homo Sapiens
SNAHTTEKP

SEQ ID NO: 844928 - protein, 9 aa, Homo Sapiens
TNPPPEPDP

SEQ ID NO: 844929 - protein, 9 aa, Homo Sapiens
PDISIRARF

SEQ ID NO: 844930 - protein, 9 aa, Homo Sapiens
CSMTSYYGN

SEQ ID NO: 844931 - protein, 9 aa, Homo Sapiens
HILASLFER

SEQ ID NO: 844932 - protein, 9 aa, Homo Sapiens
VLVKRAKKE

SEQ ID NO: 844933 - protein, 9 aa, Homo Sapiens
NEVLTAAVA

SEQ ID NO: 844934 - protein, 9 aa, Homo Sapiens
GLEVLCTHL

SEQ ID NO: 844935 - protein, 9 aa, Homo Sapiens
ILNQSQDGA

SEQ ID NO: 844936 - protein, 9 aa, Homo Sapiens
VVDERRYWK

SEQ ID NO: 844937 - protein, 9 aa, Homo Sapiens
HFNSNCKGG

SEQ ID NO: 844938 - protein, 9 aa, Homo Sapiens
AMCNFAEKV

SEQ ID NO: 844939 - protein, 9 aa, Homo Sapiens
PPARPRIFK

SEQ ID NO: 844940 - protein, 9 aa, Homo Sapiens
TPFSGTRRV

SEQ ID NO: 844941 - protein, 9 aa, Homo Sapiens
EISAPLPLE

SEQ ID NO: 844942 - protein, 9 aa, Homo Sapiens
SILLSEFWS

SEQ ID NO: 844943 - protein, 9 aa, Homo Sapiens
EQLATKDTP

SEQ ID NO: 844944 - protein, 9 aa, Homo Sapiens
INNEWQTSE

SEQ ID NO: 844945 - protein, 9 aa, Homo Sapiens
CAMTKNSKS

SEQ ID NO: 844946 - protein, 9 aa, Homo Sapiens
LKRRIRKGH

SEQ ID NO: 844947 - protein, 9 aa, Homo Sapiens
QEDKIREQE

SEQ ID NO: 844948 - protein, 9 aa, Homo Sapiens
ACYKRNEEL

SEQ ID NO: 844949 - protein, 9 aa, Homo Sapiens
ISNPDCVIY

SEQ ID NO: 844950 - protein, 9 aa, Homo Sapiens
ELEMTPMVF

SEQ ID NO: 844951 - protein, 9 aa, Homo Sapiens
LSEHLRYCN

SEQ ID NO: 844952 - protein, 9 aa, Homo Sapiens
INPMYRVLS

SEQ ID NO: 844953 - protein, 9 aa, Homo Sapiens
NSCLAKLRV

SEQ ID NO: 844954 - protein, 9 aa, Homo Sapiens
TCEFNITKS

SEQ ID NO: 844955 - protein, 9 aa, Homo Sapiens
LFCPRMSAS

SEQ ID NO: 844956 - protein, 9 aa, Homo Sapiens
VLTYTSKEN

SEQ ID NO: 844957 - protein, 9 aa, Homo Sapiens
VSQGRLAIG

SEQ ID NO: 844958 - protein, 9 aa, Homo Sapiens
NKTRIEERS

SEQ ID NO: 844959 - protein, 9 aa, Homo Sapiens
FTGIIILTQ

SEQ ID NO: 844960 - protein, 9 aa, Homo Sapiens
AVGKHNGTV

SEQ ID NO: 844961 - protein, 9 aa, Homo Sapiens
TVDDKLDIT

SEQ ID NO: 844962 - protein, 9 aa, Homo Sapiens
YYRHFVGEI

SEQ ID NO: 844963 - protein, 9 aa, Homo Sapiens
ETAEKLARC

SEQ ID NO: 844964 - protein, 9 aa, Homo Sapiens
NLKVLFVFS

SEQ ID NO: 844965 - protein, 9 aa, Homo Sapiens
TAEDIKAID

SEQ ID NO: 844966 - protein, 9 aa, Homo Sapiens
SAVDFHMKG

SEQ ID NO: 844967 - protein, 9 aa, Homo Sapiens
IKQPLMDNN

SEQ ID NO: 844968 - protein, 9 aa, Homo Sapiens
RRFQNTLLV

SEQ ID NO: 844969 - protein, 9 aa, Homo Sapiens
RVKTSVEHI

SEQ ID NO: 844970 - protein, 9 aa, Homo Sapiens
FAIKYWAKR

SEQ ID NO: 844971 - protein, 9 aa, Homo Sapiens
LGSKVIRQY

SEQ ID NO: 844972 - protein, 9 aa, Homo Sapiens
RLESQGVRG

SEQ ID NO: 844973 - protein, 9 aa, Homo Sapiens
ADGDVFNDC

SEQ ID NO: 844974 - protein, 9 aa, Homo Sapiens
PACSPFVLI

SEQ ID NO: 844975 - protein, 9 aa, Homo Sapiens
RDAWGPGDS

SEQ ID NO: 844976 - protein, 9 aa, Homo Sapiens
LDYHNRQGI

SEQ ID NO: 844977 - protein, 9 aa, Homo Sapiens
MCLCLCVCT

SEQ ID NO: 844978 - protein, 9 aa, Homo Sapiens
RNPSDNSLN

SEQ ID NO: 844979 - protein, 9 aa, Homo Sapiens
TSSFLANKQ

SEQ ID NO: 844980 - protein, 9 aa, Homo Sapiens
EKLWKWIAY

SEQ ID NO: 844981 - protein, 9 aa, Homo Sapiens
KERLNMALG

SEQ ID NO: 844982 - protein, 9 aa, Homo Sapiens
IFFLYMAPR

SEQ ID NO: 844983 - protein, 9 aa, Homo Sapiens
ELVGRVELG

SEQ ID NO: 844984 - protein, 9 aa, Homo Sapiens
EVHGADNFI

SEQ ID NO: 844985 - protein, 9 aa, Homo Sapiens
FYYPRVSED

SEQ ID NO: 844986 - protein, 9 aa, Homo Sapiens
PPPWGIPAH

SEQ ID NO: 844987 - protein, 9 aa, Homo Sapiens
VNANSTPPP

SEQ ID NO: 844988 - protein, 9 aa, Homo Sapiens
TRHFVGLQV

SEQ ID NO: 844989 - protein, 9 aa, Homo Sapiens
HLYWLDSKL

SEQ ID NO: 844990 - protein, 9 aa, Homo Sapiens
NHNQQNGDS

SEQ ID NO: 844991 - protein, 9 aa, Homo Sapiens
GKEGSLKDK

SEQ ID NO: 844992 - protein, 9 aa, Homo Sapiens
EELSCSARN

SEQ ID NO: 844993 - protein, 9 aa, Homo Sapiens
TKHVQIHTG

SEQ ID NO: 844994 - protein, 9 aa, Homo Sapiens
NQLLAEITK

SEQ ID NO: 844995 - protein, 9 aa, Homo Sapiens
GEKGSHMPE

SEQ ID NO: 844996 - protein, 9 aa, Homo Sapiens
NDFEQGKLY

SEQ ID NO: 844997 - protein, 9 aa, Homo Sapiens
GHLQIFYMF

SEQ ID NO: 844998 - protein, 9 aa, Homo Sapiens
VDNTYVFGR

SEQ ID NO: 844999 - protein, 9 aa, Homo Sapiens
TYEDTNFQH

SEQ ID NO: 845000 - protein, 9 aa, Homo Sapiens
IGWNINNDT

SEQ ID NO: 845001 - protein, 9 aa, Homo Sapiens
KLHGKLCGA

SEQ ID NO: 845002 - protein, 9 aa, Homo Sapiens
LIERLNEML

SEQ ID NO: 845003 - protein, 9 aa, Homo Sapiens
LSSRLQTDN

SEQ ID NO: 845004 - protein, 9 aa, Homo Sapiens
VLNLGKVHS

SEQ ID NO: 845005 - protein, 9 aa, Homo Sapiens
AKKPLFSSN

SEQ ID NO: 845006 - protein, 9 aa, Homo Sapiens
IEAPLQQKR

SEQ ID NO: 845007 - protein, 9 aa, Homo Sapiens
DVEEKSKEC

SEQ ID NO: 845008 - protein, 9 aa, Homo Sapiens
GTGSVQKSN

SEQ ID NO: 845009 - protein, 9 aa, Homo Sapiens
IWPGQMMPA

SEQ ID NO: 845010 - protein, 9 aa, Homo Sapiens
AFGQSSGFR

SEQ ID NO: 845011 - protein, 9 aa, Homo Sapiens
SFENETEET

SEQ ID NO: 845012 - protein, 9 aa, Homo Sapiens
QCHSHFHNI

SEQ ID NO: 845013 - protein, 9 aa, Homo Sapiens
GDKTKWIIG

SEQ ID NO: 845014 - protein, 9 aa, Homo Sapiens
ETTHKSSAI

SEQ ID NO: 845015 - protein, 9 aa, Homo Sapiens
PVDPNKPTY

SEQ ID NO: 845016 - protein, 9 aa, Homo Sapiens
SICTGIKEF

SEQ ID NO: 845017 - protein, 9 aa, Homo Sapiens
SIQRGQFVG

SEQ ID NO: 845018 - protein, 9 aa, Homo Sapiens
RTLTSFGGQ

SEQ ID NO: 845019 - protein, 9 aa, Homo Sapiens
DPGLPDRTG

SEQ ID NO: 845020 - protein, 9 aa, Homo Sapiens
YQLQIVIFL

SEQ ID NO: 845021 - protein, 9 aa, Homo Sapiens
YQAVALDEC

SEQ ID NO: 845022 - protein, 9 aa, Homo Sapiens
DVAGTDSGC

SEQ ID NO: 845023 - protein, 9 aa, Homo Sapiens
SAHFSQPTG

SEQ ID NO: 845024 - protein, 9 aa, Homo Sapiens
KVIRLLATN

SEQ ID NO: 845025 - protein, 9 aa, Homo Sapiens
QQPDDRIPF

SEQ ID NO: 845026 - protein, 9 aa, Homo Sapiens
YLGCHQWVS

SEQ ID NO: 845027 - protein, 9 aa, Homo Sapiens
GYVAKEKYI

SEQ ID NO: 845028 - protein, 9 aa, Homo Sapiens
PLSIIPNYR

SEQ ID NO: 845029 - protein, 9 aa, Homo Sapiens
GHFEISTDK

SEQ ID NO: 845030 - protein, 9 aa, Homo Sapiens
ELYAPWCGH

SEQ ID NO: 845031 - protein, 9 aa, Homo Sapiens
VLFKMTGES

SEQ ID NO: 845032 - protein, 9 aa, Homo Sapiens
PPSPIKPNI

SEQ ID NO: 845033 - protein, 9 aa, Homo Sapiens
EIEEKYSII

SEQ ID NO: 845034 - protein, 9 aa, Homo Sapiens
LPQSPSFPL

SEQ ID NO: 845035 - protein, 9 aa, Homo Sapiens
PLYMSLFSF

SEQ ID NO: 845036 - protein, 9 aa, Homo Sapiens
CGPNVIVQF

SEQ ID NO: 845037 - protein, 9 aa, Homo Sapiens
LRNYTRMEL

SEQ ID NO: 845038 - protein, 9 aa, Homo Sapiens
GPNVIVQFS

SEQ ID NO: 845039 - protein, 9 aa, Homo Sapiens
VGIQYFYST

SEQ ID NO: 845040 - protein, 9 aa, Homo Sapiens
NILAHYMRR

SEQ ID NO: 845041 - protein, 9 aa, Homo Sapiens
LRSLGEKAA

SEQ ID NO: 845042 - protein, 9 aa, Homo Sapiens
TTTALPVRF

SEQ ID NO: 845043 - protein, 9 aa, Homo Sapiens
FSYFAHAQV

SEQ ID NO: 845044 - protein, 9 aa, Homo Sapiens
WDSELAKLP

SEQ ID NO: 845045 - protein, 9 aa, Homo Sapiens
PELCLLIPP

SEQ ID NO: 845046 - protein, 9 aa, Homo Sapiens
SKDKPFKCQ

SEQ ID NO: 845047 - protein, 9 aa, Homo Sapiens
KPHKIKFMK

SEQ ID NO: 845048 - protein, 9 aa, Homo Sapiens
ACNNRTMKY

SEQ ID NO: 845049 - protein, 9 aa, Homo Sapiens
IYECQSSPC

SEQ ID NO: 845050 - protein, 9 aa, Homo Sapiens
GDRIKSLSD

SEQ ID NO: 845051 - protein, 9 aa, Homo Sapiens
HSLKCMIYE

SEQ ID NO: 845052 - protein, 9 aa, Homo Sapiens
TNNQQVKPL

SEQ ID NO: 845053 - protein, 9 aa, Homo Sapiens
NKRVSSFRG

SEQ ID NO: 845054 - protein, 9 aa, Homo Sapiens
SDVLNNAIF

SEQ ID NO: 845055 - protein, 9 aa, Homo Sapiens
PKLPSGFPI

SEQ ID NO: 845056 - protein, 9 aa, Homo Sapiens
RLDLLSCLL

SEQ ID NO: 845057 - protein, 9 aa, Homo Sapiens
SYSVGQMFL

SEQ ID NO: 845058 - protein, 9 aa, Homo Sapiens
SFIMDQANR

SEQ ID NO: 845059 - protein, 9 aa, Homo Sapiens
IILEKKFYF

SEQ ID NO: 845060 - protein, 9 aa, Homo Sapiens
SQMGKPVPF

SEQ ID NO: 845061 - protein, 9 aa, Homo Sapiens
AIRTDIMDD

SEQ ID NO: 845062 - protein, 9 aa, Homo Sapiens
LLDPSHQKK

SEQ ID NO: 845063 - protein, 9 aa, Homo Sapiens
QPFECLECG

SEQ ID NO: 845064 - protein, 9 aa, Homo Sapiens
TELVPLVCK

SEQ ID NO: 845065 - protein, 9 aa, Homo Sapiens
NAPQSPKDA

SEQ ID NO: 845066 - protein, 9 aa, Homo Sapiens
HLNCLTCMM

SEQ ID NO: 845067 - protein, 9 aa, Homo Sapiens
QGIQNYHSG

SEQ ID NO: 845068 - protein, 9 aa, Homo Sapiens
EEEPLDEAH

SEQ ID NO: 845069 - protein, 9 aa, Homo Sapiens
MCKNHSLDC

SEQ ID NO: 845070 - protein, 9 aa, Homo Sapiens
RRLKKDNKV

SEQ ID NO: 845071 - protein, 9 aa, Homo Sapiens
HFDRTKNGT

SEQ ID NO: 845072 - protein, 9 aa, Homo Sapiens
PRFKNSLED

SEQ ID NO: 845073 - protein, 9 aa, Homo Sapiens
QDKSDTNFK

SEQ ID NO: 845074 - protein, 9 aa, Homo Sapiens
FFTWGNNSH

SEQ ID NO: 845075 - protein, 9 aa, Homo Sapiens
TSIDESSSM

SEQ ID NO: 845076 - protein, 9 aa, Homo Sapiens
SEIYNTLST

SEQ ID NO: 845077 - protein, 9 aa, Homo Sapiens
RRSLTSGSL

SEQ ID NO: 845078 - protein, 9 aa, Homo Sapiens
GELPSVRPL

SEQ ID NO: 845079 - protein, 9 aa, Homo Sapiens
SNALNQNLV

SEQ ID NO: 845080 - protein, 9 aa, Homo Sapiens
HKNVIQSVR

SEQ ID NO: 845081 - protein, 9 aa, Homo Sapiens
RPYTCKTVE

SEQ ID NO: 845082 - protein, 9 aa, Homo Sapiens
SIYQSSDMK

SEQ ID NO: 845083 - protein, 9 aa, Homo Sapiens
SEPQYSVAL

SEQ ID NO: 845084 - protein, 9 aa, Homo Sapiens
LIDKEDLKD

SEQ ID NO: 845085 - protein, 9 aa, Homo Sapiens
RWDLHVSTG

SEQ ID NO: 845086 - protein, 9 aa, Homo Sapiens
TCGIGNDYF

SEQ ID NO: 845087 - protein, 9 aa, Homo Sapiens
TRSSSVYRD

SEQ ID NO: 845088 - protein, 9 aa, Homo Sapiens
MFWGLHWVM

SEQ ID NO: 845089 - protein, 9 aa, Homo Sapiens
LWELNKPFS

SEQ ID NO: 845090 - protein, 9 aa, Homo Sapiens
AFLRWKGYN

SEQ ID NO: 845091 - protein, 9 aa, Homo Sapiens
DKEPVPMSL

SEQ ID NO: 845092 - protein, 9 aa, Homo Sapiens
ILGWICLCF

SEQ ID NO: 845093 - protein, 9 aa, Homo Sapiens
GQRGKTLCL

SEQ ID NO: 845094 - protein, 9 aa, Homo Sapiens
AACIKLIEK

SEQ ID NO: 845095 - protein, 9 aa, Homo Sapiens
PQNKLECLK

SEQ ID NO: 845096 - protein, 9 aa, Homo Sapiens
CNKSFLATV

SEQ ID NO: 845097 - protein, 9 aa, Homo Sapiens
LDKEPVPMS

SEQ ID NO: 845098 - protein, 9 aa, Homo Sapiens
IRITGSGRS

SEQ ID NO: 845099 - protein, 9 aa, Homo Sapiens
KDKVQDEAQ

SEQ ID NO: 845100 - protein, 9 aa, Homo Sapiens
LAHYHAPST

SEQ ID NO: 845101 - protein, 9 aa, Homo Sapiens
NNTPSPFIE

SEQ ID NO: 845102 - protein, 9 aa, Homo Sapiens
RMLGYQVKE

SEQ ID NO: 845103 - protein, 9 aa, Homo Sapiens
LSDKFYYTE

SEQ ID NO: 845104 - protein, 9 aa, Homo Sapiens
SFNLFVTAP

SEQ ID NO: 845105 - protein, 9 aa, Homo Sapiens
ISLLQHNMK

SEQ ID NO: 845106 - protein, 9 aa, Homo Sapiens
MRLTRHSLG

SEQ ID NO: 845107 - protein, 9 aa, Homo Sapiens
ATIAAMEDR

SEQ ID NO: 845108 - protein, 9 aa, Homo Sapiens
ILDDLSPRN

SEQ ID NO: 845109 - protein, 9 aa, Homo Sapiens
LLGAMLGLL

SEQ ID NO: 845110 - protein, 9 aa, Homo Sapiens
EIDSTFLNV

SEQ ID NO: 845111 - protein, 9 aa, Homo Sapiens
KPNAKECTN

SEQ ID NO: 845112 - protein, 9 aa, Homo Sapiens
GIELMESEE

SEQ ID NO: 845113 - protein, 9 aa, Homo Sapiens
KWQHQNNSK

SEQ ID NO: 845114 - protein, 9 aa, Homo Sapiens
HLNAGYNVV

SEQ ID NO: 845115 - protein, 9 aa, Homo Sapiens
KLPSVRPFK

SEQ ID NO: 845116 - protein, 9 aa, Homo Sapiens
PGTDEAEDP

SEQ ID NO: 845117 - protein, 9 aa, Homo Sapiens
TLHKAFTGS

SEQ ID NO: 845118 - protein, 9 aa, Homo Sapiens
IIILEPDKN

SEQ ID NO: 845119 - protein, 9 aa, Homo Sapiens
IVKAVEFIL

SEQ ID NO: 845120 - protein, 9 aa, Homo Sapiens
NAEDENREE

SEQ ID NO: 845121 - protein, 9 aa, Homo Sapiens
AGPSRVCQN

SEQ ID NO: 845122 - protein, 9 aa, Homo Sapiens
YKLSSKSDV

SEQ ID NO: 845123 - protein, 9 aa, Homo Sapiens
VCRAVLNFL

SEQ ID NO: 845124 - protein, 9 aa, Homo Sapiens
HTIIGGIVA

SEQ ID NO: 845125 - protein, 9 aa, Homo Sapiens
DLRWTSENI

SEQ ID NO: 845126 - protein, 9 aa, Homo Sapiens
KKAVKARTT

SEQ ID NO: 845127 - protein, 9 aa, Homo Sapiens
WIRYLPKLT

SEQ ID NO: 845128 - protein, 9 aa, Homo Sapiens
SPSLVAHQI

SEQ ID NO: 845129 - protein, 9 aa, Homo Sapiens
TGYFFIHGQ

SEQ ID NO: 845130 - protein, 9 aa, Homo Sapiens
EPNYATSTT

SEQ ID NO: 845131 - protein, 9 aa, Homo Sapiens
IDNLHRTFV

SEQ ID NO: 845132 - protein, 9 aa, Homo Sapiens
VDYIVSTWS

SEQ ID NO: 845133 - protein, 9 aa, Homo Sapiens
SDNEDGGEA

SEQ ID NO: 845134 - protein, 9 aa, Homo Sapiens
SRAIKNTSK

SEQ ID NO: 845135 - protein, 9 aa, Homo Sapiens
KQGHSIVIS

SEQ ID NO: 845136 - protein, 9 aa, Homo Sapiens
FHGQTGPPG

SEQ ID NO: 845137 - protein, 9 aa, Homo Sapiens
IDTKENNGV

SEQ ID NO: 845138 - protein, 9 aa, Homo Sapiens
ADCSEACLK

SEQ ID NO: 845139 - protein, 9 aa, Homo Sapiens
LGTGPEKRE

SEQ ID NO: 845140 - protein, 9 aa, Homo Sapiens
IIGIKKAIT

SEQ ID NO: 845141 - protein, 9 aa, Homo Sapiens
KQECLIATF

SEQ ID NO: 845142 - protein, 9 aa, Homo Sapiens
RQKSSYNYI

SEQ ID NO: 845143 - protein, 9 aa, Homo Sapiens
LQKQHFCGQ

SEQ ID NO: 845144 - protein, 9 aa, Homo Sapiens
VSDKPLDGT

SEQ ID NO: 845145 - protein, 9 aa, Homo Sapiens
NLASLIYST

SEQ ID NO: 845146 - protein, 9 aa, Homo Sapiens
HMSTSLMQM

SEQ ID NO: 845147 - protein, 9 aa, Homo Sapiens
GIYRCYYRS

SEQ ID NO: 845148 - protein, 9 aa, Homo Sapiens
FWDKNWPAG

SEQ ID NO: 845149 - protein, 9 aa, Homo Sapiens
EMASEEAAI

SEQ ID NO: 845150 - protein, 9 aa, Homo Sapiens
TEVKPMWPK

SEQ ID NO: 845151 - protein, 9 aa, Homo Sapiens
SPRGRIRLA

SEQ ID NO: 845152 - protein, 9 aa, Homo Sapiens
RIEKGSSYR

SEQ ID NO: 845153 - protein, 9 aa, Homo Sapiens
EVPEMFTKK

SEQ ID NO: 845154 - protein, 9 aa, Homo Sapiens
KTTPGAQEG

SEQ ID NO: 845155 - protein, 9 aa, Homo Sapiens
NAQKKINRL

SEQ ID NO: 845156 - protein, 9 aa, Homo Sapiens
KTTQEDHMK

SEQ ID NO: 845157 - protein, 9 aa, Homo Sapiens
TLAAAVQGT

SEQ ID NO: 845158 - protein, 9 aa, Homo Sapiens
IQAARGYVV

SEQ ID NO: 845159 - protein, 9 aa, Homo Sapiens
EYPIFDKFS

SEQ ID NO: 845160 - protein, 9 aa, Homo Sapiens
DNLQLKIGC

SEQ ID NO: 845161 - protein, 9 aa, Homo Sapiens
LKKITKDIM

SEQ ID NO: 845162 - protein, 9 aa, Homo Sapiens
SRLSEHAKI

SEQ ID NO: 845163 - protein, 9 aa, Homo Sapiens
LEYYDVSDS

SEQ ID NO: 845164 - protein, 9 aa, Homo Sapiens
KLGETDEDK

SEQ ID NO: 845165 - protein, 9 aa, Homo Sapiens
VTEGRAHPA

SEQ ID NO: 845166 - protein, 9 aa, Homo Sapiens
AGVPGPLPY

SEQ ID NO: 845167 - protein, 9 aa, Homo Sapiens
PAWGLVATL

SEQ ID NO: 845168 - protein, 9 aa, Homo Sapiens
KYQAGEGRR

SEQ ID NO: 845169 - protein, 9 aa, Homo Sapiens
QASFLNNSV

SEQ ID NO: 845170 - protein, 9 aa, Homo Sapiens
QLRKKRRQA

SEQ ID NO: 845171 - protein, 9 aa, Homo Sapiens
GEFKGLFKM

SEQ ID NO: 845172 - protein, 9 aa, Homo Sapiens
IPAHQRCDD

SEQ ID NO: 845173 - protein, 9 aa, Homo Sapiens
ESVFWNFDV

SEQ ID NO: 845174 - protein, 9 aa, Homo Sapiens
PQESMSASL

SEQ ID NO: 845175 - protein, 9 aa, Homo Sapiens
GIYANIFYY

SEQ ID NO: 845176 - protein, 9 aa, Homo Sapiens
YDLSQKPGD

SEQ ID NO: 845177 - protein, 9 aa, Homo Sapiens
MQNNTFPPS

SEQ ID NO: 845178 - protein, 9 aa, Homo Sapiens
WRTMSSSDR

SEQ ID NO: 845179 - protein, 9 aa, Homo Sapiens
IFEIHFSQW

SEQ ID NO: 845180 - protein, 9 aa, Homo Sapiens
QSNRDELQR

SEQ ID NO: 845181 - protein, 9 aa, Homo Sapiens
MKGLVQELW

SEQ ID NO: 845182 - protein, 9 aa, Homo Sapiens
ITKTEVAIQ

SEQ ID NO: 845183 - protein, 9 aa, Homo Sapiens
IISAQQEQT

SEQ ID NO: 845184 - protein, 9 aa, Homo Sapiens
RQISGGFDE

SEQ ID NO: 845185 - protein, 9 aa, Homo Sapiens
QKKYKNRTN

SEQ ID NO: 845186 - protein, 9 aa, Homo Sapiens
KRQGDRGQG

SEQ ID NO: 845187 - protein, 9 aa, Homo Sapiens
AGFIILSLF

SEQ ID NO: 845188 - protein, 9 aa, Homo Sapiens
FTVITPCRT

SEQ ID NO: 845189 - protein, 9 aa, Homo Sapiens
LSLKEAMEE

SEQ ID NO: 845190 - protein, 9 aa, Homo Sapiens
VQWQIILEQ

SEQ ID NO: 845191 - protein, 9 aa, Homo Sapiens
CTCTSQKAV

SEQ ID NO: 845192 - protein, 9 aa, Homo Sapiens
FSQVTVSSF

SEQ ID NO: 845193 - protein, 9 aa, Homo Sapiens
LETLPDEMG

SEQ ID NO: 845194 - protein, 9 aa, Homo Sapiens
PKTVDTIKR

SEQ ID NO: 845195 - protein, 9 aa, Homo Sapiens
YFLCDIPAV

SEQ ID NO: 845196 - protein, 9 aa, Homo Sapiens
AIHAMNFSN

SEQ ID NO: 845197 - protein, 9 aa, Homo Sapiens
LDLRGNTFE

SEQ ID NO: 845198 - protein, 9 aa, Homo Sapiens
LFRSCSRLT

SEQ ID NO: 845199 - protein, 9 aa, Homo Sapiens
VKIIFSVIH

SEQ ID NO: 845200 - protein, 9 aa, Homo Sapiens
ASDAGDGLP

SEQ ID NO: 845201 - protein, 9 aa, Homo Sapiens
IIIRCKRKL

SEQ ID NO: 845202 - protein, 9 aa, Homo Sapiens
VLKVQDLSY

SEQ ID NO: 845203 - protein, 9 aa, Homo Sapiens
NIWKKQEER

SEQ ID NO: 845204 - protein, 9 aa, Homo Sapiens
SYDIINGDG

SEQ ID NO: 845205 - protein, 9 aa, Homo Sapiens
DLFMSGQKK

SEQ ID NO: 845206 - protein, 9 aa, Homo Sapiens
RPKSNQYPS

SEQ ID NO: 845207 - protein, 9 aa, Homo Sapiens
APFQSELHP

SEQ ID NO: 845208 - protein, 9 aa, Homo Sapiens
SHRPNQHNA

SEQ ID NO: 845209 - protein, 9 aa, Homo Sapiens
ILGLETIRL

SEQ ID NO: 845210 - protein, 9 aa, Homo Sapiens
IKYNVEHSV

SEQ ID NO: 845211 - protein, 9 aa, Homo Sapiens
GEGRFCRMD

SEQ ID NO: 845212 - protein, 9 aa, Homo Sapiens
HLFLSHFGF

SEQ ID NO: 845213 - protein, 9 aa, Homo Sapiens
APQSPKDAY

SEQ ID NO: 845214 - protein, 9 aa, Homo Sapiens
ILDPLKYHM

SEQ ID NO: 845215 - protein, 9 aa, Homo Sapiens
SFTEEQLHP

SEQ ID NO: 845216 - protein, 9 aa, Homo Sapiens
LMTAEIDST

SEQ ID NO: 845217 - protein, 9 aa, Homo Sapiens
TREGVDNAC

SEQ ID NO: 845218 - protein, 9 aa, Homo Sapiens
NITSPMSIG

SEQ ID NO: 845219 - protein, 9 aa, Homo Sapiens
CGWNFPSMS

SEQ ID NO: 845220 - protein, 9 aa, Homo Sapiens
MSLFERLRS

SEQ ID NO: 845221 - protein, 9 aa, Homo Sapiens
ETVSCCPTG

SEQ ID NO: 845222 - protein, 9 aa, Homo Sapiens
VVGSLIIVI

SEQ ID NO: 845223 - protein, 9 aa, Homo Sapiens
RVVMNSRDF

SEQ ID NO: 845224 - protein, 9 aa, Homo Sapiens
MTNCEVKAS

SEQ ID NO: 845225 - protein, 9 aa, Homo Sapiens
QKEKSKVAK

SEQ ID NO: 845226 - protein, 9 aa, Homo Sapiens
SSIHSKYKI

SEQ ID NO: 845227 - protein, 9 aa, Homo Sapiens
SGICKIHPP

SEQ ID NO: 845228 - protein, 9 aa, Homo Sapiens
LLASHTIQG

SEQ ID NO: 845229 - protein, 9 aa, Homo Sapiens
TTPLPVTNT

SEQ ID NO: 845230 - protein, 9 aa, Homo Sapiens
LRMRTLADV

SEQ ID NO: 845231 - protein, 9 aa, Homo Sapiens
LINKQVIDS

SEQ ID NO: 845232 - protein, 9 aa, Homo Sapiens
LAVQYLKKQ

SEQ ID NO: 845233 - protein, 9 aa, Homo Sapiens
VIPWKQGLE

SEQ ID NO: 845234 - protein, 9 aa, Homo Sapiens
CSISNPDCV

SEQ ID NO: 845235 - protein, 9 aa, Homo Sapiens
VSGFSSPRT

SEQ ID NO: 845236 - protein, 9 aa, Homo Sapiens
ILILPGKLS

SEQ ID NO: 845237 - protein, 9 aa, Homo Sapiens
ESKHLHNKE

SEQ ID NO: 845238 - protein, 9 aa, Homo Sapiens
PLDWLCGES

SEQ ID NO: 845239 - protein, 9 aa, Homo Sapiens
VCIRCDAGM

SEQ ID NO: 845240 - protein, 9 aa, Homo Sapiens
CWGKPNAKE

SEQ ID NO: 845241 - protein, 9 aa, Homo Sapiens
QVQGLINKY

SEQ ID NO: 845242 - protein, 9 aa, Homo Sapiens
GYVVLLESL

SEQ ID NO: 845243 - protein, 9 aa, Homo Sapiens
RKISTEIEL

SEQ ID NO: 845244 - protein, 9 aa, Homo Sapiens
VAVTDINYH

SEQ ID NO: 845245 - protein, 9 aa, Homo Sapiens
ECKSETAAI

SEQ ID NO: 845246 - protein, 9 aa, Homo Sapiens
VLNHVEQLR

SEQ ID NO: 845247 - protein, 9 aa, Homo Sapiens
SVCAILVFQ

SEQ ID NO: 845248 - protein, 9 aa, Homo Sapiens
QHTPCYRTT

SEQ ID NO: 845249 - protein, 9 aa, Homo Sapiens
QSFNHEQTK

SEQ ID NO: 845250 - protein, 9 aa, Homo Sapiens
SPVGDKAKY

SEQ ID NO: 845251 - protein, 9 aa, Homo Sapiens
CRKKVHHPF

SEQ ID NO: 845252 - protein, 9 aa, Homo Sapiens
STINTHKRI

SEQ ID NO: 845253 - protein, 9 aa, Homo Sapiens
HGIRNTFQG

SEQ ID NO: 845254 - protein, 9 aa, Homo Sapiens
LNMDEYNLF

SEQ ID NO: 845255 - protein, 9 aa, Homo Sapiens
SRIESEVRW

SEQ ID NO: 845256 - protein, 9 aa, Homo Sapiens
EHLASVVIY

SEQ ID NO: 845257 - protein, 9 aa, Homo Sapiens
RLNLYPKEW

SEQ ID NO: 845258 - protein, 9 aa, Homo Sapiens
TTCGTLKIS

SEQ ID NO: 845259 - protein, 9 aa, Homo Sapiens
SQEKRRSAD

SEQ ID NO: 845260 - protein, 9 aa, Homo Sapiens
ERKHTLEME

SEQ ID NO: 845261 - protein, 9 aa, Homo Sapiens
LALAQNKSL

SEQ ID NO: 845262 - protein, 9 aa, Homo Sapiens
PGDLQWLKL

SEQ ID NO: 845263 - protein, 9 aa, Homo Sapiens
RKVGAPSHG

SEQ ID NO: 845264 - protein, 9 aa, Homo Sapiens
SSLSVSPLI

SEQ ID NO: 845265 - protein, 9 aa, Homo Sapiens
SVALNTAYT

SEQ ID NO: 845266 - protein, 9 aa, Homo Sapiens
LCLSMLEDG

SEQ ID NO: 845267 - protein, 9 aa, Homo Sapiens
SGMYVIYSK

SEQ ID NO: 845268 - protein, 9 aa, Homo Sapiens
LKTISESYS

SEQ ID NO: 845269 - protein, 9 aa, Homo Sapiens
LTFNFQGIV

SEQ ID NO: 845270 - protein, 9 aa, Homo Sapiens
DNVTRLLSQ

SEQ ID NO: 845271 - protein, 9 aa, Homo Sapiens
QGFEVLVEK

SEQ ID NO: 845272 - protein, 9 aa, Homo Sapiens
YMIPIENMV

SEQ ID NO: 845273 - protein, 9 aa, Homo Sapiens
FKPDSEDKI

SEQ ID NO: 845274 - protein, 9 aa, Homo Sapiens
HSPDAKEDP

SEQ ID NO: 845275 - protein, 9 aa, Homo Sapiens
GSRSTDDQI

SEQ ID NO: 845276 - protein, 9 aa, Homo Sapiens
LTVRGLKII

SEQ ID NO: 845277 - protein, 9 aa, Homo Sapiens
HYSEKPINW

SEQ ID NO: 845278 - protein, 9 aa, Homo Sapiens
LVLHKSGLL

SEQ ID NO: 845279 - protein, 9 aa, Homo Sapiens
LWYQDTARL

SEQ ID NO: 845280 - protein, 9 aa, Homo Sapiens
TFRLSSQSA

SEQ ID NO: 845281 - protein, 9 aa, Homo Sapiens
QKEGLYEKV

SEQ ID NO: 845282 - protein, 9 aa, Homo Sapiens
SSSNAAVPE

SEQ ID NO: 845283 - protein, 9 aa, Homo Sapiens
FQPRNIQGS

SEQ ID NO: 845284 - protein, 9 aa, Homo Sapiens
IGPGYRVAC

SEQ ID NO: 845285 - protein, 9 aa, Homo Sapiens
IHKKLATKN

SEQ ID NO: 845286 - protein, 9 aa, Homo Sapiens
PRVLSVYIF

SEQ ID NO: 845287 - protein, 9 aa, Homo Sapiens
EEQRPNKST

SEQ ID NO: 845288 - protein, 9 aa, Homo Sapiens
NLDNNQIRK

SEQ ID NO: 845289 - protein, 9 aa, Homo Sapiens
KAPEKTIDQ

SEQ ID NO: 845290 - protein, 9 aa, Homo Sapiens
EILFGTPLP

SEQ ID NO: 845291 - protein, 9 aa, Homo Sapiens
LKNRYYVSN

SEQ ID NO: 845292 - protein, 9 aa, Homo Sapiens
INVVRQLVA

SEQ ID NO: 845293 - protein, 9 aa, Homo Sapiens
AKLKGLHRQ

SEQ ID NO: 845294 - protein, 9 aa, Homo Sapiens
RAKRNTVLD

SEQ ID NO: 845295 - protein, 9 aa, Homo Sapiens
PLISDADLD

SEQ ID NO: 845296 - protein, 9 aa, Homo Sapiens
TSHWHTKKL

SEQ ID NO: 845297 - protein, 9 aa, Homo Sapiens
ETSLPPLHR

SEQ ID NO: 845298 - protein, 9 aa, Homo Sapiens
DDNFISRAF

SEQ ID NO: 845299 - protein, 9 aa, Homo Sapiens
KETATTPKR

SEQ ID NO: 845300 - protein, 9 aa, Homo Sapiens
WPLAEVAEG

SEQ ID NO: 845301 - protein, 9 aa, Homo Sapiens
ITGRDVVLA

SEQ ID NO: 845302 - protein, 9 aa, Homo Sapiens
HDSYNRARE

SEQ ID NO: 845303 - protein, 9 aa, Homo Sapiens
NIIKRKEIF

SEQ ID NO: 845304 - protein, 9 aa, Homo Sapiens
RQKALEEKR

SEQ ID NO: 845305 - protein, 9 aa, Homo Sapiens
SVPLTNLTD

SEQ ID NO: 845306 - protein, 9 aa, Homo Sapiens
PAVMVILLI

SEQ ID NO: 845307 - protein, 9 aa, Homo Sapiens
EVTELLMGE

SEQ ID NO: 845308 - protein, 9 aa, Homo Sapiens
HYPQLHARK

SEQ ID NO: 845309 - protein, 9 aa, Homo Sapiens
RLNAELLTE

SEQ ID NO: 845310 - protein, 9 aa, Homo Sapiens
RNQREFSMA

SEQ ID NO: 845311 - protein, 9 aa, Homo Sapiens
TPIIPAFSN

SEQ ID NO: 845312 - protein, 9 aa, Homo Sapiens
TGLECPVCK

SEQ ID NO: 845313 - protein, 9 aa, Homo Sapiens
GDRCDNCGG

SEQ ID NO: 845314 - protein, 9 aa, Homo Sapiens
PDDQEFLKG

SEQ ID NO: 845315 - protein, 9 aa, Homo Sapiens
GDNKMVTTF

SEQ ID NO: 845316 - protein, 9 aa, Homo Sapiens
WAHDLQQNS

SEQ ID NO: 845317 - protein, 9 aa, Homo Sapiens
QNNFSYKDD

SEQ ID NO: 845318 - protein, 9 aa, Homo Sapiens
DVAHVTSTV

SEQ ID NO: 845319 - protein, 9 aa, Homo Sapiens
KEMFIDTVS

SEQ ID NO: 845320 - protein, 9 aa, Homo Sapiens
PPKPGHRSE

SEQ ID NO: 845321 - protein, 9 aa, Homo Sapiens
DLIPKMPYE

SEQ ID NO: 845322 - protein, 9 aa, Homo Sapiens
EYGLVDGIY

SEQ ID NO: 845323 - protein, 9 aa, Homo Sapiens
LQINPIPQP

SEQ ID NO: 845324 - protein, 9 aa, Homo Sapiens
CILIIEQSR

SEQ ID NO: 845325 - protein, 9 aa, Homo Sapiens
HDQEVIPMH

SEQ ID NO: 845326 - protein, 9 aa, Homo Sapiens
PAGTWVITM

SEQ ID NO: 845327 - protein, 9 aa, Homo Sapiens
TNVLNASIS

SEQ ID NO: 845328 - protein, 9 aa, Homo Sapiens
LAWRLWRCQ

SEQ ID NO: 845329 - protein, 9 aa, Homo Sapiens
IAACSLQPD

SEQ ID NO: 845330 - protein, 9 aa, Homo Sapiens
VEFTTHEDA

SEQ ID NO: 845331 - protein, 9 aa, Homo Sapiens
HLAVKAYTS

SEQ ID NO: 845332 - protein, 9 aa, Homo Sapiens
NHQRVHTED

SEQ ID NO: 845333 - protein, 9 aa, Homo Sapiens
KAFINQAFL

SEQ ID NO: 845334 - protein, 9 aa, Homo Sapiens
AQKYYDDYR

SEQ ID NO: 845335 - protein, 9 aa, Homo Sapiens
FHLTAITIF

SEQ ID NO: 845336 - protein, 9 aa, Homo Sapiens
EYKNRDAIL

SEQ ID NO: 845337 - protein, 9 aa, Homo Sapiens
MLLFYSLKN

SEQ ID NO: 845338 - protein, 9 aa, Homo Sapiens
ITKLRKLFH

SEQ ID NO: 845339 - protein, 9 aa, Homo Sapiens
VVVVIVGLY

SEQ ID NO: 845340 - protein, 9 aa, Homo Sapiens
SRKAKEEGA

SEQ ID NO: 845341 - protein, 9 aa, Homo Sapiens
SREIARFFC

SEQ ID NO: 845342 - protein, 9 aa, Homo Sapiens
SLQRDMQPL

SEQ ID NO: 845343 - protein, 9 aa, Homo Sapiens
EEVEAGTAK

SEQ ID NO: 845344 - protein, 9 aa, Homo Sapiens
CVYHSSLVV

SEQ ID NO: 845345 - protein, 9 aa, Homo Sapiens
HPLKQRRRR

SEQ ID NO: 845346 - protein, 9 aa, Homo Sapiens
FNTIAAEFK

SEQ ID NO: 845347 - protein, 9 aa, Homo Sapiens
ASTPMNVQS

SEQ ID NO: 845348 - protein, 9 aa, Homo Sapiens
LNLKLPLQF

SEQ ID NO: 845349 - protein, 9 aa, Homo Sapiens
AWAVYYAHY

SEQ ID NO: 845350 - protein, 9 aa, Homo Sapiens
LTAAVAQAS

SEQ ID NO: 845351 - protein, 9 aa, Homo Sapiens
EKKQEKALW

SEQ ID NO: 845352 - protein, 9 aa, Homo Sapiens
KGQKAYAPS

SEQ ID NO: 845353 - protein, 9 aa, Homo Sapiens
CSIIHPVLG

SEQ ID NO: 845354 - protein, 9 aa, Homo Sapiens
NRYMIVSFW

SEQ ID NO: 845355 - protein, 9 aa, Homo Sapiens
SCETSGSIW

SEQ ID NO: 845356 - protein, 9 aa, Homo Sapiens
DPFYLNHNL

SEQ ID NO: 845357 - protein, 9 aa, Homo Sapiens
EDSFLQYFG

SEQ ID NO: 845358 - protein, 9 aa, Homo Sapiens
TTQMGRGTK

SEQ ID NO: 845359 - protein, 9 aa, Homo Sapiens
GRCFRGSSY

SEQ ID NO: 845360 - protein, 9 aa, Homo Sapiens
VLNRCLEMD

SEQ ID NO: 845361 - protein, 9 aa, Homo Sapiens
LITREPALD

SEQ ID NO: 845362 - protein, 9 aa, Homo Sapiens
EEAHKKFNI

SEQ ID NO: 845363 - protein, 9 aa, Homo Sapiens
AMLCAGIPD

SEQ ID NO: 845364 - protein, 9 aa, Homo Sapiens
RVFFGNNLN

SEQ ID NO: 845365 - protein, 9 aa, Homo Sapiens
SIKDLSAIQ

SEQ ID NO: 845366 - protein, 9 aa, Homo Sapiens
WKLAGRAQH

SEQ ID NO: 845367 - protein, 9 aa, Homo Sapiens
VYLMTLGKL

SEQ ID NO: 845368 - protein, 9 aa, Homo Sapiens
LRQAQEKSG

SEQ ID NO: 845369 - protein, 9 aa, Homo Sapiens
GNFNSISTS

SEQ ID NO: 845370 - protein, 9 aa, Homo Sapiens
DDTRVSTNG

SEQ ID NO: 845371 - protein, 9 aa, Homo Sapiens
YNHMRAAIL

SEQ ID NO: 845372 - protein, 9 aa, Homo Sapiens
SSQGDEEKY

SEQ ID NO: 845373 - protein, 9 aa, Homo Sapiens
TGFCLYRGL

SEQ ID NO: 845374 - protein, 9 aa, Homo Sapiens
GQLFSNSSI

SEQ ID NO: 845375 - protein, 9 aa, Homo Sapiens
YRHNFARQD

SEQ ID NO: 845376 - protein, 9 aa, Homo Sapiens
VIRNTNFCH

SEQ ID NO: 845377 - protein, 9 aa, Homo Sapiens
PNRYLVKAV

SEQ ID NO: 845378 - protein, 9 aa, Homo Sapiens
FASAYEHHL

SEQ ID NO: 845379 - protein, 9 aa, Homo Sapiens
EELKEKANI

SEQ ID NO: 845380 - protein, 9 aa, Homo Sapiens
KTRLELSNP

SEQ ID NO: 845381 - protein, 9 aa, Homo Sapiens
FITAAWLLF

SEQ ID NO: 845382 - protein, 9 aa, Homo Sapiens
VEKLAKYLD

SEQ ID NO: 845383 - protein, 9 aa, Homo Sapiens
SRIRRKSSR

SEQ ID NO: 845384 - protein, 9 aa, Homo Sapiens
LFLLQQKPG

SEQ ID NO: 845385 - protein, 9 aa, Homo Sapiens
ARATLRERY

SEQ ID NO: 845386 - protein, 9 aa, Homo Sapiens
LSLQKSYEI

SEQ ID NO: 845387 - protein, 9 aa, Homo Sapiens
YLSNKAMPS

SEQ ID NO: 845388 - protein, 9 aa, Homo Sapiens
LADHAPGVG

SEQ ID NO: 845389 - protein, 9 aa, Homo Sapiens
YGQEIYQAS

SEQ ID NO: 845390 - protein, 9 aa, Homo Sapiens
EQLNKLQDK

SEQ ID NO: 845391 - protein, 9 aa, Homo Sapiens
NCRERMVYW

SEQ ID NO: 845392 - protein, 9 aa, Homo Sapiens
PQPRAHFQR

SEQ ID NO: 845393 - protein, 9 aa, Homo Sapiens
LVHGRNVTS

SEQ ID NO: 845394 - protein, 9 aa, Homo Sapiens
TKSEPSVMW

SEQ ID NO: 845395 - protein, 9 aa, Homo Sapiens
ALWRLHELA

SEQ ID NO: 845396 - protein, 9 aa, Homo Sapiens
PASQPPGPV

SEQ ID NO: 845397 - protein, 9 aa, Homo Sapiens
NTNKLSARD

SEQ ID NO: 845398 - protein, 9 aa, Homo Sapiens
DKLCEWMGN

SEQ ID NO: 845399 - protein, 9 aa, Homo Sapiens
LVIQVIVYI

SEQ ID NO: 845400 - protein, 9 aa, Homo Sapiens
LAFAFGDQN

SEQ ID NO: 845401 - protein, 9 aa, Homo Sapiens
SVTTDSWSI

SEQ ID NO: 845402 - protein, 9 aa, Homo Sapiens
SLTEHSCSA

SEQ ID NO: 845403 - protein, 9 aa, Homo Sapiens
SNMYVVDIP

SEQ ID NO: 845404 - protein, 9 aa, Homo Sapiens
YIFLYLKWR

SEQ ID NO: 845405 - protein, 9 aa, Homo Sapiens
FLITREPAL

SEQ ID NO: 845406 - protein, 9 aa, Homo Sapiens
PQSLPKYLI

SEQ ID NO: 845407 - protein, 9 aa, Homo Sapiens
LSSKRYTED

SEQ ID NO: 845408 - protein, 9 aa, Homo Sapiens
SEDYTLLEN

SEQ ID NO: 845409 - protein, 9 aa, Homo Sapiens
FGGNPKSVI

SEQ ID NO: 845410 - protein, 9 aa, Homo Sapiens
PFIYDAPPN

SEQ ID NO: 845411 - protein, 9 aa, Homo Sapiens
KEPFPESMD

SEQ ID NO: 845412 - protein, 9 aa, Homo Sapiens
HNVPEGFAV

SEQ ID NO: 845413 - protein, 9 aa, Homo Sapiens
LYGPEPALE

SEQ ID NO: 845414 - protein, 9 aa, Homo Sapiens
FQLITSGTD

SEQ ID NO: 845415 - protein, 9 aa, Homo Sapiens
DNESDIKDE

SEQ ID NO: 845416 - protein, 9 aa, Homo Sapiens
PREGKQTWR

SEQ ID NO: 845417 - protein, 9 aa, Homo Sapiens
ETLSELLGT

SEQ ID NO: 845418 - protein, 9 aa, Homo Sapiens
SAGNKFTQD

SEQ ID NO: 845419 - protein, 9 aa, Homo Sapiens
QARRIWKEP

SEQ ID NO: 845420 - protein, 9 aa, Homo Sapiens
FGPFATDIF

SEQ ID NO: 845421 - protein, 9 aa, Homo Sapiens
RFYYEQQLL

SEQ ID NO: 845422 - protein, 9 aa, Homo Sapiens
QDFSRLSDD

SEQ ID NO: 845423 - protein, 9 aa, Homo Sapiens
EGDDVDKYL

SEQ ID NO: 845424 - protein, 9 aa, Homo Sapiens
PAMAAQVVG

SEQ ID NO: 845425 - protein, 9 aa, Homo Sapiens
PKLQFQVTE

SEQ ID NO: 845426 - protein, 9 aa, Homo Sapiens
IIGEAPATL

SEQ ID NO: 845427 - protein, 9 aa, Homo Sapiens
DDIRKEVNR

SEQ ID NO: 845428 - protein, 9 aa, Homo Sapiens
KQESLEISL

SEQ ID NO: 845429 - protein, 9 aa, Homo Sapiens
WCLNKPGHV

SEQ ID NO: 845430 - protein, 9 aa, Homo Sapiens
FSLLSHEQK

SEQ ID NO: 845431 - protein, 9 aa, Homo Sapiens
TKIPGVPNL

SEQ ID NO: 845432 - protein, 9 aa, Homo Sapiens
CVGLEAGVN

SEQ ID NO: 845433 - protein, 9 aa, Homo Sapiens
TTFEEDQRC

SEQ ID NO: 845434 - protein, 9 aa, Homo Sapiens
IYIQGVDAN

SEQ ID NO: 845435 - protein, 9 aa, Homo Sapiens
VSGKNKELS

SEQ ID NO: 845436 - protein, 9 aa, Homo Sapiens
ASLDGDKLE

SEQ ID NO: 845437 - protein, 9 aa, Homo Sapiens
NSSTSIKGT

SEQ ID NO: 845438 - protein, 9 aa, Homo Sapiens
RKLYCQDIR

SEQ ID NO: 845439 - protein, 9 aa, Homo Sapiens
DHDDHECCK

SEQ ID NO: 845440 - protein, 9 aa, Homo Sapiens
RSSNFGKTW

SEQ ID NO: 845441 - protein, 9 aa, Homo Sapiens
LFADEDLPV

SEQ ID NO: 845442 - protein, 9 aa, Homo Sapiens
IIIAINSEL

SEQ ID NO: 845443 - protein, 9 aa, Homo Sapiens
QKQEAICEV

SEQ ID NO: 845444 - protein, 9 aa, Homo Sapiens
MHLLTHGLR

SEQ ID NO: 845445 - protein, 9 aa, Homo Sapiens
LQFKRKAIN

SEQ ID NO: 845446 - protein, 9 aa, Homo Sapiens
HYMASFLVF

SEQ ID NO: 845447 - protein, 9 aa, Homo Sapiens
FSSTGDAGE

SEQ ID NO: 845448 - protein, 9 aa, Homo Sapiens
KQPKGINSN

SEQ ID NO: 845449 - protein, 9 aa, Homo Sapiens
AGEDEEKRE

SEQ ID NO: 845450 - protein, 9 aa, Homo Sapiens
LQDLLSDLN

SEQ ID NO: 845451 - protein, 9 aa, Homo Sapiens
SGNCFIMII

SEQ ID NO: 845452 - protein, 9 aa, Homo Sapiens
DKNRLAGEL

SEQ ID NO: 845453 - protein, 9 aa, Homo Sapiens
QKIHTIEEL

SEQ ID NO: 845454 - protein, 9 aa, Homo Sapiens
LGVVDLTTV

SEQ ID NO: 845455 - protein, 9 aa, Homo Sapiens
KHLTDPFYG

SEQ ID NO: 845456 - protein, 9 aa, Homo Sapiens
ESLINCPGI

SEQ ID NO: 845457 - protein, 9 aa, Homo Sapiens
KDLPKLASG

SEQ ID NO: 845458 - protein, 9 aa, Homo Sapiens
LKLARRIAL

SEQ ID NO: 845459 - protein, 9 aa, Homo Sapiens
LRKSPVVSD

SEQ ID NO: 845460 - protein, 9 aa, Homo Sapiens
EPRGGFSFD

SEQ ID NO: 845461 - protein, 9 aa, Homo Sapiens
ICHYLDPLW

SEQ ID NO: 845462 - protein, 9 aa, Homo Sapiens
LNTLESTHA

SEQ ID NO: 845463 - protein, 9 aa, Homo Sapiens
VQSHMIRHT

SEQ ID NO: 845464 - protein, 9 aa, Homo Sapiens
PENMSIGEG

SEQ ID NO: 845465 - protein, 9 aa, Homo Sapiens
LFQNVQGQF

SEQ ID NO: 845466 - protein, 9 aa, Homo Sapiens
TRVYKKVLL

SEQ ID NO: 845467 - protein, 9 aa, Homo Sapiens
EEDACWIIE

SEQ ID NO: 845468 - protein, 9 aa, Homo Sapiens
LFVFSTLAN

SEQ ID NO: 845469 - protein, 9 aa, Homo Sapiens
TEICYQNKY

SEQ ID NO: 845470 - protein, 9 aa, Homo Sapiens
WGETKGPEM

SEQ ID NO: 845471 - protein, 9 aa, Homo Sapiens
RPLWVLRAR

SEQ ID NO: 845472 - protein, 9 aa, Homo Sapiens
QFLPTMSPT

SEQ ID NO: 845473 - protein, 9 aa, Homo Sapiens
VVSTNWSDV

SEQ ID NO: 845474 - protein, 9 aa, Homo Sapiens
LFATYCLLL

SEQ ID NO: 845475 - protein, 9 aa, Homo Sapiens
PDQADLVND

SEQ ID NO: 845476 - protein, 9 aa, Homo Sapiens
VLSCGVPGS

SEQ ID NO: 845477 - protein, 9 aa, Homo Sapiens
QFVMGSSRV

SEQ ID NO: 845478 - protein, 9 aa, Homo Sapiens
ELIHKVQAA

SEQ ID NO: 845479 - protein, 9 aa, Homo Sapiens
RCHTGKIPY

SEQ ID NO: 845480 - protein, 9 aa, Homo Sapiens
LRALRKGDS

SEQ ID NO: 845481 - protein, 9 aa, Homo Sapiens
FKPVKSHLV

SEQ ID NO: 845482 - protein, 9 aa, Homo Sapiens
LGKTQKAML

SEQ ID NO: 845483 - protein, 9 aa, Homo Sapiens
ADRLFRSHS

SEQ ID NO: 845484 - protein, 9 aa, Homo Sapiens
KKNIIEATN

SEQ ID NO: 845485 - protein, 9 aa, Homo Sapiens
DAVRLFEEF

SEQ ID NO: 845486 - protein, 9 aa, Homo Sapiens
MTTTERHHL

SEQ ID NO: 845487 - protein, 9 aa, Homo Sapiens
FGSRPLHYP

SEQ ID NO: 845488 - protein, 9 aa, Homo Sapiens
LLCRQAQQA

SEQ ID NO: 845489 - protein, 9 aa, Homo Sapiens
ITDGGDLPE

SEQ ID NO: 845490 - protein, 9 aa, Homo Sapiens
RAQEDVFQK

SEQ ID NO: 845491 - protein, 9 aa, Homo Sapiens
YYGQQAWVL

SEQ ID NO: 845492 - protein, 9 aa, Homo Sapiens
NWGLPSLLR

SEQ ID NO: 845493 - protein, 9 aa, Homo Sapiens
SQKVNKRSL

SEQ ID NO: 845494 - protein, 9 aa, Homo Sapiens
LGGAMVWGL

SEQ ID NO: 845495 - protein, 9 aa, Homo Sapiens
GFAVGVGFG

SEQ ID NO: 845496 - protein, 9 aa, Homo Sapiens
DPESTKISA

SEQ ID NO: 845497 - protein, 9 aa, Homo Sapiens
VCAFFKALQ

SEQ ID NO: 845498 - protein, 9 aa, Homo Sapiens
MYSLRNKNV

SEQ ID NO: 845499 - protein, 9 aa, Homo Sapiens
VWKNKGAIY

SEQ ID NO: 845500 - protein, 9 aa, Homo Sapiens
IVLAVLLVV

SEQ ID NO: 845501 - protein, 9 aa, Homo Sapiens
ICISLAQTM

SEQ ID NO: 845502 - protein, 9 aa, Homo Sapiens
DVSSKQSPG

SEQ ID NO: 845503 - protein, 9 aa, Homo Sapiens
GRGSPEEKT

SEQ ID NO: 845504 - protein, 9 aa, Homo Sapiens
TLGEEELTS

SEQ ID NO: 845505 - protein, 9 aa, Homo Sapiens
QINEDNKRW

SEQ ID NO: 845506 - protein, 9 aa, Homo Sapiens
FIHDLVSAY

SEQ ID NO: 845507 - protein, 9 aa, Homo Sapiens
FRLFIPVTL

SEQ ID NO: 845508 - protein, 9 aa, Homo Sapiens
KRVNTGEKP

SEQ ID NO: 845509 - protein, 9 aa, Homo Sapiens
DKMQEQEEK

SEQ ID NO: 845510 - protein, 9 aa, Homo Sapiens
DRDRDRGRD

SEQ ID NO: 845511 - protein, 9 aa, Homo Sapiens
QEEAVCTTI

SEQ ID NO: 845512 - protein, 9 aa, Homo Sapiens
CICSGAFAL

SEQ ID NO: 845513 - protein, 9 aa, Homo Sapiens
FKATMYNVL

SEQ ID NO: 845514 - protein, 9 aa, Homo Sapiens
ESHNQIDLM

SEQ ID NO: 845515 - protein, 9 aa, Homo Sapiens
WMVYFVSNY

SEQ ID NO: 845516 - protein, 9 aa, Homo Sapiens
VASVSLLMF

SEQ ID NO: 845517 - protein, 9 aa, Homo Sapiens
QETCYWDSG

SEQ ID NO: 845518 - protein, 9 aa, Homo Sapiens
LGLGNKCPA

SEQ ID NO: 845519 - protein, 9 aa, Homo Sapiens
ILKGEHLSK

SEQ ID NO: 845520 - protein, 9 aa, Homo Sapiens
TEGKPTAPS

SEQ ID NO: 845521 - protein, 9 aa, Homo Sapiens
LIFAVVFSI

SEQ ID NO: 845522 - protein, 9 aa, Homo Sapiens
LAGSEGTTY

SEQ ID NO: 845523 - protein, 9 aa, Homo Sapiens
ATDRDDGVN

SEQ ID NO: 845524 - protein, 9 aa, Homo Sapiens
DMKLSMNNN

SEQ ID NO: 845525 - protein, 9 aa, Homo Sapiens
AAKLAPKFA

SEQ ID NO: 845526 - protein, 9 aa, Homo Sapiens
KGPDKSVEV

SEQ ID NO: 845527 - protein, 9 aa, Homo Sapiens
PHQPGGKVW

SEQ ID NO: 845528 - protein, 9 aa, Homo Sapiens
LISIWNRNA

SEQ ID NO: 845529 - protein, 9 aa, Homo Sapiens
DYAIYLAKQ

SEQ ID NO: 845530 - protein, 9 aa, Homo Sapiens
CYLETLSEV

SEQ ID NO: 845531 - protein, 9 aa, Homo Sapiens
TIDNAQPIL

SEQ ID NO: 845532 - protein, 9 aa, Homo Sapiens
DASSSKMKA

SEQ ID NO: 845533 - protein, 9 aa, Homo Sapiens
SCFPACSPF

SEQ ID NO: 845534 - protein, 9 aa, Homo Sapiens
LKDKLCQYD

SEQ ID NO: 845535 - protein, 9 aa, Homo Sapiens
MKNGKFVIL

SEQ ID NO: 845536 - protein, 9 aa, Homo Sapiens
REYLSADTF

SEQ ID NO: 845537 - protein, 9 aa, Homo Sapiens
DQHALRNEK

SEQ ID NO: 845538 - protein, 9 aa, Homo Sapiens
YPSTTIPNM

SEQ ID NO: 845539 - protein, 9 aa, Homo Sapiens
RINTLQAIW

SEQ ID NO: 845540 - protein, 9 aa, Homo Sapiens
ENATTNGHD

SEQ ID NO: 845541 - protein, 9 aa, Homo Sapiens
ENKIPFKIL

SEQ ID NO: 845542 - protein, 9 aa, Homo Sapiens
LRPNKMDGA

SEQ ID NO: 845543 - protein, 9 aa, Homo Sapiens
YLPAPLGTI

SEQ ID NO: 845544 - protein, 9 aa, Homo Sapiens
HRGLLSSLG

SEQ ID NO: 845545 - protein, 9 aa, Homo Sapiens
SRGSRRRRQ

SEQ ID NO: 845546 - protein, 9 aa, Homo Sapiens
AHIALLVAK

SEQ ID NO: 845547 - protein, 9 aa, Homo Sapiens
CRDRIICFC

SEQ ID NO: 845548 - protein, 9 aa, Homo Sapiens
QDSVTFDNV

SEQ ID NO: 845549 - protein, 9 aa, Homo Sapiens
SGWIRYLPK

SEQ ID NO: 845550 - protein, 9 aa, Homo Sapiens
EGRGTKKDE

SEQ ID NO: 845551 - protein, 9 aa, Homo Sapiens
NDQHALRNE

SEQ ID NO: 845552 - protein, 9 aa, Homo Sapiens
CYPSTTIPN

SEQ ID NO: 845553 - protein, 9 aa, Homo Sapiens
ISEGIYAIA

SEQ ID NO: 845554 - protein, 9 aa, Homo Sapiens
AVRGSLNVH

SEQ ID NO: 845555 - protein, 9 aa, Homo Sapiens
TLELSGGAQ

SEQ ID NO: 845556 - protein, 9 aa, Homo Sapiens
QVFPINPPK

SEQ ID NO: 845557 - protein, 9 aa, Homo Sapiens
TVQNRFTTN

SEQ ID NO: 845558 - protein, 9 aa, Homo Sapiens
PVLIIEAHK

SEQ ID NO: 845559 - protein, 9 aa, Homo Sapiens
KKHNMTAVV

SEQ ID NO: 845560 - protein, 9 aa, Homo Sapiens
FQNQLLRGN

SEQ ID NO: 845561 - protein, 9 aa, Homo Sapiens
PTFSVATVS

SEQ ID NO: 845562 - protein, 9 aa, Homo Sapiens
CRNQTRHLP

SEQ ID NO: 845563 - protein, 9 aa, Homo Sapiens
RCQRRLIPH

SEQ ID NO: 845564 - protein, 9 aa, Homo Sapiens
VYDQSTWDA

SEQ ID NO: 845565 - protein, 9 aa, Homo Sapiens
QFFGFYWPK

SEQ ID NO: 845566 - protein, 9 aa, Homo Sapiens
WGPLKLRIN

SEQ ID NO: 845567 - protein, 9 aa, Homo Sapiens
FTTEILGLT

SEQ ID NO: 845568 - protein, 9 aa, Homo Sapiens
LQAKNREPL

SEQ ID NO: 845569 - protein, 9 aa, Homo Sapiens
NSGDIYALQ

SEQ ID NO: 845570 - protein, 9 aa, Homo Sapiens
KEHKPGGDL

SEQ ID NO: 845571 - protein, 9 aa, Homo Sapiens
KKRLIEHQR

SEQ ID NO: 845572 - protein, 9 aa, Homo Sapiens
NYFTYYYIQ

SEQ ID NO: 845573 - protein, 9 aa, Homo Sapiens
TEDIPGDTY

SEQ ID NO: 845574 - protein, 9 aa, Homo Sapiens
IKNTNRKAD

SEQ ID NO: 845575 - protein, 9 aa, Homo Sapiens
DEDEDDLNK

SEQ ID NO: 845576 - protein, 9 aa, Homo Sapiens
AKLAPKFAK

SEQ ID NO: 845577 - protein, 9 aa, Homo Sapiens
GAQDHIFSF

SEQ ID NO: 845578 - protein, 9 aa, Homo Sapiens
FAQLIIDGI

SEQ ID NO: 845579 - protein, 9 aa, Homo Sapiens
HGIPTVGIP

SEQ ID NO: 845580 - protein, 9 aa, Homo Sapiens
RAHFIRCIY

SEQ ID NO: 845581 - protein, 9 aa, Homo Sapiens
ILISYDDEQ

SEQ ID NO: 845582 - protein, 9 aa, Homo Sapiens
ALQKQANRK

SEQ ID NO: 845583 - protein, 9 aa, Homo Sapiens
LTCAPPPPI

SEQ ID NO: 845584 - protein, 9 aa, Homo Sapiens
NRKNILNQI

SEQ ID NO: 845585 - protein, 9 aa, Homo Sapiens
EKTDPQYLA

SEQ ID NO: 845586 - protein, 9 aa, Homo Sapiens
DLFPVEPVS

SEQ ID NO: 845587 - protein, 9 aa, Homo Sapiens
TNMDKVLLK

SEQ ID NO: 845588 - protein, 9 aa, Homo Sapiens
YPVYRGSSS

SEQ ID NO: 845589 - protein, 9 aa, Homo Sapiens
EDIAHSIQT

SEQ ID NO: 845590 - protein, 9 aa, Homo Sapiens
QMRLKRPET

SEQ ID NO: 845591 - protein, 9 aa, Homo Sapiens
SEHQIIHTG

SEQ ID NO: 845592 - protein, 9 aa, Homo Sapiens
FNNTGSGLL

SEQ ID NO: 845593 - protein, 9 aa, Homo Sapiens
VTPLSAAPV

SEQ ID NO: 845594 - protein, 9 aa, Homo Sapiens
AACYLKKGN

SEQ ID NO: 845595 - protein, 9 aa, Homo Sapiens
EFANLTRVE

SEQ ID NO: 845596 - protein, 9 aa, Homo Sapiens
TQYYGQQAW

SEQ ID NO: 845597 - protein, 9 aa, Homo Sapiens
LFEACRLLQ

SEQ ID NO: 845598 - protein, 9 aa, Homo Sapiens
RPYFQSAAI

SEQ ID NO: 845599 - protein, 9 aa, Homo Sapiens
ILPVLNFCK

SEQ ID NO: 845600 - protein, 9 aa, Homo Sapiens
GGLLVSLTS

SEQ ID NO: 845601 - protein, 9 aa, Homo Sapiens
GPDKSVEVP

SEQ ID NO: 845602 - protein, 9 aa, Homo Sapiens
PTTFSTSGI

SEQ ID NO: 845603 - protein, 9 aa, Homo Sapiens
LEKAATHRQ

SEQ ID NO: 845604 - protein, 9 aa, Homo Sapiens
ILVIQVIVY

SEQ ID NO: 845605 - protein, 9 aa, Homo Sapiens
SKALVTMPG

SEQ ID NO: 845606 - protein, 9 aa, Homo Sapiens
THGKNYLNS

SEQ ID NO: 845607 - protein, 9 aa, Homo Sapiens
SAMPKHLNS

SEQ ID NO: 845608 - protein, 9 aa, Homo Sapiens
HLTETGNNW

SEQ ID NO: 845609 - protein, 9 aa, Homo Sapiens
PGFTNLDLN

SEQ ID NO: 845610 - protein, 9 aa, Homo Sapiens
GFYPFPQGP

SEQ ID NO: 845611 - protein, 9 aa, Homo Sapiens
TDWMNVLPH

SEQ ID NO: 845612 - protein, 9 aa, Homo Sapiens
QVMTINSVT

SEQ ID NO: 845613 - protein, 9 aa, Homo Sapiens
PEMQRRDSY

SEQ ID NO: 845614 - protein, 9 aa, Homo Sapiens
YCNAIKINI

SEQ ID NO: 845615 - protein, 9 aa, Homo Sapiens
YQLLGIKNI

SEQ ID NO: 845616 - protein, 9 aa, Homo Sapiens
IRAVLCIPY

SEQ ID NO: 845617 - protein, 9 aa, Homo Sapiens
EPEAPMLTH

SEQ ID NO: 845618 - protein, 9 aa, Homo Sapiens
DPTEWTSFV

SEQ ID NO: 845619 - protein, 9 aa, Homo Sapiens
EISNPFYDR

SEQ ID NO: 845620 - protein, 9 aa, Homo Sapiens
ACIKIGVPQ

SEQ ID NO: 845621 - protein, 9 aa, Homo Sapiens
LNAPQSPKD

SEQ ID NO: 845622 - protein, 9 aa, Homo Sapiens
SSNVCFAQE

SEQ ID NO: 845623 - protein, 9 aa, Homo Sapiens
YFEVVFNDP

SEQ ID NO: 845624 - protein, 9 aa, Homo Sapiens
PRGCKKHLT

SEQ ID NO: 845625 - protein, 9 aa, Homo Sapiens
KENLCSFTK

SEQ ID NO: 845626 - protein, 9 aa, Homo Sapiens
QDLFTAFLP

SEQ ID NO: 845627 - protein, 9 aa, Homo Sapiens
EFVSSLPLK

SEQ ID NO: 845628 - protein, 9 aa, Homo Sapiens
SKPSLHSRN

SEQ ID NO: 845629 - protein, 9 aa, Homo Sapiens
KRGHLPSSS

SEQ ID NO: 845630 - protein, 9 aa, Homo Sapiens
YSVPHNHNQ

SEQ ID NO: 845631 - protein, 9 aa, Homo Sapiens
NLADVVQIA

SEQ ID NO: 845632 - protein, 9 aa, Homo Sapiens
QCISGDCDD

SEQ ID NO: 845633 - protein, 9 aa, Homo Sapiens
GDKLELLKN

SEQ ID NO: 845634 - protein, 9 aa, Homo Sapiens
MIKMAHIGV

SEQ ID NO: 845635 - protein, 9 aa, Homo Sapiens
RKKVDPSKL

SEQ ID NO: 845636 - protein, 9 aa, Homo Sapiens
ALTVHCKVH

SEQ ID NO: 845637 - protein, 9 aa, Homo Sapiens
AEVFMTPEY

SEQ ID NO: 845638 - protein, 9 aa, Homo Sapiens
TMPFLNDRL

SEQ ID NO: 845639 - protein, 9 aa, Homo Sapiens
PGSSDEDIS

SEQ ID NO: 845640 - protein, 9 aa, Homo Sapiens
KARFDPYGN

SEQ ID NO: 845641 - protein, 9 aa, Homo Sapiens
QEANGNKCS

SEQ ID NO: 845642 - protein, 9 aa, Homo Sapiens
SLTPGLPAP

SEQ ID NO: 845643 - protein, 9 aa, Homo Sapiens
ITEHANQAK

SEQ ID NO: 845644 - protein, 9 aa, Homo Sapiens
PLAFLKPTI

SEQ ID NO: 845645 - protein, 9 aa, Homo Sapiens
IVKHLCHSA

SEQ ID NO: 845646 - protein, 9 aa, Homo Sapiens
YFPSVLWQD

SEQ ID NO: 845647 - protein, 9 aa, Homo Sapiens
QQAFQLWLK

SEQ ID NO: 845648 - protein, 9 aa, Homo Sapiens
AMTKFERHT

SEQ ID NO: 845649 - protein, 9 aa, Homo Sapiens
KIIIRCKRK

SEQ ID NO: 845650 - protein, 9 aa, Homo Sapiens
EQPFECLEC

SEQ ID NO: 845651 - protein, 9 aa, Homo Sapiens
QVHLWTGIR

SEQ ID NO: 845652 - protein, 9 aa, Homo Sapiens
QRKKEEHEE

SEQ ID NO: 845653 - protein, 9 aa, Homo Sapiens
EQTIIFPGS

SEQ ID NO: 845654 - protein, 9 aa, Homo Sapiens
STMGKALVD

SEQ ID NO: 845655 - protein, 9 aa, Homo Sapiens
QGPGKYPMT

SEQ ID NO: 845656 - protein, 9 aa, Homo Sapiens
LMLIRQDLM

SEQ ID NO: 845657 - protein, 9 aa, Homo Sapiens
WTESVGLAL

SEQ ID NO: 845658 - protein, 9 aa, Homo Sapiens
DLQHSQVPS

SEQ ID NO: 845659 - protein, 9 aa, Homo Sapiens
EPSSADIFR

SEQ ID NO: 845660 - protein, 9 aa, Homo Sapiens
VSQLLKSSW

SEQ ID NO: 845661 - protein, 9 aa, Homo Sapiens
FPDTTQCAY

SEQ ID NO: 845662 - protein, 9 aa, Homo Sapiens
VFIGWNINN

SEQ ID NO: 845663 - protein, 9 aa, Homo Sapiens
YIEHNARKF

SEQ ID NO: 845664 - protein, 9 aa, Homo Sapiens
PSWTGIRNT

SEQ ID NO: 845665 - protein, 9 aa, Homo Sapiens
YTQNLPSEK

SEQ ID NO: 845666 - protein, 9 aa, Homo Sapiens
GHKRKKSRY

SEQ ID NO: 845667 - protein, 9 aa, Homo Sapiens
VLLQWRVTA

SEQ ID NO: 845668 - protein, 9 aa, Homo Sapiens
PFWVHAGGD

SEQ ID NO: 845669 - protein, 9 aa, Homo Sapiens
YRFCSVSDK

SEQ ID NO: 845670 - protein, 9 aa, Homo Sapiens
GWDLGRLSL

SEQ ID NO: 845671 - protein, 9 aa, Homo Sapiens
PGSSSPGPL

SEQ ID NO: 845672 - protein, 9 aa, Homo Sapiens
PNDKAFSKP

SEQ ID NO: 845673 - protein, 9 aa, Homo Sapiens
ADRLQSDFT

SEQ ID NO: 845674 - protein, 9 aa, Homo Sapiens
GDPGLPDRT

SEQ ID NO: 845675 - protein, 9 aa, Homo Sapiens
VQDSGKLQG

SEQ ID NO: 845676 - protein, 9 aa, Homo Sapiens
KFPVADYLV

SEQ ID NO: 845677 - protein, 9 aa, Homo Sapiens
CTVSVSGIC

SEQ ID NO: 845678 - protein, 9 aa, Homo Sapiens
CPVGLITLA

SEQ ID NO: 845679 - protein, 9 aa, Homo Sapiens
QASAVNPLL

SEQ ID NO: 845680 - protein, 9 aa, Homo Sapiens
LEEIKNLKH

SEQ ID NO: 845681 - protein, 9 aa, Homo Sapiens
RVPLKDKLC

SEQ ID NO: 845682 - protein, 9 aa, Homo Sapiens
LGIRGSVEA

SEQ ID NO: 845683 - protein, 9 aa, Homo Sapiens
PSYSGPSKM

SEQ ID NO: 845684 - protein, 9 aa, Homo Sapiens
QPICSTNFI

SEQ ID NO: 845685 - protein, 9 aa, Homo Sapiens
CFQQIQTVM

SEQ ID NO: 845686 - protein, 9 aa, Homo Sapiens
EHSRFHEFH

SEQ ID NO: 845687 - protein, 9 aa, Homo Sapiens
QNRDGLIDK

SEQ ID NO: 845688 - protein, 9 aa, Homo Sapiens
VIAHLGALK

SEQ ID NO: 845689 - protein, 9 aa, Homo Sapiens
TLLNLKDSS

SEQ ID NO: 845690 - protein, 9 aa, Homo Sapiens
QCPVGLITL

SEQ ID NO: 845691 - protein, 9 aa, Homo Sapiens
EVFGDIDTK

SEQ ID NO: 845692 - protein, 9 aa, Homo Sapiens
VLISGNCPE

SEQ ID NO: 845693 - protein, 9 aa, Homo Sapiens
SEGRCKALS

SEQ ID NO: 845694 - protein, 9 aa, Homo Sapiens
VEIETQGDD

SEQ ID NO: 845695 - protein, 9 aa, Homo Sapiens
PPASVEASQ

SEQ ID NO: 845696 - protein, 9 aa, Homo Sapiens
GRFSGKMCF

SEQ ID NO: 845697 - protein, 9 aa, Homo Sapiens
GLIDEQLLC

SEQ ID NO: 845698 - protein, 9 aa, Homo Sapiens
ISNKACGKI

SEQ ID NO: 845699 - protein, 9 aa, Homo Sapiens
PQSSYSVPC

SEQ ID NO: 845700 - protein, 9 aa, Homo Sapiens
ALLTSANEV

SEQ ID NO: 845701 - protein, 9 aa, Homo Sapiens
PHLAPPYAA

SEQ ID NO: 845702 - protein, 9 aa, Homo Sapiens
TKWKDLKLM

SEQ ID NO: 845703 - protein, 9 aa, Homo Sapiens
ELIGRYIKL

SEQ ID NO: 845704 - protein, 9 aa, Homo Sapiens
FQRLIHREP

SEQ ID NO: 845705 - protein, 9 aa, Homo Sapiens
RRSKSQYSG

SEQ ID NO: 845706 - protein, 9 aa, Homo Sapiens
DHAHRQLGE

SEQ ID NO: 845707 - protein, 9 aa, Homo Sapiens
SGLLLCPPI

SEQ ID NO: 845708 - protein, 9 aa, Homo Sapiens
EFAELDQFM

SEQ ID NO: 845709 - protein, 9 aa, Homo Sapiens
GSLCAGCKC

SEQ ID NO: 845710 - protein, 9 aa, Homo Sapiens
ILLQSAKNS

SEQ ID NO: 845711 - protein, 9 aa, Homo Sapiens
SCWAWQGLG

SEQ ID NO: 845712 - protein, 9 aa, Homo Sapiens
FEELICQRL

SEQ ID NO: 845713 - protein, 9 aa, Homo Sapiens
RLIHREPGS

SEQ ID NO: 845714 - protein, 9 aa, Homo Sapiens
NGGSKSDGE

SEQ ID NO: 845715 - protein, 9 aa, Homo Sapiens
NKKVYTGVK

SEQ ID NO: 845716 - protein, 9 aa, Homo Sapiens
YAGIKNAEI

SEQ ID NO: 845717 - protein, 9 aa, Homo Sapiens
GEFLNKYHK

SEQ ID NO: 845718 - protein, 9 aa, Homo Sapiens
SLIHVCLAL

SEQ ID NO: 845719 - protein, 9 aa, Homo Sapiens
PVRGFGWHL

SEQ ID NO: 845720 - protein, 9 aa, Homo Sapiens
AQMLISTPT

SEQ ID NO: 845721 - protein, 9 aa, Homo Sapiens
SNEESGYFV

SEQ ID NO: 845722 - protein, 9 aa, Homo Sapiens
TTGIWKQWH

SEQ ID NO: 845723 - protein, 9 aa, Homo Sapiens
WLRSQLAIV

SEQ ID NO: 845724 - protein, 9 aa, Homo Sapiens
HTLPPGLPQ

SEQ ID NO: 845725 - protein, 9 aa, Homo Sapiens
NFPRRSKSL

SEQ ID NO: 845726 - protein, 9 aa, Homo Sapiens
EAFDDLFPV

SEQ ID NO: 845727 - protein, 9 aa, Homo Sapiens
RPLFSPASY

SEQ ID NO: 845728 - protein, 9 aa, Homo Sapiens
VSFKLFADK

SEQ ID NO: 845729 - protein, 9 aa, Homo Sapiens
KTKVLDMYQ

SEQ ID NO: 845730 - protein, 9 aa, Homo Sapiens
ENETEETTT

SEQ ID NO: 845731 - protein, 9 aa, Homo Sapiens
AFQKRNRIK

SEQ ID NO: 845732 - protein, 9 aa, Homo Sapiens
KIYFLQLLK

SEQ ID NO: 845733 - protein, 9 aa, Homo Sapiens
LHNLYGLTK

SEQ ID NO: 845734 - protein, 9 aa, Homo Sapiens
VGYKTVTYL

SEQ ID NO: 845735 - protein, 9 aa, Homo Sapiens
LEYRDSHSQ

SEQ ID NO: 845736 - protein, 9 aa, Homo Sapiens
GKWLHSHVQ

SEQ ID NO: 845737 - protein, 9 aa, Homo Sapiens
CINLLKLPE

SEQ ID NO: 845738 - protein, 9 aa, Homo Sapiens
PEDQLRGTW

SEQ ID NO: 845739 - protein, 9 aa, Homo Sapiens
ICTFISGRF

SEQ ID NO: 845740 - protein, 9 aa, Homo Sapiens
QIIFVSYPS

SEQ ID NO: 845741 - protein, 9 aa, Homo Sapiens
CHGQGGNQL

SEQ ID NO: 845742 - protein, 9 aa, Homo Sapiens
ASKDESDSA

SEQ ID NO: 845743 - protein, 9 aa, Homo Sapiens
CAHTQVKQE

SEQ ID NO: 845744 - protein, 9 aa, Homo Sapiens
KPSCGVPDV

SEQ ID NO: 845745 - protein, 9 aa, Homo Sapiens
GKRIGFYQI

SEQ ID NO: 845746 - protein, 9 aa, Homo Sapiens
EQGKLYLRE

SEQ ID NO: 845747 - protein, 9 aa, Homo Sapiens
CCQSSCCKS

SEQ ID NO: 845748 - protein, 9 aa, Homo Sapiens
EAVPWKQPK

SEQ ID NO: 845749 - protein, 9 aa, Homo Sapiens
LHNLENSAF

SEQ ID NO: 845750 - protein, 9 aa, Homo Sapiens
IMLKDEVSK

SEQ ID NO: 845751 - protein, 9 aa, Homo Sapiens
RINVYGFSA

SEQ ID NO: 845752 - protein, 9 aa, Homo Sapiens
MDEYKNLYY

SEQ ID NO: 845753 - protein, 9 aa, Homo Sapiens
NHVEQLRVE

SEQ ID NO: 845754 - protein, 9 aa, Homo Sapiens
LYKAINSNG

SEQ ID NO: 845755 - protein, 9 aa, Homo Sapiens
QVQWQIILE

SEQ ID NO: 845756 - protein, 9 aa, Homo Sapiens
EKHLNSHMW

SEQ ID NO: 845757 - protein, 9 aa, Homo Sapiens
ATLTNHKII

SEQ ID NO: 845758 - protein, 9 aa, Homo Sapiens
VPLECLDNR

SEQ ID NO: 845759 - protein, 9 aa, Homo Sapiens
QSAFLHCIR

SEQ ID NO: 845760 - protein, 9 aa, Homo Sapiens
QFYSMTRPA

SEQ ID NO: 845761 - protein, 9 aa, Homo Sapiens
YLIMNSIKK

SEQ ID NO: 845762 - protein, 9 aa, Homo Sapiens
HGAPKIIYF

SEQ ID NO: 845763 - protein, 9 aa, Homo Sapiens
LLMDSGLPV

SEQ ID NO: 845764 - protein, 9 aa, Homo Sapiens
LKMKIKVSY

SEQ ID NO: 845765 - protein, 9 aa, Homo Sapiens
DAGDGLPGD

SEQ ID NO: 845766 - protein, 9 aa, Homo Sapiens
GVRTKEINQ

SEQ ID NO: 845767 - protein, 9 aa, Homo Sapiens
SSLGPVATF

SEQ ID NO: 845768 - protein, 9 aa, Homo Sapiens
ILFTTVSIP

SEQ ID NO: 845769 - protein, 9 aa, Homo Sapiens
IKKQLREWG

SEQ ID NO: 845770 - protein, 9 aa, Homo Sapiens
DLPDEPFTI

SEQ ID NO: 845771 - protein, 9 aa, Homo Sapiens
QYLIVHCKT

SEQ ID NO: 845772 - protein, 9 aa, Homo Sapiens
DGVQFSWNV

SEQ ID NO: 845773 - protein, 9 aa, Homo Sapiens
LNRRSLTSG

SEQ ID NO: 845774 - protein, 9 aa, Homo Sapiens
AFIEPPEIM

SEQ ID NO: 845775 - protein, 9 aa, Homo Sapiens
REINQIFHE

SEQ ID NO: 845776 - protein, 9 aa, Homo Sapiens
AAHILKARK

SEQ ID NO: 845777 - protein, 9 aa, Homo Sapiens
TSGKTVLHL

SEQ ID NO: 845778 - protein, 9 aa, Homo Sapiens
SPFTNLINL

SEQ ID NO: 845779 - protein, 9 aa, Homo Sapiens
GRMVNLGGK

SEQ ID NO: 845780 - protein, 9 aa, Homo Sapiens
KLLQILSQL

SEQ ID NO: 845781 - protein, 9 aa, Homo Sapiens
LLCRYKIRL

SEQ ID NO: 845782 - protein, 9 aa, Homo Sapiens
DVMLDNYSH

SEQ ID NO: 845783 - protein, 9 aa, Homo Sapiens
SSSFHSRTL

SEQ ID NO: 845784 - protein, 9 aa, Homo Sapiens
LLSSYDVDA

SEQ ID NO: 845785 - protein, 9 aa, Homo Sapiens
RNKQTFSYY

SEQ ID NO: 845786 - protein, 9 aa, Homo Sapiens
WSDNGNVCQ

SEQ ID NO: 845787 - protein, 9 aa, Homo Sapiens
NVDMWDKPQ

SEQ ID NO: 845788 - protein, 9 aa, Homo Sapiens
TKDKHLSLR

SEQ ID NO: 845789 - protein, 9 aa, Homo Sapiens
HSRTLGKSN

SEQ ID NO: 845790 - protein, 9 aa, Homo Sapiens
FQYASTNMD

SEQ ID NO: 845791 - protein, 9 aa, Homo Sapiens
LQMRLGGSE

SEQ ID NO: 845792 - protein, 9 aa, Homo Sapiens
NANLIRHQI

SEQ ID NO: 845793 - protein, 9 aa, Homo Sapiens
EAEKLFWDL

SEQ ID NO: 845794 - protein, 9 aa, Homo Sapiens
QPSDKSTEP

SEQ ID NO: 845795 - protein, 9 aa, Homo Sapiens
NLFMSFQSL

SEQ ID NO: 845796 - protein, 9 aa, Homo Sapiens
ALHIGSVST

SEQ ID NO: 845797 - protein, 9 aa, Homo Sapiens
KIASSLPAA

SEQ ID NO: 845798 - protein, 9 aa, Homo Sapiens
LLGRSWLLS

SEQ ID NO: 845799 - protein, 9 aa, Homo Sapiens
ISVERQIHT

SEQ ID NO: 845800 - protein, 9 aa, Homo Sapiens
LRDFPNHWE

SEQ ID NO: 845801 - protein, 9 aa, Homo Sapiens
RCLRIINQN

SEQ ID NO: 845802 - protein, 9 aa, Homo Sapiens
IKTDVFSYA

SEQ ID NO: 845803 - protein, 9 aa, Homo Sapiens
PSQNNLASL

SEQ ID NO: 845804 - protein, 9 aa, Homo Sapiens
SMHCYLDLV

SEQ ID NO: 845805 - protein, 9 aa, Homo Sapiens
LRVEDYEPY

SEQ ID NO: 845806 - protein, 9 aa, Homo Sapiens
DAGSSTIRI

SEQ ID NO: 845807 - protein, 9 aa, Homo Sapiens
FRTLPPSDI

SEQ ID NO: 845808 - protein, 9 aa, Homo Sapiens
TSLWNNNER

SEQ ID NO: 845809 - protein, 9 aa, Homo Sapiens
ATAAECASH

SEQ ID NO: 845810 - protein, 9 aa, Homo Sapiens
DPQQAFQLW

SEQ ID NO: 845811 - protein, 9 aa, Homo Sapiens
EVLWPGTIQ

SEQ ID NO: 845812 - protein, 9 aa, Homo Sapiens
VSSDDDLFQ

SEQ ID NO: 845813 - protein, 9 aa, Homo Sapiens
RTLDDDDMF

SEQ ID NO: 845814 - protein, 9 aa, Homo Sapiens
LNKYHKKKK

SEQ ID NO: 845815 - protein, 9 aa, Homo Sapiens
GTMDSIQSS

SEQ ID NO: 845816 - protein, 9 aa, Homo Sapiens
SEGDTNSND

SEQ ID NO: 845817 - protein, 9 aa, Homo Sapiens
EIQYIILRS

SEQ ID NO: 845818 - protein, 9 aa, Homo Sapiens
KISHYMKKI

SEQ ID NO: 845819 - protein, 9 aa, Homo Sapiens
EPGDNSEIL

SEQ ID NO: 845820 - protein, 9 aa, Homo Sapiens
PHSQVGACI

SEQ ID NO: 845821 - protein, 9 aa, Homo Sapiens
RCNCNGHSE

SEQ ID NO: 845822 - protein, 9 aa, Homo Sapiens
FPAPIPRAV

SEQ ID NO: 845823 - protein, 9 aa, Homo Sapiens
EEAIIPCFG

SEQ ID NO: 845824 - protein, 9 aa, Homo Sapiens
GDEEANIGL

SEQ ID NO: 845825 - protein, 9 aa, Homo Sapiens
FVAPDFLDS

SEQ ID NO: 845826 - protein, 9 aa, Homo Sapiens
NSRENCWTT

SEQ ID NO: 845827 - protein, 9 aa, Homo Sapiens
LCCDRNLCN

SEQ ID NO: 845828 - protein, 9 aa, Homo Sapiens
MRIGKYFIL

SEQ ID NO: 845829 - protein, 9 aa, Homo Sapiens
IPCLALPVK

SEQ ID NO: 845830 - protein, 9 aa, Homo Sapiens
NACFDHQGE

SEQ ID NO: 845831 - protein, 9 aa, Homo Sapiens
PRSLIYYKS

SEQ ID NO: 845832 - protein, 9 aa, Homo Sapiens
GPKGQGKYS

SEQ ID NO: 845833 - protein, 9 aa, Homo Sapiens
ESIIWKGSC

SEQ ID NO: 845834 - protein, 9 aa, Homo Sapiens
NALKIELQA

SEQ ID NO: 845835 - protein, 9 aa, Homo Sapiens
RKSSALKAI

SEQ ID NO: 845836 - protein, 9 aa, Homo Sapiens
LKHCELWLE

SEQ ID NO: 845837 - protein, 9 aa, Homo Sapiens
QRGKTLCLL

SEQ ID NO: 845838 - protein, 9 aa, Homo Sapiens
FGWINVFLL

SEQ ID NO: 845839 - protein, 9 aa, Homo Sapiens
AWQGLGVPC

SEQ ID NO: 845840 - protein, 9 aa, Homo Sapiens
QMESGYESS

SEQ ID NO: 845841 - protein, 9 aa, Homo Sapiens
YIKRSIQDI

SEQ ID NO: 845842 - protein, 9 aa, Homo Sapiens
FPSLELNIK

SEQ ID NO: 845843 - protein, 9 aa, Homo Sapiens
PGPQGSAGN

SEQ ID NO: 845844 - protein, 9 aa, Homo Sapiens
KGKKIDLDT

SEQ ID NO: 845845 - protein, 9 aa, Homo Sapiens
LNKFRWYRF

SEQ ID NO: 845846 - protein, 9 aa, Homo Sapiens
LLIPEKLDL

SEQ ID NO: 845847 - protein, 9 aa, Homo Sapiens
TSRYNFHSL

SEQ ID NO: 845848 - protein, 9 aa, Homo Sapiens
TIIDGSQVW

SEQ ID NO: 845849 - protein, 9 aa, Homo Sapiens
SRYMHDLFP

SEQ ID NO: 845850 - protein, 9 aa, Homo Sapiens
FETKIISVF

SEQ ID NO: 845851 - protein, 9 aa, Homo Sapiens
DQPPNSVDG

SEQ ID NO: 845852 - protein, 9 aa, Homo Sapiens
KMFIRYGNY

SEQ ID NO: 845853 - protein, 9 aa, Homo Sapiens
CQEVVNLGG

SEQ ID NO: 845854 - protein, 9 aa, Homo Sapiens
CQVESLNLP

SEQ ID NO: 845855 - protein, 9 aa, Homo Sapiens
DSKRFWYIK

SEQ ID NO: 845856 - protein, 9 aa, Homo Sapiens
LTFLYTLMR

SEQ ID NO: 845857 - protein, 9 aa, Homo Sapiens
ELNAPQSPK

SEQ ID NO: 845858 - protein, 9 aa, Homo Sapiens
MEDKKRKKL

SEQ ID NO: 845859 - protein, 9 aa, Homo Sapiens
LWRPQPCCI

SEQ ID NO: 845860 - protein, 9 aa, Homo Sapiens
YMEKEKKTW

SEQ ID NO: 845861 - protein, 9 aa, Homo Sapiens
EKLQRRQDK

SEQ ID NO: 845862 - protein, 9 aa, Homo Sapiens
QIIYIGESS

SEQ ID NO: 845863 - protein, 9 aa, Homo Sapiens
PYLPYKYTC

SEQ ID NO: 845864 - protein, 9 aa, Homo Sapiens
KAFDWDVWE

SEQ ID NO: 845865 - protein, 9 aa, Homo Sapiens
NKIYDGGAR

SEQ ID NO: 845866 - protein, 9 aa, Homo Sapiens
SVCCRSLAS

SEQ ID NO: 845867 - protein, 9 aa, Homo Sapiens
MVIPVPETE

SEQ ID NO: 845868 - protein, 9 aa, Homo Sapiens
VRGIAGVDL

SEQ ID NO: 845869 - protein, 9 aa, Homo Sapiens
AMARFHKNL

SEQ ID NO: 845870 - protein, 9 aa, Homo Sapiens
EPIERKYYI

SEQ ID NO: 845871 - protein, 9 aa, Homo Sapiens
HSHEAIINY

SEQ ID NO: 845872 - protein, 9 aa, Homo Sapiens
GVILHSHKT

SEQ ID NO: 845873 - protein, 9 aa, Homo Sapiens
EELMLLANM

SEQ ID NO: 845874 - protein, 9 aa, Homo Sapiens
ENDPSVNYQ

SEQ ID NO: 845875 - protein, 9 aa, Homo Sapiens
PLWVLRARQ

SEQ ID NO: 845876 - protein, 9 aa, Homo Sapiens
MSRIHEEFK

SEQ ID NO: 845877 - protein, 9 aa, Homo Sapiens
LGKRYNLTL

SEQ ID NO: 845878 - protein, 9 aa, Homo Sapiens
PLANQSILL

SEQ ID NO: 845879 - protein, 9 aa, Homo Sapiens
YAMVLFMIT

SEQ ID NO: 845880 - protein, 9 aa, Homo Sapiens
NGQGSRMLH

SEQ ID NO: 845881 - protein, 9 aa, Homo Sapiens
ILTFTCYYV

SEQ ID NO: 845882 - protein, 9 aa, Homo Sapiens
RDLINFLKL

SEQ ID NO: 845883 - protein, 9 aa, Homo Sapiens
SEDSELESS

SEQ ID NO: 845884 - protein, 9 aa, Homo Sapiens
TTELPDSCS

SEQ ID NO: 845885 - protein, 9 aa, Homo Sapiens
SLFHPEKLH

SEQ ID NO: 845886 - protein, 9 aa, Homo Sapiens
KERSIFLVT

SEQ ID NO: 845887 - protein, 9 aa, Homo Sapiens
SDTAGKNAL

SEQ ID NO: 845888 - protein, 9 aa, Homo Sapiens
SRNEELGDE

SEQ ID NO: 845889 - protein, 9 aa, Homo Sapiens
LICEGKNQN

SEQ ID NO: 845890 - protein, 9 aa, Homo Sapiens
SLSADPLPN

SEQ ID NO: 845891 - protein, 9 aa, Homo Sapiens
DPSVNYQAQ

SEQ ID NO: 845892 - protein, 9 aa, Homo Sapiens
KYDLTRIKT

SEQ ID NO: 845893 - protein, 9 aa, Homo Sapiens
GNSLALLVL

SEQ ID NO: 845894 - protein, 9 aa, Homo Sapiens
TTEDTEQDK

SEQ ID NO: 845895 - protein, 9 aa, Homo Sapiens
PFFLFAAIC

SEQ ID NO: 845896 - protein, 9 aa, Homo Sapiens
IPFSVKDIL

SEQ ID NO: 845897 - protein, 9 aa, Homo Sapiens
VTNNHFAHF

SEQ ID NO: 845898 - protein, 9 aa, Homo Sapiens
CINNNVCKQ

SEQ ID NO: 845899 - protein, 9 aa, Homo Sapiens
FHSHGWPEV

SEQ ID NO: 845900 - protein, 9 aa, Homo Sapiens
SSWEKLENN

SEQ ID NO: 845901 - protein, 9 aa, Homo Sapiens
NRAACYLKK

SEQ ID NO: 845902 - protein, 9 aa, Homo Sapiens
NPLVAATLL

SEQ ID NO: 845903 - protein, 9 aa, Homo Sapiens
ENLFCFLTD

SEQ ID NO: 845904 - protein, 9 aa, Homo Sapiens
SNTSRKSLL

SEQ ID NO: 845905 - protein, 9 aa, Homo Sapiens
TVDPLDWLC

SEQ ID NO: 845906 - protein, 9 aa, Homo Sapiens
IAQLEIMRM

SEQ ID NO: 845907 - protein, 9 aa, Homo Sapiens
LKITIPNAL

SEQ ID NO: 845908 - protein, 9 aa, Homo Sapiens
KKIRNSLLE

SEQ ID NO: 845909 - protein, 9 aa, Homo Sapiens
SQEQRARAT

SEQ ID NO: 845910 - protein, 9 aa, Homo Sapiens
GLFNPQGFL

SEQ ID NO: 845911 - protein, 9 aa, Homo Sapiens
ISSGNLLPP

SEQ ID NO: 845912 - protein, 9 aa, Homo Sapiens
DAFNLKRHM

SEQ ID NO: 845913 - protein, 9 aa, Homo Sapiens
LDALTEKFR

SEQ ID NO: 845914 - protein, 9 aa, Homo Sapiens
LNDDNEYLF

SEQ ID NO: 845915 - protein, 9 aa, Homo Sapiens
PICVVWGRY

SEQ ID NO: 845916 - protein, 9 aa, Homo Sapiens
LQVLGHTLR

SEQ ID NO: 845917 - protein, 9 aa, Homo Sapiens
WDAAKYLKE

SEQ ID NO: 845918 - protein, 9 aa, Homo Sapiens
RQNHSLDSK

SEQ ID NO: 845919 - protein, 9 aa, Homo Sapiens
GFILQCTHG

SEQ ID NO: 845920 - protein, 9 aa, Homo Sapiens
LGEYQELLD

SEQ ID NO: 845921 - protein, 9 aa, Homo Sapiens
GRTENRREM

SEQ ID NO: 845922 - protein, 9 aa, Homo Sapiens
DKHLDVPNI

SEQ ID NO: 845923 - protein, 9 aa, Homo Sapiens
PMSSPDLLP

SEQ ID NO: 845924 - protein, 9 aa, Homo Sapiens
KPGKPQKRK

SEQ ID NO: 845925 - protein, 9 aa, Homo Sapiens
EEKPTDDTP

SEQ ID NO: 845926 - protein, 9 aa, Homo Sapiens
IPVNVTLRQ

SEQ ID NO: 845927 - protein, 9 aa, Homo Sapiens
ILKYAPFYF

SEQ ID NO: 845928 - protein, 9 aa, Homo Sapiens
YWDTIPPDW

SEQ ID NO: 845929 - protein, 9 aa, Homo Sapiens
WTAEGDINT

SEQ ID NO: 845930 - protein, 9 aa, Homo Sapiens
STTLTKHNI

SEQ ID NO: 845931 - protein, 9 aa, Homo Sapiens
HFQSLAGLE

SEQ ID NO: 845932 - protein, 9 aa, Homo Sapiens
DFVTKTPLE

SEQ ID NO: 845933 - protein, 9 aa, Homo Sapiens
DLLGEDYLA

SEQ ID NO: 845934 - protein, 9 aa, Homo Sapiens
LYDCQTRQH

SEQ ID NO: 845935 - protein, 9 aa, Homo Sapiens
CNRENNRTS

SEQ ID NO: 845936 - protein, 9 aa, Homo Sapiens
RAFPEERYD

SEQ ID NO: 845937 - protein, 9 aa, Homo Sapiens
KSVQEREVP

SEQ ID NO: 845938 - protein, 9 aa, Homo Sapiens
SESSSNQSY

SEQ ID NO: 845939 - protein, 9 aa, Homo Sapiens
SLVPYIMEA

SEQ ID NO: 845940 - protein, 9 aa, Homo Sapiens
EEPTCRNQT

SEQ ID NO: 845941 - protein, 9 aa, Homo Sapiens
MVWGLDLDD

SEQ ID NO: 845942 - protein, 9 aa, Homo Sapiens
RTADLQAAL

SEQ ID NO: 845943 - protein, 9 aa, Homo Sapiens
HNQIVIRGL

SEQ ID NO: 845944 - protein, 9 aa, Homo Sapiens
PQICDHCSA

SEQ ID NO: 845945 - protein, 9 aa, Homo Sapiens
TMLFPDIVG

SEQ ID NO: 845946 - protein, 9 aa, Homo Sapiens
SVSSTSLGT

SEQ ID NO: 845947 - protein, 9 aa, Homo Sapiens
ENSVYEGDD

SEQ ID NO: 845948 - protein, 9 aa, Homo Sapiens
QDAKERAEL

SEQ ID NO: 845949 - protein, 9 aa, Homo Sapiens
GLMNSGKVL

SEQ ID NO: 845950 - protein, 9 aa, Homo Sapiens
VLYKLSPKE

SEQ ID NO: 845951 - protein, 9 aa, Homo Sapiens
SHEQKMSVL

SEQ ID NO: 845952 - protein, 9 aa, Homo Sapiens
PVPASPIHF

SEQ ID NO: 845953 - protein, 9 aa, Homo Sapiens
LRQIAHGAD

SEQ ID NO: 845954 - protein, 9 aa, Homo Sapiens
MDSIQSSKL

SEQ ID NO: 845955 - protein, 9 aa, Homo Sapiens
VNLGGLSIL

SEQ ID NO: 845956 - protein, 9 aa, Homo Sapiens
CDINKRLCY

SEQ ID NO: 845957 - protein, 9 aa, Homo Sapiens
YASVEYLPP

SEQ ID NO: 845958 - protein, 9 aa, Homo Sapiens
EVYPTTMRT

SEQ ID NO: 845959 - protein, 9 aa, Homo Sapiens
KGKAGTTEK

SEQ ID NO: 845960 - protein, 9 aa, Homo Sapiens
LHSHVQGIS

SEQ ID NO: 845961 - protein, 9 aa, Homo Sapiens
EQNKPYYDE

SEQ ID NO: 845962 - protein, 9 aa, Homo Sapiens
DSHAHRLIG

SEQ ID NO: 845963 - protein, 9 aa, Homo Sapiens
GWKWGGCSK

SEQ ID NO: 845964 - protein, 9 aa, Homo Sapiens
IKYEFFRRK

SEQ ID NO: 845965 - protein, 9 aa, Homo Sapiens
LKTIDIREE

SEQ ID NO: 845966 - protein, 9 aa, Homo Sapiens
DRFGRRFII

SEQ ID NO: 845967 - protein, 9 aa, Homo Sapiens
LQEQLNEDE

SEQ ID NO: 845968 - protein, 9 aa, Homo Sapiens
MTIKAELPL

SEQ ID NO: 845969 - protein, 9 aa, Homo Sapiens
SSLSLTVLF

SEQ ID NO: 845970 - protein, 9 aa, Homo Sapiens
CLCHKVQCF

SEQ ID NO: 845971 - protein, 9 aa, Homo Sapiens
IHAIMENAV

SEQ ID NO: 845972 - protein, 9 aa, Homo Sapiens
KKHIIIYEQ

SEQ ID NO: 845973 - protein, 9 aa, Homo Sapiens
SLSVSPLIL

SEQ ID NO: 845974 - protein, 9 aa, Homo Sapiens
WDVDVTHSS

SEQ ID NO: 845975 - protein, 9 aa, Homo Sapiens
PNHPFYSNI

SEQ ID NO: 845976 - protein, 9 aa, Homo Sapiens
LVAYWENTF

SEQ ID NO: 845977 - protein, 9 aa, Homo Sapiens
WRYINFNMS

SEQ ID NO: 845978 - protein, 9 aa, Homo Sapiens
DFQHRPRGK

SEQ ID NO: 845979 - protein, 9 aa, Homo Sapiens
RCQKMCDQW

SEQ ID NO: 845980 - protein, 9 aa, Homo Sapiens
PCNQCGKSF

SEQ ID NO: 845981 - protein, 9 aa, Homo Sapiens
DGRITLSDF

SEQ ID NO: 845982 - protein, 9 aa, Homo Sapiens
DTTPVRPVT

SEQ ID NO: 845983 - protein, 9 aa, Homo Sapiens
GLLTSYSWD

SEQ ID NO: 845984 - protein, 9 aa, Homo Sapiens
LLILVRSHH

SEQ ID NO: 845985 - protein, 9 aa, Homo Sapiens
LNVGEHKEA

SEQ ID NO: 845986 - protein, 9 aa, Homo Sapiens
WRLWRCQVA

SEQ ID NO: 845987 - protein, 9 aa, Homo Sapiens
EVMTDFKLH

SEQ ID NO: 845988 - protein, 9 aa, Homo Sapiens
DMQMKDPLP

SEQ ID NO: 845989 - protein, 9 aa, Homo Sapiens
HYQIYKAAR

SEQ ID NO: 845990 - protein, 9 aa, Homo Sapiens
TIVFPTDWM

SEQ ID NO: 845991 - protein, 9 aa, Homo Sapiens
LIKILSMQG

SEQ ID NO: 845992 - protein, 9 aa, Homo Sapiens
LPQMSQCTC

SEQ ID NO: 845993 - protein, 9 aa, Homo Sapiens
YDGIPCVNA

SEQ ID NO: 845994 - protein, 9 aa, Homo Sapiens
VWVGGRSNS

SEQ ID NO: 845995 - protein, 9 aa, Homo Sapiens
RVLELEAEV

SEQ ID NO: 845996 - protein, 9 aa, Homo Sapiens
ERVPIDWDP

SEQ ID NO: 845997 - protein, 9 aa, Homo Sapiens
IILMTIGGN

SEQ ID NO: 845998 - protein, 9 aa, Homo Sapiens
QSSCCKSCC

SEQ ID NO: 845999 - protein, 9 aa, Homo Sapiens
IKIFSKTSS

SEQ ID NO: 846000 - protein, 9 aa, Homo Sapiens
PKDVIENYC

SEQ ID NO: 846001 - protein, 9 aa, Homo Sapiens
NFEVQRYDN

SEQ ID NO: 846002 - protein, 9 aa, Homo Sapiens
YIYYLCLDK

SEQ ID NO: 846003 - protein, 9 aa, Homo Sapiens
SSLYREPLA

SEQ ID NO: 846004 - protein, 9 aa, Homo Sapiens
DISELNRVI

SEQ ID NO: 846005 - protein, 9 aa, Homo Sapiens
VKYLKIHAR

SEQ ID NO: 846006 - protein, 9 aa, Homo Sapiens
GGGGGDSGG

SEQ ID NO: 846007 - protein, 9 aa, Homo Sapiens
VHQIHTQNK

SEQ ID NO: 846008 - protein, 9 aa, Homo Sapiens
MHLSQETQQ

SEQ ID NO: 846009 - protein, 9 aa, Homo Sapiens
QFKEEKLAD

SEQ ID NO: 846010 - protein, 9 aa, Homo Sapiens
HLFYIHVDK

SEQ ID NO: 846011 - protein, 9 aa, Homo Sapiens
PEGFAVGVG

SEQ ID NO: 846012 - protein, 9 aa, Homo Sapiens
YIAKQKQLK

SEQ ID NO: 846013 - protein, 9 aa, Homo Sapiens
NRQKNKCVC

SEQ ID NO: 846014 - protein, 9 aa, Homo Sapiens
DGIFFYYLG

SEQ ID NO: 846015 - protein, 9 aa, Homo Sapiens
ISVLQDYCN

SEQ ID NO: 846016 - protein, 9 aa, Homo Sapiens
YPIGTTANE

SEQ ID NO: 846017 - protein, 9 aa, Homo Sapiens
LEYLELLFT

SEQ ID NO: 846018 - protein, 9 aa, Homo Sapiens
KGVLDWRIQ

SEQ ID NO: 846019 - protein, 9 aa, Homo Sapiens
YDAVNYPLR

SEQ ID NO: 846020 - protein, 9 aa, Homo Sapiens
YFNMRVFSQ

SEQ ID NO: 846021 - protein, 9 aa, Homo Sapiens
GGIIAPFML

SEQ ID NO: 846022 - protein, 9 aa, Homo Sapiens
HLRHDKIMF

SEQ ID NO: 846023 - protein, 9 aa, Homo Sapiens
YGYLVNYLH

SEQ ID NO: 846024 - protein, 9 aa, Homo Sapiens
IPNKSSVRL

SEQ ID NO: 846025 - protein, 9 aa, Homo Sapiens
HSYVGSFSS

SEQ ID NO: 846026 - protein, 9 aa, Homo Sapiens
LDELVQIGH

SEQ ID NO: 846027 - protein, 9 aa, Homo Sapiens
TMGILLREM

SEQ ID NO: 846028 - protein, 9 aa, Homo Sapiens
FKLENFQGR

SEQ ID NO: 846029 - protein, 9 aa, Homo Sapiens
ATVIHTLEK

SEQ ID NO: 846030 - protein, 9 aa, Homo Sapiens
NGTSSKKVI

SEQ ID NO: 846031 - protein, 9 aa, Homo Sapiens
ITKMTAVIF

SEQ ID NO: 846032 - protein, 9 aa, Homo Sapiens
VAYSLNGHK

SEQ ID NO: 846033 - protein, 9 aa, Homo Sapiens
HLEDRVEDL

SEQ ID NO: 846034 - protein, 9 aa, Homo Sapiens
TGVKPYLTD

SEQ ID NO: 846035 - protein, 9 aa, Homo Sapiens
LDCVLKVIA

SEQ ID NO: 846036 - protein, 9 aa, Homo Sapiens
YGELRAFDW

SEQ ID NO: 846037 - protein, 9 aa, Homo Sapiens
ELEVKIIEN

SEQ ID NO: 846038 - protein, 9 aa, Homo Sapiens
IILNDNDLA

SEQ ID NO: 846039 - protein, 9 aa, Homo Sapiens
QRLQESREG

SEQ ID NO: 846040 - protein, 9 aa, Homo Sapiens
AQSDLAAIF

SEQ ID NO: 846041 - protein, 9 aa, Homo Sapiens
LILKVHGSK

SEQ ID NO: 846042 - protein, 9 aa, Homo Sapiens
FILLGFYNY

SEQ ID NO: 846043 - protein, 9 aa, Homo Sapiens
VVVFQTPPI

SEQ ID NO: 846044 - protein, 9 aa, Homo Sapiens
KFKESVFEK

SEQ ID NO: 846045 - protein, 9 aa, Homo Sapiens
TGITPVLRR

SEQ ID NO: 846046 - protein, 9 aa, Homo Sapiens
EVAESQFNK

SEQ ID NO: 846047 - protein, 9 aa, Homo Sapiens
GRQGEKGAN

SEQ ID NO: 846048 - protein, 9 aa, Homo Sapiens
LFIAKETTI

SEQ ID NO: 846049 - protein, 9 aa, Homo Sapiens
IKILSMQGQ

SEQ ID NO: 846050 - protein, 9 aa, Homo Sapiens
YLEFKEPKE

SEQ ID NO: 846051 - protein, 9 aa, Homo Sapiens
FNSKNEAPV

SEQ ID NO: 846052 - protein, 9 aa, Homo Sapiens
IHSKDKPFK

SEQ ID NO: 846053 - protein, 9 aa, Homo Sapiens
DKTGEIMDN

SEQ ID NO: 846054 - protein, 9 aa, Homo Sapiens
KMNYIGQLL

SEQ ID NO: 846055 - protein, 9 aa, Homo Sapiens
ALSQPSPPS

SEQ ID NO: 846056 - protein, 9 aa, Homo Sapiens
SLTRGASLL

SEQ ID NO: 846057 - protein, 9 aa, Homo Sapiens
EDKSLNLAS

SEQ ID NO: 846058 - protein, 9 aa, Homo Sapiens
KNSAESHGL

SEQ ID NO: 846059 - protein, 9 aa, Homo Sapiens
PCLYTFPDH

SEQ ID NO: 846060 - protein, 9 aa, Homo Sapiens
QNSKIFFLY

SEQ ID NO: 846061 - protein, 9 aa, Homo Sapiens
QSTWDASVL

SEQ ID NO: 846062 - protein, 9 aa, Homo Sapiens
NKDKNKKSK

SEQ ID NO: 846063 - protein, 9 aa, Homo Sapiens
LVTNNHFAH

SEQ ID NO: 846064 - protein, 9 aa, Homo Sapiens
TNNEGGGSA

SEQ ID NO: 846065 - protein, 9 aa, Homo Sapiens
PRSSLAAFQ

SEQ ID NO: 846066 - protein, 9 aa, Homo Sapiens
DNILPLNSA

SEQ ID NO: 846067 - protein, 9 aa, Homo Sapiens
PMLYNTCYS

SEQ ID NO: 846068 - protein, 9 aa, Homo Sapiens
HHTDMSSLS

SEQ ID NO: 846069 - protein, 9 aa, Homo Sapiens
WINLNKEER

SEQ ID NO: 846070 - protein, 9 aa, Homo Sapiens
IRRRLRMLA

SEQ ID NO: 846071 - protein, 9 aa, Homo Sapiens
QTIQILTCQ

SEQ ID NO: 846072 - protein, 9 aa, Homo Sapiens
TRLGQSHRR

SEQ ID NO: 846073 - protein, 9 aa, Homo Sapiens
ENREEEKEK

SEQ ID NO: 846074 - protein, 9 aa, Homo Sapiens
EHLEERVAV

SEQ ID NO: 846075 - protein, 9 aa, Homo Sapiens
SRTTASTPM

SEQ ID NO: 846076 - protein, 9 aa, Homo Sapiens
SHTTATGEI

SEQ ID NO: 846077 - protein, 9 aa, Homo Sapiens
ELLDSKLSL

SEQ ID NO: 846078 - protein, 9 aa, Homo Sapiens
QAADEISLS

SEQ ID NO: 846079 - protein, 9 aa, Homo Sapiens
KLRKLFHPF

SEQ ID NO: 846080 - protein, 9 aa, Homo Sapiens
HPDCSINGQ

SEQ ID NO: 846081 - protein, 9 aa, Homo Sapiens
QGDEEKYPP

SEQ ID NO: 846082 - protein, 9 aa, Homo Sapiens
AHIILVNVR

SEQ ID NO: 846083 - protein, 9 aa, Homo Sapiens
RIMEISAPL

SEQ ID NO: 846084 - protein, 9 aa, Homo Sapiens
VMAQKRGEA

SEQ ID NO: 846085 - protein, 9 aa, Homo Sapiens
HPHMASQLG

SEQ ID NO: 846086 - protein, 9 aa, Homo Sapiens
TDLFLSLVA

SEQ ID NO: 846087 - protein, 9 aa, Homo Sapiens
LIIRPSNGI

SEQ ID NO: 846088 - protein, 9 aa, Homo Sapiens
EFLKGCACA

SEQ ID NO: 846089 - protein, 9 aa, Homo Sapiens
NELFCEVDE

SEQ ID NO: 846090 - protein, 9 aa, Homo Sapiens
ENHENIFLQ

SEQ ID NO: 846091 - protein, 9 aa, Homo Sapiens
IKAWLFSNN

SEQ ID NO: 846092 - protein, 9 aa, Homo Sapiens
LPANILTAD

SEQ ID NO: 846093 - protein, 9 aa, Homo Sapiens
FTFGIDSHI

SEQ ID NO: 846094 - protein, 9 aa, Homo Sapiens
LRTTTQMGR

SEQ ID NO: 846095 - protein, 9 aa, Homo Sapiens
VLRVVKYFE

SEQ ID NO: 846096 - protein, 9 aa, Homo Sapiens
NFKLKYGWK

SEQ ID NO: 846097 - protein, 9 aa, Homo Sapiens
SYAQHSYVG

SEQ ID NO: 846098 - protein, 9 aa, Homo Sapiens
KGYQDVNTS

SEQ ID NO: 846099 - protein, 9 aa, Homo Sapiens
STRTISAGK

SEQ ID NO: 846100 - protein, 9 aa, Homo Sapiens
CKKHLTHCQ

SEQ ID NO: 846101 - protein, 9 aa, Homo Sapiens
AQHFYNLVL

SEQ ID NO: 846102 - protein, 9 aa, Homo Sapiens
TQGQIHSTS

SEQ ID NO: 846103 - protein, 9 aa, Homo Sapiens
PRFNREVDM

SEQ ID NO: 846104 - protein, 9 aa, Homo Sapiens
VKSVLVYHN

SEQ ID NO: 846105 - protein, 9 aa, Homo Sapiens
TFRDSLEDC

SEQ ID NO: 846106 - protein, 9 aa, Homo Sapiens
YGYKYCDAK

SEQ ID NO: 846107 - protein, 9 aa, Homo Sapiens
LHPLESLAK

SEQ ID NO: 846108 - protein, 9 aa, Homo Sapiens
LFFRIKCFM

SEQ ID NO: 846109 - protein, 9 aa, Homo Sapiens
MRYKHIDHT

SEQ ID NO: 846110 - protein, 9 aa, Homo Sapiens
LCHVATSPG

SEQ ID NO: 846111 - protein, 9 aa, Homo Sapiens
LEKEEVEVT

SEQ ID NO: 846112 - protein, 9 aa, Homo Sapiens
ICIIGPPAV

SEQ ID NO: 846113 - protein, 9 aa, Homo Sapiens
TVTIWAANT

SEQ ID NO: 846114 - protein, 9 aa, Homo Sapiens
PGQITFHAV

SEQ ID NO: 846115 - protein, 9 aa, Homo Sapiens
FLRWKGYNC

SEQ ID NO: 846116 - protein, 9 aa, Homo Sapiens
KHTGKKPYK

SEQ ID NO: 846117 - protein, 9 aa, Homo Sapiens
TLGPGPHHQ

SEQ ID NO: 846118 - protein, 9 aa, Homo Sapiens
QRKIMTSQD

SEQ ID NO: 846119 - protein, 9 aa, Homo Sapiens
NHRIIHTGE

SEQ ID NO: 846120 - protein, 9 aa, Homo Sapiens
ETSKLIYNF

SEQ ID NO: 846121 - protein, 9 aa, Homo Sapiens
RCAPFLPES

SEQ ID NO: 846122 - protein, 9 aa, Homo Sapiens
TPPKMDIPV

SEQ ID NO: 846123 - protein, 9 aa, Homo Sapiens
DQRVIIVRR

SEQ ID NO: 846124 - protein, 9 aa, Homo Sapiens
QCTRYTIKT

SEQ ID NO: 846125 - protein, 9 aa, Homo Sapiens
TNFDPRLHR

SEQ ID NO: 846126 - protein, 9 aa, Homo Sapiens
ETGILDGMM

SEQ ID NO: 846127 - protein, 9 aa, Homo Sapiens
PRSYNPQYQ

SEQ ID NO: 846128 - protein, 9 aa, Homo Sapiens
GQGGGGGGD

SEQ ID NO: 846129 - protein, 9 aa, Homo Sapiens
CRPFSDRVP

SEQ ID NO: 846130 - protein, 9 aa, Homo Sapiens
CKQCKNLTT

SEQ ID NO: 846131 - protein, 9 aa, Homo Sapiens
YSCASKHAF

SEQ ID NO: 846132 - protein, 9 aa, Homo Sapiens
PYYCYGGYS

SEQ ID NO: 846133 - protein, 9 aa, Homo Sapiens
KEAHPKYPD

SEQ ID NO: 846134 - protein, 9 aa, Homo Sapiens
EDAHEFIMF

SEQ ID NO: 846135 - protein, 9 aa, Homo Sapiens
SQLLVNYPE

SEQ ID NO: 846136 - protein, 9 aa, Homo Sapiens
LNNLSLTEK

SEQ ID NO: 846137 - protein, 9 aa, Homo Sapiens
PDKFKPEVK

SEQ ID NO: 846138 - protein, 9 aa, Homo Sapiens
YLNHNLGAG

SEQ ID NO: 846139 - protein, 9 aa, Homo Sapiens
SQEANGNKC

SEQ ID NO: 846140 - protein, 9 aa, Homo Sapiens
INDSKLASA

SEQ ID NO: 846141 - protein, 9 aa, Homo Sapiens
LIDGSFKIG

SEQ ID NO: 846142 - protein, 9 aa, Homo Sapiens
YYYDKIERT

SEQ ID NO: 846143 - protein, 9 aa, Homo Sapiens
NTTVKGVTF

SEQ ID NO: 846144 - protein, 9 aa, Homo Sapiens
YLQQRYLAT

SEQ ID NO: 846145 - protein, 9 aa, Homo Sapiens
GGSQKLFYL

SEQ ID NO: 846146 - protein, 9 aa, Homo Sapiens
DNGNVCQRE

SEQ ID NO: 846147 - protein, 9 aa, Homo Sapiens
PFANKECSI

SEQ ID NO: 846148 - protein, 9 aa, Homo Sapiens
SDPSTDFDT

SEQ ID NO: 846149 - protein, 9 aa, Homo Sapiens
YKHPDICKD

SEQ ID NO: 846150 - protein, 9 aa, Homo Sapiens
NKILQGKLS

SEQ ID NO: 846151 - protein, 9 aa, Homo Sapiens
TLPILSRLQ

SEQ ID NO: 846152 - protein, 9 aa, Homo Sapiens
KMSLRSQIR

SEQ ID NO: 846153 - protein, 9 aa, Homo Sapiens
LTEYFTFKH

SEQ ID NO: 846154 - protein, 9 aa, Homo Sapiens
PKDLGTEHS

SEQ ID NO: 846155 - protein, 9 aa, Homo Sapiens
NYLIYTLRN

SEQ ID NO: 846156 - protein, 9 aa, Homo Sapiens
GFSSLFKGF

SEQ ID NO: 846157 - protein, 9 aa, Homo Sapiens
TFRVVDTEF

SEQ ID NO: 846158 - protein, 9 aa, Homo Sapiens
EENPTNNEN

SEQ ID NO: 846159 - protein, 9 aa, Homo Sapiens
IPANTLNPV

SEQ ID NO: 846160 - protein, 9 aa, Homo Sapiens
PAVGLCCPA

SEQ ID NO: 846161 - protein, 9 aa, Homo Sapiens
GEQPFECLE

SEQ ID NO: 846162 - protein, 9 aa, Homo Sapiens
TSALRMPSA

SEQ ID NO: 846163 - protein, 9 aa, Homo Sapiens
FTSVRRDCN

SEQ ID NO: 846164 - protein, 9 aa, Homo Sapiens
ATQKIAKAF

SEQ ID NO: 846165 - protein, 9 aa, Homo Sapiens
IRVKYLKIH

SEQ ID NO: 846166 - protein, 9 aa, Homo Sapiens
AASKFITKD

SEQ ID NO: 846167 - protein, 9 aa, Homo Sapiens
HNGDPFYAG

SEQ ID NO: 846168 - protein, 9 aa, Homo Sapiens
TQMGRGTKA

SEQ ID NO: 846169 - protein, 9 aa, Homo Sapiens
YQALARMRE

SEQ ID NO: 846170 - protein, 9 aa, Homo Sapiens
AFTTILIIF

SEQ ID NO: 846171 - protein, 9 aa, Homo Sapiens
HKSIDLGYA

SEQ ID NO: 846172 - protein, 9 aa, Homo Sapiens
EEIEEYVPS

SEQ ID NO: 846173 - protein, 9 aa, Homo Sapiens
GSNQSRVKC

SEQ ID NO: 846174 - protein, 9 aa, Homo Sapiens
AIKEDAGRM

SEQ ID NO: 846175 - protein, 9 aa, Homo Sapiens
YDNREEHTE

SEQ ID NO: 846176 - protein, 9 aa, Homo Sapiens
MKRLTYSNL

SEQ ID NO: 846177 - protein, 9 aa, Homo Sapiens
SQDTINYSV

SEQ ID NO: 846178 - protein, 9 aa, Homo Sapiens
PEKTSSSSP

SEQ ID NO: 846179 - protein, 9 aa, Homo Sapiens
REPNAVDPV

SEQ ID NO: 846180 - protein, 9 aa, Homo Sapiens
DLLVRTHNS

SEQ ID NO: 846181 - protein, 9 aa, Homo Sapiens
KYLPAPLGT

SEQ ID NO: 846182 - protein, 9 aa, Homo Sapiens
TKEEKNKKY

SEQ ID NO: 846183 - protein, 9 aa, Homo Sapiens
GRGNRGVIV

SEQ ID NO: 846184 - protein, 9 aa, Homo Sapiens
QIIHAVEKP

SEQ ID NO: 846185 - protein, 9 aa, Homo Sapiens
QMNDQGLYS

SEQ ID NO: 846186 - protein, 9 aa, Homo Sapiens
PPPDEDDPR

SEQ ID NO: 846187 - protein, 9 aa, Homo Sapiens
FWENEVNNE

SEQ ID NO: 846188 - protein, 9 aa, Homo Sapiens
LFSLVTTVT

SEQ ID NO: 846189 - protein, 9 aa, Homo Sapiens
WPEGQPLCE

SEQ ID NO: 846190 - protein, 9 aa, Homo Sapiens
HTQVKQEAS

SEQ ID NO: 846191 - protein, 9 aa, Homo Sapiens
EQLFKMLPY

SEQ ID NO: 846192 - protein, 9 aa, Homo Sapiens
LLYGGPELE

SEQ ID NO: 846193 - protein, 9 aa, Homo Sapiens
IPHNSATES

SEQ ID NO: 846194 - protein, 9 aa, Homo Sapiens
DAKSSVDDE

SEQ ID NO: 846195 - protein, 9 aa, Homo Sapiens
ASVEDLLNY

SEQ ID NO: 846196 - protein, 9 aa, Homo Sapiens
DYVERKQKE

SEQ ID NO: 846197 - protein, 9 aa, Homo Sapiens
NNIIKKIIN

SEQ ID NO: 846198 - protein, 9 aa, Homo Sapiens
QVPGASHFE

SEQ ID NO: 846199 - protein, 9 aa, Homo Sapiens
GLSCAGRYS

SEQ ID NO: 846200 - protein, 9 aa, Homo Sapiens
LGSEEVWKV

SEQ ID NO: 846201 - protein, 9 aa, Homo Sapiens
VDVILDSVG

SEQ ID NO: 846202 - protein, 9 aa, Homo Sapiens
SLGYIYFKL

SEQ ID NO: 846203 - protein, 9 aa, Homo Sapiens
SLNLQSRKD

SEQ ID NO: 846204 - protein, 9 aa, Homo Sapiens
GSQSETSYW

SEQ ID NO: 846205 - protein, 9 aa, Homo Sapiens
RQTVPSGLS

SEQ ID NO: 846206 - protein, 9 aa, Homo Sapiens
NIDREFALW

SEQ ID NO: 846207 - protein, 9 aa, Homo Sapiens
WALPSLKWI

SEQ ID NO: 846208 - protein, 9 aa, Homo Sapiens
IMPNTGFLI

SEQ ID NO: 846209 - protein, 9 aa, Homo Sapiens
QWPFCGNNI

SEQ ID NO: 846210 - protein, 9 aa, Homo Sapiens
HSHDVTERK

SEQ ID NO: 846211 - protein, 9 aa, Homo Sapiens
SFSLGYIYF

SEQ ID NO: 846212 - protein, 9 aa, Homo Sapiens
CEAINQMFQ

SEQ ID NO: 846213 - protein, 9 aa, Homo Sapiens
LIAFSLLSH

SEQ ID NO: 846214 - protein, 9 aa, Homo Sapiens
QTGLDRITL

SEQ ID NO: 846215 - protein, 9 aa, Homo Sapiens
RIENHICKL

SEQ ID NO: 846216 - protein, 9 aa, Homo Sapiens
LCGLSDAVL

SEQ ID NO: 846217 - protein, 9 aa, Homo Sapiens
DTAEALTAF

SEQ ID NO: 846218 - protein, 9 aa, Homo Sapiens
CETNLWRCI

SEQ ID NO: 846219 - protein, 9 aa, Homo Sapiens
LISLEEEEG

SEQ ID NO: 846220 - protein, 9 aa, Homo Sapiens
INTNLTLIP

SEQ ID NO: 846221 - protein, 9 aa, Homo Sapiens
PLENNPSLG

SEQ ID NO: 846222 - protein, 9 aa, Homo Sapiens
EKEILLNIN

SEQ ID NO: 846223 - protein, 9 aa, Homo Sapiens
RSKCLEKVH

SEQ ID NO: 846224 - protein, 9 aa, Homo Sapiens
QNGEEEDEN

SEQ ID NO: 846225 - protein, 9 aa, Homo Sapiens
SKRIIKKVQ

SEQ ID NO: 846226 - protein, 9 aa, Homo Sapiens
YRLGILVFL

SEQ ID NO: 846227 - protein, 9 aa, Homo Sapiens
GDVINHDPV

SEQ ID NO: 846228 - protein, 9 aa, Homo Sapiens
RIILQPDDS

SEQ ID NO: 846229 - protein, 9 aa, Homo Sapiens
ELQVLWVDR

SEQ ID NO: 846230 - protein, 9 aa, Homo Sapiens
VMVILLIET

SEQ ID NO: 846231 - protein, 9 aa, Homo Sapiens
LTMSPFCQI

SEQ ID NO: 846232 - protein, 9 aa, Homo Sapiens
FISGDELIN

SEQ ID NO: 846233 - protein, 9 aa, Homo Sapiens
HSYPKCFSL

SEQ ID NO: 846234 - protein, 9 aa, Homo Sapiens
QKHSNLTQH

SEQ ID NO: 846235 - protein, 9 aa, Homo Sapiens
PDCLADINY

SEQ ID NO: 846236 - protein, 9 aa, Homo Sapiens
WDNKDYGST

SEQ ID NO: 846237 - protein, 9 aa, Homo Sapiens
KDKRGKGRT

SEQ ID NO: 846238 - protein, 9 aa, Homo Sapiens
NEGIELHSF

SEQ ID NO: 846239 - protein, 9 aa, Homo Sapiens
EGGKNFSRP

SEQ ID NO: 846240 - protein, 9 aa, Homo Sapiens
EMEYSGDLN

SEQ ID NO: 846241 - protein, 9 aa, Homo Sapiens
RALLPDEQK

SEQ ID NO: 846242 - protein, 9 aa, Homo Sapiens
DIAKKHIII

SEQ ID NO: 846243 - protein, 9 aa, Homo Sapiens
FGVFIGWNI

SEQ ID NO: 846244 - protein, 9 aa, Homo Sapiens
SPQPLQSSR

SEQ ID NO: 846245 - protein, 9 aa, Homo Sapiens
LIKTKANLN

SEQ ID NO: 846246 - protein, 9 aa, Homo Sapiens
RSQPCVLNN

SEQ ID NO: 846247 - protein, 9 aa, Homo Sapiens
ARQVVCDTK

SEQ ID NO: 846248 - protein, 9 aa, Homo Sapiens
SICMHTNKR

SEQ ID NO: 846249 - protein, 9 aa, Homo Sapiens
ITLDLFPGV

SEQ ID NO: 846250 - protein, 9 aa, Homo Sapiens
GSVPHVNQN

SEQ ID NO: 846251 - protein, 9 aa, Homo Sapiens
NRTMKYKPD

SEQ ID NO: 846252 - protein, 9 aa, Homo Sapiens
CRDMTRMFV

SEQ ID NO: 846253 - protein, 9 aa, Homo Sapiens
KNNKIYDGG

SEQ ID NO: 846254 - protein, 9 aa, Homo Sapiens
LVKFIHGQH

SEQ ID NO: 846255 - protein, 9 aa, Homo Sapiens
SQGTTIGCI

SEQ ID NO: 846256 - protein, 9 aa, Homo Sapiens
CRTLILCAD

SEQ ID NO: 846257 - protein, 9 aa, Homo Sapiens
SILQEHPQV

SEQ ID NO: 846258 - protein, 9 aa, Homo Sapiens
IQSFQVALH

SEQ ID NO: 846259 - protein, 9 aa, Homo Sapiens
PPFYGEYDI

SEQ ID NO: 846260 - protein, 9 aa, Homo Sapiens
ILPGKLSLP

SEQ ID NO: 846261 - protein, 9 aa, Homo Sapiens
LPSDEWERC

SEQ ID NO: 846262 - protein, 9 aa, Homo Sapiens
ICQSRPNAI

SEQ ID NO: 846263 - protein, 9 aa, Homo Sapiens
WTKVVLTDP

SEQ ID NO: 846264 - protein, 9 aa, Homo Sapiens
MWDFPGQID

SEQ ID NO: 846265 - protein, 9 aa, Homo Sapiens
SRAVFSSLQ

SEQ ID NO: 846266 - protein, 9 aa, Homo Sapiens
IVNLKKTIR

SEQ ID NO: 846267 - protein, 9 aa, Homo Sapiens
QQQEEMHHL

SEQ ID NO: 846268 - protein, 9 aa, Homo Sapiens
KSAIRRTIG

SEQ ID NO: 846269 - protein, 9 aa, Homo Sapiens
SDTKKNKIN

SEQ ID NO: 846270 - protein, 9 aa, Homo Sapiens
VAERVGTHS

SEQ ID NO: 846271 - protein, 9 aa, Homo Sapiens
SGKTVLHLA

SEQ ID NO: 846272 - protein, 9 aa, Homo Sapiens
NIVMAIAVN

SEQ ID NO: 846273 - protein, 9 aa, Homo Sapiens
VNKTVDTFR

SEQ ID NO: 846274 - protein, 9 aa, Homo Sapiens
KQENTVLNS

SEQ ID NO: 846275 - protein, 9 aa, Homo Sapiens
GIPFFHSAN

SEQ ID NO: 846276 - protein, 9 aa, Homo Sapiens
FEGCPALLY

SEQ ID NO: 846277 - protein, 9 aa, Homo Sapiens
KGAISGQSR

SEQ ID NO: 846278 - protein, 9 aa, Homo Sapiens
KRNEELSLQ

SEQ ID NO: 846279 - protein, 9 aa, Homo Sapiens
KHPEKTTST

SEQ ID NO: 846280 - protein, 9 aa, Homo Sapiens
TAIMQTMAQ

SEQ ID NO: 846281 - protein, 9 aa, Homo Sapiens
HELGPLASH

SEQ ID NO: 846282 - protein, 9 aa, Homo Sapiens
STGLETTFP

SEQ ID NO: 846283 - protein, 9 aa, Homo Sapiens
GGVTFLGLC

SEQ ID NO: 846284 - protein, 9 aa, Homo Sapiens
NVQLRKGCK

SEQ ID NO: 846285 - protein, 9 aa, Homo Sapiens
DYPMRMLYD

SEQ ID NO: 846286 - protein, 9 aa, Homo Sapiens
TFIYLGVEW

SEQ ID NO: 846287 - protein, 9 aa, Homo Sapiens
CLTKIPGVP

SEQ ID NO: 846288 - protein, 9 aa, Homo Sapiens
AFERNNITE

SEQ ID NO: 846289 - protein, 9 aa, Homo Sapiens
PLFLDLLKQ

SEQ ID NO: 846290 - protein, 9 aa, Homo Sapiens
DSLHTGPGN

SEQ ID NO: 846291 - protein, 9 aa, Homo Sapiens
KKYSKSSTY

SEQ ID NO: 846292 - protein, 9 aa, Homo Sapiens
DNQNSQNSL

SEQ ID NO: 846293 - protein, 9 aa, Homo Sapiens
LNAYLHSKR

SEQ ID NO: 846294 - protein, 9 aa, Homo Sapiens
CVQDVLCAA

SEQ ID NO: 846295 - protein, 9 aa, Homo Sapiens
KQDISSLHY

SEQ ID NO: 846296 - protein, 9 aa, Homo Sapiens
MEVSQTNLA

SEQ ID NO: 846297 - protein, 9 aa, Homo Sapiens
DLSYCWLLN

SEQ ID NO: 846298 - protein, 9 aa, Homo Sapiens
GSTDSDFGS

SEQ ID NO: 846299 - protein, 9 aa, Homo Sapiens
ISNYELFEN

SEQ ID NO: 846300 - protein, 9 aa, Homo Sapiens
SHQIIHTGQ

SEQ ID NO: 846301 - protein, 9 aa, Homo Sapiens
VAANGTKRK

SEQ ID NO: 846302 - protein, 9 aa, Homo Sapiens
ILEKCKRLI

SEQ ID NO: 846303 - protein, 9 aa, Homo Sapiens
HLFGVALEN

SEQ ID NO: 846304 - protein, 9 aa, Homo Sapiens
TADKPYKCE

SEQ ID NO: 846305 - protein, 9 aa, Homo Sapiens
NLFGSNAQY

SEQ ID NO: 846306 - protein, 9 aa, Homo Sapiens
NNYSTSGNE

SEQ ID NO: 846307 - protein, 9 aa, Homo Sapiens
LLFSKCTLI

SEQ ID NO: 846308 - protein, 9 aa, Homo Sapiens
FFLDVPTNN

SEQ ID NO: 846309 - protein, 9 aa, Homo Sapiens
HCELWLERG

SEQ ID NO: 846310 - protein, 9 aa, Homo Sapiens
IPCVNAGSR

SEQ ID NO: 846311 - protein, 9 aa, Homo Sapiens
IAGVDLFGT

SEQ ID NO: 846312 - protein, 9 aa, Homo Sapiens
KELLIDKFC

SEQ ID NO: 846313 - protein, 9 aa, Homo Sapiens
ICKQNFDAY

SEQ ID NO: 846314 - protein, 9 aa, Homo Sapiens
SINTVLVFP

SEQ ID NO: 846315 - protein, 9 aa, Homo Sapiens
LAWLQHQKK

SEQ ID NO: 846316 - protein, 9 aa, Homo Sapiens
SCEEYKTIK

SEQ ID NO: 846317 - protein, 9 aa, Homo Sapiens
SSQRLPPPL

SEQ ID NO: 846318 - protein, 9 aa, Homo Sapiens
DQEHLVLNE

SEQ ID NO: 846319 - protein, 9 aa, Homo Sapiens
LFQHFMHQT

SEQ ID NO: 846320 - protein, 9 aa, Homo Sapiens
GRRNNTHVP

SEQ ID NO: 846321 - protein, 9 aa, Homo Sapiens
EENKSSTKL

SEQ ID NO: 846322 - protein, 9 aa, Homo Sapiens
HLRKDLDEL

SEQ ID NO: 846323 - protein, 9 aa, Homo Sapiens
LEDSGLSTC

SEQ ID NO: 846324 - protein, 9 aa, Homo Sapiens
AKNKLSGSH

SEQ ID NO: 846325 - protein, 9 aa, Homo Sapiens
YLVGDGPHN

SEQ ID NO: 846326 - protein, 9 aa, Homo Sapiens
VQIPLPCCT

SEQ ID NO: 846327 - protein, 9 aa, Homo Sapiens
AATIDNAQP

SEQ ID NO: 846328 - protein, 9 aa, Homo Sapiens
GAVKIWKGQ

SEQ ID NO: 846329 - protein, 9 aa, Homo Sapiens
DSLVHGKPK

SEQ ID NO: 846330 - protein, 9 aa, Homo Sapiens
DITLLHNLL

SEQ ID NO: 846331 - protein, 9 aa, Homo Sapiens
DRKKLGNAC

SEQ ID NO: 846332 - protein, 9 aa, Homo Sapiens
IANANELKY

SEQ ID NO: 846333 - protein, 9 aa, Homo Sapiens
GLQCRRCCP

SEQ ID NO: 846334 - protein, 9 aa, Homo Sapiens
TSDEEVYSV

SEQ ID NO: 846335 - protein, 9 aa, Homo Sapiens
RGIKNRSSG

SEQ ID NO: 846336 - protein, 9 aa, Homo Sapiens
PSLHSRNTI

SEQ ID NO: 846337 - protein, 9 aa, Homo Sapiens
CPQAFNNQN

SEQ ID NO: 846338 - protein, 9 aa, Homo Sapiens
EMLKKAAHK

SEQ ID NO: 846339 - protein, 9 aa, Homo Sapiens
ISKVILSIC

SEQ ID NO: 846340 - protein, 9 aa, Homo Sapiens
LLAHIILVN

SEQ ID NO: 846341 - protein, 9 aa, Homo Sapiens
KVVMLGAWG

SEQ ID NO: 846342 - protein, 9 aa, Homo Sapiens
PQIESSSLQ

SEQ ID NO: 846343 - protein, 9 aa, Homo Sapiens
AAGAVFMAL

SEQ ID NO: 846344 - protein, 9 aa, Homo Sapiens
SPSPAHIVI

SEQ ID NO: 846345 - protein, 9 aa, Homo Sapiens
KPSILNVFC

SEQ ID NO: 846346 - protein, 9 aa, Homo Sapiens
KCINRQEKP

SEQ ID NO: 846347 - protein, 9 aa, Homo Sapiens
AHFSQPTGA

SEQ ID NO: 846348 - protein, 9 aa, Homo Sapiens
DLRQDHPAS

SEQ ID NO: 846349 - protein, 9 aa, Homo Sapiens
FDLKVVAHN

SEQ ID NO: 846350 - protein, 9 aa, Homo Sapiens
PTNQNVIII

SEQ ID NO: 846351 - protein, 9 aa, Homo Sapiens
SLTWGLTLT

SEQ ID NO: 846352 - protein, 9 aa, Homo Sapiens
GFALVYAIT

SEQ ID NO: 846353 - protein, 9 aa, Homo Sapiens
GGPFSGGEK

SEQ ID NO: 846354 - protein, 9 aa, Homo Sapiens
AHHQQIHTG

SEQ ID NO: 846355 - protein, 9 aa, Homo Sapiens
KMEDDKLEA

SEQ ID NO: 846356 - protein, 9 aa, Homo Sapiens
NVREWLQLT

SEQ ID NO: 846357 - protein, 9 aa, Homo Sapiens
WTNGSVAYY

SEQ ID NO: 846358 - protein, 9 aa, Homo Sapiens
YPCNQCGKS

SEQ ID NO: 846359 - protein, 9 aa, Homo Sapiens
GFLARKMHA

SEQ ID NO: 846360 - protein, 9 aa, Homo Sapiens
STTMYGLEY

SEQ ID NO: 846361 - protein, 9 aa, Homo Sapiens
APLEAARWK

SEQ ID NO: 846362 - protein, 9 aa, Homo Sapiens
VNLKELCVY

SEQ ID NO: 846363 - protein, 9 aa, Homo Sapiens
VDTIVFPTD

SEQ ID NO: 846364 - protein, 9 aa, Homo Sapiens
ILTFVSIFS

SEQ ID NO: 846365 - protein, 9 aa, Homo Sapiens
KGAQEQQVR

SEQ ID NO: 846366 - protein, 9 aa, Homo Sapiens
PIPLTEDVL

SEQ ID NO: 846367 - protein, 9 aa, Homo Sapiens
PSNVLQDVF

SEQ ID NO: 846368 - protein, 9 aa, Homo Sapiens
NFCKYVVSN

SEQ ID NO: 846369 - protein, 9 aa, Homo Sapiens
TLTGVYSGK

SEQ ID NO: 846370 - protein, 9 aa, Homo Sapiens
TYYGTKDPV

SEQ ID NO: 846371 - protein, 9 aa, Homo Sapiens
KELFSLFSH

SEQ ID NO: 846372 - protein, 9 aa, Homo Sapiens
LDVYGHHHS

SEQ ID NO: 846373 - protein, 9 aa, Homo Sapiens
SYSWDYMSF

SEQ ID NO: 846374 - protein, 9 aa, Homo Sapiens
YWENTFKID

SEQ ID NO: 846375 - protein, 9 aa, Homo Sapiens
FAEWCLEHG

SEQ ID NO: 846376 - protein, 9 aa, Homo Sapiens
EEKIREQED

SEQ ID NO: 846377 - protein, 9 aa, Homo Sapiens
WHHCPHLPT

SEQ ID NO: 846378 - protein, 9 aa, Homo Sapiens
FLTSNRSVC

SEQ ID NO: 846379 - protein, 9 aa, Homo Sapiens
QNGVALTAL

SEQ ID NO: 846380 - protein, 9 aa, Homo Sapiens
SFHNTCFHC

SEQ ID NO: 846381 - protein, 9 aa, Homo Sapiens
SGTTWSPDN

SEQ ID NO: 846382 - protein, 9 aa, Homo Sapiens
HDRNVECSF

SEQ ID NO: 846383 - protein, 9 aa, Homo Sapiens
QEFANLTRV

SEQ ID NO: 846384 - protein, 9 aa, Homo Sapiens
YLPNSNGAA

SEQ ID NO: 846385 - protein, 9 aa, Homo Sapiens
AQCDALVDD

SEQ ID NO: 846386 - protein, 9 aa, Homo Sapiens
YVVANKKFW

SEQ ID NO: 846387 - protein, 9 aa, Homo Sapiens
TTVYSEERL

SEQ ID NO: 846388 - protein, 9 aa, Homo Sapiens
PGMVLLLPL

SEQ ID NO: 846389 - protein, 9 aa, Homo Sapiens
NHAPMAGGD

SEQ ID NO: 846390 - protein, 9 aa, Homo Sapiens
ALARAQEDV

SEQ ID NO: 846391 - protein, 9 aa, Homo Sapiens
IRKTQKLTF

SEQ ID NO: 846392 - protein, 9 aa, Homo Sapiens
LCPRKFPAI

SEQ ID NO: 846393 - protein, 9 aa, Homo Sapiens
ELFFRVAAL

SEQ ID NO: 846394 - protein, 9 aa, Homo Sapiens
DFLSSKIKQ

SEQ ID NO: 846395 - protein, 9 aa, Homo Sapiens
ADRFFSMVC

SEQ ID NO: 846396 - protein, 9 aa, Homo Sapiens
KATQICASY

SEQ ID NO: 846397 - protein, 9 aa, Homo Sapiens
GMMGTFIEL

SEQ ID NO: 846398 - protein, 9 aa, Homo Sapiens
IQNEFAHYT

SEQ ID NO: 846399 - protein, 9 aa, Homo Sapiens
IFQKFECAN

SEQ ID NO: 846400 - protein, 9 aa, Homo Sapiens
FKAVGKSRG

SEQ ID NO: 846401 - protein, 9 aa, Homo Sapiens
CLGSSSLTN

SEQ ID NO: 846402 - protein, 9 aa, Homo Sapiens
IGFYQIRGE

SEQ ID NO: 846403 - protein, 9 aa, Homo Sapiens
RICTKGIEA

SEQ ID NO: 846404 - protein, 9 aa, Homo Sapiens
KILKEGLML

SEQ ID NO: 846405 - protein, 9 aa, Homo Sapiens
IYLYREGVI

SEQ ID NO: 846406 - protein, 9 aa, Homo Sapiens
NFPSGNVAK

SEQ ID NO: 846407 - protein, 9 aa, Homo Sapiens
LESPLKYLE

SEQ ID NO: 846408 - protein, 9 aa, Homo Sapiens
FLLQKTLEE

SEQ ID NO: 846409 - protein, 9 aa, Homo Sapiens
SLPRVICTC

SEQ ID NO: 846410 - protein, 9 aa, Homo Sapiens
YETQQLQPD

SEQ ID NO: 846411 - protein, 9 aa, Homo Sapiens
LETESKHLH

SEQ ID NO: 846412 - protein, 9 aa, Homo Sapiens
QTGSEGLAQ

SEQ ID NO: 846413 - protein, 9 aa, Homo Sapiens
GLDNGDCDQ

SEQ ID NO: 846414 - protein, 9 aa, Homo Sapiens
AYAEKIMLT

SEQ ID NO: 846415 - protein, 9 aa, Homo Sapiens
WDKTSNIVN

SEQ ID NO: 846416 - protein, 9 aa, Homo Sapiens
CENYHSHEA

SEQ ID NO: 846417 - protein, 9 aa, Homo Sapiens
IGCWYCRRQ

SEQ ID NO: 846418 - protein, 9 aa, Homo Sapiens
GDYVPKEHT

SEQ ID NO: 846419 - protein, 9 aa, Homo Sapiens
KTPKEITLE

SEQ ID NO: 846420 - protein, 9 aa, Homo Sapiens
ELLAKLKGL

SEQ ID NO: 846421 - protein, 9 aa, Homo Sapiens
METGNQAHA

SEQ ID NO: 846422 - protein, 9 aa, Homo Sapiens
PHNLSSGTN

SEQ ID NO: 846423 - protein, 9 aa, Homo Sapiens
SVFWNFDVD

SEQ ID NO: 846424 - protein, 9 aa, Homo Sapiens
WMTGLFNPQ

SEQ ID NO: 846425 - protein, 9 aa, Homo Sapiens
TYHGSITHG

SEQ ID NO: 846426 - protein, 9 aa, Homo Sapiens
YLSADTFKS

SEQ ID NO: 846427 - protein, 9 aa, Homo Sapiens
LLENTFKAN

SEQ ID NO: 846428 - protein, 9 aa, Homo Sapiens
PEIIITYLS

SEQ ID NO: 846429 - protein, 9 aa, Homo Sapiens
PFQREECGK

SEQ ID NO: 846430 - protein, 9 aa, Homo Sapiens
SPPSTTKPL

SEQ ID NO: 846431 - protein, 9 aa, Homo Sapiens
PVLRNQREF

SEQ ID NO: 846432 - protein, 9 aa, Homo Sapiens
ETAVLKWIR

SEQ ID NO: 846433 - protein, 9 aa, Homo Sapiens
NISVNDSDY

SEQ ID NO: 846434 - protein, 9 aa, Homo Sapiens
IWLFGAWHV

SEQ ID NO: 846435 - protein, 9 aa, Homo Sapiens
SSLLTLDNL

SEQ ID NO: 846436 - protein, 9 aa, Homo Sapiens
SLTSGSLET

SEQ ID NO: 846437 - protein, 9 aa, Homo Sapiens
GQMGEDGNY

SEQ ID NO: 846438 - protein, 9 aa, Homo Sapiens
TCEDNSLPY

SEQ ID NO: 846439 - protein, 9 aa, Homo Sapiens
YSIIVALMA

SEQ ID NO: 846440 - protein, 9 aa, Homo Sapiens
CTMKGNLKL

SEQ ID NO: 846441 - protein, 9 aa, Homo Sapiens
LLATGFCLY

SEQ ID NO: 846442 - protein, 9 aa, Homo Sapiens
WHYKYNSQI

SEQ ID NO: 846443 - protein, 9 aa, Homo Sapiens
TPEMILKIK

SEQ ID NO: 846444 - protein, 9 aa, Homo Sapiens
DIHKEMMPR

SEQ ID NO: 846445 - protein, 9 aa, Homo Sapiens
NRTTSFPCT

SEQ ID NO: 846446 - protein, 9 aa, Homo Sapiens
PFKDEVAKS

SEQ ID NO: 846447 - protein, 9 aa, Homo Sapiens
LSLAKGDQS

SEQ ID NO: 846448 - protein, 9 aa, Homo Sapiens
GAGLAVIMG

SEQ ID NO: 846449 - protein, 9 aa, Homo Sapiens
SVPMCDLYP

SEQ ID NO: 846450 - protein, 9 aa, Homo Sapiens
MKGLTLGRS

SEQ ID NO: 846451 - protein, 9 aa, Homo Sapiens
YHQVTESKG

SEQ ID NO: 846452 - protein, 9 aa, Homo Sapiens
STDKEITSE

SEQ ID NO: 846453 - protein, 9 aa, Homo Sapiens
AGFLYLQGL

SEQ ID NO: 846454 - protein, 9 aa, Homo Sapiens
KLVDRPQEL

SEQ ID NO: 846455 - protein, 9 aa, Homo Sapiens
VKPSILNVF

SEQ ID NO: 846456 - protein, 9 aa, Homo Sapiens
KPQKAHKYL

SEQ ID NO: 846457 - protein, 9 aa, Homo Sapiens
LTNILKMPM

SEQ ID NO: 846458 - protein, 9 aa, Homo Sapiens
QITMDKTPS

SEQ ID NO: 846459 - protein, 9 aa, Homo Sapiens
GTPSKDTWP

SEQ ID NO: 846460 - protein, 9 aa, Homo Sapiens
VKFTAQEMY

SEQ ID NO: 846461 - protein, 9 aa, Homo Sapiens
NNSTKEFVR

SEQ ID NO: 846462 - protein, 9 aa, Homo Sapiens
AKIIGIKKA

SEQ ID NO: 846463 - protein, 9 aa, Homo Sapiens
VKEAEVLQA

SEQ ID NO: 846464 - protein, 9 aa, Homo Sapiens
SCCSLKKYS

SEQ ID NO: 846465 - protein, 9 aa, Homo Sapiens
HTPILRDLF

SEQ ID NO: 846466 - protein, 9 aa, Homo Sapiens
LDEAVLRCF

SEQ ID NO: 846467 - protein, 9 aa, Homo Sapiens
NYICSGTLV

SEQ ID NO: 846468 - protein, 9 aa, Homo Sapiens
ASKAGMVNK

SEQ ID NO: 846469 - protein, 9 aa, Homo Sapiens
AQLKQLILA

SEQ ID NO: 846470 - protein, 9 aa, Homo Sapiens
HYWDVDVTH

SEQ ID NO: 846471 - protein, 9 aa, Homo Sapiens
EKAKEPDTS

SEQ ID NO: 846472 - protein, 9 aa, Homo Sapiens
RYVAPLVML

SEQ ID NO: 846473 - protein, 9 aa, Homo Sapiens
KAELAWLQH

SEQ ID NO: 846474 - protein, 9 aa, Homo Sapiens
IADKIYNLC

SEQ ID NO: 846475 - protein, 9 aa, Homo Sapiens
STEGFSSDG

SEQ ID NO: 846476 - protein, 9 aa, Homo Sapiens
SSLLNHRRS

SEQ ID NO: 846477 - protein, 9 aa, Homo Sapiens
PFKDMDTFS

SEQ ID NO: 846478 - protein, 9 aa, Homo Sapiens
VHAENAEEY

SEQ ID NO: 846479 - protein, 9 aa, Homo Sapiens
LGKYVLVIQ

SEQ ID NO: 846480 - protein, 9 aa, Homo Sapiens
QERVPIDWD

SEQ ID NO: 846481 - protein, 9 aa, Homo Sapiens
DSGRPTFRV

SEQ ID NO: 846482 - protein, 9 aa, Homo Sapiens
NKCPFTVKN

SEQ ID NO: 846483 - protein, 9 aa, Homo Sapiens
SVIFSVEKF

SEQ ID NO: 846484 - protein, 9 aa, Homo Sapiens
SLLLPLAVL

SEQ ID NO: 846485 - protein, 9 aa, Homo Sapiens
IDESSSMVL

SEQ ID NO: 846486 - protein, 9 aa, Homo Sapiens
LHDPEGMGV

SEQ ID NO: 846487 - protein, 9 aa, Homo Sapiens
GKKDPNERG

SEQ ID NO: 846488 - protein, 9 aa, Homo Sapiens
SRVTVVGPP

SEQ ID NO: 846489 - protein, 9 aa, Homo Sapiens
PALVKVLLY

SEQ ID NO: 846490 - protein, 9 aa, Homo Sapiens
ADYRLPQVI

SEQ ID NO: 846491 - protein, 9 aa, Homo Sapiens
LTVEHDSLK

SEQ ID NO: 846492 - protein, 9 aa, Homo Sapiens
TPPRSVKAS

SEQ ID NO: 846493 - protein, 9 aa, Homo Sapiens
CLPPTSSCC

SEQ ID NO: 846494 - protein, 9 aa, Homo Sapiens
SSNISANQR

SEQ ID NO: 846495 - protein, 9 aa, Homo Sapiens
WINLDNNQI

SEQ ID NO: 846496 - protein, 9 aa, Homo Sapiens
ERCKELTPN

SEQ ID NO: 846497 - protein, 9 aa, Homo Sapiens
DCCVNLINN

SEQ ID NO: 846498 - protein, 9 aa, Homo Sapiens
EERYMTFNV

SEQ ID NO: 846499 - protein, 9 aa, Homo Sapiens
ARRPSNNCR

SEQ ID NO: 846500 - protein, 9 aa, Homo Sapiens
NLLLTTCGT

SEQ ID NO: 846501 - protein, 9 aa, Homo Sapiens
NNRNQDMSG

SEQ ID NO: 846502 - protein, 9 aa, Homo Sapiens
NQMDQNIEY

SEQ ID NO: 846503 - protein, 9 aa, Homo Sapiens
EACKLYSSQ

SEQ ID NO: 846504 - protein, 9 aa, Homo Sapiens
DRTLTSFGG

SEQ ID NO: 846505 - protein, 9 aa, Homo Sapiens
PGMEITNCS

SEQ ID NO: 846506 - protein, 9 aa, Homo Sapiens
LYYKIFSDK

SEQ ID NO: 846507 - protein, 9 aa, Homo Sapiens
KEKFTPEKI

SEQ ID NO: 846508 - protein, 9 aa, Homo Sapiens
LQKKDVLLR

SEQ ID NO: 846509 - protein, 9 aa, Homo Sapiens
QKHSTSNHQ

SEQ ID NO: 846510 - protein, 9 aa, Homo Sapiens
APSPPPLGA

SEQ ID NO: 846511 - protein, 9 aa, Homo Sapiens
REPLASHSE

SEQ ID NO: 846512 - protein, 9 aa, Homo Sapiens
WKYVATRVP

SEQ ID NO: 846513 - protein, 9 aa, Homo Sapiens
IVPPIMFEN

SEQ ID NO: 846514 - protein, 9 aa, Homo Sapiens
LLRDYKSPT

SEQ ID NO: 846515 - protein, 9 aa, Homo Sapiens
AKNIIVTGS

SEQ ID NO: 846516 - protein, 9 aa, Homo Sapiens
ATDNEKMTY

SEQ ID NO: 846517 - protein, 9 aa, Homo Sapiens
KHLGVKVKG

SEQ ID NO: 846518 - protein, 9 aa, Homo Sapiens
HFVGLQVLG

SEQ ID NO: 846519 - protein, 9 aa, Homo Sapiens
KNKRQYVTT

SEQ ID NO: 846520 - protein, 9 aa, Homo Sapiens
QSHERTGPD

SEQ ID NO: 846521 - protein, 9 aa, Homo Sapiens
GGGDSGGIA

SEQ ID NO: 846522 - protein, 9 aa, Homo Sapiens
MATHPAGQN

SEQ ID NO: 846523 - protein, 9 aa, Homo Sapiens
KKQGVSPQP

SEQ ID NO: 846524 - protein, 9 aa, Homo Sapiens
DTEAWTTGP

SEQ ID NO: 846525 - protein, 9 aa, Homo Sapiens
VKISSSWGN

SEQ ID NO: 846526 - protein, 9 aa, Homo Sapiens
IVEFIDAQC

SEQ ID NO: 846527 - protein, 9 aa, Homo Sapiens
TNRGVINEF

SEQ ID NO: 846528 - protein, 9 aa, Homo Sapiens
LKYGWKKEA

SEQ ID NO: 846529 - protein, 9 aa, Homo Sapiens
TAINFGTKS

SEQ ID NO: 846530 - protein, 9 aa, Homo Sapiens
PEKLDLRTV

SEQ ID NO: 846531 - protein, 9 aa, Homo Sapiens
ATQIITTRP

SEQ ID NO: 846532 - protein, 9 aa, Homo Sapiens
ERYQLLSEV

SEQ ID NO: 846533 - protein, 9 aa, Homo Sapiens
STTWKVISS

SEQ ID NO: 846534 - protein, 9 aa, Homo Sapiens
KYINTIEDA

SEQ ID NO: 846535 - protein, 9 aa, Homo Sapiens
AIQGGVEDE

SEQ ID NO: 846536 - protein, 9 aa, Homo Sapiens
LTFTCYYVL

SEQ ID NO: 846537 - protein, 9 aa, Homo Sapiens
LSLLGGEPR

SEQ ID NO: 846538 - protein, 9 aa, Homo Sapiens
LSMNNNIIN

SEQ ID NO: 846539 - protein, 9 aa, Homo Sapiens
AMHLLTHGL

SEQ ID NO: 846540 - protein, 9 aa, Homo Sapiens
ESETDPGAK

SEQ ID NO: 846541 - protein, 9 aa, Homo Sapiens
ATSTFNLFE

SEQ ID NO: 846542 - protein, 9 aa, Homo Sapiens
RRILFMKES

SEQ ID NO: 846543 - protein, 9 aa, Homo Sapiens
LEITDNPFM

SEQ ID NO: 846544 - protein, 9 aa, Homo Sapiens
PMLDLDDND

SEQ ID NO: 846545 - protein, 9 aa, Homo Sapiens
NDFLEADAY

SEQ ID NO: 846546 - protein, 9 aa, Homo Sapiens
EDNQKRYYL

SEQ ID NO: 846547 - protein, 9 aa, Homo Sapiens
TYRGPDTNP

SEQ ID NO: 846548 - protein, 9 aa, Homo Sapiens
PQEPNYATS

SEQ ID NO: 846549 - protein, 9 aa, Homo Sapiens
SNAAVPEAI

SEQ ID NO: 846550 - protein, 9 aa, Homo Sapiens
EHASRPTPA

SEQ ID NO: 846551 - protein, 9 aa, Homo Sapiens
YTFPDHTLS

SEQ ID NO: 846552 - protein, 9 aa, Homo Sapiens
DGDFPDTTQ

SEQ ID NO: 846553 - protein, 9 aa, Homo Sapiens
KRHFVAHKY

SEQ ID NO: 846554 - protein, 9 aa, Homo Sapiens
CHDLIKAAL

SEQ ID NO: 846555 - protein, 9 aa, Homo Sapiens
ITDLYPNSK

SEQ ID NO: 846556 - protein, 9 aa, Homo Sapiens
EKSKLNILE

SEQ ID NO: 846557 - protein, 9 aa, Homo Sapiens
SITASLQFD

SEQ ID NO: 846558 - protein, 9 aa, Homo Sapiens
GDPNKKLIC

SEQ ID NO: 846559 - protein, 9 aa, Homo Sapiens
AAAAHSAPP

SEQ ID NO: 846560 - protein, 9 aa, Homo Sapiens
AQYLHQFML

SEQ ID NO: 846561 - protein, 9 aa, Homo Sapiens
KAFISFTNV

SEQ ID NO: 846562 - protein, 9 aa, Homo Sapiens
PFQNPNFPR

SEQ ID NO: 846563 - protein, 9 aa, Homo Sapiens
TQLPVRTFK

SEQ ID NO: 846564 - protein, 9 aa, Homo Sapiens
TYVKIINYI

SEQ ID NO: 846565 - protein, 9 aa, Homo Sapiens
QIHLRLHTG

SEQ ID NO: 846566 - protein, 9 aa, Homo Sapiens
EASSRIRRK

SEQ ID NO: 846567 - protein, 9 aa, Homo Sapiens
EGHSEAVMS

SEQ ID NO: 846568 - protein, 9 aa, Homo Sapiens
MDNNLNAIQ

SEQ ID NO: 846569 - protein, 9 aa, Homo Sapiens
DVPTCRDSC

SEQ ID NO: 846570 - protein, 9 aa, Homo Sapiens
LRLHSGENP

SEQ ID NO: 846571 - protein, 9 aa, Homo Sapiens
VQDILHFEM

SEQ ID NO: 846572 - protein, 9 aa, Homo Sapiens
CPAIIQAFK

SEQ ID NO: 846573 - protein, 9 aa, Homo Sapiens
DYTQTLSNK

SEQ ID NO: 846574 - protein, 9 aa, Homo Sapiens
IRQFIPIKV

SEQ ID NO: 846575 - protein, 9 aa, Homo Sapiens
IQKRGVSKL

SEQ ID NO: 846576 - protein, 9 aa, Homo Sapiens
FRQAQRQDN

SEQ ID NO: 846577 - protein, 9 aa, Homo Sapiens
LVYICFQNG

SEQ ID NO: 846578 - protein, 9 aa, Homo Sapiens
LHSSCYQPF

SEQ ID NO: 846579 - protein, 9 aa, Homo Sapiens
DEEATPHKL

SEQ ID NO: 846580 - protein, 9 aa, Homo Sapiens
FIAFILLII

SEQ ID NO: 846581 - protein, 9 aa, Homo Sapiens
VPAQEGGPC

SEQ ID NO: 846582 - protein, 9 aa, Homo Sapiens
PTTTNNNYS

SEQ ID NO: 846583 - protein, 9 aa, Homo Sapiens
SFSNLVHLV

SEQ ID NO: 846584 - protein, 9 aa, Homo Sapiens
GVKGNYLRT

SEQ ID NO: 846585 - protein, 9 aa, Homo Sapiens
IAICTPLRY

SEQ ID NO: 846586 - protein, 9 aa, Homo Sapiens
QDKQGTSRG

SEQ ID NO: 846587 - protein, 9 aa, Homo Sapiens
EKSCSVLRE

SEQ ID NO: 846588 - protein, 9 aa, Homo Sapiens
KPTTTKQTT

SEQ ID NO: 846589 - protein, 9 aa, Homo Sapiens
NDIFLPVKH

SEQ ID NO: 846590 - protein, 9 aa, Homo Sapiens
NEKNVSIED

SEQ ID NO: 846591 - protein, 9 aa, Homo Sapiens
DALFCPRMS

SEQ ID NO: 846592 - protein, 9 aa, Homo Sapiens
EELQNLSLS

SEQ ID NO: 846593 - protein, 9 aa, Homo Sapiens
GVLEPGQPD

SEQ ID NO: 846594 - protein, 9 aa, Homo Sapiens
SEKAILQAW

SEQ ID NO: 846595 - protein, 9 aa, Homo Sapiens
LLTHGLRHK

SEQ ID NO: 846596 - protein, 9 aa, Homo Sapiens
KNNKDYHSL

SEQ ID NO: 846597 - protein, 9 aa, Homo Sapiens
DTPSLRRVH

SEQ ID NO: 846598 - protein, 9 aa, Homo Sapiens
RHPKFIQLY

SEQ ID NO: 846599 - protein, 9 aa, Homo Sapiens
ALQCEEIAT

SEQ ID NO: 846600 - protein, 9 aa, Homo Sapiens
GRVITCFDS

SEQ ID NO: 846601 - protein, 9 aa, Homo Sapiens
DATVEVSPP

SEQ ID NO: 846602 - protein, 9 aa, Homo Sapiens
DSSWAIGEE

SEQ ID NO: 846603 - protein, 9 aa, Homo Sapiens
DTHKSIWKA

SEQ ID NO: 846604 - protein, 9 aa, Homo Sapiens
TKAFFFQDT

SEQ ID NO: 846605 - protein, 9 aa, Homo Sapiens
VIYFARARI

SEQ ID NO: 846606 - protein, 9 aa, Homo Sapiens
TFDECQQNL

SEQ ID NO: 846607 - protein, 9 aa, Homo Sapiens
SYVGSFSSL

SEQ ID NO: 846608 - protein, 9 aa, Homo Sapiens
CIPYGAGRT

SEQ ID NO: 846609 - protein, 9 aa, Homo Sapiens
TTFSTSGIG

SEQ ID NO: 846610 - protein, 9 aa, Homo Sapiens
SGMTKNIYG

SEQ ID NO: 846611 - protein, 9 aa, Homo Sapiens
EFDCRYKTI

SEQ ID NO: 846612 - protein, 9 aa, Homo Sapiens
DLSEADLQA

SEQ ID NO: 846613 - protein, 9 aa, Homo Sapiens
ERRLKQNLA

SEQ ID NO: 846614 - protein, 9 aa, Homo Sapiens
DDVETNWIV

SEQ ID NO: 846615 - protein, 9 aa, Homo Sapiens
TSGNLERDA

SEQ ID NO: 846616 - protein, 9 aa, Homo Sapiens
PELQIALMA

SEQ ID NO: 846617 - protein, 9 aa, Homo Sapiens
PKRQPHLPW

SEQ ID NO: 846618 - protein, 9 aa, Homo Sapiens
QKMCDQWDR

SEQ ID NO: 846619 - protein, 9 aa, Homo Sapiens
NIIWTLPYV

SEQ ID NO: 846620 - protein, 9 aa, Homo Sapiens
IDKVCFVVF

SEQ ID NO: 846621 - protein, 9 aa, Homo Sapiens
GLGFNSMGG

SEQ ID NO: 846622 - protein, 9 aa, Homo Sapiens
EPLLKITDK

SEQ ID NO: 846623 - protein, 9 aa, Homo Sapiens
ERDGVQFSW

SEQ ID NO: 846624 - protein, 9 aa, Homo Sapiens
SMHNHIEKL

SEQ ID NO: 846625 - protein, 9 aa, Homo Sapiens
YFCVDFSSP

SEQ ID NO: 846626 - protein, 9 aa, Homo Sapiens
VFLFACSLD

SEQ ID NO: 846627 - protein, 9 aa, Homo Sapiens
EFNNTGSGL

SEQ ID NO: 846628 - protein, 9 aa, Homo Sapiens
VPPTLNHVI

SEQ ID NO: 846629 - protein, 9 aa, Homo Sapiens
ILSICSLLC

SEQ ID NO: 846630 - protein, 9 aa, Homo Sapiens
QGAISKMDP

SEQ ID NO: 846631 - protein, 9 aa, Homo Sapiens
VSGYRNEFL

SEQ ID NO: 846632 - protein, 9 aa, Homo Sapiens
MLINNAGSL

SEQ ID NO: 846633 - protein, 9 aa, Homo Sapiens
FDFSLFKHR

SEQ ID NO: 846634 - protein, 9 aa, Homo Sapiens
ADCFKKTFD

SEQ ID NO: 846635 - protein, 9 aa, Homo Sapiens
MAVEITEQL

SEQ ID NO: 846636 - protein, 9 aa, Homo Sapiens
ECILLGFSD

SEQ ID NO: 846637 - protein, 9 aa, Homo Sapiens
TQEQVDTGL

SEQ ID NO: 846638 - protein, 9 aa, Homo Sapiens
WRRDVQWVY

SEQ ID NO: 846639 - protein, 9 aa, Homo Sapiens
KVTSSKCFL

SEQ ID NO: 846640 - protein, 9 aa, Homo Sapiens
SNLTFSLFG

SEQ ID NO: 846641 - protein, 9 aa, Homo Sapiens
PLAPQVKNK

SEQ ID NO: 846642 - protein, 9 aa, Homo Sapiens
TVLGKSNIQ

SEQ ID NO: 846643 - protein, 9 aa, Homo Sapiens
MACEMLLQF

SEQ ID NO: 846644 - protein, 9 aa, Homo Sapiens
DSLTFNLDI

SEQ ID NO: 846645 - protein, 9 aa, Homo Sapiens
ETAVREIKY

SEQ ID NO: 846646 - protein, 9 aa, Homo Sapiens
NNLLLQHNI

SEQ ID NO: 846647 - protein, 9 aa, Homo Sapiens
NDERAAQRG

SEQ ID NO: 846648 - protein, 9 aa, Homo Sapiens
GSPNQARAQ

SEQ ID NO: 846649 - protein, 9 aa, Homo Sapiens
IINELNRLR

SEQ ID NO: 846650 - protein, 9 aa, Homo Sapiens
EGKTNALLK

SEQ ID NO: 846651 - protein, 9 aa, Homo Sapiens
PIYLSKKCL

SEQ ID NO: 846652 - protein, 9 aa, Homo Sapiens
TTVEITFTT

SEQ ID NO: 846653 - protein, 9 aa, Homo Sapiens
LWRLHELAE

SEQ ID NO: 846654 - protein, 9 aa, Homo Sapiens
SIKGHLCQL

SEQ ID NO: 846655 - protein, 9 aa, Homo Sapiens
KVMFVAGMF

SEQ ID NO: 846656 - protein, 9 aa, Homo Sapiens
WTDTGINPQ

SEQ ID NO: 846657 - protein, 9 aa, Homo Sapiens
KDPAGPCFQ

SEQ ID NO: 846658 - protein, 9 aa, Homo Sapiens
DKAHVKCKA

SEQ ID NO: 846659 - protein, 9 aa, Homo Sapiens
AQMQSPTTT

SEQ ID NO: 846660 - protein, 9 aa, Homo Sapiens
AQTLHRASP

SEQ ID NO: 846661 - protein, 9 aa, Homo Sapiens
IDIIQTLVL

SEQ ID NO: 846662 - protein, 9 aa, Homo Sapiens
ASPFSITSN

SEQ ID NO: 846663 - protein, 9 aa, Homo Sapiens
TCRDSCDKV

SEQ ID NO: 846664 - protein, 9 aa, Homo Sapiens
TCAPPPPIH

SEQ ID NO: 846665 - protein, 9 aa, Homo Sapiens
REVAGTLMT

SEQ ID NO: 846666 - protein, 9 aa, Homo Sapiens
PLHTSIPQQ

SEQ ID NO: 846667 - protein, 9 aa, Homo Sapiens
SHQCHHKQK

SEQ ID NO: 846668 - protein, 9 aa, Homo Sapiens
SAPTRAGAL

SEQ ID NO: 846669 - protein, 9 aa, Homo Sapiens
PCGYLMNGM

SEQ ID NO: 846670 - protein, 9 aa, Homo Sapiens
MVSGFSSPR

SEQ ID NO: 846671 - protein, 9 aa, Homo Sapiens
PAIKEDAGR

SEQ ID NO: 846672 - protein, 9 aa, Homo Sapiens
EYDYETRIT

SEQ ID NO: 846673 - protein, 9 aa, Homo Sapiens
HMVQNGYYE

SEQ ID NO: 846674 - protein, 9 aa, Homo Sapiens
GGVRPAPSL

SEQ ID NO: 846675 - protein, 9 aa, Homo Sapiens
EQGAKKHVM

SEQ ID NO: 846676 - protein, 9 aa, Homo Sapiens
FESKHPTCP

SEQ ID NO: 846677 - protein, 9 aa, Homo Sapiens
PICGEIENI

SEQ ID NO: 846678 - protein, 9 aa, Homo Sapiens
DQYSRILFT

SEQ ID NO: 846679 - protein, 9 aa, Homo Sapiens
IQHIVIDKA

SEQ ID NO: 846680 - protein, 9 aa, Homo Sapiens
PALISTVEG

SEQ ID NO: 846681 - protein, 9 aa, Homo Sapiens
CEMLLQFNA

SEQ ID NO: 846682 - protein, 9 aa, Homo Sapiens
AQSRGELMH

SEQ ID NO: 846683 - protein, 9 aa, Homo Sapiens
ALNDVFHHQ

SEQ ID NO: 846684 - protein, 9 aa, Homo Sapiens
FKSNNLKSG

SEQ ID NO: 846685 - protein, 9 aa, Homo Sapiens
VVVVVIVGL

SEQ ID NO: 846686 - protein, 9 aa, Homo Sapiens
TSYINELQT

SEQ ID NO: 846687 - protein, 9 aa, Homo Sapiens
TDCATIRKC

SEQ ID NO: 846688 - protein, 9 aa, Homo Sapiens
HFPHPNVFT

SEQ ID NO: 846689 - protein, 9 aa, Homo Sapiens
PKSKLFELI

SEQ ID NO: 846690 - protein, 9 aa, Homo Sapiens
TEINYTVDK

SEQ ID NO: 846691 - protein, 9 aa, Homo Sapiens
SRRRNAPLA

SEQ ID NO: 846692 - protein, 9 aa, Homo Sapiens
ILTNHKIIH

SEQ ID NO: 846693 - protein, 9 aa, Homo Sapiens
AWGPGDSAR

SEQ ID NO: 846694 - protein, 9 aa, Homo Sapiens
QEPPNFVVK

SEQ ID NO: 846695 - protein, 9 aa, Homo Sapiens
SSCLTIFLD

SEQ ID NO: 846696 - protein, 9 aa, Homo Sapiens
TSTVHCMHL

SEQ ID NO: 846697 - protein, 9 aa, Homo Sapiens
CENPETDSH

SEQ ID NO: 846698 - protein, 9 aa, Homo Sapiens
RFPLVNFCV

SEQ ID NO: 846699 - protein, 9 aa, Homo Sapiens
KTSNIVNIK

SEQ ID NO: 846700 - protein, 9 aa, Homo Sapiens
EDLPVHGDI

SEQ ID NO: 846701 - protein, 9 aa, Homo Sapiens
CKDIEHLES

SEQ ID NO: 846702 - protein, 9 aa, Homo Sapiens
AHAGHITKM

SEQ ID NO: 846703 - protein, 9 aa, Homo Sapiens
FHINLDGYL

SEQ ID NO: 846704 - protein, 9 aa, Homo Sapiens
NLKKEKPVA

SEQ ID NO: 846705 - protein, 9 aa, Homo Sapiens
LPEHEMNRA

SEQ ID NO: 846706 - protein, 9 aa, Homo Sapiens
WFISCLLGS

SEQ ID NO: 846707 - protein, 9 aa, Homo Sapiens
NYSLVPYIM

SEQ ID NO: 846708 - protein, 9 aa, Homo Sapiens
CQKPLPRCA

SEQ ID NO: 846709 - protein, 9 aa, Homo Sapiens
YTTLSLLHR

SEQ ID NO: 846710 - protein, 9 aa, Homo Sapiens
FECGGPEVL

SEQ ID NO: 846711 - protein, 9 aa, Homo Sapiens
IWNMEESYV

SEQ ID NO: 846712 - protein, 9 aa, Homo Sapiens
TYIGPCGGR

SEQ ID NO: 846713 - protein, 9 aa, Homo Sapiens
SENVQNNTR

SEQ ID NO: 846714 - protein, 9 aa, Homo Sapiens
YYNFWCGIT

SEQ ID NO: 846715 - protein, 9 aa, Homo Sapiens
TALRFTMLR

SEQ ID NO: 846716 - protein, 9 aa, Homo Sapiens
AKENLIMQE

SEQ ID NO: 846717 - protein, 9 aa, Homo Sapiens
ECGKTFIFK

SEQ ID NO: 846718 - protein, 9 aa, Homo Sapiens
TLLHQATQA

SEQ ID NO: 846719 - protein, 9 aa, Homo Sapiens
GYGMMSKSD

SEQ ID NO: 846720 - protein, 9 aa, Homo Sapiens
LQMKRPGED

SEQ ID NO: 846721 - protein, 9 aa, Homo Sapiens
YKRWLDSES

SEQ ID NO: 846722 - protein, 9 aa, Homo Sapiens
NNNARNDFL

SEQ ID NO: 846723 - protein, 9 aa, Homo Sapiens
FNDELDKLT

SEQ ID NO: 846724 - protein, 9 aa, Homo Sapiens
TSDTAGKNA

SEQ ID NO: 846725 - protein, 9 aa, Homo Sapiens
IDSIDHVQQ

SEQ ID NO: 846726 - protein, 9 aa, Homo Sapiens
TSAVNNTKP

SEQ ID NO: 846727 - protein, 9 aa, Homo Sapiens
KQRRLIEEQ

SEQ ID NO: 846728 - protein, 9 aa, Homo Sapiens
IMGSMVPPP

SEQ ID NO: 846729 - protein, 9 aa, Homo Sapiens
LILVLISIC

SEQ ID NO: 846730 - protein, 9 aa, Homo Sapiens
YHSPSMPEN

SEQ ID NO: 846731 - protein, 9 aa, Homo Sapiens
VPPPPMEPN

SEQ ID NO: 846732 - protein, 9 aa, Homo Sapiens
KHYRSIINI

SEQ ID NO: 846733 - protein, 9 aa, Homo Sapiens
SDVNKLTPS

SEQ ID NO: 846734 - protein, 9 aa, Homo Sapiens
DHPHCLPYK

SEQ ID NO: 846735 - protein, 9 aa, Homo Sapiens
AGNDTLQDV

SEQ ID NO: 846736 - protein, 9 aa, Homo Sapiens
QNALGVLSS

SEQ ID NO: 846737 - protein, 9 aa, Homo Sapiens
CWITFLNQS

SEQ ID NO: 846738 - protein, 9 aa, Homo Sapiens
KWHSSLAKR

SEQ ID NO: 846739 - protein, 9 aa, Homo Sapiens
LSIHRGVHT

SEQ ID NO: 846740 - protein, 9 aa, Homo Sapiens
GNDGVKVCT

SEQ ID NO: 846741 - protein, 9 aa, Homo Sapiens
DISQIFYGK

SEQ ID NO: 846742 - protein, 9 aa, Homo Sapiens
NMNLLSDAC

SEQ ID NO: 846743 - protein, 9 aa, Homo Sapiens
DSEHVYDLF

SEQ ID NO: 846744 - protein, 9 aa, Homo Sapiens
DVCSCKAES

SEQ ID NO: 846745 - protein, 9 aa, Homo Sapiens
GMLNNPINA

SEQ ID NO: 846746 - protein, 9 aa, Homo Sapiens
QIDEKNKSN

SEQ ID NO: 846747 - protein, 9 aa, Homo Sapiens
ATLLLQIEK

SEQ ID NO: 846748 - protein, 9 aa, Homo Sapiens
IGAGKGKYD

SEQ ID NO: 846749 - protein, 9 aa, Homo Sapiens
AELSLEEQR

SEQ ID NO: 846750 - protein, 9 aa, Homo Sapiens
KANDLFENG

SEQ ID NO: 846751 - protein, 9 aa, Homo Sapiens
IIAGYGVEG

SEQ ID NO: 846752 - protein, 9 aa, Homo Sapiens
GTGPTQGDM

SEQ ID NO: 846753 - protein, 9 aa, Homo Sapiens
GVDLKTVDS

SEQ ID NO: 846754 - protein, 9 aa, Homo Sapiens
LTSNRSVCD

SEQ ID NO: 846755 - protein, 9 aa, Homo Sapiens
KYFNFIGYF

SEQ ID NO: 846756 - protein, 9 aa, Homo Sapiens
LKLSTDLDR

SEQ ID NO: 846757 - protein, 9 aa, Homo Sapiens
VNSIKRSRT

SEQ ID NO: 846758 - protein, 9 aa, Homo Sapiens
VIVNSVPMI

SEQ ID NO: 846759 - protein, 9 aa, Homo Sapiens
PYILEALMV

SEQ ID NO: 846760 - protein, 9 aa, Homo Sapiens
SRTIFRKSR

SEQ ID NO: 846761 - protein, 9 aa, Homo Sapiens
NYYVGSNYR

SEQ ID NO: 846762 - protein, 9 aa, Homo Sapiens
KRYEDEINK

SEQ ID NO: 846763 - protein, 9 aa, Homo Sapiens
DTDEKCTLC

SEQ ID NO: 846764 - protein, 9 aa, Homo Sapiens
FYAAEIILA

SEQ ID NO: 846765 - protein, 9 aa, Homo Sapiens
YHVRISTST

SEQ ID NO: 846766 - protein, 9 aa, Homo Sapiens
MSVQENINM

SEQ ID NO: 846767 - protein, 9 aa, Homo Sapiens
KEKTPDENK

SEQ ID NO: 846768 - protein, 9 aa, Homo Sapiens
DGKDSTITR

SEQ ID NO: 846769 - protein, 9 aa, Homo Sapiens
NTNSKDEQI

SEQ ID NO: 846770 - protein, 9 aa, Homo Sapiens
SFVNFQMWD

SEQ ID NO: 846771 - protein, 9 aa, Homo Sapiens
NQMLSDLNC

SEQ ID NO: 846772 - protein, 9 aa, Homo Sapiens
AEKRKNNAP

SEQ ID NO: 846773 - protein, 9 aa, Homo Sapiens
SLPYEQTII

SEQ ID NO: 846774 - protein, 9 aa, Homo Sapiens
ILVAVGLSV

SEQ ID NO: 846775 - protein, 9 aa, Homo Sapiens
ESCSWSFFC

SEQ ID NO: 846776 - protein, 9 aa, Homo Sapiens
YFSEIKSQQ

SEQ ID NO: 846777 - protein, 9 aa, Homo Sapiens
LASDVVRIF

SEQ ID NO: 846778 - protein, 9 aa, Homo Sapiens
RLDLTVEHD

SEQ ID NO: 846779 - protein, 9 aa, Homo Sapiens
CHQPPSHSG

SEQ ID NO: 846780 - protein, 9 aa, Homo Sapiens
QKSSPKSTG

SEQ ID NO: 846781 - protein, 9 aa, Homo Sapiens
DKHPEYGDT

SEQ ID NO: 846782 - protein, 9 aa, Homo Sapiens
AFPVFLGTE

SEQ ID NO: 846783 - protein, 9 aa, Homo Sapiens
CLEYWNPDN

SEQ ID NO: 846784 - protein, 9 aa, Homo Sapiens
QLILAHKDC

SEQ ID NO: 846785 - protein, 9 aa, Homo Sapiens
DKTLEDRLF

SEQ ID NO: 846786 - protein, 9 aa, Homo Sapiens
VANKKFWRA

SEQ ID NO: 846787 - protein, 9 aa, Homo Sapiens
SLQLTWSDN

SEQ ID NO: 846788 - protein, 9 aa, Homo Sapiens
VPFSTFRRC

SEQ ID NO: 846789 - protein, 9 aa, Homo Sapiens
NVACSNVSQ

SEQ ID NO: 846790 - protein, 9 aa, Homo Sapiens
QSVRLDDNF

SEQ ID NO: 846791 - protein, 9 aa, Homo Sapiens
DPSHQKKLV

SEQ ID NO: 846792 - protein, 9 aa, Homo Sapiens
QSTSQQPKL

SEQ ID NO: 846793 - protein, 9 aa, Homo Sapiens
KWKKIKTAT

SEQ ID NO: 846794 - protein, 9 aa, Homo Sapiens
YTVGMKPLS

SEQ ID NO: 846795 - protein, 9 aa, Homo Sapiens
EQGKDINLN

SEQ ID NO: 846796 - protein, 9 aa, Homo Sapiens
PSTDFDTIH

SEQ ID NO: 846797 - protein, 9 aa, Homo Sapiens
LPPSTSSQE

SEQ ID NO: 846798 - protein, 9 aa, Homo Sapiens
TPIIQPKTC

SEQ ID NO: 846799 - protein, 9 aa, Homo Sapiens
HGNAPVETE

SEQ ID NO: 846800 - protein, 9 aa, Homo Sapiens
VTTAAHIAL

SEQ ID NO: 846801 - protein, 9 aa, Homo Sapiens
NRNKKCIAV

SEQ ID NO: 846802 - protein, 9 aa, Homo Sapiens
SHLTKHKII

SEQ ID NO: 846803 - protein, 9 aa, Homo Sapiens
APIKPDPPV

SEQ ID NO: 846804 - protein, 9 aa, Homo Sapiens
ERFTYEDTN

SEQ ID NO: 846805 - protein, 9 aa, Homo Sapiens
PQKAKIIVL

SEQ ID NO: 846806 - protein, 9 aa, Homo Sapiens
MTEDYAGIY

SEQ ID NO: 846807 - protein, 9 aa, Homo Sapiens
GLLTLRSLS

SEQ ID NO: 846808 - protein, 9 aa, Homo Sapiens
DNIAVGLAT

SEQ ID NO: 846809 - protein, 9 aa, Homo Sapiens
PQSDQQDSA

SEQ ID NO: 846810 - protein, 9 aa, Homo Sapiens
YLKKGAAAL

SEQ ID NO: 846811 - protein, 9 aa, Homo Sapiens
IIAPFMLFR

SEQ ID NO: 846812 - protein, 9 aa, Homo Sapiens
SVMAYQLGE

SEQ ID NO: 846813 - protein, 9 aa, Homo Sapiens
LTEHKRLHT

SEQ ID NO: 846814 - protein, 9 aa, Homo Sapiens
KLIRQQIYY

SEQ ID NO: 846815 - protein, 9 aa, Homo Sapiens
QAAQLSRTS

SEQ ID NO: 846816 - protein, 9 aa, Homo Sapiens
RSRASIKHK

SEQ ID NO: 846817 - protein, 9 aa, Homo Sapiens
QNMDRLQGE

SEQ ID NO: 846818 - protein, 9 aa, Homo Sapiens
PALRGLDRT

SEQ ID NO: 846819 - protein, 9 aa, Homo Sapiens
KHLQSSQFG

SEQ ID NO: 846820 - protein, 9 aa, Homo Sapiens
TASGRNPVM

SEQ ID NO: 846821 - protein, 9 aa, Homo Sapiens
QEGRVFQGK

SEQ ID NO: 846822 - protein, 9 aa, Homo Sapiens
IFYGTLTFM

SEQ ID NO: 846823 - protein, 9 aa, Homo Sapiens
EFMETKSTQ

SEQ ID NO: 846824 - protein, 9 aa, Homo Sapiens
RQVRLWRDS

SEQ ID NO: 846825 - protein, 9 aa, Homo Sapiens
GRGCPPQKL

SEQ ID NO: 846826 - protein, 9 aa, Homo Sapiens
TQIYLKRPR

SEQ ID NO: 846827 - protein, 9 aa, Homo Sapiens
ISCLLGSPT

SEQ ID NO: 846828 - protein, 9 aa, Homo Sapiens
LPGPKGNDG

SEQ ID NO: 846829 - protein, 9 aa, Homo Sapiens
ETKCFTCGI

SEQ ID NO: 846830 - protein, 9 aa, Homo Sapiens
YKVVVDRKH

SEQ ID NO: 846831 - protein, 9 aa, Homo Sapiens
LSQFQSNRM

SEQ ID NO: 846832 - protein, 9 aa, Homo Sapiens
KAPNNRYSH

SEQ ID NO: 846833 - protein, 9 aa, Homo Sapiens
AIYRPMGFG

SEQ ID NO: 846834 - protein, 9 aa, Homo Sapiens
LQTLELEKE

SEQ ID NO: 846835 - protein, 9 aa, Homo Sapiens
KCPDNGWDE

SEQ ID NO: 846836 - protein, 9 aa, Homo Sapiens
NYLTHMVVV

SEQ ID NO: 846837 - protein, 9 aa, Homo Sapiens
CPRKFPAIQ

SEQ ID NO: 846838 - protein, 9 aa, Homo Sapiens
VGVKAGRGT

SEQ ID NO: 846839 - protein, 9 aa, Homo Sapiens
LFIKRTRLP

SEQ ID NO: 846840 - protein, 9 aa, Homo Sapiens
KLQHGVIAA

SEQ ID NO: 846841 - protein, 9 aa, Homo Sapiens
IWRRDVQWV

SEQ ID NO: 846842 - protein, 9 aa, Homo Sapiens
CAGNTTVLY

SEQ ID NO: 846843 - protein, 9 aa, Homo Sapiens
ELKTMRKVM

SEQ ID NO: 846844 - protein, 9 aa, Homo Sapiens
RATVSTEQE

SEQ ID NO: 846845 - protein, 9 aa, Homo Sapiens
TPGCSVSIK

SEQ ID NO: 846846 - protein, 9 aa, Homo Sapiens
VHYYFSALP

SEQ ID NO: 846847 - protein, 9 aa, Homo Sapiens
KLSPTYPVY

SEQ ID NO: 846848 - protein, 9 aa, Homo Sapiens
VKAMDITGA

SEQ ID NO: 846849 - protein, 9 aa, Homo Sapiens
KITLRNLNG

SEQ ID NO: 846850 - protein, 9 aa, Homo Sapiens
HTGEQPFEC

SEQ ID NO: 846851 - protein, 9 aa, Homo Sapiens
IFPGLVGIT

SEQ ID NO: 846852 - protein, 9 aa, Homo Sapiens
GKTQKAMLD

SEQ ID NO: 846853 - protein, 9 aa, Homo Sapiens
AEKSHRDKL

SEQ ID NO: 846854 - protein, 9 aa, Homo Sapiens
PGDTQDFDQ

SEQ ID NO: 846855 - protein, 9 aa, Homo Sapiens
YRCEGECPD

SEQ ID NO: 846856 - protein, 9 aa, Homo Sapiens
ALLYEEPFP

SEQ ID NO: 846857 - protein, 9 aa, Homo Sapiens
MNVRSAFTT

SEQ ID NO: 846858 - protein, 9 aa, Homo Sapiens
EQEKHNHQS

SEQ ID NO: 846859 - protein, 9 aa, Homo Sapiens
STSQQPKLK

SEQ ID NO: 846860 - protein, 9 aa, Homo Sapiens
ENPTNNENT

SEQ ID NO: 846861 - protein, 9 aa, Homo Sapiens
FSFQISTDN

SEQ ID NO: 846862 - protein, 9 aa, Homo Sapiens
EMWRQTHMD

SEQ ID NO: 846863 - protein, 9 aa, Homo Sapiens
NLQRQATKD

SEQ ID NO: 846864 - protein, 9 aa, Homo Sapiens
KETLQIRRL

SEQ ID NO: 846865 - protein, 9 aa, Homo Sapiens
EQHNQQGSM

SEQ ID NO: 846866 - protein, 9 aa, Homo Sapiens
KFCNREREF

SEQ ID NO: 846867 - protein, 9 aa, Homo Sapiens
PVKTVPLVN

SEQ ID NO: 846868 - protein, 9 aa, Homo Sapiens
TRKLCGLDN

SEQ ID NO: 846869 - protein, 9 aa, Homo Sapiens
SPQQTEYCN

SEQ ID NO: 846870 - protein, 9 aa, Homo Sapiens
ENDMFVEHR

SEQ ID NO: 846871 - protein, 9 aa, Homo Sapiens
GVNNVLLSL

SEQ ID NO: 846872 - protein, 9 aa, Homo Sapiens
AYTILQKSQ

SEQ ID NO: 846873 - protein, 9 aa, Homo Sapiens
RLLCLIPTG

SEQ ID NO: 846874 - protein, 9 aa, Homo Sapiens
VEFHPDTGN

SEQ ID NO: 846875 - protein, 9 aa, Homo Sapiens
RTEYSEDNL

SEQ ID NO: 846876 - protein, 9 aa, Homo Sapiens
KPSDCPHSS

SEQ ID NO: 846877 - protein, 9 aa, Homo Sapiens
VAIQIIDKS

SEQ ID NO: 846878 - protein, 9 aa, Homo Sapiens
AATNASNTE

SEQ ID NO: 846879 - protein, 9 aa, Homo Sapiens
VPLQIILEK

SEQ ID NO: 846880 - protein, 9 aa, Homo Sapiens
MSSPDLLPE

SEQ ID NO: 846881 - protein, 9 aa, Homo Sapiens
RQDHPASKL

SEQ ID NO: 846882 - protein, 9 aa, Homo Sapiens
PAIANLKAS

SEQ ID NO: 846883 - protein, 9 aa, Homo Sapiens
VYLIMNSIK

SEQ ID NO: 846884 - protein, 9 aa, Homo Sapiens
NNWQRIQEH

SEQ ID NO: 846885 - protein, 9 aa, Homo Sapiens
LTKVSYLIE

SEQ ID NO: 846886 - protein, 9 aa, Homo Sapiens
CTQHSLTWG

SEQ ID NO: 846887 - protein, 9 aa, Homo Sapiens
NKECVANHM

SEQ ID NO: 846888 - protein, 9 aa, Homo Sapiens
PQDIHKEMM

SEQ ID NO: 846889 - protein, 9 aa, Homo Sapiens
FNSMGGKEQ

SEQ ID NO: 846890 - protein, 9 aa, Homo Sapiens
TQTTSWLQD

SEQ ID NO: 846891 - protein, 9 aa, Homo Sapiens
VRTRPGLQT

SEQ ID NO: 846892 - protein, 9 aa, Homo Sapiens
RDKLTKPEL

SEQ ID NO: 846893 - protein, 9 aa, Homo Sapiens
YPHNPWLQE

SEQ ID NO: 846894 - protein, 9 aa, Homo Sapiens
WENFHFMLR

SEQ ID NO: 846895 - protein, 9 aa, Homo Sapiens
ESVQTPGTY

SEQ ID NO: 846896 - protein, 9 aa, Homo Sapiens
IGRLQSLTF

SEQ ID NO: 846897 - protein, 9 aa, Homo Sapiens
RVFSNKVLE

SEQ ID NO: 846898 - protein, 9 aa, Homo Sapiens
KDQCLKSWH

SEQ ID NO: 846899 - protein, 9 aa, Homo Sapiens
LRQNHSLDS

SEQ ID NO: 846900 - protein, 9 aa, Homo Sapiens
KVESEEHDQ

SEQ ID NO: 846901 - protein, 9 aa, Homo Sapiens
EQREYGNLE

SEQ ID NO: 846902 - protein, 9 aa, Homo Sapiens
VDFRTFLSS

SEQ ID NO: 846903 - protein, 9 aa, Homo Sapiens
GTSYERYNC

SEQ ID NO: 846904 - protein, 9 aa, Homo Sapiens
FVALQTSIN

SEQ ID NO: 846905 - protein, 9 aa, Homo Sapiens
VMYLGFKRG

SEQ ID NO: 846906 - protein, 9 aa, Homo Sapiens
GSSVREPGH

SEQ ID NO: 846907 - protein, 9 aa, Homo Sapiens
KEMSKLKQQ

SEQ ID NO: 846908 - protein, 9 aa, Homo Sapiens
HIEACDLSN

SEQ ID NO: 846909 - protein, 9 aa, Homo Sapiens
SRGVSVQYH

SEQ ID NO: 846910 - protein, 9 aa, Homo Sapiens
LDIPKDLPD

SEQ ID NO: 846911 - protein, 9 aa, Homo Sapiens
TWGPDASTG

SEQ ID NO: 846912 - protein, 9 aa, Homo Sapiens
HERTRTGDK

SEQ ID NO: 846913 - protein, 9 aa, Homo Sapiens
PYRYPDIKE

SEQ ID NO: 846914 - protein, 9 aa, Homo Sapiens
ESADSIDIY

SEQ ID NO: 846915 - protein, 9 aa, Homo Sapiens
SKSAEFLTV

SEQ ID NO: 846916 - protein, 9 aa, Homo Sapiens
NKELQEENQ

SEQ ID NO: 846917 - protein, 9 aa, Homo Sapiens
AHAETSKIK

SEQ ID NO: 846918 - protein, 9 aa, Homo Sapiens
SKYDATRQK

SEQ ID NO: 846919 - protein, 9 aa, Homo Sapiens
INYSGESGD

SEQ ID NO: 846920 - protein, 9 aa, Homo Sapiens
DAHIVHIAM

SEQ ID NO: 846921 - protein, 9 aa, Homo Sapiens
NACDNCPQK

SEQ ID NO: 846922 - protein, 9 aa, Homo Sapiens
VAKELKSQS

SEQ ID NO: 846923 - protein, 9 aa, Homo Sapiens
GELGFHGQT

SEQ ID NO: 846924 - protein, 9 aa, Homo Sapiens
QGVMQKHSS

SEQ ID NO: 846925 - protein, 9 aa, Homo Sapiens
YHHYQRTPC

SEQ ID NO: 846926 - protein, 9 aa, Homo Sapiens
YPRKTSLVI

SEQ ID NO: 846927 - protein, 9 aa, Homo Sapiens
SVQKSNKKM

SEQ ID NO: 846928 - protein, 9 aa, Homo Sapiens
EGGKLMKIP

SEQ ID NO: 846929 - protein, 9 aa, Homo Sapiens
QACRGRNDL

SEQ ID NO: 846930 - protein, 9 aa, Homo Sapiens
DSQRMMYAT

SEQ ID NO: 846931 - protein, 9 aa, Homo Sapiens
RLLRSFKVT

SEQ ID NO: 846932 - protein, 9 aa, Homo Sapiens
LTAKYILYR

SEQ ID NO: 846933 - protein, 9 aa, Homo Sapiens
DREPFQMRI

SEQ ID NO: 846934 - protein, 9 aa, Homo Sapiens
NPYAASNKT

SEQ ID NO: 846935 - protein, 9 aa, Homo Sapiens
KKLFEQENK

SEQ ID NO: 846936 - protein, 9 aa, Homo Sapiens
RGRIISGNF

SEQ ID NO: 846937 - protein, 9 aa, Homo Sapiens
KKMNSWVKT

SEQ ID NO: 846938 - protein, 9 aa, Homo Sapiens
QANTINMLK

SEQ ID NO: 846939 - protein, 9 aa, Homo Sapiens
DTSDQSYGI

SEQ ID NO: 846940 - protein, 9 aa, Homo Sapiens
SNAFAHLPQ

SEQ ID NO: 846941 - protein, 9 aa, Homo Sapiens
YTKEEDEQQ

SEQ ID NO: 846942 - protein, 9 aa, Homo Sapiens
LWATTSVPI

SEQ ID NO: 846943 - protein, 9 aa, Homo Sapiens
GVKETNILN

SEQ ID NO: 846944 - protein, 9 aa, Homo Sapiens
ARRRLKKDN

SEQ ID NO: 846945 - protein, 9 aa, Homo Sapiens
FAKGFWDNY

SEQ ID NO: 846946 - protein, 9 aa, Homo Sapiens
LYMFMEYVP

SEQ ID NO: 846947 - protein, 9 aa, Homo Sapiens
NHSESSGED

SEQ ID NO: 846948 - protein, 9 aa, Homo Sapiens
VNDYDKDNN

SEQ ID NO: 846949 - protein, 9 aa, Homo Sapiens
NPVHSKLFT

SEQ ID NO: 846950 - protein, 9 aa, Homo Sapiens
ELQTFMIKF

SEQ ID NO: 846951 - protein, 9 aa, Homo Sapiens
EDDSNYVLQ

SEQ ID NO: 846952 - protein, 9 aa, Homo Sapiens
DNFLEFAEL

SEQ ID NO: 846953 - protein, 9 aa, Homo Sapiens
PIVGKWSQV

SEQ ID NO: 846954 - protein, 9 aa, Homo Sapiens
PKYQAGEGR

SEQ ID NO: 846955 - protein, 9 aa, Homo Sapiens
RYFLQRPGQ

SEQ ID NO: 846956 - protein, 9 aa, Homo Sapiens
CVSKIICRY

SEQ ID NO: 846957 - protein, 9 aa, Homo Sapiens
FYGIFYSQW

SEQ ID NO: 846958 - protein, 9 aa, Homo Sapiens
LNNKKVGVK

SEQ ID NO: 846959 - protein, 9 aa, Homo Sapiens
LYLYQFQLF

SEQ ID NO: 846960 - protein, 9 aa, Homo Sapiens
MNSQQTILD

SEQ ID NO: 846961 - protein, 9 aa, Homo Sapiens
MYSFKHQRI

SEQ ID NO: 846962 - protein, 9 aa, Homo Sapiens
STGTNTNKL

SEQ ID NO: 846963 - protein, 9 aa, Homo Sapiens
PPSWTGIRN

SEQ ID NO: 846964 - protein, 9 aa, Homo Sapiens
AEGTYKEKG

SEQ ID NO: 846965 - protein, 9 aa, Homo Sapiens
QCIQWLVKF

SEQ ID NO: 846966 - protein, 9 aa, Homo Sapiens
QGNLCHVAT

SEQ ID NO: 846967 - protein, 9 aa, Homo Sapiens
TVSCCPTGL

SEQ ID NO: 846968 - protein, 9 aa, Homo Sapiens
RNKKRRKRK

SEQ ID NO: 846969 - protein, 9 aa, Homo Sapiens
KHAYRYCKP

SEQ ID NO: 846970 - protein, 9 aa, Homo Sapiens
NNCSTCQNM

SEQ ID NO: 846971 - protein, 9 aa, Homo Sapiens
AGRWKRPKG

SEQ ID NO: 846972 - protein, 9 aa, Homo Sapiens
PEAKTDTKK

SEQ ID NO: 846973 - protein, 9 aa, Homo Sapiens
IVHKRVNTG

SEQ ID NO: 846974 - protein, 9 aa, Homo Sapiens
ADNGDLREA

SEQ ID NO: 846975 - protein, 9 aa, Homo Sapiens
LNPRAKHLE

SEQ ID NO: 846976 - protein, 9 aa, Homo Sapiens
AKPQNDWKC

SEQ ID NO: 846977 - protein, 9 aa, Homo Sapiens
SLSILLSEF

SEQ ID NO: 846978 - protein, 9 aa, Homo Sapiens
NVALVGVMP

SEQ ID NO: 846979 - protein, 9 aa, Homo Sapiens
RLSREMLEA

SEQ ID NO: 846980 - protein, 9 aa, Homo Sapiens
PPNSMESNE

SEQ ID NO: 846981 - protein, 9 aa, Homo Sapiens
DSSKAGFTI

SEQ ID NO: 846982 - protein, 9 aa, Homo Sapiens
RVIMRVYFN

SEQ ID NO: 846983 - protein, 9 aa, Homo Sapiens
SLSHLPVTE

SEQ ID NO: 846984 - protein, 9 aa, Homo Sapiens
SGPSKMRDC

SEQ ID NO: 846985 - protein, 9 aa, Homo Sapiens
DNGSHFFFT

SEQ ID NO: 846986 - protein, 9 aa, Homo Sapiens
LDQLSCLGS

SEQ ID NO: 846987 - protein, 9 aa, Homo Sapiens
LDLRTVAPA

SEQ ID NO: 846988 - protein, 9 aa, Homo Sapiens
NIKLFFSGS

SEQ ID NO: 846989 - protein, 9 aa, Homo Sapiens
SDQEAAKRT

SEQ ID NO: 846990 - protein, 9 aa, Homo Sapiens
DHKVSYLRS

SEQ ID NO: 846991 - protein, 9 aa, Homo Sapiens
RDSLISLEE

SEQ ID NO: 846992 - protein, 9 aa, Homo Sapiens
LSVEKPYRC

SEQ ID NO: 846993 - protein, 9 aa, Homo Sapiens
YKRIQRTFA

SEQ ID NO: 846994 - protein, 9 aa, Homo Sapiens
EEYKTIKSP

SEQ ID NO: 846995 - protein, 9 aa, Homo Sapiens
LHTGPGNPE

SEQ ID NO: 846996 - protein, 9 aa, Homo Sapiens
SRGSRQELV

SEQ ID NO: 846997 - protein, 9 aa, Homo Sapiens
VNISVLLML

SEQ ID NO: 846998 - protein, 9 aa, Homo Sapiens
SLPKPMEPP

SEQ ID NO: 846999 - protein, 9 aa, Homo Sapiens
ICKDKLGEN

SEQ ID NO: 847000 - protein, 9 aa, Homo Sapiens
MLGGALQGC

SEQ ID NO: 847001 - protein, 9 aa, Homo Sapiens
HYLLQAATP

SEQ ID NO: 847002 - protein, 9 aa, Homo Sapiens
TAEGDINTD

SEQ ID NO: 847003 - protein, 9 aa, Homo Sapiens
SVYEGDDDD

SEQ ID NO: 847004 - protein, 9 aa, Homo Sapiens
GDVWLWLEF

SEQ ID NO: 847005 - protein, 9 aa, Homo Sapiens
REVKEKITF

SEQ ID NO: 847006 - protein, 9 aa, Homo Sapiens
YGPNVIDHL

SEQ ID NO: 847007 - protein, 9 aa, Homo Sapiens
CDIIVVVIV

SEQ ID NO: 847008 - protein, 9 aa, Homo Sapiens
RHDMGTLDK

SEQ ID NO: 847009 - protein, 9 aa, Homo Sapiens
CAREQINSS

SEQ ID NO: 847010 - protein, 9 aa, Homo Sapiens
NDWWIGRLL

SEQ ID NO: 847011 - protein, 9 aa, Homo Sapiens
LTSAGEEQK

SEQ ID NO: 847012 - protein, 9 aa, Homo Sapiens
EVNRSPSFS

SEQ ID NO: 847013 - protein, 9 aa, Homo Sapiens
LLTYQGASV

SEQ ID NO: 847014 - protein, 9 aa, Homo Sapiens
LHYEIKDIH

SEQ ID NO: 847015 - protein, 9 aa, Homo Sapiens
SKDALLNRA

SEQ ID NO: 847016 - protein, 9 aa, Homo Sapiens
GRDVLTPFP

SEQ ID NO: 847017 - protein, 9 aa, Homo Sapiens
TCTYLYLLF

SEQ ID NO: 847018 - protein, 9 aa, Homo Sapiens
PPSFVAIQA

SEQ ID NO: 847019 - protein, 9 aa, Homo Sapiens
KIHRFQPTA

SEQ ID NO: 847020 - protein, 9 aa, Homo Sapiens
YDAMADTLG

SEQ ID NO: 847021 - protein, 9 aa, Homo Sapiens
VFCGLSNMY

SEQ ID NO: 847022 - protein, 9 aa, Homo Sapiens
PPGFPGDVG

SEQ ID NO: 847023 - protein, 9 aa, Homo Sapiens
YYQNKMAEC

SEQ ID NO: 847024 - protein, 9 aa, Homo Sapiens
LSIKGHLCQ

SEQ ID NO: 847025 - protein, 9 aa, Homo Sapiens
CMAIDKLSW

SEQ ID NO: 847026 - protein, 9 aa, Homo Sapiens
FFKALQEEY

SEQ ID NO: 847027 - protein, 9 aa, Homo Sapiens
PSDEWERCQ

SEQ ID NO: 847028 - protein, 9 aa, Homo Sapiens
KAVIHLHHL

SEQ ID NO: 847029 - protein, 9 aa, Homo Sapiens
EKMCEQEDK

SEQ ID NO: 847030 - protein, 9 aa, Homo Sapiens
PPEPPPSWT

SEQ ID NO: 847031 - protein, 9 aa, Homo Sapiens
ADLDTEWNM

SEQ ID NO: 847032 - protein, 9 aa, Homo Sapiens
CHQKCKEET

SEQ ID NO: 847033 - protein, 9 aa, Homo Sapiens
THSEKQCRS

SEQ ID NO: 847034 - protein, 9 aa, Homo Sapiens
FYMEKETHR

SEQ ID NO: 847035 - protein, 9 aa, Homo Sapiens
GRSSTLNYC

SEQ ID NO: 847036 - protein, 9 aa, Homo Sapiens
INILIQSLD

SEQ ID NO: 847037 - protein, 9 aa, Homo Sapiens
QRARATLRE

SEQ ID NO: 847038 - protein, 9 aa, Homo Sapiens
EILLIPVKY

SEQ ID NO: 847039 - protein, 9 aa, Homo Sapiens
NSRDFGIWM

SEQ ID NO: 847040 - protein, 9 aa, Homo Sapiens
GRLLKEGCE

SEQ ID NO: 847041 - protein, 9 aa, Homo Sapiens
IPVNIRFCL

SEQ ID NO: 847042 - protein, 9 aa, Homo Sapiens
QRVNINFSL

SEQ ID NO: 847043 - protein, 9 aa, Homo Sapiens
PNWGLPSLL

SEQ ID NO: 847044 - protein, 9 aa, Homo Sapiens
QGYKGNGLW

SEQ ID NO: 847045 - protein, 9 aa, Homo Sapiens
NYYWLLTHR

SEQ ID NO: 847046 - protein, 9 aa, Homo Sapiens
DLATEPTKL

SEQ ID NO: 847047 - protein, 9 aa, Homo Sapiens
TAAKMENKV

SEQ ID NO: 847048 - protein, 9 aa, Homo Sapiens
SVKQQNTIK

SEQ ID NO: 847049 - protein, 9 aa, Homo Sapiens
ALNKCKPNR

SEQ ID NO: 847050 - protein, 9 aa, Homo Sapiens
LKEKERLAN

SEQ ID NO: 847051 - protein, 9 aa, Homo Sapiens
RLAHISTNP

SEQ ID NO: 847052 - protein, 9 aa, Homo Sapiens
RQPSQMIVL

SEQ ID NO: 847053 - protein, 9 aa, Homo Sapiens
TSCETSGSI

SEQ ID NO: 847054 - protein, 9 aa, Homo Sapiens
KPTAPSKLE

SEQ ID NO: 847055 - protein, 9 aa, Homo Sapiens
AENTQSSLI

SEQ ID NO: 847056 - protein, 9 aa, Homo Sapiens
NQAHAQEFL

SEQ ID NO: 847057 - protein, 9 aa, Homo Sapiens
EAEVHAKSL

SEQ ID NO: 847058 - protein, 9 aa, Homo Sapiens
ESGQDIEIW

SEQ ID NO: 847059 - protein, 9 aa, Homo Sapiens
PRDFLLYIA

SEQ ID NO: 847060 - protein, 9 aa, Homo Sapiens
ETCTYADKY

SEQ ID NO: 847061 - protein, 9 aa, Homo Sapiens
VTSKVEKSP

SEQ ID NO: 847062 - protein, 9 aa, Homo Sapiens
EIHWKIHTE

SEQ ID NO: 847063 - protein, 9 aa, Homo Sapiens
KHIIIYEQH

SEQ ID NO: 847064 - protein, 9 aa, Homo Sapiens
GLTCSRASS

SEQ ID NO: 847065 - protein, 9 aa, Homo Sapiens
DGKIKEELE

SEQ ID NO: 847066 - protein, 9 aa, Homo Sapiens
LNAEDENRE

SEQ ID NO: 847067 - protein, 9 aa, Homo Sapiens
CGVPGSQGK

SEQ ID NO: 847068 - protein, 9 aa, Homo Sapiens
LEEHSRFHE

SEQ ID NO: 847069 - protein, 9 aa, Homo Sapiens
DSDKLKEEI

SEQ ID NO: 847070 - protein, 9 aa, Homo Sapiens
PSVPTGMNP

SEQ ID NO: 847071 - protein, 9 aa, Homo Sapiens
SEKAKEPDT

SEQ ID NO: 847072 - protein, 9 aa, Homo Sapiens
EEWLITLKN

SEQ ID NO: 847073 - protein, 9 aa, Homo Sapiens
HSELDKYEQ

SEQ ID NO: 847074 - protein, 9 aa, Homo Sapiens
SRKRSSSRT

SEQ ID NO: 847075 - protein, 9 aa, Homo Sapiens
VQAYSEVDG

SEQ ID NO: 847076 - protein, 9 aa, Homo Sapiens
LPLTKTEEH

SEQ ID NO: 847077 - protein, 9 aa, Homo Sapiens
CMVQLFSLV

SEQ ID NO: 847078 - protein, 9 aa, Homo Sapiens
SVTASGLEK

SEQ ID NO: 847079 - protein, 9 aa, Homo Sapiens
HQYLRRKHL

SEQ ID NO: 847080 - protein, 9 aa, Homo Sapiens
LQRHMVVKG

SEQ ID NO: 847081 - protein, 9 aa, Homo Sapiens
GDIGIIHEK

SEQ ID NO: 847082 - protein, 9 aa, Homo Sapiens
KYYYIAGYL

SEQ ID NO: 847083 - protein, 9 aa, Homo Sapiens
IRDQIQRRA

SEQ ID NO: 847084 - protein, 9 aa, Homo Sapiens
GGGVPAWGL

SEQ ID NO: 847085 - protein, 9 aa, Homo Sapiens
ELQWLLSKA

SEQ ID NO: 847086 - protein, 9 aa, Homo Sapiens
HNGKSGREK

SEQ ID NO: 847087 - protein, 9 aa, Homo Sapiens
YLYKKLEMK

SEQ ID NO: 847088 - protein, 9 aa, Homo Sapiens
SSQPEHYSP

SEQ ID NO: 847089 - protein, 9 aa, Homo Sapiens
TTPQYYTQN

SEQ ID NO: 847090 - protein, 9 aa, Homo Sapiens
IHPNHPFQG

SEQ ID NO: 847091 - protein, 9 aa, Homo Sapiens
SASEVLPLL

SEQ ID NO: 847092 - protein, 9 aa, Homo Sapiens
PEFEECNGK

SEQ ID NO: 847093 - protein, 9 aa, Homo Sapiens
PSLLEGADY

SEQ ID NO: 847094 - protein, 9 aa, Homo Sapiens
CDCDKDMLI

SEQ ID NO: 847095 - protein, 9 aa, Homo Sapiens
IEKKAIPQH

SEQ ID NO: 847096 - protein, 9 aa, Homo Sapiens
LYGVNNVLL

SEQ ID NO: 847097 - protein, 9 aa, Homo Sapiens
YIWNYKAPA

SEQ ID NO: 847098 - protein, 9 aa, Homo Sapiens
VCGLEHLRL

SEQ ID NO: 847099 - protein, 9 aa, Homo Sapiens
QYSRILFTV

SEQ ID NO: 847100 - protein, 9 aa, Homo Sapiens
KNVNMKPRL

SEQ ID NO: 847101 - protein, 9 aa, Homo Sapiens
HCMHLHEKR

SEQ ID NO: 847102 - protein, 9 aa, Homo Sapiens
NKTLITERD

SEQ ID NO: 847103 - protein, 9 aa, Homo Sapiens
MGPWGWNLR

SEQ ID NO: 847104 - protein, 9 aa, Homo Sapiens
ESLDFSDGD

SEQ ID NO: 847105 - protein, 9 aa, Homo Sapiens
LAVLDAIYE

SEQ ID NO: 847106 - protein, 9 aa, Homo Sapiens
DISAANRND

SEQ ID NO: 847107 - protein, 9 aa, Homo Sapiens
KHSDDEELL

SEQ ID NO: 847108 - protein, 9 aa, Homo Sapiens
ANAHPWQQV

SEQ ID NO: 847109 - protein, 9 aa, Homo Sapiens
DQGIPPFLA

SEQ ID NO: 847110 - protein, 9 aa, Homo Sapiens
KENLIMQET

SEQ ID NO: 847111 - protein, 9 aa, Homo Sapiens
SVERKKQDK

SEQ ID NO: 847112 - protein, 9 aa, Homo Sapiens
IDLNDWWNN

SEQ ID NO: 847113 - protein, 9 aa, Homo Sapiens
LSDVVEKLY

SEQ ID NO: 847114 - protein, 9 aa, Homo Sapiens
KFPNPLRPF

SEQ ID NO: 847115 - protein, 9 aa, Homo Sapiens
STFKRKDWS

SEQ ID NO: 847116 - protein, 9 aa, Homo Sapiens
QEHPQVVYK

SEQ ID NO: 847117 - protein, 9 aa, Homo Sapiens
GSLDSLGRF

SEQ ID NO: 847118 - protein, 9 aa, Homo Sapiens
ESVTEAGPG

SEQ ID NO: 847119 - protein, 9 aa, Homo Sapiens
PLAWGENHL

SEQ ID NO: 847120 - protein, 9 aa, Homo Sapiens
PHNHNQIPT

SEQ ID NO: 847121 - protein, 9 aa, Homo Sapiens
SPPLIGKGL

SEQ ID NO: 847122 - protein, 9 aa, Homo Sapiens
SNRSVCDTD

SEQ ID NO: 847123 - protein, 9 aa, Homo Sapiens
RWNLFLPLE

SEQ ID NO: 847124 - protein, 9 aa, Homo Sapiens
ESQAGEFLC

SEQ ID NO: 847125 - protein, 9 aa, Homo Sapiens
LIGQGYCVF

SEQ ID NO: 847126 - protein, 9 aa, Homo Sapiens
CCKLCKYEF

SEQ ID NO: 847127 - protein, 9 aa, Homo Sapiens
LLVAYWENT

SEQ ID NO: 847128 - protein, 9 aa, Homo Sapiens
TEALWLQYR

SEQ ID NO: 847129 - protein, 9 aa, Homo Sapiens
GDTFPDENF

SEQ ID NO: 847130 - protein, 9 aa, Homo Sapiens
NSNIPTNLC

SEQ ID NO: 847131 - protein, 9 aa, Homo Sapiens
QNNSSKFHF

SEQ ID NO: 847132 - protein, 9 aa, Homo Sapiens
WDGKDSTIT

SEQ ID NO: 847133 - protein, 9 aa, Homo Sapiens
QSGGKFTCG

SEQ ID NO: 847134 - protein, 9 aa, Homo Sapiens
ERMSRIHEE

SEQ ID NO: 847135 - protein, 9 aa, Homo Sapiens
KRRAISLLV

SEQ ID NO: 847136 - protein, 9 aa, Homo Sapiens
TFFSQEKYW

SEQ ID NO: 847137 - protein, 9 aa, Homo Sapiens
KIKYDFPLN

SEQ ID NO: 847138 - protein, 9 aa, Homo Sapiens
KIEIIQPIL

SEQ ID NO: 847139 - protein, 9 aa, Homo Sapiens
LSISDRIRE

SEQ ID NO: 847140 - protein, 9 aa, Homo Sapiens
NMYVVDIPM

SEQ ID NO: 847141 - protein, 9 aa, Homo Sapiens
QGLNSECKS

SEQ ID NO: 847142 - protein, 9 aa, Homo Sapiens
SSLATGALG

SEQ ID NO: 847143 - protein, 9 aa, Homo Sapiens
SSSVDLNRP

SEQ ID NO: 847144 - protein, 9 aa, Homo Sapiens
SSIHFYLKQ

SEQ ID NO: 847145 - protein, 9 aa, Homo Sapiens
DNEELNLED

SEQ ID NO: 847146 - protein, 9 aa, Homo Sapiens
ANINSRFGY

SEQ ID NO: 847147 - protein, 9 aa, Homo Sapiens
SSKDVMEKI

SEQ ID NO: 847148 - protein, 9 aa, Homo Sapiens
ETLDNKLQE

SEQ ID NO: 847149 - protein, 9 aa, Homo Sapiens
KERMAQHFY

SEQ ID NO: 847150 - protein, 9 aa, Homo Sapiens
KKKLSSYLG

SEQ ID NO: 847151 - protein, 9 aa, Homo Sapiens
TAGLNKLFS

SEQ ID NO: 847152 - protein, 9 aa, Homo Sapiens
ASKIELLDL

SEQ ID NO: 847153 - protein, 9 aa, Homo Sapiens
QPPQLINLK

SEQ ID NO: 847154 - protein, 9 aa, Homo Sapiens
NIDEHLFGV

SEQ ID NO: 847155 - protein, 9 aa, Homo Sapiens
KSIKHETLP

SEQ ID NO: 847156 - protein, 9 aa, Homo Sapiens
AHDDDLDEL

SEQ ID NO: 847157 - protein, 9 aa, Homo Sapiens
QASELSTDA

SEQ ID NO: 847158 - protein, 9 aa, Homo Sapiens
YIARQRNQT

SEQ ID NO: 847159 - protein, 9 aa, Homo Sapiens
RLRLPLGAT

SEQ ID NO: 847160 - protein, 9 aa, Homo Sapiens
EKIYVLLCR

SEQ ID NO: 847161 - protein, 9 aa, Homo Sapiens
YVAVAIKTL

SEQ ID NO: 847162 - protein, 9 aa, Homo Sapiens
PKPETTLSP

SEQ ID NO: 847163 - protein, 9 aa, Homo Sapiens
FDPQDMDNN

SEQ ID NO: 847164 - protein, 9 aa, Homo Sapiens
EGNIIHFQT

SEQ ID NO: 847165 - protein, 9 aa, Homo Sapiens
LDDNFVRGH

SEQ ID NO: 847166 - protein, 9 aa, Homo Sapiens
VNDLQGRND

SEQ ID NO: 847167 - protein, 9 aa, Homo Sapiens
SAILRAVSD

SEQ ID NO: 847168 - protein, 9 aa, Homo Sapiens
RYEESSKPK

SEQ ID NO: 847169 - protein, 9 aa, Homo Sapiens
NRKLYCQDI

SEQ ID NO: 847170 - protein, 9 aa, Homo Sapiens
YAEKDPNKK

SEQ ID NO: 847171 - protein, 9 aa, Homo Sapiens
SYYFDMDKI

SEQ ID NO: 847172 - protein, 9 aa, Homo Sapiens
NYCNLEDKL

SEQ ID NO: 847173 - protein, 9 aa, Homo Sapiens
NSARFQPHQ

SEQ ID NO: 847174 - protein, 9 aa, Homo Sapiens
VPCTAFRAT

SEQ ID NO: 847175 - protein, 9 aa, Homo Sapiens
DGPHQKEKC

SEQ ID NO: 847176 - protein, 9 aa, Homo Sapiens
PDQSGIDIN

SEQ ID NO: 847177 - protein, 9 aa, Homo Sapiens
NAIIVIGEG

SEQ ID NO: 847178 - protein, 9 aa, Homo Sapiens
LVDFLSVKK

SEQ ID NO: 847179 - protein, 9 aa, Homo Sapiens
PDKSVNKMQ

SEQ ID NO: 847180 - protein, 9 aa, Homo Sapiens
LYSVLTIDK

SEQ ID NO: 847181 - protein, 9 aa, Homo Sapiens
ISYLYIILT

SEQ ID NO: 847182 - protein, 9 aa, Homo Sapiens
YFGAVLGKT

SEQ ID NO: 847183 - protein, 9 aa, Homo Sapiens
TVAFAGFNL

SEQ ID NO: 847184 - protein, 9 aa, Homo Sapiens
QTYEKRIER

SEQ ID NO: 847185 - protein, 9 aa, Homo Sapiens
EFCFNDNLV

SEQ ID NO: 847186 - protein, 9 aa, Homo Sapiens
FEILDRLIG

SEQ ID NO: 847187 - protein, 9 aa, Homo Sapiens
ARKLEWPLA

SEQ ID NO: 847188 - protein, 9 aa, Homo Sapiens
TCGGIDKRT

SEQ ID NO: 847189 - protein, 9 aa, Homo Sapiens
STMSVCFSA

SEQ ID NO: 847190 - protein, 9 aa, Homo Sapiens
LLQLPDLWW

SEQ ID NO: 847191 - protein, 9 aa, Homo Sapiens
YLVTLGNTF

SEQ ID NO: 847192 - protein, 9 aa, Homo Sapiens
DPAELKKLQ

SEQ ID NO: 847193 - protein, 9 aa, Homo Sapiens
LSNDAEYEC

SEQ ID NO: 847194 - protein, 9 aa, Homo Sapiens
LQTPMYLFL

SEQ ID NO: 847195 - protein, 9 aa, Homo Sapiens
KHLSWEDIV

SEQ ID NO: 847196 - protein, 9 aa, Homo Sapiens
HAYKCSDQR

SEQ ID NO: 847197 - protein, 9 aa, Homo Sapiens
NQLDAQKSA

SEQ ID NO: 847198 - protein, 9 aa, Homo Sapiens
IDIDTETEQ

SEQ ID NO: 847199 - protein, 9 aa, Homo Sapiens
GLNPVIYAF

SEQ ID NO: 847200 - protein, 9 aa, Homo Sapiens
PREYAFHIF

SEQ ID NO: 847201 - protein, 9 aa, Homo Sapiens
KPIFGSINP

SEQ ID NO: 847202 - protein, 9 aa, Homo Sapiens
LAHIILVNV

SEQ ID NO: 847203 - protein, 9 aa, Homo Sapiens
GPTHCLHSK

SEQ ID NO: 847204 - protein, 9 aa, Homo Sapiens
QKGLMRQRQ

SEQ ID NO: 847205 - protein, 9 aa, Homo Sapiens
SANEFSKCD

SEQ ID NO: 847206 - protein, 9 aa, Homo Sapiens
QRLFKWQHQ

SEQ ID NO: 847207 - protein, 9 aa, Homo Sapiens
AATVCKGSS

SEQ ID NO: 847208 - protein, 9 aa, Homo Sapiens
DMHITQMLL

SEQ ID NO: 847209 - protein, 9 aa, Homo Sapiens
GDFPDTTQC

SEQ ID NO: 847210 - protein, 9 aa, Homo Sapiens
SMPDSGRPT

SEQ ID NO: 847211 - protein, 9 aa, Homo Sapiens
QFIIQAKLD

SEQ ID NO: 847212 - protein, 9 aa, Homo Sapiens
TCCCPSCCE

SEQ ID NO: 847213 - protein, 9 aa, Homo Sapiens
SRVCQNFHP

SEQ ID NO: 847214 - protein, 9 aa, Homo Sapiens
KQQLENKKT

SEQ ID NO: 847215 - protein, 9 aa, Homo Sapiens
IADAYSSFC

SEQ ID NO: 847216 - protein, 9 aa, Homo Sapiens
KERWENDKD

SEQ ID NO: 847217 - protein, 9 aa, Homo Sapiens
CPPKFSNTP

SEQ ID NO: 847218 - protein, 9 aa, Homo Sapiens
KKNGDILTL

SEQ ID NO: 847219 - protein, 9 aa, Homo Sapiens
ANTTNGRGC

SEQ ID NO: 847220 - protein, 9 aa, Homo Sapiens
LLKKKLWSS

SEQ ID NO: 847221 - protein, 9 aa, Homo Sapiens
KRVQLISNK

SEQ ID NO: 847222 - protein, 9 aa, Homo Sapiens
TVSTEQEKF

SEQ ID NO: 847223 - protein, 9 aa, Homo Sapiens
HHSRVYLMT

SEQ ID NO: 847224 - protein, 9 aa, Homo Sapiens
HQNLAALVS

SEQ ID NO: 847225 - protein, 9 aa, Homo Sapiens
RVVGSDFVQ

SEQ ID NO: 847226 - protein, 9 aa, Homo Sapiens
KDEDLKLEL

SEQ ID NO: 847227 - protein, 9 aa, Homo Sapiens
QKRQKINLG

SEQ ID NO: 847228 - protein, 9 aa, Homo Sapiens
AMQDKYVNI

SEQ ID NO: 847229 - protein, 9 aa, Homo Sapiens
RYGFQYIYV

SEQ ID NO: 847230 - protein, 9 aa, Homo Sapiens
PTTKETRET

SEQ ID NO: 847231 - protein, 9 aa, Homo Sapiens
GTLMFMYLQ

SEQ ID NO: 847232 - protein, 9 aa, Homo Sapiens
MFLVYCALD

SEQ ID NO: 847233 - protein, 9 aa, Homo Sapiens
TDTQNVTFV

SEQ ID NO: 847234 - protein, 9 aa, Homo Sapiens
EEGIYSIIV

SEQ ID NO: 847235 - protein, 9 aa, Homo Sapiens
KNINTCGAR

SEQ ID NO: 847236 - protein, 9 aa, Homo Sapiens
GADNFIQHN

SEQ ID NO: 847237 - protein, 9 aa, Homo Sapiens
RNKIIGHFL

SEQ ID NO: 847238 - protein, 9 aa, Homo Sapiens
ECEQSFSQS

SEQ ID NO: 847239 - protein, 9 aa, Homo Sapiens
INANFLTRI

SEQ ID NO: 847240 - protein, 9 aa, Homo Sapiens
SCGLLDEDG

SEQ ID NO: 847241 - protein, 9 aa, Homo Sapiens
NMTNCEVKA

SEQ ID NO: 847242 - protein, 9 aa, Homo Sapiens
SKMPLHPSA

SEQ ID NO: 847243 - protein, 9 aa, Homo Sapiens
KTQQSQQEL

SEQ ID NO: 847244 - protein, 9 aa, Homo Sapiens
SRVRNTVQG

SEQ ID NO: 847245 - protein, 9 aa, Homo Sapiens
CKINLEIPG

SEQ ID NO: 847246 - protein, 9 aa, Homo Sapiens
SNIVNIKVQ

SEQ ID NO: 847247 - protein, 9 aa, Homo Sapiens
ACQHMSTSL

SEQ ID NO: 847248 - protein, 9 aa, Homo Sapiens
RCFTATGQS

SEQ ID NO: 847249 - protein, 9 aa, Homo Sapiens
ESLFRRCQR

SEQ ID NO: 847250 - protein, 9 aa, Homo Sapiens
VRAGYPRDI

SEQ ID NO: 847251 - protein, 9 aa, Homo Sapiens
HRASPHSSG

SEQ ID NO: 847252 - protein, 9 aa, Homo Sapiens
KSTMVYNKF

SEQ ID NO: 847253 - protein, 9 aa, Homo Sapiens
FQTEVSYLE

SEQ ID NO: 847254 - protein, 9 aa, Homo Sapiens
PKVLRGKTI

SEQ ID NO: 847255 - protein, 9 aa, Homo Sapiens
VSRSPSLNV

SEQ ID NO: 847256 - protein, 9 aa, Homo Sapiens
LTRQKAFDW

SEQ ID NO: 847257 - protein, 9 aa, Homo Sapiens
GNAFIPHLP

SEQ ID NO: 847258 - protein, 9 aa, Homo Sapiens
GECPDPVGE

SEQ ID NO: 847259 - protein, 9 aa, Homo Sapiens
RAQMLISTP

SEQ ID NO: 847260 - protein, 9 aa, Homo Sapiens
HGDVWLWLE

SEQ ID NO: 847261 - protein, 9 aa, Homo Sapiens
NGIQLAINQ

SEQ ID NO: 847262 - protein, 9 aa, Homo Sapiens
VAQVVKLTE

SEQ ID NO: 847263 - protein, 9 aa, Homo Sapiens
IPCLTKIPG

SEQ ID NO: 847264 - protein, 9 aa, Homo Sapiens
GSQAWTPPT

SEQ ID NO: 847265 - protein, 9 aa, Homo Sapiens
AGPSQRHSS

SEQ ID NO: 847266 - protein, 9 aa, Homo Sapiens
CQTLKLHKS

SEQ ID NO: 847267 - protein, 9 aa, Homo Sapiens
SLAGTLFLM

SEQ ID NO: 847268 - protein, 9 aa, Homo Sapiens
DMKGWPSGN

SEQ ID NO: 847269 - protein, 9 aa, Homo Sapiens
GLEVRIVVS

SEQ ID NO: 847270 - protein, 9 aa, Homo Sapiens
SNLQRQATK

SEQ ID NO: 847271 - protein, 9 aa, Homo Sapiens
DKFWMNKST

SEQ ID NO: 847272 - protein, 9 aa, Homo Sapiens
NKLSEEQNK

SEQ ID NO: 847273 - protein, 9 aa, Homo Sapiens
QSDSAVIGG

SEQ ID NO: 847274 - protein, 9 aa, Homo Sapiens
CHSLEPQKQ

SEQ ID NO: 847275 - protein, 9 aa, Homo Sapiens
REPFANKEC

SEQ ID NO: 847276 - protein, 9 aa, Homo Sapiens
LGKNENGKG

SEQ ID NO: 847277 - protein, 9 aa, Homo Sapiens
ATALAGTPW

SEQ ID NO: 847278 - protein, 9 aa, Homo Sapiens
FSTCAFHLT

SEQ ID NO: 847279 - protein, 9 aa, Homo Sapiens
TLVLDTMAN

SEQ ID NO: 847280 - protein, 9 aa, Homo Sapiens
GEVVCEAIQ

SEQ ID NO: 847281 - protein, 9 aa, Homo Sapiens
GSPSDDEGM

SEQ ID NO: 847282 - protein, 9 aa, Homo Sapiens
QQIMEGMHL

SEQ ID NO: 847283 - protein, 9 aa, Homo Sapiens
AFNRSSHLV

SEQ ID NO: 847284 - protein, 9 aa, Homo Sapiens
GQVILINSS

SEQ ID NO: 847285 - protein, 9 aa, Homo Sapiens
AFFFQDTPR

SEQ ID NO: 847286 - protein, 9 aa, Homo Sapiens
TVCSLIHVC

SEQ ID NO: 847287 - protein, 9 aa, Homo Sapiens
NVTLLDLSG

SEQ ID NO: 847288 - protein, 9 aa, Homo Sapiens
VGVWGQYGN

SEQ ID NO: 847289 - protein, 9 aa, Homo Sapiens
QKILLPDNL

SEQ ID NO: 847290 - protein, 9 aa, Homo Sapiens
NPFQGLMEL

SEQ ID NO: 847291 - protein, 9 aa, Homo Sapiens
IILFINNCQ

SEQ ID NO: 847292 - protein, 9 aa, Homo Sapiens
SKAFNRSSH

SEQ ID NO: 847293 - protein, 9 aa, Homo Sapiens
LQTDDRVER

SEQ ID NO: 847294 - protein, 9 aa, Homo Sapiens
SELDKYEQA

SEQ ID NO: 847295 - protein, 9 aa, Homo Sapiens
KDEVSILST

SEQ ID NO: 847296 - protein, 9 aa, Homo Sapiens
GQITMDKTP

SEQ ID NO: 847297 - protein, 9 aa, Homo Sapiens
LVEIGPRCV

SEQ ID NO: 847298 - protein, 9 aa, Homo Sapiens
TSVFEFNHH

SEQ ID NO: 847299 - protein, 9 aa, Homo Sapiens
YQCAGRSKK

SEQ ID NO: 847300 - protein, 9 aa, Homo Sapiens
EKGKCPDNG

SEQ ID NO: 847301 - protein, 9 aa, Homo Sapiens
SILSRHWII

SEQ ID NO: 847302 - protein, 9 aa, Homo Sapiens
GEPKHPGGK

SEQ ID NO: 847303 - protein, 9 aa, Homo Sapiens
ILGASDKEL

SEQ ID NO: 847304 - protein, 9 aa, Homo Sapiens
NLNTLALFD

SEQ ID NO: 847305 - protein, 9 aa, Homo Sapiens
VRLFEEFYE

SEQ ID NO: 847306 - protein, 9 aa, Homo Sapiens
SFRRRRTEQ

SEQ ID NO: 847307 - protein, 9 aa, Homo Sapiens
MKRLSPMKP

SEQ ID NO: 847308 - protein, 9 aa, Homo Sapiens
VIYVVYSTG

SEQ ID NO: 847309 - protein, 9 aa, Homo Sapiens
TFKCHRTYR

SEQ ID NO: 847310 - protein, 9 aa, Homo Sapiens
TEVAIQIID

SEQ ID NO: 847311 - protein, 9 aa, Homo Sapiens
MQKKLADHL

SEQ ID NO: 847312 - protein, 9 aa, Homo Sapiens
KRVLEIKRR

SEQ ID NO: 847313 - protein, 9 aa, Homo Sapiens
KIVSYQAIG

SEQ ID NO: 847314 - protein, 9 aa, Homo Sapiens
TRMRPYTCK

SEQ ID NO: 847315 - protein, 9 aa, Homo Sapiens
VERGAFIGI

SEQ ID NO: 847316 - protein, 9 aa, Homo Sapiens
NMYHLGTQC

SEQ ID NO: 847317 - protein, 9 aa, Homo Sapiens
QPLYPIPMM

SEQ ID NO: 847318 - protein, 9 aa, Homo Sapiens
RNVKAMDIT

SEQ ID NO: 847319 - protein, 9 aa, Homo Sapiens
DLSRILFYQ

SEQ ID NO: 847320 - protein, 9 aa, Homo Sapiens
PLIKPKQRL

SEQ ID NO: 847321 - protein, 9 aa, Homo Sapiens
VPSSPIIAP

SEQ ID NO: 847322 - protein, 9 aa, Homo Sapiens
CPMKRLSPM

SEQ ID NO: 847323 - protein, 9 aa, Homo Sapiens
VRLEQKIKI

SEQ ID NO: 847324 - protein, 9 aa, Homo Sapiens
HFFETSVTW

SEQ ID NO: 847325 - protein, 9 aa, Homo Sapiens
TGEADVEFT

SEQ ID NO: 847326 - protein, 9 aa, Homo Sapiens
AGHSISKPD

SEQ ID NO: 847327 - protein, 9 aa, Homo Sapiens
SDVKLLYTI

SEQ ID NO: 847328 - protein, 9 aa, Homo Sapiens
RGATWKTLL

SEQ ID NO: 847329 - protein, 9 aa, Homo Sapiens
PNGLRYYKA

SEQ ID NO: 847330 - protein, 9 aa, Homo Sapiens
HQTLDKVLE

SEQ ID NO: 847331 - protein, 9 aa, Homo Sapiens
KCRNVFEPA

SEQ ID NO: 847332 - protein, 9 aa, Homo Sapiens
STWRIKKKS

SEQ ID NO: 847333 - protein, 9 aa, Homo Sapiens
LLNSAGNKF

SEQ ID NO: 847334 - protein, 9 aa, Homo Sapiens
SQPKKRVET

SEQ ID NO: 847335 - protein, 9 aa, Homo Sapiens
RGERYKYMV

SEQ ID NO: 847336 - protein, 9 aa, Homo Sapiens
SNTLQVSID

SEQ ID NO: 847337 - protein, 9 aa, Homo Sapiens
NSALPATKL

SEQ ID NO: 847338 - protein, 9 aa, Homo Sapiens
IINSHSHED

SEQ ID NO: 847339 - protein, 9 aa, Homo Sapiens
CTPSFHSGS

SEQ ID NO: 847340 - protein, 9 aa, Homo Sapiens
VLSFFYHYM

SEQ ID NO: 847341 - protein, 9 aa, Homo Sapiens
HSSIERAQQ

SEQ ID NO: 847342 - protein, 9 aa, Homo Sapiens
ADYSYEQHN

SEQ ID NO: 847343 - protein, 9 aa, Homo Sapiens
DQSAGKNNN

SEQ ID NO: 847344 - protein, 9 aa, Homo Sapiens
HNRKEFAKF

SEQ ID NO: 847345 - protein, 9 aa, Homo Sapiens
YRASASRAA

SEQ ID NO: 847346 - protein, 9 aa, Homo Sapiens
KPLEEDIHF

SEQ ID NO: 847347 - protein, 9 aa, Homo Sapiens
TILQHTLQL

SEQ ID NO: 847348 - protein, 9 aa, Homo Sapiens
GYIENLKKF

SEQ ID NO: 847349 - protein, 9 aa, Homo Sapiens
NYSRLSEHA

SEQ ID NO: 847350 - protein, 9 aa, Homo Sapiens
LGKVTVVAS

SEQ ID NO: 847351 - protein, 9 aa, Homo Sapiens
TPPNSMESN

SEQ ID NO: 847352 - protein, 9 aa, Homo Sapiens
YHSLTTNIM

SEQ ID NO: 847353 - protein, 9 aa, Homo Sapiens
KDCAIFFCC

SEQ ID NO: 847354 - protein, 9 aa, Homo Sapiens
IWKRTAPED

SEQ ID NO: 847355 - protein, 9 aa, Homo Sapiens
RNKRFEQAQ

SEQ ID NO: 847356 - protein, 9 aa, Homo Sapiens
VDALFCPRM

SEQ ID NO: 847357 - protein, 9 aa, Homo Sapiens
KSDAVECLN

SEQ ID NO: 847358 - protein, 9 aa, Homo Sapiens
LYVVLWLIC

SEQ ID NO: 847359 - protein, 9 aa, Homo Sapiens
SANLYVHRI

SEQ ID NO: 847360 - protein, 9 aa, Homo Sapiens
ILTASGRNP

SEQ ID NO: 847361 - protein, 9 aa, Homo Sapiens
IIFSVIHSN

SEQ ID NO: 847362 - protein, 9 aa, Homo Sapiens
KLNDLKITG

SEQ ID NO: 847363 - protein, 9 aa, Homo Sapiens
SRVKCGRDG

SEQ ID NO: 847364 - protein, 9 aa, Homo Sapiens
HIVSASRDT

SEQ ID NO: 847365 - protein, 9 aa, Homo Sapiens
DDCDKTGIE

SEQ ID NO: 847366 - protein, 9 aa, Homo Sapiens
KNISDKLNF

SEQ ID NO: 847367 - protein, 9 aa, Homo Sapiens
SYCLKCAEY

SEQ ID NO: 847368 - protein, 9 aa, Homo Sapiens
CVKRLDECI

SEQ ID NO: 847369 - protein, 9 aa, Homo Sapiens
DIVGDILWE

SEQ ID NO: 847370 - protein, 9 aa, Homo Sapiens
SHRLHQLFR

SEQ ID NO: 847371 - protein, 9 aa, Homo Sapiens
HNSASWSDN

SEQ ID NO: 847372 - protein, 9 aa, Homo Sapiens
KPDSEDKIS

SEQ ID NO: 847373 - protein, 9 aa, Homo Sapiens
LYTHRRMTI

SEQ ID NO: 847374 - protein, 9 aa, Homo Sapiens
ETNLWRCIS

SEQ ID NO: 847375 - protein, 9 aa, Homo Sapiens
QWTESVGLA

SEQ ID NO: 847376 - protein, 9 aa, Homo Sapiens
GKGVKHQPP

SEQ ID NO: 847377 - protein, 9 aa, Homo Sapiens
ELGFRVRKI

SEQ ID NO: 847378 - protein, 9 aa, Homo Sapiens
ENYEKLWKW

SEQ ID NO: 847379 - protein, 9 aa, Homo Sapiens
CYLNELTYN

SEQ ID NO: 847380 - protein, 9 aa, Homo Sapiens
ELLDGGHGG

SEQ ID NO: 847381 - protein, 9 aa, Homo Sapiens
GIQNYHSGN

SEQ ID NO: 847382 - protein, 9 aa, Homo Sapiens
AIKCINRQE

SEQ ID NO: 847383 - protein, 9 aa, Homo Sapiens
EMAKNILRG

SEQ ID NO: 847384 - protein, 9 aa, Homo Sapiens
VMQKIQMKG

SEQ ID NO: 847385 - protein, 9 aa, Homo Sapiens
FKSIIEGER

SEQ ID NO: 847386 - protein, 9 aa, Homo Sapiens
IKAVLEVVQ

SEQ ID NO: 847387 - protein, 9 aa, Homo Sapiens
LAIYFRCLG

SEQ ID NO: 847388 - protein, 9 aa, Homo Sapiens
YNGLLHCLT

SEQ ID NO: 847389 - protein, 9 aa, Homo Sapiens
IDKLKEKKL

SEQ ID NO: 847390 - protein, 9 aa, Homo Sapiens
HVIISEAAS

SEQ ID NO: 847391 - protein, 9 aa, Homo Sapiens
NYCPVQNDI

SEQ ID NO: 847392 - protein, 9 aa, Homo Sapiens
RTSGGDGLG

SEQ ID NO: 847393 - protein, 9 aa, Homo Sapiens
PNSCPGEWL

SEQ ID NO: 847394 - protein, 9 aa, Homo Sapiens
IPAHTAEEV

SEQ ID NO: 847395 - protein, 9 aa, Homo Sapiens
EQNNEENVD

SEQ ID NO: 847396 - protein, 9 aa, Homo Sapiens
MAQKRGEAR

SEQ ID NO: 847397 - protein, 9 aa, Homo Sapiens
QTVPSGLST

SEQ ID NO: 847398 - protein, 9 aa, Homo Sapiens
STVLGKSNI

SEQ ID NO: 847399 - protein, 9 aa, Homo Sapiens
TCGCNKGFT

SEQ ID NO: 847400 - protein, 9 aa, Homo Sapiens
AEEEEDAGE

SEQ ID NO: 847401 - protein, 9 aa, Homo Sapiens
IFRDQVLHE

SEQ ID NO: 847402 - protein, 9 aa, Homo Sapiens
FDKLLKYLP

SEQ ID NO: 847403 - protein, 9 aa, Homo Sapiens
VLSENVQNN

SEQ ID NO: 847404 - protein, 9 aa, Homo Sapiens
SVWHRKSLG

SEQ ID NO: 847405 - protein, 9 aa, Homo Sapiens
YASTNMDKV

SEQ ID NO: 847406 - protein, 9 aa, Homo Sapiens
NFLLMTYFD

SEQ ID NO: 847407 - protein, 9 aa, Homo Sapiens
PFNTQRAYT

SEQ ID NO: 847408 - protein, 9 aa, Homo Sapiens
CRKPALIST

SEQ ID NO: 847409 - protein, 9 aa, Homo Sapiens
WLVFDEYLK

SEQ ID NO: 847410 - protein, 9 aa, Homo Sapiens
KVSLMGFGK

SEQ ID NO: 847411 - protein, 9 aa, Homo Sapiens
CAWFLQMKR

SEQ ID NO: 847412 - protein, 9 aa, Homo Sapiens
IKDILPQYV

SEQ ID NO: 847413 - protein, 9 aa, Homo Sapiens
GAPLVVEPT

SEQ ID NO: 847414 - protein, 9 aa, Homo Sapiens
TGMEVSQTN

SEQ ID NO: 847415 - protein, 9 aa, Homo Sapiens
GQTKVLSQC

SEQ ID NO: 847416 - protein, 9 aa, Homo Sapiens
KNIIQINTD

SEQ ID NO: 847417 - protein, 9 aa, Homo Sapiens
KVVSHLVKW

SEQ ID NO: 847418 - protein, 9 aa, Homo Sapiens
DAVNTILRN

SEQ ID NO: 847419 - protein, 9 aa, Homo Sapiens
ITIIYLLSG

SEQ ID NO: 847420 - protein, 9 aa, Homo Sapiens
PDIKEELEE

SEQ ID NO: 847421 - protein, 9 aa, Homo Sapiens
GCLHPWNTW

SEQ ID NO: 847422 - protein, 9 aa, Homo Sapiens
CVFFVKGTN

SEQ ID NO: 847423 - protein, 9 aa, Homo Sapiens
TSCCSTPGV

SEQ ID NO: 847424 - protein, 9 aa, Homo Sapiens
ALPPLDEHV

SEQ ID NO: 847425 - protein, 9 aa, Homo Sapiens
LKQLQIVHQ

SEQ ID NO: 847426 - protein, 9 aa, Homo Sapiens
IYAHKVLLN

SEQ ID NO: 847427 - protein, 9 aa, Homo Sapiens
QGRLGWVRS

SEQ ID NO: 847428 - protein, 9 aa, Homo Sapiens
MPEATPKYS

SEQ ID NO: 847429 - protein, 9 aa, Homo Sapiens
LEADLKHQF

SEQ ID NO: 847430 - protein, 9 aa, Homo Sapiens
QNEFAHYTV

SEQ ID NO: 847431 - protein, 9 aa, Homo Sapiens
VGAQDHIFS

SEQ ID NO: 847432 - protein, 9 aa, Homo Sapiens
EEEASKSVS

SEQ ID NO: 847433 - protein, 9 aa, Homo Sapiens
ENFPNGKVC

SEQ ID NO: 847434 - protein, 9 aa, Homo Sapiens
RWAKLEERS

SEQ ID NO: 847435 - protein, 9 aa, Homo Sapiens
LKSLKKLDQ

SEQ ID NO: 847436 - protein, 9 aa, Homo Sapiens
VKQLCNSTY

SEQ ID NO: 847437 - protein, 9 aa, Homo Sapiens
RQDITKCLF

SEQ ID NO: 847438 - protein, 9 aa, Homo Sapiens
PLCHLQVDG

SEQ ID NO: 847439 - protein, 9 aa, Homo Sapiens
VHFKPNEGS

SEQ ID NO: 847440 - protein, 9 aa, Homo Sapiens
HAIYLLRDA

SEQ ID NO: 847441 - protein, 9 aa, Homo Sapiens
ESKILQKDI

SEQ ID NO: 847442 - protein, 9 aa, Homo Sapiens
FSIKQVGNG

SEQ ID NO: 847443 - protein, 9 aa, Homo Sapiens
HPKTYPNCF

SEQ ID NO: 847444 - protein, 9 aa, Homo Sapiens
VPMCDLYPN

SEQ ID NO: 847445 - protein, 9 aa, Homo Sapiens
AIAHIIAAV

SEQ ID NO: 847446 - protein, 9 aa, Homo Sapiens
FEEIGKIFG

SEQ ID NO: 847447 - protein, 9 aa, Homo Sapiens
LTQQMFDAN

SEQ ID NO: 847448 - protein, 9 aa, Homo Sapiens
ISGTPQRKL

SEQ ID NO: 847449 - protein, 9 aa, Homo Sapiens
WKGINLIQT

SEQ ID NO: 847450 - protein, 9 aa, Homo Sapiens
TQLVKEDEV

SEQ ID NO: 847451 - protein, 9 aa, Homo Sapiens
SCNVENLQI

SEQ ID NO: 847452 - protein, 9 aa, Homo Sapiens
YLFHEVQRQ

SEQ ID NO: 847453 - protein, 9 aa, Homo Sapiens
AEMLTLHTW

SEQ ID NO: 847454 - protein, 9 aa, Homo Sapiens
SPGPDNKYD

SEQ ID NO: 847455 - protein, 9 aa, Homo Sapiens
CLETKVGTE

SEQ ID NO: 847456 - protein, 9 aa, Homo Sapiens
VMNSQQTIL

SEQ ID NO: 847457 - protein, 9 aa, Homo Sapiens
KIFIYNIPP

SEQ ID NO: 847458 - protein, 9 aa, Homo Sapiens
FAIFIILLL

SEQ ID NO: 847459 - protein, 9 aa, Homo Sapiens
PLPPPPPHL

SEQ ID NO: 847460 - protein, 9 aa, Homo Sapiens
TKFLRLFSS

SEQ ID NO: 847461 - protein, 9 aa, Homo Sapiens
GNKIKYDFP

SEQ ID NO: 847462 - protein, 9 aa, Homo Sapiens
LYLGKFSEI

SEQ ID NO: 847463 - protein, 9 aa, Homo Sapiens
GYVPLFDPT

SEQ ID NO: 847464 - protein, 9 aa, Homo Sapiens
IADDYDKNK

SEQ ID NO: 847465 - protein, 9 aa, Homo Sapiens
TLYNNNIET

SEQ ID NO: 847466 - protein, 9 aa, Homo Sapiens
TGDVIDCCV

SEQ ID NO: 847467 - protein, 9 aa, Homo Sapiens
KNREPLKQA

SEQ ID NO: 847468 - protein, 9 aa, Homo Sapiens
MAIYIIPPY

SEQ ID NO: 847469 - protein, 9 aa, Homo Sapiens
LDDNDDREE

SEQ ID NO: 847470 - protein, 9 aa, Homo Sapiens
QHKRFHITD

SEQ ID NO: 847471 - protein, 9 aa, Homo Sapiens
LMVEKHKRE

SEQ ID NO: 847472 - protein, 9 aa, Homo Sapiens
KSCSVLREW

SEQ ID NO: 847473 - protein, 9 aa, Homo Sapiens
KIYKYHVKP

SEQ ID NO: 847474 - protein, 9 aa, Homo Sapiens
PEVVYTNQN

SEQ ID NO: 847475 - protein, 9 aa, Homo Sapiens
KSLVNDNKW

SEQ ID NO: 847476 - protein, 9 aa, Homo Sapiens
SYLSLPNPF

SEQ ID NO: 847477 - protein, 9 aa, Homo Sapiens
GNVDGFKTC

SEQ ID NO: 847478 - protein, 9 aa, Homo Sapiens
AGTWVITMM

SEQ ID NO: 847479 - protein, 9 aa, Homo Sapiens
KITSPEELL

SEQ ID NO: 847480 - protein, 9 aa, Homo Sapiens
PSIANMINK

SEQ ID NO: 847481 - protein, 9 aa, Homo Sapiens
SLYVFNPIV

SEQ ID NO: 847482 - protein, 9 aa, Homo Sapiens
GKHLQFPGC

SEQ ID NO: 847483 - protein, 9 aa, Homo Sapiens
YDVNTSEIT

SEQ ID NO: 847484 - protein, 9 aa, Homo Sapiens
VYPSQRDEV

SEQ ID NO: 847485 - protein, 9 aa, Homo Sapiens
PLMIALLGG

SEQ ID NO: 847486 - protein, 9 aa, Homo Sapiens
GPTPVEKKN

SEQ ID NO: 847487 - protein, 9 aa, Homo Sapiens
VLFILTCML

SEQ ID NO: 847488 - protein, 9 aa, Homo Sapiens
ALASFDFGS

SEQ ID NO: 847489 - protein, 9 aa, Homo Sapiens
TWQIIQAAG

SEQ ID NO: 847490 - protein, 9 aa, Homo Sapiens
IWQIDNFVP

SEQ ID NO: 847491 - protein, 9 aa, Homo Sapiens
CSARFVTDF

SEQ ID NO: 847492 - protein, 9 aa, Homo Sapiens
VAQASLQSI

SEQ ID NO: 847493 - protein, 9 aa, Homo Sapiens
TDYLMQILT

SEQ ID NO: 847494 - protein, 9 aa, Homo Sapiens
SAVNPLLRV

SEQ ID NO: 847495 - protein, 9 aa, Homo Sapiens
IYWTDSHYK

SEQ ID NO: 847496 - protein, 9 aa, Homo Sapiens
RFGVSHRRH

SEQ ID NO: 847497 - protein, 9 aa, Homo Sapiens
PQGNLCHVA

SEQ ID NO: 847498 - protein, 9 aa, Homo Sapiens
QRKMEDDKL

SEQ ID NO: 847499 - protein, 9 aa, Homo Sapiens
FHVFDLFNT

SEQ ID NO: 847500 - protein, 9 aa, Homo Sapiens
AEWCLEHGE

SEQ ID NO: 847501 - protein, 9 aa, Homo Sapiens
EWPFHFYYP

SEQ ID NO: 847502 - protein, 9 aa, Homo Sapiens
LFFKTRYCS

SEQ ID NO: 847503 - protein, 9 aa, Homo Sapiens
TLNGIQLAI

SEQ ID NO: 847504 - protein, 9 aa, Homo Sapiens
LKPLKNYRQ

SEQ ID NO: 847505 - protein, 9 aa, Homo Sapiens
YFFLDVPTN

SEQ ID NO: 847506 - protein, 9 aa, Homo Sapiens
HNHHVIISE

SEQ ID NO: 847507 - protein, 9 aa, Homo Sapiens
RNKLYVSPG

SEQ ID NO: 847508 - protein, 9 aa, Homo Sapiens
ETYCSENKI

SEQ ID NO: 847509 - protein, 9 aa, Homo Sapiens
RTLISHKIV

SEQ ID NO: 847510 - protein, 9 aa, Homo Sapiens
VSPTKRCML

SEQ ID NO: 847511 - protein, 9 aa, Homo Sapiens
CSGTVEVKV

SEQ ID NO: 847512 - protein, 9 aa, Homo Sapiens
NISQRLLLK

SEQ ID NO: 847513 - protein, 9 aa, Homo Sapiens
NCLCLAALS

SEQ ID NO: 847514 - protein, 9 aa, Homo Sapiens
SQTIQNVVL

SEQ ID NO: 847515 - protein, 9 aa, Homo Sapiens
AREFEIDVA

SEQ ID NO: 847516 - protein, 9 aa, Homo Sapiens
AQTPLTGFS

SEQ ID NO: 847517 - protein, 9 aa, Homo Sapiens
HCCVIGYPY

SEQ ID NO: 847518 - protein, 9 aa, Homo Sapiens
IQKAWRCHV

SEQ ID NO: 847519 - protein, 9 aa, Homo Sapiens
ATGQSRVTV

SEQ ID NO: 847520 - protein, 9 aa, Homo Sapiens
DVTYEVLSL

SEQ ID NO: 847521 - protein, 9 aa, Homo Sapiens
PGADKSTQL

SEQ ID NO: 847522 - protein, 9 aa, Homo Sapiens
EPLTNAVQS

SEQ ID NO: 847523 - protein, 9 aa, Homo Sapiens
QKILEIKNN

SEQ ID NO: 847524 - protein, 9 aa, Homo Sapiens
PQYYTQNLP

SEQ ID NO: 847525 - protein, 9 aa, Homo Sapiens
HYLIGLGIK

SEQ ID NO: 847526 - protein, 9 aa, Homo Sapiens
LVKLESKGL

SEQ ID NO: 847527 - protein, 9 aa, Homo Sapiens
GTKTVQEKD

SEQ ID NO: 847528 - protein, 9 aa, Homo Sapiens
CGLRGNELF

SEQ ID NO: 847529 - protein, 9 aa, Homo Sapiens
GTIEDHLHP

SEQ ID NO: 847530 - protein, 9 aa, Homo Sapiens
GQFFTWGNN

SEQ ID NO: 847531 - protein, 9 aa, Homo Sapiens
FFRELAEDK

SEQ ID NO: 847532 - protein, 9 aa, Homo Sapiens
DKHHLTDLS

SEQ ID NO: 847533 - protein, 9 aa, Homo Sapiens
EFSFLQDPW

SEQ ID NO: 847534 - protein, 9 aa, Homo Sapiens
DSKPRYLRF

SEQ ID NO: 847535 - protein, 9 aa, Homo Sapiens
SAADFDDRR

SEQ ID NO: 847536 - protein, 9 aa, Homo Sapiens
RIQRQLARE

SEQ ID NO: 847537 - protein, 9 aa, Homo Sapiens
LRHEEQSGM

SEQ ID NO: 847538 - protein, 9 aa, Homo Sapiens
FQKCPLLPV

SEQ ID NO: 847539 - protein, 9 aa, Homo Sapiens
LNNPINAVT

SEQ ID NO: 847540 - protein, 9 aa, Homo Sapiens
YCGISGIGS

SEQ ID NO: 847541 - protein, 9 aa, Homo Sapiens
RKGTTPSYL

SEQ ID NO: 847542 - protein, 9 aa, Homo Sapiens
VVFVTKEEK

SEQ ID NO: 847543 - protein, 9 aa, Homo Sapiens
NFCEKSFHQ

SEQ ID NO: 847544 - protein, 9 aa, Homo Sapiens
VALFIFFLA

SEQ ID NO: 847545 - protein, 9 aa, Homo Sapiens
KSKSGRSRN

SEQ ID NO: 847546 - protein, 9 aa, Homo Sapiens
TSEHSHFYL

SEQ ID NO: 847547 - protein, 9 aa, Homo Sapiens
LIKTYYGTK

SEQ ID NO: 847548 - protein, 9 aa, Homo Sapiens
SLPPLHRSS

SEQ ID NO: 847549 - protein, 9 aa, Homo Sapiens
FVFSIKQVG

SEQ ID NO: 847550 - protein, 9 aa, Homo Sapiens
TMGSGAEEA

SEQ ID NO: 847551 - protein, 9 aa, Homo Sapiens
SDSSQTKKQ

SEQ ID NO: 847552 - protein, 9 aa, Homo Sapiens
CKKPRKNVN

SEQ ID NO: 847553 - protein, 9 aa, Homo Sapiens
GTLSCNSTP

SEQ ID NO: 847554 - protein, 9 aa, Homo Sapiens
HCGRCIPMQ

SEQ ID NO: 847555 - protein, 9 aa, Homo Sapiens
RKCCDQYPK

SEQ ID NO: 847556 - protein, 9 aa, Homo Sapiens
DSQATKYRS

SEQ ID NO: 847557 - protein, 9 aa, Homo Sapiens
CLYRGLIAL

SEQ ID NO: 847558 - protein, 9 aa, Homo Sapiens
PMILQLGGG

SEQ ID NO: 847559 - protein, 9 aa, Homo Sapiens
IAKYMNHLI

SEQ ID NO: 847560 - protein, 9 aa, Homo Sapiens
RSSSVYRDA

SEQ ID NO: 847561 - protein, 9 aa, Homo Sapiens
VPTVDYYPN

SEQ ID NO: 847562 - protein, 9 aa, Homo Sapiens
SLIQINLHD

SEQ ID NO: 847563 - protein, 9 aa, Homo Sapiens
ISSSTKNYP

SEQ ID NO: 847564 - protein, 9 aa, Homo Sapiens
FGLATVFWY

SEQ ID NO: 847565 - protein, 9 aa, Homo Sapiens
QLPRRVAVP

SEQ ID NO: 847566 - protein, 9 aa, Homo Sapiens
DPNSCPGEW

SEQ ID NO: 847567 - protein, 9 aa, Homo Sapiens
IPLCHLQVD

SEQ ID NO: 847568 - protein, 9 aa, Homo Sapiens
TLFGPQLNP

SEQ ID NO: 847569 - protein, 9 aa, Homo Sapiens
MDFGVFIGW

SEQ ID NO: 847570 - protein, 9 aa, Homo Sapiens
ARLFTSVLR

SEQ ID NO: 847571 - protein, 9 aa, Homo Sapiens
ITFGVRTRD

SEQ ID NO: 847572 - protein, 9 aa, Homo Sapiens
CFRPILKLT

SEQ ID NO: 847573 - protein, 9 aa, Homo Sapiens
RSFPENEED

SEQ ID NO: 847574 - protein, 9 aa, Homo Sapiens
FLDFFPDGA

SEQ ID NO: 847575 - protein, 9 aa, Homo Sapiens
KNNFQNITE

SEQ ID NO: 847576 - protein, 9 aa, Homo Sapiens
NLPATSFSN

SEQ ID NO: 847577 - protein, 9 aa, Homo Sapiens
LVMTLNYLG

SEQ ID NO: 847578 - protein, 9 aa, Homo Sapiens
FSEVHGADN

SEQ ID NO: 847579 - protein, 9 aa, Homo Sapiens
GMDLAACIK

SEQ ID NO: 847580 - protein, 9 aa, Homo Sapiens
LAGTPWPSP

SEQ ID NO: 847581 - protein, 9 aa, Homo Sapiens
AKRTITFHL

SEQ ID NO: 847582 - protein, 9 aa, Homo Sapiens
SLEYYDIEA

SEQ ID NO: 847583 - protein, 9 aa, Homo Sapiens
ATRFKHLRR

SEQ ID NO: 847584 - protein, 9 aa, Homo Sapiens
DEDKLFVET

SEQ ID NO: 847585 - protein, 9 aa, Homo Sapiens
EQLQNLIIS

SEQ ID NO: 847586 - protein, 9 aa, Homo Sapiens
EKIIYPEFN

SEQ ID NO: 847587 - protein, 9 aa, Homo Sapiens
PKSFSSHYT

SEQ ID NO: 847588 - protein, 9 aa, Homo Sapiens
VKCYRGKET

SEQ ID NO: 847589 - protein, 9 aa, Homo Sapiens
ELAHYHAPS

SEQ ID NO: 847590 - protein, 9 aa, Homo Sapiens
MPQIPQTEE

SEQ ID NO: 847591 - protein, 9 aa, Homo Sapiens
LQEVKILAH

SEQ ID NO: 847592 - protein, 9 aa, Homo Sapiens
GSYEILQDT

SEQ ID NO: 847593 - protein, 9 aa, Homo Sapiens
NLIMQETSV

SEQ ID NO: 847594 - protein, 9 aa, Homo Sapiens
DRLYELDIL

SEQ ID NO: 847595 - protein, 9 aa, Homo Sapiens
AMMGALHPR

SEQ ID NO: 847596 - protein, 9 aa, Homo Sapiens
PKKVYLSSD

SEQ ID NO: 847597 - protein, 9 aa, Homo Sapiens
CSGLHSLRH

SEQ ID NO: 847598 - protein, 9 aa, Homo Sapiens
PQTVATPLN

SEQ ID NO: 847599 - protein, 9 aa, Homo Sapiens
ILQDTDEDT

SEQ ID NO: 847600 - protein, 9 aa, Homo Sapiens
LTIDNVTLA

SEQ ID NO: 847601 - protein, 9 aa, Homo Sapiens
VSADSKGVD

SEQ ID NO: 847602 - protein, 9 aa, Homo Sapiens
AYRYCKPLS

SEQ ID NO: 847603 - protein, 9 aa, Homo Sapiens
AMQWPFCGN

SEQ ID NO: 847604 - protein, 9 aa, Homo Sapiens
EGGKAFRAH

SEQ ID NO: 847605 - protein, 9 aa, Homo Sapiens
PTSPDYSPT

SEQ ID NO: 847606 - protein, 9 aa, Homo Sapiens
DVSLTIDNV

SEQ ID NO: 847607 - protein, 9 aa, Homo Sapiens
FYTMVILML

SEQ ID NO: 847608 - protein, 9 aa, Homo Sapiens
KVCGVMLQF

SEQ ID NO: 847609 - protein, 9 aa, Homo Sapiens
LKEFVKEKE

SEQ ID NO: 847610 - protein, 9 aa, Homo Sapiens
DPHLETVYT

SEQ ID NO: 847611 - protein, 9 aa, Homo Sapiens
TGSACACSL

SEQ ID NO: 847612 - protein, 9 aa, Homo Sapiens
PLLEEEAAF

SEQ ID NO: 847613 - protein, 9 aa, Homo Sapiens
SMYYIPAGS

SEQ ID NO: 847614 - protein, 9 aa, Homo Sapiens
LHFAIQDIS

SEQ ID NO: 847615 - protein, 9 aa, Homo Sapiens
GGEPRMLGA

SEQ ID NO: 847616 - protein, 9 aa, Homo Sapiens
VEYVRQLLL

SEQ ID NO: 847617 - protein, 9 aa, Homo Sapiens
FRQIANANE

SEQ ID NO: 847618 - protein, 9 aa, Homo Sapiens
DRRYEVARA

SEQ ID NO: 847619 - protein, 9 aa, Homo Sapiens
KAFSCGSGL

SEQ ID NO: 847620 - protein, 9 aa, Homo Sapiens
VISSLEINI

SEQ ID NO: 847621 - protein, 9 aa, Homo Sapiens
PDIRRRLRM

SEQ ID NO: 847622 - protein, 9 aa, Homo Sapiens
ARFYWNVSR

SEQ ID NO: 847623 - protein, 9 aa, Homo Sapiens
DELVQIGHE

SEQ ID NO: 847624 - protein, 9 aa, Homo Sapiens
KWAAQTTDG

SEQ ID NO: 847625 - protein, 9 aa, Homo Sapiens
GEFKELVQK

SEQ ID NO: 847626 - protein, 9 aa, Homo Sapiens
ILKRNLYSA

SEQ ID NO: 847627 - protein, 9 aa, Homo Sapiens
FGVVLADSS

SEQ ID NO: 847628 - protein, 9 aa, Homo Sapiens
QEEIDTVLP

SEQ ID NO: 847629 - protein, 9 aa, Homo Sapiens
GNYGSPLEL

SEQ ID NO: 847630 - protein, 9 aa, Homo Sapiens
VTQNCRVTF

SEQ ID NO: 847631 - protein, 9 aa, Homo Sapiens
DCSQCIDSL

SEQ ID NO: 847632 - protein, 9 aa, Homo Sapiens
GVPNLPEIP

SEQ ID NO: 847633 - protein, 9 aa, Homo Sapiens
DGTQGPPGS

SEQ ID NO: 847634 - protein, 9 aa, Homo Sapiens
FILKVLEDE

SEQ ID NO: 847635 - protein, 9 aa, Homo Sapiens
FVAKSGACN

SEQ ID NO: 847636 - protein, 9 aa, Homo Sapiens
MAETTELMT

SEQ ID NO: 847637 - protein, 9 aa, Homo Sapiens
TSTRITLLV

SEQ ID NO: 847638 - protein, 9 aa, Homo Sapiens
EKLFWDLIY

SEQ ID NO: 847639 - protein, 9 aa, Homo Sapiens
NAELTANKR

SEQ ID NO: 847640 - protein, 9 aa, Homo Sapiens
HSHFHNIFW

SEQ ID NO: 847641 - protein, 9 aa, Homo Sapiens
LVATGTHEC

SEQ ID NO: 847642 - protein, 9 aa, Homo Sapiens
NKNNTFNAL

SEQ ID NO: 847643 - protein, 9 aa, Homo Sapiens
APALLRPSI

SEQ ID NO: 847644 - protein, 9 aa, Homo Sapiens
TLPFWVHAG

SEQ ID NO: 847645 - protein, 9 aa, Homo Sapiens
LENVESIVK

SEQ ID NO: 847646 - protein, 9 aa, Homo Sapiens
IRKNGRMVN

SEQ ID NO: 847647 - protein, 9 aa, Homo Sapiens
IYRESDLDQ

SEQ ID NO: 847648 - protein, 9 aa, Homo Sapiens
PPGQITNLK

SEQ ID NO: 847649 - protein, 9 aa, Homo Sapiens
KTLCLLKIH

SEQ ID NO: 847650 - protein, 9 aa, Homo Sapiens
STSPSRPKA

SEQ ID NO: 847651 - protein, 9 aa, Homo Sapiens
HEREVAGTL

SEQ ID NO: 847652 - protein, 9 aa, Homo Sapiens
VPYIMEAVR

SEQ ID NO: 847653 - protein, 9 aa, Homo Sapiens
YIYYSNFHA

SEQ ID NO: 847654 - protein, 9 aa, Homo Sapiens
IQNVVLMPV

SEQ ID NO: 847655 - protein, 9 aa, Homo Sapiens
TVIILTFTC

SEQ ID NO: 847656 - protein, 9 aa, Homo Sapiens
RKQTCHFST

SEQ ID NO: 847657 - protein, 9 aa, Homo Sapiens
ITNGPEKTS

SEQ ID NO: 847658 - protein, 9 aa, Homo Sapiens
PGNTLGYFG

SEQ ID NO: 847659 - protein, 9 aa, Homo Sapiens
TTGPFCVNH

SEQ ID NO: 847660 - protein, 9 aa, Homo Sapiens
NYGEVQTNI

SEQ ID NO: 847661 - protein, 9 aa, Homo Sapiens
TLVVLDTDA

SEQ ID NO: 847662 - protein, 9 aa, Homo Sapiens
SQLHQVDSD

SEQ ID NO: 847663 - protein, 9 aa, Homo Sapiens
QQIYYKTLT

SEQ ID NO: 847664 - protein, 9 aa, Homo Sapiens
GVSTFWNKP

SEQ ID NO: 847665 - protein, 9 aa, Homo Sapiens
KEKKTWGTV

SEQ ID NO: 847666 - protein, 9 aa, Homo Sapiens
DSDGDGIGN

SEQ ID NO: 847667 - protein, 9 aa, Homo Sapiens
LPGRLGPWR

SEQ ID NO: 847668 - protein, 9 aa, Homo Sapiens
YKTAAEMVD

SEQ ID NO: 847669 - protein, 9 aa, Homo Sapiens
VTNHWAVLS

SEQ ID NO: 847670 - protein, 9 aa, Homo Sapiens
GGAMVWGLD

SEQ ID NO: 847671 - protein, 9 aa, Homo Sapiens
VPPSCCSGL

SEQ ID NO: 847672 - protein, 9 aa, Homo Sapiens
EEQNKPYYD

SEQ ID NO: 847673 - protein, 9 aa, Homo Sapiens
SYFTKKASY

SEQ ID NO: 847674 - protein, 9 aa, Homo Sapiens
DFVQAIIVN

SEQ ID NO: 847675 - protein, 9 aa, Homo Sapiens
GSSEKGSHM

SEQ ID NO: 847676 - protein, 9 aa, Homo Sapiens
NEAQEILAR

SEQ ID NO: 847677 - protein, 9 aa, Homo Sapiens
GINGEGSTF

SEQ ID NO: 847678 - protein, 9 aa, Homo Sapiens
EHKPGGDLE

SEQ ID NO: 847679 - protein, 9 aa, Homo Sapiens
KDQQIAVTL

SEQ ID NO: 847680 - protein, 9 aa, Homo Sapiens
WVWAGLGGR

SEQ ID NO: 847681 - protein, 9 aa, Homo Sapiens
RAMANCNSL

SEQ ID NO: 847682 - protein, 9 aa, Homo Sapiens
ATSMFETID

SEQ ID NO: 847683 - protein, 9 aa, Homo Sapiens
FHDAEESKA

SEQ ID NO: 847684 - protein, 9 aa, Homo Sapiens
YPSLVQGRI

SEQ ID NO: 847685 - protein, 9 aa, Homo Sapiens
DKAIHHLIE

SEQ ID NO: 847686 - protein, 9 aa, Homo Sapiens
TPLLDFPVT

SEQ ID NO: 847687 - protein, 9 aa, Homo Sapiens
HLSCDASPL

SEQ ID NO: 847688 - protein, 9 aa, Homo Sapiens
ICAGYETTS

SEQ ID NO: 847689 - protein, 9 aa, Homo Sapiens
PLPSLEYLD

SEQ ID NO: 847690 - protein, 9 aa, Homo Sapiens
RIRCSPQKT

SEQ ID NO: 847691 - protein, 9 aa, Homo Sapiens
REQVKELLN

SEQ ID NO: 847692 - protein, 9 aa, Homo Sapiens
YKTAEENEK

SEQ ID NO: 847693 - protein, 9 aa, Homo Sapiens
RPSRSNTAC

SEQ ID NO: 847694 - protein, 9 aa, Homo Sapiens
SSSANEFSK

SEQ ID NO: 847695 - protein, 9 aa, Homo Sapiens
EPGTMDSIQ

SEQ ID NO: 847696 - protein, 9 aa, Homo Sapiens
GNLFMSFQS

SEQ ID NO: 847697 - protein, 9 aa, Homo Sapiens
PAAAPNFSF

SEQ ID NO: 847698 - protein, 9 aa, Homo Sapiens
VDGKNKSEY

SEQ ID NO: 847699 - protein, 9 aa, Homo Sapiens
PVQKKYKNR

SEQ ID NO: 847700 - protein, 9 aa, Homo Sapiens
KDILAWKVS

SEQ ID NO: 847701 - protein, 9 aa, Homo Sapiens
HGLRHKCGV

SEQ ID NO: 847702 - protein, 9 aa, Homo Sapiens
LIFSHLHKL

SEQ ID NO: 847703 - protein, 9 aa, Homo Sapiens
FLTRIADLF

SEQ ID NO: 847704 - protein, 9 aa, Homo Sapiens
LSEKAILQA

SEQ ID NO: 847705 - protein, 9 aa, Homo Sapiens
NYFWQQVLA

SEQ ID NO: 847706 - protein, 9 aa, Homo Sapiens
ETLGGDKLA

SEQ ID NO: 847707 - protein, 9 aa, Homo Sapiens
LPERQPCFI

SEQ ID NO: 847708 - protein, 9 aa, Homo Sapiens
QSMRGNGKK

SEQ ID NO: 847709 - protein, 9 aa, Homo Sapiens
PLGEVGNYL

SEQ ID NO: 847710 - protein, 9 aa, Homo Sapiens
SKTYSTKIE

SEQ ID NO: 847711 - protein, 9 aa, Homo Sapiens
KLSTSALKG

SEQ ID NO: 847712 - protein, 9 aa, Homo Sapiens
VRWISQGNY

SEQ ID NO: 847713 - protein, 9 aa, Homo Sapiens
DKAATPIKD

SEQ ID NO: 847714 - protein, 9 aa, Homo Sapiens
SFSDADIQK

SEQ ID NO: 847715 - protein, 9 aa, Homo Sapiens
RTHGKNYLN

SEQ ID NO: 847716 - protein, 9 aa, Homo Sapiens
TKDLQNGMI

SEQ ID NO: 847717 - protein, 9 aa, Homo Sapiens
ICKDKRVLV

SEQ ID NO: 847718 - protein, 9 aa, Homo Sapiens
TMPESDLGT

SEQ ID NO: 847719 - protein, 9 aa, Homo Sapiens
VPLIQLSCS

SEQ ID NO: 847720 - protein, 9 aa, Homo Sapiens
TGFQYEMVR

SEQ ID NO: 847721 - protein, 9 aa, Homo Sapiens
LQQIAMLWG

SEQ ID NO: 847722 - protein, 9 aa, Homo Sapiens
KDILTFKEH

SEQ ID NO: 847723 - protein, 9 aa, Homo Sapiens
LCMDAKINV

SEQ ID NO: 847724 - protein, 9 aa, Homo Sapiens
RQISCKAEV

SEQ ID NO: 847725 - protein, 9 aa, Homo Sapiens
IMDQANRPH

SEQ ID NO: 847726 - protein, 9 aa, Homo Sapiens
RVIIVRRNL

SEQ ID NO: 847727 - protein, 9 aa, Homo Sapiens
FILIKSELE

SEQ ID NO: 847728 - protein, 9 aa, Homo Sapiens
AFLPLPAPA

SEQ ID NO: 847729 - protein, 9 aa, Homo Sapiens
TNSNAYMLL

SEQ ID NO: 847730 - protein, 9 aa, Homo Sapiens
EQLWKVNPA

SEQ ID NO: 847731 - protein, 9 aa, Homo Sapiens
SISFQTEKL

SEQ ID NO: 847732 - protein, 9 aa, Homo Sapiens
NINECDVEP

SEQ ID NO: 847733 - protein, 9 aa, Homo Sapiens
VQEQTTAFL

SEQ ID NO: 847734 - protein, 9 aa, Homo Sapiens
TLALTSRVC

SEQ ID NO: 847735 - protein, 9 aa, Homo Sapiens
GGIGLAMLV

SEQ ID NO: 847736 - protein, 9 aa, Homo Sapiens
HCFQTHERP

SEQ ID NO: 847737 - protein, 9 aa, Homo Sapiens
ASNKTIYTY

SEQ ID NO: 847738 - protein, 9 aa, Homo Sapiens
LWLEFFLTS

SEQ ID NO: 847739 - protein, 9 aa, Homo Sapiens
FVLFTGFKP

SEQ ID NO: 847740 - protein, 9 aa, Homo Sapiens
SKEQHARKK

SEQ ID NO: 847741 - protein, 9 aa, Homo Sapiens
LKVVKKPKS

SEQ ID NO: 847742 - protein, 9 aa, Homo Sapiens
THECSLWGS

SEQ ID NO: 847743 - protein, 9 aa, Homo Sapiens
GNACDNCPQ

SEQ ID NO: 847744 - protein, 9 aa, Homo Sapiens
GTQTYPVGT

SEQ ID NO: 847745 - protein, 9 aa, Homo Sapiens
ISELPIRPV

SEQ ID NO: 847746 - protein, 9 aa, Homo Sapiens
NRGITDGGD

SEQ ID NO: 847747 - protein, 9 aa, Homo Sapiens
PVPFSTFRR

SEQ ID NO: 847748 - protein, 9 aa, Homo Sapiens
GIAMAVLGH

SEQ ID NO: 847749 - protein, 9 aa, Homo Sapiens
GIKFIRQFI

SEQ ID NO: 847750 - protein, 9 aa, Homo Sapiens
IKLLQTRPL

SEQ ID NO: 847751 - protein, 9 aa, Homo Sapiens
RCPERQSGH

SEQ ID NO: 847752 - protein, 9 aa, Homo Sapiens
TVQGPAYLR

SEQ ID NO: 847753 - protein, 9 aa, Homo Sapiens
ILEGNQIEI

SEQ ID NO: 847754 - protein, 9 aa, Homo Sapiens
GTRGCHPSH

SEQ ID NO: 847755 - protein, 9 aa, Homo Sapiens
MMGALHPRA

SEQ ID NO: 847756 - protein, 9 aa, Homo Sapiens
LGKRADNPH

SEQ ID NO: 847757 - protein, 9 aa, Homo Sapiens
LGMIGIFGA

SEQ ID NO: 847758 - protein, 9 aa, Homo Sapiens
RDAETDQIM

SEQ ID NO: 847759 - protein, 9 aa, Homo Sapiens
EEVVPTPPL

SEQ ID NO: 847760 - protein, 9 aa, Homo Sapiens
LLPPSIISL

SEQ ID NO: 847761 - protein, 9 aa, Homo Sapiens
DQLFGYMQM

SEQ ID NO: 847762 - protein, 9 aa, Homo Sapiens
TEWIANCQR

SEQ ID NO: 847763 - protein, 9 aa, Homo Sapiens
MSASQNLEP

SEQ ID NO: 847764 - protein, 9 aa, Homo Sapiens
IDGSFKIGN

SEQ ID NO: 847765 - protein, 9 aa, Homo Sapiens
VCSISNPDC

SEQ ID NO: 847766 - protein, 9 aa, Homo Sapiens
PPSLVPLAV

SEQ ID NO: 847767 - protein, 9 aa, Homo Sapiens
SCPSEAIRI

SEQ ID NO: 847768 - protein, 9 aa, Homo Sapiens
FEEKVAQAV

SEQ ID NO: 847769 - protein, 9 aa, Homo Sapiens
VKITLRNLN

SEQ ID NO: 847770 - protein, 9 aa, Homo Sapiens
ENKTKENPL

SEQ ID NO: 847771 - protein, 9 aa, Homo Sapiens
PPSIISLEF

SEQ ID NO: 847772 - protein, 9 aa, Homo Sapiens
AELDKITRK

SEQ ID NO: 847773 - protein, 9 aa, Homo Sapiens
MRVLAVLSV

SEQ ID NO: 847774 - protein, 9 aa, Homo Sapiens
IRQDLMRRQ

SEQ ID NO: 847775 - protein, 9 aa, Homo Sapiens
PSSVFRNGL

SEQ ID NO: 847776 - protein, 9 aa, Homo Sapiens
EENKEYAHT

SEQ ID NO: 847777 - protein, 9 aa, Homo Sapiens
KATVKDEPQ

SEQ ID NO: 847778 - protein, 9 aa, Homo Sapiens
HTVTHVHMH

SEQ ID NO: 847779 - protein, 9 aa, Homo Sapiens
QVIESGILL

SEQ ID NO: 847780 - protein, 9 aa, Homo Sapiens
LPSSGHRSS

SEQ ID NO: 847781 - protein, 9 aa, Homo Sapiens
TVFIADLLI

SEQ ID NO: 847782 - protein, 9 aa, Homo Sapiens
KSDGEENIG

SEQ ID NO: 847783 - protein, 9 aa, Homo Sapiens
AFTEREASK

SEQ ID NO: 847784 - protein, 9 aa, Homo Sapiens
SVNNVLCNG

SEQ ID NO: 847785 - protein, 9 aa, Homo Sapiens
ECGVAFSRS

SEQ ID NO: 847786 - protein, 9 aa, Homo Sapiens
VATVSSSVL

SEQ ID NO: 847787 - protein, 9 aa, Homo Sapiens
WQMQCSEFD

SEQ ID NO: 847788 - protein, 9 aa, Homo Sapiens
MLDGATFHQ

SEQ ID NO: 847789 - protein, 9 aa, Homo Sapiens
LVTTPTSLQ

SEQ ID NO: 847790 - protein, 9 aa, Homo Sapiens
SEGYRHISA

SEQ ID NO: 847791 - protein, 9 aa, Homo Sapiens
ASEENVEHI

SEQ ID NO: 847792 - protein, 9 aa, Homo Sapiens
QVIRMSHKN

SEQ ID NO: 847793 - protein, 9 aa, Homo Sapiens
CEFHEASTA

SEQ ID NO: 847794 - protein, 9 aa, Homo Sapiens
LINQSQGSR

SEQ ID NO: 847795 - protein, 9 aa, Homo Sapiens
AKVTMNDFN

SEQ ID NO: 847796 - protein, 9 aa, Homo Sapiens
SQKENTGQH

SEQ ID NO: 847797 - protein, 9 aa, Homo Sapiens
FVSKLFEHH

SEQ ID NO: 847798 - protein, 9 aa, Homo Sapiens
RDMVTTAGI

SEQ ID NO: 847799 - protein, 9 aa, Homo Sapiens
GGYNQYSYG

SEQ ID NO: 847800 - protein, 9 aa, Homo Sapiens
WSEFKTLPE

SEQ ID NO: 847801 - protein, 9 aa, Homo Sapiens
EEVKQQLEN

SEQ ID NO: 847802 - protein, 9 aa, Homo Sapiens
IMFPPDCPV

SEQ ID NO: 847803 - protein, 9 aa, Homo Sapiens
QMDQNIEYE

SEQ ID NO: 847804 - protein, 9 aa, Homo Sapiens
TKSKLPIIE

SEQ ID NO: 847805 - protein, 9 aa, Homo Sapiens
ENKNYYVGS

SEQ ID NO: 847806 - protein, 9 aa, Homo Sapiens
QIPYIEQVS

SEQ ID NO: 847807 - protein, 9 aa, Homo Sapiens
SSLLETLYQ

SEQ ID NO: 847808 - protein, 9 aa, Homo Sapiens
DIKDEDLKL

SEQ ID NO: 847809 - protein, 9 aa, Homo Sapiens
LQILSSVLQ

SEQ ID NO: 847810 - protein, 9 aa, Homo Sapiens
PTKRCMLQA

SEQ ID NO: 847811 - protein, 9 aa, Homo Sapiens
EAGPSQRHS

SEQ ID NO: 847812 - protein, 9 aa, Homo Sapiens
RKSSVSGIC

SEQ ID NO: 847813 - protein, 9 aa, Homo Sapiens
ASTDILERA

SEQ ID NO: 847814 - protein, 9 aa, Homo Sapiens
IPRRLIDRI

SEQ ID NO: 847815 - protein, 9 aa, Homo Sapiens
AGLEFPPKK

SEQ ID NO: 847816 - protein, 9 aa, Homo Sapiens
DKTGIEEAN

SEQ ID NO: 847817 - protein, 9 aa, Homo Sapiens
TFEEDQRCL

SEQ ID NO: 847818 - protein, 9 aa, Homo Sapiens
AQNALGVLS

SEQ ID NO: 847819 - protein, 9 aa, Homo Sapiens
PIGSSGFFL

SEQ ID NO: 847820 - protein, 9 aa, Homo Sapiens
EKTAAKLRK

SEQ ID NO: 847821 - protein, 9 aa, Homo Sapiens
TLNCHLPAI

SEQ ID NO: 847822 - protein, 9 aa, Homo Sapiens
CYWDSGNIT

SEQ ID NO: 847823 - protein, 9 aa, Homo Sapiens
SLVHGKPKY

SEQ ID NO: 847824 - protein, 9 aa, Homo Sapiens
QRQRAKRNT

SEQ ID NO: 847825 - protein, 9 aa, Homo Sapiens
SYDVDANQI

SEQ ID NO: 847826 - protein, 9 aa, Homo Sapiens
AFRCASSVQ

SEQ ID NO: 847827 - protein, 9 aa, Homo Sapiens
TTGIQSELF

SEQ ID NO: 847828 - protein, 9 aa, Homo Sapiens
RSTSPIYHQ

SEQ ID NO: 847829 - protein, 9 aa, Homo Sapiens
QDVVPPPNP

SEQ ID NO: 847830 - protein, 9 aa, Homo Sapiens
LEILFTTVS

SEQ ID NO: 847831 - protein, 9 aa, Homo Sapiens
SSLQKQVLS

SEQ ID NO: 847832 - protein, 9 aa, Homo Sapiens
YRINRAQEH

SEQ ID NO: 847833 - protein, 9 aa, Homo Sapiens
SWSGDPFIK

SEQ ID NO: 847834 - protein, 9 aa, Homo Sapiens
TQIIRSCKA

SEQ ID NO: 847835 - protein, 9 aa, Homo Sapiens
LALTSLFSL

SEQ ID NO: 847836 - protein, 9 aa, Homo Sapiens
GNTVFPVLQ

SEQ ID NO: 847837 - protein, 9 aa, Homo Sapiens
AISSLPLPI

SEQ ID NO: 847838 - protein, 9 aa, Homo Sapiens
GYSVTSFTT

SEQ ID NO: 847839 - protein, 9 aa, Homo Sapiens
AFDWISKNI

SEQ ID NO: 847840 - protein, 9 aa, Homo Sapiens
RWGFIPLVM

SEQ ID NO: 847841 - protein, 9 aa, Homo Sapiens
INMFNNPAT

SEQ ID NO: 847842 - protein, 9 aa, Homo Sapiens
SSTTVYSEE

SEQ ID NO: 847843 - protein, 9 aa, Homo Sapiens
IYYIPLEDD

SEQ ID NO: 847844 - protein, 9 aa, Homo Sapiens
ELVQKDLQN

SEQ ID NO: 847845 - protein, 9 aa, Homo Sapiens
LSDLNKQVL

SEQ ID NO: 847846 - protein, 9 aa, Homo Sapiens
GIKLLETSA

SEQ ID NO: 847847 - protein, 9 aa, Homo Sapiens
RMIMAAVPV

SEQ ID NO: 847848 - protein, 9 aa, Homo Sapiens
IIYTGEEPD

SEQ ID NO: 847849 - protein, 9 aa, Homo Sapiens
EPYWSPAMA

SEQ ID NO: 847850 - protein, 9 aa, Homo Sapiens
HGHEYYGDY

SEQ ID NO: 847851 - protein, 9 aa, Homo Sapiens
RLVVLHTFM

SEQ ID NO: 847852 - protein, 9 aa, Homo Sapiens
CIVETEHLE

SEQ ID NO: 847853 - protein, 9 aa, Homo Sapiens
AHKKFNIKI

SEQ ID NO: 847854 - protein, 9 aa, Homo Sapiens
KNDRKEDKE

SEQ ID NO: 847855 - protein, 9 aa, Homo Sapiens
SALKGLTKV

SEQ ID NO: 847856 - protein, 9 aa, Homo Sapiens
MFENHMYIF

SEQ ID NO: 847857 - protein, 9 aa, Homo Sapiens
TEMRLIRFQ

SEQ ID NO: 847858 - protein, 9 aa, Homo Sapiens
IVIDSIDHV

SEQ ID NO: 847859 - protein, 9 aa, Homo Sapiens
SLIQLVGPS

SEQ ID NO: 847860 - protein, 9 aa, Homo Sapiens
TNVQSHMIR

SEQ ID NO: 847861 - protein, 9 aa, Homo Sapiens
FPGVAAAVA

SEQ ID NO: 847862 - protein, 9 aa, Homo Sapiens
YVLQYNSFP

SEQ ID NO: 847863 - protein, 9 aa, Homo Sapiens
CLFDDDLVL

SEQ ID NO: 847864 - protein, 9 aa, Homo Sapiens
ITELNDRSK

SEQ ID NO: 847865 - protein, 9 aa, Homo Sapiens
PVNIRFCLE

SEQ ID NO: 847866 - protein, 9 aa, Homo Sapiens
VHRLPEKNW

SEQ ID NO: 847867 - protein, 9 aa, Homo Sapiens
ETTSTTLIY

SEQ ID NO: 847868 - protein, 9 aa, Homo Sapiens
SCHVEKLAR

SEQ ID NO: 847869 - protein, 9 aa, Homo Sapiens
DTPRINSSS

SEQ ID NO: 847870 - protein, 9 aa, Homo Sapiens
SQFSGAAQA

SEQ ID NO: 847871 - protein, 9 aa, Homo Sapiens
ENIQKDLET

SEQ ID NO: 847872 - protein, 9 aa, Homo Sapiens
SQVAMKQNK

SEQ ID NO: 847873 - protein, 9 aa, Homo Sapiens
FTTILIIFA

SEQ ID NO: 847874 - protein, 9 aa, Homo Sapiens
RIQRTFAAC

SEQ ID NO: 847875 - protein, 9 aa, Homo Sapiens
VHLLCCCLS

SEQ ID NO: 847876 - protein, 9 aa, Homo Sapiens
KLNNEDNDI

SEQ ID NO: 847877 - protein, 9 aa, Homo Sapiens
YPTNSYGVL

SEQ ID NO: 847878 - protein, 9 aa, Homo Sapiens
KVYRALWCG

SEQ ID NO: 847879 - protein, 9 aa, Homo Sapiens
EELIAIMTG

SEQ ID NO: 847880 - protein, 9 aa, Homo Sapiens
RTFKLTLQA

SEQ ID NO: 847881 - protein, 9 aa, Homo Sapiens
GLGHSAKLA

SEQ ID NO: 847882 - protein, 9 aa, Homo Sapiens
LRMSKGLDA

SEQ ID NO: 847883 - protein, 9 aa, Homo Sapiens
TLWGAINGE

SEQ ID NO: 847884 - protein, 9 aa, Homo Sapiens
MSTAINFGT

SEQ ID NO: 847885 - protein, 9 aa, Homo Sapiens
EPPTKSMME

SEQ ID NO: 847886 - protein, 9 aa, Homo Sapiens
RDRGRDRSS

SEQ ID NO: 847887 - protein, 9 aa, Homo Sapiens
IMRMLKLII

SEQ ID NO: 847888 - protein, 9 aa, Homo Sapiens
KEIFAFKDL

SEQ ID NO: 847889 - protein, 9 aa, Homo Sapiens
LSAACHGNL

SEQ ID NO: 847890 - protein, 9 aa, Homo Sapiens
KRIKNQLGL

SEQ ID NO: 847891 - protein, 9 aa, Homo Sapiens
NSVIQVLSH

SEQ ID NO: 847892 - protein, 9 aa, Homo Sapiens
EPVCFEMTD

SEQ ID NO: 847893 - protein, 9 aa, Homo Sapiens
DCFSKHDII

SEQ ID NO: 847894 - protein, 9 aa, Homo Sapiens
VSHLVKWVT

SEQ ID NO: 847895 - protein, 9 aa, Homo Sapiens
WELFKQRRL

SEQ ID NO: 847896 - protein, 9 aa, Homo Sapiens
LTESLLFEQ

SEQ ID NO: 847897 - protein, 9 aa, Homo Sapiens
KALESMDLS

SEQ ID NO: 847898 - protein, 9 aa, Homo Sapiens
GLFAIIVLM

SEQ ID NO: 847899 - protein, 9 aa, Homo Sapiens
VSNFVDNRY

SEQ ID NO: 847900 - protein, 9 aa, Homo Sapiens
FCGQRKKYA

SEQ ID NO: 847901 - protein, 9 aa, Homo Sapiens
SDISDNVPT

SEQ ID NO: 847902 - protein, 9 aa, Homo Sapiens
GSPTLLSRE

SEQ ID NO: 847903 - protein, 9 aa, Homo Sapiens
ETLWGAING

SEQ ID NO: 847904 - protein, 9 aa, Homo Sapiens
VCYKKCVTQ

SEQ ID NO: 847905 - protein, 9 aa, Homo Sapiens
SKINTLLRN

SEQ ID NO: 847906 - protein, 9 aa, Homo Sapiens
SGKHFINTN

SEQ ID NO: 847907 - protein, 9 aa, Homo Sapiens
AFQRSAILV

SEQ ID NO: 847908 - protein, 9 aa, Homo Sapiens
IIFICAGYE

SEQ ID NO: 847909 - protein, 9 aa, Homo Sapiens
LLENAMLCA

SEQ ID NO: 847910 - protein, 9 aa, Homo Sapiens
QANHEKLQE

SEQ ID NO: 847911 - protein, 9 aa, Homo Sapiens
GQDKIQPLW

SEQ ID NO: 847912 - protein, 9 aa, Homo Sapiens
TYPVYRGSS

SEQ ID NO: 847913 - protein, 9 aa, Homo Sapiens
QYQNCIAAE

SEQ ID NO: 847914 - protein, 9 aa, Homo Sapiens
LSTDTNKAS

SEQ ID NO: 847915 - protein, 9 aa, Homo Sapiens
GEASERDTH

SEQ ID NO: 847916 - protein, 9 aa, Homo Sapiens
LQFQICYGL

SEQ ID NO: 847917 - protein, 9 aa, Homo Sapiens
RAATPLLMG

SEQ ID NO: 847918 - protein, 9 aa, Homo Sapiens
ASVLQGYNN

SEQ ID NO: 847919 - protein, 9 aa, Homo Sapiens
TSVFKNAMY

SEQ ID NO: 847920 - protein, 9 aa, Homo Sapiens
EVKRLMFQI

SEQ ID NO: 847921 - protein, 9 aa, Homo Sapiens
TILVKHMKY

SEQ ID NO: 847922 - protein, 9 aa, Homo Sapiens
QRINTDDKP

SEQ ID NO: 847923 - protein, 9 aa, Homo Sapiens
KEKREDVKL

SEQ ID NO: 847924 - protein, 9 aa, Homo Sapiens
RGIISGTCP

SEQ ID NO: 847925 - protein, 9 aa, Homo Sapiens
GSLLFGDVA

SEQ ID NO: 847926 - protein, 9 aa, Homo Sapiens
APEISSNVC

SEQ ID NO: 847927 - protein, 9 aa, Homo Sapiens
MTHPEFIIL

SEQ ID NO: 847928 - protein, 9 aa, Homo Sapiens
TNIWKKQEE

SEQ ID NO: 847929 - protein, 9 aa, Homo Sapiens
FPWIIHAYS

SEQ ID NO: 847930 - protein, 9 aa, Homo Sapiens
CPFYLIHLQ

SEQ ID NO: 847931 - protein, 9 aa, Homo Sapiens
ETFDFNIKF

SEQ ID NO: 847932 - protein, 9 aa, Homo Sapiens
KEKANIEDE

SEQ ID NO: 847933 - protein, 9 aa, Homo Sapiens
KIKSNKRTP

SEQ ID NO: 847934 - protein, 9 aa, Homo Sapiens
LVLSFFYHY

SEQ ID NO: 847935 - protein, 9 aa, Homo Sapiens
IILEQAFYL

SEQ ID NO: 847936 - protein, 9 aa, Homo Sapiens
TLGSCPSEA

SEQ ID NO: 847937 - protein, 9 aa, Homo Sapiens
MSPIINKTQ

SEQ ID NO: 847938 - protein, 9 aa, Homo Sapiens
TLEMEKQEF

SEQ ID NO: 847939 - protein, 9 aa, Homo Sapiens
NNWIEGEEW

SEQ ID NO: 847940 - protein, 9 aa, Homo Sapiens
QQSQLVVDW

SEQ ID NO: 847941 - protein, 9 aa, Homo Sapiens
VLEAKKIKC

SEQ ID NO: 847942 - protein, 9 aa, Homo Sapiens
MPVDPNKPT

SEQ ID NO: 847943 - protein, 9 aa, Homo Sapiens
QLSQEAQII

SEQ ID NO: 847944 - protein, 9 aa, Homo Sapiens
LTKDLQNGM

SEQ ID NO: 847945 - protein, 9 aa, Homo Sapiens
EEVLDQGDL

SEQ ID NO: 847946 - protein, 9 aa, Homo Sapiens
SKPLPDRPT

SEQ ID NO: 847947 - protein, 9 aa, Homo Sapiens
YSGPSKMRD

SEQ ID NO: 847948 - protein, 9 aa, Homo Sapiens
QCNLSDRQA

SEQ ID NO: 847949 - protein, 9 aa, Homo Sapiens
HNLSDVDAF

SEQ ID NO: 847950 - protein, 9 aa, Homo Sapiens
YSSPAAARL

SEQ ID NO: 847951 - protein, 9 aa, Homo Sapiens
GPWGWNLRW

SEQ ID NO: 847952 - protein, 9 aa, Homo Sapiens
QVNHLKIPV

SEQ ID NO: 847953 - protein, 9 aa, Homo Sapiens
TLPDSLTFN

SEQ ID NO: 847954 - protein, 9 aa, Homo Sapiens
HQVKQHILI

SEQ ID NO: 847955 - protein, 9 aa, Homo Sapiens
KWLYGLLPW

SEQ ID NO: 847956 - protein, 9 aa, Homo Sapiens
PVCCVKSII

SEQ ID NO: 847957 - protein, 9 aa, Homo Sapiens
KVDVVPINN

SEQ ID NO: 847958 - protein, 9 aa, Homo Sapiens
ITHLKLIAL

SEQ ID NO: 847959 - protein, 9 aa, Homo Sapiens
GKLQAYAKT

SEQ ID NO: 847960 - protein, 9 aa, Homo Sapiens
HRYGQYTMN

SEQ ID NO: 847961 - protein, 9 aa, Homo Sapiens
YFLGNYLGL

SEQ ID NO: 847962 - protein, 9 aa, Homo Sapiens
FREHSSLNT

SEQ ID NO: 847963 - protein, 9 aa, Homo Sapiens
FWHKEMVLK

SEQ ID NO: 847964 - protein, 9 aa, Homo Sapiens
PDIQVPGAS

SEQ ID NO: 847965 - protein, 9 aa, Homo Sapiens
EALFLSWFA

SEQ ID NO: 847966 - protein, 9 aa, Homo Sapiens
SSDLQKEVE

SEQ ID NO: 847967 - protein, 9 aa, Homo Sapiens
NEIQPIDRQ

SEQ ID NO: 847968 - protein, 9 aa, Homo Sapiens
SKSTPDVKL

SEQ ID NO: 847969 - protein, 9 aa, Homo Sapiens
VITDTGQLH

SEQ ID NO: 847970 - protein, 9 aa, Homo Sapiens
DRIKSLSDQ

SEQ ID NO: 847971 - protein, 9 aa, Homo Sapiens
YIPSKFPNN

SEQ ID NO: 847972 - protein, 9 aa, Homo Sapiens
GRLRDYIKE

SEQ ID NO: 847973 - protein, 9 aa, Homo Sapiens
EPAGTWVIT

SEQ ID NO: 847974 - protein, 9 aa, Homo Sapiens
EGLLKVAQE

SEQ ID NO: 847975 - protein, 9 aa, Homo Sapiens
LNTLMESVT

SEQ ID NO: 847976 - protein, 9 aa, Homo Sapiens
RSAMSTTTV

SEQ ID NO: 847977 - protein, 9 aa, Homo Sapiens
SRTSKLLRD

SEQ ID NO: 847978 - protein, 9 aa, Homo Sapiens
MWGDLFTQQ

SEQ ID NO: 847979 - protein, 9 aa, Homo Sapiens
GQEKEESKN

SEQ ID NO: 847980 - protein, 9 aa, Homo Sapiens
DHVRAFKPL

SEQ ID NO: 847981 - protein, 9 aa, Homo Sapiens
EKLPQLHGH

SEQ ID NO: 847982 - protein, 9 aa, Homo Sapiens
VQLVLEILT

SEQ ID NO: 847983 - protein, 9 aa, Homo Sapiens
QEFQTAHLF

SEQ ID NO: 847984 - protein, 9 aa, Homo Sapiens
DKELGFESD

SEQ ID NO: 847985 - protein, 9 aa, Homo Sapiens
LRVKCSVTR

SEQ ID NO: 847986 - protein, 9 aa, Homo Sapiens
DPVLENILF

SEQ ID NO: 847987 - protein, 9 aa, Homo Sapiens
HLIEGVKIN

SEQ ID NO: 847988 - protein, 9 aa, Homo Sapiens
AIALSSFNS

SEQ ID NO: 847989 - protein, 9 aa, Homo Sapiens
FCWSTSLIR

SEQ ID NO: 847990 - protein, 9 aa, Homo Sapiens
RHPKRILLC

SEQ ID NO: 847991 - protein, 9 aa, Homo Sapiens
NLDSLGLSG

SEQ ID NO: 847992 - protein, 9 aa, Homo Sapiens
WWSEFKTLP

SEQ ID NO: 847993 - protein, 9 aa, Homo Sapiens
RLKLEPHKG

SEQ ID NO: 847994 - protein, 9 aa, Homo Sapiens
NHISIRQLQ

SEQ ID NO: 847995 - protein, 9 aa, Homo Sapiens
YHGYPYRDL

SEQ ID NO: 847996 - protein, 9 aa, Homo Sapiens
QFAKQFKQW

SEQ ID NO: 847997 - protein, 9 aa, Homo Sapiens
CLYTFPDHT

SEQ ID NO: 847998 - protein, 9 aa, Homo Sapiens
GSPFNERNG

SEQ ID NO: 847999 - protein, 9 aa, Homo Sapiens
NHEKMHNAK

SEQ ID NO: 848000 - protein, 9 aa, Homo Sapiens
TCLQSGIDF

SEQ ID NO: 848001 - protein, 9 aa, Homo Sapiens
LMAHIKRVT

SEQ ID NO: 848002 - protein, 9 aa, Homo Sapiens
ISPHNPLGD

SEQ ID NO: 848003 - protein, 9 aa, Homo Sapiens
IAKKHIIIY

SEQ ID NO: 848004 - protein, 9 aa, Homo Sapiens
TGLETTFPK

SEQ ID NO: 848005 - protein, 9 aa, Homo Sapiens
MSQGAVVNA

SEQ ID NO: 848006 - protein, 9 aa, Homo Sapiens
PYYMLNLKK

SEQ ID NO: 848007 - protein, 9 aa, Homo Sapiens
KMTLSEFYQ

SEQ ID NO: 848008 - protein, 9 aa, Homo Sapiens
PKRNVIQKK

SEQ ID NO: 848009 - protein, 9 aa, Homo Sapiens
VDTIDLVIF

SEQ ID NO: 848010 - protein, 9 aa, Homo Sapiens
YRVVDLNLL

SEQ ID NO: 848011 - protein, 9 aa, Homo Sapiens
KITLPVGFG

SEQ ID NO: 848012 - protein, 9 aa, Homo Sapiens
AQSLAAEIN

SEQ ID NO: 848013 - protein, 9 aa, Homo Sapiens
FDFLKVIGR

SEQ ID NO: 848014 - protein, 9 aa, Homo Sapiens
LSHSSSFQS

SEQ ID NO: 848015 - protein, 9 aa, Homo Sapiens
IGMKNGKFV

SEQ ID NO: 848016 - protein, 9 aa, Homo Sapiens
QSLTYDNQI

SEQ ID NO: 848017 - protein, 9 aa, Homo Sapiens
EKFCNRERE

SEQ ID NO: 848018 - protein, 9 aa, Homo Sapiens
EICNAFTFL

SEQ ID NO: 848019 - protein, 9 aa, Homo Sapiens
PEKIIKESI

SEQ ID NO: 848020 - protein, 9 aa, Homo Sapiens
IWNRNARYF

SEQ ID NO: 848021 - protein, 9 aa, Homo Sapiens
GSRSKDDTR

SEQ ID NO: 848022 - protein, 9 aa, Homo Sapiens
EDGIFFYYL

SEQ ID NO: 848023 - protein, 9 aa, Homo Sapiens
KSMDEFILK

SEQ ID NO: 848024 - protein, 9 aa, Homo Sapiens
EFVKKCSET

SEQ ID NO: 848025 - protein, 9 aa, Homo Sapiens
GKLSLPCDA

SEQ ID NO: 848026 - protein, 9 aa, Homo Sapiens
SLPPIDRRL

SEQ ID NO: 848027 - protein, 9 aa, Homo Sapiens
TERHPDMLI

SEQ ID NO: 848028 - protein, 9 aa, Homo Sapiens
KFIQLYAVC

SEQ ID NO: 848029 - protein, 9 aa, Homo Sapiens
MSYTMKPNT

SEQ ID NO: 848030 - protein, 9 aa, Homo Sapiens
EVFQDTVHM

SEQ ID NO: 848031 - protein, 9 aa, Homo Sapiens
VSLRVKCQG

SEQ ID NO: 848032 - protein, 9 aa, Homo Sapiens
ECERNPAKA

SEQ ID NO: 848033 - protein, 9 aa, Homo Sapiens
TPMSSPDLL

SEQ ID NO: 848034 - protein, 9 aa, Homo Sapiens
PDSQNPDPA

SEQ ID NO: 848035 - protein, 9 aa, Homo Sapiens
ADGFKEAVC

SEQ ID NO: 848036 - protein, 9 aa, Homo Sapiens
FEEGQDKQR

SEQ ID NO: 848037 - protein, 9 aa, Homo Sapiens
SLLSCVYHA

SEQ ID NO: 848038 - protein, 9 aa, Homo Sapiens
KMSLFERLR

SEQ ID NO: 848039 - protein, 9 aa, Homo Sapiens
ALVTMPGPS

SEQ ID NO: 848040 - protein, 9 aa, Homo Sapiens
TFTTGDVID

SEQ ID NO: 848041 - protein, 9 aa, Homo Sapiens
KIYLPGQMA

SEQ ID NO: 848042 - protein, 9 aa, Homo Sapiens
NKLFSEFVL

SEQ ID NO: 848043 - protein, 9 aa, Homo Sapiens
AYMKKLTRK

SEQ ID NO: 848044 - protein, 9 aa, Homo Sapiens
YSHNELEKH

SEQ ID NO: 848045 - protein, 9 aa, Homo Sapiens
HLPSNKKYP

SEQ ID NO: 848046 - protein, 9 aa, Homo Sapiens
AVTDVIRIT

SEQ ID NO: 848047 - protein, 9 aa, Homo Sapiens
LNNLFFSRV

SEQ ID NO: 848048 - protein, 9 aa, Homo Sapiens
RTLGMGTSG

SEQ ID NO: 848049 - protein, 9 aa, Homo Sapiens
NMGVGIRNI

SEQ ID NO: 848050 - protein, 9 aa, Homo Sapiens
DYDIQFYMY

SEQ ID NO: 848051 - protein, 9 aa, Homo Sapiens
KAGPGLQTH

SEQ ID NO: 848052 - protein, 9 aa, Homo Sapiens
SNVIGGLKL

SEQ ID NO: 848053 - protein, 9 aa, Homo Sapiens
RNLIVHQIT

SEQ ID NO: 848054 - protein, 9 aa, Homo Sapiens
NQIISFYDS

SEQ ID NO: 848055 - protein, 9 aa, Homo Sapiens
LQRAMSTTE

SEQ ID NO: 848056 - protein, 9 aa, Homo Sapiens
TEKEVTELL

SEQ ID NO: 848057 - protein, 9 aa, Homo Sapiens
ENTGQHNAI

SEQ ID NO: 848058 - protein, 9 aa, Homo Sapiens
CGSRCCVPV

SEQ ID NO: 848059 - protein, 9 aa, Homo Sapiens
CHFGHPDRA

SEQ ID NO: 848060 - protein, 9 aa, Homo Sapiens
DGLIIGEAP

SEQ ID NO: 848061 - protein, 9 aa, Homo Sapiens
PLIGKGLAA

SEQ ID NO: 848062 - protein, 9 aa, Homo Sapiens
KHMETKGAG

SEQ ID NO: 848063 - protein, 9 aa, Homo Sapiens
IASTSYLID

SEQ ID NO: 848064 - protein, 9 aa, Homo Sapiens
KAFTFSSTI

SEQ ID NO: 848065 - protein, 9 aa, Homo Sapiens
TPQITRNKE

SEQ ID NO: 848066 - protein, 9 aa, Homo Sapiens
SESMPDRNM

SEQ ID NO: 848067 - protein, 9 aa, Homo Sapiens
NLFKKVEYT

SEQ ID NO: 848068 - protein, 9 aa, Homo Sapiens
VDEEEETGE

SEQ ID NO: 848069 - protein, 9 aa, Homo Sapiens
LVNDLIGQG

SEQ ID NO: 848070 - protein, 9 aa, Homo Sapiens
AKNILSLMT

SEQ ID NO: 848071 - protein, 9 aa, Homo Sapiens
YRRNVKITS

SEQ ID NO: 848072 - protein, 9 aa, Homo Sapiens
LERNIVSRN

SEQ ID NO: 848073 - protein, 9 aa, Homo Sapiens
RNYTRMELF

SEQ ID NO: 848074 - protein, 9 aa, Homo Sapiens
SNFNAYQRA

SEQ ID NO: 848075 - protein, 9 aa, Homo Sapiens
ILSPSQKPQ

SEQ ID NO: 848076 - protein, 9 aa, Homo Sapiens
VLVVHQITH

SEQ ID NO: 848077 - protein, 9 aa, Homo Sapiens
SRETSSICT

SEQ ID NO: 848078 - protein, 9 aa, Homo Sapiens
CCGEHDVLI

SEQ ID NO: 848079 - protein, 9 aa, Homo Sapiens
VSKPLEEDI

SEQ ID NO: 848080 - protein, 9 aa, Homo Sapiens
NIYWTDSHY

SEQ ID NO: 848081 - protein, 9 aa, Homo Sapiens
SSETSTLSS

SEQ ID NO: 848082 - protein, 9 aa, Homo Sapiens
GLVHMINWA

SEQ ID NO: 848083 - protein, 9 aa, Homo Sapiens
LFVFLTLGG

SEQ ID NO: 848084 - protein, 9 aa, Homo Sapiens
HRPRGKTGS

SEQ ID NO: 848085 - protein, 9 aa, Homo Sapiens
SPSIIVIST

SEQ ID NO: 848086 - protein, 9 aa, Homo Sapiens
QELLDIINE

SEQ ID NO: 848087 - protein, 9 aa, Homo Sapiens
EQIQNAGGS

SEQ ID NO: 848088 - protein, 9 aa, Homo Sapiens
MVLTTATFY

SEQ ID NO: 848089 - protein, 9 aa, Homo Sapiens
AFYSVEVII

SEQ ID NO: 848090 - protein, 9 aa, Homo Sapiens
LGEHYNLVT

SEQ ID NO: 848091 - protein, 9 aa, Homo Sapiens
AAFYMPVTS

SEQ ID NO: 848092 - protein, 9 aa, Homo Sapiens
KTDPSEQVE

SEQ ID NO: 848093 - protein, 9 aa, Homo Sapiens
PETESNVNY

SEQ ID NO: 848094 - protein, 9 aa, Homo Sapiens
AINNYNPKY

SEQ ID NO: 848095 - protein, 9 aa, Homo Sapiens
RPHVYVGMK

SEQ ID NO: 848096 - protein, 9 aa, Homo Sapiens
EYFTVHPES

SEQ ID NO: 848097 - protein, 9 aa, Homo Sapiens
FIPQLCVGT

SEQ ID NO: 848098 - protein, 9 aa, Homo Sapiens
REMLASRIV

SEQ ID NO: 848099 - protein, 9 aa, Homo Sapiens
DVSKHDFLG

SEQ ID NO: 848100 - protein, 9 aa, Homo Sapiens
SWTAEGDIN

SEQ ID NO: 848101 - protein, 9 aa, Homo Sapiens
SKIITGHGH

SEQ ID NO: 848102 - protein, 9 aa, Homo Sapiens
PKTYKSKNF

SEQ ID NO: 848103 - protein, 9 aa, Homo Sapiens
KCTVSVSGI

SEQ ID NO: 848104 - protein, 9 aa, Homo Sapiens
RIYPQLILA

SEQ ID NO: 848105 - protein, 9 aa, Homo Sapiens
TEDGITPGL

SEQ ID NO: 848106 - protein, 9 aa, Homo Sapiens
ANLQERVRR

SEQ ID NO: 848107 - protein, 9 aa, Homo Sapiens
LGFYNYPEL

SEQ ID NO: 848108 - protein, 9 aa, Homo Sapiens
QCLDDPVLS

SEQ ID NO: 848109 - protein, 9 aa, Homo Sapiens
LSVYIFSFL

SEQ ID NO: 848110 - protein, 9 aa, Homo Sapiens
SNQKPGTDE

SEQ ID NO: 848111 - protein, 9 aa, Homo Sapiens
STPDKTDMT

SEQ ID NO: 848112 - protein, 9 aa, Homo Sapiens
MLVDSSDHD

SEQ ID NO: 848113 - protein, 9 aa, Homo Sapiens
KAFVFGRKY

SEQ ID NO: 848114 - protein, 9 aa, Homo Sapiens
INKTQNVSS

SEQ ID NO: 848115 - protein, 9 aa, Homo Sapiens
PHDIFKAND

SEQ ID NO: 848116 - protein, 9 aa, Homo Sapiens
LCVELEAVS

SEQ ID NO: 848117 - protein, 9 aa, Homo Sapiens
RGIAGVDLF

SEQ ID NO: 848118 - protein, 9 aa, Homo Sapiens
KYQESVCQR

SEQ ID NO: 848119 - protein, 9 aa, Homo Sapiens
IQIVITMSS

SEQ ID NO: 848120 - protein, 9 aa, Homo Sapiens
TPQRKLPQN

SEQ ID NO: 848121 - protein, 9 aa, Homo Sapiens
RSKSPKNKL

SEQ ID NO: 848122 - protein, 9 aa, Homo Sapiens
RVRNSLIHN

SEQ ID NO: 848123 - protein, 9 aa, Homo Sapiens
TNGPEKTSS

SEQ ID NO: 848124 - protein, 9 aa, Homo Sapiens
VLVYHNGDP

SEQ ID NO: 848125 - protein, 9 aa, Homo Sapiens
PENHENIFL

SEQ ID NO: 848126 - protein, 9 aa, Homo Sapiens
YSALKNLDS

SEQ ID NO: 848127 - protein, 9 aa, Homo Sapiens
IVQWLINNL

SEQ ID NO: 848128 - protein, 9 aa, Homo Sapiens
FQPHQDANP

SEQ ID NO: 848129 - protein, 9 aa, Homo Sapiens
DTLEEDQQF

SEQ ID NO: 848130 - protein, 9 aa, Homo Sapiens
SSPQKRSYS

SEQ ID NO: 848131 - protein, 9 aa, Homo Sapiens
KVKQENTVL

SEQ ID NO: 848132 - protein, 9 aa, Homo Sapiens
AFQFQLHFG

SEQ ID NO: 848133 - protein, 9 aa, Homo Sapiens
LPRRTPPAR

SEQ ID NO: 848134 - protein, 9 aa, Homo Sapiens
GPYRRCYLF

SEQ ID NO: 848135 - protein, 9 aa, Homo Sapiens
LYSLLSKLL

SEQ ID NO: 848136 - protein, 9 aa, Homo Sapiens
NILFGVFLA

SEQ ID NO: 848137 - protein, 9 aa, Homo Sapiens
IPLIWIDHR

SEQ ID NO: 848138 - protein, 9 aa, Homo Sapiens
TRINEEIDK

SEQ ID NO: 848139 - protein, 9 aa, Homo Sapiens
SDSTVYYYA

SEQ ID NO: 848140 - protein, 9 aa, Homo Sapiens
QHFMHQTLG

SEQ ID NO: 848141 - protein, 9 aa, Homo Sapiens
TSVIRNRMA

SEQ ID NO: 848142 - protein, 9 aa, Homo Sapiens
EVKKKRWNH

SEQ ID NO: 848143 - protein, 9 aa, Homo Sapiens
KYVVSNKKL

SEQ ID NO: 848144 - protein, 9 aa, Homo Sapiens
PMNVQSSRS

SEQ ID NO: 848145 - protein, 9 aa, Homo Sapiens
QTGIYPIDV

SEQ ID NO: 848146 - protein, 9 aa, Homo Sapiens
KQEFQFVDE

SEQ ID NO: 848147 - protein, 9 aa, Homo Sapiens
PAASEEAHP

SEQ ID NO: 848148 - protein, 9 aa, Homo Sapiens
SNSSSANEF

SEQ ID NO: 848149 - protein, 9 aa, Homo Sapiens
EQLHTAIKF

SEQ ID NO: 848150 - protein, 9 aa, Homo Sapiens
NNQGVVSQA

SEQ ID NO: 848151 - protein, 9 aa, Homo Sapiens
TALRSEEYE

SEQ ID NO: 848152 - protein, 9 aa, Homo Sapiens
PNFSFSKEQ

SEQ ID NO: 848153 - protein, 9 aa, Homo Sapiens
SSDDVNTFL

SEQ ID NO: 848154 - protein, 9 aa, Homo Sapiens
RLRMLALGT

SEQ ID NO: 848155 - protein, 9 aa, Homo Sapiens
QLANPKELY

SEQ ID NO: 848156 - protein, 9 aa, Homo Sapiens
NDNKWKKTE

SEQ ID NO: 848157 - protein, 9 aa, Homo Sapiens
AELKILVSA

SEQ ID NO: 848158 - protein, 9 aa, Homo Sapiens
EIDVAGTDS

SEQ ID NO: 848159 - protein, 9 aa, Homo Sapiens
NTWSNTHDF

SEQ ID NO: 848160 - protein, 9 aa, Homo Sapiens
VFKGAVKIW

SEQ ID NO: 848161 - protein, 9 aa, Homo Sapiens
YKLAINIFQ

SEQ ID NO: 848162 - protein, 9 aa, Homo Sapiens
LQKLCWEYY

SEQ ID NO: 848163 - protein, 9 aa, Homo Sapiens
LTSYINELQ

SEQ ID NO: 848164 - protein, 9 aa, Homo Sapiens
PFLWKKAQI

SEQ ID NO: 848165 - protein, 9 aa, Homo Sapiens
ESMDLSQYV

SEQ ID NO: 848166 - protein, 9 aa, Homo Sapiens
DTVGCCSLC

SEQ ID NO: 848167 - protein, 9 aa, Homo Sapiens
LVTTLTLRL

SEQ ID NO: 848168 - protein, 9 aa, Homo Sapiens
FWLEDPANQ

SEQ ID NO: 848169 - protein, 9 aa, Homo Sapiens
FQSAAIQSG

SEQ ID NO: 848170 - protein, 9 aa, Homo Sapiens
LENLIKGRN

SEQ ID NO: 848171 - protein, 9 aa, Homo Sapiens
EKYARDMIM

SEQ ID NO: 848172 - protein, 9 aa, Homo Sapiens
GVRALNVLF

SEQ ID NO: 848173 - protein, 9 aa, Homo Sapiens
AKLNSAFQR

SEQ ID NO: 848174 - protein, 9 aa, Homo Sapiens
ICDHQAAQL

SEQ ID NO: 848175 - protein, 9 aa, Homo Sapiens
GSSETSSSF

SEQ ID NO: 848176 - protein, 9 aa, Homo Sapiens
PGDVGAKGE

SEQ ID NO: 848177 - protein, 9 aa, Homo Sapiens
FLSFFWDKN

SEQ ID NO: 848178 - protein, 9 aa, Homo Sapiens
NLAEAVRDY

SEQ ID NO: 848179 - protein, 9 aa, Homo Sapiens
ALHQVKQHI

SEQ ID NO: 848180 - protein, 9 aa, Homo Sapiens
QSYDNLDYT

SEQ ID NO: 848181 - protein, 9 aa, Homo Sapiens
ALYATKTLQ

SEQ ID NO: 848182 - protein, 9 aa, Homo Sapiens
TQPFRDEGE

SEQ ID NO: 848183 - protein, 9 aa, Homo Sapiens
TSVCCRSLA

SEQ ID NO: 848184 - protein, 9 aa, Homo Sapiens
LLGQAAQNM

SEQ ID NO: 848185 - protein, 9 aa, Homo Sapiens
FSSHYTFSK

SEQ ID NO: 848186 - protein, 9 aa, Homo Sapiens
KNAEIYNYL

SEQ ID NO: 848187 - protein, 9 aa, Homo Sapiens
LSEGSTLAG

SEQ ID NO: 848188 - protein, 9 aa, Homo Sapiens
IVHMHRFYM

SEQ ID NO: 848189 - protein, 9 aa, Homo Sapiens
QDDPLRADH

SEQ ID NO: 848190 - protein, 9 aa, Homo Sapiens
SSVREPGHS

SEQ ID NO: 848191 - protein, 9 aa, Homo Sapiens
YSYGQQRYT

SEQ ID NO: 848192 - protein, 9 aa, Homo Sapiens
DRTIKQTDE

SEQ ID NO: 848193 - protein, 9 aa, Homo Sapiens
NTDQQLIET

SEQ ID NO: 848194 - protein, 9 aa, Homo Sapiens
TSRTGYWIM

SEQ ID NO: 848195 - protein, 9 aa, Homo Sapiens
VFNSKNEAP

SEQ ID NO: 848196 - protein, 9 aa, Homo Sapiens
RNNYLKPVT

SEQ ID NO: 848197 - protein, 9 aa, Homo Sapiens
MKLEQERPR

SEQ ID NO: 848198 - protein, 9 aa, Homo Sapiens
MTSKRHFKL

SEQ ID NO: 848199 - protein, 9 aa, Homo Sapiens
ECSNVMICE

SEQ ID NO: 848200 - protein, 9 aa, Homo Sapiens
SHGWPEVGI

SEQ ID NO: 848201 - protein, 9 aa, Homo Sapiens
LEEFKGNSK

SEQ ID NO: 848202 - protein, 9 aa, Homo Sapiens
TAKHVESRT

SEQ ID NO: 848203 - protein, 9 aa, Homo Sapiens
VQRQIRRHK

SEQ ID NO: 848204 - protein, 9 aa, Homo Sapiens
QAHAGHITK

SEQ ID NO: 848205 - protein, 9 aa, Homo Sapiens
ETLLTYQGA

SEQ ID NO: 848206 - protein, 9 aa, Homo Sapiens
FFHAILQQE

SEQ ID NO: 848207 - protein, 9 aa, Homo Sapiens
RIVLIIYNF

SEQ ID NO: 848208 - protein, 9 aa, Homo Sapiens
FLKLLPESE

SEQ ID NO: 848209 - protein, 9 aa, Homo Sapiens
LLGEDYLAA

SEQ ID NO: 848210 - protein, 9 aa, Homo Sapiens
DKYLPAPLG

SEQ ID NO: 848211 - protein, 9 aa, Homo Sapiens
LSSADNIAV

SEQ ID NO: 848212 - protein, 9 aa, Homo Sapiens
YFAHAQVSI

SEQ ID NO: 848213 - protein, 9 aa, Homo Sapiens
PQNLPSTGF

SEQ ID NO: 848214 - protein, 9 aa, Homo Sapiens
NEDIKSLWS

SEQ ID NO: 848215 - protein, 9 aa, Homo Sapiens
DIPCLALPV

SEQ ID NO: 848216 - protein, 9 aa, Homo Sapiens
FLFCLPGFV

SEQ ID NO: 848217 - protein, 9 aa, Homo Sapiens
SNSCIDCNP

SEQ ID NO: 848218 - protein, 9 aa, Homo Sapiens
LQWKSANFS

SEQ ID NO: 848219 - protein, 9 aa, Homo Sapiens
ALKIELQAQ

SEQ ID NO: 848220 - protein, 9 aa, Homo Sapiens
LRKPQKAHK

SEQ ID NO: 848221 - protein, 9 aa, Homo Sapiens
DKADEGPEE

SEQ ID NO: 848222 - protein, 9 aa, Homo Sapiens
LIAFRNNYL

SEQ ID NO: 848223 - protein, 9 aa, Homo Sapiens
HGKNYLNSG

SEQ ID NO: 848224 - protein, 9 aa, Homo Sapiens
RLEDESFDR

SEQ ID NO: 848225 - protein, 9 aa, Homo Sapiens
ADTLGEAWA

SEQ ID NO: 848226 - protein, 9 aa, Homo Sapiens
KASSIVYTK

SEQ ID NO: 848227 - protein, 9 aa, Homo Sapiens
NHQSEFTVE

SEQ ID NO: 848228 - protein, 9 aa, Homo Sapiens
NQTTKIFIY

SEQ ID NO: 848229 - protein, 9 aa, Homo Sapiens
PVVAVNSYM

SEQ ID NO: 848230 - protein, 9 aa, Homo Sapiens
RDDGIQKLG

SEQ ID NO: 848231 - protein, 9 aa, Homo Sapiens
EIKKYSDPS

SEQ ID NO: 848232 - protein, 9 aa, Homo Sapiens
GNLTLRYII

SEQ ID NO: 848233 - protein, 9 aa, Homo Sapiens
KYDSVINHQ

SEQ ID NO: 848234 - protein, 9 aa, Homo Sapiens
VKQFPVEGN

SEQ ID NO: 848235 - protein, 9 aa, Homo Sapiens
FHRDQRSLY

SEQ ID NO: 848236 - protein, 9 aa, Homo Sapiens
PWGTLSSLN

SEQ ID NO: 848237 - protein, 9 aa, Homo Sapiens
FDRTKNGTS

SEQ ID NO: 848238 - protein, 9 aa, Homo Sapiens
PSVFEDNFL

SEQ ID NO: 848239 - protein, 9 aa, Homo Sapiens
HQTLFIFNE

SEQ ID NO: 848240 - protein, 9 aa, Homo Sapiens
YGWLGLGEG

SEQ ID NO: 848241 - protein, 9 aa, Homo Sapiens
MPETFLPTN

SEQ ID NO: 848242 - protein, 9 aa, Homo Sapiens
TPASEPQYS

SEQ ID NO: 848243 - protein, 9 aa, Homo Sapiens
YEGDDDDED

SEQ ID NO: 848244 - protein, 9 aa, Homo Sapiens
IPKATEEVG

SEQ ID NO: 848245 - protein, 9 aa, Homo Sapiens
VGQVILINS

SEQ ID NO: 848246 - protein, 9 aa, Homo Sapiens
LFQYETQQL

SEQ ID NO: 848247 - protein, 9 aa, Homo Sapiens
HAQIRKTSA

SEQ ID NO: 848248 - protein, 9 aa, Homo Sapiens
MKTPPGIPA

SEQ ID NO: 848249 - protein, 9 aa, Homo Sapiens
HNLSSGTNP

SEQ ID NO: 848250 - protein, 9 aa, Homo Sapiens
SPQLFHQDK

SEQ ID NO: 848251 - protein, 9 aa, Homo Sapiens
RDAVQVNLT

SEQ ID NO: 848252 - protein, 9 aa, Homo Sapiens
GVKPYLTDV

SEQ ID NO: 848253 - protein, 9 aa, Homo Sapiens
QMLEKAGCH

SEQ ID NO: 848254 - protein, 9 aa, Homo Sapiens
SMAIRHNPQ

SEQ ID NO: 848255 - protein, 9 aa, Homo Sapiens
TDTIKLIVG

SEQ ID NO: 848256 - protein, 9 aa, Homo Sapiens
PCPVCRQPS

SEQ ID NO: 848257 - protein, 9 aa, Homo Sapiens
RVVDSADAG

SEQ ID NO: 848258 - protein, 9 aa, Homo Sapiens
ECNCPSMYI

SEQ ID NO: 848259 - protein, 9 aa, Homo Sapiens
FHGVLLDAL

SEQ ID NO: 848260 - protein, 9 aa, Homo Sapiens
DKFYKIECD

SEQ ID NO: 848261 - protein, 9 aa, Homo Sapiens
ELFDPNSCP

SEQ ID NO: 848262 - protein, 9 aa, Homo Sapiens
YERYNCYKV

SEQ ID NO: 848263 - protein, 9 aa, Homo Sapiens
AHSGSRDLS

SEQ ID NO: 848264 - protein, 9 aa, Homo Sapiens
KIWKGQAVT

SEQ ID NO: 848265 - protein, 9 aa, Homo Sapiens
TQEGGINKE

SEQ ID NO: 848266 - protein, 9 aa, Homo Sapiens
DESDTRRLS

SEQ ID NO: 848267 - protein, 9 aa, Homo Sapiens
LTYNQINYV

SEQ ID NO: 848268 - protein, 9 aa, Homo Sapiens
KYMNHLIDI

SEQ ID NO: 848269 - protein, 9 aa, Homo Sapiens
LEDESFDRL

SEQ ID NO: 848270 - protein, 9 aa, Homo Sapiens
LHDYTIFEI

SEQ ID NO: 848271 - protein, 9 aa, Homo Sapiens
LYVNKKIDR

SEQ ID NO: 848272 - protein, 9 aa, Homo Sapiens
LSYPDLDAV

SEQ ID NO: 848273 - protein, 9 aa, Homo Sapiens
RSLEDHRFD

SEQ ID NO: 848274 - protein, 9 aa, Homo Sapiens
PKDAENPTE

SEQ ID NO: 848275 - protein, 9 aa, Homo Sapiens
VGTLLFRSC

SEQ ID NO: 848276 - protein, 9 aa, Homo Sapiens
GKHYWDVDV

SEQ ID NO: 848277 - protein, 9 aa, Homo Sapiens
GKHTERIGH

SEQ ID NO: 848278 - protein, 9 aa, Homo Sapiens
RGRQTYSRL

SEQ ID NO: 848279 - protein, 9 aa, Homo Sapiens
KHHLTDLSH

SEQ ID NO: 848280 - protein, 9 aa, Homo Sapiens
FPKNNKNKF

SEQ ID NO: 848281 - protein, 9 aa, Homo Sapiens
IDDPSIFGH

SEQ ID NO: 848282 - protein, 9 aa, Homo Sapiens
DSIQSSKLG

SEQ ID NO: 848283 - protein, 9 aa, Homo Sapiens
PYECKECGV

SEQ ID NO: 848284 - protein, 9 aa, Homo Sapiens
QNAIAFHRD

SEQ ID NO: 848285 - protein, 9 aa, Homo Sapiens
ATPDVVSKI

SEQ ID NO: 848286 - protein, 9 aa, Homo Sapiens
GIADDYDKN

SEQ ID NO: 848287 - protein, 9 aa, Homo Sapiens
AKQNIKKKG

SEQ ID NO: 848288 - protein, 9 aa, Homo Sapiens
SADTMQSAL

SEQ ID NO: 848289 - protein, 9 aa, Homo Sapiens
LKVIGRGNY

SEQ ID NO: 848290 - protein, 9 aa, Homo Sapiens
YLSKGTQHL

SEQ ID NO: 848291 - protein, 9 aa, Homo Sapiens
RGCPPQKLR

SEQ ID NO: 848292 - protein, 9 aa, Homo Sapiens
FLSGLLSLR

SEQ ID NO: 848293 - protein, 9 aa, Homo Sapiens
KDVMEKIED

SEQ ID NO: 848294 - protein, 9 aa, Homo Sapiens
RQDNALAIV

SEQ ID NO: 848295 - protein, 9 aa, Homo Sapiens
TDKQRKHLN

SEQ ID NO: 848296 - protein, 9 aa, Homo Sapiens
LPYKLELGS

SEQ ID NO: 848297 - protein, 9 aa, Homo Sapiens
RLGGSEGPG

SEQ ID NO: 848298 - protein, 9 aa, Homo Sapiens
LSDRQAELN

SEQ ID NO: 848299 - protein, 9 aa, Homo Sapiens
LASVVFLLL

SEQ ID NO: 848300 - protein, 9 aa, Homo Sapiens
VAEEKSIKH

SEQ ID NO: 848301 - protein, 9 aa, Homo Sapiens
NANKTSYLT

SEQ ID NO: 848302 - protein, 9 aa, Homo Sapiens
YLSDSEFNQ

SEQ ID NO: 848303 - protein, 9 aa, Homo Sapiens
ARMPRKRKT

SEQ ID NO: 848304 - protein, 9 aa, Homo Sapiens
EHPEAVCQL

SEQ ID NO: 848305 - protein, 9 aa, Homo Sapiens
DRIIRTYWD

SEQ ID NO: 848306 - protein, 9 aa, Homo Sapiens
FRVFSNKVL

SEQ ID NO: 848307 - protein, 9 aa, Homo Sapiens
GMIWTIILH

SEQ ID NO: 848308 - protein, 9 aa, Homo Sapiens
YPSKVAFVS

SEQ ID NO: 848309 - protein, 9 aa, Homo Sapiens
ESLNSTQSH

SEQ ID NO: 848310 - protein, 9 aa, Homo Sapiens
SSTDAVLNN

SEQ ID NO: 848311 - protein, 9 aa, Homo Sapiens
QHINIIYRD

SEQ ID NO: 848312 - protein, 9 aa, Homo Sapiens
PFGVVDEIN

SEQ ID NO: 848313 - protein, 9 aa, Homo Sapiens
LTFSLFGLR

SEQ ID NO: 848314 - protein, 9 aa, Homo Sapiens
KTQLEQEAE

SEQ ID NO: 848315 - protein, 9 aa, Homo Sapiens
YQNKYTHFK

SEQ ID NO: 848316 - protein, 9 aa, Homo Sapiens
DEDQKVWPN

SEQ ID NO: 848317 - protein, 9 aa, Homo Sapiens
KAASTPRDP

SEQ ID NO: 848318 - protein, 9 aa, Homo Sapiens
GLLTVLSWL

SEQ ID NO: 848319 - protein, 9 aa, Homo Sapiens
EIMLKDEVS

SEQ ID NO: 848320 - protein, 9 aa, Homo Sapiens
EKLARCVAQ

SEQ ID NO: 848321 - protein, 9 aa, Homo Sapiens
ITERDNVFG

SEQ ID NO: 848322 - protein, 9 aa, Homo Sapiens
TCLALGTHR

SEQ ID NO: 848323 - protein, 9 aa, Homo Sapiens
NLQTLKGLK

SEQ ID NO: 848324 - protein, 9 aa, Homo Sapiens
KSHCSENCI

SEQ ID NO: 848325 - protein, 9 aa, Homo Sapiens
KIITKKKSD

SEQ ID NO: 848326 - protein, 9 aa, Homo Sapiens
KKGDPSAPF

SEQ ID NO: 848327 - protein, 9 aa, Homo Sapiens
WCDWTMISR

SEQ ID NO: 848328 - protein, 9 aa, Homo Sapiens
SKNKLFIKR

SEQ ID NO: 848329 - protein, 9 aa, Homo Sapiens
VNSVTTDSW

SEQ ID NO: 848330 - protein, 9 aa, Homo Sapiens
EFGAVFRRP

SEQ ID NO: 848331 - protein, 9 aa, Homo Sapiens
TMNKNTWEQ

SEQ ID NO: 848332 - protein, 9 aa, Homo Sapiens
NLYRRHCPR

SEQ ID NO: 848333 - protein, 9 aa, Homo Sapiens
PAGPGAQTP

SEQ ID NO: 848334 - protein, 9 aa, Homo Sapiens
IYFLLDSSE

SEQ ID NO: 848335 - protein, 9 aa, Homo Sapiens
QGKLEDWAR

SEQ ID NO: 848336 - protein, 9 aa, Homo Sapiens
MNYIGQLLP

SEQ ID NO: 848337 - protein, 9 aa, Homo Sapiens
NLKVHEIIH

SEQ ID NO: 848338 - protein, 9 aa, Homo Sapiens
IVCEGSIKH

SEQ ID NO: 848339 - protein, 9 aa, Homo Sapiens
LAPRAKIFW

SEQ ID NO: 848340 - protein, 9 aa, Homo Sapiens
SFHNVQQIG

SEQ ID NO: 848341 - protein, 9 aa, Homo Sapiens
PVDLSKLPS

SEQ ID NO: 848342 - protein, 9 aa, Homo Sapiens
NLSPVDVSY

SEQ ID NO: 848343 - protein, 9 aa, Homo Sapiens
SLLLGKSLD

SEQ ID NO: 848344 - protein, 9 aa, Homo Sapiens
SVLYTVPST

SEQ ID NO: 848345 - protein, 9 aa, Homo Sapiens
GLLFKKSLD

SEQ ID NO: 848346 - protein, 9 aa, Homo Sapiens
DTFKSGIVQ

SEQ ID NO: 848347 - protein, 9 aa, Homo Sapiens
TWRIKKKSR

SEQ ID NO: 848348 - protein, 9 aa, Homo Sapiens
GLILPLCWT

SEQ ID NO: 848349 - protein, 9 aa, Homo Sapiens
SYCWLLNEF

SEQ ID NO: 848350 - protein, 9 aa, Homo Sapiens
YHNPTHSAD

SEQ ID NO: 848351 - protein, 9 aa, Homo Sapiens
PLAVLPILT

SEQ ID NO: 848352 - protein, 9 aa, Homo Sapiens
IKAYSLVDR

SEQ ID NO: 848353 - protein, 9 aa, Homo Sapiens
YLIYTLRNK

SEQ ID NO: 848354 - protein, 9 aa, Homo Sapiens
ARENTFIVR

SEQ ID NO: 848355 - protein, 9 aa, Homo Sapiens
SEPSPAPPT

SEQ ID NO: 848356 - protein, 9 aa, Homo Sapiens
GIPTVGIPL

SEQ ID NO: 848357 - protein, 9 aa, Homo Sapiens
EELNLEDED

SEQ ID NO: 848358 - protein, 9 aa, Homo Sapiens
VGSLRAMAL

SEQ ID NO: 848359 - protein, 9 aa, Homo Sapiens
LPLMQIFRD

SEQ ID NO: 848360 - protein, 9 aa, Homo Sapiens
KNAVAHRNS

SEQ ID NO: 848361 - protein, 9 aa, Homo Sapiens
PINAVTTKF

SEQ ID NO: 848362 - protein, 9 aa, Homo Sapiens
LQQVLDNLT

SEQ ID NO: 848363 - protein, 9 aa, Homo Sapiens
GEHLSKKAK

SEQ ID NO: 848364 - protein, 9 aa, Homo Sapiens
VRQSYFALL

SEQ ID NO: 848365 - protein, 9 aa, Homo Sapiens
RRSKRKDEV

SEQ ID NO: 848366 - protein, 9 aa, Homo Sapiens
KLPLKFRDA

SEQ ID NO: 848367 - protein, 9 aa, Homo Sapiens
EELRQKALE

SEQ ID NO: 848368 - protein, 9 aa, Homo Sapiens
KFVILLVNS

SEQ ID NO: 848369 - protein, 9 aa, Homo Sapiens
YFPSEATSS

SEQ ID NO: 848370 - protein, 9 aa, Homo Sapiens
STGNKTITE

SEQ ID NO: 848371 - protein, 9 aa, Homo Sapiens
TLLFSGIFP

SEQ ID NO: 848372 - protein, 9 aa, Homo Sapiens
SSQTQDKAS

SEQ ID NO: 848373 - protein, 9 aa, Homo Sapiens
RSAHLIQHQ

SEQ ID NO: 848374 - protein, 9 aa, Homo Sapiens
LEARVRDIT

SEQ ID NO: 848375 - protein, 9 aa, Homo Sapiens
EAFLRLAQS

SEQ ID NO: 848376 - protein, 9 aa, Homo Sapiens
NNPPNNDDQ

SEQ ID NO: 848377 - protein, 9 aa, Homo Sapiens
RIQQMKSQW

SEQ ID NO: 848378 - protein, 9 aa, Homo Sapiens
EQKIDRFFC

SEQ ID NO: 848379 - protein, 9 aa, Homo Sapiens
LTELMSKMR

SEQ ID NO: 848380 - protein, 9 aa, Homo Sapiens
DKNFWSGLE

SEQ ID NO: 848381 - protein, 9 aa, Homo Sapiens
WSDNDSDYA

SEQ ID NO: 848382 - protein, 9 aa, Homo Sapiens
MDPHTAPSR

SEQ ID NO: 848383 - protein, 9 aa, Homo Sapiens
AEIDDLSEV

SEQ ID NO: 848384 - protein, 9 aa, Homo Sapiens
SDLNCVDFA

SEQ ID NO: 848385 - protein, 9 aa, Homo Sapiens
RDALLLQIP

SEQ ID NO: 848386 - protein, 9 aa, Homo Sapiens
KDPKPAIHF

SEQ ID NO: 848387 - protein, 9 aa, Homo Sapiens
MDDGPSRID

SEQ ID NO: 848388 - protein, 9 aa, Homo Sapiens
THGSLILPH

SEQ ID NO: 848389 - protein, 9 aa, Homo Sapiens
FTLFFRIKC

SEQ ID NO: 848390 - protein, 9 aa, Homo Sapiens
LTWSDNGNV

SEQ ID NO: 848391 - protein, 9 aa, Homo Sapiens
ASDSIECST

SEQ ID NO: 848392 - protein, 9 aa, Homo Sapiens
FQHPSELRK

SEQ ID NO: 848393 - protein, 9 aa, Homo Sapiens
WEVMWTKLP

SEQ ID NO: 848394 - protein, 9 aa, Homo Sapiens
EQGLNSECK

SEQ ID NO: 848395 - protein, 9 aa, Homo Sapiens
FQPSPDIIP

SEQ ID NO: 848396 - protein, 9 aa, Homo Sapiens
KLENGGAHR

SEQ ID NO: 848397 - protein, 9 aa, Homo Sapiens
SLRQNHSLD

SEQ ID NO: 848398 - protein, 9 aa, Homo Sapiens
YVASEESQI

SEQ ID NO: 848399 - protein, 9 aa, Homo Sapiens
FKQRRLIEE

SEQ ID NO: 848400 - protein, 9 aa, Homo Sapiens
NRDKVELLD

SEQ ID NO: 848401 - protein, 9 aa, Homo Sapiens
AEELASQGL

SEQ ID NO: 848402 - protein, 9 aa, Homo Sapiens
CGFLKGRCF

SEQ ID NO: 848403 - protein, 9 aa, Homo Sapiens
LRLPDSRDY

SEQ ID NO: 848404 - protein, 9 aa, Homo Sapiens
YCDYHGHSQ

SEQ ID NO: 848405 - protein, 9 aa, Homo Sapiens
KTVLAKQTG

SEQ ID NO: 848406 - protein, 9 aa, Homo Sapiens
QGFYVRLID

SEQ ID NO: 848407 - protein, 9 aa, Homo Sapiens
SKEARTYIF

SEQ ID NO: 848408 - protein, 9 aa, Homo Sapiens
YEVLSLLEE

SEQ ID NO: 848409 - protein, 9 aa, Homo Sapiens
HTKDMDLYS

SEQ ID NO: 848410 - protein, 9 aa, Homo Sapiens
ISANQRARW

SEQ ID NO: 848411 - protein, 9 aa, Homo Sapiens
KINRLGKKG

SEQ ID NO: 848412 - protein, 9 aa, Homo Sapiens
KQCGNTYTT

SEQ ID NO: 848413 - protein, 9 aa, Homo Sapiens
NEAVYTCIC

SEQ ID NO: 848414 - protein, 9 aa, Homo Sapiens
RREQPESFR

SEQ ID NO: 848415 - protein, 9 aa, Homo Sapiens
ALKNLDSRI

SEQ ID NO: 848416 - protein, 9 aa, Homo Sapiens
KPALISTVE

SEQ ID NO: 848417 - protein, 9 aa, Homo Sapiens
AAQSDLAAI

SEQ ID NO: 848418 - protein, 9 aa, Homo Sapiens
CQEQLRELS

SEQ ID NO: 848419 - protein, 9 aa, Homo Sapiens
EIHQYGYRN

SEQ ID NO: 848420 - protein, 9 aa, Homo Sapiens
EEIHRFSYQ

SEQ ID NO: 848421 - protein, 9 aa, Homo Sapiens
LNVAHNRIQ

SEQ ID NO: 848422 - protein, 9 aa, Homo Sapiens
PRLRHVGIF

SEQ ID NO: 848423 - protein, 9 aa, Homo Sapiens
QVASEFGLN

SEQ ID NO: 848424 - protein, 9 aa, Homo Sapiens
SYVVEAIPE

SEQ ID NO: 848425 - protein, 9 aa, Homo Sapiens
TNKAKKREV

SEQ ID NO: 848426 - protein, 9 aa, Homo Sapiens
IIRIMRVLH

SEQ ID NO: 848427 - protein, 9 aa, Homo Sapiens
LRVFLGRES

SEQ ID NO: 848428 - protein, 9 aa, Homo Sapiens
AVAVTMLLG

SEQ ID NO: 848429 - protein, 9 aa, Homo Sapiens
YPPDISDEV

SEQ ID NO: 848430 - protein, 9 aa, Homo Sapiens
QNLQDCLQA

SEQ ID NO: 848431 - protein, 9 aa, Homo Sapiens
GQGGNQLFE

SEQ ID NO: 848432 - protein, 9 aa, Homo Sapiens
RMCKNHSLD

SEQ ID NO: 848433 - protein, 9 aa, Homo Sapiens
QTFNLFSTD

SEQ ID NO: 848434 - protein, 9 aa, Homo Sapiens
HFEMPASKI

SEQ ID NO: 848435 - protein, 9 aa, Homo Sapiens
NSKLTFKPD

SEQ ID NO: 848436 - protein, 9 aa, Homo Sapiens
NNLSPSLPG

SEQ ID NO: 848437 - protein, 9 aa, Homo Sapiens
GSWRAVARD

SEQ ID NO: 848438 - protein, 9 aa, Homo Sapiens
VIIFISPDL

SEQ ID NO: 848439 - protein, 9 aa, Homo Sapiens
TRQNKLQAE

SEQ ID NO: 848440 - protein, 9 aa, Homo Sapiens
LMLNPLVYS

SEQ ID NO: 848441 - protein, 9 aa, Homo Sapiens
VNTILRNHL

SEQ ID NO: 848442 - protein, 9 aa, Homo Sapiens
SKEQRVKSA

SEQ ID NO: 848443 - protein, 9 aa, Homo Sapiens
DQCHSHFHN

SEQ ID NO: 848444 - protein, 9 aa, Homo Sapiens
GVCTDTIKL

SEQ ID NO: 848445 - protein, 9 aa, Homo Sapiens
VISPESLSC

SEQ ID NO: 848446 - protein, 9 aa, Homo Sapiens
SDVQITLPR

SEQ ID NO: 848447 - protein, 9 aa, Homo Sapiens
NNVNEFAPV

SEQ ID NO: 848448 - protein, 9 aa, Homo Sapiens
ASAARVTLG

SEQ ID NO: 848449 - protein, 9 aa, Homo Sapiens
YFRWDFKKT

SEQ ID NO: 848450 - protein, 9 aa, Homo Sapiens
YCEKLYLFP

SEQ ID NO: 848451 - protein, 9 aa, Homo Sapiens
LKKEANKRE

SEQ ID NO: 848452 - protein, 9 aa, Homo Sapiens
RPLNIVCKQ

SEQ ID NO: 848453 - protein, 9 aa, Homo Sapiens
NLTPYWALI

SEQ ID NO: 848454 - protein, 9 aa, Homo Sapiens
PSDKSTEPK

SEQ ID NO: 848455 - protein, 9 aa, Homo Sapiens
IWKGSCPLT

SEQ ID NO: 848456 - protein, 9 aa, Homo Sapiens
TSTNGLINF

SEQ ID NO: 848457 - protein, 9 aa, Homo Sapiens
HFKGVKKIK

SEQ ID NO: 848458 - protein, 9 aa, Homo Sapiens
LEEIEEQEV

SEQ ID NO: 848459 - protein, 9 aa, Homo Sapiens
LENTFKANS

SEQ ID NO: 848460 - protein, 9 aa, Homo Sapiens
QSMEDYFQK

SEQ ID NO: 848461 - protein, 9 aa, Homo Sapiens
GKAFTQKPH

SEQ ID NO: 848462 - protein, 9 aa, Homo Sapiens
GNLENSCLA

SEQ ID NO: 848463 - protein, 9 aa, Homo Sapiens
LIIVFLFAC

SEQ ID NO: 848464 - protein, 9 aa, Homo Sapiens
TLSKGVAVF

SEQ ID NO: 848465 - protein, 9 aa, Homo Sapiens
TVPGEQTSY

SEQ ID NO: 848466 - protein, 9 aa, Homo Sapiens
WDLMDKELL

SEQ ID NO: 848467 - protein, 9 aa, Homo Sapiens
SLKDKKSAA

SEQ ID NO: 848468 - protein, 9 aa, Homo Sapiens
SLQERVPID

SEQ ID NO: 848469 - protein, 9 aa, Homo Sapiens
VIEAPDPVP

SEQ ID NO: 848470 - protein, 9 aa, Homo Sapiens
GRNKKRRKR

SEQ ID NO: 848471 - protein, 9 aa, Homo Sapiens
AGRIYIRAN

SEQ ID NO: 848472 - protein, 9 aa, Homo Sapiens
QLEKMNVNI

SEQ ID NO: 848473 - protein, 9 aa, Homo Sapiens
APQDGESTQ

SEQ ID NO: 848474 - protein, 9 aa, Homo Sapiens
TIIYLLSGV

SEQ ID NO: 848475 - protein, 9 aa, Homo Sapiens
FRRPHDPKT

SEQ ID NO: 848476 - protein, 9 aa, Homo Sapiens
TNSDLRNDS

SEQ ID NO: 848477 - protein, 9 aa, Homo Sapiens
RNYNKQSSE

SEQ ID NO: 848478 - protein, 9 aa, Homo Sapiens
KGSLGSDMG

SEQ ID NO: 848479 - protein, 9 aa, Homo Sapiens
GINLIQTIQ

SEQ ID NO: 848480 - protein, 9 aa, Homo Sapiens
QSFPQPLPW

SEQ ID NO: 848481 - protein, 9 aa, Homo Sapiens
ECYNSRENC

SEQ ID NO: 848482 - protein, 9 aa, Homo Sapiens
NLTVAEEKS

SEQ ID NO: 848483 - protein, 9 aa, Homo Sapiens
RADAETLWK

SEQ ID NO: 848484 - protein, 9 aa, Homo Sapiens
QVIGLCKEA

SEQ ID NO: 848485 - protein, 9 aa, Homo Sapiens
SGSRDLSRH

SEQ ID NO: 848486 - protein, 9 aa, Homo Sapiens
EAIIMRHEE

SEQ ID NO: 848487 - protein, 9 aa, Homo Sapiens
QCNTNCCQE

SEQ ID NO: 848488 - protein, 9 aa, Homo Sapiens
WLQEAPAAQ

SEQ ID NO: 848489 - protein, 9 aa, Homo Sapiens
GIELHSFEV

SEQ ID NO: 848490 - protein, 9 aa, Homo Sapiens
KVISYRSGI

SEQ ID NO: 848491 - protein, 9 aa, Homo Sapiens
VTACPRQEL

SEQ ID NO: 848492 - protein, 9 aa, Homo Sapiens
LRFSVTWGL

SEQ ID NO: 848493 - protein, 9 aa, Homo Sapiens
NLQTLCLDD

SEQ ID NO: 848494 - protein, 9 aa, Homo Sapiens
LALLVLALA

SEQ ID NO: 848495 - protein, 9 aa, Homo Sapiens
EDEREKQEK

SEQ ID NO: 848496 - protein, 9 aa, Homo Sapiens
HNRNLLNKK

SEQ ID NO: 848497 - protein, 9 aa, Homo Sapiens
ISVLLMLNM

SEQ ID NO: 848498 - protein, 9 aa, Homo Sapiens
SKKIARIAV

SEQ ID NO: 848499 - protein, 9 aa, Homo Sapiens
NKPREKTVK

SEQ ID NO: 848500 - protein, 9 aa, Homo Sapiens
ILGQVFISD

SEQ ID NO: 848501 - protein, 9 aa, Homo Sapiens
AFGDQNCST

SEQ ID NO: 848502 - protein, 9 aa, Homo Sapiens
NLTAHEVWN

SEQ ID NO: 848503 - protein, 9 aa, Homo Sapiens
NEHMNIHIG

SEQ ID NO: 848504 - protein, 9 aa, Homo Sapiens
ETFMEKLGN

SEQ ID NO: 848505 - protein, 9 aa, Homo Sapiens
CKVCGVMLQ

SEQ ID NO: 848506 - protein, 9 aa, Homo Sapiens
NVKEILTSL

SEQ ID NO: 848507 - protein, 9 aa, Homo Sapiens
AHPDMEAGP

SEQ ID NO: 848508 - protein, 9 aa, Homo Sapiens
SSCNQNVHE

SEQ ID NO: 848509 - protein, 9 aa, Homo Sapiens
GSVQTPPAL

SEQ ID NO: 848510 - protein, 9 aa, Homo Sapiens
TKLFPEFRP

SEQ ID NO: 848511 - protein, 9 aa, Homo Sapiens
TSSLPLQCI

SEQ ID NO: 848512 - protein, 9 aa, Homo Sapiens
TPRLTISEL

SEQ ID NO: 848513 - protein, 9 aa, Homo Sapiens
IRYGNYSLF

SEQ ID NO: 848514 - protein, 9 aa, Homo Sapiens
VSPPPSSSS

SEQ ID NO: 848515 - protein, 9 aa, Homo Sapiens
CRLIGVTEI

SEQ ID NO: 848516 - protein, 9 aa, Homo Sapiens
DVQMLQGAI

SEQ ID NO: 848517 - protein, 9 aa, Homo Sapiens
TKGDIMIDS

SEQ ID NO: 848518 - protein, 9 aa, Homo Sapiens
TRTEVVAGA

SEQ ID NO: 848519 - protein, 9 aa, Homo Sapiens
ARGEIARIW

SEQ ID NO: 848520 - protein, 9 aa, Homo Sapiens
PNPPTFVQG

SEQ ID NO: 848521 - protein, 9 aa, Homo Sapiens
MAKDRINHC

SEQ ID NO: 848522 - protein, 9 aa, Homo Sapiens
QQRKSEKRR

SEQ ID NO: 848523 - protein, 9 aa, Homo Sapiens
KHLNNINIR

SEQ ID NO: 848524 - protein, 9 aa, Homo Sapiens
THTGEKLFK

SEQ ID NO: 848525 - protein, 9 aa, Homo Sapiens
SCTNTRVYK

SEQ ID NO: 848526 - protein, 9 aa, Homo Sapiens
TPDKTDMTP

SEQ ID NO: 848527 - protein, 9 aa, Homo Sapiens
PALEPFIYD

SEQ ID NO: 848528 - protein, 9 aa, Homo Sapiens
WSSFAALPC

SEQ ID NO: 848529 - protein, 9 aa, Homo Sapiens
PLNNLSLTE

SEQ ID NO: 848530 - protein, 9 aa, Homo Sapiens
LDHFQVDNL

SEQ ID NO: 848531 - protein, 9 aa, Homo Sapiens
EHLAALQCE

SEQ ID NO: 848532 - protein, 9 aa, Homo Sapiens
ASLIYSTNT

SEQ ID NO: 848533 - protein, 9 aa, Homo Sapiens
LPKQFLPTM

SEQ ID NO: 848534 - protein, 9 aa, Homo Sapiens
TQECGEYLS

SEQ ID NO: 848535 - protein, 9 aa, Homo Sapiens
NPQTEEVSS

SEQ ID NO: 848536 - protein, 9 aa, Homo Sapiens
KQRTEKRIK

SEQ ID NO: 848537 - protein, 9 aa, Homo Sapiens
TLKLCMNLP

SEQ ID NO: 848538 - protein, 9 aa, Homo Sapiens
GGTHKRYFS

SEQ ID NO: 848539 - protein, 9 aa, Homo Sapiens
YRVAGQLQE

SEQ ID NO: 848540 - protein, 9 aa, Homo Sapiens
IAHAFTKNS

SEQ ID NO: 848541 - protein, 9 aa, Homo Sapiens
RWWSQYTGI

SEQ ID NO: 848542 - protein, 9 aa, Homo Sapiens
ICLKHNIRN

SEQ ID NO: 848543 - protein, 9 aa, Homo Sapiens
QNIIRDQMQ

SEQ ID NO: 848544 - protein, 9 aa, Homo Sapiens
QNKIKLAVL

SEQ ID NO: 848545 - protein, 9 aa, Homo Sapiens
GKYDDEEFE

SEQ ID NO: 848546 - protein, 9 aa, Homo Sapiens
WHTKDMDLY

SEQ ID NO: 848547 - protein, 9 aa, Homo Sapiens
EMFERNPSD

SEQ ID NO: 848548 - protein, 9 aa, Homo Sapiens
KGKEFGFIK

SEQ ID NO: 848549 - protein, 9 aa, Homo Sapiens
ITDNSYQCK

SEQ ID NO: 848550 - protein, 9 aa, Homo Sapiens
QGDRGQGVL

SEQ ID NO: 848551 - protein, 9 aa, Homo Sapiens
ENTFIVRDF

SEQ ID NO: 848552 - protein, 9 aa, Homo Sapiens
RTGAVDSVV

SEQ ID NO: 848553 - protein, 9 aa, Homo Sapiens
GLDPNLLDS

SEQ ID NO: 848554 - protein, 9 aa, Homo Sapiens
FTGVFAFGP

SEQ ID NO: 848555 - protein, 9 aa, Homo Sapiens
ASENRLERL

SEQ ID NO: 848556 - protein, 9 aa, Homo Sapiens
LTQHQIIYI

SEQ ID NO: 848557 - protein, 9 aa, Homo Sapiens
KKPSCGVPD

SEQ ID NO: 848558 - protein, 9 aa, Homo Sapiens
CSTIVIGNG

SEQ ID NO: 848559 - protein, 9 aa, Homo Sapiens
EPKHPGGKH

SEQ ID NO: 848560 - protein, 9 aa, Homo Sapiens
YSSGQSSGY

SEQ ID NO: 848561 - protein, 9 aa, Homo Sapiens
RKRMNRFKD

SEQ ID NO: 848562 - protein, 9 aa, Homo Sapiens
VVDYGKLLD

SEQ ID NO: 848563 - protein, 9 aa, Homo Sapiens
VINSSESVG

SEQ ID NO: 848564 - protein, 9 aa, Homo Sapiens
CRYKTIQTM

SEQ ID NO: 848565 - protein, 9 aa, Homo Sapiens
FVKNMNRYS

SEQ ID NO: 848566 - protein, 9 aa, Homo Sapiens
CLIKSPDCL

SEQ ID NO: 848567 - protein, 9 aa, Homo Sapiens
HREIEIQAH

SEQ ID NO: 848568 - protein, 9 aa, Homo Sapiens
TDNNGEGGA

SEQ ID NO: 848569 - protein, 9 aa, Homo Sapiens
IIFPGSTGH

SEQ ID NO: 848570 - protein, 9 aa, Homo Sapiens
RNRLNNYLH

SEQ ID NO: 848571 - protein, 9 aa, Homo Sapiens
SDSWEAFWR

SEQ ID NO: 848572 - protein, 9 aa, Homo Sapiens
FISCLLGSP

SEQ ID NO: 848573 - protein, 9 aa, Homo Sapiens
RLVALQRQA

SEQ ID NO: 848574 - protein, 9 aa, Homo Sapiens
AVYDFDCFS

SEQ ID NO: 848575 - protein, 9 aa, Homo Sapiens
QQRRSDLNR

SEQ ID NO: 848576 - protein, 9 aa, Homo Sapiens
FKQAAFDVG

SEQ ID NO: 848577 - protein, 9 aa, Homo Sapiens
KQWRIKLGF

SEQ ID NO: 848578 - protein, 9 aa, Homo Sapiens
ALEIQSSLS

SEQ ID NO: 848579 - protein, 9 aa, Homo Sapiens
KSTRQKKER

SEQ ID NO: 848580 - protein, 9 aa, Homo Sapiens
RGVVSVFVK

SEQ ID NO: 848581 - protein, 9 aa, Homo Sapiens
KLSTIPAGS

SEQ ID NO: 848582 - protein, 9 aa, Homo Sapiens
PAAIPKDKA

SEQ ID NO: 848583 - protein, 9 aa, Homo Sapiens
TEEDYQALQ

SEQ ID NO: 848584 - protein, 9 aa, Homo Sapiens
LESMDLSQY

SEQ ID NO: 848585 - protein, 9 aa, Homo Sapiens
KRASAEESN

SEQ ID NO: 848586 - protein, 9 aa, Homo Sapiens
LDVSSKSRT

SEQ ID NO: 848587 - protein, 9 aa, Homo Sapiens
LIYLSKGTQ

SEQ ID NO: 848588 - protein, 9 aa, Homo Sapiens
YILGWICLC

SEQ ID NO: 848589 - protein, 9 aa, Homo Sapiens
SHLARHQTI

SEQ ID NO: 848590 - protein, 9 aa, Homo Sapiens
KLNENSTPD

SEQ ID NO: 848591 - protein, 9 aa, Homo Sapiens
DLASDVVRI

SEQ ID NO: 848592 - protein, 9 aa, Homo Sapiens
ALIFRHLSM

SEQ ID NO: 848593 - protein, 9 aa, Homo Sapiens
PLKTKGELL

SEQ ID NO: 848594 - protein, 9 aa, Homo Sapiens
LASLFERYG

SEQ ID NO: 848595 - protein, 9 aa, Homo Sapiens
GTQVWKNKG

SEQ ID NO: 848596 - protein, 9 aa, Homo Sapiens
SKIFFIILL

SEQ ID NO: 848597 - protein, 9 aa, Homo Sapiens
EVKIIENAA

SEQ ID NO: 848598 - protein, 9 aa, Homo Sapiens
NRSPSFSTD

SEQ ID NO: 848599 - protein, 9 aa, Homo Sapiens
LHSMTDYPP

SEQ ID NO: 848600 - protein, 9 aa, Homo Sapiens
FHCQQEDIK

SEQ ID NO: 848601 - protein, 9 aa, Homo Sapiens
FLLCVCIMM

SEQ ID NO: 848602 - protein, 9 aa, Homo Sapiens
VFLLLFAPF

SEQ ID NO: 848603 - protein, 9 aa, Homo Sapiens
FSGHATLHA

SEQ ID NO: 848604 - protein, 9 aa, Homo Sapiens
GSVAYYVAR

SEQ ID NO: 848605 - protein, 9 aa, Homo Sapiens
GLFNNNPRH

SEQ ID NO: 848606 - protein, 9 aa, Homo Sapiens
RRREINKIA

SEQ ID NO: 848607 - protein, 9 aa, Homo Sapiens
HTSTKQVEL

SEQ ID NO: 848608 - protein, 9 aa, Homo Sapiens
GDGKKAHHD

SEQ ID NO: 848609 - protein, 9 aa, Homo Sapiens
HGFYPPEMY

SEQ ID NO: 848610 - protein, 9 aa, Homo Sapiens
LAWLYFKIF

SEQ ID NO: 848611 - protein, 9 aa, Homo Sapiens
VQKRRQVLK

SEQ ID NO: 848612 - protein, 9 aa, Homo Sapiens
REDGSFADT

SEQ ID NO: 848613 - protein, 9 aa, Homo Sapiens
SIILLTLML

SEQ ID NO: 848614 - protein, 9 aa, Homo Sapiens
QLQFEGERV

SEQ ID NO: 848615 - protein, 9 aa, Homo Sapiens
ANDDLARLL

SEQ ID NO: 848616 - protein, 9 aa, Homo Sapiens
FNGERLRLQ

SEQ ID NO: 848617 - protein, 9 aa, Homo Sapiens
IKWLEANAE

SEQ ID NO: 848618 - protein, 9 aa, Homo Sapiens
TQLSQEAQI

SEQ ID NO: 848619 - protein, 9 aa, Homo Sapiens
NSYMPVIDV

SEQ ID NO: 848620 - protein, 9 aa, Homo Sapiens
DGSFKIGNL

SEQ ID NO: 848621 - protein, 9 aa, Homo Sapiens
KSSVSGICI

SEQ ID NO: 848622 - protein, 9 aa, Homo Sapiens
KNVNLNTGM

SEQ ID NO: 848623 - protein, 9 aa, Homo Sapiens
SKNDRKEDK

SEQ ID NO: 848624 - protein, 9 aa, Homo Sapiens
ETPNSEFIQ

SEQ ID NO: 848625 - protein, 9 aa, Homo Sapiens
TSEDYTLLE

SEQ ID NO: 848626 - protein, 9 aa, Homo Sapiens
AKTSAVNNT

SEQ ID NO: 848627 - protein, 9 aa, Homo Sapiens
RISTSTFFD

SEQ ID NO: 848628 - protein, 9 aa, Homo Sapiens
NKLVKAFKK

SEQ ID NO: 848629 - protein, 9 aa, Homo Sapiens
GYGVEGTLA

SEQ ID NO: 848630 - protein, 9 aa, Homo Sapiens
IQPLNRRAI

SEQ ID NO: 848631 - protein, 9 aa, Homo Sapiens
FMERNRAAA

SEQ ID NO: 848632 - protein, 9 aa, Homo Sapiens
MAQGSLLFG

SEQ ID NO: 848633 - protein, 9 aa, Homo Sapiens
TGDCGNGGD

SEQ ID NO: 848634 - protein, 9 aa, Homo Sapiens
MQILTERGY

SEQ ID NO: 848635 - protein, 9 aa, Homo Sapiens
GHVAHLEDY

SEQ ID NO: 848636 - protein, 9 aa, Homo Sapiens
KRINSAVKT

SEQ ID NO: 848637 - protein, 9 aa, Homo Sapiens
FFFNIFTLQ

SEQ ID NO: 848638 - protein, 9 aa, Homo Sapiens
MKDAINKFV

SEQ ID NO: 848639 - protein, 9 aa, Homo Sapiens
TIRDDMIPK

SEQ ID NO: 848640 - protein, 9 aa, Homo Sapiens
NVSKLASNA

SEQ ID NO: 848641 - protein, 9 aa, Homo Sapiens
LAPQNLPST

SEQ ID NO: 848642 - protein, 9 aa, Homo Sapiens
SKPLMTPTA

SEQ ID NO: 848643 - protein, 9 aa, Homo Sapiens
KQTCHFSTL

SEQ ID NO: 848644 - protein, 9 aa, Homo Sapiens
LMTPYIAHS

SEQ ID NO: 848645 - protein, 9 aa, Homo Sapiens
HPLNKSLVN

SEQ ID NO: 848646 - protein, 9 aa, Homo Sapiens
SEDKKPLET

SEQ ID NO: 848647 - protein, 9 aa, Homo Sapiens
ADEILWGQH

SEQ ID NO: 848648 - protein, 9 aa, Homo Sapiens
EPFRLFIPV

SEQ ID NO: 848649 - protein, 9 aa, Homo Sapiens
INRTIFQKG

SEQ ID NO: 848650 - protein, 9 aa, Homo Sapiens
PVDVILDSV

SEQ ID NO: 848651 - protein, 9 aa, Homo Sapiens
AKQFAVSSG

SEQ ID NO: 848652 - protein, 9 aa, Homo Sapiens
KKSSSIISD

SEQ ID NO: 848653 - protein, 9 aa, Homo Sapiens
YIHLPDGSA

SEQ ID NO: 848654 - protein, 9 aa, Homo Sapiens
TDSKFLKLV

SEQ ID NO: 848655 - protein, 9 aa, Homo Sapiens
WEDFNVFTK

SEQ ID NO: 848656 - protein, 9 aa, Homo Sapiens
GDQQLLTRV

SEQ ID NO: 848657 - protein, 9 aa, Homo Sapiens
PIIYSLINK

SEQ ID NO: 848658 - protein, 9 aa, Homo Sapiens
MYFSLSNLS

SEQ ID NO: 848659 - protein, 9 aa, Homo Sapiens
DSEDESGIN

SEQ ID NO: 848660 - protein, 9 aa, Homo Sapiens
LQIHLRLHT

SEQ ID NO: 848661 - protein, 9 aa, Homo Sapiens
NKCKPNRTP

SEQ ID NO: 848662 - protein, 9 aa, Homo Sapiens
AAEERDKRL

SEQ ID NO: 848663 - protein, 9 aa, Homo Sapiens
GFIPLVMYL

SEQ ID NO: 848664 - protein, 9 aa, Homo Sapiens
HEPVLKAMF

SEQ ID NO: 848665 - protein, 9 aa, Homo Sapiens
QGLYSWLLV

SEQ ID NO: 848666 - protein, 9 aa, Homo Sapiens
SISTITRIY

SEQ ID NO: 848667 - protein, 9 aa, Homo Sapiens
QGQPTGNVW

SEQ ID NO: 848668 - protein, 9 aa, Homo Sapiens
GRKPQGLAE

SEQ ID NO: 848669 - protein, 9 aa, Homo Sapiens
SSTRESGDS

SEQ ID NO: 848670 - protein, 9 aa, Homo Sapiens
TAHQRRHTG

SEQ ID NO: 848671 - protein, 9 aa, Homo Sapiens
FYRFSRDDI

SEQ ID NO: 848672 - protein, 9 aa, Homo Sapiens
FTSEHSHFY

SEQ ID NO: 848673 - protein, 9 aa, Homo Sapiens
GKPQKRKKR

SEQ ID NO: 848674 - protein, 9 aa, Homo Sapiens
MIGPENTLM

SEQ ID NO: 848675 - protein, 9 aa, Homo Sapiens
YSKIFFIIL

SEQ ID NO: 848676 - protein, 9 aa, Homo Sapiens
TAVIFSDYR

SEQ ID NO: 848677 - protein, 9 aa, Homo Sapiens
NLKRHMRTH

SEQ ID NO: 848678 - protein, 9 aa, Homo Sapiens
SGLLSLRVN

SEQ ID NO: 848679 - protein, 9 aa, Homo Sapiens
PGYSFSPRD

SEQ ID NO: 848680 - protein, 9 aa, Homo Sapiens
CLKRNPRSY

SEQ ID NO: 848681 - protein, 9 aa, Homo Sapiens
AAEGHIKVV

SEQ ID NO: 848682 - protein, 9 aa, Homo Sapiens
EASNKPVTI

SEQ ID NO: 848683 - protein, 9 aa, Homo Sapiens
GLPGPKGND

SEQ ID NO: 848684 - protein, 9 aa, Homo Sapiens
ADQSAGKNN

SEQ ID NO: 848685 - protein, 9 aa, Homo Sapiens
DYIKEYKFR

SEQ ID NO: 848686 - protein, 9 aa, Homo Sapiens
SNTSGEICQ

SEQ ID NO: 848687 - protein, 9 aa, Homo Sapiens
SHSYMLWYR

SEQ ID NO: 848688 - protein, 9 aa, Homo Sapiens
DKQGVICDA

SEQ ID NO: 848689 - protein, 9 aa, Homo Sapiens
NAGVVLFNF

SEQ ID NO: 848690 - protein, 9 aa, Homo Sapiens
KIIDKSRRD

SEQ ID NO: 848691 - protein, 9 aa, Homo Sapiens
GIYCLCHKV

SEQ ID NO: 848692 - protein, 9 aa, Homo Sapiens
TKPLKTVII

SEQ ID NO: 848693 - protein, 9 aa, Homo Sapiens
IYFVGCFAQ

SEQ ID NO: 848694 - protein, 9 aa, Homo Sapiens
YLQTDDRVE

SEQ ID NO: 848695 - protein, 9 aa, Homo Sapiens
KKNLLEGEV

SEQ ID NO: 848696 - protein, 9 aa, Homo Sapiens
VAIEVIKDT

SEQ ID NO: 848697 - protein, 9 aa, Homo Sapiens
HLNMKKTAL

SEQ ID NO: 848698 - protein, 9 aa, Homo Sapiens
QKVGQVILI

SEQ ID NO: 848699 - protein, 9 aa, Homo Sapiens
DDVTMLFPD

SEQ ID NO: 848700 - protein, 9 aa, Homo Sapiens
QNGAPLKVK

SEQ ID NO: 848701 - protein, 9 aa, Homo Sapiens
VYGLNKFRW

SEQ ID NO: 848702 - protein, 9 aa, Homo Sapiens
RVYLMTLGK

SEQ ID NO: 848703 - protein, 9 aa, Homo Sapiens
KVSYLRSGT

SEQ ID NO: 848704 - protein, 9 aa, Homo Sapiens
FGDQNCSTI

SEQ ID NO: 848705 - protein, 9 aa, Homo Sapiens
YIQQSMHGR

SEQ ID NO: 848706 - protein, 9 aa, Homo Sapiens
NPNNSWNSY

SEQ ID NO: 848707 - protein, 9 aa, Homo Sapiens
DSAHGVQRD

SEQ ID NO: 848708 - protein, 9 aa, Homo Sapiens
RNPSTLCSG

SEQ ID NO: 848709 - protein, 9 aa, Homo Sapiens
SCSHDSYNR

SEQ ID NO: 848710 - protein, 9 aa, Homo Sapiens
DVYYYHIII

SEQ ID NO: 848711 - protein, 9 aa, Homo Sapiens
GGVYSYSGL

SEQ ID NO: 848712 - protein, 9 aa, Homo Sapiens
PRTTTGTLS

SEQ ID NO: 848713 - protein, 9 aa, Homo Sapiens
LTVELQFKR

SEQ ID NO: 848714 - protein, 9 aa, Homo Sapiens
KQEGRHIEV

SEQ ID NO: 848715 - protein, 9 aa, Homo Sapiens
VISQGKIIF

SEQ ID NO: 848716 - protein, 9 aa, Homo Sapiens
FFLLNKTLH

SEQ ID NO: 848717 - protein, 9 aa, Homo Sapiens
STTLKYGLL

SEQ ID NO: 848718 - protein, 9 aa, Homo Sapiens
VTLLMVLTH

SEQ ID NO: 848719 - protein, 9 aa, Homo Sapiens
QDGESTQSG

SEQ ID NO: 848720 - protein, 9 aa, Homo Sapiens
AISSSAILR

SEQ ID NO: 848721 - protein, 9 aa, Homo Sapiens
FQGVMQKHS

SEQ ID NO: 848722 - protein, 9 aa, Homo Sapiens
VHQITHKGE

SEQ ID NO: 848723 - protein, 9 aa, Homo Sapiens
ILSGGALKL

SEQ ID NO: 848724 - protein, 9 aa, Homo Sapiens
LFSCLEDRH

SEQ ID NO: 848725 - protein, 9 aa, Homo Sapiens
LMAALCPRK

SEQ ID NO: 848726 - protein, 9 aa, Homo Sapiens
EFKVVETYP

SEQ ID NO: 848727 - protein, 9 aa, Homo Sapiens
FKDEFSPMK

SEQ ID NO: 848728 - protein, 9 aa, Homo Sapiens
LKETPQMLF

SEQ ID NO: 848729 - protein, 9 aa, Homo Sapiens
SFLPGLEED

SEQ ID NO: 848730 - protein, 9 aa, Homo Sapiens
SLAAQTFIS

SEQ ID NO: 848731 - protein, 9 aa, Homo Sapiens
RLSQSNPKR

SEQ ID NO: 848732 - protein, 9 aa, Homo Sapiens
FRRKYEEAQ

SEQ ID NO: 848733 - protein, 9 aa, Homo Sapiens
CCNYSLHVA

SEQ ID NO: 848734 - protein, 9 aa, Homo Sapiens
VTEKSTKHP

SEQ ID NO: 848735 - protein, 9 aa, Homo Sapiens
GKTFIFKRN

SEQ ID NO: 848736 - protein, 9 aa, Homo Sapiens
PTKVAKACS

SEQ ID NO: 848737 - protein, 9 aa, Homo Sapiens
RYLVKLICL

SEQ ID NO: 848738 - protein, 9 aa, Homo Sapiens
GHINLNQVR

SEQ ID NO: 848739 - protein, 9 aa, Homo Sapiens
SVQYHYFKG

SEQ ID NO: 848740 - protein, 9 aa, Homo Sapiens
RHTYFYAPE

SEQ ID NO: 848741 - protein, 9 aa, Homo Sapiens
VAVDLPVPS

SEQ ID NO: 848742 - protein, 9 aa, Homo Sapiens
KDKNCNLPR

SEQ ID NO: 848743 - protein, 9 aa, Homo Sapiens
KTGSLNAYL

SEQ ID NO: 848744 - protein, 9 aa, Homo Sapiens
TKGIEAPLQ

SEQ ID NO: 848745 - protein, 9 aa, Homo Sapiens
LINVTLLDL

SEQ ID NO: 848746 - protein, 9 aa, Homo Sapiens
IFDMHIPYF

SEQ ID NO: 848747 - protein, 9 aa, Homo Sapiens
LQDYCNAIK

SEQ ID NO: 848748 - protein, 9 aa, Homo Sapiens
RKLITDLQP

SEQ ID NO: 848749 - protein, 9 aa, Homo Sapiens
MNMANVLRG

SEQ ID NO: 848750 - protein, 9 aa, Homo Sapiens
IHWKIHTED

SEQ ID NO: 848751 - protein, 9 aa, Homo Sapiens
GTRTVVCVW

SEQ ID NO: 848752 - protein, 9 aa, Homo Sapiens
GWINVFLLS

SEQ ID NO: 848753 - protein, 9 aa, Homo Sapiens
PDAWLMTSN

SEQ ID NO: 848754 - protein, 9 aa, Homo Sapiens
KTCRRILFM

SEQ ID NO: 848755 - protein, 9 aa, Homo Sapiens
EGLANQFFS

SEQ ID NO: 848756 - protein, 9 aa, Homo Sapiens
EYLEFKEPK

SEQ ID NO: 848757 - protein, 9 aa, Homo Sapiens
NGRIYVTGG

SEQ ID NO: 848758 - protein, 9 aa, Homo Sapiens
FISGTPQRK

SEQ ID NO: 848759 - protein, 9 aa, Homo Sapiens
SATPTPPPG

SEQ ID NO: 848760 - protein, 9 aa, Homo Sapiens
SGTSGMEES

SEQ ID NO: 848761 - protein, 9 aa, Homo Sapiens
AMANCNSLR

SEQ ID NO: 848762 - protein, 9 aa, Homo Sapiens
KSSLLSCVY

SEQ ID NO: 848763 - protein, 9 aa, Homo Sapiens
EIWDACAET

SEQ ID NO: 848764 - protein, 9 aa, Homo Sapiens
NKNTWEQML

SEQ ID NO: 848765 - protein, 9 aa, Homo Sapiens
QRRYWELPW

SEQ ID NO: 848766 - protein, 9 aa, Homo Sapiens
EWTANVTAK

SEQ ID NO: 848767 - protein, 9 aa, Homo Sapiens
VELLGDMDC

SEQ ID NO: 848768 - protein, 9 aa, Homo Sapiens
GAGVRTHSV

SEQ ID NO: 848769 - protein, 9 aa, Homo Sapiens
ALRWLEDGF

SEQ ID NO: 848770 - protein, 9 aa, Homo Sapiens
YNCRERMVY

SEQ ID NO: 848771 - protein, 9 aa, Homo Sapiens
KRVRIIAMR

SEQ ID NO: 848772 - protein, 9 aa, Homo Sapiens
VWPDSQNPD

SEQ ID NO: 848773 - protein, 9 aa, Homo Sapiens
LHSLRHGNW

SEQ ID NO: 848774 - protein, 9 aa, Homo Sapiens
KFRQIVLAV

SEQ ID NO: 848775 - protein, 9 aa, Homo Sapiens
WQSRHSGAT

SEQ ID NO: 848776 - protein, 9 aa, Homo Sapiens
EEDAGEDEE

SEQ ID NO: 848777 - protein, 9 aa, Homo Sapiens
VFEYCDNTL

SEQ ID NO: 848778 - protein, 9 aa, Homo Sapiens
REWLQLTMY

SEQ ID NO: 848779 - protein, 9 aa, Homo Sapiens
FMFLLVGDL

SEQ ID NO: 848780 - protein, 9 aa, Homo Sapiens
HMEVPGADG

SEQ ID NO: 848781 - protein, 9 aa, Homo Sapiens
CGKAFSDLY

SEQ ID NO: 848782 - protein, 9 aa, Homo Sapiens
NLGNNGNMT

SEQ ID NO: 848783 - protein, 9 aa, Homo Sapiens
IVNRGEHNN

SEQ ID NO: 848784 - protein, 9 aa, Homo Sapiens
QHNAIISPT

SEQ ID NO: 848785 - protein, 9 aa, Homo Sapiens
EILVKRYLT

SEQ ID NO: 848786 - protein, 9 aa, Homo Sapiens
CKKIILPTT

SEQ ID NO: 848787 - protein, 9 aa, Homo Sapiens
RYLVYICFQ

SEQ ID NO: 848788 - protein, 9 aa, Homo Sapiens
TVPLSRLLK

SEQ ID NO: 848789 - protein, 9 aa, Homo Sapiens
LEDKLCEWM

SEQ ID NO: 848790 - protein, 9 aa, Homo Sapiens
DFTALINFW

SEQ ID NO: 848791 - protein, 9 aa, Homo Sapiens
DVFNSKNEA

SEQ ID NO: 848792 - protein, 9 aa, Homo Sapiens
IINKKLDIS

SEQ ID NO: 848793 - protein, 9 aa, Homo Sapiens
VMVIDRIFL

SEQ ID NO: 848794 - protein, 9 aa, Homo Sapiens
IQSSLSEKR

SEQ ID NO: 848795 - protein, 9 aa, Homo Sapiens
RYLLGVINA

SEQ ID NO: 848796 - protein, 9 aa, Homo Sapiens
TTAFLDGFN

SEQ ID NO: 848797 - protein, 9 aa, Homo Sapiens
KRRQAKLEL

SEQ ID NO: 848798 - protein, 9 aa, Homo Sapiens
CNPKHSAIK

SEQ ID NO: 848799 - protein, 9 aa, Homo Sapiens
NVDVESTDY

SEQ ID NO: 848800 - protein, 9 aa, Homo Sapiens
QLTNKGQPR

SEQ ID NO: 848801 - protein, 9 aa, Homo Sapiens
AKLEEIYES

SEQ ID NO: 848802 - protein, 9 aa, Homo Sapiens
EYFTFKHEC

SEQ ID NO: 848803 - protein, 9 aa, Homo Sapiens
CAEEARKKM

SEQ ID NO: 848804 - protein, 9 aa, Homo Sapiens
CLFSVVAFK

SEQ ID NO: 848805 - protein, 9 aa, Homo Sapiens
KIYVLLCRQ

SEQ ID NO: 848806 - protein, 9 aa, Homo Sapiens
ELPHAYKCS

SEQ ID NO: 848807 - protein, 9 aa, Homo Sapiens
HNRIQSFKL

SEQ ID NO: 848808 - protein, 9 aa, Homo Sapiens
RLPTASTCI

SEQ ID NO: 848809 - protein, 9 aa, Homo Sapiens
YHWMHICSA

SEQ ID NO: 848810 - protein, 9 aa, Homo Sapiens
KRLTHKDDS

SEQ ID NO: 848811 - protein, 9 aa, Homo Sapiens
ELRYRKCPF

SEQ ID NO: 848812 - protein, 9 aa, Homo Sapiens
KGKCSRHKV

SEQ ID NO: 848813 - protein, 9 aa, Homo Sapiens
SVVCRFAHL

SEQ ID NO: 848814 - protein, 9 aa, Homo Sapiens
SFQSLFQDV

SEQ ID NO: 848815 - protein, 9 aa, Homo Sapiens
ILGSEPLNH

SEQ ID NO: 848816 - protein, 9 aa, Homo Sapiens
LKNDIGGDG

SEQ ID NO: 848817 - protein, 9 aa, Homo Sapiens
LIREEECSP

SEQ ID NO: 848818 - protein, 9 aa, Homo Sapiens
EMCVETMEL

SEQ ID NO: 848819 - protein, 9 aa, Homo Sapiens
SQPTNVSDA

SEQ ID NO: 848820 - protein, 9 aa, Homo Sapiens
AYNACVIQL

SEQ ID NO: 848821 - protein, 9 aa, Homo Sapiens
LFVNSECYV

SEQ ID NO: 848822 - protein, 9 aa, Homo Sapiens
CCNVTIIRI

SEQ ID NO: 848823 - protein, 9 aa, Homo Sapiens
SKHYKFTVG

SEQ ID NO: 848824 - protein, 9 aa, Homo Sapiens
IMLENHTVA

SEQ ID NO: 848825 - protein, 9 aa, Homo Sapiens
ECSAKTLYG

SEQ ID NO: 848826 - protein, 9 aa, Homo Sapiens
AFSQGFNEQ

SEQ ID NO: 848827 - protein, 9 aa, Homo Sapiens
LIRLDLPIL

SEQ ID NO: 848828 - protein, 9 aa, Homo Sapiens
DKLDVKQTE

SEQ ID NO: 848829 - protein, 9 aa, Homo Sapiens
SLGAIPQAH

SEQ ID NO: 848830 - protein, 9 aa, Homo Sapiens
KHDRNVECS

SEQ ID NO: 848831 - protein, 9 aa, Homo Sapiens
LRDYKSPTL

SEQ ID NO: 848832 - protein, 9 aa, Homo Sapiens
ALSSRLQTD

SEQ ID NO: 848833 - protein, 9 aa, Homo Sapiens
FKWQHQNNS

SEQ ID NO: 848834 - protein, 9 aa, Homo Sapiens
PPPLPTEHA

SEQ ID NO: 848835 - protein, 9 aa, Homo Sapiens
NFGSRPLHY

SEQ ID NO: 848836 - protein, 9 aa, Homo Sapiens
TGRYVSAEI

SEQ ID NO: 848837 - protein, 9 aa, Homo Sapiens
KRWNHPKMS

SEQ ID NO: 848838 - protein, 9 aa, Homo Sapiens
RLPKDLGTE

SEQ ID NO: 848839 - protein, 9 aa, Homo Sapiens
GSTSNHVVR

SEQ ID NO: 848840 - protein, 9 aa, Homo Sapiens
VDADINGLQ

SEQ ID NO: 848841 - protein, 9 aa, Homo Sapiens
LSGIKKPWH

SEQ ID NO: 848842 - protein, 9 aa, Homo Sapiens
SMNSATPDS

SEQ ID NO: 848843 - protein, 9 aa, Homo Sapiens
HTSKILMQY

SEQ ID NO: 848844 - protein, 9 aa, Homo Sapiens
WLNGPLVHV

SEQ ID NO: 848845 - protein, 9 aa, Homo Sapiens
EAVLAMSRR

SEQ ID NO: 848846 - protein, 9 aa, Homo Sapiens
TQPRQISAI

SEQ ID NO: 848847 - protein, 9 aa, Homo Sapiens
TFAFCCALG

SEQ ID NO: 848848 - protein, 9 aa, Homo Sapiens
LKVVSVESL

SEQ ID NO: 848849 - protein, 9 aa, Homo Sapiens
ESLKQLQIV

SEQ ID NO: 848850 - protein, 9 aa, Homo Sapiens
DKYIEEALT

SEQ ID NO: 848851 - protein, 9 aa, Homo Sapiens
ASSSKESSW

SEQ ID NO: 848852 - protein, 9 aa, Homo Sapiens
LARQISCKA

SEQ ID NO: 848853 - protein, 9 aa, Homo Sapiens
VTHSIKKMS

SEQ ID NO: 848854 - protein, 9 aa, Homo Sapiens
IINTNKLSA

SEQ ID NO: 848855 - protein, 9 aa, Homo Sapiens
HPNPPPDNV

SEQ ID NO: 848856 - protein, 9 aa, Homo Sapiens
NELQTFMIK

SEQ ID NO: 848857 - protein, 9 aa, Homo Sapiens
HEYGDKPHK

SEQ ID NO: 848858 - protein, 9 aa, Homo Sapiens
CVDDKGGFI

SEQ ID NO: 848859 - protein, 9 aa, Homo Sapiens
QFFLFNYIL

SEQ ID NO: 848860 - protein, 9 aa, Homo Sapiens
PDCSINGQW

SEQ ID NO: 848861 - protein, 9 aa, Homo Sapiens
GKNKSEYTV

SEQ ID NO: 848862 - protein, 9 aa, Homo Sapiens
SPIPDNAPE

SEQ ID NO: 848863 - protein, 9 aa, Homo Sapiens
GLVDGIYRL

SEQ ID NO: 848864 - protein, 9 aa, Homo Sapiens
GTTSEKLSN

SEQ ID NO: 848865 - protein, 9 aa, Homo Sapiens
HSSAKVWSR

SEQ ID NO: 848866 - protein, 9 aa, Homo Sapiens
GSYLSVLEG

SEQ ID NO: 848867 - protein, 9 aa, Homo Sapiens
AENGEQGPI

SEQ ID NO: 848868 - protein, 9 aa, Homo Sapiens
DGMGGDGDY

SEQ ID NO: 848869 - protein, 9 aa, Homo Sapiens
VDLVQAALI

SEQ ID NO: 848870 - protein, 9 aa, Homo Sapiens
LLVLHKSGL

SEQ ID NO: 848871 - protein, 9 aa, Homo Sapiens
EDLPLTMES

SEQ ID NO: 848872 - protein, 9 aa, Homo Sapiens
VAYSTVRSH

SEQ ID NO: 848873 - protein, 9 aa, Homo Sapiens
LTHGLRHKC

SEQ ID NO: 848874 - protein, 9 aa, Homo Sapiens
LWCSAIPEN

SEQ ID NO: 848875 - protein, 9 aa, Homo Sapiens
GGVSEDARL

SEQ ID NO: 848876 - protein, 9 aa, Homo Sapiens
KFHKTLKEM

SEQ ID NO: 848877 - protein, 9 aa, Homo Sapiens
FLQTYFQEF

SEQ ID NO: 848878 - protein, 9 aa, Homo Sapiens
SVRRLMLSE

SEQ ID NO: 848879 - protein, 9 aa, Homo Sapiens
KIKIQQIEQ

SEQ ID NO: 848880 - protein, 9 aa, Homo Sapiens
SQQKKTFFL

SEQ ID NO: 848881 - protein, 9 aa, Homo Sapiens
PTEWTSFVL

SEQ ID NO: 848882 - protein, 9 aa, Homo Sapiens
EINVSDCRS

SEQ ID NO: 848883 - protein, 9 aa, Homo Sapiens
PSCCSGLHS

SEQ ID NO: 848884 - protein, 9 aa, Homo Sapiens
IGDLHRSPH

SEQ ID NO: 848885 - protein, 9 aa, Homo Sapiens
SVEAVVMAR

SEQ ID NO: 848886 - protein, 9 aa, Homo Sapiens
QEGTSGKTV

SEQ ID NO: 848887 - protein, 9 aa, Homo Sapiens
RYKRIQRTF

SEQ ID NO: 848888 - protein, 9 aa, Homo Sapiens
SCSKAPLYG

SEQ ID NO: 848889 - protein, 9 aa, Homo Sapiens
ATTVEITFT

SEQ ID NO: 848890 - protein, 9 aa, Homo Sapiens
RAGEPILTQ

SEQ ID NO: 848891 - protein, 9 aa, Homo Sapiens
YTFSKPVLQ

SEQ ID NO: 848892 - protein, 9 aa, Homo Sapiens
EKFLKRADN

SEQ ID NO: 848893 - protein, 9 aa, Homo Sapiens
ERDHTGNKP

SEQ ID NO: 848894 - protein, 9 aa, Homo Sapiens
TMLRGDNNP

SEQ ID NO: 848895 - protein, 9 aa, Homo Sapiens
PWLNLHELG

SEQ ID NO: 848896 - protein, 9 aa, Homo Sapiens
PEAKAAKLE

SEQ ID NO: 848897 - protein, 9 aa, Homo Sapiens
SNKVLEKAF

SEQ ID NO: 848898 - protein, 9 aa, Homo Sapiens
VLQTDSKII

SEQ ID NO: 848899 - protein, 9 aa, Homo Sapiens
KSQAFVLNS

SEQ ID NO: 848900 - protein, 9 aa, Homo Sapiens
ENKRFTEEA

SEQ ID NO: 848901 - protein, 9 aa, Homo Sapiens
TTEFQLLAS

SEQ ID NO: 848902 - protein, 9 aa, Homo Sapiens
IKFIRQFIP

SEQ ID NO: 848903 - protein, 9 aa, Homo Sapiens
RVKKETFRS

SEQ ID NO: 848904 - protein, 9 aa, Homo Sapiens
MGHCLFVPR

SEQ ID NO: 848905 - protein, 9 aa, Homo Sapiens
NNRTSSIIP

SEQ ID NO: 848906 - protein, 9 aa, Homo Sapiens
RPVTFPSLP

SEQ ID NO: 848907 - protein, 9 aa, Homo Sapiens
RRLVPSAFD

SEQ ID NO: 848908 - protein, 9 aa, Homo Sapiens
PVALEVPFI

SEQ ID NO: 848909 - protein, 9 aa, Homo Sapiens
GHNNSPQLS

SEQ ID NO: 848910 - protein, 9 aa, Homo Sapiens
AFDDLFPVE

SEQ ID NO: 848911 - protein, 9 aa, Homo Sapiens
TDLAERTVR

SEQ ID NO: 848912 - protein, 9 aa, Homo Sapiens
FINYRFMSS

SEQ ID NO: 848913 - protein, 9 aa, Homo Sapiens
KANIEDEKK

SEQ ID NO: 848914 - protein, 9 aa, Homo Sapiens
ELCNHSESS

SEQ ID NO: 848915 - protein, 9 aa, Homo Sapiens
KTKLSLPGP

SEQ ID NO: 848916 - protein, 9 aa, Homo Sapiens
SKKEVSGDK

SEQ ID NO: 848917 - protein, 9 aa, Homo Sapiens
FTILSFYRF

SEQ ID NO: 848918 - protein, 9 aa, Homo Sapiens
TRKNLTCAH

SEQ ID NO: 848919 - protein, 9 aa, Homo Sapiens
APKFAKRNV

SEQ ID NO: 848920 - protein, 9 aa, Homo Sapiens
LGEYFLFTF

SEQ ID NO: 848921 - protein, 9 aa, Homo Sapiens
VMQIQAVGT

SEQ ID NO: 848922 - protein, 9 aa, Homo Sapiens
KMSVPMRIY

SEQ ID NO: 848923 - protein, 9 aa, Homo Sapiens
PRQAWVWAT

SEQ ID NO: 848924 - protein, 9 aa, Homo Sapiens
MRAVRVFEC

SEQ ID NO: 848925 - protein, 9 aa, Homo Sapiens
QLGQDGRRW

SEQ ID NO: 848926 - protein, 9 aa, Homo Sapiens
CGLSSMFLS

SEQ ID NO: 848927 - protein, 9 aa, Homo Sapiens
IRPSNGIWI

SEQ ID NO: 848928 - protein, 9 aa, Homo Sapiens
QGIFVDWKY

SEQ ID NO: 848929 - protein, 9 aa, Homo Sapiens
AIDKLSWGY

SEQ ID NO: 848930 - protein, 9 aa, Homo Sapiens
LGRSPINAS

SEQ ID NO: 848931 - protein, 9 aa, Homo Sapiens
SPYFCQNIA

SEQ ID NO: 848932 - protein, 9 aa, Homo Sapiens
APKETNSSS

SEQ ID NO: 848933 - protein, 9 aa, Homo Sapiens
AWTDNERSI

SEQ ID NO: 848934 - protein, 9 aa, Homo Sapiens
TSDIEPKNS

SEQ ID NO: 848935 - protein, 9 aa, Homo Sapiens
YRVVGGIMT

SEQ ID NO: 848936 - protein, 9 aa, Homo Sapiens
LVIMAVVIL

SEQ ID NO: 848937 - protein, 9 aa, Homo Sapiens
DIINGDGTA

SEQ ID NO: 848938 - protein, 9 aa, Homo Sapiens
KPVATNSCK

SEQ ID NO: 848939 - protein, 9 aa, Homo Sapiens
LGFRVRKIT

SEQ ID NO: 848940 - protein, 9 aa, Homo Sapiens
WIGLKMATN

SEQ ID NO: 848941 - protein, 9 aa, Homo Sapiens
CFINMAGNV

SEQ ID NO: 848942 - protein, 9 aa, Homo Sapiens
ILDKGHAKH

SEQ ID NO: 848943 - protein, 9 aa, Homo Sapiens
TSHMSQSSR

SEQ ID NO: 848944 - protein, 9 aa, Homo Sapiens
RFLQPYISI

SEQ ID NO: 848945 - protein, 9 aa, Homo Sapiens
RRSKAKYLT

SEQ ID NO: 848946 - protein, 9 aa, Homo Sapiens
PHRVLFQNV

SEQ ID NO: 848947 - protein, 9 aa, Homo Sapiens
AQKRGEARA

SEQ ID NO: 848948 - protein, 9 aa, Homo Sapiens
ERDTHKLWR

SEQ ID NO: 848949 - protein, 9 aa, Homo Sapiens
VGSGPGSVC

SEQ ID NO: 848950 - protein, 9 aa, Homo Sapiens
KHLNAITGS

SEQ ID NO: 848951 - protein, 9 aa, Homo Sapiens
LFSTDDSSA

SEQ ID NO: 848952 - protein, 9 aa, Homo Sapiens
EPQKLYPKR

SEQ ID NO: 848953 - protein, 9 aa, Homo Sapiens
CASISSEDL

SEQ ID NO: 848954 - protein, 9 aa, Homo Sapiens
LVTQHPEVV

SEQ ID NO: 848955 - protein, 9 aa, Homo Sapiens
CFIMIIIKT

SEQ ID NO: 848956 - protein, 9 aa, Homo Sapiens
MRVRNSLIH

SEQ ID NO: 848957 - protein, 9 aa, Homo Sapiens
CPKMCQWYQ

SEQ ID NO: 848958 - protein, 9 aa, Homo Sapiens
IVYTKEGEQ

SEQ ID NO: 848959 - protein, 9 aa, Homo Sapiens
ERVLQYLVE

SEQ ID NO: 848960 - protein, 9 aa, Homo Sapiens
QHFIDHLNK

SEQ ID NO: 848961 - protein, 9 aa, Homo Sapiens
MDFHTFYFE

SEQ ID NO: 848962 - protein, 9 aa, Homo Sapiens
DGDDSLERK

SEQ ID NO: 848963 - protein, 9 aa, Homo Sapiens
NKKLLYKKM

SEQ ID NO: 848964 - protein, 9 aa, Homo Sapiens
TKREHSKVP

SEQ ID NO: 848965 - protein, 9 aa, Homo Sapiens
DTAGKNALH

SEQ ID NO: 848966 - protein, 9 aa, Homo Sapiens
FVNFQMWDF

SEQ ID NO: 848967 - protein, 9 aa, Homo Sapiens
KEEDNGGRG

SEQ ID NO: 848968 - protein, 9 aa, Homo Sapiens
ECDTFIQKT

SEQ ID NO: 848969 - protein, 9 aa, Homo Sapiens
NSPQALKQI

SEQ ID NO: 848970 - protein, 9 aa, Homo Sapiens
IAYLAQHQI

SEQ ID NO: 848971 - protein, 9 aa, Homo Sapiens
ITLVFLVAF

SEQ ID NO: 848972 - protein, 9 aa, Homo Sapiens
ENSKRVRII

SEQ ID NO: 848973 - protein, 9 aa, Homo Sapiens
DFDNWSTFH

SEQ ID NO: 848974 - protein, 9 aa, Homo Sapiens
GTSLAEILL

SEQ ID NO: 848975 - protein, 9 aa, Homo Sapiens
SKKQAKLEE

SEQ ID NO: 848976 - protein, 9 aa, Homo Sapiens
IEKIIDKLT

SEQ ID NO: 848977 - protein, 9 aa, Homo Sapiens
IILEKVAAT

SEQ ID NO: 848978 - protein, 9 aa, Homo Sapiens
CEGECPDPV

SEQ ID NO: 848979 - protein, 9 aa, Homo Sapiens
QYVTTSFLS

SEQ ID NO: 848980 - protein, 9 aa, Homo Sapiens
LLMSIQMYL

SEQ ID NO: 848981 - protein, 9 aa, Homo Sapiens
TCALWDIKT

SEQ ID NO: 848982 - protein, 9 aa, Homo Sapiens
SSQQWRELG

SEQ ID NO: 848983 - protein, 9 aa, Homo Sapiens
KSFLATVIH

SEQ ID NO: 848984 - protein, 9 aa, Homo Sapiens
WGNESYVRS

SEQ ID NO: 848985 - protein, 9 aa, Homo Sapiens
QIYWLNYEA

SEQ ID NO: 848986 - protein, 9 aa, Homo Sapiens
LDTLSKLSH

SEQ ID NO: 848987 - protein, 9 aa, Homo Sapiens
EWLEPKIYL

SEQ ID NO: 848988 - protein, 9 aa, Homo Sapiens
LCVYEQKLN

SEQ ID NO: 848989 - protein, 9 aa, Homo Sapiens
EQDNKGRPF

SEQ ID NO: 848990 - protein, 9 aa, Homo Sapiens
AGGKLRFRA

SEQ ID NO: 848991 - protein, 9 aa, Homo Sapiens
MLLNIAYEK

SEQ ID NO: 848992 - protein, 9 aa, Homo Sapiens
RVRKITCTN

SEQ ID NO: 848993 - protein, 9 aa, Homo Sapiens
IPQFTVAKN

SEQ ID NO: 848994 - protein, 9 aa, Homo Sapiens
MDISVTMMA

SEQ ID NO: 848995 - protein, 9 aa, Homo Sapiens
SGITQLFFL

SEQ ID NO: 848996 - protein, 9 aa, Homo Sapiens
ASLKQKDGE

SEQ ID NO: 848997 - protein, 9 aa, Homo Sapiens
SYLQNDSVL

SEQ ID NO: 848998 - protein, 9 aa, Homo Sapiens
PCLRSSYCI

SEQ ID NO: 848999 - protein, 9 aa, Homo Sapiens
IQTAVHLLL

SEQ ID NO: 849000 - protein, 9 aa, Homo Sapiens
SFLVRESEN

SEQ ID NO: 849001 - protein, 9 aa, Homo Sapiens
ASMHNHIEK

SEQ ID NO: 849002 - protein, 9 aa, Homo Sapiens
NGSGCTLAQ

SEQ ID NO: 849003 - protein, 9 aa, Homo Sapiens
WPGKSSYSD

SEQ ID NO: 849004 - protein, 9 aa, Homo Sapiens
VPNVAYSLL

SEQ ID NO: 849005 - protein, 9 aa, Homo Sapiens
LQRIKDILP

SEQ ID NO: 849006 - protein, 9 aa, Homo Sapiens
KDVIENYCD

SEQ ID NO: 849007 - protein, 9 aa, Homo Sapiens
LYKEGERYF

SEQ ID NO: 849008 - protein, 9 aa, Homo Sapiens
EENKAPTPQ

SEQ ID NO: 849009 - protein, 9 aa, Homo Sapiens
YYMRSLHQF

SEQ ID NO: 849010 - protein, 9 aa, Homo Sapiens
WIRKISESK

SEQ ID NO: 849011 - protein, 9 aa, Homo Sapiens
TLDGQITMD

SEQ ID NO: 849012 - protein, 9 aa, Homo Sapiens
AFSICFTDT

SEQ ID NO: 849013 - protein, 9 aa, Homo Sapiens
VAQDVFNPS

SEQ ID NO: 849014 - protein, 9 aa, Homo Sapiens
LELSNPIPI

SEQ ID NO: 849015 - protein, 9 aa, Homo Sapiens
QTYMTHTIF

SEQ ID NO: 849016 - protein, 9 aa, Homo Sapiens
ELMVHGYPS

SEQ ID NO: 849017 - protein, 9 aa, Homo Sapiens
SKNIITVLR

SEQ ID NO: 849018 - protein, 9 aa, Homo Sapiens
QRYKMVIAA

SEQ ID NO: 849019 - protein, 9 aa, Homo Sapiens
AVILMTTKN

SEQ ID NO: 849020 - protein, 9 aa, Homo Sapiens
SMTSYYGNQ

SEQ ID NO: 849021 - protein, 9 aa, Homo Sapiens
ISYVVEAIP

SEQ ID NO: 849022 - protein, 9 aa, Homo Sapiens
LPLLLDLGG

SEQ ID NO: 849023 - protein, 9 aa, Homo Sapiens
NNLIYLKLD

SEQ ID NO: 849024 - protein, 9 aa, Homo Sapiens
AFAAGERTL

SEQ ID NO: 849025 - protein, 9 aa, Homo Sapiens
YYLDAELSL

SEQ ID NO: 849026 - protein, 9 aa, Homo Sapiens
RNNRTIQAS

SEQ ID NO: 849027 - protein, 9 aa, Homo Sapiens
AQEDVFQKF

SEQ ID NO: 849028 - protein, 9 aa, Homo Sapiens
PPLFSYCLA

SEQ ID NO: 849029 - protein, 9 aa, Homo Sapiens
KFSRLFELF

SEQ ID NO: 849030 - protein, 9 aa, Homo Sapiens
ITSSTINLS

SEQ ID NO: 849031 - protein, 9 aa, Homo Sapiens
LPCFPETTS

SEQ ID NO: 849032 - protein, 9 aa, Homo Sapiens
HPLHNDPHL

SEQ ID NO: 849033 - protein, 9 aa, Homo Sapiens
CSWITVSAL

SEQ ID NO: 849034 - protein, 9 aa, Homo Sapiens
KASLKQKDG

SEQ ID NO: 849035 - protein, 9 aa, Homo Sapiens
IQSARRHTN

SEQ ID NO: 849036 - protein, 9 aa, Homo Sapiens
FVGASEMLL

SEQ ID NO: 849037 - protein, 9 aa, Homo Sapiens
GQKIQIVTT

SEQ ID NO: 849038 - protein, 9 aa, Homo Sapiens
RDPQQAFQL

SEQ ID NO: 849039 - protein, 9 aa, Homo Sapiens
MSDVVEKSL

SEQ ID NO: 849040 - protein, 9 aa, Homo Sapiens
PQRKLPQNP

SEQ ID NO: 849041 - protein, 9 aa, Homo Sapiens
KNMEIPSTS

SEQ ID NO: 849042 - protein, 9 aa, Homo Sapiens
KYGPLENEQ

SEQ ID NO: 849043 - protein, 9 aa, Homo Sapiens
ISSWLSTFC

SEQ ID NO: 849044 - protein, 9 aa, Homo Sapiens
EFIRKPEIH

SEQ ID NO: 849045 - protein, 9 aa, Homo Sapiens
WDVDALFCP

SEQ ID NO: 849046 - protein, 9 aa, Homo Sapiens
HLKIPVSGV

SEQ ID NO: 849047 - protein, 9 aa, Homo Sapiens
RFTTNLPSG

SEQ ID NO: 849048 - protein, 9 aa, Homo Sapiens
GKFDEPLYM

SEQ ID NO: 849049 - protein, 9 aa, Homo Sapiens
RLKQNLALS

SEQ ID NO: 849050 - protein, 9 aa, Homo Sapiens
RVCISYPSL

SEQ ID NO: 849051 - protein, 9 aa, Homo Sapiens
SKEEKTVVT

SEQ ID NO: 849052 - protein, 9 aa, Homo Sapiens
LQSASDESS

SEQ ID NO: 849053 - protein, 9 aa, Homo Sapiens
PNAIIVIGE

SEQ ID NO: 849054 - protein, 9 aa, Homo Sapiens
ARFDPYGNN

SEQ ID NO: 849055 - protein, 9 aa, Homo Sapiens
FGRKYRVVD

SEQ ID NO: 849056 - protein, 9 aa, Homo Sapiens
NYLDEQEGV

SEQ ID NO: 849057 - protein, 9 aa, Homo Sapiens
VLEVVQSGG

SEQ ID NO: 849058 - protein, 9 aa, Homo Sapiens
VMEDPGQGL

SEQ ID NO: 849059 - protein, 9 aa, Homo Sapiens
TFNLFSTDD

SEQ ID NO: 849060 - protein, 9 aa, Homo Sapiens
EEEEQDQHM

SEQ ID NO: 849061 - protein, 9 aa, Homo Sapiens
QTILDRYYT

SEQ ID NO: 849062 - protein, 9 aa, Homo Sapiens
PHLPWVLIA

SEQ ID NO: 849063 - protein, 9 aa, Homo Sapiens
TNPRLAKAI

SEQ ID NO: 849064 - protein, 9 aa, Homo Sapiens
QILVLTELL

SEQ ID NO: 849065 - protein, 9 aa, Homo Sapiens
LEKARKGYG

SEQ ID NO: 849066 - protein, 9 aa, Homo Sapiens
SGQTKVLSQ

SEQ ID NO: 849067 - protein, 9 aa, Homo Sapiens
AFIYSNSIR

SEQ ID NO: 849068 - protein, 9 aa, Homo Sapiens
RVLLALHDQ

SEQ ID NO: 849069 - protein, 9 aa, Homo Sapiens
PSNLRLSPL

SEQ ID NO: 849070 - protein, 9 aa, Homo Sapiens
MAGFIILSL

SEQ ID NO: 849071 - protein, 9 aa, Homo Sapiens
ASKLKEFVK

SEQ ID NO: 849072 - protein, 9 aa, Homo Sapiens
KIIAATIDN

SEQ ID NO: 849073 - protein, 9 aa, Homo Sapiens
GQIIQYDKC

SEQ ID NO: 849074 - protein, 9 aa, Homo Sapiens
DETINGNYN

SEQ ID NO: 849075 - protein, 9 aa, Homo Sapiens
FVNKQHKRK

SEQ ID NO: 849076 - protein, 9 aa, Homo Sapiens
IVFLRAITP

SEQ ID NO: 849077 - protein, 9 aa, Homo Sapiens
KDMQAVRQD

SEQ ID NO: 849078 - protein, 9 aa, Homo Sapiens
LCAKTDPSE

SEQ ID NO: 849079 - protein, 9 aa, Homo Sapiens
YLTITNLLE

SEQ ID NO: 849080 - protein, 9 aa, Homo Sapiens
EKKLSKAQC

SEQ ID NO: 849081 - protein, 9 aa, Homo Sapiens
EILRLFGSL

SEQ ID NO: 849082 - protein, 9 aa, Homo Sapiens
KVYTGVKPC

SEQ ID NO: 849083 - protein, 9 aa, Homo Sapiens
QPSQCHPDA

SEQ ID NO: 849084 - protein, 9 aa, Homo Sapiens
SIKLLQTRP

SEQ ID NO: 849085 - protein, 9 aa, Homo Sapiens
TDQIYFKKR

SEQ ID NO: 849086 - protein, 9 aa, Homo Sapiens
SRNLIRKIS

SEQ ID NO: 849087 - protein, 9 aa, Homo Sapiens
LIHNRTNTT

SEQ ID NO: 849088 - protein, 9 aa, Homo Sapiens
KGIRLTAAE

SEQ ID NO: 849089 - protein, 9 aa, Homo Sapiens
AVVFSEEDL

SEQ ID NO: 849090 - protein, 9 aa, Homo Sapiens
CFYGYLVNY

SEQ ID NO: 849091 - protein, 9 aa, Homo Sapiens
LAVHYCHQK

SEQ ID NO: 849092 - protein, 9 aa, Homo Sapiens
DVKSTTIAV

SEQ ID NO: 849093 - protein, 9 aa, Homo Sapiens
LAWISQVLY

SEQ ID NO: 849094 - protein, 9 aa, Homo Sapiens
SLKYCNVDS

SEQ ID NO: 849095 - protein, 9 aa, Homo Sapiens
NVNDRCQKM

SEQ ID NO: 849096 - protein, 9 aa, Homo Sapiens
YLGPPNHHS

SEQ ID NO: 849097 - protein, 9 aa, Homo Sapiens
LSRILFYQR

SEQ ID NO: 849098 - protein, 9 aa, Homo Sapiens
CKQNFDAYV

SEQ ID NO: 849099 - protein, 9 aa, Homo Sapiens
FYNSNPAQD

SEQ ID NO: 849100 - protein, 9 aa, Homo Sapiens
GTYNNFFYL

SEQ ID NO: 849101 - protein, 9 aa, Homo Sapiens
HVEKIELPS

SEQ ID NO: 849102 - protein, 9 aa, Homo Sapiens
GSRINYYCT

SEQ ID NO: 849103 - protein, 9 aa, Homo Sapiens
IIKGKYALP

SEQ ID NO: 849104 - protein, 9 aa, Homo Sapiens
TYFCRDLVR

SEQ ID NO: 849105 - protein, 9 aa, Homo Sapiens
SFSSHYTFS

SEQ ID NO: 849106 - protein, 9 aa, Homo Sapiens
LKHNTPRKK

SEQ ID NO: 849107 - protein, 9 aa, Homo Sapiens
SQNLEPKPL

SEQ ID NO: 849108 - protein, 9 aa, Homo Sapiens
FDQQIGDSS

SEQ ID NO: 849109 - protein, 9 aa, Homo Sapiens
ATIKSERIK

SEQ ID NO: 849110 - protein, 9 aa, Homo Sapiens
PKAEVTARD

SEQ ID NO: 849111 - protein, 9 aa, Homo Sapiens
HQLHREIEI

SEQ ID NO: 849112 - protein, 9 aa, Homo Sapiens
GSPVSPPPS

SEQ ID NO: 849113 - protein, 9 aa, Homo Sapiens
IFGRLERTL

SEQ ID NO: 849114 - protein, 9 aa, Homo Sapiens
QLWLKKKHE

SEQ ID NO: 849115 - protein, 9 aa, Homo Sapiens
PYIRHKYVN

SEQ ID NO: 849116 - protein, 9 aa, Homo Sapiens
QRACPNNCR

SEQ ID NO: 849117 - protein, 9 aa, Homo Sapiens
PPLRCQELL

SEQ ID NO: 849118 - protein, 9 aa, Homo Sapiens
GLAPETTKT

SEQ ID NO: 849119 - protein, 9 aa, Homo Sapiens
GAPSRAEHL

SEQ ID NO: 849120 - protein, 9 aa, Homo Sapiens
SDIGRQIYH

SEQ ID NO: 849121 - protein, 9 aa, Homo Sapiens
VENLRLDLC

SEQ ID NO: 849122 - protein, 9 aa, Homo Sapiens
GNTCKTQTT

SEQ ID NO: 849123 - protein, 9 aa, Homo Sapiens
WQFMGQSDI

SEQ ID NO: 849124 - protein, 9 aa, Homo Sapiens
CEVDSSEDD

SEQ ID NO: 849125 - protein, 9 aa, Homo Sapiens
LWKLQKQET

SEQ ID NO: 849126 - protein, 9 aa, Homo Sapiens
DTNFQHMIE

SEQ ID NO: 849127 - protein, 9 aa, Homo Sapiens
KLDLRTVAP

SEQ ID NO: 849128 - protein, 9 aa, Homo Sapiens
KAISSTDAV

SEQ ID NO: 849129 - protein, 9 aa, Homo Sapiens
KEEVTKERY

SEQ ID NO: 849130 - protein, 9 aa, Homo Sapiens
LIALKSVLG

SEQ ID NO: 849131 - protein, 9 aa, Homo Sapiens
KVLIQPLNR

SEQ ID NO: 849132 - protein, 9 aa, Homo Sapiens
KWLHSHVQG

SEQ ID NO: 849133 - protein, 9 aa, Homo Sapiens
TVLDEANND

SEQ ID NO: 849134 - protein, 9 aa, Homo Sapiens
GKCFTQCSS

SEQ ID NO: 849135 - protein, 9 aa, Homo Sapiens
LVATTVEIT

SEQ ID NO: 849136 - protein, 9 aa, Homo Sapiens
TTPVRPVTF

SEQ ID NO: 849137 - protein, 9 aa, Homo Sapiens
SRFSLENNL

SEQ ID NO: 849138 - protein, 9 aa, Homo Sapiens
QIIKLEILE

SEQ ID NO: 849139 - protein, 9 aa, Homo Sapiens
LRKYLDREG

SEQ ID NO: 849140 - protein, 9 aa, Homo Sapiens
GPSGSRPDG

SEQ ID NO: 849141 - protein, 9 aa, Homo Sapiens
SIKKMSLRS

SEQ ID NO: 849142 - protein, 9 aa, Homo Sapiens
GKVVMEYLG

SEQ ID NO: 849143 - protein, 9 aa, Homo Sapiens
LHQFMLQQQ

SEQ ID NO: 849144 - protein, 9 aa, Homo Sapiens
TETGKLQAY

SEQ ID NO: 849145 - protein, 9 aa, Homo Sapiens
CEIHNGIEA

SEQ ID NO: 849146 - protein, 9 aa, Homo Sapiens
AKRALKAQQ

SEQ ID NO: 849147 - protein, 9 aa, Homo Sapiens
KYWAKRKFG

SEQ ID NO: 849148 - protein, 9 aa, Homo Sapiens
GPLISDADL

SEQ ID NO: 849149 - protein, 9 aa, Homo Sapiens
IVYILAVVG

SEQ ID NO: 849150 - protein, 9 aa, Homo Sapiens
RKMCNYNKI

SEQ ID NO: 849151 - protein, 9 aa, Homo Sapiens
GPNVIDHLS

SEQ ID NO: 849152 - protein, 9 aa, Homo Sapiens
FSEHCQDSM

SEQ ID NO: 849153 - protein, 9 aa, Homo Sapiens
IEHLESFTD

SEQ ID NO: 849154 - protein, 9 aa, Homo Sapiens
KHVNVMMPP

SEQ ID NO: 849155 - protein, 9 aa, Homo Sapiens
IDTETEQVK

SEQ ID NO: 849156 - protein, 9 aa, Homo Sapiens
VKFEDLIKY

SEQ ID NO: 849157 - protein, 9 aa, Homo Sapiens
KLSSKSDVW

SEQ ID NO: 849158 - protein, 9 aa, Homo Sapiens
YGIRQLIKK

SEQ ID NO: 849159 - protein, 9 aa, Homo Sapiens
ITVPPFYGE

SEQ ID NO: 849160 - protein, 9 aa, Homo Sapiens
EHTLQVLGI

SEQ ID NO: 849161 - protein, 9 aa, Homo Sapiens
FCYYYFICP

SEQ ID NO: 849162 - protein, 9 aa, Homo Sapiens
LSVPHRHGE

SEQ ID NO: 849163 - protein, 9 aa, Homo Sapiens
DMLTLVFLV

SEQ ID NO: 849164 - protein, 9 aa, Homo Sapiens
TTLTKHNII

SEQ ID NO: 849165 - protein, 9 aa, Homo Sapiens
VDVKINNAT

SEQ ID NO: 849166 - protein, 9 aa, Homo Sapiens
QINISLQLM

SEQ ID NO: 849167 - protein, 9 aa, Homo Sapiens
NFNNFEITI

SEQ ID NO: 849168 - protein, 9 aa, Homo Sapiens
INYYCTTGH

SEQ ID NO: 849169 - protein, 9 aa, Homo Sapiens
TTVLGSNSM

SEQ ID NO: 849170 - protein, 9 aa, Homo Sapiens
IQDNEVLFT

SEQ ID NO: 849171 - protein, 9 aa, Homo Sapiens
NIFSSTGDA

SEQ ID NO: 849172 - protein, 9 aa, Homo Sapiens
KHHRLHTQE

SEQ ID NO: 849173 - protein, 9 aa, Homo Sapiens
KYIIEIVSY

SEQ ID NO: 849174 - protein, 9 aa, Homo Sapiens
HIHELEKIK

SEQ ID NO: 849175 - protein, 9 aa, Homo Sapiens
NKRTEVVLT

SEQ ID NO: 849176 - protein, 9 aa, Homo Sapiens
DKSMDPFKP

SEQ ID NO: 849177 - protein, 9 aa, Homo Sapiens
VLGAMVHRD

SEQ ID NO: 849178 - protein, 9 aa, Homo Sapiens
WCTYVVLRG

SEQ ID NO: 849179 - protein, 9 aa, Homo Sapiens
MLHVVQTLY

SEQ ID NO: 849180 - protein, 9 aa, Homo Sapiens
DKFFYSFLA

SEQ ID NO: 849181 - protein, 9 aa, Homo Sapiens
QQEMRAFPV

SEQ ID NO: 849182 - protein, 9 aa, Homo Sapiens
ITDFKRFVT

SEQ ID NO: 849183 - protein, 9 aa, Homo Sapiens
TCHFSTLKD

SEQ ID NO: 849184 - protein, 9 aa, Homo Sapiens
SSCSITAFA

SEQ ID NO: 849185 - protein, 9 aa, Homo Sapiens
LPCRHLLHK

SEQ ID NO: 849186 - protein, 9 aa, Homo Sapiens
NTKSSIIEA

SEQ ID NO: 849187 - protein, 9 aa, Homo Sapiens
VASKGQECL

SEQ ID NO: 849188 - protein, 9 aa, Homo Sapiens
GLHEKCKQR

SEQ ID NO: 849189 - protein, 9 aa, Homo Sapiens
YWLNRDRHG

SEQ ID NO: 849190 - protein, 9 aa, Homo Sapiens
GLLVFNKIV

SEQ ID NO: 849191 - protein, 9 aa, Homo Sapiens
ESVASKGQE

SEQ ID NO: 849192 - protein, 9 aa, Homo Sapiens
QRTFPEMQR

SEQ ID NO: 849193 - protein, 9 aa, Homo Sapiens
TYDLPATIN

SEQ ID NO: 849194 - protein, 9 aa, Homo Sapiens
PYGNNKFST

SEQ ID NO: 849195 - protein, 9 aa, Homo Sapiens
INGEGSTFS

SEQ ID NO: 849196 - protein, 9 aa, Homo Sapiens
PRSLLIQAA

SEQ ID NO: 849197 - protein, 9 aa, Homo Sapiens
VGLQVLGHT

SEQ ID NO: 849198 - protein, 9 aa, Homo Sapiens
LKSQKELVN

SEQ ID NO: 849199 - protein, 9 aa, Homo Sapiens
NPYRYPDIK

SEQ ID NO: 849200 - protein, 9 aa, Homo Sapiens
WNSYQLCNN

SEQ ID NO: 849201 - protein, 9 aa, Homo Sapiens
TINKMKTLN

SEQ ID NO: 849202 - protein, 9 aa, Homo Sapiens
HQRCHTGKI

SEQ ID NO: 849203 - protein, 9 aa, Homo Sapiens
ETRDLSELF

SEQ ID NO: 849204 - protein, 9 aa, Homo Sapiens
RRQSRTDNG

SEQ ID NO: 849205 - protein, 9 aa, Homo Sapiens
SGSGSESGP

SEQ ID NO: 849206 - protein, 9 aa, Homo Sapiens
EYLDRNKDQ

SEQ ID NO: 849207 - protein, 9 aa, Homo Sapiens
SCRASNYSM

SEQ ID NO: 849208 - protein, 9 aa, Homo Sapiens
TVKWADIKE

SEQ ID NO: 849209 - protein, 9 aa, Homo Sapiens
LVPSAFDKQ

SEQ ID NO: 849210 - protein, 9 aa, Homo Sapiens
ESEEEEEAH

SEQ ID NO: 849211 - protein, 9 aa, Homo Sapiens
SMTDYPPTT

SEQ ID NO: 849212 - protein, 9 aa, Homo Sapiens
AFNGERLRL

SEQ ID NO: 849213 - protein, 9 aa, Homo Sapiens
PMLNLIMYS

SEQ ID NO: 849214 - protein, 9 aa, Homo Sapiens
SLSDLNSTR

SEQ ID NO: 849215 - protein, 9 aa, Homo Sapiens
RKRSSSRTP

SEQ ID NO: 849216 - protein, 9 aa, Homo Sapiens
YECLTVHCM

SEQ ID NO: 849217 - protein, 9 aa, Homo Sapiens
NLRVEDYEP

SEQ ID NO: 849218 - protein, 9 aa, Homo Sapiens
NSNAYMLLQ

SEQ ID NO: 849219 - protein, 9 aa, Homo Sapiens
NILYWVIYK

SEQ ID NO: 849220 - protein, 9 aa, Homo Sapiens
ILSLPKYQA

SEQ ID NO: 849221 - protein, 9 aa, Homo Sapiens
SLLSAQLAP

SEQ ID NO: 849222 - protein, 9 aa, Homo Sapiens
PVFLGTEAS

SEQ ID NO: 849223 - protein, 9 aa, Homo Sapiens
GLHVHMEVP

SEQ ID NO: 849224 - protein, 9 aa, Homo Sapiens
VNCAENSRL

SEQ ID NO: 849225 - protein, 9 aa, Homo Sapiens
TSENAGGQS

SEQ ID NO: 849226 - protein, 9 aa, Homo Sapiens
YFARARIPV

SEQ ID NO: 849227 - protein, 9 aa, Homo Sapiens
HKRYRPIYI

SEQ ID NO: 849228 - protein, 9 aa, Homo Sapiens
LSPGVKNKT

SEQ ID NO: 849229 - protein, 9 aa, Homo Sapiens
VYSLFLLSV

SEQ ID NO: 849230 - protein, 9 aa, Homo Sapiens
QTLQSNGII

SEQ ID NO: 849231 - protein, 9 aa, Homo Sapiens
HSGMDYTIM

SEQ ID NO: 849232 - protein, 9 aa, Homo Sapiens
YCYGGYSGA

SEQ ID NO: 849233 - protein, 9 aa, Homo Sapiens
AILQQEIGW

SEQ ID NO: 849234 - protein, 9 aa, Homo Sapiens
YQALQTSID

SEQ ID NO: 849235 - protein, 9 aa, Homo Sapiens
QMWGDLFTQ

SEQ ID NO: 849236 - protein, 9 aa, Homo Sapiens
DEISLSSNS

SEQ ID NO: 849237 - protein, 9 aa, Homo Sapiens
DKSFHLYCR

SEQ ID NO: 849238 - protein, 9 aa, Homo Sapiens
SYAKWSYFP

SEQ ID NO: 849239 - protein, 9 aa, Homo Sapiens
NPEMQVALF

SEQ ID NO: 849240 - protein, 9 aa, Homo Sapiens
SSWPQSRSV

SEQ ID NO: 849241 - protein, 9 aa, Homo Sapiens
GCVSKIICR

SEQ ID NO: 849242 - protein, 9 aa, Homo Sapiens
VLAPKASEE

SEQ ID NO: 849243 - protein, 9 aa, Homo Sapiens
KENKTKENP

SEQ ID NO: 849244 - protein, 9 aa, Homo Sapiens
NNYLLGTYS

SEQ ID NO: 849245 - protein, 9 aa, Homo Sapiens
TIMGNILIV

SEQ ID NO: 849246 - protein, 9 aa, Homo Sapiens
AHQIIRDLE

SEQ ID NO: 849247 - protein, 9 aa, Homo Sapiens
TVPAYFNES

SEQ ID NO: 849248 - protein, 9 aa, Homo Sapiens
QILGRRWHV

SEQ ID NO: 849249 - protein, 9 aa, Homo Sapiens
LDHGTESKL

SEQ ID NO: 849250 - protein, 9 aa, Homo Sapiens
LLIQPCILI

SEQ ID NO: 849251 - protein, 9 aa, Homo Sapiens
GKLWTISMK

SEQ ID NO: 849252 - protein, 9 aa, Homo Sapiens
KTSVKGVSK

SEQ ID NO: 849253 - protein, 9 aa, Homo Sapiens
IFRHLSMRD

SEQ ID NO: 849254 - protein, 9 aa, Homo Sapiens
RSYSWFQDE

SEQ ID NO: 849255 - protein, 9 aa, Homo Sapiens
KNSSHVDQR

SEQ ID NO: 849256 - protein, 9 aa, Homo Sapiens
EVKSLIQVI

SEQ ID NO: 849257 - protein, 9 aa, Homo Sapiens
SQKPGDRVV

SEQ ID NO: 849258 - protein, 9 aa, Homo Sapiens
LQYDMLHET

SEQ ID NO: 849259 - protein, 9 aa, Homo Sapiens
EVVEKLSDL

SEQ ID NO: 849260 - protein, 9 aa, Homo Sapiens
QSGNYWLEM

SEQ ID NO: 849261 - protein, 9 aa, Homo Sapiens
ARCLENVLS

SEQ ID NO: 849262 - protein, 9 aa, Homo Sapiens
GLHSGGEGL

SEQ ID NO: 849263 - protein, 9 aa, Homo Sapiens
SGKLLNKEW

SEQ ID NO: 849264 - protein, 9 aa, Homo Sapiens
RTLETLLTY

SEQ ID NO: 849265 - protein, 9 aa, Homo Sapiens
IISNGPVLT

SEQ ID NO: 849266 - protein, 9 aa, Homo Sapiens
LGQAPPKPG

SEQ ID NO: 849267 - protein, 9 aa, Homo Sapiens
DHTQCRKIL

SEQ ID NO: 849268 - protein, 9 aa, Homo Sapiens
DTLLVEEIK

SEQ ID NO: 849269 - protein, 9 aa, Homo Sapiens
WKAELEARL

SEQ ID NO: 849270 - protein, 9 aa, Homo Sapiens
QPKLKRVMK

SEQ ID NO: 849271 - protein, 9 aa, Homo Sapiens
QPSYPGRAV

SEQ ID NO: 849272 - protein, 9 aa, Homo Sapiens
TEFDFSEYV

SEQ ID NO: 849273 - protein, 9 aa, Homo Sapiens
VPDQADLVN

SEQ ID NO: 849274 - protein, 9 aa, Homo Sapiens
FTKKASYSH

SEQ ID NO: 849275 - protein, 9 aa, Homo Sapiens
CDSQGPGKY

SEQ ID NO: 849276 - protein, 9 aa, Homo Sapiens
QLDCFKRWR

SEQ ID NO: 849277 - protein, 9 aa, Homo Sapiens
TTDRDSGTN

SEQ ID NO: 849278 - protein, 9 aa, Homo Sapiens
RHFVGLQVL

SEQ ID NO: 849279 - protein, 9 aa, Homo Sapiens
PGSAGPPGP

SEQ ID NO: 849280 - protein, 9 aa, Homo Sapiens
GSAGAAPRR

SEQ ID NO: 849281 - protein, 9 aa, Homo Sapiens
NQPKEVWCE

SEQ ID NO: 849282 - protein, 9 aa, Homo Sapiens
HEFKRFILF

SEQ ID NO: 849283 - protein, 9 aa, Homo Sapiens
AEFLTVKED

SEQ ID NO: 849284 - protein, 9 aa, Homo Sapiens
MILLFSKCT

SEQ ID NO: 849285 - protein, 9 aa, Homo Sapiens
EKVAPYNIQ

SEQ ID NO: 849286 - protein, 9 aa, Homo Sapiens
RIKNQLGLS

SEQ ID NO: 849287 - protein, 9 aa, Homo Sapiens
RACGPGPHR

SEQ ID NO: 849288 - protein, 9 aa, Homo Sapiens
VGGIGLAML

SEQ ID NO: 849289 - protein, 9 aa, Homo Sapiens
DFEPFVEND

SEQ ID NO: 849290 - protein, 9 aa, Homo Sapiens
TNHHMQCLE

SEQ ID NO: 849291 - protein, 9 aa, Homo Sapiens
SSLPCHRIL

SEQ ID NO: 849292 - protein, 9 aa, Homo Sapiens
HEAEVHAKS

SEQ ID NO: 849293 - protein, 9 aa, Homo Sapiens
QLAYLLRHP

SEQ ID NO: 849294 - protein, 9 aa, Homo Sapiens
LGVQALGII

SEQ ID NO: 849295 - protein, 9 aa, Homo Sapiens
DLKTELGNE

SEQ ID NO: 849296 - protein, 9 aa, Homo Sapiens
LLINVDRYA

SEQ ID NO: 849297 - protein, 9 aa, Homo Sapiens
ESENSPGQL

SEQ ID NO: 849298 - protein, 9 aa, Homo Sapiens
PVIYAFLGL

SEQ ID NO: 849299 - protein, 9 aa, Homo Sapiens
YATKTLQKK

SEQ ID NO: 849300 - protein, 9 aa, Homo Sapiens
KVNKRSLSK

SEQ ID NO: 849301 - protein, 9 aa, Homo Sapiens
LDCFKRWRS

SEQ ID NO: 849302 - protein, 9 aa, Homo Sapiens
NPKCRNVFE

SEQ ID NO: 849303 - protein, 9 aa, Homo Sapiens
IKYIKRKAP

SEQ ID NO: 849304 - protein, 9 aa, Homo Sapiens
LRQLLKKTQ

SEQ ID NO: 849305 - protein, 9 aa, Homo Sapiens
VAVQVPQHK

SEQ ID NO: 849306 - protein, 9 aa, Homo Sapiens
FFKGSRFQY

SEQ ID NO: 849307 - protein, 9 aa, Homo Sapiens
DVGGQGSER

SEQ ID NO: 849308 - protein, 9 aa, Homo Sapiens
GQQGGWRCS

SEQ ID NO: 849309 - protein, 9 aa, Homo Sapiens
QNDRRNAPP

SEQ ID NO: 849310 - protein, 9 aa, Homo Sapiens
QKIKAIKLA

SEQ ID NO: 849311 - protein, 9 aa, Homo Sapiens
KYMVDPKKE

SEQ ID NO: 849312 - protein, 9 aa, Homo Sapiens
LLHNLLFGS

SEQ ID NO: 849313 - protein, 9 aa, Homo Sapiens
VVKYFEHLN

SEQ ID NO: 849314 - protein, 9 aa, Homo Sapiens
TNVSDAFGS

SEQ ID NO: 849315 - protein, 9 aa, Homo Sapiens
CGEGGKNFS

SEQ ID NO: 849316 - protein, 9 aa, Homo Sapiens
LAQIGLSVG

SEQ ID NO: 849317 - protein, 9 aa, Homo Sapiens
SSLPRVICT

SEQ ID NO: 849318 - protein, 9 aa, Homo Sapiens
LRNNMFEIL

SEQ ID NO: 849319 - protein, 9 aa, Homo Sapiens
SIELRELEN

SEQ ID NO: 849320 - protein, 9 aa, Homo Sapiens
LSCDASPLL

SEQ ID NO: 849321 - protein, 9 aa, Homo Sapiens
DDPTRRAGA

SEQ ID NO: 849322 - protein, 9 aa, Homo Sapiens
HSLLRDPDR

SEQ ID NO: 849323 - protein, 9 aa, Homo Sapiens
SVQEREVPI

SEQ ID NO: 849324 - protein, 9 aa, Homo Sapiens
KSKSTPDVK

SEQ ID NO: 849325 - protein, 9 aa, Homo Sapiens
YQPICSTNF

SEQ ID NO: 849326 - protein, 9 aa, Homo Sapiens
GRFVIGGSQ

SEQ ID NO: 849327 - protein, 9 aa, Homo Sapiens
VRKERLGMC

SEQ ID NO: 849328 - protein, 9 aa, Homo Sapiens
VMSKSSPRL

SEQ ID NO: 849329 - protein, 9 aa, Homo Sapiens
IKETDLEYV

SEQ ID NO: 849330 - protein, 9 aa, Homo Sapiens
ECERKASDP

SEQ ID NO: 849331 - protein, 9 aa, Homo Sapiens
GTKQLLANF

SEQ ID NO: 849332 - protein, 9 aa, Homo Sapiens
KLCGSGNGA

SEQ ID NO: 849333 - protein, 9 aa, Homo Sapiens
QAGVQVGMW

SEQ ID NO: 849334 - protein, 9 aa, Homo Sapiens
QETYRDYVH

SEQ ID NO: 849335 - protein, 9 aa, Homo Sapiens
FLMGAANQE

SEQ ID NO: 849336 - protein, 9 aa, Homo Sapiens
QLFKNTGSK

SEQ ID NO: 849337 - protein, 9 aa, Homo Sapiens
SNSGCVVLV

SEQ ID NO: 849338 - protein, 9 aa, Homo Sapiens
HVWYRTCMM

SEQ ID NO: 849339 - protein, 9 aa, Homo Sapiens
LFTAFLPFE

SEQ ID NO: 849340 - protein, 9 aa, Homo Sapiens
HPDICKDKR

SEQ ID NO: 849341 - protein, 9 aa, Homo Sapiens
YTKEGEQVE

SEQ ID NO: 849342 - protein, 9 aa, Homo Sapiens
RLIRFQSVE

SEQ ID NO: 849343 - protein, 9 aa, Homo Sapiens
LVAATLLNI

SEQ ID NO: 849344 - protein, 9 aa, Homo Sapiens
NTWEQMLQI

SEQ ID NO: 849345 - protein, 9 aa, Homo Sapiens
ACLGPQIQI

SEQ ID NO: 849346 - protein, 9 aa, Homo Sapiens
TTQADIVRG

SEQ ID NO: 849347 - protein, 9 aa, Homo Sapiens
YLVVIMFQK

SEQ ID NO: 849348 - protein, 9 aa, Homo Sapiens
LHHVTVAGF

SEQ ID NO: 849349 - protein, 9 aa, Homo Sapiens
LVKAVNYTV

SEQ ID NO: 849350 - protein, 9 aa, Homo Sapiens
PLTAYNHFF

SEQ ID NO: 849351 - protein, 9 aa, Homo Sapiens
FVKEKEKVH

SEQ ID NO: 849352 - protein, 9 aa, Homo Sapiens
VVSVLEKTY

SEQ ID NO: 849353 - protein, 9 aa, Homo Sapiens
RAACLQYLK

SEQ ID NO: 849354 - protein, 9 aa, Homo Sapiens
LLTENVEVK

SEQ ID NO: 849355 - protein, 9 aa, Homo Sapiens
DLLKEIINV

SEQ ID NO: 849356 - protein, 9 aa, Homo Sapiens
TFHVLYLAT

SEQ ID NO: 849357 - protein, 9 aa, Homo Sapiens
VEVLNNNKC

SEQ ID NO: 849358 - protein, 9 aa, Homo Sapiens
LGPAERATK

SEQ ID NO: 849359 - protein, 9 aa, Homo Sapiens
VLINSKPEN

SEQ ID NO: 849360 - protein, 9 aa, Homo Sapiens
GKLCGAEVP

SEQ ID NO: 849361 - protein, 9 aa, Homo Sapiens
IQLNQGKFE

SEQ ID NO: 849362 - protein, 9 aa, Homo Sapiens
TIAWPLCGD

SEQ ID NO: 849363 - protein, 9 aa, Homo Sapiens
CFGEISIGT

SEQ ID NO: 849364 - protein, 9 aa, Homo Sapiens
HSIATLLLQ

SEQ ID NO: 849365 - protein, 9 aa, Homo Sapiens
RQIRRHKNY

SEQ ID NO: 849366 - protein, 9 aa, Homo Sapiens
GPEDQGIPP

SEQ ID NO: 849367 - protein, 9 aa, Homo Sapiens
FPCEPFKCL

SEQ ID NO: 849368 - protein, 9 aa, Homo Sapiens
MKYSCNPGY

SEQ ID NO: 849369 - protein, 9 aa, Homo Sapiens
WRCRHPSLS

SEQ ID NO: 849370 - protein, 9 aa, Homo Sapiens
RGYLLGIHL

SEQ ID NO: 849371 - protein, 9 aa, Homo Sapiens
ASLALDCKD

SEQ ID NO: 849372 - protein, 9 aa, Homo Sapiens
GEEVVPTPP

SEQ ID NO: 849373 - protein, 9 aa, Homo Sapiens
INTGEKPYK

SEQ ID NO: 849374 - protein, 9 aa, Homo Sapiens
FQGLTSLCK

SEQ ID NO: 849375 - protein, 9 aa, Homo Sapiens
KDTVRLNKK

SEQ ID NO: 849376 - protein, 9 aa, Homo Sapiens
VGIYANIFY

SEQ ID NO: 849377 - protein, 9 aa, Homo Sapiens
QYIKMTVCL

SEQ ID NO: 849378 - protein, 9 aa, Homo Sapiens
FLTSDEEVY

SEQ ID NO: 849379 - protein, 9 aa, Homo Sapiens
SLGEEARGT

SEQ ID NO: 849380 - protein, 9 aa, Homo Sapiens
PSKVAFVSE

SEQ ID NO: 849381 - protein, 9 aa, Homo Sapiens
NVCFAQEFF

SEQ ID NO: 849382 - protein, 9 aa, Homo Sapiens
INTGEKPYR

SEQ ID NO: 849383 - protein, 9 aa, Homo Sapiens
YTLMREVIH

SEQ ID NO: 849384 - protein, 9 aa, Homo Sapiens
RKIIKTYRE

SEQ ID NO: 849385 - protein, 9 aa, Homo Sapiens
ATVAHQRKS

SEQ ID NO: 849386 - protein, 9 aa, Homo Sapiens
LHIPMYLLI

SEQ ID NO: 849387 - protein, 9 aa, Homo Sapiens
YLSPSIIVI

SEQ ID NO: 849388 - protein, 9 aa, Homo Sapiens
QKVAHLEIE

SEQ ID NO: 849389 - protein, 9 aa, Homo Sapiens
KRNEIQKRG

SEQ ID NO: 849390 - protein, 9 aa, Homo Sapiens
VATTVEITF

SEQ ID NO: 849391 - protein, 9 aa, Homo Sapiens
NVRPPWVSG

SEQ ID NO: 849392 - protein, 9 aa, Homo Sapiens
PTRDFPTRN

SEQ ID NO: 849393 - protein, 9 aa, Homo Sapiens
QWPEGQPLC

SEQ ID NO: 849394 - protein, 9 aa, Homo Sapiens
PVVSAPLEA

SEQ ID NO: 849395 - protein, 9 aa, Homo Sapiens
NKESLINCP

SEQ ID NO: 849396 - protein, 9 aa, Homo Sapiens
RPLMAVEIT

SEQ ID NO: 849397 - protein, 9 aa, Homo Sapiens
QVLYSCLET

SEQ ID NO: 849398 - protein, 9 aa, Homo Sapiens
LSIVSNLSH

SEQ ID NO: 849399 - protein, 9 aa, Homo Sapiens
LCLSQQLRI

SEQ ID NO: 849400 - protein, 9 aa, Homo Sapiens
KHIEFSFHP

SEQ ID NO: 849401 - protein, 9 aa, Homo Sapiens
DPRKDTGSR

SEQ ID NO: 849402 - protein, 9 aa, Homo Sapiens
CVGFSNYKL

SEQ ID NO: 849403 - protein, 9 aa, Homo Sapiens
KFTCGCNKG

SEQ ID NO: 849404 - protein, 9 aa, Homo Sapiens
WYPSDLLDA

SEQ ID NO: 849405 - protein, 9 aa, Homo Sapiens
VLPALLKQG

SEQ ID NO: 849406 - protein, 9 aa, Homo Sapiens
EENNLVKKK

SEQ ID NO: 849407 - protein, 9 aa, Homo Sapiens
TLHLVLHLR

SEQ ID NO: 849408 - protein, 9 aa, Homo Sapiens
DGSNQTVFV

SEQ ID NO: 849409 - protein, 9 aa, Homo Sapiens
ASIKHKDET

SEQ ID NO: 849410 - protein, 9 aa, Homo Sapiens
SPTKKEKCE

SEQ ID NO: 849411 - protein, 9 aa, Homo Sapiens
EYYQNKMAE

SEQ ID NO: 849412 - protein, 9 aa, Homo Sapiens
IISNYELFE

SEQ ID NO: 849413 - protein, 9 aa, Homo Sapiens
QNVHVLKVK

SEQ ID NO: 849414 - protein, 9 aa, Homo Sapiens
IMIDSRIVM

SEQ ID NO: 849415 - protein, 9 aa, Homo Sapiens
FLRSYQRTF

SEQ ID NO: 849416 - protein, 9 aa, Homo Sapiens
FLRKEYGTF

SEQ ID NO: 849417 - protein, 9 aa, Homo Sapiens
STKHLKSVE

SEQ ID NO: 849418 - protein, 9 aa, Homo Sapiens
TCKTVEKPL

SEQ ID NO: 849419 - protein, 9 aa, Homo Sapiens
CHYLDPLWH

SEQ ID NO: 849420 - protein, 9 aa, Homo Sapiens
KLKYAELAG

SEQ ID NO: 849421 - protein, 9 aa, Homo Sapiens
ITGIYGLFV

SEQ ID NO: 849422 - protein, 9 aa, Homo Sapiens
LALFSNHQS

SEQ ID NO: 849423 - protein, 9 aa, Homo Sapiens
FLLFLSFFF

SEQ ID NO: 849424 - protein, 9 aa, Homo Sapiens
ANLNTLALF

SEQ ID NO: 849425 - protein, 9 aa, Homo Sapiens
IYANIFYYI

SEQ ID NO: 849426 - protein, 9 aa, Homo Sapiens
LLIVSAGMR

SEQ ID NO: 849427 - protein, 9 aa, Homo Sapiens
TTEHTRKLY

SEQ ID NO: 849428 - protein, 9 aa, Homo Sapiens
ASDQNYNYK

SEQ ID NO: 849429 - protein, 9 aa, Homo Sapiens
AGSVPHVNQ

SEQ ID NO: 849430 - protein, 9 aa, Homo Sapiens
DDEFMETKS

SEQ ID NO: 849431 - protein, 9 aa, Homo Sapiens
TTSWLQDCV

SEQ ID NO: 849432 - protein, 9 aa, Homo Sapiens
KREHSKVPY

SEQ ID NO: 849433 - protein, 9 aa, Homo Sapiens
VGASKIIML

SEQ ID NO: 849434 - protein, 9 aa, Homo Sapiens
GEHYNLVTR

SEQ ID NO: 849435 - protein, 9 aa, Homo Sapiens
PIFGSINPL

SEQ ID NO: 849436 - protein, 9 aa, Homo Sapiens
GQTDCIRAL

SEQ ID NO: 849437 - protein, 9 aa, Homo Sapiens
KAESTAVQF

SEQ ID NO: 849438 - protein, 9 aa, Homo Sapiens
KLPQLHGHF

SEQ ID NO: 849439 - protein, 9 aa, Homo Sapiens
EFVSALCQR

SEQ ID NO: 849440 - protein, 9 aa, Homo Sapiens
HKKYSKSST

SEQ ID NO: 849441 - protein, 9 aa, Homo Sapiens
LLHHARCCN

SEQ ID NO: 849442 - protein, 9 aa, Homo Sapiens
YVYICLFTC

SEQ ID NO: 849443 - protein, 9 aa, Homo Sapiens
VYRDAFNSA

SEQ ID NO: 849444 - protein, 9 aa, Homo Sapiens
QLFMEQYKY

SEQ ID NO: 849445 - protein, 9 aa, Homo Sapiens
EEFKGNSKV

SEQ ID NO: 849446 - protein, 9 aa, Homo Sapiens
VVDLVSIPG

SEQ ID NO: 849447 - protein, 9 aa, Homo Sapiens
NVGLVNLCI

SEQ ID NO: 849448 - protein, 9 aa, Homo Sapiens
RLDLCCLAG

SEQ ID NO: 849449 - protein, 9 aa, Homo Sapiens
MLTYLNLSQ

SEQ ID NO: 849450 - protein, 9 aa, Homo Sapiens
FSSWTPLKF

SEQ ID NO: 849451 - protein, 9 aa, Homo Sapiens
TCIGDLHRS

SEQ ID NO: 849452 - protein, 9 aa, Homo Sapiens
RIWEPQTSH

SEQ ID NO: 849453 - protein, 9 aa, Homo Sapiens
TQNLFTGVD

SEQ ID NO: 849454 - protein, 9 aa, Homo Sapiens
QYQSFKLFT

SEQ ID NO: 849455 - protein, 9 aa, Homo Sapiens
QCRRNNYGQ

SEQ ID NO: 849456 - protein, 9 aa, Homo Sapiens
QKYISPPER

SEQ ID NO: 849457 - protein, 9 aa, Homo Sapiens
FQDMHITQM

SEQ ID NO: 849458 - protein, 9 aa, Homo Sapiens
LPFFNISAK

SEQ ID NO: 849459 - protein, 9 aa, Homo Sapiens
DKQDLLKEH

SEQ ID NO: 849460 - protein, 9 aa, Homo Sapiens
CNPCPKMCQ

SEQ ID NO: 849461 - protein, 9 aa, Homo Sapiens
ADTIGQISP

SEQ ID NO: 849462 - protein, 9 aa, Homo Sapiens
LISDADLDA

SEQ ID NO: 849463 - protein, 9 aa, Homo Sapiens
TVGTAEEFT

SEQ ID NO: 849464 - protein, 9 aa, Homo Sapiens
KSWQITIRW

SEQ ID NO: 849465 - protein, 9 aa, Homo Sapiens
GSEKKKKSD

SEQ ID NO: 849466 - protein, 9 aa, Homo Sapiens
LNYLDEQEG

SEQ ID NO: 849467 - protein, 9 aa, Homo Sapiens
PFQYPQLNV

SEQ ID NO: 849468 - protein, 9 aa, Homo Sapiens
TVYLASSIA

SEQ ID NO: 849469 - protein, 9 aa, Homo Sapiens
SSPVTPCSS

SEQ ID NO: 849470 - protein, 9 aa, Homo Sapiens
LKEIYSKEE

SEQ ID NO: 849471 - protein, 9 aa, Homo Sapiens
AQSLRERGR

SEQ ID NO: 849472 - protein, 9 aa, Homo Sapiens
MLIERSSNF

SEQ ID NO: 849473 - protein, 9 aa, Homo Sapiens
TATLFIVLL

SEQ ID NO: 849474 - protein, 9 aa, Homo Sapiens
CCEAPAKNI

SEQ ID NO: 849475 - protein, 9 aa, Homo Sapiens
RDPTRQDTA

SEQ ID NO: 849476 - protein, 9 aa, Homo Sapiens
KQICDTLLV

SEQ ID NO: 849477 - protein, 9 aa, Homo Sapiens
FVASVRSGG

SEQ ID NO: 849478 - protein, 9 aa, Homo Sapiens
INNSKDIQK

SEQ ID NO: 849479 - protein, 9 aa, Homo Sapiens
FKVQQARKM

SEQ ID NO: 849480 - protein, 9 aa, Homo Sapiens
MPFWIVHCE

SEQ ID NO: 849481 - protein, 9 aa, Homo Sapiens
DLEQDKISL

SEQ ID NO: 849482 - protein, 9 aa, Homo Sapiens
ILGRAPYPF

SEQ ID NO: 849483 - protein, 9 aa, Homo Sapiens
DLHSVVRLP

SEQ ID NO: 849484 - protein, 9 aa, Homo Sapiens
ETVYGLNKF

SEQ ID NO: 849485 - protein, 9 aa, Homo Sapiens
LKSLEVSEQ

SEQ ID NO: 849486 - protein, 9 aa, Homo Sapiens
TFSAVRSTN

SEQ ID NO: 849487 - protein, 9 aa, Homo Sapiens
QFDVLFRSV

SEQ ID NO: 849488 - protein, 9 aa, Homo Sapiens
VDHKGNVAA

SEQ ID NO: 849489 - protein, 9 aa, Homo Sapiens
LKFSRLFEL

SEQ ID NO: 849490 - protein, 9 aa, Homo Sapiens
IILPTTVPP

SEQ ID NO: 849491 - protein, 9 aa, Homo Sapiens
NLKTLLEIM

SEQ ID NO: 849492 - protein, 9 aa, Homo Sapiens
SLPKKVYLS

SEQ ID NO: 849493 - protein, 9 aa, Homo Sapiens
HQLLDTCFT

SEQ ID NO: 849494 - protein, 9 aa, Homo Sapiens
NFLSRKRRQ

SEQ ID NO: 849495 - protein, 9 aa, Homo Sapiens
YVIDQIQIP

SEQ ID NO: 849496 - protein, 9 aa, Homo Sapiens
LSECMVQLF

SEQ ID NO: 849497 - protein, 9 aa, Homo Sapiens
LQAQSPADS

SEQ ID NO: 849498 - protein, 9 aa, Homo Sapiens
QSPSFPLEP

SEQ ID NO: 849499 - protein, 9 aa, Homo Sapiens
PGRYFKHYR

SEQ ID NO: 849500 - protein, 9 aa, Homo Sapiens
EQLWLPYNT

SEQ ID NO: 849501 - protein, 9 aa, Homo Sapiens
FVINSSESV

SEQ ID NO: 849502 - protein, 9 aa, Homo Sapiens
VNKTSCTVI

SEQ ID NO: 849503 - protein, 9 aa, Homo Sapiens
DYLENVESI

SEQ ID NO: 849504 - protein, 9 aa, Homo Sapiens
EKSKSTPDV

SEQ ID NO: 849505 - protein, 9 aa, Homo Sapiens
VPSNFIGRL

SEQ ID NO: 849506 - protein, 9 aa, Homo Sapiens
AASVNKQKH

SEQ ID NO: 849507 - protein, 9 aa, Homo Sapiens
PQDREQLDT

SEQ ID NO: 849508 - protein, 9 aa, Homo Sapiens
LPSPLTVLT

SEQ ID NO: 849509 - protein, 9 aa, Homo Sapiens
EPVWEPLQH

SEQ ID NO: 849510 - protein, 9 aa, Homo Sapiens
VPASPIHFH

SEQ ID NO: 849511 - protein, 9 aa, Homo Sapiens
DDHALVTRA

SEQ ID NO: 849512 - protein, 9 aa, Homo Sapiens
EDKAIHHLI

SEQ ID NO: 849513 - protein, 9 aa, Homo Sapiens
LDPSHQKKL

SEQ ID NO: 849514 - protein, 9 aa, Homo Sapiens
GDSPPALIV

SEQ ID NO: 849515 - protein, 9 aa, Homo Sapiens
PKSLRLKPH

SEQ ID NO: 849516 - protein, 9 aa, Homo Sapiens
EQHLFYIHV

SEQ ID NO: 849517 - protein, 9 aa, Homo Sapiens
AEITSDLTV

SEQ ID NO: 849518 - protein, 9 aa, Homo Sapiens
WRNKGAMVI

SEQ ID NO: 849519 - protein, 9 aa, Homo Sapiens
PAIHFRLEQ

SEQ ID NO: 849520 - protein, 9 aa, Homo Sapiens
RAGGKVVSL

SEQ ID NO: 849521 - protein, 9 aa, Homo Sapiens
LPINDLSRE

SEQ ID NO: 849522 - protein, 9 aa, Homo Sapiens
YRKGTTPSY

SEQ ID NO: 849523 - protein, 9 aa, Homo Sapiens
EQFIIQAKL

SEQ ID NO: 849524 - protein, 9 aa, Homo Sapiens
VPPLDSRPR

SEQ ID NO: 849525 - protein, 9 aa, Homo Sapiens
DLQYAAPGS

SEQ ID NO: 849526 - protein, 9 aa, Homo Sapiens
QQFCGKYAY

SEQ ID NO: 849527 - protein, 9 aa, Homo Sapiens
QYPGVCYPV

SEQ ID NO: 849528 - protein, 9 aa, Homo Sapiens
ARKRNRMHG

SEQ ID NO: 849529 - protein, 9 aa, Homo Sapiens
NLESFPRVE

SEQ ID NO: 849530 - protein, 9 aa, Homo Sapiens
ITMVNYYTP

SEQ ID NO: 849531 - protein, 9 aa, Homo Sapiens
DLYRDVMMD

SEQ ID NO: 849532 - protein, 9 aa, Homo Sapiens
GDKSFQLPA

SEQ ID NO: 849533 - protein, 9 aa, Homo Sapiens
DDKIVDLNL

SEQ ID NO: 849534 - protein, 9 aa, Homo Sapiens
LPTEHASRP

SEQ ID NO: 849535 - protein, 9 aa, Homo Sapiens
VRQLEFSET

SEQ ID NO: 849536 - protein, 9 aa, Homo Sapiens
QQIAVTLNK

SEQ ID NO: 849537 - protein, 9 aa, Homo Sapiens
YKPQKSSPK

SEQ ID NO: 849538 - protein, 9 aa, Homo Sapiens
GYLVNYLHK

SEQ ID NO: 849539 - protein, 9 aa, Homo Sapiens
IRRFVHDQG

SEQ ID NO: 849540 - protein, 9 aa, Homo Sapiens
DKSVEKIQR

SEQ ID NO: 849541 - protein, 9 aa, Homo Sapiens
VIGSFLTLN

SEQ ID NO: 849542 - protein, 9 aa, Homo Sapiens
LSHKLISQM

SEQ ID NO: 849543 - protein, 9 aa, Homo Sapiens
DTVYRQANT

SEQ ID NO: 849544 - protein, 9 aa, Homo Sapiens
MFANQLDAQ

SEQ ID NO: 849545 - protein, 9 aa, Homo Sapiens
MGSSRVPHG

SEQ ID NO: 849546 - protein, 9 aa, Homo Sapiens
VLSAQQLQA

SEQ ID NO: 849547 - protein, 9 aa, Homo Sapiens
EVKLAGLEF

SEQ ID NO: 849548 - protein, 9 aa, Homo Sapiens
RLNEMLQEW

SEQ ID NO: 849549 - protein, 9 aa, Homo Sapiens
CSYSVGQMF

SEQ ID NO: 849550 - protein, 9 aa, Homo Sapiens
ITSQLHQVD

SEQ ID NO: 849551 - protein, 9 aa, Homo Sapiens
GFVSGITEI

SEQ ID NO: 849552 - protein, 9 aa, Homo Sapiens
SRLDASLSN

SEQ ID NO: 849553 - protein, 9 aa, Homo Sapiens
GNSSVDKTS

SEQ ID NO: 849554 - protein, 9 aa, Homo Sapiens
PALLKQGHT

SEQ ID NO: 849555 - protein, 9 aa, Homo Sapiens
FLLNKTLHE

SEQ ID NO: 849556 - protein, 9 aa, Homo Sapiens
LSAKGDPLI

SEQ ID NO: 849557 - protein, 9 aa, Homo Sapiens
LYTIQENMR

SEQ ID NO: 849558 - protein, 9 aa, Homo Sapiens
MGTFAKVRR

SEQ ID NO: 849559 - protein, 9 aa, Homo Sapiens
TGLIEKNIK

SEQ ID NO: 849560 - protein, 9 aa, Homo Sapiens
FPRGCKKHL

SEQ ID NO: 849561 - protein, 9 aa, Homo Sapiens
NERTNVGIV

SEQ ID NO: 849562 - protein, 9 aa, Homo Sapiens
GRLRNLILD

SEQ ID NO: 849563 - protein, 9 aa, Homo Sapiens
ETSVTWTRP

SEQ ID NO: 849564 - protein, 9 aa, Homo Sapiens
DSHISQSNI

SEQ ID NO: 849565 - protein, 9 aa, Homo Sapiens
LFKPLVLRH

SEQ ID NO: 849566 - protein, 9 aa, Homo Sapiens
LSLVDLNTN

SEQ ID NO: 849567 - protein, 9 aa, Homo Sapiens
IHDFEKGMA

SEQ ID NO: 849568 - protein, 9 aa, Homo Sapiens
SKTAVHVQD

SEQ ID NO: 849569 - protein, 9 aa, Homo Sapiens
SCSWSFFCS

SEQ ID NO: 849570 - protein, 9 aa, Homo Sapiens
NRKDGTPFD

SEQ ID NO: 849571 - protein, 9 aa, Homo Sapiens
DRLQSDFTA

SEQ ID NO: 849572 - protein, 9 aa, Homo Sapiens
PFDTPSFNK

SEQ ID NO: 849573 - protein, 9 aa, Homo Sapiens
GDHTLTYPI

SEQ ID NO: 849574 - protein, 9 aa, Homo Sapiens
KGMVQVVRL

SEQ ID NO: 849575 - protein, 9 aa, Homo Sapiens
GMKGFIKGQ

SEQ ID NO: 849576 - protein, 9 aa, Homo Sapiens
ECKYITKNL

SEQ ID NO: 849577 - protein, 9 aa, Homo Sapiens
QMKSQWMLS

SEQ ID NO: 849578 - protein, 9 aa, Homo Sapiens
GLYLYQFQL

SEQ ID NO: 849579 - protein, 9 aa, Homo Sapiens
VVNANSTPP

SEQ ID NO: 849580 - protein, 9 aa, Homo Sapiens
LVCCRDEFL

SEQ ID NO: 849581 - protein, 9 aa, Homo Sapiens
QPSPKPSPN

SEQ ID NO: 849582 - protein, 9 aa, Homo Sapiens
FLLNAEYYR

SEQ ID NO: 849583 - protein, 9 aa, Homo Sapiens
PDNLLLGSA

SEQ ID NO: 849584 - protein, 9 aa, Homo Sapiens
MITISKGCI

SEQ ID NO: 849585 - protein, 9 aa, Homo Sapiens
IDFHVTVLP

SEQ ID NO: 849586 - protein, 9 aa, Homo Sapiens
KVNCSDRVF

SEQ ID NO: 849587 - protein, 9 aa, Homo Sapiens
WMLAWEVLR

SEQ ID NO: 849588 - protein, 9 aa, Homo Sapiens
LFSLFSHIV

SEQ ID NO: 849589 - protein, 9 aa, Homo Sapiens
LSEREVEII

SEQ ID NO: 849590 - protein, 9 aa, Homo Sapiens
RRRLRMLAL

SEQ ID NO: 849591 - protein, 9 aa, Homo Sapiens
IYALQSFNH

SEQ ID NO: 849592 - protein, 9 aa, Homo Sapiens
RLLLPHWTK

SEQ ID NO: 849593 - protein, 9 aa, Homo Sapiens
KEIVKSHSP

SEQ ID NO: 849594 - protein, 9 aa, Homo Sapiens
HKCGKTFSG

SEQ ID NO: 849595 - protein, 9 aa, Homo Sapiens
EELSLQKSY

SEQ ID NO: 849596 - protein, 9 aa, Homo Sapiens
KDGRFTAQV

SEQ ID NO: 849597 - protein, 9 aa, Homo Sapiens
KRQKINLGD

SEQ ID NO: 849598 - protein, 9 aa, Homo Sapiens
RFGKTKSIV

SEQ ID NO: 849599 - protein, 9 aa, Homo Sapiens
NPQEWHCKQ

SEQ ID NO: 849600 - protein, 9 aa, Homo Sapiens
TSFEEWGKI

SEQ ID NO: 849601 - protein, 9 aa, Homo Sapiens
TAKFKETRR

SEQ ID NO: 849602 - protein, 9 aa, Homo Sapiens
SPASYSVSL

SEQ ID NO: 849603 - protein, 9 aa, Homo Sapiens
GFNSMGGKE

SEQ ID NO: 849604 - protein, 9 aa, Homo Sapiens
PSNMISYAI

SEQ ID NO: 849605 - protein, 9 aa, Homo Sapiens
DGEAENGEQ

SEQ ID NO: 849606 - protein, 9 aa, Homo Sapiens
MRHVNISVR

SEQ ID NO: 849607 - protein, 9 aa, Homo Sapiens
IAALNQQIL

SEQ ID NO: 849608 - protein, 9 aa, Homo Sapiens
KTYDTINTT

SEQ ID NO: 849609 - protein, 9 aa, Homo Sapiens
LGYIYFKLF

SEQ ID NO: 849610 - protein, 9 aa, Homo Sapiens
QFFTWGNNS

SEQ ID NO: 849611 - protein, 9 aa, Homo Sapiens
ILKSQLVQP

SEQ ID NO: 849612 - protein, 9 aa, Homo Sapiens
SLPLGPILG

SEQ ID NO: 849613 - protein, 9 aa, Homo Sapiens
QTSYGTFQR

SEQ ID NO: 849614 - protein, 9 aa, Homo Sapiens
PKPAIHFRL

SEQ ID NO: 849615 - protein, 9 aa, Homo Sapiens
EFLLLGLSK

SEQ ID NO: 849616 - protein, 9 aa, Homo Sapiens
ICQLLGAPR

SEQ ID NO: 849617 - protein, 9 aa, Homo Sapiens
LCRGNPSER

SEQ ID NO: 849618 - protein, 9 aa, Homo Sapiens
HKNLCSLKT

SEQ ID NO: 849619 - protein, 9 aa, Homo Sapiens
CTIFLFKFL

SEQ ID NO: 849620 - protein, 9 aa, Homo Sapiens
KATYNRTLI

SEQ ID NO: 849621 - protein, 9 aa, Homo Sapiens
HCWYTAHRT

SEQ ID NO: 849622 - protein, 9 aa, Homo Sapiens
QRMMYATLL

SEQ ID NO: 849623 - protein, 9 aa, Homo Sapiens
CCGLDRFKV

SEQ ID NO: 849624 - protein, 9 aa, Homo Sapiens
VVFSEEDLQ

SEQ ID NO: 849625 - protein, 9 aa, Homo Sapiens
AAYDKRFPT

SEQ ID NO: 849626 - protein, 9 aa, Homo Sapiens
FYNYPELQG

SEQ ID NO: 849627 - protein, 9 aa, Homo Sapiens
AHGLLQPHL

SEQ ID NO: 849628 - protein, 9 aa, Homo Sapiens
TGFLFGVAN

SEQ ID NO: 849629 - protein, 9 aa, Homo Sapiens
LPNGSSSVN

SEQ ID NO: 849630 - protein, 9 aa, Homo Sapiens
GANNRLESQ

SEQ ID NO: 849631 - protein, 9 aa, Homo Sapiens
SPQGLSAQW

SEQ ID NO: 849632 - protein, 9 aa, Homo Sapiens
LNEMLQEWQ

SEQ ID NO: 849633 - protein, 9 aa, Homo Sapiens
SLHTGPGNP

SEQ ID NO: 849634 - protein, 9 aa, Homo Sapiens
AQIYYFQLY

SEQ ID NO: 849635 - protein, 9 aa, Homo Sapiens
YVGSFSSLH

SEQ ID NO: 849636 - protein, 9 aa, Homo Sapiens
SYMDVYLIH

SEQ ID NO: 849637 - protein, 9 aa, Homo Sapiens
PFQVQVKRY

SEQ ID NO: 849638 - protein, 9 aa, Homo Sapiens
DLNFNQIAR

SEQ ID NO: 849639 - protein, 9 aa, Homo Sapiens
SDPEETTEF

SEQ ID NO: 849640 - protein, 9 aa, Homo Sapiens
ALETLGGDK

SEQ ID NO: 849641 - protein, 9 aa, Homo Sapiens
YIRHKYVNV

SEQ ID NO: 849642 - protein, 9 aa, Homo Sapiens
RYLMAHIKR

SEQ ID NO: 849643 - protein, 9 aa, Homo Sapiens
LTSYSWDYM

SEQ ID NO: 849644 - protein, 9 aa, Homo Sapiens
ILRAVSDAS

SEQ ID NO: 849645 - protein, 9 aa, Homo Sapiens
HNFYSHPHF

SEQ ID NO: 849646 - protein, 9 aa, Homo Sapiens
RRCQRRLIP

SEQ ID NO: 849647 - protein, 9 aa, Homo Sapiens
RTGLKVDWR

SEQ ID NO: 849648 - protein, 9 aa, Homo Sapiens
SDYATCLYF

SEQ ID NO: 849649 - protein, 9 aa, Homo Sapiens
KMCEQEDKM

SEQ ID NO: 849650 - protein, 9 aa, Homo Sapiens
SSPSLCIAR

SEQ ID NO: 849651 - protein, 9 aa, Homo Sapiens
MPEFSLDST

SEQ ID NO: 849652 - protein, 9 aa, Homo Sapiens
CEECTFMAV

SEQ ID NO: 849653 - protein, 9 aa, Homo Sapiens
RLGMCFGDR

SEQ ID NO: 849654 - protein, 9 aa, Homo Sapiens
SHPVKPSIL

SEQ ID NO: 849655 - protein, 9 aa, Homo Sapiens
FLVAFVNMF

SEQ ID NO: 849656 - protein, 9 aa, Homo Sapiens
CSVPCTAFR

SEQ ID NO: 849657 - protein, 9 aa, Homo Sapiens
VVFGVDLKT

SEQ ID NO: 849658 - protein, 9 aa, Homo Sapiens
PFILRFHEN

SEQ ID NO: 849659 - protein, 9 aa, Homo Sapiens
KAKKARSTT

SEQ ID NO: 849660 - protein, 9 aa, Homo Sapiens
YYLTYLYTG

SEQ ID NO: 849661 - protein, 9 aa, Homo Sapiens
QRIYYSWEG

SEQ ID NO: 849662 - protein, 9 aa, Homo Sapiens
LASQKLRIN

SEQ ID NO: 849663 - protein, 9 aa, Homo Sapiens
RVNRNVWSQ

SEQ ID NO: 849664 - protein, 9 aa, Homo Sapiens
SQLLLDLSC

SEQ ID NO: 849665 - protein, 9 aa, Homo Sapiens
IFYSPISIA

SEQ ID NO: 849666 - protein, 9 aa, Homo Sapiens
SFECSRKKR

SEQ ID NO: 849667 - protein, 9 aa, Homo Sapiens
EAVCQLHRE

SEQ ID NO: 849668 - protein, 9 aa, Homo Sapiens
KDPVSNTPA

SEQ ID NO: 849669 - protein, 9 aa, Homo Sapiens
IKNLEVQLC

SEQ ID NO: 849670 - protein, 9 aa, Homo Sapiens
PSSSSTSQN

SEQ ID NO: 849671 - protein, 9 aa, Homo Sapiens
GGGGGGDSG

SEQ ID NO: 849672 - protein, 9 aa, Homo Sapiens
SGLEKTTTK

SEQ ID NO: 849673 - protein, 9 aa, Homo Sapiens
LGNKCVLNF

SEQ ID NO: 849674 - protein, 9 aa, Homo Sapiens
QQQQEEMHH

SEQ ID NO: 849675 - protein, 9 aa, Homo Sapiens
TFKSGIVQY

SEQ ID NO: 849676 - protein, 9 aa, Homo Sapiens
TLLTNTGAP

SEQ ID NO: 849677 - protein, 9 aa, Homo Sapiens
QNRLQDIAE

SEQ ID NO: 849678 - protein, 9 aa, Homo Sapiens
QTRMATMGI

SEQ ID NO: 849679 - protein, 9 aa, Homo Sapiens
NSVTTDSWS

SEQ ID NO: 849680 - protein, 9 aa, Homo Sapiens
PRPSRSNTA

SEQ ID NO: 849681 - protein, 9 aa, Homo Sapiens
MKKLKGEKK

SEQ ID NO: 849682 - protein, 9 aa, Homo Sapiens
MNDFNYLKL

SEQ ID NO: 849683 - protein, 9 aa, Homo Sapiens
PNPAVGLCC

SEQ ID NO: 849684 - protein, 9 aa, Homo Sapiens
NRTVLDNLG

SEQ ID NO: 849685 - protein, 9 aa, Homo Sapiens
ASRDVWMSS

SEQ ID NO: 849686 - protein, 9 aa, Homo Sapiens
GKCPDNGWD

SEQ ID NO: 849687 - protein, 9 aa, Homo Sapiens
SFEEWGKIM

SEQ ID NO: 849688 - protein, 9 aa, Homo Sapiens
AMAHLSGTV

SEQ ID NO: 849689 - protein, 9 aa, Homo Sapiens
SQVFCGLSN

SEQ ID NO: 849690 - protein, 9 aa, Homo Sapiens
PVDVSYATS

SEQ ID NO: 849691 - protein, 9 aa, Homo Sapiens
NVIDHLSCD

SEQ ID NO: 849692 - protein, 9 aa, Homo Sapiens
DPDMALCQN

SEQ ID NO: 849693 - protein, 9 aa, Homo Sapiens
GGINKEILR

SEQ ID NO: 849694 - protein, 9 aa, Homo Sapiens
MLQEICTMM

SEQ ID NO: 849695 - protein, 9 aa, Homo Sapiens
KSQFKEHQQ

SEQ ID NO: 849696 - protein, 9 aa, Homo Sapiens
TIQGFEVLV

SEQ ID NO: 849697 - protein, 9 aa, Homo Sapiens
PPPPPPSSL

SEQ ID NO: 849698 - protein, 9 aa, Homo Sapiens
YHTGLYSKI

SEQ ID NO: 849699 - protein, 9 aa, Homo Sapiens
LENKTIRGK

SEQ ID NO: 849700 - protein, 9 aa, Homo Sapiens
CLAVREFIC

SEQ ID NO: 849701 - protein, 9 aa, Homo Sapiens
RKRGICGCV

SEQ ID NO: 849702 - protein, 9 aa, Homo Sapiens
SDDEELLLA

SEQ ID NO: 849703 - protein, 9 aa, Homo Sapiens
FPNNNLKKN

SEQ ID NO: 849704 - protein, 9 aa, Homo Sapiens
SSVTDADAG

SEQ ID NO: 849705 - protein, 9 aa, Homo Sapiens
SVCQRYNKI

SEQ ID NO: 849706 - protein, 9 aa, Homo Sapiens
CIFHPILSY

SEQ ID NO: 849707 - protein, 9 aa, Homo Sapiens
VDSLTEHSC

SEQ ID NO: 849708 - protein, 9 aa, Homo Sapiens
FFYWRSKSK

SEQ ID NO: 849709 - protein, 9 aa, Homo Sapiens
WRNPRRFQY

SEQ ID NO: 849710 - protein, 9 aa, Homo Sapiens
PSGLHEKCK

SEQ ID NO: 849711 - protein, 9 aa, Homo Sapiens
RRVAEELTL

SEQ ID NO: 849712 - protein, 9 aa, Homo Sapiens
EDAVKTISP

SEQ ID NO: 849713 - protein, 9 aa, Homo Sapiens
VLQTNNDPG

SEQ ID NO: 849714 - protein, 9 aa, Homo Sapiens
AKVIRLLAT

SEQ ID NO: 849715 - protein, 9 aa, Homo Sapiens
ALACFLHSG

SEQ ID NO: 849716 - protein, 9 aa, Homo Sapiens
MLQYFITVV

SEQ ID NO: 849717 - protein, 9 aa, Homo Sapiens
QTLDKVLEV

SEQ ID NO: 849718 - protein, 9 aa, Homo Sapiens
TGFKPVQVQ

SEQ ID NO: 849719 - protein, 9 aa, Homo Sapiens
AKLRKCIGM

SEQ ID NO: 849720 - protein, 9 aa, Homo Sapiens
RILRRPASY

SEQ ID NO: 849721 - protein, 9 aa, Homo Sapiens
LEIHNEHLS

SEQ ID NO: 849722 - protein, 9 aa, Homo Sapiens
LVQIINSIY

SEQ ID NO: 849723 - protein, 9 aa, Homo Sapiens
TRDGHYYLT

SEQ ID NO: 849724 - protein, 9 aa, Homo Sapiens
FLQELSKEE

SEQ ID NO: 849725 - protein, 9 aa, Homo Sapiens
KYVLVIQNS

SEQ ID NO: 849726 - protein, 9 aa, Homo Sapiens
LCSRLDASL

SEQ ID NO: 849727 - protein, 9 aa, Homo Sapiens
TKGGKKGDK

SEQ ID NO: 849728 - protein, 9 aa, Homo Sapiens
CIDARFYWN

SEQ ID NO: 849729 - protein, 9 aa, Homo Sapiens
ILISYIDNP

SEQ ID NO: 849730 - protein, 9 aa, Homo Sapiens
GEALFLSWF

SEQ ID NO: 849731 - protein, 9 aa, Homo Sapiens
NIVNIKVQE

SEQ ID NO: 849732 - protein, 9 aa, Homo Sapiens
KCCDQYPKG

SEQ ID NO: 849733 - protein, 9 aa, Homo Sapiens
EENNLVTEP

SEQ ID NO: 849734 - protein, 9 aa, Homo Sapiens
KGYGLVSFF

SEQ ID NO: 849735 - protein, 9 aa, Homo Sapiens
KTVIQHCRE

SEQ ID NO: 849736 - protein, 9 aa, Homo Sapiens
RVRSRASIK

SEQ ID NO: 849737 - protein, 9 aa, Homo Sapiens
GIVPLCYVK

SEQ ID NO: 849738 - protein, 9 aa, Homo Sapiens
IEAILANME

SEQ ID NO: 849739 - protein, 9 aa, Homo Sapiens
HQHEGRKVC

SEQ ID NO: 849740 - protein, 9 aa, Homo Sapiens
GRDAWGPGD

SEQ ID NO: 849741 - protein, 9 aa, Homo Sapiens
EMRHVNISV

SEQ ID NO: 849742 - protein, 9 aa, Homo Sapiens
GRNVTSKFP

SEQ ID NO: 849743 - protein, 9 aa, Homo Sapiens
VLCEMAVNT

SEQ ID NO: 849744 - protein, 9 aa, Homo Sapiens
EYSEDNLLF

SEQ ID NO: 849745 - protein, 9 aa, Homo Sapiens
VNRNKKCIA

SEQ ID NO: 849746 - protein, 9 aa, Homo Sapiens
PLNTSDLSD

SEQ ID NO: 849747 - protein, 9 aa, Homo Sapiens
GSKAVWMPS

SEQ ID NO: 849748 - protein, 9 aa, Homo Sapiens
YGLVDGIYR

SEQ ID NO: 849749 - protein, 9 aa, Homo Sapiens
AQRSKDPHS

SEQ ID NO: 849750 - protein, 9 aa, Homo Sapiens
EIISNSCSN

SEQ ID NO: 849751 - protein, 9 aa, Homo Sapiens
APAVQDVSR

SEQ ID NO: 849752 - protein, 9 aa, Homo Sapiens
QMLRGEKNQ

SEQ ID NO: 849753 - protein, 9 aa, Homo Sapiens
LNIRCEHFR

SEQ ID NO: 849754 - protein, 9 aa, Homo Sapiens
DFLQVLEPG

SEQ ID NO: 849755 - protein, 9 aa, Homo Sapiens
KEPGKLDKL

SEQ ID NO: 849756 - protein, 9 aa, Homo Sapiens
FFLLFLSFF

SEQ ID NO: 849757 - protein, 9 aa, Homo Sapiens
LEQPFAGKE

SEQ ID NO: 849758 - protein, 9 aa, Homo Sapiens
HQIIHTVVK

SEQ ID NO: 849759 - protein, 9 aa, Homo Sapiens
VCKVGKDYF

SEQ ID NO: 849760 - protein, 9 aa, Homo Sapiens
PQITPKQNG

SEQ ID NO: 849761 - protein, 9 aa, Homo Sapiens
GLVLKIFFE

SEQ ID NO: 849762 - protein, 9 aa, Homo Sapiens
TQWIQNGTK

SEQ ID NO: 849763 - protein, 9 aa, Homo Sapiens
LGRGAAASS

SEQ ID NO: 849764 - protein, 9 aa, Homo Sapiens
IISPRQVSY

SEQ ID NO: 849765 - protein, 9 aa, Homo Sapiens
AIKDAEEDG

SEQ ID NO: 849766 - protein, 9 aa, Homo Sapiens
HVTRYVVKH

SEQ ID NO: 849767 - protein, 9 aa, Homo Sapiens
QLNDLDKSV

SEQ ID NO: 849768 - protein, 9 aa, Homo Sapiens
DPDSQFPAW

SEQ ID NO: 849769 - protein, 9 aa, Homo Sapiens
PVANIFHLR

SEQ ID NO: 849770 - protein, 9 aa, Homo Sapiens
PSDKGATWN

SEQ ID NO: 849771 - protein, 9 aa, Homo Sapiens
KISASRQTL

SEQ ID NO: 849772 - protein, 9 aa, Homo Sapiens
ILSPGEILL

SEQ ID NO: 849773 - protein, 9 aa, Homo Sapiens
GVIFQKFEC

SEQ ID NO: 849774 - protein, 9 aa, Homo Sapiens
CIFYDYNNP

SEQ ID NO: 849775 - protein, 9 aa, Homo Sapiens
QELNRCPFG

SEQ ID NO: 849776 - protein, 9 aa, Homo Sapiens
TLHAENLWP

SEQ ID NO: 849777 - protein, 9 aa, Homo Sapiens
DVNLNNNFS

SEQ ID NO: 849778 - protein, 9 aa, Homo Sapiens
SGFALQSDI

SEQ ID NO: 849779 - protein, 9 aa, Homo Sapiens
QEANARKRN

SEQ ID NO: 849780 - protein, 9 aa, Homo Sapiens
KIITLNGKT

SEQ ID NO: 849781 - protein, 9 aa, Homo Sapiens
QAIGEDNVA

SEQ ID NO: 849782 - protein, 9 aa, Homo Sapiens
WKVNCYGQE

SEQ ID NO: 849783 - protein, 9 aa, Homo Sapiens
PDYGTSSAA

SEQ ID NO: 849784 - protein, 9 aa, Homo Sapiens
AHILNKAGE

SEQ ID NO: 849785 - protein, 9 aa, Homo Sapiens
TNNNVVDCN

SEQ ID NO: 849786 - protein, 9 aa, Homo Sapiens
LIAYMFLLV

SEQ ID NO: 849787 - protein, 9 aa, Homo Sapiens
SRDLSRHEQ

SEQ ID NO: 849788 - protein, 9 aa, Homo Sapiens
MGVALGQYA

SEQ ID NO: 849789 - protein, 9 aa, Homo Sapiens
CMFGPDKLV

SEQ ID NO: 849790 - protein, 9 aa, Homo Sapiens
ECSKTSDIE

SEQ ID NO: 849791 - protein, 9 aa, Homo Sapiens
EPDGSNQTV

SEQ ID NO: 849792 - protein, 9 aa, Homo Sapiens
PLPPSADDY

SEQ ID NO: 849793 - protein, 9 aa, Homo Sapiens
NFSFQISTD

SEQ ID NO: 849794 - protein, 9 aa, Homo Sapiens
TSNTYPPDL

SEQ ID NO: 849795 - protein, 9 aa, Homo Sapiens
ESEDTPNQF

SEQ ID NO: 849796 - protein, 9 aa, Homo Sapiens
TPMLNTFIY

SEQ ID NO: 849797 - protein, 9 aa, Homo Sapiens
VIQTIHKYA

SEQ ID NO: 849798 - protein, 9 aa, Homo Sapiens
SWSDNLREV

SEQ ID NO: 849799 - protein, 9 aa, Homo Sapiens
DSYTAEVVG

SEQ ID NO: 849800 - protein, 9 aa, Homo Sapiens
IINLKRELN

SEQ ID NO: 849801 - protein, 9 aa, Homo Sapiens
EDEEEDQDP

SEQ ID NO: 849802 - protein, 9 aa, Homo Sapiens
PWTTALLLI

SEQ ID NO: 849803 - protein, 9 aa, Homo Sapiens
DSSRKNEQS

SEQ ID NO: 849804 - protein, 9 aa, Homo Sapiens
YKSSGLSCA

SEQ ID NO: 849805 - protein, 9 aa, Homo Sapiens
ENVISQPDE

SEQ ID NO: 849806 - protein, 9 aa, Homo Sapiens
STTIRIRCS

SEQ ID NO: 849807 - protein, 9 aa, Homo Sapiens
NGRSFHNTC

SEQ ID NO: 849808 - protein, 9 aa, Homo Sapiens
QVAAPGTAD

SEQ ID NO: 849809 - protein, 9 aa, Homo Sapiens
PTSCETSGS

SEQ ID NO: 849810 - protein, 9 aa, Homo Sapiens
FPIGSSGFF

SEQ ID NO: 849811 - protein, 9 aa, Homo Sapiens
LGLYGTPDS

SEQ ID NO: 849812 - protein, 9 aa, Homo Sapiens
KFVRPGASY

SEQ ID NO: 849813 - protein, 9 aa, Homo Sapiens
HPKEHMFCK

SEQ ID NO: 849814 - protein, 9 aa, Homo Sapiens
HFKVSAQVI

SEQ ID NO: 849815 - protein, 9 aa, Homo Sapiens
WEPQTSHCK

SEQ ID NO: 849816 - protein, 9 aa, Homo Sapiens
GSQDLFTAF

SEQ ID NO: 849817 - protein, 9 aa, Homo Sapiens
KQHFCGQRK

SEQ ID NO: 849818 - protein, 9 aa, Homo Sapiens
TTFILQNVM

SEQ ID NO: 849819 - protein, 9 aa, Homo Sapiens
TAATRAVLC

SEQ ID NO: 849820 - protein, 9 aa, Homo Sapiens
NLFLAEHHK

SEQ ID NO: 849821 - protein, 9 aa, Homo Sapiens
ANLFVFLTL

SEQ ID NO: 849822 - protein, 9 aa, Homo Sapiens
FLIDDIRKE

SEQ ID NO: 849823 - protein, 9 aa, Homo Sapiens
FKPLVLRHQ

SEQ ID NO: 849824 - protein, 9 aa, Homo Sapiens
GGCGSRCCV

SEQ ID NO: 849825 - protein, 9 aa, Homo Sapiens
VNKQHKRKL

SEQ ID NO: 849826 - protein, 9 aa, Homo Sapiens
ERPAGSTPT

SEQ ID NO: 849827 - protein, 9 aa, Homo Sapiens
PSHRSFTNM

SEQ ID NO: 849828 - protein, 9 aa, Homo Sapiens
QARINSLKL

SEQ ID NO: 849829 - protein, 9 aa, Homo Sapiens
LREQVKELL

SEQ ID NO: 849830 - protein, 9 aa, Homo Sapiens
VGLEAGVNP

SEQ ID NO: 849831 - protein, 9 aa, Homo Sapiens
PDESIQRGQ

SEQ ID NO: 849832 - protein, 9 aa, Homo Sapiens
DSAVCSTIH

SEQ ID NO: 849833 - protein, 9 aa, Homo Sapiens
PVATWQIIQ

SEQ ID NO: 849834 - protein, 9 aa, Homo Sapiens
IKKAEESAN

SEQ ID NO: 849835 - protein, 9 aa, Homo Sapiens
SECGSSFQK

SEQ ID NO: 849836 - protein, 9 aa, Homo Sapiens
LDEKDEDTF

SEQ ID NO: 849837 - protein, 9 aa, Homo Sapiens
SPQAIIMFP

SEQ ID NO: 849838 - protein, 9 aa, Homo Sapiens
LAWPPKEHA

SEQ ID NO: 849839 - protein, 9 aa, Homo Sapiens
VSKLFEHHP

SEQ ID NO: 849840 - protein, 9 aa, Homo Sapiens
RIKDGNGRR

SEQ ID NO: 849841 - protein, 9 aa, Homo Sapiens
HSKLEENHI

SEQ ID NO: 849842 - protein, 9 aa, Homo Sapiens
DGIDLNQTK

SEQ ID NO: 849843 - protein, 9 aa, Homo Sapiens
QKFIKIDQA

SEQ ID NO: 849844 - protein, 9 aa, Homo Sapiens
QRIILEPYK

SEQ ID NO: 849845 - protein, 9 aa, Homo Sapiens
CGHPILQVA

SEQ ID NO: 849846 - protein, 9 aa, Homo Sapiens
SLTPDYDVF

SEQ ID NO: 849847 - protein, 9 aa, Homo Sapiens
HQGDKLEIA

SEQ ID NO: 849848 - protein, 9 aa, Homo Sapiens
EEYRGRLLN

SEQ ID NO: 849849 - protein, 9 aa, Homo Sapiens
SAYEHHLEA

SEQ ID NO: 849850 - protein, 9 aa, Homo Sapiens
NTRVYKKVL

SEQ ID NO: 849851 - protein, 9 aa, Homo Sapiens
IYINNVVSD

SEQ ID NO: 849852 - protein, 9 aa, Homo Sapiens
QKEKNVAGG

SEQ ID NO: 849853 - protein, 9 aa, Homo Sapiens
GLDSEHVYD

SEQ ID NO: 849854 - protein, 9 aa, Homo Sapiens
CVETMELCV

SEQ ID NO: 849855 - protein, 9 aa, Homo Sapiens
LASRHEYLK

SEQ ID NO: 849856 - protein, 9 aa, Homo Sapiens
SSISKHNLF

SEQ ID NO: 849857 - protein, 9 aa, Homo Sapiens
NTLESTHAS

SEQ ID NO: 849858 - protein, 9 aa, Homo Sapiens
QNFEYLHCK

SEQ ID NO: 849859 - protein, 9 aa, Homo Sapiens
SANVFTANT

SEQ ID NO: 849860 - protein, 9 aa, Homo Sapiens
HRAIINTDF

SEQ ID NO: 849861 - protein, 9 aa, Homo Sapiens
GAPGTRRQF

SEQ ID NO: 849862 - protein, 9 aa, Homo Sapiens
RTLDARMPR

SEQ ID NO: 849863 - protein, 9 aa, Homo Sapiens
FVIRIKDGN

SEQ ID NO: 849864 - protein, 9 aa, Homo Sapiens
PQISLAEML

SEQ ID NO: 849865 - protein, 9 aa, Homo Sapiens
VIIKETQVP

SEQ ID NO: 849866 - protein, 9 aa, Homo Sapiens
QYLTVDRNC

SEQ ID NO: 849867 - protein, 9 aa, Homo Sapiens
PVQFYSMTR

SEQ ID NO: 849868 - protein, 9 aa, Homo Sapiens
ENTLMMDAN

SEQ ID NO: 849869 - protein, 9 aa, Homo Sapiens
QLEQEAEKP

SEQ ID NO: 849870 - protein, 9 aa, Homo Sapiens
QLFKMLPYT

SEQ ID NO: 849871 - protein, 9 aa, Homo Sapiens
GRYGSSCLK

SEQ ID NO: 849872 - protein, 9 aa, Homo Sapiens
ETPVVGLTI

SEQ ID NO: 849873 - protein, 9 aa, Homo Sapiens
VDGLLNALR

SEQ ID NO: 849874 - protein, 9 aa, Homo Sapiens
QLKLENIQS

SEQ ID NO: 849875 - protein, 9 aa, Homo Sapiens
SKYQNWRTM

SEQ ID NO: 849876 - protein, 9 aa, Homo Sapiens
SIIRIAACN

SEQ ID NO: 849877 - protein, 9 aa, Homo Sapiens
EDVLNAQKL

SEQ ID NO: 849878 - protein, 9 aa, Homo Sapiens
PQALLTAEE

SEQ ID NO: 849879 - protein, 9 aa, Homo Sapiens
DCPSFSQSS

SEQ ID NO: 849880 - protein, 9 aa, Homo Sapiens
VNQKGCYAL

SEQ ID NO: 849881 - protein, 9 aa, Homo Sapiens
TAEPLLVSF

SEQ ID NO: 849882 - protein, 9 aa, Homo Sapiens
LNMKKTALV

SEQ ID NO: 849883 - protein, 9 aa, Homo Sapiens
TKVTITLTN

SEQ ID NO: 849884 - protein, 9 aa, Homo Sapiens
TINFSGDDL

SEQ ID NO: 849885 - protein, 9 aa, Homo Sapiens
FAPIMNQWW

SEQ ID NO: 849886 - protein, 9 aa, Homo Sapiens
TLQKKDVLL

SEQ ID NO: 849887 - protein, 9 aa, Homo Sapiens
YAPAEYSSF

SEQ ID NO: 849888 - protein, 9 aa, Homo Sapiens
TNVNDALGY

SEQ ID NO: 849889 - protein, 9 aa, Homo Sapiens
HYTWKTSLW

SEQ ID NO: 849890 - protein, 9 aa, Homo Sapiens
IDISELNRV

SEQ ID NO: 849891 - protein, 9 aa, Homo Sapiens
THFEEDTLE

SEQ ID NO: 849892 - protein, 9 aa, Homo Sapiens
AELAWPPKE

SEQ ID NO: 849893 - protein, 9 aa, Homo Sapiens
IAYPSHIGS

SEQ ID NO: 849894 - protein, 9 aa, Homo Sapiens
KTPHKSERH

SEQ ID NO: 849895 - protein, 9 aa, Homo Sapiens
LLNIAYEKI

SEQ ID NO: 849896 - protein, 9 aa, Homo Sapiens
IIQNLKRNY

SEQ ID NO: 849897 - protein, 9 aa, Homo Sapiens
TSLPPLHRS

SEQ ID NO: 849898 - protein, 9 aa, Homo Sapiens
VPDYNDEIC

SEQ ID NO: 849899 - protein, 9 aa, Homo Sapiens
KCRRINSSV

SEQ ID NO: 849900 - protein, 9 aa, Homo Sapiens
PDYPGLFPS

SEQ ID NO: 849901 - protein, 9 aa, Homo Sapiens
EVDIYECQS

SEQ ID NO: 849902 - protein, 9 aa, Homo Sapiens
QTMSALKRH

SEQ ID NO: 849903 - protein, 9 aa, Homo Sapiens
NNLNAIQTV

SEQ ID NO: 849904 - protein, 9 aa, Homo Sapiens
EFYQWICDN

SEQ ID NO: 849905 - protein, 9 aa, Homo Sapiens
VYLCDTNHI

SEQ ID NO: 849906 - protein, 9 aa, Homo Sapiens
SIFQELKPQ

SEQ ID NO: 849907 - protein, 9 aa, Homo Sapiens
DTIPPDWVE

SEQ ID NO: 849908 - protein, 9 aa, Homo Sapiens
HSVVRLPPG

SEQ ID NO: 849909 - protein, 9 aa, Homo Sapiens
TKPNKRKRH

SEQ ID NO: 849910 - protein, 9 aa, Homo Sapiens
YYKTLTLHC

SEQ ID NO: 849911 - protein, 9 aa, Homo Sapiens
SFSVQQHKG

SEQ ID NO: 849912 - protein, 9 aa, Homo Sapiens
YCIFNNNTN

SEQ ID NO: 849913 - protein, 9 aa, Homo Sapiens
LGLVLTPTQ

SEQ ID NO: 849914 - protein, 9 aa, Homo Sapiens
DTVYHNSQR

SEQ ID NO: 849915 - protein, 9 aa, Homo Sapiens
LSLDVASGL

SEQ ID NO: 849916 - protein, 9 aa, Homo Sapiens
NLFVFLTLG

SEQ ID NO: 849917 - protein, 9 aa, Homo Sapiens
IIKVTVNTP

SEQ ID NO: 849918 - protein, 9 aa, Homo Sapiens
EILYTKTEA

SEQ ID NO: 849919 - protein, 9 aa, Homo Sapiens
ETFHVLYLA

SEQ ID NO: 849920 - protein, 9 aa, Homo Sapiens
QLYYKRNVN

SEQ ID NO: 849921 - protein, 9 aa, Homo Sapiens
RLTVSQRNK

SEQ ID NO: 849922 - protein, 9 aa, Homo Sapiens
DEYNGFWKI

SEQ ID NO: 849923 - protein, 9 aa, Homo Sapiens
HPDTWLASR

SEQ ID NO: 849924 - protein, 9 aa, Homo Sapiens
DPKCCGFVT

SEQ ID NO: 849925 - protein, 9 aa, Homo Sapiens
EDKARIIYE

SEQ ID NO: 849926 - protein, 9 aa, Homo Sapiens
KNGTSSKKV

SEQ ID NO: 849927 - protein, 9 aa, Homo Sapiens
PFIETSTKT

SEQ ID NO: 849928 - protein, 9 aa, Homo Sapiens
AIITHFNGN

SEQ ID NO: 849929 - protein, 9 aa, Homo Sapiens
FLIFNILYW

SEQ ID NO: 849930 - protein, 9 aa, Homo Sapiens
NNNFGVVLA

SEQ ID NO: 849931 - protein, 9 aa, Homo Sapiens
CVAHEIYQI

SEQ ID NO: 849932 - protein, 9 aa, Homo Sapiens
MYDQRPSWY

SEQ ID NO: 849933 - protein, 9 aa, Homo Sapiens
PPDLIPKMP

SEQ ID NO: 849934 - protein, 9 aa, Homo Sapiens
SFSPRDVSS

SEQ ID NO: 849935 - protein, 9 aa, Homo Sapiens
DKHPEKFNS

SEQ ID NO: 849936 - protein, 9 aa, Homo Sapiens
HFSQPTGAN

SEQ ID NO: 849937 - protein, 9 aa, Homo Sapiens
LTPYTDSDK

SEQ ID NO: 849938 - protein, 9 aa, Homo Sapiens
KLVAHKPLN

SEQ ID NO: 849939 - protein, 9 aa, Homo Sapiens
VLFVSSRKH

SEQ ID NO: 849940 - protein, 9 aa, Homo Sapiens
RYYLMDLLS

SEQ ID NO: 849941 - protein, 9 aa, Homo Sapiens
PKAASTPRD

SEQ ID NO: 849942 - protein, 9 aa, Homo Sapiens
DIHTLGFPP

SEQ ID NO: 849943 - protein, 9 aa, Homo Sapiens
AWEVLRMRG

SEQ ID NO: 849944 - protein, 9 aa, Homo Sapiens
VGTHSEKQC

SEQ ID NO: 849945 - protein, 9 aa, Homo Sapiens
CVLRSILEN

SEQ ID NO: 849946 - protein, 9 aa, Homo Sapiens
LKPSVFHGP

SEQ ID NO: 849947 - protein, 9 aa, Homo Sapiens
NSPGQLSIS

SEQ ID NO: 849948 - protein, 9 aa, Homo Sapiens
MESISAGSV

SEQ ID NO: 849949 - protein, 9 aa, Homo Sapiens
TIDNAKDTT

SEQ ID NO: 849950 - protein, 9 aa, Homo Sapiens
TTDFGLSKI

SEQ ID NO: 849951 - protein, 9 aa, Homo Sapiens
GLFRAWVWA

SEQ ID NO: 849952 - protein, 9 aa, Homo Sapiens
GGGVGDGGP

SEQ ID NO: 849953 - protein, 9 aa, Homo Sapiens
NVFEPARAQ

SEQ ID NO: 849954 - protein, 9 aa, Homo Sapiens
GGEGLWAWG

SEQ ID NO: 849955 - protein, 9 aa, Homo Sapiens
KALWGRHTN

SEQ ID NO: 849956 - protein, 9 aa, Homo Sapiens
ELVELHWRL

SEQ ID NO: 849957 - protein, 9 aa, Homo Sapiens
HHRNPGIVG

SEQ ID NO: 849958 - protein, 9 aa, Homo Sapiens
YVSRPSHLY

SEQ ID NO: 849959 - protein, 9 aa, Homo Sapiens
KNLKHNTPR

SEQ ID NO: 849960 - protein, 9 aa, Homo Sapiens
SSPRRKMAS

SEQ ID NO: 849961 - protein, 9 aa, Homo Sapiens
EQQQIIIRQ

SEQ ID NO: 849962 - protein, 9 aa, Homo Sapiens
YTQPSAIIS

SEQ ID NO: 849963 - protein, 9 aa, Homo Sapiens
PDSLTFNLD

SEQ ID NO: 849964 - protein, 9 aa, Homo Sapiens
KETMPFLND

SEQ ID NO: 849965 - protein, 9 aa, Homo Sapiens
RPFQVQVKR

SEQ ID NO: 849966 - protein, 9 aa, Homo Sapiens
DWHIQLDKY

SEQ ID NO: 849967 - protein, 9 aa, Homo Sapiens
EDRGVVSVF

SEQ ID NO: 849968 - protein, 9 aa, Homo Sapiens
CDQKYSDED

SEQ ID NO: 849969 - protein, 9 aa, Homo Sapiens
QEELIAIMT

SEQ ID NO: 849970 - protein, 9 aa, Homo Sapiens
KPVEKEILL

SEQ ID NO: 849971 - protein, 9 aa, Homo Sapiens
SPGAVAAPF

SEQ ID NO: 849972 - protein, 9 aa, Homo Sapiens
FGRPVAVPH

SEQ ID NO: 849973 - protein, 9 aa, Homo Sapiens
YCVRRRKWI

SEQ ID NO: 849974 - protein, 9 aa, Homo Sapiens
IKEMAEHEA

SEQ ID NO: 849975 - protein, 9 aa, Homo Sapiens
QHERIYTRD

SEQ ID NO: 849976 - protein, 9 aa, Homo Sapiens
NARTEKEEK

SEQ ID NO: 849977 - protein, 9 aa, Homo Sapiens
WDELWKLAG

SEQ ID NO: 849978 - protein, 9 aa, Homo Sapiens
EPFKCLEPT

SEQ ID NO: 849979 - protein, 9 aa, Homo Sapiens
DEPQKNAVA

SEQ ID NO: 849980 - protein, 9 aa, Homo Sapiens
DCWITFLNQ

SEQ ID NO: 849981 - protein, 9 aa, Homo Sapiens
SSLHYELLE

SEQ ID NO: 849982 - protein, 9 aa, Homo Sapiens
TDPVAYILE

SEQ ID NO: 849983 - protein, 9 aa, Homo Sapiens
TLLILVRSH

SEQ ID NO: 849984 - protein, 9 aa, Homo Sapiens
LDFSDGDEE

SEQ ID NO: 849985 - protein, 9 aa, Homo Sapiens
QIKHLPYTT

SEQ ID NO: 849986 - protein, 9 aa, Homo Sapiens
SLRRVATLV

SEQ ID NO: 849987 - protein, 9 aa, Homo Sapiens
EGTIDFIVN

SEQ ID NO: 849988 - protein, 9 aa, Homo Sapiens
SPLPGGALN

SEQ ID NO: 849989 - protein, 9 aa, Homo Sapiens
QRRIIQWLE

SEQ ID NO: 849990 - protein, 9 aa, Homo Sapiens
EAPTFWQMQ

SEQ ID NO: 849991 - protein, 9 aa, Homo Sapiens
PYKLAINIF

SEQ ID NO: 849992 - protein, 9 aa, Homo Sapiens
PELAREYYI

SEQ ID NO: 849993 - protein, 9 aa, Homo Sapiens
HDKDLRENG

SEQ ID NO: 849994 - protein, 9 aa, Homo Sapiens
PKEPISFSK

SEQ ID NO: 849995 - protein, 9 aa, Homo Sapiens
LCRQSILGT

SEQ ID NO: 849996 - protein, 9 aa, Homo Sapiens
ELHENVIDK

SEQ ID NO: 849997 - protein, 9 aa, Homo Sapiens
QNTPLQSTH

SEQ ID NO: 849998 - protein, 9 aa, Homo Sapiens
EEAGETMVR

SEQ ID NO: 849999 - protein, 9 aa, Homo Sapiens
VFGYLSPSI

SEQ ID NO: 850000 - protein, 9 aa, Homo Sapiens
CNKTRIEER

SEQ ID NO: 850001 - protein, 9 aa, Homo Sapiens
YQIRGEIGS

SEQ ID NO: 850002 - protein, 9 aa, Homo Sapiens
IIKESINKT

SEQ ID NO: 850003 - protein, 9 aa, Homo Sapiens
NTTVSQYPE

SEQ ID NO: 850004 - protein, 9 aa, Homo Sapiens
QYTCSPGFV

SEQ ID NO: 850005 - protein, 9 aa, Homo Sapiens
LSRKEEKPT

SEQ ID NO: 850006 - protein, 9 aa, Homo Sapiens
RKLFKNKSS

SEQ ID NO: 850007 - protein, 9 aa, Homo Sapiens
CREKRREEK

SEQ ID NO: 850008 - protein, 9 aa, Homo Sapiens
YYIWNYKAP

SEQ ID NO: 850009 - protein, 9 aa, Homo Sapiens
LEKECQYSE

SEQ ID NO: 850010 - protein, 9 aa, Homo Sapiens
RYEDRYALA

SEQ ID NO: 850011 - protein, 9 aa, Homo Sapiens
LDIYCVQAI

SEQ ID NO: 850012 - protein, 9 aa, Homo Sapiens
LICVAFTTF

SEQ ID NO: 850013 - protein, 9 aa, Homo Sapiens
FRHLSMRDR

SEQ ID NO: 850014 - protein, 9 aa, Homo Sapiens
RERRWRHRN

SEQ ID NO: 850015 - protein, 9 aa, Homo Sapiens
ARAEEHQET

SEQ ID NO: 850016 - protein, 9 aa, Homo Sapiens
NGNANILVA

SEQ ID NO: 850017 - protein, 9 aa, Homo Sapiens
DELYNPDSE

SEQ ID NO: 850018 - protein, 9 aa, Homo Sapiens
GYKGVTSHW

SEQ ID NO: 850019 - protein, 9 aa, Homo Sapiens
LVLALAGVL

SEQ ID NO: 850020 - protein, 9 aa, Homo Sapiens
DQQIQKRQM

SEQ ID NO: 850021 - protein, 9 aa, Homo Sapiens
SKSAKEELI

SEQ ID NO: 850022 - protein, 9 aa, Homo Sapiens
VGASEMLLL

SEQ ID NO: 850023 - protein, 9 aa, Homo Sapiens
FNALRAACL

SEQ ID NO: 850024 - protein, 9 aa, Homo Sapiens
YDRERCSAY

SEQ ID NO: 850025 - protein, 9 aa, Homo Sapiens
VLPTVMSCD

SEQ ID NO: 850026 - protein, 9 aa, Homo Sapiens
QRKLPQNPK

SEQ ID NO: 850027 - protein, 9 aa, Homo Sapiens
LQKQETSLL

SEQ ID NO: 850028 - protein, 9 aa, Homo Sapiens
EDKVLCRVH

SEQ ID NO: 850029 - protein, 9 aa, Homo Sapiens
VKETNILNM

SEQ ID NO: 850030 - protein, 9 aa, Homo Sapiens
NSSKCEECG

SEQ ID NO: 850031 - protein, 9 aa, Homo Sapiens
QNSQNSLKH

SEQ ID NO: 850032 - protein, 9 aa, Homo Sapiens
NKRWETNRM

SEQ ID NO: 850033 - protein, 9 aa, Homo Sapiens
ENSECSAKT

SEQ ID NO: 850034 - protein, 9 aa, Homo Sapiens
RCCKLCKYE

SEQ ID NO: 850035 - protein, 9 aa, Homo Sapiens
IGCGLSSMF

SEQ ID NO: 850036 - protein, 9 aa, Homo Sapiens
MASQPVMRP

SEQ ID NO: 850037 - protein, 9 aa, Homo Sapiens
CASKHAFAR

SEQ ID NO: 850038 - protein, 9 aa, Homo Sapiens
ITLAFPSPA

SEQ ID NO: 850039 - protein, 9 aa, Homo Sapiens
FGGIIAPFM

SEQ ID NO: 850040 - protein, 9 aa, Homo Sapiens
RYQLLSEVV

SEQ ID NO: 850041 - protein, 9 aa, Homo Sapiens
QTTANNWEL

SEQ ID NO: 850042 - protein, 9 aa, Homo Sapiens
MSTTELRKE

SEQ ID NO: 850043 - protein, 9 aa, Homo Sapiens
FGFNNEKFA

SEQ ID NO: 850044 - protein, 9 aa, Homo Sapiens
SITQVVILS

SEQ ID NO: 850045 - protein, 9 aa, Homo Sapiens
GRKWDFSPV

SEQ ID NO: 850046 - protein, 9 aa, Homo Sapiens
IIYFFLGAS

SEQ ID NO: 850047 - protein, 9 aa, Homo Sapiens
RVNAIHLLV

SEQ ID NO: 850048 - protein, 9 aa, Homo Sapiens
TCQNMACII

SEQ ID NO: 850049 - protein, 9 aa, Homo Sapiens
RQPSSAGVG

SEQ ID NO: 850050 - protein, 9 aa, Homo Sapiens
AIKAVLEVV

SEQ ID NO: 850051 - protein, 9 aa, Homo Sapiens
PLLITALAA

SEQ ID NO: 850052 - protein, 9 aa, Homo Sapiens
LHYLIGLGI

SEQ ID NO: 850053 - protein, 9 aa, Homo Sapiens
PEINRQKSK

SEQ ID NO: 850054 - protein, 9 aa, Homo Sapiens
SPSQIWNFV

SEQ ID NO: 850055 - protein, 9 aa, Homo Sapiens
AATSIMPLG

SEQ ID NO: 850056 - protein, 9 aa, Homo Sapiens
SDKQTEWIA

SEQ ID NO: 850057 - protein, 9 aa, Homo Sapiens
WVLSYRRNS

SEQ ID NO: 850058 - protein, 9 aa, Homo Sapiens
LFECKQCGN

SEQ ID NO: 850059 - protein, 9 aa, Homo Sapiens
YPIPMMPMP

SEQ ID NO: 850060 - protein, 9 aa, Homo Sapiens
EECMLTSVC

SEQ ID NO: 850061 - protein, 9 aa, Homo Sapiens
SAAYTTSIP

SEQ ID NO: 850062 - protein, 9 aa, Homo Sapiens
DKVCFVVFS

SEQ ID NO: 850063 - protein, 9 aa, Homo Sapiens
AYLTEEDVF

SEQ ID NO: 850064 - protein, 9 aa, Homo Sapiens
NTNCCQESA

SEQ ID NO: 850065 - protein, 9 aa, Homo Sapiens
KLMDVWGFS

SEQ ID NO: 850066 - protein, 9 aa, Homo Sapiens
SQVKEINED

SEQ ID NO: 850067 - protein, 9 aa, Homo Sapiens
PQHFCKLRK

SEQ ID NO: 850068 - protein, 9 aa, Homo Sapiens
ICPATSTRI

SEQ ID NO: 850069 - protein, 9 aa, Homo Sapiens
FPMFNPIMY

SEQ ID NO: 850070 - protein, 9 aa, Homo Sapiens
TYSSGNKKD

SEQ ID NO: 850071 - protein, 9 aa, Homo Sapiens
IQAAAPTPT

SEQ ID NO: 850072 - protein, 9 aa, Homo Sapiens
VILQVFQGE

SEQ ID NO: 850073 - protein, 9 aa, Homo Sapiens
NYFHENNVS

SEQ ID NO: 850074 - protein, 9 aa, Homo Sapiens
GNYGFGVLV

SEQ ID NO: 850075 - protein, 9 aa, Homo Sapiens
AWTMSDVVE

SEQ ID NO: 850076 - protein, 9 aa, Homo Sapiens
TCLQTIHFS

SEQ ID NO: 850077 - protein, 9 aa, Homo Sapiens
SDGPYNYDI

SEQ ID NO: 850078 - protein, 9 aa, Homo Sapiens
LVDRPQELK

SEQ ID NO: 850079 - protein, 9 aa, Homo Sapiens
EFLYKENKT

SEQ ID NO: 850080 - protein, 9 aa, Homo Sapiens
KDGDPRKDT

SEQ ID NO: 850081 - protein, 9 aa, Homo Sapiens
KTVISSIYY

SEQ ID NO: 850082 - protein, 9 aa, Homo Sapiens
EEEEENKAP

SEQ ID NO: 850083 - protein, 9 aa, Homo Sapiens
LSQPSPPSS

SEQ ID NO: 850084 - protein, 9 aa, Homo Sapiens
VEASQKKSA

SEQ ID NO: 850085 - protein, 9 aa, Homo Sapiens
VGGKMAGQL

SEQ ID NO: 850086 - protein, 9 aa, Homo Sapiens
HFSPFCVQH

SEQ ID NO: 850087 - protein, 9 aa, Homo Sapiens
VSSTDGDDS

SEQ ID NO: 850088 - protein, 9 aa, Homo Sapiens
RRDCNDFWE

SEQ ID NO: 850089 - protein, 9 aa, Homo Sapiens
FFINDSKLA

SEQ ID NO: 850090 - protein, 9 aa, Homo Sapiens
IPQQLANLP

SEQ ID NO: 850091 - protein, 9 aa, Homo Sapiens
PQDFLSFTN

SEQ ID NO: 850092 - protein, 9 aa, Homo Sapiens
KRGRKRKMC

SEQ ID NO: 850093 - protein, 9 aa, Homo Sapiens
DVRVAASYA

SEQ ID NO: 850094 - protein, 9 aa, Homo Sapiens
LSQNQLSAL

SEQ ID NO: 850095 - protein, 9 aa, Homo Sapiens
FFLTNLSPV

SEQ ID NO: 850096 - protein, 9 aa, Homo Sapiens
TLGPTVVSH

SEQ ID NO: 850097 - protein, 9 aa, Homo Sapiens
LKPQTVATP

SEQ ID NO: 850098 - protein, 9 aa, Homo Sapiens
LCKLWLMHA

SEQ ID NO: 850099 - protein, 9 aa, Homo Sapiens
GSTGFGNVS

SEQ ID NO: 850100 - protein, 9 aa, Homo Sapiens
KRSQTRMAT

SEQ ID NO: 850101 - protein, 9 aa, Homo Sapiens
GRSPINASN

SEQ ID NO: 850102 - protein, 9 aa, Homo Sapiens
NLGDRSQKC

SEQ ID NO: 850103 - protein, 9 aa, Homo Sapiens
YRIENHICK

SEQ ID NO: 850104 - protein, 9 aa, Homo Sapiens
SVFEDNFLS

SEQ ID NO: 850105 - protein, 9 aa, Homo Sapiens
LLSNPGLMN

SEQ ID NO: 850106 - protein, 9 aa, Homo Sapiens
SKAVWMPSP

SEQ ID NO: 850107 - protein, 9 aa, Homo Sapiens
FVLFFFRRV

SEQ ID NO: 850108 - protein, 9 aa, Homo Sapiens
VLLESLEFY

SEQ ID NO: 850109 - protein, 9 aa, Homo Sapiens
PGHENFQNW

SEQ ID NO: 850110 - protein, 9 aa, Homo Sapiens
EDLCEVYNA

SEQ ID NO: 850111 - protein, 9 aa, Homo Sapiens
RAPPWQEGQ

SEQ ID NO: 850112 - protein, 9 aa, Homo Sapiens
GTSIWKAEL

SEQ ID NO: 850113 - protein, 9 aa, Homo Sapiens
KKSDDPVED

SEQ ID NO: 850114 - protein, 9 aa, Homo Sapiens
RRIKTELLV

SEQ ID NO: 850115 - protein, 9 aa, Homo Sapiens
HKLFRKIIP

SEQ ID NO: 850116 - protein, 9 aa, Homo Sapiens
QLEKLDILE

SEQ ID NO: 850117 - protein, 9 aa, Homo Sapiens
PHLDHPGYL

SEQ ID NO: 850118 - protein, 9 aa, Homo Sapiens
SDIWLFGAW

SEQ ID NO: 850119 - protein, 9 aa, Homo Sapiens
QDYASVEYL

SEQ ID NO: 850120 - protein, 9 aa, Homo Sapiens
SSLFKGFFP

SEQ ID NO: 850121 - protein, 9 aa, Homo Sapiens
IHNEHLSPV

SEQ ID NO: 850122 - protein, 9 aa, Homo Sapiens
LQGEKQYYS

SEQ ID NO: 850123 - protein, 9 aa, Homo Sapiens
KGNGLWCSA

SEQ ID NO: 850124 - protein, 9 aa, Homo Sapiens
RGQFVGDGT

SEQ ID NO: 850125 - protein, 9 aa, Homo Sapiens
RAITGTISP

SEQ ID NO: 850126 - protein, 9 aa, Homo Sapiens
LLARLGCSS

SEQ ID NO: 850127 - protein, 9 aa, Homo Sapiens
DYAKNILSL

SEQ ID NO: 850128 - protein, 9 aa, Homo Sapiens
TRHDMGTLD

SEQ ID NO: 850129 - protein, 9 aa, Homo Sapiens
TQNVTFVFD

SEQ ID NO: 850130 - protein, 9 aa, Homo Sapiens
DPTRQDTAL

SEQ ID NO: 850131 - protein, 9 aa, Homo Sapiens
TIPYFRDKE

SEQ ID NO: 850132 - protein, 9 aa, Homo Sapiens
EWFSEYVYK

SEQ ID NO: 850133 - protein, 9 aa, Homo Sapiens
HSEKNWNRD

SEQ ID NO: 850134 - protein, 9 aa, Homo Sapiens
SWEAFWRFP

SEQ ID NO: 850135 - protein, 9 aa, Homo Sapiens
SSKPKRQPH

SEQ ID NO: 850136 - protein, 9 aa, Homo Sapiens
ESYVRSQLN

SEQ ID NO: 850137 - protein, 9 aa, Homo Sapiens
LQNLSLSGH

SEQ ID NO: 850138 - protein, 9 aa, Homo Sapiens
QENKLQNTM

SEQ ID NO: 850139 - protein, 9 aa, Homo Sapiens
GWLGLGEGA

SEQ ID NO: 850140 - protein, 9 aa, Homo Sapiens
HFHDFSVIF

SEQ ID NO: 850141 - protein, 9 aa, Homo Sapiens
CRIYLIQHQ

SEQ ID NO: 850142 - protein, 9 aa, Homo Sapiens
GTPLLDFPV

SEQ ID NO: 850143 - protein, 9 aa, Homo Sapiens
TSPRATVST

SEQ ID NO: 850144 - protein, 9 aa, Homo Sapiens
SRQAKRPAA

SEQ ID NO: 850145 - protein, 9 aa, Homo Sapiens
PFHFYYPRV

SEQ ID NO: 850146 - protein, 9 aa, Homo Sapiens
TGHCWCVDD

SEQ ID NO: 850147 - protein, 9 aa, Homo Sapiens
ERGIISGTC

SEQ ID NO: 850148 - protein, 9 aa, Homo Sapiens
YQNNNPPNN

SEQ ID NO: 850149 - protein, 9 aa, Homo Sapiens
ARNVKAMDI

SEQ ID NO: 850150 - protein, 9 aa, Homo Sapiens
GKDINLNKV

SEQ ID NO: 850151 - protein, 9 aa, Homo Sapiens
YVINWFMFF

SEQ ID NO: 850152 - protein, 9 aa, Homo Sapiens
IYTWTKGPD

SEQ ID NO: 850153 - protein, 9 aa, Homo Sapiens
PLPACLQWL

SEQ ID NO: 850154 - protein, 9 aa, Homo Sapiens
RAEKRKNNA

SEQ ID NO: 850155 - protein, 9 aa, Homo Sapiens
AKDLPKLAS

SEQ ID NO: 850156 - protein, 9 aa, Homo Sapiens
NLVAMKEIM

SEQ ID NO: 850157 - protein, 9 aa, Homo Sapiens
YATCLYFIC

SEQ ID NO: 850158 - protein, 9 aa, Homo Sapiens
ILPRLQQLP

SEQ ID NO: 850159 - protein, 9 aa, Homo Sapiens
EDSVLSGCS

SEQ ID NO: 850160 - protein, 9 aa, Homo Sapiens
VAVNSYMPV

SEQ ID NO: 850161 - protein, 9 aa, Homo Sapiens
VAHKYKKQI

SEQ ID NO: 850162 - protein, 9 aa, Homo Sapiens
EAFWRFPAF

SEQ ID NO: 850163 - protein, 9 aa, Homo Sapiens
ITHQIIHSG

SEQ ID NO: 850164 - protein, 9 aa, Homo Sapiens
EEPTVSIHL

SEQ ID NO: 850165 - protein, 9 aa, Homo Sapiens
GRKCRRINS

SEQ ID NO: 850166 - protein, 9 aa, Homo Sapiens
MWSNLTFSL

SEQ ID NO: 850167 - protein, 9 aa, Homo Sapiens
PKWEQFILG

SEQ ID NO: 850168 - protein, 9 aa, Homo Sapiens
QHFAFMYIT

SEQ ID NO: 850169 - protein, 9 aa, Homo Sapiens
GCAYFHKEE

SEQ ID NO: 850170 - protein, 9 aa, Homo Sapiens
IRNEDIKSL

SEQ ID NO: 850171 - protein, 9 aa, Homo Sapiens
LPQAQSCAK

SEQ ID NO: 850172 - protein, 9 aa, Homo Sapiens
QRPNLRANP

SEQ ID NO: 850173 - protein, 9 aa, Homo Sapiens
KQARIKARK

SEQ ID NO: 850174 - protein, 9 aa, Homo Sapiens
PPSNLRLSP

SEQ ID NO: 850175 - protein, 9 aa, Homo Sapiens
LKILRKYKP

SEQ ID NO: 850176 - protein, 9 aa, Homo Sapiens
NTNRKADFH

SEQ ID NO: 850177 - protein, 9 aa, Homo Sapiens
FSLLLMQLV

SEQ ID NO: 850178 - protein, 9 aa, Homo Sapiens
KLFELIQGT

SEQ ID NO: 850179 - protein, 9 aa, Homo Sapiens
EQVRRQRLR

SEQ ID NO: 850180 - protein, 9 aa, Homo Sapiens
RYCSMLCKA

SEQ ID NO: 850181 - protein, 9 aa, Homo Sapiens
QTAHLFLSH

SEQ ID NO: 850182 - protein, 9 aa, Homo Sapiens
DEFKNDLLK

SEQ ID NO: 850183 - protein, 9 aa, Homo Sapiens
EGYVGVEDL

SEQ ID NO: 850184 - protein, 9 aa, Homo Sapiens
GYNCNVRLP

SEQ ID NO: 850185 - protein, 9 aa, Homo Sapiens
DFQGAQEPA

SEQ ID NO: 850186 - protein, 9 aa, Homo Sapiens
EKVCLAQKM

SEQ ID NO: 850187 - protein, 9 aa, Homo Sapiens
DTVLQHVVK

SEQ ID NO: 850188 - protein, 9 aa, Homo Sapiens
GRVFRSRCQ

SEQ ID NO: 850189 - protein, 9 aa, Homo Sapiens
KCMRNGPDA

SEQ ID NO: 850190 - protein, 9 aa, Homo Sapiens
TWKREFGEE

SEQ ID NO: 850191 - protein, 9 aa, Homo Sapiens
VRTHNSWTQ

SEQ ID NO: 850192 - protein, 9 aa, Homo Sapiens
ILMMLRYHT

SEQ ID NO: 850193 - protein, 9 aa, Homo Sapiens
DGVSKSRIR

SEQ ID NO: 850194 - protein, 9 aa, Homo Sapiens
LTDYVNDLQ

SEQ ID NO: 850195 - protein, 9 aa, Homo Sapiens
SESQRSWNV

SEQ ID NO: 850196 - protein, 9 aa, Homo Sapiens
RLSSWCLNK

SEQ ID NO: 850197 - protein, 9 aa, Homo Sapiens
AESVKILCD

SEQ ID NO: 850198 - protein, 9 aa, Homo Sapiens
SSETSSSFS

SEQ ID NO: 850199 - protein, 9 aa, Homo Sapiens
VKKDVTVGS

SEQ ID NO: 850200 - protein, 9 aa, Homo Sapiens
TITLTNVND

SEQ ID NO: 850201 - protein, 9 aa, Homo Sapiens
RQHSAVLPG

SEQ ID NO: 850202 - protein, 9 aa, Homo Sapiens
CKASYHLKI

SEQ ID NO: 850203 - protein, 9 aa, Homo Sapiens
DIFLPVKHK

SEQ ID NO: 850204 - protein, 9 aa, Homo Sapiens
DWHYMQKEG

SEQ ID NO: 850205 - protein, 9 aa, Homo Sapiens
SHPKEKMNK

SEQ ID NO: 850206 - protein, 9 aa, Homo Sapiens
CAYFHKEER

SEQ ID NO: 850207 - protein, 9 aa, Homo Sapiens
SYAGYIENL

SEQ ID NO: 850208 - protein, 9 aa, Homo Sapiens
PGAVAAPFI

SEQ ID NO: 850209 - protein, 9 aa, Homo Sapiens
QPLLKLSCS

SEQ ID NO: 850210 - protein, 9 aa, Homo Sapiens
ELGNEKLKN

SEQ ID NO: 850211 - protein, 9 aa, Homo Sapiens
SEMLLLTVM

SEQ ID NO: 850212 - protein, 9 aa, Homo Sapiens
YKKVTSSKC

SEQ ID NO: 850213 - protein, 9 aa, Homo Sapiens
DPVMAQQHH

SEQ ID NO: 850214 - protein, 9 aa, Homo Sapiens
NKHLNNINI

SEQ ID NO: 850215 - protein, 9 aa, Homo Sapiens
IFSLPQVFS

SEQ ID NO: 850216 - protein, 9 aa, Homo Sapiens
FTVAKNNTL

SEQ ID NO: 850217 - protein, 9 aa, Homo Sapiens
YLAPGFVIK

SEQ ID NO: 850218 - protein, 9 aa, Homo Sapiens
LQIFYMFVV

SEQ ID NO: 850219 - protein, 9 aa, Homo Sapiens
RQYYGKSPE

SEQ ID NO: 850220 - protein, 9 aa, Homo Sapiens
DQQIAVTLN

SEQ ID NO: 850221 - protein, 9 aa, Homo Sapiens
FTRLGQSHR

SEQ ID NO: 850222 - protein, 9 aa, Homo Sapiens
ECENPETDS

SEQ ID NO: 850223 - protein, 9 aa, Homo Sapiens
GRETNNLSP

SEQ ID NO: 850224 - protein, 9 aa, Homo Sapiens
GELFPVPES

SEQ ID NO: 850225 - protein, 9 aa, Homo Sapiens
TSNSLLVSW

SEQ ID NO: 850226 - protein, 9 aa, Homo Sapiens
NILVENNYT

SEQ ID NO: 850227 - protein, 9 aa, Homo Sapiens
VQGPPMLQE

SEQ ID NO: 850228 - protein, 9 aa, Homo Sapiens
GQTFGREEL

SEQ ID NO: 850229 - protein, 9 aa, Homo Sapiens
DVFWAKYTT

SEQ ID NO: 850230 - protein, 9 aa, Homo Sapiens
SWIPPFPKR

SEQ ID NO: 850231 - protein, 9 aa, Homo Sapiens
KNRDKVILF

SEQ ID NO: 850232 - protein, 9 aa, Homo Sapiens
HKLHYLIGL

SEQ ID NO: 850233 - protein, 9 aa, Homo Sapiens
SDKLTCQGS

SEQ ID NO: 850234 - protein, 9 aa, Homo Sapiens
KAINSNGEN

SEQ ID NO: 850235 - protein, 9 aa, Homo Sapiens
LDVSSNKLK

SEQ ID NO: 850236 - protein, 9 aa, Homo Sapiens
SLLIFLFAV

SEQ ID NO: 850237 - protein, 9 aa, Homo Sapiens
FGKTKSIVE

SEQ ID NO: 850238 - protein, 9 aa, Homo Sapiens
QKKMTMREI

SEQ ID NO: 850239 - protein, 9 aa, Homo Sapiens
TTVFIADLL

SEQ ID NO: 850240 - protein, 9 aa, Homo Sapiens
YGDTFPDEN

SEQ ID NO: 850241 - protein, 9 aa, Homo Sapiens
VTEIGITFI

SEQ ID NO: 850242 - protein, 9 aa, Homo Sapiens
FRAGLPQDL

SEQ ID NO: 850243 - protein, 9 aa, Homo Sapiens
EQSLDESRG

SEQ ID NO: 850244 - protein, 9 aa, Homo Sapiens
TVDTIKRPS

SEQ ID NO: 850245 - protein, 9 aa, Homo Sapiens
SPNNTVISV

SEQ ID NO: 850246 - protein, 9 aa, Homo Sapiens
GAGCSGPVD

SEQ ID NO: 850247 - protein, 9 aa, Homo Sapiens
TQNAIAFHR

SEQ ID NO: 850248 - protein, 9 aa, Homo Sapiens
EINTASRDE

SEQ ID NO: 850249 - protein, 9 aa, Homo Sapiens
WSYFPSEAT

SEQ ID NO: 850250 - protein, 9 aa, Homo Sapiens
LQRQALKED

SEQ ID NO: 850251 - protein, 9 aa, Homo Sapiens
EKNVAGGVK

SEQ ID NO: 850252 - protein, 9 aa, Homo Sapiens
RGAWACGYR

SEQ ID NO: 850253 - protein, 9 aa, Homo Sapiens
VYKTLFARC

SEQ ID NO: 850254 - protein, 9 aa, Homo Sapiens
FLPPARPRI

SEQ ID NO: 850255 - protein, 9 aa, Homo Sapiens
ARFVTDFLD

SEQ ID NO: 850256 - protein, 9 aa, Homo Sapiens
EGPFDHMFQ

SEQ ID NO: 850257 - protein, 9 aa, Homo Sapiens
ALLEITGYT

SEQ ID NO: 850258 - protein, 9 aa, Homo Sapiens
RWKALRSYI

SEQ ID NO: 850259 - protein, 9 aa, Homo Sapiens
FSRITYKMP

SEQ ID NO: 850260 - protein, 9 aa, Homo Sapiens
EEEEEAHKK

SEQ ID NO: 850261 - protein, 9 aa, Homo Sapiens
NCLISSGNL

SEQ ID NO: 850262 - protein, 9 aa, Homo Sapiens
LDNPLNSTQ

SEQ ID NO: 850263 - protein, 9 aa, Homo Sapiens
LLLINVDRY

SEQ ID NO: 850264 - protein, 9 aa, Homo Sapiens
TLWKAMKGL

SEQ ID NO: 850265 - protein, 9 aa, Homo Sapiens
NTSSESTGH

SEQ ID NO: 850266 - protein, 9 aa, Homo Sapiens
FKNIDESWI

SEQ ID NO: 850267 - protein, 9 aa, Homo Sapiens
PICKQNFDA

SEQ ID NO: 850268 - protein, 9 aa, Homo Sapiens
WYEHRFAPF

SEQ ID NO: 850269 - protein, 9 aa, Homo Sapiens
LAVLKVRTE

SEQ ID NO: 850270 - protein, 9 aa, Homo Sapiens
KEVDATRKC

SEQ ID NO: 850271 - protein, 9 aa, Homo Sapiens
RHPGIQRTA

SEQ ID NO: 850272 - protein, 9 aa, Homo Sapiens
SHLSLLNIW

SEQ ID NO: 850273 - protein, 9 aa, Homo Sapiens
SMAQHLIES

SEQ ID NO: 850274 - protein, 9 aa, Homo Sapiens
HLKDTPSLR

SEQ ID NO: 850275 - protein, 9 aa, Homo Sapiens
KEKYIVYPG

SEQ ID NO: 850276 - protein, 9 aa, Homo Sapiens
VLRALKTIY

SEQ ID NO: 850277 - protein, 9 aa, Homo Sapiens
RFSYQEKPR

SEQ ID NO: 850278 - protein, 9 aa, Homo Sapiens
EETAGDSED

SEQ ID NO: 850279 - protein, 9 aa, Homo Sapiens
TDVPATGLL

SEQ ID NO: 850280 - protein, 9 aa, Homo Sapiens
SALHIVSRV

SEQ ID NO: 850281 - protein, 9 aa, Homo Sapiens
VNKSLEGIF

SEQ ID NO: 850282 - protein, 9 aa, Homo Sapiens
PLETVSCCP

SEQ ID NO: 850283 - protein, 9 aa, Homo Sapiens
PLEKEQIQN

SEQ ID NO: 850284 - protein, 9 aa, Homo Sapiens
SGIFPGLVG

SEQ ID NO: 850285 - protein, 9 aa, Homo Sapiens
SVDDFYSGL

SEQ ID NO: 850286 - protein, 9 aa, Homo Sapiens
EVLEEIKNL

SEQ ID NO: 850287 - protein, 9 aa, Homo Sapiens
NKVKQENTV

SEQ ID NO: 850288 - protein, 9 aa, Homo Sapiens
MVYKTLFAR

SEQ ID NO: 850289 - protein, 9 aa, Homo Sapiens
KLVQIINSI

SEQ ID NO: 850290 - protein, 9 aa, Homo Sapiens
YELDILFPP

SEQ ID NO: 850291 - protein, 9 aa, Homo Sapiens
AASEEAHPS

SEQ ID NO: 850292 - protein, 9 aa, Homo Sapiens
TLGMGTSGS

SEQ ID NO: 850293 - protein, 9 aa, Homo Sapiens
ISCEEYKTI

SEQ ID NO: 850294 - protein, 9 aa, Homo Sapiens
KFLQVYDGD

SEQ ID NO: 850295 - protein, 9 aa, Homo Sapiens
TNTSFYGFT

SEQ ID NO: 850296 - protein, 9 aa, Homo Sapiens
CYMYRIIHE

SEQ ID NO: 850297 - protein, 9 aa, Homo Sapiens
KRRQNAGKD

SEQ ID NO: 850298 - protein, 9 aa, Homo Sapiens
KPGLRELSE

SEQ ID NO: 850299 - protein, 9 aa, Homo Sapiens
PKAQQKAKV

SEQ ID NO: 850300 - protein, 9 aa, Homo Sapiens
GRFWSGNYR

SEQ ID NO: 850301 - protein, 9 aa, Homo Sapiens
MVKLNDGSP

SEQ ID NO: 850302 - protein, 9 aa, Homo Sapiens
GLRVALEDS

SEQ ID NO: 850303 - protein, 9 aa, Homo Sapiens
DLTVEHDSL

SEQ ID NO: 850304 - protein, 9 aa, Homo Sapiens
EPVSSLEDI

SEQ ID NO: 850305 - protein, 9 aa, Homo Sapiens
ARLMEYLDR

SEQ ID NO: 850306 - protein, 9 aa, Homo Sapiens
LQDEKIIYP

SEQ ID NO: 850307 - protein, 9 aa, Homo Sapiens
EMFIDTVSS

SEQ ID NO: 850308 - protein, 9 aa, Homo Sapiens
LIVHQGTHT

SEQ ID NO: 850309 - protein, 9 aa, Homo Sapiens
ADGTGPTQG

SEQ ID NO: 850310 - protein, 9 aa, Homo Sapiens
RSYPHLSPN

SEQ ID NO: 850311 - protein, 9 aa, Homo Sapiens
RQKGLMRQR

SEQ ID NO: 850312 - protein, 9 aa, Homo Sapiens
NKGAIYEGD

SEQ ID NO: 850313 - protein, 9 aa, Homo Sapiens
AAPFSNVLT

SEQ ID NO: 850314 - protein, 9 aa, Homo Sapiens
PPKCCNLLR

SEQ ID NO: 850315 - protein, 9 aa, Homo Sapiens
CLIQHQLFH

SEQ ID NO: 850316 - protein, 9 aa, Homo Sapiens
SGDKVEIGP

SEQ ID NO: 850317 - protein, 9 aa, Homo Sapiens
DWCISLICA

SEQ ID NO: 850318 - protein, 9 aa, Homo Sapiens
FDCRYKTIQ

SEQ ID NO: 850319 - protein, 9 aa, Homo Sapiens
LVDEDTTSF

SEQ ID NO: 850320 - protein, 9 aa, Homo Sapiens
PAGRWKRPK

SEQ ID NO: 850321 - protein, 9 aa, Homo Sapiens
RSLQELLDF

SEQ ID NO: 850322 - protein, 9 aa, Homo Sapiens
ASRAIKNTS

SEQ ID NO: 850323 - protein, 9 aa, Homo Sapiens
SQSVGSPNK

SEQ ID NO: 850324 - protein, 9 aa, Homo Sapiens
RKISESKSL

SEQ ID NO: 850325 - protein, 9 aa, Homo Sapiens
EKTAAKMEN

SEQ ID NO: 850326 - protein, 9 aa, Homo Sapiens
HKLEQHGGS

SEQ ID NO: 850327 - protein, 9 aa, Homo Sapiens
LYGPNKRGP

SEQ ID NO: 850328 - protein, 9 aa, Homo Sapiens
DSEQDKNEK

SEQ ID NO: 850329 - protein, 9 aa, Homo Sapiens
KKYKNRTNC

SEQ ID NO: 850330 - protein, 9 aa, Homo Sapiens
ISTEIELPE

SEQ ID NO: 850331 - protein, 9 aa, Homo Sapiens
NIIVYLYTK

SEQ ID NO: 850332 - protein, 9 aa, Homo Sapiens
LTQNDFGHP

SEQ ID NO: 850333 - protein, 9 aa, Homo Sapiens
KVTMNDFNY

SEQ ID NO: 850334 - protein, 9 aa, Homo Sapiens
ECYNIYSKT

SEQ ID NO: 850335 - protein, 9 aa, Homo Sapiens
MFAFLLCVC

SEQ ID NO: 850336 - protein, 9 aa, Homo Sapiens
PGSPGHTVY

SEQ ID NO: 850337 - protein, 9 aa, Homo Sapiens
SPINGSCQC

SEQ ID NO: 850338 - protein, 9 aa, Homo Sapiens
RNGTKNRYK

SEQ ID NO: 850339 - protein, 9 aa, Homo Sapiens
VMEYLGPPN

SEQ ID NO: 850340 - protein, 9 aa, Homo Sapiens
VLNDEQYQS

SEQ ID NO: 850341 - protein, 9 aa, Homo Sapiens
LDNTPNNYL

SEQ ID NO: 850342 - protein, 9 aa, Homo Sapiens
NMWLCPIKE

SEQ ID NO: 850343 - protein, 9 aa, Homo Sapiens
LITTFILQN

SEQ ID NO: 850344 - protein, 9 aa, Homo Sapiens
IFDEDYKKK

SEQ ID NO: 850345 - protein, 9 aa, Homo Sapiens
TTCQAGGRD

SEQ ID NO: 850346 - protein, 9 aa, Homo Sapiens
IDHDITSQR

SEQ ID NO: 850347 - protein, 9 aa, Homo Sapiens
MNKEAVWFL

SEQ ID NO: 850348 - protein, 9 aa, Homo Sapiens
PQKSSPKST

SEQ ID NO: 850349 - protein, 9 aa, Homo Sapiens
KLFLDSYKL

SEQ ID NO: 850350 - protein, 9 aa, Homo Sapiens
RNRSWGALG

SEQ ID NO: 850351 - protein, 9 aa, Homo Sapiens
APDDQEFLK

SEQ ID NO: 850352 - protein, 9 aa, Homo Sapiens
GEKCHPDTG

SEQ ID NO: 850353 - protein, 9 aa, Homo Sapiens
GQEPVLAAE

SEQ ID NO: 850354 - protein, 9 aa, Homo Sapiens
DPEARKLIK

SEQ ID NO: 850355 - protein, 9 aa, Homo Sapiens
SLGSDMGGP

SEQ ID NO: 850356 - protein, 9 aa, Homo Sapiens
VPKPIEPLN

SEQ ID NO: 850357 - protein, 9 aa, Homo Sapiens
YLQYLTHWP

SEQ ID NO: 850358 - protein, 9 aa, Homo Sapiens
QKKTPEPIP

SEQ ID NO: 850359 - protein, 9 aa, Homo Sapiens
YYCYGGYSG

SEQ ID NO: 850360 - protein, 9 aa, Homo Sapiens
YLGCDLPQT

SEQ ID NO: 850361 - protein, 9 aa, Homo Sapiens
LTWENFHFM

SEQ ID NO: 850362 - protein, 9 aa, Homo Sapiens
IAYEKIAYL

SEQ ID NO: 850363 - protein, 9 aa, Homo Sapiens
IPICGEIEN

SEQ ID NO: 850364 - protein, 9 aa, Homo Sapiens
LTKVVQCRE

SEQ ID NO: 850365 - protein, 9 aa, Homo Sapiens
DEFRYQMYQ

SEQ ID NO: 850366 - protein, 9 aa, Homo Sapiens
PIPCEVMAS

SEQ ID NO: 850367 - protein, 9 aa, Homo Sapiens
YPEKEDYIV

SEQ ID NO: 850368 - protein, 9 aa, Homo Sapiens
GSCKRIEEV

SEQ ID NO: 850369 - protein, 9 aa, Homo Sapiens
FEDMQEIIH

SEQ ID NO: 850370 - protein, 9 aa, Homo Sapiens
SLAGEEDVL

SEQ ID NO: 850371 - protein, 9 aa, Homo Sapiens
SATWKREFG

SEQ ID NO: 850372 - protein, 9 aa, Homo Sapiens
RDRICRVLS

SEQ ID NO: 850373 - protein, 9 aa, Homo Sapiens
QRQALKEDF

SEQ ID NO: 850374 - protein, 9 aa, Homo Sapiens
KNWQMLQLL

SEQ ID NO: 850375 - protein, 9 aa, Homo Sapiens
QVTEGLCAS

SEQ ID NO: 850376 - protein, 9 aa, Homo Sapiens
RPALLVYLI

SEQ ID NO: 850377 - protein, 9 aa, Homo Sapiens
MAVLISNKA

SEQ ID NO: 850378 - protein, 9 aa, Homo Sapiens
KMAHIGVGI

SEQ ID NO: 850379 - protein, 9 aa, Homo Sapiens
LWLICVAFT

SEQ ID NO: 850380 - protein, 9 aa, Homo Sapiens
MVFSLDCVL

SEQ ID NO: 850381 - protein, 9 aa, Homo Sapiens
TFIYSLRNK

SEQ ID NO: 850382 - protein, 9 aa, Homo Sapiens
FTKGEFILL

SEQ ID NO: 850383 - protein, 9 aa, Homo Sapiens
PKLYYLRIH

SEQ ID NO: 850384 - protein, 9 aa, Homo Sapiens
EGRCKALSS

SEQ ID NO: 850385 - protein, 9 aa, Homo Sapiens
LMEEQYRTQ

SEQ ID NO: 850386 - protein, 9 aa, Homo Sapiens
VDPLDWLCG

SEQ ID NO: 850387 - protein, 9 aa, Homo Sapiens
HASDLQVEV

SEQ ID NO: 850388 - protein, 9 aa, Homo Sapiens
KQSNSTAWQ

SEQ ID NO: 850389 - protein, 9 aa, Homo Sapiens
TQSYPTNSY

SEQ ID NO: 850390 - protein, 9 aa, Homo Sapiens
EQIKWSLFK

SEQ ID NO: 850391 - protein, 9 aa, Homo Sapiens
VQLETESKH

SEQ ID NO: 850392 - protein, 9 aa, Homo Sapiens
IKNTRRSIK

SEQ ID NO: 850393 - protein, 9 aa, Homo Sapiens
GEDDPENIE

SEQ ID NO: 850394 - protein, 9 aa, Homo Sapiens
VLVAVALAS

SEQ ID NO: 850395 - protein, 9 aa, Homo Sapiens
MRIYKTGDI

SEQ ID NO: 850396 - protein, 9 aa, Homo Sapiens
QPSAIISVP

SEQ ID NO: 850397 - protein, 9 aa, Homo Sapiens
DNAPETVVA

SEQ ID NO: 850398 - protein, 9 aa, Homo Sapiens
HSSNPYHNP

SEQ ID NO: 850399 - protein, 9 aa, Homo Sapiens
ESRGSRQEL

SEQ ID NO: 850400 - protein, 9 aa, Homo Sapiens
MAIAVSSSF

SEQ ID NO: 850401 - protein, 9 aa, Homo Sapiens
KKTVEAGGV

SEQ ID NO: 850402 - protein, 9 aa, Homo Sapiens
TQMTRCPEQ

SEQ ID NO: 850403 - protein, 9 aa, Homo Sapiens
QKYLERLTQ

SEQ ID NO: 850404 - protein, 9 aa, Homo Sapiens
KCSKENEEH

SEQ ID NO: 850405 - protein, 9 aa, Homo Sapiens
LHDEFGYNA

SEQ ID NO: 850406 - protein, 9 aa, Homo Sapiens
CSECGSSFQ

SEQ ID NO: 850407 - protein, 9 aa, Homo Sapiens
TRLELSNPI

SEQ ID NO: 850408 - protein, 9 aa, Homo Sapiens
MEKGGNIQV

SEQ ID NO: 850409 - protein, 9 aa, Homo Sapiens
DYDPLQFQG

SEQ ID NO: 850410 - protein, 9 aa, Homo Sapiens
LKLSYMDVY

SEQ ID NO: 850411 - protein, 9 aa, Homo Sapiens
PCSARFVTD

SEQ ID NO: 850412 - protein, 9 aa, Homo Sapiens
QSDFTALLT

SEQ ID NO: 850413 - protein, 9 aa, Homo Sapiens
TKNNFSSLK

SEQ ID NO: 850414 - protein, 9 aa, Homo Sapiens
SLNILGLET

SEQ ID NO: 850415 - protein, 9 aa, Homo Sapiens
HNHIEKLNS

SEQ ID NO: 850416 - protein, 9 aa, Homo Sapiens
PNDLWYNLI

SEQ ID NO: 850417 - protein, 9 aa, Homo Sapiens
LRKKRRQAK

SEQ ID NO: 850418 - protein, 9 aa, Homo Sapiens
ENYLLKNDT

SEQ ID NO: 850419 - protein, 9 aa, Homo Sapiens
ELRAFSSFK

SEQ ID NO: 850420 - protein, 9 aa, Homo Sapiens
NACGKGFTQ

SEQ ID NO: 850421 - protein, 9 aa, Homo Sapiens
NPLNTATLF

SEQ ID NO: 850422 - protein, 9 aa, Homo Sapiens
APDKVTLLV

SEQ ID NO: 850423 - protein, 9 aa, Homo Sapiens
TELNRAMAN

SEQ ID NO: 850424 - protein, 9 aa, Homo Sapiens
NREEEKEKQ

SEQ ID NO: 850425 - protein, 9 aa, Homo Sapiens
KLIYTLSLE

SEQ ID NO: 850426 - protein, 9 aa, Homo Sapiens
TTKTPAGAS

SEQ ID NO: 850427 - protein, 9 aa, Homo Sapiens
RGEHNNGVL

SEQ ID NO: 850428 - protein, 9 aa, Homo Sapiens
CAGCKCSYH

SEQ ID NO: 850429 - protein, 9 aa, Homo Sapiens
SFVAEFSVS

SEQ ID NO: 850430 - protein, 9 aa, Homo Sapiens
SQYLIVHCK

SEQ ID NO: 850431 - protein, 9 aa, Homo Sapiens
YLIVYYTGW

SEQ ID NO: 850432 - protein, 9 aa, Homo Sapiens
FFPRPSRSN

SEQ ID NO: 850433 - protein, 9 aa, Homo Sapiens
ANAPEELSS

SEQ ID NO: 850434 - protein, 9 aa, Homo Sapiens
RNVSLRVKC

SEQ ID NO: 850435 - protein, 9 aa, Homo Sapiens
QYEMVRRHR

SEQ ID NO: 850436 - protein, 9 aa, Homo Sapiens
MMCPQAFNN

SEQ ID NO: 850437 - protein, 9 aa, Homo Sapiens
HKKLFEQEN

SEQ ID NO: 850438 - protein, 9 aa, Homo Sapiens
ADNRKVQEP

SEQ ID NO: 850439 - protein, 9 aa, Homo Sapiens
NYFGAENLF

SEQ ID NO: 850440 - protein, 9 aa, Homo Sapiens
ELRVKCSVT

SEQ ID NO: 850441 - protein, 9 aa, Homo Sapiens
EDIDVTSNA

SEQ ID NO: 850442 - protein, 9 aa, Homo Sapiens
GIYEHISLA

SEQ ID NO: 850443 - protein, 9 aa, Homo Sapiens
RNRQMKINT

SEQ ID NO: 850444 - protein, 9 aa, Homo Sapiens
RTIKQTDEE

SEQ ID NO: 850445 - protein, 9 aa, Homo Sapiens
EINQEELIA

SEQ ID NO: 850446 - protein, 9 aa, Homo Sapiens
AFSKLSGDY

SEQ ID NO: 850447 - protein, 9 aa, Homo Sapiens
RKLFLGVAE

SEQ ID NO: 850448 - protein, 9 aa, Homo Sapiens
EMLRQFSTE

SEQ ID NO: 850449 - protein, 9 aa, Homo Sapiens
RIYTRDNSY

SEQ ID NO: 850450 - protein, 9 aa, Homo Sapiens
LMGHQRVHT

SEQ ID NO: 850451 - protein, 9 aa, Homo Sapiens
QQRMRKMLQ

SEQ ID NO: 850452 - protein, 9 aa, Homo Sapiens
LRGAGLLGR

SEQ ID NO: 850453 - protein, 9 aa, Homo Sapiens
KSCCSSSGC

SEQ ID NO: 850454 - protein, 9 aa, Homo Sapiens
RRVGPFGPS

SEQ ID NO: 850455 - protein, 9 aa, Homo Sapiens
FFSKPSLHS

SEQ ID NO: 850456 - protein, 9 aa, Homo Sapiens
QMKAQEIEI

SEQ ID NO: 850457 - protein, 9 aa, Homo Sapiens
WLIHSFQVI

SEQ ID NO: 850458 - protein, 9 aa, Homo Sapiens
SDHVKVILY

SEQ ID NO: 850459 - protein, 9 aa, Homo Sapiens
LLCVYEQKL

SEQ ID NO: 850460 - protein, 9 aa, Homo Sapiens
LHFLRLNHN

SEQ ID NO: 850461 - protein, 9 aa, Homo Sapiens
KERSEKDIG

SEQ ID NO: 850462 - protein, 9 aa, Homo Sapiens
EISLSSNSS

SEQ ID NO: 850463 - protein, 9 aa, Homo Sapiens
NNNVCKQCK

SEQ ID NO: 850464 - protein, 9 aa, Homo Sapiens
TEGRGTKKD

SEQ ID NO: 850465 - protein, 9 aa, Homo Sapiens
TELLMGELL

SEQ ID NO: 850466 - protein, 9 aa, Homo Sapiens
SDSEDESGI

SEQ ID NO: 850467 - protein, 9 aa, Homo Sapiens
KFTPEKIIA

SEQ ID NO: 850468 - protein, 9 aa, Homo Sapiens
KGKMDMEES

SEQ ID NO: 850469 - protein, 9 aa, Homo Sapiens
PHRVDLDML

SEQ ID NO: 850470 - protein, 9 aa, Homo Sapiens
CSIGGGSVW

SEQ ID NO: 850471 - protein, 9 aa, Homo Sapiens
TSELPLKLE

SEQ ID NO: 850472 - protein, 9 aa, Homo Sapiens
PEYLVSGIQ

SEQ ID NO: 850473 - protein, 9 aa, Homo Sapiens
LVGASKIIM

SEQ ID NO: 850474 - protein, 9 aa, Homo Sapiens
LLTTIGKYL

SEQ ID NO: 850475 - protein, 9 aa, Homo Sapiens
GFKQAAFDV

SEQ ID NO: 850476 - protein, 9 aa, Homo Sapiens
EIVSANLVV

SEQ ID NO: 850477 - protein, 9 aa, Homo Sapiens
AYSSSELDL

SEQ ID NO: 850478 - protein, 9 aa, Homo Sapiens
SAQVITLTD

SEQ ID NO: 850479 - protein, 9 aa, Homo Sapiens
EHLRYCNSI

SEQ ID NO: 850480 - protein, 9 aa, Homo Sapiens
RWRNPRRFQ

SEQ ID NO: 850481 - protein, 9 aa, Homo Sapiens
KRSTTKLGE

SEQ ID NO: 850482 - protein, 9 aa, Homo Sapiens
FIVHKRVNT

SEQ ID NO: 850483 - protein, 9 aa, Homo Sapiens
NQSLRYYRD

SEQ ID NO: 850484 - protein, 9 aa, Homo Sapiens
QCGDCKCNV

SEQ ID NO: 850485 - protein, 9 aa, Homo Sapiens
RQCGDCKCN

SEQ ID NO: 850486 - protein, 9 aa, Homo Sapiens
ACFVWFMNY

SEQ ID NO: 850487 - protein, 9 aa, Homo Sapiens
WSTSLIRHA

SEQ ID NO: 850488 - protein, 9 aa, Homo Sapiens
VVNMAQKAR

SEQ ID NO: 850489 - protein, 9 aa, Homo Sapiens
FAWHTKDMD

SEQ ID NO: 850490 - protein, 9 aa, Homo Sapiens
DFTELDAKT

SEQ ID NO: 850491 - protein, 9 aa, Homo Sapiens
FNIKFAETK

SEQ ID NO: 850492 - protein, 9 aa, Homo Sapiens
KGTPGPAGR

SEQ ID NO: 850493 - protein, 9 aa, Homo Sapiens
LGNDQLQTH

SEQ ID NO: 850494 - protein, 9 aa, Homo Sapiens
TGGDPGERP

SEQ ID NO: 850495 - protein, 9 aa, Homo Sapiens
ILYDIMSKK

SEQ ID NO: 850496 - protein, 9 aa, Homo Sapiens
RNELIGRYI

SEQ ID NO: 850497 - protein, 9 aa, Homo Sapiens
NFCVTVSFT

SEQ ID NO: 850498 - protein, 9 aa, Homo Sapiens
LLHMCDGRT

SEQ ID NO: 850499 - protein, 9 aa, Homo Sapiens
TLPAEAPSP

SEQ ID NO: 850500 - protein, 9 aa, Homo Sapiens
PSNNCRASW

SEQ ID NO: 850501 - protein, 9 aa, Homo Sapiens
DPSLCMFFE

SEQ ID NO: 850502 - protein, 9 aa, Homo Sapiens
VPTYFSNLQ

SEQ ID NO: 850503 - protein, 9 aa, Homo Sapiens
GMLYGSTAF

SEQ ID NO: 850504 - protein, 9 aa, Homo Sapiens
YLALFRVAV

SEQ ID NO: 850505 - protein, 9 aa, Homo Sapiens
ELITHQIIH

SEQ ID NO: 850506 - protein, 9 aa, Homo Sapiens
VVLTSGIPT

SEQ ID NO: 850507 - protein, 9 aa, Homo Sapiens
FAFPGEIIM

SEQ ID NO: 850508 - protein, 9 aa, Homo Sapiens
SFYGSSYLT

SEQ ID NO: 850509 - protein, 9 aa, Homo Sapiens
SYLTPDDSP

SEQ ID NO: 850510 - protein, 9 aa, Homo Sapiens
AFLHCIRQN

SEQ ID NO: 850511 - protein, 9 aa, Homo Sapiens
AKKPACQFE

SEQ ID NO: 850512 - protein, 9 aa, Homo Sapiens
RWELMMKTT

SEQ ID NO: 850513 - protein, 9 aa, Homo Sapiens
QQRDFQRES

SEQ ID NO: 850514 - protein, 9 aa, Homo Sapiens
RGVLLGRFQ

SEQ ID NO: 850515 - protein, 9 aa, Homo Sapiens
YKDVLYKLS

SEQ ID NO: 850516 - protein, 9 aa, Homo Sapiens
ADIESKNTH

SEQ ID NO: 850517 - protein, 9 aa, Homo Sapiens
FDEPLYMSL

SEQ ID NO: 850518 - protein, 9 aa, Homo Sapiens
AGDKFYKCE

SEQ ID NO: 850519 - protein, 9 aa, Homo Sapiens
NGQTDPLQK

SEQ ID NO: 850520 - protein, 9 aa, Homo Sapiens
PQQEWENNL

SEQ ID NO: 850521 - protein, 9 aa, Homo Sapiens
MTTRGEYFL

SEQ ID NO: 850522 - protein, 9 aa, Homo Sapiens
ASRHEYLKL

SEQ ID NO: 850523 - protein, 9 aa, Homo Sapiens
YRALQWTGA

SEQ ID NO: 850524 - protein, 9 aa, Homo Sapiens
RPSPSAAYT

SEQ ID NO: 850525 - protein, 9 aa, Homo Sapiens
KLVEELMLL

SEQ ID NO: 850526 - protein, 9 aa, Homo Sapiens
EIMKEWKNN

SEQ ID NO: 850527 - protein, 9 aa, Homo Sapiens
ALPHAIIRL

SEQ ID NO: 850528 - protein, 9 aa, Homo Sapiens
MSEKLPQLH

SEQ ID NO: 850529 - protein, 9 aa, Homo Sapiens
LFKKSLDRE

SEQ ID NO: 850530 - protein, 9 aa, Homo Sapiens
KDVLIELYA

SEQ ID NO: 850531 - protein, 9 aa, Homo Sapiens
LCVGTMALL

SEQ ID NO: 850532 - protein, 9 aa, Homo Sapiens
GCGWNFPSM

SEQ ID NO: 850533 - protein, 9 aa, Homo Sapiens
ELKEKRSQT

SEQ ID NO: 850534 - protein, 9 aa, Homo Sapiens
RAAKLAPKF

SEQ ID NO: 850535 - protein, 9 aa, Homo Sapiens
CENCKPLRQ

SEQ ID NO: 850536 - protein, 9 aa, Homo Sapiens
DQKDKELLI

SEQ ID NO: 850537 - protein, 9 aa, Homo Sapiens
KIDQAWKIL

SEQ ID NO: 850538 - protein, 9 aa, Homo Sapiens
CVHSLVQIC

SEQ ID NO: 850539 - protein, 9 aa, Homo Sapiens
QNVQGQFLY

SEQ ID NO: 850540 - protein, 9 aa, Homo Sapiens
DQSEIISKQ

SEQ ID NO: 850541 - protein, 9 aa, Homo Sapiens
INDIQEKCV

SEQ ID NO: 850542 - protein, 9 aa, Homo Sapiens
ESTHASLYF

SEQ ID NO: 850543 - protein, 9 aa, Homo Sapiens
QLSTLSHSN

SEQ ID NO: 850544 - protein, 9 aa, Homo Sapiens
PIIYHDVTS

SEQ ID NO: 850545 - protein, 9 aa, Homo Sapiens
VCKADAKIA

SEQ ID NO: 850546 - protein, 9 aa, Homo Sapiens
PPLALAPLP

SEQ ID NO: 850547 - protein, 9 aa, Homo Sapiens
TSTVFSSVL

SEQ ID NO: 850548 - protein, 9 aa, Homo Sapiens
KFITEKSDI

SEQ ID NO: 850549 - protein, 9 aa, Homo Sapiens
NTPCLKNDI

SEQ ID NO: 850550 - protein, 9 aa, Homo Sapiens
KAGDTEDNM

SEQ ID NO: 850551 - protein, 9 aa, Homo Sapiens
MPCYSKTQN

SEQ ID NO: 850552 - protein, 9 aa, Homo Sapiens
REEGIYSII

SEQ ID NO: 850553 - protein, 9 aa, Homo Sapiens
EREQKHPER

SEQ ID NO: 850554 - protein, 9 aa, Homo Sapiens
RWVYGADRF

SEQ ID NO: 850555 - protein, 9 aa, Homo Sapiens
KRYSFSNAW

SEQ ID NO: 850556 - protein, 9 aa, Homo Sapiens
EIIITYLSD

SEQ ID NO: 850557 - protein, 9 aa, Homo Sapiens
DIEEVKKLI

SEQ ID NO: 850558 - protein, 9 aa, Homo Sapiens
FHENHCGLS

SEQ ID NO: 850559 - protein, 9 aa, Homo Sapiens
FGQLILPGL

SEQ ID NO: 850560 - protein, 9 aa, Homo Sapiens
IKLIEKPMG

SEQ ID NO: 850561 - protein, 9 aa, Homo Sapiens
PSPIKPNIP

SEQ ID NO: 850562 - protein, 9 aa, Homo Sapiens
IILAFSLHS

SEQ ID NO: 850563 - protein, 9 aa, Homo Sapiens
HEKQKNELL

SEQ ID NO: 850564 - protein, 9 aa, Homo Sapiens
TVSALCSSS

SEQ ID NO: 850565 - protein, 9 aa, Homo Sapiens
QSRGELMHS

SEQ ID NO: 850566 - protein, 9 aa, Homo Sapiens
KKHLYDVNT

SEQ ID NO: 850567 - protein, 9 aa, Homo Sapiens
RGVSKLNFW

SEQ ID NO: 850568 - protein, 9 aa, Homo Sapiens
LYAPPLALN

SEQ ID NO: 850569 - protein, 9 aa, Homo Sapiens
DYVRSKIAK

SEQ ID NO: 850570 - protein, 9 aa, Homo Sapiens
RIICFCGLF

SEQ ID NO: 850571 - protein, 9 aa, Homo Sapiens
NSDLRNDSY

SEQ ID NO: 850572 - protein, 9 aa, Homo Sapiens
RADTPRINS

SEQ ID NO: 850573 - protein, 9 aa, Homo Sapiens
SKGAISGQS

SEQ ID NO: 850574 - protein, 9 aa, Homo Sapiens
YPNDTVYLA

SEQ ID NO: 850575 - protein, 9 aa, Homo Sapiens
QLFEYTSNK

SEQ ID NO: 850576 - protein, 9 aa, Homo Sapiens
HVSPEEPQT

SEQ ID NO: 850577 - protein, 9 aa, Homo Sapiens
AEHLEDAAN

SEQ ID NO: 850578 - protein, 9 aa, Homo Sapiens
ATDFQVFKQ

SEQ ID NO: 850579 - protein, 9 aa, Homo Sapiens
RLDASLSNN

SEQ ID NO: 850580 - protein, 9 aa, Homo Sapiens
YDSSEPADF

SEQ ID NO: 850581 - protein, 9 aa, Homo Sapiens
KNSKPDSVL

SEQ ID NO: 850582 - protein, 9 aa, Homo Sapiens
KAFTQKPHR

SEQ ID NO: 850583 - protein, 9 aa, Homo Sapiens
YEILQDTDE

SEQ ID NO: 850584 - protein, 9 aa, Homo Sapiens
TSEEKRGFI

SEQ ID NO: 850585 - protein, 9 aa, Homo Sapiens
ARHWIIHTG

SEQ ID NO: 850586 - protein, 9 aa, Homo Sapiens
PEKNWQMLQ

SEQ ID NO: 850587 - protein, 9 aa, Homo Sapiens
NVSYKPQKS

SEQ ID NO: 850588 - protein, 9 aa, Homo Sapiens
PALPHAIYL

SEQ ID NO: 850589 - protein, 9 aa, Homo Sapiens
YREIPEGND

SEQ ID NO: 850590 - protein, 9 aa, Homo Sapiens
EDLEQDKIS

SEQ ID NO: 850591 - protein, 9 aa, Homo Sapiens
KEFKSAIRR

SEQ ID NO: 850592 - protein, 9 aa, Homo Sapiens
LSTIPAGSF

SEQ ID NO: 850593 - protein, 9 aa, Homo Sapiens
EQPFGLYPN

SEQ ID NO: 850594 - protein, 9 aa, Homo Sapiens
QQRYTQSPM

SEQ ID NO: 850595 - protein, 9 aa, Homo Sapiens
FLCETKLEA

SEQ ID NO: 850596 - protein, 9 aa, Homo Sapiens
VLLFPLIPA

SEQ ID NO: 850597 - protein, 9 aa, Homo Sapiens
VYYAKKKRI

SEQ ID NO: 850598 - protein, 9 aa, Homo Sapiens
EEEVLNHVE

SEQ ID NO: 850599 - protein, 9 aa, Homo Sapiens
QEMAIAVSS

SEQ ID NO: 850600 - protein, 9 aa, Homo Sapiens
ADIYCGNCK

SEQ ID NO: 850601 - protein, 9 aa, Homo Sapiens
ADVYYYHII

SEQ ID NO: 850602 - protein, 9 aa, Homo Sapiens
TLSLNTSTA

SEQ ID NO: 850603 - protein, 9 aa, Homo Sapiens
ARSSPYATD

SEQ ID NO: 850604 - protein, 9 aa, Homo Sapiens
VGKDYFGND

SEQ ID NO: 850605 - protein, 9 aa, Homo Sapiens
WQIDNFVPV

SEQ ID NO: 850606 - protein, 9 aa, Homo Sapiens
TYLAWRCCP

SEQ ID NO: 850607 - protein, 9 aa, Homo Sapiens
GGGATSQLL

SEQ ID NO: 850608 - protein, 9 aa, Homo Sapiens
KELVQKDLQ

SEQ ID NO: 850609 - protein, 9 aa, Homo Sapiens
RKLQENLGN

SEQ ID NO: 850610 - protein, 9 aa, Homo Sapiens
VTEGLCASS

SEQ ID NO: 850611 - protein, 9 aa, Homo Sapiens
PKFSNTPKE

SEQ ID NO: 850612 - protein, 9 aa, Homo Sapiens
LPLCWLFLN

SEQ ID NO: 850613 - protein, 9 aa, Homo Sapiens
IRLDLAGRD

SEQ ID NO: 850614 - protein, 9 aa, Homo Sapiens
INIFVDVNK

SEQ ID NO: 850615 - protein, 9 aa, Homo Sapiens
YRSLRSQRL

SEQ ID NO: 850616 - protein, 9 aa, Homo Sapiens
GSTAADSGT

SEQ ID NO: 850617 - protein, 9 aa, Homo Sapiens
WIAYYSEVP

SEQ ID NO: 850618 - protein, 9 aa, Homo Sapiens
PHPHLVLTA

SEQ ID NO: 850619 - protein, 9 aa, Homo Sapiens
GEDDDDVET

SEQ ID NO: 850620 - protein, 9 aa, Homo Sapiens
DLLPNSTLS

SEQ ID NO: 850621 - protein, 9 aa, Homo Sapiens
HTNLTLLQV

SEQ ID NO: 850622 - protein, 9 aa, Homo Sapiens
DCVLKVIAF

SEQ ID NO: 850623 - protein, 9 aa, Homo Sapiens
ASTLAHLDL

SEQ ID NO: 850624 - protein, 9 aa, Homo Sapiens
WDVWEKNSS

SEQ ID NO: 850625 - protein, 9 aa, Homo Sapiens
IIRAYTEDQ

SEQ ID NO: 850626 - protein, 9 aa, Homo Sapiens
MENYQDAME

SEQ ID NO: 850627 - protein, 9 aa, Homo Sapiens
LTYPILQAM

SEQ ID NO: 850628 - protein, 9 aa, Homo Sapiens
ALARIADSC

SEQ ID NO: 850629 - protein, 9 aa, Homo Sapiens
QEKALWRLH

SEQ ID NO: 850630 - protein, 9 aa, Homo Sapiens
EEAHPSNVK

SEQ ID NO: 850631 - protein, 9 aa, Homo Sapiens
SRLYVGRDK

SEQ ID NO: 850632 - protein, 9 aa, Homo Sapiens
RTLSLVLVL

SEQ ID NO: 850633 - protein, 9 aa, Homo Sapiens
KRLNATHCQ

SEQ ID NO: 850634 - protein, 9 aa, Homo Sapiens
IARLMEYLD

SEQ ID NO: 850635 - protein, 9 aa, Homo Sapiens
FIAKETTIF

SEQ ID NO: 850636 - protein, 9 aa, Homo Sapiens
LPLQSDAPK

SEQ ID NO: 850637 - protein, 9 aa, Homo Sapiens
GVRTHSVVC

SEQ ID NO: 850638 - protein, 9 aa, Homo Sapiens
LLILREIVI

SEQ ID NO: 850639 - protein, 9 aa, Homo Sapiens
DLNRPEDVD

SEQ ID NO: 850640 - protein, 9 aa, Homo Sapiens
KRKKHLYDV

SEQ ID NO: 850641 - protein, 9 aa, Homo Sapiens
PNMIADTFV

SEQ ID NO: 850642 - protein, 9 aa, Homo Sapiens
DGNYIKVNL

SEQ ID NO: 850643 - protein, 9 aa, Homo Sapiens
TQSSLIYLT

SEQ ID NO: 850644 - protein, 9 aa, Homo Sapiens
IQDDWKYVV

SEQ ID NO: 850645 - protein, 9 aa, Homo Sapiens
ASVYSLFLL

SEQ ID NO: 850646 - protein, 9 aa, Homo Sapiens
VGVPEDMRC

SEQ ID NO: 850647 - protein, 9 aa, Homo Sapiens
YTISMPSDS

SEQ ID NO: 850648 - protein, 9 aa, Homo Sapiens
KIQQIEQDR

SEQ ID NO: 850649 - protein, 9 aa, Homo Sapiens
SFQGLTSLC

SEQ ID NO: 850650 - protein, 9 aa, Homo Sapiens
NGLQQVLDN

SEQ ID NO: 850651 - protein, 9 aa, Homo Sapiens
CSGTLVMIV

SEQ ID NO: 850652 - protein, 9 aa, Homo Sapiens
GNKCVLNFP

SEQ ID NO: 850653 - protein, 9 aa, Homo Sapiens
DDRTETYVR

SEQ ID NO: 850654 - protein, 9 aa, Homo Sapiens
LEKMNVNIP

SEQ ID NO: 850655 - protein, 9 aa, Homo Sapiens
KYYQILIDK

SEQ ID NO: 850656 - protein, 9 aa, Homo Sapiens
VHFKVSAQV

SEQ ID NO: 850657 - protein, 9 aa, Homo Sapiens
EARIHKEEE

SEQ ID NO: 850658 - protein, 9 aa, Homo Sapiens
VYVINWFMF

SEQ ID NO: 850659 - protein, 9 aa, Homo Sapiens
KGEIEDLAL

SEQ ID NO: 850660 - protein, 9 aa, Homo Sapiens
SIGEGRFCR

SEQ ID NO: 850661 - protein, 9 aa, Homo Sapiens
VLFELAHYH

SEQ ID NO: 850662 - protein, 9 aa, Homo Sapiens
TAAPDLKVK

SEQ ID NO: 850663 - protein, 9 aa, Homo Sapiens
PMKKAQNDE

SEQ ID NO: 850664 - protein, 9 aa, Homo Sapiens
KSALIVHQI

SEQ ID NO: 850665 - protein, 9 aa, Homo Sapiens
IRLVRWLRR

SEQ ID NO: 850666 - protein, 9 aa, Homo Sapiens
CQKLVHRDI

SEQ ID NO: 850667 - protein, 9 aa, Homo Sapiens
ILLRAGTGF

SEQ ID NO: 850668 - protein, 9 aa, Homo Sapiens
SELPLKLEA

SEQ ID NO: 850669 - protein, 9 aa, Homo Sapiens
LSGCSWITV

SEQ ID NO: 850670 - protein, 9 aa, Homo Sapiens
VWAYIRHLN

SEQ ID NO: 850671 - protein, 9 aa, Homo Sapiens
PGPHRLRRT

SEQ ID NO: 850672 - protein, 9 aa, Homo Sapiens
NPLPLLPEA

SEQ ID NO: 850673 - protein, 9 aa, Homo Sapiens
NHARERLEQ

SEQ ID NO: 850674 - protein, 9 aa, Homo Sapiens
LKYHTDIVF

SEQ ID NO: 850675 - protein, 9 aa, Homo Sapiens
QEEMHHLQQ

SEQ ID NO: 850676 - protein, 9 aa, Homo Sapiens
RLIINFRKG

SEQ ID NO: 850677 - protein, 9 aa, Homo Sapiens
TKVVLTDPE

SEQ ID NO: 850678 - protein, 9 aa, Homo Sapiens
AQGADRVSE

SEQ ID NO: 850679 - protein, 9 aa, Homo Sapiens
WKAKFLPRG

SEQ ID NO: 850680 - protein, 9 aa, Homo Sapiens
CVELEAVSE

SEQ ID NO: 850681 - protein, 9 aa, Homo Sapiens
INNLVKHVK

SEQ ID NO: 850682 - protein, 9 aa, Homo Sapiens
IAVLAAAVF

SEQ ID NO: 850683 - protein, 9 aa, Homo Sapiens
QAWTPPTDG

SEQ ID NO: 850684 - protein, 9 aa, Homo Sapiens
FYSMTRPAS

SEQ ID NO: 850685 - protein, 9 aa, Homo Sapiens
VCTTIQVQS

SEQ ID NO: 850686 - protein, 9 aa, Homo Sapiens
KQFFNRALK

SEQ ID NO: 850687 - protein, 9 aa, Homo Sapiens
IQNQLRRNL

SEQ ID NO: 850688 - protein, 9 aa, Homo Sapiens
KRKHDEDRR

SEQ ID NO: 850689 - protein, 9 aa, Homo Sapiens
FGGFSLFFF

SEQ ID NO: 850690 - protein, 9 aa, Homo Sapiens
CYVFTGELE

SEQ ID NO: 850691 - protein, 9 aa, Homo Sapiens
WTDKAVNPI

SEQ ID NO: 850692 - protein, 9 aa, Homo Sapiens
KEVRKNVQK

SEQ ID NO: 850693 - protein, 9 aa, Homo Sapiens
LHNGKSGRE

SEQ ID NO: 850694 - protein, 9 aa, Homo Sapiens
KEHTLQVLG

SEQ ID NO: 850695 - protein, 9 aa, Homo Sapiens
LLDTFEWEK

SEQ ID NO: 850696 - protein, 9 aa, Homo Sapiens
HAPGVGLVT

SEQ ID NO: 850697 - protein, 9 aa, Homo Sapiens
AYSCASKHA

SEQ ID NO: 850698 - protein, 9 aa, Homo Sapiens
YALFVRDNN

SEQ ID NO: 850699 - protein, 9 aa, Homo Sapiens
TIIGIIYIL

SEQ ID NO: 850700 - protein, 9 aa, Homo Sapiens
DVVEKLYIQ

SEQ ID NO: 850701 - protein, 9 aa, Homo Sapiens
NVDHILDRS

SEQ ID NO: 850702 - protein, 9 aa, Homo Sapiens
ECIKMPYSP

SEQ ID NO: 850703 - protein, 9 aa, Homo Sapiens
VSIILLTLM

SEQ ID NO: 850704 - protein, 9 aa, Homo Sapiens
SNFKDLQTL

SEQ ID NO: 850705 - protein, 9 aa, Homo Sapiens
ACNNLPGSF

SEQ ID NO: 850706 - protein, 9 aa, Homo Sapiens
AKTGCVYLT

SEQ ID NO: 850707 - protein, 9 aa, Homo Sapiens
NNEAVILRE

SEQ ID NO: 850708 - protein, 9 aa, Homo Sapiens
VSSLPLKMN

SEQ ID NO: 850709 - protein, 9 aa, Homo Sapiens
FEPNTFRDS

SEQ ID NO: 850710 - protein, 9 aa, Homo Sapiens
HEYLKLDKW

SEQ ID NO: 850711 - protein, 9 aa, Homo Sapiens
LQSFNHEQT

SEQ ID NO: 850712 - protein, 9 aa, Homo Sapiens
MKVKYQSLN

SEQ ID NO: 850713 - protein, 9 aa, Homo Sapiens
DGDYMEIFM

SEQ ID NO: 850714 - protein, 9 aa, Homo Sapiens
KCQGSAQRL

SEQ ID NO: 850715 - protein, 9 aa, Homo Sapiens
SHGALSPSG

SEQ ID NO: 850716 - protein, 9 aa, Homo Sapiens
IIHPHLSTK

SEQ ID NO: 850717 - protein, 9 aa, Homo Sapiens
KQRYKMVIA

SEQ ID NO: 850718 - protein, 9 aa, Homo Sapiens
PIHSSDFVK

SEQ ID NO: 850719 - protein, 9 aa, Homo Sapiens
LHAENLWPG

SEQ ID NO: 850720 - protein, 9 aa, Homo Sapiens
EAFPISHVR

SEQ ID NO: 850721 - protein, 9 aa, Homo Sapiens
YEATIAAME

SEQ ID NO: 850722 - protein, 9 aa, Homo Sapiens
KEESKLLKK

SEQ ID NO: 850723 - protein, 9 aa, Homo Sapiens
TSDNNELWK

SEQ ID NO: 850724 - protein, 9 aa, Homo Sapiens
CHEQCEAKN

SEQ ID NO: 850725 - protein, 9 aa, Homo Sapiens
LRHSSAKVW

SEQ ID NO: 850726 - protein, 9 aa, Homo Sapiens
PGARKMKER

SEQ ID NO: 850727 - protein, 9 aa, Homo Sapiens
RRMKSDSFI

SEQ ID NO: 850728 - protein, 9 aa, Homo Sapiens
PNITPVPLL

SEQ ID NO: 850729 - protein, 9 aa, Homo Sapiens
GMDIEEVKK

SEQ ID NO: 850730 - protein, 9 aa, Homo Sapiens
NKLQNTMKL

SEQ ID NO: 850731 - protein, 9 aa, Homo Sapiens
CYNYSENCG

SEQ ID NO: 850732 - protein, 9 aa, Homo Sapiens
ALYSVPHNH

SEQ ID NO: 850733 - protein, 9 aa, Homo Sapiens
NYKAPAPVT

SEQ ID NO: 850734 - protein, 9 aa, Homo Sapiens
NKDLTSRLM

SEQ ID NO: 850735 - protein, 9 aa, Homo Sapiens
KETQVPAYL

SEQ ID NO: 850736 - protein, 9 aa, Homo Sapiens
RNKPIVPEH

SEQ ID NO: 850737 - protein, 9 aa, Homo Sapiens
VVHKEPTYG

SEQ ID NO: 850738 - protein, 9 aa, Homo Sapiens
ELLDKNTFE

SEQ ID NO: 850739 - protein, 9 aa, Homo Sapiens
FSEITFFSP

SEQ ID NO: 850740 - protein, 9 aa, Homo Sapiens
FGNRIKRVQ

SEQ ID NO: 850741 - protein, 9 aa, Homo Sapiens
KVKKSAVVY

SEQ ID NO: 850742 - protein, 9 aa, Homo Sapiens
HARKKLRSS

SEQ ID NO: 850743 - protein, 9 aa, Homo Sapiens
LENNPSLGW

SEQ ID NO: 850744 - protein, 9 aa, Homo Sapiens
MWWMLAWEV

SEQ ID NO: 850745 - protein, 9 aa, Homo Sapiens
KQYKEAIHA

SEQ ID NO: 850746 - protein, 9 aa, Homo Sapiens
YQNHSSTSS

SEQ ID NO: 850747 - protein, 9 aa, Homo Sapiens
ENVPLLVPL

SEQ ID NO: 850748 - protein, 9 aa, Homo Sapiens
KQQNLNKEK

SEQ ID NO: 850749 - protein, 9 aa, Homo Sapiens
HPEEQQKVI

SEQ ID NO: 850750 - protein, 9 aa, Homo Sapiens
QAKCKASYH

SEQ ID NO: 850751 - protein, 9 aa, Homo Sapiens
LFWDELWKL

SEQ ID NO: 850752 - protein, 9 aa, Homo Sapiens
SVQTPVPSH

SEQ ID NO: 850753 - protein, 9 aa, Homo Sapiens
KTSDSTLLV

SEQ ID NO: 850754 - protein, 9 aa, Homo Sapiens
GIVQEDAQP

SEQ ID NO: 850755 - protein, 9 aa, Homo Sapiens
AYRGSYHLD

SEQ ID NO: 850756 - protein, 9 aa, Homo Sapiens
GKFSEITFF

SEQ ID NO: 850757 - protein, 9 aa, Homo Sapiens
NKGTSLAEI

SEQ ID NO: 850758 - protein, 9 aa, Homo Sapiens
KVYFKQFCI

SEQ ID NO: 850759 - protein, 9 aa, Homo Sapiens
TMLITCLQS

SEQ ID NO: 850760 - protein, 9 aa, Homo Sapiens
LRPPGILKN

SEQ ID NO: 850761 - protein, 9 aa, Homo Sapiens
TAESLFYKG

SEQ ID NO: 850762 - protein, 9 aa, Homo Sapiens
GPGRKWDFS

SEQ ID NO: 850763 - protein, 9 aa, Homo Sapiens
MTAVVRLNK

SEQ ID NO: 850764 - protein, 9 aa, Homo Sapiens
EAHNLIPMD

SEQ ID NO: 850765 - protein, 9 aa, Homo Sapiens
NVGEKKDQQ

SEQ ID NO: 850766 - protein, 9 aa, Homo Sapiens
RKLIKKKRN

SEQ ID NO: 850767 - protein, 9 aa, Homo Sapiens
AGLAVIMGC

SEQ ID NO: 850768 - protein, 9 aa, Homo Sapiens
TFSHPSSFQ

SEQ ID NO: 850769 - protein, 9 aa, Homo Sapiens
VGYRISHMW

SEQ ID NO: 850770 - protein, 9 aa, Homo Sapiens
YPTSKDPQS

SEQ ID NO: 850771 - protein, 9 aa, Homo Sapiens
EDKLFVETG

SEQ ID NO: 850772 - protein, 9 aa, Homo Sapiens
HQKFLGSKR

SEQ ID NO: 850773 - protein, 9 aa, Homo Sapiens
HIGSIINYM

SEQ ID NO: 850774 - protein, 9 aa, Homo Sapiens
RKMCSKKED

SEQ ID NO: 850775 - protein, 9 aa, Homo Sapiens
SFVAVLTQE

SEQ ID NO: 850776 - protein, 9 aa, Homo Sapiens
ETNRKLYCQ

SEQ ID NO: 850777 - protein, 9 aa, Homo Sapiens
NLRLDLCCL

SEQ ID NO: 850778 - protein, 9 aa, Homo Sapiens
IIGIPEQAL

SEQ ID NO: 850779 - protein, 9 aa, Homo Sapiens
YTVIAPKML

SEQ ID NO: 850780 - protein, 9 aa, Homo Sapiens
IITNWDYME

SEQ ID NO: 850781 - protein, 9 aa, Homo Sapiens
QISAISVAE

SEQ ID NO: 850782 - protein, 9 aa, Homo Sapiens
LRSAGDHAH

SEQ ID NO: 850783 - protein, 9 aa, Homo Sapiens
TKLYQYLLQ

SEQ ID NO: 850784 - protein, 9 aa, Homo Sapiens
YFTWAGFKY

SEQ ID NO: 850785 - protein, 9 aa, Homo Sapiens
SLAFLDTAL

SEQ ID NO: 850786 - protein, 9 aa, Homo Sapiens
AELLIKMKG

SEQ ID NO: 850787 - protein, 9 aa, Homo Sapiens
GEYFLFTFH

SEQ ID NO: 850788 - protein, 9 aa, Homo Sapiens
MRELINIPL

SEQ ID NO: 850789 - protein, 9 aa, Homo Sapiens
LLLRKILLQ

SEQ ID NO: 850790 - protein, 9 aa, Homo Sapiens
KNYLNSGQG

SEQ ID NO: 850791 - protein, 9 aa, Homo Sapiens
KKSTFEDSE

SEQ ID NO: 850792 - protein, 9 aa, Homo Sapiens
HSVVCMTNH

SEQ ID NO: 850793 - protein, 9 aa, Homo Sapiens
DLFNAILIK

SEQ ID NO: 850794 - protein, 9 aa, Homo Sapiens
KKAVLKLRY

SEQ ID NO: 850795 - protein, 9 aa, Homo Sapiens
STNFITYDN

SEQ ID NO: 850796 - protein, 9 aa, Homo Sapiens
KEEHEEELR

SEQ ID NO: 850797 - protein, 9 aa, Homo Sapiens
VEHRGWGLL

SEQ ID NO: 850798 - protein, 9 aa, Homo Sapiens
LGTASPSPG

SEQ ID NO: 850799 - protein, 9 aa, Homo Sapiens
VTRRRVRTL

SEQ ID NO: 850800 - protein, 9 aa, Homo Sapiens
LDILEQEYN

SEQ ID NO: 850801 - protein, 9 aa, Homo Sapiens
EESFMTSRK

SEQ ID NO: 850802 - protein, 9 aa, Homo Sapiens
IVETEHLEE

SEQ ID NO: 850803 - protein, 9 aa, Homo Sapiens
RQRAPPWQE

SEQ ID NO: 850804 - protein, 9 aa, Homo Sapiens
QKIQMKGSL

SEQ ID NO: 850805 - protein, 9 aa, Homo Sapiens
EVVAGAFSR

SEQ ID NO: 850806 - protein, 9 aa, Homo Sapiens
QRLAHISTN

SEQ ID NO: 850807 - protein, 9 aa, Homo Sapiens
GNSCPPKTY

SEQ ID NO: 850808 - protein, 9 aa, Homo Sapiens
QSSTPTFII

SEQ ID NO: 850809 - protein, 9 aa, Homo Sapiens
YEDTNFQHM

SEQ ID NO: 850810 - protein, 9 aa, Homo Sapiens
VLSGCSEQQ

SEQ ID NO: 850811 - protein, 9 aa, Homo Sapiens
DFSRLSDDP

SEQ ID NO: 850812 - protein, 9 aa, Homo Sapiens
KAQHLLKLT

SEQ ID NO: 850813 - protein, 9 aa, Homo Sapiens
RKIILCPLD

SEQ ID NO: 850814 - protein, 9 aa, Homo Sapiens
AWPPKEHAR

SEQ ID NO: 850815 - protein, 9 aa, Homo Sapiens
VLCYAARVN

SEQ ID NO: 850816 - protein, 9 aa, Homo Sapiens
KEYAHTLTC

SEQ ID NO: 850817 - protein, 9 aa, Homo Sapiens
MRNHIAASK

SEQ ID NO: 850818 - protein, 9 aa, Homo Sapiens
YCDAKSWTQ

SEQ ID NO: 850819 - protein, 9 aa, Homo Sapiens
KKHWFVLAN

SEQ ID NO: 850820 - protein, 9 aa, Homo Sapiens
FNGNYIKTP

SEQ ID NO: 850821 - protein, 9 aa, Homo Sapiens
ACFVNKQHK

SEQ ID NO: 850822 - protein, 9 aa, Homo Sapiens
HNQIDLMDM

SEQ ID NO: 850823 - protein, 9 aa, Homo Sapiens
HVLLSLLDK

SEQ ID NO: 850824 - protein, 9 aa, Homo Sapiens
DTKTMYAMK

SEQ ID NO: 850825 - protein, 9 aa, Homo Sapiens
IGLVMLGKV

SEQ ID NO: 850826 - protein, 9 aa, Homo Sapiens
KNKKSKPIL

SEQ ID NO: 850827 - protein, 9 aa, Homo Sapiens
IQTSILRDA

SEQ ID NO: 850828 - protein, 9 aa, Homo Sapiens
TKVQKQQKQ

SEQ ID NO: 850829 - protein, 9 aa, Homo Sapiens
AAKKYNLRV

SEQ ID NO: 850830 - protein, 9 aa, Homo Sapiens
RLGIIYRYL

SEQ ID NO: 850831 - protein, 9 aa, Homo Sapiens
DSKSPDVSK

SEQ ID NO: 850832 - protein, 9 aa, Homo Sapiens
LWSEGKGRV

SEQ ID NO: 850833 - protein, 9 aa, Homo Sapiens
KVKVNCSDR

SEQ ID NO: 850834 - protein, 9 aa, Homo Sapiens
AVFRRPHDP

SEQ ID NO: 850835 - protein, 9 aa, Homo Sapiens
QIKIEQIKC

SEQ ID NO: 850836 - protein, 9 aa, Homo Sapiens
AVNNTKPGQ

SEQ ID NO: 850837 - protein, 9 aa, Homo Sapiens
EKLFQRLIH

SEQ ID NO: 850838 - protein, 9 aa, Homo Sapiens
VMFVAGMFV

SEQ ID NO: 850839 - protein, 9 aa, Homo Sapiens
YHLAVKAYT

SEQ ID NO: 850840 - protein, 9 aa, Homo Sapiens
GQYICKDLK

SEQ ID NO: 850841 - protein, 9 aa, Homo Sapiens
RLFIPVTLS

SEQ ID NO: 850842 - protein, 9 aa, Homo Sapiens
YSAKAVDVL

SEQ ID NO: 850843 - protein, 9 aa, Homo Sapiens
SIWDLLLNV

SEQ ID NO: 850844 - protein, 9 aa, Homo Sapiens
DNWLQPTAE

SEQ ID NO: 850845 - protein, 9 aa, Homo Sapiens
VNQSILTPL

SEQ ID NO: 850846 - protein, 9 aa, Homo Sapiens
QMLSDLNCV

SEQ ID NO: 850847 - protein, 9 aa, Homo Sapiens
NGPVGAVQI

SEQ ID NO: 850848 - protein, 9 aa, Homo Sapiens
RMVTNTIED

SEQ ID NO: 850849 - protein, 9 aa, Homo Sapiens
SEIKLKMNY

SEQ ID NO: 850850 - protein, 9 aa, Homo Sapiens
FNPIVGKWS

SEQ ID NO: 850851 - protein, 9 aa, Homo Sapiens
TKTFLVFQD

SEQ ID NO: 850852 - protein, 9 aa, Homo Sapiens
LFETQGNDR

SEQ ID NO: 850853 - protein, 9 aa, Homo Sapiens
LQQEMAIAV

SEQ ID NO: 850854 - protein, 9 aa, Homo Sapiens
TVLMQEYEE

SEQ ID NO: 850855 - protein, 9 aa, Homo Sapiens
ISAPFLLFF

SEQ ID NO: 850856 - protein, 9 aa, Homo Sapiens
TKTRQRVED

SEQ ID NO: 850857 - protein, 9 aa, Homo Sapiens
RKRPFPDET

SEQ ID NO: 850858 - protein, 9 aa, Homo Sapiens
AEAKARAEA

SEQ ID NO: 850859 - protein, 9 aa, Homo Sapiens
HLPAGFLYL

SEQ ID NO: 850860 - protein, 9 aa, Homo Sapiens
FDGLLTLRS

SEQ ID NO: 850861 - protein, 9 aa, Homo Sapiens
SFQINQLLQ

SEQ ID NO: 850862 - protein, 9 aa, Homo Sapiens
NQNGFNRSY

SEQ ID NO: 850863 - protein, 9 aa, Homo Sapiens
SKINEGYFC

SEQ ID NO: 850864 - protein, 9 aa, Homo Sapiens
LDTFEWEKG

SEQ ID NO: 850865 - protein, 9 aa, Homo Sapiens
GSMRIGKYF

SEQ ID NO: 850866 - protein, 9 aa, Homo Sapiens
GFTNYIQAL

SEQ ID NO: 850867 - protein, 9 aa, Homo Sapiens
SQLQKLCWE

SEQ ID NO: 850868 - protein, 9 aa, Homo Sapiens
SRLYKWIPQ

SEQ ID NO: 850869 - protein, 9 aa, Homo Sapiens
RRMPGGGYP

SEQ ID NO: 850870 - protein, 9 aa, Homo Sapiens
ELDKITRKP

SEQ ID NO: 850871 - protein, 9 aa, Homo Sapiens
SFIQEMPNV

SEQ ID NO: 850872 - protein, 9 aa, Homo Sapiens
QSSLSAFPA

SEQ ID NO: 850873 - protein, 9 aa, Homo Sapiens
GQEYTPGNP

SEQ ID NO: 850874 - protein, 9 aa, Homo Sapiens
HIAVVILLF

SEQ ID NO: 850875 - protein, 9 aa, Homo Sapiens
TKTLQKKDV

SEQ ID NO: 850876 - protein, 9 aa, Homo Sapiens
YQNLVKDLC

SEQ ID NO: 850877 - protein, 9 aa, Homo Sapiens
FVHDQGCVQ

SEQ ID NO: 850878 - protein, 9 aa, Homo Sapiens
NKKIDREQI

SEQ ID NO: 850879 - protein, 9 aa, Homo Sapiens
TVTQEQVDT

SEQ ID NO: 850880 - protein, 9 aa, Homo Sapiens
AEDDDPQIH

SEQ ID NO: 850881 - protein, 9 aa, Homo Sapiens
ELNVAHNRI

SEQ ID NO: 850882 - protein, 9 aa, Homo Sapiens
MECYNIYSK

SEQ ID NO: 850883 - protein, 9 aa, Homo Sapiens
FFDLMTLFE

SEQ ID NO: 850884 - protein, 9 aa, Homo Sapiens
CDEAIYQRG

SEQ ID NO: 850885 - protein, 9 aa, Homo Sapiens
EDESGINFL

SEQ ID NO: 850886 - protein, 9 aa, Homo Sapiens
VTVVDYGKL

SEQ ID NO: 850887 - protein, 9 aa, Homo Sapiens
NGNKCSHFF

SEQ ID NO: 850888 - protein, 9 aa, Homo Sapiens
KLPGKRYVA

SEQ ID NO: 850889 - protein, 9 aa, Homo Sapiens
LTLGRSPIN

SEQ ID NO: 850890 - protein, 9 aa, Homo Sapiens
NPIIYGLFN

SEQ ID NO: 850891 - protein, 9 aa, Homo Sapiens
TSYYGNQCN

SEQ ID NO: 850892 - protein, 9 aa, Homo Sapiens
IQIEFINEK

SEQ ID NO: 850893 - protein, 9 aa, Homo Sapiens
AFFYWRSKS

SEQ ID NO: 850894 - protein, 9 aa, Homo Sapiens
EKLLQRIKD

SEQ ID NO: 850895 - protein, 9 aa, Homo Sapiens
PGIKIISGC

SEQ ID NO: 850896 - protein, 9 aa, Homo Sapiens
VSDSLLLGK

SEQ ID NO: 850897 - protein, 9 aa, Homo Sapiens
SYGNIISNI

SEQ ID NO: 850898 - protein, 9 aa, Homo Sapiens
QPGTLGEIW

SEQ ID NO: 850899 - protein, 9 aa, Homo Sapiens
LSYSFVQYS

SEQ ID NO: 850900 - protein, 9 aa, Homo Sapiens
FAIALSSFN

SEQ ID NO: 850901 - protein, 9 aa, Homo Sapiens
AHILKARKA

SEQ ID NO: 850902 - protein, 9 aa, Homo Sapiens
SKRPKSNQY

SEQ ID NO: 850903 - protein, 9 aa, Homo Sapiens
CLADINYEG

SEQ ID NO: 850904 - protein, 9 aa, Homo Sapiens
LVDSSDHDP

SEQ ID NO: 850905 - protein, 9 aa, Homo Sapiens
SPKNKLGVS

SEQ ID NO: 850906 - protein, 9 aa, Homo Sapiens
SLLDTFEWE

SEQ ID NO: 850907 - protein, 9 aa, Homo Sapiens
KTVIIEETG

SEQ ID NO: 850908 - protein, 9 aa, Homo Sapiens
GNSKYQNWR

SEQ ID NO: 850909 - protein, 9 aa, Homo Sapiens
AAPTPTNAT

SEQ ID NO: 850910 - protein, 9 aa, Homo Sapiens
KSIWKAKFL

SEQ ID NO: 850911 - protein, 9 aa, Homo Sapiens
ISLICAYRV

SEQ ID NO: 850912 - protein, 9 aa, Homo Sapiens
AAYTTSIPR

SEQ ID NO: 850913 - protein, 9 aa, Homo Sapiens
AIIMFPPDC

SEQ ID NO: 850914 - protein, 9 aa, Homo Sapiens
IKGVNMVLP

SEQ ID NO: 850915 - protein, 9 aa, Homo Sapiens
YQSNRDELQ

SEQ ID NO: 850916 - protein, 9 aa, Homo Sapiens
DPLALTSTS

SEQ ID NO: 850917 - protein, 9 aa, Homo Sapiens
YPVCTVWYF

SEQ ID NO: 850918 - protein, 9 aa, Homo Sapiens
HVVRRQIGE

SEQ ID NO: 850919 - protein, 9 aa, Homo Sapiens
EWTDKAVNP

SEQ ID NO: 850920 - protein, 9 aa, Homo Sapiens
DSAPNSDEG

SEQ ID NO: 850921 - protein, 9 aa, Homo Sapiens
SRGQEIEAI

SEQ ID NO: 850922 - protein, 9 aa, Homo Sapiens
TRRQKIEMW

SEQ ID NO: 850923 - protein, 9 aa, Homo Sapiens
GKNGSQSVI

SEQ ID NO: 850924 - protein, 9 aa, Homo Sapiens
EVKEKITFQ

SEQ ID NO: 850925 - protein, 9 aa, Homo Sapiens
IIKTYREIV

SEQ ID NO: 850926 - protein, 9 aa, Homo Sapiens
PYDVVHCWY

SEQ ID NO: 850927 - protein, 9 aa, Homo Sapiens
DSHVNPKKQ

SEQ ID NO: 850928 - protein, 9 aa, Homo Sapiens
NRSAPQTLE

SEQ ID NO: 850929 - protein, 9 aa, Homo Sapiens
ALRREVIML

SEQ ID NO: 850930 - protein, 9 aa, Homo Sapiens
VIHFPHPNV

SEQ ID NO: 850931 - protein, 9 aa, Homo Sapiens
LEVQRQKGL

SEQ ID NO: 850932 - protein, 9 aa, Homo Sapiens
TPTTFSTSG

SEQ ID NO: 850933 - protein, 9 aa, Homo Sapiens
STHASLYFA

SEQ ID NO: 850934 - protein, 9 aa, Homo Sapiens
NMNRYSTFI

SEQ ID NO: 850935 - protein, 9 aa, Homo Sapiens
FCKEAKLEM

SEQ ID NO: 850936 - protein, 9 aa, Homo Sapiens
YPKRSGRSC

SEQ ID NO: 850937 - protein, 9 aa, Homo Sapiens
PESMDNFIL

SEQ ID NO: 850938 - protein, 9 aa, Homo Sapiens
LMAQQELDH

SEQ ID NO: 850939 - protein, 9 aa, Homo Sapiens
LYYFRNHET

SEQ ID NO: 850940 - protein, 9 aa, Homo Sapiens
EIGPRCVLN

SEQ ID NO: 850941 - protein, 9 aa, Homo Sapiens
ETGKLQAYA

SEQ ID NO: 850942 - protein, 9 aa, Homo Sapiens
KGELLLNEL

SEQ ID NO: 850943 - protein, 9 aa, Homo Sapiens
GALNKCKPN

SEQ ID NO: 850944 - protein, 9 aa, Homo Sapiens
SQHAAKCIP

SEQ ID NO: 850945 - protein, 9 aa, Homo Sapiens
KTHASAPVK

SEQ ID NO: 850946 - protein, 9 aa, Homo Sapiens
NKMDGASGV

SEQ ID NO: 850947 - protein, 9 aa, Homo Sapiens
SEPTFAARP

SEQ ID NO: 850948 - protein, 9 aa, Homo Sapiens
GPDCQPVCS

SEQ ID NO: 850949 - protein, 9 aa, Homo Sapiens
EGYRHISAL

SEQ ID NO: 850950 - protein, 9 aa, Homo Sapiens
NKLEKRDEQ

SEQ ID NO: 850951 - protein, 9 aa, Homo Sapiens
DKFLTCDEY

SEQ ID NO: 850952 - protein, 9 aa, Homo Sapiens
FMSGQKKEL

SEQ ID NO: 850953 - protein, 9 aa, Homo Sapiens
RAVLCCQKQ

SEQ ID NO: 850954 - protein, 9 aa, Homo Sapiens
SISKEDILE

SEQ ID NO: 850955 - protein, 9 aa, Homo Sapiens
YEIRNCWSP

SEQ ID NO: 850956 - protein, 9 aa, Homo Sapiens
INHDTGECW

SEQ ID NO: 850957 - protein, 9 aa, Homo Sapiens
AEELTLEQA

SEQ ID NO: 850958 - protein, 9 aa, Homo Sapiens
PAYFNESQR

SEQ ID NO: 850959 - protein, 9 aa, Homo Sapiens
YLIHLQLFK

SEQ ID NO: 850960 - protein, 9 aa, Homo Sapiens
EECGKTFSQ

SEQ ID NO: 850961 - protein, 9 aa, Homo Sapiens
PPRFLQINP

SEQ ID NO: 850962 - protein, 9 aa, Homo Sapiens
RGGHLTIHL

SEQ ID NO: 850963 - protein, 9 aa, Homo Sapiens
CRRYLVMQK

SEQ ID NO: 850964 - protein, 9 aa, Homo Sapiens
YLRSGTKLI

SEQ ID NO: 850965 - protein, 9 aa, Homo Sapiens
RAGIVQEDA

SEQ ID NO: 850966 - protein, 9 aa, Homo Sapiens
CSVTRIKKR

SEQ ID NO: 850967 - protein, 9 aa, Homo Sapiens
RRQRAPPWQ

SEQ ID NO: 850968 - protein, 9 aa, Homo Sapiens
VRVNYLTHM

SEQ ID NO: 850969 - protein, 9 aa, Homo Sapiens
QISLAEMLE

SEQ ID NO: 850970 - protein, 9 aa, Homo Sapiens
EEDKEKEEK

SEQ ID NO: 850971 - protein, 9 aa, Homo Sapiens
KKMSLRSQI

SEQ ID NO: 850972 - protein, 9 aa, Homo Sapiens
MGPPARKEK

SEQ ID NO: 850973 - protein, 9 aa, Homo Sapiens
REPRFVEDL

SEQ ID NO: 850974 - protein, 9 aa, Homo Sapiens
GAWKKLDRN

SEQ ID NO: 850975 - protein, 9 aa, Homo Sapiens
TVLQLSLII

SEQ ID NO: 850976 - protein, 9 aa, Homo Sapiens
NRYGYPEGK

SEQ ID NO: 850977 - protein, 9 aa, Homo Sapiens
PNVIDHLSC

SEQ ID NO: 850978 - protein, 9 aa, Homo Sapiens
KLRKKSITN

SEQ ID NO: 850979 - protein, 9 aa, Homo Sapiens
CRKNRDKVI

SEQ ID NO: 850980 - protein, 9 aa, Homo Sapiens
VVKLTEELL

SEQ ID NO: 850981 - protein, 9 aa, Homo Sapiens
KLYCSELHG

SEQ ID NO: 850982 - protein, 9 aa, Homo Sapiens
QQNLNKEKG

SEQ ID NO: 850983 - protein, 9 aa, Homo Sapiens
TIPGYKPMH

SEQ ID NO: 850984 - protein, 9 aa, Homo Sapiens
ANDVSMIKM

SEQ ID NO: 850985 - protein, 9 aa, Homo Sapiens
ASKINDDYS

SEQ ID NO: 850986 - protein, 9 aa, Homo Sapiens
SFQVASQNV

SEQ ID NO: 850987 - protein, 9 aa, Homo Sapiens
QFVDEEEET

SEQ ID NO: 850988 - protein, 9 aa, Homo Sapiens
LTLDNLILN

SEQ ID NO: 850989 - protein, 9 aa, Homo Sapiens
SYAPAEYSS

SEQ ID NO: 850990 - protein, 9 aa, Homo Sapiens
HCGHPILQV

SEQ ID NO: 850991 - protein, 9 aa, Homo Sapiens
HYLTPQSVL

SEQ ID NO: 850992 - protein, 9 aa, Homo Sapiens
LLQLLADHA

SEQ ID NO: 850993 - protein, 9 aa, Homo Sapiens
QRGATLGEE

SEQ ID NO: 850994 - protein, 9 aa, Homo Sapiens
MRLGGSEGP

SEQ ID NO: 850995 - protein, 9 aa, Homo Sapiens
AMQKRSTTK

SEQ ID NO: 850996 - protein, 9 aa, Homo Sapiens
ECPIKEAVL

SEQ ID NO: 850997 - protein, 9 aa, Homo Sapiens
LQKFQTEGN

SEQ ID NO: 850998 - protein, 9 aa, Homo Sapiens
MTRGHLAKA

SEQ ID NO: 850999 - protein, 9 aa, Homo Sapiens
SWLQDGLKP

SEQ ID NO: 851000 - protein, 9 aa, Homo Sapiens
MAKQFAVSS

SEQ ID NO: 851001 - protein, 9 aa, Homo Sapiens
KYSSHSGRS

SEQ ID NO: 851002 - protein, 9 aa, Homo Sapiens
EDVKLEDED

SEQ ID NO: 851003 - protein, 9 aa, Homo Sapiens
EDLGEEEDK

SEQ ID NO: 851004 - protein, 9 aa, Homo Sapiens
SSVHGSDGH

SEQ ID NO: 851005 - protein, 9 aa, Homo Sapiens
VPILRVLNL

SEQ ID NO: 851006 - protein, 9 aa, Homo Sapiens
ALVVLIITC

SEQ ID NO: 851007 - protein, 9 aa, Homo Sapiens
NLSMFLIKC

SEQ ID NO: 851008 - protein, 9 aa, Homo Sapiens
VLQISVADE

SEQ ID NO: 851009 - protein, 9 aa, Homo Sapiens
KKMDNLLRG

SEQ ID NO: 851010 - protein, 9 aa, Homo Sapiens
GRLERTLDD

SEQ ID NO: 851011 - protein, 9 aa, Homo Sapiens
AIKLFKDEF

SEQ ID NO: 851012 - protein, 9 aa, Homo Sapiens
CKLLLAHLK

SEQ ID NO: 851013 - protein, 9 aa, Homo Sapiens
PLFEGITLD

SEQ ID NO: 851014 - protein, 9 aa, Homo Sapiens
FLASIFHLA

SEQ ID NO: 851015 - protein, 9 aa, Homo Sapiens
TNEPTAAAM

SEQ ID NO: 851016 - protein, 9 aa, Homo Sapiens
TIPKGKAGT

SEQ ID NO: 851017 - protein, 9 aa, Homo Sapiens
VVSLFFGTY

SEQ ID NO: 851018 - protein, 9 aa, Homo Sapiens
PTGNVWWQK

SEQ ID NO: 851019 - protein, 9 aa, Homo Sapiens
AKHMETKGA

SEQ ID NO: 851020 - protein, 9 aa, Homo Sapiens
KTSRHKELF

SEQ ID NO: 851021 - protein, 9 aa, Homo Sapiens
LIQLRKELH

SEQ ID NO: 851022 - protein, 9 aa, Homo Sapiens
NFLEFAELD

SEQ ID NO: 851023 - protein, 9 aa, Homo Sapiens
IYGHKYYFT

SEQ ID NO: 851024 - protein, 9 aa, Homo Sapiens
YYSNFHAVK

SEQ ID NO: 851025 - protein, 9 aa, Homo Sapiens
EDCRVIPWK

SEQ ID NO: 851026 - protein, 9 aa, Homo Sapiens
KSAPIRTPA

SEQ ID NO: 851027 - protein, 9 aa, Homo Sapiens
EEDKIPNKS

SEQ ID NO: 851028 - protein, 9 aa, Homo Sapiens
VETQMKKLD

SEQ ID NO: 851029 - protein, 9 aa, Homo Sapiens
HAYGDQYRT

SEQ ID NO: 851030 - protein, 9 aa, Homo Sapiens
EPSEYPTSK

SEQ ID NO: 851031 - protein, 9 aa, Homo Sapiens
ITLLHNLLF

SEQ ID NO: 851032 - protein, 9 aa, Homo Sapiens
SKTSTELAE

SEQ ID NO: 851033 - protein, 9 aa, Homo Sapiens
GYVNYLINP

SEQ ID NO: 851034 - protein, 9 aa, Homo Sapiens
VCNPGQGLG

SEQ ID NO: 851035 - protein, 9 aa, Homo Sapiens
HIYLRMIKD

SEQ ID NO: 851036 - protein, 9 aa, Homo Sapiens
AGLGFKQAA

SEQ ID NO: 851037 - protein, 9 aa, Homo Sapiens
LFVTEVCRF

SEQ ID NO: 851038 - protein, 9 aa, Homo Sapiens
GHIKVVKFL

SEQ ID NO: 851039 - protein, 9 aa, Homo Sapiens
TNLTDNGLM

SEQ ID NO: 851040 - protein, 9 aa, Homo Sapiens
EDSLFLISG

SEQ ID NO: 851041 - protein, 9 aa, Homo Sapiens
SLFKLCGSG

SEQ ID NO: 851042 - protein, 9 aa, Homo Sapiens
ECNGKPDSL

SEQ ID NO: 851043 - protein, 9 aa, Homo Sapiens
TPGVELTLL

SEQ ID NO: 851044 - protein, 9 aa, Homo Sapiens
NEYNNGYEI

SEQ ID NO: 851045 - protein, 9 aa, Homo Sapiens
LGVQDAVPF

SEQ ID NO: 851046 - protein, 9 aa, Homo Sapiens
YDSFLPGLE

SEQ ID NO: 851047 - protein, 9 aa, Homo Sapiens
FLLTSFSVL

SEQ ID NO: 851048 - protein, 9 aa, Homo Sapiens
TPGYLVGRN

SEQ ID NO: 851049 - protein, 9 aa, Homo Sapiens
YGYRDFGSS

SEQ ID NO: 851050 - protein, 9 aa, Homo Sapiens
HPPLSVVCR

SEQ ID NO: 851051 - protein, 9 aa, Homo Sapiens
ASYHLKITS

SEQ ID NO: 851052 - protein, 9 aa, Homo Sapiens
TTGIMNKPE

SEQ ID NO: 851053 - protein, 9 aa, Homo Sapiens
SAGRYVCEN

SEQ ID NO: 851054 - protein, 9 aa, Homo Sapiens
RSLPRVISP

SEQ ID NO: 851055 - protein, 9 aa, Homo Sapiens
NLWWVGLTE

SEQ ID NO: 851056 - protein, 9 aa, Homo Sapiens
ERNIVSRNP

SEQ ID NO: 851057 - protein, 9 aa, Homo Sapiens
GTIQLTAKY

SEQ ID NO: 851058 - protein, 9 aa, Homo Sapiens
YYLDGVSNE

SEQ ID NO: 851059 - protein, 9 aa, Homo Sapiens
LLDIAHAFT

SEQ ID NO: 851060 - protein, 9 aa, Homo Sapiens
RATTVHAVW

SEQ ID NO: 851061 - protein, 9 aa, Homo Sapiens
LEPFIYDAP

SEQ ID NO: 851062 - protein, 9 aa, Homo Sapiens
SCNSTPRLA

SEQ ID NO: 851063 - protein, 9 aa, Homo Sapiens
KWGYDVAVN

SEQ ID NO: 851064 - protein, 9 aa, Homo Sapiens
LEYLDIFGN

SEQ ID NO: 851065 - protein, 9 aa, Homo Sapiens
PKPGHRSED

SEQ ID NO: 851066 - protein, 9 aa, Homo Sapiens
TAAVAQASL

SEQ ID NO: 851067 - protein, 9 aa, Homo Sapiens
NAMLCAGIP

SEQ ID NO: 851068 - protein, 9 aa, Homo Sapiens
AKTTPPNSM

SEQ ID NO: 851069 - protein, 9 aa, Homo Sapiens
QIEQPVTQQ

SEQ ID NO: 851070 - protein, 9 aa, Homo Sapiens
VKESKVEQQ

SEQ ID NO: 851071 - protein, 9 aa, Homo Sapiens
EDLHDYVNV

SEQ ID NO: 851072 - protein, 9 aa, Homo Sapiens
SDLNRFWLE

SEQ ID NO: 851073 - protein, 9 aa, Homo Sapiens
ELERQVVDQ

SEQ ID NO: 851074 - protein, 9 aa, Homo Sapiens
TCNHALYAM

SEQ ID NO: 851075 - protein, 9 aa, Homo Sapiens
VRHPALKAN

SEQ ID NO: 851076 - protein, 9 aa, Homo Sapiens
IESSKGTNN

SEQ ID NO: 851077 - protein, 9 aa, Homo Sapiens
FEVQRYDNS

SEQ ID NO: 851078 - protein, 9 aa, Homo Sapiens
KSALGYDYK

SEQ ID NO: 851079 - protein, 9 aa, Homo Sapiens
VRGRIISGN

SEQ ID NO: 851080 - protein, 9 aa, Homo Sapiens
SSDLQHSQV

SEQ ID NO: 851081 - protein, 9 aa, Homo Sapiens
GFYPPEMYM

SEQ ID NO: 851082 - protein, 9 aa, Homo Sapiens
ASENQHPGH

SEQ ID NO: 851083 - protein, 9 aa, Homo Sapiens
KWHYNKQSL

SEQ ID NO: 851084 - protein, 9 aa, Homo Sapiens
KGEIHSDYE

SEQ ID NO: 851085 - protein, 9 aa, Homo Sapiens
LNVSKLASN

SEQ ID NO: 851086 - protein, 9 aa, Homo Sapiens
LKSDTFFRM

SEQ ID NO: 851087 - protein, 9 aa, Homo Sapiens
GEICQLLGA

SEQ ID NO: 851088 - protein, 9 aa, Homo Sapiens
YDCFIAICT

SEQ ID NO: 851089 - protein, 9 aa, Homo Sapiens
QLQIVHQPW

SEQ ID NO: 851090 - protein, 9 aa, Homo Sapiens
AAVPEPSEY

SEQ ID NO: 851091 - protein, 9 aa, Homo Sapiens
FIMGGDTEL

SEQ ID NO: 851092 - protein, 9 aa, Homo Sapiens
KKIIEEQPQ

SEQ ID NO: 851093 - protein, 9 aa, Homo Sapiens
GDTEAWTTG

SEQ ID NO: 851094 - protein, 9 aa, Homo Sapiens
EVAENQQSQ

SEQ ID NO: 851095 - protein, 9 aa, Homo Sapiens
ELAHGPDTL

SEQ ID NO: 851096 - protein, 9 aa, Homo Sapiens
DSQLQEHQI

SEQ ID NO: 851097 - protein, 9 aa, Homo Sapiens
KGQWPEGQP

SEQ ID NO: 851098 - protein, 9 aa, Homo Sapiens
AQPSTTGIW

SEQ ID NO: 851099 - protein, 9 aa, Homo Sapiens
NGEDKLLPG

SEQ ID NO: 851100 - protein, 9 aa, Homo Sapiens
EHQLHREIE

SEQ ID NO: 851101 - protein, 9 aa, Homo Sapiens
HTWSKMFDC

SEQ ID NO: 851102 - protein, 9 aa, Homo Sapiens
EDPFYLNHN

SEQ ID NO: 851103 - protein, 9 aa, Homo Sapiens
SPKEKSVQE

SEQ ID NO: 851104 - protein, 9 aa, Homo Sapiens
KEMETLAAT

SEQ ID NO: 851105 - protein, 9 aa, Homo Sapiens
HFYLKKGAA

SEQ ID NO: 851106 - protein, 9 aa, Homo Sapiens
WDWWDAEKC

SEQ ID NO: 851107 - protein, 9 aa, Homo Sapiens
GVKNKTFKC

SEQ ID NO: 851108 - protein, 9 aa, Homo Sapiens
FLMLVSTVL

SEQ ID NO: 851109 - protein, 9 aa, Homo Sapiens
HRYLHQESL

SEQ ID NO: 851110 - protein, 9 aa, Homo Sapiens
RWAEYQNSL

SEQ ID NO: 851111 - protein, 9 aa, Homo Sapiens
ECHEYGDKP

SEQ ID NO: 851112 - protein, 9 aa, Homo Sapiens
KAVKARTTI

SEQ ID NO: 851113 - protein, 9 aa, Homo Sapiens
DVVREKLAR

SEQ ID NO: 851114 - protein, 9 aa, Homo Sapiens
MAQSQLTAT

SEQ ID NO: 851115 - protein, 9 aa, Homo Sapiens
QRKPQAGLK

SEQ ID NO: 851116 - protein, 9 aa, Homo Sapiens
DYTLLENMN

SEQ ID NO: 851117 - protein, 9 aa, Homo Sapiens
MASQDDPLR

SEQ ID NO: 851118 - protein, 9 aa, Homo Sapiens
GPGTRKAYF

SEQ ID NO: 851119 - protein, 9 aa, Homo Sapiens
IRLQELRIV

SEQ ID NO: 851120 - protein, 9 aa, Homo Sapiens
YNASKNIIT

SEQ ID NO: 851121 - protein, 9 aa, Homo Sapiens
KPKQRLSAA

SEQ ID NO: 851122 - protein, 9 aa, Homo Sapiens
QVYISPNNT

SEQ ID NO: 851123 - protein, 9 aa, Homo Sapiens
YMKWRRKAA

SEQ ID NO: 851124 - protein, 9 aa, Homo Sapiens
SSTSSTKHL

SEQ ID NO: 851125 - protein, 9 aa, Homo Sapiens
GKQFENTEM

SEQ ID NO: 851126 - protein, 9 aa, Homo Sapiens
DPHNLSDVD

SEQ ID NO: 851127 - protein, 9 aa, Homo Sapiens
GGPSLRRVA

SEQ ID NO: 851128 - protein, 9 aa, Homo Sapiens
SQPEVSRSL

SEQ ID NO: 851129 - protein, 9 aa, Homo Sapiens
YGEIGVSSV

SEQ ID NO: 851130 - protein, 9 aa, Homo Sapiens
AGEFDKIIH

SEQ ID NO: 851131 - protein, 9 aa, Homo Sapiens
VRSKQDTIL

SEQ ID NO: 851132 - protein, 9 aa, Homo Sapiens
LHVRFAGCL

SEQ ID NO: 851133 - protein, 9 aa, Homo Sapiens
SILGTTPIT

SEQ ID NO: 851134 - protein, 9 aa, Homo Sapiens
CTFKMASRF

SEQ ID NO: 851135 - protein, 9 aa, Homo Sapiens
NWFMFFGPE

SEQ ID NO: 851136 - protein, 9 aa, Homo Sapiens
AIAYFTGNA

SEQ ID NO: 851137 - protein, 9 aa, Homo Sapiens
LLLGLSKSQ

SEQ ID NO: 851138 - protein, 9 aa, Homo Sapiens
ARCCNVTII

SEQ ID NO: 851139 - protein, 9 aa, Homo Sapiens
GRVPSLKRR

SEQ ID NO: 851140 - protein, 9 aa, Homo Sapiens
WLVEDHVQI

SEQ ID NO: 851141 - protein, 9 aa, Homo Sapiens
DQNRDGLID

SEQ ID NO: 851142 - protein, 9 aa, Homo Sapiens
GLLGAMLGL

SEQ ID NO: 851143 - protein, 9 aa, Homo Sapiens
KGNDGKLGA

SEQ ID NO: 851144 - protein, 9 aa, Homo Sapiens
RCYKEICNA

SEQ ID NO: 851145 - protein, 9 aa, Homo Sapiens
KHMVILFTH

SEQ ID NO: 851146 - protein, 9 aa, Homo Sapiens
YLRIHMLKH

SEQ ID NO: 851147 - protein, 9 aa, Homo Sapiens
SKIKQISRD

SEQ ID NO: 851148 - protein, 9 aa, Homo Sapiens
KLDLKAARS

SEQ ID NO: 851149 - protein, 9 aa, Homo Sapiens
FGGWTSPLK

SEQ ID NO: 851150 - protein, 9 aa, Homo Sapiens
GHVVVELFG

SEQ ID NO: 851151 - protein, 9 aa, Homo Sapiens
VELFDEKLN

SEQ ID NO: 851152 - protein, 9 aa, Homo Sapiens
SITYIRADI

SEQ ID NO: 851153 - protein, 9 aa, Homo Sapiens
EQHNIKGEI

SEQ ID NO: 851154 - protein, 9 aa, Homo Sapiens
LHRHKTVIQ

SEQ ID NO: 851155 - protein, 9 aa, Homo Sapiens
RKKITNVLL

SEQ ID NO: 851156 - protein, 9 aa, Homo Sapiens
PAHCKVIIK

SEQ ID NO: 851157 - protein, 9 aa, Homo Sapiens
REQQTRPVW

SEQ ID NO: 851158 - protein, 9 aa, Homo Sapiens
NVNIPENIY

SEQ ID NO: 851159 - protein, 9 aa, Homo Sapiens
GEFKDALRT

SEQ ID NO: 851160 - protein, 9 aa, Homo Sapiens
DDDDIQGRD

SEQ ID NO: 851161 - protein, 9 aa, Homo Sapiens
DNCVNSGSG

SEQ ID NO: 851162 - protein, 9 aa, Homo Sapiens
GLDLHSVVR

SEQ ID NO: 851163 - protein, 9 aa, Homo Sapiens
ASITTDIII

SEQ ID NO: 851164 - protein, 9 aa, Homo Sapiens
SPSLPWSSD

SEQ ID NO: 851165 - protein, 9 aa, Homo Sapiens
SLIAFRNNY

SEQ ID NO: 851166 - protein, 9 aa, Homo Sapiens
HRKRKQLLV

SEQ ID NO: 851167 - protein, 9 aa, Homo Sapiens
LSRRRSHQD

SEQ ID NO: 851168 - protein, 9 aa, Homo Sapiens
GLHYPKKNR

SEQ ID NO: 851169 - protein, 9 aa, Homo Sapiens
FAFGDQNCS

SEQ ID NO: 851170 - protein, 9 aa, Homo Sapiens
HFSAFRMLS

SEQ ID NO: 851171 - protein, 9 aa, Homo Sapiens
RQGEKGANG

SEQ ID NO: 851172 - protein, 9 aa, Homo Sapiens
RPKGLQRLM

SEQ ID NO: 851173 - protein, 9 aa, Homo Sapiens
SGFVSGITE

SEQ ID NO: 851174 - protein, 9 aa, Homo Sapiens
LNDHWRIHT

SEQ ID NO: 851175 - protein, 9 aa, Homo Sapiens
NVSYPEVFV

SEQ ID NO: 851176 - protein, 9 aa, Homo Sapiens
PQWAGRYRI

SEQ ID NO: 851177 - protein, 9 aa, Homo Sapiens
AGICLNLLK

SEQ ID NO: 851178 - protein, 9 aa, Homo Sapiens
PAGVGFHTL

SEQ ID NO: 851179 - protein, 9 aa, Homo Sapiens
KLSLPGPSK

SEQ ID NO: 851180 - protein, 9 aa, Homo Sapiens
SDYYIWNYK

SEQ ID NO: 851181 - protein, 9 aa, Homo Sapiens
YMEIFMEEM

SEQ ID NO: 851182 - protein, 9 aa, Homo Sapiens
SRLWSGTAY

SEQ ID NO: 851183 - protein, 9 aa, Homo Sapiens
ALKKCGISA

SEQ ID NO: 851184 - protein, 9 aa, Homo Sapiens
GTYFCVDFS

SEQ ID NO: 851185 - protein, 9 aa, Homo Sapiens
FFCGNKYYR

SEQ ID NO: 851186 - protein, 9 aa, Homo Sapiens
GVRTRDANV

SEQ ID NO: 851187 - protein, 9 aa, Homo Sapiens
LAKYMFFLM

SEQ ID NO: 851188 - protein, 9 aa, Homo Sapiens
ANYTNGNFG

SEQ ID NO: 851189 - protein, 9 aa, Homo Sapiens
KSLYFKLQS

SEQ ID NO: 851190 - protein, 9 aa, Homo Sapiens
TKVLSQCVT

SEQ ID NO: 851191 - protein, 9 aa, Homo Sapiens
AFLKPTIAT

SEQ ID NO: 851192 - protein, 9 aa, Homo Sapiens
NWLSACFDN

SEQ ID NO: 851193 - protein, 9 aa, Homo Sapiens
PCPKMCQWY

SEQ ID NO: 851194 - protein, 9 aa, Homo Sapiens
AERVGTHSE

SEQ ID NO: 851195 - protein, 9 aa, Homo Sapiens
YSYRKFFYG

SEQ ID NO: 851196 - protein, 9 aa, Homo Sapiens
EKTHGSLIL

SEQ ID NO: 851197 - protein, 9 aa, Homo Sapiens
VLCNGIPDS

SEQ ID NO: 851198 - protein, 9 aa, Homo Sapiens
VSDEPSTKQ

SEQ ID NO: 851199 - protein, 9 aa, Homo Sapiens
QNLNKKERR

SEQ ID NO: 851200 - protein, 9 aa, Homo Sapiens
YSELSKWSF

SEQ ID NO: 851201 - protein, 9 aa, Homo Sapiens
SDIEPKNSP

SEQ ID NO: 851202 - protein, 9 aa, Homo Sapiens
KWISHDPHN

SEQ ID NO: 851203 - protein, 9 aa, Homo Sapiens
RPHKGPGGG

SEQ ID NO: 851204 - protein, 9 aa, Homo Sapiens
LAEIHPNHP

SEQ ID NO: 851205 - protein, 9 aa, Homo Sapiens
EAIYGTPHN

SEQ ID NO: 851206 - protein, 9 aa, Homo Sapiens
IELHSFEVY

SEQ ID NO: 851207 - protein, 9 aa, Homo Sapiens
LEVLKEDAA

SEQ ID NO: 851208 - protein, 9 aa, Homo Sapiens
KKIKWIYDE

SEQ ID NO: 851209 - protein, 9 aa, Homo Sapiens
QEGVEMLLN

SEQ ID NO: 851210 - protein, 9 aa, Homo Sapiens
PNNTVISVN

SEQ ID NO: 851211 - protein, 9 aa, Homo Sapiens
GRCLDDVKD

SEQ ID NO: 851212 - protein, 9 aa, Homo Sapiens
SSPERNHST

SEQ ID NO: 851213 - protein, 9 aa, Homo Sapiens
VPLISQACK

SEQ ID NO: 851214 - protein, 9 aa, Homo Sapiens
SYSCPSCGQ

SEQ ID NO: 851215 - protein, 9 aa, Homo Sapiens
LETIVNLKK

SEQ ID NO: 851216 - protein, 9 aa, Homo Sapiens
PCNHMRFWA

SEQ ID NO: 851217 - protein, 9 aa, Homo Sapiens
TRLKTMTDM

SEQ ID NO: 851218 - protein, 9 aa, Homo Sapiens
DWKVNKDKE

SEQ ID NO: 851219 - protein, 9 aa, Homo Sapiens
GNLWWVGLT

SEQ ID NO: 851220 - protein, 9 aa, Homo Sapiens
SSFSCYHDH

SEQ ID NO: 851221 - protein, 9 aa, Homo Sapiens
IVCIMKARK

SEQ ID NO: 851222 - protein, 9 aa, Homo Sapiens
DLPTPDQDT

SEQ ID NO: 851223 - protein, 9 aa, Homo Sapiens
CKAARKQDV

SEQ ID NO: 851224 - protein, 9 aa, Homo Sapiens
EVRQSYFAL

SEQ ID NO: 851225 - protein, 9 aa, Homo Sapiens
AQERKLCRY

SEQ ID NO: 851226 - protein, 9 aa, Homo Sapiens
FINEMVIYL

SEQ ID NO: 851227 - protein, 9 aa, Homo Sapiens
LDHHCWVHI

SEQ ID NO: 851228 - protein, 9 aa, Homo Sapiens
AVKHDLILN

SEQ ID NO: 851229 - protein, 9 aa, Homo Sapiens
ETLQIRRLG

SEQ ID NO: 851230 - protein, 9 aa, Homo Sapiens
IKVLIIVFL

SEQ ID NO: 851231 - protein, 9 aa, Homo Sapiens
CINPVHSKL

SEQ ID NO: 851232 - protein, 9 aa, Homo Sapiens
ALAGSEGTT

SEQ ID NO: 851233 - protein, 9 aa, Homo Sapiens
KLAPKFAKR

SEQ ID NO: 851234 - protein, 9 aa, Homo Sapiens
SVNLDSLGL

SEQ ID NO: 851235 - protein, 9 aa, Homo Sapiens
ATLLNYPDR

SEQ ID NO: 851236 - protein, 9 aa, Homo Sapiens
FASISSQMH

SEQ ID NO: 851237 - protein, 9 aa, Homo Sapiens
GRKYRVVDL

SEQ ID NO: 851238 - protein, 9 aa, Homo Sapiens
SKGDQRRAR

SEQ ID NO: 851239 - protein, 9 aa, Homo Sapiens
ILARDVHNQ

SEQ ID NO: 851240 - protein, 9 aa, Homo Sapiens
QLLEKLIEL

SEQ ID NO: 851241 - protein, 9 aa, Homo Sapiens
LTLTGVYSG

SEQ ID NO: 851242 - protein, 9 aa, Homo Sapiens
TESITGSPL

SEQ ID NO: 851243 - protein, 9 aa, Homo Sapiens
NPALSQPSP

SEQ ID NO: 851244 - protein, 9 aa, Homo Sapiens
KKLCQICQH

SEQ ID NO: 851245 - protein, 9 aa, Homo Sapiens
QTALRSEEY

SEQ ID NO: 851246 - protein, 9 aa, Homo Sapiens
PRGLREQLA

SEQ ID NO: 851247 - protein, 9 aa, Homo Sapiens
FDFRLYCLW

SEQ ID NO: 851248 - protein, 9 aa, Homo Sapiens
GNAATVCKG

SEQ ID NO: 851249 - protein, 9 aa, Homo Sapiens
TIWQIDNFV

SEQ ID NO: 851250 - protein, 9 aa, Homo Sapiens
KATVNYRQA

SEQ ID NO: 851251 - protein, 9 aa, Homo Sapiens
NRGVIVFNN

SEQ ID NO: 851252 - protein, 9 aa, Homo Sapiens
TYEKRIERL

SEQ ID NO: 851253 - protein, 9 aa, Homo Sapiens
RQFSTSGGG

SEQ ID NO: 851254 - protein, 9 aa, Homo Sapiens
VKLQKLQAA

SEQ ID NO: 851255 - protein, 9 aa, Homo Sapiens
AINRTIFQK

SEQ ID NO: 851256 - protein, 9 aa, Homo Sapiens
FLLMTYFDP

SEQ ID NO: 851257 - protein, 9 aa, Homo Sapiens
LKELFEENI

SEQ ID NO: 851258 - protein, 9 aa, Homo Sapiens
YNNFFYLIK

SEQ ID NO: 851259 - protein, 9 aa, Homo Sapiens
LCQNAREMT

SEQ ID NO: 851260 - protein, 9 aa, Homo Sapiens
KTMRKVMQI

SEQ ID NO: 851261 - protein, 9 aa, Homo Sapiens
RYCIFNNNT

SEQ ID NO: 851262 - protein, 9 aa, Homo Sapiens
VESVFWNFD

SEQ ID NO: 851263 - protein, 9 aa, Homo Sapiens
SVIQVLSHL

SEQ ID NO: 851264 - protein, 9 aa, Homo Sapiens
VLRNQREFS

SEQ ID NO: 851265 - protein, 9 aa, Homo Sapiens
FRKYNHMRA

SEQ ID NO: 851266 - protein, 9 aa, Homo Sapiens
ECVLPTVMS

SEQ ID NO: 851267 - protein, 9 aa, Homo Sapiens
YAAVKHSRP

SEQ ID NO: 851268 - protein, 9 aa, Homo Sapiens
FFIHGQVLY

SEQ ID NO: 851269 - protein, 9 aa, Homo Sapiens
CSKLVDNSA

SEQ ID NO: 851270 - protein, 9 aa, Homo Sapiens
FPRRSKSLK

SEQ ID NO: 851271 - protein, 9 aa, Homo Sapiens
TLTYRGFIF

SEQ ID NO: 851272 - protein, 9 aa, Homo Sapiens
SSSLTYHQT

SEQ ID NO: 851273 - protein, 9 aa, Homo Sapiens
IWKAELEAR

SEQ ID NO: 851274 - protein, 9 aa, Homo Sapiens
FSVRDDLFG

SEQ ID NO: 851275 - protein, 9 aa, Homo Sapiens
SQIVTSALR

SEQ ID NO: 851276 - protein, 9 aa, Homo Sapiens
KDKENSECA

SEQ ID NO: 851277 - protein, 9 aa, Homo Sapiens
SFTNMSSMN

SEQ ID NO: 851278 - protein, 9 aa, Homo Sapiens
ITREPALDG

SEQ ID NO: 851279 - protein, 9 aa, Homo Sapiens
LFTDKFCKV

SEQ ID NO: 851280 - protein, 9 aa, Homo Sapiens
VMQKYLAEI

SEQ ID NO: 851281 - protein, 9 aa, Homo Sapiens
TRHYQSYMQ

SEQ ID NO: 851282 - protein, 9 aa, Homo Sapiens
SPQQTFPAR

SEQ ID NO: 851283 - protein, 9 aa, Homo Sapiens
PQLSGYQQQ

SEQ ID NO: 851284 - protein, 9 aa, Homo Sapiens
FNFQGIVKH

SEQ ID NO: 851285 - protein, 9 aa, Homo Sapiens
DILESSKDK

SEQ ID NO: 851286 - protein, 9 aa, Homo Sapiens
KSLVQAAEA

SEQ ID NO: 851287 - protein, 9 aa, Homo Sapiens
ENHLCVGCC

SEQ ID NO: 851288 - protein, 9 aa, Homo Sapiens
KIEDLSLAF

SEQ ID NO: 851289 - protein, 9 aa, Homo Sapiens
FKQLCLLQE

SEQ ID NO: 851290 - protein, 9 aa, Homo Sapiens
KYTKHNFMM

SEQ ID NO: 851291 - protein, 9 aa, Homo Sapiens
PILTASGRN

SEQ ID NO: 851292 - protein, 9 aa, Homo Sapiens
PRLLLFHLL

SEQ ID NO: 851293 - protein, 9 aa, Homo Sapiens
GEIARIWSL

SEQ ID NO: 851294 - protein, 9 aa, Homo Sapiens
LFRLVDNEE

SEQ ID NO: 851295 - protein, 9 aa, Homo Sapiens
KAPSRTQRA

SEQ ID NO: 851296 - protein, 9 aa, Homo Sapiens
GSGKTYIGP

SEQ ID NO: 851297 - protein, 9 aa, Homo Sapiens
CPLHAWPKC

SEQ ID NO: 851298 - protein, 9 aa, Homo Sapiens
TDTSRGASP

SEQ ID NO: 851299 - protein, 9 aa, Homo Sapiens
LISRMYKEL

SEQ ID NO: 851300 - protein, 9 aa, Homo Sapiens
LNGVDKLLL

SEQ ID NO: 851301 - protein, 9 aa, Homo Sapiens
FISLAFLDT

SEQ ID NO: 851302 - protein, 9 aa, Homo Sapiens
IKERSRINY

SEQ ID NO: 851303 - protein, 9 aa, Homo Sapiens
DTKPTRIIW

SEQ ID NO: 851304 - protein, 9 aa, Homo Sapiens
IKKGYQDVN

SEQ ID NO: 851305 - protein, 9 aa, Homo Sapiens
DQFSAIQRQ

SEQ ID NO: 851306 - protein, 9 aa, Homo Sapiens
SKCQNSWGE

SEQ ID NO: 851307 - protein, 9 aa, Homo Sapiens
PLFQLVFSD

SEQ ID NO: 851308 - protein, 9 aa, Homo Sapiens
IVTSGTRTV

SEQ ID NO: 851309 - protein, 9 aa, Homo Sapiens
ENKDEIEKI

SEQ ID NO: 851310 - protein, 9 aa, Homo Sapiens
LLWFRDGVM

SEQ ID NO: 851311 - protein, 9 aa, Homo Sapiens
RKLDIYCVQ

SEQ ID NO: 851312 - protein, 9 aa, Homo Sapiens
NGMKNAMNM

SEQ ID NO: 851313 - protein, 9 aa, Homo Sapiens
GHRSSSEPM

SEQ ID NO: 851314 - protein, 9 aa, Homo Sapiens
ILLFSKCTL

SEQ ID NO: 851315 - protein, 9 aa, Homo Sapiens
LIYADKELV

SEQ ID NO: 851316 - protein, 9 aa, Homo Sapiens
EIQELNGVA

SEQ ID NO: 851317 - protein, 9 aa, Homo Sapiens
ENDFSPEAL

SEQ ID NO: 851318 - protein, 9 aa, Homo Sapiens
NMFEILDRL

SEQ ID NO: 851319 - protein, 9 aa, Homo Sapiens
TGACNNRTM

SEQ ID NO: 851320 - protein, 9 aa, Homo Sapiens
MTFIAGYLI

SEQ ID NO: 851321 - protein, 9 aa, Homo Sapiens
LDVPTNNQQ

SEQ ID NO: 851322 - protein, 9 aa, Homo Sapiens
FFRDSPAGD

SEQ ID NO: 851323 - protein, 9 aa, Homo Sapiens
IQNMDRLQG

SEQ ID NO: 851324 - protein, 9 aa, Homo Sapiens
AAQITTQKW

SEQ ID NO: 851325 - protein, 9 aa, Homo Sapiens
VTSKFPRQI

SEQ ID NO: 851326 - protein, 9 aa, Homo Sapiens
GVEGTLAKH

SEQ ID NO: 851327 - protein, 9 aa, Homo Sapiens
STCAFHLTA

SEQ ID NO: 851328 - protein, 9 aa, Homo Sapiens
PPGLKRFSC

SEQ ID NO: 851329 - protein, 9 aa, Homo Sapiens
LTKHVQIHT

SEQ ID NO: 851330 - protein, 9 aa, Homo Sapiens
LFLNILQPG

SEQ ID NO: 851331 - protein, 9 aa, Homo Sapiens
LYVMRLTRH

SEQ ID NO: 851332 - protein, 9 aa, Homo Sapiens
ELCAKTDPS

SEQ ID NO: 851333 - protein, 9 aa, Homo Sapiens
PFIKDGSFN

SEQ ID NO: 851334 - protein, 9 aa, Homo Sapiens
EGAYARDNQ

SEQ ID NO: 851335 - protein, 9 aa, Homo Sapiens
KFANTSMAL

SEQ ID NO: 851336 - protein, 9 aa, Homo Sapiens
TCSIPKSNI

SEQ ID NO: 851337 - protein, 9 aa, Homo Sapiens
FELRKSPVV

SEQ ID NO: 851338 - protein, 9 aa, Homo Sapiens
LDSLVHGKP

SEQ ID NO: 851339 - protein, 9 aa, Homo Sapiens
ELSGDKNRL

SEQ ID NO: 851340 - protein, 9 aa, Homo Sapiens
EARRAFNGE

SEQ ID NO: 851341 - protein, 9 aa, Homo Sapiens
HSEIYNTLS

SEQ ID NO: 851342 - protein, 9 aa, Homo Sapiens
FDCFSKHDI

SEQ ID NO: 851343 - protein, 9 aa, Homo Sapiens
QCLISPDCC

SEQ ID NO: 851344 - protein, 9 aa, Homo Sapiens
WEEGKAAAS

SEQ ID NO: 851345 - protein, 9 aa, Homo Sapiens
QIKHTMAFI

SEQ ID NO: 851346 - protein, 9 aa, Homo Sapiens
SNKICSLPA

SEQ ID NO: 851347 - protein, 9 aa, Homo Sapiens
VLLCCQAGV

SEQ ID NO: 851348 - protein, 9 aa, Homo Sapiens
TQTILFYDR

SEQ ID NO: 851349 - protein, 9 aa, Homo Sapiens
DIGLPGPQG

SEQ ID NO: 851350 - protein, 9 aa, Homo Sapiens
YQMYQTQVS

SEQ ID NO: 851351 - protein, 9 aa, Homo Sapiens
FMQNVACSN

SEQ ID NO: 851352 - protein, 9 aa, Homo Sapiens
RIKGDYVLG

SEQ ID NO: 851353 - protein, 9 aa, Homo Sapiens
INENRIVEH

SEQ ID NO: 851354 - protein, 9 aa, Homo Sapiens
NGKFVILLV

SEQ ID NO: 851355 - protein, 9 aa, Homo Sapiens
GKFVILLVN

SEQ ID NO: 851356 - protein, 9 aa, Homo Sapiens
FATFIDNKS

SEQ ID NO: 851357 - protein, 9 aa, Homo Sapiens
RRSERNQEQ

SEQ ID NO: 851358 - protein, 9 aa, Homo Sapiens
CNYSLHVAV

SEQ ID NO: 851359 - protein, 9 aa, Homo Sapiens
STEIVNVLL

SEQ ID NO: 851360 - protein, 9 aa, Homo Sapiens
NQIAALNQQ

SEQ ID NO: 851361 - protein, 9 aa, Homo Sapiens
IIKPSFVPG

SEQ ID NO: 851362 - protein, 9 aa, Homo Sapiens
KYIATILEL

SEQ ID NO: 851363 - protein, 9 aa, Homo Sapiens
FPSIYINNV

SEQ ID NO: 851364 - protein, 9 aa, Homo Sapiens
VPVCCQCNI

SEQ ID NO: 851365 - protein, 9 aa, Homo Sapiens
CVTQQQYRD

SEQ ID NO: 851366 - protein, 9 aa, Homo Sapiens
IEKDWCDWT

SEQ ID NO: 851367 - protein, 9 aa, Homo Sapiens
QEPDVLHDY

SEQ ID NO: 851368 - protein, 9 aa, Homo Sapiens
SAAAQGTWS

SEQ ID NO: 851369 - protein, 9 aa, Homo Sapiens
GDPGPSVVD

SEQ ID NO: 851370 - protein, 9 aa, Homo Sapiens
LDIINELNR

SEQ ID NO: 851371 - protein, 9 aa, Homo Sapiens
TKESYAIQS

SEQ ID NO: 851372 - protein, 9 aa, Homo Sapiens
DQSLSHLPV

SEQ ID NO: 851373 - protein, 9 aa, Homo Sapiens
LFSPASYSV

SEQ ID NO: 851374 - protein, 9 aa, Homo Sapiens
EALLGNEAV

SEQ ID NO: 851375 - protein, 9 aa, Homo Sapiens
TNFKKIYWP

SEQ ID NO: 851376 - protein, 9 aa, Homo Sapiens
LLSDIGRQI

SEQ ID NO: 851377 - protein, 9 aa, Homo Sapiens
VTGEIRVKY

SEQ ID NO: 851378 - protein, 9 aa, Homo Sapiens
NCLAQTTEW

SEQ ID NO: 851379 - protein, 9 aa, Homo Sapiens
TRNVMTAII

SEQ ID NO: 851380 - protein, 9 aa, Homo Sapiens
LMTNHLYAA

SEQ ID NO: 851381 - protein, 9 aa, Homo Sapiens
IESIILIFA

SEQ ID NO: 851382 - protein, 9 aa, Homo Sapiens
KQTTSLLHP

SEQ ID NO: 851383 - protein, 9 aa, Homo Sapiens
LLIPVKYWH

SEQ ID NO: 851384 - protein, 9 aa, Homo Sapiens
VVQELAETI

SEQ ID NO: 851385 - protein, 9 aa, Homo Sapiens
NTYVFGRVM

SEQ ID NO: 851386 - protein, 9 aa, Homo Sapiens
KRLMFQIAM

SEQ ID NO: 851387 - protein, 9 aa, Homo Sapiens
SNKRSSCEL

SEQ ID NO: 851388 - protein, 9 aa, Homo Sapiens
GPRPPNSPL

SEQ ID NO: 851389 - protein, 9 aa, Homo Sapiens
EQREEERYA

SEQ ID NO: 851390 - protein, 9 aa, Homo Sapiens
TPSMTNWSP

SEQ ID NO: 851391 - protein, 9 aa, Homo Sapiens
PQIPQTEEK

SEQ ID NO: 851392 - protein, 9 aa, Homo Sapiens
LVKGLKSAL

SEQ ID NO: 851393 - protein, 9 aa, Homo Sapiens
FTAAPDLKV

SEQ ID NO: 851394 - protein, 9 aa, Homo Sapiens
VLHWCIMPF

SEQ ID NO: 851395 - protein, 9 aa, Homo Sapiens
NDIGGDGNN

SEQ ID NO: 851396 - protein, 9 aa, Homo Sapiens
VFLSVDDDN

SEQ ID NO: 851397 - protein, 9 aa, Homo Sapiens
FSQSQYLIV

SEQ ID NO: 851398 - protein, 9 aa, Homo Sapiens
SLVTTPTSL

SEQ ID NO: 851399 - protein, 9 aa, Homo Sapiens
RNLQRYCYT

SEQ ID NO: 851400 - protein, 9 aa, Homo Sapiens
SQSFPQPLP

SEQ ID NO: 851401 - protein, 9 aa, Homo Sapiens
VGSRINYYC

SEQ ID NO: 851402 - protein, 9 aa, Homo Sapiens
KWVTTVGKH

SEQ ID NO: 851403 - protein, 9 aa, Homo Sapiens
FSNTVIDQM

SEQ ID NO: 851404 - protein, 9 aa, Homo Sapiens
SLYFKLQSM

SEQ ID NO: 851405 - protein, 9 aa, Homo Sapiens
LQYLTHWPE

SEQ ID NO: 851406 - protein, 9 aa, Homo Sapiens
DLLMGMDST

SEQ ID NO: 851407 - protein, 9 aa, Homo Sapiens
QNGYRALMD

SEQ ID NO: 851408 - protein, 9 aa, Homo Sapiens
RDVEVSLPS

SEQ ID NO: 851409 - protein, 9 aa, Homo Sapiens
YGKKCTYAI

SEQ ID NO: 851410 - protein, 9 aa, Homo Sapiens
AYAEELASQ

SEQ ID NO: 851411 - protein, 9 aa, Homo Sapiens
EKLEQRQAT

SEQ ID NO: 851412 - protein, 9 aa, Homo Sapiens
NKQRLHFAL

SEQ ID NO: 851413 - protein, 9 aa, Homo Sapiens
EIISNGPVL

SEQ ID NO: 851414 - protein, 9 aa, Homo Sapiens
DASIVGSFD

SEQ ID NO: 851415 - protein, 9 aa, Homo Sapiens
FNRALKVMK

SEQ ID NO: 851416 - protein, 9 aa, Homo Sapiens
ELYKNRGVL

SEQ ID NO: 851417 - protein, 9 aa, Homo Sapiens
PCSSLPRVI

SEQ ID NO: 851418 - protein, 9 aa, Homo Sapiens
MHADMDGKK

SEQ ID NO: 851419 - protein, 9 aa, Homo Sapiens
RHFKLEKHS

SEQ ID NO: 851420 - protein, 9 aa, Homo Sapiens
NETCYPGFY

SEQ ID NO: 851421 - protein, 9 aa, Homo Sapiens
HKQIYYSGK

SEQ ID NO: 851422 - protein, 9 aa, Homo Sapiens
HLGYIEDFD

SEQ ID NO: 851423 - protein, 9 aa, Homo Sapiens
IIPPLFSYC

SEQ ID NO: 851424 - protein, 9 aa, Homo Sapiens
VNKKNTWRQ

SEQ ID NO: 851425 - protein, 9 aa, Homo Sapiens
ILESQVCTP

SEQ ID NO: 851426 - protein, 9 aa, Homo Sapiens
WICLCFSFI

SEQ ID NO: 851427 - protein, 9 aa, Homo Sapiens
EGSGSHEGP

SEQ ID NO: 851428 - protein, 9 aa, Homo Sapiens
HPDMLIKIH

SEQ ID NO: 851429 - protein, 9 aa, Homo Sapiens
SSDMKGWPS

SEQ ID NO: 851430 - protein, 9 aa, Homo Sapiens
PPQHCQQKC

SEQ ID NO: 851431 - protein, 9 aa, Homo Sapiens
YSEAKSENR

SEQ ID NO: 851432 - protein, 9 aa, Homo Sapiens
CTMAEMVLH

SEQ ID NO: 851433 - protein, 9 aa, Homo Sapiens
KECIKMPYS

SEQ ID NO: 851434 - protein, 9 aa, Homo Sapiens
IWQEARLQG

SEQ ID NO: 851435 - protein, 9 aa, Homo Sapiens
TKAIKLKNV

SEQ ID NO: 851436 - protein, 9 aa, Homo Sapiens
DSSDGSDSS

SEQ ID NO: 851437 - protein, 9 aa, Homo Sapiens
HHDGQNNGD

SEQ ID NO: 851438 - protein, 9 aa, Homo Sapiens
EHMNIHIGE

SEQ ID NO: 851439 - protein, 9 aa, Homo Sapiens
NIHQQTHTG

SEQ ID NO: 851440 - protein, 9 aa, Homo Sapiens
QSQQELSPV

SEQ ID NO: 851441 - protein, 9 aa, Homo Sapiens
NKEFLNLQD

SEQ ID NO: 851442 - protein, 9 aa, Homo Sapiens
LEITPGLEP

SEQ ID NO: 851443 - protein, 9 aa, Homo Sapiens
PDENKDEIE

SEQ ID NO: 851444 - protein, 9 aa, Homo Sapiens
HCPIYYLMA

SEQ ID NO: 851445 - protein, 9 aa, Homo Sapiens
NFGVVLADS

SEQ ID NO: 851446 - protein, 9 aa, Homo Sapiens
NESQRQATK

SEQ ID NO: 851447 - protein, 9 aa, Homo Sapiens
VPAEELCNE

SEQ ID NO: 851448 - protein, 9 aa, Homo Sapiens
QARKMVLEI

SEQ ID NO: 851449 - protein, 9 aa, Homo Sapiens
HTEMGLYYS

SEQ ID NO: 851450 - protein, 9 aa, Homo Sapiens
LRAYMKKLT

SEQ ID NO: 851451 - protein, 9 aa, Homo Sapiens
VHQRINTGE

SEQ ID NO: 851452 - protein, 9 aa, Homo Sapiens
CQWYQNSCY

SEQ ID NO: 851453 - protein, 9 aa, Homo Sapiens
ITADEVHYL

SEQ ID NO: 851454 - protein, 9 aa, Homo Sapiens
RTTASTPMN

SEQ ID NO: 851455 - protein, 9 aa, Homo Sapiens
ETLAAAVQG

SEQ ID NO: 851456 - protein, 9 aa, Homo Sapiens
KRKDEVSIL

SEQ ID NO: 851457 - protein, 9 aa, Homo Sapiens
ALHGSLVCT

SEQ ID NO: 851458 - protein, 9 aa, Homo Sapiens
ADANNNARN

SEQ ID NO: 851459 - protein, 9 aa, Homo Sapiens
QKVISLFYS

SEQ ID NO: 851460 - protein, 9 aa, Homo Sapiens
LMFSMLKTS

SEQ ID NO: 851461 - protein, 9 aa, Homo Sapiens
VQVLHQVTP

SEQ ID NO: 851462 - protein, 9 aa, Homo Sapiens
WTPLKFLVE

SEQ ID NO: 851463 - protein, 9 aa, Homo Sapiens
IWQKNLTVL

SEQ ID NO: 851464 - protein, 9 aa, Homo Sapiens
LDNKLQEEE

SEQ ID NO: 851465 - protein, 9 aa, Homo Sapiens
IVSLLARLG

SEQ ID NO: 851466 - protein, 9 aa, Homo Sapiens
PSFGRKVMD

SEQ ID NO: 851467 - protein, 9 aa, Homo Sapiens
PPTYRTHDG

SEQ ID NO: 851468 - protein, 9 aa, Homo Sapiens
KEILLNING

SEQ ID NO: 851469 - protein, 9 aa, Homo Sapiens
EGGHSIESS

SEQ ID NO: 851470 - protein, 9 aa, Homo Sapiens
NYLRTSTGR

SEQ ID NO: 851471 - protein, 9 aa, Homo Sapiens
ISTFKRKDW

SEQ ID NO: 851472 - protein, 9 aa, Homo Sapiens
REGVDNACF

SEQ ID NO: 851473 - protein, 9 aa, Homo Sapiens
FGNVDCDFC

SEQ ID NO: 851474 - protein, 9 aa, Homo Sapiens
HSFQVIESG

SEQ ID NO: 851475 - protein, 9 aa, Homo Sapiens
MHYQIYKAA

SEQ ID NO: 851476 - protein, 9 aa, Homo Sapiens
SPSQNNLAS

SEQ ID NO: 851477 - protein, 9 aa, Homo Sapiens
YNDRSVLDN

SEQ ID NO: 851478 - protein, 9 aa, Homo Sapiens
GNKLCSVPC

SEQ ID NO: 851479 - protein, 9 aa, Homo Sapiens
QRQKGLMRQ

SEQ ID NO: 851480 - protein, 9 aa, Homo Sapiens
QGLSAQWKQ

SEQ ID NO: 851481 - protein, 9 aa, Homo Sapiens
LAVGIFFGF

SEQ ID NO: 851482 - protein, 9 aa, Homo Sapiens
VFASISSQM

SEQ ID NO: 851483 - protein, 9 aa, Homo Sapiens
AALEKDEQV

SEQ ID NO: 851484 - protein, 9 aa, Homo Sapiens
EVSQHAAKC

SEQ ID NO: 851485 - protein, 9 aa, Homo Sapiens
LAKKVDSHT

SEQ ID NO: 851486 - protein, 9 aa, Homo Sapiens
DMEGSVPAV

SEQ ID NO: 851487 - protein, 9 aa, Homo Sapiens
RNQVETPGC

SEQ ID NO: 851488 - protein, 9 aa, Homo Sapiens
SNSHSQAPD

SEQ ID NO: 851489 - protein, 9 aa, Homo Sapiens
NVRHILRIN

SEQ ID NO: 851490 - protein, 9 aa, Homo Sapiens
KPTFGIEPN

SEQ ID NO: 851491 - protein, 9 aa, Homo Sapiens
ITVPPKKSG

SEQ ID NO: 851492 - protein, 9 aa, Homo Sapiens
NIYKIRHTK

SEQ ID NO: 851493 - protein, 9 aa, Homo Sapiens
VVVMPKKKQ

SEQ ID NO: 851494 - protein, 9 aa, Homo Sapiens
PMMCPQAFN

SEQ ID NO: 851495 - protein, 9 aa, Homo Sapiens
KGLKLLCRY

SEQ ID NO: 851496 - protein, 9 aa, Homo Sapiens
ITAAWLLFL

SEQ ID NO: 851497 - protein, 9 aa, Homo Sapiens
LYNPDSEQD

SEQ ID NO: 851498 - protein, 9 aa, Homo Sapiens
VRNYWRGLF

SEQ ID NO: 851499 - protein, 9 aa, Homo Sapiens
SYSQARGRQ

SEQ ID NO: 851500 - protein, 9 aa, Homo Sapiens
NKVPAPCPP

SEQ ID NO: 851501 - protein, 9 aa, Homo Sapiens
GYWIMMNIP

SEQ ID NO: 851502 - protein, 9 aa, Homo Sapiens
DLECKYITK

SEQ ID NO: 851503 - protein, 9 aa, Homo Sapiens
YIRSLQELL

SEQ ID NO: 851504 - protein, 9 aa, Homo Sapiens
RKCRRINSS

SEQ ID NO: 851505 - protein, 9 aa, Homo Sapiens
AAHCGHPIL

SEQ ID NO: 851506 - protein, 9 aa, Homo Sapiens
GKKGAVTKM

SEQ ID NO: 851507 - protein, 9 aa, Homo Sapiens
GPVRLYEDA

SEQ ID NO: 851508 - protein, 9 aa, Homo Sapiens
VPAVTEEAA

SEQ ID NO: 851509 - protein, 9 aa, Homo Sapiens
KPILLLLAH

SEQ ID NO: 851510 - protein, 9 aa, Homo Sapiens
TTLAFKLQH

SEQ ID NO: 851511 - protein, 9 aa, Homo Sapiens
KNKLLIDGF

SEQ ID NO: 851512 - protein, 9 aa, Homo Sapiens
IVIVSYFNI

SEQ ID NO: 851513 - protein, 9 aa, Homo Sapiens
LCSIYGSIT

SEQ ID NO: 851514 - protein, 9 aa, Homo Sapiens
TEHKRLHTG

SEQ ID NO: 851515 - protein, 9 aa, Homo Sapiens
YIKDKTHQT

SEQ ID NO: 851516 - protein, 9 aa, Homo Sapiens
KINSEKEVS

SEQ ID NO: 851517 - protein, 9 aa, Homo Sapiens
KLTQHQIIY

SEQ ID NO: 851518 - protein, 9 aa, Homo Sapiens
RKIIHAICS

SEQ ID NO: 851519 - protein, 9 aa, Homo Sapiens
STQSQGRVP

SEQ ID NO: 851520 - protein, 9 aa, Homo Sapiens
LFELFDRTE

SEQ ID NO: 851521 - protein, 9 aa, Homo Sapiens
VCQNFHPDS

SEQ ID NO: 851522 - protein, 9 aa, Homo Sapiens
CDVQGALRA

SEQ ID NO: 851523 - protein, 9 aa, Homo Sapiens
YLTNILKMP

SEQ ID NO: 851524 - protein, 9 aa, Homo Sapiens
TEDVPTCRD

SEQ ID NO: 851525 - protein, 9 aa, Homo Sapiens
DEDCTLMSG

SEQ ID NO: 851526 - protein, 9 aa, Homo Sapiens
TGSVQKSNK

SEQ ID NO: 851527 - protein, 9 aa, Homo Sapiens
LMLFLSDIS

SEQ ID NO: 851528 - protein, 9 aa, Homo Sapiens
ARKLIKKKR

SEQ ID NO: 851529 - protein, 9 aa, Homo Sapiens
WGYDVAVNI

SEQ ID NO: 851530 - protein, 9 aa, Homo Sapiens
GALQLYFRD

SEQ ID NO: 851531 - protein, 9 aa, Homo Sapiens
ESTCTAIRT

SEQ ID NO: 851532 - protein, 9 aa, Homo Sapiens
RHRAIINTD

SEQ ID NO: 851533 - protein, 9 aa, Homo Sapiens
EVEAGTAKD

SEQ ID NO: 851534 - protein, 9 aa, Homo Sapiens
FHKNLEAIV

SEQ ID NO: 851535 - protein, 9 aa, Homo Sapiens
STEMLQEIC

SEQ ID NO: 851536 - protein, 9 aa, Homo Sapiens
VFRSRCQKV

SEQ ID NO: 851537 - protein, 9 aa, Homo Sapiens
TKLIMYSAH

SEQ ID NO: 851538 - protein, 9 aa, Homo Sapiens
FQELKPQSL

SEQ ID NO: 851539 - protein, 9 aa, Homo Sapiens
RVATSQISD

SEQ ID NO: 851540 - protein, 9 aa, Homo Sapiens
EASKSVSST

SEQ ID NO: 851541 - protein, 9 aa, Homo Sapiens
SSTDGDDSL

SEQ ID NO: 851542 - protein, 9 aa, Homo Sapiens
QFDGALNVD

SEQ ID NO: 851543 - protein, 9 aa, Homo Sapiens
QKFTHSRPH

SEQ ID NO: 851544 - protein, 9 aa, Homo Sapiens
GPPKCCNLL

SEQ ID NO: 851545 - protein, 9 aa, Homo Sapiens
EDKKPLETG

SEQ ID NO: 851546 - protein, 9 aa, Homo Sapiens
LKTVLAKQT

SEQ ID NO: 851547 - protein, 9 aa, Homo Sapiens
LLGIAVGLS

SEQ ID NO: 851548 - protein, 9 aa, Homo Sapiens
YFPESLDFS

SEQ ID NO: 851549 - protein, 9 aa, Homo Sapiens
AAAAKKYNL

SEQ ID NO: 851550 - protein, 9 aa, Homo Sapiens
EIDEDCTLM

SEQ ID NO: 851551 - protein, 9 aa, Homo Sapiens
NARRNRQMT

SEQ ID NO: 851552 - protein, 9 aa, Homo Sapiens
SSEQRPVNH

SEQ ID NO: 851553 - protein, 9 aa, Homo Sapiens
EGTSGKTVL

SEQ ID NO: 851554 - protein, 9 aa, Homo Sapiens
HPNPGKRHP

SEQ ID NO: 851555 - protein, 9 aa, Homo Sapiens
SELRQVPGG

SEQ ID NO: 851556 - protein, 9 aa, Homo Sapiens
PSNFIGRLQ

SEQ ID NO: 851557 - protein, 9 aa, Homo Sapiens
RLPPVIRGQ

SEQ ID NO: 851558 - protein, 9 aa, Homo Sapiens
KELSDTMTT

SEQ ID NO: 851559 - protein, 9 aa, Homo Sapiens
PEEPEEDVH

SEQ ID NO: 851560 - protein, 9 aa, Homo Sapiens
KDRKEDVKG

SEQ ID NO: 851561 - protein, 9 aa, Homo Sapiens
IAEIDDLSE

SEQ ID NO: 851562 - protein, 9 aa, Homo Sapiens
NFHEEPQIA

SEQ ID NO: 851563 - protein, 9 aa, Homo Sapiens
SQNNSKNYY

SEQ ID NO: 851564 - protein, 9 aa, Homo Sapiens
VKGFVQKNG

SEQ ID NO: 851565 - protein, 9 aa, Homo Sapiens
DEEDGEEDN

SEQ ID NO: 851566 - protein, 9 aa, Homo Sapiens
GAELESVPL

SEQ ID NO: 851567 - protein, 9 aa, Homo Sapiens
LTAIQKAVS

SEQ ID NO: 851568 - protein, 9 aa, Homo Sapiens
PTCRDSCDK

SEQ ID NO: 851569 - protein, 9 aa, Homo Sapiens
GLIKYIKRK

SEQ ID NO: 851570 - protein, 9 aa, Homo Sapiens
TEDLGNVIR

SEQ ID NO: 851571 - protein, 9 aa, Homo Sapiens
WGEKHCCPI

SEQ ID NO: 851572 - protein, 9 aa, Homo Sapiens
STEYLSSLD

SEQ ID NO: 851573 - protein, 9 aa, Homo Sapiens
FEDVYAGIC

SEQ ID NO: 851574 - protein, 9 aa, Homo Sapiens
FLLKKLLLS

SEQ ID NO: 851575 - protein, 9 aa, Homo Sapiens
REIQTAVHL

SEQ ID NO: 851576 - protein, 9 aa, Homo Sapiens
SSYTLILSI

SEQ ID NO: 851577 - protein, 9 aa, Homo Sapiens
FNLAEKPKP

SEQ ID NO: 851578 - protein, 9 aa, Homo Sapiens
CNITVFRQT

SEQ ID NO: 851579 - protein, 9 aa, Homo Sapiens
VELEKLASQ

SEQ ID NO: 851580 - protein, 9 aa, Homo Sapiens
SRIKTLQAD

SEQ ID NO: 851581 - protein, 9 aa, Homo Sapiens
ASQDTINYS

SEQ ID NO: 851582 - protein, 9 aa, Homo Sapiens
ESPRAANNV

SEQ ID NO: 851583 - protein, 9 aa, Homo Sapiens
DFLCETKLE

SEQ ID NO: 851584 - protein, 9 aa, Homo Sapiens
QIKKAEESA

SEQ ID NO: 851585 - protein, 9 aa, Homo Sapiens
VIFSVEKFL

SEQ ID NO: 851586 - protein, 9 aa, Homo Sapiens
TGNKPYACK

SEQ ID NO: 851587 - protein, 9 aa, Homo Sapiens
LSSGLCREG

SEQ ID NO: 851588 - protein, 9 aa, Homo Sapiens
QLYKSADHQ

SEQ ID NO: 851589 - protein, 9 aa, Homo Sapiens
MIEASKESK

SEQ ID NO: 851590 - protein, 9 aa, Homo Sapiens
DVSKPLEED

SEQ ID NO: 851591 - protein, 9 aa, Homo Sapiens
LQLTWSDNG

SEQ ID NO: 851592 - protein, 9 aa, Homo Sapiens
ELDLRGNTF

SEQ ID NO: 851593 - protein, 9 aa, Homo Sapiens
EVNKVKQEN

SEQ ID NO: 851594 - protein, 9 aa, Homo Sapiens
LVEALERNI

SEQ ID NO: 851595 - protein, 9 aa, Homo Sapiens
RVKNSPPEE

SEQ ID NO: 851596 - protein, 9 aa, Homo Sapiens
QKFCRIDTS

SEQ ID NO: 851597 - protein, 9 aa, Homo Sapiens
FDKLLEERA

SEQ ID NO: 851598 - protein, 9 aa, Homo Sapiens
IPTGLPVRS

SEQ ID NO: 851599 - protein, 9 aa, Homo Sapiens
CLSQQLRIK

SEQ ID NO: 851600 - protein, 9 aa, Homo Sapiens
ALTVSQVLL

SEQ ID NO: 851601 - protein, 9 aa, Homo Sapiens
TERKLRTLW

SEQ ID NO: 851602 - protein, 9 aa, Homo Sapiens
ESRQEHERM

SEQ ID NO: 851603 - protein, 9 aa, Homo Sapiens
SPVVPPTEY

SEQ ID NO: 851604 - protein, 9 aa, Homo Sapiens
YFRKFNKRK

SEQ ID NO: 851605 - protein, 9 aa, Homo Sapiens
RFMYDSFNN

SEQ ID NO: 851606 - protein, 9 aa, Homo Sapiens
VRQVRLWRD

SEQ ID NO: 851607 - protein, 9 aa, Homo Sapiens
ATQNRESPP

SEQ ID NO: 851608 - protein, 9 aa, Homo Sapiens
IPSDNAVNP

SEQ ID NO: 851609 - protein, 9 aa, Homo Sapiens
QRDQECLGK

SEQ ID NO: 851610 - protein, 9 aa, Homo Sapiens
NIFEENVTG

SEQ ID NO: 851611 - protein, 9 aa, Homo Sapiens
SSMDEEELH

SEQ ID NO: 851612 - protein, 9 aa, Homo Sapiens
LSGLLRKSP

SEQ ID NO: 851613 - protein, 9 aa, Homo Sapiens
YPSAMNEEE

SEQ ID NO: 851614 - protein, 9 aa, Homo Sapiens
INMRYPVMS

SEQ ID NO: 851615 - protein, 9 aa, Homo Sapiens
YLSNHYKNG

SEQ ID NO: 851616 - protein, 9 aa, Homo Sapiens
SQDGAFCYW

SEQ ID NO: 851617 - protein, 9 aa, Homo Sapiens
LFTTVSIPK

SEQ ID NO: 851618 - protein, 9 aa, Homo Sapiens
RESGDSDNM

SEQ ID NO: 851619 - protein, 9 aa, Homo Sapiens
QIIHTSDKL

SEQ ID NO: 851620 - protein, 9 aa, Homo Sapiens
VRSFQIVCT

SEQ ID NO: 851621 - protein, 9 aa, Homo Sapiens
SERHAHLHT

SEQ ID NO: 851622 - protein, 9 aa, Homo Sapiens
KKTCHARDK

SEQ ID NO: 851623 - protein, 9 aa, Homo Sapiens
KKAISSTDA

SEQ ID NO: 851624 - protein, 9 aa, Homo Sapiens
SPDPSSPDK

SEQ ID NO: 851625 - protein, 9 aa, Homo Sapiens
LIIHQRNHT

SEQ ID NO: 851626 - protein, 9 aa, Homo Sapiens
EEVFGDIDT

SEQ ID NO: 851627 - protein, 9 aa, Homo Sapiens
SSNQSYRDS

SEQ ID NO: 851628 - protein, 9 aa, Homo Sapiens
DIQLEEGAM

SEQ ID NO: 851629 - protein, 9 aa, Homo Sapiens
HILLPKNVI

SEQ ID NO: 851630 - protein, 9 aa, Homo Sapiens
LVFLFTLLS

SEQ ID NO: 851631 - protein, 9 aa, Homo Sapiens
GRRLRISGL

SEQ ID NO: 851632 - protein, 9 aa, Homo Sapiens
CLQSASDES

SEQ ID NO: 851633 - protein, 9 aa, Homo Sapiens
MCCYVLSAQ

SEQ ID NO: 851634 - protein, 9 aa, Homo Sapiens
VYLASSIAT

SEQ ID NO: 851635 - protein, 9 aa, Homo Sapiens
NGPLVHVKS

SEQ ID NO: 851636 - protein, 9 aa, Homo Sapiens
GPSSFYFTV

SEQ ID NO: 851637 - protein, 9 aa, Homo Sapiens
VRKCCSNGC

SEQ ID NO: 851638 - protein, 9 aa, Homo Sapiens
SEKLPQLHG

SEQ ID NO: 851639 - protein, 9 aa, Homo Sapiens
YLAMVIEGL

SEQ ID NO: 851640 - protein, 9 aa, Homo Sapiens
RNAPLAAGW

SEQ ID NO: 851641 - protein, 9 aa, Homo Sapiens
NCSTCQNMA

SEQ ID NO: 851642 - protein, 9 aa, Homo Sapiens
ARKMVLEII

SEQ ID NO: 851643 - protein, 9 aa, Homo Sapiens
EINTKEVAH

SEQ ID NO: 851644 - protein, 9 aa, Homo Sapiens
KLFQRLIHR

SEQ ID NO: 851645 - protein, 9 aa, Homo Sapiens
IMDGKIFEL

SEQ ID NO: 851646 - protein, 9 aa, Homo Sapiens
LKRTGLKVD

SEQ ID NO: 851647 - protein, 9 aa, Homo Sapiens
NTNKLLAYT

SEQ ID NO: 851648 - protein, 9 aa, Homo Sapiens
LKGKWLTPF

SEQ ID NO: 851649 - protein, 9 aa, Homo Sapiens
GPLENEQSI

SEQ ID NO: 851650 - protein, 9 aa, Homo Sapiens
KPQTVATPL

SEQ ID NO: 851651 - protein, 9 aa, Homo Sapiens
FTELQQKFI

SEQ ID NO: 851652 - protein, 9 aa, Homo Sapiens
VAARSIPPI

SEQ ID NO: 851653 - protein, 9 aa, Homo Sapiens
NLFFSRVRN

SEQ ID NO: 851654 - protein, 9 aa, Homo Sapiens
YETLEDDSN

SEQ ID NO: 851655 - protein, 9 aa, Homo Sapiens
PDNYFHENN

SEQ ID NO: 851656 - protein, 9 aa, Homo Sapiens
LFSDNAVLK

SEQ ID NO: 851657 - protein, 9 aa, Homo Sapiens
IEILGKSVF

SEQ ID NO: 851658 - protein, 9 aa, Homo Sapiens
DLRAESVTN

SEQ ID NO: 851659 - protein, 9 aa, Homo Sapiens
HILISRKHY

SEQ ID NO: 851660 - protein, 9 aa, Homo Sapiens
NQIMPNTGF

SEQ ID NO: 851661 - protein, 9 aa, Homo Sapiens
SSSEKDSQE

SEQ ID NO: 851662 - protein, 9 aa, Homo Sapiens
AHGPGHIHL

SEQ ID NO: 851663 - protein, 9 aa, Homo Sapiens
FTATGQSRV

SEQ ID NO: 851664 - protein, 9 aa, Homo Sapiens
AQKKINRLG

SEQ ID NO: 851665 - protein, 9 aa, Homo Sapiens
KNIEAPISK

SEQ ID NO: 851666 - protein, 9 aa, Homo Sapiens
GPSLGAIPQ

SEQ ID NO: 851667 - protein, 9 aa, Homo Sapiens
KVVMEYLGR

SEQ ID NO: 851668 - protein, 9 aa, Homo Sapiens
REEINVDVE

SEQ ID NO: 851669 - protein, 9 aa, Homo Sapiens
KVVMEYLGP

SEQ ID NO: 851670 - protein, 9 aa, Homo Sapiens
NRNARYFPL

SEQ ID NO: 851671 - protein, 9 aa, Homo Sapiens
PALAEIHPN

SEQ ID NO: 851672 - protein, 9 aa, Homo Sapiens
IETSTKTRQ

SEQ ID NO: 851673 - protein, 9 aa, Homo Sapiens
NINFLLRMD

SEQ ID NO: 851674 - protein, 9 aa, Homo Sapiens
ISKPDLITL

SEQ ID NO: 851675 - protein, 9 aa, Homo Sapiens
LDRPRFKRV

SEQ ID NO: 851676 - protein, 9 aa, Homo Sapiens
WDLLLNVDM

SEQ ID NO: 851677 - protein, 9 aa, Homo Sapiens
HANHEQLHT

SEQ ID NO: 851678 - protein, 9 aa, Homo Sapiens
PEMGMRLIC

SEQ ID NO: 851679 - protein, 9 aa, Homo Sapiens
PKDPAGPCF

SEQ ID NO: 851680 - protein, 9 aa, Homo Sapiens
PYNIQYTCL

SEQ ID NO: 851681 - protein, 9 aa, Homo Sapiens
SALGYDYKG

SEQ ID NO: 851682 - protein, 9 aa, Homo Sapiens
QVIGKYLAP

SEQ ID NO: 851683 - protein, 9 aa, Homo Sapiens
LDNCEDVAD

SEQ ID NO: 851684 - protein, 9 aa, Homo Sapiens
LKTVISSIY

SEQ ID NO: 851685 - protein, 9 aa, Homo Sapiens
ARALNLTER

SEQ ID NO: 851686 - protein, 9 aa, Homo Sapiens
PCTAFRATP

SEQ ID NO: 851687 - protein, 9 aa, Homo Sapiens
MYLQQYVEA

SEQ ID NO: 851688 - protein, 9 aa, Homo Sapiens
SHQKKLVLG

SEQ ID NO: 851689 - protein, 9 aa, Homo Sapiens
QNQLSALPA

SEQ ID NO: 851690 - protein, 9 aa, Homo Sapiens
STFKSTRNY

SEQ ID NO: 851691 - protein, 9 aa, Homo Sapiens
LERITRDNA

SEQ ID NO: 851692 - protein, 9 aa, Homo Sapiens
SAGKATSDP

SEQ ID NO: 851693 - protein, 9 aa, Homo Sapiens
EFGWINVFL

SEQ ID NO: 851694 - protein, 9 aa, Homo Sapiens
YFLPLPTGF

SEQ ID NO: 851695 - protein, 9 aa, Homo Sapiens
YYECMVQLF

SEQ ID NO: 851696 - protein, 9 aa, Homo Sapiens
LHKNRDKKT

SEQ ID NO: 851697 - protein, 9 aa, Homo Sapiens
GRRWLTLKE

SEQ ID NO: 851698 - protein, 9 aa, Homo Sapiens
CQELLDEWL

SEQ ID NO: 851699 - protein, 9 aa, Homo Sapiens
TKLLPSVTK

SEQ ID NO: 851700 - protein, 9 aa, Homo Sapiens
YPEGKLISN

SEQ ID NO: 851701 - protein, 9 aa, Homo Sapiens
AIVQDILHF

SEQ ID NO: 851702 - protein, 9 aa, Homo Sapiens
VGGQDKIQP

SEQ ID NO: 851703 - protein, 9 aa, Homo Sapiens
LCEMAVNTE

SEQ ID NO: 851704 - protein, 9 aa, Homo Sapiens
MIMKILKPA

SEQ ID NO: 851705 - protein, 9 aa, Homo Sapiens
VVDVPFDEG

SEQ ID NO: 851706 - protein, 9 aa, Homo Sapiens
TSDLSDWSS

SEQ ID NO: 851707 - protein, 9 aa, Homo Sapiens
DKYEQACNE

SEQ ID NO: 851708 - protein, 9 aa, Homo Sapiens
ETKGRGSPE

SEQ ID NO: 851709 - protein, 9 aa, Homo Sapiens
TYKEKGIPA

SEQ ID NO: 851710 - protein, 9 aa, Homo Sapiens
IRELLDPSH

SEQ ID NO: 851711 - protein, 9 aa, Homo Sapiens
DLVYSFHGL

SEQ ID NO: 851712 - protein, 9 aa, Homo Sapiens
IRTCSRDPT

SEQ ID NO: 851713 - protein, 9 aa, Homo Sapiens
YWSPAMAGG

SEQ ID NO: 851714 - protein, 9 aa, Homo Sapiens
IMQETSVIE

SEQ ID NO: 851715 - protein, 9 aa, Homo Sapiens
DLPKLASGE

SEQ ID NO: 851716 - protein, 9 aa, Homo Sapiens
NKPTYCLCH

SEQ ID NO: 851717 - protein, 9 aa, Homo Sapiens
LILLFCLFI

SEQ ID NO: 851718 - protein, 9 aa, Homo Sapiens
KQTQVLING

SEQ ID NO: 851719 - protein, 9 aa, Homo Sapiens
HEYKKMKEK

SEQ ID NO: 851720 - protein, 9 aa, Homo Sapiens
HVVVELFGV

SEQ ID NO: 851721 - protein, 9 aa, Homo Sapiens
NLQRHMVVK

SEQ ID NO: 851722 - protein, 9 aa, Homo Sapiens
VVAISCPLH

SEQ ID NO: 851723 - protein, 9 aa, Homo Sapiens
TKQLSDVCQ

SEQ ID NO: 851724 - protein, 9 aa, Homo Sapiens
KLIEKPMGI

SEQ ID NO: 851725 - protein, 9 aa, Homo Sapiens
PKYVKFQMK

SEQ ID NO: 851726 - protein, 9 aa, Homo Sapiens
LLHKSCVDP

SEQ ID NO: 851727 - protein, 9 aa, Homo Sapiens
VMSEVDCCG

SEQ ID NO: 851728 - protein, 9 aa, Homo Sapiens
ARCVAQVGP

SEQ ID NO: 851729 - protein, 9 aa, Homo Sapiens
TRLSFETKI

SEQ ID NO: 851730 - protein, 9 aa, Homo Sapiens
DEKSLEKAR

SEQ ID NO: 851731 - protein, 9 aa, Homo Sapiens
IHNRKEFAK

SEQ ID NO: 851732 - protein, 9 aa, Homo Sapiens
KEKEKEPGK

SEQ ID NO: 851733 - protein, 9 aa, Homo Sapiens
RKGSRKESY

SEQ ID NO: 851734 - protein, 9 aa, Homo Sapiens
IFQELKPQS

SEQ ID NO: 851735 - protein, 9 aa, Homo Sapiens
YINTIEDAV

SEQ ID NO: 851736 - protein, 9 aa, Homo Sapiens
PVGLITLAF

SEQ ID NO: 851737 - protein, 9 aa, Homo Sapiens
KQDTILACA

SEQ ID NO: 851738 - protein, 9 aa, Homo Sapiens
LTNFHEEPQ

SEQ ID NO: 851739 - protein, 9 aa, Homo Sapiens
KTSSRLDHG

SEQ ID NO: 851740 - protein, 9 aa, Homo Sapiens
KHLNSHMWK

SEQ ID NO: 851741 - protein, 9 aa, Homo Sapiens
LFLGATLSS

SEQ ID NO: 851742 - protein, 9 aa, Homo Sapiens
KTVLLKVPK

SEQ ID NO: 851743 - protein, 9 aa, Homo Sapiens
DQTALRVSS

SEQ ID NO: 851744 - protein, 9 aa, Homo Sapiens
LDAAAAEAK

SEQ ID NO: 851745 - protein, 9 aa, Homo Sapiens
DNLKEKSEG

SEQ ID NO: 851746 - protein, 9 aa, Homo Sapiens
LGSCAVSRE

SEQ ID NO: 851747 - protein, 9 aa, Homo Sapiens
QKHAYRYCK

SEQ ID NO: 851748 - protein, 9 aa, Homo Sapiens
NRGKYHCAV

SEQ ID NO: 851749 - protein, 9 aa, Homo Sapiens
SKIAKYMNH

SEQ ID NO: 851750 - protein, 9 aa, Homo Sapiens
PGFVFQFIP

SEQ ID NO: 851751 - protein, 9 aa, Homo Sapiens
LNKEFLNLQ

SEQ ID NO: 851752 - protein, 9 aa, Homo Sapiens
ETNTYFNIH

SEQ ID NO: 851753 - protein, 9 aa, Homo Sapiens
SWLLVIRVD

SEQ ID NO: 851754 - protein, 9 aa, Homo Sapiens
LQGYNNRNQ

SEQ ID NO: 851755 - protein, 9 aa, Homo Sapiens
GDDVDKYLA

SEQ ID NO: 851756 - protein, 9 aa, Homo Sapiens
DANNMMAAC

SEQ ID NO: 851757 - protein, 9 aa, Homo Sapiens
EYYDVSDSF

SEQ ID NO: 851758 - protein, 9 aa, Homo Sapiens
EVAQVVKLT

SEQ ID NO: 851759 - protein, 9 aa, Homo Sapiens
VQGVINEAD

SEQ ID NO: 851760 - protein, 9 aa, Homo Sapiens
VFNQKAKLA

SEQ ID NO: 851761 - protein, 9 aa, Homo Sapiens
GFPPLSYGS

SEQ ID NO: 851762 - protein, 9 aa, Homo Sapiens
DFLSFTNSD

SEQ ID NO: 851763 - protein, 9 aa, Homo Sapiens
TPIPRKLVA

SEQ ID NO: 851764 - protein, 9 aa, Homo Sapiens
TYGNYYWLL

SEQ ID NO: 851765 - protein, 9 aa, Homo Sapiens
YATETGKLQ

SEQ ID NO: 851766 - protein, 9 aa, Homo Sapiens
LGLTDNYQL

SEQ ID NO: 851767 - protein, 9 aa, Homo Sapiens
PTRAGALLL

SEQ ID NO: 851768 - protein, 9 aa, Homo Sapiens
SMHSSDYPS

SEQ ID NO: 851769 - protein, 9 aa, Homo Sapiens
LMELGTVER

SEQ ID NO: 851770 - protein, 9 aa, Homo Sapiens
HVTFSQRVA

SEQ ID NO: 851771 - protein, 9 aa, Homo Sapiens
YTGEKPYTC

SEQ ID NO: 851772 - protein, 9 aa, Homo Sapiens
YVKEELSNI

SEQ ID NO: 851773 - protein, 9 aa, Homo Sapiens
CYKRNEELS

SEQ ID NO: 851774 - protein, 9 aa, Homo Sapiens
GQNYFSLEL

SEQ ID NO: 851775 - protein, 9 aa, Homo Sapiens
GRWVEHRGW

SEQ ID NO: 851776 - protein, 9 aa, Homo Sapiens
LGRESPEPG

SEQ ID NO: 851777 - protein, 9 aa, Homo Sapiens
SRLDHGTES

SEQ ID NO: 851778 - protein, 9 aa, Homo Sapiens
NLILDSMKA

SEQ ID NO: 851779 - protein, 9 aa, Homo Sapiens
SGVIKKSSS

SEQ ID NO: 851780 - protein, 9 aa, Homo Sapiens
AVRQVLAVD

SEQ ID NO: 851781 - protein, 9 aa, Homo Sapiens
ALQGCDCDK

SEQ ID NO: 851782 - protein, 9 aa, Homo Sapiens
KKKRGRKCR

SEQ ID NO: 851783 - protein, 9 aa, Homo Sapiens
SSTSLGTLY

SEQ ID NO: 851784 - protein, 9 aa, Homo Sapiens
DLIQHFNIH

SEQ ID NO: 851785 - protein, 9 aa, Homo Sapiens
SDTCLANVL

SEQ ID NO: 851786 - protein, 9 aa, Homo Sapiens
KGEAKIAYF

SEQ ID NO: 851787 - protein, 9 aa, Homo Sapiens
MEFVSGYRN

SEQ ID NO: 851788 - protein, 9 aa, Homo Sapiens
YVPLFDPTG

SEQ ID NO: 851789 - protein, 9 aa, Homo Sapiens
YLDAELSLE

SEQ ID NO: 851790 - protein, 9 aa, Homo Sapiens
ASFRGHITM

SEQ ID NO: 851791 - protein, 9 aa, Homo Sapiens
SSTKHLKSV

SEQ ID NO: 851792 - protein, 9 aa, Homo Sapiens
ISETAQQNN

SEQ ID NO: 851793 - protein, 9 aa, Homo Sapiens
QSHTTATGE

SEQ ID NO: 851794 - protein, 9 aa, Homo Sapiens
PFLGIGLKH

SEQ ID NO: 851795 - protein, 9 aa, Homo Sapiens
NKAMLLGAL

SEQ ID NO: 851796 - protein, 9 aa, Homo Sapiens
SIQDIKALK

SEQ ID NO: 851797 - protein, 9 aa, Homo Sapiens
IITLNGKTM

SEQ ID NO: 851798 - protein, 9 aa, Homo Sapiens
TYVIYHDAL

SEQ ID NO: 851799 - protein, 9 aa, Homo Sapiens
LIMEVYHLS

SEQ ID NO: 851800 - protein, 9 aa, Homo Sapiens
NSGDGHIDP

SEQ ID NO: 851801 - protein, 9 aa, Homo Sapiens
YQAVNDEIE

SEQ ID NO: 851802 - protein, 9 aa, Homo Sapiens
SRSLLEILK

SEQ ID NO: 851803 - protein, 9 aa, Homo Sapiens
QHNRKVQSL

SEQ ID NO: 851804 - protein, 9 aa, Homo Sapiens
KRVCAQLNK

SEQ ID NO: 851805 - protein, 9 aa, Homo Sapiens
IFTIQARTP

SEQ ID NO: 851806 - protein, 9 aa, Homo Sapiens
SLTTLPILS

SEQ ID NO: 851807 - protein, 9 aa, Homo Sapiens
FLHQRQEII

SEQ ID NO: 851808 - protein, 9 aa, Homo Sapiens
KNKLFIKRT

SEQ ID NO: 851809 - protein, 9 aa, Homo Sapiens
EQTTTALPV

SEQ ID NO: 851810 - protein, 9 aa, Homo Sapiens
LIGSDVVDW

SEQ ID NO: 851811 - protein, 9 aa, Homo Sapiens
IRHKEAQFR

SEQ ID NO: 851812 - protein, 9 aa, Homo Sapiens
NLIVHQGTH

SEQ ID NO: 851813 - protein, 9 aa, Homo Sapiens
RADMNRLII

SEQ ID NO: 851814 - protein, 9 aa, Homo Sapiens
CNNLPGSFR

SEQ ID NO: 851815 - protein, 9 aa, Homo Sapiens
TAVQFKIPE

SEQ ID NO: 851816 - protein, 9 aa, Homo Sapiens
PEKLHFVFN

SEQ ID NO: 851817 - protein, 9 aa, Homo Sapiens
LLANQRRYW

SEQ ID NO: 851818 - protein, 9 aa, Homo Sapiens
SNLPCNHMR

SEQ ID NO: 851819 - protein, 9 aa, Homo Sapiens
TQIEKGIFK

SEQ ID NO: 851820 - protein, 9 aa, Homo Sapiens
RDFNSIFSN

SEQ ID NO: 851821 - protein, 9 aa, Homo Sapiens
SNPGLMNNA

SEQ ID NO: 851822 - protein, 9 aa, Homo Sapiens
LREAPDDIQ

SEQ ID NO: 851823 - protein, 9 aa, Homo Sapiens
LALTSTSNL

SEQ ID NO: 851824 - protein, 9 aa, Homo Sapiens
YNDSAHGVQ

SEQ ID NO: 851825 - protein, 9 aa, Homo Sapiens
CKECGKAVI

SEQ ID NO: 851826 - protein, 9 aa, Homo Sapiens
IMKTLTYRG

SEQ ID NO: 851827 - protein, 9 aa, Homo Sapiens
ARRAFNGER

SEQ ID NO: 851828 - protein, 9 aa, Homo Sapiens
NRLIINYLV

SEQ ID NO: 851829 - protein, 9 aa, Homo Sapiens
TSSSLATLP

SEQ ID NO: 851830 - protein, 9 aa, Homo Sapiens
AEENRNNRT

SEQ ID NO: 851831 - protein, 9 aa, Homo Sapiens
SDKLPSSSS

SEQ ID NO: 851832 - protein, 9 aa, Homo Sapiens
LLEAAESFH

SEQ ID NO: 851833 - protein, 9 aa, Homo Sapiens
NHMRFWAPG

SEQ ID NO: 851834 - protein, 9 aa, Homo Sapiens
FVEKQLMED

SEQ ID NO: 851835 - protein, 9 aa, Homo Sapiens
TKAVRTTGV

SEQ ID NO: 851836 - protein, 9 aa, Homo Sapiens
LWSWGQNEK

SEQ ID NO: 851837 - protein, 9 aa, Homo Sapiens
PRVLSGDPH

SEQ ID NO: 851838 - protein, 9 aa, Homo Sapiens
ELTMNKNTW

SEQ ID NO: 851839 - protein, 9 aa, Homo Sapiens
GPRMVGMSF

SEQ ID NO: 851840 - protein, 9 aa, Homo Sapiens
TGISYLIPS

SEQ ID NO: 851841 - protein, 9 aa, Homo Sapiens
ASQKLRINA

SEQ ID NO: 851842 - protein, 9 aa, Homo Sapiens
TKLPRVLSV

SEQ ID NO: 851843 - protein, 9 aa, Homo Sapiens
NREKFCNRE

SEQ ID NO: 851844 - protein, 9 aa, Homo Sapiens
DNFIQHNLQ

SEQ ID NO: 851845 - protein, 9 aa, Homo Sapiens
VLSAGFMPG

SEQ ID NO: 851846 - protein, 9 aa, Homo Sapiens
HYFPSVLWQ

SEQ ID NO: 851847 - protein, 9 aa, Homo Sapiens
ILSSTLSSP

SEQ ID NO: 851848 - protein, 9 aa, Homo Sapiens
KGQQLHKNQ

SEQ ID NO: 851849 - protein, 9 aa, Homo Sapiens
LKDLKLSYM

SEQ ID NO: 851850 - protein, 9 aa, Homo Sapiens
HIEFKCCGN

SEQ ID NO: 851851 - protein, 9 aa, Homo Sapiens
SNLTVHHII

SEQ ID NO: 851852 - protein, 9 aa, Homo Sapiens
GEFSVRDDL

SEQ ID NO: 851853 - protein, 9 aa, Homo Sapiens
VEEWWAQNA

SEQ ID NO: 851854 - protein, 9 aa, Homo Sapiens
RATRGIKNR

SEQ ID NO: 851855 - protein, 9 aa, Homo Sapiens
IAIWKHNKF

SEQ ID NO: 851856 - protein, 9 aa, Homo Sapiens
GAQTPLTGF

SEQ ID NO: 851857 - protein, 9 aa, Homo Sapiens
QNRRAKFCK

SEQ ID NO: 851858 - protein, 9 aa, Homo Sapiens
AGSHDNGSH

SEQ ID NO: 851859 - protein, 9 aa, Homo Sapiens
QLAVTRIST

SEQ ID NO: 851860 - protein, 9 aa, Homo Sapiens
DIVFARTSP

SEQ ID NO: 851861 - protein, 9 aa, Homo Sapiens
CGRNSNICH

SEQ ID NO: 851862 - protein, 9 aa, Homo Sapiens
QKEKCIKHI

SEQ ID NO: 851863 - protein, 9 aa, Homo Sapiens
SLLNNLIYL

SEQ ID NO: 851864 - protein, 9 aa, Homo Sapiens
NKRSLSKGS

SEQ ID NO: 851865 - protein, 9 aa, Homo Sapiens
PTELQNHEK

SEQ ID NO: 851866 - protein, 9 aa, Homo Sapiens
AKNVNMKPR

SEQ ID NO: 851867 - protein, 9 aa, Homo Sapiens
GEPFELKVY

SEQ ID NO: 851868 - protein, 9 aa, Homo Sapiens
AGGTKVLLL

SEQ ID NO: 851869 - protein, 9 aa, Homo Sapiens
KDRSCYICY

SEQ ID NO: 851870 - protein, 9 aa, Homo Sapiens
DDSLERKPS

SEQ ID NO: 851871 - protein, 9 aa, Homo Sapiens
GMDKLQNAS

SEQ ID NO: 851872 - protein, 9 aa, Homo Sapiens
TIKAELPLG

SEQ ID NO: 851873 - protein, 9 aa, Homo Sapiens
TETASCLLQ

SEQ ID NO: 851874 - protein, 9 aa, Homo Sapiens
QRDNLRLFK

SEQ ID NO: 851875 - protein, 9 aa, Homo Sapiens
YLVNYLHKN

SEQ ID NO: 851876 - protein, 9 aa, Homo Sapiens
CRYRENVCV

SEQ ID NO: 851877 - protein, 9 aa, Homo Sapiens
LILLALCTL

SEQ ID NO: 851878 - protein, 9 aa, Homo Sapiens
ELLLLKLST

SEQ ID NO: 851879 - protein, 9 aa, Homo Sapiens
QTVEIETQG

SEQ ID NO: 851880 - protein, 9 aa, Homo Sapiens
NLNKEKGLF

SEQ ID NO: 851881 - protein, 9 aa, Homo Sapiens
NTVFPVLQT

SEQ ID NO: 851882 - protein, 9 aa, Homo Sapiens
TAIHTYQSI

SEQ ID NO: 851883 - protein, 9 aa, Homo Sapiens
YLPELALDT

SEQ ID NO: 851884 - protein, 9 aa, Homo Sapiens
CSKENEEHK

SEQ ID NO: 851885 - protein, 9 aa, Homo Sapiens
ILRLFGDHV

SEQ ID NO: 851886 - protein, 9 aa, Homo Sapiens
PLYELVTST

SEQ ID NO: 851887 - protein, 9 aa, Homo Sapiens
SQAVNYGEL

SEQ ID NO: 851888 - protein, 9 aa, Homo Sapiens
GEAERHVGR

SEQ ID NO: 851889 - protein, 9 aa, Homo Sapiens
SLKDHKVSY

SEQ ID NO: 851890 - protein, 9 aa, Homo Sapiens
KFYFNRNPY

SEQ ID NO: 851891 - protein, 9 aa, Homo Sapiens
FYSLKNPSF

SEQ ID NO: 851892 - protein, 9 aa, Homo Sapiens
HTEFVLVRK

SEQ ID NO: 851893 - protein, 9 aa, Homo Sapiens
GMGLALFSN

SEQ ID NO: 851894 - protein, 9 aa, Homo Sapiens
VVDGKNKSE

SEQ ID NO: 851895 - protein, 9 aa, Homo Sapiens
RTIQGFEVL

SEQ ID NO: 851896 - protein, 9 aa, Homo Sapiens
FGYLSPSII

SEQ ID NO: 851897 - protein, 9 aa, Homo Sapiens
LGLLDGVRG

SEQ ID NO: 851898 - protein, 9 aa, Homo Sapiens
REGAPIKPD

SEQ ID NO: 851899 - protein, 9 aa, Homo Sapiens
LTCHRKLHT

SEQ ID NO: 851900 - protein, 9 aa, Homo Sapiens
TESNVNYYN

SEQ ID NO: 851901 - protein, 9 aa, Homo Sapiens
SNLNYLDEQ

SEQ ID NO: 851902 - protein, 9 aa, Homo Sapiens
LHYLVSAHG

SEQ ID NO: 851903 - protein, 9 aa, Homo Sapiens
LAMTAVVTN

SEQ ID NO: 851904 - protein, 9 aa, Homo Sapiens
FSHLSLLNI

SEQ ID NO: 851905 - protein, 9 aa, Homo Sapiens
DFFRDPLDW

SEQ ID NO: 851906 - protein, 9 aa, Homo Sapiens
SYERYNCYK

SEQ ID NO: 851907 - protein, 9 aa, Homo Sapiens
DTRVSTNGS

SEQ ID NO: 851908 - protein, 9 aa, Homo Sapiens
GVSNNVTQM

SEQ ID NO: 851909 - protein, 9 aa, Homo Sapiens
ETMKKKLSS

SEQ ID NO: 851910 - protein, 9 aa, Homo Sapiens
IIHTRTHSG

SEQ ID NO: 851911 - protein, 9 aa, Homo Sapiens
CLKTYTGHN

SEQ ID NO: 851912 - protein, 9 aa, Homo Sapiens
QANRTVLDN

SEQ ID NO: 851913 - protein, 9 aa, Homo Sapiens
SLLQHNMKC

SEQ ID NO: 851914 - protein, 9 aa, Homo Sapiens
AKVTADVVL

SEQ ID NO: 851915 - protein, 9 aa, Homo Sapiens
ETSYWKVHK

SEQ ID NO: 851916 - protein, 9 aa, Homo Sapiens
AEPPEKHIP

SEQ ID NO: 851917 - protein, 9 aa, Homo Sapiens
HNILRDDHA

SEQ ID NO: 851918 - protein, 9 aa, Homo Sapiens
VVLLAEGCL

SEQ ID NO: 851919 - protein, 9 aa, Homo Sapiens
EGHDFVLQC

SEQ ID NO: 851920 - protein, 9 aa, Homo Sapiens
QTGRKQHMK

SEQ ID NO: 851921 - protein, 9 aa, Homo Sapiens
STLNYCNLE

SEQ ID NO: 851922 - protein, 9 aa, Homo Sapiens
TIFLAATNI

SEQ ID NO: 851923 - protein, 9 aa, Homo Sapiens
LYIARQRNQ

SEQ ID NO: 851924 - protein, 9 aa, Homo Sapiens
GLQSGSARA

SEQ ID NO: 851925 - protein, 9 aa, Homo Sapiens
CVKDISAAN

SEQ ID NO: 851926 - protein, 9 aa, Homo Sapiens
NAIYFLGNY

SEQ ID NO: 851927 - protein, 9 aa, Homo Sapiens
TPGYIYYSN

SEQ ID NO: 851928 - protein, 9 aa, Homo Sapiens
KVIIFFDPD

SEQ ID NO: 851929 - protein, 9 aa, Homo Sapiens
STVNTGLMT

SEQ ID NO: 851930 - protein, 9 aa, Homo Sapiens
YQLGPPKHC

SEQ ID NO: 851931 - protein, 9 aa, Homo Sapiens
MTFKERVRS

SEQ ID NO: 851932 - protein, 9 aa, Homo Sapiens
NQSQDGAFC

SEQ ID NO: 851933 - protein, 9 aa, Homo Sapiens
KNLTVLNPM

SEQ ID NO: 851934 - protein, 9 aa, Homo Sapiens
SNGRRGRGC

SEQ ID NO: 851935 - protein, 9 aa, Homo Sapiens
HFNGKYMKT

SEQ ID NO: 851936 - protein, 9 aa, Homo Sapiens
LEPPEKLTQ

SEQ ID NO: 851937 - protein, 9 aa, Homo Sapiens
DGFPSNVLQ

SEQ ID NO: 851938 - protein, 9 aa, Homo Sapiens
RRRNAPLAA

SEQ ID NO: 851939 - protein, 9 aa, Homo Sapiens
FVRPGASYK

SEQ ID NO: 851940 - protein, 9 aa, Homo Sapiens
AVGVLEGKQ

SEQ ID NO: 851941 - protein, 9 aa, Homo Sapiens
RVCMFGPDK

SEQ ID NO: 851942 - protein, 9 aa, Homo Sapiens
LYKDVRQIF

SEQ ID NO: 851943 - protein, 9 aa, Homo Sapiens
KVSAQVITL

SEQ ID NO: 851944 - protein, 9 aa, Homo Sapiens
VNYLINPLL

SEQ ID NO: 851945 - protein, 9 aa, Homo Sapiens
LEEETRRQK

SEQ ID NO: 851946 - protein, 9 aa, Homo Sapiens
QQEDIKTSN

SEQ ID NO: 851947 - protein, 9 aa, Homo Sapiens
LDDTNHARE

SEQ ID NO: 851948 - protein, 9 aa, Homo Sapiens
AKTPPTPKT

SEQ ID NO: 851949 - protein, 9 aa, Homo Sapiens
VRVDIISWG

SEQ ID NO: 851950 - protein, 9 aa, Homo Sapiens
NTNAEGCIL

SEQ ID NO: 851951 - protein, 9 aa, Homo Sapiens
GRGAWACGY

SEQ ID NO: 851952 - protein, 9 aa, Homo Sapiens
HSSKEQHAR

SEQ ID NO: 851953 - protein, 9 aa, Homo Sapiens
RLYCLWKSR

SEQ ID NO: 851954 - protein, 9 aa, Homo Sapiens
TYVGKEESL

SEQ ID NO: 851955 - protein, 9 aa, Homo Sapiens
QEGKAPQCL

SEQ ID NO: 851956 - protein, 9 aa, Homo Sapiens
QMQEKTDII

SEQ ID NO: 851957 - protein, 9 aa, Homo Sapiens
HLRDCMDPT

SEQ ID NO: 851958 - protein, 9 aa, Homo Sapiens
DTIKRPSPD

SEQ ID NO: 851959 - protein, 9 aa, Homo Sapiens
EQYGKVLDC

SEQ ID NO: 851960 - protein, 9 aa, Homo Sapiens
PWDFLQVLE

SEQ ID NO: 851961 - protein, 9 aa, Homo Sapiens
QSASDESSG

SEQ ID NO: 851962 - protein, 9 aa, Homo Sapiens
LQYFITVVP

SEQ ID NO: 851963 - protein, 9 aa, Homo Sapiens
AAGAILQAN

SEQ ID NO: 851964 - protein, 9 aa, Homo Sapiens
PNNSIKTEP

SEQ ID NO: 851965 - protein, 9 aa, Homo Sapiens
EGSLKDKKS

SEQ ID NO: 851966 - protein, 9 aa, Homo Sapiens
MLRGEKNQQ

SEQ ID NO: 851967 - protein, 9 aa, Homo Sapiens
SIRKGYRRI

SEQ ID NO: 851968 - protein, 9 aa, Homo Sapiens
GVSSVTDAD

SEQ ID NO: 851969 - protein, 9 aa, Homo Sapiens
ITAEIFTTE

SEQ ID NO: 851970 - protein, 9 aa, Homo Sapiens
LLKVAQEAI

SEQ ID NO: 851971 - protein, 9 aa, Homo Sapiens
KLKREKKPK

SEQ ID NO: 851972 - protein, 9 aa, Homo Sapiens
VKNKTFKCH

SEQ ID NO: 851973 - protein, 9 aa, Homo Sapiens
TSQNNLQEK

SEQ ID NO: 851974 - protein, 9 aa, Homo Sapiens
YVKMAKDRI

SEQ ID NO: 851975 - protein, 9 aa, Homo Sapiens
TFSILNFLN

SEQ ID NO: 851976 - protein, 9 aa, Homo Sapiens
RKMEDDKLE

SEQ ID NO: 851977 - protein, 9 aa, Homo Sapiens
TEESVEVLW

SEQ ID NO: 851978 - protein, 9 aa, Homo Sapiens
VQKEKNVAG

SEQ ID NO: 851979 - protein, 9 aa, Homo Sapiens
ENGRVITCF

SEQ ID NO: 851980 - protein, 9 aa, Homo Sapiens
TSPSRPKAQ

SEQ ID NO: 851981 - protein, 9 aa, Homo Sapiens
IEKGIFKLV

SEQ ID NO: 851982 - protein, 9 aa, Homo Sapiens
WKRTCSIPK

SEQ ID NO: 851983 - protein, 9 aa, Homo Sapiens
HITKMLLTF

SEQ ID NO: 851984 - protein, 9 aa, Homo Sapiens
PNKPTYCLC

SEQ ID NO: 851985 - protein, 9 aa, Homo Sapiens
FRKFNKRKE

SEQ ID NO: 851986 - protein, 9 aa, Homo Sapiens
VIRITGRDV

SEQ ID NO: 851987 - protein, 9 aa, Homo Sapiens
RLKPAIKFA

SEQ ID NO: 851988 - protein, 9 aa, Homo Sapiens
INQAFLQSH

SEQ ID NO: 851989 - protein, 9 aa, Homo Sapiens
VCLTRHILL

SEQ ID NO: 851990 - protein, 9 aa, Homo Sapiens
DHVQSENSC

SEQ ID NO: 851991 - protein, 9 aa, Homo Sapiens
ELFPDITRP

SEQ ID NO: 851992 - protein, 9 aa, Homo Sapiens
KKKMTLSEF

SEQ ID NO: 851993 - protein, 9 aa, Homo Sapiens
MGAANQETS

SEQ ID NO: 851994 - protein, 9 aa, Homo Sapiens
MYQNYIAEL

SEQ ID NO: 851995 - protein, 9 aa, Homo Sapiens
LGNVIRSEE

SEQ ID NO: 851996 - protein, 9 aa, Homo Sapiens
VKGIKKEVN

SEQ ID NO: 851997 - protein, 9 aa, Homo Sapiens
LGGAGLAVI

SEQ ID NO: 851998 - protein, 9 aa, Homo Sapiens
RWKCISQAL

SEQ ID NO: 851999 - protein, 9 aa, Homo Sapiens
RIRKGHMEY

SEQ ID NO: 852000 - protein, 9 aa, Homo Sapiens
TDMRLTKLA

SEQ ID NO: 852001 - protein, 9 aa, Homo Sapiens
GAAASSPGE

SEQ ID NO: 852002 - protein, 9 aa, Homo Sapiens
KSSYNYILA

SEQ ID NO: 852003 - protein, 9 aa, Homo Sapiens
NGRGCTDYV

SEQ ID NO: 852004 - protein, 9 aa, Homo Sapiens
DDLSNPVGQ

SEQ ID NO: 852005 - protein, 9 aa, Homo Sapiens
AHECQRCNC

SEQ ID NO: 852006 - protein, 9 aa, Homo Sapiens
EQPEINRQK

SEQ ID NO: 852007 - protein, 9 aa, Homo Sapiens
YKVVMLGAW

SEQ ID NO: 852008 - protein, 9 aa, Homo Sapiens
PAKAEKLAI

SEQ ID NO: 852009 - protein, 9 aa, Homo Sapiens
TVPSGLSTL

SEQ ID NO: 852010 - protein, 9 aa, Homo Sapiens
HFKSNNLKS

SEQ ID NO: 852011 - protein, 9 aa, Homo Sapiens
IQWLVKFIH

SEQ ID NO: 852012 - protein, 9 aa, Homo Sapiens
NISYGLPAV

SEQ ID NO: 852013 - protein, 9 aa, Homo Sapiens
KSKGFGVFN

SEQ ID NO: 852014 - protein, 9 aa, Homo Sapiens
EDEEDGEED

SEQ ID NO: 852015 - protein, 9 aa, Homo Sapiens
DKELSCTVV

SEQ ID NO: 852016 - protein, 9 aa, Homo Sapiens
ADAERSIVS

SEQ ID NO: 852017 - protein, 9 aa, Homo Sapiens
QRGASSSPQ

SEQ ID NO: 852018 - protein, 9 aa, Homo Sapiens
GGGHNALKG

SEQ ID NO: 852019 - protein, 9 aa, Homo Sapiens
GLLHCLTTI

SEQ ID NO: 852020 - protein, 9 aa, Homo Sapiens
TRLNLFKRS

SEQ ID NO: 852021 - protein, 9 aa, Homo Sapiens
KKLRIQSSF

SEQ ID NO: 852022 - protein, 9 aa, Homo Sapiens
LSMFLIKCR

SEQ ID NO: 852023 - protein, 9 aa, Homo Sapiens
SWTPLKFLV

SEQ ID NO: 852024 - protein, 9 aa, Homo Sapiens
VLSVETGFH

SEQ ID NO: 852025 - protein, 9 aa, Homo Sapiens
KDSIKAQDL

SEQ ID NO: 852026 - protein, 9 aa, Homo Sapiens
KTFLVFQDI

SEQ ID NO: 852027 - protein, 9 aa, Homo Sapiens
GPSRSFKDE

SEQ ID NO: 852028 - protein, 9 aa, Homo Sapiens
TIGQISPDG

SEQ ID NO: 852029 - protein, 9 aa, Homo Sapiens
RLRRTLWAL

SEQ ID NO: 852030 - protein, 9 aa, Homo Sapiens
QSLRPDQTR

SEQ ID NO: 852031 - protein, 9 aa, Homo Sapiens
MKALEYLEL

SEQ ID NO: 852032 - protein, 9 aa, Homo Sapiens
IFVWFICIS

SEQ ID NO: 852033 - protein, 9 aa, Homo Sapiens
IKMAHIGVG

SEQ ID NO: 852034 - protein, 9 aa, Homo Sapiens
NSGYDSMGL

SEQ ID NO: 852035 - protein, 9 aa, Homo Sapiens
LDPQGLMNS

SEQ ID NO: 852036 - protein, 9 aa, Homo Sapiens
DSDIRLVRW

SEQ ID NO: 852037 - protein, 9 aa, Homo Sapiens
YSRHHSLSS

SEQ ID NO: 852038 - protein, 9 aa, Homo Sapiens
AVSPSQIWN

SEQ ID NO: 852039 - protein, 9 aa, Homo Sapiens
SEGKGRVKH

SEQ ID NO: 852040 - protein, 9 aa, Homo Sapiens
SETIKNYMM

SEQ ID NO: 852041 - protein, 9 aa, Homo Sapiens
QNLNKEKGL

SEQ ID NO: 852042 - protein, 9 aa, Homo Sapiens
YILVGGIGL

SEQ ID NO: 852043 - protein, 9 aa, Homo Sapiens
ELKLMEEQY

SEQ ID NO: 852044 - protein, 9 aa, Homo Sapiens
PPGSPFNER

SEQ ID NO: 852045 - protein, 9 aa, Homo Sapiens
NVPYNHIDD

SEQ ID NO: 852046 - protein, 9 aa, Homo Sapiens
ALRFLQNNS

SEQ ID NO: 852047 - protein, 9 aa, Homo Sapiens
QARKMCNYN

SEQ ID NO: 852048 - protein, 9 aa, Homo Sapiens
RPRFKRVLG

SEQ ID NO: 852049 - protein, 9 aa, Homo Sapiens
IQILMVVRL

SEQ ID NO: 852050 - protein, 9 aa, Homo Sapiens
FWMTGLFNP

SEQ ID NO: 852051 - protein, 9 aa, Homo Sapiens
THEQMQTVI

SEQ ID NO: 852052 - protein, 9 aa, Homo Sapiens
GLCSLFVVS

SEQ ID NO: 852053 - protein, 9 aa, Homo Sapiens
QPSQMIVLT

SEQ ID NO: 852054 - protein, 9 aa, Homo Sapiens
ETTLSPEEL

SEQ ID NO: 852055 - protein, 9 aa, Homo Sapiens
LQERVRRKE

SEQ ID NO: 852056 - protein, 9 aa, Homo Sapiens
TSKPLPDRP

SEQ ID NO: 852057 - protein, 9 aa, Homo Sapiens
KANMPVRPK

SEQ ID NO: 852058 - protein, 9 aa, Homo Sapiens
NPCGYLMNG

SEQ ID NO: 852059 - protein, 9 aa, Homo Sapiens
VYKSHKREA

SEQ ID NO: 852060 - protein, 9 aa, Homo Sapiens
IQTDTSRGA

SEQ ID NO: 852061 - protein, 9 aa, Homo Sapiens
RLSEHAKIE

SEQ ID NO: 852062 - protein, 9 aa, Homo Sapiens
SLTFLYTLM

SEQ ID NO: 852063 - protein, 9 aa, Homo Sapiens
LLVSMYYIP

SEQ ID NO: 852064 - protein, 9 aa, Homo Sapiens
EDREPLSLI

SEQ ID NO: 852065 - protein, 9 aa, Homo Sapiens
FVKIIFSVI

SEQ ID NO: 852066 - protein, 9 aa, Homo Sapiens
CQSHVLSHA

SEQ ID NO: 852067 - protein, 9 aa, Homo Sapiens
EVIITAYNV

SEQ ID NO: 852068 - protein, 9 aa, Homo Sapiens
KLLLFTTTS

SEQ ID NO: 852069 - protein, 9 aa, Homo Sapiens
RPQCLVMAG

SEQ ID NO: 852070 - protein, 9 aa, Homo Sapiens
GWSPNFQTC

SEQ ID NO: 852071 - protein, 9 aa, Homo Sapiens
LDAELSLEE

SEQ ID NO: 852072 - protein, 9 aa, Homo Sapiens
EHQQIHTGE

SEQ ID NO: 852073 - protein, 9 aa, Homo Sapiens
ASSYSLSDL

SEQ ID NO: 852074 - protein, 9 aa, Homo Sapiens
WFHTSLLLE

SEQ ID NO: 852075 - protein, 9 aa, Homo Sapiens
VLLPSYPVA

SEQ ID NO: 852076 - protein, 9 aa, Homo Sapiens
KKVVQKEKN

SEQ ID NO: 852077 - protein, 9 aa, Homo Sapiens
VYKKVLLGV

SEQ ID NO: 852078 - protein, 9 aa, Homo Sapiens
QYDIEITII

SEQ ID NO: 852079 - protein, 9 aa, Homo Sapiens
TQMSFIFRL

SEQ ID NO: 852080 - protein, 9 aa, Homo Sapiens
SNQSYRDSG

SEQ ID NO: 852081 - protein, 9 aa, Homo Sapiens
AEIDSTFLN

SEQ ID NO: 852082 - protein, 9 aa, Homo Sapiens
GEGKAPQSL

SEQ ID NO: 852083 - protein, 9 aa, Homo Sapiens
EREVKEKIT

SEQ ID NO: 852084 - protein, 9 aa, Homo Sapiens
DNGDLREAF

SEQ ID NO: 852085 - protein, 9 aa, Homo Sapiens
FSHPSSFQN

SEQ ID NO: 852086 - protein, 9 aa, Homo Sapiens
DSHVLWAPR

SEQ ID NO: 852087 - protein, 9 aa, Homo Sapiens
AKKAISSTD

SEQ ID NO: 852088 - protein, 9 aa, Homo Sapiens
AEATTKLYQ

SEQ ID NO: 852089 - protein, 9 aa, Homo Sapiens
YGVLSFSLR

SEQ ID NO: 852090 - protein, 9 aa, Homo Sapiens
ATNASNTEK

SEQ ID NO: 852091 - protein, 9 aa, Homo Sapiens
GSPSEDVRV

SEQ ID NO: 852092 - protein, 9 aa, Homo Sapiens
DEFKYFFYI

SEQ ID NO: 852093 - protein, 9 aa, Homo Sapiens
PGANEKDKR

SEQ ID NO: 852094 - protein, 9 aa, Homo Sapiens
ARLTCAPPP

SEQ ID NO: 852095 - protein, 9 aa, Homo Sapiens
RKKSRYRSQ

SEQ ID NO: 852096 - protein, 9 aa, Homo Sapiens
LVLVAVALA

SEQ ID NO: 852097 - protein, 9 aa, Homo Sapiens
QPDNDIDRI

SEQ ID NO: 852098 - protein, 9 aa, Homo Sapiens
VSCSENTSS

SEQ ID NO: 852099 - protein, 9 aa, Homo Sapiens
FIMPQIPQT

SEQ ID NO: 852100 - protein, 9 aa, Homo Sapiens
LIQDLRWTS

SEQ ID NO: 852101 - protein, 9 aa, Homo Sapiens
KGPLFRFFE

SEQ ID NO: 852102 - protein, 9 aa, Homo Sapiens
PIPRAVPSA

SEQ ID NO: 852103 - protein, 9 aa, Homo Sapiens
PSEYPTSKD

SEQ ID NO: 852104 - protein, 9 aa, Homo Sapiens
VFSDLPCEE

SEQ ID NO: 852105 - protein, 9 aa, Homo Sapiens
EEPQALLTA

SEQ ID NO: 852106 - protein, 9 aa, Homo Sapiens
GLTSQPQAL

SEQ ID NO: 852107 - protein, 9 aa, Homo Sapiens
LLNFNCSTI

SEQ ID NO: 852108 - protein, 9 aa, Homo Sapiens
ILVPNEELL

SEQ ID NO: 852109 - protein, 9 aa, Homo Sapiens
DDGPSRIDH

SEQ ID NO: 852110 - protein, 9 aa, Homo Sapiens
KYILYRLRA

SEQ ID NO: 852111 - protein, 9 aa, Homo Sapiens
NTTSNSFIC

SEQ ID NO: 852112 - protein, 9 aa, Homo Sapiens
TFLVFQDIQ

SEQ ID NO: 852113 - protein, 9 aa, Homo Sapiens
KHYKVYKDV

SEQ ID NO: 852114 - protein, 9 aa, Homo Sapiens
YQNSLLKMI

SEQ ID NO: 852115 - protein, 9 aa, Homo Sapiens
QLPKQFLPT

SEQ ID NO: 852116 - protein, 9 aa, Homo Sapiens
IDQQIQKRQ

SEQ ID NO: 852117 - protein, 9 aa, Homo Sapiens
SSMSRALLY

SEQ ID NO: 852118 - protein, 9 aa, Homo Sapiens
NLYGTKIDY

SEQ ID NO: 852119 - protein, 9 aa, Homo Sapiens
EEPLDEAHD

SEQ ID NO: 852120 - protein, 9 aa, Homo Sapiens
LSDQQYQAI

SEQ ID NO: 852121 - protein, 9 aa, Homo Sapiens
TEFVLVRKD

SEQ ID NO: 852122 - protein, 9 aa, Homo Sapiens
IMTSQDCLE

SEQ ID NO: 852123 - protein, 9 aa, Homo Sapiens
AHDTLNATL

SEQ ID NO: 852124 - protein, 9 aa, Homo Sapiens
NISDKLNFG

SEQ ID NO: 852125 - protein, 9 aa, Homo Sapiens
ATVSTEQEK

SEQ ID NO: 852126 - protein, 9 aa, Homo Sapiens
EGWLSLAKV

SEQ ID NO: 852127 - protein, 9 aa, Homo Sapiens
FFWYRQYYG

SEQ ID NO: 852128 - protein, 9 aa, Homo Sapiens
QLCYSESMK

SEQ ID NO: 852129 - protein, 9 aa, Homo Sapiens
VKHKIQCQQ

SEQ ID NO: 852130 - protein, 9 aa, Homo Sapiens
TDRALALNL

SEQ ID NO: 852131 - protein, 9 aa, Homo Sapiens
QDTITNLNK

SEQ ID NO: 852132 - protein, 9 aa, Homo Sapiens
WMITISKGC

SEQ ID NO: 852133 - protein, 9 aa, Homo Sapiens
ADASGTENA

SEQ ID NO: 852134 - protein, 9 aa, Homo Sapiens
CRDVEQGEL

SEQ ID NO: 852135 - protein, 9 aa, Homo Sapiens
TMLENVGML

SEQ ID NO: 852136 - protein, 9 aa, Homo Sapiens
TRDNAAICT

SEQ ID NO: 852137 - protein, 9 aa, Homo Sapiens
RVEGVPVVV

SEQ ID NO: 852138 - protein, 9 aa, Homo Sapiens
RNGSMKAAL

SEQ ID NO: 852139 - protein, 9 aa, Homo Sapiens
FDGKELSGN

SEQ ID NO: 852140 - protein, 9 aa, Homo Sapiens
QIANANELK

SEQ ID NO: 852141 - protein, 9 aa, Homo Sapiens
CKDCWITFL

SEQ ID NO: 852142 - protein, 9 aa, Homo Sapiens
AKRKKHLYD

SEQ ID NO: 852143 - protein, 9 aa, Homo Sapiens
KHYLSTLGS

SEQ ID NO: 852144 - protein, 9 aa, Homo Sapiens
LIYRIWEPQ

SEQ ID NO: 852145 - protein, 9 aa, Homo Sapiens
LCQIQEPGS

SEQ ID NO: 852146 - protein, 9 aa, Homo Sapiens
VGIVKVVKP

SEQ ID NO: 852147 - protein, 9 aa, Homo Sapiens
QPQHNVMIS

SEQ ID NO: 852148 - protein, 9 aa, Homo Sapiens
SGLGTFILK

SEQ ID NO: 852149 - protein, 9 aa, Homo Sapiens
IYCLALNPE

SEQ ID NO: 852150 - protein, 9 aa, Homo Sapiens
KKKRWNHPK

SEQ ID NO: 852151 - protein, 9 aa, Homo Sapiens
FKLEKHSAP

SEQ ID NO: 852152 - protein, 9 aa, Homo Sapiens
VDSADAGQY

SEQ ID NO: 852153 - protein, 9 aa, Homo Sapiens
LGIISQEER

SEQ ID NO: 852154 - protein, 9 aa, Homo Sapiens
ALRLQTLQS

SEQ ID NO: 852155 - protein, 9 aa, Homo Sapiens
IKGYQCLIS

SEQ ID NO: 852156 - protein, 9 aa, Homo Sapiens
YFLGVVDLT

SEQ ID NO: 852157 - protein, 9 aa, Homo Sapiens
CMRNGPDAL

SEQ ID NO: 852158 - protein, 9 aa, Homo Sapiens
FTALEVRHF

SEQ ID NO: 852159 - protein, 9 aa, Homo Sapiens
MLQGAISKM

SEQ ID NO: 852160 - protein, 9 aa, Homo Sapiens
IGSYATYNQ

SEQ ID NO: 852161 - protein, 9 aa, Homo Sapiens
LTASGRNPV

SEQ ID NO: 852162 - protein, 9 aa, Homo Sapiens
AMNNSTKEF

SEQ ID NO: 852163 - protein, 9 aa, Homo Sapiens
STALGNGSY

SEQ ID NO: 852164 - protein, 9 aa, Homo Sapiens
FYIYYLCLD

SEQ ID NO: 852165 - protein, 9 aa, Homo Sapiens
LSRSDPHHC

SEQ ID NO: 852166 - protein, 9 aa, Homo Sapiens
YSGESGDES

SEQ ID NO: 852167 - protein, 9 aa, Homo Sapiens
SPKAEVTAR

SEQ ID NO: 852168 - protein, 9 aa, Homo Sapiens
TSCTVIFSN

SEQ ID NO: 852169 - protein, 9 aa, Homo Sapiens
QDKKQEQED

SEQ ID NO: 852170 - protein, 9 aa, Homo Sapiens
RIIHEAIIQ

SEQ ID NO: 852171 - protein, 9 aa, Homo Sapiens
GNIRITGIY

SEQ ID NO: 852172 - protein, 9 aa, Homo Sapiens
TSFSVLGLE

SEQ ID NO: 852173 - protein, 9 aa, Homo Sapiens
SAKAVDVLE

SEQ ID NO: 852174 - protein, 9 aa, Homo Sapiens
HSITQGAQR

SEQ ID NO: 852175 - protein, 9 aa, Homo Sapiens
IVQQQFCGK

SEQ ID NO: 852176 - protein, 9 aa, Homo Sapiens
KTNIWKKQE

SEQ ID NO: 852177 - protein, 9 aa, Homo Sapiens
LPLKFRDAE

SEQ ID NO: 852178 - protein, 9 aa, Homo Sapiens
QGHKLFRKI

SEQ ID NO: 852179 - protein, 9 aa, Homo Sapiens
ISLDLTSQD

SEQ ID NO: 852180 - protein, 9 aa, Homo Sapiens
IMKILKPAS

SEQ ID NO: 852181 - protein, 9 aa, Homo Sapiens
LGEIIEWID

SEQ ID NO: 852182 - protein, 9 aa, Homo Sapiens
LEQVEGGAI

SEQ ID NO: 852183 - protein, 9 aa, Homo Sapiens
VDARPLIQT

SEQ ID NO: 852184 - protein, 9 aa, Homo Sapiens
RRNNYGQLD

SEQ ID NO: 852185 - protein, 9 aa, Homo Sapiens
LRLLRSFKV

SEQ ID NO: 852186 - protein, 9 aa, Homo Sapiens
GHLVNLNGS

SEQ ID NO: 852187 - protein, 9 aa, Homo Sapiens
TPEAMPTHK

SEQ ID NO: 852188 - protein, 9 aa, Homo Sapiens
EFDTNGDGD

SEQ ID NO: 852189 - protein, 9 aa, Homo Sapiens
DGILFGGMC

SEQ ID NO: 852190 - protein, 9 aa, Homo Sapiens
NLGKKPSKL

SEQ ID NO: 852191 - protein, 9 aa, Homo Sapiens
KDPCQKGKC

SEQ ID NO: 852192 - protein, 9 aa, Homo Sapiens
MEHLFWSFT

SEQ ID NO: 852193 - protein, 9 aa, Homo Sapiens
HSPSMPENL

SEQ ID NO: 852194 - protein, 9 aa, Homo Sapiens
IVHNCLISS

SEQ ID NO: 852195 - protein, 9 aa, Homo Sapiens
YFRTVERIE

SEQ ID NO: 852196 - protein, 9 aa, Homo Sapiens
KLPNGSSSV

SEQ ID NO: 852197 - protein, 9 aa, Homo Sapiens
TVMSCDRYV

SEQ ID NO: 852198 - protein, 9 aa, Homo Sapiens
HLFQIKHLP

SEQ ID NO: 852199 - protein, 9 aa, Homo Sapiens
IIEDTACLE

SEQ ID NO: 852200 - protein, 9 aa, Homo Sapiens
KLKSILEII

SEQ ID NO: 852201 - protein, 9 aa, Homo Sapiens
RYFSEIKSQ

SEQ ID NO: 852202 - protein, 9 aa, Homo Sapiens
QSSRAIIKA

SEQ ID NO: 852203 - protein, 9 aa, Homo Sapiens
ISLKVKAMQ

SEQ ID NO: 852204 - protein, 9 aa, Homo Sapiens
RLFLPVVLK

SEQ ID NO: 852205 - protein, 9 aa, Homo Sapiens
VTTPTSLQV

SEQ ID NO: 852206 - protein, 9 aa, Homo Sapiens
EKNKILQGK

SEQ ID NO: 852207 - protein, 9 aa, Homo Sapiens
LFNNNPRHS

SEQ ID NO: 852208 - protein, 9 aa, Homo Sapiens
DLADVDCVL

SEQ ID NO: 852209 - protein, 9 aa, Homo Sapiens
LANLFVFLT

SEQ ID NO: 852210 - protein, 9 aa, Homo Sapiens
ETNILNMTT

SEQ ID NO: 852211 - protein, 9 aa, Homo Sapiens
HGKVFKKLI

SEQ ID NO: 852212 - protein, 9 aa, Homo Sapiens
PRETRVRAE

SEQ ID NO: 852213 - protein, 9 aa, Homo Sapiens
CGHCFGRQS

SEQ ID NO: 852214 - protein, 9 aa, Homo Sapiens
GQSGAKVMS

SEQ ID NO: 852215 - protein, 9 aa, Homo Sapiens
ILVENNYTN

SEQ ID NO: 852216 - protein, 9 aa, Homo Sapiens
SGSHEGPQL

SEQ ID NO: 852217 - protein, 9 aa, Homo Sapiens
SEDEWQCTA

SEQ ID NO: 852218 - protein, 9 aa, Homo Sapiens
ASPKAASTP

SEQ ID NO: 852219 - protein, 9 aa, Homo Sapiens
KGVAVFNTS

SEQ ID NO: 852220 - protein, 9 aa, Homo Sapiens
LSYFFGAAI

SEQ ID NO: 852221 - protein, 9 aa, Homo Sapiens
AVLKVRTEG

SEQ ID NO: 852222 - protein, 9 aa, Homo Sapiens
MIQTGIYPI

SEQ ID NO: 852223 - protein, 9 aa, Homo Sapiens
QMFQKEQSE

SEQ ID NO: 852224 - protein, 9 aa, Homo Sapiens
SQFIKHVEE

SEQ ID NO: 852225 - protein, 9 aa, Homo Sapiens
LFYLWGLFT

SEQ ID NO: 852226 - protein, 9 aa, Homo Sapiens
SSQMHHLNL

SEQ ID NO: 852227 - protein, 9 aa, Homo Sapiens
WTIPGYKPM

SEQ ID NO: 852228 - protein, 9 aa, Homo Sapiens
FQLVFSDLP

SEQ ID NO: 852229 - protein, 9 aa, Homo Sapiens
VRSDRDKLV

SEQ ID NO: 852230 - protein, 9 aa, Homo Sapiens
RTEKSKLNI

SEQ ID NO: 852231 - protein, 9 aa, Homo Sapiens
ETTKTPAGA

SEQ ID NO: 852232 - protein, 9 aa, Homo Sapiens
PDTLQTGGD

SEQ ID NO: 852233 - protein, 9 aa, Homo Sapiens
DCIGWLEDL

SEQ ID NO: 852234 - protein, 9 aa, Homo Sapiens
LEQRQATDD

SEQ ID NO: 852235 - protein, 9 aa, Homo Sapiens
LHVKVKGYE

SEQ ID NO: 852236 - protein, 9 aa, Homo Sapiens
KYISPPERK

SEQ ID NO: 852237 - protein, 9 aa, Homo Sapiens
ISSQISWPL

SEQ ID NO: 852238 - protein, 9 aa, Homo Sapiens
ILATNISRQ

SEQ ID NO: 852239 - protein, 9 aa, Homo Sapiens
VHITDLYPN

SEQ ID NO: 852240 - protein, 9 aa, Homo Sapiens
RVARSINGI

SEQ ID NO: 852241 - protein, 9 aa, Homo Sapiens
LDGKDCAIF

SEQ ID NO: 852242 - protein, 9 aa, Homo Sapiens
RNPDPQGLP

SEQ ID NO: 852243 - protein, 9 aa, Homo Sapiens
GLTAVVWTD

SEQ ID NO: 852244 - protein, 9 aa, Homo Sapiens
QSDQQDSAP

SEQ ID NO: 852245 - protein, 9 aa, Homo Sapiens
KGSRFQYSG

SEQ ID NO: 852246 - protein, 9 aa, Homo Sapiens
VEIKLESFE

SEQ ID NO: 852247 - protein, 9 aa, Homo Sapiens
ALCKKEINN

SEQ ID NO: 852248 - protein, 9 aa, Homo Sapiens
VVYGKQKYV

SEQ ID NO: 852249 - protein, 9 aa, Homo Sapiens
KKRQSKINE

SEQ ID NO: 852250 - protein, 9 aa, Homo Sapiens
RQSSTQVRS

SEQ ID NO: 852251 - protein, 9 aa, Homo Sapiens
NVDCDFCPV

SEQ ID NO: 852252 - protein, 9 aa, Homo Sapiens
MARFHKNLE

SEQ ID NO: 852253 - protein, 9 aa, Homo Sapiens
MSACQHMST

SEQ ID NO: 852254 - protein, 9 aa, Homo Sapiens
FSMLKTSMY

SEQ ID NO: 852255 - protein, 9 aa, Homo Sapiens
LAEKPKPVQ

SEQ ID NO: 852256 - protein, 9 aa, Homo Sapiens
LRQLCTYLP

SEQ ID NO: 852257 - protein, 9 aa, Homo Sapiens
APPTQPQIY

SEQ ID NO: 852258 - protein, 9 aa, Homo Sapiens
DSEEACQQN

SEQ ID NO: 852259 - protein, 9 aa, Homo Sapiens
GKLFLDSYK

SEQ ID NO: 852260 - protein, 9 aa, Homo Sapiens
VSRSLLEIL

SEQ ID NO: 852261 - protein, 9 aa, Homo Sapiens
VVQPAGASA

SEQ ID NO: 852262 - protein, 9 aa, Homo Sapiens
MAPLKGAQE

SEQ ID NO: 852263 - protein, 9 aa, Homo Sapiens
SQGAKPSLL

SEQ ID NO: 852264 - protein, 9 aa, Homo Sapiens
SKAKYLTDP

SEQ ID NO: 852265 - protein, 9 aa, Homo Sapiens
GNGSLTPGL

SEQ ID NO: 852266 - protein, 9 aa, Homo Sapiens
YDVFQYLAH

SEQ ID NO: 852267 - protein, 9 aa, Homo Sapiens
EVFSYFAHA

SEQ ID NO: 852268 - protein, 9 aa, Homo Sapiens
DESDSAVKM

SEQ ID NO: 852269 - protein, 9 aa, Homo Sapiens
EAAVYRVFK

SEQ ID NO: 852270 - protein, 9 aa, Homo Sapiens
MQRRDSYYM

SEQ ID NO: 852271 - protein, 9 aa, Homo Sapiens
ILARNLNVM

SEQ ID NO: 852272 - protein, 9 aa, Homo Sapiens
QIGSYAPAE

SEQ ID NO: 852273 - protein, 9 aa, Homo Sapiens
DNKYDPEKD

SEQ ID NO: 852274 - protein, 9 aa, Homo Sapiens
YLGLQPKMV

SEQ ID NO: 852275 - protein, 9 aa, Homo Sapiens
TDDEIDEDC

SEQ ID NO: 852276 - protein, 9 aa, Homo Sapiens
VNMEREQKH

SEQ ID NO: 852277 - protein, 9 aa, Homo Sapiens
FFLYTDLFL

SEQ ID NO: 852278 - protein, 9 aa, Homo Sapiens
AEVTARDVE

SEQ ID NO: 852279 - protein, 9 aa, Homo Sapiens
HWHTKKLPR

SEQ ID NO: 852280 - protein, 9 aa, Homo Sapiens
HYELLEDKS

SEQ ID NO: 852281 - protein, 9 aa, Homo Sapiens
KHEYKKMKE

SEQ ID NO: 852282 - protein, 9 aa, Homo Sapiens
NLWDILIKA

SEQ ID NO: 852283 - protein, 9 aa, Homo Sapiens
SLEDHRFDN

SEQ ID NO: 852284 - protein, 9 aa, Homo Sapiens
GILKTLLWC

SEQ ID NO: 852285 - protein, 9 aa, Homo Sapiens
DFDTIHSTV

SEQ ID NO: 852286 - protein, 9 aa, Homo Sapiens
TTERHHLFS

SEQ ID NO: 852287 - protein, 9 aa, Homo Sapiens
CRSNVAEHF

SEQ ID NO: 852288 - protein, 9 aa, Homo Sapiens
CVHNYPTQL

SEQ ID NO: 852289 - protein, 9 aa, Homo Sapiens
CTDPMSKQE

SEQ ID NO: 852290 - protein, 9 aa, Homo Sapiens
YPNIAERVK

SEQ ID NO: 852291 - protein, 9 aa, Homo Sapiens
AAVAPNISQ

SEQ ID NO: 852292 - protein, 9 aa, Homo Sapiens
QITQNYLKV

SEQ ID NO: 852293 - protein, 9 aa, Homo Sapiens
IMGLFNGCF

SEQ ID NO: 852294 - protein, 9 aa, Homo Sapiens
NGSVAYYVA

SEQ ID NO: 852295 - protein, 9 aa, Homo Sapiens
IPGSPGHTV

SEQ ID NO: 852296 - protein, 9 aa, Homo Sapiens
GGSIIGSQW

SEQ ID NO: 852297 - protein, 9 aa, Homo Sapiens
TVLFILTCM

SEQ ID NO: 852298 - protein, 9 aa, Homo Sapiens
PPAASCPDK

SEQ ID NO: 852299 - protein, 9 aa, Homo Sapiens
WVLRARQQT

SEQ ID NO: 852300 - protein, 9 aa, Homo Sapiens
CSKLKMLER

SEQ ID NO: 852301 - protein, 9 aa, Homo Sapiens
PFSGGEKQT

SEQ ID NO: 852302 - protein, 9 aa, Homo Sapiens
TTMYGLEYL

SEQ ID NO: 852303 - protein, 9 aa, Homo Sapiens
DRDRARLDY

SEQ ID NO: 852304 - protein, 9 aa, Homo Sapiens
DCLAQLCLA

SEQ ID NO: 852305 - protein, 9 aa, Homo Sapiens
RPPDVLLGA

SEQ ID NO: 852306 - protein, 9 aa, Homo Sapiens
IPGAEPDKM

SEQ ID NO: 852307 - protein, 9 aa, Homo Sapiens
KMNEKSVLL

SEQ ID NO: 852308 - protein, 9 aa, Homo Sapiens
SPKPSPNNS

SEQ ID NO: 852309 - protein, 9 aa, Homo Sapiens
CLDDNFLTT

SEQ ID NO: 852310 - protein, 9 aa, Homo Sapiens
QPQQQQQIA

SEQ ID NO: 852311 - protein, 9 aa, Homo Sapiens
KFDFIHDVN

SEQ ID NO: 852312 - protein, 9 aa, Homo Sapiens
RLQIVGFDP

SEQ ID NO: 852313 - protein, 9 aa, Homo Sapiens
NKLLKQHEY

SEQ ID NO: 852314 - protein, 9 aa, Homo Sapiens
DLMPKAEKN

SEQ ID NO: 852315 - protein, 9 aa, Homo Sapiens
IYYLCLDKK

SEQ ID NO: 852316 - protein, 9 aa, Homo Sapiens
CSTDFDCKE

SEQ ID NO: 852317 - protein, 9 aa, Homo Sapiens
LAQHQIVHT

SEQ ID NO: 852318 - protein, 9 aa, Homo Sapiens
WKTSLWNNN

SEQ ID NO: 852319 - protein, 9 aa, Homo Sapiens
RLKICFINM

SEQ ID NO: 852320 - protein, 9 aa, Homo Sapiens
IFEDGNINV

SEQ ID NO: 852321 - protein, 9 aa, Homo Sapiens
SKLFELIQG

SEQ ID NO: 852322 - protein, 9 aa, Homo Sapiens
VLHRASPCK

SEQ ID NO: 852323 - protein, 9 aa, Homo Sapiens
TMREINQIF

SEQ ID NO: 852324 - protein, 9 aa, Homo Sapiens
QHPFCEPVF

SEQ ID NO: 852325 - protein, 9 aa, Homo Sapiens
LSNLLNFDI

SEQ ID NO: 852326 - protein, 9 aa, Homo Sapiens
VGMKTRSPK

SEQ ID NO: 852327 - protein, 9 aa, Homo Sapiens
AFPRTDEFK

SEQ ID NO: 852328 - protein, 9 aa, Homo Sapiens
AFTMVFSLD

SEQ ID NO: 852329 - protein, 9 aa, Homo Sapiens
PAISPLTFL

SEQ ID NO: 852330 - protein, 9 aa, Homo Sapiens
ISINDYAKF

SEQ ID NO: 852331 - protein, 9 aa, Homo Sapiens
SDYSGRSSS

SEQ ID NO: 852332 - protein, 9 aa, Homo Sapiens
LPAAAHNLV

SEQ ID NO: 852333 - protein, 9 aa, Homo Sapiens
SHPHMASQL

SEQ ID NO: 852334 - protein, 9 aa, Homo Sapiens
KPGQVNISV

SEQ ID NO: 852335 - protein, 9 aa, Homo Sapiens
LTHWPEYFI

SEQ ID NO: 852336 - protein, 9 aa, Homo Sapiens
EMWKEGNII

SEQ ID NO: 852337 - protein, 9 aa, Homo Sapiens
TIQENMRYG

SEQ ID NO: 852338 - protein, 9 aa, Homo Sapiens
PDHMSLWRG

SEQ ID NO: 852339 - protein, 9 aa, Homo Sapiens
VMNDKGELY

SEQ ID NO: 852340 - protein, 9 aa, Homo Sapiens
FVLSQALRG

SEQ ID NO: 852341 - protein, 9 aa, Homo Sapiens
KPNKRKRHF

SEQ ID NO: 852342 - protein, 9 aa, Homo Sapiens
LYMRLEDES

SEQ ID NO: 852343 - protein, 9 aa, Homo Sapiens
STAINFGTK

SEQ ID NO: 852344 - protein, 9 aa, Homo Sapiens
PSMSKLLRH

SEQ ID NO: 852345 - protein, 9 aa, Homo Sapiens
LYKKMKGGE

SEQ ID NO: 852346 - protein, 9 aa, Homo Sapiens
HLSRLPLGG

SEQ ID NO: 852347 - protein, 9 aa, Homo Sapiens
EIEAILANM

SEQ ID NO: 852348 - protein, 9 aa, Homo Sapiens
CGSGSFNWH

SEQ ID NO: 852349 - protein, 9 aa, Homo Sapiens
TDNTKFMIF

SEQ ID NO: 852350 - protein, 9 aa, Homo Sapiens
KQLLGEVKR

SEQ ID NO: 852351 - protein, 9 aa, Homo Sapiens
NKLLTVYLC

SEQ ID NO: 852352 - protein, 9 aa, Homo Sapiens
PVVDESGKG

SEQ ID NO: 852353 - protein, 9 aa, Homo Sapiens
DVLNRCLEM

SEQ ID NO: 852354 - protein, 9 aa, Homo Sapiens
LFNLGSKVI

SEQ ID NO: 852355 - protein, 9 aa, Homo Sapiens
RHVGIFLDA

SEQ ID NO: 852356 - protein, 9 aa, Homo Sapiens
SCGVPDVGE

SEQ ID NO: 852357 - protein, 9 aa, Homo Sapiens
RMLVDFLSV

SEQ ID NO: 852358 - protein, 9 aa, Homo Sapiens
LLNEKYGEA

SEQ ID NO: 852359 - protein, 9 aa, Homo Sapiens
LAGLYNSGD

SEQ ID NO: 852360 - protein, 9 aa, Homo Sapiens
DSFNNTYQA

SEQ ID NO: 852361 - protein, 9 aa, Homo Sapiens
KICDLLVTN

SEQ ID NO: 852362 - protein, 9 aa, Homo Sapiens
DIKSLWSGL

SEQ ID NO: 852363 - protein, 9 aa, Homo Sapiens
LLLGWLHWG

SEQ ID NO: 852364 - protein, 9 aa, Homo Sapiens
IYFGAVLGK

SEQ ID NO: 852365 - protein, 9 aa, Homo Sapiens
NVTLRQIAH

SEQ ID NO: 852366 - protein, 9 aa, Homo Sapiens
IAHLGALKY

SEQ ID NO: 852367 - protein, 9 aa, Homo Sapiens
MPQIVNVTS

SEQ ID NO: 852368 - protein, 9 aa, Homo Sapiens
KKRSKQLLG

SEQ ID NO: 852369 - protein, 9 aa, Homo Sapiens
TPKQNGLYA

SEQ ID NO: 852370 - protein, 9 aa, Homo Sapiens
SNEGIELHS

SEQ ID NO: 852371 - protein, 9 aa, Homo Sapiens
STPMSSPDL

SEQ ID NO: 852372 - protein, 9 aa, Homo Sapiens
QGRLPKDLG

SEQ ID NO: 852373 - protein, 9 aa, Homo Sapiens
NNKLEELQT

SEQ ID NO: 852374 - protein, 9 aa, Homo Sapiens
NQFGLDEAE

SEQ ID NO: 852375 - protein, 9 aa, Homo Sapiens
WESLKYAVP

SEQ ID NO: 852376 - protein, 9 aa, Homo Sapiens
LQECLEHDR

SEQ ID NO: 852377 - protein, 9 aa, Homo Sapiens
MTQLLTLIF

SEQ ID NO: 852378 - protein, 9 aa, Homo Sapiens
LKHTQSITS

SEQ ID NO: 852379 - protein, 9 aa, Homo Sapiens
PLVLRHQYL

SEQ ID NO: 852380 - protein, 9 aa, Homo Sapiens
KENTKEDKF

SEQ ID NO: 852381 - protein, 9 aa, Homo Sapiens
LVIVKCVQD

SEQ ID NO: 852382 - protein, 9 aa, Homo Sapiens
KKTIDMLHI

SEQ ID NO: 852383 - protein, 9 aa, Homo Sapiens
EKLLDIRNK

SEQ ID NO: 852384 - protein, 9 aa, Homo Sapiens
TLIAVLWAV

SEQ ID NO: 852385 - protein, 9 aa, Homo Sapiens
TDDSNDYGD

SEQ ID NO: 852386 - protein, 9 aa, Homo Sapiens
YENIYIIIY

SEQ ID NO: 852387 - protein, 9 aa, Homo Sapiens
NLFSRHQSF

SEQ ID NO: 852388 - protein, 9 aa, Homo Sapiens
QIQRRAEEL

SEQ ID NO: 852389 - protein, 9 aa, Homo Sapiens
ASVEYLPPH

SEQ ID NO: 852390 - protein, 9 aa, Homo Sapiens
AHEEVRKLT

SEQ ID NO: 852391 - protein, 9 aa, Homo Sapiens
YVTIFGGSV

SEQ ID NO: 852392 - protein, 9 aa, Homo Sapiens
AKFKETRRR

SEQ ID NO: 852393 - protein, 9 aa, Homo Sapiens
NGSTNLVLI

SEQ ID NO: 852394 - protein, 9 aa, Homo Sapiens
LYTDGPLMP

SEQ ID NO: 852395 - protein, 9 aa, Homo Sapiens
EVSILSTFL

SEQ ID NO: 852396 - protein, 9 aa, Homo Sapiens
PERQPCFIV

SEQ ID NO: 852397 - protein, 9 aa, Homo Sapiens
AENKELQEE

SEQ ID NO: 852398 - protein, 9 aa, Homo Sapiens
AKYVSINSM

SEQ ID NO: 852399 - protein, 9 aa, Homo Sapiens
TCKTFRPAA

SEQ ID NO: 852400 - protein, 9 aa, Homo Sapiens
LNFNCSTIV

SEQ ID NO: 852401 - protein, 9 aa, Homo Sapiens
LFGSNAQYI

SEQ ID NO: 852402 - protein, 9 aa, Homo Sapiens
ITPCRTLIL

SEQ ID NO: 852403 - protein, 9 aa, Homo Sapiens
LILGSYAII

SEQ ID NO: 852404 - protein, 9 aa, Homo Sapiens
SREGLKQPS

SEQ ID NO: 852405 - protein, 9 aa, Homo Sapiens
CVCYVPYVA

SEQ ID NO: 852406 - protein, 9 aa, Homo Sapiens
DSIFVWFIC

SEQ ID NO: 852407 - protein, 9 aa, Homo Sapiens
VTLGITTVL

SEQ ID NO: 852408 - protein, 9 aa, Homo Sapiens
MLAQKNSIT

SEQ ID NO: 852409 - protein, 9 aa, Homo Sapiens
EDYQALQTS

SEQ ID NO: 852410 - protein, 9 aa, Homo Sapiens
NMEREQKHP

SEQ ID NO: 852411 - protein, 9 aa, Homo Sapiens
YQVHQSRVT

SEQ ID NO: 852412 - protein, 9 aa, Homo Sapiens
RAAFSEDQR

SEQ ID NO: 852413 - protein, 9 aa, Homo Sapiens
RPSLYWWLC

SEQ ID NO: 852414 - protein, 9 aa, Homo Sapiens
VLYKKCPLT

SEQ ID NO: 852415 - protein, 9 aa, Homo Sapiens
IKEVIEQTK

SEQ ID NO: 852416 - protein, 9 aa, Homo Sapiens
ELCDGNGNS

SEQ ID NO: 852417 - protein, 9 aa, Homo Sapiens
QKVWPNEEN

SEQ ID NO: 852418 - protein, 9 aa, Homo Sapiens
DRGLVHMIN

SEQ ID NO: 852419 - protein, 9 aa, Homo Sapiens
RRRMPGGGY

SEQ ID NO: 852420 - protein, 9 aa, Homo Sapiens
TDCTNARRN

SEQ ID NO: 852421 - protein, 9 aa, Homo Sapiens
KLKRHFVAH

SEQ ID NO: 852422 - protein, 9 aa, Homo Sapiens
FAIERYIAI

SEQ ID NO: 852423 - protein, 9 aa, Homo Sapiens
LGEDYLAAL

SEQ ID NO: 852424 - protein, 9 aa, Homo Sapiens
VVDLTTVYG

SEQ ID NO: 852425 - protein, 9 aa, Homo Sapiens
SDRDKLVIF

SEQ ID NO: 852426 - protein, 9 aa, Homo Sapiens
NQHKSEGNY

SEQ ID NO: 852427 - protein, 9 aa, Homo Sapiens
GGSLVILRF

SEQ ID NO: 852428 - protein, 9 aa, Homo Sapiens
KCQAMKKIC

SEQ ID NO: 852429 - protein, 9 aa, Homo Sapiens
EPDLDIKID

SEQ ID NO: 852430 - protein, 9 aa, Homo Sapiens
DEIKAAVKA

SEQ ID NO: 852431 - protein, 9 aa, Homo Sapiens
DRFSQEEIN

SEQ ID NO: 852432 - protein, 9 aa, Homo Sapiens
RKAKEEGAE

SEQ ID NO: 852433 - protein, 9 aa, Homo Sapiens
SLIQILMVV

SEQ ID NO: 852434 - protein, 9 aa, Homo Sapiens
EEPLVPTQS

SEQ ID NO: 852435 - protein, 9 aa, Homo Sapiens
AKSSVDDEI

SEQ ID NO: 852436 - protein, 9 aa, Homo Sapiens
KHYKFTVGV

SEQ ID NO: 852437 - protein, 9 aa, Homo Sapiens
KLFRKIIPA

SEQ ID NO: 852438 - protein, 9 aa, Homo Sapiens
TSSGLCQSV

SEQ ID NO: 852439 - protein, 9 aa, Homo Sapiens
VSVPVFIQV

SEQ ID NO: 852440 - protein, 9 aa, Homo Sapiens
FRKMMERRD

SEQ ID NO: 852441 - protein, 9 aa, Homo Sapiens
EDPPAKSKC

SEQ ID NO: 852442 - protein, 9 aa, Homo Sapiens
DLFGMGKEV

SEQ ID NO: 852443 - protein, 9 aa, Homo Sapiens
QSSYDIING

SEQ ID NO: 852444 - protein, 9 aa, Homo Sapiens
KREQHEDKP

SEQ ID NO: 852445 - protein, 9 aa, Homo Sapiens
DGYRYTSLL

SEQ ID NO: 852446 - protein, 9 aa, Homo Sapiens
LCLALMQKK

SEQ ID NO: 852447 - protein, 9 aa, Homo Sapiens
KLGFYNSNP

SEQ ID NO: 852448 - protein, 9 aa, Homo Sapiens
SQRCVTFHL

SEQ ID NO: 852449 - protein, 9 aa, Homo Sapiens
IKWTQIEKG

SEQ ID NO: 852450 - protein, 9 aa, Homo Sapiens
LSTFDVIKY

SEQ ID NO: 852451 - protein, 9 aa, Homo Sapiens
TLGETLSGL

SEQ ID NO: 852452 - protein, 9 aa, Homo Sapiens
QIEFINEKG

SEQ ID NO: 852453 - protein, 9 aa, Homo Sapiens
GRSRNEELG

SEQ ID NO: 852454 - protein, 9 aa, Homo Sapiens
RSKSKEEEE

SEQ ID NO: 852455 - protein, 9 aa, Homo Sapiens
ENNTTFLNI

SEQ ID NO: 852456 - protein, 9 aa, Homo Sapiens
HSQIKHQNL

SEQ ID NO: 852457 - protein, 9 aa, Homo Sapiens
FLQAHTPTL

SEQ ID NO: 852458 - protein, 9 aa, Homo Sapiens
PDANPMEHF

SEQ ID NO: 852459 - protein, 9 aa, Homo Sapiens
GREHAGCIF

SEQ ID NO: 852460 - protein, 9 aa, Homo Sapiens
VALQRQALK

SEQ ID NO: 852461 - protein, 9 aa, Homo Sapiens
TLEYRDSHS

SEQ ID NO: 852462 - protein, 9 aa, Homo Sapiens
KMYVQPFWI

SEQ ID NO: 852463 - protein, 9 aa, Homo Sapiens
LSWFAGLSL

SEQ ID NO: 852464 - protein, 9 aa, Homo Sapiens
STSEQRTPS

SEQ ID NO: 852465 - protein, 9 aa, Homo Sapiens
LQARINSLK

SEQ ID NO: 852466 - protein, 9 aa, Homo Sapiens
PYEPDLDIK

SEQ ID NO: 852467 - protein, 9 aa, Homo Sapiens
EWDEKIEEL

SEQ ID NO: 852468 - protein, 9 aa, Homo Sapiens
AKRNISVND

SEQ ID NO: 852469 - protein, 9 aa, Homo Sapiens
EALTAFTAL

SEQ ID NO: 852470 - protein, 9 aa, Homo Sapiens
LYNSGDGHI

SEQ ID NO: 852471 - protein, 9 aa, Homo Sapiens
GQAFTMAEM

SEQ ID NO: 852472 - protein, 9 aa, Homo Sapiens
CCPIFSSQA

SEQ ID NO: 852473 - protein, 9 aa, Homo Sapiens
LWVDPCYVL

SEQ ID NO: 852474 - protein, 9 aa, Homo Sapiens
NPGYVTIFG

SEQ ID NO: 852475 - protein, 9 aa, Homo Sapiens
QAVDIWSVG

SEQ ID NO: 852476 - protein, 9 aa, Homo Sapiens
TNLDLNDQV

SEQ ID NO: 852477 - protein, 9 aa, Homo Sapiens
SRYNFHSLK

SEQ ID NO: 852478 - protein, 9 aa, Homo Sapiens
RFFCELPSL

SEQ ID NO: 852479 - protein, 9 aa, Homo Sapiens
EHLFGVALE

SEQ ID NO: 852480 - protein, 9 aa, Homo Sapiens
SETCTYLYL

SEQ ID NO: 852481 - protein, 9 aa, Homo Sapiens
TLIQTDTSR

SEQ ID NO: 852482 - protein, 9 aa, Homo Sapiens
WQGITHLKL

SEQ ID NO: 852483 - protein, 9 aa, Homo Sapiens
LHLIEHQKI

SEQ ID NO: 852484 - protein, 9 aa, Homo Sapiens
ELILKRLII

SEQ ID NO: 852485 - protein, 9 aa, Homo Sapiens
EFCQEVVNL

SEQ ID NO: 852486 - protein, 9 aa, Homo Sapiens
SNHVVRNSR

SEQ ID NO: 852487 - protein, 9 aa, Homo Sapiens
DERRYWKVF

SEQ ID NO: 852488 - protein, 9 aa, Homo Sapiens
TVIIEETGN

SEQ ID NO: 852489 - protein, 9 aa, Homo Sapiens
LKTLLEIMD

SEQ ID NO: 852490 - protein, 9 aa, Homo Sapiens
NTVLETKWA

SEQ ID NO: 852491 - protein, 9 aa, Homo Sapiens
CDKSFSHLS

SEQ ID NO: 852492 - protein, 9 aa, Homo Sapiens
NYFTLDAQN

SEQ ID NO: 852493 - protein, 9 aa, Homo Sapiens
RRDSLSVPH

SEQ ID NO: 852494 - protein, 9 aa, Homo Sapiens
FIYHDQVPD

SEQ ID NO: 852495 - protein, 9 aa, Homo Sapiens
STLKAWLNG

SEQ ID NO: 852496 - protein, 9 aa, Homo Sapiens
THLVDEDTT

SEQ ID NO: 852497 - protein, 9 aa, Homo Sapiens
EVEKLKESA

SEQ ID NO: 852498 - protein, 9 aa, Homo Sapiens
VPGEMLKKA

SEQ ID NO: 852499 - protein, 9 aa, Homo Sapiens
SGSLQRDMQ

SEQ ID NO: 852500 - protein, 9 aa, Homo Sapiens
KPVQLLLDF

SEQ ID NO: 852501 - protein, 9 aa, Homo Sapiens
ITKKKSDPL

SEQ ID NO: 852502 - protein, 9 aa, Homo Sapiens
IIYIGESSQ

SEQ ID NO: 852503 - protein, 9 aa, Homo Sapiens
QLIKQIRHQ

SEQ ID NO: 852504 - protein, 9 aa, Homo Sapiens
NYNKQSSEQ

SEQ ID NO: 852505 - protein, 9 aa, Homo Sapiens
VEEWWSEFK

SEQ ID NO: 852506 - protein, 9 aa, Homo Sapiens
MHIPYFPSL

SEQ ID NO: 852507 - protein, 9 aa, Homo Sapiens
RRDPSEEIE

SEQ ID NO: 852508 - protein, 9 aa, Homo Sapiens
SITPEALIC

SEQ ID NO: 852509 - protein, 9 aa, Homo Sapiens
MSASLNSLL

SEQ ID NO: 852510 - protein, 9 aa, Homo Sapiens
YTLLENMNK

SEQ ID NO: 852511 - protein, 9 aa, Homo Sapiens
SHFYLKKGA

SEQ ID NO: 852512 - protein, 9 aa, Homo Sapiens
QNNLASLIQ

SEQ ID NO: 852513 - protein, 9 aa, Homo Sapiens
YVYFPRIGD

SEQ ID NO: 852514 - protein, 9 aa, Homo Sapiens
KRVVINISG

SEQ ID NO: 852515 - protein, 9 aa, Homo Sapiens
QLISNKGTE

SEQ ID NO: 852516 - protein, 9 aa, Homo Sapiens
WDTVSWIFS

SEQ ID NO: 852517 - protein, 9 aa, Homo Sapiens
VVNLIGLIP

SEQ ID NO: 852518 - protein, 9 aa, Homo Sapiens
LTNTGAPHQ

SEQ ID NO: 852519 - protein, 9 aa, Homo Sapiens
EYEQAAAHT

SEQ ID NO: 852520 - protein, 9 aa, Homo Sapiens
GEVEKLKES

SEQ ID NO: 852521 - protein, 9 aa, Homo Sapiens
PPRDFLLYI

SEQ ID NO: 852522 - protein, 9 aa, Homo Sapiens
LSHLPVTEA

SEQ ID NO: 852523 - protein, 9 aa, Homo Sapiens
EGLGTGPEK

SEQ ID NO: 852524 - protein, 9 aa, Homo Sapiens
GLTKHVQIH

SEQ ID NO: 852525 - protein, 9 aa, Homo Sapiens
VLAPEQSFK

SEQ ID NO: 852526 - protein, 9 aa, Homo Sapiens
LWVTEWLPM

SEQ ID NO: 852527 - protein, 9 aa, Homo Sapiens
SYLIVHKIT

SEQ ID NO: 852528 - protein, 9 aa, Homo Sapiens
LITTSLLTF

SEQ ID NO: 852529 - protein, 9 aa, Homo Sapiens
SVPCTAFRA

SEQ ID NO: 852530 - protein, 9 aa, Homo Sapiens
DLFNTAIEM

SEQ ID NO: 852531 - protein, 9 aa, Homo Sapiens
GQPTGNVWW

SEQ ID NO: 852532 - protein, 9 aa, Homo Sapiens
WALRIKSYN

SEQ ID NO: 852533 - protein, 9 aa, Homo Sapiens
ASKQSMINS

SEQ ID NO: 852534 - protein, 9 aa, Homo Sapiens
SRIQYCIPS

SEQ ID NO: 852535 - protein, 9 aa, Homo Sapiens
VILLKDAKE

SEQ ID NO: 852536 - protein, 9 aa, Homo Sapiens
WLVKFIHGQ

SEQ ID NO: 852537 - protein, 9 aa, Homo Sapiens
AGEAERHVG

SEQ ID NO: 852538 - protein, 9 aa, Homo Sapiens
RQLRKEHEK

SEQ ID NO: 852539 - protein, 9 aa, Homo Sapiens
YFTGNAQKA

SEQ ID NO: 852540 - protein, 9 aa, Homo Sapiens
KPKPVQLLL

SEQ ID NO: 852541 - protein, 9 aa, Homo Sapiens
GSNLHVKVK

SEQ ID NO: 852542 - protein, 9 aa, Homo Sapiens
SNNKHLNNI

SEQ ID NO: 852543 - protein, 9 aa, Homo Sapiens
KYLRKLKRQ

SEQ ID NO: 852544 - protein, 9 aa, Homo Sapiens
EKANPNIND

SEQ ID NO: 852545 - protein, 9 aa, Homo Sapiens
NYDSSSWPQ

SEQ ID NO: 852546 - protein, 9 aa, Homo Sapiens
LEGERSARL

SEQ ID NO: 852547 - protein, 9 aa, Homo Sapiens
LSPAGKIYL

SEQ ID NO: 852548 - protein, 9 aa, Homo Sapiens
IRTKQLFEC

SEQ ID NO: 852549 - protein, 9 aa, Homo Sapiens
TPRKGDKIY

SEQ ID NO: 852550 - protein, 9 aa, Homo Sapiens
LNRHWVHRE

SEQ ID NO: 852551 - protein, 9 aa, Homo Sapiens
SRRERQQAN

SEQ ID NO: 852552 - protein, 9 aa, Homo Sapiens
NHWAVLSPH

SEQ ID NO: 852553 - protein, 9 aa, Homo Sapiens
VKHRCVTNP

SEQ ID NO: 852554 - protein, 9 aa, Homo Sapiens
QQEWENNLR

SEQ ID NO: 852555 - protein, 9 aa, Homo Sapiens
VTVEFTRDE

SEQ ID NO: 852556 - protein, 9 aa, Homo Sapiens
KGKEIFAFK

SEQ ID NO: 852557 - protein, 9 aa, Homo Sapiens
TEPLARERI

SEQ ID NO: 852558 - protein, 9 aa, Homo Sapiens
QIVGFDPRL

SEQ ID NO: 852559 - protein, 9 aa, Homo Sapiens
ATVRGPCSV

SEQ ID NO: 852560 - protein, 9 aa, Homo Sapiens
KFISNQRIY

SEQ ID NO: 852561 - protein, 9 aa, Homo Sapiens
LSFFYHYML

SEQ ID NO: 852562 - protein, 9 aa, Homo Sapiens
DISDEVTCV

SEQ ID NO: 852563 - protein, 9 aa, Homo Sapiens
YDTSQDEQD

SEQ ID NO: 852564 - protein, 9 aa, Homo Sapiens
NMANVLRGF

SEQ ID NO: 852565 - protein, 9 aa, Homo Sapiens
CIVRDSRHL

SEQ ID NO: 852566 - protein, 9 aa, Homo Sapiens
NEFCQEVVN

SEQ ID NO: 852567 - protein, 9 aa, Homo Sapiens
RKHDEDRRF

SEQ ID NO: 852568 - protein, 9 aa, Homo Sapiens
FLQLRKDFG

SEQ ID NO: 852569 - protein, 9 aa, Homo Sapiens
TTKMNILKF

SEQ ID NO: 852570 - protein, 9 aa, Homo Sapiens
DQLSCLGSS

SEQ ID NO: 852571 - protein, 9 aa, Homo Sapiens
KTPKMLRMS

SEQ ID NO: 852572 - protein, 9 aa, Homo Sapiens
ELQRCLRDP

SEQ ID NO: 852573 - protein, 9 aa, Homo Sapiens
VDPNKPTYC

SEQ ID NO: 852574 - protein, 9 aa, Homo Sapiens
GVHKLHYLI

SEQ ID NO: 852575 - protein, 9 aa, Homo Sapiens
SAPNPDGKI

SEQ ID NO: 852576 - protein, 9 aa, Homo Sapiens
QPSPDIIPP

SEQ ID NO: 852577 - protein, 9 aa, Homo Sapiens
NNGRLDPQE

SEQ ID NO: 852578 - protein, 9 aa, Homo Sapiens
NSHSMKKYL

SEQ ID NO: 852579 - protein, 9 aa, Homo Sapiens
RLYLCGLSD

SEQ ID NO: 852580 - protein, 9 aa, Homo Sapiens
FLFKFLFTC

SEQ ID NO: 852581 - protein, 9 aa, Homo Sapiens
HNLGGLLAA

SEQ ID NO: 852582 - protein, 9 aa, Homo Sapiens
VWMPSPVSP

SEQ ID NO: 852583 - protein, 9 aa, Homo Sapiens
LRFTMLRAQ

SEQ ID NO: 852584 - protein, 9 aa, Homo Sapiens
TFGRPLNIV

SEQ ID NO: 852585 - protein, 9 aa, Homo Sapiens
TKTPIFQAN

SEQ ID NO: 852586 - protein, 9 aa, Homo Sapiens
GRCKALSSC

SEQ ID NO: 852587 - protein, 9 aa, Homo Sapiens
VKMASDYLM

SEQ ID NO: 852588 - protein, 9 aa, Homo Sapiens
QQHQEYQEL

SEQ ID NO: 852589 - protein, 9 aa, Homo Sapiens
SVRKTLFLC

SEQ ID NO: 852590 - protein, 9 aa, Homo Sapiens
RFSNSSSAN

SEQ ID NO: 852591 - protein, 9 aa, Homo Sapiens
IVVSNAWAV

SEQ ID NO: 852592 - protein, 9 aa, Homo Sapiens
MQQQLGEYQ

SEQ ID NO: 852593 - protein, 9 aa, Homo Sapiens
LYTKTEACQ

SEQ ID NO: 852594 - protein, 9 aa, Homo Sapiens
VFNTSVAPL

SEQ ID NO: 852595 - protein, 9 aa, Homo Sapiens
EEKMCEQED

SEQ ID NO: 852596 - protein, 9 aa, Homo Sapiens
QLRDDGCNS

SEQ ID NO: 852597 - protein, 9 aa, Homo Sapiens
HRGSSSPQK

SEQ ID NO: 852598 - protein, 9 aa, Homo Sapiens
KLTRLKKLL

SEQ ID NO: 852599 - protein, 9 aa, Homo Sapiens
LFVQLVLEI

SEQ ID NO: 852600 - protein, 9 aa, Homo Sapiens
TFTSDNNEL

SEQ ID NO: 852601 - protein, 9 aa, Homo Sapiens
SRKRRQSSD

SEQ ID NO: 852602 - protein, 9 aa, Homo Sapiens
NKRSSCELE

SEQ ID NO: 852603 - protein, 9 aa, Homo Sapiens
MIKDNSSGY

SEQ ID NO: 852604 - protein, 9 aa, Homo Sapiens
FELANTVCH

SEQ ID NO: 852605 - protein, 9 aa, Homo Sapiens
PSADDYLKT

SEQ ID NO: 852606 - protein, 9 aa, Homo Sapiens
NYEIRICRP

SEQ ID NO: 852607 - protein, 9 aa, Homo Sapiens
NECSGVRKC

SEQ ID NO: 852608 - protein, 9 aa, Homo Sapiens
YFGLTGRDV

SEQ ID NO: 852609 - protein, 9 aa, Homo Sapiens
VASEFGLNI

SEQ ID NO: 852610 - protein, 9 aa, Homo Sapiens
EYTQRSYSW

SEQ ID NO: 852611 - protein, 9 aa, Homo Sapiens
TSTIRKVQT

SEQ ID NO: 852612 - protein, 9 aa, Homo Sapiens
ICEQEKKEM

SEQ ID NO: 852613 - protein, 9 aa, Homo Sapiens
MLSTDTNKA

SEQ ID NO: 852614 - protein, 9 aa, Homo Sapiens
KIIGIKKAI

SEQ ID NO: 852615 - protein, 9 aa, Homo Sapiens
IMMNIPPVE

SEQ ID NO: 852616 - protein, 9 aa, Homo Sapiens
QAELQWLLS

SEQ ID NO: 852617 - protein, 9 aa, Homo Sapiens
NSRQRLQES

SEQ ID NO: 852618 - protein, 9 aa, Homo Sapiens
QSDTLDNNE

SEQ ID NO: 852619 - protein, 9 aa, Homo Sapiens
LAHEEVRKL

SEQ ID NO: 852620 - protein, 9 aa, Homo Sapiens
RKYIIEIVS

SEQ ID NO: 852621 - protein, 9 aa, Homo Sapiens
ELLHQAKYF

SEQ ID NO: 852622 - protein, 9 aa, Homo Sapiens
TILRNHLIR

SEQ ID NO: 852623 - protein, 9 aa, Homo Sapiens
NYSHTDAHE

SEQ ID NO: 852624 - protein, 9 aa, Homo Sapiens
CGVMTSSGL

SEQ ID NO: 852625 - protein, 9 aa, Homo Sapiens
RWHYKYNSQ

SEQ ID NO: 852626 - protein, 9 aa, Homo Sapiens
IRYNKIGIK

SEQ ID NO: 852627 - protein, 9 aa, Homo Sapiens
LITSGTDRK

SEQ ID NO: 852628 - protein, 9 aa, Homo Sapiens
TLFQPSFLG

SEQ ID NO: 852629 - protein, 9 aa, Homo Sapiens
QNLKKEKPV

SEQ ID NO: 852630 - protein, 9 aa, Homo Sapiens
NVNHEFNLL

SEQ ID NO: 852631 - protein, 9 aa, Homo Sapiens
HANPSERAH

SEQ ID NO: 852632 - protein, 9 aa, Homo Sapiens
ERIHFFRNA

SEQ ID NO: 852633 - protein, 9 aa, Homo Sapiens
QNDIAYAND

SEQ ID NO: 852634 - protein, 9 aa, Homo Sapiens
RQTYSRLQT

SEQ ID NO: 852635 - protein, 9 aa, Homo Sapiens
EFLNKYHKK

SEQ ID NO: 852636 - protein, 9 aa, Homo Sapiens
ELSCSARNC

SEQ ID NO: 852637 - protein, 9 aa, Homo Sapiens
QRCNCNGHS

SEQ ID NO: 852638 - protein, 9 aa, Homo Sapiens
TEVCRFLFL

SEQ ID NO: 852639 - protein, 9 aa, Homo Sapiens
ITLNILGKI

SEQ ID NO: 852640 - protein, 9 aa, Homo Sapiens
RVHSSPASS

SEQ ID NO: 852641 - protein, 9 aa, Homo Sapiens
EDNPMVGAL

SEQ ID NO: 852642 - protein, 9 aa, Homo Sapiens
MQDILLIGF

SEQ ID NO: 852643 - protein, 9 aa, Homo Sapiens
QGNGSLSPP

SEQ ID NO: 852644 - protein, 9 aa, Homo Sapiens
WKITLPVGF

SEQ ID NO: 852645 - protein, 9 aa, Homo Sapiens
RMSVLRSAD

SEQ ID NO: 852646 - protein, 9 aa, Homo Sapiens
VQGLINKYE

SEQ ID NO: 852647 - protein, 9 aa, Homo Sapiens
TYSTKIENL

SEQ ID NO: 852648 - protein, 9 aa, Homo Sapiens
LLGGEPRML

SEQ ID NO: 852649 - protein, 9 aa, Homo Sapiens
LQRKQNVLR

SEQ ID NO: 852650 - protein, 9 aa, Homo Sapiens
KNPNAGQVW

SEQ ID NO: 852651 - protein, 9 aa, Homo Sapiens
EAASNGVVD

SEQ ID NO: 852652 - protein, 9 aa, Homo Sapiens
KMVADTSKV

SEQ ID NO: 852653 - protein, 9 aa, Homo Sapiens
QILSLSEEG

SEQ ID NO: 852654 - protein, 9 aa, Homo Sapiens
PSVPESPKF

SEQ ID NO: 852655 - protein, 9 aa, Homo Sapiens
GSTKPLKTV

SEQ ID NO: 852656 - protein, 9 aa, Homo Sapiens
QQNKDHSVF

SEQ ID NO: 852657 - protein, 9 aa, Homo Sapiens
EKLYLFPLK

SEQ ID NO: 852658 - protein, 9 aa, Homo Sapiens
AGMVNKKGI

SEQ ID NO: 852659 - protein, 9 aa, Homo Sapiens
TLAGVDFEL

SEQ ID NO: 852660 - protein, 9 aa, Homo Sapiens
LRNKPIVPE

SEQ ID NO: 852661 - protein, 9 aa, Homo Sapiens
NIWDYRHPP

SEQ ID NO: 852662 - protein, 9 aa, Homo Sapiens
GNSRSSIGF

SEQ ID NO: 852663 - protein, 9 aa, Homo Sapiens
GNANVTVLD

SEQ ID NO: 852664 - protein, 9 aa, Homo Sapiens
VALQQGKIV

SEQ ID NO: 852665 - protein, 9 aa, Homo Sapiens
PLVPEPPAG

SEQ ID NO: 852666 - protein, 9 aa, Homo Sapiens
EGGSGKGTT

SEQ ID NO: 852667 - protein, 9 aa, Homo Sapiens
CVQVLHQVT

SEQ ID NO: 852668 - protein, 9 aa, Homo Sapiens
EQLMEEIIS

SEQ ID NO: 852669 - protein, 9 aa, Homo Sapiens
TDIIITEHA

SEQ ID NO: 852670 - protein, 9 aa, Homo Sapiens
DHQAAQLSR

SEQ ID NO: 852671 - protein, 9 aa, Homo Sapiens
MDLQHGSLL

SEQ ID NO: 852672 - protein, 9 aa, Homo Sapiens
EGHIKVVKF

SEQ ID NO: 852673 - protein, 9 aa, Homo Sapiens
SKGDRCDNC

SEQ ID NO: 852674 - protein, 9 aa, Homo Sapiens
EQSFKKTKT

SEQ ID NO: 852675 - protein, 9 aa, Homo Sapiens
DPNRSCQIE

SEQ ID NO: 852676 - protein, 9 aa, Homo Sapiens
GLAVILMTT

SEQ ID NO: 852677 - protein, 9 aa, Homo Sapiens
LCKKEINNS

SEQ ID NO: 852678 - protein, 9 aa, Homo Sapiens
REHSSLNTH

SEQ ID NO: 852679 - protein, 9 aa, Homo Sapiens
GQSDIETMR

SEQ ID NO: 852680 - protein, 9 aa, Homo Sapiens
TTSVENLFC

SEQ ID NO: 852681 - protein, 9 aa, Homo Sapiens
KFFYSFLAP

SEQ ID NO: 852682 - protein, 9 aa, Homo Sapiens
IVLFYLWGL

SEQ ID NO: 852683 - protein, 9 aa, Homo Sapiens
RNEIQKRGV

SEQ ID NO: 852684 - protein, 9 aa, Homo Sapiens
MVILLIETS

SEQ ID NO: 852685 - protein, 9 aa, Homo Sapiens
GYSFSPRDV

SEQ ID NO: 852686 - protein, 9 aa, Homo Sapiens
CLLGSPTLL

SEQ ID NO: 852687 - protein, 9 aa, Homo Sapiens
RKKRRQAKL

SEQ ID NO: 852688 - protein, 9 aa, Homo Sapiens
SHRCSWLYG

SEQ ID NO: 852689 - protein, 9 aa, Homo Sapiens
NLRKKAFEE

SEQ ID NO: 852690 - protein, 9 aa, Homo Sapiens
FIVFMILLG

SEQ ID NO: 852691 - protein, 9 aa, Homo Sapiens
QKARIRYFP

SEQ ID NO: 852692 - protein, 9 aa, Homo Sapiens
GQKRATIQF

SEQ ID NO: 852693 - protein, 9 aa, Homo Sapiens
SINFFLLNK

SEQ ID NO: 852694 - protein, 9 aa, Homo Sapiens
QVFQELEYY

SEQ ID NO: 852695 - protein, 9 aa, Homo Sapiens
GIGHIEAIL

SEQ ID NO: 852696 - protein, 9 aa, Homo Sapiens
KKFLEKKHI

SEQ ID NO: 852697 - protein, 9 aa, Homo Sapiens
GHKVDAVFI

SEQ ID NO: 852698 - protein, 9 aa, Homo Sapiens
GILCALLNL

SEQ ID NO: 852699 - protein, 9 aa, Homo Sapiens
YYRWQWTSF

SEQ ID NO: 852700 - protein, 9 aa, Homo Sapiens
FSQSSKLIM

SEQ ID NO: 852701 - protein, 9 aa, Homo Sapiens
KPMPFSIYE

SEQ ID NO: 852702 - protein, 9 aa, Homo Sapiens
SKCIFMSET

SEQ ID NO: 852703 - protein, 9 aa, Homo Sapiens
TPNPLATLG

SEQ ID NO: 852704 - protein, 9 aa, Homo Sapiens
SRSLPRVIS

SEQ ID NO: 852705 - protein, 9 aa, Homo Sapiens
IFYGTLMFM

SEQ ID NO: 852706 - protein, 9 aa, Homo Sapiens
WNGPVGAVQ

SEQ ID NO: 852707 - protein, 9 aa, Homo Sapiens
KPPRWEEGK

SEQ ID NO: 852708 - protein, 9 aa, Homo Sapiens
ACQQNNPAT

SEQ ID NO: 852709 - protein, 9 aa, Homo Sapiens
FYTGNLQTL

SEQ ID NO: 852710 - protein, 9 aa, Homo Sapiens
GTSQKEVNA

SEQ ID NO: 852711 - protein, 9 aa, Homo Sapiens
SHPKLLHKG

SEQ ID NO: 852712 - protein, 9 aa, Homo Sapiens
ALQTQLEGA

SEQ ID NO: 852713 - protein, 9 aa, Homo Sapiens
QSVDEAIKC

SEQ ID NO: 852714 - protein, 9 aa, Homo Sapiens
GSGTSGMEE

SEQ ID NO: 852715 - protein, 9 aa, Homo Sapiens
AFLWPWWYV

SEQ ID NO: 852716 - protein, 9 aa, Homo Sapiens
VHSSPASSP

SEQ ID NO: 852717 - protein, 9 aa, Homo Sapiens
MKPLSYSQL

SEQ ID NO: 852718 - protein, 9 aa, Homo Sapiens
NGNYNIMCL

SEQ ID NO: 852719 - protein, 9 aa, Homo Sapiens
CLCPFYLIH

SEQ ID NO: 852720 - protein, 9 aa, Homo Sapiens
FKIIRNEDI

SEQ ID NO: 852721 - protein, 9 aa, Homo Sapiens
LCGRGACNN

SEQ ID NO: 852722 - protein, 9 aa, Homo Sapiens
TTGPLFTFP

SEQ ID NO: 852723 - protein, 9 aa, Homo Sapiens
VIDSTRTIS

SEQ ID NO: 852724 - protein, 9 aa, Homo Sapiens
KEKTSAINQ

SEQ ID NO: 852725 - protein, 9 aa, Homo Sapiens
NPLVILGGN

SEQ ID NO: 852726 - protein, 9 aa, Homo Sapiens
FAAFILDHH

SEQ ID NO: 852727 - protein, 9 aa, Homo Sapiens
ISHKSSKGG

SEQ ID NO: 852728 - protein, 9 aa, Homo Sapiens
ASCFRGKLL

SEQ ID NO: 852729 - protein, 9 aa, Homo Sapiens
TIEDNFPLG

SEQ ID NO: 852730 - protein, 9 aa, Homo Sapiens
HGVHVVLNQ

SEQ ID NO: 852731 - protein, 9 aa, Homo Sapiens
NCSTVDNTY

SEQ ID NO: 852732 - protein, 9 aa, Homo Sapiens
QSVGSPNKK

SEQ ID NO: 852733 - protein, 9 aa, Homo Sapiens
GNCSNTTSN

SEQ ID NO: 852734 - protein, 9 aa, Homo Sapiens
FCSVSDKSN

SEQ ID NO: 852735 - protein, 9 aa, Homo Sapiens
LMQEYEEQK

SEQ ID NO: 852736 - protein, 9 aa, Homo Sapiens
HNARKFNEP

SEQ ID NO: 852737 - protein, 9 aa, Homo Sapiens
DAEEDKIPN

SEQ ID NO: 852738 - protein, 9 aa, Homo Sapiens
PPTPPPVAT

SEQ ID NO: 852739 - protein, 9 aa, Homo Sapiens
MPPPQKLPS

SEQ ID NO: 852740 - protein, 9 aa, Homo Sapiens
SPRASSSRS

SEQ ID NO: 852741 - protein, 9 aa, Homo Sapiens
RKLEWPLAE

SEQ ID NO: 852742 - protein, 9 aa, Homo Sapiens
SSLQRKGLE

SEQ ID NO: 852743 - protein, 9 aa, Homo Sapiens
LLEDKLQPQ

SEQ ID NO: 852744 - protein, 9 aa, Homo Sapiens
GSIFVLTCM

SEQ ID NO: 852745 - protein, 9 aa, Homo Sapiens
KKLFPKGAT

SEQ ID NO: 852746 - protein, 9 aa, Homo Sapiens
DGGPSLRRV

SEQ ID NO: 852747 - protein, 9 aa, Homo Sapiens
KLRVFLGRE

SEQ ID NO: 852748 - protein, 9 aa, Homo Sapiens
AAAVVHKEP

SEQ ID NO: 852749 - protein, 9 aa, Homo Sapiens
QWRCRHPSL

SEQ ID NO: 852750 - protein, 9 aa, Homo Sapiens
LFLCSPQPD

SEQ ID NO: 852751 - protein, 9 aa, Homo Sapiens
IREPRFVED

SEQ ID NO: 852752 - protein, 9 aa, Homo Sapiens
AQNNLSPSL

SEQ ID NO: 852753 - protein, 9 aa, Homo Sapiens
LVKEVISAV

SEQ ID NO: 852754 - protein, 9 aa, Homo Sapiens
LGKQPNRTT

SEQ ID NO: 852755 - protein, 9 aa, Homo Sapiens
RGKETLDMI

SEQ ID NO: 852756 - protein, 9 aa, Homo Sapiens
SVENLFCFL

SEQ ID NO: 852757 - protein, 9 aa, Homo Sapiens
TEGNANVTV

SEQ ID NO: 852758 - protein, 9 aa, Homo Sapiens
QARMLSLTT

SEQ ID NO: 852759 - protein, 9 aa, Homo Sapiens
GHSEAVMSV

SEQ ID NO: 852760 - protein, 9 aa, Homo Sapiens
QKQANRKKI

SEQ ID NO: 852761 - protein, 9 aa, Homo Sapiens
LIVHEEAAV

SEQ ID NO: 852762 - protein, 9 aa, Homo Sapiens
VHGADNFIQ

SEQ ID NO: 852763 - protein, 9 aa, Homo Sapiens
STTKPLRAS

SEQ ID NO: 852764 - protein, 9 aa, Homo Sapiens
PMWPKGWMQ

SEQ ID NO: 852765 - protein, 9 aa, Homo Sapiens
ISCKAEVNS

SEQ ID NO: 852766 - protein, 9 aa, Homo Sapiens
RTLPPSDIN

SEQ ID NO: 852767 - protein, 9 aa, Homo Sapiens
LCECKDCWI

SEQ ID NO: 852768 - protein, 9 aa, Homo Sapiens
QSQQIQRAI

SEQ ID NO: 852769 - protein, 9 aa, Homo Sapiens
DIIGDIYST

SEQ ID NO: 852770 - protein, 9 aa, Homo Sapiens
TGEQPFECL

SEQ ID NO: 852771 - protein, 9 aa, Homo Sapiens
PSCSHDSYN

SEQ ID NO: 852772 - protein, 9 aa, Homo Sapiens
LRSQLAIVP

SEQ ID NO: 852773 - protein, 9 aa, Homo Sapiens
TDAASRRRN

SEQ ID NO: 852774 - protein, 9 aa, Homo Sapiens
FQKFECANV

SEQ ID NO: 852775 - protein, 9 aa, Homo Sapiens
KRGLALDGQ

SEQ ID NO: 852776 - protein, 9 aa, Homo Sapiens
SRKKYCFHK

SEQ ID NO: 852777 - protein, 9 aa, Homo Sapiens
VWRYINFNM

SEQ ID NO: 852778 - protein, 9 aa, Homo Sapiens
FLGVYQNGG

SEQ ID NO: 852779 - protein, 9 aa, Homo Sapiens
NLVTRLVNI

SEQ ID NO: 852780 - protein, 9 aa, Homo Sapiens
LRINRGNCW

SEQ ID NO: 852781 - protein, 9 aa, Homo Sapiens
VLSSADNIA

SEQ ID NO: 852782 - protein, 9 aa, Homo Sapiens
LELHDEFGY

SEQ ID NO: 852783 - protein, 9 aa, Homo Sapiens
SEDNLLFWL

SEQ ID NO: 852784 - protein, 9 aa, Homo Sapiens
LTDHLRLHT

SEQ ID NO: 852785 - protein, 9 aa, Homo Sapiens
QEQLNEDEL

SEQ ID NO: 852786 - protein, 9 aa, Homo Sapiens
EAGLNELSE

SEQ ID NO: 852787 - protein, 9 aa, Homo Sapiens
LYPPLIHLW

SEQ ID NO: 852788 - protein, 9 aa, Homo Sapiens
GHPEVNSLE

SEQ ID NO: 852789 - protein, 9 aa, Homo Sapiens
AKTTITVPP

SEQ ID NO: 852790 - protein, 9 aa, Homo Sapiens
CYSKTQNLS

SEQ ID NO: 852791 - protein, 9 aa, Homo Sapiens
LTYLNLSQN

SEQ ID NO: 852792 - protein, 9 aa, Homo Sapiens
VVVSVKHNP

SEQ ID NO: 852793 - protein, 9 aa, Homo Sapiens
FLYMFMEYV

SEQ ID NO: 852794 - protein, 9 aa, Homo Sapiens
QQYACVKDI

SEQ ID NO: 852795 - protein, 9 aa, Homo Sapiens
PREIRWGHR

SEQ ID NO: 852796 - protein, 9 aa, Homo Sapiens
PFYCADCGE

SEQ ID NO: 852797 - protein, 9 aa, Homo Sapiens
EFTTHEDAV

SEQ ID NO: 852798 - protein, 9 aa, Homo Sapiens
SMLIIHQQT

SEQ ID NO: 852799 - protein, 9 aa, Homo Sapiens
DKSFSHLSY

SEQ ID NO: 852800 - protein, 9 aa, Homo Sapiens
TFDANGDGA

SEQ ID NO: 852801 - protein, 9 aa, Homo Sapiens
HEIELKVMK

SEQ ID NO: 852802 - protein, 9 aa, Homo Sapiens
MPEEMCVET

SEQ ID NO: 852803 - protein, 9 aa, Homo Sapiens
REHSKVPYI

SEQ ID NO: 852804 - protein, 9 aa, Homo Sapiens
AYLTAHQRR

SEQ ID NO: 852805 - protein, 9 aa, Homo Sapiens
ADTIRLPYE

SEQ ID NO: 852806 - protein, 9 aa, Homo Sapiens
TSYWKVHKI

SEQ ID NO: 852807 - protein, 9 aa, Homo Sapiens
PGMQDILLI

SEQ ID NO: 852808 - protein, 9 aa, Homo Sapiens
SPHVCKRMK

SEQ ID NO: 852809 - protein, 9 aa, Homo Sapiens
KLDRNYLNY

SEQ ID NO: 852810 - protein, 9 aa, Homo Sapiens
SCIVKRTKK

SEQ ID NO: 852811 - protein, 9 aa, Homo Sapiens
WRIKKKSRM

SEQ ID NO: 852812 - protein, 9 aa, Homo Sapiens
IRRAGGKVV

SEQ ID NO: 852813 - protein, 9 aa, Homo Sapiens
SQDGDNDED

SEQ ID NO: 852814 - protein, 9 aa, Homo Sapiens
IKSNKRTPS

SEQ ID NO: 852815 - protein, 9 aa, Homo Sapiens
RIRKTQKLT

SEQ ID NO: 852816 - protein, 9 aa, Homo Sapiens
NNVLCNGIP

SEQ ID NO: 852817 - protein, 9 aa, Homo Sapiens
QRRLIPHPR

SEQ ID NO: 852818 - protein, 9 aa, Homo Sapiens
NTSDLSDWS

SEQ ID NO: 852819 - protein, 9 aa, Homo Sapiens
GRRINTLQA

SEQ ID NO: 852820 - protein, 9 aa, Homo Sapiens
EISTDKETN

SEQ ID NO: 852821 - protein, 9 aa, Homo Sapiens
EPGEGLGGE

SEQ ID NO: 852822 - protein, 9 aa, Homo Sapiens
WEAFWRFPA

SEQ ID NO: 852823 - protein, 9 aa, Homo Sapiens
SSSWGNPGF

SEQ ID NO: 852824 - protein, 9 aa, Homo Sapiens
PVLNFCKVF

SEQ ID NO: 852825 - protein, 9 aa, Homo Sapiens
ASTSYLIDT

SEQ ID NO: 852826 - protein, 9 aa, Homo Sapiens
LMGFLVGNA

SEQ ID NO: 852827 - protein, 9 aa, Homo Sapiens
NEDSLLKST

SEQ ID NO: 852828 - protein, 9 aa, Homo Sapiens
LMTLGPTVV

SEQ ID NO: 852829 - protein, 9 aa, Homo Sapiens
AAFAINYKG

SEQ ID NO: 852830 - protein, 9 aa, Homo Sapiens
TFHSILSIK

SEQ ID NO: 852831 - protein, 9 aa, Homo Sapiens
SDSEEEEII

SEQ ID NO: 852832 - protein, 9 aa, Homo Sapiens
WCHQPPSHS

SEQ ID NO: 852833 - protein, 9 aa, Homo Sapiens
WLGLKNIFY

SEQ ID NO: 852834 - protein, 9 aa, Homo Sapiens
FLKVIGRGN

SEQ ID NO: 852835 - protein, 9 aa, Homo Sapiens
EDQKVWPNE

SEQ ID NO: 852836 - protein, 9 aa, Homo Sapiens
LLKWHVPPE

SEQ ID NO: 852837 - protein, 9 aa, Homo Sapiens
IGPENTLMM

SEQ ID NO: 852838 - protein, 9 aa, Homo Sapiens
MKPLPLVGT

SEQ ID NO: 852839 - protein, 9 aa, Homo Sapiens
TIPYWDWWD

SEQ ID NO: 852840 - protein, 9 aa, Homo Sapiens
GKPNAKECT

SEQ ID NO: 852841 - protein, 9 aa, Homo Sapiens
NIPLAFLKP

SEQ ID NO: 852842 - protein, 9 aa, Homo Sapiens
ETLKAVDQD

SEQ ID NO: 852843 - protein, 9 aa, Homo Sapiens
AERRRMHLV

SEQ ID NO: 852844 - protein, 9 aa, Homo Sapiens
KKTEEIVQN

SEQ ID NO: 852845 - protein, 9 aa, Homo Sapiens
DLKINDATQ

SEQ ID NO: 852846 - protein, 9 aa, Homo Sapiens
FMKDAINKF

SEQ ID NO: 852847 - protein, 9 aa, Homo Sapiens
DNFRKNLTD

SEQ ID NO: 852848 - protein, 9 aa, Homo Sapiens
YSFHNVQQI

SEQ ID NO: 852849 - protein, 9 aa, Homo Sapiens
LGQMDKPFL

SEQ ID NO: 852850 - protein, 9 aa, Homo Sapiens
ETMLITCLQ

SEQ ID NO: 852851 - protein, 9 aa, Homo Sapiens
PNYHNMTTT

SEQ ID NO: 852852 - protein, 9 aa, Homo Sapiens
LGTEHSSGR

SEQ ID NO: 852853 - protein, 9 aa, Homo Sapiens
CGEYGRAWN

SEQ ID NO: 852854 - protein, 9 aa, Homo Sapiens
QIHAANVTQ

SEQ ID NO: 852855 - protein, 9 aa, Homo Sapiens
VWGKVFPPA

SEQ ID NO: 852856 - protein, 9 aa, Homo Sapiens
TKFMIFKSS

SEQ ID NO: 852857 - protein, 9 aa, Homo Sapiens
LHHCLLPVL

SEQ ID NO: 852858 - protein, 9 aa, Homo Sapiens
NFFCDVSPI

SEQ ID NO: 852859 - protein, 9 aa, Homo Sapiens
KCAACGKVF

SEQ ID NO: 852860 - protein, 9 aa, Homo Sapiens
KYCNFRSHD

SEQ ID NO: 852861 - protein, 9 aa, Homo Sapiens
PFELKVYEI

SEQ ID NO: 852862 - protein, 9 aa, Homo Sapiens
PLYGDLSLK

SEQ ID NO: 852863 - protein, 9 aa, Homo Sapiens
KVIFGKVKK

SEQ ID NO: 852864 - protein, 9 aa, Homo Sapiens
VHTGDPNKK

SEQ ID NO: 852865 - protein, 9 aa, Homo Sapiens
VGTQSLTYD

SEQ ID NO: 852866 - protein, 9 aa, Homo Sapiens
HLCHSAWPP

SEQ ID NO: 852867 - protein, 9 aa, Homo Sapiens
GSVPNKCYV

SEQ ID NO: 852868 - protein, 9 aa, Homo Sapiens
EIYRVAGQL

SEQ ID NO: 852869 - protein, 9 aa, Homo Sapiens
RQTQWGLRS

SEQ ID NO: 852870 - protein, 9 aa, Homo Sapiens
SKNIFIGEK

SEQ ID NO: 852871 - protein, 9 aa, Homo Sapiens
HSPLQSGNA

SEQ ID NO: 852872 - protein, 9 aa, Homo Sapiens
KEVFSEFKD

SEQ ID NO: 852873 - protein, 9 aa, Homo Sapiens
HADFANECP

SEQ ID NO: 852874 - protein, 9 aa, Homo Sapiens
KCKNSSTNN

SEQ ID NO: 852875 - protein, 9 aa, Homo Sapiens
DRHILDWHF

SEQ ID NO: 852876 - protein, 9 aa, Homo Sapiens
VMAYQLGEF

SEQ ID NO: 852877 - protein, 9 aa, Homo Sapiens
IDFIVNETN

SEQ ID NO: 852878 - protein, 9 aa, Homo Sapiens
QAFVLNSPK

SEQ ID NO: 852879 - protein, 9 aa, Homo Sapiens
NYYVGSQFS

SEQ ID NO: 852880 - protein, 9 aa, Homo Sapiens
MFLSKPYVY

SEQ ID NO: 852881 - protein, 9 aa, Homo Sapiens
LRVKCQGYS

SEQ ID NO: 852882 - protein, 9 aa, Homo Sapiens
IKTYYWDNA

SEQ ID NO: 852883 - protein, 9 aa, Homo Sapiens
CSGNIKTDT

SEQ ID NO: 852884 - protein, 9 aa, Homo Sapiens
EGWAVQDVA

SEQ ID NO: 852885 - protein, 9 aa, Homo Sapiens
EDYRGNAGV

SEQ ID NO: 852886 - protein, 9 aa, Homo Sapiens
CQGSAQRLL

SEQ ID NO: 852887 - protein, 9 aa, Homo Sapiens
VSSQFSGAA

SEQ ID NO: 852888 - protein, 9 aa, Homo Sapiens
PQIHWDLST

SEQ ID NO: 852889 - protein, 9 aa, Homo Sapiens
TTSFPCTVL

SEQ ID NO: 852890 - protein, 9 aa, Homo Sapiens
DHAHGLLQP

SEQ ID NO: 852891 - protein, 9 aa, Homo Sapiens
FWYNNRERL

SEQ ID NO: 852892 - protein, 9 aa, Homo Sapiens
KHRVKNSPP

SEQ ID NO: 852893 - protein, 9 aa, Homo Sapiens
CGKAFTQKP

SEQ ID NO: 852894 - protein, 9 aa, Homo Sapiens
NTKTSSPGQ

SEQ ID NO: 852895 - protein, 9 aa, Homo Sapiens
RDYYHCYSP

SEQ ID NO: 852896 - protein, 9 aa, Homo Sapiens
VCTPSFHSG

SEQ ID NO: 852897 - protein, 9 aa, Homo Sapiens
EYTEIPSPF

SEQ ID NO: 852898 - protein, 9 aa, Homo Sapiens
FSSDSFNFN

SEQ ID NO: 852899 - protein, 9 aa, Homo Sapiens
NMTIKAELP

SEQ ID NO: 852900 - protein, 9 aa, Homo Sapiens
WDILIKATY

SEQ ID NO: 852901 - protein, 9 aa, Homo Sapiens
GCHPSHEGR

SEQ ID NO: 852902 - protein, 9 aa, Homo Sapiens
GEGAASAWG

SEQ ID NO: 852903 - protein, 9 aa, Homo Sapiens
CPGCQKPLP

SEQ ID NO: 852904 - protein, 9 aa, Homo Sapiens
VQFSCDMHP

SEQ ID NO: 852905 - protein, 9 aa, Homo Sapiens
NTLITFIER

SEQ ID NO: 852906 - protein, 9 aa, Homo Sapiens
FIQNLKVLF

SEQ ID NO: 852907 - protein, 9 aa, Homo Sapiens
RLSPDWCKC

SEQ ID NO: 852908 - protein, 9 aa, Homo Sapiens
EDQGIPPFL

SEQ ID NO: 852909 - protein, 9 aa, Homo Sapiens
NRGVLHQFS

SEQ ID NO: 852910 - protein, 9 aa, Homo Sapiens
LKSQLVQPV

SEQ ID NO: 852911 - protein, 9 aa, Homo Sapiens
LTVHQRINT

SEQ ID NO: 852912 - protein, 9 aa, Homo Sapiens
QFCLLLNVQ

SEQ ID NO: 852913 - protein, 9 aa, Homo Sapiens
SAYQLYQDP

SEQ ID NO: 852914 - protein, 9 aa, Homo Sapiens
IYWLNYEAH

SEQ ID NO: 852915 - protein, 9 aa, Homo Sapiens
NSNIYKIRH

SEQ ID NO: 852916 - protein, 9 aa, Homo Sapiens
MTLSEFYQW

SEQ ID NO: 852917 - protein, 9 aa, Homo Sapiens
VLYLSMQEA

SEQ ID NO: 852918 - protein, 9 aa, Homo Sapiens
DIESKNTHG

SEQ ID NO: 852919 - protein, 9 aa, Homo Sapiens
DSKIITGHG

SEQ ID NO: 852920 - protein, 9 aa, Homo Sapiens
QEQQNVLKV

SEQ ID NO: 852921 - protein, 9 aa, Homo Sapiens
AYAFSNGKT

SEQ ID NO: 852922 - protein, 9 aa, Homo Sapiens
EIEYIKNVP

SEQ ID NO: 852923 - protein, 9 aa, Homo Sapiens
YLIYGPVLP

SEQ ID NO: 852924 - protein, 9 aa, Homo Sapiens
NQSHGIGTD

SEQ ID NO: 852925 - protein, 9 aa, Homo Sapiens
VHIQHQIVH

SEQ ID NO: 852926 - protein, 9 aa, Homo Sapiens
IEQLSVVKG

SEQ ID NO: 852927 - protein, 9 aa, Homo Sapiens
TPEKDKIYL

SEQ ID NO: 852928 - protein, 9 aa, Homo Sapiens
PKSAVYFLL

SEQ ID NO: 852929 - protein, 9 aa, Homo Sapiens
SNASSQRTA

SEQ ID NO: 852930 - protein, 9 aa, Homo Sapiens
MDQAHIYIQ

SEQ ID NO: 852931 - protein, 9 aa, Homo Sapiens
LYNVLEDFS

SEQ ID NO: 852932 - protein, 9 aa, Homo Sapiens
VTLLDLSGN

SEQ ID NO: 852933 - protein, 9 aa, Homo Sapiens
RCQVARSRE

SEQ ID NO: 852934 - protein, 9 aa, Homo Sapiens
KNIIEDKAR

SEQ ID NO: 852935 - protein, 9 aa, Homo Sapiens
MPDRNMKNV

SEQ ID NO: 852936 - protein, 9 aa, Homo Sapiens
FHMVPVSQP

SEQ ID NO: 852937 - protein, 9 aa, Homo Sapiens
ELYPVPLEC

SEQ ID NO: 852938 - protein, 9 aa, Homo Sapiens
FVSGALNKC

SEQ ID NO: 852939 - protein, 9 aa, Homo Sapiens
VGQLDISIV

SEQ ID NO: 852940 - protein, 9 aa, Homo Sapiens
QSVITSSTI

SEQ ID NO: 852941 - protein, 9 aa, Homo Sapiens
KLFEHHPIP

SEQ ID NO: 852942 - protein, 9 aa, Homo Sapiens
NLLLLSKAT

SEQ ID NO: 852943 - protein, 9 aa, Homo Sapiens
YMEKETHRG

SEQ ID NO: 852944 - protein, 9 aa, Homo Sapiens
SVCFSACSD

SEQ ID NO: 852945 - protein, 9 aa, Homo Sapiens
LPGPSKSET

SEQ ID NO: 852946 - protein, 9 aa, Homo Sapiens
ERRTPLRAA

SEQ ID NO: 852947 - protein, 9 aa, Homo Sapiens
GTPFDEHDE

SEQ ID NO: 852948 - protein, 9 aa, Homo Sapiens
KRRVAEELT

SEQ ID NO: 852949 - protein, 9 aa, Homo Sapiens
FDWISKNIY

SEQ ID NO: 852950 - protein, 9 aa, Homo Sapiens
GSGSLDSLG

SEQ ID NO: 852951 - protein, 9 aa, Homo Sapiens
SRDYKIKYE

SEQ ID NO: 852952 - protein, 9 aa, Homo Sapiens
IEENNDMNN

SEQ ID NO: 852953 - protein, 9 aa, Homo Sapiens
VEFKVVETY

SEQ ID NO: 852954 - protein, 9 aa, Homo Sapiens
WYKHKGDLE

SEQ ID NO: 852955 - protein, 9 aa, Homo Sapiens
AAISVRFVQ

SEQ ID NO: 852956 - protein, 9 aa, Homo Sapiens
LVNFCVTVS

SEQ ID NO: 852957 - protein, 9 aa, Homo Sapiens
YFSNLQRQA

SEQ ID NO: 852958 - protein, 9 aa, Homo Sapiens
IFIHEGLTV

SEQ ID NO: 852959 - protein, 9 aa, Homo Sapiens
KKGVLDWRI

SEQ ID NO: 852960 - protein, 9 aa, Homo Sapiens
ITLELSCLE

SEQ ID NO: 852961 - protein, 9 aa, Homo Sapiens
DVMYLSWNP

SEQ ID NO: 852962 - protein, 9 aa, Homo Sapiens
VTRYEQREY

SEQ ID NO: 852963 - protein, 9 aa, Homo Sapiens
GIFYSQWEG

SEQ ID NO: 852964 - protein, 9 aa, Homo Sapiens
GVSVQYHYF

SEQ ID NO: 852965 - protein, 9 aa, Homo Sapiens
VSTEQEKFG

SEQ ID NO: 852966 - protein, 9 aa, Homo Sapiens
TNRWDLMDK

SEQ ID NO: 852967 - protein, 9 aa, Homo Sapiens
ALFTLYNNN

SEQ ID NO: 852968 - protein, 9 aa, Homo Sapiens
IKIHIGSSF

SEQ ID NO: 852969 - protein, 9 aa, Homo Sapiens
SFVAGAVGM

SEQ ID NO: 852970 - protein, 9 aa, Homo Sapiens
PPTKSMMEV

SEQ ID NO: 852971 - protein, 9 aa, Homo Sapiens
ELLEYYQNK

SEQ ID NO: 852972 - protein, 9 aa, Homo Sapiens
DYTSPSELA

SEQ ID NO: 852973 - protein, 9 aa, Homo Sapiens
KLTCQGSSQ

SEQ ID NO: 852974 - protein, 9 aa, Homo Sapiens
TEETTTQNQ

SEQ ID NO: 852975 - protein, 9 aa, Homo Sapiens
HNGTVVQYL

SEQ ID NO: 852976 - protein, 9 aa, Homo Sapiens
EVTLAILLC

SEQ ID NO: 852977 - protein, 9 aa, Homo Sapiens
NAMRAVMES

SEQ ID NO: 852978 - protein, 9 aa, Homo Sapiens
ENQQSQSSD

SEQ ID NO: 852979 - protein, 9 aa, Homo Sapiens
IYFIAPKQR

SEQ ID NO: 852980 - protein, 9 aa, Homo Sapiens
QKAGPGLQT

SEQ ID NO: 852981 - protein, 9 aa, Homo Sapiens
KLLNPKCRN

SEQ ID NO: 852982 - protein, 9 aa, Homo Sapiens
RIVAIVSPF

SEQ ID NO: 852983 - protein, 9 aa, Homo Sapiens
AGRMIQRLM

SEQ ID NO: 852984 - protein, 9 aa, Homo Sapiens
GSEIKEIGS

SEQ ID NO: 852985 - protein, 9 aa, Homo Sapiens
LFWDLIYLG

SEQ ID NO: 852986 - protein, 9 aa, Homo Sapiens
FVAIQAGTT

SEQ ID NO: 852987 - protein, 9 aa, Homo Sapiens
QDREQLDTF

SEQ ID NO: 852988 - protein, 9 aa, Homo Sapiens
KIKINDVEI

SEQ ID NO: 852989 - protein, 9 aa, Homo Sapiens
LLNIWDYRH

SEQ ID NO: 852990 - protein, 9 aa, Homo Sapiens
SERNDQKGN

SEQ ID NO: 852991 - protein, 9 aa, Homo Sapiens
DLNLLIGPK

SEQ ID NO: 852992 - protein, 9 aa, Homo Sapiens
FWWEQDEIP

SEQ ID NO: 852993 - protein, 9 aa, Homo Sapiens
TLTDAQVVM

SEQ ID NO: 852994 - protein, 9 aa, Homo Sapiens
GWFHTSLLL

SEQ ID NO: 852995 - protein, 9 aa, Homo Sapiens
LLVSFPEHP

SEQ ID NO: 852996 - protein, 9 aa, Homo Sapiens
EVATEILYT

SEQ ID NO: 852997 - protein, 9 aa, Homo Sapiens
GEQTTHEPV

SEQ ID NO: 852998 - protein, 9 aa, Homo Sapiens
QFKQWRIKL

SEQ ID NO: 852999 - protein, 9 aa, Homo Sapiens
EHQLMLIRQ

SEQ ID NO: 853000 - protein, 9 aa, Homo Sapiens
EPSNLPLYI

SEQ ID NO: 853001 - protein, 9 aa, Homo Sapiens
FFYSFLAPW

SEQ ID NO: 853002 - protein, 9 aa, Homo Sapiens
KLEDKTLEL

SEQ ID NO: 853003 - protein, 9 aa, Homo Sapiens
VSGLACDPA

SEQ ID NO: 853004 - protein, 9 aa, Homo Sapiens
QGAVVNANS

SEQ ID NO: 853005 - protein, 9 aa, Homo Sapiens
PNYRTKVLA

SEQ ID NO: 853006 - protein, 9 aa, Homo Sapiens
RWEEGKAAA

SEQ ID NO: 853007 - protein, 9 aa, Homo Sapiens
STAPSDKGA

SEQ ID NO: 853008 - protein, 9 aa, Homo Sapiens
SSKAGFTII

SEQ ID NO: 853009 - protein, 9 aa, Homo Sapiens
LDVALLMGV

SEQ ID NO: 853010 - protein, 9 aa, Homo Sapiens
GHVIYKHRS

SEQ ID NO: 853011 - protein, 9 aa, Homo Sapiens
KRRRDSLSH

SEQ ID NO: 853012 - protein, 9 aa, Homo Sapiens
LNKLSSTPF

SEQ ID NO: 853013 - protein, 9 aa, Homo Sapiens
LEKGDIGII

SEQ ID NO: 853014 - protein, 9 aa, Homo Sapiens
MCNFSATDF

SEQ ID NO: 853015 - protein, 9 aa, Homo Sapiens
EKNHSKLLF

SEQ ID NO: 853016 - protein, 9 aa, Homo Sapiens
TSQPQALYQ

SEQ ID NO: 853017 - protein, 9 aa, Homo Sapiens
GEPILTQNT

SEQ ID NO: 853018 - protein, 9 aa, Homo Sapiens
KVKLRIRDR

SEQ ID NO: 853019 - protein, 9 aa, Homo Sapiens
SYLTNSSQS

SEQ ID NO: 853020 - protein, 9 aa, Homo Sapiens
LATVIHTLE

SEQ ID NO: 853021 - protein, 9 aa, Homo Sapiens
RLYVGREKT

SEQ ID NO: 853022 - protein, 9 aa, Homo Sapiens
NTPALVFEY

SEQ ID NO: 853023 - protein, 9 aa, Homo Sapiens
FMTPEYFVR

SEQ ID NO: 853024 - protein, 9 aa, Homo Sapiens
LVSAPTFAL

SEQ ID NO: 853025 - protein, 9 aa, Homo Sapiens
EVSPPFAFL

SEQ ID NO: 853026 - protein, 9 aa, Homo Sapiens
PLNKSLVND

SEQ ID NO: 853027 - protein, 9 aa, Homo Sapiens
FVRLQNYFK

SEQ ID NO: 853028 - protein, 9 aa, Homo Sapiens
LRIKSYNKY

SEQ ID NO: 853029 - protein, 9 aa, Homo Sapiens
LNRKNILNQ

SEQ ID NO: 853030 - protein, 9 aa, Homo Sapiens
NMKEIEFKV

SEQ ID NO: 853031 - protein, 9 aa, Homo Sapiens
SSAPMGIYH

SEQ ID NO: 853032 - protein, 9 aa, Homo Sapiens
PNINDSKDN

SEQ ID NO: 853033 - protein, 9 aa, Homo Sapiens
ITISKGCIK

SEQ ID NO: 853034 - protein, 9 aa, Homo Sapiens
IQYFYSTFQ

SEQ ID NO: 853035 - protein, 9 aa, Homo Sapiens
CVEGIVTTC

SEQ ID NO: 853036 - protein, 9 aa, Homo Sapiens
PLIPALSPG

SEQ ID NO: 853037 - protein, 9 aa, Homo Sapiens
TILQATPSS

SEQ ID NO: 853038 - protein, 9 aa, Homo Sapiens
AQRLFLPVV

SEQ ID NO: 853039 - protein, 9 aa, Homo Sapiens
AELKKLQQS

SEQ ID NO: 853040 - protein, 9 aa, Homo Sapiens
HERMSRIHE

SEQ ID NO: 853041 - protein, 9 aa, Homo Sapiens
WQLPRPNVC

SEQ ID NO: 853042 - protein, 9 aa, Homo Sapiens
SIIVALMAG

SEQ ID NO: 853043 - protein, 9 aa, Homo Sapiens
STLLVFMSH

SEQ ID NO: 853044 - protein, 9 aa, Homo Sapiens
QPLLHSFLL

SEQ ID NO: 853045 - protein, 9 aa, Homo Sapiens
INFGTKSFQ

SEQ ID NO: 853046 - protein, 9 aa, Homo Sapiens
QQRVPVEVR

SEQ ID NO: 853047 - protein, 9 aa, Homo Sapiens
AIFKLLDYI

SEQ ID NO: 853048 - protein, 9 aa, Homo Sapiens
QRLHFALKS

SEQ ID NO: 853049 - protein, 9 aa, Homo Sapiens
AAAAFQRAS

SEQ ID NO: 853050 - protein, 9 aa, Homo Sapiens
PPEKLTQTR

SEQ ID NO: 853051 - protein, 9 aa, Homo Sapiens
AANTVDNFF

SEQ ID NO: 853052 - protein, 9 aa, Homo Sapiens
LFLSLVAVP

SEQ ID NO: 853053 - protein, 9 aa, Homo Sapiens
FVLSVYLLT

SEQ ID NO: 853054 - protein, 9 aa, Homo Sapiens
TGVWCWDRG

SEQ ID NO: 853055 - protein, 9 aa, Homo Sapiens
RARWTLGSC

SEQ ID NO: 853056 - protein, 9 aa, Homo Sapiens
NQEDKGNCK

SEQ ID NO: 853057 - protein, 9 aa, Homo Sapiens
QLNCLSNSF

SEQ ID NO: 853058 - protein, 9 aa, Homo Sapiens
PQAQSCAKV

SEQ ID NO: 853059 - protein, 9 aa, Homo Sapiens
TLNYLGFSF

SEQ ID NO: 853060 - protein, 9 aa, Homo Sapiens
LIINFRKGY

SEQ ID NO: 853061 - protein, 9 aa, Homo Sapiens
AGKATSDPC

SEQ ID NO: 853062 - protein, 9 aa, Homo Sapiens
ERLNEMLQE

SEQ ID NO: 853063 - protein, 9 aa, Homo Sapiens
KSSPSNYVH

SEQ ID NO: 853064 - protein, 9 aa, Homo Sapiens
FQMKQISSG

SEQ ID NO: 853065 - protein, 9 aa, Homo Sapiens
WNKPSSSSS

SEQ ID NO: 853066 - protein, 9 aa, Homo Sapiens
DGIPCVNAG

SEQ ID NO: 853067 - protein, 9 aa, Homo Sapiens
QLEIHQYGY

SEQ ID NO: 853068 - protein, 9 aa, Homo Sapiens
QCNCRKTIP

SEQ ID NO: 853069 - protein, 9 aa, Homo Sapiens
SITTRLSST

SEQ ID NO: 853070 - protein, 9 aa, Homo Sapiens
LFNLAVLMN

SEQ ID NO: 853071 - protein, 9 aa, Homo Sapiens
LIIHQGAQL

SEQ ID NO: 853072 - protein, 9 aa, Homo Sapiens
NITFGVRTR

SEQ ID NO: 853073 - protein, 9 aa, Homo Sapiens
GQAFYFLNS

SEQ ID NO: 853074 - protein, 9 aa, Homo Sapiens
SAFLSAVKW

SEQ ID NO: 853075 - protein, 9 aa, Homo Sapiens
MGRIGISCI

SEQ ID NO: 853076 - protein, 9 aa, Homo Sapiens
LVWRGVNVN

SEQ ID NO: 853077 - protein, 9 aa, Homo Sapiens
LKCRLIHNN

SEQ ID NO: 853078 - protein, 9 aa, Homo Sapiens
QSRWSNLEK

SEQ ID NO: 853079 - protein, 9 aa, Homo Sapiens
PTGVHASKI

SEQ ID NO: 853080 - protein, 9 aa, Homo Sapiens
SSPGNLQRH

SEQ ID NO: 853081 - protein, 9 aa, Homo Sapiens
TGAQRACPN

SEQ ID NO: 853082 - protein, 9 aa, Homo Sapiens
DLKANVEYI

SEQ ID NO: 853083 - protein, 9 aa, Homo Sapiens
SVMTTEVTS

SEQ ID NO: 853084 - protein, 9 aa, Homo Sapiens
LSVGLGNIW

SEQ ID NO: 853085 - protein, 9 aa, Homo Sapiens
TMAPEARNV

SEQ ID NO: 853086 - protein, 9 aa, Homo Sapiens
KTLEDRLFE

SEQ ID NO: 853087 - protein, 9 aa, Homo Sapiens
KNRVAAQIS

SEQ ID NO: 853088 - protein, 9 aa, Homo Sapiens
ISEAASLEL

SEQ ID NO: 853089 - protein, 9 aa, Homo Sapiens
LDDPVLSQA

SEQ ID NO: 853090 - protein, 9 aa, Homo Sapiens
HCLFVPRLL

SEQ ID NO: 853091 - protein, 9 aa, Homo Sapiens
QESDQSDSA

SEQ ID NO: 853092 - protein, 9 aa, Homo Sapiens
SDSDREEIN

SEQ ID NO: 853093 - protein, 9 aa, Homo Sapiens
RPRTSAPTR

SEQ ID NO: 853094 - protein, 9 aa, Homo Sapiens
HITDLYPNS

SEQ ID NO: 853095 - protein, 9 aa, Homo Sapiens
TVIQHCREG

SEQ ID NO: 853096 - protein, 9 aa, Homo Sapiens
RTILHRDIK

SEQ ID NO: 853097 - protein, 9 aa, Homo Sapiens
YFHNHEEMK

SEQ ID NO: 853098 - protein, 9 aa, Homo Sapiens
DNSYLPIIV

SEQ ID NO: 853099 - protein, 9 aa, Homo Sapiens
DEDNLPEKL

SEQ ID NO: 853100 - protein, 9 aa, Homo Sapiens
SFKIGNLFV

SEQ ID NO: 853101 - protein, 9 aa, Homo Sapiens
FMIFKSSYS

SEQ ID NO: 853102 - protein, 9 aa, Homo Sapiens
DFKRFVTTS

SEQ ID NO: 853103 - protein, 9 aa, Homo Sapiens
LLSEFWSKP

SEQ ID NO: 853104 - protein, 9 aa, Homo Sapiens
AGKPTFGIE

SEQ ID NO: 853105 - protein, 9 aa, Homo Sapiens
ERSSFEINA

SEQ ID NO: 853106 - protein, 9 aa, Homo Sapiens
IIYFIFKHN

SEQ ID NO: 853107 - protein, 9 aa, Homo Sapiens
VKLTEELLR

SEQ ID NO: 853108 - protein, 9 aa, Homo Sapiens
IDGISQGPH

SEQ ID NO: 853109 - protein, 9 aa, Homo Sapiens
VILSLPKYQ

SEQ ID NO: 853110 - protein, 9 aa, Homo Sapiens
LNIGDYNMD

SEQ ID NO: 853111 - protein, 9 aa, Homo Sapiens
SIYINNVVS

SEQ ID NO: 853112 - protein, 9 aa, Homo Sapiens
HNNKLSTIP

SEQ ID NO: 853113 - protein, 9 aa, Homo Sapiens
FICKDKLGE

SEQ ID NO: 853114 - protein, 9 aa, Homo Sapiens
SSKEQHARK

SEQ ID NO: 853115 - protein, 9 aa, Homo Sapiens
LNEHMNIHI

SEQ ID NO: 853116 - protein, 9 aa, Homo Sapiens
YFDQKYLFA

SEQ ID NO: 853117 - protein, 9 aa, Homo Sapiens
AVAHRNSTH

SEQ ID NO: 853118 - protein, 9 aa, Homo Sapiens
PLTMESAAS

SEQ ID NO: 853119 - protein, 9 aa, Homo Sapiens
DRCDNCGGL

SEQ ID NO: 853120 - protein, 9 aa, Homo Sapiens
SAESIKLKR

SEQ ID NO: 853121 - protein, 9 aa, Homo Sapiens
KLNVREWLQ

SEQ ID NO: 853122 - protein, 9 aa, Homo Sapiens
FQYEMVRRH

SEQ ID NO: 853123 - protein, 9 aa, Homo Sapiens
EATPQYSLE

SEQ ID NO: 853124 - protein, 9 aa, Homo Sapiens
KKIDREQIC

SEQ ID NO: 853125 - protein, 9 aa, Homo Sapiens
DCCGEHDVL

SEQ ID NO: 853126 - protein, 9 aa, Homo Sapiens
QLLKKTQVS

SEQ ID NO: 853127 - protein, 9 aa, Homo Sapiens
SVDLNRPED

SEQ ID NO: 853128 - protein, 9 aa, Homo Sapiens
TFMYLQPKS

SEQ ID NO: 853129 - protein, 9 aa, Homo Sapiens
KYQALCSIY

SEQ ID NO: 853130 - protein, 9 aa, Homo Sapiens
YCALDKEPV

SEQ ID NO: 853131 - protein, 9 aa, Homo Sapiens
PCASIWLQK

SEQ ID NO: 853132 - protein, 9 aa, Homo Sapiens
WFLQMKRPG

SEQ ID NO: 853133 - protein, 9 aa, Homo Sapiens
TVAQNEIFD

SEQ ID NO: 853134 - protein, 9 aa, Homo Sapiens
IKKAINMRY

SEQ ID NO: 853135 - protein, 9 aa, Homo Sapiens
SNPYHNPTH

SEQ ID NO: 853136 - protein, 9 aa, Homo Sapiens
IKKSSSIIS

SEQ ID NO: 853137 - protein, 9 aa, Homo Sapiens
PSLPWSSDP

SEQ ID NO: 853138 - protein, 9 aa, Homo Sapiens
KIQMKGSLP

SEQ ID NO: 853139 - protein, 9 aa, Homo Sapiens
QFQSNRMDD

SEQ ID NO: 853140 - protein, 9 aa, Homo Sapiens
EDTLVCCRD

SEQ ID NO: 853141 - protein, 9 aa, Homo Sapiens
CWLFLNILQ

SEQ ID NO: 853142 - protein, 9 aa, Homo Sapiens
DMQEIIHNF

SEQ ID NO: 853143 - protein, 9 aa, Homo Sapiens
NTLLVLHKS

SEQ ID NO: 853144 - protein, 9 aa, Homo Sapiens
CRLPVSNKT

SEQ ID NO: 853145 - protein, 9 aa, Homo Sapiens
TRSPLRVSK

SEQ ID NO: 853146 - protein, 9 aa, Homo Sapiens
GVVSVFVKV

SEQ ID NO: 853147 - protein, 9 aa, Homo Sapiens
IFGPDGSQI

SEQ ID NO: 853148 - protein, 9 aa, Homo Sapiens
DGWPRAKLP

SEQ ID NO: 853149 - protein, 9 aa, Homo Sapiens
STFEGCPAL

SEQ ID NO: 853150 - protein, 9 aa, Homo Sapiens
RKMVLEIIR

SEQ ID NO: 853151 - protein, 9 aa, Homo Sapiens
MLDNLALLT

SEQ ID NO: 853152 - protein, 9 aa, Homo Sapiens
TSSICTECG

SEQ ID NO: 853153 - protein, 9 aa, Homo Sapiens
KQAKLEEIY

SEQ ID NO: 853154 - protein, 9 aa, Homo Sapiens
APPSFVAIQ

SEQ ID NO: 853155 - protein, 9 aa, Homo Sapiens
TNTSSESTG

SEQ ID NO: 853156 - protein, 9 aa, Homo Sapiens
IMRVLHIAR

SEQ ID NO: 853157 - protein, 9 aa, Homo Sapiens
TSIWKAELE

SEQ ID NO: 853158 - protein, 9 aa, Homo Sapiens
EVSRISKVL

SEQ ID NO: 853159 - protein, 9 aa, Homo Sapiens
FFNRALKVM

SEQ ID NO: 853160 - protein, 9 aa, Homo Sapiens
EDARKIILC

SEQ ID NO: 853161 - protein, 9 aa, Homo Sapiens
ENLQIYWLN

SEQ ID NO: 853162 - protein, 9 aa, Homo Sapiens
MIYFVGCFA

SEQ ID NO: 853163 - protein, 9 aa, Homo Sapiens
SQAFVLNSP

SEQ ID NO: 853164 - protein, 9 aa, Homo Sapiens
GGVRMDVVS

SEQ ID NO: 853165 - protein, 9 aa, Homo Sapiens
AFIETYNVD

SEQ ID NO: 853166 - protein, 9 aa, Homo Sapiens
GATWKTLLH

SEQ ID NO: 853167 - protein, 9 aa, Homo Sapiens
LDWKVNKDK

SEQ ID NO: 853168 - protein, 9 aa, Homo Sapiens
IIILTFVSI

SEQ ID NO: 853169 - protein, 9 aa, Homo Sapiens
NRLYDNIED

SEQ ID NO: 853170 - protein, 9 aa, Homo Sapiens
HLAPPYAAV

SEQ ID NO: 853171 - protein, 9 aa, Homo Sapiens
LIKNGSKTV

SEQ ID NO: 853172 - protein, 9 aa, Homo Sapiens
GNTTVLYRL

SEQ ID NO: 853173 - protein, 9 aa, Homo Sapiens
LVIIFISPD

SEQ ID NO: 853174 - protein, 9 aa, Homo Sapiens
GHSISKPDL

SEQ ID NO: 853175 - protein, 9 aa, Homo Sapiens
YCNSVIQAL

SEQ ID NO: 853176 - protein, 9 aa, Homo Sapiens
FKALQEEYK

SEQ ID NO: 853177 - protein, 9 aa, Homo Sapiens
KNAKDLDVG

SEQ ID NO: 853178 - protein, 9 aa, Homo Sapiens
KLYYLRIHM

SEQ ID NO: 853179 - protein, 9 aa, Homo Sapiens
LCQDMRGYQ

SEQ ID NO: 853180 - protein, 9 aa, Homo Sapiens
MFPEHAVQA

SEQ ID NO: 853181 - protein, 9 aa, Homo Sapiens
HWSQAVNYG

SEQ ID NO: 853182 - protein, 9 aa, Homo Sapiens
HLNHAIGGL

SEQ ID NO: 853183 - protein, 9 aa, Homo Sapiens
KLHEIELKV

SEQ ID NO: 853184 - protein, 9 aa, Homo Sapiens
IIPNYRTKV

SEQ ID NO: 853185 - protein, 9 aa, Homo Sapiens
RGNELFCEV

SEQ ID NO: 853186 - protein, 9 aa, Homo Sapiens
VTEKLRRSQ

SEQ ID NO: 853187 - protein, 9 aa, Homo Sapiens
LQNKIKLAV

SEQ ID NO: 853188 - protein, 9 aa, Homo Sapiens
RSSHLVKHQ

SEQ ID NO: 853189 - protein, 9 aa, Homo Sapiens
LKLIAKERQ

SEQ ID NO: 853190 - protein, 9 aa, Homo Sapiens
EDNNKLISE

SEQ ID NO: 853191 - protein, 9 aa, Homo Sapiens
NLEKLRVDT

SEQ ID NO: 853192 - protein, 9 aa, Homo Sapiens
DERNAICSM

SEQ ID NO: 853193 - protein, 9 aa, Homo Sapiens
LCSLFVVST

SEQ ID NO: 853194 - protein, 9 aa, Homo Sapiens
GFTIIYKWN

SEQ ID NO: 853195 - protein, 9 aa, Homo Sapiens
INGAWEIVH

SEQ ID NO: 853196 - protein, 9 aa, Homo Sapiens
ELSQEEWKC

SEQ ID NO: 853197 - protein, 9 aa, Homo Sapiens
EKYSIINYT

SEQ ID NO: 853198 - protein, 9 aa, Homo Sapiens
HHMQCLEKE

SEQ ID NO: 853199 - protein, 9 aa, Homo Sapiens
KDSKPRYLR

SEQ ID NO: 853200 - protein, 9 aa, Homo Sapiens
EFIFHISRL

SEQ ID NO: 853201 - protein, 9 aa, Homo Sapiens
ECSGVRKCC

SEQ ID NO: 853202 - protein, 9 aa, Homo Sapiens
NGNMTELER

SEQ ID NO: 853203 - protein, 9 aa, Homo Sapiens
KDAEEWLFT

SEQ ID NO: 853204 - protein, 9 aa, Homo Sapiens
KENSKLTFK

SEQ ID NO: 853205 - protein, 9 aa, Homo Sapiens
QLHREIEIQ

SEQ ID NO: 853206 - protein, 9 aa, Homo Sapiens
NKICSLPAE

SEQ ID NO: 853207 - protein, 9 aa, Homo Sapiens
FSRSSTLVQ

SEQ ID NO: 853208 - protein, 9 aa, Homo Sapiens
GPQNAAAAA

SEQ ID NO: 853209 - protein, 9 aa, Homo Sapiens
ECWCPFGSE

SEQ ID NO: 853210 - protein, 9 aa, Homo Sapiens
HIHDRTILH

SEQ ID NO: 853211 - protein, 9 aa, Homo Sapiens
MFPALGEVS

SEQ ID NO: 853212 - protein, 9 aa, Homo Sapiens
PDFREIIIA

SEQ ID NO: 853213 - protein, 9 aa, Homo Sapiens
KAEVTARDV

SEQ ID NO: 853214 - protein, 9 aa, Homo Sapiens
YVNKKIDRE

SEQ ID NO: 853215 - protein, 9 aa, Homo Sapiens
ARGQDPAKR

SEQ ID NO: 853216 - protein, 9 aa, Homo Sapiens
TQHPEVVYT

SEQ ID NO: 853217 - protein, 9 aa, Homo Sapiens
YLNELTYNN

SEQ ID NO: 853218 - protein, 9 aa, Homo Sapiens
CVGTMALLS

SEQ ID NO: 853219 - protein, 9 aa, Homo Sapiens
MSHSPDAKE

SEQ ID NO: 853220 - protein, 9 aa, Homo Sapiens
SSDGDLVSL

SEQ ID NO: 853221 - protein, 9 aa, Homo Sapiens
KSEAASVNK

SEQ ID NO: 853222 - protein, 9 aa, Homo Sapiens
HGNLFMSFQ

SEQ ID NO: 853223 - protein, 9 aa, Homo Sapiens
FGVRTRDAN

SEQ ID NO: 853224 - protein, 9 aa, Homo Sapiens
INYSVVEEN

SEQ ID NO: 853225 - protein, 9 aa, Homo Sapiens
SFETKIISV

SEQ ID NO: 853226 - protein, 9 aa, Homo Sapiens
LHWMEGDPD

SEQ ID NO: 853227 - protein, 9 aa, Homo Sapiens
LQNYFKKEE

SEQ ID NO: 853228 - protein, 9 aa, Homo Sapiens
PSPVTSIPF

SEQ ID NO: 853229 - protein, 9 aa, Homo Sapiens
PWEHQWNVV

SEQ ID NO: 853230 - protein, 9 aa, Homo Sapiens
IYQQEWQRF

SEQ ID NO: 853231 - protein, 9 aa, Homo Sapiens
DESVCIECN

SEQ ID NO: 853232 - protein, 9 aa, Homo Sapiens
ATATINSLS

SEQ ID NO: 853233 - protein, 9 aa, Homo Sapiens
DELDKLTGY

SEQ ID NO: 853234 - protein, 9 aa, Homo Sapiens
LYPSCTGSH

SEQ ID NO: 853235 - protein, 9 aa, Homo Sapiens
KYFDWNLKN

SEQ ID NO: 853236 - protein, 9 aa, Homo Sapiens
YIQDKTAVP

SEQ ID NO: 853237 - protein, 9 aa, Homo Sapiens
WRLFLECER

SEQ ID NO: 853238 - protein, 9 aa, Homo Sapiens
SLNTHLRTH

SEQ ID NO: 853239 - protein, 9 aa, Homo Sapiens
RIPAKTPPT

SEQ ID NO: 853240 - protein, 9 aa, Homo Sapiens
AGIKNAEIY

SEQ ID NO: 853241 - protein, 9 aa, Homo Sapiens
IYAGVCEEM

SEQ ID NO: 853242 - protein, 9 aa, Homo Sapiens
HYQRTPCYA

SEQ ID NO: 853243 - protein, 9 aa, Homo Sapiens
FFMLYLVTI

SEQ ID NO: 853244 - protein, 9 aa, Homo Sapiens
NLGSKVIRQ

SEQ ID NO: 853245 - protein, 9 aa, Homo Sapiens
ISLVPPSTA

SEQ ID NO: 853246 - protein, 9 aa, Homo Sapiens
LFFSRVRNA

SEQ ID NO: 853247 - protein, 9 aa, Homo Sapiens
AGPCFQLRY

SEQ ID NO: 853248 - protein, 9 aa, Homo Sapiens
ITAAHCGHP

SEQ ID NO: 853249 - protein, 9 aa, Homo Sapiens
MNYRVVGGI

SEQ ID NO: 853250 - protein, 9 aa, Homo Sapiens
LDRIMDFRR

SEQ ID NO: 853251 - protein, 9 aa, Homo Sapiens
GKAYDNACQ

SEQ ID NO: 853252 - protein, 9 aa, Homo Sapiens
IKIQQIEQD

SEQ ID NO: 853253 - protein, 9 aa, Homo Sapiens
VLKEFIYCL

SEQ ID NO: 853254 - protein, 9 aa, Homo Sapiens
IAYGADGDV

SEQ ID NO: 853255 - protein, 9 aa, Homo Sapiens
KTLITERDN

SEQ ID NO: 853256 - protein, 9 aa, Homo Sapiens
NQTLTGYNY

SEQ ID NO: 853257 - protein, 9 aa, Homo Sapiens
RDINLKEYA

SEQ ID NO: 853258 - protein, 9 aa, Homo Sapiens
FHPVSNSCI

SEQ ID NO: 853259 - protein, 9 aa, Homo Sapiens
QARIKARKE

SEQ ID NO: 853260 - protein, 9 aa, Homo Sapiens
AAHRCCNKT

SEQ ID NO: 853261 - protein, 9 aa, Homo Sapiens
FLVEEVVQE

SEQ ID NO: 853262 - protein, 9 aa, Homo Sapiens
GLYHSPSMP

SEQ ID NO: 853263 - protein, 9 aa, Homo Sapiens
KKNKLTFVQ

SEQ ID NO: 853264 - protein, 9 aa, Homo Sapiens
HIGAKVMFV

SEQ ID NO: 853265 - protein, 9 aa, Homo Sapiens
HGQTGPPGP

SEQ ID NO: 853266 - protein, 9 aa, Homo Sapiens
PQVNHLKIP

SEQ ID NO: 853267 - protein, 9 aa, Homo Sapiens
TINTHKRIH

SEQ ID NO: 853268 - protein, 9 aa, Homo Sapiens
WNRNARYFP

SEQ ID NO: 853269 - protein, 9 aa, Homo Sapiens
HWDVNKRDS

SEQ ID NO: 853270 - protein, 9 aa, Homo Sapiens
LQVQKDIFI

SEQ ID NO: 853271 - protein, 9 aa, Homo Sapiens
VPAAPTECF

SEQ ID NO: 853272 - protein, 9 aa, Homo Sapiens
ALMASLATH

SEQ ID NO: 853273 - protein, 9 aa, Homo Sapiens
RATQIPSYT

SEQ ID NO: 853274 - protein, 9 aa, Homo Sapiens
LLNQLDECR

SEQ ID NO: 853275 - protein, 9 aa, Homo Sapiens
CSEACLKMK

SEQ ID NO: 853276 - protein, 9 aa, Homo Sapiens
KKRKALYEQ

SEQ ID NO: 853277 - protein, 9 aa, Homo Sapiens
RLKEHIARK

SEQ ID NO: 853278 - protein, 9 aa, Homo Sapiens
ECCAVCPHP

SEQ ID NO: 853279 - protein, 9 aa, Homo Sapiens
DDNEENPTN

SEQ ID NO: 853280 - protein, 9 aa, Homo Sapiens
PPPQKLPSV

SEQ ID NO: 853281 - protein, 9 aa, Homo Sapiens
GNGLTVASF

SEQ ID NO: 853282 - protein, 9 aa, Homo Sapiens
IGFLFAIFI

SEQ ID NO: 853283 - protein, 9 aa, Homo Sapiens
LQQEIGWFD

SEQ ID NO: 853284 - protein, 9 aa, Homo Sapiens
GGFQAMDGR

SEQ ID NO: 853285 - protein, 9 aa, Homo Sapiens
NTMKENSIT

SEQ ID NO: 853286 - protein, 9 aa, Homo Sapiens
FQNGEEEDE

SEQ ID NO: 853287 - protein, 9 aa, Homo Sapiens
TLAVLTAGL

SEQ ID NO: 853288 - protein, 9 aa, Homo Sapiens
EYQKIMKKL

SEQ ID NO: 853289 - protein, 9 aa, Homo Sapiens
LQGCDCDKD

SEQ ID NO: 853290 - protein, 9 aa, Homo Sapiens
VEKKNKGKR

SEQ ID NO: 853291 - protein, 9 aa, Homo Sapiens
FKEEKLADQ

SEQ ID NO: 853292 - protein, 9 aa, Homo Sapiens
GGSILSGLV

SEQ ID NO: 853293 - protein, 9 aa, Homo Sapiens
KRITPDSYA

SEQ ID NO: 853294 - protein, 9 aa, Homo Sapiens
SKGQKAYAP

SEQ ID NO: 853295 - protein, 9 aa, Homo Sapiens
TFPPASVEA

SEQ ID NO: 853296 - protein, 9 aa, Homo Sapiens
NYIKVNLIK

SEQ ID NO: 853297 - protein, 9 aa, Homo Sapiens
LIYSTNTKT

SEQ ID NO: 853298 - protein, 9 aa, Homo Sapiens
IYHSELDKY

SEQ ID NO: 853299 - protein, 9 aa, Homo Sapiens
DGGPVISKG

SEQ ID NO: 853300 - protein, 9 aa, Homo Sapiens
SGDLGPWNQ

SEQ ID NO: 853301 - protein, 9 aa, Homo Sapiens
THTGEQPFE

SEQ ID NO: 853302 - protein, 9 aa, Homo Sapiens
IGKYFILFT

SEQ ID NO: 853303 - protein, 9 aa, Homo Sapiens
LFDEKLNSL

SEQ ID NO: 853304 - protein, 9 aa, Homo Sapiens
EIDKMAETT

SEQ ID NO: 853305 - protein, 9 aa, Homo Sapiens
DGSLKEVHT

SEQ ID NO: 853306 - protein, 9 aa, Homo Sapiens
LRRSGYGPG

SEQ ID NO: 853307 - protein, 9 aa, Homo Sapiens
VESIVKLYK

SEQ ID NO: 853308 - protein, 9 aa, Homo Sapiens
TRKAYFRWD

SEQ ID NO: 853309 - protein, 9 aa, Homo Sapiens
RDVISLKVK

SEQ ID NO: 853310 - protein, 9 aa, Homo Sapiens
PKARFVAKS

SEQ ID NO: 853311 - protein, 9 aa, Homo Sapiens
DQYLQVQKD

SEQ ID NO: 853312 - protein, 9 aa, Homo Sapiens
YRYDRVIFW

SEQ ID NO: 853313 - protein, 9 aa, Homo Sapiens
QQQFCGKYA

SEQ ID NO: 853314 - protein, 9 aa, Homo Sapiens
GPEKNIPIT

SEQ ID NO: 853315 - protein, 9 aa, Homo Sapiens
GHGRFLGDK

SEQ ID NO: 853316 - protein, 9 aa, Homo Sapiens
ARKFVPFRK

SEQ ID NO: 853317 - protein, 9 aa, Homo Sapiens
PVMALIIYM

SEQ ID NO: 853318 - protein, 9 aa, Homo Sapiens
GYRNEFLDF

SEQ ID NO: 853319 - protein, 9 aa, Homo Sapiens
TGHNNEKYC

SEQ ID NO: 853320 - protein, 9 aa, Homo Sapiens
NIKDLLEDT

SEQ ID NO: 853321 - protein, 9 aa, Homo Sapiens
PGHTVYAKV

SEQ ID NO: 853322 - protein, 9 aa, Homo Sapiens
NLVLIGAPH

SEQ ID NO: 853323 - protein, 9 aa, Homo Sapiens
KVPQIHWDL

SEQ ID NO: 853324 - protein, 9 aa, Homo Sapiens
FIDTVSSSY

SEQ ID NO: 853325 - protein, 9 aa, Homo Sapiens
DKLQNASWI

SEQ ID NO: 853326 - protein, 9 aa, Homo Sapiens
GFPGDVGAK

SEQ ID NO: 853327 - protein, 9 aa, Homo Sapiens
CTKLDMARG

SEQ ID NO: 853328 - protein, 9 aa, Homo Sapiens
RQIAHGADA

SEQ ID NO: 853329 - protein, 9 aa, Homo Sapiens
LGADTVGMS

SEQ ID NO: 853330 - protein, 9 aa, Homo Sapiens
YPSDLLDAL

SEQ ID NO: 853331 - protein, 9 aa, Homo Sapiens
VVDQALRES

SEQ ID NO: 853332 - protein, 9 aa, Homo Sapiens
IFLAATNIC

SEQ ID NO: 853333 - protein, 9 aa, Homo Sapiens
ETSSSFSLS

SEQ ID NO: 853334 - protein, 9 aa, Homo Sapiens
ENMSIGEGR

SEQ ID NO: 853335 - protein, 9 aa, Homo Sapiens
CSEFCFNDN

SEQ ID NO: 853336 - protein, 9 aa, Homo Sapiens
LRYHTGEGR

SEQ ID NO: 853337 - protein, 9 aa, Homo Sapiens
FENSVYEGD

SEQ ID NO: 853338 - protein, 9 aa, Homo Sapiens
SHTPELAHC

SEQ ID NO: 853339 - protein, 9 aa, Homo Sapiens
SDKSNDLLY

SEQ ID NO: 853340 - protein, 9 aa, Homo Sapiens
VTETVNLQN

SEQ ID NO: 853341 - protein, 9 aa, Homo Sapiens
KNQYTIDYS

SEQ ID NO: 853342 - protein, 9 aa, Homo Sapiens
KVILLKDAK

SEQ ID NO: 853343 - protein, 9 aa, Homo Sapiens
FGEPTTGLD

SEQ ID NO: 853344 - protein, 9 aa, Homo Sapiens
FDAMNNSTK

SEQ ID NO: 853345 - protein, 9 aa, Homo Sapiens
LESDNEDGG

SEQ ID NO: 853346 - protein, 9 aa, Homo Sapiens
RDVTKNALL

SEQ ID NO: 853347 - protein, 9 aa, Homo Sapiens
LAHLDLSGN

SEQ ID NO: 853348 - protein, 9 aa, Homo Sapiens
IAWRAATPL

SEQ ID NO: 853349 - protein, 9 aa, Homo Sapiens
RTFKLPRLT

SEQ ID NO: 853350 - protein, 9 aa, Homo Sapiens
LRKRASKIY

SEQ ID NO: 853351 - protein, 9 aa, Homo Sapiens
AYQCAGRSK

SEQ ID NO: 853352 - protein, 9 aa, Homo Sapiens
YQNYIAELQ

SEQ ID NO: 853353 - protein, 9 aa, Homo Sapiens
EREVPRGLR

SEQ ID NO: 853354 - protein, 9 aa, Homo Sapiens
VAQEAIENG

SEQ ID NO: 853355 - protein, 9 aa, Homo Sapiens
TEMLQEICT

SEQ ID NO: 853356 - protein, 9 aa, Homo Sapiens
LAQQPSYPG

SEQ ID NO: 853357 - protein, 9 aa, Homo Sapiens
AKYKVKANL

SEQ ID NO: 853358 - protein, 9 aa, Homo Sapiens
KYHVKPLQT

SEQ ID NO: 853359 - protein, 9 aa, Homo Sapiens
TDTFPNTWL

SEQ ID NO: 853360 - protein, 9 aa, Homo Sapiens
SAFERNNIT

SEQ ID NO: 853361 - protein, 9 aa, Homo Sapiens
IFFKGSRFQ

SEQ ID NO: 853362 - protein, 9 aa, Homo Sapiens
KAQEYERIV

SEQ ID NO: 853363 - protein, 9 aa, Homo Sapiens
SVAQIYHAV

SEQ ID NO: 853364 - protein, 9 aa, Homo Sapiens
PTLTWFVPL

SEQ ID NO: 853365 - protein, 9 aa, Homo Sapiens
SQNHSCTPD

SEQ ID NO: 853366 - protein, 9 aa, Homo Sapiens
TANNWELTA

SEQ ID NO: 853367 - protein, 9 aa, Homo Sapiens
SRVLDNCED

SEQ ID NO: 853368 - protein, 9 aa, Homo Sapiens
KTPLEGDFA

SEQ ID NO: 853369 - protein, 9 aa, Homo Sapiens
ISKLLSYFM

SEQ ID NO: 853370 - protein, 9 aa, Homo Sapiens
TDDTPSSLL

SEQ ID NO: 853371 - protein, 9 aa, Homo Sapiens
CCPAYPQSP

SEQ ID NO: 853372 - protein, 9 aa, Homo Sapiens
YWKVFEDSV

SEQ ID NO: 853373 - protein, 9 aa, Homo Sapiens
VAQGEMGLQ

SEQ ID NO: 853374 - protein, 9 aa, Homo Sapiens
VGLCVHVCL

SEQ ID NO: 853375 - protein, 9 aa, Homo Sapiens
LVDLVREGL

SEQ ID NO: 853376 - protein, 9 aa, Homo Sapiens
NDRSKDLEK

SEQ ID NO: 853377 - protein, 9 aa, Homo Sapiens
FNKALPALP

SEQ ID NO: 853378 - protein, 9 aa, Homo Sapiens
VSLGRAVSK

SEQ ID NO: 853379 - protein, 9 aa, Homo Sapiens
SEDSSVAQI

SEQ ID NO: 853380 - protein, 9 aa, Homo Sapiens
EKPGLRELS

SEQ ID NO: 853381 - protein, 9 aa, Homo Sapiens
FNSVQEMVQ

SEQ ID NO: 853382 - protein, 9 aa, Homo Sapiens
REHGSGVTV

SEQ ID NO: 853383 - protein, 9 aa, Homo Sapiens
ASHSPACNN

SEQ ID NO: 853384 - protein, 9 aa, Homo Sapiens
HAEQVLSDK

SEQ ID NO: 853385 - protein, 9 aa, Homo Sapiens
FGNDGVKVC

SEQ ID NO: 853386 - protein, 9 aa, Homo Sapiens
RLEQKIKIN

SEQ ID NO: 853387 - protein, 9 aa, Homo Sapiens
AYRNLIKVL

SEQ ID NO: 853388 - protein, 9 aa, Homo Sapiens
LQFQRLGHL

SEQ ID NO: 853389 - protein, 9 aa, Homo Sapiens
VTIKEEVLS

SEQ ID NO: 853390 - protein, 9 aa, Homo Sapiens
AAACAATDD

SEQ ID NO: 853391 - protein, 9 aa, Homo Sapiens
IRVVGSDFV

SEQ ID NO: 853392 - protein, 9 aa, Homo Sapiens
NKFRWYRFQ

SEQ ID NO: 853393 - protein, 9 aa, Homo Sapiens
ISKHNLFQT

SEQ ID NO: 853394 - protein, 9 aa, Homo Sapiens
LKQCNRENN

SEQ ID NO: 853395 - protein, 9 aa, Homo Sapiens
KNSLKNMAF

SEQ ID NO: 853396 - protein, 9 aa, Homo Sapiens
QLTAKYILY

SEQ ID NO: 853397 - protein, 9 aa, Homo Sapiens
AIYFRCLGL

SEQ ID NO: 853398 - protein, 9 aa, Homo Sapiens
NDLESLDAT

SEQ ID NO: 853399 - protein, 9 aa, Homo Sapiens
IHLDDMHSD

SEQ ID NO: 853400 - protein, 9 aa, Homo Sapiens
PTGMNPTGI

SEQ ID NO: 853401 - protein, 9 aa, Homo Sapiens
YYKNTHRLP

SEQ ID NO: 853402 - protein, 9 aa, Homo Sapiens
KIHYMASFL

SEQ ID NO: 853403 - protein, 9 aa, Homo Sapiens
IADIFESKR

SEQ ID NO: 853404 - protein, 9 aa, Homo Sapiens
KLADTMRTR

SEQ ID NO: 853405 - protein, 9 aa, Homo Sapiens
GPRCELWAG

SEQ ID NO: 853406 - protein, 9 aa, Homo Sapiens
TKSLVYGIV

SEQ ID NO: 853407 - protein, 9 aa, Homo Sapiens
KKPFFLGPQ

SEQ ID NO: 853408 - protein, 9 aa, Homo Sapiens
KTYKSKNFE

SEQ ID NO: 853409 - protein, 9 aa, Homo Sapiens
EDRRFMCPV

SEQ ID NO: 853410 - protein, 9 aa, Homo Sapiens
GTPQPGVFN

SEQ ID NO: 853411 - protein, 9 aa, Homo Sapiens
GEYLSKQEV

SEQ ID NO: 853412 - protein, 9 aa, Homo Sapiens
GREKTLGET

SEQ ID NO: 853413 - protein, 9 aa, Homo Sapiens
MNNSTKEFV

SEQ ID NO: 853414 - protein, 9 aa, Homo Sapiens
PFVENDIPF

SEQ ID NO: 853415 - protein, 9 aa, Homo Sapiens
ACGYRGSSE

SEQ ID NO: 853416 - protein, 9 aa, Homo Sapiens
VNPIWKIYH

SEQ ID NO: 853417 - protein, 9 aa, Homo Sapiens
CDYHGHSQK

SEQ ID NO: 853418 - protein, 9 aa, Homo Sapiens
RTCSIPKSN

SEQ ID NO: 853419 - protein, 9 aa, Homo Sapiens
RSFLFITPP

SEQ ID NO: 853420 - protein, 9 aa, Homo Sapiens
LFGAWHVYR

SEQ ID NO: 853421 - protein, 9 aa, Homo Sapiens
DERRRKFME

SEQ ID NO: 853422 - protein, 9 aa, Homo Sapiens
VESAPKQHD

SEQ ID NO: 853423 - protein, 9 aa, Homo Sapiens
SPRNTYSDR

SEQ ID NO: 853424 - protein, 9 aa, Homo Sapiens
ARLTYNLKK

SEQ ID NO: 853425 - protein, 9 aa, Homo Sapiens
PDTQPPNNI

SEQ ID NO: 853426 - protein, 9 aa, Homo Sapiens
QRQEIIQHV

SEQ ID NO: 853427 - protein, 9 aa, Homo Sapiens
VVLKDVDSL

SEQ ID NO: 853428 - protein, 9 aa, Homo Sapiens
IVIIILMTI

SEQ ID NO: 853429 - protein, 9 aa, Homo Sapiens
QELDHIKKA

SEQ ID NO: 853430 - protein, 9 aa, Homo Sapiens
DVGRPQPGH

SEQ ID NO: 853431 - protein, 9 aa, Homo Sapiens
ANKREKLEK

SEQ ID NO: 853432 - protein, 9 aa, Homo Sapiens
VGTFVVNKK

SEQ ID NO: 853433 - protein, 9 aa, Homo Sapiens
ILQYDMLHE

SEQ ID NO: 853434 - protein, 9 aa, Homo Sapiens
AELMAMVRP

SEQ ID NO: 853435 - protein, 9 aa, Homo Sapiens
KLGLELYPV

SEQ ID NO: 853436 - protein, 9 aa, Homo Sapiens
LIYLITMLE

SEQ ID NO: 853437 - protein, 9 aa, Homo Sapiens
FAISASTVL

SEQ ID NO: 853438 - protein, 9 aa, Homo Sapiens
EDTTSFDSA

SEQ ID NO: 853439 - protein, 9 aa, Homo Sapiens
MSTLTCHRK

SEQ ID NO: 853440 - protein, 9 aa, Homo Sapiens
FDIQLPYKL

SEQ ID NO: 853441 - protein, 9 aa, Homo Sapiens
WRDSKEKNE

SEQ ID NO: 853442 - protein, 9 aa, Homo Sapiens
CNSTPRLAT

SEQ ID NO: 853443 - protein, 9 aa, Homo Sapiens
AEEAGETMV

SEQ ID NO: 853444 - protein, 9 aa, Homo Sapiens
IMEKSTMVY

SEQ ID NO: 853445 - protein, 9 aa, Homo Sapiens
TERWWLNGP

SEQ ID NO: 853446 - protein, 9 aa, Homo Sapiens
SLFLHYLVS

SEQ ID NO: 853447 - protein, 9 aa, Homo Sapiens
SLPWSSDPF

SEQ ID NO: 853448 - protein, 9 aa, Homo Sapiens
KNKECVANH

SEQ ID NO: 853449 - protein, 9 aa, Homo Sapiens
GLVKTFIDK

SEQ ID NO: 853450 - protein, 9 aa, Homo Sapiens
PYSPGLQSC

SEQ ID NO: 853451 - protein, 9 aa, Homo Sapiens
QLVQSWYIR

SEQ ID NO: 853452 - protein, 9 aa, Homo Sapiens
SIHRGVHTG

SEQ ID NO: 853453 - protein, 9 aa, Homo Sapiens
LDREEQPHP

SEQ ID NO: 853454 - protein, 9 aa, Homo Sapiens
TLGGDKLAN

SEQ ID NO: 853455 - protein, 9 aa, Homo Sapiens
YLHCQKLVH

SEQ ID NO: 853456 - protein, 9 aa, Homo Sapiens
MATIKSERI

SEQ ID NO: 853457 - protein, 9 aa, Homo Sapiens
GSRVAELTG

SEQ ID NO: 853458 - protein, 9 aa, Homo Sapiens
QAIKLFKDE

SEQ ID NO: 853459 - protein, 9 aa, Homo Sapiens
TVDVEFGVA

SEQ ID NO: 853460 - protein, 9 aa, Homo Sapiens
RLHSGENPF

SEQ ID NO: 853461 - protein, 9 aa, Homo Sapiens
NTVNVASRI

SEQ ID NO: 853462 - protein, 9 aa, Homo Sapiens
SIINSFVTD

SEQ ID NO: 853463 - protein, 9 aa, Homo Sapiens
NMPLSHSIT

SEQ ID NO: 853464 - protein, 9 aa, Homo Sapiens
VRTKEINQG

SEQ ID NO: 853465 - protein, 9 aa, Homo Sapiens
ENKINISKN

SEQ ID NO: 853466 - protein, 9 aa, Homo Sapiens
VEMNTGKAE

SEQ ID NO: 853467 - protein, 9 aa, Homo Sapiens
SQQSFECSR

SEQ ID NO: 853468 - protein, 9 aa, Homo Sapiens
PSIIVISTP

SEQ ID NO: 853469 - protein, 9 aa, Homo Sapiens
LNKCKPNRT

SEQ ID NO: 853470 - protein, 9 aa, Homo Sapiens
MDQNRDGLI

SEQ ID NO: 853471 - protein, 9 aa, Homo Sapiens
DADRCTLPK

SEQ ID NO: 853472 - protein, 9 aa, Homo Sapiens
NISEELQIN

SEQ ID NO: 853473 - protein, 9 aa, Homo Sapiens
FEVVCIRWV

SEQ ID NO: 853474 - protein, 9 aa, Homo Sapiens
SSIVYTKEG

SEQ ID NO: 853475 - protein, 9 aa, Homo Sapiens
MSRSMTFQS

SEQ ID NO: 853476 - protein, 9 aa, Homo Sapiens
KRKALYEQS

SEQ ID NO: 853477 - protein, 9 aa, Homo Sapiens
FVQKNGVNE

SEQ ID NO: 853478 - protein, 9 aa, Homo Sapiens
LADRGLVHM

SEQ ID NO: 853479 - protein, 9 aa, Homo Sapiens
QVKQESVGV

SEQ ID NO: 853480 - protein, 9 aa, Homo Sapiens
QECPIKEAV

SEQ ID NO: 853481 - protein, 9 aa, Homo Sapiens
GVCAVINQS

SEQ ID NO: 853482 - protein, 9 aa, Homo Sapiens
VLAVLLVVA

SEQ ID NO: 853483 - protein, 9 aa, Homo Sapiens
TITVPPFYG

SEQ ID NO: 853484 - protein, 9 aa, Homo Sapiens
LNGRRINTL

SEQ ID NO: 853485 - protein, 9 aa, Homo Sapiens
PSTARITFQ

SEQ ID NO: 853486 - protein, 9 aa, Homo Sapiens
LMVKLQKLQ

SEQ ID NO: 853487 - protein, 9 aa, Homo Sapiens
ANALGKYVL

SEQ ID NO: 853488 - protein, 9 aa, Homo Sapiens
DNNRIEERL

SEQ ID NO: 853489 - protein, 9 aa, Homo Sapiens
LPINPSMAD

SEQ ID NO: 853490 - protein, 9 aa, Homo Sapiens
VTSTWNLAL

SEQ ID NO: 853491 - protein, 9 aa, Homo Sapiens
TTFLNIKHY

SEQ ID NO: 853492 - protein, 9 aa, Homo Sapiens
FDPDNFDKS

SEQ ID NO: 853493 - protein, 9 aa, Homo Sapiens
HGYPYRDLD

SEQ ID NO: 853494 - protein, 9 aa, Homo Sapiens
LADVPGEML

SEQ ID NO: 853495 - protein, 9 aa, Homo Sapiens
TYLYLLFDE

SEQ ID NO: 853496 - protein, 9 aa, Homo Sapiens
PGNIIVYLY

SEQ ID NO: 853497 - protein, 9 aa, Homo Sapiens
TGNNWIEGE

SEQ ID NO: 853498 - protein, 9 aa, Homo Sapiens
RFHCPIYYL

SEQ ID NO: 853499 - protein, 9 aa, Homo Sapiens
CPSWAGLSL

SEQ ID NO: 853500 - protein, 9 aa, Homo Sapiens
LNPKLKQAR

SEQ ID NO: 853501 - protein, 9 aa, Homo Sapiens
LINIPLVHI

SEQ ID NO: 853502 - protein, 9 aa, Homo Sapiens
SSSTYHTII

SEQ ID NO: 853503 - protein, 9 aa, Homo Sapiens
QICLALSLP

SEQ ID NO: 853504 - protein, 9 aa, Homo Sapiens
EKLCKREQK

SEQ ID NO: 853505 - protein, 9 aa, Homo Sapiens
IISYLTIAL

SEQ ID NO: 853506 - protein, 9 aa, Homo Sapiens
FISNQRIYY

SEQ ID NO: 853507 - protein, 9 aa, Homo Sapiens
CYACPQSFS

SEQ ID NO: 853508 - protein, 9 aa, Homo Sapiens
ILALAQNKS

SEQ ID NO: 853509 - protein, 9 aa, Homo Sapiens
PESFICKDK

SEQ ID NO: 853510 - protein, 9 aa, Homo Sapiens
PAVTEEAAL

SEQ ID NO: 853511 - protein, 9 aa, Homo Sapiens
KEELSNIAA

SEQ ID NO: 853512 - protein, 9 aa, Homo Sapiens
GHTVYAKVD

SEQ ID NO: 853513 - protein, 9 aa, Homo Sapiens
TSEGKFDKL

SEQ ID NO: 853514 - protein, 9 aa, Homo Sapiens
FQVASQNVG

SEQ ID NO: 853515 - protein, 9 aa, Homo Sapiens
GLRHKCGVC

SEQ ID NO: 853516 - protein, 9 aa, Homo Sapiens
SHRDKLTKP

SEQ ID NO: 853517 - protein, 9 aa, Homo Sapiens
WKKAQILEV

SEQ ID NO: 853518 - protein, 9 aa, Homo Sapiens
GKAFSRSLG

SEQ ID NO: 853519 - protein, 9 aa, Homo Sapiens
QVKVEGSKY

SEQ ID NO: 853520 - protein, 9 aa, Homo Sapiens
SPYLTPYTD

SEQ ID NO: 853521 - protein, 9 aa, Homo Sapiens
SDPENMSLF

SEQ ID NO: 853522 - protein, 9 aa, Homo Sapiens
EPHKGLLLR

SEQ ID NO: 853523 - protein, 9 aa, Homo Sapiens
EDLLPNSTL

SEQ ID NO: 853524 - protein, 9 aa, Homo Sapiens
DSVAAPFCC

SEQ ID NO: 853525 - protein, 9 aa, Homo Sapiens
DGDKKNHYN

SEQ ID NO: 853526 - protein, 9 aa, Homo Sapiens
VWPAKEDNS

SEQ ID NO: 853527 - protein, 9 aa, Homo Sapiens
SSKLIMHQR

SEQ ID NO: 853528 - protein, 9 aa, Homo Sapiens
EGNDDRIQG

SEQ ID NO: 853529 - protein, 9 aa, Homo Sapiens
MAQKARIRY

SEQ ID NO: 853530 - protein, 9 aa, Homo Sapiens
EVGWYRPPL

SEQ ID NO: 853531 - protein, 9 aa, Homo Sapiens
TGNIIMEFR

SEQ ID NO: 853532 - protein, 9 aa, Homo Sapiens
KLECYPKVA

SEQ ID NO: 853533 - protein, 9 aa, Homo Sapiens
PRKFPAIQN

SEQ ID NO: 853534 - protein, 9 aa, Homo Sapiens
TAVHLLLPG

SEQ ID NO: 853535 - protein, 9 aa, Homo Sapiens
WKREFGEEA

SEQ ID NO: 853536 - protein, 9 aa, Homo Sapiens
DPWEHQWNV

SEQ ID NO: 853537 - protein, 9 aa, Homo Sapiens
DNCSTQREI

SEQ ID NO: 853538 - protein, 9 aa, Homo Sapiens
FLVYNASVI

SEQ ID NO: 853539 - protein, 9 aa, Homo Sapiens
YREPLASHS

SEQ ID NO: 853540 - protein, 9 aa, Homo Sapiens
GKVYRALWC

SEQ ID NO: 853541 - protein, 9 aa, Homo Sapiens
HDCEFHEAS

SEQ ID NO: 853542 - protein, 9 aa, Homo Sapiens
TQSHTTATG

SEQ ID NO: 853543 - protein, 9 aa, Homo Sapiens
QNYHSGNDV

SEQ ID NO: 853544 - protein, 9 aa, Homo Sapiens
ICFQNGEEE

SEQ ID NO: 853545 - protein, 9 aa, Homo Sapiens
DHDQLEQFW

SEQ ID NO: 853546 - protein, 9 aa, Homo Sapiens
GVVYNDSAH

SEQ ID NO: 853547 - protein, 9 aa, Homo Sapiens
EYKLYGGKL

SEQ ID NO: 853548 - protein, 9 aa, Homo Sapiens
CSIVSLLAR

SEQ ID NO: 853549 - protein, 9 aa, Homo Sapiens
PTNLCVLRS

SEQ ID NO: 853550 - protein, 9 aa, Homo Sapiens
IKCLDYKPI

SEQ ID NO: 853551 - protein, 9 aa, Homo Sapiens
AQKGTAFLS

SEQ ID NO: 853552 - protein, 9 aa, Homo Sapiens
SWSRAAFLP

SEQ ID NO: 853553 - protein, 9 aa, Homo Sapiens
VYISPNNTV

SEQ ID NO: 853554 - protein, 9 aa, Homo Sapiens
GSGDCKRSN

SEQ ID NO: 853555 - protein, 9 aa, Homo Sapiens
TWRLFLECE

SEQ ID NO: 853556 - protein, 9 aa, Homo Sapiens
FCGPNVIVQ

SEQ ID NO: 853557 - protein, 9 aa, Homo Sapiens
SESEEEEEA

SEQ ID NO: 853558 - protein, 9 aa, Homo Sapiens
KKKCKNSST

SEQ ID NO: 853559 - protein, 9 aa, Homo Sapiens
SYEILQDTD

SEQ ID NO: 853560 - protein, 9 aa, Homo Sapiens
LKVIFTTVC

SEQ ID NO: 853561 - protein, 9 aa, Homo Sapiens
QQDSAPNSD

SEQ ID NO: 853562 - protein, 9 aa, Homo Sapiens
IFLADSGRK

SEQ ID NO: 853563 - protein, 9 aa, Homo Sapiens
DDDFFNELP

SEQ ID NO: 853564 - protein, 9 aa, Homo Sapiens
VIIKVLDVN

SEQ ID NO: 853565 - protein, 9 aa, Homo Sapiens
IRPLRIHTG

SEQ ID NO: 853566 - protein, 9 aa, Homo Sapiens
LEHMHSQRV

SEQ ID NO: 853567 - protein, 9 aa, Homo Sapiens
HALASFDFG

SEQ ID NO: 853568 - protein, 9 aa, Homo Sapiens
LEREMAFHT

SEQ ID NO: 853569 - protein, 9 aa, Homo Sapiens
MDQNIEYEE

SEQ ID NO: 853570 - protein, 9 aa, Homo Sapiens
NGKYMKTPP

SEQ ID NO: 853571 - protein, 9 aa, Homo Sapiens
LRSSYCIEG

SEQ ID NO: 853572 - protein, 9 aa, Homo Sapiens
EEKSIKHET

SEQ ID NO: 853573 - protein, 9 aa, Homo Sapiens
KDTGSRYVA

SEQ ID NO: 853574 - protein, 9 aa, Homo Sapiens
ELFGGVSGL

SEQ ID NO: 853575 - protein, 9 aa, Homo Sapiens
RRDVCSCKA

SEQ ID NO: 853576 - protein, 9 aa, Homo Sapiens
LCYVKFQNV

SEQ ID NO: 853577 - protein, 9 aa, Homo Sapiens
EKYQESVCQ

SEQ ID NO: 853578 - protein, 9 aa, Homo Sapiens
HRSQSSLTI

SEQ ID NO: 853579 - protein, 9 aa, Homo Sapiens
KGAKGESGF

SEQ ID NO: 853580 - protein, 9 aa, Homo Sapiens
CCVGLEAGV

SEQ ID NO: 853581 - protein, 9 aa, Homo Sapiens
LADTLFWWE

SEQ ID NO: 853582 - protein, 9 aa, Homo Sapiens
NMKCCIHGS

SEQ ID NO: 853583 - protein, 9 aa, Homo Sapiens
NRENNRTSS

SEQ ID NO: 853584 - protein, 9 aa, Homo Sapiens
RKEYGTFSL

SEQ ID NO: 853585 - protein, 9 aa, Homo Sapiens
TTTERHHLF

SEQ ID NO: 853586 - protein, 9 aa, Homo Sapiens
EWDGKDSTI

SEQ ID NO: 853587 - protein, 9 aa, Homo Sapiens
QRTVPGEQT

SEQ ID NO: 853588 - protein, 9 aa, Homo Sapiens
QLHERGLTL

SEQ ID NO: 853589 - protein, 9 aa, Homo Sapiens
GVHAENAEE

SEQ ID NO: 853590 - protein, 9 aa, Homo Sapiens
FWKYVATRV

SEQ ID NO: 853591 - protein, 9 aa, Homo Sapiens
VQIINSIYN

SEQ ID NO: 853592 - protein, 9 aa, Homo Sapiens
TLLVFMSHG

SEQ ID NO: 853593 - protein, 9 aa, Homo Sapiens
VDRAQQYVL

SEQ ID NO: 853594 - protein, 9 aa, Homo Sapiens
IYVDTCGQN

SEQ ID NO: 853595 - protein, 9 aa, Homo Sapiens
DQLEIISNG

SEQ ID NO: 853596 - protein, 9 aa, Homo Sapiens
EDVEAEKLF

SEQ ID NO: 853597 - protein, 9 aa, Homo Sapiens
MNIHIGEKP

SEQ ID NO: 853598 - protein, 9 aa, Homo Sapiens
GHLAKAQRG

SEQ ID NO: 853599 - protein, 9 aa, Homo Sapiens
SAKVWSRTA

SEQ ID NO: 853600 - protein, 9 aa, Homo Sapiens
FRSILIDKS

SEQ ID NO: 853601 - protein, 9 aa, Homo Sapiens
LIIDGISQG

SEQ ID NO: 853602 - protein, 9 aa, Homo Sapiens
KVICLVRQR

SEQ ID NO: 853603 - protein, 9 aa, Homo Sapiens
KVFVASVRS

SEQ ID NO: 853604 - protein, 9 aa, Homo Sapiens
LEFLMGAAN

SEQ ID NO: 853605 - protein, 9 aa, Homo Sapiens
GWRNKGAMV

SEQ ID NO: 853606 - protein, 9 aa, Homo Sapiens
LLCQLKELS

SEQ ID NO: 853607 - protein, 9 aa, Homo Sapiens
EDNLHIAED

SEQ ID NO: 853608 - protein, 9 aa, Homo Sapiens
RISHHHPEP

SEQ ID NO: 853609 - protein, 9 aa, Homo Sapiens
GIILYKFLV

SEQ ID NO: 853610 - protein, 9 aa, Homo Sapiens
RIQGVLCGA

SEQ ID NO: 853611 - protein, 9 aa, Homo Sapiens
IPSTARITF

SEQ ID NO: 853612 - protein, 9 aa, Homo Sapiens
ISLEFKNKD

SEQ ID NO: 853613 - protein, 9 aa, Homo Sapiens
NFQSGIGEK

SEQ ID NO: 853614 - protein, 9 aa, Homo Sapiens
AKNILRGFV

SEQ ID NO: 853615 - protein, 9 aa, Homo Sapiens
NTPNNYLSK

SEQ ID NO: 853616 - protein, 9 aa, Homo Sapiens
AENSLGSPA

SEQ ID NO: 853617 - protein, 9 aa, Homo Sapiens
TDKEMEKSF

SEQ ID NO: 853618 - protein, 9 aa, Homo Sapiens
ITCALNNLL

SEQ ID NO: 853619 - protein, 9 aa, Homo Sapiens
KDTKNVNLN

SEQ ID NO: 853620 - protein, 9 aa, Homo Sapiens
DHHCWVHIL

SEQ ID NO: 853621 - protein, 9 aa, Homo Sapiens
GKMDMEESI

SEQ ID NO: 853622 - protein, 9 aa, Homo Sapiens
NHLEDRTLT

SEQ ID NO: 853623 - protein, 9 aa, Homo Sapiens
TLMFMYLQP

SEQ ID NO: 853624 - protein, 9 aa, Homo Sapiens
KDCAVIEGH

SEQ ID NO: 853625 - protein, 9 aa, Homo Sapiens
LETYGFSSL

SEQ ID NO: 853626 - protein, 9 aa, Homo Sapiens
QSIKLMDVW

SEQ ID NO: 853627 - protein, 9 aa, Homo Sapiens
LRFLQPYIS

SEQ ID NO: 853628 - protein, 9 aa, Homo Sapiens
QAVNDEIEA

SEQ ID NO: 853629 - protein, 9 aa, Homo Sapiens
HRVREITEN

SEQ ID NO: 853630 - protein, 9 aa, Homo Sapiens
SDFLTEINY

SEQ ID NO: 853631 - protein, 9 aa, Homo Sapiens
NSLKNMAFF

SEQ ID NO: 853632 - protein, 9 aa, Homo Sapiens
VEHPEAVCQ

SEQ ID NO: 853633 - protein, 9 aa, Homo Sapiens
LQEICTMMT

SEQ ID NO: 853634 - protein, 9 aa, Homo Sapiens
ELLESADKL

SEQ ID NO: 853635 - protein, 9 aa, Homo Sapiens
ATVTLHVLL

SEQ ID NO: 853636 - protein, 9 aa, Homo Sapiens
DSCDNCSTQ

SEQ ID NO: 853637 - protein, 9 aa, Homo Sapiens
HQESPTQYS

SEQ ID NO: 853638 - protein, 9 aa, Homo Sapiens
RQAQRQDNA

SEQ ID NO: 853639 - protein, 9 aa, Homo Sapiens
AVSFCRERS

SEQ ID NO: 853640 - protein, 9 aa, Homo Sapiens
CEKLITVNL

SEQ ID NO: 853641 - protein, 9 aa, Homo Sapiens
SDEVTCVIY

SEQ ID NO: 853642 - protein, 9 aa, Homo Sapiens
QLGGKIHSK

SEQ ID NO: 853643 - protein, 9 aa, Homo Sapiens
TRYVVKHHL

SEQ ID NO: 853644 - protein, 9 aa, Homo Sapiens
IYFARARIP

SEQ ID NO: 853645 - protein, 9 aa, Homo Sapiens
KLQFQVTEG

SEQ ID NO: 853646 - protein, 9 aa, Homo Sapiens
EAILANMET

SEQ ID NO: 853647 - protein, 9 aa, Homo Sapiens
SPPASKRVV

SEQ ID NO: 853648 - protein, 9 aa, Homo Sapiens
VIPLPCCTQ

SEQ ID NO: 853649 - protein, 9 aa, Homo Sapiens
DVDTSWKEL

SEQ ID NO: 853650 - protein, 9 aa, Homo Sapiens
LFQEMAIYI

SEQ ID NO: 853651 - protein, 9 aa, Homo Sapiens
VYNKFKNMF

SEQ ID NO: 853652 - protein, 9 aa, Homo Sapiens
AYAPSFIWV

SEQ ID NO: 853653 - protein, 9 aa, Homo Sapiens
ELYEGPFEY

SEQ ID NO: 853654 - protein, 9 aa, Homo Sapiens
YSVPCQRTT

SEQ ID NO: 853655 - protein, 9 aa, Homo Sapiens
PHELGHVLG

SEQ ID NO: 853656 - protein, 9 aa, Homo Sapiens
ADSGRKILS

SEQ ID NO: 853657 - protein, 9 aa, Homo Sapiens
TSQDEQDEL

SEQ ID NO: 853658 - protein, 9 aa, Homo Sapiens
EFRYQMYQT

SEQ ID NO: 853659 - protein, 9 aa, Homo Sapiens
DGLLNALRY

SEQ ID NO: 853660 - protein, 9 aa, Homo Sapiens
RPRLQLKPQ

SEQ ID NO: 853661 - protein, 9 aa, Homo Sapiens
PILYDIMSK

SEQ ID NO: 853662 - protein, 9 aa, Homo Sapiens
QFIPIKVEQ

SEQ ID NO: 853663 - protein, 9 aa, Homo Sapiens
KMNPPKFFK

SEQ ID NO: 853664 - protein, 9 aa, Homo Sapiens
ATDDYHYDK

SEQ ID NO: 853665 - protein, 9 aa, Homo Sapiens
LRYKRIQRT

SEQ ID NO: 853666 - protein, 9 aa, Homo Sapiens
VICLVRQRT

SEQ ID NO: 853667 - protein, 9 aa, Homo Sapiens
MNSRDFGIW

SEQ ID NO: 853668 - protein, 9 aa, Homo Sapiens
VVILIAYMF

SEQ ID NO: 853669 - protein, 9 aa, Homo Sapiens
GQGWMKLDT

SEQ ID NO: 853670 - protein, 9 aa, Homo Sapiens
SIIEAIKIQ

SEQ ID NO: 853671 - protein, 9 aa, Homo Sapiens
TDPQYLALF

SEQ ID NO: 853672 - protein, 9 aa, Homo Sapiens
WQEDPGAQC

SEQ ID NO: 853673 - protein, 9 aa, Homo Sapiens
ILCAILNIQ

SEQ ID NO: 853674 - protein, 9 aa, Homo Sapiens
SDFTALLTG

SEQ ID NO: 853675 - protein, 9 aa, Homo Sapiens
SEQRPVNHS

SEQ ID NO: 853676 - protein, 9 aa, Homo Sapiens
KPYLTDVLL

SEQ ID NO: 853677 - protein, 9 aa, Homo Sapiens
FDDDLVLGV

SEQ ID NO: 853678 - protein, 9 aa, Homo Sapiens
LSTTNMKTA

SEQ ID NO: 853679 - protein, 9 aa, Homo Sapiens
DNLENYLES

SEQ ID NO: 853680 - protein, 9 aa, Homo Sapiens
EESHPYTNK

SEQ ID NO: 853681 - protein, 9 aa, Homo Sapiens
GRMIQRLMQ

SEQ ID NO: 853682 - protein, 9 aa, Homo Sapiens
HCPSPTMSL

SEQ ID NO: 853683 - protein, 9 aa, Homo Sapiens
ALSNVCALA

SEQ ID NO: 853684 - protein, 9 aa, Homo Sapiens
VPLKELDVL

SEQ ID NO: 853685 - protein, 9 aa, Homo Sapiens
AASVFYTIV

SEQ ID NO: 853686 - protein, 9 aa, Homo Sapiens
AVNYGELRA

SEQ ID NO: 853687 - protein, 9 aa, Homo Sapiens
VHRAFEASE

SEQ ID NO: 853688 - protein, 9 aa, Homo Sapiens
FDEYTEFID

SEQ ID NO: 853689 - protein, 9 aa, Homo Sapiens
STCQNMACI

SEQ ID NO: 853690 - protein, 9 aa, Homo Sapiens
KLDQLIEQR

SEQ ID NO: 853691 - protein, 9 aa, Homo Sapiens
VVWDAAIIL

SEQ ID NO: 853692 - protein, 9 aa, Homo Sapiens
TFINELKNL

SEQ ID NO: 853693 - protein, 9 aa, Homo Sapiens
AEMTKNWSL

SEQ ID NO: 853694 - protein, 9 aa, Homo Sapiens
NINPPALVH

SEQ ID NO: 853695 - protein, 9 aa, Homo Sapiens
NLVSLGRAV

SEQ ID NO: 853696 - protein, 9 aa, Homo Sapiens
HVPPRMSFP

SEQ ID NO: 853697 - protein, 9 aa, Homo Sapiens
QKYVPNKAL

SEQ ID NO: 853698 - protein, 9 aa, Homo Sapiens
EIMYGTNEK

SEQ ID NO: 853699 - protein, 9 aa, Homo Sapiens
PSTFQNKKK

SEQ ID NO: 853700 - protein, 9 aa, Homo Sapiens
QFFRPHYMF

SEQ ID NO: 853701 - protein, 9 aa, Homo Sapiens
LQSLLLPLA

SEQ ID NO: 853702 - protein, 9 aa, Homo Sapiens
MCEQEDKMQ

SEQ ID NO: 853703 - protein, 9 aa, Homo Sapiens
SSINTPAVS

SEQ ID NO: 853704 - protein, 9 aa, Homo Sapiens
KTPPRSVKA

SEQ ID NO: 853705 - protein, 9 aa, Homo Sapiens
AKDKVQDEA

SEQ ID NO: 853706 - protein, 9 aa, Homo Sapiens
TPEEMSEVL

SEQ ID NO: 853707 - protein, 9 aa, Homo Sapiens
SYSGLKQIP

SEQ ID NO: 853708 - protein, 9 aa, Homo Sapiens
MRKLQESKL

SEQ ID NO: 853709 - protein, 9 aa, Homo Sapiens
VRPLSYPDL

SEQ ID NO: 853710 - protein, 9 aa, Homo Sapiens
EYVIRHGAD

SEQ ID NO: 853711 - protein, 9 aa, Homo Sapiens
SRGMLLFYS

SEQ ID NO: 853712 - protein, 9 aa, Homo Sapiens
KEINEDFIE

SEQ ID NO: 853713 - protein, 9 aa, Homo Sapiens
LPDPQNIYL

SEQ ID NO: 853714 - protein, 9 aa, Homo Sapiens
SPRQTAPRP

SEQ ID NO: 853715 - protein, 9 aa, Homo Sapiens
GLINKYEPS

SEQ ID NO: 853716 - protein, 9 aa, Homo Sapiens
SECMVQLFS

SEQ ID NO: 853717 - protein, 9 aa, Homo Sapiens
SDKSEEELE

SEQ ID NO: 853718 - protein, 9 aa, Homo Sapiens
GILKITYLG

SEQ ID NO: 853719 - protein, 9 aa, Homo Sapiens
RWNHPKMSL

SEQ ID NO: 853720 - protein, 9 aa, Homo Sapiens
RIDSTGVLD

SEQ ID NO: 853721 - protein, 9 aa, Homo Sapiens
KVQDEAQTL

SEQ ID NO: 853722 - protein, 9 aa, Homo Sapiens
KQHFAFMYI

SEQ ID NO: 853723 - protein, 9 aa, Homo Sapiens
LCSVPCTAF

SEQ ID NO: 853724 - protein, 9 aa, Homo Sapiens
LRQKALEEK

SEQ ID NO: 853725 - protein, 9 aa, Homo Sapiens
SSGMYKESA

SEQ ID NO: 853726 - protein, 9 aa, Homo Sapiens
FRDVAIELS

SEQ ID NO: 853727 - protein, 9 aa, Homo Sapiens
QLAATTLRK

SEQ ID NO: 853728 - protein, 9 aa, Homo Sapiens
IYYRHFVGE

SEQ ID NO: 853729 - protein, 9 aa, Homo Sapiens
DPPMPAYRG

SEQ ID NO: 853730 - protein, 9 aa, Homo Sapiens
ENIGNISYV

SEQ ID NO: 853731 - protein, 9 aa, Homo Sapiens
HTGDKLYPC

SEQ ID NO: 853732 - protein, 9 aa, Homo Sapiens
LVILGGNKE

SEQ ID NO: 853733 - protein, 9 aa, Homo Sapiens
SPEIDKVCF

SEQ ID NO: 853734 - protein, 9 aa, Homo Sapiens
LIFSYNRLR

SEQ ID NO: 853735 - protein, 9 aa, Homo Sapiens
AMPSPRILN

SEQ ID NO: 853736 - protein, 9 aa, Homo Sapiens
VFLSTGDQA

SEQ ID NO: 853737 - protein, 9 aa, Homo Sapiens
IKVLEFLAK

SEQ ID NO: 853738 - protein, 9 aa, Homo Sapiens
IVGPVEHGK

SEQ ID NO: 853739 - protein, 9 aa, Homo Sapiens
PPEVASHSP

SEQ ID NO: 853740 - protein, 9 aa, Homo Sapiens
ESHRLHQLF

SEQ ID NO: 853741 - protein, 9 aa, Homo Sapiens
QAKLEEIYE

SEQ ID NO: 853742 - protein, 9 aa, Homo Sapiens
GHYYLTYLY

SEQ ID NO: 853743 - protein, 9 aa, Homo Sapiens
NLLSDACSA

SEQ ID NO: 853744 - protein, 9 aa, Homo Sapiens
GNLKLHIRI

SEQ ID NO: 853745 - protein, 9 aa, Homo Sapiens
RWIRGFIVR

SEQ ID NO: 853746 - protein, 9 aa, Homo Sapiens
YRGLIALDC

SEQ ID NO: 853747 - protein, 9 aa, Homo Sapiens
GLLREKYFF

SEQ ID NO: 853748 - protein, 9 aa, Homo Sapiens
GALGGPPVS

SEQ ID NO: 853749 - protein, 9 aa, Homo Sapiens
VHLLLPGEL

SEQ ID NO: 853750 - protein, 9 aa, Homo Sapiens
LLKLSTDLD

SEQ ID NO: 853751 - protein, 9 aa, Homo Sapiens
EYNNLKFTI

SEQ ID NO: 853752 - protein, 9 aa, Homo Sapiens
KVVVDRKHV

SEQ ID NO: 853753 - protein, 9 aa, Homo Sapiens
SKLTFKPDT

SEQ ID NO: 853754 - protein, 9 aa, Homo Sapiens
ERSRRERQQ

SEQ ID NO: 853755 - protein, 9 aa, Homo Sapiens
KLGLRAEDN

SEQ ID NO: 853756 - protein, 9 aa, Homo Sapiens
NQDLLGLPT

SEQ ID NO: 853757 - protein, 9 aa, Homo Sapiens
GVLCTVEYV

SEQ ID NO: 853758 - protein, 9 aa, Homo Sapiens
HVKKDVTVG

SEQ ID NO: 853759 - protein, 9 aa, Homo Sapiens
LFLDLLKQC

SEQ ID NO: 853760 - protein, 9 aa, Homo Sapiens
CRERSTFRR

SEQ ID NO: 853761 - protein, 9 aa, Homo Sapiens
YEGSSRNVP

SEQ ID NO: 853762 - protein, 9 aa, Homo Sapiens
NNLKSGDAS

SEQ ID NO: 853763 - protein, 9 aa, Homo Sapiens
NAEEYEGRD

SEQ ID NO: 853764 - protein, 9 aa, Homo Sapiens
GIDKEKPIH

SEQ ID NO: 853765 - protein, 9 aa, Homo Sapiens
CVQHMDLSN

SEQ ID NO: 853766 - protein, 9 aa, Homo Sapiens
CIMMNEGKI

SEQ ID NO: 853767 - protein, 9 aa, Homo Sapiens
WVYGSNRLY

SEQ ID NO: 853768 - protein, 9 aa, Homo Sapiens
IAQLLDMDG

SEQ ID NO: 853769 - protein, 9 aa, Homo Sapiens
IQMKGSLPS

SEQ ID NO: 853770 - protein, 9 aa, Homo Sapiens
IQPEIMDGP

SEQ ID NO: 853771 - protein, 9 aa, Homo Sapiens
DLRGNTFEC

SEQ ID NO: 853772 - protein, 9 aa, Homo Sapiens
SMPSEYTYV

SEQ ID NO: 853773 - protein, 9 aa, Homo Sapiens
LKNEERKLQ

SEQ ID NO: 853774 - protein, 9 aa, Homo Sapiens
QHPSELRKH

SEQ ID NO: 853775 - protein, 9 aa, Homo Sapiens
GLWCSAIPE

SEQ ID NO: 853776 - protein, 9 aa, Homo Sapiens
VGREKTLGE

SEQ ID NO: 853777 - protein, 9 aa, Homo Sapiens
ALQDLVDLV

SEQ ID NO: 853778 - protein, 9 aa, Homo Sapiens
LLFRSCSRL

SEQ ID NO: 853779 - protein, 9 aa, Homo Sapiens
NYTLVVLDY

SEQ ID NO: 853780 - protein, 9 aa, Homo Sapiens
KHCGKPVIN

SEQ ID NO: 853781 - protein, 9 aa, Homo Sapiens
YFPQCGSLR

SEQ ID NO: 853782 - protein, 9 aa, Homo Sapiens
RQIVLAVHY

SEQ ID NO: 853783 - protein, 9 aa, Homo Sapiens
SDSQRMMYA

SEQ ID NO: 853784 - protein, 9 aa, Homo Sapiens
GNNKYGQLG

SEQ ID NO: 853785 - protein, 9 aa, Homo Sapiens
WDIKTGQQT

SEQ ID NO: 853786 - protein, 9 aa, Homo Sapiens
TENRREMGK

SEQ ID NO: 853787 - protein, 9 aa, Homo Sapiens
NLAEKTSYS

SEQ ID NO: 853788 - protein, 9 aa, Homo Sapiens
EILWGQHFV

SEQ ID NO: 853789 - protein, 9 aa, Homo Sapiens
TNSFLNLNN

SEQ ID NO: 853790 - protein, 9 aa, Homo Sapiens
FVLKISLTN

SEQ ID NO: 853791 - protein, 9 aa, Homo Sapiens
KVTEKLRRS

SEQ ID NO: 853792 - protein, 9 aa, Homo Sapiens
RQRLQESRE

SEQ ID NO: 853793 - protein, 9 aa, Homo Sapiens
SMRDRAAAA

SEQ ID NO: 853794 - protein, 9 aa, Homo Sapiens
EGIKGMVQV

SEQ ID NO: 853795 - protein, 9 aa, Homo Sapiens
DDESVCIEC

SEQ ID NO: 853796 - protein, 9 aa, Homo Sapiens
PGQCVLGLD

SEQ ID NO: 853797 - protein, 9 aa, Homo Sapiens
ILFSALHIV

SEQ ID NO: 853798 - protein, 9 aa, Homo Sapiens
PGVSCCIKY

SEQ ID NO: 853799 - protein, 9 aa, Homo Sapiens
ETFLPTNKL

SEQ ID NO: 853800 - protein, 9 aa, Homo Sapiens
QVTRLLDIL

SEQ ID NO: 853801 - protein, 9 aa, Homo Sapiens
VRKNVQKTW

SEQ ID NO: 853802 - protein, 9 aa, Homo Sapiens
QQKALYREG

SEQ ID NO: 853803 - protein, 9 aa, Homo Sapiens
DCQTRQHEL

SEQ ID NO: 853804 - protein, 9 aa, Homo Sapiens
SQSETSYWK

SEQ ID NO: 853805 - protein, 9 aa, Homo Sapiens
NISANQRAR

SEQ ID NO: 853806 - protein, 9 aa, Homo Sapiens
SCDQLSTTV

SEQ ID NO: 853807 - protein, 9 aa, Homo Sapiens
LMTIIGIIY

SEQ ID NO: 853808 - protein, 9 aa, Homo Sapiens
IKLLETSAK

SEQ ID NO: 853809 - protein, 9 aa, Homo Sapiens
RKATFWKEH

SEQ ID NO: 853810 - protein, 9 aa, Homo Sapiens
LIQLVGPSS

SEQ ID NO: 853811 - protein, 9 aa, Homo Sapiens
LLSQGILFP

SEQ ID NO: 853812 - protein, 9 aa, Homo Sapiens
GNGLWCSAI

SEQ ID NO: 853813 - protein, 9 aa, Homo Sapiens
YLSSRDRHI

SEQ ID NO: 853814 - protein, 9 aa, Homo Sapiens
QNGLYACSA

SEQ ID NO: 853815 - protein, 9 aa, Homo Sapiens
RQVVCDTKC

SEQ ID NO: 853816 - protein, 9 aa, Homo Sapiens
QHQEWDGKD

SEQ ID NO: 853817 - protein, 9 aa, Homo Sapiens
ASENSECSA

SEQ ID NO: 853818 - protein, 9 aa, Homo Sapiens
PQLSPAGKI

SEQ ID NO: 853819 - protein, 9 aa, Homo Sapiens
HSQVPSSLA

SEQ ID NO: 853820 - protein, 9 aa, Homo Sapiens
FIRYGNYSL

SEQ ID NO: 853821 - protein, 9 aa, Homo Sapiens
EELKATIHE

SEQ ID NO: 853822 - protein, 9 aa, Homo Sapiens
DYGKLLDPQ

SEQ ID NO: 853823 - protein, 9 aa, Homo Sapiens
WGSPKKCEA

SEQ ID NO: 853824 - protein, 9 aa, Homo Sapiens
KVIIKVLDV

SEQ ID NO: 853825 - protein, 9 aa, Homo Sapiens
GLAGDHLSD

SEQ ID NO: 853826 - protein, 9 aa, Homo Sapiens
GESGFRGPP

SEQ ID NO: 853827 - protein, 9 aa, Homo Sapiens
DFSEYVKRK

SEQ ID NO: 853828 - protein, 9 aa, Homo Sapiens
VVGAETALL

SEQ ID NO: 853829 - protein, 9 aa, Homo Sapiens
PFYGIPREQ

SEQ ID NO: 853830 - protein, 9 aa, Homo Sapiens
CVIYSSVVS

SEQ ID NO: 853831 - protein, 9 aa, Homo Sapiens
AISDLNNLF

SEQ ID NO: 853832 - protein, 9 aa, Homo Sapiens
DVGGQDKIQ

SEQ ID NO: 853833 - protein, 9 aa, Homo Sapiens
GLYTDQAFG

SEQ ID NO: 853834 - protein, 9 aa, Homo Sapiens
MAPFILRFH

SEQ ID NO: 853835 - protein, 9 aa, Homo Sapiens
NPWLQEAPA

SEQ ID NO: 853836 - protein, 9 aa, Homo Sapiens
IRKPEIHGA

SEQ ID NO: 853837 - protein, 9 aa, Homo Sapiens
ILMLNPLVY

SEQ ID NO: 853838 - protein, 9 aa, Homo Sapiens
NLVGKDSYV

SEQ ID NO: 853839 - protein, 9 aa, Homo Sapiens
LEDWARWAK

SEQ ID NO: 853840 - protein, 9 aa, Homo Sapiens
VNSYMPVID

SEQ ID NO: 853841 - protein, 9 aa, Homo Sapiens
GSHSQQKKT

SEQ ID NO: 853842 - protein, 9 aa, Homo Sapiens
SESSSETST

SEQ ID NO: 853843 - protein, 9 aa, Homo Sapiens
REENKSSTK

SEQ ID NO: 853844 - protein, 9 aa, Homo Sapiens
RVLAPKASE

SEQ ID NO: 853845 - protein, 9 aa, Homo Sapiens
GGTWDGFKC

SEQ ID NO: 853846 - protein, 9 aa, Homo Sapiens
VQWCDCCLW

SEQ ID NO: 853847 - protein, 9 aa, Homo Sapiens
QGPSRKRRQ

SEQ ID NO: 853848 - protein, 9 aa, Homo Sapiens
QSILTPLNL

SEQ ID NO: 853849 - protein, 9 aa, Homo Sapiens
DWLDRGDKS

SEQ ID NO: 853850 - protein, 9 aa, Homo Sapiens
LERQRVRGH

SEQ ID NO: 853851 - protein, 9 aa, Homo Sapiens
CIAATVAHQ

SEQ ID NO: 853852 - protein, 9 aa, Homo Sapiens
LSGVIKKSS

SEQ ID NO: 853853 - protein, 9 aa, Homo Sapiens
PSGYYLDAE

SEQ ID NO: 853854 - protein, 9 aa, Homo Sapiens
VDTDSKFLK

SEQ ID NO: 853855 - protein, 9 aa, Homo Sapiens
LVLQTDSKI

SEQ ID NO: 853856 - protein, 9 aa, Homo Sapiens
EFTKLSSLN

SEQ ID NO: 853857 - protein, 9 aa, Homo Sapiens
LPLFEGITL

SEQ ID NO: 853858 - protein, 9 aa, Homo Sapiens
ETVHQIHTQ

SEQ ID NO: 853859 - protein, 9 aa, Homo Sapiens
NTHADFANE

SEQ ID NO: 853860 - protein, 9 aa, Homo Sapiens
NHIAASKCR

SEQ ID NO: 853861 - protein, 9 aa, Homo Sapiens
IQSKGITFE

SEQ ID NO: 853862 - protein, 9 aa, Homo Sapiens
SIKRSRTII

SEQ ID NO: 853863 - protein, 9 aa, Homo Sapiens
EVLQAALGV

SEQ ID NO: 853864 - protein, 9 aa, Homo Sapiens
DHQAAINNL

SEQ ID NO: 853865 - protein, 9 aa, Homo Sapiens
EQSMEDYFQ

SEQ ID NO: 853866 - protein, 9 aa, Homo Sapiens
VAVNIVNSK

SEQ ID NO: 853867 - protein, 9 aa, Homo Sapiens
NIIQINTDS

SEQ ID NO: 853868 - protein, 9 aa, Homo Sapiens
AVKIIDKSR

SEQ ID NO: 853869 - protein, 9 aa, Homo Sapiens
PGSSTDNPK

SEQ ID NO: 853870 - protein, 9 aa, Homo Sapiens
VRLYEDAEA

SEQ ID NO: 853871 - protein, 9 aa, Homo Sapiens
SDQSDSAKE

SEQ ID NO: 853872 - protein, 9 aa, Homo Sapiens
NRVLKNLTA

SEQ ID NO: 853873 - protein, 9 aa, Homo Sapiens
NFPNGKVCW

SEQ ID NO: 853874 - protein, 9 aa, Homo Sapiens
ESMPDRNMK

SEQ ID NO: 853875 - protein, 9 aa, Homo Sapiens
REYGFIYQT

SEQ ID NO: 853876 - protein, 9 aa, Homo Sapiens
QIRYNKIGI

SEQ ID NO: 853877 - protein, 9 aa, Homo Sapiens
ASQGLNIIL

SEQ ID NO: 853878 - protein, 9 aa, Homo Sapiens
GGCGFPPLS

SEQ ID NO: 853879 - protein, 9 aa, Homo Sapiens
GVKDPEARK

SEQ ID NO: 853880 - protein, 9 aa, Homo Sapiens
RAIIKAGDT

SEQ ID NO: 853881 - protein, 9 aa, Homo Sapiens
LVSIILLTL

SEQ ID NO: 853882 - protein, 9 aa, Homo Sapiens
SPPEVASHS

SEQ ID NO: 853883 - protein, 9 aa, Homo Sapiens
VGSQSETSY

SEQ ID NO: 853884 - protein, 9 aa, Homo Sapiens
SYYRHNFAR

SEQ ID NO: 853885 - protein, 9 aa, Homo Sapiens
KRFPGKSGN

SEQ ID NO: 853886 - protein, 9 aa, Homo Sapiens
KAAASVCSV

SEQ ID NO: 853887 - protein, 9 aa, Homo Sapiens
DTVVGPSGS

SEQ ID NO: 853888 - protein, 9 aa, Homo Sapiens
IQRGQFVGD

SEQ ID NO: 853889 - protein, 9 aa, Homo Sapiens
SAAVSPYYC

SEQ ID NO: 853890 - protein, 9 aa, Homo Sapiens
DEFVKIIFS

SEQ ID NO: 853891 - protein, 9 aa, Homo Sapiens
AAKYLKEPQ

SEQ ID NO: 853892 - protein, 9 aa, Homo Sapiens
ITNTVQQAR

SEQ ID NO: 853893 - protein, 9 aa, Homo Sapiens
QSGRYSSSS

SEQ ID NO: 853894 - protein, 9 aa, Homo Sapiens
IMEGMHLSQ

SEQ ID NO: 853895 - protein, 9 aa, Homo Sapiens
TQPPNNIHS

SEQ ID NO: 853896 - protein, 9 aa, Homo Sapiens
YAASNKTIY

SEQ ID NO: 853897 - protein, 9 aa, Homo Sapiens
ALRTSGGDG

SEQ ID NO: 853898 - protein, 9 aa, Homo Sapiens
TVFWYNNRE

SEQ ID NO: 853899 - protein, 9 aa, Homo Sapiens
MATNRTGQW

SEQ ID NO: 853900 - protein, 9 aa, Homo Sapiens
DCFEMCASL

SEQ ID NO: 853901 - protein, 9 aa, Homo Sapiens
NGIPDSRPL

SEQ ID NO: 853902 - protein, 9 aa, Homo Sapiens
VEDNGNHIK

SEQ ID NO: 853903 - protein, 9 aa, Homo Sapiens
LQDLRLNGC

SEQ ID NO: 853904 - protein, 9 aa, Homo Sapiens
VPIYLSKKC

SEQ ID NO: 853905 - protein, 9 aa, Homo Sapiens
EAQKEVHNL

SEQ ID NO: 853906 - protein, 9 aa, Homo Sapiens
LIRKSGYFP

SEQ ID NO: 853907 - protein, 9 aa, Homo Sapiens
YHDQVPDLK

SEQ ID NO: 853908 - protein, 9 aa, Homo Sapiens
YPDEELSCS

SEQ ID NO: 853909 - protein, 9 aa, Homo Sapiens
PLQIILEKV

SEQ ID NO: 853910 - protein, 9 aa, Homo Sapiens
KSICYLGCD

SEQ ID NO: 853911 - protein, 9 aa, Homo Sapiens
SQQIQRAIT

SEQ ID NO: 853912 - protein, 9 aa, Homo Sapiens
KDLSEADLQ

SEQ ID NO: 853913 - protein, 9 aa, Homo Sapiens
HVIYKHRSR

SEQ ID NO: 853914 - protein, 9 aa, Homo Sapiens
NTSAGRYVC

SEQ ID NO: 853915 - protein, 9 aa, Homo Sapiens
NHKRYRPIY

SEQ ID NO: 853916 - protein, 9 aa, Homo Sapiens
KYFKKAVKA

SEQ ID NO: 853917 - protein, 9 aa, Homo Sapiens
IEKNIKLFF

SEQ ID NO: 853918 - protein, 9 aa, Homo Sapiens
LLGNEAVDQ

SEQ ID NO: 853919 - protein, 9 aa, Homo Sapiens
IAPKVLRGK

SEQ ID NO: 853920 - protein, 9 aa, Homo Sapiens
EELTLEQAK

SEQ ID NO: 853921 - protein, 9 aa, Homo Sapiens
SKTNIWKKQ

SEQ ID NO: 853922 - protein, 9 aa, Homo Sapiens
ANFKLKYGW

SEQ ID NO: 853923 - protein, 9 aa, Homo Sapiens
LYGGPELEH

SEQ ID NO: 853924 - protein, 9 aa, Homo Sapiens
AWKKLDRNY

SEQ ID NO: 853925 - protein, 9 aa, Homo Sapiens
LRNLILDSM

SEQ ID NO: 853926 - protein, 9 aa, Homo Sapiens
KFNTIAAEF

SEQ ID NO: 853927 - protein, 9 aa, Homo Sapiens
LQVEVQKVY

SEQ ID NO: 853928 - protein, 9 aa, Homo Sapiens
SSEKAKEPD

SEQ ID NO: 853929 - protein, 9 aa, Homo Sapiens
TPGNPPAEI

SEQ ID NO: 853930 - protein, 9 aa, Homo Sapiens
VSYSERHSS

SEQ ID NO: 853931 - protein, 9 aa, Homo Sapiens
WTSFVLQEL

SEQ ID NO: 853932 - protein, 9 aa, Homo Sapiens
TIIGRSFLF

SEQ ID NO: 853933 - protein, 9 aa, Homo Sapiens
KVYKDVLYK

SEQ ID NO: 853934 - protein, 9 aa, Homo Sapiens
YLNSALMGH

SEQ ID NO: 853935 - protein, 9 aa, Homo Sapiens
TWYHRHYRG

SEQ ID NO: 853936 - protein, 9 aa, Homo Sapiens
SAPMGIYHK

SEQ ID NO: 853937 - protein, 9 aa, Homo Sapiens
ISVQPDTKP

SEQ ID NO: 853938 - protein, 9 aa, Homo Sapiens
EVQRQKGLM

SEQ ID NO: 853939 - protein, 9 aa, Homo Sapiens
GDELINQSQ

SEQ ID NO: 853940 - protein, 9 aa, Homo Sapiens
CVYLTITNL

SEQ ID NO: 853941 - protein, 9 aa, Homo Sapiens
RRNVKITSP

SEQ ID NO: 853942 - protein, 9 aa, Homo Sapiens
VPVLNPFIY

SEQ ID NO: 853943 - protein, 9 aa, Homo Sapiens
RLKVESEEH

SEQ ID NO: 853944 - protein, 9 aa, Homo Sapiens
GVQHVRRMF

SEQ ID NO: 853945 - protein, 9 aa, Homo Sapiens
WIGGSIPAS

SEQ ID NO: 853946 - protein, 9 aa, Homo Sapiens
DNLDEIIPN

SEQ ID NO: 853947 - protein, 9 aa, Homo Sapiens
QEDKGNCKE

SEQ ID NO: 853948 - protein, 9 aa, Homo Sapiens
SLPCQPFYQ

SEQ ID NO: 853949 - protein, 9 aa, Homo Sapiens
WNHSDPENM

SEQ ID NO: 853950 - protein, 9 aa, Homo Sapiens
SFFPAGGDP

SEQ ID NO: 853951 - protein, 9 aa, Homo Sapiens
EIKDILPEM

SEQ ID NO: 853952 - protein, 9 aa, Homo Sapiens
VVTEPWLTQ

SEQ ID NO: 853953 - protein, 9 aa, Homo Sapiens
FVKKTEALW

SEQ ID NO: 853954 - protein, 9 aa, Homo Sapiens
YFVESNLRK

SEQ ID NO: 853955 - protein, 9 aa, Homo Sapiens
PCRHLLHKS

SEQ ID NO: 853956 - protein, 9 aa, Homo Sapiens
RRVRTLIAV

SEQ ID NO: 853957 - protein, 9 aa, Homo Sapiens
REQQLVDKS

SEQ ID NO: 853958 - protein, 9 aa, Homo Sapiens
VRRGQSLYV

SEQ ID NO: 853959 - protein, 9 aa, Homo Sapiens
CLANVLARL

SEQ ID NO: 853960 - protein, 9 aa, Homo Sapiens
GTTWSPDNW

SEQ ID NO: 853961 - protein, 9 aa, Homo Sapiens
NQTLSFNET

SEQ ID NO: 853962 - protein, 9 aa, Homo Sapiens
LSPYLTPYT

SEQ ID NO: 853963 - protein, 9 aa, Homo Sapiens
GKKPYTCQD

SEQ ID NO: 853964 - protein, 9 aa, Homo Sapiens
PFLYDYKRF

SEQ ID NO: 853965 - protein, 9 aa, Homo Sapiens
AKPLDNWLL

SEQ ID NO: 853966 - protein, 9 aa, Homo Sapiens
QVEEVTYNV

SEQ ID NO: 853967 - protein, 9 aa, Homo Sapiens
DCIKTTPGA

SEQ ID NO: 853968 - protein, 9 aa, Homo Sapiens
TLPHGRCHG

SEQ ID NO: 853969 - protein, 9 aa, Homo Sapiens
YVAKEKYIV

SEQ ID NO: 853970 - protein, 9 aa, Homo Sapiens
LSDSEEEEI

SEQ ID NO: 853971 - protein, 9 aa, Homo Sapiens
DGITPGLVG

SEQ ID NO: 853972 - protein, 9 aa, Homo Sapiens
ANGACNVLS

SEQ ID NO: 853973 - protein, 9 aa, Homo Sapiens
EIVSTGNKT

SEQ ID NO: 853974 - protein, 9 aa, Homo Sapiens
SSNLGQHQI

SEQ ID NO: 853975 - protein, 9 aa, Homo Sapiens
ADPAAMVSS

SEQ ID NO: 853976 - protein, 9 aa, Homo Sapiens
LYTLWNSRL

SEQ ID NO: 853977 - protein, 9 aa, Homo Sapiens
TAKGDQLEI

SEQ ID NO: 853978 - protein, 9 aa, Homo Sapiens
WLSLAKVRY

SEQ ID NO: 853979 - protein, 9 aa, Homo Sapiens
DKSTQLTNK

SEQ ID NO: 853980 - protein, 9 aa, Homo Sapiens
LEKLDILEQ

SEQ ID NO: 853981 - protein, 9 aa, Homo Sapiens
MFDNFAASP

SEQ ID NO: 853982 - protein, 9 aa, Homo Sapiens
LEIKNNEIE

SEQ ID NO: 853983 - protein, 9 aa, Homo Sapiens
EIPAEKVCL

SEQ ID NO: 853984 - protein, 9 aa, Homo Sapiens
VALILMTSS

SEQ ID NO: 853985 - protein, 9 aa, Homo Sapiens
KSLRLKPHG

SEQ ID NO: 853986 - protein, 9 aa, Homo Sapiens
RKNRQKNKC

SEQ ID NO: 853987 - protein, 9 aa, Homo Sapiens
PFGTKYLGN

SEQ ID NO: 853988 - protein, 9 aa, Homo Sapiens
PHGKVFKKL

SEQ ID NO: 853989 - protein, 9 aa, Homo Sapiens
TETPNSEFI

SEQ ID NO: 853990 - protein, 9 aa, Homo Sapiens
TLRSLSLRS

SEQ ID NO: 853991 - protein, 9 aa, Homo Sapiens
EFGFIKLES

SEQ ID NO: 853992 - protein, 9 aa, Homo Sapiens
EMVLANNRR

SEQ ID NO: 853993 - protein, 9 aa, Homo Sapiens
LDSCVISNH

SEQ ID NO: 853994 - protein, 9 aa, Homo Sapiens
SNKACGKIP

SEQ ID NO: 853995 - protein, 9 aa, Homo Sapiens
LARTKFKLP

SEQ ID NO: 853996 - protein, 9 aa, Homo Sapiens
KVVSVESLL

SEQ ID NO: 853997 - protein, 9 aa, Homo Sapiens
MAKLNSAFQ

SEQ ID NO: 853998 - protein, 9 aa, Homo Sapiens
LNNGVVLCK

SEQ ID NO: 853999 - protein, 9 aa, Homo Sapiens
DVFNDCKYR

SEQ ID NO: 854000 - protein, 9 aa, Homo Sapiens
NTNNNVVDC

SEQ ID NO: 854001 - protein, 9 aa, Homo Sapiens
DRNKQTFSY

SEQ ID NO: 854002 - protein, 9 aa, Homo Sapiens
DLVSAIRRS

SEQ ID NO: 854003 - protein, 9 aa, Homo Sapiens
LMPVSGAET

SEQ ID NO: 854004 - protein, 9 aa, Homo Sapiens
AMGRKPYVR

SEQ ID NO: 854005 - protein, 9 aa, Homo Sapiens
INLNKEERE

SEQ ID NO: 854006 - protein, 9 aa, Homo Sapiens
GTRPPLIQN

SEQ ID NO: 854007 - protein, 9 aa, Homo Sapiens
FSRLSDDPR

SEQ ID NO: 854008 - protein, 9 aa, Homo Sapiens
QQMFDANNM

SEQ ID NO: 854009 - protein, 9 aa, Homo Sapiens
TGKAESRNS

SEQ ID NO: 854010 - protein, 9 aa, Homo Sapiens
DHSDPEETT

SEQ ID NO: 854011 - protein, 9 aa, Homo Sapiens
NLKHNTPRK

SEQ ID NO: 854012 - protein, 9 aa, Homo Sapiens
ALVEIGPRC

SEQ ID NO: 854013 - protein, 9 aa, Homo Sapiens
DGQELMFWG

SEQ ID NO: 854014 - protein, 9 aa, Homo Sapiens
GISPEPPIV

SEQ ID NO: 854015 - protein, 9 aa, Homo Sapiens
EGKQFENTE

SEQ ID NO: 854016 - protein, 9 aa, Homo Sapiens
TENVEVKLV

SEQ ID NO: 854017 - protein, 9 aa, Homo Sapiens
YPAVMVILL

SEQ ID NO: 854018 - protein, 9 aa, Homo Sapiens
TIHKYAFMT

SEQ ID NO: 854019 - protein, 9 aa, Homo Sapiens
DDYLKTPPE

SEQ ID NO: 854020 - protein, 9 aa, Homo Sapiens
VIEHLYHWM

SEQ ID NO: 854021 - protein, 9 aa, Homo Sapiens
HFRSKDHNK

SEQ ID NO: 854022 - protein, 9 aa, Homo Sapiens
KQDKKQEQE

SEQ ID NO: 854023 - protein, 9 aa, Homo Sapiens
LSMQGQITD

SEQ ID NO: 854024 - protein, 9 aa, Homo Sapiens
KGLFNNNPR

SEQ ID NO: 854025 - protein, 9 aa, Homo Sapiens
MLLKRSGKL

SEQ ID NO: 854026 - protein, 9 aa, Homo Sapiens
KPQGLAEKS

SEQ ID NO: 854027 - protein, 9 aa, Homo Sapiens
DYMEKIWHH

SEQ ID NO: 854028 - protein, 9 aa, Homo Sapiens
SHSPACNNS

SEQ ID NO: 854029 - protein, 9 aa, Homo Sapiens
KKVHLGADL

SEQ ID NO: 854030 - protein, 9 aa, Homo Sapiens
TNMYDNAAE

SEQ ID NO: 854031 - protein, 9 aa, Homo Sapiens
PPICLRHRR

SEQ ID NO: 854032 - protein, 9 aa, Homo Sapiens
TPPPTYRTH

SEQ ID NO: 854033 - protein, 9 aa, Homo Sapiens
CIDIIQTLV

SEQ ID NO: 854034 - protein, 9 aa, Homo Sapiens
FKHLRRYTY

SEQ ID NO: 854035 - protein, 9 aa, Homo Sapiens
GQITHNTSL

SEQ ID NO: 854036 - protein, 9 aa, Homo Sapiens
SLRHGNWYI

SEQ ID NO: 854037 - protein, 9 aa, Homo Sapiens
LEGVLAGLR

SEQ ID NO: 854038 - protein, 9 aa, Homo Sapiens
FYTILTPMF

SEQ ID NO: 854039 - protein, 9 aa, Homo Sapiens
HYKGPGVSC

SEQ ID NO: 854040 - protein, 9 aa, Homo Sapiens
DSTITRKLK

SEQ ID NO: 854041 - protein, 9 aa, Homo Sapiens
WKWIAYYSE

SEQ ID NO: 854042 - protein, 9 aa, Homo Sapiens
ELHSFEVYD

SEQ ID NO: 854043 - protein, 9 aa, Homo Sapiens
QGPIACDNV

SEQ ID NO: 854044 - protein, 9 aa, Homo Sapiens
TPFDEHDEY

SEQ ID NO: 854045 - protein, 9 aa, Homo Sapiens
SMSQGAVVN

SEQ ID NO: 854046 - protein, 9 aa, Homo Sapiens
LPLEETEKQ

SEQ ID NO: 854047 - protein, 9 aa, Homo Sapiens
PRGSRGDLL

SEQ ID NO: 854048 - protein, 9 aa, Homo Sapiens
FFVPYIFLF

SEQ ID NO: 854049 - protein, 9 aa, Homo Sapiens
AFAESHNQI

SEQ ID NO: 854050 - protein, 9 aa, Homo Sapiens
AARPFSDPF

SEQ ID NO: 854051 - protein, 9 aa, Homo Sapiens
TVPSTIVIA

SEQ ID NO: 854052 - protein, 9 aa, Homo Sapiens
VLKEDAAYD

SEQ ID NO: 854053 - protein, 9 aa, Homo Sapiens
QLHFGHPAI

SEQ ID NO: 854054 - protein, 9 aa, Homo Sapiens
RNEELSLQK

SEQ ID NO: 854055 - protein, 9 aa, Homo Sapiens
GTFSKNCNL

SEQ ID NO: 854056 - protein, 9 aa, Homo Sapiens
FRSCSRLTH

SEQ ID NO: 854057 - protein, 9 aa, Homo Sapiens
GQIRYNKIG

SEQ ID NO: 854058 - protein, 9 aa, Homo Sapiens
CFLTDTSHL

SEQ ID NO: 854059 - protein, 9 aa, Homo Sapiens
LCPECGRWF

SEQ ID NO: 854060 - protein, 9 aa, Homo Sapiens
SILTPLNLQ

SEQ ID NO: 854061 - protein, 9 aa, Homo Sapiens
SVNKQKHYK

SEQ ID NO: 854062 - protein, 9 aa, Homo Sapiens
TAKFREQIL

SEQ ID NO: 854063 - protein, 9 aa, Homo Sapiens
LPPSWRELM

SEQ ID NO: 854064 - protein, 9 aa, Homo Sapiens
QPEINRQKS

SEQ ID NO: 854065 - protein, 9 aa, Homo Sapiens
RTIIFVITH

SEQ ID NO: 854066 - protein, 9 aa, Homo Sapiens
VRAMEGKLG

SEQ ID NO: 854067 - protein, 9 aa, Homo Sapiens
KGLILISPH

SEQ ID NO: 854068 - protein, 9 aa, Homo Sapiens
CRAVLNFLC

SEQ ID NO: 854069 - protein, 9 aa, Homo Sapiens
TTQCAYIHL

SEQ ID NO: 854070 - protein, 9 aa, Homo Sapiens
QDKETVIFI

SEQ ID NO: 854071 - protein, 9 aa, Homo Sapiens
ALGNGSYLS

SEQ ID NO: 854072 - protein, 9 aa, Homo Sapiens
LKTVIIEET

SEQ ID NO: 854073 - protein, 9 aa, Homo Sapiens
DEEEEEYNE

SEQ ID NO: 854074 - protein, 9 aa, Homo Sapiens
RLTQECGEY

SEQ ID NO: 854075 - protein, 9 aa, Homo Sapiens
AMLLGALAL

SEQ ID NO: 854076 - protein, 9 aa, Homo Sapiens
GFIKGQKLH

SEQ ID NO: 854077 - protein, 9 aa, Homo Sapiens
GRFMGHRRA

SEQ ID NO: 854078 - protein, 9 aa, Homo Sapiens
NSHANILYS

SEQ ID NO: 854079 - protein, 9 aa, Homo Sapiens
TFPHVSQMF

SEQ ID NO: 854080 - protein, 9 aa, Homo Sapiens
GVYQNGGYI

SEQ ID NO: 854081 - protein, 9 aa, Homo Sapiens
GSEDGLPKG

SEQ ID NO: 854082 - protein, 9 aa, Homo Sapiens
ILIKSELEA

SEQ ID NO: 854083 - protein, 9 aa, Homo Sapiens
PSDAESLES

SEQ ID NO: 854084 - protein, 9 aa, Homo Sapiens
LPPFSSLRE

SEQ ID NO: 854085 - protein, 9 aa, Homo Sapiens
KRNISVNDS

SEQ ID NO: 854086 - protein, 9 aa, Homo Sapiens
LFELAHYHA

SEQ ID NO: 854087 - protein, 9 aa, Homo Sapiens
WFSEYVYKV

SEQ ID NO: 854088 - protein, 9 aa, Homo Sapiens
LQQLPKYIL

SEQ ID NO: 854089 - protein, 9 aa, Homo Sapiens
QEENPGVFL

SEQ ID NO: 854090 - protein, 9 aa, Homo Sapiens
HPEYGDTAI

SEQ ID NO: 854091 - protein, 9 aa, Homo Sapiens
YTDPINGLS

SEQ ID NO: 854092 - protein, 9 aa, Homo Sapiens
EKETHRGLY

SEQ ID NO: 854093 - protein, 9 aa, Homo Sapiens
NHNSLDILK

SEQ ID NO: 854094 - protein, 9 aa, Homo Sapiens
ATIILRHLI

SEQ ID NO: 854095 - protein, 9 aa, Homo Sapiens
SEYPIFDKF

SEQ ID NO: 854096 - protein, 9 aa, Homo Sapiens
SVEAATNAS

SEQ ID NO: 854097 - protein, 9 aa, Homo Sapiens
CEERSSFEI

SEQ ID NO: 854098 - protein, 9 aa, Homo Sapiens
PAPIPLELF

SEQ ID NO: 854099 - protein, 9 aa, Homo Sapiens
FIGYKNFNN

SEQ ID NO: 854100 - protein, 9 aa, Homo Sapiens
NYCVRRRKW

SEQ ID NO: 854101 - protein, 9 aa, Homo Sapiens
LKQSLVAAV

SEQ ID NO: 854102 - protein, 9 aa, Homo Sapiens
KLFLGVAET

SEQ ID NO: 854103 - protein, 9 aa, Homo Sapiens
ESGYFVLTI

SEQ ID NO: 854104 - protein, 9 aa, Homo Sapiens
GNESYVRSQ

SEQ ID NO: 854105 - protein, 9 aa, Homo Sapiens
FPEHPKRWG

SEQ ID NO: 854106 - protein, 9 aa, Homo Sapiens
TTSVGLPHN

SEQ ID NO: 854107 - protein, 9 aa, Homo Sapiens
IRRTIGQTF

SEQ ID NO: 854108 - protein, 9 aa, Homo Sapiens
YLIDTVRSY

SEQ ID NO: 854109 - protein, 9 aa, Homo Sapiens
KLPEVLSME

SEQ ID NO: 854110 - protein, 9 aa, Homo Sapiens
SAKDDVEED

SEQ ID NO: 854111 - protein, 9 aa, Homo Sapiens
FTPRKGDKI

SEQ ID NO: 854112 - protein, 9 aa, Homo Sapiens
LNGGGVPAW

SEQ ID NO: 854113 - protein, 9 aa, Homo Sapiens
ILKIDSYYY

SEQ ID NO: 854114 - protein, 9 aa, Homo Sapiens
GFKPVQVQQ

SEQ ID NO: 854115 - protein, 9 aa, Homo Sapiens
ASCGLCGLT

SEQ ID NO: 854116 - protein, 9 aa, Homo Sapiens
RSNFEIHWK

SEQ ID NO: 854117 - protein, 9 aa, Homo Sapiens
SGLPVIPCP

SEQ ID NO: 854118 - protein, 9 aa, Homo Sapiens
DTKDDIGNL

SEQ ID NO: 854119 - protein, 9 aa, Homo Sapiens
NPKHSTRGI

SEQ ID NO: 854120 - protein, 9 aa, Homo Sapiens
ARFYYEQQL

SEQ ID NO: 854121 - protein, 9 aa, Homo Sapiens
LFMSFQSLF

SEQ ID NO: 854122 - protein, 9 aa, Homo Sapiens
SALKAIDSS

SEQ ID NO: 854123 - protein, 9 aa, Homo Sapiens
VVFLLLFAP

SEQ ID NO: 854124 - protein, 9 aa, Homo Sapiens
GLACDPALP

SEQ ID NO: 854125 - protein, 9 aa, Homo Sapiens
PPVKKKPTL

SEQ ID NO: 854126 - protein, 9 aa, Homo Sapiens
YPSRSPKTL

SEQ ID NO: 854127 - protein, 9 aa, Homo Sapiens
LTNVVMGHQ

SEQ ID NO: 854128 - protein, 9 aa, Homo Sapiens
LTEHKKIYT

SEQ ID NO: 854129 - protein, 9 aa, Homo Sapiens
INYRFMSSH

SEQ ID NO: 854130 - protein, 9 aa, Homo Sapiens
QPCILIIEQ

SEQ ID NO: 854131 - protein, 9 aa, Homo Sapiens
LVYAITAQS

SEQ ID NO: 854132 - protein, 9 aa, Homo Sapiens
YQITNDLAQ

SEQ ID NO: 854133 - protein, 9 aa, Homo Sapiens
LQSMIPCCL

SEQ ID NO: 854134 - protein, 9 aa, Homo Sapiens
LEERLKYYQ

SEQ ID NO: 854135 - protein, 9 aa, Homo Sapiens
EFQTAHLFL

SEQ ID NO: 854136 - protein, 9 aa, Homo Sapiens
IHSLSNVKL

SEQ ID NO: 854137 - protein, 9 aa, Homo Sapiens
HLVNLNGSK

SEQ ID NO: 854138 - protein, 9 aa, Homo Sapiens
VGCVSCFVG

SEQ ID NO: 854139 - protein, 9 aa, Homo Sapiens
FTEAGLNEL

SEQ ID NO: 854140 - protein, 9 aa, Homo Sapiens
KEEKLADQL

SEQ ID NO: 854141 - protein, 9 aa, Homo Sapiens
KKARQEIKN

SEQ ID NO: 854142 - protein, 9 aa, Homo Sapiens
CPPKTYKSK

SEQ ID NO: 854143 - protein, 9 aa, Homo Sapiens
EFKSAIRRT

SEQ ID NO: 854144 - protein, 9 aa, Homo Sapiens
EEIISPRQV

SEQ ID NO: 854145 - protein, 9 aa, Homo Sapiens
TIKEGSKPV

SEQ ID NO: 854146 - protein, 9 aa, Homo Sapiens
AHFHDFSVI

SEQ ID NO: 854147 - protein, 9 aa, Homo Sapiens
ASPHGSSET

SEQ ID NO: 854148 - protein, 9 aa, Homo Sapiens
RMHLVYADT

SEQ ID NO: 854149 - protein, 9 aa, Homo Sapiens
DPPHCGRCI

SEQ ID NO: 854150 - protein, 9 aa, Homo Sapiens
LQNIIRDQM

SEQ ID NO: 854151 - protein, 9 aa, Homo Sapiens
QRPDQTVTD

SEQ ID NO: 854152 - protein, 9 aa, Homo Sapiens
ELDNVTRLL

SEQ ID NO: 854153 - protein, 9 aa, Homo Sapiens
DAAKYLKEP

SEQ ID NO: 854154 - protein, 9 aa, Homo Sapiens
KVYLSSDTT

SEQ ID NO: 854155 - protein, 9 aa, Homo Sapiens
VKEAMARFH

SEQ ID NO: 854156 - protein, 9 aa, Homo Sapiens
ISMQLMFGD

SEQ ID NO: 854157 - protein, 9 aa, Homo Sapiens
QPVCSCVHG

SEQ ID NO: 854158 - protein, 9 aa, Homo Sapiens
LIMFQNLAH

SEQ ID NO: 854159 - protein, 9 aa, Homo Sapiens
ANLHGGYLV

SEQ ID NO: 854160 - protein, 9 aa, Homo Sapiens
AYMFLLVPP

SEQ ID NO: 854161 - protein, 9 aa, Homo Sapiens
YQAQETTII

SEQ ID NO: 854162 - protein, 9 aa, Homo Sapiens
RHMGTAVGR

SEQ ID NO: 854163 - protein, 9 aa, Homo Sapiens
KDVQKRRQV

SEQ ID NO: 854164 - protein, 9 aa, Homo Sapiens
QEVKILAHF

SEQ ID NO: 854165 - protein, 9 aa, Homo Sapiens
LNNIIKKII

SEQ ID NO: 854166 - protein, 9 aa, Homo Sapiens
HKGEIEDLA

SEQ ID NO: 854167 - protein, 9 aa, Homo Sapiens
TIQGTLSYP

SEQ ID NO: 854168 - protein, 9 aa, Homo Sapiens
HELRVKCSV

SEQ ID NO: 854169 - protein, 9 aa, Homo Sapiens
DSVLKMEEE

SEQ ID NO: 854170 - protein, 9 aa, Homo Sapiens
SENCLSAQG

SEQ ID NO: 854171 - protein, 9 aa, Homo Sapiens
ALVATLHHC

SEQ ID NO: 854172 - protein, 9 aa, Homo Sapiens
VLPLLLPLL

SEQ ID NO: 854173 - protein, 9 aa, Homo Sapiens
TYYYIQEGS

SEQ ID NO: 854174 - protein, 9 aa, Homo Sapiens
GFSSPRTRT

SEQ ID NO: 854175 - protein, 9 aa, Homo Sapiens
WDLTLFLPD

SEQ ID NO: 854176 - protein, 9 aa, Homo Sapiens
VDPIFYVSS

SEQ ID NO: 854177 - protein, 9 aa, Homo Sapiens
VSQVLLSIC

SEQ ID NO: 854178 - protein, 9 aa, Homo Sapiens
SLKHRVKNS

SEQ ID NO: 854179 - protein, 9 aa, Homo Sapiens
LNIKHKAKP

SEQ ID NO: 854180 - protein, 9 aa, Homo Sapiens
YKRNEELSL

SEQ ID NO: 854181 - protein, 9 aa, Homo Sapiens
LHPDTWLAS

SEQ ID NO: 854182 - protein, 9 aa, Homo Sapiens
PRGGFSFDN

SEQ ID NO: 854183 - protein, 9 aa, Homo Sapiens
ETLPDEMGD

SEQ ID NO: 854184 - protein, 9 aa, Homo Sapiens
LLKTMHRTQ

SEQ ID NO: 854185 - protein, 9 aa, Homo Sapiens
CFMDDVSLI

SEQ ID NO: 854186 - protein, 9 aa, Homo Sapiens
RDRHGHEYY

SEQ ID NO: 854187 - protein, 9 aa, Homo Sapiens
KELGSEEVW

SEQ ID NO: 854188 - protein, 9 aa, Homo Sapiens
ELRKTNYVD

SEQ ID NO: 854189 - protein, 9 aa, Homo Sapiens
TWAGFKYYN

SEQ ID NO: 854190 - protein, 9 aa, Homo Sapiens
RAGTGFSGD

SEQ ID NO: 854191 - protein, 9 aa, Homo Sapiens
KPLHTSIPQ

SEQ ID NO: 854192 - protein, 9 aa, Homo Sapiens
FSEPSNLPL

SEQ ID NO: 854193 - protein, 9 aa, Homo Sapiens
DKIQPLWRH

SEQ ID NO: 854194 - protein, 9 aa, Homo Sapiens
NNEAVMSTL

SEQ ID NO: 854195 - protein, 9 aa, Homo Sapiens
PRRVLNTVI

SEQ ID NO: 854196 - protein, 9 aa, Homo Sapiens
KNLCQDMRG

SEQ ID NO: 854197 - protein, 9 aa, Homo Sapiens
LFCFLTDTS

SEQ ID NO: 854198 - protein, 9 aa, Homo Sapiens
HSFLSADYN

SEQ ID NO: 854199 - protein, 9 aa, Homo Sapiens
DGPHNRYAL

SEQ ID NO: 854200 - protein, 9 aa, Homo Sapiens
IPIQKFICA

SEQ ID NO: 854201 - protein, 9 aa, Homo Sapiens
AIYHGIPTV

SEQ ID NO: 854202 - protein, 9 aa, Homo Sapiens
LYDNIEDMI

SEQ ID NO: 854203 - protein, 9 aa, Homo Sapiens
WIYTSENDL

SEQ ID NO: 854204 - protein, 9 aa, Homo Sapiens
EEFYEDHGD

SEQ ID NO: 854205 - protein, 9 aa, Homo Sapiens
EATTKLYQY

SEQ ID NO: 854206 - protein, 9 aa, Homo Sapiens
QNDQNSSGE

SEQ ID NO: 854207 - protein, 9 aa, Homo Sapiens
EKCQGSAQR

SEQ ID NO: 854208 - protein, 9 aa, Homo Sapiens
LPSVRPFKQ

SEQ ID NO: 854209 - protein, 9 aa, Homo Sapiens
SVASKGQEC

SEQ ID NO: 854210 - protein, 9 aa, Homo Sapiens
QLARRICGE

SEQ ID NO: 854211 - protein, 9 aa, Homo Sapiens
TGEKLFKCN

SEQ ID NO: 854212 - protein, 9 aa, Homo Sapiens
IYSIIVALM

SEQ ID NO: 854213 - protein, 9 aa, Homo Sapiens
GARAALSRI

SEQ ID NO: 854214 - protein, 9 aa, Homo Sapiens
GQAPPKPGH

SEQ ID NO: 854215 - protein, 9 aa, Homo Sapiens
LKYAPFYFP

SEQ ID NO: 854216 - protein, 9 aa, Homo Sapiens
LKLRDSNEG

SEQ ID NO: 854217 - protein, 9 aa, Homo Sapiens
DFLTEINYT

SEQ ID NO: 854218 - protein, 9 aa, Homo Sapiens
DAHECQRCN

SEQ ID NO: 854219 - protein, 9 aa, Homo Sapiens
AQETLAAAV

SEQ ID NO: 854220 - protein, 9 aa, Homo Sapiens
KDKAATPIK

SEQ ID NO: 854221 - protein, 9 aa, Homo Sapiens
GIIELLDSK

SEQ ID NO: 854222 - protein, 9 aa, Homo Sapiens
PGLAYAEIA

SEQ ID NO: 854223 - protein, 9 aa, Homo Sapiens
FSPASYSVS

SEQ ID NO: 854224 - protein, 9 aa, Homo Sapiens
PVVVHKHAL

SEQ ID NO: 854225 - protein, 9 aa, Homo Sapiens
ARVENIIWG

SEQ ID NO: 854226 - protein, 9 aa, Homo Sapiens
TQGYSFFHD

SEQ ID NO: 854227 - protein, 9 aa, Homo Sapiens
HEKEMFAQG

SEQ ID NO: 854228 - protein, 9 aa, Homo Sapiens
AFSCGSGLI

SEQ ID NO: 854229 - protein, 9 aa, Homo Sapiens
NIRQSSTQV

SEQ ID NO: 854230 - protein, 9 aa, Homo Sapiens
RLPEHEMNR

SEQ ID NO: 854231 - protein, 9 aa, Homo Sapiens
LHLVDQEER

SEQ ID NO: 854232 - protein, 9 aa, Homo Sapiens
SLTTILVQW

SEQ ID NO: 854233 - protein, 9 aa, Homo Sapiens
KGLHRQPGL

SEQ ID NO: 854234 - protein, 9 aa, Homo Sapiens
NWDYMEKIW

SEQ ID NO: 854235 - protein, 9 aa, Homo Sapiens
HAENAEEYE

SEQ ID NO: 854236 - protein, 9 aa, Homo Sapiens
KSSIIEAIK

SEQ ID NO: 854237 - protein, 9 aa, Homo Sapiens
YGNITECRN

SEQ ID NO: 854238 - protein, 9 aa, Homo Sapiens
STDFAYSST

SEQ ID NO: 854239 - protein, 9 aa, Homo Sapiens
AAVAQASLQ

SEQ ID NO: 854240 - protein, 9 aa, Homo Sapiens
GLTVASFSN

SEQ ID NO: 854241 - protein, 9 aa, Homo Sapiens
ALLKDLEEG

SEQ ID NO: 854242 - protein, 9 aa, Homo Sapiens
RYQMYQTQV

SEQ ID NO: 854243 - protein, 9 aa, Homo Sapiens
YGEVEKLKE

SEQ ID NO: 854244 - protein, 9 aa, Homo Sapiens
PELINFLIG

SEQ ID NO: 854245 - protein, 9 aa, Homo Sapiens
RIELPWGSL

SEQ ID NO: 854246 - protein, 9 aa, Homo Sapiens
EEIIKLENM

SEQ ID NO: 854247 - protein, 9 aa, Homo Sapiens
NSVIQALYF

SEQ ID NO: 854248 - protein, 9 aa, Homo Sapiens
SEFNQLRLQ

SEQ ID NO: 854249 - protein, 9 aa, Homo Sapiens
EPNTDQQLI

SEQ ID NO: 854250 - protein, 9 aa, Homo Sapiens
IVCDINKRL

SEQ ID NO: 854251 - protein, 9 aa, Homo Sapiens
PQHLLPVPP

SEQ ID NO: 854252 - protein, 9 aa, Homo Sapiens
DKLQCTQGK

SEQ ID NO: 854253 - protein, 9 aa, Homo Sapiens
SEVHGADNF

SEQ ID NO: 854254 - protein, 9 aa, Homo Sapiens
RPNVCLPAS

SEQ ID NO: 854255 - protein, 9 aa, Homo Sapiens
LARCVAQVG

SEQ ID NO: 854256 - protein, 9 aa, Homo Sapiens
DDSKKIARI

SEQ ID NO: 854257 - protein, 9 aa, Homo Sapiens
AENAEEYEG

SEQ ID NO: 854258 - protein, 9 aa, Homo Sapiens
ANVTAKFKE

SEQ ID NO: 854259 - protein, 9 aa, Homo Sapiens
IFILAAMGF

SEQ ID NO: 854260 - protein, 9 aa, Homo Sapiens
VIYPGVVEV

SEQ ID NO: 854261 - protein, 9 aa, Homo Sapiens
KDGTPFDEH

SEQ ID NO: 854262 - protein, 9 aa, Homo Sapiens
SILNVFCCP

SEQ ID NO: 854263 - protein, 9 aa, Homo Sapiens
FHYLKPDIT

SEQ ID NO: 854264 - protein, 9 aa, Homo Sapiens
IDNFRRNSD

SEQ ID NO: 854265 - protein, 9 aa, Homo Sapiens
ELIRQQREA

SEQ ID NO: 854266 - protein, 9 aa, Homo Sapiens
GEEEDKADE

SEQ ID NO: 854267 - protein, 9 aa, Homo Sapiens
RLGKTQKAM

SEQ ID NO: 854268 - protein, 9 aa, Homo Sapiens
LVSFFNDVD

SEQ ID NO: 854269 - protein, 9 aa, Homo Sapiens
TWWRGLRLQ

SEQ ID NO: 854270 - protein, 9 aa, Homo Sapiens
AQSSLNSSL

SEQ ID NO: 854271 - protein, 9 aa, Homo Sapiens
HPKFIQLYA

SEQ ID NO: 854272 - protein, 9 aa, Homo Sapiens
DFKGLINVT

SEQ ID NO: 854273 - protein, 9 aa, Homo Sapiens
QKKNVFMYG

SEQ ID NO: 854274 - protein, 9 aa, Homo Sapiens
ECMLTSVCC

SEQ ID NO: 854275 - protein, 9 aa, Homo Sapiens
SMPDKEPSV

SEQ ID NO: 854276 - protein, 9 aa, Homo Sapiens
PIKLSPTYP

SEQ ID NO: 854277 - protein, 9 aa, Homo Sapiens
FIPRRLIDR

SEQ ID NO: 854278 - protein, 9 aa, Homo Sapiens
LNDRSKDLE

SEQ ID NO: 854279 - protein, 9 aa, Homo Sapiens
TVPTYFSNL

SEQ ID NO: 854280 - protein, 9 aa, Homo Sapiens
ANNMMAACD

SEQ ID NO: 854281 - protein, 9 aa, Homo Sapiens
LTGLLTQHG

SEQ ID NO: 854282 - protein, 9 aa, Homo Sapiens
SQKYKEGTY

SEQ ID NO: 854283 - protein, 9 aa, Homo Sapiens
ADLILYALE

SEQ ID NO: 854284 - protein, 9 aa, Homo Sapiens
AKNNWQRIQ

SEQ ID NO: 854285 - protein, 9 aa, Homo Sapiens
LFNTAIEMN

SEQ ID NO: 854286 - protein, 9 aa, Homo Sapiens
KGELMENYQ

SEQ ID NO: 854287 - protein, 9 aa, Homo Sapiens
LLIDGFPRN

SEQ ID NO: 854288 - protein, 9 aa, Homo Sapiens
GPGDPASDA

SEQ ID NO: 854289 - protein, 9 aa, Homo Sapiens
ASCLLQNVS

SEQ ID NO: 854290 - protein, 9 aa, Homo Sapiens
VYVGMKTRS

SEQ ID NO: 854291 - protein, 9 aa, Homo Sapiens
AGQLQEPRL

SEQ ID NO: 854292 - protein, 9 aa, Homo Sapiens
LTQCYLETL

SEQ ID NO: 854293 - protein, 9 aa, Homo Sapiens
LNQTKLECE

SEQ ID NO: 854294 - protein, 9 aa, Homo Sapiens
TQCVWLDSD

SEQ ID NO: 854295 - protein, 9 aa, Homo Sapiens
RPVAVPHGK

SEQ ID NO: 854296 - protein, 9 aa, Homo Sapiens
GLGQSLAAG

SEQ ID NO: 854297 - protein, 9 aa, Homo Sapiens
TANKRKLED

SEQ ID NO: 854298 - protein, 9 aa, Homo Sapiens
QCTACKKFN

SEQ ID NO: 854299 - protein, 9 aa, Homo Sapiens
MSGMDKLQN

SEQ ID NO: 854300 - protein, 9 aa, Homo Sapiens
LLVHQRTHN

SEQ ID NO: 854301 - protein, 9 aa, Homo Sapiens
FSTWRIKKK

SEQ ID NO: 854302 - protein, 9 aa, Homo Sapiens
QLAINQNGE

SEQ ID NO: 854303 - protein, 9 aa, Homo Sapiens
TISMKVAYS

SEQ ID NO: 854304 - protein, 9 aa, Homo Sapiens
ECWDELQKV

SEQ ID NO: 854305 - protein, 9 aa, Homo Sapiens
LNYLIYTLR

SEQ ID NO: 854306 - protein, 9 aa, Homo Sapiens
PRAKHLESP

SEQ ID NO: 854307 - protein, 9 aa, Homo Sapiens
YFHCLHLFI

SEQ ID NO: 854308 - protein, 9 aa, Homo Sapiens
LVSFPEHPK

SEQ ID NO: 854309 - protein, 9 aa, Homo Sapiens
YQNCIAAEF

SEQ ID NO: 854310 - protein, 9 aa, Homo Sapiens
SDNAVLKSL

SEQ ID NO: 854311 - protein, 9 aa, Homo Sapiens
SCASKHAFA

SEQ ID NO: 854312 - protein, 9 aa, Homo Sapiens
RNIRAGYEV

SEQ ID NO: 854313 - protein, 9 aa, Homo Sapiens
ETDHDQEVI

SEQ ID NO: 854314 - protein, 9 aa, Homo Sapiens
QLPIYSEND

SEQ ID NO: 854315 - protein, 9 aa, Homo Sapiens
LMHSLEGFL

SEQ ID NO: 854316 - protein, 9 aa, Homo Sapiens
VPPLALAPL

SEQ ID NO: 854317 - protein, 9 aa, Homo Sapiens
AGEEATSSH

SEQ ID NO: 854318 - protein, 9 aa, Homo Sapiens
TAEKLARCV

SEQ ID NO: 854319 - protein, 9 aa, Homo Sapiens
ELPERQPCF

SEQ ID NO: 854320 - protein, 9 aa, Homo Sapiens
HIVIDKAQN

SEQ ID NO: 854321 - protein, 9 aa, Homo Sapiens
WGKIRITQS

SEQ ID NO: 854322 - protein, 9 aa, Homo Sapiens
LPTMSPTLS

SEQ ID NO: 854323 - protein, 9 aa, Homo Sapiens
GAPLISAKP

SEQ ID NO: 854324 - protein, 9 aa, Homo Sapiens
AHTNLTLLQ

SEQ ID NO: 854325 - protein, 9 aa, Homo Sapiens
SASQGAKPS

SEQ ID NO: 854326 - protein, 9 aa, Homo Sapiens
SFCWSTSLI

SEQ ID NO: 854327 - protein, 9 aa, Homo Sapiens
ADDPESTKI

SEQ ID NO: 854328 - protein, 9 aa, Homo Sapiens
LVKHMKYIH

SEQ ID NO: 854329 - protein, 9 aa, Homo Sapiens
LNPLVILGG

SEQ ID NO: 854330 - protein, 9 aa, Homo Sapiens
AQVPGMQDI

SEQ ID NO: 854331 - protein, 9 aa, Homo Sapiens
IIYILFAPL

SEQ ID NO: 854332 - protein, 9 aa, Homo Sapiens
YGHKYYFTS

SEQ ID NO: 854333 - protein, 9 aa, Homo Sapiens
VILLFVPCI

SEQ ID NO: 854334 - protein, 9 aa, Homo Sapiens
GSQKSDKLP

SEQ ID NO: 854335 - protein, 9 aa, Homo Sapiens
QKYSDEDNL

SEQ ID NO: 854336 - protein, 9 aa, Homo Sapiens
PLISQACKL

SEQ ID NO: 854337 - protein, 9 aa, Homo Sapiens
DILLIGFYQ

SEQ ID NO: 854338 - protein, 9 aa, Homo Sapiens
KKHRDRTAK

SEQ ID NO: 854339 - protein, 9 aa, Homo Sapiens
TETSKIKRL

SEQ ID NO: 854340 - protein, 9 aa, Homo Sapiens
DEEEDDVKL

SEQ ID NO: 854341 - protein, 9 aa, Homo Sapiens
PLTVLTFTL

SEQ ID NO: 854342 - protein, 9 aa, Homo Sapiens
VVFGGFSLF

SEQ ID NO: 854343 - protein, 9 aa, Homo Sapiens
RKVMQIQAV

SEQ ID NO: 854344 - protein, 9 aa, Homo Sapiens
AQGYAWIFI

SEQ ID NO: 854345 - protein, 9 aa, Homo Sapiens
DRTETYVRT

SEQ ID NO: 854346 - protein, 9 aa, Homo Sapiens
FLLTAKLFL

SEQ ID NO: 854347 - protein, 9 aa, Homo Sapiens
NANVTVLDT

SEQ ID NO: 854348 - protein, 9 aa, Homo Sapiens
MPAWQKLSD

SEQ ID NO: 854349 - protein, 9 aa, Homo Sapiens
DHPHMKIFL

SEQ ID NO: 854350 - protein, 9 aa, Homo Sapiens
EPSSSNAAV

SEQ ID NO: 854351 - protein, 9 aa, Homo Sapiens
KMCNYNKIL

SEQ ID NO: 854352 - protein, 9 aa, Homo Sapiens
TTDKGQQLH

SEQ ID NO: 854353 - protein, 9 aa, Homo Sapiens
SKDLETIVN

SEQ ID NO: 854354 - protein, 9 aa, Homo Sapiens
RELMSDPDS

SEQ ID NO: 854355 - protein, 9 aa, Homo Sapiens
KERIALSRE

SEQ ID NO: 854356 - protein, 9 aa, Homo Sapiens
NAISSLPLP

SEQ ID NO: 854357 - protein, 9 aa, Homo Sapiens
FMVEMEKKL

SEQ ID NO: 854358 - protein, 9 aa, Homo Sapiens
LYFDQKYLF

SEQ ID NO: 854359 - protein, 9 aa, Homo Sapiens
ALFNESSAD

SEQ ID NO: 854360 - protein, 9 aa, Homo Sapiens
VGTYNNFFY

SEQ ID NO: 854361 - protein, 9 aa, Homo Sapiens
GPRNLEHKR

SEQ ID NO: 854362 - protein, 9 aa, Homo Sapiens
KEENNLVTE

SEQ ID NO: 854363 - protein, 9 aa, Homo Sapiens
TGIYPIDVM

SEQ ID NO: 854364 - protein, 9 aa, Homo Sapiens
KQTFSYYAD

SEQ ID NO: 854365 - protein, 9 aa, Homo Sapiens
SLPCHRILH

SEQ ID NO: 854366 - protein, 9 aa, Homo Sapiens
QERERRWRH

SEQ ID NO: 854367 - protein, 9 aa, Homo Sapiens
SMESLPTVH

SEQ ID NO: 854368 - protein, 9 aa, Homo Sapiens
KCAEYNSDL

SEQ ID NO: 854369 - protein, 9 aa, Homo Sapiens
TGSGLAGDH

SEQ ID NO: 854370 - protein, 9 aa, Homo Sapiens
PPTEYFLPL

SEQ ID NO: 854371 - protein, 9 aa, Homo Sapiens
MTGLFNPQG

SEQ ID NO: 854372 - protein, 9 aa, Homo Sapiens
YLLACEFLL

SEQ ID NO: 854373 - protein, 9 aa, Homo Sapiens
EVITENLEA

SEQ ID NO: 854374 - protein, 9 aa, Homo Sapiens
GRGLPQDIH

SEQ ID NO: 854375 - protein, 9 aa, Homo Sapiens
ALVNRWLNE

SEQ ID NO: 854376 - protein, 9 aa, Homo Sapiens
RIKSLSDQV

SEQ ID NO: 854377 - protein, 9 aa, Homo Sapiens
YAFLDENLK

SEQ ID NO: 854378 - protein, 9 aa, Homo Sapiens
ERTRTGDKL

SEQ ID NO: 854379 - protein, 9 aa, Homo Sapiens
AYTSAGTGP

SEQ ID NO: 854380 - protein, 9 aa, Homo Sapiens
VVYFDNTQK

SEQ ID NO: 854381 - protein, 9 aa, Homo Sapiens
IIRNFCKYV

SEQ ID NO: 854382 - protein, 9 aa, Homo Sapiens
NVDSNSAYR

SEQ ID NO: 854383 - protein, 9 aa, Homo Sapiens
EITPPTNFK

SEQ ID NO: 854384 - protein, 9 aa, Homo Sapiens
AEKLAILSQ

SEQ ID NO: 854385 - protein, 9 aa, Homo Sapiens
STVMHNYQI

SEQ ID NO: 854386 - protein, 9 aa, Homo Sapiens
HVEQLRVEE

SEQ ID NO: 854387 - protein, 9 aa, Homo Sapiens
LRDDGCNSG

SEQ ID NO: 854388 - protein, 9 aa, Homo Sapiens
GLPREYAFH

SEQ ID NO: 854389 - protein, 9 aa, Homo Sapiens
KSFSSHYTF

SEQ ID NO: 854390 - protein, 9 aa, Homo Sapiens
TAGISSSLD

SEQ ID NO: 854391 - protein, 9 aa, Homo Sapiens
AENHFSMAI

SEQ ID NO: 854392 - protein, 9 aa, Homo Sapiens
MSISREDNI

SEQ ID NO: 854393 - protein, 9 aa, Homo Sapiens
QQYSSCLTI

SEQ ID NO: 854394 - protein, 9 aa, Homo Sapiens
QNIEYEELP

SEQ ID NO: 854395 - protein, 9 aa, Homo Sapiens
TENMYLTDA

SEQ ID NO: 854396 - protein, 9 aa, Homo Sapiens
ACIVRDSRH

SEQ ID NO: 854397 - protein, 9 aa, Homo Sapiens
KFKETRRRL

SEQ ID NO: 854398 - protein, 9 aa, Homo Sapiens
VVVWKKSCG

SEQ ID NO: 854399 - protein, 9 aa, Homo Sapiens
LAKTGCVYL

SEQ ID NO: 854400 - protein, 9 aa, Homo Sapiens
VIKDTKEKR

SEQ ID NO: 854401 - protein, 9 aa, Homo Sapiens
CCYLYACGS

SEQ ID NO: 854402 - protein, 9 aa, Homo Sapiens
PRRTPPARD

SEQ ID NO: 854403 - protein, 9 aa, Homo Sapiens
GYAWIFIAW

SEQ ID NO: 854404 - protein, 9 aa, Homo Sapiens
LVYKDILAW

SEQ ID NO: 854405 - protein, 9 aa, Homo Sapiens
NDFIYHDQV

SEQ ID NO: 854406 - protein, 9 aa, Homo Sapiens
VNVSSRMDN

SEQ ID NO: 854407 - protein, 9 aa, Homo Sapiens
DNRKVQEPQ

SEQ ID NO: 854408 - protein, 9 aa, Homo Sapiens
FSVQQHKGS

SEQ ID NO: 854409 - protein, 9 aa, Homo Sapiens
AVGMLYGST

SEQ ID NO: 854410 - protein, 9 aa, Homo Sapiens
LWSSVAAPE

SEQ ID NO: 854411 - protein, 9 aa, Homo Sapiens
QPPMDSAGA

SEQ ID NO: 854412 - protein, 9 aa, Homo Sapiens
ESHGLCSSG

SEQ ID NO: 854413 - protein, 9 aa, Homo Sapiens
CNMPLTHFF

SEQ ID NO: 854414 - protein, 9 aa, Homo Sapiens
MQSLRPDQT

SEQ ID NO: 854415 - protein, 9 aa, Homo Sapiens
PPNSPLVPQ

SEQ ID NO: 854416 - protein, 9 aa, Homo Sapiens
DSEDSELES

SEQ ID NO: 854417 - protein, 9 aa, Homo Sapiens
FYSPISIAS

SEQ ID NO: 854418 - protein, 9 aa, Homo Sapiens
EEKSKECVQ

SEQ ID NO: 854419 - protein, 9 aa, Homo Sapiens
HCFSEEQGT

SEQ ID NO: 854420 - protein, 9 aa, Homo Sapiens
MQYFPAEIF

SEQ ID NO: 854421 - protein, 9 aa, Homo Sapiens
VKLAQCQSC

SEQ ID NO: 854422 - protein, 9 aa, Homo Sapiens
KYKRWLDSE

SEQ ID NO: 854423 - protein, 9 aa, Homo Sapiens
FLLDAVRNI

SEQ ID NO: 854424 - protein, 9 aa, Homo Sapiens
EKIEDSKEA

SEQ ID NO: 854425 - protein, 9 aa, Homo Sapiens
AHSSKEQHA

SEQ ID NO: 854426 - protein, 9 aa, Homo Sapiens
GKVLDCDII

SEQ ID NO: 854427 - protein, 9 aa, Homo Sapiens
PAPAAEPSA

SEQ ID NO: 854428 - protein, 9 aa, Homo Sapiens
AKIASSLPA

SEQ ID NO: 854429 - protein, 9 aa, Homo Sapiens
SNVLTFYRK

SEQ ID NO: 854430 - protein, 9 aa, Homo Sapiens
MTVTVHMPK

SEQ ID NO: 854431 - protein, 9 aa, Homo Sapiens
KSPDVSKHD

SEQ ID NO: 854432 - protein, 9 aa, Homo Sapiens
QQLRKDKMY

SEQ ID NO: 854433 - protein, 9 aa, Homo Sapiens
IVQNFQSGI

SEQ ID NO: 854434 - protein, 9 aa, Homo Sapiens
LSQVDKLVE

SEQ ID NO: 854435 - protein, 9 aa, Homo Sapiens
TTIAEAEEL

SEQ ID NO: 854436 - protein, 9 aa, Homo Sapiens
GQSLYVQID

SEQ ID NO: 854437 - protein, 9 aa, Homo Sapiens
DLQFASSPL

SEQ ID NO: 854438 - protein, 9 aa, Homo Sapiens
LDTFICHTI

SEQ ID NO: 854439 - protein, 9 aa, Homo Sapiens
AVKAYTSAG

SEQ ID NO: 854440 - protein, 9 aa, Homo Sapiens
LKEAMLQAH

SEQ ID NO: 854441 - protein, 9 aa, Homo Sapiens
KYKNRTNCD

SEQ ID NO: 854442 - protein, 9 aa, Homo Sapiens
RIGKYFILF

SEQ ID NO: 854443 - protein, 9 aa, Homo Sapiens
RGTWECSQR

SEQ ID NO: 854444 - protein, 9 aa, Homo Sapiens
AGAPNSRPA

SEQ ID NO: 854445 - protein, 9 aa, Homo Sapiens
KARAEARTR

SEQ ID NO: 854446 - protein, 9 aa, Homo Sapiens
LGGDKLANG

SEQ ID NO: 854447 - protein, 9 aa, Homo Sapiens
RFLEQQNTV

SEQ ID NO: 854448 - protein, 9 aa, Homo Sapiens
VLEFKAHKG

SEQ ID NO: 854449 - protein, 9 aa, Homo Sapiens
LFRIVAIVS

SEQ ID NO: 854450 - protein, 9 aa, Homo Sapiens
KRIHIRENY

SEQ ID NO: 854451 - protein, 9 aa, Homo Sapiens
AFKVQQARK

SEQ ID NO: 854452 - protein, 9 aa, Homo Sapiens
FFQNQLLRG

SEQ ID NO: 854453 - protein, 9 aa, Homo Sapiens
VSPFSKMPL

SEQ ID NO: 854454 - protein, 9 aa, Homo Sapiens
KCLTKCADD

SEQ ID NO: 854455 - protein, 9 aa, Homo Sapiens
VRSHSWKIN

SEQ ID NO: 854456 - protein, 9 aa, Homo Sapiens
AQQNNFSYK

SEQ ID NO: 854457 - protein, 9 aa, Homo Sapiens
KAKYLTDPS

SEQ ID NO: 854458 - protein, 9 aa, Homo Sapiens
EKELKTTRF

SEQ ID NO: 854459 - protein, 9 aa, Homo Sapiens
LNCLTCMMC

SEQ ID NO: 854460 - protein, 9 aa, Homo Sapiens
HTWLSFYEK

SEQ ID NO: 854461 - protein, 9 aa, Homo Sapiens
DYQSLSWIW

SEQ ID NO: 854462 - protein, 9 aa, Homo Sapiens
SLKEEDNGG

SEQ ID NO: 854463 - protein, 9 aa, Homo Sapiens
ETEETTTQN

SEQ ID NO: 854464 - protein, 9 aa, Homo Sapiens
AILQAWTDN

SEQ ID NO: 854465 - protein, 9 aa, Homo Sapiens
CEMCNFSAT

SEQ ID NO: 854466 - protein, 9 aa, Homo Sapiens
MDSGLPVIP

SEQ ID NO: 854467 - protein, 9 aa, Homo Sapiens
RGKFKQFCL

SEQ ID NO: 854468 - protein, 9 aa, Homo Sapiens
MWPNITPVP

SEQ ID NO: 854469 - protein, 9 aa, Homo Sapiens
DVGGQISER

SEQ ID NO: 854470 - protein, 9 aa, Homo Sapiens
IQFYMKLLY

SEQ ID NO: 854471 - protein, 9 aa, Homo Sapiens
DDSSAAWEQ

SEQ ID NO: 854472 - protein, 9 aa, Homo Sapiens
NVLTFYRKE

SEQ ID NO: 854473 - protein, 9 aa, Homo Sapiens
YMWLQSRDI

SEQ ID NO: 854474 - protein, 9 aa, Homo Sapiens
DKLADELHM

SEQ ID NO: 854475 - protein, 9 aa, Homo Sapiens
PGKIITISF

SEQ ID NO: 854476 - protein, 9 aa, Homo Sapiens
LMSEKLPQL

SEQ ID NO: 854477 - protein, 9 aa, Homo Sapiens
ELVCLTRHI

SEQ ID NO: 854478 - protein, 9 aa, Homo Sapiens
NTLALFDNR

SEQ ID NO: 854479 - protein, 9 aa, Homo Sapiens
TDKSYDDPT

SEQ ID NO: 854480 - protein, 9 aa, Homo Sapiens
CSINGQWDV

SEQ ID NO: 854481 - protein, 9 aa, Homo Sapiens
HSAIKIVDF

SEQ ID NO: 854482 - protein, 9 aa, Homo Sapiens
ILKITYLGN

SEQ ID NO: 854483 - protein, 9 aa, Homo Sapiens
EILGKSVFP

SEQ ID NO: 854484 - protein, 9 aa, Homo Sapiens
LGLDPNLLD

SEQ ID NO: 854485 - protein, 9 aa, Homo Sapiens
FTIDLRQDH

SEQ ID NO: 854486 - protein, 9 aa, Homo Sapiens
VASVPPDFQ

SEQ ID NO: 854487 - protein, 9 aa, Homo Sapiens
ITDKAPEEK

SEQ ID NO: 854488 - protein, 9 aa, Homo Sapiens
CGHDNLQLK

SEQ ID NO: 854489 - protein, 9 aa, Homo Sapiens
MDEFILKKV

SEQ ID NO: 854490 - protein, 9 aa, Homo Sapiens
TSSVTVGTA

SEQ ID NO: 854491 - protein, 9 aa, Homo Sapiens
LRTEYSEDN

SEQ ID NO: 854492 - protein, 9 aa, Homo Sapiens
ESMDNFILF

SEQ ID NO: 854493 - protein, 9 aa, Homo Sapiens
MGHQQSFGT

SEQ ID NO: 854494 - protein, 9 aa, Homo Sapiens
ILDRYYTAL

SEQ ID NO: 854495 - protein, 9 aa, Homo Sapiens
LIKKLCRGN

SEQ ID NO: 854496 - protein, 9 aa, Homo Sapiens
QVNISVLLM

SEQ ID NO: 854497 - protein, 9 aa, Homo Sapiens
TPEPIPLTE

SEQ ID NO: 854498 - protein, 9 aa, Homo Sapiens
EVQFSDRII

SEQ ID NO: 854499 - protein, 9 aa, Homo Sapiens
SQRVKSVLP

SEQ ID NO: 854500 - protein, 9 aa, Homo Sapiens
PLQQVLSVM

SEQ ID NO: 854501 - protein, 9 aa, Homo Sapiens
KIINYIIVI

SEQ ID NO: 854502 - protein, 9 aa, Homo Sapiens
DEDIVTILQ

SEQ ID NO: 854503 - protein, 9 aa, Homo Sapiens
KNSPPEESN

SEQ ID NO: 854504 - protein, 9 aa, Homo Sapiens
SPALTVSQV

SEQ ID NO: 854505 - protein, 9 aa, Homo Sapiens
HNKHVFKDN

SEQ ID NO: 854506 - protein, 9 aa, Homo Sapiens
LYTVPSTIV

SEQ ID NO: 854507 - protein, 9 aa, Homo Sapiens
LSLLNIWDY

SEQ ID NO: 854508 - protein, 9 aa, Homo Sapiens
LSKPYVYIC

SEQ ID NO: 854509 - protein, 9 aa, Homo Sapiens
RFSVTWGLT

SEQ ID NO: 854510 - protein, 9 aa, Homo Sapiens
EKARKIFRF

SEQ ID NO: 854511 - protein, 9 aa, Homo Sapiens
VNLNTGMQT

SEQ ID NO: 854512 - protein, 9 aa, Homo Sapiens
PYKYTCEGM

SEQ ID NO: 854513 - protein, 9 aa, Homo Sapiens
GFIGSIGPP

SEQ ID NO: 854514 - protein, 9 aa, Homo Sapiens
IRSAYFEFV

SEQ ID NO: 854515 - protein, 9 aa, Homo Sapiens
WKGSCPLTP

SEQ ID NO: 854516 - protein, 9 aa, Homo Sapiens
TKTMYAMKY

SEQ ID NO: 854517 - protein, 9 aa, Homo Sapiens
RPHPKPETT

SEQ ID NO: 854518 - protein, 9 aa, Homo Sapiens
CILDPRGIY

SEQ ID NO: 854519 - protein, 9 aa, Homo Sapiens
VNETPVVGL

SEQ ID NO: 854520 - protein, 9 aa, Homo Sapiens
CTYLYLLFD

SEQ ID NO: 854521 - protein, 9 aa, Homo Sapiens
NLFEPLAEH

SEQ ID NO: 854522 - protein, 9 aa, Homo Sapiens
VINAGKADL

SEQ ID NO: 854523 - protein, 9 aa, Homo Sapiens
FLPLPAPAP

SEQ ID NO: 854524 - protein, 9 aa, Homo Sapiens
RDPLDWSKT

SEQ ID NO: 854525 - protein, 9 aa, Homo Sapiens
KTKSGRINV

SEQ ID NO: 854526 - protein, 9 aa, Homo Sapiens
RKEQEHIHR

SEQ ID NO: 854527 - protein, 9 aa, Homo Sapiens
FEIHFSQWE

SEQ ID NO: 854528 - protein, 9 aa, Homo Sapiens
ISSISICTG

SEQ ID NO: 854529 - protein, 9 aa, Homo Sapiens
NINMLSEEK

SEQ ID NO: 854530 - protein, 9 aa, Homo Sapiens
PPSTTKPLR

SEQ ID NO: 854531 - protein, 9 aa, Homo Sapiens
FLQNNSSKF

SEQ ID NO: 854532 - protein, 9 aa, Homo Sapiens
VNALKIELQ

SEQ ID NO: 854533 - protein, 9 aa, Homo Sapiens
WASTQKKIS

SEQ ID NO: 854534 - protein, 9 aa, Homo Sapiens
KRKLQGRLG

SEQ ID NO: 854535 - protein, 9 aa, Homo Sapiens
EAANDIESP

SEQ ID NO: 854536 - protein, 9 aa, Homo Sapiens
AYEMVKYGF

SEQ ID NO: 854537 - protein, 9 aa, Homo Sapiens
CIQHEPLAK

SEQ ID NO: 854538 - protein, 9 aa, Homo Sapiens
GSPLELYKD

SEQ ID NO: 854539 - protein, 9 aa, Homo Sapiens
EAPSPPPLG

SEQ ID NO: 854540 - protein, 9 aa, Homo Sapiens
ELEQLATKD

SEQ ID NO: 854541 - protein, 9 aa, Homo Sapiens
SPGLSHLPT

SEQ ID NO: 854542 - protein, 9 aa, Homo Sapiens
LLQYHKHHD

SEQ ID NO: 854543 - protein, 9 aa, Homo Sapiens
DDEGMPGSH

SEQ ID NO: 854544 - protein, 9 aa, Homo Sapiens
LDNNQIRKI

SEQ ID NO: 854545 - protein, 9 aa, Homo Sapiens
IIDQLFAVG

SEQ ID NO: 854546 - protein, 9 aa, Homo Sapiens
CYQNKYTHF

SEQ ID NO: 854547 - protein, 9 aa, Homo Sapiens
TSWKELSNV

SEQ ID NO: 854548 - protein, 9 aa, Homo Sapiens
EMTSQLEKM

SEQ ID NO: 854549 - protein, 9 aa, Homo Sapiens
SDGVQNLFQ

SEQ ID NO: 854550 - protein, 9 aa, Homo Sapiens
FYFPQCGSL

SEQ ID NO: 854551 - protein, 9 aa, Homo Sapiens
FVGEIFEDS

SEQ ID NO: 854552 - protein, 9 aa, Homo Sapiens
GKQSRTSKL

SEQ ID NO: 854553 - protein, 9 aa, Homo Sapiens
NDLFSTNPP

SEQ ID NO: 854554 - protein, 9 aa, Homo Sapiens
MMTRGHLAK

SEQ ID NO: 854555 - protein, 9 aa, Homo Sapiens
TPKTPPSSG

SEQ ID NO: 854556 - protein, 9 aa, Homo Sapiens
GYGEIGVSS

SEQ ID NO: 854557 - protein, 9 aa, Homo Sapiens
CSLIKWLEA

SEQ ID NO: 854558 - protein, 9 aa, Homo Sapiens
LPMLAAPQI

SEQ ID NO: 854559 - protein, 9 aa, Homo Sapiens
FLNNSVLTD

SEQ ID NO: 854560 - protein, 9 aa, Homo Sapiens
EAAKRTITF

SEQ ID NO: 854561 - protein, 9 aa, Homo Sapiens
MRLTKLAEV

SEQ ID NO: 854562 - protein, 9 aa, Homo Sapiens
TELSDQQYQ

SEQ ID NO: 854563 - protein, 9 aa, Homo Sapiens
HKIIHSGQK

SEQ ID NO: 854564 - protein, 9 aa, Homo Sapiens
KLMEVCKEN

SEQ ID NO: 854565 - protein, 9 aa, Homo Sapiens
GHPDRARRA

SEQ ID NO: 854566 - protein, 9 aa, Homo Sapiens
PRWKQQNLN

SEQ ID NO: 854567 - protein, 9 aa, Homo Sapiens
APNNDFEIV

SEQ ID NO: 854568 - protein, 9 aa, Homo Sapiens
SRYRGLGIL

SEQ ID NO: 854569 - protein, 9 aa, Homo Sapiens
ADQLKQAEE

SEQ ID NO: 854570 - protein, 9 aa, Homo Sapiens
IENKAFKQL

SEQ ID NO: 854571 - protein, 9 aa, Homo Sapiens
LGLQCRRCC

SEQ ID NO: 854572 - protein, 9 aa, Homo Sapiens
HSHVQGISY

SEQ ID NO: 854573 - protein, 9 aa, Homo Sapiens
GRGLALLRA

SEQ ID NO: 854574 - protein, 9 aa, Homo Sapiens
NFSFSKEQR

SEQ ID NO: 854575 - protein, 9 aa, Homo Sapiens
KSNLNYLDE

SEQ ID NO: 854576 - protein, 9 aa, Homo Sapiens
RHHRIHTGD

SEQ ID NO: 854577 - protein, 9 aa, Homo Sapiens
REQKHPERR

SEQ ID NO: 854578 - protein, 9 aa, Homo Sapiens
SSRARSFST

SEQ ID NO: 854579 - protein, 9 aa, Homo Sapiens
KAIKLAEQK

SEQ ID NO: 854580 - protein, 9 aa, Homo Sapiens
SFNKLYRVV

SEQ ID NO: 854581 - protein, 9 aa, Homo Sapiens
NNSFLQSEE

SEQ ID NO: 854582 - protein, 9 aa, Homo Sapiens
LCCPAYPQS

SEQ ID NO: 854583 - protein, 9 aa, Homo Sapiens
IPMQVPSYE

SEQ ID NO: 854584 - protein, 9 aa, Homo Sapiens
RPETGILDG

SEQ ID NO: 854585 - protein, 9 aa, Homo Sapiens
PNAKGVLVG

SEQ ID NO: 854586 - protein, 9 aa, Homo Sapiens
SVPVFIQVP

SEQ ID NO: 854587 - protein, 9 aa, Homo Sapiens
LVDKSGELL

SEQ ID NO: 854588 - protein, 9 aa, Homo Sapiens
ANEDNRKWM

SEQ ID NO: 854589 - protein, 9 aa, Homo Sapiens
KGNYLRTST

SEQ ID NO: 854590 - protein, 9 aa, Homo Sapiens
LCDWMYKHR

SEQ ID NO: 854591 - protein, 9 aa, Homo Sapiens
NLARHRRIN

SEQ ID NO: 854592 - protein, 9 aa, Homo Sapiens
GEYLEFKEP

SEQ ID NO: 854593 - protein, 9 aa, Homo Sapiens
FVQHWKPSF

SEQ ID NO: 854594 - protein, 9 aa, Homo Sapiens
KRGMEQDNK

SEQ ID NO: 854595 - protein, 9 aa, Homo Sapiens
VHVCLCMCV

SEQ ID NO: 854596 - protein, 9 aa, Homo Sapiens
HNQNENVVP

SEQ ID NO: 854597 - protein, 9 aa, Homo Sapiens
SASDGFWKY

SEQ ID NO: 854598 - protein, 9 aa, Homo Sapiens
EVLTLTGVY

SEQ ID NO: 854599 - protein, 9 aa, Homo Sapiens
ALGVLSSYG

SEQ ID NO: 854600 - protein, 9 aa, Homo Sapiens
STTTVTVNV

SEQ ID NO: 854601 - protein, 9 aa, Homo Sapiens
FAPGITDKA

SEQ ID NO: 854602 - protein, 9 aa, Homo Sapiens
HTTLGPGPH

SEQ ID NO: 854603 - protein, 9 aa, Homo Sapiens
LVFRESSSK

SEQ ID NO: 854604 - protein, 9 aa, Homo Sapiens
KECQYSEES

SEQ ID NO: 854605 - protein, 9 aa, Homo Sapiens
TNPDRRCTK

SEQ ID NO: 854606 - protein, 9 aa, Homo Sapiens
YNIIEDILE

SEQ ID NO: 854607 - protein, 9 aa, Homo Sapiens
GIVTTCSLV

SEQ ID NO: 854608 - protein, 9 aa, Homo Sapiens
RPSLRQNHS

SEQ ID NO: 854609 - protein, 9 aa, Homo Sapiens
WGIRCLHYE

SEQ ID NO: 854610 - protein, 9 aa, Homo Sapiens
TDSTPALHS

SEQ ID NO: 854611 - protein, 9 aa, Homo Sapiens
SLSYSSLML

SEQ ID NO: 854612 - protein, 9 aa, Homo Sapiens
SCSEQAQVF

SEQ ID NO: 854613 - protein, 9 aa, Homo Sapiens
SHLRFHKAP

SEQ ID NO: 854614 - protein, 9 aa, Homo Sapiens
LYLLQGIQN

SEQ ID NO: 854615 - protein, 9 aa, Homo Sapiens
PDLAFNKEQ

SEQ ID NO: 854616 - protein, 9 aa, Homo Sapiens
QLVVDGVKF

SEQ ID NO: 854617 - protein, 9 aa, Homo Sapiens
DVMLDNLAL

SEQ ID NO: 854618 - protein, 9 aa, Homo Sapiens
QSLQLTWSD

SEQ ID NO: 854619 - protein, 9 aa, Homo Sapiens
ASVSLLMFK

SEQ ID NO: 854620 - protein, 9 aa, Homo Sapiens
MVGIIYKPT

SEQ ID NO: 854621 - protein, 9 aa, Homo Sapiens
SSRLDHGTE

SEQ ID NO: 854622 - protein, 9 aa, Homo Sapiens
EYNLSGTKN

SEQ ID NO: 854623 - protein, 9 aa, Homo Sapiens
WVWATVRGP

SEQ ID NO: 854624 - protein, 9 aa, Homo Sapiens
VKVILYQIL

SEQ ID NO: 854625 - protein, 9 aa, Homo Sapiens
LEDLLMGMD

SEQ ID NO: 854626 - protein, 9 aa, Homo Sapiens
YSFSNAWLL

SEQ ID NO: 854627 - protein, 9 aa, Homo Sapiens
GPNQVDYFL

SEQ ID NO: 854628 - protein, 9 aa, Homo Sapiens
RTGDKLYEC

SEQ ID NO: 854629 - protein, 9 aa, Homo Sapiens
EIKNKSSDT

SEQ ID NO: 854630 - protein, 9 aa, Homo Sapiens
LRLFGSLSN

SEQ ID NO: 854631 - protein, 9 aa, Homo Sapiens
EISKRQFKN

SEQ ID NO: 854632 - protein, 9 aa, Homo Sapiens
VQYSNQIIQ

SEQ ID NO: 854633 - protein, 9 aa, Homo Sapiens
RVQIHNSFS

SEQ ID NO: 854634 - protein, 9 aa, Homo Sapiens
AIDFREFII

SEQ ID NO: 854635 - protein, 9 aa, Homo Sapiens
GPDALIASL

SEQ ID NO: 854636 - protein, 9 aa, Homo Sapiens
IKKIVYSIV

SEQ ID NO: 854637 - protein, 9 aa, Homo Sapiens
LKKLCFDIE

SEQ ID NO: 854638 - protein, 9 aa, Homo Sapiens
RILCSRGLQ

SEQ ID NO: 854639 - protein, 9 aa, Homo Sapiens
YLKPENLIL

SEQ ID NO: 854640 - protein, 9 aa, Homo Sapiens
FDKQVMEQG

SEQ ID NO: 854641 - protein, 9 aa, Homo Sapiens
YPSTRVMRN

SEQ ID NO: 854642 - protein, 9 aa, Homo Sapiens
IFSYNRLRC

SEQ ID NO: 854643 - protein, 9 aa, Homo Sapiens
AILNIQSGE

SEQ ID NO: 854644 - protein, 9 aa, Homo Sapiens
MKYTKHNFM

SEQ ID NO: 854645 - protein, 9 aa, Homo Sapiens
LDHPHCLPY

SEQ ID NO: 854646 - protein, 9 aa, Homo Sapiens
TDPFYGIPR

SEQ ID NO: 854647 - protein, 9 aa, Homo Sapiens
GVQTQGQVT

SEQ ID NO: 854648 - protein, 9 aa, Homo Sapiens
ALGKYVLVI

SEQ ID NO: 854649 - protein, 9 aa, Homo Sapiens
ACDNVEGLF

SEQ ID NO: 854650 - protein, 9 aa, Homo Sapiens
AAKMENKVS

SEQ ID NO: 854651 - protein, 9 aa, Homo Sapiens
GLLLPSEAV

SEQ ID NO: 854652 - protein, 9 aa, Homo Sapiens
LFMITSVFY

SEQ ID NO: 854653 - protein, 9 aa, Homo Sapiens
SSHLRFHKA

SEQ ID NO: 854654 - protein, 9 aa, Homo Sapiens
HLIYPRHCD

SEQ ID NO: 854655 - protein, 9 aa, Homo Sapiens
IAVNKCDLS

SEQ ID NO: 854656 - protein, 9 aa, Homo Sapiens
KQQKKEEKT

SEQ ID NO: 854657 - protein, 9 aa, Homo Sapiens
FLFAAICLV

SEQ ID NO: 854658 - protein, 9 aa, Homo Sapiens
RYKIRLNNA

SEQ ID NO: 854659 - protein, 9 aa, Homo Sapiens
ECVSELISF

SEQ ID NO: 854660 - protein, 9 aa, Homo Sapiens
NLATSNAEH

SEQ ID NO: 854661 - protein, 9 aa, Homo Sapiens
EQLGMQALV

SEQ ID NO: 854662 - protein, 9 aa, Homo Sapiens
SPSSPKRNL

SEQ ID NO: 854663 - protein, 9 aa, Homo Sapiens
KKAIPQHFC

SEQ ID NO: 854664 - protein, 9 aa, Homo Sapiens
VILLLLFLK

SEQ ID NO: 854665 - protein, 9 aa, Homo Sapiens
GEQTSYGTF

SEQ ID NO: 854666 - protein, 9 aa, Homo Sapiens
IYGKFRTTF

SEQ ID NO: 854667 - protein, 9 aa, Homo Sapiens
YCWLLNEFP

SEQ ID NO: 854668 - protein, 9 aa, Homo Sapiens
NETYKNNFD

SEQ ID NO: 854669 - protein, 9 aa, Homo Sapiens
NANIDVVDA

SEQ ID NO: 854670 - protein, 9 aa, Homo Sapiens
LGRSWLLSP

SEQ ID NO: 854671 - protein, 9 aa, Homo Sapiens
QVQVKRYDL

SEQ ID NO: 854672 - protein, 9 aa, Homo Sapiens
VEFLGMIGI

SEQ ID NO: 854673 - protein, 9 aa, Homo Sapiens
INECDVEPC

SEQ ID NO: 854674 - protein, 9 aa, Homo Sapiens
TNFQHMIEL

SEQ ID NO: 854675 - protein, 9 aa, Homo Sapiens
EEIQEWDEK

SEQ ID NO: 854676 - protein, 9 aa, Homo Sapiens
VLEIHNEHL

SEQ ID NO: 854677 - protein, 9 aa, Homo Sapiens
LNWLISDLQ

SEQ ID NO: 854678 - protein, 9 aa, Homo Sapiens
LVGKDSYVE

SEQ ID NO: 854679 - protein, 9 aa, Homo Sapiens
SRAAFLPLP

SEQ ID NO: 854680 - protein, 9 aa, Homo Sapiens
KEMSNAFAH

SEQ ID NO: 854681 - protein, 9 aa, Homo Sapiens
KSSVLHHCC

SEQ ID NO: 854682 - protein, 9 aa, Homo Sapiens
PFKTIILLT

SEQ ID NO: 854683 - protein, 9 aa, Homo Sapiens
PDMQMKDPL

SEQ ID NO: 854684 - protein, 9 aa, Homo Sapiens
PDIVGFTAI

SEQ ID NO: 854685 - protein, 9 aa, Homo Sapiens
LKRNYSYFL

SEQ ID NO: 854686 - protein, 9 aa, Homo Sapiens
KQLFECMNF

SEQ ID NO: 854687 - protein, 9 aa, Homo Sapiens
YPPEMYMTW

SEQ ID NO: 854688 - protein, 9 aa, Homo Sapiens
KYEEAQKEV

SEQ ID NO: 854689 - protein, 9 aa, Homo Sapiens
GRHDFGFPQ

SEQ ID NO: 854690 - protein, 9 aa, Homo Sapiens
EESVEVLWP

SEQ ID NO: 854691 - protein, 9 aa, Homo Sapiens
YDMPHVVAC

SEQ ID NO: 854692 - protein, 9 aa, Homo Sapiens
LIQDNEVLF

SEQ ID NO: 854693 - protein, 9 aa, Homo Sapiens
FQSELHPAL

SEQ ID NO: 854694 - protein, 9 aa, Homo Sapiens
GNGALLCQL

SEQ ID NO: 854695 - protein, 9 aa, Homo Sapiens
ITASLQFDG

SEQ ID NO: 854696 - protein, 9 aa, Homo Sapiens
EDRIQNIRL

SEQ ID NO: 854697 - protein, 9 aa, Homo Sapiens
VEDLLNYQV

SEQ ID NO: 854698 - protein, 9 aa, Homo Sapiens
LSINFFLLN

SEQ ID NO: 854699 - protein, 9 aa, Homo Sapiens
KRIHQQGQG

SEQ ID NO: 854700 - protein, 9 aa, Homo Sapiens
RDTSYWLQT

SEQ ID NO: 854701 - protein, 9 aa, Homo Sapiens
INKMKTLNR

SEQ ID NO: 854702 - protein, 9 aa, Homo Sapiens
NSFQTLNHC

SEQ ID NO: 854703 - protein, 9 aa, Homo Sapiens
AQGSLLFGD

SEQ ID NO: 854704 - protein, 9 aa, Homo Sapiens
DDTEKERPV

SEQ ID NO: 854705 - protein, 9 aa, Homo Sapiens
VVAVNSYMP

SEQ ID NO: 854706 - protein, 9 aa, Homo Sapiens
IDEPPVLTK

SEQ ID NO: 854707 - protein, 9 aa, Homo Sapiens
LHIEFKCCG

SEQ ID NO: 854708 - protein, 9 aa, Homo Sapiens
QLNVSQLLK

SEQ ID NO: 854709 - protein, 9 aa, Homo Sapiens
SLCKLWLMH

SEQ ID NO: 854710 - protein, 9 aa, Homo Sapiens
RNYVTHYCQ

SEQ ID NO: 854711 - protein, 9 aa, Homo Sapiens
LSQCVTHCS

SEQ ID NO: 854712 - protein, 9 aa, Homo Sapiens
SGEMWRQTH

SEQ ID NO: 854713 - protein, 9 aa, Homo Sapiens
LFQGVMQKH

SEQ ID NO: 854714 - protein, 9 aa, Homo Sapiens
SSHKISHTG

SEQ ID NO: 854715 - protein, 9 aa, Homo Sapiens
QIGDSSEEV

SEQ ID NO: 854716 - protein, 9 aa, Homo Sapiens
GKTTAIIQL

SEQ ID NO: 854717 - protein, 9 aa, Homo Sapiens
NTTNGRGCT

SEQ ID NO: 854718 - protein, 9 aa, Homo Sapiens
EPLVPTQSV

SEQ ID NO: 854719 - protein, 9 aa, Homo Sapiens
KSVEVLNNN

SEQ ID NO: 854720 - protein, 9 aa, Homo Sapiens
CNTLITFIE

SEQ ID NO: 854721 - protein, 9 aa, Homo Sapiens
HTSIPQQLA

SEQ ID NO: 854722 - protein, 9 aa, Homo Sapiens
KVAPYNIQY

SEQ ID NO: 854723 - protein, 9 aa, Homo Sapiens
PKVGFFCPI

SEQ ID NO: 854724 - protein, 9 aa, Homo Sapiens
SFISAQASC

SEQ ID NO: 854725 - protein, 9 aa, Homo Sapiens
QIGLSVGLG

SEQ ID NO: 854726 - protein, 9 aa, Homo Sapiens
QQINSIKLL

SEQ ID NO: 854727 - protein, 9 aa, Homo Sapiens
KVYLGSQID

SEQ ID NO: 854728 - protein, 9 aa, Homo Sapiens
LGAHKLYFP

SEQ ID NO: 854729 - protein, 9 aa, Homo Sapiens
LFKMLPYTF

SEQ ID NO: 854730 - protein, 9 aa, Homo Sapiens
IMAAVPVAA

SEQ ID NO: 854731 - protein, 9 aa, Homo Sapiens
KDINLNKVK

SEQ ID NO: 854732 - protein, 9 aa, Homo Sapiens
LASLIYSTN

SEQ ID NO: 854733 - protein, 9 aa, Homo Sapiens
PNKKAHPDM

SEQ ID NO: 854734 - protein, 9 aa, Homo Sapiens
KYHGYPYRD

SEQ ID NO: 854735 - protein, 9 aa, Homo Sapiens
VGYRGTMVT

SEQ ID NO: 854736 - protein, 9 aa, Homo Sapiens
TERFQHVIE

SEQ ID NO: 854737 - protein, 9 aa, Homo Sapiens
CLAEGGKLM

SEQ ID NO: 854738 - protein, 9 aa, Homo Sapiens
NPLATLGVS

SEQ ID NO: 854739 - protein, 9 aa, Homo Sapiens
AGTKVLEVP

SEQ ID NO: 854740 - protein, 9 aa, Homo Sapiens
QIAVTLNKT

SEQ ID NO: 854741 - protein, 9 aa, Homo Sapiens
RVPGSQVPT

SEQ ID NO: 854742 - protein, 9 aa, Homo Sapiens
IKLEILEKC

SEQ ID NO: 854743 - protein, 9 aa, Homo Sapiens
CFDHAHRQL

SEQ ID NO: 854744 - protein, 9 aa, Homo Sapiens
RNDYLWHRS

SEQ ID NO: 854745 - protein, 9 aa, Homo Sapiens
GSDSSDSSN

SEQ ID NO: 854746 - protein, 9 aa, Homo Sapiens
VKAVLNDEQ

SEQ ID NO: 854747 - protein, 9 aa, Homo Sapiens
TFIDNKSMS

SEQ ID NO: 854748 - protein, 9 aa, Homo Sapiens
AQSCAKVRK

SEQ ID NO: 854749 - protein, 9 aa, Homo Sapiens
PLHPDTWLA

SEQ ID NO: 854750 - protein, 9 aa, Homo Sapiens
KYEAIMCII

SEQ ID NO: 854751 - protein, 9 aa, Homo Sapiens
DDFYSGLES

SEQ ID NO: 854752 - protein, 9 aa, Homo Sapiens
CDCSMTSYY

SEQ ID NO: 854753 - protein, 9 aa, Homo Sapiens
VVSSAEKLS

SEQ ID NO: 854754 - protein, 9 aa, Homo Sapiens
DLNKQVLEH

SEQ ID NO: 854755 - protein, 9 aa, Homo Sapiens
YHLKQIKEH

SEQ ID NO: 854756 - protein, 9 aa, Homo Sapiens
FIRQFIPIK

SEQ ID NO: 854757 - protein, 9 aa, Homo Sapiens
SESKLHGKL

SEQ ID NO: 854758 - protein, 9 aa, Homo Sapiens
DKVILFSFS

SEQ ID NO: 854759 - protein, 9 aa, Homo Sapiens
WTLGSCPSE

SEQ ID NO: 854760 - protein, 9 aa, Homo Sapiens
HKIQCQQEK

SEQ ID NO: 854761 - protein, 9 aa, Homo Sapiens
LSGEDDPEN

SEQ ID NO: 854762 - protein, 9 aa, Homo Sapiens
IHFQRKKPY

SEQ ID NO: 854763 - protein, 9 aa, Homo Sapiens
NWQMLQLLM

SEQ ID NO: 854764 - protein, 9 aa, Homo Sapiens
LERTGHYST

SEQ ID NO: 854765 - protein, 9 aa, Homo Sapiens
RMSFPYCGP

SEQ ID NO: 854766 - protein, 9 aa, Homo Sapiens
IMKGLTLGR

SEQ ID NO: 854767 - protein, 9 aa, Homo Sapiens
RGAEGPLPL

SEQ ID NO: 854768 - protein, 9 aa, Homo Sapiens
KSFDKLLKY

SEQ ID NO: 854769 - protein, 9 aa, Homo Sapiens
DYMKWRRKA

SEQ ID NO: 854770 - protein, 9 aa, Homo Sapiens
TPQCFFYII

SEQ ID NO: 854771 - protein, 9 aa, Homo Sapiens
CYVLSAQQL

SEQ ID NO: 854772 - protein, 9 aa, Homo Sapiens
LSPRAGSPV

SEQ ID NO: 854773 - protein, 9 aa, Homo Sapiens
APPPDEDDP

SEQ ID NO: 854774 - protein, 9 aa, Homo Sapiens
NPVIYAFLG

SEQ ID NO: 854775 - protein, 9 aa, Homo Sapiens
GFFILFRGF

SEQ ID NO: 854776 - protein, 9 aa, Homo Sapiens
QTVATPLNQ

SEQ ID NO: 854777 - protein, 9 aa, Homo Sapiens
AIKAECSIQ

SEQ ID NO: 854778 - protein, 9 aa, Homo Sapiens
RRYAMVLFM

SEQ ID NO: 854779 - protein, 9 aa, Homo Sapiens
KKIYLPGQM

SEQ ID NO: 854780 - protein, 9 aa, Homo Sapiens
IKLKNVDVN

SEQ ID NO: 854781 - protein, 9 aa, Homo Sapiens
EVFMTPEYF

SEQ ID NO: 854782 - protein, 9 aa, Homo Sapiens
GLISRMYKE

SEQ ID NO: 854783 - protein, 9 aa, Homo Sapiens
LVRFLFSIR

SEQ ID NO: 854784 - protein, 9 aa, Homo Sapiens
KYIPHNSAT

SEQ ID NO: 854785 - protein, 9 aa, Homo Sapiens
DSLGGEPSS

SEQ ID NO: 854786 - protein, 9 aa, Homo Sapiens
VVVVSVKHN

SEQ ID NO: 854787 - protein, 9 aa, Homo Sapiens
QTQVLINGA

SEQ ID NO: 854788 - protein, 9 aa, Homo Sapiens
AQLWSESFD

SEQ ID NO: 854789 - protein, 9 aa, Homo Sapiens
LSAHHDKRL

SEQ ID NO: 854790 - protein, 9 aa, Homo Sapiens
TEQEKFGKV

SEQ ID NO: 854791 - protein, 9 aa, Homo Sapiens
SAGKNNNKF

SEQ ID NO: 854792 - protein, 9 aa, Homo Sapiens
YGSSYLTNS

SEQ ID NO: 854793 - protein, 9 aa, Homo Sapiens
DDNPLLRSV

SEQ ID NO: 854794 - protein, 9 aa, Homo Sapiens
THDKDLREN

SEQ ID NO: 854795 - protein, 9 aa, Homo Sapiens
YYKAANIHI

SEQ ID NO: 854796 - protein, 9 aa, Homo Sapiens
YGSGKTYIG

SEQ ID NO: 854797 - protein, 9 aa, Homo Sapiens
ELLQQAHQI

SEQ ID NO: 854798 - protein, 9 aa, Homo Sapiens
PAAAHNLVL

SEQ ID NO: 854799 - protein, 9 aa, Homo Sapiens
ARIWSLESL

SEQ ID NO: 854800 - protein, 9 aa, Homo Sapiens
RLNNYLHFA

SEQ ID NO: 854801 - protein, 9 aa, Homo Sapiens
IYHQGQPQT

SEQ ID NO: 854802 - protein, 9 aa, Homo Sapiens
NKHVFKDNV

SEQ ID NO: 854803 - protein, 9 aa, Homo Sapiens
DTINRQIVD

SEQ ID NO: 854804 - protein, 9 aa, Homo Sapiens
LSGDKNRLA

SEQ ID NO: 854805 - protein, 9 aa, Homo Sapiens
LEKYARDMI

SEQ ID NO: 854806 - protein, 9 aa, Homo Sapiens
IIITYLSDQ

SEQ ID NO: 854807 - protein, 9 aa, Homo Sapiens
SPIFRDVLN

SEQ ID NO: 854808 - protein, 9 aa, Homo Sapiens
IYTLINEEV

SEQ ID NO: 854809 - protein, 9 aa, Homo Sapiens
LTTATFYHR

SEQ ID NO: 854810 - protein, 9 aa, Homo Sapiens
LLAPRNPDP

SEQ ID NO: 854811 - protein, 9 aa, Homo Sapiens
PRCELWAGP

SEQ ID NO: 854812 - protein, 9 aa, Homo Sapiens
DTFIDQLYK

SEQ ID NO: 854813 - protein, 9 aa, Homo Sapiens
NDIFEIHFS

SEQ ID NO: 854814 - protein, 9 aa, Homo Sapiens
TVTHVHMHA

SEQ ID NO: 854815 - protein, 9 aa, Homo Sapiens
NSEGGSGRA

SEQ ID NO: 854816 - protein, 9 aa, Homo Sapiens
PILLLLAHI

SEQ ID NO: 854817 - protein, 9 aa, Homo Sapiens
CPCVHPCIL

SEQ ID NO: 854818 - protein, 9 aa, Homo Sapiens
NLALPLLSV

SEQ ID NO: 854819 - protein, 9 aa, Homo Sapiens
IIKAINRTI

SEQ ID NO: 854820 - protein, 9 aa, Homo Sapiens
EAYSCASKH

SEQ ID NO: 854821 - protein, 9 aa, Homo Sapiens
AVFNTSVAP

SEQ ID NO: 854822 - protein, 9 aa, Homo Sapiens
HSRVYLMTL

SEQ ID NO: 854823 - protein, 9 aa, Homo Sapiens
EMIDRIKYN

SEQ ID NO: 854824 - protein, 9 aa, Homo Sapiens
AKSQFIKHV

SEQ ID NO: 854825 - protein, 9 aa, Homo Sapiens
AHQRKSMEA

SEQ ID NO: 854826 - protein, 9 aa, Homo Sapiens
GKFISGTPQ

SEQ ID NO: 854827 - protein, 9 aa, Homo Sapiens
TLYQNRSNL

SEQ ID NO: 854828 - protein, 9 aa, Homo Sapiens
PSRTIFRKS

SEQ ID NO: 854829 - protein, 9 aa, Homo Sapiens
QLETESKHL

SEQ ID NO: 854830 - protein, 9 aa, Homo Sapiens
IILWWNIFT

SEQ ID NO: 854831 - protein, 9 aa, Homo Sapiens
SSLEDISCN

SEQ ID NO: 854832 - protein, 9 aa, Homo Sapiens
VAHMTRSEL

SEQ ID NO: 854833 - protein, 9 aa, Homo Sapiens
LFPVPESIL

SEQ ID NO: 854834 - protein, 9 aa, Homo Sapiens
PLITDFKRF

SEQ ID NO: 854835 - protein, 9 aa, Homo Sapiens
HVDNIMLEN

SEQ ID NO: 854836 - protein, 9 aa, Homo Sapiens
PGSTKPLKT

SEQ ID NO: 854837 - protein, 9 aa, Homo Sapiens
ITIIKIELE

SEQ ID NO: 854838 - protein, 9 aa, Homo Sapiens
TKAELAWLQ

SEQ ID NO: 854839 - protein, 9 aa, Homo Sapiens
SYSSVQHPL

SEQ ID NO: 854840 - protein, 9 aa, Homo Sapiens
KKLLLVNNK

SEQ ID NO: 854841 - protein, 9 aa, Homo Sapiens
QRDTSYWLQ

SEQ ID NO: 854842 - protein, 9 aa, Homo Sapiens
LIFAIVFSI

SEQ ID NO: 854843 - protein, 9 aa, Homo Sapiens
NLRANPLHS

SEQ ID NO: 854844 - protein, 9 aa, Homo Sapiens
HTEDKFYKI

SEQ ID NO: 854845 - protein, 9 aa, Homo Sapiens
RSGLYHSPS

SEQ ID NO: 854846 - protein, 9 aa, Homo Sapiens
ECQRCNCNG

SEQ ID NO: 854847 - protein, 9 aa, Homo Sapiens
QELWIYQQE

SEQ ID NO: 854848 - protein, 9 aa, Homo Sapiens
MLLQFNAIR

SEQ ID NO: 854849 - protein, 9 aa, Homo Sapiens
RFFLISSNR

SEQ ID NO: 854850 - protein, 9 aa, Homo Sapiens
GQSPKSLRL

SEQ ID NO: 854851 - protein, 9 aa, Homo Sapiens
RQTAPRPRL

SEQ ID NO: 854852 - protein, 9 aa, Homo Sapiens
NTSGNALLQ

SEQ ID NO: 854853 - protein, 9 aa, Homo Sapiens
RKRASKIYF

SEQ ID NO: 854854 - protein, 9 aa, Homo Sapiens
LTTIGFGDI

SEQ ID NO: 854855 - protein, 9 aa, Homo Sapiens
FLWRQQKER

SEQ ID NO: 854856 - protein, 9 aa, Homo Sapiens
YKCSDCGKC

SEQ ID NO: 854857 - protein, 9 aa, Homo Sapiens
FWIVFLLVG

SEQ ID NO: 854858 - protein, 9 aa, Homo Sapiens
SLDFSDGDE

SEQ ID NO: 854859 - protein, 9 aa, Homo Sapiens
RQRAKRNTV

SEQ ID NO: 854860 - protein, 9 aa, Homo Sapiens
VSPPQTKDK

SEQ ID NO: 854861 - protein, 9 aa, Homo Sapiens
KEIFLVSII

SEQ ID NO: 854862 - protein, 9 aa, Homo Sapiens
SSALKAIDS

SEQ ID NO: 854863 - protein, 9 aa, Homo Sapiens
HGLQVWLQL

SEQ ID NO: 854864 - protein, 9 aa, Homo Sapiens
KRLSPMKPL

SEQ ID NO: 854865 - protein, 9 aa, Homo Sapiens
SNNLKSGDA

SEQ ID NO: 854866 - protein, 9 aa, Homo Sapiens
RAAATSMFE

SEQ ID NO: 854867 - protein, 9 aa, Homo Sapiens
VDRTIEKII

SEQ ID NO: 854868 - protein, 9 aa, Homo Sapiens
EPYMDDNFI

SEQ ID NO: 854869 - protein, 9 aa, Homo Sapiens
IPQLCVGTM

SEQ ID NO: 854870 - protein, 9 aa, Homo Sapiens
VFQTPPIVE

SEQ ID NO: 854871 - protein, 9 aa, Homo Sapiens
CCDRNLCNV

SEQ ID NO: 854872 - protein, 9 aa, Homo Sapiens
HDPHNRKQH

SEQ ID NO: 854873 - protein, 9 aa, Homo Sapiens
TEREASKIM

SEQ ID NO: 854874 - protein, 9 aa, Homo Sapiens
QEELKIKCS

SEQ ID NO: 854875 - protein, 9 aa, Homo Sapiens
EGVDNACFS

SEQ ID NO: 854876 - protein, 9 aa, Homo Sapiens
NVTGFILLG

SEQ ID NO: 854877 - protein, 9 aa, Homo Sapiens
GKLVSLSKQ

SEQ ID NO: 854878 - protein, 9 aa, Homo Sapiens
PTSQENNEN

SEQ ID NO: 854879 - protein, 9 aa, Homo Sapiens
PNGYLVLYL

SEQ ID NO: 854880 - protein, 9 aa, Homo Sapiens
NSSTSDGDQ

SEQ ID NO: 854881 - protein, 9 aa, Homo Sapiens
SWALRIKSY

SEQ ID NO: 854882 - protein, 9 aa, Homo Sapiens
KLCPALKIF

SEQ ID NO: 854883 - protein, 9 aa, Homo Sapiens
SLMGLSLFF

SEQ ID NO: 854884 - protein, 9 aa, Homo Sapiens
ASFQINQLL

SEQ ID NO: 854885 - protein, 9 aa, Homo Sapiens
PNESDLPYN

SEQ ID NO: 854886 - protein, 9 aa, Homo Sapiens
EMQPHGKVF

SEQ ID NO: 854887 - protein, 9 aa, Homo Sapiens
PGPSKSETS

SEQ ID NO: 854888 - protein, 9 aa, Homo Sapiens
EDGLPKGIH

SEQ ID NO: 854889 - protein, 9 aa, Homo Sapiens
LNSTTWKVI

SEQ ID NO: 854890 - protein, 9 aa, Homo Sapiens
YRGGHLTIH

SEQ ID NO: 854891 - protein, 9 aa, Homo Sapiens
VQLQERLAV

SEQ ID NO: 854892 - protein, 9 aa, Homo Sapiens
MALIIYMLI

SEQ ID NO: 854893 - protein, 9 aa, Homo Sapiens
PTMKMLERS

SEQ ID NO: 854894 - protein, 9 aa, Homo Sapiens
EVCKADAKI

SEQ ID NO: 854895 - protein, 9 aa, Homo Sapiens
FIFTGLDVY

SEQ ID NO: 854896 - protein, 9 aa, Homo Sapiens
HSHYPQLHA

SEQ ID NO: 854897 - protein, 9 aa, Homo Sapiens
HMASQPVMR

SEQ ID NO: 854898 - protein, 9 aa, Homo Sapiens
NVEYIKMAD

SEQ ID NO: 854899 - protein, 9 aa, Homo Sapiens
SHEAEVHAK

SEQ ID NO: 854900 - protein, 9 aa, Homo Sapiens
RYGFSHQSK

SEQ ID NO: 854901 - protein, 9 aa, Homo Sapiens
RQPNAAQYL

SEQ ID NO: 854902 - protein, 9 aa, Homo Sapiens
EKQLTEDDL

SEQ ID NO: 854903 - protein, 9 aa, Homo Sapiens
RPSQRCVTF

SEQ ID NO: 854904 - protein, 9 aa, Homo Sapiens
LFMRTTVFI

SEQ ID NO: 854905 - protein, 9 aa, Homo Sapiens
VLLYPSHPT

SEQ ID NO: 854906 - protein, 9 aa, Homo Sapiens
AVEHPEAVC

SEQ ID NO: 854907 - protein, 9 aa, Homo Sapiens
LEQKIKIND

SEQ ID NO: 854908 - protein, 9 aa, Homo Sapiens
TVYGQIPLS

SEQ ID NO: 854909 - protein, 9 aa, Homo Sapiens
EITCALNNL

SEQ ID NO: 854910 - protein, 9 aa, Homo Sapiens
EEATSSHRY

SEQ ID NO: 854911 - protein, 9 aa, Homo Sapiens
PRTVSRLAH

SEQ ID NO: 854912 - protein, 9 aa, Homo Sapiens
LEACIKIGV

SEQ ID NO: 854913 - protein, 9 aa, Homo Sapiens
QKAHKYLRL

SEQ ID NO: 854914 - protein, 9 aa, Homo Sapiens
HFSPDIFSS

SEQ ID NO: 854915 - protein, 9 aa, Homo Sapiens
QTPGTYPED

SEQ ID NO: 854916 - protein, 9 aa, Homo Sapiens
SGDGKKAHH

SEQ ID NO: 854917 - protein, 9 aa, Homo Sapiens
IQREGKSYK

SEQ ID NO: 854918 - protein, 9 aa, Homo Sapiens
AYKLILGEI

SEQ ID NO: 854919 - protein, 9 aa, Homo Sapiens
PDGAHWQEL

SEQ ID NO: 854920 - protein, 9 aa, Homo Sapiens
VKRDERLGM

SEQ ID NO: 854921 - protein, 9 aa, Homo Sapiens
RVRSHIMHL

SEQ ID NO: 854922 - protein, 9 aa, Homo Sapiens
QQCAKHNSY

SEQ ID NO: 854923 - protein, 9 aa, Homo Sapiens
TQTDADPAK

SEQ ID NO: 854924 - protein, 9 aa, Homo Sapiens
ILIFIMAGI

SEQ ID NO: 854925 - protein, 9 aa, Homo Sapiens
DHLIYPRHC

SEQ ID NO: 854926 - protein, 9 aa, Homo Sapiens
LWRVARSIN

SEQ ID NO: 854927 - protein, 9 aa, Homo Sapiens
LLGLTDNYQ

SEQ ID NO: 854928 - protein, 9 aa, Homo Sapiens
IIHAYSSSE

SEQ ID NO: 854929 - protein, 9 aa, Homo Sapiens
SEKKLRQNQ

SEQ ID NO: 854930 - protein, 9 aa, Homo Sapiens
VHRLEHHAK

SEQ ID NO: 854931 - protein, 9 aa, Homo Sapiens
TFEEVIFIC

SEQ ID NO: 854932 - protein, 9 aa, Homo Sapiens
SCLMGRHDF

SEQ ID NO: 854933 - protein, 9 aa, Homo Sapiens
HVQIWEVLK

SEQ ID NO: 854934 - protein, 9 aa, Homo Sapiens
ATFDLKVVA

SEQ ID NO: 854935 - protein, 9 aa, Homo Sapiens
KISQPKKRV

SEQ ID NO: 854936 - protein, 9 aa, Homo Sapiens
QNVHEETTF

SEQ ID NO: 854937 - protein, 9 aa, Homo Sapiens
AASAWGMPS

SEQ ID NO: 854938 - protein, 9 aa, Homo Sapiens
PEWGSPKKC

SEQ ID NO: 854939 - protein, 9 aa, Homo Sapiens
NMEIPSTSN

SEQ ID NO: 854940 - protein, 9 aa, Homo Sapiens
SQSNPKREP

SEQ ID NO: 854941 - protein, 9 aa, Homo Sapiens
LTVGSECLF

SEQ ID NO: 854942 - protein, 9 aa, Homo Sapiens
SIFSNMGAW

SEQ ID NO: 854943 - protein, 9 aa, Homo Sapiens
SICFTDTAV

SEQ ID NO: 854944 - protein, 9 aa, Homo Sapiens
MKSKEARTY

SEQ ID NO: 854945 - protein, 9 aa, Homo Sapiens
WLHSSCYQP

SEQ ID NO: 854946 - protein, 9 aa, Homo Sapiens
IRGSVEAVV

SEQ ID NO: 854947 - protein, 9 aa, Homo Sapiens
VFGVDLKTV

SEQ ID NO: 854948 - protein, 9 aa, Homo Sapiens
EKKAIPQHF

SEQ ID NO: 854949 - protein, 9 aa, Homo Sapiens
NSLGSPAIK

SEQ ID NO: 854950 - protein, 9 aa, Homo Sapiens
FLVFQDIQD

SEQ ID NO: 854951 - protein, 9 aa, Homo Sapiens
TTKMPCKSS

SEQ ID NO: 854952 - protein, 9 aa, Homo Sapiens
EARDFPKDV

SEQ ID NO: 854953 - protein, 9 aa, Homo Sapiens
DVFNGRCHV

SEQ ID NO: 854954 - protein, 9 aa, Homo Sapiens
EDEEEDDVK

SEQ ID NO: 854955 - protein, 9 aa, Homo Sapiens
QTSSLPLQC

SEQ ID NO: 854956 - protein, 9 aa, Homo Sapiens
LLTRVLVRK

SEQ ID NO: 854957 - protein, 9 aa, Homo Sapiens
FSVSLLIFL

SEQ ID NO: 854958 - protein, 9 aa, Homo Sapiens
VQNFQSGIG

SEQ ID NO: 854959 - protein, 9 aa, Homo Sapiens
LKKPHKIKF

SEQ ID NO: 854960 - protein, 9 aa, Homo Sapiens
GAMLGLLCF

SEQ ID NO: 854961 - protein, 9 aa, Homo Sapiens
PYKTCNITV

SEQ ID NO: 854962 - protein, 9 aa, Homo Sapiens
ELGGDSHIL

SEQ ID NO: 854963 - protein, 9 aa, Homo Sapiens
TTPNHAPMA

SEQ ID NO: 854964 - protein, 9 aa, Homo Sapiens
APNISQRLL

SEQ ID NO: 854965 - protein, 9 aa, Homo Sapiens
ILLLSQGIL

SEQ ID NO: 854966 - protein, 9 aa, Homo Sapiens
IIGPPAVGK

SEQ ID NO: 854967 - protein, 9 aa, Homo Sapiens
REPQDGRDR

SEQ ID NO: 854968 - protein, 9 aa, Homo Sapiens
LFDELRMNY

SEQ ID NO: 854969 - protein, 9 aa, Homo Sapiens
RDLIKGVNM

SEQ ID NO: 854970 - protein, 9 aa, Homo Sapiens
ISSLEINIL

SEQ ID NO: 854971 - protein, 9 aa, Homo Sapiens
FKGVASSQF

SEQ ID NO: 854972 - protein, 9 aa, Homo Sapiens
SPRRKMASP

SEQ ID NO: 854973 - protein, 9 aa, Homo Sapiens
QQWRELGEQ

SEQ ID NO: 854974 - protein, 9 aa, Homo Sapiens
MGVVYALKR

SEQ ID NO: 854975 - protein, 9 aa, Homo Sapiens
VRVASAIVD

SEQ ID NO: 854976 - protein, 9 aa, Homo Sapiens
AKDSDKLKE

SEQ ID NO: 854977 - protein, 9 aa, Homo Sapiens
LFRRLSTLI

SEQ ID NO: 854978 - protein, 9 aa, Homo Sapiens
LKISLTNVC

SEQ ID NO: 854979 - protein, 9 aa, Homo Sapiens
DIAHAFTKN

SEQ ID NO: 854980 - protein, 9 aa, Homo Sapiens
GSQMGKPVP

SEQ ID NO: 854981 - protein, 9 aa, Homo Sapiens
TLASHSFTL

SEQ ID NO: 854982 - protein, 9 aa, Homo Sapiens
CVQECVSEL

SEQ ID NO: 854983 - protein, 9 aa, Homo Sapiens
DVEFTTHED

SEQ ID NO: 854984 - protein, 9 aa, Homo Sapiens
QYACVKDIS

SEQ ID NO: 854985 - protein, 9 aa, Homo Sapiens
NDYDKDNNG

SEQ ID NO: 854986 - protein, 9 aa, Homo Sapiens
PAHAGAVAV

SEQ ID NO: 854987 - protein, 9 aa, Homo Sapiens
RILIERQDK

SEQ ID NO: 854988 - protein, 9 aa, Homo Sapiens
ECLFSVVAF

SEQ ID NO: 854989 - protein, 9 aa, Homo Sapiens
TQDKASRKR

SEQ ID NO: 854990 - protein, 9 aa, Homo Sapiens
PINWQRARR

SEQ ID NO: 854991 - protein, 9 aa, Homo Sapiens
VFGRKYRVV

SEQ ID NO: 854992 - protein, 9 aa, Homo Sapiens
FEVVSPTKR

SEQ ID NO: 854993 - protein, 9 aa, Homo Sapiens
FQHRPRGKT

SEQ ID NO: 854994 - protein, 9 aa, Homo Sapiens
YELRNGEAT

SEQ ID NO: 854995 - protein, 9 aa, Homo Sapiens
KRILLCTDN

SEQ ID NO: 854996 - protein, 9 aa, Homo Sapiens
QLSTTVNSR

SEQ ID NO: 854997 - protein, 9 aa, Homo Sapiens
RSAIPEQIL

SEQ ID NO: 854998 - protein, 9 aa, Homo Sapiens
FHFYYPRVS

SEQ ID NO: 854999 - protein, 9 aa, Homo Sapiens
PKYLIYGPV

SEQ ID NO: 855000 - protein, 9 aa, Homo Sapiens
GICAMTKNS

SEQ ID NO: 855001 - protein, 9 aa, Homo Sapiens
DEKPYTCDK

SEQ ID NO: 855002 - protein, 9 aa, Homo Sapiens
LVTFNLLGE

SEQ ID NO: 855003 - protein, 9 aa, Homo Sapiens
EDLFPFPRH

SEQ ID NO: 855004 - protein, 9 aa, Homo Sapiens
TTFDSENDT

SEQ ID NO: 855005 - protein, 9 aa, Homo Sapiens
GMQFLACII

SEQ ID NO: 855006 - protein, 9 aa, Homo Sapiens
AVDVLERLD

SEQ ID NO: 855007 - protein, 9 aa, Homo Sapiens
KENTGQHNA

SEQ ID NO: 855008 - protein, 9 aa, Homo Sapiens
FISFAMGAA

SEQ ID NO: 855009 - protein, 9 aa, Homo Sapiens
PTFVQGVIN

SEQ ID NO: 855010 - protein, 9 aa, Homo Sapiens
ELDGRRIWV

SEQ ID NO: 855011 - protein, 9 aa, Homo Sapiens
LFDRTETRT

SEQ ID NO: 855012 - protein, 9 aa, Homo Sapiens
TSYLIDTVR

SEQ ID NO: 855013 - protein, 9 aa, Homo Sapiens
ALSKSCTMH

SEQ ID NO: 855014 - protein, 9 aa, Homo Sapiens
LRAYCESEI

SEQ ID NO: 855015 - protein, 9 aa, Homo Sapiens
CLRHRRSRS

SEQ ID NO: 855016 - protein, 9 aa, Homo Sapiens
CGKAFSRSL

SEQ ID NO: 855017 - protein, 9 aa, Homo Sapiens
DTMQEDLVT

SEQ ID NO: 855018 - protein, 9 aa, Homo Sapiens
HLVYADTIK

SEQ ID NO: 855019 - protein, 9 aa, Homo Sapiens
HVLTVTELL

SEQ ID NO: 855020 - protein, 9 aa, Homo Sapiens
PPRAPFAMI

SEQ ID NO: 855021 - protein, 9 aa, Homo Sapiens
HRDLKIITD

SEQ ID NO: 855022 - protein, 9 aa, Homo Sapiens
SEVLPLLLP

SEQ ID NO: 855023 - protein, 9 aa, Homo Sapiens
KDGNGRRAF

SEQ ID NO: 855024 - protein, 9 aa, Homo Sapiens
SAVVALILM

SEQ ID NO: 855025 - protein, 9 aa, Homo Sapiens
NNPSLGWGR

SEQ ID NO: 855026 - protein, 9 aa, Homo Sapiens
WNNLIDEHP

SEQ ID NO: 855027 - protein, 9 aa, Homo Sapiens
LGHGMDRVD

SEQ ID NO: 855028 - protein, 9 aa, Homo Sapiens
LRNIFVTSY

SEQ ID NO: 855029 - protein, 9 aa, Homo Sapiens
LTSQPQALY

SEQ ID NO: 855030 - protein, 9 aa, Homo Sapiens
TEIYKFHKT

SEQ ID NO: 855031 - protein, 9 aa, Homo Sapiens
VDLNLLIGP

SEQ ID NO: 855032 - protein, 9 aa, Homo Sapiens
LERLECIAH

SEQ ID NO: 855033 - protein, 9 aa, Homo Sapiens
FYSFLAPWL

SEQ ID NO: 855034 - protein, 9 aa, Homo Sapiens
KETNILNMT

SEQ ID NO: 855035 - protein, 9 aa, Homo Sapiens
DHNRFKNID

SEQ ID NO: 855036 - protein, 9 aa, Homo Sapiens
TPNNYLSKE

SEQ ID NO: 855037 - protein, 9 aa, Homo Sapiens
QQLHKNQQL

SEQ ID NO: 855038 - protein, 9 aa, Homo Sapiens
VWSRTAYLF

SEQ ID NO: 855039 - protein, 9 aa, Homo Sapiens
SKSVQTPVP

SEQ ID NO: 855040 - protein, 9 aa, Homo Sapiens
AWLLFLFMV

SEQ ID NO: 855041 - protein, 9 aa, Homo Sapiens
IYLIQHQKL

SEQ ID NO: 855042 - protein, 9 aa, Homo Sapiens
SFQNHERTH

SEQ ID NO: 855043 - protein, 9 aa, Homo Sapiens
INVDSNSAY

SEQ ID NO: 855044 - protein, 9 aa, Homo Sapiens
TLLHNLLFG

SEQ ID NO: 855045 - protein, 9 aa, Homo Sapiens
LPHQPGGKV

SEQ ID NO: 855046 - protein, 9 aa, Homo Sapiens
MTQVIHSIK

SEQ ID NO: 855047 - protein, 9 aa, Homo Sapiens
GHTSTVHCM

SEQ ID NO: 855048 - protein, 9 aa, Homo Sapiens
LHRARMHIQ

SEQ ID NO: 855049 - protein, 9 aa, Homo Sapiens
GDKPYKCTE

SEQ ID NO: 855050 - protein, 9 aa, Homo Sapiens
KTDTNRIAR

SEQ ID NO: 855051 - protein, 9 aa, Homo Sapiens
SAGCVGEII

SEQ ID NO: 855052 - protein, 9 aa, Homo Sapiens
EIHRFSYQE

SEQ ID NO: 855053 - protein, 9 aa, Homo Sapiens
HTTATGEIE

SEQ ID NO: 855054 - protein, 9 aa, Homo Sapiens
KEKNVAGGV

SEQ ID NO: 855055 - protein, 9 aa, Homo Sapiens
LTDDNINPP

SEQ ID NO: 855056 - protein, 9 aa, Homo Sapiens
NRRHDIQNQ

SEQ ID NO: 855057 - protein, 9 aa, Homo Sapiens
APSDKGATW

SEQ ID NO: 855058 - protein, 9 aa, Homo Sapiens
NKKSKPILC

SEQ ID NO: 855059 - protein, 9 aa, Homo Sapiens
WDTAETNVS

SEQ ID NO: 855060 - protein, 9 aa, Homo Sapiens
KHKGDLEEP

SEQ ID NO: 855061 - protein, 9 aa, Homo Sapiens
HIKVVKFLI

SEQ ID NO: 855062 - protein, 9 aa, Homo Sapiens
WELLIYLSK

SEQ ID NO: 855063 - protein, 9 aa, Homo Sapiens
PRGKTGSGG

SEQ ID NO: 855064 - protein, 9 aa, Homo Sapiens
NLQNKDKNK

SEQ ID NO: 855065 - protein, 9 aa, Homo Sapiens
MTAEIDSTF

SEQ ID NO: 855066 - protein, 9 aa, Homo Sapiens
ICFINMAGN

SEQ ID NO: 855067 - protein, 9 aa, Homo Sapiens
FSLLNNLIY

SEQ ID NO: 855068 - protein, 9 aa, Homo Sapiens
LAPPYAAVN

SEQ ID NO: 855069 - protein, 9 aa, Homo Sapiens
ADRDNQSIL

SEQ ID NO: 855070 - protein, 9 aa, Homo Sapiens
VNRRFHCPI

SEQ ID NO: 855071 - protein, 9 aa, Homo Sapiens
ARTYIFNSL

SEQ ID NO: 855072 - protein, 9 aa, Homo Sapiens
EDDNPLLRS

SEQ ID NO: 855073 - protein, 9 aa, Homo Sapiens
IIDDNMLVI

SEQ ID NO: 855074 - protein, 9 aa, Homo Sapiens
SLTLSILLT

SEQ ID NO: 855075 - protein, 9 aa, Homo Sapiens
MLLNLGVIF

SEQ ID NO: 855076 - protein, 9 aa, Homo Sapiens
VAKLTLDNF

SEQ ID NO: 855077 - protein, 9 aa, Homo Sapiens
KEIINVDHI

SEQ ID NO: 855078 - protein, 9 aa, Homo Sapiens
RQESKEGAC

SEQ ID NO: 855079 - protein, 9 aa, Homo Sapiens
NSEENFPNG

SEQ ID NO: 855080 - protein, 9 aa, Homo Sapiens
LSQEEHTSK

SEQ ID NO: 855081 - protein, 9 aa, Homo Sapiens
FSIRKDLIQ

SEQ ID NO: 855082 - protein, 9 aa, Homo Sapiens
VSTGNKTIT

SEQ ID NO: 855083 - protein, 9 aa, Homo Sapiens
SVLQDYCNA

SEQ ID NO: 855084 - protein, 9 aa, Homo Sapiens
GMTASAVVA

SEQ ID NO: 855085 - protein, 9 aa, Homo Sapiens
DGSPNQARA

SEQ ID NO: 855086 - protein, 9 aa, Homo Sapiens
KINVDSNSA

SEQ ID NO: 855087 - protein, 9 aa, Homo Sapiens
EDNDEQGNY

SEQ ID NO: 855088 - protein, 9 aa, Homo Sapiens
QPEIMDGPN

SEQ ID NO: 855089 - protein, 9 aa, Homo Sapiens
LKERMAQHF

SEQ ID NO: 855090 - protein, 9 aa, Homo Sapiens
WRFPAFGHN

SEQ ID NO: 855091 - protein, 9 aa, Homo Sapiens
AILLCVYEQ

SEQ ID NO: 855092 - protein, 9 aa, Homo Sapiens
NNTFQSFLG

SEQ ID NO: 855093 - protein, 9 aa, Homo Sapiens
MYSFRNKDV

SEQ ID NO: 855094 - protein, 9 aa, Homo Sapiens
HSGVEGPHS

SEQ ID NO: 855095 - protein, 9 aa, Homo Sapiens
LIRVHSSPA

SEQ ID NO: 855096 - protein, 9 aa, Homo Sapiens
EPGHSGVEG

SEQ ID NO: 855097 - protein, 9 aa, Homo Sapiens
GVHRLEHHA

SEQ ID NO: 855098 - protein, 9 aa, Homo Sapiens
PPMEPNHPF

SEQ ID NO: 855099 - protein, 9 aa, Homo Sapiens
TYTCEMSNT

SEQ ID NO: 855100 - protein, 9 aa, Homo Sapiens
TLTFMYLQP

SEQ ID NO: 855101 - protein, 9 aa, Homo Sapiens
DCKVIRCQV

SEQ ID NO: 855102 - protein, 9 aa, Homo Sapiens
DPNCEKMLD

SEQ ID NO: 855103 - protein, 9 aa, Homo Sapiens
WPDSQNPDP

SEQ ID NO: 855104 - protein, 9 aa, Homo Sapiens
NIIQASLAL

SEQ ID NO: 855105 - protein, 9 aa, Homo Sapiens
RDQLKTEPF

SEQ ID NO: 855106 - protein, 9 aa, Homo Sapiens
KHNPLPLLP

SEQ ID NO: 855107 - protein, 9 aa, Homo Sapiens
VDTCGQNTE

SEQ ID NO: 855108 - protein, 9 aa, Homo Sapiens
ILKEMRHVN

SEQ ID NO: 855109 - protein, 9 aa, Homo Sapiens
AEPQGQPQE

SEQ ID NO: 855110 - protein, 9 aa, Homo Sapiens
WDSHAHRLI

SEQ ID NO: 855111 - protein, 9 aa, Homo Sapiens
NVASRIDST

SEQ ID NO: 855112 - protein, 9 aa, Homo Sapiens
ITFHSILSI

SEQ ID NO: 855113 - protein, 9 aa, Homo Sapiens
SKIICRYQE

SEQ ID NO: 855114 - protein, 9 aa, Homo Sapiens
ARWAKLEER

SEQ ID NO: 855115 - protein, 9 aa, Homo Sapiens
MELSCSKAP

SEQ ID NO: 855116 - protein, 9 aa, Homo Sapiens
ATRGLNPTD

SEQ ID NO: 855117 - protein, 9 aa, Homo Sapiens
SVLTEHKRL

SEQ ID NO: 855118 - protein, 9 aa, Homo Sapiens
SDLNNLFFS

SEQ ID NO: 855119 - protein, 9 aa, Homo Sapiens
RTINPDVDH

SEQ ID NO: 855120 - protein, 9 aa, Homo Sapiens
TTHKNPNAG

SEQ ID NO: 855121 - protein, 9 aa, Homo Sapiens
DCWGIRCLH

SEQ ID NO: 855122 - protein, 9 aa, Homo Sapiens
VCLKYAYEE

SEQ ID NO: 855123 - protein, 9 aa, Homo Sapiens
NGRRGRGCP

SEQ ID NO: 855124 - protein, 9 aa, Homo Sapiens
AKTACDEAI

SEQ ID NO: 855125 - protein, 9 aa, Homo Sapiens
FPLLITALA

SEQ ID NO: 855126 - protein, 9 aa, Homo Sapiens
QQTYDYAKN

SEQ ID NO: 855127 - protein, 9 aa, Homo Sapiens
AVRTTGVLS

SEQ ID NO: 855128 - protein, 9 aa, Homo Sapiens
IDNVTLADS

SEQ ID NO: 855129 - protein, 9 aa, Homo Sapiens
FTWGNNSHG

SEQ ID NO: 855130 - protein, 9 aa, Homo Sapiens
KETFDAMNN

SEQ ID NO: 855131 - protein, 9 aa, Homo Sapiens
LPDKDGHGN

SEQ ID NO: 855132 - protein, 9 aa, Homo Sapiens
KHSKRFLLV

SEQ ID NO: 855133 - protein, 9 aa, Homo Sapiens
EGQKTMYLQ

SEQ ID NO: 855134 - protein, 9 aa, Homo Sapiens
TILSFYRFS

SEQ ID NO: 855135 - protein, 9 aa, Homo Sapiens
VHEGYTFMF

SEQ ID NO: 855136 - protein, 9 aa, Homo Sapiens
GGRKFDLHL

SEQ ID NO: 855137 - protein, 9 aa, Homo Sapiens
SGMGNFNSI

SEQ ID NO: 855138 - protein, 9 aa, Homo Sapiens
KGRTENRRE

SEQ ID NO: 855139 - protein, 9 aa, Homo Sapiens
WGENHLCVG

SEQ ID NO: 855140 - protein, 9 aa, Homo Sapiens
VPPTEYFLP

SEQ ID NO: 855141 - protein, 9 aa, Homo Sapiens
NGPSGSTGF

SEQ ID NO: 855142 - protein, 9 aa, Homo Sapiens
FSLASVVFL

SEQ ID NO: 855143 - protein, 9 aa, Homo Sapiens
LLALCTLVA

SEQ ID NO: 855144 - protein, 9 aa, Homo Sapiens
CLFNEDSLL

SEQ ID NO: 855145 - protein, 9 aa, Homo Sapiens
EIGSKYSEQ

SEQ ID NO: 855146 - protein, 9 aa, Homo Sapiens
EIPTPSNKL

SEQ ID NO: 855147 - protein, 9 aa, Homo Sapiens
YRFSRDDII

SEQ ID NO: 855148 - protein, 9 aa, Homo Sapiens
KDLQTLLNE

SEQ ID NO: 855149 - protein, 9 aa, Homo Sapiens
RLTAAEERD

SEQ ID NO: 855150 - protein, 9 aa, Homo Sapiens
DSKNNFQNI

SEQ ID NO: 855151 - protein, 9 aa, Homo Sapiens
ELDRPDIKV

SEQ ID NO: 855152 - protein, 9 aa, Homo Sapiens
VILSVLFTP

SEQ ID NO: 855153 - protein, 9 aa, Homo Sapiens
HGSLLFSTS

SEQ ID NO: 855154 - protein, 9 aa, Homo Sapiens
TLHQTIYNQ

SEQ ID NO: 855155 - protein, 9 aa, Homo Sapiens
TNDGDDDED

SEQ ID NO: 855156 - protein, 9 aa, Homo Sapiens
IDKMAETTE

SEQ ID NO: 855157 - protein, 9 aa, Homo Sapiens
TEEQLHPKL

SEQ ID NO: 855158 - protein, 9 aa, Homo Sapiens
PLDWSKTEE

SEQ ID NO: 855159 - protein, 9 aa, Homo Sapiens
KSLEAPIKL

SEQ ID NO: 855160 - protein, 9 aa, Homo Sapiens
STGDCGNGG

SEQ ID NO: 855161 - protein, 9 aa, Homo Sapiens
ECPDPVGEE

SEQ ID NO: 855162 - protein, 9 aa, Homo Sapiens
LDSEHVYDL

SEQ ID NO: 855163 - protein, 9 aa, Homo Sapiens
FIVRKNLSP

SEQ ID NO: 855164 - protein, 9 aa, Homo Sapiens
ASTGTNTNK

SEQ ID NO: 855165 - protein, 9 aa, Homo Sapiens
MFFQNISLG

SEQ ID NO: 855166 - protein, 9 aa, Homo Sapiens
FIILWWNIF

SEQ ID NO: 855167 - protein, 9 aa, Homo Sapiens
YKAPAPVTY

SEQ ID NO: 855168 - protein, 9 aa, Homo Sapiens
SVRCSHFPA

SEQ ID NO: 855169 - protein, 9 aa, Homo Sapiens
KYEFFWGSR

SEQ ID NO: 855170 - protein, 9 aa, Homo Sapiens
MIRANCLAQ

SEQ ID NO: 855171 - protein, 9 aa, Homo Sapiens
IHKEEEEIL

SEQ ID NO: 855172 - protein, 9 aa, Homo Sapiens
EVAYEMVKY

SEQ ID NO: 855173 - protein, 9 aa, Homo Sapiens
LLIDKFCDP

SEQ ID NO: 855174 - protein, 9 aa, Homo Sapiens
KIVDLNLLI

SEQ ID NO: 855175 - protein, 9 aa, Homo Sapiens
KSVLVYHNG

SEQ ID NO: 855176 - protein, 9 aa, Homo Sapiens
ELMESEEVY

SEQ ID NO: 855177 - protein, 9 aa, Homo Sapiens
VANVDMSRD

SEQ ID NO: 855178 - protein, 9 aa, Homo Sapiens
TKMPCKSSP

SEQ ID NO: 855179 - protein, 9 aa, Homo Sapiens
ILKNASDLL

SEQ ID NO: 855180 - protein, 9 aa, Homo Sapiens
MLPYTFPHP

SEQ ID NO: 855181 - protein, 9 aa, Homo Sapiens
DSLRRENNL

SEQ ID NO: 855182 - protein, 9 aa, Homo Sapiens
DCRTSFRQR

SEQ ID NO: 855183 - protein, 9 aa, Homo Sapiens
QRLIEQSNL

SEQ ID NO: 855184 - protein, 9 aa, Homo Sapiens
LTGYNYYIK

SEQ ID NO: 855185 - protein, 9 aa, Homo Sapiens
SKKEHNVTV

SEQ ID NO: 855186 - protein, 9 aa, Homo Sapiens
KRSQTQEAK

SEQ ID NO: 855187 - protein, 9 aa, Homo Sapiens
TVGIPLFFD

SEQ ID NO: 855188 - protein, 9 aa, Homo Sapiens
WRIQKGVDL

SEQ ID NO: 855189 - protein, 9 aa, Homo Sapiens
APAEYSSFR

SEQ ID NO: 855190 - protein, 9 aa, Homo Sapiens
PKLRKDSAV

SEQ ID NO: 855191 - protein, 9 aa, Homo Sapiens
LSSKIKQIS

SEQ ID NO: 855192 - protein, 9 aa, Homo Sapiens
LNGPSGSTG

SEQ ID NO: 855193 - protein, 9 aa, Homo Sapiens
YFSLSNLSL

SEQ ID NO: 855194 - protein, 9 aa, Homo Sapiens
SVLPNDLFS

SEQ ID NO: 855195 - protein, 9 aa, Homo Sapiens
KSAKEELIN

SEQ ID NO: 855196 - protein, 9 aa, Homo Sapiens
KHCTDQIYF

SEQ ID NO: 855197 - protein, 9 aa, Homo Sapiens
PGHGVPDTT

SEQ ID NO: 855198 - protein, 9 aa, Homo Sapiens
EFKDLIGQI

SEQ ID NO: 855199 - protein, 9 aa, Homo Sapiens
YYVGSQFSV

SEQ ID NO: 855200 - protein, 9 aa, Homo Sapiens
YDIINGDGT

SEQ ID NO: 855201 - protein, 9 aa, Homo Sapiens
VEENLKLLQ

SEQ ID NO: 855202 - protein, 9 aa, Homo Sapiens
QIATIAESE

SEQ ID NO: 855203 - protein, 9 aa, Homo Sapiens
HWEDFNVFT

SEQ ID NO: 855204 - protein, 9 aa, Homo Sapiens
SVFRNGLSG

SEQ ID NO: 855205 - protein, 9 aa, Homo Sapiens
SSMTRSPLR

SEQ ID NO: 855206 - protein, 9 aa, Homo Sapiens
PMYRVLSPL

SEQ ID NO: 855207 - protein, 9 aa, Homo Sapiens
VQPVLNEHT

SEQ ID NO: 855208 - protein, 9 aa, Homo Sapiens
AKLQANHEK

SEQ ID NO: 855209 - protein, 9 aa, Homo Sapiens
LIREEKNSS

SEQ ID NO: 855210 - protein, 9 aa, Homo Sapiens
CLDNSARFQ

SEQ ID NO: 855211 - protein, 9 aa, Homo Sapiens
RTLADVLHT

SEQ ID NO: 855212 - protein, 9 aa, Homo Sapiens
NKRLKQLSV

SEQ ID NO: 855213 - protein, 9 aa, Homo Sapiens
WPGITCLIQ

SEQ ID NO: 855214 - protein, 9 aa, Homo Sapiens
FIPVTLSSS

SEQ ID NO: 855215 - protein, 9 aa, Homo Sapiens
IPFSLANKV

SEQ ID NO: 855216 - protein, 9 aa, Homo Sapiens
SDMKGWPSG

SEQ ID NO: 855217 - protein, 9 aa, Homo Sapiens
TVRNSGEIV

SEQ ID NO: 855218 - protein, 9 aa, Homo Sapiens
LDFSLPDIQ

SEQ ID NO: 855219 - protein, 9 aa, Homo Sapiens
TLRYFCGRC

SEQ ID NO: 855220 - protein, 9 aa, Homo Sapiens
FNTAIEMNI

SEQ ID NO: 855221 - protein, 9 aa, Homo Sapiens
GPVMCKVIG

SEQ ID NO: 855222 - protein, 9 aa, Homo Sapiens
LQTSINTAI

SEQ ID NO: 855223 - protein, 9 aa, Homo Sapiens
TSPLINMFN

SEQ ID NO: 855224 - protein, 9 aa, Homo Sapiens
NGLWCSAIP

SEQ ID NO: 855225 - protein, 9 aa, Homo Sapiens
DKVTLLVDG

SEQ ID NO: 855226 - protein, 9 aa, Homo Sapiens
WLQTTLLDV

SEQ ID NO: 855227 - protein, 9 aa, Homo Sapiens
HKKKGKVKP

SEQ ID NO: 855228 - protein, 9 aa, Homo Sapiens
ILQCTHGVG

SEQ ID NO: 855229 - protein, 9 aa, Homo Sapiens
LITIHNRKE

SEQ ID NO: 855230 - protein, 9 aa, Homo Sapiens
CDLLFLLQQ

SEQ ID NO: 855231 - protein, 9 aa, Homo Sapiens
ADWFYYSIS

SEQ ID NO: 855232 - protein, 9 aa, Homo Sapiens
IFSKKGYLH

SEQ ID NO: 855233 - protein, 9 aa, Homo Sapiens
VAAPFISGV

SEQ ID NO: 855234 - protein, 9 aa, Homo Sapiens
TECPHKGRN

SEQ ID NO: 855235 - protein, 9 aa, Homo Sapiens
EASGKTSVK

SEQ ID NO: 855236 - protein, 9 aa, Homo Sapiens
DFCDSHKKY

SEQ ID NO: 855237 - protein, 9 aa, Homo Sapiens
NQNENVVPN

SEQ ID NO: 855238 - protein, 9 aa, Homo Sapiens
VNSSSSPII

SEQ ID NO: 855239 - protein, 9 aa, Homo Sapiens
LDQGNQKDS

SEQ ID NO: 855240 - protein, 9 aa, Homo Sapiens
YRHFVGEIF

SEQ ID NO: 855241 - protein, 9 aa, Homo Sapiens
EDFEPFVEN

SEQ ID NO: 855242 - protein, 9 aa, Homo Sapiens
ALLDIAHAF

SEQ ID NO: 855243 - protein, 9 aa, Homo Sapiens
AHMMPNILL

SEQ ID NO: 855244 - protein, 9 aa, Homo Sapiens
RLSIHQIKR

SEQ ID NO: 855245 - protein, 9 aa, Homo Sapiens
KLPQSPSFP

SEQ ID NO: 855246 - protein, 9 aa, Homo Sapiens
AYFNESQRQ

SEQ ID NO: 855247 - protein, 9 aa, Homo Sapiens
NPLREPFAN

SEQ ID NO: 855248 - protein, 9 aa, Homo Sapiens
LYYECMVQL

SEQ ID NO: 855249 - protein, 9 aa, Homo Sapiens
RCLRDPDWL

SEQ ID NO: 855250 - protein, 9 aa, Homo Sapiens
NSRKLFLGV

SEQ ID NO: 855251 - protein, 9 aa, Homo Sapiens
IDDIRKEVN

SEQ ID NO: 855252 - protein, 9 aa, Homo Sapiens
RTDKEMEKS

SEQ ID NO: 855253 - protein, 9 aa, Homo Sapiens
ERADAETLW

SEQ ID NO: 855254 - protein, 9 aa, Homo Sapiens
NYSLFTSFF

SEQ ID NO: 855255 - protein, 9 aa, Homo Sapiens
SLAVLNGEV

SEQ ID NO: 855256 - protein, 9 aa, Homo Sapiens
ARRIKTELL

SEQ ID NO: 855257 - protein, 9 aa, Homo Sapiens
RESFQILKQ

SEQ ID NO: 855258 - protein, 9 aa, Homo Sapiens
MAGGKLRFR

SEQ ID NO: 855259 - protein, 9 aa, Homo Sapiens
PERYELCKQ

SEQ ID NO: 855260 - protein, 9 aa, Homo Sapiens
GLKNMKGLS

SEQ ID NO: 855261 - protein, 9 aa, Homo Sapiens
TVASYFRYY

SEQ ID NO: 855262 - protein, 9 aa, Homo Sapiens
TFRSSYWRV

SEQ ID NO: 855263 - protein, 9 aa, Homo Sapiens
QLPYKLAIN

SEQ ID NO: 855264 - protein, 9 aa, Homo Sapiens
KGLKSALDA

SEQ ID NO: 855265 - protein, 9 aa, Homo Sapiens
FAFKDLQRD

SEQ ID NO: 855266 - protein, 9 aa, Homo Sapiens
MHEGNISKQ

SEQ ID NO: 855267 - protein, 9 aa, Homo Sapiens
TAQFNMFAS

SEQ ID NO: 855268 - protein, 9 aa, Homo Sapiens
KAFRVFVVV

SEQ ID NO: 855269 - protein, 9 aa, Homo Sapiens
LLPDEQKEV

SEQ ID NO: 855270 - protein, 9 aa, Homo Sapiens
RICRPCEIK

SEQ ID NO: 855271 - protein, 9 aa, Homo Sapiens
NCPGQYTIS

SEQ ID NO: 855272 - protein, 9 aa, Homo Sapiens
SSATLLNYP

SEQ ID NO: 855273 - protein, 9 aa, Homo Sapiens
FLSEGSTLA

SEQ ID NO: 855274 - protein, 9 aa, Homo Sapiens
DVNDMYLPL

SEQ ID NO: 855275 - protein, 9 aa, Homo Sapiens
NYEHVTVPP

SEQ ID NO: 855276 - protein, 9 aa, Homo Sapiens
KDAEEDGDT

SEQ ID NO: 855277 - protein, 9 aa, Homo Sapiens
EERRVASVL

SEQ ID NO: 855278 - protein, 9 aa, Homo Sapiens
GEALIHLDD

SEQ ID NO: 855279 - protein, 9 aa, Homo Sapiens
DECRLYYEG

SEQ ID NO: 855280 - protein, 9 aa, Homo Sapiens
NMISLKPVL

SEQ ID NO: 855281 - protein, 9 aa, Homo Sapiens
TGLKVDWRR

SEQ ID NO: 855282 - protein, 9 aa, Homo Sapiens
KPHRTEHQR

SEQ ID NO: 855283 - protein, 9 aa, Homo Sapiens
IKLCPALKI

SEQ ID NO: 855284 - protein, 9 aa, Homo Sapiens
GRLKTVQGI

SEQ ID NO: 855285 - protein, 9 aa, Homo Sapiens
NRNNVTGFI

SEQ ID NO: 855286 - protein, 9 aa, Homo Sapiens
SSSSTSQNH

SEQ ID NO: 855287 - protein, 9 aa, Homo Sapiens
GPFSGGEKQ

SEQ ID NO: 855288 - protein, 9 aa, Homo Sapiens
SSKPNNLRE

SEQ ID NO: 855289 - protein, 9 aa, Homo Sapiens
KLGDPRLQT

SEQ ID NO: 855290 - protein, 9 aa, Homo Sapiens
PIPANTLNP

SEQ ID NO: 855291 - protein, 9 aa, Homo Sapiens
LSDHPHMKI

SEQ ID NO: 855292 - protein, 9 aa, Homo Sapiens
SKRMLVGGV

SEQ ID NO: 855293 - protein, 9 aa, Homo Sapiens
MIKVLIIVF

SEQ ID NO: 855294 - protein, 9 aa, Homo Sapiens
SRTPGNIIV

SEQ ID NO: 855295 - protein, 9 aa, Homo Sapiens
FDANNMMAA

SEQ ID NO: 855296 - protein, 9 aa, Homo Sapiens
HCCPIFSSQ

SEQ ID NO: 855297 - protein, 9 aa, Homo Sapiens
VASVRSGGS

SEQ ID NO: 855298 - protein, 9 aa, Homo Sapiens
IKVQGPPML

SEQ ID NO: 855299 - protein, 9 aa, Homo Sapiens
NEQSINLLT

SEQ ID NO: 855300 - protein, 9 aa, Homo Sapiens
DKVFVASVR

SEQ ID NO: 855301 - protein, 9 aa, Homo Sapiens
HSQKKNVFM

SEQ ID NO: 855302 - protein, 9 aa, Homo Sapiens
LPSYSGPSK

SEQ ID NO: 855303 - protein, 9 aa, Homo Sapiens
ILEEPNLGK

SEQ ID NO: 855304 - protein, 9 aa, Homo Sapiens
NLFKKAAAA

SEQ ID NO: 855305 - protein, 9 aa, Homo Sapiens
LALHDQAPQ

SEQ ID NO: 855306 - protein, 9 aa, Homo Sapiens
CSEEINNYI

SEQ ID NO: 855307 - protein, 9 aa, Homo Sapiens
LDGQLKHED

SEQ ID NO: 855308 - protein, 9 aa, Homo Sapiens
EIPIPITLN

SEQ ID NO: 855309 - protein, 9 aa, Homo Sapiens
RISHMWQSA

SEQ ID NO: 855310 - protein, 9 aa, Homo Sapiens
GMGKFSSVT

SEQ ID NO: 855311 - protein, 9 aa, Homo Sapiens
LAAAPVVPA

SEQ ID NO: 855312 - protein, 9 aa, Homo Sapiens
IGGSQGDAG

SEQ ID NO: 855313 - protein, 9 aa, Homo Sapiens
FTHLIMTCK

SEQ ID NO: 855314 - protein, 9 aa, Homo Sapiens
PDKMGGAGT

SEQ ID NO: 855315 - protein, 9 aa, Homo Sapiens
EDGGVYSYS

SEQ ID NO: 855316 - protein, 9 aa, Homo Sapiens
PHLLVSESS

SEQ ID NO: 855317 - protein, 9 aa, Homo Sapiens
WQKLSDGGT

SEQ ID NO: 855318 - protein, 9 aa, Homo Sapiens
LELNIKDLL

SEQ ID NO: 855319 - protein, 9 aa, Homo Sapiens
YTSPSELAK

SEQ ID NO: 855320 - protein, 9 aa, Homo Sapiens
GEGLWAWGV

SEQ ID NO: 855321 - protein, 9 aa, Homo Sapiens
KVRYAMGAK

SEQ ID NO: 855322 - protein, 9 aa, Homo Sapiens
IDSSRKNEQ

SEQ ID NO: 855323 - protein, 9 aa, Homo Sapiens
DGQFFTWGN

SEQ ID NO: 855324 - protein, 9 aa, Homo Sapiens
ELFKQNFEY

SEQ ID NO: 855325 - protein, 9 aa, Homo Sapiens
GHNALKGPN

SEQ ID NO: 855326 - protein, 9 aa, Homo Sapiens
RKQNVLRSE

SEQ ID NO: 855327 - protein, 9 aa, Homo Sapiens
NRLILKRAS

SEQ ID NO: 855328 - protein, 9 aa, Homo Sapiens
YTMAPVANI

SEQ ID NO: 855329 - protein, 9 aa, Homo Sapiens
TKVAKACSC

SEQ ID NO: 855330 - protein, 9 aa, Homo Sapiens
VALNTAYTY

SEQ ID NO: 855331 - protein, 9 aa, Homo Sapiens
VCNAMRAVM

SEQ ID NO: 855332 - protein, 9 aa, Homo Sapiens
GPACWDLTL

SEQ ID NO: 855333 - protein, 9 aa, Homo Sapiens
DEGHRLNNS

SEQ ID NO: 855334 - protein, 9 aa, Homo Sapiens
IPYFRDKEL

SEQ ID NO: 855335 - protein, 9 aa, Homo Sapiens
TTAFPFLQL

SEQ ID NO: 855336 - protein, 9 aa, Homo Sapiens
DFGLARTAS

SEQ ID NO: 855337 - protein, 9 aa, Homo Sapiens
KNRKKLKKK

SEQ ID NO: 855338 - protein, 9 aa, Homo Sapiens
SGRNPVMEL

SEQ ID NO: 855339 - protein, 9 aa, Homo Sapiens
DQSGIDING

SEQ ID NO: 855340 - protein, 9 aa, Homo Sapiens
LLKHHRLHT

SEQ ID NO: 855341 - protein, 9 aa, Homo Sapiens
QIVHQPWIL

SEQ ID NO: 855342 - protein, 9 aa, Homo Sapiens
LLSHPKEKM

SEQ ID NO: 855343 - protein, 9 aa, Homo Sapiens
DSLTEHSCS

SEQ ID NO: 855344 - protein, 9 aa, Homo Sapiens
FGGSGQTFG

SEQ ID NO: 855345 - protein, 9 aa, Homo Sapiens
QNEIFDEDY

SEQ ID NO: 855346 - protein, 9 aa, Homo Sapiens
VGAASFGVC

SEQ ID NO: 855347 - protein, 9 aa, Homo Sapiens
LEWTHHNMK

SEQ ID NO: 855348 - protein, 9 aa, Homo Sapiens
NATTNGHDF

SEQ ID NO: 855349 - protein, 9 aa, Homo Sapiens
MEESIQRIE

SEQ ID NO: 855350 - protein, 9 aa, Homo Sapiens
GSLHPMKQP

SEQ ID NO: 855351 - protein, 9 aa, Homo Sapiens
GETCEFNIT

SEQ ID NO: 855352 - protein, 9 aa, Homo Sapiens
TVSRLAHRT

SEQ ID NO: 855353 - protein, 9 aa, Homo Sapiens
IAYNACVIQ

SEQ ID NO: 855354 - protein, 9 aa, Homo Sapiens
AQQCAKHNS

SEQ ID NO: 855355 - protein, 9 aa, Homo Sapiens
KAQNDEYEN

SEQ ID NO: 855356 - protein, 9 aa, Homo Sapiens
KRMAAHITM

SEQ ID NO: 855357 - protein, 9 aa, Homo Sapiens
ELRELENKL

SEQ ID NO: 855358 - protein, 9 aa, Homo Sapiens
KDFVSLYQY

SEQ ID NO: 855359 - protein, 9 aa, Homo Sapiens
PIDRRLGHH

SEQ ID NO: 855360 - protein, 9 aa, Homo Sapiens
SNLANNFVL

SEQ ID NO: 855361 - protein, 9 aa, Homo Sapiens
LPGPQGSAG

SEQ ID NO: 855362 - protein, 9 aa, Homo Sapiens
AIISVPPQP

SEQ ID NO: 855363 - protein, 9 aa, Homo Sapiens
NSVLTDEEL

SEQ ID NO: 855364 - protein, 9 aa, Homo Sapiens
PSQCHPDAF

SEQ ID NO: 855365 - protein, 9 aa, Homo Sapiens
AMPQLFMEQ

SEQ ID NO: 855366 - protein, 9 aa, Homo Sapiens
EAFNCRIYL

SEQ ID NO: 855367 - protein, 9 aa, Homo Sapiens
LQGRLGWVR

SEQ ID NO: 855368 - protein, 9 aa, Homo Sapiens
ASSRIRRKS

SEQ ID NO: 855369 - protein, 9 aa, Homo Sapiens
VTNSSFQVA

SEQ ID NO: 855370 - protein, 9 aa, Homo Sapiens
LQTLQEQLN

SEQ ID NO: 855371 - protein, 9 aa, Homo Sapiens
HQAKYFGNY

SEQ ID NO: 855372 - protein, 9 aa, Homo Sapiens
VRKERRRHK

SEQ ID NO: 855373 - protein, 9 aa, Homo Sapiens
TYWEYTFKV

SEQ ID NO: 855374 - protein, 9 aa, Homo Sapiens
LPLAPQVKN

SEQ ID NO: 855375 - protein, 9 aa, Homo Sapiens
LLREKYFFP

SEQ ID NO: 855376 - protein, 9 aa, Homo Sapiens
ADSKGVDTV

SEQ ID NO: 855377 - protein, 9 aa, Homo Sapiens
EFVKIIFSV

SEQ ID NO: 855378 - protein, 9 aa, Homo Sapiens
NNTTVKGVT

SEQ ID NO: 855379 - protein, 9 aa, Homo Sapiens
DIDRGRQLF

SEQ ID NO: 855380 - protein, 9 aa, Homo Sapiens
AVDQDNTEN

SEQ ID NO: 855381 - protein, 9 aa, Homo Sapiens
DPEPDRKKL

SEQ ID NO: 855382 - protein, 9 aa, Homo Sapiens
ELLGTFILI

SEQ ID NO: 855383 - protein, 9 aa, Homo Sapiens
LPAFLCLGG

SEQ ID NO: 855384 - protein, 9 aa, Homo Sapiens
SLIQHKIIH

SEQ ID NO: 855385 - protein, 9 aa, Homo Sapiens
NEDNKRWET

SEQ ID NO: 855386 - protein, 9 aa, Homo Sapiens
RCPAHAGAV

SEQ ID NO: 855387 - protein, 9 aa, Homo Sapiens
VHELRVKCS

SEQ ID NO: 855388 - protein, 9 aa, Homo Sapiens
RTHNSWTQD

SEQ ID NO: 855389 - protein, 9 aa, Homo Sapiens
TIFYGTLSW

SEQ ID NO: 855390 - protein, 9 aa, Homo Sapiens
EPSGLHEKC

SEQ ID NO: 855391 - protein, 9 aa, Homo Sapiens
HIESQQCEP

SEQ ID NO: 855392 - protein, 9 aa, Homo Sapiens
LSCSARNCK

SEQ ID NO: 855393 - protein, 9 aa, Homo Sapiens
DRDKLVIFL

SEQ ID NO: 855394 - protein, 9 aa, Homo Sapiens
LVNILLYFP

SEQ ID NO: 855395 - protein, 9 aa, Homo Sapiens
CERIHFFRN

SEQ ID NO: 855396 - protein, 9 aa, Homo Sapiens
QHLLKLTCP

SEQ ID NO: 855397 - protein, 9 aa, Homo Sapiens
FKQFCITCQ

SEQ ID NO: 855398 - protein, 9 aa, Homo Sapiens
QALRESFQI

SEQ ID NO: 855399 - protein, 9 aa, Homo Sapiens
ASGRNPVME

SEQ ID NO: 855400 - protein, 9 aa, Homo Sapiens
NLYYAAVPS

SEQ ID NO: 855401 - protein, 9 aa, Homo Sapiens
ASGLPLGYM

SEQ ID NO: 855402 - protein, 9 aa, Homo Sapiens
IINKESLIN

SEQ ID NO: 855403 - protein, 9 aa, Homo Sapiens
NPETDSHVN

SEQ ID NO: 855404 - protein, 9 aa, Homo Sapiens
NLITRQIYG

SEQ ID NO: 855405 - protein, 9 aa, Homo Sapiens
QLKKEANKR

SEQ ID NO: 855406 - protein, 9 aa, Homo Sapiens
KLAIKAVLE

SEQ ID NO: 855407 - protein, 9 aa, Homo Sapiens
ENLKLLQLK

SEQ ID NO: 855408 - protein, 9 aa, Homo Sapiens
WSGQPPMDS

SEQ ID NO: 855409 - protein, 9 aa, Homo Sapiens
SYQRTFNEF

SEQ ID NO: 855410 - protein, 9 aa, Homo Sapiens
QVAMKQNKL

SEQ ID NO: 855411 - protein, 9 aa, Homo Sapiens
NQIRKIDQR

SEQ ID NO: 855412 - protein, 9 aa, Homo Sapiens
ITPPTNFKR

SEQ ID NO: 855413 - protein, 9 aa, Homo Sapiens
SNIQFSGMN

SEQ ID NO: 855414 - protein, 9 aa, Homo Sapiens
METKCFTCG

SEQ ID NO: 855415 - protein, 9 aa, Homo Sapiens
FHLVGVPED

SEQ ID NO: 855416 - protein, 9 aa, Homo Sapiens
PPLIPASQP

SEQ ID NO: 855417 - protein, 9 aa, Homo Sapiens
NTRSSSVYR

SEQ ID NO: 855418 - protein, 9 aa, Homo Sapiens
AWISQVLYS

SEQ ID NO: 855419 - protein, 9 aa, Homo Sapiens
FNNNPRHSS

SEQ ID NO: 855420 - protein, 9 aa, Homo Sapiens
QKLGADTVG

SEQ ID NO: 855421 - protein, 9 aa, Homo Sapiens
PVKKKPTLL

SEQ ID NO: 855422 - protein, 9 aa, Homo Sapiens
WEEREIMLK

SEQ ID NO: 855423 - protein, 9 aa, Homo Sapiens
SDFVQKYLG

SEQ ID NO: 855424 - protein, 9 aa, Homo Sapiens
RRIWKEPPV

SEQ ID NO: 855425 - protein, 9 aa, Homo Sapiens
SHKKYSKSS

SEQ ID NO: 855426 - protein, 9 aa, Homo Sapiens
IATRRFNEQ

SEQ ID NO: 855427 - protein, 9 aa, Homo Sapiens
KTMTKMPSA

SEQ ID NO: 855428 - protein, 9 aa, Homo Sapiens
ILLIETSIS

SEQ ID NO: 855429 - protein, 9 aa, Homo Sapiens
RHAVRVARQ

SEQ ID NO: 855430 - protein, 9 aa, Homo Sapiens
KDRRHHPKT

SEQ ID NO: 855431 - protein, 9 aa, Homo Sapiens
PYNKTISPF

SEQ ID NO: 855432 - protein, 9 aa, Homo Sapiens
PSVLESEDT

SEQ ID NO: 855433 - protein, 9 aa, Homo Sapiens
RICRISHHH

SEQ ID NO: 855434 - protein, 9 aa, Homo Sapiens
VVCCKGINI

SEQ ID NO: 855435 - protein, 9 aa, Homo Sapiens
GVFLSVCHL

SEQ ID NO: 855436 - protein, 9 aa, Homo Sapiens
IVCSSEAFQ

SEQ ID NO: 855437 - protein, 9 aa, Homo Sapiens
LALPLSTQV

SEQ ID NO: 855438 - protein, 9 aa, Homo Sapiens
GCRKAMTKF

SEQ ID NO: 855439 - protein, 9 aa, Homo Sapiens
TAFTALMEG

SEQ ID NO: 855440 - protein, 9 aa, Homo Sapiens
VELHFKLMR

SEQ ID NO: 855441 - protein, 9 aa, Homo Sapiens
KQRLSAARR

SEQ ID NO: 855442 - protein, 9 aa, Homo Sapiens
ERKLCRYLV

SEQ ID NO: 855443 - protein, 9 aa, Homo Sapiens
GATSQLLVN

SEQ ID NO: 855444 - protein, 9 aa, Homo Sapiens
AGRYRIISG

SEQ ID NO: 855445 - protein, 9 aa, Homo Sapiens
REEKLCKRE

SEQ ID NO: 855446 - protein, 9 aa, Homo Sapiens
ARWTLGSCP

SEQ ID NO: 855447 - protein, 9 aa, Homo Sapiens
KDPSLCMFF

SEQ ID NO: 855448 - protein, 9 aa, Homo Sapiens
EMLQEWQKV

SEQ ID NO: 855449 - protein, 9 aa, Homo Sapiens
LDHPGYLRS

SEQ ID NO: 855450 - protein, 9 aa, Homo Sapiens
NKCVLNFPA

SEQ ID NO: 855451 - protein, 9 aa, Homo Sapiens
KHPDCSING

SEQ ID NO: 855452 - protein, 9 aa, Homo Sapiens
KDALLNRAR

SEQ ID NO: 855453 - protein, 9 aa, Homo Sapiens
DSTTMYGLE

SEQ ID NO: 855454 - protein, 9 aa, Homo Sapiens
PGITDKAPE

SEQ ID NO: 855455 - protein, 9 aa, Homo Sapiens
RLFGSLSNA

SEQ ID NO: 855456 - protein, 9 aa, Homo Sapiens
NIILTDDNF

SEQ ID NO: 855457 - protein, 9 aa, Homo Sapiens
KKRTEAPEF

SEQ ID NO: 855458 - protein, 9 aa, Homo Sapiens
QRCTDHGSD

SEQ ID NO: 855459 - protein, 9 aa, Homo Sapiens
VVDYIVSTW

SEQ ID NO: 855460 - protein, 9 aa, Homo Sapiens
SKDLEKQIG

SEQ ID NO: 855461 - protein, 9 aa, Homo Sapiens
CVSELISFI

SEQ ID NO: 855462 - protein, 9 aa, Homo Sapiens
QYENDFLEA

SEQ ID NO: 855463 - protein, 9 aa, Homo Sapiens
TTASMSLMA

SEQ ID NO: 855464 - protein, 9 aa, Homo Sapiens
GMDFHTFYF

SEQ ID NO: 855465 - protein, 9 aa, Homo Sapiens
YSPGLQSCQ

SEQ ID NO: 855466 - protein, 9 aa, Homo Sapiens
NEERDGVQF

SEQ ID NO: 855467 - protein, 9 aa, Homo Sapiens
DTLNATLNN

SEQ ID NO: 855468 - protein, 9 aa, Homo Sapiens
EKKHRDRTA

SEQ ID NO: 855469 - protein, 9 aa, Homo Sapiens
ESQFNKLKI

SEQ ID NO: 855470 - protein, 9 aa, Homo Sapiens
SGMDKLQNA

SEQ ID NO: 855471 - protein, 9 aa, Homo Sapiens
YKNFNNFEI

SEQ ID NO: 855472 - protein, 9 aa, Homo Sapiens
IFHPILSYF

SEQ ID NO: 855473 - protein, 9 aa, Homo Sapiens
QPSFSQRGR

SEQ ID NO: 855474 - protein, 9 aa, Homo Sapiens
LRKDFGQKR

SEQ ID NO: 855475 - protein, 9 aa, Homo Sapiens
EREKQARIK

SEQ ID NO: 855476 - protein, 9 aa, Homo Sapiens
HNPSNFLKT

SEQ ID NO: 855477 - protein, 9 aa, Homo Sapiens
DTIHSTVRS

SEQ ID NO: 855478 - protein, 9 aa, Homo Sapiens
KQIIKSQER

SEQ ID NO: 855479 - protein, 9 aa, Homo Sapiens
VACEELPPG

SEQ ID NO: 855480 - protein, 9 aa, Homo Sapiens
DGKTTQEDH

SEQ ID NO: 855481 - protein, 9 aa, Homo Sapiens
VLTFIGINF

SEQ ID NO: 855482 - protein, 9 aa, Homo Sapiens
NQRKWKKIK

SEQ ID NO: 855483 - protein, 9 aa, Homo Sapiens
KCNDYFFNN

SEQ ID NO: 855484 - protein, 9 aa, Homo Sapiens
VASYFRYYL

SEQ ID NO: 855485 - protein, 9 aa, Homo Sapiens
KKPACQFEE

SEQ ID NO: 855486 - protein, 9 aa, Homo Sapiens
IEDTLCHFG

SEQ ID NO: 855487 - protein, 9 aa, Homo Sapiens
YPYRDLDFE

SEQ ID NO: 855488 - protein, 9 aa, Homo Sapiens
GVEVGWDLG

SEQ ID NO: 855489 - protein, 9 aa, Homo Sapiens
DVVSKIAQY

SEQ ID NO: 855490 - protein, 9 aa, Homo Sapiens
DFGSTKPSL

SEQ ID NO: 855491 - protein, 9 aa, Homo Sapiens
EQYSNVTEF

SEQ ID NO: 855492 - protein, 9 aa, Homo Sapiens
NQSHNPATT

SEQ ID NO: 855493 - protein, 9 aa, Homo Sapiens
YNDQLFGYM

SEQ ID NO: 855494 - protein, 9 aa, Homo Sapiens
LIERSSNFG

SEQ ID NO: 855495 - protein, 9 aa, Homo Sapiens
QRGELGFHG

SEQ ID NO: 855496 - protein, 9 aa, Homo Sapiens
HSWKINHSR

SEQ ID NO: 855497 - protein, 9 aa, Homo Sapiens
FYLNSALMG

SEQ ID NO: 855498 - protein, 9 aa, Homo Sapiens
STAPNSLLN

SEQ ID NO: 855499 - protein, 9 aa, Homo Sapiens
LQEAPAAQN

SEQ ID NO: 855500 - protein, 9 aa, Homo Sapiens
EELLVEVLE

SEQ ID NO: 855501 - protein, 9 aa, Homo Sapiens
FYITIIAVY

SEQ ID NO: 855502 - protein, 9 aa, Homo Sapiens
IRMIMKISN

SEQ ID NO: 855503 - protein, 9 aa, Homo Sapiens
ANEKDKRQQ

SEQ ID NO: 855504 - protein, 9 aa, Homo Sapiens
RISKVLQKL

SEQ ID NO: 855505 - protein, 9 aa, Homo Sapiens
RINHCGIAS

SEQ ID NO: 855506 - protein, 9 aa, Homo Sapiens
LFKLCGSGN

SEQ ID NO: 855507 - protein, 9 aa, Homo Sapiens
PLQAQSPAD

SEQ ID NO: 855508 - protein, 9 aa, Homo Sapiens
ATFWKEHKP

SEQ ID NO: 855509 - protein, 9 aa, Homo Sapiens
DASQPRTTT

SEQ ID NO: 855510 - protein, 9 aa, Homo Sapiens
KTSVEHISR

SEQ ID NO: 855511 - protein, 9 aa, Homo Sapiens
DAWDVDALF

SEQ ID NO: 855512 - protein, 9 aa, Homo Sapiens
GVQPVLNEH

SEQ ID NO: 855513 - protein, 9 aa, Homo Sapiens
KAVYHEQHL

SEQ ID NO: 855514 - protein, 9 aa, Homo Sapiens
RLRNLILDS

SEQ ID NO: 855515 - protein, 9 aa, Homo Sapiens
ESKNLCKAM

SEQ ID NO: 855516 - protein, 9 aa, Homo Sapiens
RGLFAATFS

SEQ ID NO: 855517 - protein, 9 aa, Homo Sapiens
ATAKFREQI

SEQ ID NO: 855518 - protein, 9 aa, Homo Sapiens
WNMEESYVN

SEQ ID NO: 855519 - protein, 9 aa, Homo Sapiens
NKFTQDQMG

SEQ ID NO: 855520 - protein, 9 aa, Homo Sapiens
INLDNNQIR

SEQ ID NO: 855521 - protein, 9 aa, Homo Sapiens
MKKKLSSYL

SEQ ID NO: 855522 - protein, 9 aa, Homo Sapiens
KLDILEQEY

SEQ ID NO: 855523 - protein, 9 aa, Homo Sapiens
GSSGGTRGC

SEQ ID NO: 855524 - protein, 9 aa, Homo Sapiens
KVPGQDLEV

SEQ ID NO: 855525 - protein, 9 aa, Homo Sapiens
PVADYLVVI

SEQ ID NO: 855526 - protein, 9 aa, Homo Sapiens
GGHHIEGVH

SEQ ID NO: 855527 - protein, 9 aa, Homo Sapiens
VSVPGGHKL

SEQ ID NO: 855528 - protein, 9 aa, Homo Sapiens
PKFSTQFHC

SEQ ID NO: 855529 - protein, 9 aa, Homo Sapiens
KKKYKNSES

SEQ ID NO: 855530 - protein, 9 aa, Homo Sapiens
KRSVEYHYL

SEQ ID NO: 855531 - protein, 9 aa, Homo Sapiens
CLALGTHRM

SEQ ID NO: 855532 - protein, 9 aa, Homo Sapiens
DLYYFRNHE

SEQ ID NO: 855533 - protein, 9 aa, Homo Sapiens
VVTPLLNAG

SEQ ID NO: 855534 - protein, 9 aa, Homo Sapiens
CTVYAFKTW

SEQ ID NO: 855535 - protein, 9 aa, Homo Sapiens
SRTGYWIMM

SEQ ID NO: 855536 - protein, 9 aa, Homo Sapiens
AYPIGTTAN

SEQ ID NO: 855537 - protein, 9 aa, Homo Sapiens
WAMGIILYK

SEQ ID NO: 855538 - protein, 9 aa, Homo Sapiens
ERRKEQEHI

SEQ ID NO: 855539 - protein, 9 aa, Homo Sapiens
QKPNGTNPS

SEQ ID NO: 855540 - protein, 9 aa, Homo Sapiens
GDVGAKGEA

SEQ ID NO: 855541 - protein, 9 aa, Homo Sapiens
FSSLFKNMI

SEQ ID NO: 855542 - protein, 9 aa, Homo Sapiens
HPKPETTLS

SEQ ID NO: 855543 - protein, 9 aa, Homo Sapiens
LKPDEEKKY

SEQ ID NO: 855544 - protein, 9 aa, Homo Sapiens
LSVCHLFTS

SEQ ID NO: 855545 - protein, 9 aa, Homo Sapiens
GAEAASFQI

SEQ ID NO: 855546 - protein, 9 aa, Homo Sapiens
MCDQWDRLG

SEQ ID NO: 855547 - protein, 9 aa, Homo Sapiens
ISELDDIIK

SEQ ID NO: 855548 - protein, 9 aa, Homo Sapiens
HCGLDDSKK

SEQ ID NO: 855549 - protein, 9 aa, Homo Sapiens
DVTQGYNET

SEQ ID NO: 855550 - protein, 9 aa, Homo Sapiens
DYFGNDYIE

SEQ ID NO: 855551 - protein, 9 aa, Homo Sapiens
DTIGQISPD

SEQ ID NO: 855552 - protein, 9 aa, Homo Sapiens
TPRGRRGWN

SEQ ID NO: 855553 - protein, 9 aa, Homo Sapiens
LDASLSNNS

SEQ ID NO: 855554 - protein, 9 aa, Homo Sapiens
HFALVTAYG

SEQ ID NO: 855555 - protein, 9 aa, Homo Sapiens
ALYAMCDVF

SEQ ID NO: 855556 - protein, 9 aa, Homo Sapiens
LSERGPPTA

SEQ ID NO: 855557 - protein, 9 aa, Homo Sapiens
KSRTAEKTD

SEQ ID NO: 855558 - protein, 9 aa, Homo Sapiens
NLLEWTHHN

SEQ ID NO: 855559 - protein, 9 aa, Homo Sapiens
ELDNTPNNY

SEQ ID NO: 855560 - protein, 9 aa, Homo Sapiens
QLQLIKQIR

SEQ ID NO: 855561 - protein, 9 aa, Homo Sapiens
GPPARKEKT

SEQ ID NO: 855562 - protein, 9 aa, Homo Sapiens
MSIINSFVT

SEQ ID NO: 855563 - protein, 9 aa, Homo Sapiens
QIQTVMKKV

SEQ ID NO: 855564 - protein, 9 aa, Homo Sapiens
PSLEDLKEF

SEQ ID NO: 855565 - protein, 9 aa, Homo Sapiens
VISVETRVQ

SEQ ID NO: 855566 - protein, 9 aa, Homo Sapiens
TSVNNVLCN

SEQ ID NO: 855567 - protein, 9 aa, Homo Sapiens
VCNMQNNTF

SEQ ID NO: 855568 - protein, 9 aa, Homo Sapiens
HDQCHSHFH

SEQ ID NO: 855569 - protein, 9 aa, Homo Sapiens
VMMDNYSSL

SEQ ID NO: 855570 - protein, 9 aa, Homo Sapiens
ISLSYSQIS

SEQ ID NO: 855571 - protein, 9 aa, Homo Sapiens
ITTSLLTFW

SEQ ID NO: 855572 - protein, 9 aa, Homo Sapiens
VQHSETYCM

SEQ ID NO: 855573 - protein, 9 aa, Homo Sapiens
DWIRKEINQ

SEQ ID NO: 855574 - protein, 9 aa, Homo Sapiens
GSPEEKTLD

SEQ ID NO: 855575 - protein, 9 aa, Homo Sapiens
QIKTYYWDN

SEQ ID NO: 855576 - protein, 9 aa, Homo Sapiens
GLLSLRVNA

SEQ ID NO: 855577 - protein, 9 aa, Homo Sapiens
CLSEDLYPN

SEQ ID NO: 855578 - protein, 9 aa, Homo Sapiens
HYYFSALPS

SEQ ID NO: 855579 - protein, 9 aa, Homo Sapiens
IELYAPWCG

SEQ ID NO: 855580 - protein, 9 aa, Homo Sapiens
QYIDRDPDT

SEQ ID NO: 855581 - protein, 9 aa, Homo Sapiens
ECIFYDYNN

SEQ ID NO: 855582 - protein, 9 aa, Homo Sapiens
RVLTSRKTV

SEQ ID NO: 855583 - protein, 9 aa, Homo Sapiens
QITHTQEKP

SEQ ID NO: 855584 - protein, 9 aa, Homo Sapiens
YTQRSYSWF

SEQ ID NO: 855585 - protein, 9 aa, Homo Sapiens
ERLANTEQE

SEQ ID NO: 855586 - protein, 9 aa, Homo Sapiens
AKKYERISW

SEQ ID NO: 855587 - protein, 9 aa, Homo Sapiens
TVHVRVNNV

SEQ ID NO: 855588 - protein, 9 aa, Homo Sapiens
KWPTLVAAV

SEQ ID NO: 855589 - protein, 9 aa, Homo Sapiens
EEMSEVLQL

SEQ ID NO: 855590 - protein, 9 aa, Homo Sapiens
SEEAVSFCR

SEQ ID NO: 855591 - protein, 9 aa, Homo Sapiens
RYFELYEGP

SEQ ID NO: 855592 - protein, 9 aa, Homo Sapiens
EESKLLKKA

SEQ ID NO: 855593 - protein, 9 aa, Homo Sapiens
PHVCKRMKI

SEQ ID NO: 855594 - protein, 9 aa, Homo Sapiens
DILKYHTDI

SEQ ID NO: 855595 - protein, 9 aa, Homo Sapiens
WVTEWLPMA

SEQ ID NO: 855596 - protein, 9 aa, Homo Sapiens
KLLPLEEHS

SEQ ID NO: 855597 - protein, 9 aa, Homo Sapiens
NDPVMGTHT

SEQ ID NO: 855598 - protein, 9 aa, Homo Sapiens
LNTWKKKYV

SEQ ID NO: 855599 - protein, 9 aa, Homo Sapiens
KSQFIKHVE

SEQ ID NO: 855600 - protein, 9 aa, Homo Sapiens
KFTSVRRDC

SEQ ID NO: 855601 - protein, 9 aa, Homo Sapiens
RLQMRLKRP

SEQ ID NO: 855602 - protein, 9 aa, Homo Sapiens
DTSVFKNAM

SEQ ID NO: 855603 - protein, 9 aa, Homo Sapiens
SLKEAMEER

SEQ ID NO: 855604 - protein, 9 aa, Homo Sapiens
AVVIQQRKS

SEQ ID NO: 855605 - protein, 9 aa, Homo Sapiens
PSKAPSRTQ

SEQ ID NO: 855606 - protein, 9 aa, Homo Sapiens
KSSSIISDS

SEQ ID NO: 855607 - protein, 9 aa, Homo Sapiens
EGNDKALKR

SEQ ID NO: 855608 - protein, 9 aa, Homo Sapiens
WRRMSVMDS

SEQ ID NO: 855609 - protein, 9 aa, Homo Sapiens
AQECERIHF

SEQ ID NO: 855610 - protein, 9 aa, Homo Sapiens
QAPKTVDTI

SEQ ID NO: 855611 - protein, 9 aa, Homo Sapiens
SWADLVYSF

SEQ ID NO: 855612 - protein, 9 aa, Homo Sapiens
SHCSGTRVP

SEQ ID NO: 855613 - protein, 9 aa, Homo Sapiens
VKDFAAHCG

SEQ ID NO: 855614 - protein, 9 aa, Homo Sapiens
QEPENNQGV

SEQ ID NO: 855615 - protein, 9 aa, Homo Sapiens
ELFPAPIPR

SEQ ID NO: 855616 - protein, 9 aa, Homo Sapiens
CLSQLFIQV

SEQ ID NO: 855617 - protein, 9 aa, Homo Sapiens
QRYDNSAHG

SEQ ID NO: 855618 - protein, 9 aa, Homo Sapiens
LLKVPKDAE

SEQ ID NO: 855619 - protein, 9 aa, Homo Sapiens
RKEDQYIKM

SEQ ID NO: 855620 - protein, 9 aa, Homo Sapiens
SIVKDFAAH

SEQ ID NO: 855621 - protein, 9 aa, Homo Sapiens
LNVREWLQL

SEQ ID NO: 855622 - protein, 9 aa, Homo Sapiens
LSVWHRKSL

SEQ ID NO: 855623 - protein, 9 aa, Homo Sapiens
YSLINKQVI

SEQ ID NO: 855624 - protein, 9 aa, Homo Sapiens
TNALLKYNG

SEQ ID NO: 855625 - protein, 9 aa, Homo Sapiens
DPTRRAGAD

SEQ ID NO: 855626 - protein, 9 aa, Homo Sapiens
AGSNQSRVK

SEQ ID NO: 855627 - protein, 9 aa, Homo Sapiens
KRKTVTDFC

SEQ ID NO: 855628 - protein, 9 aa, Homo Sapiens
DEFEHTPQE

SEQ ID NO: 855629 - protein, 9 aa, Homo Sapiens
GFFSKPSLH

SEQ ID NO: 855630 - protein, 9 aa, Homo Sapiens
FSDRIILQP

SEQ ID NO: 855631 - protein, 9 aa, Homo Sapiens
SSQFLPKGT

SEQ ID NO: 855632 - protein, 9 aa, Homo Sapiens
LIMQETSVI

SEQ ID NO: 855633 - protein, 9 aa, Homo Sapiens
MVLTHIIAI

SEQ ID NO: 855634 - protein, 9 aa, Homo Sapiens
PATSFSNLV

SEQ ID NO: 855635 - protein, 9 aa, Homo Sapiens
KDGYVPLFD

SEQ ID NO: 855636 - protein, 9 aa, Homo Sapiens
FSLFGLRTK

SEQ ID NO: 855637 - protein, 9 aa, Homo Sapiens
IYRIWEPQT

SEQ ID NO: 855638 - protein, 9 aa, Homo Sapiens
QRRIDTKEN

SEQ ID NO: 855639 - protein, 9 aa, Homo Sapiens
DATAEIIDE

SEQ ID NO: 855640 - protein, 9 aa, Homo Sapiens
AIHAIMENA

SEQ ID NO: 855641 - protein, 9 aa, Homo Sapiens
QQYVLQSDG

SEQ ID NO: 855642 - protein, 9 aa, Homo Sapiens
HEGRKVCAI

SEQ ID NO: 855643 - protein, 9 aa, Homo Sapiens
SSGYPPDIS

SEQ ID NO: 855644 - protein, 9 aa, Homo Sapiens
FRGHITMKK

SEQ ID NO: 855645 - protein, 9 aa, Homo Sapiens
EPASTMLTA

SEQ ID NO: 855646 - protein, 9 aa, Homo Sapiens
NSWDKAHVK

SEQ ID NO: 855647 - protein, 9 aa, Homo Sapiens
ATDVARVVN

SEQ ID NO: 855648 - protein, 9 aa, Homo Sapiens
RLPAVDTSY

SEQ ID NO: 855649 - protein, 9 aa, Homo Sapiens
NGHLPHPSL

SEQ ID NO: 855650 - protein, 9 aa, Homo Sapiens
TPCYRTTGP

SEQ ID NO: 855651 - protein, 9 aa, Homo Sapiens
ETLSNALNQ

SEQ ID NO: 855652 - protein, 9 aa, Homo Sapiens
RLDYMVLLI

SEQ ID NO: 855653 - protein, 9 aa, Homo Sapiens
YNVLEDFSI

SEQ ID NO: 855654 - protein, 9 aa, Homo Sapiens
GLMRQRQQQ

SEQ ID NO: 855655 - protein, 9 aa, Homo Sapiens
EEKVCALQC

SEQ ID NO: 855656 - protein, 9 aa, Homo Sapiens
PVIVHQAIL

SEQ ID NO: 855657 - protein, 9 aa, Homo Sapiens
DRTKNGTSS

SEQ ID NO: 855658 - protein, 9 aa, Homo Sapiens
EERIMEISA

SEQ ID NO: 855659 - protein, 9 aa, Homo Sapiens
TASTCINLL

SEQ ID NO: 855660 - protein, 9 aa, Homo Sapiens
ECPDPNILA

SEQ ID NO: 855661 - protein, 9 aa, Homo Sapiens
KNHDEEPTV

SEQ ID NO: 855662 - protein, 9 aa, Homo Sapiens
CELWAGPCP

SEQ ID NO: 855663 - protein, 9 aa, Homo Sapiens
RSLTSGSLE

SEQ ID NO: 855664 - protein, 9 aa, Homo Sapiens
AKRKIIHTG

SEQ ID NO: 855665 - protein, 9 aa, Homo Sapiens
GHFDGGPVI

SEQ ID NO: 855666 - protein, 9 aa, Homo Sapiens
SYPDLDAVL

SEQ ID NO: 855667 - protein, 9 aa, Homo Sapiens
WSILVNILL

SEQ ID NO: 855668 - protein, 9 aa, Homo Sapiens
KEVVILLLL

SEQ ID NO: 855669 - protein, 9 aa, Homo Sapiens
IGCSLVCGE

SEQ ID NO: 855670 - protein, 9 aa, Homo Sapiens
VEKIELPSS

SEQ ID NO: 855671 - protein, 9 aa, Homo Sapiens
QKPVLHRAS

SEQ ID NO: 855672 - protein, 9 aa, Homo Sapiens
YVTPIIQPK

SEQ ID NO: 855673 - protein, 9 aa, Homo Sapiens
EVLSLLEEV

SEQ ID NO: 855674 - protein, 9 aa, Homo Sapiens
KVWRYINFN

SEQ ID NO: 855675 - protein, 9 aa, Homo Sapiens
VNPSDHVIT

SEQ ID NO: 855676 - protein, 9 aa, Homo Sapiens
SVMLFMHYQ

SEQ ID NO: 855677 - protein, 9 aa, Homo Sapiens
EDYFQKVLL

SEQ ID NO: 855678 - protein, 9 aa, Homo Sapiens
FPESMDNFI

SEQ ID NO: 855679 - protein, 9 aa, Homo Sapiens
GDPCLRSSY

SEQ ID NO: 855680 - protein, 9 aa, Homo Sapiens
GQWEGKVNG

SEQ ID NO: 855681 - protein, 9 aa, Homo Sapiens
DKQTEWIAN

SEQ ID NO: 855682 - protein, 9 aa, Homo Sapiens
GNMPAISDQ

SEQ ID NO: 855683 - protein, 9 aa, Homo Sapiens
QLNPATTSI

SEQ ID NO: 855684 - protein, 9 aa, Homo Sapiens
SYFIWNMEE

SEQ ID NO: 855685 - protein, 9 aa, Homo Sapiens
LLNYPDRAR

SEQ ID NO: 855686 - protein, 9 aa, Homo Sapiens
VEDKVLCRV

SEQ ID NO: 855687 - protein, 9 aa, Homo Sapiens
SLFKNMIQP

SEQ ID NO: 855688 - protein, 9 aa, Homo Sapiens
KLQNQIAAL

SEQ ID NO: 855689 - protein, 9 aa, Homo Sapiens
GPVMSKSSP

SEQ ID NO: 855690 - protein, 9 aa, Homo Sapiens
PDGDLSPTK

SEQ ID NO: 855691 - protein, 9 aa, Homo Sapiens
GVSKSRIRS

SEQ ID NO: 855692 - protein, 9 aa, Homo Sapiens
FGFYWPKML

SEQ ID NO: 855693 - protein, 9 aa, Homo Sapiens
HKLDYLTYK

SEQ ID NO: 855694 - protein, 9 aa, Homo Sapiens
YTLPLTEGN

SEQ ID NO: 855695 - protein, 9 aa, Homo Sapiens
YWALPSLKW

SEQ ID NO: 855696 - protein, 9 aa, Homo Sapiens
DFGLATVFW

SEQ ID NO: 855697 - protein, 9 aa, Homo Sapiens
NKQIWDTVS

SEQ ID NO: 855698 - protein, 9 aa, Homo Sapiens
RKEMIGWIY

SEQ ID NO: 855699 - protein, 9 aa, Homo Sapiens
LAQLYGPEP

SEQ ID NO: 855700 - protein, 9 aa, Homo Sapiens
YHALASFDF

SEQ ID NO: 855701 - protein, 9 aa, Homo Sapiens
KAFSDLYYF

SEQ ID NO: 855702 - protein, 9 aa, Homo Sapiens
HLVDQEERS

SEQ ID NO: 855703 - protein, 9 aa, Homo Sapiens
YPVPLECLD

SEQ ID NO: 855704 - protein, 9 aa, Homo Sapiens
SNHQIFHTG

SEQ ID NO: 855705 - protein, 9 aa, Homo Sapiens
DDREPQDGR

SEQ ID NO: 855706 - protein, 9 aa, Homo Sapiens
DARFYWNVS

SEQ ID NO: 855707 - protein, 9 aa, Homo Sapiens
SDTFSLLNN

SEQ ID NO: 855708 - protein, 9 aa, Homo Sapiens
GAKGESGFR

SEQ ID NO: 855709 - protein, 9 aa, Homo Sapiens
YIDNPLDKN

SEQ ID NO: 855710 - protein, 9 aa, Homo Sapiens
VKNYQVHQS

SEQ ID NO: 855711 - protein, 9 aa, Homo Sapiens
PEVDTIDLV

SEQ ID NO: 855712 - protein, 9 aa, Homo Sapiens
KMIPERKNQ

SEQ ID NO: 855713 - protein, 9 aa, Homo Sapiens
NETQHYPAF

SEQ ID NO: 855714 - protein, 9 aa, Homo Sapiens
TSAINQLEE

SEQ ID NO: 855715 - protein, 9 aa, Homo Sapiens
ILDHHCWVH

SEQ ID NO: 855716 - protein, 9 aa, Homo Sapiens
KEKLECYPK

SEQ ID NO: 855717 - protein, 9 aa, Homo Sapiens
FLGIGLKHY

SEQ ID NO: 855718 - protein, 9 aa, Homo Sapiens
LIIMLLKIS

SEQ ID NO: 855719 - protein, 9 aa, Homo Sapiens
DKGPASNDP

SEQ ID NO: 855720 - protein, 9 aa, Homo Sapiens
FSLGYIYFK

SEQ ID NO: 855721 - protein, 9 aa, Homo Sapiens
NSFYGSSYL

SEQ ID NO: 855722 - protein, 9 aa, Homo Sapiens
GSWDNGKLK

SEQ ID NO: 855723 - protein, 9 aa, Homo Sapiens
IITLLVKSS

SEQ ID NO: 855724 - protein, 9 aa, Homo Sapiens
QNRFTTNLP

SEQ ID NO: 855725 - protein, 9 aa, Homo Sapiens
KMQHNGHSL

SEQ ID NO: 855726 - protein, 9 aa, Homo Sapiens
GKVTVVASV

SEQ ID NO: 855727 - protein, 9 aa, Homo Sapiens
IKVVKFLIE

SEQ ID NO: 855728 - protein, 9 aa, Homo Sapiens
KSFKNKTRN

SEQ ID NO: 855729 - protein, 9 aa, Homo Sapiens
VLIELYAPW

SEQ ID NO: 855730 - protein, 9 aa, Homo Sapiens
QDYEIRQYV

SEQ ID NO: 855731 - protein, 9 aa, Homo Sapiens
EFIDAQCEA

SEQ ID NO: 855732 - protein, 9 aa, Homo Sapiens
PPLIHLWEA

SEQ ID NO: 855733 - protein, 9 aa, Homo Sapiens
ADAMFSEYI

SEQ ID NO: 855734 - protein, 9 aa, Homo Sapiens
LRGEKNQQI

SEQ ID NO: 855735 - protein, 9 aa, Homo Sapiens
ENHYLTPQS

SEQ ID NO: 855736 - protein, 9 aa, Homo Sapiens
KSLEVSEQM

SEQ ID NO: 855737 - protein, 9 aa, Homo Sapiens
LECERKASD

SEQ ID NO: 855738 - protein, 9 aa, Homo Sapiens
VHCWYTAHR

SEQ ID NO: 855739 - protein, 9 aa, Homo Sapiens
ASDKELHPN

SEQ ID NO: 855740 - protein, 9 aa, Homo Sapiens
VAAAEGHIK

SEQ ID NO: 855741 - protein, 9 aa, Homo Sapiens
GREQLEVTC

SEQ ID NO: 855742 - protein, 9 aa, Homo Sapiens
EGSKPVLFQ

SEQ ID NO: 855743 - protein, 9 aa, Homo Sapiens
KLFPRIPHM

SEQ ID NO: 855744 - protein, 9 aa, Homo Sapiens
TNIISLLNV

SEQ ID NO: 855745 - protein, 9 aa, Homo Sapiens
LQTPLLTLY

SEQ ID NO: 855746 - protein, 9 aa, Homo Sapiens
DHQTLDKVL

SEQ ID NO: 855747 - protein, 9 aa, Homo Sapiens
LLSLLDKVC

SEQ ID NO: 855748 - protein, 9 aa, Homo Sapiens
PSNLQSAVS

SEQ ID NO: 855749 - protein, 9 aa, Homo Sapiens
AVLCIPYGA

SEQ ID NO: 855750 - protein, 9 aa, Homo Sapiens
CPHKFLQVY

SEQ ID NO: 855751 - protein, 9 aa, Homo Sapiens
FTTNLPSGE

SEQ ID NO: 855752 - protein, 9 aa, Homo Sapiens
FSATDFQVF

SEQ ID NO: 855753 - protein, 9 aa, Homo Sapiens
EQKAKLDKF

SEQ ID NO: 855754 - protein, 9 aa, Homo Sapiens
VFILRNQKR

SEQ ID NO: 855755 - protein, 9 aa, Homo Sapiens
AKTPTNKAP

SEQ ID NO: 855756 - protein, 9 aa, Homo Sapiens
ITKETTTVI

SEQ ID NO: 855757 - protein, 9 aa, Homo Sapiens
INTASRDEL

SEQ ID NO: 855758 - protein, 9 aa, Homo Sapiens
DTLMSQSVG

SEQ ID NO: 855759 - protein, 9 aa, Homo Sapiens
LSLTESVRW

SEQ ID NO: 855760 - protein, 9 aa, Homo Sapiens
LGWLHWGPA

SEQ ID NO: 855761 - protein, 9 aa, Homo Sapiens
GEMWRQTHM

SEQ ID NO: 855762 - protein, 9 aa, Homo Sapiens
FDFDLEEFK

SEQ ID NO: 855763 - protein, 9 aa, Homo Sapiens
AARMTMYYP

SEQ ID NO: 855764 - protein, 9 aa, Homo Sapiens
SSSLIAHQI

SEQ ID NO: 855765 - protein, 9 aa, Homo Sapiens
QRQGLTCSR

SEQ ID NO: 855766 - protein, 9 aa, Homo Sapiens
SVVSSAEKL

SEQ ID NO: 855767 - protein, 9 aa, Homo Sapiens
MEYTKQLII

SEQ ID NO: 855768 - protein, 9 aa, Homo Sapiens
PEQDSVERH

SEQ ID NO: 855769 - protein, 9 aa, Homo Sapiens
VKQHILISR

SEQ ID NO: 855770 - protein, 9 aa, Homo Sapiens
PLFTFPSDV

SEQ ID NO: 855771 - protein, 9 aa, Homo Sapiens
SVPNKCYVH

SEQ ID NO: 855772 - protein, 9 aa, Homo Sapiens
IEDLCEVYN

SEQ ID NO: 855773 - protein, 9 aa, Homo Sapiens
GTYIIEMSH

SEQ ID NO: 855774 - protein, 9 aa, Homo Sapiens
PAEKVCLAQ

SEQ ID NO: 855775 - protein, 9 aa, Homo Sapiens
IVTRYEQRE

SEQ ID NO: 855776 - protein, 9 aa, Homo Sapiens
AMQMAAFAI

SEQ ID NO: 855777 - protein, 9 aa, Homo Sapiens
LPDIQLEEG

SEQ ID NO: 855778 - protein, 9 aa, Homo Sapiens
DLGLQDKQG

SEQ ID NO: 855779 - protein, 9 aa, Homo Sapiens
HIIHVGDKS

SEQ ID NO: 855780 - protein, 9 aa, Homo Sapiens
LFYKFYPCE

SEQ ID NO: 855781 - protein, 9 aa, Homo Sapiens
SLFFFTEKI

SEQ ID NO: 855782 - protein, 9 aa, Homo Sapiens
VLKIADIFE

SEQ ID NO: 855783 - protein, 9 aa, Homo Sapiens
SSEDLHDYV

SEQ ID NO: 855784 - protein, 9 aa, Homo Sapiens
AGLSAYQLY

SEQ ID NO: 855785 - protein, 9 aa, Homo Sapiens
YKILEGTET

SEQ ID NO: 855786 - protein, 9 aa, Homo Sapiens
IAEKPLGEN

SEQ ID NO: 855787 - protein, 9 aa, Homo Sapiens
NGELYLRQT

SEQ ID NO: 855788 - protein, 9 aa, Homo Sapiens
EQRKIMTSQ

SEQ ID NO: 855789 - protein, 9 aa, Homo Sapiens
YKKAKERDK

SEQ ID NO: 855790 - protein, 9 aa, Homo Sapiens
PHRTEHQRT

SEQ ID NO: 855791 - protein, 9 aa, Homo Sapiens
LDTMPEYPA

SEQ ID NO: 855792 - protein, 9 aa, Homo Sapiens
RNNGLNDRD

SEQ ID NO: 855793 - protein, 9 aa, Homo Sapiens
LDPDMALCQ

SEQ ID NO: 855794 - protein, 9 aa, Homo Sapiens
IKFEDVYAG

SEQ ID NO: 855795 - protein, 9 aa, Homo Sapiens
SYILGWICL

SEQ ID NO: 855796 - protein, 9 aa, Homo Sapiens
GKGFQHPSE

SEQ ID NO: 855797 - protein, 9 aa, Homo Sapiens
WATLQLLCQ

SEQ ID NO: 855798 - protein, 9 aa, Homo Sapiens
HFPDDLSYC

SEQ ID NO: 855799 - protein, 9 aa, Homo Sapiens
WKCPENFNE

SEQ ID NO: 855800 - protein, 9 aa, Homo Sapiens
RLDLKLVDR

SEQ ID NO: 855801 - protein, 9 aa, Homo Sapiens
YFITHSLKF

SEQ ID NO: 855802 - protein, 9 aa, Homo Sapiens
IKLQQFSPL

SEQ ID NO: 855803 - protein, 9 aa, Homo Sapiens
SKQHLWLVF

SEQ ID NO: 855804 - protein, 9 aa, Homo Sapiens
KLAINIFQY

SEQ ID NO: 855805 - protein, 9 aa, Homo Sapiens
GIYYIPLED

SEQ ID NO: 855806 - protein, 9 aa, Homo Sapiens
LGESCLNTI

SEQ ID NO: 855807 - protein, 9 aa, Homo Sapiens
QGLMELGTV

SEQ ID NO: 855808 - protein, 9 aa, Homo Sapiens
QTVTDGQDS

SEQ ID NO: 855809 - protein, 9 aa, Homo Sapiens
KYYFTSSRH

SEQ ID NO: 855810 - protein, 9 aa, Homo Sapiens
EADLKHQFT

SEQ ID NO: 855811 - protein, 9 aa, Homo Sapiens
LPHMEPICK

SEQ ID NO: 855812 - protein, 9 aa, Homo Sapiens
SFSNLANNF

SEQ ID NO: 855813 - protein, 9 aa, Homo Sapiens
QGAKKHVMP

SEQ ID NO: 855814 - protein, 9 aa, Homo Sapiens
FQTCGNVAH

SEQ ID NO: 855815 - protein, 9 aa, Homo Sapiens
NLEPKPLFP

SEQ ID NO: 855816 - protein, 9 aa, Homo Sapiens
REIARFFCE

SEQ ID NO: 855817 - protein, 9 aa, Homo Sapiens
LDLDVSLQK

SEQ ID NO: 855818 - protein, 9 aa, Homo Sapiens
ITHFNGNYI

SEQ ID NO: 855819 - protein, 9 aa, Homo Sapiens
FTITLVFLV

SEQ ID NO: 855820 - protein, 9 aa, Homo Sapiens
QKREQHEDK

SEQ ID NO: 855821 - protein, 9 aa, Homo Sapiens
VNHSYPKCF

SEQ ID NO: 855822 - protein, 9 aa, Homo Sapiens
VYASQQMRA

SEQ ID NO: 855823 - protein, 9 aa, Homo Sapiens
NNPLSIIPN

SEQ ID NO: 855824 - protein, 9 aa, Homo Sapiens
EVKSWQITI

SEQ ID NO: 855825 - protein, 9 aa, Homo Sapiens
SEYPTSKDP

SEQ ID NO: 855826 - protein, 9 aa, Homo Sapiens
QHILLDQKD

SEQ ID NO: 855827 - protein, 9 aa, Homo Sapiens
KIIVLSLFP

SEQ ID NO: 855828 - protein, 9 aa, Homo Sapiens
ELKGKNQLL

SEQ ID NO: 855829 - protein, 9 aa, Homo Sapiens
FKLFADKFP

SEQ ID NO: 855830 - protein, 9 aa, Homo Sapiens
NLAEKPKPV

SEQ ID NO: 855831 - protein, 9 aa, Homo Sapiens
GYLVLYLSM

SEQ ID NO: 855832 - protein, 9 aa, Homo Sapiens
SSAASPYFC

SEQ ID NO: 855833 - protein, 9 aa, Homo Sapiens
PKHLNSPNG

SEQ ID NO: 855834 - protein, 9 aa, Homo Sapiens
LWVDRAYAL

SEQ ID NO: 855835 - protein, 9 aa, Homo Sapiens
LTEKFRTME

SEQ ID NO: 855836 - protein, 9 aa, Homo Sapiens
EVLIDTRLF

SEQ ID NO: 855837 - protein, 9 aa, Homo Sapiens
KAPGVADKK

SEQ ID NO: 855838 - protein, 9 aa, Homo Sapiens
NLEELKATI

SEQ ID NO: 855839 - protein, 9 aa, Homo Sapiens
LSVRGTTHV

SEQ ID NO: 855840 - protein, 9 aa, Homo Sapiens
AINKFVVTQ

SEQ ID NO: 855841 - protein, 9 aa, Homo Sapiens
GIGNACDNC

SEQ ID NO: 855842 - protein, 9 aa, Homo Sapiens
SGELLKPQK

SEQ ID NO: 855843 - protein, 9 aa, Homo Sapiens
SREDNITTP

SEQ ID NO: 855844 - protein, 9 aa, Homo Sapiens
QFVMDNSQN

SEQ ID NO: 855845 - protein, 9 aa, Homo Sapiens
SYSPTSPDY

SEQ ID NO: 855846 - protein, 9 aa, Homo Sapiens
SPNNSPKKG

SEQ ID NO: 855847 - protein, 9 aa, Homo Sapiens
VINHDPVVG

SEQ ID NO: 855848 - protein, 9 aa, Homo Sapiens
LYCNETCYP

SEQ ID NO: 855849 - protein, 9 aa, Homo Sapiens
SKCKINLEI

SEQ ID NO: 855850 - protein, 9 aa, Homo Sapiens
RGLGILASV

SEQ ID NO: 855851 - protein, 9 aa, Homo Sapiens
RMPRKRKTR

SEQ ID NO: 855852 - protein, 9 aa, Homo Sapiens
LQEQEVLFK

SEQ ID NO: 855853 - protein, 9 aa, Homo Sapiens
LKQKEANQL

SEQ ID NO: 855854 - protein, 9 aa, Homo Sapiens
GICELVSEE

SEQ ID NO: 855855 - protein, 9 aa, Homo Sapiens
KIVITDTGQ

SEQ ID NO: 855856 - protein, 9 aa, Homo Sapiens
DGVMLDGAT

SEQ ID NO: 855857 - protein, 9 aa, Homo Sapiens
EFSPGGEPD

SEQ ID NO: 855858 - protein, 9 aa, Homo Sapiens
VVSPGPDNK

SEQ ID NO: 855859 - protein, 9 aa, Homo Sapiens
KKAQNDEYE

SEQ ID NO: 855860 - protein, 9 aa, Homo Sapiens
HEIYQITND

SEQ ID NO: 855861 - protein, 9 aa, Homo Sapiens
EDLDALTEK

SEQ ID NO: 855862 - protein, 9 aa, Homo Sapiens
KDLQDEKII

SEQ ID NO: 855863 - protein, 9 aa, Homo Sapiens
APKASEEPR

SEQ ID NO: 855864 - protein, 9 aa, Homo Sapiens
DTMPEYPAL

SEQ ID NO: 855865 - protein, 9 aa, Homo Sapiens
NMSQLFATY

SEQ ID NO: 855866 - protein, 9 aa, Homo Sapiens
AQLAVTRIS

SEQ ID NO: 855867 - protein, 9 aa, Homo Sapiens
IIAKPEMNV

SEQ ID NO: 855868 - protein, 9 aa, Homo Sapiens
CKDSAFERN

SEQ ID NO: 855869 - protein, 9 aa, Homo Sapiens
DDQIIVSYL

SEQ ID NO: 855870 - protein, 9 aa, Homo Sapiens
VQTLLQYHK

SEQ ID NO: 855871 - protein, 9 aa, Homo Sapiens
QLLCVFFVK

SEQ ID NO: 855872 - protein, 9 aa, Homo Sapiens
SISLVPPST

SEQ ID NO: 855873 - protein, 9 aa, Homo Sapiens
DNKQIGLLF

SEQ ID NO: 855874 - protein, 9 aa, Homo Sapiens
VEEKSKECV

SEQ ID NO: 855875 - protein, 9 aa, Homo Sapiens
GENAKKYLQ

SEQ ID NO: 855876 - protein, 9 aa, Homo Sapiens
NPQNSKIFF

SEQ ID NO: 855877 - protein, 9 aa, Homo Sapiens
LIDKSTQAT

SEQ ID NO: 855878 - protein, 9 aa, Homo Sapiens
SSTKNYPST

SEQ ID NO: 855879 - protein, 9 aa, Homo Sapiens
HTVYAKVDN

SEQ ID NO: 855880 - protein, 9 aa, Homo Sapiens
VLFVFSTLA

SEQ ID NO: 855881 - protein, 9 aa, Homo Sapiens
LQHNMKCCI

SEQ ID NO: 855882 - protein, 9 aa, Homo Sapiens
SVSVPGGHK

SEQ ID NO: 855883 - protein, 9 aa, Homo Sapiens
NNKGVSNNV

SEQ ID NO: 855884 - protein, 9 aa, Homo Sapiens
LMTYFDPDF

SEQ ID NO: 855885 - protein, 9 aa, Homo Sapiens
KTNALLKYN

SEQ ID NO: 855886 - protein, 9 aa, Homo Sapiens
LPDEPFTIQ

SEQ ID NO: 855887 - protein, 9 aa, Homo Sapiens
ESIQRIENV

SEQ ID NO: 855888 - protein, 9 aa, Homo Sapiens
KVAQEAIEN

SEQ ID NO: 855889 - protein, 9 aa, Homo Sapiens
QQQEEEGLY

SEQ ID NO: 855890 - protein, 9 aa, Homo Sapiens
HRKFVRPGA

SEQ ID NO: 855891 - protein, 9 aa, Homo Sapiens
QRIHTGETP

SEQ ID NO: 855892 - protein, 9 aa, Homo Sapiens
LGMTASAVV

SEQ ID NO: 855893 - protein, 9 aa, Homo Sapiens
ECMNFLAEN

SEQ ID NO: 855894 - protein, 9 aa, Homo Sapiens
RTYIFNSLD

SEQ ID NO: 855895 - protein, 9 aa, Homo Sapiens
LRPDQTRGL

SEQ ID NO: 855896 - protein, 9 aa, Homo Sapiens
ISPSSCLMG

SEQ ID NO: 855897 - protein, 9 aa, Homo Sapiens
SIWKAELEA

SEQ ID NO: 855898 - protein, 9 aa, Homo Sapiens
MFTKKSEAG

SEQ ID NO: 855899 - protein, 9 aa, Homo Sapiens
KDKFDYGNK

SEQ ID NO: 855900 - protein, 9 aa, Homo Sapiens
PRFVEDLLP

SEQ ID NO: 855901 - protein, 9 aa, Homo Sapiens
QLFFYHFHF

SEQ ID NO: 855902 - protein, 9 aa, Homo Sapiens
REKALREQA

SEQ ID NO: 855903 - protein, 9 aa, Homo Sapiens
KTLEEMELI

SEQ ID NO: 855904 - protein, 9 aa, Homo Sapiens
LVLHLRGGC

SEQ ID NO: 855905 - protein, 9 aa, Homo Sapiens
RRRKFMERN

SEQ ID NO: 855906 - protein, 9 aa, Homo Sapiens
PTEYFLPLP

SEQ ID NO: 855907 - protein, 9 aa, Homo Sapiens
YYIVENEKE

SEQ ID NO: 855908 - protein, 9 aa, Homo Sapiens
QNLYSFQKQ

SEQ ID NO: 855909 - protein, 9 aa, Homo Sapiens
KTLHGSVHV

SEQ ID NO: 855910 - protein, 9 aa, Homo Sapiens
LLNKEWKKK

SEQ ID NO: 855911 - protein, 9 aa, Homo Sapiens
QQAQDQQVL

SEQ ID NO: 855912 - protein, 9 aa, Homo Sapiens
DNAYQFMLA

SEQ ID NO: 855913 - protein, 9 aa, Homo Sapiens
SKQYNNEPS

SEQ ID NO: 855914 - protein, 9 aa, Homo Sapiens
TDTNRIARA

SEQ ID NO: 855915 - protein, 9 aa, Homo Sapiens
YTLWNSRLL

SEQ ID NO: 855916 - protein, 9 aa, Homo Sapiens
SWGYVLLIL

SEQ ID NO: 855917 - protein, 9 aa, Homo Sapiens
SEATPQYSL

SEQ ID NO: 855918 - protein, 9 aa, Homo Sapiens
HYSREQRCT

SEQ ID NO: 855919 - protein, 9 aa, Homo Sapiens
RSSQEKRRS

SEQ ID NO: 855920 - protein, 9 aa, Homo Sapiens
HLRAYMKKL

SEQ ID NO: 855921 - protein, 9 aa, Homo Sapiens
AAQLSRTSL

SEQ ID NO: 855922 - protein, 9 aa, Homo Sapiens
AAMAGVKLT

SEQ ID NO: 855923 - protein, 9 aa, Homo Sapiens
LIILRLPFC

SEQ ID NO: 855924 - protein, 9 aa, Homo Sapiens
PVMCKVIGS

SEQ ID NO: 855925 - protein, 9 aa, Homo Sapiens
TMVILMLNP

SEQ ID NO: 855926 - protein, 9 aa, Homo Sapiens
PEIHGAPVL

SEQ ID NO: 855927 - protein, 9 aa, Homo Sapiens
LEPHKGLLL

SEQ ID NO: 855928 - protein, 9 aa, Homo Sapiens
VAQNEIFDE

SEQ ID NO: 855929 - protein, 9 aa, Homo Sapiens
TGEIWLRKA

SEQ ID NO: 855930 - protein, 9 aa, Homo Sapiens
STFLLLGLS

SEQ ID NO: 855931 - protein, 9 aa, Homo Sapiens
EEKQLTEDD

SEQ ID NO: 855932 - protein, 9 aa, Homo Sapiens
YLTEEDVFR

SEQ ID NO: 855933 - protein, 9 aa, Homo Sapiens
YEIRICRPC

SEQ ID NO: 855934 - protein, 9 aa, Homo Sapiens
ANLKASLKQ

SEQ ID NO: 855935 - protein, 9 aa, Homo Sapiens
DRSAAAAAV

SEQ ID NO: 855936 - protein, 9 aa, Homo Sapiens
DLITTLTFP

SEQ ID NO: 855937 - protein, 9 aa, Homo Sapiens
GTIESHCSI

SEQ ID NO: 855938 - protein, 9 aa, Homo Sapiens
DLIVGCDVA

SEQ ID NO: 855939 - protein, 9 aa, Homo Sapiens
KFFHAILQQ

SEQ ID NO: 855940 - protein, 9 aa, Homo Sapiens
NSGKDEIKA

SEQ ID NO: 855941 - protein, 9 aa, Homo Sapiens
FADVVQKLF

SEQ ID NO: 855942 - protein, 9 aa, Homo Sapiens
NSYVLSAGF

SEQ ID NO: 855943 - protein, 9 aa, Homo Sapiens
RKMNEKSVL

SEQ ID NO: 855944 - protein, 9 aa, Homo Sapiens
YESQQNGAP

SEQ ID NO: 855945 - protein, 9 aa, Homo Sapiens
SAPPSEPVS

SEQ ID NO: 855946 - protein, 9 aa, Homo Sapiens
SHDPHNRKQ

SEQ ID NO: 855947 - protein, 9 aa, Homo Sapiens
VEMLLNPEE

SEQ ID NO: 855948 - protein, 9 aa, Homo Sapiens
LHVDMLTLV

SEQ ID NO: 855949 - protein, 9 aa, Homo Sapiens
TDFDEEPQA

SEQ ID NO: 855950 - protein, 9 aa, Homo Sapiens
EILQICQRK

SEQ ID NO: 855951 - protein, 9 aa, Homo Sapiens
LREDCALFV

SEQ ID NO: 855952 - protein, 9 aa, Homo Sapiens
LQVYISPNN

SEQ ID NO: 855953 - protein, 9 aa, Homo Sapiens
VENSKRVRI

SEQ ID NO: 855954 - protein, 9 aa, Homo Sapiens
EIKIFSKTS

SEQ ID NO: 855955 - protein, 9 aa, Homo Sapiens
LGPWNQYAP

SEQ ID NO: 855956 - protein, 9 aa, Homo Sapiens
ATFINELKN

SEQ ID NO: 855957 - protein, 9 aa, Homo Sapiens
KLADVPGEM

SEQ ID NO: 855958 - protein, 9 aa, Homo Sapiens
MWMITISKG

SEQ ID NO: 855959 - protein, 9 aa, Homo Sapiens
ALLKQGHTR

SEQ ID NO: 855960 - protein, 9 aa, Homo Sapiens
QCEMVLANN

SEQ ID NO: 855961 - protein, 9 aa, Homo Sapiens
EQKNPTYVG

SEQ ID NO: 855962 - protein, 9 aa, Homo Sapiens
QAAVQCLQS

SEQ ID NO: 855963 - protein, 9 aa, Homo Sapiens
HVKISASRQ

SEQ ID NO: 855964 - protein, 9 aa, Homo Sapiens
MTSPRRTTL

SEQ ID NO: 855965 - protein, 9 aa, Homo Sapiens
IIKLSRRRS

SEQ ID NO: 855966 - protein, 9 aa, Homo Sapiens
GNNKFSTCR

SEQ ID NO: 855967 - protein, 9 aa, Homo Sapiens
QVRLWRDSK

SEQ ID NO: 855968 - protein, 9 aa, Homo Sapiens
GKTYDTINT

SEQ ID NO: 855969 - protein, 9 aa, Homo Sapiens
KSTFEDSEI

SEQ ID NO: 855970 - protein, 9 aa, Homo Sapiens
HITLHHEEV

SEQ ID NO: 855971 - protein, 9 aa, Homo Sapiens
MNRFKDKEN

SEQ ID NO: 855972 - protein, 9 aa, Homo Sapiens
LTVASFSNK

SEQ ID NO: 855973 - protein, 9 aa, Homo Sapiens
STLGTLNKL

SEQ ID NO: 855974 - protein, 9 aa, Homo Sapiens
PGLIFAVVF

SEQ ID NO: 855975 - protein, 9 aa, Homo Sapiens
YGGQQEPGT

SEQ ID NO: 855976 - protein, 9 aa, Homo Sapiens
RIMRVLHIA

SEQ ID NO: 855977 - protein, 9 aa, Homo Sapiens
AIYRESDLD

SEQ ID NO: 855978 - protein, 9 aa, Homo Sapiens
GPSKSETSK

SEQ ID NO: 855979 - protein, 9 aa, Homo Sapiens
IHWIYPEGK

SEQ ID NO: 855980 - protein, 9 aa, Homo Sapiens
LIVSAGMRT

SEQ ID NO: 855981 - protein, 9 aa, Homo Sapiens
DGISQGPHC

SEQ ID NO: 855982 - protein, 9 aa, Homo Sapiens
GTSQKDKNC

SEQ ID NO: 855983 - protein, 9 aa, Homo Sapiens
YYTQNLPSE

SEQ ID NO: 855984 - protein, 9 aa, Homo Sapiens
VWPNEENNK

SEQ ID NO: 855985 - protein, 9 aa, Homo Sapiens
YPKSGTAWV

SEQ ID NO: 855986 - protein, 9 aa, Homo Sapiens
DASGTENAF

SEQ ID NO: 855987 - protein, 9 aa, Homo Sapiens
PAAVCHHHH

SEQ ID NO: 855988 - protein, 9 aa, Homo Sapiens
QGLPVCCVK

SEQ ID NO: 855989 - protein, 9 aa, Homo Sapiens
LGAPFWLED

SEQ ID NO: 855990 - protein, 9 aa, Homo Sapiens
MLTLHTWLS

SEQ ID NO: 855991 - protein, 9 aa, Homo Sapiens
SLNEHMNIH

SEQ ID NO: 855992 - protein, 9 aa, Homo Sapiens
AKRRTSTFS

SEQ ID NO: 855993 - protein, 9 aa, Homo Sapiens
KAQQKAKVS

SEQ ID NO: 855994 - protein, 9 aa, Homo Sapiens
IIAPVRSRS

SEQ ID NO: 855995 - protein, 9 aa, Homo Sapiens
KMCQWYQNS

SEQ ID NO: 855996 - protein, 9 aa, Homo Sapiens
VIAEKYHQE

SEQ ID NO: 855997 - protein, 9 aa, Homo Sapiens
TFLEKIVCN

SEQ ID NO: 855998 - protein, 9 aa, Homo Sapiens
KRGRKCRRI

SEQ ID NO: 855999 - protein, 9 aa, Homo Sapiens
DPMSKQEDS

SEQ ID NO: 856000 - protein, 9 aa, Homo Sapiens
SVEYHYLVS

SEQ ID NO: 856001 - protein, 9 aa, Homo Sapiens
RRHIYNRYQ

SEQ ID NO: 856002 - protein, 9 aa, Homo Sapiens
KPDITWFQI

SEQ ID NO: 856003 - protein, 9 aa, Homo Sapiens
YPQTNVFAI

SEQ ID NO: 856004 - protein, 9 aa, Homo Sapiens
SVGSLPPSK

SEQ ID NO: 856005 - protein, 9 aa, Homo Sapiens
NLKQACLPS

SEQ ID NO: 856006 - protein, 9 aa, Homo Sapiens
NNNKCPYFS

SEQ ID NO: 856007 - protein, 9 aa, Homo Sapiens
PNQVDYFLC

SEQ ID NO: 856008 - protein, 9 aa, Homo Sapiens
DKSVEVPKE

SEQ ID NO: 856009 - protein, 9 aa, Homo Sapiens
QETLAAAVQ

SEQ ID NO: 856010 - protein, 9 aa, Homo Sapiens
CEEPTCRNQ

SEQ ID NO: 856011 - protein, 9 aa, Homo Sapiens
KPFFLGPQR

SEQ ID NO: 856012 - protein, 9 aa, Homo Sapiens
FISASKIEL

SEQ ID NO: 856013 - protein, 9 aa, Homo Sapiens
SMVSVPVFI

SEQ ID NO: 856014 - protein, 9 aa, Homo Sapiens
LKSIMNKRD

SEQ ID NO: 856015 - protein, 9 aa, Homo Sapiens
CGHRSGRSY

SEQ ID NO: 856016 - protein, 9 aa, Homo Sapiens
DNSSGYKDL

SEQ ID NO: 856017 - protein, 9 aa, Homo Sapiens
RAIINTDFE

SEQ ID NO: 856018 - protein, 9 aa, Homo Sapiens
LLDMATHPA

SEQ ID NO: 856019 - protein, 9 aa, Homo Sapiens
CIDILLERL

SEQ ID NO: 856020 - protein, 9 aa, Homo Sapiens
YLACRDVEQ

SEQ ID NO: 856021 - protein, 9 aa, Homo Sapiens
TYKTAAEMV

SEQ ID NO: 856022 - protein, 9 aa, Homo Sapiens
KSLEESRKV

SEQ ID NO: 856023 - protein, 9 aa, Homo Sapiens
NAVLKSLSP

SEQ ID NO: 856024 - protein, 9 aa, Homo Sapiens
PCRCPAHAG

SEQ ID NO: 856025 - protein, 9 aa, Homo Sapiens
LHAWPKCLT

SEQ ID NO: 856026 - protein, 9 aa, Homo Sapiens
DEEKKYLSN

SEQ ID NO: 856027 - protein, 9 aa, Homo Sapiens
DDEEEEESF

SEQ ID NO: 856028 - protein, 9 aa, Homo Sapiens
GRTPLMIAL

SEQ ID NO: 856029 - protein, 9 aa, Homo Sapiens
PNKSTGGEH

SEQ ID NO: 856030 - protein, 9 aa, Homo Sapiens
DKFCDPQMC

SEQ ID NO: 856031 - protein, 9 aa, Homo Sapiens
NTWKKKYVT

SEQ ID NO: 856032 - protein, 9 aa, Homo Sapiens
VVETYPSPY

SEQ ID NO: 856033 - protein, 9 aa, Homo Sapiens
GVFIGWNIN

SEQ ID NO: 856034 - protein, 9 aa, Homo Sapiens
HTNIISLLN

SEQ ID NO: 856035 - protein, 9 aa, Homo Sapiens
PVVGLTIRD

SEQ ID NO: 856036 - protein, 9 aa, Homo Sapiens
KQAEVFQDT

SEQ ID NO: 856037 - protein, 9 aa, Homo Sapiens
LGNGALLCQ

SEQ ID NO: 856038 - protein, 9 aa, Homo Sapiens
YMYRIIHEA

SEQ ID NO: 856039 - protein, 9 aa, Homo Sapiens
DYHGHSQKK

SEQ ID NO: 856040 - protein, 9 aa, Homo Sapiens
LMESVTEAG

SEQ ID NO: 856041 - protein, 9 aa, Homo Sapiens
NRQMKINTY

SEQ ID NO: 856042 - protein, 9 aa, Homo Sapiens
HFDHIWQKN

SEQ ID NO: 856043 - protein, 9 aa, Homo Sapiens
TMDDSKNNF

SEQ ID NO: 856044 - protein, 9 aa, Homo Sapiens
ILLCNPKHS

SEQ ID NO: 856045 - protein, 9 aa, Homo Sapiens
NSAAWAVYY

SEQ ID NO: 856046 - protein, 9 aa, Homo Sapiens
VSEPIKGHE

SEQ ID NO: 856047 - protein, 9 aa, Homo Sapiens
VFINKGKEF

SEQ ID NO: 856048 - protein, 9 aa, Homo Sapiens
NDPKCCGFV

SEQ ID NO: 856049 - protein, 9 aa, Homo Sapiens
DSNPNGSWG

SEQ ID NO: 856050 - protein, 9 aa, Homo Sapiens
FGFITFMYF

SEQ ID NO: 856051 - protein, 9 aa, Homo Sapiens
LQQANDDLA

SEQ ID NO: 856052 - protein, 9 aa, Homo Sapiens
QMLGGFLVS

SEQ ID NO: 856053 - protein, 9 aa, Homo Sapiens
PGHIHLPYW

SEQ ID NO: 856054 - protein, 9 aa, Homo Sapiens
ISKMNRLFS

SEQ ID NO: 856055 - protein, 9 aa, Homo Sapiens
DALGVWRRD

SEQ ID NO: 856056 - protein, 9 aa, Homo Sapiens
ILLGLTDNY

SEQ ID NO: 856057 - protein, 9 aa, Homo Sapiens
NTPLCEQGL

SEQ ID NO: 856058 - protein, 9 aa, Homo Sapiens
DRCFRVDLV

SEQ ID NO: 856059 - protein, 9 aa, Homo Sapiens
PEERYDSHV

SEQ ID NO: 856060 - protein, 9 aa, Homo Sapiens
PPKPLKKLC

SEQ ID NO: 856061 - protein, 9 aa, Homo Sapiens
ANRRDVCSC

SEQ ID NO: 856062 - protein, 9 aa, Homo Sapiens
DKEEDKEKE

SEQ ID NO: 856063 - protein, 9 aa, Homo Sapiens
PSKLMTPYI

SEQ ID NO: 856064 - protein, 9 aa, Homo Sapiens
IVQEDAQPP

SEQ ID NO: 856065 - protein, 9 aa, Homo Sapiens
SCVPISTEL

SEQ ID NO: 856066 - protein, 9 aa, Homo Sapiens
EITFTTKVL

SEQ ID NO: 856067 - protein, 9 aa, Homo Sapiens
NHARKYNFP

SEQ ID NO: 856068 - protein, 9 aa, Homo Sapiens
LCGAEVPEV

SEQ ID NO: 856069 - protein, 9 aa, Homo Sapiens
LENEQSINL

SEQ ID NO: 856070 - protein, 9 aa, Homo Sapiens
PRVELLKKE

SEQ ID NO: 856071 - protein, 9 aa, Homo Sapiens
DKYVNIVQF

SEQ ID NO: 856072 - protein, 9 aa, Homo Sapiens
ETGNNWIEG

SEQ ID NO: 856073 - protein, 9 aa, Homo Sapiens
QVKQRPTSS

SEQ ID NO: 856074 - protein, 9 aa, Homo Sapiens
WGPEIETEV

SEQ ID NO: 856075 - protein, 9 aa, Homo Sapiens
LVMYLGFKR

SEQ ID NO: 856076 - protein, 9 aa, Homo Sapiens
YLIRKSGYF

SEQ ID NO: 856077 - protein, 9 aa, Homo Sapiens
TTLGPGPHH

SEQ ID NO: 856078 - protein, 9 aa, Homo Sapiens
AESQFNKLK

SEQ ID NO: 856079 - protein, 9 aa, Homo Sapiens
YQTPDLAIQ

SEQ ID NO: 856080 - protein, 9 aa, Homo Sapiens
APSHGALSP

SEQ ID NO: 856081 - protein, 9 aa, Homo Sapiens
NTAYTYATV

SEQ ID NO: 856082 - protein, 9 aa, Homo Sapiens
GKLDKLENS

SEQ ID NO: 856083 - protein, 9 aa, Homo Sapiens
EKTYGNYYW

SEQ ID NO: 856084 - protein, 9 aa, Homo Sapiens
SPRLECSDT

SEQ ID NO: 856085 - protein, 9 aa, Homo Sapiens
QDVNDMYLP

SEQ ID NO: 856086 - protein, 9 aa, Homo Sapiens
KEHQQIHTG

SEQ ID NO: 856087 - protein, 9 aa, Homo Sapiens
AVRNYWRGL

SEQ ID NO: 856088 - protein, 9 aa, Homo Sapiens
SFVENDMFV

SEQ ID NO: 856089 - protein, 9 aa, Homo Sapiens
ISAPLPLEN

SEQ ID NO: 856090 - protein, 9 aa, Homo Sapiens
LCTLVATIW

SEQ ID NO: 856091 - protein, 9 aa, Homo Sapiens
NGDLREAFR

SEQ ID NO: 856092 - protein, 9 aa, Homo Sapiens
MRKMLQEIC

SEQ ID NO: 856093 - protein, 9 aa, Homo Sapiens
NEKSVLLWD

SEQ ID NO: 856094 - protein, 9 aa, Homo Sapiens
TVMKKVLVA

SEQ ID NO: 856095 - protein, 9 aa, Homo Sapiens
RNFCKYVVS

SEQ ID NO: 856096 - protein, 9 aa, Homo Sapiens
RKIFDLCIV

SEQ ID NO: 856097 - protein, 9 aa, Homo Sapiens
PEAVLLKRL

SEQ ID NO: 856098 - protein, 9 aa, Homo Sapiens
DNNLNAIQT

SEQ ID NO: 856099 - protein, 9 aa, Homo Sapiens
CGISANDTS

SEQ ID NO: 856100 - protein, 9 aa, Homo Sapiens
TTIQVQSSE

SEQ ID NO: 856101 - protein, 9 aa, Homo Sapiens
YLIQHQKLH

SEQ ID NO: 856102 - protein, 9 aa, Homo Sapiens
ANNVPRQNS

SEQ ID NO: 856103 - protein, 9 aa, Homo Sapiens
NWRERAELR

SEQ ID NO: 856104 - protein, 9 aa, Homo Sapiens
NYGSPLELY

SEQ ID NO: 856105 - protein, 9 aa, Homo Sapiens
DESSSMVLR

SEQ ID NO: 856106 - protein, 9 aa, Homo Sapiens
LLNDHKVFV

SEQ ID NO: 856107 - protein, 9 aa, Homo Sapiens
AIHFRLEQV

SEQ ID NO: 856108 - protein, 9 aa, Homo Sapiens
EDEEATPHK

SEQ ID NO: 856109 - protein, 9 aa, Homo Sapiens
KELVNILHK

SEQ ID NO: 856110 - protein, 9 aa, Homo Sapiens
LGVYQNGGY

SEQ ID NO: 856111 - protein, 9 aa, Homo Sapiens
VNIVNSKAI

SEQ ID NO: 856112 - protein, 9 aa, Homo Sapiens
KYTSVFEFN

SEQ ID NO: 856113 - protein, 9 aa, Homo Sapiens
DSLTTLPIL

SEQ ID NO: 856114 - protein, 9 aa, Homo Sapiens
EYAFHIFRD

SEQ ID NO: 856115 - protein, 9 aa, Homo Sapiens
FRRNSDLGV

SEQ ID NO: 856116 - protein, 9 aa, Homo Sapiens
QQLENKKTG

SEQ ID NO: 856117 - protein, 9 aa, Homo Sapiens
NSAVKTSRR

SEQ ID NO: 856118 - protein, 9 aa, Homo Sapiens
YVKFQMKQI

SEQ ID NO: 856119 - protein, 9 aa, Homo Sapiens
GCSVSIKIR

SEQ ID NO: 856120 - protein, 9 aa, Homo Sapiens
NREEHTEFV

SEQ ID NO: 856121 - protein, 9 aa, Homo Sapiens
HNAVKLGAF

SEQ ID NO: 856122 - protein, 9 aa, Homo Sapiens
TGLFRAWVW

SEQ ID NO: 856123 - protein, 9 aa, Homo Sapiens
MDADNPLHQ

SEQ ID NO: 856124 - protein, 9 aa, Homo Sapiens
PVCTVWYFP

SEQ ID NO: 856125 - protein, 9 aa, Homo Sapiens
GCPALLYKA

SEQ ID NO: 856126 - protein, 9 aa, Homo Sapiens
LYLIILVAN

SEQ ID NO: 856127 - protein, 9 aa, Homo Sapiens
LPAVFYLKR

SEQ ID NO: 856128 - protein, 9 aa, Homo Sapiens
VDDEIEETR

SEQ ID NO: 856129 - protein, 9 aa, Homo Sapiens
EEDEVWYLQ

SEQ ID NO: 856130 - protein, 9 aa, Homo Sapiens
VRTFKLPRL

SEQ ID NO: 856131 - protein, 9 aa, Homo Sapiens
SGFMEQLHT

SEQ ID NO: 856132 - protein, 9 aa, Homo Sapiens
VIPMLNLIM

SEQ ID NO: 856133 - protein, 9 aa, Homo Sapiens
DKSNDLLYQ

SEQ ID NO: 856134 - protein, 9 aa, Homo Sapiens
VTVSSFSLE

SEQ ID NO: 856135 - protein, 9 aa, Homo Sapiens
HLWLVFDEY

SEQ ID NO: 856136 - protein, 9 aa, Homo Sapiens
FLGDKSLPH

SEQ ID NO: 856137 - protein, 9 aa, Homo Sapiens
TWRNPWRCS

SEQ ID NO: 856138 - protein, 9 aa, Homo Sapiens
QENGEKVKH

SEQ ID NO: 856139 - protein, 9 aa, Homo Sapiens
ARAQEDVFQ

SEQ ID NO: 856140 - protein, 9 aa, Homo Sapiens
DKMAETTEL

SEQ ID NO: 856141 - protein, 9 aa, Homo Sapiens
AQPPGLKVW

SEQ ID NO: 856142 - protein, 9 aa, Homo Sapiens
PMSVMLFMH

SEQ ID NO: 856143 - protein, 9 aa, Homo Sapiens
THKSSAIDT

SEQ ID NO: 856144 - protein, 9 aa, Homo Sapiens
KENYNKFYE

SEQ ID NO: 856145 - protein, 9 aa, Homo Sapiens
GKKGVLDWR

SEQ ID NO: 856146 - protein, 9 aa, Homo Sapiens
IPYECIECG

SEQ ID NO: 856147 - protein, 9 aa, Homo Sapiens
NLEANISCY

SEQ ID NO: 856148 - protein, 9 aa, Homo Sapiens
ILHSHKTQS

SEQ ID NO: 856149 - protein, 9 aa, Homo Sapiens
GMLLNERKV

SEQ ID NO: 856150 - protein, 9 aa, Homo Sapiens
SPCLDCPSF

SEQ ID NO: 856151 - protein, 9 aa, Homo Sapiens
YKQVNKAIN

SEQ ID NO: 856152 - protein, 9 aa, Homo Sapiens
VLLAEGCLL

SEQ ID NO: 856153 - protein, 9 aa, Homo Sapiens
VVALASVYS

SEQ ID NO: 856154 - protein, 9 aa, Homo Sapiens
LEDRLFEHE

SEQ ID NO: 856155 - protein, 9 aa, Homo Sapiens
PPNSVDGLL

SEQ ID NO: 856156 - protein, 9 aa, Homo Sapiens
MDVWGFSAT

SEQ ID NO: 856157 - protein, 9 aa, Homo Sapiens
EDISELKAE

SEQ ID NO: 856158 - protein, 9 aa, Homo Sapiens
RDQAVMPCW

SEQ ID NO: 856159 - protein, 9 aa, Homo Sapiens
FDVLFRSVI

SEQ ID NO: 856160 - protein, 9 aa, Homo Sapiens
GQEDEMDIY

SEQ ID NO: 856161 - protein, 9 aa, Homo Sapiens
RLLQNVNDT

SEQ ID NO: 856162 - protein, 9 aa, Homo Sapiens
HYYLTYLYT

SEQ ID NO: 856163 - protein, 9 aa, Homo Sapiens
QYPHLAPPY

SEQ ID NO: 856164 - protein, 9 aa, Homo Sapiens
LLFLLQQKP

SEQ ID NO: 856165 - protein, 9 aa, Homo Sapiens
DTRLFKPCC

SEQ ID NO: 856166 - protein, 9 aa, Homo Sapiens
AVTILPKQA

SEQ ID NO: 856167 - protein, 9 aa, Homo Sapiens
IYDQRRIDT

SEQ ID NO: 856168 - protein, 9 aa, Homo Sapiens
IPRQNIWDE

SEQ ID NO: 856169 - protein, 9 aa, Homo Sapiens
LLSLRVNAL

SEQ ID NO: 856170 - protein, 9 aa, Homo Sapiens
GDFDGGNFD

SEQ ID NO: 856171 - protein, 9 aa, Homo Sapiens
EKPVATNSC

SEQ ID NO: 856172 - protein, 9 aa, Homo Sapiens
SFHPIPTQS

SEQ ID NO: 856173 - protein, 9 aa, Homo Sapiens
FHPRTSSNA

SEQ ID NO: 856174 - protein, 9 aa, Homo Sapiens
PASVEASQP

SEQ ID NO: 856175 - protein, 9 aa, Homo Sapiens
SNYELFENQ

SEQ ID NO: 856176 - protein, 9 aa, Homo Sapiens
IPYGAGRTK

SEQ ID NO: 856177 - protein, 9 aa, Homo Sapiens
TVLPNKAPV

SEQ ID NO: 856178 - protein, 9 aa, Homo Sapiens
KSWTQRSQQ

SEQ ID NO: 856179 - protein, 9 aa, Homo Sapiens
TEKESKKRL

SEQ ID NO: 856180 - protein, 9 aa, Homo Sapiens
HKYYFTSSR

SEQ ID NO: 856181 - protein, 9 aa, Homo Sapiens
YFETFISAS

SEQ ID NO: 856182 - protein, 9 aa, Homo Sapiens
KVEASQKKS

SEQ ID NO: 856183 - protein, 9 aa, Homo Sapiens
RHRRINTGE

SEQ ID NO: 856184 - protein, 9 aa, Homo Sapiens
KEMLRQFST

SEQ ID NO: 856185 - protein, 9 aa, Homo Sapiens
LLGRWAILA

SEQ ID NO: 856186 - protein, 9 aa, Homo Sapiens
EDDIPQGKR

SEQ ID NO: 856187 - protein, 9 aa, Homo Sapiens
VWDSNAHTT

SEQ ID NO: 856188 - protein, 9 aa, Homo Sapiens
TRDYQTNIG

SEQ ID NO: 856189 - protein, 9 aa, Homo Sapiens
TDFVAKFYQ

SEQ ID NO: 856190 - protein, 9 aa, Homo Sapiens
VKVVKPLDY

SEQ ID NO: 856191 - protein, 9 aa, Homo Sapiens
GDANYVDPI

SEQ ID NO: 856192 - protein, 9 aa, Homo Sapiens
KTTFAWHTK

SEQ ID NO: 856193 - protein, 9 aa, Homo Sapiens
GWLHWGPAG

SEQ ID NO: 856194 - protein, 9 aa, Homo Sapiens
VEDDNILPL

SEQ ID NO: 856195 - protein, 9 aa, Homo Sapiens
KILRVTNEP

SEQ ID NO: 856196 - protein, 9 aa, Homo Sapiens
DFADCMDFQ

SEQ ID NO: 856197 - protein, 9 aa, Homo Sapiens
SYGQERCCH

SEQ ID NO: 856198 - protein, 9 aa, Homo Sapiens
ITWFQILLN

SEQ ID NO: 856199 - protein, 9 aa, Homo Sapiens
MALAEATVV

SEQ ID NO: 856200 - protein, 9 aa, Homo Sapiens
AKKDYLGKV

SEQ ID NO: 856201 - protein, 9 aa, Homo Sapiens
PALGLLDGV

SEQ ID NO: 856202 - protein, 9 aa, Homo Sapiens
KMKTLNRKN

SEQ ID NO: 856203 - protein, 9 aa, Homo Sapiens
NSCPGEWLS

SEQ ID NO: 856204 - protein, 9 aa, Homo Sapiens
PLMAQQHYY

SEQ ID NO: 856205 - protein, 9 aa, Homo Sapiens
LAPPLRPAH

SEQ ID NO: 856206 - protein, 9 aa, Homo Sapiens
LCLDASENR

SEQ ID NO: 856207 - protein, 9 aa, Homo Sapiens
LDISIVRLK

SEQ ID NO: 856208 - protein, 9 aa, Homo Sapiens
VVPALRESS

SEQ ID NO: 856209 - protein, 9 aa, Homo Sapiens
QAVVITVGG

SEQ ID NO: 856210 - protein, 9 aa, Homo Sapiens
QLQEPNTDQ

SEQ ID NO: 856211 - protein, 9 aa, Homo Sapiens
WKHDYVGER

SEQ ID NO: 856212 - protein, 9 aa, Homo Sapiens
KRCMLQADS

SEQ ID NO: 856213 - protein, 9 aa, Homo Sapiens
FEEGKKIYL

SEQ ID NO: 856214 - protein, 9 aa, Homo Sapiens
SYTLIQTDT

SEQ ID NO: 856215 - protein, 9 aa, Homo Sapiens
GKSFSLGYI

SEQ ID NO: 856216 - protein, 9 aa, Homo Sapiens
AQQHYYGKK

SEQ ID NO: 856217 - protein, 9 aa, Homo Sapiens
PSDPPFNTQ

SEQ ID NO: 856218 - protein, 9 aa, Homo Sapiens
YWDVDVTHS

SEQ ID NO: 856219 - protein, 9 aa, Homo Sapiens
HYLSNLIPS

SEQ ID NO: 856220 - protein, 9 aa, Homo Sapiens
QKFIKEPSK

SEQ ID NO: 856221 - protein, 9 aa, Homo Sapiens
LACDPALPS

SEQ ID NO: 856222 - protein, 9 aa, Homo Sapiens
LVFVSHVIY

SEQ ID NO: 856223 - protein, 9 aa, Homo Sapiens
EFEIDVAGT

SEQ ID NO: 856224 - protein, 9 aa, Homo Sapiens
QVPCSLECW

SEQ ID NO: 856225 - protein, 9 aa, Homo Sapiens
LGMCCYVLS

SEQ ID NO: 856226 - protein, 9 aa, Homo Sapiens
FMPIAPTGE

SEQ ID NO: 856227 - protein, 9 aa, Homo Sapiens
SNNEIDIDA

SEQ ID NO: 856228 - protein, 9 aa, Homo Sapiens
KLCGAEVPE

SEQ ID NO: 856229 - protein, 9 aa, Homo Sapiens
SNQNVYPSQ

SEQ ID NO: 856230 - protein, 9 aa, Homo Sapiens
WFQDEEDDD

SEQ ID NO: 856231 - protein, 9 aa, Homo Sapiens
DSSSPATNY

SEQ ID NO: 856232 - protein, 9 aa, Homo Sapiens
PHLSTKKPM

SEQ ID NO: 856233 - protein, 9 aa, Homo Sapiens
PALLVYLIH

SEQ ID NO: 856234 - protein, 9 aa, Homo Sapiens
KGDQRRARM

SEQ ID NO: 856235 - protein, 9 aa, Homo Sapiens
KYMKTPPGI

SEQ ID NO: 856236 - protein, 9 aa, Homo Sapiens
VHADPEKED

SEQ ID NO: 856237 - protein, 9 aa, Homo Sapiens
DTINTTDGS

SEQ ID NO: 856238 - protein, 9 aa, Homo Sapiens
TRAHLGANE

SEQ ID NO: 856239 - protein, 9 aa, Homo Sapiens
TKDIMKILN

SEQ ID NO: 856240 - protein, 9 aa, Homo Sapiens
SHIHYWVFQ

SEQ ID NO: 856241 - protein, 9 aa, Homo Sapiens
KSVHILSWF

SEQ ID NO: 856242 - protein, 9 aa, Homo Sapiens
DTQNVTFVF

SEQ ID NO: 856243 - protein, 9 aa, Homo Sapiens
KCYHYTWKT

SEQ ID NO: 856244 - protein, 9 aa, Homo Sapiens
LEWPLAEVA

SEQ ID NO: 856245 - protein, 9 aa, Homo Sapiens
LCYAARVNK

SEQ ID NO: 856246 - protein, 9 aa, Homo Sapiens
MVLANNRRE

SEQ ID NO: 856247 - protein, 9 aa, Homo Sapiens
RRRVRTLIA

SEQ ID NO: 856248 - protein, 9 aa, Homo Sapiens
TLNGKTMTK

SEQ ID NO: 856249 - protein, 9 aa, Homo Sapiens
QQVLDNLTM

SEQ ID NO: 856250 - protein, 9 aa, Homo Sapiens
LLYKKMKGG

SEQ ID NO: 856251 - protein, 9 aa, Homo Sapiens
FLNYLPEEM

SEQ ID NO: 856252 - protein, 9 aa, Homo Sapiens
KLKMDDDEV

SEQ ID NO: 856253 - protein, 9 aa, Homo Sapiens
LVTIMGNIL

SEQ ID NO: 856254 - protein, 9 aa, Homo Sapiens
AKACSCQRC

SEQ ID NO: 856255 - protein, 9 aa, Homo Sapiens
EALERNIVS

SEQ ID NO: 856256 - protein, 9 aa, Homo Sapiens
ENNFDEFSK

SEQ ID NO: 856257 - protein, 9 aa, Homo Sapiens
LRKDISTNT

SEQ ID NO: 856258 - protein, 9 aa, Homo Sapiens
DMRLTKLAE

SEQ ID NO: 856259 - protein, 9 aa, Homo Sapiens
ARRIALASR

SEQ ID NO: 856260 - protein, 9 aa, Homo Sapiens
LLLEGKNYL

SEQ ID NO: 856261 - protein, 9 aa, Homo Sapiens
ALLPDEQKE

SEQ ID NO: 856262 - protein, 9 aa, Homo Sapiens
GPLKPMPFS

SEQ ID NO: 856263 - protein, 9 aa, Homo Sapiens
QGLKGLFNN

SEQ ID NO: 856264 - protein, 9 aa, Homo Sapiens
AVCPHPPTA

SEQ ID NO: 856265 - protein, 9 aa, Homo Sapiens
RKIDQSECE

SEQ ID NO: 856266 - protein, 9 aa, Homo Sapiens
ITGVKPYLT

SEQ ID NO: 856267 - protein, 9 aa, Homo Sapiens
SLPPSKIAS

SEQ ID NO: 856268 - protein, 9 aa, Homo Sapiens
YQDTARLME

SEQ ID NO: 856269 - protein, 9 aa, Homo Sapiens
GCCLTREVQ

SEQ ID NO: 856270 - protein, 9 aa, Homo Sapiens
HISTNPRLA

SEQ ID NO: 856271 - protein, 9 aa, Homo Sapiens
ALTEKFRTM

SEQ ID NO: 856272 - protein, 9 aa, Homo Sapiens
MPQWRCRHP

SEQ ID NO: 856273 - protein, 9 aa, Homo Sapiens
VAAAQGPNT

SEQ ID NO: 856274 - protein, 9 aa, Homo Sapiens
RQSILGTPL

SEQ ID NO: 856275 - protein, 9 aa, Homo Sapiens
LWYIELALT

SEQ ID NO: 856276 - protein, 9 aa, Homo Sapiens
NAQNGVALT

SEQ ID NO: 856277 - protein, 9 aa, Homo Sapiens
KAENHFSMA

SEQ ID NO: 856278 - protein, 9 aa, Homo Sapiens
LRHGNWYIQ

SEQ ID NO: 856279 - protein, 9 aa, Homo Sapiens
GLPAPNNDF

SEQ ID NO: 856280 - protein, 9 aa, Homo Sapiens
AIGGRYGSS

SEQ ID NO: 856281 - protein, 9 aa, Homo Sapiens
QLDAQKSAV

SEQ ID NO: 856282 - protein, 9 aa, Homo Sapiens
PVTFPSLPR

SEQ ID NO: 856283 - protein, 9 aa, Homo Sapiens
SSWTPLKFL

SEQ ID NO: 856284 - protein, 9 aa, Homo Sapiens
LKSWNGEDR

SEQ ID NO: 856285 - protein, 9 aa, Homo Sapiens
SYKSICYLG

SEQ ID NO: 856286 - protein, 9 aa, Homo Sapiens
SWKITLPVG

SEQ ID NO: 856287 - protein, 9 aa, Homo Sapiens
ALGNGSLTP

SEQ ID NO: 856288 - protein, 9 aa, Homo Sapiens
GRQTVPSGL

SEQ ID NO: 856289 - protein, 9 aa, Homo Sapiens
CRRQNGYRA

SEQ ID NO: 856290 - protein, 9 aa, Homo Sapiens
DYVHRKFRL

SEQ ID NO: 856291 - protein, 9 aa, Homo Sapiens
EITLELSCL

SEQ ID NO: 856292 - protein, 9 aa, Homo Sapiens
RDCMDPTMD

SEQ ID NO: 856293 - protein, 9 aa, Homo Sapiens
LPRDITQER

SEQ ID NO: 856294 - protein, 9 aa, Homo Sapiens
TLLRNLGLY

SEQ ID NO: 856295 - protein, 9 aa, Homo Sapiens
MINVCPLRG

SEQ ID NO: 856296 - protein, 9 aa, Homo Sapiens
KGQECLKQL

SEQ ID NO: 856297 - protein, 9 aa, Homo Sapiens
IIAATIDNA

SEQ ID NO: 856298 - protein, 9 aa, Homo Sapiens
SSFYFTVTA

SEQ ID NO: 856299 - protein, 9 aa, Homo Sapiens
FTSWPGHGV

SEQ ID NO: 856300 - protein, 9 aa, Homo Sapiens
PTYVGKEES

SEQ ID NO: 856301 - protein, 9 aa, Homo Sapiens
RLEPQEPNY

SEQ ID NO: 856302 - protein, 9 aa, Homo Sapiens
LVVAIILAG

SEQ ID NO: 856303 - protein, 9 aa, Homo Sapiens
LGSCKRIEE

SEQ ID NO: 856304 - protein, 9 aa, Homo Sapiens
GVPCVGGDG

SEQ ID NO: 856305 - protein, 9 aa, Homo Sapiens
AQVITLTDN

SEQ ID NO: 856306 - protein, 9 aa, Homo Sapiens
HPGHFSTAS

SEQ ID NO: 856307 - protein, 9 aa, Homo Sapiens
AKNNTLQFT

SEQ ID NO: 856308 - protein, 9 aa, Homo Sapiens
KYGLLLLLK

SEQ ID NO: 856309 - protein, 9 aa, Homo Sapiens
PLAEVAEGV

SEQ ID NO: 856310 - protein, 9 aa, Homo Sapiens
PAKEDNSCS

SEQ ID NO: 856311 - protein, 9 aa, Homo Sapiens
SSWCLNKPG

SEQ ID NO: 856312 - protein, 9 aa, Homo Sapiens
SFSSLFKNM

SEQ ID NO: 856313 - protein, 9 aa, Homo Sapiens
QQKRQNGQT

SEQ ID NO: 856314 - protein, 9 aa, Homo Sapiens
TEKRIKALH

SEQ ID NO: 856315 - protein, 9 aa, Homo Sapiens
RSAAAAAVV

SEQ ID NO: 856316 - protein, 9 aa, Homo Sapiens
SQKLFYLGA

SEQ ID NO: 856317 - protein, 9 aa, Homo Sapiens
FGSNTKNNK

SEQ ID NO: 856318 - protein, 9 aa, Homo Sapiens
TEPPTKSMM

SEQ ID NO: 856319 - protein, 9 aa, Homo Sapiens
PVPLECLDN

SEQ ID NO: 856320 - protein, 9 aa, Homo Sapiens
QIIRSCKAK

SEQ ID NO: 856321 - protein, 9 aa, Homo Sapiens
YVRKERRRH

SEQ ID NO: 856322 - protein, 9 aa, Homo Sapiens
LLRDPDRTV

SEQ ID NO: 856323 - protein, 9 aa, Homo Sapiens
VNLKKTIRI

SEQ ID NO: 856324 - protein, 9 aa, Homo Sapiens
LIQATAANY

SEQ ID NO: 856325 - protein, 9 aa, Homo Sapiens
NLQFQICYG

SEQ ID NO: 856326 - protein, 9 aa, Homo Sapiens
MAFMDISVT

SEQ ID NO: 856327 - protein, 9 aa, Homo Sapiens
VTTSVGLPH

SEQ ID NO: 856328 - protein, 9 aa, Homo Sapiens
ELSWLQNTN

SEQ ID NO: 856329 - protein, 9 aa, Homo Sapiens
GDKPHKCKE

SEQ ID NO: 856330 - protein, 9 aa, Homo Sapiens
YSFDKLKLA

SEQ ID NO: 856331 - protein, 9 aa, Homo Sapiens
VEYLSKATQ

SEQ ID NO: 856332 - protein, 9 aa, Homo Sapiens
NVALNNSGS

SEQ ID NO: 856333 - protein, 9 aa, Homo Sapiens
QRAQMEMKP

SEQ ID NO: 856334 - protein, 9 aa, Homo Sapiens
QDSMDVMVF

SEQ ID NO: 856335 - protein, 9 aa, Homo Sapiens
LQLPIIQLR

SEQ ID NO: 856336 - protein, 9 aa, Homo Sapiens
DNVAVDFTQ

SEQ ID NO: 856337 - protein, 9 aa, Homo Sapiens
VMALIIYML

SEQ ID NO: 856338 - protein, 9 aa, Homo Sapiens
TENETMSKI

SEQ ID NO: 856339 - protein, 9 aa, Homo Sapiens
ERTLDDDDM

SEQ ID NO: 856340 - protein, 9 aa, Homo Sapiens
EHYKDPSLC

SEQ ID NO: 856341 - protein, 9 aa, Homo Sapiens
TRSTSPIYH

SEQ ID NO: 856342 - protein, 9 aa, Homo Sapiens
TQPKGPMSI

SEQ ID NO: 856343 - protein, 9 aa, Homo Sapiens
VARSINGII

SEQ ID NO: 856344 - protein, 9 aa, Homo Sapiens
EEGSGSHEG

SEQ ID NO: 856345 - protein, 9 aa, Homo Sapiens
NINVITGIL

SEQ ID NO: 856346 - protein, 9 aa, Homo Sapiens
EVSEQMKIV

SEQ ID NO: 856347 - protein, 9 aa, Homo Sapiens
QDPLHPDTW

SEQ ID NO: 856348 - protein, 9 aa, Homo Sapiens
ELSGKLDTT

SEQ ID NO: 856349 - protein, 9 aa, Homo Sapiens
SSVAVDLPV

SEQ ID NO: 856350 - protein, 9 aa, Homo Sapiens
RHVGRPWLL

SEQ ID NO: 856351 - protein, 9 aa, Homo Sapiens
EAVLYVKEE

SEQ ID NO: 856352 - protein, 9 aa, Homo Sapiens
DNLLRGDNS

SEQ ID NO: 856353 - protein, 9 aa, Homo Sapiens
NKRKRHFQA

SEQ ID NO: 856354 - protein, 9 aa, Homo Sapiens
DGDKMYVES

SEQ ID NO: 856355 - protein, 9 aa, Homo Sapiens
HGPPLQAQS

SEQ ID NO: 856356 - protein, 9 aa, Homo Sapiens
YIIVCENSK

SEQ ID NO: 856357 - protein, 9 aa, Homo Sapiens
LHSFEVYDP

SEQ ID NO: 856358 - protein, 9 aa, Homo Sapiens
HLNDHWRIH

SEQ ID NO: 856359 - protein, 9 aa, Homo Sapiens
CIPMQVPSY

SEQ ID NO: 856360 - protein, 9 aa, Homo Sapiens
YTCEDNSLP

SEQ ID NO: 856361 - protein, 9 aa, Homo Sapiens
FDFLKVPQI

SEQ ID NO: 856362 - protein, 9 aa, Homo Sapiens
QKQALFKTK

SEQ ID NO: 856363 - protein, 9 aa, Homo Sapiens
WEFGRETNN

SEQ ID NO: 856364 - protein, 9 aa, Homo Sapiens
SHNQIDLMD

SEQ ID NO: 856365 - protein, 9 aa, Homo Sapiens
ITLINWWVM

SEQ ID NO: 856366 - protein, 9 aa, Homo Sapiens
FWSFTLYMT

SEQ ID NO: 856367 - protein, 9 aa, Homo Sapiens
PDWVEAACQ

SEQ ID NO: 856368 - protein, 9 aa, Homo Sapiens
KKKTRSKAK

SEQ ID NO: 856369 - protein, 9 aa, Homo Sapiens
ICYRQMLFC

SEQ ID NO: 856370 - protein, 9 aa, Homo Sapiens
QELKPQSLQ

SEQ ID NO: 856371 - protein, 9 aa, Homo Sapiens
FKRPFSTPA

SEQ ID NO: 856372 - protein, 9 aa, Homo Sapiens
SQPTGANRR

SEQ ID NO: 856373 - protein, 9 aa, Homo Sapiens
LYLATFDLK

SEQ ID NO: 856374 - protein, 9 aa, Homo Sapiens
DNEQLMEEI

SEQ ID NO: 856375 - protein, 9 aa, Homo Sapiens
LGRVFRSRC

SEQ ID NO: 856376 - protein, 9 aa, Homo Sapiens
MAMVRPIIS

SEQ ID NO: 856377 - protein, 9 aa, Homo Sapiens
RDARNKRIK

SEQ ID NO: 856378 - protein, 9 aa, Homo Sapiens
KVLSQCVTH

SEQ ID NO: 856379 - protein, 9 aa, Homo Sapiens
SRQPSSAGV

SEQ ID NO: 856380 - protein, 9 aa, Homo Sapiens
RLPLGATGL

SEQ ID NO: 856381 - protein, 9 aa, Homo Sapiens
KTKANLNAL

SEQ ID NO: 856382 - protein, 9 aa, Homo Sapiens
KSTPDVKLT

SEQ ID NO: 856383 - protein, 9 aa, Homo Sapiens
TFLPTNKLE

SEQ ID NO: 856384 - protein, 9 aa, Homo Sapiens
SKLVDNSAC

SEQ ID NO: 856385 - protein, 9 aa, Homo Sapiens
DISSLHYEL

SEQ ID NO: 856386 - protein, 9 aa, Homo Sapiens
QGKYSGSWN

SEQ ID NO: 856387 - protein, 9 aa, Homo Sapiens
CGTFGATYL

SEQ ID NO: 856388 - protein, 9 aa, Homo Sapiens
PCEPFKCLE

SEQ ID NO: 856389 - protein, 9 aa, Homo Sapiens
YVPYDGIPC

SEQ ID NO: 856390 - protein, 9 aa, Homo Sapiens
ETTFPKTTP

SEQ ID NO: 856391 - protein, 9 aa, Homo Sapiens
DILAWKVSL

SEQ ID NO: 856392 - protein, 9 aa, Homo Sapiens
KKWNYCVRR

SEQ ID NO: 856393 - protein, 9 aa, Homo Sapiens
LDRPDIKVA

SEQ ID NO: 856394 - protein, 9 aa, Homo Sapiens
QKSMKGLYF

SEQ ID NO: 856395 - protein, 9 aa, Homo Sapiens
TLTRHRIIH

SEQ ID NO: 856396 - protein, 9 aa, Homo Sapiens
QCLPPTSSC

SEQ ID NO: 856397 - protein, 9 aa, Homo Sapiens
LVKSYLYQL

SEQ ID NO: 856398 - protein, 9 aa, Homo Sapiens
TAREFEIDV

SEQ ID NO: 856399 - protein, 9 aa, Homo Sapiens
ALRESSAPR

SEQ ID NO: 856400 - protein, 9 aa, Homo Sapiens
PILGSEPLN

SEQ ID NO: 856401 - protein, 9 aa, Homo Sapiens
SNGRRLRIS

SEQ ID NO: 856402 - protein, 9 aa, Homo Sapiens
YCCEECTFM

SEQ ID NO: 856403 - protein, 9 aa, Homo Sapiens
QDMDNNLNA

SEQ ID NO: 856404 - protein, 9 aa, Homo Sapiens
ITRNKEFAY

SEQ ID NO: 856405 - protein, 9 aa, Homo Sapiens
FIFKRNLFR

SEQ ID NO: 856406 - protein, 9 aa, Homo Sapiens
DHKHEFKRF

SEQ ID NO: 856407 - protein, 9 aa, Homo Sapiens
VCGTYFRNS

SEQ ID NO: 856408 - protein, 9 aa, Homo Sapiens
YELFENQYI

SEQ ID NO: 856409 - protein, 9 aa, Homo Sapiens
VYAGICLNL

SEQ ID NO: 856410 - protein, 9 aa, Homo Sapiens
EAKENLIMQ

SEQ ID NO: 856411 - protein, 9 aa, Homo Sapiens
QIISFYDSQ

SEQ ID NO: 856412 - protein, 9 aa, Homo Sapiens
QLNLYMRLE

SEQ ID NO: 856413 - protein, 9 aa, Homo Sapiens
YGLFHLKSY

SEQ ID NO: 856414 - protein, 9 aa, Homo Sapiens
TQVVSKLWV

SEQ ID NO: 856415 - protein, 9 aa, Homo Sapiens
TSYTLIQTD

SEQ ID NO: 856416 - protein, 9 aa, Homo Sapiens
VQKQQKQLQ

SEQ ID NO: 856417 - protein, 9 aa, Homo Sapiens
QYPEAVLLK

SEQ ID NO: 856418 - protein, 9 aa, Homo Sapiens
GPVRGEPVW

SEQ ID NO: 856419 - protein, 9 aa, Homo Sapiens
QNLEPKPLF

SEQ ID NO: 856420 - protein, 9 aa, Homo Sapiens
ATTAFPFLQ

SEQ ID NO: 856421 - protein, 9 aa, Homo Sapiens
FSNTPKELT

SEQ ID NO: 856422 - protein, 9 aa, Homo Sapiens
PLLLVQAGA

SEQ ID NO: 856423 - protein, 9 aa, Homo Sapiens
RGCTDYVSE

SEQ ID NO: 856424 - protein, 9 aa, Homo Sapiens
LARERIATY

SEQ ID NO: 856425 - protein, 9 aa, Homo Sapiens
VKVNCSDRV

SEQ ID NO: 856426 - protein, 9 aa, Homo Sapiens
IIYRDRNVP

SEQ ID NO: 856427 - protein, 9 aa, Homo Sapiens
VQMLQGAIS

SEQ ID NO: 856428 - protein, 9 aa, Homo Sapiens
SHEQCIQWL

SEQ ID NO: 856429 - protein, 9 aa, Homo Sapiens
ETLEIIPAS

SEQ ID NO: 856430 - protein, 9 aa, Homo Sapiens
VQMAVLISN

SEQ ID NO: 856431 - protein, 9 aa, Homo Sapiens
GPSSSVDLN

SEQ ID NO: 856432 - protein, 9 aa, Homo Sapiens
SEIRRSERN

SEQ ID NO: 856433 - protein, 9 aa, Homo Sapiens
SAACHGNLT

SEQ ID NO: 856434 - protein, 9 aa, Homo Sapiens
GSCGPIFQA

SEQ ID NO: 856435 - protein, 9 aa, Homo Sapiens
SGALNKCKP

SEQ ID NO: 856436 - protein, 9 aa, Homo Sapiens
KYGFFHESD

SEQ ID NO: 856437 - protein, 9 aa, Homo Sapiens
TFIGINFGL

SEQ ID NO: 856438 - protein, 9 aa, Homo Sapiens
EPPEIMEFS

SEQ ID NO: 856439 - protein, 9 aa, Homo Sapiens
RGEKNQQII

SEQ ID NO: 856440 - protein, 9 aa, Homo Sapiens
QNCIAAEFN

SEQ ID NO: 856441 - protein, 9 aa, Homo Sapiens
ANGGSKSDG

SEQ ID NO: 856442 - protein, 9 aa, Homo Sapiens
LFARFDQLA

SEQ ID NO: 856443 - protein, 9 aa, Homo Sapiens
TLRTESINE

SEQ ID NO: 856444 - protein, 9 aa, Homo Sapiens
LKHIHDRTI

SEQ ID NO: 856445 - protein, 9 aa, Homo Sapiens
SFKLFADKF

SEQ ID NO: 856446 - protein, 9 aa, Homo Sapiens
VLTEHKRLH

SEQ ID NO: 856447 - protein, 9 aa, Homo Sapiens
ASFQTEVSY

SEQ ID NO: 856448 - protein, 9 aa, Homo Sapiens
DILKEDTFH

SEQ ID NO: 856449 - protein, 9 aa, Homo Sapiens
CTEDRGNGI

SEQ ID NO: 856450 - protein, 9 aa, Homo Sapiens
AVKSALPTL

SEQ ID NO: 856451 - protein, 9 aa, Homo Sapiens
RSLEELTCL

SEQ ID NO: 856452 - protein, 9 aa, Homo Sapiens
VRESIIWKG

SEQ ID NO: 856453 - protein, 9 aa, Homo Sapiens
PIIDDNMLV

SEQ ID NO: 856454 - protein, 9 aa, Homo Sapiens
HRRFQNTLL

SEQ ID NO: 856455 - protein, 9 aa, Homo Sapiens
CLGQKPVLH

SEQ ID NO: 856456 - protein, 9 aa, Homo Sapiens
GERYKYMVD

SEQ ID NO: 856457 - protein, 9 aa, Homo Sapiens
KCGISANDT

SEQ ID NO: 856458 - protein, 9 aa, Homo Sapiens
PHLDSVGDI

SEQ ID NO: 856459 - protein, 9 aa, Homo Sapiens
ISKNIYWTD

SEQ ID NO: 856460 - protein, 9 aa, Homo Sapiens
KEDAGRMIQ

SEQ ID NO: 856461 - protein, 9 aa, Homo Sapiens
QWAFCMDNI

SEQ ID NO: 856462 - protein, 9 aa, Homo Sapiens
YEMVKYGFF

SEQ ID NO: 856463 - protein, 9 aa, Homo Sapiens
NITIIPLIW

SEQ ID NO: 856464 - protein, 9 aa, Homo Sapiens
DVLNNAIFD

SEQ ID NO: 856465 - protein, 9 aa, Homo Sapiens
LEKDEQVRR

SEQ ID NO: 856466 - protein, 9 aa, Homo Sapiens
VNEHEDGYG

SEQ ID NO: 856467 - protein, 9 aa, Homo Sapiens
LSKSCTMHS

SEQ ID NO: 856468 - protein, 9 aa, Homo Sapiens
VNMSWAKPV

SEQ ID NO: 856469 - protein, 9 aa, Homo Sapiens
RQNTKSSII

SEQ ID NO: 856470 - protein, 9 aa, Homo Sapiens
TTGTLSIEI

SEQ ID NO: 856471 - protein, 9 aa, Homo Sapiens
IFHLAMWTT

SEQ ID NO: 856472 - protein, 9 aa, Homo Sapiens
SCSPQKAKI

SEQ ID NO: 856473 - protein, 9 aa, Homo Sapiens
PIMNQWWRV

SEQ ID NO: 856474 - protein, 9 aa, Homo Sapiens
RHAQIRKTS

SEQ ID NO: 856475 - protein, 9 aa, Homo Sapiens
SEVGPVMSK

SEQ ID NO: 856476 - protein, 9 aa, Homo Sapiens
GGPVGTQVA

SEQ ID NO: 856477 - protein, 9 aa, Homo Sapiens
EIFKEMSNA

SEQ ID NO: 856478 - protein, 9 aa, Homo Sapiens
EEMCVETME

SEQ ID NO: 856479 - protein, 9 aa, Homo Sapiens
VATWQIIQA

SEQ ID NO: 856480 - protein, 9 aa, Homo Sapiens
ANRKKITNV

SEQ ID NO: 856481 - protein, 9 aa, Homo Sapiens
NVVTDHLIY

SEQ ID NO: 856482 - protein, 9 aa, Homo Sapiens
IIQPILDMA

SEQ ID NO: 856483 - protein, 9 aa, Homo Sapiens
MILMTNHLY

SEQ ID NO: 856484 - protein, 9 aa, Homo Sapiens
VMWMITISK

SEQ ID NO: 856485 - protein, 9 aa, Homo Sapiens
AVVWDAAII

SEQ ID NO: 856486 - protein, 9 aa, Homo Sapiens
MTKFERHTL

SEQ ID NO: 856487 - protein, 9 aa, Homo Sapiens
KASQDTINY

SEQ ID NO: 856488 - protein, 9 aa, Homo Sapiens
LSEIKCNSY

SEQ ID NO: 856489 - protein, 9 aa, Homo Sapiens
YTCGECGHC

SEQ ID NO: 856490 - protein, 9 aa, Homo Sapiens
PKIYLSNHY

SEQ ID NO: 856491 - protein, 9 aa, Homo Sapiens
LFVRDNNSP

SEQ ID NO: 856492 - protein, 9 aa, Homo Sapiens
MQVSKRMLV

SEQ ID NO: 856493 - protein, 9 aa, Homo Sapiens
FAIIVLMLA

SEQ ID NO: 856494 - protein, 9 aa, Homo Sapiens
AKKKRIHQQ

SEQ ID NO: 856495 - protein, 9 aa, Homo Sapiens
PPKDVIENY

SEQ ID NO: 856496 - protein, 9 aa, Homo Sapiens
EITGPKVAF

SEQ ID NO: 856497 - protein, 9 aa, Homo Sapiens
RKDKMYSFK

SEQ ID NO: 856498 - protein, 9 aa, Homo Sapiens
GNVAHTVIR

SEQ ID NO: 856499 - protein, 9 aa, Homo Sapiens
IKAINRTIF

SEQ ID NO: 856500 - protein, 9 aa, Homo Sapiens
LFEEKNQYT

SEQ ID NO: 856501 - protein, 9 aa, Homo Sapiens
SPLESNVKP

SEQ ID NO: 856502 - protein, 9 aa, Homo Sapiens
EEIKKIKYK

SEQ ID NO: 856503 - protein, 9 aa, Homo Sapiens
RKYFVESNL

SEQ ID NO: 856504 - protein, 9 aa, Homo Sapiens
VNVQDKQGT

SEQ ID NO: 856505 - protein, 9 aa, Homo Sapiens
TLHHEEVNS

SEQ ID NO: 856506 - protein, 9 aa, Homo Sapiens
YQNKMAECE

SEQ ID NO: 856507 - protein, 9 aa, Homo Sapiens
LIMNSIKKK

SEQ ID NO: 856508 - protein, 9 aa, Homo Sapiens
CWCPFGSEG

SEQ ID NO: 856509 - protein, 9 aa, Homo Sapiens
NKSSGSEYR

SEQ ID NO: 856510 - protein, 9 aa, Homo Sapiens
RCNMPLTHF

SEQ ID NO: 856511 - protein, 9 aa, Homo Sapiens
LNRFWLETL

SEQ ID NO: 856512 - protein, 9 aa, Homo Sapiens
KRNLFSRHQ

SEQ ID NO: 856513 - protein, 9 aa, Homo Sapiens
DRVEDLWRK

SEQ ID NO: 856514 - protein, 9 aa, Homo Sapiens
NNSGSCFIT

SEQ ID NO: 856515 - protein, 9 aa, Homo Sapiens
KVQEMTSQL

SEQ ID NO: 856516 - protein, 9 aa, Homo Sapiens
LAEEIPTPS

SEQ ID NO: 856517 - protein, 9 aa, Homo Sapiens
SMKKYLVMP

SEQ ID NO: 856518 - protein, 9 aa, Homo Sapiens
PSNNSSLDA

SEQ ID NO: 856519 - protein, 9 aa, Homo Sapiens
LYDYVERKQ

SEQ ID NO: 856520 - protein, 9 aa, Homo Sapiens
IIPKATEEV

SEQ ID NO: 856521 - protein, 9 aa, Homo Sapiens
LWFRDGVML

SEQ ID NO: 856522 - protein, 9 aa, Homo Sapiens
NKLQDKIEK

SEQ ID NO: 856523 - protein, 9 aa, Homo Sapiens
GEDDTNDGD

SEQ ID NO: 856524 - protein, 9 aa, Homo Sapiens
DERFLYMFM

SEQ ID NO: 856525 - protein, 9 aa, Homo Sapiens
SCSVLREWY

SEQ ID NO: 856526 - protein, 9 aa, Homo Sapiens
VLSHSSSFQ

SEQ ID NO: 856527 - protein, 9 aa, Homo Sapiens
HHVTVAGFI

SEQ ID NO: 856528 - protein, 9 aa, Homo Sapiens
TLNATLNNM

SEQ ID NO: 856529 - protein, 9 aa, Homo Sapiens
PADSNKTLD

SEQ ID NO: 856530 - protein, 9 aa, Homo Sapiens
WGYVLLILL

SEQ ID NO: 856531 - protein, 9 aa, Homo Sapiens
RRENNLEEA

SEQ ID NO: 856532 - protein, 9 aa, Homo Sapiens
MKWRRKAAY

SEQ ID NO: 856533 - protein, 9 aa, Homo Sapiens
NYVHRELLR

SEQ ID NO: 856534 - protein, 9 aa, Homo Sapiens
GANGEAGLE

SEQ ID NO: 856535 - protein, 9 aa, Homo Sapiens
TYCEVDIYE

SEQ ID NO: 856536 - protein, 9 aa, Homo Sapiens
DNKSMSQWE

SEQ ID NO: 856537 - protein, 9 aa, Homo Sapiens
KPDEEKKYL

SEQ ID NO: 856538 - protein, 9 aa, Homo Sapiens
RALNLTERQ

SEQ ID NO: 856539 - protein, 9 aa, Homo Sapiens
ITFPPASVE

SEQ ID NO: 856540 - protein, 9 aa, Homo Sapiens
INGNYNIMC

SEQ ID NO: 856541 - protein, 9 aa, Homo Sapiens
GLPAVPFEM

SEQ ID NO: 856542 - protein, 9 aa, Homo Sapiens
LQCEEFIYG

SEQ ID NO: 856543 - protein, 9 aa, Homo Sapiens
LRNEKPVSL

SEQ ID NO: 856544 - protein, 9 aa, Homo Sapiens
DVTMLFPDI

SEQ ID NO: 856545 - protein, 9 aa, Homo Sapiens
LDAQAKNEC

SEQ ID NO: 856546 - protein, 9 aa, Homo Sapiens
SRCLKADAL

SEQ ID NO: 856547 - protein, 9 aa, Homo Sapiens
QDHPASKLV

SEQ ID NO: 856548 - protein, 9 aa, Homo Sapiens
AKETLSELL

SEQ ID NO: 856549 - protein, 9 aa, Homo Sapiens
QRQIRRHKN

SEQ ID NO: 856550 - protein, 9 aa, Homo Sapiens
ATIRKCLTK

SEQ ID NO: 856551 - protein, 9 aa, Homo Sapiens
VDNRYGYPE

SEQ ID NO: 856552 - protein, 9 aa, Homo Sapiens
LFKEYFINY

SEQ ID NO: 856553 - protein, 9 aa, Homo Sapiens
TFSMQDGPK

SEQ ID NO: 856554 - protein, 9 aa, Homo Sapiens
EILFTTVSI

SEQ ID NO: 856555 - protein, 9 aa, Homo Sapiens
SSLIQHKII

SEQ ID NO: 856556 - protein, 9 aa, Homo Sapiens
CGNVRGNAI

SEQ ID NO: 856557 - protein, 9 aa, Homo Sapiens
IFQVVISII

SEQ ID NO: 856558 - protein, 9 aa, Homo Sapiens
RGEPVWEPL

SEQ ID NO: 856559 - protein, 9 aa, Homo Sapiens
NYSYFLGLS

SEQ ID NO: 856560 - protein, 9 aa, Homo Sapiens
LCAPDDQEF

SEQ ID NO: 856561 - protein, 9 aa, Homo Sapiens
SSGVQHVRR

SEQ ID NO: 856562 - protein, 9 aa, Homo Sapiens
PPNFVVKPR

SEQ ID NO: 856563 - protein, 9 aa, Homo Sapiens
PTSLQVPEI

SEQ ID NO: 856564 - protein, 9 aa, Homo Sapiens
EWKRTCSIP

SEQ ID NO: 856565 - protein, 9 aa, Homo Sapiens
CPRYLLGVI

SEQ ID NO: 856566 - protein, 9 aa, Homo Sapiens
DKKVSLMGF

SEQ ID NO: 856567 - protein, 9 aa, Homo Sapiens
NPTNNENTY

SEQ ID NO: 856568 - protein, 9 aa, Homo Sapiens
QANSSQVPP

SEQ ID NO: 856569 - protein, 9 aa, Homo Sapiens
QMFDANNMM

SEQ ID NO: 856570 - protein, 9 aa, Homo Sapiens
TASFSVQQH

SEQ ID NO: 856571 - protein, 9 aa, Homo Sapiens
KSEAKQVPR

SEQ ID NO: 856572 - protein, 9 aa, Homo Sapiens
SVNLKNLKQ

SEQ ID NO: 856573 - protein, 9 aa, Homo Sapiens
LLDLIQDLR

SEQ ID NO: 856574 - protein, 9 aa, Homo Sapiens
HRAYAEKIM

SEQ ID NO: 856575 - protein, 9 aa, Homo Sapiens
ELFKQRRLI

SEQ ID NO: 856576 - protein, 9 aa, Homo Sapiens
FSFWYHLHG

SEQ ID NO: 856577 - protein, 9 aa, Homo Sapiens
KKAINMRYP

SEQ ID NO: 856578 - protein, 9 aa, Homo Sapiens
EDASGGEQD

SEQ ID NO: 856579 - protein, 9 aa, Homo Sapiens
FRDKELSCT

SEQ ID NO: 856580 - protein, 9 aa, Homo Sapiens
KVMLFGEPT

SEQ ID NO: 856581 - protein, 9 aa, Homo Sapiens
AIINLGNYT

SEQ ID NO: 856582 - protein, 9 aa, Homo Sapiens
YPSLVYMGH

SEQ ID NO: 856583 - protein, 9 aa, Homo Sapiens
IEGHPVLRE

SEQ ID NO: 856584 - protein, 9 aa, Homo Sapiens
SACQYVYGV

SEQ ID NO: 856585 - protein, 9 aa, Homo Sapiens
QLLYCIALS

SEQ ID NO: 856586 - protein, 9 aa, Homo Sapiens
PNLKCLDVS

SEQ ID NO: 856587 - protein, 9 aa, Homo Sapiens
SSAKVWSRT

SEQ ID NO: 856588 - protein, 9 aa, Homo Sapiens
GPSRKRRQS

SEQ ID NO: 856589 - protein, 9 aa, Homo Sapiens
KKRKYINTI

SEQ ID NO: 856590 - protein, 9 aa, Homo Sapiens
CSPTFRLSS

SEQ ID NO: 856591 - protein, 9 aa, Homo Sapiens
KEANQLNDT

SEQ ID NO: 856592 - protein, 9 aa, Homo Sapiens
ESYSCPSCG

SEQ ID NO: 856593 - protein, 9 aa, Homo Sapiens
FNVRGIRGR

SEQ ID NO: 856594 - protein, 9 aa, Homo Sapiens
LRYLMAHIK

SEQ ID NO: 856595 - protein, 9 aa, Homo Sapiens
RTTTQMGRG

SEQ ID NO: 856596 - protein, 9 aa, Homo Sapiens
KVNQKGCYA

SEQ ID NO: 856597 - protein, 9 aa, Homo Sapiens
SGRSRNEEL

SEQ ID NO: 856598 - protein, 9 aa, Homo Sapiens
GAFIGISLV

SEQ ID NO: 856599 - protein, 9 aa, Homo Sapiens
HNCREENKS

SEQ ID NO: 856600 - protein, 9 aa, Homo Sapiens
LFYFSQSFP

SEQ ID NO: 856601 - protein, 9 aa, Homo Sapiens
TSDLTVINA

SEQ ID NO: 856602 - protein, 9 aa, Homo Sapiens
PDRRCTKLD

SEQ ID NO: 856603 - protein, 9 aa, Homo Sapiens
WSSVAAPEK

SEQ ID NO: 856604 - protein, 9 aa, Homo Sapiens
IIRTYWDAG

SEQ ID NO: 856605 - protein, 9 aa, Homo Sapiens
HFLFRFIVL

SEQ ID NO: 856606 - protein, 9 aa, Homo Sapiens
EFSNTVIDQ

SEQ ID NO: 856607 - protein, 9 aa, Homo Sapiens
LSKSGCSRD

SEQ ID NO: 856608 - protein, 9 aa, Homo Sapiens
IQLSCSSTY

SEQ ID NO: 856609 - protein, 9 aa, Homo Sapiens
VLAVDEQLE

SEQ ID NO: 856610 - protein, 9 aa, Homo Sapiens
KLLKYLPEL

SEQ ID NO: 856611 - protein, 9 aa, Homo Sapiens
TPEKGSHMP

SEQ ID NO: 856612 - protein, 9 aa, Homo Sapiens
IRKALESMD

SEQ ID NO: 856613 - protein, 9 aa, Homo Sapiens
CTDQIYFKK

SEQ ID NO: 856614 - protein, 9 aa, Homo Sapiens
KGTNNEGGG

SEQ ID NO: 856615 - protein, 9 aa, Homo Sapiens
CGEVRNEEH

SEQ ID NO: 856616 - protein, 9 aa, Homo Sapiens
LETLYQNRS

SEQ ID NO: 856617 - protein, 9 aa, Homo Sapiens
RVLQYLVEV

SEQ ID NO: 856618 - protein, 9 aa, Homo Sapiens
MNKRDGTPG

SEQ ID NO: 856619 - protein, 9 aa, Homo Sapiens
ATMGILLRE

SEQ ID NO: 856620 - protein, 9 aa, Homo Sapiens
EEKVICLVR

SEQ ID NO: 856621 - protein, 9 aa, Homo Sapiens
LMKIPGTCC

SEQ ID NO: 856622 - protein, 9 aa, Homo Sapiens
SHFFETSVT

SEQ ID NO: 856623 - protein, 9 aa, Homo Sapiens
DSVVSSAEK

SEQ ID NO: 856624 - protein, 9 aa, Homo Sapiens
NIEDEKKDE

SEQ ID NO: 856625 - protein, 9 aa, Homo Sapiens
SRSTDDQII

SEQ ID NO: 856626 - protein, 9 aa, Homo Sapiens
LFSKCTLIH

SEQ ID NO: 856627 - protein, 9 aa, Homo Sapiens
LNEIKIFSK

SEQ ID NO: 856628 - protein, 9 aa, Homo Sapiens
GADDEEEEE

SEQ ID NO: 856629 - protein, 9 aa, Homo Sapiens
SYLPIIVLL

SEQ ID NO: 856630 - protein, 9 aa, Homo Sapiens
QEEHTSKIL

SEQ ID NO: 856631 - protein, 9 aa, Homo Sapiens
VWTAEDQLD

SEQ ID NO: 856632 - protein, 9 aa, Homo Sapiens
GSLQIHERT

SEQ ID NO: 856633 - protein, 9 aa, Homo Sapiens
TNARRNRQM

SEQ ID NO: 856634 - protein, 9 aa, Homo Sapiens
GIKNRSSGK

SEQ ID NO: 856635 - protein, 9 aa, Homo Sapiens
VTKLFPEFR

SEQ ID NO: 856636 - protein, 9 aa, Homo Sapiens
SSHYIKSQT

SEQ ID NO: 856637 - protein, 9 aa, Homo Sapiens
SEHVIENNN

SEQ ID NO: 856638 - protein, 9 aa, Homo Sapiens
TAFAIERYI

SEQ ID NO: 856639 - protein, 9 aa, Homo Sapiens
FGDHVRAFK

SEQ ID NO: 856640 - protein, 9 aa, Homo Sapiens
NAVHDSFRP

SEQ ID NO: 856641 - protein, 9 aa, Homo Sapiens
AFTDLNNGS

SEQ ID NO: 856642 - protein, 9 aa, Homo Sapiens
DRIKYNVEH

SEQ ID NO: 856643 - protein, 9 aa, Homo Sapiens
HRLNNSENQ

SEQ ID NO: 856644 - protein, 9 aa, Homo Sapiens
DLLSQFQSN

SEQ ID NO: 856645 - protein, 9 aa, Homo Sapiens
RDAILALMP

SEQ ID NO: 856646 - protein, 9 aa, Homo Sapiens
LSEFSPQLF

SEQ ID NO: 856647 - protein, 9 aa, Homo Sapiens
GEQLRDDGC

SEQ ID NO: 856648 - protein, 9 aa, Homo Sapiens
FFVQETDHD

SEQ ID NO: 856649 - protein, 9 aa, Homo Sapiens
NSALMGHQR

SEQ ID NO: 856650 - protein, 9 aa, Homo Sapiens
IPITPVRVV

SEQ ID NO: 856651 - protein, 9 aa, Homo Sapiens
SEKNWNRDK

SEQ ID NO: 856652 - protein, 9 aa, Homo Sapiens
IEQSNLRAL

SEQ ID NO: 856653 - protein, 9 aa, Homo Sapiens
LPHKRYVLL

SEQ ID NO: 856654 - protein, 9 aa, Homo Sapiens
SGLHEKCKQ

SEQ ID NO: 856655 - protein, 9 aa, Homo Sapiens
NLNIHQQTH

SEQ ID NO: 856656 - protein, 9 aa, Homo Sapiens
RMMYATLLK

SEQ ID NO: 856657 - protein, 9 aa, Homo Sapiens
LFNVRPPWV

SEQ ID NO: 856658 - protein, 9 aa, Homo Sapiens
LSADQMSEN

SEQ ID NO: 856659 - protein, 9 aa, Homo Sapiens
MLDNYSHLI

SEQ ID NO: 856660 - protein, 9 aa, Homo Sapiens
RSTSIDRLD

SEQ ID NO: 856661 - protein, 9 aa, Homo Sapiens
IFQANMNTG

SEQ ID NO: 856662 - protein, 9 aa, Homo Sapiens
RTLPKLYYL

SEQ ID NO: 856663 - protein, 9 aa, Homo Sapiens
EQVEGGAIY

SEQ ID NO: 856664 - protein, 9 aa, Homo Sapiens
DLCIVDEAS

SEQ ID NO: 856665 - protein, 9 aa, Homo Sapiens
AWSTGDCGN

SEQ ID NO: 856666 - protein, 9 aa, Homo Sapiens
IKAIKLAEQ

SEQ ID NO: 856667 - protein, 9 aa, Homo Sapiens
QQTGILCAL

SEQ ID NO: 856668 - protein, 9 aa, Homo Sapiens
NNKVNQWAL

SEQ ID NO: 856669 - protein, 9 aa, Homo Sapiens
TRDLSELFH

SEQ ID NO: 856670 - protein, 9 aa, Homo Sapiens
LVGDLRAES

SEQ ID NO: 856671 - protein, 9 aa, Homo Sapiens
ACKLYSSQW

SEQ ID NO: 856672 - protein, 9 aa, Homo Sapiens
TAQTEPVVL

SEQ ID NO: 856673 - protein, 9 aa, Homo Sapiens
DVISLKVKA

SEQ ID NO: 856674 - protein, 9 aa, Homo Sapiens
KRAKKECPF

SEQ ID NO: 856675 - protein, 9 aa, Homo Sapiens
KEVNEVSHN

SEQ ID NO: 856676 - protein, 9 aa, Homo Sapiens
GKYLAPGFV

SEQ ID NO: 856677 - protein, 9 aa, Homo Sapiens
PTPIIPAFS

SEQ ID NO: 856678 - protein, 9 aa, Homo Sapiens
LLLLFLGAT

SEQ ID NO: 856679 - protein, 9 aa, Homo Sapiens
LNRDRHGHE

SEQ ID NO: 856680 - protein, 9 aa, Homo Sapiens
ACLARCWDT

SEQ ID NO: 856681 - protein, 9 aa, Homo Sapiens
TGTNTNKLL

SEQ ID NO: 856682 - protein, 9 aa, Homo Sapiens
PNNYLLGTY

SEQ ID NO: 856683 - protein, 9 aa, Homo Sapiens
LILPGLAYA

SEQ ID NO: 856684 - protein, 9 aa, Homo Sapiens
EIVFLRAIT

SEQ ID NO: 856685 - protein, 9 aa, Homo Sapiens
SCTGFLFGV

SEQ ID NO: 856686 - protein, 9 aa, Homo Sapiens
AKIKALLEI

SEQ ID NO: 856687 - protein, 9 aa, Homo Sapiens
IEELKLMEE

SEQ ID NO: 856688 - protein, 9 aa, Homo Sapiens
GTSAKPSDC

SEQ ID NO: 856689 - protein, 9 aa, Homo Sapiens
HLNSPNGVL

SEQ ID NO: 856690 - protein, 9 aa, Homo Sapiens
YSSVQHPLG

SEQ ID NO: 856691 - protein, 9 aa, Homo Sapiens
ARRHTYFYA

SEQ ID NO: 856692 - protein, 9 aa, Homo Sapiens
RRWLHSSCY

SEQ ID NO: 856693 - protein, 9 aa, Homo Sapiens
GSGLGTFIL

SEQ ID NO: 856694 - protein, 9 aa, Homo Sapiens
ARTASTSFM

SEQ ID NO: 856695 - protein, 9 aa, Homo Sapiens
ETRERKGLY

SEQ ID NO: 856696 - protein, 9 aa, Homo Sapiens
FNNYYSLVL

SEQ ID NO: 856697 - protein, 9 aa, Homo Sapiens
HLEIRDLEE

SEQ ID NO: 856698 - protein, 9 aa, Homo Sapiens
LIVHQITHT

SEQ ID NO: 856699 - protein, 9 aa, Homo Sapiens
IEIIQPILD

SEQ ID NO: 856700 - protein, 9 aa, Homo Sapiens
GTLFLMLVS

SEQ ID NO: 856701 - protein, 9 aa, Homo Sapiens
VPSAAAQGT

SEQ ID NO: 856702 - protein, 9 aa, Homo Sapiens
VAMKEIMYG

SEQ ID NO: 856703 - protein, 9 aa, Homo Sapiens
SLSWIWKME

SEQ ID NO: 856704 - protein, 9 aa, Homo Sapiens
KKKSDDPVE

SEQ ID NO: 856705 - protein, 9 aa, Homo Sapiens
KQSMINSLP

SEQ ID NO: 856706 - protein, 9 aa, Homo Sapiens
RGILRRAAF

SEQ ID NO: 856707 - protein, 9 aa, Homo Sapiens
MQKIQMKGS

SEQ ID NO: 856708 - protein, 9 aa, Homo Sapiens
AGDGLPGDR

SEQ ID NO: 856709 - protein, 9 aa, Homo Sapiens
YKQIIKSQE

SEQ ID NO: 856710 - protein, 9 aa, Homo Sapiens
AVIMNGRIY

SEQ ID NO: 856711 - protein, 9 aa, Homo Sapiens
AITTLVVKG

SEQ ID NO: 856712 - protein, 9 aa, Homo Sapiens
KHNKFHNRM

SEQ ID NO: 856713 - protein, 9 aa, Homo Sapiens
GPVVSAPLE

SEQ ID NO: 856714 - protein, 9 aa, Homo Sapiens
KIQRTEPSP

SEQ ID NO: 856715 - protein, 9 aa, Homo Sapiens
ANQRRYWEL

SEQ ID NO: 856716 - protein, 9 aa, Homo Sapiens
PRRPYILKI

SEQ ID NO: 856717 - protein, 9 aa, Homo Sapiens
YLSNLIPSI

SEQ ID NO: 856718 - protein, 9 aa, Homo Sapiens
IIVLSLFPI

SEQ ID NO: 856719 - protein, 9 aa, Homo Sapiens
VAGCSKVYT

SEQ ID NO: 856720 - protein, 9 aa, Homo Sapiens
YKPTTKETR

SEQ ID NO: 856721 - protein, 9 aa, Homo Sapiens
KLWYQDTAR

SEQ ID NO: 856722 - protein, 9 aa, Homo Sapiens
CPFGTKYLG

SEQ ID NO: 856723 - protein, 9 aa, Homo Sapiens
DSIGEKLER

SEQ ID NO: 856724 - protein, 9 aa, Homo Sapiens
HSHKTQSLE

SEQ ID NO: 856725 - protein, 9 aa, Homo Sapiens
NNLQFQICY

SEQ ID NO: 856726 - protein, 9 aa, Homo Sapiens
NSVQEMVQH

SEQ ID NO: 856727 - protein, 9 aa, Homo Sapiens
VYSSPAAAR

SEQ ID NO: 856728 - protein, 9 aa, Homo Sapiens
AHEALQTQL

SEQ ID NO: 856729 - protein, 9 aa, Homo Sapiens
RKDAEEWLF

SEQ ID NO: 856730 - protein, 9 aa, Homo Sapiens
FDVGGQGSE

SEQ ID NO: 856731 - protein, 9 aa, Homo Sapiens
GQLLPGYEA

SEQ ID NO: 856732 - protein, 9 aa, Homo Sapiens
VVNHDFFMY

SEQ ID NO: 856733 - protein, 9 aa, Homo Sapiens
WSLLDTFEW

SEQ ID NO: 856734 - protein, 9 aa, Homo Sapiens
TEHKKIYTG

SEQ ID NO: 856735 - protein, 9 aa, Homo Sapiens
KWKQRVKAA

SEQ ID NO: 856736 - protein, 9 aa, Homo Sapiens
KIPYECIEC

SEQ ID NO: 856737 - protein, 9 aa, Homo Sapiens
CPSFSQSSI

SEQ ID NO: 856738 - protein, 9 aa, Homo Sapiens
ETPEETLLT

SEQ ID NO: 856739 - protein, 9 aa, Homo Sapiens
GNRRHDIQN

SEQ ID NO: 856740 - protein, 9 aa, Homo Sapiens
MCRRLNKHE

SEQ ID NO: 856741 - protein, 9 aa, Homo Sapiens
IRMSHKNFH

SEQ ID NO: 856742 - protein, 9 aa, Homo Sapiens
ATGNWLSAC

SEQ ID NO: 856743 - protein, 9 aa, Homo Sapiens
TIDFIVNET

SEQ ID NO: 856744 - protein, 9 aa, Homo Sapiens
IQASLALDC

SEQ ID NO: 856745 - protein, 9 aa, Homo Sapiens
SRPVATHPG

SEQ ID NO: 856746 - protein, 9 aa, Homo Sapiens
YFPPRRWLH

SEQ ID NO: 856747 - protein, 9 aa, Homo Sapiens
GARSPDPSS

SEQ ID NO: 856748 - protein, 9 aa, Homo Sapiens
QIEYRGNSL

SEQ ID NO: 856749 - protein, 9 aa, Homo Sapiens
VESDVRGIA

SEQ ID NO: 856750 - protein, 9 aa, Homo Sapiens
QEINCKEAF

SEQ ID NO: 856751 - protein, 9 aa, Homo Sapiens
GIIANINRT

SEQ ID NO: 856752 - protein, 9 aa, Homo Sapiens
KECGDKVNL

SEQ ID NO: 856753 - protein, 9 aa, Homo Sapiens
KIIIDELSK

SEQ ID NO: 856754 - protein, 9 aa, Homo Sapiens
IYPRHCDPE

SEQ ID NO: 856755 - protein, 9 aa, Homo Sapiens
KLHWQFFQG

SEQ ID NO: 856756 - protein, 9 aa, Homo Sapiens
TRLNAELLT

SEQ ID NO: 856757 - protein, 9 aa, Homo Sapiens
LIGKGLAAL

SEQ ID NO: 856758 - protein, 9 aa, Homo Sapiens
QLCNSTYRR

SEQ ID NO: 856759 - protein, 9 aa, Homo Sapiens
DSCVISNHP

SEQ ID NO: 856760 - protein, 9 aa, Homo Sapiens
CVNHTNIIS

SEQ ID NO: 856761 - protein, 9 aa, Homo Sapiens
IEGVDEDAD

SEQ ID NO: 856762 - protein, 9 aa, Homo Sapiens
QKGKEGSLK

SEQ ID NO: 856763 - protein, 9 aa, Homo Sapiens
TKVADWFYY

SEQ ID NO: 856764 - protein, 9 aa, Homo Sapiens
ILQAWTDNE

SEQ ID NO: 856765 - protein, 9 aa, Homo Sapiens
PDITWFQIL

SEQ ID NO: 856766 - protein, 9 aa, Homo Sapiens
YLLQGIQNY

SEQ ID NO: 856767 - protein, 9 aa, Homo Sapiens
FCAVHLHSG

SEQ ID NO: 856768 - protein, 9 aa, Homo Sapiens
EKDIEELKL

SEQ ID NO: 856769 - protein, 9 aa, Homo Sapiens
VSYLYDVTR

SEQ ID NO: 856770 - protein, 9 aa, Homo Sapiens
GEFWLGLKN

SEQ ID NO: 856771 - protein, 9 aa, Homo Sapiens
DLLNYQVTL

SEQ ID NO: 856772 - protein, 9 aa, Homo Sapiens
KFMVEMEKK

SEQ ID NO: 856773 - protein, 9 aa, Homo Sapiens
LEREFGAVF

SEQ ID NO: 856774 - protein, 9 aa, Homo Sapiens
LEPMPFQTH

SEQ ID NO: 856775 - protein, 9 aa, Homo Sapiens
NESKRMIYN

SEQ ID NO: 856776 - protein, 9 aa, Homo Sapiens
DRLIKILSM

SEQ ID NO: 856777 - protein, 9 aa, Homo Sapiens
MPYSPGLQS

SEQ ID NO: 856778 - protein, 9 aa, Homo Sapiens
KQVIEAPDP

SEQ ID NO: 856779 - protein, 9 aa, Homo Sapiens
NCREENKSS

SEQ ID NO: 856780 - protein, 9 aa, Homo Sapiens
IIENEGKLK

SEQ ID NO: 856781 - protein, 9 aa, Homo Sapiens
DHPASKLVV

SEQ ID NO: 856782 - protein, 9 aa, Homo Sapiens
VDEAIKCIN

SEQ ID NO: 856783 - protein, 9 aa, Homo Sapiens
RRYTYNYEA

SEQ ID NO: 856784 - protein, 9 aa, Homo Sapiens
APLAKILKG

SEQ ID NO: 856785 - protein, 9 aa, Homo Sapiens
GGSEGPGSP

SEQ ID NO: 856786 - protein, 9 aa, Homo Sapiens
VNGSSFVSV

SEQ ID NO: 856787 - protein, 9 aa, Homo Sapiens
AFKFRVGAS

SEQ ID NO: 856788 - protein, 9 aa, Homo Sapiens
LLLKLSVET

SEQ ID NO: 856789 - protein, 9 aa, Homo Sapiens
RKEDVKGME

SEQ ID NO: 856790 - protein, 9 aa, Homo Sapiens
ISGHKHRKY

SEQ ID NO: 856791 - protein, 9 aa, Homo Sapiens
CVSWADLVY

SEQ ID NO: 856792 - protein, 9 aa, Homo Sapiens
VERQIHTLQ

SEQ ID NO: 856793 - protein, 9 aa, Homo Sapiens
VDYDNTTTK

SEQ ID NO: 856794 - protein, 9 aa, Homo Sapiens
MMSEHNLAD

SEQ ID NO: 856795 - protein, 9 aa, Homo Sapiens
KISALCIFK

SEQ ID NO: 856796 - protein, 9 aa, Homo Sapiens
NEIQKRGVS

SEQ ID NO: 856797 - protein, 9 aa, Homo Sapiens
AAQYLHQFM

SEQ ID NO: 856798 - protein, 9 aa, Homo Sapiens
AKCKASYHL

SEQ ID NO: 856799 - protein, 9 aa, Homo Sapiens
VDSHTPSLL

SEQ ID NO: 856800 - protein, 9 aa, Homo Sapiens
SIDHVQQVE

SEQ ID NO: 856801 - protein, 9 aa, Homo Sapiens
ERYGFQYIY

SEQ ID NO: 856802 - protein, 9 aa, Homo Sapiens
ERWWLNGPL

SEQ ID NO: 856803 - protein, 9 aa, Homo Sapiens
LKDEANQED

SEQ ID NO: 856804 - protein, 9 aa, Homo Sapiens
HRILIERQD

SEQ ID NO: 856805 - protein, 9 aa, Homo Sapiens
VRSHIMHLE

SEQ ID NO: 856806 - protein, 9 aa, Homo Sapiens
ITKFLRLFS

SEQ ID NO: 856807 - protein, 9 aa, Homo Sapiens
PDEKAKVPT

SEQ ID NO: 856808 - protein, 9 aa, Homo Sapiens
AIPKSFNLE

SEQ ID NO: 856809 - protein, 9 aa, Homo Sapiens
SRDEPQKLY

SEQ ID NO: 856810 - protein, 9 aa, Homo Sapiens
PTQGDMEIP

SEQ ID NO: 856811 - protein, 9 aa, Homo Sapiens
SQLNLYMRL

SEQ ID NO: 856812 - protein, 9 aa, Homo Sapiens
ILDSKILNS

SEQ ID NO: 856813 - protein, 9 aa, Homo Sapiens
INIITGALQ

SEQ ID NO: 856814 - protein, 9 aa, Homo Sapiens
QRRHTGDKP

SEQ ID NO: 856815 - protein, 9 aa, Homo Sapiens
SHIMHLEEH

SEQ ID NO: 856816 - protein, 9 aa, Homo Sapiens
IIHQGAQLS

SEQ ID NO: 856817 - protein, 9 aa, Homo Sapiens
LHGGILRMF

SEQ ID NO: 856818 - protein, 9 aa, Homo Sapiens
LNWYEHNNY

SEQ ID NO: 856819 - protein, 9 aa, Homo Sapiens
SAVYFLLPE

SEQ ID NO: 856820 - protein, 9 aa, Homo Sapiens
KKLFQVDIQ

SEQ ID NO: 856821 - protein, 9 aa, Homo Sapiens
RRFNDELDK

SEQ ID NO: 856822 - protein, 9 aa, Homo Sapiens
EASVLNPTS

SEQ ID NO: 856823 - protein, 9 aa, Homo Sapiens
PLLSTFKST

SEQ ID NO: 856824 - protein, 9 aa, Homo Sapiens
RQIRQFHSH

SEQ ID NO: 856825 - protein, 9 aa, Homo Sapiens
GPFATDIFV

SEQ ID NO: 856826 - protein, 9 aa, Homo Sapiens
KTLSNVKYF

SEQ ID NO: 856827 - protein, 9 aa, Homo Sapiens
RNLIKVLKW

SEQ ID NO: 856828 - protein, 9 aa, Homo Sapiens
SFHLNHAIG

SEQ ID NO: 856829 - protein, 9 aa, Homo Sapiens
GRITLSDFG

SEQ ID NO: 856830 - protein, 9 aa, Homo Sapiens
CYCNSVIQA

SEQ ID NO: 856831 - protein, 9 aa, Homo Sapiens
LLSWESLKY

SEQ ID NO: 856832 - protein, 9 aa, Homo Sapiens
VRLDDNFVR

SEQ ID NO: 856833 - protein, 9 aa, Homo Sapiens
DLLALIQGY

SEQ ID NO: 856834 - protein, 9 aa, Homo Sapiens
GKLLLKLSV

SEQ ID NO: 856835 - protein, 9 aa, Homo Sapiens
YGVNNVLLS

SEQ ID NO: 856836 - protein, 9 aa, Homo Sapiens
ILRDDHALV

SEQ ID NO: 856837 - protein, 9 aa, Homo Sapiens
SWISDGKKQ

SEQ ID NO: 856838 - protein, 9 aa, Homo Sapiens
SRVNAIHLL

SEQ ID NO: 856839 - protein, 9 aa, Homo Sapiens
KRRTSTFSG

SEQ ID NO: 856840 - protein, 9 aa, Homo Sapiens
VQYAEDQGF

SEQ ID NO: 856841 - protein, 9 aa, Homo Sapiens
QIKEKLECY

SEQ ID NO: 856842 - protein, 9 aa, Homo Sapiens
FINQAFLQS

SEQ ID NO: 856843 - protein, 9 aa, Homo Sapiens
ALMIRAEDA

SEQ ID NO: 856844 - protein, 9 aa, Homo Sapiens
LSEFWSKPF

SEQ ID NO: 856845 - protein, 9 aa, Homo Sapiens
QEWENNLRE

SEQ ID NO: 856846 - protein, 9 aa, Homo Sapiens
IHTYQSITE

SEQ ID NO: 856847 - protein, 9 aa, Homo Sapiens
ALYRARSLQ

SEQ ID NO: 856848 - protein, 9 aa, Homo Sapiens
FPVEGNLEF

SEQ ID NO: 856849 - protein, 9 aa, Homo Sapiens
RTRPGLQTP

SEQ ID NO: 856850 - protein, 9 aa, Homo Sapiens
CSRASSLSI

SEQ ID NO: 856851 - protein, 9 aa, Homo Sapiens
NSGLKQNVL

SEQ ID NO: 856852 - protein, 9 aa, Homo Sapiens
KEVWCERCV

SEQ ID NO: 856853 - protein, 9 aa, Homo Sapiens
IQWLLEEKV

SEQ ID NO: 856854 - protein, 9 aa, Homo Sapiens
GKAFRVFVV

SEQ ID NO: 856855 - protein, 9 aa, Homo Sapiens
NNKDYHSLT

SEQ ID NO: 856856 - protein, 9 aa, Homo Sapiens
ESTVENPQV

SEQ ID NO: 856857 - protein, 9 aa, Homo Sapiens
SRNVPAEQK

SEQ ID NO: 856858 - protein, 9 aa, Homo Sapiens
NGKSFCHEQ

SEQ ID NO: 856859 - protein, 9 aa, Homo Sapiens
RWFSMYDQR

SEQ ID NO: 856860 - protein, 9 aa, Homo Sapiens
YLPSISLDL

SEQ ID NO: 856861 - protein, 9 aa, Homo Sapiens
IQTPPVRRN

SEQ ID NO: 856862 - protein, 9 aa, Homo Sapiens
ERWENDKDM

SEQ ID NO: 856863 - protein, 9 aa, Homo Sapiens
TARNTPNWY

SEQ ID NO: 856864 - protein, 9 aa, Homo Sapiens
MTVDVEFGV

SEQ ID NO: 856865 - protein, 9 aa, Homo Sapiens
NFLEACIKI

SEQ ID NO: 856866 - protein, 9 aa, Homo Sapiens
GNKIDLVCN

SEQ ID NO: 856867 - protein, 9 aa, Homo Sapiens
VHQSRVTMI

SEQ ID NO: 856868 - protein, 9 aa, Homo Sapiens
NTSGEICQL

SEQ ID NO: 856869 - protein, 9 aa, Homo Sapiens
MGRRNNTHV

SEQ ID NO: 856870 - protein, 9 aa, Homo Sapiens
GTDSWNHST

SEQ ID NO: 856871 - protein, 9 aa, Homo Sapiens
GSLSEEKAN

SEQ ID NO: 856872 - protein, 9 aa, Homo Sapiens
LHNLLFGSL

SEQ ID NO: 856873 - protein, 9 aa, Homo Sapiens
KADEGNKET

SEQ ID NO: 856874 - protein, 9 aa, Homo Sapiens
EEKTKWKDL

SEQ ID NO: 856875 - protein, 9 aa, Homo Sapiens
PQDDDARTG

SEQ ID NO: 856876 - protein, 9 aa, Homo Sapiens
ELCSCGWHH

SEQ ID NO: 856877 - protein, 9 aa, Homo Sapiens
VQLIWKKHL

SEQ ID NO: 856878 - protein, 9 aa, Homo Sapiens
PCECQQCGK

SEQ ID NO: 856879 - protein, 9 aa, Homo Sapiens
SFPYCGPYS

SEQ ID NO: 856880 - protein, 9 aa, Homo Sapiens
ILSVLFTPY

SEQ ID NO: 856881 - protein, 9 aa, Homo Sapiens
FSTLTRHRI

SEQ ID NO: 856882 - protein, 9 aa, Homo Sapiens
RSFKVTKYW

SEQ ID NO: 856883 - protein, 9 aa, Homo Sapiens
AMCLVRGIQ

SEQ ID NO: 856884 - protein, 9 aa, Homo Sapiens
LKNMKGLSY

SEQ ID NO: 856885 - protein, 9 aa, Homo Sapiens
ALSSFNSKL

SEQ ID NO: 856886 - protein, 9 aa, Homo Sapiens
GYRDIVNIN

SEQ ID NO: 856887 - protein, 9 aa, Homo Sapiens
IGKQTVSPA

SEQ ID NO: 856888 - protein, 9 aa, Homo Sapiens
LLEIMDGKI

SEQ ID NO: 856889 - protein, 9 aa, Homo Sapiens
PSRSNTACD

SEQ ID NO: 856890 - protein, 9 aa, Homo Sapiens
FGIDSHISQ

SEQ ID NO: 856891 - protein, 9 aa, Homo Sapiens
GLPSLLRPG

SEQ ID NO: 856892 - protein, 9 aa, Homo Sapiens
KLENFQGRR

SEQ ID NO: 856893 - protein, 9 aa, Homo Sapiens
ALKTISESY

SEQ ID NO: 856894 - protein, 9 aa, Homo Sapiens
KKNPAFNKD

SEQ ID NO: 856895 - protein, 9 aa, Homo Sapiens
INLTRLNVP

SEQ ID NO: 856896 - protein, 9 aa, Homo Sapiens
WHYNKQSLH

SEQ ID NO: 856897 - protein, 9 aa, Homo Sapiens
FTVGTFVVN

SEQ ID NO: 856898 - protein, 9 aa, Homo Sapiens
ENESKILQK

SEQ ID NO: 856899 - protein, 9 aa, Homo Sapiens
AYPSHIGSI

SEQ ID NO: 856900 - protein, 9 aa, Homo Sapiens
NPTELQNHE

SEQ ID NO: 856901 - protein, 9 aa, Homo Sapiens
KCRLCAKVF

SEQ ID NO: 856902 - protein, 9 aa, Homo Sapiens
PSSGHRSSS

SEQ ID NO: 856903 - protein, 9 aa, Homo Sapiens
AWGLVATLQ

SEQ ID NO: 856904 - protein, 9 aa, Homo Sapiens
DPGANNRLE

SEQ ID NO: 856905 - protein, 9 aa, Homo Sapiens
GLEDCAVAL

SEQ ID NO: 856906 - protein, 9 aa, Homo Sapiens
DYGTSSAAD

SEQ ID NO: 856907 - protein, 9 aa, Homo Sapiens
FPEMQRRDS

SEQ ID NO: 856908 - protein, 9 aa, Homo Sapiens
AWVLQEARV

SEQ ID NO: 856909 - protein, 9 aa, Homo Sapiens
SEAFYDISQ

SEQ ID NO: 856910 - protein, 9 aa, Homo Sapiens
LNKEEREAF

SEQ ID NO: 856911 - protein, 9 aa, Homo Sapiens
QQEWQRFGV

SEQ ID NO: 856912 - protein, 9 aa, Homo Sapiens
TKEESTVEN

SEQ ID NO: 856913 - protein, 9 aa, Homo Sapiens
HLPVTEAEM

SEQ ID NO: 856914 - protein, 9 aa, Homo Sapiens
LEAAESFHP

SEQ ID NO: 856915 - protein, 9 aa, Homo Sapiens
VCMFGPDKL

SEQ ID NO: 856916 - protein, 9 aa, Homo Sapiens
HYIQDKTAV

SEQ ID NO: 856917 - protein, 9 aa, Homo Sapiens
TEYCFYGYL

SEQ ID NO: 856918 - protein, 9 aa, Homo Sapiens
GLGNKCPAR

SEQ ID NO: 856919 - protein, 9 aa, Homo Sapiens
GLDNTVRSC

SEQ ID NO: 856920 - protein, 9 aa, Homo Sapiens
NGSVRCSHF

SEQ ID NO: 856921 - protein, 9 aa, Homo Sapiens
DTKRITPDS

SEQ ID NO: 856922 - protein, 9 aa, Homo Sapiens
QYTGIPLPD

SEQ ID NO: 856923 - protein, 9 aa, Homo Sapiens
DEELLLHDT

SEQ ID NO: 856924 - protein, 9 aa, Homo Sapiens
ISQGKIIFE

SEQ ID NO: 856925 - protein, 9 aa, Homo Sapiens
DLHHVTVAG

SEQ ID NO: 856926 - protein, 9 aa, Homo Sapiens
QNCKWYQDN

SEQ ID NO: 856927 - protein, 9 aa, Homo Sapiens
GMLLFYSLK

SEQ ID NO: 856928 - protein, 9 aa, Homo Sapiens
TAHLFLSHF

SEQ ID NO: 856929 - protein, 9 aa, Homo Sapiens
NMYLTDARK

SEQ ID NO: 856930 - protein, 9 aa, Homo Sapiens
YSYSGLKQI

SEQ ID NO: 856931 - protein, 9 aa, Homo Sapiens
SKRVRIIAM

SEQ ID NO: 856932 - protein, 9 aa, Homo Sapiens
ECGGPEVLK

SEQ ID NO: 856933 - protein, 9 aa, Homo Sapiens
GSQQTGILC

SEQ ID NO: 856934 - protein, 9 aa, Homo Sapiens
LDQGDLYSL

SEQ ID NO: 856935 - protein, 9 aa, Homo Sapiens
EIDILNKRL

SEQ ID NO: 856936 - protein, 9 aa, Homo Sapiens
LQNKDKNKK

SEQ ID NO: 856937 - protein, 9 aa, Homo Sapiens
KVILSICSL

SEQ ID NO: 856938 - protein, 9 aa, Homo Sapiens
TIEPLYQRV

SEQ ID NO: 856939 - protein, 9 aa, Homo Sapiens
GIPGLAYAE

SEQ ID NO: 856940 - protein, 9 aa, Homo Sapiens
LVKEWIRKI

SEQ ID NO: 856941 - protein, 9 aa, Homo Sapiens
PECSKHSHR

SEQ ID NO: 856942 - protein, 9 aa, Homo Sapiens
IRRLLKHPN

SEQ ID NO: 856943 - protein, 9 aa, Homo Sapiens
AVQDVSRPV

SEQ ID NO: 856944 - protein, 9 aa, Homo Sapiens
ETQVPAYLI

SEQ ID NO: 856945 - protein, 9 aa, Homo Sapiens
PSNLPLYIS

SEQ ID NO: 856946 - protein, 9 aa, Homo Sapiens
PSAFDKQVM

SEQ ID NO: 856947 - protein, 9 aa, Homo Sapiens
PIKEVIEQT

SEQ ID NO: 856948 - protein, 9 aa, Homo Sapiens
WELNKPFSI

SEQ ID NO: 856949 - protein, 9 aa, Homo Sapiens
FSSDRTDGD

SEQ ID NO: 856950 - protein, 9 aa, Homo Sapiens
LPHNLSSGT

SEQ ID NO: 856951 - protein, 9 aa, Homo Sapiens
ALLFLVFND

SEQ ID NO: 856952 - protein, 9 aa, Homo Sapiens
SRKRRQNAG

SEQ ID NO: 856953 - protein, 9 aa, Homo Sapiens
DIVQACHDL

SEQ ID NO: 856954 - protein, 9 aa, Homo Sapiens
NSNTPLVSI

SEQ ID NO: 856955 - protein, 9 aa, Homo Sapiens
HYCQGPKEV

SEQ ID NO: 856956 - protein, 9 aa, Homo Sapiens
TSEISDCYV

SEQ ID NO: 856957 - protein, 9 aa, Homo Sapiens
TPPSNLRLS

SEQ ID NO: 856958 - protein, 9 aa, Homo Sapiens
GLQTHCYRA

SEQ ID NO: 856959 - protein, 9 aa, Homo Sapiens
KETNSSSNQ

SEQ ID NO: 856960 - protein, 9 aa, Homo Sapiens
FSWCANYIC

SEQ ID NO: 856961 - protein, 9 aa, Homo Sapiens
NNCRCDGKI

SEQ ID NO: 856962 - protein, 9 aa, Homo Sapiens
DRKHRTYVH

SEQ ID NO: 856963 - protein, 9 aa, Homo Sapiens
SNDYGDNEK

SEQ ID NO: 856964 - protein, 9 aa, Homo Sapiens
VDEFVKIIF

SEQ ID NO: 856965 - protein, 9 aa, Homo Sapiens
IHVTVGEAH

SEQ ID NO: 856966 - protein, 9 aa, Homo Sapiens
LTSSVTVGT

SEQ ID NO: 856967 - protein, 9 aa, Homo Sapiens
VKCQGYSIF

SEQ ID NO: 856968 - protein, 9 aa, Homo Sapiens
LYTDQAFGE

SEQ ID NO: 856969 - protein, 9 aa, Homo Sapiens
TEEGMMGTF

SEQ ID NO: 856970 - protein, 9 aa, Homo Sapiens
RGKGRTENR

SEQ ID NO: 856971 - protein, 9 aa, Homo Sapiens
KEIILLTGL

SEQ ID NO: 856972 - protein, 9 aa, Homo Sapiens
PVRHPALKA

SEQ ID NO: 856973 - protein, 9 aa, Homo Sapiens
SRSLNEHMN

SEQ ID NO: 856974 - protein, 9 aa, Homo Sapiens
GLHSPLQSG

SEQ ID NO: 856975 - protein, 9 aa, Homo Sapiens
QRADQLADE

SEQ ID NO: 856976 - protein, 9 aa, Homo Sapiens
NIISNILKL

SEQ ID NO: 856977 - protein, 9 aa, Homo Sapiens
LVTTECPHK

SEQ ID NO: 856978 - protein, 9 aa, Homo Sapiens
CYLKKGNCS

SEQ ID NO: 856979 - protein, 9 aa, Homo Sapiens
KKAHPDMEA

SEQ ID NO: 856980 - protein, 9 aa, Homo Sapiens
YNLVTRLVN

SEQ ID NO: 856981 - protein, 9 aa, Homo Sapiens
YSDLEDDSE

SEQ ID NO: 856982 - protein, 9 aa, Homo Sapiens
IFLKLILPR

SEQ ID NO: 856983 - protein, 9 aa, Homo Sapiens
KNQTTKIFI

SEQ ID NO: 856984 - protein, 9 aa, Homo Sapiens
IHVEDYTSP

SEQ ID NO: 856985 - protein, 9 aa, Homo Sapiens
RLHSGVQPF

SEQ ID NO: 856986 - protein, 9 aa, Homo Sapiens
HLNNINIRH

SEQ ID NO: 856987 - protein, 9 aa, Homo Sapiens
FNLLDVRFH

SEQ ID NO: 856988 - protein, 9 aa, Homo Sapiens
KRSFGDDRH

SEQ ID NO: 856989 - protein, 9 aa, Homo Sapiens
SSEKGSHMP

SEQ ID NO: 856990 - protein, 9 aa, Homo Sapiens
RAEHLASVV

SEQ ID NO: 856991 - protein, 9 aa, Homo Sapiens
SHMWQSAGI

SEQ ID NO: 856992 - protein, 9 aa, Homo Sapiens
ALKQCNREN

SEQ ID NO: 856993 - protein, 9 aa, Homo Sapiens
KETTIFLAA

SEQ ID NO: 856994 - protein, 9 aa, Homo Sapiens
CCKSCCSSS

SEQ ID NO: 856995 - protein, 9 aa, Homo Sapiens
MTKRTKGMG

SEQ ID NO: 856996 - protein, 9 aa, Homo Sapiens
WLRSHPHTQ

SEQ ID NO: 856997 - protein, 9 aa, Homo Sapiens
EKLHFVFNI

SEQ ID NO: 856998 - protein, 9 aa, Homo Sapiens
GEILLIPVK

SEQ ID NO: 856999 - protein, 9 aa, Homo Sapiens
LNKRLTVSQ

SEQ ID NO: 857000 - protein, 9 aa, Homo Sapiens
PGCSVSIKI

SEQ ID NO: 857001 - protein, 9 aa, Homo Sapiens
PGLFPSQCQ

SEQ ID NO: 857002 - protein, 9 aa, Homo Sapiens
LMVMSSKKK

SEQ ID NO: 857003 - protein, 9 aa, Homo Sapiens
LKEFIYCLA

SEQ ID NO: 857004 - protein, 9 aa, Homo Sapiens
GAELAWPPK

SEQ ID NO: 857005 - protein, 9 aa, Homo Sapiens
FENMKENPM

SEQ ID NO: 857006 - protein, 9 aa, Homo Sapiens
ELTAIQKAV

SEQ ID NO: 857007 - protein, 9 aa, Homo Sapiens
GVHVVLNQQ

SEQ ID NO: 857008 - protein, 9 aa, Homo Sapiens
YMFLLVPPL

SEQ ID NO: 857009 - protein, 9 aa, Homo Sapiens
HITQMLLQK

SEQ ID NO: 857010 - protein, 9 aa, Homo Sapiens
HGEHGCRTP

SEQ ID NO: 857011 - protein, 9 aa, Homo Sapiens
LEELPKDDA

SEQ ID NO: 857012 - protein, 9 aa, Homo Sapiens
HLTVVVLLF

SEQ ID NO: 857013 - protein, 9 aa, Homo Sapiens
ACIDIIQTL

SEQ ID NO: 857014 - protein, 9 aa, Homo Sapiens
QQMRAGKGK

SEQ ID NO: 857015 - protein, 9 aa, Homo Sapiens
GFSDSSQTK

SEQ ID NO: 857016 - protein, 9 aa, Homo Sapiens
ELVHGYIFV

SEQ ID NO: 857017 - protein, 9 aa, Homo Sapiens
KRKMNLSER

SEQ ID NO: 857018 - protein, 9 aa, Homo Sapiens
KRLIINFRK

SEQ ID NO: 857019 - protein, 9 aa, Homo Sapiens
VLIDTRLFK

SEQ ID NO: 857020 - protein, 9 aa, Homo Sapiens
LPHHGLHTA

SEQ ID NO: 857021 - protein, 9 aa, Homo Sapiens
ITLKGKMRA

SEQ ID NO: 857022 - protein, 9 aa, Homo Sapiens
FLATYYKIK

SEQ ID NO: 857023 - protein, 9 aa, Homo Sapiens
DKKKVVDPF

SEQ ID NO: 857024 - protein, 9 aa, Homo Sapiens
NRTIQASEA

SEQ ID NO: 857025 - protein, 9 aa, Homo Sapiens
SEDGLPKGI

SEQ ID NO: 857026 - protein, 9 aa, Homo Sapiens
AHRITAELK

SEQ ID NO: 857027 - protein, 9 aa, Homo Sapiens
SSKEIAITH

SEQ ID NO: 857028 - protein, 9 aa, Homo Sapiens
DLTDYLMQI

SEQ ID NO: 857029 - protein, 9 aa, Homo Sapiens
GASDKELHP

SEQ ID NO: 857030 - protein, 9 aa, Homo Sapiens
YNLPFPLLI

SEQ ID NO: 857031 - protein, 9 aa, Homo Sapiens
SWIWKMEAS

SEQ ID NO: 857032 - protein, 9 aa, Homo Sapiens
HIYHSELDK

SEQ ID NO: 857033 - protein, 9 aa, Homo Sapiens
DGKELSGNP

SEQ ID NO: 857034 - protein, 9 aa, Homo Sapiens
FTPKTNTKT

SEQ ID NO: 857035 - protein, 9 aa, Homo Sapiens
ESSKVKLLR

SEQ ID NO: 857036 - protein, 9 aa, Homo Sapiens
LCKREQKQR

SEQ ID NO: 857037 - protein, 9 aa, Homo Sapiens
GSQKLFYLG

SEQ ID NO: 857038 - protein, 9 aa, Homo Sapiens
YNFHSLKSG

SEQ ID NO: 857039 - protein, 9 aa, Homo Sapiens
TPGFPTSCE

SEQ ID NO: 857040 - protein, 9 aa, Homo Sapiens
YPIFDKFSS

SEQ ID NO: 857041 - protein, 9 aa, Homo Sapiens
SHTMDCFEM

SEQ ID NO: 857042 - protein, 9 aa, Homo Sapiens
QYAEDQGFQ

SEQ ID NO: 857043 - protein, 9 aa, Homo Sapiens
SFDNCQRNA

SEQ ID NO: 857044 - protein, 9 aa, Homo Sapiens
LLTNVVMGH

SEQ ID NO: 857045 - protein, 9 aa, Homo Sapiens
YFIAPKQRL

SEQ ID NO: 857046 - protein, 9 aa, Homo Sapiens
ISGTCPDVE

SEQ ID NO: 857047 - protein, 9 aa, Homo Sapiens
NVCALANHA

SEQ ID NO: 857048 - protein, 9 aa, Homo Sapiens
LLRVEPYPT

SEQ ID NO: 857049 - protein, 9 aa, Homo Sapiens
RPTWEEVKQ

SEQ ID NO: 857050 - protein, 9 aa, Homo Sapiens
YPGVCYPVL

SEQ ID NO: 857051 - protein, 9 aa, Homo Sapiens
VLIEFYLLR

SEQ ID NO: 857052 - protein, 9 aa, Homo Sapiens
NVDGKSLLD

SEQ ID NO: 857053 - protein, 9 aa, Homo Sapiens
LKCMIYELF

SEQ ID NO: 857054 - protein, 9 aa, Homo Sapiens
KMHNAKKSY

SEQ ID NO: 857055 - protein, 9 aa, Homo Sapiens
SVPPLALAP

SEQ ID NO: 857056 - protein, 9 aa, Homo Sapiens
DEILWGQHF

SEQ ID NO: 857057 - protein, 9 aa, Homo Sapiens
MADTLGEAW

SEQ ID NO: 857058 - protein, 9 aa, Homo Sapiens
MGTFIELSS

SEQ ID NO: 857059 - protein, 9 aa, Homo Sapiens
KETNRKLYC

SEQ ID NO: 857060 - protein, 9 aa, Homo Sapiens
CEEIATQFR

SEQ ID NO: 857061 - protein, 9 aa, Homo Sapiens
CTVHITDLY

SEQ ID NO: 857062 - protein, 9 aa, Homo Sapiens
GKTLTDAQV

SEQ ID NO: 857063 - protein, 9 aa, Homo Sapiens
DFPKNNKNK

SEQ ID NO: 857064 - protein, 9 aa, Homo Sapiens
YDQRRIDTK

SEQ ID NO: 857065 - protein, 9 aa, Homo Sapiens
DNKSEYLFK

SEQ ID NO: 857066 - protein, 9 aa, Homo Sapiens
AIRDKLQCT

SEQ ID NO: 857067 - protein, 9 aa, Homo Sapiens
PAELKKLQQ

SEQ ID NO: 857068 - protein, 9 aa, Homo Sapiens
KYVKFQMKQ

SEQ ID NO: 857069 - protein, 9 aa, Homo Sapiens
QVVKFLIKT

SEQ ID NO: 857070 - protein, 9 aa, Homo Sapiens
QWLKLIISC

SEQ ID NO: 857071 - protein, 9 aa, Homo Sapiens
VKRVAATSR

SEQ ID NO: 857072 - protein, 9 aa, Homo Sapiens
RWVEHRGWG

SEQ ID NO: 857073 - protein, 9 aa, Homo Sapiens
PYFQSAAIQ

SEQ ID NO: 857074 - protein, 9 aa, Homo Sapiens
FKSAIRRTI

SEQ ID NO: 857075 - protein, 9 aa, Homo Sapiens
VIVYILAVV

SEQ ID NO: 857076 - protein, 9 aa, Homo Sapiens
DNSYKCEEN

SEQ ID NO: 857077 - protein, 9 aa, Homo Sapiens
CSITAFAIE

SEQ ID NO: 857078 - protein, 9 aa, Homo Sapiens
GDHVRAFKP

SEQ ID NO: 857079 - protein, 9 aa, Homo Sapiens
NILLALTDD

SEQ ID NO: 857080 - protein, 9 aa, Homo Sapiens
VSAVQLQER

SEQ ID NO: 857081 - protein, 9 aa, Homo Sapiens
LFFQNQLLR

SEQ ID NO: 857082 - protein, 9 aa, Homo Sapiens
EGMGVIPRI

SEQ ID NO: 857083 - protein, 9 aa, Homo Sapiens
FDPYGNNKF

SEQ ID NO: 857084 - protein, 9 aa, Homo Sapiens
DRDRGRDRS

SEQ ID NO: 857085 - protein, 9 aa, Homo Sapiens
CFKRWRSYV

SEQ ID NO: 857086 - protein, 9 aa, Homo Sapiens
EEERCNMPL

SEQ ID NO: 857087 - protein, 9 aa, Homo Sapiens
NYQPQSSYS

SEQ ID NO: 857088 - protein, 9 aa, Homo Sapiens
SRDILAGLP

SEQ ID NO: 857089 - protein, 9 aa, Homo Sapiens
HPILQVALG

SEQ ID NO: 857090 - protein, 9 aa, Homo Sapiens
KEDCVQIWY

SEQ ID NO: 857091 - protein, 9 aa, Homo Sapiens
PPELQIALM

SEQ ID NO: 857092 - protein, 9 aa, Homo Sapiens
LLEGADYVS

SEQ ID NO: 857093 - protein, 9 aa, Homo Sapiens
GNIISNILK

SEQ ID NO: 857094 - protein, 9 aa, Homo Sapiens
LYSLIQILM

SEQ ID NO: 857095 - protein, 9 aa, Homo Sapiens
DLVEALERN

SEQ ID NO: 857096 - protein, 9 aa, Homo Sapiens
NYCDPVLDL

SEQ ID NO: 857097 - protein, 9 aa, Homo Sapiens
LMASLATHF

SEQ ID NO: 857098 - protein, 9 aa, Homo Sapiens
YDVAVNIVN

SEQ ID NO: 857099 - protein, 9 aa, Homo Sapiens
YTGNLQTLK

SEQ ID NO: 857100 - protein, 9 aa, Homo Sapiens
SFIITLLVK

SEQ ID NO: 857101 - protein, 9 aa, Homo Sapiens
EKRKNNAPK

SEQ ID NO: 857102 - protein, 9 aa, Homo Sapiens
MGFDRYMAI

SEQ ID NO: 857103 - protein, 9 aa, Homo Sapiens
PRSESSSEK

SEQ ID NO: 857104 - protein, 9 aa, Homo Sapiens
NIIYRDRNV

SEQ ID NO: 857105 - protein, 9 aa, Homo Sapiens
DWCKCKKVK

SEQ ID NO: 857106 - protein, 9 aa, Homo Sapiens
WKKSCGRVQ

SEQ ID NO: 857107 - protein, 9 aa, Homo Sapiens
GTSLCCGGV

SEQ ID NO: 857108 - protein, 9 aa, Homo Sapiens
PYSAFLSAV

SEQ ID NO: 857109 - protein, 9 aa, Homo Sapiens
REKNQGFDS

SEQ ID NO: 857110 - protein, 9 aa, Homo Sapiens
EIREENMDN

SEQ ID NO: 857111 - protein, 9 aa, Homo Sapiens
CVTRRETGQ

SEQ ID NO: 857112 - protein, 9 aa, Homo Sapiens
CCNLLRAAL

SEQ ID NO: 857113 - protein, 9 aa, Homo Sapiens
WSYFSQLQK

SEQ ID NO: 857114 - protein, 9 aa, Homo Sapiens
VFSQRTYRI

SEQ ID NO: 857115 - protein, 9 aa, Homo Sapiens
QYHFESKHP

SEQ ID NO: 857116 - protein, 9 aa, Homo Sapiens
YYVVFGSRN

SEQ ID NO: 857117 - protein, 9 aa, Homo Sapiens
ETALQSSHR

SEQ ID NO: 857118 - protein, 9 aa, Homo Sapiens
RVPIDWDPQ

SEQ ID NO: 857119 - protein, 9 aa, Homo Sapiens
LLDALHLQC

SEQ ID NO: 857120 - protein, 9 aa, Homo Sapiens
LYVFNPIVG

SEQ ID NO: 857121 - protein, 9 aa, Homo Sapiens
EDIGNKIKY

SEQ ID NO: 857122 - protein, 9 aa, Homo Sapiens
RVALEDSGL

SEQ ID NO: 857123 - protein, 9 aa, Homo Sapiens
ASHSFTLSW

SEQ ID NO: 857124 - protein, 9 aa, Homo Sapiens
SEDEEEDDV

SEQ ID NO: 857125 - protein, 9 aa, Homo Sapiens
IYFFLGASL

SEQ ID NO: 857126 - protein, 9 aa, Homo Sapiens
LARMKIPDT

SEQ ID NO: 857127 - protein, 9 aa, Homo Sapiens
ACTLAKTAC

SEQ ID NO: 857128 - protein, 9 aa, Homo Sapiens
HQYDQIYCG

SEQ ID NO: 857129 - protein, 9 aa, Homo Sapiens
SFFWDKNWP

SEQ ID NO: 857130 - protein, 9 aa, Homo Sapiens
WGQYGNEEM

SEQ ID NO: 857131 - protein, 9 aa, Homo Sapiens
TQNLSKIET

SEQ ID NO: 857132 - protein, 9 aa, Homo Sapiens
TAGKNALHL

SEQ ID NO: 857133 - protein, 9 aa, Homo Sapiens
KHFINTNAA

SEQ ID NO: 857134 - protein, 9 aa, Homo Sapiens
QKLFLTSNR

SEQ ID NO: 857135 - protein, 9 aa, Homo Sapiens
RLQTNFDPR

SEQ ID NO: 857136 - protein, 9 aa, Homo Sapiens
SYLTIALNK

SEQ ID NO: 857137 - protein, 9 aa, Homo Sapiens
FKAKNKVDD

SEQ ID NO: 857138 - protein, 9 aa, Homo Sapiens
MTVKYYMRS

SEQ ID NO: 857139 - protein, 9 aa, Homo Sapiens
CSAYFLRYK

SEQ ID NO: 857140 - protein, 9 aa, Homo Sapiens
FHQIIHTGE

SEQ ID NO: 857141 - protein, 9 aa, Homo Sapiens
ARALCLGVT

SEQ ID NO: 857142 - protein, 9 aa, Homo Sapiens
QVGKAQMQS

SEQ ID NO: 857143 - protein, 9 aa, Homo Sapiens
RAALSRIWQ

SEQ ID NO: 857144 - protein, 9 aa, Homo Sapiens
GILRMFPEG

SEQ ID NO: 857145 - protein, 9 aa, Homo Sapiens
FEFRTTTTA

SEQ ID NO: 857146 - protein, 9 aa, Homo Sapiens
DTESITGSP

SEQ ID NO: 857147 - protein, 9 aa, Homo Sapiens
KRSSISKHN

SEQ ID NO: 857148 - protein, 9 aa, Homo Sapiens
LKVHEIIHS

SEQ ID NO: 857149 - protein, 9 aa, Homo Sapiens
DRVYTLRTE

SEQ ID NO: 857150 - protein, 9 aa, Homo Sapiens
VMFKKIKYF

SEQ ID NO: 857151 - protein, 9 aa, Homo Sapiens
IKSGKQSRT

SEQ ID NO: 857152 - protein, 9 aa, Homo Sapiens
LLAATSIMP

SEQ ID NO: 857153 - protein, 9 aa, Homo Sapiens
NLQKLFLTS

SEQ ID NO: 857154 - protein, 9 aa, Homo Sapiens
QSRTSKLLR

SEQ ID NO: 857155 - protein, 9 aa, Homo Sapiens
LLKEIINVD

SEQ ID NO: 857156 - protein, 9 aa, Homo Sapiens
QLITSGTDR

SEQ ID NO: 857157 - protein, 9 aa, Homo Sapiens
SRPRSPALY

SEQ ID NO: 857158 - protein, 9 aa, Homo Sapiens
SHLQTPMYL

SEQ ID NO: 857159 - protein, 9 aa, Homo Sapiens
LHSKAVAIG

SEQ ID NO: 857160 - protein, 9 aa, Homo Sapiens
SAYFEFVSA

SEQ ID NO: 857161 - protein, 9 aa, Homo Sapiens
TTPSYLTPD

SEQ ID NO: 857162 - protein, 9 aa, Homo Sapiens
GRSQKVNKR

SEQ ID NO: 857163 - protein, 9 aa, Homo Sapiens
SRDTTIKMW

SEQ ID NO: 857164 - protein, 9 aa, Homo Sapiens
SAQVTSHDT

SEQ ID NO: 857165 - protein, 9 aa, Homo Sapiens
AKSKGFGVF

SEQ ID NO: 857166 - protein, 9 aa, Homo Sapiens
WSEGTTPQN

SEQ ID NO: 857167 - protein, 9 aa, Homo Sapiens
RPCFYDIDI

SEQ ID NO: 857168 - protein, 9 aa, Homo Sapiens
YGVKNNTTV

SEQ ID NO: 857169 - protein, 9 aa, Homo Sapiens
VQIGHEVTV

SEQ ID NO: 857170 - protein, 9 aa, Homo Sapiens
SSPGTVHTA

SEQ ID NO: 857171 - protein, 9 aa, Homo Sapiens
GYKVLIQPL

SEQ ID NO: 857172 - protein, 9 aa, Homo Sapiens
HYFIKTTMP

SEQ ID NO: 857173 - protein, 9 aa, Homo Sapiens
HVKVKGYED

SEQ ID NO: 857174 - protein, 9 aa, Homo Sapiens
PSYNAFVKK

SEQ ID NO: 857175 - protein, 9 aa, Homo Sapiens
ERLECIAHD

SEQ ID NO: 857176 - protein, 9 aa, Homo Sapiens
LFMEQYKYE

SEQ ID NO: 857177 - protein, 9 aa, Homo Sapiens
SYDADTGIF

SEQ ID NO: 857178 - protein, 9 aa, Homo Sapiens
IFLPVKHKI

SEQ ID NO: 857179 - protein, 9 aa, Homo Sapiens
MKNYEIKKY

SEQ ID NO: 857180 - protein, 9 aa, Homo Sapiens
VPVSQPFVD

SEQ ID NO: 857181 - protein, 9 aa, Homo Sapiens
NTRVIQLNA

SEQ ID NO: 857182 - protein, 9 aa, Homo Sapiens
QISERKKWI

SEQ ID NO: 857183 - protein, 9 aa, Homo Sapiens
NQNPIAQSL

SEQ ID NO: 857184 - protein, 9 aa, Homo Sapiens
LSFCRSNVA

SEQ ID NO: 857185 - protein, 9 aa, Homo Sapiens
RVKYYSSKP

SEQ ID NO: 857186 - protein, 9 aa, Homo Sapiens
IPSILIILR

SEQ ID NO: 857187 - protein, 9 aa, Homo Sapiens
KIKWIYDEP

SEQ ID NO: 857188 - protein, 9 aa, Homo Sapiens
ITCQKSYNP

SEQ ID NO: 857189 - protein, 9 aa, Homo Sapiens
EGLMKHLNA

SEQ ID NO: 857190 - protein, 9 aa, Homo Sapiens
YNLCNGYTS

SEQ ID NO: 857191 - protein, 9 aa, Homo Sapiens
IPIENMVNP

SEQ ID NO: 857192 - protein, 9 aa, Homo Sapiens
YYLRIHMLK

SEQ ID NO: 857193 - protein, 9 aa, Homo Sapiens
ATYLPDHMS

SEQ ID NO: 857194 - protein, 9 aa, Homo Sapiens
PPSDSQRMM

SEQ ID NO: 857195 - protein, 9 aa, Homo Sapiens
MQEYEEQKK

SEQ ID NO: 857196 - protein, 9 aa, Homo Sapiens
ISATWKREF

SEQ ID NO: 857197 - protein, 9 aa, Homo Sapiens
VPGASHFEH

SEQ ID NO: 857198 - protein, 9 aa, Homo Sapiens
FGHMPEKEM

SEQ ID NO: 857199 - protein, 9 aa, Homo Sapiens
KKKQALVEF

SEQ ID NO: 857200 - protein, 9 aa, Homo Sapiens
NKNVAEIPF

SEQ ID NO: 857201 - protein, 9 aa, Homo Sapiens
EPNLGKKPS

SEQ ID NO: 857202 - protein, 9 aa, Homo Sapiens
YQRVGVPKG

SEQ ID NO: 857203 - protein, 9 aa, Homo Sapiens
NIFIGEKAA

SEQ ID NO: 857204 - protein, 9 aa, Homo Sapiens
PDDGFPSNV

SEQ ID NO: 857205 - protein, 9 aa, Homo Sapiens
YPTDNTKFM

SEQ ID NO: 857206 - protein, 9 aa, Homo Sapiens
FPFPRHGHS

SEQ ID NO: 857207 - protein, 9 aa, Homo Sapiens
DEQQILNKR

SEQ ID NO: 857208 - protein, 9 aa, Homo Sapiens
YYDVMYLSW

SEQ ID NO: 857209 - protein, 9 aa, Homo Sapiens
VNYRQAKTH

SEQ ID NO: 857210 - protein, 9 aa, Homo Sapiens
MGRNRSWGA

SEQ ID NO: 857211 - protein, 9 aa, Homo Sapiens
HRHRAIINT

SEQ ID NO: 857212 - protein, 9 aa, Homo Sapiens
EDYTLLENM

SEQ ID NO: 857213 - protein, 9 aa, Homo Sapiens
YQDVNTSLQ

SEQ ID NO: 857214 - protein, 9 aa, Homo Sapiens
EGTYKEKGI

SEQ ID NO: 857215 - protein, 9 aa, Homo Sapiens
TRIAALKTI

SEQ ID NO: 857216 - protein, 9 aa, Homo Sapiens
YFFVEIRGT

SEQ ID NO: 857217 - protein, 9 aa, Homo Sapiens
LTHKDDSVM

SEQ ID NO: 857218 - protein, 9 aa, Homo Sapiens
ESLDSIAHS

SEQ ID NO: 857219 - protein, 9 aa, Homo Sapiens
RISFNLFVT

SEQ ID NO: 857220 - protein, 9 aa, Homo Sapiens
SKISLAIYF

SEQ ID NO: 857221 - protein, 9 aa, Homo Sapiens
GIEGHPVLR

SEQ ID NO: 857222 - protein, 9 aa, Homo Sapiens
APPGEFNEL

SEQ ID NO: 857223 - protein, 9 aa, Homo Sapiens
VRVEGDCFK

SEQ ID NO: 857224 - protein, 9 aa, Homo Sapiens
INYRLGILV

SEQ ID NO: 857225 - protein, 9 aa, Homo Sapiens
KEAQFRFYR

SEQ ID NO: 857226 - protein, 9 aa, Homo Sapiens
KNILSLMTR

SEQ ID NO: 857227 - protein, 9 aa, Homo Sapiens
RCCNVTIIR

SEQ ID NO: 857228 - protein, 9 aa, Homo Sapiens
LNELSEYVR

SEQ ID NO: 857229 - protein, 9 aa, Homo Sapiens
EEDLQLLDL

SEQ ID NO: 857230 - protein, 9 aa, Homo Sapiens
LNCCDDSQR

SEQ ID NO: 857231 - protein, 9 aa, Homo Sapiens
SHSEKKARK

SEQ ID NO: 857232 - protein, 9 aa, Homo Sapiens
IYGDTFPDE

SEQ ID NO: 857233 - protein, 9 aa, Homo Sapiens
MLRVGLILP

SEQ ID NO: 857234 - protein, 9 aa, Homo Sapiens
IYQQKFIKE

SEQ ID NO: 857235 - protein, 9 aa, Homo Sapiens
EAAAAAWCH

SEQ ID NO: 857236 - protein, 9 aa, Homo Sapiens
TKLRKLFHP

SEQ ID NO: 857237 - protein, 9 aa, Homo Sapiens
KLRMRVRNS

SEQ ID NO: 857238 - protein, 9 aa, Homo Sapiens
KRKYWALPS

SEQ ID NO: 857239 - protein, 9 aa, Homo Sapiens
TAMMAQNNL

SEQ ID NO: 857240 - protein, 9 aa, Homo Sapiens
KPHDIFKAN

SEQ ID NO: 857241 - protein, 9 aa, Homo Sapiens
TVKDEPQRR

SEQ ID NO: 857242 - protein, 9 aa, Homo Sapiens
AKLDQEAEE

SEQ ID NO: 857243 - protein, 9 aa, Homo Sapiens
CGKYAYVTV

SEQ ID NO: 857244 - protein, 9 aa, Homo Sapiens
TGVASTRHD

SEQ ID NO: 857245 - protein, 9 aa, Homo Sapiens
RQTFRKIIH

SEQ ID NO: 857246 - protein, 9 aa, Homo Sapiens
RSCSRLTHL

SEQ ID NO: 857247 - protein, 9 aa, Homo Sapiens
DNARLDTLW

SEQ ID NO: 857248 - protein, 9 aa, Homo Sapiens
DKFKPEVKM

SEQ ID NO: 857249 - protein, 9 aa, Homo Sapiens
QQNNPATEE

SEQ ID NO: 857250 - protein, 9 aa, Homo Sapiens
DGPISQRDN

SEQ ID NO: 857251 - protein, 9 aa, Homo Sapiens
LAFLAYIVF

SEQ ID NO: 857252 - protein, 9 aa, Homo Sapiens
DLTNHKIIH

SEQ ID NO: 857253 - protein, 9 aa, Homo Sapiens
PEEMCVETM

SEQ ID NO: 857254 - protein, 9 aa, Homo Sapiens
SAKHEYKKM

SEQ ID NO: 857255 - protein, 9 aa, Homo Sapiens
AIVCIMKAR

SEQ ID NO: 857256 - protein, 9 aa, Homo Sapiens
NCNGHSETC

SEQ ID NO: 857257 - protein, 9 aa, Homo Sapiens
RQSRTDNGI

SEQ ID NO: 857258 - protein, 9 aa, Homo Sapiens
CAHTINSSA

SEQ ID NO: 857259 - protein, 9 aa, Homo Sapiens
FPGLIFAIV

SEQ ID NO: 857260 - protein, 9 aa, Homo Sapiens
VNLIGLIPV

SEQ ID NO: 857261 - protein, 9 aa, Homo Sapiens
LRFPHLYKI

SEQ ID NO: 857262 - protein, 9 aa, Homo Sapiens
IMEAVREGL

SEQ ID NO: 857263 - protein, 9 aa, Homo Sapiens
TMLPASASA

SEQ ID NO: 857264 - protein, 9 aa, Homo Sapiens
HWGFLGVYQ

SEQ ID NO: 857265 - protein, 9 aa, Homo Sapiens
KYDAVNYPL

SEQ ID NO: 857266 - protein, 9 aa, Homo Sapiens
VRKHPDCSI

SEQ ID NO: 857267 - protein, 9 aa, Homo Sapiens
DTIDKLKEK

SEQ ID NO: 857268 - protein, 9 aa, Homo Sapiens
CSDELRRHM

SEQ ID NO: 857269 - protein, 9 aa, Homo Sapiens
TINKQIWDT

SEQ ID NO: 857270 - protein, 9 aa, Homo Sapiens
FSGPLKPMP

SEQ ID NO: 857271 - protein, 9 aa, Homo Sapiens
FPQRDSTKS

SEQ ID NO: 857272 - protein, 9 aa, Homo Sapiens
PEPKKSHRC

SEQ ID NO: 857273 - protein, 9 aa, Homo Sapiens
DAVDVTQGY

SEQ ID NO: 857274 - protein, 9 aa, Homo Sapiens
LPKGIHLDK

SEQ ID NO: 857275 - protein, 9 aa, Homo Sapiens
SGQVGYRSP

SEQ ID NO: 857276 - protein, 9 aa, Homo Sapiens
WRELGEQVV

SEQ ID NO: 857277 - protein, 9 aa, Homo Sapiens
FTYYYIQEG

SEQ ID NO: 857278 - protein, 9 aa, Homo Sapiens
CATIRKCLT

SEQ ID NO: 857279 - protein, 9 aa, Homo Sapiens
KQVKEYQIQ

SEQ ID NO: 857280 - protein, 9 aa, Homo Sapiens
LSCAHTQVK

SEQ ID NO: 857281 - protein, 9 aa, Homo Sapiens
LQHGTQQQN

SEQ ID NO: 857282 - protein, 9 aa, Homo Sapiens
RHTGDKPYK

SEQ ID NO: 857283 - protein, 9 aa, Homo Sapiens
LLLGGGSGH

SEQ ID NO: 857284 - protein, 9 aa, Homo Sapiens
VEEIQCYVR

SEQ ID NO: 857285 - protein, 9 aa, Homo Sapiens
GELRKDIST

SEQ ID NO: 857286 - protein, 9 aa, Homo Sapiens
LSHCTVHIT

SEQ ID NO: 857287 - protein, 9 aa, Homo Sapiens
MTRSELYLQ

SEQ ID NO: 857288 - protein, 9 aa, Homo Sapiens
SRLFELFDR

SEQ ID NO: 857289 - protein, 9 aa, Homo Sapiens
PSGGEGLWA

SEQ ID NO: 857290 - protein, 9 aa, Homo Sapiens
IINLGNYTV

SEQ ID NO: 857291 - protein, 9 aa, Homo Sapiens
QRDAFGIYL

SEQ ID NO: 857292 - protein, 9 aa, Homo Sapiens
SVQLIWKKH

SEQ ID NO: 857293 - protein, 9 aa, Homo Sapiens
VCPHPPTAP

SEQ ID NO: 857294 - protein, 9 aa, Homo Sapiens
DIDGEAENG

SEQ ID NO: 857295 - protein, 9 aa, Homo Sapiens
CDLSNDAEY

SEQ ID NO: 857296 - protein, 9 aa, Homo Sapiens
PTRRLFKVT

SEQ ID NO: 857297 - protein, 9 aa, Homo Sapiens
LFPPSYPYS

SEQ ID NO: 857298 - protein, 9 aa, Homo Sapiens
RAYAEKIML

SEQ ID NO: 857299 - protein, 9 aa, Homo Sapiens
QALVNRWLN

SEQ ID NO: 857300 - protein, 9 aa, Homo Sapiens
CRKSFHLFG

SEQ ID NO: 857301 - protein, 9 aa, Homo Sapiens
DLQNGMIIP

SEQ ID NO: 857302 - protein, 9 aa, Homo Sapiens
RSHSWKINH

SEQ ID NO: 857303 - protein, 9 aa, Homo Sapiens
VLNFCKVFL

SEQ ID NO: 857304 - protein, 9 aa, Homo Sapiens
INISEVVIK

SEQ ID NO: 857305 - protein, 9 aa, Homo Sapiens
QAKELFLLQ

SEQ ID NO: 857306 - protein, 9 aa, Homo Sapiens
LKNIIQINT

SEQ ID NO: 857307 - protein, 9 aa, Homo Sapiens
DYNCRERMV

SEQ ID NO: 857308 - protein, 9 aa, Homo Sapiens
FCHEQCEAK

SEQ ID NO: 857309 - protein, 9 aa, Homo Sapiens
LIRLQSLHI

SEQ ID NO: 857310 - protein, 9 aa, Homo Sapiens
GPDNKYDPE

SEQ ID NO: 857311 - protein, 9 aa, Homo Sapiens
EPRMLGAVQ

SEQ ID NO: 857312 - protein, 9 aa, Homo Sapiens
YQLSKNFKK

SEQ ID NO: 857313 - protein, 9 aa, Homo Sapiens
KIKKNQLKF

SEQ ID NO: 857314 - protein, 9 aa, Homo Sapiens
SMDNCPHKF

SEQ ID NO: 857315 - protein, 9 aa, Homo Sapiens
PGFIGSIGP

SEQ ID NO: 857316 - protein, 9 aa, Homo Sapiens
PTKSEFTKL

SEQ ID NO: 857317 - protein, 9 aa, Homo Sapiens
KQETSLLKN

SEQ ID NO: 857318 - protein, 9 aa, Homo Sapiens
APGCTLVLD

SEQ ID NO: 857319 - protein, 9 aa, Homo Sapiens
SFNVSQGRL

SEQ ID NO: 857320 - protein, 9 aa, Homo Sapiens
TYLQQRYLA

SEQ ID NO: 857321 - protein, 9 aa, Homo Sapiens
LFYSLKNPS

SEQ ID NO: 857322 - protein, 9 aa, Homo Sapiens
DEMATYDLP

SEQ ID NO: 857323 - protein, 9 aa, Homo Sapiens
FFPQRDSTK

SEQ ID NO: 857324 - protein, 9 aa, Homo Sapiens
DSDRDLVCS

SEQ ID NO: 857325 - protein, 9 aa, Homo Sapiens
DSPREDEQF

SEQ ID NO: 857326 - protein, 9 aa, Homo Sapiens
NKLYVSPGT

SEQ ID NO: 857327 - protein, 9 aa, Homo Sapiens
SQARGRQTQ

SEQ ID NO: 857328 - protein, 9 aa, Homo Sapiens
YPVMSTLLP

SEQ ID NO: 857329 - protein, 9 aa, Homo Sapiens
LMAMVRPII

SEQ ID NO: 857330 - protein, 9 aa, Homo Sapiens
GVLINSKPE

SEQ ID NO: 857331 - protein, 9 aa, Homo Sapiens
TRSSAEITS

SEQ ID NO: 857332 - protein, 9 aa, Homo Sapiens
VCTFQKREE

SEQ ID NO: 857333 - protein, 9 aa, Homo Sapiens
QDNALLDKV

SEQ ID NO: 857334 - protein, 9 aa, Homo Sapiens
SNTPALVFE

SEQ ID NO: 857335 - protein, 9 aa, Homo Sapiens
TPLMIALLG

SEQ ID NO: 857336 - protein, 9 aa, Homo Sapiens
RENNKPHTV

SEQ ID NO: 857337 - protein, 9 aa, Homo Sapiens
TPYAGIKNA

SEQ ID NO: 857338 - protein, 9 aa, Homo Sapiens
NQHPGHFST

SEQ ID NO: 857339 - protein, 9 aa, Homo Sapiens
DSITVSVYQ

SEQ ID NO: 857340 - protein, 9 aa, Homo Sapiens
TKENLCSFT

SEQ ID NO: 857341 - protein, 9 aa, Homo Sapiens
QVQTIQILT

SEQ ID NO: 857342 - protein, 9 aa, Homo Sapiens
RITLLVHTS

SEQ ID NO: 857343 - protein, 9 aa, Homo Sapiens
QHFNGKYMK

SEQ ID NO: 857344 - protein, 9 aa, Homo Sapiens
EGRVFQGKW

SEQ ID NO: 857345 - protein, 9 aa, Homo Sapiens
EQQTRPVWT

SEQ ID NO: 857346 - protein, 9 aa, Homo Sapiens
IYVVYSTGG

SEQ ID NO: 857347 - protein, 9 aa, Homo Sapiens
FVSGSDDAT

SEQ ID NO: 857348 - protein, 9 aa, Homo Sapiens
VNDRCQKMC

SEQ ID NO: 857349 - protein, 9 aa, Homo Sapiens
KQFENTEMF

SEQ ID NO: 857350 - protein, 9 aa, Homo Sapiens
NVKELTKEE

SEQ ID NO: 857351 - protein, 9 aa, Homo Sapiens
ISASKIELL

SEQ ID NO: 857352 - protein, 9 aa, Homo Sapiens
NDRKEDKEK

SEQ ID NO: 857353 - protein, 9 aa, Homo Sapiens
VMLDNLALL

SEQ ID NO: 857354 - protein, 9 aa, Homo Sapiens
NLIKGRNIY

SEQ ID NO: 857355 - protein, 9 aa, Homo Sapiens
DEDADISDD

SEQ ID NO: 857356 - protein, 9 aa, Homo Sapiens
HYLKPDITW

SEQ ID NO: 857357 - protein, 9 aa, Homo Sapiens
YEESSKPKG

SEQ ID NO: 857358 - protein, 9 aa, Homo Sapiens
MLLNERKVF

SEQ ID NO: 857359 - protein, 9 aa, Homo Sapiens
RSNVAEHFF

SEQ ID NO: 857360 - protein, 9 aa, Homo Sapiens
IEKLEQRQA

SEQ ID NO: 857361 - protein, 9 aa, Homo Sapiens
ARCGLNPVI

SEQ ID NO: 857362 - protein, 9 aa, Homo Sapiens
KTEQVQHSE

SEQ ID NO: 857363 - protein, 9 aa, Homo Sapiens
LILKRLIIN

SEQ ID NO: 857364 - protein, 9 aa, Homo Sapiens
AGAWGFPRP

SEQ ID NO: 857365 - protein, 9 aa, Homo Sapiens
GRDPTRQDT

SEQ ID NO: 857366 - protein, 9 aa, Homo Sapiens
EEAKDNFKN

SEQ ID NO: 857367 - protein, 9 aa, Homo Sapiens
LLIIKGKYA

SEQ ID NO: 857368 - protein, 9 aa, Homo Sapiens
MQMAAFAIN

SEQ ID NO: 857369 - protein, 9 aa, Homo Sapiens
HQAAQLSRT

SEQ ID NO: 857370 - protein, 9 aa, Homo Sapiens
TCKECGKLF

SEQ ID NO: 857371 - protein, 9 aa, Homo Sapiens
TGVCIRCDA

SEQ ID NO: 857372 - protein, 9 aa, Homo Sapiens
ISSEDLHDY

SEQ ID NO: 857373 - protein, 9 aa, Homo Sapiens
INSEGTCIH

SEQ ID NO: 857374 - protein, 9 aa, Homo Sapiens
LLRHPEERA

SEQ ID NO: 857375 - protein, 9 aa, Homo Sapiens
QAAAPVTEG

SEQ ID NO: 857376 - protein, 9 aa, Homo Sapiens
NKIVEVTLL

SEQ ID NO: 857377 - protein, 9 aa, Homo Sapiens
AENVSKKEN

SEQ ID NO: 857378 - protein, 9 aa, Homo Sapiens
KKVECREKR

SEQ ID NO: 857379 - protein, 9 aa, Homo Sapiens
LNIQGSLFK

SEQ ID NO: 857380 - protein, 9 aa, Homo Sapiens
SIIFICAGY

SEQ ID NO: 857381 - protein, 9 aa, Homo Sapiens
SFQDRYKKL

SEQ ID NO: 857382 - protein, 9 aa, Homo Sapiens
QCKKEENNL

SEQ ID NO: 857383 - protein, 9 aa, Homo Sapiens
TLNPYRYPD

SEQ ID NO: 857384 - protein, 9 aa, Homo Sapiens
PHKLQEPMT

SEQ ID NO: 857385 - protein, 9 aa, Homo Sapiens
IFKEMSNAF

SEQ ID NO: 857386 - protein, 9 aa, Homo Sapiens
QDKQGVICD

SEQ ID NO: 857387 - protein, 9 aa, Homo Sapiens
KDPNERGSW

SEQ ID NO: 857388 - protein, 9 aa, Homo Sapiens
GVMPHELGH

SEQ ID NO: 857389 - protein, 9 aa, Homo Sapiens
RARLDYMVL

SEQ ID NO: 857390 - protein, 9 aa, Homo Sapiens
VTSIGDVIN

SEQ ID NO: 857391 - protein, 9 aa, Homo Sapiens
CKAPIKEKK

SEQ ID NO: 857392 - protein, 9 aa, Homo Sapiens
ALGHVSFKL

SEQ ID NO: 857393 - protein, 9 aa, Homo Sapiens
KRQQGLQHF

SEQ ID NO: 857394 - protein, 9 aa, Homo Sapiens
EDSLRRENN

SEQ ID NO: 857395 - protein, 9 aa, Homo Sapiens
TCHILLHLF

SEQ ID NO: 857396 - protein, 9 aa, Homo Sapiens
PEPIIDDNM

SEQ ID NO: 857397 - protein, 9 aa, Homo Sapiens
GYNQYSYGS

SEQ ID NO: 857398 - protein, 9 aa, Homo Sapiens
SVQKSITQW

SEQ ID NO: 857399 - protein, 9 aa, Homo Sapiens
QPAQGCMGY

SEQ ID NO: 857400 - protein, 9 aa, Homo Sapiens
FYHLPSNKK

SEQ ID NO: 857401 - protein, 9 aa, Homo Sapiens
RGNRGVIVF

SEQ ID NO: 857402 - protein, 9 aa, Homo Sapiens
NVHRKASVI

SEQ ID NO: 857403 - protein, 9 aa, Homo Sapiens
QQNGAPLKV

SEQ ID NO: 857404 - protein, 9 aa, Homo Sapiens
LAPQDSHGC

SEQ ID NO: 857405 - protein, 9 aa, Homo Sapiens
LSKLCSKLR

SEQ ID NO: 857406 - protein, 9 aa, Homo Sapiens
QGKWERAFF

SEQ ID NO: 857407 - protein, 9 aa, Homo Sapiens
LLMGELLMH

SEQ ID NO: 857408 - protein, 9 aa, Homo Sapiens
RRIYDMTNV

SEQ ID NO: 857409 - protein, 9 aa, Homo Sapiens
VNIPENIYR

SEQ ID NO: 857410 - protein, 9 aa, Homo Sapiens
LFGSLAGLS

SEQ ID NO: 857411 - protein, 9 aa, Homo Sapiens
EESIQRIEN

SEQ ID NO: 857412 - protein, 9 aa, Homo Sapiens
VQARMLSLT

SEQ ID NO: 857413 - protein, 9 aa, Homo Sapiens
RVRTLIAVL

SEQ ID NO: 857414 - protein, 9 aa, Homo Sapiens
WLLSKANAE

SEQ ID NO: 857415 - protein, 9 aa, Homo Sapiens
KRGLRNKII

SEQ ID NO: 857416 - protein, 9 aa, Homo Sapiens
LQVKQRPTS

SEQ ID NO: 857417 - protein, 9 aa, Homo Sapiens
SVHFYAKCR

SEQ ID NO: 857418 - protein, 9 aa, Homo Sapiens
WLLWCVLLC

SEQ ID NO: 857419 - protein, 9 aa, Homo Sapiens
TYHYSEKPI

SEQ ID NO: 857420 - protein, 9 aa, Homo Sapiens
FETQGNDRL

SEQ ID NO: 857421 - protein, 9 aa, Homo Sapiens
RAQKYYDDY

SEQ ID NO: 857422 - protein, 9 aa, Homo Sapiens
LPQVFSFFP

SEQ ID NO: 857423 - protein, 9 aa, Homo Sapiens
DYVKITLRN

SEQ ID NO: 857424 - protein, 9 aa, Homo Sapiens
KGAVKIWKG

SEQ ID NO: 857425 - protein, 9 aa, Homo Sapiens
HGLQETCYW

SEQ ID NO: 857426 - protein, 9 aa, Homo Sapiens
VMYLSWNPG

SEQ ID NO: 857427 - protein, 9 aa, Homo Sapiens
NRDCGIPLC

SEQ ID NO: 857428 - protein, 9 aa, Homo Sapiens
RFVTTSYLI

SEQ ID NO: 857429 - protein, 9 aa, Homo Sapiens
EWWAQNAVQ

SEQ ID NO: 857430 - protein, 9 aa, Homo Sapiens
ITVIKAPRD

SEQ ID NO: 857431 - protein, 9 aa, Homo Sapiens
CIAFSTNPS

SEQ ID NO: 857432 - protein, 9 aa, Homo Sapiens
WNSYSALSL

SEQ ID NO: 857433 - protein, 9 aa, Homo Sapiens
IRLTAAEER

SEQ ID NO: 857434 - protein, 9 aa, Homo Sapiens
RLQLRLNLY

SEQ ID NO: 857435 - protein, 9 aa, Homo Sapiens
ELRIVGAQL

SEQ ID NO: 857436 - protein, 9 aa, Homo Sapiens
DLDTFICHT

SEQ ID NO: 857437 - protein, 9 aa, Homo Sapiens
AGAVFMALS

SEQ ID NO: 857438 - protein, 9 aa, Homo Sapiens
PPKFFKVED

SEQ ID NO: 857439 - protein, 9 aa, Homo Sapiens
IQEMPNVTN

SEQ ID NO: 857440 - protein, 9 aa, Homo Sapiens
DDRKCLEDE

SEQ ID NO: 857441 - protein, 9 aa, Homo Sapiens
MTNHLYAAI

SEQ ID NO: 857442 - protein, 9 aa, Homo Sapiens
MFIHDLVSA

SEQ ID NO: 857443 - protein, 9 aa, Homo Sapiens
LSGDYADPP

SEQ ID NO: 857444 - protein, 9 aa, Homo Sapiens
TGFHHVGLW

SEQ ID NO: 857445 - protein, 9 aa, Homo Sapiens
EATNMYDNA

SEQ ID NO: 857446 - protein, 9 aa, Homo Sapiens
AMVLFMITS

SEQ ID NO: 857447 - protein, 9 aa, Homo Sapiens
GLPKGIHLD

SEQ ID NO: 857448 - protein, 9 aa, Homo Sapiens
RLDLGKCIL

SEQ ID NO: 857449 - protein, 9 aa, Homo Sapiens
QLAHEHHCL

SEQ ID NO: 857450 - protein, 9 aa, Homo Sapiens
HLLHKSCVD

SEQ ID NO: 857451 - protein, 9 aa, Homo Sapiens
HHCLLPVLS

SEQ ID NO: 857452 - protein, 9 aa, Homo Sapiens
IKKIINLKS

SEQ ID NO: 857453 - protein, 9 aa, Homo Sapiens
IEAWINLNK

SEQ ID NO: 857454 - protein, 9 aa, Homo Sapiens
TMGKALVDQ

SEQ ID NO: 857455 - protein, 9 aa, Homo Sapiens
IFELIHKYI

SEQ ID NO: 857456 - protein, 9 aa, Homo Sapiens
NKATPCLEL

SEQ ID NO: 857457 - protein, 9 aa, Homo Sapiens
GQGSHSQQK

SEQ ID NO: 857458 - protein, 9 aa, Homo Sapiens
KEHMFCKEA

SEQ ID NO: 857459 - protein, 9 aa, Homo Sapiens
YAIGISLLK

SEQ ID NO: 857460 - protein, 9 aa, Homo Sapiens
QEGGINKEI

SEQ ID NO: 857461 - protein, 9 aa, Homo Sapiens
KDSAFERNN

SEQ ID NO: 857462 - protein, 9 aa, Homo Sapiens
CQAASDPMS

SEQ ID NO: 857463 - protein, 9 aa, Homo Sapiens
TSTTLKYGL

SEQ ID NO: 857464 - protein, 9 aa, Homo Sapiens
SPFNERNGM

SEQ ID NO: 857465 - protein, 9 aa, Homo Sapiens
EWLRSQHRD

SEQ ID NO: 857466 - protein, 9 aa, Homo Sapiens
RFAPQLSGY

SEQ ID NO: 857467 - protein, 9 aa, Homo Sapiens
PMFPALGEV

SEQ ID NO: 857468 - protein, 9 aa, Homo Sapiens
ERCSAYFLR

SEQ ID NO: 857469 - protein, 9 aa, Homo Sapiens
YCRKKVHHP

SEQ ID NO: 857470 - protein, 9 aa, Homo Sapiens
EEWWAQNAV

SEQ ID NO: 857471 - protein, 9 aa, Homo Sapiens
FCHDCEFHE

SEQ ID NO: 857472 - protein, 9 aa, Homo Sapiens
VKSALPTLT

SEQ ID NO: 857473 - protein, 9 aa, Homo Sapiens
SGPSSRGGS

SEQ ID NO: 857474 - protein, 9 aa, Homo Sapiens
KLKLARDVV

SEQ ID NO: 857475 - protein, 9 aa, Homo Sapiens
LKRASAEES

SEQ ID NO: 857476 - protein, 9 aa, Homo Sapiens
IPKWEQFIL

SEQ ID NO: 857477 - protein, 9 aa, Homo Sapiens
YNDNCSLEK

SEQ ID NO: 857478 - protein, 9 aa, Homo Sapiens
FPNTWLLAR

SEQ ID NO: 857479 - protein, 9 aa, Homo Sapiens
FWNKPSSSS

SEQ ID NO: 857480 - protein, 9 aa, Homo Sapiens
VQDCHVLTY

SEQ ID NO: 857481 - protein, 9 aa, Homo Sapiens
RNSPSFDAI

SEQ ID NO: 857482 - protein, 9 aa, Homo Sapiens
WAKGLGADG

SEQ ID NO: 857483 - protein, 9 aa, Homo Sapiens
PTAPSKLES

SEQ ID NO: 857484 - protein, 9 aa, Homo Sapiens
PAKNSAESH

SEQ ID NO: 857485 - protein, 9 aa, Homo Sapiens
LLRGNRATK

SEQ ID NO: 857486 - protein, 9 aa, Homo Sapiens
KPFQREECG

SEQ ID NO: 857487 - protein, 9 aa, Homo Sapiens
DGLPKGIHL

SEQ ID NO: 857488 - protein, 9 aa, Homo Sapiens
SRISKVLQK

SEQ ID NO: 857489 - protein, 9 aa, Homo Sapiens
ASSKNKDKL

SEQ ID NO: 857490 - protein, 9 aa, Homo Sapiens
DWTMISRPY

SEQ ID NO: 857491 - protein, 9 aa, Homo Sapiens
GIYPIDVMN

SEQ ID NO: 857492 - protein, 9 aa, Homo Sapiens
QIRRHKNYL

SEQ ID NO: 857493 - protein, 9 aa, Homo Sapiens
TLDNNEAVI

SEQ ID NO: 857494 - protein, 9 aa, Homo Sapiens
SPGHTVYAK

SEQ ID NO: 857495 - protein, 9 aa, Homo Sapiens
RASSSRSSS

SEQ ID NO: 857496 - protein, 9 aa, Homo Sapiens
FDMHIPYFP

SEQ ID NO: 857497 - protein, 9 aa, Homo Sapiens
RRTSTFSGF

SEQ ID NO: 857498 - protein, 9 aa, Homo Sapiens
SDIGNMPAI

SEQ ID NO: 857499 - protein, 9 aa, Homo Sapiens
LAFEDMLDN

SEQ ID NO: 857500 - protein, 9 aa, Homo Sapiens
YYIAGYLFP

SEQ ID NO: 857501 - protein, 9 aa, Homo Sapiens
QVVRLIAEG

SEQ ID NO: 857502 - protein, 9 aa, Homo Sapiens
EDTNFQHMI

SEQ ID NO: 857503 - protein, 9 aa, Homo Sapiens
QSILLLLVL

SEQ ID NO: 857504 - protein, 9 aa, Homo Sapiens
TLLVLHKSG

SEQ ID NO: 857505 - protein, 9 aa, Homo Sapiens
YMEKIWHHT

SEQ ID NO: 857506 - protein, 9 aa, Homo Sapiens
QIDLMDMAD

SEQ ID NO: 857507 - protein, 9 aa, Homo Sapiens
FYSTFQALM

SEQ ID NO: 857508 - protein, 9 aa, Homo Sapiens
KLTDIVSFL

SEQ ID NO: 857509 - protein, 9 aa, Homo Sapiens
PGAEPDKMG

SEQ ID NO: 857510 - protein, 9 aa, Homo Sapiens
RTMKYKPDH

SEQ ID NO: 857511 - protein, 9 aa, Homo Sapiens
REQLDTFID

SEQ ID NO: 857512 - protein, 9 aa, Homo Sapiens
DLETIVNLK

SEQ ID NO: 857513 - protein, 9 aa, Homo Sapiens
NKCGKSFCV

SEQ ID NO: 857514 - protein, 9 aa, Homo Sapiens
SGNSKLSIK

SEQ ID NO: 857515 - protein, 9 aa, Homo Sapiens
PIAQSLASR

SEQ ID NO: 857516 - protein, 9 aa, Homo Sapiens
GPGCYNVLN

SEQ ID NO: 857517 - protein, 9 aa, Homo Sapiens
PSLDNFLRN

SEQ ID NO: 857518 - protein, 9 aa, Homo Sapiens
MRIVLIIYN

SEQ ID NO: 857519 - protein, 9 aa, Homo Sapiens
HKEAQFRFY

SEQ ID NO: 857520 - protein, 9 aa, Homo Sapiens
YIIVIFVIA

SEQ ID NO: 857521 - protein, 9 aa, Homo Sapiens
AVWMPSPVS

SEQ ID NO: 857522 - protein, 9 aa, Homo Sapiens
AFSLLSHEQ

SEQ ID NO: 857523 - protein, 9 aa, Homo Sapiens
LLQHNMKCC

SEQ ID NO: 857524 - protein, 9 aa, Homo Sapiens
LRHPEERAQ

SEQ ID NO: 857525 - protein, 9 aa, Homo Sapiens
KVDKPEAFT

SEQ ID NO: 857526 - protein, 9 aa, Homo Sapiens
APTVKPRET

SEQ ID NO: 857527 - protein, 9 aa, Homo Sapiens
QASYQHEAL

SEQ ID NO: 857528 - protein, 9 aa, Homo Sapiens
REYAFHIFR

SEQ ID NO: 857529 - protein, 9 aa, Homo Sapiens
DKQGTSRGH

SEQ ID NO: 857530 - protein, 9 aa, Homo Sapiens
GKDGYVPLF

SEQ ID NO: 857531 - protein, 9 aa, Homo Sapiens
DAACFGEIS

SEQ ID NO: 857532 - protein, 9 aa, Homo Sapiens
KCGKTFSGR

SEQ ID NO: 857533 - protein, 9 aa, Homo Sapiens
EKINSEKEV

SEQ ID NO: 857534 - protein, 9 aa, Homo Sapiens
YFPIRSKLS

SEQ ID NO: 857535 - protein, 9 aa, Homo Sapiens
KLKQDEQRN

SEQ ID NO: 857536 - protein, 9 aa, Homo Sapiens
APNSLLNAL

SEQ ID NO: 857537 - protein, 9 aa, Homo Sapiens
SNSTAWQDL

SEQ ID NO: 857538 - protein, 9 aa, Homo Sapiens
TNSNDGPER

SEQ ID NO: 857539 - protein, 9 aa, Homo Sapiens
GDWEVNGKT

SEQ ID NO: 857540 - protein, 9 aa, Homo Sapiens
DDVEEALSY

SEQ ID NO: 857541 - protein, 9 aa, Homo Sapiens
KLWKWIAYY

SEQ ID NO: 857542 - protein, 9 aa, Homo Sapiens
NKTIRGKKY

SEQ ID NO: 857543 - protein, 9 aa, Homo Sapiens
ILRFSVTWG

SEQ ID NO: 857544 - protein, 9 aa, Homo Sapiens
GCLLNLSCS

SEQ ID NO: 857545 - protein, 9 aa, Homo Sapiens
EKQLGGKIH

SEQ ID NO: 857546 - protein, 9 aa, Homo Sapiens
RGFGKSGEL

SEQ ID NO: 857547 - protein, 9 aa, Homo Sapiens
KSDDPVEDD

SEQ ID NO: 857548 - protein, 9 aa, Homo Sapiens
DNCEDVADF

SEQ ID NO: 857549 - protein, 9 aa, Homo Sapiens
KRYFSEIKS

SEQ ID NO: 857550 - protein, 9 aa, Homo Sapiens
NNRLESQGV

SEQ ID NO: 857551 - protein, 9 aa, Homo Sapiens
YKQVIEAPD

SEQ ID NO: 857552 - protein, 9 aa, Homo Sapiens
SEGIDSDNL

SEQ ID NO: 857553 - protein, 9 aa, Homo Sapiens
LAMMGALHP

SEQ ID NO: 857554 - protein, 9 aa, Homo Sapiens
DKRDPLQQV

SEQ ID NO: 857555 - protein, 9 aa, Homo Sapiens
MNKHQVPKL

SEQ ID NO: 857556 - protein, 9 aa, Homo Sapiens
DKAFSKPST

SEQ ID NO: 857557 - protein, 9 aa, Homo Sapiens
DLNRFWLET

SEQ ID NO: 857558 - protein, 9 aa, Homo Sapiens
DWFYYSISI

SEQ ID NO: 857559 - protein, 9 aa, Homo Sapiens
LPSELSLLH

SEQ ID NO: 857560 - protein, 9 aa, Homo Sapiens
TTSFFRDSP

SEQ ID NO: 857561 - protein, 9 aa, Homo Sapiens
SILTNHKII

SEQ ID NO: 857562 - protein, 9 aa, Homo Sapiens
KAKIIVLSL

SEQ ID NO: 857563 - protein, 9 aa, Homo Sapiens
KIKTATKKG

SEQ ID NO: 857564 - protein, 9 aa, Homo Sapiens
PLYFPIRSK

SEQ ID NO: 857565 - protein, 9 aa, Homo Sapiens
EVRKNVQKT

SEQ ID NO: 857566 - protein, 9 aa, Homo Sapiens
QPPHGSDTP

SEQ ID NO: 857567 - protein, 9 aa, Homo Sapiens
HPERRMEGN

SEQ ID NO: 857568 - protein, 9 aa, Homo Sapiens
KNDNRLKAL

SEQ ID NO: 857569 - protein, 9 aa, Homo Sapiens
CIAFELLDK

SEQ ID NO: 857570 - protein, 9 aa, Homo Sapiens
SLVPLQIIL

SEQ ID NO: 857571 - protein, 9 aa, Homo Sapiens
VFQDIQDEG

SEQ ID NO: 857572 - protein, 9 aa, Homo Sapiens
SEKKKCKNS

SEQ ID NO: 857573 - protein, 9 aa, Homo Sapiens
LMCTGETEA

SEQ ID NO: 857574 - protein, 9 aa, Homo Sapiens
KHPQLKITA

SEQ ID NO: 857575 - protein, 9 aa, Homo Sapiens
SLKEVHTIN

SEQ ID NO: 857576 - protein, 9 aa, Homo Sapiens
VTTDSWSIW

SEQ ID NO: 857577 - protein, 9 aa, Homo Sapiens
SLSKLCSKL

SEQ ID NO: 857578 - protein, 9 aa, Homo Sapiens
NASKNIITV

SEQ ID NO: 857579 - protein, 9 aa, Homo Sapiens
LHSHKTQSL

SEQ ID NO: 857580 - protein, 9 aa, Homo Sapiens
PPTFVQGVI

SEQ ID NO: 857581 - protein, 9 aa, Homo Sapiens
SSEDVSQED

SEQ ID NO: 857582 - protein, 9 aa, Homo Sapiens
PYVYICLFT

SEQ ID NO: 857583 - protein, 9 aa, Homo Sapiens
FLQILPVLN

SEQ ID NO: 857584 - protein, 9 aa, Homo Sapiens
HENFQNWLK

SEQ ID NO: 857585 - protein, 9 aa, Homo Sapiens
GINFLEKRA

SEQ ID NO: 857586 - protein, 9 aa, Homo Sapiens
DITSQRYAW

SEQ ID NO: 857587 - protein, 9 aa, Homo Sapiens
PSGAHDTLN

SEQ ID NO: 857588 - protein, 9 aa, Homo Sapiens
FRDRICRVL

SEQ ID NO: 857589 - protein, 9 aa, Homo Sapiens
QNVMWFLLQ

SEQ ID NO: 857590 - protein, 9 aa, Homo Sapiens
QTTSLLHPD

SEQ ID NO: 857591 - protein, 9 aa, Homo Sapiens
QIRGEIGSG

SEQ ID NO: 857592 - protein, 9 aa, Homo Sapiens
SVQTPGTYP

SEQ ID NO: 857593 - protein, 9 aa, Homo Sapiens
WFRGCQVWA

SEQ ID NO: 857594 - protein, 9 aa, Homo Sapiens
PFEEGKKIY

SEQ ID NO: 857595 - protein, 9 aa, Homo Sapiens
DGATSTFNL

SEQ ID NO: 857596 - protein, 9 aa, Homo Sapiens
MKTRTMFGE

SEQ ID NO: 857597 - protein, 9 aa, Homo Sapiens
LGHNLGGLL

SEQ ID NO: 857598 - protein, 9 aa, Homo Sapiens
THNGEKPYA

SEQ ID NO: 857599 - protein, 9 aa, Homo Sapiens
DSNNKVNQW

SEQ ID NO: 857600 - protein, 9 aa, Homo Sapiens
TTTQSHTTA

SEQ ID NO: 857601 - protein, 9 aa, Homo Sapiens
SVFEFNHHL

SEQ ID NO: 857602 - protein, 9 aa, Homo Sapiens
PLMAVEITE

SEQ ID NO: 857603 - protein, 9 aa, Homo Sapiens
CPAKNSAES

SEQ ID NO: 857604 - protein, 9 aa, Homo Sapiens
GHYFDEKHL

SEQ ID NO: 857605 - protein, 9 aa, Homo Sapiens
IAKALSKSC

SEQ ID NO: 857606 - protein, 9 aa, Homo Sapiens
TKRITENAS

SEQ ID NO: 857607 - protein, 9 aa, Homo Sapiens
DEYKNLYYA

SEQ ID NO: 857608 - protein, 9 aa, Homo Sapiens
TGTHECSLW

SEQ ID NO: 857609 - protein, 9 aa, Homo Sapiens
SIICMAIPA

SEQ ID NO: 857610 - protein, 9 aa, Homo Sapiens
ASVIYWQMV

SEQ ID NO: 857611 - protein, 9 aa, Homo Sapiens
SLTTPRLTI

SEQ ID NO: 857612 - protein, 9 aa, Homo Sapiens
NPEIFKEMS

SEQ ID NO: 857613 - protein, 9 aa, Homo Sapiens
KAGMVNKKG

SEQ ID NO: 857614 - protein, 9 aa, Homo Sapiens
RYLHQESLK

SEQ ID NO: 857615 - protein, 9 aa, Homo Sapiens
AVKLFQNDQ

SEQ ID NO: 857616 - protein, 9 aa, Homo Sapiens
IYIIIYFIF

SEQ ID NO: 857617 - protein, 9 aa, Homo Sapiens
NDLWYNLIE

SEQ ID NO: 857618 - protein, 9 aa, Homo Sapiens
DKKIHLVVL

SEQ ID NO: 857619 - protein, 9 aa, Homo Sapiens
QKALEEKRR

SEQ ID NO: 857620 - protein, 9 aa, Homo Sapiens
LPSEAVFGN

SEQ ID NO: 857621 - protein, 9 aa, Homo Sapiens
LTPMFNPII

SEQ ID NO: 857622 - protein, 9 aa, Homo Sapiens
IEMQKYVPN

SEQ ID NO: 857623 - protein, 9 aa, Homo Sapiens
VPPRMSFPY

SEQ ID NO: 857624 - protein, 9 aa, Homo Sapiens
INHDPVVGD

SEQ ID NO: 857625 - protein, 9 aa, Homo Sapiens
NGKGRCPFD

SEQ ID NO: 857626 - protein, 9 aa, Homo Sapiens
DLLAATSIM

SEQ ID NO: 857627 - protein, 9 aa, Homo Sapiens
DDGSRSKDD

SEQ ID NO: 857628 - protein, 9 aa, Homo Sapiens
LKNLVNNLQ

SEQ ID NO: 857629 - protein, 9 aa, Homo Sapiens
HAKKMDNLL

SEQ ID NO: 857630 - protein, 9 aa, Homo Sapiens
SDTRCCKLC

SEQ ID NO: 857631 - protein, 9 aa, Homo Sapiens
VICTCCSRC

SEQ ID NO: 857632 - protein, 9 aa, Homo Sapiens
PGSGKKTPP

SEQ ID NO: 857633 - protein, 9 aa, Homo Sapiens
VKNVFITKK

SEQ ID NO: 857634 - protein, 9 aa, Homo Sapiens
HWEYYLKQL

SEQ ID NO: 857635 - protein, 9 aa, Homo Sapiens
KDLKLSYMD

SEQ ID NO: 857636 - protein, 9 aa, Homo Sapiens
GRLSIHQIK

SEQ ID NO: 857637 - protein, 9 aa, Homo Sapiens
QAQRQDNAL

SEQ ID NO: 857638 - protein, 9 aa, Homo Sapiens
ITELNILEI

SEQ ID NO: 857639 - protein, 9 aa, Homo Sapiens
NLPSYSGPS

SEQ ID NO: 857640 - protein, 9 aa, Homo Sapiens
TVYAFKTWK

SEQ ID NO: 857641 - protein, 9 aa, Homo Sapiens
SSFLTGVML

SEQ ID NO: 857642 - protein, 9 aa, Homo Sapiens
EFKRFILFR

SEQ ID NO: 857643 - protein, 9 aa, Homo Sapiens
WIKETDLEY

SEQ ID NO: 857644 - protein, 9 aa, Homo Sapiens
QSSLSEKRA

SEQ ID NO: 857645 - protein, 9 aa, Homo Sapiens
AHIKRVTLH

SEQ ID NO: 857646 - protein, 9 aa, Homo Sapiens
FNGCFISIM

SEQ ID NO: 857647 - protein, 9 aa, Homo Sapiens
HTHTHTVTH

SEQ ID NO: 857648 - protein, 9 aa, Homo Sapiens
NDLSKLAQG

SEQ ID NO: 857649 - protein, 9 aa, Homo Sapiens
PQIVNVTSL

SEQ ID NO: 857650 - protein, 9 aa, Homo Sapiens
VLCVVFSLV

SEQ ID NO: 857651 - protein, 9 aa, Homo Sapiens
LFNGCFISI

SEQ ID NO: 857652 - protein, 9 aa, Homo Sapiens
LLFKTVIQT

SEQ ID NO: 857653 - protein, 9 aa, Homo Sapiens
VPAYLIDLM

SEQ ID NO: 857654 - protein, 9 aa, Homo Sapiens
ISKYLSIAV

SEQ ID NO: 857655 - protein, 9 aa, Homo Sapiens
VQTFLQTYS

SEQ ID NO: 857656 - protein, 9 aa, Homo Sapiens
AVVIDSTRT

SEQ ID NO: 857657 - protein, 9 aa, Homo Sapiens
PETGILDGM

SEQ ID NO: 857658 - protein, 9 aa, Homo Sapiens
GDDSLERKP

SEQ ID NO: 857659 - protein, 9 aa, Homo Sapiens
CITAMDTED

SEQ ID NO: 857660 - protein, 9 aa, Homo Sapiens
LPYVCFHII

SEQ ID NO: 857661 - protein, 9 aa, Homo Sapiens
GGPGMVADA

SEQ ID NO: 857662 - protein, 9 aa, Homo Sapiens
FQHVLYKLN

SEQ ID NO: 857663 - protein, 9 aa, Homo Sapiens
GKQEGRHIE

SEQ ID NO: 857664 - protein, 9 aa, Homo Sapiens
TLTLTYGSL

SEQ ID NO: 857665 - protein, 9 aa, Homo Sapiens
TLVCCRDEF

SEQ ID NO: 857666 - protein, 9 aa, Homo Sapiens
SDIDGEAEN

SEQ ID NO: 857667 - protein, 9 aa, Homo Sapiens
QDGAQTLHR

SEQ ID NO: 857668 - protein, 9 aa, Homo Sapiens
AGYGRFSGK

SEQ ID NO: 857669 - protein, 9 aa, Homo Sapiens
GISQGPHCF

SEQ ID NO: 857670 - protein, 9 aa, Homo Sapiens
SGRSCEKFG

SEQ ID NO: 857671 - protein, 9 aa, Homo Sapiens
RADGTGPTQ

SEQ ID NO: 857672 - protein, 9 aa, Homo Sapiens
EEGKKIYLP

SEQ ID NO: 857673 - protein, 9 aa, Homo Sapiens
DKDTIDKLK

SEQ ID NO: 857674 - protein, 9 aa, Homo Sapiens
NHQNLQDCL

SEQ ID NO: 857675 - protein, 9 aa, Homo Sapiens
QKEANQLND

SEQ ID NO: 857676 - protein, 9 aa, Homo Sapiens
VITAAHCGH

SEQ ID NO: 857677 - protein, 9 aa, Homo Sapiens
MAENKELQE

SEQ ID NO: 857678 - protein, 9 aa, Homo Sapiens
ANLIDSITV

SEQ ID NO: 857679 - protein, 9 aa, Homo Sapiens
LFRSACQYV

SEQ ID NO: 857680 - protein, 9 aa, Homo Sapiens
RGTLTPRDH

SEQ ID NO: 857681 - protein, 9 aa, Homo Sapiens
HEVQRQIRR

SEQ ID NO: 857682 - protein, 9 aa, Homo Sapiens
QVCTPSFHS

SEQ ID NO: 857683 - protein, 9 aa, Homo Sapiens
PGGALNRVL

SEQ ID NO: 857684 - protein, 9 aa, Homo Sapiens
NAYQRAQME

SEQ ID NO: 857685 - protein, 9 aa, Homo Sapiens
VNYGELRAF

SEQ ID NO: 857686 - protein, 9 aa, Homo Sapiens
QKVREHLHN

SEQ ID NO: 857687 - protein, 9 aa, Homo Sapiens
SNLRLSPLT

SEQ ID NO: 857688 - protein, 9 aa, Homo Sapiens
ASRGTTRPN

SEQ ID NO: 857689 - protein, 9 aa, Homo Sapiens
KICSLPAEL

SEQ ID NO: 857690 - protein, 9 aa, Homo Sapiens
LPHLDHPGY

SEQ ID NO: 857691 - protein, 9 aa, Homo Sapiens
NLADRGLVH

SEQ ID NO: 857692 - protein, 9 aa, Homo Sapiens
MAGIDLKFW

SEQ ID NO: 857693 - protein, 9 aa, Homo Sapiens
LGPGTRKAY

SEQ ID NO: 857694 - protein, 9 aa, Homo Sapiens
IELPSSTST

SEQ ID NO: 857695 - protein, 9 aa, Homo Sapiens
MYRVLSPLS

SEQ ID NO: 857696 - protein, 9 aa, Homo Sapiens
EREIMLKDE

SEQ ID NO: 857697 - protein, 9 aa, Homo Sapiens
KRQIAAHTN

SEQ ID NO: 857698 - protein, 9 aa, Homo Sapiens
IFIILLLVY

SEQ ID NO: 857699 - protein, 9 aa, Homo Sapiens
WTDGIVNEL

SEQ ID NO: 857700 - protein, 9 aa, Homo Sapiens
SEKVYLGSQ

SEQ ID NO: 857701 - protein, 9 aa, Homo Sapiens
QEIVCDINK

SEQ ID NO: 857702 - protein, 9 aa, Homo Sapiens
WKNGILPAW

SEQ ID NO: 857703 - protein, 9 aa, Homo Sapiens
PRPPETAQT

SEQ ID NO: 857704 - protein, 9 aa, Homo Sapiens
AGVDLFGTT

SEQ ID NO: 857705 - protein, 9 aa, Homo Sapiens
LVFNDNESW

SEQ ID NO: 857706 - protein, 9 aa, Homo Sapiens
RNYSYFLGL

SEQ ID NO: 857707 - protein, 9 aa, Homo Sapiens
EYAYLKVII

SEQ ID NO: 857708 - protein, 9 aa, Homo Sapiens
GNMVDGYRY

SEQ ID NO: 857709 - protein, 9 aa, Homo Sapiens
MAEHEAFLL

SEQ ID NO: 857710 - protein, 9 aa, Homo Sapiens
VSYPEVFVL

SEQ ID NO: 857711 - protein, 9 aa, Homo Sapiens
QLGKRYNLT

SEQ ID NO: 857712 - protein, 9 aa, Homo Sapiens
DITKCLFLG

SEQ ID NO: 857713 - protein, 9 aa, Homo Sapiens
PNSLHLEIR

SEQ ID NO: 857714 - protein, 9 aa, Homo Sapiens
HGKVVMEYL

SEQ ID NO: 857715 - protein, 9 aa, Homo Sapiens
SPGVKNKTF

SEQ ID NO: 857716 - protein, 9 aa, Homo Sapiens
QPNAAQYLH

SEQ ID NO: 857717 - protein, 9 aa, Homo Sapiens
EKRGFIHED

SEQ ID NO: 857718 - protein, 9 aa, Homo Sapiens
SFENMKENP

SEQ ID NO: 857719 - protein, 9 aa, Homo Sapiens
TYDNQIHII

SEQ ID NO: 857720 - protein, 9 aa, Homo Sapiens
KCGVMTSSG

SEQ ID NO: 857721 - protein, 9 aa, Homo Sapiens
YFTSSRHTV

SEQ ID NO: 857722 - protein, 9 aa, Homo Sapiens
PWPYGRQTV

SEQ ID NO: 857723 - protein, 9 aa, Homo Sapiens
IASALGMVL

SEQ ID NO: 857724 - protein, 9 aa, Homo Sapiens
YWRVFHTLR

SEQ ID NO: 857725 - protein, 9 aa, Homo Sapiens
YFTFKHECK

SEQ ID NO: 857726 - protein, 9 aa, Homo Sapiens
AKKVDSHTP

SEQ ID NO: 857727 - protein, 9 aa, Homo Sapiens
QCLKSWHRL

SEQ ID NO: 857728 - protein, 9 aa, Homo Sapiens
LAAETGMEV

SEQ ID NO: 857729 - protein, 9 aa, Homo Sapiens
FLKVIFTTV

SEQ ID NO: 857730 - protein, 9 aa, Homo Sapiens
AGILKSIMN

SEQ ID NO: 857731 - protein, 9 aa, Homo Sapiens
AQTFISDIA

SEQ ID NO: 857732 - protein, 9 aa, Homo Sapiens
RGLRNKIIG

SEQ ID NO: 857733 - protein, 9 aa, Homo Sapiens
MQQVIGKYL

SEQ ID NO: 857734 - protein, 9 aa, Homo Sapiens
LTDYDIQFY

SEQ ID NO: 857735 - protein, 9 aa, Homo Sapiens
TTVERERAL

SEQ ID NO: 857736 - protein, 9 aa, Homo Sapiens
QFTRQEWDL

SEQ ID NO: 857737 - protein, 9 aa, Homo Sapiens
LSKATQLVR

SEQ ID NO: 857738 - protein, 9 aa, Homo Sapiens
DGTPFDEHD

SEQ ID NO: 857739 - protein, 9 aa, Homo Sapiens
AHQRRHTGD

SEQ ID NO: 857740 - protein, 9 aa, Homo Sapiens
TDVIRITGR

SEQ ID NO: 857741 - protein, 9 aa, Homo Sapiens
ACHGNLTEK

SEQ ID NO: 857742 - protein, 9 aa, Homo Sapiens
LTPYWALIL

SEQ ID NO: 857743 - protein, 9 aa, Homo Sapiens
QDQPGQRGK

SEQ ID NO: 857744 - protein, 9 aa, Homo Sapiens
QLYFRDLPI

SEQ ID NO: 857745 - protein, 9 aa, Homo Sapiens
QEPNYATST

SEQ ID NO: 857746 - protein, 9 aa, Homo Sapiens
IHQRVHTGK

SEQ ID NO: 857747 - protein, 9 aa, Homo Sapiens
PAKEYARLC

SEQ ID NO: 857748 - protein, 9 aa, Homo Sapiens
TFLTSYSPF

SEQ ID NO: 857749 - protein, 9 aa, Homo Sapiens
TCMLGYVTL

SEQ ID NO: 857750 - protein, 9 aa, Homo Sapiens
EPFELKVYE

SEQ ID NO: 857751 - protein, 9 aa, Homo Sapiens
QRGRELFDS

SEQ ID NO: 857752 - protein, 9 aa, Homo Sapiens
QKDSIKAQD

SEQ ID NO: 857753 - protein, 9 aa, Homo Sapiens
NQFRFSTDY

SEQ ID NO: 857754 - protein, 9 aa, Homo Sapiens
RNGLSGIKK

SEQ ID NO: 857755 - protein, 9 aa, Homo Sapiens
LVVAILVVC

SEQ ID NO: 857756 - protein, 9 aa, Homo Sapiens
DMLGDDGVL

SEQ ID NO: 857757 - protein, 9 aa, Homo Sapiens
TDPMSKQED

SEQ ID NO: 857758 - protein, 9 aa, Homo Sapiens
EQQDLPILA

SEQ ID NO: 857759 - protein, 9 aa, Homo Sapiens
LRFWLAVQY

SEQ ID NO: 857760 - protein, 9 aa, Homo Sapiens
DKSTQATEP

SEQ ID NO: 857761 - protein, 9 aa, Homo Sapiens
IKGHEDYHM

SEQ ID NO: 857762 - protein, 9 aa, Homo Sapiens
AGTGFSGDG

SEQ ID NO: 857763 - protein, 9 aa, Homo Sapiens
NHTNIISLL

SEQ ID NO: 857764 - protein, 9 aa, Homo Sapiens
DYGDNEKQK

SEQ ID NO: 857765 - protein, 9 aa, Homo Sapiens
ARERIATYT

SEQ ID NO: 857766 - protein, 9 aa, Homo Sapiens
NGKLKMDDD

SEQ ID NO: 857767 - protein, 9 aa, Homo Sapiens
EIIDEFIVK

SEQ ID NO: 857768 - protein, 9 aa, Homo Sapiens
ELRLYLCGL

SEQ ID NO: 857769 - protein, 9 aa, Homo Sapiens
SSVSSQFSG

SEQ ID NO: 857770 - protein, 9 aa, Homo Sapiens
KIKFMKIGV

SEQ ID NO: 857771 - protein, 9 aa, Homo Sapiens
SESSSEKDS

SEQ ID NO: 857772 - protein, 9 aa, Homo Sapiens
LCFDIEGSD

SEQ ID NO: 857773 - protein, 9 aa, Homo Sapiens
FIETSTKTR

SEQ ID NO: 857774 - protein, 9 aa, Homo Sapiens
AEKALGKHT

SEQ ID NO: 857775 - protein, 9 aa, Homo Sapiens
DSVERHMGT

SEQ ID NO: 857776 - protein, 9 aa, Homo Sapiens
YLIERLNEM

SEQ ID NO: 857777 - protein, 9 aa, Homo Sapiens
DSVSSTDGD

SEQ ID NO: 857778 - protein, 9 aa, Homo Sapiens
TNLKIKFNT

SEQ ID NO: 857779 - protein, 9 aa, Homo Sapiens
QHIVIDKAQ

SEQ ID NO: 857780 - protein, 9 aa, Homo Sapiens
RERKGLYIF

SEQ ID NO: 857781 - protein, 9 aa, Homo Sapiens
GLLNSAGNK

SEQ ID NO: 857782 - protein, 9 aa, Homo Sapiens
LTEGKPTAP

SEQ ID NO: 857783 - protein, 9 aa, Homo Sapiens
TFFTEDDNP

SEQ ID NO: 857784 - protein, 9 aa, Homo Sapiens
LGGRALLLQ

SEQ ID NO: 857785 - protein, 9 aa, Homo Sapiens
AMIFAMCLV

SEQ ID NO: 857786 - protein, 9 aa, Homo Sapiens
ETLSLKQIH

SEQ ID NO: 857787 - protein, 9 aa, Homo Sapiens
DWEVNGKTI

SEQ ID NO: 857788 - protein, 9 aa, Homo Sapiens
NYKLFLLFL

SEQ ID NO: 857789 - protein, 9 aa, Homo Sapiens
LDTNERTPY

SEQ ID NO: 857790 - protein, 9 aa, Homo Sapiens
DGGLTTFEE

SEQ ID NO: 857791 - protein, 9 aa, Homo Sapiens
FQNTTWVPY

SEQ ID NO: 857792 - protein, 9 aa, Homo Sapiens
TESKHLHNK

SEQ ID NO: 857793 - protein, 9 aa, Homo Sapiens
DTKIISLSG

SEQ ID NO: 857794 - protein, 9 aa, Homo Sapiens
DLLKQCLEW

SEQ ID NO: 857795 - protein, 9 aa, Homo Sapiens
EVAGTLMTF

SEQ ID NO: 857796 - protein, 9 aa, Homo Sapiens
SGTRTVVCV

SEQ ID NO: 857797 - protein, 9 aa, Homo Sapiens
QILSQLLLD

SEQ ID NO: 857798 - protein, 9 aa, Homo Sapiens
PHKGRNFSL

SEQ ID NO: 857799 - protein, 9 aa, Homo Sapiens
EDRLFEHEV

SEQ ID NO: 857800 - protein, 9 aa, Homo Sapiens
CPFGSEGKN

SEQ ID NO: 857801 - protein, 9 aa, Homo Sapiens
GAWHVYRNF

SEQ ID NO: 857802 - protein, 9 aa, Homo Sapiens
CYFCYYYFI

SEQ ID NO: 857803 - protein, 9 aa, Homo Sapiens
EDKFYKIEC

SEQ ID NO: 857804 - protein, 9 aa, Homo Sapiens
RRTWGNESY

SEQ ID NO: 857805 - protein, 9 aa, Homo Sapiens
LKSMDEFIL

SEQ ID NO: 857806 - protein, 9 aa, Homo Sapiens
KLDFETMSL

SEQ ID NO: 857807 - protein, 9 aa, Homo Sapiens
LKICFINMA

SEQ ID NO: 857808 - protein, 9 aa, Homo Sapiens
SLILALPLS

SEQ ID NO: 857809 - protein, 9 aa, Homo Sapiens
LNKSLVNDN

SEQ ID NO: 857810 - protein, 9 aa, Homo Sapiens
PTDPVAYIL

SEQ ID NO: 857811 - protein, 9 aa, Homo Sapiens
REPRQIVIH

SEQ ID NO: 857812 - protein, 9 aa, Homo Sapiens
ASNDPRSKH

SEQ ID NO: 857813 - protein, 9 aa, Homo Sapiens
KKKLWSSVA

SEQ ID NO: 857814 - protein, 9 aa, Homo Sapiens
QLSSSSARA

SEQ ID NO: 857815 - protein, 9 aa, Homo Sapiens
IFQEYHYPD

SEQ ID NO: 857816 - protein, 9 aa, Homo Sapiens
LLFLFMVLC

SEQ ID NO: 857817 - protein, 9 aa, Homo Sapiens
AVLCCQKQC

SEQ ID NO: 857818 - protein, 9 aa, Homo Sapiens
RGCQVWAYI

SEQ ID NO: 857819 - protein, 9 aa, Homo Sapiens
IEELSWLQN

SEQ ID NO: 857820 - protein, 9 aa, Homo Sapiens
GVRAAEFIN

SEQ ID NO: 857821 - protein, 9 aa, Homo Sapiens
GLGTFILKV

SEQ ID NO: 857822 - protein, 9 aa, Homo Sapiens
NAQGYAWIF

SEQ ID NO: 857823 - protein, 9 aa, Homo Sapiens
CCSPYLFDI

SEQ ID NO: 857824 - protein, 9 aa, Homo Sapiens
SYCLLKASE

SEQ ID NO: 857825 - protein, 9 aa, Homo Sapiens
ELLMVMSSK

SEQ ID NO: 857826 - protein, 9 aa, Homo Sapiens
IEDPELQPI

SEQ ID NO: 857827 - protein, 9 aa, Homo Sapiens
KKYNLRVED

SEQ ID NO: 857828 - protein, 9 aa, Homo Sapiens
ENIFLQPPK

SEQ ID NO: 857829 - protein, 9 aa, Homo Sapiens
ARLDYMVLL

SEQ ID NO: 857830 - protein, 9 aa, Homo Sapiens
VLNPTSWEK

SEQ ID NO: 857831 - protein, 9 aa, Homo Sapiens
KLTEHKKIY

SEQ ID NO: 857832 - protein, 9 aa, Homo Sapiens
MKERWENDK

SEQ ID NO: 857833 - protein, 9 aa, Homo Sapiens
NHATFINEL

SEQ ID NO: 857834 - protein, 9 aa, Homo Sapiens
KQTGRSEVE

SEQ ID NO: 857835 - protein, 9 aa, Homo Sapiens
LVHLLCCCL

SEQ ID NO: 857836 - protein, 9 aa, Homo Sapiens
TSPLLEEEA

SEQ ID NO: 857837 - protein, 9 aa, Homo Sapiens
KDTSENAGG

SEQ ID NO: 857838 - protein, 9 aa, Homo Sapiens
KVMQIQAVG

SEQ ID NO: 857839 - protein, 9 aa, Homo Sapiens
VLRNVSLRV

SEQ ID NO: 857840 - protein, 9 aa, Homo Sapiens
NAILTVADM

SEQ ID NO: 857841 - protein, 9 aa, Homo Sapiens
QLMEEIISP

SEQ ID NO: 857842 - protein, 9 aa, Homo Sapiens
NSHSHEDDN

SEQ ID NO: 857843 - protein, 9 aa, Homo Sapiens
AETMKKKLS

SEQ ID NO: 857844 - protein, 9 aa, Homo Sapiens
GNGFEMKLD

SEQ ID NO: 857845 - protein, 9 aa, Homo Sapiens
GKTLCLLKI

SEQ ID NO: 857846 - protein, 9 aa, Homo Sapiens
SSSATLLNY

SEQ ID NO: 857847 - protein, 9 aa, Homo Sapiens
SSFQSHMIT

SEQ ID NO: 857848 - protein, 9 aa, Homo Sapiens
AHFLPGKDL

SEQ ID NO: 857849 - protein, 9 aa, Homo Sapiens
NPKREPAQK

SEQ ID NO: 857850 - protein, 9 aa, Homo Sapiens
SADTFKSGI

SEQ ID NO: 857851 - protein, 9 aa, Homo Sapiens
FPDGAHWQE

SEQ ID NO: 857852 - protein, 9 aa, Homo Sapiens
GLSMSKPNM

SEQ ID NO: 857853 - protein, 9 aa, Homo Sapiens
PDWRDFFWS

SEQ ID NO: 857854 - protein, 9 aa, Homo Sapiens
RTTGPELGS

SEQ ID NO: 857855 - protein, 9 aa, Homo Sapiens
EDNITTPKT

SEQ ID NO: 857856 - protein, 9 aa, Homo Sapiens
ADNNENIQE

SEQ ID NO: 857857 - protein, 9 aa, Homo Sapiens
PEQLNKLQD

SEQ ID NO: 857858 - protein, 9 aa, Homo Sapiens
DLIKSHLYW

SEQ ID NO: 857859 - protein, 9 aa, Homo Sapiens
SINSMLESC

SEQ ID NO: 857860 - protein, 9 aa, Homo Sapiens
KYYSSKPNN

SEQ ID NO: 857861 - protein, 9 aa, Homo Sapiens
AQLEIMRMC

SEQ ID NO: 857862 - protein, 9 aa, Homo Sapiens
GDLEPYMDD

SEQ ID NO: 857863 - protein, 9 aa, Homo Sapiens
TLDEGLVEF

SEQ ID NO: 857864 - protein, 9 aa, Homo Sapiens
YCIDARFYW

SEQ ID NO: 857865 - protein, 9 aa, Homo Sapiens
ILLIPVKYW

SEQ ID NO: 857866 - protein, 9 aa, Homo Sapiens
LIVHKITHT

SEQ ID NO: 857867 - protein, 9 aa, Homo Sapiens
SKFPVADYL

SEQ ID NO: 857868 - protein, 9 aa, Homo Sapiens
YFGTGSVQK

SEQ ID NO: 857869 - protein, 9 aa, Homo Sapiens
PLQSDAPKM

SEQ ID NO: 857870 - protein, 9 aa, Homo Sapiens
PTKLPFPLS

SEQ ID NO: 857871 - protein, 9 aa, Homo Sapiens
RIDRIIYVS

SEQ ID NO: 857872 - protein, 9 aa, Homo Sapiens
VCKQLIQSH

SEQ ID NO: 857873 - protein, 9 aa, Homo Sapiens
PFFHMTAET

SEQ ID NO: 857874 - protein, 9 aa, Homo Sapiens
QEPVLAAEN

SEQ ID NO: 857875 - protein, 9 aa, Homo Sapiens
KSNIQFSGM

SEQ ID NO: 857876 - protein, 9 aa, Homo Sapiens
GPQGSAGNP

SEQ ID NO: 857877 - protein, 9 aa, Homo Sapiens
CLSLDYPQR

SEQ ID NO: 857878 - protein, 9 aa, Homo Sapiens
ADKLYGVKF

SEQ ID NO: 857879 - protein, 9 aa, Homo Sapiens
QKAKLDKFS

SEQ ID NO: 857880 - protein, 9 aa, Homo Sapiens
ALEVRHFSK

SEQ ID NO: 857881 - protein, 9 aa, Homo Sapiens
TEMSPSKNY

SEQ ID NO: 857882 - protein, 9 aa, Homo Sapiens
VDMYTGYTT

SEQ ID NO: 857883 - protein, 9 aa, Homo Sapiens
VQTPGTYPE

SEQ ID NO: 857884 - protein, 9 aa, Homo Sapiens
QKEVENHYK

SEQ ID NO: 857885 - protein, 9 aa, Homo Sapiens
ESTAVQFKI

SEQ ID NO: 857886 - protein, 9 aa, Homo Sapiens
VQFKIPEVE

SEQ ID NO: 857887 - protein, 9 aa, Homo Sapiens
PFRSCTIRT

SEQ ID NO: 857888 - protein, 9 aa, Homo Sapiens
RGKTVIELG

SEQ ID NO: 857889 - protein, 9 aa, Homo Sapiens
LFHQRRHQS

SEQ ID NO: 857890 - protein, 9 aa, Homo Sapiens
PCLDCPSFS

SEQ ID NO: 857891 - protein, 9 aa, Homo Sapiens
SETDEEDNL

SEQ ID NO: 857892 - protein, 9 aa, Homo Sapiens
IILQPDDSL

SEQ ID NO: 857893 - protein, 9 aa, Homo Sapiens
KTELLVQMQ

SEQ ID NO: 857894 - protein, 9 aa, Homo Sapiens
RYCKPLSSW

SEQ ID NO: 857895 - protein, 9 aa, Homo Sapiens
EEIKNLKHN

SEQ ID NO: 857896 - protein, 9 aa, Homo Sapiens
VVDCNQVQL

SEQ ID NO: 857897 - protein, 9 aa, Homo Sapiens
ELEKARKGY

SEQ ID NO: 857898 - protein, 9 aa, Homo Sapiens
FICISLAQT

SEQ ID NO: 857899 - protein, 9 aa, Homo Sapiens
VSLSGSSNF

SEQ ID NO: 857900 - protein, 9 aa, Homo Sapiens
LEAGYTKEF

SEQ ID NO: 857901 - protein, 9 aa, Homo Sapiens
VEALERNIV

SEQ ID NO: 857902 - protein, 9 aa, Homo Sapiens
SEFTKLSSL

SEQ ID NO: 857903 - protein, 9 aa, Homo Sapiens
AVQFKIPEV

SEQ ID NO: 857904 - protein, 9 aa, Homo Sapiens
RDEKELEIL

SEQ ID NO: 857905 - protein, 9 aa, Homo Sapiens
EEDARKIIL

SEQ ID NO: 857906 - protein, 9 aa, Homo Sapiens
RDGAARGTN

SEQ ID NO: 857907 - protein, 9 aa, Homo Sapiens
VTKMAAVTA

SEQ ID NO: 857908 - protein, 9 aa, Homo Sapiens
EEEEAHKKF

SEQ ID NO: 857909 - protein, 9 aa, Homo Sapiens
NNIFSLNLL

SEQ ID NO: 857910 - protein, 9 aa, Homo Sapiens
EAASVNKQK

SEQ ID NO: 857911 - protein, 9 aa, Homo Sapiens
ECGEYLSKQ

SEQ ID NO: 857912 - protein, 9 aa, Homo Sapiens
QSQQLEQPF

SEQ ID NO: 857913 - protein, 9 aa, Homo Sapiens
VIMRVYFNV

SEQ ID NO: 857914 - protein, 9 aa, Homo Sapiens
FDAFTDLNN

SEQ ID NO: 857915 - protein, 9 aa, Homo Sapiens
IISMIFIKG

SEQ ID NO: 857916 - protein, 9 aa, Homo Sapiens
CPHPPTAPT

SEQ ID NO: 857917 - protein, 9 aa, Homo Sapiens
ESEVRWDLH

SEQ ID NO: 857918 - protein, 9 aa, Homo Sapiens
KEARTYIFN

SEQ ID NO: 857919 - protein, 9 aa, Homo Sapiens
FSGNHWFVL

SEQ ID NO: 857920 - protein, 9 aa, Homo Sapiens
FFNELPETF

SEQ ID NO: 857921 - protein, 9 aa, Homo Sapiens
RNTGQLDCF

SEQ ID NO: 857922 - protein, 9 aa, Homo Sapiens
FKGLFKMYP

SEQ ID NO: 857923 - protein, 9 aa, Homo Sapiens
MSSYLQNDS

SEQ ID NO: 857924 - protein, 9 aa, Homo Sapiens
TTETASCLL

SEQ ID NO: 857925 - protein, 9 aa, Homo Sapiens
ADRMQTEIT

SEQ ID NO: 857926 - protein, 9 aa, Homo Sapiens
SSTLNYCNL

SEQ ID NO: 857927 - protein, 9 aa, Homo Sapiens
GEMLKKAAH

SEQ ID NO: 857928 - protein, 9 aa, Homo Sapiens
KKRGRKCRR

SEQ ID NO: 857929 - protein, 9 aa, Homo Sapiens
EEQKIDRFF

SEQ ID NO: 857930 - protein, 9 aa, Homo Sapiens
SEISNPFYD

SEQ ID NO: 857931 - protein, 9 aa, Homo Sapiens
QKLGETDED

SEQ ID NO: 857932 - protein, 9 aa, Homo Sapiens
NPVNFAFEV

SEQ ID NO: 857933 - protein, 9 aa, Homo Sapiens
SSSTKNYPS

SEQ ID NO: 857934 - protein, 9 aa, Homo Sapiens
ENVGMLLII

SEQ ID NO: 857935 - protein, 9 aa, Homo Sapiens
YHAPEFITS

SEQ ID NO: 857936 - protein, 9 aa, Homo Sapiens
FSLSYSSLM

SEQ ID NO: 857937 - protein, 9 aa, Homo Sapiens
TDRNASVGN

SEQ ID NO: 857938 - protein, 9 aa, Homo Sapiens
QLKADRDYH

SEQ ID NO: 857939 - protein, 9 aa, Homo Sapiens
GECGHCFGR

SEQ ID NO: 857940 - protein, 9 aa, Homo Sapiens
WSNTHDFTP

SEQ ID NO: 857941 - protein, 9 aa, Homo Sapiens
LLSKATLVP

SEQ ID NO: 857942 - protein, 9 aa, Homo Sapiens
EFICLDDPP

SEQ ID NO: 857943 - protein, 9 aa, Homo Sapiens
ELKEKANIE

SEQ ID NO: 857944 - protein, 9 aa, Homo Sapiens
KLCRGNPSE

SEQ ID NO: 857945 - protein, 9 aa, Homo Sapiens
DTNKASILL

SEQ ID NO: 857946 - protein, 9 aa, Homo Sapiens
FLAPWLGDG

SEQ ID NO: 857947 - protein, 9 aa, Homo Sapiens
LPLQFQRLG

SEQ ID NO: 857948 - protein, 9 aa, Homo Sapiens
AKCDEIYGT

SEQ ID NO: 857949 - protein, 9 aa, Homo Sapiens
NKLSARDHQ

SEQ ID NO: 857950 - protein, 9 aa, Homo Sapiens
FPNAHVKKD

SEQ ID NO: 857951 - protein, 9 aa, Homo Sapiens
GINSHKRTC

SEQ ID NO: 857952 - protein, 9 aa, Homo Sapiens
LILREIVIN

SEQ ID NO: 857953 - protein, 9 aa, Homo Sapiens
LSNHQIFHT

SEQ ID NO: 857954 - protein, 9 aa, Homo Sapiens
PPKKSGILL

SEQ ID NO: 857955 - protein, 9 aa, Homo Sapiens
GRIYIRANR

SEQ ID NO: 857956 - protein, 9 aa, Homo Sapiens
FGLNTLMES

SEQ ID NO: 857957 - protein, 9 aa, Homo Sapiens
AKSFKNKTR

SEQ ID NO: 857958 - protein, 9 aa, Homo Sapiens
EGLPPFSSL

SEQ ID NO: 857959 - protein, 9 aa, Homo Sapiens
VALILQYDM

SEQ ID NO: 857960 - protein, 9 aa, Homo Sapiens
LAHNYDIPN

SEQ ID NO: 857961 - protein, 9 aa, Homo Sapiens
ERKLQENLG

SEQ ID NO: 857962 - protein, 9 aa, Homo Sapiens
EKSVQKSIT

SEQ ID NO: 857963 - protein, 9 aa, Homo Sapiens
KAILQAWTD

SEQ ID NO: 857964 - protein, 9 aa, Homo Sapiens
NQRAKWRKR

SEQ ID NO: 857965 - protein, 9 aa, Homo Sapiens
DRTYYESVQ

SEQ ID NO: 857966 - protein, 9 aa, Homo Sapiens
TRTGDKLYE

SEQ ID NO: 857967 - protein, 9 aa, Homo Sapiens
LNLCARRIT

SEQ ID NO: 857968 - protein, 9 aa, Homo Sapiens
GERYFLQRP

SEQ ID NO: 857969 - protein, 9 aa, Homo Sapiens
NDDLARLLR

SEQ ID NO: 857970 - protein, 9 aa, Homo Sapiens
ICQEQLREL

SEQ ID NO: 857971 - protein, 9 aa, Homo Sapiens
HTELNRAMA

SEQ ID NO: 857972 - protein, 9 aa, Homo Sapiens
DTNSNDGPE

SEQ ID NO: 857973 - protein, 9 aa, Homo Sapiens
ALYFDQKYL

SEQ ID NO: 857974 - protein, 9 aa, Homo Sapiens
VNKPLSAMG

SEQ ID NO: 857975 - protein, 9 aa, Homo Sapiens
STEIELPEK

SEQ ID NO: 857976 - protein, 9 aa, Homo Sapiens
QCDPKTGEC

SEQ ID NO: 857977 - protein, 9 aa, Homo Sapiens
LHNILRDDH

SEQ ID NO: 857978 - protein, 9 aa, Homo Sapiens
LRYGGQQEP

SEQ ID NO: 857979 - protein, 9 aa, Homo Sapiens
CEPITLKLC

SEQ ID NO: 857980 - protein, 9 aa, Homo Sapiens
HLYQALARM

SEQ ID NO: 857981 - protein, 9 aa, Homo Sapiens
VADVISVGS

SEQ ID NO: 857982 - protein, 9 aa, Homo Sapiens
NITECRNPQ

SEQ ID NO: 857983 - protein, 9 aa, Homo Sapiens
AISVVEENL

SEQ ID NO: 857984 - protein, 9 aa, Homo Sapiens
TRFKHLRRY

SEQ ID NO: 857985 - protein, 9 aa, Homo Sapiens
MKVILLKDA

SEQ ID NO: 857986 - protein, 9 aa, Homo Sapiens
QYCGCLEYW

SEQ ID NO: 857987 - protein, 9 aa, Homo Sapiens
KVVETYPSP

SEQ ID NO: 857988 - protein, 9 aa, Homo Sapiens
QTNIQHLKG

SEQ ID NO: 857989 - protein, 9 aa, Homo Sapiens
EHLELLQRK

SEQ ID NO: 857990 - protein, 9 aa, Homo Sapiens
KQLILAHKD

SEQ ID NO: 857991 - protein, 9 aa, Homo Sapiens
MEEIISPRQ

SEQ ID NO: 857992 - protein, 9 aa, Homo Sapiens
TAYESQGAV

SEQ ID NO: 857993 - protein, 9 aa, Homo Sapiens
MMTFKGNAI

SEQ ID NO: 857994 - protein, 9 aa, Homo Sapiens
YPPLIHLWE

SEQ ID NO: 857995 - protein, 9 aa, Homo Sapiens
LGPVRGEPV

SEQ ID NO: 857996 - protein, 9 aa, Homo Sapiens
LSKKTHASA

SEQ ID NO: 857997 - protein, 9 aa, Homo Sapiens
LYNNNIETH

SEQ ID NO: 857998 - protein, 9 aa, Homo Sapiens
AVCQCRRNN

SEQ ID NO: 857999 - protein, 9 aa, Homo Sapiens
QMKARPDKS

SEQ ID NO: 858000 - protein, 9 aa, Homo Sapiens
FRGKTVIEL

SEQ ID NO: 858001 - protein, 9 aa, Homo Sapiens
GRGFCDKSH

SEQ ID NO: 858002 - protein, 9 aa, Homo Sapiens
GKYMKTPPG

SEQ ID NO: 858003 - protein, 9 aa, Homo Sapiens
NTVDNFFCD

SEQ ID NO: 858004 - protein, 9 aa, Homo Sapiens
LNIQSGEGC

SEQ ID NO: 858005 - protein, 9 aa, Homo Sapiens
RMHILHAND

SEQ ID NO: 858006 - protein, 9 aa, Homo Sapiens
MTSQLEKMA

SEQ ID NO: 858007 - protein, 9 aa, Homo Sapiens
VVYNDSAHG

SEQ ID NO: 858008 - protein, 9 aa, Homo Sapiens
FPYFKKHNM

SEQ ID NO: 858009 - protein, 9 aa, Homo Sapiens
VKGEAKIAY

SEQ ID NO: 858010 - protein, 9 aa, Homo Sapiens
SGPGLVCMV

SEQ ID NO: 858011 - protein, 9 aa, Homo Sapiens
NLKCLDVSS

SEQ ID NO: 858012 - protein, 9 aa, Homo Sapiens
YVVSNKKLM

SEQ ID NO: 858013 - protein, 9 aa, Homo Sapiens
RSWLLSPGT

SEQ ID NO: 858014 - protein, 9 aa, Homo Sapiens
KPVPFSTFR

SEQ ID NO: 858015 - protein, 9 aa, Homo Sapiens
TEEGLGFNS

SEQ ID NO: 858016 - protein, 9 aa, Homo Sapiens
KPLETGVWC

SEQ ID NO: 858017 - protein, 9 aa, Homo Sapiens
VEDYTSPSE

SEQ ID NO: 858018 - protein, 9 aa, Homo Sapiens
EEYEGRDVF

SEQ ID NO: 858019 - protein, 9 aa, Homo Sapiens
WSFFCSDEL

SEQ ID NO: 858020 - protein, 9 aa, Homo Sapiens
LDCPSFSQS

SEQ ID NO: 858021 - protein, 9 aa, Homo Sapiens
APDLKVKLH

SEQ ID NO: 858022 - protein, 9 aa, Homo Sapiens
PACLQWLGQ

SEQ ID NO: 858023 - protein, 9 aa, Homo Sapiens
DTSGLEISH

SEQ ID NO: 858024 - protein, 9 aa, Homo Sapiens
DLSQKPGDR

SEQ ID NO: 858025 - protein, 9 aa, Homo Sapiens
RQYVTTSFL

SEQ ID NO: 858026 - protein, 9 aa, Homo Sapiens
DGNGNSFMV

SEQ ID NO: 858027 - protein, 9 aa, Homo Sapiens
YDASAARVT

SEQ ID NO: 858028 - protein, 9 aa, Homo Sapiens
GCDCDKDML

SEQ ID NO: 858029 - protein, 9 aa, Homo Sapiens
EEIDKFDIS

SEQ ID NO: 858030 - protein, 9 aa, Homo Sapiens
SIIWKGSCP

SEQ ID NO: 858031 - protein, 9 aa, Homo Sapiens
PAPPTQPQI

SEQ ID NO: 858032 - protein, 9 aa, Homo Sapiens
ISNEGIELH

SEQ ID NO: 858033 - protein, 9 aa, Homo Sapiens
LVYPAVMVI

SEQ ID NO: 858034 - protein, 9 aa, Homo Sapiens
TTAGGGPPG

SEQ ID NO: 858035 - protein, 9 aa, Homo Sapiens
YATDVARVV

SEQ ID NO: 858036 - protein, 9 aa, Homo Sapiens
SALRMPSAR

SEQ ID NO: 858037 - protein, 9 aa, Homo Sapiens
GEAGKPTFG

SEQ ID NO: 858038 - protein, 9 aa, Homo Sapiens
KEEAQQLLH

SEQ ID NO: 858039 - protein, 9 aa, Homo Sapiens
LGKGVKHQP

SEQ ID NO: 858040 - protein, 9 aa, Homo Sapiens
IYKYQGGHS

SEQ ID NO: 858041 - protein, 9 aa, Homo Sapiens
PYTKEEDEQ

SEQ ID NO: 858042 - protein, 9 aa, Homo Sapiens
DCFKRWRSY

SEQ ID NO: 858043 - protein, 9 aa, Homo Sapiens
TRAMCRRLN

SEQ ID NO: 858044 - protein, 9 aa, Homo Sapiens
PHAYKCSDQ

SEQ ID NO: 858045 - protein, 9 aa, Homo Sapiens
ISPNNTVIS

SEQ ID NO: 858046 - protein, 9 aa, Homo Sapiens
SLDESRGSR

SEQ ID NO: 858047 - protein, 9 aa, Homo Sapiens
HQGTYVLQY

SEQ ID NO: 858048 - protein, 9 aa, Homo Sapiens
KVHLGADLK

SEQ ID NO: 858049 - protein, 9 aa, Homo Sapiens
KKLDISNVQ

SEQ ID NO: 858050 - protein, 9 aa, Homo Sapiens
SHTKHDRNV

SEQ ID NO: 858051 - protein, 9 aa, Homo Sapiens
MVSSIGYRA

SEQ ID NO: 858052 - protein, 9 aa, Homo Sapiens
KQPTSADKS

SEQ ID NO: 858053 - protein, 9 aa, Homo Sapiens
RFTPRKGDK

SEQ ID NO: 858054 - protein, 9 aa, Homo Sapiens
MGHQRVHTG

SEQ ID NO: 858055 - protein, 9 aa, Homo Sapiens
NNMFEILDR

SEQ ID NO: 858056 - protein, 9 aa, Homo Sapiens
ILKSIMNKR

SEQ ID NO: 858057 - protein, 9 aa, Homo Sapiens
HLVLHLRGG

SEQ ID NO: 858058 - protein, 9 aa, Homo Sapiens
VKGPRNLEH

SEQ ID NO: 858059 - protein, 9 aa, Homo Sapiens
KDRGQIRYN

SEQ ID NO: 858060 - protein, 9 aa, Homo Sapiens
FIHVEDYTS

SEQ ID NO: 858061 - protein, 9 aa, Homo Sapiens
GWYRPPLSR

SEQ ID NO: 858062 - protein, 9 aa, Homo Sapiens
QQIAMLWGS

SEQ ID NO: 858063 - protein, 9 aa, Homo Sapiens
VFDLSYLIV

SEQ ID NO: 858064 - protein, 9 aa, Homo Sapiens
TNLCVLRSI

SEQ ID NO: 858065 - protein, 9 aa, Homo Sapiens
NKRQYVTTS

SEQ ID NO: 858066 - protein, 9 aa, Homo Sapiens
ATSGELLLR

SEQ ID NO: 858067 - protein, 9 aa, Homo Sapiens
PLRAAAYVG

SEQ ID NO: 858068 - protein, 9 aa, Homo Sapiens
FPLNLCTKA

SEQ ID NO: 858069 - protein, 9 aa, Homo Sapiens
TQEGAQDGG

SEQ ID NO: 858070 - protein, 9 aa, Homo Sapiens
IDYNCRERM

SEQ ID NO: 858071 - protein, 9 aa, Homo Sapiens
VIELYKNRG

SEQ ID NO: 858072 - protein, 9 aa, Homo Sapiens
KVIRQYLDA

SEQ ID NO: 858073 - protein, 9 aa, Homo Sapiens
LSGCSEQQE

SEQ ID NO: 858074 - protein, 9 aa, Homo Sapiens
CLWYVPRHL

SEQ ID NO: 858075 - protein, 9 aa, Homo Sapiens
FQESKNLCK

SEQ ID NO: 858076 - protein, 9 aa, Homo Sapiens
MGVGIRNIL

SEQ ID NO: 858077 - protein, 9 aa, Homo Sapiens
ICGNFNSIQ

SEQ ID NO: 858078 - protein, 9 aa, Homo Sapiens
CSDRVFKAV

SEQ ID NO: 858079 - protein, 9 aa, Homo Sapiens
ETDPGAKEL

SEQ ID NO: 858080 - protein, 9 aa, Homo Sapiens
YFKKHNMTA

SEQ ID NO: 858081 - protein, 9 aa, Homo Sapiens
SILLSHQII

SEQ ID NO: 858082 - protein, 9 aa, Homo Sapiens
NSSLLTLDN

SEQ ID NO: 858083 - protein, 9 aa, Homo Sapiens
VNYHDKTGE

SEQ ID NO: 858084 - protein, 9 aa, Homo Sapiens
MKETLQIRR

SEQ ID NO: 858085 - protein, 9 aa, Homo Sapiens
RSSTLNYCN

SEQ ID NO: 858086 - protein, 9 aa, Homo Sapiens
YVVQLPANI

SEQ ID NO: 858087 - protein, 9 aa, Homo Sapiens
WAQSFENVM

SEQ ID NO: 858088 - protein, 9 aa, Homo Sapiens
LKKEKPVAT

SEQ ID NO: 858089 - protein, 9 aa, Homo Sapiens
LRTRIAALK

SEQ ID NO: 858090 - protein, 9 aa, Homo Sapiens
SRPSHLYTD

SEQ ID NO: 858091 - protein, 9 aa, Homo Sapiens
ELKIKCSLF

SEQ ID NO: 858092 - protein, 9 aa, Homo Sapiens
KYFYRTLIT

SEQ ID NO: 858093 - protein, 9 aa, Homo Sapiens
FVAVVIDST

SEQ ID NO: 858094 - protein, 9 aa, Homo Sapiens
DMIMKILKP

SEQ ID NO: 858095 - protein, 9 aa, Homo Sapiens
DILHFEMPA

SEQ ID NO: 858096 - protein, 9 aa, Homo Sapiens
SNKTLLCSF

SEQ ID NO: 858097 - protein, 9 aa, Homo Sapiens
INELKNLQA

SEQ ID NO: 858098 - protein, 9 aa, Homo Sapiens
RKKELFNVR

SEQ ID NO: 858099 - protein, 9 aa, Homo Sapiens
YVFKSIIEG

SEQ ID NO: 858100 - protein, 9 aa, Homo Sapiens
GDVDRAQQY

SEQ ID NO: 858101 - protein, 9 aa, Homo Sapiens
SKYLSIAVQ

SEQ ID NO: 858102 - protein, 9 aa, Homo Sapiens
RRQVHLWTG

SEQ ID NO: 858103 - protein, 9 aa, Homo Sapiens
LHSGENPFQ

SEQ ID NO: 858104 - protein, 9 aa, Homo Sapiens
AKPSDCPHS

SEQ ID NO: 858105 - protein, 9 aa, Homo Sapiens
SRFHEFHSP

SEQ ID NO: 858106 - protein, 9 aa, Homo Sapiens
MSEHNLADV

SEQ ID NO: 858107 - protein, 9 aa, Homo Sapiens
RDVHNQIVI

SEQ ID NO: 858108 - protein, 9 aa, Homo Sapiens
TWGNNSHGQ

SEQ ID NO: 858109 - protein, 9 aa, Homo Sapiens
EEIILNDND

SEQ ID NO: 858110 - protein, 9 aa, Homo Sapiens
SNFPRGCKK

SEQ ID NO: 858111 - protein, 9 aa, Homo Sapiens
KAIPQHFCK

SEQ ID NO: 858112 - protein, 9 aa, Homo Sapiens
ASLCSPTFR

SEQ ID NO: 858113 - protein, 9 aa, Homo Sapiens
IDSPPASKR

SEQ ID NO: 858114 - protein, 9 aa, Homo Sapiens
GTSERRKII

SEQ ID NO: 858115 - protein, 9 aa, Homo Sapiens
NQVDYFLCD

SEQ ID NO: 858116 - protein, 9 aa, Homo Sapiens
EESGQDIEI

SEQ ID NO: 858117 - protein, 9 aa, Homo Sapiens
KSITNTVQQ

SEQ ID NO: 858118 - protein, 9 aa, Homo Sapiens
SSQWDGPEP

SEQ ID NO: 858119 - protein, 9 aa, Homo Sapiens
QRAYTSEDE

SEQ ID NO: 858120 - protein, 9 aa, Homo Sapiens
PDEELSCSA

SEQ ID NO: 858121 - protein, 9 aa, Homo Sapiens
HLLVSESSQ

SEQ ID NO: 858122 - protein, 9 aa, Homo Sapiens
LFNEDSLLK

SEQ ID NO: 858123 - protein, 9 aa, Homo Sapiens
NNFSYKDDD

SEQ ID NO: 858124 - protein, 9 aa, Homo Sapiens
KINAPKEYD

SEQ ID NO: 858125 - protein, 9 aa, Homo Sapiens
AHVTSTVNT

SEQ ID NO: 858126 - protein, 9 aa, Homo Sapiens
ICTEDRGNG

SEQ ID NO: 858127 - protein, 9 aa, Homo Sapiens
PRAPPPDED

SEQ ID NO: 858128 - protein, 9 aa, Homo Sapiens
TVKEDREAT

SEQ ID NO: 858129 - protein, 9 aa, Homo Sapiens
RQDPLHPDT

SEQ ID NO: 858130 - protein, 9 aa, Homo Sapiens
VSYFIWNME

SEQ ID NO: 858131 - protein, 9 aa, Homo Sapiens
LSEFYQWIC

SEQ ID NO: 858132 - protein, 9 aa, Homo Sapiens
VDDFYSGLE

SEQ ID NO: 858133 - protein, 9 aa, Homo Sapiens
KIKHLRKDL

SEQ ID NO: 858134 - protein, 9 aa, Homo Sapiens
EMGMRLICE

SEQ ID NO: 858135 - protein, 9 aa, Homo Sapiens
TPESNTSRK

SEQ ID NO: 858136 - protein, 9 aa, Homo Sapiens
GFIILSLFS

SEQ ID NO: 858137 - protein, 9 aa, Homo Sapiens
LNCLSNSFQ

SEQ ID NO: 858138 - protein, 9 aa, Homo Sapiens
GGDGDYMEI

SEQ ID NO: 858139 - protein, 9 aa, Homo Sapiens
GLSHTKHDR

SEQ ID NO: 858140 - protein, 9 aa, Homo Sapiens
KAYAPSFIW

SEQ ID NO: 858141 - protein, 9 aa, Homo Sapiens
AQAKNECYR

SEQ ID NO: 858142 - protein, 9 aa, Homo Sapiens
MLHGDDTNR

SEQ ID NO: 858143 - protein, 9 aa, Homo Sapiens
MCIIHQATQ

SEQ ID NO: 858144 - protein, 9 aa, Homo Sapiens
SDYLRHYSW

SEQ ID NO: 858145 - protein, 9 aa, Homo Sapiens
IKKNGDILT

SEQ ID NO: 858146 - protein, 9 aa, Homo Sapiens
NKMVTTFKN

SEQ ID NO: 858147 - protein, 9 aa, Homo Sapiens
TDADPAKEY

SEQ ID NO: 858148 - protein, 9 aa, Homo Sapiens
SNPYNKTIS

SEQ ID NO: 858149 - protein, 9 aa, Homo Sapiens
TIAWMVYFV

SEQ ID NO: 858150 - protein, 9 aa, Homo Sapiens
CSSEAFQKR

SEQ ID NO: 858151 - protein, 9 aa, Homo Sapiens
REPFQMRIV

SEQ ID NO: 858152 - protein, 9 aa, Homo Sapiens
FVLCVVFSL

SEQ ID NO: 858153 - protein, 9 aa, Homo Sapiens
LIYLTLEIL

SEQ ID NO: 858154 - protein, 9 aa, Homo Sapiens
HWIIHTGEK

SEQ ID NO: 858155 - protein, 9 aa, Homo Sapiens
RQISAISVA

SEQ ID NO: 858156 - protein, 9 aa, Homo Sapiens
ATHPAGQNL

SEQ ID NO: 858157 - protein, 9 aa, Homo Sapiens
YEIARRHTY

SEQ ID NO: 858158 - protein, 9 aa, Homo Sapiens
NFTINMVTD

SEQ ID NO: 858159 - protein, 9 aa, Homo Sapiens
DSRPRSPAL

SEQ ID NO: 858160 - protein, 9 aa, Homo Sapiens
RVHTEDKFY

SEQ ID NO: 858161 - protein, 9 aa, Homo Sapiens
GQAAQNMVL

SEQ ID NO: 858162 - protein, 9 aa, Homo Sapiens
NFNSISTST

SEQ ID NO: 858163 - protein, 9 aa, Homo Sapiens
KICDDAYKS

SEQ ID NO: 858164 - protein, 9 aa, Homo Sapiens
GVQNLFQIV

SEQ ID NO: 858165 - protein, 9 aa, Homo Sapiens
RDSREDVVE

SEQ ID NO: 858166 - protein, 9 aa, Homo Sapiens
QIVCTFKMA

SEQ ID NO: 858167 - protein, 9 aa, Homo Sapiens
YLSVLEGQS

SEQ ID NO: 858168 - protein, 9 aa, Homo Sapiens
YYSGKYDDE

SEQ ID NO: 858169 - protein, 9 aa, Homo Sapiens
EQLMSCGAS

SEQ ID NO: 858170 - protein, 9 aa, Homo Sapiens
IQDIKALKY

SEQ ID NO: 858171 - protein, 9 aa, Homo Sapiens
QEPQGEGGI

SEQ ID NO: 858172 - protein, 9 aa, Homo Sapiens
NNVCKQCKN

SEQ ID NO: 858173 - protein, 9 aa, Homo Sapiens
GKYAYVTVC

SEQ ID NO: 858174 - protein, 9 aa, Homo Sapiens
KTGECLCYE

SEQ ID NO: 858175 - protein, 9 aa, Homo Sapiens
TSFRQRAHL

SEQ ID NO: 858176 - protein, 9 aa, Homo Sapiens
YQTNIGLTC

SEQ ID NO: 858177 - protein, 9 aa, Homo Sapiens
GQEEAVCTT

SEQ ID NO: 858178 - protein, 9 aa, Homo Sapiens
SENDLNGSS

SEQ ID NO: 858179 - protein, 9 aa, Homo Sapiens
LITVNLVGK

SEQ ID NO: 858180 - protein, 9 aa, Homo Sapiens
SEFGLNISF

SEQ ID NO: 858181 - protein, 9 aa, Homo Sapiens
EINNYIEER

SEQ ID NO: 858182 - protein, 9 aa, Homo Sapiens
SKRKDEVSI

SEQ ID NO: 858183 - protein, 9 aa, Homo Sapiens
EKEMFAQGH

SEQ ID NO: 858184 - protein, 9 aa, Homo Sapiens
LSCTSLDTK

SEQ ID NO: 858185 - protein, 9 aa, Homo Sapiens
PLVEMNTGK

SEQ ID NO: 858186 - protein, 9 aa, Homo Sapiens
GISPFHDHA

SEQ ID NO: 858187 - protein, 9 aa, Homo Sapiens
KCRLIHNNN

SEQ ID NO: 858188 - protein, 9 aa, Homo Sapiens
AAFLPLPAP

SEQ ID NO: 858189 - protein, 9 aa, Homo Sapiens
YGWKKEAIS

SEQ ID NO: 858190 - protein, 9 aa, Homo Sapiens
QKKGAKEKN

SEQ ID NO: 858191 - protein, 9 aa, Homo Sapiens
MTDDIGGLW

SEQ ID NO: 858192 - protein, 9 aa, Homo Sapiens
DELWKLAGR

SEQ ID NO: 858193 - protein, 9 aa, Homo Sapiens
GPGKYPMTD

SEQ ID NO: 858194 - protein, 9 aa, Homo Sapiens
TDMSSLSYL

SEQ ID NO: 858195 - protein, 9 aa, Homo Sapiens
SSEKLFQRL

SEQ ID NO: 858196 - protein, 9 aa, Homo Sapiens
ATDDPTRRA

SEQ ID NO: 858197 - protein, 9 aa, Homo Sapiens
HLNAITGSA

SEQ ID NO: 858198 - protein, 9 aa, Homo Sapiens
ENIEERKKS

SEQ ID NO: 858199 - protein, 9 aa, Homo Sapiens
ASRPQTTQA

SEQ ID NO: 858200 - protein, 9 aa, Homo Sapiens
DTIDLVIFL

SEQ ID NO: 858201 - protein, 9 aa, Homo Sapiens
MEKIEDSKE

SEQ ID NO: 858202 - protein, 9 aa, Homo Sapiens
FCGLRGNEL

SEQ ID NO: 858203 - protein, 9 aa, Homo Sapiens
WICQICQPR

SEQ ID NO: 858204 - protein, 9 aa, Homo Sapiens
KPQCKKEEN

SEQ ID NO: 858205 - protein, 9 aa, Homo Sapiens
DHIWQKNLT

SEQ ID NO: 858206 - protein, 9 aa, Homo Sapiens
NFSFLKVIF

SEQ ID NO: 858207 - protein, 9 aa, Homo Sapiens
QVEIPDFSN

SEQ ID NO: 858208 - protein, 9 aa, Homo Sapiens
ARALGKTRR

SEQ ID NO: 858209 - protein, 9 aa, Homo Sapiens
KLYLREKFE

SEQ ID NO: 858210 - protein, 9 aa, Homo Sapiens
PEAVCQLHR

SEQ ID NO: 858211 - protein, 9 aa, Homo Sapiens
IKGRSFTLA

SEQ ID NO: 858212 - protein, 9 aa, Homo Sapiens
TASQEVMGL

SEQ ID NO: 858213 - protein, 9 aa, Homo Sapiens
SKCFLPIKE

SEQ ID NO: 858214 - protein, 9 aa, Homo Sapiens
VLRVGIPDN

SEQ ID NO: 858215 - protein, 9 aa, Homo Sapiens
CNDTSTFEE

SEQ ID NO: 858216 - protein, 9 aa, Homo Sapiens
ITGPKVAFP

SEQ ID NO: 858217 - protein, 9 aa, Homo Sapiens
SKNLCKAME

SEQ ID NO: 858218 - protein, 9 aa, Homo Sapiens
ITGSGRSTL

SEQ ID NO: 858219 - protein, 9 aa, Homo Sapiens
PNGADGTQG

SEQ ID NO: 858220 - protein, 9 aa, Homo Sapiens
DGDYISKRP

SEQ ID NO: 858221 - protein, 9 aa, Homo Sapiens
NAFNGTTLT

SEQ ID NO: 858222 - protein, 9 aa, Homo Sapiens
ALASRHEYL

SEQ ID NO: 858223 - protein, 9 aa, Homo Sapiens
QTRQHELLY

SEQ ID NO: 858224 - protein, 9 aa, Homo Sapiens
SGSLQIHER

SEQ ID NO: 858225 - protein, 9 aa, Homo Sapiens
QNNPATEES

SEQ ID NO: 858226 - protein, 9 aa, Homo Sapiens
FMSFQSLFQ

SEQ ID NO: 858227 - protein, 9 aa, Homo Sapiens
PLVQATFPD

SEQ ID NO: 858228 - protein, 9 aa, Homo Sapiens
LYVPSSPII

SEQ ID NO: 858229 - protein, 9 aa, Homo Sapiens
YNSQIQPII

SEQ ID NO: 858230 - protein, 9 aa, Homo Sapiens
HGLLDPYSA

SEQ ID NO: 858231 - protein, 9 aa, Homo Sapiens
AVVSGNAQN

SEQ ID NO: 858232 - protein, 9 aa, Homo Sapiens
FLYTHRRMT

SEQ ID NO: 858233 - protein, 9 aa, Homo Sapiens
AAQGPNTPG

SEQ ID NO: 858234 - protein, 9 aa, Homo Sapiens
DVARPKLWK

SEQ ID NO: 858235 - protein, 9 aa, Homo Sapiens
KAAMQDKYV

SEQ ID NO: 858236 - protein, 9 aa, Homo Sapiens
ILGITDNLT

SEQ ID NO: 858237 - protein, 9 aa, Homo Sapiens
NCKGGFNFY

SEQ ID NO: 858238 - protein, 9 aa, Homo Sapiens
KKECPFPDA

SEQ ID NO: 858239 - protein, 9 aa, Homo Sapiens
CQFVMDNSQ

SEQ ID NO: 858240 - protein, 9 aa, Homo Sapiens
RKDLIQHFN

SEQ ID NO: 858241 - protein, 9 aa, Homo Sapiens
GRRGRGCPP

SEQ ID NO: 858242 - protein, 9 aa, Homo Sapiens
YSREQRCTD

SEQ ID NO: 858243 - protein, 9 aa, Homo Sapiens
YKTVTYLAW

SEQ ID NO: 858244 - protein, 9 aa, Homo Sapiens
YGPGDGPSY

SEQ ID NO: 858245 - protein, 9 aa, Homo Sapiens
FDSYYSLLI

SEQ ID NO: 858246 - protein, 9 aa, Homo Sapiens
VTMPREVEE

SEQ ID NO: 858247 - protein, 9 aa, Homo Sapiens
CELSGHINI

SEQ ID NO: 858248 - protein, 9 aa, Homo Sapiens
NSHMWKKIP

SEQ ID NO: 858249 - protein, 9 aa, Homo Sapiens
ITYIRADID

SEQ ID NO: 858250 - protein, 9 aa, Homo Sapiens
RDMVPQAAD

SEQ ID NO: 858251 - protein, 9 aa, Homo Sapiens
LIEVVDKQL

SEQ ID NO: 858252 - protein, 9 aa, Homo Sapiens
IVWVGGRSN

SEQ ID NO: 858253 - protein, 9 aa, Homo Sapiens
LHNKRTEVV

SEQ ID NO: 858254 - protein, 9 aa, Homo Sapiens
YRSGITQLF

SEQ ID NO: 858255 - protein, 9 aa, Homo Sapiens
IKDAEEDGD

SEQ ID NO: 858256 - protein, 9 aa, Homo Sapiens
PRPDNYFHE

SEQ ID NO: 858257 - protein, 9 aa, Homo Sapiens
TNLPVQLLP

SEQ ID NO: 858258 - protein, 9 aa, Homo Sapiens
DTILACAPL

SEQ ID NO: 858259 - protein, 9 aa, Homo Sapiens
LNHLEDRTL

SEQ ID NO: 858260 - protein, 9 aa, Homo Sapiens
RHGGFCYKM

SEQ ID NO: 858261 - protein, 9 aa, Homo Sapiens
YKYTCEGML

SEQ ID NO: 858262 - protein, 9 aa, Homo Sapiens
TATSQLPLK

SEQ ID NO: 858263 - protein, 9 aa, Homo Sapiens
PFFNISAKH

SEQ ID NO: 858264 - protein, 9 aa, Homo Sapiens
KSCTMHSLT

SEQ ID NO: 858265 - protein, 9 aa, Homo Sapiens
EFALVEDKV

SEQ ID NO: 858266 - protein, 9 aa, Homo Sapiens
TQQELQRKF

SEQ ID NO: 858267 - protein, 9 aa, Homo Sapiens
CTLRLPPVI

SEQ ID NO: 858268 - protein, 9 aa, Homo Sapiens
MSLRSQIRV

SEQ ID NO: 858269 - protein, 9 aa, Homo Sapiens
INHEKMHNA

SEQ ID NO: 858270 - protein, 9 aa, Homo Sapiens
TTIQELKEK

SEQ ID NO: 858271 - protein, 9 aa, Homo Sapiens
ADKKIHLVV

SEQ ID NO: 858272 - protein, 9 aa, Homo Sapiens
VGYRLPLPA

SEQ ID NO: 858273 - protein, 9 aa, Homo Sapiens
RSRQIIPRD

SEQ ID NO: 858274 - protein, 9 aa, Homo Sapiens
QSSYSVPCQ

SEQ ID NO: 858275 - protein, 9 aa, Homo Sapiens
TNVFAICFS

SEQ ID NO: 858276 - protein, 9 aa, Homo Sapiens
HAKSLQQKL

SEQ ID NO: 858277 - protein, 9 aa, Homo Sapiens
IGIAVQYAE

SEQ ID NO: 858278 - protein, 9 aa, Homo Sapiens
SQLAEPQNL

SEQ ID NO: 858279 - protein, 9 aa, Homo Sapiens
QLKILNLHF

SEQ ID NO: 858280 - protein, 9 aa, Homo Sapiens
ILPKQASID

SEQ ID NO: 858281 - protein, 9 aa, Homo Sapiens
WMDEFKYFF

SEQ ID NO: 858282 - protein, 9 aa, Homo Sapiens
IVALVVLII

SEQ ID NO: 858283 - protein, 9 aa, Homo Sapiens
IEHLYHWMH

SEQ ID NO: 858284 - protein, 9 aa, Homo Sapiens
VSSLEDISC

SEQ ID NO: 858285 - protein, 9 aa, Homo Sapiens
RSRINYSGE

SEQ ID NO: 858286 - protein, 9 aa, Homo Sapiens
PPWKVLSGF

SEQ ID NO: 858287 - protein, 9 aa, Homo Sapiens
VETYCSENK

SEQ ID NO: 858288 - protein, 9 aa, Homo Sapiens
WDFLQVLEP

SEQ ID NO: 858289 - protein, 9 aa, Homo Sapiens
QQQLGEYQE

SEQ ID NO: 858290 - protein, 9 aa, Homo Sapiens
SKHSDDEEL

SEQ ID NO: 858291 - protein, 9 aa, Homo Sapiens
SCDVAEGTY

SEQ ID NO: 858292 - protein, 9 aa, Homo Sapiens
SMPDRNMKN

SEQ ID NO: 858293 - protein, 9 aa, Homo Sapiens
TNVGIVKVV

SEQ ID NO: 858294 - protein, 9 aa, Homo Sapiens
KFVRVRSYE

SEQ ID NO: 858295 - protein, 9 aa, Homo Sapiens
AKEDPVCTP

SEQ ID NO: 858296 - protein, 9 aa, Homo Sapiens
GTNTSFYGF

SEQ ID NO: 858297 - protein, 9 aa, Homo Sapiens
VALLLGGGS

SEQ ID NO: 858298 - protein, 9 aa, Homo Sapiens
IKAQKGTAF

SEQ ID NO: 858299 - protein, 9 aa, Homo Sapiens
VMQKLFPRI

SEQ ID NO: 858300 - protein, 9 aa, Homo Sapiens
RSPDPSSPD

SEQ ID NO: 858301 - protein, 9 aa, Homo Sapiens
AELTANKRK

SEQ ID NO: 858302 - protein, 9 aa, Homo Sapiens
GEATGRDRR

SEQ ID NO: 858303 - protein, 9 aa, Homo Sapiens
EAESTELVP

SEQ ID NO: 858304 - protein, 9 aa, Homo Sapiens
VEKLKESAV

SEQ ID NO: 858305 - protein, 9 aa, Homo Sapiens
KGQRGYVVL

SEQ ID NO: 858306 - protein, 9 aa, Homo Sapiens
LGCTMAPEA

SEQ ID NO: 858307 - protein, 9 aa, Homo Sapiens
LRLPPVIRG

SEQ ID NO: 858308 - protein, 9 aa, Homo Sapiens
VEGTSAKPS

SEQ ID NO: 858309 - protein, 9 aa, Homo Sapiens
MKILNKKST

SEQ ID NO: 858310 - protein, 9 aa, Homo Sapiens
VQDLFETQG

SEQ ID NO: 858311 - protein, 9 aa, Homo Sapiens
FYVPKGTSE

SEQ ID NO: 858312 - protein, 9 aa, Homo Sapiens
YSLVPYIME

SEQ ID NO: 858313 - protein, 9 aa, Homo Sapiens
CLQWLGQQG

SEQ ID NO: 858314 - protein, 9 aa, Homo Sapiens
FSITSNTYP

SEQ ID NO: 858315 - protein, 9 aa, Homo Sapiens
GTKGLSVDD

SEQ ID NO: 858316 - protein, 9 aa, Homo Sapiens
GLCREGDQL

SEQ ID NO: 858317 - protein, 9 aa, Homo Sapiens
LQRDQECLG

SEQ ID NO: 858318 - protein, 9 aa, Homo Sapiens
LTKQQASSL

SEQ ID NO: 858319 - protein, 9 aa, Homo Sapiens
LIPEKLDLR

SEQ ID NO: 858320 - protein, 9 aa, Homo Sapiens
GSDMGGPLP

SEQ ID NO: 858321 - protein, 9 aa, Homo Sapiens
YFFLTNLSP

SEQ ID NO: 858322 - protein, 9 aa, Homo Sapiens
LPNDLFSTN

SEQ ID NO: 858323 - protein, 9 aa, Homo Sapiens
QKLSDGGTE

SEQ ID NO: 858324 - protein, 9 aa, Homo Sapiens
IVRQVRLWR

SEQ ID NO: 858325 - protein, 9 aa, Homo Sapiens
NRPVRYAIY

SEQ ID NO: 858326 - protein, 9 aa, Homo Sapiens
LDDSKKIAR

SEQ ID NO: 858327 - protein, 9 aa, Homo Sapiens
ECGKLFLDS

SEQ ID NO: 858328 - protein, 9 aa, Homo Sapiens
KGKALESLD

SEQ ID NO: 858329 - protein, 9 aa, Homo Sapiens
KEKTVTFLG

SEQ ID NO: 858330 - protein, 9 aa, Homo Sapiens
PRMVGMSFQ

SEQ ID NO: 858331 - protein, 9 aa, Homo Sapiens
NKRGPKPKT

SEQ ID NO: 858332 - protein, 9 aa, Homo Sapiens
IDNAQPILQ

SEQ ID NO: 858333 - protein, 9 aa, Homo Sapiens
DSRDSGFQF

SEQ ID NO: 858334 - protein, 9 aa, Homo Sapiens
RFLRFLANL

SEQ ID NO: 858335 - protein, 9 aa, Homo Sapiens
AQENVDYVT

SEQ ID NO: 858336 - protein, 9 aa, Homo Sapiens
DSQRVKSVL

SEQ ID NO: 858337 - protein, 9 aa, Homo Sapiens
QHMRKHTGK

SEQ ID NO: 858338 - protein, 9 aa, Homo Sapiens
SPLETLTLT

SEQ ID NO: 858339 - protein, 9 aa, Homo Sapiens
AQLIIDGIS

SEQ ID NO: 858340 - protein, 9 aa, Homo Sapiens
QRDMQPLSP

SEQ ID NO: 858341 - protein, 9 aa, Homo Sapiens
SRSNSGCVV

SEQ ID NO: 858342 - protein, 9 aa, Homo Sapiens
EKGDIGIIH

SEQ ID NO: 858343 - protein, 9 aa, Homo Sapiens
RQIGELKKM

SEQ ID NO: 858344 - protein, 9 aa, Homo Sapiens
RIISGNFFL

SEQ ID NO: 858345 - protein, 9 aa, Homo Sapiens
RNNTHVPDF

SEQ ID NO: 858346 - protein, 9 aa, Homo Sapiens
MSNAFAHLP

SEQ ID NO: 858347 - protein, 9 aa, Homo Sapiens
PTEEQRPNK

SEQ ID NO: 858348 - protein, 9 aa, Homo Sapiens
KTNTKTSSP

SEQ ID NO: 858349 - protein, 9 aa, Homo Sapiens
GNCNREAFN

SEQ ID NO: 858350 - protein, 9 aa, Homo Sapiens
RTLIAVLWA

SEQ ID NO: 858351 - protein, 9 aa, Homo Sapiens
VKVCTCTSQ

SEQ ID NO: 858352 - protein, 9 aa, Homo Sapiens
HKLISQMLT

SEQ ID NO: 858353 - protein, 9 aa, Homo Sapiens
LEDEDGQTK

SEQ ID NO: 858354 - protein, 9 aa, Homo Sapiens
DVTVEFTRD

SEQ ID NO: 858355 - protein, 9 aa, Homo Sapiens
FQDTAEALT

SEQ ID NO: 858356 - protein, 9 aa, Homo Sapiens
SALMTLGPT

SEQ ID NO: 858357 - protein, 9 aa, Homo Sapiens
FAATLCAPK

SEQ ID NO: 858358 - protein, 9 aa, Homo Sapiens
LSMESLPTV

SEQ ID NO: 858359 - protein, 9 aa, Homo Sapiens
ISLKPVLQA

SEQ ID NO: 858360 - protein, 9 aa, Homo Sapiens
YFVEFIFHI

SEQ ID NO: 858361 - protein, 9 aa, Homo Sapiens
NWLISDLQK

SEQ ID NO: 858362 - protein, 9 aa, Homo Sapiens
EDKLCEWMG

SEQ ID NO: 858363 - protein, 9 aa, Homo Sapiens
DSPKEKSVQ

SEQ ID NO: 858364 - protein, 9 aa, Homo Sapiens
IYCLCHKVQ

SEQ ID NO: 858365 - protein, 9 aa, Homo Sapiens
DAMCNFAEK

SEQ ID NO: 858366 - protein, 9 aa, Homo Sapiens
FLPPSWREL

SEQ ID NO: 858367 - protein, 9 aa, Homo Sapiens
KEVLKEFIY

SEQ ID NO: 858368 - protein, 9 aa, Homo Sapiens
ASFISAQAS

SEQ ID NO: 858369 - protein, 9 aa, Homo Sapiens
IKAFFEQML

SEQ ID NO: 858370 - protein, 9 aa, Homo Sapiens
DRPYECSVC

SEQ ID NO: 858371 - protein, 9 aa, Homo Sapiens
AIKLAIKAV

SEQ ID NO: 858372 - protein, 9 aa, Homo Sapiens
SSYLILRNN

SEQ ID NO: 858373 - protein, 9 aa, Homo Sapiens
FPSVLESED

SEQ ID NO: 858374 - protein, 9 aa, Homo Sapiens
AKKKTRSKA

SEQ ID NO: 858375 - protein, 9 aa, Homo Sapiens
EINYTVDKD

SEQ ID NO: 858376 - protein, 9 aa, Homo Sapiens
LNQRKWKKI

SEQ ID NO: 858377 - protein, 9 aa, Homo Sapiens
GAACDQRVI

SEQ ID NO: 858378 - protein, 9 aa, Homo Sapiens
FETNTYFNI

SEQ ID NO: 858379 - protein, 9 aa, Homo Sapiens
IKMTVCLET

SEQ ID NO: 858380 - protein, 9 aa, Homo Sapiens
SLHEPIQIV

SEQ ID NO: 858381 - protein, 9 aa, Homo Sapiens
KVKATTAFP

SEQ ID NO: 858382 - protein, 9 aa, Homo Sapiens
MLAKVIRLL

SEQ ID NO: 858383 - protein, 9 aa, Homo Sapiens
IVLHWCIMP

SEQ ID NO: 858384 - protein, 9 aa, Homo Sapiens
LAVCQCRRN

SEQ ID NO: 858385 - protein, 9 aa, Homo Sapiens
NQTVFVSID

SEQ ID NO: 858386 - protein, 9 aa, Homo Sapiens
RFGFLQELS

SEQ ID NO: 858387 - protein, 9 aa, Homo Sapiens
KLFQNDQNS

SEQ ID NO: 858388 - protein, 9 aa, Homo Sapiens
HKPGGDLES

SEQ ID NO: 858389 - protein, 9 aa, Homo Sapiens
DHPGYLRSA

SEQ ID NO: 858390 - protein, 9 aa, Homo Sapiens
ETVLHIAAL

SEQ ID NO: 858391 - protein, 9 aa, Homo Sapiens
ADDYDKNKL

SEQ ID NO: 858392 - protein, 9 aa, Homo Sapiens
ASYLDNMLA

SEQ ID NO: 858393 - protein, 9 aa, Homo Sapiens
KKVSLMGFG

SEQ ID NO: 858394 - protein, 9 aa, Homo Sapiens
GLFEGTSLC

SEQ ID NO: 858395 - protein, 9 aa, Homo Sapiens
KASLAGTLF

SEQ ID NO: 858396 - protein, 9 aa, Homo Sapiens
GQLHSEAAY

SEQ ID NO: 858397 - protein, 9 aa, Homo Sapiens
RLVVFKLEN

SEQ ID NO: 858398 - protein, 9 aa, Homo Sapiens
HFQRKKPYE

SEQ ID NO: 858399 - protein, 9 aa, Homo Sapiens
INGLQQVLD

SEQ ID NO: 858400 - protein, 9 aa, Homo Sapiens
QTLSFNETS

SEQ ID NO: 858401 - protein, 9 aa, Homo Sapiens
LEGYVGVED

SEQ ID NO: 858402 - protein, 9 aa, Homo Sapiens
ALKAIHAIM

SEQ ID NO: 858403 - protein, 9 aa, Homo Sapiens
GPRTRAHLG

SEQ ID NO: 858404 - protein, 9 aa, Homo Sapiens
DILFPPSYP

SEQ ID NO: 858405 - protein, 9 aa, Homo Sapiens
YSVGQMFLG

SEQ ID NO: 858406 - protein, 9 aa, Homo Sapiens
SPRSAMSTT

SEQ ID NO: 858407 - protein, 9 aa, Homo Sapiens
REFLKLLPE

SEQ ID NO: 858408 - protein, 9 aa, Homo Sapiens
IIDELSKKE

SEQ ID NO: 858409 - protein, 9 aa, Homo Sapiens
PHCHFGHPD

SEQ ID NO: 858410 - protein, 9 aa, Homo Sapiens
VYVSRPSHL

SEQ ID NO: 858411 - protein, 9 aa, Homo Sapiens
YRQMLFCRV

SEQ ID NO: 858412 - protein, 9 aa, Homo Sapiens
WGPGDSARD

SEQ ID NO: 858413 - protein, 9 aa, Homo Sapiens
QFKEHQQIH

SEQ ID NO: 858414 - protein, 9 aa, Homo Sapiens
TTAIHTYQS

SEQ ID NO: 858415 - protein, 9 aa, Homo Sapiens
HKRKLKRKK

SEQ ID NO: 858416 - protein, 9 aa, Homo Sapiens
YRGKETLDM

SEQ ID NO: 858417 - protein, 9 aa, Homo Sapiens
PDALIASLA

SEQ ID NO: 858418 - protein, 9 aa, Homo Sapiens
AEKTHGSLI

SEQ ID NO: 858419 - protein, 9 aa, Homo Sapiens
QSGNATDSP

SEQ ID NO: 858420 - protein, 9 aa, Homo Sapiens
ISQACKLLL

SEQ ID NO: 858421 - protein, 9 aa, Homo Sapiens
PPHLSCLPA

SEQ ID NO: 858422 - protein, 9 aa, Homo Sapiens
KERRRHKTD

SEQ ID NO: 858423 - protein, 9 aa, Homo Sapiens
TSWIPPFPK

SEQ ID NO: 858424 - protein, 9 aa, Homo Sapiens
FITEKSDID

SEQ ID NO: 858425 - protein, 9 aa, Homo Sapiens
KTKANVKEL

SEQ ID NO: 858426 - protein, 9 aa, Homo Sapiens
LRLAQSRTN

SEQ ID NO: 858427 - protein, 9 aa, Homo Sapiens
LIKIHIGSS

SEQ ID NO: 858428 - protein, 9 aa, Homo Sapiens
LCEVYNAKH

SEQ ID NO: 858429 - protein, 9 aa, Homo Sapiens
DYDWYNVPD

SEQ ID NO: 858430 - protein, 9 aa, Homo Sapiens
QAHQIIRDL

SEQ ID NO: 858431 - protein, 9 aa, Homo Sapiens
EVKKLITAQ

SEQ ID NO: 858432 - protein, 9 aa, Homo Sapiens
QCLQYYDSY

SEQ ID NO: 858433 - protein, 9 aa, Homo Sapiens
SSSKESSWI

SEQ ID NO: 858434 - protein, 9 aa, Homo Sapiens
FFTDCYGYR

SEQ ID NO: 858435 - protein, 9 aa, Homo Sapiens
KLEQRQATD

SEQ ID NO: 858436 - protein, 9 aa, Homo Sapiens
SWNPTSQEN

SEQ ID NO: 858437 - protein, 9 aa, Homo Sapiens
CYIIPKATE

SEQ ID NO: 858438 - protein, 9 aa, Homo Sapiens
LRRHIYNRY

SEQ ID NO: 858439 - protein, 9 aa, Homo Sapiens
FVGEALLGN

SEQ ID NO: 858440 - protein, 9 aa, Homo Sapiens
SGPLISDAD

SEQ ID NO: 858441 - protein, 9 aa, Homo Sapiens
YISPPERKR

SEQ ID NO: 858442 - protein, 9 aa, Homo Sapiens
ASAEESNFP

SEQ ID NO: 858443 - protein, 9 aa, Homo Sapiens
EITFPPASV

SEQ ID NO: 858444 - protein, 9 aa, Homo Sapiens
ILRNQKRSK

SEQ ID NO: 858445 - protein, 9 aa, Homo Sapiens
TDDYHYDKF

SEQ ID NO: 858446 - protein, 9 aa, Homo Sapiens
INARDAKAI

SEQ ID NO: 858447 - protein, 9 aa, Homo Sapiens
RKAFSTCAF

SEQ ID NO: 858448 - protein, 9 aa, Homo Sapiens
SVCGLEHLR

SEQ ID NO: 858449 - protein, 9 aa, Homo Sapiens
KENIFQEHR

SEQ ID NO: 858450 - protein, 9 aa, Homo Sapiens
MGIEPWPED

SEQ ID NO: 858451 - protein, 9 aa, Homo Sapiens
LGRHCVTRR

SEQ ID NO: 858452 - protein, 9 aa, Homo Sapiens
RPVRYAIYR

SEQ ID NO: 858453 - protein, 9 aa, Homo Sapiens
NYLGFSFGH

SEQ ID NO: 858454 - protein, 9 aa, Homo Sapiens
ILVDYILLK

SEQ ID NO: 858455 - protein, 9 aa, Homo Sapiens
HGSLVCTQI

SEQ ID NO: 858456 - protein, 9 aa, Homo Sapiens
CWGIRCLHY

SEQ ID NO: 858457 - protein, 9 aa, Homo Sapiens
RKVQSLKEQ

SEQ ID NO: 858458 - protein, 9 aa, Homo Sapiens
TYFFCGNKY

SEQ ID NO: 858459 - protein, 9 aa, Homo Sapiens
EILTRGVKT

SEQ ID NO: 858460 - protein, 9 aa, Homo Sapiens
TGNVWLTHK

SEQ ID NO: 858461 - protein, 9 aa, Homo Sapiens
YGQCWVFTS

SEQ ID NO: 858462 - protein, 9 aa, Homo Sapiens
PNGCDLLFL

SEQ ID NO: 858463 - protein, 9 aa, Homo Sapiens
ELDPWEHQW

SEQ ID NO: 858464 - protein, 9 aa, Homo Sapiens
KKDDTEKER

SEQ ID NO: 858465 - protein, 9 aa, Homo Sapiens
VTKTPLEGD

SEQ ID NO: 858466 - protein, 9 aa, Homo Sapiens
YRRILRRPA

SEQ ID NO: 858467 - protein, 9 aa, Homo Sapiens
IGSFLTLNM

SEQ ID NO: 858468 - protein, 9 aa, Homo Sapiens
RKLGFYNSN

SEQ ID NO: 858469 - protein, 9 aa, Homo Sapiens
SQNAQGYAW

SEQ ID NO: 858470 - protein, 9 aa, Homo Sapiens
SNFKSPVKM

SEQ ID NO: 858471 - protein, 9 aa, Homo Sapiens
ERYAAELEA

SEQ ID NO: 858472 - protein, 9 aa, Homo Sapiens
EAINQMFQK

SEQ ID NO: 858473 - protein, 9 aa, Homo Sapiens
AVRVFECGG

SEQ ID NO: 858474 - protein, 9 aa, Homo Sapiens
GSTNLVLIG

SEQ ID NO: 858475 - protein, 9 aa, Homo Sapiens
ESREGLKQP

SEQ ID NO: 858476 - protein, 9 aa, Homo Sapiens
ATLIRDQLK

SEQ ID NO: 858477 - protein, 9 aa, Homo Sapiens
DMLTFTIAL

SEQ ID NO: 858478 - protein, 9 aa, Homo Sapiens
HLALGGCTN

SEQ ID NO: 858479 - protein, 9 aa, Homo Sapiens
EQKHPERRM

SEQ ID NO: 858480 - protein, 9 aa, Homo Sapiens
ENMGVGIRN

SEQ ID NO: 858481 - protein, 9 aa, Homo Sapiens
TTALPVRFL

SEQ ID NO: 858482 - protein, 9 aa, Homo Sapiens
EDLATEPTK

SEQ ID NO: 858483 - protein, 9 aa, Homo Sapiens
QQREADAAL

SEQ ID NO: 858484 - protein, 9 aa, Homo Sapiens
NLQRYCYTD

SEQ ID NO: 858485 - protein, 9 aa, Homo Sapiens
CSLCVEHIN

SEQ ID NO: 858486 - protein, 9 aa, Homo Sapiens
RIYKTGDIV

SEQ ID NO: 858487 - protein, 9 aa, Homo Sapiens
TRISTEDDG

SEQ ID NO: 858488 - protein, 9 aa, Homo Sapiens
KVREHLHNL

SEQ ID NO: 858489 - protein, 9 aa, Homo Sapiens
TEHASRPTP

SEQ ID NO: 858490 - protein, 9 aa, Homo Sapiens
GGRESYMST

SEQ ID NO: 858491 - protein, 9 aa, Homo Sapiens
QVSNELFQG

SEQ ID NO: 858492 - protein, 9 aa, Homo Sapiens
DVCVNVTDV

SEQ ID NO: 858493 - protein, 9 aa, Homo Sapiens
QATKQHLTP

SEQ ID NO: 858494 - protein, 9 aa, Homo Sapiens
DPRFKNSLE

SEQ ID NO: 858495 - protein, 9 aa, Homo Sapiens
KNEQSVSAT

SEQ ID NO: 858496 - protein, 9 aa, Homo Sapiens
DFLLLTYMA

SEQ ID NO: 858497 - protein, 9 aa, Homo Sapiens
LSHEQKMSV

SEQ ID NO: 858498 - protein, 9 aa, Homo Sapiens
GQGNGSLSP

SEQ ID NO: 858499 - protein, 9 aa, Homo Sapiens
SDAFGSLSN

SEQ ID NO: 858500 - protein, 9 aa, Homo Sapiens
RPAHGRRPP

SEQ ID NO: 858501 - protein, 9 aa, Homo Sapiens
IIKETQVPA

SEQ ID NO: 858502 - protein, 9 aa, Homo Sapiens
RKVLRKIEQ

SEQ ID NO: 858503 - protein, 9 aa, Homo Sapiens
EFNELFNDV

SEQ ID NO: 858504 - protein, 9 aa, Homo Sapiens
VNELYEQGD

SEQ ID NO: 858505 - protein, 9 aa, Homo Sapiens
LNGHLPHPS

SEQ ID NO: 858506 - protein, 9 aa, Homo Sapiens
SDYTQTLSN

SEQ ID NO: 858507 - protein, 9 aa, Homo Sapiens
GKGKAKLGQ

SEQ ID NO: 858508 - protein, 9 aa, Homo Sapiens
SAIPEQILS

SEQ ID NO: 858509 - protein, 9 aa, Homo Sapiens
RFHQIIHTG

SEQ ID NO: 858510 - protein, 9 aa, Homo Sapiens
IEYIKNVPI

SEQ ID NO: 858511 - protein, 9 aa, Homo Sapiens
KTTITVPPF

SEQ ID NO: 858512 - protein, 9 aa, Homo Sapiens
PFACVVCGT

SEQ ID NO: 858513 - protein, 9 aa, Homo Sapiens
RPSNNCRAS

SEQ ID NO: 858514 - protein, 9 aa, Homo Sapiens
YLPLEETEK

SEQ ID NO: 858515 - protein, 9 aa, Homo Sapiens
RNKSTHLKK

SEQ ID NO: 858516 - protein, 9 aa, Homo Sapiens
LYRDVMMDN

SEQ ID NO: 858517 - protein, 9 aa, Homo Sapiens
EVCKVKTIV

SEQ ID NO: 858518 - protein, 9 aa, Homo Sapiens
PKELVELHF

SEQ ID NO: 858519 - protein, 9 aa, Homo Sapiens
PRQQKEEQK

SEQ ID NO: 858520 - protein, 9 aa, Homo Sapiens
KRDPLQQVL

SEQ ID NO: 858521 - protein, 9 aa, Homo Sapiens
SFICKDKLG

SEQ ID NO: 858522 - protein, 9 aa, Homo Sapiens
NKRFPLVNF

SEQ ID NO: 858523 - protein, 9 aa, Homo Sapiens
GHRYLHQES

SEQ ID NO: 858524 - protein, 9 aa, Homo Sapiens
YACARLTCA

SEQ ID NO: 858525 - protein, 9 aa, Homo Sapiens
TWKTSLWNN

SEQ ID NO: 858526 - protein, 9 aa, Homo Sapiens
AAYWKALKV

SEQ ID NO: 858527 - protein, 9 aa, Homo Sapiens
KAQNALGVL

SEQ ID NO: 858528 - protein, 9 aa, Homo Sapiens
KLDQEAEEN

SEQ ID NO: 858529 - protein, 9 aa, Homo Sapiens
RSFLENKRF

SEQ ID NO: 858530 - protein, 9 aa, Homo Sapiens
FQEGVEMLL

SEQ ID NO: 858531 - protein, 9 aa, Homo Sapiens
DKIKTNITF

SEQ ID NO: 858532 - protein, 9 aa, Homo Sapiens
YHKLDYLTY

SEQ ID NO: 858533 - protein, 9 aa, Homo Sapiens
TDYPFKPPQ

SEQ ID NO: 858534 - protein, 9 aa, Homo Sapiens
YFYSTFQAL

SEQ ID NO: 858535 - protein, 9 aa, Homo Sapiens
DLEDDSEFD

SEQ ID NO: 858536 - protein, 9 aa, Homo Sapiens
IKESEIIYF

SEQ ID NO: 858537 - protein, 9 aa, Homo Sapiens
SPATNYSHT

SEQ ID NO: 858538 - protein, 9 aa, Homo Sapiens
GTTHVLVHD

SEQ ID NO: 858539 - protein, 9 aa, Homo Sapiens
TIDLVIFLD

SEQ ID NO: 858540 - protein, 9 aa, Homo Sapiens
HYLPWPEKR

SEQ ID NO: 858541 - protein, 9 aa, Homo Sapiens
YLERLTQER

SEQ ID NO: 858542 - protein, 9 aa, Homo Sapiens
KKKEKKQSG

SEQ ID NO: 858543 - protein, 9 aa, Homo Sapiens
SHPKEHMFC

SEQ ID NO: 858544 - protein, 9 aa, Homo Sapiens
QGLNIILIS

SEQ ID NO: 858545 - protein, 9 aa, Homo Sapiens
DLFMMPQIV

SEQ ID NO: 858546 - protein, 9 aa, Homo Sapiens
RSSYWRVFH

SEQ ID NO: 858547 - protein, 9 aa, Homo Sapiens
PLIDSFQRV

SEQ ID NO: 858548 - protein, 9 aa, Homo Sapiens
GSAELDDES

SEQ ID NO: 858549 - protein, 9 aa, Homo Sapiens
YKDPAAIPK

SEQ ID NO: 858550 - protein, 9 aa, Homo Sapiens
LRAACLQYL

SEQ ID NO: 858551 - protein, 9 aa, Homo Sapiens
LYSWLLVIR

SEQ ID NO: 858552 - protein, 9 aa, Homo Sapiens
HKLSLRWHL

SEQ ID NO: 858553 - protein, 9 aa, Homo Sapiens
YGRNELIGR

SEQ ID NO: 858554 - protein, 9 aa, Homo Sapiens
RAAQSDLAA

SEQ ID NO: 858555 - protein, 9 aa, Homo Sapiens
GETDEDKLF

SEQ ID NO: 858556 - protein, 9 aa, Homo Sapiens
ISICTGIKE

SEQ ID NO: 858557 - protein, 9 aa, Homo Sapiens
MSTSLMQML

SEQ ID NO: 858558 - protein, 9 aa, Homo Sapiens
CTMMTQLKS

SEQ ID NO: 858559 - protein, 9 aa, Homo Sapiens
FFSSPITEA

SEQ ID NO: 858560 - protein, 9 aa, Homo Sapiens
PILSYFFGA

SEQ ID NO: 858561 - protein, 9 aa, Homo Sapiens
QKNQLISFQ

SEQ ID NO: 858562 - protein, 9 aa, Homo Sapiens
LVFSDLPCE

SEQ ID NO: 858563 - protein, 9 aa, Homo Sapiens
DIQLARRIC

SEQ ID NO: 858564 - protein, 9 aa, Homo Sapiens
QVASMHCYL

SEQ ID NO: 858565 - protein, 9 aa, Homo Sapiens
IKGRNIYEP

SEQ ID NO: 858566 - protein, 9 aa, Homo Sapiens
SIKNMKEIE

SEQ ID NO: 858567 - protein, 9 aa, Homo Sapiens
GPNSLHLEI

SEQ ID NO: 858568 - protein, 9 aa, Homo Sapiens
TAGVLLGIS

SEQ ID NO: 858569 - protein, 9 aa, Homo Sapiens
PKSQARRIW

SEQ ID NO: 858570 - protein, 9 aa, Homo Sapiens
SNVLQDVFT

SEQ ID NO: 858571 - protein, 9 aa, Homo Sapiens
VKATVRNYS

SEQ ID NO: 858572 - protein, 9 aa, Homo Sapiens
TDINYHAPE

SEQ ID NO: 858573 - protein, 9 aa, Homo Sapiens
RRIDITTKL

SEQ ID NO: 858574 - protein, 9 aa, Homo Sapiens
DINGLQQVL

SEQ ID NO: 858575 - protein, 9 aa, Homo Sapiens
MPNDKAFSK

SEQ ID NO: 858576 - protein, 9 aa, Homo Sapiens
SLLDKVCKF

SEQ ID NO: 858577 - protein, 9 aa, Homo Sapiens
KTSLWNNNE

SEQ ID NO: 858578 - protein, 9 aa, Homo Sapiens
NTSLVTTPT

SEQ ID NO: 858579 - protein, 9 aa, Homo Sapiens
MISLTSGLS

SEQ ID NO: 858580 - protein, 9 aa, Homo Sapiens
SLLKTMHRT

SEQ ID NO: 858581 - protein, 9 aa, Homo Sapiens
RNLILDSMK

SEQ ID NO: 858582 - protein, 9 aa, Homo Sapiens
KKGKKLPEA

SEQ ID NO: 858583 - protein, 9 aa, Homo Sapiens
INLEIPGKS

SEQ ID NO: 858584 - protein, 9 aa, Homo Sapiens
ISLAYSEVS

SEQ ID NO: 858585 - protein, 9 aa, Homo Sapiens
RCCVPVCCC

SEQ ID NO: 858586 - protein, 9 aa, Homo Sapiens
VPTNNQQVK

SEQ ID NO: 858587 - protein, 9 aa, Homo Sapiens
AFKTWKCPE

SEQ ID NO: 858588 - protein, 9 aa, Homo Sapiens
AEAEDGEEY

SEQ ID NO: 858589 - protein, 9 aa, Homo Sapiens
FNETSPEIV

SEQ ID NO: 858590 - protein, 9 aa, Homo Sapiens
QRFCDNIIV

SEQ ID NO: 858591 - protein, 9 aa, Homo Sapiens
PHVLVDTLA

SEQ ID NO: 858592 - protein, 9 aa, Homo Sapiens
ASLSNNSTS

SEQ ID NO: 858593 - protein, 9 aa, Homo Sapiens
KTDPQYLAL

SEQ ID NO: 858594 - protein, 9 aa, Homo Sapiens
LQTAMSSRQ

SEQ ID NO: 858595 - protein, 9 aa, Homo Sapiens
VHFKSNNLK

SEQ ID NO: 858596 - protein, 9 aa, Homo Sapiens
TFHPRTSSN

SEQ ID NO: 858597 - protein, 9 aa, Homo Sapiens
RRRRQQRSE

SEQ ID NO: 858598 - protein, 9 aa, Homo Sapiens
KDLEKQIGS

SEQ ID NO: 858599 - protein, 9 aa, Homo Sapiens
IILLLVYRM

SEQ ID NO: 858600 - protein, 9 aa, Homo Sapiens
TCINNNVCK

SEQ ID NO: 858601 - protein, 9 aa, Homo Sapiens
KGRCFRGSS

SEQ ID NO: 858602 - protein, 9 aa, Homo Sapiens
PGKRFMFQF

SEQ ID NO: 858603 - protein, 9 aa, Homo Sapiens
RMEFEEIDY

SEQ ID NO: 858604 - protein, 9 aa, Homo Sapiens
DVFIVFTGN

SEQ ID NO: 858605 - protein, 9 aa, Homo Sapiens
LSQKPGDRV

SEQ ID NO: 858606 - protein, 9 aa, Homo Sapiens
LPGHRVREI

SEQ ID NO: 858607 - protein, 9 aa, Homo Sapiens
LEKSEEPPE

SEQ ID NO: 858608 - protein, 9 aa, Homo Sapiens
QEFQFVDEE

SEQ ID NO: 858609 - protein, 9 aa, Homo Sapiens
RNVSSIQMI

SEQ ID NO: 858610 - protein, 9 aa, Homo Sapiens
SALIVHQIT

SEQ ID NO: 858611 - protein, 9 aa, Homo Sapiens
MLICLVLRQ

SEQ ID NO: 858612 - protein, 9 aa, Homo Sapiens
INVSDCRSM

SEQ ID NO: 858613 - protein, 9 aa, Homo Sapiens
ACLVIIFIS

SEQ ID NO: 858614 - protein, 9 aa, Homo Sapiens
EEKDLLKTV

SEQ ID NO: 858615 - protein, 9 aa, Homo Sapiens
VHDSFRPKL

SEQ ID NO: 858616 - protein, 9 aa, Homo Sapiens
KTSIVWVGG

SEQ ID NO: 858617 - protein, 9 aa, Homo Sapiens
YQRTPCYAC

SEQ ID NO: 858618 - protein, 9 aa, Homo Sapiens
GSVEAVVMA

SEQ ID NO: 858619 - protein, 9 aa, Homo Sapiens
INAYLIALL

SEQ ID NO: 858620 - protein, 9 aa, Homo Sapiens
ATINSLSYY

SEQ ID NO: 858621 - protein, 9 aa, Homo Sapiens
PIKPNIPLS

SEQ ID NO: 858622 - protein, 9 aa, Homo Sapiens
TCKTQTTSW

SEQ ID NO: 858623 - protein, 9 aa, Homo Sapiens
AAPFISGVE

SEQ ID NO: 858624 - protein, 9 aa, Homo Sapiens
LHWRLMALR

SEQ ID NO: 858625 - protein, 9 aa, Homo Sapiens
SNLIVHQGT

SEQ ID NO: 858626 - protein, 9 aa, Homo Sapiens
WLRSQHRDL

SEQ ID NO: 858627 - protein, 9 aa, Homo Sapiens
RALWCGEEV

SEQ ID NO: 858628 - protein, 9 aa, Homo Sapiens
FPTSCETSG

SEQ ID NO: 858629 - protein, 9 aa, Homo Sapiens
DHRDDREPQ

SEQ ID NO: 858630 - protein, 9 aa, Homo Sapiens
VPAMAAQVV

SEQ ID NO: 858631 - protein, 9 aa, Homo Sapiens
KHCSRYMHD

SEQ ID NO: 858632 - protein, 9 aa, Homo Sapiens
DKCYIHEVQ

SEQ ID NO: 858633 - protein, 9 aa, Homo Sapiens
MYIVVVAGN

SEQ ID NO: 858634 - protein, 9 aa, Homo Sapiens
NEKFADQDD

SEQ ID NO: 858635 - protein, 9 aa, Homo Sapiens
SPVSPPPSS

SEQ ID NO: 858636 - protein, 9 aa, Homo Sapiens
CQKGKCSRH

SEQ ID NO: 858637 - protein, 9 aa, Homo Sapiens
GVRMDVVSV

SEQ ID NO: 858638 - protein, 9 aa, Homo Sapiens
SWLYGVNNV

SEQ ID NO: 858639 - protein, 9 aa, Homo Sapiens
RVFSQRTYR

SEQ ID NO: 858640 - protein, 9 aa, Homo Sapiens
EGKISKYLS

SEQ ID NO: 858641 - protein, 9 aa, Homo Sapiens
EMTKNWSLI

SEQ ID NO: 858642 - protein, 9 aa, Homo Sapiens
LINRCKKII

SEQ ID NO: 858643 - protein, 9 aa, Homo Sapiens
WAFCMDNIL

SEQ ID NO: 858644 - protein, 9 aa, Homo Sapiens
MHSIYFLLD

SEQ ID NO: 858645 - protein, 9 aa, Homo Sapiens
DSLVQQSQL

SEQ ID NO: 858646 - protein, 9 aa, Homo Sapiens
MGNYGFGVL

SEQ ID NO: 858647 - protein, 9 aa, Homo Sapiens
PTPNPLATL

SEQ ID NO: 858648 - protein, 9 aa, Homo Sapiens
EIFPQIKEG

SEQ ID NO: 858649 - protein, 9 aa, Homo Sapiens
DYYPNRTYI

SEQ ID NO: 858650 - protein, 9 aa, Homo Sapiens
LESGLRVAL

SEQ ID NO: 858651 - protein, 9 aa, Homo Sapiens
DLGPWNQYA

SEQ ID NO: 858652 - protein, 9 aa, Homo Sapiens
EYLVSGIQT

SEQ ID NO: 858653 - protein, 9 aa, Homo Sapiens
KLCGLDNGD

SEQ ID NO: 858654 - protein, 9 aa, Homo Sapiens
RKIEQPFGL

SEQ ID NO: 858655 - protein, 9 aa, Homo Sapiens
QQRLLGSVQ

SEQ ID NO: 858656 - protein, 9 aa, Homo Sapiens
AFFPDKFKP

SEQ ID NO: 858657 - protein, 9 aa, Homo Sapiens
ITVSVYQYT

SEQ ID NO: 858658 - protein, 9 aa, Homo Sapiens
WCGEEVAVK

SEQ ID NO: 858659 - protein, 9 aa, Homo Sapiens
AHIHYFPSV

SEQ ID NO: 858660 - protein, 9 aa, Homo Sapiens
LRTLSLVLV

SEQ ID NO: 858661 - protein, 9 aa, Homo Sapiens
VLVLSFFYH

SEQ ID NO: 858662 - protein, 9 aa, Homo Sapiens
ENYFTLDAD

SEQ ID NO: 858663 - protein, 9 aa, Homo Sapiens
KIIENAAPS

SEQ ID NO: 858664 - protein, 9 aa, Homo Sapiens
REKECGDKV

SEQ ID NO: 858665 - protein, 9 aa, Homo Sapiens
ESTGLETTF

SEQ ID NO: 858666 - protein, 9 aa, Homo Sapiens
LHSGMDYTI

SEQ ID NO: 858667 - protein, 9 aa, Homo Sapiens
GVCRLIGVT

SEQ ID NO: 858668 - protein, 9 aa, Homo Sapiens
YKSADHQTL

SEQ ID NO: 858669 - protein, 9 aa, Homo Sapiens
FVCAFFKAL

SEQ ID NO: 858670 - protein, 9 aa, Homo Sapiens
TKDTPIKIT

SEQ ID NO: 858671 - protein, 9 aa, Homo Sapiens
VAHKPLNDR

SEQ ID NO: 858672 - protein, 9 aa, Homo Sapiens
LVLSVPLNT

SEQ ID NO: 858673 - protein, 9 aa, Homo Sapiens
SETDFVAKF

SEQ ID NO: 858674 - protein, 9 aa, Homo Sapiens
KKMKEKAKK

SEQ ID NO: 858675 - protein, 9 aa, Homo Sapiens
EEKNSSKCE

SEQ ID NO: 858676 - protein, 9 aa, Homo Sapiens
STQSHERTG

SEQ ID NO: 858677 - protein, 9 aa, Homo Sapiens
TDGTSELPL

SEQ ID NO: 858678 - protein, 9 aa, Homo Sapiens
SVVPKMLIN

SEQ ID NO: 858679 - protein, 9 aa, Homo Sapiens
DITLKGKMR

SEQ ID NO: 858680 - protein, 9 aa, Homo Sapiens
KRDEQRPGN

SEQ ID NO: 858681 - protein, 9 aa, Homo Sapiens
TEQLHRQFA

SEQ ID NO: 858682 - protein, 9 aa, Homo Sapiens
HMQCLEKEE

SEQ ID NO: 858683 - protein, 9 aa, Homo Sapiens
RHSSAKVWS

SEQ ID NO: 858684 - protein, 9 aa, Homo Sapiens
PKAPGFNQR

SEQ ID NO: 858685 - protein, 9 aa, Homo Sapiens
RSLSYNDNC

SEQ ID NO: 858686 - protein, 9 aa, Homo Sapiens
LKPRISFNL

SEQ ID NO: 858687 - protein, 9 aa, Homo Sapiens
LTDIVSFLD

SEQ ID NO: 858688 - protein, 9 aa, Homo Sapiens
DMGTLDKHK

SEQ ID NO: 858689 - protein, 9 aa, Homo Sapiens
PPQKLPSVR

SEQ ID NO: 858690 - protein, 9 aa, Homo Sapiens
NLDYTLSKE

SEQ ID NO: 858691 - protein, 9 aa, Homo Sapiens
DPLPTHFEE

SEQ ID NO: 858692 - protein, 9 aa, Homo Sapiens
QQQQTQMAV

SEQ ID NO: 858693 - protein, 9 aa, Homo Sapiens
DGSPITYEK

SEQ ID NO: 858694 - protein, 9 aa, Homo Sapiens
RQKSKSSQL

SEQ ID NO: 858695 - protein, 9 aa, Homo Sapiens
IHNMGIVHQ

SEQ ID NO: 858696 - protein, 9 aa, Homo Sapiens
IKQMLLNLG

SEQ ID NO: 858697 - protein, 9 aa, Homo Sapiens
ARLRLYTAD

SEQ ID NO: 858698 - protein, 9 aa, Homo Sapiens
FLQDPWNWL

SEQ ID NO: 858699 - protein, 9 aa, Homo Sapiens
NLQIYWLNY

SEQ ID NO: 858700 - protein, 9 aa, Homo Sapiens
GALLYGGPE

SEQ ID NO: 858701 - protein, 9 aa, Homo Sapiens
GSRCCVPVC

SEQ ID NO: 858702 - protein, 9 aa, Homo Sapiens
ACDLSNDAE

SEQ ID NO: 858703 - protein, 9 aa, Homo Sapiens
LPQVIAHLG

SEQ ID NO: 858704 - protein, 9 aa, Homo Sapiens
GEVGNYLGV

SEQ ID NO: 858705 - protein, 9 aa, Homo Sapiens
HRFDNTPEI

SEQ ID NO: 858706 - protein, 9 aa, Homo Sapiens
VDTTNIVLT

SEQ ID NO: 858707 - protein, 9 aa, Homo Sapiens
LWRSAKKYV

SEQ ID NO: 858708 - protein, 9 aa, Homo Sapiens
NLNLNKKVY

SEQ ID NO: 858709 - protein, 9 aa, Homo Sapiens
LTQECGEYL

SEQ ID NO: 858710 - protein, 9 aa, Homo Sapiens
ILQQEIGWF

SEQ ID NO: 858711 - protein, 9 aa, Homo Sapiens
EEACQQNNP

SEQ ID NO: 858712 - protein, 9 aa, Homo Sapiens
MNNNIINTQ

SEQ ID NO: 858713 - protein, 9 aa, Homo Sapiens
VWIGLHYPK

SEQ ID NO: 858714 - protein, 9 aa, Homo Sapiens
VKVDVNKTV

SEQ ID NO: 858715 - protein, 9 aa, Homo Sapiens
VLGLDPNLL

SEQ ID NO: 858716 - protein, 9 aa, Homo Sapiens
IGIIHEKKE

SEQ ID NO: 858717 - protein, 9 aa, Homo Sapiens
YYQILIDKL

SEQ ID NO: 858718 - protein, 9 aa, Homo Sapiens
STIVIGNGT

SEQ ID NO: 858719 - protein, 9 aa, Homo Sapiens
EKALWRLHE

SEQ ID NO: 858720 - protein, 9 aa, Homo Sapiens
AFTSPIPDN

SEQ ID NO: 858721 - protein, 9 aa, Homo Sapiens
DPHLTSVLE

SEQ ID NO: 858722 - protein, 9 aa, Homo Sapiens
LLLVSMYYI

SEQ ID NO: 858723 - protein, 9 aa, Homo Sapiens
LENNLSDRL

SEQ ID NO: 858724 - protein, 9 aa, Homo Sapiens
TVDNTYVFG

SEQ ID NO: 858725 - protein, 9 aa, Homo Sapiens
HPTPIIPAF

SEQ ID NO: 858726 - protein, 9 aa, Homo Sapiens
QQLPKQFLP

SEQ ID NO: 858727 - protein, 9 aa, Homo Sapiens
KIIAYNACV

SEQ ID NO: 858728 - protein, 9 aa, Homo Sapiens
EATGRDRRG

SEQ ID NO: 858729 - protein, 9 aa, Homo Sapiens
CDSINTVLV

SEQ ID NO: 858730 - protein, 9 aa, Homo Sapiens
PLLVSFPEH

SEQ ID NO: 858731 - protein, 9 aa, Homo Sapiens
QITFHAVKK

SEQ ID NO: 858732 - protein, 9 aa, Homo Sapiens
YYIGPGYRV

SEQ ID NO: 858733 - protein, 9 aa, Homo Sapiens
LRGNRATKV

SEQ ID NO: 858734 - protein, 9 aa, Homo Sapiens
QAQQVEEWW

SEQ ID NO: 858735 - protein, 9 aa, Homo Sapiens
SLLRPGTPM

SEQ ID NO: 858736 - protein, 9 aa, Homo Sapiens
YSRKIIHAI

SEQ ID NO: 858737 - protein, 9 aa, Homo Sapiens
FLTDYVNDL

SEQ ID NO: 858738 - protein, 9 aa, Homo Sapiens
GCILCGKAF

SEQ ID NO: 858739 - protein, 9 aa, Homo Sapiens
VSSVTDADA

SEQ ID NO: 858740 - protein, 9 aa, Homo Sapiens
DNSCSHGRI

SEQ ID NO: 858741 - protein, 9 aa, Homo Sapiens
DYILEVVQT

SEQ ID NO: 858742 - protein, 9 aa, Homo Sapiens
NSGEEVVPT

SEQ ID NO: 858743 - protein, 9 aa, Homo Sapiens
NDTKDDIGN

SEQ ID NO: 858744 - protein, 9 aa, Homo Sapiens
VFQFIPYMK

SEQ ID NO: 858745 - protein, 9 aa, Homo Sapiens
HDMGTLDKH

SEQ ID NO: 858746 - protein, 9 aa, Homo Sapiens
TPEYFVRSI

SEQ ID NO: 858747 - protein, 9 aa, Homo Sapiens
LAGVDFELV

SEQ ID NO: 858748 - protein, 9 aa, Homo Sapiens
CTECEQSFS

SEQ ID NO: 858749 - protein, 9 aa, Homo Sapiens
IDNFVPVLV

SEQ ID NO: 858750 - protein, 9 aa, Homo Sapiens
HINLDGYLL

SEQ ID NO: 858751 - protein, 9 aa, Homo Sapiens
VNIKVQELF

SEQ ID NO: 858752 - protein, 9 aa, Homo Sapiens
NNKFSTCRI

SEQ ID NO: 858753 - protein, 9 aa, Homo Sapiens
NGEQGPIWT

SEQ ID NO: 858754 - protein, 9 aa, Homo Sapiens
LCETKLEAI

SEQ ID NO: 858755 - protein, 9 aa, Homo Sapiens
HQIHTQNKI

SEQ ID NO: 858756 - protein, 9 aa, Homo Sapiens
DQMKKFGRI

SEQ ID NO: 858757 - protein, 9 aa, Homo Sapiens
DAKDKVQDE

SEQ ID NO: 858758 - protein, 9 aa, Homo Sapiens
NCCDDSQRV

SEQ ID NO: 858759 - protein, 9 aa, Homo Sapiens
LLIYADIFA

SEQ ID NO: 858760 - protein, 9 aa, Homo Sapiens
HFHSTMFAF

SEQ ID NO: 858761 - protein, 9 aa, Homo Sapiens
ISFAMGAAE

SEQ ID NO: 858762 - protein, 9 aa, Homo Sapiens
LAFIEPPEI

SEQ ID NO: 858763 - protein, 9 aa, Homo Sapiens
ECIAHDAEL

SEQ ID NO: 858764 - protein, 9 aa, Homo Sapiens
FVEFIFHIS

SEQ ID NO: 858765 - protein, 9 aa, Homo Sapiens
KGFYTKKQC

SEQ ID NO: 858766 - protein, 9 aa, Homo Sapiens
KSLEKARKI

SEQ ID NO: 858767 - protein, 9 aa, Homo Sapiens
PDRNMKNVF

SEQ ID NO: 858768 - protein, 9 aa, Homo Sapiens
GIMKDMLYA

SEQ ID NO: 858769 - protein, 9 aa, Homo Sapiens
VFFFVFSIK

SEQ ID NO: 858770 - protein, 9 aa, Homo Sapiens
CSVSDKSND

SEQ ID NO: 858771 - protein, 9 aa, Homo Sapiens
VTTVGKHYR

SEQ ID NO: 858772 - protein, 9 aa, Homo Sapiens
STSPIYHQG

SEQ ID NO: 858773 - protein, 9 aa, Homo Sapiens
KVVQVYRNK

SEQ ID NO: 858774 - protein, 9 aa, Homo Sapiens
FYQEEIQEW

SEQ ID NO: 858775 - protein, 9 aa, Homo Sapiens
FPGDVGAKG

SEQ ID NO: 858776 - protein, 9 aa, Homo Sapiens
PQRSQLQIL

SEQ ID NO: 858777 - protein, 9 aa, Homo Sapiens
KTIKSPSKL

SEQ ID NO: 858778 - protein, 9 aa, Homo Sapiens
NLHLPKMAE

SEQ ID NO: 858779 - protein, 9 aa, Homo Sapiens
LFHLKSYLR

SEQ ID NO: 858780 - protein, 9 aa, Homo Sapiens
MLGKVGITS

SEQ ID NO: 858781 - protein, 9 aa, Homo Sapiens
PRYRVVDSA

SEQ ID NO: 858782 - protein, 9 aa, Homo Sapiens
MPTYCRAPN

SEQ ID NO: 858783 - protein, 9 aa, Homo Sapiens
VPQNLKKEK

SEQ ID NO: 858784 - protein, 9 aa, Homo Sapiens
KNNSYVLSA

SEQ ID NO: 858785 - protein, 9 aa, Homo Sapiens
LHLVLHLRG

SEQ ID NO: 858786 - protein, 9 aa, Homo Sapiens
EHKKIYTGE

SEQ ID NO: 858787 - protein, 9 aa, Homo Sapiens
DIFKQLLWG

SEQ ID NO: 858788 - protein, 9 aa, Homo Sapiens
YPMTDARNN

SEQ ID NO: 858789 - protein, 9 aa, Homo Sapiens
SLTPCLYTF

SEQ ID NO: 858790 - protein, 9 aa, Homo Sapiens
NTLLRNKDS

SEQ ID NO: 858791 - protein, 9 aa, Homo Sapiens
LQDCLFNED

SEQ ID NO: 858792 - protein, 9 aa, Homo Sapiens
GQDPAKRMA

SEQ ID NO: 858793 - protein, 9 aa, Homo Sapiens
AGCLHPWNT

SEQ ID NO: 858794 - protein, 9 aa, Homo Sapiens
NDTHKSIWK

SEQ ID NO: 858795 - protein, 9 aa, Homo Sapiens
VEYIKMADH

SEQ ID NO: 858796 - protein, 9 aa, Homo Sapiens
MGIILYKFL

SEQ ID NO: 858797 - protein, 9 aa, Homo Sapiens
TVTTRFIFL

SEQ ID NO: 858798 - protein, 9 aa, Homo Sapiens
QYHYFKGYF

SEQ ID NO: 858799 - protein, 9 aa, Homo Sapiens
VSLPDAATR

SEQ ID NO: 858800 - protein, 9 aa, Homo Sapiens
VIVGFFQDI

SEQ ID NO: 858801 - protein, 9 aa, Homo Sapiens
PRTPPPTYR

SEQ ID NO: 858802 - protein, 9 aa, Homo Sapiens
KIHTIEELS

SEQ ID NO: 858803 - protein, 9 aa, Homo Sapiens
WKQQNLNKE

SEQ ID NO: 858804 - protein, 9 aa, Homo Sapiens
DGYVPLFDP

SEQ ID NO: 858805 - protein, 9 aa, Homo Sapiens
IKSPDCLAD

SEQ ID NO: 858806 - protein, 9 aa, Homo Sapiens
YRMQLLYCI

SEQ ID NO: 858807 - protein, 9 aa, Homo Sapiens
ALKANSQRP

SEQ ID NO: 858808 - protein, 9 aa, Homo Sapiens
PAEELCNEG

SEQ ID NO: 858809 - protein, 9 aa, Homo Sapiens
GPSRIDHFM

SEQ ID NO: 858810 - protein, 9 aa, Homo Sapiens
AHLEDYEGD

SEQ ID NO: 858811 - protein, 9 aa, Homo Sapiens
ETAQQNNFS

SEQ ID NO: 858812 - protein, 9 aa, Homo Sapiens
KRAKLHEIE

SEQ ID NO: 858813 - protein, 9 aa, Homo Sapiens
KNTILYYEC

SEQ ID NO: 858814 - protein, 9 aa, Homo Sapiens
KLEPPAPQI

SEQ ID NO: 858815 - protein, 9 aa, Homo Sapiens
TFYGPRSEF

SEQ ID NO: 858816 - protein, 9 aa, Homo Sapiens
ICGEGGKNF

SEQ ID NO: 858817 - protein, 9 aa, Homo Sapiens
KNLEVQLCR

SEQ ID NO: 858818 - protein, 9 aa, Homo Sapiens
TEMWKEGNI

SEQ ID NO: 858819 - protein, 9 aa, Homo Sapiens
HDAFNLKRH

SEQ ID NO: 858820 - protein, 9 aa, Homo Sapiens
YSQIVTSAL

SEQ ID NO: 858821 - protein, 9 aa, Homo Sapiens
RTRTGDKLY

SEQ ID NO: 858822 - protein, 9 aa, Homo Sapiens
VQNNTRVIQ

SEQ ID NO: 858823 - protein, 9 aa, Homo Sapiens
SECKSETAA

SEQ ID NO: 858824 - protein, 9 aa, Homo Sapiens
ALKRDLDAQ

SEQ ID NO: 858825 - protein, 9 aa, Homo Sapiens
LASAHFSQP

SEQ ID NO: 858826 - protein, 9 aa, Homo Sapiens
FLCLMESVV

SEQ ID NO: 858827 - protein, 9 aa, Homo Sapiens
LFIPVTLSS

SEQ ID NO: 858828 - protein, 9 aa, Homo Sapiens
ILVLYFTVG

SEQ ID NO: 858829 - protein, 9 aa, Homo Sapiens
RMSPYLVSI

SEQ ID NO: 858830 - protein, 9 aa, Homo Sapiens
DQNCSTITL

SEQ ID NO: 858831 - protein, 9 aa, Homo Sapiens
LHRSPHQAF

SEQ ID NO: 858832 - protein, 9 aa, Homo Sapiens
GQVTGSAWV

SEQ ID NO: 858833 - protein, 9 aa, Homo Sapiens
PQSCPPQHC

SEQ ID NO: 858834 - protein, 9 aa, Homo Sapiens
ENPDFREII

SEQ ID NO: 858835 - protein, 9 aa, Homo Sapiens
PKNNKNKFV

SEQ ID NO: 858836 - protein, 9 aa, Homo Sapiens
TLQCEEFIY

SEQ ID NO: 858837 - protein, 9 aa, Homo Sapiens
GLYVLQVHD

SEQ ID NO: 858838 - protein, 9 aa, Homo Sapiens
VPFHLWIRR

SEQ ID NO: 858839 - protein, 9 aa, Homo Sapiens
ITFEIFHKG

SEQ ID NO: 858840 - protein, 9 aa, Homo Sapiens
QDCLQAAHL

SEQ ID NO: 858841 - protein, 9 aa, Homo Sapiens
ASTVFPIMN

SEQ ID NO: 858842 - protein, 9 aa, Homo Sapiens
WRLHELAEQ

SEQ ID NO: 858843 - protein, 9 aa, Homo Sapiens
DTWQKYYLD

SEQ ID NO: 858844 - protein, 9 aa, Homo Sapiens
HHDKRLNAT

SEQ ID NO: 858845 - protein, 9 aa, Homo Sapiens
SDLYYFRNH

SEQ ID NO: 858846 - protein, 9 aa, Homo Sapiens
SRGDLLKPT

SEQ ID NO: 858847 - protein, 9 aa, Homo Sapiens
LPSLEYLDN

SEQ ID NO: 858848 - protein, 9 aa, Homo Sapiens
SDLNKQVLE

SEQ ID NO: 858849 - protein, 9 aa, Homo Sapiens
RYMTFNVQS

SEQ ID NO: 858850 - protein, 9 aa, Homo Sapiens
MSVCFSACS

SEQ ID NO: 858851 - protein, 9 aa, Homo Sapiens
SLRVKCQGY

SEQ ID NO: 858852 - protein, 9 aa, Homo Sapiens
KEEGAELES

SEQ ID NO: 858853 - protein, 9 aa, Homo Sapiens
DLDESSGVQ

SEQ ID NO: 858854 - protein, 9 aa, Homo Sapiens
NNGTCSPIN

SEQ ID NO: 858855 - protein, 9 aa, Homo Sapiens
GKVKPEQLT

SEQ ID NO: 858856 - protein, 9 aa, Homo Sapiens
CFGAGCGMG

SEQ ID NO: 858857 - protein, 9 aa, Homo Sapiens
AITAQSTFN

SEQ ID NO: 858858 - protein, 9 aa, Homo Sapiens
DLTTVYGLR

SEQ ID NO: 858859 - protein, 9 aa, Homo Sapiens
EYTCAKCEH

SEQ ID NO: 858860 - protein, 9 aa, Homo Sapiens
FVAEFSVSL

SEQ ID NO: 858861 - protein, 9 aa, Homo Sapiens
MLNLIMYSL

SEQ ID NO: 858862 - protein, 9 aa, Homo Sapiens
VGFHTLSFQ

SEQ ID NO: 858863 - protein, 9 aa, Homo Sapiens
LCLMESVVV

SEQ ID NO: 858864 - protein, 9 aa, Homo Sapiens
FNLNEIKIF

SEQ ID NO: 858865 - protein, 9 aa, Homo Sapiens
KIYLSAPAK

SEQ ID NO: 858866 - protein, 9 aa, Homo Sapiens
KLLDYIVKE

SEQ ID NO: 858867 - protein, 9 aa, Homo Sapiens
EMDIYGYNL

SEQ ID NO: 858868 - protein, 9 aa, Homo Sapiens
RETNNLSPK

SEQ ID NO: 858869 - protein, 9 aa, Homo Sapiens
KTVQGIGWY

SEQ ID NO: 858870 - protein, 9 aa, Homo Sapiens
PSRTVASQA

SEQ ID NO: 858871 - protein, 9 aa, Homo Sapiens
LLYLIILVA

SEQ ID NO: 858872 - protein, 9 aa, Homo Sapiens
ENGHFEIST

SEQ ID NO: 858873 - protein, 9 aa, Homo Sapiens
RFFSMVCLS

SEQ ID NO: 858874 - protein, 9 aa, Homo Sapiens
VPSTIVIAC

SEQ ID NO: 858875 - protein, 9 aa, Homo Sapiens
TAKSQFIKH

SEQ ID NO: 858876 - protein, 9 aa, Homo Sapiens
EGHFDGGPV

SEQ ID NO: 858877 - protein, 9 aa, Homo Sapiens
HRCSWLYGV

SEQ ID NO: 858878 - protein, 9 aa, Homo Sapiens
AIMENAVQP

SEQ ID NO: 858879 - protein, 9 aa, Homo Sapiens
DCAIFFCCF

SEQ ID NO: 858880 - protein, 9 aa, Homo Sapiens
IWGPEIETE

SEQ ID NO: 858881 - protein, 9 aa, Homo Sapiens
IKLNYFFVE

SEQ ID NO: 858882 - protein, 9 aa, Homo Sapiens
GPSSRGGSL

SEQ ID NO: 858883 - protein, 9 aa, Homo Sapiens
QKNPTYVGK

SEQ ID NO: 858884 - protein, 9 aa, Homo Sapiens
HVLTYTSKE

SEQ ID NO: 858885 - protein, 9 aa, Homo Sapiens
SVPTGMNPT

SEQ ID NO: 858886 - protein, 9 aa, Homo Sapiens
EFKATMYNV

SEQ ID NO: 858887 - protein, 9 aa, Homo Sapiens
LTDDPVLEN

SEQ ID NO: 858888 - protein, 9 aa, Homo Sapiens
GCKKHLTHC

SEQ ID NO: 858889 - protein, 9 aa, Homo Sapiens
KQSHSEKKA

SEQ ID NO: 858890 - protein, 9 aa, Homo Sapiens
GNKKDGRFT

SEQ ID NO: 858891 - protein, 9 aa, Homo Sapiens
SLESSDDEK

SEQ ID NO: 858892 - protein, 9 aa, Homo Sapiens
TLGTLNKLS

SEQ ID NO: 858893 - protein, 9 aa, Homo Sapiens
MGNFNSIST

SEQ ID NO: 858894 - protein, 9 aa, Homo Sapiens
RNIFVTSYI

SEQ ID NO: 858895 - protein, 9 aa, Homo Sapiens
NFNMSPGFP

SEQ ID NO: 858896 - protein, 9 aa, Homo Sapiens
KVIGSFLTL

SEQ ID NO: 858897 - protein, 9 aa, Homo Sapiens
RWKTIGSLH

SEQ ID NO: 858898 - protein, 9 aa, Homo Sapiens
ARDKHHLTD

SEQ ID NO: 858899 - protein, 9 aa, Homo Sapiens
RDQYLQVQK

SEQ ID NO: 858900 - protein, 9 aa, Homo Sapiens
SGVVSAQRA

SEQ ID NO: 858901 - protein, 9 aa, Homo Sapiens
LARTASTSF

SEQ ID NO: 858902 - protein, 9 aa, Homo Sapiens
PERTDIAQL

SEQ ID NO: 858903 - protein, 9 aa, Homo Sapiens
EEAQLWSES

SEQ ID NO: 858904 - protein, 9 aa, Homo Sapiens
MEKYQESVC

SEQ ID NO: 858905 - protein, 9 aa, Homo Sapiens
GCGLDCLQW

SEQ ID NO: 858906 - protein, 9 aa, Homo Sapiens
EGWEKTKGN

SEQ ID NO: 858907 - protein, 9 aa, Homo Sapiens
SEACLKMKM

SEQ ID NO: 858908 - protein, 9 aa, Homo Sapiens
LHKLEAMMH

SEQ ID NO: 858909 - protein, 9 aa, Homo Sapiens
PENKNYYVG

SEQ ID NO: 858910 - protein, 9 aa, Homo Sapiens
SGDKSFQLP

SEQ ID NO: 858911 - protein, 9 aa, Homo Sapiens
RNHIAASKC

SEQ ID NO: 858912 - protein, 9 aa, Homo Sapiens
HLLCVGAYT

SEQ ID NO: 858913 - protein, 9 aa, Homo Sapiens
VKLVETPRP

SEQ ID NO: 858914 - protein, 9 aa, Homo Sapiens
FQFPLERCR

SEQ ID NO: 858915 - protein, 9 aa, Homo Sapiens
TVTFLGVMA

SEQ ID NO: 858916 - protein, 9 aa, Homo Sapiens
LIKSPDCLA

SEQ ID NO: 858917 - protein, 9 aa, Homo Sapiens
KEFCSYLSQ

SEQ ID NO: 858918 - protein, 9 aa, Homo Sapiens
KIDQSECEG

SEQ ID NO: 858919 - protein, 9 aa, Homo Sapiens
LLVLGMVRV

SEQ ID NO: 858920 - protein, 9 aa, Homo Sapiens
LEECMLTSV

SEQ ID NO: 858921 - protein, 9 aa, Homo Sapiens
YFLRDTCTY

SEQ ID NO: 858922 - protein, 9 aa, Homo Sapiens
TINSVTTDF

SEQ ID NO: 858923 - protein, 9 aa, Homo Sapiens
LLTLIFSYN

SEQ ID NO: 858924 - protein, 9 aa, Homo Sapiens
ILLLLAHII

SEQ ID NO: 858925 - protein, 9 aa, Homo Sapiens
REAFNVYLD

SEQ ID NO: 858926 - protein, 9 aa, Homo Sapiens
RMYKELKQI

SEQ ID NO: 858927 - protein, 9 aa, Homo Sapiens
RADEELLLH

SEQ ID NO: 858928 - protein, 9 aa, Homo Sapiens
LRLQRDQEC

SEQ ID NO: 858929 - protein, 9 aa, Homo Sapiens
EGAASAWGM

SEQ ID NO: 858930 - protein, 9 aa, Homo Sapiens
RASRAIKNT

SEQ ID NO: 858931 - protein, 9 aa, Homo Sapiens
LTRVLVRKL

SEQ ID NO: 858932 - protein, 9 aa, Homo Sapiens
LDEFSFLQD

SEQ ID NO: 858933 - protein, 9 aa, Homo Sapiens
TLVLAPSGG

SEQ ID NO: 858934 - protein, 9 aa, Homo Sapiens
ARKKMNSWV

SEQ ID NO: 858935 - protein, 9 aa, Homo Sapiens
LLLFTTTSV

SEQ ID NO: 858936 - protein, 9 aa, Homo Sapiens
TMVLTMSTI

SEQ ID NO: 858937 - protein, 9 aa, Homo Sapiens
FWGTVRLYN

SEQ ID NO: 858938 - protein, 9 aa, Homo Sapiens
EKVCALQCA

SEQ ID NO: 858939 - protein, 9 aa, Homo Sapiens
TQTYPVGTG

SEQ ID NO: 858940 - protein, 9 aa, Homo Sapiens
YPDLDAVLI

SEQ ID NO: 858941 - protein, 9 aa, Homo Sapiens
ALSHSHCFQ

SEQ ID NO: 858942 - protein, 9 aa, Homo Sapiens
KIQSRETSS

SEQ ID NO: 858943 - protein, 9 aa, Homo Sapiens
VAKTPTNKA

SEQ ID NO: 858944 - protein, 9 aa, Homo Sapiens
PLQPQPQQS

SEQ ID NO: 858945 - protein, 9 aa, Homo Sapiens
IHPPADWQP

SEQ ID NO: 858946 - protein, 9 aa, Homo Sapiens
VDQLSHMCL

SEQ ID NO: 858947 - protein, 9 aa, Homo Sapiens
RLSSSVVDT

SEQ ID NO: 858948 - protein, 9 aa, Homo Sapiens
SGQTGHNYL

SEQ ID NO: 858949 - protein, 9 aa, Homo Sapiens
TDEEEEECI

SEQ ID NO: 858950 - protein, 9 aa, Homo Sapiens
LSDLNCVDF

SEQ ID NO: 858951 - protein, 9 aa, Homo Sapiens
IIGRSFLFI

SEQ ID NO: 858952 - protein, 9 aa, Homo Sapiens
HTINEMYAS

SEQ ID NO: 858953 - protein, 9 aa, Homo Sapiens
TNRIARACG

SEQ ID NO: 858954 - protein, 9 aa, Homo Sapiens
GFRRALQQP

SEQ ID NO: 858955 - protein, 9 aa, Homo Sapiens
LKVQDLSYG

SEQ ID NO: 858956 - protein, 9 aa, Homo Sapiens
VRYRRNVKI

SEQ ID NO: 858957 - protein, 9 aa, Homo Sapiens
IDDISVGKE

SEQ ID NO: 858958 - protein, 9 aa, Homo Sapiens
LSERLIEPK

SEQ ID NO: 858959 - protein, 9 aa, Homo Sapiens
PRNIQGSIV

SEQ ID NO: 858960 - protein, 9 aa, Homo Sapiens
SWQLPRPNV

SEQ ID NO: 858961 - protein, 9 aa, Homo Sapiens
SFDDSFSEA

SEQ ID NO: 858962 - protein, 9 aa, Homo Sapiens
HRLHTQEGA

SEQ ID NO: 858963 - protein, 9 aa, Homo Sapiens
KYPMTDARN

SEQ ID NO: 858964 - protein, 9 aa, Homo Sapiens
CNIGPACWD

SEQ ID NO: 858965 - protein, 9 aa, Homo Sapiens
IELLDSKLS

SEQ ID NO: 858966 - protein, 9 aa, Homo Sapiens
QLIWKKHLF

SEQ ID NO: 858967 - protein, 9 aa, Homo Sapiens
NYTVDKDIC

SEQ ID NO: 858968 - protein, 9 aa, Homo Sapiens
ELIIETQKQ

SEQ ID NO: 858969 - protein, 9 aa, Homo Sapiens
AFNLKRHMR

SEQ ID NO: 858970 - protein, 9 aa, Homo Sapiens
YNSNPAQDL

SEQ ID NO: 858971 - protein, 9 aa, Homo Sapiens
AIIMRHEEN

SEQ ID NO: 858972 - protein, 9 aa, Homo Sapiens
SGSCGPIFQ

SEQ ID NO: 858973 - protein, 9 aa, Homo Sapiens
ESYFDAVFL

SEQ ID NO: 858974 - protein, 9 aa, Homo Sapiens
YLGNKAILY

SEQ ID NO: 858975 - protein, 9 aa, Homo Sapiens
VPLFDPTGT

SEQ ID NO: 858976 - protein, 9 aa, Homo Sapiens
SRLDLTVEH

SEQ ID NO: 858977 - protein, 9 aa, Homo Sapiens
TLGTPQPGV

SEQ ID NO: 858978 - protein, 9 aa, Homo Sapiens
RMQLLYCIA

SEQ ID NO: 858979 - protein, 9 aa, Homo Sapiens
LKNVDVNVK

SEQ ID NO: 858980 - protein, 9 aa, Homo Sapiens
IYKYHVKPL

SEQ ID NO: 858981 - protein, 9 aa, Homo Sapiens
DENIGNISY

SEQ ID NO: 858982 - protein, 9 aa, Homo Sapiens
KIKHCKVKK

SEQ ID NO: 858983 - protein, 9 aa, Homo Sapiens
EKLWDARLC

SEQ ID NO: 858984 - protein, 9 aa, Homo Sapiens
SKHLHNKEN

SEQ ID NO: 858985 - protein, 9 aa, Homo Sapiens
FQSRVMNVH

SEQ ID NO: 858986 - protein, 9 aa, Homo Sapiens
ATNYSHTDA

SEQ ID NO: 858987 - protein, 9 aa, Homo Sapiens
IYFKKRLSL

SEQ ID NO: 858988 - protein, 9 aa, Homo Sapiens
KTKFLSQIE

SEQ ID NO: 858989 - protein, 9 aa, Homo Sapiens
KKIVSYQAI

SEQ ID NO: 858990 - protein, 9 aa, Homo Sapiens
IEINVSDCR

SEQ ID NO: 858991 - protein, 9 aa, Homo Sapiens
VAKLADTMR

SEQ ID NO: 858992 - protein, 9 aa, Homo Sapiens
KLEQVEGGA

SEQ ID NO: 858993 - protein, 9 aa, Homo Sapiens
ILGELFTKT

SEQ ID NO: 858994 - protein, 9 aa, Homo Sapiens
ATNKTGQNY

SEQ ID NO: 858995 - protein, 9 aa, Homo Sapiens
QISDAHLAD

SEQ ID NO: 858996 - protein, 9 aa, Homo Sapiens
VSSAEKLSH

SEQ ID NO: 858997 - protein, 9 aa, Homo Sapiens
VFWHKEMVL

SEQ ID NO: 858998 - protein, 9 aa, Homo Sapiens
QNTVASLHV

SEQ ID NO: 858999 - protein, 9 aa, Homo Sapiens
VENLFCFLT

SEQ ID NO: 859000 - protein, 9 aa, Homo Sapiens
RAFPVFLGT

SEQ ID NO: 859001 - protein, 9 aa, Homo Sapiens
TPSNKLAIV

SEQ ID NO: 859002 - protein, 9 aa, Homo Sapiens
AKNSVGSLP

SEQ ID NO: 859003 - protein, 9 aa, Homo Sapiens
IDQSLSADE

SEQ ID NO: 859004 - protein, 9 aa, Homo Sapiens
INYIIVIFV

SEQ ID NO: 859005 - protein, 9 aa, Homo Sapiens
DFNSIFSNM

SEQ ID NO: 859006 - protein, 9 aa, Homo Sapiens
IVYDLIDLM

SEQ ID NO: 859007 - protein, 9 aa, Homo Sapiens
QNPNFPRRS

SEQ ID NO: 859008 - protein, 9 aa, Homo Sapiens
ITKDIMKIL

SEQ ID NO: 859009 - protein, 9 aa, Homo Sapiens
IITAESLFY

SEQ ID NO: 859010 - protein, 9 aa, Homo Sapiens
ILDELVQIG

SEQ ID NO: 859011 - protein, 9 aa, Homo Sapiens
TSGSEKKKK

SEQ ID NO: 859012 - protein, 9 aa, Homo Sapiens
VRKNHCSRL

SEQ ID NO: 859013 - protein, 9 aa, Homo Sapiens
QQIGDSSEE

SEQ ID NO: 859014 - protein, 9 aa, Homo Sapiens
ASKGQECLK

SEQ ID NO: 859015 - protein, 9 aa, Homo Sapiens
RVIKGQTYE

SEQ ID NO: 859016 - protein, 9 aa, Homo Sapiens
SCFRGKLLL

SEQ ID NO: 859017 - protein, 9 aa, Homo Sapiens
YKENKTKEN

SEQ ID NO: 859018 - protein, 9 aa, Homo Sapiens
TTSVPIEVA

SEQ ID NO: 859019 - protein, 9 aa, Homo Sapiens
KSQTIQNVV

SEQ ID NO: 859020 - protein, 9 aa, Homo Sapiens
KGEEQNNEE

SEQ ID NO: 859021 - protein, 9 aa, Homo Sapiens
GSVVINEDI

SEQ ID NO: 859022 - protein, 9 aa, Homo Sapiens
EEIDTVLPN

SEQ ID NO: 859023 - protein, 9 aa, Homo Sapiens
FATENDFKA

SEQ ID NO: 859024 - protein, 9 aa, Homo Sapiens
QLEKMAVEG

SEQ ID NO: 859025 - protein, 9 aa, Homo Sapiens
LPTKVAKAC

SEQ ID NO: 859026 - protein, 9 aa, Homo Sapiens
GAARGTNDE

SEQ ID NO: 859027 - protein, 9 aa, Homo Sapiens
MFKDLKLRG

SEQ ID NO: 859028 - protein, 9 aa, Homo Sapiens
ARTGAVDSV

SEQ ID NO: 859029 - protein, 9 aa, Homo Sapiens
TEPVATWQI

SEQ ID NO: 859030 - protein, 9 aa, Homo Sapiens
VGRDKKLAL

SEQ ID NO: 859031 - protein, 9 aa, Homo Sapiens
IIKVLDVND

SEQ ID NO: 859032 - protein, 9 aa, Homo Sapiens
IFWKNLAVL

SEQ ID NO: 859033 - protein, 9 aa, Homo Sapiens
MEAIIMRHE

SEQ ID NO: 859034 - protein, 9 aa, Homo Sapiens
LTQMTRCPE

SEQ ID NO: 859035 - protein, 9 aa, Homo Sapiens
EDARLFTSV

SEQ ID NO: 859036 - protein, 9 aa, Homo Sapiens
VLFTGFKPV

SEQ ID NO: 859037 - protein, 9 aa, Homo Sapiens
ENSSQSKTY

SEQ ID NO: 859038 - protein, 9 aa, Homo Sapiens
KLRFHQIIH

SEQ ID NO: 859039 - protein, 9 aa, Homo Sapiens
AELQWLLSK

SEQ ID NO: 859040 - protein, 9 aa, Homo Sapiens
TPNWYFHNH

SEQ ID NO: 859041 - protein, 9 aa, Homo Sapiens
IPSKFPNNN

SEQ ID NO: 859042 - protein, 9 aa, Homo Sapiens
EDRTLTSFG

SEQ ID NO: 859043 - protein, 9 aa, Homo Sapiens
AACLVIIFI

SEQ ID NO: 859044 - protein, 9 aa, Homo Sapiens
RLRFPGIRP

SEQ ID NO: 859045 - protein, 9 aa, Homo Sapiens
SGKPSTKKV

SEQ ID NO: 859046 - protein, 9 aa, Homo Sapiens
QVQDCHVLT

SEQ ID NO: 859047 - protein, 9 aa, Homo Sapiens
VPRGLREQL

SEQ ID NO: 859048 - protein, 9 aa, Homo Sapiens
LSTFCGRPC

SEQ ID NO: 859049 - protein, 9 aa, Homo Sapiens
TQGQVTGSA

SEQ ID NO: 859050 - protein, 9 aa, Homo Sapiens
HLTSVLERL

SEQ ID NO: 859051 - protein, 9 aa, Homo Sapiens
TWSNTHDFT

SEQ ID NO: 859052 - protein, 9 aa, Homo Sapiens
LLTSDGRIT

SEQ ID NO: 859053 - protein, 9 aa, Homo Sapiens
DCSWKITLP

SEQ ID NO: 859054 - protein, 9 aa, Homo Sapiens
VNTVNKDAF

SEQ ID NO: 859055 - protein, 9 aa, Homo Sapiens
SFKRSFLEN

SEQ ID NO: 859056 - protein, 9 aa, Homo Sapiens
EELTWENFH

SEQ ID NO: 859057 - protein, 9 aa, Homo Sapiens
RVNNVNEFA

SEQ ID NO: 859058 - protein, 9 aa, Homo Sapiens
DNTTTKGTP

SEQ ID NO: 859059 - protein, 9 aa, Homo Sapiens
TTPRLTISE

SEQ ID NO: 859060 - protein, 9 aa, Homo Sapiens
LCARRITRV

SEQ ID NO: 859061 - protein, 9 aa, Homo Sapiens
DELLCAVCY

SEQ ID NO: 859062 - protein, 9 aa, Homo Sapiens
IDLPPSRNW

SEQ ID NO: 859063 - protein, 9 aa, Homo Sapiens
LAVCQQRIQ

SEQ ID NO: 859064 - protein, 9 aa, Homo Sapiens
AETVKNRMG

SEQ ID NO: 859065 - protein, 9 aa, Homo Sapiens
FEDLIKYLR

SEQ ID NO: 859066 - protein, 9 aa, Homo Sapiens
KACSCQRCT

SEQ ID NO: 859067 - protein, 9 aa, Homo Sapiens
CLGNKCVLN

SEQ ID NO: 859068 - protein, 9 aa, Homo Sapiens
LHDYVNVPT

SEQ ID NO: 859069 - protein, 9 aa, Homo Sapiens
NIVLTGTKD

SEQ ID NO: 859070 - protein, 9 aa, Homo Sapiens
RIDITTKLC

SEQ ID NO: 859071 - protein, 9 aa, Homo Sapiens
AILVIQVIV

SEQ ID NO: 859072 - protein, 9 aa, Homo Sapiens
IVHEEAAVY

SEQ ID NO: 859073 - protein, 9 aa, Homo Sapiens
ELAEVLGRC

SEQ ID NO: 859074 - protein, 9 aa, Homo Sapiens
RGYVVLLES

SEQ ID NO: 859075 - protein, 9 aa, Homo Sapiens
QRLPPPLPP

SEQ ID NO: 859076 - protein, 9 aa, Homo Sapiens
SDPLAWGEN

SEQ ID NO: 859077 - protein, 9 aa, Homo Sapiens
TGVDTTNIV

SEQ ID NO: 859078 - protein, 9 aa, Homo Sapiens
IGYKNFNNF

SEQ ID NO: 859079 - protein, 9 aa, Homo Sapiens
NSTPRLATA

SEQ ID NO: 859080 - protein, 9 aa, Homo Sapiens
ENEVNNEAV

SEQ ID NO: 859081 - protein, 9 aa, Homo Sapiens
PYFLYLEVA

SEQ ID NO: 859082 - protein, 9 aa, Homo Sapiens
DGAHWQELT

SEQ ID NO: 859083 - protein, 9 aa, Homo Sapiens
ADLVYSFHG

SEQ ID NO: 859084 - protein, 9 aa, Homo Sapiens
IHQYPGVCY

SEQ ID NO: 859085 - protein, 9 aa, Homo Sapiens
DKDNNGRLD

SEQ ID NO: 859086 - protein, 9 aa, Homo Sapiens
TMIYFVGCF

SEQ ID NO: 859087 - protein, 9 aa, Homo Sapiens
GLNELSEYV

SEQ ID NO: 859088 - protein, 9 aa, Homo Sapiens
ISAANRNDP

SEQ ID NO: 859089 - protein, 9 aa, Homo Sapiens
QGTRLAAEG

SEQ ID NO: 859090 - protein, 9 aa, Homo Sapiens
DHAEVVFTA

SEQ ID NO: 859091 - protein, 9 aa, Homo Sapiens
PVCSCVHGV

SEQ ID NO: 859092 - protein, 9 aa, Homo Sapiens
VQICLALSL

SEQ ID NO: 859093 - protein, 9 aa, Homo Sapiens
DSQNAQGYA

SEQ ID NO: 859094 - protein, 9 aa, Homo Sapiens
LEEEEGLVC

SEQ ID NO: 859095 - protein, 9 aa, Homo Sapiens
QEWDEKIEE

SEQ ID NO: 859096 - protein, 9 aa, Homo Sapiens
GRSWLLSPG

SEQ ID NO: 859097 - protein, 9 aa, Homo Sapiens
LEYKLYGGK

SEQ ID NO: 859098 - protein, 9 aa, Homo Sapiens
SLMVHQITH

SEQ ID NO: 859099 - protein, 9 aa, Homo Sapiens
LLIWDNKDY

SEQ ID NO: 859100 - protein, 9 aa, Homo Sapiens
TNFTKLENK

SEQ ID NO: 859101 - protein, 9 aa, Homo Sapiens
FRTTYFCRD

SEQ ID NO: 859102 - protein, 9 aa, Homo Sapiens
LCLQLQRKS

SEQ ID NO: 859103 - protein, 9 aa, Homo Sapiens
FRSCTIRTR

SEQ ID NO: 859104 - protein, 9 aa, Homo Sapiens
DDWKYVVMV

SEQ ID NO: 859105 - protein, 9 aa, Homo Sapiens
PSAKDDVEE

SEQ ID NO: 859106 - protein, 9 aa, Homo Sapiens
YYMLNLKKL

SEQ ID NO: 859107 - protein, 9 aa, Homo Sapiens
ILVLISICW

SEQ ID NO: 859108 - protein, 9 aa, Homo Sapiens
KICIIGPPA

SEQ ID NO: 859109 - protein, 9 aa, Homo Sapiens
FQDAVAFED

SEQ ID NO: 859110 - protein, 9 aa, Homo Sapiens
IQHKIIHTG

SEQ ID NO: 859111 - protein, 9 aa, Homo Sapiens
KEIYSKEEK

SEQ ID NO: 859112 - protein, 9 aa, Homo Sapiens
LLEVNRSPS

SEQ ID NO: 859113 - protein, 9 aa, Homo Sapiens
SPVYPKCLF

SEQ ID NO: 859114 - protein, 9 aa, Homo Sapiens
IRAEYFKGL

SEQ ID NO: 859115 - protein, 9 aa, Homo Sapiens
WCVLLCVSL

SEQ ID NO: 859116 - protein, 9 aa, Homo Sapiens
DKSLNLASD

SEQ ID NO: 859117 - protein, 9 aa, Homo Sapiens
GCTLAQWPH

SEQ ID NO: 859118 - protein, 9 aa, Homo Sapiens
VDNECSGVR

SEQ ID NO: 859119 - protein, 9 aa, Homo Sapiens
FYQIRGEIG

SEQ ID NO: 859120 - protein, 9 aa, Homo Sapiens
VISGVGKLD

SEQ ID NO: 859121 - protein, 9 aa, Homo Sapiens
LYGLTKAIA

SEQ ID NO: 859122 - protein, 9 aa, Homo Sapiens
VVTDHLIYP

SEQ ID NO: 859123 - protein, 9 aa, Homo Sapiens
IDLNQTKLE

SEQ ID NO: 859124 - protein, 9 aa, Homo Sapiens
AFRNNYLKP

SEQ ID NO: 859125 - protein, 9 aa, Homo Sapiens
LKLISIWNR

SEQ ID NO: 859126 - protein, 9 aa, Homo Sapiens
YKSPTLITV

SEQ ID NO: 859127 - protein, 9 aa, Homo Sapiens
GKTYIGPCG

SEQ ID NO: 859128 - protein, 9 aa, Homo Sapiens
RHFVAHKYK

SEQ ID NO: 859129 - protein, 9 aa, Homo Sapiens
GGFDLYFVL

SEQ ID NO: 859130 - protein, 9 aa, Homo Sapiens
KQLLFSDNA

SEQ ID NO: 859131 - protein, 9 aa, Homo Sapiens
DPENIEERK

SEQ ID NO: 859132 - protein, 9 aa, Homo Sapiens
LPRPAFSLM

SEQ ID NO: 859133 - protein, 9 aa, Homo Sapiens
GVKKIKWIY

SEQ ID NO: 859134 - protein, 9 aa, Homo Sapiens
RGWNKFYAV

SEQ ID NO: 859135 - protein, 9 aa, Homo Sapiens
GDGIGNACD

SEQ ID NO: 859136 - protein, 9 aa, Homo Sapiens
AMYVRQTAL

SEQ ID NO: 859137 - protein, 9 aa, Homo Sapiens
LSELLGTFI

SEQ ID NO: 859138 - protein, 9 aa, Homo Sapiens
SRENNKPHT

SEQ ID NO: 859139 - protein, 9 aa, Homo Sapiens
VGIYQQKFI

SEQ ID NO: 859140 - protein, 9 aa, Homo Sapiens
SDMPEEMCV

SEQ ID NO: 859141 - protein, 9 aa, Homo Sapiens
DQQYQAIET

SEQ ID NO: 859142 - protein, 9 aa, Homo Sapiens
EDLKANVEY

SEQ ID NO: 859143 - protein, 9 aa, Homo Sapiens
LGYVNYLIN

SEQ ID NO: 859144 - protein, 9 aa, Homo Sapiens
RWGHRFNDV

SEQ ID NO: 859145 - protein, 9 aa, Homo Sapiens
VVQIIVWGD

SEQ ID NO: 859146 - protein, 9 aa, Homo Sapiens
ISTDNFFLG

SEQ ID NO: 859147 - protein, 9 aa, Homo Sapiens
LQEELKIKC

SEQ ID NO: 859148 - protein, 9 aa, Homo Sapiens
TSLSKLCSK

SEQ ID NO: 859149 - protein, 9 aa, Homo Sapiens
DVYAGICLN

SEQ ID NO: 859150 - protein, 9 aa, Homo Sapiens
VFLSVCHLF

SEQ ID NO: 859151 - protein, 9 aa, Homo Sapiens
ISGGFDEPS

SEQ ID NO: 859152 - protein, 9 aa, Homo Sapiens
FLCDIPAVL

SEQ ID NO: 859153 - protein, 9 aa, Homo Sapiens
GFGVFNALD

SEQ ID NO: 859154 - protein, 9 aa, Homo Sapiens
PAFPGLIFA

SEQ ID NO: 859155 - protein, 9 aa, Homo Sapiens
AIKFAYLGR

SEQ ID NO: 859156 - protein, 9 aa, Homo Sapiens
YRGNSLALL

SEQ ID NO: 859157 - protein, 9 aa, Homo Sapiens
CEGEEPKLD

SEQ ID NO: 859158 - protein, 9 aa, Homo Sapiens
NVLLIQTSI

SEQ ID NO: 859159 - protein, 9 aa, Homo Sapiens
GDLSLKEAM

SEQ ID NO: 859160 - protein, 9 aa, Homo Sapiens
CVYEQKLNE

SEQ ID NO: 859161 - protein, 9 aa, Homo Sapiens
ALSIVIIIL

SEQ ID NO: 859162 - protein, 9 aa, Homo Sapiens
VKDLMLRSL

SEQ ID NO: 859163 - protein, 9 aa, Homo Sapiens
QNLSKIETL

SEQ ID NO: 859164 - protein, 9 aa, Homo Sapiens
QVAFTTKIY

SEQ ID NO: 859165 - protein, 9 aa, Homo Sapiens
GKELSGNPI

SEQ ID NO: 859166 - protein, 9 aa, Homo Sapiens
RKFDLHLYV

SEQ ID NO: 859167 - protein, 9 aa, Homo Sapiens
THRPPALAR

SEQ ID NO: 859168 - protein, 9 aa, Homo Sapiens
LDLLLLGLI

SEQ ID NO: 859169 - protein, 9 aa, Homo Sapiens
EKLDQIGSY

SEQ ID NO: 859170 - protein, 9 aa, Homo Sapiens
IQSGKHFIN

SEQ ID NO: 859171 - protein, 9 aa, Homo Sapiens
LWSESFDEL

SEQ ID NO: 859172 - protein, 9 aa, Homo Sapiens
YFKQFCITC

SEQ ID NO: 859173 - protein, 9 aa, Homo Sapiens
KFWSSPSDS

SEQ ID NO: 859174 - protein, 9 aa, Homo Sapiens
EEYNEVEIE

SEQ ID NO: 859175 - protein, 9 aa, Homo Sapiens
ENEGKLKRE

SEQ ID NO: 859176 - protein, 9 aa, Homo Sapiens
EPSAKHEYK

SEQ ID NO: 859177 - protein, 9 aa, Homo Sapiens
QKPGDRVVK

SEQ ID NO: 859178 - protein, 9 aa, Homo Sapiens
PAIIQAFKV

SEQ ID NO: 859179 - protein, 9 aa, Homo Sapiens
LAQASAVNP

SEQ ID NO: 859180 - protein, 9 aa, Homo Sapiens
FIKTTMPES

SEQ ID NO: 859181 - protein, 9 aa, Homo Sapiens
SVTWTRPTS

SEQ ID NO: 859182 - protein, 9 aa, Homo Sapiens
VDRGQPLSK

SEQ ID NO: 859183 - protein, 9 aa, Homo Sapiens
NKDNGTGVV

SEQ ID NO: 859184 - protein, 9 aa, Homo Sapiens
CVEDNGNHI

SEQ ID NO: 859185 - protein, 9 aa, Homo Sapiens
LGMQALVEL

SEQ ID NO: 859186 - protein, 9 aa, Homo Sapiens
LLAVFNKAL

SEQ ID NO: 859187 - protein, 9 aa, Homo Sapiens
AVLTAGLSK

SEQ ID NO: 859188 - protein, 9 aa, Homo Sapiens
KRGSQPACL

SEQ ID NO: 859189 - protein, 9 aa, Homo Sapiens
VPYSRDYKI

SEQ ID NO: 859190 - protein, 9 aa, Homo Sapiens
SQWMLSQTG

SEQ ID NO: 859191 - protein, 9 aa, Homo Sapiens
NKILNNLES

SEQ ID NO: 859192 - protein, 9 aa, Homo Sapiens
GDAKTTPPN

SEQ ID NO: 859193 - protein, 9 aa, Homo Sapiens
RWLHSSCYQ

SEQ ID NO: 859194 - protein, 9 aa, Homo Sapiens
HVVYDLSQK

SEQ ID NO: 859195 - protein, 9 aa, Homo Sapiens
CGHKEVDHL

SEQ ID NO: 859196 - protein, 9 aa, Homo Sapiens
IAFELLDKN

SEQ ID NO: 859197 - protein, 9 aa, Homo Sapiens
DESIQRGQF

SEQ ID NO: 859198 - protein, 9 aa, Homo Sapiens
GPLKLRINE

SEQ ID NO: 859199 - protein, 9 aa, Homo Sapiens
KRGVSKLNF

SEQ ID NO: 859200 - protein, 9 aa, Homo Sapiens
STQIKTYYW

SEQ ID NO: 859201 - protein, 9 aa, Homo Sapiens
RPLTAYNHF

SEQ ID NO: 859202 - protein, 9 aa, Homo Sapiens
SGINFLEKR

SEQ ID NO: 859203 - protein, 9 aa, Homo Sapiens
QLKPQTVAT

SEQ ID NO: 859204 - protein, 9 aa, Homo Sapiens
CAYSPGGDW

SEQ ID NO: 859205 - protein, 9 aa, Homo Sapiens
CFPDSDDIK

SEQ ID NO: 859206 - protein, 9 aa, Homo Sapiens
SDPHHCSFS

SEQ ID NO: 859207 - protein, 9 aa, Homo Sapiens
NITTPKTEV

SEQ ID NO: 859208 - protein, 9 aa, Homo Sapiens
EQKKQNKPR

SEQ ID NO: 859209 - protein, 9 aa, Homo Sapiens
LPAVPFEMV

SEQ ID NO: 859210 - protein, 9 aa, Homo Sapiens
QMDKPFLIF

SEQ ID NO: 859211 - protein, 9 aa, Homo Sapiens
VAFSRSKNL

SEQ ID NO: 859212 - protein, 9 aa, Homo Sapiens
QEQRARATL

SEQ ID NO: 859213 - protein, 9 aa, Homo Sapiens
GSGSFNWHQ

SEQ ID NO: 859214 - protein, 9 aa, Homo Sapiens
KDNFWMTQQ

SEQ ID NO: 859215 - protein, 9 aa, Homo Sapiens
SGLCREGDQ

SEQ ID NO: 859216 - protein, 9 aa, Homo Sapiens
KKSSKMVCK

SEQ ID NO: 859217 - protein, 9 aa, Homo Sapiens
YTLDEGLVE

SEQ ID NO: 859218 - protein, 9 aa, Homo Sapiens
FVQAIIVNN

SEQ ID NO: 859219 - protein, 9 aa, Homo Sapiens
MYIQAMEEN

SEQ ID NO: 859220 - protein, 9 aa, Homo Sapiens
FSKMPLHPS

SEQ ID NO: 859221 - protein, 9 aa, Homo Sapiens
RGQIRYNKI

SEQ ID NO: 859222 - protein, 9 aa, Homo Sapiens
KWNYYEGFL

SEQ ID NO: 859223 - protein, 9 aa, Homo Sapiens
FGQLSDVVE

SEQ ID NO: 859224 - protein, 9 aa, Homo Sapiens
GHRSGRSYP

SEQ ID NO: 859225 - protein, 9 aa, Homo Sapiens
SASGEMWRQ

SEQ ID NO: 859226 - protein, 9 aa, Homo Sapiens
TLSLVLVLD

SEQ ID NO: 859227 - protein, 9 aa, Homo Sapiens
LEESRKVFR

SEQ ID NO: 859228 - protein, 9 aa, Homo Sapiens
RYYCCEECT

SEQ ID NO: 859229 - protein, 9 aa, Homo Sapiens
DVKNVLYAW

SEQ ID NO: 859230 - protein, 9 aa, Homo Sapiens
QYSFDKLKL

SEQ ID NO: 859231 - protein, 9 aa, Homo Sapiens
EIENITAPK

SEQ ID NO: 859232 - protein, 9 aa, Homo Sapiens
CQKFEQLSK

SEQ ID NO: 859233 - protein, 9 aa, Homo Sapiens
FYPFPQGPS

SEQ ID NO: 859234 - protein, 9 aa, Homo Sapiens
STVDNTYVF

SEQ ID NO: 859235 - protein, 9 aa, Homo Sapiens
LFEEFYEDH

SEQ ID NO: 859236 - protein, 9 aa, Homo Sapiens
TSSSSPSSV

SEQ ID NO: 859237 - protein, 9 aa, Homo Sapiens
RQSSSQDEE

SEQ ID NO: 859238 - protein, 9 aa, Homo Sapiens
LIESSKVKL

SEQ ID NO: 859239 - protein, 9 aa, Homo Sapiens
SDSAITYHG

SEQ ID NO: 859240 - protein, 9 aa, Homo Sapiens
THKKSKKNK

SEQ ID NO: 859241 - protein, 9 aa, Homo Sapiens
YIPKWEQFI

SEQ ID NO: 859242 - protein, 9 aa, Homo Sapiens
MRDTLEALS

SEQ ID NO: 859243 - protein, 9 aa, Homo Sapiens
YQWLANKDN

SEQ ID NO: 859244 - protein, 9 aa, Homo Sapiens
SFTLALTSR

SEQ ID NO: 859245 - protein, 9 aa, Homo Sapiens
KLWSSVAAP

SEQ ID NO: 859246 - protein, 9 aa, Homo Sapiens
GSACACSLD

SEQ ID NO: 859247 - protein, 9 aa, Homo Sapiens
TDFQVFKQH

SEQ ID NO: 859248 - protein, 9 aa, Homo Sapiens
LMMKTTEHT

SEQ ID NO: 859249 - protein, 9 aa, Homo Sapiens
GAVAAPFIS

SEQ ID NO: 859250 - protein, 9 aa, Homo Sapiens
CCGFVTNRA

SEQ ID NO: 859251 - protein, 9 aa, Homo Sapiens
SSLNLQSRK

SEQ ID NO: 859252 - protein, 9 aa, Homo Sapiens
FPSKHLSWE

SEQ ID NO: 859253 - protein, 9 aa, Homo Sapiens
AYSLLKTDL

SEQ ID NO: 859254 - protein, 9 aa, Homo Sapiens
SRYQHLFEA

SEQ ID NO: 859255 - protein, 9 aa, Homo Sapiens
EQLRDDGCN

SEQ ID NO: 859256 - protein, 9 aa, Homo Sapiens
DVWAFIHYL

SEQ ID NO: 859257 - protein, 9 aa, Homo Sapiens
KFLVGCVPF

SEQ ID NO: 859258 - protein, 9 aa, Homo Sapiens
KNGILPAWC

SEQ ID NO: 859259 - protein, 9 aa, Homo Sapiens
PPKETETSK

SEQ ID NO: 859260 - protein, 9 aa, Homo Sapiens
EKQIDDAMC

SEQ ID NO: 859261 - protein, 9 aa, Homo Sapiens
AIEVIKDTK

SEQ ID NO: 859262 - protein, 9 aa, Homo Sapiens
NNSIKTEPD

SEQ ID NO: 859263 - protein, 9 aa, Homo Sapiens
QQTILDRYY

SEQ ID NO: 859264 - protein, 9 aa, Homo Sapiens
NVKAMDITG

SEQ ID NO: 859265 - protein, 9 aa, Homo Sapiens
TVSYLYDVT

SEQ ID NO: 859266 - protein, 9 aa, Homo Sapiens
CHQLLQGLF

SEQ ID NO: 859267 - protein, 9 aa, Homo Sapiens
GMTSMSLEV

SEQ ID NO: 859268 - protein, 9 aa, Homo Sapiens
SAYQRTYYM

SEQ ID NO: 859269 - protein, 9 aa, Homo Sapiens
AGSQTGRKQ

SEQ ID NO: 859270 - protein, 9 aa, Homo Sapiens
MAQLYYKRN

SEQ ID NO: 859271 - protein, 9 aa, Homo Sapiens
LMSCGASDC

SEQ ID NO: 859272 - protein, 9 aa, Homo Sapiens
ANAVLHKNR

SEQ ID NO: 859273 - protein, 9 aa, Homo Sapiens
KKEVNVYKS

SEQ ID NO: 859274 - protein, 9 aa, Homo Sapiens
DCLADINYE

SEQ ID NO: 859275 - protein, 9 aa, Homo Sapiens
ERLQIVGFD

SEQ ID NO: 859276 - protein, 9 aa, Homo Sapiens
GSCPSEAIR

SEQ ID NO: 859277 - protein, 9 aa, Homo Sapiens
TKVGTEPLR

SEQ ID NO: 859278 - protein, 9 aa, Homo Sapiens
QIFYMFVVE

SEQ ID NO: 859279 - protein, 9 aa, Homo Sapiens
SRHEYLKLD

SEQ ID NO: 859280 - protein, 9 aa, Homo Sapiens
DKTICHYLD

SEQ ID NO: 859281 - protein, 9 aa, Homo Sapiens
AVESRYAFV

SEQ ID NO: 859282 - protein, 9 aa, Homo Sapiens
QQRKSYRRK

SEQ ID NO: 859283 - protein, 9 aa, Homo Sapiens
VKDLCVELE

SEQ ID NO: 859284 - protein, 9 aa, Homo Sapiens
GNIIMEFRH

SEQ ID NO: 859285 - protein, 9 aa, Homo Sapiens
SVGQMFLGG

SEQ ID NO: 859286 - protein, 9 aa, Homo Sapiens
VLFIKKTGQ

SEQ ID NO: 859287 - protein, 9 aa, Homo Sapiens
LQADFNKTE

SEQ ID NO: 859288 - protein, 9 aa, Homo Sapiens
KEQHARKKL

SEQ ID NO: 859289 - protein, 9 aa, Homo Sapiens
EYKKMKEKQ

SEQ ID NO: 859290 - protein, 9 aa, Homo Sapiens
ELVACIDII

SEQ ID NO: 859291 - protein, 9 aa, Homo Sapiens
GFSLFFFTE

SEQ ID NO: 859292 - protein, 9 aa, Homo Sapiens
CFNDNLVSR

SEQ ID NO: 859293 - protein, 9 aa, Homo Sapiens
WDVNKRDSI

SEQ ID NO: 859294 - protein, 9 aa, Homo Sapiens
KVQGPPMLQ

SEQ ID NO: 859295 - protein, 9 aa, Homo Sapiens
VSHSGFSSV

SEQ ID NO: 859296 - protein, 9 aa, Homo Sapiens
ARDFPKDVL

SEQ ID NO: 859297 - protein, 9 aa, Homo Sapiens
KSHKREAVI

SEQ ID NO: 859298 - protein, 9 aa, Homo Sapiens
FAGALAYRN

SEQ ID NO: 859299 - protein, 9 aa, Homo Sapiens
ESVGLALVS

SEQ ID NO: 859300 - protein, 9 aa, Homo Sapiens
HSKLFTVDF

SEQ ID NO: 859301 - protein, 9 aa, Homo Sapiens
DNLHRTFGQ

SEQ ID NO: 859302 - protein, 9 aa, Homo Sapiens
GQTCGICGN

SEQ ID NO: 859303 - protein, 9 aa, Homo Sapiens
ERDVGTNTS

SEQ ID NO: 859304 - protein, 9 aa, Homo Sapiens
SGININAYL

SEQ ID NO: 859305 - protein, 9 aa, Homo Sapiens
GRPSNEELQ

SEQ ID NO: 859306 - protein, 9 aa, Homo Sapiens
AFCMDNILG

SEQ ID NO: 859307 - protein, 9 aa, Homo Sapiens
TSSTSSTKH

SEQ ID NO: 859308 - protein, 9 aa, Homo Sapiens
VFLFTLLSE

SEQ ID NO: 859309 - protein, 9 aa, Homo Sapiens
SFCSVRAIR

SEQ ID NO: 859310 - protein, 9 aa, Homo Sapiens
LTQLVKEDE

SEQ ID NO: 859311 - protein, 9 aa, Homo Sapiens
LDAVRNIRA

SEQ ID NO: 859312 - protein, 9 aa, Homo Sapiens
ILQNVMWFL

SEQ ID NO: 859313 - protein, 9 aa, Homo Sapiens
NKVMGYWYF

SEQ ID NO: 859314 - protein, 9 aa, Homo Sapiens
NHGCQHVKY

SEQ ID NO: 859315 - protein, 9 aa, Homo Sapiens
DEGTIDFIV

SEQ ID NO: 859316 - protein, 9 aa, Homo Sapiens
LDNEDLKLW

SEQ ID NO: 859317 - protein, 9 aa, Homo Sapiens
NDKALKRAV

SEQ ID NO: 859318 - protein, 9 aa, Homo Sapiens
MHLKVLKSL

SEQ ID NO: 859319 - protein, 9 aa, Homo Sapiens
ENPFQCPQC

SEQ ID NO: 859320 - protein, 9 aa, Homo Sapiens
RWIIPASQE

SEQ ID NO: 859321 - protein, 9 aa, Homo Sapiens
PGVSHSGFS

SEQ ID NO: 859322 - protein, 9 aa, Homo Sapiens
GHCFGRQST

SEQ ID NO: 859323 - protein, 9 aa, Homo Sapiens
ITDTGQLHS

SEQ ID NO: 859324 - protein, 9 aa, Homo Sapiens
LPVRGFGWH

SEQ ID NO: 859325 - protein, 9 aa, Homo Sapiens
ENKDVLIEL

SEQ ID NO: 859326 - protein, 9 aa, Homo Sapiens
YQASYNQIF

SEQ ID NO: 859327 - protein, 9 aa, Homo Sapiens
DDGIQKLGV

SEQ ID NO: 859328 - protein, 9 aa, Homo Sapiens
MVILMLNPL

SEQ ID NO: 859329 - protein, 9 aa, Homo Sapiens
IHIYKYQGG

SEQ ID NO: 859330 - protein, 9 aa, Homo Sapiens
RKVCAIYDF

SEQ ID NO: 859331 - protein, 9 aa, Homo Sapiens
DKRDASLKN

SEQ ID NO: 859332 - protein, 9 aa, Homo Sapiens
IRTEQGFYV

SEQ ID NO: 859333 - protein, 9 aa, Homo Sapiens
SPAKTSAVN

SEQ ID NO: 859334 - protein, 9 aa, Homo Sapiens
FIAVEDDNI

SEQ ID NO: 859335 - protein, 9 aa, Homo Sapiens
HILNVEDSN

SEQ ID NO: 859336 - protein, 9 aa, Homo Sapiens
CQGSSQWDG

SEQ ID NO: 859337 - protein, 9 aa, Homo Sapiens
GWHRITIIY

SEQ ID NO: 859338 - protein, 9 aa, Homo Sapiens
RDYPASASR

SEQ ID NO: 859339 - protein, 9 aa, Homo Sapiens
VTELSDQQY

SEQ ID NO: 859340 - protein, 9 aa, Homo Sapiens
SKLDVLLAD

SEQ ID NO: 859341 - protein, 9 aa, Homo Sapiens
SAQRLLQNV

SEQ ID NO: 859342 - protein, 9 aa, Homo Sapiens
LLVATTVEI

SEQ ID NO: 859343 - protein, 9 aa, Homo Sapiens
IWRLICGII

SEQ ID NO: 859344 - protein, 9 aa, Homo Sapiens
CLQYLKMAF

SEQ ID NO: 859345 - protein, 9 aa, Homo Sapiens
CHDCEFHEA

SEQ ID NO: 859346 - protein, 9 aa, Homo Sapiens
CGLEHLRLA

SEQ ID NO: 859347 - protein, 9 aa, Homo Sapiens
CAPFLPESF

SEQ ID NO: 859348 - protein, 9 aa, Homo Sapiens
ENFENHKKL

SEQ ID NO: 859349 - protein, 9 aa, Homo Sapiens
FSGLFAIIV

SEQ ID NO: 859350 - protein, 9 aa, Homo Sapiens
IVHQITHKG

SEQ ID NO: 859351 - protein, 9 aa, Homo Sapiens
KILLPDNLS

SEQ ID NO: 859352 - protein, 9 aa, Homo Sapiens
YISIGKQEF

SEQ ID NO: 859353 - protein, 9 aa, Homo Sapiens
NILHKALEA

SEQ ID NO: 859354 - protein, 9 aa, Homo Sapiens
EDLIKYLRK

SEQ ID NO: 859355 - protein, 9 aa, Homo Sapiens
KPNNLREEF

SEQ ID NO: 859356 - protein, 9 aa, Homo Sapiens
EAELVGRVE

SEQ ID NO: 859357 - protein, 9 aa, Homo Sapiens
ERKETEFVS

SEQ ID NO: 859358 - protein, 9 aa, Homo Sapiens
MLRANNQLF

SEQ ID NO: 859359 - protein, 9 aa, Homo Sapiens
FSEFVKKCS

SEQ ID NO: 859360 - protein, 9 aa, Homo Sapiens
RKPPNRYLV

SEQ ID NO: 859361 - protein, 9 aa, Homo Sapiens
HFGFEVYPF

SEQ ID NO: 859362 - protein, 9 aa, Homo Sapiens
SLSPPCPYE

SEQ ID NO: 859363 - protein, 9 aa, Homo Sapiens
RAAAAETRE

SEQ ID NO: 859364 - protein, 9 aa, Homo Sapiens
VCLALRIPF

SEQ ID NO: 859365 - protein, 9 aa, Homo Sapiens
SQLTQCYLE

SEQ ID NO: 859366 - protein, 9 aa, Homo Sapiens
DSQFPAWRE

SEQ ID NO: 859367 - protein, 9 aa, Homo Sapiens
RVLFELAHY

SEQ ID NO: 859368 - protein, 9 aa, Homo Sapiens
TTRIRDIAC

SEQ ID NO: 859369 - protein, 9 aa, Homo Sapiens
LEETLHNLQ

SEQ ID NO: 859370 - protein, 9 aa, Homo Sapiens
TEHEKIHPG

SEQ ID NO: 859371 - protein, 9 aa, Homo Sapiens
KYPYFFRTI

SEQ ID NO: 859372 - protein, 9 aa, Homo Sapiens
ASVNKQKHY

SEQ ID NO: 859373 - protein, 9 aa, Homo Sapiens
AFSDLYYFR

SEQ ID NO: 859374 - protein, 9 aa, Homo Sapiens
PVMAQQHHV

SEQ ID NO: 859375 - protein, 9 aa, Homo Sapiens
IHKNLNLVW

SEQ ID NO: 859376 - protein, 9 aa, Homo Sapiens
SLELNIKDL

SEQ ID NO: 859377 - protein, 9 aa, Homo Sapiens
QHNHHVIIS

SEQ ID NO: 859378 - protein, 9 aa, Homo Sapiens
PRCYKEICN

SEQ ID NO: 859379 - protein, 9 aa, Homo Sapiens
VMAIAVNKC

SEQ ID NO: 859380 - protein, 9 aa, Homo Sapiens
IIAVLAAAV

SEQ ID NO: 859381 - protein, 9 aa, Homo Sapiens
GTAWVSEIV

SEQ ID NO: 859382 - protein, 9 aa, Homo Sapiens
DFEQGKLYL

SEQ ID NO: 859383 - protein, 9 aa, Homo Sapiens
KYSSGQSSG

SEQ ID NO: 859384 - protein, 9 aa, Homo Sapiens
RKYYIVENE

SEQ ID NO: 859385 - protein, 9 aa, Homo Sapiens
GLTLLHQAT

SEQ ID NO: 859386 - protein, 9 aa, Homo Sapiens
QHSKLEENH

SEQ ID NO: 859387 - protein, 9 aa, Homo Sapiens
GELMVEKHK

SEQ ID NO: 859388 - protein, 9 aa, Homo Sapiens
MTYFDPDFY

SEQ ID NO: 859389 - protein, 9 aa, Homo Sapiens
TLKEYETVS

SEQ ID NO: 859390 - protein, 9 aa, Homo Sapiens
TALAGTPWP

SEQ ID NO: 859391 - protein, 9 aa, Homo Sapiens
ISHIHYWVF

SEQ ID NO: 859392 - protein, 9 aa, Homo Sapiens
MCLHDYREV

SEQ ID NO: 859393 - protein, 9 aa, Homo Sapiens
VVCYKKCVT

SEQ ID NO: 859394 - protein, 9 aa, Homo Sapiens
IYLITMLEN

SEQ ID NO: 859395 - protein, 9 aa, Homo Sapiens
ASEKSICIT

SEQ ID NO: 859396 - protein, 9 aa, Homo Sapiens
RTTFDSEND

SEQ ID NO: 859397 - protein, 9 aa, Homo Sapiens
LFTTGNSRS

SEQ ID NO: 859398 - protein, 9 aa, Homo Sapiens
QASRLDLDV

SEQ ID NO: 859399 - protein, 9 aa, Homo Sapiens
LFRDMDDEE

SEQ ID NO: 859400 - protein, 9 aa, Homo Sapiens
KVVQIIVWG

SEQ ID NO: 859401 - protein, 9 aa, Homo Sapiens
FFYYLGCHQ

SEQ ID NO: 859402 - protein, 9 aa, Homo Sapiens
IYTLSLERT

SEQ ID NO: 859403 - protein, 9 aa, Homo Sapiens
GPKAGQTVK

SEQ ID NO: 859404 - protein, 9 aa, Homo Sapiens
FYIRANYLQ

SEQ ID NO: 859405 - protein, 9 aa, Homo Sapiens
NSHPVKPSI

SEQ ID NO: 859406 - protein, 9 aa, Homo Sapiens
RKVSRKRSS

SEQ ID NO: 859407 - protein, 9 aa, Homo Sapiens
RESCWDEYN

SEQ ID NO: 859408 - protein, 9 aa, Homo Sapiens
FMTSRKMIP

SEQ ID NO: 859409 - protein, 9 aa, Homo Sapiens
RAAFSLIQD

SEQ ID NO: 859410 - protein, 9 aa, Homo Sapiens
KKTRSKAKQ

SEQ ID NO: 859411 - protein, 9 aa, Homo Sapiens
IKCDKYILS

SEQ ID NO: 859412 - protein, 9 aa, Homo Sapiens
TCHARDKDK

SEQ ID NO: 859413 - protein, 9 aa, Homo Sapiens
VMEAIIMRH

SEQ ID NO: 859414 - protein, 9 aa, Homo Sapiens
RGNAIYGLI

SEQ ID NO: 859415 - protein, 9 aa, Homo Sapiens
KDAERRYLT

SEQ ID NO: 859416 - protein, 9 aa, Homo Sapiens
VKDTHKKSK

SEQ ID NO: 859417 - protein, 9 aa, Homo Sapiens
CVGEIITQM

SEQ ID NO: 859418 - protein, 9 aa, Homo Sapiens
ARINLAAAA

SEQ ID NO: 859419 - protein, 9 aa, Homo Sapiens
KLWSWGQNE

SEQ ID NO: 859420 - protein, 9 aa, Homo Sapiens
NQLLRGNRA

SEQ ID NO: 859421 - protein, 9 aa, Homo Sapiens
PEKEMLCLE

SEQ ID NO: 859422 - protein, 9 aa, Homo Sapiens
SEEKANGPE

SEQ ID NO: 859423 - protein, 9 aa, Homo Sapiens
WYHCFRPIL

SEQ ID NO: 859424 - protein, 9 aa, Homo Sapiens
IRKGHMEYL

SEQ ID NO: 859425 - protein, 9 aa, Homo Sapiens
CLALPVKLA

SEQ ID NO: 859426 - protein, 9 aa, Homo Sapiens
KKPTLLNLK

SEQ ID NO: 859427 - protein, 9 aa, Homo Sapiens
LTLDNFYSN

SEQ ID NO: 859428 - protein, 9 aa, Homo Sapiens
YFQSAAIQS

SEQ ID NO: 859429 - protein, 9 aa, Homo Sapiens
LLMGVALGQ

SEQ ID NO: 859430 - protein, 9 aa, Homo Sapiens
AESEDEEED

SEQ ID NO: 859431 - protein, 9 aa, Homo Sapiens
MSQKFQQCY

SEQ ID NO: 859432 - protein, 9 aa, Homo Sapiens
TKKRKQSEY

SEQ ID NO: 859433 - protein, 9 aa, Homo Sapiens
PVSNQKPGT

SEQ ID NO: 859434 - protein, 9 aa, Homo Sapiens
RKALYEQSL

SEQ ID NO: 859435 - protein, 9 aa, Homo Sapiens
TLEVIYPQL

SEQ ID NO: 859436 - protein, 9 aa, Homo Sapiens
QLDTFIDQL

SEQ ID NO: 859437 - protein, 9 aa, Homo Sapiens
LPCHRILHS

SEQ ID NO: 859438 - protein, 9 aa, Homo Sapiens
VYPHNPWLQ

SEQ ID NO: 859439 - protein, 9 aa, Homo Sapiens
QLKITAGLE

SEQ ID NO: 859440 - protein, 9 aa, Homo Sapiens
QVARSRELN

SEQ ID NO: 859441 - protein, 9 aa, Homo Sapiens
AACFVNKQH

SEQ ID NO: 859442 - protein, 9 aa, Homo Sapiens
DMEESIQRI

SEQ ID NO: 859443 - protein, 9 aa, Homo Sapiens
TRSRGVLLG

SEQ ID NO: 859444 - protein, 9 aa, Homo Sapiens
QVHDNNIPG

SEQ ID NO: 859445 - protein, 9 aa, Homo Sapiens
RRSKNKIAA

SEQ ID NO: 859446 - protein, 9 aa, Homo Sapiens
YLPGQMAGT

SEQ ID NO: 859447 - protein, 9 aa, Homo Sapiens
LNARQVVCD

SEQ ID NO: 859448 - protein, 9 aa, Homo Sapiens
LVVLDTDAE

SEQ ID NO: 859449 - protein, 9 aa, Homo Sapiens
ENGKGRCPF

SEQ ID NO: 859450 - protein, 9 aa, Homo Sapiens
ALFIFFLAI

SEQ ID NO: 859451 - protein, 9 aa, Homo Sapiens
LFHPFNQKF

SEQ ID NO: 859452 - protein, 9 aa, Homo Sapiens
YIEDFDGRP

SEQ ID NO: 859453 - protein, 9 aa, Homo Sapiens
ITPEALICS

SEQ ID NO: 859454 - protein, 9 aa, Homo Sapiens
VFSSLQRKG

SEQ ID NO: 859455 - protein, 9 aa, Homo Sapiens
FKSTRNYAK

SEQ ID NO: 859456 - protein, 9 aa, Homo Sapiens
CYALVTSFM

SEQ ID NO: 859457 - protein, 9 aa, Homo Sapiens
MEKFLTDYV

SEQ ID NO: 859458 - protein, 9 aa, Homo Sapiens
YLPIIVLLM

SEQ ID NO: 859459 - protein, 9 aa, Homo Sapiens
ILAWISQVL

SEQ ID NO: 859460 - protein, 9 aa, Homo Sapiens
TEDYAGIYR

SEQ ID NO: 859461 - protein, 9 aa, Homo Sapiens
PPKKRQNGH

SEQ ID NO: 859462 - protein, 9 aa, Homo Sapiens
FTSGNLERD

SEQ ID NO: 859463 - protein, 9 aa, Homo Sapiens
RAYTSPLIN

SEQ ID NO: 859464 - protein, 9 aa, Homo Sapiens
FITFMYFKP

SEQ ID NO: 859465 - protein, 9 aa, Homo Sapiens
SQIQPIIAV

SEQ ID NO: 859466 - protein, 9 aa, Homo Sapiens
RARMHERIV

SEQ ID NO: 859467 - protein, 9 aa, Homo Sapiens
ELPEKIDVV

SEQ ID NO: 859468 - protein, 9 aa, Homo Sapiens
HSFEVYDPL

SEQ ID NO: 859469 - protein, 9 aa, Homo Sapiens
FKEKSCSVL

SEQ ID NO: 859470 - protein, 9 aa, Homo Sapiens
ALEANGACN

SEQ ID NO: 859471 - protein, 9 aa, Homo Sapiens
NRRFHCPIY

SEQ ID NO: 859472 - protein, 9 aa, Homo Sapiens
HTENKSHEC

SEQ ID NO: 859473 - protein, 9 aa, Homo Sapiens
PKGNDGKLG

SEQ ID NO: 859474 - protein, 9 aa, Homo Sapiens
SFLQDPWNW

SEQ ID NO: 859475 - protein, 9 aa, Homo Sapiens
HCTVHITDL

SEQ ID NO: 859476 - protein, 9 aa, Homo Sapiens
QIPLGSVVI

SEQ ID NO: 859477 - protein, 9 aa, Homo Sapiens
LLYLVKLES

SEQ ID NO: 859478 - protein, 9 aa, Homo Sapiens
AALGQMLGG

SEQ ID NO: 859479 - protein, 9 aa, Homo Sapiens
SEPIKGHED

SEQ ID NO: 859480 - protein, 9 aa, Homo Sapiens
TLKAIPVAN

SEQ ID NO: 859481 - protein, 9 aa, Homo Sapiens
MRQLFQDYE

SEQ ID NO: 859482 - protein, 9 aa, Homo Sapiens
EPQTLVTPA

SEQ ID NO: 859483 - protein, 9 aa, Homo Sapiens
TVWYFPSTA

SEQ ID NO: 859484 - protein, 9 aa, Homo Sapiens
LDQEAEENS

SEQ ID NO: 859485 - protein, 9 aa, Homo Sapiens
FRTTTTAGV

SEQ ID NO: 859486 - protein, 9 aa, Homo Sapiens
GFFDLLSQF

SEQ ID NO: 859487 - protein, 9 aa, Homo Sapiens
HKLCDIILR

SEQ ID NO: 859488 - protein, 9 aa, Homo Sapiens
APCLLLIKC

SEQ ID NO: 859489 - protein, 9 aa, Homo Sapiens
PTNVLEIMK

SEQ ID NO: 859490 - protein, 9 aa, Homo Sapiens
SVDTGGDGE

SEQ ID NO: 859491 - protein, 9 aa, Homo Sapiens
FLTGLGHIS

SEQ ID NO: 859492 - protein, 9 aa, Homo Sapiens
GFGKSGELL

SEQ ID NO: 859493 - protein, 9 aa, Homo Sapiens
SVPESPKFV

SEQ ID NO: 859494 - protein, 9 aa, Homo Sapiens
QPSAELFPI

SEQ ID NO: 859495 - protein, 9 aa, Homo Sapiens
KRKQLLVAM

SEQ ID NO: 859496 - protein, 9 aa, Homo Sapiens
MDKLQNASW

SEQ ID NO: 859497 - protein, 9 aa, Homo Sapiens
VTWTRPTSH

SEQ ID NO: 859498 - protein, 9 aa, Homo Sapiens
QRSYSWFQD

SEQ ID NO: 859499 - protein, 9 aa, Homo Sapiens
TLDNLILNE

SEQ ID NO: 859500 - protein, 9 aa, Homo Sapiens
SGSRPDGCN

SEQ ID NO: 859501 - protein, 9 aa, Homo Sapiens
LSSLLGGFQ

SEQ ID NO: 859502 - protein, 9 aa, Homo Sapiens
IVKHLRLSL

SEQ ID NO: 859503 - protein, 9 aa, Homo Sapiens
RKKTMEMTT

SEQ ID NO: 859504 - protein, 9 aa, Homo Sapiens
IPQIRIETR

SEQ ID NO: 859505 - protein, 9 aa, Homo Sapiens
RLKKLLLVN

SEQ ID NO: 859506 - protein, 9 aa, Homo Sapiens
ARHAQIRKT

SEQ ID NO: 859507 - protein, 9 aa, Homo Sapiens
KETLSELLG

SEQ ID NO: 859508 - protein, 9 aa, Homo Sapiens
YQDAMEYSS

SEQ ID NO: 859509 - protein, 9 aa, Homo Sapiens
HNSRDRWRN

SEQ ID NO: 859510 - protein, 9 aa, Homo Sapiens
CFWGTVRLY

SEQ ID NO: 859511 - protein, 9 aa, Homo Sapiens
NEELNLEDE

SEQ ID NO: 859512 - protein, 9 aa, Homo Sapiens
SPHSLSVSE

SEQ ID NO: 859513 - protein, 9 aa, Homo Sapiens
IWTLPYVCF

SEQ ID NO: 859514 - protein, 9 aa, Homo Sapiens
LLELGRRTW

SEQ ID NO: 859515 - protein, 9 aa, Homo Sapiens
YAVISFGCA

SEQ ID NO: 859516 - protein, 9 aa, Homo Sapiens
LFIDLSFLN

SEQ ID NO: 859517 - protein, 9 aa, Homo Sapiens
REHDAHIVH

SEQ ID NO: 859518 - protein, 9 aa, Homo Sapiens
GTERWWLNG

SEQ ID NO: 859519 - protein, 9 aa, Homo Sapiens
DKASEKSIC

SEQ ID NO: 859520 - protein, 9 aa, Homo Sapiens
IESSLGVLR

SEQ ID NO: 859521 - protein, 9 aa, Homo Sapiens
DLNDWWNNT

SEQ ID NO: 859522 - protein, 9 aa, Homo Sapiens
CCKRVVINI

SEQ ID NO: 859523 - protein, 9 aa, Homo Sapiens
KVQDAQPNP

SEQ ID NO: 859524 - protein, 9 aa, Homo Sapiens
KAVLEVVQS

SEQ ID NO: 859525 - protein, 9 aa, Homo Sapiens
DTHKLWRNI

SEQ ID NO: 859526 - protein, 9 aa, Homo Sapiens
GFKYYNLVV

SEQ ID NO: 859527 - protein, 9 aa, Homo Sapiens
NNLSDKTSK

SEQ ID NO: 859528 - protein, 9 aa, Homo Sapiens
LHQPYEAAH

SEQ ID NO: 859529 - protein, 9 aa, Homo Sapiens
KNKSSDTLK

SEQ ID NO: 859530 - protein, 9 aa, Homo Sapiens
TLKLHKSNA

SEQ ID NO: 859531 - protein, 9 aa, Homo Sapiens
GRDTYIHCC

SEQ ID NO: 859532 - protein, 9 aa, Homo Sapiens
VTVAKSLEA

SEQ ID NO: 859533 - protein, 9 aa, Homo Sapiens
FSWQEDPGA

SEQ ID NO: 859534 - protein, 9 aa, Homo Sapiens
CLLNLSCST

SEQ ID NO: 859535 - protein, 9 aa, Homo Sapiens
YVRFNSDVG

SEQ ID NO: 859536 - protein, 9 aa, Homo Sapiens
HLFEACRLL

SEQ ID NO: 859537 - protein, 9 aa, Homo Sapiens
YLCDTNHII

SEQ ID NO: 859538 - protein, 9 aa, Homo Sapiens
IAFEDSKVH

SEQ ID NO: 859539 - protein, 9 aa, Homo Sapiens
SKSQYSGQL

SEQ ID NO: 859540 - protein, 9 aa, Homo Sapiens
KSKHFESKF

SEQ ID NO: 859541 - protein, 9 aa, Homo Sapiens
ALLMGVALG

SEQ ID NO: 859542 - protein, 9 aa, Homo Sapiens
LDYQVPLDP

SEQ ID NO: 859543 - protein, 9 aa, Homo Sapiens
VLSTEKTAI

SEQ ID NO: 859544 - protein, 9 aa, Homo Sapiens
GDPRLQTNF

SEQ ID NO: 859545 - protein, 9 aa, Homo Sapiens
TPVSPGSIT

SEQ ID NO: 859546 - protein, 9 aa, Homo Sapiens
LGGKQRATF

SEQ ID NO: 859547 - protein, 9 aa, Homo Sapiens
PWIQEKHNH

SEQ ID NO: 859548 - protein, 9 aa, Homo Sapiens
HGAAVSCVP

SEQ ID NO: 859549 - protein, 9 aa, Homo Sapiens
EPLYQRVGV

SEQ ID NO: 859550 - protein, 9 aa, Homo Sapiens
RSSPLHYAA

SEQ ID NO: 859551 - protein, 9 aa, Homo Sapiens
ILYVVLWLI

SEQ ID NO: 859552 - protein, 9 aa, Homo Sapiens
RAICQSRPN

SEQ ID NO: 859553 - protein, 9 aa, Homo Sapiens
PSPQGLSAQ

SEQ ID NO: 859554 - protein, 9 aa, Homo Sapiens
SYYMTYGKT

SEQ ID NO: 859555 - protein, 9 aa, Homo Sapiens
FPGIEGHPV

SEQ ID NO: 859556 - protein, 9 aa, Homo Sapiens
WPRYRVVDS

SEQ ID NO: 859557 - protein, 9 aa, Homo Sapiens
EASKIMKSI

SEQ ID NO: 859558 - protein, 9 aa, Homo Sapiens
FADTIRLPY

SEQ ID NO: 859559 - protein, 9 aa, Homo Sapiens
KQTWRRKGS

SEQ ID NO: 859560 - protein, 9 aa, Homo Sapiens
CTLCLSMLE

SEQ ID NO: 859561 - protein, 9 aa, Homo Sapiens
ENSTQENLE

SEQ ID NO: 859562 - protein, 9 aa, Homo Sapiens
HKVDAVFIK

SEQ ID NO: 859563 - protein, 9 aa, Homo Sapiens
INSVNLDSL

SEQ ID NO: 859564 - protein, 9 aa, Homo Sapiens
FTGELERGP

SEQ ID NO: 859565 - protein, 9 aa, Homo Sapiens
GSETDEEDN

SEQ ID NO: 859566 - protein, 9 aa, Homo Sapiens
RNTVLDEAN

SEQ ID NO: 859567 - protein, 9 aa, Homo Sapiens
EEEEIIILE

SEQ ID NO: 859568 - protein, 9 aa, Homo Sapiens
SRASIKHKD

SEQ ID NO: 859569 - protein, 9 aa, Homo Sapiens
GAICDIIVV

SEQ ID NO: 859570 - protein, 9 aa, Homo Sapiens
DVIRITGRD

SEQ ID NO: 859571 - protein, 9 aa, Homo Sapiens
IYTCGGIDK

SEQ ID NO: 859572 - protein, 9 aa, Homo Sapiens
LCLAALSCD

SEQ ID NO: 859573 - protein, 9 aa, Homo Sapiens
TVASQAYNL

SEQ ID NO: 859574 - protein, 9 aa, Homo Sapiens
PNSLDPLKH

SEQ ID NO: 859575 - protein, 9 aa, Homo Sapiens
IVDVCVNVT

SEQ ID NO: 859576 - protein, 9 aa, Homo Sapiens
MDTVVGPSG

SEQ ID NO: 859577 - protein, 9 aa, Homo Sapiens
TFKAVGKSR

SEQ ID NO: 859578 - protein, 9 aa, Homo Sapiens
SSKNKDKLI

SEQ ID NO: 859579 - protein, 9 aa, Homo Sapiens
PGTSMKYSC

SEQ ID NO: 859580 - protein, 9 aa, Homo Sapiens
FFLSKCQNS

SEQ ID NO: 859581 - protein, 9 aa, Homo Sapiens
HIQHIVIDK

SEQ ID NO: 859582 - protein, 9 aa, Homo Sapiens
AAKRTITFH

SEQ ID NO: 859583 - protein, 9 aa, Homo Sapiens
KSGKAFGQS

SEQ ID NO: 859584 - protein, 9 aa, Homo Sapiens
NMTTPNKTP

SEQ ID NO: 859585 - protein, 9 aa, Homo Sapiens
GSWNPTSQE

SEQ ID NO: 859586 - protein, 9 aa, Homo Sapiens
NKTGQNYFS

SEQ ID NO: 859587 - protein, 9 aa, Homo Sapiens
AAQNMVLQE

SEQ ID NO: 859588 - protein, 9 aa, Homo Sapiens
QSLQTEICY

SEQ ID NO: 859589 - protein, 9 aa, Homo Sapiens
VKKHFEKIN

SEQ ID NO: 859590 - protein, 9 aa, Homo Sapiens
QWIQNGTKL

SEQ ID NO: 859591 - protein, 9 aa, Homo Sapiens
SLCIARFRF

SEQ ID NO: 859592 - protein, 9 aa, Homo Sapiens
PDLDIKIDF

SEQ ID NO: 859593 - protein, 9 aa, Homo Sapiens
GAKVMFVAG

SEQ ID NO: 859594 - protein, 9 aa, Homo Sapiens
KHECKIKYS

SEQ ID NO: 859595 - protein, 9 aa, Homo Sapiens
TQQQPPPAT

SEQ ID NO: 859596 - protein, 9 aa, Homo Sapiens
DITIATRNT

SEQ ID NO: 859597 - protein, 9 aa, Homo Sapiens
MPVSNQKPG

SEQ ID NO: 859598 - protein, 9 aa, Homo Sapiens
YPYFFRTIP

SEQ ID NO: 859599 - protein, 9 aa, Homo Sapiens
WQKHAYRYC

SEQ ID NO: 859600 - protein, 9 aa, Homo Sapiens
WMAGGKLRF

SEQ ID NO: 859601 - protein, 9 aa, Homo Sapiens
HRTGSRLGG

SEQ ID NO: 859602 - protein, 9 aa, Homo Sapiens
FVLTCMSVD

SEQ ID NO: 859603 - protein, 9 aa, Homo Sapiens
HRELLRRTW

SEQ ID NO: 859604 - protein, 9 aa, Homo Sapiens
NRQIVDHVD

SEQ ID NO: 859605 - protein, 9 aa, Homo Sapiens
VAGYGRFSG

SEQ ID NO: 859606 - protein, 9 aa, Homo Sapiens
SDMGGPLPA

SEQ ID NO: 859607 - protein, 9 aa, Homo Sapiens
GTPQPSSPL

SEQ ID NO: 859608 - protein, 9 aa, Homo Sapiens
LRLYLCGLS

SEQ ID NO: 859609 - protein, 9 aa, Homo Sapiens
NRAMANCNS

SEQ ID NO: 859610 - protein, 9 aa, Homo Sapiens
KYSIINYTF

SEQ ID NO: 859611 - protein, 9 aa, Homo Sapiens
IAAISVRFV

SEQ ID NO: 859612 - protein, 9 aa, Homo Sapiens
TSTTLIYGL

SEQ ID NO: 859613 - protein, 9 aa, Homo Sapiens
HDKTGEIMD

SEQ ID NO: 859614 - protein, 9 aa, Homo Sapiens
LLQILSQLL

SEQ ID NO: 859615 - protein, 9 aa, Homo Sapiens
RWLIGGGRK

SEQ ID NO: 859616 - protein, 9 aa, Homo Sapiens
TEDTEQDKD

SEQ ID NO: 859617 - protein, 9 aa, Homo Sapiens
FKANDLFEN

SEQ ID NO: 859618 - protein, 9 aa, Homo Sapiens
LRVSKRKSK

SEQ ID NO: 859619 - protein, 9 aa, Homo Sapiens
APYPVCTVW

SEQ ID NO: 859620 - protein, 9 aa, Homo Sapiens
SLVQQSQLV

SEQ ID NO: 859621 - protein, 9 aa, Homo Sapiens
FKGLINVTL

SEQ ID NO: 859622 - protein, 9 aa, Homo Sapiens
DISIVRLKT

SEQ ID NO: 859623 - protein, 9 aa, Homo Sapiens
KKKIHRFQP

SEQ ID NO: 859624 - protein, 9 aa, Homo Sapiens
SSTIRITGS

SEQ ID NO: 859625 - protein, 9 aa, Homo Sapiens
QEDHMKLKV

SEQ ID NO: 859626 - protein, 9 aa, Homo Sapiens
RVRVIILAF

SEQ ID NO: 859627 - protein, 9 aa, Homo Sapiens
WWAQNAVQR

SEQ ID NO: 859628 - protein, 9 aa, Homo Sapiens
QQRERMMTW

SEQ ID NO: 859629 - protein, 9 aa, Homo Sapiens
AGAAPRRRW

SEQ ID NO: 859630 - protein, 9 aa, Homo Sapiens
GLEETLHNL

SEQ ID NO: 859631 - protein, 9 aa, Homo Sapiens
VNNTLLGQD

SEQ ID NO: 859632 - protein, 9 aa, Homo Sapiens
HKKLYCSEL

SEQ ID NO: 859633 - protein, 9 aa, Homo Sapiens
HPAVVIQQR

SEQ ID NO: 859634 - protein, 9 aa, Homo Sapiens
RIYVTGGYS

SEQ ID NO: 859635 - protein, 9 aa, Homo Sapiens
EEWGKIMRT

SEQ ID NO: 859636 - protein, 9 aa, Homo Sapiens
WVFTSVMCT

SEQ ID NO: 859637 - protein, 9 aa, Homo Sapiens
LDEAENDIC

SEQ ID NO: 859638 - protein, 9 aa, Homo Sapiens
DEEPQALLT

SEQ ID NO: 859639 - protein, 9 aa, Homo Sapiens
KLFADKFPK

SEQ ID NO: 859640 - protein, 9 aa, Homo Sapiens
DRLFEHEVK

SEQ ID NO: 859641 - protein, 9 aa, Homo Sapiens
GECERNPAK

SEQ ID NO: 859642 - protein, 9 aa, Homo Sapiens
WYLQSTQAI

SEQ ID NO: 859643 - protein, 9 aa, Homo Sapiens
RQEAVPWKQ

SEQ ID NO: 859644 - protein, 9 aa, Homo Sapiens
QLIIDGISQ

SEQ ID NO: 859645 - protein, 9 aa, Homo Sapiens
NTPTAQTFD

SEQ ID NO: 859646 - protein, 9 aa, Homo Sapiens
VQRDASLPV

SEQ ID NO: 859647 - protein, 9 aa, Homo Sapiens
DQYIKMTVC

SEQ ID NO: 859648 - protein, 9 aa, Homo Sapiens
TFIKKRDEK

SEQ ID NO: 859649 - protein, 9 aa, Homo Sapiens
NPRAHSSPV

SEQ ID NO: 859650 - protein, 9 aa, Homo Sapiens
DTGNIIMEF

SEQ ID NO: 859651 - protein, 9 aa, Homo Sapiens
PTPPPVATV

SEQ ID NO: 859652 - protein, 9 aa, Homo Sapiens
VANVACGEG

SEQ ID NO: 859653 - protein, 9 aa, Homo Sapiens
INDGDLRNK

SEQ ID NO: 859654 - protein, 9 aa, Homo Sapiens
NNYGQLDIF

SEQ ID NO: 859655 - protein, 9 aa, Homo Sapiens
INLKSDEHI

SEQ ID NO: 859656 - protein, 9 aa, Homo Sapiens
PVLTPLMLD

SEQ ID NO: 859657 - protein, 9 aa, Homo Sapiens
GKSCRASNY

SEQ ID NO: 859658 - protein, 9 aa, Homo Sapiens
KLYRSPEHG

SEQ ID NO: 859659 - protein, 9 aa, Homo Sapiens
PGDYFSLIQ

SEQ ID NO: 859660 - protein, 9 aa, Homo Sapiens
LAKVRYAMG

SEQ ID NO: 859661 - protein, 9 aa, Homo Sapiens
SGMYKESAL

SEQ ID NO: 859662 - protein, 9 aa, Homo Sapiens
IPLKPTMKM

SEQ ID NO: 859663 - protein, 9 aa, Homo Sapiens
QIEKGIFKL

SEQ ID NO: 859664 - protein, 9 aa, Homo Sapiens
VPTQSVPSG

SEQ ID NO: 859665 - protein, 9 aa, Homo Sapiens
PGITCLIQL

SEQ ID NO: 859666 - protein, 9 aa, Homo Sapiens
WHYFGADSV

SEQ ID NO: 859667 - protein, 9 aa, Homo Sapiens
NGYLVLYLS

SEQ ID NO: 859668 - protein, 9 aa, Homo Sapiens
ATVHVRVNN

SEQ ID NO: 859669 - protein, 9 aa, Homo Sapiens
VIGKQNGNI

SEQ ID NO: 859670 - protein, 9 aa, Homo Sapiens
RSEAPTFWQ

SEQ ID NO: 859671 - protein, 9 aa, Homo Sapiens
EGTYIIEMS

SEQ ID NO: 859672 - protein, 9 aa, Homo Sapiens
YQAVLSQPT

SEQ ID NO: 859673 - protein, 9 aa, Homo Sapiens
KGLSHTKHD

SEQ ID NO: 859674 - protein, 9 aa, Homo Sapiens
QITHKGENI

SEQ ID NO: 859675 - protein, 9 aa, Homo Sapiens
VAQSIIFIC

SEQ ID NO: 859676 - protein, 9 aa, Homo Sapiens
MQEKTDIID

SEQ ID NO: 859677 - protein, 9 aa, Homo Sapiens
SMVCLSPLL

SEQ ID NO: 859678 - protein, 9 aa, Homo Sapiens
IIHFQTKVQ

SEQ ID NO: 859679 - protein, 9 aa, Homo Sapiens
EFEQLWKVN

SEQ ID NO: 859680 - protein, 9 aa, Homo Sapiens
FHKPCASIW

SEQ ID NO: 859681 - protein, 9 aa, Homo Sapiens
YLLASENQH

SEQ ID NO: 859682 - protein, 9 aa, Homo Sapiens
SYPHLSPNM

SEQ ID NO: 859683 - protein, 9 aa, Homo Sapiens
YRIKDGHLV

SEQ ID NO: 859684 - protein, 9 aa, Homo Sapiens
LKTLLWCRN

SEQ ID NO: 859685 - protein, 9 aa, Homo Sapiens
MGIYHKQNL

SEQ ID NO: 859686 - protein, 9 aa, Homo Sapiens
NVDFRGKTV

SEQ ID NO: 859687 - protein, 9 aa, Homo Sapiens
EKFLARTKF

SEQ ID NO: 859688 - protein, 9 aa, Homo Sapiens
SEIIYFFLG

SEQ ID NO: 859689 - protein, 9 aa, Homo Sapiens
TYFLLNAEY

SEQ ID NO: 859690 - protein, 9 aa, Homo Sapiens
LPKWGREQL

SEQ ID NO: 859691 - protein, 9 aa, Homo Sapiens
DREPQDGRD

SEQ ID NO: 859692 - protein, 9 aa, Homo Sapiens
LKTVDSTKD

SEQ ID NO: 859693 - protein, 9 aa, Homo Sapiens
RDTHKLWRN

SEQ ID NO: 859694 - protein, 9 aa, Homo Sapiens
TLSTTNMKT

SEQ ID NO: 859695 - protein, 9 aa, Homo Sapiens
MREVIHPLA

SEQ ID NO: 859696 - protein, 9 aa, Homo Sapiens
IARRHTYFY

SEQ ID NO: 859697 - protein, 9 aa, Homo Sapiens
NVIVTGGKV

SEQ ID NO: 859698 - protein, 9 aa, Homo Sapiens
DAVSDKPLD

SEQ ID NO: 859699 - protein, 9 aa, Homo Sapiens
EFSPQLFHQ

SEQ ID NO: 859700 - protein, 9 aa, Homo Sapiens
DGIVPLCYV

SEQ ID NO: 859701 - protein, 9 aa, Homo Sapiens
SNTPLVSIT

SEQ ID NO: 859702 - protein, 9 aa, Homo Sapiens
KKQDKKQEQ

SEQ ID NO: 859703 - protein, 9 aa, Homo Sapiens
GGALSAVTA

SEQ ID NO: 859704 - protein, 9 aa, Homo Sapiens
APSPQGLSA

SEQ ID NO: 859705 - protein, 9 aa, Homo Sapiens
YSLTLCQAA

SEQ ID NO: 859706 - protein, 9 aa, Homo Sapiens
DDVKLLSIS

SEQ ID NO: 859707 - protein, 9 aa, Homo Sapiens
ETMVRELVH

SEQ ID NO: 859708 - protein, 9 aa, Homo Sapiens
FRTTGQSVY

SEQ ID NO: 859709 - protein, 9 aa, Homo Sapiens
ARLPGVSHS

SEQ ID NO: 859710 - protein, 9 aa, Homo Sapiens
SNSSLSVSP

SEQ ID NO: 859711 - protein, 9 aa, Homo Sapiens
YGCNKCGKS

SEQ ID NO: 859712 - protein, 9 aa, Homo Sapiens
TDLNNGSLF

SEQ ID NO: 859713 - protein, 9 aa, Homo Sapiens
GGGGHRPHK

SEQ ID NO: 859714 - protein, 9 aa, Homo Sapiens
EFSLDSTMR

SEQ ID NO: 859715 - protein, 9 aa, Homo Sapiens
LFLDSYKLV

SEQ ID NO: 859716 - protein, 9 aa, Homo Sapiens
HGYIFVYSA

SEQ ID NO: 859717 - protein, 9 aa, Homo Sapiens
YNSFPLLLP

SEQ ID NO: 859718 - protein, 9 aa, Homo Sapiens
TNYVCLKYA

SEQ ID NO: 859719 - protein, 9 aa, Homo Sapiens
PFLQRLGMI

SEQ ID NO: 859720 - protein, 9 aa, Homo Sapiens
VIVTRYEQR

SEQ ID NO: 859721 - protein, 9 aa, Homo Sapiens
WLWLEFFLT

SEQ ID NO: 859722 - protein, 9 aa, Homo Sapiens
LLIGTVPFH

SEQ ID NO: 859723 - protein, 9 aa, Homo Sapiens
DDNEYLFQA

SEQ ID NO: 859724 - protein, 9 aa, Homo Sapiens
STCCQTTCY

SEQ ID NO: 859725 - protein, 9 aa, Homo Sapiens
KDATAEIID

SEQ ID NO: 859726 - protein, 9 aa, Homo Sapiens
NFHFMLRDH

SEQ ID NO: 859727 - protein, 9 aa, Homo Sapiens
GLELYPVPL

SEQ ID NO: 859728 - protein, 9 aa, Homo Sapiens
GGTSYERYN

SEQ ID NO: 859729 - protein, 9 aa, Homo Sapiens
GQEIPVNIR

SEQ ID NO: 859730 - protein, 9 aa, Homo Sapiens
VCQRYNKIA

SEQ ID NO: 859731 - protein, 9 aa, Homo Sapiens
LWDARLCPH

SEQ ID NO: 859732 - protein, 9 aa, Homo Sapiens
PFWIVFLLV

SEQ ID NO: 859733 - protein, 9 aa, Homo Sapiens
QVLINGAWE

SEQ ID NO: 859734 - protein, 9 aa, Homo Sapiens
SWFRGCQVW

SEQ ID NO: 859735 - protein, 9 aa, Homo Sapiens
SNCKGGFNF

SEQ ID NO: 859736 - protein, 9 aa, Homo Sapiens
IFGPIADVV

SEQ ID NO: 859737 - protein, 9 aa, Homo Sapiens
PLAKILKGS

SEQ ID NO: 859738 - protein, 9 aa, Homo Sapiens
VTADVVLAH

SEQ ID NO: 859739 - protein, 9 aa, Homo Sapiens
IKKACKVFI

SEQ ID NO: 859740 - protein, 9 aa, Homo Sapiens
HKLHTADKP

SEQ ID NO: 859741 - protein, 9 aa, Homo Sapiens
PTAQRAAII

SEQ ID NO: 859742 - protein, 9 aa, Homo Sapiens
KRNYSYFLG

SEQ ID NO: 859743 - protein, 9 aa, Homo Sapiens
TTTQMGRGT

SEQ ID NO: 859744 - protein, 9 aa, Homo Sapiens
MQLMFGDPC

SEQ ID NO: 859745 - protein, 9 aa, Homo Sapiens
KPSPNNSPK

SEQ ID NO: 859746 - protein, 9 aa, Homo Sapiens
RVVDYIVST

SEQ ID NO: 859747 - protein, 9 aa, Homo Sapiens
TVSVYQYTI

SEQ ID NO: 859748 - protein, 9 aa, Homo Sapiens
HFCDKAFIN

SEQ ID NO: 859749 - protein, 9 aa, Homo Sapiens
ILAVLTTLK

SEQ ID NO: 859750 - protein, 9 aa, Homo Sapiens
YRDSHSQQW

SEQ ID NO: 859751 - protein, 9 aa, Homo Sapiens
PCVNAGSRA

SEQ ID NO: 859752 - protein, 9 aa, Homo Sapiens
RSLGEKAAA

SEQ ID NO: 859753 - protein, 9 aa, Homo Sapiens
YNRKDGTPF

SEQ ID NO: 859754 - protein, 9 aa, Homo Sapiens
VKTVPLVNS

SEQ ID NO: 859755 - protein, 9 aa, Homo Sapiens
LEEKVCALQ

SEQ ID NO: 859756 - protein, 9 aa, Homo Sapiens
WTQREPNAV

SEQ ID NO: 859757 - protein, 9 aa, Homo Sapiens
MAQSRGELM

SEQ ID NO: 859758 - protein, 9 aa, Homo Sapiens
VLMGTYNDG

SEQ ID NO: 859759 - protein, 9 aa, Homo Sapiens
VRLWVLQII

SEQ ID NO: 859760 - protein, 9 aa, Homo Sapiens
AESTGLETT

SEQ ID NO: 859761 - protein, 9 aa, Homo Sapiens
CSLFEYHDS

SEQ ID NO: 859762 - protein, 9 aa, Homo Sapiens
KYKKLRVFL

SEQ ID NO: 859763 - protein, 9 aa, Homo Sapiens
PLGSSTPMS

SEQ ID NO: 859764 - protein, 9 aa, Homo Sapiens
VHPESGDLL

SEQ ID NO: 859765 - protein, 9 aa, Homo Sapiens
GEGSYTCDT

SEQ ID NO: 859766 - protein, 9 aa, Homo Sapiens
VVCIRWVYG

SEQ ID NO: 859767 - protein, 9 aa, Homo Sapiens
TTSKRIIKK

SEQ ID NO: 859768 - protein, 9 aa, Homo Sapiens
SSHLSRHEI

SEQ ID NO: 859769 - protein, 9 aa, Homo Sapiens
ASLAGTLFL

SEQ ID NO: 859770 - protein, 9 aa, Homo Sapiens
RPRSPALYF

SEQ ID NO: 859771 - protein, 9 aa, Homo Sapiens
MKNLRHPKF

SEQ ID NO: 859772 - protein, 9 aa, Homo Sapiens
YASQQMRAG

SEQ ID NO: 859773 - protein, 9 aa, Homo Sapiens
VGRGRAWLC

SEQ ID NO: 859774 - protein, 9 aa, Homo Sapiens
CSWLYGVNN

SEQ ID NO: 859775 - protein, 9 aa, Homo Sapiens
LAVKAYTSA

SEQ ID NO: 859776 - protein, 9 aa, Homo Sapiens
LSRIWQEAR

SEQ ID NO: 859777 - protein, 9 aa, Homo Sapiens
LKMTIRDDM

SEQ ID NO: 859778 - protein, 9 aa, Homo Sapiens
RKMLQEICT

SEQ ID NO: 859779 - protein, 9 aa, Homo Sapiens
NVQNILHEV

SEQ ID NO: 859780 - protein, 9 aa, Homo Sapiens
QESKALVTM

SEQ ID NO: 859781 - protein, 9 aa, Homo Sapiens
RRLMLSERL

SEQ ID NO: 859782 - protein, 9 aa, Homo Sapiens
TLQTLQEQL

SEQ ID NO: 859783 - protein, 9 aa, Homo Sapiens
VPGSSGSRS

SEQ ID NO: 859784 - protein, 9 aa, Homo Sapiens
LDKYLPAPL

SEQ ID NO: 859785 - protein, 9 aa, Homo Sapiens
LDVMKKPSC

SEQ ID NO: 859786 - protein, 9 aa, Homo Sapiens
IIYSLINKQ

SEQ ID NO: 859787 - protein, 9 aa, Homo Sapiens
VTKEEKNKK

SEQ ID NO: 859788 - protein, 9 aa, Homo Sapiens
RGALGETVL

SEQ ID NO: 859789 - protein, 9 aa, Homo Sapiens
KEKFPSKHL

SEQ ID NO: 859790 - protein, 9 aa, Homo Sapiens
GDLLGEDYL

SEQ ID NO: 859791 - protein, 9 aa, Homo Sapiens
YMHLKVLKS

SEQ ID NO: 859792 - protein, 9 aa, Homo Sapiens
LLFGDVAVG

SEQ ID NO: 859793 - protein, 9 aa, Homo Sapiens
PTFRLSSQS

SEQ ID NO: 859794 - protein, 9 aa, Homo Sapiens
KRIHAGDKF

SEQ ID NO: 859795 - protein, 9 aa, Homo Sapiens
PEQRKIMTS

SEQ ID NO: 859796 - protein, 9 aa, Homo Sapiens
PLNYVVIMN

SEQ ID NO: 859797 - protein, 9 aa, Homo Sapiens
DYQTNIGLT

SEQ ID NO: 859798 - protein, 9 aa, Homo Sapiens
QNEILVKRY

SEQ ID NO: 859799 - protein, 9 aa, Homo Sapiens
AAAPNFSFS

SEQ ID NO: 859800 - protein, 9 aa, Homo Sapiens
AKIEDLSLA

SEQ ID NO: 859801 - protein, 9 aa, Homo Sapiens
ALNLTERQV

SEQ ID NO: 859802 - protein, 9 aa, Homo Sapiens
KWEQFILGR

SEQ ID NO: 859803 - protein, 9 aa, Homo Sapiens
KRMNRFKDK

SEQ ID NO: 859804 - protein, 9 aa, Homo Sapiens
LPAFIETYN

SEQ ID NO: 859805 - protein, 9 aa, Homo Sapiens
DGSQQTGIL

SEQ ID NO: 859806 - protein, 9 aa, Homo Sapiens
QQNNFSYKD

SEQ ID NO: 859807 - protein, 9 aa, Homo Sapiens
LDWLCGESQ

SEQ ID NO: 859808 - protein, 9 aa, Homo Sapiens
LSENVQNNT

SEQ ID NO: 859809 - protein, 9 aa, Homo Sapiens
WLTLKEQPT

SEQ ID NO: 859810 - protein, 9 aa, Homo Sapiens
APGGVKTTD

SEQ ID NO: 859811 - protein, 9 aa, Homo Sapiens
KYKIIYTGE

SEQ ID NO: 859812 - protein, 9 aa, Homo Sapiens
PSPRILNTH

SEQ ID NO: 859813 - protein, 9 aa, Homo Sapiens
PTKCTVSVS

SEQ ID NO: 859814 - protein, 9 aa, Homo Sapiens
SRVEGADDE

SEQ ID NO: 859815 - protein, 9 aa, Homo Sapiens
NIPITPVRV

SEQ ID NO: 859816 - protein, 9 aa, Homo Sapiens
IFYSQWEGA

SEQ ID NO: 859817 - protein, 9 aa, Homo Sapiens
FCFNDNLVS

SEQ ID NO: 859818 - protein, 9 aa, Homo Sapiens
FNSNCKGGF

SEQ ID NO: 859819 - protein, 9 aa, Homo Sapiens
RILALAQNK

SEQ ID NO: 859820 - protein, 9 aa, Homo Sapiens
QAAIVCIMK

SEQ ID NO: 859821 - protein, 9 aa, Homo Sapiens
WLQVENSKR

SEQ ID NO: 859822 - protein, 9 aa, Homo Sapiens
TFIDQLYKD

SEQ ID NO: 859823 - protein, 9 aa, Homo Sapiens
LGIIANINR

SEQ ID NO: 859824 - protein, 9 aa, Homo Sapiens
ETLYQNRSN

SEQ ID NO: 859825 - protein, 9 aa, Homo Sapiens
KVRQLFFYH

SEQ ID NO: 859826 - protein, 9 aa, Homo Sapiens
YMFVVEKWP

SEQ ID NO: 859827 - protein, 9 aa, Homo Sapiens
IGANVTAFI

SEQ ID NO: 859828 - protein, 9 aa, Homo Sapiens
IYYKTLTLH

SEQ ID NO: 859829 - protein, 9 aa, Homo Sapiens
EKVNKYFDF

SEQ ID NO: 859830 - protein, 9 aa, Homo Sapiens
KHSEIYNTL

SEQ ID NO: 859831 - protein, 9 aa, Homo Sapiens
GDTELSACS

SEQ ID NO: 859832 - protein, 9 aa, Homo Sapiens
LENSCLAKL

SEQ ID NO: 859833 - protein, 9 aa, Homo Sapiens
QVLAVDEQL

SEQ ID NO: 859834 - protein, 9 aa, Homo Sapiens
SILNFLNKS

SEQ ID NO: 859835 - protein, 9 aa, Homo Sapiens
VLNTVIPHQ

SEQ ID NO: 859836 - protein, 9 aa, Homo Sapiens
SFVAIQAGT

SEQ ID NO: 859837 - protein, 9 aa, Homo Sapiens
RKDISTNTE

SEQ ID NO: 859838 - protein, 9 aa, Homo Sapiens
DQAPQLKIS

SEQ ID NO: 859839 - protein, 9 aa, Homo Sapiens
NTCYSSKRR

SEQ ID NO: 859840 - protein, 9 aa, Homo Sapiens
SFSAKSFKN

SEQ ID NO: 859841 - protein, 9 aa, Homo Sapiens
WCRNEKKRH

SEQ ID NO: 859842 - protein, 9 aa, Homo Sapiens
DNTKFMIFK

SEQ ID NO: 859843 - protein, 9 aa, Homo Sapiens
LFENQYIHV

SEQ ID NO: 859844 - protein, 9 aa, Homo Sapiens
FTNMSSMNE

SEQ ID NO: 859845 - protein, 9 aa, Homo Sapiens
NMFIDAMLL

SEQ ID NO: 859846 - protein, 9 aa, Homo Sapiens
ELKKPHKIK

SEQ ID NO: 859847 - protein, 9 aa, Homo Sapiens
IRCPFVETT

SEQ ID NO: 859848 - protein, 9 aa, Homo Sapiens
HPVSNSCID

SEQ ID NO: 859849 - protein, 9 aa, Homo Sapiens
RAKFRQIVL

SEQ ID NO: 859850 - protein, 9 aa, Homo Sapiens
YSKEEKYVA

SEQ ID NO: 859851 - protein, 9 aa, Homo Sapiens
SVFIPRRLI

SEQ ID NO: 859852 - protein, 9 aa, Homo Sapiens
YLGNEKRRC

SEQ ID NO: 859853 - protein, 9 aa, Homo Sapiens
EVRIVVSNA

SEQ ID NO: 859854 - protein, 9 aa, Homo Sapiens
LREWGENLK

SEQ ID NO: 859855 - protein, 9 aa, Homo Sapiens
AHYHAPSTI

SEQ ID NO: 859856 - protein, 9 aa, Homo Sapiens
KKDGRFTAQ

SEQ ID NO: 859857 - protein, 9 aa, Homo Sapiens
NEQSLPHLI

SEQ ID NO: 859858 - protein, 9 aa, Homo Sapiens
VFNSTSSPP

SEQ ID NO: 859859 - protein, 9 aa, Homo Sapiens
DTSTNGLIN

SEQ ID NO: 859860 - protein, 9 aa, Homo Sapiens
NKELVPLAT

SEQ ID NO: 859861 - protein, 9 aa, Homo Sapiens
IVHLGEKPF

SEQ ID NO: 859862 - protein, 9 aa, Homo Sapiens
EITFFSPIM

SEQ ID NO: 859863 - protein, 9 aa, Homo Sapiens
NLEKGDIGI

SEQ ID NO: 859864 - protein, 9 aa, Homo Sapiens
SGKQSRTSK

SEQ ID NO: 859865 - protein, 9 aa, Homo Sapiens
INDYAKFTQ

SEQ ID NO: 859866 - protein, 9 aa, Homo Sapiens
KSRYRSQSK

SEQ ID NO: 859867 - protein, 9 aa, Homo Sapiens
VETLMFSNN

SEQ ID NO: 859868 - protein, 9 aa, Homo Sapiens
GGHNALKGP

SEQ ID NO: 859869 - protein, 9 aa, Homo Sapiens
KCRDMTRMF

SEQ ID NO: 859870 - protein, 9 aa, Homo Sapiens
LPRSSYYFD

SEQ ID NO: 859871 - protein, 9 aa, Homo Sapiens
QNTTWVPYP

SEQ ID NO: 859872 - protein, 9 aa, Homo Sapiens
VCNSGLKQN

SEQ ID NO: 859873 - protein, 9 aa, Homo Sapiens
NKDVPKKCF

SEQ ID NO: 859874 - protein, 9 aa, Homo Sapiens
KIILPTTVP

SEQ ID NO: 859875 - protein, 9 aa, Homo Sapiens
RPKYNGLLH

SEQ ID NO: 859876 - protein, 9 aa, Homo Sapiens
RSKQGKTQQ

SEQ ID NO: 859877 - protein, 9 aa, Homo Sapiens
DKSAPIRTP

SEQ ID NO: 859878 - protein, 9 aa, Homo Sapiens
CKVGKDYFG

SEQ ID NO: 859879 - protein, 9 aa, Homo Sapiens
ATTVHAVWD

SEQ ID NO: 859880 - protein, 9 aa, Homo Sapiens
SPTYPVYRG

SEQ ID NO: 859881 - protein, 9 aa, Homo Sapiens
GPSVGVKAG

SEQ ID NO: 859882 - protein, 9 aa, Homo Sapiens
AKMIPTTTN

SEQ ID NO: 859883 - protein, 9 aa, Homo Sapiens
ERWKALRSY

SEQ ID NO: 859884 - protein, 9 aa, Homo Sapiens
PAAQITTQK

SEQ ID NO: 859885 - protein, 9 aa, Homo Sapiens
GPGEKCHPD

SEQ ID NO: 859886 - protein, 9 aa, Homo Sapiens
QTLPYRGPR

SEQ ID NO: 859887 - protein, 9 aa, Homo Sapiens
RNRQMTRKQ

SEQ ID NO: 859888 - protein, 9 aa, Homo Sapiens
LIGKQEGRH

SEQ ID NO: 859889 - protein, 9 aa, Homo Sapiens
WLSACFDNF

SEQ ID NO: 859890 - protein, 9 aa, Homo Sapiens
LLTPLFEEL

SEQ ID NO: 859891 - protein, 9 aa, Homo Sapiens
RIIPLRFVE

SEQ ID NO: 859892 - protein, 9 aa, Homo Sapiens
AASNKTIYT

SEQ ID NO: 859893 - protein, 9 aa, Homo Sapiens
WVNNTIIDG

SEQ ID NO: 859894 - protein, 9 aa, Homo Sapiens
KSVILFGES

SEQ ID NO: 859895 - protein, 9 aa, Homo Sapiens
IWTIILHFA

SEQ ID NO: 859896 - protein, 9 aa, Homo Sapiens
IIYPEFNKL

SEQ ID NO: 859897 - protein, 9 aa, Homo Sapiens
DGGPPKCCN

SEQ ID NO: 859898 - protein, 9 aa, Homo Sapiens
TSWSLLDTF

SEQ ID NO: 859899 - protein, 9 aa, Homo Sapiens
AMGFDRYMA

SEQ ID NO: 859900 - protein, 9 aa, Homo Sapiens
ELLVEVLED

SEQ ID NO: 859901 - protein, 9 aa, Homo Sapiens
LRDFVSILP

SEQ ID NO: 859902 - protein, 9 aa, Homo Sapiens
TTPITPTPF

SEQ ID NO: 859903 - protein, 9 aa, Homo Sapiens
EMNEKTLDK

SEQ ID NO: 859904 - protein, 9 aa, Homo Sapiens
KQKENSGAQ

SEQ ID NO: 859905 - protein, 9 aa, Homo Sapiens
HDQGCVQII

SEQ ID NO: 859906 - protein, 9 aa, Homo Sapiens
VCTCVCVCM

SEQ ID NO: 859907 - protein, 9 aa, Homo Sapiens
IDILLERLQ

SEQ ID NO: 859908 - protein, 9 aa, Homo Sapiens
RILFTVAFA

SEQ ID NO: 859909 - protein, 9 aa, Homo Sapiens
SFGSGDCKR

SEQ ID NO: 859910 - protein, 9 aa, Homo Sapiens
YDNSAHGYS

SEQ ID NO: 859911 - protein, 9 aa, Homo Sapiens
VLPHHGLHT

SEQ ID NO: 859912 - protein, 9 aa, Homo Sapiens
WKPTCDVFC

SEQ ID NO: 859913 - protein, 9 aa, Homo Sapiens
ASEANAPEE

SEQ ID NO: 859914 - protein, 9 aa, Homo Sapiens
EQSDTLDNN

SEQ ID NO: 859915 - protein, 9 aa, Homo Sapiens
AILRAVSDA

SEQ ID NO: 859916 - protein, 9 aa, Homo Sapiens
QQDLPILAE

SEQ ID NO: 859917 - protein, 9 aa, Homo Sapiens
ASSQFLPKG

SEQ ID NO: 859918 - protein, 9 aa, Homo Sapiens
LQELRYEES

SEQ ID NO: 859919 - protein, 9 aa, Homo Sapiens
SLVNFPTSI

SEQ ID NO: 859920 - protein, 9 aa, Homo Sapiens
YNDEICQEQ

SEQ ID NO: 859921 - protein, 9 aa, Homo Sapiens
PAAARLRFP

SEQ ID NO: 859922 - protein, 9 aa, Homo Sapiens
CSWSFFCSD

SEQ ID NO: 859923 - protein, 9 aa, Homo Sapiens
ARMTMYYPG

SEQ ID NO: 859924 - protein, 9 aa, Homo Sapiens
AIDLRGISD

SEQ ID NO: 859925 - protein, 9 aa, Homo Sapiens
SSSSFKLEM

SEQ ID NO: 859926 - protein, 9 aa, Homo Sapiens
PAYRGSYHL

SEQ ID NO: 859927 - protein, 9 aa, Homo Sapiens
LLADCSEAC

SEQ ID NO: 859928 - protein, 9 aa, Homo Sapiens
IFICAGYET

SEQ ID NO: 859929 - protein, 9 aa, Homo Sapiens
RLFGDHVRA

SEQ ID NO: 859930 - protein, 9 aa, Homo Sapiens
NGFEEVQSN

SEQ ID NO: 859931 - protein, 9 aa, Homo Sapiens
LYDLDIEAS

SEQ ID NO: 859932 - protein, 9 aa, Homo Sapiens
PGETLNINF

SEQ ID NO: 859933 - protein, 9 aa, Homo Sapiens
ARNLKDMDI

SEQ ID NO: 859934 - protein, 9 aa, Homo Sapiens
LKVHGSKVQ

SEQ ID NO: 859935 - protein, 9 aa, Homo Sapiens
DDFLCETKL

SEQ ID NO: 859936 - protein, 9 aa, Homo Sapiens
IPMYLLIGN

SEQ ID NO: 859937 - protein, 9 aa, Homo Sapiens
TGAYRARVL

SEQ ID NO: 859938 - protein, 9 aa, Homo Sapiens
KNLTCAHTI

SEQ ID NO: 859939 - protein, 9 aa, Homo Sapiens
IRRTADLQA

SEQ ID NO: 859940 - protein, 9 aa, Homo Sapiens
NLSDKTSKQ

SEQ ID NO: 859941 - protein, 9 aa, Homo Sapiens
SSHTPELAH

SEQ ID NO: 859942 - protein, 9 aa, Homo Sapiens
PGKRHPGIQ

SEQ ID NO: 859943 - protein, 9 aa, Homo Sapiens
YYFSALPSQ

SEQ ID NO: 859944 - protein, 9 aa, Homo Sapiens
LTLCQAASD

SEQ ID NO: 859945 - protein, 9 aa, Homo Sapiens
LLGLPAPNN

SEQ ID NO: 859946 - protein, 9 aa, Homo Sapiens
LLCVFFVKG

SEQ ID NO: 859947 - protein, 9 aa, Homo Sapiens
RGKTLCLLK

SEQ ID NO: 859948 - protein, 9 aa, Homo Sapiens
AMHYSFASL

SEQ ID NO: 859949 - protein, 9 aa, Homo Sapiens
KYLETPTKS

SEQ ID NO: 859950 - protein, 9 aa, Homo Sapiens
IHLSSGSRD

SEQ ID NO: 859951 - protein, 9 aa, Homo Sapiens
AFIRVVGSD

SEQ ID NO: 859952 - protein, 9 aa, Homo Sapiens
AKLTLDNFY

SEQ ID NO: 859953 - protein, 9 aa, Homo Sapiens
KYVVMVIDR

SEQ ID NO: 859954 - protein, 9 aa, Homo Sapiens
FWNEEIFPQ

SEQ ID NO: 859955 - protein, 9 aa, Homo Sapiens
WNNTEYRGG

SEQ ID NO: 859956 - protein, 9 aa, Homo Sapiens
HASKISRNY

SEQ ID NO: 859957 - protein, 9 aa, Homo Sapiens
HNFMMSVLG

SEQ ID NO: 859958 - protein, 9 aa, Homo Sapiens
TDEDTIISV

SEQ ID NO: 859959 - protein, 9 aa, Homo Sapiens
DLSPTKDGE

SEQ ID NO: 859960 - protein, 9 aa, Homo Sapiens
VQFNILDPL

SEQ ID NO: 859961 - protein, 9 aa, Homo Sapiens
IIPLRFVEL

SEQ ID NO: 859962 - protein, 9 aa, Homo Sapiens
ATYCLLLFY

SEQ ID NO: 859963 - protein, 9 aa, Homo Sapiens
DYLRHYSWA

SEQ ID NO: 859964 - protein, 9 aa, Homo Sapiens
LPGVAHGPA

SEQ ID NO: 859965 - protein, 9 aa, Homo Sapiens
KNVLYAWCG

SEQ ID NO: 859966 - protein, 9 aa, Homo Sapiens
NSPFFHMTA

SEQ ID NO: 859967 - protein, 9 aa, Homo Sapiens
RLQELRIVG

SEQ ID NO: 859968 - protein, 9 aa, Homo Sapiens
ANIFYYIPW

SEQ ID NO: 859969 - protein, 9 aa, Homo Sapiens
NDFFINDSK

SEQ ID NO: 859970 - protein, 9 aa, Homo Sapiens
PETDSHVNP

SEQ ID NO: 859971 - protein, 9 aa, Homo Sapiens
IPVPETESN

SEQ ID NO: 859972 - protein, 9 aa, Homo Sapiens
KANPNINDS

SEQ ID NO: 859973 - protein, 9 aa, Homo Sapiens
SISREDNIT

SEQ ID NO: 859974 - protein, 9 aa, Homo Sapiens
PHVYVGMKT

SEQ ID NO: 859975 - protein, 9 aa, Homo Sapiens
VVQMAVLIS

SEQ ID NO: 859976 - protein, 9 aa, Homo Sapiens
KRADTYWEY

SEQ ID NO: 859977 - protein, 9 aa, Homo Sapiens
LVCMVTVCA

SEQ ID NO: 859978 - protein, 9 aa, Homo Sapiens
SPGFVLEGS

SEQ ID NO: 859979 - protein, 9 aa, Homo Sapiens
IFNNTWSNT

SEQ ID NO: 859980 - protein, 9 aa, Homo Sapiens
TAVCERKDL

SEQ ID NO: 859981 - protein, 9 aa, Homo Sapiens
PLRIHTGEK

SEQ ID NO: 859982 - protein, 9 aa, Homo Sapiens
LPLGYMGEN

SEQ ID NO: 859983 - protein, 9 aa, Homo Sapiens
KHREQLIQN

SEQ ID NO: 859984 - protein, 9 aa, Homo Sapiens
PYFFRTIPS

SEQ ID NO: 859985 - protein, 9 aa, Homo Sapiens
MMEIANVSY

SEQ ID NO: 859986 - protein, 9 aa, Homo Sapiens
RDPDWLAQL

SEQ ID NO: 859987 - protein, 9 aa, Homo Sapiens
HFDFDLEEF

SEQ ID NO: 859988 - protein, 9 aa, Homo Sapiens
GNGSYLSVL

SEQ ID NO: 859989 - protein, 9 aa, Homo Sapiens
IKSQTGEIQ

SEQ ID NO: 859990 - protein, 9 aa, Homo Sapiens
AKWLPYKTC

SEQ ID NO: 859991 - protein, 9 aa, Homo Sapiens
SSSTRESGD

SEQ ID NO: 859992 - protein, 9 aa, Homo Sapiens
QKEDAAFTI

SEQ ID NO: 859993 - protein, 9 aa, Homo Sapiens
ERQQRLLGS

SEQ ID NO: 859994 - protein, 9 aa, Homo Sapiens
DYSPTSPNY

SEQ ID NO: 859995 - protein, 9 aa, Homo Sapiens
SLIRHAIIH

SEQ ID NO: 859996 - protein, 9 aa, Homo Sapiens
NYDRERCSA

SEQ ID NO: 859997 - protein, 9 aa, Homo Sapiens
AKKHIIIYE

SEQ ID NO: 859998 - protein, 9 aa, Homo Sapiens
LESTHASLY

SEQ ID NO: 859999 - protein, 9 aa, Homo Sapiens
TDTLEHKLR

SEQ ID NO: 860000 - protein, 9 aa, Homo Sapiens
PRLVLKIAD

SEQ ID NO: 860001 - protein, 9 aa, Homo Sapiens
GVHGSAKLY

SEQ ID NO: 860002 - protein, 9 aa, Homo Sapiens
KSRSNSGCV

SEQ ID NO: 860003 - protein, 9 aa, Homo Sapiens
DTGQLHSEA

SEQ ID NO: 860004 - protein, 9 aa, Homo Sapiens
RRFHCPIYY

SEQ ID NO: 860005 - protein, 9 aa, Homo Sapiens
ELDFLVPKV

SEQ ID NO: 860006 - protein, 9 aa, Homo Sapiens
GVARTSATV

SEQ ID NO: 860007 - protein, 9 aa, Homo Sapiens
FSFDNCQRN

SEQ ID NO: 860008 - protein, 9 aa, Homo Sapiens
ILGEITCAL

SEQ ID NO: 860009 - protein, 9 aa, Homo Sapiens
SQRGTLENY

SEQ ID NO: 860010 - protein, 9 aa, Homo Sapiens
QQELDHIKK

SEQ ID NO: 860011 - protein, 9 aa, Homo Sapiens
RHLFQIKHL

SEQ ID NO: 860012 - protein, 9 aa, Homo Sapiens
QGESPAWEC

SEQ ID NO: 860013 - protein, 9 aa, Homo Sapiens
DSNDYGDNE

SEQ ID NO: 860014 - protein, 9 aa, Homo Sapiens
LNTNFKKIY

SEQ ID NO: 860015 - protein, 9 aa, Homo Sapiens
SNVKPRKLR

SEQ ID NO: 860016 - protein, 9 aa, Homo Sapiens
LIQGYAEGV

SEQ ID NO: 860017 - protein, 9 aa, Homo Sapiens
TLSSHKISH

SEQ ID NO: 860018 - protein, 9 aa, Homo Sapiens
VLAADSANG

SEQ ID NO: 860019 - protein, 9 aa, Homo Sapiens
WIIHTGEKP

SEQ ID NO: 860020 - protein, 9 aa, Homo Sapiens
FIQEMPNVT

SEQ ID NO: 860021 - protein, 9 aa, Homo Sapiens
ISCIFPASW

SEQ ID NO: 860022 - protein, 9 aa, Homo Sapiens
KLQRDTSYW

SEQ ID NO: 860023 - protein, 9 aa, Homo Sapiens
IRCKRKLGL

SEQ ID NO: 860024 - protein, 9 aa, Homo Sapiens
FENHMYIFK

SEQ ID NO: 860025 - protein, 9 aa, Homo Sapiens
LFMKESSTA

SEQ ID NO: 860026 - protein, 9 aa, Homo Sapiens
SANLHGGYL

SEQ ID NO: 860027 - protein, 9 aa, Homo Sapiens
DGEEDNQKR

SEQ ID NO: 860028 - protein, 9 aa, Homo Sapiens
IKLKMNYRV

SEQ ID NO: 860029 - protein, 9 aa, Homo Sapiens
PGFNQRLLL

SEQ ID NO: 860030 - protein, 9 aa, Homo Sapiens
KHSGSDYSG

SEQ ID NO: 860031 - protein, 9 aa, Homo Sapiens
SLLGIAVGL

SEQ ID NO: 860032 - protein, 9 aa, Homo Sapiens
RQFDYRDPV

SEQ ID NO: 860033 - protein, 9 aa, Homo Sapiens
ESSGVQHVR

SEQ ID NO: 860034 - protein, 9 aa, Homo Sapiens
LQIVHQPWI

SEQ ID NO: 860035 - protein, 9 aa, Homo Sapiens
TSYSDESED

SEQ ID NO: 860036 - protein, 9 aa, Homo Sapiens
SGKDKSPKF

SEQ ID NO: 860037 - protein, 9 aa, Homo Sapiens
QLEEETRRQ

SEQ ID NO: 860038 - protein, 9 aa, Homo Sapiens
PIIPAFSNQ

SEQ ID NO: 860039 - protein, 9 aa, Homo Sapiens
KDVFNSKNE

SEQ ID NO: 860040 - protein, 9 aa, Homo Sapiens
QFLRFGKTK

SEQ ID NO: 860041 - protein, 9 aa, Homo Sapiens
TYRHASSLL

SEQ ID NO: 860042 - protein, 9 aa, Homo Sapiens
KLCWEYYDY

SEQ ID NO: 860043 - protein, 9 aa, Homo Sapiens
QLQELRYEE

SEQ ID NO: 860044 - protein, 9 aa, Homo Sapiens
KCIVETEHL

SEQ ID NO: 860045 - protein, 9 aa, Homo Sapiens
QEQVDTGLE

SEQ ID NO: 860046 - protein, 9 aa, Homo Sapiens
LSERVVDYI

SEQ ID NO: 860047 - protein, 9 aa, Homo Sapiens
RRKAAYWKA

SEQ ID NO: 860048 - protein, 9 aa, Homo Sapiens
PPIVQPLHF

SEQ ID NO: 860049 - protein, 9 aa, Homo Sapiens
TNSYGVLEF

SEQ ID NO: 860050 - protein, 9 aa, Homo Sapiens
QAYSEVDGQ

SEQ ID NO: 860051 - protein, 9 aa, Homo Sapiens
GEKLFKCNE

SEQ ID NO: 860052 - protein, 9 aa, Homo Sapiens
NFDKSMDPF

SEQ ID NO: 860053 - protein, 9 aa, Homo Sapiens
DTILLLNPA

SEQ ID NO: 860054 - protein, 9 aa, Homo Sapiens
MVTNTIEDN

SEQ ID NO: 860055 - protein, 9 aa, Homo Sapiens
GMTFIAGYL

SEQ ID NO: 860056 - protein, 9 aa, Homo Sapiens
MRDRAAAAR

SEQ ID NO: 860057 - protein, 9 aa, Homo Sapiens
NISTDRNAS

SEQ ID NO: 860058 - protein, 9 aa, Homo Sapiens
LQFDGALNV

SEQ ID NO: 860059 - protein, 9 aa, Homo Sapiens
FKVVETYPS

SEQ ID NO: 860060 - protein, 9 aa, Homo Sapiens
VKKCSETWK

SEQ ID NO: 860061 - protein, 9 aa, Homo Sapiens
VKKAPEKTI

SEQ ID NO: 860062 - protein, 9 aa, Homo Sapiens
INLMRQKKI

SEQ ID NO: 860063 - protein, 9 aa, Homo Sapiens
GMDRVDSEI

SEQ ID NO: 860064 - protein, 9 aa, Homo Sapiens
QTWSHSYML

SEQ ID NO: 860065 - protein, 9 aa, Homo Sapiens
SEENFPNGK

SEQ ID NO: 860066 - protein, 9 aa, Homo Sapiens
TFPEMQRRD

SEQ ID NO: 860067 - protein, 9 aa, Homo Sapiens
DKFYKCEVC

SEQ ID NO: 860068 - protein, 9 aa, Homo Sapiens
DTNPRPGSC

SEQ ID NO: 860069 - protein, 9 aa, Homo Sapiens
EYLDNTVFG

SEQ ID NO: 860070 - protein, 9 aa, Homo Sapiens
VGMWVVRGV

SEQ ID NO: 860071 - protein, 9 aa, Homo Sapiens
TVTAMGVVY

SEQ ID NO: 860072 - protein, 9 aa, Homo Sapiens
ETLIHNRTN

SEQ ID NO: 860073 - protein, 9 aa, Homo Sapiens
TSAGTGPSS

SEQ ID NO: 860074 - protein, 9 aa, Homo Sapiens
CEGPGMEIT

SEQ ID NO: 860075 - protein, 9 aa, Homo Sapiens
HADPEKEDC

SEQ ID NO: 860076 - protein, 9 aa, Homo Sapiens
CFRGKLLLK

SEQ ID NO: 860077 - protein, 9 aa, Homo Sapiens
VFPMFNPIM

SEQ ID NO: 860078 - protein, 9 aa, Homo Sapiens
TFLGVMADG

SEQ ID NO: 860079 - protein, 9 aa, Homo Sapiens
HQLMLIRQD

SEQ ID NO: 860080 - protein, 9 aa, Homo Sapiens
KDESDSAVK

SEQ ID NO: 860081 - protein, 9 aa, Homo Sapiens
TSVENLFCF

SEQ ID NO: 860082 - protein, 9 aa, Homo Sapiens
NNKHLNNIN

SEQ ID NO: 860083 - protein, 9 aa, Homo Sapiens
CKDKRVLVI

SEQ ID NO: 860084 - protein, 9 aa, Homo Sapiens
SLSQVSQFV

SEQ ID NO: 860085 - protein, 9 aa, Homo Sapiens
SGKHYWDVD

SEQ ID NO: 860086 - protein, 9 aa, Homo Sapiens
ILAIQSFQV

SEQ ID NO: 860087 - protein, 9 aa, Homo Sapiens
STKHPEKTT

SEQ ID NO: 860088 - protein, 9 aa, Homo Sapiens
IPYFPSLKE

SEQ ID NO: 860089 - protein, 9 aa, Homo Sapiens
KKTPPRSVK

SEQ ID NO: 860090 - protein, 9 aa, Homo Sapiens
SLLGGEPRM

SEQ ID NO: 860091 - protein, 9 aa, Homo Sapiens
GITPGLVGL

SEQ ID NO: 860092 - protein, 9 aa, Homo Sapiens
MKLIVIHFP

SEQ ID NO: 860093 - protein, 9 aa, Homo Sapiens
MEPICKQNF

SEQ ID NO: 860094 - protein, 9 aa, Homo Sapiens
LNCVDFANV

SEQ ID NO: 860095 - protein, 9 aa, Homo Sapiens
NAELLTEKE

SEQ ID NO: 860096 - protein, 9 aa, Homo Sapiens
GRGAAASSP

SEQ ID NO: 860097 - protein, 9 aa, Homo Sapiens
QDGDNDEDT

SEQ ID NO: 860098 - protein, 9 aa, Homo Sapiens
EHPQVVYKS

SEQ ID NO: 860099 - protein, 9 aa, Homo Sapiens
DENTVNMSW

SEQ ID NO: 860100 - protein, 9 aa, Homo Sapiens
HESFTATAK

SEQ ID NO: 860101 - protein, 9 aa, Homo Sapiens
QQAQQQLPR

SEQ ID NO: 860102 - protein, 9 aa, Homo Sapiens
QKFSPPLIG

SEQ ID NO: 860103 - protein, 9 aa, Homo Sapiens
NASCGLCGL

SEQ ID NO: 860104 - protein, 9 aa, Homo Sapiens
TSQNHSCTP

SEQ ID NO: 860105 - protein, 9 aa, Homo Sapiens
RMKLEQERP

SEQ ID NO: 860106 - protein, 9 aa, Homo Sapiens
HDNGSHFFF

SEQ ID NO: 860107 - protein, 9 aa, Homo Sapiens
PPDFQGAQE

SEQ ID NO: 860108 - protein, 9 aa, Homo Sapiens
SSKVKLLRN

SEQ ID NO: 860109 - protein, 9 aa, Homo Sapiens
ALCVTACPR

SEQ ID NO: 860110 - protein, 9 aa, Homo Sapiens
TRQDTALEG

SEQ ID NO: 860111 - protein, 9 aa, Homo Sapiens
ELDDESVCI

SEQ ID NO: 860112 - protein, 9 aa, Homo Sapiens
LMLDFNFGA

SEQ ID NO: 860113 - protein, 9 aa, Homo Sapiens
NDEGAVLSF

SEQ ID NO: 860114 - protein, 9 aa, Homo Sapiens
SGALLYGGP

SEQ ID NO: 860115 - protein, 9 aa, Homo Sapiens
VSASRDTTI

SEQ ID NO: 860116 - protein, 9 aa, Homo Sapiens
KIQPLWRHY

SEQ ID NO: 860117 - protein, 9 aa, Homo Sapiens
QGYAWIFIA

SEQ ID NO: 860118 - protein, 9 aa, Homo Sapiens
LVPLVCKSA

SEQ ID NO: 860119 - protein, 9 aa, Homo Sapiens
PEKNIPITP

SEQ ID NO: 860120 - protein, 9 aa, Homo Sapiens
KLFIKRTRL

SEQ ID NO: 860121 - protein, 9 aa, Homo Sapiens
RNLFSRHQS

SEQ ID NO: 860122 - protein, 9 aa, Homo Sapiens
EGADYVSSR

SEQ ID NO: 860123 - protein, 9 aa, Homo Sapiens
VGAPSHGAL

SEQ ID NO: 860124 - protein, 9 aa, Homo Sapiens
TNADVYYYH

SEQ ID NO: 860125 - protein, 9 aa, Homo Sapiens
LLKQGHTRQ

SEQ ID NO: 860126 - protein, 9 aa, Homo Sapiens
FIDNKSMSQ

SEQ ID NO: 860127 - protein, 9 aa, Homo Sapiens
EDNFPLGTV

SEQ ID NO: 860128 - protein, 9 aa, Homo Sapiens
YDIEITIIK

SEQ ID NO: 860129 - protein, 9 aa, Homo Sapiens
WFSQKASLS

SEQ ID NO: 860130 - protein, 9 aa, Homo Sapiens
LPKDPAGPC

SEQ ID NO: 860131 - protein, 9 aa, Homo Sapiens
DLVSIPGMG

SEQ ID NO: 860132 - protein, 9 aa, Homo Sapiens
DHLHPYMPE

SEQ ID NO: 860133 - protein, 9 aa, Homo Sapiens
REEDISELK

SEQ ID NO: 860134 - protein, 9 aa, Homo Sapiens
EKRDLINFL

SEQ ID NO: 860135 - protein, 9 aa, Homo Sapiens
VLEIKRRYH

SEQ ID NO: 860136 - protein, 9 aa, Homo Sapiens
TVTYLAWRC

SEQ ID NO: 860137 - protein, 9 aa, Homo Sapiens
SDHFQIHTG

SEQ ID NO: 860138 - protein, 9 aa, Homo Sapiens
RDMIGPENT

SEQ ID NO: 860139 - protein, 9 aa, Homo Sapiens
PMKAPKRMI

SEQ ID NO: 860140 - protein, 9 aa, Homo Sapiens
GPGDGPSYG

SEQ ID NO: 860141 - protein, 9 aa, Homo Sapiens
EVGNYLGVQ

SEQ ID NO: 860142 - protein, 9 aa, Homo Sapiens
SQSLPKKVY

SEQ ID NO: 860143 - protein, 9 aa, Homo Sapiens
KLYTNSFLN

SEQ ID NO: 860144 - protein, 9 aa, Homo Sapiens
QDISSLHYE

SEQ ID NO: 860145 - protein, 9 aa, Homo Sapiens
ALKDFTTKG

SEQ ID NO: 860146 - protein, 9 aa, Homo Sapiens
DSFNFNSQN

SEQ ID NO: 860147 - protein, 9 aa, Homo Sapiens
VTDGQDSPA

SEQ ID NO: 860148 - protein, 9 aa, Homo Sapiens
DKLIKDSSD

SEQ ID NO: 860149 - protein, 9 aa, Homo Sapiens
YRIYVTVKE

SEQ ID NO: 860150 - protein, 9 aa, Homo Sapiens
IRKISDSIS

SEQ ID NO: 860151 - protein, 9 aa, Homo Sapiens
GSAVLIREE

SEQ ID NO: 860152 - protein, 9 aa, Homo Sapiens
EAGNDLYDG

SEQ ID NO: 860153 - protein, 9 aa, Homo Sapiens
QIPQTEEKP

SEQ ID NO: 860154 - protein, 9 aa, Homo Sapiens
GVPVFIHFQ

SEQ ID NO: 860155 - protein, 9 aa, Homo Sapiens
AADAMAHLS

SEQ ID NO: 860156 - protein, 9 aa, Homo Sapiens
SKVIRQYLD

SEQ ID NO: 860157 - protein, 9 aa, Homo Sapiens
VTLGRVDNL

SEQ ID NO: 860158 - protein, 9 aa, Homo Sapiens
AKKHEDERE

SEQ ID NO: 860159 - protein, 9 aa, Homo Sapiens
DLRTFRVLR

SEQ ID NO: 860160 - protein, 9 aa, Homo Sapiens
CLWKSRQHS

SEQ ID NO: 860161 - protein, 9 aa, Homo Sapiens
PTALLLIVS

SEQ ID NO: 860162 - protein, 9 aa, Homo Sapiens
EHIRLEKEM

SEQ ID NO: 860163 - protein, 9 aa, Homo Sapiens
DGVRGVLSR

SEQ ID NO: 860164 - protein, 9 aa, Homo Sapiens
KQATKQHLT

SEQ ID NO: 860165 - protein, 9 aa, Homo Sapiens
SIKYCLGCI

SEQ ID NO: 860166 - protein, 9 aa, Homo Sapiens
KLEAIARPV

SEQ ID NO: 860167 - protein, 9 aa, Homo Sapiens
EEKRAKLHE

SEQ ID NO: 860168 - protein, 9 aa, Homo Sapiens
TSNHQLFLI

SEQ ID NO: 860169 - protein, 9 aa, Homo Sapiens
EHESPRAAN

SEQ ID NO: 860170 - protein, 9 aa, Homo Sapiens
ELYKDVRQI

SEQ ID NO: 860171 - protein, 9 aa, Homo Sapiens
ILRINRGNC

SEQ ID NO: 860172 - protein, 9 aa, Homo Sapiens
HLQNIENVP

SEQ ID NO: 860173 - protein, 9 aa, Homo Sapiens
PAAARRSKS

SEQ ID NO: 860174 - protein, 9 aa, Homo Sapiens
KTDARRPSN

SEQ ID NO: 860175 - protein, 9 aa, Homo Sapiens
EQCIQWLVK

SEQ ID NO: 860176 - protein, 9 aa, Homo Sapiens
KIHPGEKPF

SEQ ID NO: 860177 - protein, 9 aa, Homo Sapiens
PKPLPNDGY

SEQ ID NO: 860178 - protein, 9 aa, Homo Sapiens
PVFSYDAIL

SEQ ID NO: 860179 - protein, 9 aa, Homo Sapiens
KLEENHIQV

SEQ ID NO: 860180 - protein, 9 aa, Homo Sapiens
TLSEFYQWI

SEQ ID NO: 860181 - protein, 9 aa, Homo Sapiens
PELLYPNIA

SEQ ID NO: 860182 - protein, 9 aa, Homo Sapiens
HHKLHTADK

SEQ ID NO: 860183 - protein, 9 aa, Homo Sapiens
ADIFRQIAE

SEQ ID NO: 860184 - protein, 9 aa, Homo Sapiens
STTNMKTAD

SEQ ID NO: 860185 - protein, 9 aa, Homo Sapiens
KHSSSLFKT

SEQ ID NO: 860186 - protein, 9 aa, Homo Sapiens
YMSLFSFIG

SEQ ID NO: 860187 - protein, 9 aa, Homo Sapiens
VHKRVNTGE

SEQ ID NO: 860188 - protein, 9 aa, Homo Sapiens
TDCSFIVLY

SEQ ID NO: 860189 - protein, 9 aa, Homo Sapiens
FGRGYTGLG

SEQ ID NO: 860190 - protein, 9 aa, Homo Sapiens
PQKGKEGSL

SEQ ID NO: 860191 - protein, 9 aa, Homo Sapiens
AVVFGGFSL

SEQ ID NO: 860192 - protein, 9 aa, Homo Sapiens
ISKSPDSYQ

SEQ ID NO: 860193 - protein, 9 aa, Homo Sapiens
WTGIRPSTI

SEQ ID NO: 860194 - protein, 9 aa, Homo Sapiens
EIQPIDRQA

SEQ ID NO: 860195 - protein, 9 aa, Homo Sapiens
LPQESMSAS

SEQ ID NO: 860196 - protein, 9 aa, Homo Sapiens
FLDSHPKLL

SEQ ID NO: 860197 - protein, 9 aa, Homo Sapiens
PRNPDPQGL

SEQ ID NO: 860198 - protein, 9 aa, Homo Sapiens
KASYHLKIT

SEQ ID NO: 860199 - protein, 9 aa, Homo Sapiens
GIHLGEGSY

SEQ ID NO: 860200 - protein, 9 aa, Homo Sapiens
SSSARRPSL

SEQ ID NO: 860201 - protein, 9 aa, Homo Sapiens
SLAPQDSHG

SEQ ID NO: 860202 - protein, 9 aa, Homo Sapiens
SRQISGGFD

SEQ ID NO: 860203 - protein, 9 aa, Homo Sapiens
PSPLMQTGD

SEQ ID NO: 860204 - protein, 9 aa, Homo Sapiens
QHSQVPSSL

SEQ ID NO: 860205 - protein, 9 aa, Homo Sapiens
KICFINMAG

SEQ ID NO: 860206 - protein, 9 aa, Homo Sapiens
ESPAWECVG

SEQ ID NO: 860207 - protein, 9 aa, Homo Sapiens
PQKQALFKT

SEQ ID NO: 860208 - protein, 9 aa, Homo Sapiens
RLKLPGKRY

SEQ ID NO: 860209 - protein, 9 aa, Homo Sapiens
LRRTMEKEL

SEQ ID NO: 860210 - protein, 9 aa, Homo Sapiens
NGVVYNDSA

SEQ ID NO: 860211 - protein, 9 aa, Homo Sapiens
RNLGLYTDQ

SEQ ID NO: 860212 - protein, 9 aa, Homo Sapiens
TKKFPNHYS

SEQ ID NO: 860213 - protein, 9 aa, Homo Sapiens
LCTVNETHN

SEQ ID NO: 860214 - protein, 9 aa, Homo Sapiens
GGKVVSLLL

SEQ ID NO: 860215 - protein, 9 aa, Homo Sapiens
HDYTIFEIF

SEQ ID NO: 860216 - protein, 9 aa, Homo Sapiens
DFEDYPMRM

SEQ ID NO: 860217 - protein, 9 aa, Homo Sapiens
LFTTEEEII

SEQ ID NO: 860218 - protein, 9 aa, Homo Sapiens
LNMTTRGEY

SEQ ID NO: 860219 - protein, 9 aa, Homo Sapiens
IIRWCLLQL

SEQ ID NO: 860220 - protein, 9 aa, Homo Sapiens
KSNYEIRIC

SEQ ID NO: 860221 - protein, 9 aa, Homo Sapiens
PQIPNYHNM

SEQ ID NO: 860222 - protein, 9 aa, Homo Sapiens
NEIKIFSKT

SEQ ID NO: 860223 - protein, 9 aa, Homo Sapiens
HMGTAVGRS

SEQ ID NO: 860224 - protein, 9 aa, Homo Sapiens
HGIIHTGEK

SEQ ID NO: 860225 - protein, 9 aa, Homo Sapiens
ENVSKKENL

SEQ ID NO: 860226 - protein, 9 aa, Homo Sapiens
DVLCAAVFL

SEQ ID NO: 860227 - protein, 9 aa, Homo Sapiens
KITKDIMKI

SEQ ID NO: 860228 - protein, 9 aa, Homo Sapiens
KPKKPFFLG

SEQ ID NO: 860229 - protein, 9 aa, Homo Sapiens
SIHFYLKQS

SEQ ID NO: 860230 - protein, 9 aa, Homo Sapiens
QVVSKLWVP

SEQ ID NO: 860231 - protein, 9 aa, Homo Sapiens
TVFRSSQEK

SEQ ID NO: 860232 - protein, 9 aa, Homo Sapiens
SPEEKTLDC

SEQ ID NO: 860233 - protein, 9 aa, Homo Sapiens
QDDDFFNEL

SEQ ID NO: 860234 - protein, 9 aa, Homo Sapiens
LMLVMVECF

SEQ ID NO: 860235 - protein, 9 aa, Homo Sapiens
STFEDSEIR

SEQ ID NO: 860236 - protein, 9 aa, Homo Sapiens
RLPPPLPPP

SEQ ID NO: 860237 - protein, 9 aa, Homo Sapiens
PLCCDSRAS

SEQ ID NO: 860238 - protein, 9 aa, Homo Sapiens
IMKSADVDK

SEQ ID NO: 860239 - protein, 9 aa, Homo Sapiens
YRDIVNINI

SEQ ID NO: 860240 - protein, 9 aa, Homo Sapiens
TDSLTTLPI

SEQ ID NO: 860241 - protein, 9 aa, Homo Sapiens
FIDYPEKED

SEQ ID NO: 860242 - protein, 9 aa, Homo Sapiens
VFITKKFPN

SEQ ID NO: 860243 - protein, 9 aa, Homo Sapiens
IAYFTGNAQ

SEQ ID NO: 860244 - protein, 9 aa, Homo Sapiens
ALNTAYTYA

SEQ ID NO: 860245 - protein, 9 aa, Homo Sapiens
NIQGSIVAN

SEQ ID NO: 860246 - protein, 9 aa, Homo Sapiens
LESRGLYYN

SEQ ID NO: 860247 - protein, 9 aa, Homo Sapiens
TMSKIVELE

SEQ ID NO: 860248 - protein, 9 aa, Homo Sapiens
DDKDTIDKL

SEQ ID NO: 860249 - protein, 9 aa, Homo Sapiens
APRNPDPQG

SEQ ID NO: 860250 - protein, 9 aa, Homo Sapiens
LEPIPCEVM

SEQ ID NO: 860251 - protein, 9 aa, Homo Sapiens
LFDPNSCPG

SEQ ID NO: 860252 - protein, 9 aa, Homo Sapiens
YIILTIFRM

SEQ ID NO: 860253 - protein, 9 aa, Homo Sapiens
KQQNTIKYM

SEQ ID NO: 860254 - protein, 9 aa, Homo Sapiens
MLSSLPVIY

SEQ ID NO: 860255 - protein, 9 aa, Homo Sapiens
YFCYYYFIC

SEQ ID NO: 860256 - protein, 9 aa, Homo Sapiens
AAIILSTYL

SEQ ID NO: 860257 - protein, 9 aa, Homo Sapiens
HECQRCNCN

SEQ ID NO: 860258 - protein, 9 aa, Homo Sapiens
KENHATFIN

SEQ ID NO: 860259 - protein, 9 aa, Homo Sapiens
SELSKWSFE

SEQ ID NO: 860260 - protein, 9 aa, Homo Sapiens
TTTGIMNKP

SEQ ID NO: 860261 - protein, 9 aa, Homo Sapiens
GNGISRIQY

SEQ ID NO: 860262 - protein, 9 aa, Homo Sapiens
SIKLCPALK

SEQ ID NO: 860263 - protein, 9 aa, Homo Sapiens
ILNKRKDHK

SEQ ID NO: 860264 - protein, 9 aa, Homo Sapiens
PLHNDPHLE

SEQ ID NO: 860265 - protein, 9 aa, Homo Sapiens
RVVLLAEGC

SEQ ID NO: 860266 - protein, 9 aa, Homo Sapiens
DYISPGKES

SEQ ID NO: 860267 - protein, 9 aa, Homo Sapiens
IPLRFVELQ

SEQ ID NO: 860268 - protein, 9 aa, Homo Sapiens
GCIAFSTNP

SEQ ID NO: 860269 - protein, 9 aa, Homo Sapiens
FILKSQLVQ

SEQ ID NO: 860270 - protein, 9 aa, Homo Sapiens
LNNLESKKL

SEQ ID NO: 860271 - protein, 9 aa, Homo Sapiens
TPCLYTFPD

SEQ ID NO: 860272 - protein, 9 aa, Homo Sapiens
NWFINARRI

SEQ ID NO: 860273 - protein, 9 aa, Homo Sapiens
RGCVIRNTN

SEQ ID NO: 860274 - protein, 9 aa, Homo Sapiens
IRICRPCEI

SEQ ID NO: 860275 - protein, 9 aa, Homo Sapiens
LFIIILTFV

SEQ ID NO: 860276 - protein, 9 aa, Homo Sapiens
GDTINRQIV

SEQ ID NO: 860277 - protein, 9 aa, Homo Sapiens
ELALTSLFS

SEQ ID NO: 860278 - protein, 9 aa, Homo Sapiens
VNTFLRQLC

SEQ ID NO: 860279 - protein, 9 aa, Homo Sapiens
TKADGSFHL

SEQ ID NO: 860280 - protein, 9 aa, Homo Sapiens
FGRRFIIRW

SEQ ID NO: 860281 - protein, 9 aa, Homo Sapiens
PQNSKIFFL

SEQ ID NO: 860282 - protein, 9 aa, Homo Sapiens
FKKIKYFEV

SEQ ID NO: 860283 - protein, 9 aa, Homo Sapiens
EHIHREREE

SEQ ID NO: 860284 - protein, 9 aa, Homo Sapiens
TSTFEEVIF

SEQ ID NO: 860285 - protein, 9 aa, Homo Sapiens
LFYKGVYYQ

SEQ ID NO: 860286 - protein, 9 aa, Homo Sapiens
IAKPEMNVR

SEQ ID NO: 860287 - protein, 9 aa, Homo Sapiens
CLKYAYEEQ

SEQ ID NO: 860288 - protein, 9 aa, Homo Sapiens
WIWKMEASY

SEQ ID NO: 860289 - protein, 9 aa, Homo Sapiens
LWTISMKVA

SEQ ID NO: 860290 - protein, 9 aa, Homo Sapiens
NKGAMVIYT

SEQ ID NO: 860291 - protein, 9 aa, Homo Sapiens
NEVQDYASV

SEQ ID NO: 860292 - protein, 9 aa, Homo Sapiens
GEKPCECQQ

SEQ ID NO: 860293 - protein, 9 aa, Homo Sapiens
GSAKLYISD

SEQ ID NO: 860294 - protein, 9 aa, Homo Sapiens
NKLQKLELS

SEQ ID NO: 860295 - protein, 9 aa, Homo Sapiens
KAIPVANIN

SEQ ID NO: 860296 - protein, 9 aa, Homo Sapiens
DFRTFLSSL

SEQ ID NO: 860297 - protein, 9 aa, Homo Sapiens
ANIGLPISP

SEQ ID NO: 860298 - protein, 9 aa, Homo Sapiens
GFRVRKITC

SEQ ID NO: 860299 - protein, 9 aa, Homo Sapiens
EHVERHFRT

SEQ ID NO: 860300 - protein, 9 aa, Homo Sapiens
LENKLKAAY

SEQ ID NO: 860301 - protein, 9 aa, Homo Sapiens
GDLNQNEEN

SEQ ID NO: 860302 - protein, 9 aa, Homo Sapiens
DQEDDEQQI

SEQ ID NO: 860303 - protein, 9 aa, Homo Sapiens
AEVLGRCVI

SEQ ID NO: 860304 - protein, 9 aa, Homo Sapiens
FPALGEVSS

SEQ ID NO: 860305 - protein, 9 aa, Homo Sapiens
LSVQRDASL

SEQ ID NO: 860306 - protein, 9 aa, Homo Sapiens
WYSEPTSFK

SEQ ID NO: 860307 - protein, 9 aa, Homo Sapiens
LQKQANRKK

SEQ ID NO: 860308 - protein, 9 aa, Homo Sapiens
MGALHPRAG

SEQ ID NO: 860309 - protein, 9 aa, Homo Sapiens
FAHGPPLQA

SEQ ID NO: 860310 - protein, 9 aa, Homo Sapiens
LEAGNDLYD

SEQ ID NO: 860311 - protein, 9 aa, Homo Sapiens
GSIIRVLTS

SEQ ID NO: 860312 - protein, 9 aa, Homo Sapiens
SANVQSNLI

SEQ ID NO: 860313 - protein, 9 aa, Homo Sapiens
TVASLHVRQ

SEQ ID NO: 860314 - protein, 9 aa, Homo Sapiens
SSNKICSLP

SEQ ID NO: 860315 - protein, 9 aa, Homo Sapiens
HEKIHPGEK

SEQ ID NO: 860316 - protein, 9 aa, Homo Sapiens
GVKHQPPPI

SEQ ID NO: 860317 - protein, 9 aa, Homo Sapiens
LATFDLKVV

SEQ ID NO: 860318 - protein, 9 aa, Homo Sapiens
TQIATIAES

SEQ ID NO: 860319 - protein, 9 aa, Homo Sapiens
DIRLVRWLR

SEQ ID NO: 860320 - protein, 9 aa, Homo Sapiens
DPSKLMTPY

SEQ ID NO: 860321 - protein, 9 aa, Homo Sapiens
KNTNIDNFL

SEQ ID NO: 860322 - protein, 9 aa, Homo Sapiens
LAGCIHSLS

SEQ ID NO: 860323 - protein, 9 aa, Homo Sapiens
MKKQGVSPQ

SEQ ID NO: 860324 - protein, 9 aa, Homo Sapiens
LVAAVQDHG

SEQ ID NO: 860325 - protein, 9 aa, Homo Sapiens
PKELYHEVH

SEQ ID NO: 860326 - protein, 9 aa, Homo Sapiens
EVRAGYPRD

SEQ ID NO: 860327 - protein, 9 aa, Homo Sapiens
KAGCHLLTV

SEQ ID NO: 860328 - protein, 9 aa, Homo Sapiens
DEERYMTFN

SEQ ID NO: 860329 - protein, 9 aa, Homo Sapiens
DTNRIARAC

SEQ ID NO: 860330 - protein, 9 aa, Homo Sapiens
CEITEKTSK

SEQ ID NO: 860331 - protein, 9 aa, Homo Sapiens
LVVAHMTRS

SEQ ID NO: 860332 - protein, 9 aa, Homo Sapiens
FRTTFDSEN

SEQ ID NO: 860333 - protein, 9 aa, Homo Sapiens
IISGTCPDV

SEQ ID NO: 860334 - protein, 9 aa, Homo Sapiens
CLENVLSCT

SEQ ID NO: 860335 - protein, 9 aa, Homo Sapiens
QTVPLSRLL

SEQ ID NO: 860336 - protein, 9 aa, Homo Sapiens
NVLAYIKHL

SEQ ID NO: 860337 - protein, 9 aa, Homo Sapiens
LAVFNKALP

SEQ ID NO: 860338 - protein, 9 aa, Homo Sapiens
DTPRKQLQF

SEQ ID NO: 860339 - protein, 9 aa, Homo Sapiens
SYHLKAHRR

SEQ ID NO: 860340 - protein, 9 aa, Homo Sapiens
EVMWTKLPC

SEQ ID NO: 860341 - protein, 9 aa, Homo Sapiens
LKAVDQDNT

SEQ ID NO: 860342 - protein, 9 aa, Homo Sapiens
RHDCEEASK

SEQ ID NO: 860343 - protein, 9 aa, Homo Sapiens
AFIPHLPHL

SEQ ID NO: 860344 - protein, 9 aa, Homo Sapiens
YLIKVAIKI

SEQ ID NO: 860345 - protein, 9 aa, Homo Sapiens
KKLLQILSQ

SEQ ID NO: 860346 - protein, 9 aa, Homo Sapiens
QTTHEPVLK

SEQ ID NO: 860347 - protein, 9 aa, Homo Sapiens
LEKLRVDTS

SEQ ID NO: 860348 - protein, 9 aa, Homo Sapiens
SEAKQVPRA

SEQ ID NO: 860349 - protein, 9 aa, Homo Sapiens
NQMLQYFIT

SEQ ID NO: 860350 - protein, 9 aa, Homo Sapiens
NIIITPPTP

SEQ ID NO: 860351 - protein, 9 aa, Homo Sapiens
STNKISTAS

SEQ ID NO: 860352 - protein, 9 aa, Homo Sapiens
LGLQDKQGV

SEQ ID NO: 860353 - protein, 9 aa, Homo Sapiens
GPEGILGTI

SEQ ID NO: 860354 - protein, 9 aa, Homo Sapiens
FWLAVQYLK

SEQ ID NO: 860355 - protein, 9 aa, Homo Sapiens
LISIFGSSL

SEQ ID NO: 860356 - protein, 9 aa, Homo Sapiens
IRHHSSGSI

SEQ ID NO: 860357 - protein, 9 aa, Homo Sapiens
CTFGRGYTG

SEQ ID NO: 860358 - protein, 9 aa, Homo Sapiens
TQSLTYDNQ

SEQ ID NO: 860359 - protein, 9 aa, Homo Sapiens
NQEELIAIM

SEQ ID NO: 860360 - protein, 9 aa, Homo Sapiens
GITDNLTRD

SEQ ID NO: 860361 - protein, 9 aa, Homo Sapiens
EDTLCHFGF

SEQ ID NO: 860362 - protein, 9 aa, Homo Sapiens
PIAPTGEPL

SEQ ID NO: 860363 - protein, 9 aa, Homo Sapiens
TVEFTRDEW

SEQ ID NO: 860364 - protein, 9 aa, Homo Sapiens
LMDSGLPVI

SEQ ID NO: 860365 - protein, 9 aa, Homo Sapiens
PVFYTMVIL

SEQ ID NO: 860366 - protein, 9 aa, Homo Sapiens
PASEPQYSV

SEQ ID NO: 860367 - protein, 9 aa, Homo Sapiens
KKGYQDVNT

SEQ ID NO: 860368 - protein, 9 aa, Homo Sapiens
ESISAGSVS

SEQ ID NO: 860369 - protein, 9 aa, Homo Sapiens
IGEAPATLR

SEQ ID NO: 860370 - protein, 9 aa, Homo Sapiens
TCINPVHSK

SEQ ID NO: 860371 - protein, 9 aa, Homo Sapiens
NHWEYYLKQ

SEQ ID NO: 860372 - protein, 9 aa, Homo Sapiens
DNKCPCRVE

SEQ ID NO: 860373 - protein, 9 aa, Homo Sapiens
EMLLLTVMA

SEQ ID NO: 860374 - protein, 9 aa, Homo Sapiens
CGRWFSQKA

SEQ ID NO: 860375 - protein, 9 aa, Homo Sapiens
LSLPGPSKS

SEQ ID NO: 860376 - protein, 9 aa, Homo Sapiens
CWVFTSVMC

SEQ ID NO: 860377 - protein, 9 aa, Homo Sapiens
AKLQGIPRY

SEQ ID NO: 860378 - protein, 9 aa, Homo Sapiens
AIRRSDLYE

SEQ ID NO: 860379 - protein, 9 aa, Homo Sapiens
PRQTAPRPR

SEQ ID NO: 860380 - protein, 9 aa, Homo Sapiens
NKSSVRLLI

SEQ ID NO: 860381 - protein, 9 aa, Homo Sapiens
WIYGLGLCS

SEQ ID NO: 860382 - protein, 9 aa, Homo Sapiens
AGDHLSDTS

SEQ ID NO: 860383 - protein, 9 aa, Homo Sapiens
LPDSCSTDF

SEQ ID NO: 860384 - protein, 9 aa, Homo Sapiens
KVTEPLARE

SEQ ID NO: 860385 - protein, 9 aa, Homo Sapiens
LLGYLAMVI

SEQ ID NO: 860386 - protein, 9 aa, Homo Sapiens
LGVKVKGPR

SEQ ID NO: 860387 - protein, 9 aa, Homo Sapiens
EIARAEEHQ

SEQ ID NO: 860388 - protein, 9 aa, Homo Sapiens
YHNGDPFYA

SEQ ID NO: 860389 - protein, 9 aa, Homo Sapiens
GYMGENLPV

SEQ ID NO: 860390 - protein, 9 aa, Homo Sapiens
ITTDIIITE

SEQ ID NO: 860391 - protein, 9 aa, Homo Sapiens
LQYNSFPLL

SEQ ID NO: 860392 - protein, 9 aa, Homo Sapiens
REISKRQFK

SEQ ID NO: 860393 - protein, 9 aa, Homo Sapiens
IRQRFPQLT

SEQ ID NO: 860394 - protein, 9 aa, Homo Sapiens
LGIHLPCVQ

SEQ ID NO: 860395 - protein, 9 aa, Homo Sapiens
NSILREMLS

SEQ ID NO: 860396 - protein, 9 aa, Homo Sapiens
EDKLLPGLD

SEQ ID NO: 860397 - protein, 9 aa, Homo Sapiens
SSYYRHNFA

SEQ ID NO: 860398 - protein, 9 aa, Homo Sapiens
TVVAMHYSF

SEQ ID NO: 860399 - protein, 9 aa, Homo Sapiens
CGQRKKYAP

SEQ ID NO: 860400 - protein, 9 aa, Homo Sapiens
CSVLREWYA

SEQ ID NO: 860401 - protein, 9 aa, Homo Sapiens
KCNSYNNAG

SEQ ID NO: 860402 - protein, 9 aa, Homo Sapiens
QLLSTDAEA

SEQ ID NO: 860403 - protein, 9 aa, Homo Sapiens
MRDKSYECP

SEQ ID NO: 860404 - protein, 9 aa, Homo Sapiens
SQFKEHQQI

SEQ ID NO: 860405 - protein, 9 aa, Homo Sapiens
VGFFCPICS

SEQ ID NO: 860406 - protein, 9 aa, Homo Sapiens
LIRLQELRI

SEQ ID NO: 860407 - protein, 9 aa, Homo Sapiens
NKDAGLFRS

SEQ ID NO: 860408 - protein, 9 aa, Homo Sapiens
FLGSRVAEL

SEQ ID NO: 860409 - protein, 9 aa, Homo Sapiens
DVPTNNQQV

SEQ ID NO: 860410 - protein, 9 aa, Homo Sapiens
VFIQVPVRR

SEQ ID NO: 860411 - protein, 9 aa, Homo Sapiens
INSIFTHFH

SEQ ID NO: 860412 - protein, 9 aa, Homo Sapiens
LQTNFDPRL

SEQ ID NO: 860413 - protein, 9 aa, Homo Sapiens
ISFFLSKCQ

SEQ ID NO: 860414 - protein, 9 aa, Homo Sapiens
EILTQGQIH

SEQ ID NO: 860415 - protein, 9 aa, Homo Sapiens
TQELAVQVK

SEQ ID NO: 860416 - protein, 9 aa, Homo Sapiens
VPLVNSEGG

SEQ ID NO: 860417 - protein, 9 aa, Homo Sapiens
LIKMKGLQE

SEQ ID NO: 860418 - protein, 9 aa, Homo Sapiens
PCPCVHPCI

SEQ ID NO: 860419 - protein, 9 aa, Homo Sapiens
LCRLVYKDI

SEQ ID NO: 860420 - protein, 9 aa, Homo Sapiens
FGREELFGE

SEQ ID NO: 860421 - protein, 9 aa, Homo Sapiens
LVQICLALS

SEQ ID NO: 860422 - protein, 9 aa, Homo Sapiens
LPDMQMKDP

SEQ ID NO: 860423 - protein, 9 aa, Homo Sapiens
AYFTGNAQK

SEQ ID NO: 860424 - protein, 9 aa, Homo Sapiens
EMFTKKSEA

SEQ ID NO: 860425 - protein, 9 aa, Homo Sapiens
TDPGAKELP

SEQ ID NO: 860426 - protein, 9 aa, Homo Sapiens
GDVFNGRCH

SEQ ID NO: 860427 - protein, 9 aa, Homo Sapiens
MVLIAIWKH

SEQ ID NO: 860428 - protein, 9 aa, Homo Sapiens
TGIWKQWHE

SEQ ID NO: 860429 - protein, 9 aa, Homo Sapiens
HRMAKKNAI

SEQ ID NO: 860430 - protein, 9 aa, Homo Sapiens
GLKNQKLFD

SEQ ID NO: 860431 - protein, 9 aa, Homo Sapiens
AKINVDSNS

SEQ ID NO: 860432 - protein, 9 aa, Homo Sapiens
CDKYILSKQ

SEQ ID NO: 860433 - protein, 9 aa, Homo Sapiens
ITKCLFLGI

SEQ ID NO: 860434 - protein, 9 aa, Homo Sapiens
KKKRIHQQG

SEQ ID NO: 860435 - protein, 9 aa, Homo Sapiens
KTQTLPYRG

SEQ ID NO: 860436 - protein, 9 aa, Homo Sapiens
ILLPSPLTV

SEQ ID NO: 860437 - protein, 9 aa, Homo Sapiens
LGSVASMNS

SEQ ID NO: 860438 - protein, 9 aa, Homo Sapiens
TLFERQMQE

SEQ ID NO: 860439 - protein, 9 aa, Homo Sapiens
LSYCLLKAS

SEQ ID NO: 860440 - protein, 9 aa, Homo Sapiens
VRPRKCETH

SEQ ID NO: 860441 - protein, 9 aa, Homo Sapiens
FKRFTPRKG

SEQ ID NO: 860442 - protein, 9 aa, Homo Sapiens
RDFPKDVLV

SEQ ID NO: 860443 - protein, 9 aa, Homo Sapiens
KAVWMPSPV

SEQ ID NO: 860444 - protein, 9 aa, Homo Sapiens
FKCVKRLDE

SEQ ID NO: 860445 - protein, 9 aa, Homo Sapiens
HEQCIQWLV

SEQ ID NO: 860446 - protein, 9 aa, Homo Sapiens
KGDVWNMGV

SEQ ID NO: 860447 - protein, 9 aa, Homo Sapiens
AVHGEEMYC

SEQ ID NO: 860448 - protein, 9 aa, Homo Sapiens
DKPLDGTTS

SEQ ID NO: 860449 - protein, 9 aa, Homo Sapiens
LKFLVETFH

SEQ ID NO: 860450 - protein, 9 aa, Homo Sapiens
VLNASISKT

SEQ ID NO: 860451 - protein, 9 aa, Homo Sapiens
QLHKNQQLQ

SEQ ID NO: 860452 - protein, 9 aa, Homo Sapiens
FFMKTCFWG

SEQ ID NO: 860453 - protein, 9 aa, Homo Sapiens
IGNISYVVE

SEQ ID NO: 860454 - protein, 9 aa, Homo Sapiens
LEDYEGDDD

SEQ ID NO: 860455 - protein, 9 aa, Homo Sapiens
EGLGFNSMG

SEQ ID NO: 860456 - protein, 9 aa, Homo Sapiens
DEMGDMQKL

SEQ ID NO: 860457 - protein, 9 aa, Homo Sapiens
FRSSQEKRR

SEQ ID NO: 860458 - protein, 9 aa, Homo Sapiens
GTHECSLWG

SEQ ID NO: 860459 - protein, 9 aa, Homo Sapiens
HPLLAENDT

SEQ ID NO: 860460 - protein, 9 aa, Homo Sapiens
PVLQTNNDP

SEQ ID NO: 860461 - protein, 9 aa, Homo Sapiens
QYHKQLVNS

SEQ ID NO: 860462 - protein, 9 aa, Homo Sapiens
TPRLPAVDT

SEQ ID NO: 860463 - protein, 9 aa, Homo Sapiens
FGWSPNFQT

SEQ ID NO: 860464 - protein, 9 aa, Homo Sapiens
LYDVTRNSY

SEQ ID NO: 860465 - protein, 9 aa, Homo Sapiens
YAVMQEVPL

SEQ ID NO: 860466 - protein, 9 aa, Homo Sapiens
LMLSERLIE

SEQ ID NO: 860467 - protein, 9 aa, Homo Sapiens
NLEFRALLF

SEQ ID NO: 860468 - protein, 9 aa, Homo Sapiens
NVCKQCKNL

SEQ ID NO: 860469 - protein, 9 aa, Homo Sapiens
MRRVAGDKL

SEQ ID NO: 860470 - protein, 9 aa, Homo Sapiens
VDPSKLMTP

SEQ ID NO: 860471 - protein, 9 aa, Homo Sapiens
RKTKANVKE

SEQ ID NO: 860472 - protein, 9 aa, Homo Sapiens
QQPSYPGRA

SEQ ID NO: 860473 - protein, 9 aa, Homo Sapiens
SLAGLEVLC

SEQ ID NO: 860474 - protein, 9 aa, Homo Sapiens
WQKDAERRY

SEQ ID NO: 860475 - protein, 9 aa, Homo Sapiens
ESIKLKREY

SEQ ID NO: 860476 - protein, 9 aa, Homo Sapiens
RYKCAACGK

SEQ ID NO: 860477 - protein, 9 aa, Homo Sapiens
ARQFFLFNY

SEQ ID NO: 860478 - protein, 9 aa, Homo Sapiens
GNALLQLPD

SEQ ID NO: 860479 - protein, 9 aa, Homo Sapiens
FKESVFEKY

SEQ ID NO: 860480 - protein, 9 aa, Homo Sapiens
HVPDFILTG

SEQ ID NO: 860481 - protein, 9 aa, Homo Sapiens
AQQLLHNGK

SEQ ID NO: 860482 - protein, 9 aa, Homo Sapiens
ETEHLEERV

SEQ ID NO: 860483 - protein, 9 aa, Homo Sapiens
ASNKKKLED

SEQ ID NO: 860484 - protein, 9 aa, Homo Sapiens
AFLIFNILY

SEQ ID NO: 860485 - protein, 9 aa, Homo Sapiens
EEVCTSLTQ

SEQ ID NO: 860486 - protein, 9 aa, Homo Sapiens
KKLPEASDR

SEQ ID NO: 860487 - protein, 9 aa, Homo Sapiens
QLFFFCLFV

SEQ ID NO: 860488 - protein, 9 aa, Homo Sapiens
SHANILYSV

SEQ ID NO: 860489 - protein, 9 aa, Homo Sapiens
DECQPSQCH

SEQ ID NO: 860490 - protein, 9 aa, Homo Sapiens
DDKLEARLN

SEQ ID NO: 860491 - protein, 9 aa, Homo Sapiens
LTPCLYTFP

SEQ ID NO: 860492 - protein, 9 aa, Homo Sapiens
STLAHLDLS

SEQ ID NO: 860493 - protein, 9 aa, Homo Sapiens
KTAAEMVDL

SEQ ID NO: 860494 - protein, 9 aa, Homo Sapiens
LFPAKVVSH

SEQ ID NO: 860495 - protein, 9 aa, Homo Sapiens
PRMPQWRCR

SEQ ID NO: 860496 - protein, 9 aa, Homo Sapiens
HPHCLPYKL

SEQ ID NO: 860497 - protein, 9 aa, Homo Sapiens
NNKPHTVLK

SEQ ID NO: 860498 - protein, 9 aa, Homo Sapiens
YSNLKVPEE

SEQ ID NO: 860499 - protein, 9 aa, Homo Sapiens
IWAANTGVT

SEQ ID NO: 860500 - protein, 9 aa, Homo Sapiens
GICIKIADF

SEQ ID NO: 860501 - protein, 9 aa, Homo Sapiens
LLFHLLEFC

SEQ ID NO: 860502 - protein, 9 aa, Homo Sapiens
APAVDSLHT

SEQ ID NO: 860503 - protein, 9 aa, Homo Sapiens
RYEVARALN

SEQ ID NO: 860504 - protein, 9 aa, Homo Sapiens
RIQKGVDLL

SEQ ID NO: 860505 - protein, 9 aa, Homo Sapiens
LLKQCLEWD

SEQ ID NO: 860506 - protein, 9 aa, Homo Sapiens
YRDVTKNAL

SEQ ID NO: 860507 - protein, 9 aa, Homo Sapiens
EIINVDHIL

SEQ ID NO: 860508 - protein, 9 aa, Homo Sapiens
PLSVVCRFA

SEQ ID NO: 860509 - protein, 9 aa, Homo Sapiens
AKERDKSSL

SEQ ID NO: 860510 - protein, 9 aa, Homo Sapiens
IGQLLPGYE

SEQ ID NO: 860511 - protein, 9 aa, Homo Sapiens
CKAENSLGS

SEQ ID NO: 860512 - protein, 9 aa, Homo Sapiens
PGAAPGRAT

SEQ ID NO: 860513 - protein, 9 aa, Homo Sapiens
NIFQEHRGL

SEQ ID NO: 860514 - protein, 9 aa, Homo Sapiens
HKAFTGSIF

SEQ ID NO: 860515 - protein, 9 aa, Homo Sapiens
VRTRDANVI

SEQ ID NO: 860516 - protein, 9 aa, Homo Sapiens
SSILFNLAV

SEQ ID NO: 860517 - protein, 9 aa, Homo Sapiens
KKYLQTDDR

SEQ ID NO: 860518 - protein, 9 aa, Homo Sapiens
QREECGKRF

SEQ ID NO: 860519 - protein, 9 aa, Homo Sapiens
IKDNSSGYK

SEQ ID NO: 860520 - protein, 9 aa, Homo Sapiens
GLRERVKTS

SEQ ID NO: 860521 - protein, 9 aa, Homo Sapiens
PGNLQRHMV

SEQ ID NO: 860522 - protein, 9 aa, Homo Sapiens
ICDTLLVEE

SEQ ID NO: 860523 - protein, 9 aa, Homo Sapiens
KSLKKLDQL

SEQ ID NO: 860524 - protein, 9 aa, Homo Sapiens
IKARIELPW

SEQ ID NO: 860525 - protein, 9 aa, Homo Sapiens
PKPKFLKTS

SEQ ID NO: 860526 - protein, 9 aa, Homo Sapiens
SSPYATDVA

SEQ ID NO: 860527 - protein, 9 aa, Homo Sapiens
LTSVCCRSL

SEQ ID NO: 860528 - protein, 9 aa, Homo Sapiens
TANVTAKFK

SEQ ID NO: 860529 - protein, 9 aa, Homo Sapiens
SGGTVVSTN

SEQ ID NO: 860530 - protein, 9 aa, Homo Sapiens
NVTFVFDAV

SEQ ID NO: 860531 - protein, 9 aa, Homo Sapiens
LLPHWTKVV

SEQ ID NO: 860532 - protein, 9 aa, Homo Sapiens
HMKGKENLT

SEQ ID NO: 860533 - protein, 9 aa, Homo Sapiens
TRRLSSSVV

SEQ ID NO: 860534 - protein, 9 aa, Homo Sapiens
NNFGVVLAD

SEQ ID NO: 860535 - protein, 9 aa, Homo Sapiens
IRSTFQGEK

SEQ ID NO: 860536 - protein, 9 aa, Homo Sapiens
VAKCDEIYG

SEQ ID NO: 860537 - protein, 9 aa, Homo Sapiens
GSGPGSVCT

SEQ ID NO: 860538 - protein, 9 aa, Homo Sapiens
NSGSCFITG

SEQ ID NO: 860539 - protein, 9 aa, Homo Sapiens
GQVENLRLD

SEQ ID NO: 860540 - protein, 9 aa, Homo Sapiens
SYCLPCCRS

SEQ ID NO: 860541 - protein, 9 aa, Homo Sapiens
QNSRTNIKR

SEQ ID NO: 860542 - protein, 9 aa, Homo Sapiens
LILQYDMLH

SEQ ID NO: 860543 - protein, 9 aa, Homo Sapiens
SLPKYLIYG

SEQ ID NO: 860544 - protein, 9 aa, Homo Sapiens
QKQKAQDEP

SEQ ID NO: 860545 - protein, 9 aa, Homo Sapiens
IFFGFITFM

SEQ ID NO: 860546 - protein, 9 aa, Homo Sapiens
LKPMPFSIY

SEQ ID NO: 860547 - protein, 9 aa, Homo Sapiens
EHEDGYGDG

SEQ ID NO: 860548 - protein, 9 aa, Homo Sapiens
DLTEGKPTA

SEQ ID NO: 860549 - protein, 9 aa, Homo Sapiens
LATLGVSLS

SEQ ID NO: 860550 - protein, 9 aa, Homo Sapiens
YLEPLTILY

SEQ ID NO: 860551 - protein, 9 aa, Homo Sapiens
DLGTEHSSG

SEQ ID NO: 860552 - protein, 9 aa, Homo Sapiens
ISNHPKIQI

SEQ ID NO: 860553 - protein, 9 aa, Homo Sapiens
YAIIVSSIL

SEQ ID NO: 860554 - protein, 9 aa, Homo Sapiens
CGAVIMNGR

SEQ ID NO: 860555 - protein, 9 aa, Homo Sapiens
FTKTPIFQA

SEQ ID NO: 860556 - protein, 9 aa, Homo Sapiens
SMLRFPHLY

SEQ ID NO: 860557 - protein, 9 aa, Homo Sapiens
QVDSDLLGW

SEQ ID NO: 860558 - protein, 9 aa, Homo Sapiens
SEEDFEKAL

SEQ ID NO: 860559 - protein, 9 aa, Homo Sapiens
IEVVDKQLQ

SEQ ID NO: 860560 - protein, 9 aa, Homo Sapiens
KGKVKPEQL

SEQ ID NO: 860561 - protein, 9 aa, Homo Sapiens
NQRRYWELP

SEQ ID NO: 860562 - protein, 9 aa, Homo Sapiens
AQGPNTPGY

SEQ ID NO: 860563 - protein, 9 aa, Homo Sapiens
QQLVDKSGE

SEQ ID NO: 860564 - protein, 9 aa, Homo Sapiens
GSRVEGADD

SEQ ID NO: 860565 - protein, 9 aa, Homo Sapiens
CRSPCLDCP

SEQ ID NO: 860566 - protein, 9 aa, Homo Sapiens
YLETPTKSL

SEQ ID NO: 860567 - protein, 9 aa, Homo Sapiens
ESGPSSRGG

SEQ ID NO: 860568 - protein, 9 aa, Homo Sapiens
PSGPFRQQH

SEQ ID NO: 860569 - protein, 9 aa, Homo Sapiens
NSCPPKTYK

SEQ ID NO: 860570 - protein, 9 aa, Homo Sapiens
ALGISPFHD

SEQ ID NO: 860571 - protein, 9 aa, Homo Sapiens
LEKRDEQRP

SEQ ID NO: 860572 - protein, 9 aa, Homo Sapiens
EQTTETASC

SEQ ID NO: 860573 - protein, 9 aa, Homo Sapiens
AFSRSSTLV

SEQ ID NO: 860574 - protein, 9 aa, Homo Sapiens
RTLGKSNRN

SEQ ID NO: 860575 - protein, 9 aa, Homo Sapiens
QDQHMVQNG

SEQ ID NO: 860576 - protein, 9 aa, Homo Sapiens
TLLENMNKL

SEQ ID NO: 860577 - protein, 9 aa, Homo Sapiens
DIRRRLRML

SEQ ID NO: 860578 - protein, 9 aa, Homo Sapiens
SNKLETLPD

SEQ ID NO: 860579 - protein, 9 aa, Homo Sapiens
CSHCSGTRV

SEQ ID NO: 860580 - protein, 9 aa, Homo Sapiens
PCRTLILCA

SEQ ID NO: 860581 - protein, 9 aa, Homo Sapiens
TSQENNENK

SEQ ID NO: 860582 - protein, 9 aa, Homo Sapiens
KVTFSAVRS

SEQ ID NO: 860583 - protein, 9 aa, Homo Sapiens
WSTQIKTYY

SEQ ID NO: 860584 - protein, 9 aa, Homo Sapiens
DSEEEEIII

SEQ ID NO: 860585 - protein, 9 aa, Homo Sapiens
CLFVTEVCR

SEQ ID NO: 860586 - protein, 9 aa, Homo Sapiens
PEARKLIKK

SEQ ID NO: 860587 - protein, 9 aa, Homo Sapiens
LSLPCDAVL

SEQ ID NO: 860588 - protein, 9 aa, Homo Sapiens
LANHRIIHT

SEQ ID NO: 860589 - protein, 9 aa, Homo Sapiens
ADHAPGVGL

SEQ ID NO: 860590 - protein, 9 aa, Homo Sapiens
EELCQIQEP

SEQ ID NO: 860591 - protein, 9 aa, Homo Sapiens
KLKQARLII

SEQ ID NO: 860592 - protein, 9 aa, Homo Sapiens
NTFKAVGKS

SEQ ID NO: 860593 - protein, 9 aa, Homo Sapiens
DTSYWLQTT

SEQ ID NO: 860594 - protein, 9 aa, Homo Sapiens
RLKTVLAKQ

SEQ ID NO: 860595 - protein, 9 aa, Homo Sapiens
EALAENNLH

SEQ ID NO: 860596 - protein, 9 aa, Homo Sapiens
KSFHQLSHL

SEQ ID NO: 860597 - protein, 9 aa, Homo Sapiens
EDRGNGIKL

SEQ ID NO: 860598 - protein, 9 aa, Homo Sapiens
SHSWKINHS

SEQ ID NO: 860599 - protein, 9 aa, Homo Sapiens
AINTTVSQY

SEQ ID NO: 860600 - protein, 9 aa, Homo Sapiens
HSSNVIGGL

SEQ ID NO: 860601 - protein, 9 aa, Homo Sapiens
SCLTIFLDD

SEQ ID NO: 860602 - protein, 9 aa, Homo Sapiens
LSEHAKIEE

SEQ ID NO: 860603 - protein, 9 aa, Homo Sapiens
VLNWLISDL

SEQ ID NO: 860604 - protein, 9 aa, Homo Sapiens
VTPLLNAGG

SEQ ID NO: 860605 - protein, 9 aa, Homo Sapiens
REESYPRKT

SEQ ID NO: 860606 - protein, 9 aa, Homo Sapiens
RKTQKLTFY

SEQ ID NO: 860607 - protein, 9 aa, Homo Sapiens
PERNHSTFE

SEQ ID NO: 860608 - protein, 9 aa, Homo Sapiens
PEALICSFH

SEQ ID NO: 860609 - protein, 9 aa, Homo Sapiens
TGLKLIAKE

SEQ ID NO: 860610 - protein, 9 aa, Homo Sapiens
IKLFKDEFS

SEQ ID NO: 860611 - protein, 9 aa, Homo Sapiens
DPYLPYKYT

SEQ ID NO: 860612 - protein, 9 aa, Homo Sapiens
SLLNIWDYR

SEQ ID NO: 860613 - protein, 9 aa, Homo Sapiens
GPFPPLRCQ

SEQ ID NO: 860614 - protein, 9 aa, Homo Sapiens
GKAFSCGSG

SEQ ID NO: 860615 - protein, 9 aa, Homo Sapiens
KERRSLMPV

SEQ ID NO: 860616 - protein, 9 aa, Homo Sapiens
NRESPPAEI

SEQ ID NO: 860617 - protein, 9 aa, Homo Sapiens
GHKYYFTSS

SEQ ID NO: 860618 - protein, 9 aa, Homo Sapiens
REMAFHTEM

SEQ ID NO: 860619 - protein, 9 aa, Homo Sapiens
GLAVKHDLI

SEQ ID NO: 860620 - protein, 9 aa, Homo Sapiens
EEEDKADEG

SEQ ID NO: 860621 - protein, 9 aa, Homo Sapiens
GIFPGLVGI

SEQ ID NO: 860622 - protein, 9 aa, Homo Sapiens
LRNFSFLKV

SEQ ID NO: 860623 - protein, 9 aa, Homo Sapiens
GGCGGNRNT

SEQ ID NO: 860624 - protein, 9 aa, Homo Sapiens
FIFNEAEKL

SEQ ID NO: 860625 - protein, 9 aa, Homo Sapiens
HIIPQSLDL

SEQ ID NO: 860626 - protein, 9 aa, Homo Sapiens
ESFQILKQF

SEQ ID NO: 860627 - protein, 9 aa, Homo Sapiens
WAVDLGLQD

SEQ ID NO: 860628 - protein, 9 aa, Homo Sapiens
EDSYTAEVV

SEQ ID NO: 860629 - protein, 9 aa, Homo Sapiens
KLEEQFQSD

SEQ ID NO: 860630 - protein, 9 aa, Homo Sapiens
TPAGPGAQT

SEQ ID NO: 860631 - protein, 9 aa, Homo Sapiens
SSIIEAIKI

SEQ ID NO: 860632 - protein, 9 aa, Homo Sapiens
IKTYYGTKD

SEQ ID NO: 860633 - protein, 9 aa, Homo Sapiens
SSTPMSSPD

SEQ ID NO: 860634 - protein, 9 aa, Homo Sapiens
QESLAVLNG

SEQ ID NO: 860635 - protein, 9 aa, Homo Sapiens
TVHCKVHMG

SEQ ID NO: 860636 - protein, 9 aa, Homo Sapiens
TNILNMTTP

SEQ ID NO: 860637 - protein, 9 aa, Homo Sapiens
PPKHCPVVT

SEQ ID NO: 860638 - protein, 9 aa, Homo Sapiens
NRRAKFCKQ

SEQ ID NO: 860639 - protein, 9 aa, Homo Sapiens
TLEDRLFEH

SEQ ID NO: 860640 - protein, 9 aa, Homo Sapiens
SVRDDLFGM

SEQ ID NO: 860641 - protein, 9 aa, Homo Sapiens
MNFNLPAEN

SEQ ID NO: 860642 - protein, 9 aa, Homo Sapiens
YFGNYLFNF

SEQ ID NO: 860643 - protein, 9 aa, Homo Sapiens
RPDDGFPSN

SEQ ID NO: 860644 - protein, 9 aa, Homo Sapiens
GLSKKTHAS

SEQ ID NO: 860645 - protein, 9 aa, Homo Sapiens
LSILLSEFW

SEQ ID NO: 860646 - protein, 9 aa, Homo Sapiens
SLEMKMSLF

SEQ ID NO: 860647 - protein, 9 aa, Homo Sapiens
HSPACNNSI

SEQ ID NO: 860648 - protein, 9 aa, Homo Sapiens
LRPPASLHY

SEQ ID NO: 860649 - protein, 9 aa, Homo Sapiens
ALQLFKNTG

SEQ ID NO: 860650 - protein, 9 aa, Homo Sapiens
SVWIGGSIP

SEQ ID NO: 860651 - protein, 9 aa, Homo Sapiens
EESTVENPQ

SEQ ID NO: 860652 - protein, 9 aa, Homo Sapiens
KTVRKERLG

SEQ ID NO: 860653 - protein, 9 aa, Homo Sapiens
CTLPTYHLP

SEQ ID NO: 860654 - protein, 9 aa, Homo Sapiens
PKEVWCERC

SEQ ID NO: 860655 - protein, 9 aa, Homo Sapiens
KDEMRKRDQ

SEQ ID NO: 860656 - protein, 9 aa, Homo Sapiens
FSKCTLIHK

SEQ ID NO: 860657 - protein, 9 aa, Homo Sapiens
DRIKKDEDE

SEQ ID NO: 860658 - protein, 9 aa, Homo Sapiens
ERATKVEDM

SEQ ID NO: 860659 - protein, 9 aa, Homo Sapiens
RGSRRRRQQ

SEQ ID NO: 860660 - protein, 9 aa, Homo Sapiens
EDIKAIDGL

SEQ ID NO: 860661 - protein, 9 aa, Homo Sapiens
EGEGHINLN

SEQ ID NO: 860662 - protein, 9 aa, Homo Sapiens
LHNNKLSTI

SEQ ID NO: 860663 - protein, 9 aa, Homo Sapiens
VFYILVGGI

SEQ ID NO: 860664 - protein, 9 aa, Homo Sapiens
IYVTVKEHA

SEQ ID NO: 860665 - protein, 9 aa, Homo Sapiens
VNDLIGQGY

SEQ ID NO: 860666 - protein, 9 aa, Homo Sapiens
ESVFEKYYV

SEQ ID NO: 860667 - protein, 9 aa, Homo Sapiens
HTTILCLSL

SEQ ID NO: 860668 - protein, 9 aa, Homo Sapiens
SIVKHLCHS

SEQ ID NO: 860669 - protein, 9 aa, Homo Sapiens
KTSFKRAKS

SEQ ID NO: 860670 - protein, 9 aa, Homo Sapiens
RKFMERNRA

SEQ ID NO: 860671 - protein, 9 aa, Homo Sapiens
YSGKYDDEE

SEQ ID NO: 860672 - protein, 9 aa, Homo Sapiens
QQHHVGKKH

SEQ ID NO: 860673 - protein, 9 aa, Homo Sapiens
AEYYRWQWT

SEQ ID NO: 860674 - protein, 9 aa, Homo Sapiens
NKPIVPEHK

SEQ ID NO: 860675 - protein, 9 aa, Homo Sapiens
LSRVVHLYR

SEQ ID NO: 860676 - protein, 9 aa, Homo Sapiens
NIKVQELFQ

SEQ ID NO: 860677 - protein, 9 aa, Homo Sapiens
DIPKDLPDI

SEQ ID NO: 860678 - protein, 9 aa, Homo Sapiens
VTFNLLGED

SEQ ID NO: 860679 - protein, 9 aa, Homo Sapiens
HLIYTCGGI

SEQ ID NO: 860680 - protein, 9 aa, Homo Sapiens
RPQERVIGS

SEQ ID NO: 860681 - protein, 9 aa, Homo Sapiens
TLPQESMSA

SEQ ID NO: 860682 - protein, 9 aa, Homo Sapiens
YRQYYGKSP

SEQ ID NO: 860683 - protein, 9 aa, Homo Sapiens
KHLKSVEDE

SEQ ID NO: 860684 - protein, 9 aa, Homo Sapiens
QQGPIACDN

SEQ ID NO: 860685 - protein, 9 aa, Homo Sapiens
GDGWPRAKL

SEQ ID NO: 860686 - protein, 9 aa, Homo Sapiens
GYRYTSLLC

SEQ ID NO: 860687 - protein, 9 aa, Homo Sapiens
VGKHNGTVV

SEQ ID NO: 860688 - protein, 9 aa, Homo Sapiens
TYHTIIGGI

SEQ ID NO: 860689 - protein, 9 aa, Homo Sapiens
KMLQEICTL

SEQ ID NO: 860690 - protein, 9 aa, Homo Sapiens
LLALHDQAP

SEQ ID NO: 860691 - protein, 9 aa, Homo Sapiens
QVWYEHRFA

SEQ ID NO: 860692 - protein, 9 aa, Homo Sapiens
LAENDTYDS

SEQ ID NO: 860693 - protein, 9 aa, Homo Sapiens
NEMLQEWQK

SEQ ID NO: 860694 - protein, 9 aa, Homo Sapiens
CPSMYIQAM

SEQ ID NO: 860695 - protein, 9 aa, Homo Sapiens
GIKNIGFEW

SEQ ID NO: 860696 - protein, 9 aa, Homo Sapiens
SLSLTVLFD

SEQ ID NO: 860697 - protein, 9 aa, Homo Sapiens
SGQSRWSNL

SEQ ID NO: 860698 - protein, 9 aa, Homo Sapiens
KEHNCREEN

SEQ ID NO: 860699 - protein, 9 aa, Homo Sapiens
ILTKQQASS

SEQ ID NO: 860700 - protein, 9 aa, Homo Sapiens
LNVGFLEVL

SEQ ID NO: 860701 - protein, 9 aa, Homo Sapiens
HRARMHIQK

SEQ ID NO: 860702 - protein, 9 aa, Homo Sapiens
SKIQEFANL

SEQ ID NO: 860703 - protein, 9 aa, Homo Sapiens
RGCKKHLTH

SEQ ID NO: 860704 - protein, 9 aa, Homo Sapiens
SAHQNTPLQ

SEQ ID NO: 860705 - protein, 9 aa, Homo Sapiens
YEFIWTEGL

SEQ ID NO: 860706 - protein, 9 aa, Homo Sapiens
RSRLYVGRD

SEQ ID NO: 860707 - protein, 9 aa, Homo Sapiens
GFVFQFIPY

SEQ ID NO: 860708 - protein, 9 aa, Homo Sapiens
HFTSWPGHG

SEQ ID NO: 860709 - protein, 9 aa, Homo Sapiens
QLVNRSIRQ

SEQ ID NO: 860710 - protein, 9 aa, Homo Sapiens
AKYLDFINL

SEQ ID NO: 860711 - protein, 9 aa, Homo Sapiens
SPTKRCMLQ

SEQ ID NO: 860712 - protein, 9 aa, Homo Sapiens
QARLRLYTA

SEQ ID NO: 860713 - protein, 9 aa, Homo Sapiens
YHSLLRDPD

SEQ ID NO: 860714 - protein, 9 aa, Homo Sapiens
MWRQTHMDG

SEQ ID NO: 860715 - protein, 9 aa, Homo Sapiens
PTHCLHSKA

SEQ ID NO: 860716 - protein, 9 aa, Homo Sapiens
KSCRASNYS

SEQ ID NO: 860717 - protein, 9 aa, Homo Sapiens
IEPFEEKVA

SEQ ID NO: 860718 - protein, 9 aa, Homo Sapiens
ASAVNPLLR

SEQ ID NO: 860719 - protein, 9 aa, Homo Sapiens
VVSVESLLA

SEQ ID NO: 860720 - protein, 9 aa, Homo Sapiens
PDSIDIWIG

SEQ ID NO: 860721 - protein, 9 aa, Homo Sapiens
AAPDLKVKL

SEQ ID NO: 860722 - protein, 9 aa, Homo Sapiens
SWQEDPGAQ

SEQ ID NO: 860723 - protein, 9 aa, Homo Sapiens
CSDTISPHC

SEQ ID NO: 860724 - protein, 9 aa, Homo Sapiens
TIHGIIHTG

SEQ ID NO: 860725 - protein, 9 aa, Homo Sapiens
YLLRLENPD

SEQ ID NO: 860726 - protein, 9 aa, Homo Sapiens
DNVQLVNQY

SEQ ID NO: 860727 - protein, 9 aa, Homo Sapiens
YDVKYAIGI

SEQ ID NO: 860728 - protein, 9 aa, Homo Sapiens
YFKKRLSLK

SEQ ID NO: 860729 - protein, 9 aa, Homo Sapiens
AVLNFLCCG

SEQ ID NO: 860730 - protein, 9 aa, Homo Sapiens
NESHRLHQL

SEQ ID NO: 860731 - protein, 9 aa, Homo Sapiens
VVCLLCWTP

SEQ ID NO: 860732 - protein, 9 aa, Homo Sapiens
VYPTTMRTL

SEQ ID NO: 860733 - protein, 9 aa, Homo Sapiens
PVSNKTLLC

SEQ ID NO: 860734 - protein, 9 aa, Homo Sapiens
WIVFLLVGH

SEQ ID NO: 860735 - protein, 9 aa, Homo Sapiens
PPNIYFPIR

SEQ ID NO: 860736 - protein, 9 aa, Homo Sapiens
DLDTILLLN

SEQ ID NO: 860737 - protein, 9 aa, Homo Sapiens
DALSPFLWK

SEQ ID NO: 860738 - protein, 9 aa, Homo Sapiens
LWKAMKGLG

SEQ ID NO: 860739 - protein, 9 aa, Homo Sapiens
TLLHMCDGR

SEQ ID NO: 860740 - protein, 9 aa, Homo Sapiens
LVAKLADTM

SEQ ID NO: 860741 - protein, 9 aa, Homo Sapiens
RRWHVLSRE

SEQ ID NO: 860742 - protein, 9 aa, Homo Sapiens
WTANVTAKF

SEQ ID NO: 860743 - protein, 9 aa, Homo Sapiens
KAIIFKCLS

SEQ ID NO: 860744 - protein, 9 aa, Homo Sapiens
APPKPGHRS

SEQ ID NO: 860745 - protein, 9 aa, Homo Sapiens
SSPIIAPVR

SEQ ID NO: 860746 - protein, 9 aa, Homo Sapiens
TLITERDNV

SEQ ID NO: 860747 - protein, 9 aa, Homo Sapiens
GAQINRIFH

SEQ ID NO: 860748 - protein, 9 aa, Homo Sapiens
DSNVSGLAC

SEQ ID NO: 860749 - protein, 9 aa, Homo Sapiens
GQLNCLSNS

SEQ ID NO: 860750 - protein, 9 aa, Homo Sapiens
EMCLSQLFI

SEQ ID NO: 860751 - protein, 9 aa, Homo Sapiens
VLYKLNNED

SEQ ID NO: 860752 - protein, 9 aa, Homo Sapiens
FGSSFSSDS

SEQ ID NO: 860753 - protein, 9 aa, Homo Sapiens
ILIKATYNR

SEQ ID NO: 860754 - protein, 9 aa, Homo Sapiens
FPDAVSDKP

SEQ ID NO: 860755 - protein, 9 aa, Homo Sapiens
QELNGVART

SEQ ID NO: 860756 - protein, 9 aa, Homo Sapiens
ITQMLLQKL

SEQ ID NO: 860757 - protein, 9 aa, Homo Sapiens
AVYTCICSG

SEQ ID NO: 860758 - protein, 9 aa, Homo Sapiens
YLERQRVRG

SEQ ID NO: 860759 - protein, 9 aa, Homo Sapiens
NGPGIKIIS

SEQ ID NO: 860760 - protein, 9 aa, Homo Sapiens
AKLLSPRQT

SEQ ID NO: 860761 - protein, 9 aa, Homo Sapiens
KEETCTYAD

SEQ ID NO: 860762 - protein, 9 aa, Homo Sapiens
LDSIVRDDG

SEQ ID NO: 860763 - protein, 9 aa, Homo Sapiens
NDPHLETVY

SEQ ID NO: 860764 - protein, 9 aa, Homo Sapiens
STKVGVQGG

SEQ ID NO: 860765 - protein, 9 aa, Homo Sapiens
TRPALLDIA

SEQ ID NO: 860766 - protein, 9 aa, Homo Sapiens
EVLSMESLP

SEQ ID NO: 860767 - protein, 9 aa, Homo Sapiens
EDILESSKD

SEQ ID NO: 860768 - protein, 9 aa, Homo Sapiens
TSIRRTADL

SEQ ID NO: 860769 - protein, 9 aa, Homo Sapiens
NNSHGQLGL

SEQ ID NO: 860770 - protein, 9 aa, Homo Sapiens
FMEKLGNGA

SEQ ID NO: 860771 - protein, 9 aa, Homo Sapiens
PYKDLKTKL

SEQ ID NO: 860772 - protein, 9 aa, Homo Sapiens
KEKPVATNS

SEQ ID NO: 860773 - protein, 9 aa, Homo Sapiens
ITQLPVRTF

SEQ ID NO: 860774 - protein, 9 aa, Homo Sapiens
TDDIDQFQT

SEQ ID NO: 860775 - protein, 9 aa, Homo Sapiens
DYLQARINS

SEQ ID NO: 860776 - protein, 9 aa, Homo Sapiens
HLHKLSLRW

SEQ ID NO: 860777 - protein, 9 aa, Homo Sapiens
RNITVHLVG

SEQ ID NO: 860778 - protein, 9 aa, Homo Sapiens
IIWTLPYVC

SEQ ID NO: 860779 - protein, 9 aa, Homo Sapiens
KSAKKKTRS

SEQ ID NO: 860780 - protein, 9 aa, Homo Sapiens
RVEPYPTSR

SEQ ID NO: 860781 - protein, 9 aa, Homo Sapiens
HKGLLLRFP

SEQ ID NO: 860782 - protein, 9 aa, Homo Sapiens
TNEHTYSNR

SEQ ID NO: 860783 - protein, 9 aa, Homo Sapiens
ARAALSRIW

SEQ ID NO: 860784 - protein, 9 aa, Homo Sapiens
NCSTIVIGN

SEQ ID NO: 860785 - protein, 9 aa, Homo Sapiens
MRMCKNHSL

SEQ ID NO: 860786 - protein, 9 aa, Homo Sapiens
PHCLPYKLE

SEQ ID NO: 860787 - protein, 9 aa, Homo Sapiens
SGEEVVPTP

SEQ ID NO: 860788 - protein, 9 aa, Homo Sapiens
LILLLLFLG

SEQ ID NO: 860789 - protein, 9 aa, Homo Sapiens
IYLGVEWDY

SEQ ID NO: 860790 - protein, 9 aa, Homo Sapiens
WYIKGIMYK

SEQ ID NO: 860791 - protein, 9 aa, Homo Sapiens
ASVPPDFQG

SEQ ID NO: 860792 - protein, 9 aa, Homo Sapiens
NYTGSACAC

SEQ ID NO: 860793 - protein, 9 aa, Homo Sapiens
ELLGMGHCL

SEQ ID NO: 860794 - protein, 9 aa, Homo Sapiens
CGFVTNRAY

SEQ ID NO: 860795 - protein, 9 aa, Homo Sapiens
RGAGLLGRL

SEQ ID NO: 860796 - protein, 9 aa, Homo Sapiens
TLGYFGGVG

SEQ ID NO: 860797 - protein, 9 aa, Homo Sapiens
DTYIHCCVI

SEQ ID NO: 860798 - protein, 9 aa, Homo Sapiens
VSYPSLVYM

SEQ ID NO: 860799 - protein, 9 aa, Homo Sapiens
HLVGVPEDM

SEQ ID NO: 860800 - protein, 9 aa, Homo Sapiens
IMCIIHQAT

SEQ ID NO: 860801 - protein, 9 aa, Homo Sapiens
YILAQIGLS

SEQ ID NO: 860802 - protein, 9 aa, Homo Sapiens
DPNFTEAID

SEQ ID NO: 860803 - protein, 9 aa, Homo Sapiens
LITFIEREN

SEQ ID NO: 860804 - protein, 9 aa, Homo Sapiens
EIGITFIKK

SEQ ID NO: 860805 - protein, 9 aa, Homo Sapiens
SEVLNRRSL

SEQ ID NO: 860806 - protein, 9 aa, Homo Sapiens
TVKSCLDIL

SEQ ID NO: 860807 - protein, 9 aa, Homo Sapiens
LGRAVSKPD

SEQ ID NO: 860808 - protein, 9 aa, Homo Sapiens
EENHYLTPQ

SEQ ID NO: 860809 - protein, 9 aa, Homo Sapiens
SSPIINIHN

SEQ ID NO: 860810 - protein, 9 aa, Homo Sapiens
PQLRPNKMD

SEQ ID NO: 860811 - protein, 9 aa, Homo Sapiens
SYNDNCWIS

SEQ ID NO: 860812 - protein, 9 aa, Homo Sapiens
VKAPTVKPR

SEQ ID NO: 860813 - protein, 9 aa, Homo Sapiens
CGDSPPALI

SEQ ID NO: 860814 - protein, 9 aa, Homo Sapiens
EMLAKVIRL

SEQ ID NO: 860815 - protein, 9 aa, Homo Sapiens
VKFPNPLRP

SEQ ID NO: 860816 - protein, 9 aa, Homo Sapiens
NSLKLQAGA

SEQ ID NO: 860817 - protein, 9 aa, Homo Sapiens
LLTYMAKQF

SEQ ID NO: 860818 - protein, 9 aa, Homo Sapiens
LLISYGIRQ

SEQ ID NO: 860819 - protein, 9 aa, Homo Sapiens
NSHNAPAKL

SEQ ID NO: 860820 - protein, 9 aa, Homo Sapiens
NTVNMSWAK

SEQ ID NO: 860821 - protein, 9 aa, Homo Sapiens
DLDGLLVFN

SEQ ID NO: 860822 - protein, 9 aa, Homo Sapiens
RGFCDKSHL

SEQ ID NO: 860823 - protein, 9 aa, Homo Sapiens
FPNHWEYYL

SEQ ID NO: 860824 - protein, 9 aa, Homo Sapiens
SKVTLGRVD

SEQ ID NO: 860825 - protein, 9 aa, Homo Sapiens
EREARIRRL

SEQ ID NO: 860826 - protein, 9 aa, Homo Sapiens
GGSGQTFGR

SEQ ID NO: 860827 - protein, 9 aa, Homo Sapiens
SGKTYIGPC

SEQ ID NO: 860828 - protein, 9 aa, Homo Sapiens
CLSKDAVKK

SEQ ID NO: 860829 - protein, 9 aa, Homo Sapiens
MFIDTVSSS

SEQ ID NO: 860830 - protein, 9 aa, Homo Sapiens
LKEMRHVNI

SEQ ID NO: 860831 - protein, 9 aa, Homo Sapiens
VLSQALRGT

SEQ ID NO: 860832 - protein, 9 aa, Homo Sapiens
LSAQQLQAA

SEQ ID NO: 860833 - protein, 9 aa, Homo Sapiens
KDKMYSFKH

SEQ ID NO: 860834 - protein, 9 aa, Homo Sapiens
ELNIKDLLE

SEQ ID NO: 860835 - protein, 9 aa, Homo Sapiens
TEAWTTGPF

SEQ ID NO: 860836 - protein, 9 aa, Homo Sapiens
WQDIIYGMA

SEQ ID NO: 860837 - protein, 9 aa, Homo Sapiens
SGVILGITD

SEQ ID NO: 860838 - protein, 9 aa, Homo Sapiens
NIRCEHFRS

SEQ ID NO: 860839 - protein, 9 aa, Homo Sapiens
SPLINMFNN

SEQ ID NO: 860840 - protein, 9 aa, Homo Sapiens
QDMRGYQRC

SEQ ID NO: 860841 - protein, 9 aa, Homo Sapiens
DEGQEAEGD

SEQ ID NO: 860842 - protein, 9 aa, Homo Sapiens
EGTADVEKI

SEQ ID NO: 860843 - protein, 9 aa, Homo Sapiens
LQSDLVRVD

SEQ ID NO: 860844 - protein, 9 aa, Homo Sapiens
RKKQDKKQE

SEQ ID NO: 860845 - protein, 9 aa, Homo Sapiens
NYYRCEECG

SEQ ID NO: 860846 - protein, 9 aa, Homo Sapiens
PRTDEFKND

SEQ ID NO: 860847 - protein, 9 aa, Homo Sapiens
CPIKEVIEQ

SEQ ID NO: 860848 - protein, 9 aa, Homo Sapiens
GRRYGFSHQ

SEQ ID NO: 860849 - protein, 9 aa, Homo Sapiens
LPFWVHAGG

SEQ ID NO: 860850 - protein, 9 aa, Homo Sapiens
VIENNNTKH

SEQ ID NO: 860851 - protein, 9 aa, Homo Sapiens
FLHSGKTGR

SEQ ID NO: 860852 - protein, 9 aa, Homo Sapiens
IIKRKEIFE

SEQ ID NO: 860853 - protein, 9 aa, Homo Sapiens
PEISSNVCF

SEQ ID NO: 860854 - protein, 9 aa, Homo Sapiens
TLTATMRYE

SEQ ID NO: 860855 - protein, 9 aa, Homo Sapiens
EAPEFPCPT

SEQ ID NO: 860856 - protein, 9 aa, Homo Sapiens
HTQCRKILS

SEQ ID NO: 860857 - protein, 9 aa, Homo Sapiens
GALGETVLH

SEQ ID NO: 860858 - protein, 9 aa, Homo Sapiens
QNGQTDPLQ

SEQ ID NO: 860859 - protein, 9 aa, Homo Sapiens
VGNLCRQSI

SEQ ID NO: 860860 - protein, 9 aa, Homo Sapiens
CYRGKETLD

SEQ ID NO: 860861 - protein, 9 aa, Homo Sapiens
GDPTEWTSF

SEQ ID NO: 860862 - protein, 9 aa, Homo Sapiens
YLLRDAIVK

SEQ ID NO: 860863 - protein, 9 aa, Homo Sapiens
PLGCTMAPE

SEQ ID NO: 860864 - protein, 9 aa, Homo Sapiens
LAPKASEEP

SEQ ID NO: 860865 - protein, 9 aa, Homo Sapiens
EHTYSNRTL

SEQ ID NO: 860866 - protein, 9 aa, Homo Sapiens
SPYLFDIFN

SEQ ID NO: 860867 - protein, 9 aa, Homo Sapiens
IRQYLDALK

SEQ ID NO: 860868 - protein, 9 aa, Homo Sapiens
LNKPGHVAE

SEQ ID NO: 860869 - protein, 9 aa, Homo Sapiens
TLGRVDNLF

SEQ ID NO: 860870 - protein, 9 aa, Homo Sapiens
EIKVSNRKI

SEQ ID NO: 860871 - protein, 9 aa, Homo Sapiens
SKPRVATPD

SEQ ID NO: 860872 - protein, 9 aa, Homo Sapiens
QQSFECSRK

SEQ ID NO: 860873 - protein, 9 aa, Homo Sapiens
NGCGRSNKR

SEQ ID NO: 860874 - protein, 9 aa, Homo Sapiens
STKPLKTVI

SEQ ID NO: 860875 - protein, 9 aa, Homo Sapiens
GFGKTTAII

SEQ ID NO: 860876 - protein, 9 aa, Homo Sapiens
KSKEEEEEE

SEQ ID NO: 860877 - protein, 9 aa, Homo Sapiens
YLMTLGKLE

SEQ ID NO: 860878 - protein, 9 aa, Homo Sapiens
TSKRHFKLE

SEQ ID NO: 860879 - protein, 9 aa, Homo Sapiens
APFSLHFLA

SEQ ID NO: 860880 - protein, 9 aa, Homo Sapiens
PSLRRVATL

SEQ ID NO: 860881 - protein, 9 aa, Homo Sapiens
SWTPESNTS

SEQ ID NO: 860882 - protein, 9 aa, Homo Sapiens
RSGVSTFWN

SEQ ID NO: 860883 - protein, 9 aa, Homo Sapiens
YGLGLCSLF

SEQ ID NO: 860884 - protein, 9 aa, Homo Sapiens
LCAILNIQS

SEQ ID NO: 860885 - protein, 9 aa, Homo Sapiens
QNGHVIYKH

SEQ ID NO: 860886 - protein, 9 aa, Homo Sapiens
GHYSTVKDN

SEQ ID NO: 860887 - protein, 9 aa, Homo Sapiens
NDLDKSVEK

SEQ ID NO: 860888 - protein, 9 aa, Homo Sapiens
LQTDNLQSL

SEQ ID NO: 860889 - protein, 9 aa, Homo Sapiens
INVDHILDR

SEQ ID NO: 860890 - protein, 9 aa, Homo Sapiens
RQSDTVYHN

SEQ ID NO: 860891 - protein, 9 aa, Homo Sapiens
ITDVRLSEM

SEQ ID NO: 860892 - protein, 9 aa, Homo Sapiens
ALRPAPMQA

SEQ ID NO: 860893 - protein, 9 aa, Homo Sapiens
QEIIQHVDV

SEQ ID NO: 860894 - protein, 9 aa, Homo Sapiens
SRCQKVELN

SEQ ID NO: 860895 - protein, 9 aa, Homo Sapiens
PLTKTEEHI

SEQ ID NO: 860896 - protein, 9 aa, Homo Sapiens
DVDVTHSSN

SEQ ID NO: 860897 - protein, 9 aa, Homo Sapiens
PRPTWKPWR

SEQ ID NO: 860898 - protein, 9 aa, Homo Sapiens
VSSITASLQ

SEQ ID NO: 860899 - protein, 9 aa, Homo Sapiens
GCVIRNTNF

SEQ ID NO: 860900 - protein, 9 aa, Homo Sapiens
QQEYQEKGV

SEQ ID NO: 860901 - protein, 9 aa, Homo Sapiens
NQGGYNQYS

SEQ ID NO: 860902 - protein, 9 aa, Homo Sapiens
TLPQMSQCT

SEQ ID NO: 860903 - protein, 9 aa, Homo Sapiens
LEKKFYFPQ

SEQ ID NO: 860904 - protein, 9 aa, Homo Sapiens
GFLYPSCTG

SEQ ID NO: 860905 - protein, 9 aa, Homo Sapiens
KLTLQARDQ

SEQ ID NO: 860906 - protein, 9 aa, Homo Sapiens
VLIYFGAVL

SEQ ID NO: 860907 - protein, 9 aa, Homo Sapiens
WDAEKCDIC

SEQ ID NO: 860908 - protein, 9 aa, Homo Sapiens
PRRKMASPP

SEQ ID NO: 860909 - protein, 9 aa, Homo Sapiens
VDQDLMTYL

SEQ ID NO: 860910 - protein, 9 aa, Homo Sapiens
MRDKHPEKF

SEQ ID NO: 860911 - protein, 9 aa, Homo Sapiens
AINFGTKSF

SEQ ID NO: 860912 - protein, 9 aa, Homo Sapiens
MLYDLHSEV

SEQ ID NO: 860913 - protein, 9 aa, Homo Sapiens
QPPGFSDSS

SEQ ID NO: 860914 - protein, 9 aa, Homo Sapiens
NLRLSPLTP

SEQ ID NO: 860915 - protein, 9 aa, Homo Sapiens
RLPDSRDYP

SEQ ID NO: 860916 - protein, 9 aa, Homo Sapiens
IDSITVSVY

SEQ ID NO: 860917 - protein, 9 aa, Homo Sapiens
NMRYPVMST

SEQ ID NO: 860918 - protein, 9 aa, Homo Sapiens
ITPVPLLQT

SEQ ID NO: 860919 - protein, 9 aa, Homo Sapiens
LGLPAPNND

SEQ ID NO: 860920 - protein, 9 aa, Homo Sapiens
SKNIYWTDS

SEQ ID NO: 860921 - protein, 9 aa, Homo Sapiens
GFVLKISLT

SEQ ID NO: 860922 - protein, 9 aa, Homo Sapiens
VEIGPVTNQ

SEQ ID NO: 860923 - protein, 9 aa, Homo Sapiens
KYTCEGMLE

SEQ ID NO: 860924 - protein, 9 aa, Homo Sapiens
LTKIPGVPN

SEQ ID NO: 860925 - protein, 9 aa, Homo Sapiens
SGPSLGAIP

SEQ ID NO: 860926 - protein, 9 aa, Homo Sapiens
TLLQQIAML

SEQ ID NO: 860927 - protein, 9 aa, Homo Sapiens
VLQALLGIN

SEQ ID NO: 860928 - protein, 9 aa, Homo Sapiens
SVILQVFQG

SEQ ID NO: 860929 - protein, 9 aa, Homo Sapiens
AKHEYKKMK

SEQ ID NO: 860930 - protein, 9 aa, Homo Sapiens
EQSPHSLSV

SEQ ID NO: 860931 - protein, 9 aa, Homo Sapiens
QPQRTFPEM

SEQ ID NO: 860932 - protein, 9 aa, Homo Sapiens
CKDKLGENV

SEQ ID NO: 860933 - protein, 9 aa, Homo Sapiens
RHQALGTTV

SEQ ID NO: 860934 - protein, 9 aa, Homo Sapiens
TEPTKLPFP

SEQ ID NO: 860935 - protein, 9 aa, Homo Sapiens
EKLADQLKQ

SEQ ID NO: 860936 - protein, 9 aa, Homo Sapiens
STAFLRWKG

SEQ ID NO: 860937 - protein, 9 aa, Homo Sapiens
EKDDCDKTG

SEQ ID NO: 860938 - protein, 9 aa, Homo Sapiens
RTALTKVVQ

SEQ ID NO: 860939 - protein, 9 aa, Homo Sapiens
QTFSYYADK

SEQ ID NO: 860940 - protein, 9 aa, Homo Sapiens
VTTCSLVRP

SEQ ID NO: 860941 - protein, 9 aa, Homo Sapiens
RTAEELDNE

SEQ ID NO: 860942 - protein, 9 aa, Homo Sapiens
FYKTAEENE

SEQ ID NO: 860943 - protein, 9 aa, Homo Sapiens
QLFIQVEAA

SEQ ID NO: 860944 - protein, 9 aa, Homo Sapiens
LTYMSHQNS

SEQ ID NO: 860945 - protein, 9 aa, Homo Sapiens
KHTVLMQEY

SEQ ID NO: 860946 - protein, 9 aa, Homo Sapiens
PSEHVIENN

SEQ ID NO: 860947 - protein, 9 aa, Homo Sapiens
NILYSVLTI

SEQ ID NO: 860948 - protein, 9 aa, Homo Sapiens
ATKNLHVID

SEQ ID NO: 860949 - protein, 9 aa, Homo Sapiens
PSTFPHVSQ

SEQ ID NO: 860950 - protein, 9 aa, Homo Sapiens
PKEHARATV

SEQ ID NO: 860951 - protein, 9 aa, Homo Sapiens
KLCKREQKQ

SEQ ID NO: 860952 - protein, 9 aa, Homo Sapiens
RARVLELEA

SEQ ID NO: 860953 - protein, 9 aa, Homo Sapiens
WGLVKTFID

SEQ ID NO: 860954 - protein, 9 aa, Homo Sapiens
SVFEKYYVT

SEQ ID NO: 860955 - protein, 9 aa, Homo Sapiens
SDLAAIFNL

SEQ ID NO: 860956 - protein, 9 aa, Homo Sapiens
SSLIYLTLE

SEQ ID NO: 860957 - protein, 9 aa, Homo Sapiens
VPFFLFAAI

SEQ ID NO: 860958 - protein, 9 aa, Homo Sapiens
AIAPKPKFL

SEQ ID NO: 860959 - protein, 9 aa, Homo Sapiens
SLECWDELQ

SEQ ID NO: 860960 - protein, 9 aa, Homo Sapiens
KRKTVTAMG

SEQ ID NO: 860961 - protein, 9 aa, Homo Sapiens
KKCVTQQQY

SEQ ID NO: 860962 - protein, 9 aa, Homo Sapiens
RRKSEAKQV

SEQ ID NO: 860963 - protein, 9 aa, Homo Sapiens
CRNYNKQSS

SEQ ID NO: 860964 - protein, 9 aa, Homo Sapiens
LTLRSLSLR

SEQ ID NO: 860965 - protein, 9 aa, Homo Sapiens
MGLRTTTQM

SEQ ID NO: 860966 - protein, 9 aa, Homo Sapiens
SQLEKLDIL

SEQ ID NO: 860967 - protein, 9 aa, Homo Sapiens
TFGVRTRDA

SEQ ID NO: 860968 - protein, 9 aa, Homo Sapiens
SVPHVNQNG

SEQ ID NO: 860969 - protein, 9 aa, Homo Sapiens
LEGDNKMVT

SEQ ID NO: 860970 - protein, 9 aa, Homo Sapiens
NVIIIQPPS

SEQ ID NO: 860971 - protein, 9 aa, Homo Sapiens
RDNVFGKTL

SEQ ID NO: 860972 - protein, 9 aa, Homo Sapiens
TGMNPTGIG

SEQ ID NO: 860973 - protein, 9 aa, Homo Sapiens
LALCKKEIN

SEQ ID NO: 860974 - protein, 9 aa, Homo Sapiens
NCRIYLIQH

SEQ ID NO: 860975 - protein, 9 aa, Homo Sapiens
GIGTNLVKT

SEQ ID NO: 860976 - protein, 9 aa, Homo Sapiens
GSCAVSREH

SEQ ID NO: 860977 - protein, 9 aa, Homo Sapiens
ELVFVINSS

SEQ ID NO: 860978 - protein, 9 aa, Homo Sapiens
ALAKYHLKQ

SEQ ID NO: 860979 - protein, 9 aa, Homo Sapiens
CSLFVVSTV

SEQ ID NO: 860980 - protein, 9 aa, Homo Sapiens
RMKIPDTLE

SEQ ID NO: 860981 - protein, 9 aa, Homo Sapiens
WRRKAAYWK

SEQ ID NO: 860982 - protein, 9 aa, Homo Sapiens
TICHYLDPL

SEQ ID NO: 860983 - protein, 9 aa, Homo Sapiens
LQESVVQWC

SEQ ID NO: 860984 - protein, 9 aa, Homo Sapiens
ISSQMHHLN

SEQ ID NO: 860985 - protein, 9 aa, Homo Sapiens
LFISGDELI

SEQ ID NO: 860986 - protein, 9 aa, Homo Sapiens
EIWSLLLLA

SEQ ID NO: 860987 - protein, 9 aa, Homo Sapiens
ICRVLSHKG

SEQ ID NO: 860988 - protein, 9 aa, Homo Sapiens
LDTFIDQLY

SEQ ID NO: 860989 - protein, 9 aa, Homo Sapiens
DINNVDGKS

SEQ ID NO: 860990 - protein, 9 aa, Homo Sapiens
TIIFPGSTG

SEQ ID NO: 860991 - protein, 9 aa, Homo Sapiens
VINEFMGHK

SEQ ID NO: 860992 - protein, 9 aa, Homo Sapiens
PSKDTWPGV

SEQ ID NO: 860993 - protein, 9 aa, Homo Sapiens
VAAQISRKK

SEQ ID NO: 860994 - protein, 9 aa, Homo Sapiens
GPPGSPFNE

SEQ ID NO: 860995 - protein, 9 aa, Homo Sapiens
RLSSTSCMS

SEQ ID NO: 860996 - protein, 9 aa, Homo Sapiens
PVCFEMTDD

SEQ ID NO: 860997 - protein, 9 aa, Homo Sapiens
ASRQDPLHP

SEQ ID NO: 860998 - protein, 9 aa, Homo Sapiens
KNKGAIYEG

SEQ ID NO: 860999 - protein, 9 aa, Homo Sapiens
SWTCLQTIH

SEQ ID NO: 861000 - protein, 9 aa, Homo Sapiens
TYLPYYMLN

SEQ ID NO: 861001 - protein, 9 aa, Homo Sapiens
LFAIIVLML

SEQ ID NO: 861002 - protein, 9 aa, Homo Sapiens
ANHGLQETC

SEQ ID NO: 861003 - protein, 9 aa, Homo Sapiens
VPGSQGKAL

SEQ ID NO: 861004 - protein, 9 aa, Homo Sapiens
KLGFQGAWA

SEQ ID NO: 861005 - protein, 9 aa, Homo Sapiens
YEKLWKWIA

SEQ ID NO: 861006 - protein, 9 aa, Homo Sapiens
EAIMCIIHQ

SEQ ID NO: 861007 - protein, 9 aa, Homo Sapiens
LHFPIKPSL

SEQ ID NO: 861008 - protein, 9 aa, Homo Sapiens
LSAQLAPGS

SEQ ID NO: 861009 - protein, 9 aa, Homo Sapiens
IIVNNHTSL

SEQ ID NO: 861010 - protein, 9 aa, Homo Sapiens
RGAAASSPG

SEQ ID NO: 861011 - protein, 9 aa, Homo Sapiens
PKCLFDDDL

SEQ ID NO: 861012 - protein, 9 aa, Homo Sapiens
KPKRQPHLP

SEQ ID NO: 861013 - protein, 9 aa, Homo Sapiens
GELERGPSG

SEQ ID NO: 861014 - protein, 9 aa, Homo Sapiens
EKMLDNGNF

SEQ ID NO: 861015 - protein, 9 aa, Homo Sapiens
FTLYMTYFI

SEQ ID NO: 861016 - protein, 9 aa, Homo Sapiens
NSQGHKLFR

SEQ ID NO: 861017 - protein, 9 aa, Homo Sapiens
HQRRSVFPQ

SEQ ID NO: 861018 - protein, 9 aa, Homo Sapiens
QAQEKSGKD

SEQ ID NO: 861019 - protein, 9 aa, Homo Sapiens
HNRKQHISI

SEQ ID NO: 861020 - protein, 9 aa, Homo Sapiens
AGEFLCLWE

SEQ ID NO: 861021 - protein, 9 aa, Homo Sapiens
KARNVKAMD

SEQ ID NO: 861022 - protein, 9 aa, Homo Sapiens
RMTDPTRRL

SEQ ID NO: 861023 - protein, 9 aa, Homo Sapiens
KLWDHTQCR

SEQ ID NO: 861024 - protein, 9 aa, Homo Sapiens
KFSRLDPNF

SEQ ID NO: 861025 - protein, 9 aa, Homo Sapiens
LYQWLANKD

SEQ ID NO: 861026 - protein, 9 aa, Homo Sapiens
PKTPKMLRM

SEQ ID NO: 861027 - protein, 9 aa, Homo Sapiens
EVSSWTAEG

SEQ ID NO: 861028 - protein, 9 aa, Homo Sapiens
PENNQGVVS

SEQ ID NO: 861029 - protein, 9 aa, Homo Sapiens
LNTATLFIV

SEQ ID NO: 861030 - protein, 9 aa, Homo Sapiens
NMPVRPKPS

SEQ ID NO: 861031 - protein, 9 aa, Homo Sapiens
LPCNHMRFW

SEQ ID NO: 861032 - protein, 9 aa, Homo Sapiens
YLSSDTTRK

SEQ ID NO: 861033 - protein, 9 aa, Homo Sapiens
NQVSGNLLR

SEQ ID NO: 861034 - protein, 9 aa, Homo Sapiens
VEYNNLKFT

SEQ ID NO: 861035 - protein, 9 aa, Homo Sapiens
VEVPNSKEQ

SEQ ID NO: 861036 - protein, 9 aa, Homo Sapiens
FLAYYQAVA

SEQ ID NO: 861037 - protein, 9 aa, Homo Sapiens
VLGHWPQKE

SEQ ID NO: 861038 - protein, 9 aa, Homo Sapiens
LHQATQAAE

SEQ ID NO: 861039 - protein, 9 aa, Homo Sapiens
SERRKIIKT

SEQ ID NO: 861040 - protein, 9 aa, Homo Sapiens
LPFPLRKPQ

SEQ ID NO: 861041 - protein, 9 aa, Homo Sapiens
DSEIERMGL

SEQ ID NO: 861042 - protein, 9 aa, Homo Sapiens
IEDIGNKIK

SEQ ID NO: 861043 - protein, 9 aa, Homo Sapiens
FQEMAIYII

SEQ ID NO: 861044 - protein, 9 aa, Homo Sapiens
NARRRLKKD

SEQ ID NO: 861045 - protein, 9 aa, Homo Sapiens
QLLGEVKRR

SEQ ID NO: 861046 - protein, 9 aa, Homo Sapiens
AINKKMQML

SEQ ID NO: 861047 - protein, 9 aa, Homo Sapiens
REQLIQNLE

SEQ ID NO: 861048 - protein, 9 aa, Homo Sapiens
PCNAACSSQ

SEQ ID NO: 861049 - protein, 9 aa, Homo Sapiens
FGSGDCKRS

SEQ ID NO: 861050 - protein, 9 aa, Homo Sapiens
PSCAPSPQG

SEQ ID NO: 861051 - protein, 9 aa, Homo Sapiens
NFTLGVDIL

SEQ ID NO: 861052 - protein, 9 aa, Homo Sapiens
ASRERRLKQ

SEQ ID NO: 861053 - protein, 9 aa, Homo Sapiens
KDTHKKSKK

SEQ ID NO: 861054 - protein, 9 aa, Homo Sapiens
CIDSLNRRI

SEQ ID NO: 861055 - protein, 9 aa, Homo Sapiens
VAVVIDSTR

SEQ ID NO: 861056 - protein, 9 aa, Homo Sapiens
LVKGEITNL

SEQ ID NO: 861057 - protein, 9 aa, Homo Sapiens
FIAMNRGIT

SEQ ID NO: 861058 - protein, 9 aa, Homo Sapiens
PETAQTEPV

SEQ ID NO: 861059 - protein, 9 aa, Homo Sapiens
DPKIPKSTR

SEQ ID NO: 861060 - protein, 9 aa, Homo Sapiens
PEKDIRSCC

SEQ ID NO: 861061 - protein, 9 aa, Homo Sapiens
SPAEKGSHM

SEQ ID NO: 861062 - protein, 9 aa, Homo Sapiens
CQEISTFYT

SEQ ID NO: 861063 - protein, 9 aa, Homo Sapiens
GSNTKNNKI

SEQ ID NO: 861064 - protein, 9 aa, Homo Sapiens
SRYHSLLRD

SEQ ID NO: 861065 - protein, 9 aa, Homo Sapiens
QSWYIRSLQ

SEQ ID NO: 861066 - protein, 9 aa, Homo Sapiens
LENVGMLLI

SEQ ID NO: 861067 - protein, 9 aa, Homo Sapiens
LYSALKNLD

SEQ ID NO: 861068 - protein, 9 aa, Homo Sapiens
VLKYFYVHT

SEQ ID NO: 861069 - protein, 9 aa, Homo Sapiens
KEKRDLINF

SEQ ID NO: 861070 - protein, 9 aa, Homo Sapiens
IHYFPSVLW

SEQ ID NO: 861071 - protein, 9 aa, Homo Sapiens
TSNSLSVIE

SEQ ID NO: 861072 - protein, 9 aa, Homo Sapiens
VDSNSAYRQ

SEQ ID NO: 861073 - protein, 9 aa, Homo Sapiens
VAVFNTSVA

SEQ ID NO: 861074 - protein, 9 aa, Homo Sapiens
IGYRALQWT

SEQ ID NO: 861075 - protein, 9 aa, Homo Sapiens
HLFELRLYL

SEQ ID NO: 861076 - protein, 9 aa, Homo Sapiens
SFAMGAAEC

SEQ ID NO: 861077 - protein, 9 aa, Homo Sapiens
AIGEDNVAV

SEQ ID NO: 861078 - protein, 9 aa, Homo Sapiens
AHRFHVMRD

SEQ ID NO: 861079 - protein, 9 aa, Homo Sapiens
MRAFPVFLG

SEQ ID NO: 861080 - protein, 9 aa, Homo Sapiens
CTVNETHNF

SEQ ID NO: 861081 - protein, 9 aa, Homo Sapiens
AVGTPVYIS

SEQ ID NO: 861082 - protein, 9 aa, Homo Sapiens
DAMAHLSGT

SEQ ID NO: 861083 - protein, 9 aa, Homo Sapiens
VMLFMHYQI

SEQ ID NO: 861084 - protein, 9 aa, Homo Sapiens
KVIGRGNYG

SEQ ID NO: 861085 - protein, 9 aa, Homo Sapiens
ILLCVYEQK

SEQ ID NO: 861086 - protein, 9 aa, Homo Sapiens
DFSKSLQSS

SEQ ID NO: 861087 - protein, 9 aa, Homo Sapiens
RPQNDRRNA

SEQ ID NO: 861088 - protein, 9 aa, Homo Sapiens
RGYTGLGHS

SEQ ID NO: 861089 - protein, 9 aa, Homo Sapiens
ACSARMYRD

SEQ ID NO: 861090 - protein, 9 aa, Homo Sapiens
LSLSNHQIF

SEQ ID NO: 861091 - protein, 9 aa, Homo Sapiens
SKYKEIILL

SEQ ID NO: 861092 - protein, 9 aa, Homo Sapiens
AWLEITPGL

SEQ ID NO: 861093 - protein, 9 aa, Homo Sapiens
AGKIYLLSS

SEQ ID NO: 861094 - protein, 9 aa, Homo Sapiens
QGKLYLREK

SEQ ID NO: 861095 - protein, 9 aa, Homo Sapiens
LINKYEPSG

SEQ ID NO: 861096 - protein, 9 aa, Homo Sapiens
MLTMHQIVI

SEQ ID NO: 861097 - protein, 9 aa, Homo Sapiens
HRCLGQKPV

SEQ ID NO: 861098 - protein, 9 aa, Homo Sapiens
ELLGDMDCN

SEQ ID NO: 861099 - protein, 9 aa, Homo Sapiens
ALCAFQGYS

SEQ ID NO: 861100 - protein, 9 aa, Homo Sapiens
IKKRDEKKY

SEQ ID NO: 861101 - protein, 9 aa, Homo Sapiens
ILEILFTTV

SEQ ID NO: 861102 - protein, 9 aa, Homo Sapiens
NQTRHLPLQ

SEQ ID NO: 861103 - protein, 9 aa, Homo Sapiens
HRYIHSKDK

SEQ ID NO: 861104 - protein, 9 aa, Homo Sapiens
PLGITMVLT

SEQ ID NO: 861105 - protein, 9 aa, Homo Sapiens
SSYWRVFHT

SEQ ID NO: 861106 - protein, 9 aa, Homo Sapiens
LYRRILRRP

SEQ ID NO: 861107 - protein, 9 aa, Homo Sapiens
EFLDFFPDG

SEQ ID NO: 861108 - protein, 9 aa, Homo Sapiens
NQAMLHYIQ

SEQ ID NO: 861109 - protein, 9 aa, Homo Sapiens
HGNSPLFFL

SEQ ID NO: 861110 - protein, 9 aa, Homo Sapiens
KMASPPSSL

SEQ ID NO: 861111 - protein, 9 aa, Homo Sapiens
KGSGVDAKV

SEQ ID NO: 861112 - protein, 9 aa, Homo Sapiens
LITMLENVG

SEQ ID NO: 861113 - protein, 9 aa, Homo Sapiens
IHHLIEGVK

SEQ ID NO: 861114 - protein, 9 aa, Homo Sapiens
LVSITTRLS

SEQ ID NO: 861115 - protein, 9 aa, Homo Sapiens
VVFGLLTVL

SEQ ID NO: 861116 - protein, 9 aa, Homo Sapiens
ADSSRHSGV

SEQ ID NO: 861117 - protein, 9 aa, Homo Sapiens
CAQVPGMQD

SEQ ID NO: 861118 - protein, 9 aa, Homo Sapiens
AISSTDAVL

SEQ ID NO: 861119 - protein, 9 aa, Homo Sapiens
VYFRTVERI

SEQ ID NO: 861120 - protein, 9 aa, Homo Sapiens
VSNSCIDCN

SEQ ID NO: 861121 - protein, 9 aa, Homo Sapiens
ITSALHKLE

SEQ ID NO: 861122 - protein, 9 aa, Homo Sapiens
NLYAETAVL

SEQ ID NO: 861123 - protein, 9 aa, Homo Sapiens
IYLSKKCLS

SEQ ID NO: 861124 - protein, 9 aa, Homo Sapiens
LTPSNIAIV

SEQ ID NO: 861125 - protein, 9 aa, Homo Sapiens
PSILIILRL

SEQ ID NO: 861126 - protein, 9 aa, Homo Sapiens
TTKDPCQKG

SEQ ID NO: 861127 - protein, 9 aa, Homo Sapiens
AQGRLPKDL

SEQ ID NO: 861128 - protein, 9 aa, Homo Sapiens
SRVLIFSQV

SEQ ID NO: 861129 - protein, 9 aa, Homo Sapiens
AWTPPTDGE

SEQ ID NO: 861130 - protein, 9 aa, Homo Sapiens
FGQLNCLSN

SEQ ID NO: 861131 - protein, 9 aa, Homo Sapiens
LMMLRYHTG

SEQ ID NO: 861132 - protein, 9 aa, Homo Sapiens
VDSSWAIGE

SEQ ID NO: 861133 - protein, 9 aa, Homo Sapiens
FKGAVKIWK

SEQ ID NO: 861134 - protein, 9 aa, Homo Sapiens
LCLAAAPSR

SEQ ID NO: 861135 - protein, 9 aa, Homo Sapiens
GSNGRRLRI

SEQ ID NO: 861136 - protein, 9 aa, Homo Sapiens
TQKNQLISF

SEQ ID NO: 861137 - protein, 9 aa, Homo Sapiens
RVTTAAHIA

SEQ ID NO: 861138 - protein, 9 aa, Homo Sapiens
ETRDGHYYL

SEQ ID NO: 861139 - protein, 9 aa, Homo Sapiens
RTFLSSLKG

SEQ ID NO: 861140 - protein, 9 aa, Homo Sapiens
VSELISFIT

SEQ ID NO: 861141 - protein, 9 aa, Homo Sapiens
TASCLLQNV

SEQ ID NO: 861142 - protein, 9 aa, Homo Sapiens
FYYTECLFF

SEQ ID NO: 861143 - protein, 9 aa, Homo Sapiens
MLQEWQKVH

SEQ ID NO: 861144 - protein, 9 aa, Homo Sapiens
LMDNNKLNI

SEQ ID NO: 861145 - protein, 9 aa, Homo Sapiens
CQKMCDQWD

SEQ ID NO: 861146 - protein, 9 aa, Homo Sapiens
EKSGICKIH

SEQ ID NO: 861147 - protein, 9 aa, Homo Sapiens
RNHHSRVYL

SEQ ID NO: 861148 - protein, 9 aa, Homo Sapiens
KRGKGRTEN

SEQ ID NO: 861149 - protein, 9 aa, Homo Sapiens
VVSPKLPSG

SEQ ID NO: 861150 - protein, 9 aa, Homo Sapiens
CFIVYSYKY

SEQ ID NO: 861151 - protein, 9 aa, Homo Sapiens
WGALGSGRT

SEQ ID NO: 861152 - protein, 9 aa, Homo Sapiens
LAVPGSSGS

SEQ ID NO: 861153 - protein, 9 aa, Homo Sapiens
PDNDIDRIL

SEQ ID NO: 861154 - protein, 9 aa, Homo Sapiens
VTNPAYEDV

SEQ ID NO: 861155 - protein, 9 aa, Homo Sapiens
MSQSSRYGN

SEQ ID NO: 861156 - protein, 9 aa, Homo Sapiens
NVYLDICDD

SEQ ID NO: 861157 - protein, 9 aa, Homo Sapiens
AFGIYLKWC

SEQ ID NO: 861158 - protein, 9 aa, Homo Sapiens
QLRKDKMYS

SEQ ID NO: 861159 - protein, 9 aa, Homo Sapiens
HKYSSGQSS

SEQ ID NO: 861160 - protein, 9 aa, Homo Sapiens
SDIKDEDLK

SEQ ID NO: 861161 - protein, 9 aa, Homo Sapiens
VLKHLRAYM

SEQ ID NO: 861162 - protein, 9 aa, Homo Sapiens
ICGYHSTIY

SEQ ID NO: 861163 - protein, 9 aa, Homo Sapiens
MNKMGIKSG

SEQ ID NO: 861164 - protein, 9 aa, Homo Sapiens
LSSFNSKLA

SEQ ID NO: 861165 - protein, 9 aa, Homo Sapiens
NSPPEESNQ

SEQ ID NO: 861166 - protein, 9 aa, Homo Sapiens
GRSTTIRIR

SEQ ID NO: 861167 - protein, 9 aa, Homo Sapiens
NKYHKKKKI

SEQ ID NO: 861168 - protein, 9 aa, Homo Sapiens
LGEKHKALK

SEQ ID NO: 861169 - protein, 9 aa, Homo Sapiens
KRVAATSRS

SEQ ID NO: 861170 - protein, 9 aa, Homo Sapiens
PGLGSKAVW

SEQ ID NO: 861171 - protein, 9 aa, Homo Sapiens
ICKDLKIND

SEQ ID NO: 861172 - protein, 9 aa, Homo Sapiens
LRIVGAQLR

SEQ ID NO: 861173 - protein, 9 aa, Homo Sapiens
ADWLESLNV

SEQ ID NO: 861174 - protein, 9 aa, Homo Sapiens
HAANVTQTV

SEQ ID NO: 861175 - protein, 9 aa, Homo Sapiens
RLICEGKNQ

SEQ ID NO: 861176 - protein, 9 aa, Homo Sapiens
KHVESRTDK

SEQ ID NO: 861177 - protein, 9 aa, Homo Sapiens
DTAGSQTGR

SEQ ID NO: 861178 - protein, 9 aa, Homo Sapiens
LQDIAERIS

SEQ ID NO: 861179 - protein, 9 aa, Homo Sapiens
RKCKKEELL

SEQ ID NO: 861180 - protein, 9 aa, Homo Sapiens
HDAEESKAT

SEQ ID NO: 861181 - protein, 9 aa, Homo Sapiens
AGEYSQVFC

SEQ ID NO: 861182 - protein, 9 aa, Homo Sapiens
SAEEAGETM

SEQ ID NO: 861183 - protein, 9 aa, Homo Sapiens
LYQFQLFQE

SEQ ID NO: 861184 - protein, 9 aa, Homo Sapiens
PPIMFENHM

SEQ ID NO: 861185 - protein, 9 aa, Homo Sapiens
LLSHEQKMS

SEQ ID NO: 861186 - protein, 9 aa, Homo Sapiens
TSFIMDQAN

SEQ ID NO: 861187 - protein, 9 aa, Homo Sapiens
ITKKFPNHY

SEQ ID NO: 861188 - protein, 9 aa, Homo Sapiens
PSPGLSHLP

SEQ ID NO: 861189 - protein, 9 aa, Homo Sapiens
EGNQIEIID

SEQ ID NO: 861190 - protein, 9 aa, Homo Sapiens
RNHRPKLTD

SEQ ID NO: 861191 - protein, 9 aa, Homo Sapiens
KFTFHLVGV

SEQ ID NO: 861192 - protein, 9 aa, Homo Sapiens
HSQGTTIGC

SEQ ID NO: 861193 - protein, 9 aa, Homo Sapiens
EAATFLDII

SEQ ID NO: 861194 - protein, 9 aa, Homo Sapiens
TSQKEVNAQ

SEQ ID NO: 861195 - protein, 9 aa, Homo Sapiens
YTNGNFGSN

SEQ ID NO: 861196 - protein, 9 aa, Homo Sapiens
LLRDFPNHW

SEQ ID NO: 861197 - protein, 9 aa, Homo Sapiens
LMTIGGNIL

SEQ ID NO: 861198 - protein, 9 aa, Homo Sapiens
RLQDSNNKV

SEQ ID NO: 861199 - protein, 9 aa, Homo Sapiens
DLLEKKLSK

SEQ ID NO: 861200 - protein, 9 aa, Homo Sapiens
EGPLPLPAC

SEQ ID NO: 861201 - protein, 9 aa, Homo Sapiens
ICAYRVRIG

SEQ ID NO: 861202 - protein, 9 aa, Homo Sapiens
HDFVLQCSV

SEQ ID NO: 861203 - protein, 9 aa, Homo Sapiens
QQKFIDNRP

SEQ ID NO: 861204 - protein, 9 aa, Homo Sapiens
LPHAYKCSD

SEQ ID NO: 861205 - protein, 9 aa, Homo Sapiens
MDSAGAPVD

SEQ ID NO: 861206 - protein, 9 aa, Homo Sapiens
VYIFSFLDP

SEQ ID NO: 861207 - protein, 9 aa, Homo Sapiens
LTNVNDNPP

SEQ ID NO: 861208 - protein, 9 aa, Homo Sapiens
ERQLRKEHE

SEQ ID NO: 861209 - protein, 9 aa, Homo Sapiens
LCRDEPVVQ

SEQ ID NO: 861210 - protein, 9 aa, Homo Sapiens
DNVTLADSG

SEQ ID NO: 861211 - protein, 9 aa, Homo Sapiens
NLEEYVRFN

SEQ ID NO: 861212 - protein, 9 aa, Homo Sapiens
DTQNINLYD

SEQ ID NO: 861213 - protein, 9 aa, Homo Sapiens
EHAVQAYSE

SEQ ID NO: 861214 - protein, 9 aa, Homo Sapiens
KPLKTVIIE

SEQ ID NO: 861215 - protein, 9 aa, Homo Sapiens
QVIGKQNGN

SEQ ID NO: 861216 - protein, 9 aa, Homo Sapiens
KYALLTSAN

SEQ ID NO: 861217 - protein, 9 aa, Homo Sapiens
PTVGFNVEH

SEQ ID NO: 861218 - protein, 9 aa, Homo Sapiens
RFLANLFVF

SEQ ID NO: 861219 - protein, 9 aa, Homo Sapiens
KLFLTSNRS

SEQ ID NO: 861220 - protein, 9 aa, Homo Sapiens
DSVLSGCSE

SEQ ID NO: 861221 - protein, 9 aa, Homo Sapiens
LKKLLLSSE

SEQ ID NO: 861222 - protein, 9 aa, Homo Sapiens
IFPASWHFS

SEQ ID NO: 861223 - protein, 9 aa, Homo Sapiens
LCRQAQQAG

SEQ ID NO: 861224 - protein, 9 aa, Homo Sapiens
IGALGAPFW

SEQ ID NO: 861225 - protein, 9 aa, Homo Sapiens
GAESPSRTV

SEQ ID NO: 861226 - protein, 9 aa, Homo Sapiens
AWALPCFPE

SEQ ID NO: 861227 - protein, 9 aa, Homo Sapiens
VMVSLFMGV

SEQ ID NO: 861228 - protein, 9 aa, Homo Sapiens
ITCFDSLKG

SEQ ID NO: 861229 - protein, 9 aa, Homo Sapiens
CLYRDVMLD

SEQ ID NO: 861230 - protein, 9 aa, Homo Sapiens
VQVKRYDLE

SEQ ID NO: 861231 - protein, 9 aa, Homo Sapiens
PVCTPESMG

SEQ ID NO: 861232 - protein, 9 aa, Homo Sapiens
FGVFNALDL

SEQ ID NO: 861233 - protein, 9 aa, Homo Sapiens
IPPFPKRSD

SEQ ID NO: 861234 - protein, 9 aa, Homo Sapiens
LPPDFKIQR

SEQ ID NO: 861235 - protein, 9 aa, Homo Sapiens
YIKEYKFRE

SEQ ID NO: 861236 - protein, 9 aa, Homo Sapiens
APVIPPAAL

SEQ ID NO: 861237 - protein, 9 aa, Homo Sapiens
TLRLPPVIR

SEQ ID NO: 861238 - protein, 9 aa, Homo Sapiens
WLICVAFTT

SEQ ID NO: 861239 - protein, 9 aa, Homo Sapiens
PNERGSWRA

SEQ ID NO: 861240 - protein, 9 aa, Homo Sapiens
NVFTKGENV

SEQ ID NO: 861241 - protein, 9 aa, Homo Sapiens
PVMGTHTST

SEQ ID NO: 861242 - protein, 9 aa, Homo Sapiens
EPFVENDIP

SEQ ID NO: 861243 - protein, 9 aa, Homo Sapiens
TSALKGLTK

SEQ ID NO: 861244 - protein, 9 aa, Homo Sapiens
PRSVKASPR

SEQ ID NO: 861245 - protein, 9 aa, Homo Sapiens
EKECQYSEE

SEQ ID NO: 861246 - protein, 9 aa, Homo Sapiens
KCFMDDVSL

SEQ ID NO: 861247 - protein, 9 aa, Homo Sapiens
APGFNQRLL

SEQ ID NO: 861248 - protein, 9 aa, Homo Sapiens
TKQFFLLFL

SEQ ID NO: 861249 - protein, 9 aa, Homo Sapiens
GAVFMALSA

SEQ ID NO: 861250 - protein, 9 aa, Homo Sapiens
TIQLTAKYI

SEQ ID NO: 861251 - protein, 9 aa, Homo Sapiens
EDLQDEFDC

SEQ ID NO: 861252 - protein, 9 aa, Homo Sapiens
CVHFKPNEG

SEQ ID NO: 861253 - protein, 9 aa, Homo Sapiens
RDTSSVAVD

SEQ ID NO: 861254 - protein, 9 aa, Homo Sapiens
ACACSLDTS

SEQ ID NO: 861255 - protein, 9 aa, Homo Sapiens
SRKRPFPDE

SEQ ID NO: 861256 - protein, 9 aa, Homo Sapiens
SQAGGPKGK

SEQ ID NO: 861257 - protein, 9 aa, Homo Sapiens
LHEPIQIVI

SEQ ID NO: 861258 - protein, 9 aa, Homo Sapiens
TNNPEMQVA

SEQ ID NO: 861259 - protein, 9 aa, Homo Sapiens
GARPQPRAH

SEQ ID NO: 861260 - protein, 9 aa, Homo Sapiens
FIIIMLLNI

SEQ ID NO: 861261 - protein, 9 aa, Homo Sapiens
VDYILLKGK

SEQ ID NO: 861262 - protein, 9 aa, Homo Sapiens
SLDIPKDLP

SEQ ID NO: 861263 - protein, 9 aa, Homo Sapiens
GGQISERKK

SEQ ID NO: 861264 - protein, 9 aa, Homo Sapiens
LMGVLLQWR

SEQ ID NO: 861265 - protein, 9 aa, Homo Sapiens
SFKCKQFLI

SEQ ID NO: 861266 - protein, 9 aa, Homo Sapiens
CIDVDKCLR

SEQ ID NO: 861267 - protein, 9 aa, Homo Sapiens
LVSVCAILV

SEQ ID NO: 861268 - protein, 9 aa, Homo Sapiens
MHILQAETT

SEQ ID NO: 861269 - protein, 9 aa, Homo Sapiens
IHSHVLRQQ

SEQ ID NO: 861270 - protein, 9 aa, Homo Sapiens
EKSFHQLSH

SEQ ID NO: 861271 - protein, 9 aa, Homo Sapiens
QRTEPSPAL

SEQ ID NO: 861272 - protein, 9 aa, Homo Sapiens
NIICTQPRQ

SEQ ID NO: 861273 - protein, 9 aa, Homo Sapiens
PGMGDALNH

SEQ ID NO: 861274 - protein, 9 aa, Homo Sapiens
ICITAMDTE

SEQ ID NO: 861275 - protein, 9 aa, Homo Sapiens
GHLTIHLAL

SEQ ID NO: 861276 - protein, 9 aa, Homo Sapiens
EESKNDRKE

SEQ ID NO: 861277 - protein, 9 aa, Homo Sapiens
SSLAQQPSY

SEQ ID NO: 861278 - protein, 9 aa, Homo Sapiens
LVGLLSGLQ

SEQ ID NO: 861279 - protein, 9 aa, Homo Sapiens
VAGTDSGCY

SEQ ID NO: 861280 - protein, 9 aa, Homo Sapiens
FETMSLYDL

SEQ ID NO: 861281 - protein, 9 aa, Homo Sapiens
DLKDRTIKQ

SEQ ID NO: 861282 - protein, 9 aa, Homo Sapiens
YKKVLLGVV

SEQ ID NO: 861283 - protein, 9 aa, Homo Sapiens
RQFIPIKVE

SEQ ID NO: 861284 - protein, 9 aa, Homo Sapiens
ASIFHLAMW

SEQ ID NO: 861285 - protein, 9 aa, Homo Sapiens
KKGFYTKKQ

SEQ ID NO: 861286 - protein, 9 aa, Homo Sapiens
EESRKVFRF

SEQ ID NO: 861287 - protein, 9 aa, Homo Sapiens
CFFYIIKAW

SEQ ID NO: 861288 - protein, 9 aa, Homo Sapiens
NVMATKYGP

SEQ ID NO: 861289 - protein, 9 aa, Homo Sapiens
THEIESIIL

SEQ ID NO: 861290 - protein, 9 aa, Homo Sapiens
YMHDLFPSL

SEQ ID NO: 861291 - protein, 9 aa, Homo Sapiens
IDEDYRGNA

SEQ ID NO: 861292 - protein, 9 aa, Homo Sapiens
PLGATGLPH

SEQ ID NO: 861293 - protein, 9 aa, Homo Sapiens
KQNLVDCSR

SEQ ID NO: 861294 - protein, 9 aa, Homo Sapiens
AAFSEDQRK

SEQ ID NO: 861295 - protein, 9 aa, Homo Sapiens
DRRLGHHPP

SEQ ID NO: 861296 - protein, 9 aa, Homo Sapiens
HLSCLPASD

SEQ ID NO: 861297 - protein, 9 aa, Homo Sapiens
TRGIKNRSS

SEQ ID NO: 861298 - protein, 9 aa, Homo Sapiens
LLGQDKETV

SEQ ID NO: 861299 - protein, 9 aa, Homo Sapiens
EEVISVETR

SEQ ID NO: 861300 - protein, 9 aa, Homo Sapiens
QTPVVRPAH

SEQ ID NO: 861301 - protein, 9 aa, Homo Sapiens
HLGTTGRFM

SEQ ID NO: 861302 - protein, 9 aa, Homo Sapiens
SRNWRERAE

SEQ ID NO: 861303 - protein, 9 aa, Homo Sapiens
IYILFAPLC

SEQ ID NO: 861304 - protein, 9 aa, Homo Sapiens
ENLRLDLCC

SEQ ID NO: 861305 - protein, 9 aa, Homo Sapiens
PGKYPMTDA

SEQ ID NO: 861306 - protein, 9 aa, Homo Sapiens
LRWLEDGFP

SEQ ID NO: 861307 - protein, 9 aa, Homo Sapiens
FDKKKEINK

SEQ ID NO: 861308 - protein, 9 aa, Homo Sapiens
ASEPQYSVA

SEQ ID NO: 861309 - protein, 9 aa, Homo Sapiens
YLNGRRINT

SEQ ID NO: 861310 - protein, 9 aa, Homo Sapiens
FSGSLCAGC

SEQ ID NO: 861311 - protein, 9 aa, Homo Sapiens
KNREKFCNR

SEQ ID NO: 861312 - protein, 9 aa, Homo Sapiens
KWNYCVRRR

SEQ ID NO: 861313 - protein, 9 aa, Homo Sapiens
TSLGTLYTS

SEQ ID NO: 861314 - protein, 9 aa, Homo Sapiens
WLQLFKTQN

SEQ ID NO: 861315 - protein, 9 aa, Homo Sapiens
AQCLPPTSS

SEQ ID NO: 861316 - protein, 9 aa, Homo Sapiens
REVSSWTAE

SEQ ID NO: 861317 - protein, 9 aa, Homo Sapiens
ELMHSLEGF

SEQ ID NO: 861318 - protein, 9 aa, Homo Sapiens
QGRVPCVMF

SEQ ID NO: 861319 - protein, 9 aa, Homo Sapiens
EFKGNSKVN

SEQ ID NO: 861320 - protein, 9 aa, Homo Sapiens
SWVNTVNKD

SEQ ID NO: 861321 - protein, 9 aa, Homo Sapiens
LIKCRDMTR

SEQ ID NO: 861322 - protein, 9 aa, Homo Sapiens
MEQDNKGRP

SEQ ID NO: 861323 - protein, 9 aa, Homo Sapiens
EAVEEIQCY

SEQ ID NO: 861324 - protein, 9 aa, Homo Sapiens
RDVSSLRMM

SEQ ID NO: 861325 - protein, 9 aa, Homo Sapiens
KFIKEPSKT

SEQ ID NO: 861326 - protein, 9 aa, Homo Sapiens
QLIKKSPSD

SEQ ID NO: 861327 - protein, 9 aa, Homo Sapiens
LSRTPGNII

SEQ ID NO: 861328 - protein, 9 aa, Homo Sapiens
VTPEYTVAD

SEQ ID NO: 861329 - protein, 9 aa, Homo Sapiens
QLFECMNFL

SEQ ID NO: 861330 - protein, 9 aa, Homo Sapiens
HRRINTGEK

SEQ ID NO: 861331 - protein, 9 aa, Homo Sapiens
PVPAEELCN

SEQ ID NO: 861332 - protein, 9 aa, Homo Sapiens
LFHAEQDKF

SEQ ID NO: 861333 - protein, 9 aa, Homo Sapiens
SFNETSPEI

SEQ ID NO: 861334 - protein, 9 aa, Homo Sapiens
TMTTTERHH

SEQ ID NO: 861335 - protein, 9 aa, Homo Sapiens
TAKYILYRL

SEQ ID NO: 861336 - protein, 9 aa, Homo Sapiens
RMNIDREFA

SEQ ID NO: 861337 - protein, 9 aa, Homo Sapiens
VLSLLEEVM

SEQ ID NO: 861338 - protein, 9 aa, Homo Sapiens
IDHFMKSGF

SEQ ID NO: 861339 - protein, 9 aa, Homo Sapiens
NNLVKKKER

SEQ ID NO: 861340 - protein, 9 aa, Homo Sapiens
GPKVAFPGP

SEQ ID NO: 861341 - protein, 9 aa, Homo Sapiens
TALTQLVKE

SEQ ID NO: 861342 - protein, 9 aa, Homo Sapiens
RELQNTVAS

SEQ ID NO: 861343 - protein, 9 aa, Homo Sapiens
HVESRTDKE

SEQ ID NO: 861344 - protein, 9 aa, Homo Sapiens
CGFNERNVN

SEQ ID NO: 861345 - protein, 9 aa, Homo Sapiens
WNSRLLPDQ

SEQ ID NO: 861346 - protein, 9 aa, Homo Sapiens
ARVLELEAE

SEQ ID NO: 861347 - protein, 9 aa, Homo Sapiens
VKIEFEDVI

SEQ ID NO: 861348 - protein, 9 aa, Homo Sapiens
AGAILQANS

SEQ ID NO: 861349 - protein, 9 aa, Homo Sapiens
SVGKEGTRM

SEQ ID NO: 861350 - protein, 9 aa, Homo Sapiens
EKEKEPGKL

SEQ ID NO: 861351 - protein, 9 aa, Homo Sapiens
SCMSEQSER

SEQ ID NO: 861352 - protein, 9 aa, Homo Sapiens
PAKSKCIFM

SEQ ID NO: 861353 - protein, 9 aa, Homo Sapiens
VSLAGHSIS

SEQ ID NO: 861354 - protein, 9 aa, Homo Sapiens
LCIARFRFR

SEQ ID NO: 861355 - protein, 9 aa, Homo Sapiens
WNNEVKEKG

SEQ ID NO: 861356 - protein, 9 aa, Homo Sapiens
PGAKYKVKA

SEQ ID NO: 861357 - protein, 9 aa, Homo Sapiens
NNPEMQVAL

SEQ ID NO: 861358 - protein, 9 aa, Homo Sapiens
KSGFLARKM

SEQ ID NO: 861359 - protein, 9 aa, Homo Sapiens
RIKTLQADF

SEQ ID NO: 861360 - protein, 9 aa, Homo Sapiens
EKQICDTLL

SEQ ID NO: 861361 - protein, 9 aa, Homo Sapiens
IKRTRLPQY

SEQ ID NO: 861362 - protein, 9 aa, Homo Sapiens
NIFTLQCEE

SEQ ID NO: 861363 - protein, 9 aa, Homo Sapiens
LTDPAELKK

SEQ ID NO: 861364 - protein, 9 aa, Homo Sapiens
KGDRCDNCG

SEQ ID NO: 861365 - protein, 9 aa, Homo Sapiens
NYCGISGIG

SEQ ID NO: 861366 - protein, 9 aa, Homo Sapiens
RCVAQVGPE

SEQ ID NO: 861367 - protein, 9 aa, Homo Sapiens
LPTLTWFVP

SEQ ID NO: 861368 - protein, 9 aa, Homo Sapiens
EERLCEQDK

SEQ ID NO: 861369 - protein, 9 aa, Homo Sapiens
VEHVFRIKD

SEQ ID NO: 861370 - protein, 9 aa, Homo Sapiens
LPFPLLITA

SEQ ID NO: 861371 - protein, 9 aa, Homo Sapiens
RSGRSYPHL

SEQ ID NO: 861372 - protein, 9 aa, Homo Sapiens
CSCWAWQGL

SEQ ID NO: 861373 - protein, 9 aa, Homo Sapiens
EHDAHIVHI

SEQ ID NO: 861374 - protein, 9 aa, Homo Sapiens
PSGQPPHLE

SEQ ID NO: 861375 - protein, 9 aa, Homo Sapiens
KHYAEYQVC

SEQ ID NO: 861376 - protein, 9 aa, Homo Sapiens
AASIYQSSD

SEQ ID NO: 861377 - protein, 9 aa, Homo Sapiens
GPGYRVACF

SEQ ID NO: 861378 - protein, 9 aa, Homo Sapiens
SSVSLRAPA

SEQ ID NO: 861379 - protein, 9 aa, Homo Sapiens
YGRQTVPSG

SEQ ID NO: 861380 - protein, 9 aa, Homo Sapiens
KFMIFKSSY

SEQ ID NO: 861381 - protein, 9 aa, Homo Sapiens
QQVLSVMSK

SEQ ID NO: 861382 - protein, 9 aa, Homo Sapiens
KPGEPEAPM

SEQ ID NO: 861383 - protein, 9 aa, Homo Sapiens
ATMRYEPAN

SEQ ID NO: 861384 - protein, 9 aa, Homo Sapiens
EGMTVTVHM

SEQ ID NO: 861385 - protein, 9 aa, Homo Sapiens
ENIIQASLA

SEQ ID NO: 861386 - protein, 9 aa, Homo Sapiens
GVQRKRADT

SEQ ID NO: 861387 - protein, 9 aa, Homo Sapiens
FGTMLPASA

SEQ ID NO: 861388 - protein, 9 aa, Homo Sapiens
KSNNIFIHE

SEQ ID NO: 861389 - protein, 9 aa, Homo Sapiens
WLGYVNYLI

SEQ ID NO: 861390 - protein, 9 aa, Homo Sapiens
REEARRAFN

SEQ ID NO: 861391 - protein, 9 aa, Homo Sapiens
TAGLSKRWP

SEQ ID NO: 861392 - protein, 9 aa, Homo Sapiens
ANKDNKVDF

SEQ ID NO: 861393 - protein, 9 aa, Homo Sapiens
CPAHILNKA

SEQ ID NO: 861394 - protein, 9 aa, Homo Sapiens
LFYGNVGYR

SEQ ID NO: 861395 - protein, 9 aa, Homo Sapiens
PPTDGEGAG

SEQ ID NO: 861396 - protein, 9 aa, Homo Sapiens
QMPEYTVTS

SEQ ID NO: 861397 - protein, 9 aa, Homo Sapiens
WLDSDATSP

SEQ ID NO: 861398 - protein, 9 aa, Homo Sapiens
MQKHSSSLF

SEQ ID NO: 861399 - protein, 9 aa, Homo Sapiens
KNAQKKINR

SEQ ID NO: 861400 - protein, 9 aa, Homo Sapiens
ESIFPDFFV

SEQ ID NO: 861401 - protein, 9 aa, Homo Sapiens
NPILYDIMS

SEQ ID NO: 861402 - protein, 9 aa, Homo Sapiens
TDTFHPEIL

SEQ ID NO: 861403 - protein, 9 aa, Homo Sapiens
TISDVLNNA

SEQ ID NO: 861404 - protein, 9 aa, Homo Sapiens
VDSGLYLVM

SEQ ID NO: 861405 - protein, 9 aa, Homo Sapiens
PKQNGLYAC

SEQ ID NO: 861406 - protein, 9 aa, Homo Sapiens
RGIFKTKFL

SEQ ID NO: 861407 - protein, 9 aa, Homo Sapiens
WKCISQALL

SEQ ID NO: 861408 - protein, 9 aa, Homo Sapiens
GNLEFRALL

SEQ ID NO: 861409 - protein, 9 aa, Homo Sapiens
LVYCLKRNP

SEQ ID NO: 861410 - protein, 9 aa, Homo Sapiens
RIDHFMKSG

SEQ ID NO: 861411 - protein, 9 aa, Homo Sapiens
DPTLPQESM

SEQ ID NO: 861412 - protein, 9 aa, Homo Sapiens
RVRKTDTNR

SEQ ID NO: 861413 - protein, 9 aa, Homo Sapiens
DEEKNHSKL

SEQ ID NO: 861414 - protein, 9 aa, Homo Sapiens
QYDQIYCGA

SEQ ID NO: 861415 - protein, 9 aa, Homo Sapiens
TRGCHPSHE

SEQ ID NO: 861416 - protein, 9 aa, Homo Sapiens
PPQSIKLMD

SEQ ID NO: 861417 - protein, 9 aa, Homo Sapiens
NCINANFLT

SEQ ID NO: 861418 - protein, 9 aa, Homo Sapiens
HTNPPPEPD

SEQ ID NO: 861419 - protein, 9 aa, Homo Sapiens
DAPETTHKS

SEQ ID NO: 861420 - protein, 9 aa, Homo Sapiens
RTQAAAPVT

SEQ ID NO: 861421 - protein, 9 aa, Homo Sapiens
YCPVQNDIA

SEQ ID NO: 861422 - protein, 9 aa, Homo Sapiens
NTCYCCYLY

SEQ ID NO: 861423 - protein, 9 aa, Homo Sapiens
SCCSSSGCG

SEQ ID NO: 861424 - protein, 9 aa, Homo Sapiens
AGLALIKTY

SEQ ID NO: 861425 - protein, 9 aa, Homo Sapiens
FIILGFSEY

SEQ ID NO: 861426 - protein, 9 aa, Homo Sapiens
AQGPSRKRR

SEQ ID NO: 861427 - protein, 9 aa, Homo Sapiens
LNSSLLTLD

SEQ ID NO: 861428 - protein, 9 aa, Homo Sapiens
SERAHFIRC

SEQ ID NO: 861429 - protein, 9 aa, Homo Sapiens
LKGRCFRGS

SEQ ID NO: 861430 - protein, 9 aa, Homo Sapiens
SLEHASDLQ

SEQ ID NO: 861431 - protein, 9 aa, Homo Sapiens
ISDLRTFRV

SEQ ID NO: 861432 - protein, 9 aa, Homo Sapiens
CVSHLTVVA

SEQ ID NO: 861433 - protein, 9 aa, Homo Sapiens
CQKVELNKE

SEQ ID NO: 861434 - protein, 9 aa, Homo Sapiens
AFSRSLGLI

SEQ ID NO: 861435 - protein, 9 aa, Homo Sapiens
WDLGRLSLG

SEQ ID NO: 861436 - protein, 9 aa, Homo Sapiens
SEIKCNSYN

SEQ ID NO: 861437 - protein, 9 aa, Homo Sapiens
IYRVAGQLQ

SEQ ID NO: 861438 - protein, 9 aa, Homo Sapiens
IVLMTAEID

SEQ ID NO: 861439 - protein, 9 aa, Homo Sapiens
KKDPNERGS

SEQ ID NO: 861440 - protein, 9 aa, Homo Sapiens
VNLNNNFSL

SEQ ID NO: 861441 - protein, 9 aa, Homo Sapiens
PRMLGAVQM

SEQ ID NO: 861442 - protein, 9 aa, Homo Sapiens
YLYQFQLFQ

SEQ ID NO: 861443 - protein, 9 aa, Homo Sapiens
CGLDDSKKI

SEQ ID NO: 861444 - protein, 9 aa, Homo Sapiens
GNENGHFEI

SEQ ID NO: 861445 - protein, 9 aa, Homo Sapiens
AFIGISLVI

SEQ ID NO: 861446 - protein, 9 aa, Homo Sapiens
RFKNIDESW

SEQ ID NO: 861447 - protein, 9 aa, Homo Sapiens
FLRTEYSED

SEQ ID NO: 861448 - protein, 9 aa, Homo Sapiens
SQLPLKSDA

SEQ ID NO: 861449 - protein, 9 aa, Homo Sapiens
GLHWMEGDP

SEQ ID NO: 861450 - protein, 9 aa, Homo Sapiens
RDKLVIFLD

SEQ ID NO: 861451 - protein, 9 aa, Homo Sapiens
DGHLVNLNG

SEQ ID NO: 861452 - protein, 9 aa, Homo Sapiens
KDKLCQYDE

SEQ ID NO: 861453 - protein, 9 aa, Homo Sapiens
YSTVEQLYE

SEQ ID NO: 861454 - protein, 9 aa, Homo Sapiens
RPSIAGLDY

SEQ ID NO: 861455 - protein, 9 aa, Homo Sapiens
PLSYGSRFC

SEQ ID NO: 861456 - protein, 9 aa, Homo Sapiens
FLEVLKEDA

SEQ ID NO: 861457 - protein, 9 aa, Homo Sapiens
HQWNVVAIN

SEQ ID NO: 861458 - protein, 9 aa, Homo Sapiens
KSPDCLADI

SEQ ID NO: 861459 - protein, 9 aa, Homo Sapiens
RFDPGTSMK

SEQ ID NO: 861460 - protein, 9 aa, Homo Sapiens
KKPRKNVNV

SEQ ID NO: 861461 - protein, 9 aa, Homo Sapiens
IRANYLQDR

SEQ ID NO: 861462 - protein, 9 aa, Homo Sapiens
GRQQRKSEK

SEQ ID NO: 861463 - protein, 9 aa, Homo Sapiens
KRKGSRKES

SEQ ID NO: 861464 - protein, 9 aa, Homo Sapiens
ADRDYHIFY

SEQ ID NO: 861465 - protein, 9 aa, Homo Sapiens
GLLGIRGSV

SEQ ID NO: 861466 - protein, 9 aa, Homo Sapiens
VDDKLDITT

SEQ ID NO: 861467 - protein, 9 aa, Homo Sapiens
NLFQIVSNL

SEQ ID NO: 861468 - protein, 9 aa, Homo Sapiens
TIEDLCEVY

SEQ ID NO: 861469 - protein, 9 aa, Homo Sapiens
KISKEESKL

SEQ ID NO: 861470 - protein, 9 aa, Homo Sapiens
IDKILAKKQ

SEQ ID NO: 861471 - protein, 9 aa, Homo Sapiens
SRNLQRYCY

SEQ ID NO: 861472 - protein, 9 aa, Homo Sapiens
HNKIRNILP

SEQ ID NO: 861473 - protein, 9 aa, Homo Sapiens
HFIYNNVSE

SEQ ID NO: 861474 - protein, 9 aa, Homo Sapiens
YTPGNPPAE

SEQ ID NO: 861475 - protein, 9 aa, Homo Sapiens
QTGHNYLRD

SEQ ID NO: 861476 - protein, 9 aa, Homo Sapiens
MKENSITLN

SEQ ID NO: 861477 - protein, 9 aa, Homo Sapiens
GVKTTDPKS

SEQ ID NO: 861478 - protein, 9 aa, Homo Sapiens
ICQPRKKGR

SEQ ID NO: 861479 - protein, 9 aa, Homo Sapiens
DAVRNIRAG

SEQ ID NO: 861480 - protein, 9 aa, Homo Sapiens
ESVCQRYNK

SEQ ID NO: 861481 - protein, 9 aa, Homo Sapiens
NLIELPYHG

SEQ ID NO: 861482 - protein, 9 aa, Homo Sapiens
GAWATLQLL

SEQ ID NO: 861483 - protein, 9 aa, Homo Sapiens
IRKPDTLQT

SEQ ID NO: 861484 - protein, 9 aa, Homo Sapiens
DFHDNLENY

SEQ ID NO: 861485 - protein, 9 aa, Homo Sapiens
NKMGIKSGF

SEQ ID NO: 861486 - protein, 9 aa, Homo Sapiens
SSKCEECGK

SEQ ID NO: 861487 - protein, 9 aa, Homo Sapiens
NNLSLTEKS

SEQ ID NO: 861488 - protein, 9 aa, Homo Sapiens
MYPLPEDPA

SEQ ID NO: 861489 - protein, 9 aa, Homo Sapiens
SQTNIQHLK

SEQ ID NO: 861490 - protein, 9 aa, Homo Sapiens
ITKAIKLKN

SEQ ID NO: 861491 - protein, 9 aa, Homo Sapiens
ANMPVRPKP

SEQ ID NO: 861492 - protein, 9 aa, Homo Sapiens
SLGCISYYM

SEQ ID NO: 861493 - protein, 9 aa, Homo Sapiens
TLHRASPHS

SEQ ID NO: 861494 - protein, 9 aa, Homo Sapiens
PHGSDTPNP

SEQ ID NO: 861495 - protein, 9 aa, Homo Sapiens
PSLCMFFEP

SEQ ID NO: 861496 - protein, 9 aa, Homo Sapiens
GILLPPSII

SEQ ID NO: 861497 - protein, 9 aa, Homo Sapiens
VGGTLSSGL

SEQ ID NO: 861498 - protein, 9 aa, Homo Sapiens
FVLANQSLR

SEQ ID NO: 861499 - protein, 9 aa, Homo Sapiens
LGILVFLST

SEQ ID NO: 861500 - protein, 9 aa, Homo Sapiens
QVDNLDEII

SEQ ID NO: 861501 - protein, 9 aa, Homo Sapiens
SKQLLGEVK

SEQ ID NO: 861502 - protein, 9 aa, Homo Sapiens
SADKSVAKK

SEQ ID NO: 861503 - protein, 9 aa, Homo Sapiens
VLPKWGREQ

SEQ ID NO: 861504 - protein, 9 aa, Homo Sapiens
RSALQSINK

SEQ ID NO: 861505 - protein, 9 aa, Homo Sapiens
KKRYEDEIN

SEQ ID NO: 861506 - protein, 9 aa, Homo Sapiens
GEVRNEEHA

SEQ ID NO: 861507 - protein, 9 aa, Homo Sapiens
TKTPAGASE

SEQ ID NO: 861508 - protein, 9 aa, Homo Sapiens
IHRFQPTAL

SEQ ID NO: 861509 - protein, 9 aa, Homo Sapiens
EVKRVAATS

SEQ ID NO: 861510 - protein, 9 aa, Homo Sapiens
ATVQNRFTT

SEQ ID NO: 861511 - protein, 9 aa, Homo Sapiens
NLYTDVMLE

SEQ ID NO: 861512 - protein, 9 aa, Homo Sapiens
YQDSVTFDN

SEQ ID NO: 861513 - protein, 9 aa, Homo Sapiens
KITIPNALI

SEQ ID NO: 861514 - protein, 9 aa, Homo Sapiens
SYMLWYRQD

SEQ ID NO: 861515 - protein, 9 aa, Homo Sapiens
NKQSSEQNW

SEQ ID NO: 861516 - protein, 9 aa, Homo Sapiens
DKRQQGKNE

SEQ ID NO: 861517 - protein, 9 aa, Homo Sapiens
EQLSKSAKE

SEQ ID NO: 861518 - protein, 9 aa, Homo Sapiens
PVVPPTEYF

SEQ ID NO: 861519 - protein, 9 aa, Homo Sapiens
TGSGLGTFI

SEQ ID NO: 861520 - protein, 9 aa, Homo Sapiens
ESSWISDGK

SEQ ID NO: 861521 - protein, 9 aa, Homo Sapiens
KWDKSALGY

SEQ ID NO: 861522 - protein, 9 aa, Homo Sapiens
VLKHTQSIT

SEQ ID NO: 861523 - protein, 9 aa, Homo Sapiens
MALCQNARE

SEQ ID NO: 861524 - protein, 9 aa, Homo Sapiens
KAYTSAGTG

SEQ ID NO: 861525 - protein, 9 aa, Homo Sapiens
LGRVPSLKR

SEQ ID NO: 861526 - protein, 9 aa, Homo Sapiens
YTSAGTGPS

SEQ ID NO: 861527 - protein, 9 aa, Homo Sapiens
QVLSDKENH

SEQ ID NO: 861528 - protein, 9 aa, Homo Sapiens
GSLQRDMQP

SEQ ID NO: 861529 - protein, 9 aa, Homo Sapiens
DEAIKCINR

SEQ ID NO: 861530 - protein, 9 aa, Homo Sapiens
KQEKALWRL

SEQ ID NO: 861531 - protein, 9 aa, Homo Sapiens
KRKKQRSRI

SEQ ID NO: 861532 - protein, 9 aa, Homo Sapiens
IQDLRWTSE

SEQ ID NO: 861533 - protein, 9 aa, Homo Sapiens
MYGEECIFY

SEQ ID NO: 861534 - protein, 9 aa, Homo Sapiens
INKILNNLE

SEQ ID NO: 861535 - protein, 9 aa, Homo Sapiens
GASRDVWMS

SEQ ID NO: 861536 - protein, 9 aa, Homo Sapiens
VMGTHTSTK

SEQ ID NO: 861537 - protein, 9 aa, Homo Sapiens
IQSIFENQQ

SEQ ID NO: 861538 - protein, 9 aa, Homo Sapiens
GQSSGFRGN

SEQ ID NO: 861539 - protein, 9 aa, Homo Sapiens
RKYINTIED

SEQ ID NO: 861540 - protein, 9 aa, Homo Sapiens
TNKRVSSFR

SEQ ID NO: 861541 - protein, 9 aa, Homo Sapiens
KIKRTKQEP

SEQ ID NO: 861542 - protein, 9 aa, Homo Sapiens
YGFFHESDS

SEQ ID NO: 861543 - protein, 9 aa, Homo Sapiens
GYIFVYSAK

SEQ ID NO: 861544 - protein, 9 aa, Homo Sapiens
QRGYVVLLE

SEQ ID NO: 861545 - protein, 9 aa, Homo Sapiens
AWACGYRGS

SEQ ID NO: 861546 - protein, 9 aa, Homo Sapiens
TTQLIPALV

SEQ ID NO: 861547 - protein, 9 aa, Homo Sapiens
RKWDFSPVP

SEQ ID NO: 861548 - protein, 9 aa, Homo Sapiens
HAIIRLDLA

SEQ ID NO: 861549 - protein, 9 aa, Homo Sapiens
KTLRKRASK

SEQ ID NO: 861550 - protein, 9 aa, Homo Sapiens
KAFHTFSNS

SEQ ID NO: 861551 - protein, 9 aa, Homo Sapiens
VCRQPSQMI

SEQ ID NO: 861552 - protein, 9 aa, Homo Sapiens
FETSVTWTR

SEQ ID NO: 861553 - protein, 9 aa, Homo Sapiens
ESNLFLAEH

SEQ ID NO: 861554 - protein, 9 aa, Homo Sapiens
GTLPAEAPS

SEQ ID NO: 861555 - protein, 9 aa, Homo Sapiens
MLPDPQNIY

SEQ ID NO: 861556 - protein, 9 aa, Homo Sapiens
FHEEPQIAP

SEQ ID NO: 861557 - protein, 9 aa, Homo Sapiens
ATIADLILY

SEQ ID NO: 861558 - protein, 9 aa, Homo Sapiens
ISAGSVSVP

SEQ ID NO: 861559 - protein, 9 aa, Homo Sapiens
QKENTGQHN

SEQ ID NO: 861560 - protein, 9 aa, Homo Sapiens
VSPIFSKKG

SEQ ID NO: 861561 - protein, 9 aa, Homo Sapiens
KDNQGDTPL

SEQ ID NO: 861562 - protein, 9 aa, Homo Sapiens
VMGSSRVPH

SEQ ID NO: 861563 - protein, 9 aa, Homo Sapiens
GGAQINRIF

SEQ ID NO: 861564 - protein, 9 aa, Homo Sapiens
FLYTLMREV

SEQ ID NO: 861565 - protein, 9 aa, Homo Sapiens
HPFCEPVFV

SEQ ID NO: 861566 - protein, 9 aa, Homo Sapiens
ILVKHMKYI

SEQ ID NO: 861567 - protein, 9 aa, Homo Sapiens
CPHLDSVGD

SEQ ID NO: 861568 - protein, 9 aa, Homo Sapiens
SSLPTFSVA

SEQ ID NO: 861569 - protein, 9 aa, Homo Sapiens
CGGHYLNVP

SEQ ID NO: 861570 - protein, 9 aa, Homo Sapiens
YLDRNKDQE

SEQ ID NO: 861571 - protein, 9 aa, Homo Sapiens
CTVEYVRQL

SEQ ID NO: 861572 - protein, 9 aa, Homo Sapiens
PPNGKSFCH

SEQ ID NO: 861573 - protein, 9 aa, Homo Sapiens
LYCLWKSRQ

SEQ ID NO: 861574 - protein, 9 aa, Homo Sapiens
KLYPCNQCG

SEQ ID NO: 861575 - protein, 9 aa, Homo Sapiens
SNTKNNKIY

SEQ ID NO: 861576 - protein, 9 aa, Homo Sapiens
IQQMKSQWM

SEQ ID NO: 861577 - protein, 9 aa, Homo Sapiens
GERFSQSFN

SEQ ID NO: 861578 - protein, 9 aa, Homo Sapiens
RRGRHAVRV

SEQ ID NO: 861579 - protein, 9 aa, Homo Sapiens
EAFQKRNRI

SEQ ID NO: 861580 - protein, 9 aa, Homo Sapiens
GESCLNTIA

SEQ ID NO: 861581 - protein, 9 aa, Homo Sapiens
RWLTLKEQP

SEQ ID NO: 861582 - protein, 9 aa, Homo Sapiens
FNVEHLKAP

SEQ ID NO: 861583 - protein, 9 aa, Homo Sapiens
SKAFVNCAE

SEQ ID NO: 861584 - protein, 9 aa, Homo Sapiens
NHMRAAILE

SEQ ID NO: 861585 - protein, 9 aa, Homo Sapiens
LSLLLVSMY

SEQ ID NO: 861586 - protein, 9 aa, Homo Sapiens
NMYDNAAEA

SEQ ID NO: 861587 - protein, 9 aa, Homo Sapiens
ALPCGCLCG

SEQ ID NO: 861588 - protein, 9 aa, Homo Sapiens
QDVFNPSWK

SEQ ID NO: 861589 - protein, 9 aa, Homo Sapiens
HQHDFQKVK

SEQ ID NO: 861590 - protein, 9 aa, Homo Sapiens
ACEVKGEED

SEQ ID NO: 861591 - protein, 9 aa, Homo Sapiens
PYILKIDSY

SEQ ID NO: 861592 - protein, 9 aa, Homo Sapiens
ISYGLPAVP

SEQ ID NO: 861593 - protein, 9 aa, Homo Sapiens
DPFDTPSFN

SEQ ID NO: 861594 - protein, 9 aa, Homo Sapiens
EPQTEDGIT

SEQ ID NO: 861595 - protein, 9 aa, Homo Sapiens
WGVGKSAMT

SEQ ID NO: 861596 - protein, 9 aa, Homo Sapiens
DMNNKLEEL

SEQ ID NO: 861597 - protein, 9 aa, Homo Sapiens
GNDTLQDVL

SEQ ID NO: 861598 - protein, 9 aa, Homo Sapiens
DTFSGLFSA

SEQ ID NO: 861599 - protein, 9 aa, Homo Sapiens
PTYKRRAIS

SEQ ID NO: 861600 - protein, 9 aa, Homo Sapiens
KATLVPSER

SEQ ID NO: 861601 - protein, 9 aa, Homo Sapiens
IHSIKYCLG

SEQ ID NO: 861602 - protein, 9 aa, Homo Sapiens
PASLHYRFA

SEQ ID NO: 861603 - protein, 9 aa, Homo Sapiens
HKYKKQIDH

SEQ ID NO: 861604 - protein, 9 aa, Homo Sapiens
TLQWKSANF

SEQ ID NO: 861605 - protein, 9 aa, Homo Sapiens
VPSHLSRLP

SEQ ID NO: 861606 - protein, 9 aa, Homo Sapiens
RSSAEITSD

SEQ ID NO: 861607 - protein, 9 aa, Homo Sapiens
VRFLEQQNT

SEQ ID NO: 861608 - protein, 9 aa, Homo Sapiens
IQHFNIHTG

SEQ ID NO: 861609 - protein, 9 aa, Homo Sapiens
FHKNVIQSV

SEQ ID NO: 861610 - protein, 9 aa, Homo Sapiens
MPMLYNTCY

SEQ ID NO: 861611 - protein, 9 aa, Homo Sapiens
FQDTVLQHV

SEQ ID NO: 861612 - protein, 9 aa, Homo Sapiens
QVLLTNVVM

SEQ ID NO: 861613 - protein, 9 aa, Homo Sapiens
NGEAGLEGP

SEQ ID NO: 861614 - protein, 9 aa, Homo Sapiens
EKSTKHPEK

SEQ ID NO: 861615 - protein, 9 aa, Homo Sapiens
LETLGGDKL

SEQ ID NO: 861616 - protein, 9 aa, Homo Sapiens
IAGGQVMTI

SEQ ID NO: 861617 - protein, 9 aa, Homo Sapiens
LSLAFSGVV

SEQ ID NO: 861618 - protein, 9 aa, Homo Sapiens
GEGRFGVSH

SEQ ID NO: 861619 - protein, 9 aa, Homo Sapiens
MASDYLMKL

SEQ ID NO: 861620 - protein, 9 aa, Homo Sapiens
WRCQVARSR

SEQ ID NO: 861621 - protein, 9 aa, Homo Sapiens
ALRGLDRTH

SEQ ID NO: 861622 - protein, 9 aa, Homo Sapiens
RGLVLKIFF

SEQ ID NO: 861623 - protein, 9 aa, Homo Sapiens
KQIKHTMAF

SEQ ID NO: 861624 - protein, 9 aa, Homo Sapiens
QEALRFLQN

SEQ ID NO: 861625 - protein, 9 aa, Homo Sapiens
AEKGSHMPE

SEQ ID NO: 861626 - protein, 9 aa, Homo Sapiens
HDHAEVVFT

SEQ ID NO: 861627 - protein, 9 aa, Homo Sapiens
YHEQHLFYI

SEQ ID NO: 861628 - protein, 9 aa, Homo Sapiens
RSIFGTMLP

SEQ ID NO: 861629 - protein, 9 aa, Homo Sapiens
DSFSAFQEL

SEQ ID NO: 861630 - protein, 9 aa, Homo Sapiens
LPYNEMETL

SEQ ID NO: 861631 - protein, 9 aa, Homo Sapiens
KNALHLAAK

SEQ ID NO: 861632 - protein, 9 aa, Homo Sapiens
SGQAYVALY

SEQ ID NO: 861633 - protein, 9 aa, Homo Sapiens
LDALFNESS

SEQ ID NO: 861634 - protein, 9 aa, Homo Sapiens
LPGDVDRAQ

SEQ ID NO: 861635 - protein, 9 aa, Homo Sapiens
VLGMVRVAS

SEQ ID NO: 861636 - protein, 9 aa, Homo Sapiens
GLEGERSAR

SEQ ID NO: 861637 - protein, 9 aa, Homo Sapiens
ILTPMFNPI

SEQ ID NO: 861638 - protein, 9 aa, Homo Sapiens
HTVLMQEYE

SEQ ID NO: 861639 - protein, 9 aa, Homo Sapiens
PHNLSDVDA

SEQ ID NO: 861640 - protein, 9 aa, Homo Sapiens
PSPLTVLTF

SEQ ID NO: 861641 - protein, 9 aa, Homo Sapiens
VSYSSSSAR

SEQ ID NO: 861642 - protein, 9 aa, Homo Sapiens
AGDTEDNMD

SEQ ID NO: 861643 - protein, 9 aa, Homo Sapiens
NQEFLQAHT

SEQ ID NO: 861644 - protein, 9 aa, Homo Sapiens
KDEDTFFSQ

SEQ ID NO: 861645 - protein, 9 aa, Homo Sapiens
PEKLTQTRL

SEQ ID NO: 861646 - protein, 9 aa, Homo Sapiens
PVFIQVPVR

SEQ ID NO: 861647 - protein, 9 aa, Homo Sapiens
ANSTISFGN

SEQ ID NO: 861648 - protein, 9 aa, Homo Sapiens
ISRVNRNVW

SEQ ID NO: 861649 - protein, 9 aa, Homo Sapiens
CRFLFLGTV

SEQ ID NO: 861650 - protein, 9 aa, Homo Sapiens
PRAQELRIS

SEQ ID NO: 861651 - protein, 9 aa, Homo Sapiens
MHGAGNAKN

SEQ ID NO: 861652 - protein, 9 aa, Homo Sapiens
TTGNSRSSI

SEQ ID NO: 861653 - protein, 9 aa, Homo Sapiens
VVILLLLFL

SEQ ID NO: 861654 - protein, 9 aa, Homo Sapiens
LGRDQAASV

SEQ ID NO: 861655 - protein, 9 aa, Homo Sapiens
VKIIENAAP

SEQ ID NO: 861656 - protein, 9 aa, Homo Sapiens
IHQYGYRNN

SEQ ID NO: 861657 - protein, 9 aa, Homo Sapiens
LLCCCLSRG

SEQ ID NO: 861658 - protein, 9 aa, Homo Sapiens
QFDYRDPVF

SEQ ID NO: 861659 - protein, 9 aa, Homo Sapiens
LVRNDYLWH

SEQ ID NO: 861660 - protein, 9 aa, Homo Sapiens
PPLPTEHAS

SEQ ID NO: 861661 - protein, 9 aa, Homo Sapiens
ALTKVVQCR

SEQ ID NO: 861662 - protein, 9 aa, Homo Sapiens
RFTEIYKFH

SEQ ID NO: 861663 - protein, 9 aa, Homo Sapiens
ATGTHECSL

SEQ ID NO: 861664 - protein, 9 aa, Homo Sapiens
DSVEAEAED

SEQ ID NO: 861665 - protein, 9 aa, Homo Sapiens
APEDTAGSQ

SEQ ID NO: 861666 - protein, 9 aa, Homo Sapiens
WKKEAISDL

SEQ ID NO: 861667 - protein, 9 aa, Homo Sapiens
DLAALASRH

SEQ ID NO: 861668 - protein, 9 aa, Homo Sapiens
TRRRVRTLI

SEQ ID NO: 861669 - protein, 9 aa, Homo Sapiens
LSANLQERV

SEQ ID NO: 861670 - protein, 9 aa, Homo Sapiens
SASRPGHVV

SEQ ID NO: 861671 - protein, 9 aa, Homo Sapiens
INLKPSVFH

SEQ ID NO: 861672 - protein, 9 aa, Homo Sapiens
KEAEVLQAA

SEQ ID NO: 861673 - protein, 9 aa, Homo Sapiens
PIMNLLIAL

SEQ ID NO: 861674 - protein, 9 aa, Homo Sapiens
LEKGKCPDN

SEQ ID NO: 861675 - protein, 9 aa, Homo Sapiens
YAMCDVFTQ

SEQ ID NO: 861676 - protein, 9 aa, Homo Sapiens
MELCAKTDP

SEQ ID NO: 861677 - protein, 9 aa, Homo Sapiens
AFTGSIFVV

SEQ ID NO: 861678 - protein, 9 aa, Homo Sapiens
SMINSLPTF

SEQ ID NO: 861679 - protein, 9 aa, Homo Sapiens
SKISRNYVV

SEQ ID NO: 861680 - protein, 9 aa, Homo Sapiens
DVQKILEIK

SEQ ID NO: 861681 - protein, 9 aa, Homo Sapiens
GVPEDMRCV

SEQ ID NO: 861682 - protein, 9 aa, Homo Sapiens
MPSNQNVYP

SEQ ID NO: 861683 - protein, 9 aa, Homo Sapiens
QPTNVSDAF

SEQ ID NO: 861684 - protein, 9 aa, Homo Sapiens
TIILHFAIQ

SEQ ID NO: 861685 - protein, 9 aa, Homo Sapiens
KRTPSAPNL

SEQ ID NO: 861686 - protein, 9 aa, Homo Sapiens
DQDKNPEGD

SEQ ID NO: 861687 - protein, 9 aa, Homo Sapiens
QLMINLCGV

SEQ ID NO: 861688 - protein, 9 aa, Homo Sapiens
KERVRSHIM

SEQ ID NO: 861689 - protein, 9 aa, Homo Sapiens
FILLGGSDK

SEQ ID NO: 861690 - protein, 9 aa, Homo Sapiens
WHYMQKEGL

SEQ ID NO: 861691 - protein, 9 aa, Homo Sapiens
FSIAVENQV

SEQ ID NO: 861692 - protein, 9 aa, Homo Sapiens
HCVTRRETG

SEQ ID NO: 861693 - protein, 9 aa, Homo Sapiens
IARKFVPFR

SEQ ID NO: 861694 - protein, 9 aa, Homo Sapiens
IYQASLLVI

SEQ ID NO: 861695 - protein, 9 aa, Homo Sapiens
EIRRSERNQ

SEQ ID NO: 861696 - protein, 9 aa, Homo Sapiens
SFINYRFMS

SEQ ID NO: 861697 - protein, 9 aa, Homo Sapiens
MEKLGNGAL

SEQ ID NO: 861698 - protein, 9 aa, Homo Sapiens
SAKLYISDL

SEQ ID NO: 861699 - protein, 9 aa, Homo Sapiens
LKKRSKQLL

SEQ ID NO: 861700 - protein, 9 aa, Homo Sapiens
VEVYGLLTL

SEQ ID NO: 861701 - protein, 9 aa, Homo Sapiens
KKRKHQHDF

SEQ ID NO: 861702 - protein, 9 aa, Homo Sapiens
QHSEGYRHI

SEQ ID NO: 861703 - protein, 9 aa, Homo Sapiens
TSRLMIFSV

SEQ ID NO: 861704 - protein, 9 aa, Homo Sapiens
NFEYLHCKF

SEQ ID NO: 861705 - protein, 9 aa, Homo Sapiens
ALQTIGVEA

SEQ ID NO: 861706 - protein, 9 aa, Homo Sapiens
PSWSLAPQD

SEQ ID NO: 861707 - protein, 9 aa, Homo Sapiens
VMLFGEPTT

SEQ ID NO: 861708 - protein, 9 aa, Homo Sapiens
KCSVTRIKK

SEQ ID NO: 861709 - protein, 9 aa, Homo Sapiens
KLDRPRFKR

SEQ ID NO: 861710 - protein, 9 aa, Homo Sapiens
QTLKGLKDL

SEQ ID NO: 861711 - protein, 9 aa, Homo Sapiens
QNLALSRES

SEQ ID NO: 861712 - protein, 9 aa, Homo Sapiens
PSTTIPNMI

SEQ ID NO: 861713 - protein, 9 aa, Homo Sapiens
ANAVPAAVC

SEQ ID NO: 861714 - protein, 9 aa, Homo Sapiens
GKRKVQYDS

SEQ ID NO: 861715 - protein, 9 aa, Homo Sapiens
RSKQEFQFV

SEQ ID NO: 861716 - protein, 9 aa, Homo Sapiens
EDLYSELSK

SEQ ID NO: 861717 - protein, 9 aa, Homo Sapiens
ITTLVVKGT

SEQ ID NO: 861718 - protein, 9 aa, Homo Sapiens
TLLWCRNEK

SEQ ID NO: 861719 - protein, 9 aa, Homo Sapiens
LVRYIKERE

SEQ ID NO: 861720 - protein, 9 aa, Homo Sapiens
VAKTGSLNA

SEQ ID NO: 861721 - protein, 9 aa, Homo Sapiens
NSECKSETA

SEQ ID NO: 861722 - protein, 9 aa, Homo Sapiens
LPKANMPVR

SEQ ID NO: 861723 - protein, 9 aa, Homo Sapiens
VISLFYSLF

SEQ ID NO: 861724 - protein, 9 aa, Homo Sapiens
TNQHIKISC

SEQ ID NO: 861725 - protein, 9 aa, Homo Sapiens
HFEISTDKE

SEQ ID NO: 861726 - protein, 9 aa, Homo Sapiens
SSYLTNSSQ

SEQ ID NO: 861727 - protein, 9 aa, Homo Sapiens
FVCSQQSFE

SEQ ID NO: 861728 - protein, 9 aa, Homo Sapiens
EPITSALHK

SEQ ID NO: 861729 - protein, 9 aa, Homo Sapiens
EMAGASVAV

SEQ ID NO: 861730 - protein, 9 aa, Homo Sapiens
DSAFERNNI

SEQ ID NO: 861731 - protein, 9 aa, Homo Sapiens
EEECIEEED

SEQ ID NO: 861732 - protein, 9 aa, Homo Sapiens
HFATENDFK

SEQ ID NO: 861733 - protein, 9 aa, Homo Sapiens
ARSTTKKSK

SEQ ID NO: 861734 - protein, 9 aa, Homo Sapiens
SEEYEQAAA

SEQ ID NO: 861735 - protein, 9 aa, Homo Sapiens
QTDDRVERV

SEQ ID NO: 861736 - protein, 9 aa, Homo Sapiens
QLRKDFGQK

SEQ ID NO: 861737 - protein, 9 aa, Homo Sapiens
QRLFYGNVG

SEQ ID NO: 861738 - protein, 9 aa, Homo Sapiens
TYVHVLTVT

SEQ ID NO: 861739 - protein, 9 aa, Homo Sapiens
TFVQGVINE

SEQ ID NO: 861740 - protein, 9 aa, Homo Sapiens
LICSFHPSY

SEQ ID NO: 861741 - protein, 9 aa, Homo Sapiens
GIHLYEQPE

SEQ ID NO: 861742 - protein, 9 aa, Homo Sapiens
GQTYEKRIE

SEQ ID NO: 861743 - protein, 9 aa, Homo Sapiens
VKGSLDRNK

SEQ ID NO: 861744 - protein, 9 aa, Homo Sapiens
QQRQQCQAP

SEQ ID NO: 861745 - protein, 9 aa, Homo Sapiens
QMYLWAQKK

SEQ ID NO: 861746 - protein, 9 aa, Homo Sapiens
RIKDGHLVN

SEQ ID NO: 861747 - protein, 9 aa, Homo Sapiens
SYNQIFSSQ

SEQ ID NO: 861748 - protein, 9 aa, Homo Sapiens
QSEYIEEHV

SEQ ID NO: 861749 - protein, 9 aa, Homo Sapiens
SPSNNSSLD

SEQ ID NO: 861750 - protein, 9 aa, Homo Sapiens
AFLDSHPKL

SEQ ID NO: 861751 - protein, 9 aa, Homo Sapiens
GHTSVIRNR

SEQ ID NO: 861752 - protein, 9 aa, Homo Sapiens
TVYRQANTI

SEQ ID NO: 861753 - protein, 9 aa, Homo Sapiens
CEVYNAKHH

SEQ ID NO: 861754 - protein, 9 aa, Homo Sapiens
SYFTQERLP

SEQ ID NO: 861755 - protein, 9 aa, Homo Sapiens
RYMHDLFPS

SEQ ID NO: 861756 - protein, 9 aa, Homo Sapiens
AEGLKGVLI

SEQ ID NO: 861757 - protein, 9 aa, Homo Sapiens
DNGKLKMDD

SEQ ID NO: 861758 - protein, 9 aa, Homo Sapiens
DVWLWLEFF

SEQ ID NO: 861759 - protein, 9 aa, Homo Sapiens
RMAAKNKEC

SEQ ID NO: 861760 - protein, 9 aa, Homo Sapiens
NTLSELNAL

SEQ ID NO: 861761 - protein, 9 aa, Homo Sapiens
KRQYVTTSF

SEQ ID NO: 861762 - protein, 9 aa, Homo Sapiens
QLQLRIAFR

SEQ ID NO: 861763 - protein, 9 aa, Homo Sapiens
RALQWTGAS

SEQ ID NO: 861764 - protein, 9 aa, Homo Sapiens
SGFDQGING

SEQ ID NO: 861765 - protein, 9 aa, Homo Sapiens
LPRLVLKIA

SEQ ID NO: 861766 - protein, 9 aa, Homo Sapiens
NLKRNYSYF

SEQ ID NO: 861767 - protein, 9 aa, Homo Sapiens
KNENGKGRC

SEQ ID NO: 861768 - protein, 9 aa, Homo Sapiens
ALRKNTNID

SEQ ID NO: 861769 - protein, 9 aa, Homo Sapiens
ITGPAPVIP

SEQ ID NO: 861770 - protein, 9 aa, Homo Sapiens
LLYPSHPTV

SEQ ID NO: 861771 - protein, 9 aa, Homo Sapiens
VLGPVRGEP

SEQ ID NO: 861772 - protein, 9 aa, Homo Sapiens
KRNLYSALK

SEQ ID NO: 861773 - protein, 9 aa, Homo Sapiens
KASEKVYLG

SEQ ID NO: 861774 - protein, 9 aa, Homo Sapiens
IIHSGQKPY

SEQ ID NO: 861775 - protein, 9 aa, Homo Sapiens
DGDNDEDTT

SEQ ID NO: 861776 - protein, 9 aa, Homo Sapiens
SLIYLTLEI

SEQ ID NO: 861777 - protein, 9 aa, Homo Sapiens
AWVWAGLGG

SEQ ID NO: 861778 - protein, 9 aa, Homo Sapiens
RRNSDLGVG

SEQ ID NO: 861779 - protein, 9 aa, Homo Sapiens
IYIIQQPQK

SEQ ID NO: 861780 - protein, 9 aa, Homo Sapiens
AVAAPFISG

SEQ ID NO: 861781 - protein, 9 aa, Homo Sapiens
AEIPGAEPD

SEQ ID NO: 861782 - protein, 9 aa, Homo Sapiens
FIECDTFIQ

SEQ ID NO: 861783 - protein, 9 aa, Homo Sapiens
NYPTDNTKF

SEQ ID NO: 861784 - protein, 9 aa, Homo Sapiens
NSLDPLKHV

SEQ ID NO: 861785 - protein, 9 aa, Homo Sapiens
PFDAFTDLN

SEQ ID NO: 861786 - protein, 9 aa, Homo Sapiens
ECGRWFSQK

SEQ ID NO: 861787 - protein, 9 aa, Homo Sapiens
AALLGLRKL

SEQ ID NO: 861788 - protein, 9 aa, Homo Sapiens
MYSSRDLEE

SEQ ID NO: 861789 - protein, 9 aa, Homo Sapiens
DIRSISFPA

SEQ ID NO: 861790 - protein, 9 aa, Homo Sapiens
LELYKDVRQ

SEQ ID NO: 861791 - protein, 9 aa, Homo Sapiens
IIEATNMYD

SEQ ID NO: 861792 - protein, 9 aa, Homo Sapiens
LSQLLLDLS

SEQ ID NO: 861793 - protein, 9 aa, Homo Sapiens
SSLSGLLRK

SEQ ID NO: 861794 - protein, 9 aa, Homo Sapiens
RFMGHRRAS

SEQ ID NO: 861795 - protein, 9 aa, Homo Sapiens
AILALMPLF

SEQ ID NO: 861796 - protein, 9 aa, Homo Sapiens
EEHTSKILM

SEQ ID NO: 861797 - protein, 9 aa, Homo Sapiens
KHKGPPVLT

SEQ ID NO: 861798 - protein, 9 aa, Homo Sapiens
LIIGEAPAT

SEQ ID NO: 861799 - protein, 9 aa, Homo Sapiens
VGTIEDHLH

SEQ ID NO: 861800 - protein, 9 aa, Homo Sapiens
EATPHKLQE

SEQ ID NO: 861801 - protein, 9 aa, Homo Sapiens
FTQISYLVQ

SEQ ID NO: 861802 - protein, 9 aa, Homo Sapiens
RAPHFHINL

SEQ ID NO: 861803 - protein, 9 aa, Homo Sapiens
HRTYVHVLT

SEQ ID NO: 861804 - protein, 9 aa, Homo Sapiens
NNNIETHLK

SEQ ID NO: 861805 - protein, 9 aa, Homo Sapiens
RDYKIKYEF

SEQ ID NO: 861806 - protein, 9 aa, Homo Sapiens
IPASQEEEL

SEQ ID NO: 861807 - protein, 9 aa, Homo Sapiens
HRITIIYLL

SEQ ID NO: 861808 - protein, 9 aa, Homo Sapiens
YAHSGSRDL

SEQ ID NO: 861809 - protein, 9 aa, Homo Sapiens
QNNLSPSLP

SEQ ID NO: 861810 - protein, 9 aa, Homo Sapiens
PICLRHRRS

SEQ ID NO: 861811 - protein, 9 aa, Homo Sapiens
LHKLEQHGG

SEQ ID NO: 861812 - protein, 9 aa, Homo Sapiens
HPKRILLCT

SEQ ID NO: 861813 - protein, 9 aa, Homo Sapiens
AHCKVIIKV

SEQ ID NO: 861814 - protein, 9 aa, Homo Sapiens
SMVPPPVGM

SEQ ID NO: 861815 - protein, 9 aa, Homo Sapiens
KKILKEGLM

SEQ ID NO: 861816 - protein, 9 aa, Homo Sapiens
MKSNNIFIH

SEQ ID NO: 861817 - protein, 9 aa, Homo Sapiens
TFHLVGVPE

SEQ ID NO: 861818 - protein, 9 aa, Homo Sapiens
PTDWMNVLP

SEQ ID NO: 861819 - protein, 9 aa, Homo Sapiens
TPLFEELGT

SEQ ID NO: 861820 - protein, 9 aa, Homo Sapiens
PAWECVGQE

SEQ ID NO: 861821 - protein, 9 aa, Homo Sapiens
LGSDMGGPL

SEQ ID NO: 861822 - protein, 9 aa, Homo Sapiens
MIKCLDYKP

SEQ ID NO: 861823 - protein, 9 aa, Homo Sapiens
PLKNEERKL

SEQ ID NO: 861824 - protein, 9 aa, Homo Sapiens
IQYCIPSPG

SEQ ID NO: 861825 - protein, 9 aa, Homo Sapiens
RPTDVPATG

SEQ ID NO: 861826 - protein, 9 aa, Homo Sapiens
LHLGYIEDF

SEQ ID NO: 861827 - protein, 9 aa, Homo Sapiens
DLSAIQADL

SEQ ID NO: 861828 - protein, 9 aa, Homo Sapiens
RDDLFGMGK

SEQ ID NO: 861829 - protein, 9 aa, Homo Sapiens
YCKPLSSWI

SEQ ID NO: 861830 - protein, 9 aa, Homo Sapiens
VVDHKGNVA

SEQ ID NO: 861831 - protein, 9 aa, Homo Sapiens
DLETSIRRT

SEQ ID NO: 861832 - protein, 9 aa, Homo Sapiens
YQMCLTSDI

SEQ ID NO: 861833 - protein, 9 aa, Homo Sapiens
EVVSPTKRC

SEQ ID NO: 861834 - protein, 9 aa, Homo Sapiens
HIKEYTEIP

SEQ ID NO: 861835 - protein, 9 aa, Homo Sapiens
SPAPAAEPS

SEQ ID NO: 861836 - protein, 9 aa, Homo Sapiens
RAKHLESPQ

SEQ ID NO: 861837 - protein, 9 aa, Homo Sapiens
KDMDTFSGL

SEQ ID NO: 861838 - protein, 9 aa, Homo Sapiens
AGCVGEIIT

SEQ ID NO: 861839 - protein, 9 aa, Homo Sapiens
DKWDKSALG

SEQ ID NO: 861840 - protein, 9 aa, Homo Sapiens
SSANEFSKC

SEQ ID NO: 861841 - protein, 9 aa, Homo Sapiens
YWACVHNYP

SEQ ID NO: 861842 - protein, 9 aa, Homo Sapiens
QRQDNALAI

SEQ ID NO: 861843 - protein, 9 aa, Homo Sapiens
ICNAFTFLP

SEQ ID NO: 861844 - protein, 9 aa, Homo Sapiens
PSPAHIVQI

SEQ ID NO: 861845 - protein, 9 aa, Homo Sapiens
HLSKKAKEK

SEQ ID NO: 861846 - protein, 9 aa, Homo Sapiens
EQPESFRAQ

SEQ ID NO: 861847 - protein, 9 aa, Homo Sapiens
NPAVGLCCP

SEQ ID NO: 861848 - protein, 9 aa, Homo Sapiens
RIHFFRNAL

SEQ ID NO: 861849 - protein, 9 aa, Homo Sapiens
LQYLQQDAK

SEQ ID NO: 861850 - protein, 9 aa, Homo Sapiens
GSGLLREKY

SEQ ID NO: 861851 - protein, 9 aa, Homo Sapiens
NVNEFAPVF

SEQ ID NO: 861852 - protein, 9 aa, Homo Sapiens
KGAMVIYTS

SEQ ID NO: 861853 - protein, 9 aa, Homo Sapiens
AKALSKSCT

SEQ ID NO: 861854 - protein, 9 aa, Homo Sapiens
GAEGPLPLP

SEQ ID NO: 861855 - protein, 9 aa, Homo Sapiens
GYKNFNNFE

SEQ ID NO: 861856 - protein, 9 aa, Homo Sapiens
APGVGLVTT

SEQ ID NO: 861857 - protein, 9 aa, Homo Sapiens
SHSQIKHQN

SEQ ID NO: 861858 - protein, 9 aa, Homo Sapiens
MVMKLIVIH

SEQ ID NO: 861859 - protein, 9 aa, Homo Sapiens
RHMRIHKEV

SEQ ID NO: 861860 - protein, 9 aa, Homo Sapiens
WGLDLDDFA

SEQ ID NO: 861861 - protein, 9 aa, Homo Sapiens
LIYADIFAG

SEQ ID NO: 861862 - protein, 9 aa, Homo Sapiens
PVEKKNKGK

SEQ ID NO: 861863 - protein, 9 aa, Homo Sapiens
CQLHREFLR

SEQ ID NO: 861864 - protein, 9 aa, Homo Sapiens
EELSGDKNR

SEQ ID NO: 861865 - protein, 9 aa, Homo Sapiens
GMKPLSYSQ

SEQ ID NO: 861866 - protein, 9 aa, Homo Sapiens
QCEPITLKL

SEQ ID NO: 861867 - protein, 9 aa, Homo Sapiens
KVCALQCAV

SEQ ID NO: 861868 - protein, 9 aa, Homo Sapiens
LPKARFVAK

SEQ ID NO: 861869 - protein, 9 aa, Homo Sapiens
KQNVLDYYK

SEQ ID NO: 861870 - protein, 9 aa, Homo Sapiens
TVTLLTLGS

SEQ ID NO: 861871 - protein, 9 aa, Homo Sapiens
LHVLLDAIR

SEQ ID NO: 861872 - protein, 9 aa, Homo Sapiens
QGINGEGST

SEQ ID NO: 861873 - protein, 9 aa, Homo Sapiens
HSESSGEDF

SEQ ID NO: 861874 - protein, 9 aa, Homo Sapiens
CGIYNASKN

SEQ ID NO: 861875 - protein, 9 aa, Homo Sapiens
ERNHRPKLT

SEQ ID NO: 861876 - protein, 9 aa, Homo Sapiens
IGVWYSEPT

SEQ ID NO: 861877 - protein, 9 aa, Homo Sapiens
IGLIVHEEA

SEQ ID NO: 861878 - protein, 9 aa, Homo Sapiens
CIKIGVPQE

SEQ ID NO: 861879 - protein, 9 aa, Homo Sapiens
CIKIGVPQD

SEQ ID NO: 861880 - protein, 9 aa, Homo Sapiens
SRKLFLGVA

SEQ ID NO: 861881 - protein, 9 aa, Homo Sapiens
LENIQSIFE

SEQ ID NO: 861882 - protein, 9 aa, Homo Sapiens
LSPDWCKCK

SEQ ID NO: 861883 - protein, 9 aa, Homo Sapiens
GPATQNRES

SEQ ID NO: 861884 - protein, 9 aa, Homo Sapiens
MDVYLIHWP

SEQ ID NO: 861885 - protein, 9 aa, Homo Sapiens
STQLTNKGQ

SEQ ID NO: 861886 - protein, 9 aa, Homo Sapiens
PDICKDKRV

SEQ ID NO: 861887 - protein, 9 aa, Homo Sapiens
SEDLYPNIN

SEQ ID NO: 861888 - protein, 9 aa, Homo Sapiens
EHMHSQRVM

SEQ ID NO: 861889 - protein, 9 aa, Homo Sapiens
SLQKHDIPE

SEQ ID NO: 861890 - protein, 9 aa, Homo Sapiens
TLGGLTAVV

SEQ ID NO: 861891 - protein, 9 aa, Homo Sapiens
YLKEPQCPP

SEQ ID NO: 861892 - protein, 9 aa, Homo Sapiens
FKEAVCYVL

SEQ ID NO: 861893 - protein, 9 aa, Homo Sapiens
AQKGAKGES

SEQ ID NO: 861894 - protein, 9 aa, Homo Sapiens
LEVPEMSPV

SEQ ID NO: 861895 - protein, 9 aa, Homo Sapiens
KIIFSVIHS

SEQ ID NO: 861896 - protein, 9 aa, Homo Sapiens
AEKLSHPTT

SEQ ID NO: 861897 - protein, 9 aa, Homo Sapiens
VKYAIGISL

SEQ ID NO: 861898 - protein, 9 aa, Homo Sapiens
PVQNDIAYA

SEQ ID NO: 861899 - protein, 9 aa, Homo Sapiens
TVITPCRTL

SEQ ID NO: 861900 - protein, 9 aa, Homo Sapiens
LCIVDEASQ

SEQ ID NO: 861901 - protein, 9 aa, Homo Sapiens
MAALCPRKF

SEQ ID NO: 861902 - protein, 9 aa, Homo Sapiens
ELYRCSIGG

SEQ ID NO: 861903 - protein, 9 aa, Homo Sapiens
HWTKVVLTD

SEQ ID NO: 861904 - protein, 9 aa, Homo Sapiens
LDLQQEMAI

SEQ ID NO: 861905 - protein, 9 aa, Homo Sapiens
ITPGLVGLA

SEQ ID NO: 861906 - protein, 9 aa, Homo Sapiens
IGAVVDVPF

SEQ ID NO: 861907 - protein, 9 aa, Homo Sapiens
RMAAHITMK

SEQ ID NO: 861908 - protein, 9 aa, Homo Sapiens
TLTKHNIIH

SEQ ID NO: 861909 - protein, 9 aa, Homo Sapiens
RQQGLQHFL

SEQ ID NO: 861910 - protein, 9 aa, Homo Sapiens
QRGRLRDYI

SEQ ID NO: 861911 - protein, 9 aa, Homo Sapiens
QKPLPRCAL

SEQ ID NO: 861912 - protein, 9 aa, Homo Sapiens
KYYMRSLHQ

SEQ ID NO: 861913 - protein, 9 aa, Homo Sapiens
LTRRPTLQP

SEQ ID NO: 861914 - protein, 9 aa, Homo Sapiens
ALGETVLHI

SEQ ID NO: 861915 - protein, 9 aa, Homo Sapiens
SPAAARLRF

SEQ ID NO: 861916 - protein, 9 aa, Homo Sapiens
EGLEDYFSG

SEQ ID NO: 861917 - protein, 9 aa, Homo Sapiens
IGFVGLFRI

SEQ ID NO: 861918 - protein, 9 aa, Homo Sapiens
MPQEINCKE

SEQ ID NO: 861919 - protein, 9 aa, Homo Sapiens
IEPAPAPGA

SEQ ID NO: 861920 - protein, 9 aa, Homo Sapiens
KGNGMKNAM

SEQ ID NO: 861921 - protein, 9 aa, Homo Sapiens
CFSGHATLH

SEQ ID NO: 861922 - protein, 9 aa, Homo Sapiens
ESSAADFDD

SEQ ID NO: 861923 - protein, 9 aa, Homo Sapiens
RESHQDNED

SEQ ID NO: 861924 - protein, 9 aa, Homo Sapiens
PLTEGNANV

SEQ ID NO: 861925 - protein, 9 aa, Homo Sapiens
ENTVNMSWA

SEQ ID NO: 861926 - protein, 9 aa, Homo Sapiens
AHTQVKQEA

SEQ ID NO: 861927 - protein, 9 aa, Homo Sapiens
GSFADTIRL

SEQ ID NO: 861928 - protein, 9 aa, Homo Sapiens
AMEGKLGEL

SEQ ID NO: 861929 - protein, 9 aa, Homo Sapiens
LLLSAATAT

SEQ ID NO: 861930 - protein, 9 aa, Homo Sapiens
NNLSIIRIA

SEQ ID NO: 861931 - protein, 9 aa, Homo Sapiens
FYNDLESLD

SEQ ID NO: 861932 - protein, 9 aa, Homo Sapiens
NAIAFHRDQ

SEQ ID NO: 861933 - protein, 9 aa, Homo Sapiens
KLNSAFQRS

SEQ ID NO: 861934 - protein, 9 aa, Homo Sapiens
PISHIHYWV

SEQ ID NO: 861935 - protein, 9 aa, Homo Sapiens
GRLQSLTFN

SEQ ID NO: 861936 - protein, 9 aa, Homo Sapiens
YIIPKATEE

SEQ ID NO: 861937 - protein, 9 aa, Homo Sapiens
LLTLRSLSL

SEQ ID NO: 861938 - protein, 9 aa, Homo Sapiens
MAHIKRVTL

SEQ ID NO: 861939 - protein, 9 aa, Homo Sapiens
SKNYFISYS

SEQ ID NO: 861940 - protein, 9 aa, Homo Sapiens
LFAYVLIMD

SEQ ID NO: 861941 - protein, 9 aa, Homo Sapiens
PLKNYRQVE

SEQ ID NO: 861942 - protein, 9 aa, Homo Sapiens
EKRIKALHA

SEQ ID NO: 861943 - protein, 9 aa, Homo Sapiens
TRNLSYFAT

SEQ ID NO: 861944 - protein, 9 aa, Homo Sapiens
CVHPCILSQ

SEQ ID NO: 861945 - protein, 9 aa, Homo Sapiens
FPATLPPST

SEQ ID NO: 861946 - protein, 9 aa, Homo Sapiens
LIKAQKGTA

SEQ ID NO: 861947 - protein, 9 aa, Homo Sapiens
TEVTSKVEK

SEQ ID NO: 861948 - protein, 9 aa, Homo Sapiens
GIFFGFITF

SEQ ID NO: 861949 - protein, 9 aa, Homo Sapiens
IIQAAGTQK

SEQ ID NO: 861950 - protein, 9 aa, Homo Sapiens
GEIWLRKAL

SEQ ID NO: 861951 - protein, 9 aa, Homo Sapiens
INMPNTLVV

SEQ ID NO: 861952 - protein, 9 aa, Homo Sapiens
QLREWGENL

SEQ ID NO: 861953 - protein, 9 aa, Homo Sapiens
GEEELTSYQ

SEQ ID NO: 861954 - protein, 9 aa, Homo Sapiens
QKRGVSKLN

SEQ ID NO: 861955 - protein, 9 aa, Homo Sapiens
LPEEQLMSC

SEQ ID NO: 861956 - protein, 9 aa, Homo Sapiens
DQSECEGFE

SEQ ID NO: 861957 - protein, 9 aa, Homo Sapiens
QFPVEGNLE

SEQ ID NO: 861958 - protein, 9 aa, Homo Sapiens
HLNSHMWKK

SEQ ID NO: 861959 - protein, 9 aa, Homo Sapiens
PLVPTQSVP

SEQ ID NO: 861960 - protein, 9 aa, Homo Sapiens
PDDIQDLMD

SEQ ID NO: 861961 - protein, 9 aa, Homo Sapiens
TVNALKIEL

SEQ ID NO: 861962 - protein, 9 aa, Homo Sapiens
SPPEPEAKT

SEQ ID NO: 861963 - protein, 9 aa, Homo Sapiens
ENAFEPATG

SEQ ID NO: 861964 - protein, 9 aa, Homo Sapiens
IIYRVRGGS

SEQ ID NO: 861965 - protein, 9 aa, Homo Sapiens
MADKIDFTT

SEQ ID NO: 861966 - protein, 9 aa, Homo Sapiens
FYSRVLDNC

SEQ ID NO: 861967 - protein, 9 aa, Homo Sapiens
PFASVANVA

SEQ ID NO: 861968 - protein, 9 aa, Homo Sapiens
KAYFRWDFK

SEQ ID NO: 861969 - protein, 9 aa, Homo Sapiens
KEKRGSQPA

SEQ ID NO: 861970 - protein, 9 aa, Homo Sapiens
QEAVPWKQP

SEQ ID NO: 861971 - protein, 9 aa, Homo Sapiens
PQCFFYIIK

SEQ ID NO: 861972 - protein, 9 aa, Homo Sapiens
KALGKHTER

SEQ ID NO: 861973 - protein, 9 aa, Homo Sapiens
DAIQKMKKI

SEQ ID NO: 861974 - protein, 9 aa, Homo Sapiens
VLKISLTNV

SEQ ID NO: 861975 - protein, 9 aa, Homo Sapiens
GQDPFLYDY

SEQ ID NO: 861976 - protein, 9 aa, Homo Sapiens
KEESKNDRK

SEQ ID NO: 861977 - protein, 9 aa, Homo Sapiens
VLEKAFSIS

SEQ ID NO: 861978 - protein, 9 aa, Homo Sapiens
LSLTVLFDT

SEQ ID NO: 861979 - protein, 9 aa, Homo Sapiens
IAFQFQLHF

SEQ ID NO: 861980 - protein, 9 aa, Homo Sapiens
TDELVELHW

SEQ ID NO: 861981 - protein, 9 aa, Homo Sapiens
KLKVFLGTA

SEQ ID NO: 861982 - protein, 9 aa, Homo Sapiens
AYTYATVLT

SEQ ID NO: 861983 - protein, 9 aa, Homo Sapiens
LLQVCCCHL

SEQ ID NO: 861984 - protein, 9 aa, Homo Sapiens
FSSLCYKQI

SEQ ID NO: 861985 - protein, 9 aa, Homo Sapiens
ETYGFSSLF

SEQ ID NO: 861986 - protein, 9 aa, Homo Sapiens
ILDGMMTTE

SEQ ID NO: 861987 - protein, 9 aa, Homo Sapiens
DDPVLSQAK

SEQ ID NO: 861988 - protein, 9 aa, Homo Sapiens
STTVYSEER

SEQ ID NO: 861989 - protein, 9 aa, Homo Sapiens
KTYLIRYQW

SEQ ID NO: 861990 - protein, 9 aa, Homo Sapiens
TTHKSSAID

SEQ ID NO: 861991 - protein, 9 aa, Homo Sapiens
QRKSMEASL

SEQ ID NO: 861992 - protein, 9 aa, Homo Sapiens
PRLPLRLQM

SEQ ID NO: 861993 - protein, 9 aa, Homo Sapiens
RRDHSSIER

SEQ ID NO: 861994 - protein, 9 aa, Homo Sapiens
FLQSAFLHC

SEQ ID NO: 861995 - protein, 9 aa, Homo Sapiens
SRDRHILDW

SEQ ID NO: 861996 - protein, 9 aa, Homo Sapiens
NIKGPLFRF

SEQ ID NO: 861997 - protein, 9 aa, Homo Sapiens
YFLFTFHLD

SEQ ID NO: 861998 - protein, 9 aa, Homo Sapiens
ITFTTKVLS

SEQ ID NO: 861999 - protein, 9 aa, Homo Sapiens
LAEITKEQL

SEQ ID NO: 862000 - protein, 9 aa, Homo Sapiens
PNFQTCKGQ

SEQ ID NO: 862001 - protein, 9 aa, Homo Sapiens
YALLKDLEE

SEQ ID NO: 862002 - protein, 9 aa, Homo Sapiens
IGISPEPPI

SEQ ID NO: 862003 - protein, 9 aa, Homo Sapiens
VEAIYGTPH

SEQ ID NO: 862004 - protein, 9 aa, Homo Sapiens
LQEELSGDK

SEQ ID NO: 862005 - protein, 9 aa, Homo Sapiens
LKEIINVDH

SEQ ID NO: 862006 - protein, 9 aa, Homo Sapiens
VIQACRGRN

SEQ ID NO: 862007 - protein, 9 aa, Homo Sapiens
TMQEDLVTL

SEQ ID NO: 862008 - protein, 9 aa, Homo Sapiens
VVRESIIWK

SEQ ID NO: 862009 - protein, 9 aa, Homo Sapiens
VMAQQHHVG

SEQ ID NO: 862010 - protein, 9 aa, Homo Sapiens
SGDPHNLSD

SEQ ID NO: 862011 - protein, 9 aa, Homo Sapiens
LHSPLQSGN

SEQ ID NO: 862012 - protein, 9 aa, Homo Sapiens
RLTREKEHE

SEQ ID NO: 862013 - protein, 9 aa, Homo Sapiens
LADTMRTRL

SEQ ID NO: 862014 - protein, 9 aa, Homo Sapiens
ELISMECYN

SEQ ID NO: 862015 - protein, 9 aa, Homo Sapiens
QISYLVQHQ

SEQ ID NO: 862016 - protein, 9 aa, Homo Sapiens
NVSDAFGSL

SEQ ID NO: 862017 - protein, 9 aa, Homo Sapiens
DMEVMTDFK

SEQ ID NO: 862018 - protein, 9 aa, Homo Sapiens
AVCQLHREF

SEQ ID NO: 862019 - protein, 9 aa, Homo Sapiens
QKLFPRIPH

SEQ ID NO: 862020 - protein, 9 aa, Homo Sapiens
EVIDFISGF

SEQ ID NO: 862021 - protein, 9 aa, Homo Sapiens
TNLVKTAIY

SEQ ID NO: 862022 - protein, 9 aa, Homo Sapiens
LWTVFRSSQ

SEQ ID NO: 862023 - protein, 9 aa, Homo Sapiens
LCCCLSRGM

SEQ ID NO: 862024 - protein, 9 aa, Homo Sapiens
KYNSQIQPI

SEQ ID NO: 862025 - protein, 9 aa, Homo Sapiens
NKKRRKRKK

SEQ ID NO: 862026 - protein, 9 aa, Homo Sapiens
PQNAAAAAF

SEQ ID NO: 862027 - protein, 9 aa, Homo Sapiens
WYENIYIII

SEQ ID NO: 862028 - protein, 9 aa, Homo Sapiens
AQELRISRG

SEQ ID NO: 862029 - protein, 9 aa, Homo Sapiens
LNRPEDVDP

SEQ ID NO: 862030 - protein, 9 aa, Homo Sapiens
DKELLRLRD

SEQ ID NO: 862031 - protein, 9 aa, Homo Sapiens
ECTFMAVTE

SEQ ID NO: 862032 - protein, 9 aa, Homo Sapiens
MDLEVKRVA

SEQ ID NO: 862033 - protein, 9 aa, Homo Sapiens
GSLSPPCPY

SEQ ID NO: 862034 - protein, 9 aa, Homo Sapiens
ETSLLKNAE

SEQ ID NO: 862035 - protein, 9 aa, Homo Sapiens
LSVDDFYSG

SEQ ID NO: 862036 - protein, 9 aa, Homo Sapiens
RPPFLFGSG

SEQ ID NO: 862037 - protein, 9 aa, Homo Sapiens
IILDILEYI

SEQ ID NO: 862038 - protein, 9 aa, Homo Sapiens
YIKAFFEQM

SEQ ID NO: 862039 - protein, 9 aa, Homo Sapiens
CSLPAELGN

SEQ ID NO: 862040 - protein, 9 aa, Homo Sapiens
KMVTTFKNI

SEQ ID NO: 862041 - protein, 9 aa, Homo Sapiens
LFLSDISDN

SEQ ID NO: 862042 - protein, 9 aa, Homo Sapiens
RCRYPVLII

SEQ ID NO: 862043 - protein, 9 aa, Homo Sapiens
LTRHFVGLQ

SEQ ID NO: 862044 - protein, 9 aa, Homo Sapiens
YLHCKFYQL

SEQ ID NO: 862045 - protein, 9 aa, Homo Sapiens
VTILPKQAS

SEQ ID NO: 862046 - protein, 9 aa, Homo Sapiens
WIMEAVRGS

SEQ ID NO: 862047 - protein, 9 aa, Homo Sapiens
AHFIRCIYN

SEQ ID NO: 862048 - protein, 9 aa, Homo Sapiens
DNISYGLPA

SEQ ID NO: 862049 - protein, 9 aa, Homo Sapiens
GDKLANGSL

SEQ ID NO: 862050 - protein, 9 aa, Homo Sapiens
KEHARATVE

SEQ ID NO: 862051 - protein, 9 aa, Homo Sapiens
AQTEPVVLV

SEQ ID NO: 862052 - protein, 9 aa, Homo Sapiens
EGKFDKLLE

SEQ ID NO: 862053 - protein, 9 aa, Homo Sapiens
LATGFCLYR

SEQ ID NO: 862054 - protein, 9 aa, Homo Sapiens
SYGIFWYKQ

SEQ ID NO: 862055 - protein, 9 aa, Homo Sapiens
NKQNVFNRE

SEQ ID NO: 862056 - protein, 9 aa, Homo Sapiens
ADLKSILSE

SEQ ID NO: 862057 - protein, 9 aa, Homo Sapiens
DMEAGPPES

SEQ ID NO: 862058 - protein, 9 aa, Homo Sapiens
SGKEADKLL

SEQ ID NO: 862059 - protein, 9 aa, Homo Sapiens
EPLVPEPPA

SEQ ID NO: 862060 - protein, 9 aa, Homo Sapiens
TKDNVEKER

SEQ ID NO: 862061 - protein, 9 aa, Homo Sapiens
LNNAIQGGV

SEQ ID NO: 862062 - protein, 9 aa, Homo Sapiens
EQADKKVSL

SEQ ID NO: 862063 - protein, 9 aa, Homo Sapiens
LKGLTNYYV

SEQ ID NO: 862064 - protein, 9 aa, Homo Sapiens
AEEARKKMN

SEQ ID NO: 862065 - protein, 9 aa, Homo Sapiens
VTSHWHTKK

SEQ ID NO: 862066 - protein, 9 aa, Homo Sapiens
GNWLSACFD

SEQ ID NO: 862067 - protein, 9 aa, Homo Sapiens
EHYLPWPEK

SEQ ID NO: 862068 - protein, 9 aa, Homo Sapiens
KVSRSGLYH

SEQ ID NO: 862069 - protein, 9 aa, Homo Sapiens
SCSRLTHLS

SEQ ID NO: 862070 - protein, 9 aa, Homo Sapiens
IRFQSVESG

SEQ ID NO: 862071 - protein, 9 aa, Homo Sapiens
RDSLVQQSQ

SEQ ID NO: 862072 - protein, 9 aa, Homo Sapiens
GQSACVHFK

SEQ ID NO: 862073 - protein, 9 aa, Homo Sapiens
IEPLNNLSL

SEQ ID NO: 862074 - protein, 9 aa, Homo Sapiens
VEYKIADRG

SEQ ID NO: 862075 - protein, 9 aa, Homo Sapiens
VANQDPVYP

SEQ ID NO: 862076 - protein, 9 aa, Homo Sapiens
LGNGLTVAS

SEQ ID NO: 862077 - protein, 9 aa, Homo Sapiens
TKEIARAEE

SEQ ID NO: 862078 - protein, 9 aa, Homo Sapiens
DKSDTNFKE

SEQ ID NO: 862079 - protein, 9 aa, Homo Sapiens
VPHVNQNGF

SEQ ID NO: 862080 - protein, 9 aa, Homo Sapiens
TTKLCDVAQ

SEQ ID NO: 862081 - protein, 9 aa, Homo Sapiens
FSDADIQKR

SEQ ID NO: 862082 - protein, 9 aa, Homo Sapiens
DYDNTTTKG

SEQ ID NO: 862083 - protein, 9 aa, Homo Sapiens
VKIMSIKLC

SEQ ID NO: 862084 - protein, 9 aa, Homo Sapiens
KTVIQACRG

SEQ ID NO: 862085 - protein, 9 aa, Homo Sapiens
NSDLVKGLK

SEQ ID NO: 862086 - protein, 9 aa, Homo Sapiens
SYLFASFSS

SEQ ID NO: 862087 - protein, 9 aa, Homo Sapiens
EGAKRALKA

SEQ ID NO: 862088 - protein, 9 aa, Homo Sapiens
YDFDCFSKH

SEQ ID NO: 862089 - protein, 9 aa, Homo Sapiens
YKCAACGKV

SEQ ID NO: 862090 - protein, 9 aa, Homo Sapiens
LECSDTISP

SEQ ID NO: 862091 - protein, 9 aa, Homo Sapiens
SSETSRYNF

SEQ ID NO: 862092 - protein, 9 aa, Homo Sapiens
NKSFLATVI

SEQ ID NO: 862093 - protein, 9 aa, Homo Sapiens
QEREVPISL

SEQ ID NO: 862094 - protein, 9 aa, Homo Sapiens
RDRHILDWH

SEQ ID NO: 862095 - protein, 9 aa, Homo Sapiens
GKFCAGAIN

SEQ ID NO: 862096 - protein, 9 aa, Homo Sapiens
IKCFLERVI

SEQ ID NO: 862097 - protein, 9 aa, Homo Sapiens
GCPRVAKND

SEQ ID NO: 862098 - protein, 9 aa, Homo Sapiens
LPGAKYKVK

SEQ ID NO: 862099 - protein, 9 aa, Homo Sapiens
HPNHPFQGQ

SEQ ID NO: 862100 - protein, 9 aa, Homo Sapiens
EKMVESVFW

SEQ ID NO: 862101 - protein, 9 aa, Homo Sapiens
NEDVIINSH

SEQ ID NO: 862102 - protein, 9 aa, Homo Sapiens
DLHGSTDSD

SEQ ID NO: 862103 - protein, 9 aa, Homo Sapiens
EIQEWDEKI

SEQ ID NO: 862104 - protein, 9 aa, Homo Sapiens
PRDVSSLRM

SEQ ID NO: 862105 - protein, 9 aa, Homo Sapiens
GMYKESALD

SEQ ID NO: 862106 - protein, 9 aa, Homo Sapiens
RPIISLYFR

SEQ ID NO: 862107 - protein, 9 aa, Homo Sapiens
RAACYLKKG

SEQ ID NO: 862108 - protein, 9 aa, Homo Sapiens
QITDVRLSE

SEQ ID NO: 862109 - protein, 9 aa, Homo Sapiens
QNTGDEERP

SEQ ID NO: 862110 - protein, 9 aa, Homo Sapiens
TVYSEERLL

SEQ ID NO: 862111 - protein, 9 aa, Homo Sapiens
PENATTNGH

SEQ ID NO: 862112 - protein, 9 aa, Homo Sapiens
GGQGSERKK

SEQ ID NO: 862113 - protein, 9 aa, Homo Sapiens
VTQHPEVVY

SEQ ID NO: 862114 - protein, 9 aa, Homo Sapiens
MNSATPDSS

SEQ ID NO: 862115 - protein, 9 aa, Homo Sapiens
AFHTEMGLY

SEQ ID NO: 862116 - protein, 9 aa, Homo Sapiens
NANILVAAN

SEQ ID NO: 862117 - protein, 9 aa, Homo Sapiens
FWDELWKLA

SEQ ID NO: 862118 - protein, 9 aa, Homo Sapiens
NETPVVGLT

SEQ ID NO: 862119 - protein, 9 aa, Homo Sapiens
DVQKRRQVL

SEQ ID NO: 862120 - protein, 9 aa, Homo Sapiens
GLSLAFSGV

SEQ ID NO: 862121 - protein, 9 aa, Homo Sapiens
AMNFSNEDM

SEQ ID NO: 862122 - protein, 9 aa, Homo Sapiens
LALDGQLKH

SEQ ID NO: 862123 - protein, 9 aa, Homo Sapiens
LAACIKLIE

SEQ ID NO: 862124 - protein, 9 aa, Homo Sapiens
AAHTNLTLL

SEQ ID NO: 862125 - protein, 9 aa, Homo Sapiens
LMTLGKLEE

SEQ ID NO: 862126 - protein, 9 aa, Homo Sapiens
RRCLRIINQ

SEQ ID NO: 862127 - protein, 9 aa, Homo Sapiens
YEHISLAYS

SEQ ID NO: 862128 - protein, 9 aa, Homo Sapiens
ILSFYRFSR

SEQ ID NO: 862129 - protein, 9 aa, Homo Sapiens
GMIGIFGAF

SEQ ID NO: 862130 - protein, 9 aa, Homo Sapiens
LHNLRTLWI

SEQ ID NO: 862131 - protein, 9 aa, Homo Sapiens
LSLMGVLLQ

SEQ ID NO: 862132 - protein, 9 aa, Homo Sapiens
WSLLLLAAE

SEQ ID NO: 862133 - protein, 9 aa, Homo Sapiens
TPAGSPLSV

SEQ ID NO: 862134 - protein, 9 aa, Homo Sapiens
AAPTPGARS

SEQ ID NO: 862135 - protein, 9 aa, Homo Sapiens
KTAVHVQDS

SEQ ID NO: 862136 - protein, 9 aa, Homo Sapiens
ISLEEEEGL

SEQ ID NO: 862137 - protein, 9 aa, Homo Sapiens
APNPDGKIK

SEQ ID NO: 862138 - protein, 9 aa, Homo Sapiens
GDEDIVTIL

SEQ ID NO: 862139 - protein, 9 aa, Homo Sapiens
ATEEVGEAS

SEQ ID NO: 862140 - protein, 9 aa, Homo Sapiens
RTSKETDVI

SEQ ID NO: 862141 - protein, 9 aa, Homo Sapiens
YLYIILTIF

SEQ ID NO: 862142 - protein, 9 aa, Homo Sapiens
SLLEEVMMK

SEQ ID NO: 862143 - protein, 9 aa, Homo Sapiens
CFVWFMNYC

SEQ ID NO: 862144 - protein, 9 aa, Homo Sapiens
FSMQDGPKA

SEQ ID NO: 862145 - protein, 9 aa, Homo Sapiens
KYTTSAVLI

SEQ ID NO: 862146 - protein, 9 aa, Homo Sapiens
PDNKYDPEK

SEQ ID NO: 862147 - protein, 9 aa, Homo Sapiens
GMAAYLDLL

SEQ ID NO: 862148 - protein, 9 aa, Homo Sapiens
KISLAIYFR

SEQ ID NO: 862149 - protein, 9 aa, Homo Sapiens
YQKIMKKLD

SEQ ID NO: 862150 - protein, 9 aa, Homo Sapiens
SRYLGVSSP

SEQ ID NO: 862151 - protein, 9 aa, Homo Sapiens
CLALMQKKL

SEQ ID NO: 862152 - protein, 9 aa, Homo Sapiens
PFLNDRLAN

SEQ ID NO: 862153 - protein, 9 aa, Homo Sapiens
ALVSRDLTS

SEQ ID NO: 862154 - protein, 9 aa, Homo Sapiens
LQAFKFRVG

SEQ ID NO: 862155 - protein, 9 aa, Homo Sapiens
GLLCFPINV

SEQ ID NO: 862156 - protein, 9 aa, Homo Sapiens
ITFFTEDDN

SEQ ID NO: 862157 - protein, 9 aa, Homo Sapiens
NVNMKPRLK

SEQ ID NO: 862158 - protein, 9 aa, Homo Sapiens
SLKKLDQLI

SEQ ID NO: 862159 - protein, 9 aa, Homo Sapiens
DNSAHGYSW

SEQ ID NO: 862160 - protein, 9 aa, Homo Sapiens
WRCISEQHR

SEQ ID NO: 862161 - protein, 9 aa, Homo Sapiens
LRLMWYKHK

SEQ ID NO: 862162 - protein, 9 aa, Homo Sapiens
EGFAVGVGF

SEQ ID NO: 862163 - protein, 9 aa, Homo Sapiens
MNLSEREVE

SEQ ID NO: 862164 - protein, 9 aa, Homo Sapiens
NDTYDSSSS

SEQ ID NO: 862165 - protein, 9 aa, Homo Sapiens
VCTPESMGS

SEQ ID NO: 862166 - protein, 9 aa, Homo Sapiens
FQVDIQPEE

SEQ ID NO: 862167 - protein, 9 aa, Homo Sapiens
RRSKGDRCD

SEQ ID NO: 862168 - protein, 9 aa, Homo Sapiens
LELVFVINS

SEQ ID NO: 862169 - protein, 9 aa, Homo Sapiens
TLGNTFEKL

SEQ ID NO: 862170 - protein, 9 aa, Homo Sapiens
VSSPGTVHT

SEQ ID NO: 862171 - protein, 9 aa, Homo Sapiens
LYIILSVIY

SEQ ID NO: 862172 - protein, 9 aa, Homo Sapiens
MVTTAGISS

SEQ ID NO: 862173 - protein, 9 aa, Homo Sapiens
QQSQSSDPE

SEQ ID NO: 862174 - protein, 9 aa, Homo Sapiens
NHGLQETCY

SEQ ID NO: 862175 - protein, 9 aa, Homo Sapiens
RADNPHVAL

SEQ ID NO: 862176 - protein, 9 aa, Homo Sapiens
LRLLCLIPT

SEQ ID NO: 862177 - protein, 9 aa, Homo Sapiens
ANQETSNIL

SEQ ID NO: 862178 - protein, 9 aa, Homo Sapiens
PKSEAASVN

SEQ ID NO: 862179 - protein, 9 aa, Homo Sapiens
EKIREQEDK

SEQ ID NO: 862180 - protein, 9 aa, Homo Sapiens
LYIILTIFR

SEQ ID NO: 862181 - protein, 9 aa, Homo Sapiens
SKFQEGVEM

SEQ ID NO: 862182 - protein, 9 aa, Homo Sapiens
EDKIPNKSS

SEQ ID NO: 862183 - protein, 9 aa, Homo Sapiens
FGSLAGLSA

SEQ ID NO: 862184 - protein, 9 aa, Homo Sapiens
HHQPSGTGP

SEQ ID NO: 862185 - protein, 9 aa, Homo Sapiens
TEYFLPLPT

SEQ ID NO: 862186 - protein, 9 aa, Homo Sapiens
NEHEDGYGD

SEQ ID NO: 862187 - protein, 9 aa, Homo Sapiens
IHQLLLLFL

SEQ ID NO: 862188 - protein, 9 aa, Homo Sapiens
IYPEFNKLK

SEQ ID NO: 862189 - protein, 9 aa, Homo Sapiens
MCQWYQNSC

SEQ ID NO: 862190 - protein, 9 aa, Homo Sapiens
GGLIKYIKR

SEQ ID NO: 862191 - protein, 9 aa, Homo Sapiens
RIKTELLVQ

SEQ ID NO: 862192 - protein, 9 aa, Homo Sapiens
NTHDFTPVS

SEQ ID NO: 862193 - protein, 9 aa, Homo Sapiens
QRSMPSMGY

SEQ ID NO: 862194 - protein, 9 aa, Homo Sapiens
NKPSSSSSS

SEQ ID NO: 862195 - protein, 9 aa, Homo Sapiens
PGAYQPCLI

SEQ ID NO: 862196 - protein, 9 aa, Homo Sapiens
YTIFEIFNN

SEQ ID NO: 862197 - protein, 9 aa, Homo Sapiens
TGREYFPKK

SEQ ID NO: 862198 - protein, 9 aa, Homo Sapiens
FCTKLNDLK

SEQ ID NO: 862199 - protein, 9 aa, Homo Sapiens
LLEGEVDDE

SEQ ID NO: 862200 - protein, 9 aa, Homo Sapiens
FTCGCNKGF

SEQ ID NO: 862201 - protein, 9 aa, Homo Sapiens
ALLGGHAAI

SEQ ID NO: 862202 - protein, 9 aa, Homo Sapiens
FNYILVYGN

SEQ ID NO: 862203 - protein, 9 aa, Homo Sapiens
ANVQSNLIE

SEQ ID NO: 862204 - protein, 9 aa, Homo Sapiens
IQRVFFGNN

SEQ ID NO: 862205 - protein, 9 aa, Homo Sapiens
DNNSPALHI

SEQ ID NO: 862206 - protein, 9 aa, Homo Sapiens
KQESNAVHD

SEQ ID NO: 862207 - protein, 9 aa, Homo Sapiens
TSAGEEQKI

SEQ ID NO: 862208 - protein, 9 aa, Homo Sapiens
EINVDVEST

SEQ ID NO: 862209 - protein, 9 aa, Homo Sapiens
GEEQKIDRF

SEQ ID NO: 862210 - protein, 9 aa, Homo Sapiens
SGHNNSPQL

SEQ ID NO: 862211 - protein, 9 aa, Homo Sapiens
SQVCTPSFH

SEQ ID NO: 862212 - protein, 9 aa, Homo Sapiens
LGFILTGEQ

SEQ ID NO: 862213 - protein, 9 aa, Homo Sapiens
WTVSPFSKM

SEQ ID NO: 862214 - protein, 9 aa, Homo Sapiens
EKECGDKVN

SEQ ID NO: 862215 - protein, 9 aa, Homo Sapiens
QIVTTVDAS

SEQ ID NO: 862216 - protein, 9 aa, Homo Sapiens
PYLFDIFNS

SEQ ID NO: 862217 - protein, 9 aa, Homo Sapiens
GSAVSLSGS

SEQ ID NO: 862218 - protein, 9 aa, Homo Sapiens
RIPKLVQII

SEQ ID NO: 862219 - protein, 9 aa, Homo Sapiens
LPTPSVFED

SEQ ID NO: 862220 - protein, 9 aa, Homo Sapiens
FRIKCFMDD

SEQ ID NO: 862221 - protein, 9 aa, Homo Sapiens
TVGGAHEAL

SEQ ID NO: 862222 - protein, 9 aa, Homo Sapiens
LRESFQILK

SEQ ID NO: 862223 - protein, 9 aa, Homo Sapiens
FFYIIKAWL

SEQ ID NO: 862224 - protein, 9 aa, Homo Sapiens
AERHVGRPW

SEQ ID NO: 862225 - protein, 9 aa, Homo Sapiens
WSSILFNLA

SEQ ID NO: 862226 - protein, 9 aa, Homo Sapiens
MVQRGFGKS

SEQ ID NO: 862227 - protein, 9 aa, Homo Sapiens
SEDKPEEEV

SEQ ID NO: 862228 - protein, 9 aa, Homo Sapiens
PIPTQSSTL

SEQ ID NO: 862229 - protein, 9 aa, Homo Sapiens
YFKLQSMIP

SEQ ID NO: 862230 - protein, 9 aa, Homo Sapiens
SKDTTIQEL

SEQ ID NO: 862231 - protein, 9 aa, Homo Sapiens
STDSDFGST

SEQ ID NO: 862232 - protein, 9 aa, Homo Sapiens
TRNECTTQS

SEQ ID NO: 862233 - protein, 9 aa, Homo Sapiens
STVTVTLLT

SEQ ID NO: 862234 - protein, 9 aa, Homo Sapiens
TCIHIYKYQ

SEQ ID NO: 862235 - protein, 9 aa, Homo Sapiens
NPSDNSLNT

SEQ ID NO: 862236 - protein, 9 aa, Homo Sapiens
NGTVTENMY

SEQ ID NO: 862237 - protein, 9 aa, Homo Sapiens
GKGTTSEKL

SEQ ID NO: 862238 - protein, 9 aa, Homo Sapiens
VKWADIKED

SEQ ID NO: 862239 - protein, 9 aa, Homo Sapiens
SQKDKNCNL

SEQ ID NO: 862240 - protein, 9 aa, Homo Sapiens
VPTPITKME

SEQ ID NO: 862241 - protein, 9 aa, Homo Sapiens
RTSAPTRAG

SEQ ID NO: 862242 - protein, 9 aa, Homo Sapiens
MKGNLKLHI

SEQ ID NO: 862243 - protein, 9 aa, Homo Sapiens
ILDTLSKLS

SEQ ID NO: 862244 - protein, 9 aa, Homo Sapiens
EILDRLIGI

SEQ ID NO: 862245 - protein, 9 aa, Homo Sapiens
GLTNYYVGS

SEQ ID NO: 862246 - protein, 9 aa, Homo Sapiens
LTMNKNTWE

SEQ ID NO: 862247 - protein, 9 aa, Homo Sapiens
LASFDFGSG

SEQ ID NO: 862248 - protein, 9 aa, Homo Sapiens
GSYSPIRRV

SEQ ID NO: 862249 - protein, 9 aa, Homo Sapiens
VPFIWPGQM

SEQ ID NO: 862250 - protein, 9 aa, Homo Sapiens
ETKDNRWVP

SEQ ID NO: 862251 - protein, 9 aa, Homo Sapiens
YRDVMMDNY

SEQ ID NO: 862252 - protein, 9 aa, Homo Sapiens
GLIVHEEAA

SEQ ID NO: 862253 - protein, 9 aa, Homo Sapiens
RSADGANNY

SEQ ID NO: 862254 - protein, 9 aa, Homo Sapiens
EQPFAGKED

SEQ ID NO: 862255 - protein, 9 aa, Homo Sapiens
SRSKDDTRV

SEQ ID NO: 862256 - protein, 9 aa, Homo Sapiens
QEMRAFPVF

SEQ ID NO: 862257 - protein, 9 aa, Homo Sapiens
QLQMPGGTL

SEQ ID NO: 862258 - protein, 9 aa, Homo Sapiens
DANYVDPIF

SEQ ID NO: 862259 - protein, 9 aa, Homo Sapiens
KRNVIQKKY

SEQ ID NO: 862260 - protein, 9 aa, Homo Sapiens
LWCVLLCVS

SEQ ID NO: 862261 - protein, 9 aa, Homo Sapiens
HLSSGSRDT

SEQ ID NO: 862262 - protein, 9 aa, Homo Sapiens
DCLQAAHLL

SEQ ID NO: 862263 - protein, 9 aa, Homo Sapiens
NILEEKIPT

SEQ ID NO: 862264 - protein, 9 aa, Homo Sapiens
RQGIFVDWK

SEQ ID NO: 862265 - protein, 9 aa, Homo Sapiens
YLTPDDSPL

SEQ ID NO: 862266 - protein, 9 aa, Homo Sapiens
PGSSGSRSS

SEQ ID NO: 862267 - protein, 9 aa, Homo Sapiens
VKDNKCPCR

SEQ ID NO: 862268 - protein, 9 aa, Homo Sapiens
QRAKWRKRE

SEQ ID NO: 862269 - protein, 9 aa, Homo Sapiens
EQHNRKVQS

SEQ ID NO: 862270 - protein, 9 aa, Homo Sapiens
KLKGLHRQP

SEQ ID NO: 862271 - protein, 9 aa, Homo Sapiens
RDRDRGRDR

SEQ ID NO: 862272 - protein, 9 aa, Homo Sapiens
IDDNMLVIF

SEQ ID NO: 862273 - protein, 9 aa, Homo Sapiens
EYDGGYGGF

SEQ ID NO: 862274 - protein, 9 aa, Homo Sapiens
ASTRHDMGT

SEQ ID NO: 862275 - protein, 9 aa, Homo Sapiens
NVEDNCVNS

SEQ ID NO: 862276 - protein, 9 aa, Homo Sapiens
PMGIYHKQN

SEQ ID NO: 862277 - protein, 9 aa, Homo Sapiens
AAETRERKG

SEQ ID NO: 862278 - protein, 9 aa, Homo Sapiens
NSGLINHQI

SEQ ID NO: 862279 - protein, 9 aa, Homo Sapiens
LADSGRKIL

SEQ ID NO: 862280 - protein, 9 aa, Homo Sapiens
PGARSPDPS

SEQ ID NO: 862281 - protein, 9 aa, Homo Sapiens
WKQATKQHL

SEQ ID NO: 862282 - protein, 9 aa, Homo Sapiens
LRIQSSFVA

SEQ ID NO: 862283 - protein, 9 aa, Homo Sapiens
TKDTESITG

SEQ ID NO: 862284 - protein, 9 aa, Homo Sapiens
RVIPWKQGL

SEQ ID NO: 862285 - protein, 9 aa, Homo Sapiens
KETDVINFD

SEQ ID NO: 862286 - protein, 9 aa, Homo Sapiens
EAENKRMHI

SEQ ID NO: 862287 - protein, 9 aa, Homo Sapiens
IVQETSFEN

SEQ ID NO: 862288 - protein, 9 aa, Homo Sapiens
NGAPLVVEP

SEQ ID NO: 862289 - protein, 9 aa, Homo Sapiens
PILESQVCT

SEQ ID NO: 862290 - protein, 9 aa, Homo Sapiens
KKPIHKQGD

SEQ ID NO: 862291 - protein, 9 aa, Homo Sapiens
HQCHHKQKH

SEQ ID NO: 862292 - protein, 9 aa, Homo Sapiens
LEDEIEHLQ

SEQ ID NO: 862293 - protein, 9 aa, Homo Sapiens
SSIGDVEIA

SEQ ID NO: 862294 - protein, 9 aa, Homo Sapiens
SSSSTRSSH

SEQ ID NO: 862295 - protein, 9 aa, Homo Sapiens
LPYKLAINI

SEQ ID NO: 862296 - protein, 9 aa, Homo Sapiens
AGTNQPDIL

SEQ ID NO: 862297 - protein, 9 aa, Homo Sapiens
KVHMGEKHY

SEQ ID NO: 862298 - protein, 9 aa, Homo Sapiens
LAEKTSYSL

SEQ ID NO: 862299 - protein, 9 aa, Homo Sapiens
ATNVNDALG

SEQ ID NO: 862300 - protein, 9 aa, Homo Sapiens
DSGQYENDF

SEQ ID NO: 862301 - protein, 9 aa, Homo Sapiens
HVVKWHYNK

SEQ ID NO: 862302 - protein, 9 aa, Homo Sapiens
SMVLRYRTP

SEQ ID NO: 862303 - protein, 9 aa, Homo Sapiens
AREYYIIVC

SEQ ID NO: 862304 - protein, 9 aa, Homo Sapiens
WQKKTPEPI

SEQ ID NO: 862305 - protein, 9 aa, Homo Sapiens
AKEAQKQLT

SEQ ID NO: 862306 - protein, 9 aa, Homo Sapiens
SPDWCKCKK

SEQ ID NO: 862307 - protein, 9 aa, Homo Sapiens
GFDRYMAIG

SEQ ID NO: 862308 - protein, 9 aa, Homo Sapiens
LPILAEVIP

SEQ ID NO: 862309 - protein, 9 aa, Homo Sapiens
SITSQNNLQ

SEQ ID NO: 862310 - protein, 9 aa, Homo Sapiens
AFHLTAITI

SEQ ID NO: 862311 - protein, 9 aa, Homo Sapiens
GHSAKLAFA

SEQ ID NO: 862312 - protein, 9 aa, Homo Sapiens
YFLLNAEYY

SEQ ID NO: 862313 - protein, 9 aa, Homo Sapiens
CFDHQGEIY

SEQ ID NO: 862314 - protein, 9 aa, Homo Sapiens
STEQEKFGK

SEQ ID NO: 862315 - protein, 9 aa, Homo Sapiens
VAPCLLLIK

SEQ ID NO: 862316 - protein, 9 aa, Homo Sapiens
GKQSQEASP

SEQ ID NO: 862317 - protein, 9 aa, Homo Sapiens
CKQGKDLTV

SEQ ID NO: 862318 - protein, 9 aa, Homo Sapiens
DNKMVTTFK

SEQ ID NO: 862319 - protein, 9 aa, Homo Sapiens
ARITIICLP

SEQ ID NO: 862320 - protein, 9 aa, Homo Sapiens
MLIRQDLMR

SEQ ID NO: 862321 - protein, 9 aa, Homo Sapiens
MNIDREFAL

SEQ ID NO: 862322 - protein, 9 aa, Homo Sapiens
SQTQDKASR

SEQ ID NO: 862323 - protein, 9 aa, Homo Sapiens
KLSHDADPE

SEQ ID NO: 862324 - protein, 9 aa, Homo Sapiens
NKTVRKERL

SEQ ID NO: 862325 - protein, 9 aa, Homo Sapiens
LFTPEENKE

SEQ ID NO: 862326 - protein, 9 aa, Homo Sapiens
QQPPPATRE

SEQ ID NO: 862327 - protein, 9 aa, Homo Sapiens
NLLGEDQLV

SEQ ID NO: 862328 - protein, 9 aa, Homo Sapiens
YGEYLEFKE

SEQ ID NO: 862329 - protein, 9 aa, Homo Sapiens
NNGKHNGWK

SEQ ID NO: 862330 - protein, 9 aa, Homo Sapiens
QMSFIFRLI

SEQ ID NO: 862331 - protein, 9 aa, Homo Sapiens
EDYLSSIYE

SEQ ID NO: 862332 - protein, 9 aa, Homo Sapiens
LTLAKLEQV

SEQ ID NO: 862333 - protein, 9 aa, Homo Sapiens
RFFVMEAII

SEQ ID NO: 862334 - protein, 9 aa, Homo Sapiens
LNDHKVFVG

SEQ ID NO: 862335 - protein, 9 aa, Homo Sapiens
HLETVYTLC

SEQ ID NO: 862336 - protein, 9 aa, Homo Sapiens
GMTVTVHMP

SEQ ID NO: 862337 - protein, 9 aa, Homo Sapiens
SDREEINVD

SEQ ID NO: 862338 - protein, 9 aa, Homo Sapiens
TAIIQLAPK

SEQ ID NO: 862339 - protein, 9 aa, Homo Sapiens
YVALYRARS

SEQ ID NO: 862340 - protein, 9 aa, Homo Sapiens
KRFMFQFPL

SEQ ID NO: 862341 - protein, 9 aa, Homo Sapiens
DIEQLSVVK

SEQ ID NO: 862342 - protein, 9 aa, Homo Sapiens
KKKRKFPGV

SEQ ID NO: 862343 - protein, 9 aa, Homo Sapiens
YPPKSHPYS

SEQ ID NO: 862344 - protein, 9 aa, Homo Sapiens
YLAQHQIVH

SEQ ID NO: 862345 - protein, 9 aa, Homo Sapiens
NVAVDFTQE

SEQ ID NO: 862346 - protein, 9 aa, Homo Sapiens
YDKCYIHEV

SEQ ID NO: 862347 - protein, 9 aa, Homo Sapiens
IKLAVLEGD

SEQ ID NO: 862348 - protein, 9 aa, Homo Sapiens
AFLQTYFQE

SEQ ID NO: 862349 - protein, 9 aa, Homo Sapiens
RFGKYFEIE

SEQ ID NO: 862350 - protein, 9 aa, Homo Sapiens
VMLDNYSHL

SEQ ID NO: 862351 - protein, 9 aa, Homo Sapiens
CSLHFPHKS

SEQ ID NO: 862352 - protein, 9 aa, Homo Sapiens
WMPTKENLC

SEQ ID NO: 862353 - protein, 9 aa, Homo Sapiens
QSLYQKIAK

SEQ ID NO: 862354 - protein, 9 aa, Homo Sapiens
LQHGVIAAV

SEQ ID NO: 862355 - protein, 9 aa, Homo Sapiens
SSSTRSSHI

SEQ ID NO: 862356 - protein, 9 aa, Homo Sapiens
TGVHRLEHH

SEQ ID NO: 862357 - protein, 9 aa, Homo Sapiens
LENGGAHRE

SEQ ID NO: 862358 - protein, 9 aa, Homo Sapiens
KAQNFRTED

SEQ ID NO: 862359 - protein, 9 aa, Homo Sapiens
NSKIDISEL

SEQ ID NO: 862360 - protein, 9 aa, Homo Sapiens
PYANTNNNV

SEQ ID NO: 862361 - protein, 9 aa, Homo Sapiens
GMYNIIEDI

SEQ ID NO: 862362 - protein, 9 aa, Homo Sapiens
TIVCEGSIK

SEQ ID NO: 862363 - protein, 9 aa, Homo Sapiens
NAEYYRWQW

SEQ ID NO: 862364 - protein, 9 aa, Homo Sapiens
DIVQWLINN

SEQ ID NO: 862365 - protein, 9 aa, Homo Sapiens
LFTLLSELV

SEQ ID NO: 862366 - protein, 9 aa, Homo Sapiens
GIMNKPEET

SEQ ID NO: 862367 - protein, 9 aa, Homo Sapiens
NNYNPKYFD

SEQ ID NO: 862368 - protein, 9 aa, Homo Sapiens
KTGDHVQSE

SEQ ID NO: 862369 - protein, 9 aa, Homo Sapiens
KVMGEPHLM

SEQ ID NO: 862370 - protein, 9 aa, Homo Sapiens
VYYYAGKNK

SEQ ID NO: 862371 - protein, 9 aa, Homo Sapiens
GSIIGSQWI

SEQ ID NO: 862372 - protein, 9 aa, Homo Sapiens
PKKTRAMCR

SEQ ID NO: 862373 - protein, 9 aa, Homo Sapiens
AHNLIPMDP

SEQ ID NO: 862374 - protein, 9 aa, Homo Sapiens
GLLGRLRLP

SEQ ID NO: 862375 - protein, 9 aa, Homo Sapiens
FFQDIEEEV

SEQ ID NO: 862376 - protein, 9 aa, Homo Sapiens
QPKGINSNS

SEQ ID NO: 862377 - protein, 9 aa, Homo Sapiens
HKIVHLGEK

SEQ ID NO: 862378 - protein, 9 aa, Homo Sapiens
KKKPISKKP

SEQ ID NO: 862379 - protein, 9 aa, Homo Sapiens
PCEHQCDPK

SEQ ID NO: 862380 - protein, 9 aa, Homo Sapiens
QKQLTQMTR

SEQ ID NO: 862381 - protein, 9 aa, Homo Sapiens
QECVSELIS

SEQ ID NO: 862382 - protein, 9 aa, Homo Sapiens
FPDSDDIKE

SEQ ID NO: 862383 - protein, 9 aa, Homo Sapiens
ARFQDQVCR

SEQ ID NO: 862384 - protein, 9 aa, Homo Sapiens
MKIKVSYSE

SEQ ID NO: 862385 - protein, 9 aa, Homo Sapiens
GTSKPLPDR

SEQ ID NO: 862386 - protein, 9 aa, Homo Sapiens
QDGILKITY

SEQ ID NO: 862387 - protein, 9 aa, Homo Sapiens
KMNLNNFIS

SEQ ID NO: 862388 - protein, 9 aa, Homo Sapiens
FKHYRSIIN

SEQ ID NO: 862389 - protein, 9 aa, Homo Sapiens
LETMLITCL

SEQ ID NO: 862390 - protein, 9 aa, Homo Sapiens
EETRRQKIE

SEQ ID NO: 862391 - protein, 9 aa, Homo Sapiens
CGKFFQMKM

SEQ ID NO: 862392 - protein, 9 aa, Homo Sapiens
QEDKMQEQE

SEQ ID NO: 862393 - protein, 9 aa, Homo Sapiens
STIVIACYF

SEQ ID NO: 862394 - protein, 9 aa, Homo Sapiens
LIIGIPEQA

SEQ ID NO: 862395 - protein, 9 aa, Homo Sapiens
EPFYHLPSN

SEQ ID NO: 862396 - protein, 9 aa, Homo Sapiens
GSNRLYDNI

SEQ ID NO: 862397 - protein, 9 aa, Homo Sapiens
NLDEIIPND

SEQ ID NO: 862398 - protein, 9 aa, Homo Sapiens
LAKRKIIHT

SEQ ID NO: 862399 - protein, 9 aa, Homo Sapiens
KEEIIKLEN

SEQ ID NO: 862400 - protein, 9 aa, Homo Sapiens
INEEVKNAM

SEQ ID NO: 862401 - protein, 9 aa, Homo Sapiens
EGMDFHTFY

SEQ ID NO: 862402 - protein, 9 aa, Homo Sapiens
VNKRSLSKG

SEQ ID NO: 862403 - protein, 9 aa, Homo Sapiens
ALRMAAKNK

SEQ ID NO: 862404 - protein, 9 aa, Homo Sapiens
EKIVCNPGQ

SEQ ID NO: 862405 - protein, 9 aa, Homo Sapiens
VRRSTSIDR

SEQ ID NO: 862406 - protein, 9 aa, Homo Sapiens
EEDIHFNDA

SEQ ID NO: 862407 - protein, 9 aa, Homo Sapiens
LGRRTWRFG

SEQ ID NO: 862408 - protein, 9 aa, Homo Sapiens
QIITTRPDL

SEQ ID NO: 862409 - protein, 9 aa, Homo Sapiens
QAFYFLNSV

SEQ ID NO: 862410 - protein, 9 aa, Homo Sapiens
RIKCFMDDV

SEQ ID NO: 862411 - protein, 9 aa, Homo Sapiens
EKTKGNGFE

SEQ ID NO: 862412 - protein, 9 aa, Homo Sapiens
AVSFAPIMN

SEQ ID NO: 862413 - protein, 9 aa, Homo Sapiens
SSTEIVNVL

SEQ ID NO: 862414 - protein, 9 aa, Homo Sapiens
RFAFVAGPR

SEQ ID NO: 862415 - protein, 9 aa, Homo Sapiens
IGGSIPASL

SEQ ID NO: 862416 - protein, 9 aa, Homo Sapiens
QVIEAPDPV

SEQ ID NO: 862417 - protein, 9 aa, Homo Sapiens
GFDCGLEAN

SEQ ID NO: 862418 - protein, 9 aa, Homo Sapiens
ILHSLLNKE

SEQ ID NO: 862419 - protein, 9 aa, Homo Sapiens
QLEIMRMCK

SEQ ID NO: 862420 - protein, 9 aa, Homo Sapiens
RKEHEKQKN

SEQ ID NO: 862421 - protein, 9 aa, Homo Sapiens
IDRIIYVSL

SEQ ID NO: 862422 - protein, 9 aa, Homo Sapiens
IDTVSSSYN

SEQ ID NO: 862423 - protein, 9 aa, Homo Sapiens
QENIIQASL

SEQ ID NO: 862424 - protein, 9 aa, Homo Sapiens
QNHERTHSG

SEQ ID NO: 862425 - protein, 9 aa, Homo Sapiens
KENKPGKPQ

SEQ ID NO: 862426 - protein, 9 aa, Homo Sapiens
ALASVYSLF

SEQ ID NO: 862427 - protein, 9 aa, Homo Sapiens
SSGSRDTTC

SEQ ID NO: 862428 - protein, 9 aa, Homo Sapiens
CLQAAHLLL

SEQ ID NO: 862429 - protein, 9 aa, Homo Sapiens
GIEAFSNSG

SEQ ID NO: 862430 - protein, 9 aa, Homo Sapiens
TILHRDIKA

SEQ ID NO: 862431 - protein, 9 aa, Homo Sapiens
FFLVKEIKD

SEQ ID NO: 862432 - protein, 9 aa, Homo Sapiens
EIIKAINRT

SEQ ID NO: 862433 - protein, 9 aa, Homo Sapiens
FKRFILFRP

SEQ ID NO: 862434 - protein, 9 aa, Homo Sapiens
ERGLSKKTH

SEQ ID NO: 862435 - protein, 9 aa, Homo Sapiens
HSVHIQHQI

SEQ ID NO: 862436 - protein, 9 aa, Homo Sapiens
RPDKSVNKM

SEQ ID NO: 862437 - protein, 9 aa, Homo Sapiens
AQAELQWLL

SEQ ID NO: 862438 - protein, 9 aa, Homo Sapiens
QPRKKGRKL

SEQ ID NO: 862439 - protein, 9 aa, Homo Sapiens
YAKVWKMPE

SEQ ID NO: 862440 - protein, 9 aa, Homo Sapiens
LLQVPLKEL

SEQ ID NO: 862441 - protein, 9 aa, Homo Sapiens
CSATPTPPP

SEQ ID NO: 862442 - protein, 9 aa, Homo Sapiens
FHQLSHLQQ

SEQ ID NO: 862443 - protein, 9 aa, Homo Sapiens
PPGPQGSTG

SEQ ID NO: 862444 - protein, 9 aa, Homo Sapiens
NGRRLRISG

SEQ ID NO: 862445 - protein, 9 aa, Homo Sapiens
KAHSSKEQH

SEQ ID NO: 862446 - protein, 9 aa, Homo Sapiens
SIVGSFDDS

SEQ ID NO: 862447 - protein, 9 aa, Homo Sapiens
FPHVSQMFL

SEQ ID NO: 862448 - protein, 9 aa, Homo Sapiens
VSITTRLSS

SEQ ID NO: 862449 - protein, 9 aa, Homo Sapiens
TGNQAHAQE

SEQ ID NO: 862450 - protein, 9 aa, Homo Sapiens
YLKPDITWF

SEQ ID NO: 862451 - protein, 9 aa, Homo Sapiens
QTALKVIKF

SEQ ID NO: 862452 - protein, 9 aa, Homo Sapiens
VATLHHCLL

SEQ ID NO: 862453 - protein, 9 aa, Homo Sapiens
FMEYVPGGE

SEQ ID NO: 862454 - protein, 9 aa, Homo Sapiens
LTRLNVPYN

SEQ ID NO: 862455 - protein, 9 aa, Homo Sapiens
LHGKLCGAE

SEQ ID NO: 862456 - protein, 9 aa, Homo Sapiens
FLVYCALDK

SEQ ID NO: 862457 - protein, 9 aa, Homo Sapiens
MYATLLKRL

SEQ ID NO: 862458 - protein, 9 aa, Homo Sapiens
TIIPLIWID

SEQ ID NO: 862459 - protein, 9 aa, Homo Sapiens
LFAAICLVS

SEQ ID NO: 862460 - protein, 9 aa, Homo Sapiens
WFYYSISIV

SEQ ID NO: 862461 - protein, 9 aa, Homo Sapiens
TQAAAPVTE

SEQ ID NO: 862462 - protein, 9 aa, Homo Sapiens
PGRFLKQVI

SEQ ID NO: 862463 - protein, 9 aa, Homo Sapiens
QYLVEVEEL

SEQ ID NO: 862464 - protein, 9 aa, Homo Sapiens
HMILHFATE

SEQ ID NO: 862465 - protein, 9 aa, Homo Sapiens
TACPRQELK

SEQ ID NO: 862466 - protein, 9 aa, Homo Sapiens
PGYRVACFA

SEQ ID NO: 862467 - protein, 9 aa, Homo Sapiens
DAWGPGDSA

SEQ ID NO: 862468 - protein, 9 aa, Homo Sapiens
HCTDQIYFK

SEQ ID NO: 862469 - protein, 9 aa, Homo Sapiens
QFQVTEGLC

SEQ ID NO: 862470 - protein, 9 aa, Homo Sapiens
FNMFASVFF

SEQ ID NO: 862471 - protein, 9 aa, Homo Sapiens
ILYVMRLTR

SEQ ID NO: 862472 - protein, 9 aa, Homo Sapiens
SFFCSDELR

SEQ ID NO: 862473 - protein, 9 aa, Homo Sapiens
EGSFSQVTV

SEQ ID NO: 862474 - protein, 9 aa, Homo Sapiens
MTMREINQI

SEQ ID NO: 862475 - protein, 9 aa, Homo Sapiens
CSWKITLPV

SEQ ID NO: 862476 - protein, 9 aa, Homo Sapiens
KSVQTPVPS

SEQ ID NO: 862477 - protein, 9 aa, Homo Sapiens
KSVALCVTA

SEQ ID NO: 862478 - protein, 9 aa, Homo Sapiens
RGSAGAAPR

SEQ ID NO: 862479 - protein, 9 aa, Homo Sapiens
ACVVCYKKC

SEQ ID NO: 862480 - protein, 9 aa, Homo Sapiens
SAVKPAITT

SEQ ID NO: 862481 - protein, 9 aa, Homo Sapiens
FKPPQVAFT

SEQ ID NO: 862482 - protein, 9 aa, Homo Sapiens
HNVQQIGIL

SEQ ID NO: 862483 - protein, 9 aa, Homo Sapiens
LGRRWHVLS

SEQ ID NO: 862484 - protein, 9 aa, Homo Sapiens
GLGGAGLAV

SEQ ID NO: 862485 - protein, 9 aa, Homo Sapiens
YYESVQTPG

SEQ ID NO: 862486 - protein, 9 aa, Homo Sapiens
LITSSWGGT

SEQ ID NO: 862487 - protein, 9 aa, Homo Sapiens
ERPNVETTK

SEQ ID NO: 862488 - protein, 9 aa, Homo Sapiens
AGVLKMTIR

SEQ ID NO: 862489 - protein, 9 aa, Homo Sapiens
VHVHTCHHI

SEQ ID NO: 862490 - protein, 9 aa, Homo Sapiens
LLCTDNCPD

SEQ ID NO: 862491 - protein, 9 aa, Homo Sapiens
EIPGAEPDK

SEQ ID NO: 862492 - protein, 9 aa, Homo Sapiens
TVPRVPSHL

SEQ ID NO: 862493 - protein, 9 aa, Homo Sapiens
QNVYPSQRD

SEQ ID NO: 862494 - protein, 9 aa, Homo Sapiens
CVTFHLPEG

SEQ ID NO: 862495 - protein, 9 aa, Homo Sapiens
PSLVPLAVY

SEQ ID NO: 862496 - protein, 9 aa, Homo Sapiens
VEAVVMARS

SEQ ID NO: 862497 - protein, 9 aa, Homo Sapiens
LQNNSSKFH

SEQ ID NO: 862498 - protein, 9 aa, Homo Sapiens
PTLNHVIYG

SEQ ID NO: 862499 - protein, 9 aa, Homo Sapiens
YGAGRTKAF

SEQ ID NO: 862500 - protein, 9 aa, Homo Sapiens
PSSPIIAPV

SEQ ID NO: 862501 - protein, 9 aa, Homo Sapiens
IQDLAPSCT

SEQ ID NO: 862502 - protein, 9 aa, Homo Sapiens
RMKSDSFIQ

SEQ ID NO: 862503 - protein, 9 aa, Homo Sapiens
IKAPRDKYW

SEQ ID NO: 862504 - protein, 9 aa, Homo Sapiens
AVNTELLGY

SEQ ID NO: 862505 - protein, 9 aa, Homo Sapiens
LGILCLCSH

SEQ ID NO: 862506 - protein, 9 aa, Homo Sapiens
QEHLVLNEV

SEQ ID NO: 862507 - protein, 9 aa, Homo Sapiens
KAFVCAFFK

SEQ ID NO: 862508 - protein, 9 aa, Homo Sapiens
GTTIGCIAF

SEQ ID NO: 862509 - protein, 9 aa, Homo Sapiens
AMNRGITDG

SEQ ID NO: 862510 - protein, 9 aa, Homo Sapiens
LNLNKKVYT

SEQ ID NO: 862511 - protein, 9 aa, Homo Sapiens
SCPPKTYKS

SEQ ID NO: 862512 - protein, 9 aa, Homo Sapiens
NSAGKATSD

SEQ ID NO: 862513 - protein, 9 aa, Homo Sapiens
RENVCVYGD

SEQ ID NO: 862514 - protein, 9 aa, Homo Sapiens
RAEVAESQF

SEQ ID NO: 862515 - protein, 9 aa, Homo Sapiens
YGMMSKSDN

SEQ ID NO: 862516 - protein, 9 aa, Homo Sapiens
RTPPARDNT

SEQ ID NO: 862517 - protein, 9 aa, Homo Sapiens
LSTFLLLGL

SEQ ID NO: 862518 - protein, 9 aa, Homo Sapiens
FNLLGEDQL

SEQ ID NO: 862519 - protein, 9 aa, Homo Sapiens
TDFKLHVLC

SEQ ID NO: 862520 - protein, 9 aa, Homo Sapiens
LLEKGKCPD

SEQ ID NO: 862521 - protein, 9 aa, Homo Sapiens
FTDSRITRN

SEQ ID NO: 862522 - protein, 9 aa, Homo Sapiens
QDEKIIYPE

SEQ ID NO: 862523 - protein, 9 aa, Homo Sapiens
EKIDVVYEA

SEQ ID NO: 862524 - protein, 9 aa, Homo Sapiens
ILKRVCAQL

SEQ ID NO: 862525 - protein, 9 aa, Homo Sapiens
FIGSIGPPG

SEQ ID NO: 862526 - protein, 9 aa, Homo Sapiens
RLCGNYNGD

SEQ ID NO: 862527 - protein, 9 aa, Homo Sapiens
NIRNIEKKK

SEQ ID NO: 862528 - protein, 9 aa, Homo Sapiens
QNNTRVIQL

SEQ ID NO: 862529 - protein, 9 aa, Homo Sapiens
EKGNPGFIG

SEQ ID NO: 862530 - protein, 9 aa, Homo Sapiens
LPVPPTQHF

SEQ ID NO: 862531 - protein, 9 aa, Homo Sapiens
KEQYSNVTE

SEQ ID NO: 862532 - protein, 9 aa, Homo Sapiens
ASEVGPVMS

SEQ ID NO: 862533 - protein, 9 aa, Homo Sapiens
QLFQDYEIR

SEQ ID NO: 862534 - protein, 9 aa, Homo Sapiens
WFMFFGPEI

SEQ ID NO: 862535 - protein, 9 aa, Homo Sapiens
MSETVNSVT

SEQ ID NO: 862536 - protein, 9 aa, Homo Sapiens
DHKGNVAAA

SEQ ID NO: 862537 - protein, 9 aa, Homo Sapiens
YNLSGTKNN

SEQ ID NO: 862538 - protein, 9 aa, Homo Sapiens
ALLNRARKL

SEQ ID NO: 862539 - protein, 9 aa, Homo Sapiens
FQMWDFPGQ

SEQ ID NO: 862540 - protein, 9 aa, Homo Sapiens
PLCTLSFHL

SEQ ID NO: 862541 - protein, 9 aa, Homo Sapiens
AICTPLRYN

SEQ ID NO: 862542 - protein, 9 aa, Homo Sapiens
QIYYSGKYD

SEQ ID NO: 862543 - protein, 9 aa, Homo Sapiens
LRFLANLFV

SEQ ID NO: 862544 - protein, 9 aa, Homo Sapiens
KGDIKLSIP

SEQ ID NO: 862545 - protein, 9 aa, Homo Sapiens
NKREKLEKF

SEQ ID NO: 862546 - protein, 9 aa, Homo Sapiens
DASKAGMVN

SEQ ID NO: 862547 - protein, 9 aa, Homo Sapiens
FVIPSILII

SEQ ID NO: 862548 - protein, 9 aa, Homo Sapiens
LPSRLWSGT

SEQ ID NO: 862549 - protein, 9 aa, Homo Sapiens
AEELSEAQD

SEQ ID NO: 862550 - protein, 9 aa, Homo Sapiens
LKNYRQVEV

SEQ ID NO: 862551 - protein, 9 aa, Homo Sapiens
IYCGNCKTT

SEQ ID NO: 862552 - protein, 9 aa, Homo Sapiens
LPPRSESSS

SEQ ID NO: 862553 - protein, 9 aa, Homo Sapiens
QMKGSLPSL

SEQ ID NO: 862554 - protein, 9 aa, Homo Sapiens
ERFCVVYYF

SEQ ID NO: 862555 - protein, 9 aa, Homo Sapiens
MELGTVERQ

SEQ ID NO: 862556 - protein, 9 aa, Homo Sapiens
SVLRVGIPD

SEQ ID NO: 862557 - protein, 9 aa, Homo Sapiens
HSAFTFGID

SEQ ID NO: 862558 - protein, 9 aa, Homo Sapiens
DFSKELKKN

SEQ ID NO: 862559 - protein, 9 aa, Homo Sapiens
IFTPNNYST

SEQ ID NO: 862560 - protein, 9 aa, Homo Sapiens
VNYEHVTVP

SEQ ID NO: 862561 - protein, 9 aa, Homo Sapiens
LRDPDWLAQ

SEQ ID NO: 862562 - protein, 9 aa, Homo Sapiens
EQQPSDKST

SEQ ID NO: 862563 - protein, 9 aa, Homo Sapiens
GHYLNVPLS

SEQ ID NO: 862564 - protein, 9 aa, Homo Sapiens
VYFHCLHLF

SEQ ID NO: 862565 - protein, 9 aa, Homo Sapiens
LDSHPKLLH

SEQ ID NO: 862566 - protein, 9 aa, Homo Sapiens
ITPSMTNWS

SEQ ID NO: 862567 - protein, 9 aa, Homo Sapiens
GNISYVVEA

SEQ ID NO: 862568 - protein, 9 aa, Homo Sapiens
HNNGVLEEA

SEQ ID NO: 862569 - protein, 9 aa, Homo Sapiens
SSRIRRKSS

SEQ ID NO: 862570 - protein, 9 aa, Homo Sapiens
ILKVHGSKV

SEQ ID NO: 862571 - protein, 9 aa, Homo Sapiens
RSANGGSKS

SEQ ID NO: 862572 - protein, 9 aa, Homo Sapiens
NMLCYTPNY

SEQ ID NO: 862573 - protein, 9 aa, Homo Sapiens
LKVLFVFST

SEQ ID NO: 862574 - protein, 9 aa, Homo Sapiens
HGQVLYTDK

SEQ ID NO: 862575 - protein, 9 aa, Homo Sapiens
SKAQITGPG

SEQ ID NO: 862576 - protein, 9 aa, Homo Sapiens
YTVTSTVGD

SEQ ID NO: 862577 - protein, 9 aa, Homo Sapiens
RTLQRLQAR

SEQ ID NO: 862578 - protein, 9 aa, Homo Sapiens
MGSVRRLML

SEQ ID NO: 862579 - protein, 9 aa, Homo Sapiens
ARKGYGMMS

SEQ ID NO: 862580 - protein, 9 aa, Homo Sapiens
SEGTTPQNK

SEQ ID NO: 862581 - protein, 9 aa, Homo Sapiens
KVALRWLED

SEQ ID NO: 862582 - protein, 9 aa, Homo Sapiens
SGFRGPPGP

SEQ ID NO: 862583 - protein, 9 aa, Homo Sapiens
GTFIELSSP

SEQ ID NO: 862584 - protein, 9 aa, Homo Sapiens
KLSLRWHLG

SEQ ID NO: 862585 - protein, 9 aa, Homo Sapiens
CSENCIEIT

SEQ ID NO: 862586 - protein, 9 aa, Homo Sapiens
DLIGQGYCV

SEQ ID NO: 862587 - protein, 9 aa, Homo Sapiens
LSKGVAVFN

SEQ ID NO: 862588 - protein, 9 aa, Homo Sapiens
QELLAKLKG

SEQ ID NO: 862589 - protein, 9 aa, Homo Sapiens
EAIHAMNFS

SEQ ID NO: 862590 - protein, 9 aa, Homo Sapiens
NNTRVIQLN

SEQ ID NO: 862591 - protein, 9 aa, Homo Sapiens
GPIFQANMN

SEQ ID NO: 862592 - protein, 9 aa, Homo Sapiens
KYNVEHSVD

SEQ ID NO: 862593 - protein, 9 aa, Homo Sapiens
FTGFKPVQV

SEQ ID NO: 862594 - protein, 9 aa, Homo Sapiens
DEFDCRYKT

SEQ ID NO: 862595 - protein, 9 aa, Homo Sapiens
NYELFENQY

SEQ ID NO: 862596 - protein, 9 aa, Homo Sapiens
GIRQLIKKS

SEQ ID NO: 862597 - protein, 9 aa, Homo Sapiens
VQDEAQTLI

SEQ ID NO: 862598 - protein, 9 aa, Homo Sapiens
TALLTGPLQ

SEQ ID NO: 862599 - protein, 9 aa, Homo Sapiens
RSAPQTLEV

SEQ ID NO: 862600 - protein, 9 aa, Homo Sapiens
NRDELQRRI

SEQ ID NO: 862601 - protein, 9 aa, Homo Sapiens
AQHLLKLTC

SEQ ID NO: 862602 - protein, 9 aa, Homo Sapiens
LFKKAAAAL

SEQ ID NO: 862603 - protein, 9 aa, Homo Sapiens
TEWLPMASS

SEQ ID NO: 862604 - protein, 9 aa, Homo Sapiens
GSQGDAGVT

SEQ ID NO: 862605 - protein, 9 aa, Homo Sapiens
IRDMIGPEN

SEQ ID NO: 862606 - protein, 9 aa, Homo Sapiens
TMKKLKGEK

SEQ ID NO: 862607 - protein, 9 aa, Homo Sapiens
TPKEITLEL

SEQ ID NO: 862608 - protein, 9 aa, Homo Sapiens
FYRLRLQED

SEQ ID NO: 862609 - protein, 9 aa, Homo Sapiens
KKFKIYFLQ

SEQ ID NO: 862610 - protein, 9 aa, Homo Sapiens
EIIATKALC

SEQ ID NO: 862611 - protein, 9 aa, Homo Sapiens
PAVQDVSRP

SEQ ID NO: 862612 - protein, 9 aa, Homo Sapiens
LRLNDDNEY

SEQ ID NO: 862613 - protein, 9 aa, Homo Sapiens
FKELVQKDL

SEQ ID NO: 862614 - protein, 9 aa, Homo Sapiens
VMLTMHQIV

SEQ ID NO: 862615 - protein, 9 aa, Homo Sapiens
NAQKLERDS

SEQ ID NO: 862616 - protein, 9 aa, Homo Sapiens
FKAESNLFL

SEQ ID NO: 862617 - protein, 9 aa, Homo Sapiens
KNNFSSLKD

SEQ ID NO: 862618 - protein, 9 aa, Homo Sapiens
RVPCVMFVL

SEQ ID NO: 862619 - protein, 9 aa, Homo Sapiens
VRLFHAEQD

SEQ ID NO: 862620 - protein, 9 aa, Homo Sapiens
HSEGYRHIS

SEQ ID NO: 862621 - protein, 9 aa, Homo Sapiens
KRKVQYDSS

SEQ ID NO: 862622 - protein, 9 aa, Homo Sapiens
NIEYEELPT

SEQ ID NO: 862623 - protein, 9 aa, Homo Sapiens
ALFCPRMSA

SEQ ID NO: 862624 - protein, 9 aa, Homo Sapiens
QNNSKNYYL

SEQ ID NO: 862625 - protein, 9 aa, Homo Sapiens
ANANELKYL

SEQ ID NO: 862626 - protein, 9 aa, Homo Sapiens
DSEDKPEEE

SEQ ID NO: 862627 - protein, 9 aa, Homo Sapiens
KKAAARYVT

SEQ ID NO: 862628 - protein, 9 aa, Homo Sapiens
IVSYFNIVL

SEQ ID NO: 862629 - protein, 9 aa, Homo Sapiens
TGQEIPVNI

SEQ ID NO: 862630 - protein, 9 aa, Homo Sapiens
WLMTSNTEV

SEQ ID NO: 862631 - protein, 9 aa, Homo Sapiens
VGAVVVDHK

SEQ ID NO: 862632 - protein, 9 aa, Homo Sapiens
VSKKASPKA

SEQ ID NO: 862633 - protein, 9 aa, Homo Sapiens
KPRAQELRI

SEQ ID NO: 862634 - protein, 9 aa, Homo Sapiens
VDSKSPDVS

SEQ ID NO: 862635 - protein, 9 aa, Homo Sapiens
AENNLHLPK

SEQ ID NO: 862636 - protein, 9 aa, Homo Sapiens
VDLLAATSI

SEQ ID NO: 862637 - protein, 9 aa, Homo Sapiens
PNTWLLARP

SEQ ID NO: 862638 - protein, 9 aa, Homo Sapiens
FHHVGLWLV

SEQ ID NO: 862639 - protein, 9 aa, Homo Sapiens
TGYWIMMNI

SEQ ID NO: 862640 - protein, 9 aa, Homo Sapiens
SKGEGDMAK

SEQ ID NO: 862641 - protein, 9 aa, Homo Sapiens
TYMRIYKTG

SEQ ID NO: 862642 - protein, 9 aa, Homo Sapiens
AATTLRKVL

SEQ ID NO: 862643 - protein, 9 aa, Homo Sapiens
LGQDKETVI

SEQ ID NO: 862644 - protein, 9 aa, Homo Sapiens
RFKHLRRYT

SEQ ID NO: 862645 - protein, 9 aa, Homo Sapiens
ENNLQFQIC

SEQ ID NO: 862646 - protein, 9 aa, Homo Sapiens
KIQMASFYQ

SEQ ID NO: 862647 - protein, 9 aa, Homo Sapiens
PIFDKEELL

SEQ ID NO: 862648 - protein, 9 aa, Homo Sapiens
DDVDKYLAG

SEQ ID NO: 862649 - protein, 9 aa, Homo Sapiens
KNRDAILAL

SEQ ID NO: 862650 - protein, 9 aa, Homo Sapiens
FHAILQQEI

SEQ ID NO: 862651 - protein, 9 aa, Homo Sapiens
ENFQRTLNI

SEQ ID NO: 862652 - protein, 9 aa, Homo Sapiens
VPQPGKQSQ

SEQ ID NO: 862653 - protein, 9 aa, Homo Sapiens
VEVRPRKCE

SEQ ID NO: 862654 - protein, 9 aa, Homo Sapiens
PSLNPEQLN

SEQ ID NO: 862655 - protein, 9 aa, Homo Sapiens
FEVTQCNCR

SEQ ID NO: 862656 - protein, 9 aa, Homo Sapiens
MVESVFWNF

SEQ ID NO: 862657 - protein, 9 aa, Homo Sapiens
SYWLQTTLL

SEQ ID NO: 862658 - protein, 9 aa, Homo Sapiens
SSVMTTEVT

SEQ ID NO: 862659 - protein, 9 aa, Homo Sapiens
YWLQTTLLD

SEQ ID NO: 862660 - protein, 9 aa, Homo Sapiens
FHPIPTQSS

SEQ ID NO: 862661 - protein, 9 aa, Homo Sapiens
RVLDNCEDV

SEQ ID NO: 862662 - protein, 9 aa, Homo Sapiens
PSTKKVKKR

SEQ ID NO: 862663 - protein, 9 aa, Homo Sapiens
PSVFDQQIG

SEQ ID NO: 862664 - protein, 9 aa, Homo Sapiens
NSRDRWRNP

SEQ ID NO: 862665 - protein, 9 aa, Homo Sapiens
ITMLNRKCK

SEQ ID NO: 862666 - protein, 9 aa, Homo Sapiens
IKSLPDSNR

SEQ ID NO: 862667 - protein, 9 aa, Homo Sapiens
RQVHLWTGI

SEQ ID NO: 862668 - protein, 9 aa, Homo Sapiens
DCEFHEAST

SEQ ID NO: 862669 - protein, 9 aa, Homo Sapiens
RNVPAEQKD

SEQ ID NO: 862670 - protein, 9 aa, Homo Sapiens
MERNRAAAT

SEQ ID NO: 862671 - protein, 9 aa, Homo Sapiens
QMQSPTTTN

SEQ ID NO: 862672 - protein, 9 aa, Homo Sapiens
FDFSEYVKR

SEQ ID NO: 862673 - protein, 9 aa, Homo Sapiens
VPENMSIGE

SEQ ID NO: 862674 - protein, 9 aa, Homo Sapiens
FTAFLPFEK

SEQ ID NO: 862675 - protein, 9 aa, Homo Sapiens
LINCPGIKG

SEQ ID NO: 862676 - protein, 9 aa, Homo Sapiens
IHSTSGLNK

SEQ ID NO: 862677 - protein, 9 aa, Homo Sapiens
AKELFLLQK

SEQ ID NO: 862678 - protein, 9 aa, Homo Sapiens
KLHGGILRM

SEQ ID NO: 862679 - protein, 9 aa, Homo Sapiens
EDLQLLDLA

SEQ ID NO: 862680 - protein, 9 aa, Homo Sapiens
PGKTPVYAK

SEQ ID NO: 862681 - protein, 9 aa, Homo Sapiens
PRQIVIHRG

SEQ ID NO: 862682 - protein, 9 aa, Homo Sapiens
VKQENTVLN

SEQ ID NO: 862683 - protein, 9 aa, Homo Sapiens
KLQKRPLMP

SEQ ID NO: 862684 - protein, 9 aa, Homo Sapiens
WAIGEEHFQ

SEQ ID NO: 862685 - protein, 9 aa, Homo Sapiens
NGKVCWTSG

SEQ ID NO: 862686 - protein, 9 aa, Homo Sapiens
TSQISDAHL

SEQ ID NO: 862687 - protein, 9 aa, Homo Sapiens
IWLRKALDF

SEQ ID NO: 862688 - protein, 9 aa, Homo Sapiens
DSCSTDFDC

SEQ ID NO: 862689 - protein, 9 aa, Homo Sapiens
IPPAALRTP

SEQ ID NO: 862690 - protein, 9 aa, Homo Sapiens
PLKTPYFDV

SEQ ID NO: 862691 - protein, 9 aa, Homo Sapiens
FIRHHSSGS

SEQ ID NO: 862692 - protein, 9 aa, Homo Sapiens
EPILTQNTH

SEQ ID NO: 862693 - protein, 9 aa, Homo Sapiens
DHKETATTP

SEQ ID NO: 862694 - protein, 9 aa, Homo Sapiens
AVCCSLIKW

SEQ ID NO: 862695 - protein, 9 aa, Homo Sapiens
AHAQEFLLL

SEQ ID NO: 862696 - protein, 9 aa, Homo Sapiens
RAAEFINNY

SEQ ID NO: 862697 - protein, 9 aa, Homo Sapiens
PMMPMPVNQ

SEQ ID NO: 862698 - protein, 9 aa, Homo Sapiens
LLLNVQPDF

SEQ ID NO: 862699 - protein, 9 aa, Homo Sapiens
RRAISLLVT

SEQ ID NO: 862700 - protein, 9 aa, Homo Sapiens
QRSQLQILS

SEQ ID NO: 862701 - protein, 9 aa, Homo Sapiens
GSGLSCAFG

SEQ ID NO: 862702 - protein, 9 aa, Homo Sapiens
GIAVGLSLS

SEQ ID NO: 862703 - protein, 9 aa, Homo Sapiens
DKFYKCEEC

SEQ ID NO: 862704 - protein, 9 aa, Homo Sapiens
TMEKELKTT

SEQ ID NO: 862705 - protein, 9 aa, Homo Sapiens
DGEQTTHEP

SEQ ID NO: 862706 - protein, 9 aa, Homo Sapiens
SLWATTSVP

SEQ ID NO: 862707 - protein, 9 aa, Homo Sapiens
CGSGLIRHQ

SEQ ID NO: 862708 - protein, 9 aa, Homo Sapiens
VVIVGLYRT

SEQ ID NO: 862709 - protein, 9 aa, Homo Sapiens
GVLFVSSRK

SEQ ID NO: 862710 - protein, 9 aa, Homo Sapiens
PELFDPNSC

SEQ ID NO: 862711 - protein, 9 aa, Homo Sapiens
AIGMKNGKF

SEQ ID NO: 862712 - protein, 9 aa, Homo Sapiens
WQQRMRKML

SEQ ID NO: 862713 - protein, 9 aa, Homo Sapiens
FVQGVINEA

SEQ ID NO: 862714 - protein, 9 aa, Homo Sapiens
NQLLRCSDD

SEQ ID NO: 862715 - protein, 9 aa, Homo Sapiens
TKVLDMYQN

SEQ ID NO: 862716 - protein, 9 aa, Homo Sapiens
RRYGFSHQS

SEQ ID NO: 862717 - protein, 9 aa, Homo Sapiens
GLTIWQIDN

SEQ ID NO: 862718 - protein, 9 aa, Homo Sapiens
MKTLTYRGF

SEQ ID NO: 862719 - protein, 9 aa, Homo Sapiens
LIDEQLLCQ

SEQ ID NO: 862720 - protein, 9 aa, Homo Sapiens
GTWVITMMA

SEQ ID NO: 862721 - protein, 9 aa, Homo Sapiens
KDEFSPMKD

SEQ ID NO: 862722 - protein, 9 aa, Homo Sapiens
PAVPFEMVV

SEQ ID NO: 862723 - protein, 9 aa, Homo Sapiens
IKNTSKKVT

SEQ ID NO: 862724 - protein, 9 aa, Homo Sapiens
HPGSASGTS

SEQ ID NO: 862725 - protein, 9 aa, Homo Sapiens
YRGPRGGGA

SEQ ID NO: 862726 - protein, 9 aa, Homo Sapiens
RDSIGTHLS

SEQ ID NO: 862727 - protein, 9 aa, Homo Sapiens
NVTINFSGD

SEQ ID NO: 862728 - protein, 9 aa, Homo Sapiens
PYGCILCGK

SEQ ID NO: 862729 - protein, 9 aa, Homo Sapiens
KNAMYICCV

SEQ ID NO: 862730 - protein, 9 aa, Homo Sapiens
INDLSREKM

SEQ ID NO: 862731 - protein, 9 aa, Homo Sapiens
QNKDHSVFL

SEQ ID NO: 862732 - protein, 9 aa, Homo Sapiens
LDECRLYYE

SEQ ID NO: 862733 - protein, 9 aa, Homo Sapiens
TDPPSVPMC

SEQ ID NO: 862734 - protein, 9 aa, Homo Sapiens
FYKDLTYLG

SEQ ID NO: 862735 - protein, 9 aa, Homo Sapiens
WLLEEKVCA

SEQ ID NO: 862736 - protein, 9 aa, Homo Sapiens
EREQQLVDK

SEQ ID NO: 862737 - protein, 9 aa, Homo Sapiens
AVPHGKEKE

SEQ ID NO: 862738 - protein, 9 aa, Homo Sapiens
YRYLKPENL

SEQ ID NO: 862739 - protein, 9 aa, Homo Sapiens
GITQLFFLH

SEQ ID NO: 862740 - protein, 9 aa, Homo Sapiens
KTLNCHLPA

SEQ ID NO: 862741 - protein, 9 aa, Homo Sapiens
SSYCIEGFC

SEQ ID NO: 862742 - protein, 9 aa, Homo Sapiens
SGLYLVMND

SEQ ID NO: 862743 - protein, 9 aa, Homo Sapiens
LATVFWYNN

SEQ ID NO: 862744 - protein, 9 aa, Homo Sapiens
GAQEQQVRH

SEQ ID NO: 862745 - protein, 9 aa, Homo Sapiens
NRYLVKAVN

SEQ ID NO: 862746 - protein, 9 aa, Homo Sapiens
DLIKGVNMV

SEQ ID NO: 862747 - protein, 9 aa, Homo Sapiens
LDNFLRNKP

SEQ ID NO: 862748 - protein, 9 aa, Homo Sapiens
VNRSIRQGF

SEQ ID NO: 862749 - protein, 9 aa, Homo Sapiens
TSDSTVYYY

SEQ ID NO: 862750 - protein, 9 aa, Homo Sapiens
VITKLRKLF

SEQ ID NO: 862751 - protein, 9 aa, Homo Sapiens
KTISESYSC

SEQ ID NO: 862752 - protein, 9 aa, Homo Sapiens
GYISLLLRV

SEQ ID NO: 862753 - protein, 9 aa, Homo Sapiens
KATMYNVLA

SEQ ID NO: 862754 - protein, 9 aa, Homo Sapiens
SLKNMAFFG

SEQ ID NO: 862755 - protein, 9 aa, Homo Sapiens
TGKLVSLSK

SEQ ID NO: 862756 - protein, 9 aa, Homo Sapiens
HLAAVGMLY

SEQ ID NO: 862757 - protein, 9 aa, Homo Sapiens
DLSDQFSAI

SEQ ID NO: 862758 - protein, 9 aa, Homo Sapiens
AHLLQVCCC

SEQ ID NO: 862759 - protein, 9 aa, Homo Sapiens
SSAFLDSHP

SEQ ID NO: 862760 - protein, 9 aa, Homo Sapiens
MYKESALDK

SEQ ID NO: 862761 - protein, 9 aa, Homo Sapiens
KWADIKEDK

SEQ ID NO: 862762 - protein, 9 aa, Homo Sapiens
VKKKPTLLN

SEQ ID NO: 862763 - protein, 9 aa, Homo Sapiens
FIISYLTIA

SEQ ID NO: 862764 - protein, 9 aa, Homo Sapiens
ITKRITENA

SEQ ID NO: 862765 - protein, 9 aa, Homo Sapiens
LINFLIGIL

SEQ ID NO: 862766 - protein, 9 aa, Homo Sapiens
SMKGLYFAK

SEQ ID NO: 862767 - protein, 9 aa, Homo Sapiens
YFDEKHLQS

SEQ ID NO: 862768 - protein, 9 aa, Homo Sapiens
RCKKIILPT

SEQ ID NO: 862769 - protein, 9 aa, Homo Sapiens
KRVRSRASI

SEQ ID NO: 862770 - protein, 9 aa, Homo Sapiens
AVPWKQPKG

SEQ ID NO: 862771 - protein, 9 aa, Homo Sapiens
TFPAPFYYK

SEQ ID NO: 862772 - protein, 9 aa, Homo Sapiens
TQQSTNQSH

SEQ ID NO: 862773 - protein, 9 aa, Homo Sapiens
EELEYTCAK

SEQ ID NO: 862774 - protein, 9 aa, Homo Sapiens
PGFSDSSQT

SEQ ID NO: 862775 - protein, 9 aa, Homo Sapiens
IHAYSSSEL

SEQ ID NO: 862776 - protein, 9 aa, Homo Sapiens
ASRENNKPH

SEQ ID NO: 862777 - protein, 9 aa, Homo Sapiens
IGEKLERYS

SEQ ID NO: 862778 - protein, 9 aa, Homo Sapiens
EQYQSFKLF

SEQ ID NO: 862779 - protein, 9 aa, Homo Sapiens
RESVFRQIA

SEQ ID NO: 862780 - protein, 9 aa, Homo Sapiens
QTPMYLFLR

SEQ ID NO: 862781 - protein, 9 aa, Homo Sapiens
FELIHKYID

SEQ ID NO: 862782 - protein, 9 aa, Homo Sapiens
SMSKPNMIS

SEQ ID NO: 862783 - protein, 9 aa, Homo Sapiens
FWAKYTTCE

SEQ ID NO: 862784 - protein, 9 aa, Homo Sapiens
DCNEFDQYL

SEQ ID NO: 862785 - protein, 9 aa, Homo Sapiens
LQMPGGTLS

SEQ ID NO: 862786 - protein, 9 aa, Homo Sapiens
SARAQGPSR

SEQ ID NO: 862787 - protein, 9 aa, Homo Sapiens
ALEKNILKE

SEQ ID NO: 862788 - protein, 9 aa, Homo Sapiens
PISTELDMA

SEQ ID NO: 862789 - protein, 9 aa, Homo Sapiens
TAPEEKQLT

SEQ ID NO: 862790 - protein, 9 aa, Homo Sapiens
SNKTLDKME

SEQ ID NO: 862791 - protein, 9 aa, Homo Sapiens
RHKCRLCAK

SEQ ID NO: 862792 - protein, 9 aa, Homo Sapiens
LFLPRRTPP

SEQ ID NO: 862793 - protein, 9 aa, Homo Sapiens
LDGQELMFW

SEQ ID NO: 862794 - protein, 9 aa, Homo Sapiens
VLSVYLLTF

SEQ ID NO: 862795 - protein, 9 aa, Homo Sapiens
AFAINYKGP

SEQ ID NO: 862796 - protein, 9 aa, Homo Sapiens
IKHQNLAAL

SEQ ID NO: 862797 - protein, 9 aa, Homo Sapiens
SDKQQKRQN

SEQ ID NO: 862798 - protein, 9 aa, Homo Sapiens
KYNHMRAAI

SEQ ID NO: 862799 - protein, 9 aa, Homo Sapiens
ERWSQQGPP

SEQ ID NO: 862800 - protein, 9 aa, Homo Sapiens
RAVFSSLQR

SEQ ID NO: 862801 - protein, 9 aa, Homo Sapiens
YLQQYVEAG

SEQ ID NO: 862802 - protein, 9 aa, Homo Sapiens
KPTMKMLER

SEQ ID NO: 862803 - protein, 9 aa, Homo Sapiens
NVCVYGDSC

SEQ ID NO: 862804 - protein, 9 aa, Homo Sapiens
REKRHRNKL

SEQ ID NO: 862805 - protein, 9 aa, Homo Sapiens
ILSLLLVSM

SEQ ID NO: 862806 - protein, 9 aa, Homo Sapiens
LPLAVLPIL

SEQ ID NO: 862807 - protein, 9 aa, Homo Sapiens
VSPYYCYGG

SEQ ID NO: 862808 - protein, 9 aa, Homo Sapiens
EDNSLPYQV

SEQ ID NO: 862809 - protein, 9 aa, Homo Sapiens
PSRAEHLAS

SEQ ID NO: 862810 - protein, 9 aa, Homo Sapiens
DFTTKGVTS

SEQ ID NO: 862811 - protein, 9 aa, Homo Sapiens
ENQPAGAGS

SEQ ID NO: 862812 - protein, 9 aa, Homo Sapiens
NNVSEDLPL

SEQ ID NO: 862813 - protein, 9 aa, Homo Sapiens
KETKKVYEG

SEQ ID NO: 862814 - protein, 9 aa, Homo Sapiens
PPPLPAAAH

SEQ ID NO: 862815 - protein, 9 aa, Homo Sapiens
KMKVKKSAV

SEQ ID NO: 862816 - protein, 9 aa, Homo Sapiens
EIVQNFQSG

SEQ ID NO: 862817 - protein, 9 aa, Homo Sapiens
FLLYIARQR

SEQ ID NO: 862818 - protein, 9 aa, Homo Sapiens
CRRLNKHEE

SEQ ID NO: 862819 - protein, 9 aa, Homo Sapiens
QGSHSQQKK

SEQ ID NO: 862820 - protein, 9 aa, Homo Sapiens
GKPVPFSTF

SEQ ID NO: 862821 - protein, 9 aa, Homo Sapiens
MVQHYMEVN

SEQ ID NO: 862822 - protein, 9 aa, Homo Sapiens
MAQQHYYGK

SEQ ID NO: 862823 - protein, 9 aa, Homo Sapiens
DDGVLLYPS

SEQ ID NO: 862824 - protein, 9 aa, Homo Sapiens
QSLPHLIQT

SEQ ID NO: 862825 - protein, 9 aa, Homo Sapiens
LKRCFREFC

SEQ ID NO: 862826 - protein, 9 aa, Homo Sapiens
KEVDHLFCE

SEQ ID NO: 862827 - protein, 9 aa, Homo Sapiens
DNNELWKKV

SEQ ID NO: 862828 - protein, 9 aa, Homo Sapiens
LSIHSCYLR

SEQ ID NO: 862829 - protein, 9 aa, Homo Sapiens
RLEPLYFPI

SEQ ID NO: 862830 - protein, 9 aa, Homo Sapiens
ILEPYKYLL

SEQ ID NO: 862831 - protein, 9 aa, Homo Sapiens
NSESQRSWN

SEQ ID NO: 862832 - protein, 9 aa, Homo Sapiens
YACVKDISA

SEQ ID NO: 862833 - protein, 9 aa, Homo Sapiens
KLVSLSKQN

SEQ ID NO: 862834 - protein, 9 aa, Homo Sapiens
IISYDVKYA

SEQ ID NO: 862835 - protein, 9 aa, Homo Sapiens
MMPMPVNQA

SEQ ID NO: 862836 - protein, 9 aa, Homo Sapiens
PRSYLFDNP

SEQ ID NO: 862837 - protein, 9 aa, Homo Sapiens
QPLMDNNRI

SEQ ID NO: 862838 - protein, 9 aa, Homo Sapiens
QIIQERNGV

SEQ ID NO: 862839 - protein, 9 aa, Homo Sapiens
KTLLWCRNE

SEQ ID NO: 862840 - protein, 9 aa, Homo Sapiens
SFKLEMAQE

SEQ ID NO: 862841 - protein, 9 aa, Homo Sapiens
HPVKPSILN

SEQ ID NO: 862842 - protein, 9 aa, Homo Sapiens
FQDYEIRQY

SEQ ID NO: 862843 - protein, 9 aa, Homo Sapiens
VALVVLIIT

SEQ ID NO: 862844 - protein, 9 aa, Homo Sapiens
PHHPNPPPD

SEQ ID NO: 862845 - protein, 9 aa, Homo Sapiens
ALGGFYPFP

SEQ ID NO: 862846 - protein, 9 aa, Homo Sapiens
DNNKLNILD

SEQ ID NO: 862847 - protein, 9 aa, Homo Sapiens
LSMRDRAAA

SEQ ID NO: 862848 - protein, 9 aa, Homo Sapiens
PKTKERSEK

SEQ ID NO: 862849 - protein, 9 aa, Homo Sapiens
FLIKCRDMT

SEQ ID NO: 862850 - protein, 9 aa, Homo Sapiens
ACCSPYLFD

SEQ ID NO: 862851 - protein, 9 aa, Homo Sapiens
IEFIRKPEI

SEQ ID NO: 862852 - protein, 9 aa, Homo Sapiens
AWLNGHRKN

SEQ ID NO: 862853 - protein, 9 aa, Homo Sapiens
KTSVARLTR

SEQ ID NO: 862854 - protein, 9 aa, Homo Sapiens
SPKAASTPR

SEQ ID NO: 862855 - protein, 9 aa, Homo Sapiens
LGRNKKRRK

SEQ ID NO: 862856 - protein, 9 aa, Homo Sapiens
TFRDVAIEL

SEQ ID NO: 862857 - protein, 9 aa, Homo Sapiens
SIKHKDETV

SEQ ID NO: 862858 - protein, 9 aa, Homo Sapiens
IIKLNVREW

SEQ ID NO: 862859 - protein, 9 aa, Homo Sapiens
EAATNASNT

SEQ ID NO: 862860 - protein, 9 aa, Homo Sapiens
PSHLYTDGP

SEQ ID NO: 862861 - protein, 9 aa, Homo Sapiens
SQTQEAKDI

SEQ ID NO: 862862 - protein, 9 aa, Homo Sapiens
KKQLREWGE

SEQ ID NO: 862863 - protein, 9 aa, Homo Sapiens
EMSISREDN

SEQ ID NO: 862864 - protein, 9 aa, Homo Sapiens
EEIVFLRAI

SEQ ID NO: 862865 - protein, 9 aa, Homo Sapiens
NQINYVIKE

SEQ ID NO: 862866 - protein, 9 aa, Homo Sapiens
PSELPVKLL

SEQ ID NO: 862867 - protein, 9 aa, Homo Sapiens
LQDKQGVIC

SEQ ID NO: 862868 - protein, 9 aa, Homo Sapiens
MTINSVTTD

SEQ ID NO: 862869 - protein, 9 aa, Homo Sapiens
TAVLKWIRE

SEQ ID NO: 862870 - protein, 9 aa, Homo Sapiens
AGGKVVSLL

SEQ ID NO: 862871 - protein, 9 aa, Homo Sapiens
QLRGTWECS

SEQ ID NO: 862872 - protein, 9 aa, Homo Sapiens
TSYSWDYMS

SEQ ID NO: 862873 - protein, 9 aa, Homo Sapiens
FKRSFLENK

SEQ ID NO: 862874 - protein, 9 aa, Homo Sapiens
VVQKEKNVA

SEQ ID NO: 862875 - protein, 9 aa, Homo Sapiens
LSRHWIIHT

SEQ ID NO: 862876 - protein, 9 aa, Homo Sapiens
TDKFCKVCG

SEQ ID NO: 862877 - protein, 9 aa, Homo Sapiens
APGAAPGRA

SEQ ID NO: 862878 - protein, 9 aa, Homo Sapiens
SMLKTSMYA

SEQ ID NO: 862879 - protein, 9 aa, Homo Sapiens
IIKARNVKA

SEQ ID NO: 862880 - protein, 9 aa, Homo Sapiens
RTGSRLGGK

SEQ ID NO: 862881 - protein, 9 aa, Homo Sapiens
LVEELMLLA

SEQ ID NO: 862882 - protein, 9 aa, Homo Sapiens
YHYSEKPIN

SEQ ID NO: 862883 - protein, 9 aa, Homo Sapiens
PPGDPGLPD

SEQ ID NO: 862884 - protein, 9 aa, Homo Sapiens
CKLREDCAL

SEQ ID NO: 862885 - protein, 9 aa, Homo Sapiens
LTSDEEVYS

SEQ ID NO: 862886 - protein, 9 aa, Homo Sapiens
PDVSKHDFL

SEQ ID NO: 862887 - protein, 9 aa, Homo Sapiens
SSWTAEGDI

SEQ ID NO: 862888 - protein, 9 aa, Homo Sapiens
LIPTGLPVR

SEQ ID NO: 862889 - protein, 9 aa, Homo Sapiens
RQRFPQLTT

SEQ ID NO: 862890 - protein, 9 aa, Homo Sapiens
RALKTIYVI

SEQ ID NO: 862891 - protein, 9 aa, Homo Sapiens
YIGPGYRVA

SEQ ID NO: 862892 - protein, 9 aa, Homo Sapiens
AKGLGADGL

SEQ ID NO: 862893 - protein, 9 aa, Homo Sapiens
VLKLRYKVA

SEQ ID NO: 862894 - protein, 9 aa, Homo Sapiens
LCEGEEPKL

SEQ ID NO: 862895 - protein, 9 aa, Homo Sapiens
RLIRKALES

SEQ ID NO: 862896 - protein, 9 aa, Homo Sapiens
IWKKQEERP

SEQ ID NO: 862897 - protein, 9 aa, Homo Sapiens
KGVDIYSKF

SEQ ID NO: 862898 - protein, 9 aa, Homo Sapiens
PSSPKRNLF

SEQ ID NO: 862899 - protein, 9 aa, Homo Sapiens
RKYSHLSDT

SEQ ID NO: 862900 - protein, 9 aa, Homo Sapiens
EGPQLPQYH

SEQ ID NO: 862901 - protein, 9 aa, Homo Sapiens
ENIQETCKA

SEQ ID NO: 862902 - protein, 9 aa, Homo Sapiens
ILCLCSHCS

SEQ ID NO: 862903 - protein, 9 aa, Homo Sapiens
QASGGRWVE

SEQ ID NO: 862904 - protein, 9 aa, Homo Sapiens
EYFINYVQY

SEQ ID NO: 862905 - protein, 9 aa, Homo Sapiens
TPIFQANQE

SEQ ID NO: 862906 - protein, 9 aa, Homo Sapiens
LQMAKSVHI

SEQ ID NO: 862907 - protein, 9 aa, Homo Sapiens
KSKLFELIQ

SEQ ID NO: 862908 - protein, 9 aa, Homo Sapiens
DGIQKLGVS

SEQ ID NO: 862909 - protein, 9 aa, Homo Sapiens
QVPLDPTRS

SEQ ID NO: 862910 - protein, 9 aa, Homo Sapiens
QDVNTSLQS

SEQ ID NO: 862911 - protein, 9 aa, Homo Sapiens
DSLFLISGK

SEQ ID NO: 862912 - protein, 9 aa, Homo Sapiens
DKKKEINKR

SEQ ID NO: 862913 - protein, 9 aa, Homo Sapiens
THESDEEQL

SEQ ID NO: 862914 - protein, 9 aa, Homo Sapiens
SAVVYMLHL

SEQ ID NO: 862915 - protein, 9 aa, Homo Sapiens
SRLQTDNLQ

SEQ ID NO: 862916 - protein, 9 aa, Homo Sapiens
TYPKSGTAW

SEQ ID NO: 862917 - protein, 9 aa, Homo Sapiens
LLLRVEPYP

SEQ ID NO: 862918 - protein, 9 aa, Homo Sapiens
QSSDLQHSQ

SEQ ID NO: 862919 - protein, 9 aa, Homo Sapiens
CYVLPRLML

SEQ ID NO: 862920 - protein, 9 aa, Homo Sapiens
PFEPNTFRD

SEQ ID NO: 862921 - protein, 9 aa, Homo Sapiens
NAKCEIHNG

SEQ ID NO: 862922 - protein, 9 aa, Homo Sapiens
LGSKAVWMP

SEQ ID NO: 862923 - protein, 9 aa, Homo Sapiens
YITIIAVYF

SEQ ID NO: 862924 - protein, 9 aa, Homo Sapiens
ETLYGQEIY

SEQ ID NO: 862925 - protein, 9 aa, Homo Sapiens
STGLDTMLI

SEQ ID NO: 862926 - protein, 9 aa, Homo Sapiens
LLLMQLVLS

SEQ ID NO: 862927 - protein, 9 aa, Homo Sapiens
EALRREVIM

SEQ ID NO: 862928 - protein, 9 aa, Homo Sapiens
TNCEVKASE

SEQ ID NO: 862929 - protein, 9 aa, Homo Sapiens
TTKKSKKAD

SEQ ID NO: 862930 - protein, 9 aa, Homo Sapiens
GTQQQNLNK

SEQ ID NO: 862931 - protein, 9 aa, Homo Sapiens
RVHFKSNNL

SEQ ID NO: 862932 - protein, 9 aa, Homo Sapiens
SRLYVGAQD

SEQ ID NO: 862933 - protein, 9 aa, Homo Sapiens
KYEATIAAM

SEQ ID NO: 862934 - protein, 9 aa, Homo Sapiens
NWGNLWWVG

SEQ ID NO: 862935 - protein, 9 aa, Homo Sapiens
HSANGVILT

SEQ ID NO: 862936 - protein, 9 aa, Homo Sapiens
SIDESSSMV

SEQ ID NO: 862937 - protein, 9 aa, Homo Sapiens
FQINQLLQK

SEQ ID NO: 862938 - protein, 9 aa, Homo Sapiens
LYNDRSVLD

SEQ ID NO: 862939 - protein, 9 aa, Homo Sapiens
TLMREVIHP

SEQ ID NO: 862940 - protein, 9 aa, Homo Sapiens
EDFCYVFTG

SEQ ID NO: 862941 - protein, 9 aa, Homo Sapiens
GYLLGIHLG

SEQ ID NO: 862942 - protein, 9 aa, Homo Sapiens
ENLKKRLNT

SEQ ID NO: 862943 - protein, 9 aa, Homo Sapiens
LHQLFRDMD

SEQ ID NO: 862944 - protein, 9 aa, Homo Sapiens
TYHQTIHTG

SEQ ID NO: 862945 - protein, 9 aa, Homo Sapiens
LTLLILVRS

SEQ ID NO: 862946 - protein, 9 aa, Homo Sapiens
ECERIHFFR

SEQ ID NO: 862947 - protein, 9 aa, Homo Sapiens
SPDNWLQPT

SEQ ID NO: 862948 - protein, 9 aa, Homo Sapiens
DKNCNLPRL

SEQ ID NO: 862949 - protein, 9 aa, Homo Sapiens
YSEKPINWQ

SEQ ID NO: 862950 - protein, 9 aa, Homo Sapiens
DNFYSNLIL

SEQ ID NO: 862951 - protein, 9 aa, Homo Sapiens
NFRSHDMTQ

SEQ ID NO: 862952 - protein, 9 aa, Homo Sapiens
LMWWMLAWE

SEQ ID NO: 862953 - protein, 9 aa, Homo Sapiens
GTLSSGLCR

SEQ ID NO: 862954 - protein, 9 aa, Homo Sapiens
SPGPDGDLS

SEQ ID NO: 862955 - protein, 9 aa, Homo Sapiens
GVPGSQGKA

SEQ ID NO: 862956 - protein, 9 aa, Homo Sapiens
WIIHAYSSS

SEQ ID NO: 862957 - protein, 9 aa, Homo Sapiens
FASRQDPLH

SEQ ID NO: 862958 - protein, 9 aa, Homo Sapiens
KHNQNENVV

SEQ ID NO: 862959 - protein, 9 aa, Homo Sapiens
SDAIYRPMG

SEQ ID NO: 862960 - protein, 9 aa, Homo Sapiens
PVRGEPVWE

SEQ ID NO: 862961 - protein, 9 aa, Homo Sapiens
LYYWALAYQ

SEQ ID NO: 862962 - protein, 9 aa, Homo Sapiens
FEWERTGLT

SEQ ID NO: 862963 - protein, 9 aa, Homo Sapiens
HRVRQNVSQ

SEQ ID NO: 862964 - protein, 9 aa, Homo Sapiens
LQNIPFNLT

SEQ ID NO: 862965 - protein, 9 aa, Homo Sapiens
VLKDVDSLL

SEQ ID NO: 862966 - protein, 9 aa, Homo Sapiens
LLTKTLPDS

SEQ ID NO: 862967 - protein, 9 aa, Homo Sapiens
AVLWELNKP

SEQ ID NO: 862968 - protein, 9 aa, Homo Sapiens
SQLMALVRY

SEQ ID NO: 862969 - protein, 9 aa, Homo Sapiens
GFLGKKFKI

SEQ ID NO: 862970 - protein, 9 aa, Homo Sapiens
SNMTNCEVK

SEQ ID NO: 862971 - protein, 9 aa, Homo Sapiens
TFAARPFSD

SEQ ID NO: 862972 - protein, 9 aa, Homo Sapiens
RGNSLALLV

SEQ ID NO: 862973 - protein, 9 aa, Homo Sapiens
SQLAIVPQE

SEQ ID NO: 862974 - protein, 9 aa, Homo Sapiens
SISDRIRET

SEQ ID NO: 862975 - protein, 9 aa, Homo Sapiens
KSITQWIVD

SEQ ID NO: 862976 - protein, 9 aa, Homo Sapiens
DTALEARIH

SEQ ID NO: 862977 - protein, 9 aa, Homo Sapiens
CFDIEGSDE

SEQ ID NO: 862978 - protein, 9 aa, Homo Sapiens
SSRNVPAEQ

SEQ ID NO: 862979 - protein, 9 aa, Homo Sapiens
VHKLHYLIG

SEQ ID NO: 862980 - protein, 9 aa, Homo Sapiens
LDMLTFTIA

SEQ ID NO: 862981 - protein, 9 aa, Homo Sapiens
LREYLSADT

SEQ ID NO: 862982 - protein, 9 aa, Homo Sapiens
RISLIALTQ

SEQ ID NO: 862983 - protein, 9 aa, Homo Sapiens
SEKSKSTPD

SEQ ID NO: 862984 - protein, 9 aa, Homo Sapiens
YQSLNKQNV

SEQ ID NO: 862985 - protein, 9 aa, Homo Sapiens
PIFYGIFYS

SEQ ID NO: 862986 - protein, 9 aa, Homo Sapiens
PPARDNTDV

SEQ ID NO: 862987 - protein, 9 aa, Homo Sapiens
QCLPSRLWS

SEQ ID NO: 862988 - protein, 9 aa, Homo Sapiens
RLNDDNEYL

SEQ ID NO: 862989 - protein, 9 aa, Homo Sapiens
EKTVTFLGV

SEQ ID NO: 862990 - protein, 9 aa, Homo Sapiens
QRQSDTVYH

SEQ ID NO: 862991 - protein, 9 aa, Homo Sapiens
EKLTQTRLH

SEQ ID NO: 862992 - protein, 9 aa, Homo Sapiens
WAEYQNSLL

SEQ ID NO: 862993 - protein, 9 aa, Homo Sapiens
TLINWWVMA

SEQ ID NO: 862994 - protein, 9 aa, Homo Sapiens
PDGSQIPYI

SEQ ID NO: 862995 - protein, 9 aa, Homo Sapiens
DIQFYMYEI

SEQ ID NO: 862996 - protein, 9 aa, Homo Sapiens
EGTSFIMDQ

SEQ ID NO: 862997 - protein, 9 aa, Homo Sapiens
KIIHTGDKF

SEQ ID NO: 862998 - protein, 9 aa, Homo Sapiens
SSLNTHLRT

SEQ ID NO: 862999 - protein, 9 aa, Homo Sapiens
DPLDWLCGE

SEQ ID NO: 863000 - protein, 9 aa, Homo Sapiens
KHRTYVHVL

SEQ ID NO: 863001 - protein, 9 aa, Homo Sapiens
VARALNLTE

SEQ ID NO: 863002 - protein, 9 aa, Homo Sapiens
IFPVRDQVL

SEQ ID NO: 863003 - protein, 9 aa, Homo Sapiens
PVIRGQSSV

SEQ ID NO: 863004 - protein, 9 aa, Homo Sapiens
FSAIENDPL

SEQ ID NO: 863005 - protein, 9 aa, Homo Sapiens
RKMMERRDS

SEQ ID NO: 863006 - protein, 9 aa, Homo Sapiens
LDNGRGFAH

SEQ ID NO: 863007 - protein, 9 aa, Homo Sapiens
LQLKPLKNY

SEQ ID NO: 863008 - protein, 9 aa, Homo Sapiens
LMGFGKDVR

SEQ ID NO: 863009 - protein, 9 aa, Homo Sapiens
IGRSFLFIT

SEQ ID NO: 863010 - protein, 9 aa, Homo Sapiens
EITNCSRNG

SEQ ID NO: 863011 - protein, 9 aa, Homo Sapiens
LYLNGRRIN

SEQ ID NO: 863012 - protein, 9 aa, Homo Sapiens
EECWGKPNA

SEQ ID NO: 863013 - protein, 9 aa, Homo Sapiens
SVAWRVAQG

SEQ ID NO: 863014 - protein, 9 aa, Homo Sapiens
TPSFHSGSP

SEQ ID NO: 863015 - protein, 9 aa, Homo Sapiens
NISINDYAK

SEQ ID NO: 863016 - protein, 9 aa, Homo Sapiens
TIQKAWRCH

SEQ ID NO: 863017 - protein, 9 aa, Homo Sapiens
AYKCSDQRG

SEQ ID NO: 863018 - protein, 9 aa, Homo Sapiens
GTMLPASAS

SEQ ID NO: 863019 - protein, 9 aa, Homo Sapiens
HVGELPTPA

SEQ ID NO: 863020 - protein, 9 aa, Homo Sapiens
NKRTPSAPN

SEQ ID NO: 863021 - protein, 9 aa, Homo Sapiens
KVHAEQVLS

SEQ ID NO: 863022 - protein, 9 aa, Homo Sapiens
KIFDSLSMK

SEQ ID NO: 863023 - protein, 9 aa, Homo Sapiens
IEKDDCDKT

SEQ ID NO: 863024 - protein, 9 aa, Homo Sapiens
EVCRAVLNF

SEQ ID NO: 863025 - protein, 9 aa, Homo Sapiens
GCTISMIKV

SEQ ID NO: 863026 - protein, 9 aa, Homo Sapiens
KKMTMREIN

SEQ ID NO: 863027 - protein, 9 aa, Homo Sapiens
FLVRESENS

SEQ ID NO: 863028 - protein, 9 aa, Homo Sapiens
FQRSAILVT

SEQ ID NO: 863029 - protein, 9 aa, Homo Sapiens
CTLIHKPHG

SEQ ID NO: 863030 - protein, 9 aa, Homo Sapiens
NVLLGRWAI

SEQ ID NO: 863031 - protein, 9 aa, Homo Sapiens
TSNIVNIKV

SEQ ID NO: 863032 - protein, 9 aa, Homo Sapiens
RTLKTNLPV

SEQ ID NO: 863033 - protein, 9 aa, Homo Sapiens
EVWEVLTLT

SEQ ID NO: 863034 - protein, 9 aa, Homo Sapiens
AGNKFTQDQ

SEQ ID NO: 863035 - protein, 9 aa, Homo Sapiens
LSKYEAIMC

SEQ ID NO: 863036 - protein, 9 aa, Homo Sapiens
LLDSLVHGK

SEQ ID NO: 863037 - protein, 9 aa, Homo Sapiens
TETKTFLVF

SEQ ID NO: 863038 - protein, 9 aa, Homo Sapiens
TVEIETQGD

SEQ ID NO: 863039 - protein, 9 aa, Homo Sapiens
LGFYNSNPA

SEQ ID NO: 863040 - protein, 9 aa, Homo Sapiens
PQHKLFSMV

SEQ ID NO: 863041 - protein, 9 aa, Homo Sapiens
LNYFFVEIR

SEQ ID NO: 863042 - protein, 9 aa, Homo Sapiens
TPELAHCPS

SEQ ID NO: 863043 - protein, 9 aa, Homo Sapiens
TVEYNNLKF

SEQ ID NO: 863044 - protein, 9 aa, Homo Sapiens
YILKIDSYY

SEQ ID NO: 863045 - protein, 9 aa, Homo Sapiens
SSLNNGVVL

SEQ ID NO: 863046 - protein, 9 aa, Homo Sapiens
VFNGRCHVV

SEQ ID NO: 863047 - protein, 9 aa, Homo Sapiens
VIAYPSHIG

SEQ ID NO: 863048 - protein, 9 aa, Homo Sapiens
DKELVQSLK

SEQ ID NO: 863049 - protein, 9 aa, Homo Sapiens
KIALHDCVL

SEQ ID NO: 863050 - protein, 9 aa, Homo Sapiens
GYTFMFDEK

SEQ ID NO: 863051 - protein, 9 aa, Homo Sapiens
AEVFQDTVH

SEQ ID NO: 863052 - protein, 9 aa, Homo Sapiens
ERLGMKKEQ

SEQ ID NO: 863053 - protein, 9 aa, Homo Sapiens
AFTQKPHRT

SEQ ID NO: 863054 - protein, 9 aa, Homo Sapiens
FIITLLVKS

SEQ ID NO: 863055 - protein, 9 aa, Homo Sapiens
FSRSKHSDD

SEQ ID NO: 863056 - protein, 9 aa, Homo Sapiens
NINIRHIAN

SEQ ID NO: 863057 - protein, 9 aa, Homo Sapiens
SLFSCLEDR

SEQ ID NO: 863058 - protein, 9 aa, Homo Sapiens
RVDSEIERM

SEQ ID NO: 863059 - protein, 9 aa, Homo Sapiens
LDNLILNEF

SEQ ID NO: 863060 - protein, 9 aa, Homo Sapiens
PLEGDHVFC

SEQ ID NO: 863061 - protein, 9 aa, Homo Sapiens
QHELLYTFE

SEQ ID NO: 863062 - protein, 9 aa, Homo Sapiens
GKLYRSPEH

SEQ ID NO: 863063 - protein, 9 aa, Homo Sapiens
VTFLGVMAD

SEQ ID NO: 863064 - protein, 9 aa, Homo Sapiens
KNMKGLSYD

SEQ ID NO: 863065 - protein, 9 aa, Homo Sapiens
DDLFMMPQI

SEQ ID NO: 863066 - protein, 9 aa, Homo Sapiens
VFKEKTVTF

SEQ ID NO: 863067 - protein, 9 aa, Homo Sapiens
DRVLYILKL

SEQ ID NO: 863068 - protein, 9 aa, Homo Sapiens
SLVDLNTNF

SEQ ID NO: 863069 - protein, 9 aa, Homo Sapiens
QPERYELCK

SEQ ID NO: 863070 - protein, 9 aa, Homo Sapiens
GRPVAVPHG

SEQ ID NO: 863071 - protein, 9 aa, Homo Sapiens
ESWSLRMVG

SEQ ID NO: 863072 - protein, 9 aa, Homo Sapiens
LCQFVMDNS

SEQ ID NO: 863073 - protein, 9 aa, Homo Sapiens
YRTHDGSRA

SEQ ID NO: 863074 - protein, 9 aa, Homo Sapiens
AKLEKPSRT

SEQ ID NO: 863075 - protein, 9 aa, Homo Sapiens
RATLPIFDK

SEQ ID NO: 863076 - protein, 9 aa, Homo Sapiens
LPAEGLKGV

SEQ ID NO: 863077 - protein, 9 aa, Homo Sapiens
VPSGLSTLP

SEQ ID NO: 863078 - protein, 9 aa, Homo Sapiens
TGVHASKIS

SEQ ID NO: 863079 - protein, 9 aa, Homo Sapiens
RYLRFTWSM

SEQ ID NO: 863080 - protein, 9 aa, Homo Sapiens
GLQVPFFLF

SEQ ID NO: 863081 - protein, 9 aa, Homo Sapiens
EEQKKQNKP

SEQ ID NO: 863082 - protein, 9 aa, Homo Sapiens
GPGAQTPLT

SEQ ID NO: 863083 - protein, 9 aa, Homo Sapiens
FPIRSKLSS

SEQ ID NO: 863084 - protein, 9 aa, Homo Sapiens
FWNFDVDGD

SEQ ID NO: 863085 - protein, 9 aa, Homo Sapiens
LKEHIARKF

SEQ ID NO: 863086 - protein, 9 aa, Homo Sapiens
TEWNMFIDA

SEQ ID NO: 863087 - protein, 9 aa, Homo Sapiens
VWEVLTLTG

SEQ ID NO: 863088 - protein, 9 aa, Homo Sapiens
QINDIQEKC

SEQ ID NO: 863089 - protein, 9 aa, Homo Sapiens
KQFQYQNCI

SEQ ID NO: 863090 - protein, 9 aa, Homo Sapiens
EVSSKEIAI

SEQ ID NO: 863091 - protein, 9 aa, Homo Sapiens
EYGDKPHKC

SEQ ID NO: 863092 - protein, 9 aa, Homo Sapiens
RSFTNMSSM

SEQ ID NO: 863093 - protein, 9 aa, Homo Sapiens
GENVRELFF

SEQ ID NO: 863094 - protein, 9 aa, Homo Sapiens
SIFVLTCMS

SEQ ID NO: 863095 - protein, 9 aa, Homo Sapiens
IDVAGTDSG

SEQ ID NO: 863096 - protein, 9 aa, Homo Sapiens
TSIGDVINH

SEQ ID NO: 863097 - protein, 9 aa, Homo Sapiens
NQDGDIFRD

SEQ ID NO: 863098 - protein, 9 aa, Homo Sapiens
ESRRDSLSV

SEQ ID NO: 863099 - protein, 9 aa, Homo Sapiens
QSELQVLWV

SEQ ID NO: 863100 - protein, 9 aa, Homo Sapiens
KNVFITKKF

SEQ ID NO: 863101 - protein, 9 aa, Homo Sapiens
TQKFTHSRP

SEQ ID NO: 863102 - protein, 9 aa, Homo Sapiens
HQNTGPCLE

SEQ ID NO: 863103 - protein, 9 aa, Homo Sapiens
IKLNVREWL

SEQ ID NO: 863104 - protein, 9 aa, Homo Sapiens
ATKEESTVE

SEQ ID NO: 863105 - protein, 9 aa, Homo Sapiens
GPHNFYSHP

SEQ ID NO: 863106 - protein, 9 aa, Homo Sapiens
FKKAVKART

SEQ ID NO: 863107 - protein, 9 aa, Homo Sapiens
ETAFSKLSG

SEQ ID NO: 863108 - protein, 9 aa, Homo Sapiens
GANVIVTGG

SEQ ID NO: 863109 - protein, 9 aa, Homo Sapiens
LLKFITEKS

SEQ ID NO: 863110 - protein, 9 aa, Homo Sapiens
KKRKFPGVA

SEQ ID NO: 863111 - protein, 9 aa, Homo Sapiens
EKKLRIQSS

SEQ ID NO: 863112 - protein, 9 aa, Homo Sapiens
YSLFYHAHM

SEQ ID NO: 863113 - protein, 9 aa, Homo Sapiens
LAEYKILEG

SEQ ID NO: 863114 - protein, 9 aa, Homo Sapiens
ELKDRKEDV

SEQ ID NO: 863115 - protein, 9 aa, Homo Sapiens
SRGELMHSL

SEQ ID NO: 863116 - protein, 9 aa, Homo Sapiens
EQSVSATEK

SEQ ID NO: 863117 - protein, 9 aa, Homo Sapiens
RSIFLVTGQ

SEQ ID NO: 863118 - protein, 9 aa, Homo Sapiens
KYFFYIISP

SEQ ID NO: 863119 - protein, 9 aa, Homo Sapiens
VIGGLKLNA

SEQ ID NO: 863120 - protein, 9 aa, Homo Sapiens
PNVIVQFSC

SEQ ID NO: 863121 - protein, 9 aa, Homo Sapiens
RNLYTDVML

SEQ ID NO: 863122 - protein, 9 aa, Homo Sapiens
NYDITLYLV

SEQ ID NO: 863123 - protein, 9 aa, Homo Sapiens
LVQAGAWGF

SEQ ID NO: 863124 - protein, 9 aa, Homo Sapiens
EEVYSVLFG

SEQ ID NO: 863125 - protein, 9 aa, Homo Sapiens
EAFNVYLDI

SEQ ID NO: 863126 - protein, 9 aa, Homo Sapiens
QLRLNLYPK

SEQ ID NO: 863127 - protein, 9 aa, Homo Sapiens
KDVQMLQGA

SEQ ID NO: 863128 - protein, 9 aa, Homo Sapiens
VFTSVMCTV

SEQ ID NO: 863129 - protein, 9 aa, Homo Sapiens
VECFGGKEA

SEQ ID NO: 863130 - protein, 9 aa, Homo Sapiens
DKFYYTECL

SEQ ID NO: 863131 - protein, 9 aa, Homo Sapiens
YSEDNLLFW

SEQ ID NO: 863132 - protein, 9 aa, Homo Sapiens
AKHKGPPVL

SEQ ID NO: 863133 - protein, 9 aa, Homo Sapiens
YQKNNKDYH

SEQ ID NO: 863134 - protein, 9 aa, Homo Sapiens
RFGGWTSPL

SEQ ID NO: 863135 - protein, 9 aa, Homo Sapiens
QGLSMARME

SEQ ID NO: 863136 - protein, 9 aa, Homo Sapiens
EEERYAAEL

SEQ ID NO: 863137 - protein, 9 aa, Homo Sapiens
VNRWLNENY

SEQ ID NO: 863138 - protein, 9 aa, Homo Sapiens
WANQFRFST

SEQ ID NO: 863139 - protein, 9 aa, Homo Sapiens
STKGKALES

SEQ ID NO: 863140 - protein, 9 aa, Homo Sapiens
LWLVFDEYL

SEQ ID NO: 863141 - protein, 9 aa, Homo Sapiens
VSQIDAVCS

SEQ ID NO: 863142 - protein, 9 aa, Homo Sapiens
CDNCGGLDH

SEQ ID NO: 863143 - protein, 9 aa, Homo Sapiens
GACNNLPGS

SEQ ID NO: 863144 - protein, 9 aa, Homo Sapiens
GETLNINFL

SEQ ID NO: 863145 - protein, 9 aa, Homo Sapiens
VEKHLNSHM

SEQ ID NO: 863146 - protein, 9 aa, Homo Sapiens
KPSFGRKVM

SEQ ID NO: 863147 - protein, 9 aa, Homo Sapiens
PNGKVCWTS

SEQ ID NO: 863148 - protein, 9 aa, Homo Sapiens
ARMKIPDTL

SEQ ID NO: 863149 - protein, 9 aa, Homo Sapiens
YFELYEGPF

SEQ ID NO: 863150 - protein, 9 aa, Homo Sapiens
TQSSTLETT

SEQ ID NO: 863151 - protein, 9 aa, Homo Sapiens
IYSRHHSLS

SEQ ID NO: 863152 - protein, 9 aa, Homo Sapiens
SSPATIIDF

SEQ ID NO: 863153 - protein, 9 aa, Homo Sapiens
TPPPVATVP

SEQ ID NO: 863154 - protein, 9 aa, Homo Sapiens
NTNGVVYND

SEQ ID NO: 863155 - protein, 9 aa, Homo Sapiens
RFDLLVRTH

SEQ ID NO: 863156 - protein, 9 aa, Homo Sapiens
VLAIFWYDI

SEQ ID NO: 863157 - protein, 9 aa, Homo Sapiens
TNGADIDAL

SEQ ID NO: 863158 - protein, 9 aa, Homo Sapiens
DIKIDFPRA

SEQ ID NO: 863159 - protein, 9 aa, Homo Sapiens
LLLTTCGTL

SEQ ID NO: 863160 - protein, 9 aa, Homo Sapiens
EEINNMWAA

SEQ ID NO: 863161 - protein, 9 aa, Homo Sapiens
PCVQVLHQV

SEQ ID NO: 863162 - protein, 9 aa, Homo Sapiens
VGQFTSSSI

SEQ ID NO: 863163 - protein, 9 aa, Homo Sapiens
FELVMAAYD

SEQ ID NO: 863164 - protein, 9 aa, Homo Sapiens
GDLREAFRA

SEQ ID NO: 863165 - protein, 9 aa, Homo Sapiens
VALNNSGSC

SEQ ID NO: 863166 - protein, 9 aa, Homo Sapiens
DCGYAVISF

SEQ ID NO: 863167 - protein, 9 aa, Homo Sapiens
CEDKAIHHL

SEQ ID NO: 863168 - protein, 9 aa, Homo Sapiens
DGIVNELYE

SEQ ID NO: 863169 - protein, 9 aa, Homo Sapiens
QELRKCCDQ

SEQ ID NO: 863170 - protein, 9 aa, Homo Sapiens
TTIQYTCSP

SEQ ID NO: 863171 - protein, 9 aa, Homo Sapiens
KKEKGNGMK

SEQ ID NO: 863172 - protein, 9 aa, Homo Sapiens
HVKCKAFSS

SEQ ID NO: 863173 - protein, 9 aa, Homo Sapiens
LKRSGKLLN

SEQ ID NO: 863174 - protein, 9 aa, Homo Sapiens
GEEERCNMP

SEQ ID NO: 863175 - protein, 9 aa, Homo Sapiens
DQDLMTYLD

SEQ ID NO: 863176 - protein, 9 aa, Homo Sapiens
QFPAWRESQ

SEQ ID NO: 863177 - protein, 9 aa, Homo Sapiens
DRFSSRRPQ

SEQ ID NO: 863178 - protein, 9 aa, Homo Sapiens
LIRQQREAD

SEQ ID NO: 863179 - protein, 9 aa, Homo Sapiens
PSSRPQTLP

SEQ ID NO: 863180 - protein, 9 aa, Homo Sapiens
SERCKELTP

SEQ ID NO: 863181 - protein, 9 aa, Homo Sapiens
KAVVSGNAQ

SEQ ID NO: 863182 - protein, 9 aa, Homo Sapiens
STMSLPKPM

SEQ ID NO: 863183 - protein, 9 aa, Homo Sapiens
RGLALDGQL

SEQ ID NO: 863184 - protein, 9 aa, Homo Sapiens
QGSAGNPGE

SEQ ID NO: 863185 - protein, 9 aa, Homo Sapiens
MSPYLVSIW

SEQ ID NO: 863186 - protein, 9 aa, Homo Sapiens
NSHSQAPDK

SEQ ID NO: 863187 - protein, 9 aa, Homo Sapiens
LNRCLETKV

SEQ ID NO: 863188 - protein, 9 aa, Homo Sapiens
TFHAVKKHS

SEQ ID NO: 863189 - protein, 9 aa, Homo Sapiens
DGEINQEEL

SEQ ID NO: 863190 - protein, 9 aa, Homo Sapiens
SGTKNNFSS

SEQ ID NO: 863191 - protein, 9 aa, Homo Sapiens
MHFRQLLLH

SEQ ID NO: 863192 - protein, 9 aa, Homo Sapiens
NYQDAMEYS

SEQ ID NO: 863193 - protein, 9 aa, Homo Sapiens
GLSHLPTSS

SEQ ID NO: 863194 - protein, 9 aa, Homo Sapiens
IIEEQPQSP

SEQ ID NO: 863195 - protein, 9 aa, Homo Sapiens
YGKVLDCDI

SEQ ID NO: 863196 - protein, 9 aa, Homo Sapiens
HGVLLDALF

SEQ ID NO: 863197 - protein, 9 aa, Homo Sapiens
TQLDVESLM

SEQ ID NO: 863198 - protein, 9 aa, Homo Sapiens
YGIKLLETS

SEQ ID NO: 863199 - protein, 9 aa, Homo Sapiens
TAANYLLAC

SEQ ID NO: 863200 - protein, 9 aa, Homo Sapiens
AKSKGDQRR

SEQ ID NO: 863201 - protein, 9 aa, Homo Sapiens
AVFIKDGFF

SEQ ID NO: 863202 - protein, 9 aa, Homo Sapiens
NNLIDEHPV

SEQ ID NO: 863203 - protein, 9 aa, Homo Sapiens
QLSDVVEKL

SEQ ID NO: 863204 - protein, 9 aa, Homo Sapiens
KNCNLPRLC

SEQ ID NO: 863205 - protein, 9 aa, Homo Sapiens
DKPLDLSDQ

SEQ ID NO: 863206 - protein, 9 aa, Homo Sapiens
CAVSREHGS

SEQ ID NO: 863207 - protein, 9 aa, Homo Sapiens
SRASRAIKN

SEQ ID NO: 863208 - protein, 9 aa, Homo Sapiens
SSFNSKLAC

SEQ ID NO: 863209 - protein, 9 aa, Homo Sapiens
PEEKTLDCG

SEQ ID NO: 863210 - protein, 9 aa, Homo Sapiens
DSNVYALLK

SEQ ID NO: 863211 - protein, 9 aa, Homo Sapiens
YKKCVTQQQ

SEQ ID NO: 863212 - protein, 9 aa, Homo Sapiens
YSLNGHKFD

SEQ ID NO: 863213 - protein, 9 aa, Homo Sapiens
RLIDRIQIL

SEQ ID NO: 863214 - protein, 9 aa, Homo Sapiens
AAASTVFPI

SEQ ID NO: 863215 - protein, 9 aa, Homo Sapiens
CQYYDVMYL

SEQ ID NO: 863216 - protein, 9 aa, Homo Sapiens
KRGTGVHRL

SEQ ID NO: 863217 - protein, 9 aa, Homo Sapiens
VLGSVASMN

SEQ ID NO: 863218 - protein, 9 aa, Homo Sapiens
FTKLENKTI

SEQ ID NO: 863219 - protein, 9 aa, Homo Sapiens
IIRQLQEQH

SEQ ID NO: 863220 - protein, 9 aa, Homo Sapiens
FAKQVRAKK

SEQ ID NO: 863221 - protein, 9 aa, Homo Sapiens
AVLPGVAHG

SEQ ID NO: 863222 - protein, 9 aa, Homo Sapiens
PMLTHATTV

SEQ ID NO: 863223 - protein, 9 aa, Homo Sapiens
TSVMCTVMR

SEQ ID NO: 863224 - protein, 9 aa, Homo Sapiens
SRSNTACDG

SEQ ID NO: 863225 - protein, 9 aa, Homo Sapiens
GEIWDACAE

SEQ ID NO: 863226 - protein, 9 aa, Homo Sapiens
KQSRGMLLF

SEQ ID NO: 863227 - protein, 9 aa, Homo Sapiens
SILVNILLY

SEQ ID NO: 863228 - protein, 9 aa, Homo Sapiens
NNKFVPYRD

SEQ ID NO: 863229 - protein, 9 aa, Homo Sapiens
VIDHLSCDA

SEQ ID NO: 863230 - protein, 9 aa, Homo Sapiens
QRSKDPHSQ

SEQ ID NO: 863231 - protein, 9 aa, Homo Sapiens
VSEDSSVAQ

SEQ ID NO: 863232 - protein, 9 aa, Homo Sapiens
FFETSVTWT

SEQ ID NO: 863233 - protein, 9 aa, Homo Sapiens
EPQIDEKNK

SEQ ID NO: 863234 - protein, 9 aa, Homo Sapiens
YLPDHMSLW

SEQ ID NO: 863235 - protein, 9 aa, Homo Sapiens
NSSFQVASQ

SEQ ID NO: 863236 - protein, 9 aa, Homo Sapiens
ANYWAKRRT

SEQ ID NO: 863237 - protein, 9 aa, Homo Sapiens
HHLQQELER

SEQ ID NO: 863238 - protein, 9 aa, Homo Sapiens
VSNQKPGTD

SEQ ID NO: 863239 - protein, 9 aa, Homo Sapiens
LQRDTSYWL

SEQ ID NO: 863240 - protein, 9 aa, Homo Sapiens
SHIGSIINY

SEQ ID NO: 863241 - protein, 9 aa, Homo Sapiens
LGRLGLVDT

SEQ ID NO: 863242 - protein, 9 aa, Homo Sapiens
LRWKGYNCN

SEQ ID NO: 863243 - protein, 9 aa, Homo Sapiens
GIVTLDEFI

SEQ ID NO: 863244 - protein, 9 aa, Homo Sapiens
FLVIEDNKV

SEQ ID NO: 863245 - protein, 9 aa, Homo Sapiens
GNGNSFMVV

SEQ ID NO: 863246 - protein, 9 aa, Homo Sapiens
HNFQTTKDS

SEQ ID NO: 863247 - protein, 9 aa, Homo Sapiens
YLVSAHGEK

SEQ ID NO: 863248 - protein, 9 aa, Homo Sapiens
MHICSALMK

SEQ ID NO: 863249 - protein, 9 aa, Homo Sapiens
SNLGQHQII

SEQ ID NO: 863250 - protein, 9 aa, Homo Sapiens
DIEPKNSPE

SEQ ID NO: 863251 - protein, 9 aa, Homo Sapiens
ITGALQLYF

SEQ ID NO: 863252 - protein, 9 aa, Homo Sapiens
RDTLEALSS

SEQ ID NO: 863253 - protein, 9 aa, Homo Sapiens
PEPSAKHEY

SEQ ID NO: 863254 - protein, 9 aa, Homo Sapiens
ICSFHPSYD

SEQ ID NO: 863255 - protein, 9 aa, Homo Sapiens
EHEDISVIV

SEQ ID NO: 863256 - protein, 9 aa, Homo Sapiens
ARIRYFPVF

SEQ ID NO: 863257 - protein, 9 aa, Homo Sapiens
LATKDTPIK

SEQ ID NO: 863258 - protein, 9 aa, Homo Sapiens
GNDGKLGAT

SEQ ID NO: 863259 - protein, 9 aa, Homo Sapiens
HGFMLYQTY

SEQ ID NO: 863260 - protein, 9 aa, Homo Sapiens
PLVVEPTLT

SEQ ID NO: 863261 - protein, 9 aa, Homo Sapiens
DRESHQDNE

SEQ ID NO: 863262 - protein, 9 aa, Homo Sapiens
GQVGYRSPS

SEQ ID NO: 863263 - protein, 9 aa, Homo Sapiens
CLLELGNDQ

SEQ ID NO: 863264 - protein, 9 aa, Homo Sapiens
IKHVEEFSP

SEQ ID NO: 863265 - protein, 9 aa, Homo Sapiens
KLMRERNKN

SEQ ID NO: 863266 - protein, 9 aa, Homo Sapiens
KYLTDPSQE

SEQ ID NO: 863267 - protein, 9 aa, Homo Sapiens
HLLKLTCPG

SEQ ID NO: 863268 - protein, 9 aa, Homo Sapiens
KGPASNDPR

SEQ ID NO: 863269 - protein, 9 aa, Homo Sapiens
APGVADKKI

SEQ ID NO: 863270 - protein, 9 aa, Homo Sapiens
IEDISGQTG

SEQ ID NO: 863271 - protein, 9 aa, Homo Sapiens
FCDPQMCFD

SEQ ID NO: 863272 - protein, 9 aa, Homo Sapiens
KMCSKKEDS

SEQ ID NO: 863273 - protein, 9 aa, Homo Sapiens
VVMLGAWGV

SEQ ID NO: 863274 - protein, 9 aa, Homo Sapiens
ALDECASRS

SEQ ID NO: 863275 - protein, 9 aa, Homo Sapiens
HDEDRRFMC

SEQ ID NO: 863276 - protein, 9 aa, Homo Sapiens
QGFKPPGYE

SEQ ID NO: 863277 - protein, 9 aa, Homo Sapiens
YTVDKDICS

SEQ ID NO: 863278 - protein, 9 aa, Homo Sapiens
TVTTTQSHT

SEQ ID NO: 863279 - protein, 9 aa, Homo Sapiens
AINQMFQKE

SEQ ID NO: 863280 - protein, 9 aa, Homo Sapiens
SALMIRAED

SEQ ID NO: 863281 - protein, 9 aa, Homo Sapiens
PQCLLSGPT

SEQ ID NO: 863282 - protein, 9 aa, Homo Sapiens
VLVFPYTLL

SEQ ID NO: 863283 - protein, 9 aa, Homo Sapiens
YFKVRQLFF

SEQ ID NO: 863284 - protein, 9 aa, Homo Sapiens
CASDGKAYD

SEQ ID NO: 863285 - protein, 9 aa, Homo Sapiens
MEDYFQKVL

SEQ ID NO: 863286 - protein, 9 aa, Homo Sapiens
FIKEPSKTW

SEQ ID NO: 863287 - protein, 9 aa, Homo Sapiens
SDNVPTLRP

SEQ ID NO: 863288 - protein, 9 aa, Homo Sapiens
SRPGHVVVE

SEQ ID NO: 863289 - protein, 9 aa, Homo Sapiens
VLFYINMYV

SEQ ID NO: 863290 - protein, 9 aa, Homo Sapiens
ATNDDIFSI

SEQ ID NO: 863291 - protein, 9 aa, Homo Sapiens
LLGRLRLPL

SEQ ID NO: 863292 - protein, 9 aa, Homo Sapiens
SRGKPLPLL

SEQ ID NO: 863293 - protein, 9 aa, Homo Sapiens
SHVNPKKQT

SEQ ID NO: 863294 - protein, 9 aa, Homo Sapiens
NGKTFENFY

SEQ ID NO: 863295 - protein, 9 aa, Homo Sapiens
LSSEKSSWR

SEQ ID NO: 863296 - protein, 9 aa, Homo Sapiens
SKQNLVDCS

SEQ ID NO: 863297 - protein, 9 aa, Homo Sapiens
REELLSQVD

SEQ ID NO: 863298 - protein, 9 aa, Homo Sapiens
YHAKPAIAD

SEQ ID NO: 863299 - protein, 9 aa, Homo Sapiens
VTSHQCHHK

SEQ ID NO: 863300 - protein, 9 aa, Homo Sapiens
KRIPQIRIE

SEQ ID NO: 863301 - protein, 9 aa, Homo Sapiens
ELEKIFQEY

SEQ ID NO: 863302 - protein, 9 aa, Homo Sapiens
NLNNAVSIN

SEQ ID NO: 863303 - protein, 9 aa, Homo Sapiens
AANTSGNAL

SEQ ID NO: 863304 - protein, 9 aa, Homo Sapiens
LFCEVPALL

SEQ ID NO: 863305 - protein, 9 aa, Homo Sapiens
RTSMQGAVA

SEQ ID NO: 863306 - protein, 9 aa, Homo Sapiens
QYVYGSGKT

SEQ ID NO: 863307 - protein, 9 aa, Homo Sapiens
VEGKTNALL

SEQ ID NO: 863308 - protein, 9 aa, Homo Sapiens
DLTRQKAKL

SEQ ID NO: 863309 - protein, 9 aa, Homo Sapiens
RSHTAEQPY

SEQ ID NO: 863310 - protein, 9 aa, Homo Sapiens
IHLWEAGKE

SEQ ID NO: 863311 - protein, 9 aa, Homo Sapiens
HNIFWSSLM

SEQ ID NO: 863312 - protein, 9 aa, Homo Sapiens
LGIFSYDKT

SEQ ID NO: 863313 - protein, 9 aa, Homo Sapiens
DIEELKLME

SEQ ID NO: 863314 - protein, 9 aa, Homo Sapiens
IDLRQDHPA

SEQ ID NO: 863315 - protein, 9 aa, Homo Sapiens
PLFDPTGTI

SEQ ID NO: 863316 - protein, 9 aa, Homo Sapiens
LRWFSMYDQ

SEQ ID NO: 863317 - protein, 9 aa, Homo Sapiens
IPQHFCKLR

SEQ ID NO: 863318 - protein, 9 aa, Homo Sapiens
SSEDREPLS

SEQ ID NO: 863319 - protein, 9 aa, Homo Sapiens
LQETCYWDS

SEQ ID NO: 863320 - protein, 9 aa, Homo Sapiens
QKRLGRNKK

SEQ ID NO: 863321 - protein, 9 aa, Homo Sapiens
GLSAACHGN

SEQ ID NO: 863322 - protein, 9 aa, Homo Sapiens
ITIEPLYQR

SEQ ID NO: 863323 - protein, 9 aa, Homo Sapiens
KATEEVGEA

SEQ ID NO: 863324 - protein, 9 aa, Homo Sapiens
SFWSSILFN

SEQ ID NO: 863325 - protein, 9 aa, Homo Sapiens
LSCDTGLES

SEQ ID NO: 863326 - protein, 9 aa, Homo Sapiens
WECVGQEVL

SEQ ID NO: 863327 - protein, 9 aa, Homo Sapiens
FPGPQGKKR

SEQ ID NO: 863328 - protein, 9 aa, Homo Sapiens
QYSYGSSSG

SEQ ID NO: 863329 - protein, 9 aa, Homo Sapiens
EDGEEDNQK

SEQ ID NO: 863330 - protein, 9 aa, Homo Sapiens
PGAALGQML

SEQ ID NO: 863331 - protein, 9 aa, Homo Sapiens
KTVESITYI

SEQ ID NO: 863332 - protein, 9 aa, Homo Sapiens
MTIHQLLLL

SEQ ID NO: 863333 - protein, 9 aa, Homo Sapiens
GANEYNNGY

SEQ ID NO: 863334 - protein, 9 aa, Homo Sapiens
QHLKGLNSP

SEQ ID NO: 863335 - protein, 9 aa, Homo Sapiens
EGFGKTTAI

SEQ ID NO: 863336 - protein, 9 aa, Homo Sapiens
VAHMMPNIL

SEQ ID NO: 863337 - protein, 9 aa, Homo Sapiens
KRKDGKTTQ

SEQ ID NO: 863338 - protein, 9 aa, Homo Sapiens
KTMPHINDC

SEQ ID NO: 863339 - protein, 9 aa, Homo Sapiens
KEGLMLKNC

SEQ ID NO: 863340 - protein, 9 aa, Homo Sapiens
LGGPPVSKA

SEQ ID NO: 863341 - protein, 9 aa, Homo Sapiens
NCAENSRLV

SEQ ID NO: 863342 - protein, 9 aa, Homo Sapiens
SYFRYYLMD

SEQ ID NO: 863343 - protein, 9 aa, Homo Sapiens
LHFEMPASK

SEQ ID NO: 863344 - protein, 9 aa, Homo Sapiens
YDLTRIKTE

SEQ ID NO: 863345 - protein, 9 aa, Homo Sapiens
SKLTQHQII

SEQ ID NO: 863346 - protein, 9 aa, Homo Sapiens
KYPPKSHPY

SEQ ID NO: 863347 - protein, 9 aa, Homo Sapiens
RLMLPKEAG

SEQ ID NO: 863348 - protein, 9 aa, Homo Sapiens
PIQRQSDTV

SEQ ID NO: 863349 - protein, 9 aa, Homo Sapiens
SIRNQLRYI

SEQ ID NO: 863350 - protein, 9 aa, Homo Sapiens
QDDDDIQGR

SEQ ID NO: 863351 - protein, 9 aa, Homo Sapiens
SEHREESYP

SEQ ID NO: 863352 - protein, 9 aa, Homo Sapiens
EELICQRLM

SEQ ID NO: 863353 - protein, 9 aa, Homo Sapiens
KAKAEGRWN

SEQ ID NO: 863354 - protein, 9 aa, Homo Sapiens
LREKYFFPG

SEQ ID NO: 863355 - protein, 9 aa, Homo Sapiens
VELHWRLMA

SEQ ID NO: 863356 - protein, 9 aa, Homo Sapiens
SVSGICIKI

SEQ ID NO: 863357 - protein, 9 aa, Homo Sapiens
SNTVIDQMK

SEQ ID NO: 863358 - protein, 9 aa, Homo Sapiens
NKNYVLNTA

SEQ ID NO: 863359 - protein, 9 aa, Homo Sapiens
SKAPLYGQM

SEQ ID NO: 863360 - protein, 9 aa, Homo Sapiens
AAKHEIKAA

SEQ ID NO: 863361 - protein, 9 aa, Homo Sapiens
GLCYERQIS

SEQ ID NO: 863362 - protein, 9 aa, Homo Sapiens
QPPEPPPSW

SEQ ID NO: 863363 - protein, 9 aa, Homo Sapiens
PRKYIIEIV

SEQ ID NO: 863364 - protein, 9 aa, Homo Sapiens
QSQDGAFCY

SEQ ID NO: 863365 - protein, 9 aa, Homo Sapiens
LKKKLWSSV

SEQ ID NO: 863366 - protein, 9 aa, Homo Sapiens
GRVDNLFRS

SEQ ID NO: 863367 - protein, 9 aa, Homo Sapiens
LIQTIQGAH

SEQ ID NO: 863368 - protein, 9 aa, Homo Sapiens
SNYSMELQV

SEQ ID NO: 863369 - protein, 9 aa, Homo Sapiens
PREPELLYP

SEQ ID NO: 863370 - protein, 9 aa, Homo Sapiens
LVECYMYRI

SEQ ID NO: 863371 - protein, 9 aa, Homo Sapiens
PLCWLFLNI

SEQ ID NO: 863372 - protein, 9 aa, Homo Sapiens
LCCAIQNSR

SEQ ID NO: 863373 - protein, 9 aa, Homo Sapiens
LSNPVGQMS

SEQ ID NO: 863374 - protein, 9 aa, Homo Sapiens
VPLTNLTDN

SEQ ID NO: 863375 - protein, 9 aa, Homo Sapiens
AAAAVVHKE

SEQ ID NO: 863376 - protein, 9 aa, Homo Sapiens
CIKGRSFTL

SEQ ID NO: 863377 - protein, 9 aa, Homo Sapiens
KFQLQSDLV

SEQ ID NO: 863378 - protein, 9 aa, Homo Sapiens
SLLLLPALN

SEQ ID NO: 863379 - protein, 9 aa, Homo Sapiens
CRDEFLLPK

SEQ ID NO: 863380 - protein, 9 aa, Homo Sapiens
YSLFLLSVL

SEQ ID NO: 863381 - protein, 9 aa, Homo Sapiens
EPQLRPNKM

SEQ ID NO: 863382 - protein, 9 aa, Homo Sapiens
RTVLDNLGN

SEQ ID NO: 863383 - protein, 9 aa, Homo Sapiens
NPIAQSLAS

SEQ ID NO: 863384 - protein, 9 aa, Homo Sapiens
ETERLFGKI

SEQ ID NO: 863385 - protein, 9 aa, Homo Sapiens
DSDLLGWWL

SEQ ID NO: 863386 - protein, 9 aa, Homo Sapiens
ALHILASLF

SEQ ID NO: 863387 - protein, 9 aa, Homo Sapiens
LDNYSHLIS

SEQ ID NO: 863388 - protein, 9 aa, Homo Sapiens
VGTAEEFTY

SEQ ID NO: 863389 - protein, 9 aa, Homo Sapiens
EDKIITYED

SEQ ID NO: 863390 - protein, 9 aa, Homo Sapiens
CVIRNTNFC

SEQ ID NO: 863391 - protein, 9 aa, Homo Sapiens
MSKPNMISL

SEQ ID NO: 863392 - protein, 9 aa, Homo Sapiens
AENQQSQSS

SEQ ID NO: 863393 - protein, 9 aa, Homo Sapiens
RAEIDNLHR

SEQ ID NO: 863394 - protein, 9 aa, Homo Sapiens
LFHSSNVIG

SEQ ID NO: 863395 - protein, 9 aa, Homo Sapiens
ASGATYVIY

SEQ ID NO: 863396 - protein, 9 aa, Homo Sapiens
FKQLLWGPA

SEQ ID NO: 863397 - protein, 9 aa, Homo Sapiens
PGFPTSCET

SEQ ID NO: 863398 - protein, 9 aa, Homo Sapiens
FILYQNRVP

SEQ ID NO: 863399 - protein, 9 aa, Homo Sapiens
FKFRVGASD

SEQ ID NO: 863400 - protein, 9 aa, Homo Sapiens
DLQWLKLII

SEQ ID NO: 863401 - protein, 9 aa, Homo Sapiens
DFPALRKNT

SEQ ID NO: 863402 - protein, 9 aa, Homo Sapiens
GIEAPLQQK

SEQ ID NO: 863403 - protein, 9 aa, Homo Sapiens
VKQQNTIKY

SEQ ID NO: 863404 - protein, 9 aa, Homo Sapiens
TAGFFIAFL

SEQ ID NO: 863405 - protein, 9 aa, Homo Sapiens
DIYIPEAQT

SEQ ID NO: 863406 - protein, 9 aa, Homo Sapiens
TQHYPAFTR

SEQ ID NO: 863407 - protein, 9 aa, Homo Sapiens
LDIKIDFPR

SEQ ID NO: 863408 - protein, 9 aa, Homo Sapiens
GNHWFVLSV

SEQ ID NO: 863409 - protein, 9 aa, Homo Sapiens
EYNEVEIEV

SEQ ID NO: 863410 - protein, 9 aa, Homo Sapiens
LLNRARKLH

SEQ ID NO: 863411 - protein, 9 aa, Homo Sapiens
GVASTRHDM

SEQ ID NO: 863412 - protein, 9 aa, Homo Sapiens
KVLLNIRCE

SEQ ID NO: 863413 - protein, 9 aa, Homo Sapiens
VDTLASHSF

SEQ ID NO: 863414 - protein, 9 aa, Homo Sapiens
HSKYKIIYT

SEQ ID NO: 863415 - protein, 9 aa, Homo Sapiens
CMSACQHMS

SEQ ID NO: 863416 - protein, 9 aa, Homo Sapiens
ALAQASAVN

SEQ ID NO: 863417 - protein, 9 aa, Homo Sapiens
RVTLGITTV

SEQ ID NO: 863418 - protein, 9 aa, Homo Sapiens
VASTRHDMG

SEQ ID NO: 863419 - protein, 9 aa, Homo Sapiens
CESEINSLK

SEQ ID NO: 863420 - protein, 9 aa, Homo Sapiens
YPSGAHDTL

SEQ ID NO: 863421 - protein, 9 aa, Homo Sapiens
QPYEAAHMF

SEQ ID NO: 863422 - protein, 9 aa, Homo Sapiens
NMSWAKPVD

SEQ ID NO: 863423 - protein, 9 aa, Homo Sapiens
TNQNVIIIQ

SEQ ID NO: 863424 - protein, 9 aa, Homo Sapiens
MSFWSSILF

SEQ ID NO: 863425 - protein, 9 aa, Homo Sapiens
ECGKAFSDL

SEQ ID NO: 863426 - protein, 9 aa, Homo Sapiens
NMKKTALVV

SEQ ID NO: 863427 - protein, 9 aa, Homo Sapiens
DEMRCQCEM

SEQ ID NO: 863428 - protein, 9 aa, Homo Sapiens
TEKLRRSQS

SEQ ID NO: 863429 - protein, 9 aa, Homo Sapiens
QDGPKAGQT

SEQ ID NO: 863430 - protein, 9 aa, Homo Sapiens
NTSQERDRG

SEQ ID NO: 863431 - protein, 9 aa, Homo Sapiens
ADTAATRAV

SEQ ID NO: 863432 - protein, 9 aa, Homo Sapiens
LPLGATGLP

SEQ ID NO: 863433 - protein, 9 aa, Homo Sapiens
NNTFPPSLQ

SEQ ID NO: 863434 - protein, 9 aa, Homo Sapiens
GKKLPEASD

SEQ ID NO: 863435 - protein, 9 aa, Homo Sapiens
KMVESVFWN

SEQ ID NO: 863436 - protein, 9 aa, Homo Sapiens
CSFNVSQGR

SEQ ID NO: 863437 - protein, 9 aa, Homo Sapiens
NVLEIMKEW

SEQ ID NO: 863438 - protein, 9 aa, Homo Sapiens
DVVDARPLI

SEQ ID NO: 863439 - protein, 9 aa, Homo Sapiens
WYIRSLQEL

SEQ ID NO: 863440 - protein, 9 aa, Homo Sapiens
YNKFYEAFS

SEQ ID NO: 863441 - protein, 9 aa, Homo Sapiens
NYHDKTGEI

SEQ ID NO: 863442 - protein, 9 aa, Homo Sapiens
SSQMVLLPS

SEQ ID NO: 863443 - protein, 9 aa, Homo Sapiens
VVLYAPPLA

SEQ ID NO: 863444 - protein, 9 aa, Homo Sapiens
LSSGSRDTT

SEQ ID NO: 863445 - protein, 9 aa, Homo Sapiens
IQTIQGAHA

SEQ ID NO: 863446 - protein, 9 aa, Homo Sapiens
SPFCVQHMD

SEQ ID NO: 863447 - protein, 9 aa, Homo Sapiens
HIMKSADVD

SEQ ID NO: 863448 - protein, 9 aa, Homo Sapiens
KPVLHRASP

SEQ ID NO: 863449 - protein, 9 aa, Homo Sapiens
GFSVDYDNT

SEQ ID NO: 863450 - protein, 9 aa, Homo Sapiens
PTFRSSYWR

SEQ ID NO: 863451 - protein, 9 aa, Homo Sapiens
KQLIDKETD

SEQ ID NO: 863452 - protein, 9 aa, Homo Sapiens
RIVGPVEHG

SEQ ID NO: 863453 - protein, 9 aa, Homo Sapiens
FAGCGGRHL

SEQ ID NO: 863454 - protein, 9 aa, Homo Sapiens
IGGDGNNIL

SEQ ID NO: 863455 - protein, 9 aa, Homo Sapiens
EASFQTEVS

SEQ ID NO: 863456 - protein, 9 aa, Homo Sapiens
LGLSDHPHM

SEQ ID NO: 863457 - protein, 9 aa, Homo Sapiens
CLKCAEYNS

SEQ ID NO: 863458 - protein, 9 aa, Homo Sapiens
DTLGEAWAA

SEQ ID NO: 863459 - protein, 9 aa, Homo Sapiens
NYIKKNGED

SEQ ID NO: 863460 - protein, 9 aa, Homo Sapiens
ALCQEISTF

SEQ ID NO: 863461 - protein, 9 aa, Homo Sapiens
MRIHKEVKP

SEQ ID NO: 863462 - protein, 9 aa, Homo Sapiens
AVAQDVFNP

SEQ ID NO: 863463 - protein, 9 aa, Homo Sapiens
TLILHKIIH

SEQ ID NO: 863464 - protein, 9 aa, Homo Sapiens
GYTKEFFRR

SEQ ID NO: 863465 - protein, 9 aa, Homo Sapiens
VALLMGVAL

SEQ ID NO: 863466 - protein, 9 aa, Homo Sapiens
LLSSEKSSW

SEQ ID NO: 863467 - protein, 9 aa, Homo Sapiens
QNQNYMNIL

SEQ ID NO: 863468 - protein, 9 aa, Homo Sapiens
NFDVARPKL

SEQ ID NO: 863469 - protein, 9 aa, Homo Sapiens
MRLICEGKN

SEQ ID NO: 863470 - protein, 9 aa, Homo Sapiens
PNLGKKPSK

SEQ ID NO: 863471 - protein, 9 aa, Homo Sapiens
RPFSDPFQL

SEQ ID NO: 863472 - protein, 9 aa, Homo Sapiens
NVFITKKFP

SEQ ID NO: 863473 - protein, 9 aa, Homo Sapiens
PRPNPPTFV

SEQ ID NO: 863474 - protein, 9 aa, Homo Sapiens
NQTGLKLIA

SEQ ID NO: 863475 - protein, 9 aa, Homo Sapiens
TSFGTGNYC

SEQ ID NO: 863476 - protein, 9 aa, Homo Sapiens
ASYNQIFSS

SEQ ID NO: 863477 - protein, 9 aa, Homo Sapiens
KREEKLCKR

SEQ ID NO: 863478 - protein, 9 aa, Homo Sapiens
MSQSVGSPN

SEQ ID NO: 863479 - protein, 9 aa, Homo Sapiens
GIQSELFIN

SEQ ID NO: 863480 - protein, 9 aa, Homo Sapiens
RLHFALKSL

SEQ ID NO: 863481 - protein, 9 aa, Homo Sapiens
MLCYTPNYV

SEQ ID NO: 863482 - protein, 9 aa, Homo Sapiens
LKSYLRKNS

SEQ ID NO: 863483 - protein, 9 aa, Homo Sapiens
ISKISLAIY

SEQ ID NO: 863484 - protein, 9 aa, Homo Sapiens
DAELIMFIH

SEQ ID NO: 863485 - protein, 9 aa, Homo Sapiens
HKAKPQNDW

SEQ ID NO: 863486 - protein, 9 aa, Homo Sapiens
KVHSIVRLV

SEQ ID NO: 863487 - protein, 9 aa, Homo Sapiens
ELGFHGQTG

SEQ ID NO: 863488 - protein, 9 aa, Homo Sapiens
VQGQWGTVC

SEQ ID NO: 863489 - protein, 9 aa, Homo Sapiens
RFKDLRFQE

SEQ ID NO: 863490 - protein, 9 aa, Homo Sapiens
SWAIGEEHF

SEQ ID NO: 863491 - protein, 9 aa, Homo Sapiens
HHCYIIPKA

SEQ ID NO: 863492 - protein, 9 aa, Homo Sapiens
NAHTTEKPT

SEQ ID NO: 863493 - protein, 9 aa, Homo Sapiens
IVHQGTHTG

SEQ ID NO: 863494 - protein, 9 aa, Homo Sapiens
HLPKMAEKD

SEQ ID NO: 863495 - protein, 9 aa, Homo Sapiens
SSTDNPKHS

SEQ ID NO: 863496 - protein, 9 aa, Homo Sapiens
SAVNNTKPG

SEQ ID NO: 863497 - protein, 9 aa, Homo Sapiens
GNKIIAYNA

SEQ ID NO: 863498 - protein, 9 aa, Homo Sapiens
MTKPTTIIK

SEQ ID NO: 863499 - protein, 9 aa, Homo Sapiens
DYFLCDIPA

SEQ ID NO: 863500 - protein, 9 aa, Homo Sapiens
IHLRLHTGE

SEQ ID NO: 863501 - protein, 9 aa, Homo Sapiens
EIKLKMNYR

SEQ ID NO: 863502 - protein, 9 aa, Homo Sapiens
TNKDVQKRR

SEQ ID NO: 863503 - protein, 9 aa, Homo Sapiens
THCFIDYPE

SEQ ID NO: 863504 - protein, 9 aa, Homo Sapiens
GTEAVNKSL

SEQ ID NO: 863505 - protein, 9 aa, Homo Sapiens
LTDSNLQNI

SEQ ID NO: 863506 - protein, 9 aa, Homo Sapiens
SKKASPKAA

SEQ ID NO: 863507 - protein, 9 aa, Homo Sapiens
LTGRDVLTP

SEQ ID NO: 863508 - protein, 9 aa, Homo Sapiens
ELDPLHPDA

SEQ ID NO: 863509 - protein, 9 aa, Homo Sapiens
PSRIDHFMK

SEQ ID NO: 863510 - protein, 9 aa, Homo Sapiens
TSNHVVRNS

SEQ ID NO: 863511 - protein, 9 aa, Homo Sapiens
LLVRTHNSW

SEQ ID NO: 863512 - protein, 9 aa, Homo Sapiens
TVGKHYRDF

SEQ ID NO: 863513 - protein, 9 aa, Homo Sapiens
KFPNHYSIV

SEQ ID NO: 863514 - protein, 9 aa, Homo Sapiens
LWDHTQCRK

SEQ ID NO: 863515 - protein, 9 aa, Homo Sapiens
LKGLHRQPG

SEQ ID NO: 863516 - protein, 9 aa, Homo Sapiens
VVNLGGLSI

SEQ ID NO: 863517 - protein, 9 aa, Homo Sapiens
VMTSSGLCQ

SEQ ID NO: 863518 - protein, 9 aa, Homo Sapiens
AHIVQIPLP

SEQ ID NO: 863519 - protein, 9 aa, Homo Sapiens
KDERASLQY

SEQ ID NO: 863520 - protein, 9 aa, Homo Sapiens
KPDEKAKVP

SEQ ID NO: 863521 - protein, 9 aa, Homo Sapiens
TISKVILSI

SEQ ID NO: 863522 - protein, 9 aa, Homo Sapiens
FVRDNNSPA

SEQ ID NO: 863523 - protein, 9 aa, Homo Sapiens
LYLVKLESK

SEQ ID NO: 863524 - protein, 9 aa, Homo Sapiens
CLSAQGDSL

SEQ ID NO: 863525 - protein, 9 aa, Homo Sapiens
EILSNWGNL

SEQ ID NO: 863526 - protein, 9 aa, Homo Sapiens
LVSLFLHYL

SEQ ID NO: 863527 - protein, 9 aa, Homo Sapiens
TKSFTPKTN

SEQ ID NO: 863528 - protein, 9 aa, Homo Sapiens
KCDEIYGTL

SEQ ID NO: 863529 - protein, 9 aa, Homo Sapiens
DETIQSKKE

SEQ ID NO: 863530 - protein, 9 aa, Homo Sapiens
KRWIIPASQ

SEQ ID NO: 863531 - protein, 9 aa, Homo Sapiens
VEQHNRKVQ

SEQ ID NO: 863532 - protein, 9 aa, Homo Sapiens
KINSVINCF

SEQ ID NO: 863533 - protein, 9 aa, Homo Sapiens
MYHLGTQCP

SEQ ID NO: 863534 - protein, 9 aa, Homo Sapiens
DESWIQKYD

SEQ ID NO: 863535 - protein, 9 aa, Homo Sapiens
APQIPSYRL

SEQ ID NO: 863536 - protein, 9 aa, Homo Sapiens
VQIGIIDGE

SEQ ID NO: 863537 - protein, 9 aa, Homo Sapiens
EPICKQNFD

SEQ ID NO: 863538 - protein, 9 aa, Homo Sapiens
DQSDSAKES

SEQ ID NO: 863539 - protein, 9 aa, Homo Sapiens
GVKFMVEME

SEQ ID NO: 863540 - protein, 9 aa, Homo Sapiens
HGYPNDTVY

SEQ ID NO: 863541 - protein, 9 aa, Homo Sapiens
KWIAYYSEV

SEQ ID NO: 863542 - protein, 9 aa, Homo Sapiens
SSSTGISYL

SEQ ID NO: 863543 - protein, 9 aa, Homo Sapiens
RVLGQAPPK

SEQ ID NO: 863544 - protein, 9 aa, Homo Sapiens
SVRLDDNFV

SEQ ID NO: 863545 - protein, 9 aa, Homo Sapiens
IDKAQNFRT

SEQ ID NO: 863546 - protein, 9 aa, Homo Sapiens
KLELGGDSH

SEQ ID NO: 863547 - protein, 9 aa, Homo Sapiens
ARFFCELPS

SEQ ID NO: 863548 - protein, 9 aa, Homo Sapiens
SETVNSVTT

SEQ ID NO: 863549 - protein, 9 aa, Homo Sapiens
GMKNGKFVI

SEQ ID NO: 863550 - protein, 9 aa, Homo Sapiens
QQQNEILVK

SEQ ID NO: 863551 - protein, 9 aa, Homo Sapiens
YRLVVLHTF

SEQ ID NO: 863552 - protein, 9 aa, Homo Sapiens
YHTEVAYGP

SEQ ID NO: 863553 - protein, 9 aa, Homo Sapiens
PALIVSERN

SEQ ID NO: 863554 - protein, 9 aa, Homo Sapiens
KLCSKLRHL

SEQ ID NO: 863555 - protein, 9 aa, Homo Sapiens
VLEKTYPYV

SEQ ID NO: 863556 - protein, 9 aa, Homo Sapiens
YLGAGDRQL

SEQ ID NO: 863557 - protein, 9 aa, Homo Sapiens
QGILFPDSK

SEQ ID NO: 863558 - protein, 9 aa, Homo Sapiens
ELTDLAERT

SEQ ID NO: 863559 - protein, 9 aa, Homo Sapiens
FHGNCSNTT

SEQ ID NO: 863560 - protein, 9 aa, Homo Sapiens
EWIANCQRQ

SEQ ID NO: 863561 - protein, 9 aa, Homo Sapiens
RKRVLEIKR

SEQ ID NO: 863562 - protein, 9 aa, Homo Sapiens
SKQVKEYQI

SEQ ID NO: 863563 - protein, 9 aa, Homo Sapiens
LAEGCLLNL

SEQ ID NO: 863564 - protein, 9 aa, Homo Sapiens
PPEKGSHMP

SEQ ID NO: 863565 - protein, 9 aa, Homo Sapiens
LFINTTRAG

SEQ ID NO: 863566 - protein, 9 aa, Homo Sapiens
PGSFVENDM

SEQ ID NO: 863567 - protein, 9 aa, Homo Sapiens
QIIDKSQLD

SEQ ID NO: 863568 - protein, 9 aa, Homo Sapiens
ILNLEELKA

SEQ ID NO: 863569 - protein, 9 aa, Homo Sapiens
IEHNARKFN

SEQ ID NO: 863570 - protein, 9 aa, Homo Sapiens
QMNLLAVLK

SEQ ID NO: 863571 - protein, 9 aa, Homo Sapiens
NKLLEPNSF

SEQ ID NO: 863572 - protein, 9 aa, Homo Sapiens
DDNFVRGHL

SEQ ID NO: 863573 - protein, 9 aa, Homo Sapiens
RTFPEMQRR

SEQ ID NO: 863574 - protein, 9 aa, Homo Sapiens
DIFGNTFEQ

SEQ ID NO: 863575 - protein, 9 aa, Homo Sapiens
NKMKTLNRK

SEQ ID NO: 863576 - protein, 9 aa, Homo Sapiens
HDIFKANDL

SEQ ID NO: 863577 - protein, 9 aa, Homo Sapiens
KGNGSNGYS

SEQ ID NO: 863578 - protein, 9 aa, Homo Sapiens
VGEIFEDSF

SEQ ID NO: 863579 - protein, 9 aa, Homo Sapiens
AEKTSYSLA

SEQ ID NO: 863580 - protein, 9 aa, Homo Sapiens
SLHYRFARI

SEQ ID NO: 863581 - protein, 9 aa, Homo Sapiens
IYVGELLRK

SEQ ID NO: 863582 - protein, 9 aa, Homo Sapiens
LATQPKGPM

SEQ ID NO: 863583 - protein, 9 aa, Homo Sapiens
AQLKKEANK

SEQ ID NO: 863584 - protein, 9 aa, Homo Sapiens
SFKNKTRNE

SEQ ID NO: 863585 - protein, 9 aa, Homo Sapiens
FPYCQSHVL

SEQ ID NO: 863586 - protein, 9 aa, Homo Sapiens
FSSPGNLQR

SEQ ID NO: 863587 - protein, 9 aa, Homo Sapiens
TCYCNSVIQ

SEQ ID NO: 863588 - protein, 9 aa, Homo Sapiens
AACSSQPEH

SEQ ID NO: 863589 - protein, 9 aa, Homo Sapiens
CYLFSHCST

SEQ ID NO: 863590 - protein, 9 aa, Homo Sapiens
LLGFYNYPE

SEQ ID NO: 863591 - protein, 9 aa, Homo Sapiens
TQCNNMATK

SEQ ID NO: 863592 - protein, 9 aa, Homo Sapiens
YYKIKRTKQ

SEQ ID NO: 863593 - protein, 9 aa, Homo Sapiens
MSPPLGLGN

SEQ ID NO: 863594 - protein, 9 aa, Homo Sapiens
RSSHIPPWT

SEQ ID NO: 863595 - protein, 9 aa, Homo Sapiens
RQNQNYMNI

SEQ ID NO: 863596 - protein, 9 aa, Homo Sapiens
RPKLTDIVS

SEQ ID NO: 863597 - protein, 9 aa, Homo Sapiens
LPCWDAAKY

SEQ ID NO: 863598 - protein, 9 aa, Homo Sapiens
SATGNWLSA

SEQ ID NO: 863599 - protein, 9 aa, Homo Sapiens
QWKSANFSG

SEQ ID NO: 863600 - protein, 9 aa, Homo Sapiens
LCPFYLIHL

SEQ ID NO: 863601 - protein, 9 aa, Homo Sapiens
TERLQIVGF

SEQ ID NO: 863602 - protein, 9 aa, Homo Sapiens
LEESCVEAQ

SEQ ID NO: 863603 - protein, 9 aa, Homo Sapiens
VGLILPLCW

SEQ ID NO: 863604 - protein, 9 aa, Homo Sapiens
DPAGPCFQL

SEQ ID NO: 863605 - protein, 9 aa, Homo Sapiens
GVIYVVYST

SEQ ID NO: 863606 - protein, 9 aa, Homo Sapiens
YQYFENFYT

SEQ ID NO: 863607 - protein, 9 aa, Homo Sapiens
EGNLEFRAL

SEQ ID NO: 863608 - protein, 9 aa, Homo Sapiens
MPLLEGYVG

SEQ ID NO: 863609 - protein, 9 aa, Homo Sapiens
IFRDSATAL

SEQ ID NO: 863610 - protein, 9 aa, Homo Sapiens
DDRIIRTYW

SEQ ID NO: 863611 - protein, 9 aa, Homo Sapiens
PFTRLGQSH

SEQ ID NO: 863612 - protein, 9 aa, Homo Sapiens
IDSTFLNVA

SEQ ID NO: 863613 - protein, 9 aa, Homo Sapiens
IFSSTGDAG

SEQ ID NO: 863614 - protein, 9 aa, Homo Sapiens
GLYNSGDGH

SEQ ID NO: 863615 - protein, 9 aa, Homo Sapiens
NTTFLNIKH

SEQ ID NO: 863616 - protein, 9 aa, Homo Sapiens
KCKAARKQD

SEQ ID NO: 863617 - protein, 9 aa, Homo Sapiens
QQILLLRNN

SEQ ID NO: 863618 - protein, 9 aa, Homo Sapiens
HFVPIVAEE

SEQ ID NO: 863619 - protein, 9 aa, Homo Sapiens
EEEYNEVEI

SEQ ID NO: 863620 - protein, 9 aa, Homo Sapiens
ASERDTHKL

SEQ ID NO: 863621 - protein, 9 aa, Homo Sapiens
MPCWVPQVL

SEQ ID NO: 863622 - protein, 9 aa, Homo Sapiens
GTTIQYTCS

SEQ ID NO: 863623 - protein, 9 aa, Homo Sapiens
LVLEAATFL

SEQ ID NO: 863624 - protein, 9 aa, Homo Sapiens
ANLTRVETF

SEQ ID NO: 863625 - protein, 9 aa, Homo Sapiens
TDPNRSCQI

SEQ ID NO: 863626 - protein, 9 aa, Homo Sapiens
KRLTYSNLK

SEQ ID NO: 863627 - protein, 9 aa, Homo Sapiens
NKPYYDEAQ

SEQ ID NO: 863628 - protein, 9 aa, Homo Sapiens
VDGIWLLGT

SEQ ID NO: 863629 - protein, 9 aa, Homo Sapiens
KTMHRTQMK

SEQ ID NO: 863630 - protein, 9 aa, Homo Sapiens
IQKMKKIDK

SEQ ID NO: 863631 - protein, 9 aa, Homo Sapiens
HLVDEDTTS

SEQ ID NO: 863632 - protein, 9 aa, Homo Sapiens
LSPRNTYSD

SEQ ID NO: 863633 - protein, 9 aa, Homo Sapiens
ADHLKVLID

SEQ ID NO: 863634 - protein, 9 aa, Homo Sapiens
KTYGNYYWL

SEQ ID NO: 863635 - protein, 9 aa, Homo Sapiens
STLILHKII

SEQ ID NO: 863636 - protein, 9 aa, Homo Sapiens
PYTCKTVEK

SEQ ID NO: 863637 - protein, 9 aa, Homo Sapiens
SFNFNSQNG

SEQ ID NO: 863638 - protein, 9 aa, Homo Sapiens
KSNDLLYQY

SEQ ID NO: 863639 - protein, 9 aa, Homo Sapiens
DQQLLTRVL

SEQ ID NO: 863640 - protein, 9 aa, Homo Sapiens
PFMPIAPTG

SEQ ID NO: 863641 - protein, 9 aa, Homo Sapiens
NVISQPDEF

SEQ ID NO: 863642 - protein, 9 aa, Homo Sapiens
PKPIEPLNN

SEQ ID NO: 863643 - protein, 9 aa, Homo Sapiens
SPAGVGFHT

SEQ ID NO: 863644 - protein, 9 aa, Homo Sapiens
VINSIFTHF

SEQ ID NO: 863645 - protein, 9 aa, Homo Sapiens
PNAHVKKDV

SEQ ID NO: 863646 - protein, 9 aa, Homo Sapiens
KLVVAHMTR

SEQ ID NO: 863647 - protein, 9 aa, Homo Sapiens
IKQISRDIN

SEQ ID NO: 863648 - protein, 9 aa, Homo Sapiens
QNNGDAIVK

SEQ ID NO: 863649 - protein, 9 aa, Homo Sapiens
HVIYPCHFY

SEQ ID NO: 863650 - protein, 9 aa, Homo Sapiens
TGNLQTLKG

SEQ ID NO: 863651 - protein, 9 aa, Homo Sapiens
AADKEVFSY

SEQ ID NO: 863652 - protein, 9 aa, Homo Sapiens
FDRVLTELM

SEQ ID NO: 863653 - protein, 9 aa, Homo Sapiens
IIPCFGAKE

SEQ ID NO: 863654 - protein, 9 aa, Homo Sapiens
GHITKMLLT

SEQ ID NO: 863655 - protein, 9 aa, Homo Sapiens
SLEKARKIF

SEQ ID NO: 863656 - protein, 9 aa, Homo Sapiens
KNYRQVEVS

SEQ ID NO: 863657 - protein, 9 aa, Homo Sapiens
IHPHLSTKK

SEQ ID NO: 863658 - protein, 9 aa, Homo Sapiens
TKPTRIIWK

SEQ ID NO: 863659 - protein, 9 aa, Homo Sapiens
QEKGIYYIP

SEQ ID NO: 863660 - protein, 9 aa, Homo Sapiens
AKAFKRCVL

SEQ ID NO: 863661 - protein, 9 aa, Homo Sapiens
PSAPNLAET

SEQ ID NO: 863662 - protein, 9 aa, Homo Sapiens
SKGVAVFNT

SEQ ID NO: 863663 - protein, 9 aa, Homo Sapiens
NIYFPIRDS

SEQ ID NO: 863664 - protein, 9 aa, Homo Sapiens
EDIIYRVRG

SEQ ID NO: 863665 - protein, 9 aa, Homo Sapiens
LAPDIVGDI

SEQ ID NO: 863666 - protein, 9 aa, Homo Sapiens
APRDKYWLQ

SEQ ID NO: 863667 - protein, 9 aa, Homo Sapiens
HSQLAEPQN

SEQ ID NO: 863668 - protein, 9 aa, Homo Sapiens
TLTGYNYYI

SEQ ID NO: 863669 - protein, 9 aa, Homo Sapiens
YVLAAETGM

SEQ ID NO: 863670 - protein, 9 aa, Homo Sapiens
LLCNPKHSA

SEQ ID NO: 863671 - protein, 9 aa, Homo Sapiens
VVSKLWVPN

SEQ ID NO: 863672 - protein, 9 aa, Homo Sapiens
DPEKEDCVQ

SEQ ID NO: 863673 - protein, 9 aa, Homo Sapiens
SQISLADIA

SEQ ID NO: 863674 - protein, 9 aa, Homo Sapiens
DLTLFLPDT

SEQ ID NO: 863675 - protein, 9 aa, Homo Sapiens
VKCKAFSSD

SEQ ID NO: 863676 - protein, 9 aa, Homo Sapiens
EEMPGPGCY

SEQ ID NO: 863677 - protein, 9 aa, Homo Sapiens
RLIIWAVMD

SEQ ID NO: 863678 - protein, 9 aa, Homo Sapiens
KYVATRVPK

SEQ ID NO: 863679 - protein, 9 aa, Homo Sapiens
YGKFRTTFD

SEQ ID NO: 863680 - protein, 9 aa, Homo Sapiens
QTPDLAIQL

SEQ ID NO: 863681 - protein, 9 aa, Homo Sapiens
LKVPKDAEN

SEQ ID NO: 863682 - protein, 9 aa, Homo Sapiens
IHSFQVIES

SEQ ID NO: 863683 - protein, 9 aa, Homo Sapiens
ISKFTCSRL

SEQ ID NO: 863684 - protein, 9 aa, Homo Sapiens
FLLTLPFWV

SEQ ID NO: 863685 - protein, 9 aa, Homo Sapiens
AMLGLLCFP

SEQ ID NO: 863686 - protein, 9 aa, Homo Sapiens
KSGYFPMPE

SEQ ID NO: 863687 - protein, 9 aa, Homo Sapiens
CKAVGKFTK

SEQ ID NO: 863688 - protein, 9 aa, Homo Sapiens
VLEAATFLD

SEQ ID NO: 863689 - protein, 9 aa, Homo Sapiens
VHGEFRQDI

SEQ ID NO: 863690 - protein, 9 aa, Homo Sapiens
RDSGFQFKL

SEQ ID NO: 863691 - protein, 9 aa, Homo Sapiens
ERYNCYKVP

SEQ ID NO: 863692 - protein, 9 aa, Homo Sapiens
NTGDEERPQ

SEQ ID NO: 863693 - protein, 9 aa, Homo Sapiens
VRVARQRRH

SEQ ID NO: 863694 - protein, 9 aa, Homo Sapiens
CMLTSVCCR

SEQ ID NO: 863695 - protein, 9 aa, Homo Sapiens
HQERDLIKG

SEQ ID NO: 863696 - protein, 9 aa, Homo Sapiens
CNETCYPGF

SEQ ID NO: 863697 - protein, 9 aa, Homo Sapiens
SNLRALRKG

SEQ ID NO: 863698 - protein, 9 aa, Homo Sapiens
QCSNSNRHK

SEQ ID NO: 863699 - protein, 9 aa, Homo Sapiens
RKEEKPTDD

SEQ ID NO: 863700 - protein, 9 aa, Homo Sapiens
PTSRATRGI

SEQ ID NO: 863701 - protein, 9 aa, Homo Sapiens
VPALVAKCD

SEQ ID NO: 863702 - protein, 9 aa, Homo Sapiens
QDAVNTILR

SEQ ID NO: 863703 - protein, 9 aa, Homo Sapiens
ASSQRTALS

SEQ ID NO: 863704 - protein, 9 aa, Homo Sapiens
QNEMNVMLK

SEQ ID NO: 863705 - protein, 9 aa, Homo Sapiens
SEVSAVQLQ

SEQ ID NO: 863706 - protein, 9 aa, Homo Sapiens
LRNVSLRVK

SEQ ID NO: 863707 - protein, 9 aa, Homo Sapiens
GKATSDPCA

SEQ ID NO: 863708 - protein, 9 aa, Homo Sapiens
YMIVSFWFG

SEQ ID NO: 863709 - protein, 9 aa, Homo Sapiens
FGKTTAIIQ

SEQ ID NO: 863710 - protein, 9 aa, Homo Sapiens
QLSDVCQLR

SEQ ID NO: 863711 - protein, 9 aa, Homo Sapiens
EHKEVVILL

SEQ ID NO: 863712 - protein, 9 aa, Homo Sapiens
LYEMFERNP

SEQ ID NO: 863713 - protein, 9 aa, Homo Sapiens
VCHHHHHHP

SEQ ID NO: 863714 - protein, 9 aa, Homo Sapiens
WVDTMQEDL

SEQ ID NO: 863715 - protein, 9 aa, Homo Sapiens
ESEEHDQTF

SEQ ID NO: 863716 - protein, 9 aa, Homo Sapiens
ESVTILVAV

SEQ ID NO: 863717 - protein, 9 aa, Homo Sapiens
ENKTIRGKK

SEQ ID NO: 863718 - protein, 9 aa, Homo Sapiens
IGAHITTPE

SEQ ID NO: 863719 - protein, 9 aa, Homo Sapiens
PTYFSNLQR

SEQ ID NO: 863720 - protein, 9 aa, Homo Sapiens
DGSFHLENI

SEQ ID NO: 863721 - protein, 9 aa, Homo Sapiens
EPTVSIHLN

SEQ ID NO: 863722 - protein, 9 aa, Homo Sapiens
RKKMNSWVK

SEQ ID NO: 863723 - protein, 9 aa, Homo Sapiens
LDLGGQPVV

SEQ ID NO: 863724 - protein, 9 aa, Homo Sapiens
ENSTPDKTD

SEQ ID NO: 863725 - protein, 9 aa, Homo Sapiens
GQIHSTSGL

SEQ ID NO: 863726 - protein, 9 aa, Homo Sapiens
DKMIEASKE

SEQ ID NO: 863727 - protein, 9 aa, Homo Sapiens
QSGVVSAQR

SEQ ID NO: 863728 - protein, 9 aa, Homo Sapiens
AFPISHVRL

SEQ ID NO: 863729 - protein, 9 aa, Homo Sapiens
DEVWYLQST

SEQ ID NO: 863730 - protein, 9 aa, Homo Sapiens
SLLGGFQAM

SEQ ID NO: 863731 - protein, 9 aa, Homo Sapiens
SLGKVICLT

SEQ ID NO: 863732 - protein, 9 aa, Homo Sapiens
IIKLEILEK

SEQ ID NO: 863733 - protein, 9 aa, Homo Sapiens
MEKLWDARL

SEQ ID NO: 863734 - protein, 9 aa, Homo Sapiens
GEEKVAPYN

SEQ ID NO: 863735 - protein, 9 aa, Homo Sapiens
IRCDAGMCR

SEQ ID NO: 863736 - protein, 9 aa, Homo Sapiens
DFDCFSKHD

SEQ ID NO: 863737 - protein, 9 aa, Homo Sapiens
FFDEGTIDF

SEQ ID NO: 863738 - protein, 9 aa, Homo Sapiens
GTNNEGGGS

SEQ ID NO: 863739 - protein, 9 aa, Homo Sapiens
LGPNQTGSE

SEQ ID NO: 863740 - protein, 9 aa, Homo Sapiens
QVETPGCSV

SEQ ID NO: 863741 - protein, 9 aa, Homo Sapiens
FQDTVHMLL

SEQ ID NO: 863742 - protein, 9 aa, Homo Sapiens
QIWEVLKTE

SEQ ID NO: 863743 - protein, 9 aa, Homo Sapiens
ILTRGVKTS

SEQ ID NO: 863744 - protein, 9 aa, Homo Sapiens
LVQKDLQNF

SEQ ID NO: 863745 - protein, 9 aa, Homo Sapiens
CSLKHCELW

SEQ ID NO: 863746 - protein, 9 aa, Homo Sapiens
YGEVQTNIF

SEQ ID NO: 863747 - protein, 9 aa, Homo Sapiens
PPSRNWRER

SEQ ID NO: 863748 - protein, 9 aa, Homo Sapiens
LAAVGMLYG

SEQ ID NO: 863749 - protein, 9 aa, Homo Sapiens
LKLEPHKGL

SEQ ID NO: 863750 - protein, 9 aa, Homo Sapiens
APPLRPAHG

SEQ ID NO: 863751 - protein, 9 aa, Homo Sapiens
RRKNQTTKI

SEQ ID NO: 863752 - protein, 9 aa, Homo Sapiens
GVLVEFSGL

SEQ ID NO: 863753 - protein, 9 aa, Homo Sapiens
MTKKCECGR

SEQ ID NO: 863754 - protein, 9 aa, Homo Sapiens
DSYENGPEE

SEQ ID NO: 863755 - protein, 9 aa, Homo Sapiens
NAGVSPGPP

SEQ ID NO: 863756 - protein, 9 aa, Homo Sapiens
LHVLVPPED

SEQ ID NO: 863757 - protein, 9 aa, Homo Sapiens
LWCRWAETS

SEQ ID NO: 863758 - protein, 9 aa, Homo Sapiens
YKCSALNDV

SEQ ID NO: 863759 - protein, 9 aa, Homo Sapiens
TAHLIFCGS

SEQ ID NO: 863760 - protein, 9 aa, Homo Sapiens
DVSHYVSPE

SEQ ID NO: 863761 - protein, 9 aa, Homo Sapiens
GSNHLENIA

SEQ ID NO: 863762 - protein, 9 aa, Homo Sapiens
WDRTSHNDF

SEQ ID NO: 863763 - protein, 9 aa, Homo Sapiens
SCIGCCVGL

SEQ ID NO: 863764 - protein, 9 aa, Homo Sapiens
HYVSPEQKK

SEQ ID NO: 863765 - protein, 9 aa, Homo Sapiens
STLKIFCGR

SEQ ID NO: 863766 - protein, 9 aa, Homo Sapiens
LKVTSATQL

SEQ ID NO: 863767 - protein, 9 aa, Homo Sapiens
VLKVTSATQ

SEQ ID NO: 863768 - protein, 9 aa, Homo Sapiens
DIVHITTSI

SEQ ID NO: 863769 - protein, 9 aa, Homo Sapiens
SLPVCEPVK

SEQ ID NO: 863770 - protein, 9 aa, Homo Sapiens
SHNDFMGAM

SEQ ID NO: 863771 - protein, 9 aa, Homo Sapiens
SNAGVSPGP

SEQ ID NO: 863772 - protein, 9 aa, Homo Sapiens
GMNWRPILT

SEQ ID NO: 863773 - protein, 9 aa, Homo Sapiens
KVAGGFRWG

SEQ ID NO: 863774 - protein, 9 aa, Homo Sapiens
WCRWAETSS

SEQ ID NO: 863775 - protein, 9 aa, Homo Sapiens
VVSRGCLRR

SEQ ID NO: 863776 - protein, 9 aa, Homo Sapiens
VSHYVSPEQ

SEQ ID NO: 863777 - protein, 9 aa, Homo Sapiens
VHITTSITN

SEQ ID NO: 863778 - protein, 9 aa, Homo Sapiens
ETCDHPPII

SEQ ID NO: 863779 - protein, 9 aa, Homo Sapiens
NHLENIAES

SEQ ID NO: 863780 - protein, 9 aa, Homo Sapiens
SSCMGGMNW

SEQ ID NO: 863781 - protein, 9 aa, Homo Sapiens
MRLSGNKEE

SEQ ID NO: 863782 - protein, 9 aa, Homo Sapiens
LPVCEPVKC

SEQ ID NO: 863783 - protein, 9 aa, Homo Sapiens
KLQKRECSC

SEQ ID NO: 863784 - protein, 9 aa, Homo Sapiens
DPACAEGSV

SEQ ID NO: 863785 - protein, 9 aa, Homo Sapiens
RPLERHAAE

SEQ ID NO: 863786 - protein, 9 aa, Homo Sapiens
NISPNGKYV

SEQ ID NO: 863787 - protein, 9 aa, Homo Sapiens
VSLAQLGLG

SEQ ID NO: 863788 - protein, 9 aa, Homo Sapiens
VVGACGVGK

SEQ ID NO: 863789 - protein, 9 aa, Homo Sapiens
MYFLIIFLL

SEQ ID NO: 863790 - protein, 9 aa, Homo Sapiens
LEPAVIERP

SEQ ID NO: 863791 - protein, 9 aa, Homo Sapiens
AVKQMRLSG

SEQ ID NO: 863792 - protein, 9 aa, Homo Sapiens
RLSGNKEEN

SEQ ID NO: 863793 - protein, 9 aa, Homo Sapiens
ATLSVRQLI

SEQ ID NO: 863794 - protein, 9 aa, Homo Sapiens
RIVVSRGCL

SEQ ID NO: 863795 - protein, 9 aa, Homo Sapiens
ALLWCRWAE

SEQ ID NO: 863796 - protein, 9 aa, Homo Sapiens
GLGALALEA

SEQ ID NO: 863797 - protein, 9 aa, Homo Sapiens
SPVELAERC

SEQ ID NO: 863798 - protein, 9 aa, Homo Sapiens
SGPTEVFET

SEQ ID NO: 863799 - protein, 9 aa, Homo Sapiens
AHLIFCGSQ

SEQ ID NO: 863800 - protein, 9 aa, Homo Sapiens
LVEFSGLAF

SEQ ID NO: 863801 - protein, 9 aa, Homo Sapiens
FSGLAFHLR

SEQ ID NO: 863802 - protein, 9 aa, Homo Sapiens
SASSTEKAV

SEQ ID NO: 863803 - protein, 9 aa, Homo Sapiens
DWEEKAEYT

SEQ ID NO: 863804 - protein, 9 aa, Homo Sapiens
PALQICTVL

SEQ ID NO: 863805 - protein, 9 aa, Homo Sapiens
CPRHCPPGR

SEQ ID NO: 863806 - protein, 9 aa, Homo Sapiens
SKIVHRVLK

SEQ ID NO: 863807 - protein, 9 aa, Homo Sapiens
DVEMKEDSY

SEQ ID NO: 863808 - protein, 9 aa, Homo Sapiens
IFMIIEEFN

SEQ ID NO: 863809 - protein, 9 aa, Homo Sapiens
NHVLKVTSA

SEQ ID NO: 863810 - protein, 9 aa, Homo Sapiens
TTMQKCLKK

SEQ ID NO: 863811 - protein, 9 aa, Homo Sapiens
SCQPSDASA

SEQ ID NO: 863812 - protein, 9 aa, Homo Sapiens
HITTSITNA

SEQ ID NO: 863813 - protein, 9 aa, Homo Sapiens
LSVRQLIEN

SEQ ID NO: 863814 - protein, 9 aa, Homo Sapiens
EATCCYHSA

SEQ ID NO: 863815 - protein, 9 aa, Homo Sapiens
HGQAELAAA

SEQ ID NO: 863816 - protein, 9 aa, Homo Sapiens
KNHVLKVTS

SEQ ID NO: 863817 - protein, 9 aa, Homo Sapiens
ITTSITNAK

SEQ ID NO: 863818 - protein, 9 aa, Homo Sapiens
ANSSWSHSL

SEQ ID NO: 863819 - protein, 9 aa, Homo Sapiens
SHLSDSRQT

SEQ ID NO: 863820 - protein, 9 aa, Homo Sapiens
HLENIAESI

SEQ ID NO: 863821 - protein, 9 aa, Homo Sapiens
TALHGDVCT

SEQ ID NO: 863822 - protein, 9 aa, Homo Sapiens
SNHLENIAE

SEQ ID NO: 863823 - protein, 9 aa, Homo Sapiens
CCYHSALRY

SEQ ID NO: 863824 - protein, 9 aa, Homo Sapiens
KLVVVGACG

SEQ ID NO: 863825 - protein, 9 aa, Homo Sapiens
MEGYIGMDF

SEQ ID NO: 863826 - protein, 9 aa, Homo Sapiens
EDSYENGPE

SEQ ID NO: 863827 - protein, 9 aa, Homo Sapiens
ESLNSCQPS

SEQ ID NO: 863828 - protein, 9 aa, Homo Sapiens
PPGRLHTVS

SEQ ID NO: 863829 - protein, 9 aa, Homo Sapiens
EEATCCYHS

SEQ ID NO: 863830 - protein, 9 aa, Homo Sapiens
CCVGLGNVW

SEQ ID NO: 863831 - protein, 9 aa, Homo Sapiens
FLLSCIGCC

SEQ ID NO: 863832 - protein, 9 aa, Homo Sapiens
SVMTAHLIF

SEQ ID NO: 863833 - protein, 9 aa, Homo Sapiens
LQKRECSCR

SEQ ID NO: 863834 - protein, 9 aa, Homo Sapiens
LNSCQPSDA

SEQ ID NO: 863835 - protein, 9 aa, Homo Sapiens
GACGVGKSA

SEQ ID NO: 863836 - protein, 9 aa, Homo Sapiens
VLGTALHGD

SEQ ID NO: 863837 - protein, 9 aa, Homo Sapiens
VTSATQLFS

SEQ ID NO: 863838 - protein, 9 aa, Homo Sapiens
LLWCRWAET

SEQ ID NO: 863839 - protein, 9 aa, Homo Sapiens
PRPQDHDTD

SEQ ID NO: 863840 - protein, 9 aa, Homo Sapiens
HCSSNAGVS

SEQ ID NO: 863841 - protein, 9 aa, Homo Sapiens
PAFMTKKCE

SEQ ID NO: 863842 - protein, 9 aa, Homo Sapiens
KWSPALQIC

SEQ ID NO: 863843 - protein, 9 aa, Homo Sapiens
TGGGGEKVA

SEQ ID NO: 863844 - protein, 9 aa, Homo Sapiens
LAAAVWKGH

SEQ ID NO: 863845 - protein, 9 aa, Homo Sapiens
SGEYKCSAL

SEQ ID NO: 863846 - protein, 9 aa, Homo Sapiens
NVEAHSRFI

SEQ ID NO: 863847 - protein, 9 aa, Homo Sapiens
EACRDPACA

SEQ ID NO: 863848 - protein, 9 aa, Homo Sapiens
LGLGALALE

SEQ ID NO: 863849 - protein, 9 aa, Homo Sapiens
PLEPAVIER

SEQ ID NO: 863850 - protein, 9 aa, Homo Sapiens
QSRTTMQKC

SEQ ID NO: 863851 - protein, 9 aa, Homo Sapiens
TIRVFACER

SEQ ID NO: 863852 - protein, 9 aa, Homo Sapiens
GEYKCSALN

SEQ ID NO: 863853 - protein, 9 aa, Homo Sapiens
DAHEFPMFT

SEQ ID NO: 863854 - protein, 9 aa, Homo Sapiens
ATMAVEPTQ

SEQ ID NO: 863855 - protein, 9 aa, Homo Sapiens
EEGDIVHIT

SEQ ID NO: 863856 - protein, 9 aa, Homo Sapiens
NLHVSVLHR

SEQ ID NO: 863857 - protein, 9 aa, Homo Sapiens
TKKCECGRT

SEQ ID NO: 863858 - protein, 9 aa, Homo Sapiens
TLSHLSDSR

SEQ ID NO: 863859 - protein, 9 aa, Homo Sapiens
PYNATLSVR

SEQ ID NO: 863860 - protein, 9 aa, Homo Sapiens
ASSTEKAVT

SEQ ID NO: 863861 - protein, 9 aa, Homo Sapiens
LERHAAEAI

SEQ ID NO: 863862 - protein, 9 aa, Homo Sapiens
SLVTYELRS

SEQ ID NO: 863863 - protein, 9 aa, Homo Sapiens
LHQPFSEKN

SEQ ID NO: 863864 - protein, 9 aa, Homo Sapiens
AEEEDVHRS

SEQ ID NO: 863865 - protein, 9 aa, Homo Sapiens
LAEACRDPA

SEQ ID NO: 863866 - protein, 9 aa, Homo Sapiens
KFAEEEDVH

SEQ ID NO: 863867 - protein, 9 aa, Homo Sapiens
GGGGEKVAG

SEQ ID NO: 863868 - protein, 9 aa, Homo Sapiens
HLSDSRQTL

SEQ ID NO: 863869 - protein, 9 aa, Homo Sapiens
GTALHGDVC

SEQ ID NO: 863870 - protein, 9 aa, Homo Sapiens
ENIFMIIEE

SEQ ID NO: 863871 - protein, 9 aa, Homo Sapiens
RDGDWDPER

SEQ ID NO: 863872 - protein, 9 aa, Homo Sapiens
SSGPTEVFE

SEQ ID NO: 863873 - protein, 9 aa, Homo Sapiens
TSATQLFSE

SEQ ID NO: 863874 - protein, 9 aa, Homo Sapiens
HRVLKEMVA

SEQ ID NO: 863875 - protein, 9 aa, Homo Sapiens
RSRPEQDKF

SEQ ID NO: 863876 - protein, 9 aa, Homo Sapiens
IRVFACERD

SEQ ID NO: 863877 - protein, 9 aa, Homo Sapiens
GLAFHLRSP

SEQ ID NO: 863878 - protein, 9 aa, Homo Sapiens
ASKIVHRVL

SEQ ID NO: 863879 - protein, 9 aa, Homo Sapiens
RRRDGDWDP

SEQ ID NO: 863880 - protein, 9 aa, Homo Sapiens
GCISHCSSN

SEQ ID NO: 863881 - protein, 9 aa, Homo Sapiens
RVFACERDG

SEQ ID NO: 863882 - protein, 9 aa, Homo Sapiens
SPALQICTV

SEQ ID NO: 863883 - protein, 9 aa, Homo Sapiens
DLHGQAELA

SEQ ID NO: 863884 - protein, 9 aa, Homo Sapiens
PGRLHTVSL

SEQ ID NO: 863885 - protein, 9 aa, Homo Sapiens
TLTIRVFAC

SEQ ID NO: 863886 - protein, 9 aa, Homo Sapiens
SSNAGVSPG

SEQ ID NO: 863887 - protein, 9 aa, Homo Sapiens
GCCVGLGNV

SEQ ID NO: 863888 - protein, 9 aa, Homo Sapiens
KEKESPVEL

SEQ ID NO: 863889 - protein, 9 aa, Homo Sapiens
NVLGTALHG

SEQ ID NO: 863890 - protein, 9 aa, Homo Sapiens
RECSCRAYV

SEQ ID NO: 863891 - protein, 9 aa, Homo Sapiens
ELRSRPEQD

SEQ ID NO: 863892 - protein, 9 aa, Homo Sapiens
ASNLHVSVL

SEQ ID NO: 863893 - protein, 9 aa, Homo Sapiens
ISSGPTEVF

SEQ ID NO: 863894 - protein, 9 aa, Homo Sapiens
HTVSLAQLG

SEQ ID NO: 863895 - protein, 9 aa, Homo Sapiens
GGVALAIAS

SEQ ID NO: 863896 - protein, 9 aa, Homo Sapiens
EKESPVELA

SEQ ID NO: 863897 - protein, 9 aa, Homo Sapiens
VGACGVGKS

SEQ ID NO: 863898 - protein, 9 aa, Homo Sapiens
SSLVTYELR

SEQ ID NO: 863899 - protein, 9 aa, Homo Sapiens
NIFMIIEEF

SEQ ID NO: 863900 - protein, 9 aa, Homo Sapiens
VIAVKQMRL

SEQ ID NO: 863901 - protein, 9 aa, Homo Sapiens
VSRGCLRRL

SEQ ID NO: 863902 - protein, 9 aa, Homo Sapiens
NGINISPNG

SEQ ID NO: 863903 - protein, 9 aa, Homo Sapiens
ICTVLLSIQ

SEQ ID NO: 863904 - protein, 9 aa, Homo Sapiens
AFNAWKLDD

SEQ ID NO: 863905 - protein, 9 aa, Homo Sapiens
SRGCLRRLL

SEQ ID NO: 863906 - protein, 9 aa, Homo Sapiens
ATLAEACRD

SEQ ID NO: 863907 - protein, 9 aa, Homo Sapiens
DVPNASNLH

SEQ ID NO: 863908 - protein, 9 aa, Homo Sapiens
ACRDPACAE

SEQ ID NO: 863909 - protein, 9 aa, Homo Sapiens
RQLIENADE

SEQ ID NO: 863910 - protein, 9 aa, Homo Sapiens
CPAFMTKKC

SEQ ID NO: 863911 - protein, 9 aa, Homo Sapiens
GYIGMDFEP

SEQ ID NO: 863912 - protein, 9 aa, Homo Sapiens
LNLHQPFSE

SEQ ID NO: 863913 - protein, 9 aa, Homo Sapiens
CLRRLLWIG

SEQ ID NO: 863914 - protein, 9 aa, Homo Sapiens
PPEDPQVLG

SEQ ID NO: 863915 - protein, 9 aa, Homo Sapiens
GLSEDGATM

SEQ ID NO: 863916 - protein, 9 aa, Homo Sapiens
VVVGACGVG

SEQ ID NO: 863917 - protein, 9 aa, Homo Sapiens
DHPPIISEE

SEQ ID NO: 863918 - protein, 9 aa, Homo Sapiens
NSCQPSDAS

SEQ ID NO: 863919 - protein, 9 aa, Homo Sapiens
FMTKKCECG

SEQ ID NO: 863920 - protein, 9 aa, Homo Sapiens
HCPPGRLHT

SEQ ID NO: 863921 - protein, 9 aa, Homo Sapiens
IFCGRGDHI

SEQ ID NO: 863922 - protein, 9 aa, Homo Sapiens
VEAHSRFIF

SEQ ID NO: 863923 - protein, 9 aa, Homo Sapiens
STEKAVTTV

SEQ ID NO: 863924 - protein, 9 aa, Homo Sapiens
IKRLDWEEK

SEQ ID NO: 863925 - protein, 9 aa, Homo Sapiens
QEDAHEFPM

SEQ ID NO: 863926 - protein, 9 aa, Homo Sapiens
FLHVGSNHL

SEQ ID NO: 863927 - protein, 9 aa, Homo Sapiens
HNDFMGAMS

SEQ ID NO: 863928 - protein, 9 aa, Homo Sapiens
VWRPLERHA

SEQ ID NO: 863929 - protein, 9 aa, Homo Sapiens
SGLAFHLRS

SEQ ID NO: 863930 - protein, 9 aa, Homo Sapiens
ILSHMDVSH

SEQ ID NO: 863931 - protein, 9 aa, Homo Sapiens
PNASNLHVS

SEQ ID NO: 863932 - protein, 9 aa, Homo Sapiens
NVLAGGGVA

SEQ ID NO: 863933 - protein, 9 aa, Homo Sapiens
KKCECGRTR

SEQ ID NO: 863934 - protein, 9 aa, Homo Sapiens
ALQICTVLL

SEQ ID NO: 863935 - protein, 9 aa, Homo Sapiens
LKNHVLKVT

SEQ ID NO: 863936 - protein, 9 aa, Homo Sapiens
WNVLAGGGV

SEQ ID NO: 863937 - protein, 9 aa, Homo Sapiens
FSEKNNGSS

SEQ ID NO: 863938 - protein, 9 aa, Homo Sapiens
AELAAAVWK

SEQ ID NO: 863939 - protein, 9 aa, Homo Sapiens
WDPERDQER

SEQ ID NO: 863940 - protein, 9 aa, Homo Sapiens
VRQIGDKDQ

SEQ ID NO: 863941 - protein, 9 aa, Homo Sapiens
SLAQLGLGA

SEQ ID NO: 863942 - protein, 9 aa, Homo Sapiens
WRPLERHAA

SEQ ID NO: 863943 - protein, 9 aa, Homo Sapiens
FTPRPQDHD

SEQ ID NO: 863944 - protein, 9 aa, Homo Sapiens
LSDSRQTLS

SEQ ID NO: 863945 - protein, 9 aa, Homo Sapiens
QCPRHCPPG

SEQ ID NO: 863946 - protein, 9 aa, Homo Sapiens
WSPALQICT

SEQ ID NO: 863947 - protein, 9 aa, Homo Sapiens
NRRRDGDWD

SEQ ID NO: 863948 - protein, 9 aa, Homo Sapiens
GNVEAHSRF

SEQ ID NO: 863949 - protein, 9 aa, Homo Sapiens
SEDGATMAV

SEQ ID NO: 863950 - protein, 9 aa, Homo Sapiens
ERPGCVNLS

SEQ ID NO: 863951 - protein, 9 aa, Homo Sapiens
RRDGDWDPE

SEQ ID NO: 863952 - protein, 9 aa, Homo Sapiens
CGVGKSALT

SEQ ID NO: 863953 - protein, 9 aa, Homo Sapiens
HVLKVTSAT

SEQ ID NO: 863954 - protein, 9 aa, Homo Sapiens
YELRSRPEQ

SEQ ID NO: 863955 - protein, 9 aa, Homo Sapiens
YVELAFNAW

SEQ ID NO: 863956 - protein, 9 aa, Homo Sapiens
TEKAVTTVL

SEQ ID NO: 863957 - protein, 9 aa, Homo Sapiens
GINISPNGK

SEQ ID NO: 863958 - protein, 9 aa, Homo Sapiens
LQICTVLLS

SEQ ID NO: 863959 - protein, 9 aa, Homo Sapiens
CISHCSSNA

SEQ ID NO: 863960 - protein, 9 aa, Homo Sapiens
VYFAINVCT

SEQ ID NO: 863961 - protein, 9 aa, Homo Sapiens
PQSISSGPT

SEQ ID NO: 863962 - protein, 9 aa, Homo Sapiens
EHDSEEATC

SEQ ID NO: 863963 - protein, 9 aa, Homo Sapiens
SHCSSNAGV

SEQ ID NO: 863964 - protein, 9 aa, Homo Sapiens
VGSNHLENI

SEQ ID NO: 863965 - protein, 9 aa, Homo Sapiens
EEDVHRSFE

SEQ ID NO: 863966 - protein, 9 aa, Homo Sapiens
LWNVLAGGG

SEQ ID NO: 863967 - protein, 9 aa, Homo Sapiens
HMDVSHYVS

SEQ ID NO: 863968 - protein, 9 aa, Homo Sapiens
IVHITTSIT

SEQ ID NO: 863969 - protein, 9 aa, Homo Sapiens
AIKRLDWEE

SEQ ID NO: 863970 - protein, 9 aa, Homo Sapiens
MNWRPILTI

SEQ ID NO: 863971 - protein, 9 aa, Homo Sapiens
AHEFPMFTV

SEQ ID NO: 863972 - protein, 9 aa, Homo Sapiens
LHTVSLAQL

SEQ ID NO: 863973 - protein, 9 aa, Homo Sapiens
DVHRSFENT

SEQ ID NO: 863974 - protein, 9 aa, Homo Sapiens
KCLKKEKKT

SEQ ID NO: 863975 - protein, 9 aa, Homo Sapiens
EAHSRFIFF

SEQ ID NO: 863976 - protein, 9 aa, Homo Sapiens
EFSGLAFHL

SEQ ID NO: 863977 - protein, 9 aa, Homo Sapiens
IAESLNSCQ

SEQ ID NO: 863978 - protein, 9 aa, Homo Sapiens
NLNLHQPFS

SEQ ID NO: 863979 - protein, 9 aa, Homo Sapiens
PPIISEEDI

SEQ ID NO: 863980 - protein, 9 aa, Homo Sapiens
LIFCGSQKL

SEQ ID NO: 863981 - protein, 9 aa, Homo Sapiens
LSSASSTEK

SEQ ID NO: 863982 - protein, 9 aa, Homo Sapiens
PRHCPPGRL

SEQ ID NO: 863983 - protein, 9 aa, Homo Sapiens
NAWKLDDKD

SEQ ID NO: 863984 - protein, 9 aa, Homo Sapiens
EFPMFTVDA

SEQ ID NO: 863985 - protein, 9 aa, Homo Sapiens
VWDWDRTSH

SEQ ID NO: 863986 - protein, 9 aa, Homo Sapiens
QICTVLLSI

SEQ ID NO: 863987 - protein, 9 aa, Homo Sapiens
EYKCSALND

SEQ ID NO: 863988 - protein, 9 aa, Homo Sapiens
VHRVLKEMV

SEQ ID NO: 863989 - protein, 9 aa, Homo Sapiens
VMTAHLIFC

SEQ ID NO: 863990 - protein, 9 aa, Homo Sapiens
KESPVELAE

SEQ ID NO: 863991 - protein, 9 aa, Homo Sapiens
TLSVRQLIE

SEQ ID NO: 863992 - protein, 9 aa, Homo Sapiens
HDSEEATCC

SEQ ID NO: 863993 - protein, 9 aa, Homo Sapiens
CQPSDASAT

SEQ ID NO: 863994 - protein, 9 aa, Homo Sapiens
QKRECSCRA

SEQ ID NO: 863995 - protein, 9 aa, Homo Sapiens
IEFGNVEAH

SEQ ID NO: 863996 - protein, 9 aa, Homo Sapiens
LHVSVLHRY

SEQ ID NO: 863997 - protein, 9 aa, Homo Sapiens
EGYIGMDFE

SEQ ID NO: 863998 - protein, 9 aa, Homo Sapiens
VHRSFENTA

SEQ ID NO: 863999 - protein, 9 aa, Homo Sapiens
HSRFIFFVD

SEQ ID NO: 864000 - protein, 9 aa, Homo Sapiens
LGTALHGDV

SEQ ID NO: 864001 - protein, 9 aa, Homo Sapiens
SSTLKIFCG

SEQ ID NO: 864002 - protein, 9 aa, Homo Sapiens
EMPASKIVH

SEQ ID NO: 864003 - protein, 9 aa, Homo Sapiens
MTAHLIFCG

SEQ ID NO: 864004 - protein, 9 aa, Homo Sapiens
SEEATCCYH

SEQ ID NO: 864005 - protein, 9 aa, Homo Sapiens
EGDIVHITT

SEQ ID NO: 864006 - protein, 9 aa, Homo Sapiens
LNLNLHQPF

SEQ ID NO: 864007 - protein, 9 aa, Homo Sapiens
YENGPEEKQ

SEQ ID NO: 864008 - protein, 9 aa, Homo Sapiens
SVRQLIENA

SEQ ID NO: 864009 - protein, 9 aa, Homo Sapiens
LAGGGVALA

SEQ ID NO: 864010 - protein, 9 aa, Homo Sapiens
NWRPILTII

SEQ ID NO: 864011 - protein, 9 aa, Homo Sapiens
ALHGDVCTH

SEQ ID NO: 864012 - protein, 9 aa, Homo Sapiens
MIIEEFNKK

SEQ ID NO: 864013 - protein, 9 aa, Homo Sapiens
FGNVEAHSR

SEQ ID NO: 864014 - protein, 9 aa, Homo Sapiens
LHGQAELAA

SEQ ID NO: 864015 - protein, 9 aa, Homo Sapiens
VISALLWCR

SEQ ID NO: 864016 - protein, 9 aa, Homo Sapiens
PEDPQVLGG

SEQ ID NO: 864017 - protein, 9 aa, Homo Sapiens
HQPFSEKNN

SEQ ID NO: 864018 - protein, 9 aa, Homo Sapiens
VEFSGLAFH

SEQ ID NO: 864019 - protein, 9 aa, Homo Sapiens
SGLPNEVYF

SEQ ID NO: 864020 - protein, 9 aa, Homo Sapiens
IGMDFEPLS

SEQ ID NO: 864021 - protein, 9 aa, Homo Sapiens
IFCGSQKLN

SEQ ID NO: 864022 - protein, 9 aa, Homo Sapiens
VPNASNLHV

SEQ ID NO: 864023 - protein, 9 aa, Homo Sapiens
YNATLSVRQ

SEQ ID NO: 864024 - protein, 9 aa, Homo Sapiens
KVTSATQLF

SEQ ID NO: 864025 - protein, 9 aa, Homo Sapiens
DFLLSCIGC

SEQ ID NO: 864026 - protein, 9 aa, Homo Sapiens
AWKLDDKDF

SEQ ID NO: 864027 - protein, 9 aa, Homo Sapiens
PIISEEDIS

SEQ ID NO: 864028 - protein, 9 aa, Homo Sapiens
ECSCRAYVQ

SEQ ID NO: 864029 - protein, 9 aa, Homo Sapiens
HLIFCGSQK

SEQ ID NO: 864030 - protein, 9 aa, Homo Sapiens
RDLHGQAEL

SEQ ID NO: 864031 - protein, 9 aa, Homo Sapiens
GCLRRLLWI

SEQ ID NO: 864032 - protein, 9 aa, Homo Sapiens
ELAAAVWKG

SEQ ID NO: 864033 - protein, 9 aa, Homo Sapiens
SSASSTEKA

SEQ ID NO: 864034 - protein, 9 aa, Homo Sapiens
GATMAVEPT

SEQ ID NO: 864035 - protein, 9 aa, Homo Sapiens
CGRGDHIFL

SEQ ID NO: 864036 - protein, 9 aa, Homo Sapiens
GGEKVAGGF

SEQ ID NO: 864037 - protein, 9 aa, Homo Sapiens
TMQKCLKKE

SEQ ID NO: 864038 - protein, 9 aa, Homo Sapiens
GDWDPERDQ

SEQ ID NO: 864039 - protein, 9 aa, Homo Sapiens
DSEEATCCY

SEQ ID NO: 864040 - protein, 9 aa, Homo Sapiens
LAQLGLGAL

SEQ ID NO: 864041 - protein, 9 aa, Homo Sapiens
TCCYHSALR

SEQ ID NO: 864042 - protein, 9 aa, Homo Sapiens
NKLQKRECS

SEQ ID NO: 864043 - protein, 9 aa, Homo Sapiens
MENIFMIIE

SEQ ID NO: 864044 - protein, 9 aa, Homo Sapiens
YFAINVCTL

SEQ ID NO: 864045 - protein, 9 aa, Homo Sapiens
HEFPMFTVD

SEQ ID NO: 864046 - protein, 9 aa, Homo Sapiens
ISEEDISVG

SEQ ID NO: 864047 - protein, 9 aa, Homo Sapiens
SLNSCQPSD

SEQ ID NO: 864048 - protein, 8 aa, Homo Sapiens
GPAGCAFT

SEQ ID NO: 864049 - protein, 9 aa, Homo Sapiens
ELAFNAWKL

SEQ ID NO: 864050 - protein, 9 aa, Homo Sapiens
KRLDWEEKA

SEQ ID NO: 864051 - protein, 9 aa, Homo Sapiens
IAVKQMRLS

SEQ ID NO: 864052 - protein, 9 aa, Homo Sapiens
SRTTMQKCL

SEQ ID NO: 864053 - protein, 9 aa, Homo Sapiens
STLTIRVFA

SEQ ID NO: 864054 - protein, 9 aa, Homo Sapiens
PPLEPAVIE

SEQ ID NO: 864055 - protein, 9 aa, Homo Sapiens
QSGEYKCSA

SEQ ID NO: 864056 - protein, 9 aa, Homo Sapiens
DLEQVVRQI

SEQ ID NO: 864057 - protein, 9 aa, Homo Sapiens
SNLHVSVLH

SEQ ID NO: 864058 - protein, 9 aa, Homo Sapiens
QNDLEQVVR

SEQ ID NO: 864059 - protein, 9 aa, Homo Sapiens
KIFCGRGDH

SEQ ID NO: 864060 - protein, 9 aa, Homo Sapiens
IIEEFNKKL

SEQ ID NO: 864061 - protein, 9 aa, Homo Sapiens
MKEDSYENG

SEQ ID NO: 864062 - protein, 9 aa, Homo Sapiens
CSCRAYVQA

SEQ ID NO: 864063 - protein, 9 aa, Homo Sapiens
EGLSEDGAT

SEQ ID NO: 864064 - protein, 9 aa, Homo Sapiens
QSISSGPTE

SEQ ID NO: 864065 - protein, 9 aa, Homo Sapiens
SHYVSPEQK

SEQ ID NO: 864066 - protein, 9 aa, Homo Sapiens
RTTMQKCLK

SEQ ID NO: 864067 - protein, 9 aa, Homo Sapiens
LVTYELRSR

SEQ ID NO: 864068 - protein, 9 aa, Homo Sapiens
EDPQVLGGP

SEQ ID NO: 864069 - protein, 9 aa, Homo Sapiens
EPAVIERPG

SEQ ID NO: 864070 - protein, 9 aa, Homo Sapiens
SEEGDIVHI

SEQ ID NO: 864071 - protein, 9 aa, Homo Sapiens
VLVEFSGLA

SEQ ID NO: 864072 - protein, 9 aa, Homo Sapiens
AMEGYIGMD

SEQ ID NO: 864073 - protein, 9 aa, Homo Sapiens
AQNDLEQVV

SEQ ID NO: 864074 - protein, 9 aa, Homo Sapiens
GGMNWRPIL

SEQ ID NO: 864075 - protein, 9 aa, Homo Sapiens
AGGGVALAI

SEQ ID NO: 864076 - protein, 9 aa, Homo Sapiens
RHCPPGRLH

SEQ ID NO: 864077 - protein, 9 aa, Homo Sapiens
GLPNEVYFA

SEQ ID NO: 864078 - protein, 9 aa, Homo Sapiens
IVHRVLKEM

SEQ ID NO: 864079 - protein, 9 aa, Homo Sapiens
HRSFENTAA

SEQ ID NO: 864080 - protein, 9 aa, Homo Sapiens
WKLDDKDFF

SEQ ID NO: 864081 - protein, 9 aa, Homo Sapiens
QPFSEKNNG

SEQ ID NO: 864082 - protein, 9 aa, Homo Sapiens
IFLHVGSNH

SEQ ID NO: 864083 - protein, 9 aa, Homo Sapiens
GGGVALAIA

SEQ ID NO: 864084 - protein, 9 aa, Homo Sapiens
EFGNVEAHS

SEQ ID NO: 864085 - protein, 9 aa, Homo Sapiens
LPQSISSGP

SEQ ID NO: 864086 - protein, 9 aa, Homo Sapiens
PMFTVDAMK

SEQ ID NO: 864087 - protein, 9 aa, Homo Sapiens
IGCCVGLGN

SEQ ID NO: 864088 - protein, 9 aa, Homo Sapiens
VELAFNAWK

SEQ ID NO: 864089 - protein, 9 aa, Homo Sapiens
VEMKEDSYE

SEQ ID NO: 864090 - protein, 9 aa, Homo Sapiens
EDGATMAVE

SEQ ID NO: 864091 - protein, 9 aa, Homo Sapiens
NGKYVYIAE

SEQ ID NO: 864092 - protein, 9 aa, Homo Sapiens
FCGRGDHIF

SEQ ID NO: 864093 - protein, 9 aa, Homo Sapiens
FACERDGRV

SEQ ID NO: 864094 - protein, 9 aa, Homo Sapiens
YIGMDFEPL

SEQ ID NO: 864095 - protein, 9 aa, Homo Sapiens
KVWRPLERH

SEQ ID NO: 864096 - protein, 9 aa, Homo Sapiens
AHSRFIFFV

SEQ ID NO: 864097 - protein, 9 aa, Homo Sapiens
QAELAAAVW

SEQ ID NO: 864098 - protein, 9 aa, Homo Sapiens
IHAIKRLDW

SEQ ID NO: 864099 - protein, 9 aa, Homo Sapiens
LSCIGCCVG

SEQ ID NO: 864100 - protein, 9 aa, Homo Sapiens
PEKEKESPV

SEQ ID NO: 864101 - protein, 9 aa, Homo Sapiens
FPMFTVDAM

SEQ ID NO: 864102 - protein, 9 aa, Homo Sapiens
VRQLIENAD

SEQ ID NO: 864103 - protein, 9 aa, Homo Sapiens
DSSTLKIFC

SEQ ID NO: 864104 - protein, 9 aa, Homo Sapiens
SYENGPEEK

SEQ ID NO: 864105 - protein, 9 aa, Homo Sapiens
SEMENIFMI

SEQ ID NO: 864106 - protein, 9 aa, Homo Sapiens
LVPPEDPQV

SEQ ID NO: 864107 - protein, 9 aa, Homo Sapiens
IISEEDISV

SEQ ID NO: 864108 - protein, 9 aa, Homo Sapiens
KCECGRTRH

SEQ ID NO: 864109 - protein, 9 aa, Homo Sapiens
DWDPERDQE

SEQ ID NO: 864110 - protein, 9 aa, Homo Sapiens
EKEKESPVE

SEQ ID NO: 864111 - protein, 9 aa, Homo Sapiens
LDWEEKAEY

SEQ ID NO: 864112 - protein, 9 aa, Homo Sapiens
FAEEEDVHR

SEQ ID NO: 864113 - protein, 9 aa, Homo Sapiens
VAGGFRWGR

SEQ ID NO: 864114 - protein, 9 aa, Homo Sapiens
VPPEDPQVL

SEQ ID NO: 864115 - protein, 9 aa, Homo Sapiens
VVRQIGDKD

SEQ ID NO: 864116 - protein, 9 aa, Homo Sapiens
RPQDHDTDL

SEQ ID NO: 864117 - protein, 9 aa, Homo Sapiens
EKVAGGFRW

SEQ ID NO: 864118 - protein, 9 aa, Homo Sapiens
TPRPQDHDT

SEQ ID NO: 864119 - protein, 9 aa, Homo Sapiens
ISALLWCRW

SEQ ID NO: 864120 - protein, 9 aa, Homo Sapiens
TGVLVEFSG

SEQ ID NO: 864121 - protein, 9 aa, Homo Sapiens
EVYFAINVC

SEQ ID NO: 864122 - protein, 9 aa, Homo Sapiens
AFMTKKCEC

SEQ ID NO: 864123 - protein, 9 aa, Homo Sapiens
RTSHNDFMG

SEQ ID NO: 864124 - protein, 9 aa, Homo Sapiens
AAMEGYIGM

SEQ ID NO: 864125 - protein, 9 aa, Homo Sapiens
LHVGSNHLE

SEQ ID NO: 864126 - protein, 9 aa, Homo Sapiens
HPPIISEED

SEQ ID NO: 864127 - protein, 9 aa, Homo Sapiens
KQEDAHEFP

SEQ ID NO: 864128 - protein, 9 aa, Homo Sapiens
TYELRSRPE

SEQ ID NO: 864129 - protein, 9 aa, Homo Sapiens
GQAELAAAV

SEQ ID NO: 864130 - protein, 9 aa, Homo Sapiens
SPNGKYVYI

SEQ ID NO: 864131 - protein, 9 aa, Homo Sapiens
SSTLTIRVF

SEQ ID NO: 864132 - protein, 9 aa, Homo Sapiens
SDSRQTLSE

SEQ ID NO: 864133 - protein, 9 aa, Homo Sapiens
CSSNAGVSP

SEQ ID NO: 864134 - protein, 9 aa, Homo Sapiens
HGDVCTHSV

SEQ ID NO: 864135 - protein, 9 aa, Homo Sapiens
QMRLSGNKE

SEQ ID NO: 864136 - protein, 9 aa, Homo Sapiens
PFSEKNNGS

SEQ ID NO: 864137 - protein, 9 aa, Homo Sapiens
DQSGEYKCS

SEQ ID NO: 864138 - protein, 9 aa, Homo Sapiens
KCSALNDVA

SEQ ID NO: 864139 - protein, 9 aa, Homo Sapiens
PVELAERCL

SEQ ID NO: 864140 - protein, 9 aa, Homo Sapiens
LKIFCGRGD

SEQ ID NO: 864141 - protein, 9 aa, Homo Sapiens
VFACERDGR

SEQ ID NO: 864142 - protein, 9 aa, Homo Sapiens
SWSHSLPVC

SEQ ID NO: 864143 - protein, 9 aa, Homo Sapiens
RDQSGEYKC

SEQ ID NO: 864144 - protein, 9 aa, Homo Sapiens
EMKEDSYEN

SEQ ID NO: 864145 - protein, 9 aa, Homo Sapiens
EDAHEFPMF

SEQ ID NO: 864146 - protein, 9 aa, Homo Sapiens
RGCLRRLLW

SEQ ID NO: 864147 - protein, 9 aa, Homo Sapiens
MDVSHYVSP

SEQ ID NO: 864148 - protein, 9 aa, Homo Sapiens
QPSDASATR

SEQ ID NO: 864149 - protein, 9 aa, Homo Sapiens
KIVHRVLKE

SEQ ID NO: 864150 - protein, 9 aa, Homo Sapiens
PCPAFMTKK

SEQ ID NO: 864151 - protein, 9 aa, Homo Sapiens
NLHQPFSEK

SEQ ID NO: 864152 - protein, 9 aa, Homo Sapiens
ISHCSSNAG

SEQ ID NO: 864153 - protein, 9 aa, Homo Sapiens
PASKIVHRV

SEQ ID NO: 864154 - protein, 9 aa, Homo Sapiens
EMENIFMII

SEQ ID NO: 864155 - protein, 9 aa, Homo Sapiens
VELAERCLR

SEQ ID NO: 864156 - protein, 9 aa, Homo Sapiens
CMGGMNWRP

SEQ ID NO: 864157 - protein, 9 aa, Homo Sapiens
QVVRQIGDK

SEQ ID NO: 864158 - protein, 9 aa, Homo Sapiens
GPTEVFETE

SEQ ID NO: 864159 - protein, 9 aa, Homo Sapiens
NSSWSHSLP

SEQ ID NO: 864160 - protein, 9 aa, Homo Sapiens
LHGDVCTHS

SEQ ID NO: 864161 - protein, 9 aa, Homo Sapiens
CTVLLSIQA

SEQ ID NO: 864162 - protein, 9 aa, Homo Sapiens
TVSLAQLGL

SEQ ID NO: 864163 - protein, 9 aa, Homo Sapiens
ERHAAEAIK

SEQ ID NO: 864164 - protein, 9 aa, Homo Sapiens
TLPQSISSG

SEQ ID NO: 864165 - protein, 9 aa, Homo Sapiens
EEEDVHRSF

SEQ ID NO: 864166 - protein, 9 aa, Homo Sapiens
HAIKRLDWE

SEQ ID NO: 864167 - protein, 9 aa, Homo Sapiens
CIGCCVGLG

SEQ ID NO: 864168 - protein, 9 aa, Homo Sapiens
HVLVPPEDP

SEQ ID NO: 864169 - protein, 9 aa, Homo Sapiens
RLDWEEKAE

SEQ ID NO: 864170 - protein, 9 aa, Homo Sapiens
NASNLHVSV

SEQ ID NO: 864171 - protein, 9 aa, Homo Sapiens
AVIERPGCV

SEQ ID NO: 864172 - protein, 9 aa, Homo Sapiens
SHSLPVCEP

SEQ ID NO: 864173 - protein, 9 aa, Homo Sapiens
NATLSVRQL

SEQ ID NO: 864174 - protein, 9 aa, Homo Sapiens
VLAGGGVAL

SEQ ID NO: 864175 - protein, 9 aa, Homo Sapiens
ACGVGKSAL

SEQ ID NO: 864176 - protein, 9 aa, Homo Sapiens
IERPGCVNL

SEQ ID NO: 864177 - protein, 9 aa, Homo Sapiens
MPASKIVHR

SEQ ID NO: 864178 - protein, 9 aa, Homo Sapiens
LSHMDVSHY

SEQ ID NO: 864179 - protein, 9 aa, Homo Sapiens
LLSCIGCCV

SEQ ID NO: 864180 - protein, 9 aa, Homo Sapiens
CRDPACAEG

SEQ ID NO: 864181 - protein, 9 aa, Homo Sapiens
RQTLSEDSG

SEQ ID NO: 864182 - protein, 9 aa, Homo Sapiens
TSHNDFMGA

SEQ ID NO: 864183 - protein, 9 aa, Homo Sapiens
AESLNSCQP

SEQ ID NO: 864184 - protein, 9 aa, Homo Sapiens
EQVVRQIGD

SEQ ID NO: 864185 - protein, 9 aa, Homo Sapiens
ESPVELAER

SEQ ID NO: 864186 - protein, 9 aa, Homo Sapiens
DGDWDPERD

SEQ ID NO: 864187 - protein, 9 aa, Homo Sapiens
INISPNGKY

SEQ ID NO: 864188 - protein, 9 aa, Homo Sapiens
ANGINISPN

SEQ ID NO: 864189 - protein, 9 aa, Homo Sapiens
SALLWCRWA

SEQ ID NO: 864190 - protein, 9 aa, Homo Sapiens
PLERHAAEA

SEQ ID NO: 864191 - protein, 9 aa, Homo Sapiens
CPPGRLHTV

SEQ ID NO: 864192 - protein, 9 aa, Homo Sapiens
VIERPGCVN

SEQ ID NO: 864193 - protein, 9 aa, Homo Sapiens
GDIVHITTS

SEQ ID NO: 864194 - protein, 9 aa, Homo Sapiens
SSTEKAVTT

SEQ ID NO: 864195 - protein, 9 aa, Homo Sapiens
SCMGGMNWR

SEQ ID NO: 864196 - protein, 9 aa, Homo Sapiens
VTYELRSRP

SEQ ID NO: 864197 - protein, 9 aa, Homo Sapiens
PNEVYFAIN

SEQ ID NO: 864198 - protein, 9 aa, Homo Sapiens
TLKIFCGRG

SEQ ID NO: 864199 - protein, 9 aa, Homo Sapiens
ISPNGKYVY

SEQ ID NO: 864200 - protein, 9 aa, Homo Sapiens
CLKKEKKTK

SEQ ID NO: 864201 - protein, 9 aa, Homo Sapiens
LSHLSDSRQ

SEQ ID NO: 864202 - protein, 9 aa, Homo Sapiens
LEQVVRQIG

SEQ ID NO: 864203 - protein, 9 aa, Homo Sapiens
MGGMNWRPI

SEQ ID NO: 864204 - protein, 9 aa, Homo Sapiens
GRLHTVSLA

SEQ ID NO: 864205 - protein, 9 aa, Homo Sapiens
HAAEAIKAW

SEQ ID NO: 864206 - protein, 9 aa, Homo Sapiens
TMAVEPTQI

SEQ ID NO: 864207 - protein, 9 aa, Homo Sapiens
SSWSHSLPV

SEQ ID NO: 864208 - protein, 9 aa, Homo Sapiens
SHMDVSHYV

SEQ ID NO: 864209 - protein, 9 aa, Homo Sapiens
AEACRDPAC

SEQ ID NO: 864210 - protein, 9 aa, Homo Sapiens
HSVMTAHLI

SEQ ID NO: 864211 - protein, 9 aa, Homo Sapiens
NEVYFAINV

SEQ ID NO: 864212 - protein, 9 aa, Homo Sapiens
GGGEKVAGG

SEQ ID NO: 864213 - protein, 9 aa, Homo Sapiens
LAFNAWKLD

SEQ ID NO: 864214 - protein, 9 aa, Homo Sapiens
VKQMRLSGN

SEQ ID NO: 864215 - protein, 9 aa, Homo Sapiens
PAVIERPGC

SEQ ID NO: 864216 - protein, 9 aa, Homo Sapiens
PNGKYVYIA

SEQ ID NO: 864217 - protein, 9 aa, Homo Sapiens
HTGGGGEKV

SEQ ID NO: 864218 - protein, 9 aa, Homo Sapiens
LSGLPNEVY

SEQ ID NO: 864219 - protein, 9 aa, Homo Sapiens
WDWDRTSHN

SEQ ID NO: 864220 - protein, 9 aa, Homo Sapiens
RHAAEAIKA

SEQ ID NO: 864221 - protein, 9 aa, Homo Sapiens
MQKCLKKEK

SEQ ID NO: 864222 - protein, 9 aa, Homo Sapiens
LRSRPEQDK

SEQ ID NO: 864223 - protein, 9 aa, Homo Sapiens
KRECSCRAY

SEQ ID NO: 864224 - protein, 9 aa, Homo Sapiens
DWDRTSHND

SEQ ID NO: 864225 - protein, 9 aa, Homo Sapiens
WRPILTIIT

SEQ ID NO: 864226 - protein, 9 aa, Homo Sapiens
DGATMAVEP

SEQ ID NO: 864227 - protein, 9 aa, Homo Sapiens
MDFEPLSSK

SEQ ID NO: 864228 - protein, 9 aa, Homo Sapiens
TLAEACRDP

SEQ ID NO: 864229 - protein, 9 aa, Homo Sapiens
YFLIIFLLL

SEQ ID NO: 864230 - protein, 9 aa, Homo Sapiens
VLVPPEDPQ

SEQ ID NO: 864231 - protein, 9 aa, Homo Sapiens
LPNEVYFAI

SEQ ID NO: 864232 - protein, 9 aa, Homo Sapiens
FMIIEEFNK

SEQ ID NO: 864233 - protein, 9 aa, Homo Sapiens
QLGLGALAL

SEQ ID NO: 864234 - protein, 9 aa, Homo Sapiens
TCDHPPIIS

SEQ ID NO: 864235 - protein, 9 aa, Homo Sapiens
DRTSHNDFM

SEQ ID NO: 864236 - protein, 9 aa, Homo Sapiens
CDHPPIISE

SEQ ID NO: 864237 - protein, 9 aa, Homo Sapiens
SISSGPTEV

SEQ ID NO: 864238 - protein, 9 aa, Homo Sapiens
HVSVLHRYL

SEQ ID NO: 864239 - protein, 9 aa, Homo Sapiens
GEKVAGGFR

SEQ ID NO: 864240 - protein, 9 aa, Homo Sapiens
LSEDGATMA

SEQ ID NO: 864241 - protein, 9 aa, Homo Sapiens
FNAWKLDDK

SEQ ID NO: 864242 - protein, 9 aa, Homo Sapiens
LNKLQKREC

SEQ ID NO: 864243 - protein, 9 aa, Homo Sapiens
GMDFEPLSS

SEQ ID NO: 864244 - protein, 9 aa, Homo Sapiens
GVALAIASF

SEQ ID NO: 864245 - protein, 9 aa, Homo Sapiens
RDPACAEGS

SEQ ID NO: 864246 - protein, 9 aa, Homo Sapiens
HSLPVCEPV

SEQ ID NO: 864247 - protein, 9 aa, Homo Sapiens
QNVLGTALH

SEQ ID NO: 864248 - protein, 9 aa, Homo Sapiens
RLHTVSLAQ

SEQ ID NO: 864249 - protein, 9 aa, Homo Sapiens
LTIRVFACE

SEQ ID NO: 864250 - protein, 9 aa, Homo Sapiens
LSGNKEENK

SEQ ID NO: 864251 - protein, 9 aa, Homo Sapiens
RRIVVSRGC

SEQ ID NO: 864252 - protein, 9 aa, Homo Sapiens
KRDQSGEYK

SEQ ID NO: 864253 - protein, 9 aa, Homo Sapiens
WSHSLPVCE

SEQ ID NO: 864254 - protein, 9 aa, Homo Sapiens
EDVHRSFEN

SEQ ID NO: 864255 - protein, 9 aa, Homo Sapiens
DSRQTLSED

SEQ ID NO: 864256 - protein, 9 aa, Homo Sapiens
HVGSNHLEN

SEQ ID NO: 864257 - protein, 9 aa, Homo Sapiens
QKCLKKEKK

SEQ ID NO: 864258 - protein, 9 aa, Homo Sapiens
YKLVVVGAC

SEQ ID NO: 864259 - protein, 9 aa, Homo Sapiens
AQLGLGALA

SEQ ID NO: 864260 - protein, 9 aa, Homo Sapiens
NDLEQVVRQ

SEQ ID NO: 864261 - protein, 9 aa, Homo Sapiens
SRQTLSEDS

SEQ ID NO: 864262 - protein, 9 aa, Homo Sapiens
LVVVGACGV

SEQ ID NO: 864263 - protein, 9 aa, Homo Sapiens
KEDSYENGP

SEQ ID NO: 864264 - protein, 9 aa, Homo Sapiens
IVVSRGCLR

SEQ ID NO: 864265 - protein, 9 aa, Homo Sapiens
GNRRRDGDW

SEQ ID NO: 864266 - protein, 9 aa, Homo Sapiens
ATCCYHSAL

SEQ ID NO: 864267 - protein, 9 aa, Homo Sapiens
DPQVLGGPS

SEQ ID NO: 864268 - protein, 9 aa, Homo Sapiens
KQMRLSGNK

SEQ ID NO: 864269 - protein, 9 aa, Homo Sapiens
WEEKAEYTL

SEQ ID NO: 864270 - protein, 9 aa, Homo Sapiens
LDQSSRIQS

SEQ ID NO: 864271 - protein, 9 aa, Homo Sapiens
SPTVKRLLG

SEQ ID NO: 864272 - protein, 9 aa, Homo Sapiens
LLKILVILL

SEQ ID NO: 864273 - protein, 9 aa, Homo Sapiens
MRTKQLQER

SEQ ID NO: 864274 - protein, 9 aa, Homo Sapiens
DGVSRCFHN

SEQ ID NO: 864275 - protein, 9 aa, Homo Sapiens
KSFTNAIQD

SEQ ID NO: 864276 - protein, 9 aa, Homo Sapiens
NWSSICNFP

SEQ ID NO: 864277 - protein, 9 aa, Homo Sapiens
LTIIPPNKG

SEQ ID NO: 864278 - protein, 9 aa, Homo Sapiens
SFRRQQKEK

SEQ ID NO: 864279 - protein, 9 aa, Homo Sapiens
RIQPSLTKN

SEQ ID NO: 864280 - protein, 9 aa, Homo Sapiens
RSPVTVMES

SEQ ID NO: 864281 - protein, 9 aa, Homo Sapiens
PSQQGQYNM

SEQ ID NO: 864282 - protein, 9 aa, Homo Sapiens
FKQREWKSI

SEQ ID NO: 864283 - protein, 9 aa, Homo Sapiens
FSKEASRQT

SEQ ID NO: 864284 - protein, 9 aa, Homo Sapiens
ASKFLPMSY

SEQ ID NO: 864285 - protein, 9 aa, Homo Sapiens
RPHNRDSIL

SEQ ID NO: 864286 - protein, 9 aa, Homo Sapiens
NAKCKKSWG

SEQ ID NO: 864287 - protein, 9 aa, Homo Sapiens
SNDFTKVEN

SEQ ID NO: 864288 - protein, 9 aa, Homo Sapiens
SHRSFTNMS

SEQ ID NO: 864289 - protein, 9 aa, Homo Sapiens
VKNHIFKHG

SEQ ID NO: 864290 - protein, 9 aa, Homo Sapiens
NFISAQTLT

SEQ ID NO: 864291 - protein, 9 aa, Homo Sapiens
PCSLCVSNG

SEQ ID NO: 864292 - protein, 9 aa, Homo Sapiens
PHNRPYFKR

SEQ ID NO: 864293 - protein, 9 aa, Homo Sapiens
CCQCRPGFQ

SEQ ID NO: 864294 - protein, 9 aa, Homo Sapiens
IELSYEDIQ

SEQ ID NO: 864295 - protein, 9 aa, Homo Sapiens
TSLLLSADW

SEQ ID NO: 864296 - protein, 9 aa, Homo Sapiens
SRGDSSKLR

SEQ ID NO: 864297 - protein, 9 aa, Homo Sapiens
FNVNYTQYL

SEQ ID NO: 864298 - protein, 9 aa, Homo Sapiens
RQIMLLNHP

SEQ ID NO: 864299 - protein, 9 aa, Homo Sapiens
ILTLVPVED

SEQ ID NO: 864300 - protein, 9 aa, Homo Sapiens
LVSWYLKEI

SEQ ID NO: 864301 - protein, 9 aa, Homo Sapiens
EDGPPELLC

SEQ ID NO: 864302 - protein, 9 aa, Homo Sapiens
DLLISQFRG

SEQ ID NO: 864303 - protein, 9 aa, Homo Sapiens
GADDTNEVK

SEQ ID NO: 864304 - protein, 9 aa, Homo Sapiens
KDMAFTHEG

SEQ ID NO: 864305 - protein, 9 aa, Homo Sapiens
FMDCSAPQL

SEQ ID NO: 864306 - protein, 9 aa, Homo Sapiens
INRETGTLL

SEQ ID NO: 864307 - protein, 9 aa, Homo Sapiens
QQFCVRDCR

SEQ ID NO: 864308 - protein, 9 aa, Homo Sapiens
QDLPVRSKF

SEQ ID NO: 864309 - protein, 9 aa, Homo Sapiens
NGYCNKCFQ

SEQ ID NO: 864310 - protein, 9 aa, Homo Sapiens
VGNCYFTSK

SEQ ID NO: 864311 - protein, 9 aa, Homo Sapiens
SSLSYLAAT

SEQ ID NO: 864312 - protein, 9 aa, Homo Sapiens
QDFQKLTTA

SEQ ID NO: 864313 - protein, 9 aa, Homo Sapiens
ELDVLQARV

SEQ ID NO: 864314 - protein, 9 aa, Homo Sapiens
RSVQQLQTS

SEQ ID NO: 864315 - protein, 9 aa, Homo Sapiens
DTTADYTTK

SEQ ID NO: 864316 - protein, 9 aa, Homo Sapiens
MSYLNEVHS

SEQ ID NO: 864317 - protein, 9 aa, Homo Sapiens
NFATMINFV

SEQ ID NO: 864318 - protein, 9 aa, Homo Sapiens
AVQNIQNVL

SEQ ID NO: 864319 - protein, 9 aa, Homo Sapiens
KCFGLLAGR

SEQ ID NO: 864320 - protein, 9 aa, Homo Sapiens
DRNTFQHSV

SEQ ID NO: 864321 - protein, 9 aa, Homo Sapiens
FSFDLQAKE

SEQ ID NO: 864322 - protein, 9 aa, Homo Sapiens
VRGSGKGGP

SEQ ID NO: 864323 - protein, 9 aa, Homo Sapiens
KSNPRGPSP

SEQ ID NO: 864324 - protein, 9 aa, Homo Sapiens
VIYVIFGLC

SEQ ID NO: 864325 - protein, 9 aa, Homo Sapiens
INFMLRRHI

SEQ ID NO: 864326 - protein, 9 aa, Homo Sapiens
QKSRTEGEH

SEQ ID NO: 864327 - protein, 9 aa, Homo Sapiens
DSSKLRPDD

SEQ ID NO: 864328 - protein, 9 aa, Homo Sapiens
PKSLSSGLQ

SEQ ID NO: 864329 - protein, 9 aa, Homo Sapiens
SSKKAIEDR

SEQ ID NO: 864330 - protein, 9 aa, Homo Sapiens
LSPPHPALS

SEQ ID NO: 864331 - protein, 9 aa, Homo Sapiens
VNSEDIFIL

SEQ ID NO: 864332 - protein, 9 aa, Homo Sapiens
EGANDFVVA

SEQ ID NO: 864333 - protein, 9 aa, Homo Sapiens
FWLNAADTW

SEQ ID NO: 864334 - protein, 9 aa, Homo Sapiens
TCDLNTSPY

SEQ ID NO: 864335 - protein, 9 aa, Homo Sapiens
TYTGMKEQK

SEQ ID NO: 864336 - protein, 9 aa, Homo Sapiens
LTGKECEDS

SEQ ID NO: 864337 - protein, 9 aa, Homo Sapiens
NNNNIDDIT

SEQ ID NO: 864338 - protein, 9 aa, Homo Sapiens
PSVITKLCK

SEQ ID NO: 864339 - protein, 9 aa, Homo Sapiens
SSICNFPSA

SEQ ID NO: 864340 - protein, 9 aa, Homo Sapiens
HTGDKPFGC

SEQ ID NO: 864341 - protein, 9 aa, Homo Sapiens
LNGAVPLGL

SEQ ID NO: 864342 - protein, 9 aa, Homo Sapiens
QGSGSHPDL

SEQ ID NO: 864343 - protein, 9 aa, Homo Sapiens
IIGFAAEQL

SEQ ID NO: 864344 - protein, 9 aa, Homo Sapiens
TLACQQFCV

SEQ ID NO: 864345 - protein, 9 aa, Homo Sapiens
LLKQKENKN

SEQ ID NO: 864346 - protein, 9 aa, Homo Sapiens
EGNVVYKLF

SEQ ID NO: 864347 - protein, 9 aa, Homo Sapiens
DLKADKPSS

SEQ ID NO: 864348 - protein, 9 aa, Homo Sapiens
RTHYDPPQK

SEQ ID NO: 864349 - protein, 9 aa, Homo Sapiens
PSQKEVKIL

SEQ ID NO: 864350 - protein, 9 aa, Homo Sapiens
INHVISVNP

SEQ ID NO: 864351 - protein, 9 aa, Homo Sapiens
SQQTGIFCV

SEQ ID NO: 864352 - protein, 9 aa, Homo Sapiens
IKDGQTSGT

SEQ ID NO: 864353 - protein, 9 aa, Homo Sapiens
KAEFRVFCL

SEQ ID NO: 864354 - protein, 9 aa, Homo Sapiens
VVIRIPVIC

SEQ ID NO: 864355 - protein, 9 aa, Homo Sapiens
QGENPKGKN

SEQ ID NO: 864356 - protein, 9 aa, Homo Sapiens
NIFAITFQY

SEQ ID NO: 864357 - protein, 9 aa, Homo Sapiens
SCLQDQQSN

SEQ ID NO: 864358 - protein, 9 aa, Homo Sapiens
HAQMPDLLR

SEQ ID NO: 864359 - protein, 9 aa, Homo Sapiens
RHWSSKINL

SEQ ID NO: 864360 - protein, 9 aa, Homo Sapiens
TVKGFASDC

SEQ ID NO: 864361 - protein, 9 aa, Homo Sapiens
EQFLLHLLL

SEQ ID NO: 864362 - protein, 9 aa, Homo Sapiens
PLALIVDSS

SEQ ID NO: 864363 - protein, 9 aa, Homo Sapiens
QPLNRRAIH

SEQ ID NO: 864364 - protein, 9 aa, Homo Sapiens
VEWKPFNIL

SEQ ID NO: 864365 - protein, 9 aa, Homo Sapiens
AAYDDSDSE

SEQ ID NO: 864366 - protein, 9 aa, Homo Sapiens
TTAEDIKQF

SEQ ID NO: 864367 - protein, 9 aa, Homo Sapiens
LECSLSMWS

SEQ ID NO: 864368 - protein, 9 aa, Homo Sapiens
TYCLNPQEY

SEQ ID NO: 864369 - protein, 9 aa, Homo Sapiens
AGQITTIYK

SEQ ID NO: 864370 - protein, 9 aa, Homo Sapiens
NHHNVGMAC

SEQ ID NO: 864371 - protein, 9 aa, Homo Sapiens
DKVKARLQK

SEQ ID NO: 864372 - protein, 9 aa, Homo Sapiens
YADHHYGAR

SEQ ID NO: 864373 - protein, 9 aa, Homo Sapiens
CRGLRAISV

SEQ ID NO: 864374 - protein, 9 aa, Homo Sapiens
GGGVRICSV

SEQ ID NO: 864375 - protein, 9 aa, Homo Sapiens
KTDNNIVVY

SEQ ID NO: 864376 - protein, 9 aa, Homo Sapiens
IRLRHRRSH

SEQ ID NO: 864377 - protein, 9 aa, Homo Sapiens
CHQEHKQLL

SEQ ID NO: 864378 - protein, 9 aa, Homo Sapiens
DSESRWRLD

SEQ ID NO: 864379 - protein, 9 aa, Homo Sapiens
VLQGFDQLQ

SEQ ID NO: 864380 - protein, 9 aa, Homo Sapiens
EELPELSCG

SEQ ID NO: 864381 - protein, 9 aa, Homo Sapiens
EMNRHSNEW

SEQ ID NO: 864382 - protein, 9 aa, Homo Sapiens
IAISSLTYP

SEQ ID NO: 864383 - protein, 9 aa, Homo Sapiens
TLFFGPCMF

SEQ ID NO: 864384 - protein, 9 aa, Homo Sapiens
SNPCTSCAP

SEQ ID NO: 864385 - protein, 9 aa, Homo Sapiens
KLSVNNKSP

SEQ ID NO: 864386 - protein, 9 aa, Homo Sapiens
NFDRDNVRI

SEQ ID NO: 864387 - protein, 9 aa, Homo Sapiens
LSFKKGEIF

SEQ ID NO: 864388 - protein, 9 aa, Homo Sapiens
NQAVSLDSP

SEQ ID NO: 864389 - protein, 9 aa, Homo Sapiens
LSCGSPLTL

SEQ ID NO: 864390 - protein, 9 aa, Homo Sapiens
RHQIIHTME

SEQ ID NO: 864391 - protein, 9 aa, Homo Sapiens
PAADVLKYF

SEQ ID NO: 864392 - protein, 9 aa, Homo Sapiens
DYKKERICK

SEQ ID NO: 864393 - protein, 9 aa, Homo Sapiens
KEQFHYFII

SEQ ID NO: 864394 - protein, 9 aa, Homo Sapiens
YPVQSAYPQ

SEQ ID NO: 864395 - protein, 9 aa, Homo Sapiens
CLHRRRRQE

SEQ ID NO: 864396 - protein, 9 aa, Homo Sapiens
PIKINSIFN

SEQ ID NO: 864397 - protein, 9 aa, Homo Sapiens
INNNNIDDI

SEQ ID NO: 864398 - protein, 9 aa, Homo Sapiens
VQTGNDVLK

SEQ ID NO: 864399 - protein, 9 aa, Homo Sapiens
LYSLNQTLK

SEQ ID NO: 864400 - protein, 9 aa, Homo Sapiens
AEMNRHSNE

SEQ ID NO: 864401 - protein, 9 aa, Homo Sapiens
QKGKYVKKE

SEQ ID NO: 864402 - protein, 9 aa, Homo Sapiens
HKVHFTCNP

SEQ ID NO: 864403 - protein, 9 aa, Homo Sapiens
LCTENEIFF

SEQ ID NO: 864404 - protein, 9 aa, Homo Sapiens
FWGRDVLDL

SEQ ID NO: 864405 - protein, 9 aa, Homo Sapiens
FNPSLYKAM

SEQ ID NO: 864406 - protein, 9 aa, Homo Sapiens
TSNVFIVIA

SEQ ID NO: 864407 - protein, 9 aa, Homo Sapiens
LQNWQKSSS

SEQ ID NO: 864408 - protein, 9 aa, Homo Sapiens
NGTVWSEIG

SEQ ID NO: 864409 - protein, 9 aa, Homo Sapiens
KVVFNKIGN

SEQ ID NO: 864410 - protein, 9 aa, Homo Sapiens
RTHYYETYI

SEQ ID NO: 864411 - protein, 9 aa, Homo Sapiens
KYHERPLPA

SEQ ID NO: 864412 - protein, 9 aa, Homo Sapiens
LAYVLASRE

SEQ ID NO: 864413 - protein, 9 aa, Homo Sapiens
GTPFLPIQA

SEQ ID NO: 864414 - protein, 9 aa, Homo Sapiens
MMTTALMSS

SEQ ID NO: 864415 - protein, 9 aa, Homo Sapiens
GRITLFREA

SEQ ID NO: 864416 - protein, 9 aa, Homo Sapiens
LIEAIWLYL

SEQ ID NO: 864417 - protein, 9 aa, Homo Sapiens
NNFWLLQNS

SEQ ID NO: 864418 - protein, 9 aa, Homo Sapiens
QLQIRGLPV

SEQ ID NO: 864419 - protein, 9 aa, Homo Sapiens
AEAVHLFCN

SEQ ID NO: 864420 - protein, 9 aa, Homo Sapiens
ESKEGTEVS

SEQ ID NO: 864421 - protein, 9 aa, Homo Sapiens
RSEVCIYYD

SEQ ID NO: 864422 - protein, 9 aa, Homo Sapiens
NKTNIRIME

SEQ ID NO: 864423 - protein, 9 aa, Homo Sapiens
ATNNPRFGK

SEQ ID NO: 864424 - protein, 9 aa, Homo Sapiens
IIGLVSVII

SEQ ID NO: 864425 - protein, 9 aa, Homo Sapiens
LEGNQIEII

SEQ ID NO: 864426 - protein, 9 aa, Homo Sapiens
PQAWALFPP

SEQ ID NO: 864427 - protein, 9 aa, Homo Sapiens
TWGPRGDPG

SEQ ID NO: 864428 - protein, 9 aa, Homo Sapiens
NSGRDDSEN

SEQ ID NO: 864429 - protein, 9 aa, Homo Sapiens
KKNDTLDPK

SEQ ID NO: 864430 - protein, 9 aa, Homo Sapiens
LEASDYKYF

SEQ ID NO: 864431 - protein, 9 aa, Homo Sapiens
MNQTRIIDS

SEQ ID NO: 864432 - protein, 9 aa, Homo Sapiens
TSKRFSSLH

SEQ ID NO: 864433 - protein, 9 aa, Homo Sapiens
SSSSSSYSS

SEQ ID NO: 864434 - protein, 9 aa, Homo Sapiens
CWVFAYVMC

SEQ ID NO: 864435 - protein, 9 aa, Homo Sapiens
DLKICGFGL

SEQ ID NO: 864436 - protein, 9 aa, Homo Sapiens
LLLNTFQEL

SEQ ID NO: 864437 - protein, 9 aa, Homo Sapiens
RKKQELAFH

SEQ ID NO: 864438 - protein, 9 aa, Homo Sapiens
KYKFWNHIV

SEQ ID NO: 864439 - protein, 9 aa, Homo Sapiens
HIKKEQEEE

SEQ ID NO: 864440 - protein, 9 aa, Homo Sapiens
IWFMLETML

SEQ ID NO: 864441 - protein, 9 aa, Homo Sapiens
PDINKNVQK

SEQ ID NO: 864442 - protein, 9 aa, Homo Sapiens
NACDQPLDD

SEQ ID NO: 864443 - protein, 9 aa, Homo Sapiens
VDFSQEEWI

SEQ ID NO: 864444 - protein, 9 aa, Homo Sapiens
SSKFQEGVE

SEQ ID NO: 864445 - protein, 9 aa, Homo Sapiens
CTVDSYDPV

SEQ ID NO: 864446 - protein, 9 aa, Homo Sapiens
PRRYRAPNH

SEQ ID NO: 864447 - protein, 9 aa, Homo Sapiens
ASLQQGCWD

SEQ ID NO: 864448 - protein, 9 aa, Homo Sapiens
AVNGVDYSD

SEQ ID NO: 864449 - protein, 9 aa, Homo Sapiens
KCVKDADYS

SEQ ID NO: 864450 - protein, 9 aa, Homo Sapiens
VHASCALLC

SEQ ID NO: 864451 - protein, 9 aa, Homo Sapiens
LNNLMSRAQ

SEQ ID NO: 864452 - protein, 9 aa, Homo Sapiens
AHQTNKQEK

SEQ ID NO: 864453 - protein, 9 aa, Homo Sapiens
NKHGRAVCC

SEQ ID NO: 864454 - protein, 9 aa, Homo Sapiens
WLRTIFIIL

SEQ ID NO: 864455 - protein, 9 aa, Homo Sapiens
DGPFGLSPL

SEQ ID NO: 864456 - protein, 9 aa, Homo Sapiens
QICTSQLKW

SEQ ID NO: 864457 - protein, 9 aa, Homo Sapiens
GEAELWRAM

SEQ ID NO: 864458 - protein, 9 aa, Homo Sapiens
ESVLINILE

SEQ ID NO: 864459 - protein, 9 aa, Homo Sapiens
SKSRAFIIE

SEQ ID NO: 864460 - protein, 9 aa, Homo Sapiens
KKNEIQKLG

SEQ ID NO: 864461 - protein, 9 aa, Homo Sapiens
GRPNKEELD

SEQ ID NO: 864462 - protein, 9 aa, Homo Sapiens
KFELDRICG

SEQ ID NO: 864463 - protein, 9 aa, Homo Sapiens
VDTTVDEDV

SEQ ID NO: 864464 - protein, 9 aa, Homo Sapiens
TKNGVFSAL

SEQ ID NO: 864465 - protein, 9 aa, Homo Sapiens
DQIDNGFFY

SEQ ID NO: 864466 - protein, 9 aa, Homo Sapiens
MKPRVIKEA

SEQ ID NO: 864467 - protein, 9 aa, Homo Sapiens
PHIHRWTIL

SEQ ID NO: 864468 - protein, 9 aa, Homo Sapiens
ARREYPFSP

SEQ ID NO: 864469 - protein, 9 aa, Homo Sapiens
QINKLCVSA

SEQ ID NO: 864470 - protein, 9 aa, Homo Sapiens
TYIQQEYET

SEQ ID NO: 864471 - protein, 9 aa, Homo Sapiens
SHVIYTDYR

SEQ ID NO: 864472 - protein, 9 aa, Homo Sapiens
SKNDQLRIY

SEQ ID NO: 864473 - protein, 9 aa, Homo Sapiens
NMVLAYVLA

SEQ ID NO: 864474 - protein, 9 aa, Homo Sapiens
FSSNLIDKI

SEQ ID NO: 864475 - protein, 9 aa, Homo Sapiens
LIDKISKEF

SEQ ID NO: 864476 - protein, 9 aa, Homo Sapiens
IATAFGHMP

SEQ ID NO: 864477 - protein, 9 aa, Homo Sapiens
YERSVKRIK

SEQ ID NO: 864478 - protein, 9 aa, Homo Sapiens
MAQFLAQFS

SEQ ID NO: 864479 - protein, 9 aa, Homo Sapiens
PFDIGFKGI

SEQ ID NO: 864480 - protein, 9 aa, Homo Sapiens
SLTEHQIIH

SEQ ID NO: 864481 - protein, 9 aa, Homo Sapiens
ELCKILCMP

SEQ ID NO: 864482 - protein, 9 aa, Homo Sapiens
AAHTTPPVL

SEQ ID NO: 864483 - protein, 9 aa, Homo Sapiens
LRFQLGYHA

SEQ ID NO: 864484 - protein, 9 aa, Homo Sapiens
ATELLQSQV

SEQ ID NO: 864485 - protein, 9 aa, Homo Sapiens
NKYIQIHTG

SEQ ID NO: 864486 - protein, 9 aa, Homo Sapiens
ATSADRFYQ

SEQ ID NO: 864487 - protein, 9 aa, Homo Sapiens
SKTVVQVAE

SEQ ID NO: 864488 - protein, 9 aa, Homo Sapiens
ENYQKNGTA

SEQ ID NO: 864489 - protein, 9 aa, Homo Sapiens
DVIWRFQPN

SEQ ID NO: 864490 - protein, 9 aa, Homo Sapiens
TIQDPQKKS

SEQ ID NO: 864491 - protein, 9 aa, Homo Sapiens
KESGSCTGW

SEQ ID NO: 864492 - protein, 9 aa, Homo Sapiens
NPAGEVSTP

SEQ ID NO: 864493 - protein, 9 aa, Homo Sapiens
VDIEGNVVA

SEQ ID NO: 864494 - protein, 9 aa, Homo Sapiens
RNKELKVTM

SEQ ID NO: 864495 - protein, 9 aa, Homo Sapiens
TTALDLEWD

SEQ ID NO: 864496 - protein, 9 aa, Homo Sapiens
SDNPSKNHS

SEQ ID NO: 864497 - protein, 9 aa, Homo Sapiens
LARMREYEC

SEQ ID NO: 864498 - protein, 9 aa, Homo Sapiens
WEPNDLALF

SEQ ID NO: 864499 - protein, 9 aa, Homo Sapiens
RQIAHGADA

SEQ ID NO: 864500 - protein, 9 aa, Homo Sapiens
SQEDVNSWK

SEQ ID NO: 864501 - protein, 9 aa, Homo Sapiens
QTFRVLRAL

SEQ ID NO: 864502 - protein, 9 aa, Homo Sapiens
TMMMGIIKR

SEQ ID NO: 864503 - protein, 9 aa, Homo Sapiens
ISYEDFLSA

SEQ ID NO: 864504 - protein, 9 aa, Homo Sapiens
YKTKMRSSG

SEQ ID NO: 864505 - protein, 9 aa, Homo Sapiens
QRFEEYLNL

SEQ ID NO: 864506 - protein, 9 aa, Homo Sapiens
RKSMLDAEP

SEQ ID NO: 864507 - protein, 9 aa, Homo Sapiens
IWFIRKNKP

SEQ ID NO: 864508 - protein, 9 aa, Homo Sapiens
NADSGYNAW

SEQ ID NO: 864509 - protein, 9 aa, Homo Sapiens
FIECNGRGT

SEQ ID NO: 864510 - protein, 9 aa, Homo Sapiens
TINQREKDC

SEQ ID NO: 864511 - protein, 9 aa, Homo Sapiens
YDKVKTMSE

SEQ ID NO: 864512 - protein, 9 aa, Homo Sapiens
GKIVGHGNG

SEQ ID NO: 864513 - protein, 9 aa, Homo Sapiens
QKKSTTLSG

SEQ ID NO: 864514 - protein, 9 aa, Homo Sapiens
PHCHIPIKI

SEQ ID NO: 864515 - protein, 9 aa, Homo Sapiens
GDYNDSAFM

SEQ ID NO: 864516 - protein, 9 aa, Homo Sapiens
EGYKVSQKE

SEQ ID NO: 864517 - protein, 9 aa, Homo Sapiens
TGMGVQNGT

SEQ ID NO: 864518 - protein, 9 aa, Homo Sapiens
FSVILHYLS

SEQ ID NO: 864519 - protein, 9 aa, Homo Sapiens
EGKAALRGE

SEQ ID NO: 864520 - protein, 9 aa, Homo Sapiens
ENVWWITGT

SEQ ID NO: 864521 - protein, 9 aa, Homo Sapiens
TFNLFNICQ

SEQ ID NO: 864522 - protein, 9 aa, Homo Sapiens
IATVINLSK

SEQ ID NO: 864523 - protein, 9 aa, Homo Sapiens
LDATTASHF

SEQ ID NO: 864524 - protein, 9 aa, Homo Sapiens
GKRGVHEIR

SEQ ID NO: 864525 - protein, 9 aa, Homo Sapiens
TFSNLTLNK

SEQ ID NO: 864526 - protein, 9 aa, Homo Sapiens
CKLQSGNQQ

SEQ ID NO: 864527 - protein, 9 aa, Homo Sapiens
LHIMENYCL

SEQ ID NO: 864528 - protein, 9 aa, Homo Sapiens
PVPLAATSY

SEQ ID NO: 864529 - protein, 9 aa, Homo Sapiens
STLTTPGLT

SEQ ID NO: 864530 - protein, 9 aa, Homo Sapiens
VEKAMGNKM

SEQ ID NO: 864531 - protein, 9 aa, Homo Sapiens
QEAFQIIRG

SEQ ID NO: 864532 - protein, 9 aa, Homo Sapiens
RQEKRMLKA

SEQ ID NO: 864533 - protein, 9 aa, Homo Sapiens
EGVDSSGKT

SEQ ID NO: 864534 - protein, 9 aa, Homo Sapiens
KLPVLAPQW

SEQ ID NO: 864535 - protein, 9 aa, Homo Sapiens
YECYSDASV

SEQ ID NO: 864536 - protein, 9 aa, Homo Sapiens
KVKTHLRCQ

SEQ ID NO: 864537 - protein, 9 aa, Homo Sapiens
QNFLALDPT

SEQ ID NO: 864538 - protein, 9 aa, Homo Sapiens
GYHGDDGHL

SEQ ID NO: 864539 - protein, 9 aa, Homo Sapiens
DPQGIYAIS

SEQ ID NO: 864540 - protein, 9 aa, Homo Sapiens
ALLGSTGEQ

SEQ ID NO: 864541 - protein, 9 aa, Homo Sapiens
YLHVADNNE

SEQ ID NO: 864542 - protein, 9 aa, Homo Sapiens
LNFISAQTL

SEQ ID NO: 864543 - protein, 9 aa, Homo Sapiens
LETLNARAV

SEQ ID NO: 864544 - protein, 9 aa, Homo Sapiens
ARYDRRHEP

SEQ ID NO: 864545 - protein, 9 aa, Homo Sapiens
KDRKKIQLS

SEQ ID NO: 864546 - protein, 9 aa, Homo Sapiens
KTTIKVWFQ

SEQ ID NO: 864547 - protein, 9 aa, Homo Sapiens
EDAWMDTHP

SEQ ID NO: 864548 - protein, 9 aa, Homo Sapiens
IANLFSPLN

SEQ ID NO: 864549 - protein, 9 aa, Homo Sapiens
EEAILNMVV

SEQ ID NO: 864550 - protein, 9 aa, Homo Sapiens
NKEGSKQAQ

SEQ ID NO: 864551 - protein, 9 aa, Homo Sapiens
NCLCYLFLA

SEQ ID NO: 864552 - protein, 9 aa, Homo Sapiens
SENNSNNEV

SEQ ID NO: 864553 - protein, 9 aa, Homo Sapiens
QIETKTKDK

SEQ ID NO: 864554 - protein, 9 aa, Homo Sapiens
AAIMTNSQG

SEQ ID NO: 864555 - protein, 9 aa, Homo Sapiens
CDALVQLIE

SEQ ID NO: 864556 - protein, 9 aa, Homo Sapiens
EQRKKICEQ

SEQ ID NO: 864557 - protein, 9 aa, Homo Sapiens
TILQYYCCM

SEQ ID NO: 864558 - protein, 9 aa, Homo Sapiens
FSILNDNDN

SEQ ID NO: 864559 - protein, 9 aa, Homo Sapiens
LIGNKSKGE

SEQ ID NO: 864560 - protein, 9 aa, Homo Sapiens
SQTDGVLFC

SEQ ID NO: 864561 - protein, 9 aa, Homo Sapiens
NQRNVWFAE

SEQ ID NO: 864562 - protein, 9 aa, Homo Sapiens
QGKLIPPVL

SEQ ID NO: 864563 - protein, 9 aa, Homo Sapiens
VETDNWDGP

SEQ ID NO: 864564 - protein, 9 aa, Homo Sapiens
FSPDGHLHR

SEQ ID NO: 864565 - protein, 9 aa, Homo Sapiens
NIHGKLCIC

SEQ ID NO: 864566 - protein, 9 aa, Homo Sapiens
SCETRVNLC

SEQ ID NO: 864567 - protein, 9 aa, Homo Sapiens
CECLVKEGR

SEQ ID NO: 864568 - protein, 9 aa, Homo Sapiens
SCFKDGVQQ

SEQ ID NO: 864569 - protein, 9 aa, Homo Sapiens
DHVKKDYLR

SEQ ID NO: 864570 - protein, 9 aa, Homo Sapiens
GKGVALITA

SEQ ID NO: 864571 - protein, 9 aa, Homo Sapiens
LESLNFSVS

SEQ ID NO: 864572 - protein, 9 aa, Homo Sapiens
ADSKKRIQM

SEQ ID NO: 864573 - protein, 9 aa, Homo Sapiens
VTTIPIVLL

SEQ ID NO: 864574 - protein, 9 aa, Homo Sapiens
HPDRTHTQI

SEQ ID NO: 864575 - protein, 9 aa, Homo Sapiens
LLLSIAVAA

SEQ ID NO: 864576 - protein, 9 aa, Homo Sapiens
KAFFSPSLL

SEQ ID NO: 864577 - protein, 9 aa, Homo Sapiens
VAQSNSALI

SEQ ID NO: 864578 - protein, 9 aa, Homo Sapiens
KHLRIHSGE

SEQ ID NO: 864579 - protein, 9 aa, Homo Sapiens
WGQPQIQPF

SEQ ID NO: 864580 - protein, 9 aa, Homo Sapiens
LWLRNNPIK

SEQ ID NO: 864581 - protein, 9 aa, Homo Sapiens
AWQRCCPQL

SEQ ID NO: 864582 - protein, 9 aa, Homo Sapiens
TLANNQRNV

SEQ ID NO: 864583 - protein, 9 aa, Homo Sapiens
DNDDLQTTA

SEQ ID NO: 864584 - protein, 9 aa, Homo Sapiens
DWNKSICKV

SEQ ID NO: 864585 - protein, 9 aa, Homo Sapiens
AIKQNARWS

SEQ ID NO: 864586 - protein, 9 aa, Homo Sapiens
KKYSKQVDN

SEQ ID NO: 864587 - protein, 9 aa, Homo Sapiens
PLLVFADMQ

SEQ ID NO: 864588 - protein, 9 aa, Homo Sapiens
AQIVKLFLS

SEQ ID NO: 864589 - protein, 9 aa, Homo Sapiens
KAFWLPDNR

SEQ ID NO: 864590 - protein, 9 aa, Homo Sapiens
TKILAETKL

SEQ ID NO: 864591 - protein, 9 aa, Homo Sapiens
ESQKKSTTL

SEQ ID NO: 864592 - protein, 9 aa, Homo Sapiens
QIIKEKEEA

SEQ ID NO: 864593 - protein, 9 aa, Homo Sapiens
FDIGFKGIG

SEQ ID NO: 864594 - protein, 9 aa, Homo Sapiens
VLKQKEYCG

SEQ ID NO: 864595 - protein, 9 aa, Homo Sapiens
QHLNQKGKA

SEQ ID NO: 864596 - protein, 9 aa, Homo Sapiens
LFAVHHSSL

SEQ ID NO: 864597 - protein, 9 aa, Homo Sapiens
NLYIKNGQG

SEQ ID NO: 864598 - protein, 9 aa, Homo Sapiens
DTIQNQVRK

SEQ ID NO: 864599 - protein, 9 aa, Homo Sapiens
SGLYGLSWY

SEQ ID NO: 864600 - protein, 9 aa, Homo Sapiens
SRSPRISLS

SEQ ID NO: 864601 - protein, 9 aa, Homo Sapiens
IKCDKIQVD

SEQ ID NO: 864602 - protein, 9 aa, Homo Sapiens
CILCDTSED

SEQ ID NO: 864603 - protein, 9 aa, Homo Sapiens
AIKTILRLK

SEQ ID NO: 864604 - protein, 9 aa, Homo Sapiens
YWLFIILNF

SEQ ID NO: 864605 - protein, 9 aa, Homo Sapiens
GEWANAPWD

SEQ ID NO: 864606 - protein, 9 aa, Homo Sapiens
QHTNQTEAF

SEQ ID NO: 864607 - protein, 9 aa, Homo Sapiens
VQRVPRNRN

SEQ ID NO: 864608 - protein, 9 aa, Homo Sapiens
RLLPRGNGY

SEQ ID NO: 864609 - protein, 9 aa, Homo Sapiens
CRASNNPKR

SEQ ID NO: 864610 - protein, 9 aa, Homo Sapiens
LQVQHFGVF

SEQ ID NO: 864611 - protein, 9 aa, Homo Sapiens
KMNIKLTQL

SEQ ID NO: 864612 - protein, 9 aa, Homo Sapiens
VTIYLGNRY

SEQ ID NO: 864613 - protein, 9 aa, Homo Sapiens
RDNAAYFFW

SEQ ID NO: 864614 - protein, 9 aa, Homo Sapiens
KLSVCMTLY

SEQ ID NO: 864615 - protein, 9 aa, Homo Sapiens
IKKEDSGIP

SEQ ID NO: 864616 - protein, 9 aa, Homo Sapiens
VCYNAEKKK

SEQ ID NO: 864617 - protein, 9 aa, Homo Sapiens
ITVHPKEIW

SEQ ID NO: 864618 - protein, 9 aa, Homo Sapiens
LFTAVSLLN

SEQ ID NO: 864619 - protein, 9 aa, Homo Sapiens
QTLAMVVAS

SEQ ID NO: 864620 - protein, 9 aa, Homo Sapiens
DISRTLGVA

SEQ ID NO: 864621 - protein, 9 aa, Homo Sapiens
AKEAITALY

SEQ ID NO: 864622 - protein, 9 aa, Homo Sapiens
RHLPKLGQS

SEQ ID NO: 864623 - protein, 9 aa, Homo Sapiens
VTAQACLDE

SEQ ID NO: 864624 - protein, 9 aa, Homo Sapiens
PGSNVRLHP

SEQ ID NO: 864625 - protein, 9 aa, Homo Sapiens
TNNSPLMED

SEQ ID NO: 864626 - protein, 9 aa, Homo Sapiens
NVKVLLSNI

SEQ ID NO: 864627 - protein, 9 aa, Homo Sapiens
DISLQGNYP

SEQ ID NO: 864628 - protein, 9 aa, Homo Sapiens
FLSLEPQDQ

SEQ ID NO: 864629 - protein, 9 aa, Homo Sapiens
RRQNGYRAL

SEQ ID NO: 864630 - protein, 9 aa, Homo Sapiens
LLCMYQNAT

SEQ ID NO: 864631 - protein, 9 aa, Homo Sapiens
HFQWANTGA

SEQ ID NO: 864632 - protein, 9 aa, Homo Sapiens
SLAPFISPQ

SEQ ID NO: 864633 - protein, 9 aa, Homo Sapiens
ISSVFSLGS

SEQ ID NO: 864634 - protein, 9 aa, Homo Sapiens
RVYTGEKPY

SEQ ID NO: 864635 - protein, 9 aa, Homo Sapiens
LDKRFQKVG

SEQ ID NO: 864636 - protein, 9 aa, Homo Sapiens
NNSNKFKHK

SEQ ID NO: 864637 - protein, 9 aa, Homo Sapiens
QTLQSLQRT

SEQ ID NO: 864638 - protein, 9 aa, Homo Sapiens
VSFAYPNHP

SEQ ID NO: 864639 - protein, 9 aa, Homo Sapiens
PYVLRNEVI

SEQ ID NO: 864640 - protein, 9 aa, Homo Sapiens
KLEGHKLPN

SEQ ID NO: 864641 - protein, 9 aa, Homo Sapiens
SCLSSSHPQ

SEQ ID NO: 864642 - protein, 9 aa, Homo Sapiens
SPNKHSIYI

SEQ ID NO: 864643 - protein, 9 aa, Homo Sapiens
WIRIYPDMS

SEQ ID NO: 864644 - protein, 9 aa, Homo Sapiens
DENIRYKYP

SEQ ID NO: 864645 - protein, 9 aa, Homo Sapiens
EERLLKQEE

SEQ ID NO: 864646 - protein, 9 aa, Homo Sapiens
VLPSRVQKS

SEQ ID NO: 864647 - protein, 9 aa, Homo Sapiens
GQCWVFAYV

SEQ ID NO: 864648 - protein, 9 aa, Homo Sapiens
LQDWASFIR

SEQ ID NO: 864649 - protein, 9 aa, Homo Sapiens
AYVWVPIEQ

SEQ ID NO: 864650 - protein, 9 aa, Homo Sapiens
TAADFIHRV

SEQ ID NO: 864651 - protein, 9 aa, Homo Sapiens
PKSSVLRVP

SEQ ID NO: 864652 - protein, 9 aa, Homo Sapiens
VNFCYSSVI

SEQ ID NO: 864653 - protein, 9 aa, Homo Sapiens
MMSSVAPAS

SEQ ID NO: 864654 - protein, 9 aa, Homo Sapiens
YHSSEVRLK

SEQ ID NO: 864655 - protein, 9 aa, Homo Sapiens
EGTHDYGRI

SEQ ID NO: 864656 - protein, 9 aa, Homo Sapiens
KTLSPQTLQ

SEQ ID NO: 864657 - protein, 9 aa, Homo Sapiens
DNFELVKKF

SEQ ID NO: 864658 - protein, 9 aa, Homo Sapiens
VQQANGNMQ

SEQ ID NO: 864659 - protein, 9 aa, Homo Sapiens
LPYADHHYG

SEQ ID NO: 864660 - protein, 9 aa, Homo Sapiens
GTEEDPVLS

SEQ ID NO: 864661 - protein, 9 aa, Homo Sapiens
ELKSRSVKL

SEQ ID NO: 864662 - protein, 9 aa, Homo Sapiens
LDALGHKLP

SEQ ID NO: 864663 - protein, 9 aa, Homo Sapiens
CISHKKLEH

SEQ ID NO: 864664 - protein, 9 aa, Homo Sapiens
TMQIIFRHL

SEQ ID NO: 864665 - protein, 9 aa, Homo Sapiens
FKGHPNLIM

SEQ ID NO: 864666 - protein, 9 aa, Homo Sapiens
DIENAVESG

SEQ ID NO: 864667 - protein, 9 aa, Homo Sapiens
YECEIWNPV

SEQ ID NO: 864668 - protein, 9 aa, Homo Sapiens
ARAGTMALA

SEQ ID NO: 864669 - protein, 9 aa, Homo Sapiens
PRRPHNRDS

SEQ ID NO: 864670 - protein, 9 aa, Homo Sapiens
DFLDLIFQL

SEQ ID NO: 864671 - protein, 9 aa, Homo Sapiens
DESIPFWTF

SEQ ID NO: 864672 - protein, 9 aa, Homo Sapiens
VTLSQRFIP

SEQ ID NO: 864673 - protein, 9 aa, Homo Sapiens
PETGRSRLI

SEQ ID NO: 864674 - protein, 9 aa, Homo Sapiens
IKAVFKHEG

SEQ ID NO: 864675 - protein, 9 aa, Homo Sapiens
TSCDNLVAK

SEQ ID NO: 864676 - protein, 9 aa, Homo Sapiens
PVNVTLRQI

SEQ ID NO: 864677 - protein, 9 aa, Homo Sapiens
FKPESSYPV

SEQ ID NO: 864678 - protein, 9 aa, Homo Sapiens
VNKLHPQQV

SEQ ID NO: 864679 - protein, 9 aa, Homo Sapiens
AVNNYIVNK

SEQ ID NO: 864680 - protein, 9 aa, Homo Sapiens
LGRQCWKLK

SEQ ID NO: 864681 - protein, 9 aa, Homo Sapiens
WGDYDNSAF

SEQ ID NO: 864682 - protein, 9 aa, Homo Sapiens
NGNMQLCEQ

SEQ ID NO: 864683 - protein, 9 aa, Homo Sapiens
IVPRHLFQI

SEQ ID NO: 864684 - protein, 9 aa, Homo Sapiens
SSPINGLQD

SEQ ID NO: 864685 - protein, 9 aa, Homo Sapiens
ESQSSENDG

SEQ ID NO: 864686 - protein, 9 aa, Homo Sapiens
INMLLKFKD

SEQ ID NO: 864687 - protein, 9 aa, Homo Sapiens
KTKLQQPVS

SEQ ID NO: 864688 - protein, 9 aa, Homo Sapiens
VTPDKDDHL

SEQ ID NO: 864689 - protein, 9 aa, Homo Sapiens
SDLLRHHII

SEQ ID NO: 864690 - protein, 9 aa, Homo Sapiens
SLLSHNKFW

SEQ ID NO: 864691 - protein, 9 aa, Homo Sapiens
SVVAIMAID

SEQ ID NO: 864692 - protein, 9 aa, Homo Sapiens
LSMIRASRN

SEQ ID NO: 864693 - protein, 9 aa, Homo Sapiens
LVFLFMQYC

SEQ ID NO: 864694 - protein, 9 aa, Homo Sapiens
RAGDIGGAT

SEQ ID NO: 864695 - protein, 9 aa, Homo Sapiens
AGNESGLEL

SEQ ID NO: 864696 - protein, 9 aa, Homo Sapiens
HKCKCRNHD

SEQ ID NO: 864697 - protein, 9 aa, Homo Sapiens
RIEIIQVPG

SEQ ID NO: 864698 - protein, 9 aa, Homo Sapiens
NVSESLGEQ

SEQ ID NO: 864699 - protein, 9 aa, Homo Sapiens
PVVTTLHSA

SEQ ID NO: 864700 - protein, 9 aa, Homo Sapiens
RDIQYAPLS

SEQ ID NO: 864701 - protein, 9 aa, Homo Sapiens
LKVLRKIQK

SEQ ID NO: 864702 - protein, 9 aa, Homo Sapiens
LSLLHANVV

SEQ ID NO: 864703 - protein, 9 aa, Homo Sapiens
QNKFLLKSI

SEQ ID NO: 864704 - protein, 9 aa, Homo Sapiens
GLHLVTMLG

SEQ ID NO: 864705 - protein, 9 aa, Homo Sapiens
LPPKKKRLC

SEQ ID NO: 864706 - protein, 9 aa, Homo Sapiens
NMHSHTHAH

SEQ ID NO: 864707 - protein, 9 aa, Homo Sapiens
HLAHHQQIH

SEQ ID NO: 864708 - protein, 9 aa, Homo Sapiens
KFQKGKYVK

SEQ ID NO: 864709 - protein, 9 aa, Homo Sapiens
EKNIPLIPV

SEQ ID NO: 864710 - protein, 9 aa, Homo Sapiens
EPECLPCLQ

SEQ ID NO: 864711 - protein, 9 aa, Homo Sapiens
YVKRSQGWI

SEQ ID NO: 864712 - protein, 9 aa, Homo Sapiens
GHKENEKVG

SEQ ID NO: 864713 - protein, 9 aa, Homo Sapiens
SQGLDFLSS

SEQ ID NO: 864714 - protein, 9 aa, Homo Sapiens
KLLQKAAPS

SEQ ID NO: 864715 - protein, 9 aa, Homo Sapiens
SCFIKWGLP

SEQ ID NO: 864716 - protein, 9 aa, Homo Sapiens
WKQKHHYDH

SEQ ID NO: 864717 - protein, 9 aa, Homo Sapiens
KGTGATVLG

SEQ ID NO: 864718 - protein, 9 aa, Homo Sapiens
WTFFIHFQQ

SEQ ID NO: 864719 - protein, 9 aa, Homo Sapiens
QNTSLGIEL

SEQ ID NO: 864720 - protein, 9 aa, Homo Sapiens
VIVTKDNAM

SEQ ID NO: 864721 - protein, 9 aa, Homo Sapiens
PTHKQVFLQ

SEQ ID NO: 864722 - protein, 9 aa, Homo Sapiens
YVFDTALLE

SEQ ID NO: 864723 - protein, 9 aa, Homo Sapiens
QKSILYDHE

SEQ ID NO: 864724 - protein, 9 aa, Homo Sapiens
SHFEHIIYQ

SEQ ID NO: 864725 - protein, 9 aa, Homo Sapiens
LKRVPQTGW

SEQ ID NO: 864726 - protein, 9 aa, Homo Sapiens
LFWTLEFRD

SEQ ID NO: 864727 - protein, 9 aa, Homo Sapiens
ELKEAFCRR

SEQ ID NO: 864728 - protein, 9 aa, Homo Sapiens
EAKDFGAKS

SEQ ID NO: 864729 - protein, 9 aa, Homo Sapiens
EFIQGEVRL

SEQ ID NO: 864730 - protein, 9 aa, Homo Sapiens
HPLALIVDS

SEQ ID NO: 864731 - protein, 9 aa, Homo Sapiens
ERDIKFELL

SEQ ID NO: 864732 - protein, 9 aa, Homo Sapiens
YFSLDVQSV

SEQ ID NO: 864733 - protein, 9 aa, Homo Sapiens
CCKKDLCNG

SEQ ID NO: 864734 - protein, 9 aa, Homo Sapiens
NASDRFKGI

SEQ ID NO: 864735 - protein, 9 aa, Homo Sapiens
FVPRHEDKL

SEQ ID NO: 864736 - protein, 9 aa, Homo Sapiens
NFKTNRKTC

SEQ ID NO: 864737 - protein, 9 aa, Homo Sapiens
LKSSPGLGR

SEQ ID NO: 864738 - protein, 9 aa, Homo Sapiens
TRNDHGLFG

SEQ ID NO: 864739 - protein, 9 aa, Homo Sapiens
QTKLECESA

SEQ ID NO: 864740 - protein, 9 aa, Homo Sapiens
FQGQLDYIP

SEQ ID NO: 864741 - protein, 9 aa, Homo Sapiens
SDEDFNWTA

SEQ ID NO: 864742 - protein, 9 aa, Homo Sapiens
HSFDSNYFG

SEQ ID NO: 864743 - protein, 9 aa, Homo Sapiens
TTEVTIEAQ

SEQ ID NO: 864744 - protein, 9 aa, Homo Sapiens
QQRTYEKCF

SEQ ID NO: 864745 - protein, 9 aa, Homo Sapiens
HAIYLLSAL

SEQ ID NO: 864746 - protein, 9 aa, Homo Sapiens
GVWRQGFNI

SEQ ID NO: 864747 - protein, 9 aa, Homo Sapiens
INMALSEYP

SEQ ID NO: 864748 - protein, 9 aa, Homo Sapiens
QNRQPFPAF

SEQ ID NO: 864749 - protein, 9 aa, Homo Sapiens
DQLRIYFPP

SEQ ID NO: 864750 - protein, 9 aa, Homo Sapiens
SAPFIECNG

SEQ ID NO: 864751 - protein, 9 aa, Homo Sapiens
LNIKQNNSW

SEQ ID NO: 864752 - protein, 9 aa, Homo Sapiens
DFIDCLKIF

SEQ ID NO: 864753 - protein, 9 aa, Homo Sapiens
GALEKDNQM

SEQ ID NO: 864754 - protein, 9 aa, Homo Sapiens
SQMETVSNA

SEQ ID NO: 864755 - protein, 9 aa, Homo Sapiens
LLERDSFLK

SEQ ID NO: 864756 - protein, 9 aa, Homo Sapiens
YMDSYTSNK

SEQ ID NO: 864757 - protein, 9 aa, Homo Sapiens
VEDSGGARQ

SEQ ID NO: 864758 - protein, 9 aa, Homo Sapiens
QQSIDKPFR

SEQ ID NO: 864759 - protein, 9 aa, Homo Sapiens
SVLLSLQTL

SEQ ID NO: 864760 - protein, 9 aa, Homo Sapiens
DGIWLYNSL

SEQ ID NO: 864761 - protein, 9 aa, Homo Sapiens
NCRPIQFEP

SEQ ID NO: 864762 - protein, 9 aa, Homo Sapiens
EECRPQPRS

SEQ ID NO: 864763 - protein, 9 aa, Homo Sapiens
HLENNDNKP

SEQ ID NO: 864764 - protein, 9 aa, Homo Sapiens
HKDDKLQNR

SEQ ID NO: 864765 - protein, 9 aa, Homo Sapiens
PSKIEPMKV

SEQ ID NO: 864766 - protein, 9 aa, Homo Sapiens
ENVLPLLMA

SEQ ID NO: 864767 - protein, 9 aa, Homo Sapiens
GISLPKVLN

SEQ ID NO: 864768 - protein, 9 aa, Homo Sapiens
KKLFLKRNN

SEQ ID NO: 864769 - protein, 9 aa, Homo Sapiens
MVMSLYMVN

SEQ ID NO: 864770 - protein, 9 aa, Homo Sapiens
RQRHIKHRT

SEQ ID NO: 864771 - protein, 9 aa, Homo Sapiens
VQDLDSVPL

SEQ ID NO: 864772 - protein, 9 aa, Homo Sapiens
IINKTINTT

SEQ ID NO: 864773 - protein, 9 aa, Homo Sapiens
GQNSFEENP

SEQ ID NO: 864774 - protein, 9 aa, Homo Sapiens
SSSPEITSP

SEQ ID NO: 864775 - protein, 9 aa, Homo Sapiens
VDKIVVTLT

SEQ ID NO: 864776 - protein, 9 aa, Homo Sapiens
CLKKVSEEQ

SEQ ID NO: 864777 - protein, 9 aa, Homo Sapiens
ILCDTSEDL

SEQ ID NO: 864778 - protein, 9 aa, Homo Sapiens
FLALTSHFL

SEQ ID NO: 864779 - protein, 9 aa, Homo Sapiens
LSLDGLDNK

SEQ ID NO: 864780 - protein, 9 aa, Homo Sapiens
EDNPEESEY

SEQ ID NO: 864781 - protein, 9 aa, Homo Sapiens
QSHIFSSFF

SEQ ID NO: 864782 - protein, 9 aa, Homo Sapiens
NVTGNSIRS

SEQ ID NO: 864783 - protein, 9 aa, Homo Sapiens
VAIQLSLEE

SEQ ID NO: 864784 - protein, 9 aa, Homo Sapiens
QEETAWREK

SEQ ID NO: 864785 - protein, 9 aa, Homo Sapiens
DKNEIDEND

SEQ ID NO: 864786 - protein, 9 aa, Homo Sapiens
NLKTRTYHS

SEQ ID NO: 864787 - protein, 9 aa, Homo Sapiens
QAGFPRCPP

SEQ ID NO: 864788 - protein, 9 aa, Homo Sapiens
TLRGHSAKI

SEQ ID NO: 864789 - protein, 9 aa, Homo Sapiens
QIATAFGHM

SEQ ID NO: 864790 - protein, 9 aa, Homo Sapiens
ENYYRKQRQ

SEQ ID NO: 864791 - protein, 9 aa, Homo Sapiens
GLKVVFDEA

SEQ ID NO: 864792 - protein, 9 aa, Homo Sapiens
KSTASSLLQ

SEQ ID NO: 864793 - protein, 9 aa, Homo Sapiens
VCDKHYYGE

SEQ ID NO: 864794 - protein, 9 aa, Homo Sapiens
FCFYFCTFA

SEQ ID NO: 864795 - protein, 9 aa, Homo Sapiens
EVEKKDDFN

SEQ ID NO: 864796 - protein, 9 aa, Homo Sapiens
QMHDEDLIH

SEQ ID NO: 864797 - protein, 9 aa, Homo Sapiens
VLGLHKLHL

SEQ ID NO: 864798 - protein, 9 aa, Homo Sapiens
VRVFRPQTP

SEQ ID NO: 864799 - protein, 9 aa, Homo Sapiens
LCLTLVALS

SEQ ID NO: 864800 - protein, 9 aa, Homo Sapiens
EERLWFREA

SEQ ID NO: 864801 - protein, 9 aa, Homo Sapiens
KCEGFKLHF

SEQ ID NO: 864802 - protein, 9 aa, Homo Sapiens
KHLTETLKE

SEQ ID NO: 864803 - protein, 9 aa, Homo Sapiens
QASMEFQRK

SEQ ID NO: 864804 - protein, 9 aa, Homo Sapiens
GNLIARKTK

SEQ ID NO: 864805 - protein, 9 aa, Homo Sapiens
MRLPPYATR

SEQ ID NO: 864806 - protein, 9 aa, Homo Sapiens
PLTQLSCQN

SEQ ID NO: 864807 - protein, 9 aa, Homo Sapiens
EGACVTVTC

SEQ ID NO: 864808 - protein, 9 aa, Homo Sapiens
NFPELQVQH

SEQ ID NO: 864809 - protein, 9 aa, Homo Sapiens
IVEDIDKGQ

SEQ ID NO: 864810 - protein, 9 aa, Homo Sapiens
NKEDPMMYP

SEQ ID NO: 864811 - protein, 9 aa, Homo Sapiens
EYPFSPDGH

SEQ ID NO: 864812 - protein, 9 aa, Homo Sapiens
TTEKTTKSK

SEQ ID NO: 864813 - protein, 9 aa, Homo Sapiens
DKLSWDLIY

SEQ ID NO: 864814 - protein, 9 aa, Homo Sapiens
QKESGLNKH

SEQ ID NO: 864815 - protein, 9 aa, Homo Sapiens
SQGSGSHPD

SEQ ID NO: 864816 - protein, 9 aa, Homo Sapiens
IGHLPYKDC

SEQ ID NO: 864817 - protein, 9 aa, Homo Sapiens
HPQSRSAAA

SEQ ID NO: 864818 - protein, 9 aa, Homo Sapiens
KRNFLGSPL

SEQ ID NO: 864819 - protein, 9 aa, Homo Sapiens
CKSAENGDI

SEQ ID NO: 864820 - protein, 9 aa, Homo Sapiens
KQVHILPVG

SEQ ID NO: 864821 - protein, 9 aa, Homo Sapiens
ECRGGVRTA

SEQ ID NO: 864822 - protein, 9 aa, Homo Sapiens
MRSHTGDKP

SEQ ID NO: 864823 - protein, 9 aa, Homo Sapiens
GFNGSLRVC

SEQ ID NO: 864824 - protein, 9 aa, Homo Sapiens
KHQLSQYFL

SEQ ID NO: 864825 - protein, 9 aa, Homo Sapiens
TQFRTQNDF

SEQ ID NO: 864826 - protein, 9 aa, Homo Sapiens
HMWADEGSR

SEQ ID NO: 864827 - protein, 9 aa, Homo Sapiens
LLSFLLVFW

SEQ ID NO: 864828 - protein, 9 aa, Homo Sapiens
PMLCLTLVA

SEQ ID NO: 864829 - protein, 9 aa, Homo Sapiens
DSVLYANNK

SEQ ID NO: 864830 - protein, 9 aa, Homo Sapiens
LEWYEPQIK

SEQ ID NO: 864831 - protein, 9 aa, Homo Sapiens
NKIGNAIAQ

SEQ ID NO: 864832 - protein, 9 aa, Homo Sapiens
CHTDSLTSQ

SEQ ID NO: 864833 - protein, 9 aa, Homo Sapiens
SQETEQRCA

SEQ ID NO: 864834 - protein, 9 aa, Homo Sapiens
LDNICGLNA

SEQ ID NO: 864835 - protein, 9 aa, Homo Sapiens
ETPKRVLKM

SEQ ID NO: 864836 - protein, 9 aa, Homo Sapiens
RAFLTACCE

SEQ ID NO: 864837 - protein, 9 aa, Homo Sapiens
QDAHAASLA

SEQ ID NO: 864838 - protein, 9 aa, Homo Sapiens
LKDTEDNLH

SEQ ID NO: 864839 - protein, 9 aa, Homo Sapiens
GYGGFNDLG

SEQ ID NO: 864840 - protein, 9 aa, Homo Sapiens
FIGFLLEDQ

SEQ ID NO: 864841 - protein, 9 aa, Homo Sapiens
EQSLIKFFN

SEQ ID NO: 864842 - protein, 9 aa, Homo Sapiens
GIQCAIRIA

SEQ ID NO: 864843 - protein, 9 aa, Homo Sapiens
FCRSGWTAV

SEQ ID NO: 864844 - protein, 9 aa, Homo Sapiens
VLFIFQILL

SEQ ID NO: 864845 - protein, 9 aa, Homo Sapiens
DDGIDLNQT

SEQ ID NO: 864846 - protein, 9 aa, Homo Sapiens
IEVLKHKVI

SEQ ID NO: 864847 - protein, 9 aa, Homo Sapiens
GKSRRCRTA

SEQ ID NO: 864848 - protein, 9 aa, Homo Sapiens
VNGVTQLSI

SEQ ID NO: 864849 - protein, 9 aa, Homo Sapiens
FHNETSKTF

SEQ ID NO: 864850 - protein, 9 aa, Homo Sapiens
SSRHDCNLL

SEQ ID NO: 864851 - protein, 9 aa, Homo Sapiens
FLDQHMLKV

SEQ ID NO: 864852 - protein, 9 aa, Homo Sapiens
EIKSWEEQM

SEQ ID NO: 864853 - protein, 9 aa, Homo Sapiens
SKLIRHQII

SEQ ID NO: 864854 - protein, 9 aa, Homo Sapiens
AFSLSSTLN

SEQ ID NO: 864855 - protein, 9 aa, Homo Sapiens
GGLQPVTIV

SEQ ID NO: 864856 - protein, 9 aa, Homo Sapiens
IISLLCVYV

SEQ ID NO: 864857 - protein, 9 aa, Homo Sapiens
LCPEAYVWV

SEQ ID NO: 864858 - protein, 9 aa, Homo Sapiens
VHKGYKFMF

SEQ ID NO: 864859 - protein, 9 aa, Homo Sapiens
DRFKGITTL

SEQ ID NO: 864860 - protein, 9 aa, Homo Sapiens
QKRKSVVNQ

SEQ ID NO: 864861 - protein, 9 aa, Homo Sapiens
LHKLINKIK

SEQ ID NO: 864862 - protein, 9 aa, Homo Sapiens
IHKITHTGE

SEQ ID NO: 864863 - protein, 9 aa, Homo Sapiens
MGNRTSLRV

SEQ ID NO: 864864 - protein, 9 aa, Homo Sapiens
GQTSGTVSS

SEQ ID NO: 864865 - protein, 9 aa, Homo Sapiens
RHQLHKFLC

SEQ ID NO: 864866 - protein, 9 aa, Homo Sapiens
NTLIALVTS

SEQ ID NO: 864867 - protein, 9 aa, Homo Sapiens
EYHGDLIKI

SEQ ID NO: 864868 - protein, 9 aa, Homo Sapiens
VLKVLTNKT

SEQ ID NO: 864869 - protein, 9 aa, Homo Sapiens
NINTLQRCI

SEQ ID NO: 864870 - protein, 9 aa, Homo Sapiens
MASKHSAWP

SEQ ID NO: 864871 - protein, 9 aa, Homo Sapiens
SYAFTSPDA

SEQ ID NO: 864872 - protein, 9 aa, Homo Sapiens
WSVFHGAIM

SEQ ID NO: 864873 - protein, 9 aa, Homo Sapiens
RMSNVYSKV

SEQ ID NO: 864874 - protein, 9 aa, Homo Sapiens
FIVVERDAQ

SEQ ID NO: 864875 - protein, 9 aa, Homo Sapiens
RLCGQDLNT

SEQ ID NO: 864876 - protein, 9 aa, Homo Sapiens
DAMKEVVPE

SEQ ID NO: 864877 - protein, 9 aa, Homo Sapiens
VVDGGQAGS

SEQ ID NO: 864878 - protein, 9 aa, Homo Sapiens
GVSLCHPVW

SEQ ID NO: 864879 - protein, 9 aa, Homo Sapiens
NLRFEERDF

SEQ ID NO: 864880 - protein, 9 aa, Homo Sapiens
NYMIHVNQN

SEQ ID NO: 864881 - protein, 9 aa, Homo Sapiens
ATAFNTNDG

SEQ ID NO: 864882 - protein, 9 aa, Homo Sapiens
VFWWESLVL

SEQ ID NO: 864883 - protein, 9 aa, Homo Sapiens
IDCLKIFLN

SEQ ID NO: 864884 - protein, 9 aa, Homo Sapiens
EKTILLCIL

SEQ ID NO: 864885 - protein, 9 aa, Homo Sapiens
FGLSPLIDR

SEQ ID NO: 864886 - protein, 9 aa, Homo Sapiens
GRTKELTLE

SEQ ID NO: 864887 - protein, 9 aa, Homo Sapiens
NSSGPSTSQ

SEQ ID NO: 864888 - protein, 9 aa, Homo Sapiens
TETGWGEFK

SEQ ID NO: 864889 - protein, 9 aa, Homo Sapiens
LGYTVVDKK

SEQ ID NO: 864890 - protein, 9 aa, Homo Sapiens
SKPVSYSFL

SEQ ID NO: 864891 - protein, 9 aa, Homo Sapiens
LLGLQDKLV

SEQ ID NO: 864892 - protein, 9 aa, Homo Sapiens
DGTAVENSD

SEQ ID NO: 864893 - protein, 9 aa, Homo Sapiens
NSLSKLSEE

SEQ ID NO: 864894 - protein, 9 aa, Homo Sapiens
HGLYSRSNP

SEQ ID NO: 864895 - protein, 9 aa, Homo Sapiens
MFTNFLSFM

SEQ ID NO: 864896 - protein, 9 aa, Homo Sapiens
TEGSKMQQN

SEQ ID NO: 864897 - protein, 9 aa, Homo Sapiens
ILIQTDSHL

SEQ ID NO: 864898 - protein, 9 aa, Homo Sapiens
DLQPDINKN

SEQ ID NO: 864899 - protein, 9 aa, Homo Sapiens
KKDVKSYFS

SEQ ID NO: 864900 - protein, 9 aa, Homo Sapiens
QQNIAIEVD

SEQ ID NO: 864901 - protein, 9 aa, Homo Sapiens
SYDPKTNSW

SEQ ID NO: 864902 - protein, 9 aa, Homo Sapiens
SSVSGICIK

SEQ ID NO: 864903 - protein, 9 aa, Homo Sapiens
QERLPVLPK

SEQ ID NO: 864904 - protein, 9 aa, Homo Sapiens
RRLDGEDGS

SEQ ID NO: 864905 - protein, 9 aa, Homo Sapiens
LNKELVPLA

SEQ ID NO: 864906 - protein, 9 aa, Homo Sapiens
HKTDSAVAT

SEQ ID NO: 864907 - protein, 9 aa, Homo Sapiens
GIIYRYLKP

SEQ ID NO: 864908 - protein, 9 aa, Homo Sapiens
AEKNIPLIP

SEQ ID NO: 864909 - protein, 9 aa, Homo Sapiens
TKAPDAMKE

SEQ ID NO: 864910 - protein, 9 aa, Homo Sapiens
LLSNLGYLQ

SEQ ID NO: 864911 - protein, 9 aa, Homo Sapiens
SKCPAEGVD

SEQ ID NO: 864912 - protein, 9 aa, Homo Sapiens
FQILLEKRS

SEQ ID NO: 864913 - protein, 9 aa, Homo Sapiens
CMQYRSHMP

SEQ ID NO: 864914 - protein, 9 aa, Homo Sapiens
KNPMSSLQI

SEQ ID NO: 864915 - protein, 9 aa, Homo Sapiens
EIICRFETR

SEQ ID NO: 864916 - protein, 9 aa, Homo Sapiens
PAEGVDSSG

SEQ ID NO: 864917 - protein, 9 aa, Homo Sapiens
TYTFRGFWS

SEQ ID NO: 864918 - protein, 9 aa, Homo Sapiens
GLCHQMSIG

SEQ ID NO: 864919 - protein, 9 aa, Homo Sapiens
CCVLERKQP

SEQ ID NO: 864920 - protein, 9 aa, Homo Sapiens
DVRSGKCFK

SEQ ID NO: 864921 - protein, 9 aa, Homo Sapiens
MLPSPRPYV

SEQ ID NO: 864922 - protein, 9 aa, Homo Sapiens
SHPARKPPN

SEQ ID NO: 864923 - protein, 9 aa, Homo Sapiens
YQPETNSYF

SEQ ID NO: 864924 - protein, 9 aa, Homo Sapiens
QEFSWEEVE

SEQ ID NO: 864925 - protein, 9 aa, Homo Sapiens
PQEPEEEEN

SEQ ID NO: 864926 - protein, 9 aa, Homo Sapiens
YMQIRDNWN

SEQ ID NO: 864927 - protein, 9 aa, Homo Sapiens
WIEKNDLRS

SEQ ID NO: 864928 - protein, 9 aa, Homo Sapiens
NRTNPKSLI

SEQ ID NO: 864929 - protein, 9 aa, Homo Sapiens
IFCAIFLHG

SEQ ID NO: 864930 - protein, 9 aa, Homo Sapiens
KCLPEVYCI

SEQ ID NO: 864931 - protein, 9 aa, Homo Sapiens
GLLSAERMC

SEQ ID NO: 864932 - protein, 9 aa, Homo Sapiens
LWDTGVFEH

SEQ ID NO: 864933 - protein, 9 aa, Homo Sapiens
KEGWVKVTR

SEQ ID NO: 864934 - protein, 9 aa, Homo Sapiens
GSNNVTLGY

SEQ ID NO: 864935 - protein, 9 aa, Homo Sapiens
LCKYPDIAQ

SEQ ID NO: 864936 - protein, 9 aa, Homo Sapiens
RLKVLRKIQ

SEQ ID NO: 864937 - protein, 9 aa, Homo Sapiens
MSGGLQPVT

SEQ ID NO: 864938 - protein, 9 aa, Homo Sapiens
ENSQTKLQD

SEQ ID NO: 864939 - protein, 9 aa, Homo Sapiens
YGLRDSHSE

SEQ ID NO: 864940 - protein, 9 aa, Homo Sapiens
VNLTTCPLA

SEQ ID NO: 864941 - protein, 9 aa, Homo Sapiens
KQLMNEYNK

SEQ ID NO: 864942 - protein, 9 aa, Homo Sapiens
REIKQVNER

SEQ ID NO: 864943 - protein, 9 aa, Homo Sapiens
YKDCLRLYY

SEQ ID NO: 864944 - protein, 9 aa, Homo Sapiens
TIIHEEVYF

SEQ ID NO: 864945 - protein, 9 aa, Homo Sapiens
KPFVCKFCG

SEQ ID NO: 864946 - protein, 9 aa, Homo Sapiens
IVFLDTSER

SEQ ID NO: 864947 - protein, 9 aa, Homo Sapiens
PLGSEQLFE

SEQ ID NO: 864948 - protein, 9 aa, Homo Sapiens
TLKFIVGHL

SEQ ID NO: 864949 - protein, 9 aa, Homo Sapiens
VVKGTFISV

SEQ ID NO: 864950 - protein, 9 aa, Homo Sapiens
FNMHDSSLV

SEQ ID NO: 864951 - protein, 9 aa, Homo Sapiens
HTQVPVHRH

SEQ ID NO: 864952 - protein, 9 aa, Homo Sapiens
GEKPCECNV

SEQ ID NO: 864953 - protein, 9 aa, Homo Sapiens
PIKSIPSYA

SEQ ID NO: 864954 - protein, 9 aa, Homo Sapiens
TGKPDEEEG

SEQ ID NO: 864955 - protein, 9 aa, Homo Sapiens
AKRLESLGT

SEQ ID NO: 864956 - protein, 9 aa, Homo Sapiens
IHSLNLWTT

SEQ ID NO: 864957 - protein, 9 aa, Homo Sapiens
DISLIENKI

SEQ ID NO: 864958 - protein, 9 aa, Homo Sapiens
QIHTPPAKA

SEQ ID NO: 864959 - protein, 9 aa, Homo Sapiens
ADYDNFSCT

SEQ ID NO: 864960 - protein, 9 aa, Homo Sapiens
QGDKQFLLF

SEQ ID NO: 864961 - protein, 9 aa, Homo Sapiens
NLMDGRDAF

SEQ ID NO: 864962 - protein, 9 aa, Homo Sapiens
TEEACIISP

SEQ ID NO: 864963 - protein, 9 aa, Homo Sapiens
NYQKNGTAE

SEQ ID NO: 864964 - protein, 9 aa, Homo Sapiens
KEIRLIGNK

SEQ ID NO: 864965 - protein, 9 aa, Homo Sapiens
RMGVLAFLA

SEQ ID NO: 864966 - protein, 9 aa, Homo Sapiens
KQAQKENEF

SEQ ID NO: 864967 - protein, 9 aa, Homo Sapiens
RAWHVKCAQ

SEQ ID NO: 864968 - protein, 9 aa, Homo Sapiens
SHLFQHQRI

SEQ ID NO: 864969 - protein, 9 aa, Homo Sapiens
PPENVLPLL

SEQ ID NO: 864970 - protein, 9 aa, Homo Sapiens
QTVHTGERS

SEQ ID NO: 864971 - protein, 9 aa, Homo Sapiens
QQRMLNEFS

SEQ ID NO: 864972 - protein, 9 aa, Homo Sapiens
DYDNFSCTW

SEQ ID NO: 864973 - protein, 9 aa, Homo Sapiens
GNNSSFHHQ

SEQ ID NO: 864974 - protein, 9 aa, Homo Sapiens
LGKSVQQQE

SEQ ID NO: 864975 - protein, 9 aa, Homo Sapiens
LIKITDAKK

SEQ ID NO: 864976 - protein, 9 aa, Homo Sapiens
DPNDSGKLT

SEQ ID NO: 864977 - protein, 9 aa, Homo Sapiens
ILLSFLLVF

SEQ ID NO: 864978 - protein, 9 aa, Homo Sapiens
KSFYQTLIT

SEQ ID NO: 864979 - protein, 9 aa, Homo Sapiens
LLRLKSPVG

SEQ ID NO: 864980 - protein, 9 aa, Homo Sapiens
WAGLLRNHC

SEQ ID NO: 864981 - protein, 9 aa, Homo Sapiens
ALLAATCST

SEQ ID NO: 864982 - protein, 9 aa, Homo Sapiens
ICNLFDFDT

SEQ ID NO: 864983 - protein, 9 aa, Homo Sapiens
RTLYTQICN

SEQ ID NO: 864984 - protein, 9 aa, Homo Sapiens
TKPSKLPGS

SEQ ID NO: 864985 - protein, 9 aa, Homo Sapiens
EPCGVGTCK

SEQ ID NO: 864986 - protein, 9 aa, Homo Sapiens
AQPILENDI

SEQ ID NO: 864987 - protein, 9 aa, Homo Sapiens
HYDEYSAIG

SEQ ID NO: 864988 - protein, 9 aa, Homo Sapiens
LETISQPVV

SEQ ID NO: 864989 - protein, 9 aa, Homo Sapiens
SLAEGLQTV

SEQ ID NO: 864990 - protein, 9 aa, Homo Sapiens
DLLNKKAIC

SEQ ID NO: 864991 - protein, 9 aa, Homo Sapiens
MAVKRIWST

SEQ ID NO: 864992 - protein, 9 aa, Homo Sapiens
NRALHAAEC

SEQ ID NO: 864993 - protein, 9 aa, Homo Sapiens
AEAHRIQEQ

SEQ ID NO: 864994 - protein, 9 aa, Homo Sapiens
SIKSLRTFL

SEQ ID NO: 864995 - protein, 9 aa, Homo Sapiens
QTKQKNLFR

SEQ ID NO: 864996 - protein, 9 aa, Homo Sapiens
RRQHYRNEL

SEQ ID NO: 864997 - protein, 9 aa, Homo Sapiens
PPQPEASGL

SEQ ID NO: 864998 - protein, 9 aa, Homo Sapiens
GQKPYKCNE

SEQ ID NO: 864999 - protein, 9 aa, Homo Sapiens
LMLVHSRTP

SEQ ID NO: 865000 - protein, 9 aa, Homo Sapiens
YAGAVHKFL

SEQ ID NO: 865001 - protein, 9 aa, Homo Sapiens
GHFHIQLPN

SEQ ID NO: 865002 - protein, 9 aa, Homo Sapiens
VSKVLRIEN

SEQ ID NO: 865003 - protein, 9 aa, Homo Sapiens
NIFKLNGLP

SEQ ID NO: 865004 - protein, 9 aa, Homo Sapiens
NPPARHTLA

SEQ ID NO: 865005 - protein, 9 aa, Homo Sapiens
DIQEEIINA

SEQ ID NO: 865006 - protein, 9 aa, Homo Sapiens
QPSRQKWSV

SEQ ID NO: 865007 - protein, 9 aa, Homo Sapiens
KYLYGPDNH

SEQ ID NO: 865008 - protein, 9 aa, Homo Sapiens
NTGEKPYKC

SEQ ID NO: 865009 - protein, 9 aa, Homo Sapiens
PCFGSKLVK

SEQ ID NO: 865010 - protein, 9 aa, Homo Sapiens
AASIAGSLI

SEQ ID NO: 865011 - protein, 9 aa, Homo Sapiens
ASRQNTSLG

SEQ ID NO: 865012 - protein, 9 aa, Homo Sapiens
NQIATATQS

SEQ ID NO: 865013 - protein, 9 aa, Homo Sapiens
QILPWEHNE

SEQ ID NO: 865014 - protein, 9 aa, Homo Sapiens
GRQVAGPHP

SEQ ID NO: 865015 - protein, 9 aa, Homo Sapiens
QQENMNLLL

SEQ ID NO: 865016 - protein, 9 aa, Homo Sapiens
RASNNSMDN

SEQ ID NO: 865017 - protein, 9 aa, Homo Sapiens
PINIARPCS

SEQ ID NO: 865018 - protein, 9 aa, Homo Sapiens
QRLFVLFTM

SEQ ID NO: 865019 - protein, 9 aa, Homo Sapiens
VQQGGNMLG

SEQ ID NO: 865020 - protein, 9 aa, Homo Sapiens
PYTEEACII

SEQ ID NO: 865021 - protein, 9 aa, Homo Sapiens
QVDNRFGAY

SEQ ID NO: 865022 - protein, 9 aa, Homo Sapiens
VQRWMRGFL

SEQ ID NO: 865023 - protein, 9 aa, Homo Sapiens
EKLLCMYQN

SEQ ID NO: 865024 - protein, 9 aa, Homo Sapiens
KSLVKQSPN

SEQ ID NO: 865025 - protein, 9 aa, Homo Sapiens
EKEISGCCS

SEQ ID NO: 865026 - protein, 9 aa, Homo Sapiens
TKSQFDKFV

SEQ ID NO: 865027 - protein, 9 aa, Homo Sapiens
RLEKMCLKA

SEQ ID NO: 865028 - protein, 9 aa, Homo Sapiens
RGGETQGVA

SEQ ID NO: 865029 - protein, 9 aa, Homo Sapiens
NAETSVERV

SEQ ID NO: 865030 - protein, 9 aa, Homo Sapiens
NGAVCATDM

SEQ ID NO: 865031 - protein, 9 aa, Homo Sapiens
TQYQFGITK

SEQ ID NO: 865032 - protein, 9 aa, Homo Sapiens
NLYMQIRDN

SEQ ID NO: 865033 - protein, 9 aa, Homo Sapiens
GNQIEIIDQ

SEQ ID NO: 865034 - protein, 9 aa, Homo Sapiens
AVEAQERGL

SEQ ID NO: 865035 - protein, 9 aa, Homo Sapiens
HTGEKVYEC

SEQ ID NO: 865036 - protein, 9 aa, Homo Sapiens
HPGTLLINS

SEQ ID NO: 865037 - protein, 9 aa, Homo Sapiens
EVQEIIGVA

SEQ ID NO: 865038 - protein, 9 aa, Homo Sapiens
CELYQVMCR

SEQ ID NO: 865039 - protein, 9 aa, Homo Sapiens
NPLEKHNHQ

SEQ ID NO: 865040 - protein, 9 aa, Homo Sapiens
IVKNHIFKH

SEQ ID NO: 865041 - protein, 9 aa, Homo Sapiens
VSVSSYEIW

SEQ ID NO: 865042 - protein, 9 aa, Homo Sapiens
NQVFGEGTK

SEQ ID NO: 865043 - protein, 9 aa, Homo Sapiens
WQEAVSRKR

SEQ ID NO: 865044 - protein, 9 aa, Homo Sapiens
HDLFNLPHN

SEQ ID NO: 865045 - protein, 9 aa, Homo Sapiens
CFSCAQKMA

SEQ ID NO: 865046 - protein, 9 aa, Homo Sapiens
SPIMNLEQF

SEQ ID NO: 865047 - protein, 9 aa, Homo Sapiens
KWTKLTLDY

SEQ ID NO: 865048 - protein, 9 aa, Homo Sapiens
RSDMEKWVE

SEQ ID NO: 865049 - protein, 9 aa, Homo Sapiens
SIKDYFQKV

SEQ ID NO: 865050 - protein, 9 aa, Homo Sapiens
SVAAFAVLA

SEQ ID NO: 865051 - protein, 9 aa, Homo Sapiens
AGSLVINLG

SEQ ID NO: 865052 - protein, 9 aa, Homo Sapiens
GKACGRKIK

SEQ ID NO: 865053 - protein, 9 aa, Homo Sapiens
LCIHGGHTA

SEQ ID NO: 865054 - protein, 9 aa, Homo Sapiens
EDKSILGNK

SEQ ID NO: 865055 - protein, 9 aa, Homo Sapiens
RTARVMIGH

SEQ ID NO: 865056 - protein, 9 aa, Homo Sapiens
MLVPLPVPW

SEQ ID NO: 865057 - protein, 9 aa, Homo Sapiens
YNAMTNEDN

SEQ ID NO: 865058 - protein, 9 aa, Homo Sapiens
VGDIADVQK

SEQ ID NO: 865059 - protein, 9 aa, Homo Sapiens
SHSAGDRWV

SEQ ID NO: 865060 - protein, 9 aa, Homo Sapiens
DAYVPRHEI

SEQ ID NO: 865061 - protein, 9 aa, Homo Sapiens
CFLCKLKEA

SEQ ID NO: 865062 - protein, 9 aa, Homo Sapiens
MRVPIVLHI

SEQ ID NO: 865063 - protein, 9 aa, Homo Sapiens
EGKYHRASS

SEQ ID NO: 865064 - protein, 9 aa, Homo Sapiens
ERAKLAASL

SEQ ID NO: 865065 - protein, 9 aa, Homo Sapiens
CGMAFQYHY

SEQ ID NO: 865066 - protein, 9 aa, Homo Sapiens
LHVGSNCLE

SEQ ID NO: 865067 - protein, 9 aa, Homo Sapiens
HSINCARQE

SEQ ID NO: 865068 - protein, 9 aa, Homo Sapiens
AKEEVPGKV

SEQ ID NO: 865069 - protein, 9 aa, Homo Sapiens
TPSKSNSPS

SEQ ID NO: 865070 - protein, 9 aa, Homo Sapiens
VQFLNNLNL

SEQ ID NO: 865071 - protein, 9 aa, Homo Sapiens
KDARALINL

SEQ ID NO: 865072 - protein, 9 aa, Homo Sapiens
HKRSPLRQN

SEQ ID NO: 865073 - protein, 9 aa, Homo Sapiens
LDLLKGAFQ

SEQ ID NO: 865074 - protein, 9 aa, Homo Sapiens
LMNVVVLTV

SEQ ID NO: 865075 - protein, 9 aa, Homo Sapiens
QQKILCTKT

SEQ ID NO: 865076 - protein, 9 aa, Homo Sapiens
NMCVGEKRR

SEQ ID NO: 865077 - protein, 9 aa, Homo Sapiens
LLCLKHGAK

SEQ ID NO: 865078 - protein, 9 aa, Homo Sapiens
KVKDGLPNN

SEQ ID NO: 865079 - protein, 9 aa, Homo Sapiens
NVVPNATIR

SEQ ID NO: 865080 - protein, 9 aa, Homo Sapiens
LLGHAVQDL

SEQ ID NO: 865081 - protein, 9 aa, Homo Sapiens
APSTLCSLI

SEQ ID NO: 865082 - protein, 9 aa, Homo Sapiens
IGFLLEDQV

SEQ ID NO: 865083 - protein, 9 aa, Homo Sapiens
EHLACIQVL

SEQ ID NO: 865084 - protein, 9 aa, Homo Sapiens
NHTILQYYC

SEQ ID NO: 865085 - protein, 9 aa, Homo Sapiens
LDEMNIELI

SEQ ID NO: 865086 - protein, 9 aa, Homo Sapiens
YGFTHISTG

SEQ ID NO: 865087 - protein, 9 aa, Homo Sapiens
EQARVCKLQ

SEQ ID NO: 865088 - protein, 9 aa, Homo Sapiens
KYINKGEIS

SEQ ID NO: 865089 - protein, 9 aa, Homo Sapiens
LSEEKQWIM

SEQ ID NO: 865090 - protein, 9 aa, Homo Sapiens
ISEIPRWGS

SEQ ID NO: 865091 - protein, 9 aa, Homo Sapiens
ANTSVKPSQ

SEQ ID NO: 865092 - protein, 9 aa, Homo Sapiens
KLYPINISL

SEQ ID NO: 865093 - protein, 9 aa, Homo Sapiens
ELTPKAVTA

SEQ ID NO: 865094 - protein, 9 aa, Homo Sapiens
YKHFDKSPT

SEQ ID NO: 865095 - protein, 9 aa, Homo Sapiens
LQSQTDNLK

SEQ ID NO: 865096 - protein, 9 aa, Homo Sapiens
SYFQPNGIH

SEQ ID NO: 865097 - protein, 9 aa, Homo Sapiens
NDHGLFGLD

SEQ ID NO: 865098 - protein, 9 aa, Homo Sapiens
DKFRGVELV

SEQ ID NO: 865099 - protein, 9 aa, Homo Sapiens
ANYPDADRL

SEQ ID NO: 865100 - protein, 9 aa, Homo Sapiens
DINEESVEG

SEQ ID NO: 865101 - protein, 9 aa, Homo Sapiens
SSISTLKSQ

SEQ ID NO: 865102 - protein, 9 aa, Homo Sapiens
ENLRPQNGN

SEQ ID NO: 865103 - protein, 9 aa, Homo Sapiens
QKKDFLEPE

SEQ ID NO: 865104 - protein, 9 aa, Homo Sapiens
LSEEIQMTV

SEQ ID NO: 865105 - protein, 9 aa, Homo Sapiens
KDDMGRINA

SEQ ID NO: 865106 - protein, 9 aa, Homo Sapiens
EKQWIMLLE

SEQ ID NO: 865107 - protein, 9 aa, Homo Sapiens
VLLTDIFLC

SEQ ID NO: 865108 - protein, 9 aa, Homo Sapiens
LQQQIFPLM

SEQ ID NO: 865109 - protein, 9 aa, Homo Sapiens
RVPVDQVNC

SEQ ID NO: 865110 - protein, 9 aa, Homo Sapiens
MRLAASLYC

SEQ ID NO: 865111 - protein, 9 aa, Homo Sapiens
NLHSWHAES

SEQ ID NO: 865112 - protein, 9 aa, Homo Sapiens
PSKSNSPSS

SEQ ID NO: 865113 - protein, 9 aa, Homo Sapiens
VTHCGQMKQ

SEQ ID NO: 865114 - protein, 9 aa, Homo Sapiens
KYFIKIEKN

SEQ ID NO: 865115 - protein, 9 aa, Homo Sapiens
LNKLCQAPD

SEQ ID NO: 865116 - protein, 9 aa, Homo Sapiens
SGMFIMVVC

SEQ ID NO: 865117 - protein, 9 aa, Homo Sapiens
NINLWLTLL

SEQ ID NO: 865118 - protein, 9 aa, Homo Sapiens
MVDYLYQNA

SEQ ID NO: 865119 - protein, 9 aa, Homo Sapiens
PESLQKEAA

SEQ ID NO: 865120 - protein, 9 aa, Homo Sapiens
KLKKLESSA

SEQ ID NO: 865121 - protein, 9 aa, Homo Sapiens
IGENIENRT

SEQ ID NO: 865122 - protein, 9 aa, Homo Sapiens
KMRHELNKA

SEQ ID NO: 865123 - protein, 9 aa, Homo Sapiens
TPLENMLFT

SEQ ID NO: 865124 - protein, 9 aa, Homo Sapiens
TVQQLELEN

SEQ ID NO: 865125 - protein, 9 aa, Homo Sapiens
PSQKTGYLV

SEQ ID NO: 865126 - protein, 9 aa, Homo Sapiens
ERDCLKAEW

SEQ ID NO: 865127 - protein, 9 aa, Homo Sapiens
ATCLPFSPV

SEQ ID NO: 865128 - protein, 9 aa, Homo Sapiens
VLSEKKTIS

SEQ ID NO: 865129 - protein, 9 aa, Homo Sapiens
HTKPSKLPG

SEQ ID NO: 865130 - protein, 9 aa, Homo Sapiens
QEINSDDRQ

SEQ ID NO: 865131 - protein, 9 aa, Homo Sapiens
GDQYRTEQY

SEQ ID NO: 865132 - protein, 9 aa, Homo Sapiens
YYQCFDRIN

SEQ ID NO: 865133 - protein, 9 aa, Homo Sapiens
DGVLFCRSG

SEQ ID NO: 865134 - protein, 9 aa, Homo Sapiens
ACNAKDPTD

SEQ ID NO: 865135 - protein, 9 aa, Homo Sapiens
FYDLLNIFK

SEQ ID NO: 865136 - protein, 9 aa, Homo Sapiens
DGRSNGYRW

SEQ ID NO: 865137 - protein, 9 aa, Homo Sapiens
ERVQPITSS

SEQ ID NO: 865138 - protein, 9 aa, Homo Sapiens
QEDVNSWKA

SEQ ID NO: 865139 - protein, 9 aa, Homo Sapiens
KNLGPAEWQ

SEQ ID NO: 865140 - protein, 9 aa, Homo Sapiens
VPQLYFSSS

SEQ ID NO: 865141 - protein, 9 aa, Homo Sapiens
LPDTPFWLL

SEQ ID NO: 865142 - protein, 9 aa, Homo Sapiens
YTSAVSMAK

SEQ ID NO: 865143 - protein, 9 aa, Homo Sapiens
PTTNIQIWL

SEQ ID NO: 865144 - protein, 9 aa, Homo Sapiens
TGHYLQQVT

SEQ ID NO: 865145 - protein, 9 aa, Homo Sapiens
RVCKLQSGN

SEQ ID NO: 865146 - protein, 9 aa, Homo Sapiens
HSLKNLEHH

SEQ ID NO: 865147 - protein, 9 aa, Homo Sapiens
DRTARVMIG

SEQ ID NO: 865148 - protein, 9 aa, Homo Sapiens
GITGSERYY

SEQ ID NO: 865149 - protein, 9 aa, Homo Sapiens
VDVEDGKFL

SEQ ID NO: 865150 - protein, 9 aa, Homo Sapiens
DNLDNIKRI

SEQ ID NO: 865151 - protein, 9 aa, Homo Sapiens
HLTSLGILF

SEQ ID NO: 865152 - protein, 9 aa, Homo Sapiens
TSIAQARKL

SEQ ID NO: 865153 - protein, 9 aa, Homo Sapiens
TFQINLTVL

SEQ ID NO: 865154 - protein, 9 aa, Homo Sapiens
SARNTLMRV

SEQ ID NO: 865155 - protein, 9 aa, Homo Sapiens
TAGDKLGKE

SEQ ID NO: 865156 - protein, 9 aa, Homo Sapiens
LMDVKVPMD

SEQ ID NO: 865157 - protein, 9 aa, Homo Sapiens
VKLCLECIE

SEQ ID NO: 865158 - protein, 9 aa, Homo Sapiens
LSSDQNPPI

SEQ ID NO: 865159 - protein, 9 aa, Homo Sapiens
DTEGKYHRA

SEQ ID NO: 865160 - protein, 9 aa, Homo Sapiens
LIMQQGQFR

SEQ ID NO: 865161 - protein, 9 aa, Homo Sapiens
RLCQDEQLR

SEQ ID NO: 865162 - protein, 9 aa, Homo Sapiens
TQTPWRQIP

SEQ ID NO: 865163 - protein, 9 aa, Homo Sapiens
KQQKAVKLK

SEQ ID NO: 865164 - protein, 9 aa, Homo Sapiens
SVLQNQDNK

SEQ ID NO: 865165 - protein, 9 aa, Homo Sapiens
VTQTCTTKF

SEQ ID NO: 865166 - protein, 9 aa, Homo Sapiens
PDQNLDLQI

SEQ ID NO: 865167 - protein, 9 aa, Homo Sapiens
CFRDDNDHS

SEQ ID NO: 865168 - protein, 9 aa, Homo Sapiens
WTLEFRDIQ

SEQ ID NO: 865169 - protein, 9 aa, Homo Sapiens
VAGRFGQDY

SEQ ID NO: 865170 - protein, 9 aa, Homo Sapiens
SELSVPYKQ

SEQ ID NO: 865171 - protein, 9 aa, Homo Sapiens
WRHVDKGTT

SEQ ID NO: 865172 - protein, 9 aa, Homo Sapiens
VLQNSFRDQ

SEQ ID NO: 865173 - protein, 9 aa, Homo Sapiens
DLLSGKYVA

SEQ ID NO: 865174 - protein, 9 aa, Homo Sapiens
STRKIEGAQ

SEQ ID NO: 865175 - protein, 9 aa, Homo Sapiens
SAKDIKHRL

SEQ ID NO: 865176 - protein, 9 aa, Homo Sapiens
LCLEGIQCA

SEQ ID NO: 865177 - protein, 9 aa, Homo Sapiens
QSINLNHNF

SEQ ID NO: 865178 - protein, 9 aa, Homo Sapiens
IVHYNSDSY

SEQ ID NO: 865179 - protein, 9 aa, Homo Sapiens
NVEIEELTA

SEQ ID NO: 865180 - protein, 9 aa, Homo Sapiens
ETAWREKQQ

SEQ ID NO: 865181 - protein, 9 aa, Homo Sapiens
QIALLGLKD

SEQ ID NO: 865182 - protein, 9 aa, Homo Sapiens
EVLEREQRE

SEQ ID NO: 865183 - protein, 9 aa, Homo Sapiens
YQTLITLLA

SEQ ID NO: 865184 - protein, 9 aa, Homo Sapiens
AQHINLTTL

SEQ ID NO: 865185 - protein, 9 aa, Homo Sapiens
GTNTNKLLA

SEQ ID NO: 865186 - protein, 9 aa, Homo Sapiens
KHVRTHTGD

SEQ ID NO: 865187 - protein, 9 aa, Homo Sapiens
NKGRPMVIS

SEQ ID NO: 865188 - protein, 9 aa, Homo Sapiens
RNQVVISTN

SEQ ID NO: 865189 - protein, 9 aa, Homo Sapiens
DTNWIYYGD

SEQ ID NO: 865190 - protein, 9 aa, Homo Sapiens
NLHQLGSKY

SEQ ID NO: 865191 - protein, 9 aa, Homo Sapiens
CFRHHTSLI

SEQ ID NO: 865192 - protein, 9 aa, Homo Sapiens
NAQPILEND

SEQ ID NO: 865193 - protein, 9 aa, Homo Sapiens
TILRLKLEQ

SEQ ID NO: 865194 - protein, 9 aa, Homo Sapiens
KCFSYLTKH

SEQ ID NO: 865195 - protein, 9 aa, Homo Sapiens
VRCCGRGMP

SEQ ID NO: 865196 - protein, 9 aa, Homo Sapiens
DKDNQRTFR

SEQ ID NO: 865197 - protein, 9 aa, Homo Sapiens
LVVGIYLKN

SEQ ID NO: 865198 - protein, 9 aa, Homo Sapiens
KRATASEKM

SEQ ID NO: 865199 - protein, 9 aa, Homo Sapiens
RTRPYLFSN

SEQ ID NO: 865200 - protein, 9 aa, Homo Sapiens
TLTAPYRTQ

SEQ ID NO: 865201 - protein, 9 aa, Homo Sapiens
GLYGLSWYQ

SEQ ID NO: 865202 - protein, 9 aa, Homo Sapiens
DPPQKLMAM

SEQ ID NO: 865203 - protein, 9 aa, Homo Sapiens
PLKLEKSIG

SEQ ID NO: 865204 - protein, 9 aa, Homo Sapiens
HWMRQKISF

SEQ ID NO: 865205 - protein, 9 aa, Homo Sapiens
LHYRYFIPG

SEQ ID NO: 865206 - protein, 9 aa, Homo Sapiens
LQLNQSVHT

SEQ ID NO: 865207 - protein, 9 aa, Homo Sapiens
DMYSQDSIY

SEQ ID NO: 865208 - protein, 9 aa, Homo Sapiens
KANYLDGFA

SEQ ID NO: 865209 - protein, 9 aa, Homo Sapiens
KRRDTLITE

SEQ ID NO: 865210 - protein, 9 aa, Homo Sapiens
EEEYQSRYQ

SEQ ID NO: 865211 - protein, 9 aa, Homo Sapiens
RNKSELDFK

SEQ ID NO: 865212 - protein, 9 aa, Homo Sapiens
GFKLTSVEK

SEQ ID NO: 865213 - protein, 9 aa, Homo Sapiens
YKPQNHPYR

SEQ ID NO: 865214 - protein, 9 aa, Homo Sapiens
PSLDKAQPF

SEQ ID NO: 865215 - protein, 9 aa, Homo Sapiens
GYARGIDPP

SEQ ID NO: 865216 - protein, 9 aa, Homo Sapiens
CLNWWSTVC

SEQ ID NO: 865217 - protein, 9 aa, Homo Sapiens
ERRIKRLCN

SEQ ID NO: 865218 - protein, 9 aa, Homo Sapiens
EKFLNILFH

SEQ ID NO: 865219 - protein, 9 aa, Homo Sapiens
ACMVDILAC

SEQ ID NO: 865220 - protein, 9 aa, Homo Sapiens
GPIPGPMSG

SEQ ID NO: 865221 - protein, 9 aa, Homo Sapiens
TKRNSRLGV

SEQ ID NO: 865222 - protein, 9 aa, Homo Sapiens
TGDWGDTHG

SEQ ID NO: 865223 - protein, 9 aa, Homo Sapiens
MREITQDFK

SEQ ID NO: 865224 - protein, 9 aa, Homo Sapiens
GGTLLFCTV

SEQ ID NO: 865225 - protein, 9 aa, Homo Sapiens
LLPVWEPND

SEQ ID NO: 865226 - protein, 9 aa, Homo Sapiens
DNSGRDDSE

SEQ ID NO: 865227 - protein, 9 aa, Homo Sapiens
RGGVRTAAA

SEQ ID NO: 865228 - protein, 9 aa, Homo Sapiens
HLSRRADDD

SEQ ID NO: 865229 - protein, 9 aa, Homo Sapiens
TGHYGFLLP

SEQ ID NO: 865230 - protein, 9 aa, Homo Sapiens
APEPNLMSP

SEQ ID NO: 865231 - protein, 9 aa, Homo Sapiens
EVRRLYVPK

SEQ ID NO: 865232 - protein, 9 aa, Homo Sapiens
YVAVYQPLH

SEQ ID NO: 865233 - protein, 9 aa, Homo Sapiens
ARHGCLGLE

SEQ ID NO: 865234 - protein, 9 aa, Homo Sapiens
TLRQIAHGA

SEQ ID NO: 865235 - protein, 9 aa, Homo Sapiens
KGLEAVACN

SEQ ID NO: 865236 - protein, 9 aa, Homo Sapiens
LSNTDSGCC

SEQ ID NO: 865237 - protein, 9 aa, Homo Sapiens
SLHSSLPIH

SEQ ID NO: 865238 - protein, 9 aa, Homo Sapiens
RSFLALTSH

SEQ ID NO: 865239 - protein, 9 aa, Homo Sapiens
DILPYDATR

SEQ ID NO: 865240 - protein, 9 aa, Homo Sapiens
KAVTFSILN

SEQ ID NO: 865241 - protein, 9 aa, Homo Sapiens
IAKIYQQHP

SEQ ID NO: 865242 - protein, 9 aa, Homo Sapiens
GHGGGQSQQ

SEQ ID NO: 865243 - protein, 9 aa, Homo Sapiens
HHPKWKNKV

SEQ ID NO: 865244 - protein, 9 aa, Homo Sapiens
NRKFYLFAE

SEQ ID NO: 865245 - protein, 9 aa, Homo Sapiens
ILCKYPDIA

SEQ ID NO: 865246 - protein, 9 aa, Homo Sapiens
NDLTSPSMG

SEQ ID NO: 865247 - protein, 9 aa, Homo Sapiens
YEGKLVRQT

SEQ ID NO: 865248 - protein, 9 aa, Homo Sapiens
EKTTVATEE

SEQ ID NO: 865249 - protein, 9 aa, Homo Sapiens
VYYCLHRRR

SEQ ID NO: 865250 - protein, 9 aa, Homo Sapiens
VGKYSIDID

SEQ ID NO: 865251 - protein, 9 aa, Homo Sapiens
SQVQRYTNA

SEQ ID NO: 865252 - protein, 9 aa, Homo Sapiens
GLVLPSRVQ

SEQ ID NO: 865253 - protein, 9 aa, Homo Sapiens
TMQTTTPGA

SEQ ID NO: 865254 - protein, 9 aa, Homo Sapiens
VFADMQEGG

SEQ ID NO: 865255 - protein, 9 aa, Homo Sapiens
IELSTLAAK

SEQ ID NO: 865256 - protein, 9 aa, Homo Sapiens
NPVQEEEDK

SEQ ID NO: 865257 - protein, 9 aa, Homo Sapiens
ALACKFIPP

SEQ ID NO: 865258 - protein, 9 aa, Homo Sapiens
ENIENRTER

SEQ ID NO: 865259 - protein, 9 aa, Homo Sapiens
EDRKTPSKS

SEQ ID NO: 865260 - protein, 9 aa, Homo Sapiens
YSDSVARGK

SEQ ID NO: 865261 - protein, 9 aa, Homo Sapiens
NLHLITHKQ

SEQ ID NO: 865262 - protein, 9 aa, Homo Sapiens
KPTVSRVVY

SEQ ID NO: 865263 - protein, 9 aa, Homo Sapiens
VVLNQHNSH

SEQ ID NO: 865264 - protein, 9 aa, Homo Sapiens
LGQQLPKVN

SEQ ID NO: 865265 - protein, 9 aa, Homo Sapiens
HIGMGVCYN

SEQ ID NO: 865266 - protein, 9 aa, Homo Sapiens
CLKGKMPIN

SEQ ID NO: 865267 - protein, 9 aa, Homo Sapiens
GQPVSTVWG

SEQ ID NO: 865268 - protein, 9 aa, Homo Sapiens
AHLVLPTDA

SEQ ID NO: 865269 - protein, 9 aa, Homo Sapiens
LFNKTFWDA

SEQ ID NO: 865270 - protein, 9 aa, Homo Sapiens
ELSWNQFST

SEQ ID NO: 865271 - protein, 9 aa, Homo Sapiens
VQQMEQETQ

SEQ ID NO: 865272 - protein, 9 aa, Homo Sapiens
EEAVSHNAS

SEQ ID NO: 865273 - protein, 9 aa, Homo Sapiens
FSLQNTFTT

SEQ ID NO: 865274 - protein, 9 aa, Homo Sapiens
SQASLGFKL

SEQ ID NO: 865275 - protein, 9 aa, Homo Sapiens
KHFQWANTG

SEQ ID NO: 865276 - protein, 9 aa, Homo Sapiens
ILRFLEIKE

SEQ ID NO: 865277 - protein, 9 aa, Homo Sapiens
DKPLLRALL

SEQ ID NO: 865278 - protein, 9 aa, Homo Sapiens
QDAHKLFHV

SEQ ID NO: 865279 - protein, 9 aa, Homo Sapiens
EDFLSALRQ

SEQ ID NO: 865280 - protein, 9 aa, Homo Sapiens
GDMFMSMQS

SEQ ID NO: 865281 - protein, 9 aa, Homo Sapiens
SHSDPHPDR

SEQ ID NO: 865282 - protein, 9 aa, Homo Sapiens
NNETFRISV

SEQ ID NO: 865283 - protein, 9 aa, Homo Sapiens
LPLKLEKSI

SEQ ID NO: 865284 - protein, 9 aa, Homo Sapiens
LPYKDCLRL

SEQ ID NO: 865285 - protein, 9 aa, Homo Sapiens
VHPLLQGWV

SEQ ID NO: 865286 - protein, 9 aa, Homo Sapiens
VETLSSYSG

SEQ ID NO: 865287 - protein, 9 aa, Homo Sapiens
HQNNHIRRH

SEQ ID NO: 865288 - protein, 9 aa, Homo Sapiens
MNLTVCGGT

SEQ ID NO: 865289 - protein, 9 aa, Homo Sapiens
QNGPRCLMN

SEQ ID NO: 865290 - protein, 9 aa, Homo Sapiens
QNLAALVSE

SEQ ID NO: 865291 - protein, 9 aa, Homo Sapiens
ETELQTELV

SEQ ID NO: 865292 - protein, 9 aa, Homo Sapiens
PEFQDLNKK

SEQ ID NO: 865293 - protein, 9 aa, Homo Sapiens
SCWPFSDEC

SEQ ID NO: 865294 - protein, 9 aa, Homo Sapiens
LTITRHCCQ

SEQ ID NO: 865295 - protein, 9 aa, Homo Sapiens
KKEHKREEE

SEQ ID NO: 865296 - protein, 9 aa, Homo Sapiens
VPHPSYLSG

SEQ ID NO: 865297 - protein, 9 aa, Homo Sapiens
LLAAIWFQT

SEQ ID NO: 865298 - protein, 9 aa, Homo Sapiens
VFCLQNPKA

SEQ ID NO: 865299 - protein, 9 aa, Homo Sapiens
PVFQENPLW

SEQ ID NO: 865300 - protein, 9 aa, Homo Sapiens
GIICLSSGW

SEQ ID NO: 865301 - protein, 9 aa, Homo Sapiens
GTNSPPDAD

SEQ ID NO: 865302 - protein, 9 aa, Homo Sapiens
PKAIKTNDP

SEQ ID NO: 865303 - protein, 9 aa, Homo Sapiens
WTEEMAFFG

SEQ ID NO: 865304 - protein, 9 aa, Homo Sapiens
GRFKPESSY

SEQ ID NO: 865305 - protein, 9 aa, Homo Sapiens
RNEPWNIYI

SEQ ID NO: 865306 - protein, 9 aa, Homo Sapiens
QFASMRNLY

SEQ ID NO: 865307 - protein, 9 aa, Homo Sapiens
TASYLICAR

SEQ ID NO: 865308 - protein, 9 aa, Homo Sapiens
YPKRRMTIA

SEQ ID NO: 865309 - protein, 9 aa, Homo Sapiens
PGHYIEKKT

SEQ ID NO: 865310 - protein, 9 aa, Homo Sapiens
GCAEILGKT

SEQ ID NO: 865311 - protein, 9 aa, Homo Sapiens
DFIFSSDHL

SEQ ID NO: 865312 - protein, 9 aa, Homo Sapiens
VTGLGKVTM

SEQ ID NO: 865313 - protein, 9 aa, Homo Sapiens
SLTKNGVFS

SEQ ID NO: 865314 - protein, 9 aa, Homo Sapiens
KDPQGNGSN

SEQ ID NO: 865315 - protein, 9 aa, Homo Sapiens
NLETERIPS

SEQ ID NO: 865316 - protein, 9 aa, Homo Sapiens
TAQLKDTKR

SEQ ID NO: 865317 - protein, 9 aa, Homo Sapiens
ETLIINLGE

SEQ ID NO: 865318 - protein, 9 aa, Homo Sapiens
TNKASILLI

SEQ ID NO: 865319 - protein, 9 aa, Homo Sapiens
YATQYYQCF

SEQ ID NO: 865320 - protein, 9 aa, Homo Sapiens
SFSETRTHQ

SEQ ID NO: 865321 - protein, 9 aa, Homo Sapiens
IAKENECMK

SEQ ID NO: 865322 - protein, 9 aa, Homo Sapiens
VVEESLPYF

SEQ ID NO: 865323 - protein, 9 aa, Homo Sapiens
RHSSYCSNT

SEQ ID NO: 865324 - protein, 9 aa, Homo Sapiens
NLYLLDSPF

SEQ ID NO: 865325 - protein, 9 aa, Homo Sapiens
DCINQIATA

SEQ ID NO: 865326 - protein, 9 aa, Homo Sapiens
PRWRRSHSR

SEQ ID NO: 865327 - protein, 9 aa, Homo Sapiens
SNGLFCKTL

SEQ ID NO: 865328 - protein, 9 aa, Homo Sapiens
QNIYFADQD

SEQ ID NO: 865329 - protein, 9 aa, Homo Sapiens
ISCFTQLIN

SEQ ID NO: 865330 - protein, 9 aa, Homo Sapiens
NMLLKFKDG

SEQ ID NO: 865331 - protein, 9 aa, Homo Sapiens
SLQNHYLNV

SEQ ID NO: 865332 - protein, 9 aa, Homo Sapiens
FNKTFWDAF

SEQ ID NO: 865333 - protein, 9 aa, Homo Sapiens
ISLPKVLNI

SEQ ID NO: 865334 - protein, 9 aa, Homo Sapiens
KCKLVNHIR

SEQ ID NO: 865335 - protein, 9 aa, Homo Sapiens
NNYFTNSVL

SEQ ID NO: 865336 - protein, 9 aa, Homo Sapiens
AEVIAGGCA

SEQ ID NO: 865337 - protein, 9 aa, Homo Sapiens
GIARMFPSI

SEQ ID NO: 865338 - protein, 9 aa, Homo Sapiens
SIDKDAKEA

SEQ ID NO: 865339 - protein, 9 aa, Homo Sapiens
KQLALSTAI

SEQ ID NO: 865340 - protein, 9 aa, Homo Sapiens
KQKEYCGIW

SEQ ID NO: 865341 - protein, 9 aa, Homo Sapiens
FNASDRFKG

SEQ ID NO: 865342 - protein, 9 aa, Homo Sapiens
DTNEVKNKP

SEQ ID NO: 865343 - protein, 9 aa, Homo Sapiens
DLTHRVANV

SEQ ID NO: 865344 - protein, 9 aa, Homo Sapiens
NKAQYEEPQ

SEQ ID NO: 865345 - protein, 9 aa, Homo Sapiens
LRFLDIPGQ

SEQ ID NO: 865346 - protein, 9 aa, Homo Sapiens
CHSLWGTHV

SEQ ID NO: 865347 - protein, 9 aa, Homo Sapiens
HNQVWGKVF

SEQ ID NO: 865348 - protein, 9 aa, Homo Sapiens
GAWLLLYRN

SEQ ID NO: 865349 - protein, 9 aa, Homo Sapiens
ALKEHLKRH

SEQ ID NO: 865350 - protein, 9 aa, Homo Sapiens
NRFGAYVAC

SEQ ID NO: 865351 - protein, 9 aa, Homo Sapiens
KCIFQIHTS

SEQ ID NO: 865352 - protein, 9 aa, Homo Sapiens
CCSPVPGLS

SEQ ID NO: 865353 - protein, 9 aa, Homo Sapiens
YSKLTWYLT

SEQ ID NO: 865354 - protein, 9 aa, Homo Sapiens
AYFRLQELF

SEQ ID NO: 865355 - protein, 9 aa, Homo Sapiens
SCLNKYIQI

SEQ ID NO: 865356 - protein, 9 aa, Homo Sapiens
FQNALEIGF

SEQ ID NO: 865357 - protein, 9 aa, Homo Sapiens
CVLHKCQVT

SEQ ID NO: 865358 - protein, 9 aa, Homo Sapiens
LSVPDDVYA

SEQ ID NO: 865359 - protein, 9 aa, Homo Sapiens
GKLIPPVLR

SEQ ID NO: 865360 - protein, 9 aa, Homo Sapiens
STNLDILTC

SEQ ID NO: 865361 - protein, 9 aa, Homo Sapiens
SILWDTIST

SEQ ID NO: 865362 - protein, 9 aa, Homo Sapiens
DMHVILWPI

SEQ ID NO: 865363 - protein, 9 aa, Homo Sapiens
KELDNLEIY

SEQ ID NO: 865364 - protein, 9 aa, Homo Sapiens
RYPNTCFFE

SEQ ID NO: 865365 - protein, 9 aa, Homo Sapiens
KQQVQIYKE

SEQ ID NO: 865366 - protein, 9 aa, Homo Sapiens
CPGNTYHLG

SEQ ID NO: 865367 - protein, 9 aa, Homo Sapiens
RGAEKEWGN

SEQ ID NO: 865368 - protein, 9 aa, Homo Sapiens
MLQSENKRL

SEQ ID NO: 865369 - protein, 9 aa, Homo Sapiens
SLVHHTYPQ

SEQ ID NO: 865370 - protein, 9 aa, Homo Sapiens
NAHLVQHLQ

SEQ ID NO: 865371 - protein, 9 aa, Homo Sapiens
GVELVCCPL

SEQ ID NO: 865372 - protein, 9 aa, Homo Sapiens
GDWYKPQNH

SEQ ID NO: 865373 - protein, 9 aa, Homo Sapiens
IISPHPALG

SEQ ID NO: 865374 - protein, 9 aa, Homo Sapiens
ELCAALVLV

SEQ ID NO: 865375 - protein, 9 aa, Homo Sapiens
ILALNPQTQ

SEQ ID NO: 865376 - protein, 9 aa, Homo Sapiens
EFCKRMEKE

SEQ ID NO: 865377 - protein, 9 aa, Homo Sapiens
NLPLKLEKS

SEQ ID NO: 865378 - protein, 9 aa, Homo Sapiens
MYSGSQTPH

SEQ ID NO: 865379 - protein, 9 aa, Homo Sapiens
IVLVILTTR

SEQ ID NO: 865380 - protein, 9 aa, Homo Sapiens
KVQAYIQMK

SEQ ID NO: 865381 - protein, 9 aa, Homo Sapiens
CYTLLPFLY

SEQ ID NO: 865382 - protein, 9 aa, Homo Sapiens
KLLQNIRQA

SEQ ID NO: 865383 - protein, 9 aa, Homo Sapiens
KILRRDIPV

SEQ ID NO: 865384 - protein, 9 aa, Homo Sapiens
EDTLIDEVE

SEQ ID NO: 865385 - protein, 9 aa, Homo Sapiens
MLLGIIICS

SEQ ID NO: 865386 - protein, 9 aa, Homo Sapiens
TEEAWLRHE

SEQ ID NO: 865387 - protein, 9 aa, Homo Sapiens
FKKGEIFQI

SEQ ID NO: 865388 - protein, 9 aa, Homo Sapiens
EIYQELAQL

SEQ ID NO: 865389 - protein, 9 aa, Homo Sapiens
RTSSTSCIC

SEQ ID NO: 865390 - protein, 9 aa, Homo Sapiens
GHKLPVLAP

SEQ ID NO: 865391 - protein, 9 aa, Homo Sapiens
SMFKDQMVY

SEQ ID NO: 865392 - protein, 9 aa, Homo Sapiens
FRNQRPGAS

SEQ ID NO: 865393 - protein, 9 aa, Homo Sapiens
LINHIKQFL

SEQ ID NO: 865394 - protein, 9 aa, Homo Sapiens
SLNLWTTLA

SEQ ID NO: 865395 - protein, 9 aa, Homo Sapiens
QLAGSDDSK

SEQ ID NO: 865396 - protein, 9 aa, Homo Sapiens
DALEKAQTY

SEQ ID NO: 865397 - protein, 9 aa, Homo Sapiens
VQIVERNYP

SEQ ID NO: 865398 - protein, 9 aa, Homo Sapiens
FRYLGDKGL

SEQ ID NO: 865399 - protein, 9 aa, Homo Sapiens
VRMRRKNRK

SEQ ID NO: 865400 - protein, 9 aa, Homo Sapiens
PGAHPKGYV

SEQ ID NO: 865401 - protein, 9 aa, Homo Sapiens
AGNSYIKYW

SEQ ID NO: 865402 - protein, 9 aa, Homo Sapiens
GHQPYWWVQ

SEQ ID NO: 865403 - protein, 9 aa, Homo Sapiens
QEGSEKIIT

SEQ ID NO: 865404 - protein, 9 aa, Homo Sapiens
LAVEAQERG

SEQ ID NO: 865405 - protein, 9 aa, Homo Sapiens
SGSSQSLYK

SEQ ID NO: 865406 - protein, 9 aa, Homo Sapiens
ASDYKYFYI

SEQ ID NO: 865407 - protein, 9 aa, Homo Sapiens
TVVQVAENQ

SEQ ID NO: 865408 - protein, 9 aa, Homo Sapiens
PSAWQMAYE

SEQ ID NO: 865409 - protein, 9 aa, Homo Sapiens
IHLIQRKIV

SEQ ID NO: 865410 - protein, 9 aa, Homo Sapiens
VVSDNNPCI

SEQ ID NO: 865411 - protein, 9 aa, Homo Sapiens
YNAWSLRKA

SEQ ID NO: 865412 - protein, 9 aa, Homo Sapiens
APIIILQRT

SEQ ID NO: 865413 - protein, 9 aa, Homo Sapiens
PQNGNTYKK

SEQ ID NO: 865414 - protein, 9 aa, Homo Sapiens
LRTLETQPT

SEQ ID NO: 865415 - protein, 9 aa, Homo Sapiens
QTTTFQVFV

SEQ ID NO: 865416 - protein, 9 aa, Homo Sapiens
RIILNGKDK

SEQ ID NO: 865417 - protein, 9 aa, Homo Sapiens
KIKRGIKIL

SEQ ID NO: 865418 - protein, 9 aa, Homo Sapiens
RHHIIHSGE

SEQ ID NO: 865419 - protein, 9 aa, Homo Sapiens
NTSDLLRKM

SEQ ID NO: 865420 - protein, 9 aa, Homo Sapiens
LFLADVNNY

SEQ ID NO: 865421 - protein, 9 aa, Homo Sapiens
IILYCNSSG

SEQ ID NO: 865422 - protein, 9 aa, Homo Sapiens
HHIYNKCKI

SEQ ID NO: 865423 - protein, 9 aa, Homo Sapiens
MQNKFLLKS

SEQ ID NO: 865424 - protein, 9 aa, Homo Sapiens
LSDNSLDSL

SEQ ID NO: 865425 - protein, 9 aa, Homo Sapiens
PQHLNQKGK

SEQ ID NO: 865426 - protein, 9 aa, Homo Sapiens
RIYPDMSVL

SEQ ID NO: 865427 - protein, 9 aa, Homo Sapiens
VFLELTAGV

SEQ ID NO: 865428 - protein, 9 aa, Homo Sapiens
AVTSQSDSK

SEQ ID NO: 865429 - protein, 9 aa, Homo Sapiens
GENFLHTYS

SEQ ID NO: 865430 - protein, 9 aa, Homo Sapiens
CKVNESIKY

SEQ ID NO: 865431 - protein, 9 aa, Homo Sapiens
KKHLRIHSG

SEQ ID NO: 865432 - protein, 9 aa, Homo Sapiens
DREIIQEVA

SEQ ID NO: 865433 - protein, 9 aa, Homo Sapiens
PKIGRGELQ

SEQ ID NO: 865434 - protein, 9 aa, Homo Sapiens
AFKPGRQSD

SEQ ID NO: 865435 - protein, 9 aa, Homo Sapiens
KCRHPGTCP

SEQ ID NO: 865436 - protein, 9 aa, Homo Sapiens
LPNPDSDNF

SEQ ID NO: 865437 - protein, 9 aa, Homo Sapiens
PFQGQLDYI

SEQ ID NO: 865438 - protein, 9 aa, Homo Sapiens
AGVANCSAS

SEQ ID NO: 865439 - protein, 9 aa, Homo Sapiens
YRHGISSQI

SEQ ID NO: 865440 - protein, 9 aa, Homo Sapiens
DSQGLGLHF

SEQ ID NO: 865441 - protein, 9 aa, Homo Sapiens
GEKGKRGPP

SEQ ID NO: 865442 - protein, 9 aa, Homo Sapiens
FLKAFAANV

SEQ ID NO: 865443 - protein, 9 aa, Homo Sapiens
GGNFLEDKS

SEQ ID NO: 865444 - protein, 9 aa, Homo Sapiens
RKMQRVQEE

SEQ ID NO: 865445 - protein, 9 aa, Homo Sapiens
ASESGDQYR

SEQ ID NO: 865446 - protein, 9 aa, Homo Sapiens
ESRHRHAMT

SEQ ID NO: 865447 - protein, 9 aa, Homo Sapiens
ASNNTTSIA

SEQ ID NO: 865448 - protein, 9 aa, Homo Sapiens
RPGKDSYWT

SEQ ID NO: 865449 - protein, 9 aa, Homo Sapiens
SIIHPGSVA

SEQ ID NO: 865450 - protein, 9 aa, Homo Sapiens
PIMNLEQFP

SEQ ID NO: 865451 - protein, 9 aa, Homo Sapiens
VSYVPYCRF

SEQ ID NO: 865452 - protein, 9 aa, Homo Sapiens
FLCSRTLNK

SEQ ID NO: 865453 - protein, 9 aa, Homo Sapiens
ILVFVAVKI

SEQ ID NO: 865454 - protein, 9 aa, Homo Sapiens
QKEVKILKG

SEQ ID NO: 865455 - protein, 9 aa, Homo Sapiens
GDKLPIQGH

SEQ ID NO: 865456 - protein, 9 aa, Homo Sapiens
TEVKLQNGE

SEQ ID NO: 865457 - protein, 9 aa, Homo Sapiens
VQELVLQLL

SEQ ID NO: 865458 - protein, 9 aa, Homo Sapiens
SVKLSVCMT

SEQ ID NO: 865459 - protein, 9 aa, Homo Sapiens
TERLLKIKY

SEQ ID NO: 865460 - protein, 9 aa, Homo Sapiens
IVFVERREK

SEQ ID NO: 865461 - protein, 9 aa, Homo Sapiens
NILQCPKCD

SEQ ID NO: 865462 - protein, 9 aa, Homo Sapiens
LQAIPHIAT

SEQ ID NO: 865463 - protein, 9 aa, Homo Sapiens
LHLTGKIQI

SEQ ID NO: 865464 - protein, 9 aa, Homo Sapiens
YNPATDKWT

SEQ ID NO: 865465 - protein, 9 aa, Homo Sapiens
IQHGVHMMV

SEQ ID NO: 865466 - protein, 9 aa, Homo Sapiens
NTRNHFEGT

SEQ ID NO: 865467 - protein, 9 aa, Homo Sapiens
HLPYKDCLR

SEQ ID NO: 865468 - protein, 9 aa, Homo Sapiens
HFKKELQEP

SEQ ID NO: 865469 - protein, 9 aa, Homo Sapiens
SSLQRHEMT

SEQ ID NO: 865470 - protein, 9 aa, Homo Sapiens
GGSMVLLGI

SEQ ID NO: 865471 - protein, 9 aa, Homo Sapiens
RDCRRHFTP

SEQ ID NO: 865472 - protein, 9 aa, Homo Sapiens
DKLENVKAI

SEQ ID NO: 865473 - protein, 9 aa, Homo Sapiens
EIGPGELGG

SEQ ID NO: 865474 - protein, 9 aa, Homo Sapiens
LNIVLSILK

SEQ ID NO: 865475 - protein, 9 aa, Homo Sapiens
RHMGNYRQI

SEQ ID NO: 865476 - protein, 9 aa, Homo Sapiens
LLITGKIVG

SEQ ID NO: 865477 - protein, 9 aa, Homo Sapiens
VGGKKRLCL

SEQ ID NO: 865478 - protein, 9 aa, Homo Sapiens
SPQIPRRDI

SEQ ID NO: 865479 - protein, 9 aa, Homo Sapiens
SLDREKTPK

SEQ ID NO: 865480 - protein, 9 aa, Homo Sapiens
EKHNQLGSA

SEQ ID NO: 865481 - protein, 9 aa, Homo Sapiens
VKFSYMWII

SEQ ID NO: 865482 - protein, 9 aa, Homo Sapiens
QLLASGSLL

SEQ ID NO: 865483 - protein, 9 aa, Homo Sapiens
IPPVEGCLP

SEQ ID NO: 865484 - protein, 9 aa, Homo Sapiens
SAPDLTIKK

SEQ ID NO: 865485 - protein, 9 aa, Homo Sapiens
KFKSKFQFI

SEQ ID NO: 865486 - protein, 9 aa, Homo Sapiens
LLEVGEDCE

SEQ ID NO: 865487 - protein, 9 aa, Homo Sapiens
LAKWMVHGY

SEQ ID NO: 865488 - protein, 9 aa, Homo Sapiens
FTCSVGKSL

SEQ ID NO: 865489 - protein, 9 aa, Homo Sapiens
LDDLYKYLF

SEQ ID NO: 865490 - protein, 9 aa, Homo Sapiens
ALKTLSFLF

SEQ ID NO: 865491 - protein, 9 aa, Homo Sapiens
PDIAQQFKM

SEQ ID NO: 865492 - protein, 9 aa, Homo Sapiens
NCIEDLQKN

SEQ ID NO: 865493 - protein, 9 aa, Homo Sapiens
RVQPITSST

SEQ ID NO: 865494 - protein, 9 aa, Homo Sapiens
RFGVTTHKH

SEQ ID NO: 865495 - protein, 9 aa, Homo Sapiens
DIEGNVVAA

SEQ ID NO: 865496 - protein, 9 aa, Homo Sapiens
VWAAAPSHW

SEQ ID NO: 865497 - protein, 9 aa, Homo Sapiens
RNLRSPAEV

SEQ ID NO: 865498 - protein, 9 aa, Homo Sapiens
ICYSTWKKA

SEQ ID NO: 865499 - protein, 9 aa, Homo Sapiens
EVKLCLECI

SEQ ID NO: 865500 - protein, 9 aa, Homo Sapiens
VNQMGEEND

SEQ ID NO: 865501 - protein, 9 aa, Homo Sapiens
IADVQKHAS

SEQ ID NO: 865502 - protein, 9 aa, Homo Sapiens
DLNQTKLEC

SEQ ID NO: 865503 - protein, 9 aa, Homo Sapiens
GSRYDNLVS

SEQ ID NO: 865504 - protein, 9 aa, Homo Sapiens
REGVSPQNS

SEQ ID NO: 865505 - protein, 9 aa, Homo Sapiens
SKGDFIFSS

SEQ ID NO: 865506 - protein, 9 aa, Homo Sapiens
SRAQELVAK

SEQ ID NO: 865507 - protein, 9 aa, Homo Sapiens
AKNNVLNMN

SEQ ID NO: 865508 - protein, 9 aa, Homo Sapiens
ANTVKFCCP

SEQ ID NO: 865509 - protein, 9 aa, Homo Sapiens
FGADDTNEV

SEQ ID NO: 865510 - protein, 9 aa, Homo Sapiens
TPAPMAQFL

SEQ ID NO: 865511 - protein, 9 aa, Homo Sapiens
IIVLVSYLN

SEQ ID NO: 865512 - protein, 9 aa, Homo Sapiens
SVAVVVGIT

SEQ ID NO: 865513 - protein, 9 aa, Homo Sapiens
ITLRLGKAH

SEQ ID NO: 865514 - protein, 9 aa, Homo Sapiens
HVGSNCLEN

SEQ ID NO: 865515 - protein, 9 aa, Homo Sapiens
LKVLAQLWD

SEQ ID NO: 865516 - protein, 9 aa, Homo Sapiens
YPVPKSPVE

SEQ ID NO: 865517 - protein, 9 aa, Homo Sapiens
DVHRLIKGE

SEQ ID NO: 865518 - protein, 9 aa, Homo Sapiens
GRVDEEIVL

SEQ ID NO: 865519 - protein, 9 aa, Homo Sapiens
QACLDETAV

SEQ ID NO: 865520 - protein, 9 aa, Homo Sapiens
LSRSLLYVG

SEQ ID NO: 865521 - protein, 9 aa, Homo Sapiens
ILLPLIISK

SEQ ID NO: 865522 - protein, 9 aa, Homo Sapiens
TENKEKLAY

SEQ ID NO: 865523 - protein, 9 aa, Homo Sapiens
LCHQMSIGS

SEQ ID NO: 865524 - protein, 9 aa, Homo Sapiens
AATYTLSGL

SEQ ID NO: 865525 - protein, 9 aa, Homo Sapiens
SQDYRRRHS

SEQ ID NO: 865526 - protein, 9 aa, Homo Sapiens
EEPPASAYP

SEQ ID NO: 865527 - protein, 9 aa, Homo Sapiens
EAENVWWIT

SEQ ID NO: 865528 - protein, 9 aa, Homo Sapiens
SKSNSPSSS

SEQ ID NO: 865529 - protein, 9 aa, Homo Sapiens
ASDSLYAVN

SEQ ID NO: 865530 - protein, 9 aa, Homo Sapiens
ADWHGRPVV

SEQ ID NO: 865531 - protein, 9 aa, Homo Sapiens
LNFSVSNFN

SEQ ID NO: 865532 - protein, 9 aa, Homo Sapiens
VLVKRRDNE

SEQ ID NO: 865533 - protein, 9 aa, Homo Sapiens
TSIKPKATE

SEQ ID NO: 865534 - protein, 9 aa, Homo Sapiens
LVNNPPVML

SEQ ID NO: 865535 - protein, 9 aa, Homo Sapiens
RLGLQLHPA

SEQ ID NO: 865536 - protein, 9 aa, Homo Sapiens
PPNMTTNKR

SEQ ID NO: 865537 - protein, 9 aa, Homo Sapiens
LWSQAHFPL

SEQ ID NO: 865538 - protein, 9 aa, Homo Sapiens
RLSGRKASC

SEQ ID NO: 865539 - protein, 9 aa, Homo Sapiens
QTRLRLLRS

SEQ ID NO: 865540 - protein, 9 aa, Homo Sapiens
NNLNTLLLN

SEQ ID NO: 865541 - protein, 9 aa, Homo Sapiens
KVFNQASCL

SEQ ID NO: 865542 - protein, 9 aa, Homo Sapiens
GMQKQGLFQ

SEQ ID NO: 865543 - protein, 9 aa, Homo Sapiens
VLEAALEQM

SEQ ID NO: 865544 - protein, 9 aa, Homo Sapiens
DSNNFPLRA

SEQ ID NO: 865545 - protein, 9 aa, Homo Sapiens
SHYHRGYHH

SEQ ID NO: 865546 - protein, 9 aa, Homo Sapiens
DATPGVDLS

SEQ ID NO: 865547 - protein, 9 aa, Homo Sapiens
YLHNCETCR

SEQ ID NO: 865548 - protein, 9 aa, Homo Sapiens
SADTTGVSA

SEQ ID NO: 865549 - protein, 9 aa, Homo Sapiens
RVGPGFLLS

SEQ ID NO: 865550 - protein, 9 aa, Homo Sapiens
SLSDLASLS

SEQ ID NO: 865551 - protein, 9 aa, Homo Sapiens
QNENEQIHA

SEQ ID NO: 865552 - protein, 9 aa, Homo Sapiens
ETLSQIQNS

SEQ ID NO: 865553 - protein, 9 aa, Homo Sapiens
KVDYASFHE

SEQ ID NO: 865554 - protein, 9 aa, Homo Sapiens
EINEQIIKE

SEQ ID NO: 865555 - protein, 9 aa, Homo Sapiens
NSIEMYRGK

SEQ ID NO: 865556 - protein, 9 aa, Homo Sapiens
PIKKTKLQQ

SEQ ID NO: 865557 - protein, 9 aa, Homo Sapiens
GQTFVAPDY

SEQ ID NO: 865558 - protein, 9 aa, Homo Sapiens
KPLSFKWWN

SEQ ID NO: 865559 - protein, 9 aa, Homo Sapiens
YIENSDSEE

SEQ ID NO: 865560 - protein, 9 aa, Homo Sapiens
KAIKQLKEQ

SEQ ID NO: 865561 - protein, 9 aa, Homo Sapiens
LDLEVFILG

SEQ ID NO: 865562 - protein, 9 aa, Homo Sapiens
YMSVQSERS

SEQ ID NO: 865563 - protein, 9 aa, Homo Sapiens
PPGHYDINK

SEQ ID NO: 865564 - protein, 9 aa, Homo Sapiens
SPTNFQQLY

SEQ ID NO: 865565 - protein, 9 aa, Homo Sapiens
QENYCQNPR

SEQ ID NO: 865566 - protein, 9 aa, Homo Sapiens
RNMDDDHLS

SEQ ID NO: 865567 - protein, 9 aa, Homo Sapiens
GYKRFLGPE

SEQ ID NO: 865568 - protein, 9 aa, Homo Sapiens
EKGSDQYRN

SEQ ID NO: 865569 - protein, 9 aa, Homo Sapiens
ISPHPALGQ

SEQ ID NO: 865570 - protein, 9 aa, Homo Sapiens
QRHSGKDWY

SEQ ID NO: 865571 - protein, 9 aa, Homo Sapiens
RKSESQKKS

SEQ ID NO: 865572 - protein, 9 aa, Homo Sapiens
ARFNNLRFV

SEQ ID NO: 865573 - protein, 9 aa, Homo Sapiens
LLNKELVPL

SEQ ID NO: 865574 - protein, 9 aa, Homo Sapiens
SGEGRKKAF

SEQ ID NO: 865575 - protein, 9 aa, Homo Sapiens
EHLKRHTAA

SEQ ID NO: 865576 - protein, 9 aa, Homo Sapiens
IVSVLCTEN

SEQ ID NO: 865577 - protein, 9 aa, Homo Sapiens
SWTSSQEND

SEQ ID NO: 865578 - protein, 9 aa, Homo Sapiens
KFDKILYNK

SEQ ID NO: 865579 - protein, 9 aa, Homo Sapiens
ALSQPQKHR

SEQ ID NO: 865580 - protein, 9 aa, Homo Sapiens
LSTLNSCIN

SEQ ID NO: 865581 - protein, 9 aa, Homo Sapiens
CLRTCGGGV

SEQ ID NO: 865582 - protein, 9 aa, Homo Sapiens
DNSDSQDSS

SEQ ID NO: 865583 - protein, 9 aa, Homo Sapiens
VGIAYSNYN

SEQ ID NO: 865584 - protein, 9 aa, Homo Sapiens
IFSVREKRD

SEQ ID NO: 865585 - protein, 9 aa, Homo Sapiens
EFWLGNEHL

SEQ ID NO: 865586 - protein, 9 aa, Homo Sapiens
CRTVTQQRG

SEQ ID NO: 865587 - protein, 9 aa, Homo Sapiens
NSSASKFLP

SEQ ID NO: 865588 - protein, 9 aa, Homo Sapiens
WFLRSMFAN

SEQ ID NO: 865589 - protein, 9 aa, Homo Sapiens
KLKRHIHSH

SEQ ID NO: 865590 - protein, 9 aa, Homo Sapiens
PHTPLTVLM

SEQ ID NO: 865591 - protein, 9 aa, Homo Sapiens
EFIRGSTLC

SEQ ID NO: 865592 - protein, 9 aa, Homo Sapiens
YNSHSLDVA

SEQ ID NO: 865593 - protein, 9 aa, Homo Sapiens
HMYKQDGGL

SEQ ID NO: 865594 - protein, 9 aa, Homo Sapiens
NVGKQDPKH

SEQ ID NO: 865595 - protein, 9 aa, Homo Sapiens
KSLLSHNKF

SEQ ID NO: 865596 - protein, 9 aa, Homo Sapiens
DKYRNDYCE

SEQ ID NO: 865597 - protein, 9 aa, Homo Sapiens
MSPRSLPSN

SEQ ID NO: 865598 - protein, 9 aa, Homo Sapiens
RHKEIQDLE

SEQ ID NO: 865599 - protein, 9 aa, Homo Sapiens
YPINISLNY

SEQ ID NO: 865600 - protein, 9 aa, Homo Sapiens
NCWCPGPVR

SEQ ID NO: 865601 - protein, 9 aa, Homo Sapiens
KTLGYLSSV

SEQ ID NO: 865602 - protein, 9 aa, Homo Sapiens
IRLLPRGNG

SEQ ID NO: 865603 - protein, 9 aa, Homo Sapiens
WMFCGFLFS

SEQ ID NO: 865604 - protein, 9 aa, Homo Sapiens
THQAIHTGQ

SEQ ID NO: 865605 - protein, 9 aa, Homo Sapiens
IIKLTDYFT

SEQ ID NO: 865606 - protein, 9 aa, Homo Sapiens
QAPHRRWRT

SEQ ID NO: 865607 - protein, 9 aa, Homo Sapiens
GQNTLPAQP

SEQ ID NO: 865608 - protein, 9 aa, Homo Sapiens
EWNLISSVA

SEQ ID NO: 865609 - protein, 9 aa, Homo Sapiens
KNKQKHRIW

SEQ ID NO: 865610 - protein, 9 aa, Homo Sapiens
ITQDFKTDL

SEQ ID NO: 865611 - protein, 9 aa, Homo Sapiens
GLSFITCIC

SEQ ID NO: 865612 - protein, 9 aa, Homo Sapiens
VPVNWSHAN

SEQ ID NO: 865613 - protein, 9 aa, Homo Sapiens
RQCVGWRHR

SEQ ID NO: 865614 - protein, 9 aa, Homo Sapiens
MAKARITSS

SEQ ID NO: 865615 - protein, 9 aa, Homo Sapiens
KSAGKFEAV

SEQ ID NO: 865616 - protein, 9 aa, Homo Sapiens
PLKKRSCAS

SEQ ID NO: 865617 - protein, 9 aa, Homo Sapiens
GAVFPGTLT

SEQ ID NO: 865618 - protein, 9 aa, Homo Sapiens
VLYANNKYL

SEQ ID NO: 865619 - protein, 9 aa, Homo Sapiens
RTPKTPQTP

SEQ ID NO: 865620 - protein, 9 aa, Homo Sapiens
CSQTVSTRY

SEQ ID NO: 865621 - protein, 9 aa, Homo Sapiens
NYERVKTCF

SEQ ID NO: 865622 - protein, 9 aa, Homo Sapiens
RCTQQAALP

SEQ ID NO: 865623 - protein, 9 aa, Homo Sapiens
LGMKSCGIH

SEQ ID NO: 865624 - protein, 9 aa, Homo Sapiens
YAGRNKHGH

SEQ ID NO: 865625 - protein, 9 aa, Homo Sapiens
DRLDVLKKY

SEQ ID NO: 865626 - protein, 9 aa, Homo Sapiens
TCPPGWKWE

SEQ ID NO: 865627 - protein, 9 aa, Homo Sapiens
EKYSKWLGP

SEQ ID NO: 865628 - protein, 9 aa, Homo Sapiens
QPSLTKNGV

SEQ ID NO: 865629 - protein, 9 aa, Homo Sapiens
WKNMSNISI

SEQ ID NO: 865630 - protein, 9 aa, Homo Sapiens
YLALPERAK

SEQ ID NO: 865631 - protein, 9 aa, Homo Sapiens
NALNSLKEK

SEQ ID NO: 865632 - protein, 9 aa, Homo Sapiens
DIADVQKHA

SEQ ID NO: 865633 - protein, 9 aa, Homo Sapiens
VKTALKRVI

SEQ ID NO: 865634 - protein, 9 aa, Homo Sapiens
VSTQRFKVN

SEQ ID NO: 865635 - protein, 9 aa, Homo Sapiens
AVNKTPSFP

SEQ ID NO: 865636 - protein, 9 aa, Homo Sapiens
HAARRLDGE

SEQ ID NO: 865637 - protein, 9 aa, Homo Sapiens
RDKGSYFFW

SEQ ID NO: 865638 - protein, 9 aa, Homo Sapiens
KNCPDDLWN

SEQ ID NO: 865639 - protein, 9 aa, Homo Sapiens
DTTVDEDVL

SEQ ID NO: 865640 - protein, 9 aa, Homo Sapiens
GTPQPGGAS

SEQ ID NO: 865641 - protein, 9 aa, Homo Sapiens
SEKKAHTQN

SEQ ID NO: 865642 - protein, 9 aa, Homo Sapiens
VKAYVLPIG

SEQ ID NO: 865643 - protein, 9 aa, Homo Sapiens
SITLQPPNE

SEQ ID NO: 865644 - protein, 9 aa, Homo Sapiens
QVTSTEFIS

SEQ ID NO: 865645 - protein, 9 aa, Homo Sapiens
ANESRKKIN

SEQ ID NO: 865646 - protein, 9 aa, Homo Sapiens
VLGSLLFLV

SEQ ID NO: 865647 - protein, 9 aa, Homo Sapiens
LVNASCEEV

SEQ ID NO: 865648 - protein, 9 aa, Homo Sapiens
LIEKNIKLF

SEQ ID NO: 865649 - protein, 9 aa, Homo Sapiens
TCTTKFLAM

SEQ ID NO: 865650 - protein, 9 aa, Homo Sapiens
GSIKMAVCK

SEQ ID NO: 865651 - protein, 9 aa, Homo Sapiens
VNEKQIKNF

SEQ ID NO: 865652 - protein, 9 aa, Homo Sapiens
DSGHSMKWS

SEQ ID NO: 865653 - protein, 9 aa, Homo Sapiens
RFFMVVKQC

SEQ ID NO: 865654 - protein, 9 aa, Homo Sapiens
PNPALSQAM

SEQ ID NO: 865655 - protein, 9 aa, Homo Sapiens
KTKMRSSGW

SEQ ID NO: 865656 - protein, 9 aa, Homo Sapiens
GCIEWCCSV

SEQ ID NO: 865657 - protein, 9 aa, Homo Sapiens
GSLFASDNF

SEQ ID NO: 865658 - protein, 9 aa, Homo Sapiens
GIIQISLPE

SEQ ID NO: 865659 - protein, 9 aa, Homo Sapiens
TRVNLCDDL

SEQ ID NO: 865660 - protein, 9 aa, Homo Sapiens
PKTAEHFRA

SEQ ID NO: 865661 - protein, 9 aa, Homo Sapiens
WQKDVLEIF

SEQ ID NO: 865662 - protein, 9 aa, Homo Sapiens
GLQNGPRCL

SEQ ID NO: 865663 - protein, 9 aa, Homo Sapiens
VHYNSDSYD

SEQ ID NO: 865664 - protein, 9 aa, Homo Sapiens
PIWLYWQIW

SEQ ID NO: 865665 - protein, 9 aa, Homo Sapiens
QGKQMHVQL

SEQ ID NO: 865666 - protein, 9 aa, Homo Sapiens
NEDDINASY

SEQ ID NO: 865667 - protein, 9 aa, Homo Sapiens
KLLAQPADN

SEQ ID NO: 865668 - protein, 9 aa, Homo Sapiens
QNLIQQAKL

SEQ ID NO: 865669 - protein, 9 aa, Homo Sapiens
LLSNIEDIL

SEQ ID NO: 865670 - protein, 9 aa, Homo Sapiens
FVFNIPSTA

SEQ ID NO: 865671 - protein, 9 aa, Homo Sapiens
SHTLKGQRL

SEQ ID NO: 865672 - protein, 9 aa, Homo Sapiens
ASLCLEGIQ

SEQ ID NO: 865673 - protein, 9 aa, Homo Sapiens
PKAWHKDIL

SEQ ID NO: 865674 - protein, 9 aa, Homo Sapiens
GGRSGTFCT

SEQ ID NO: 865675 - protein, 9 aa, Homo Sapiens
LLGITYLPS

SEQ ID NO: 865676 - protein, 9 aa, Homo Sapiens
SESRTEKHN

SEQ ID NO: 865677 - protein, 9 aa, Homo Sapiens
DLSILWINP

SEQ ID NO: 865678 - protein, 9 aa, Homo Sapiens
EQNMKLCQE

SEQ ID NO: 865679 - protein, 9 aa, Homo Sapiens
TDPPDLLVL

SEQ ID NO: 865680 - protein, 9 aa, Homo Sapiens
RLKPHKAQN

SEQ ID NO: 865681 - protein, 9 aa, Homo Sapiens
RRVWGRLYP

SEQ ID NO: 865682 - protein, 9 aa, Homo Sapiens
PGFSGKLCE

SEQ ID NO: 865683 - protein, 9 aa, Homo Sapiens
SKYVSLPVP

SEQ ID NO: 865684 - protein, 9 aa, Homo Sapiens
DMVLRQRFW

SEQ ID NO: 865685 - protein, 9 aa, Homo Sapiens
FIRLYLLQG

SEQ ID NO: 865686 - protein, 9 aa, Homo Sapiens
SITKKTFIG

SEQ ID NO: 865687 - protein, 9 aa, Homo Sapiens
DQSSRIQSI

SEQ ID NO: 865688 - protein, 9 aa, Homo Sapiens
FFPKKLLER

SEQ ID NO: 865689 - protein, 9 aa, Homo Sapiens
KVATHAPLA

SEQ ID NO: 865690 - protein, 9 aa, Homo Sapiens
LFPFHHTTA

SEQ ID NO: 865691 - protein, 9 aa, Homo Sapiens
HTDDFEESN

SEQ ID NO: 865692 - protein, 9 aa, Homo Sapiens
RELFVDDFE

SEQ ID NO: 865693 - protein, 9 aa, Homo Sapiens
SDLLNKKAI

SEQ ID NO: 865694 - protein, 9 aa, Homo Sapiens
VPKGFNKND

SEQ ID NO: 865695 - protein, 9 aa, Homo Sapiens
PTSKQIRKD

SEQ ID NO: 865696 - protein, 9 aa, Homo Sapiens
LRLLCTDTS

SEQ ID NO: 865697 - protein, 9 aa, Homo Sapiens
VKGTMKDIC

SEQ ID NO: 865698 - protein, 9 aa, Homo Sapiens
ADRNFIKNT

SEQ ID NO: 865699 - protein, 9 aa, Homo Sapiens
VQNIQNVLV

SEQ ID NO: 865700 - protein, 9 aa, Homo Sapiens
HSPVFLDKK

SEQ ID NO: 865701 - protein, 9 aa, Homo Sapiens
SEDKSKIVC

SEQ ID NO: 865702 - protein, 9 aa, Homo Sapiens
EVNKRRQEL

SEQ ID NO: 865703 - protein, 9 aa, Homo Sapiens
TCICYVASS

SEQ ID NO: 865704 - protein, 9 aa, Homo Sapiens
LDEYLKSPL

SEQ ID NO: 865705 - protein, 9 aa, Homo Sapiens
FSGSHLEGW

SEQ ID NO: 865706 - protein, 9 aa, Homo Sapiens
CQEMIATQK

SEQ ID NO: 865707 - protein, 9 aa, Homo Sapiens
ELFIYLPFS

SEQ ID NO: 865708 - protein, 9 aa, Homo Sapiens
QGCWDAEEL

SEQ ID NO: 865709 - protein, 9 aa, Homo Sapiens
IHTGEKVYE

SEQ ID NO: 865710 - protein, 9 aa, Homo Sapiens
YDLLISQFR

SEQ ID NO: 865711 - protein, 9 aa, Homo Sapiens
YYNTIIDDL

SEQ ID NO: 865712 - protein, 9 aa, Homo Sapiens
CRSGFYKAF

SEQ ID NO: 865713 - protein, 9 aa, Homo Sapiens
LPKDFMDQN

SEQ ID NO: 865714 - protein, 9 aa, Homo Sapiens
CIMIQYLLS

SEQ ID NO: 865715 - protein, 9 aa, Homo Sapiens
AKLAASLGL

SEQ ID NO: 865716 - protein, 9 aa, Homo Sapiens
RLCKRVGPG

SEQ ID NO: 865717 - protein, 9 aa, Homo Sapiens
IYTYQKKFT

SEQ ID NO: 865718 - protein, 9 aa, Homo Sapiens
VLPKKLKKD

SEQ ID NO: 865719 - protein, 9 aa, Homo Sapiens
NNPQFVFDI

SEQ ID NO: 865720 - protein, 9 aa, Homo Sapiens
YPLCPKDVV

SEQ ID NO: 865721 - protein, 9 aa, Homo Sapiens
FGQVTILYI

SEQ ID NO: 865722 - protein, 9 aa, Homo Sapiens
IREQEERLL

SEQ ID NO: 865723 - protein, 9 aa, Homo Sapiens
LTTQEPTDN

SEQ ID NO: 865724 - protein, 9 aa, Homo Sapiens
GCVRASYDT

SEQ ID NO: 865725 - protein, 9 aa, Homo Sapiens
SEGPNLTDI

SEQ ID NO: 865726 - protein, 9 aa, Homo Sapiens
ETVMVQETQ

SEQ ID NO: 865727 - protein, 9 aa, Homo Sapiens
EEIGQKNIN

SEQ ID NO: 865728 - protein, 9 aa, Homo Sapiens
QNPMSTKKI

SEQ ID NO: 865729 - protein, 9 aa, Homo Sapiens
RQIKLGFTQ

SEQ ID NO: 865730 - protein, 9 aa, Homo Sapiens
HNCGHHKDA

SEQ ID NO: 865731 - protein, 9 aa, Homo Sapiens
RTLNKHKTI

SEQ ID NO: 865732 - protein, 9 aa, Homo Sapiens
TKIKDGDFK

SEQ ID NO: 865733 - protein, 9 aa, Homo Sapiens
RLRKNTVKC

SEQ ID NO: 865734 - protein, 9 aa, Homo Sapiens
ISFNPSLYK

SEQ ID NO: 865735 - protein, 9 aa, Homo Sapiens
ISQEECSST

SEQ ID NO: 865736 - protein, 9 aa, Homo Sapiens
KTFKCFSYL

SEQ ID NO: 865737 - protein, 9 aa, Homo Sapiens
ESPEDMEIG

SEQ ID NO: 865738 - protein, 9 aa, Homo Sapiens
IKSLVALMV

SEQ ID NO: 865739 - protein, 9 aa, Homo Sapiens
SQINHIQNG

SEQ ID NO: 865740 - protein, 9 aa, Homo Sapiens
DQSGNLRIH

SEQ ID NO: 865741 - protein, 9 aa, Homo Sapiens
ESEVFQVTS

SEQ ID NO: 865742 - protein, 9 aa, Homo Sapiens
GVEMLLNPE

SEQ ID NO: 865743 - protein, 9 aa, Homo Sapiens
QNTLQSRQT

SEQ ID NO: 865744 - protein, 9 aa, Homo Sapiens
ATYTLSGLQ

SEQ ID NO: 865745 - protein, 9 aa, Homo Sapiens
SLDVQSVAD

SEQ ID NO: 865746 - protein, 9 aa, Homo Sapiens
YGKQNIYFA

SEQ ID NO: 865747 - protein, 9 aa, Homo Sapiens
GNMTLLPEN

SEQ ID NO: 865748 - protein, 9 aa, Homo Sapiens
AEKQEDKQI

SEQ ID NO: 865749 - protein, 9 aa, Homo Sapiens
NEARDKFTK

SEQ ID NO: 865750 - protein, 9 aa, Homo Sapiens
TCRYFHKVC

SEQ ID NO: 865751 - protein, 9 aa, Homo Sapiens
RCRASFRGP

SEQ ID NO: 865752 - protein, 9 aa, Homo Sapiens
SCPEDKVLR

SEQ ID NO: 865753 - protein, 9 aa, Homo Sapiens
YVYKNRSIE

SEQ ID NO: 865754 - protein, 9 aa, Homo Sapiens
VSSRVKRPI

SEQ ID NO: 865755 - protein, 9 aa, Homo Sapiens
LKLGYAEKQ

SEQ ID NO: 865756 - protein, 9 aa, Homo Sapiens
GRCNGQFKT

SEQ ID NO: 865757 - protein, 9 aa, Homo Sapiens
FQNLDEDKQ

SEQ ID NO: 865758 - protein, 9 aa, Homo Sapiens
GQPGSGFSS

SEQ ID NO: 865759 - protein, 9 aa, Homo Sapiens
YTRDNLPLK

SEQ ID NO: 865760 - protein, 9 aa, Homo Sapiens
EEPECLPCL

SEQ ID NO: 865761 - protein, 9 aa, Homo Sapiens
LGCCKVICH

SEQ ID NO: 865762 - protein, 9 aa, Homo Sapiens
VYEEFWRGF

SEQ ID NO: 865763 - protein, 9 aa, Homo Sapiens
DCFEYFGPD

SEQ ID NO: 865764 - protein, 9 aa, Homo Sapiens
HSSEVRLKR

SEQ ID NO: 865765 - protein, 9 aa, Homo Sapiens
KKFIRRDFF

SEQ ID NO: 865766 - protein, 9 aa, Homo Sapiens
EKKNKVVKM

SEQ ID NO: 865767 - protein, 9 aa, Homo Sapiens
LVDLFAPWC

SEQ ID NO: 865768 - protein, 9 aa, Homo Sapiens
ELWCMERKR

SEQ ID NO: 865769 - protein, 9 aa, Homo Sapiens
CIKDLFMKR

SEQ ID NO: 865770 - protein, 9 aa, Homo Sapiens
NRELQERNQ

SEQ ID NO: 865771 - protein, 9 aa, Homo Sapiens
QGFNISYDP

SEQ ID NO: 865772 - protein, 9 aa, Homo Sapiens
FCFLTDTSH

SEQ ID NO: 865773 - protein, 9 aa, Homo Sapiens
RTGKPDEEE

SEQ ID NO: 865774 - protein, 9 aa, Homo Sapiens
QTLMDNGNN

SEQ ID NO: 865775 - protein, 9 aa, Homo Sapiens
HKQAQDNLH

SEQ ID NO: 865776 - protein, 9 aa, Homo Sapiens
WTVQNRESM

SEQ ID NO: 865777 - protein, 9 aa, Homo Sapiens
LLETSDKIT

SEQ ID NO: 865778 - protein, 9 aa, Homo Sapiens
CSYEGHGSH

SEQ ID NO: 865779 - protein, 9 aa, Homo Sapiens
EATFEEIEK

SEQ ID NO: 865780 - protein, 9 aa, Homo Sapiens
PQTGWVYRN

SEQ ID NO: 865781 - protein, 9 aa, Homo Sapiens
LDGGNPPRL

SEQ ID NO: 865782 - protein, 9 aa, Homo Sapiens
GHEKDTMKF

SEQ ID NO: 865783 - protein, 9 aa, Homo Sapiens
GDCLRTCGG

SEQ ID NO: 865784 - protein, 9 aa, Homo Sapiens
VNLPKYSHN

SEQ ID NO: 865785 - protein, 9 aa, Homo Sapiens
VHGYGGLVC

SEQ ID NO: 865786 - protein, 9 aa, Homo Sapiens
IQGEVRLGD

SEQ ID NO: 865787 - protein, 9 aa, Homo Sapiens
ARVEEEEEH

SEQ ID NO: 865788 - protein, 9 aa, Homo Sapiens
SSQISWPLW

SEQ ID NO: 865789 - protein, 9 aa, Homo Sapiens
SSSQSSAFK

SEQ ID NO: 865790 - protein, 9 aa, Homo Sapiens
GDKPYECSD

SEQ ID NO: 865791 - protein, 9 aa, Homo Sapiens
PGASTSPPC

SEQ ID NO: 865792 - protein, 9 aa, Homo Sapiens
SNDREIIQE

SEQ ID NO: 865793 - protein, 9 aa, Homo Sapiens
VTLRCHYCR

SEQ ID NO: 865794 - protein, 9 aa, Homo Sapiens
IDKMNIKLT

SEQ ID NO: 865795 - protein, 9 aa, Homo Sapiens
PCFLGMKSC

SEQ ID NO: 865796 - protein, 9 aa, Homo Sapiens
SSLSFVNFC

SEQ ID NO: 865797 - protein, 9 aa, Homo Sapiens
PDIYPNLLG

SEQ ID NO: 865798 - protein, 9 aa, Homo Sapiens
ETFNAMDPD

SEQ ID NO: 865799 - protein, 9 aa, Homo Sapiens
ANNKGLFSL

SEQ ID NO: 865800 - protein, 9 aa, Homo Sapiens
NSDQILLHN

SEQ ID NO: 865801 - protein, 9 aa, Homo Sapiens
DRTNLKRKN

SEQ ID NO: 865802 - protein, 9 aa, Homo Sapiens
CFTQLINLS

SEQ ID NO: 865803 - protein, 9 aa, Homo Sapiens
KEAKQQERL

SEQ ID NO: 865804 - protein, 9 aa, Homo Sapiens
LIVGKYSID

SEQ ID NO: 865805 - protein, 9 aa, Homo Sapiens
LYKTVGGLI

SEQ ID NO: 865806 - protein, 9 aa, Homo Sapiens
ERNPINVIY

SEQ ID NO: 865807 - protein, 9 aa, Homo Sapiens
ILSDNSGRD

SEQ ID NO: 865808 - protein, 9 aa, Homo Sapiens
AMTNEDNPE

SEQ ID NO: 865809 - protein, 9 aa, Homo Sapiens
VAMCRTALE

SEQ ID NO: 865810 - protein, 9 aa, Homo Sapiens
ECKAHELIT

SEQ ID NO: 865811 - protein, 9 aa, Homo Sapiens
VFYFTIPLG

SEQ ID NO: 865812 - protein, 9 aa, Homo Sapiens
LLQDNGEVP

SEQ ID NO: 865813 - protein, 9 aa, Homo Sapiens
YRQCALLQS

SEQ ID NO: 865814 - protein, 9 aa, Homo Sapiens
DQLSEVKYQ

SEQ ID NO: 865815 - protein, 9 aa, Homo Sapiens
IHFKKELQE

SEQ ID NO: 865816 - protein, 9 aa, Homo Sapiens
SIRHNLSFN

SEQ ID NO: 865817 - protein, 9 aa, Homo Sapiens
SNPVVSKLL

SEQ ID NO: 865818 - protein, 9 aa, Homo Sapiens
NQATKLSGG

SEQ ID NO: 865819 - protein, 9 aa, Homo Sapiens
QKEISNTIE

SEQ ID NO: 865820 - protein, 9 aa, Homo Sapiens
MPIKKTKLQ

SEQ ID NO: 865821 - protein, 9 aa, Homo Sapiens
YVQKESEEV

SEQ ID NO: 865822 - protein, 9 aa, Homo Sapiens
YFIPGVAIA

SEQ ID NO: 865823 - protein, 9 aa, Homo Sapiens
MDLLYSKTA

SEQ ID NO: 865824 - protein, 9 aa, Homo Sapiens
HWSSKINLE

SEQ ID NO: 865825 - protein, 9 aa, Homo Sapiens
KYVYKNRSI

SEQ ID NO: 865826 - protein, 9 aa, Homo Sapiens
VIFRGPVTT

SEQ ID NO: 865827 - protein, 9 aa, Homo Sapiens
GIFSVREKR

SEQ ID NO: 865828 - protein, 9 aa, Homo Sapiens
NQFYIKTST

SEQ ID NO: 865829 - protein, 9 aa, Homo Sapiens
KLNKFMIRI

SEQ ID NO: 865830 - protein, 9 aa, Homo Sapiens
YFHSGINIK

SEQ ID NO: 865831 - protein, 9 aa, Homo Sapiens
WHNKGKNAQ

SEQ ID NO: 865832 - protein, 9 aa, Homo Sapiens
KFKAESNLF

SEQ ID NO: 865833 - protein, 9 aa, Homo Sapiens
TWNHNNMVW

SEQ ID NO: 865834 - protein, 9 aa, Homo Sapiens
PGLASFLMP

SEQ ID NO: 865835 - protein, 9 aa, Homo Sapiens
TQCSKEDQC

SEQ ID NO: 865836 - protein, 9 aa, Homo Sapiens
WGQGAPFIP

SEQ ID NO: 865837 - protein, 9 aa, Homo Sapiens
AFGSKFIID

SEQ ID NO: 865838 - protein, 9 aa, Homo Sapiens
KKYPQPLNI

SEQ ID NO: 865839 - protein, 9 aa, Homo Sapiens
INSPSQGAV

SEQ ID NO: 865840 - protein, 9 aa, Homo Sapiens
VLYQKVYVI

SEQ ID NO: 865841 - protein, 9 aa, Homo Sapiens
DGLDNKVKD

SEQ ID NO: 865842 - protein, 9 aa, Homo Sapiens
NISYEDFLS

SEQ ID NO: 865843 - protein, 9 aa, Homo Sapiens
NKLGTKIVF

SEQ ID NO: 865844 - protein, 9 aa, Homo Sapiens
VCFAFVFSV

SEQ ID NO: 865845 - protein, 9 aa, Homo Sapiens
DPIISLDTT

SEQ ID NO: 865846 - protein, 9 aa, Homo Sapiens
ESTANENTT

SEQ ID NO: 865847 - protein, 9 aa, Homo Sapiens
GTANYSKTF

SEQ ID NO: 865848 - protein, 9 aa, Homo Sapiens
QLHIIETKF

SEQ ID NO: 865849 - protein, 9 aa, Homo Sapiens
CWHGMEDED

SEQ ID NO: 865850 - protein, 9 aa, Homo Sapiens
QNIQNVLVD

SEQ ID NO: 865851 - protein, 9 aa, Homo Sapiens
NMIILLNNT

SEQ ID NO: 865852 - protein, 9 aa, Homo Sapiens
QHPLFWEIN

SEQ ID NO: 865853 - protein, 9 aa, Homo Sapiens
SKFIWQLWD

SEQ ID NO: 865854 - protein, 9 aa, Homo Sapiens
ASDKLSKSL

SEQ ID NO: 865855 - protein, 9 aa, Homo Sapiens
GIGQRTPFQ

SEQ ID NO: 865856 - protein, 9 aa, Homo Sapiens
MACGLTTVS

SEQ ID NO: 865857 - protein, 9 aa, Homo Sapiens
FWGLLRPED

SEQ ID NO: 865858 - protein, 9 aa, Homo Sapiens
QLSGINVIN

SEQ ID NO: 865859 - protein, 9 aa, Homo Sapiens
KVGDTEGKY

SEQ ID NO: 865860 - protein, 9 aa, Homo Sapiens
DTLGLLWQE

SEQ ID NO: 865861 - protein, 9 aa, Homo Sapiens
DERDQYDEE

SEQ ID NO: 865862 - protein, 9 aa, Homo Sapiens
LIKQSREFK

SEQ ID NO: 865863 - protein, 9 aa, Homo Sapiens
NGVQNYKLI

SEQ ID NO: 865864 - protein, 9 aa, Homo Sapiens
LNAREESSI

SEQ ID NO: 865865 - protein, 9 aa, Homo Sapiens
ATHIVHPLL

SEQ ID NO: 865866 - protein, 9 aa, Homo Sapiens
LGANGFGNG

SEQ ID NO: 865867 - protein, 9 aa, Homo Sapiens
GRRVRVWRR

SEQ ID NO: 865868 - protein, 9 aa, Homo Sapiens
AQERGLVQF

SEQ ID NO: 865869 - protein, 9 aa, Homo Sapiens
LQKYDIDDK

SEQ ID NO: 865870 - protein, 9 aa, Homo Sapiens
YPIKEAPGT

SEQ ID NO: 865871 - protein, 9 aa, Homo Sapiens
EPNDPSLGD

SEQ ID NO: 865872 - protein, 9 aa, Homo Sapiens
IIDRLFLKF

SEQ ID NO: 865873 - protein, 9 aa, Homo Sapiens
REEAVCLLT

SEQ ID NO: 865874 - protein, 9 aa, Homo Sapiens
PLVGSYSPT

SEQ ID NO: 865875 - protein, 9 aa, Homo Sapiens
GQKNINRTS

SEQ ID NO: 865876 - protein, 9 aa, Homo Sapiens
NLNHNFADL

SEQ ID NO: 865877 - protein, 9 aa, Homo Sapiens
TDTFGSRVC

SEQ ID NO: 865878 - protein, 9 aa, Homo Sapiens
KNSLFKFKS

SEQ ID NO: 865879 - protein, 9 aa, Homo Sapiens
VLAKDSSTP

SEQ ID NO: 865880 - protein, 9 aa, Homo Sapiens
PASPTWQNP

SEQ ID NO: 865881 - protein, 9 aa, Homo Sapiens
AIQELFKHI

SEQ ID NO: 865882 - protein, 9 aa, Homo Sapiens
YYILTDSQL

SEQ ID NO: 865883 - protein, 9 aa, Homo Sapiens
VAAHAPLNP

SEQ ID NO: 865884 - protein, 9 aa, Homo Sapiens
RKKIQLSVP

SEQ ID NO: 865885 - protein, 9 aa, Homo Sapiens
VKFLEINEN

SEQ ID NO: 865886 - protein, 9 aa, Homo Sapiens
KAVLAGYLI

SEQ ID NO: 865887 - protein, 9 aa, Homo Sapiens
RPTKQEVKK

SEQ ID NO: 865888 - protein, 9 aa, Homo Sapiens
LQQPVSEPA

SEQ ID NO: 865889 - protein, 9 aa, Homo Sapiens
YNNWHGGQA

SEQ ID NO: 865890 - protein, 9 aa, Homo Sapiens
EDQLSWFTA

SEQ ID NO: 865891 - protein, 9 aa, Homo Sapiens
APRPTRFLC

SEQ ID NO: 865892 - protein, 9 aa, Homo Sapiens
LRELDTDIS

SEQ ID NO: 865893 - protein, 9 aa, Homo Sapiens
CNPEFESSS

SEQ ID NO: 865894 - protein, 9 aa, Homo Sapiens
TKLQQPVSE

SEQ ID NO: 865895 - protein, 9 aa, Homo Sapiens
KTSEIEPNN

SEQ ID NO: 865896 - protein, 9 aa, Homo Sapiens
SPEPLQRPK

SEQ ID NO: 865897 - protein, 9 aa, Homo Sapiens
PTLWIEKND

SEQ ID NO: 865898 - protein, 9 aa, Homo Sapiens
HTTPPVLTW

SEQ ID NO: 865899 - protein, 9 aa, Homo Sapiens
DDSNDHVIS

SEQ ID NO: 865900 - protein, 9 aa, Homo Sapiens
KPRVNKSWR

SEQ ID NO: 865901 - protein, 9 aa, Homo Sapiens
TWQNPMSTK

SEQ ID NO: 865902 - protein, 9 aa, Homo Sapiens
ISCFQVGGK

SEQ ID NO: 865903 - protein, 9 aa, Homo Sapiens
GQMTNLYHY

SEQ ID NO: 865904 - protein, 9 aa, Homo Sapiens
VGNRHGEIT

SEQ ID NO: 865905 - protein, 9 aa, Homo Sapiens
DEVMVLLGF

SEQ ID NO: 865906 - protein, 9 aa, Homo Sapiens
YSRLMGTNV

SEQ ID NO: 865907 - protein, 9 aa, Homo Sapiens
LLQCELESL

SEQ ID NO: 865908 - protein, 9 aa, Homo Sapiens
TQEILPLHV

SEQ ID NO: 865909 - protein, 9 aa, Homo Sapiens
TYRKLAKDI

SEQ ID NO: 865910 - protein, 9 aa, Homo Sapiens
QLMKEKKRK

SEQ ID NO: 865911 - protein, 9 aa, Homo Sapiens
EVYHFGAIF

SEQ ID NO: 865912 - protein, 9 aa, Homo Sapiens
AAASLLQVT

SEQ ID NO: 865913 - protein, 9 aa, Homo Sapiens
NSPSVLPSG

SEQ ID NO: 865914 - protein, 9 aa, Homo Sapiens
DKRIPQIRI

SEQ ID NO: 865915 - protein, 9 aa, Homo Sapiens
NINRTSFTQ

SEQ ID NO: 865916 - protein, 9 aa, Homo Sapiens
FTQEILPLH

SEQ ID NO: 865917 - protein, 9 aa, Homo Sapiens
SNPVPASPM

SEQ ID NO: 865918 - protein, 9 aa, Homo Sapiens
KIKNILEWA

SEQ ID NO: 865919 - protein, 9 aa, Homo Sapiens
QHLIYQQQV

SEQ ID NO: 865920 - protein, 9 aa, Homo Sapiens
PETKLIIVD

SEQ ID NO: 865921 - protein, 9 aa, Homo Sapiens
RIWFMLETM

SEQ ID NO: 865922 - protein, 9 aa, Homo Sapiens
QMSYQYIRS

SEQ ID NO: 865923 - protein, 9 aa, Homo Sapiens
INVIYVGGP

SEQ ID NO: 865924 - protein, 9 aa, Homo Sapiens
NNMPVCLCG

SEQ ID NO: 865925 - protein, 9 aa, Homo Sapiens
RILQRMMSS

SEQ ID NO: 865926 - protein, 9 aa, Homo Sapiens
YDNFSCTWS

SEQ ID NO: 865927 - protein, 9 aa, Homo Sapiens
RTQFRTQND

SEQ ID NO: 865928 - protein, 9 aa, Homo Sapiens
VNGKDVSQS

SEQ ID NO: 865929 - protein, 9 aa, Homo Sapiens
LCLSPYKSK

SEQ ID NO: 865930 - protein, 9 aa, Homo Sapiens
VVDCIIFGT

SEQ ID NO: 865931 - protein, 9 aa, Homo Sapiens
GLDIVLWNF

SEQ ID NO: 865932 - protein, 9 aa, Homo Sapiens
DYIPVSNPS

SEQ ID NO: 865933 - protein, 9 aa, Homo Sapiens
SERITVNKE

SEQ ID NO: 865934 - protein, 9 aa, Homo Sapiens
LPGRPTQGA

SEQ ID NO: 865935 - protein, 9 aa, Homo Sapiens
SICLSNFLK

SEQ ID NO: 865936 - protein, 9 aa, Homo Sapiens
KIRSMYDLA

SEQ ID NO: 865937 - protein, 9 aa, Homo Sapiens
HQLSQYFLK

SEQ ID NO: 865938 - protein, 9 aa, Homo Sapiens
AAAALALTF

SEQ ID NO: 865939 - protein, 9 aa, Homo Sapiens
RKSPLLGRL

SEQ ID NO: 865940 - protein, 9 aa, Homo Sapiens
CVQKFIKID

SEQ ID NO: 865941 - protein, 9 aa, Homo Sapiens
LPYFKVISP

SEQ ID NO: 865942 - protein, 9 aa, Homo Sapiens
LFTTTMRLP

SEQ ID NO: 865943 - protein, 9 aa, Homo Sapiens
QRFKVNKIW

SEQ ID NO: 865944 - protein, 9 aa, Homo Sapiens
LASGSLLGS

SEQ ID NO: 865945 - protein, 9 aa, Homo Sapiens
SRSRSYSQD

SEQ ID NO: 865946 - protein, 9 aa, Homo Sapiens
ELDMGQSGS

SEQ ID NO: 865947 - protein, 9 aa, Homo Sapiens
DIQAILDDQ

SEQ ID NO: 865948 - protein, 9 aa, Homo Sapiens
IAQILNFIS

SEQ ID NO: 865949 - protein, 9 aa, Homo Sapiens
ISKPGKFEE

SEQ ID NO: 865950 - protein, 9 aa, Homo Sapiens
SLQYVQCVA

SEQ ID NO: 865951 - protein, 9 aa, Homo Sapiens
APQSQSLAP

SEQ ID NO: 865952 - protein, 9 aa, Homo Sapiens
HYRNELVAG

SEQ ID NO: 865953 - protein, 9 aa, Homo Sapiens
RPEDQLSKD

SEQ ID NO: 865954 - protein, 9 aa, Homo Sapiens
KFFCDVSSD

SEQ ID NO: 865955 - protein, 9 aa, Homo Sapiens
TGLVGVACA

SEQ ID NO: 865956 - protein, 9 aa, Homo Sapiens
RRHHCHKCG

SEQ ID NO: 865957 - protein, 9 aa, Homo Sapiens
KPAIIASCL

SEQ ID NO: 865958 - protein, 9 aa, Homo Sapiens
KDPSEVVIP

SEQ ID NO: 865959 - protein, 9 aa, Homo Sapiens
RVEVTECSN

SEQ ID NO: 865960 - protein, 9 aa, Homo Sapiens
PDRKTASFL

SEQ ID NO: 865961 - protein, 9 aa, Homo Sapiens
QIYPPEDKA

SEQ ID NO: 865962 - protein, 9 aa, Homo Sapiens
KYPVPKSPV

SEQ ID NO: 865963 - protein, 9 aa, Homo Sapiens
AQTRELRLT

SEQ ID NO: 865964 - protein, 9 aa, Homo Sapiens
LIVDPYYSY

SEQ ID NO: 865965 - protein, 9 aa, Homo Sapiens
GGTEPPGSS

SEQ ID NO: 865966 - protein, 9 aa, Homo Sapiens
HRHAMTRKR

SEQ ID NO: 865967 - protein, 9 aa, Homo Sapiens
EAEKQEDKQ

SEQ ID NO: 865968 - protein, 9 aa, Homo Sapiens
SMARKKPQN

SEQ ID NO: 865969 - protein, 9 aa, Homo Sapiens
AQDSGLWSQ

SEQ ID NO: 865970 - protein, 9 aa, Homo Sapiens
SIPDIQVHE

SEQ ID NO: 865971 - protein, 9 aa, Homo Sapiens
NLYLPSCAY

SEQ ID NO: 865972 - protein, 9 aa, Homo Sapiens
AENVWWITG

SEQ ID NO: 865973 - protein, 9 aa, Homo Sapiens
MIQLPSEKA

SEQ ID NO: 865974 - protein, 9 aa, Homo Sapiens
MEEVCKVNE

SEQ ID NO: 865975 - protein, 9 aa, Homo Sapiens
SPTNDRGLQ

SEQ ID NO: 865976 - protein, 9 aa, Homo Sapiens
KELFSLMVV

SEQ ID NO: 865977 - protein, 9 aa, Homo Sapiens
EDWRNKWAQ

SEQ ID NO: 865978 - protein, 9 aa, Homo Sapiens
FAVHHSSLE

SEQ ID NO: 865979 - protein, 9 aa, Homo Sapiens
LKPDNLLYY

SEQ ID NO: 865980 - protein, 9 aa, Homo Sapiens
ANDVDNKHC

SEQ ID NO: 865981 - protein, 9 aa, Homo Sapiens
DEKICQAFY

SEQ ID NO: 865982 - protein, 9 aa, Homo Sapiens
HADACNAKD

SEQ ID NO: 865983 - protein, 9 aa, Homo Sapiens
YICRLNWSD

SEQ ID NO: 865984 - protein, 9 aa, Homo Sapiens
KKDTSLYRP

SEQ ID NO: 865985 - protein, 9 aa, Homo Sapiens
AADKQGGPG

SEQ ID NO: 865986 - protein, 9 aa, Homo Sapiens
ATASEKMST

SEQ ID NO: 865987 - protein, 9 aa, Homo Sapiens
EACIISPHP

SEQ ID NO: 865988 - protein, 9 aa, Homo Sapiens
KTPNLSKPK

SEQ ID NO: 865989 - protein, 9 aa, Homo Sapiens
ETMQTTTPG

SEQ ID NO: 865990 - protein, 9 aa, Homo Sapiens
HCYLLVHQA

SEQ ID NO: 865991 - protein, 9 aa, Homo Sapiens
ENVTSKEIC

SEQ ID NO: 865992 - protein, 9 aa, Homo Sapiens
GRPRVNKLH

SEQ ID NO: 865993 - protein, 9 aa, Homo Sapiens
IIDQLFAVG

SEQ ID NO: 865994 - protein, 9 aa, Homo Sapiens
SFLKGTTTW

SEQ ID NO: 865995 - protein, 9 aa, Homo Sapiens
HTDTNMHSH

SEQ ID NO: 865996 - protein, 9 aa, Homo Sapiens
LHNLEWLKN

SEQ ID NO: 865997 - protein, 9 aa, Homo Sapiens
CRLGEQLQM

SEQ ID NO: 865998 - protein, 9 aa, Homo Sapiens
VGAWGDYND

SEQ ID NO: 865999 - protein, 9 aa, Homo Sapiens
EEAEEEDGE

SEQ ID NO: 866000 - protein, 9 aa, Homo Sapiens
SKLEYQNKV

SEQ ID NO: 866001 - protein, 9 aa, Homo Sapiens
QNKSVVRSM

SEQ ID NO: 866002 - protein, 9 aa, Homo Sapiens
TTIPIVLLL

SEQ ID NO: 866003 - protein, 9 aa, Homo Sapiens
DYVPPTAPT

SEQ ID NO: 866004 - protein, 9 aa, Homo Sapiens
PPYKENYGH

SEQ ID NO: 866005 - protein, 9 aa, Homo Sapiens
GSTLCFLCK

SEQ ID NO: 866006 - protein, 9 aa, Homo Sapiens
SSAANTLTS

SEQ ID NO: 866007 - protein, 9 aa, Homo Sapiens
EITSPPDSS

SEQ ID NO: 866008 - protein, 9 aa, Homo Sapiens
RASNNPKRN

SEQ ID NO: 866009 - protein, 9 aa, Homo Sapiens
VNIQFIGGL

SEQ ID NO: 866010 - protein, 9 aa, Homo Sapiens
LDHQIFFNP

SEQ ID NO: 866011 - protein, 9 aa, Homo Sapiens
LDKSNPRGP

SEQ ID NO: 866012 - protein, 9 aa, Homo Sapiens
KVCKLDENN

SEQ ID NO: 866013 - protein, 9 aa, Homo Sapiens
INPDDFPLL

SEQ ID NO: 866014 - protein, 9 aa, Homo Sapiens
VFLICLSLV

SEQ ID NO: 866015 - protein, 9 aa, Homo Sapiens
CITNTFFGD

SEQ ID NO: 866016 - protein, 9 aa, Homo Sapiens
AFICAACGE

SEQ ID NO: 866017 - protein, 9 aa, Homo Sapiens
QVRTSKPDV

SEQ ID NO: 866018 - protein, 9 aa, Homo Sapiens
GGNPPRLGT

SEQ ID NO: 866019 - protein, 9 aa, Homo Sapiens
LKARTSKEQ

SEQ ID NO: 866020 - protein, 9 aa, Homo Sapiens
NNNSNKFKH

SEQ ID NO: 866021 - protein, 9 aa, Homo Sapiens
GNMNLSIIM

SEQ ID NO: 866022 - protein, 9 aa, Homo Sapiens
DSVRQFSGL

SEQ ID NO: 866023 - protein, 9 aa, Homo Sapiens
AKISVAIQN

SEQ ID NO: 866024 - protein, 9 aa, Homo Sapiens
ENVYSDDLM

SEQ ID NO: 866025 - protein, 9 aa, Homo Sapiens
STPPKAWHK

SEQ ID NO: 866026 - protein, 9 aa, Homo Sapiens
LEGWNMPFG

SEQ ID NO: 866027 - protein, 9 aa, Homo Sapiens
LRNVMQISP

SEQ ID NO: 866028 - protein, 9 aa, Homo Sapiens
AAQNTICQQ

SEQ ID NO: 866029 - protein, 9 aa, Homo Sapiens
VNIHTGLSG

SEQ ID NO: 866030 - protein, 9 aa, Homo Sapiens
TEIKDGQTS

SEQ ID NO: 866031 - protein, 9 aa, Homo Sapiens
LAASLYCPQ

SEQ ID NO: 866032 - protein, 9 aa, Homo Sapiens
MGNKMSAHQ

SEQ ID NO: 866033 - protein, 9 aa, Homo Sapiens
NRLRDEAKH

SEQ ID NO: 866034 - protein, 9 aa, Homo Sapiens
TPLNDAISK

SEQ ID NO: 866035 - protein, 9 aa, Homo Sapiens
SPIVKKIIG

SEQ ID NO: 866036 - protein, 9 aa, Homo Sapiens
KSCEMSSFV

SEQ ID NO: 866037 - protein, 9 aa, Homo Sapiens
LTPILRLLC

SEQ ID NO: 866038 - protein, 9 aa, Homo Sapiens
QEAQQWLHQ

SEQ ID NO: 866039 - protein, 9 aa, Homo Sapiens
HDGTNSPPD

SEQ ID NO: 866040 - protein, 9 aa, Homo Sapiens
SLICAKKRS

SEQ ID NO: 866041 - protein, 9 aa, Homo Sapiens
VTGKNSNEV

SEQ ID NO: 866042 - protein, 9 aa, Homo Sapiens
ACSYEGHGS

SEQ ID NO: 866043 - protein, 9 aa, Homo Sapiens
CRCKGIVTP

SEQ ID NO: 866044 - protein, 9 aa, Homo Sapiens
QIVSTTRKL

SEQ ID NO: 866045 - protein, 9 aa, Homo Sapiens
QLEQDNASL

SEQ ID NO: 866046 - protein, 9 aa, Homo Sapiens
LVLLLVTLV

SEQ ID NO: 866047 - protein, 9 aa, Homo Sapiens
LSNAETSVE

SEQ ID NO: 866048 - protein, 9 aa, Homo Sapiens
PEDQLSWFT

SEQ ID NO: 866049 - protein, 9 aa, Homo Sapiens
MNSLSFCTN

SEQ ID NO: 866050 - protein, 9 aa, Homo Sapiens
TVLYWIFTV

SEQ ID NO: 866051 - protein, 9 aa, Homo Sapiens
AEHFRALST

SEQ ID NO: 866052 - protein, 9 aa, Homo Sapiens
TRTRNIFYL

SEQ ID NO: 866053 - protein, 9 aa, Homo Sapiens
YQELAQLKA

SEQ ID NO: 866054 - protein, 9 aa, Homo Sapiens
YQSGGKIWR

SEQ ID NO: 866055 - protein, 9 aa, Homo Sapiens
PNDLALFVD

SEQ ID NO: 866056 - protein, 9 aa, Homo Sapiens
GSLSMINDA

SEQ ID NO: 866057 - protein, 9 aa, Homo Sapiens
LAWHSQYKF

SEQ ID NO: 866058 - protein, 9 aa, Homo Sapiens
LRQHKHRPA

SEQ ID NO: 866059 - protein, 9 aa, Homo Sapiens
ALDELMDGG

SEQ ID NO: 866060 - protein, 9 aa, Homo Sapiens
HRRGVLELA

SEQ ID NO: 866061 - protein, 9 aa, Homo Sapiens
QISLPEDHR

SEQ ID NO: 866062 - protein, 9 aa, Homo Sapiens
KKKVVEYEY

SEQ ID NO: 866063 - protein, 9 aa, Homo Sapiens
KLSKSLWLE

SEQ ID NO: 866064 - protein, 9 aa, Homo Sapiens
VCWHFGDHF

SEQ ID NO: 866065 - protein, 9 aa, Homo Sapiens
DNVRIPGML

SEQ ID NO: 866066 - protein, 9 aa, Homo Sapiens
YLYRRLGEE

SEQ ID NO: 866067 - protein, 9 aa, Homo Sapiens
VVYAQGLQA

SEQ ID NO: 866068 - protein, 9 aa, Homo Sapiens
LFSFCDGDC

SEQ ID NO: 866069 - protein, 9 aa, Homo Sapiens
NKLFFKKGK

SEQ ID NO: 866070 - protein, 9 aa, Homo Sapiens
LAAIWFQTY

SEQ ID NO: 866071 - protein, 9 aa, Homo Sapiens
YLTDSEYTD

SEQ ID NO: 866072 - protein, 9 aa, Homo Sapiens
QNHYRVYNL

SEQ ID NO: 866073 - protein, 9 aa, Homo Sapiens
RKLLNYQVV

SEQ ID NO: 866074 - protein, 9 aa, Homo Sapiens
IGILYIRLS

SEQ ID NO: 866075 - protein, 9 aa, Homo Sapiens
AWGDYNDSA

SEQ ID NO: 866076 - protein, 9 aa, Homo Sapiens
KLVRLMQDK

SEQ ID NO: 866077 - protein, 9 aa, Homo Sapiens
SKHSAWPAP

SEQ ID NO: 866078 - protein, 9 aa, Homo Sapiens
MFQTLPPSS

SEQ ID NO: 866079 - protein, 9 aa, Homo Sapiens
DSLPPGKVV

SEQ ID NO: 866080 - protein, 9 aa, Homo Sapiens
LHSSLPIHK

SEQ ID NO: 866081 - protein, 9 aa, Homo Sapiens
ELSTLAAKT

SEQ ID NO: 866082 - protein, 9 aa, Homo Sapiens
PEEEENTCK

SEQ ID NO: 866083 - protein, 9 aa, Homo Sapiens
SNIFPVRGQ

SEQ ID NO: 866084 - protein, 9 aa, Homo Sapiens
TIITPFTDS

SEQ ID NO: 866085 - protein, 9 aa, Homo Sapiens
PKGGYIHLI

SEQ ID NO: 866086 - protein, 9 aa, Homo Sapiens
TSNLNIKQN

SEQ ID NO: 866087 - protein, 9 aa, Homo Sapiens
LLQWKSVCL

SEQ ID NO: 866088 - protein, 9 aa, Homo Sapiens
MPLCGWMKW

SEQ ID NO: 866089 - protein, 9 aa, Homo Sapiens
MWSKCSQKY

SEQ ID NO: 866090 - protein, 9 aa, Homo Sapiens
RRSRSPRIS

SEQ ID NO: 866091 - protein, 9 aa, Homo Sapiens
SGSEASNSV

SEQ ID NO: 866092 - protein, 9 aa, Homo Sapiens
TVPSPEVVQ

SEQ ID NO: 866093 - protein, 9 aa, Homo Sapiens
LVIELDKYL

SEQ ID NO: 866094 - protein, 9 aa, Homo Sapiens
TTVCLKVKE

SEQ ID NO: 866095 - protein, 9 aa, Homo Sapiens
PAFRDKHLQ

SEQ ID NO: 866096 - protein, 9 aa, Homo Sapiens
DKSFAVGTL

SEQ ID NO: 866097 - protein, 9 aa, Homo Sapiens
ALDSIHYIT

SEQ ID NO: 866098 - protein, 9 aa, Homo Sapiens
TTLIGAGIQ

SEQ ID NO: 866099 - protein, 9 aa, Homo Sapiens
LFDPTSQHR

SEQ ID NO: 866100 - protein, 9 aa, Homo Sapiens
YIRERFNNE

SEQ ID NO: 866101 - protein, 9 aa, Homo Sapiens
NNLTLSKEV

SEQ ID NO: 866102 - protein, 9 aa, Homo Sapiens
TTAGCNYLL

SEQ ID NO: 866103 - protein, 9 aa, Homo Sapiens
ASFIRLAIP

SEQ ID NO: 866104 - protein, 9 aa, Homo Sapiens
QVDTQLQVV

SEQ ID NO: 866105 - protein, 9 aa, Homo Sapiens
LAAPSGQRR

SEQ ID NO: 866106 - protein, 9 aa, Homo Sapiens
CLVESTSLR

SEQ ID NO: 866107 - protein, 9 aa, Homo Sapiens
QLASTRSAA

SEQ ID NO: 866108 - protein, 9 aa, Homo Sapiens
VWKQPRLTH

SEQ ID NO: 866109 - protein, 9 aa, Homo Sapiens
VLNQHNSHD

SEQ ID NO: 866110 - protein, 9 aa, Homo Sapiens
SRLIKGDGE

SEQ ID NO: 866111 - protein, 9 aa, Homo Sapiens
SVDDIQAIL

SEQ ID NO: 866112 - protein, 9 aa, Homo Sapiens
DTFCPAEFH

SEQ ID NO: 866113 - protein, 9 aa, Homo Sapiens
AALLDRIEI

SEQ ID NO: 866114 - protein, 9 aa, Homo Sapiens
MLQFESQII

SEQ ID NO: 866115 - protein, 9 aa, Homo Sapiens
VTQQIRQLF

SEQ ID NO: 866116 - protein, 9 aa, Homo Sapiens
KLLLVRLCP

SEQ ID NO: 866117 - protein, 9 aa, Homo Sapiens
TLIDEVERA

SEQ ID NO: 866118 - protein, 9 aa, Homo Sapiens
SRTTKSPPS

SEQ ID NO: 866119 - protein, 9 aa, Homo Sapiens
TTHITQGAP

SEQ ID NO: 866120 - protein, 9 aa, Homo Sapiens
ALAFTVAMQ

SEQ ID NO: 866121 - protein, 9 aa, Homo Sapiens
VHTGEKPFW

SEQ ID NO: 866122 - protein, 9 aa, Homo Sapiens
LFLKFFLKC

SEQ ID NO: 866123 - protein, 9 aa, Homo Sapiens
EKSKAQMEL

SEQ ID NO: 866124 - protein, 9 aa, Homo Sapiens
EQASTERVF

SEQ ID NO: 866125 - protein, 9 aa, Homo Sapiens
DLEQAAKPA

SEQ ID NO: 866126 - protein, 9 aa, Homo Sapiens
INPDVLFEI

SEQ ID NO: 866127 - protein, 9 aa, Homo Sapiens
EWFWGRDVL

SEQ ID NO: 866128 - protein, 9 aa, Homo Sapiens
ECTLGQIVF

SEQ ID NO: 866129 - protein, 9 aa, Homo Sapiens
IAVKLLQKA

SEQ ID NO: 866130 - protein, 9 aa, Homo Sapiens
PHKAQNYRK

SEQ ID NO: 866131 - protein, 9 aa, Homo Sapiens
SSQVQRYTN

SEQ ID NO: 866132 - protein, 9 aa, Homo Sapiens
LQSPKRPQS

SEQ ID NO: 866133 - protein, 9 aa, Homo Sapiens
AVTKTLSDY

SEQ ID NO: 866134 - protein, 9 aa, Homo Sapiens
FWRGFYKMC

SEQ ID NO: 866135 - protein, 9 aa, Homo Sapiens
VADKSFAVG

SEQ ID NO: 866136 - protein, 9 aa, Homo Sapiens
TSVSIEVAN

SEQ ID NO: 866137 - protein, 9 aa, Homo Sapiens
AKDSPGVAP

SEQ ID NO: 866138 - protein, 9 aa, Homo Sapiens
DNRLLDMRN

SEQ ID NO: 866139 - protein, 9 aa, Homo Sapiens
TETNNSPLM

SEQ ID NO: 866140 - protein, 9 aa, Homo Sapiens
VSGRKENRV

SEQ ID NO: 866141 - protein, 9 aa, Homo Sapiens
LVKHHSSTT

SEQ ID NO: 866142 - protein, 9 aa, Homo Sapiens
ELSQEEWEC

SEQ ID NO: 866143 - protein, 9 aa, Homo Sapiens
FHKVCDGEG

SEQ ID NO: 866144 - protein, 9 aa, Homo Sapiens
ELTLELKEN

SEQ ID NO: 866145 - protein, 9 aa, Homo Sapiens
NFSSGFIKA

SEQ ID NO: 866146 - protein, 9 aa, Homo Sapiens
KNIPLIPVF

SEQ ID NO: 866147 - protein, 9 aa, Homo Sapiens
YEIQFGSEA

SEQ ID NO: 866148 - protein, 9 aa, Homo Sapiens
GAEKEWGNG

SEQ ID NO: 866149 - protein, 9 aa, Homo Sapiens
VKSFYQTLI

SEQ ID NO: 866150 - protein, 9 aa, Homo Sapiens
NTKNHPVQF

SEQ ID NO: 866151 - protein, 9 aa, Homo Sapiens
VPKMASDCL

SEQ ID NO: 866152 - protein, 9 aa, Homo Sapiens
KIAGGNTDM

SEQ ID NO: 866153 - protein, 9 aa, Homo Sapiens
KDAGVICSA

SEQ ID NO: 866154 - protein, 9 aa, Homo Sapiens
IRNTKAAKL

SEQ ID NO: 866155 - protein, 9 aa, Homo Sapiens
RRYSCSLHA

SEQ ID NO: 866156 - protein, 9 aa, Homo Sapiens
EHCQHLQAE

SEQ ID NO: 866157 - protein, 9 aa, Homo Sapiens
DLNTSPYCL

SEQ ID NO: 866158 - protein, 9 aa, Homo Sapiens
KQVITFLKK

SEQ ID NO: 866159 - protein, 9 aa, Homo Sapiens
HNVFKLQTT

SEQ ID NO: 866160 - protein, 9 aa, Homo Sapiens
IDAKEQGAV

SEQ ID NO: 866161 - protein, 9 aa, Homo Sapiens
DDLEEAQEG

SEQ ID NO: 866162 - protein, 9 aa, Homo Sapiens
TLHKAGRSA

SEQ ID NO: 866163 - protein, 9 aa, Homo Sapiens
AAVQAVDKY

SEQ ID NO: 866164 - protein, 9 aa, Homo Sapiens
EGDTPLNDA

SEQ ID NO: 866165 - protein, 9 aa, Homo Sapiens
SHIRGHYEQ

SEQ ID NO: 866166 - protein, 9 aa, Homo Sapiens
IHIYKSFTN

SEQ ID NO: 866167 - protein, 9 aa, Homo Sapiens
VGAQTTAGC

SEQ ID NO: 866168 - protein, 9 aa, Homo Sapiens
SCRNNRCNN

SEQ ID NO: 866169 - protein, 9 aa, Homo Sapiens
MAFVSVIPE

SEQ ID NO: 866170 - protein, 9 aa, Homo Sapiens
QELLEADNR

SEQ ID NO: 866171 - protein, 9 aa, Homo Sapiens
LKRSELVSW

SEQ ID NO: 866172 - protein, 9 aa, Homo Sapiens
CPGYYESGY

SEQ ID NO: 866173 - protein, 9 aa, Homo Sapiens
LRWKLVKDN

SEQ ID NO: 866174 - protein, 9 aa, Homo Sapiens
SYPSQKEVK

SEQ ID NO: 866175 - protein, 9 aa, Homo Sapiens
TYLNLSQNQ

SEQ ID NO: 866176 - protein, 9 aa, Homo Sapiens
IGEQFYRKS

SEQ ID NO: 866177 - protein, 9 aa, Homo Sapiens
PGVTGKNSN

SEQ ID NO: 866178 - protein, 9 aa, Homo Sapiens
RLYPVAVLF

SEQ ID NO: 866179 - protein, 9 aa, Homo Sapiens
ELKNMWKFP

SEQ ID NO: 866180 - protein, 9 aa, Homo Sapiens
YAWNDLDSR

SEQ ID NO: 866181 - protein, 9 aa, Homo Sapiens
WNHIVACVF

SEQ ID NO: 866182 - protein, 9 aa, Homo Sapiens
EEIVLRIIN

SEQ ID NO: 866183 - protein, 9 aa, Homo Sapiens
NITCSATAH

SEQ ID NO: 866184 - protein, 9 aa, Homo Sapiens
SMCKRNQVV

SEQ ID NO: 866185 - protein, 9 aa, Homo Sapiens
YLKKEDANR

SEQ ID NO: 866186 - protein, 9 aa, Homo Sapiens
TPRPQDHDT

SEQ ID NO: 866187 - protein, 9 aa, Homo Sapiens
SGEEECRPQ

SEQ ID NO: 866188 - protein, 9 aa, Homo Sapiens
SKDKISALE

SEQ ID NO: 866189 - protein, 9 aa, Homo Sapiens
RSRTLANNQ

SEQ ID NO: 866190 - protein, 9 aa, Homo Sapiens
RYTSAVSMA

SEQ ID NO: 866191 - protein, 9 aa, Homo Sapiens
GLQTPGPPP

SEQ ID NO: 866192 - protein, 9 aa, Homo Sapiens
MDIRNIFLK

SEQ ID NO: 866193 - protein, 9 aa, Homo Sapiens
GSVKLSVCM

SEQ ID NO: 866194 - protein, 9 aa, Homo Sapiens
YALMPSFDF

SEQ ID NO: 866195 - protein, 9 aa, Homo Sapiens
CAYYMPEFS

SEQ ID NO: 866196 - protein, 9 aa, Homo Sapiens
RLLVKYPKR

SEQ ID NO: 866197 - protein, 9 aa, Homo Sapiens
SFCLANSIS

SEQ ID NO: 866198 - protein, 9 aa, Homo Sapiens
PPHTNNWRP

SEQ ID NO: 866199 - protein, 9 aa, Homo Sapiens
KWILFGHQP

SEQ ID NO: 866200 - protein, 9 aa, Homo Sapiens
SRSLFDPTS

SEQ ID NO: 866201 - protein, 9 aa, Homo Sapiens
KSQKRYHKD

SEQ ID NO: 866202 - protein, 9 aa, Homo Sapiens
FLLEDQVAC

SEQ ID NO: 866203 - protein, 9 aa, Homo Sapiens
PEARYGNSI

SEQ ID NO: 866204 - protein, 9 aa, Homo Sapiens
FNLKYLIDP

SEQ ID NO: 866205 - protein, 9 aa, Homo Sapiens
DDFANVNAF

SEQ ID NO: 866206 - protein, 9 aa, Homo Sapiens
EADLQFRPH

SEQ ID NO: 866207 - protein, 9 aa, Homo Sapiens
FDEIHWLHP

SEQ ID NO: 866208 - protein, 9 aa, Homo Sapiens
TGVDPCSRQ

SEQ ID NO: 866209 - protein, 9 aa, Homo Sapiens
SVNPNDQKK

SEQ ID NO: 866210 - protein, 9 aa, Homo Sapiens
DVLPQAQDS

SEQ ID NO: 866211 - protein, 9 aa, Homo Sapiens
QNLMGSSIG

SEQ ID NO: 866212 - protein, 9 aa, Homo Sapiens
LEVNQKEDT

SEQ ID NO: 866213 - protein, 9 aa, Homo Sapiens
FGGRDYAFA

SEQ ID NO: 866214 - protein, 9 aa, Homo Sapiens
TIFFGSVSL

SEQ ID NO: 866215 - protein, 9 aa, Homo Sapiens
HRLGIIYRY

SEQ ID NO: 866216 - protein, 9 aa, Homo Sapiens
SDKLSQLQK

SEQ ID NO: 866217 - protein, 9 aa, Homo Sapiens
YHNQVWGKV

SEQ ID NO: 866218 - protein, 9 aa, Homo Sapiens
LLKRQSHFQ

SEQ ID NO: 866219 - protein, 9 aa, Homo Sapiens
RGRRVWGRL

SEQ ID NO: 866220 - protein, 9 aa, Homo Sapiens
CHPSTPLDP

SEQ ID NO: 866221 - protein, 9 aa, Homo Sapiens
AVSDAECKA

SEQ ID NO: 866222 - protein, 9 aa, Homo Sapiens
LDEVQDDDV

SEQ ID NO: 866223 - protein, 9 aa, Homo Sapiens
RGQPGSGFS

SEQ ID NO: 866224 - protein, 9 aa, Homo Sapiens
LNRTMATTA

SEQ ID NO: 866225 - protein, 9 aa, Homo Sapiens
FVPEKMRHE

SEQ ID NO: 866226 - protein, 9 aa, Homo Sapiens
VYQKVKTHL

SEQ ID NO: 866227 - protein, 9 aa, Homo Sapiens
NKLPDSFSL

SEQ ID NO: 866228 - protein, 9 aa, Homo Sapiens
TANKGRPMV

SEQ ID NO: 866229 - protein, 9 aa, Homo Sapiens
CEKMFGNGN

SEQ ID NO: 866230 - protein, 9 aa, Homo Sapiens
SDFLPSQPR

SEQ ID NO: 866231 - protein, 9 aa, Homo Sapiens
LQPDINKNV

SEQ ID NO: 866232 - protein, 9 aa, Homo Sapiens
PPNYNVALQ

SEQ ID NO: 866233 - protein, 9 aa, Homo Sapiens
PRWDISRTL

SEQ ID NO: 866234 - protein, 9 aa, Homo Sapiens
VPRFNTIHE

SEQ ID NO: 866235 - protein, 9 aa, Homo Sapiens
FEVGDKIQI

SEQ ID NO: 866236 - protein, 9 aa, Homo Sapiens
LSVCMTLYT

SEQ ID NO: 866237 - protein, 9 aa, Homo Sapiens
PCCAWQRCC

SEQ ID NO: 866238 - protein, 9 aa, Homo Sapiens
EFFSVLLPA

SEQ ID NO: 866239 - protein, 9 aa, Homo Sapiens
PSLLEDNDE

SEQ ID NO: 866240 - protein, 9 aa, Homo Sapiens
PQMLGFNPR

SEQ ID NO: 866241 - protein, 9 aa, Homo Sapiens
SYVKRSQGW

SEQ ID NO: 866242 - protein, 9 aa, Homo Sapiens
PVSTVWGTE

SEQ ID NO: 866243 - protein, 9 aa, Homo Sapiens
EKPYECQAC

SEQ ID NO: 866244 - protein, 9 aa, Homo Sapiens
ICHLHKQPS

SEQ ID NO: 866245 - protein, 9 aa, Homo Sapiens
FMSVWDQDR

SEQ ID NO: 866246 - protein, 9 aa, Homo Sapiens
EYVPWMATS

SEQ ID NO: 866247 - protein, 9 aa, Homo Sapiens
YLALQQEED

SEQ ID NO: 866248 - protein, 9 aa, Homo Sapiens
ARVCFFFPS

SEQ ID NO: 866249 - protein, 9 aa, Homo Sapiens
DSNTNGRRT

SEQ ID NO: 866250 - protein, 9 aa, Homo Sapiens
SVCGEWPWQ

SEQ ID NO: 866251 - protein, 9 aa, Homo Sapiens
KPIFWIQTE

SEQ ID NO: 866252 - protein, 9 aa, Homo Sapiens
LERIFELAR

SEQ ID NO: 866253 - protein, 9 aa, Homo Sapiens
PRLISIFFD

SEQ ID NO: 866254 - protein, 9 aa, Homo Sapiens
KRLKVLRKI

SEQ ID NO: 866255 - protein, 9 aa, Homo Sapiens
TINTFWIKS

SEQ ID NO: 866256 - protein, 9 aa, Homo Sapiens
DPLIPCNLM

SEQ ID NO: 866257 - protein, 9 aa, Homo Sapiens
KNTFGSTLL

SEQ ID NO: 866258 - protein, 9 aa, Homo Sapiens
LMAPPLSLG

SEQ ID NO: 866259 - protein, 9 aa, Homo Sapiens
HFASVVNYF

SEQ ID NO: 866260 - protein, 9 aa, Homo Sapiens
PPRLISIFF

SEQ ID NO: 866261 - protein, 9 aa, Homo Sapiens
ERRFITVSK

SEQ ID NO: 866262 - protein, 9 aa, Homo Sapiens
NPSGPSVPS

SEQ ID NO: 866263 - protein, 9 aa, Homo Sapiens
DLDHFDKLP

SEQ ID NO: 866264 - protein, 9 aa, Homo Sapiens
QVWKILAIL

SEQ ID NO: 866265 - protein, 9 aa, Homo Sapiens
KYVKKEFVH

SEQ ID NO: 866266 - protein, 9 aa, Homo Sapiens
MTWAIILKK

SEQ ID NO: 866267 - protein, 9 aa, Homo Sapiens
NFLHTYSLS

SEQ ID NO: 866268 - protein, 9 aa, Homo Sapiens
PGGPGRPRY

SEQ ID NO: 866269 - protein, 9 aa, Homo Sapiens
CGGATCVLG

SEQ ID NO: 866270 - protein, 9 aa, Homo Sapiens
TVQELFPAS

SEQ ID NO: 866271 - protein, 9 aa, Homo Sapiens
ANKTNPFPL

SEQ ID NO: 866272 - protein, 9 aa, Homo Sapiens
QPSEDPNNC

SEQ ID NO: 866273 - protein, 9 aa, Homo Sapiens
NRINHAPER

SEQ ID NO: 866274 - protein, 9 aa, Homo Sapiens
AGEKGKRGP

SEQ ID NO: 866275 - protein, 9 aa, Homo Sapiens
LLHLLRQHK

SEQ ID NO: 866276 - protein, 9 aa, Homo Sapiens
AADFIHRVL

SEQ ID NO: 866277 - protein, 9 aa, Homo Sapiens
QSHGETKVK

SEQ ID NO: 866278 - protein, 9 aa, Homo Sapiens
AYLENDIKP

SEQ ID NO: 866279 - protein, 9 aa, Homo Sapiens
YLNLSQNQL

SEQ ID NO: 866280 - protein, 9 aa, Homo Sapiens
IQTWIANEK

SEQ ID NO: 866281 - protein, 9 aa, Homo Sapiens
QRCYDELLA

SEQ ID NO: 866282 - protein, 9 aa, Homo Sapiens
GGHNRDDGS

SEQ ID NO: 866283 - protein, 9 aa, Homo Sapiens
DTLLTTMLQ

SEQ ID NO: 866284 - protein, 9 aa, Homo Sapiens
VYCSYVSWD

SEQ ID NO: 866285 - protein, 9 aa, Homo Sapiens
DVKEEWQDK

SEQ ID NO: 866286 - protein, 9 aa, Homo Sapiens
SQYFLKSSK

SEQ ID NO: 866287 - protein, 9 aa, Homo Sapiens
EYWGKYGPQ

SEQ ID NO: 866288 - protein, 9 aa, Homo Sapiens
QIISHYEGE

SEQ ID NO: 866289 - protein, 9 aa, Homo Sapiens
QDELIIKAK

SEQ ID NO: 866290 - protein, 9 aa, Homo Sapiens
CQNPRGEEG

SEQ ID NO: 866291 - protein, 9 aa, Homo Sapiens
QKFLSEREA

SEQ ID NO: 866292 - protein, 9 aa, Homo Sapiens
VSVVNGKDV

SEQ ID NO: 866293 - protein, 9 aa, Homo Sapiens
QSSRIQSIP

SEQ ID NO: 866294 - protein, 9 aa, Homo Sapiens
IPEELGHLV

SEQ ID NO: 866295 - protein, 9 aa, Homo Sapiens
IRLLDVLCK

SEQ ID NO: 866296 - protein, 9 aa, Homo Sapiens
LSTIARKLL

SEQ ID NO: 866297 - protein, 9 aa, Homo Sapiens
PSHLFQHQR

SEQ ID NO: 866298 - protein, 9 aa, Homo Sapiens
DWYKPQNHP

SEQ ID NO: 866299 - protein, 9 aa, Homo Sapiens
QYRHIHNFQ

SEQ ID NO: 866300 - protein, 9 aa, Homo Sapiens
GKAALRGEP

SEQ ID NO: 866301 - protein, 9 aa, Homo Sapiens
KYTFFPPNK

SEQ ID NO: 866302 - protein, 9 aa, Homo Sapiens
ARSKKLIKK

SEQ ID NO: 866303 - protein, 9 aa, Homo Sapiens
PPTTTEVTI

SEQ ID NO: 866304 - protein, 9 aa, Homo Sapiens
PEILQLLTE

SEQ ID NO: 866305 - protein, 9 aa, Homo Sapiens
EKEWGNGIR

SEQ ID NO: 866306 - protein, 9 aa, Homo Sapiens
RGIDPPPCD

SEQ ID NO: 866307 - protein, 9 aa, Homo Sapiens
APFKSPEEM

SEQ ID NO: 866308 - protein, 9 aa, Homo Sapiens
TDLSRLNDK

SEQ ID NO: 866309 - protein, 9 aa, Homo Sapiens
RAPYPSAYP

SEQ ID NO: 866310 - protein, 9 aa, Homo Sapiens
KVGELKDDN

SEQ ID NO: 866311 - protein, 9 aa, Homo Sapiens
WLLRLKSPV

SEQ ID NO: 866312 - protein, 9 aa, Homo Sapiens
GKEDALICF

SEQ ID NO: 866313 - protein, 9 aa, Homo Sapiens
GHYTEEEQK

SEQ ID NO: 866314 - protein, 9 aa, Homo Sapiens
CHRRVHLGY

SEQ ID NO: 866315 - protein, 9 aa, Homo Sapiens
LYMAKARIT

SEQ ID NO: 866316 - protein, 9 aa, Homo Sapiens
HLIHLMFKT

SEQ ID NO: 866317 - protein, 9 aa, Homo Sapiens
KPILITGAT

SEQ ID NO: 866318 - protein, 9 aa, Homo Sapiens
AGNFSFSVN

SEQ ID NO: 866319 - protein, 9 aa, Homo Sapiens
GSTVLYWIF

SEQ ID NO: 866320 - protein, 9 aa, Homo Sapiens
STQTDITFK

SEQ ID NO: 866321 - protein, 9 aa, Homo Sapiens
KEKQDAWTI

SEQ ID NO: 866322 - protein, 9 aa, Homo Sapiens
QEQITYIQQ

SEQ ID NO: 866323 - protein, 9 aa, Homo Sapiens
LISIFFDIY

SEQ ID NO: 866324 - protein, 9 aa, Homo Sapiens
IKVDMRTIL

SEQ ID NO: 866325 - protein, 9 aa, Homo Sapiens
LNPFIYTLC

SEQ ID NO: 866326 - protein, 9 aa, Homo Sapiens
TLLQAENET

SEQ ID NO: 866327 - protein, 9 aa, Homo Sapiens
NVIYVGGPL

SEQ ID NO: 866328 - protein, 9 aa, Homo Sapiens
IANTSVKPS

SEQ ID NO: 866329 - protein, 9 aa, Homo Sapiens
VPLQVLLAN

SEQ ID NO: 866330 - protein, 9 aa, Homo Sapiens
FQQVKASIS

SEQ ID NO: 866331 - protein, 9 aa, Homo Sapiens
IDVGNKDGG

SEQ ID NO: 866332 - protein, 9 aa, Homo Sapiens
QRQYIFKYD

SEQ ID NO: 866333 - protein, 9 aa, Homo Sapiens
TQTAVFQTY

SEQ ID NO: 866334 - protein, 9 aa, Homo Sapiens
DKIIILYDT

SEQ ID NO: 866335 - protein, 9 aa, Homo Sapiens
QKAVKLKTK

SEQ ID NO: 866336 - protein, 9 aa, Homo Sapiens
GHCQDINKC

SEQ ID NO: 866337 - protein, 9 aa, Homo Sapiens
VGSVLGVCL

SEQ ID NO: 866338 - protein, 9 aa, Homo Sapiens
ALMLQRPQH

SEQ ID NO: 866339 - protein, 9 aa, Homo Sapiens
TGKGASTKQ

SEQ ID NO: 866340 - protein, 9 aa, Homo Sapiens
LHVRDHCVA

SEQ ID NO: 866341 - protein, 9 aa, Homo Sapiens
KMQNGYELS

SEQ ID NO: 866342 - protein, 9 aa, Homo Sapiens
SERMAGNKA

SEQ ID NO: 866343 - protein, 9 aa, Homo Sapiens
TVQNRESMG

SEQ ID NO: 866344 - protein, 9 aa, Homo Sapiens
AAFAVLAVA

SEQ ID NO: 866345 - protein, 9 aa, Homo Sapiens
YIITSLCED

SEQ ID NO: 866346 - protein, 9 aa, Homo Sapiens
KMYPSMPTF

SEQ ID NO: 866347 - protein, 9 aa, Homo Sapiens
WNPVSASRS

SEQ ID NO: 866348 - protein, 9 aa, Homo Sapiens
ENTTDGQQI

SEQ ID NO: 866349 - protein, 9 aa, Homo Sapiens
AGVCNPQQH

SEQ ID NO: 866350 - protein, 9 aa, Homo Sapiens
AGAGALLHL

SEQ ID NO: 866351 - protein, 9 aa, Homo Sapiens
TLRHHNLHS

SEQ ID NO: 866352 - protein, 9 aa, Homo Sapiens
TSVAISTST

SEQ ID NO: 866353 - protein, 9 aa, Homo Sapiens
QNHLCLVFE

SEQ ID NO: 866354 - protein, 9 aa, Homo Sapiens
TIGYEGINS

SEQ ID NO: 866355 - protein, 9 aa, Homo Sapiens
YKICVCPDG

SEQ ID NO: 866356 - protein, 9 aa, Homo Sapiens
VTSQSDSKQ

SEQ ID NO: 866357 - protein, 9 aa, Homo Sapiens
TVVFLLSND

SEQ ID NO: 866358 - protein, 9 aa, Homo Sapiens
KIKSLVALM

SEQ ID NO: 866359 - protein, 9 aa, Homo Sapiens
LFKHGLKKP

SEQ ID NO: 866360 - protein, 9 aa, Homo Sapiens
IAEKSQELL

SEQ ID NO: 866361 - protein, 9 aa, Homo Sapiens
ILSFILRIN

SEQ ID NO: 866362 - protein, 9 aa, Homo Sapiens
FNATAAFKT

SEQ ID NO: 866363 - protein, 9 aa, Homo Sapiens
VFSYFLATN

SEQ ID NO: 866364 - protein, 9 aa, Homo Sapiens
LDAEPDSWG

SEQ ID NO: 866365 - protein, 9 aa, Homo Sapiens
IKENEFFPT

SEQ ID NO: 866366 - protein, 9 aa, Homo Sapiens
KGRPGKDSY

SEQ ID NO: 866367 - protein, 9 aa, Homo Sapiens
LGVNEKQIK

SEQ ID NO: 866368 - protein, 9 aa, Homo Sapiens
CSLHARIEQ

SEQ ID NO: 866369 - protein, 9 aa, Homo Sapiens
EPSALGKSV

SEQ ID NO: 866370 - protein, 9 aa, Homo Sapiens
CLQNSEWLF

SEQ ID NO: 866371 - protein, 9 aa, Homo Sapiens
AATTTTTIF

SEQ ID NO: 866372 - protein, 9 aa, Homo Sapiens
LSGIALGGR

SEQ ID NO: 866373 - protein, 9 aa, Homo Sapiens
LTNDHVQFL

SEQ ID NO: 866374 - protein, 9 aa, Homo Sapiens
TSDKITAVS

SEQ ID NO: 866375 - protein, 9 aa, Homo Sapiens
QICNRALIQ

SEQ ID NO: 866376 - protein, 9 aa, Homo Sapiens
LLCPMRWEH

SEQ ID NO: 866377 - protein, 9 aa, Homo Sapiens
AHTAWCGFV

SEQ ID NO: 866378 - protein, 9 aa, Homo Sapiens
TIQDFWDNS

SEQ ID NO: 866379 - protein, 9 aa, Homo Sapiens
LNELNPMGD

SEQ ID NO: 866380 - protein, 9 aa, Homo Sapiens
SLLNMCVGE

SEQ ID NO: 866381 - protein, 9 aa, Homo Sapiens
MYYEMIKNC

SEQ ID NO: 866382 - protein, 9 aa, Homo Sapiens
QRKQRPPRL

SEQ ID NO: 866383 - protein, 9 aa, Homo Sapiens
RQNGSAAMY

SEQ ID NO: 866384 - protein, 9 aa, Homo Sapiens
ITVLDHYTY

SEQ ID NO: 866385 - protein, 9 aa, Homo Sapiens
DTLITEETE

SEQ ID NO: 866386 - protein, 9 aa, Homo Sapiens
IWKALSFDN

SEQ ID NO: 866387 - protein, 9 aa, Homo Sapiens
NKHGHKHEL

SEQ ID NO: 866388 - protein, 9 aa, Homo Sapiens
DTEDNLHVL

SEQ ID NO: 866389 - protein, 9 aa, Homo Sapiens
SAIYKQYCL

SEQ ID NO: 866390 - protein, 9 aa, Homo Sapiens
SQNNTPECL

SEQ ID NO: 866391 - protein, 9 aa, Homo Sapiens
ASSLLQKEI

SEQ ID NO: 866392 - protein, 9 aa, Homo Sapiens
NMSSMNERT

SEQ ID NO: 866393 - protein, 9 aa, Homo Sapiens
QCNICGKRF

SEQ ID NO: 866394 - protein, 9 aa, Homo Sapiens
SFAYPNHPD

SEQ ID NO: 866395 - protein, 9 aa, Homo Sapiens
YSQNTLIAL

SEQ ID NO: 866396 - protein, 9 aa, Homo Sapiens
NRDDWDIAA

SEQ ID NO: 866397 - protein, 9 aa, Homo Sapiens
GSAAREEDK

SEQ ID NO: 866398 - protein, 9 aa, Homo Sapiens
IHVIERCCK

SEQ ID NO: 866399 - protein, 9 aa, Homo Sapiens
PKHEENLLG

SEQ ID NO: 866400 - protein, 9 aa, Homo Sapiens
SDQMESTDT

SEQ ID NO: 866401 - protein, 9 aa, Homo Sapiens
CGFCFHTDK

SEQ ID NO: 866402 - protein, 9 aa, Homo Sapiens
LPILTLLNE

SEQ ID NO: 866403 - protein, 9 aa, Homo Sapiens
VKDCDADVH

SEQ ID NO: 866404 - protein, 9 aa, Homo Sapiens
SSGNPVYEQ

SEQ ID NO: 866405 - protein, 9 aa, Homo Sapiens
ECFQPVWVT

SEQ ID NO: 866406 - protein, 9 aa, Homo Sapiens
VVLLGLASV

SEQ ID NO: 866407 - protein, 9 aa, Homo Sapiens
IVFQRKLSK

SEQ ID NO: 866408 - protein, 9 aa, Homo Sapiens
NFDKWRKVS

SEQ ID NO: 866409 - protein, 9 aa, Homo Sapiens
NDRSKSKSN

SEQ ID NO: 866410 - protein, 9 aa, Homo Sapiens
VHPKYLSCI

SEQ ID NO: 866411 - protein, 9 aa, Homo Sapiens
GSNIEPSVC

SEQ ID NO: 866412 - protein, 9 aa, Homo Sapiens
GQYDIVQKN

SEQ ID NO: 866413 - protein, 9 aa, Homo Sapiens
PLHRHHLNN

SEQ ID NO: 866414 - protein, 9 aa, Homo Sapiens
DNYIPDEDL

SEQ ID NO: 866415 - protein, 9 aa, Homo Sapiens
ANEDELDNA

SEQ ID NO: 866416 - protein, 9 aa, Homo Sapiens
HYPPGHHSV

SEQ ID NO: 866417 - protein, 9 aa, Homo Sapiens
GVRTAAAPR

SEQ ID NO: 866418 - protein, 9 aa, Homo Sapiens
ELSSSSSSS

SEQ ID NO: 866419 - protein, 9 aa, Homo Sapiens
MAHKWMPDQ

SEQ ID NO: 866420 - protein, 9 aa, Homo Sapiens
NVMQISPDQ

SEQ ID NO: 866421 - protein, 9 aa, Homo Sapiens
CDSQEDVNS

SEQ ID NO: 866422 - protein, 9 aa, Homo Sapiens
KANVRWKML

SEQ ID NO: 866423 - protein, 9 aa, Homo Sapiens
LIVHQIIHT

SEQ ID NO: 866424 - protein, 9 aa, Homo Sapiens
KALTSKINL

SEQ ID NO: 866425 - protein, 9 aa, Homo Sapiens
IIILYDTSS

SEQ ID NO: 866426 - protein, 9 aa, Homo Sapiens
ICPVLPHVQ

SEQ ID NO: 866427 - protein, 9 aa, Homo Sapiens
MPLDYVPPT

SEQ ID NO: 866428 - protein, 9 aa, Homo Sapiens
YFNIHPTKR

SEQ ID NO: 866429 - protein, 9 aa, Homo Sapiens
GIKILENLR

SEQ ID NO: 866430 - protein, 9 aa, Homo Sapiens
PAHAIYLLS

SEQ ID NO: 866431 - protein, 9 aa, Homo Sapiens
SWTALLGLM

SEQ ID NO: 866432 - protein, 9 aa, Homo Sapiens
DYYNTIIDD

SEQ ID NO: 866433 - protein, 9 aa, Homo Sapiens
KCKIKNILE

SEQ ID NO: 866434 - protein, 9 aa, Homo Sapiens
KPYECQACQ

SEQ ID NO: 866435 - protein, 9 aa, Homo Sapiens
KEATGYKKC

SEQ ID NO: 866436 - protein, 9 aa, Homo Sapiens
WVVQAWTCL

SEQ ID NO: 866437 - protein, 9 aa, Homo Sapiens
LLETFGNAK

SEQ ID NO: 866438 - protein, 9 aa, Homo Sapiens
NNWHGGQAA

SEQ ID NO: 866439 - protein, 9 aa, Homo Sapiens
SADRNFIKN

SEQ ID NO: 866440 - protein, 9 aa, Homo Sapiens
HLSCIKAKQ

SEQ ID NO: 866441 - protein, 9 aa, Homo Sapiens
STKNAAILT

SEQ ID NO: 866442 - protein, 9 aa, Homo Sapiens
NDSGKLTQE

SEQ ID NO: 866443 - protein, 9 aa, Homo Sapiens
QDINKCRHP

SEQ ID NO: 866444 - protein, 9 aa, Homo Sapiens
EEWKYELKI

SEQ ID NO: 866445 - protein, 9 aa, Homo Sapiens
QSLKALMLP

SEQ ID NO: 866446 - protein, 9 aa, Homo Sapiens
YHTERDKGT

SEQ ID NO: 866447 - protein, 9 aa, Homo Sapiens
NNSDYAITQ

SEQ ID NO: 866448 - protein, 9 aa, Homo Sapiens
EPAAEMPDM

SEQ ID NO: 866449 - protein, 9 aa, Homo Sapiens
GSLLIIGLV

SEQ ID NO: 866450 - protein, 9 aa, Homo Sapiens
DDENLIQKH

SEQ ID NO: 866451 - protein, 9 aa, Homo Sapiens
NWPMVLGWL

SEQ ID NO: 866452 - protein, 9 aa, Homo Sapiens
QYTLSVTAL

SEQ ID NO: 866453 - protein, 9 aa, Homo Sapiens
TSTPRRSCR

SEQ ID NO: 866454 - protein, 9 aa, Homo Sapiens
LSADWPTVA

SEQ ID NO: 866455 - protein, 9 aa, Homo Sapiens
NNCYRRLDL

SEQ ID NO: 866456 - protein, 9 aa, Homo Sapiens
TLITVCWHF

SEQ ID NO: 866457 - protein, 9 aa, Homo Sapiens
LSALNTAGT

SEQ ID NO: 866458 - protein, 9 aa, Homo Sapiens
QTEESPYMN

SEQ ID NO: 866459 - protein, 9 aa, Homo Sapiens
PINNLYATQ

SEQ ID NO: 866460 - protein, 9 aa, Homo Sapiens
AFLHWLTGE

SEQ ID NO: 866461 - protein, 9 aa, Homo Sapiens
KMQLWILQF

SEQ ID NO: 866462 - protein, 9 aa, Homo Sapiens
ESTAKFTHY

SEQ ID NO: 866463 - protein, 9 aa, Homo Sapiens
NIRYKYPNI

SEQ ID NO: 866464 - protein, 9 aa, Homo Sapiens
AGFKAAIVH

SEQ ID NO: 866465 - protein, 9 aa, Homo Sapiens
LQADWHGRP

SEQ ID NO: 866466 - protein, 9 aa, Homo Sapiens
DLKDVDNIL

SEQ ID NO: 866467 - protein, 9 aa, Homo Sapiens
RVFCLQNPK

SEQ ID NO: 866468 - protein, 9 aa, Homo Sapiens
VSEPLPGSL

SEQ ID NO: 866469 - protein, 9 aa, Homo Sapiens
TASSKKAIE

SEQ ID NO: 866470 - protein, 9 aa, Homo Sapiens
CFYSEIMEL

SEQ ID NO: 866471 - protein, 9 aa, Homo Sapiens
SQTPELKQS

SEQ ID NO: 866472 - protein, 9 aa, Homo Sapiens
AFTVAMQNL

SEQ ID NO: 866473 - protein, 9 aa, Homo Sapiens
QPGIFSPLA

SEQ ID NO: 866474 - protein, 9 aa, Homo Sapiens
QDHVKKDYL

SEQ ID NO: 866475 - protein, 9 aa, Homo Sapiens
SNIELPTII

SEQ ID NO: 866476 - protein, 9 aa, Homo Sapiens
CRAHQLVHK

SEQ ID NO: 866477 - protein, 9 aa, Homo Sapiens
DINASYVNM

SEQ ID NO: 866478 - protein, 9 aa, Homo Sapiens
KSSQMETVS

SEQ ID NO: 866479 - protein, 9 aa, Homo Sapiens
KEIHRALHK

SEQ ID NO: 866480 - protein, 9 aa, Homo Sapiens
TSQSDSKQR

SEQ ID NO: 866481 - protein, 9 aa, Homo Sapiens
LKNSSSNKW

SEQ ID NO: 866482 - protein, 9 aa, Homo Sapiens
DSRPTKQEV

SEQ ID NO: 866483 - protein, 9 aa, Homo Sapiens
QRHYDEYSA

SEQ ID NO: 866484 - protein, 9 aa, Homo Sapiens
LTSQCKLHP

SEQ ID NO: 866485 - protein, 9 aa, Homo Sapiens
AVNADSGYN

SEQ ID NO: 866486 - protein, 9 aa, Homo Sapiens
DTFGSRVCI

SEQ ID NO: 866487 - protein, 9 aa, Homo Sapiens
QQEHCFLKR

SEQ ID NO: 866488 - protein, 9 aa, Homo Sapiens
RLSTSLLLS

SEQ ID NO: 866489 - protein, 9 aa, Homo Sapiens
NYGYCSYKT

SEQ ID NO: 866490 - protein, 9 aa, Homo Sapiens
KPEIVDFAS

SEQ ID NO: 866491 - protein, 9 aa, Homo Sapiens
CSLSQSLVQ

SEQ ID NO: 866492 - protein, 9 aa, Homo Sapiens
LTCPPGWKW

SEQ ID NO: 866493 - protein, 9 aa, Homo Sapiens
LNFYHTGRL

SEQ ID NO: 866494 - protein, 9 aa, Homo Sapiens
CGKLFCWST

SEQ ID NO: 866495 - protein, 9 aa, Homo Sapiens
GHYDINKSL

SEQ ID NO: 866496 - protein, 9 aa, Homo Sapiens
GLYLENSFS

SEQ ID NO: 866497 - protein, 9 aa, Homo Sapiens
NFRCIPDEV

SEQ ID NO: 866498 - protein, 9 aa, Homo Sapiens
DRLLNRCRQ

SEQ ID NO: 866499 - protein, 9 aa, Homo Sapiens
VENSGAIEE

SEQ ID NO: 866500 - protein, 9 aa, Homo Sapiens
YWIFTVNHK

SEQ ID NO: 866501 - protein, 9 aa, Homo Sapiens
TLVCILGTT

SEQ ID NO: 866502 - protein, 9 aa, Homo Sapiens
MMSVQASTG

SEQ ID NO: 866503 - protein, 9 aa, Homo Sapiens
NLSSERNVS

SEQ ID NO: 866504 - protein, 9 aa, Homo Sapiens
ESCLIQLWH

SEQ ID NO: 866505 - protein, 9 aa, Homo Sapiens
WRLKCIAID

SEQ ID NO: 866506 - protein, 9 aa, Homo Sapiens
RLGRQCWKL

SEQ ID NO: 866507 - protein, 9 aa, Homo Sapiens
FTIPLGSGL

SEQ ID NO: 866508 - protein, 9 aa, Homo Sapiens
QEEIICRFE

SEQ ID NO: 866509 - protein, 9 aa, Homo Sapiens
NYLRIVPKK

SEQ ID NO: 866510 - protein, 9 aa, Homo Sapiens
RFNNLRFVG

SEQ ID NO: 866511 - protein, 9 aa, Homo Sapiens
MGDPSYKYE

SEQ ID NO: 866512 - protein, 9 aa, Homo Sapiens
PGVIGYIGM

SEQ ID NO: 866513 - protein, 9 aa, Homo Sapiens
NDSDNIKHK

SEQ ID NO: 866514 - protein, 9 aa, Homo Sapiens
KIAPEILQL

SEQ ID NO: 866515 - protein, 9 aa, Homo Sapiens
TEVSASKGL

SEQ ID NO: 866516 - protein, 9 aa, Homo Sapiens
GRAVRVLHS

SEQ ID NO: 866517 - protein, 9 aa, Homo Sapiens
LLVTLVFLF

SEQ ID NO: 866518 - protein, 9 aa, Homo Sapiens
WMWSKCSQK

SEQ ID NO: 866519 - protein, 9 aa, Homo Sapiens
QLGSLSALN

SEQ ID NO: 866520 - protein, 9 aa, Homo Sapiens
SSDYDWNKS

SEQ ID NO: 866521 - protein, 9 aa, Homo Sapiens
QCLSCQNYS

SEQ ID NO: 866522 - protein, 9 aa, Homo Sapiens
TAALGLPES

SEQ ID NO: 866523 - protein, 9 aa, Homo Sapiens
QHISQSEDE

SEQ ID NO: 866524 - protein, 9 aa, Homo Sapiens
TKRTFSPGR

SEQ ID NO: 866525 - protein, 9 aa, Homo Sapiens
YEDELDMGQ

SEQ ID NO: 866526 - protein, 9 aa, Homo Sapiens
RVVWKQPRL

SEQ ID NO: 866527 - protein, 9 aa, Homo Sapiens
ALCQNAREM

SEQ ID NO: 866528 - protein, 9 aa, Homo Sapiens
LMEDVEADK

SEQ ID NO: 866529 - protein, 9 aa, Homo Sapiens
NTFFPLLGN

SEQ ID NO: 866530 - protein, 9 aa, Homo Sapiens
ANLNMLRAL

SEQ ID NO: 866531 - protein, 9 aa, Homo Sapiens
YRNNFLTAF

SEQ ID NO: 866532 - protein, 9 aa, Homo Sapiens
QTETPALPG

SEQ ID NO: 866533 - protein, 9 aa, Homo Sapiens
KARIVLANY

SEQ ID NO: 866534 - protein, 9 aa, Homo Sapiens
QQDWTILHS

SEQ ID NO: 866535 - protein, 9 aa, Homo Sapiens
LKKYRGKCE

SEQ ID NO: 866536 - protein, 9 aa, Homo Sapiens
VALCGLPDG

SEQ ID NO: 866537 - protein, 9 aa, Homo Sapiens
KRSINKEIH

SEQ ID NO: 866538 - protein, 9 aa, Homo Sapiens
TGDHGIIQT

SEQ ID NO: 866539 - protein, 9 aa, Homo Sapiens
GKWTTNGLP

SEQ ID NO: 866540 - protein, 9 aa, Homo Sapiens
LPCFGSKLV

SEQ ID NO: 866541 - protein, 9 aa, Homo Sapiens
KDSQWDSAL

SEQ ID NO: 866542 - protein, 9 aa, Homo Sapiens
EQEFLYKTV

SEQ ID NO: 866543 - protein, 9 aa, Homo Sapiens
IPIVYELDN

SEQ ID NO: 866544 - protein, 9 aa, Homo Sapiens
CTKKIGLET

SEQ ID NO: 866545 - protein, 9 aa, Homo Sapiens
PEKGNWLQY

SEQ ID NO: 866546 - protein, 9 aa, Homo Sapiens
RKIKQRLTR

SEQ ID NO: 866547 - protein, 9 aa, Homo Sapiens
EQITKFMVT

SEQ ID NO: 866548 - protein, 9 aa, Homo Sapiens
GLYSDRMSE

SEQ ID NO: 866549 - protein, 9 aa, Homo Sapiens
TMALAFFSS

SEQ ID NO: 866550 - protein, 9 aa, Homo Sapiens
DSLQKRSVR

SEQ ID NO: 866551 - protein, 9 aa, Homo Sapiens
IPDHELFTA

SEQ ID NO: 866552 - protein, 9 aa, Homo Sapiens
WIVLGPYHY

SEQ ID NO: 866553 - protein, 9 aa, Homo Sapiens
IVAASSRSD

SEQ ID NO: 866554 - protein, 9 aa, Homo Sapiens
QDNQQANGH

SEQ ID NO: 866555 - protein, 9 aa, Homo Sapiens
FWDNSIPDI

SEQ ID NO: 866556 - protein, 9 aa, Homo Sapiens
SLFKFKSSS

SEQ ID NO: 866557 - protein, 9 aa, Homo Sapiens
VWDLEPNTD

SEQ ID NO: 866558 - protein, 9 aa, Homo Sapiens
PELSCGSPL

SEQ ID NO: 866559 - protein, 9 aa, Homo Sapiens
AHPKGYVGS

SEQ ID NO: 866560 - protein, 9 aa, Homo Sapiens
SYVELHQFV

SEQ ID NO: 866561 - protein, 9 aa, Homo Sapiens
PIIKLTDYF

SEQ ID NO: 866562 - protein, 9 aa, Homo Sapiens
VKVHPKYLS

SEQ ID NO: 866563 - protein, 9 aa, Homo Sapiens
KLGQSIACP

SEQ ID NO: 866564 - protein, 9 aa, Homo Sapiens
RNINTLQRC

SEQ ID NO: 866565 - protein, 9 aa, Homo Sapiens
NSGKTRFKK

SEQ ID NO: 866566 - protein, 9 aa, Homo Sapiens
QRYLVIMCS

SEQ ID NO: 866567 - protein, 9 aa, Homo Sapiens
SPGAINSCQ

SEQ ID NO: 866568 - protein, 9 aa, Homo Sapiens
NMSNISIWL

SEQ ID NO: 866569 - protein, 9 aa, Homo Sapiens
IDLRRPHQQ

SEQ ID NO: 866570 - protein, 9 aa, Homo Sapiens
SLSQNDFQS

SEQ ID NO: 866571 - protein, 9 aa, Homo Sapiens
LCVSNGWDP

SEQ ID NO: 866572 - protein, 9 aa, Homo Sapiens
LEKDNQMRM

SEQ ID NO: 866573 - protein, 9 aa, Homo Sapiens
IEDPPHRKH

SEQ ID NO: 866574 - protein, 9 aa, Homo Sapiens
MVERICKFQ

SEQ ID NO: 866575 - protein, 9 aa, Homo Sapiens
ILELLGSRL

SEQ ID NO: 866576 - protein, 9 aa, Homo Sapiens
SNYFGPVSL

SEQ ID NO: 866577 - protein, 9 aa, Homo Sapiens
SQPGIFSPL

SEQ ID NO: 866578 - protein, 9 aa, Homo Sapiens
KPFVPHSQA

SEQ ID NO: 866579 - protein, 9 aa, Homo Sapiens
EYQDKPLLR

SEQ ID NO: 866580 - protein, 9 aa, Homo Sapiens
ADDDSGMYT

SEQ ID NO: 866581 - protein, 9 aa, Homo Sapiens
LTPKAVTAA

SEQ ID NO: 866582 - protein, 9 aa, Homo Sapiens
GAGAGNPGS

SEQ ID NO: 866583 - protein, 9 aa, Homo Sapiens
TCLEGFKGK

SEQ ID NO: 866584 - protein, 9 aa, Homo Sapiens
CSRLTVHWR

SEQ ID NO: 866585 - protein, 9 aa, Homo Sapiens
IPSDRINKF

SEQ ID NO: 866586 - protein, 9 aa, Homo Sapiens
DSLESPHMY

SEQ ID NO: 866587 - protein, 9 aa, Homo Sapiens
HKKAHSGEK

SEQ ID NO: 866588 - protein, 9 aa, Homo Sapiens
YVLVFTLTT

SEQ ID NO: 866589 - protein, 9 aa, Homo Sapiens
QVNVFAIFI

SEQ ID NO: 866590 - protein, 9 aa, Homo Sapiens
NCLIQFDDF

SEQ ID NO: 866591 - protein, 9 aa, Homo Sapiens
GIDLNQTKL

SEQ ID NO: 866592 - protein, 9 aa, Homo Sapiens
QQRTGKPDE

SEQ ID NO: 866593 - protein, 9 aa, Homo Sapiens
LLNKKAICK

SEQ ID NO: 866594 - protein, 9 aa, Homo Sapiens
RISLSPRRS

SEQ ID NO: 866595 - protein, 9 aa, Homo Sapiens
PAAEMPDMK

SEQ ID NO: 866596 - protein, 9 aa, Homo Sapiens
EMIHKAQNF

SEQ ID NO: 866597 - protein, 9 aa, Homo Sapiens
HKHLCIQNE

SEQ ID NO: 866598 - protein, 9 aa, Homo Sapiens
FKDGVQQIP

SEQ ID NO: 866599 - protein, 9 aa, Homo Sapiens
NIARPCSET

SEQ ID NO: 866600 - protein, 9 aa, Homo Sapiens
ESGLSFITC

SEQ ID NO: 866601 - protein, 9 aa, Homo Sapiens
VQLHKKLGT

SEQ ID NO: 866602 - protein, 9 aa, Homo Sapiens
ICSICKASG

SEQ ID NO: 866603 - protein, 9 aa, Homo Sapiens
WERLELKLT

SEQ ID NO: 866604 - protein, 9 aa, Homo Sapiens
QNNLTAPVS

SEQ ID NO: 866605 - protein, 9 aa, Homo Sapiens
LACKFIPPV

SEQ ID NO: 866606 - protein, 9 aa, Homo Sapiens
AILTENQCL

SEQ ID NO: 866607 - protein, 9 aa, Homo Sapiens
EAELWRAMG

SEQ ID NO: 866608 - protein, 9 aa, Homo Sapiens
LHHCFYRGQ

SEQ ID NO: 866609 - protein, 9 aa, Homo Sapiens
TVLTSLAST

SEQ ID NO: 866610 - protein, 9 aa, Homo Sapiens
RICSVTCAK

SEQ ID NO: 866611 - protein, 9 aa, Homo Sapiens
IKSIIAIAF

SEQ ID NO: 866612 - protein, 9 aa, Homo Sapiens
WNIYISAEY

SEQ ID NO: 866613 - protein, 9 aa, Homo Sapiens
RLFVLFTMY

SEQ ID NO: 866614 - protein, 9 aa, Homo Sapiens
RGLFPESYY

SEQ ID NO: 866615 - protein, 9 aa, Homo Sapiens
LFDMKPFKD

SEQ ID NO: 866616 - protein, 9 aa, Homo Sapiens
FICSSSFRL

SEQ ID NO: 866617 - protein, 9 aa, Homo Sapiens
RLNLLTPQH

SEQ ID NO: 866618 - protein, 9 aa, Homo Sapiens
YPPLLENPM

SEQ ID NO: 866619 - protein, 9 aa, Homo Sapiens
LKVDVDCCK

SEQ ID NO: 866620 - protein, 9 aa, Homo Sapiens
VINSTLVKI

SEQ ID NO: 866621 - protein, 9 aa, Homo Sapiens
TYSNIKDYI

SEQ ID NO: 866622 - protein, 9 aa, Homo Sapiens
AVSQLAQTT

SEQ ID NO: 866623 - protein, 9 aa, Homo Sapiens
PVVKGTFIS

SEQ ID NO: 866624 - protein, 9 aa, Homo Sapiens
PTIHLRISP

SEQ ID NO: 866625 - protein, 9 aa, Homo Sapiens
FKKTVAMHK

SEQ ID NO: 866626 - protein, 9 aa, Homo Sapiens
GVPDKEGWV

SEQ ID NO: 866627 - protein, 9 aa, Homo Sapiens
HMMVGVNIS

SEQ ID NO: 866628 - protein, 9 aa, Homo Sapiens
QYLHHCEHL

SEQ ID NO: 866629 - protein, 9 aa, Homo Sapiens
SLIVTTVCL

SEQ ID NO: 866630 - protein, 9 aa, Homo Sapiens
METIQHGVH

SEQ ID NO: 866631 - protein, 9 aa, Homo Sapiens
SFVCVISLG

SEQ ID NO: 866632 - protein, 9 aa, Homo Sapiens
KIPDSLLLS

SEQ ID NO: 866633 - protein, 9 aa, Homo Sapiens
SFIRLAIPS

SEQ ID NO: 866634 - protein, 9 aa, Homo Sapiens
QLHIMENYC

SEQ ID NO: 866635 - protein, 9 aa, Homo Sapiens
VHPLNINPD

SEQ ID NO: 866636 - protein, 9 aa, Homo Sapiens
AKIYQQHPE

SEQ ID NO: 866637 - protein, 9 aa, Homo Sapiens
YLGEVLFDI

SEQ ID NO: 866638 - protein, 9 aa, Homo Sapiens
AECRGLRAI

SEQ ID NO: 866639 - protein, 9 aa, Homo Sapiens
EPKDLVVQQ

SEQ ID NO: 866640 - protein, 9 aa, Homo Sapiens
VMGLSEEWT

SEQ ID NO: 866641 - protein, 9 aa, Homo Sapiens
DIRQHPLFW

SEQ ID NO: 866642 - protein, 9 aa, Homo Sapiens
MIKNFDRDN

SEQ ID NO: 866643 - protein, 9 aa, Homo Sapiens
RYFFELRLK

SEQ ID NO: 866644 - protein, 9 aa, Homo Sapiens
CDNCNLKYL

SEQ ID NO: 866645 - protein, 9 aa, Homo Sapiens
SKRKSDQME

SEQ ID NO: 866646 - protein, 9 aa, Homo Sapiens
DIHRDLDNK

SEQ ID NO: 866647 - protein, 9 aa, Homo Sapiens
RCSKCCDDL

SEQ ID NO: 866648 - protein, 9 aa, Homo Sapiens
PDNFELVKK

SEQ ID NO: 866649 - protein, 9 aa, Homo Sapiens
HNILQRCLM

SEQ ID NO: 866650 - protein, 9 aa, Homo Sapiens
KMVDALLFG

SEQ ID NO: 866651 - protein, 9 aa, Homo Sapiens
DLYKLVQYA

SEQ ID NO: 866652 - protein, 9 aa, Homo Sapiens
WIYYGDSCY

SEQ ID NO: 866653 - protein, 9 aa, Homo Sapiens
GQLGRTRAE

SEQ ID NO: 866654 - protein, 9 aa, Homo Sapiens
EEINEQIIK

SEQ ID NO: 866655 - protein, 9 aa, Homo Sapiens
PALKTIINK

SEQ ID NO: 866656 - protein, 9 aa, Homo Sapiens
GDIGGATIP

SEQ ID NO: 866657 - protein, 9 aa, Homo Sapiens
LLFSNWMVQ

SEQ ID NO: 866658 - protein, 9 aa, Homo Sapiens
DWRNKWAQE

SEQ ID NO: 866659 - protein, 9 aa, Homo Sapiens
NYLEEAVSH

SEQ ID NO: 866660 - protein, 9 aa, Homo Sapiens
KKAHSGEKP

SEQ ID NO: 866661 - protein, 9 aa, Homo Sapiens
SQISWPLWT

SEQ ID NO: 866662 - protein, 9 aa, Homo Sapiens
IHAPPPTKI

SEQ ID NO: 866663 - protein, 9 aa, Homo Sapiens
KNLLKHCVD

SEQ ID NO: 866664 - protein, 9 aa, Homo Sapiens
ENNNSNKFK

SEQ ID NO: 866665 - protein, 9 aa, Homo Sapiens
PQGNGSNLI

SEQ ID NO: 866666 - protein, 9 aa, Homo Sapiens
NFQYDNFFN

SEQ ID NO: 866667 - protein, 9 aa, Homo Sapiens
FNTKEEILM

SEQ ID NO: 866668 - protein, 9 aa, Homo Sapiens
KRPGVTGKN

SEQ ID NO: 866669 - protein, 9 aa, Homo Sapiens
EGIKDNLDN

SEQ ID NO: 866670 - protein, 9 aa, Homo Sapiens
LLQVLHMMV

SEQ ID NO: 866671 - protein, 9 aa, Homo Sapiens
FNFIHDVNK

SEQ ID NO: 866672 - protein, 9 aa, Homo Sapiens
KLTIHRRVY

SEQ ID NO: 866673 - protein, 9 aa, Homo Sapiens
LNNYILKEN

SEQ ID NO: 866674 - protein, 9 aa, Homo Sapiens
LYAWNDLDS

SEQ ID NO: 866675 - protein, 9 aa, Homo Sapiens
LIIVDYILF

SEQ ID NO: 866676 - protein, 9 aa, Homo Sapiens
NESRKKINS

SEQ ID NO: 866677 - protein, 9 aa, Homo Sapiens
NIFRICFHD

SEQ ID NO: 866678 - protein, 9 aa, Homo Sapiens
GAADKQGGP

SEQ ID NO: 866679 - protein, 9 aa, Homo Sapiens
GKKDTSLYR

SEQ ID NO: 866680 - protein, 9 aa, Homo Sapiens
PDKEGWVKV

SEQ ID NO: 866681 - protein, 9 aa, Homo Sapiens
FSRLFELFD

SEQ ID NO: 866682 - protein, 9 aa, Homo Sapiens
ILLLEGFEL

SEQ ID NO: 866683 - protein, 9 aa, Homo Sapiens
SCRRPGVQW

SEQ ID NO: 866684 - protein, 9 aa, Homo Sapiens
LRMEEMGNC

SEQ ID NO: 866685 - protein, 9 aa, Homo Sapiens
NYCKGGITF

SEQ ID NO: 866686 - protein, 9 aa, Homo Sapiens
LGEVSVESD

SEQ ID NO: 866687 - protein, 9 aa, Homo Sapiens
ENFRPQNEL

SEQ ID NO: 866688 - protein, 9 aa, Homo Sapiens
HQIIHIGKK

SEQ ID NO: 866689 - protein, 9 aa, Homo Sapiens
NCVEFHKLN

SEQ ID NO: 866690 - protein, 9 aa, Homo Sapiens
HQRQSGVVV

SEQ ID NO: 866691 - protein, 9 aa, Homo Sapiens
KIDKEENSD

SEQ ID NO: 866692 - protein, 9 aa, Homo Sapiens
ADISLQVRQ

SEQ ID NO: 866693 - protein, 9 aa, Homo Sapiens
PPTKAPDAM

SEQ ID NO: 866694 - protein, 9 aa, Homo Sapiens
FQRRRRGFR

SEQ ID NO: 866695 - protein, 9 aa, Homo Sapiens
LSQYFLKSS

SEQ ID NO: 866696 - protein, 9 aa, Homo Sapiens
PPKTFSPSP

SEQ ID NO: 866697 - protein, 9 aa, Homo Sapiens
FGAGSDIGY

SEQ ID NO: 866698 - protein, 9 aa, Homo Sapiens
QVLHMMVGV

SEQ ID NO: 866699 - protein, 9 aa, Homo Sapiens
WSTVDEKEQ

SEQ ID NO: 866700 - protein, 9 aa, Homo Sapiens
TTSIAQARK

SEQ ID NO: 866701 - protein, 9 aa, Homo Sapiens
LAALTKCAA

SEQ ID NO: 866702 - protein, 9 aa, Homo Sapiens
VTIGLDKII

SEQ ID NO: 866703 - protein, 9 aa, Homo Sapiens
NETQEELSA

SEQ ID NO: 866704 - protein, 9 aa, Homo Sapiens
DFDDSPFFP

SEQ ID NO: 866705 - protein, 9 aa, Homo Sapiens
DPECMRLRN

SEQ ID NO: 866706 - protein, 9 aa, Homo Sapiens
YVQTYQKKP

SEQ ID NO: 866707 - protein, 9 aa, Homo Sapiens
AVAIIFHNE

SEQ ID NO: 866708 - protein, 9 aa, Homo Sapiens
FFKLARQTY

SEQ ID NO: 866709 - protein, 9 aa, Homo Sapiens
QVFQAPHRR

SEQ ID NO: 866710 - protein, 9 aa, Homo Sapiens
KKKQQFGEL

SEQ ID NO: 866711 - protein, 9 aa, Homo Sapiens
DPTVNAQLD

SEQ ID NO: 866712 - protein, 9 aa, Homo Sapiens
FVCDKHYYG

SEQ ID NO: 866713 - protein, 9 aa, Homo Sapiens
LLEKHQQLS

SEQ ID NO: 866714 - protein, 9 aa, Homo Sapiens
LSNVSLTGA

SEQ ID NO: 866715 - protein, 9 aa, Homo Sapiens
LRGKVCIYR

SEQ ID NO: 866716 - protein, 9 aa, Homo Sapiens
AGLIELLAL

SEQ ID NO: 866717 - protein, 9 aa, Homo Sapiens
NKYPTKDMK

SEQ ID NO: 866718 - protein, 9 aa, Homo Sapiens
LDEATSVLD

SEQ ID NO: 866719 - protein, 9 aa, Homo Sapiens
GYGGLVCMD

SEQ ID NO: 866720 - protein, 9 aa, Homo Sapiens
LSCETRVNL

SEQ ID NO: 866721 - protein, 9 aa, Homo Sapiens
LRKKVNNIE

SEQ ID NO: 866722 - protein, 9 aa, Homo Sapiens
DCGWFVTPL

SEQ ID NO: 866723 - protein, 9 aa, Homo Sapiens
KFHSIRGEV

SEQ ID NO: 866724 - protein, 9 aa, Homo Sapiens
LDEEDSSNN

SEQ ID NO: 866725 - protein, 9 aa, Homo Sapiens
KSTKCFDNK

SEQ ID NO: 866726 - protein, 9 aa, Homo Sapiens
TSLLVAVYK

SEQ ID NO: 866727 - protein, 9 aa, Homo Sapiens
INPAHAIYL

SEQ ID NO: 866728 - protein, 9 aa, Homo Sapiens
DNAAYFFWL

SEQ ID NO: 866729 - protein, 9 aa, Homo Sapiens
PHNILQRCL

SEQ ID NO: 866730 - protein, 9 aa, Homo Sapiens
NICTIEEII

SEQ ID NO: 866731 - protein, 9 aa, Homo Sapiens
FKSNGPGLQ

SEQ ID NO: 866732 - protein, 9 aa, Homo Sapiens
GEENDSSCH

SEQ ID NO: 866733 - protein, 9 aa, Homo Sapiens
EEKQWIMLL

SEQ ID NO: 866734 - protein, 9 aa, Homo Sapiens
DVVDTTFKN

SEQ ID NO: 866735 - protein, 9 aa, Homo Sapiens
SEFDVFDAY

SEQ ID NO: 866736 - protein, 9 aa, Homo Sapiens
LQNQDNKLL

SEQ ID NO: 866737 - protein, 9 aa, Homo Sapiens
FQGRQAEFS

SEQ ID NO: 866738 - protein, 9 aa, Homo Sapiens
CVDLPIKSA

SEQ ID NO: 866739 - protein, 9 aa, Homo Sapiens
ASNSIDHQI

SEQ ID NO: 866740 - protein, 9 aa, Homo Sapiens
VKILAVFYT

SEQ ID NO: 866741 - protein, 9 aa, Homo Sapiens
SLTTSPFVK

SEQ ID NO: 866742 - protein, 9 aa, Homo Sapiens
GYGRDMGNR

SEQ ID NO: 866743 - protein, 9 aa, Homo Sapiens
YEQDTAEYI

SEQ ID NO: 866744 - protein, 9 aa, Homo Sapiens
FQIKHLPYT

SEQ ID NO: 866745 - protein, 9 aa, Homo Sapiens
FNWFLHLVI

SEQ ID NO: 866746 - protein, 9 aa, Homo Sapiens
THMPKGMWI

SEQ ID NO: 866747 - protein, 9 aa, Homo Sapiens
KNKISESFF

SEQ ID NO: 866748 - protein, 9 aa, Homo Sapiens
SKNRYRDIL

SEQ ID NO: 866749 - protein, 9 aa, Homo Sapiens
ACMDVMKDV

SEQ ID NO: 866750 - protein, 9 aa, Homo Sapiens
WRGFYKMCD

SEQ ID NO: 866751 - protein, 9 aa, Homo Sapiens
CYFNAGQTF

SEQ ID NO: 866752 - protein, 9 aa, Homo Sapiens
KYIITSLCE

SEQ ID NO: 866753 - protein, 9 aa, Homo Sapiens
FIFHSSIQR

SEQ ID NO: 866754 - protein, 9 aa, Homo Sapiens
CPQLREICV

SEQ ID NO: 866755 - protein, 9 aa, Homo Sapiens
LKQWKTFEE

SEQ ID NO: 866756 - protein, 9 aa, Homo Sapiens
HNFAPAPAS

SEQ ID NO: 866757 - protein, 9 aa, Homo Sapiens
LLDHQIFFN

SEQ ID NO: 866758 - protein, 9 aa, Homo Sapiens
GIKHSLHQK

SEQ ID NO: 866759 - protein, 9 aa, Homo Sapiens
NQNIMDFKL

SEQ ID NO: 866760 - protein, 9 aa, Homo Sapiens
CAQTFFKIT

SEQ ID NO: 866761 - protein, 9 aa, Homo Sapiens
FQINLTVLL

SEQ ID NO: 866762 - protein, 9 aa, Homo Sapiens
DIKQFLLNY

SEQ ID NO: 866763 - protein, 9 aa, Homo Sapiens
VEQRKKICE

SEQ ID NO: 866764 - protein, 9 aa, Homo Sapiens
LEPVWFLRS

SEQ ID NO: 866765 - protein, 9 aa, Homo Sapiens
YPFSPDGHL

SEQ ID NO: 866766 - protein, 9 aa, Homo Sapiens
SRRNQKESG

SEQ ID NO: 866767 - protein, 9 aa, Homo Sapiens
GHLFCSSGT

SEQ ID NO: 866768 - protein, 9 aa, Homo Sapiens
SPPGVMCLP

SEQ ID NO: 866769 - protein, 9 aa, Homo Sapiens
YFFTIFNAF

SEQ ID NO: 866770 - protein, 9 aa, Homo Sapiens
DVKMTFDRD

SEQ ID NO: 866771 - protein, 9 aa, Homo Sapiens
RSPHADSMC

SEQ ID NO: 866772 - protein, 9 aa, Homo Sapiens
DPNNCLIVL

SEQ ID NO: 866773 - protein, 9 aa, Homo Sapiens
SSSKSDHFR

SEQ ID NO: 866774 - protein, 9 aa, Homo Sapiens
AFDRYVAVY

SEQ ID NO: 866775 - protein, 9 aa, Homo Sapiens
GILFRGQQI

SEQ ID NO: 866776 - protein, 9 aa, Homo Sapiens
IVLWNFLLA

SEQ ID NO: 866777 - protein, 9 aa, Homo Sapiens
CRSGACHAT

SEQ ID NO: 866778 - protein, 9 aa, Homo Sapiens
QETEQRCAS

SEQ ID NO: 866779 - protein, 9 aa, Homo Sapiens
IHWAVVNKD

SEQ ID NO: 866780 - protein, 9 aa, Homo Sapiens
SIEMYRGKK

SEQ ID NO: 866781 - protein, 9 aa, Homo Sapiens
DTTELQVWD

SEQ ID NO: 866782 - protein, 9 aa, Homo Sapiens
EKEECNGLE

SEQ ID NO: 866783 - protein, 9 aa, Homo Sapiens
LPCHNFAPA

SEQ ID NO: 866784 - protein, 9 aa, Homo Sapiens
SFYQTLITL

SEQ ID NO: 866785 - protein, 9 aa, Homo Sapiens
VNKVCRVSF

SEQ ID NO: 866786 - protein, 9 aa, Homo Sapiens
SPQTLQSLQ

SEQ ID NO: 866787 - protein, 9 aa, Homo Sapiens
KTTSVSTGN

SEQ ID NO: 866788 - protein, 9 aa, Homo Sapiens
IDKFRGVEL

SEQ ID NO: 866789 - protein, 9 aa, Homo Sapiens
AMHLVLRAG

SEQ ID NO: 866790 - protein, 9 aa, Homo Sapiens
YDPSISVSG

SEQ ID NO: 866791 - protein, 9 aa, Homo Sapiens
NLSTTLSDV

SEQ ID NO: 866792 - protein, 9 aa, Homo Sapiens
EFIETELSS

SEQ ID NO: 866793 - protein, 9 aa, Homo Sapiens
KKRRWAQGE

SEQ ID NO: 866794 - protein, 9 aa, Homo Sapiens
PKTFSPSPP

SEQ ID NO: 866795 - protein, 9 aa, Homo Sapiens
SFSYSNLFQ

SEQ ID NO: 866796 - protein, 9 aa, Homo Sapiens
KTHNKHLAG

SEQ ID NO: 866797 - protein, 9 aa, Homo Sapiens
CKKRRLHPP

SEQ ID NO: 866798 - protein, 9 aa, Homo Sapiens
LGQPPNHPN

SEQ ID NO: 866799 - protein, 9 aa, Homo Sapiens
SVAQLERLL

SEQ ID NO: 866800 - protein, 9 aa, Homo Sapiens
HQRCYDELL

SEQ ID NO: 866801 - protein, 9 aa, Homo Sapiens
TTAGRDHLL

SEQ ID NO: 866802 - protein, 9 aa, Homo Sapiens
KTIVKAKDQ

SEQ ID NO: 866803 - protein, 9 aa, Homo Sapiens
LHRVGHYLK

SEQ ID NO: 866804 - protein, 9 aa, Homo Sapiens
TFEQLCSLM

SEQ ID NO: 866805 - protein, 9 aa, Homo Sapiens
LQSQKDSDD

SEQ ID NO: 866806 - protein, 9 aa, Homo Sapiens
AYFHSGINI

SEQ ID NO: 866807 - protein, 9 aa, Homo Sapiens
FDCKELMNP

SEQ ID NO: 866808 - protein, 9 aa, Homo Sapiens
PQIQSIKVQ

SEQ ID NO: 866809 - protein, 9 aa, Homo Sapiens
DDQCEKQKL

SEQ ID NO: 866810 - protein, 9 aa, Homo Sapiens
FKRTQNNLG

SEQ ID NO: 866811 - protein, 9 aa, Homo Sapiens
AVLELDKRI

SEQ ID NO: 866812 - protein, 9 aa, Homo Sapiens
LVDHINQTP

SEQ ID NO: 866813 - protein, 9 aa, Homo Sapiens
IDVLLWASE

SEQ ID NO: 866814 - protein, 9 aa, Homo Sapiens
RVVLNQHNS

SEQ ID NO: 866815 - protein, 9 aa, Homo Sapiens
IQDFWDNSI

SEQ ID NO: 866816 - protein, 9 aa, Homo Sapiens
MAKKISTIK

SEQ ID NO: 866817 - protein, 9 aa, Homo Sapiens
DVFIKLQVL

SEQ ID NO: 866818 - protein, 9 aa, Homo Sapiens
MLYHKHLRK

SEQ ID NO: 866819 - protein, 9 aa, Homo Sapiens
LSVQLALII

SEQ ID NO: 866820 - protein, 9 aa, Homo Sapiens
QSYPEGDDT

SEQ ID NO: 866821 - protein, 9 aa, Homo Sapiens
QELSLSEKN

SEQ ID NO: 866822 - protein, 9 aa, Homo Sapiens
SDNLVIHAP

SEQ ID NO: 866823 - protein, 9 aa, Homo Sapiens
FLQLALSPQ

SEQ ID NO: 866824 - protein, 9 aa, Homo Sapiens
TAQPLLGSC

SEQ ID NO: 866825 - protein, 9 aa, Homo Sapiens
VFDSRFTER

SEQ ID NO: 866826 - protein, 9 aa, Homo Sapiens
REQEERLLK

SEQ ID NO: 866827 - protein, 9 aa, Homo Sapiens
QSISASSAR

SEQ ID NO: 866828 - protein, 9 aa, Homo Sapiens
SQMIEHIDA

SEQ ID NO: 866829 - protein, 9 aa, Homo Sapiens
LVDILSFLF

SEQ ID NO: 866830 - protein, 9 aa, Homo Sapiens
LLKELDNLE

SEQ ID NO: 866831 - protein, 9 aa, Homo Sapiens
LVALFISLP

SEQ ID NO: 866832 - protein, 9 aa, Homo Sapiens
CDKHYYGEG

SEQ ID NO: 866833 - protein, 9 aa, Homo Sapiens
FSYSASGQE

SEQ ID NO: 866834 - protein, 9 aa, Homo Sapiens
IVEWKPFNI

SEQ ID NO: 866835 - protein, 9 aa, Homo Sapiens
SLWCPLWSQ

SEQ ID NO: 866836 - protein, 9 aa, Homo Sapiens
SLTADSQKS

SEQ ID NO: 866837 - protein, 9 aa, Homo Sapiens
CGAGADSEL

SEQ ID NO: 866838 - protein, 9 aa, Homo Sapiens
YVNNQLSGT

SEQ ID NO: 866839 - protein, 9 aa, Homo Sapiens
LVTLVFLFL

SEQ ID NO: 866840 - protein, 9 aa, Homo Sapiens
NRSPCMQYR

SEQ ID NO: 866841 - protein, 9 aa, Homo Sapiens
VHHTYPQDP

SEQ ID NO: 866842 - protein, 9 aa, Homo Sapiens
KSLCILNIN

SEQ ID NO: 866843 - protein, 9 aa, Homo Sapiens
NATKLYCFY

SEQ ID NO: 866844 - protein, 9 aa, Homo Sapiens
HKEIQDLEE

SEQ ID NO: 866845 - protein, 9 aa, Homo Sapiens
ICLSLVSPA

SEQ ID NO: 866846 - protein, 9 aa, Homo Sapiens
NQREKDCPG

SEQ ID NO: 866847 - protein, 9 aa, Homo Sapiens
AMGLICMIT

SEQ ID NO: 866848 - protein, 9 aa, Homo Sapiens
IDPVEDRNV

SEQ ID NO: 866849 - protein, 9 aa, Homo Sapiens
RTCECLVKE

SEQ ID NO: 866850 - protein, 9 aa, Homo Sapiens
PKFNSVGKL

SEQ ID NO: 866851 - protein, 9 aa, Homo Sapiens
SAPKVEANV

SEQ ID NO: 866852 - protein, 9 aa, Homo Sapiens
TCPVCIQKF

SEQ ID NO: 866853 - protein, 9 aa, Homo Sapiens
SVELQNMFG

SEQ ID NO: 866854 - protein, 9 aa, Homo Sapiens
KYFKKQLAL

SEQ ID NO: 866855 - protein, 9 aa, Homo Sapiens
KPRRLCTLP

SEQ ID NO: 866856 - protein, 9 aa, Homo Sapiens
IEGNFLGQM

SEQ ID NO: 866857 - protein, 9 aa, Homo Sapiens
LTDIFLCYI

SEQ ID NO: 866858 - protein, 9 aa, Homo Sapiens
DQLHEGAKV

SEQ ID NO: 866859 - protein, 9 aa, Homo Sapiens
WSPSAWQMA

SEQ ID NO: 866860 - protein, 9 aa, Homo Sapiens
ESEHKPPPY

SEQ ID NO: 866861 - protein, 9 aa, Homo Sapiens
CSATAHPAP

SEQ ID NO: 866862 - protein, 9 aa, Homo Sapiens
NFQGRQAEF

SEQ ID NO: 866863 - protein, 9 aa, Homo Sapiens
DSKKRIQMD

SEQ ID NO: 866864 - protein, 9 aa, Homo Sapiens
NHICNLFDF

SEQ ID NO: 866865 - protein, 9 aa, Homo Sapiens
HTAEKSHKP

SEQ ID NO: 866866 - protein, 9 aa, Homo Sapiens
HINQTPGFS

SEQ ID NO: 866867 - protein, 9 aa, Homo Sapiens
LLDVLCKMT

SEQ ID NO: 866868 - protein, 9 aa, Homo Sapiens
VFDIILMTN

SEQ ID NO: 866869 - protein, 9 aa, Homo Sapiens
DYDKVKTMS

SEQ ID NO: 866870 - protein, 9 aa, Homo Sapiens
QIATATQSN

SEQ ID NO: 866871 - protein, 9 aa, Homo Sapiens
VSLTADSQK

SEQ ID NO: 866872 - protein, 9 aa, Homo Sapiens
MEGMARSDL

SEQ ID NO: 866873 - protein, 9 aa, Homo Sapiens
SVQIIRDWL

SEQ ID NO: 866874 - protein, 9 aa, Homo Sapiens
KRVPQTGWV

SEQ ID NO: 866875 - protein, 9 aa, Homo Sapiens
QDSKMSFKD

SEQ ID NO: 866876 - protein, 9 aa, Homo Sapiens
GRDYAFAKA

SEQ ID NO: 866877 - protein, 9 aa, Homo Sapiens
IKESHHCGE

SEQ ID NO: 866878 - protein, 9 aa, Homo Sapiens
TNKAYLDIF

SEQ ID NO: 866879 - protein, 9 aa, Homo Sapiens
EVKGYWSSL

SEQ ID NO: 866880 - protein, 9 aa, Homo Sapiens
LCPPGFLRR

SEQ ID NO: 866881 - protein, 9 aa, Homo Sapiens
IEEELERTV

SEQ ID NO: 866882 - protein, 9 aa, Homo Sapiens
LFFLKDLFT

SEQ ID NO: 866883 - protein, 9 aa, Homo Sapiens
SGNAGGFHS

SEQ ID NO: 866884 - protein, 9 aa, Homo Sapiens
RDTRLIMQQ

SEQ ID NO: 866885 - protein, 9 aa, Homo Sapiens
AALNLPKTT

SEQ ID NO: 866886 - protein, 9 aa, Homo Sapiens
LVLILIITL

SEQ ID NO: 866887 - protein, 9 aa, Homo Sapiens
RPKNIDVGN

SEQ ID NO: 866888 - protein, 9 aa, Homo Sapiens
SVTGIPREP

SEQ ID NO: 866889 - protein, 9 aa, Homo Sapiens
VALEQAGCL

SEQ ID NO: 866890 - protein, 9 aa, Homo Sapiens
IQNGIDILV

SEQ ID NO: 866891 - protein, 9 aa, Homo Sapiens
LMNYFSLAP

SEQ ID NO: 866892 - protein, 9 aa, Homo Sapiens
GICSFADAQ

SEQ ID NO: 866893 - protein, 9 aa, Homo Sapiens
YERLWPIHN

SEQ ID NO: 866894 - protein, 9 aa, Homo Sapiens
EKGSIKSLR

SEQ ID NO: 866895 - protein, 9 aa, Homo Sapiens
SNLGYLQAR

SEQ ID NO: 866896 - protein, 9 aa, Homo Sapiens
SSAVSDCGH

SEQ ID NO: 866897 - protein, 9 aa, Homo Sapiens
RRSSVKRTH

SEQ ID NO: 866898 - protein, 9 aa, Homo Sapiens
AKARITSSV

SEQ ID NO: 866899 - protein, 9 aa, Homo Sapiens
DINKSLVKQ

SEQ ID NO: 866900 - protein, 9 aa, Homo Sapiens
QDLNKKARA

SEQ ID NO: 866901 - protein, 9 aa, Homo Sapiens
FIQAAAAVC

SEQ ID NO: 866902 - protein, 9 aa, Homo Sapiens
LKLQSQKDS

SEQ ID NO: 866903 - protein, 9 aa, Homo Sapiens
APGGKSRRC

SEQ ID NO: 866904 - protein, 9 aa, Homo Sapiens
VQSELERIF

SEQ ID NO: 866905 - protein, 9 aa, Homo Sapiens
VKRIWSTVD

SEQ ID NO: 866906 - protein, 9 aa, Homo Sapiens
NPLENVYSD

SEQ ID NO: 866907 - protein, 9 aa, Homo Sapiens
SANPLLETF

SEQ ID NO: 866908 - protein, 9 aa, Homo Sapiens
SETKSQFDK

SEQ ID NO: 866909 - protein, 9 aa, Homo Sapiens
EGHKLPNEL

SEQ ID NO: 866910 - protein, 9 aa, Homo Sapiens
PYQPLWEVL

SEQ ID NO: 866911 - protein, 9 aa, Homo Sapiens
SLPIHKLGS

SEQ ID NO: 866912 - protein, 9 aa, Homo Sapiens
TTHKHHCRH

SEQ ID NO: 866913 - protein, 9 aa, Homo Sapiens
QKKYPQPLN

SEQ ID NO: 866914 - protein, 9 aa, Homo Sapiens
PSTLTTPGL

SEQ ID NO: 866915 - protein, 9 aa, Homo Sapiens
RYFHKVCDG

SEQ ID NO: 866916 - protein, 9 aa, Homo Sapiens
LELKENFIR

SEQ ID NO: 866917 - protein, 9 aa, Homo Sapiens
STNLTAHKI

SEQ ID NO: 866918 - protein, 9 aa, Homo Sapiens
RRKELEENM

SEQ ID NO: 866919 - protein, 9 aa, Homo Sapiens
MFMSMQSLN

SEQ ID NO: 866920 - protein, 9 aa, Homo Sapiens
QKISFGKLK

SEQ ID NO: 866921 - protein, 9 aa, Homo Sapiens
NEFQSLILV

SEQ ID NO: 866922 - protein, 9 aa, Homo Sapiens
YFIAGIVFW

SEQ ID NO: 866923 - protein, 9 aa, Homo Sapiens
AKIESLGIT

SEQ ID NO: 866924 - protein, 9 aa, Homo Sapiens
RAVYKDANL

SEQ ID NO: 866925 - protein, 9 aa, Homo Sapiens
NKLKTLEEL

SEQ ID NO: 866926 - protein, 9 aa, Homo Sapiens
QNNLGNWKE

SEQ ID NO: 866927 - protein, 9 aa, Homo Sapiens
INYFMYTMN

SEQ ID NO: 866928 - protein, 9 aa, Homo Sapiens
ELWRAMGPA

SEQ ID NO: 866929 - protein, 9 aa, Homo Sapiens
LEDAMEEVC

SEQ ID NO: 866930 - protein, 9 aa, Homo Sapiens
RKGRHKEIQ

SEQ ID NO: 866931 - protein, 9 aa, Homo Sapiens
LNEILNLHG

SEQ ID NO: 866932 - protein, 9 aa, Homo Sapiens
AADDYTSSE

SEQ ID NO: 866933 - protein, 9 aa, Homo Sapiens
TEQSTAARL

SEQ ID NO: 866934 - protein, 9 aa, Homo Sapiens
PKLGQSIAC

SEQ ID NO: 866935 - protein, 9 aa, Homo Sapiens
KIQVDSEEP

SEQ ID NO: 866936 - protein, 9 aa, Homo Sapiens
LTSQISTSL

SEQ ID NO: 866937 - protein, 9 aa, Homo Sapiens
DAYKCTFIV

SEQ ID NO: 866938 - protein, 9 aa, Homo Sapiens
KNINFSRLR

SEQ ID NO: 866939 - protein, 9 aa, Homo Sapiens
SMRNLYIKN

SEQ ID NO: 866940 - protein, 9 aa, Homo Sapiens
TQEELSALR

SEQ ID NO: 866941 - protein, 9 aa, Homo Sapiens
WVFAQMVQL

SEQ ID NO: 866942 - protein, 9 aa, Homo Sapiens
ARVQVVAGN

SEQ ID NO: 866943 - protein, 9 aa, Homo Sapiens
TAIQELFKH

SEQ ID NO: 866944 - protein, 9 aa, Homo Sapiens
KQMRKAVNR

SEQ ID NO: 866945 - protein, 9 aa, Homo Sapiens
GGRIMCRGT

SEQ ID NO: 866946 - protein, 9 aa, Homo Sapiens
EEEENTCKT

SEQ ID NO: 866947 - protein, 9 aa, Homo Sapiens
KAKIESLGI

SEQ ID NO: 866948 - protein, 9 aa, Homo Sapiens
CKLADQCTG

SEQ ID NO: 866949 - protein, 9 aa, Homo Sapiens
QILQMSYQY

SEQ ID NO: 866950 - protein, 9 aa, Homo Sapiens
GEEGVPGKW

SEQ ID NO: 866951 - protein, 9 aa, Homo Sapiens
PLNRRAIHD

SEQ ID NO: 866952 - protein, 9 aa, Homo Sapiens
FVITLDSIL

SEQ ID NO: 866953 - protein, 9 aa, Homo Sapiens
NITQRMWNQ

SEQ ID NO: 866954 - protein, 9 aa, Homo Sapiens
RDQYDEEAR

SEQ ID NO: 866955 - protein, 9 aa, Homo Sapiens
EQPSLLASM

SEQ ID NO: 866956 - protein, 9 aa, Homo Sapiens
FTQLINLST

SEQ ID NO: 866957 - protein, 9 aa, Homo Sapiens
SLFLLDQNN

SEQ ID NO: 866958 - protein, 9 aa, Homo Sapiens
LVCAFIILL

SEQ ID NO: 866959 - protein, 9 aa, Homo Sapiens
DKGWGQPQI

SEQ ID NO: 866960 - protein, 9 aa, Homo Sapiens
VYTGEKPYE

SEQ ID NO: 866961 - protein, 9 aa, Homo Sapiens
TMTLLDVFE

SEQ ID NO: 866962 - protein, 9 aa, Homo Sapiens
ERFIFPAPD

SEQ ID NO: 866963 - protein, 9 aa, Homo Sapiens
MLKATEVMM

SEQ ID NO: 866964 - protein, 9 aa, Homo Sapiens
RLGEQLQMD

SEQ ID NO: 866965 - protein, 9 aa, Homo Sapiens
GLAVSDACT

SEQ ID NO: 866966 - protein, 9 aa, Homo Sapiens
LGKAHEITY

SEQ ID NO: 866967 - protein, 9 aa, Homo Sapiens
PFGLSPLID

SEQ ID NO: 866968 - protein, 9 aa, Homo Sapiens
FEVFDKNRL

SEQ ID NO: 866969 - protein, 9 aa, Homo Sapiens
SNIKSIIAI

SEQ ID NO: 866970 - protein, 9 aa, Homo Sapiens
IGIKQGEKH

SEQ ID NO: 866971 - protein, 9 aa, Homo Sapiens
DLEIDKLET

SEQ ID NO: 866972 - protein, 9 aa, Homo Sapiens
LRVDQITWI

SEQ ID NO: 866973 - protein, 9 aa, Homo Sapiens
SEVDKIVVT

SEQ ID NO: 866974 - protein, 9 aa, Homo Sapiens
CGLKRLHIN

SEQ ID NO: 866975 - protein, 9 aa, Homo Sapiens
QKHHYDHQE

SEQ ID NO: 866976 - protein, 9 aa, Homo Sapiens
ALALTFLPA

SEQ ID NO: 866977 - protein, 9 aa, Homo Sapiens
SILDYLETV

SEQ ID NO: 866978 - protein, 9 aa, Homo Sapiens
DYKGAPWNC

SEQ ID NO: 866979 - protein, 9 aa, Homo Sapiens
KQTFSEPGD

SEQ ID NO: 866980 - protein, 9 aa, Homo Sapiens
MLRRHIFFF

SEQ ID NO: 866981 - protein, 9 aa, Homo Sapiens
GINCNEKPT

SEQ ID NO: 866982 - protein, 9 aa, Homo Sapiens
SYLRCCLMK

SEQ ID NO: 866983 - protein, 9 aa, Homo Sapiens
EARKITSFQ

SEQ ID NO: 866984 - protein, 9 aa, Homo Sapiens
QHSNRYLYA

SEQ ID NO: 866985 - protein, 9 aa, Homo Sapiens
HKPCRPLHQ

SEQ ID NO: 866986 - protein, 9 aa, Homo Sapiens
TNNSDYAIT

SEQ ID NO: 866987 - protein, 9 aa, Homo Sapiens
TEHLWLTRH

SEQ ID NO: 866988 - protein, 9 aa, Homo Sapiens
FFPQEQKAQ

SEQ ID NO: 866989 - protein, 9 aa, Homo Sapiens
ETIVVGMPN

SEQ ID NO: 866990 - protein, 9 aa, Homo Sapiens
CVFENEDNT

SEQ ID NO: 866991 - protein, 9 aa, Homo Sapiens
AQQMNQKNF

SEQ ID NO: 866992 - protein, 9 aa, Homo Sapiens
RRQTPRIDP

SEQ ID NO: 866993 - protein, 9 aa, Homo Sapiens
FDMKPFKDA

SEQ ID NO: 866994 - protein, 9 aa, Homo Sapiens
FSPGAQSQY

SEQ ID NO: 866995 - protein, 9 aa, Homo Sapiens
NSVWIGQLM

SEQ ID NO: 866996 - protein, 9 aa, Homo Sapiens
YERDCRRHF

SEQ ID NO: 866997 - protein, 9 aa, Homo Sapiens
EKRMLKATE

SEQ ID NO: 866998 - protein, 9 aa, Homo Sapiens
EIKQVNERV

SEQ ID NO: 866999 - protein, 9 aa, Homo Sapiens
REEAAQRGS

SEQ ID NO: 867000 - protein, 9 aa, Homo Sapiens
LFAELDKVM

SEQ ID NO: 867001 - protein, 9 aa, Homo Sapiens
QEPVPEAVG

SEQ ID NO: 867002 - protein, 9 aa, Homo Sapiens
ITSSVVDFK

SEQ ID NO: 867003 - protein, 9 aa, Homo Sapiens
YLWRGLAER

SEQ ID NO: 867004 - protein, 9 aa, Homo Sapiens
PTKPLVCRA

SEQ ID NO: 867005 - protein, 9 aa, Homo Sapiens
PDGSDDAGC

SEQ ID NO: 867006 - protein, 9 aa, Homo Sapiens
QGASHFDKL

SEQ ID NO: 867007 - protein, 9 aa, Homo Sapiens
GLSSIFLPQ

SEQ ID NO: 867008 - protein, 9 aa, Homo Sapiens
QPHPRIKPS

SEQ ID NO: 867009 - protein, 9 aa, Homo Sapiens
RPHQQELCG

SEQ ID NO: 867010 - protein, 9 aa, Homo Sapiens
EDKITDPKK

SEQ ID NO: 867011 - protein, 9 aa, Homo Sapiens
KLEEAEIKS

SEQ ID NO: 867012 - protein, 9 aa, Homo Sapiens
CLKQLQLRH

SEQ ID NO: 867013 - protein, 9 aa, Homo Sapiens
LDYHNQVWG

SEQ ID NO: 867014 - protein, 9 aa, Homo Sapiens
YLGTNAQIT

SEQ ID NO: 867015 - protein, 9 aa, Homo Sapiens
EIIVEDIDK

SEQ ID NO: 867016 - protein, 9 aa, Homo Sapiens
NTIEQLREA

SEQ ID NO: 867017 - protein, 9 aa, Homo Sapiens
MAAPAFKPG

SEQ ID NO: 867018 - protein, 9 aa, Homo Sapiens
DSMCKRNQV

SEQ ID NO: 867019 - protein, 9 aa, Homo Sapiens
GRIELSEFI

SEQ ID NO: 867020 - protein, 9 aa, Homo Sapiens
PKKTQIISH

SEQ ID NO: 867021 - protein, 9 aa, Homo Sapiens
EPDDFNSNT

SEQ ID NO: 867022 - protein, 9 aa, Homo Sapiens
HVLLKNNLT

SEQ ID NO: 867023 - protein, 9 aa, Homo Sapiens
TQHQVFHTG

SEQ ID NO: 867024 - protein, 9 aa, Homo Sapiens
YKIKKEELK

SEQ ID NO: 867025 - protein, 9 aa, Homo Sapiens
ITLVRGSGK

SEQ ID NO: 867026 - protein, 9 aa, Homo Sapiens
GSIISFNSL

SEQ ID NO: 867027 - protein, 9 aa, Homo Sapiens
IWDNHIDEP

SEQ ID NO: 867028 - protein, 9 aa, Homo Sapiens
FKLHYQLTE

SEQ ID NO: 867029 - protein, 9 aa, Homo Sapiens
IHYITRHIM

SEQ ID NO: 867030 - protein, 9 aa, Homo Sapiens
THYLHQRPL

SEQ ID NO: 867031 - protein, 9 aa, Homo Sapiens
LQNTLQTTI

SEQ ID NO: 867032 - protein, 9 aa, Homo Sapiens
THNCGHHKD

SEQ ID NO: 867033 - protein, 9 aa, Homo Sapiens
KSPLPDEID

SEQ ID NO: 867034 - protein, 9 aa, Homo Sapiens
HIYNKCKIK

SEQ ID NO: 867035 - protein, 9 aa, Homo Sapiens
MLWALLDQQ

SEQ ID NO: 867036 - protein, 9 aa, Homo Sapiens
WFTALVKCL

SEQ ID NO: 867037 - protein, 9 aa, Homo Sapiens
KEKEGANFI

SEQ ID NO: 867038 - protein, 9 aa, Homo Sapiens
IENSDSEEI

SEQ ID NO: 867039 - protein, 9 aa, Homo Sapiens
KEISNTIEQ

SEQ ID NO: 867040 - protein, 9 aa, Homo Sapiens
KSNFFHFIL

SEQ ID NO: 867041 - protein, 9 aa, Homo Sapiens
QCAIRIACI

SEQ ID NO: 867042 - protein, 9 aa, Homo Sapiens
QNAKWLTVE

SEQ ID NO: 867043 - protein, 9 aa, Homo Sapiens
VRTTDEELC

SEQ ID NO: 867044 - protein, 9 aa, Homo Sapiens
SDCVKELCE

SEQ ID NO: 867045 - protein, 9 aa, Homo Sapiens
RAFSICFTD

SEQ ID NO: 867046 - protein, 9 aa, Homo Sapiens
QRCIEKVAK

SEQ ID NO: 867047 - protein, 9 aa, Homo Sapiens
HYGFLLPAR

SEQ ID NO: 867048 - protein, 9 aa, Homo Sapiens
TRKRGEGGR

SEQ ID NO: 867049 - protein, 9 aa, Homo Sapiens
LLVTDNAID

SEQ ID NO: 867050 - protein, 9 aa, Homo Sapiens
PSLIHSLNL

SEQ ID NO: 867051 - protein, 9 aa, Homo Sapiens
TFFRYLGDK

SEQ ID NO: 867052 - protein, 9 aa, Homo Sapiens
IEVNTIINS

SEQ ID NO: 867053 - protein, 9 aa, Homo Sapiens
KTINQREKD

SEQ ID NO: 867054 - protein, 9 aa, Homo Sapiens
EAATGQEVK

SEQ ID NO: 867055 - protein, 9 aa, Homo Sapiens
IDYYNTIID

SEQ ID NO: 867056 - protein, 9 aa, Homo Sapiens
GNSNKKKKA

SEQ ID NO: 867057 - protein, 9 aa, Homo Sapiens
KPANMLVMG

SEQ ID NO: 867058 - protein, 9 aa, Homo Sapiens
IDHRGKVLS

SEQ ID NO: 867059 - protein, 9 aa, Homo Sapiens
KFLPMSYPQ

SEQ ID NO: 867060 - protein, 9 aa, Homo Sapiens
QENNGDNAT

SEQ ID NO: 867061 - protein, 9 aa, Homo Sapiens
AICKHYGEA

SEQ ID NO: 867062 - protein, 9 aa, Homo Sapiens
KVYLQRNMG

SEQ ID NO: 867063 - protein, 9 aa, Homo Sapiens
KPPNYNVAL

SEQ ID NO: 867064 - protein, 9 aa, Homo Sapiens
SEHKPPPYK

SEQ ID NO: 867065 - protein, 9 aa, Homo Sapiens
PVCGKRFRK

SEQ ID NO: 867066 - protein, 9 aa, Homo Sapiens
ITHSGEKPY

SEQ ID NO: 867067 - protein, 9 aa, Homo Sapiens
RGQNTLPAQ

SEQ ID NO: 867068 - protein, 9 aa, Homo Sapiens
QIIHTKEEF

SEQ ID NO: 867069 - protein, 9 aa, Homo Sapiens
KQKQMKYSA

SEQ ID NO: 867070 - protein, 9 aa, Homo Sapiens
TSARNCYPP

SEQ ID NO: 867071 - protein, 9 aa, Homo Sapiens
GSLHEKGNR

SEQ ID NO: 867072 - protein, 9 aa, Homo Sapiens
GQGAPFIPI

SEQ ID NO: 867073 - protein, 9 aa, Homo Sapiens
NKHKIVHTG

SEQ ID NO: 867074 - protein, 9 aa, Homo Sapiens
EGRVDEEIV

SEQ ID NO: 867075 - protein, 9 aa, Homo Sapiens
SKSFFMLLH

SEQ ID NO: 867076 - protein, 9 aa, Homo Sapiens
DNGEVPEDL

SEQ ID NO: 867077 - protein, 9 aa, Homo Sapiens
PITANLVAP

SEQ ID NO: 867078 - protein, 9 aa, Homo Sapiens
SEDSSSPEI

SEQ ID NO: 867079 - protein, 9 aa, Homo Sapiens
FLIIQNAVV

SEQ ID NO: 867080 - protein, 9 aa, Homo Sapiens
HISQEAFQI

SEQ ID NO: 867081 - protein, 9 aa, Homo Sapiens
YYGERHLDD

SEQ ID NO: 867082 - protein, 9 aa, Homo Sapiens
APEDKGRVA

SEQ ID NO: 867083 - protein, 9 aa, Homo Sapiens
SHFQAGVSK

SEQ ID NO: 867084 - protein, 9 aa, Homo Sapiens
QIEIIDQLF

SEQ ID NO: 867085 - protein, 9 aa, Homo Sapiens
CTQHVFRGQ

SEQ ID NO: 867086 - protein, 9 aa, Homo Sapiens
QLQEIWRLH

SEQ ID NO: 867087 - protein, 9 aa, Homo Sapiens
AQLWDHSTL

SEQ ID NO: 867088 - protein, 9 aa, Homo Sapiens
GFYNSHSLD

SEQ ID NO: 867089 - protein, 9 aa, Homo Sapiens
VTIVFRGPN

SEQ ID NO: 867090 - protein, 9 aa, Homo Sapiens
KLLAYTNSA

SEQ ID NO: 867091 - protein, 9 aa, Homo Sapiens
WLLVVIGVL

SEQ ID NO: 867092 - protein, 9 aa, Homo Sapiens
KIKDTEDED

SEQ ID NO: 867093 - protein, 9 aa, Homo Sapiens
VSLIIDIKC

SEQ ID NO: 867094 - protein, 9 aa, Homo Sapiens
RTGTEHLWL

SEQ ID NO: 867095 - protein, 9 aa, Homo Sapiens
KAGPETPGK

SEQ ID NO: 867096 - protein, 9 aa, Homo Sapiens
QDNTAGVYA

SEQ ID NO: 867097 - protein, 9 aa, Homo Sapiens
LHYQNQRFR

SEQ ID NO: 867098 - protein, 9 aa, Homo Sapiens
GDLTHRVAN

SEQ ID NO: 867099 - protein, 9 aa, Homo Sapiens
KTVVEEIDH

SEQ ID NO: 867100 - protein, 9 aa, Homo Sapiens
IFTPSYVKK

SEQ ID NO: 867101 - protein, 9 aa, Homo Sapiens
SVAEITFNT

SEQ ID NO: 867102 - protein, 9 aa, Homo Sapiens
KTTKSKITA

SEQ ID NO: 867103 - protein, 9 aa, Homo Sapiens
YFYRNPEEI

SEQ ID NO: 867104 - protein, 9 aa, Homo Sapiens
LGDSTVGKS

SEQ ID NO: 867105 - protein, 9 aa, Homo Sapiens
MYGKQNIYF

SEQ ID NO: 867106 - protein, 9 aa, Homo Sapiens
SVCSCVFFR

SEQ ID NO: 867107 - protein, 9 aa, Homo Sapiens
LGTAFQTWM

SEQ ID NO: 867108 - protein, 9 aa, Homo Sapiens
CEQNLNHNA

SEQ ID NO: 867109 - protein, 9 aa, Homo Sapiens
IEEKKLRRN

SEQ ID NO: 867110 - protein, 9 aa, Homo Sapiens
FNISYDPHD

SEQ ID NO: 867111 - protein, 9 aa, Homo Sapiens
LRNLTADYL

SEQ ID NO: 867112 - protein, 9 aa, Homo Sapiens
MGCFQNQKF

SEQ ID NO: 867113 - protein, 9 aa, Homo Sapiens
GKLTQEKEY

SEQ ID NO: 867114 - protein, 9 aa, Homo Sapiens
QSNEQPSLL

SEQ ID NO: 867115 - protein, 9 aa, Homo Sapiens
KDWRKDMTN

SEQ ID NO: 867116 - protein, 9 aa, Homo Sapiens
LSNIEDILE

SEQ ID NO: 867117 - protein, 9 aa, Homo Sapiens
IQIWLADGG

SEQ ID NO: 867118 - protein, 9 aa, Homo Sapiens
AGNNSWWIP

SEQ ID NO: 867119 - protein, 9 aa, Homo Sapiens
FSSGFIKAV

SEQ ID NO: 867120 - protein, 9 aa, Homo Sapiens
ISPSLPPAS

SEQ ID NO: 867121 - protein, 9 aa, Homo Sapiens
SKEQKELFA

SEQ ID NO: 867122 - protein, 9 aa, Homo Sapiens
RGMDLVDIL

SEQ ID NO: 867123 - protein, 9 aa, Homo Sapiens
QVWQNENEQ

SEQ ID NO: 867124 - protein, 9 aa, Homo Sapiens
DRFSSRRPQ

SEQ ID NO: 867125 - protein, 9 aa, Homo Sapiens
CNQRQKQKI

SEQ ID NO: 867126 - protein, 9 aa, Homo Sapiens
QSLKNKLGQ

SEQ ID NO: 867127 - protein, 9 aa, Homo Sapiens
GVTQLSILS

SEQ ID NO: 867128 - protein, 9 aa, Homo Sapiens
TSKQGGCCS

SEQ ID NO: 867129 - protein, 9 aa, Homo Sapiens
ERWHYRPTG

SEQ ID NO: 867130 - protein, 9 aa, Homo Sapiens
VMVFQTKQK

SEQ ID NO: 867131 - protein, 9 aa, Homo Sapiens
ALCRHKKAH

SEQ ID NO: 867132 - protein, 9 aa, Homo Sapiens
KNGAGSLVI

SEQ ID NO: 867133 - protein, 9 aa, Homo Sapiens
LHWRDRVQW

SEQ ID NO: 867134 - protein, 9 aa, Homo Sapiens
QTFYGLHQD

SEQ ID NO: 867135 - protein, 9 aa, Homo Sapiens
ADLSLLDHL

SEQ ID NO: 867136 - protein, 9 aa, Homo Sapiens
IYKQTAEAV

SEQ ID NO: 867137 - protein, 9 aa, Homo Sapiens
GPKEEKVAT

SEQ ID NO: 867138 - protein, 9 aa, Homo Sapiens
YFDVCADAV

SEQ ID NO: 867139 - protein, 9 aa, Homo Sapiens
IIKAKEYCR

SEQ ID NO: 867140 - protein, 9 aa, Homo Sapiens
LTLNYVQER

SEQ ID NO: 867141 - protein, 9 aa, Homo Sapiens
TLCSLISSS

SEQ ID NO: 867142 - protein, 9 aa, Homo Sapiens
DIYDKENIT

SEQ ID NO: 867143 - protein, 9 aa, Homo Sapiens
TTAAAATKV

SEQ ID NO: 867144 - protein, 9 aa, Homo Sapiens
AFHITNDES

SEQ ID NO: 867145 - protein, 9 aa, Homo Sapiens
DTAVDFSQE

SEQ ID NO: 867146 - protein, 9 aa, Homo Sapiens
FCQEMIATQ

SEQ ID NO: 867147 - protein, 9 aa, Homo Sapiens
VVAKVRAVN

SEQ ID NO: 867148 - protein, 9 aa, Homo Sapiens
KVVNKESLA

SEQ ID NO: 867149 - protein, 9 aa, Homo Sapiens
VLLALFCHK

SEQ ID NO: 867150 - protein, 9 aa, Homo Sapiens
CYLFLAELF

SEQ ID NO: 867151 - protein, 9 aa, Homo Sapiens
VHKIIHNRW

SEQ ID NO: 867152 - protein, 9 aa, Homo Sapiens
LDISLIENK

SEQ ID NO: 867153 - protein, 9 aa, Homo Sapiens
LVDHKVHFT

SEQ ID NO: 867154 - protein, 9 aa, Homo Sapiens
ARTIQKAWW

SEQ ID NO: 867155 - protein, 9 aa, Homo Sapiens
GAYHTDDCH

SEQ ID NO: 867156 - protein, 9 aa, Homo Sapiens
QTWIANEKY

SEQ ID NO: 867157 - protein, 9 aa, Homo Sapiens
SDCSPMQDK

SEQ ID NO: 867158 - protein, 9 aa, Homo Sapiens
PESFGQVTI

SEQ ID NO: 867159 - protein, 9 aa, Homo Sapiens
DSGVAVAPR

SEQ ID NO: 867160 - protein, 9 aa, Homo Sapiens
KYVFCMQKY

SEQ ID NO: 867161 - protein, 9 aa, Homo Sapiens
IITKKTSSF

SEQ ID NO: 867162 - protein, 9 aa, Homo Sapiens
KEDFKKERS

SEQ ID NO: 867163 - protein, 9 aa, Homo Sapiens
KDFLDLIFQ

SEQ ID NO: 867164 - protein, 9 aa, Homo Sapiens
KKLLLCLKH

SEQ ID NO: 867165 - protein, 9 aa, Homo Sapiens
SDKDDMGRI

SEQ ID NO: 867166 - protein, 9 aa, Homo Sapiens
YENLKFQVW

SEQ ID NO: 867167 - protein, 9 aa, Homo Sapiens
RVLGMMAQT

SEQ ID NO: 867168 - protein, 9 aa, Homo Sapiens
TPRCTQQAA

SEQ ID NO: 867169 - protein, 9 aa, Homo Sapiens
TELVRMEQQ

SEQ ID NO: 867170 - protein, 9 aa, Homo Sapiens
WYRKAKTIN

SEQ ID NO: 867171 - protein, 9 aa, Homo Sapiens
HEITHTGEK

SEQ ID NO: 867172 - protein, 9 aa, Homo Sapiens
IGVLLLLCG

SEQ ID NO: 867173 - protein, 9 aa, Homo Sapiens
DGAHNTFLK

SEQ ID NO: 867174 - protein, 9 aa, Homo Sapiens
NDKGWGQPQ

SEQ ID NO: 867175 - protein, 9 aa, Homo Sapiens
VLTTAKTSV

SEQ ID NO: 867176 - protein, 9 aa, Homo Sapiens
TVKRLLGWK

SEQ ID NO: 867177 - protein, 9 aa, Homo Sapiens
DRICKLADQ

SEQ ID NO: 867178 - protein, 9 aa, Homo Sapiens
WILQFNSQP

SEQ ID NO: 867179 - protein, 9 aa, Homo Sapiens
EAYVWVPIE

SEQ ID NO: 867180 - protein, 9 aa, Homo Sapiens
NCNKYMVTD

SEQ ID NO: 867181 - protein, 9 aa, Homo Sapiens
YVEQRKKIC

SEQ ID NO: 867182 - protein, 9 aa, Homo Sapiens
MDGKICLWR

SEQ ID NO: 867183 - protein, 9 aa, Homo Sapiens
LCKESPDIA

SEQ ID NO: 867184 - protein, 9 aa, Homo Sapiens
EVLTKFRED

SEQ ID NO: 867185 - protein, 9 aa, Homo Sapiens
TQFQLQELD

SEQ ID NO: 867186 - protein, 9 aa, Homo Sapiens
KELPGEPGE

SEQ ID NO: 867187 - protein, 9 aa, Homo Sapiens
YLKVLEKQT

SEQ ID NO: 867188 - protein, 9 aa, Homo Sapiens
KCRNHDYLS

SEQ ID NO: 867189 - protein, 9 aa, Homo Sapiens
AKEKDTMTT

SEQ ID NO: 867190 - protein, 9 aa, Homo Sapiens
FCRWYKNRK

SEQ ID NO: 867191 - protein, 9 aa, Homo Sapiens
PKYKQVHIL

SEQ ID NO: 867192 - protein, 9 aa, Homo Sapiens
SFQQQPLPF

SEQ ID NO: 867193 - protein, 9 aa, Homo Sapiens
IIFCFIEVN

SEQ ID NO: 867194 - protein, 9 aa, Homo Sapiens
FNTSVYSQL

SEQ ID NO: 867195 - protein, 9 aa, Homo Sapiens
ELSVPYKQL

SEQ ID NO: 867196 - protein, 9 aa, Homo Sapiens
EESVLINIL

SEQ ID NO: 867197 - protein, 9 aa, Homo Sapiens
DNTPGQKRE

SEQ ID NO: 867198 - protein, 9 aa, Homo Sapiens
SVKLMPSKD

SEQ ID NO: 867199 - protein, 9 aa, Homo Sapiens
LRCCLMKIE

SEQ ID NO: 867200 - protein, 9 aa, Homo Sapiens
ERQRLIQNA

SEQ ID NO: 867201 - protein, 9 aa, Homo Sapiens
TNSPPDADE

SEQ ID NO: 867202 - protein, 9 aa, Homo Sapiens
SRDAVEDNR

SEQ ID NO: 867203 - protein, 9 aa, Homo Sapiens
SLASTLVNA

SEQ ID NO: 867204 - protein, 9 aa, Homo Sapiens
NQSSNLIHH

SEQ ID NO: 867205 - protein, 9 aa, Homo Sapiens
IHKAQNFVE

SEQ ID NO: 867206 - protein, 9 aa, Homo Sapiens
ALAGQTAFT

SEQ ID NO: 867207 - protein, 9 aa, Homo Sapiens
DQKARSSEV

SEQ ID NO: 867208 - protein, 9 aa, Homo Sapiens
IITCCLLRI

SEQ ID NO: 867209 - protein, 9 aa, Homo Sapiens
SDKYHERPL

SEQ ID NO: 867210 - protein, 9 aa, Homo Sapiens
IGKFCGKQR

SEQ ID NO: 867211 - protein, 9 aa, Homo Sapiens
IRKKKLKFP

SEQ ID NO: 867212 - protein, 9 aa, Homo Sapiens
RIRSKQKET

SEQ ID NO: 867213 - protein, 9 aa, Homo Sapiens
SLAAYDDSD

SEQ ID NO: 867214 - protein, 9 aa, Homo Sapiens
PKLNLLLTA

SEQ ID NO: 867215 - protein, 9 aa, Homo Sapiens
GQQLSGINV

SEQ ID NO: 867216 - protein, 9 aa, Homo Sapiens
RDAGPSGRV

SEQ ID NO: 867217 - protein, 9 aa, Homo Sapiens
YEGHGSHKL

SEQ ID NO: 867218 - protein, 9 aa, Homo Sapiens
QNHMAVAFV

SEQ ID NO: 867219 - protein, 9 aa, Homo Sapiens
RVLDDKEEW

SEQ ID NO: 867220 - protein, 9 aa, Homo Sapiens
SSRPKNIPP

SEQ ID NO: 867221 - protein, 9 aa, Homo Sapiens
TQQQLFCQA

SEQ ID NO: 867222 - protein, 9 aa, Homo Sapiens
CLQKVTEKY

SEQ ID NO: 867223 - protein, 9 aa, Homo Sapiens
KDGQTSGTV

SEQ ID NO: 867224 - protein, 9 aa, Homo Sapiens
DSNIFPVRG

SEQ ID NO: 867225 - protein, 9 aa, Homo Sapiens
ELQEPQFRD

SEQ ID NO: 867226 - protein, 9 aa, Homo Sapiens
YPGLSSYNE

SEQ ID NO: 867227 - protein, 9 aa, Homo Sapiens
FREMGDLTH

SEQ ID NO: 867228 - protein, 9 aa, Homo Sapiens
CPAMGHFAD

SEQ ID NO: 867229 - protein, 9 aa, Homo Sapiens
DAKLERLTA

SEQ ID NO: 867230 - protein, 9 aa, Homo Sapiens
SIAGSLIIN

SEQ ID NO: 867231 - protein, 9 aa, Homo Sapiens
LKQINYSKA

SEQ ID NO: 867232 - protein, 9 aa, Homo Sapiens
DVLSEKKTI

SEQ ID NO: 867233 - protein, 9 aa, Homo Sapiens
EVDKIVVTL

SEQ ID NO: 867234 - protein, 9 aa, Homo Sapiens
QQEFFVDFR

SEQ ID NO: 867235 - protein, 9 aa, Homo Sapiens
ECGTVWDSG

SEQ ID NO: 867236 - protein, 9 aa, Homo Sapiens
DELDMGQSG

SEQ ID NO: 867237 - protein, 9 aa, Homo Sapiens
CQVWKILAI

SEQ ID NO: 867238 - protein, 9 aa, Homo Sapiens
LDFTEFFLM

SEQ ID NO: 867239 - protein, 9 aa, Homo Sapiens
QDHDTNLTC

SEQ ID NO: 867240 - protein, 9 aa, Homo Sapiens
FKLHFWRKI

SEQ ID NO: 867241 - protein, 9 aa, Homo Sapiens
SCIKAKQLL

SEQ ID NO: 867242 - protein, 9 aa, Homo Sapiens
ILWDTISTY

SEQ ID NO: 867243 - protein, 9 aa, Homo Sapiens
DSEFDVFDA

SEQ ID NO: 867244 - protein, 9 aa, Homo Sapiens
DRRMPGKVR

SEQ ID NO: 867245 - protein, 9 aa, Homo Sapiens
SDASHVLEA

SEQ ID NO: 867246 - protein, 9 aa, Homo Sapiens
CPNIAQKRM

SEQ ID NO: 867247 - protein, 9 aa, Homo Sapiens
IYFPPGLCW

SEQ ID NO: 867248 - protein, 9 aa, Homo Sapiens
PFQTLNING

SEQ ID NO: 867249 - protein, 9 aa, Homo Sapiens
YTDKVVAVF

SEQ ID NO: 867250 - protein, 9 aa, Homo Sapiens
VYHFGAIFS

SEQ ID NO: 867251 - protein, 9 aa, Homo Sapiens
LTNIRPIPD

SEQ ID NO: 867252 - protein, 9 aa, Homo Sapiens
KLLITIHDQ

SEQ ID NO: 867253 - protein, 9 aa, Homo Sapiens
GMACGLTTV

SEQ ID NO: 867254 - protein, 9 aa, Homo Sapiens
SRRIDVLLW

SEQ ID NO: 867255 - protein, 9 aa, Homo Sapiens
CKAMQRNWS

SEQ ID NO: 867256 - protein, 9 aa, Homo Sapiens
PSGGCVPDV

SEQ ID NO: 867257 - protein, 9 aa, Homo Sapiens
QFDDFANVN

SEQ ID NO: 867258 - protein, 9 aa, Homo Sapiens
DATSFNHEK

SEQ ID NO: 867259 - protein, 9 aa, Homo Sapiens
EEAWLRHEV

SEQ ID NO: 867260 - protein, 9 aa, Homo Sapiens
LSWFTALVK

SEQ ID NO: 867261 - protein, 9 aa, Homo Sapiens
LLHNLEWLK

SEQ ID NO: 867262 - protein, 9 aa, Homo Sapiens
NASCEEVDG

SEQ ID NO: 867263 - protein, 9 aa, Homo Sapiens
ASSPSLAVT

SEQ ID NO: 867264 - protein, 9 aa, Homo Sapiens
LDEDKQLLY

SEQ ID NO: 867265 - protein, 9 aa, Homo Sapiens
GKLYLREKF

SEQ ID NO: 867266 - protein, 9 aa, Homo Sapiens
RRNQKESGL

SEQ ID NO: 867267 - protein, 9 aa, Homo Sapiens
LVLKVMAAR

SEQ ID NO: 867268 - protein, 9 aa, Homo Sapiens
GRYDLLISQ

SEQ ID NO: 867269 - protein, 9 aa, Homo Sapiens
NRLCSQTVS

SEQ ID NO: 867270 - protein, 9 aa, Homo Sapiens
LKQKENKNE

SEQ ID NO: 867271 - protein, 9 aa, Homo Sapiens
VCGKRFRKS

SEQ ID NO: 867272 - protein, 9 aa, Homo Sapiens
RLECRGGVR

SEQ ID NO: 867273 - protein, 9 aa, Homo Sapiens
THNKHLAGV

SEQ ID NO: 867274 - protein, 9 aa, Homo Sapiens
STKEKISFV

SEQ ID NO: 867275 - protein, 9 aa, Homo Sapiens
NMTRVFERF

SEQ ID NO: 867276 - protein, 9 aa, Homo Sapiens
KFIVGHLKT

SEQ ID NO: 867277 - protein, 9 aa, Homo Sapiens
MPEIMESGY

SEQ ID NO: 867278 - protein, 9 aa, Homo Sapiens
WKAIELEKM

SEQ ID NO: 867279 - protein, 9 aa, Homo Sapiens
LEQKKPRIK

SEQ ID NO: 867280 - protein, 9 aa, Homo Sapiens
DVYIQPITN

SEQ ID NO: 867281 - protein, 9 aa, Homo Sapiens
LDYIPVSNP

SEQ ID NO: 867282 - protein, 9 aa, Homo Sapiens
QTKSSQMET

SEQ ID NO: 867283 - protein, 9 aa, Homo Sapiens
NEGKENLKP

SEQ ID NO: 867284 - protein, 9 aa, Homo Sapiens
THITQGAPH

SEQ ID NO: 867285 - protein, 9 aa, Homo Sapiens
SSDHPTLAS

SEQ ID NO: 867286 - protein, 9 aa, Homo Sapiens
APFISPQSW

SEQ ID NO: 867287 - protein, 9 aa, Homo Sapiens
LAARLVPPQ

SEQ ID NO: 867288 - protein, 9 aa, Homo Sapiens
SEIETELQT

SEQ ID NO: 867289 - protein, 9 aa, Homo Sapiens
DPRFKIVEH

SEQ ID NO: 867290 - protein, 9 aa, Homo Sapiens
TNKQSPHSQ

SEQ ID NO: 867291 - protein, 9 aa, Homo Sapiens
FMSMQSLNG

SEQ ID NO: 867292 - protein, 9 aa, Homo Sapiens
DVGYKRFLG

SEQ ID NO: 867293 - protein, 9 aa, Homo Sapiens
RQRTLVLLE

SEQ ID NO: 867294 - protein, 9 aa, Homo Sapiens
EMQALAELL

SEQ ID NO: 867295 - protein, 9 aa, Homo Sapiens
KRKRDNNKD

SEQ ID NO: 867296 - protein, 9 aa, Homo Sapiens
DKTSFVLPL

SEQ ID NO: 867297 - protein, 9 aa, Homo Sapiens
EAKECRLQT

SEQ ID NO: 867298 - protein, 9 aa, Homo Sapiens
DQNRFNLRF

SEQ ID NO: 867299 - protein, 9 aa, Homo Sapiens
NHCFLEENF

SEQ ID NO: 867300 - protein, 9 aa, Homo Sapiens
IGESLSSRT

SEQ ID NO: 867301 - protein, 9 aa, Homo Sapiens
GQDLNTTSR

SEQ ID NO: 867302 - protein, 9 aa, Homo Sapiens
INAEESEIC

SEQ ID NO: 867303 - protein, 9 aa, Homo Sapiens
YMLISLVLR

SEQ ID NO: 867304 - protein, 9 aa, Homo Sapiens
SQKDSDDGP

SEQ ID NO: 867305 - protein, 9 aa, Homo Sapiens
WAPDFLNKW

SEQ ID NO: 867306 - protein, 9 aa, Homo Sapiens
QKEQNLKAE

SEQ ID NO: 867307 - protein, 9 aa, Homo Sapiens
EADKSVNYK

SEQ ID NO: 867308 - protein, 9 aa, Homo Sapiens
MHIRRKQIV

SEQ ID NO: 867309 - protein, 9 aa, Homo Sapiens
LPAICKHYG

SEQ ID NO: 867310 - protein, 9 aa, Homo Sapiens
FTECKMTKS

SEQ ID NO: 867311 - protein, 9 aa, Homo Sapiens
LADRSATKM

SEQ ID NO: 867312 - protein, 9 aa, Homo Sapiens
GQLESMQLP

SEQ ID NO: 867313 - protein, 9 aa, Homo Sapiens
PSLLTLRSL

SEQ ID NO: 867314 - protein, 9 aa, Homo Sapiens
RCYDELLAY

SEQ ID NO: 867315 - protein, 9 aa, Homo Sapiens
WDAKNKKEE

SEQ ID NO: 867316 - protein, 9 aa, Homo Sapiens
SQRGINCNE

SEQ ID NO: 867317 - protein, 9 aa, Homo Sapiens
ASHQSYSQN

SEQ ID NO: 867318 - protein, 9 aa, Homo Sapiens
SSLKLQSQK

SEQ ID NO: 867319 - protein, 9 aa, Homo Sapiens
IKRFIPLAE

SEQ ID NO: 867320 - protein, 9 aa, Homo Sapiens
VALDLQSHG

SEQ ID NO: 867321 - protein, 9 aa, Homo Sapiens
TSPSMGIKE

SEQ ID NO: 867322 - protein, 9 aa, Homo Sapiens
SEGKVDPYH

SEQ ID NO: 867323 - protein, 9 aa, Homo Sapiens
LNPQIGTFD

SEQ ID NO: 867324 - protein, 9 aa, Homo Sapiens
CKRFILTIY

SEQ ID NO: 867325 - protein, 9 aa, Homo Sapiens
DPEKFLNIL

SEQ ID NO: 867326 - protein, 9 aa, Homo Sapiens
IGRGGETIC

SEQ ID NO: 867327 - protein, 9 aa, Homo Sapiens
MAESSSKSD

SEQ ID NO: 867328 - protein, 9 aa, Homo Sapiens
HAKGAKIEV

SEQ ID NO: 867329 - protein, 9 aa, Homo Sapiens
GLLCQSQLT

SEQ ID NO: 867330 - protein, 9 aa, Homo Sapiens
ADTWVDISS

SEQ ID NO: 867331 - protein, 9 aa, Homo Sapiens
KRNPDLQKK

SEQ ID NO: 867332 - protein, 9 aa, Homo Sapiens
LEDDNKFTE

SEQ ID NO: 867333 - protein, 9 aa, Homo Sapiens
PASPPKTFS

SEQ ID NO: 867334 - protein, 9 aa, Homo Sapiens
LPYDATRVI

SEQ ID NO: 867335 - protein, 9 aa, Homo Sapiens
GEVTAPVEV

SEQ ID NO: 867336 - protein, 9 aa, Homo Sapiens
HLLVTIRNV

SEQ ID NO: 867337 - protein, 9 aa, Homo Sapiens
MNMLWSQML

SEQ ID NO: 867338 - protein, 9 aa, Homo Sapiens
QKNQKHPSS

SEQ ID NO: 867339 - protein, 9 aa, Homo Sapiens
AKFTHYKPP

SEQ ID NO: 867340 - protein, 9 aa, Homo Sapiens
IKDTPALHM

SEQ ID NO: 867341 - protein, 9 aa, Homo Sapiens
FSLAPFNQL

SEQ ID NO: 867342 - protein, 9 aa, Homo Sapiens
DVKPFLDTV

SEQ ID NO: 867343 - protein, 9 aa, Homo Sapiens
DPGMPRMLP

SEQ ID NO: 867344 - protein, 9 aa, Homo Sapiens
CLKCVMPNK

SEQ ID NO: 867345 - protein, 9 aa, Homo Sapiens
SPLLDASLD

SEQ ID NO: 867346 - protein, 9 aa, Homo Sapiens
RIHEITHTG

SEQ ID NO: 867347 - protein, 9 aa, Homo Sapiens
CAKKRSDEL

SEQ ID NO: 867348 - protein, 9 aa, Homo Sapiens
QVENVKGAV

SEQ ID NO: 867349 - protein, 9 aa, Homo Sapiens
YIKTLANMK

SEQ ID NO: 867350 - protein, 9 aa, Homo Sapiens
RHFTPEDHW

SEQ ID NO: 867351 - protein, 9 aa, Homo Sapiens
IWSTVDEKE

SEQ ID NO: 867352 - protein, 9 aa, Homo Sapiens
PNYNVALQR

SEQ ID NO: 867353 - protein, 9 aa, Homo Sapiens
LDVLKKYRG

SEQ ID NO: 867354 - protein, 9 aa, Homo Sapiens
AQPYQPKID

SEQ ID NO: 867355 - protein, 9 aa, Homo Sapiens
QAAKNLMNV

SEQ ID NO: 867356 - protein, 9 aa, Homo Sapiens
IKNFDRDNV

SEQ ID NO: 867357 - protein, 9 aa, Homo Sapiens
KQAPKGQPR

SEQ ID NO: 867358 - protein, 9 aa, Homo Sapiens
SRKRLIKQS

SEQ ID NO: 867359 - protein, 9 aa, Homo Sapiens
IALVSVCVY

SEQ ID NO: 867360 - protein, 9 aa, Homo Sapiens
TRFSRPSPI

SEQ ID NO: 867361 - protein, 9 aa, Homo Sapiens
PLSPLARSS

SEQ ID NO: 867362 - protein, 9 aa, Homo Sapiens
KGADSTGSP

SEQ ID NO: 867363 - protein, 9 aa, Homo Sapiens
FEVNIQFIG

SEQ ID NO: 867364 - protein, 9 aa, Homo Sapiens
PHKLPRVPS

SEQ ID NO: 867365 - protein, 9 aa, Homo Sapiens
GDHSKISKD

SEQ ID NO: 867366 - protein, 9 aa, Homo Sapiens
TTADYTTKK

SEQ ID NO: 867367 - protein, 9 aa, Homo Sapiens
PQLDGTAVE

SEQ ID NO: 867368 - protein, 9 aa, Homo Sapiens
NEKQIKNFQ

SEQ ID NO: 867369 - protein, 9 aa, Homo Sapiens
LLRCQNEKK

SEQ ID NO: 867370 - protein, 9 aa, Homo Sapiens
KQVNERVLN

SEQ ID NO: 867371 - protein, 9 aa, Homo Sapiens
AQILNFISA

SEQ ID NO: 867372 - protein, 9 aa, Homo Sapiens
DYSTGYVIF

SEQ ID NO: 867373 - protein, 9 aa, Homo Sapiens
SRSNPVVSK

SEQ ID NO: 867374 - protein, 9 aa, Homo Sapiens
THELCPEEQ

SEQ ID NO: 867375 - protein, 9 aa, Homo Sapiens
FTNAIQDKL

SEQ ID NO: 867376 - protein, 9 aa, Homo Sapiens
NRHMGNYRQ

SEQ ID NO: 867377 - protein, 9 aa, Homo Sapiens
PEGKWHVSK

SEQ ID NO: 867378 - protein, 9 aa, Homo Sapiens
TNFLSFMVL

SEQ ID NO: 867379 - protein, 9 aa, Homo Sapiens
SSMVPQLYF

SEQ ID NO: 867380 - protein, 9 aa, Homo Sapiens
ERDTLSIQE

SEQ ID NO: 867381 - protein, 9 aa, Homo Sapiens
CFDRINWPC

SEQ ID NO: 867382 - protein, 9 aa, Homo Sapiens
PSFLKGTTT

SEQ ID NO: 867383 - protein, 9 aa, Homo Sapiens
FRGPIPGPM

SEQ ID NO: 867384 - protein, 9 aa, Homo Sapiens
ICSFADAQG

SEQ ID NO: 867385 - protein, 9 aa, Homo Sapiens
TPDKDDHLL

SEQ ID NO: 867386 - protein, 9 aa, Homo Sapiens
WQVNIQRKR

SEQ ID NO: 867387 - protein, 9 aa, Homo Sapiens
KNQKHPSSP

SEQ ID NO: 867388 - protein, 9 aa, Homo Sapiens
MEEVLTKFR

SEQ ID NO: 867389 - protein, 9 aa, Homo Sapiens
LCAALKETL

SEQ ID NO: 867390 - protein, 9 aa, Homo Sapiens
LDKYYMLIS

SEQ ID NO: 867391 - protein, 9 aa, Homo Sapiens
YYETLKFIV

SEQ ID NO: 867392 - protein, 9 aa, Homo Sapiens
SHANKPPYP

SEQ ID NO: 867393 - protein, 9 aa, Homo Sapiens
TEEDPVLSV

SEQ ID NO: 867394 - protein, 9 aa, Homo Sapiens
CSASIRIPR

SEQ ID NO: 867395 - protein, 9 aa, Homo Sapiens
DDNNPPGSC

SEQ ID NO: 867396 - protein, 9 aa, Homo Sapiens
IAATYTLSG

SEQ ID NO: 867397 - protein, 9 aa, Homo Sapiens
CRPQPRSIS

SEQ ID NO: 867398 - protein, 9 aa, Homo Sapiens
FDVCADAVS

SEQ ID NO: 867399 - protein, 9 aa, Homo Sapiens
WFWGRDVLD

SEQ ID NO: 867400 - protein, 9 aa, Homo Sapiens
FCDLKLDNI

SEQ ID NO: 867401 - protein, 9 aa, Homo Sapiens
KLVQYAGNI

SEQ ID NO: 867402 - protein, 9 aa, Homo Sapiens
DKHPYELLL

SEQ ID NO: 867403 - protein, 9 aa, Homo Sapiens
VFRAGRQLH

SEQ ID NO: 867404 - protein, 9 aa, Homo Sapiens
ENGIANLIK

SEQ ID NO: 867405 - protein, 9 aa, Homo Sapiens
PNKERQRRQ

SEQ ID NO: 867406 - protein, 9 aa, Homo Sapiens
KWLRLPCHN

SEQ ID NO: 867407 - protein, 9 aa, Homo Sapiens
KLWQRLKNL

SEQ ID NO: 867408 - protein, 9 aa, Homo Sapiens
RYMHKICFP

SEQ ID NO: 867409 - protein, 9 aa, Homo Sapiens
EKVVKRKAA

SEQ ID NO: 867410 - protein, 9 aa, Homo Sapiens
VIHKLNVEI

SEQ ID NO: 867411 - protein, 9 aa, Homo Sapiens
KGHPNLIMG

SEQ ID NO: 867412 - protein, 9 aa, Homo Sapiens
LTSKINLHQ

SEQ ID NO: 867413 - protein, 9 aa, Homo Sapiens
AWNDLDSRF

SEQ ID NO: 867414 - protein, 9 aa, Homo Sapiens
NLINAGKQT

SEQ ID NO: 867415 - protein, 9 aa, Homo Sapiens
VSHRYPQIQ

SEQ ID NO: 867416 - protein, 9 aa, Homo Sapiens
VARFNNLRF

SEQ ID NO: 867417 - protein, 9 aa, Homo Sapiens
SYHQLDANL

SEQ ID NO: 867418 - protein, 9 aa, Homo Sapiens
IPDESSEIQ

SEQ ID NO: 867419 - protein, 9 aa, Homo Sapiens
QATHPCNLK

SEQ ID NO: 867420 - protein, 9 aa, Homo Sapiens
ELFAELDKV

SEQ ID NO: 867421 - protein, 9 aa, Homo Sapiens
RLVFLFMQY

SEQ ID NO: 867422 - protein, 9 aa, Homo Sapiens
KPPQQSIDK

SEQ ID NO: 867423 - protein, 9 aa, Homo Sapiens
APKKKIQTA

SEQ ID NO: 867424 - protein, 9 aa, Homo Sapiens
STLCFLCKL

SEQ ID NO: 867425 - protein, 9 aa, Homo Sapiens
DENFRPQNE

SEQ ID NO: 867426 - protein, 9 aa, Homo Sapiens
AISSLTYPL

SEQ ID NO: 867427 - protein, 9 aa, Homo Sapiens
MIPDESSEI

SEQ ID NO: 867428 - protein, 9 aa, Homo Sapiens
KITKIKDGD

SEQ ID NO: 867429 - protein, 9 aa, Homo Sapiens
IKDNLDNIK

SEQ ID NO: 867430 - protein, 9 aa, Homo Sapiens
SFVSAAERI

SEQ ID NO: 867431 - protein, 9 aa, Homo Sapiens
GLICMITEF

SEQ ID NO: 867432 - protein, 9 aa, Homo Sapiens
TVSNAEKRK

SEQ ID NO: 867433 - protein, 9 aa, Homo Sapiens
QFLLFVLLV

SEQ ID NO: 867434 - protein, 9 aa, Homo Sapiens
QKVEFCKRM

SEQ ID NO: 867435 - protein, 9 aa, Homo Sapiens
ILIQGFFRD

SEQ ID NO: 867436 - protein, 9 aa, Homo Sapiens
GKTYSIVMG

SEQ ID NO: 867437 - protein, 9 aa, Homo Sapiens
IISLDTTAA

SEQ ID NO: 867438 - protein, 9 aa, Homo Sapiens
PPRPGMHLP

SEQ ID NO: 867439 - protein, 9 aa, Homo Sapiens
YMNGRYYSK

SEQ ID NO: 867440 - protein, 9 aa, Homo Sapiens
QAAKPAGPH

SEQ ID NO: 867441 - protein, 9 aa, Homo Sapiens
YYRGQNNLT

SEQ ID NO: 867442 - protein, 9 aa, Homo Sapiens
FKHIMALAK

SEQ ID NO: 867443 - protein, 9 aa, Homo Sapiens
GHNYVLDLV

SEQ ID NO: 867444 - protein, 9 aa, Homo Sapiens
AAISERRIK

SEQ ID NO: 867445 - protein, 9 aa, Homo Sapiens
SVVNGKDVS

SEQ ID NO: 867446 - protein, 9 aa, Homo Sapiens
GCANLLDFW

SEQ ID NO: 867447 - protein, 9 aa, Homo Sapiens
CWEDIWQVN

SEQ ID NO: 867448 - protein, 9 aa, Homo Sapiens
SIRIHEITH

SEQ ID NO: 867449 - protein, 9 aa, Homo Sapiens
HPHMVKEDI

SEQ ID NO: 867450 - protein, 9 aa, Homo Sapiens
CDNRWEVRV

SEQ ID NO: 867451 - protein, 9 aa, Homo Sapiens
YLAKWMVHG

SEQ ID NO: 867452 - protein, 9 aa, Homo Sapiens
VSQTQGKGD

SEQ ID NO: 867453 - protein, 9 aa, Homo Sapiens
AVLRLIFNH

SEQ ID NO: 867454 - protein, 9 aa, Homo Sapiens
KNIRAFLTA

SEQ ID NO: 867455 - protein, 9 aa, Homo Sapiens
RRGDTGVCR

SEQ ID NO: 867456 - protein, 9 aa, Homo Sapiens
TLANTQLVL

SEQ ID NO: 867457 - protein, 9 aa, Homo Sapiens
IVIAIRLDS

SEQ ID NO: 867458 - protein, 9 aa, Homo Sapiens
LSFITCICY

SEQ ID NO: 867459 - protein, 9 aa, Homo Sapiens
YFNAGQTFV

SEQ ID NO: 867460 - protein, 9 aa, Homo Sapiens
ASFLSLEPQ

SEQ ID NO: 867461 - protein, 9 aa, Homo Sapiens
SEEPECLPC

SEQ ID NO: 867462 - protein, 9 aa, Homo Sapiens
GSDHENSLE

SEQ ID NO: 867463 - protein, 9 aa, Homo Sapiens
IHQYKVQAY

SEQ ID NO: 867464 - protein, 9 aa, Homo Sapiens
PASQGLDFL

SEQ ID NO: 867465 - protein, 9 aa, Homo Sapiens
PRNSPQPSP

SEQ ID NO: 867466 - protein, 9 aa, Homo Sapiens
ASGETHSRE

SEQ ID NO: 867467 - protein, 9 aa, Homo Sapiens
VTGDHVNLT

SEQ ID NO: 867468 - protein, 9 aa, Homo Sapiens
LCILRHFWI

SEQ ID NO: 867469 - protein, 9 aa, Homo Sapiens
QAPYPCLMA

SEQ ID NO: 867470 - protein, 9 aa, Homo Sapiens
KKMMKDKRP

SEQ ID NO: 867471 - protein, 9 aa, Homo Sapiens
VRSIILLYF

SEQ ID NO: 867472 - protein, 9 aa, Homo Sapiens
GLLLGYHGL

SEQ ID NO: 867473 - protein, 9 aa, Homo Sapiens
ICLGDSTVG

SEQ ID NO: 867474 - protein, 9 aa, Homo Sapiens
YVRILQRMM

SEQ ID NO: 867475 - protein, 9 aa, Homo Sapiens
QETQRLHGM

SEQ ID NO: 867476 - protein, 9 aa, Homo Sapiens
TLQRCIEKV

SEQ ID NO: 867477 - protein, 9 aa, Homo Sapiens
HLNKLSVNN

SEQ ID NO: 867478 - protein, 9 aa, Homo Sapiens
YIDSPPASE

SEQ ID NO: 867479 - protein, 9 aa, Homo Sapiens
YWLSENSKE

SEQ ID NO: 867480 - protein, 9 aa, Homo Sapiens
DLNVLCNFI

SEQ ID NO: 867481 - protein, 9 aa, Homo Sapiens
EHFIQKVEG

SEQ ID NO: 867482 - protein, 9 aa, Homo Sapiens
AVLVIQTDE

SEQ ID NO: 867483 - protein, 9 aa, Homo Sapiens
IFPRFFMVV

SEQ ID NO: 867484 - protein, 9 aa, Homo Sapiens
LDNILVWSL

SEQ ID NO: 867485 - protein, 9 aa, Homo Sapiens
VADLYKLVQ

SEQ ID NO: 867486 - protein, 9 aa, Homo Sapiens
RLALYPGPD

SEQ ID NO: 867487 - protein, 9 aa, Homo Sapiens
SERYYQLWV

SEQ ID NO: 867488 - protein, 9 aa, Homo Sapiens
ELIEQNQRY

SEQ ID NO: 867489 - protein, 9 aa, Homo Sapiens
FVRATLQEL

SEQ ID NO: 867490 - protein, 9 aa, Homo Sapiens
SSELRFLDI

SEQ ID NO: 867491 - protein, 9 aa, Homo Sapiens
QGVPFACFK

SEQ ID NO: 867492 - protein, 9 aa, Homo Sapiens
EIIDQLFAV

SEQ ID NO: 867493 - protein, 9 aa, Homo Sapiens
GKYLAKWMV

SEQ ID NO: 867494 - protein, 9 aa, Homo Sapiens
AQDNTWKII

SEQ ID NO: 867495 - protein, 9 aa, Homo Sapiens
YKDPSLCMF

SEQ ID NO: 867496 - protein, 9 aa, Homo Sapiens
LRIYFPPGL

SEQ ID NO: 867497 - protein, 9 aa, Homo Sapiens
QNYSRGGVC

SEQ ID NO: 867498 - protein, 9 aa, Homo Sapiens
STAKWVLLD

SEQ ID NO: 867499 - protein, 9 aa, Homo Sapiens
NAMKLSIIQ

SEQ ID NO: 867500 - protein, 9 aa, Homo Sapiens
MLKKHTNVI

SEQ ID NO: 867501 - protein, 9 aa, Homo Sapiens
VKQVYFHCL

SEQ ID NO: 867502 - protein, 9 aa, Homo Sapiens
SFVPNASHS

SEQ ID NO: 867503 - protein, 9 aa, Homo Sapiens
TAARLPPSP

SEQ ID NO: 867504 - protein, 9 aa, Homo Sapiens
AEEEETKKK

SEQ ID NO: 867505 - protein, 9 aa, Homo Sapiens
SPRQNSRTS

SEQ ID NO: 867506 - protein, 9 aa, Homo Sapiens
SLCKRFWDC

SEQ ID NO: 867507 - protein, 9 aa, Homo Sapiens
RSKTVSTMR

SEQ ID NO: 867508 - protein, 9 aa, Homo Sapiens
FIHRVLSQP

SEQ ID NO: 867509 - protein, 9 aa, Homo Sapiens
NEVLQNSFR

SEQ ID NO: 867510 - protein, 9 aa, Homo Sapiens
KELAACQLH

SEQ ID NO: 867511 - protein, 9 aa, Homo Sapiens
HDQVLYTAS

SEQ ID NO: 867512 - protein, 9 aa, Homo Sapiens
QTPWRQIPG

SEQ ID NO: 867513 - protein, 9 aa, Homo Sapiens
KILVILLVL

SEQ ID NO: 867514 - protein, 9 aa, Homo Sapiens
PPSRGGTLL

SEQ ID NO: 867515 - protein, 9 aa, Homo Sapiens
QLCLSPYKS

SEQ ID NO: 867516 - protein, 9 aa, Homo Sapiens
LTRDPQVNV

SEQ ID NO: 867517 - protein, 9 aa, Homo Sapiens
SYQYIRSEV

SEQ ID NO: 867518 - protein, 9 aa, Homo Sapiens
SQPFHPSDP

SEQ ID NO: 867519 - protein, 9 aa, Homo Sapiens
NNGSMCNTS

SEQ ID NO: 867520 - protein, 9 aa, Homo Sapiens
RPHAFDFGP

SEQ ID NO: 867521 - protein, 9 aa, Homo Sapiens
VCLGDLINQ

SEQ ID NO: 867522 - protein, 9 aa, Homo Sapiens
TTCDLKICG

SEQ ID NO: 867523 - protein, 9 aa, Homo Sapiens
NMVSLLQEK

SEQ ID NO: 867524 - protein, 9 aa, Homo Sapiens
KLKADKEFW

SEQ ID NO: 867525 - protein, 9 aa, Homo Sapiens
NIVMFIVVM

SEQ ID NO: 867526 - protein, 9 aa, Homo Sapiens
TDMRPLEAL

SEQ ID NO: 867527 - protein, 9 aa, Homo Sapiens
VNENLVECF

SEQ ID NO: 867528 - protein, 9 aa, Homo Sapiens
KRRDNEEFG

SEQ ID NO: 867529 - protein, 9 aa, Homo Sapiens
NFTVRDNQD

SEQ ID NO: 867530 - protein, 9 aa, Homo Sapiens
DQKVWPNEE

SEQ ID NO: 867531 - protein, 9 aa, Homo Sapiens
ISEVERNLQ

SEQ ID NO: 867532 - protein, 9 aa, Homo Sapiens
HCQHLQAEK

SEQ ID NO: 867533 - protein, 9 aa, Homo Sapiens
VMSFNQTGL

SEQ ID NO: 867534 - protein, 9 aa, Homo Sapiens
AMNLCTLIS

SEQ ID NO: 867535 - protein, 9 aa, Homo Sapiens
ISLDTTAAS

SEQ ID NO: 867536 - protein, 9 aa, Homo Sapiens
LIELLALSN

SEQ ID NO: 867537 - protein, 9 aa, Homo Sapiens
QICITVFQL

SEQ ID NO: 867538 - protein, 9 aa, Homo Sapiens
IVDLDEEDS

SEQ ID NO: 867539 - protein, 9 aa, Homo Sapiens
IRFQKNNGT

SEQ ID NO: 867540 - protein, 9 aa, Homo Sapiens
IQKAWWRHV

SEQ ID NO: 867541 - protein, 9 aa, Homo Sapiens
DGHNLFTKD

SEQ ID NO: 867542 - protein, 9 aa, Homo Sapiens
IEFLKGFWV

SEQ ID NO: 867543 - protein, 9 aa, Homo Sapiens
LKKDNFSLK

SEQ ID NO: 867544 - protein, 9 aa, Homo Sapiens
SNTDANILL

SEQ ID NO: 867545 - protein, 9 aa, Homo Sapiens
ATGWTKSMA

SEQ ID NO: 867546 - protein, 9 aa, Homo Sapiens
YDTGRNIRK

SEQ ID NO: 867547 - protein, 9 aa, Homo Sapiens
KDMKATCVN

SEQ ID NO: 867548 - protein, 9 aa, Homo Sapiens
ATVDSETFS

SEQ ID NO: 867549 - protein, 9 aa, Homo Sapiens
YILPDTCFR

SEQ ID NO: 867550 - protein, 9 aa, Homo Sapiens
SQLRYCAGH

SEQ ID NO: 867551 - protein, 9 aa, Homo Sapiens
KEPWLVDLF

SEQ ID NO: 867552 - protein, 9 aa, Homo Sapiens
GWGDGGRET

SEQ ID NO: 867553 - protein, 9 aa, Homo Sapiens
ATTTEKTTK

SEQ ID NO: 867554 - protein, 9 aa, Homo Sapiens
KTNIRIMEP

SEQ ID NO: 867555 - protein, 9 aa, Homo Sapiens
LSFPVDTSN

SEQ ID NO: 867556 - protein, 9 aa, Homo Sapiens
SAPPLEQRS

SEQ ID NO: 867557 - protein, 9 aa, Homo Sapiens
GSKDKMSAL

SEQ ID NO: 867558 - protein, 9 aa, Homo Sapiens
SGKQLRIKH

SEQ ID NO: 867559 - protein, 9 aa, Homo Sapiens
GKLTEICHE

SEQ ID NO: 867560 - protein, 9 aa, Homo Sapiens
DQFFTRHPP

SEQ ID NO: 867561 - protein, 9 aa, Homo Sapiens
REVKEIRRK

SEQ ID NO: 867562 - protein, 9 aa, Homo Sapiens
FSQVFQAPH

SEQ ID NO: 867563 - protein, 9 aa, Homo Sapiens
DDIVQEKHL

SEQ ID NO: 867564 - protein, 9 aa, Homo Sapiens
LGSDNPSKN

SEQ ID NO: 867565 - protein, 9 aa, Homo Sapiens
HKIIHNRWI

SEQ ID NO: 867566 - protein, 9 aa, Homo Sapiens
GIIIKGVGK

SEQ ID NO: 867567 - protein, 9 aa, Homo Sapiens
CAALVLVVL

SEQ ID NO: 867568 - protein, 9 aa, Homo Sapiens
PGKWTTNGL

SEQ ID NO: 867569 - protein, 9 aa, Homo Sapiens
EEECRPQPR

SEQ ID NO: 867570 - protein, 9 aa, Homo Sapiens
MALVDGPAE

SEQ ID NO: 867571 - protein, 9 aa, Homo Sapiens
DIKSKHVLL

SEQ ID NO: 867572 - protein, 9 aa, Homo Sapiens
KICLWRNFY

SEQ ID NO: 867573 - protein, 9 aa, Homo Sapiens
SPCCGGATC

SEQ ID NO: 867574 - protein, 9 aa, Homo Sapiens
GHYEQILNP

SEQ ID NO: 867575 - protein, 9 aa, Homo Sapiens
MMLNINLWL

SEQ ID NO: 867576 - protein, 9 aa, Homo Sapiens
IDDSEELLV

SEQ ID NO: 867577 - protein, 9 aa, Homo Sapiens
LAEKLDWLA

SEQ ID NO: 867578 - protein, 9 aa, Homo Sapiens
AHYPPGHHS

SEQ ID NO: 867579 - protein, 9 aa, Homo Sapiens
KDKSDYNLV

SEQ ID NO: 867580 - protein, 9 aa, Homo Sapiens
KHKCKCRNH

SEQ ID NO: 867581 - protein, 9 aa, Homo Sapiens
PKEKSKRGF

SEQ ID NO: 867582 - protein, 9 aa, Homo Sapiens
QYYRQVDTG

SEQ ID NO: 867583 - protein, 9 aa, Homo Sapiens
ECMRLRNRA

SEQ ID NO: 867584 - protein, 9 aa, Homo Sapiens
PQDGVIQIK

SEQ ID NO: 867585 - protein, 9 aa, Homo Sapiens
NNLAVEKRN

SEQ ID NO: 867586 - protein, 9 aa, Homo Sapiens
ESGDQYRTE

SEQ ID NO: 867587 - protein, 9 aa, Homo Sapiens
VWRNPLTLF

SEQ ID NO: 867588 - protein, 9 aa, Homo Sapiens
RFKKTKIDY

SEQ ID NO: 867589 - protein, 9 aa, Homo Sapiens
GENKAVTFS

SEQ ID NO: 867590 - protein, 9 aa, Homo Sapiens
QKHREFLTK

SEQ ID NO: 867591 - protein, 9 aa, Homo Sapiens
LTSARNCYP

SEQ ID NO: 867592 - protein, 9 aa, Homo Sapiens
QIVLFQKRW

SEQ ID NO: 867593 - protein, 9 aa, Homo Sapiens
DISNFGAVP

SEQ ID NO: 867594 - protein, 9 aa, Homo Sapiens
RICFHDPSP

SEQ ID NO: 867595 - protein, 9 aa, Homo Sapiens
QPTTVNISA

SEQ ID NO: 867596 - protein, 9 aa, Homo Sapiens
TADLPVAQI

SEQ ID NO: 867597 - protein, 9 aa, Homo Sapiens
FDQFFTRHP

SEQ ID NO: 867598 - protein, 9 aa, Homo Sapiens
DRGTSFNLI

SEQ ID NO: 867599 - protein, 9 aa, Homo Sapiens
FCLILLILS

SEQ ID NO: 867600 - protein, 9 aa, Homo Sapiens
KKEEEEEAT

SEQ ID NO: 867601 - protein, 9 aa, Homo Sapiens
AVSMAKPHM

SEQ ID NO: 867602 - protein, 9 aa, Homo Sapiens
RALTLATVT

SEQ ID NO: 867603 - protein, 9 aa, Homo Sapiens
RAHREALAK

SEQ ID NO: 867604 - protein, 9 aa, Homo Sapiens
AVCKIKVHS

SEQ ID NO: 867605 - protein, 9 aa, Homo Sapiens
RKLLPKVSY

SEQ ID NO: 867606 - protein, 9 aa, Homo Sapiens
KKDLKSWAQ

SEQ ID NO: 867607 - protein, 9 aa, Homo Sapiens
PRIKPSPLT

SEQ ID NO: 867608 - protein, 9 aa, Homo Sapiens
YEFGICVLY

SEQ ID NO: 867609 - protein, 9 aa, Homo Sapiens
IMRTKGFWR

SEQ ID NO: 867610 - protein, 9 aa, Homo Sapiens
YVPSLYFTM

SEQ ID NO: 867611 - protein, 9 aa, Homo Sapiens
YDLKETAGD

SEQ ID NO: 867612 - protein, 9 aa, Homo Sapiens
LERKRHDSK

SEQ ID NO: 867613 - protein, 9 aa, Homo Sapiens
FKPGRQSDL

SEQ ID NO: 867614 - protein, 9 aa, Homo Sapiens
TRTPKTPQT

SEQ ID NO: 867615 - protein, 9 aa, Homo Sapiens
ESIARTRAG

SEQ ID NO: 867616 - protein, 9 aa, Homo Sapiens
ISEIKEIEE

SEQ ID NO: 867617 - protein, 9 aa, Homo Sapiens
VINNFFCDL

SEQ ID NO: 867618 - protein, 9 aa, Homo Sapiens
LCYLFLAEL

SEQ ID NO: 867619 - protein, 9 aa, Homo Sapiens
RRPHNRDSI

SEQ ID NO: 867620 - protein, 9 aa, Homo Sapiens
EDIDKGQLP

SEQ ID NO: 867621 - protein, 9 aa, Homo Sapiens
DYLYFASLN

SEQ ID NO: 867622 - protein, 9 aa, Homo Sapiens
LGILSVQME

SEQ ID NO: 867623 - protein, 9 aa, Homo Sapiens
MVWYRQDLG

SEQ ID NO: 867624 - protein, 9 aa, Homo Sapiens
LQGFDQLQL

SEQ ID NO: 867625 - protein, 9 aa, Homo Sapiens
ANEEIAQVQ

SEQ ID NO: 867626 - protein, 9 aa, Homo Sapiens
IGIQVTPDK

SEQ ID NO: 867627 - protein, 9 aa, Homo Sapiens
VIEFTETSV

SEQ ID NO: 867628 - protein, 9 aa, Homo Sapiens
KIRQPERNC

SEQ ID NO: 867629 - protein, 9 aa, Homo Sapiens
QKEGMQKQG

SEQ ID NO: 867630 - protein, 9 aa, Homo Sapiens
VGTFLCWIA

SEQ ID NO: 867631 - protein, 9 aa, Homo Sapiens
LSRSISMKP

SEQ ID NO: 867632 - protein, 9 aa, Homo Sapiens
IKEIEELSE

SEQ ID NO: 867633 - protein, 9 aa, Homo Sapiens
EGWEIRYTH

SEQ ID NO: 867634 - protein, 9 aa, Homo Sapiens
GFTSRKSCC

SEQ ID NO: 867635 - protein, 9 aa, Homo Sapiens
VFGVIVYQI

SEQ ID NO: 867636 - protein, 9 aa, Homo Sapiens
AENEDLNWI

SEQ ID NO: 867637 - protein, 9 aa, Homo Sapiens
CFMKGAYKQ

SEQ ID NO: 867638 - protein, 9 aa, Homo Sapiens
IKQNARWST

SEQ ID NO: 867639 - protein, 9 aa, Homo Sapiens
VLSVMYRFC

SEQ ID NO: 867640 - protein, 9 aa, Homo Sapiens
VNKYFKLPH

SEQ ID NO: 867641 - protein, 9 aa, Homo Sapiens
SPKTCNRKK

SEQ ID NO: 867642 - protein, 9 aa, Homo Sapiens
DVAIQLSLE

SEQ ID NO: 867643 - protein, 9 aa, Homo Sapiens
DPAFGVACM

SEQ ID NO: 867644 - protein, 9 aa, Homo Sapiens
KKILLLEGF

SEQ ID NO: 867645 - protein, 9 aa, Homo Sapiens
ACQIHHPSL

SEQ ID NO: 867646 - protein, 9 aa, Homo Sapiens
EQNLNHNAM

SEQ ID NO: 867647 - protein, 9 aa, Homo Sapiens
EGEKMKIAG

SEQ ID NO: 867648 - protein, 9 aa, Homo Sapiens
INEQIIKEK

SEQ ID NO: 867649 - protein, 9 aa, Homo Sapiens
SIDEDCKLN

SEQ ID NO: 867650 - protein, 9 aa, Homo Sapiens
EDKGLDSAE

SEQ ID NO: 867651 - protein, 9 aa, Homo Sapiens
DKKDKMKPQ

SEQ ID NO: 867652 - protein, 9 aa, Homo Sapiens
FPGLQLFNV

SEQ ID NO: 867653 - protein, 9 aa, Homo Sapiens
SDVTISYID

SEQ ID NO: 867654 - protein, 9 aa, Homo Sapiens
EKERSTRSA

SEQ ID NO: 867655 - protein, 9 aa, Homo Sapiens
LEQAAKPAG

SEQ ID NO: 867656 - protein, 9 aa, Homo Sapiens
LDTDISYLK

SEQ ID NO: 867657 - protein, 9 aa, Homo Sapiens
RFTKLGFEI

SEQ ID NO: 867658 - protein, 9 aa, Homo Sapiens
GFGAGSDIG

SEQ ID NO: 867659 - protein, 9 aa, Homo Sapiens
RLRRCHRFI

SEQ ID NO: 867660 - protein, 9 aa, Homo Sapiens
LLHCGPWDD

SEQ ID NO: 867661 - protein, 9 aa, Homo Sapiens
ERDIQYAPL

SEQ ID NO: 867662 - protein, 9 aa, Homo Sapiens
ISSIDKDAK

SEQ ID NO: 867663 - protein, 9 aa, Homo Sapiens
KKDSQGLGL

SEQ ID NO: 867664 - protein, 9 aa, Homo Sapiens
HMLSEEKQW

SEQ ID NO: 867665 - protein, 9 aa, Homo Sapiens
TNEILHLVP

SEQ ID NO: 867666 - protein, 9 aa, Homo Sapiens
DSDLLLNTR

SEQ ID NO: 867667 - protein, 9 aa, Homo Sapiens
LVAIFLMFL

SEQ ID NO: 867668 - protein, 9 aa, Homo Sapiens
PLGMEPKNF

SEQ ID NO: 867669 - protein, 9 aa, Homo Sapiens
NKAEEEMAR

SEQ ID NO: 867670 - protein, 9 aa, Homo Sapiens
HLRLIYWLF

SEQ ID NO: 867671 - protein, 9 aa, Homo Sapiens
NTSVYSQLP

SEQ ID NO: 867672 - protein, 9 aa, Homo Sapiens
LQRFLSRIK

SEQ ID NO: 867673 - protein, 9 aa, Homo Sapiens
CIIVVCSVF

SEQ ID NO: 867674 - protein, 9 aa, Homo Sapiens
YVQHKIDLP

SEQ ID NO: 867675 - protein, 9 aa, Homo Sapiens
NATIRQLED

SEQ ID NO: 867676 - protein, 9 aa, Homo Sapiens
YQSRYQSDP

SEQ ID NO: 867677 - protein, 9 aa, Homo Sapiens
QGWIPVKWM

SEQ ID NO: 867678 - protein, 9 aa, Homo Sapiens
SSRDAVEDN

SEQ ID NO: 867679 - protein, 9 aa, Homo Sapiens
NFNDYMKSL

SEQ ID NO: 867680 - protein, 9 aa, Homo Sapiens
PPLGGLVNS

SEQ ID NO: 867681 - protein, 9 aa, Homo Sapiens
DEDYKGAPW

SEQ ID NO: 867682 - protein, 9 aa, Homo Sapiens
ARYIDAGNF

SEQ ID NO: 867683 - protein, 9 aa, Homo Sapiens
ANVTGNQDI

SEQ ID NO: 867684 - protein, 9 aa, Homo Sapiens
IDTYCLNPQ

SEQ ID NO: 867685 - protein, 9 aa, Homo Sapiens
ERACPLPGS

SEQ ID NO: 867686 - protein, 9 aa, Homo Sapiens
KKWELICGQ

SEQ ID NO: 867687 - protein, 9 aa, Homo Sapiens
KGQLPSPQH

SEQ ID NO: 867688 - protein, 9 aa, Homo Sapiens
LGCRICPGN

SEQ ID NO: 867689 - protein, 9 aa, Homo Sapiens
PPYPPGVGS

SEQ ID NO: 867690 - protein, 9 aa, Homo Sapiens
WAINQYRVC

SEQ ID NO: 867691 - protein, 9 aa, Homo Sapiens
DYNDSAFME

SEQ ID NO: 867692 - protein, 9 aa, Homo Sapiens
MTHMIIHTG

SEQ ID NO: 867693 - protein, 9 aa, Homo Sapiens
HSRGDSSKL

SEQ ID NO: 867694 - protein, 9 aa, Homo Sapiens
GKNCMDCVL

SEQ ID NO: 867695 - protein, 9 aa, Homo Sapiens
PTNDRGLQR

SEQ ID NO: 867696 - protein, 9 aa, Homo Sapiens
YARDHYTIG

SEQ ID NO: 867697 - protein, 9 aa, Homo Sapiens
ENHEPKKNA

SEQ ID NO: 867698 - protein, 9 aa, Homo Sapiens
MNKRGQLYA

SEQ ID NO: 867699 - protein, 9 aa, Homo Sapiens
EEEETKKKE

SEQ ID NO: 867700 - protein, 9 aa, Homo Sapiens
WSTKSETNH

SEQ ID NO: 867701 - protein, 9 aa, Homo Sapiens
RELRLTKNI

SEQ ID NO: 867702 - protein, 9 aa, Homo Sapiens
AGTNKDALI

SEQ ID NO: 867703 - protein, 9 aa, Homo Sapiens
RQMKITKCA

SEQ ID NO: 867704 - protein, 9 aa, Homo Sapiens
LMNSLSFCT

SEQ ID NO: 867705 - protein, 9 aa, Homo Sapiens
YFGERQTDK

SEQ ID NO: 867706 - protein, 9 aa, Homo Sapiens
FKTFHLEFH

SEQ ID NO: 867707 - protein, 9 aa, Homo Sapiens
AMQLLWFNV

SEQ ID NO: 867708 - protein, 9 aa, Homo Sapiens
GRGGGHCSI

SEQ ID NO: 867709 - protein, 9 aa, Homo Sapiens
PLFTDFVHP

SEQ ID NO: 867710 - protein, 9 aa, Homo Sapiens
LLLIIIVLL

SEQ ID NO: 867711 - protein, 9 aa, Homo Sapiens
QRHLLIHTS

SEQ ID NO: 867712 - protein, 9 aa, Homo Sapiens
IHPGSVAQK

SEQ ID NO: 867713 - protein, 9 aa, Homo Sapiens
QETVKKIHP

SEQ ID NO: 867714 - protein, 9 aa, Homo Sapiens
LMSPRDCAY

SEQ ID NO: 867715 - protein, 9 aa, Homo Sapiens
SGSLSMIND

SEQ ID NO: 867716 - protein, 9 aa, Homo Sapiens
SPCFSCAQK

SEQ ID NO: 867717 - protein, 9 aa, Homo Sapiens
ESRWRLDKD

SEQ ID NO: 867718 - protein, 9 aa, Homo Sapiens
AADGIWLYN

SEQ ID NO: 867719 - protein, 9 aa, Homo Sapiens
LVFNLSSER

SEQ ID NO: 867720 - protein, 9 aa, Homo Sapiens
NVKKKRPPL

SEQ ID NO: 867721 - protein, 9 aa, Homo Sapiens
KDGDKNPMS

SEQ ID NO: 867722 - protein, 9 aa, Homo Sapiens
YPKNGSIQP

SEQ ID NO: 867723 - protein, 9 aa, Homo Sapiens
SVTSISEIP

SEQ ID NO: 867724 - protein, 9 aa, Homo Sapiens
FYSTCTKGN

SEQ ID NO: 867725 - protein, 9 aa, Homo Sapiens
FSWEEVEAA

SEQ ID NO: 867726 - protein, 9 aa, Homo Sapiens
SELPTTKLN

SEQ ID NO: 867727 - protein, 9 aa, Homo Sapiens
FLLHLLLFL

SEQ ID NO: 867728 - protein, 9 aa, Homo Sapiens
QCIHTDDKP

SEQ ID NO: 867729 - protein, 9 aa, Homo Sapiens
YRQIYPPED

SEQ ID NO: 867730 - protein, 9 aa, Homo Sapiens
MGVCYNAEK

SEQ ID NO: 867731 - protein, 9 aa, Homo Sapiens
VREKRDVQP

SEQ ID NO: 867732 - protein, 9 aa, Homo Sapiens
SELSLAPEG

SEQ ID NO: 867733 - protein, 9 aa, Homo Sapiens
MKALPILSR

SEQ ID NO: 867734 - protein, 9 aa, Homo Sapiens
KGFWVILEE

SEQ ID NO: 867735 - protein, 9 aa, Homo Sapiens
LEVFILGVV

SEQ ID NO: 867736 - protein, 9 aa, Homo Sapiens
RMAGNKALS

SEQ ID NO: 867737 - protein, 9 aa, Homo Sapiens
QFGSDDEGR

SEQ ID NO: 867738 - protein, 9 aa, Homo Sapiens
MGIIPQIAH

SEQ ID NO: 867739 - protein, 9 aa, Homo Sapiens
ILHLLKFCR

SEQ ID NO: 867740 - protein, 9 aa, Homo Sapiens
QADDERVCE

SEQ ID NO: 867741 - protein, 9 aa, Homo Sapiens
KLCQAPDFY

SEQ ID NO: 867742 - protein, 9 aa, Homo Sapiens
DSPKVKEEQ

SEQ ID NO: 867743 - protein, 9 aa, Homo Sapiens
GTSDKREKL

SEQ ID NO: 867744 - protein, 9 aa, Homo Sapiens
VLAGYLILS

SEQ ID NO: 867745 - protein, 9 aa, Homo Sapiens
GVDSSGKTA

SEQ ID NO: 867746 - protein, 9 aa, Homo Sapiens
EGHYSLYLG

SEQ ID NO: 867747 - protein, 9 aa, Homo Sapiens
ANSNKESDF

SEQ ID NO: 867748 - protein, 9 aa, Homo Sapiens
SVLFIFQIL

SEQ ID NO: 867749 - protein, 9 aa, Homo Sapiens
CVTVTCDPP

SEQ ID NO: 867750 - protein, 9 aa, Homo Sapiens
RKNMMEKIQ

SEQ ID NO: 867751 - protein, 9 aa, Homo Sapiens
KHLAGVLKD

SEQ ID NO: 867752 - protein, 9 aa, Homo Sapiens
GSPKLSPPQ

SEQ ID NO: 867753 - protein, 9 aa, Homo Sapiens
INLLESTLY

SEQ ID NO: 867754 - protein, 9 aa, Homo Sapiens
QFCEFKLSK

SEQ ID NO: 867755 - protein, 9 aa, Homo Sapiens
NLCYYKISA

SEQ ID NO: 867756 - protein, 9 aa, Homo Sapiens
EDPRFKIVE

SEQ ID NO: 867757 - protein, 9 aa, Homo Sapiens
LGISDTLIQ

SEQ ID NO: 867758 - protein, 9 aa, Homo Sapiens
CKAGKGQTG

SEQ ID NO: 867759 - protein, 9 aa, Homo Sapiens
WRQIPGGYS

SEQ ID NO: 867760 - protein, 9 aa, Homo Sapiens
FHKLNVSNY

SEQ ID NO: 867761 - protein, 9 aa, Homo Sapiens
MEMKEDNVS

SEQ ID NO: 867762 - protein, 9 aa, Homo Sapiens
QYRSHMPYT

SEQ ID NO: 867763 - protein, 9 aa, Homo Sapiens
PVSGRLPPC

SEQ ID NO: 867764 - protein, 9 aa, Homo Sapiens
LRHKTYNLS

SEQ ID NO: 867765 - protein, 9 aa, Homo Sapiens
DAHAASLAS

SEQ ID NO: 867766 - protein, 9 aa, Homo Sapiens
VVWEHFDCL

SEQ ID NO: 867767 - protein, 9 aa, Homo Sapiens
AVLCGVTVM

SEQ ID NO: 867768 - protein, 9 aa, Homo Sapiens
LCCWVLPDT

SEQ ID NO: 867769 - protein, 9 aa, Homo Sapiens
QHYLEELLA

SEQ ID NO: 867770 - protein, 9 aa, Homo Sapiens
RTIKIQNIS

SEQ ID NO: 867771 - protein, 9 aa, Homo Sapiens
TLVPVEDDA

SEQ ID NO: 867772 - protein, 9 aa, Homo Sapiens
KLFFSGSAK

SEQ ID NO: 867773 - protein, 9 aa, Homo Sapiens
GGLVCMDLL

SEQ ID NO: 867774 - protein, 9 aa, Homo Sapiens
NNMIILLNN

SEQ ID NO: 867775 - protein, 9 aa, Homo Sapiens
KVHFTCNPG

SEQ ID NO: 867776 - protein, 9 aa, Homo Sapiens
SENYSIYKQ

SEQ ID NO: 867777 - protein, 9 aa, Homo Sapiens
CIPSQLNVN

SEQ ID NO: 867778 - protein, 9 aa, Homo Sapiens
VLGAMAIWR

SEQ ID NO: 867779 - protein, 9 aa, Homo Sapiens
KKRKRDNNK

SEQ ID NO: 867780 - protein, 9 aa, Homo Sapiens
HYDHNHQEL

SEQ ID NO: 867781 - protein, 9 aa, Homo Sapiens
FKLNAQTGL

SEQ ID NO: 867782 - protein, 9 aa, Homo Sapiens
YYLSAFSAV

SEQ ID NO: 867783 - protein, 9 aa, Homo Sapiens
IHTSERTFK

SEQ ID NO: 867784 - protein, 9 aa, Homo Sapiens
KEIERLPLA

SEQ ID NO: 867785 - protein, 9 aa, Homo Sapiens
RQVQMEYKK

SEQ ID NO: 867786 - protein, 9 aa, Homo Sapiens
RLPEQITKF

SEQ ID NO: 867787 - protein, 9 aa, Homo Sapiens
LFCDIPSLL

SEQ ID NO: 867788 - protein, 9 aa, Homo Sapiens
KTRFKKTKI

SEQ ID NO: 867789 - protein, 9 aa, Homo Sapiens
IFRGPVTTI

SEQ ID NO: 867790 - protein, 9 aa, Homo Sapiens
RPVVQVFIV

SEQ ID NO: 867791 - protein, 9 aa, Homo Sapiens
DGVKVCTCT

SEQ ID NO: 867792 - protein, 9 aa, Homo Sapiens
EAILNMVVA

SEQ ID NO: 867793 - protein, 9 aa, Homo Sapiens
YTGLAIHIQ

SEQ ID NO: 867794 - protein, 9 aa, Homo Sapiens
AVSDACTST

SEQ ID NO: 867795 - protein, 9 aa, Homo Sapiens
KVQNLDCYT

SEQ ID NO: 867796 - protein, 9 aa, Homo Sapiens
FISPQSWPP

SEQ ID NO: 867797 - protein, 9 aa, Homo Sapiens
SPTGRPKRQ

SEQ ID NO: 867798 - protein, 9 aa, Homo Sapiens
LILDSMKAK

SEQ ID NO: 867799 - protein, 9 aa, Homo Sapiens
FLHTRNVHY

SEQ ID NO: 867800 - protein, 9 aa, Homo Sapiens
IHSRGDSSK

SEQ ID NO: 867801 - protein, 9 aa, Homo Sapiens
EDVNSWKAS

SEQ ID NO: 867802 - protein, 9 aa, Homo Sapiens
IKDNQATKL

SEQ ID NO: 867803 - protein, 9 aa, Homo Sapiens
HECVSTDDS

SEQ ID NO: 867804 - protein, 9 aa, Homo Sapiens
HYIEKKTNQ

SEQ ID NO: 867805 - protein, 9 aa, Homo Sapiens
PSNCLGICS

SEQ ID NO: 867806 - protein, 9 aa, Homo Sapiens
AFRRSLVLC

SEQ ID NO: 867807 - protein, 9 aa, Homo Sapiens
DGWNIKDVA

SEQ ID NO: 867808 - protein, 9 aa, Homo Sapiens
NNLLIADIE

SEQ ID NO: 867809 - protein, 9 aa, Homo Sapiens
NEALVDEIV

SEQ ID NO: 867810 - protein, 9 aa, Homo Sapiens
DSACASWIY

SEQ ID NO: 867811 - protein, 9 aa, Homo Sapiens
IIKLPESDS

SEQ ID NO: 867812 - protein, 9 aa, Homo Sapiens
TICQQEMAE

SEQ ID NO: 867813 - protein, 9 aa, Homo Sapiens
VKCDPESEN

SEQ ID NO: 867814 - protein, 9 aa, Homo Sapiens
EPLQECISH

SEQ ID NO: 867815 - protein, 9 aa, Homo Sapiens
HEITHSGEK

SEQ ID NO: 867816 - protein, 9 aa, Homo Sapiens
QSQLTSNRQ

SEQ ID NO: 867817 - protein, 9 aa, Homo Sapiens
SSYQEPSNS

SEQ ID NO: 867818 - protein, 9 aa, Homo Sapiens
SSGKQLRIK

SEQ ID NO: 867819 - protein, 9 aa, Homo Sapiens
GVLELALQG

SEQ ID NO: 867820 - protein, 9 aa, Homo Sapiens
SSTEYQPRA

SEQ ID NO: 867821 - protein, 9 aa, Homo Sapiens
KAMQRNWSG

SEQ ID NO: 867822 - protein, 9 aa, Homo Sapiens
KCKKSWGRR

SEQ ID NO: 867823 - protein, 9 aa, Homo Sapiens
VTLRQIAHG

SEQ ID NO: 867824 - protein, 9 aa, Homo Sapiens
TAGSPKTCN

SEQ ID NO: 867825 - protein, 9 aa, Homo Sapiens
AMSYVKLQT

SEQ ID NO: 867826 - protein, 9 aa, Homo Sapiens
QLTQHQVFH

SEQ ID NO: 867827 - protein, 9 aa, Homo Sapiens
VLHKCQVTN

SEQ ID NO: 867828 - protein, 9 aa, Homo Sapiens
NNLYATQMN

SEQ ID NO: 867829 - protein, 9 aa, Homo Sapiens
NIHPTKREV

SEQ ID NO: 867830 - protein, 9 aa, Homo Sapiens
MKQSLNENS

SEQ ID NO: 867831 - protein, 9 aa, Homo Sapiens
TLVKITWST

SEQ ID NO: 867832 - protein, 9 aa, Homo Sapiens
RGNGYRILS

SEQ ID NO: 867833 - protein, 9 aa, Homo Sapiens
HQISQIYDK

SEQ ID NO: 867834 - protein, 9 aa, Homo Sapiens
RNCSGNQRQ

SEQ ID NO: 867835 - protein, 9 aa, Homo Sapiens
EGNFLGQMP

SEQ ID NO: 867836 - protein, 9 aa, Homo Sapiens
TLTSNVFIV

SEQ ID NO: 867837 - protein, 9 aa, Homo Sapiens
APEDAWMDT

SEQ ID NO: 867838 - protein, 9 aa, Homo Sapiens
RVPAFRDKH

SEQ ID NO: 867839 - protein, 9 aa, Homo Sapiens
TIFIILFLN

SEQ ID NO: 867840 - protein, 9 aa, Homo Sapiens
PYTLAINVL

SEQ ID NO: 867841 - protein, 9 aa, Homo Sapiens
FNIPSTAYV

SEQ ID NO: 867842 - protein, 9 aa, Homo Sapiens
TGDKPYECV

SEQ ID NO: 867843 - protein, 9 aa, Homo Sapiens
YKRSLRNLT

SEQ ID NO: 867844 - protein, 9 aa, Homo Sapiens
ANSINTLRR

SEQ ID NO: 867845 - protein, 9 aa, Homo Sapiens
SPTFPSYSP

SEQ ID NO: 867846 - protein, 9 aa, Homo Sapiens
AFKHVFESV

SEQ ID NO: 867847 - protein, 9 aa, Homo Sapiens
HKDIFGAVF

SEQ ID NO: 867848 - protein, 9 aa, Homo Sapiens
DVVHKSFDL

SEQ ID NO: 867849 - protein, 9 aa, Homo Sapiens
SIDHQIPNS

SEQ ID NO: 867850 - protein, 9 aa, Homo Sapiens
KCCDDLEEA

SEQ ID NO: 867851 - protein, 9 aa, Homo Sapiens
SLLNLFLSA

SEQ ID NO: 867852 - protein, 9 aa, Homo Sapiens
KLRFQLGYH

SEQ ID NO: 867853 - protein, 9 aa, Homo Sapiens
AELRAHREA

SEQ ID NO: 867854 - protein, 9 aa, Homo Sapiens
RNVHPQERP

SEQ ID NO: 867855 - protein, 9 aa, Homo Sapiens
NQVSVEGLT

SEQ ID NO: 867856 - protein, 9 aa, Homo Sapiens
SAMKMAHYP

SEQ ID NO: 867857 - protein, 9 aa, Homo Sapiens
CYSTWKKAV

SEQ ID NO: 867858 - protein, 9 aa, Homo Sapiens
LHQMWRDQV

SEQ ID NO: 867859 - protein, 9 aa, Homo Sapiens
TDISYLKGR

SEQ ID NO: 867860 - protein, 9 aa, Homo Sapiens
TADRWKKYL

SEQ ID NO: 867861 - protein, 9 aa, Homo Sapiens
DTISKSKLH

SEQ ID NO: 867862 - protein, 9 aa, Homo Sapiens
EVDYYKLQY

SEQ ID NO: 867863 - protein, 9 aa, Homo Sapiens
RRIIKLPES

SEQ ID NO: 867864 - protein, 9 aa, Homo Sapiens
GSDSFIAEH

SEQ ID NO: 867865 - protein, 9 aa, Homo Sapiens
QEPSNSHSR

SEQ ID NO: 867866 - protein, 9 aa, Homo Sapiens
FHRVVKILH

SEQ ID NO: 867867 - protein, 9 aa, Homo Sapiens
KKMIAKFQE

SEQ ID NO: 867868 - protein, 9 aa, Homo Sapiens
ILLFITAIQ

SEQ ID NO: 867869 - protein, 9 aa, Homo Sapiens
TLFSRGLSF

SEQ ID NO: 867870 - protein, 9 aa, Homo Sapiens
GICVLYQKV

SEQ ID NO: 867871 - protein, 9 aa, Homo Sapiens
EQLCAQNSE

SEQ ID NO: 867872 - protein, 9 aa, Homo Sapiens
KILHKNNAP

SEQ ID NO: 867873 - protein, 9 aa, Homo Sapiens
DTLHMQALP

SEQ ID NO: 867874 - protein, 9 aa, Homo Sapiens
GDPFCSIEC

SEQ ID NO: 867875 - protein, 9 aa, Homo Sapiens
VGTGLVGVA

SEQ ID NO: 867876 - protein, 9 aa, Homo Sapiens
WARLNLNGA

SEQ ID NO: 867877 - protein, 9 aa, Homo Sapiens
KVSPPGVMC

SEQ ID NO: 867878 - protein, 9 aa, Homo Sapiens
HYMKESVQL

SEQ ID NO: 867879 - protein, 9 aa, Homo Sapiens
IIILQRTAR

SEQ ID NO: 867880 - protein, 9 aa, Homo Sapiens
DEIIEEIIQ

SEQ ID NO: 867881 - protein, 9 aa, Homo Sapiens
MKTCHFHPD

SEQ ID NO: 867882 - protein, 9 aa, Homo Sapiens
GPYHYKFEN

SEQ ID NO: 867883 - protein, 9 aa, Homo Sapiens
MDYYQSNEF

SEQ ID NO: 867884 - protein, 9 aa, Homo Sapiens
FIVNSASYR

SEQ ID NO: 867885 - protein, 9 aa, Homo Sapiens
NSNKNILQC

SEQ ID NO: 867886 - protein, 9 aa, Homo Sapiens
EICLSDPGL

SEQ ID NO: 867887 - protein, 9 aa, Homo Sapiens
IKQLKEQAA

SEQ ID NO: 867888 - protein, 9 aa, Homo Sapiens
QHNSHDALD

SEQ ID NO: 867889 - protein, 9 aa, Homo Sapiens
STLIMWCRG

SEQ ID NO: 867890 - protein, 9 aa, Homo Sapiens
GNVVYKLFS

SEQ ID NO: 867891 - protein, 9 aa, Homo Sapiens
FQTFTVHQS

SEQ ID NO: 867892 - protein, 9 aa, Homo Sapiens
SPVFLDKKI

SEQ ID NO: 867893 - protein, 9 aa, Homo Sapiens
FQIGIKESL

SEQ ID NO: 867894 - protein, 9 aa, Homo Sapiens
FVTVNEVIE

SEQ ID NO: 867895 - protein, 9 aa, Homo Sapiens
PQPSPKQSP

SEQ ID NO: 867896 - protein, 9 aa, Homo Sapiens
NPRPKNIDV

SEQ ID NO: 867897 - protein, 9 aa, Homo Sapiens
QHGARYACQ

SEQ ID NO: 867898 - protein, 9 aa, Homo Sapiens
LSYAFTSPD

SEQ ID NO: 867899 - protein, 9 aa, Homo Sapiens
RGACVRTTD

SEQ ID NO: 867900 - protein, 9 aa, Homo Sapiens
EGYVSSNFV

SEQ ID NO: 867901 - protein, 9 aa, Homo Sapiens
KLTEISQRH

SEQ ID NO: 867902 - protein, 9 aa, Homo Sapiens
ECTEAEGHH

SEQ ID NO: 867903 - protein, 9 aa, Homo Sapiens
QRNSKAERL

SEQ ID NO: 867904 - protein, 9 aa, Homo Sapiens
ENKAVTFSI

SEQ ID NO: 867905 - protein, 9 aa, Homo Sapiens
YITSDTSGD

SEQ ID NO: 867906 - protein, 9 aa, Homo Sapiens
SINSLNKLV

SEQ ID NO: 867907 - protein, 9 aa, Homo Sapiens
TQSLSPMSG

SEQ ID NO: 867908 - protein, 9 aa, Homo Sapiens
CYEGKAALR

SEQ ID NO: 867909 - protein, 9 aa, Homo Sapiens
GSNSSQPQS

SEQ ID NO: 867910 - protein, 9 aa, Homo Sapiens
KHGLKKPSL

SEQ ID NO: 867911 - protein, 9 aa, Homo Sapiens
NKKENNNSN

SEQ ID NO: 867912 - protein, 9 aa, Homo Sapiens
ANGFLVCYL

SEQ ID NO: 867913 - protein, 9 aa, Homo Sapiens
HGGECSQLW

SEQ ID NO: 867914 - protein, 9 aa, Homo Sapiens
SLQMDSNKG

SEQ ID NO: 867915 - protein, 9 aa, Homo Sapiens
LSKLSEENF

SEQ ID NO: 867916 - protein, 9 aa, Homo Sapiens
LINSSAFSY

SEQ ID NO: 867917 - protein, 9 aa, Homo Sapiens
GAFCKTGVH

SEQ ID NO: 867918 - protein, 9 aa, Homo Sapiens
VLLWASELA

SEQ ID NO: 867919 - protein, 9 aa, Homo Sapiens
QYVNWACSG

SEQ ID NO: 867920 - protein, 9 aa, Homo Sapiens
TLYFPNPYN

SEQ ID NO: 867921 - protein, 9 aa, Homo Sapiens
TTVPSNHQN

SEQ ID NO: 867922 - protein, 9 aa, Homo Sapiens
RDSLQKRSV

SEQ ID NO: 867923 - protein, 9 aa, Homo Sapiens
TISKSKLHK

SEQ ID NO: 867924 - protein, 9 aa, Homo Sapiens
GNIANTSVK

SEQ ID NO: 867925 - protein, 9 aa, Homo Sapiens
FPLEEDMSL

SEQ ID NO: 867926 - protein, 9 aa, Homo Sapiens
ISFVGRMMQ

SEQ ID NO: 867927 - protein, 9 aa, Homo Sapiens
KLRPDDTKA

SEQ ID NO: 867928 - protein, 9 aa, Homo Sapiens
AAIWFQTYL

SEQ ID NO: 867929 - protein, 9 aa, Homo Sapiens
SFAVLPWGC

SEQ ID NO: 867930 - protein, 9 aa, Homo Sapiens
SDCGHRGSS

SEQ ID NO: 867931 - protein, 9 aa, Homo Sapiens
PDLFISQSF

SEQ ID NO: 867932 - protein, 9 aa, Homo Sapiens
QGAKIVFLA

SEQ ID NO: 867933 - protein, 9 aa, Homo Sapiens
RSCASTDVE

SEQ ID NO: 867934 - protein, 9 aa, Homo Sapiens
HVNLTTCPL

SEQ ID NO: 867935 - protein, 9 aa, Homo Sapiens
VLVDCILCD

SEQ ID NO: 867936 - protein, 9 aa, Homo Sapiens
DDHQNKINE

SEQ ID NO: 867937 - protein, 9 aa, Homo Sapiens
ESKTMASKH

SEQ ID NO: 867938 - protein, 9 aa, Homo Sapiens
SEELLVTDN

SEQ ID NO: 867939 - protein, 9 aa, Homo Sapiens
LSKPSLGDH

SEQ ID NO: 867940 - protein, 9 aa, Homo Sapiens
FSEVFFPNN

SEQ ID NO: 867941 - protein, 9 aa, Homo Sapiens
NQARLECDE

SEQ ID NO: 867942 - protein, 9 aa, Homo Sapiens
PVSYSFLFG

SEQ ID NO: 867943 - protein, 9 aa, Homo Sapiens
PCLPVFNVL

SEQ ID NO: 867944 - protein, 9 aa, Homo Sapiens
QSVTSRKKQ

SEQ ID NO: 867945 - protein, 9 aa, Homo Sapiens
HAVHTGKKP

SEQ ID NO: 867946 - protein, 9 aa, Homo Sapiens
SFNPSLYKA

SEQ ID NO: 867947 - protein, 9 aa, Homo Sapiens
CCKLDVDAP

SEQ ID NO: 867948 - protein, 9 aa, Homo Sapiens
MEGNNTWIT

SEQ ID NO: 867949 - protein, 9 aa, Homo Sapiens
NSGALEKDN

SEQ ID NO: 867950 - protein, 9 aa, Homo Sapiens
CPAEGVDSS

SEQ ID NO: 867951 - protein, 9 aa, Homo Sapiens
QAQAEDLSV

SEQ ID NO: 867952 - protein, 9 aa, Homo Sapiens
GTGRLFFKF

SEQ ID NO: 867953 - protein, 9 aa, Homo Sapiens
DSDNFLSSI

SEQ ID NO: 867954 - protein, 9 aa, Homo Sapiens
QENPLWTSL

SEQ ID NO: 867955 - protein, 9 aa, Homo Sapiens
KMHFAKGRQ

SEQ ID NO: 867956 - protein, 9 aa, Homo Sapiens
KKAENDLTL

SEQ ID NO: 867957 - protein, 9 aa, Homo Sapiens
KYPYFFWTV

SEQ ID NO: 867958 - protein, 9 aa, Homo Sapiens
DAKLATRAL

SEQ ID NO: 867959 - protein, 9 aa, Homo Sapiens
TLDSILLLG

SEQ ID NO: 867960 - protein, 9 aa, Homo Sapiens
VNNPPVMLF

SEQ ID NO: 867961 - protein, 9 aa, Homo Sapiens
QNALEIGFL

SEQ ID NO: 867962 - protein, 9 aa, Homo Sapiens
TAQATVTNI

SEQ ID NO: 867963 - protein, 9 aa, Homo Sapiens
SSCVSDPPV

SEQ ID NO: 867964 - protein, 9 aa, Homo Sapiens
ILNFYHTGR

SEQ ID NO: 867965 - protein, 9 aa, Homo Sapiens
FQIFSTVLI

SEQ ID NO: 867966 - protein, 9 aa, Homo Sapiens
QIQEQQNVL

SEQ ID NO: 867967 - protein, 9 aa, Homo Sapiens
FLHLVIGIK

SEQ ID NO: 867968 - protein, 9 aa, Homo Sapiens
YFCKGCKID

SEQ ID NO: 867969 - protein, 9 aa, Homo Sapiens
DPAERWHYR

SEQ ID NO: 867970 - protein, 9 aa, Homo Sapiens
HRKHMVFLG

SEQ ID NO: 867971 - protein, 9 aa, Homo Sapiens
NLTTHKNIH

SEQ ID NO: 867972 - protein, 9 aa, Homo Sapiens
KSLPVPTPP

SEQ ID NO: 867973 - protein, 9 aa, Homo Sapiens
AETQSSSNL

SEQ ID NO: 867974 - protein, 9 aa, Homo Sapiens
QKFAITLFE

SEQ ID NO: 867975 - protein, 9 aa, Homo Sapiens
LIFLWKKYQ

SEQ ID NO: 867976 - protein, 9 aa, Homo Sapiens
CWIYLCGFS

SEQ ID NO: 867977 - protein, 9 aa, Homo Sapiens
KNLESLNFS

SEQ ID NO: 867978 - protein, 9 aa, Homo Sapiens
QQMQQQAAT

SEQ ID NO: 867979 - protein, 9 aa, Homo Sapiens
MIGHISKKM

SEQ ID NO: 867980 - protein, 9 aa, Homo Sapiens
TAHKIIHNR

SEQ ID NO: 867981 - protein, 9 aa, Homo Sapiens
VQDHSNNLL

SEQ ID NO: 867982 - protein, 9 aa, Homo Sapiens
SLNGCRVTN

SEQ ID NO: 867983 - protein, 9 aa, Homo Sapiens
ILSAFSFVA

SEQ ID NO: 867984 - protein, 9 aa, Homo Sapiens
SSMETSIKP

SEQ ID NO: 867985 - protein, 9 aa, Homo Sapiens
LKEAENVWW

SEQ ID NO: 867986 - protein, 9 aa, Homo Sapiens
VCIKGAESE

SEQ ID NO: 867987 - protein, 9 aa, Homo Sapiens
KAKQLLETK

SEQ ID NO: 867988 - protein, 9 aa, Homo Sapiens
PCSRQSIWD

SEQ ID NO: 867989 - protein, 9 aa, Homo Sapiens
QSNPVRHLS

SEQ ID NO: 867990 - protein, 9 aa, Homo Sapiens
GPGQLRGED

SEQ ID NO: 867991 - protein, 9 aa, Homo Sapiens
TNDGRPPPA

SEQ ID NO: 867992 - protein, 9 aa, Homo Sapiens
NKFFLHIFF

SEQ ID NO: 867993 - protein, 9 aa, Homo Sapiens
MRKIAPEIL

SEQ ID NO: 867994 - protein, 9 aa, Homo Sapiens
DAAAKDSPG

SEQ ID NO: 867995 - protein, 9 aa, Homo Sapiens
EELSQRYQK

SEQ ID NO: 867996 - protein, 9 aa, Homo Sapiens
GYSSPTPCT

SEQ ID NO: 867997 - protein, 9 aa, Homo Sapiens
AKMKEKYEA

SEQ ID NO: 867998 - protein, 9 aa, Homo Sapiens
KVVDKSDRL

SEQ ID NO: 867999 - protein, 9 aa, Homo Sapiens
GFSGKLCEQ

SEQ ID NO: 868000 - protein, 9 aa, Homo Sapiens
VKQYPKFNS

SEQ ID NO: 868001 - protein, 9 aa, Homo Sapiens
DLKSNNICT

SEQ ID NO: 868002 - protein, 9 aa, Homo Sapiens
KCTPSPRLA

SEQ ID NO: 868003 - protein, 9 aa, Homo Sapiens
LRKRTKEPD

SEQ ID NO: 868004 - protein, 9 aa, Homo Sapiens
MDISNAPHN

SEQ ID NO: 868005 - protein, 9 aa, Homo Sapiens
RGTRFLRNE

SEQ ID NO: 868006 - protein, 9 aa, Homo Sapiens
RVDEEIVLR

SEQ ID NO: 868007 - protein, 9 aa, Homo Sapiens
YKTIKQYQQ

SEQ ID NO: 868008 - protein, 9 aa, Homo Sapiens
WKWSPANRP

SEQ ID NO: 868009 - protein, 9 aa, Homo Sapiens
PINLLESTL

SEQ ID NO: 868010 - protein, 9 aa, Homo Sapiens
LVSDFDCKE

SEQ ID NO: 868011 - protein, 9 aa, Homo Sapiens
LGLSLLHAN

SEQ ID NO: 868012 - protein, 9 aa, Homo Sapiens
VQLLLDRQC

SEQ ID NO: 868013 - protein, 9 aa, Homo Sapiens
GFINLPEFP

SEQ ID NO: 868014 - protein, 9 aa, Homo Sapiens
RYCVIIQAN

SEQ ID NO: 868015 - protein, 9 aa, Homo Sapiens
DTVVFLLSN

SEQ ID NO: 868016 - protein, 9 aa, Homo Sapiens
GGKKRLCLP

SEQ ID NO: 868017 - protein, 9 aa, Homo Sapiens
LKICGFGLA

SEQ ID NO: 868018 - protein, 9 aa, Homo Sapiens
FIEDYILPD

SEQ ID NO: 868019 - protein, 9 aa, Homo Sapiens
NEEIAQVQT

SEQ ID NO: 868020 - protein, 9 aa, Homo Sapiens
LRTLFLHTR

SEQ ID NO: 868021 - protein, 9 aa, Homo Sapiens
NSQNNTPEC

SEQ ID NO: 868022 - protein, 9 aa, Homo Sapiens
KVVEYEYEA

SEQ ID NO: 868023 - protein, 9 aa, Homo Sapiens
YCEDIDECS

SEQ ID NO: 868024 - protein, 9 aa, Homo Sapiens
IKRLCNPSL

SEQ ID NO: 868025 - protein, 9 aa, Homo Sapiens
QMRKIAPEI

SEQ ID NO: 868026 - protein, 9 aa, Homo Sapiens
KKRRIIKLP

SEQ ID NO: 868027 - protein, 9 aa, Homo Sapiens
KINECYKPT

SEQ ID NO: 868028 - protein, 9 aa, Homo Sapiens
ILTENQCLK

SEQ ID NO: 868029 - protein, 9 aa, Homo Sapiens
IPPTKAPDA

SEQ ID NO: 868030 - protein, 9 aa, Homo Sapiens
EGGLVLPSR

SEQ ID NO: 868031 - protein, 9 aa, Homo Sapiens
FVIDVGYKR

SEQ ID NO: 868032 - protein, 9 aa, Homo Sapiens
VPLGLNARE

SEQ ID NO: 868033 - protein, 9 aa, Homo Sapiens
VTSVLCKSV

SEQ ID NO: 868034 - protein, 9 aa, Homo Sapiens
KAGKGQTGV

SEQ ID NO: 868035 - protein, 9 aa, Homo Sapiens
SAPVINLAE

SEQ ID NO: 868036 - protein, 9 aa, Homo Sapiens
VCSNLTIHQ

SEQ ID NO: 868037 - protein, 9 aa, Homo Sapiens
LQFRPHTGK

SEQ ID NO: 868038 - protein, 9 aa, Homo Sapiens
LERDTLSIQ

SEQ ID NO: 868039 - protein, 9 aa, Homo Sapiens
LPVAQISAG

SEQ ID NO: 868040 - protein, 9 aa, Homo Sapiens
FVDIKFTGD

SEQ ID NO: 868041 - protein, 9 aa, Homo Sapiens
GYRRKAGIS

SEQ ID NO: 868042 - protein, 9 aa, Homo Sapiens
ICDMDTDGG

SEQ ID NO: 868043 - protein, 9 aa, Homo Sapiens
ELDKRIEES

SEQ ID NO: 868044 - protein, 9 aa, Homo Sapiens
LIANLPPEL

SEQ ID NO: 868045 - protein, 9 aa, Homo Sapiens
PVAYHANDL

SEQ ID NO: 868046 - protein, 9 aa, Homo Sapiens
TSLGILFRG

SEQ ID NO: 868047 - protein, 9 aa, Homo Sapiens
NHPNHSPPP

SEQ ID NO: 868048 - protein, 9 aa, Homo Sapiens
IELSQEEWE

SEQ ID NO: 868049 - protein, 9 aa, Homo Sapiens
GIFCVLLNL

SEQ ID NO: 868050 - protein, 9 aa, Homo Sapiens
RTMATTALA

SEQ ID NO: 868051 - protein, 9 aa, Homo Sapiens
VQKVILVIL

SEQ ID NO: 868052 - protein, 9 aa, Homo Sapiens
GMTPGLGHQ

SEQ ID NO: 868053 - protein, 9 aa, Homo Sapiens
DIHIPQIDV

SEQ ID NO: 868054 - protein, 9 aa, Homo Sapiens
NWSDSDSST

SEQ ID NO: 868055 - protein, 9 aa, Homo Sapiens
WQNPMSTKK

SEQ ID NO: 868056 - protein, 9 aa, Homo Sapiens
SSLFALQTL

SEQ ID NO: 868057 - protein, 9 aa, Homo Sapiens
LRTGLGVIH

SEQ ID NO: 868058 - protein, 9 aa, Homo Sapiens
LAIHIQNHT

SEQ ID NO: 868059 - protein, 9 aa, Homo Sapiens
DGVQQIPIE

SEQ ID NO: 868060 - protein, 9 aa, Homo Sapiens
AWICEGLEK

SEQ ID NO: 868061 - protein, 9 aa, Homo Sapiens
TKIVFVERR

SEQ ID NO: 868062 - protein, 9 aa, Homo Sapiens
IMCRGTHVY

SEQ ID NO: 868063 - protein, 9 aa, Homo Sapiens
YKTVGGLIY

SEQ ID NO: 868064 - protein, 9 aa, Homo Sapiens
VCKLQSGNQ

SEQ ID NO: 868065 - protein, 9 aa, Homo Sapiens
NRPYFKRSN

SEQ ID NO: 868066 - protein, 9 aa, Homo Sapiens
FIILFLNKQ

SEQ ID NO: 868067 - protein, 9 aa, Homo Sapiens
QWVAGVNQD

SEQ ID NO: 868068 - protein, 9 aa, Homo Sapiens
YYNHLYKGE

SEQ ID NO: 868069 - protein, 9 aa, Homo Sapiens
SICKHKIDL

SEQ ID NO: 868070 - protein, 9 aa, Homo Sapiens
LALMCELMD

SEQ ID NO: 868071 - protein, 9 aa, Homo Sapiens
KYIEHLKEN

SEQ ID NO: 868072 - protein, 9 aa, Homo Sapiens
DSKLPASDQ

SEQ ID NO: 868073 - protein, 9 aa, Homo Sapiens
IYCIIVVCS

SEQ ID NO: 868074 - protein, 9 aa, Homo Sapiens
LVCMDLLVR

SEQ ID NO: 868075 - protein, 9 aa, Homo Sapiens
KNHTTIQSV

SEQ ID NO: 868076 - protein, 9 aa, Homo Sapiens
EGVPGKWQQ

SEQ ID NO: 868077 - protein, 9 aa, Homo Sapiens
ITKKEVNQA

SEQ ID NO: 868078 - protein, 9 aa, Homo Sapiens
KSICKVFVS

SEQ ID NO: 868079 - protein, 9 aa, Homo Sapiens
FWHPSYVGW

SEQ ID NO: 868080 - protein, 9 aa, Homo Sapiens
RYTYNNTVI

SEQ ID NO: 868081 - protein, 9 aa, Homo Sapiens
GQNNLTAPV

SEQ ID NO: 868082 - protein, 9 aa, Homo Sapiens
HLIRHHQIH

SEQ ID NO: 868083 - protein, 9 aa, Homo Sapiens
ENIKLNKKS

SEQ ID NO: 868084 - protein, 9 aa, Homo Sapiens
INLAESLVA

SEQ ID NO: 868085 - protein, 9 aa, Homo Sapiens
LQTSFQDHA

SEQ ID NO: 868086 - protein, 9 aa, Homo Sapiens
SALPMREII

SEQ ID NO: 868087 - protein, 9 aa, Homo Sapiens
ICRSTLSQH

SEQ ID NO: 868088 - protein, 9 aa, Homo Sapiens
AESNLFLAE

SEQ ID NO: 868089 - protein, 9 aa, Homo Sapiens
KKKLKAIKQ

SEQ ID NO: 868090 - protein, 9 aa, Homo Sapiens
SKETLNLDD

SEQ ID NO: 868091 - protein, 9 aa, Homo Sapiens
EDNNIVVDD

SEQ ID NO: 868092 - protein, 9 aa, Homo Sapiens
LKDVDNILL

SEQ ID NO: 868093 - protein, 9 aa, Homo Sapiens
CEKQKLAYK

SEQ ID NO: 868094 - protein, 9 aa, Homo Sapiens
PPTYYNAWS

SEQ ID NO: 868095 - protein, 9 aa, Homo Sapiens
HIPIKINSI

SEQ ID NO: 868096 - protein, 9 aa, Homo Sapiens
NELNPMGDT

SEQ ID NO: 868097 - protein, 9 aa, Homo Sapiens
KNKLFFKKG

SEQ ID NO: 868098 - protein, 9 aa, Homo Sapiens
FVRSMAMGS

SEQ ID NO: 868099 - protein, 9 aa, Homo Sapiens
LLTLPVLPP

SEQ ID NO: 868100 - protein, 9 aa, Homo Sapiens
NGRLRNLIL

SEQ ID NO: 868101 - protein, 9 aa, Homo Sapiens
LQKKDFLEP

SEQ ID NO: 868102 - protein, 9 aa, Homo Sapiens
LLTPQHLNQ

SEQ ID NO: 868103 - protein, 9 aa, Homo Sapiens
LLVDGNMNL

SEQ ID NO: 868104 - protein, 9 aa, Homo Sapiens
KEEKMWRLE

SEQ ID NO: 868105 - protein, 9 aa, Homo Sapiens
EEEERMKQK

SEQ ID NO: 868106 - protein, 9 aa, Homo Sapiens
ELALQGCGG

SEQ ID NO: 868107 - protein, 9 aa, Homo Sapiens
RSKSPRWRR

SEQ ID NO: 868108 - protein, 9 aa, Homo Sapiens
GASTSPPCA

SEQ ID NO: 868109 - protein, 9 aa, Homo Sapiens
CWHNKGKNA

SEQ ID NO: 868110 - protein, 9 aa, Homo Sapiens
NLMNVVVLT

SEQ ID NO: 868111 - protein, 9 aa, Homo Sapiens
LLISQFRGP

SEQ ID NO: 868112 - protein, 9 aa, Homo Sapiens
KRYHKDIFG

SEQ ID NO: 868113 - protein, 9 aa, Homo Sapiens
PQTTVNPDC

SEQ ID NO: 868114 - protein, 9 aa, Homo Sapiens
CKNEKKNKV

SEQ ID NO: 868115 - protein, 9 aa, Homo Sapiens
QNQDNKLLK

SEQ ID NO: 868116 - protein, 9 aa, Homo Sapiens
GIVTASVGH

SEQ ID NO: 868117 - protein, 9 aa, Homo Sapiens
VTFQINLTV

SEQ ID NO: 868118 - protein, 9 aa, Homo Sapiens
THHTDTNMH

SEQ ID NO: 868119 - protein, 9 aa, Homo Sapiens
KAENDLTLL

SEQ ID NO: 868120 - protein, 9 aa, Homo Sapiens
FTQTAVFQT

SEQ ID NO: 868121 - protein, 9 aa, Homo Sapiens
KLLIMKILW

SEQ ID NO: 868122 - protein, 9 aa, Homo Sapiens
AALQEAVTK

SEQ ID NO: 868123 - protein, 9 aa, Homo Sapiens
TVNPDCIKQ

SEQ ID NO: 868124 - protein, 9 aa, Homo Sapiens
ALMGTYVTS

SEQ ID NO: 868125 - protein, 9 aa, Homo Sapiens
KKAVVICHL

SEQ ID NO: 868126 - protein, 9 aa, Homo Sapiens
KKRSCASTD

SEQ ID NO: 868127 - protein, 9 aa, Homo Sapiens
QWMRLCTSV

SEQ ID NO: 868128 - protein, 9 aa, Homo Sapiens
SEQHPGAST

SEQ ID NO: 868129 - protein, 9 aa, Homo Sapiens
HPCNLKGIG

SEQ ID NO: 868130 - protein, 9 aa, Homo Sapiens
KLQSQKDSD

SEQ ID NO: 868131 - protein, 9 aa, Homo Sapiens
ASSTGGGLS

SEQ ID NO: 868132 - protein, 9 aa, Homo Sapiens
PASDQTSVK

SEQ ID NO: 868133 - protein, 9 aa, Homo Sapiens
KGIDYYNTI

SEQ ID NO: 868134 - protein, 9 aa, Homo Sapiens
VLLGISCFF

SEQ ID NO: 868135 - protein, 9 aa, Homo Sapiens
TFSPGAQSQ

SEQ ID NO: 868136 - protein, 9 aa, Homo Sapiens
AHYNTTADE

SEQ ID NO: 868137 - protein, 9 aa, Homo Sapiens
KPRNNKRKT

SEQ ID NO: 868138 - protein, 9 aa, Homo Sapiens
FPRFFMVVK

SEQ ID NO: 868139 - protein, 9 aa, Homo Sapiens
SQEDEQDAH

SEQ ID NO: 868140 - protein, 9 aa, Homo Sapiens
CLILLILSV

SEQ ID NO: 868141 - protein, 9 aa, Homo Sapiens
VNPFSGSHL

SEQ ID NO: 868142 - protein, 9 aa, Homo Sapiens
LIHLMFKTF

SEQ ID NO: 868143 - protein, 9 aa, Homo Sapiens
SSKPVSYSF

SEQ ID NO: 868144 - protein, 9 aa, Homo Sapiens
PYKENYGHI

SEQ ID NO: 868145 - protein, 9 aa, Homo Sapiens
DAEPDSWGS

SEQ ID NO: 868146 - protein, 9 aa, Homo Sapiens
DLIRQIECL

SEQ ID NO: 868147 - protein, 9 aa, Homo Sapiens
PAGNAATVC

SEQ ID NO: 868148 - protein, 9 aa, Homo Sapiens
DLKPDNLLY

SEQ ID NO: 868149 - protein, 9 aa, Homo Sapiens
RDHLLTCGV

SEQ ID NO: 868150 - protein, 9 aa, Homo Sapiens
DIANLFSPL

SEQ ID NO: 868151 - protein, 9 aa, Homo Sapiens
DKYGINDND

SEQ ID NO: 868152 - protein, 9 aa, Homo Sapiens
KMLEELSLV

SEQ ID NO: 868153 - protein, 9 aa, Homo Sapiens
YTTKKYREK

SEQ ID NO: 868154 - protein, 9 aa, Homo Sapiens
RIQVLHNMV

SEQ ID NO: 868155 - protein, 9 aa, Homo Sapiens
VGKNCVIGC

SEQ ID NO: 868156 - protein, 9 aa, Homo Sapiens
KPLGTAEPI

SEQ ID NO: 868157 - protein, 9 aa, Homo Sapiens
GESLSSRTS

SEQ ID NO: 868158 - protein, 9 aa, Homo Sapiens
SLEQDLKVV

SEQ ID NO: 868159 - protein, 9 aa, Homo Sapiens
TNEHLACIQ

SEQ ID NO: 868160 - protein, 9 aa, Homo Sapiens
AKWEALNLK

SEQ ID NO: 868161 - protein, 9 aa, Homo Sapiens
TGIFCVLLN

SEQ ID NO: 868162 - protein, 9 aa, Homo Sapiens
RTHQVVQQK

SEQ ID NO: 868163 - protein, 9 aa, Homo Sapiens
VKRDKQDET

SEQ ID NO: 868164 - protein, 9 aa, Homo Sapiens
IAYSRKPWD

SEQ ID NO: 868165 - protein, 9 aa, Homo Sapiens
LYKLVQYAG

SEQ ID NO: 868166 - protein, 9 aa, Homo Sapiens
LSEFIQALS

SEQ ID NO: 868167 - protein, 9 aa, Homo Sapiens
INDEEIKSL

SEQ ID NO: 868168 - protein, 9 aa, Homo Sapiens
NVGFKLNAQ

SEQ ID NO: 868169 - protein, 9 aa, Homo Sapiens
QVNCKDARA

SEQ ID NO: 868170 - protein, 9 aa, Homo Sapiens
PEDQLSKDK

SEQ ID NO: 868171 - protein, 9 aa, Homo Sapiens
VPKTAEHFR

SEQ ID NO: 868172 - protein, 9 aa, Homo Sapiens
LRETVLESL

SEQ ID NO: 868173 - protein, 9 aa, Homo Sapiens
PETFCGAEL

SEQ ID NO: 868174 - protein, 9 aa, Homo Sapiens
KECRLQTEE

SEQ ID NO: 868175 - protein, 9 aa, Homo Sapiens
VFKKESGSC

SEQ ID NO: 868176 - protein, 9 aa, Homo Sapiens
DTNLTCQVK

SEQ ID NO: 868177 - protein, 9 aa, Homo Sapiens
TLTTLPTAM

SEQ ID NO: 868178 - protein, 9 aa, Homo Sapiens
LLQAVLWAS

SEQ ID NO: 868179 - protein, 9 aa, Homo Sapiens
IERMVRTDY

SEQ ID NO: 868180 - protein, 9 aa, Homo Sapiens
EGEAGNESG

SEQ ID NO: 868181 - protein, 9 aa, Homo Sapiens
FNVISGARW

SEQ ID NO: 868182 - protein, 9 aa, Homo Sapiens
QEKLNKFMI

SEQ ID NO: 868183 - protein, 9 aa, Homo Sapiens
PEEQHHIGD

SEQ ID NO: 868184 - protein, 9 aa, Homo Sapiens
KHNHQSLVP

SEQ ID NO: 868185 - protein, 9 aa, Homo Sapiens
VWSSNGTAN

SEQ ID NO: 868186 - protein, 9 aa, Homo Sapiens
LKSKYCEDI

SEQ ID NO: 868187 - protein, 9 aa, Homo Sapiens
SVDVEDGKF

SEQ ID NO: 868188 - protein, 9 aa, Homo Sapiens
LLKNEQFLL

SEQ ID NO: 868189 - protein, 9 aa, Homo Sapiens
RTLLESSKR

SEQ ID NO: 868190 - protein, 9 aa, Homo Sapiens
YLRYILKQD

SEQ ID NO: 868191 - protein, 9 aa, Homo Sapiens
SPSQGAVSS

SEQ ID NO: 868192 - protein, 9 aa, Homo Sapiens
WLLQNSETS

SEQ ID NO: 868193 - protein, 9 aa, Homo Sapiens
VRLALEELQ

SEQ ID NO: 868194 - protein, 9 aa, Homo Sapiens
NTLNGHEKD

SEQ ID NO: 868195 - protein, 9 aa, Homo Sapiens
VQYIENSDS

SEQ ID NO: 868196 - protein, 9 aa, Homo Sapiens
VYCLLPYCS

SEQ ID NO: 868197 - protein, 9 aa, Homo Sapiens
LRRCHRFIP

SEQ ID NO: 868198 - protein, 9 aa, Homo Sapiens
QAVVWEHFD

SEQ ID NO: 868199 - protein, 9 aa, Homo Sapiens
GGDPIQKGA

SEQ ID NO: 868200 - protein, 9 aa, Homo Sapiens
TSSDSGHSM

SEQ ID NO: 868201 - protein, 9 aa, Homo Sapiens
KNILQCPKC

SEQ ID NO: 868202 - protein, 9 aa, Homo Sapiens
LCKILCMPH

SEQ ID NO: 868203 - protein, 9 aa, Homo Sapiens
IKWTKLTLD

SEQ ID NO: 868204 - protein, 9 aa, Homo Sapiens
VKLMFKIIG

SEQ ID NO: 868205 - protein, 9 aa, Homo Sapiens
SDLWYLSLE

SEQ ID NO: 868206 - protein, 9 aa, Homo Sapiens
PNHDGNYLF

SEQ ID NO: 868207 - protein, 9 aa, Homo Sapiens
KQGLVHQTH

SEQ ID NO: 868208 - protein, 9 aa, Homo Sapiens
GNETEANSI

SEQ ID NO: 868209 - protein, 9 aa, Homo Sapiens
DQVLYTASH

SEQ ID NO: 868210 - protein, 9 aa, Homo Sapiens
AVFYTMITY

SEQ ID NO: 868211 - protein, 9 aa, Homo Sapiens
KTSVKPSVS

SEQ ID NO: 868212 - protein, 9 aa, Homo Sapiens
TVAGTLVVA

SEQ ID NO: 868213 - protein, 9 aa, Homo Sapiens
PQSEPDYLK

SEQ ID NO: 868214 - protein, 9 aa, Homo Sapiens
HFDKVRNQC

SEQ ID NO: 868215 - protein, 9 aa, Homo Sapiens
DWCLSPPHP

SEQ ID NO: 868216 - protein, 9 aa, Homo Sapiens
DDSENTFSP

SEQ ID NO: 868217 - protein, 9 aa, Homo Sapiens
LSLIGIQER

SEQ ID NO: 868218 - protein, 9 aa, Homo Sapiens
VTEARHDHT

SEQ ID NO: 868219 - protein, 9 aa, Homo Sapiens
QDNLHDQVQ

SEQ ID NO: 868220 - protein, 9 aa, Homo Sapiens
INQDKIKDT

SEQ ID NO: 868221 - protein, 9 aa, Homo Sapiens
CYPPLLENP

SEQ ID NO: 868222 - protein, 9 aa, Homo Sapiens
IKDTEDEDK

SEQ ID NO: 868223 - protein, 9 aa, Homo Sapiens
LNTRFSRPS

SEQ ID NO: 868224 - protein, 9 aa, Homo Sapiens
IKMAVCKIK

SEQ ID NO: 868225 - protein, 9 aa, Homo Sapiens
FLDDHQNKI

SEQ ID NO: 868226 - protein, 9 aa, Homo Sapiens
LCTPSTTSA

SEQ ID NO: 868227 - protein, 9 aa, Homo Sapiens
SRLMGTNVR

SEQ ID NO: 868228 - protein, 9 aa, Homo Sapiens
FIFQILLLG

SEQ ID NO: 868229 - protein, 9 aa, Homo Sapiens
REPQRHRQK

SEQ ID NO: 868230 - protein, 9 aa, Homo Sapiens
FNRPHAFDF

SEQ ID NO: 868231 - protein, 9 aa, Homo Sapiens
LYDADSEFD

SEQ ID NO: 868232 - protein, 9 aa, Homo Sapiens
PCEKGDKLQ

SEQ ID NO: 868233 - protein, 9 aa, Homo Sapiens
EMDTNLQGR

SEQ ID NO: 868234 - protein, 9 aa, Homo Sapiens
VTVLTSLAS

SEQ ID NO: 868235 - protein, 9 aa, Homo Sapiens
IIQTKAFQE

SEQ ID NO: 868236 - protein, 9 aa, Homo Sapiens
TICYTLLPF

SEQ ID NO: 868237 - protein, 9 aa, Homo Sapiens
WRNKWAQEP

SEQ ID NO: 868238 - protein, 9 aa, Homo Sapiens
QFRPHTGKA

SEQ ID NO: 868239 - protein, 9 aa, Homo Sapiens
HLKNRINLV

SEQ ID NO: 868240 - protein, 9 aa, Homo Sapiens
ILQNFNLKY

SEQ ID NO: 868241 - protein, 9 aa, Homo Sapiens
KYVSLPVPD

SEQ ID NO: 868242 - protein, 9 aa, Homo Sapiens
RIPKIQTLL

SEQ ID NO: 868243 - protein, 9 aa, Homo Sapiens
SPQHYLEEL

SEQ ID NO: 868244 - protein, 9 aa, Homo Sapiens
RFSISFQHP

SEQ ID NO: 868245 - protein, 9 aa, Homo Sapiens
LGLCALDYL

SEQ ID NO: 868246 - protein, 9 aa, Homo Sapiens
SPKRPQSPG

SEQ ID NO: 868247 - protein, 9 aa, Homo Sapiens
AEKAPEPNL

SEQ ID NO: 868248 - protein, 9 aa, Homo Sapiens
VSIIHPGSV

SEQ ID NO: 868249 - protein, 9 aa, Homo Sapiens
VSHLKFKHE

SEQ ID NO: 868250 - protein, 9 aa, Homo Sapiens
HQLDANLNM

SEQ ID NO: 868251 - protein, 9 aa, Homo Sapiens
ICGFGLARV

SEQ ID NO: 868252 - protein, 9 aa, Homo Sapiens
YKLLSQAES

SEQ ID NO: 868253 - protein, 9 aa, Homo Sapiens
KILLKIPES

SEQ ID NO: 868254 - protein, 9 aa, Homo Sapiens
FQTLNINGQ

SEQ ID NO: 868255 - protein, 9 aa, Homo Sapiens
LLGRLCGDK

SEQ ID NO: 868256 - protein, 9 aa, Homo Sapiens
HPVWSAVVR

SEQ ID NO: 868257 - protein, 9 aa, Homo Sapiens
KNTVKCSLY

SEQ ID NO: 868258 - protein, 9 aa, Homo Sapiens
QLFSVGQAA

SEQ ID NO: 868259 - protein, 9 aa, Homo Sapiens
YSKQVDNRF

SEQ ID NO: 868260 - protein, 9 aa, Homo Sapiens
QNGAFIWNV

SEQ ID NO: 868261 - protein, 9 aa, Homo Sapiens
VFEAGTLVT

SEQ ID NO: 868262 - protein, 9 aa, Homo Sapiens
SNEHLSLMM

SEQ ID NO: 868263 - protein, 9 aa, Homo Sapiens
PQHEIIITV

SEQ ID NO: 868264 - protein, 9 aa, Homo Sapiens
TIGYLNYHD

SEQ ID NO: 868265 - protein, 9 aa, Homo Sapiens
SLNEAIQNI

SEQ ID NO: 868266 - protein, 9 aa, Homo Sapiens
ITLNCPRNA

SEQ ID NO: 868267 - protein, 9 aa, Homo Sapiens
NKNYLIEMM

SEQ ID NO: 868268 - protein, 9 aa, Homo Sapiens
EISGCCSGE

SEQ ID NO: 868269 - protein, 9 aa, Homo Sapiens
LCGDKLPEV

SEQ ID NO: 868270 - protein, 9 aa, Homo Sapiens
ARPIFLCLL

SEQ ID NO: 868271 - protein, 9 aa, Homo Sapiens
MRLFDDNGQ

SEQ ID NO: 868272 - protein, 9 aa, Homo Sapiens
MERFIFPAP

SEQ ID NO: 868273 - protein, 9 aa, Homo Sapiens
QDPQHEIII

SEQ ID NO: 868274 - protein, 9 aa, Homo Sapiens
FKINVPKPK

SEQ ID NO: 868275 - protein, 9 aa, Homo Sapiens
LQSQVKYTE

SEQ ID NO: 868276 - protein, 9 aa, Homo Sapiens
LGICSFADA

SEQ ID NO: 868277 - protein, 9 aa, Homo Sapiens
AIWFQTYLH

SEQ ID NO: 868278 - protein, 9 aa, Homo Sapiens
AATKVSLST

SEQ ID NO: 868279 - protein, 9 aa, Homo Sapiens
DLFRYFVNR

SEQ ID NO: 868280 - protein, 9 aa, Homo Sapiens
PTPPGEMGT

SEQ ID NO: 868281 - protein, 9 aa, Homo Sapiens
RSLRNLTAD

SEQ ID NO: 868282 - protein, 9 aa, Homo Sapiens
ITQRMWNQS

SEQ ID NO: 868283 - protein, 9 aa, Homo Sapiens
DFNWTAVLA

SEQ ID NO: 868284 - protein, 9 aa, Homo Sapiens
IQESEVFQV

SEQ ID NO: 868285 - protein, 9 aa, Homo Sapiens
LCSVLHTLA

SEQ ID NO: 868286 - protein, 9 aa, Homo Sapiens
RKFHSIRGE

SEQ ID NO: 868287 - protein, 9 aa, Homo Sapiens
GLNAREESS

SEQ ID NO: 868288 - protein, 9 aa, Homo Sapiens
PLHSGEWAN

SEQ ID NO: 868289 - protein, 9 aa, Homo Sapiens
LGEVLFDIS

SEQ ID NO: 868290 - protein, 9 aa, Homo Sapiens
VSPPGVMCL

SEQ ID NO: 868291 - protein, 9 aa, Homo Sapiens
IKLPVENSG

SEQ ID NO: 868292 - protein, 9 aa, Homo Sapiens
RELFGKDAQ

SEQ ID NO: 868293 - protein, 9 aa, Homo Sapiens
KFILHVFQG

SEQ ID NO: 868294 - protein, 9 aa, Homo Sapiens
ILCYEGKAA

SEQ ID NO: 868295 - protein, 9 aa, Homo Sapiens
QSGGKIWRP

SEQ ID NO: 868296 - protein, 9 aa, Homo Sapiens
QSLHLQDHQ

SEQ ID NO: 868297 - protein, 9 aa, Homo Sapiens
IDESSELRF

SEQ ID NO: 868298 - protein, 9 aa, Homo Sapiens
YLICYQRKH

SEQ ID NO: 868299 - protein, 9 aa, Homo Sapiens
TIEEVCYFF

SEQ ID NO: 868300 - protein, 9 aa, Homo Sapiens
PNHDKVASI

SEQ ID NO: 868301 - protein, 9 aa, Homo Sapiens
CSLCVSNGW

SEQ ID NO: 868302 - protein, 9 aa, Homo Sapiens
PSQRFEEYL

SEQ ID NO: 868303 - protein, 9 aa, Homo Sapiens
TDNGKDKEQ

SEQ ID NO: 868304 - protein, 9 aa, Homo Sapiens
SLAENQLLT

SEQ ID NO: 868305 - protein, 9 aa, Homo Sapiens
DFLSSSTEK

SEQ ID NO: 868306 - protein, 9 aa, Homo Sapiens
AVYEEFWRG

SEQ ID NO: 868307 - protein, 9 aa, Homo Sapiens
METSPLREE

SEQ ID NO: 868308 - protein, 9 aa, Homo Sapiens
LEHKDDKLQ

SEQ ID NO: 868309 - protein, 9 aa, Homo Sapiens
KARTSKEQE

SEQ ID NO: 868310 - protein, 9 aa, Homo Sapiens
NCKDARACV

SEQ ID NO: 868311 - protein, 9 aa, Homo Sapiens
TNNPHLPKK

SEQ ID NO: 868312 - protein, 9 aa, Homo Sapiens
QKQHIGEQF

SEQ ID NO: 868313 - protein, 9 aa, Homo Sapiens
SFKPPQQSI

SEQ ID NO: 868314 - protein, 9 aa, Homo Sapiens
QSLPVSSRV

SEQ ID NO: 868315 - protein, 9 aa, Homo Sapiens
VLALCVIYY

SEQ ID NO: 868316 - protein, 9 aa, Homo Sapiens
IVKIFVQKK

SEQ ID NO: 868317 - protein, 9 aa, Homo Sapiens
NQMRKIAPE

SEQ ID NO: 868318 - protein, 9 aa, Homo Sapiens
MMAQTHSGL

SEQ ID NO: 868319 - protein, 9 aa, Homo Sapiens
DGSITIPPC

SEQ ID NO: 868320 - protein, 9 aa, Homo Sapiens
NMMEKIQQE

SEQ ID NO: 868321 - protein, 9 aa, Homo Sapiens
SITLCWEVP

SEQ ID NO: 868322 - protein, 9 aa, Homo Sapiens
TAQACLDET

SEQ ID NO: 868323 - protein, 9 aa, Homo Sapiens
IHPPTDQGF

SEQ ID NO: 868324 - protein, 9 aa, Homo Sapiens
TKQVITFLK

SEQ ID NO: 868325 - protein, 9 aa, Homo Sapiens
ELYNKFPEP

SEQ ID NO: 868326 - protein, 9 aa, Homo Sapiens
GYLVEILNG

SEQ ID NO: 868327 - protein, 9 aa, Homo Sapiens
KNLCCQSFK

SEQ ID NO: 868328 - protein, 9 aa, Homo Sapiens
ADFSVSLII

SEQ ID NO: 868329 - protein, 9 aa, Homo Sapiens
RYGNSINVV

SEQ ID NO: 868330 - protein, 9 aa, Homo Sapiens
QSENKRLQD

SEQ ID NO: 868331 - protein, 9 aa, Homo Sapiens
SVLIQHQII

SEQ ID NO: 868332 - protein, 9 aa, Homo Sapiens
IQFDDFANV

SEQ ID NO: 868333 - protein, 9 aa, Homo Sapiens
KLLQCELES

SEQ ID NO: 868334 - protein, 9 aa, Homo Sapiens
ECNRIDASV

SEQ ID NO: 868335 - protein, 9 aa, Homo Sapiens
GKIWRPANV

SEQ ID NO: 868336 - protein, 9 aa, Homo Sapiens
NAESLELEG

SEQ ID NO: 868337 - protein, 9 aa, Homo Sapiens
VDNKHCYLL

SEQ ID NO: 868338 - protein, 9 aa, Homo Sapiens
ACNDIQINI

SEQ ID NO: 868339 - protein, 9 aa, Homo Sapiens
LFKGHPNLI

SEQ ID NO: 868340 - protein, 9 aa, Homo Sapiens
EDSSSPEIT

SEQ ID NO: 868341 - protein, 9 aa, Homo Sapiens
QIAAEGING

SEQ ID NO: 868342 - protein, 9 aa, Homo Sapiens
IKHSLHQKK

SEQ ID NO: 868343 - protein, 9 aa, Homo Sapiens
ITLNGTDTI

SEQ ID NO: 868344 - protein, 9 aa, Homo Sapiens
QIPQSYPEG

SEQ ID NO: 868345 - protein, 9 aa, Homo Sapiens
CLEGFKGKN

SEQ ID NO: 868346 - protein, 9 aa, Homo Sapiens
RLISIFFDI

SEQ ID NO: 868347 - protein, 9 aa, Homo Sapiens
PPTNKQKEI

SEQ ID NO: 868348 - protein, 9 aa, Homo Sapiens
ECLKKVSEE

SEQ ID NO: 868349 - protein, 9 aa, Homo Sapiens
ANTINTFWI

SEQ ID NO: 868350 - protein, 9 aa, Homo Sapiens
MNSFQQQPL

SEQ ID NO: 868351 - protein, 9 aa, Homo Sapiens
VNASCEEVD

SEQ ID NO: 868352 - protein, 9 aa, Homo Sapiens
QMRFFLMLG

SEQ ID NO: 868353 - protein, 9 aa, Homo Sapiens
IDLILNNGL

SEQ ID NO: 868354 - protein, 9 aa, Homo Sapiens
YITQFTSQF

SEQ ID NO: 868355 - protein, 9 aa, Homo Sapiens
LFQILLEKR

SEQ ID NO: 868356 - protein, 9 aa, Homo Sapiens
NQKEDTWAL

SEQ ID NO: 868357 - protein, 9 aa, Homo Sapiens
GNFLGQMPI

SEQ ID NO: 868358 - protein, 9 aa, Homo Sapiens
NKHLAGVLK

SEQ ID NO: 868359 - protein, 9 aa, Homo Sapiens
DYLYYLSVN

SEQ ID NO: 868360 - protein, 9 aa, Homo Sapiens
ICTTANTEP

SEQ ID NO: 868361 - protein, 9 aa, Homo Sapiens
RFSEDDPEC

SEQ ID NO: 868362 - protein, 9 aa, Homo Sapiens
RRDTLITEE

SEQ ID NO: 868363 - protein, 9 aa, Homo Sapiens
DIKHRLGFL

SEQ ID NO: 868364 - protein, 9 aa, Homo Sapiens
LCQDEQLRS

SEQ ID NO: 868365 - protein, 9 aa, Homo Sapiens
LLRSGEYLH

SEQ ID NO: 868366 - protein, 9 aa, Homo Sapiens
WEIRYTHEG

SEQ ID NO: 868367 - protein, 9 aa, Homo Sapiens
ASKHSAWPA

SEQ ID NO: 868368 - protein, 9 aa, Homo Sapiens
ISSAVYVNN

SEQ ID NO: 868369 - protein, 9 aa, Homo Sapiens
TQLEQEIAT

SEQ ID NO: 868370 - protein, 9 aa, Homo Sapiens
QWLIEREKE

SEQ ID NO: 868371 - protein, 9 aa, Homo Sapiens
PFPAFKPWL

SEQ ID NO: 868372 - protein, 9 aa, Homo Sapiens
TQHVFRGQP

SEQ ID NO: 868373 - protein, 9 aa, Homo Sapiens
SLCHPVWSA

SEQ ID NO: 868374 - protein, 9 aa, Homo Sapiens
RSRIEVLKH

SEQ ID NO: 868375 - protein, 9 aa, Homo Sapiens
SSNLIDKIS

SEQ ID NO: 868376 - protein, 9 aa, Homo Sapiens
LQHYMKESV

SEQ ID NO: 868377 - protein, 9 aa, Homo Sapiens
DPTGDWGDT

SEQ ID NO: 868378 - protein, 9 aa, Homo Sapiens
DEDFNGKLS

SEQ ID NO: 868379 - protein, 9 aa, Homo Sapiens
HCVCREEFE

SEQ ID NO: 868380 - protein, 9 aa, Homo Sapiens
EGGEENKSV

SEQ ID NO: 868381 - protein, 9 aa, Homo Sapiens
QIKSITKKT

SEQ ID NO: 868382 - protein, 9 aa, Homo Sapiens
GMGSGFAGG

SEQ ID NO: 868383 - protein, 9 aa, Homo Sapiens
DNICGLNAS

SEQ ID NO: 868384 - protein, 9 aa, Homo Sapiens
CECGSPKEC

SEQ ID NO: 868385 - protein, 9 aa, Homo Sapiens
ITDCLCFAI

SEQ ID NO: 868386 - protein, 9 aa, Homo Sapiens
SKLKISSSP

SEQ ID NO: 868387 - protein, 9 aa, Homo Sapiens
ICAICFGRH

SEQ ID NO: 868388 - protein, 9 aa, Homo Sapiens
LEPMQELML

SEQ ID NO: 868389 - protein, 9 aa, Homo Sapiens
ATVCKGSST

SEQ ID NO: 868390 - protein, 9 aa, Homo Sapiens
TLVFLFLNI

SEQ ID NO: 868391 - protein, 9 aa, Homo Sapiens
CPQFPLILA

SEQ ID NO: 868392 - protein, 9 aa, Homo Sapiens
DHHWPADIP

SEQ ID NO: 868393 - protein, 9 aa, Homo Sapiens
YAFTSPDAS

SEQ ID NO: 868394 - protein, 9 aa, Homo Sapiens
VKNLMASEL

SEQ ID NO: 868395 - protein, 9 aa, Homo Sapiens
CKCRNHDYL

SEQ ID NO: 868396 - protein, 9 aa, Homo Sapiens
ICITVFQLP

SEQ ID NO: 868397 - protein, 9 aa, Homo Sapiens
LPDKPRNNK

SEQ ID NO: 868398 - protein, 9 aa, Homo Sapiens
NENYNRVQR

SEQ ID NO: 868399 - protein, 9 aa, Homo Sapiens
CKYPDIAQQ

SEQ ID NO: 868400 - protein, 9 aa, Homo Sapiens
VVEEIDHRG

SEQ ID NO: 868401 - protein, 9 aa, Homo Sapiens
WPKYRLPIN

SEQ ID NO: 868402 - protein, 9 aa, Homo Sapiens
VAYHANDLC

SEQ ID NO: 868403 - protein, 9 aa, Homo Sapiens
VIRIPVICQ

SEQ ID NO: 868404 - protein, 9 aa, Homo Sapiens
FQFIVSLPL

SEQ ID NO: 868405 - protein, 9 aa, Homo Sapiens
IHGDMHVIL

SEQ ID NO: 868406 - protein, 9 aa, Homo Sapiens
AQMPDLLRS

SEQ ID NO: 868407 - protein, 9 aa, Homo Sapiens
SKEASRQTL

SEQ ID NO: 868408 - protein, 9 aa, Homo Sapiens
ISWPLWTTI

SEQ ID NO: 868409 - protein, 9 aa, Homo Sapiens
WSEQSIKDY

SEQ ID NO: 868410 - protein, 9 aa, Homo Sapiens
LLEDQVACN

SEQ ID NO: 868411 - protein, 9 aa, Homo Sapiens
KRKSDQMES

SEQ ID NO: 868412 - protein, 9 aa, Homo Sapiens
FTKVENGQI

SEQ ID NO: 868413 - protein, 9 aa, Homo Sapiens
YPYFFWTVP

SEQ ID NO: 868414 - protein, 9 aa, Homo Sapiens
CGRTFRRRL

SEQ ID NO: 868415 - protein, 9 aa, Homo Sapiens
NWGRGAKCG

SEQ ID NO: 868416 - protein, 9 aa, Homo Sapiens
LDGIVKAAK

SEQ ID NO: 868417 - protein, 9 aa, Homo Sapiens
LLKRHRRQR

SEQ ID NO: 868418 - protein, 9 aa, Homo Sapiens
VLVLLLGHY

SEQ ID NO: 868419 - protein, 9 aa, Homo Sapiens
VELYRGCVR

SEQ ID NO: 868420 - protein, 9 aa, Homo Sapiens
NNQRNVWFA

SEQ ID NO: 868421 - protein, 9 aa, Homo Sapiens
NLDSLGLSG

SEQ ID NO: 868422 - protein, 9 aa, Homo Sapiens
DRTIQISCN

SEQ ID NO: 868423 - protein, 9 aa, Homo Sapiens
SCQSEYHAA

SEQ ID NO: 868424 - protein, 9 aa, Homo Sapiens
DDVEKVGNC

SEQ ID NO: 868425 - protein, 9 aa, Homo Sapiens
KTNAQINKL

SEQ ID NO: 868426 - protein, 9 aa, Homo Sapiens
ARKLLPKVS

SEQ ID NO: 868427 - protein, 9 aa, Homo Sapiens
LSGIIGANQ

SEQ ID NO: 868428 - protein, 9 aa, Homo Sapiens
SSNEHLSLM

SEQ ID NO: 868429 - protein, 9 aa, Homo Sapiens
GELTSKIVS

SEQ ID NO: 868430 - protein, 9 aa, Homo Sapiens
QNNKIIKPA

SEQ ID NO: 868431 - protein, 9 aa, Homo Sapiens
SDTSSRSLF

SEQ ID NO: 868432 - protein, 9 aa, Homo Sapiens
VKYQMDGDV

SEQ ID NO: 868433 - protein, 9 aa, Homo Sapiens
ANMKVTLKE

SEQ ID NO: 868434 - protein, 9 aa, Homo Sapiens
FVSAAERII

SEQ ID NO: 868435 - protein, 9 aa, Homo Sapiens
NYKIKKEEL

SEQ ID NO: 868436 - protein, 9 aa, Homo Sapiens
FNDCFKKVP

SEQ ID NO: 868437 - protein, 9 aa, Homo Sapiens
IQKELKILD

SEQ ID NO: 868438 - protein, 9 aa, Homo Sapiens
SNSDVTISY

SEQ ID NO: 868439 - protein, 9 aa, Homo Sapiens
LKFIVGHLK

SEQ ID NO: 868440 - protein, 9 aa, Homo Sapiens
APKGQPRTA

SEQ ID NO: 868441 - protein, 9 aa, Homo Sapiens
PVQEEEDKG

SEQ ID NO: 868442 - protein, 9 aa, Homo Sapiens
CLDNMGHKE

SEQ ID NO: 868443 - protein, 9 aa, Homo Sapiens
AQDTSIMSI

SEQ ID NO: 868444 - protein, 9 aa, Homo Sapiens
LPDLLEMDT

SEQ ID NO: 868445 - protein, 9 aa, Homo Sapiens
NTLTSLSNA

SEQ ID NO: 868446 - protein, 9 aa, Homo Sapiens
PLENMLFTS

SEQ ID NO: 868447 - protein, 9 aa, Homo Sapiens
FQTKQKNLF

SEQ ID NO: 868448 - protein, 9 aa, Homo Sapiens
NYQKQESLE

SEQ ID NO: 868449 - protein, 9 aa, Homo Sapiens
LSSRTSYYE

SEQ ID NO: 868450 - protein, 9 aa, Homo Sapiens
FEPNNYFTN

SEQ ID NO: 868451 - protein, 9 aa, Homo Sapiens
LVAFLGSII

SEQ ID NO: 868452 - protein, 9 aa, Homo Sapiens
EELKEEFVL

SEQ ID NO: 868453 - protein, 9 aa, Homo Sapiens
VNPAGEVST

SEQ ID NO: 868454 - protein, 9 aa, Homo Sapiens
SKLWEEATP

SEQ ID NO: 868455 - protein, 9 aa, Homo Sapiens
NIIRKKNLA

SEQ ID NO: 868456 - protein, 9 aa, Homo Sapiens
KKIQLSVPA

SEQ ID NO: 868457 - protein, 9 aa, Homo Sapiens
ILQKHGKNV

SEQ ID NO: 868458 - protein, 9 aa, Homo Sapiens
NKYFIDFVA

SEQ ID NO: 868459 - protein, 9 aa, Homo Sapiens
LRYAKMKMA

SEQ ID NO: 868460 - protein, 9 aa, Homo Sapiens
SWERVFLTH

SEQ ID NO: 868461 - protein, 9 aa, Homo Sapiens
PESWVISQP

SEQ ID NO: 868462 - protein, 9 aa, Homo Sapiens
DVMCRRKSS

SEQ ID NO: 868463 - protein, 9 aa, Homo Sapiens
EESHSEEDN

SEQ ID NO: 868464 - protein, 9 aa, Homo Sapiens
LYETAENPR

SEQ ID NO: 868465 - protein, 9 aa, Homo Sapiens
QVFEFTKPK

SEQ ID NO: 868466 - protein, 9 aa, Homo Sapiens
REHFQSYYL

SEQ ID NO: 868467 - protein, 9 aa, Homo Sapiens
IVETTYFCP

SEQ ID NO: 868468 - protein, 9 aa, Homo Sapiens
KNNGTVWSE

SEQ ID NO: 868469 - protein, 9 aa, Homo Sapiens
QGFLGLWQG

SEQ ID NO: 868470 - protein, 9 aa, Homo Sapiens
QQELCGRCK

SEQ ID NO: 868471 - protein, 9 aa, Homo Sapiens
TIIRQLSSL

SEQ ID NO: 868472 - protein, 9 aa, Homo Sapiens
RKFYLFAER

SEQ ID NO: 868473 - protein, 9 aa, Homo Sapiens
DKQIGKSVK

SEQ ID NO: 868474 - protein, 9 aa, Homo Sapiens
DPYHSCGFS

SEQ ID NO: 868475 - protein, 9 aa, Homo Sapiens
SVAGELKLW

SEQ ID NO: 868476 - protein, 9 aa, Homo Sapiens
NFDEIIRVV

SEQ ID NO: 868477 - protein, 9 aa, Homo Sapiens
MGNCIEDLQ

SEQ ID NO: 868478 - protein, 9 aa, Homo Sapiens
SNSSPSRDK

SEQ ID NO: 868479 - protein, 9 aa, Homo Sapiens
QNQKFRKGK

SEQ ID NO: 868480 - protein, 9 aa, Homo Sapiens
NTRHMVKRC

SEQ ID NO: 868481 - protein, 9 aa, Homo Sapiens
EVQTWSLHP

SEQ ID NO: 868482 - protein, 9 aa, Homo Sapiens
SQTKLQDKY

SEQ ID NO: 868483 - protein, 9 aa, Homo Sapiens
NTFFGDDFI

SEQ ID NO: 868484 - protein, 9 aa, Homo Sapiens
AIVQKVILV

SEQ ID NO: 868485 - protein, 9 aa, Homo Sapiens
MLGANGFGN

SEQ ID NO: 868486 - protein, 9 aa, Homo Sapiens
KPLYWTMIQ

SEQ ID NO: 868487 - protein, 9 aa, Homo Sapiens
PYVQHKIDL

SEQ ID NO: 868488 - protein, 9 aa, Homo Sapiens
PGVYPLALH

SEQ ID NO: 868489 - protein, 9 aa, Homo Sapiens
LNINNNNID

SEQ ID NO: 868490 - protein, 9 aa, Homo Sapiens
GVPGKWQQQ

SEQ ID NO: 868491 - protein, 9 aa, Homo Sapiens
SRGSITALG

SEQ ID NO: 868492 - protein, 9 aa, Homo Sapiens
EAGKMLAIY

SEQ ID NO: 868493 - protein, 9 aa, Homo Sapiens
SIAVAAGYH

SEQ ID NO: 868494 - protein, 9 aa, Homo Sapiens
KKICEQEKK

SEQ ID NO: 868495 - protein, 9 aa, Homo Sapiens
RCNEVQLWA

SEQ ID NO: 868496 - protein, 9 aa, Homo Sapiens
KEVSHPNAL

SEQ ID NO: 868497 - protein, 9 aa, Homo Sapiens
FCELAGFAQ

SEQ ID NO: 868498 - protein, 9 aa, Homo Sapiens
EEVLCSLNI

SEQ ID NO: 868499 - protein, 9 aa, Homo Sapiens
DCREPYVFD

SEQ ID NO: 868500 - protein, 9 aa, Homo Sapiens
WMVQVSFSG

SEQ ID NO: 868501 - protein, 9 aa, Homo Sapiens
NYWILNAQH

SEQ ID NO: 868502 - protein, 9 aa, Homo Sapiens
FADTPNHYK

SEQ ID NO: 868503 - protein, 9 aa, Homo Sapiens
SLSVNSNIS

SEQ ID NO: 868504 - protein, 9 aa, Homo Sapiens
ENDLLQAQL

SEQ ID NO: 868505 - protein, 9 aa, Homo Sapiens
EQDKDEEMD

SEQ ID NO: 868506 - protein, 9 aa, Homo Sapiens
RLLDVLCKM

SEQ ID NO: 868507 - protein, 9 aa, Homo Sapiens
YSLNQTLKD

SEQ ID NO: 868508 - protein, 9 aa, Homo Sapiens
HQDSAWKNM

SEQ ID NO: 868509 - protein, 9 aa, Homo Sapiens
KPNTLTDTL

SEQ ID NO: 868510 - protein, 9 aa, Homo Sapiens
QLQHLKLNR

SEQ ID NO: 868511 - protein, 9 aa, Homo Sapiens
GGTSVSLLV

SEQ ID NO: 868512 - protein, 9 aa, Homo Sapiens
TQNRIIIVF

SEQ ID NO: 868513 - protein, 9 aa, Homo Sapiens
SLLYVNTDI

SEQ ID NO: 868514 - protein, 9 aa, Homo Sapiens
SSAIYKQYC

SEQ ID NO: 868515 - protein, 9 aa, Homo Sapiens
LPASDQTSV

SEQ ID NO: 868516 - protein, 9 aa, Homo Sapiens
CTKNREWML

SEQ ID NO: 868517 - protein, 9 aa, Homo Sapiens
REYGGIIQI

SEQ ID NO: 868518 - protein, 9 aa, Homo Sapiens
EPPLGGLVN

SEQ ID NO: 868519 - protein, 9 aa, Homo Sapiens
VFNIPSTAY

SEQ ID NO: 868520 - protein, 9 aa, Homo Sapiens
QNGAPLTRL

SEQ ID NO: 868521 - protein, 9 aa, Homo Sapiens
IIRRLLETL

SEQ ID NO: 868522 - protein, 9 aa, Homo Sapiens
KLQDKYNSW

SEQ ID NO: 868523 - protein, 9 aa, Homo Sapiens
ATKLSGGQK

SEQ ID NO: 868524 - protein, 9 aa, Homo Sapiens
FDDENLIQK

SEQ ID NO: 868525 - protein, 9 aa, Homo Sapiens
SFKHILFQR

SEQ ID NO: 868526 - protein, 9 aa, Homo Sapiens
LLFEASLTL

SEQ ID NO: 868527 - protein, 9 aa, Homo Sapiens
SQAGGESES

SEQ ID NO: 868528 - protein, 9 aa, Homo Sapiens
PHPTARSPV

SEQ ID NO: 868529 - protein, 9 aa, Homo Sapiens
ERLGKKDTS

SEQ ID NO: 868530 - protein, 9 aa, Homo Sapiens
RWPCCLVLV

SEQ ID NO: 868531 - protein, 9 aa, Homo Sapiens
DNIKHKNNI

SEQ ID NO: 868532 - protein, 9 aa, Homo Sapiens
AFRSASHLQ

SEQ ID NO: 868533 - protein, 9 aa, Homo Sapiens
QEERLLKQE

SEQ ID NO: 868534 - protein, 9 aa, Homo Sapiens
GLSLLHANV

SEQ ID NO: 868535 - protein, 9 aa, Homo Sapiens
VKLEGHKLP

SEQ ID NO: 868536 - protein, 9 aa, Homo Sapiens
IFIILFLNK

SEQ ID NO: 868537 - protein, 9 aa, Homo Sapiens
LRQREVLWN

SEQ ID NO: 868538 - protein, 9 aa, Homo Sapiens
GCAAQGGLA

SEQ ID NO: 868539 - protein, 9 aa, Homo Sapiens
VDKGTTEGA

SEQ ID NO: 868540 - protein, 9 aa, Homo Sapiens
HIYSGILNL

SEQ ID NO: 868541 - protein, 9 aa, Homo Sapiens
PTGKAIPIH

SEQ ID NO: 868542 - protein, 9 aa, Homo Sapiens
PQNQKEHRN

SEQ ID NO: 868543 - protein, 9 aa, Homo Sapiens
RIGNKEVEY

SEQ ID NO: 868544 - protein, 9 aa, Homo Sapiens
DTTAASAVW

SEQ ID NO: 868545 - protein, 9 aa, Homo Sapiens
RLNQKKYPQ

SEQ ID NO: 868546 - protein, 9 aa, Homo Sapiens
SNLIDKISK

SEQ ID NO: 868547 - protein, 9 aa, Homo Sapiens
RVPQTGWVY

SEQ ID NO: 868548 - protein, 9 aa, Homo Sapiens
GTASVCGEW

SEQ ID NO: 868549 - protein, 9 aa, Homo Sapiens
VQPRKLRHN

SEQ ID NO: 868550 - protein, 9 aa, Homo Sapiens
TDQVILQHM

SEQ ID NO: 868551 - protein, 9 aa, Homo Sapiens
CALLCPMRW

SEQ ID NO: 868552 - protein, 9 aa, Homo Sapiens
IVGGTASVC

SEQ ID NO: 868553 - protein, 9 aa, Homo Sapiens
CVEFHKLNV

SEQ ID NO: 868554 - protein, 9 aa, Homo Sapiens
PELLNKLCQ

SEQ ID NO: 868555 - protein, 9 aa, Homo Sapiens
RAKLAASLG

SEQ ID NO: 868556 - protein, 9 aa, Homo Sapiens
KPVCCKCGR

SEQ ID NO: 868557 - protein, 9 aa, Homo Sapiens
ITDPKKEGP

SEQ ID NO: 868558 - protein, 9 aa, Homo Sapiens
VQHLQVHTG

SEQ ID NO: 868559 - protein, 9 aa, Homo Sapiens
AFWLSACQS

SEQ ID NO: 868560 - protein, 9 aa, Homo Sapiens
RFWVNVINN

SEQ ID NO: 868561 - protein, 9 aa, Homo Sapiens
RSRSGTDLE

SEQ ID NO: 868562 - protein, 9 aa, Homo Sapiens
DGNMNLSII

SEQ ID NO: 868563 - protein, 9 aa, Homo Sapiens
TILYINCKV

SEQ ID NO: 868564 - protein, 9 aa, Homo Sapiens
SVLRVPCNV

SEQ ID NO: 868565 - protein, 9 aa, Homo Sapiens
HKLPVLAPQ

SEQ ID NO: 868566 - protein, 9 aa, Homo Sapiens
GISSQISWP

SEQ ID NO: 868567 - protein, 9 aa, Homo Sapiens
HAMTRKRGE

SEQ ID NO: 868568 - protein, 9 aa, Homo Sapiens
DTWVDISSN

SEQ ID NO: 868569 - protein, 9 aa, Homo Sapiens
CKHKIDLTG

SEQ ID NO: 868570 - protein, 9 aa, Homo Sapiens
RAYNIPVRK

SEQ ID NO: 868571 - protein, 9 aa, Homo Sapiens
QIDLRCPLS

SEQ ID NO: 868572 - protein, 9 aa, Homo Sapiens
AYHANDLCL

SEQ ID NO: 868573 - protein, 9 aa, Homo Sapiens
DPKPFVDCK

SEQ ID NO: 868574 - protein, 9 aa, Homo Sapiens
GGVRICSVT

SEQ ID NO: 868575 - protein, 9 aa, Homo Sapiens
GVKRGSDKL

SEQ ID NO: 868576 - protein, 9 aa, Homo Sapiens
DSDGDGKIS

SEQ ID NO: 868577 - protein, 9 aa, Homo Sapiens
EHSPSWTFK

SEQ ID NO: 868578 - protein, 9 aa, Homo Sapiens
YILTDSQLV

SEQ ID NO: 868579 - protein, 9 aa, Homo Sapiens
MDENIRYKY

SEQ ID NO: 868580 - protein, 9 aa, Homo Sapiens
QLDNVFRQL

SEQ ID NO: 868581 - protein, 9 aa, Homo Sapiens
GPQKQLAAE

SEQ ID NO: 868582 - protein, 9 aa, Homo Sapiens
RYPQIQSIK

SEQ ID NO: 868583 - protein, 9 aa, Homo Sapiens
KKVKKKVVE

SEQ ID NO: 868584 - protein, 9 aa, Homo Sapiens
AHWMRQKIS

SEQ ID NO: 868585 - protein, 9 aa, Homo Sapiens
LICHQISHT

SEQ ID NO: 868586 - protein, 9 aa, Homo Sapiens
IKNKLFFKK

SEQ ID NO: 868587 - protein, 9 aa, Homo Sapiens
ATGPKGDQG

SEQ ID NO: 868588 - protein, 9 aa, Homo Sapiens
SNNQVYQKV

SEQ ID NO: 868589 - protein, 9 aa, Homo Sapiens
NNLRFVGRS

SEQ ID NO: 868590 - protein, 9 aa, Homo Sapiens
STDTNKASI

SEQ ID NO: 868591 - protein, 9 aa, Homo Sapiens
ERSKTVSTM

SEQ ID NO: 868592 - protein, 9 aa, Homo Sapiens
VYPLALHIK

SEQ ID NO: 868593 - protein, 9 aa, Homo Sapiens
FPQEQKAQI

SEQ ID NO: 868594 - protein, 9 aa, Homo Sapiens
YKENYGHIY

SEQ ID NO: 868595 - protein, 9 aa, Homo Sapiens
LQLTTVSLN

SEQ ID NO: 868596 - protein, 9 aa, Homo Sapiens
AKTLEVTVW

SEQ ID NO: 868597 - protein, 9 aa, Homo Sapiens
CMDCVLLHV

SEQ ID NO: 868598 - protein, 9 aa, Homo Sapiens
SISNGSALV

SEQ ID NO: 868599 - protein, 9 aa, Homo Sapiens
EVNTIINSG

SEQ ID NO: 868600 - protein, 9 aa, Homo Sapiens
KEAKQKLQQ

SEQ ID NO: 868601 - protein, 9 aa, Homo Sapiens
KEVNELYKE

SEQ ID NO: 868602 - protein, 9 aa, Homo Sapiens
TVLIIPSGQ

SEQ ID NO: 868603 - protein, 9 aa, Homo Sapiens
GQDPVQLIS

SEQ ID NO: 868604 - protein, 9 aa, Homo Sapiens
CLYAGGLGY

SEQ ID NO: 868605 - protein, 9 aa, Homo Sapiens
IQMDSYTSY

SEQ ID NO: 868606 - protein, 9 aa, Homo Sapiens
CRPLHYTAL

SEQ ID NO: 868607 - protein, 9 aa, Homo Sapiens
MYPSMPTFS

SEQ ID NO: 868608 - protein, 9 aa, Homo Sapiens
QGAVSSLGD

SEQ ID NO: 868609 - protein, 9 aa, Homo Sapiens
KLGAKLNDF

SEQ ID NO: 868610 - protein, 9 aa, Homo Sapiens
WSDSDSSTL

SEQ ID NO: 868611 - protein, 9 aa, Homo Sapiens
VNRRHHCHK

SEQ ID NO: 868612 - protein, 9 aa, Homo Sapiens
HANKPPYPA

SEQ ID NO: 868613 - protein, 9 aa, Homo Sapiens
CVILALVIV

SEQ ID NO: 868614 - protein, 9 aa, Homo Sapiens
PQLQHLKLN

SEQ ID NO: 868615 - protein, 9 aa, Homo Sapiens
GATSRMDTT

SEQ ID NO: 868616 - protein, 9 aa, Homo Sapiens
DGTLDGSQM

SEQ ID NO: 868617 - protein, 9 aa, Homo Sapiens
STVLYWIFT

SEQ ID NO: 868618 - protein, 9 aa, Homo Sapiens
KQFISHKLP

SEQ ID NO: 868619 - protein, 9 aa, Homo Sapiens
EAALDSIHY

SEQ ID NO: 868620 - protein, 9 aa, Homo Sapiens
LTKVPAIQH

SEQ ID NO: 868621 - protein, 9 aa, Homo Sapiens
ILEQEKVVT

SEQ ID NO: 868622 - protein, 9 aa, Homo Sapiens
LTTMLQNGA

SEQ ID NO: 868623 - protein, 9 aa, Homo Sapiens
DSSLVASKV

SEQ ID NO: 868624 - protein, 9 aa, Homo Sapiens
LAFQGDGVP

SEQ ID NO: 868625 - protein, 9 aa, Homo Sapiens
DADVHLRAL

SEQ ID NO: 868626 - protein, 9 aa, Homo Sapiens
YTEEYEKNK

SEQ ID NO: 868627 - protein, 9 aa, Homo Sapiens
GFDDNNPPG

SEQ ID NO: 868628 - protein, 9 aa, Homo Sapiens
AKPAGPHLP

SEQ ID NO: 868629 - protein, 9 aa, Homo Sapiens
ALDGGDPIQ

SEQ ID NO: 868630 - protein, 9 aa, Homo Sapiens
AMQRNWSGR

SEQ ID NO: 868631 - protein, 9 aa, Homo Sapiens
TTMRLPPYA

SEQ ID NO: 868632 - protein, 9 aa, Homo Sapiens
AVVICHLYN

SEQ ID NO: 868633 - protein, 9 aa, Homo Sapiens
PEFESSSGH

SEQ ID NO: 868634 - protein, 9 aa, Homo Sapiens
STRLKPHKA

SEQ ID NO: 868635 - protein, 9 aa, Homo Sapiens
EQLAKNLVE

SEQ ID NO: 868636 - protein, 9 aa, Homo Sapiens
WVLYHNLCI

SEQ ID NO: 868637 - protein, 9 aa, Homo Sapiens
DCRRHFTPE

SEQ ID NO: 868638 - protein, 9 aa, Homo Sapiens
HLFCNYEES

SEQ ID NO: 868639 - protein, 9 aa, Homo Sapiens
KVWRNPLTL

SEQ ID NO: 868640 - protein, 9 aa, Homo Sapiens
TLALKLRRG

SEQ ID NO: 868641 - protein, 9 aa, Homo Sapiens
RIPQIRIET

SEQ ID NO: 868642 - protein, 9 aa, Homo Sapiens
WATHIQDMF

SEQ ID NO: 868643 - protein, 9 aa, Homo Sapiens
IVTKDNAML

SEQ ID NO: 868644 - protein, 9 aa, Homo Sapiens
SNLNIKQNN

SEQ ID NO: 868645 - protein, 9 aa, Homo Sapiens
ARINMVVDD

SEQ ID NO: 868646 - protein, 9 aa, Homo Sapiens
PFSQRIFMI

SEQ ID NO: 868647 - protein, 9 aa, Homo Sapiens
QVDIKTDLS

SEQ ID NO: 868648 - protein, 9 aa, Homo Sapiens
KYPSKGRWV

SEQ ID NO: 868649 - protein, 9 aa, Homo Sapiens
ILTPEFCQL

SEQ ID NO: 868650 - protein, 9 aa, Homo Sapiens
RLQNLVDKI

SEQ ID NO: 868651 - protein, 9 aa, Homo Sapiens
WEGAEGRQV

SEQ ID NO: 868652 - protein, 9 aa, Homo Sapiens
MLYTNHLTQ

SEQ ID NO: 868653 - protein, 9 aa, Homo Sapiens
TIKDGVSRC

SEQ ID NO: 868654 - protein, 9 aa, Homo Sapiens
DCFFEKKID

SEQ ID NO: 868655 - protein, 9 aa, Homo Sapiens
LAADFSVSL

SEQ ID NO: 868656 - protein, 9 aa, Homo Sapiens
DPVLSVENS

SEQ ID NO: 868657 - protein, 9 aa, Homo Sapiens
IWTNEHLAC

SEQ ID NO: 868658 - protein, 9 aa, Homo Sapiens
GKYVKKEFV

SEQ ID NO: 868659 - protein, 9 aa, Homo Sapiens
CIYRGKEYE

SEQ ID NO: 868660 - protein, 9 aa, Homo Sapiens
TVSQANVQV

SEQ ID NO: 868661 - protein, 9 aa, Homo Sapiens
RAVRVLHSR

SEQ ID NO: 868662 - protein, 9 aa, Homo Sapiens
SSFRNHEIT

SEQ ID NO: 868663 - protein, 9 aa, Homo Sapiens
CIMFIVNSA

SEQ ID NO: 868664 - protein, 9 aa, Homo Sapiens
DFLEPESVI

SEQ ID NO: 868665 - protein, 9 aa, Homo Sapiens
QAVENLCYY

SEQ ID NO: 868666 - protein, 9 aa, Homo Sapiens
KENACDQPL

SEQ ID NO: 868667 - protein, 9 aa, Homo Sapiens
ELLDVVHKS

SEQ ID NO: 868668 - protein, 9 aa, Homo Sapiens
TGRIGQNNF

SEQ ID NO: 868669 - protein, 9 aa, Homo Sapiens
SPFQTLNIN

SEQ ID NO: 868670 - protein, 9 aa, Homo Sapiens
QFCVRDCRK

SEQ ID NO: 868671 - protein, 9 aa, Homo Sapiens
RIHTGEKVY

SEQ ID NO: 868672 - protein, 9 aa, Homo Sapiens
NVVAAAGAQ

SEQ ID NO: 868673 - protein, 9 aa, Homo Sapiens
PAEVIAGGC

SEQ ID NO: 868674 - protein, 9 aa, Homo Sapiens
GNNSWWIPV

SEQ ID NO: 868675 - protein, 9 aa, Homo Sapiens
KPKPANKTN

SEQ ID NO: 868676 - protein, 9 aa, Homo Sapiens
CTLTARLSP

SEQ ID NO: 868677 - protein, 9 aa, Homo Sapiens
STHLVQHQI

SEQ ID NO: 868678 - protein, 9 aa, Homo Sapiens
CGLVHHRRV

SEQ ID NO: 868679 - protein, 9 aa, Homo Sapiens
MNYFSLAPF

SEQ ID NO: 868680 - protein, 9 aa, Homo Sapiens
SAWAMYFKK

SEQ ID NO: 868681 - protein, 9 aa, Homo Sapiens
YSPTFPSYS

SEQ ID NO: 868682 - protein, 9 aa, Homo Sapiens
VVIGVLLLL

SEQ ID NO: 868683 - protein, 9 aa, Homo Sapiens
IGLSFDLVA

SEQ ID NO: 868684 - protein, 9 aa, Homo Sapiens
TKDLDLENI

SEQ ID NO: 868685 - protein, 9 aa, Homo Sapiens
RMDAKINFD

SEQ ID NO: 868686 - protein, 9 aa, Homo Sapiens
TCSVGKSLA

SEQ ID NO: 868687 - protein, 9 aa, Homo Sapiens
LGHAVQDLD

SEQ ID NO: 868688 - protein, 9 aa, Homo Sapiens
GSNGRSYKQ

SEQ ID NO: 868689 - protein, 9 aa, Homo Sapiens
KNQRLFVLF

SEQ ID NO: 868690 - protein, 9 aa, Homo Sapiens
KDLCKESPD

SEQ ID NO: 868691 - protein, 9 aa, Homo Sapiens
VQGKKNYFS

SEQ ID NO: 868692 - protein, 9 aa, Homo Sapiens
NPCSSSPCC

SEQ ID NO: 868693 - protein, 9 aa, Homo Sapiens
KHSSRSHCI

SEQ ID NO: 868694 - protein, 9 aa, Homo Sapiens
MTRVFERFC

SEQ ID NO: 868695 - protein, 9 aa, Homo Sapiens
FLYIPLPML

SEQ ID NO: 868696 - protein, 9 aa, Homo Sapiens
GFCVDLPIK

SEQ ID NO: 868697 - protein, 9 aa, Homo Sapiens
ENPEEDTER

SEQ ID NO: 868698 - protein, 9 aa, Homo Sapiens
PPPYPKNGS

SEQ ID NO: 868699 - protein, 9 aa, Homo Sapiens
VSVIPESYS

SEQ ID NO: 868700 - protein, 9 aa, Homo Sapiens
NKFLAKARG

SEQ ID NO: 868701 - protein, 9 aa, Homo Sapiens
TSKPDVFIK

SEQ ID NO: 868702 - protein, 9 aa, Homo Sapiens
KEDIDAKKV

SEQ ID NO: 868703 - protein, 9 aa, Homo Sapiens
SSRSDMEKW

SEQ ID NO: 868704 - protein, 9 aa, Homo Sapiens
ERFNNETFR

SEQ ID NO: 868705 - protein, 9 aa, Homo Sapiens
GPEPLLAAH

SEQ ID NO: 868706 - protein, 9 aa, Homo Sapiens
QTFSPGAQS

SEQ ID NO: 868707 - protein, 9 aa, Homo Sapiens
SGSHPDLSP

SEQ ID NO: 868708 - protein, 9 aa, Homo Sapiens
TTGDHGIIQ

SEQ ID NO: 868709 - protein, 9 aa, Homo Sapiens
YQFGITKVF

SEQ ID NO: 868710 - protein, 9 aa, Homo Sapiens
QVLKINECY

SEQ ID NO: 868711 - protein, 9 aa, Homo Sapiens
KCLMGAHDC

SEQ ID NO: 868712 - protein, 9 aa, Homo Sapiens
SCLPHEVVG

SEQ ID NO: 868713 - protein, 9 aa, Homo Sapiens
LVASSPSIR

SEQ ID NO: 868714 - protein, 9 aa, Homo Sapiens
QPRTAPLKV

SEQ ID NO: 868715 - protein, 9 aa, Homo Sapiens
EVLEKEKAF

SEQ ID NO: 868716 - protein, 9 aa, Homo Sapiens
MSVQASTGP

SEQ ID NO: 868717 - protein, 9 aa, Homo Sapiens
RKSGSLALM

SEQ ID NO: 868718 - protein, 9 aa, Homo Sapiens
YYAYYLSAF

SEQ ID NO: 868719 - protein, 9 aa, Homo Sapiens
FCVLLNLLE

SEQ ID NO: 868720 - protein, 9 aa, Homo Sapiens
QSDNLVIHA

SEQ ID NO: 868721 - protein, 9 aa, Homo Sapiens
TADIQDIEA

SEQ ID NO: 868722 - protein, 9 aa, Homo Sapiens
EIFQIINNT

SEQ ID NO: 868723 - protein, 9 aa, Homo Sapiens
NSSWHFDKV

SEQ ID NO: 868724 - protein, 9 aa, Homo Sapiens
KPFVDCKEC

SEQ ID NO: 868725 - protein, 9 aa, Homo Sapiens
RYGNSSGMY

SEQ ID NO: 868726 - protein, 9 aa, Homo Sapiens
SFNDCFKKV

SEQ ID NO: 868727 - protein, 9 aa, Homo Sapiens
ILPDTCFRM

SEQ ID NO: 868728 - protein, 9 aa, Homo Sapiens
QDNKLLKQH

SEQ ID NO: 868729 - protein, 9 aa, Homo Sapiens
FGCNMESIR

SEQ ID NO: 868730 - protein, 9 aa, Homo Sapiens
PSSQTKVLS

SEQ ID NO: 868731 - protein, 9 aa, Homo Sapiens
QGMQKLLGL

SEQ ID NO: 868732 - protein, 9 aa, Homo Sapiens
KVENGQINS

SEQ ID NO: 868733 - protein, 9 aa, Homo Sapiens
GISVLLLSP

SEQ ID NO: 868734 - protein, 9 aa, Homo Sapiens
RKQNSLIAD

SEQ ID NO: 868735 - protein, 9 aa, Homo Sapiens
ELPFRKNKM

SEQ ID NO: 868736 - protein, 9 aa, Homo Sapiens
AMTERQSKF

SEQ ID NO: 868737 - protein, 9 aa, Homo Sapiens
PQETVKKIH

SEQ ID NO: 868738 - protein, 9 aa, Homo Sapiens
GSCPEDKVL

SEQ ID NO: 868739 - protein, 9 aa, Homo Sapiens
SFEEQDAHK

SEQ ID NO: 868740 - protein, 9 aa, Homo Sapiens
SSLICTTAN

SEQ ID NO: 868741 - protein, 9 aa, Homo Sapiens
RHGLYSRSN

SEQ ID NO: 868742 - protein, 9 aa, Homo Sapiens
GCLNWWSTV

SEQ ID NO: 868743 - protein, 9 aa, Homo Sapiens
QPHNILQRC

SEQ ID NO: 868744 - protein, 9 aa, Homo Sapiens
CREPYVFDT

SEQ ID NO: 868745 - protein, 9 aa, Homo Sapiens
SILLWVGTF

SEQ ID NO: 868746 - protein, 9 aa, Homo Sapiens
NLIDKISKE

SEQ ID NO: 868747 - protein, 9 aa, Homo Sapiens
DEDFNWTAV

SEQ ID NO: 868748 - protein, 9 aa, Homo Sapiens
VEGYRGKKC

SEQ ID NO: 868749 - protein, 9 aa, Homo Sapiens
KLDWLATAL

SEQ ID NO: 868750 - protein, 9 aa, Homo Sapiens
PIKTLIRDM

SEQ ID NO: 868751 - protein, 9 aa, Homo Sapiens
AVVIIILLM

SEQ ID NO: 868752 - protein, 9 aa, Homo Sapiens
RTIFIILFL

SEQ ID NO: 868753 - protein, 9 aa, Homo Sapiens
RRKPLSFKW

SEQ ID NO: 868754 - protein, 9 aa, Homo Sapiens
ERITVNKET

SEQ ID NO: 868755 - protein, 9 aa, Homo Sapiens
EQDQELCKI

SEQ ID NO: 868756 - protein, 9 aa, Homo Sapiens
VLLPVWEPN

SEQ ID NO: 868757 - protein, 9 aa, Homo Sapiens
HGARYACQI

SEQ ID NO: 868758 - protein, 9 aa, Homo Sapiens
CKLDNGGYY

SEQ ID NO: 868759 - protein, 9 aa, Homo Sapiens
VAKDFSAIY

SEQ ID NO: 868760 - protein, 9 aa, Homo Sapiens
ALELTSQCK

SEQ ID NO: 868761 - protein, 9 aa, Homo Sapiens
YSFLFGFHR

SEQ ID NO: 868762 - protein, 9 aa, Homo Sapiens
LKFKHEEII

SEQ ID NO: 868763 - protein, 9 aa, Homo Sapiens
DNPEESEYS

SEQ ID NO: 868764 - protein, 9 aa, Homo Sapiens
VCGEWPWQV

SEQ ID NO: 868765 - protein, 9 aa, Homo Sapiens
RIMCRGTHV

SEQ ID NO: 868766 - protein, 9 aa, Homo Sapiens
DIQWPNEIT

SEQ ID NO: 868767 - protein, 9 aa, Homo Sapiens
KCGKVFSYY

SEQ ID NO: 868768 - protein, 9 aa, Homo Sapiens
VFEGQNCIH

SEQ ID NO: 868769 - protein, 9 aa, Homo Sapiens
YVLLTDIFL

SEQ ID NO: 868770 - protein, 9 aa, Homo Sapiens
CNLFDFDTF

SEQ ID NO: 868771 - protein, 9 aa, Homo Sapiens
GKCFKTLKG

SEQ ID NO: 868772 - protein, 9 aa, Homo Sapiens
LCLAAGSKI

SEQ ID NO: 868773 - protein, 9 aa, Homo Sapiens
YQDKPLLRA

SEQ ID NO: 868774 - protein, 9 aa, Homo Sapiens
IINGSKVFI

SEQ ID NO: 868775 - protein, 9 aa, Homo Sapiens
IICPGEESY

SEQ ID NO: 868776 - protein, 9 aa, Homo Sapiens
MSSSFNLDP

SEQ ID NO: 868777 - protein, 9 aa, Homo Sapiens
YKKDGIGLY

SEQ ID NO: 868778 - protein, 9 aa, Homo Sapiens
EEQKTDNGK

SEQ ID NO: 868779 - protein, 9 aa, Homo Sapiens
AQLQEIWRL

SEQ ID NO: 868780 - protein, 9 aa, Homo Sapiens
GRRQTPRID

SEQ ID NO: 868781 - protein, 9 aa, Homo Sapiens
LHNMVHCAD

SEQ ID NO: 868782 - protein, 9 aa, Homo Sapiens
GQITTIYKR

SEQ ID NO: 868783 - protein, 9 aa, Homo Sapiens
EGFKGKNCE

SEQ ID NO: 868784 - protein, 9 aa, Homo Sapiens
HTSERTFKC

SEQ ID NO: 868785 - protein, 9 aa, Homo Sapiens
SDLPEEPSY

SEQ ID NO: 868786 - protein, 9 aa, Homo Sapiens
NVFKLQTTL

SEQ ID NO: 868787 - protein, 9 aa, Homo Sapiens
QDCEPVFSE

SEQ ID NO: 868788 - protein, 9 aa, Homo Sapiens
GLQLHPASP

SEQ ID NO: 868789 - protein, 9 aa, Homo Sapiens
QITVLDHYT

SEQ ID NO: 868790 - protein, 9 aa, Homo Sapiens
SDSVARGKL

SEQ ID NO: 868791 - protein, 9 aa, Homo Sapiens
NKSGGDSNT

SEQ ID NO: 868792 - protein, 9 aa, Homo Sapiens
LWAATEILL

SEQ ID NO: 868793 - protein, 9 aa, Homo Sapiens
NDDRNLLQI

SEQ ID NO: 868794 - protein, 9 aa, Homo Sapiens
VEYVIGCYP

SEQ ID NO: 868795 - protein, 9 aa, Homo Sapiens
LSPRQIKLY

SEQ ID NO: 868796 - protein, 9 aa, Homo Sapiens
PVYEQYYRQ

SEQ ID NO: 868797 - protein, 9 aa, Homo Sapiens
SSLEKNYSA

SEQ ID NO: 868798 - protein, 9 aa, Homo Sapiens
VTMKKTCFT

SEQ ID NO: 868799 - protein, 9 aa, Homo Sapiens
ESFGQVTIL

SEQ ID NO: 868800 - protein, 9 aa, Homo Sapiens
NDSNDFTKV

SEQ ID NO: 868801 - protein, 9 aa, Homo Sapiens
LYMQIRDNW

SEQ ID NO: 868802 - protein, 9 aa, Homo Sapiens
AGCLNWWST

SEQ ID NO: 868803 - protein, 9 aa, Homo Sapiens
RGKQHGSSR

SEQ ID NO: 868804 - protein, 9 aa, Homo Sapiens
CQGDTSKVS

SEQ ID NO: 868805 - protein, 9 aa, Homo Sapiens
QKVWPNEEN

SEQ ID NO: 868806 - protein, 9 aa, Homo Sapiens
GFVRSMAMG

SEQ ID NO: 868807 - protein, 9 aa, Homo Sapiens
RHAMTRKRG

SEQ ID NO: 868808 - protein, 9 aa, Homo Sapiens
VPYLSPETS

SEQ ID NO: 868809 - protein, 9 aa, Homo Sapiens
ELNPMGDTL

SEQ ID NO: 868810 - protein, 9 aa, Homo Sapiens
KGGMEVCNL

SEQ ID NO: 868811 - protein, 9 aa, Homo Sapiens
ARPDSMFKD

SEQ ID NO: 868812 - protein, 9 aa, Homo Sapiens
IIIMLELIA

SEQ ID NO: 868813 - protein, 9 aa, Homo Sapiens
KTQNDLDIS

SEQ ID NO: 868814 - protein, 9 aa, Homo Sapiens
NSWTVTMRI

SEQ ID NO: 868815 - protein, 9 aa, Homo Sapiens
CDKNVINNF

SEQ ID NO: 868816 - protein, 9 aa, Homo Sapiens
VYGTKSIKI

SEQ ID NO: 868817 - protein, 9 aa, Homo Sapiens
EGLSQEIWN

SEQ ID NO: 868818 - protein, 9 aa, Homo Sapiens
GSTFFRYLG

SEQ ID NO: 868819 - protein, 9 aa, Homo Sapiens
MANYFSGFS

SEQ ID NO: 868820 - protein, 9 aa, Homo Sapiens
WEAMPRSIH

SEQ ID NO: 868821 - protein, 9 aa, Homo Sapiens
LNLSQNQLS

SEQ ID NO: 868822 - protein, 9 aa, Homo Sapiens
EQVFFLFDN

SEQ ID NO: 868823 - protein, 9 aa, Homo Sapiens
ELLQFHRPD

SEQ ID NO: 868824 - protein, 9 aa, Homo Sapiens
GIYLKNQMV

SEQ ID NO: 868825 - protein, 9 aa, Homo Sapiens
HDSIEEEEA

SEQ ID NO: 868826 - protein, 9 aa, Homo Sapiens
LAYLQIFHK

SEQ ID NO: 868827 - protein, 9 aa, Homo Sapiens
IPQSLAYTH

SEQ ID NO: 868828 - protein, 9 aa, Homo Sapiens
FKHISEQFT

SEQ ID NO: 868829 - protein, 9 aa, Homo Sapiens
VTNSQRGIN

SEQ ID NO: 868830 - protein, 9 aa, Homo Sapiens
INVINYYAD

SEQ ID NO: 868831 - protein, 9 aa, Homo Sapiens
VYDAKSKYV

SEQ ID NO: 868832 - protein, 9 aa, Homo Sapiens
AYFVGKWMN

SEQ ID NO: 868833 - protein, 9 aa, Homo Sapiens
PSAPQSQSL

SEQ ID NO: 868834 - protein, 9 aa, Homo Sapiens
SVCPTDSNV

SEQ ID NO: 868835 - protein, 9 aa, Homo Sapiens
DLSVQLALI

SEQ ID NO: 868836 - protein, 9 aa, Homo Sapiens
APQEGNVVY

SEQ ID NO: 868837 - protein, 9 aa, Homo Sapiens
KRAANIAEA

SEQ ID NO: 868838 - protein, 9 aa, Homo Sapiens
SSELPTTKL

SEQ ID NO: 868839 - protein, 9 aa, Homo Sapiens
RPLEPPSEL

SEQ ID NO: 868840 - protein, 9 aa, Homo Sapiens
ATWNDHFSD

SEQ ID NO: 868841 - protein, 9 aa, Homo Sapiens
NLVIDERDG

SEQ ID NO: 868842 - protein, 9 aa, Homo Sapiens
NIANTSVKP

SEQ ID NO: 868843 - protein, 9 aa, Homo Sapiens
IWNPVSASR

SEQ ID NO: 868844 - protein, 9 aa, Homo Sapiens
KFPPHGPNL

SEQ ID NO: 868845 - protein, 9 aa, Homo Sapiens
FHKYFLIGE

SEQ ID NO: 868846 - protein, 9 aa, Homo Sapiens
FDRDNVRIP

SEQ ID NO: 868847 - protein, 9 aa, Homo Sapiens
ECVECGKLF

SEQ ID NO: 868848 - protein, 9 aa, Homo Sapiens
DKNKLVKAF

SEQ ID NO: 868849 - protein, 9 aa, Homo Sapiens
ERECKLPKI

SEQ ID NO: 868850 - protein, 9 aa, Homo Sapiens
KYDPGYESA

SEQ ID NO: 868851 - protein, 9 aa, Homo Sapiens
GYYAYYLSA

SEQ ID NO: 868852 - protein, 9 aa, Homo Sapiens
IALITDTYK

SEQ ID NO: 868853 - protein, 9 aa, Homo Sapiens
QNDSISSKT

SEQ ID NO: 868854 - protein, 9 aa, Homo Sapiens
VAKYFALPS

SEQ ID NO: 868855 - protein, 9 aa, Homo Sapiens
KTNKQSPHS

SEQ ID NO: 868856 - protein, 9 aa, Homo Sapiens
RTEARGHTA

SEQ ID NO: 868857 - protein, 9 aa, Homo Sapiens
RIYSHDGTN

SEQ ID NO: 868858 - protein, 9 aa, Homo Sapiens
SAHSSDENI

SEQ ID NO: 868859 - protein, 9 aa, Homo Sapiens
QLEDRNTLL

SEQ ID NO: 868860 - protein, 9 aa, Homo Sapiens
LFPGIPDTL

SEQ ID NO: 868861 - protein, 9 aa, Homo Sapiens
CDSKLPASD

SEQ ID NO: 868862 - protein, 9 aa, Homo Sapiens
KWEDDAWSY

SEQ ID NO: 868863 - protein, 9 aa, Homo Sapiens
NIFLKQLDQ

SEQ ID NO: 868864 - protein, 9 aa, Homo Sapiens
EWMAGGLVA

SEQ ID NO: 868865 - protein, 9 aa, Homo Sapiens
TNPPPAPFK

SEQ ID NO: 868866 - protein, 9 aa, Homo Sapiens
QIREKERRN

SEQ ID NO: 868867 - protein, 9 aa, Homo Sapiens
CDKYVFCMQ

SEQ ID NO: 868868 - protein, 9 aa, Homo Sapiens
SIGPNPALS

SEQ ID NO: 868869 - protein, 9 aa, Homo Sapiens
TNKQEKSPQ

SEQ ID NO: 868870 - protein, 9 aa, Homo Sapiens
VIYFQGFCV

SEQ ID NO: 868871 - protein, 9 aa, Homo Sapiens
EFHKLNVSN

SEQ ID NO: 868872 - protein, 9 aa, Homo Sapiens
FMTGFGLLL

SEQ ID NO: 868873 - protein, 9 aa, Homo Sapiens
AKGAKIEVD

SEQ ID NO: 868874 - protein, 9 aa, Homo Sapiens
YIRKKKLKF

SEQ ID NO: 868875 - protein, 9 aa, Homo Sapiens
WLADGGRLV

SEQ ID NO: 868876 - protein, 9 aa, Homo Sapiens
AVLDGIFCA

SEQ ID NO: 868877 - protein, 9 aa, Homo Sapiens
NEFVDMDFG

SEQ ID NO: 868878 - protein, 9 aa, Homo Sapiens
SAAEHLSMI

SEQ ID NO: 868879 - protein, 9 aa, Homo Sapiens
NKHVFSGGR

SEQ ID NO: 868880 - protein, 9 aa, Homo Sapiens
EDAYKCTFI

SEQ ID NO: 868881 - protein, 9 aa, Homo Sapiens
QITTIYKRD

SEQ ID NO: 868882 - protein, 9 aa, Homo Sapiens
TFTTMGLEW

SEQ ID NO: 868883 - protein, 9 aa, Homo Sapiens
QSQAGGESE

SEQ ID NO: 868884 - protein, 9 aa, Homo Sapiens
EVELDNQIA

SEQ ID NO: 868885 - protein, 9 aa, Homo Sapiens
VKYINKGEI

SEQ ID NO: 868886 - protein, 9 aa, Homo Sapiens
KDNQATKLS

SEQ ID NO: 868887 - protein, 9 aa, Homo Sapiens
CCLVLVPDR

SEQ ID NO: 868888 - protein, 9 aa, Homo Sapiens
NVIVGRCLA

SEQ ID NO: 868889 - protein, 9 aa, Homo Sapiens
LKAFQIDAK

SEQ ID NO: 868890 - protein, 9 aa, Homo Sapiens
YKQLMNEYN

SEQ ID NO: 868891 - protein, 9 aa, Homo Sapiens
TPPGEMGTT

SEQ ID NO: 868892 - protein, 9 aa, Homo Sapiens
TPKKSINKT

SEQ ID NO: 868893 - protein, 9 aa, Homo Sapiens
PTGGNFLED

SEQ ID NO: 868894 - protein, 9 aa, Homo Sapiens
LTMAQLKIY

SEQ ID NO: 868895 - protein, 9 aa, Homo Sapiens
TTPGVPSTL

SEQ ID NO: 868896 - protein, 9 aa, Homo Sapiens
CLTLNYVQE

SEQ ID NO: 868897 - protein, 9 aa, Homo Sapiens
VSHRATLLV

SEQ ID NO: 868898 - protein, 9 aa, Homo Sapiens
NPPPAEKNV

SEQ ID NO: 868899 - protein, 9 aa, Homo Sapiens
RCVYKVQSR

SEQ ID NO: 868900 - protein, 9 aa, Homo Sapiens
PVEEKGKYP

SEQ ID NO: 868901 - protein, 9 aa, Homo Sapiens
NKCFRNMEL

SEQ ID NO: 868902 - protein, 9 aa, Homo Sapiens
HRGPRLPQT

SEQ ID NO: 868903 - protein, 9 aa, Homo Sapiens
GSTLLCFDS

SEQ ID NO: 868904 - protein, 9 aa, Homo Sapiens
LKDLYICPN

SEQ ID NO: 868905 - protein, 9 aa, Homo Sapiens
ANGNMQLCE

SEQ ID NO: 868906 - protein, 9 aa, Homo Sapiens
KCLSPGSKE

SEQ ID NO: 868907 - protein, 9 aa, Homo Sapiens
KIPLQEQNY

SEQ ID NO: 868908 - protein, 9 aa, Homo Sapiens
LSQEIWNEI

SEQ ID NO: 868909 - protein, 9 aa, Homo Sapiens
AVLRMDAKI

SEQ ID NO: 868910 - protein, 9 aa, Homo Sapiens
TADYLAQII

SEQ ID NO: 868911 - protein, 9 aa, Homo Sapiens
VLVFTLTTI

SEQ ID NO: 868912 - protein, 9 aa, Homo Sapiens
LSSNLLEKI

SEQ ID NO: 868913 - protein, 9 aa, Homo Sapiens
INLVIDERD

SEQ ID NO: 868914 - protein, 9 aa, Homo Sapiens
TLTTQEPTD

SEQ ID NO: 868915 - protein, 9 aa, Homo Sapiens
VKITWSTVP

SEQ ID NO: 868916 - protein, 9 aa, Homo Sapiens
MWYCLRLLK

SEQ ID NO: 868917 - protein, 9 aa, Homo Sapiens
HEKDTMKFL

SEQ ID NO: 868918 - protein, 9 aa, Homo Sapiens
DGIFCAIFL

SEQ ID NO: 868919 - protein, 9 aa, Homo Sapiens
GEKGNCSQH

SEQ ID NO: 868920 - protein, 9 aa, Homo Sapiens
IIPSGQSRA

SEQ ID NO: 868921 - protein, 9 aa, Homo Sapiens
EHLRSFSMH

SEQ ID NO: 868922 - protein, 9 aa, Homo Sapiens
QLSDNSLDS

SEQ ID NO: 868923 - protein, 9 aa, Homo Sapiens
VSDNNPCIK

SEQ ID NO: 868924 - protein, 9 aa, Homo Sapiens
VDLFAPWCP

SEQ ID NO: 868925 - protein, 9 aa, Homo Sapiens
LLFSLQIRL

SEQ ID NO: 868926 - protein, 9 aa, Homo Sapiens
IYTCPVCIQ

SEQ ID NO: 868927 - protein, 9 aa, Homo Sapiens
QPKEFEDVH

SEQ ID NO: 868928 - protein, 9 aa, Homo Sapiens
PSTPLDPVS

SEQ ID NO: 868929 - protein, 9 aa, Homo Sapiens
EILPLHVLN

SEQ ID NO: 868930 - protein, 9 aa, Homo Sapiens
YPELAEELC

SEQ ID NO: 868931 - protein, 9 aa, Homo Sapiens
WYKGQMTNL

SEQ ID NO: 868932 - protein, 9 aa, Homo Sapiens
EAEPRSKIP

SEQ ID NO: 868933 - protein, 9 aa, Homo Sapiens
KNYLIEMMG

SEQ ID NO: 868934 - protein, 9 aa, Homo Sapiens
VWAINQYRV

SEQ ID NO: 868935 - protein, 9 aa, Homo Sapiens
DVWHIYSGI

SEQ ID NO: 868936 - protein, 9 aa, Homo Sapiens
DVKYINKGE

SEQ ID NO: 868937 - protein, 9 aa, Homo Sapiens
DCGPGLLCQ

SEQ ID NO: 868938 - protein, 9 aa, Homo Sapiens
QERTQQCIP

SEQ ID NO: 868939 - protein, 9 aa, Homo Sapiens
DVVYPEIFP

SEQ ID NO: 868940 - protein, 9 aa, Homo Sapiens
DVQSVADGI

SEQ ID NO: 868941 - protein, 9 aa, Homo Sapiens
TSSQVQRYT

SEQ ID NO: 868942 - protein, 9 aa, Homo Sapiens
DNVIVGRCL

SEQ ID NO: 868943 - protein, 9 aa, Homo Sapiens
SVQPRKLRH

SEQ ID NO: 868944 - protein, 9 aa, Homo Sapiens
LQEIYQELA

SEQ ID NO: 868945 - protein, 9 aa, Homo Sapiens
GTSQNGAFI

SEQ ID NO: 868946 - protein, 9 aa, Homo Sapiens
QLAEFKAPL

SEQ ID NO: 868947 - protein, 9 aa, Homo Sapiens
EKRSTQTRL

SEQ ID NO: 868948 - protein, 9 aa, Homo Sapiens
TEMCVKMIC

SEQ ID NO: 868949 - protein, 9 aa, Homo Sapiens
DFLYFTDLK

SEQ ID NO: 868950 - protein, 9 aa, Homo Sapiens
ANNRNLHSP

SEQ ID NO: 868951 - protein, 9 aa, Homo Sapiens
MCIPSDRIN

SEQ ID NO: 868952 - protein, 9 aa, Homo Sapiens
LAMNKRGQL

SEQ ID NO: 868953 - protein, 9 aa, Homo Sapiens
QILLHNLEW

SEQ ID NO: 868954 - protein, 9 aa, Homo Sapiens
LLPRGNGYR

SEQ ID NO: 868955 - protein, 9 aa, Homo Sapiens
EAAGLHNVF

SEQ ID NO: 868956 - protein, 9 aa, Homo Sapiens
DKISELIEQ

SEQ ID NO: 868957 - protein, 9 aa, Homo Sapiens
HKQDELIIK

SEQ ID NO: 868958 - protein, 9 aa, Homo Sapiens
VSEAELTPK

SEQ ID NO: 868959 - protein, 9 aa, Homo Sapiens
KGWKEVNEL

SEQ ID NO: 868960 - protein, 9 aa, Homo Sapiens
HPGVIGYIG

SEQ ID NO: 868961 - protein, 9 aa, Homo Sapiens
LYNYVHDAR

SEQ ID NO: 868962 - protein, 9 aa, Homo Sapiens
RIVALDLQS

SEQ ID NO: 868963 - protein, 9 aa, Homo Sapiens
FPTLRHHNL

SEQ ID NO: 868964 - protein, 9 aa, Homo Sapiens
GNRHGEITR

SEQ ID NO: 868965 - protein, 9 aa, Homo Sapiens
TPFLPIQAL

SEQ ID NO: 868966 - protein, 9 aa, Homo Sapiens
YYGQIHMYK

SEQ ID NO: 868967 - protein, 9 aa, Homo Sapiens
NAYTGSGDE

SEQ ID NO: 868968 - protein, 9 aa, Homo Sapiens
EFEILLPHR

SEQ ID NO: 868969 - protein, 9 aa, Homo Sapiens
IDLGAMPYV

SEQ ID NO: 868970 - protein, 9 aa, Homo Sapiens
EYGGIIQIS

SEQ ID NO: 868971 - protein, 9 aa, Homo Sapiens
RIYFPPGLC

SEQ ID NO: 868972 - protein, 9 aa, Homo Sapiens
DVLFEIHNY

SEQ ID NO: 868973 - protein, 9 aa, Homo Sapiens
IDVQGKKNY

SEQ ID NO: 868974 - protein, 9 aa, Homo Sapiens
FSTYSDDIS

SEQ ID NO: 868975 - protein, 9 aa, Homo Sapiens
RHYKHFDWL

SEQ ID NO: 868976 - protein, 9 aa, Homo Sapiens
AEGVDSSGK

SEQ ID NO: 868977 - protein, 9 aa, Homo Sapiens
RKLNEKSKA

SEQ ID NO: 868978 - protein, 9 aa, Homo Sapiens
WYEPQIKDS

SEQ ID NO: 868979 - protein, 9 aa, Homo Sapiens
ADYIMANYF

SEQ ID NO: 868980 - protein, 9 aa, Homo Sapiens
PPDLLVLTV

SEQ ID NO: 868981 - protein, 9 aa, Homo Sapiens
EELNLMTLG

SEQ ID NO: 868982 - protein, 9 aa, Homo Sapiens
YLHSSLYFV

SEQ ID NO: 868983 - protein, 9 aa, Homo Sapiens
ATDTGKENK

SEQ ID NO: 868984 - protein, 9 aa, Homo Sapiens
RFETVNQNS

SEQ ID NO: 868985 - protein, 9 aa, Homo Sapiens
LKADKEFWQ

SEQ ID NO: 868986 - protein, 9 aa, Homo Sapiens
ENCNKAKTQ

SEQ ID NO: 868987 - protein, 9 aa, Homo Sapiens
QRRLEITEG

SEQ ID NO: 868988 - protein, 9 aa, Homo Sapiens
VPATLGKNE

SEQ ID NO: 868989 - protein, 9 aa, Homo Sapiens
PKGFTECKM

SEQ ID NO: 868990 - protein, 9 aa, Homo Sapiens
QPFHPSDPT

SEQ ID NO: 868991 - protein, 9 aa, Homo Sapiens
DSPDLFISQ

SEQ ID NO: 868992 - protein, 9 aa, Homo Sapiens
HCMVAHRNS

SEQ ID NO: 868993 - protein, 9 aa, Homo Sapiens
KDTYDTLHM

SEQ ID NO: 868994 - protein, 9 aa, Homo Sapiens
YSDRMSELS

SEQ ID NO: 868995 - protein, 9 aa, Homo Sapiens
KVTMKKTCF

SEQ ID NO: 868996 - protein, 9 aa, Homo Sapiens
VPSVFKLNF

SEQ ID NO: 868997 - protein, 9 aa, Homo Sapiens
ARYMHKICF

SEQ ID NO: 868998 - protein, 9 aa, Homo Sapiens
GEYANDKNL

SEQ ID NO: 868999 - protein, 9 aa, Homo Sapiens
DNTEFQGKQ

SEQ ID NO: 869000 - protein, 9 aa, Homo Sapiens
NLCIMIQYL

SEQ ID NO: 869001 - protein, 9 aa, Homo Sapiens
SYEIIVEDI

SEQ ID NO: 869002 - protein, 9 aa, Homo Sapiens
VPFVITLDS

SEQ ID NO: 869003 - protein, 9 aa, Homo Sapiens
RWFQFFCSM

SEQ ID NO: 869004 - protein, 9 aa, Homo Sapiens
NKVASALGI

SEQ ID NO: 869005 - protein, 9 aa, Homo Sapiens
VSRPDQNLD

SEQ ID NO: 869006 - protein, 9 aa, Homo Sapiens
ITFNEADKS

SEQ ID NO: 869007 - protein, 9 aa, Homo Sapiens
GGTSQNGAF

SEQ ID NO: 869008 - protein, 9 aa, Homo Sapiens
QQVQIYKED

SEQ ID NO: 869009 - protein, 9 aa, Homo Sapiens
TSSLVSVIS

SEQ ID NO: 869010 - protein, 9 aa, Homo Sapiens
WDIAAASLL

SEQ ID NO: 869011 - protein, 9 aa, Homo Sapiens
HNNTDVSIA

SEQ ID NO: 869012 - protein, 9 aa, Homo Sapiens
SSNFVARVE

SEQ ID NO: 869013 - protein, 9 aa, Homo Sapiens
SQRQLCPLT

SEQ ID NO: 869014 - protein, 9 aa, Homo Sapiens
IMAVKRIWS

SEQ ID NO: 869015 - protein, 9 aa, Homo Sapiens
EDLQPDINK

SEQ ID NO: 869016 - protein, 9 aa, Homo Sapiens
GEVSVESDN

SEQ ID NO: 869017 - protein, 9 aa, Homo Sapiens
KQQDCEPVF

SEQ ID NO: 869018 - protein, 9 aa, Homo Sapiens
NIPCDDIQK

SEQ ID NO: 869019 - protein, 9 aa, Homo Sapiens
ISTNGELNV

SEQ ID NO: 869020 - protein, 9 aa, Homo Sapiens
PMLWSRIKK

SEQ ID NO: 869021 - protein, 9 aa, Homo Sapiens
SPEEGKFIL

SEQ ID NO: 869022 - protein, 9 aa, Homo Sapiens
CLTISSDTF

SEQ ID NO: 869023 - protein, 9 aa, Homo Sapiens
SLYTDKVVA

SEQ ID NO: 869024 - protein, 9 aa, Homo Sapiens
AIEREFLFE

SEQ ID NO: 869025 - protein, 9 aa, Homo Sapiens
AKIISLSFN

SEQ ID NO: 869026 - protein, 9 aa, Homo Sapiens
FINPGILEA

SEQ ID NO: 869027 - protein, 9 aa, Homo Sapiens
YLGVNEKQI

SEQ ID NO: 869028 - protein, 9 aa, Homo Sapiens
FSIHTGDKP

SEQ ID NO: 869029 - protein, 9 aa, Homo Sapiens
ESLKSNFTI

SEQ ID NO: 869030 - protein, 9 aa, Homo Sapiens
KRFRKSFHL

SEQ ID NO: 869031 - protein, 9 aa, Homo Sapiens
SSSYQEPSN

SEQ ID NO: 869032 - protein, 9 aa, Homo Sapiens
PPPNMTTNK

SEQ ID NO: 869033 - protein, 9 aa, Homo Sapiens
SDQNRFNLR

SEQ ID NO: 869034 - protein, 9 aa, Homo Sapiens
DSETFSTYF

SEQ ID NO: 869035 - protein, 9 aa, Homo Sapiens
ASISRVLSM

SEQ ID NO: 869036 - protein, 9 aa, Homo Sapiens
ALRFTKLGF

SEQ ID NO: 869037 - protein, 9 aa, Homo Sapiens
IKDYFQKVI

SEQ ID NO: 869038 - protein, 9 aa, Homo Sapiens
TLMPHNYTR

SEQ ID NO: 869039 - protein, 9 aa, Homo Sapiens
WETPPPYPK

SEQ ID NO: 869040 - protein, 9 aa, Homo Sapiens
KMICRVNDE

SEQ ID NO: 869041 - protein, 9 aa, Homo Sapiens
SALKTLSFL

SEQ ID NO: 869042 - protein, 9 aa, Homo Sapiens
PRDCAYLVA

SEQ ID NO: 869043 - protein, 9 aa, Homo Sapiens
KRRIIKLPE

SEQ ID NO: 869044 - protein, 9 aa, Homo Sapiens
IGQNNFKKI

SEQ ID NO: 869045 - protein, 9 aa, Homo Sapiens
PVICQGDTS

SEQ ID NO: 869046 - protein, 9 aa, Homo Sapiens
GFGSDYSQS

SEQ ID NO: 869047 - protein, 9 aa, Homo Sapiens
IKIMMEGCE

SEQ ID NO: 869048 - protein, 9 aa, Homo Sapiens
ITRLTLSGL

SEQ ID NO: 869049 - protein, 9 aa, Homo Sapiens
LFLVCHLVM

SEQ ID NO: 869050 - protein, 9 aa, Homo Sapiens
LNQKKYPQP

SEQ ID NO: 869051 - protein, 9 aa, Homo Sapiens
MNVNQMGEE

SEQ ID NO: 869052 - protein, 9 aa, Homo Sapiens
IPHIATTII

SEQ ID NO: 869053 - protein, 9 aa, Homo Sapiens
AGDSNIFPV

SEQ ID NO: 869054 - protein, 9 aa, Homo Sapiens
GNGIRGLSL

SEQ ID NO: 869055 - protein, 9 aa, Homo Sapiens
RHLKNRINL

SEQ ID NO: 869056 - protein, 9 aa, Homo Sapiens
GSPGDPDHK

SEQ ID NO: 869057 - protein, 9 aa, Homo Sapiens
KRHFQARSK

SEQ ID NO: 869058 - protein, 9 aa, Homo Sapiens
EWSNIKSII

SEQ ID NO: 869059 - protein, 9 aa, Homo Sapiens
KEEFVLKTQ

SEQ ID NO: 869060 - protein, 9 aa, Homo Sapiens
LWTCPAVGR

SEQ ID NO: 869061 - protein, 9 aa, Homo Sapiens
KVQSYDPKT

SEQ ID NO: 869062 - protein, 9 aa, Homo Sapiens
FQLQELDNF

SEQ ID NO: 869063 - protein, 9 aa, Homo Sapiens
EQMFPCQFI

SEQ ID NO: 869064 - protein, 9 aa, Homo Sapiens
CILSAFSFV

SEQ ID NO: 869065 - protein, 9 aa, Homo Sapiens
ICIKIADFG

SEQ ID NO: 869066 - protein, 9 aa, Homo Sapiens
KITSSTTGY

SEQ ID NO: 869067 - protein, 9 aa, Homo Sapiens
FTSRKSCCS

SEQ ID NO: 869068 - protein, 9 aa, Homo Sapiens
RNFDNSFQN

SEQ ID NO: 869069 - protein, 9 aa, Homo Sapiens
LLCAALKET

SEQ ID NO: 869070 - protein, 9 aa, Homo Sapiens
VPSLYFTMT

SEQ ID NO: 869071 - protein, 9 aa, Homo Sapiens
KYFSLAGNF

SEQ ID NO: 869072 - protein, 9 aa, Homo Sapiens
DFAKEGHYS

SEQ ID NO: 869073 - protein, 9 aa, Homo Sapiens
FVLPSGEVL

SEQ ID NO: 869074 - protein, 9 aa, Homo Sapiens
NIFPVRGQV

SEQ ID NO: 869075 - protein, 9 aa, Homo Sapiens
MQQRIRSKQ

SEQ ID NO: 869076 - protein, 9 aa, Homo Sapiens
GGNMTRVFE

SEQ ID NO: 869077 - protein, 9 aa, Homo Sapiens
LENFQGRQA

SEQ ID NO: 869078 - protein, 9 aa, Homo Sapiens
KKKIQTALS

SEQ ID NO: 869079 - protein, 9 aa, Homo Sapiens
SLLLSSTEY

SEQ ID NO: 869080 - protein, 9 aa, Homo Sapiens
YFFWLKSKW

SEQ ID NO: 869081 - protein, 9 aa, Homo Sapiens
VWWSFDKCQ

SEQ ID NO: 869082 - protein, 9 aa, Homo Sapiens
MKNFVLGRD

SEQ ID NO: 869083 - protein, 9 aa, Homo Sapiens
RPQPRSISE

SEQ ID NO: 869084 - protein, 9 aa, Homo Sapiens
WLRLPCHNF

SEQ ID NO: 869085 - protein, 9 aa, Homo Sapiens
FNSNTGGSE

SEQ ID NO: 869086 - protein, 9 aa, Homo Sapiens
SDSPDLFIS

SEQ ID NO: 869087 - protein, 9 aa, Homo Sapiens
YHPMGHRPQ

SEQ ID NO: 869088 - protein, 9 aa, Homo Sapiens
AYVPRHEIC

SEQ ID NO: 869089 - protein, 9 aa, Homo Sapiens
NDLLNIIRK

SEQ ID NO: 869090 - protein, 9 aa, Homo Sapiens
QDQELCKIL

SEQ ID NO: 869091 - protein, 9 aa, Homo Sapiens
VKGTFISVC

SEQ ID NO: 869092 - protein, 9 aa, Homo Sapiens
NLQRGDRLL

SEQ ID NO: 869093 - protein, 9 aa, Homo Sapiens
TFHRYTVWA

SEQ ID NO: 869094 - protein, 9 aa, Homo Sapiens
TCRNQTRHL

SEQ ID NO: 869095 - protein, 9 aa, Homo Sapiens
SNEQPSLLA

SEQ ID NO: 869096 - protein, 9 aa, Homo Sapiens
QVFIVVERD

SEQ ID NO: 869097 - protein, 9 aa, Homo Sapiens
VEVWWSFDK

SEQ ID NO: 869098 - protein, 9 aa, Homo Sapiens
EAKHIKGEQ

SEQ ID NO: 869099 - protein, 9 aa, Homo Sapiens
ALGLPESLI

SEQ ID NO: 869100 - protein, 9 aa, Homo Sapiens
TSPDVTETN

SEQ ID NO: 869101 - protein, 9 aa, Homo Sapiens
SLVLRVQEL

SEQ ID NO: 869102 - protein, 9 aa, Homo Sapiens
NSIPDIIPR

SEQ ID NO: 869103 - protein, 9 aa, Homo Sapiens
QSILDYLET

SEQ ID NO: 869104 - protein, 9 aa, Homo Sapiens
VDCIIFGTV

SEQ ID NO: 869105 - protein, 9 aa, Homo Sapiens
SGDQYRTEQ

SEQ ID NO: 869106 - protein, 9 aa, Homo Sapiens
ITGSERYYQ

SEQ ID NO: 869107 - protein, 9 aa, Homo Sapiens
LSMINDAVN

SEQ ID NO: 869108 - protein, 9 aa, Homo Sapiens
QQAQVTLID

SEQ ID NO: 869109 - protein, 9 aa, Homo Sapiens
RDGAAAVGT

SEQ ID NO: 869110 - protein, 9 aa, Homo Sapiens
VGSFKVATQ

SEQ ID NO: 869111 - protein, 9 aa, Homo Sapiens
CYPVLMNHR

SEQ ID NO: 869112 - protein, 9 aa, Homo Sapiens
FPVFLQTVS

SEQ ID NO: 869113 - protein, 9 aa, Homo Sapiens
YRILLKELD

SEQ ID NO: 869114 - protein, 9 aa, Homo Sapiens
SRYEGILTN

SEQ ID NO: 869115 - protein, 9 aa, Homo Sapiens
LLRNVMQIS

SEQ ID NO: 869116 - protein, 9 aa, Homo Sapiens
IEKIWQKVD

SEQ ID NO: 869117 - protein, 9 aa, Homo Sapiens
LIIPSGQSR

SEQ ID NO: 869118 - protein, 9 aa, Homo Sapiens
ILNINNNNI

SEQ ID NO: 869119 - protein, 9 aa, Homo Sapiens
PDLCPLPGP

SEQ ID NO: 869120 - protein, 9 aa, Homo Sapiens
DVPEARYGN

SEQ ID NO: 869121 - protein, 9 aa, Homo Sapiens
IPIDDKLYT

SEQ ID NO: 869122 - protein, 9 aa, Homo Sapiens
YRCLLEGEE

SEQ ID NO: 869123 - protein, 9 aa, Homo Sapiens
FRSLEAIDG

SEQ ID NO: 869124 - protein, 9 aa, Homo Sapiens
LIQTDSHLH

SEQ ID NO: 869125 - protein, 9 aa, Homo Sapiens
HPRSHCLYA

SEQ ID NO: 869126 - protein, 9 aa, Homo Sapiens
VILAIVLRL

SEQ ID NO: 869127 - protein, 9 aa, Homo Sapiens
IPCNLMDGR

SEQ ID NO: 869128 - protein, 9 aa, Homo Sapiens
QIQLPGYPD

SEQ ID NO: 869129 - protein, 9 aa, Homo Sapiens
DSEELLVTD

SEQ ID NO: 869130 - protein, 9 aa, Homo Sapiens
VWPNEENNK

SEQ ID NO: 869131 - protein, 9 aa, Homo Sapiens
TFKHIMALA

SEQ ID NO: 869132 - protein, 9 aa, Homo Sapiens
VGGGGERGL

SEQ ID NO: 869133 - protein, 9 aa, Homo Sapiens
HTLKGQRLV

SEQ ID NO: 869134 - protein, 9 aa, Homo Sapiens
VSQLAQTTC

SEQ ID NO: 869135 - protein, 9 aa, Homo Sapiens
YLAVNGVDY

SEQ ID NO: 869136 - protein, 9 aa, Homo Sapiens
VKLQNGEFM

SEQ ID NO: 869137 - protein, 9 aa, Homo Sapiens
NLDIIKKGS

SEQ ID NO: 869138 - protein, 9 aa, Homo Sapiens
RVCIAETWL

SEQ ID NO: 869139 - protein, 9 aa, Homo Sapiens
IQSVLMEMS

SEQ ID NO: 869140 - protein, 9 aa, Homo Sapiens
TFTVHQSPV

SEQ ID NO: 869141 - protein, 9 aa, Homo Sapiens
QIVKLFLSY

SEQ ID NO: 869142 - protein, 9 aa, Homo Sapiens
TTQEPTDNQ

SEQ ID NO: 869143 - protein, 9 aa, Homo Sapiens
FWDAFGRYI

SEQ ID NO: 869144 - protein, 9 aa, Homo Sapiens
SIHTGDKPY

SEQ ID NO: 869145 - protein, 9 aa, Homo Sapiens
LVCCPLAEE

SEQ ID NO: 869146 - protein, 9 aa, Homo Sapiens
GGRETSGRF

SEQ ID NO: 869147 - protein, 9 aa, Homo Sapiens
GQAVVWEHF

SEQ ID NO: 869148 - protein, 9 aa, Homo Sapiens
SIILIQGFF

SEQ ID NO: 869149 - protein, 9 aa, Homo Sapiens
VGGQRSERN

SEQ ID NO: 869150 - protein, 9 aa, Homo Sapiens
LTSVAISTS

SEQ ID NO: 869151 - protein, 9 aa, Homo Sapiens
VFVAVKILL

SEQ ID NO: 869152 - protein, 9 aa, Homo Sapiens
DTISTYDGS

SEQ ID NO: 869153 - protein, 9 aa, Homo Sapiens
IRQQTYLSC

SEQ ID NO: 869154 - protein, 9 aa, Homo Sapiens
LGWTEGSKM

SEQ ID NO: 869155 - protein, 9 aa, Homo Sapiens
QSRSAAAQS

SEQ ID NO: 869156 - protein, 9 aa, Homo Sapiens
LEIYQEDIR

SEQ ID NO: 869157 - protein, 9 aa, Homo Sapiens
VFEVNIQFI

SEQ ID NO: 869158 - protein, 9 aa, Homo Sapiens
EPTNSSLNI

SEQ ID NO: 869159 - protein, 9 aa, Homo Sapiens
VPPGECLIQ

SEQ ID NO: 869160 - protein, 9 aa, Homo Sapiens
NYGHDLTSV

SEQ ID NO: 869161 - protein, 9 aa, Homo Sapiens
HAMYSGSQT

SEQ ID NO: 869162 - protein, 9 aa, Homo Sapiens
QELCKILCM

SEQ ID NO: 869163 - protein, 9 aa, Homo Sapiens
KDLKKRRWA

SEQ ID NO: 869164 - protein, 9 aa, Homo Sapiens
PMNFHPESR

SEQ ID NO: 869165 - protein, 9 aa, Homo Sapiens
SLFSFTSPT

SEQ ID NO: 869166 - protein, 9 aa, Homo Sapiens
LIRVIIYNR

SEQ ID NO: 869167 - protein, 9 aa, Homo Sapiens
CVIIQANDR

SEQ ID NO: 869168 - protein, 9 aa, Homo Sapiens
IWQVNIQRK

SEQ ID NO: 869169 - protein, 9 aa, Homo Sapiens
LKSVDDVKN

SEQ ID NO: 869170 - protein, 9 aa, Homo Sapiens
NKINQLQPK

SEQ ID NO: 869171 - protein, 9 aa, Homo Sapiens
KIQTALSNL

SEQ ID NO: 869172 - protein, 9 aa, Homo Sapiens
VGDTEGKYH

SEQ ID NO: 869173 - protein, 9 aa, Homo Sapiens
ANVNDNAPA

SEQ ID NO: 869174 - protein, 9 aa, Homo Sapiens
GQYSDSVAR

SEQ ID NO: 869175 - protein, 9 aa, Homo Sapiens
AQELEKCDI

SEQ ID NO: 869176 - protein, 9 aa, Homo Sapiens
EGKLVRQTT

SEQ ID NO: 869177 - protein, 9 aa, Homo Sapiens
TGYLVEILN

SEQ ID NO: 869178 - protein, 9 aa, Homo Sapiens
LARYIDAGN

SEQ ID NO: 869179 - protein, 9 aa, Homo Sapiens
YEIVSNKIN

SEQ ID NO: 869180 - protein, 9 aa, Homo Sapiens
SIASGETHS

SEQ ID NO: 869181 - protein, 9 aa, Homo Sapiens
NSTLATIIR

SEQ ID NO: 869182 - protein, 9 aa, Homo Sapiens
DLEVFILGV

SEQ ID NO: 869183 - protein, 9 aa, Homo Sapiens
EKQIQSVLN

SEQ ID NO: 869184 - protein, 9 aa, Homo Sapiens
LFLHTRNVH

SEQ ID NO: 869185 - protein, 9 aa, Homo Sapiens
PPLKAGKTQ

SEQ ID NO: 869186 - protein, 9 aa, Homo Sapiens
DSDGAVLRM

SEQ ID NO: 869187 - protein, 9 aa, Homo Sapiens
TRVCADVTI

SEQ ID NO: 869188 - protein, 9 aa, Homo Sapiens
TDTNKASIL

SEQ ID NO: 869189 - protein, 9 aa, Homo Sapiens
WHPSYVGWF

SEQ ID NO: 869190 - protein, 9 aa, Homo Sapiens
WLQIARRAL

SEQ ID NO: 869191 - protein, 9 aa, Homo Sapiens
LKEHLKRHT

SEQ ID NO: 869192 - protein, 9 aa, Homo Sapiens
QIRKDISAG

SEQ ID NO: 869193 - protein, 9 aa, Homo Sapiens
CAAQGGLAG

SEQ ID NO: 869194 - protein, 9 aa, Homo Sapiens
MSCGYSENN

SEQ ID NO: 869195 - protein, 9 aa, Homo Sapiens
RVYNKRLKV

SEQ ID NO: 869196 - protein, 9 aa, Homo Sapiens
FSICFTDTA

SEQ ID NO: 869197 - protein, 9 aa, Homo Sapiens
RRVLCMYDD

SEQ ID NO: 869198 - protein, 9 aa, Homo Sapiens
LTQLSEAKH

SEQ ID NO: 869199 - protein, 9 aa, Homo Sapiens
SQNDFQSLL

SEQ ID NO: 869200 - protein, 9 aa, Homo Sapiens
PHNRDSILN

SEQ ID NO: 869201 - protein, 9 aa, Homo Sapiens
GSKLVKHHS

SEQ ID NO: 869202 - protein, 9 aa, Homo Sapiens
FCNAVWSYY

SEQ ID NO: 869203 - protein, 9 aa, Homo Sapiens
LMLPSPRPY

SEQ ID NO: 869204 - protein, 9 aa, Homo Sapiens
PIISLDTTA

SEQ ID NO: 869205 - protein, 9 aa, Homo Sapiens
WKILAILYL

SEQ ID NO: 869206 - protein, 9 aa, Homo Sapiens
TKGYSTSSY

SEQ ID NO: 869207 - protein, 9 aa, Homo Sapiens
RALHAAECL

SEQ ID NO: 869208 - protein, 9 aa, Homo Sapiens
YLQQTLNYT

SEQ ID NO: 869209 - protein, 9 aa, Homo Sapiens
IKQVNERVL

SEQ ID NO: 869210 - protein, 9 aa, Homo Sapiens
YSCFCNPEF

SEQ ID NO: 869211 - protein, 9 aa, Homo Sapiens
FETDIVQQM

SEQ ID NO: 869212 - protein, 9 aa, Homo Sapiens
NKEELDEKI

SEQ ID NO: 869213 - protein, 9 aa, Homo Sapiens
KKQRTKNNK

SEQ ID NO: 869214 - protein, 9 aa, Homo Sapiens
IRPPYNQAV

SEQ ID NO: 869215 - protein, 9 aa, Homo Sapiens
GKIRDAHRQ

SEQ ID NO: 869216 - protein, 9 aa, Homo Sapiens
TTWEKTAPE

SEQ ID NO: 869217 - protein, 9 aa, Homo Sapiens
EGIQCAIRI

SEQ ID NO: 869218 - protein, 9 aa, Homo Sapiens
VDRQNHICG

SEQ ID NO: 869219 - protein, 9 aa, Homo Sapiens
LNNLNTLLL

SEQ ID NO: 869220 - protein, 9 aa, Homo Sapiens
ERLGIHLIQ

SEQ ID NO: 869221 - protein, 9 aa, Homo Sapiens
LPKHQLSQY

SEQ ID NO: 869222 - protein, 9 aa, Homo Sapiens
KEEWQDKDL

SEQ ID NO: 869223 - protein, 9 aa, Homo Sapiens
NIDKLQSAF

SEQ ID NO: 869224 - protein, 9 aa, Homo Sapiens
EGPPHTNNW

SEQ ID NO: 869225 - protein, 9 aa, Homo Sapiens
NLLGLQWRD

SEQ ID NO: 869226 - protein, 9 aa, Homo Sapiens
SLPRYFELS

SEQ ID NO: 869227 - protein, 9 aa, Homo Sapiens
YCLNPQEYL

SEQ ID NO: 869228 - protein, 9 aa, Homo Sapiens
IQDFQKLTT

SEQ ID NO: 869229 - protein, 9 aa, Homo Sapiens
FCDALVQLI

SEQ ID NO: 869230 - protein, 9 aa, Homo Sapiens
FSFVCVISL

SEQ ID NO: 869231 - protein, 9 aa, Homo Sapiens
YQTCFPQYL

SEQ ID NO: 869232 - protein, 9 aa, Homo Sapiens
CCKCGRQFC

SEQ ID NO: 869233 - protein, 9 aa, Homo Sapiens
KDGRIELSE

SEQ ID NO: 869234 - protein, 9 aa, Homo Sapiens
KRPAILHLL

SEQ ID NO: 869235 - protein, 9 aa, Homo Sapiens
LAEFKAPLE

SEQ ID NO: 869236 - protein, 9 aa, Homo Sapiens
KRMKLLQFV

SEQ ID NO: 869237 - protein, 9 aa, Homo Sapiens
AEMAGQINK

SEQ ID NO: 869238 - protein, 9 aa, Homo Sapiens
GRTFRRRLN

SEQ ID NO: 869239 - protein, 9 aa, Homo Sapiens
VEDGKFLFV

SEQ ID NO: 869240 - protein, 9 aa, Homo Sapiens
CSQLWDTFS

SEQ ID NO: 869241 - protein, 9 aa, Homo Sapiens
RAVSPKFVC

SEQ ID NO: 869242 - protein, 9 aa, Homo Sapiens
YVTSVLCKS

SEQ ID NO: 869243 - protein, 9 aa, Homo Sapiens
KEIWTFFIH

SEQ ID NO: 869244 - protein, 9 aa, Homo Sapiens
CVHSESSLS

SEQ ID NO: 869245 - protein, 9 aa, Homo Sapiens
CQAADYDNF

SEQ ID NO: 869246 - protein, 9 aa, Homo Sapiens
CCYGFLGQK

SEQ ID NO: 869247 - protein, 9 aa, Homo Sapiens
DNFESMYTS

SEQ ID NO: 869248 - protein, 9 aa, Homo Sapiens
STRSALRDS

SEQ ID NO: 869249 - protein, 9 aa, Homo Sapiens
VIHISRGER

SEQ ID NO: 869250 - protein, 9 aa, Homo Sapiens
QRDLIRQIE

SEQ ID NO: 869251 - protein, 9 aa, Homo Sapiens
TARFGVTTH

SEQ ID NO: 869252 - protein, 9 aa, Homo Sapiens
YPDADRLAV

SEQ ID NO: 869253 - protein, 9 aa, Homo Sapiens
NKIYDEATW

SEQ ID NO: 869254 - protein, 9 aa, Homo Sapiens
AGQTFVAPD

SEQ ID NO: 869255 - protein, 9 aa, Homo Sapiens
HEGAKVLDV

SEQ ID NO: 869256 - protein, 9 aa, Homo Sapiens
GGSIQMPAF

SEQ ID NO: 869257 - protein, 9 aa, Homo Sapiens
GSKSVRPDN

SEQ ID NO: 869258 - protein, 9 aa, Homo Sapiens
SEGDTPLND

SEQ ID NO: 869259 - protein, 9 aa, Homo Sapiens
VDCILCDTS

SEQ ID NO: 869260 - protein, 9 aa, Homo Sapiens
RPEYEVRCT

SEQ ID NO: 869261 - protein, 9 aa, Homo Sapiens
KSGLIKHQI

SEQ ID NO: 869262 - protein, 9 aa, Homo Sapiens
DMKIRSMYD

SEQ ID NO: 869263 - protein, 9 aa, Homo Sapiens
FDKLSPLHK

SEQ ID NO: 869264 - protein, 9 aa, Homo Sapiens
LLMNRTNPK

SEQ ID NO: 869265 - protein, 9 aa, Homo Sapiens
YDQKKYKDE

SEQ ID NO: 869266 - protein, 9 aa, Homo Sapiens
KSKYKFWNH

SEQ ID NO: 869267 - protein, 9 aa, Homo Sapiens
VTDNAIDIL

SEQ ID NO: 869268 - protein, 9 aa, Homo Sapiens
QSYSQNTLI

SEQ ID NO: 869269 - protein, 9 aa, Homo Sapiens
NLMSRAQEL

SEQ ID NO: 869270 - protein, 9 aa, Homo Sapiens
KYSIDIDIS

SEQ ID NO: 869271 - protein, 9 aa, Homo Sapiens
GKAFKLHYQ

SEQ ID NO: 869272 - protein, 9 aa, Homo Sapiens
VEPGSLKSS

SEQ ID NO: 869273 - protein, 9 aa, Homo Sapiens
NTSQHNSEK

SEQ ID NO: 869274 - protein, 9 aa, Homo Sapiens
EAFNPAAAA

SEQ ID NO: 869275 - protein, 9 aa, Homo Sapiens
SAAPLLFSW

SEQ ID NO: 869276 - protein, 9 aa, Homo Sapiens
DFQSQKSIL

SEQ ID NO: 869277 - protein, 9 aa, Homo Sapiens
NAGQTFVAP

SEQ ID NO: 869278 - protein, 9 aa, Homo Sapiens
ALSGRGGGH

SEQ ID NO: 869279 - protein, 9 aa, Homo Sapiens
GVRVENANP

SEQ ID NO: 869280 - protein, 9 aa, Homo Sapiens
DSQEDVNSW

SEQ ID NO: 869281 - protein, 9 aa, Homo Sapiens
LDSEVLNLL

SEQ ID NO: 869282 - protein, 9 aa, Homo Sapiens
PVYSYLWTC

SEQ ID NO: 869283 - protein, 9 aa, Homo Sapiens
SLQQGCWDA

SEQ ID NO: 869284 - protein, 9 aa, Homo Sapiens
KKIMRTKGF

SEQ ID NO: 869285 - protein, 9 aa, Homo Sapiens
FLSIYNQVY

SEQ ID NO: 869286 - protein, 9 aa, Homo Sapiens
QVYKTKMRS

SEQ ID NO: 869287 - protein, 9 aa, Homo Sapiens
QIAMEPFKI

SEQ ID NO: 869288 - protein, 9 aa, Homo Sapiens
DQDKYCYRY

SEQ ID NO: 869289 - protein, 9 aa, Homo Sapiens
HAVATARRS

SEQ ID NO: 869290 - protein, 9 aa, Homo Sapiens
NILYRQFKQ

SEQ ID NO: 869291 - protein, 9 aa, Homo Sapiens
VPAFRDKHL

SEQ ID NO: 869292 - protein, 9 aa, Homo Sapiens
ESAKADILR

SEQ ID NO: 869293 - protein, 9 aa, Homo Sapiens
PAILHLLKF

SEQ ID NO: 869294 - protein, 9 aa, Homo Sapiens
TFTQISYTL

SEQ ID NO: 869295 - protein, 9 aa, Homo Sapiens
HIIHSGEKP

SEQ ID NO: 869296 - protein, 9 aa, Homo Sapiens
KYSEKYAEE

SEQ ID NO: 869297 - protein, 9 aa, Homo Sapiens
NHLTQEQWV

SEQ ID NO: 869298 - protein, 9 aa, Homo Sapiens
ALNTAGTVF

SEQ ID NO: 869299 - protein, 9 aa, Homo Sapiens
YCLHRRRRQ

SEQ ID NO: 869300 - protein, 9 aa, Homo Sapiens
SSCLNKYIQ

SEQ ID NO: 869301 - protein, 9 aa, Homo Sapiens
WHYRPTGYQ

SEQ ID NO: 869302 - protein, 9 aa, Homo Sapiens
VTMSREVKE

SEQ ID NO: 869303 - protein, 9 aa, Homo Sapiens
TRVALVGGT

SEQ ID NO: 869304 - protein, 9 aa, Homo Sapiens
KFQEGVEML

SEQ ID NO: 869305 - protein, 9 aa, Homo Sapiens
REQQINIPP

SEQ ID NO: 869306 - protein, 9 aa, Homo Sapiens
VRVLARYID

SEQ ID NO: 869307 - protein, 9 aa, Homo Sapiens
SFAYPAIQY

SEQ ID NO: 869308 - protein, 9 aa, Homo Sapiens
TNFDEKPAI

SEQ ID NO: 869309 - protein, 9 aa, Homo Sapiens
KQHDTFDIA

SEQ ID NO: 869310 - protein, 9 aa, Homo Sapiens
NTRESDRLE

SEQ ID NO: 869311 - protein, 9 aa, Homo Sapiens
IKQNNSWTA

SEQ ID NO: 869312 - protein, 9 aa, Homo Sapiens
CPEDKVLRN

SEQ ID NO: 869313 - protein, 9 aa, Homo Sapiens
RFQKNNGTV

SEQ ID NO: 869314 - protein, 9 aa, Homo Sapiens
IVLGSLLFL

SEQ ID NO: 869315 - protein, 9 aa, Homo Sapiens
INNMNYKIK

SEQ ID NO: 869316 - protein, 9 aa, Homo Sapiens
LDKIIILYD

SEQ ID NO: 869317 - protein, 9 aa, Homo Sapiens
QTHTGEKSY

SEQ ID NO: 869318 - protein, 9 aa, Homo Sapiens
GNSWTVTMR

SEQ ID NO: 869319 - protein, 9 aa, Homo Sapiens
LQNGEFMTH

SEQ ID NO: 869320 - protein, 9 aa, Homo Sapiens
DNSLDSLHR

SEQ ID NO: 869321 - protein, 9 aa, Homo Sapiens
TKAAKLSRF

SEQ ID NO: 869322 - protein, 9 aa, Homo Sapiens
KESPDIAKY

SEQ ID NO: 869323 - protein, 9 aa, Homo Sapiens
EKMFGNGNF

SEQ ID NO: 869324 - protein, 9 aa, Homo Sapiens
EANKLTKLN

SEQ ID NO: 869325 - protein, 9 aa, Homo Sapiens
VPENCNKAK

SEQ ID NO: 869326 - protein, 9 aa, Homo Sapiens
FHRKFHSIR

SEQ ID NO: 869327 - protein, 9 aa, Homo Sapiens
SDKKEDIKT

SEQ ID NO: 869328 - protein, 9 aa, Homo Sapiens
TATKDTYDT

SEQ ID NO: 869329 - protein, 9 aa, Homo Sapiens
QEQVFFLFD

SEQ ID NO: 869330 - protein, 9 aa, Homo Sapiens
TKYFIKIEK

SEQ ID NO: 869331 - protein, 9 aa, Homo Sapiens
YVSADRNFI

SEQ ID NO: 869332 - protein, 9 aa, Homo Sapiens
NNNAPAFAQ

SEQ ID NO: 869333 - protein, 9 aa, Homo Sapiens
LLLGQQGLG

SEQ ID NO: 869334 - protein, 9 aa, Homo Sapiens
QNAVQQEDL

SEQ ID NO: 869335 - protein, 9 aa, Homo Sapiens
TMPEIMESG

SEQ ID NO: 869336 - protein, 9 aa, Homo Sapiens
FTSKLLRQE

SEQ ID NO: 869337 - protein, 9 aa, Homo Sapiens
SEKIITEHR

SEQ ID NO: 869338 - protein, 9 aa, Homo Sapiens
KMKIAGGNT

SEQ ID NO: 869339 - protein, 9 aa, Homo Sapiens
CHKCGFVVC

SEQ ID NO: 869340 - protein, 9 aa, Homo Sapiens
LLGHLTSHG

SEQ ID NO: 869341 - protein, 9 aa, Homo Sapiens
RRKKNKNRS

SEQ ID NO: 869342 - protein, 9 aa, Homo Sapiens
ISVGKYINC

SEQ ID NO: 869343 - protein, 9 aa, Homo Sapiens
TLQPWSDDS

SEQ ID NO: 869344 - protein, 9 aa, Homo Sapiens
PGILENTSD

SEQ ID NO: 869345 - protein, 9 aa, Homo Sapiens
DPETGRSRL

SEQ ID NO: 869346 - protein, 9 aa, Homo Sapiens
PKNSLFKFK

SEQ ID NO: 869347 - protein, 9 aa, Homo Sapiens
MSLYMVNSK

SEQ ID NO: 869348 - protein, 9 aa, Homo Sapiens
FATMINFVR

SEQ ID NO: 869349 - protein, 9 aa, Homo Sapiens
KTFWDAFGR

SEQ ID NO: 869350 - protein, 9 aa, Homo Sapiens
LSSSHPQSR

SEQ ID NO: 869351 - protein, 9 aa, Homo Sapiens
KVADTLTNA

SEQ ID NO: 869352 - protein, 9 aa, Homo Sapiens
SSRTTKSPP

SEQ ID NO: 869353 - protein, 9 aa, Homo Sapiens
IVFGPTLLQ

SEQ ID NO: 869354 - protein, 9 aa, Homo Sapiens
VNKESLAIS

SEQ ID NO: 869355 - protein, 9 aa, Homo Sapiens
QLSTLDKAF

SEQ ID NO: 869356 - protein, 9 aa, Homo Sapiens
LEEINEQEV

SEQ ID NO: 869357 - protein, 9 aa, Homo Sapiens
KSVCLDVTL

SEQ ID NO: 869358 - protein, 9 aa, Homo Sapiens
KAPEPNLMS

SEQ ID NO: 869359 - protein, 9 aa, Homo Sapiens
KQRTKNNKE

SEQ ID NO: 869360 - protein, 9 aa, Homo Sapiens
LYESIMKIL

SEQ ID NO: 869361 - protein, 9 aa, Homo Sapiens
GTHDYGRIT

SEQ ID NO: 869362 - protein, 9 aa, Homo Sapiens
CKESPDIAK

SEQ ID NO: 869363 - protein, 9 aa, Homo Sapiens
NYVHDARRV

SEQ ID NO: 869364 - protein, 9 aa, Homo Sapiens
KRGLHKLIN

SEQ ID NO: 869365 - protein, 9 aa, Homo Sapiens
YLIPQFQGR

SEQ ID NO: 869366 - protein, 9 aa, Homo Sapiens
KHIMALAKL

SEQ ID NO: 869367 - protein, 9 aa, Homo Sapiens
IARKLLPKV

SEQ ID NO: 869368 - protein, 9 aa, Homo Sapiens
TGGDKLPIQ

SEQ ID NO: 869369 - protein, 9 aa, Homo Sapiens
EVQLWAATE

SEQ ID NO: 869370 - protein, 9 aa, Homo Sapiens
KQRQIKLGF

SEQ ID NO: 869371 - protein, 9 aa, Homo Sapiens
LNRIHKLLN

SEQ ID NO: 869372 - protein, 9 aa, Homo Sapiens
TEDNLHVLN

SEQ ID NO: 869373 - protein, 9 aa, Homo Sapiens
QLWDTFSCD

SEQ ID NO: 869374 - protein, 9 aa, Homo Sapiens
PVEDRNVYI

SEQ ID NO: 869375 - protein, 9 aa, Homo Sapiens
ILQYYCCMA

SEQ ID NO: 869376 - protein, 9 aa, Homo Sapiens
TGDHVNLTT

SEQ ID NO: 869377 - protein, 9 aa, Homo Sapiens
ENEPYPVEY

SEQ ID NO: 869378 - protein, 9 aa, Homo Sapiens
PLTPLWTLL

SEQ ID NO: 869379 - protein, 9 aa, Homo Sapiens
KNSLKEAKQ

SEQ ID NO: 869380 - protein, 9 aa, Homo Sapiens
YIPLPMLWA

SEQ ID NO: 869381 - protein, 9 aa, Homo Sapiens
NLDDLDATD

SEQ ID NO: 869382 - protein, 9 aa, Homo Sapiens
IRKKNLAHP

SEQ ID NO: 869383 - protein, 9 aa, Homo Sapiens
GEDRKTPSK

SEQ ID NO: 869384 - protein, 9 aa, Homo Sapiens
QTHTGEKPH

SEQ ID NO: 869385 - protein, 9 aa, Homo Sapiens
WDHSTLLKV

SEQ ID NO: 869386 - protein, 9 aa, Homo Sapiens
SEEHLGRAV

SEQ ID NO: 869387 - protein, 9 aa, Homo Sapiens
QRVESMKAL

SEQ ID NO: 869388 - protein, 9 aa, Homo Sapiens
WAMYFKKED

SEQ ID NO: 869389 - protein, 9 aa, Homo Sapiens
DVDPQGIYA

SEQ ID NO: 869390 - protein, 9 aa, Homo Sapiens
DNSCRKYLF

SEQ ID NO: 869391 - protein, 9 aa, Homo Sapiens
AATHQDIDL

SEQ ID NO: 869392 - protein, 9 aa, Homo Sapiens
TEDEVDANL

SEQ ID NO: 869393 - protein, 9 aa, Homo Sapiens
LELQQRNSK

SEQ ID NO: 869394 - protein, 9 aa, Homo Sapiens
FLHTYSLSA

SEQ ID NO: 869395 - protein, 9 aa, Homo Sapiens
YKEGERDLC

SEQ ID NO: 869396 - protein, 9 aa, Homo Sapiens
KCCQCSFTA

SEQ ID NO: 869397 - protein, 9 aa, Homo Sapiens
ELAHCTVIT

SEQ ID NO: 869398 - protein, 9 aa, Homo Sapiens
CSTLTSSAA

SEQ ID NO: 869399 - protein, 9 aa, Homo Sapiens
INQTPGFSL

SEQ ID NO: 869400 - protein, 9 aa, Homo Sapiens
RKGNTKQII

SEQ ID NO: 869401 - protein, 9 aa, Homo Sapiens
TFCRAVLCG

SEQ ID NO: 869402 - protein, 9 aa, Homo Sapiens
RDEASVQLI

SEQ ID NO: 869403 - protein, 9 aa, Homo Sapiens
GSALILHQI

SEQ ID NO: 869404 - protein, 9 aa, Homo Sapiens
LQKNQKHPS

SEQ ID NO: 869405 - protein, 9 aa, Homo Sapiens
NSVNLDSLG

SEQ ID NO: 869406 - protein, 9 aa, Homo Sapiens
IEFTETSVV

SEQ ID NO: 869407 - protein, 9 aa, Homo Sapiens
DKKRQLQER

SEQ ID NO: 869408 - protein, 9 aa, Homo Sapiens
MSATVDSET

SEQ ID NO: 869409 - protein, 9 aa, Homo Sapiens
NKFPEPIKL

SEQ ID NO: 869410 - protein, 9 aa, Homo Sapiens
TAKKAPNGT

SEQ ID NO: 869411 - protein, 9 aa, Homo Sapiens
FLATVKVHP

SEQ ID NO: 869412 - protein, 9 aa, Homo Sapiens
FAQCIMFIV

SEQ ID NO: 869413 - protein, 9 aa, Homo Sapiens
GTERVMGLS

SEQ ID NO: 869414 - protein, 9 aa, Homo Sapiens
QVACNASIP

SEQ ID NO: 869415 - protein, 9 aa, Homo Sapiens
SPEITSPPD

SEQ ID NO: 869416 - protein, 9 aa, Homo Sapiens
FNLQRGDRL

SEQ ID NO: 869417 - protein, 9 aa, Homo Sapiens
PQSPGSNSK

SEQ ID NO: 869418 - protein, 9 aa, Homo Sapiens
FSPTSKQIR

SEQ ID NO: 869419 - protein, 9 aa, Homo Sapiens
ISSGEVHDI

SEQ ID NO: 869420 - protein, 9 aa, Homo Sapiens
GQLDYIPVS

SEQ ID NO: 869421 - protein, 9 aa, Homo Sapiens
GLCEAREQN

SEQ ID NO: 869422 - protein, 9 aa, Homo Sapiens
NRHLKNRIN

SEQ ID NO: 869423 - protein, 9 aa, Homo Sapiens
QPASQGLDF

SEQ ID NO: 869424 - protein, 9 aa, Homo Sapiens
NDREIIQEV

SEQ ID NO: 869425 - protein, 9 aa, Homo Sapiens
EIRLCQLIM

SEQ ID NO: 869426 - protein, 9 aa, Homo Sapiens
QPQIQPFQN

SEQ ID NO: 869427 - protein, 9 aa, Homo Sapiens
DYLYQNAVQ

SEQ ID NO: 869428 - protein, 9 aa, Homo Sapiens
IIQNAVVFQ

SEQ ID NO: 869429 - protein, 9 aa, Homo Sapiens
LSTTNILWL

SEQ ID NO: 869430 - protein, 9 aa, Homo Sapiens
VPGKVKAQI

SEQ ID NO: 869431 - protein, 9 aa, Homo Sapiens
DLPEEPSYP

SEQ ID NO: 869432 - protein, 9 aa, Homo Sapiens
VNNKSPSDP

SEQ ID NO: 869433 - protein, 9 aa, Homo Sapiens
AWHSQYKFC

SEQ ID NO: 869434 - protein, 9 aa, Homo Sapiens
INIPFDELN

SEQ ID NO: 869435 - protein, 9 aa, Homo Sapiens
TLPSLSAWP

SEQ ID NO: 869436 - protein, 9 aa, Homo Sapiens
LMLSVFYFT

SEQ ID NO: 869437 - protein, 9 aa, Homo Sapiens
NRKDKYNAI

SEQ ID NO: 869438 - protein, 9 aa, Homo Sapiens
QGFINLPEF

SEQ ID NO: 869439 - protein, 9 aa, Homo Sapiens
VNQNIMDFK

SEQ ID NO: 869440 - protein, 9 aa, Homo Sapiens
RAGAGALLH

SEQ ID NO: 869441 - protein, 9 aa, Homo Sapiens
IIRKKNLAH

SEQ ID NO: 869442 - protein, 9 aa, Homo Sapiens
NNSWWIPVV

SEQ ID NO: 869443 - protein, 9 aa, Homo Sapiens
GHRPQTCIL

SEQ ID NO: 869444 - protein, 9 aa, Homo Sapiens
VLNMNKRLY

SEQ ID NO: 869445 - protein, 9 aa, Homo Sapiens
INNPQFVFD

SEQ ID NO: 869446 - protein, 9 aa, Homo Sapiens
KMMKDKRPR

SEQ ID NO: 869447 - protein, 9 aa, Homo Sapiens
ETKLIIVDY

SEQ ID NO: 869448 - protein, 9 aa, Homo Sapiens
CSPMQDKLV

SEQ ID NO: 869449 - protein, 9 aa, Homo Sapiens
GDSNTNGRR

SEQ ID NO: 869450 - protein, 9 aa, Homo Sapiens
LPIVFNEFV

SEQ ID NO: 869451 - protein, 9 aa, Homo Sapiens
IGFKGIGEV

SEQ ID NO: 869452 - protein, 9 aa, Homo Sapiens
SKDKKKILF

SEQ ID NO: 869453 - protein, 9 aa, Homo Sapiens
TASVGHCHP

SEQ ID NO: 869454 - protein, 9 aa, Homo Sapiens
QQRDRAAAA

SEQ ID NO: 869455 - protein, 9 aa, Homo Sapiens
LSSYSGMII

SEQ ID NO: 869456 - protein, 9 aa, Homo Sapiens
KKNIHLWTS

SEQ ID NO: 869457 - protein, 9 aa, Homo Sapiens
GHCMVAHRN

SEQ ID NO: 869458 - protein, 9 aa, Homo Sapiens
ARKTKQVIT

SEQ ID NO: 869459 - protein, 9 aa, Homo Sapiens
FFGVPYAAP

SEQ ID NO: 869460 - protein, 9 aa, Homo Sapiens
TPPVLTTAK

SEQ ID NO: 869461 - protein, 9 aa, Homo Sapiens
PYYTVVKVD

SEQ ID NO: 869462 - protein, 9 aa, Homo Sapiens
KGSDQYRNA

SEQ ID NO: 869463 - protein, 9 aa, Homo Sapiens
IDPSLMRRL

SEQ ID NO: 869464 - protein, 9 aa, Homo Sapiens
NVKSFYQTL

SEQ ID NO: 869465 - protein, 9 aa, Homo Sapiens
DNPSKNHSD

SEQ ID NO: 869466 - protein, 9 aa, Homo Sapiens
IYKRCLNEN

SEQ ID NO: 869467 - protein, 9 aa, Homo Sapiens
KDYFQKVIL

SEQ ID NO: 869468 - protein, 9 aa, Homo Sapiens
FIRRLLVKY

SEQ ID NO: 869469 - protein, 9 aa, Homo Sapiens
PSCIPLVKK

SEQ ID NO: 869470 - protein, 9 aa, Homo Sapiens
ESNTSQHNS

SEQ ID NO: 869471 - protein, 9 aa, Homo Sapiens
TLQICTSQL

SEQ ID NO: 869472 - protein, 9 aa, Homo Sapiens
EFCQLIVNK

SEQ ID NO: 869473 - protein, 9 aa, Homo Sapiens
GGVAHTLQN

SEQ ID NO: 869474 - protein, 9 aa, Homo Sapiens
NLDCYTTVA

SEQ ID NO: 869475 - protein, 9 aa, Homo Sapiens
QNSNLAKHQ

SEQ ID NO: 869476 - protein, 9 aa, Homo Sapiens
KEEWPSLRS

SEQ ID NO: 869477 - protein, 9 aa, Homo Sapiens
LLSAERMCD

SEQ ID NO: 869478 - protein, 9 aa, Homo Sapiens
CSKEGCPAM

SEQ ID NO: 869479 - protein, 9 aa, Homo Sapiens
SSKLIRHQI

SEQ ID NO: 869480 - protein, 9 aa, Homo Sapiens
EQLQQEHCF

SEQ ID NO: 869481 - protein, 9 aa, Homo Sapiens
DILRYFFEL

SEQ ID NO: 869482 - protein, 9 aa, Homo Sapiens
HKRIYCALS

SEQ ID NO: 869483 - protein, 9 aa, Homo Sapiens
HTVSLLTAA

SEQ ID NO: 869484 - protein, 9 aa, Homo Sapiens
AQTDSQPFH

SEQ ID NO: 869485 - protein, 9 aa, Homo Sapiens
VQNENYNRV

SEQ ID NO: 869486 - protein, 9 aa, Homo Sapiens
LLPENGYWV

SEQ ID NO: 869487 - protein, 9 aa, Homo Sapiens
LLSTTNILW

SEQ ID NO: 869488 - protein, 9 aa, Homo Sapiens
GPMSGPAPI

SEQ ID NO: 869489 - protein, 9 aa, Homo Sapiens
PLCTKMAFI

SEQ ID NO: 869490 - protein, 9 aa, Homo Sapiens
ITYMLNPLI

SEQ ID NO: 869491 - protein, 9 aa, Homo Sapiens
ILIGQKLKD

SEQ ID NO: 869492 - protein, 9 aa, Homo Sapiens
VRPEFYFNI

SEQ ID NO: 869493 - protein, 9 aa, Homo Sapiens
QFIKIVPLL

SEQ ID NO: 869494 - protein, 9 aa, Homo Sapiens
IYKEDFKKE

SEQ ID NO: 869495 - protein, 9 aa, Homo Sapiens
YFGRRPPTV

SEQ ID NO: 869496 - protein, 9 aa, Homo Sapiens
IKSIPSYAF

SEQ ID NO: 869497 - protein, 9 aa, Homo Sapiens
TSVENLFCF

SEQ ID NO: 869498 - protein, 9 aa, Homo Sapiens
VFVNLPYYT

SEQ ID NO: 869499 - protein, 9 aa, Homo Sapiens
FTTDGAHNT

SEQ ID NO: 869500 - protein, 9 aa, Homo Sapiens
IKITDAKKR

SEQ ID NO: 869501 - protein, 9 aa, Homo Sapiens
AEVKILAVF

SEQ ID NO: 869502 - protein, 9 aa, Homo Sapiens
RDNEEFGVK

SEQ ID NO: 869503 - protein, 9 aa, Homo Sapiens
VSQSMTPFT

SEQ ID NO: 869504 - protein, 9 aa, Homo Sapiens
LKLRRGDPF

SEQ ID NO: 869505 - protein, 9 aa, Homo Sapiens
CRLVFLFMQ

SEQ ID NO: 869506 - protein, 9 aa, Homo Sapiens
NLHVVILLP

SEQ ID NO: 869507 - protein, 9 aa, Homo Sapiens
GVLGSFSVI

SEQ ID NO: 869508 - protein, 9 aa, Homo Sapiens
WGKVFPPAA

SEQ ID NO: 869509 - protein, 9 aa, Homo Sapiens
LEQDNASLE

SEQ ID NO: 869510 - protein, 9 aa, Homo Sapiens
SLHLQDHQQ

SEQ ID NO: 869511 - protein, 9 aa, Homo Sapiens
REQHIKAHK

SEQ ID NO: 869512 - protein, 9 aa, Homo Sapiens
GIFSPLAGL

SEQ ID NO: 869513 - protein, 9 aa, Homo Sapiens
RCCVLERKQ

SEQ ID NO: 869514 - protein, 9 aa, Homo Sapiens
FNPRWMMMP

SEQ ID NO: 869515 - protein, 9 aa, Homo Sapiens
EPNRNKYLE

SEQ ID NO: 869516 - protein, 9 aa, Homo Sapiens
RTNLKRKNK

SEQ ID NO: 869517 - protein, 9 aa, Homo Sapiens
PKLSPPQPL

SEQ ID NO: 869518 - protein, 9 aa, Homo Sapiens
TECSNGLFC

SEQ ID NO: 869519 - protein, 9 aa, Homo Sapiens
KSFSFVCVI

SEQ ID NO: 869520 - protein, 9 aa, Homo Sapiens
TTDEELCNG

SEQ ID NO: 869521 - protein, 9 aa, Homo Sapiens
RQRLIQNAN

SEQ ID NO: 869522 - protein, 9 aa, Homo Sapiens
AMVCCNNEA

SEQ ID NO: 869523 - protein, 9 aa, Homo Sapiens
RVENANPTA

SEQ ID NO: 869524 - protein, 9 aa, Homo Sapiens
LYEHRRSHT

SEQ ID NO: 869525 - protein, 9 aa, Homo Sapiens
DNNLGSLQP

SEQ ID NO: 869526 - protein, 9 aa, Homo Sapiens
LFHTSIEQD

SEQ ID NO: 869527 - protein, 9 aa, Homo Sapiens
SVGISVLHW

SEQ ID NO: 869528 - protein, 9 aa, Homo Sapiens
KGRKGIYEI

SEQ ID NO: 869529 - protein, 9 aa, Homo Sapiens
DFIHRVLSQ

SEQ ID NO: 869530 - protein, 9 aa, Homo Sapiens
LIQFDDFAN

SEQ ID NO: 869531 - protein, 9 aa, Homo Sapiens
ILAKIWWKY

SEQ ID NO: 869532 - protein, 9 aa, Homo Sapiens
MKVECPTKL

SEQ ID NO: 869533 - protein, 9 aa, Homo Sapiens
QQRDLIRQI

SEQ ID NO: 869534 - protein, 9 aa, Homo Sapiens
ENVKVLLSN

SEQ ID NO: 869535 - protein, 9 aa, Homo Sapiens
HGKLCICCL

SEQ ID NO: 869536 - protein, 9 aa, Homo Sapiens
NYSASEDSS

SEQ ID NO: 869537 - protein, 9 aa, Homo Sapiens
EDNLHVLNQ

SEQ ID NO: 869538 - protein, 9 aa, Homo Sapiens
IYPNLLGLQ

SEQ ID NO: 869539 - protein, 9 aa, Homo Sapiens
KRSRSQTAT

SEQ ID NO: 869540 - protein, 9 aa, Homo Sapiens
ITANLFQIL

SEQ ID NO: 869541 - protein, 9 aa, Homo Sapiens
KICGFGLAR

SEQ ID NO: 869542 - protein, 9 aa, Homo Sapiens
CQEAPPHIF

SEQ ID NO: 869543 - protein, 9 aa, Homo Sapiens
STSFMSVNP

SEQ ID NO: 869544 - protein, 9 aa, Homo Sapiens
VFNKIGNAI

SEQ ID NO: 869545 - protein, 9 aa, Homo Sapiens
IGLPYADHH

SEQ ID NO: 869546 - protein, 9 aa, Homo Sapiens
SYWALGYVI

SEQ ID NO: 869547 - protein, 9 aa, Homo Sapiens
SPMLCLTLV

SEQ ID NO: 869548 - protein, 9 aa, Homo Sapiens
STNFDEKPA

SEQ ID NO: 869549 - protein, 9 aa, Homo Sapiens
QAGGESESG

SEQ ID NO: 869550 - protein, 9 aa, Homo Sapiens
LQNLVDKIS

SEQ ID NO: 869551 - protein, 9 aa, Homo Sapiens
QNDRRNAPP

SEQ ID NO: 869552 - protein, 9 aa, Homo Sapiens
LFKHISEQF

SEQ ID NO: 869553 - protein, 9 aa, Homo Sapiens
SQKTGYLVE

SEQ ID NO: 869554 - protein, 9 aa, Homo Sapiens
INKCRHPGT

SEQ ID NO: 869555 - protein, 9 aa, Homo Sapiens
HYLKDMMLY

SEQ ID NO: 869556 - protein, 9 aa, Homo Sapiens
DLQSHGETK

SEQ ID NO: 869557 - protein, 9 aa, Homo Sapiens
LFEASLTLK

SEQ ID NO: 869558 - protein, 9 aa, Homo Sapiens
SKGDWYKPQ

SEQ ID NO: 869559 - protein, 9 aa, Homo Sapiens
PLEKHNHQS

SEQ ID NO: 869560 - protein, 9 aa, Homo Sapiens
KPDVFIKLQ

SEQ ID NO: 869561 - protein, 9 aa, Homo Sapiens
YWIGWVCQM

SEQ ID NO: 869562 - protein, 9 aa, Homo Sapiens
VVGITWILA

SEQ ID NO: 869563 - protein, 9 aa, Homo Sapiens
LLGYHGLLG

SEQ ID NO: 869564 - protein, 9 aa, Homo Sapiens
KVSVSGIKW

SEQ ID NO: 869565 - protein, 9 aa, Homo Sapiens
CDYSKLTWY

SEQ ID NO: 869566 - protein, 9 aa, Homo Sapiens
DKVPKTAEH

SEQ ID NO: 869567 - protein, 9 aa, Homo Sapiens
DDRGRVCMA

SEQ ID NO: 869568 - protein, 9 aa, Homo Sapiens
DDKNKNKND

SEQ ID NO: 869569 - protein, 9 aa, Homo Sapiens
NKTINTTLT

SEQ ID NO: 869570 - protein, 9 aa, Homo Sapiens
QNSVTVQVP

SEQ ID NO: 869571 - protein, 9 aa, Homo Sapiens
QADTFCPAE

SEQ ID NO: 869572 - protein, 9 aa, Homo Sapiens
SHEYCRNLP

SEQ ID NO: 869573 - protein, 9 aa, Homo Sapiens
ELPTTKLNS

SEQ ID NO: 869574 - protein, 9 aa, Homo Sapiens
SQNGAFIWN

SEQ ID NO: 869575 - protein, 9 aa, Homo Sapiens
KLGNIANTS

SEQ ID NO: 869576 - protein, 9 aa, Homo Sapiens
SGGGGSQSI

SEQ ID NO: 869577 - protein, 9 aa, Homo Sapiens
QMFPCQFIK

SEQ ID NO: 869578 - protein, 9 aa, Homo Sapiens
ALFKHGLKK

SEQ ID NO: 869579 - protein, 9 aa, Homo Sapiens
PQFLQYYDM

SEQ ID NO: 869580 - protein, 9 aa, Homo Sapiens
TQTDITFKH

SEQ ID NO: 869581 - protein, 9 aa, Homo Sapiens
YTLSGLQEG

SEQ ID NO: 869582 - protein, 9 aa, Homo Sapiens
KSINKTPKK

SEQ ID NO: 869583 - protein, 9 aa, Homo Sapiens
ILPLHVLNV

SEQ ID NO: 869584 - protein, 9 aa, Homo Sapiens
SESRWRLDK

SEQ ID NO: 869585 - protein, 9 aa, Homo Sapiens
CFTDTAVVA

SEQ ID NO: 869586 - protein, 9 aa, Homo Sapiens
ISSELSLAP

SEQ ID NO: 869587 - protein, 9 aa, Homo Sapiens
YCVIIQAND

SEQ ID NO: 869588 - protein, 9 aa, Homo Sapiens
PLPMLWALL

SEQ ID NO: 869589 - protein, 9 aa, Homo Sapiens
QSPVALCGL

SEQ ID NO: 869590 - protein, 9 aa, Homo Sapiens
GFGLLLSLN

SEQ ID NO: 869591 - protein, 9 aa, Homo Sapiens
KVCIYRGKE

SEQ ID NO: 869592 - protein, 9 aa, Homo Sapiens
VKQCGLGAR

SEQ ID NO: 869593 - protein, 9 aa, Homo Sapiens
LSLLLGQQG

SEQ ID NO: 869594 - protein, 9 aa, Homo Sapiens
KFCDPQMCF

SEQ ID NO: 869595 - protein, 9 aa, Homo Sapiens
ERNQILENS

SEQ ID NO: 869596 - protein, 9 aa, Homo Sapiens
VILVILGEA

SEQ ID NO: 869597 - protein, 9 aa, Homo Sapiens
DNQQANGHV

SEQ ID NO: 869598 - protein, 9 aa, Homo Sapiens
IPILSSQLR

SEQ ID NO: 869599 - protein, 9 aa, Homo Sapiens
KYALQRTWN

SEQ ID NO: 869600 - protein, 9 aa, Homo Sapiens
RRGIVFLDT

SEQ ID NO: 869601 - protein, 9 aa, Homo Sapiens
CDASGLSCH

SEQ ID NO: 869602 - protein, 9 aa, Homo Sapiens
CAEEWQKSR

SEQ ID NO: 869603 - protein, 9 aa, Homo Sapiens
DYFTGLVNI

SEQ ID NO: 869604 - protein, 9 aa, Homo Sapiens
SLQVRQEPV

SEQ ID NO: 869605 - protein, 9 aa, Homo Sapiens
KVDLPKLDG

SEQ ID NO: 869606 - protein, 9 aa, Homo Sapiens
FASVVNYFI

SEQ ID NO: 869607 - protein, 9 aa, Homo Sapiens
SPEDMEIGP

SEQ ID NO: 869608 - protein, 9 aa, Homo Sapiens
PVENSGAIE

SEQ ID NO: 869609 - protein, 9 aa, Homo Sapiens
AIKQLKEQA

SEQ ID NO: 869610 - protein, 9 aa, Homo Sapiens
ACKECGKCF

SEQ ID NO: 869611 - protein, 9 aa, Homo Sapiens
LVMYIERYS

SEQ ID NO: 869612 - protein, 9 aa, Homo Sapiens
ESGLELEKK

SEQ ID NO: 869613 - protein, 9 aa, Homo Sapiens
SLLNKELVP

SEQ ID NO: 869614 - protein, 9 aa, Homo Sapiens
RYHNEIKSW

SEQ ID NO: 869615 - protein, 9 aa, Homo Sapiens
LPINIARPC

SEQ ID NO: 869616 - protein, 9 aa, Homo Sapiens
SLHPLALIV

SEQ ID NO: 869617 - protein, 9 aa, Homo Sapiens
GRPLTQLSC

SEQ ID NO: 869618 - protein, 9 aa, Homo Sapiens
NNLFMRGFS

SEQ ID NO: 869619 - protein, 9 aa, Homo Sapiens
REPDPFKFS

SEQ ID NO: 869620 - protein, 9 aa, Homo Sapiens
ATVTPRTVH

SEQ ID NO: 869621 - protein, 9 aa, Homo Sapiens
EASLTLKYG

SEQ ID NO: 869622 - protein, 9 aa, Homo Sapiens
RLRWPCCLV

SEQ ID NO: 869623 - protein, 9 aa, Homo Sapiens
DGMPLDYVP

SEQ ID NO: 869624 - protein, 9 aa, Homo Sapiens
IQIKASSLS

SEQ ID NO: 869625 - protein, 9 aa, Homo Sapiens
GPVLRFPLT

SEQ ID NO: 869626 - protein, 9 aa, Homo Sapiens
GRIEKLESK

SEQ ID NO: 869627 - protein, 9 aa, Homo Sapiens
RIFKNADNG

SEQ ID NO: 869628 - protein, 9 aa, Homo Sapiens
TVPSNHQNN

SEQ ID NO: 869629 - protein, 9 aa, Homo Sapiens
DARALINLH

SEQ ID NO: 869630 - protein, 9 aa, Homo Sapiens
SRDGTLDGS

SEQ ID NO: 869631 - protein, 9 aa, Homo Sapiens
KLQKKDFLE

SEQ ID NO: 869632 - protein, 9 aa, Homo Sapiens
SVLYNETQE

SEQ ID NO: 869633 - protein, 9 aa, Homo Sapiens
AQRAGFKAA

SEQ ID NO: 869634 - protein, 9 aa, Homo Sapiens
SVQLIPQTT

SEQ ID NO: 869635 - protein, 9 aa, Homo Sapiens
KTLNVGRNP

SEQ ID NO: 869636 - protein, 9 aa, Homo Sapiens
TLFCTLLIH

SEQ ID NO: 869637 - protein, 9 aa, Homo Sapiens
SICFTDTAV

SEQ ID NO: 869638 - protein, 9 aa, Homo Sapiens
FTVAGTLVV

SEQ ID NO: 869639 - protein, 9 aa, Homo Sapiens
YNAGVKQIA

SEQ ID NO: 869640 - protein, 9 aa, Homo Sapiens
TASFLSLEP

SEQ ID NO: 869641 - protein, 9 aa, Homo Sapiens
GGLVAHLLS

SEQ ID NO: 869642 - protein, 9 aa, Homo Sapiens
KGKAKWEAL

SEQ ID NO: 869643 - protein, 9 aa, Homo Sapiens
ESTGKLGKI

SEQ ID NO: 869644 - protein, 9 aa, Homo Sapiens
RKKNKNRSY

SEQ ID NO: 869645 - protein, 9 aa, Homo Sapiens
LAYTLPLER

SEQ ID NO: 869646 - protein, 9 aa, Homo Sapiens
LDREVKLRD

SEQ ID NO: 869647 - protein, 9 aa, Homo Sapiens
SKGMGSGFA

SEQ ID NO: 869648 - protein, 9 aa, Homo Sapiens
TAVPASDSR

SEQ ID NO: 869649 - protein, 9 aa, Homo Sapiens
VSRRLLLDG

SEQ ID NO: 869650 - protein, 9 aa, Homo Sapiens
IENVVRKQE

SEQ ID NO: 869651 - protein, 9 aa, Homo Sapiens
KAEARGDML

SEQ ID NO: 869652 - protein, 9 aa, Homo Sapiens
PGGATGPKG

SEQ ID NO: 869653 - protein, 9 aa, Homo Sapiens
IYLQRRPCN

SEQ ID NO: 869654 - protein, 9 aa, Homo Sapiens
SQASSLQLN

SEQ ID NO: 869655 - protein, 9 aa, Homo Sapiens
KPCRPLHQL

SEQ ID NO: 869656 - protein, 9 aa, Homo Sapiens
AILHLLKFC

SEQ ID NO: 869657 - protein, 9 aa, Homo Sapiens
QQPHPRIKP

SEQ ID NO: 869658 - protein, 9 aa, Homo Sapiens
GQVLAQMHD

SEQ ID NO: 869659 - protein, 9 aa, Homo Sapiens
LHKQPSHVI

SEQ ID NO: 869660 - protein, 9 aa, Homo Sapiens
MRRLVNISV

SEQ ID NO: 869661 - protein, 9 aa, Homo Sapiens
EEIAQVQTK

SEQ ID NO: 869662 - protein, 9 aa, Homo Sapiens
GACVTVTCD

SEQ ID NO: 869663 - protein, 9 aa, Homo Sapiens
HKLPRVPSF

SEQ ID NO: 869664 - protein, 9 aa, Homo Sapiens
EYVIGCYPQ

SEQ ID NO: 869665 - protein, 9 aa, Homo Sapiens
KAQIVKLFL

SEQ ID NO: 869666 - protein, 9 aa, Homo Sapiens
RWNNQSINL

SEQ ID NO: 869667 - protein, 9 aa, Homo Sapiens
WPRRIRMED

SEQ ID NO: 869668 - protein, 9 aa, Homo Sapiens
RRQLSLLLG

SEQ ID NO: 869669 - protein, 9 aa, Homo Sapiens
ERRLFCHLQ

SEQ ID NO: 869670 - protein, 9 aa, Homo Sapiens
DKDDMGRIN

SEQ ID NO: 869671 - protein, 9 aa, Homo Sapiens
FFFVPCMFM

SEQ ID NO: 869672 - protein, 9 aa, Homo Sapiens
VVGMWPDPQ

SEQ ID NO: 869673 - protein, 9 aa, Homo Sapiens
QLLETKPEF

SEQ ID NO: 869674 - protein, 9 aa, Homo Sapiens
IRLCQLIMA

SEQ ID NO: 869675 - protein, 9 aa, Homo Sapiens
CYLRRKLVE

SEQ ID NO: 869676 - protein, 9 aa, Homo Sapiens
LQQDDLGTA

SEQ ID NO: 869677 - protein, 9 aa, Homo Sapiens
TDLVHFAES

SEQ ID NO: 869678 - protein, 9 aa, Homo Sapiens
QLRIYFPPG

SEQ ID NO: 869679 - protein, 9 aa, Homo Sapiens
NICGKRFMQ

SEQ ID NO: 869680 - protein, 9 aa, Homo Sapiens
KSVPLQVLL

SEQ ID NO: 869681 - protein, 9 aa, Homo Sapiens
CYERECKLP

SEQ ID NO: 869682 - protein, 9 aa, Homo Sapiens
DCGHRGSSG

SEQ ID NO: 869683 - protein, 9 aa, Homo Sapiens
TPKTPQTPR

SEQ ID NO: 869684 - protein, 9 aa, Homo Sapiens
DFVHPLNIN

SEQ ID NO: 869685 - protein, 9 aa, Homo Sapiens
QDDVLIVDL

SEQ ID NO: 869686 - protein, 9 aa, Homo Sapiens
RPDNFELVK

SEQ ID NO: 869687 - protein, 9 aa, Homo Sapiens
FLCSQQELE

SEQ ID NO: 869688 - protein, 9 aa, Homo Sapiens
CRGKIVRQS

SEQ ID NO: 869689 - protein, 9 aa, Homo Sapiens
DIKFELLAR

SEQ ID NO: 869690 - protein, 9 aa, Homo Sapiens
SDISEMQAL

SEQ ID NO: 869691 - protein, 9 aa, Homo Sapiens
LPGSLHEKG

SEQ ID NO: 869692 - protein, 9 aa, Homo Sapiens
TRQIGIFSV

SEQ ID NO: 869693 - protein, 9 aa, Homo Sapiens
AGKFEAVLV

SEQ ID NO: 869694 - protein, 9 aa, Homo Sapiens
LFNRLCSQT

SEQ ID NO: 869695 - protein, 9 aa, Homo Sapiens
LKLFWTLEF

SEQ ID NO: 869696 - protein, 9 aa, Homo Sapiens
HKLGSTHER

SEQ ID NO: 869697 - protein, 9 aa, Homo Sapiens
LNVEIEELT

SEQ ID NO: 869698 - protein, 9 aa, Homo Sapiens
ISDTVSQAN

SEQ ID NO: 869699 - protein, 9 aa, Homo Sapiens
DKEYPNTAL

SEQ ID NO: 869700 - protein, 9 aa, Homo Sapiens
LSSTVTVCL

SEQ ID NO: 869701 - protein, 9 aa, Homo Sapiens
GFMEQLCTY

SEQ ID NO: 869702 - protein, 9 aa, Homo Sapiens
LTIKKRLPF

SEQ ID NO: 869703 - protein, 9 aa, Homo Sapiens
PQPGGASGP

SEQ ID NO: 869704 - protein, 9 aa, Homo Sapiens
KNRDAILAL

SEQ ID NO: 869705 - protein, 9 aa, Homo Sapiens
RNIFYLSKE

SEQ ID NO: 869706 - protein, 9 aa, Homo Sapiens
KPPSRGGTL

SEQ ID NO: 869707 - protein, 9 aa, Homo Sapiens
EKVYEIIEL

SEQ ID NO: 869708 - protein, 9 aa, Homo Sapiens
RLYNYVHDA

SEQ ID NO: 869709 - protein, 9 aa, Homo Sapiens
VAASNAADS

SEQ ID NO: 869710 - protein, 9 aa, Homo Sapiens
VLTRKHSDG

SEQ ID NO: 869711 - protein, 9 aa, Homo Sapiens
KPKATETSH

SEQ ID NO: 869712 - protein, 9 aa, Homo Sapiens
VPIIKLTDY

SEQ ID NO: 869713 - protein, 9 aa, Homo Sapiens
QPESDKYHE

SEQ ID NO: 869714 - protein, 9 aa, Homo Sapiens
TQGKGDAAD

SEQ ID NO: 869715 - protein, 9 aa, Homo Sapiens
TSLMALAVS

SEQ ID NO: 869716 - protein, 9 aa, Homo Sapiens
VENSDNPLN

SEQ ID NO: 869717 - protein, 9 aa, Homo Sapiens
LCCKRGNVG

SEQ ID NO: 869718 - protein, 9 aa, Homo Sapiens
RGTPGTWGP

SEQ ID NO: 869719 - protein, 9 aa, Homo Sapiens
AQTHSGLTD

SEQ ID NO: 869720 - protein, 9 aa, Homo Sapiens
YMHKICFPI

SEQ ID NO: 869721 - protein, 9 aa, Homo Sapiens
VRETYCYLT

SEQ ID NO: 869722 - protein, 9 aa, Homo Sapiens
LDGCWIYLC

SEQ ID NO: 869723 - protein, 9 aa, Homo Sapiens
IKTSILSLF

SEQ ID NO: 869724 - protein, 9 aa, Homo Sapiens
AADGVAASN

SEQ ID NO: 869725 - protein, 9 aa, Homo Sapiens
TIQKAWWRH

SEQ ID NO: 869726 - protein, 9 aa, Homo Sapiens
YFYICVNGS

SEQ ID NO: 869727 - protein, 9 aa, Homo Sapiens
KIDLTGIFL

SEQ ID NO: 869728 - protein, 9 aa, Homo Sapiens
PATPYEAFN

SEQ ID NO: 869729 - protein, 9 aa, Homo Sapiens
KEENYLRIV

SEQ ID NO: 869730 - protein, 9 aa, Homo Sapiens
YLQQQIFPL

SEQ ID NO: 869731 - protein, 9 aa, Homo Sapiens
NQGSYFGVI

SEQ ID NO: 869732 - protein, 9 aa, Homo Sapiens
LDLRKNLCC

SEQ ID NO: 869733 - protein, 9 aa, Homo Sapiens
ACNPQECFQ

SEQ ID NO: 869734 - protein, 9 aa, Homo Sapiens
HQEYYRGQN

SEQ ID NO: 869735 - protein, 9 aa, Homo Sapiens
RDKKLRKEA

SEQ ID NO: 869736 - protein, 9 aa, Homo Sapiens
LVALMVETQ

SEQ ID NO: 869737 - protein, 9 aa, Homo Sapiens
TGLAIHIQN

SEQ ID NO: 869738 - protein, 9 aa, Homo Sapiens
ALKALFKHG

SEQ ID NO: 869739 - protein, 9 aa, Homo Sapiens
AWKWMLGPV

SEQ ID NO: 869740 - protein, 9 aa, Homo Sapiens
YRMLLVKRR

SEQ ID NO: 869741 - protein, 9 aa, Homo Sapiens
HSIRGEVYQ

SEQ ID NO: 869742 - protein, 9 aa, Homo Sapiens
LFQSHDYPV

SEQ ID NO: 869743 - protein, 9 aa, Homo Sapiens
YIGELCCYL

SEQ ID NO: 869744 - protein, 9 aa, Homo Sapiens
CAIFLHGRN

SEQ ID NO: 869745 - protein, 9 aa, Homo Sapiens
AHSYRMGFT

SEQ ID NO: 869746 - protein, 9 aa, Homo Sapiens
RFQPNTREL

SEQ ID NO: 869747 - protein, 9 aa, Homo Sapiens
PERNCSGNQ

SEQ ID NO: 869748 - protein, 9 aa, Homo Sapiens
GVTVIDNKL

SEQ ID NO: 869749 - protein, 9 aa, Homo Sapiens
GMRRKAFWL

SEQ ID NO: 869750 - protein, 9 aa, Homo Sapiens
AFAEARINM

SEQ ID NO: 869751 - protein, 9 aa, Homo Sapiens
LFGENPWWV

SEQ ID NO: 869752 - protein, 9 aa, Homo Sapiens
AGPSGRVQA

SEQ ID NO: 869753 - protein, 9 aa, Homo Sapiens
CMVDILACR

SEQ ID NO: 869754 - protein, 9 aa, Homo Sapiens
FQSHDYPVK

SEQ ID NO: 869755 - protein, 9 aa, Homo Sapiens
KQNSLIADM

SEQ ID NO: 869756 - protein, 9 aa, Homo Sapiens
INMVVDDDS

SEQ ID NO: 869757 - protein, 9 aa, Homo Sapiens
TVADKSFAV

SEQ ID NO: 869758 - protein, 9 aa, Homo Sapiens
CITQIKCKD

SEQ ID NO: 869759 - protein, 9 aa, Homo Sapiens
WDLEPNTDY

SEQ ID NO: 869760 - protein, 9 aa, Homo Sapiens
SDLPALASQ

SEQ ID NO: 869761 - protein, 9 aa, Homo Sapiens
LIKPFVPHS

SEQ ID NO: 869762 - protein, 9 aa, Homo Sapiens
TKLQDKYNS

SEQ ID NO: 869763 - protein, 9 aa, Homo Sapiens
GHHWHMKHF

SEQ ID NO: 869764 - protein, 9 aa, Homo Sapiens
EMMNEVLDM

SEQ ID NO: 869765 - protein, 9 aa, Homo Sapiens
PVKKKKIQR

SEQ ID NO: 869766 - protein, 9 aa, Homo Sapiens
HGEITRLTL

SEQ ID NO: 869767 - protein, 9 aa, Homo Sapiens
SCSLHARIE

SEQ ID NO: 869768 - protein, 9 aa, Homo Sapiens
ATSYFSSPN

SEQ ID NO: 869769 - protein, 9 aa, Homo Sapiens
QQRLQNLVD

SEQ ID NO: 869770 - protein, 9 aa, Homo Sapiens
QNARWSTHT

SEQ ID NO: 869771 - protein, 9 aa, Homo Sapiens
IQNELAHCT

SEQ ID NO: 869772 - protein, 9 aa, Homo Sapiens
TISFNPSLY

SEQ ID NO: 869773 - protein, 9 aa, Homo Sapiens
SYLLPDKPR

SEQ ID NO: 869774 - protein, 9 aa, Homo Sapiens
AHKIIHNRE

SEQ ID NO: 869775 - protein, 9 aa, Homo Sapiens
HQSPVTKIM

SEQ ID NO: 869776 - protein, 9 aa, Homo Sapiens
AKWMVHGYP

SEQ ID NO: 869777 - protein, 9 aa, Homo Sapiens
AQCSIKQEQ

SEQ ID NO: 869778 - protein, 9 aa, Homo Sapiens
NIKLTQLKL

SEQ ID NO: 869779 - protein, 9 aa, Homo Sapiens
LTSTQSLSP

SEQ ID NO: 869780 - protein, 9 aa, Homo Sapiens
FKNRQQRDR

SEQ ID NO: 869781 - protein, 9 aa, Homo Sapiens
SSQLRYCAG

SEQ ID NO: 869782 - protein, 9 aa, Homo Sapiens
VQSLSQKYY

SEQ ID NO: 869783 - protein, 9 aa, Homo Sapiens
QSPRRIPKK

SEQ ID NO: 869784 - protein, 9 aa, Homo Sapiens
FKEIIGYTH

SEQ ID NO: 869785 - protein, 9 aa, Homo Sapiens
IKVLENIKL

SEQ ID NO: 869786 - protein, 9 aa, Homo Sapiens
AQTFFKITA

SEQ ID NO: 869787 - protein, 9 aa, Homo Sapiens
RIHEITHIG

SEQ ID NO: 869788 - protein, 9 aa, Homo Sapiens
KCQEAPPHI

SEQ ID NO: 869789 - protein, 9 aa, Homo Sapiens
HLTETLKEH

SEQ ID NO: 869790 - protein, 9 aa, Homo Sapiens
LNPLICTLK

SEQ ID NO: 869791 - protein, 9 aa, Homo Sapiens
CGKLTEICH

SEQ ID NO: 869792 - protein, 9 aa, Homo Sapiens
KYLFFHHSH

SEQ ID NO: 869793 - protein, 9 aa, Homo Sapiens
GKCFRHHTS

SEQ ID NO: 869794 - protein, 9 aa, Homo Sapiens
ISRVLSMYE

SEQ ID NO: 869795 - protein, 9 aa, Homo Sapiens
VANCSASIR

SEQ ID NO: 869796 - protein, 9 aa, Homo Sapiens
LALNPQTQT

SEQ ID NO: 869797 - protein, 9 aa, Homo Sapiens
CETCRGQVL

SEQ ID NO: 869798 - protein, 9 aa, Homo Sapiens
NSNISKKSK

SEQ ID NO: 869799 - protein, 9 aa, Homo Sapiens
KVMVMISSE

SEQ ID NO: 869800 - protein, 9 aa, Homo Sapiens
QILGVPQNA

SEQ ID NO: 869801 - protein, 9 aa, Homo Sapiens
IQVTPDKDD

SEQ ID NO: 869802 - protein, 9 aa, Homo Sapiens
ALHISQNFL

SEQ ID NO: 869803 - protein, 9 aa, Homo Sapiens
SATAHPAPM

SEQ ID NO: 869804 - protein, 9 aa, Homo Sapiens
KLHKFKIKI

SEQ ID NO: 869805 - protein, 9 aa, Homo Sapiens
ISDLGGSNS

SEQ ID NO: 869806 - protein, 9 aa, Homo Sapiens
ILALYDRQG

SEQ ID NO: 869807 - protein, 9 aa, Homo Sapiens
DSSILVMYY

SEQ ID NO: 869808 - protein, 9 aa, Homo Sapiens
ENMNLLLDA

SEQ ID NO: 869809 - protein, 9 aa, Homo Sapiens
ILSDEDFNW

SEQ ID NO: 869810 - protein, 9 aa, Homo Sapiens
KIQGDLAGC

SEQ ID NO: 869811 - protein, 9 aa, Homo Sapiens
LVSVIIPTI

SEQ ID NO: 869812 - protein, 9 aa, Homo Sapiens
GALRFTKLG

SEQ ID NO: 869813 - protein, 9 aa, Homo Sapiens
PKEICAQTF

SEQ ID NO: 869814 - protein, 9 aa, Homo Sapiens
QRTIRLAPL

SEQ ID NO: 869815 - protein, 9 aa, Homo Sapiens
YQITTAAAL

SEQ ID NO: 869816 - protein, 9 aa, Homo Sapiens
HSGEWANAP

SEQ ID NO: 869817 - protein, 9 aa, Homo Sapiens
DLYKYLFFH

SEQ ID NO: 869818 - protein, 9 aa, Homo Sapiens
EKEEQYITQ

SEQ ID NO: 869819 - protein, 9 aa, Homo Sapiens
MGRINAGID

SEQ ID NO: 869820 - protein, 9 aa, Homo Sapiens
LVSVCVYYK

SEQ ID NO: 869821 - protein, 9 aa, Homo Sapiens
RILVVNNDV

SEQ ID NO: 869822 - protein, 9 aa, Homo Sapiens
QKARSSEVK

SEQ ID NO: 869823 - protein, 9 aa, Homo Sapiens
KRSQGWIPV

SEQ ID NO: 869824 - protein, 9 aa, Homo Sapiens
KIIHNREKA

SEQ ID NO: 869825 - protein, 9 aa, Homo Sapiens
LATNMISIF

SEQ ID NO: 869826 - protein, 9 aa, Homo Sapiens
LSVKSLFWR

SEQ ID NO: 869827 - protein, 9 aa, Homo Sapiens
NDNDTTEPR

SEQ ID NO: 869828 - protein, 9 aa, Homo Sapiens
YQAVENLCY

SEQ ID NO: 869829 - protein, 9 aa, Homo Sapiens
DTFKEKDTY

SEQ ID NO: 869830 - protein, 9 aa, Homo Sapiens
RKAFLHWLT

SEQ ID NO: 869831 - protein, 9 aa, Homo Sapiens
MKMETSPLR

SEQ ID NO: 869832 - protein, 9 aa, Homo Sapiens
QNGTDKDAE

SEQ ID NO: 869833 - protein, 9 aa, Homo Sapiens
AVREELFKV

SEQ ID NO: 869834 - protein, 9 aa, Homo Sapiens
ISQFRGPQA

SEQ ID NO: 869835 - protein, 9 aa, Homo Sapiens
HSHTGERPF

SEQ ID NO: 869836 - protein, 9 aa, Homo Sapiens
GSSKWVMES

SEQ ID NO: 869837 - protein, 9 aa, Homo Sapiens
LHQIIHSGE

SEQ ID NO: 869838 - protein, 9 aa, Homo Sapiens
GMKSCGIHE

SEQ ID NO: 869839 - protein, 9 aa, Homo Sapiens
KVIILHRRK

SEQ ID NO: 869840 - protein, 9 aa, Homo Sapiens
TFFECKRSV

SEQ ID NO: 869841 - protein, 9 aa, Homo Sapiens
CPPGFLRRD

SEQ ID NO: 869842 - protein, 9 aa, Homo Sapiens
KSILYDHEN

SEQ ID NO: 869843 - protein, 9 aa, Homo Sapiens
QSPTEDKIL

SEQ ID NO: 869844 - protein, 9 aa, Homo Sapiens
ETPLMITCK

SEQ ID NO: 869845 - protein, 9 aa, Homo Sapiens
TGTLTQNQM

SEQ ID NO: 869846 - protein, 9 aa, Homo Sapiens
QYLIRNVDT

SEQ ID NO: 869847 - protein, 9 aa, Homo Sapiens
GGRYDLLIS

SEQ ID NO: 869848 - protein, 9 aa, Homo Sapiens
LPESLIPVQ

SEQ ID NO: 869849 - protein, 9 aa, Homo Sapiens
EQFPLEEDM

SEQ ID NO: 869850 - protein, 9 aa, Homo Sapiens
RKYSEKYAE

SEQ ID NO: 869851 - protein, 9 aa, Homo Sapiens
GAMAIWRSN

SEQ ID NO: 869852 - protein, 9 aa, Homo Sapiens
QMVDNVELP

SEQ ID NO: 869853 - protein, 9 aa, Homo Sapiens
AAQGGLAGG

SEQ ID NO: 869854 - protein, 9 aa, Homo Sapiens
LKTKDSGLF

SEQ ID NO: 869855 - protein, 9 aa, Homo Sapiens
INEKGSDQY

SEQ ID NO: 869856 - protein, 9 aa, Homo Sapiens
ECSDNNLGS

SEQ ID NO: 869857 - protein, 9 aa, Homo Sapiens
QILLPLIIS

SEQ ID NO: 869858 - protein, 9 aa, Homo Sapiens
RDMGNRTSL

SEQ ID NO: 869859 - protein, 9 aa, Homo Sapiens
LVKLLLVRL

SEQ ID NO: 869860 - protein, 9 aa, Homo Sapiens
RDHYTIGKE

SEQ ID NO: 869861 - protein, 9 aa, Homo Sapiens
LLQRCEKTG

SEQ ID NO: 869862 - protein, 9 aa, Homo Sapiens
KYAAGVCNP

SEQ ID NO: 869863 - protein, 9 aa, Homo Sapiens
RRRRTFNQT

SEQ ID NO: 869864 - protein, 9 aa, Homo Sapiens
QHGVHMMVA

SEQ ID NO: 869865 - protein, 9 aa, Homo Sapiens
TMDLVRSGP

SEQ ID NO: 869866 - protein, 9 aa, Homo Sapiens
RRSCRQLPP

SEQ ID NO: 869867 - protein, 9 aa, Homo Sapiens
SQDSIYLLA

SEQ ID NO: 869868 - protein, 9 aa, Homo Sapiens
KKKARFEWE

SEQ ID NO: 869869 - protein, 9 aa, Homo Sapiens
KTLILEDSE

SEQ ID NO: 869870 - protein, 9 aa, Homo Sapiens
YHQLHIIET

SEQ ID NO: 869871 - protein, 9 aa, Homo Sapiens
AHHLLPLSL

SEQ ID NO: 869872 - protein, 9 aa, Homo Sapiens
PTAMYCDNC

SEQ ID NO: 869873 - protein, 9 aa, Homo Sapiens
TTDCFLLVT

SEQ ID NO: 869874 - protein, 9 aa, Homo Sapiens
PDNFLLLGN

SEQ ID NO: 869875 - protein, 9 aa, Homo Sapiens
MFMYARPAR

SEQ ID NO: 869876 - protein, 9 aa, Homo Sapiens
KVLLSNIED

SEQ ID NO: 869877 - protein, 9 aa, Homo Sapiens
DKVTGRCNG

SEQ ID NO: 869878 - protein, 9 aa, Homo Sapiens
KKLINRKIS

SEQ ID NO: 869879 - protein, 9 aa, Homo Sapiens
FVNFCYSSV

SEQ ID NO: 869880 - protein, 9 aa, Homo Sapiens
SVHLAHHQQ

SEQ ID NO: 869881 - protein, 9 aa, Homo Sapiens
TMNKFLISN

SEQ ID NO: 869882 - protein, 9 aa, Homo Sapiens
YGHYKELPG

SEQ ID NO: 869883 - protein, 9 aa, Homo Sapiens
QYDNCLTYH

SEQ ID NO: 869884 - protein, 9 aa, Homo Sapiens
GKEKVLFIR

SEQ ID NO: 869885 - protein, 9 aa, Homo Sapiens
QNEMIETKC

SEQ ID NO: 869886 - protein, 9 aa, Homo Sapiens
NQQQRTGKP

SEQ ID NO: 869887 - protein, 9 aa, Homo Sapiens
IINMALSEY

SEQ ID NO: 869888 - protein, 9 aa, Homo Sapiens
ETQEELSAL

SEQ ID NO: 869889 - protein, 9 aa, Homo Sapiens
PIWCQNHHN

SEQ ID NO: 869890 - protein, 9 aa, Homo Sapiens
MLVERLGKK

SEQ ID NO: 869891 - protein, 9 aa, Homo Sapiens
VITATLANT

SEQ ID NO: 869892 - protein, 9 aa, Homo Sapiens
APSPQHTNQ

SEQ ID NO: 869893 - protein, 9 aa, Homo Sapiens
CLGDLINQL

SEQ ID NO: 869894 - protein, 9 aa, Homo Sapiens
GELLYYKYP

SEQ ID NO: 869895 - protein, 9 aa, Homo Sapiens
DCIKQTLPS

SEQ ID NO: 869896 - protein, 9 aa, Homo Sapiens
TNVLQPTPI

SEQ ID NO: 869897 - protein, 9 aa, Homo Sapiens
LISNVADDD

SEQ ID NO: 869898 - protein, 9 aa, Homo Sapiens
AFCSITTPK

SEQ ID NO: 869899 - protein, 9 aa, Homo Sapiens
PCQFIKIVP

SEQ ID NO: 869900 - protein, 9 aa, Homo Sapiens
SCIPLVKKH

SEQ ID NO: 869901 - protein, 9 aa, Homo Sapiens
PVCCKCGRQ

SEQ ID NO: 869902 - protein, 9 aa, Homo Sapiens
KYTFFECKR

SEQ ID NO: 869903 - protein, 9 aa, Homo Sapiens
LRLYNYVHD

SEQ ID NO: 869904 - protein, 9 aa, Homo Sapiens
QTNVREKRK

SEQ ID NO: 869905 - protein, 9 aa, Homo Sapiens
ILNLHGKIG

SEQ ID NO: 869906 - protein, 9 aa, Homo Sapiens
TSREFRGKI

SEQ ID NO: 869907 - protein, 9 aa, Homo Sapiens
WMLGPVVLY

SEQ ID NO: 869908 - protein, 9 aa, Homo Sapiens
ALLVAIFLM

SEQ ID NO: 869909 - protein, 9 aa, Homo Sapiens
GKQAVCLKC

SEQ ID NO: 869910 - protein, 9 aa, Homo Sapiens
QTPELKQSS

SEQ ID NO: 869911 - protein, 9 aa, Homo Sapiens
DEFSKQVNR

SEQ ID NO: 869912 - protein, 9 aa, Homo Sapiens
YSMPCLGTE

SEQ ID NO: 869913 - protein, 9 aa, Homo Sapiens
LMCELMDMN

SEQ ID NO: 869914 - protein, 9 aa, Homo Sapiens
FQEEAKHRW

SEQ ID NO: 869915 - protein, 9 aa, Homo Sapiens
SIKMAVCKI

SEQ ID NO: 869916 - protein, 9 aa, Homo Sapiens
PSLMRRLVN

SEQ ID NO: 869917 - protein, 9 aa, Homo Sapiens
MPTFSPGPG

SEQ ID NO: 869918 - protein, 9 aa, Homo Sapiens
EENYLRIVP

SEQ ID NO: 869919 - protein, 9 aa, Homo Sapiens
FSLGSGSEN

SEQ ID NO: 869920 - protein, 9 aa, Homo Sapiens
TNKRRVIVP

SEQ ID NO: 869921 - protein, 9 aa, Homo Sapiens
KQNIYFADQ

SEQ ID NO: 869922 - protein, 9 aa, Homo Sapiens
AITQFSYLE

SEQ ID NO: 869923 - protein, 9 aa, Homo Sapiens
SSLVSVISI

SEQ ID NO: 869924 - protein, 9 aa, Homo Sapiens
QSGSYLNSS

SEQ ID NO: 869925 - protein, 9 aa, Homo Sapiens
MRKKRRIIK

SEQ ID NO: 869926 - protein, 9 aa, Homo Sapiens
LQQRNSKAE

SEQ ID NO: 869927 - protein, 9 aa, Homo Sapiens
LQYGPMTGQ

SEQ ID NO: 869928 - protein, 9 aa, Homo Sapiens
HLQLDDSIG

SEQ ID NO: 869929 - protein, 9 aa, Homo Sapiens
TLFRGAEYR

SEQ ID NO: 869930 - protein, 9 aa, Homo Sapiens
PQAPYPCLM

SEQ ID NO: 869931 - protein, 9 aa, Homo Sapiens
PQQLTQIMS

SEQ ID NO: 869932 - protein, 9 aa, Homo Sapiens
TQVPVHRHY

SEQ ID NO: 869933 - protein, 9 aa, Homo Sapiens
CVIGCRCVL

SEQ ID NO: 869934 - protein, 9 aa, Homo Sapiens
WVAFNIMCS

SEQ ID NO: 869935 - protein, 9 aa, Homo Sapiens
QKGAVPIRV

SEQ ID NO: 869936 - protein, 9 aa, Homo Sapiens
LHKAGRSAE

SEQ ID NO: 869937 - protein, 9 aa, Homo Sapiens
PTFPSYSPT

SEQ ID NO: 869938 - protein, 9 aa, Homo Sapiens
EPSQKTGYL

SEQ ID NO: 869939 - protein, 9 aa, Homo Sapiens
VRDGPFGLS

SEQ ID NO: 869940 - protein, 9 aa, Homo Sapiens
LSFCTNHEI

SEQ ID NO: 869941 - protein, 9 aa, Homo Sapiens
SFVNFCYSS

SEQ ID NO: 869942 - protein, 9 aa, Homo Sapiens
VVAVTFGDR

SEQ ID NO: 869943 - protein, 9 aa, Homo Sapiens
SNPLEKHNH

SEQ ID NO: 869944 - protein, 9 aa, Homo Sapiens
KFSSGSESE

SEQ ID NO: 869945 - protein, 9 aa, Homo Sapiens
AIAQILNFI

SEQ ID NO: 869946 - protein, 9 aa, Homo Sapiens
LDPQAPYPC

SEQ ID NO: 869947 - protein, 9 aa, Homo Sapiens
FCIAKLMLY

SEQ ID NO: 869948 - protein, 9 aa, Homo Sapiens
EMGMPNNKF

SEQ ID NO: 869949 - protein, 9 aa, Homo Sapiens
QDWASFIRL

SEQ ID NO: 869950 - protein, 9 aa, Homo Sapiens
LSDKTVLLL

SEQ ID NO: 869951 - protein, 9 aa, Homo Sapiens
KELQEVRCG

SEQ ID NO: 869952 - protein, 9 aa, Homo Sapiens
VKAAKSIDQ

SEQ ID NO: 869953 - protein, 9 aa, Homo Sapiens
SLYMVNSKY

SEQ ID NO: 869954 - protein, 9 aa, Homo Sapiens
VLSQDYSQI

SEQ ID NO: 869955 - protein, 9 aa, Homo Sapiens
STCTDFEQM

SEQ ID NO: 869956 - protein, 9 aa, Homo Sapiens
FTSFYLLDF

SEQ ID NO: 869957 - protein, 9 aa, Homo Sapiens
TEQFASMRN

SEQ ID NO: 869958 - protein, 9 aa, Homo Sapiens
PQVNVFAIF

SEQ ID NO: 869959 - protein, 9 aa, Homo Sapiens
VVIGAVVAD

SEQ ID NO: 869960 - protein, 9 aa, Homo Sapiens
TMAQLKIYQ

SEQ ID NO: 869961 - protein, 9 aa, Homo Sapiens
VSFWISQVA

SEQ ID NO: 869962 - protein, 9 aa, Homo Sapiens
DKKILKQAS

SEQ ID NO: 869963 - protein, 9 aa, Homo Sapiens
PQSDSFPYG

SEQ ID NO: 869964 - protein, 9 aa, Homo Sapiens
SFNHEKSLG

SEQ ID NO: 869965 - protein, 9 aa, Homo Sapiens
DKPYKCQEC

SEQ ID NO: 869966 - protein, 9 aa, Homo Sapiens
MHADCITQI

SEQ ID NO: 869967 - protein, 9 aa, Homo Sapiens
LPHRRGLGL

SEQ ID NO: 869968 - protein, 9 aa, Homo Sapiens
QQSTNGQTI

SEQ ID NO: 869969 - protein, 9 aa, Homo Sapiens
INNADTGRV

SEQ ID NO: 869970 - protein, 9 aa, Homo Sapiens
DKMSALSLS

SEQ ID NO: 869971 - protein, 9 aa, Homo Sapiens
FCQLIVNKW

SEQ ID NO: 869972 - protein, 9 aa, Homo Sapiens
NNTGNLAQA

SEQ ID NO: 869973 - protein, 9 aa, Homo Sapiens
SDSGLEEKS

SEQ ID NO: 869974 - protein, 9 aa, Homo Sapiens
VRATLQELL

SEQ ID NO: 869975 - protein, 9 aa, Homo Sapiens
TYSIVMGSG

SEQ ID NO: 869976 - protein, 9 aa, Homo Sapiens
NQRTFRDVV

SEQ ID NO: 869977 - protein, 9 aa, Homo Sapiens
SAIYLACTK

SEQ ID NO: 869978 - protein, 9 aa, Homo Sapiens
PSSFRNHEI

SEQ ID NO: 869979 - protein, 9 aa, Homo Sapiens
VVHQQTHTG

SEQ ID NO: 869980 - protein, 9 aa, Homo Sapiens
KGAQGVPFA

SEQ ID NO: 869981 - protein, 9 aa, Homo Sapiens
YNHPGRVML

SEQ ID NO: 869982 - protein, 9 aa, Homo Sapiens
RLISFQRHM

SEQ ID NO: 869983 - protein, 9 aa, Homo Sapiens
SQMAAPAFK

SEQ ID NO: 869984 - protein, 9 aa, Homo Sapiens
LPKMLEELS

SEQ ID NO: 869985 - protein, 9 aa, Homo Sapiens
KPHSFMFSP

SEQ ID NO: 869986 - protein, 9 aa, Homo Sapiens
ELSLAPEGL

SEQ ID NO: 869987 - protein, 9 aa, Homo Sapiens
PVRSKFELD

SEQ ID NO: 869988 - protein, 9 aa, Homo Sapiens
DRGLQRTIR

SEQ ID NO: 869989 - protein, 9 aa, Homo Sapiens
DSENQGSYF

SEQ ID NO: 869990 - protein, 9 aa, Homo Sapiens
KLVCGNITV

SEQ ID NO: 869991 - protein, 9 aa, Homo Sapiens
VLLLGHYTE

SEQ ID NO: 869992 - protein, 9 aa, Homo Sapiens
DDDDKDEAA

SEQ ID NO: 869993 - protein, 9 aa, Homo Sapiens
GNPGSLVSP

SEQ ID NO: 869994 - protein, 9 aa, Homo Sapiens
EIKESHHCG

SEQ ID NO: 869995 - protein, 9 aa, Homo Sapiens
LMKLEKLTN

SEQ ID NO: 869996 - protein, 9 aa, Homo Sapiens
MQIRDNWNR

SEQ ID NO: 869997 - protein, 9 aa, Homo Sapiens
EEKKLRRNI

SEQ ID NO: 869998 - protein, 9 aa, Homo Sapiens
QIGIKESLW

SEQ ID NO: 869999 - protein, 9 aa, Homo Sapiens
GCPVCITIN

SEQ ID NO: 870000 - protein, 9 aa, Homo Sapiens
TLGRPLGLK

SEQ ID NO: 870001 - protein, 9 aa, Homo Sapiens
EWGPFNLVY

SEQ ID NO: 870002 - protein, 9 aa, Homo Sapiens
CGQMKQKYR

SEQ ID NO: 870003 - protein, 9 aa, Homo Sapiens
AWFWHPSYV

SEQ ID NO: 870004 - protein, 9 aa, Homo Sapiens
NHPDVLVLQ

SEQ ID NO: 870005 - protein, 9 aa, Homo Sapiens
VFIVIAIRL

SEQ ID NO: 870006 - protein, 9 aa, Homo Sapiens
LSEREASAV

SEQ ID NO: 870007 - protein, 9 aa, Homo Sapiens
DAMDNDTAS

SEQ ID NO: 870008 - protein, 9 aa, Homo Sapiens
NPQRFDLVV

SEQ ID NO: 870009 - protein, 9 aa, Homo Sapiens
RQQGFLGLW

SEQ ID NO: 870010 - protein, 9 aa, Homo Sapiens
QLPITLNKL

SEQ ID NO: 870011 - protein, 9 aa, Homo Sapiens
SVILHYLSF

SEQ ID NO: 870012 - protein, 9 aa, Homo Sapiens
MSRGKVIIL

SEQ ID NO: 870013 - protein, 9 aa, Homo Sapiens
KYGPQWKHD

SEQ ID NO: 870014 - protein, 9 aa, Homo Sapiens
KTCQLPSIC

SEQ ID NO: 870015 - protein, 9 aa, Homo Sapiens
LHPHTITGP

SEQ ID NO: 870016 - protein, 9 aa, Homo Sapiens
LQIRLIGTT

SEQ ID NO: 870017 - protein, 9 aa, Homo Sapiens
PIPVSPIPL

SEQ ID NO: 870018 - protein, 9 aa, Homo Sapiens
TATCLPFSP

SEQ ID NO: 870019 - protein, 9 aa, Homo Sapiens
PGVMCLPVL

SEQ ID NO: 870020 - protein, 9 aa, Homo Sapiens
RWIGSDISN

SEQ ID NO: 870021 - protein, 9 aa, Homo Sapiens
IHILQKHGK

SEQ ID NO: 870022 - protein, 9 aa, Homo Sapiens
LNKIKELSW

SEQ ID NO: 870023 - protein, 9 aa, Homo Sapiens
LRWLKRDSY

SEQ ID NO: 870024 - protein, 9 aa, Homo Sapiens
PDSLLLSST

SEQ ID NO: 870025 - protein, 9 aa, Homo Sapiens
TKLTLDYLK

SEQ ID NO: 870026 - protein, 9 aa, Homo Sapiens
LNINLWLTL

SEQ ID NO: 870027 - protein, 9 aa, Homo Sapiens
RKPNNLEAF

SEQ ID NO: 870028 - protein, 9 aa, Homo Sapiens
ATAFGHMPL

SEQ ID NO: 870029 - protein, 9 aa, Homo Sapiens
VSNIELPTI

SEQ ID NO: 870030 - protein, 9 aa, Homo Sapiens
FLLFINHCL

SEQ ID NO: 870031 - protein, 9 aa, Homo Sapiens
VDYYKLQYG

SEQ ID NO: 870032 - protein, 9 aa, Homo Sapiens
LLAATCSTI

SEQ ID NO: 870033 - protein, 9 aa, Homo Sapiens
EGQCRVDYK

SEQ ID NO: 870034 - protein, 9 aa, Homo Sapiens
KPVKKKKIQ

SEQ ID NO: 870035 - protein, 9 aa, Homo Sapiens
TLPAWICEG

SEQ ID NO: 870036 - protein, 9 aa, Homo Sapiens
LKEERLSGR

SEQ ID NO: 870037 - protein, 9 aa, Homo Sapiens
ELQNMFGET

SEQ ID NO: 870038 - protein, 9 aa, Homo Sapiens
DVDIEGNVV

SEQ ID NO: 870039 - protein, 9 aa, Homo Sapiens
GVIQIKASS

SEQ ID NO: 870040 - protein, 9 aa, Homo Sapiens
YQESNTSQH

SEQ ID NO: 870041 - protein, 9 aa, Homo Sapiens
SQRQYIFKY

SEQ ID NO: 870042 - protein, 9 aa, Homo Sapiens
NNFFCDLPP

SEQ ID NO: 870043 - protein, 9 aa, Homo Sapiens
FFYPKQPDL

SEQ ID NO: 870044 - protein, 9 aa, Homo Sapiens
DVTAQACLD

SEQ ID NO: 870045 - protein, 9 aa, Homo Sapiens
HGKAEECIR

SEQ ID NO: 870046 - protein, 9 aa, Homo Sapiens
HEEIILIPY

SEQ ID NO: 870047 - protein, 9 aa, Homo Sapiens
YDEYSAIGP

SEQ ID NO: 870048 - protein, 9 aa, Homo Sapiens
KDELQKRKS

SEQ ID NO: 870049 - protein, 9 aa, Homo Sapiens
RGGQVSLKA

SEQ ID NO: 870050 - protein, 9 aa, Homo Sapiens
AWMDTHPKY

SEQ ID NO: 870051 - protein, 9 aa, Homo Sapiens
ILEHLESQL

SEQ ID NO: 870052 - protein, 9 aa, Homo Sapiens
PTFLRGKVC

SEQ ID NO: 870053 - protein, 9 aa, Homo Sapiens
QKVEGVEPR

SEQ ID NO: 870054 - protein, 9 aa, Homo Sapiens
FFQAEEEET

SEQ ID NO: 870055 - protein, 9 aa, Homo Sapiens
RLMGTNVRF

SEQ ID NO: 870056 - protein, 9 aa, Homo Sapiens
QLRALGLSF

SEQ ID NO: 870057 - protein, 9 aa, Homo Sapiens
HSTEVANGY

SEQ ID NO: 870058 - protein, 9 aa, Homo Sapiens
AASVPAISD

SEQ ID NO: 870059 - protein, 9 aa, Homo Sapiens
SELRFLDIP

SEQ ID NO: 870060 - protein, 9 aa, Homo Sapiens
DKVLRNNEL

SEQ ID NO: 870061 - protein, 9 aa, Homo Sapiens
MNVPEMMNE

SEQ ID NO: 870062 - protein, 9 aa, Homo Sapiens
PAPEDKGRV

SEQ ID NO: 870063 - protein, 9 aa, Homo Sapiens
VKYRNVSYL

SEQ ID NO: 870064 - protein, 9 aa, Homo Sapiens
KFNHYDTAA

SEQ ID NO: 870065 - protein, 9 aa, Homo Sapiens
MSNVYSKVA

SEQ ID NO: 870066 - protein, 9 aa, Homo Sapiens
MVQTNMQYV

SEQ ID NO: 870067 - protein, 9 aa, Homo Sapiens
KVCRVSFAD

SEQ ID NO: 870068 - protein, 9 aa, Homo Sapiens
ALNLKKGLS

SEQ ID NO: 870069 - protein, 9 aa, Homo Sapiens
LDANLNMLR

SEQ ID NO: 870070 - protein, 9 aa, Homo Sapiens
LSPLHKRIY

SEQ ID NO: 870071 - protein, 9 aa, Homo Sapiens
CRCSKCCDD

SEQ ID NO: 870072 - protein, 9 aa, Homo Sapiens
YTFLFALSF

SEQ ID NO: 870073 - protein, 9 aa, Homo Sapiens
TGGREGGGC

SEQ ID NO: 870074 - protein, 9 aa, Homo Sapiens
DLFAPWCPP

SEQ ID NO: 870075 - protein, 9 aa, Homo Sapiens
KILVFVAVK

SEQ ID NO: 870076 - protein, 9 aa, Homo Sapiens
EFNVNYTQY

SEQ ID NO: 870077 - protein, 9 aa, Homo Sapiens
HPARKPPNY

SEQ ID NO: 870078 - protein, 9 aa, Homo Sapiens
WNGRILHML

SEQ ID NO: 870079 - protein, 9 aa, Homo Sapiens
PNSGDMFMS

SEQ ID NO: 870080 - protein, 9 aa, Homo Sapiens
NPVCEAFKV

SEQ ID NO: 870081 - protein, 9 aa, Homo Sapiens
RILLKELDN

SEQ ID NO: 870082 - protein, 9 aa, Homo Sapiens
EKKQHDTFD

SEQ ID NO: 870083 - protein, 9 aa, Homo Sapiens
MVMALVDGP

SEQ ID NO: 870084 - protein, 9 aa, Homo Sapiens
KTIGYEGIN

SEQ ID NO: 870085 - protein, 9 aa, Homo Sapiens
SFSRDYIVL

SEQ ID NO: 870086 - protein, 9 aa, Homo Sapiens
ALDYLYYLS

SEQ ID NO: 870087 - protein, 9 aa, Homo Sapiens
CWCKKRRLH

SEQ ID NO: 870088 - protein, 9 aa, Homo Sapiens
SVCQLLHEK

SEQ ID NO: 870089 - protein, 9 aa, Homo Sapiens
AGSPKLSPP

SEQ ID NO: 870090 - protein, 9 aa, Homo Sapiens
FQGDGVPPL

SEQ ID NO: 870091 - protein, 9 aa, Homo Sapiens
CRHKKAHSG

SEQ ID NO: 870092 - protein, 9 aa, Homo Sapiens
DSEDIDIML

SEQ ID NO: 870093 - protein, 9 aa, Homo Sapiens
QEQINMLLK

SEQ ID NO: 870094 - protein, 9 aa, Homo Sapiens
KNMMEKIQQ

SEQ ID NO: 870095 - protein, 9 aa, Homo Sapiens
HSEHERQYL

SEQ ID NO: 870096 - protein, 9 aa, Homo Sapiens
VNNNVRKKD

SEQ ID NO: 870097 - protein, 9 aa, Homo Sapiens
PLEQRSFIG

SEQ ID NO: 870098 - protein, 9 aa, Homo Sapiens
NEQIIKEKE

SEQ ID NO: 870099 - protein, 9 aa, Homo Sapiens
GKSFNHSSH

SEQ ID NO: 870100 - protein, 9 aa, Homo Sapiens
PLQVLLANS

SEQ ID NO: 870101 - protein, 9 aa, Homo Sapiens
VLIVDLDEE

SEQ ID NO: 870102 - protein, 9 aa, Homo Sapiens
LVLDRICKL

SEQ ID NO: 870103 - protein, 9 aa, Homo Sapiens
FGSDYSQSS

SEQ ID NO: 870104 - protein, 9 aa, Homo Sapiens
DPMSSSFNL

SEQ ID NO: 870105 - protein, 9 aa, Homo Sapiens
GRIMCRGTH

SEQ ID NO: 870106 - protein, 9 aa, Homo Sapiens
NEFSHAIAM

SEQ ID NO: 870107 - protein, 9 aa, Homo Sapiens
YMLNPLIYT

SEQ ID NO: 870108 - protein, 9 aa, Homo Sapiens
SFNLDPDVI

SEQ ID NO: 870109 - protein, 9 aa, Homo Sapiens
EQRELEKLY

SEQ ID NO: 870110 - protein, 9 aa, Homo Sapiens
TEGCFFRRK

SEQ ID NO: 870111 - protein, 9 aa, Homo Sapiens
YAETKAVCE

SEQ ID NO: 870112 - protein, 9 aa, Homo Sapiens
LSHSTLKQK

SEQ ID NO: 870113 - protein, 9 aa, Homo Sapiens
QTPPEAIAL

SEQ ID NO: 870114 - protein, 9 aa, Homo Sapiens
RLIGNKSKG

SEQ ID NO: 870115 - protein, 9 aa, Homo Sapiens
PKSCSKPEK

SEQ ID NO: 870116 - protein, 9 aa, Homo Sapiens
ISNFGAVPQ

SEQ ID NO: 870117 - protein, 9 aa, Homo Sapiens
EKITLETSL

SEQ ID NO: 870118 - protein, 9 aa, Homo Sapiens
WGNGIRGLS

SEQ ID NO: 870119 - protein, 9 aa, Homo Sapiens
TAPDAMKEV

SEQ ID NO: 870120 - protein, 9 aa, Homo Sapiens
KLLQFVTGT

SEQ ID NO: 870121 - protein, 9 aa, Homo Sapiens
LYQPEPLPE

SEQ ID NO: 870122 - protein, 9 aa, Homo Sapiens
VEHWSSFAV

SEQ ID NO: 870123 - protein, 9 aa, Homo Sapiens
RTDAELFLA

SEQ ID NO: 870124 - protein, 9 aa, Homo Sapiens
AGCEYISLA

SEQ ID NO: 870125 - protein, 9 aa, Homo Sapiens
YYHTERDKG

SEQ ID NO: 870126 - protein, 9 aa, Homo Sapiens
SMEKGGNMT

SEQ ID NO: 870127 - protein, 9 aa, Homo Sapiens
VVGSASNLT

SEQ ID NO: 870128 - protein, 9 aa, Homo Sapiens
SKKAIEDRN

SEQ ID NO: 870129 - protein, 9 aa, Homo Sapiens
GQPLHTKLN

SEQ ID NO: 870130 - protein, 9 aa, Homo Sapiens
YDKSLGSTQ

SEQ ID NO: 870131 - protein, 9 aa, Homo Sapiens
IWENPNLNS

SEQ ID NO: 870132 - protein, 9 aa, Homo Sapiens
LLGHYTEEE

SEQ ID NO: 870133 - protein, 9 aa, Homo Sapiens
HSETRGGET

SEQ ID NO: 870134 - protein, 9 aa, Homo Sapiens
LRHRRSHSA

SEQ ID NO: 870135 - protein, 9 aa, Homo Sapiens
QSSRKSDAN

SEQ ID NO: 870136 - protein, 9 aa, Homo Sapiens
HKLKKGLRK

SEQ ID NO: 870137 - protein, 9 aa, Homo Sapiens
RKDKYNAIK

SEQ ID NO: 870138 - protein, 9 aa, Homo Sapiens
QMDDVYKEP

SEQ ID NO: 870139 - protein, 9 aa, Homo Sapiens
SSVDDIQAI

SEQ ID NO: 870140 - protein, 9 aa, Homo Sapiens
QINLTVLLD

SEQ ID NO: 870141 - protein, 9 aa, Homo Sapiens
GSRRNQKES

SEQ ID NO: 870142 - protein, 9 aa, Homo Sapiens
SVFKLNFYS

SEQ ID NO: 870143 - protein, 9 aa, Homo Sapiens
LDYVPPTAP

SEQ ID NO: 870144 - protein, 9 aa, Homo Sapiens
MEFIQGEVR

SEQ ID NO: 870145 - protein, 9 aa, Homo Sapiens
VRTDYLWRG

SEQ ID NO: 870146 - protein, 9 aa, Homo Sapiens
IDKDAKEAI

SEQ ID NO: 870147 - protein, 9 aa, Homo Sapiens
RFNNETFRI

SEQ ID NO: 870148 - protein, 9 aa, Homo Sapiens
QKQESLEIS

SEQ ID NO: 870149 - protein, 9 aa, Homo Sapiens
ISQLRTLET

SEQ ID NO: 870150 - protein, 9 aa, Homo Sapiens
PRHEDKLEL

SEQ ID NO: 870151 - protein, 9 aa, Homo Sapiens
SPTWQNPMS

SEQ ID NO: 870152 - protein, 9 aa, Homo Sapiens
IRLCRALLS

SEQ ID NO: 870153 - protein, 9 aa, Homo Sapiens
KQLAAEVTK

SEQ ID NO: 870154 - protein, 9 aa, Homo Sapiens
EAAEQIWRR

SEQ ID NO: 870155 - protein, 9 aa, Homo Sapiens
LSESRFSIS

SEQ ID NO: 870156 - protein, 9 aa, Homo Sapiens
DNGKDKEQK

SEQ ID NO: 870157 - protein, 9 aa, Homo Sapiens
LQLPAADGV

SEQ ID NO: 870158 - protein, 9 aa, Homo Sapiens
VSPNDTRLS

SEQ ID NO: 870159 - protein, 9 aa, Homo Sapiens
PFSPDGHLH

SEQ ID NO: 870160 - protein, 9 aa, Homo Sapiens
VCEAFKVSL

SEQ ID NO: 870161 - protein, 9 aa, Homo Sapiens
GEGVKQCGL

SEQ ID NO: 870162 - protein, 9 aa, Homo Sapiens
KKHTNVIAQ

SEQ ID NO: 870163 - protein, 9 aa, Homo Sapiens
AVTHFIHNS

SEQ ID NO: 870164 - protein, 9 aa, Homo Sapiens
CEMSSFVET

SEQ ID NO: 870165 - protein, 9 aa, Homo Sapiens
KNTASLQRR

SEQ ID NO: 870166 - protein, 9 aa, Homo Sapiens
QGNGSNLIK

SEQ ID NO: 870167 - protein, 9 aa, Homo Sapiens
IVLRLRRSL

SEQ ID NO: 870168 - protein, 9 aa, Homo Sapiens
LQSPTEDKV

SEQ ID NO: 870169 - protein, 9 aa, Homo Sapiens
LKRNNLLIA

SEQ ID NO: 870170 - protein, 9 aa, Homo Sapiens
IYPDMSVLR

SEQ ID NO: 870171 - protein, 9 aa, Homo Sapiens
RVCNNYWIW

SEQ ID NO: 870172 - protein, 9 aa, Homo Sapiens
LQSPTEDKI

SEQ ID NO: 870173 - protein, 9 aa, Homo Sapiens
MLLKFKDGT

SEQ ID NO: 870174 - protein, 9 aa, Homo Sapiens
MPLLIKDMA

SEQ ID NO: 870175 - protein, 9 aa, Homo Sapiens
SLIPVQLLW

SEQ ID NO: 870176 - protein, 9 aa, Homo Sapiens
LSHIQNILI

SEQ ID NO: 870177 - protein, 9 aa, Homo Sapiens
EGQKTMYLQ

SEQ ID NO: 870178 - protein, 9 aa, Homo Sapiens
SVYQLLSET

SEQ ID NO: 870179 - protein, 9 aa, Homo Sapiens
KGKYVKKEF

SEQ ID NO: 870180 - protein, 9 aa, Homo Sapiens
CQNAREMTL

SEQ ID NO: 870181 - protein, 9 aa, Homo Sapiens
GAADGIWLY

SEQ ID NO: 870182 - protein, 9 aa, Homo Sapiens
EEVLLLHCG

SEQ ID NO: 870183 - protein, 9 aa, Homo Sapiens
SENDGENSV

SEQ ID NO: 870184 - protein, 9 aa, Homo Sapiens
MQFVLLQTL

SEQ ID NO: 870185 - protein, 9 aa, Homo Sapiens
ITLIEAIWL

SEQ ID NO: 870186 - protein, 9 aa, Homo Sapiens
SSSLSSHVS

SEQ ID NO: 870187 - protein, 9 aa, Homo Sapiens
GFKASKSQL

SEQ ID NO: 870188 - protein, 9 aa, Homo Sapiens
TLGIICLLL

SEQ ID NO: 870189 - protein, 9 aa, Homo Sapiens
SSLTYPLLF

SEQ ID NO: 870190 - protein, 9 aa, Homo Sapiens
ERLTAKFKT

SEQ ID NO: 870191 - protein, 9 aa, Homo Sapiens
LNTFDIATN

SEQ ID NO: 870192 - protein, 9 aa, Homo Sapiens
AFNQSLTLA

SEQ ID NO: 870193 - protein, 9 aa, Homo Sapiens
QFYRKSVRE

SEQ ID NO: 870194 - protein, 9 aa, Homo Sapiens
GEQICLAGD

SEQ ID NO: 870195 - protein, 9 aa, Homo Sapiens
LVLLELFYD

SEQ ID NO: 870196 - protein, 9 aa, Homo Sapiens
RFEWEQNDT

SEQ ID NO: 870197 - protein, 9 aa, Homo Sapiens
DAELFLADV

SEQ ID NO: 870198 - protein, 9 aa, Homo Sapiens
ALQEAVTKT

SEQ ID NO: 870199 - protein, 9 aa, Homo Sapiens
NISDNVIVG

SEQ ID NO: 870200 - protein, 9 aa, Homo Sapiens
SVQLALIIS

SEQ ID NO: 870201 - protein, 9 aa, Homo Sapiens
TDMFVAELL

SEQ ID NO: 870202 - protein, 9 aa, Homo Sapiens
AWGCFDECN

SEQ ID NO: 870203 - protein, 9 aa, Homo Sapiens
GLVHHRRVR

SEQ ID NO: 870204 - protein, 9 aa, Homo Sapiens
KLNGLPSET

SEQ ID NO: 870205 - protein, 9 aa, Homo Sapiens
KFVIDVGYK

SEQ ID NO: 870206 - protein, 9 aa, Homo Sapiens
NSVTSISEI

SEQ ID NO: 870207 - protein, 9 aa, Homo Sapiens
NILLITEDL

SEQ ID NO: 870208 - protein, 9 aa, Homo Sapiens
LQHLKLNRN

SEQ ID NO: 870209 - protein, 9 aa, Homo Sapiens
IYQQHPEAY

SEQ ID NO: 870210 - protein, 9 aa, Homo Sapiens
AKQIIYNYL

SEQ ID NO: 870211 - protein, 9 aa, Homo Sapiens
DDVPQKRKL

SEQ ID NO: 870212 - protein, 9 aa, Homo Sapiens
NFTVAFGTG

SEQ ID NO: 870213 - protein, 9 aa, Homo Sapiens
CHEVSFKNM

SEQ ID NO: 870214 - protein, 9 aa, Homo Sapiens
ENQHFDGFV

SEQ ID NO: 870215 - protein, 9 aa, Homo Sapiens
SNDHVISVW

SEQ ID NO: 870216 - protein, 9 aa, Homo Sapiens
RLPQTVISL

SEQ ID NO: 870217 - protein, 9 aa, Homo Sapiens
NVLPLLMAP

SEQ ID NO: 870218 - protein, 9 aa, Homo Sapiens
SNDINSDSD

SEQ ID NO: 870219 - protein, 9 aa, Homo Sapiens
RLRLIVGKY

SEQ ID NO: 870220 - protein, 9 aa, Homo Sapiens
LVHHRRVRV

SEQ ID NO: 870221 - protein, 9 aa, Homo Sapiens
RVNLCDDLA

SEQ ID NO: 870222 - protein, 9 aa, Homo Sapiens
LCHNPKLQL

SEQ ID NO: 870223 - protein, 9 aa, Homo Sapiens
GSYLSVKSL

SEQ ID NO: 870224 - protein, 9 aa, Homo Sapiens
SSQSSAFKS

SEQ ID NO: 870225 - protein, 9 aa, Homo Sapiens
AVCDGMPLD

SEQ ID NO: 870226 - protein, 9 aa, Homo Sapiens
HRFIPCENK

SEQ ID NO: 870227 - protein, 9 aa, Homo Sapiens
PHLYEDTLI

SEQ ID NO: 870228 - protein, 9 aa, Homo Sapiens
CNKEGSKQA

SEQ ID NO: 870229 - protein, 9 aa, Homo Sapiens
VPLPAEVIA

SEQ ID NO: 870230 - protein, 9 aa, Homo Sapiens
GFKAAIVHN

SEQ ID NO: 870231 - protein, 9 aa, Homo Sapiens
YHHGRPQYL

SEQ ID NO: 870232 - protein, 9 aa, Homo Sapiens
IVFWLHSSN

SEQ ID NO: 870233 - protein, 9 aa, Homo Sapiens
AAFYGGKPI

SEQ ID NO: 870234 - protein, 9 aa, Homo Sapiens
YNKINQLQP

SEQ ID NO: 870235 - protein, 9 aa, Homo Sapiens
GRCVDGWCE

SEQ ID NO: 870236 - protein, 9 aa, Homo Sapiens
LCLAEMAQS

SEQ ID NO: 870237 - protein, 9 aa, Homo Sapiens
AQATVTNIL

SEQ ID NO: 870238 - protein, 9 aa, Homo Sapiens
TPINNLYAT

SEQ ID NO: 870239 - protein, 9 aa, Homo Sapiens
GRDACTKKI

SEQ ID NO: 870240 - protein, 9 aa, Homo Sapiens
ILSVKNNYR

SEQ ID NO: 870241 - protein, 9 aa, Homo Sapiens
SVEVADVNN

SEQ ID NO: 870242 - protein, 9 aa, Homo Sapiens
LHQNRFSTF

SEQ ID NO: 870243 - protein, 9 aa, Homo Sapiens
ISEDKKDKM

SEQ ID NO: 870244 - protein, 9 aa, Homo Sapiens
GKDARALIN

SEQ ID NO: 870245 - protein, 9 aa, Homo Sapiens
DSISSKTGE

SEQ ID NO: 870246 - protein, 9 aa, Homo Sapiens
LAITDYFTG

SEQ ID NO: 870247 - protein, 9 aa, Homo Sapiens
DHELFTAYG

SEQ ID NO: 870248 - protein, 9 aa, Homo Sapiens
SGTDLEPLP

SEQ ID NO: 870249 - protein, 9 aa, Homo Sapiens
NKIIKPAKY

SEQ ID NO: 870250 - protein, 9 aa, Homo Sapiens
EDYKYIEHL

SEQ ID NO: 870251 - protein, 9 aa, Homo Sapiens
GKMPINLVI

SEQ ID NO: 870252 - protein, 9 aa, Homo Sapiens
RPNGFDDNN

SEQ ID NO: 870253 - protein, 9 aa, Homo Sapiens
MNFSGLSLI

SEQ ID NO: 870254 - protein, 9 aa, Homo Sapiens
SLGDHSKIS

SEQ ID NO: 870255 - protein, 9 aa, Homo Sapiens
AQAEDLSVQ

SEQ ID NO: 870256 - protein, 9 aa, Homo Sapiens
LIDKFCDPQ

SEQ ID NO: 870257 - protein, 9 aa, Homo Sapiens
IVSTTRKLY

SEQ ID NO: 870258 - protein, 9 aa, Homo Sapiens
FLRGKVCIY

SEQ ID NO: 870259 - protein, 9 aa, Homo Sapiens
EKTAAATGG

SEQ ID NO: 870260 - protein, 9 aa, Homo Sapiens
LEREQRELE

SEQ ID NO: 870261 - protein, 9 aa, Homo Sapiens
MANNKGLFS

SEQ ID NO: 870262 - protein, 9 aa, Homo Sapiens
TAWCGFVRS

SEQ ID NO: 870263 - protein, 9 aa, Homo Sapiens
MKPLYWTMI

SEQ ID NO: 870264 - protein, 9 aa, Homo Sapiens
EIEKAKTED

SEQ ID NO: 870265 - protein, 9 aa, Homo Sapiens
GYVSSNFVA

SEQ ID NO: 870266 - protein, 9 aa, Homo Sapiens
GDTEGKYHR

SEQ ID NO: 870267 - protein, 9 aa, Homo Sapiens
QTKAKAESA

SEQ ID NO: 870268 - protein, 9 aa, Homo Sapiens
AFQSSEEQQ

SEQ ID NO: 870269 - protein, 9 aa, Homo Sapiens
IQHERPASL

SEQ ID NO: 870270 - protein, 9 aa, Homo Sapiens
SIPFWTFLS

SEQ ID NO: 870271 - protein, 9 aa, Homo Sapiens
QIFSTVLII

SEQ ID NO: 870272 - protein, 9 aa, Homo Sapiens
QSIQKNMVY

SEQ ID NO: 870273 - protein, 9 aa, Homo Sapiens
GLQPVTIVF

SEQ ID NO: 870274 - protein, 9 aa, Homo Sapiens
GFDKNEIQN

SEQ ID NO: 870275 - protein, 9 aa, Homo Sapiens
LESMQLPLV

SEQ ID NO: 870276 - protein, 9 aa, Homo Sapiens
LFPVQIGDM

SEQ ID NO: 870277 - protein, 9 aa, Homo Sapiens
EQDAHAASL

SEQ ID NO: 870278 - protein, 9 aa, Homo Sapiens
GVKVCTCTS

SEQ ID NO: 870279 - protein, 9 aa, Homo Sapiens
AITDYFTGL

SEQ ID NO: 870280 - protein, 9 aa, Homo Sapiens
SSNLSRHVC

SEQ ID NO: 870281 - protein, 9 aa, Homo Sapiens
NGYINFDKW

SEQ ID NO: 870282 - protein, 9 aa, Homo Sapiens
NDHVISVWD

SEQ ID NO: 870283 - protein, 9 aa, Homo Sapiens
LLDARSARM

SEQ ID NO: 870284 - protein, 9 aa, Homo Sapiens
KDAQQRISK

SEQ ID NO: 870285 - protein, 9 aa, Homo Sapiens
HSSLENPEH

SEQ ID NO: 870286 - protein, 9 aa, Homo Sapiens
LSCRNNRCN

SEQ ID NO: 870287 - protein, 9 aa, Homo Sapiens
FIVGHLKTI

SEQ ID NO: 870288 - protein, 9 aa, Homo Sapiens
ENVVRKQEK

SEQ ID NO: 870289 - protein, 9 aa, Homo Sapiens
CFHNGYCLR

SEQ ID NO: 870290 - protein, 9 aa, Homo Sapiens
RYNLKSKYC

SEQ ID NO: 870291 - protein, 9 aa, Homo Sapiens
GTNKDALIE

SEQ ID NO: 870292 - protein, 9 aa, Homo Sapiens
GLHNVFKLQ

SEQ ID NO: 870293 - protein, 9 aa, Homo Sapiens
CWTFVSKHA

SEQ ID NO: 870294 - protein, 9 aa, Homo Sapiens
QNTLIALVT

SEQ ID NO: 870295 - protein, 9 aa, Homo Sapiens
PPNPEEVKM

SEQ ID NO: 870296 - protein, 9 aa, Homo Sapiens
QIYKKGDIV

SEQ ID NO: 870297 - protein, 9 aa, Homo Sapiens
GLYKDHYAY

SEQ ID NO: 870298 - protein, 9 aa, Homo Sapiens
SVSIEVANV

SEQ ID NO: 870299 - protein, 9 aa, Homo Sapiens
ASTGTNTNK

SEQ ID NO: 870300 - protein, 9 aa, Homo Sapiens
IRRLLETLN

SEQ ID NO: 870301 - protein, 9 aa, Homo Sapiens
QMESTDTKR

SEQ ID NO: 870302 - protein, 9 aa, Homo Sapiens
QMLSSTYNS

SEQ ID NO: 870303 - protein, 9 aa, Homo Sapiens
SEMIYLAPE

SEQ ID NO: 870304 - protein, 9 aa, Homo Sapiens
LVLSLEDDK

SEQ ID NO: 870305 - protein, 9 aa, Homo Sapiens
RLTAKFKTP

SEQ ID NO: 870306 - protein, 9 aa, Homo Sapiens
STSSYCWLS

SEQ ID NO: 870307 - protein, 9 aa, Homo Sapiens
DIDIMLGVC

SEQ ID NO: 870308 - protein, 9 aa, Homo Sapiens
KGAPWNCDS

SEQ ID NO: 870309 - protein, 9 aa, Homo Sapiens
DFLAYLEND

SEQ ID NO: 870310 - protein, 9 aa, Homo Sapiens
NSDYAITQF

SEQ ID NO: 870311 - protein, 9 aa, Homo Sapiens
ICQVIQMEL

SEQ ID NO: 870312 - protein, 9 aa, Homo Sapiens
EKNRHLKNR

SEQ ID NO: 870313 - protein, 9 aa, Homo Sapiens
VRSKFELDR

SEQ ID NO: 870314 - protein, 9 aa, Homo Sapiens
PRANWSSIC

SEQ ID NO: 870315 - protein, 9 aa, Homo Sapiens
FSAIYLACT

SEQ ID NO: 870316 - protein, 9 aa, Homo Sapiens
LLCILRHFW

SEQ ID NO: 870317 - protein, 9 aa, Homo Sapiens
GCRYLRYIL

SEQ ID NO: 870318 - protein, 9 aa, Homo Sapiens
HQIPNSQRK

SEQ ID NO: 870319 - protein, 9 aa, Homo Sapiens
CHACRSGFY

SEQ ID NO: 870320 - protein, 9 aa, Homo Sapiens
YNNRKEAAL

SEQ ID NO: 870321 - protein, 9 aa, Homo Sapiens
SDDKNKNKN

SEQ ID NO: 870322 - protein, 9 aa, Homo Sapiens
NMESIRRIF

SEQ ID NO: 870323 - protein, 9 aa, Homo Sapiens
ASAYPGGCG

SEQ ID NO: 870324 - protein, 9 aa, Homo Sapiens
LGIIYRYLK

SEQ ID NO: 870325 - protein, 9 aa, Homo Sapiens
TQSSSNLSP

SEQ ID NO: 870326 - protein, 9 aa, Homo Sapiens
LQELFFNLP

SEQ ID NO: 870327 - protein, 9 aa, Homo Sapiens
NTIRWRIRQ

SEQ ID NO: 870328 - protein, 9 aa, Homo Sapiens
ERIVTASST

SEQ ID NO: 870329 - protein, 9 aa, Homo Sapiens
SSITLCWEV

SEQ ID NO: 870330 - protein, 9 aa, Homo Sapiens
FDLRQCHQQ

SEQ ID NO: 870331 - protein, 9 aa, Homo Sapiens
HFEEDKNAL

SEQ ID NO: 870332 - protein, 9 aa, Homo Sapiens
DMRTILFDI

SEQ ID NO: 870333 - protein, 9 aa, Homo Sapiens
IMISNHQHS

SEQ ID NO: 870334 - protein, 9 aa, Homo Sapiens
KTDSAVATA

SEQ ID NO: 870335 - protein, 9 aa, Homo Sapiens
VDDSNDHVI

SEQ ID NO: 870336 - protein, 9 aa, Homo Sapiens
VRIKCPLPS

SEQ ID NO: 870337 - protein, 9 aa, Homo Sapiens
PLDWFGLGQ

SEQ ID NO: 870338 - protein, 9 aa, Homo Sapiens
LIKATTEER

SEQ ID NO: 870339 - protein, 9 aa, Homo Sapiens
FIQGEVRLG

SEQ ID NO: 870340 - protein, 9 aa, Homo Sapiens
YLFFHHSHG

SEQ ID NO: 870341 - protein, 9 aa, Homo Sapiens
ALVDEIVMT

SEQ ID NO: 870342 - protein, 9 aa, Homo Sapiens
GLCKNYVSL

SEQ ID NO: 870343 - protein, 9 aa, Homo Sapiens
QMTVVWCRS

SEQ ID NO: 870344 - protein, 9 aa, Homo Sapiens
VHKTKEMAT

SEQ ID NO: 870345 - protein, 9 aa, Homo Sapiens
DKIKDTEDE

SEQ ID NO: 870346 - protein, 9 aa, Homo Sapiens
FTIFFGSVS

SEQ ID NO: 870347 - protein, 9 aa, Homo Sapiens
AMCISHKKL

SEQ ID NO: 870348 - protein, 9 aa, Homo Sapiens
SKNGRMGVL

SEQ ID NO: 870349 - protein, 9 aa, Homo Sapiens
PKSSNNTDF

SEQ ID NO: 870350 - protein, 9 aa, Homo Sapiens
EILAKRTFR

SEQ ID NO: 870351 - protein, 9 aa, Homo Sapiens
WPDPQKASG

SEQ ID NO: 870352 - protein, 9 aa, Homo Sapiens
HLKRHFMFQ

SEQ ID NO: 870353 - protein, 9 aa, Homo Sapiens
IMAKKISTI

SEQ ID NO: 870354 - protein, 9 aa, Homo Sapiens
RPPLRELFV

SEQ ID NO: 870355 - protein, 9 aa, Homo Sapiens
SMETSIKPK

SEQ ID NO: 870356 - protein, 9 aa, Homo Sapiens
KDNQRTFRD

SEQ ID NO: 870357 - protein, 9 aa, Homo Sapiens
GKQSQTVGI

SEQ ID NO: 870358 - protein, 9 aa, Homo Sapiens
RPNFFYRCF

SEQ ID NO: 870359 - protein, 9 aa, Homo Sapiens
FIKIEKNGK

SEQ ID NO: 870360 - protein, 9 aa, Homo Sapiens
IIDEFESMM

SEQ ID NO: 870361 - protein, 9 aa, Homo Sapiens
ITIPPCYET

SEQ ID NO: 870362 - protein, 9 aa, Homo Sapiens
VNVFAIFIG

SEQ ID NO: 870363 - protein, 9 aa, Homo Sapiens
ILQGAKIVF

SEQ ID NO: 870364 - protein, 9 aa, Homo Sapiens
DKTKSPPAS

SEQ ID NO: 870365 - protein, 9 aa, Homo Sapiens
GHHKDAGVI

SEQ ID NO: 870366 - protein, 9 aa, Homo Sapiens
DNKHCYLLV

SEQ ID NO: 870367 - protein, 9 aa, Homo Sapiens
DKKPHDHKA

SEQ ID NO: 870368 - protein, 9 aa, Homo Sapiens
CGAADGIWL

SEQ ID NO: 870369 - protein, 9 aa, Homo Sapiens
KFLQDYDIQ

SEQ ID NO: 870370 - protein, 9 aa, Homo Sapiens
VCVISLGLV

SEQ ID NO: 870371 - protein, 9 aa, Homo Sapiens
VALLSALNT

SEQ ID NO: 870372 - protein, 9 aa, Homo Sapiens
GPGELGGSA

SEQ ID NO: 870373 - protein, 9 aa, Homo Sapiens
YLRLEKMCL

SEQ ID NO: 870374 - protein, 9 aa, Homo Sapiens
ALNLPKTTI

SEQ ID NO: 870375 - protein, 9 aa, Homo Sapiens
TFDIATNKA

SEQ ID NO: 870376 - protein, 9 aa, Homo Sapiens
DVSQSMTPF

SEQ ID NO: 870377 - protein, 9 aa, Homo Sapiens
VRRSEVCIY

SEQ ID NO: 870378 - protein, 9 aa, Homo Sapiens
CGKRFRKSF

SEQ ID NO: 870379 - protein, 9 aa, Homo Sapiens
QYIFKYDMW

SEQ ID NO: 870380 - protein, 9 aa, Homo Sapiens
RDKKPHDHK

SEQ ID NO: 870381 - protein, 9 aa, Homo Sapiens
SPETSPASS

SEQ ID NO: 870382 - protein, 9 aa, Homo Sapiens
RGYIKNKLF

SEQ ID NO: 870383 - protein, 9 aa, Homo Sapiens
RVLCMYDDR

SEQ ID NO: 870384 - protein, 9 aa, Homo Sapiens
RNSPQPSPK

SEQ ID NO: 870385 - protein, 9 aa, Homo Sapiens
LEEGPPHTN

SEQ ID NO: 870386 - protein, 9 aa, Homo Sapiens
PAANTVKFC

SEQ ID NO: 870387 - protein, 9 aa, Homo Sapiens
RENPYFCKG

SEQ ID NO: 870388 - protein, 9 aa, Homo Sapiens
RFQLGYHAI

SEQ ID NO: 870389 - protein, 9 aa, Homo Sapiens
NGKDKYKVY

SEQ ID NO: 870390 - protein, 9 aa, Homo Sapiens
NYPKRRSCQ

SEQ ID NO: 870391 - protein, 9 aa, Homo Sapiens
TTPPVLTWR

SEQ ID NO: 870392 - protein, 9 aa, Homo Sapiens
NVSFLMKHK

SEQ ID NO: 870393 - protein, 9 aa, Homo Sapiens
VDHKVHFTC

SEQ ID NO: 870394 - protein, 9 aa, Homo Sapiens
RHHTSLIQH

SEQ ID NO: 870395 - protein, 9 aa, Homo Sapiens
PSFPENIIS

SEQ ID NO: 870396 - protein, 9 aa, Homo Sapiens
PLPFGTVPP

SEQ ID NO: 870397 - protein, 9 aa, Homo Sapiens
VKMICRVND

SEQ ID NO: 870398 - protein, 9 aa, Homo Sapiens
FRVLACMVD

SEQ ID NO: 870399 - protein, 9 aa, Homo Sapiens
TPPPYPKNG

SEQ ID NO: 870400 - protein, 9 aa, Homo Sapiens
GHVQLHIME

SEQ ID NO: 870401 - protein, 9 aa, Homo Sapiens
FRKSFHLSK

SEQ ID NO: 870402 - protein, 9 aa, Homo Sapiens
ICRVNDEEG

SEQ ID NO: 870403 - protein, 9 aa, Homo Sapiens
LQEGDRILV

SEQ ID NO: 870404 - protein, 9 aa, Homo Sapiens
HLLLGVVQI

SEQ ID NO: 870405 - protein, 9 aa, Homo Sapiens
LCTYMASED

SEQ ID NO: 870406 - protein, 9 aa, Homo Sapiens
ITVVYAQGL

SEQ ID NO: 870407 - protein, 9 aa, Homo Sapiens
NPLTLFRGA

SEQ ID NO: 870408 - protein, 9 aa, Homo Sapiens
TVTYENLKF

SEQ ID NO: 870409 - protein, 9 aa, Homo Sapiens
DYLETVAKT

SEQ ID NO: 870410 - protein, 9 aa, Homo Sapiens
TSSTLIHSD

SEQ ID NO: 870411 - protein, 9 aa, Homo Sapiens
VVLPPVGSE

SEQ ID NO: 870412 - protein, 9 aa, Homo Sapiens
HFDKLMDGT

SEQ ID NO: 870413 - protein, 9 aa, Homo Sapiens
NSSITLCWE

SEQ ID NO: 870414 - protein, 9 aa, Homo Sapiens
KPFWCTFEG

SEQ ID NO: 870415 - protein, 9 aa, Homo Sapiens
WCECDDGFT

SEQ ID NO: 870416 - protein, 9 aa, Homo Sapiens
LVVQDRNEL

SEQ ID NO: 870417 - protein, 9 aa, Homo Sapiens
DPNFHLVGS

SEQ ID NO: 870418 - protein, 9 aa, Homo Sapiens
VAEITFNTS

SEQ ID NO: 870419 - protein, 9 aa, Homo Sapiens
HCVTGLGKV

SEQ ID NO: 870420 - protein, 9 aa, Homo Sapiens
FIILLFITA

SEQ ID NO: 870421 - protein, 9 aa, Homo Sapiens
QAKEEGEGL

SEQ ID NO: 870422 - protein, 9 aa, Homo Sapiens
GQERFQVKN

SEQ ID NO: 870423 - protein, 9 aa, Homo Sapiens
VCQMPGKGL

SEQ ID NO: 870424 - protein, 9 aa, Homo Sapiens
NNTTSIAQA

SEQ ID NO: 870425 - protein, 9 aa, Homo Sapiens
SALILESKK

SEQ ID NO: 870426 - protein, 9 aa, Homo Sapiens
VAIIFHNET

SEQ ID NO: 870427 - protein, 9 aa, Homo Sapiens
RIISLSQND

SEQ ID NO: 870428 - protein, 9 aa, Homo Sapiens
LFQLHERTH

SEQ ID NO: 870429 - protein, 9 aa, Homo Sapiens
CKFQILNDE

SEQ ID NO: 870430 - protein, 9 aa, Homo Sapiens
HYKHFDWLY

SEQ ID NO: 870431 - protein, 9 aa, Homo Sapiens
TAVTLITVC

SEQ ID NO: 870432 - protein, 9 aa, Homo Sapiens
LITVCWHFG

SEQ ID NO: 870433 - protein, 9 aa, Homo Sapiens
EQRCASLNT

SEQ ID NO: 870434 - protein, 9 aa, Homo Sapiens
LFSPLNPIR

SEQ ID NO: 870435 - protein, 9 aa, Homo Sapiens
THISTGELL

SEQ ID NO: 870436 - protein, 9 aa, Homo Sapiens
VRPRSLQSP

SEQ ID NO: 870437 - protein, 9 aa, Homo Sapiens
YETLKFIVG

SEQ ID NO: 870438 - protein, 9 aa, Homo Sapiens
EPVWFLRSM

SEQ ID NO: 870439 - protein, 9 aa, Homo Sapiens
ESLEISLSV

SEQ ID NO: 870440 - protein, 9 aa, Homo Sapiens
IDLRCPLSR

SEQ ID NO: 870441 - protein, 9 aa, Homo Sapiens
PGDLAPQSD

SEQ ID NO: 870442 - protein, 9 aa, Homo Sapiens
KSFINQDKI

SEQ ID NO: 870443 - protein, 9 aa, Homo Sapiens
IECNGRGTC

SEQ ID NO: 870444 - protein, 9 aa, Homo Sapiens
RGQLYASEH

SEQ ID NO: 870445 - protein, 9 aa, Homo Sapiens
FSEDDPECM

SEQ ID NO: 870446 - protein, 9 aa, Homo Sapiens
THLHINAPQ

SEQ ID NO: 870447 - protein, 9 aa, Homo Sapiens
LLLNTRESD

SEQ ID NO: 870448 - protein, 9 aa, Homo Sapiens
GENREEAIL

SEQ ID NO: 870449 - protein, 9 aa, Homo Sapiens
TAPYRTQSS

SEQ ID NO: 870450 - protein, 9 aa, Homo Sapiens
GKTRFKKTK

SEQ ID NO: 870451 - protein, 9 aa, Homo Sapiens
PVLDISLIE

SEQ ID NO: 870452 - protein, 9 aa, Homo Sapiens
KLLERDSFL

SEQ ID NO: 870453 - protein, 9 aa, Homo Sapiens
SKAERLRWS

SEQ ID NO: 870454 - protein, 9 aa, Homo Sapiens
HSNEWKTVM

SEQ ID NO: 870455 - protein, 9 aa, Homo Sapiens
DLFTSLSAE

SEQ ID NO: 870456 - protein, 9 aa, Homo Sapiens
VYPVQSAYP

SEQ ID NO: 870457 - protein, 9 aa, Homo Sapiens
YSIYKQTAE

SEQ ID NO: 870458 - protein, 9 aa, Homo Sapiens
CLSNMLKFG

SEQ ID NO: 870459 - protein, 9 aa, Homo Sapiens
VCRAGAKSR

SEQ ID NO: 870460 - protein, 9 aa, Homo Sapiens
KSQFDKFVR

SEQ ID NO: 870461 - protein, 9 aa, Homo Sapiens
GDTGRIGQN

SEQ ID NO: 870462 - protein, 9 aa, Homo Sapiens
YLENSFSNM

SEQ ID NO: 870463 - protein, 9 aa, Homo Sapiens
QKYITEFLD

SEQ ID NO: 870464 - protein, 9 aa, Homo Sapiens
QEILPLHVL

SEQ ID NO: 870465 - protein, 9 aa, Homo Sapiens
VHFDLAVNK

SEQ ID NO: 870466 - protein, 9 aa, Homo Sapiens
KILVATYIH

SEQ ID NO: 870467 - protein, 9 aa, Homo Sapiens
ILHRRKQDN

SEQ ID NO: 870468 - protein, 9 aa, Homo Sapiens
VTGNSIRSY

SEQ ID NO: 870469 - protein, 9 aa, Homo Sapiens
MLQRPQHYN

SEQ ID NO: 870470 - protein, 9 aa, Homo Sapiens
HLVTMLGAN

SEQ ID NO: 870471 - protein, 9 aa, Homo Sapiens
LMRRLVNIS

SEQ ID NO: 870472 - protein, 9 aa, Homo Sapiens
CRVTNEILH

SEQ ID NO: 870473 - protein, 9 aa, Homo Sapiens
PFILFQLYK

SEQ ID NO: 870474 - protein, 9 aa, Homo Sapiens
LDLAEYTFL

SEQ ID NO: 870475 - protein, 9 aa, Homo Sapiens
LTSLASTLV

SEQ ID NO: 870476 - protein, 9 aa, Homo Sapiens
KHHTDMSSL

SEQ ID NO: 870477 - protein, 9 aa, Homo Sapiens
NELAHCTVI

SEQ ID NO: 870478 - protein, 9 aa, Homo Sapiens
CLQTKLRER

SEQ ID NO: 870479 - protein, 9 aa, Homo Sapiens
KCIPQSLAY

SEQ ID NO: 870480 - protein, 9 aa, Homo Sapiens
VICHLYNED

SEQ ID NO: 870481 - protein, 9 aa, Homo Sapiens
EACKYTLQI

SEQ ID NO: 870482 - protein, 9 aa, Homo Sapiens
QLDGTAVEN

SEQ ID NO: 870483 - protein, 9 aa, Homo Sapiens
EGAKVLDVG

SEQ ID NO: 870484 - protein, 9 aa, Homo Sapiens
LPKTTIKVW

SEQ ID NO: 870485 - protein, 9 aa, Homo Sapiens
QIWHMDLIQ

SEQ ID NO: 870486 - protein, 9 aa, Homo Sapiens
FETSLQITA

SEQ ID NO: 870487 - protein, 9 aa, Homo Sapiens
QADHLALYD

SEQ ID NO: 870488 - protein, 9 aa, Homo Sapiens
TQVDTQLQV

SEQ ID NO: 870489 - protein, 9 aa, Homo Sapiens
SLSYLAATH

SEQ ID NO: 870490 - protein, 9 aa, Homo Sapiens
WRNMDDDHL

SEQ ID NO: 870491 - protein, 9 aa, Homo Sapiens
IAGGNTDMK

SEQ ID NO: 870492 - protein, 9 aa, Homo Sapiens
KITKCADID

SEQ ID NO: 870493 - protein, 9 aa, Homo Sapiens
ALIQTLGKQ

SEQ ID NO: 870494 - protein, 9 aa, Homo Sapiens
ILMTNNHAQ

SEQ ID NO: 870495 - protein, 9 aa, Homo Sapiens
SSTSCICQS

SEQ ID NO: 870496 - protein, 9 aa, Homo Sapiens
NLPYYTVVK

SEQ ID NO: 870497 - protein, 9 aa, Homo Sapiens
VRQEPVPEA

SEQ ID NO: 870498 - protein, 9 aa, Homo Sapiens
APPTVTLLH

SEQ ID NO: 870499 - protein, 9 aa, Homo Sapiens
RDIGNSIKH

SEQ ID NO: 870500 - protein, 9 aa, Homo Sapiens
LDVLQARVA

SEQ ID NO: 870501 - protein, 9 aa, Homo Sapiens
YKEDFKKER

SEQ ID NO: 870502 - protein, 9 aa, Homo Sapiens
LVGSYSPTR

SEQ ID NO: 870503 - protein, 9 aa, Homo Sapiens
GIAYSNYNW

SEQ ID NO: 870504 - protein, 9 aa, Homo Sapiens
HSALIRHQQ

SEQ ID NO: 870505 - protein, 9 aa, Homo Sapiens
ENMLFTSFY

SEQ ID NO: 870506 - protein, 9 aa, Homo Sapiens
GNSYIKYWL

SEQ ID NO: 870507 - protein, 9 aa, Homo Sapiens
SNGYRWCAT

SEQ ID NO: 870508 - protein, 9 aa, Homo Sapiens
EYEHIAIGV

SEQ ID NO: 870509 - protein, 9 aa, Homo Sapiens
LNKWSGATY

SEQ ID NO: 870510 - protein, 9 aa, Homo Sapiens
VLPSGEVLT

SEQ ID NO: 870511 - protein, 9 aa, Homo Sapiens
GHSFDSNYF

SEQ ID NO: 870512 - protein, 9 aa, Homo Sapiens
RVPNFNDNC

SEQ ID NO: 870513 - protein, 9 aa, Homo Sapiens
RQYIFKYDM

SEQ ID NO: 870514 - protein, 9 aa, Homo Sapiens
HSALIRHQI

SEQ ID NO: 870515 - protein, 9 aa, Homo Sapiens
SLKLLGHLT

SEQ ID NO: 870516 - protein, 9 aa, Homo Sapiens
ANQKTLYFP

SEQ ID NO: 870517 - protein, 9 aa, Homo Sapiens
RNNIDVNEI

SEQ ID NO: 870518 - protein, 9 aa, Homo Sapiens
VDTTFKNGL

SEQ ID NO: 870519 - protein, 9 aa, Homo Sapiens
NKRGQLYAS

SEQ ID NO: 870520 - protein, 9 aa, Homo Sapiens
CLPCLQRLL

SEQ ID NO: 870521 - protein, 9 aa, Homo Sapiens
EVCKVNESI

SEQ ID NO: 870522 - protein, 9 aa, Homo Sapiens
SSLGAKKER

SEQ ID NO: 870523 - protein, 9 aa, Homo Sapiens
ERLLIENCN

SEQ ID NO: 870524 - protein, 9 aa, Homo Sapiens
WVSRPDQNL

SEQ ID NO: 870525 - protein, 9 aa, Homo Sapiens
GRINAGIDF

SEQ ID NO: 870526 - protein, 9 aa, Homo Sapiens
PNGTVIPNG

SEQ ID NO: 870527 - protein, 9 aa, Homo Sapiens
SQTKVLSSK

SEQ ID NO: 870528 - protein, 9 aa, Homo Sapiens
IVYELDNNL

SEQ ID NO: 870529 - protein, 9 aa, Homo Sapiens
EDMEIGPGE

SEQ ID NO: 870530 - protein, 9 aa, Homo Sapiens
RDLEPKQSL

SEQ ID NO: 870531 - protein, 9 aa, Homo Sapiens
TPLTVLMAA

SEQ ID NO: 870532 - protein, 9 aa, Homo Sapiens
TGKLGKIQV

SEQ ID NO: 870533 - protein, 9 aa, Homo Sapiens
PPSELIIKV

SEQ ID NO: 870534 - protein, 9 aa, Homo Sapiens
TIYLGNRYY

SEQ ID NO: 870535 - protein, 9 aa, Homo Sapiens
ILSAAEHLS

SEQ ID NO: 870536 - protein, 9 aa, Homo Sapiens
WYMDSYTSN

SEQ ID NO: 870537 - protein, 9 aa, Homo Sapiens
ALVSVCVYY

SEQ ID NO: 870538 - protein, 9 aa, Homo Sapiens
QQAKLYESI

SEQ ID NO: 870539 - protein, 9 aa, Homo Sapiens
SSAASPPAS

SEQ ID NO: 870540 - protein, 9 aa, Homo Sapiens
LCDTSEDLR

SEQ ID NO: 870541 - protein, 9 aa, Homo Sapiens
NLGAHIKKE

SEQ ID NO: 870542 - protein, 9 aa, Homo Sapiens
AIHTGQKPY

SEQ ID NO: 870543 - protein, 9 aa, Homo Sapiens
GEDCECGSP

SEQ ID NO: 870544 - protein, 9 aa, Homo Sapiens
VLTSLASTL

SEQ ID NO: 870545 - protein, 9 aa, Homo Sapiens
TSILNFYHT

SEQ ID NO: 870546 - protein, 9 aa, Homo Sapiens
TSKDQQNIL

SEQ ID NO: 870547 - protein, 9 aa, Homo Sapiens
DQLSKDKKK

SEQ ID NO: 870548 - protein, 9 aa, Homo Sapiens
WRFQPNTRE

SEQ ID NO: 870549 - protein, 9 aa, Homo Sapiens
TSCQPNNPR

SEQ ID NO: 870550 - protein, 9 aa, Homo Sapiens
QAQDNLHDQ

SEQ ID NO: 870551 - protein, 9 aa, Homo Sapiens
KSPAPEDKG

SEQ ID NO: 870552 - protein, 9 aa, Homo Sapiens
FGSKFIIDL

SEQ ID NO: 870553 - protein, 9 aa, Homo Sapiens
TVLPTNVLQ

SEQ ID NO: 870554 - protein, 9 aa, Homo Sapiens
TYQTSGLYG

SEQ ID NO: 870555 - protein, 9 aa, Homo Sapiens
TTGLFLQPL

SEQ ID NO: 870556 - protein, 9 aa, Homo Sapiens
EDQLSKDKK

SEQ ID NO: 870557 - protein, 9 aa, Homo Sapiens
EFNFIHDVN

SEQ ID NO: 870558 - protein, 9 aa, Homo Sapiens
FQCNKCGKV

SEQ ID NO: 870559 - protein, 9 aa, Homo Sapiens
VSVHCKKEH

SEQ ID NO: 870560 - protein, 9 aa, Homo Sapiens
EGTQYTLSV

SEQ ID NO: 870561 - protein, 9 aa, Homo Sapiens
LKTIINKSS

SEQ ID NO: 870562 - protein, 9 aa, Homo Sapiens
IKSLRTFLL

SEQ ID NO: 870563 - protein, 9 aa, Homo Sapiens
CWYCRRQNG

SEQ ID NO: 870564 - protein, 9 aa, Homo Sapiens
CSGNQRQST

SEQ ID NO: 870565 - protein, 9 aa, Homo Sapiens
QALPFSASS

SEQ ID NO: 870566 - protein, 9 aa, Homo Sapiens
IVTMSREVK

SEQ ID NO: 870567 - protein, 9 aa, Homo Sapiens
REDIPICPV

SEQ ID NO: 870568 - protein, 9 aa, Homo Sapiens
IIINCGANV

SEQ ID NO: 870569 - protein, 9 aa, Homo Sapiens
PTVVMFGCN

SEQ ID NO: 870570 - protein, 9 aa, Homo Sapiens
TAEDKELEA

SEQ ID NO: 870571 - protein, 9 aa, Homo Sapiens
YHGLLGSPV

SEQ ID NO: 870572 - protein, 9 aa, Homo Sapiens
DPALSQPQK

SEQ ID NO: 870573 - protein, 9 aa, Homo Sapiens
PDQTSLLGD

SEQ ID NO: 870574 - protein, 9 aa, Homo Sapiens
VPSTLTTPG

SEQ ID NO: 870575 - protein, 9 aa, Homo Sapiens
LREPVTINC

SEQ ID NO: 870576 - protein, 9 aa, Homo Sapiens
EAGCEYISL

SEQ ID NO: 870577 - protein, 9 aa, Homo Sapiens
TTWERKYYI

SEQ ID NO: 870578 - protein, 9 aa, Homo Sapiens
SPLHKRIYC

SEQ ID NO: 870579 - protein, 9 aa, Homo Sapiens
YVFILSFIL

SEQ ID NO: 870580 - protein, 9 aa, Homo Sapiens
CPPPRGTRP

SEQ ID NO: 870581 - protein, 9 aa, Homo Sapiens
ELSYVLLTD

SEQ ID NO: 870582 - protein, 9 aa, Homo Sapiens
GKGECASQT

SEQ ID NO: 870583 - protein, 9 aa, Homo Sapiens
LLLFSNWMV

SEQ ID NO: 870584 - protein, 9 aa, Homo Sapiens
EQITYIQQE

SEQ ID NO: 870585 - protein, 9 aa, Homo Sapiens
QDNYIPDED

SEQ ID NO: 870586 - protein, 9 aa, Homo Sapiens
KKEDIKTLI

SEQ ID NO: 870587 - protein, 9 aa, Homo Sapiens
RLANLMGLA

SEQ ID NO: 870588 - protein, 9 aa, Homo Sapiens
DNKLLKQHE

SEQ ID NO: 870589 - protein, 9 aa, Homo Sapiens
SSVSKTLIF

SEQ ID NO: 870590 - protein, 9 aa, Homo Sapiens
LNISVTSFK

SEQ ID NO: 870591 - protein, 9 aa, Homo Sapiens
NPIIYVFMG

SEQ ID NO: 870592 - protein, 9 aa, Homo Sapiens
SRAFIIEET

SEQ ID NO: 870593 - protein, 9 aa, Homo Sapiens
QTPWVSSRI

SEQ ID NO: 870594 - protein, 9 aa, Homo Sapiens
PHADSMCKR

SEQ ID NO: 870595 - protein, 9 aa, Homo Sapiens
SKQGGCCSP

SEQ ID NO: 870596 - protein, 9 aa, Homo Sapiens
SFFSVKTHT

SEQ ID NO: 870597 - protein, 9 aa, Homo Sapiens
LKAGKTQTF

SEQ ID NO: 870598 - protein, 9 aa, Homo Sapiens
TMLQNGAPL

SEQ ID NO: 870599 - protein, 9 aa, Homo Sapiens
KKEESKLKI

SEQ ID NO: 870600 - protein, 9 aa, Homo Sapiens
GRPRYPNTC

SEQ ID NO: 870601 - protein, 9 aa, Homo Sapiens
LAAALQIQN

SEQ ID NO: 870602 - protein, 9 aa, Homo Sapiens
AVEEERQRL

SEQ ID NO: 870603 - protein, 9 aa, Homo Sapiens
FQELFGLNN

SEQ ID NO: 870604 - protein, 9 aa, Homo Sapiens
QSTNGQTIQ

SEQ ID NO: 870605 - protein, 9 aa, Homo Sapiens
PHLTIQDPQ

SEQ ID NO: 870606 - protein, 9 aa, Homo Sapiens
RYFVNREIY

SEQ ID NO: 870607 - protein, 9 aa, Homo Sapiens
RLVSLDLGL

SEQ ID NO: 870608 - protein, 9 aa, Homo Sapiens
DTVPWLQGL

SEQ ID NO: 870609 - protein, 9 aa, Homo Sapiens
NFQQLYRHL

SEQ ID NO: 870610 - protein, 9 aa, Homo Sapiens
EKDPEKFLN

SEQ ID NO: 870611 - protein, 9 aa, Homo Sapiens
TNMHSHTHA

SEQ ID NO: 870612 - protein, 9 aa, Homo Sapiens
GESTANENT

SEQ ID NO: 870613 - protein, 9 aa, Homo Sapiens
ALSNLVVKG

SEQ ID NO: 870614 - protein, 9 aa, Homo Sapiens
QVAVPARVS

SEQ ID NO: 870615 - protein, 9 aa, Homo Sapiens
LRHHIIHSG

SEQ ID NO: 870616 - protein, 9 aa, Homo Sapiens
ECLVKEGRF

SEQ ID NO: 870617 - protein, 9 aa, Homo Sapiens
SEEKQWIML

SEQ ID NO: 870618 - protein, 9 aa, Homo Sapiens
QIFHKLWCR

SEQ ID NO: 870619 - protein, 9 aa, Homo Sapiens
ELVEQSHIF

SEQ ID NO: 870620 - protein, 9 aa, Homo Sapiens
VLPWGCLCG

SEQ ID NO: 870621 - protein, 9 aa, Homo Sapiens
LNWSDSDSS

SEQ ID NO: 870622 - protein, 9 aa, Homo Sapiens
PLEDDNKFT

SEQ ID NO: 870623 - protein, 9 aa, Homo Sapiens
ARGTFGSSK

SEQ ID NO: 870624 - protein, 9 aa, Homo Sapiens
DAGPSGRVQ

SEQ ID NO: 870625 - protein, 9 aa, Homo Sapiens
SGGDSNTNG

SEQ ID NO: 870626 - protein, 9 aa, Homo Sapiens
NIICCKKVE

SEQ ID NO: 870627 - protein, 9 aa, Homo Sapiens
QRLHGMDMS

SEQ ID NO: 870628 - protein, 9 aa, Homo Sapiens
SNVADDDSG

SEQ ID NO: 870629 - protein, 9 aa, Homo Sapiens
WAFMMCLHA

SEQ ID NO: 870630 - protein, 9 aa, Homo Sapiens
VLQDFIGVL

SEQ ID NO: 870631 - protein, 9 aa, Homo Sapiens
RTAYPNAFC

SEQ ID NO: 870632 - protein, 9 aa, Homo Sapiens
INGSLHQEL

SEQ ID NO: 870633 - protein, 9 aa, Homo Sapiens
TATITKPRG

SEQ ID NO: 870634 - protein, 9 aa, Homo Sapiens
EHKPPPYKH

SEQ ID NO: 870635 - protein, 9 aa, Homo Sapiens
KIIRVDAPD

SEQ ID NO: 870636 - protein, 9 aa, Homo Sapiens
MKKAQNDEY

SEQ ID NO: 870637 - protein, 9 aa, Homo Sapiens
QISTSLPQC

SEQ ID NO: 870638 - protein, 9 aa, Homo Sapiens
NRDLGPNTQ

SEQ ID NO: 870639 - protein, 9 aa, Homo Sapiens
QPSPKQSPR

SEQ ID NO: 870640 - protein, 9 aa, Homo Sapiens
LDQQKPRVN

SEQ ID NO: 870641 - protein, 9 aa, Homo Sapiens
NIVYTYQIF

SEQ ID NO: 870642 - protein, 9 aa, Homo Sapiens
KSYYTVQQL

SEQ ID NO: 870643 - protein, 9 aa, Homo Sapiens
DLPVAQISA

SEQ ID NO: 870644 - protein, 9 aa, Homo Sapiens
LTYPLLFTA

SEQ ID NO: 870645 - protein, 9 aa, Homo Sapiens
AFCVLSEPI

SEQ ID NO: 870646 - protein, 9 aa, Homo Sapiens
QPPNEATAS

SEQ ID NO: 870647 - protein, 9 aa, Homo Sapiens
KLQNRPRKH

SEQ ID NO: 870648 - protein, 9 aa, Homo Sapiens
RPSYIMSGP

SEQ ID NO: 870649 - protein, 9 aa, Homo Sapiens
AIQLSLEEW

SEQ ID NO: 870650 - protein, 9 aa, Homo Sapiens
QPIDLGAMP

SEQ ID NO: 870651 - protein, 9 aa, Homo Sapiens
YLEEAVSHN

SEQ ID NO: 870652 - protein, 9 aa, Homo Sapiens
ELFVDIGPV

SEQ ID NO: 870653 - protein, 9 aa, Homo Sapiens
LDIVLWNFL

SEQ ID NO: 870654 - protein, 9 aa, Homo Sapiens
SKLKRHIHS

SEQ ID NO: 870655 - protein, 9 aa, Homo Sapiens
GLGYTVVDK

SEQ ID NO: 870656 - protein, 9 aa, Homo Sapiens
DGGDPIQKG

SEQ ID NO: 870657 - protein, 9 aa, Homo Sapiens
SLESPHMYV

SEQ ID NO: 870658 - protein, 9 aa, Homo Sapiens
GTQPHPCIL

SEQ ID NO: 870659 - protein, 9 aa, Homo Sapiens
QTYLSCQAC

SEQ ID NO: 870660 - protein, 9 aa, Homo Sapiens
ITAFCCNGE

SEQ ID NO: 870661 - protein, 9 aa, Homo Sapiens
SKPSLGDHS

SEQ ID NO: 870662 - protein, 9 aa, Homo Sapiens
VKRGSDKLL

SEQ ID NO: 870663 - protein, 9 aa, Homo Sapiens
WILFGHQPY

SEQ ID NO: 870664 - protein, 9 aa, Homo Sapiens
CHHRLHGGD

SEQ ID NO: 870665 - protein, 9 aa, Homo Sapiens
QTTIQNELA

SEQ ID NO: 870666 - protein, 9 aa, Homo Sapiens
LPSLSAWPL

SEQ ID NO: 870667 - protein, 9 aa, Homo Sapiens
PTEHGESTA

SEQ ID NO: 870668 - protein, 9 aa, Homo Sapiens
DTSERMEPP

SEQ ID NO: 870669 - protein, 9 aa, Homo Sapiens
NKKAICKQD

SEQ ID NO: 870670 - protein, 9 aa, Homo Sapiens
NTSLGIELH

SEQ ID NO: 870671 - protein, 9 aa, Homo Sapiens
DKGSYFFWL

SEQ ID NO: 870672 - protein, 9 aa, Homo Sapiens
INQLQPKEF

SEQ ID NO: 870673 - protein, 9 aa, Homo Sapiens
LHSLRQQNI

SEQ ID NO: 870674 - protein, 9 aa, Homo Sapiens
QQFGELREI

SEQ ID NO: 870675 - protein, 9 aa, Homo Sapiens
VCCLTINLH

SEQ ID NO: 870676 - protein, 9 aa, Homo Sapiens
KVKARLQKF

SEQ ID NO: 870677 - protein, 9 aa, Homo Sapiens
LDHDDQCEK

SEQ ID NO: 870678 - protein, 9 aa, Homo Sapiens
LIHTSERTF

SEQ ID NO: 870679 - protein, 9 aa, Homo Sapiens
TVVEEIDHR

SEQ ID NO: 870680 - protein, 9 aa, Homo Sapiens
VGPGFLLSS

SEQ ID NO: 870681 - protein, 9 aa, Homo Sapiens
RYTDLSRLN

SEQ ID NO: 870682 - protein, 9 aa, Homo Sapiens
DKREKLEKD

SEQ ID NO: 870683 - protein, 9 aa, Homo Sapiens
MGFTSRKSC

SEQ ID NO: 870684 - protein, 9 aa, Homo Sapiens
CRKTFICRS

SEQ ID NO: 870685 - protein, 9 aa, Homo Sapiens
HNSIDETLE

SEQ ID NO: 870686 - protein, 9 aa, Homo Sapiens
LARRLQNHM

SEQ ID NO: 870687 - protein, 9 aa, Homo Sapiens
LNALNSLKE

SEQ ID NO: 870688 - protein, 9 aa, Homo Sapiens
NIRPIPDKE

SEQ ID NO: 870689 - protein, 9 aa, Homo Sapiens
NICSKLGAK

SEQ ID NO: 870690 - protein, 9 aa, Homo Sapiens
TVIDNKLYV

SEQ ID NO: 870691 - protein, 9 aa, Homo Sapiens
RLDVLKKYR

SEQ ID NO: 870692 - protein, 9 aa, Homo Sapiens
QRKGSQMST

SEQ ID NO: 870693 - protein, 9 aa, Homo Sapiens
PIVPLDTQN

SEQ ID NO: 870694 - protein, 9 aa, Homo Sapiens
YLYFASLNK

SEQ ID NO: 870695 - protein, 9 aa, Homo Sapiens
SALNTAGTV

SEQ ID NO: 870696 - protein, 9 aa, Homo Sapiens
TVPSVFKLN

SEQ ID NO: 870697 - protein, 9 aa, Homo Sapiens
TGLNTTTAY

SEQ ID NO: 870698 - protein, 9 aa, Homo Sapiens
QNQEYLKRF

SEQ ID NO: 870699 - protein, 9 aa, Homo Sapiens
YEIIELCRE

SEQ ID NO: 870700 - protein, 9 aa, Homo Sapiens
ALKKKQQFG

SEQ ID NO: 870701 - protein, 9 aa, Homo Sapiens
KNLYVKIDT

SEQ ID NO: 870702 - protein, 9 aa, Homo Sapiens
PINSVNLDS

SEQ ID NO: 870703 - protein, 9 aa, Homo Sapiens
DPCSRQSIW

SEQ ID NO: 870704 - protein, 9 aa, Homo Sapiens
DHDTNLTCQ

SEQ ID NO: 870705 - protein, 9 aa, Homo Sapiens
TRNIFYLSK

SEQ ID NO: 870706 - protein, 9 aa, Homo Sapiens
NIIPETLFI

SEQ ID NO: 870707 - protein, 9 aa, Homo Sapiens
PSPRTPMLW

SEQ ID NO: 870708 - protein, 9 aa, Homo Sapiens
LSQRYQKQM

SEQ ID NO: 870709 - protein, 9 aa, Homo Sapiens
YQNKVMQEN

SEQ ID NO: 870710 - protein, 9 aa, Homo Sapiens
IILKRAANI

SEQ ID NO: 870711 - protein, 9 aa, Homo Sapiens
CGQNATKLY

SEQ ID NO: 870712 - protein, 9 aa, Homo Sapiens
LHGGDKSYK

SEQ ID NO: 870713 - protein, 9 aa, Homo Sapiens
PPAEDRLAL

SEQ ID NO: 870714 - protein, 9 aa, Homo Sapiens
LPLSLQWLT

SEQ ID NO: 870715 - protein, 9 aa, Homo Sapiens
EPPKNCPDD

SEQ ID NO: 870716 - protein, 9 aa, Homo Sapiens
SNNGSMCNT

SEQ ID NO: 870717 - protein, 9 aa, Homo Sapiens
IIELFIYLP

SEQ ID NO: 870718 - protein, 9 aa, Homo Sapiens
QRFHTGNTS

SEQ ID NO: 870719 - protein, 9 aa, Homo Sapiens
LQRNSVSPV

SEQ ID NO: 870720 - protein, 9 aa, Homo Sapiens
DRNFIKNTA

SEQ ID NO: 870721 - protein, 9 aa, Homo Sapiens
WLLILSYVG

SEQ ID NO: 870722 - protein, 9 aa, Homo Sapiens
EKSQELLEA

SEQ ID NO: 870723 - protein, 9 aa, Homo Sapiens
EEKGKYPVP

SEQ ID NO: 870724 - protein, 9 aa, Homo Sapiens
TQLSEAKHK

SEQ ID NO: 870725 - protein, 9 aa, Homo Sapiens
FLPSQPRYS

SEQ ID NO: 870726 - protein, 9 aa, Homo Sapiens
PITLNKLFQ

SEQ ID NO: 870727 - protein, 9 aa, Homo Sapiens
FFLQGDKQF

SEQ ID NO: 870728 - protein, 9 aa, Homo Sapiens
PYLTSTQSL

SEQ ID NO: 870729 - protein, 9 aa, Homo Sapiens
QRGRAVEVW

SEQ ID NO: 870730 - protein, 9 aa, Homo Sapiens
SRCKNRTGT

SEQ ID NO: 870731 - protein, 9 aa, Homo Sapiens
AMYFKKEDV

SEQ ID NO: 870732 - protein, 9 aa, Homo Sapiens
QLAITDYFT

SEQ ID NO: 870733 - protein, 9 aa, Homo Sapiens
THYDPPQKL

SEQ ID NO: 870734 - protein, 9 aa, Homo Sapiens
NIPFLQNAI

SEQ ID NO: 870735 - protein, 9 aa, Homo Sapiens
IVLVLLLGH

SEQ ID NO: 870736 - protein, 9 aa, Homo Sapiens
NSLDVYGQE

SEQ ID NO: 870737 - protein, 9 aa, Homo Sapiens
TERVFRAGR

SEQ ID NO: 870738 - protein, 9 aa, Homo Sapiens
HKQPSHVIY

SEQ ID NO: 870739 - protein, 9 aa, Homo Sapiens
QTRLSTETG

SEQ ID NO: 870740 - protein, 9 aa, Homo Sapiens
ANPLGLEAE

SEQ ID NO: 870741 - protein, 9 aa, Homo Sapiens
YGHIYNKNI

SEQ ID NO: 870742 - protein, 9 aa, Homo Sapiens
FIPCENKSK

SEQ ID NO: 870743 - protein, 9 aa, Homo Sapiens
LTTSPFVKP

SEQ ID NO: 870744 - protein, 9 aa, Homo Sapiens
CLPHEVVGS

SEQ ID NO: 870745 - protein, 9 aa, Homo Sapiens
QTDVFLICL

SEQ ID NO: 870746 - protein, 9 aa, Homo Sapiens
SPHADSMCK

SEQ ID NO: 870747 - protein, 9 aa, Homo Sapiens
SPSRDKKPH

SEQ ID NO: 870748 - protein, 9 aa, Homo Sapiens
IILKKNEIQ

SEQ ID NO: 870749 - protein, 9 aa, Homo Sapiens
VPKSSVLRV

SEQ ID NO: 870750 - protein, 9 aa, Homo Sapiens
VITYQTVAN

SEQ ID NO: 870751 - protein, 9 aa, Homo Sapiens
LKYFSLAGN

SEQ ID NO: 870752 - protein, 9 aa, Homo Sapiens
TIKDNQATK

SEQ ID NO: 870753 - protein, 9 aa, Homo Sapiens
DSGKLTQEK

SEQ ID NO: 870754 - protein, 9 aa, Homo Sapiens
PKTNSWLLR

SEQ ID NO: 870755 - protein, 9 aa, Homo Sapiens
GSLKSSPGL

SEQ ID NO: 870756 - protein, 9 aa, Homo Sapiens
ILDTLGLLW

SEQ ID NO: 870757 - protein, 9 aa, Homo Sapiens
CKFFHPFNQ

SEQ ID NO: 870758 - protein, 9 aa, Homo Sapiens
QLGYHAIPS

SEQ ID NO: 870759 - protein, 9 aa, Homo Sapiens
GSVCSCVFF

SEQ ID NO: 870760 - protein, 9 aa, Homo Sapiens
DQPGEKGNC

SEQ ID NO: 870761 - protein, 9 aa, Homo Sapiens
ECNGRGTCN

SEQ ID NO: 870762 - protein, 9 aa, Homo Sapiens
LKLNRNKIK

SEQ ID NO: 870763 - protein, 9 aa, Homo Sapiens
SQEQGKFIY

SEQ ID NO: 870764 - protein, 9 aa, Homo Sapiens
FKKESGSCT

SEQ ID NO: 870765 - protein, 9 aa, Homo Sapiens
AACCNYSLH

SEQ ID NO: 870766 - protein, 9 aa, Homo Sapiens
TIIDDLLKN

SEQ ID NO: 870767 - protein, 9 aa, Homo Sapiens
TSHRNKSEL

SEQ ID NO: 870768 - protein, 9 aa, Homo Sapiens
LHAAITADI

SEQ ID NO: 870769 - protein, 9 aa, Homo Sapiens
AETKAVCEF

SEQ ID NO: 870770 - protein, 9 aa, Homo Sapiens
TGERSYECS

SEQ ID NO: 870771 - protein, 9 aa, Homo Sapiens
EGKFILHVF

SEQ ID NO: 870772 - protein, 9 aa, Homo Sapiens
LGIIVFLEL

SEQ ID NO: 870773 - protein, 9 aa, Homo Sapiens
KDTFKEKDT

SEQ ID NO: 870774 - protein, 9 aa, Homo Sapiens
GHYSLYLGT

SEQ ID NO: 870775 - protein, 9 aa, Homo Sapiens
VFLSRSLLY

SEQ ID NO: 870776 - protein, 9 aa, Homo Sapiens
LHYTALMHP

SEQ ID NO: 870777 - protein, 9 aa, Homo Sapiens
IKINSIFNR

SEQ ID NO: 870778 - protein, 9 aa, Homo Sapiens
PKESVQIIR

SEQ ID NO: 870779 - protein, 9 aa, Homo Sapiens
LCPEEQHHI

SEQ ID NO: 870780 - protein, 9 aa, Homo Sapiens
KMYGKQNIY

SEQ ID NO: 870781 - protein, 9 aa, Homo Sapiens
EVDERDQYD

SEQ ID NO: 870782 - protein, 9 aa, Homo Sapiens
VVALWECLV

SEQ ID NO: 870783 - protein, 9 aa, Homo Sapiens
ICGKLTEIC

SEQ ID NO: 870784 - protein, 9 aa, Homo Sapiens
SFFRIAYIL

SEQ ID NO: 870785 - protein, 9 aa, Homo Sapiens
DPSVITKLC

SEQ ID NO: 870786 - protein, 9 aa, Homo Sapiens
TASHFYRID

SEQ ID NO: 870787 - protein, 9 aa, Homo Sapiens
KIESLGITS

SEQ ID NO: 870788 - protein, 9 aa, Homo Sapiens
ALYNNNVPA

SEQ ID NO: 870789 - protein, 9 aa, Homo Sapiens
PILENDIGN

SEQ ID NO: 870790 - protein, 9 aa, Homo Sapiens
FVLLQTLAY

SEQ ID NO: 870791 - protein, 9 aa, Homo Sapiens
RSIQHCNIC

SEQ ID NO: 870792 - protein, 9 aa, Homo Sapiens
ETVKANVRW

SEQ ID NO: 870793 - protein, 9 aa, Homo Sapiens
NVYTLLTEG

SEQ ID NO: 870794 - protein, 9 aa, Homo Sapiens
QVTQLAINT

SEQ ID NO: 870795 - protein, 9 aa, Homo Sapiens
IIRVVISLQ

SEQ ID NO: 870796 - protein, 9 aa, Homo Sapiens
LEEAEIKSQ

SEQ ID NO: 870797 - protein, 9 aa, Homo Sapiens
KSESQKKST

SEQ ID NO: 870798 - protein, 9 aa, Homo Sapiens
NHIQNGIDI

SEQ ID NO: 870799 - protein, 9 aa, Homo Sapiens
GQLYASEHY

SEQ ID NO: 870800 - protein, 9 aa, Homo Sapiens
IVQQMEQET

SEQ ID NO: 870801 - protein, 9 aa, Homo Sapiens
ICNTARQGL

SEQ ID NO: 870802 - protein, 9 aa, Homo Sapiens
YRGKKCQEA

SEQ ID NO: 870803 - protein, 9 aa, Homo Sapiens
EFHFEPNNY

SEQ ID NO: 870804 - protein, 9 aa, Homo Sapiens
TAVKNLMAS

SEQ ID NO: 870805 - protein, 9 aa, Homo Sapiens
DDNRKFYLF

SEQ ID NO: 870806 - protein, 9 aa, Homo Sapiens
RICKLADQC

SEQ ID NO: 870807 - protein, 9 aa, Homo Sapiens
DVEADKLSW

SEQ ID NO: 870808 - protein, 9 aa, Homo Sapiens
STPVYYILC

SEQ ID NO: 870809 - protein, 9 aa, Homo Sapiens
AVRQEKRML

SEQ ID NO: 870810 - protein, 9 aa, Homo Sapiens
SVFMWGVNH

SEQ ID NO: 870811 - protein, 9 aa, Homo Sapiens
MVLKVDELV

SEQ ID NO: 870812 - protein, 9 aa, Homo Sapiens
SQNHLQQAQ

SEQ ID NO: 870813 - protein, 9 aa, Homo Sapiens
CHREPCLGS

SEQ ID NO: 870814 - protein, 9 aa, Homo Sapiens
IDKAKIESL

SEQ ID NO: 870815 - protein, 9 aa, Homo Sapiens
ADIQWPNEI

SEQ ID NO: 870816 - protein, 9 aa, Homo Sapiens
ADGNKQQDC

SEQ ID NO: 870817 - protein, 9 aa, Homo Sapiens
TRELRLTKN

SEQ ID NO: 870818 - protein, 9 aa, Homo Sapiens
WTTNGLPVQ

SEQ ID NO: 870819 - protein, 9 aa, Homo Sapiens
PQDMDENIR

SEQ ID NO: 870820 - protein, 9 aa, Homo Sapiens
TLSLMASLA

SEQ ID NO: 870821 - protein, 9 aa, Homo Sapiens
ATIFEPVYP

SEQ ID NO: 870822 - protein, 9 aa, Homo Sapiens
QAPCGATSS

SEQ ID NO: 870823 - protein, 9 aa, Homo Sapiens
FVIKGKVLC

SEQ ID NO: 870824 - protein, 9 aa, Homo Sapiens
LVIVLGSLL

SEQ ID NO: 870825 - protein, 9 aa, Homo Sapiens
CDPNFHLVG

SEQ ID NO: 870826 - protein, 9 aa, Homo Sapiens
KGQLVKLLL

SEQ ID NO: 870827 - protein, 9 aa, Homo Sapiens
MSSVAPASQ

SEQ ID NO: 870828 - protein, 9 aa, Homo Sapiens
SKIPLQEQN

SEQ ID NO: 870829 - protein, 9 aa, Homo Sapiens
PYNDCFEYF

SEQ ID NO: 870830 - protein, 9 aa, Homo Sapiens
MRSSGWKSN

SEQ ID NO: 870831 - protein, 9 aa, Homo Sapiens
CYRRLDLFQ

SEQ ID NO: 870832 - protein, 9 aa, Homo Sapiens
LAINTEERL

SEQ ID NO: 870833 - protein, 9 aa, Homo Sapiens
IASERHSIS

SEQ ID NO: 870834 - protein, 9 aa, Homo Sapiens
CFGSKLVKH

SEQ ID NO: 870835 - protein, 9 aa, Homo Sapiens
LRRNIIPET

SEQ ID NO: 870836 - protein, 9 aa, Homo Sapiens
NKISESFFY

SEQ ID NO: 870837 - protein, 9 aa, Homo Sapiens
EAQQWLHQN

SEQ ID NO: 870838 - protein, 9 aa, Homo Sapiens
RKIKENEFF

SEQ ID NO: 870839 - protein, 9 aa, Homo Sapiens
VSRKSIPKS

SEQ ID NO: 870840 - protein, 9 aa, Homo Sapiens
DTLSIQESR

SEQ ID NO: 870841 - protein, 9 aa, Homo Sapiens
RREGFDKNE

SEQ ID NO: 870842 - protein, 9 aa, Homo Sapiens
RNWAGTGHY

SEQ ID NO: 870843 - protein, 9 aa, Homo Sapiens
NNFPLRAQV

SEQ ID NO: 870844 - protein, 9 aa, Homo Sapiens
VAELRAHRE

SEQ ID NO: 870845 - protein, 9 aa, Homo Sapiens
KYACNDIQI

SEQ ID NO: 870846 - protein, 9 aa, Homo Sapiens
MPSSFACHR

SEQ ID NO: 870847 - protein, 9 aa, Homo Sapiens
FINQDKIKD

SEQ ID NO: 870848 - protein, 9 aa, Homo Sapiens
VSDFDCKEL

SEQ ID NO: 870849 - protein, 9 aa, Homo Sapiens
TARQGLKRK

SEQ ID NO: 870850 - protein, 9 aa, Homo Sapiens
GWNIKDVAV

SEQ ID NO: 870851 - protein, 9 aa, Homo Sapiens
SEDIDIMLG

SEQ ID NO: 870852 - protein, 9 aa, Homo Sapiens
MVFHPRSHC

SEQ ID NO: 870853 - protein, 9 aa, Homo Sapiens
KEKVLFIRL

SEQ ID NO: 870854 - protein, 9 aa, Homo Sapiens
AVPSQLNAL

SEQ ID NO: 870855 - protein, 9 aa, Homo Sapiens
AFLTACCET

SEQ ID NO: 870856 - protein, 9 aa, Homo Sapiens
FETLIINLG

SEQ ID NO: 870857 - protein, 9 aa, Homo Sapiens
FLHSLRQQN

SEQ ID NO: 870858 - protein, 9 aa, Homo Sapiens
FIVIAIRLD

SEQ ID NO: 870859 - protein, 9 aa, Homo Sapiens
RSGTDLEPL

SEQ ID NO: 870860 - protein, 9 aa, Homo Sapiens
ISNLSSTAK

SEQ ID NO: 870861 - protein, 9 aa, Homo Sapiens
ITTIYKRDP

SEQ ID NO: 870862 - protein, 9 aa, Homo Sapiens
TFSPGPGIK

SEQ ID NO: 870863 - protein, 9 aa, Homo Sapiens
PQNSVTVQV

SEQ ID NO: 870864 - protein, 9 aa, Homo Sapiens
CVRDCRKLE

SEQ ID NO: 870865 - protein, 9 aa, Homo Sapiens
LFCFLTDTS

SEQ ID NO: 870866 - protein, 9 aa, Homo Sapiens
LPLLVFADM

SEQ ID NO: 870867 - protein, 9 aa, Homo Sapiens
DGGNPPRLG

SEQ ID NO: 870868 - protein, 9 aa, Homo Sapiens
QNTLPAQPA

SEQ ID NO: 870869 - protein, 9 aa, Homo Sapiens
GYGFVEGLG

SEQ ID NO: 870870 - protein, 9 aa, Homo Sapiens
NWLQYVNWA

SEQ ID NO: 870871 - protein, 9 aa, Homo Sapiens
FLQEKTAAA

SEQ ID NO: 870872 - protein, 9 aa, Homo Sapiens
ETERIPSHK

SEQ ID NO: 870873 - protein, 9 aa, Homo Sapiens
KIMKYSAGI

SEQ ID NO: 870874 - protein, 9 aa, Homo Sapiens
LRRSHKLQG

SEQ ID NO: 870875 - protein, 9 aa, Homo Sapiens
VCLLTKQVV

SEQ ID NO: 870876 - protein, 9 aa, Homo Sapiens
KRTFSPGRP

SEQ ID NO: 870877 - protein, 9 aa, Homo Sapiens
MAFICAACG

SEQ ID NO: 870878 - protein, 9 aa, Homo Sapiens
EVSFSFDVE

SEQ ID NO: 870879 - protein, 9 aa, Homo Sapiens
FSIPEKNRH

SEQ ID NO: 870880 - protein, 9 aa, Homo Sapiens
DTEQDKDEE

SEQ ID NO: 870881 - protein, 9 aa, Homo Sapiens
SYFLNEILN

SEQ ID NO: 870882 - protein, 9 aa, Homo Sapiens
QDKDEEMDV

SEQ ID NO: 870883 - protein, 9 aa, Homo Sapiens
HCLYAYGNQ

SEQ ID NO: 870884 - protein, 9 aa, Homo Sapiens
DGDNKYYDA

SEQ ID NO: 870885 - protein, 9 aa, Homo Sapiens
QTCILLRGD

SEQ ID NO: 870886 - protein, 9 aa, Homo Sapiens
AQLKIYQGN

SEQ ID NO: 870887 - protein, 9 aa, Homo Sapiens
INKSSEMGI

SEQ ID NO: 870888 - protein, 9 aa, Homo Sapiens
RHIKHRTSD

SEQ ID NO: 870889 - protein, 9 aa, Homo Sapiens
QELFPASIL

SEQ ID NO: 870890 - protein, 9 aa, Homo Sapiens
KSFNHSSHL

SEQ ID NO: 870891 - protein, 9 aa, Homo Sapiens
LLHLIQHKR

SEQ ID NO: 870892 - protein, 9 aa, Homo Sapiens
EQRTQINVI

SEQ ID NO: 870893 - protein, 9 aa, Homo Sapiens
LTGSRRNQK

SEQ ID NO: 870894 - protein, 9 aa, Homo Sapiens
LWQCGQWVE

SEQ ID NO: 870895 - protein, 9 aa, Homo Sapiens
EVSTPSYPG

SEQ ID NO: 870896 - protein, 9 aa, Homo Sapiens
KKKKHQKSS

SEQ ID NO: 870897 - protein, 9 aa, Homo Sapiens
NLLDFWFAC

SEQ ID NO: 870898 - protein, 9 aa, Homo Sapiens
HGLNNALDN

SEQ ID NO: 870899 - protein, 9 aa, Homo Sapiens
RKSIPKSGG

SEQ ID NO: 870900 - protein, 9 aa, Homo Sapiens
TAIEGNFLG

SEQ ID NO: 870901 - protein, 9 aa, Homo Sapiens
LGLLWQEAV

SEQ ID NO: 870902 - protein, 9 aa, Homo Sapiens
KNGTAEEQP

SEQ ID NO: 870903 - protein, 9 aa, Homo Sapiens
KQKEISNTI

SEQ ID NO: 870904 - protein, 9 aa, Homo Sapiens
LVTHRQGLQ

SEQ ID NO: 870905 - protein, 9 aa, Homo Sapiens
SRDRLLNRC

SEQ ID NO: 870906 - protein, 9 aa, Homo Sapiens
ECCDPPLTH

SEQ ID NO: 870907 - protein, 9 aa, Homo Sapiens
ATWFFINLI

SEQ ID NO: 870908 - protein, 9 aa, Homo Sapiens
KKVNNIETQ

SEQ ID NO: 870909 - protein, 9 aa, Homo Sapiens
EPPAEPWGH

SEQ ID NO: 870910 - protein, 9 aa, Homo Sapiens
FLLVFWTPS

SEQ ID NO: 870911 - protein, 9 aa, Homo Sapiens
VLSLLRSEQ

SEQ ID NO: 870912 - protein, 9 aa, Homo Sapiens
AKVAELLLS

SEQ ID NO: 870913 - protein, 9 aa, Homo Sapiens
IILQRTARI

SEQ ID NO: 870914 - protein, 9 aa, Homo Sapiens
GDGHNLFTK

SEQ ID NO: 870915 - protein, 9 aa, Homo Sapiens
KTVVQVAEN

SEQ ID NO: 870916 - protein, 9 aa, Homo Sapiens
TAHPAPMVF

SEQ ID NO: 870917 - protein, 9 aa, Homo Sapiens
NTGKGLFID

SEQ ID NO: 870918 - protein, 9 aa, Homo Sapiens
TQMRFFLML

SEQ ID NO: 870919 - protein, 9 aa, Homo Sapiens
CHQCVKTIV

SEQ ID NO: 870920 - protein, 9 aa, Homo Sapiens
KKLNNLNTL

SEQ ID NO: 870921 - protein, 9 aa, Homo Sapiens
QLWDHSTLL

SEQ ID NO: 870922 - protein, 9 aa, Homo Sapiens
AVGTKSKPP

SEQ ID NO: 870923 - protein, 9 aa, Homo Sapiens
SSLQLNQSV

SEQ ID NO: 870924 - protein, 9 aa, Homo Sapiens
DYENEDNYS

SEQ ID NO: 870925 - protein, 9 aa, Homo Sapiens
EEADEAYKL

SEQ ID NO: 870926 - protein, 9 aa, Homo Sapiens
TTTFQVFVF

SEQ ID NO: 870927 - protein, 9 aa, Homo Sapiens
EVWSSNGTA

SEQ ID NO: 870928 - protein, 9 aa, Homo Sapiens
NTEGFVPPK

SEQ ID NO: 870929 - protein, 9 aa, Homo Sapiens
NLLQQYYLS

SEQ ID NO: 870930 - protein, 9 aa, Homo Sapiens
IIELCRERE

SEQ ID NO: 870931 - protein, 9 aa, Homo Sapiens
RIQSGEGRK

SEQ ID NO: 870932 - protein, 9 aa, Homo Sapiens
KVQFLNNLN

SEQ ID NO: 870933 - protein, 9 aa, Homo Sapiens
PSPRNSPQP

SEQ ID NO: 870934 - protein, 9 aa, Homo Sapiens
ICFMKGAYK

SEQ ID NO: 870935 - protein, 9 aa, Homo Sapiens
EALAFTVAM

SEQ ID NO: 870936 - protein, 9 aa, Homo Sapiens
YLRFGVQVL

SEQ ID NO: 870937 - protein, 9 aa, Homo Sapiens
INSASDSLY

SEQ ID NO: 870938 - protein, 9 aa, Homo Sapiens
TERQSKFTN

SEQ ID NO: 870939 - protein, 9 aa, Homo Sapiens
LFMTGFGLL

SEQ ID NO: 870940 - protein, 9 aa, Homo Sapiens
CRWILSVKN

SEQ ID NO: 870941 - protein, 9 aa, Homo Sapiens
EKHLSRGIS

SEQ ID NO: 870942 - protein, 9 aa, Homo Sapiens
YSIVMGSGQ

SEQ ID NO: 870943 - protein, 9 aa, Homo Sapiens
SELRQQLQI

SEQ ID NO: 870944 - protein, 9 aa, Homo Sapiens
LNPLKLARY

SEQ ID NO: 870945 - protein, 9 aa, Homo Sapiens
QHYMKESVQ

SEQ ID NO: 870946 - protein, 9 aa, Homo Sapiens
YCNKCFQFK

SEQ ID NO: 870947 - protein, 9 aa, Homo Sapiens
ISPLLDASL

SEQ ID NO: 870948 - protein, 9 aa, Homo Sapiens
PEMMNEVLD

SEQ ID NO: 870949 - protein, 9 aa, Homo Sapiens
TFPRLNCNK

SEQ ID NO: 870950 - protein, 9 aa, Homo Sapiens
LYKYLFFHH

SEQ ID NO: 870951 - protein, 9 aa, Homo Sapiens
EKPAIIASC

SEQ ID NO: 870952 - protein, 9 aa, Homo Sapiens
SKRHLRVDQ

SEQ ID NO: 870953 - protein, 9 aa, Homo Sapiens
EEIICRFET

SEQ ID NO: 870954 - protein, 9 aa, Homo Sapiens
RIHKQDELI

SEQ ID NO: 870955 - protein, 9 aa, Homo Sapiens
WAPEDAWMD

SEQ ID NO: 870956 - protein, 9 aa, Homo Sapiens
KRMSFCLAN

SEQ ID NO: 870957 - protein, 9 aa, Homo Sapiens
QIAHDIFDH

SEQ ID NO: 870958 - protein, 9 aa, Homo Sapiens
LELCGFKNK

SEQ ID NO: 870959 - protein, 9 aa, Homo Sapiens
EPKKNAICE

SEQ ID NO: 870960 - protein, 9 aa, Homo Sapiens
ETSFEHHVN

SEQ ID NO: 870961 - protein, 9 aa, Homo Sapiens
QGKRRKKNK

SEQ ID NO: 870962 - protein, 9 aa, Homo Sapiens
VQHKIDLPP

SEQ ID NO: 870963 - protein, 9 aa, Homo Sapiens
TQTNSSITL

SEQ ID NO: 870964 - protein, 9 aa, Homo Sapiens
IQISLPEDH

SEQ ID NO: 870965 - protein, 9 aa, Homo Sapiens
SRLISFQRH

SEQ ID NO: 870966 - protein, 9 aa, Homo Sapiens
EKLIKCDKI

SEQ ID NO: 870967 - protein, 9 aa, Homo Sapiens
KDSPGVAPE

SEQ ID NO: 870968 - protein, 9 aa, Homo Sapiens
ICQAFYFAL

SEQ ID NO: 870969 - protein, 9 aa, Homo Sapiens
VLHMMVGVN

SEQ ID NO: 870970 - protein, 9 aa, Homo Sapiens
LRFKVSVSS

SEQ ID NO: 870971 - protein, 9 aa, Homo Sapiens
KHSLERYLH

SEQ ID NO: 870972 - protein, 9 aa, Homo Sapiens
SGIIGANQV

SEQ ID NO: 870973 - protein, 9 aa, Homo Sapiens
STLNSCINP

SEQ ID NO: 870974 - protein, 9 aa, Homo Sapiens
ICTLKNAQM

SEQ ID NO: 870975 - protein, 9 aa, Homo Sapiens
RKYYILTDS

SEQ ID NO: 870976 - protein, 9 aa, Homo Sapiens
LAAPIIILQ

SEQ ID NO: 870977 - protein, 9 aa, Homo Sapiens
QTTCVVGRP

SEQ ID NO: 870978 - protein, 9 aa, Homo Sapiens
PNNLEAFRI

SEQ ID NO: 870979 - protein, 9 aa, Homo Sapiens
EMARLEGEL

SEQ ID NO: 870980 - protein, 9 aa, Homo Sapiens
TLSGLQEGT

SEQ ID NO: 870981 - protein, 9 aa, Homo Sapiens
LGSTQFFKV

SEQ ID NO: 870982 - protein, 9 aa, Homo Sapiens
EQLFSVGQA

SEQ ID NO: 870983 - protein, 9 aa, Homo Sapiens
PKPANKTNP

SEQ ID NO: 870984 - protein, 9 aa, Homo Sapiens
DVLKYFSLA

SEQ ID NO: 870985 - protein, 9 aa, Homo Sapiens
KEKCEGFKL

SEQ ID NO: 870986 - protein, 9 aa, Homo Sapiens
LFKFMHETH

SEQ ID NO: 870987 - protein, 9 aa, Homo Sapiens
FNSFDRSVV

SEQ ID NO: 870988 - protein, 9 aa, Homo Sapiens
KDSEDIDIM

SEQ ID NO: 870989 - protein, 9 aa, Homo Sapiens
VFNVLKLIG

SEQ ID NO: 870990 - protein, 9 aa, Homo Sapiens
ILSDGVTKS

SEQ ID NO: 870991 - protein, 9 aa, Homo Sapiens
LAHYNTTAD

SEQ ID NO: 870992 - protein, 9 aa, Homo Sapiens
DNRFGAYVA

SEQ ID NO: 870993 - protein, 9 aa, Homo Sapiens
TVHTGERSY

SEQ ID NO: 870994 - protein, 9 aa, Homo Sapiens
CNPQQHRNA

SEQ ID NO: 870995 - protein, 9 aa, Homo Sapiens
ISQRHREEL

SEQ ID NO: 870996 - protein, 9 aa, Homo Sapiens
LGMEPKNFI

SEQ ID NO: 870997 - protein, 9 aa, Homo Sapiens
AQGSDHENS

SEQ ID NO: 870998 - protein, 9 aa, Homo Sapiens
TKVSLSTFE

SEQ ID NO: 870999 - protein, 9 aa, Homo Sapiens
VITLDSILL

SEQ ID NO: 871000 - protein, 9 aa, Homo Sapiens
LSLLQDNGE

SEQ ID NO: 871001 - protein, 9 aa, Homo Sapiens
EETYSRLMG

SEQ ID NO: 871002 - protein, 9 aa, Homo Sapiens
IVVGMPNGI

SEQ ID NO: 871003 - protein, 9 aa, Homo Sapiens
KKCILHCLG

SEQ ID NO: 871004 - protein, 9 aa, Homo Sapiens
QNISKLHLE

SEQ ID NO: 871005 - protein, 9 aa, Homo Sapiens
NLFQLHERT

SEQ ID NO: 871006 - protein, 9 aa, Homo Sapiens
ELDNNLKPI

SEQ ID NO: 871007 - protein, 9 aa, Homo Sapiens
VDQITWIGG

SEQ ID NO: 871008 - protein, 9 aa, Homo Sapiens
NLLHKTDSA

SEQ ID NO: 871009 - protein, 9 aa, Homo Sapiens
KSRRCRTAF

SEQ ID NO: 871010 - protein, 9 aa, Homo Sapiens
GDKQFLLFT

SEQ ID NO: 871011 - protein, 9 aa, Homo Sapiens
WIKSGNENG

SEQ ID NO: 871012 - protein, 9 aa, Homo Sapiens
TKLMSDGSS

SEQ ID NO: 871013 - protein, 9 aa, Homo Sapiens
NFSFSVNFS

SEQ ID NO: 871014 - protein, 9 aa, Homo Sapiens
EDQDKCLMG

SEQ ID NO: 871015 - protein, 9 aa, Homo Sapiens
SNTDSGCCL

SEQ ID NO: 871016 - protein, 9 aa, Homo Sapiens
GNYRQIYPP

SEQ ID NO: 871017 - protein, 9 aa, Homo Sapiens
NKPEAEMLP

SEQ ID NO: 871018 - protein, 9 aa, Homo Sapiens
NKILNVTTD

SEQ ID NO: 871019 - protein, 9 aa, Homo Sapiens
HNGSTCRDL

SEQ ID NO: 871020 - protein, 9 aa, Homo Sapiens
LGKNEGKEN

SEQ ID NO: 871021 - protein, 9 aa, Homo Sapiens
VDFVNAANE

SEQ ID NO: 871022 - protein, 9 aa, Homo Sapiens
GRIPHPHLG

SEQ ID NO: 871023 - protein, 9 aa, Homo Sapiens
YSQIQGGWT

SEQ ID NO: 871024 - protein, 9 aa, Homo Sapiens
LCKFFHPFN

SEQ ID NO: 871025 - protein, 9 aa, Homo Sapiens
MRGFLVRKN

SEQ ID NO: 871026 - protein, 9 aa, Homo Sapiens
FGLCHQMSI

SEQ ID NO: 871027 - protein, 9 aa, Homo Sapiens
SQRFEEYLN

SEQ ID NO: 871028 - protein, 9 aa, Homo Sapiens
LLRMYYFDQ

SEQ ID NO: 871029 - protein, 9 aa, Homo Sapiens
YTQICNRAL

SEQ ID NO: 871030 - protein, 9 aa, Homo Sapiens
SLGSTQFFK

SEQ ID NO: 871031 - protein, 9 aa, Homo Sapiens
CQLIMATPE

SEQ ID NO: 871032 - protein, 9 aa, Homo Sapiens
PVTTIPIVL

SEQ ID NO: 871033 - protein, 9 aa, Homo Sapiens
TVANVTGNQ

SEQ ID NO: 871034 - protein, 9 aa, Homo Sapiens
HAASLASVE

SEQ ID NO: 871035 - protein, 9 aa, Homo Sapiens
EQARPEYEV

SEQ ID NO: 871036 - protein, 9 aa, Homo Sapiens
KGGYIHLIQ

SEQ ID NO: 871037 - protein, 9 aa, Homo Sapiens
FKNIPNSLA

SEQ ID NO: 871038 - protein, 9 aa, Homo Sapiens
DNNPCIKHY

SEQ ID NO: 871039 - protein, 9 aa, Homo Sapiens
ELQEVRCGI

SEQ ID NO: 871040 - protein, 9 aa, Homo Sapiens
VFDKNRLTR

SEQ ID NO: 871041 - protein, 9 aa, Homo Sapiens
DVLKKYRGK

SEQ ID NO: 871042 - protein, 9 aa, Homo Sapiens
RGSDKLLSG

SEQ ID NO: 871043 - protein, 9 aa, Homo Sapiens
FVRPFPLNQ

SEQ ID NO: 871044 - protein, 9 aa, Homo Sapiens
VSLKASNDG

SEQ ID NO: 871045 - protein, 9 aa, Homo Sapiens
METSIKPKA

SEQ ID NO: 871046 - protein, 9 aa, Homo Sapiens
PKKSINKTP

SEQ ID NO: 871047 - protein, 9 aa, Homo Sapiens
LALPRRPHN

SEQ ID NO: 871048 - protein, 9 aa, Homo Sapiens
QGVPENCNK

SEQ ID NO: 871049 - protein, 9 aa, Homo Sapiens
KISVAIQNF

SEQ ID NO: 871050 - protein, 9 aa, Homo Sapiens
LNPIIYVFM

SEQ ID NO: 871051 - protein, 9 aa, Homo Sapiens
TLSVAVVVG

SEQ ID NO: 871052 - protein, 9 aa, Homo Sapiens
YFQGFCVDL

SEQ ID NO: 871053 - protein, 9 aa, Homo Sapiens
GLSPLIDRY

SEQ ID NO: 871054 - protein, 9 aa, Homo Sapiens
VLWNFLLAV

SEQ ID NO: 871055 - protein, 9 aa, Homo Sapiens
DIIKRNPDL

SEQ ID NO: 871056 - protein, 9 aa, Homo Sapiens
SQNQLSALP

SEQ ID NO: 871057 - protein, 9 aa, Homo Sapiens
GGGKNYGGG

SEQ ID NO: 871058 - protein, 9 aa, Homo Sapiens
KTASFLSLE

SEQ ID NO: 871059 - protein, 9 aa, Homo Sapiens
ELNDIQFEF

SEQ ID NO: 871060 - protein, 9 aa, Homo Sapiens
DVGENFLHT

SEQ ID NO: 871061 - protein, 9 aa, Homo Sapiens
LEQRSFIGN

SEQ ID NO: 871062 - protein, 9 aa, Homo Sapiens
QAYIQMKSL

SEQ ID NO: 871063 - protein, 9 aa, Homo Sapiens
SLKLQSQKD

SEQ ID NO: 871064 - protein, 9 aa, Homo Sapiens
YVKKKKRRR

SEQ ID NO: 871065 - protein, 9 aa, Homo Sapiens
FLIKPFVPH

SEQ ID NO: 871066 - protein, 9 aa, Homo Sapiens
NKMPITANL

SEQ ID NO: 871067 - protein, 9 aa, Homo Sapiens
LGNIANTSV

SEQ ID NO: 871068 - protein, 9 aa, Homo Sapiens
KPDNFITQI

SEQ ID NO: 871069 - protein, 9 aa, Homo Sapiens
RGDTGVCRR

SEQ ID NO: 871070 - protein, 9 aa, Homo Sapiens
QENLKLVRL

SEQ ID NO: 871071 - protein, 9 aa, Homo Sapiens
ICCLLCEAY

SEQ ID NO: 871072 - protein, 9 aa, Homo Sapiens
FDVDIENVV

SEQ ID NO: 871073 - protein, 9 aa, Homo Sapiens
PDVTETNNS

SEQ ID NO: 871074 - protein, 9 aa, Homo Sapiens
GPSLLTLRS

SEQ ID NO: 871075 - protein, 9 aa, Homo Sapiens
STRVRCINL

SEQ ID NO: 871076 - protein, 9 aa, Homo Sapiens
WMRGFLVRK

SEQ ID NO: 871077 - protein, 9 aa, Homo Sapiens
QIIYNYLKE

SEQ ID NO: 871078 - protein, 9 aa, Homo Sapiens
SERNKWIHC

SEQ ID NO: 871079 - protein, 9 aa, Homo Sapiens
DPSYKENAM

SEQ ID NO: 871080 - protein, 9 aa, Homo Sapiens
TWSNPLEKH

SEQ ID NO: 871081 - protein, 9 aa, Homo Sapiens
QRGSESKSG

SEQ ID NO: 871082 - protein, 9 aa, Homo Sapiens
CLFVLDLND

SEQ ID NO: 871083 - protein, 9 aa, Homo Sapiens
RAALVGRCL

SEQ ID NO: 871084 - protein, 9 aa, Homo Sapiens
QVQMEYKKW

SEQ ID NO: 871085 - protein, 9 aa, Homo Sapiens
LEDIQAFEN

SEQ ID NO: 871086 - protein, 9 aa, Homo Sapiens
KAPNGTVIP

SEQ ID NO: 871087 - protein, 9 aa, Homo Sapiens
ENKSVQKKK

SEQ ID NO: 871088 - protein, 9 aa, Homo Sapiens
FRPQTPPEA

SEQ ID NO: 871089 - protein, 9 aa, Homo Sapiens
KLFKFMHET

SEQ ID NO: 871090 - protein, 9 aa, Homo Sapiens
FLHRVGHYL

SEQ ID NO: 871091 - protein, 9 aa, Homo Sapiens
QATVTNILL

SEQ ID NO: 871092 - protein, 9 aa, Homo Sapiens
ALGCRICPG

SEQ ID NO: 871093 - protein, 9 aa, Homo Sapiens
NKNILQCPK

SEQ ID NO: 871094 - protein, 9 aa, Homo Sapiens
NKDMKRGLH

SEQ ID NO: 871095 - protein, 9 aa, Homo Sapiens
ASDSRPTKQ

SEQ ID NO: 871096 - protein, 9 aa, Homo Sapiens
APDAAAKDS

SEQ ID NO: 871097 - protein, 9 aa, Homo Sapiens
TLAINVLDS

SEQ ID NO: 871098 - protein, 9 aa, Homo Sapiens
NPSSHELAL

SEQ ID NO: 871099 - protein, 9 aa, Homo Sapiens
ACRSGFYKA

SEQ ID NO: 871100 - protein, 9 aa, Homo Sapiens
TVQQGGNML

SEQ ID NO: 871101 - protein, 9 aa, Homo Sapiens
KHISEQFTA

SEQ ID NO: 871102 - protein, 9 aa, Homo Sapiens
QRRPCNVTF

SEQ ID NO: 871103 - protein, 9 aa, Homo Sapiens
QKTLSPQTL

SEQ ID NO: 871104 - protein, 9 aa, Homo Sapiens
GGLAGDFYF

SEQ ID NO: 871105 - protein, 9 aa, Homo Sapiens
FQNIPGSKL

SEQ ID NO: 871106 - protein, 9 aa, Homo Sapiens
DNASLESRI

SEQ ID NO: 871107 - protein, 9 aa, Homo Sapiens
TPSSIRKPP

SEQ ID NO: 871108 - protein, 9 aa, Homo Sapiens
KRFLGPEIF

SEQ ID NO: 871109 - protein, 9 aa, Homo Sapiens
QIGASTLLS

SEQ ID NO: 871110 - protein, 9 aa, Homo Sapiens
RPGVTGKNS

SEQ ID NO: 871111 - protein, 9 aa, Homo Sapiens
KQKFIVTQM

SEQ ID NO: 871112 - protein, 9 aa, Homo Sapiens
ATSFNHEKS

SEQ ID NO: 871113 - protein, 9 aa, Homo Sapiens
SVPDDVYAK

SEQ ID NO: 871114 - protein, 9 aa, Homo Sapiens
VTHFIHNSA

SEQ ID NO: 871115 - protein, 9 aa, Homo Sapiens
QTLITLLAH

SEQ ID NO: 871116 - protein, 9 aa, Homo Sapiens
VARNYLEEA

SEQ ID NO: 871117 - protein, 9 aa, Homo Sapiens
GVQDPQHEI

SEQ ID NO: 871118 - protein, 9 aa, Homo Sapiens
SKIQRLSEA

SEQ ID NO: 871119 - protein, 9 aa, Homo Sapiens
IASGETHSR

SEQ ID NO: 871120 - protein, 9 aa, Homo Sapiens
QGNEDDINA

SEQ ID NO: 871121 - protein, 9 aa, Homo Sapiens
RNKYLELKA

SEQ ID NO: 871122 - protein, 9 aa, Homo Sapiens
AVGAAHTTP

SEQ ID NO: 871123 - protein, 9 aa, Homo Sapiens
DDGWNIKDV

SEQ ID NO: 871124 - protein, 9 aa, Homo Sapiens
NHCLVESTS

SEQ ID NO: 871125 - protein, 9 aa, Homo Sapiens
AVCLLTKQV

SEQ ID NO: 871126 - protein, 9 aa, Homo Sapiens
KPTLENVYT

SEQ ID NO: 871127 - protein, 9 aa, Homo Sapiens
RMFPSITPF

SEQ ID NO: 871128 - protein, 9 aa, Homo Sapiens
SNNSMDNYL

SEQ ID NO: 871129 - protein, 9 aa, Homo Sapiens
KISESLSVT

SEQ ID NO: 871130 - protein, 9 aa, Homo Sapiens
KTYSNIKDY

SEQ ID NO: 871131 - protein, 9 aa, Homo Sapiens
SLAPFNQLL

SEQ ID NO: 871132 - protein, 9 aa, Homo Sapiens
DQEEDNNIV

SEQ ID NO: 871133 - protein, 9 aa, Homo Sapiens
YTYQKKFTI

SEQ ID NO: 871134 - protein, 9 aa, Homo Sapiens
VSVAGELKL

SEQ ID NO: 871135 - protein, 9 aa, Homo Sapiens
LNRAIQRLQ

SEQ ID NO: 871136 - protein, 9 aa, Homo Sapiens
QLYQGINQL

SEQ ID NO: 871137 - protein, 9 aa, Homo Sapiens
SYMWIINNF

SEQ ID NO: 871138 - protein, 9 aa, Homo Sapiens
RRLLKQHVA

SEQ ID NO: 871139 - protein, 9 aa, Homo Sapiens
QLHKFLCLR

SEQ ID NO: 871140 - protein, 9 aa, Homo Sapiens
IPGAHPKGY

SEQ ID NO: 871141 - protein, 9 aa, Homo Sapiens
ATTASHFYR

SEQ ID NO: 871142 - protein, 9 aa, Homo Sapiens
RRPCNVTFR

SEQ ID NO: 871143 - protein, 9 aa, Homo Sapiens
LEELQSKGE

SEQ ID NO: 871144 - protein, 9 aa, Homo Sapiens
PENIISQEE

SEQ ID NO: 871145 - protein, 9 aa, Homo Sapiens
AVFQTYGTW

SEQ ID NO: 871146 - protein, 9 aa, Homo Sapiens
VPDKEGWVK

SEQ ID NO: 871147 - protein, 9 aa, Homo Sapiens
QQKEKRKRM

SEQ ID NO: 871148 - protein, 9 aa, Homo Sapiens
RLTEGCFFR

SEQ ID NO: 871149 - protein, 9 aa, Homo Sapiens
FADMQEGGT

SEQ ID NO: 871150 - protein, 9 aa, Homo Sapiens
PSTRVRCIN

SEQ ID NO: 871151 - protein, 9 aa, Homo Sapiens
SKTHPKQEK

SEQ ID NO: 871152 - protein, 9 aa, Homo Sapiens
LVTVKNLLK

SEQ ID NO: 871153 - protein, 9 aa, Homo Sapiens
DTGHYGFLL

SEQ ID NO: 871154 - protein, 9 aa, Homo Sapiens
QHEIIITVS

SEQ ID NO: 871155 - protein, 9 aa, Homo Sapiens
QESIPDIQV

SEQ ID NO: 871156 - protein, 9 aa, Homo Sapiens
TRGYGRDMG

SEQ ID NO: 871157 - protein, 9 aa, Homo Sapiens
HYFNDTLVV

SEQ ID NO: 871158 - protein, 9 aa, Homo Sapiens
VVPSCIPLV

SEQ ID NO: 871159 - protein, 9 aa, Homo Sapiens
VPGPVQFQY

SEQ ID NO: 871160 - protein, 9 aa, Homo Sapiens
IPRRHTRST

SEQ ID NO: 871161 - protein, 9 aa, Homo Sapiens
YINCDVMIH

SEQ ID NO: 871162 - protein, 9 aa, Homo Sapiens
PSICAITLG

SEQ ID NO: 871163 - protein, 9 aa, Homo Sapiens
PWALITIAV

SEQ ID NO: 871164 - protein, 9 aa, Homo Sapiens
CHNPKLQLK

SEQ ID NO: 871165 - protein, 9 aa, Homo Sapiens
AFAFLFSFQ

SEQ ID NO: 871166 - protein, 9 aa, Homo Sapiens
SPSPRTPML

SEQ ID NO: 871167 - protein, 9 aa, Homo Sapiens
ENEFFPTNS

SEQ ID NO: 871168 - protein, 9 aa, Homo Sapiens
PDLSILWIN

SEQ ID NO: 871169 - protein, 9 aa, Homo Sapiens
KLETHKCAA

SEQ ID NO: 871170 - protein, 9 aa, Homo Sapiens
VIVYQITTA

SEQ ID NO: 871171 - protein, 9 aa, Homo Sapiens
TIINKSSEM

SEQ ID NO: 871172 - protein, 9 aa, Homo Sapiens
RDQRVREQQ

SEQ ID NO: 871173 - protein, 9 aa, Homo Sapiens
RFKPESSYP

SEQ ID NO: 871174 - protein, 9 aa, Homo Sapiens
KKISESLSV

SEQ ID NO: 871175 - protein, 9 aa, Homo Sapiens
GYFCIPLCT

SEQ ID NO: 871176 - protein, 9 aa, Homo Sapiens
TPYEAFNPA

SEQ ID NO: 871177 - protein, 9 aa, Homo Sapiens
DSFIAEHKL

SEQ ID NO: 871178 - protein, 9 aa, Homo Sapiens
VFENEDNTQ

SEQ ID NO: 871179 - protein, 9 aa, Homo Sapiens
LFNLPHNRP

SEQ ID NO: 871180 - protein, 9 aa, Homo Sapiens
QSERSGGNK

SEQ ID NO: 871181 - protein, 9 aa, Homo Sapiens
QNAREMTLQ

SEQ ID NO: 871182 - protein, 9 aa, Homo Sapiens
MKKRKMQRV

SEQ ID NO: 871183 - protein, 9 aa, Homo Sapiens
STLAAKTLE

SEQ ID NO: 871184 - protein, 9 aa, Homo Sapiens
TLMKHKIIN

SEQ ID NO: 871185 - protein, 9 aa, Homo Sapiens
QNCIHLEIK

SEQ ID NO: 871186 - protein, 9 aa, Homo Sapiens
RCVDGWCEC

SEQ ID NO: 871187 - protein, 9 aa, Homo Sapiens
TRHQIIHIG

SEQ ID NO: 871188 - protein, 9 aa, Homo Sapiens
KYPTKDMKA

SEQ ID NO: 871189 - protein, 9 aa, Homo Sapiens
DLQTTALDL

SEQ ID NO: 871190 - protein, 9 aa, Homo Sapiens
EGERRFITV

SEQ ID NO: 871191 - protein, 9 aa, Homo Sapiens
ERNCSGNQR

SEQ ID NO: 871192 - protein, 9 aa, Homo Sapiens
LSGHLPKYK

SEQ ID NO: 871193 - protein, 9 aa, Homo Sapiens
FQNLHQLGS

SEQ ID NO: 871194 - protein, 9 aa, Homo Sapiens
MRTKGFWRP

SEQ ID NO: 871195 - protein, 9 aa, Homo Sapiens
SSLDASTQT

SEQ ID NO: 871196 - protein, 9 aa, Homo Sapiens
SAPGDLAPQ

SEQ ID NO: 871197 - protein, 9 aa, Homo Sapiens
DYTSSELQR

SEQ ID NO: 871198 - protein, 9 aa, Homo Sapiens
QKLKNSLKE

SEQ ID NO: 871199 - protein, 9 aa, Homo Sapiens
WSQTPELKQ

SEQ ID NO: 871200 - protein, 9 aa, Homo Sapiens
ALFTSKLLR

SEQ ID NO: 871201 - protein, 9 aa, Homo Sapiens
GSLNTYRLC

SEQ ID NO: 871202 - protein, 9 aa, Homo Sapiens
LLVAVYKTV

SEQ ID NO: 871203 - protein, 9 aa, Homo Sapiens
NPLWTSLAE

SEQ ID NO: 871204 - protein, 9 aa, Homo Sapiens
AYKCTFIVL

SEQ ID NO: 871205 - protein, 9 aa, Homo Sapiens
NEKRMKLLQ

SEQ ID NO: 871206 - protein, 9 aa, Homo Sapiens
AYPNHPDVL

SEQ ID NO: 871207 - protein, 9 aa, Homo Sapiens
NHIKQFLDT

SEQ ID NO: 871208 - protein, 9 aa, Homo Sapiens
GCGKVYGTS

SEQ ID NO: 871209 - protein, 9 aa, Homo Sapiens
CPCCAWQRC

SEQ ID NO: 871210 - protein, 9 aa, Homo Sapiens
RYDRRHEPY

SEQ ID NO: 871211 - protein, 9 aa, Homo Sapiens
SSMPLQRCR

SEQ ID NO: 871212 - protein, 9 aa, Homo Sapiens
DIIRGIDII

SEQ ID NO: 871213 - protein, 9 aa, Homo Sapiens
QEIRLCQLI

SEQ ID NO: 871214 - protein, 9 aa, Homo Sapiens
ASSRSDMEK

SEQ ID NO: 871215 - protein, 9 aa, Homo Sapiens
NTISPTLGF

SEQ ID NO: 871216 - protein, 9 aa, Homo Sapiens
KKPQNTSRL

SEQ ID NO: 871217 - protein, 9 aa, Homo Sapiens
PRSDMESLS

SEQ ID NO: 871218 - protein, 9 aa, Homo Sapiens
DLSPAEIRR

SEQ ID NO: 871219 - protein, 9 aa, Homo Sapiens
DQKQEVWEA

SEQ ID NO: 871220 - protein, 9 aa, Homo Sapiens
LAHVAEQNS

SEQ ID NO: 871221 - protein, 9 aa, Homo Sapiens
EWESIFYFH

SEQ ID NO: 871222 - protein, 9 aa, Homo Sapiens
LPELSCGSP

SEQ ID NO: 871223 - protein, 9 aa, Homo Sapiens
SVADGIKYP

SEQ ID NO: 871224 - protein, 9 aa, Homo Sapiens
PIVRVLARY

SEQ ID NO: 871225 - protein, 9 aa, Homo Sapiens
CNGRGTCNY

SEQ ID NO: 871226 - protein, 9 aa, Homo Sapiens
HYFRNQRPG

SEQ ID NO: 871227 - protein, 9 aa, Homo Sapiens
AKTYFFSSG

SEQ ID NO: 871228 - protein, 9 aa, Homo Sapiens
SAKVAELLL

SEQ ID NO: 871229 - protein, 9 aa, Homo Sapiens
VSLTGASTI

SEQ ID NO: 871230 - protein, 9 aa, Homo Sapiens
MWRDQVTDT

SEQ ID NO: 871231 - protein, 9 aa, Homo Sapiens
QITASPDSK

SEQ ID NO: 871232 - protein, 9 aa, Homo Sapiens
NKRKMEFNL

SEQ ID NO: 871233 - protein, 9 aa, Homo Sapiens
KNKLVKAFK

SEQ ID NO: 871234 - protein, 9 aa, Homo Sapiens
ELAEELCRL

SEQ ID NO: 871235 - protein, 9 aa, Homo Sapiens
YSQSSRKSD

SEQ ID NO: 871236 - protein, 9 aa, Homo Sapiens
TKEKISFVS

SEQ ID NO: 871237 - protein, 9 aa, Homo Sapiens
TTIHGSKKT

SEQ ID NO: 871238 - protein, 9 aa, Homo Sapiens
LAPSTLCSL

SEQ ID NO: 871239 - protein, 9 aa, Homo Sapiens
ETLNLDDLD

SEQ ID NO: 871240 - protein, 9 aa, Homo Sapiens
EGTDWLGCT

SEQ ID NO: 871241 - protein, 9 aa, Homo Sapiens
CPAEFHWKL

SEQ ID NO: 871242 - protein, 9 aa, Homo Sapiens
HLRLASLWI

SEQ ID NO: 871243 - protein, 9 aa, Homo Sapiens
VFGPTLLQA

SEQ ID NO: 871244 - protein, 9 aa, Homo Sapiens
TKTQCSKED

SEQ ID NO: 871245 - protein, 9 aa, Homo Sapiens
ADRILASYA

SEQ ID NO: 871246 - protein, 9 aa, Homo Sapiens
KSHKPIQSG

SEQ ID NO: 871247 - protein, 9 aa, Homo Sapiens
LCKRFWDCG

SEQ ID NO: 871248 - protein, 9 aa, Homo Sapiens
QAHFPLSLG

SEQ ID NO: 871249 - protein, 9 aa, Homo Sapiens
LCMYQNATG

SEQ ID NO: 871250 - protein, 9 aa, Homo Sapiens
LKVISSPHL

SEQ ID NO: 871251 - protein, 9 aa, Homo Sapiens
EMLPVVKGT

SEQ ID NO: 871252 - protein, 9 aa, Homo Sapiens
CVWEGEGSF

SEQ ID NO: 871253 - protein, 9 aa, Homo Sapiens
VKSASRQNT

SEQ ID NO: 871254 - protein, 9 aa, Homo Sapiens
IGNANISLS

SEQ ID NO: 871255 - protein, 9 aa, Homo Sapiens
CFQPVWVTG

SEQ ID NO: 871256 - protein, 9 aa, Homo Sapiens
IILLMFTSV

SEQ ID NO: 871257 - protein, 9 aa, Homo Sapiens
GIFRFRLWQ

SEQ ID NO: 871258 - protein, 9 aa, Homo Sapiens
LNKKAICKQ

SEQ ID NO: 871259 - protein, 9 aa, Homo Sapiens
GTGTQQQLF

SEQ ID NO: 871260 - protein, 9 aa, Homo Sapiens
SAGKFEAVL

SEQ ID NO: 871261 - protein, 9 aa, Homo Sapiens
EASDYKYFY

SEQ ID NO: 871262 - protein, 9 aa, Homo Sapiens
LDFGDKLYS

SEQ ID NO: 871263 - protein, 9 aa, Homo Sapiens
DKSPAPEDK

SEQ ID NO: 871264 - protein, 9 aa, Homo Sapiens
RRGPQKQLA

SEQ ID NO: 871265 - protein, 9 aa, Homo Sapiens
ALEELQSKG

SEQ ID NO: 871266 - protein, 9 aa, Homo Sapiens
CRVNDEEGI

SEQ ID NO: 871267 - protein, 9 aa, Homo Sapiens
HMPKGMWIC

SEQ ID NO: 871268 - protein, 9 aa, Homo Sapiens
LTVENYHTN

SEQ ID NO: 871269 - protein, 9 aa, Homo Sapiens
TNTFFGDDF

SEQ ID NO: 871270 - protein, 9 aa, Homo Sapiens
MYQVWQRTL

SEQ ID NO: 871271 - protein, 9 aa, Homo Sapiens
NNPPGSCGP

SEQ ID NO: 871272 - protein, 9 aa, Homo Sapiens
GSQPGIFSP

SEQ ID NO: 871273 - protein, 9 aa, Homo Sapiens
CRYFHKVCD

SEQ ID NO: 871274 - protein, 9 aa, Homo Sapiens
SSFNLDPDV

SEQ ID NO: 871275 - protein, 9 aa, Homo Sapiens
RAHQLVHKG

SEQ ID NO: 871276 - protein, 9 aa, Homo Sapiens
IDKFCDPQM

SEQ ID NO: 871277 - protein, 9 aa, Homo Sapiens
VKDLKKRRW

SEQ ID NO: 871278 - protein, 9 aa, Homo Sapiens
VAFLGSIIL

SEQ ID NO: 871279 - protein, 9 aa, Homo Sapiens
GHAVQDLDS

SEQ ID NO: 871280 - protein, 9 aa, Homo Sapiens
VQLLSEKIA

SEQ ID NO: 871281 - protein, 9 aa, Homo Sapiens
SSSYLAVQS

SEQ ID NO: 871282 - protein, 9 aa, Homo Sapiens
QNNTPECLA

SEQ ID NO: 871283 - protein, 9 aa, Homo Sapiens
SGLSCHRRV

SEQ ID NO: 871284 - protein, 9 aa, Homo Sapiens
ILGFQTDLL

SEQ ID NO: 871285 - protein, 9 aa, Homo Sapiens
YKICKLDNG

SEQ ID NO: 871286 - protein, 9 aa, Homo Sapiens
YNKFPEPIK

SEQ ID NO: 871287 - protein, 9 aa, Homo Sapiens
TEQDKDEEM

SEQ ID NO: 871288 - protein, 9 aa, Homo Sapiens
SPVADIAVK

SEQ ID NO: 871289 - protein, 9 aa, Homo Sapiens
IEKLESKIQ

SEQ ID NO: 871290 - protein, 9 aa, Homo Sapiens
LMGTYVTSV

SEQ ID NO: 871291 - protein, 9 aa, Homo Sapiens
DTTEPRVLY

SEQ ID NO: 871292 - protein, 9 aa, Homo Sapiens
QLQMASPEE

SEQ ID NO: 871293 - protein, 9 aa, Homo Sapiens
YYRRFLKDN

SEQ ID NO: 871294 - protein, 9 aa, Homo Sapiens
NENEQIHAQ

SEQ ID NO: 871295 - protein, 9 aa, Homo Sapiens
KGKNCELFT

SEQ ID NO: 871296 - protein, 9 aa, Homo Sapiens
LVCRAGAKS

SEQ ID NO: 871297 - protein, 9 aa, Homo Sapiens
AGFQSNPVR

SEQ ID NO: 871298 - protein, 9 aa, Homo Sapiens
IAGTSDKRE

SEQ ID NO: 871299 - protein, 9 aa, Homo Sapiens
IPDIQVHEW

SEQ ID NO: 871300 - protein, 9 aa, Homo Sapiens
TVAMHKVFL

SEQ ID NO: 871301 - protein, 9 aa, Homo Sapiens
MRIGNKEVE

SEQ ID NO: 871302 - protein, 9 aa, Homo Sapiens
VSGIKWDYI

SEQ ID NO: 871303 - protein, 9 aa, Homo Sapiens
LAHHQQIHT

SEQ ID NO: 871304 - protein, 9 aa, Homo Sapiens
TMDLLSGKY

SEQ ID NO: 871305 - protein, 9 aa, Homo Sapiens
PEALACKFI

SEQ ID NO: 871306 - protein, 9 aa, Homo Sapiens
DEEIVLRII

SEQ ID NO: 871307 - protein, 9 aa, Homo Sapiens
EEKILNRKI

SEQ ID NO: 871308 - protein, 9 aa, Homo Sapiens
LSEELDSEV

SEQ ID NO: 871309 - protein, 9 aa, Homo Sapiens
SERDCLKAE

SEQ ID NO: 871310 - protein, 9 aa, Homo Sapiens
YTHEGVRYF

SEQ ID NO: 871311 - protein, 9 aa, Homo Sapiens
ISYIIPIDD

SEQ ID NO: 871312 - protein, 9 aa, Homo Sapiens
AYTLPLERT

SEQ ID NO: 871313 - protein, 9 aa, Homo Sapiens
KDIFGAVFP

SEQ ID NO: 871314 - protein, 9 aa, Homo Sapiens
TALCSLPQA

SEQ ID NO: 871315 - protein, 9 aa, Homo Sapiens
CPFREPQNI

SEQ ID NO: 871316 - protein, 9 aa, Homo Sapiens
LKHKVIEKV

SEQ ID NO: 871317 - protein, 9 aa, Homo Sapiens
NNGTVWSEI

SEQ ID NO: 871318 - protein, 9 aa, Homo Sapiens
SNAESLELE

SEQ ID NO: 871319 - protein, 9 aa, Homo Sapiens
FPVQIGDMR

SEQ ID NO: 871320 - protein, 9 aa, Homo Sapiens
QDYDIQTGN

SEQ ID NO: 871321 - protein, 9 aa, Homo Sapiens
ICSVTCAKN

SEQ ID NO: 871322 - protein, 9 aa, Homo Sapiens
LGLNAREES

SEQ ID NO: 871323 - protein, 9 aa, Homo Sapiens
VADDDSGMY

SEQ ID NO: 871324 - protein, 9 aa, Homo Sapiens
ASIAGSLII

SEQ ID NO: 871325 - protein, 9 aa, Homo Sapiens
QEQLCAQNS

SEQ ID NO: 871326 - protein, 9 aa, Homo Sapiens
PEYEVRCTH

SEQ ID NO: 871327 - protein, 9 aa, Homo Sapiens
YQYIRSEVM

SEQ ID NO: 871328 - protein, 9 aa, Homo Sapiens
SDKVNLPKY

SEQ ID NO: 871329 - protein, 9 aa, Homo Sapiens
NIGELRTAH

SEQ ID NO: 871330 - protein, 9 aa, Homo Sapiens
DDFNSNTGG

SEQ ID NO: 871331 - protein, 9 aa, Homo Sapiens
AITADIQDI

SEQ ID NO: 871332 - protein, 9 aa, Homo Sapiens
IGELCCYLC

SEQ ID NO: 871333 - protein, 9 aa, Homo Sapiens
CSVLCGGGE

SEQ ID NO: 871334 - protein, 9 aa, Homo Sapiens
QWRETGKIY

SEQ ID NO: 871335 - protein, 9 aa, Homo Sapiens
KTFICRSTL

SEQ ID NO: 871336 - protein, 9 aa, Homo Sapiens
GTKSKPPRS

SEQ ID NO: 871337 - protein, 9 aa, Homo Sapiens
DFYFGRRPP

SEQ ID NO: 871338 - protein, 9 aa, Homo Sapiens
YSTSSYCWL

SEQ ID NO: 871339 - protein, 9 aa, Homo Sapiens
FMPPTYYNA

SEQ ID NO: 871340 - protein, 9 aa, Homo Sapiens
AVHTGKKPY

SEQ ID NO: 871341 - protein, 9 aa, Homo Sapiens
TTTEVTIEA

SEQ ID NO: 871342 - protein, 9 aa, Homo Sapiens
GCWYCRRQN

SEQ ID NO: 871343 - protein, 9 aa, Homo Sapiens
LNSCINPFV

SEQ ID NO: 871344 - protein, 9 aa, Homo Sapiens
HSDPHPDRT

SEQ ID NO: 871345 - protein, 9 aa, Homo Sapiens
ETVNQNSTS

SEQ ID NO: 871346 - protein, 9 aa, Homo Sapiens
KTKSSWFGL

SEQ ID NO: 871347 - protein, 9 aa, Homo Sapiens
GESKTMASK

SEQ ID NO: 871348 - protein, 9 aa, Homo Sapiens
YGLEDWRNK

SEQ ID NO: 871349 - protein, 9 aa, Homo Sapiens
CIKGAESEK

SEQ ID NO: 871350 - protein, 9 aa, Homo Sapiens
RIESHEYCR

SEQ ID NO: 871351 - protein, 9 aa, Homo Sapiens
ELDNLEIYT

SEQ ID NO: 871352 - protein, 9 aa, Homo Sapiens
CFITLSFPV

SEQ ID NO: 871353 - protein, 9 aa, Homo Sapiens
EAIWLYLGY

SEQ ID NO: 871354 - protein, 9 aa, Homo Sapiens
KTLANMKVT

SEQ ID NO: 871355 - protein, 9 aa, Homo Sapiens
EEVKNKISE

SEQ ID NO: 871356 - protein, 9 aa, Homo Sapiens
LHEKGNRIV

SEQ ID NO: 871357 - protein, 9 aa, Homo Sapiens
PSATLTAPY

SEQ ID NO: 871358 - protein, 9 aa, Homo Sapiens
RLKFAFADT

SEQ ID NO: 871359 - protein, 9 aa, Homo Sapiens
NLRPQNGNT

SEQ ID NO: 871360 - protein, 9 aa, Homo Sapiens
LLKQHVAPH

SEQ ID NO: 871361 - protein, 9 aa, Homo Sapiens
SPDVTETNN

SEQ ID NO: 871362 - protein, 9 aa, Homo Sapiens
LVVLPPVGS

SEQ ID NO: 871363 - protein, 9 aa, Homo Sapiens
KSSERDCLK

SEQ ID NO: 871364 - protein, 9 aa, Homo Sapiens
NKFMIRIGV

SEQ ID NO: 871365 - protein, 9 aa, Homo Sapiens
IYGLVIYCH

SEQ ID NO: 871366 - protein, 9 aa, Homo Sapiens
TQMLIQMKL

SEQ ID NO: 871367 - protein, 9 aa, Homo Sapiens
AGAFCKTGV

SEQ ID NO: 871368 - protein, 9 aa, Homo Sapiens
AFWLPDNRI

SEQ ID NO: 871369 - protein, 9 aa, Homo Sapiens
SECGKSFNH

SEQ ID NO: 871370 - protein, 9 aa, Homo Sapiens
LLQAENETG

SEQ ID NO: 871371 - protein, 9 aa, Homo Sapiens
SLHQKKLQL

SEQ ID NO: 871372 - protein, 9 aa, Homo Sapiens
MYIERYSRK

SEQ ID NO: 871373 - protein, 9 aa, Homo Sapiens
PPAEPWGHA

SEQ ID NO: 871374 - protein, 9 aa, Homo Sapiens
ILQHMKDHH

SEQ ID NO: 871375 - protein, 9 aa, Homo Sapiens
EISDDKVST

SEQ ID NO: 871376 - protein, 9 aa, Homo Sapiens
RWHYRPTGY

SEQ ID NO: 871377 - protein, 9 aa, Homo Sapiens
KQGKRRKKN

SEQ ID NO: 871378 - protein, 9 aa, Homo Sapiens
TIRNVLLTC

SEQ ID NO: 871379 - protein, 9 aa, Homo Sapiens
THAPLAVSS

SEQ ID NO: 871380 - protein, 9 aa, Homo Sapiens
VCLKVKEPI

SEQ ID NO: 871381 - protein, 9 aa, Homo Sapiens
HSLLNKELV

SEQ ID NO: 871382 - protein, 9 aa, Homo Sapiens
WTNTYTGMK

SEQ ID NO: 871383 - protein, 9 aa, Homo Sapiens
FDECNRIDA

SEQ ID NO: 871384 - protein, 9 aa, Homo Sapiens
NVWWITGTD

SEQ ID NO: 871385 - protein, 9 aa, Homo Sapiens
KKNPKLTID

SEQ ID NO: 871386 - protein, 9 aa, Homo Sapiens
PVLRFPLTQ

SEQ ID NO: 871387 - protein, 9 aa, Homo Sapiens
HLCLTISSD

SEQ ID NO: 871388 - protein, 9 aa, Homo Sapiens
HKRMHTGDK

SEQ ID NO: 871389 - protein, 9 aa, Homo Sapiens
YPSMPTFSP

SEQ ID NO: 871390 - protein, 9 aa, Homo Sapiens
GAEGRQVAG

SEQ ID NO: 871391 - protein, 9 aa, Homo Sapiens
CLNPIIYVF

SEQ ID NO: 871392 - protein, 9 aa, Homo Sapiens
DLRNNFLNF

SEQ ID NO: 871393 - protein, 9 aa, Homo Sapiens
QGGNMLGLA

SEQ ID NO: 871394 - protein, 9 aa, Homo Sapiens
RGIKILENL

SEQ ID NO: 871395 - protein, 9 aa, Homo Sapiens
HLACIQVLD

SEQ ID NO: 871396 - protein, 9 aa, Homo Sapiens
KCDKIQVDS

SEQ ID NO: 871397 - protein, 9 aa, Homo Sapiens
MPNGILSVK

SEQ ID NO: 871398 - protein, 9 aa, Homo Sapiens
ALLFEASLT

SEQ ID NO: 871399 - protein, 9 aa, Homo Sapiens
DKHSINCAR

SEQ ID NO: 871400 - protein, 9 aa, Homo Sapiens
RVPVNWSHA

SEQ ID NO: 871401 - protein, 9 aa, Homo Sapiens
KIKQRLTRK

SEQ ID NO: 871402 - protein, 9 aa, Homo Sapiens
PKSKETLNL

SEQ ID NO: 871403 - protein, 9 aa, Homo Sapiens
KSKSNRVDA

SEQ ID NO: 871404 - protein, 9 aa, Homo Sapiens
FPGTLTPTG

SEQ ID NO: 871405 - protein, 9 aa, Homo Sapiens
LALTFLPAR

SEQ ID NO: 871406 - protein, 9 aa, Homo Sapiens
CTVSGDLAA

SEQ ID NO: 871407 - protein, 9 aa, Homo Sapiens
DAKNKKEEN

SEQ ID NO: 871408 - protein, 9 aa, Homo Sapiens
QNHICGFLD

SEQ ID NO: 871409 - protein, 9 aa, Homo Sapiens
FDIATNKAY

SEQ ID NO: 871410 - protein, 9 aa, Homo Sapiens
LRDEAKHIK

SEQ ID NO: 871411 - protein, 9 aa, Homo Sapiens
VEEERQRLI

SEQ ID NO: 871412 - protein, 9 aa, Homo Sapiens
LSFKWWNMV

SEQ ID NO: 871413 - protein, 9 aa, Homo Sapiens
QGIHGDMHV

SEQ ID NO: 871414 - protein, 9 aa, Homo Sapiens
NRIRKYQIL

SEQ ID NO: 871415 - protein, 9 aa, Homo Sapiens
LFKFKSSSH

SEQ ID NO: 871416 - protein, 9 aa, Homo Sapiens
ESGSCTGWQ

SEQ ID NO: 871417 - protein, 9 aa, Homo Sapiens
LGKKDTSLY

SEQ ID NO: 871418 - protein, 9 aa, Homo Sapiens
DPVIIDRLF

SEQ ID NO: 871419 - protein, 9 aa, Homo Sapiens
QPTTSYSLY

SEQ ID NO: 871420 - protein, 9 aa, Homo Sapiens
TSKIVSSIK

SEQ ID NO: 871421 - protein, 9 aa, Homo Sapiens
FQFCAHCRA

SEQ ID NO: 871422 - protein, 9 aa, Homo Sapiens
TALAASPAP

SEQ ID NO: 871423 - protein, 9 aa, Homo Sapiens
KTCHFHPDK

SEQ ID NO: 871424 - protein, 9 aa, Homo Sapiens
WMMVDYLYQ

SEQ ID NO: 871425 - protein, 9 aa, Homo Sapiens
IILLYFRMQ

SEQ ID NO: 871426 - protein, 9 aa, Homo Sapiens
GVIGYIGMV

SEQ ID NO: 871427 - protein, 9 aa, Homo Sapiens
KIEVDENGT

SEQ ID NO: 871428 - protein, 9 aa, Homo Sapiens
NPKEDKKPK

SEQ ID NO: 871429 - protein, 9 aa, Homo Sapiens
SLPPGKVVF

SEQ ID NO: 871430 - protein, 9 aa, Homo Sapiens
GTNGRSLTT

SEQ ID NO: 871431 - protein, 9 aa, Homo Sapiens
YRHIHNFQL

SEQ ID NO: 871432 - protein, 9 aa, Homo Sapiens
FLNFLPEEM

SEQ ID NO: 871433 - protein, 9 aa, Homo Sapiens
CKLVNHIRV

SEQ ID NO: 871434 - protein, 9 aa, Homo Sapiens
PYVFDTALL

SEQ ID NO: 871435 - protein, 9 aa, Homo Sapiens
CKRRDTLIT

SEQ ID NO: 871436 - protein, 9 aa, Homo Sapiens
LLIMKILWD

SEQ ID NO: 871437 - protein, 9 aa, Homo Sapiens
SILCYRKQE

SEQ ID NO: 871438 - protein, 9 aa, Homo Sapiens
SLPVSSRVK

SEQ ID NO: 871439 - protein, 9 aa, Homo Sapiens
VHQRTHTGD

SEQ ID NO: 871440 - protein, 9 aa, Homo Sapiens
FEEQDAHKL

SEQ ID NO: 871441 - protein, 9 aa, Homo Sapiens
ITQIKCKDC

SEQ ID NO: 871442 - protein, 9 aa, Homo Sapiens
AFQLQEQSS

SEQ ID NO: 871443 - protein, 9 aa, Homo Sapiens
CKGSSTVCS

SEQ ID NO: 871444 - protein, 9 aa, Homo Sapiens
KCFVQVENV

SEQ ID NO: 871445 - protein, 9 aa, Homo Sapiens
GPFSKIVLS

SEQ ID NO: 871446 - protein, 9 aa, Homo Sapiens
GLLLSLNLS

SEQ ID NO: 871447 - protein, 9 aa, Homo Sapiens
TTNGLPVQE

SEQ ID NO: 871448 - protein, 9 aa, Homo Sapiens
PEAAEGDEN

SEQ ID NO: 871449 - protein, 9 aa, Homo Sapiens
CGAFMLKLI

SEQ ID NO: 871450 - protein, 9 aa, Homo Sapiens
IAENNCWCP

SEQ ID NO: 871451 - protein, 9 aa, Homo Sapiens
HEITHIGEK

SEQ ID NO: 871452 - protein, 9 aa, Homo Sapiens
CFIKWGLPG

SEQ ID NO: 871453 - protein, 9 aa, Homo Sapiens
FQTYGTWWD

SEQ ID NO: 871454 - protein, 9 aa, Homo Sapiens
KNRAFSICF

SEQ ID NO: 871455 - protein, 9 aa, Homo Sapiens
DGIGLYLEN

SEQ ID NO: 871456 - protein, 9 aa, Homo Sapiens
ASNNGSMCN

SEQ ID NO: 871457 - protein, 9 aa, Homo Sapiens
SIEEEEAEE

SEQ ID NO: 871458 - protein, 9 aa, Homo Sapiens
TSCEPKDLV

SEQ ID NO: 871459 - protein, 9 aa, Homo Sapiens
TNIRPIPDK

SEQ ID NO: 871460 - protein, 9 aa, Homo Sapiens
VKTLNVGRN

SEQ ID NO: 871461 - protein, 9 aa, Homo Sapiens
ERVMGLSEE

SEQ ID NO: 871462 - protein, 9 aa, Homo Sapiens
SYIDAEDVL

SEQ ID NO: 871463 - protein, 9 aa, Homo Sapiens
PVYYILCIH

SEQ ID NO: 871464 - protein, 9 aa, Homo Sapiens
NHLQQAQVT

SEQ ID NO: 871465 - protein, 9 aa, Homo Sapiens
DGSDWIING

SEQ ID NO: 871466 - protein, 9 aa, Homo Sapiens
FDEIIRVVI

SEQ ID NO: 871467 - protein, 9 aa, Homo Sapiens
EAGTLVTYM

SEQ ID NO: 871468 - protein, 9 aa, Homo Sapiens
SNHQNNHIR

SEQ ID NO: 871469 - protein, 9 aa, Homo Sapiens
TAGPETFCG

SEQ ID NO: 871470 - protein, 9 aa, Homo Sapiens
MTKDDSKLI

SEQ ID NO: 871471 - protein, 9 aa, Homo Sapiens
KRPEKIIQI

SEQ ID NO: 871472 - protein, 9 aa, Homo Sapiens
EFLYKTVGG

SEQ ID NO: 871473 - protein, 9 aa, Homo Sapiens
LAQNLTKLM

SEQ ID NO: 871474 - protein, 9 aa, Homo Sapiens
LHNCETCRG

SEQ ID NO: 871475 - protein, 9 aa, Homo Sapiens
PQRFDLVVS

SEQ ID NO: 871476 - protein, 9 aa, Homo Sapiens
LNKLSVNNK

SEQ ID NO: 871477 - protein, 9 aa, Homo Sapiens
LTLAKHKKI

SEQ ID NO: 871478 - protein, 9 aa, Homo Sapiens
ARNRCRGKI

SEQ ID NO: 871479 - protein, 9 aa, Homo Sapiens
GYKVSQKEK

SEQ ID NO: 871480 - protein, 9 aa, Homo Sapiens
DLLDGCWIY

SEQ ID NO: 871481 - protein, 9 aa, Homo Sapiens
KAFKLHYQL

SEQ ID NO: 871482 - protein, 9 aa, Homo Sapiens
IYLGNRYYI

SEQ ID NO: 871483 - protein, 9 aa, Homo Sapiens
VKLVCGNIT

SEQ ID NO: 871484 - protein, 9 aa, Homo Sapiens
TKIGKIRDE

SEQ ID NO: 871485 - protein, 9 aa, Homo Sapiens
VHHRRVRVS

SEQ ID NO: 871486 - protein, 9 aa, Homo Sapiens
KGEIKPSLE

SEQ ID NO: 871487 - protein, 9 aa, Homo Sapiens
GALKKLINR

SEQ ID NO: 871488 - protein, 9 aa, Homo Sapiens
KLNICPETG

SEQ ID NO: 871489 - protein, 9 aa, Homo Sapiens
TEPPGSSSG

SEQ ID NO: 871490 - protein, 9 aa, Homo Sapiens
CPEAYVWVP

SEQ ID NO: 871491 - protein, 9 aa, Homo Sapiens
LKQRNFLQS

SEQ ID NO: 871492 - protein, 9 aa, Homo Sapiens
AKLATRALP

SEQ ID NO: 871493 - protein, 9 aa, Homo Sapiens
PLQILLPLI

SEQ ID NO: 871494 - protein, 9 aa, Homo Sapiens
AFKPSFIHP

SEQ ID NO: 871495 - protein, 9 aa, Homo Sapiens
QDKIKDTED

SEQ ID NO: 871496 - protein, 9 aa, Homo Sapiens
FLHVGSNCL

SEQ ID NO: 871497 - protein, 9 aa, Homo Sapiens
NQKTLYFPN

SEQ ID NO: 871498 - protein, 9 aa, Homo Sapiens
IDLVLDRIC

SEQ ID NO: 871499 - protein, 9 aa, Homo Sapiens
STTGYKHFD

SEQ ID NO: 871500 - protein, 9 aa, Homo Sapiens
GTAVENSDN

SEQ ID NO: 871501 - protein, 9 aa, Homo Sapiens
QEERRKIKQ

SEQ ID NO: 871502 - protein, 9 aa, Homo Sapiens
LLCTDTSVN

SEQ ID NO: 871503 - protein, 9 aa, Homo Sapiens
GRRSVTGIP

SEQ ID NO: 871504 - protein, 9 aa, Homo Sapiens
TLLSTSVDT

SEQ ID NO: 871505 - protein, 9 aa, Homo Sapiens
DLSDGWLKI

SEQ ID NO: 871506 - protein, 9 aa, Homo Sapiens
TRKQIRYRF

SEQ ID NO: 871507 - protein, 9 aa, Homo Sapiens
VAKEKDTMT

SEQ ID NO: 871508 - protein, 9 aa, Homo Sapiens
QRQDCPFFL

SEQ ID NO: 871509 - protein, 9 aa, Homo Sapiens
DLLIEEIER

SEQ ID NO: 871510 - protein, 9 aa, Homo Sapiens
KNGSIQPYP

SEQ ID NO: 871511 - protein, 9 aa, Homo Sapiens
SLAVTSQSD

SEQ ID NO: 871512 - protein, 9 aa, Homo Sapiens
FLSLVHHTY

SEQ ID NO: 871513 - protein, 9 aa, Homo Sapiens
AMVFGLALA

SEQ ID NO: 871514 - protein, 9 aa, Homo Sapiens
KRRKKNKNR

SEQ ID NO: 871515 - protein, 9 aa, Homo Sapiens
VADVNNNAP

SEQ ID NO: 871516 - protein, 9 aa, Homo Sapiens
IKFFNKMKK

SEQ ID NO: 871517 - protein, 9 aa, Homo Sapiens
VSVSGIKWD

SEQ ID NO: 871518 - protein, 9 aa, Homo Sapiens
FRNMKQKFI

SEQ ID NO: 871519 - protein, 9 aa, Homo Sapiens
NKKARALKQ

SEQ ID NO: 871520 - protein, 9 aa, Homo Sapiens
WRQQGFLGL

SEQ ID NO: 871521 - protein, 9 aa, Homo Sapiens
TSNKIVREY

SEQ ID NO: 871522 - protein, 9 aa, Homo Sapiens
CLAALTKCA

SEQ ID NO: 871523 - protein, 9 aa, Homo Sapiens
SLSGIIGAN

SEQ ID NO: 871524 - protein, 9 aa, Homo Sapiens
ELNLMTLGE

SEQ ID NO: 871525 - protein, 9 aa, Homo Sapiens
RNHFEGTRS

SEQ ID NO: 871526 - protein, 9 aa, Homo Sapiens
GMEVCNLCI

SEQ ID NO: 871527 - protein, 9 aa, Homo Sapiens
RTILIDFTK

SEQ ID NO: 871528 - protein, 9 aa, Homo Sapiens
SCCLNPIIY

SEQ ID NO: 871529 - protein, 9 aa, Homo Sapiens
GTFCTCATV

SEQ ID NO: 871530 - protein, 9 aa, Homo Sapiens
QIVERNYPL

SEQ ID NO: 871531 - protein, 9 aa, Homo Sapiens
ILKRAANIA

SEQ ID NO: 871532 - protein, 9 aa, Homo Sapiens
WCTFEGCGK

SEQ ID NO: 871533 - protein, 9 aa, Homo Sapiens
ELTQMLIQM

SEQ ID NO: 871534 - protein, 9 aa, Homo Sapiens
PASAYPGGC

SEQ ID NO: 871535 - protein, 9 aa, Homo Sapiens
LIKKCSELY

SEQ ID NO: 871536 - protein, 9 aa, Homo Sapiens
VLIQPLNRR

SEQ ID NO: 871537 - protein, 9 aa, Homo Sapiens
IWLYNSLKS

SEQ ID NO: 871538 - protein, 9 aa, Homo Sapiens
WSSICNFPS

SEQ ID NO: 871539 - protein, 9 aa, Homo Sapiens
DNKLKTLEE

SEQ ID NO: 871540 - protein, 9 aa, Homo Sapiens
FTSPKIDSV

SEQ ID NO: 871541 - protein, 9 aa, Homo Sapiens
EFSKQVNRI

SEQ ID NO: 871542 - protein, 9 aa, Homo Sapiens
VTECSNGLF

SEQ ID NO: 871543 - protein, 9 aa, Homo Sapiens
ISKLHLETC

SEQ ID NO: 871544 - protein, 9 aa, Homo Sapiens
LLNYQVVRF

SEQ ID NO: 871545 - protein, 9 aa, Homo Sapiens
AITEGYLDW

SEQ ID NO: 871546 - protein, 9 aa, Homo Sapiens
QSLDLAEYT

SEQ ID NO: 871547 - protein, 9 aa, Homo Sapiens
IPQLDGTAV

SEQ ID NO: 871548 - protein, 9 aa, Homo Sapiens
ISVAIQNFL

SEQ ID NO: 871549 - protein, 9 aa, Homo Sapiens
EDLLDGCWI

SEQ ID NO: 871550 - protein, 9 aa, Homo Sapiens
PTWLSTNLD

SEQ ID NO: 871551 - protein, 9 aa, Homo Sapiens
CSELYEAEE

SEQ ID NO: 871552 - protein, 9 aa, Homo Sapiens
PTLALKLRR

SEQ ID NO: 871553 - protein, 9 aa, Homo Sapiens
HQSHSSGNR

SEQ ID NO: 871554 - protein, 9 aa, Homo Sapiens
RLHHKLKTV

SEQ ID NO: 871555 - protein, 9 aa, Homo Sapiens
SNTTSNIRK

SEQ ID NO: 871556 - protein, 9 aa, Homo Sapiens
EKSLGLELI

SEQ ID NO: 871557 - protein, 9 aa, Homo Sapiens
VWEKYSKWL

SEQ ID NO: 871558 - protein, 9 aa, Homo Sapiens
NSCINPFVY

SEQ ID NO: 871559 - protein, 9 aa, Homo Sapiens
KSQLKHKYI

SEQ ID NO: 871560 - protein, 9 aa, Homo Sapiens
ANLLDFWFA

SEQ ID NO: 871561 - protein, 9 aa, Homo Sapiens
FDLVALNLT

SEQ ID NO: 871562 - protein, 9 aa, Homo Sapiens
PTPLLKEIS

SEQ ID NO: 871563 - protein, 9 aa, Homo Sapiens
FGRHYDHNH

SEQ ID NO: 871564 - protein, 9 aa, Homo Sapiens
LPSEEVLCS

SEQ ID NO: 871565 - protein, 9 aa, Homo Sapiens
LFSFTSPTV

SEQ ID NO: 871566 - protein, 9 aa, Homo Sapiens
VQIDRRMPG

SEQ ID NO: 871567 - protein, 9 aa, Homo Sapiens
FGQGEEVET

SEQ ID NO: 871568 - protein, 9 aa, Homo Sapiens
HESAKADIL

SEQ ID NO: 871569 - protein, 9 aa, Homo Sapiens
GQSHYRHRH

SEQ ID NO: 871570 - protein, 9 aa, Homo Sapiens
LNHAVLGLY

SEQ ID NO: 871571 - protein, 9 aa, Homo Sapiens
KKGFTEVKL

SEQ ID NO: 871572 - protein, 9 aa, Homo Sapiens
IRKQNSLIA

SEQ ID NO: 871573 - protein, 9 aa, Homo Sapiens
YQTSGLYGL

SEQ ID NO: 871574 - protein, 9 aa, Homo Sapiens
VFGEGTKAV

SEQ ID NO: 871575 - protein, 9 aa, Homo Sapiens
KMLSSVSKT

SEQ ID NO: 871576 - protein, 9 aa, Homo Sapiens
ILFGHQPYW

SEQ ID NO: 871577 - protein, 9 aa, Homo Sapiens
DNDTASEET

SEQ ID NO: 871578 - protein, 9 aa, Homo Sapiens
FFWTVPSDN

SEQ ID NO: 871579 - protein, 9 aa, Homo Sapiens
QEEAKHRWE

SEQ ID NO: 871580 - protein, 9 aa, Homo Sapiens
EFPNLDNTS

SEQ ID NO: 871581 - protein, 9 aa, Homo Sapiens
IFRHLRRVI

SEQ ID NO: 871582 - protein, 9 aa, Homo Sapiens
ILQRMMSSV

SEQ ID NO: 871583 - protein, 9 aa, Homo Sapiens
SHKQAQDNL

SEQ ID NO: 871584 - protein, 9 aa, Homo Sapiens
GIIQTLDLP

SEQ ID NO: 871585 - protein, 9 aa, Homo Sapiens
ELARKNIHG

SEQ ID NO: 871586 - protein, 9 aa, Homo Sapiens
NGCRVTNEI

SEQ ID NO: 871587 - protein, 9 aa, Homo Sapiens
ETQSSSNLS

SEQ ID NO: 871588 - protein, 9 aa, Homo Sapiens
KTLIFIFMG

SEQ ID NO: 871589 - protein, 9 aa, Homo Sapiens
VVKRKAAVL

SEQ ID NO: 871590 - protein, 9 aa, Homo Sapiens
YKVDYASFH

SEQ ID NO: 871591 - protein, 9 aa, Homo Sapiens
KYFYICVNG

SEQ ID NO: 871592 - protein, 9 aa, Homo Sapiens
HFEGTRSEV

SEQ ID NO: 871593 - protein, 9 aa, Homo Sapiens
VEEIDHRGK

SEQ ID NO: 871594 - protein, 9 aa, Homo Sapiens
QAEESVLIN

SEQ ID NO: 871595 - protein, 9 aa, Homo Sapiens
VLELALQGC

SEQ ID NO: 871596 - protein, 9 aa, Homo Sapiens
LLYGADIKS

SEQ ID NO: 871597 - protein, 9 aa, Homo Sapiens
CRRSRAALV

SEQ ID NO: 871598 - protein, 9 aa, Homo Sapiens
LPKEVNYSP

SEQ ID NO: 871599 - protein, 9 aa, Homo Sapiens
YGGFNDLGY

SEQ ID NO: 871600 - protein, 9 aa, Homo Sapiens
SDKREKLEK

SEQ ID NO: 871601 - protein, 9 aa, Homo Sapiens
ATSRMDTTA

SEQ ID NO: 871602 - protein, 9 aa, Homo Sapiens
NKQDDKSSG

SEQ ID NO: 871603 - protein, 9 aa, Homo Sapiens
ICFQIKYLI

SEQ ID NO: 871604 - protein, 9 aa, Homo Sapiens
WTFKHLVYQ

SEQ ID NO: 871605 - protein, 9 aa, Homo Sapiens
AIPIHLFLT

SEQ ID NO: 871606 - protein, 9 aa, Homo Sapiens
LTPKQAIFK

SEQ ID NO: 871607 - protein, 9 aa, Homo Sapiens
ENLVECFSQ

SEQ ID NO: 871608 - protein, 9 aa, Homo Sapiens
TYENLKFQV

SEQ ID NO: 871609 - protein, 9 aa, Homo Sapiens
LGNLSALQT

SEQ ID NO: 871610 - protein, 9 aa, Homo Sapiens
VRRECDKGR

SEQ ID NO: 871611 - protein, 9 aa, Homo Sapiens
WLVDLFAPW

SEQ ID NO: 871612 - protein, 9 aa, Homo Sapiens
FQRKLSKSL

SEQ ID NO: 871613 - protein, 9 aa, Homo Sapiens
ADVLKYFSL

SEQ ID NO: 871614 - protein, 9 aa, Homo Sapiens
GHQVPESVE

SEQ ID NO: 871615 - protein, 9 aa, Homo Sapiens
GTLVTYMFQ

SEQ ID NO: 871616 - protein, 9 aa, Homo Sapiens
AHQLVHKGY

SEQ ID NO: 871617 - protein, 9 aa, Homo Sapiens
QLPLSRIKL

SEQ ID NO: 871618 - protein, 9 aa, Homo Sapiens
QQKLTEISQ

SEQ ID NO: 871619 - protein, 9 aa, Homo Sapiens
VANVTGNQD

SEQ ID NO: 871620 - protein, 9 aa, Homo Sapiens
IFAITFQYA

SEQ ID NO: 871621 - protein, 9 aa, Homo Sapiens
RACCYGFLG

SEQ ID NO: 871622 - protein, 9 aa, Homo Sapiens
PTPCTLTAR

SEQ ID NO: 871623 - protein, 9 aa, Homo Sapiens
RKVADLYKL

SEQ ID NO: 871624 - protein, 9 aa, Homo Sapiens
TTVNISANG

SEQ ID NO: 871625 - protein, 9 aa, Homo Sapiens
TWKPLNGFK

SEQ ID NO: 871626 - protein, 9 aa, Homo Sapiens
ITKILAETK

SEQ ID NO: 871627 - protein, 9 aa, Homo Sapiens
AVKDYIQTQ

SEQ ID NO: 871628 - protein, 9 aa, Homo Sapiens
YEDTLIDEV

SEQ ID NO: 871629 - protein, 9 aa, Homo Sapiens
TLLMDVKVP

SEQ ID NO: 871630 - protein, 9 aa, Homo Sapiens
HIVHPLLQG

SEQ ID NO: 871631 - protein, 9 aa, Homo Sapiens
PDPLIPCNL

SEQ ID NO: 871632 - protein, 9 aa, Homo Sapiens
GLNSTGYYD

SEQ ID NO: 871633 - protein, 9 aa, Homo Sapiens
SSGFIKAVF

SEQ ID NO: 871634 - protein, 9 aa, Homo Sapiens
ASNPLAHYN

SEQ ID NO: 871635 - protein, 9 aa, Homo Sapiens
CLTINLHVV

SEQ ID NO: 871636 - protein, 9 aa, Homo Sapiens
DLLKEYPVA

SEQ ID NO: 871637 - protein, 9 aa, Homo Sapiens
GVQWPCPGV

SEQ ID NO: 871638 - protein, 9 aa, Homo Sapiens
DLLRSGEYL

SEQ ID NO: 871639 - protein, 9 aa, Homo Sapiens
VIFKNSQGE

SEQ ID NO: 871640 - protein, 9 aa, Homo Sapiens
VGEKNQRLF

SEQ ID NO: 871641 - protein, 9 aa, Homo Sapiens
ESSASTGRK

SEQ ID NO: 871642 - protein, 9 aa, Homo Sapiens
LYIITNAQN

SEQ ID NO: 871643 - protein, 9 aa, Homo Sapiens
LEQEHLRKY

SEQ ID NO: 871644 - protein, 9 aa, Homo Sapiens
MNPLENVYS

SEQ ID NO: 871645 - protein, 9 aa, Homo Sapiens
YGRTKELTL

SEQ ID NO: 871646 - protein, 9 aa, Homo Sapiens
RKTPSPNKH

SEQ ID NO: 871647 - protein, 9 aa, Homo Sapiens
GKICLWRNF

SEQ ID NO: 871648 - protein, 9 aa, Homo Sapiens
TVRCCGRGM

SEQ ID NO: 871649 - protein, 9 aa, Homo Sapiens
AGDVDTHAE

SEQ ID NO: 871650 - protein, 9 aa, Homo Sapiens
KQIVGGKRA

SEQ ID NO: 871651 - protein, 9 aa, Homo Sapiens
SSIQRHMVM

SEQ ID NO: 871652 - protein, 9 aa, Homo Sapiens
CRSTLSQHL

SEQ ID NO: 871653 - protein, 9 aa, Homo Sapiens
TLNYVQERK

SEQ ID NO: 871654 - protein, 9 aa, Homo Sapiens
TTKKYREKS

SEQ ID NO: 871655 - protein, 9 aa, Homo Sapiens
GQDYSTGYV

SEQ ID NO: 871656 - protein, 9 aa, Homo Sapiens
KTFKQRQIK

SEQ ID NO: 871657 - protein, 9 aa, Homo Sapiens
HSPFQTLNI

SEQ ID NO: 871658 - protein, 9 aa, Homo Sapiens
LRLHQIQHK

SEQ ID NO: 871659 - protein, 9 aa, Homo Sapiens
SFDVDIENV

SEQ ID NO: 871660 - protein, 9 aa, Homo Sapiens
SAAFKPSFI

SEQ ID NO: 871661 - protein, 9 aa, Homo Sapiens
LMSRAQELV

SEQ ID NO: 871662 - protein, 9 aa, Homo Sapiens
EPKGFTECK

SEQ ID NO: 871663 - protein, 9 aa, Homo Sapiens
LHVCFITLS

SEQ ID NO: 871664 - protein, 9 aa, Homo Sapiens
IYQEDIRDL

SEQ ID NO: 871665 - protein, 9 aa, Homo Sapiens
GVGTCKETE

SEQ ID NO: 871666 - protein, 9 aa, Homo Sapiens
LDFLSSSTE

SEQ ID NO: 871667 - protein, 9 aa, Homo Sapiens
SFVFNIPST

SEQ ID NO: 871668 - protein, 9 aa, Homo Sapiens
SPERPINNS

SEQ ID NO: 871669 - protein, 9 aa, Homo Sapiens
ITSFVAAVK

SEQ ID NO: 871670 - protein, 9 aa, Homo Sapiens
DKGYGFVEG

SEQ ID NO: 871671 - protein, 9 aa, Homo Sapiens
SPSLAVTSQ

SEQ ID NO: 871672 - protein, 9 aa, Homo Sapiens
WKKYLIKIC

SEQ ID NO: 871673 - protein, 9 aa, Homo Sapiens
SPAEVKILA

SEQ ID NO: 871674 - protein, 9 aa, Homo Sapiens
VPKIYALMP

SEQ ID NO: 871675 - protein, 9 aa, Homo Sapiens
KQNARWSTH

SEQ ID NO: 871676 - protein, 9 aa, Homo Sapiens
QEEDNNIVV

SEQ ID NO: 871677 - protein, 9 aa, Homo Sapiens
PLENVYSDD

SEQ ID NO: 871678 - protein, 9 aa, Homo Sapiens
SLSAWPLSA

SEQ ID NO: 871679 - protein, 9 aa, Homo Sapiens
LVIDKAKIE

SEQ ID NO: 871680 - protein, 9 aa, Homo Sapiens
KEKLRKRTK

SEQ ID NO: 871681 - protein, 9 aa, Homo Sapiens
NNTDVSIAV

SEQ ID NO: 871682 - protein, 9 aa, Homo Sapiens
ESAYGGAYG

SEQ ID NO: 871683 - protein, 9 aa, Homo Sapiens
ILPWEHNEQ

SEQ ID NO: 871684 - protein, 9 aa, Homo Sapiens
TNDRGLQRT

SEQ ID NO: 871685 - protein, 9 aa, Homo Sapiens
ELTLVFKQD

SEQ ID NO: 871686 - protein, 9 aa, Homo Sapiens
AFLSPEQTK

SEQ ID NO: 871687 - protein, 9 aa, Homo Sapiens
LNEFSHAIA

SEQ ID NO: 871688 - protein, 9 aa, Homo Sapiens
VLYHNLCIM

SEQ ID NO: 871689 - protein, 9 aa, Homo Sapiens
QVHDQVLYT

SEQ ID NO: 871690 - protein, 9 aa, Homo Sapiens
LQKHGKNVP

SEQ ID NO: 871691 - protein, 9 aa, Homo Sapiens
DKLYPINIS

SEQ ID NO: 871692 - protein, 9 aa, Homo Sapiens
LGTKIVFVE

SEQ ID NO: 871693 - protein, 9 aa, Homo Sapiens
SLFAVHHSS

SEQ ID NO: 871694 - protein, 9 aa, Homo Sapiens
AGDIGGATI

SEQ ID NO: 871695 - protein, 9 aa, Homo Sapiens
GASKEIISE

SEQ ID NO: 871696 - protein, 9 aa, Homo Sapiens
ECSDCGQFF

SEQ ID NO: 871697 - protein, 9 aa, Homo Sapiens
RRKAFLHWL

SEQ ID NO: 871698 - protein, 9 aa, Homo Sapiens
PCPSIPLFA

SEQ ID NO: 871699 - protein, 9 aa, Homo Sapiens
LEDKLENVK

SEQ ID NO: 871700 - protein, 9 aa, Homo Sapiens
LCGQDLNTT

SEQ ID NO: 871701 - protein, 9 aa, Homo Sapiens
AVYVNNQLS

SEQ ID NO: 871702 - protein, 9 aa, Homo Sapiens
AAALQIQNM

SEQ ID NO: 871703 - protein, 9 aa, Homo Sapiens
SDHPTLASQ

SEQ ID NO: 871704 - protein, 9 aa, Homo Sapiens
NPMSSLQIS

SEQ ID NO: 871705 - protein, 9 aa, Homo Sapiens
RKPTVIQIP

SEQ ID NO: 871706 - protein, 9 aa, Homo Sapiens
VAMVFGLAL

SEQ ID NO: 871707 - protein, 9 aa, Homo Sapiens
IVQRWMRGF

SEQ ID NO: 871708 - protein, 9 aa, Homo Sapiens
YYNAWSLRK

SEQ ID NO: 871709 - protein, 9 aa, Homo Sapiens
STKTQCSKE

SEQ ID NO: 871710 - protein, 9 aa, Homo Sapiens
TAYFHSGIN

SEQ ID NO: 871711 - protein, 9 aa, Homo Sapiens
ILLYFRMQD

SEQ ID NO: 871712 - protein, 9 aa, Homo Sapiens
QADWHGRPV

SEQ ID NO: 871713 - protein, 9 aa, Homo Sapiens
MVMKINGSL

SEQ ID NO: 871714 - protein, 9 aa, Homo Sapiens
KEKDTFKEK

SEQ ID NO: 871715 - protein, 9 aa, Homo Sapiens
PAEVWEKYS

SEQ ID NO: 871716 - protein, 9 aa, Homo Sapiens
IDDKNEIDE

SEQ ID NO: 871717 - protein, 9 aa, Homo Sapiens
DLASEEPEC

SEQ ID NO: 871718 - protein, 9 aa, Homo Sapiens
LQITVLDHY

SEQ ID NO: 871719 - protein, 9 aa, Homo Sapiens
ICENFQDLM

SEQ ID NO: 871720 - protein, 9 aa, Homo Sapiens
KQMETEEAW

SEQ ID NO: 871721 - protein, 9 aa, Homo Sapiens
QMYKSNGYT

SEQ ID NO: 871722 - protein, 9 aa, Homo Sapiens
CQPNNPREL

SEQ ID NO: 871723 - protein, 9 aa, Homo Sapiens
KVFVDIKFT

SEQ ID NO: 871724 - protein, 9 aa, Homo Sapiens
DDAKLATRA

SEQ ID NO: 871725 - protein, 9 aa, Homo Sapiens
NPASPPKTF

SEQ ID NO: 871726 - protein, 9 aa, Homo Sapiens
AAAKDSPGV

SEQ ID NO: 871727 - protein, 9 aa, Homo Sapiens
TSPKIDSVA

SEQ ID NO: 871728 - protein, 9 aa, Homo Sapiens
KGWGQPQIQ

SEQ ID NO: 871729 - protein, 9 aa, Homo Sapiens
KGNCSQHMG

SEQ ID NO: 871730 - protein, 9 aa, Homo Sapiens
LLLVRLCPP

SEQ ID NO: 871731 - protein, 9 aa, Homo Sapiens
ACLQCSQCY

SEQ ID NO: 871732 - protein, 9 aa, Homo Sapiens
QYPLTISQL

SEQ ID NO: 871733 - protein, 9 aa, Homo Sapiens
LEKTSQMLS

SEQ ID NO: 871734 - protein, 9 aa, Homo Sapiens
KVEPGIICL

SEQ ID NO: 871735 - protein, 9 aa, Homo Sapiens
LAMVVASQN

SEQ ID NO: 871736 - protein, 9 aa, Homo Sapiens
EKSKRGFFW

SEQ ID NO: 871737 - protein, 9 aa, Homo Sapiens
FCFYSEIME

SEQ ID NO: 871738 - protein, 9 aa, Homo Sapiens
PSTAQATVT

SEQ ID NO: 871739 - protein, 9 aa, Homo Sapiens
CRTAFTSEQ

SEQ ID NO: 871740 - protein, 9 aa, Homo Sapiens
LVDITKILA

SEQ ID NO: 871741 - protein, 9 aa, Homo Sapiens
PYLEKTANK

SEQ ID NO: 871742 - protein, 9 aa, Homo Sapiens
CICQSSRTS

SEQ ID NO: 871743 - protein, 9 aa, Homo Sapiens
QRQKQKIMK

SEQ ID NO: 871744 - protein, 9 aa, Homo Sapiens
YVTTAEDKE

SEQ ID NO: 871745 - protein, 9 aa, Homo Sapiens
LRGDPVYCL

SEQ ID NO: 871746 - protein, 9 aa, Homo Sapiens
QLISGFPRR

SEQ ID NO: 871747 - protein, 9 aa, Homo Sapiens
PGLLCQSQL

SEQ ID NO: 871748 - protein, 9 aa, Homo Sapiens
ILKMHFAKG

SEQ ID NO: 871749 - protein, 9 aa, Homo Sapiens
HAPLNPALF

SEQ ID NO: 871750 - protein, 9 aa, Homo Sapiens
SLKVAAHAP

SEQ ID NO: 871751 - protein, 9 aa, Homo Sapiens
VVKFSYMWI

SEQ ID NO: 871752 - protein, 9 aa, Homo Sapiens
VEKRNFLGS

SEQ ID NO: 871753 - protein, 9 aa, Homo Sapiens
GDVMKMNEF

SEQ ID NO: 871754 - protein, 9 aa, Homo Sapiens
RSMYDLAES

SEQ ID NO: 871755 - protein, 9 aa, Homo Sapiens
SEQNMKLCQ

SEQ ID NO: 871756 - protein, 9 aa, Homo Sapiens
VIGIKQGEK

SEQ ID NO: 871757 - protein, 9 aa, Homo Sapiens
DEAFCNAVW

SEQ ID NO: 871758 - protein, 9 aa, Homo Sapiens
VLCTENEIF

SEQ ID NO: 871759 - protein, 9 aa, Homo Sapiens
LFKDWEQFL

SEQ ID NO: 871760 - protein, 9 aa, Homo Sapiens
GFSQVFQAP

SEQ ID NO: 871761 - protein, 9 aa, Homo Sapiens
NVLCNFILE

SEQ ID NO: 871762 - protein, 9 aa, Homo Sapiens
QHLNDLKKD

SEQ ID NO: 871763 - protein, 9 aa, Homo Sapiens
PNKEELDEK

SEQ ID NO: 871764 - protein, 9 aa, Homo Sapiens
CCRCSKCCD

SEQ ID NO: 871765 - protein, 9 aa, Homo Sapiens
DVYLDITDC

SEQ ID NO: 871766 - protein, 9 aa, Homo Sapiens
DKRLLLKED

SEQ ID NO: 871767 - protein, 9 aa, Homo Sapiens
FFTIFNAFQ

SEQ ID NO: 871768 - protein, 9 aa, Homo Sapiens
LTFEQLCSL

SEQ ID NO: 871769 - protein, 9 aa, Homo Sapiens
GGPFAKLNT

SEQ ID NO: 871770 - protein, 9 aa, Homo Sapiens
FEIHNYNIT

SEQ ID NO: 871771 - protein, 9 aa, Homo Sapiens
TPELSSKKN

SEQ ID NO: 871772 - protein, 9 aa, Homo Sapiens
SKFTNFKRI

SEQ ID NO: 871773 - protein, 9 aa, Homo Sapiens
SINTLRRTR

SEQ ID NO: 871774 - protein, 9 aa, Homo Sapiens
EIELSTLAA

SEQ ID NO: 871775 - protein, 9 aa, Homo Sapiens
CVLLHVDVN

SEQ ID NO: 871776 - protein, 9 aa, Homo Sapiens
RDPQVNVFA

SEQ ID NO: 871777 - protein, 9 aa, Homo Sapiens
ETFSTYFTH

SEQ ID NO: 871778 - protein, 9 aa, Homo Sapiens
IPVARFGAR

SEQ ID NO: 871779 - protein, 9 aa, Homo Sapiens
PLCGWMKWP

SEQ ID NO: 871780 - protein, 9 aa, Homo Sapiens
CKDARACVI

SEQ ID NO: 871781 - protein, 9 aa, Homo Sapiens
YDKNKLVKA

SEQ ID NO: 871782 - protein, 9 aa, Homo Sapiens
ARASRRGDT

SEQ ID NO: 871783 - protein, 9 aa, Homo Sapiens
PIFLCLLPQ

SEQ ID NO: 871784 - protein, 9 aa, Homo Sapiens
RIPSHKEER

SEQ ID NO: 871785 - protein, 9 aa, Homo Sapiens
LLYLQLDIY

SEQ ID NO: 871786 - protein, 9 aa, Homo Sapiens
ESPHMYVSD

SEQ ID NO: 871787 - protein, 9 aa, Homo Sapiens
SRGKVIILH

SEQ ID NO: 871788 - protein, 9 aa, Homo Sapiens
KYPDIAQQF

SEQ ID NO: 871789 - protein, 9 aa, Homo Sapiens
MINFNGEEK

SEQ ID NO: 871790 - protein, 9 aa, Homo Sapiens
QPSHVIYTD

SEQ ID NO: 871791 - protein, 9 aa, Homo Sapiens
NYFSGFSSP

SEQ ID NO: 871792 - protein, 9 aa, Homo Sapiens
LQRCLMETN

SEQ ID NO: 871793 - protein, 9 aa, Homo Sapiens
CTYMASEDK

SEQ ID NO: 871794 - protein, 9 aa, Homo Sapiens
YRFVCDKHY

SEQ ID NO: 871795 - protein, 9 aa, Homo Sapiens
LAEVQSELE

SEQ ID NO: 871796 - protein, 9 aa, Homo Sapiens
DYKYIEHLK

SEQ ID NO: 871797 - protein, 9 aa, Homo Sapiens
VVEYEYEAE

SEQ ID NO: 871798 - protein, 9 aa, Homo Sapiens
DTYWELQKD

SEQ ID NO: 871799 - protein, 9 aa, Homo Sapiens
VNYYNHLYK

SEQ ID NO: 871800 - protein, 9 aa, Homo Sapiens
AAPEICCTV

SEQ ID NO: 871801 - protein, 9 aa, Homo Sapiens
PRFNTIHEE

SEQ ID NO: 871802 - protein, 9 aa, Homo Sapiens
FSVREKRDV

SEQ ID NO: 871803 - protein, 9 aa, Homo Sapiens
NNIKTNAQI

SEQ ID NO: 871804 - protein, 9 aa, Homo Sapiens
KEVFNNLFM

SEQ ID NO: 871805 - protein, 9 aa, Homo Sapiens
GCKGFFRQS

SEQ ID NO: 871806 - protein, 9 aa, Homo Sapiens
SCEMSSFVE

SEQ ID NO: 871807 - protein, 9 aa, Homo Sapiens
SSDVDIGEN

SEQ ID NO: 871808 - protein, 9 aa, Homo Sapiens
TYRCLLEGE

SEQ ID NO: 871809 - protein, 9 aa, Homo Sapiens
YVPKGFNKN

SEQ ID NO: 871810 - protein, 9 aa, Homo Sapiens
TPGLGHQVP

SEQ ID NO: 871811 - protein, 9 aa, Homo Sapiens
STSQNFPSS

SEQ ID NO: 871812 - protein, 9 aa, Homo Sapiens
VLYNETQEE

SEQ ID NO: 871813 - protein, 9 aa, Homo Sapiens
NIQIWLADG

SEQ ID NO: 871814 - protein, 9 aa, Homo Sapiens
YFLATNMIS

SEQ ID NO: 871815 - protein, 9 aa, Homo Sapiens
PGSLFASDN

SEQ ID NO: 871816 - protein, 9 aa, Homo Sapiens
SVTEETFTI

SEQ ID NO: 871817 - protein, 9 aa, Homo Sapiens
DLCKESPDI

SEQ ID NO: 871818 - protein, 9 aa, Homo Sapiens
LSSYNERVG

SEQ ID NO: 871819 - protein, 9 aa, Homo Sapiens
RQAGPVITV

SEQ ID NO: 871820 - protein, 9 aa, Homo Sapiens
ALGTKTFQI

SEQ ID NO: 871821 - protein, 9 aa, Homo Sapiens
PVQFQYVLI

SEQ ID NO: 871822 - protein, 9 aa, Homo Sapiens
LFELYHSSE

SEQ ID NO: 871823 - protein, 9 aa, Homo Sapiens
MHGLNNALD

SEQ ID NO: 871824 - protein, 9 aa, Homo Sapiens
KLLSQAESW

SEQ ID NO: 871825 - protein, 9 aa, Homo Sapiens
GQKPLGTAE

SEQ ID NO: 871826 - protein, 9 aa, Homo Sapiens
AKKAPNGTV

SEQ ID NO: 871827 - protein, 9 aa, Homo Sapiens
QDDSDLDCK

SEQ ID NO: 871828 - protein, 9 aa, Homo Sapiens
FTTTMRLPP

SEQ ID NO: 871829 - protein, 9 aa, Homo Sapiens
PLCYPVLMN

SEQ ID NO: 871830 - protein, 9 aa, Homo Sapiens
KSTKDEPRK

SEQ ID NO: 871831 - protein, 9 aa, Homo Sapiens
ETFCGAELV

SEQ ID NO: 871832 - protein, 9 aa, Homo Sapiens
EEVCYFFHR

SEQ ID NO: 871833 - protein, 9 aa, Homo Sapiens
QNNNAPEIL

SEQ ID NO: 871834 - protein, 9 aa, Homo Sapiens
IYYFVMMGI

SEQ ID NO: 871835 - protein, 9 aa, Homo Sapiens
SCTGWQSYG

SEQ ID NO: 871836 - protein, 9 aa, Homo Sapiens
NNYNPTAAG

SEQ ID NO: 871837 - protein, 9 aa, Homo Sapiens
KVKEEQIDT

SEQ ID NO: 871838 - protein, 9 aa, Homo Sapiens
EEERMKQKN

SEQ ID NO: 871839 - protein, 9 aa, Homo Sapiens
SIYKQTAEA

SEQ ID NO: 871840 - protein, 9 aa, Homo Sapiens
QLPTPWKIS

SEQ ID NO: 871841 - protein, 9 aa, Homo Sapiens
AAPAFKPGR

SEQ ID NO: 871842 - protein, 9 aa, Homo Sapiens
ERPLPAICK

SEQ ID NO: 871843 - protein, 9 aa, Homo Sapiens
KYANFGLRL

SEQ ID NO: 871844 - protein, 9 aa, Homo Sapiens
KDFNRRIQN

SEQ ID NO: 871845 - protein, 9 aa, Homo Sapiens
PESENKRKM

SEQ ID NO: 871846 - protein, 9 aa, Homo Sapiens
TGEQICLAG

SEQ ID NO: 871847 - protein, 9 aa, Homo Sapiens
NFAPAPASV

SEQ ID NO: 871848 - protein, 9 aa, Homo Sapiens
TECKMTKSS

SEQ ID NO: 871849 - protein, 9 aa, Homo Sapiens
SKTLYLQQQ

SEQ ID NO: 871850 - protein, 9 aa, Homo Sapiens
FMIDTYCLN

SEQ ID NO: 871851 - protein, 9 aa, Homo Sapiens
SSTGGGLSP

SEQ ID NO: 871852 - protein, 9 aa, Homo Sapiens
DHTEHQIIC

SEQ ID NO: 871853 - protein, 9 aa, Homo Sapiens
TLPTAMQLL

SEQ ID NO: 871854 - protein, 9 aa, Homo Sapiens
ILRTGGDKL

SEQ ID NO: 871855 - protein, 9 aa, Homo Sapiens
LHLVIGIKQ

SEQ ID NO: 871856 - protein, 9 aa, Homo Sapiens
KTINTTLTQ

SEQ ID NO: 871857 - protein, 9 aa, Homo Sapiens
CCLRCLCQQ

SEQ ID NO: 871858 - protein, 9 aa, Homo Sapiens
ETTKDHSIF

SEQ ID NO: 871859 - protein, 9 aa, Homo Sapiens
SLPILTLLN

SEQ ID NO: 871860 - protein, 9 aa, Homo Sapiens
GSDSPDLFI

SEQ ID NO: 871861 - protein, 9 aa, Homo Sapiens
VTLVFLFLN

SEQ ID NO: 871862 - protein, 9 aa, Homo Sapiens
TWSPSAWQM

SEQ ID NO: 871863 - protein, 9 aa, Homo Sapiens
EFLFELGLY

SEQ ID NO: 871864 - protein, 9 aa, Homo Sapiens
ALKKQRTKN

SEQ ID NO: 871865 - protein, 9 aa, Homo Sapiens
LLARRLQNH

SEQ ID NO: 871866 - protein, 9 aa, Homo Sapiens
SLCVSNGWD

SEQ ID NO: 871867 - protein, 9 aa, Homo Sapiens
SLMPQPLGN

SEQ ID NO: 871868 - protein, 9 aa, Homo Sapiens
APDFLNKWS

SEQ ID NO: 871869 - protein, 9 aa, Homo Sapiens
ILALVIVIS

SEQ ID NO: 871870 - protein, 9 aa, Homo Sapiens
LWNLSSPGW

SEQ ID NO: 871871 - protein, 9 aa, Homo Sapiens
NVINNFFCD

SEQ ID NO: 871872 - protein, 9 aa, Homo Sapiens
ASVEYYNPA

SEQ ID NO: 871873 - protein, 9 aa, Homo Sapiens
DDSPFFPQE

SEQ ID NO: 871874 - protein, 9 aa, Homo Sapiens
EENLLGYYV

SEQ ID NO: 871875 - protein, 9 aa, Homo Sapiens
NLCTLISAA

SEQ ID NO: 871876 - protein, 9 aa, Homo Sapiens
HGIIQTLDL

SEQ ID NO: 871877 - protein, 9 aa, Homo Sapiens
AGRIPHPHL

SEQ ID NO: 871878 - protein, 9 aa, Homo Sapiens
SIKPKATET

SEQ ID NO: 871879 - protein, 9 aa, Homo Sapiens
LSNMLKFGF

SEQ ID NO: 871880 - protein, 9 aa, Homo Sapiens
WDVRSGKCF

SEQ ID NO: 871881 - protein, 9 aa, Homo Sapiens
TFKILVATY

SEQ ID NO: 871882 - protein, 9 aa, Homo Sapiens
MFVAELLMV

SEQ ID NO: 871883 - protein, 9 aa, Homo Sapiens
LSTLDKAFE

SEQ ID NO: 871884 - protein, 9 aa, Homo Sapiens
IRLSFHGRH

SEQ ID NO: 871885 - protein, 9 aa, Homo Sapiens
SLSSRTSYY

SEQ ID NO: 871886 - protein, 9 aa, Homo Sapiens
HTTANNKKV

SEQ ID NO: 871887 - protein, 9 aa, Homo Sapiens
VSPSAETQS

SEQ ID NO: 871888 - protein, 9 aa, Homo Sapiens
IKANYLDGF

SEQ ID NO: 871889 - protein, 9 aa, Homo Sapiens
QHYRNELVA

SEQ ID NO: 871890 - protein, 9 aa, Homo Sapiens
DIPVVIDTD

SEQ ID NO: 871891 - protein, 9 aa, Homo Sapiens
AFQYHYQLI

SEQ ID NO: 871892 - protein, 9 aa, Homo Sapiens
YKVQSRLLA

SEQ ID NO: 871893 - protein, 9 aa, Homo Sapiens
HRQGLQTPG

SEQ ID NO: 871894 - protein, 9 aa, Homo Sapiens
NTKQIIDEF

SEQ ID NO: 871895 - protein, 9 aa, Homo Sapiens
NPDVLFEIH

SEQ ID NO: 871896 - protein, 9 aa, Homo Sapiens
PSDLLCPEA

SEQ ID NO: 871897 - protein, 9 aa, Homo Sapiens
VTSISEIPR

SEQ ID NO: 871898 - protein, 9 aa, Homo Sapiens
LQNHYLNVT

SEQ ID NO: 871899 - protein, 9 aa, Homo Sapiens
ADMQEGGTC

SEQ ID NO: 871900 - protein, 9 aa, Homo Sapiens
KTLSFLFNT

SEQ ID NO: 871901 - protein, 9 aa, Homo Sapiens
RIRCGAFML

SEQ ID NO: 871902 - protein, 9 aa, Homo Sapiens
KKNQCLLYK

SEQ ID NO: 871903 - protein, 9 aa, Homo Sapiens
DDYDKNKLV

SEQ ID NO: 871904 - protein, 9 aa, Homo Sapiens
DLVALNLTG

SEQ ID NO: 871905 - protein, 9 aa, Homo Sapiens
TLATVTPRT

SEQ ID NO: 871906 - protein, 9 aa, Homo Sapiens
YIFKYDMWD

SEQ ID NO: 871907 - protein, 9 aa, Homo Sapiens
RHDHTVSLL

SEQ ID NO: 871908 - protein, 9 aa, Homo Sapiens
LKTQVDTQL

SEQ ID NO: 871909 - protein, 9 aa, Homo Sapiens
ILINKNVSE

SEQ ID NO: 871910 - protein, 9 aa, Homo Sapiens
IGAGIQILF

SEQ ID NO: 871911 - protein, 9 aa, Homo Sapiens
QLRNVREQL

SEQ ID NO: 871912 - protein, 9 aa, Homo Sapiens
TKAKYLCIA

SEQ ID NO: 871913 - protein, 9 aa, Homo Sapiens
FSLAPFISP

SEQ ID NO: 871914 - protein, 9 aa, Homo Sapiens
LVIHQQTHT

SEQ ID NO: 871915 - protein, 9 aa, Homo Sapiens
LISKAVYTS

SEQ ID NO: 871916 - protein, 9 aa, Homo Sapiens
CIAKLMLYI

SEQ ID NO: 871917 - protein, 9 aa, Homo Sapiens
LICYQRKHD

SEQ ID NO: 871918 - protein, 9 aa, Homo Sapiens
TTFQVFVFE

SEQ ID NO: 871919 - protein, 9 aa, Homo Sapiens
YTFFECKRS

SEQ ID NO: 871920 - protein, 9 aa, Homo Sapiens
TFQAFILDE

SEQ ID NO: 871921 - protein, 9 aa, Homo Sapiens
RYYQLWVNS

SEQ ID NO: 871922 - protein, 9 aa, Homo Sapiens
QHTCLTLNY

SEQ ID NO: 871923 - protein, 9 aa, Homo Sapiens
TELLQSQVV

SEQ ID NO: 871924 - protein, 9 aa, Homo Sapiens
FDIILMTNN

SEQ ID NO: 871925 - protein, 9 aa, Homo Sapiens
TFVAPDYVL

SEQ ID NO: 871926 - protein, 9 aa, Homo Sapiens
KYFLIGEGE

SEQ ID NO: 871927 - protein, 9 aa, Homo Sapiens
IAVEEERQR

SEQ ID NO: 871928 - protein, 9 aa, Homo Sapiens
AQSQYVCRL

SEQ ID NO: 871929 - protein, 9 aa, Homo Sapiens
IKSTKNINF

SEQ ID NO: 871930 - protein, 9 aa, Homo Sapiens
TVIITDFKD

SEQ ID NO: 871931 - protein, 9 aa, Homo Sapiens
DNFSLKLRI

SEQ ID NO: 871932 - protein, 9 aa, Homo Sapiens
DLGILSVQM

SEQ ID NO: 871933 - protein, 9 aa, Homo Sapiens
STGGGLSPS

SEQ ID NO: 871934 - protein, 9 aa, Homo Sapiens
KKLPAGSTK

SEQ ID NO: 871935 - protein, 9 aa, Homo Sapiens
LSNLDIIKK

SEQ ID NO: 871936 - protein, 9 aa, Homo Sapiens
LKPEWFWGR

SEQ ID NO: 871937 - protein, 9 aa, Homo Sapiens
GEKNQRLFV

SEQ ID NO: 871938 - protein, 9 aa, Homo Sapiens
LVFLLQFSL

SEQ ID NO: 871939 - protein, 9 aa, Homo Sapiens
FQPNTRELW

SEQ ID NO: 871940 - protein, 9 aa, Homo Sapiens
FLCPPGFLR

SEQ ID NO: 871941 - protein, 9 aa, Homo Sapiens
MSTSLNYKS

SEQ ID NO: 871942 - protein, 9 aa, Homo Sapiens
NKDVKYALQ

SEQ ID NO: 871943 - protein, 9 aa, Homo Sapiens
NVGFKEFEN

SEQ ID NO: 871944 - protein, 9 aa, Homo Sapiens
AKWVLLDQT

SEQ ID NO: 871945 - protein, 9 aa, Homo Sapiens
GIWLYNSLK

SEQ ID NO: 871946 - protein, 9 aa, Homo Sapiens
PLRQNQKTP

SEQ ID NO: 871947 - protein, 9 aa, Homo Sapiens
TLENNPSYT

SEQ ID NO: 871948 - protein, 9 aa, Homo Sapiens
HSENEKQRQ

SEQ ID NO: 871949 - protein, 9 aa, Homo Sapiens
VQVTESGTF

SEQ ID NO: 871950 - protein, 9 aa, Homo Sapiens
EDSGGARQS

SEQ ID NO: 871951 - protein, 9 aa, Homo Sapiens
CKGMQCAAG

SEQ ID NO: 871952 - protein, 9 aa, Homo Sapiens
FLAHPGPLL

SEQ ID NO: 871953 - protein, 9 aa, Homo Sapiens
PTKDLYEYK

SEQ ID NO: 871954 - protein, 9 aa, Homo Sapiens
REGFGIQIQ

SEQ ID NO: 871955 - protein, 9 aa, Homo Sapiens
TLSVTALYA

SEQ ID NO: 871956 - protein, 9 aa, Homo Sapiens
CTSCAPPAP

SEQ ID NO: 871957 - protein, 9 aa, Homo Sapiens
QGLDFLSSS

SEQ ID NO: 871958 - protein, 9 aa, Homo Sapiens
VIMSLAQNQ

SEQ ID NO: 871959 - protein, 9 aa, Homo Sapiens
CISHQKFAI

SEQ ID NO: 871960 - protein, 9 aa, Homo Sapiens
GKRFRKSFH

SEQ ID NO: 871961 - protein, 9 aa, Homo Sapiens
PETPKFSTF

SEQ ID NO: 871962 - protein, 9 aa, Homo Sapiens
HYKFENLNT

SEQ ID NO: 871963 - protein, 9 aa, Homo Sapiens
QKENACDQP

SEQ ID NO: 871964 - protein, 9 aa, Homo Sapiens
LGKGCRYLR

SEQ ID NO: 871965 - protein, 9 aa, Homo Sapiens
DCVLLLTNG

SEQ ID NO: 871966 - protein, 9 aa, Homo Sapiens
LGERPSYIM

SEQ ID NO: 871967 - protein, 9 aa, Homo Sapiens
TSKEQEGFI

SEQ ID NO: 871968 - protein, 9 aa, Homo Sapiens
AALFTSKLL

SEQ ID NO: 871969 - protein, 9 aa, Homo Sapiens
SDSPMVMAL

SEQ ID NO: 871970 - protein, 9 aa, Homo Sapiens
FSLTKNSVW

SEQ ID NO: 871971 - protein, 9 aa, Homo Sapiens
CTQQAALPR

SEQ ID NO: 871972 - protein, 9 aa, Homo Sapiens
ALSWLANCK

SEQ ID NO: 871973 - protein, 9 aa, Homo Sapiens
RMCDIERHF

SEQ ID NO: 871974 - protein, 9 aa, Homo Sapiens
LEYQNKVMQ

SEQ ID NO: 871975 - protein, 9 aa, Homo Sapiens
DGVSLCHPV

SEQ ID NO: 871976 - protein, 9 aa, Homo Sapiens
PLPSLLKNH

SEQ ID NO: 871977 - protein, 9 aa, Homo Sapiens
LDHFDKLPI

SEQ ID NO: 871978 - protein, 9 aa, Homo Sapiens
EMAGQINKL

SEQ ID NO: 871979 - protein, 9 aa, Homo Sapiens
KNKYRVLGI

SEQ ID NO: 871980 - protein, 9 aa, Homo Sapiens
CLAEMAQSS

SEQ ID NO: 871981 - protein, 9 aa, Homo Sapiens
EGYLDWSVF

SEQ ID NO: 871982 - protein, 9 aa, Homo Sapiens
QFKQREWKS

SEQ ID NO: 871983 - protein, 9 aa, Homo Sapiens
IIQTLDLPI

SEQ ID NO: 871984 - protein, 9 aa, Homo Sapiens
LLLFSLQIR

SEQ ID NO: 871985 - protein, 9 aa, Homo Sapiens
PGMPRMLPF

SEQ ID NO: 871986 - protein, 9 aa, Homo Sapiens
HTKLNRAMD

SEQ ID NO: 871987 - protein, 9 aa, Homo Sapiens
LQNGPRCLM

SEQ ID NO: 871988 - protein, 9 aa, Homo Sapiens
ACCTQLYQK

SEQ ID NO: 871989 - protein, 9 aa, Homo Sapiens
VDANQHCVC

SEQ ID NO: 871990 - protein, 9 aa, Homo Sapiens
IYDKLFQIH

SEQ ID NO: 871991 - protein, 9 aa, Homo Sapiens
VQKESEEVF

SEQ ID NO: 871992 - protein, 9 aa, Homo Sapiens
TLDTLTKHY

SEQ ID NO: 871993 - protein, 9 aa, Homo Sapiens
PLPAICKHY

SEQ ID NO: 871994 - protein, 9 aa, Homo Sapiens
RRCREIKQV

SEQ ID NO: 871995 - protein, 9 aa, Homo Sapiens
REKKEESKL

SEQ ID NO: 871996 - protein, 9 aa, Homo Sapiens
TQRMWNQSF

SEQ ID NO: 871997 - protein, 9 aa, Homo Sapiens
AMPRSIHDG

SEQ ID NO: 871998 - protein, 9 aa, Homo Sapiens
SRSLSDLAS

SEQ ID NO: 871999 - protein, 9 aa, Homo Sapiens
LLCQSQLTS

SEQ ID NO: 872000 - protein, 9 aa, Homo Sapiens
ELLQSNEQP

SEQ ID NO: 872001 - protein, 9 aa, Homo Sapiens
GDFYFGRRP

SEQ ID NO: 872002 - protein, 9 aa, Homo Sapiens
ALILESKKA

SEQ ID NO: 872003 - protein, 9 aa, Homo Sapiens
RLLSECDAA

SEQ ID NO: 872004 - protein, 9 aa, Homo Sapiens
RYDLLISQF

SEQ ID NO: 872005 - protein, 9 aa, Homo Sapiens
KGNWLQYVN

SEQ ID NO: 872006 - protein, 9 aa, Homo Sapiens
DKRFQKVGL

SEQ ID NO: 872007 - protein, 9 aa, Homo Sapiens
DCNKQGFIN

SEQ ID NO: 872008 - protein, 9 aa, Homo Sapiens
GCRCVLKDC

SEQ ID NO: 872009 - protein, 9 aa, Homo Sapiens
VSGICIKIA

SEQ ID NO: 872010 - protein, 9 aa, Homo Sapiens
YIPVSNPSC

SEQ ID NO: 872011 - protein, 9 aa, Homo Sapiens
SSEKITLET

SEQ ID NO: 872012 - protein, 9 aa, Homo Sapiens
PLDTQNRII

SEQ ID NO: 872013 - protein, 9 aa, Homo Sapiens
CEDQDKCLM

SEQ ID NO: 872014 - protein, 9 aa, Homo Sapiens
CCDPPLTHM

SEQ ID NO: 872015 - protein, 9 aa, Homo Sapiens
EHEKPAQPE

SEQ ID NO: 872016 - protein, 9 aa, Homo Sapiens
KTMASKHSA

SEQ ID NO: 872017 - protein, 9 aa, Homo Sapiens
SYLRLEKMC

SEQ ID NO: 872018 - protein, 9 aa, Homo Sapiens
LKNLESLNF

SEQ ID NO: 872019 - protein, 9 aa, Homo Sapiens
SLRQQNIAI

SEQ ID NO: 872020 - protein, 9 aa, Homo Sapiens
ANTLTSLSN

SEQ ID NO: 872021 - protein, 9 aa, Homo Sapiens
PSAGAFCKT

SEQ ID NO: 872022 - protein, 9 aa, Homo Sapiens
YTRKSQLQV

SEQ ID NO: 872023 - protein, 9 aa, Homo Sapiens
APEILQLLT

SEQ ID NO: 872024 - protein, 9 aa, Homo Sapiens
SYLSVKSLF

SEQ ID NO: 872025 - protein, 9 aa, Homo Sapiens
RSQGWIPVK

SEQ ID NO: 872026 - protein, 9 aa, Homo Sapiens
LGVCLGNSP

SEQ ID NO: 872027 - protein, 9 aa, Homo Sapiens
GSNCLENIA

SEQ ID NO: 872028 - protein, 9 aa, Homo Sapiens
IDHQIPNSQ

SEQ ID NO: 872029 - protein, 9 aa, Homo Sapiens
VTGREGYVS

SEQ ID NO: 872030 - protein, 9 aa, Homo Sapiens
VPLDTQNRI

SEQ ID NO: 872031 - protein, 9 aa, Homo Sapiens
YHTDDCHPW

SEQ ID NO: 872032 - protein, 9 aa, Homo Sapiens
QTDNLKKQN

SEQ ID NO: 872033 - protein, 9 aa, Homo Sapiens
SSYFLNEIL

SEQ ID NO: 872034 - protein, 9 aa, Homo Sapiens
WCETFPSLL

SEQ ID NO: 872035 - protein, 9 aa, Homo Sapiens
AILNQHFCK

SEQ ID NO: 872036 - protein, 9 aa, Homo Sapiens
SFDLQAKEE

SEQ ID NO: 872037 - protein, 9 aa, Homo Sapiens
YGEEGVPGK

SEQ ID NO: 872038 - protein, 9 aa, Homo Sapiens
LHTKLNRAM

SEQ ID NO: 872039 - protein, 9 aa, Homo Sapiens
GNPPRLGTV

SEQ ID NO: 872040 - protein, 9 aa, Homo Sapiens
KHLVYQVEV

SEQ ID NO: 872041 - protein, 9 aa, Homo Sapiens
WVCQMPGKG

SEQ ID NO: 872042 - protein, 9 aa, Homo Sapiens
HELALAGQT

SEQ ID NO: 872043 - protein, 9 aa, Homo Sapiens
VLHTLATDS

SEQ ID NO: 872044 - protein, 9 aa, Homo Sapiens
KKSCWPFSD

SEQ ID NO: 872045 - protein, 9 aa, Homo Sapiens
LQLHPASPA

SEQ ID NO: 872046 - protein, 9 aa, Homo Sapiens
IKLLDGKQS

SEQ ID NO: 872047 - protein, 9 aa, Homo Sapiens
VPLKKMANR

SEQ ID NO: 872048 - protein, 9 aa, Homo Sapiens
KDTMKFLND

SEQ ID NO: 872049 - protein, 9 aa, Homo Sapiens
SVLRHNYQT

SEQ ID NO: 872050 - protein, 9 aa, Homo Sapiens
WSSNGTANY

SEQ ID NO: 872051 - protein, 9 aa, Homo Sapiens
SKDKHFQWA

SEQ ID NO: 872052 - protein, 9 aa, Homo Sapiens
GKVIILHRR

SEQ ID NO: 872053 - protein, 9 aa, Homo Sapiens
KLQQPVSEP

SEQ ID NO: 872054 - protein, 9 aa, Homo Sapiens
TGARVPRFN

SEQ ID NO: 872055 - protein, 9 aa, Homo Sapiens
AALLFEASL

SEQ ID NO: 872056 - protein, 9 aa, Homo Sapiens
KQDAWTIIT

SEQ ID NO: 872057 - protein, 9 aa, Homo Sapiens
PIQALPFSA

SEQ ID NO: 872058 - protein, 9 aa, Homo Sapiens
DIKNALQLI

SEQ ID NO: 872059 - protein, 9 aa, Homo Sapiens
QIQSIKVQF

SEQ ID NO: 872060 - protein, 9 aa, Homo Sapiens
ASVGHCHPK

SEQ ID NO: 872061 - protein, 9 aa, Homo Sapiens
LCSLFFAIL

SEQ ID NO: 872062 - protein, 9 aa, Homo Sapiens
EGCANLLDF

SEQ ID NO: 872063 - protein, 9 aa, Homo Sapiens
LVILIQTDS

SEQ ID NO: 872064 - protein, 9 aa, Homo Sapiens
KVKTMSEGS

SEQ ID NO: 872065 - protein, 9 aa, Homo Sapiens
ILSISKDDL

SEQ ID NO: 872066 - protein, 9 aa, Homo Sapiens
VLDILRYFF

SEQ ID NO: 872067 - protein, 9 aa, Homo Sapiens
LSDGWLKII

SEQ ID NO: 872068 - protein, 9 aa, Homo Sapiens
TVKANVRWK

SEQ ID NO: 872069 - protein, 9 aa, Homo Sapiens
MPQAPPPPP

SEQ ID NO: 872070 - protein, 9 aa, Homo Sapiens
VYKTDNNIV

SEQ ID NO: 872071 - protein, 9 aa, Homo Sapiens
QHKRTVAFL

SEQ ID NO: 872072 - protein, 9 aa, Homo Sapiens
YLEASDYKY

SEQ ID NO: 872073 - protein, 9 aa, Homo Sapiens
GTQQQLFCQ

SEQ ID NO: 872074 - protein, 9 aa, Homo Sapiens
NLPHNRPYF

SEQ ID NO: 872075 - protein, 9 aa, Homo Sapiens
NQTLNLFFT

SEQ ID NO: 872076 - protein, 9 aa, Homo Sapiens
DCDKYVFCM

SEQ ID NO: 872077 - protein, 9 aa, Homo Sapiens
DAKFETKAQ

SEQ ID NO: 872078 - protein, 9 aa, Homo Sapiens
LTIQDPQKK

SEQ ID NO: 872079 - protein, 9 aa, Homo Sapiens
WLWKKKDVK

SEQ ID NO: 872080 - protein, 9 aa, Homo Sapiens
TLTKAQIVK

SEQ ID NO: 872081 - protein, 9 aa, Homo Sapiens
KTNRKTCFI

SEQ ID NO: 872082 - protein, 9 aa, Homo Sapiens
PQLKQWKTF

SEQ ID NO: 872083 - protein, 9 aa, Homo Sapiens
INYQDDAKL

SEQ ID NO: 872084 - protein, 9 aa, Homo Sapiens
KLYCFYSEN

SEQ ID NO: 872085 - protein, 9 aa, Homo Sapiens
KHVFESVQC

SEQ ID NO: 872086 - protein, 9 aa, Homo Sapiens
KQKNEAPLI

SEQ ID NO: 872087 - protein, 9 aa, Homo Sapiens
PNDSGKLTQ

SEQ ID NO: 872088 - protein, 9 aa, Homo Sapiens
YPSHRSFTN

SEQ ID NO: 872089 - protein, 9 aa, Homo Sapiens
LAAEKKCIL

SEQ ID NO: 872090 - protein, 9 aa, Homo Sapiens
LYRRLGEEA

SEQ ID NO: 872091 - protein, 9 aa, Homo Sapiens
SKYLVDHKV

SEQ ID NO: 872092 - protein, 9 aa, Homo Sapiens
CLSPYKSKK

SEQ ID NO: 872093 - protein, 9 aa, Homo Sapiens
KHCYLLVHQ

SEQ ID NO: 872094 - protein, 9 aa, Homo Sapiens
DKDIESIDA

SEQ ID NO: 872095 - protein, 9 aa, Homo Sapiens
QQGGRIMCR

SEQ ID NO: 872096 - protein, 9 aa, Homo Sapiens
GGDSNTNGR

SEQ ID NO: 872097 - protein, 9 aa, Homo Sapiens
GVALITAVA

SEQ ID NO: 872098 - protein, 9 aa, Homo Sapiens
ESVQIIRDW

SEQ ID NO: 872099 - protein, 9 aa, Homo Sapiens
LHSFVQLCA

SEQ ID NO: 872100 - protein, 9 aa, Homo Sapiens
KVLQADWHG

SEQ ID NO: 872101 - protein, 9 aa, Homo Sapiens
TKELTLELK

SEQ ID NO: 872102 - protein, 9 aa, Homo Sapiens
FPESWVISQ

SEQ ID NO: 872103 - protein, 9 aa, Homo Sapiens
SPMVMALVD

SEQ ID NO: 872104 - protein, 9 aa, Homo Sapiens
HHLKKHLRI

SEQ ID NO: 872105 - protein, 9 aa, Homo Sapiens
PSCIWRFAY

SEQ ID NO: 872106 - protein, 9 aa, Homo Sapiens
NEHLACIQV

SEQ ID NO: 872107 - protein, 9 aa, Homo Sapiens
AERMCDIER

SEQ ID NO: 872108 - protein, 9 aa, Homo Sapiens
FNNETFRIS

SEQ ID NO: 872109 - protein, 9 aa, Homo Sapiens
PTVTLLHSE

SEQ ID NO: 872110 - protein, 9 aa, Homo Sapiens
KQVNRIDWP

SEQ ID NO: 872111 - protein, 9 aa, Homo Sapiens
KTGQEVAQA

SEQ ID NO: 872112 - protein, 9 aa, Homo Sapiens
WSSFAVLPW

SEQ ID NO: 872113 - protein, 9 aa, Homo Sapiens
RQHYYPMAG

SEQ ID NO: 872114 - protein, 9 aa, Homo Sapiens
RNSSCLNKY

SEQ ID NO: 872115 - protein, 9 aa, Homo Sapiens
PKDVVYPEI

SEQ ID NO: 872116 - protein, 9 aa, Homo Sapiens
DAILALMPL

SEQ ID NO: 872117 - protein, 9 aa, Homo Sapiens
VCLDVTLSP

SEQ ID NO: 872118 - protein, 9 aa, Homo Sapiens
KIEDASEPL

SEQ ID NO: 872119 - protein, 9 aa, Homo Sapiens
ELMDGGIIV

SEQ ID NO: 872120 - protein, 9 aa, Homo Sapiens
SSPVNKVCR

SEQ ID NO: 872121 - protein, 9 aa, Homo Sapiens
PTASISRVL

SEQ ID NO: 872122 - protein, 9 aa, Homo Sapiens
PMVLGWLML

SEQ ID NO: 872123 - protein, 9 aa, Homo Sapiens
GGCSDVDPG

SEQ ID NO: 872124 - protein, 9 aa, Homo Sapiens
SIYFLSSLL

SEQ ID NO: 872125 - protein, 9 aa, Homo Sapiens
GIIPQIAHD

SEQ ID NO: 872126 - protein, 9 aa, Homo Sapiens
LENIVRNIQ

SEQ ID NO: 872127 - protein, 9 aa, Homo Sapiens
KWGLPGTKN

SEQ ID NO: 872128 - protein, 9 aa, Homo Sapiens
YQKVYVIGG

SEQ ID NO: 872129 - protein, 9 aa, Homo Sapiens
KESVQLLSE

SEQ ID NO: 872130 - protein, 9 aa, Homo Sapiens
ECSLSMWSV

SEQ ID NO: 872131 - protein, 9 aa, Homo Sapiens
AHNRFRLNK

SEQ ID NO: 872132 - protein, 9 aa, Homo Sapiens
NYVAPLELR

SEQ ID NO: 872133 - protein, 9 aa, Homo Sapiens
INFVRAVIS

SEQ ID NO: 872134 - protein, 9 aa, Homo Sapiens
VKCQKLTND

SEQ ID NO: 872135 - protein, 9 aa, Homo Sapiens
RIRQDEEGN

SEQ ID NO: 872136 - protein, 9 aa, Homo Sapiens
SSPEITSPP

SEQ ID NO: 872137 - protein, 9 aa, Homo Sapiens
EARHDHTVS

SEQ ID NO: 872138 - protein, 9 aa, Homo Sapiens
EAEMLPQEL

SEQ ID NO: 872139 - protein, 9 aa, Homo Sapiens
VKYLKKEDA

SEQ ID NO: 872140 - protein, 9 aa, Homo Sapiens
VKRIKEGSA

SEQ ID NO: 872141 - protein, 9 aa, Homo Sapiens
QLQMDGAPP

SEQ ID NO: 872142 - protein, 9 aa, Homo Sapiens
KARSSEVKT

SEQ ID NO: 872143 - protein, 9 aa, Homo Sapiens
EGVTWILFQ

SEQ ID NO: 872144 - protein, 9 aa, Homo Sapiens
SRAPYPSAY

SEQ ID NO: 872145 - protein, 9 aa, Homo Sapiens
SEEVLCSLN

SEQ ID NO: 872146 - protein, 9 aa, Homo Sapiens
GLTDCCNNM

SEQ ID NO: 872147 - protein, 9 aa, Homo Sapiens
IKLNKKSMY

SEQ ID NO: 872148 - protein, 9 aa, Homo Sapiens
YYIDHVSQV

SEQ ID NO: 872149 - protein, 9 aa, Homo Sapiens
VGDKIQILA

SEQ ID NO: 872150 - protein, 9 aa, Homo Sapiens
EVGGGGERG

SEQ ID NO: 872151 - protein, 9 aa, Homo Sapiens
IQLPGYPDS

SEQ ID NO: 872152 - protein, 9 aa, Homo Sapiens
PPVMPQAPP

SEQ ID NO: 872153 - protein, 9 aa, Homo Sapiens
SLIIDIKCT

SEQ ID NO: 872154 - protein, 9 aa, Homo Sapiens
EMLVERLGK

SEQ ID NO: 872155 - protein, 9 aa, Homo Sapiens
FRGPVTTIP

SEQ ID NO: 872156 - protein, 9 aa, Homo Sapiens
RMLLVKRRF

SEQ ID NO: 872157 - protein, 9 aa, Homo Sapiens
VVQPTTVNI

SEQ ID NO: 872158 - protein, 9 aa, Homo Sapiens
QTNKQEKSP

SEQ ID NO: 872159 - protein, 9 aa, Homo Sapiens
KNRQQRDRA

SEQ ID NO: 872160 - protein, 9 aa, Homo Sapiens
NGVVKLMFK

SEQ ID NO: 872161 - protein, 9 aa, Homo Sapiens
PTYYNAWSL

SEQ ID NO: 872162 - protein, 9 aa, Homo Sapiens
ERIPSHKEE

SEQ ID NO: 872163 - protein, 9 aa, Homo Sapiens
FRGVELVCC

SEQ ID NO: 872164 - protein, 9 aa, Homo Sapiens
ALFISLPLI

SEQ ID NO: 872165 - protein, 9 aa, Homo Sapiens
DVCIPSQLN

SEQ ID NO: 872166 - protein, 9 aa, Homo Sapiens
ATAHPAPMV

SEQ ID NO: 872167 - protein, 9 aa, Homo Sapiens
IPVTRTLID

SEQ ID NO: 872168 - protein, 9 aa, Homo Sapiens
IFKRIAGEA

SEQ ID NO: 872169 - protein, 9 aa, Homo Sapiens
LTPQHLNQK

SEQ ID NO: 872170 - protein, 9 aa, Homo Sapiens
SQDNTPGQK

SEQ ID NO: 872171 - protein, 9 aa, Homo Sapiens
LDGLDNKVK

SEQ ID NO: 872172 - protein, 9 aa, Homo Sapiens
LIMWCRGHG

SEQ ID NO: 872173 - protein, 9 aa, Homo Sapiens
PPKTTKKPP

SEQ ID NO: 872174 - protein, 9 aa, Homo Sapiens
TYIHLGFME

SEQ ID NO: 872175 - protein, 9 aa, Homo Sapiens
LPEEPSYPQ

SEQ ID NO: 872176 - protein, 9 aa, Homo Sapiens
HPHVANPQL

SEQ ID NO: 872177 - protein, 9 aa, Homo Sapiens
VADIAVKLL

SEQ ID NO: 872178 - protein, 9 aa, Homo Sapiens
VPCMFMYAR

SEQ ID NO: 872179 - protein, 9 aa, Homo Sapiens
GAKIEVDEN

SEQ ID NO: 872180 - protein, 9 aa, Homo Sapiens
ELAGFAQTE

SEQ ID NO: 872181 - protein, 9 aa, Homo Sapiens
RHESAKADI

SEQ ID NO: 872182 - protein, 9 aa, Homo Sapiens
HSRGSITAL

SEQ ID NO: 872183 - protein, 9 aa, Homo Sapiens
TEVTIEAQP

SEQ ID NO: 872184 - protein, 9 aa, Homo Sapiens
NEWSLKVEY

SEQ ID NO: 872185 - protein, 9 aa, Homo Sapiens
VFEVPKIYA

SEQ ID NO: 872186 - protein, 9 aa, Homo Sapiens
PSSFACHRE

SEQ ID NO: 872187 - protein, 9 aa, Homo Sapiens
ADHLALYDF

SEQ ID NO: 872188 - protein, 9 aa, Homo Sapiens
SLLLWVLLD

SEQ ID NO: 872189 - protein, 9 aa, Homo Sapiens
DGVAASNAA

SEQ ID NO: 872190 - protein, 9 aa, Homo Sapiens
LLHSERPPI

SEQ ID NO: 872191 - protein, 9 aa, Homo Sapiens
MQENYQKNG

SEQ ID NO: 872192 - protein, 9 aa, Homo Sapiens
LKGQRLVFD

SEQ ID NO: 872193 - protein, 9 aa, Homo Sapiens
SQEQITYIQ

SEQ ID NO: 872194 - protein, 9 aa, Homo Sapiens
ATHPCNLKG

SEQ ID NO: 872195 - protein, 9 aa, Homo Sapiens
LQEKTAAAT

SEQ ID NO: 872196 - protein, 9 aa, Homo Sapiens
PGRPLTQLS

SEQ ID NO: 872197 - protein, 9 aa, Homo Sapiens
RQIECLPTS

SEQ ID NO: 872198 - protein, 9 aa, Homo Sapiens
IPLATSLGL

SEQ ID NO: 872199 - protein, 9 aa, Homo Sapiens
VLLLLCGLT

SEQ ID NO: 872200 - protein, 9 aa, Homo Sapiens
NQVLNSNGL

SEQ ID NO: 872201 - protein, 9 aa, Homo Sapiens
AILPMQFNS

SEQ ID NO: 872202 - protein, 9 aa, Homo Sapiens
GRSGTFCTC

SEQ ID NO: 872203 - protein, 9 aa, Homo Sapiens
LSLVMWLGG

SEQ ID NO: 872204 - protein, 9 aa, Homo Sapiens
LRDQDKYCY

SEQ ID NO: 872205 - protein, 9 aa, Homo Sapiens
KIMAKKIST

SEQ ID NO: 872206 - protein, 9 aa, Homo Sapiens
IQNVVLQYG

SEQ ID NO: 872207 - protein, 9 aa, Homo Sapiens
DLSFKKGEI

SEQ ID NO: 872208 - protein, 9 aa, Homo Sapiens
IINCGANVD

SEQ ID NO: 872209 - protein, 9 aa, Homo Sapiens
SKDDDEPDM

SEQ ID NO: 872210 - protein, 9 aa, Homo Sapiens
KRFWDCGLV

SEQ ID NO: 872211 - protein, 9 aa, Homo Sapiens
PFSQGSGSH

SEQ ID NO: 872212 - protein, 9 aa, Homo Sapiens
SNFFHFILA

SEQ ID NO: 872213 - protein, 9 aa, Homo Sapiens
GRDMGNRTS

SEQ ID NO: 872214 - protein, 9 aa, Homo Sapiens
LATCPLNAR

SEQ ID NO: 872215 - protein, 9 aa, Homo Sapiens
LTSNVFIVI

SEQ ID NO: 872216 - protein, 9 aa, Homo Sapiens
EEIIQTKAF

SEQ ID NO: 872217 - protein, 9 aa, Homo Sapiens
EQLEKERRA

SEQ ID NO: 872218 - protein, 9 aa, Homo Sapiens
FRAGRQLHR

SEQ ID NO: 872219 - protein, 9 aa, Homo Sapiens
CFSQEVQVP

SEQ ID NO: 872220 - protein, 9 aa, Homo Sapiens
QKKYKDESD

SEQ ID NO: 872221 - protein, 9 aa, Homo Sapiens
VCNNYWIWE

SEQ ID NO: 872222 - protein, 9 aa, Homo Sapiens
HFMFQNHLC

SEQ ID NO: 872223 - protein, 9 aa, Homo Sapiens
KHLCIQNEW

SEQ ID NO: 872224 - protein, 9 aa, Homo Sapiens
LEISLSVGQ

SEQ ID NO: 872225 - protein, 9 aa, Homo Sapiens
YTLAINVLD

SEQ ID NO: 872226 - protein, 9 aa, Homo Sapiens
LQEIWRLHQ

SEQ ID NO: 872227 - protein, 9 aa, Homo Sapiens
GENWPTRVC

SEQ ID NO: 872228 - protein, 9 aa, Homo Sapiens
IFLWKKYQP

SEQ ID NO: 872229 - protein, 9 aa, Homo Sapiens
GYEGINSPS

SEQ ID NO: 872230 - protein, 9 aa, Homo Sapiens
FIPPVEGCL

SEQ ID NO: 872231 - protein, 9 aa, Homo Sapiens
RKLYLEDSP

SEQ ID NO: 872232 - protein, 9 aa, Homo Sapiens
VPEMMNEVL

SEQ ID NO: 872233 - protein, 9 aa, Homo Sapiens
LWVGTFLCW

SEQ ID NO: 872234 - protein, 9 aa, Homo Sapiens
TLTQHQITH

SEQ ID NO: 872235 - protein, 9 aa, Homo Sapiens
RQQLQIRGL

SEQ ID NO: 872236 - protein, 9 aa, Homo Sapiens
TKSSQGASH

SEQ ID NO: 872237 - protein, 9 aa, Homo Sapiens
DCSVLCGGG

SEQ ID NO: 872238 - protein, 9 aa, Homo Sapiens
ASLSLIFSR

SEQ ID NO: 872239 - protein, 9 aa, Homo Sapiens
EIIRVVISL

SEQ ID NO: 872240 - protein, 9 aa, Homo Sapiens
AKEPSALGK

SEQ ID NO: 872241 - protein, 9 aa, Homo Sapiens
YELKIRYLP

SEQ ID NO: 872242 - protein, 9 aa, Homo Sapiens
PVPTPPGEM

SEQ ID NO: 872243 - protein, 9 aa, Homo Sapiens
MGSNSQVQF

SEQ ID NO: 872244 - protein, 9 aa, Homo Sapiens
YPNPPGTME

SEQ ID NO: 872245 - protein, 9 aa, Homo Sapiens
HFSIYFLSS

SEQ ID NO: 872246 - protein, 9 aa, Homo Sapiens
GQIQLPGYP

SEQ ID NO: 872247 - protein, 9 aa, Homo Sapiens
KPLAERAGD

SEQ ID NO: 872248 - protein, 9 aa, Homo Sapiens
CRVDYKVNF

SEQ ID NO: 872249 - protein, 9 aa, Homo Sapiens
SMQLPLVTD

SEQ ID NO: 872250 - protein, 9 aa, Homo Sapiens
RTEQSTAAR

SEQ ID NO: 872251 - protein, 9 aa, Homo Sapiens
VFNEFVDMD

SEQ ID NO: 872252 - protein, 9 aa, Homo Sapiens
ALIPTGDGH

SEQ ID NO: 872253 - protein, 9 aa, Homo Sapiens
ERYSRKTTP

SEQ ID NO: 872254 - protein, 9 aa, Homo Sapiens
SCICQSSRT

SEQ ID NO: 872255 - protein, 9 aa, Homo Sapiens
RVLLYVQKE

SEQ ID NO: 872256 - protein, 9 aa, Homo Sapiens
KSQEEIEKK

SEQ ID NO: 872257 - protein, 9 aa, Homo Sapiens
QRHMRMHTG

SEQ ID NO: 872258 - protein, 9 aa, Homo Sapiens
IADYIMANY

SEQ ID NO: 872259 - protein, 9 aa, Homo Sapiens
NDGVKVCTC

SEQ ID NO: 872260 - protein, 9 aa, Homo Sapiens
IAAASLLQV

SEQ ID NO: 872261 - protein, 9 aa, Homo Sapiens
GNEHLHQLT

SEQ ID NO: 872262 - protein, 9 aa, Homo Sapiens
SSENDGENS

SEQ ID NO: 872263 - protein, 9 aa, Homo Sapiens
FCVKTSLTR

SEQ ID NO: 872264 - protein, 9 aa, Homo Sapiens
DESPLWNGN

SEQ ID NO: 872265 - protein, 9 aa, Homo Sapiens
EFSWEEVEA

SEQ ID NO: 872266 - protein, 9 aa, Homo Sapiens
RMHTGDKPY

SEQ ID NO: 872267 - protein, 9 aa, Homo Sapiens
EDVFDIILM

SEQ ID NO: 872268 - protein, 9 aa, Homo Sapiens
KFIVTQMAG

SEQ ID NO: 872269 - protein, 9 aa, Homo Sapiens
HILQKHGKN

SEQ ID NO: 872270 - protein, 9 aa, Homo Sapiens
LFDEPTSGL

SEQ ID NO: 872271 - protein, 9 aa, Homo Sapiens
LQEPQFRDA

SEQ ID NO: 872272 - protein, 9 aa, Homo Sapiens
SEEIQMTVV

SEQ ID NO: 872273 - protein, 9 aa, Homo Sapiens
AASKGDFIF

SEQ ID NO: 872274 - protein, 9 aa, Homo Sapiens
IEIATYRCL

SEQ ID NO: 872275 - protein, 9 aa, Homo Sapiens
MEDEDIPFE

SEQ ID NO: 872276 - protein, 9 aa, Homo Sapiens
LWCMERKRD

SEQ ID NO: 872277 - protein, 9 aa, Homo Sapiens
RHCCQCRPG

SEQ ID NO: 872278 - protein, 9 aa, Homo Sapiens
NSIRSYCEK

SEQ ID NO: 872279 - protein, 9 aa, Homo Sapiens
GVPNPINLL

SEQ ID NO: 872280 - protein, 9 aa, Homo Sapiens
KKTPNLSKP

SEQ ID NO: 872281 - protein, 9 aa, Homo Sapiens
ECKLPKIDV

SEQ ID NO: 872282 - protein, 9 aa, Homo Sapiens
FTVEYWGKY

SEQ ID NO: 872283 - protein, 9 aa, Homo Sapiens
PFSPVPKET

SEQ ID NO: 872284 - protein, 9 aa, Homo Sapiens
CGWFVTPLG

SEQ ID NO: 872285 - protein, 9 aa, Homo Sapiens
TGLTDCCNN

SEQ ID NO: 872286 - protein, 9 aa, Homo Sapiens
NDLDSRFWP

SEQ ID NO: 872287 - protein, 9 aa, Homo Sapiens
ISIFFDIYE

SEQ ID NO: 872288 - protein, 9 aa, Homo Sapiens
HQISHTGEE

SEQ ID NO: 872289 - protein, 9 aa, Homo Sapiens
KGSKRKSDQ

SEQ ID NO: 872290 - protein, 9 aa, Homo Sapiens
PLQRPKMLK

SEQ ID NO: 872291 - protein, 9 aa, Homo Sapiens
REVNKRRQE

SEQ ID NO: 872292 - protein, 9 aa, Homo Sapiens
LGEQLQMDG

SEQ ID NO: 872293 - protein, 9 aa, Homo Sapiens
IPGPMSGPA

SEQ ID NO: 872294 - protein, 9 aa, Homo Sapiens
LSVSGAGLQ

SEQ ID NO: 872295 - protein, 9 aa, Homo Sapiens
TMIWQLQKN

SEQ ID NO: 872296 - protein, 9 aa, Homo Sapiens
RPQNELIPL

SEQ ID NO: 872297 - protein, 9 aa, Homo Sapiens
IRHNLSFND

SEQ ID NO: 872298 - protein, 9 aa, Homo Sapiens
ELLEEVKCT

SEQ ID NO: 872299 - protein, 9 aa, Homo Sapiens
SNSTQLPVA

SEQ ID NO: 872300 - protein, 9 aa, Homo Sapiens
LRMDAKINF

SEQ ID NO: 872301 - protein, 9 aa, Homo Sapiens
YHSCGFSYE

SEQ ID NO: 872302 - protein, 9 aa, Homo Sapiens
VDDVKNLNT

SEQ ID NO: 872303 - protein, 9 aa, Homo Sapiens
FFLYSLNQT

SEQ ID NO: 872304 - protein, 9 aa, Homo Sapiens
AEEEDGEKP

SEQ ID NO: 872305 - protein, 9 aa, Homo Sapiens
QHFGVFLVI

SEQ ID NO: 872306 - protein, 9 aa, Homo Sapiens
SPFSLQNTF

SEQ ID NO: 872307 - protein, 9 aa, Homo Sapiens
DPPDLLVLT

SEQ ID NO: 872308 - protein, 9 aa, Homo Sapiens
KTPSSIRKP

SEQ ID NO: 872309 - protein, 9 aa, Homo Sapiens
KVGNCYFTS

SEQ ID NO: 872310 - protein, 9 aa, Homo Sapiens
EESKLKISS

SEQ ID NO: 872311 - protein, 9 aa, Homo Sapiens
VCMDLLVRR

SEQ ID NO: 872312 - protein, 9 aa, Homo Sapiens
GNMQLCEQS

SEQ ID NO: 872313 - protein, 9 aa, Homo Sapiens
SNVNYYNHL

SEQ ID NO: 872314 - protein, 9 aa, Homo Sapiens
EKIWQKVDD

SEQ ID NO: 872315 - protein, 9 aa, Homo Sapiens
LLMFTSVTR

SEQ ID NO: 872316 - protein, 9 aa, Homo Sapiens
DNLHDQVQE

SEQ ID NO: 872317 - protein, 9 aa, Homo Sapiens
KQTHIKNTT

SEQ ID NO: 872318 - protein, 9 aa, Homo Sapiens
RVTNEILHL

SEQ ID NO: 872319 - protein, 9 aa, Homo Sapiens
DPTFSSCVS

SEQ ID NO: 872320 - protein, 9 aa, Homo Sapiens
KSNRVDAHG

SEQ ID NO: 872321 - protein, 9 aa, Homo Sapiens
SSRRPQNDR

SEQ ID NO: 872322 - protein, 9 aa, Homo Sapiens
TKNSVWIGQ

SEQ ID NO: 872323 - protein, 9 aa, Homo Sapiens
PHPALSPIL

SEQ ID NO: 872324 - protein, 9 aa, Homo Sapiens
LYTDKVVAV

SEQ ID NO: 872325 - protein, 9 aa, Homo Sapiens
TDGSTGKTC

SEQ ID NO: 872326 - protein, 9 aa, Homo Sapiens
TDVFLICLS

SEQ ID NO: 872327 - protein, 9 aa, Homo Sapiens
LGRTALILA

SEQ ID NO: 872328 - protein, 9 aa, Homo Sapiens
GQLPSPQHY

SEQ ID NO: 872329 - protein, 9 aa, Homo Sapiens
LIFQLELSR

SEQ ID NO: 872330 - protein, 9 aa, Homo Sapiens
LINLHNNRA

SEQ ID NO: 872331 - protein, 9 aa, Homo Sapiens
RVLKMDSLS

SEQ ID NO: 872332 - protein, 9 aa, Homo Sapiens
MLNPLICTL

SEQ ID NO: 872333 - protein, 9 aa, Homo Sapiens
GHYIEKKTN

SEQ ID NO: 872334 - protein, 9 aa, Homo Sapiens
ANPLLETFG

SEQ ID NO: 872335 - protein, 9 aa, Homo Sapiens
DFTEFFLMI

SEQ ID NO: 872336 - protein, 9 aa, Homo Sapiens
KHSIYIQSI

SEQ ID NO: 872337 - protein, 9 aa, Homo Sapiens
LECRGGVRT

SEQ ID NO: 872338 - protein, 9 aa, Homo Sapiens
IVDYILFKG

SEQ ID NO: 872339 - protein, 9 aa, Homo Sapiens
GTLDPQAPY

SEQ ID NO: 872340 - protein, 9 aa, Homo Sapiens
NQGKLIPPV

SEQ ID NO: 872341 - protein, 9 aa, Homo Sapiens
LRLKLEQVQ

SEQ ID NO: 872342 - protein, 9 aa, Homo Sapiens
KLAASLGLT

SEQ ID NO: 872343 - protein, 9 aa, Homo Sapiens
RAVNADSGY

SEQ ID NO: 872344 - protein, 9 aa, Homo Sapiens
VPELTFSNL

SEQ ID NO: 872345 - protein, 9 aa, Homo Sapiens
QKRPAILHL

SEQ ID NO: 872346 - protein, 9 aa, Homo Sapiens
SPLRLAYYS

SEQ ID NO: 872347 - protein, 9 aa, Homo Sapiens
GNLRKTGQE

SEQ ID NO: 872348 - protein, 9 aa, Homo Sapiens
VKEDIDAKK

SEQ ID NO: 872349 - protein, 9 aa, Homo Sapiens
RYPNWPMVL

SEQ ID NO: 872350 - protein, 9 aa, Homo Sapiens
ETPPPYPKN

SEQ ID NO: 872351 - protein, 9 aa, Homo Sapiens
NNMVWYRQD

SEQ ID NO: 872352 - protein, 9 aa, Homo Sapiens
DKFIEDYIL

SEQ ID NO: 872353 - protein, 9 aa, Homo Sapiens
NAQTGLITT

SEQ ID NO: 872354 - protein, 9 aa, Homo Sapiens
QPQKHREFL

SEQ ID NO: 872355 - protein, 9 aa, Homo Sapiens
VRMIKRFIP

SEQ ID NO: 872356 - protein, 9 aa, Homo Sapiens
GTTGLFLQP

SEQ ID NO: 872357 - protein, 9 aa, Homo Sapiens
IEYQDKPLL

SEQ ID NO: 872358 - protein, 9 aa, Homo Sapiens
EKYFFENED

SEQ ID NO: 872359 - protein, 9 aa, Homo Sapiens
QPVTVYVLV

SEQ ID NO: 872360 - protein, 9 aa, Homo Sapiens
ELVSDFDCK

SEQ ID NO: 872361 - protein, 9 aa, Homo Sapiens
ATHIQDMFT

SEQ ID NO: 872362 - protein, 9 aa, Homo Sapiens
KQVTQLAIN

SEQ ID NO: 872363 - protein, 9 aa, Homo Sapiens
PPPRPGMHL

SEQ ID NO: 872364 - protein, 9 aa, Homo Sapiens
NYSNAESLE

SEQ ID NO: 872365 - protein, 9 aa, Homo Sapiens
CEAFKVSLS

SEQ ID NO: 872366 - protein, 9 aa, Homo Sapiens
LGAHIKKEQ

SEQ ID NO: 872367 - protein, 9 aa, Homo Sapiens
NILEVRGVK

SEQ ID NO: 872368 - protein, 9 aa, Homo Sapiens
FAFVFSVLI

SEQ ID NO: 872369 - protein, 9 aa, Homo Sapiens
LQEVLEREQ

SEQ ID NO: 872370 - protein, 9 aa, Homo Sapiens
GNFQYDNFF

SEQ ID NO: 872371 - protein, 9 aa, Homo Sapiens
SRRPQNDRR

SEQ ID NO: 872372 - protein, 9 aa, Homo Sapiens
LEKCDIFFE

SEQ ID NO: 872373 - protein, 9 aa, Homo Sapiens
GCNMESIRR

SEQ ID NO: 872374 - protein, 9 aa, Homo Sapiens
EAEQLEKER

SEQ ID NO: 872375 - protein, 9 aa, Homo Sapiens
TLNLFFTVL

SEQ ID NO: 872376 - protein, 9 aa, Homo Sapiens
VMYKHMDPP

SEQ ID NO: 872377 - protein, 9 aa, Homo Sapiens
DDVPLSPML

SEQ ID NO: 872378 - protein, 9 aa, Homo Sapiens
QKNGTAEEQ

SEQ ID NO: 872379 - protein, 9 aa, Homo Sapiens
KVTTERSQD

SEQ ID NO: 872380 - protein, 9 aa, Homo Sapiens
DKEGWVKVT

SEQ ID NO: 872381 - protein, 9 aa, Homo Sapiens
SEDGSGKGV

SEQ ID NO: 872382 - protein, 9 aa, Homo Sapiens
GVANCSASI

SEQ ID NO: 872383 - protein, 9 aa, Homo Sapiens
AEPRSKIPL

SEQ ID NO: 872384 - protein, 9 aa, Homo Sapiens
MGEENDSSC

SEQ ID NO: 872385 - protein, 9 aa, Homo Sapiens
AASIGPNPA

SEQ ID NO: 872386 - protein, 9 aa, Homo Sapiens
DKDLPRPLP

SEQ ID NO: 872387 - protein, 9 aa, Homo Sapiens
GLGFGAGSD

SEQ ID NO: 872388 - protein, 9 aa, Homo Sapiens
KEIISEVER

SEQ ID NO: 872389 - protein, 9 aa, Homo Sapiens
LTSHGALRS

SEQ ID NO: 872390 - protein, 9 aa, Homo Sapiens
QRFWGLLRP

SEQ ID NO: 872391 - protein, 9 aa, Homo Sapiens
ACIISPHPA

SEQ ID NO: 872392 - protein, 9 aa, Homo Sapiens
DPSLMRRLV

SEQ ID NO: 872393 - protein, 9 aa, Homo Sapiens
FCSKEGCPA

SEQ ID NO: 872394 - protein, 9 aa, Homo Sapiens
PLTVICDMD

SEQ ID NO: 872395 - protein, 9 aa, Homo Sapiens
LSSLKLQSQ

SEQ ID NO: 872396 - protein, 9 aa, Homo Sapiens
WHRLKHKRD

SEQ ID NO: 872397 - protein, 9 aa, Homo Sapiens
SKLTWYLTS

SEQ ID NO: 872398 - protein, 9 aa, Homo Sapiens
ECGMAFQYH

SEQ ID NO: 872399 - protein, 9 aa, Homo Sapiens
SEIPDHELF

SEQ ID NO: 872400 - protein, 9 aa, Homo Sapiens
QSQVKYTEE

SEQ ID NO: 872401 - protein, 9 aa, Homo Sapiens
KVKKKVVEY

SEQ ID NO: 872402 - protein, 9 aa, Homo Sapiens
PMVPLQILL

SEQ ID NO: 872403 - protein, 9 aa, Homo Sapiens
DNKLRSVIS

SEQ ID NO: 872404 - protein, 9 aa, Homo Sapiens
VTHRQGLQT

SEQ ID NO: 872405 - protein, 9 aa, Homo Sapiens
LQNAIMSYV

SEQ ID NO: 872406 - protein, 9 aa, Homo Sapiens
TRKIEGAQS

SEQ ID NO: 872407 - protein, 9 aa, Homo Sapiens
FCCPAGGNP

SEQ ID NO: 872408 - protein, 9 aa, Homo Sapiens
ATIANNRNL

SEQ ID NO: 872409 - protein, 9 aa, Homo Sapiens
LTHNCGHHK

SEQ ID NO: 872410 - protein, 9 aa, Homo Sapiens
NPAAAAFSH

SEQ ID NO: 872411 - protein, 9 aa, Homo Sapiens
IISEVERNL

SEQ ID NO: 872412 - protein, 9 aa, Homo Sapiens
KPELFQIGA

SEQ ID NO: 872413 - protein, 9 aa, Homo Sapiens
YAKMKMATN

SEQ ID NO: 872414 - protein, 9 aa, Homo Sapiens
AFPVFLQTV

SEQ ID NO: 872415 - protein, 9 aa, Homo Sapiens
KIIKPAKYF

SEQ ID NO: 872416 - protein, 9 aa, Homo Sapiens
QNIAAIKSF

SEQ ID NO: 872417 - protein, 9 aa, Homo Sapiens
PAITKRTFS

SEQ ID NO: 872418 - protein, 9 aa, Homo Sapiens
YYGEQQSTN

SEQ ID NO: 872419 - protein, 9 aa, Homo Sapiens
LHHLTSRHQ

SEQ ID NO: 872420 - protein, 9 aa, Homo Sapiens
EKIWIEIIA

SEQ ID NO: 872421 - protein, 9 aa, Homo Sapiens
LSAWPLSAS

SEQ ID NO: 872422 - protein, 9 aa, Homo Sapiens
HRKPDAKPD

SEQ ID NO: 872423 - protein, 9 aa, Homo Sapiens
MLISLVLRQ

SEQ ID NO: 872424 - protein, 9 aa, Homo Sapiens
LFDIPPQEI

SEQ ID NO: 872425 - protein, 9 aa, Homo Sapiens
WVLLDGGLL

SEQ ID NO: 872426 - protein, 9 aa, Homo Sapiens
DFLSALRQY

SEQ ID NO: 872427 - protein, 9 aa, Homo Sapiens
KYVFDLIDT

SEQ ID NO: 872428 - protein, 9 aa, Homo Sapiens
MCRTALESP

SEQ ID NO: 872429 - protein, 9 aa, Homo Sapiens
MKYVFDLID

SEQ ID NO: 872430 - protein, 9 aa, Homo Sapiens
SLGKTNKQS

SEQ ID NO: 872431 - protein, 9 aa, Homo Sapiens
WHRSSLSES

SEQ ID NO: 872432 - protein, 9 aa, Homo Sapiens
CVREGCAAQ

SEQ ID NO: 872433 - protein, 9 aa, Homo Sapiens
NFDKWRKEF

SEQ ID NO: 872434 - protein, 9 aa, Homo Sapiens
VAYLDVCIP

SEQ ID NO: 872435 - protein, 9 aa, Homo Sapiens
YLDKVMSAV

SEQ ID NO: 872436 - protein, 9 aa, Homo Sapiens
TNQTEAFQK

SEQ ID NO: 872437 - protein, 9 aa, Homo Sapiens
LQSNEQPSL

SEQ ID NO: 872438 - protein, 9 aa, Homo Sapiens
ITDFKDKTK

SEQ ID NO: 872439 - protein, 9 aa, Homo Sapiens
IFPAPDLPA

SEQ ID NO: 872440 - protein, 9 aa, Homo Sapiens
NQHCVCREE

SEQ ID NO: 872441 - protein, 9 aa, Homo Sapiens
MVAATHIVH

SEQ ID NO: 872442 - protein, 9 aa, Homo Sapiens
ELQKRKSVV

SEQ ID NO: 872443 - protein, 9 aa, Homo Sapiens
SRDDRGRVC

SEQ ID NO: 872444 - protein, 9 aa, Homo Sapiens
DTEKIRECL

SEQ ID NO: 872445 - protein, 9 aa, Homo Sapiens
RYVAVYQPL

SEQ ID NO: 872446 - protein, 9 aa, Homo Sapiens
EAGTNGRSL

SEQ ID NO: 872447 - protein, 9 aa, Homo Sapiens
VKVLLSNIE

SEQ ID NO: 872448 - protein, 9 aa, Homo Sapiens
IKSWEEQMI

SEQ ID NO: 872449 - protein, 9 aa, Homo Sapiens
GFPRCPPPR

SEQ ID NO: 872450 - protein, 9 aa, Homo Sapiens
RELEKEATG

SEQ ID NO: 872451 - protein, 9 aa, Homo Sapiens
NQIHQFDYG

SEQ ID NO: 872452 - protein, 9 aa, Homo Sapiens
LSKEAKQKL

SEQ ID NO: 872453 - protein, 9 aa, Homo Sapiens
GGVVALAIT

SEQ ID NO: 872454 - protein, 9 aa, Homo Sapiens
QVQTKAKAE

SEQ ID NO: 872455 - protein, 9 aa, Homo Sapiens
LNARHQVPR

SEQ ID NO: 872456 - protein, 9 aa, Homo Sapiens
IAQVPSDVM

SEQ ID NO: 872457 - protein, 9 aa, Homo Sapiens
IKYISRECA

SEQ ID NO: 872458 - protein, 9 aa, Homo Sapiens
DPESKKAEN

SEQ ID NO: 872459 - protein, 9 aa, Homo Sapiens
RHTLADIIM

SEQ ID NO: 872460 - protein, 9 aa, Homo Sapiens
IYFQGFCVD

SEQ ID NO: 872461 - protein, 9 aa, Homo Sapiens
DQNQYALLL

SEQ ID NO: 872462 - protein, 9 aa, Homo Sapiens
NMLCAGFHE

SEQ ID NO: 872463 - protein, 9 aa, Homo Sapiens
FITLSFPVD

SEQ ID NO: 872464 - protein, 9 aa, Homo Sapiens
LGVIHMWAD

SEQ ID NO: 872465 - protein, 9 aa, Homo Sapiens
MNATIRRTD

SEQ ID NO: 872466 - protein, 9 aa, Homo Sapiens
TYLICYQRK

SEQ ID NO: 872467 - protein, 9 aa, Homo Sapiens
LTAHKIIHN

SEQ ID NO: 872468 - protein, 9 aa, Homo Sapiens
FDDNGQEIK

SEQ ID NO: 872469 - protein, 9 aa, Homo Sapiens
RDNNKDIDS

SEQ ID NO: 872470 - protein, 9 aa, Homo Sapiens
KVVKMIFAV

SEQ ID NO: 872471 - protein, 9 aa, Homo Sapiens
GSLIINKML

SEQ ID NO: 872472 - protein, 9 aa, Homo Sapiens
QLLVSRKSI

SEQ ID NO: 872473 - protein, 9 aa, Homo Sapiens
DSGGARQSV

SEQ ID NO: 872474 - protein, 9 aa, Homo Sapiens
FEINKNRNA

SEQ ID NO: 872475 - protein, 9 aa, Homo Sapiens
RPLHYTALM

SEQ ID NO: 872476 - protein, 9 aa, Homo Sapiens
HYPGPMSAA

SEQ ID NO: 872477 - protein, 9 aa, Homo Sapiens
PIREEDHSC

SEQ ID NO: 872478 - protein, 9 aa, Homo Sapiens
PSGRVQALR

SEQ ID NO: 872479 - protein, 9 aa, Homo Sapiens
TSKINLHQH

SEQ ID NO: 872480 - protein, 9 aa, Homo Sapiens
SLFSPRQNS

SEQ ID NO: 872481 - protein, 9 aa, Homo Sapiens
YRGRRQTPR

SEQ ID NO: 872482 - protein, 9 aa, Homo Sapiens
DKVKTMSEG

SEQ ID NO: 872483 - protein, 9 aa, Homo Sapiens
QVKYTEEYE

SEQ ID NO: 872484 - protein, 9 aa, Homo Sapiens
FLHWLTGEG

SEQ ID NO: 872485 - protein, 9 aa, Homo Sapiens
DSELSNTDS

SEQ ID NO: 872486 - protein, 9 aa, Homo Sapiens
PQEGNVVYK

SEQ ID NO: 872487 - protein, 9 aa, Homo Sapiens
RLQNHMAVA

SEQ ID NO: 872488 - protein, 9 aa, Homo Sapiens
VKANVRWKM

SEQ ID NO: 872489 - protein, 9 aa, Homo Sapiens
ELIIKVQDI

SEQ ID NO: 872490 - protein, 9 aa, Homo Sapiens
NSDVTISYI

SEQ ID NO: 872491 - protein, 9 aa, Homo Sapiens
AICALHHLT

SEQ ID NO: 872492 - protein, 9 aa, Homo Sapiens
VKINDEEIK

SEQ ID NO: 872493 - protein, 9 aa, Homo Sapiens
LAEEYEHIA

SEQ ID NO: 872494 - protein, 9 aa, Homo Sapiens
ATALTPDLC

SEQ ID NO: 872495 - protein, 9 aa, Homo Sapiens
DSEGDTPLN

SEQ ID NO: 872496 - protein, 9 aa, Homo Sapiens
VHEWVPLWL

SEQ ID NO: 872497 - protein, 9 aa, Homo Sapiens
CNRKKDENY

SEQ ID NO: 872498 - protein, 9 aa, Homo Sapiens
KPSFIHPPT

SEQ ID NO: 872499 - protein, 9 aa, Homo Sapiens
TKKCIFQIH

SEQ ID NO: 872500 - protein, 9 aa, Homo Sapiens
INTLYYQLG

SEQ ID NO: 872501 - protein, 9 aa, Homo Sapiens
HTNSCNRCP

SEQ ID NO: 872502 - protein, 9 aa, Homo Sapiens
PHNAHRGFF

SEQ ID NO: 872503 - protein, 9 aa, Homo Sapiens
SHAWDSEEE

SEQ ID NO: 872504 - protein, 9 aa, Homo Sapiens
HAVSQTQGK

SEQ ID NO: 872505 - protein, 9 aa, Homo Sapiens
CGPGLLCQS

SEQ ID NO: 872506 - protein, 9 aa, Homo Sapiens
LFCHKPCRP

SEQ ID NO: 872507 - protein, 9 aa, Homo Sapiens
ALDLQSHGE

SEQ ID NO: 872508 - protein, 9 aa, Homo Sapiens
VSPKFVCEG

SEQ ID NO: 872509 - protein, 9 aa, Homo Sapiens
GSSLAQNCG

SEQ ID NO: 872510 - protein, 9 aa, Homo Sapiens
EQYYRQVDT

SEQ ID NO: 872511 - protein, 9 aa, Homo Sapiens
NYLFLVAVH

SEQ ID NO: 872512 - protein, 9 aa, Homo Sapiens
SHPGTLLIN

SEQ ID NO: 872513 - protein, 9 aa, Homo Sapiens
TVQVISSGE

SEQ ID NO: 872514 - protein, 9 aa, Homo Sapiens
KAQKGEKPC

SEQ ID NO: 872515 - protein, 9 aa, Homo Sapiens
CIYYDYTDV

SEQ ID NO: 872516 - protein, 9 aa, Homo Sapiens
SQKEKRNFP

SEQ ID NO: 872517 - protein, 9 aa, Homo Sapiens
RCLNENTDF

SEQ ID NO: 872518 - protein, 9 aa, Homo Sapiens
TRLCQDEQL

SEQ ID NO: 872519 - protein, 9 aa, Homo Sapiens
HLVQHLQVH

SEQ ID NO: 872520 - protein, 9 aa, Homo Sapiens
VSVRLHHKL

SEQ ID NO: 872521 - protein, 9 aa, Homo Sapiens
LLMAPPLSL

SEQ ID NO: 872522 - protein, 9 aa, Homo Sapiens
PFSGSHLEG

SEQ ID NO: 872523 - protein, 9 aa, Homo Sapiens
MGLICMITE

SEQ ID NO: 872524 - protein, 9 aa, Homo Sapiens
IQKYNTGKG

SEQ ID NO: 872525 - protein, 9 aa, Homo Sapiens
KVLVVFLEK

SEQ ID NO: 872526 - protein, 9 aa, Homo Sapiens
NEYIKTLAN

SEQ ID NO: 872527 - protein, 9 aa, Homo Sapiens
TMGLEWEDA

SEQ ID NO: 872528 - protein, 9 aa, Homo Sapiens
IVIEQPNVK

SEQ ID NO: 872529 - protein, 9 aa, Homo Sapiens
KEKLAYTLP

SEQ ID NO: 872530 - protein, 9 aa, Homo Sapiens
DNSAFMEPR

SEQ ID NO: 872531 - protein, 9 aa, Homo Sapiens
MFGCNMESI

SEQ ID NO: 872532 - protein, 9 aa, Homo Sapiens
RAKRMSFCL

SEQ ID NO: 872533 - protein, 9 aa, Homo Sapiens
QGAIVIEQP

SEQ ID NO: 872534 - protein, 9 aa, Homo Sapiens
ELKDDNFEK

SEQ ID NO: 872535 - protein, 9 aa, Homo Sapiens
KVADLYKLV

SEQ ID NO: 872536 - protein, 9 aa, Homo Sapiens
QAEDLSVQL

SEQ ID NO: 872537 - protein, 9 aa, Homo Sapiens
RVFRPQTPP

SEQ ID NO: 872538 - protein, 9 aa, Homo Sapiens
NKRRVIVPA

SEQ ID NO: 872539 - protein, 9 aa, Homo Sapiens
SYWIGWVCQ

SEQ ID NO: 872540 - protein, 9 aa, Homo Sapiens
KMIQLPSEK

SEQ ID NO: 872541 - protein, 9 aa, Homo Sapiens
KKSSCFIKW

SEQ ID NO: 872542 - protein, 9 aa, Homo Sapiens
VFTKAVVSD

SEQ ID NO: 872543 - protein, 9 aa, Homo Sapiens
QKTGYLVEI

SEQ ID NO: 872544 - protein, 9 aa, Homo Sapiens
MAGNKALSP

SEQ ID NO: 872545 - protein, 9 aa, Homo Sapiens
SGYFCIPLC

SEQ ID NO: 872546 - protein, 9 aa, Homo Sapiens
ARMFPSITP

SEQ ID NO: 872547 - protein, 9 aa, Homo Sapiens
TLGRPPAPP

SEQ ID NO: 872548 - protein, 9 aa, Homo Sapiens
QKNINRTSF

SEQ ID NO: 872549 - protein, 9 aa, Homo Sapiens
QINKLPIEE

SEQ ID NO: 872550 - protein, 9 aa, Homo Sapiens
NPVVSKLLQ

SEQ ID NO: 872551 - protein, 9 aa, Homo Sapiens
CRLQTEECQ

SEQ ID NO: 872552 - protein, 9 aa, Homo Sapiens
SLQKEAAAA

SEQ ID NO: 872553 - protein, 9 aa, Homo Sapiens
QSIWDVISK

SEQ ID NO: 872554 - protein, 9 aa, Homo Sapiens
CMTLYTLTH

SEQ ID NO: 872555 - protein, 9 aa, Homo Sapiens
EGEGSFECA

SEQ ID NO: 872556 - protein, 9 aa, Homo Sapiens
PKTCNRKKD

SEQ ID NO: 872557 - protein, 9 aa, Homo Sapiens
KEISVVIFK

SEQ ID NO: 872558 - protein, 9 aa, Homo Sapiens
HKHKCKCRN

SEQ ID NO: 872559 - protein, 9 aa, Homo Sapiens
DRWKKYLIK

SEQ ID NO: 872560 - protein, 9 aa, Homo Sapiens
PSQPRYSWE

SEQ ID NO: 872561 - protein, 9 aa, Homo Sapiens
LYTLPFHLI

SEQ ID NO: 872562 - protein, 9 aa, Homo Sapiens
PNFHLVGSS

SEQ ID NO: 872563 - protein, 9 aa, Homo Sapiens
LIEREKERD

SEQ ID NO: 872564 - protein, 9 aa, Homo Sapiens
KCFKELNVF

SEQ ID NO: 872565 - protein, 9 aa, Homo Sapiens
HQCIHTDDK

SEQ ID NO: 872566 - protein, 9 aa, Homo Sapiens
GPNTQGFLY

SEQ ID NO: 872567 - protein, 9 aa, Homo Sapiens
YFTEVKVDI

SEQ ID NO: 872568 - protein, 9 aa, Homo Sapiens
HPSSRTTKS

SEQ ID NO: 872569 - protein, 9 aa, Homo Sapiens
AVFPGAPGE

SEQ ID NO: 872570 - protein, 9 aa, Homo Sapiens
NKRQTLQRN

SEQ ID NO: 872571 - protein, 9 aa, Homo Sapiens
GLEQSLLNM

SEQ ID NO: 872572 - protein, 9 aa, Homo Sapiens
PDEVIAKVL

SEQ ID NO: 872573 - protein, 9 aa, Homo Sapiens
EMIKNCSST

SEQ ID NO: 872574 - protein, 9 aa, Homo Sapiens
GGTASVCGE

SEQ ID NO: 872575 - protein, 9 aa, Homo Sapiens
LMWTLFSRG

SEQ ID NO: 872576 - protein, 9 aa, Homo Sapiens
NIWKALSFD

SEQ ID NO: 872577 - protein, 9 aa, Homo Sapiens
EYTFLFALS

SEQ ID NO: 872578 - protein, 9 aa, Homo Sapiens
EGPRSDMES

SEQ ID NO: 872579 - protein, 9 aa, Homo Sapiens
SDTVSQANV

SEQ ID NO: 872580 - protein, 9 aa, Homo Sapiens
PHRRGLGLC

SEQ ID NO: 872581 - protein, 9 aa, Homo Sapiens
NHKSKLEYQ

SEQ ID NO: 872582 - protein, 9 aa, Homo Sapiens
KQVYFHCLH

SEQ ID NO: 872583 - protein, 9 aa, Homo Sapiens
LCYEGKAAL

SEQ ID NO: 872584 - protein, 9 aa, Homo Sapiens
TTKSKITAT

SEQ ID NO: 872585 - protein, 9 aa, Homo Sapiens
PQYTPPSVL

SEQ ID NO: 872586 - protein, 9 aa, Homo Sapiens
TLNKHKTIH

SEQ ID NO: 872587 - protein, 9 aa, Homo Sapiens
HQVPESVEL

SEQ ID NO: 872588 - protein, 9 aa, Homo Sapiens
LNTRHMVKR

SEQ ID NO: 872589 - protein, 9 aa, Homo Sapiens
SPAASALIQ

SEQ ID NO: 872590 - protein, 9 aa, Homo Sapiens
MPQPLGNGI

SEQ ID NO: 872591 - protein, 9 aa, Homo Sapiens
ECDKAFSWS

SEQ ID NO: 872592 - protein, 9 aa, Homo Sapiens
CVKMICRVN

SEQ ID NO: 872593 - protein, 9 aa, Homo Sapiens
HGKKVADTL

SEQ ID NO: 872594 - protein, 9 aa, Homo Sapiens
PLQIPQSYP

SEQ ID NO: 872595 - protein, 9 aa, Homo Sapiens
AAPKRKLSL

SEQ ID NO: 872596 - protein, 9 aa, Homo Sapiens
YKINTLYYQ

SEQ ID NO: 872597 - protein, 9 aa, Homo Sapiens
RVRVWRRHR

SEQ ID NO: 872598 - protein, 9 aa, Homo Sapiens
LYRKYKHQS

SEQ ID NO: 872599 - protein, 9 aa, Homo Sapiens
NHVISVNPN

SEQ ID NO: 872600 - protein, 9 aa, Homo Sapiens
KLLCMYQNA

SEQ ID NO: 872601 - protein, 9 aa, Homo Sapiens
VLWNLSSPG

SEQ ID NO: 872602 - protein, 9 aa, Homo Sapiens
YNLYRDGRK

SEQ ID NO: 872603 - protein, 9 aa, Homo Sapiens
VRDHCVAHK

SEQ ID NO: 872604 - protein, 9 aa, Homo Sapiens
YKLQYGPMT

SEQ ID NO: 872605 - protein, 9 aa, Homo Sapiens
KRTLVIHQQ

SEQ ID NO: 872606 - protein, 9 aa, Homo Sapiens
KARLTEGCF

SEQ ID NO: 872607 - protein, 9 aa, Homo Sapiens
IRSMYDLAE

SEQ ID NO: 872608 - protein, 9 aa, Homo Sapiens
TDLEPLPGA

SEQ ID NO: 872609 - protein, 9 aa, Homo Sapiens
MRDEKLHKL

SEQ ID NO: 872610 - protein, 9 aa, Homo Sapiens
IPGKWTTNG

SEQ ID NO: 872611 - protein, 9 aa, Homo Sapiens
RQIYPPEDK

SEQ ID NO: 872612 - protein, 9 aa, Homo Sapiens
SAVCGFQPI

SEQ ID NO: 872613 - protein, 9 aa, Homo Sapiens
QRKCLSPGS

SEQ ID NO: 872614 - protein, 9 aa, Homo Sapiens
IGPNPALSQ

SEQ ID NO: 872615 - protein, 9 aa, Homo Sapiens
LGMKLLHGE

SEQ ID NO: 872616 - protein, 9 aa, Homo Sapiens
FRKNKMKEQ

SEQ ID NO: 872617 - protein, 9 aa, Homo Sapiens
HQLHKFLCL

SEQ ID NO: 872618 - protein, 9 aa, Homo Sapiens
RVESMKALP

SEQ ID NO: 872619 - protein, 9 aa, Homo Sapiens
GKLGKIQVT

SEQ ID NO: 872620 - protein, 9 aa, Homo Sapiens
TAGNFSFSV

SEQ ID NO: 872621 - protein, 9 aa, Homo Sapiens
FMCDLVPIL

SEQ ID NO: 872622 - protein, 9 aa, Homo Sapiens
PWLVDLFAP

SEQ ID NO: 872623 - protein, 9 aa, Homo Sapiens
QFSYSASGQ

SEQ ID NO: 872624 - protein, 9 aa, Homo Sapiens
YTGEKPYEC

SEQ ID NO: 872625 - protein, 9 aa, Homo Sapiens
IKRDSLQKR

SEQ ID NO: 872626 - protein, 9 aa, Homo Sapiens
KEPTLALKL

SEQ ID NO: 872627 - protein, 9 aa, Homo Sapiens
RIHKLLNGT

SEQ ID NO: 872628 - protein, 9 aa, Homo Sapiens
EIEKLVKDM

SEQ ID NO: 872629 - protein, 9 aa, Homo Sapiens
TILFDIPPQ

SEQ ID NO: 872630 - protein, 9 aa, Homo Sapiens
SPTPCTLTA

SEQ ID NO: 872631 - protein, 9 aa, Homo Sapiens
MQNGYELSP

SEQ ID NO: 872632 - protein, 9 aa, Homo Sapiens
DNFLSSILG

SEQ ID NO: 872633 - protein, 9 aa, Homo Sapiens
RTRAGSRLS

SEQ ID NO: 872634 - protein, 9 aa, Homo Sapiens
LKLINHTKK

SEQ ID NO: 872635 - protein, 9 aa, Homo Sapiens
FLNPLKLAR

SEQ ID NO: 872636 - protein, 9 aa, Homo Sapiens
CPTDSNVSP

SEQ ID NO: 872637 - protein, 9 aa, Homo Sapiens
ADVMCRRKS

SEQ ID NO: 872638 - protein, 9 aa, Homo Sapiens
CNYLLEQYE

SEQ ID NO: 872639 - protein, 9 aa, Homo Sapiens
TQQRGNMVT

SEQ ID NO: 872640 - protein, 9 aa, Homo Sapiens
ARNTLMRVC

SEQ ID NO: 872641 - protein, 9 aa, Homo Sapiens
KTEKAINEL

SEQ ID NO: 872642 - protein, 9 aa, Homo Sapiens
ARACCYGFL

SEQ ID NO: 872643 - protein, 9 aa, Homo Sapiens
NETEANSIN

SEQ ID NO: 872644 - protein, 9 aa, Homo Sapiens
ESGYFCIPL

SEQ ID NO: 872645 - protein, 9 aa, Homo Sapiens
EVGSVCSCV

SEQ ID NO: 872646 - protein, 9 aa, Homo Sapiens
KKNDFEQGK

SEQ ID NO: 872647 - protein, 9 aa, Homo Sapiens
LTDCCNNMP

SEQ ID NO: 872648 - protein, 9 aa, Homo Sapiens
TLYLQQQIF

SEQ ID NO: 872649 - protein, 9 aa, Homo Sapiens
QMTNLYHYI

SEQ ID NO: 872650 - protein, 9 aa, Homo Sapiens
HMFAVNMFQ

SEQ ID NO: 872651 - protein, 9 aa, Homo Sapiens
VKMPEEGEG

SEQ ID NO: 872652 - protein, 9 aa, Homo Sapiens
NKVQIKVLN

SEQ ID NO: 872653 - protein, 9 aa, Homo Sapiens
ICCMNGGSC

SEQ ID NO: 872654 - protein, 9 aa, Homo Sapiens
GKQHGSSRK

SEQ ID NO: 872655 - protein, 9 aa, Homo Sapiens
KVLGLHKLH

SEQ ID NO: 872656 - protein, 9 aa, Homo Sapiens
CDLVPILEL

SEQ ID NO: 872657 - protein, 9 aa, Homo Sapiens
TDNLKKQNA

SEQ ID NO: 872658 - protein, 9 aa, Homo Sapiens
LVATYIHLG

SEQ ID NO: 872659 - protein, 9 aa, Homo Sapiens
KLFQPTEMA

SEQ ID NO: 872660 - protein, 9 aa, Homo Sapiens
KFLIIQNAV

SEQ ID NO: 872661 - protein, 9 aa, Homo Sapiens
LDLKSNNIC

SEQ ID NO: 872662 - protein, 9 aa, Homo Sapiens
TSERTFKCH

SEQ ID NO: 872663 - protein, 9 aa, Homo Sapiens
VKREVNKRR

SEQ ID NO: 872664 - protein, 9 aa, Homo Sapiens
LSVFMWGVN

SEQ ID NO: 872665 - protein, 9 aa, Homo Sapiens
DEHLFPVQI

SEQ ID NO: 872666 - protein, 9 aa, Homo Sapiens
KPEELPELS

SEQ ID NO: 872667 - protein, 9 aa, Homo Sapiens
GGFNDLGYG

SEQ ID NO: 872668 - protein, 9 aa, Homo Sapiens
AVLFAMVLL

SEQ ID NO: 872669 - protein, 9 aa, Homo Sapiens
LHHSDRKPY

SEQ ID NO: 872670 - protein, 9 aa, Homo Sapiens
VKRRDNEEF

SEQ ID NO: 872671 - protein, 9 aa, Homo Sapiens
RQQFPYGAR

SEQ ID NO: 872672 - protein, 9 aa, Homo Sapiens
YKVLIQPLN

SEQ ID NO: 872673 - protein, 9 aa, Homo Sapiens
KLTPLHCAA

SEQ ID NO: 872674 - protein, 9 aa, Homo Sapiens
CHGAPCNPQ

SEQ ID NO: 872675 - protein, 9 aa, Homo Sapiens
PWGDCLRTC

SEQ ID NO: 872676 - protein, 9 aa, Homo Sapiens
HVKCAQCCE

SEQ ID NO: 872677 - protein, 9 aa, Homo Sapiens
LSFNDCFKK

SEQ ID NO: 872678 - protein, 9 aa, Homo Sapiens
TEPPAEPWG

SEQ ID NO: 872679 - protein, 9 aa, Homo Sapiens
IIHEEVYFE

SEQ ID NO: 872680 - protein, 9 aa, Homo Sapiens
EVFDKNRLT

SEQ ID NO: 872681 - protein, 9 aa, Homo Sapiens
MKQKNEAPL

SEQ ID NO: 872682 - protein, 9 aa, Homo Sapiens
KVEGVEPRL

SEQ ID NO: 872683 - protein, 9 aa, Homo Sapiens
EKGDKLQLF

SEQ ID NO: 872684 - protein, 9 aa, Homo Sapiens
STLCSLISS

SEQ ID NO: 872685 - protein, 9 aa, Homo Sapiens
TKKLQNPYS

SEQ ID NO: 872686 - protein, 9 aa, Homo Sapiens
VKALLETSD

SEQ ID NO: 872687 - protein, 9 aa, Homo Sapiens
KFKCKLCCW

SEQ ID NO: 872688 - protein, 9 aa, Homo Sapiens
RQTEDKKRQ

SEQ ID NO: 872689 - protein, 9 aa, Homo Sapiens
QSPVTKIML

SEQ ID NO: 872690 - protein, 9 aa, Homo Sapiens
CLPFSPVPK

SEQ ID NO: 872691 - protein, 9 aa, Homo Sapiens
KPSQQGQYN

SEQ ID NO: 872692 - protein, 9 aa, Homo Sapiens
DQELCKILC

SEQ ID NO: 872693 - protein, 9 aa, Homo Sapiens
EVLKHKVIE

SEQ ID NO: 872694 - protein, 9 aa, Homo Sapiens
HGKAFNLLS

SEQ ID NO: 872695 - protein, 9 aa, Homo Sapiens
GCEYISLAL

SEQ ID NO: 872696 - protein, 9 aa, Homo Sapiens
YQMDDVYKE

SEQ ID NO: 872697 - protein, 9 aa, Homo Sapiens
GKVFNQASC

SEQ ID NO: 872698 - protein, 9 aa, Homo Sapiens
KAVKLKTKD

SEQ ID NO: 872699 - protein, 9 aa, Homo Sapiens
RSRSRSYSQ

SEQ ID NO: 872700 - protein, 9 aa, Homo Sapiens
CKIHLQGQT

SEQ ID NO: 872701 - protein, 9 aa, Homo Sapiens
SETFSTYFT

SEQ ID NO: 872702 - protein, 9 aa, Homo Sapiens
SHGVRVENA

SEQ ID NO: 872703 - protein, 9 aa, Homo Sapiens
VEEWGPFNL

SEQ ID NO: 872704 - protein, 9 aa, Homo Sapiens
SYNKINQLQ

SEQ ID NO: 872705 - protein, 9 aa, Homo Sapiens
KIYALMPSF

SEQ ID NO: 872706 - protein, 9 aa, Homo Sapiens
VTQLAITDY

SEQ ID NO: 872707 - protein, 9 aa, Homo Sapiens
PMAQFLAQF

SEQ ID NO: 872708 - protein, 9 aa, Homo Sapiens
KTMYLQQYV

SEQ ID NO: 872709 - protein, 9 aa, Homo Sapiens
SNVRLHPHT

SEQ ID NO: 872710 - protein, 9 aa, Homo Sapiens
SAADDYTSS

SEQ ID NO: 872711 - protein, 9 aa, Homo Sapiens
YECSDCGQF

SEQ ID NO: 872712 - protein, 9 aa, Homo Sapiens
FLEINENCT

SEQ ID NO: 872713 - protein, 9 aa, Homo Sapiens
DSGLWSQAH

SEQ ID NO: 872714 - protein, 9 aa, Homo Sapiens
DVGISLPKV

SEQ ID NO: 872715 - protein, 9 aa, Homo Sapiens
PQKKISESL

SEQ ID NO: 872716 - protein, 9 aa, Homo Sapiens
HPSNCLGIC

SEQ ID NO: 872717 - protein, 9 aa, Homo Sapiens
TYYFCRWYK

SEQ ID NO: 872718 - protein, 9 aa, Homo Sapiens
EKLWQRLKN

SEQ ID NO: 872719 - protein, 9 aa, Homo Sapiens
MHLRLIYWL

SEQ ID NO: 872720 - protein, 9 aa, Homo Sapiens
IVLRIINEG

SEQ ID NO: 872721 - protein, 9 aa, Homo Sapiens
AKYQENLAV

SEQ ID NO: 872722 - protein, 9 aa, Homo Sapiens
TVPPGECLI

SEQ ID NO: 872723 - protein, 9 aa, Homo Sapiens
DLAVNKTPS

SEQ ID NO: 872724 - protein, 9 aa, Homo Sapiens
DKDAKEAIT

SEQ ID NO: 872725 - protein, 9 aa, Homo Sapiens
MVLLGISCF

SEQ ID NO: 872726 - protein, 9 aa, Homo Sapiens
KQFLLNYLK

SEQ ID NO: 872727 - protein, 9 aa, Homo Sapiens
SKEGTEVSA

SEQ ID NO: 872728 - protein, 9 aa, Homo Sapiens
YSGDALYKL

SEQ ID NO: 872729 - protein, 9 aa, Homo Sapiens
TELPLDNIC

SEQ ID NO: 872730 - protein, 9 aa, Homo Sapiens
ERSVKRIKE

SEQ ID NO: 872731 - protein, 9 aa, Homo Sapiens
QGGCCSPVP

SEQ ID NO: 872732 - protein, 9 aa, Homo Sapiens
LLGLDFGDK

SEQ ID NO: 872733 - protein, 9 aa, Homo Sapiens
FVRMIKRFI

SEQ ID NO: 872734 - protein, 9 aa, Homo Sapiens
LDKKHQNHY

SEQ ID NO: 872735 - protein, 9 aa, Homo Sapiens
GKGDAADGE

SEQ ID NO: 872736 - protein, 9 aa, Homo Sapiens
LSKEQKELF

SEQ ID NO: 872737 - protein, 9 aa, Homo Sapiens
CFIIHGFID

SEQ ID NO: 872738 - protein, 9 aa, Homo Sapiens
KINLIVHQR

SEQ ID NO: 872739 - protein, 9 aa, Homo Sapiens
QLSEEIQMT

SEQ ID NO: 872740 - protein, 9 aa, Homo Sapiens
EFRGKIYNF

SEQ ID NO: 872741 - protein, 9 aa, Homo Sapiens
YSDDLMETL

SEQ ID NO: 872742 - protein, 9 aa, Homo Sapiens
IFLLFINHC

SEQ ID NO: 872743 - protein, 9 aa, Homo Sapiens
WILSVKNNY

SEQ ID NO: 872744 - protein, 9 aa, Homo Sapiens
KIWRPANVP

SEQ ID NO: 872745 - protein, 9 aa, Homo Sapiens
SLEISKPGK

SEQ ID NO: 872746 - protein, 9 aa, Homo Sapiens
FMLLHLIQH

SEQ ID NO: 872747 - protein, 9 aa, Homo Sapiens
KLLRWLQNW

SEQ ID NO: 872748 - protein, 9 aa, Homo Sapiens
KSGSLALMC

SEQ ID NO: 872749 - protein, 9 aa, Homo Sapiens
NSDSEEIET

SEQ ID NO: 872750 - protein, 9 aa, Homo Sapiens
AHTLQNTLQ

SEQ ID NO: 872751 - protein, 9 aa, Homo Sapiens
YVENQFCEF

SEQ ID NO: 872752 - protein, 9 aa, Homo Sapiens
VSTPSYPGY

SEQ ID NO: 872753 - protein, 9 aa, Homo Sapiens
MSVWDQDRE

SEQ ID NO: 872754 - protein, 9 aa, Homo Sapiens
ISELLSHNT

SEQ ID NO: 872755 - protein, 9 aa, Homo Sapiens
KIQRLSEAH

SEQ ID NO: 872756 - protein, 9 aa, Homo Sapiens
SVCLDVTLS

SEQ ID NO: 872757 - protein, 9 aa, Homo Sapiens
PCITNTFFG

SEQ ID NO: 872758 - protein, 9 aa, Homo Sapiens
SSTAKWVLL

SEQ ID NO: 872759 - protein, 9 aa, Homo Sapiens
NEDLNWIIP

SEQ ID NO: 872760 - protein, 9 aa, Homo Sapiens
CKKDLCNGA

SEQ ID NO: 872761 - protein, 9 aa, Homo Sapiens
RVMLQNLTM

SEQ ID NO: 872762 - protein, 9 aa, Homo Sapiens
LKSPGFTSP

SEQ ID NO: 872763 - protein, 9 aa, Homo Sapiens
SLSKLSEEN

SEQ ID NO: 872764 - protein, 9 aa, Homo Sapiens
CFDNKLKTL

SEQ ID NO: 872765 - protein, 9 aa, Homo Sapiens
VELKEAFCR

SEQ ID NO: 872766 - protein, 9 aa, Homo Sapiens
IEEANKLTK

SEQ ID NO: 872767 - protein, 9 aa, Homo Sapiens
KAPDAMKEV

SEQ ID NO: 872768 - protein, 9 aa, Homo Sapiens
CSHGDKLFK

SEQ ID NO: 872769 - protein, 9 aa, Homo Sapiens
KYFALPSVV

SEQ ID NO: 872770 - protein, 9 aa, Homo Sapiens
GEKVLVVFL

SEQ ID NO: 872771 - protein, 9 aa, Homo Sapiens
ITEHRVFFS

SEQ ID NO: 872772 - protein, 9 aa, Homo Sapiens
ELDKYLYGP

SEQ ID NO: 872773 - protein, 9 aa, Homo Sapiens
LGKQIHVSK

SEQ ID NO: 872774 - protein, 9 aa, Homo Sapiens
IYYGDSCYG

SEQ ID NO: 872775 - protein, 9 aa, Homo Sapiens
CQSLDLCTQ

SEQ ID NO: 872776 - protein, 9 aa, Homo Sapiens
IHSLLRREP

SEQ ID NO: 872777 - protein, 9 aa, Homo Sapiens
RMLKATEVM

SEQ ID NO: 872778 - protein, 9 aa, Homo Sapiens
SPKSTGSVC

SEQ ID NO: 872779 - protein, 9 aa, Homo Sapiens
NRTMATTAL

SEQ ID NO: 872780 - protein, 9 aa, Homo Sapiens
DDKDEAAAQ

SEQ ID NO: 872781 - protein, 9 aa, Homo Sapiens
DYIMANYFS

SEQ ID NO: 872782 - protein, 9 aa, Homo Sapiens
ISSKTGETV

SEQ ID NO: 872783 - protein, 9 aa, Homo Sapiens
PRSHCLYAY

SEQ ID NO: 872784 - protein, 9 aa, Homo Sapiens
MYKHMDPPP

SEQ ID NO: 872785 - protein, 9 aa, Homo Sapiens
SKEAKQKLQ

SEQ ID NO: 872786 - protein, 9 aa, Homo Sapiens
IFCDLKLDN

SEQ ID NO: 872787 - protein, 9 aa, Homo Sapiens
SSIIQHERP

SEQ ID NO: 872788 - protein, 9 aa, Homo Sapiens
YAPCGNLSG

SEQ ID NO: 872789 - protein, 9 aa, Homo Sapiens
SLQRHEMTH

SEQ ID NO: 872790 - protein, 9 aa, Homo Sapiens
ASKLATCPL

SEQ ID NO: 872791 - protein, 9 aa, Homo Sapiens
RRPGVQWPC

SEQ ID NO: 872792 - protein, 9 aa, Homo Sapiens
NANISLSSS

SEQ ID NO: 872793 - protein, 9 aa, Homo Sapiens
FMVVKQCSA

SEQ ID NO: 872794 - protein, 9 aa, Homo Sapiens
REKIKYISR

SEQ ID NO: 872795 - protein, 9 aa, Homo Sapiens
YQKKPMKKD

SEQ ID NO: 872796 - protein, 9 aa, Homo Sapiens
QRLMREITQ

SEQ ID NO: 872797 - protein, 9 aa, Homo Sapiens
LIAISSLTY

SEQ ID NO: 872798 - protein, 9 aa, Homo Sapiens
TNSQGDGEH

SEQ ID NO: 872799 - protein, 9 aa, Homo Sapiens
SEMKTLKKY

SEQ ID NO: 872800 - protein, 9 aa, Homo Sapiens
LNVTTDMLK

SEQ ID NO: 872801 - protein, 9 aa, Homo Sapiens
ETHSREMGD

SEQ ID NO: 872802 - protein, 9 aa, Homo Sapiens
KVICHSLWG

SEQ ID NO: 872803 - protein, 9 aa, Homo Sapiens
QAGCLNWWS

SEQ ID NO: 872804 - protein, 9 aa, Homo Sapiens
LAARTIKIQ

SEQ ID NO: 872805 - protein, 9 aa, Homo Sapiens
QCALLQSQP

SEQ ID NO: 872806 - protein, 9 aa, Homo Sapiens
PEPLQRPKM

SEQ ID NO: 872807 - protein, 9 aa, Homo Sapiens
VTNEILHLV

SEQ ID NO: 872808 - protein, 9 aa, Homo Sapiens
HSCGFSYEQ

SEQ ID NO: 872809 - protein, 9 aa, Homo Sapiens
WFWHPSYVG

SEQ ID NO: 872810 - protein, 9 aa, Homo Sapiens
QQEERKVDG

SEQ ID NO: 872811 - protein, 9 aa, Homo Sapiens
VIIILLMFT

SEQ ID NO: 872812 - protein, 9 aa, Homo Sapiens
WKALSFDNR

SEQ ID NO: 872813 - protein, 9 aa, Homo Sapiens
YLGNRYYID

SEQ ID NO: 872814 - protein, 9 aa, Homo Sapiens
ETQRLHGMD

SEQ ID NO: 872815 - protein, 9 aa, Homo Sapiens
RVLVDCILC

SEQ ID NO: 872816 - protein, 9 aa, Homo Sapiens
ILFQLYKEF

SEQ ID NO: 872817 - protein, 9 aa, Homo Sapiens
RKITSFQPV

SEQ ID NO: 872818 - protein, 9 aa, Homo Sapiens
CIWLLILSY

SEQ ID NO: 872819 - protein, 9 aa, Homo Sapiens
YMQQIGNAN

SEQ ID NO: 872820 - protein, 9 aa, Homo Sapiens
LAGDSNIFP

SEQ ID NO: 872821 - protein, 9 aa, Homo Sapiens
ALQRVCKNH

SEQ ID NO: 872822 - protein, 9 aa, Homo Sapiens
HVSSEAGNM

SEQ ID NO: 872823 - protein, 9 aa, Homo Sapiens
LNVLCNFIL

SEQ ID NO: 872824 - protein, 9 aa, Homo Sapiens
ECNGLEEEE

SEQ ID NO: 872825 - protein, 9 aa, Homo Sapiens
VTRGDFLAY

SEQ ID NO: 872826 - protein, 9 aa, Homo Sapiens
SDDVPQKRK

SEQ ID NO: 872827 - protein, 9 aa, Homo Sapiens
KLLNGTRGL

SEQ ID NO: 872828 - protein, 9 aa, Homo Sapiens
SAIWNQRHS

SEQ ID NO: 872829 - protein, 9 aa, Homo Sapiens
QVQDNQQAN

SEQ ID NO: 872830 - protein, 9 aa, Homo Sapiens
ERHSISNGS

SEQ ID NO: 872831 - protein, 9 aa, Homo Sapiens
SERSGGNKK

SEQ ID NO: 872832 - protein, 9 aa, Homo Sapiens
ELPYNDCFE

SEQ ID NO: 872833 - protein, 9 aa, Homo Sapiens
AASALIQTL

SEQ ID NO: 872834 - protein, 9 aa, Homo Sapiens
SGKYVAVEE

SEQ ID NO: 872835 - protein, 9 aa, Homo Sapiens
NGKDVSQSM

SEQ ID NO: 872836 - protein, 9 aa, Homo Sapiens
WHGRPVVLK

SEQ ID NO: 872837 - protein, 9 aa, Homo Sapiens
QTWSLHPLA

SEQ ID NO: 872838 - protein, 9 aa, Homo Sapiens
ELPTIIHEE

SEQ ID NO: 872839 - protein, 9 aa, Homo Sapiens
KRCLNENTD

SEQ ID NO: 872840 - protein, 9 aa, Homo Sapiens
LEPGSEGPN

SEQ ID NO: 872841 - protein, 9 aa, Homo Sapiens
AIEEKLLDD

SEQ ID NO: 872842 - protein, 9 aa, Homo Sapiens
FEASLTLKY

SEQ ID NO: 872843 - protein, 9 aa, Homo Sapiens
LQTNLQHAI

SEQ ID NO: 872844 - protein, 9 aa, Homo Sapiens
HQDIDLLIE

SEQ ID NO: 872845 - protein, 9 aa, Homo Sapiens
CALDYLYYL

SEQ ID NO: 872846 - protein, 9 aa, Homo Sapiens
DNLHVLNQT

SEQ ID NO: 872847 - protein, 9 aa, Homo Sapiens
VHPKEIWTF

SEQ ID NO: 872848 - protein, 9 aa, Homo Sapiens
YRISQQTDI

SEQ ID NO: 872849 - protein, 9 aa, Homo Sapiens
LEVEMSKYA

SEQ ID NO: 872850 - protein, 9 aa, Homo Sapiens
LATWFFINL

SEQ ID NO: 872851 - protein, 9 aa, Homo Sapiens
SVERDIKFE

SEQ ID NO: 872852 - protein, 9 aa, Homo Sapiens
EDAEEVVKV

SEQ ID NO: 872853 - protein, 9 aa, Homo Sapiens
LCGGGEQLR

SEQ ID NO: 872854 - protein, 9 aa, Homo Sapiens
FLFCLLEKH

SEQ ID NO: 872855 - protein, 9 aa, Homo Sapiens
KRYVTTAED

SEQ ID NO: 872856 - protein, 9 aa, Homo Sapiens
CSPTGTGCP

SEQ ID NO: 872857 - protein, 9 aa, Homo Sapiens
KMSAHQYLA

SEQ ID NO: 872858 - protein, 9 aa, Homo Sapiens
EQINMLLKF

SEQ ID NO: 872859 - protein, 9 aa, Homo Sapiens
EAVLSVPDD

SEQ ID NO: 872860 - protein, 9 aa, Homo Sapiens
CMVAHRNSL

SEQ ID NO: 872861 - protein, 9 aa, Homo Sapiens
VQVAENQHF

SEQ ID NO: 872862 - protein, 9 aa, Homo Sapiens
GQKTMYLQQ

SEQ ID NO: 872863 - protein, 9 aa, Homo Sapiens
LSFETDQVI

SEQ ID NO: 872864 - protein, 9 aa, Homo Sapiens
QTYQKKPMK

SEQ ID NO: 872865 - protein, 9 aa, Homo Sapiens
TVGRLDKSN

SEQ ID NO: 872866 - protein, 9 aa, Homo Sapiens
LCTKSCRQS

SEQ ID NO: 872867 - protein, 9 aa, Homo Sapiens
CVLYQKVYV

SEQ ID NO: 872868 - protein, 9 aa, Homo Sapiens
LHRNVHPQE

SEQ ID NO: 872869 - protein, 9 aa, Homo Sapiens
LGAKKEREM

SEQ ID NO: 872870 - protein, 9 aa, Homo Sapiens
HQMWRDQVT

SEQ ID NO: 872871 - protein, 9 aa, Homo Sapiens
KLIKKCSEL

SEQ ID NO: 872872 - protein, 9 aa, Homo Sapiens
ADTVVFLLS

SEQ ID NO: 872873 - protein, 9 aa, Homo Sapiens
VKFCCPAGG

SEQ ID NO: 872874 - protein, 9 aa, Homo Sapiens
HNLKTRTYH

SEQ ID NO: 872875 - protein, 9 aa, Homo Sapiens
NFTIDLKHE

SEQ ID NO: 872876 - protein, 9 aa, Homo Sapiens
PLPKEVNYS

SEQ ID NO: 872877 - protein, 9 aa, Homo Sapiens
RALINLHNN

SEQ ID NO: 872878 - protein, 9 aa, Homo Sapiens
SPLQIPQSY

SEQ ID NO: 872879 - protein, 9 aa, Homo Sapiens
AEREPDPFK

SEQ ID NO: 872880 - protein, 9 aa, Homo Sapiens
GDLDERRLF

SEQ ID NO: 872881 - protein, 9 aa, Homo Sapiens
NPNHDGNYL

SEQ ID NO: 872882 - protein, 9 aa, Homo Sapiens
GKLVRQTTE

SEQ ID NO: 872883 - protein, 9 aa, Homo Sapiens
QSEQNMKLC

SEQ ID NO: 872884 - protein, 9 aa, Homo Sapiens
GELPTHKQV

SEQ ID NO: 872885 - protein, 9 aa, Homo Sapiens
GAPSPQHTN

SEQ ID NO: 872886 - protein, 9 aa, Homo Sapiens
GARPGTLLE

SEQ ID NO: 872887 - protein, 9 aa, Homo Sapiens
YAQIFQFQN

SEQ ID NO: 872888 - protein, 9 aa, Homo Sapiens
CGLTTVSVG

SEQ ID NO: 872889 - protein, 9 aa, Homo Sapiens
FRVFCLQNP

SEQ ID NO: 872890 - protein, 9 aa, Homo Sapiens
EGRRQHYRN

SEQ ID NO: 872891 - protein, 9 aa, Homo Sapiens
LFFGPCMFI

SEQ ID NO: 872892 - protein, 9 aa, Homo Sapiens
IKIDQAWKI

SEQ ID NO: 872893 - protein, 9 aa, Homo Sapiens
QSLNENSAR

SEQ ID NO: 872894 - protein, 9 aa, Homo Sapiens
NHDKVASIF

SEQ ID NO: 872895 - protein, 9 aa, Homo Sapiens
EKHKHKCKC

SEQ ID NO: 872896 - protein, 9 aa, Homo Sapiens
IEVANVNDN

SEQ ID NO: 872897 - protein, 9 aa, Homo Sapiens
KLKAIKQLK

SEQ ID NO: 872898 - protein, 9 aa, Homo Sapiens
QSGNLRIHE

SEQ ID NO: 872899 - protein, 9 aa, Homo Sapiens
QKNFLSLIV

SEQ ID NO: 872900 - protein, 9 aa, Homo Sapiens
TFWIKSGNE

SEQ ID NO: 872901 - protein, 9 aa, Homo Sapiens
LAVASQWER

SEQ ID NO: 872902 - protein, 9 aa, Homo Sapiens
GKSFSYKIN

SEQ ID NO: 872903 - protein, 9 aa, Homo Sapiens
DLIKITDAK

SEQ ID NO: 872904 - protein, 9 aa, Homo Sapiens
FHFEPNNYF

SEQ ID NO: 872905 - protein, 9 aa, Homo Sapiens
RILHMLNRL

SEQ ID NO: 872906 - protein, 9 aa, Homo Sapiens
NNYWILNAQ

SEQ ID NO: 872907 - protein, 9 aa, Homo Sapiens
NRDAILALM

SEQ ID NO: 872908 - protein, 9 aa, Homo Sapiens
VIHQLFCDI

SEQ ID NO: 872909 - protein, 9 aa, Homo Sapiens
CYFFHRSPQ

SEQ ID NO: 872910 - protein, 9 aa, Homo Sapiens
LLNRCRQAG

SEQ ID NO: 872911 - protein, 9 aa, Homo Sapiens
ILRAVRASS

SEQ ID NO: 872912 - protein, 9 aa, Homo Sapiens
WERVFLTHP

SEQ ID NO: 872913 - protein, 9 aa, Homo Sapiens
HILAKIWWK

SEQ ID NO: 872914 - protein, 9 aa, Homo Sapiens
EICHEVSFK

SEQ ID NO: 872915 - protein, 9 aa, Homo Sapiens
QLERLLIEN

SEQ ID NO: 872916 - protein, 9 aa, Homo Sapiens
SSPEEGKFI

SEQ ID NO: 872917 - protein, 9 aa, Homo Sapiens
ESNVNYYNH

SEQ ID NO: 872918 - protein, 9 aa, Homo Sapiens
QYTPPSVLP

SEQ ID NO: 872919 - protein, 9 aa, Homo Sapiens
GECSQLWDT

SEQ ID NO: 872920 - protein, 9 aa, Homo Sapiens
SKVAVSITI

SEQ ID NO: 872921 - protein, 9 aa, Homo Sapiens
YSCSLHARI

SEQ ID NO: 872922 - protein, 9 aa, Homo Sapiens
KSIPSYAFN

SEQ ID NO: 872923 - protein, 9 aa, Homo Sapiens
YRDSKEKRY

SEQ ID NO: 872924 - protein, 9 aa, Homo Sapiens
HSLVLRVQE

SEQ ID NO: 872925 - protein, 9 aa, Homo Sapiens
PLVGLLLFY

SEQ ID NO: 872926 - protein, 9 aa, Homo Sapiens
DAQQRISKD

SEQ ID NO: 872927 - protein, 9 aa, Homo Sapiens
QELDKFANQ

SEQ ID NO: 872928 - protein, 9 aa, Homo Sapiens
QQIFPLMLS

SEQ ID NO: 872929 - protein, 9 aa, Homo Sapiens
HLIQMAVAL

SEQ ID NO: 872930 - protein, 9 aa, Homo Sapiens
WISQVAVPA

SEQ ID NO: 872931 - protein, 9 aa, Homo Sapiens
LDVQSVADG

SEQ ID NO: 872932 - protein, 9 aa, Homo Sapiens
CCDDLEEAQ

SEQ ID NO: 872933 - protein, 9 aa, Homo Sapiens
LKSNNICTI

SEQ ID NO: 872934 - protein, 9 aa, Homo Sapiens
ICAKKRSDE

SEQ ID NO: 872935 - protein, 9 aa, Homo Sapiens
VESDNYVQA

SEQ ID NO: 872936 - protein, 9 aa, Homo Sapiens
LRQLVLNNY

SEQ ID NO: 872937 - protein, 9 aa, Homo Sapiens
NNCLIVLSD

SEQ ID NO: 872938 - protein, 9 aa, Homo Sapiens
VIGLSFDLV

SEQ ID NO: 872939 - protein, 9 aa, Homo Sapiens
KHGHKHELL

SEQ ID NO: 872940 - protein, 9 aa, Homo Sapiens
ADSAACCNY

SEQ ID NO: 872941 - protein, 9 aa, Homo Sapiens
NIVRNIQAS

SEQ ID NO: 872942 - protein, 9 aa, Homo Sapiens
DVENGPVEI

SEQ ID NO: 872943 - protein, 9 aa, Homo Sapiens
TLFLHTRNV

SEQ ID NO: 872944 - protein, 9 aa, Homo Sapiens
GNSKVIDVK

SEQ ID NO: 872945 - protein, 9 aa, Homo Sapiens
YSSMVPQLY

SEQ ID NO: 872946 - protein, 9 aa, Homo Sapiens
MAQTHSGLT

SEQ ID NO: 872947 - protein, 9 aa, Homo Sapiens
TRHYIDSPP

SEQ ID NO: 872948 - protein, 9 aa, Homo Sapiens
EGILRTGGD

SEQ ID NO: 872949 - protein, 9 aa, Homo Sapiens
HYYPMAGYI

SEQ ID NO: 872950 - protein, 9 aa, Homo Sapiens
NNIPFLQNA

SEQ ID NO: 872951 - protein, 9 aa, Homo Sapiens
QRTKNNKEE

SEQ ID NO: 872952 - protein, 9 aa, Homo Sapiens
RHKKAHSGE

SEQ ID NO: 872953 - protein, 9 aa, Homo Sapiens
AFSYLNSFQ

SEQ ID NO: 872954 - protein, 9 aa, Homo Sapiens
CLKHGAKLV

SEQ ID NO: 872955 - protein, 9 aa, Homo Sapiens
EEKNKIGHL

SEQ ID NO: 872956 - protein, 9 aa, Homo Sapiens
ECRASNNPK

SEQ ID NO: 872957 - protein, 9 aa, Homo Sapiens
TEIEKMAEK

SEQ ID NO: 872958 - protein, 9 aa, Homo Sapiens
QSRYQSDPN

SEQ ID NO: 872959 - protein, 9 aa, Homo Sapiens
LDNKLRSVI

SEQ ID NO: 872960 - protein, 9 aa, Homo Sapiens
QAPHIHRWT

SEQ ID NO: 872961 - protein, 9 aa, Homo Sapiens
LQSKCPAEG

SEQ ID NO: 872962 - protein, 9 aa, Homo Sapiens
VTSCQPNNP

SEQ ID NO: 872963 - protein, 9 aa, Homo Sapiens
NIKQNNSWT

SEQ ID NO: 872964 - protein, 9 aa, Homo Sapiens
FVGKWMNKF

SEQ ID NO: 872965 - protein, 9 aa, Homo Sapiens
DLAGCAEIL

SEQ ID NO: 872966 - protein, 9 aa, Homo Sapiens
NNKDIDSEK

SEQ ID NO: 872967 - protein, 9 aa, Homo Sapiens
GELRNGQVD

SEQ ID NO: 872968 - protein, 9 aa, Homo Sapiens
SGPFSKIVL

SEQ ID NO: 872969 - protein, 9 aa, Homo Sapiens
GHLTSHGAL

SEQ ID NO: 872970 - protein, 9 aa, Homo Sapiens
GAGFQSNPV

SEQ ID NO: 872971 - protein, 9 aa, Homo Sapiens
KNKNKNDPE

SEQ ID NO: 872972 - protein, 9 aa, Homo Sapiens
ALFVDIQLP

SEQ ID NO: 872973 - protein, 9 aa, Homo Sapiens
NDDLQTTAL

SEQ ID NO: 872974 - protein, 9 aa, Homo Sapiens
PPVMLFDEP

SEQ ID NO: 872975 - protein, 9 aa, Homo Sapiens
PCNAQELEK

SEQ ID NO: 872976 - protein, 9 aa, Homo Sapiens
SASKFLPMS

SEQ ID NO: 872977 - protein, 9 aa, Homo Sapiens
SPVACQTPV

SEQ ID NO: 872978 - protein, 9 aa, Homo Sapiens
IGYIGMVVL

SEQ ID NO: 872979 - protein, 9 aa, Homo Sapiens
INHIQNGID

SEQ ID NO: 872980 - protein, 9 aa, Homo Sapiens
ASTSPPCAS

SEQ ID NO: 872981 - protein, 9 aa, Homo Sapiens
KCSELYEAE

SEQ ID NO: 872982 - protein, 9 aa, Homo Sapiens
LRHIHLENN

SEQ ID NO: 872983 - protein, 9 aa, Homo Sapiens
LLIQNDYFI

SEQ ID NO: 872984 - protein, 9 aa, Homo Sapiens
QKYNTGKGL

SEQ ID NO: 872985 - protein, 9 aa, Homo Sapiens
AVEKRNFLG

SEQ ID NO: 872986 - protein, 9 aa, Homo Sapiens
GEKPFWCTF

SEQ ID NO: 872987 - protein, 9 aa, Homo Sapiens
ILTNGVLSR

SEQ ID NO: 872988 - protein, 9 aa, Homo Sapiens
SKEICNELE

SEQ ID NO: 872989 - protein, 9 aa, Homo Sapiens
EFQGKQMHV

SEQ ID NO: 872990 - protein, 9 aa, Homo Sapiens
CSLISSSSG

SEQ ID NO: 872991 - protein, 9 aa, Homo Sapiens
QPRKLRHNL

SEQ ID NO: 872992 - protein, 9 aa, Homo Sapiens
LLETLNARA

SEQ ID NO: 872993 - protein, 9 aa, Homo Sapiens
GYRGKKCQE

SEQ ID NO: 872994 - protein, 9 aa, Homo Sapiens
TYLSCQACA

SEQ ID NO: 872995 - protein, 9 aa, Homo Sapiens
FRGFWSTKS

SEQ ID NO: 872996 - protein, 9 aa, Homo Sapiens
FLKGTTTWE

SEQ ID NO: 872997 - protein, 9 aa, Homo Sapiens
QNIMDFKLF

SEQ ID NO: 872998 - protein, 9 aa, Homo Sapiens
KWMERGISV

SEQ ID NO: 872999 - protein, 9 aa, Homo Sapiens
NLKAEIEKL

SEQ ID NO: 873000 - protein, 9 aa, Homo Sapiens
KDIESIDAT

SEQ ID NO: 873001 - protein, 9 aa, Homo Sapiens
IQKAEEVLL

SEQ ID NO: 873002 - protein, 9 aa, Homo Sapiens
VHQSPVTKI

SEQ ID NO: 873003 - protein, 9 aa, Homo Sapiens
GARYDRRHE

SEQ ID NO: 873004 - protein, 9 aa, Homo Sapiens
VEYWGKYGP

SEQ ID NO: 873005 - protein, 9 aa, Homo Sapiens
SKCCDDLEE

SEQ ID NO: 873006 - protein, 9 aa, Homo Sapiens
KGECASQTV

SEQ ID NO: 873007 - protein, 9 aa, Homo Sapiens
DYHNQVWGK

SEQ ID NO: 873008 - protein, 9 aa, Homo Sapiens
ICARRSMDE

SEQ ID NO: 873009 - protein, 9 aa, Homo Sapiens
SLLQWKSVC

SEQ ID NO: 873010 - protein, 9 aa, Homo Sapiens
PQMNPFVLI

SEQ ID NO: 873011 - protein, 9 aa, Homo Sapiens
FQLLLPVLD

SEQ ID NO: 873012 - protein, 9 aa, Homo Sapiens
IKKEQEEEA

SEQ ID NO: 873013 - protein, 9 aa, Homo Sapiens
LRTGGFLIE

SEQ ID NO: 873014 - protein, 9 aa, Homo Sapiens
GQYNMTYER

SEQ ID NO: 873015 - protein, 9 aa, Homo Sapiens
GQTSVLLSL

SEQ ID NO: 873016 - protein, 9 aa, Homo Sapiens
YLVIMCSPV

SEQ ID NO: 873017 - protein, 9 aa, Homo Sapiens
GEDAGCRPA

SEQ ID NO: 873018 - protein, 9 aa, Homo Sapiens
FTENTTDGQ

SEQ ID NO: 873019 - protein, 9 aa, Homo Sapiens
AHTEILAKR

SEQ ID NO: 873020 - protein, 9 aa, Homo Sapiens
TKQIIDEFE

SEQ ID NO: 873021 - protein, 9 aa, Homo Sapiens
SNSALILES

SEQ ID NO: 873022 - protein, 9 aa, Homo Sapiens
PSELIIKVQ

SEQ ID NO: 873023 - protein, 9 aa, Homo Sapiens
LSTPMGKGV

SEQ ID NO: 873024 - protein, 9 aa, Homo Sapiens
GMQFVLLQT

SEQ ID NO: 873025 - protein, 9 aa, Homo Sapiens
RQTRKSINY

SEQ ID NO: 873026 - protein, 9 aa, Homo Sapiens
ATENDIANL

SEQ ID NO: 873027 - protein, 9 aa, Homo Sapiens
NQYICRLNW

SEQ ID NO: 873028 - protein, 9 aa, Homo Sapiens
EPGSEGPNL

SEQ ID NO: 873029 - protein, 9 aa, Homo Sapiens
QTLKDKADP

SEQ ID NO: 873030 - protein, 9 aa, Homo Sapiens
SLSSTLNKH

SEQ ID NO: 873031 - protein, 9 aa, Homo Sapiens
SEMAPRNLK

SEQ ID NO: 873032 - protein, 9 aa, Homo Sapiens
ALILHQIIH

SEQ ID NO: 873033 - protein, 9 aa, Homo Sapiens
LFTDFVHPL

SEQ ID NO: 873034 - protein, 9 aa, Homo Sapiens
WKKKDVKSY

SEQ ID NO: 873035 - protein, 9 aa, Homo Sapiens
LAEMAGQIN

SEQ ID NO: 873036 - protein, 9 aa, Homo Sapiens
LSVAVVVGI

SEQ ID NO: 873037 - protein, 9 aa, Homo Sapiens
PCMFIYVWP

SEQ ID NO: 873038 - protein, 9 aa, Homo Sapiens
QGFDQLQLE

SEQ ID NO: 873039 - protein, 9 aa, Homo Sapiens
CLPVVLTLN

SEQ ID NO: 873040 - protein, 9 aa, Homo Sapiens
FYVFYILIV

SEQ ID NO: 873041 - protein, 9 aa, Homo Sapiens
YSRSRSQSR

SEQ ID NO: 873042 - protein, 9 aa, Homo Sapiens
VQQLQTSFQ

SEQ ID NO: 873043 - protein, 9 aa, Homo Sapiens
DDDHLSRRA

SEQ ID NO: 873044 - protein, 9 aa, Homo Sapiens
VNKSWRKIK

SEQ ID NO: 873045 - protein, 9 aa, Homo Sapiens
LQIRGLPVS

SEQ ID NO: 873046 - protein, 9 aa, Homo Sapiens
QRGQYSDSV

SEQ ID NO: 873047 - protein, 9 aa, Homo Sapiens
CNTARQGLK

SEQ ID NO: 873048 - protein, 9 aa, Homo Sapiens
KAGKEEWKG

SEQ ID NO: 873049 - protein, 9 aa, Homo Sapiens
LSPAEIRRS

SEQ ID NO: 873050 - protein, 9 aa, Homo Sapiens
SLKALMLPS

SEQ ID NO: 873051 - protein, 9 aa, Homo Sapiens
PHSHTLKGQ

SEQ ID NO: 873052 - protein, 9 aa, Homo Sapiens
QLAAPIIIL

SEQ ID NO: 873053 - protein, 9 aa, Homo Sapiens
TPSPNKHSI

SEQ ID NO: 873054 - protein, 9 aa, Homo Sapiens
PKNLAAPSG

SEQ ID NO: 873055 - protein, 9 aa, Homo Sapiens
HVANPQLQM

SEQ ID NO: 873056 - protein, 9 aa, Homo Sapiens
GLEDWRNKW

SEQ ID NO: 873057 - protein, 9 aa, Homo Sapiens
GSLPRYFEL

SEQ ID NO: 873058 - protein, 9 aa, Homo Sapiens
HCIFQFVCL

SEQ ID NO: 873059 - protein, 9 aa, Homo Sapiens
HYTALMHPR

SEQ ID NO: 873060 - protein, 9 aa, Homo Sapiens
QKEASTFNL

SEQ ID NO: 873061 - protein, 9 aa, Homo Sapiens
RETYCYLTD

SEQ ID NO: 873062 - protein, 9 aa, Homo Sapiens
GDHRSQRRH

SEQ ID NO: 873063 - protein, 9 aa, Homo Sapiens
LGHLTSHGA

SEQ ID NO: 873064 - protein, 9 aa, Homo Sapiens
RGSLNTYRL

SEQ ID NO: 873065 - protein, 9 aa, Homo Sapiens
EQIIKEKEE

SEQ ID NO: 873066 - protein, 9 aa, Homo Sapiens
EILLPHRRG

SEQ ID NO: 873067 - protein, 9 aa, Homo Sapiens
SRVKRPIEN

SEQ ID NO: 873068 - protein, 9 aa, Homo Sapiens
YECVECGKL

SEQ ID NO: 873069 - protein, 9 aa, Homo Sapiens
HQAAQNTIC

SEQ ID NO: 873070 - protein, 9 aa, Homo Sapiens
VKDEKICQA

SEQ ID NO: 873071 - protein, 9 aa, Homo Sapiens
FHITNDESI

SEQ ID NO: 873072 - protein, 9 aa, Homo Sapiens
EEDNNIVVD

SEQ ID NO: 873073 - protein, 9 aa, Homo Sapiens
YALSLVMWL

SEQ ID NO: 873074 - protein, 9 aa, Homo Sapiens
EGYYAYYLS

SEQ ID NO: 873075 - protein, 9 aa, Homo Sapiens
WRIRQDEEG

SEQ ID NO: 873076 - protein, 9 aa, Homo Sapiens
LLKARTSKE

SEQ ID NO: 873077 - protein, 9 aa, Homo Sapiens
MTNEDNPEE

SEQ ID NO: 873078 - protein, 9 aa, Homo Sapiens
HHRRVRVSY

SEQ ID NO: 873079 - protein, 9 aa, Homo Sapiens
NILAALKEL

SEQ ID NO: 873080 - protein, 9 aa, Homo Sapiens
IIVVCSVFL

SEQ ID NO: 873081 - protein, 9 aa, Homo Sapiens
KMPEEGEGQ

SEQ ID NO: 873082 - protein, 9 aa, Homo Sapiens
LYPINISLN

SEQ ID NO: 873083 - protein, 9 aa, Homo Sapiens
LPERAKLAA

SEQ ID NO: 873084 - protein, 9 aa, Homo Sapiens
RFSSRRPQN

SEQ ID NO: 873085 - protein, 9 aa, Homo Sapiens
AKDIEEELE

SEQ ID NO: 873086 - protein, 9 aa, Homo Sapiens
LAQNCGKLE

SEQ ID NO: 873087 - protein, 9 aa, Homo Sapiens
LDNDDLQTT

SEQ ID NO: 873088 - protein, 9 aa, Homo Sapiens
LLLHCGPWD

SEQ ID NO: 873089 - protein, 9 aa, Homo Sapiens
GGAGKYLAK

SEQ ID NO: 873090 - protein, 9 aa, Homo Sapiens
ELCCYLCKQ

SEQ ID NO: 873091 - protein, 9 aa, Homo Sapiens
QIPRRDIGN

SEQ ID NO: 873092 - protein, 9 aa, Homo Sapiens
TFKQRQIKL

SEQ ID NO: 873093 - protein, 9 aa, Homo Sapiens
IYQMDDVYK

SEQ ID NO: 873094 - protein, 9 aa, Homo Sapiens
LLVKRRFAT

SEQ ID NO: 873095 - protein, 9 aa, Homo Sapiens
RQVQRGPAQ

SEQ ID NO: 873096 - protein, 9 aa, Homo Sapiens
YTVNLMQKH

SEQ ID NO: 873097 - protein, 9 aa, Homo Sapiens
YVSWDLFRE

SEQ ID NO: 873098 - protein, 9 aa, Homo Sapiens
PKNGSIQPY

SEQ ID NO: 873099 - protein, 9 aa, Homo Sapiens
EDPTFNPSG

SEQ ID NO: 873100 - protein, 9 aa, Homo Sapiens
QQDLYQILK

SEQ ID NO: 873101 - protein, 9 aa, Homo Sapiens
LTGKIQIAA

SEQ ID NO: 873102 - protein, 9 aa, Homo Sapiens
CICYVASSA

SEQ ID NO: 873103 - protein, 9 aa, Homo Sapiens
LKVTMKKTC

SEQ ID NO: 873104 - protein, 9 aa, Homo Sapiens
EFCDALVQL

SEQ ID NO: 873105 - protein, 9 aa, Homo Sapiens
IRCGAFMLK

SEQ ID NO: 873106 - protein, 9 aa, Homo Sapiens
VRKPNNLEA

SEQ ID NO: 873107 - protein, 9 aa, Homo Sapiens
IMENISDNV

SEQ ID NO: 873108 - protein, 9 aa, Homo Sapiens
KELAAEKKC

SEQ ID NO: 873109 - protein, 9 aa, Homo Sapiens
DKRPRSKLP

SEQ ID NO: 873110 - protein, 9 aa, Homo Sapiens
DDLQTTALD

SEQ ID NO: 873111 - protein, 9 aa, Homo Sapiens
HCHIPIKIN

SEQ ID NO: 873112 - protein, 9 aa, Homo Sapiens
TKNAAILTH

SEQ ID NO: 873113 - protein, 9 aa, Homo Sapiens
DFQTRLRLL

SEQ ID NO: 873114 - protein, 9 aa, Homo Sapiens
LTLATVTPR

SEQ ID NO: 873115 - protein, 9 aa, Homo Sapiens
KLYESIMKI

SEQ ID NO: 873116 - protein, 9 aa, Homo Sapiens
TSLSQDSPW

SEQ ID NO: 873117 - protein, 9 aa, Homo Sapiens
KHKVIEKVQ

SEQ ID NO: 873118 - protein, 9 aa, Homo Sapiens
DEELYTLPF

SEQ ID NO: 873119 - protein, 9 aa, Homo Sapiens
RHFMFQNHL

SEQ ID NO: 873120 - protein, 9 aa, Homo Sapiens
VSVTSHRNK

SEQ ID NO: 873121 - protein, 9 aa, Homo Sapiens
EIQMTVVWC

SEQ ID NO: 873122 - protein, 9 aa, Homo Sapiens
YYSFDVKYI

SEQ ID NO: 873123 - protein, 9 aa, Homo Sapiens
AEKSHKPIQ

SEQ ID NO: 873124 - protein, 9 aa, Homo Sapiens
SVLKQKEYC

SEQ ID NO: 873125 - protein, 9 aa, Homo Sapiens
VVCMFSLMC

SEQ ID NO: 873126 - protein, 9 aa, Homo Sapiens
VLLSNIEDI

SEQ ID NO: 873127 - protein, 9 aa, Homo Sapiens
TGDKPYKCQ

SEQ ID NO: 873128 - protein, 9 aa, Homo Sapiens
FMILRENPY

SEQ ID NO: 873129 - protein, 9 aa, Homo Sapiens
FGPCMFIYV

SEQ ID NO: 873130 - protein, 9 aa, Homo Sapiens
PDIAKYMPT

SEQ ID NO: 873131 - protein, 9 aa, Homo Sapiens
YIQPITNTP

SEQ ID NO: 873132 - protein, 9 aa, Homo Sapiens
YEKNKNYLI

SEQ ID NO: 873133 - protein, 9 aa, Homo Sapiens
RGLHKLINK

SEQ ID NO: 873134 - protein, 9 aa, Homo Sapiens
VAMQNLNED

SEQ ID NO: 873135 - protein, 9 aa, Homo Sapiens
GHNEVPPPV

SEQ ID NO: 873136 - protein, 9 aa, Homo Sapiens
MPYVDRQNH

SEQ ID NO: 873137 - protein, 9 aa, Homo Sapiens
AKENECMKI

SEQ ID NO: 873138 - protein, 9 aa, Homo Sapiens
QQTHTGEKS

SEQ ID NO: 873139 - protein, 9 aa, Homo Sapiens
ANNYARDHY

SEQ ID NO: 873140 - protein, 9 aa, Homo Sapiens
YAITQFSYL

SEQ ID NO: 873141 - protein, 9 aa, Homo Sapiens
ANVFSEYLH

SEQ ID NO: 873142 - protein, 9 aa, Homo Sapiens
YHAQMPDLL

SEQ ID NO: 873143 - protein, 9 aa, Homo Sapiens
LWNGNSCSD

SEQ ID NO: 873144 - protein, 9 aa, Homo Sapiens
KGTTEGAVD

SEQ ID NO: 873145 - protein, 9 aa, Homo Sapiens
QIYDKLFQI

SEQ ID NO: 873146 - protein, 9 aa, Homo Sapiens
KFNGEDINT

SEQ ID NO: 873147 - protein, 9 aa, Homo Sapiens
RGALRFTKL

SEQ ID NO: 873148 - protein, 9 aa, Homo Sapiens
VSDNEYGQG

SEQ ID NO: 873149 - protein, 9 aa, Homo Sapiens
LRQQLQIRG

SEQ ID NO: 873150 - protein, 9 aa, Homo Sapiens
RSPLRQNQK

SEQ ID NO: 873151 - protein, 9 aa, Homo Sapiens
QIPNSQRKI

SEQ ID NO: 873152 - protein, 9 aa, Homo Sapiens
NYAGLGPSP

SEQ ID NO: 873153 - protein, 9 aa, Homo Sapiens
NKDALEKAQ

SEQ ID NO: 873154 - protein, 9 aa, Homo Sapiens
TYLRPRSLQ

SEQ ID NO: 873155 - protein, 9 aa, Homo Sapiens
KYKQVHILP

SEQ ID NO: 873156 - protein, 9 aa, Homo Sapiens
LASVLESGT

SEQ ID NO: 873157 - protein, 9 aa, Homo Sapiens
SCDNLVAKQ

SEQ ID NO: 873158 - protein, 9 aa, Homo Sapiens
ASSQAFGNV

SEQ ID NO: 873159 - protein, 9 aa, Homo Sapiens
LNTSPYCLT

SEQ ID NO: 873160 - protein, 9 aa, Homo Sapiens
SHQKFAITL

SEQ ID NO: 873161 - protein, 9 aa, Homo Sapiens
LGAMAIWRS

SEQ ID NO: 873162 - protein, 9 aa, Homo Sapiens
GYVPHPSYL

SEQ ID NO: 873163 - protein, 9 aa, Homo Sapiens
PLPSADTVP

SEQ ID NO: 873164 - protein, 9 aa, Homo Sapiens
FMLKLINHT

SEQ ID NO: 873165 - protein, 9 aa, Homo Sapiens
RTFAVGKRG

SEQ ID NO: 873166 - protein, 9 aa, Homo Sapiens
KKRKKYPSK

SEQ ID NO: 873167 - protein, 9 aa, Homo Sapiens
PVQSAYPQQ

SEQ ID NO: 873168 - protein, 9 aa, Homo Sapiens
VGAAHTTPP

SEQ ID NO: 873169 - protein, 9 aa, Homo Sapiens
LEHLESQLR

SEQ ID NO: 873170 - protein, 9 aa, Homo Sapiens
QTSLLGDSK

SEQ ID NO: 873171 - protein, 9 aa, Homo Sapiens
CDVVDTTFK

SEQ ID NO: 873172 - protein, 9 aa, Homo Sapiens
SKYCEDIDE

SEQ ID NO: 873173 - protein, 9 aa, Homo Sapiens
DSYHQLDAN

SEQ ID NO: 873174 - protein, 9 aa, Homo Sapiens
EMCVKMICR

SEQ ID NO: 873175 - protein, 9 aa, Homo Sapiens
SGRKENRVD

SEQ ID NO: 873176 - protein, 9 aa, Homo Sapiens
YFVNREIYP

SEQ ID NO: 873177 - protein, 9 aa, Homo Sapiens
SLDVEASDK

SEQ ID NO: 873178 - protein, 9 aa, Homo Sapiens
PNQDTMQII

SEQ ID NO: 873179 - protein, 9 aa, Homo Sapiens
MLQNGAPLT

SEQ ID NO: 873180 - protein, 9 aa, Homo Sapiens
GKMEGNPIC

SEQ ID NO: 873181 - protein, 9 aa, Homo Sapiens
WRRSHSRER

SEQ ID NO: 873182 - protein, 9 aa, Homo Sapiens
TKCFDNKLK

SEQ ID NO: 873183 - protein, 9 aa, Homo Sapiens
LALCVIYYF

SEQ ID NO: 873184 - protein, 9 aa, Homo Sapiens
QFLDDHQNK

SEQ ID NO: 873185 - protein, 9 aa, Homo Sapiens
GLLRNHCFL

SEQ ID NO: 873186 - protein, 9 aa, Homo Sapiens
FASELTAGV

SEQ ID NO: 873187 - protein, 9 aa, Homo Sapiens
SEKTEVKQK

SEQ ID NO: 873188 - protein, 9 aa, Homo Sapiens
YVAPLELRD

SEQ ID NO: 873189 - protein, 9 aa, Homo Sapiens
ETGKIYTYQ

SEQ ID NO: 873190 - protein, 9 aa, Homo Sapiens
ADTPNHYKK

SEQ ID NO: 873191 - protein, 9 aa, Homo Sapiens
HEVTVLTSL

SEQ ID NO: 873192 - protein, 9 aa, Homo Sapiens
RAVLCGVTV

SEQ ID NO: 873193 - protein, 9 aa, Homo Sapiens
DNFEKISEL

SEQ ID NO: 873194 - protein, 9 aa, Homo Sapiens
DTHAVATAR

SEQ ID NO: 873195 - protein, 9 aa, Homo Sapiens
TKDKLTPLH

SEQ ID NO: 873196 - protein, 9 aa, Homo Sapiens
QTTTPGAQP

SEQ ID NO: 873197 - protein, 9 aa, Homo Sapiens
VLFMTGFGL

SEQ ID NO: 873198 - protein, 9 aa, Homo Sapiens
PRPKNIDVG

SEQ ID NO: 873199 - protein, 9 aa, Homo Sapiens
QKKISESLS

SEQ ID NO: 873200 - protein, 9 aa, Homo Sapiens
CDPQMCFDI

SEQ ID NO: 873201 - protein, 9 aa, Homo Sapiens
HDQKEFAKF

SEQ ID NO: 873202 - protein, 9 aa, Homo Sapiens
PPYNQAVSL

SEQ ID NO: 873203 - protein, 9 aa, Homo Sapiens
TKTFQIHTP

SEQ ID NO: 873204 - protein, 9 aa, Homo Sapiens
MSGPAPIPG

SEQ ID NO: 873205 - protein, 9 aa, Homo Sapiens
RLPSLISKA

SEQ ID NO: 873206 - protein, 9 aa, Homo Sapiens
LAVILAIVL

SEQ ID NO: 873207 - protein, 9 aa, Homo Sapiens
KGNSCPFRH

SEQ ID NO: 873208 - protein, 9 aa, Homo Sapiens
PNNPRELHR

SEQ ID NO: 873209 - protein, 9 aa, Homo Sapiens
SKFELDRIC

SEQ ID NO: 873210 - protein, 9 aa, Homo Sapiens
SVDENFRPQ

SEQ ID NO: 873211 - protein, 9 aa, Homo Sapiens
LRDTGHYGF

SEQ ID NO: 873212 - protein, 9 aa, Homo Sapiens
VYAWFWHPS

SEQ ID NO: 873213 - protein, 9 aa, Homo Sapiens
GRGGETICS

SEQ ID NO: 873214 - protein, 9 aa, Homo Sapiens
TMNPLENVY

SEQ ID NO: 873215 - protein, 9 aa, Homo Sapiens
DLSAHSSDE

SEQ ID NO: 873216 - protein, 9 aa, Homo Sapiens
TTVPSVFKL

SEQ ID NO: 873217 - protein, 9 aa, Homo Sapiens
DKVRNQCYF

SEQ ID NO: 873218 - protein, 9 aa, Homo Sapiens
QKQQEEQKQ

SEQ ID NO: 873219 - protein, 9 aa, Homo Sapiens
SAVSMAKPH

SEQ ID NO: 873220 - protein, 9 aa, Homo Sapiens
RHFFLQGDK

SEQ ID NO: 873221 - protein, 9 aa, Homo Sapiens
ELFFNLPQL

SEQ ID NO: 873222 - protein, 9 aa, Homo Sapiens
FKHLVYQVE

SEQ ID NO: 873223 - protein, 9 aa, Homo Sapiens
VTTDMLKMA

SEQ ID NO: 873224 - protein, 9 aa, Homo Sapiens
YAQGLQAKD

SEQ ID NO: 873225 - protein, 9 aa, Homo Sapiens
VLLELFYDH

SEQ ID NO: 873226 - protein, 9 aa, Homo Sapiens
FLFELGLYD

SEQ ID NO: 873227 - protein, 9 aa, Homo Sapiens
IQNEKGEIE

SEQ ID NO: 873228 - protein, 9 aa, Homo Sapiens
HNCETCRGQ

SEQ ID NO: 873229 - protein, 9 aa, Homo Sapiens
PEGYKVSQK

SEQ ID NO: 873230 - protein, 9 aa, Homo Sapiens
PQNFTVAFG

SEQ ID NO: 873231 - protein, 9 aa, Homo Sapiens
LFNQSKGMG

SEQ ID NO: 873232 - protein, 9 aa, Homo Sapiens
TPVTLFPGI

SEQ ID NO: 873233 - protein, 9 aa, Homo Sapiens
LKIMTKAKY

SEQ ID NO: 873234 - protein, 9 aa, Homo Sapiens
NSNTTSNIR

SEQ ID NO: 873235 - protein, 9 aa, Homo Sapiens
ANKHGRAVC

SEQ ID NO: 873236 - protein, 9 aa, Homo Sapiens
ELPELSCGS

SEQ ID NO: 873237 - protein, 9 aa, Homo Sapiens
IDVGYKRFL

SEQ ID NO: 873238 - protein, 9 aa, Homo Sapiens
LGYVPHPSY

SEQ ID NO: 873239 - protein, 9 aa, Homo Sapiens
AKSIDQKND

SEQ ID NO: 873240 - protein, 9 aa, Homo Sapiens
YSGMIIDNM

SEQ ID NO: 873241 - protein, 9 aa, Homo Sapiens
PFSLQNTFT

SEQ ID NO: 873242 - protein, 9 aa, Homo Sapiens
VMSEMAPRN

SEQ ID NO: 873243 - protein, 9 aa, Homo Sapiens
GIKDNLDNI

SEQ ID NO: 873244 - protein, 9 aa, Homo Sapiens
AAPIIILQR

SEQ ID NO: 873245 - protein, 9 aa, Homo Sapiens
SQAHFPLSL

SEQ ID NO: 873246 - protein, 9 aa, Homo Sapiens
NSMDNYLSK

SEQ ID NO: 873247 - protein, 9 aa, Homo Sapiens
MIKNCSSTT

SEQ ID NO: 873248 - protein, 9 aa, Homo Sapiens
KAALRGEPR

SEQ ID NO: 873249 - protein, 9 aa, Homo Sapiens
APNHDKVAS

SEQ ID NO: 873250 - protein, 9 aa, Homo Sapiens
NQKHPSSPE

SEQ ID NO: 873251 - protein, 9 aa, Homo Sapiens
LVFLFLNIA

SEQ ID NO: 873252 - protein, 9 aa, Homo Sapiens
VAVPARVSL

SEQ ID NO: 873253 - protein, 9 aa, Homo Sapiens
TRIPKIQTL

SEQ ID NO: 873254 - protein, 9 aa, Homo Sapiens
QARSCWVLH

SEQ ID NO: 873255 - protein, 9 aa, Homo Sapiens
HLFQHQRIH

SEQ ID NO: 873256 - protein, 9 aa, Homo Sapiens
ELDALGHKL

SEQ ID NO: 873257 - protein, 9 aa, Homo Sapiens
LILESKKAN

SEQ ID NO: 873258 - protein, 9 aa, Homo Sapiens
RQVFCQMQK

SEQ ID NO: 873259 - protein, 9 aa, Homo Sapiens
FSLAEGLQT

SEQ ID NO: 873260 - protein, 9 aa, Homo Sapiens
LSYLAATHH

SEQ ID NO: 873261 - protein, 9 aa, Homo Sapiens
TAFQTWMDT

SEQ ID NO: 873262 - protein, 9 aa, Homo Sapiens
QQGQYNMTY

SEQ ID NO: 873263 - protein, 9 aa, Homo Sapiens
TCVLHKCQV

SEQ ID NO: 873264 - protein, 9 aa, Homo Sapiens
GFPPLDWFG

SEQ ID NO: 873265 - protein, 9 aa, Homo Sapiens
DEQDAHAAS

SEQ ID NO: 873266 - protein, 9 aa, Homo Sapiens
QPKYTVFVK

SEQ ID NO: 873267 - protein, 9 aa, Homo Sapiens
QHYYPMAGY

SEQ ID NO: 873268 - protein, 9 aa, Homo Sapiens
EIQTLKHKF

SEQ ID NO: 873269 - protein, 9 aa, Homo Sapiens
FHRGPRLPQ

SEQ ID NO: 873270 - protein, 9 aa, Homo Sapiens
LHHCEHLLE

SEQ ID NO: 873271 - protein, 9 aa, Homo Sapiens
QIHTGESSV

SEQ ID NO: 873272 - protein, 9 aa, Homo Sapiens
SVTHLAEKN

SEQ ID NO: 873273 - protein, 9 aa, Homo Sapiens
IQCAIRIAC

SEQ ID NO: 873274 - protein, 9 aa, Homo Sapiens
ALLNGICLY

SEQ ID NO: 873275 - protein, 9 aa, Homo Sapiens
LCQAPDFYV

SEQ ID NO: 873276 - protein, 9 aa, Homo Sapiens
WLLKILVIL

SEQ ID NO: 873277 - protein, 9 aa, Homo Sapiens
KQSREFKKN

SEQ ID NO: 873278 - protein, 9 aa, Homo Sapiens
VDPDNFLLL

SEQ ID NO: 873279 - protein, 9 aa, Homo Sapiens
WEGEGSFEC

SEQ ID NO: 873280 - protein, 9 aa, Homo Sapiens
KQSQTKSSQ

SEQ ID NO: 873281 - protein, 9 aa, Homo Sapiens
IEIIDQLFA

SEQ ID NO: 873282 - protein, 9 aa, Homo Sapiens
ESTPEPQKK

SEQ ID NO: 873283 - protein, 9 aa, Homo Sapiens
ALKRSELVS

SEQ ID NO: 873284 - protein, 9 aa, Homo Sapiens
FFSVLLPAL

SEQ ID NO: 873285 - protein, 9 aa, Homo Sapiens
YKNRDAILA

SEQ ID NO: 873286 - protein, 9 aa, Homo Sapiens
QTQTHATLR

SEQ ID NO: 873287 - protein, 9 aa, Homo Sapiens
AKIVFLATD

SEQ ID NO: 873288 - protein, 9 aa, Homo Sapiens
TVVMFGCNM

SEQ ID NO: 873289 - protein, 9 aa, Homo Sapiens
LPHTPLTVL

SEQ ID NO: 873290 - protein, 9 aa, Homo Sapiens
QQQIFPLML

SEQ ID NO: 873291 - protein, 9 aa, Homo Sapiens
CPAVKKQDN

SEQ ID NO: 873292 - protein, 9 aa, Homo Sapiens
DPCMQDQET

SEQ ID NO: 873293 - protein, 9 aa, Homo Sapiens
DREDIPICP

SEQ ID NO: 873294 - protein, 9 aa, Homo Sapiens
SWEEVEAAG

SEQ ID NO: 873295 - protein, 9 aa, Homo Sapiens
PDCRPLTVI

SEQ ID NO: 873296 - protein, 9 aa, Homo Sapiens
NHAVLGLYL

SEQ ID NO: 873297 - protein, 9 aa, Homo Sapiens
RFKVNKIWD

SEQ ID NO: 873298 - protein, 9 aa, Homo Sapiens
DVVKGKQMH

SEQ ID NO: 873299 - protein, 9 aa, Homo Sapiens
VYVWLERTM

SEQ ID NO: 873300 - protein, 9 aa, Homo Sapiens
DVAIELSQE

SEQ ID NO: 873301 - protein, 9 aa, Homo Sapiens
KNNLTLSKE

SEQ ID NO: 873302 - protein, 9 aa, Homo Sapiens
CPEEQHHIG

SEQ ID NO: 873303 - protein, 9 aa, Homo Sapiens
CKMTKSSPL

SEQ ID NO: 873304 - protein, 9 aa, Homo Sapiens
AMPFGVSEL

SEQ ID NO: 873305 - protein, 9 aa, Homo Sapiens
KMVERICKF

SEQ ID NO: 873306 - protein, 9 aa, Homo Sapiens
EESPYMNGR

SEQ ID NO: 873307 - protein, 9 aa, Homo Sapiens
DTNLQGRLF

SEQ ID NO: 873308 - protein, 9 aa, Homo Sapiens
ALSLVMWLG

SEQ ID NO: 873309 - protein, 9 aa, Homo Sapiens
SQVLKINEC

SEQ ID NO: 873310 - protein, 9 aa, Homo Sapiens
RCCKLDVDA

SEQ ID NO: 873311 - protein, 9 aa, Homo Sapiens
EARGRRVWG

SEQ ID NO: 873312 - protein, 9 aa, Homo Sapiens
CMQDQETYS

SEQ ID NO: 873313 - protein, 9 aa, Homo Sapiens
MIFVGVGFL

SEQ ID NO: 873314 - protein, 9 aa, Homo Sapiens
QRIFMILWL

SEQ ID NO: 873315 - protein, 9 aa, Homo Sapiens
EIISEVERN

SEQ ID NO: 873316 - protein, 9 aa, Homo Sapiens
PSMPTFSPG

SEQ ID NO: 873317 - protein, 9 aa, Homo Sapiens
PRSKIPLQE

SEQ ID NO: 873318 - protein, 9 aa, Homo Sapiens
SSFACHREP

SEQ ID NO: 873319 - protein, 9 aa, Homo Sapiens
CYFTSKCHS

SEQ ID NO: 873320 - protein, 9 aa, Homo Sapiens
VKKKNPKLT

SEQ ID NO: 873321 - protein, 9 aa, Homo Sapiens
IPREPSRGQ

SEQ ID NO: 873322 - protein, 9 aa, Homo Sapiens
CVLCTKSCR

SEQ ID NO: 873323 - protein, 9 aa, Homo Sapiens
SVIPESYSH

SEQ ID NO: 873324 - protein, 9 aa, Homo Sapiens
FKIVEHFGI

SEQ ID NO: 873325 - protein, 9 aa, Homo Sapiens
ELRNGQVDI

SEQ ID NO: 873326 - protein, 9 aa, Homo Sapiens
DNFSCTWSP

SEQ ID NO: 873327 - protein, 9 aa, Homo Sapiens
SDQNPPIDD

SEQ ID NO: 873328 - protein, 9 aa, Homo Sapiens
KKVVEYEYE

SEQ ID NO: 873329 - protein, 9 aa, Homo Sapiens
LVLRVQELV

SEQ ID NO: 873330 - protein, 9 aa, Homo Sapiens
LTPLWTLLQ

SEQ ID NO: 873331 - protein, 9 aa, Homo Sapiens
FQILLLGTA

SEQ ID NO: 873332 - protein, 9 aa, Homo Sapiens
EYSAIGPRS

SEQ ID NO: 873333 - protein, 9 aa, Homo Sapiens
VRVPNFNDN

SEQ ID NO: 873334 - protein, 9 aa, Homo Sapiens
QKPDSQMKQ

SEQ ID NO: 873335 - protein, 9 aa, Homo Sapiens
KLARYFLWH

SEQ ID NO: 873336 - protein, 9 aa, Homo Sapiens
DLCQLPGRQ

SEQ ID NO: 873337 - protein, 9 aa, Homo Sapiens
ENREEAILN

SEQ ID NO: 873338 - protein, 9 aa, Homo Sapiens
ELRAHREAL

SEQ ID NO: 873339 - protein, 9 aa, Homo Sapiens
LLSLQGVTT

SEQ ID NO: 873340 - protein, 9 aa, Homo Sapiens
LPEPFILFQ

SEQ ID NO: 873341 - protein, 9 aa, Homo Sapiens
LESQLRALG

SEQ ID NO: 873342 - protein, 9 aa, Homo Sapiens
ADTLTNAVA

SEQ ID NO: 873343 - protein, 9 aa, Homo Sapiens
TMKKTCFTK

SEQ ID NO: 873344 - protein, 9 aa, Homo Sapiens
KIWIEIIAL

SEQ ID NO: 873345 - protein, 9 aa, Homo Sapiens
SAVYVNNQL

SEQ ID NO: 873346 - protein, 9 aa, Homo Sapiens
RVQALRRLL

SEQ ID NO: 873347 - protein, 9 aa, Homo Sapiens
IIQVVFQNA

SEQ ID NO: 873348 - protein, 9 aa, Homo Sapiens
NQDNTAGVY

SEQ ID NO: 873349 - protein, 9 aa, Homo Sapiens
GAIKQNARW

SEQ ID NO: 873350 - protein, 9 aa, Homo Sapiens
RWLRTIFII

SEQ ID NO: 873351 - protein, 9 aa, Homo Sapiens
RQYLTICYT

SEQ ID NO: 873352 - protein, 9 aa, Homo Sapiens
KSQTNVREK

SEQ ID NO: 873353 - protein, 9 aa, Homo Sapiens
AGIQILFSS

SEQ ID NO: 873354 - protein, 9 aa, Homo Sapiens
HSLNLWTTL

SEQ ID NO: 873355 - protein, 9 aa, Homo Sapiens
NISKKSKVN

SEQ ID NO: 873356 - protein, 9 aa, Homo Sapiens
QAKGFHGKI

SEQ ID NO: 873357 - protein, 9 aa, Homo Sapiens
GVPQNASQK

SEQ ID NO: 873358 - protein, 9 aa, Homo Sapiens
MTPGLGHQV

SEQ ID NO: 873359 - protein, 9 aa, Homo Sapiens
DLKKDNFSL

SEQ ID NO: 873360 - protein, 9 aa, Homo Sapiens
VILLVLGIV

SEQ ID NO: 873361 - protein, 9 aa, Homo Sapiens
KYTLQICTS

SEQ ID NO: 873362 - protein, 9 aa, Homo Sapiens
PVGNSLSKL

SEQ ID NO: 873363 - protein, 9 aa, Homo Sapiens
IEAGRIPHP

SEQ ID NO: 873364 - protein, 9 aa, Homo Sapiens
RNVREQLAK

SEQ ID NO: 873365 - protein, 9 aa, Homo Sapiens
NNYARDHYT

SEQ ID NO: 873366 - protein, 9 aa, Homo Sapiens
AISERRIKR

SEQ ID NO: 873367 - protein, 9 aa, Homo Sapiens
FPLTQKHGL

SEQ ID NO: 873368 - protein, 9 aa, Homo Sapiens
KEASTFNLF

SEQ ID NO: 873369 - protein, 9 aa, Homo Sapiens
QKEKRNFPL

SEQ ID NO: 873370 - protein, 9 aa, Homo Sapiens
DMKTCHFHP

SEQ ID NO: 873371 - protein, 9 aa, Homo Sapiens
IVPLDTQNR

SEQ ID NO: 873372 - protein, 9 aa, Homo Sapiens
GSSSPINGL

SEQ ID NO: 873373 - protein, 9 aa, Homo Sapiens
ALLLLFSNW

SEQ ID NO: 873374 - protein, 9 aa, Homo Sapiens
LLDDLYKYL

SEQ ID NO: 873375 - protein, 9 aa, Homo Sapiens
DKYNSWHHG

SEQ ID NO: 873376 - protein, 9 aa, Homo Sapiens
LTAAEKKDS

SEQ ID NO: 873377 - protein, 9 aa, Homo Sapiens
SFLQEKTAA

SEQ ID NO: 873378 - protein, 9 aa, Homo Sapiens
GRGELQRFL

SEQ ID NO: 873379 - protein, 9 aa, Homo Sapiens
LVTYRSFNT

SEQ ID NO: 873380 - protein, 9 aa, Homo Sapiens
ETLLDIENA

SEQ ID NO: 873381 - protein, 9 aa, Homo Sapiens
VSTTRKLYL

SEQ ID NO: 873382 - protein, 9 aa, Homo Sapiens
NPSSIHHFK

SEQ ID NO: 873383 - protein, 9 aa, Homo Sapiens
TRTPINNLY

SEQ ID NO: 873384 - protein, 9 aa, Homo Sapiens
TESGTFHIS

SEQ ID NO: 873385 - protein, 9 aa, Homo Sapiens
KQELAFHSA

SEQ ID NO: 873386 - protein, 9 aa, Homo Sapiens
CRSASCRNT

SEQ ID NO: 873387 - protein, 9 aa, Homo Sapiens
TKVHRSACG

SEQ ID NO: 873388 - protein, 9 aa, Homo Sapiens
DPQKKSDVT

SEQ ID NO: 873389 - protein, 9 aa, Homo Sapiens
RQENLKLVR

SEQ ID NO: 873390 - protein, 9 aa, Homo Sapiens
ERLLKIKYR

SEQ ID NO: 873391 - protein, 9 aa, Homo Sapiens
RVMGLSEEW

SEQ ID NO: 873392 - protein, 9 aa, Homo Sapiens
KPGFPKAIK

SEQ ID NO: 873393 - protein, 9 aa, Homo Sapiens
SKIVCVLNL

SEQ ID NO: 873394 - protein, 9 aa, Homo Sapiens
TGFGLLLSL

SEQ ID NO: 873395 - protein, 9 aa, Homo Sapiens
PSYKYEHTE

SEQ ID NO: 873396 - protein, 9 aa, Homo Sapiens
TAAEKKDSQ

SEQ ID NO: 873397 - protein, 9 aa, Homo Sapiens
SHSRGSITA

SEQ ID NO: 873398 - protein, 9 aa, Homo Sapiens
LVIVISMGF

SEQ ID NO: 873399 - protein, 9 aa, Homo Sapiens
PPLEQRSFI

SEQ ID NO: 873400 - protein, 9 aa, Homo Sapiens
DYAFAKAIG

SEQ ID NO: 873401 - protein, 9 aa, Homo Sapiens
VLHDTHAVA

SEQ ID NO: 873402 - protein, 9 aa, Homo Sapiens
ILENQAMDN

SEQ ID NO: 873403 - protein, 9 aa, Homo Sapiens
PMSGPAPIP

SEQ ID NO: 873404 - protein, 9 aa, Homo Sapiens
DDNDHSLWR

SEQ ID NO: 873405 - protein, 9 aa, Homo Sapiens
VWHQQDWTI

SEQ ID NO: 873406 - protein, 9 aa, Homo Sapiens
EFYQKKKSC

SEQ ID NO: 873407 - protein, 9 aa, Homo Sapiens
FSYVELHQF

SEQ ID NO: 873408 - protein, 9 aa, Homo Sapiens
SCALLCPMR

SEQ ID NO: 873409 - protein, 9 aa, Homo Sapiens
KGAYKQVIK

SEQ ID NO: 873410 - protein, 9 aa, Homo Sapiens
DGDGKISFQ

SEQ ID NO: 873411 - protein, 9 aa, Homo Sapiens
ITKTDTEGI

SEQ ID NO: 873412 - protein, 9 aa, Homo Sapiens
YHLLKARTS

SEQ ID NO: 873413 - protein, 9 aa, Homo Sapiens
AKTCEGEGC

SEQ ID NO: 873414 - protein, 9 aa, Homo Sapiens
YVPWMATSG

SEQ ID NO: 873415 - protein, 9 aa, Homo Sapiens
AEKNVKKKR

SEQ ID NO: 873416 - protein, 9 aa, Homo Sapiens
RRRLTWEAM

SEQ ID NO: 873417 - protein, 9 aa, Homo Sapiens
KVRRIKLGH

SEQ ID NO: 873418 - protein, 9 aa, Homo Sapiens
KEKISFVSA

SEQ ID NO: 873419 - protein, 9 aa, Homo Sapiens
NKTPKKVKK

SEQ ID NO: 873420 - protein, 9 aa, Homo Sapiens
EAGEKGKRG

SEQ ID NO: 873421 - protein, 9 aa, Homo Sapiens
PKSTGSVCQ

SEQ ID NO: 873422 - protein, 9 aa, Homo Sapiens
IQLWHWLQE

SEQ ID NO: 873423 - protein, 9 aa, Homo Sapiens
DGLHLVTML

SEQ ID NO: 873424 - protein, 9 aa, Homo Sapiens
KGNTKQIID

SEQ ID NO: 873425 - protein, 9 aa, Homo Sapiens
PQHYLEELL

SEQ ID NO: 873426 - protein, 9 aa, Homo Sapiens
LFKVLGLHK

SEQ ID NO: 873427 - protein, 9 aa, Homo Sapiens
SQWDSALHI

SEQ ID NO: 873428 - protein, 9 aa, Homo Sapiens
KLESKIQRL

SEQ ID NO: 873429 - protein, 9 aa, Homo Sapiens
PVCIQKFKR

SEQ ID NO: 873430 - protein, 9 aa, Homo Sapiens
NAQDLPQNQ

SEQ ID NO: 873431 - protein, 9 aa, Homo Sapiens
LKDTKRNSR

SEQ ID NO: 873432 - protein, 9 aa, Homo Sapiens
QLSEVKYQM

SEQ ID NO: 873433 - protein, 9 aa, Homo Sapiens
NVFSEYLHS

SEQ ID NO: 873434 - protein, 9 aa, Homo Sapiens
LADVLSEKK

SEQ ID NO: 873435 - protein, 9 aa, Homo Sapiens
LQSRQTRIR

SEQ ID NO: 873436 - protein, 9 aa, Homo Sapiens
NLNTHQIIH

SEQ ID NO: 873437 - protein, 9 aa, Homo Sapiens
LRRQRHIKH

SEQ ID NO: 873438 - protein, 9 aa, Homo Sapiens
DKPSSEESD

SEQ ID NO: 873439 - protein, 9 aa, Homo Sapiens
KNGEQQDEE

SEQ ID NO: 873440 - protein, 9 aa, Homo Sapiens
LQIREKERR

SEQ ID NO: 873441 - protein, 9 aa, Homo Sapiens
TANLFQILL

SEQ ID NO: 873442 - protein, 9 aa, Homo Sapiens
FNIPCDDIQ

SEQ ID NO: 873443 - protein, 9 aa, Homo Sapiens
EERDIQYAP

SEQ ID NO: 873444 - protein, 9 aa, Homo Sapiens
EEKDPEKFL

SEQ ID NO: 873445 - protein, 9 aa, Homo Sapiens
ESSSKSDHF

SEQ ID NO: 873446 - protein, 9 aa, Homo Sapiens
LTPDLCPLP

SEQ ID NO: 873447 - protein, 9 aa, Homo Sapiens
SVKKYSRVM

SEQ ID NO: 873448 - protein, 9 aa, Homo Sapiens
ELFLADVNN

SEQ ID NO: 873449 - protein, 9 aa, Homo Sapiens
GPYESDKDK

SEQ ID NO: 873450 - protein, 9 aa, Homo Sapiens
KEGCPAMGH

SEQ ID NO: 873451 - protein, 9 aa, Homo Sapiens
KDEEMDVGT

SEQ ID NO: 873452 - protein, 9 aa, Homo Sapiens
IDKFWDRSS

SEQ ID NO: 873453 - protein, 9 aa, Homo Sapiens
PAGEVSTPS

SEQ ID NO: 873454 - protein, 9 aa, Homo Sapiens
RLYCEKENY

SEQ ID NO: 873455 - protein, 9 aa, Homo Sapiens
FNILILLTI

SEQ ID NO: 873456 - protein, 9 aa, Homo Sapiens
EIIGVAKQL

SEQ ID NO: 873457 - protein, 9 aa, Homo Sapiens
MTTNKRRVI

SEQ ID NO: 873458 - protein, 9 aa, Homo Sapiens
IPRAFKHVF

SEQ ID NO: 873459 - protein, 9 aa, Homo Sapiens
YETLSFKDS

SEQ ID NO: 873460 - protein, 9 aa, Homo Sapiens
RDACTKKIG

SEQ ID NO: 873461 - protein, 9 aa, Homo Sapiens
SRMCCQQEF

SEQ ID NO: 873462 - protein, 9 aa, Homo Sapiens
GRPRPNFFY

SEQ ID NO: 873463 - protein, 9 aa, Homo Sapiens
SKKTPAKSV

SEQ ID NO: 873464 - protein, 9 aa, Homo Sapiens
LTAAHCHKP

SEQ ID NO: 873465 - protein, 9 aa, Homo Sapiens
NLVSRLLEQ

SEQ ID NO: 873466 - protein, 9 aa, Homo Sapiens
KASTQGRTC

SEQ ID NO: 873467 - protein, 9 aa, Homo Sapiens
SVQSERSGG

SEQ ID NO: 873468 - protein, 9 aa, Homo Sapiens
CKELMNPLS

SEQ ID NO: 873469 - protein, 9 aa, Homo Sapiens
ILHQIIHSG

SEQ ID NO: 873470 - protein, 9 aa, Homo Sapiens
LCADYRSAR

SEQ ID NO: 873471 - protein, 9 aa, Homo Sapiens
PAIQYLLYG

SEQ ID NO: 873472 - protein, 9 aa, Homo Sapiens
SMTKDDSKL

SEQ ID NO: 873473 - protein, 9 aa, Homo Sapiens
FCNPEFESS

SEQ ID NO: 873474 - protein, 9 aa, Homo Sapiens
RVPIVLHIC

SEQ ID NO: 873475 - protein, 9 aa, Homo Sapiens
PFWCTFEGC

SEQ ID NO: 873476 - protein, 9 aa, Homo Sapiens
IEIIQVPGY

SEQ ID NO: 873477 - protein, 9 aa, Homo Sapiens
HLIYQQQVS

SEQ ID NO: 873478 - protein, 9 aa, Homo Sapiens
LSLQWLTLE

SEQ ID NO: 873479 - protein, 9 aa, Homo Sapiens
LNYSNAESL

SEQ ID NO: 873480 - protein, 9 aa, Homo Sapiens
PRNADMKNQ

SEQ ID NO: 873481 - protein, 9 aa, Homo Sapiens
NWKPKYVYK

SEQ ID NO: 873482 - protein, 9 aa, Homo Sapiens
KGYVGSEPQ

SEQ ID NO: 873483 - protein, 9 aa, Homo Sapiens
NSVTVQVPQ

SEQ ID NO: 873484 - protein, 9 aa, Homo Sapiens
VLEIFNVIS

SEQ ID NO: 873485 - protein, 9 aa, Homo Sapiens
IHLWTSYSE

SEQ ID NO: 873486 - protein, 9 aa, Homo Sapiens
ELCGFKNKL

SEQ ID NO: 873487 - protein, 9 aa, Homo Sapiens
VRDNQDNTA

SEQ ID NO: 873488 - protein, 9 aa, Homo Sapiens
RIKCPLPSQ

SEQ ID NO: 873489 - protein, 9 aa, Homo Sapiens
INYAGLGPS

SEQ ID NO: 873490 - protein, 9 aa, Homo Sapiens
QRGDRLLLF

SEQ ID NO: 873491 - protein, 9 aa, Homo Sapiens
QGDWERLEL

SEQ ID NO: 873492 - protein, 9 aa, Homo Sapiens
DTSSRSLFD

SEQ ID NO: 873493 - protein, 9 aa, Homo Sapiens
SSSGVWATL

SEQ ID NO: 873494 - protein, 9 aa, Homo Sapiens
KYCYRYPKG

SEQ ID NO: 873495 - protein, 9 aa, Homo Sapiens
THILSVRDS

SEQ ID NO: 873496 - protein, 9 aa, Homo Sapiens
LQMDSNKGA

SEQ ID NO: 873497 - protein, 9 aa, Homo Sapiens
AASLLQVTP

SEQ ID NO: 873498 - protein, 9 aa, Homo Sapiens
MLEAELLIL

SEQ ID NO: 873499 - protein, 9 aa, Homo Sapiens
MKMNEFLRL

SEQ ID NO: 873500 - protein, 9 aa, Homo Sapiens
PYHYKFENL

SEQ ID NO: 873501 - protein, 9 aa, Homo Sapiens
NFDEKPAII

SEQ ID NO: 873502 - protein, 9 aa, Homo Sapiens
SLVASKVFR

SEQ ID NO: 873503 - protein, 9 aa, Homo Sapiens
CMFIYVWPF

SEQ ID NO: 873504 - protein, 9 aa, Homo Sapiens
TGTPQPGGA

SEQ ID NO: 873505 - protein, 9 aa, Homo Sapiens
KDQQNILAA

SEQ ID NO: 873506 - protein, 9 aa, Homo Sapiens
EKNNLTLSK

SEQ ID NO: 873507 - protein, 9 aa, Homo Sapiens
RLAASLYCP

SEQ ID NO: 873508 - protein, 9 aa, Homo Sapiens
TTAKTSVKP

SEQ ID NO: 873509 - protein, 9 aa, Homo Sapiens
PGPGQLRGE

SEQ ID NO: 873510 - protein, 9 aa, Homo Sapiens
FKLNGLPSE

SEQ ID NO: 873511 - protein, 9 aa, Homo Sapiens
IGEWDCKSA

SEQ ID NO: 873512 - protein, 9 aa, Homo Sapiens
SPRDCAYLV

SEQ ID NO: 873513 - protein, 9 aa, Homo Sapiens
ASLLDREVK

SEQ ID NO: 873514 - protein, 9 aa, Homo Sapiens
GKENKGETS

SEQ ID NO: 873515 - protein, 9 aa, Homo Sapiens
DNLVSRLLE

SEQ ID NO: 873516 - protein, 9 aa, Homo Sapiens
FSVNFSLSL

SEQ ID NO: 873517 - protein, 9 aa, Homo Sapiens
QHQRFHTGN

SEQ ID NO: 873518 - protein, 9 aa, Homo Sapiens
PAVGAAHTT

SEQ ID NO: 873519 - protein, 9 aa, Homo Sapiens
AVSSLGDLS

SEQ ID NO: 873520 - protein, 9 aa, Homo Sapiens
VLKKYRGKC

SEQ ID NO: 873521 - protein, 9 aa, Homo Sapiens
GETHSREMG

SEQ ID NO: 873522 - protein, 9 aa, Homo Sapiens
ADTTGVSAD

SEQ ID NO: 873523 - protein, 9 aa, Homo Sapiens
QTTALDLEW

SEQ ID NO: 873524 - protein, 9 aa, Homo Sapiens
KNADNGTTV

SEQ ID NO: 873525 - protein, 9 aa, Homo Sapiens
RYYIDHVSQ

SEQ ID NO: 873526 - protein, 9 aa, Homo Sapiens
THKHHCRHC

SEQ ID NO: 873527 - protein, 9 aa, Homo Sapiens
GRLCSLGRA

SEQ ID NO: 873528 - protein, 9 aa, Homo Sapiens
QEIYQELAQ

SEQ ID NO: 873529 - protein, 9 aa, Homo Sapiens
NFHKYFLIG

SEQ ID NO: 873530 - protein, 9 aa, Homo Sapiens
CQFIKIVPL

SEQ ID NO: 873531 - protein, 9 aa, Homo Sapiens
TKLGFEIFL

SEQ ID NO: 873532 - protein, 9 aa, Homo Sapiens
YEGKAALRG

SEQ ID NO: 873533 - protein, 9 aa, Homo Sapiens
KLIIVDYIL

SEQ ID NO: 873534 - protein, 9 aa, Homo Sapiens
ANLQDCYQL

SEQ ID NO: 873535 - protein, 9 aa, Homo Sapiens
NGRGTCNYY

SEQ ID NO: 873536 - protein, 9 aa, Homo Sapiens
HSCYKCCQC

SEQ ID NO: 873537 - protein, 9 aa, Homo Sapiens
LICGQERFQ

SEQ ID NO: 873538 - protein, 9 aa, Homo Sapiens
ARIVLANYP

SEQ ID NO: 873539 - protein, 9 aa, Homo Sapiens
RHEDKLELE

SEQ ID NO: 873540 - protein, 9 aa, Homo Sapiens
RETKKMMKD

SEQ ID NO: 873541 - protein, 9 aa, Homo Sapiens
NRQKHFPER

SEQ ID NO: 873542 - protein, 9 aa, Homo Sapiens
QAAAAVCLS

SEQ ID NO: 873543 - protein, 9 aa, Homo Sapiens
NVRETYCYL

SEQ ID NO: 873544 - protein, 9 aa, Homo Sapiens
RATLLVPDT

SEQ ID NO: 873545 - protein, 9 aa, Homo Sapiens
PPQDMDENI

SEQ ID NO: 873546 - protein, 9 aa, Homo Sapiens
AGLLRNHCF

SEQ ID NO: 873547 - protein, 9 aa, Homo Sapiens
GHDLTSVQA

SEQ ID NO: 873548 - protein, 9 aa, Homo Sapiens
DWASFIRLA

SEQ ID NO: 873549 - protein, 9 aa, Homo Sapiens
TDFEQMKEY

SEQ ID NO: 873550 - protein, 9 aa, Homo Sapiens
FIYLFYSII

SEQ ID NO: 873551 - protein, 9 aa, Homo Sapiens
ARTEIEKMA

SEQ ID NO: 873552 - protein, 9 aa, Homo Sapiens
KGYIIQKGE

SEQ ID NO: 873553 - protein, 9 aa, Homo Sapiens
SVVNNSQNN

SEQ ID NO: 873554 - protein, 9 aa, Homo Sapiens
PELFQIGAS

SEQ ID NO: 873555 - protein, 9 aa, Homo Sapiens
LLGHNNTDV

SEQ ID NO: 873556 - protein, 9 aa, Homo Sapiens
IQLSVGLED

SEQ ID NO: 873557 - protein, 9 aa, Homo Sapiens
VKKIHPCKK

SEQ ID NO: 873558 - protein, 9 aa, Homo Sapiens
TNAIQDKLS

SEQ ID NO: 873559 - protein, 9 aa, Homo Sapiens
YHANDLCLA

SEQ ID NO: 873560 - protein, 9 aa, Homo Sapiens
RKMAFCAKS

SEQ ID NO: 873561 - protein, 9 aa, Homo Sapiens
YLCIAEYAF

SEQ ID NO: 873562 - protein, 9 aa, Homo Sapiens
DYDIQTGNT

SEQ ID NO: 873563 - protein, 9 aa, Homo Sapiens
GESGSEASN

SEQ ID NO: 873564 - protein, 9 aa, Homo Sapiens
IQRHMVMHS

SEQ ID NO: 873565 - protein, 9 aa, Homo Sapiens
KNFLHWRRA

SEQ ID NO: 873566 - protein, 9 aa, Homo Sapiens
QVTPDKDDH

SEQ ID NO: 873567 - protein, 9 aa, Homo Sapiens
IDISNNSFH

SEQ ID NO: 873568 - protein, 9 aa, Homo Sapiens
AWKNMSNIS

SEQ ID NO: 873569 - protein, 9 aa, Homo Sapiens
RERQENLKL

SEQ ID NO: 873570 - protein, 9 aa, Homo Sapiens
ASLYGLDLD

SEQ ID NO: 873571 - protein, 9 aa, Homo Sapiens
NTTDGQQIW

SEQ ID NO: 873572 - protein, 9 aa, Homo Sapiens
VASSPSIRQ

SEQ ID NO: 873573 - protein, 9 aa, Homo Sapiens
SMYDLAESY

SEQ ID NO: 873574 - protein, 9 aa, Homo Sapiens
CAGLYSDRM

SEQ ID NO: 873575 - protein, 9 aa, Homo Sapiens
IDCREPYVF

SEQ ID NO: 873576 - protein, 9 aa, Homo Sapiens
TVCLKVKEP

SEQ ID NO: 873577 - protein, 9 aa, Homo Sapiens
VQGHVQLHI

SEQ ID NO: 873578 - protein, 9 aa, Homo Sapiens
KSGDQLKRP

SEQ ID NO: 873579 - protein, 9 aa, Homo Sapiens
IAGIVFWLH

SEQ ID NO: 873580 - protein, 9 aa, Homo Sapiens
YKCGECGKF

SEQ ID NO: 873581 - protein, 9 aa, Homo Sapiens
KLHIPLKTQ

SEQ ID NO: 873582 - protein, 9 aa, Homo Sapiens
LLDASLDLQ

SEQ ID NO: 873583 - protein, 9 aa, Homo Sapiens
LQDALHISQ

SEQ ID NO: 873584 - protein, 9 aa, Homo Sapiens
ITPLIQAVH

SEQ ID NO: 873585 - protein, 9 aa, Homo Sapiens
AALAEKLDW

SEQ ID NO: 873586 - protein, 9 aa, Homo Sapiens
SRQKWSVEN

SEQ ID NO: 873587 - protein, 9 aa, Homo Sapiens
FYPLQMHCI

SEQ ID NO: 873588 - protein, 9 aa, Homo Sapiens
RKFKIQTWI

SEQ ID NO: 873589 - protein, 9 aa, Homo Sapiens
TLQEAVNKY

SEQ ID NO: 873590 - protein, 9 aa, Homo Sapiens
LLYETAENP

SEQ ID NO: 873591 - protein, 9 aa, Homo Sapiens
VAQLERLLI

SEQ ID NO: 873592 - protein, 9 aa, Homo Sapiens
KFSTFRACQ

SEQ ID NO: 873593 - protein, 9 aa, Homo Sapiens
YIGMVVLVR

SEQ ID NO: 873594 - protein, 9 aa, Homo Sapiens
KPEAEMLPQ

SEQ ID NO: 873595 - protein, 9 aa, Homo Sapiens
EPLLAAHQD

SEQ ID NO: 873596 - protein, 9 aa, Homo Sapiens
EGDRILVVN

SEQ ID NO: 873597 - protein, 9 aa, Homo Sapiens
ICAACGEIQ

SEQ ID NO: 873598 - protein, 9 aa, Homo Sapiens
LQNPYSIDN

SEQ ID NO: 873599 - protein, 9 aa, Homo Sapiens
RPQDHDTNL

SEQ ID NO: 873600 - protein, 9 aa, Homo Sapiens
FHGEGVKQC

SEQ ID NO: 873601 - protein, 9 aa, Homo Sapiens
PEGIQIDLR

SEQ ID NO: 873602 - protein, 9 aa, Homo Sapiens
PHQQELCGR

SEQ ID NO: 873603 - protein, 9 aa, Homo Sapiens
NNSSFHHQI

SEQ ID NO: 873604 - protein, 9 aa, Homo Sapiens
LPSLISKAV

SEQ ID NO: 873605 - protein, 9 aa, Homo Sapiens
KKAKNPKED

SEQ ID NO: 873606 - protein, 9 aa, Homo Sapiens
QTCTTKFLA

SEQ ID NO: 873607 - protein, 9 aa, Homo Sapiens
AKAETTLLS

SEQ ID NO: 873608 - protein, 9 aa, Homo Sapiens
MHVILWPIQ

SEQ ID NO: 873609 - protein, 9 aa, Homo Sapiens
PSEKIWIEI

SEQ ID NO: 873610 - protein, 9 aa, Homo Sapiens
VEKDDIIKR

SEQ ID NO: 873611 - protein, 9 aa, Homo Sapiens
KYVSADRNF

SEQ ID NO: 873612 - protein, 9 aa, Homo Sapiens
PQKQLAAEV

SEQ ID NO: 873613 - protein, 9 aa, Homo Sapiens
WEKEEKMWR

SEQ ID NO: 873614 - protein, 9 aa, Homo Sapiens
SLLHANVVP

SEQ ID NO: 873615 - protein, 9 aa, Homo Sapiens
SIGLAGEWL

SEQ ID NO: 873616 - protein, 9 aa, Homo Sapiens
YLAMNKRGQ

SEQ ID NO: 873617 - protein, 9 aa, Homo Sapiens
TMNFSGLSL

SEQ ID NO: 873618 - protein, 9 aa, Homo Sapiens
NSDSQDSSR

SEQ ID NO: 873619 - protein, 9 aa, Homo Sapiens
GHGSHKLFE

SEQ ID NO: 873620 - protein, 9 aa, Homo Sapiens
HSTLKQKEP

SEQ ID NO: 873621 - protein, 9 aa, Homo Sapiens
TELTVGKSI

SEQ ID NO: 873622 - protein, 9 aa, Homo Sapiens
HYCSPTGTG

SEQ ID NO: 873623 - protein, 9 aa, Homo Sapiens
PESDKYHER

SEQ ID NO: 873624 - protein, 9 aa, Homo Sapiens
GKAHEITYV

SEQ ID NO: 873625 - protein, 9 aa, Homo Sapiens
LNLNGAPLC

SEQ ID NO: 873626 - protein, 9 aa, Homo Sapiens
RHICKFHCE

SEQ ID NO: 873627 - protein, 9 aa, Homo Sapiens
LWLTLLLGM

SEQ ID NO: 873628 - protein, 9 aa, Homo Sapiens
QTLQPWSDD

SEQ ID NO: 873629 - protein, 9 aa, Homo Sapiens
KQNLTLRNQ

SEQ ID NO: 873630 - protein, 9 aa, Homo Sapiens
NMRKKRRII

SEQ ID NO: 873631 - protein, 9 aa, Homo Sapiens
NQLLTLPVL

SEQ ID NO: 873632 - protein, 9 aa, Homo Sapiens
GCCSPVPGL

SEQ ID NO: 873633 - protein, 9 aa, Homo Sapiens
SCAYYMPEF

SEQ ID NO: 873634 - protein, 9 aa, Homo Sapiens
VNWSHANKP

SEQ ID NO: 873635 - protein, 9 aa, Homo Sapiens
RCLLEGEEQ

SEQ ID NO: 873636 - protein, 9 aa, Homo Sapiens
GSNVRLHPH

SEQ ID NO: 873637 - protein, 9 aa, Homo Sapiens
IQALPFSAS

SEQ ID NO: 873638 - protein, 9 aa, Homo Sapiens
GEDINTISP

SEQ ID NO: 873639 - protein, 9 aa, Homo Sapiens
NTKEEILMH

SEQ ID NO: 873640 - protein, 9 aa, Homo Sapiens
LLEEVKCTP

SEQ ID NO: 873641 - protein, 9 aa, Homo Sapiens
LDLQNVSLS

SEQ ID NO: 873642 - protein, 9 aa, Homo Sapiens
TYNNRKEAA

SEQ ID NO: 873643 - protein, 9 aa, Homo Sapiens
TVNQNSTSS

SEQ ID NO: 873644 - protein, 9 aa, Homo Sapiens
RFWGLLRPE

SEQ ID NO: 873645 - protein, 9 aa, Homo Sapiens
PSYLSGSLP

SEQ ID NO: 873646 - protein, 9 aa, Homo Sapiens
KNVQLYKMQ

SEQ ID NO: 873647 - protein, 9 aa, Homo Sapiens
LTRKQIRYR

SEQ ID NO: 873648 - protein, 9 aa, Homo Sapiens
IQTGNTREA

SEQ ID NO: 873649 - protein, 9 aa, Homo Sapiens
EAELAAQIL

SEQ ID NO: 873650 - protein, 9 aa, Homo Sapiens
EKNIKLFFS

SEQ ID NO: 873651 - protein, 9 aa, Homo Sapiens
AAEMGMPNN

SEQ ID NO: 873652 - protein, 9 aa, Homo Sapiens
AERAGDIGG

SEQ ID NO: 873653 - protein, 9 aa, Homo Sapiens
VPLHRHHLN

SEQ ID NO: 873654 - protein, 9 aa, Homo Sapiens
HYEQILNPY

SEQ ID NO: 873655 - protein, 9 aa, Homo Sapiens
VLEREQREL

SEQ ID NO: 873656 - protein, 9 aa, Homo Sapiens
SGRRSPKSC

SEQ ID NO: 873657 - protein, 9 aa, Homo Sapiens
LKNHIVWGS

SEQ ID NO: 873658 - protein, 9 aa, Homo Sapiens
KNRKSKEPK

SEQ ID NO: 873659 - protein, 9 aa, Homo Sapiens
RGVLELALQ

SEQ ID NO: 873660 - protein, 9 aa, Homo Sapiens
EAVHLFCNY

SEQ ID NO: 873661 - protein, 9 aa, Homo Sapiens
KKINKQNLT

SEQ ID NO: 873662 - protein, 9 aa, Homo Sapiens
PGGQLESMQ

SEQ ID NO: 873663 - protein, 9 aa, Homo Sapiens
SVARVSGRK

SEQ ID NO: 873664 - protein, 9 aa, Homo Sapiens
AEEEMARLE

SEQ ID NO: 873665 - protein, 9 aa, Homo Sapiens
ATLLQSPVA

SEQ ID NO: 873666 - protein, 9 aa, Homo Sapiens
MVAHRNSLY

SEQ ID NO: 873667 - protein, 9 aa, Homo Sapiens
ALPERAKLA

SEQ ID NO: 873668 - protein, 9 aa, Homo Sapiens
EIPPTKAPD

SEQ ID NO: 873669 - protein, 9 aa, Homo Sapiens
QQRLTVQQV

SEQ ID NO: 873670 - protein, 9 aa, Homo Sapiens
RQKSCILSL

SEQ ID NO: 873671 - protein, 9 aa, Homo Sapiens
HSRDAGPSG

SEQ ID NO: 873672 - protein, 9 aa, Homo Sapiens
LLDLAFTHL

SEQ ID NO: 873673 - protein, 9 aa, Homo Sapiens
PPTVTLLHS

SEQ ID NO: 873674 - protein, 9 aa, Homo Sapiens
RSSEVKTEG

SEQ ID NO: 873675 - protein, 9 aa, Homo Sapiens
KVCLLREEL

SEQ ID NO: 873676 - protein, 9 aa, Homo Sapiens
KLPNELPAH

SEQ ID NO: 873677 - protein, 9 aa, Homo Sapiens
NTNGNTDNN

SEQ ID NO: 873678 - protein, 9 aa, Homo Sapiens
GKITDLVHF

SEQ ID NO: 873679 - protein, 9 aa, Homo Sapiens
NQTRIIDSK

SEQ ID NO: 873680 - protein, 9 aa, Homo Sapiens
SLEDDKRLL

SEQ ID NO: 873681 - protein, 9 aa, Homo Sapiens
VPAIQHKRT

SEQ ID NO: 873682 - protein, 9 aa, Homo Sapiens
CLGWTEGSK

SEQ ID NO: 873683 - protein, 9 aa, Homo Sapiens
LELSNLDII

SEQ ID NO: 873684 - protein, 9 aa, Homo Sapiens
SRLTVHWRI

SEQ ID NO: 873685 - protein, 9 aa, Homo Sapiens
RFLCSQQEL

SEQ ID NO: 873686 - protein, 9 aa, Homo Sapiens
PICPVLPHV

SEQ ID NO: 873687 - protein, 9 aa, Homo Sapiens
AIDITECME

SEQ ID NO: 873688 - protein, 9 aa, Homo Sapiens
MALPTAQPL

SEQ ID NO: 873689 - protein, 9 aa, Homo Sapiens
LETFNAMDP

SEQ ID NO: 873690 - protein, 9 aa, Homo Sapiens
FYVQTYQKK

SEQ ID NO: 873691 - protein, 9 aa, Homo Sapiens
TFCPAEFHW

SEQ ID NO: 873692 - protein, 9 aa, Homo Sapiens
CFRSLVASS

SEQ ID NO: 873693 - protein, 9 aa, Homo Sapiens
KQVDNRFGA

SEQ ID NO: 873694 - protein, 9 aa, Homo Sapiens
HTSLIQHQK

SEQ ID NO: 873695 - protein, 9 aa, Homo Sapiens
RNRTEARGH

SEQ ID NO: 873696 - protein, 9 aa, Homo Sapiens
LLGFPGLQL

SEQ ID NO: 873697 - protein, 9 aa, Homo Sapiens
KESLLEESL

SEQ ID NO: 873698 - protein, 9 aa, Homo Sapiens
IINAAVKDT

SEQ ID NO: 873699 - protein, 9 aa, Homo Sapiens
ARNYLEEAV

SEQ ID NO: 873700 - protein, 9 aa, Homo Sapiens
YQKQMEEMQ

SEQ ID NO: 873701 - protein, 9 aa, Homo Sapiens
ISQEAFQII

SEQ ID NO: 873702 - protein, 9 aa, Homo Sapiens
SPRQIKLYS

SEQ ID NO: 873703 - protein, 9 aa, Homo Sapiens
VNQDCHFNL

SEQ ID NO: 873704 - protein, 9 aa, Homo Sapiens
EGPGSASST

SEQ ID NO: 873705 - protein, 9 aa, Homo Sapiens
YPLAIKNAI

SEQ ID NO: 873706 - protein, 9 aa, Homo Sapiens
TCEGEGCIE

SEQ ID NO: 873707 - protein, 9 aa, Homo Sapiens
ATQMRFFLM

SEQ ID NO: 873708 - protein, 9 aa, Homo Sapiens
ADVNNNAPA

SEQ ID NO: 873709 - protein, 9 aa, Homo Sapiens
KNVPKYQCP

SEQ ID NO: 873710 - protein, 9 aa, Homo Sapiens
NMQLCEQSE

SEQ ID NO: 873711 - protein, 9 aa, Homo Sapiens
TMITYMLNP

SEQ ID NO: 873712 - protein, 9 aa, Homo Sapiens
DDVLIVDLD

SEQ ID NO: 873713 - protein, 9 aa, Homo Sapiens
IEEMINNQN

SEQ ID NO: 873714 - protein, 9 aa, Homo Sapiens
LSSSSGVWA

SEQ ID NO: 873715 - protein, 9 aa, Homo Sapiens
PFEINKNRN

SEQ ID NO: 873716 - protein, 9 aa, Homo Sapiens
LNEVHSTEV

SEQ ID NO: 873717 - protein, 9 aa, Homo Sapiens
TPPPDQKAR

SEQ ID NO: 873718 - protein, 9 aa, Homo Sapiens
TIWRQQGFL

SEQ ID NO: 873719 - protein, 9 aa, Homo Sapiens
SMVNNNVRK

SEQ ID NO: 873720 - protein, 9 aa, Homo Sapiens
QTGLITTTK

SEQ ID NO: 873721 - protein, 9 aa, Homo Sapiens
CSLPQAWAL

SEQ ID NO: 873722 - protein, 9 aa, Homo Sapiens
LQFSLEKYL

SEQ ID NO: 873723 - protein, 9 aa, Homo Sapiens
RGFFWANIR

SEQ ID NO: 873724 - protein, 9 aa, Homo Sapiens
AQTEVMQKS

SEQ ID NO: 873725 - protein, 9 aa, Homo Sapiens
PHPDRTHTQ

SEQ ID NO: 873726 - protein, 9 aa, Homo Sapiens
PDTSNLNIK

SEQ ID NO: 873727 - protein, 9 aa, Homo Sapiens
YVELHQFVS

SEQ ID NO: 873728 - protein, 9 aa, Homo Sapiens
KFIIDLILN

SEQ ID NO: 873729 - protein, 9 aa, Homo Sapiens
IALLNGICL

SEQ ID NO: 873730 - protein, 9 aa, Homo Sapiens
EVRCGIEKQ

SEQ ID NO: 873731 - protein, 9 aa, Homo Sapiens
LLALFCHKP

SEQ ID NO: 873732 - protein, 9 aa, Homo Sapiens
SQSLHLQDH

SEQ ID NO: 873733 - protein, 9 aa, Homo Sapiens
KKDDFNWGK

SEQ ID NO: 873734 - protein, 9 aa, Homo Sapiens
NKQGFINLP

SEQ ID NO: 873735 - protein, 9 aa, Homo Sapiens
LTVYQDIKV

SEQ ID NO: 873736 - protein, 9 aa, Homo Sapiens
GLIELLALS

SEQ ID NO: 873737 - protein, 9 aa, Homo Sapiens
NLSFNDCFK

SEQ ID NO: 873738 - protein, 9 aa, Homo Sapiens
IFLALLLII

SEQ ID NO: 873739 - protein, 9 aa, Homo Sapiens
VVFYTWADP

SEQ ID NO: 873740 - protein, 9 aa, Homo Sapiens
CFPIPTEMI

SEQ ID NO: 873741 - protein, 9 aa, Homo Sapiens
ISSEHTETK

SEQ ID NO: 873742 - protein, 9 aa, Homo Sapiens
QKQKIMKYS

SEQ ID NO: 873743 - protein, 9 aa, Homo Sapiens
IQILFSSCQ

SEQ ID NO: 873744 - protein, 9 aa, Homo Sapiens
KALPILSRN

SEQ ID NO: 873745 - protein, 9 aa, Homo Sapiens
AGADSELVL

SEQ ID NO: 873746 - protein, 9 aa, Homo Sapiens
MYTHHTDTN

SEQ ID NO: 873747 - protein, 9 aa, Homo Sapiens
TPPFEINKN

SEQ ID NO: 873748 - protein, 9 aa, Homo Sapiens
EPQTPWVSS

SEQ ID NO: 873749 - protein, 9 aa, Homo Sapiens
RLCDNVWTF

SEQ ID NO: 873750 - protein, 9 aa, Homo Sapiens
SPCMQYRSH

SEQ ID NO: 873751 - protein, 9 aa, Homo Sapiens
KMEDEAEPP

SEQ ID NO: 873752 - protein, 9 aa, Homo Sapiens
GAQTTAGCN

SEQ ID NO: 873753 - protein, 9 aa, Homo Sapiens
LAFTVAMQN

SEQ ID NO: 873754 - protein, 9 aa, Homo Sapiens
KHEENLLGY

SEQ ID NO: 873755 - protein, 9 aa, Homo Sapiens
SVSLLVVSP

SEQ ID NO: 873756 - protein, 9 aa, Homo Sapiens
QRVQEEYER

SEQ ID NO: 873757 - protein, 9 aa, Homo Sapiens
RPPYNQAVS

SEQ ID NO: 873758 - protein, 9 aa, Homo Sapiens
RNFATMINF

SEQ ID NO: 873759 - protein, 9 aa, Homo Sapiens
AKSTKCFDN

SEQ ID NO: 873760 - protein, 9 aa, Homo Sapiens
RTEKHNQLG

SEQ ID NO: 873761 - protein, 9 aa, Homo Sapiens
KDNLDNIKR

SEQ ID NO: 873762 - protein, 9 aa, Homo Sapiens
GELKDDNFE

SEQ ID NO: 873763 - protein, 9 aa, Homo Sapiens
PDESSEIQE

SEQ ID NO: 873764 - protein, 9 aa, Homo Sapiens
REAAALVLA

SEQ ID NO: 873765 - protein, 9 aa, Homo Sapiens
NAPWDPCPA

SEQ ID NO: 873766 - protein, 9 aa, Homo Sapiens
ICFTDTAVV

SEQ ID NO: 873767 - protein, 9 aa, Homo Sapiens
LRTLGRPPA

SEQ ID NO: 873768 - protein, 9 aa, Homo Sapiens
VLAQMHDED

SEQ ID NO: 873769 - protein, 9 aa, Homo Sapiens
PRSGKTPSS

SEQ ID NO: 873770 - protein, 9 aa, Homo Sapiens
LIVDLDEED

SEQ ID NO: 873771 - protein, 9 aa, Homo Sapiens
SQIEINQTG

SEQ ID NO: 873772 - protein, 9 aa, Homo Sapiens
QGLQTPGPP

SEQ ID NO: 873773 - protein, 9 aa, Homo Sapiens
SGLELEKKC

SEQ ID NO: 873774 - protein, 9 aa, Homo Sapiens
KCKCRNHDY

SEQ ID NO: 873775 - protein, 9 aa, Homo Sapiens
MNKFSESET

SEQ ID NO: 873776 - protein, 9 aa, Homo Sapiens
EQAGCLNWW

SEQ ID NO: 873777 - protein, 9 aa, Homo Sapiens
RRRKGRHKE

SEQ ID NO: 873778 - protein, 9 aa, Homo Sapiens
QMETEEAWL

SEQ ID NO: 873779 - protein, 9 aa, Homo Sapiens
QPILENDIG

SEQ ID NO: 873780 - protein, 9 aa, Homo Sapiens
QQMVTKVPC

SEQ ID NO: 873781 - protein, 9 aa, Homo Sapiens
LCILNINNN

SEQ ID NO: 873782 - protein, 9 aa, Homo Sapiens
GFAQTEVMQ

SEQ ID NO: 873783 - protein, 9 aa, Homo Sapiens
RAVETVKAN

SEQ ID NO: 873784 - protein, 9 aa, Homo Sapiens
PQTLQSLQR

SEQ ID NO: 873785 - protein, 9 aa, Homo Sapiens
MQTTTPGAQ

SEQ ID NO: 873786 - protein, 9 aa, Homo Sapiens
CDNLVAKQL

SEQ ID NO: 873787 - protein, 9 aa, Homo Sapiens
SSHLIRHHQ

SEQ ID NO: 873788 - protein, 9 aa, Homo Sapiens
TLVRGSGKG

SEQ ID NO: 873789 - protein, 9 aa, Homo Sapiens
TGSERYYQL

SEQ ID NO: 873790 - protein, 9 aa, Homo Sapiens
SSTLNKHKI

SEQ ID NO: 873791 - protein, 9 aa, Homo Sapiens
ARITSSVVD

SEQ ID NO: 873792 - protein, 9 aa, Homo Sapiens
CYQRKHDYV

SEQ ID NO: 873793 - protein, 9 aa, Homo Sapiens
IVGKYSIDI

SEQ ID NO: 873794 - protein, 9 aa, Homo Sapiens
RFKIVEHFG

SEQ ID NO: 873795 - protein, 9 aa, Homo Sapiens
QHNSEKLRV

SEQ ID NO: 873796 - protein, 9 aa, Homo Sapiens
WATLRLYAE

SEQ ID NO: 873797 - protein, 9 aa, Homo Sapiens
REELKEEFV

SEQ ID NO: 873798 - protein, 9 aa, Homo Sapiens
IYNQVYYVE

SEQ ID NO: 873799 - protein, 9 aa, Homo Sapiens
HRQLYDDRN

SEQ ID NO: 873800 - protein, 9 aa, Homo Sapiens
RQKISFGKL

SEQ ID NO: 873801 - protein, 9 aa, Homo Sapiens
QRVREQQIN

SEQ ID NO: 873802 - protein, 9 aa, Homo Sapiens
CNPRPKNID

SEQ ID NO: 873803 - protein, 9 aa, Homo Sapiens
NKRRQELEY

SEQ ID NO: 873804 - protein, 9 aa, Homo Sapiens
YTLDFPESW

SEQ ID NO: 873805 - protein, 9 aa, Homo Sapiens
DYDWNKSIC

SEQ ID NO: 873806 - protein, 9 aa, Homo Sapiens
LNLEDKDIE

SEQ ID NO: 873807 - protein, 9 aa, Homo Sapiens
TFLFALSFT

SEQ ID NO: 873808 - protein, 9 aa, Homo Sapiens
ARRKELEEN

SEQ ID NO: 873809 - protein, 9 aa, Homo Sapiens
HKPESKVEC

SEQ ID NO: 873810 - protein, 9 aa, Homo Sapiens
ICHSLWGTH

SEQ ID NO: 873811 - protein, 9 aa, Homo Sapiens
LSRLISFQR

SEQ ID NO: 873812 - protein, 9 aa, Homo Sapiens
QPADNHEEL

SEQ ID NO: 873813 - protein, 9 aa, Homo Sapiens
IMSGPNSSS

SEQ ID NO: 873814 - protein, 9 aa, Homo Sapiens
LLISNVADD

SEQ ID NO: 873815 - protein, 9 aa, Homo Sapiens
MSMQSLNGD

SEQ ID NO: 873816 - protein, 9 aa, Homo Sapiens
PATDTGKEN

SEQ ID NO: 873817 - protein, 9 aa, Homo Sapiens
QAVLWASDE

SEQ ID NO: 873818 - protein, 9 aa, Homo Sapiens
VCKVNESIK

SEQ ID NO: 873819 - protein, 9 aa, Homo Sapiens
DPLLSVFMW

SEQ ID NO: 873820 - protein, 9 aa, Homo Sapiens
EKPFWCTFE

SEQ ID NO: 873821 - protein, 9 aa, Homo Sapiens
TQQAALPRL

SEQ ID NO: 873822 - protein, 9 aa, Homo Sapiens
LTKFREDLE

SEQ ID NO: 873823 - protein, 9 aa, Homo Sapiens
DTLTKHYGA

SEQ ID NO: 873824 - protein, 9 aa, Homo Sapiens
VINLAESLV

SEQ ID NO: 873825 - protein, 9 aa, Homo Sapiens
NVSLSSMQG

SEQ ID NO: 873826 - protein, 9 aa, Homo Sapiens
ICNELEKQM

SEQ ID NO: 873827 - protein, 9 aa, Homo Sapiens
KESVQIIRD

SEQ ID NO: 873828 - protein, 9 aa, Homo Sapiens
RNQEKLNKF

SEQ ID NO: 873829 - protein, 9 aa, Homo Sapiens
KVNNLAVEK

SEQ ID NO: 873830 - protein, 9 aa, Homo Sapiens
YAVMVFQTK

SEQ ID NO: 873831 - protein, 9 aa, Homo Sapiens
CKIKVHSAD

SEQ ID NO: 873832 - protein, 9 aa, Homo Sapiens
CCQQEFFVD

SEQ ID NO: 873833 - protein, 9 aa, Homo Sapiens
NPLICTLKN

SEQ ID NO: 873834 - protein, 9 aa, Homo Sapiens
FYNKSKDDD

SEQ ID NO: 873835 - protein, 9 aa, Homo Sapiens
YKYIEHLKE

SEQ ID NO: 873836 - protein, 9 aa, Homo Sapiens
IICLSSGWG

SEQ ID NO: 873837 - protein, 9 aa, Homo Sapiens
IQSIPSLLS

SEQ ID NO: 873838 - protein, 9 aa, Homo Sapiens
ATKLYCFYS

SEQ ID NO: 873839 - protein, 9 aa, Homo Sapiens
EGEGCIEWC

SEQ ID NO: 873840 - protein, 9 aa, Homo Sapiens
VDILQGAKI

SEQ ID NO: 873841 - protein, 9 aa, Homo Sapiens
PCCLVLVPD

SEQ ID NO: 873842 - protein, 9 aa, Homo Sapiens
ILTRKQIRY

SEQ ID NO: 873843 - protein, 9 aa, Homo Sapiens
KIQTLLQDF

SEQ ID NO: 873844 - protein, 9 aa, Homo Sapiens
EDPPHRKHM

SEQ ID NO: 873845 - protein, 9 aa, Homo Sapiens
NQRLFVLFT

SEQ ID NO: 873846 - protein, 9 aa, Homo Sapiens
ISNAPHNYA

SEQ ID NO: 873847 - protein, 9 aa, Homo Sapiens
VIGYIGMVV

SEQ ID NO: 873848 - protein, 9 aa, Homo Sapiens
RQTLQRNDI

SEQ ID NO: 873849 - protein, 9 aa, Homo Sapiens
LEAIDGSGL

SEQ ID NO: 873850 - protein, 9 aa, Homo Sapiens
PMSIRSASA

SEQ ID NO: 873851 - protein, 9 aa, Homo Sapiens
INGLQDKHL

SEQ ID NO: 873852 - protein, 9 aa, Homo Sapiens
DAVEDNRIY

SEQ ID NO: 873853 - protein, 9 aa, Homo Sapiens
IHLIQMAVA

SEQ ID NO: 873854 - protein, 9 aa, Homo Sapiens
SSKSRAFII

SEQ ID NO: 873855 - protein, 9 aa, Homo Sapiens
DCDADVHLR

SEQ ID NO: 873856 - protein, 9 aa, Homo Sapiens
AVEDNRIYG

SEQ ID NO: 873857 - protein, 9 aa, Homo Sapiens
SIPKSGGSG

SEQ ID NO: 873858 - protein, 9 aa, Homo Sapiens
NRLYPVAVL

SEQ ID NO: 873859 - protein, 9 aa, Homo Sapiens
ARALINLHN

SEQ ID NO: 873860 - protein, 9 aa, Homo Sapiens
LEDKSILGN

SEQ ID NO: 873861 - protein, 9 aa, Homo Sapiens
TQKKAADTV

SEQ ID NO: 873862 - protein, 9 aa, Homo Sapiens
PEDKGRVAR

SEQ ID NO: 873863 - protein, 9 aa, Homo Sapiens
DLLVLTVYQ

SEQ ID NO: 873864 - protein, 9 aa, Homo Sapiens
NRIHKLLNG

SEQ ID NO: 873865 - protein, 9 aa, Homo Sapiens
KHTDDFEES

SEQ ID NO: 873866 - protein, 9 aa, Homo Sapiens
HIVHYNSDS

SEQ ID NO: 873867 - protein, 9 aa, Homo Sapiens
YRSFNTFFP

SEQ ID NO: 873868 - protein, 9 aa, Homo Sapiens
NNAPAFAQS

SEQ ID NO: 873869 - protein, 9 aa, Homo Sapiens
SQSSENDGE

SEQ ID NO: 873870 - protein, 9 aa, Homo Sapiens
TAKAETTLL

SEQ ID NO: 873871 - protein, 9 aa, Homo Sapiens
LQFLSLVHH

SEQ ID NO: 873872 - protein, 9 aa, Homo Sapiens
DMLKMATRY

SEQ ID NO: 873873 - protein, 9 aa, Homo Sapiens
ILLMFTSVT

SEQ ID NO: 873874 - protein, 9 aa, Homo Sapiens
TFICRSTLS

SEQ ID NO: 873875 - protein, 9 aa, Homo Sapiens
LGPYHYKFE

SEQ ID NO: 873876 - protein, 9 aa, Homo Sapiens
KTVGGLIYW

SEQ ID NO: 873877 - protein, 9 aa, Homo Sapiens
ASYLICARR

SEQ ID NO: 873878 - protein, 9 aa, Homo Sapiens
DIVQKNTSY

SEQ ID NO: 873879 - protein, 9 aa, Homo Sapiens
ISKKRNKSC

SEQ ID NO: 873880 - protein, 9 aa, Homo Sapiens
PIHLFLTNE

SEQ ID NO: 873881 - protein, 9 aa, Homo Sapiens
IEARDYSQG

SEQ ID NO: 873882 - protein, 9 aa, Homo Sapiens
STSTLANLT

SEQ ID NO: 873883 - protein, 9 aa, Homo Sapiens
DCFLLVTMA

SEQ ID NO: 873884 - protein, 9 aa, Homo Sapiens
ETISQPVVV

SEQ ID NO: 873885 - protein, 9 aa, Homo Sapiens
RHHNLHSWH

SEQ ID NO: 873886 - protein, 9 aa, Homo Sapiens
TIRQLEDRN

SEQ ID NO: 873887 - protein, 9 aa, Homo Sapiens
HLTRHQIIH

SEQ ID NO: 873888 - protein, 9 aa, Homo Sapiens
GVDYSDSAV

SEQ ID NO: 873889 - protein, 9 aa, Homo Sapiens
LFDDNGQEI

SEQ ID NO: 873890 - protein, 9 aa, Homo Sapiens
EKAPEPNLM

SEQ ID NO: 873891 - protein, 9 aa, Homo Sapiens
GAHTEILAK

SEQ ID NO: 873892 - protein, 9 aa, Homo Sapiens
INLIVHQRT

SEQ ID NO: 873893 - protein, 9 aa, Homo Sapiens
RDLIRQIEC

SEQ ID NO: 873894 - protein, 9 aa, Homo Sapiens
ETCEQALRI

SEQ ID NO: 873895 - protein, 9 aa, Homo Sapiens
QANVQVNKA

SEQ ID NO: 873896 - protein, 9 aa, Homo Sapiens
LHLETCQYL

SEQ ID NO: 873897 - protein, 9 aa, Homo Sapiens
DACTKKIGL

SEQ ID NO: 873898 - protein, 9 aa, Homo Sapiens
IVALDLQSH

SEQ ID NO: 873899 - protein, 9 aa, Homo Sapiens
LMKHKIINT

SEQ ID NO: 873900 - protein, 9 aa, Homo Sapiens
CQTRQNAKW

SEQ ID NO: 873901 - protein, 9 aa, Homo Sapiens
PKEVVDCII

SEQ ID NO: 873902 - protein, 9 aa, Homo Sapiens
SERHSISNG

SEQ ID NO: 873903 - protein, 9 aa, Homo Sapiens
CPVCIQKFK

SEQ ID NO: 873904 - protein, 9 aa, Homo Sapiens
LAKHKKIHT

SEQ ID NO: 873905 - protein, 9 aa, Homo Sapiens
LKSESLKSN

SEQ ID NO: 873906 - protein, 9 aa, Homo Sapiens
QILINKNVS

SEQ ID NO: 873907 - protein, 9 aa, Homo Sapiens
SFANVFSEY

SEQ ID NO: 873908 - protein, 9 aa, Homo Sapiens
CCLNPIIYG

SEQ ID NO: 873909 - protein, 9 aa, Homo Sapiens
QNSLIADME

SEQ ID NO: 873910 - protein, 9 aa, Homo Sapiens
KNDRSKSKS

SEQ ID NO: 873911 - protein, 9 aa, Homo Sapiens
VAVKILLTF

SEQ ID NO: 873912 - protein, 9 aa, Homo Sapiens
SHLTRHQII

SEQ ID NO: 873913 - protein, 9 aa, Homo Sapiens
NLMSPTRKA

SEQ ID NO: 873914 - protein, 9 aa, Homo Sapiens
SFILRINCA

SEQ ID NO: 873915 - protein, 9 aa, Homo Sapiens
GKDYENEDN

SEQ ID NO: 873916 - protein, 9 aa, Homo Sapiens
HRKPSFLAH

SEQ ID NO: 873917 - protein, 9 aa, Homo Sapiens
FVNAANESR

SEQ ID NO: 873918 - protein, 9 aa, Homo Sapiens
SFKFVRPFP

SEQ ID NO: 873919 - protein, 9 aa, Homo Sapiens
RKAKTINQR

SEQ ID NO: 873920 - protein, 9 aa, Homo Sapiens
PLHTLYHIL

SEQ ID NO: 873921 - protein, 9 aa, Homo Sapiens
WEQNDTFIM

SEQ ID NO: 873922 - protein, 9 aa, Homo Sapiens
YSPRAADKS

SEQ ID NO: 873923 - protein, 9 aa, Homo Sapiens
KLRHNLDAL

SEQ ID NO: 873924 - protein, 9 aa, Homo Sapiens
DTRLSPIAP

SEQ ID NO: 873925 - protein, 9 aa, Homo Sapiens
FHHTTANNK

SEQ ID NO: 873926 - protein, 9 aa, Homo Sapiens
HNYVLDLVS

SEQ ID NO: 873927 - protein, 9 aa, Homo Sapiens
NVSLTGAST

SEQ ID NO: 873928 - protein, 9 aa, Homo Sapiens
DVCADAVSK

SEQ ID NO: 873929 - protein, 9 aa, Homo Sapiens
HEVVGSASN

SEQ ID NO: 873930 - protein, 9 aa, Homo Sapiens
NMNLLLDAR

SEQ ID NO: 873931 - protein, 9 aa, Homo Sapiens
SWGYRRKAG

SEQ ID NO: 873932 - protein, 9 aa, Homo Sapiens
NGHEKDTMK

SEQ ID NO: 873933 - protein, 9 aa, Homo Sapiens
GINSPSVLP

SEQ ID NO: 873934 - protein, 9 aa, Homo Sapiens
ITKGWKEVN

SEQ ID NO: 873935 - protein, 9 aa, Homo Sapiens
SKVVFTENT

SEQ ID NO: 873936 - protein, 9 aa, Homo Sapiens
WNPPTTTEV

SEQ ID NO: 873937 - protein, 9 aa, Homo Sapiens
HKIDLPPTI

SEQ ID NO: 873938 - protein, 9 aa, Homo Sapiens
QQQRTGKPD

SEQ ID NO: 873939 - protein, 9 aa, Homo Sapiens
SNNVTLGYD

SEQ ID NO: 873940 - protein, 9 aa, Homo Sapiens
YGRCMWYCL

SEQ ID NO: 873941 - protein, 9 aa, Homo Sapiens
AFLCSRTLN

SEQ ID NO: 873942 - protein, 9 aa, Homo Sapiens
NLLFMSVWD

SEQ ID NO: 873943 - protein, 9 aa, Homo Sapiens
PQERLPVLP

SEQ ID NO: 873944 - protein, 9 aa, Homo Sapiens
NDYMKSLGV

SEQ ID NO: 873945 - protein, 9 aa, Homo Sapiens
LWRAMGPAG

SEQ ID NO: 873946 - protein, 9 aa, Homo Sapiens
TTAKEPSAL

SEQ ID NO: 873947 - protein, 9 aa, Homo Sapiens
LQRHEMTHT

SEQ ID NO: 873948 - protein, 9 aa, Homo Sapiens
VLVLLLVTL

SEQ ID NO: 873949 - protein, 9 aa, Homo Sapiens
LSCHRRVHL

SEQ ID NO: 873950 - protein, 9 aa, Homo Sapiens
MVLRQRFWG

SEQ ID NO: 873951 - protein, 9 aa, Homo Sapiens
HTCLTLNYV

SEQ ID NO: 873952 - protein, 9 aa, Homo Sapiens
RYQKQMEEM

SEQ ID NO: 873953 - protein, 9 aa, Homo Sapiens
HLRSFSMHD

SEQ ID NO: 873954 - protein, 9 aa, Homo Sapiens
EMQENYQKN

SEQ ID NO: 873955 - protein, 9 aa, Homo Sapiens
LLQTDFVLD

SEQ ID NO: 873956 - protein, 9 aa, Homo Sapiens
SDPPVISEE

SEQ ID NO: 873957 - protein, 9 aa, Homo Sapiens
KEISDDKVS

SEQ ID NO: 873958 - protein, 9 aa, Homo Sapiens
KGLCLSCRN

SEQ ID NO: 873959 - protein, 9 aa, Homo Sapiens
HRSQRRHAA

SEQ ID NO: 873960 - protein, 9 aa, Homo Sapiens
FHSIRGEVY

SEQ ID NO: 873961 - protein, 9 aa, Homo Sapiens
QLSCQNLGA

SEQ ID NO: 873962 - protein, 9 aa, Homo Sapiens
PASEVLQIQ

SEQ ID NO: 873963 - protein, 9 aa, Homo Sapiens
HQTNKQEKS

SEQ ID NO: 873964 - protein, 9 aa, Homo Sapiens
GNSIRSYCE

SEQ ID NO: 873965 - protein, 9 aa, Homo Sapiens
KELSLICAK

SEQ ID NO: 873966 - protein, 9 aa, Homo Sapiens
QCIMFIVNS

SEQ ID NO: 873967 - protein, 9 aa, Homo Sapiens
ESWLEPVWF

SEQ ID NO: 873968 - protein, 9 aa, Homo Sapiens
TLPVGRLCS

SEQ ID NO: 873969 - protein, 9 aa, Homo Sapiens
STANENTTP

SEQ ID NO: 873970 - protein, 9 aa, Homo Sapiens
GDHVNLTTC

SEQ ID NO: 873971 - protein, 9 aa, Homo Sapiens
YIIQVVFQN

SEQ ID NO: 873972 - protein, 9 aa, Homo Sapiens
CGQFFTFNS

SEQ ID NO: 873973 - protein, 9 aa, Homo Sapiens
WRKEFAVLS

SEQ ID NO: 873974 - protein, 9 aa, Homo Sapiens
PKEDKKPKE

SEQ ID NO: 873975 - protein, 9 aa, Homo Sapiens
IFRICFHDP

SEQ ID NO: 873976 - protein, 9 aa, Homo Sapiens
NGGTSLSDK

SEQ ID NO: 873977 - protein, 9 aa, Homo Sapiens
QIAKIYQQH

SEQ ID NO: 873978 - protein, 9 aa, Homo Sapiens
NKNVQKINE

SEQ ID NO: 873979 - protein, 9 aa, Homo Sapiens
EANSINTLR

SEQ ID NO: 873980 - protein, 9 aa, Homo Sapiens
RLNWSDSDS

SEQ ID NO: 873981 - protein, 9 aa, Homo Sapiens
LPAGSTKNW

SEQ ID NO: 873982 - protein, 9 aa, Homo Sapiens
QMQKLPQLW

SEQ ID NO: 873983 - protein, 9 aa, Homo Sapiens
IKQAFCVLS

SEQ ID NO: 873984 - protein, 9 aa, Homo Sapiens
GQSIACPFV

SEQ ID NO: 873985 - protein, 9 aa, Homo Sapiens
NGKNIGKFC

SEQ ID NO: 873986 - protein, 9 aa, Homo Sapiens
PMLWALLDQ

SEQ ID NO: 873987 - protein, 9 aa, Homo Sapiens
KSCGIHETT

SEQ ID NO: 873988 - protein, 9 aa, Homo Sapiens
IDRLFLKFF

SEQ ID NO: 873989 - protein, 9 aa, Homo Sapiens
IRGSTLCFL

SEQ ID NO: 873990 - protein, 9 aa, Homo Sapiens
DLLLAKVDL

SEQ ID NO: 873991 - protein, 9 aa, Homo Sapiens
RINKFFLHI

SEQ ID NO: 873992 - protein, 9 aa, Homo Sapiens
DDRQPQWRR

SEQ ID NO: 873993 - protein, 9 aa, Homo Sapiens
LGTLTHGDR

SEQ ID NO: 873994 - protein, 9 aa, Homo Sapiens
TLDYLKEVD

SEQ ID NO: 873995 - protein, 9 aa, Homo Sapiens
LDDHQNKIN

SEQ ID NO: 873996 - protein, 9 aa, Homo Sapiens
VEHEKPAQP

SEQ ID NO: 873997 - protein, 9 aa, Homo Sapiens
SRVEKFLFN

SEQ ID NO: 873998 - protein, 9 aa, Homo Sapiens
TIQNQVRKE

SEQ ID NO: 873999 - protein, 9 aa, Homo Sapiens
IDALEKIKA

SEQ ID NO: 874000 - protein, 9 aa, Homo Sapiens
FHAMYSGSQ

SEQ ID NO: 874001 - protein, 9 aa, Homo Sapiens
TQLSCQNLG

SEQ ID NO: 874002 - protein, 9 aa, Homo Sapiens
TASEKMSTP

SEQ ID NO: 874003 - protein, 9 aa, Homo Sapiens
SQRRHAASP

SEQ ID NO: 874004 - protein, 9 aa, Homo Sapiens
EVNQARLEC

SEQ ID NO: 874005 - protein, 9 aa, Homo Sapiens
WGCFDECNR

SEQ ID NO: 874006 - protein, 9 aa, Homo Sapiens
AMNKRGQLY

SEQ ID NO: 874007 - protein, 9 aa, Homo Sapiens
LSIAVAAGY

SEQ ID NO: 874008 - protein, 9 aa, Homo Sapiens
LDHLGNSVL

SEQ ID NO: 874009 - protein, 9 aa, Homo Sapiens
IDIFFHFFY

SEQ ID NO: 874010 - protein, 9 aa, Homo Sapiens
RRSHKLQGM

SEQ ID NO: 874011 - protein, 9 aa, Homo Sapiens
PVPSAPVIN

SEQ ID NO: 874012 - protein, 9 aa, Homo Sapiens
SRPDQNLDL

SEQ ID NO: 874013 - protein, 9 aa, Homo Sapiens
RNEVIHISR

SEQ ID NO: 874014 - protein, 9 aa, Homo Sapiens
KLNDFAVFT

SEQ ID NO: 874015 - protein, 9 aa, Homo Sapiens
EQDLKVVKD

SEQ ID NO: 874016 - protein, 9 aa, Homo Sapiens
YSTGYVIFT

SEQ ID NO: 874017 - protein, 9 aa, Homo Sapiens
LCKMTVNTE

SEQ ID NO: 874018 - protein, 9 aa, Homo Sapiens
KVLIQPLNR

SEQ ID NO: 874019 - protein, 9 aa, Homo Sapiens
RRDIGNSIK

SEQ ID NO: 874020 - protein, 9 aa, Homo Sapiens
KNEIQNAEQ

SEQ ID NO: 874021 - protein, 9 aa, Homo Sapiens
FFVPCMFMY

SEQ ID NO: 874022 - protein, 9 aa, Homo Sapiens
KLPVENSGA

SEQ ID NO: 874023 - protein, 9 aa, Homo Sapiens
LFPQYTPPS

SEQ ID NO: 874024 - protein, 9 aa, Homo Sapiens
NDTLDPKPF

SEQ ID NO: 874025 - protein, 9 aa, Homo Sapiens
IQTLKHKFK

SEQ ID NO: 874026 - protein, 9 aa, Homo Sapiens
FMISTPEKC

SEQ ID NO: 874027 - protein, 9 aa, Homo Sapiens
DNSVKKYSR

SEQ ID NO: 874028 - protein, 9 aa, Homo Sapiens
VCREEFEGK

SEQ ID NO: 874029 - protein, 9 aa, Homo Sapiens
FIYKRCLNE

SEQ ID NO: 874030 - protein, 9 aa, Homo Sapiens
GDKPFECNE

SEQ ID NO: 874031 - protein, 9 aa, Homo Sapiens
HYCRGFNIF

SEQ ID NO: 874032 - protein, 9 aa, Homo Sapiens
VEYYNPATD

SEQ ID NO: 874033 - protein, 9 aa, Homo Sapiens
KHQCIHTDD

SEQ ID NO: 874034 - protein, 9 aa, Homo Sapiens
FLFNKPVSP

SEQ ID NO: 874035 - protein, 9 aa, Homo Sapiens
NNKVVDKSD

SEQ ID NO: 874036 - protein, 9 aa, Homo Sapiens
ANVSLSSMQ

SEQ ID NO: 874037 - protein, 9 aa, Homo Sapiens
SSFNFCREN

SEQ ID NO: 874038 - protein, 9 aa, Homo Sapiens
LYRNNFLTA

SEQ ID NO: 874039 - protein, 9 aa, Homo Sapiens
ETINKGGVS

SEQ ID NO: 874040 - protein, 9 aa, Homo Sapiens
DIFILLCLK

SEQ ID NO: 874041 - protein, 9 aa, Homo Sapiens
RPPRLISIF

SEQ ID NO: 874042 - protein, 9 aa, Homo Sapiens
KKLLEEVKK

SEQ ID NO: 874043 - protein, 9 aa, Homo Sapiens
AVVDGGQAG

SEQ ID NO: 874044 - protein, 9 aa, Homo Sapiens
PMRSCLYAG

SEQ ID NO: 874045 - protein, 9 aa, Homo Sapiens
LIEQNQRYV

SEQ ID NO: 874046 - protein, 9 aa, Homo Sapiens
LACEKGSAK

SEQ ID NO: 874047 - protein, 9 aa, Homo Sapiens
ASNLTRHQI

SEQ ID NO: 874048 - protein, 9 aa, Homo Sapiens
KDDNFEKIS

SEQ ID NO: 874049 - protein, 9 aa, Homo Sapiens
YAAGVCNPQ

SEQ ID NO: 874050 - protein, 9 aa, Homo Sapiens
AGSDIGYGF

SEQ ID NO: 874051 - protein, 9 aa, Homo Sapiens
KEEEGVPDK

SEQ ID NO: 874052 - protein, 9 aa, Homo Sapiens
YYQILGVPQ

SEQ ID NO: 874053 - protein, 9 aa, Homo Sapiens
ISLQVRQEP

SEQ ID NO: 874054 - protein, 9 aa, Homo Sapiens
HNNMVWYRQ

SEQ ID NO: 874055 - protein, 9 aa, Homo Sapiens
MQCCGLVHH

SEQ ID NO: 874056 - protein, 9 aa, Homo Sapiens
RKEKSTKDE

SEQ ID NO: 874057 - protein, 9 aa, Homo Sapiens
NSFDRSVVV

SEQ ID NO: 874058 - protein, 9 aa, Homo Sapiens
KKQQFGELR

SEQ ID NO: 874059 - protein, 9 aa, Homo Sapiens
ITLDSILLL

SEQ ID NO: 874060 - protein, 9 aa, Homo Sapiens
VHCKKEHKR

SEQ ID NO: 874061 - protein, 9 aa, Homo Sapiens
AKTSVKPSV

SEQ ID NO: 874062 - protein, 9 aa, Homo Sapiens
TADSQKSHL

SEQ ID NO: 874063 - protein, 9 aa, Homo Sapiens
NNRWLRTIF

SEQ ID NO: 874064 - protein, 9 aa, Homo Sapiens
MNGRYYSKI

SEQ ID NO: 874065 - protein, 9 aa, Homo Sapiens
ESGSEASNS

SEQ ID NO: 874066 - protein, 9 aa, Homo Sapiens
GSLFSPRQN

SEQ ID NO: 874067 - protein, 9 aa, Homo Sapiens
GEERDIQYA

SEQ ID NO: 874068 - protein, 9 aa, Homo Sapiens
KKAVLAGYL

SEQ ID NO: 874069 - protein, 9 aa, Homo Sapiens
KNYGGGKGS

SEQ ID NO: 874070 - protein, 9 aa, Homo Sapiens
NICQVIQME

SEQ ID NO: 874071 - protein, 9 aa, Homo Sapiens
SDKTVLLLV

SEQ ID NO: 874072 - protein, 9 aa, Homo Sapiens
VFILGVVYT

SEQ ID NO: 874073 - protein, 9 aa, Homo Sapiens
RYLGDKGLI

SEQ ID NO: 874074 - protein, 9 aa, Homo Sapiens
YGRVVLNQH

SEQ ID NO: 874075 - protein, 9 aa, Homo Sapiens
VILQHMKDH

SEQ ID NO: 874076 - protein, 9 aa, Homo Sapiens
ESLLARACC

SEQ ID NO: 874077 - protein, 9 aa, Homo Sapiens
YLQRRPCNV

SEQ ID NO: 874078 - protein, 9 aa, Homo Sapiens
RSLPSNPSS

SEQ ID NO: 874079 - protein, 9 aa, Homo Sapiens
RDVKCIKDL

SEQ ID NO: 874080 - protein, 9 aa, Homo Sapiens
FKAKCKLVN

SEQ ID NO: 874081 - protein, 9 aa, Homo Sapiens
QELFGLNNC

SEQ ID NO: 874082 - protein, 9 aa, Homo Sapiens
RCNGQFKTY

SEQ ID NO: 874083 - protein, 9 aa, Homo Sapiens
LSFLFNTIC

SEQ ID NO: 874084 - protein, 9 aa, Homo Sapiens
DLKLDNILV

SEQ ID NO: 874085 - protein, 9 aa, Homo Sapiens
SQVKIRNRT

SEQ ID NO: 874086 - protein, 9 aa, Homo Sapiens
MPHNYTRCY

SEQ ID NO: 874087 - protein, 9 aa, Homo Sapiens
KCDVTAQAC

SEQ ID NO: 874088 - protein, 9 aa, Homo Sapiens
SIEARDYSQ

SEQ ID NO: 874089 - protein, 9 aa, Homo Sapiens
VIDKMNIKL

SEQ ID NO: 874090 - protein, 9 aa, Homo Sapiens
NLTLRNQIQ

SEQ ID NO: 874091 - protein, 9 aa, Homo Sapiens
KDTEDNLHV

SEQ ID NO: 874092 - protein, 9 aa, Homo Sapiens
EEPTCRNQT

SEQ ID NO: 874093 - protein, 9 aa, Homo Sapiens
QKFIVTQMA

SEQ ID NO: 874094 - protein, 9 aa, Homo Sapiens
SRFSISFQH

SEQ ID NO: 874095 - protein, 9 aa, Homo Sapiens
GNCDGFNVR

SEQ ID NO: 874096 - protein, 9 aa, Homo Sapiens
RMRRGQNTL

SEQ ID NO: 874097 - protein, 9 aa, Homo Sapiens
YINFDKWRK

SEQ ID NO: 874098 - protein, 9 aa, Homo Sapiens
LLLRFKVSV

SEQ ID NO: 874099 - protein, 9 aa, Homo Sapiens
QIKYLIPQF

SEQ ID NO: 874100 - protein, 9 aa, Homo Sapiens
SSSVRWATH

SEQ ID NO: 874101 - protein, 9 aa, Homo Sapiens
CIHFICIYA

SEQ ID NO: 874102 - protein, 9 aa, Homo Sapiens
ASHVLEAAL

SEQ ID NO: 874103 - protein, 9 aa, Homo Sapiens
RDSFLKEPI

SEQ ID NO: 874104 - protein, 9 aa, Homo Sapiens
QSLLNMCVG

SEQ ID NO: 874105 - protein, 9 aa, Homo Sapiens
FWVNVINNP

SEQ ID NO: 874106 - protein, 9 aa, Homo Sapiens
ISLSSHILF

SEQ ID NO: 874107 - protein, 9 aa, Homo Sapiens
CEFKLSKVW

SEQ ID NO: 874108 - protein, 9 aa, Homo Sapiens
NNWRPQLLV

SEQ ID NO: 874109 - protein, 9 aa, Homo Sapiens
RTLETQPTR

SEQ ID NO: 874110 - protein, 9 aa, Homo Sapiens
IAQQFKMQL

SEQ ID NO: 874111 - protein, 9 aa, Homo Sapiens
TRQNAKWLT

SEQ ID NO: 874112 - protein, 9 aa, Homo Sapiens
ADGREFNLQ

SEQ ID NO: 874113 - protein, 9 aa, Homo Sapiens
HAAFLRTLG

SEQ ID NO: 874114 - protein, 9 aa, Homo Sapiens
VWGRLYPWG

SEQ ID NO: 874115 - protein, 9 aa, Homo Sapiens
SSSGEEKTK

SEQ ID NO: 874116 - protein, 9 aa, Homo Sapiens
IARTRAGSR

SEQ ID NO: 874117 - protein, 9 aa, Homo Sapiens
NTRQHYYPM

SEQ ID NO: 874118 - protein, 9 aa, Homo Sapiens
PEYKLQAPH

SEQ ID NO: 874119 - protein, 9 aa, Homo Sapiens
PNNQLRHIH

SEQ ID NO: 874120 - protein, 9 aa, Homo Sapiens
GSGAPWLQI

SEQ ID NO: 874121 - protein, 9 aa, Homo Sapiens
VWIGQLMHY

SEQ ID NO: 874122 - protein, 9 aa, Homo Sapiens
AREEDKHPY

SEQ ID NO: 874123 - protein, 9 aa, Homo Sapiens
CCQSFKWYL

SEQ ID NO: 874124 - protein, 9 aa, Homo Sapiens
CKERNLREN

SEQ ID NO: 874125 - protein, 9 aa, Homo Sapiens
QQLSGINVI

SEQ ID NO: 874126 - protein, 9 aa, Homo Sapiens
FKDALRVPP

SEQ ID NO: 874127 - protein, 9 aa, Homo Sapiens
IIHKIIHTE

SEQ ID NO: 874128 - protein, 9 aa, Homo Sapiens
NFFYRCFPD

SEQ ID NO: 874129 - protein, 9 aa, Homo Sapiens
LPVENSGAI

SEQ ID NO: 874130 - protein, 9 aa, Homo Sapiens
ACNTEGFVP

SEQ ID NO: 874131 - protein, 9 aa, Homo Sapiens
LRQIAHGAD

SEQ ID NO: 874132 - protein, 9 aa, Homo Sapiens
NQDKQRQKQ

SEQ ID NO: 874133 - protein, 9 aa, Homo Sapiens
RFKGITTLP

SEQ ID NO: 874134 - protein, 9 aa, Homo Sapiens
WNQRHSGKD

SEQ ID NO: 874135 - protein, 9 aa, Homo Sapiens
IYIAATYTL

SEQ ID NO: 874136 - protein, 9 aa, Homo Sapiens
TLRSRSGTD

SEQ ID NO: 874137 - protein, 9 aa, Homo Sapiens
YPCLMARET

SEQ ID NO: 874138 - protein, 9 aa, Homo Sapiens
GPRSDMESL

SEQ ID NO: 874139 - protein, 9 aa, Homo Sapiens
YDSKLWEEA

SEQ ID NO: 874140 - protein, 9 aa, Homo Sapiens
LSNAKCKKS

SEQ ID NO: 874141 - protein, 9 aa, Homo Sapiens
FCLMNYFSL

SEQ ID NO: 874142 - protein, 9 aa, Homo Sapiens
ENQHNNILY

SEQ ID NO: 874143 - protein, 9 aa, Homo Sapiens
FMEQLCTYQ

SEQ ID NO: 874144 - protein, 9 aa, Homo Sapiens
KRHLRVDQI

SEQ ID NO: 874145 - protein, 9 aa, Homo Sapiens
YSNVRGKQH

SEQ ID NO: 874146 - protein, 9 aa, Homo Sapiens
AEACKYTLQ

SEQ ID NO: 874147 - protein, 9 aa, Homo Sapiens
LLKGAFQSS

SEQ ID NO: 874148 - protein, 9 aa, Homo Sapiens
KEKMYGKQN

SEQ ID NO: 874149 - protein, 9 aa, Homo Sapiens
ICPNIAQKR

SEQ ID NO: 874150 - protein, 9 aa, Homo Sapiens
MSYVKLQTN

SEQ ID NO: 874151 - protein, 9 aa, Homo Sapiens
ICLSSGWGK

SEQ ID NO: 874152 - protein, 9 aa, Homo Sapiens
RIEVLKHKV

SEQ ID NO: 874153 - protein, 9 aa, Homo Sapiens
NEDELDNAY

SEQ ID NO: 874154 - protein, 9 aa, Homo Sapiens
SYSRWARLN

SEQ ID NO: 874155 - protein, 9 aa, Homo Sapiens
TLGKNEGKE

SEQ ID NO: 874156 - protein, 9 aa, Homo Sapiens
IQKFKRKEM

SEQ ID NO: 874157 - protein, 9 aa, Homo Sapiens
QVWGKVFPP

SEQ ID NO: 874158 - protein, 9 aa, Homo Sapiens
QIHMYKQDG

SEQ ID NO: 874159 - protein, 9 aa, Homo Sapiens
KIVCVLNLW

SEQ ID NO: 874160 - protein, 9 aa, Homo Sapiens
SNRFCRDAK

SEQ ID NO: 874161 - protein, 9 aa, Homo Sapiens
DCPDGSDDA

SEQ ID NO: 874162 - protein, 9 aa, Homo Sapiens
CDLKLDNIL

SEQ ID NO: 874163 - protein, 9 aa, Homo Sapiens
SGRGGGHCS

SEQ ID NO: 874164 - protein, 9 aa, Homo Sapiens
IPVSPIPLT

SEQ ID NO: 874165 - protein, 9 aa, Homo Sapiens
IKCPLPSQV

SEQ ID NO: 874166 - protein, 9 aa, Homo Sapiens
TAVAELRAH

SEQ ID NO: 874167 - protein, 9 aa, Homo Sapiens
KAAIVHNVH

SEQ ID NO: 874168 - protein, 9 aa, Homo Sapiens
TFTILFESQ

SEQ ID NO: 874169 - protein, 9 aa, Homo Sapiens
TLIMWCRGH

SEQ ID NO: 874170 - protein, 9 aa, Homo Sapiens
VPPPRSTSQ

SEQ ID NO: 874171 - protein, 9 aa, Homo Sapiens
TPADKRIPQ

SEQ ID NO: 874172 - protein, 9 aa, Homo Sapiens
LGTPSEVYH

SEQ ID NO: 874173 - protein, 9 aa, Homo Sapiens
EQIHAQETI

SEQ ID NO: 874174 - protein, 9 aa, Homo Sapiens
VSHAWDSEE

SEQ ID NO: 874175 - protein, 9 aa, Homo Sapiens
DLLRHHIIH

SEQ ID NO: 874176 - protein, 9 aa, Homo Sapiens
YCDNCNLKY

SEQ ID NO: 874177 - protein, 9 aa, Homo Sapiens
LQTELVRME

SEQ ID NO: 874178 - protein, 9 aa, Homo Sapiens
LQERNQILE

SEQ ID NO: 874179 - protein, 9 aa, Homo Sapiens
HRRQRKQRP

SEQ ID NO: 874180 - protein, 9 aa, Homo Sapiens
EQRSFIGNS

SEQ ID NO: 874181 - protein, 9 aa, Homo Sapiens
NVARRIEFQ

SEQ ID NO: 874182 - protein, 9 aa, Homo Sapiens
YLGDKGLIS

SEQ ID NO: 874183 - protein, 9 aa, Homo Sapiens
KVSGRRSPK

SEQ ID NO: 874184 - protein, 9 aa, Homo Sapiens
VIITDFKDK

SEQ ID NO: 874185 - protein, 9 aa, Homo Sapiens
AAGKDYENE

SEQ ID NO: 874186 - protein, 9 aa, Homo Sapiens
KGLFSLVAR

SEQ ID NO: 874187 - protein, 9 aa, Homo Sapiens
LDTEANSNK

SEQ ID NO: 874188 - protein, 9 aa, Homo Sapiens
NYSNENDLL

SEQ ID NO: 874189 - protein, 9 aa, Homo Sapiens
DCLKIFLND

SEQ ID NO: 874190 - protein, 9 aa, Homo Sapiens
KYLIPQFQG

SEQ ID NO: 874191 - protein, 9 aa, Homo Sapiens
SGRLPPCAS

SEQ ID NO: 874192 - protein, 9 aa, Homo Sapiens
SDGWLKIIR

SEQ ID NO: 874193 - protein, 9 aa, Homo Sapiens
SQTNVREKR

SEQ ID NO: 874194 - protein, 9 aa, Homo Sapiens
FPENIISQE

SEQ ID NO: 874195 - protein, 9 aa, Homo Sapiens
SHKKLEHRI

SEQ ID NO: 874196 - protein, 9 aa, Homo Sapiens
APQSDSFPY

SEQ ID NO: 874197 - protein, 9 aa, Homo Sapiens
NDINSDSDK

SEQ ID NO: 874198 - protein, 9 aa, Homo Sapiens
VCKIKVHSA

SEQ ID NO: 874199 - protein, 9 aa, Homo Sapiens
AIEDRNIKN

SEQ ID NO: 874200 - protein, 9 aa, Homo Sapiens
GKIYTYQKK

SEQ ID NO: 874201 - protein, 9 aa, Homo Sapiens
NSLMWTLFS

SEQ ID NO: 874202 - protein, 9 aa, Homo Sapiens
KLLRQEQAK

SEQ ID NO: 874203 - protein, 9 aa, Homo Sapiens
ISANPLLET

SEQ ID NO: 874204 - protein, 9 aa, Homo Sapiens
EPMQELMLR

SEQ ID NO: 874205 - protein, 9 aa, Homo Sapiens
VNYSPRAAD

SEQ ID NO: 874206 - protein, 9 aa, Homo Sapiens
SGHLPKYKQ

SEQ ID NO: 874207 - protein, 9 aa, Homo Sapiens
FDVGSEKTQ

SEQ ID NO: 874208 - protein, 9 aa, Homo Sapiens
TLDKAFEEL

SEQ ID NO: 874209 - protein, 9 aa, Homo Sapiens
CLSPPHPAL

SEQ ID NO: 874210 - protein, 9 aa, Homo Sapiens
PRLSDYETL

SEQ ID NO: 874211 - protein, 9 aa, Homo Sapiens
NDCFEYFGP

SEQ ID NO: 874212 - protein, 9 aa, Homo Sapiens
QNGYRALMD

SEQ ID NO: 874213 - protein, 9 aa, Homo Sapiens
ICVLYQKVY

SEQ ID NO: 874214 - protein, 9 aa, Homo Sapiens
SVAIQNFLA

SEQ ID NO: 874215 - protein, 9 aa, Homo Sapiens
PKEIWTFFI

SEQ ID NO: 874216 - protein, 9 aa, Homo Sapiens
RSNPVVSKL

SEQ ID NO: 874217 - protein, 9 aa, Homo Sapiens
DFKHTDDFE

SEQ ID NO: 874218 - protein, 9 aa, Homo Sapiens
GKAIPIHLF

SEQ ID NO: 874219 - protein, 9 aa, Homo Sapiens
TWNDHFSDI

SEQ ID NO: 874220 - protein, 9 aa, Homo Sapiens
RTDYLWRGL

SEQ ID NO: 874221 - protein, 9 aa, Homo Sapiens
EETAKQIIY

SEQ ID NO: 874222 - protein, 9 aa, Homo Sapiens
LIFGAHNRF

SEQ ID NO: 874223 - protein, 9 aa, Homo Sapiens
GKNEGKENL

SEQ ID NO: 874224 - protein, 9 aa, Homo Sapiens
KDALRVPPP

SEQ ID NO: 874225 - protein, 9 aa, Homo Sapiens
VLCTKSCRQ

SEQ ID NO: 874226 - protein, 9 aa, Homo Sapiens
KTSQMLSST

SEQ ID NO: 874227 - protein, 9 aa, Homo Sapiens
LACQQFCVR

SEQ ID NO: 874228 - protein, 9 aa, Homo Sapiens
GSAIWNQRH

SEQ ID NO: 874229 - protein, 9 aa, Homo Sapiens
SASDSLYAV

SEQ ID NO: 874230 - protein, 9 aa, Homo Sapiens
TAAATGGTG

SEQ ID NO: 874231 - protein, 9 aa, Homo Sapiens
TSHGALRSR

SEQ ID NO: 874232 - protein, 9 aa, Homo Sapiens
AFFGTSTGD

SEQ ID NO: 874233 - protein, 9 aa, Homo Sapiens
AKKQEGGAK

SEQ ID NO: 874234 - protein, 9 aa, Homo Sapiens
SSRVKRPIE

SEQ ID NO: 874235 - protein, 9 aa, Homo Sapiens
EGAQSVLRL

SEQ ID NO: 874236 - protein, 9 aa, Homo Sapiens
DFNGMPVIS

SEQ ID NO: 874237 - protein, 9 aa, Homo Sapiens
PSEDPNNCL

SEQ ID NO: 874238 - protein, 9 aa, Homo Sapiens
GSQSISASS

SEQ ID NO: 874239 - protein, 9 aa, Homo Sapiens
PGPVQFQYV

SEQ ID NO: 874240 - protein, 9 aa, Homo Sapiens
ADKSFAVGT

SEQ ID NO: 874241 - protein, 9 aa, Homo Sapiens
DGKFLFVEP

SEQ ID NO: 874242 - protein, 9 aa, Homo Sapiens
AICFGRHYD

SEQ ID NO: 874243 - protein, 9 aa, Homo Sapiens
AVYRRVLCM

SEQ ID NO: 874244 - protein, 9 aa, Homo Sapiens
LFMPPTYYN

SEQ ID NO: 874245 - protein, 9 aa, Homo Sapiens
AFNTSHLQK

SEQ ID NO: 874246 - protein, 9 aa, Homo Sapiens
YEMIKNCSS

SEQ ID NO: 874247 - protein, 9 aa, Homo Sapiens
VYIQPITNT

SEQ ID NO: 874248 - protein, 9 aa, Homo Sapiens
VVTSCQPNN

SEQ ID NO: 874249 - protein, 9 aa, Homo Sapiens
CTKGNSCPF

SEQ ID NO: 874250 - protein, 9 aa, Homo Sapiens
ITVCWHFGD

SEQ ID NO: 874251 - protein, 9 aa, Homo Sapiens
LLWIRIYPD

SEQ ID NO: 874252 - protein, 9 aa, Homo Sapiens
SQLRALGLS

SEQ ID NO: 874253 - protein, 9 aa, Homo Sapiens
KMTKSSPLK

SEQ ID NO: 874254 - protein, 9 aa, Homo Sapiens
THMIIHTGE

SEQ ID NO: 874255 - protein, 9 aa, Homo Sapiens
NLSSTAKWV

SEQ ID NO: 874256 - protein, 9 aa, Homo Sapiens
HSHVPYTSA

SEQ ID NO: 874257 - protein, 9 aa, Homo Sapiens
VVFTENTTD

SEQ ID NO: 874258 - protein, 9 aa, Homo Sapiens
ILYNKFNHY

SEQ ID NO: 874259 - protein, 9 aa, Homo Sapiens
VPLFGENPW

SEQ ID NO: 874260 - protein, 9 aa, Homo Sapiens
LPATGWTKS

SEQ ID NO: 874261 - protein, 9 aa, Homo Sapiens
KVPAIQHKR

SEQ ID NO: 874262 - protein, 9 aa, Homo Sapiens
IQINIWYGF

SEQ ID NO: 874263 - protein, 9 aa, Homo Sapiens
TKYFKKQLA

SEQ ID NO: 874264 - protein, 9 aa, Homo Sapiens
ENEQIHAQE

SEQ ID NO: 874265 - protein, 9 aa, Homo Sapiens
HSERPPIFE

SEQ ID NO: 874266 - protein, 9 aa, Homo Sapiens
GTVWDSGVA

SEQ ID NO: 874267 - protein, 9 aa, Homo Sapiens
EYILRAVRA

SEQ ID NO: 874268 - protein, 9 aa, Homo Sapiens
YCEKENYPK

SEQ ID NO: 874269 - protein, 9 aa, Homo Sapiens
TLLPENGYW

SEQ ID NO: 874270 - protein, 9 aa, Homo Sapiens
VYQLLSETP

SEQ ID NO: 874271 - protein, 9 aa, Homo Sapiens
ELTFSNLTL

SEQ ID NO: 874272 - protein, 9 aa, Homo Sapiens
VSHQAEYKL

SEQ ID NO: 874273 - protein, 9 aa, Homo Sapiens
LLLYRNNFL

SEQ ID NO: 874274 - protein, 9 aa, Homo Sapiens
EYRISQQTD

SEQ ID NO: 874275 - protein, 9 aa, Homo Sapiens
LAQMHDEDL

SEQ ID NO: 874276 - protein, 9 aa, Homo Sapiens
RLTWEAMPR

SEQ ID NO: 874277 - protein, 9 aa, Homo Sapiens
PKLALEDLE

SEQ ID NO: 874278 - protein, 9 aa, Homo Sapiens
RLCLAEMAQ

SEQ ID NO: 874279 - protein, 9 aa, Homo Sapiens
PYECSDCGQ

SEQ ID NO: 874280 - protein, 9 aa, Homo Sapiens
LDVKINDEE

SEQ ID NO: 874281 - protein, 9 aa, Homo Sapiens
ALTSKINLH

SEQ ID NO: 874282 - protein, 9 aa, Homo Sapiens
VYVLVFTLT

SEQ ID NO: 874283 - protein, 9 aa, Homo Sapiens
CLTYHRIYL

SEQ ID NO: 874284 - protein, 9 aa, Homo Sapiens
SLVASSPSI

SEQ ID NO: 874285 - protein, 9 aa, Homo Sapiens
NTFTTGIVS

SEQ ID NO: 874286 - protein, 9 aa, Homo Sapiens
SVWVLTDHD

SEQ ID NO: 874287 - protein, 9 aa, Homo Sapiens
TRKLYLEDS

SEQ ID NO: 874288 - protein, 9 aa, Homo Sapiens
NDFDDSPFF

SEQ ID NO: 874289 - protein, 9 aa, Homo Sapiens
KADLSGIAL

SEQ ID NO: 874290 - protein, 9 aa, Homo Sapiens
ALYKLFHDP

SEQ ID NO: 874291 - protein, 9 aa, Homo Sapiens
RQDEEGNEI

SEQ ID NO: 874292 - protein, 9 aa, Homo Sapiens
QYKVQAYIQ

SEQ ID NO: 874293 - protein, 9 aa, Homo Sapiens
DLPVRSKFE

SEQ ID NO: 874294 - protein, 9 aa, Homo Sapiens
FRYFVNREI

SEQ ID NO: 874295 - protein, 9 aa, Homo Sapiens
TRAGSRLSA

SEQ ID NO: 874296 - protein, 9 aa, Homo Sapiens
FDRYVAVYQ

SEQ ID NO: 874297 - protein, 9 aa, Homo Sapiens
KLQSGNQQL

SEQ ID NO: 874298 - protein, 9 aa, Homo Sapiens
MANADEGFG

SEQ ID NO: 874299 - protein, 9 aa, Homo Sapiens
SIAPSSQTK

SEQ ID NO: 874300 - protein, 9 aa, Homo Sapiens
TKFREDLEL

SEQ ID NO: 874301 - protein, 9 aa, Homo Sapiens
CKILCMPHY

SEQ ID NO: 874302 - protein, 9 aa, Homo Sapiens
PYKFQKGKY

SEQ ID NO: 874303 - protein, 9 aa, Homo Sapiens
PFCSIECYS

SEQ ID NO: 874304 - protein, 9 aa, Homo Sapiens
QKQMKYSAV

SEQ ID NO: 874305 - protein, 9 aa, Homo Sapiens
PEQTKLWGG

SEQ ID NO: 874306 - protein, 9 aa, Homo Sapiens
YDPKTNSWL

SEQ ID NO: 874307 - protein, 9 aa, Homo Sapiens
WRNPLTLFR

SEQ ID NO: 874308 - protein, 9 aa, Homo Sapiens
TLNVSLQMD

SEQ ID NO: 874309 - protein, 9 aa, Homo Sapiens
GNTYKKPSK

SEQ ID NO: 874310 - protein, 9 aa, Homo Sapiens
LNRKIGFAI

SEQ ID NO: 874311 - protein, 9 aa, Homo Sapiens
GHSMKWSAR

SEQ ID NO: 874312 - protein, 9 aa, Homo Sapiens
KQPSEDPNN

SEQ ID NO: 874313 - protein, 9 aa, Homo Sapiens
LIINKMLLA

SEQ ID NO: 874314 - protein, 9 aa, Homo Sapiens
GNVVMLVPL

SEQ ID NO: 874315 - protein, 9 aa, Homo Sapiens
RDTMNFSGL

SEQ ID NO: 874316 - protein, 9 aa, Homo Sapiens
YRSEEDHHW

SEQ ID NO: 874317 - protein, 9 aa, Homo Sapiens
DPRMHYPGP

SEQ ID NO: 874318 - protein, 9 aa, Homo Sapiens
TALFPQYTP

SEQ ID NO: 874319 - protein, 9 aa, Homo Sapiens
RVDYKVNFH

SEQ ID NO: 874320 - protein, 9 aa, Homo Sapiens
RGTFGSSKW

SEQ ID NO: 874321 - protein, 9 aa, Homo Sapiens
AMCRTALES

SEQ ID NO: 874322 - protein, 9 aa, Homo Sapiens
MAFLTYDKV

SEQ ID NO: 874323 - protein, 9 aa, Homo Sapiens
ILGQPPNHP

SEQ ID NO: 874324 - protein, 9 aa, Homo Sapiens
PANMLVMGE

SEQ ID NO: 874325 - protein, 9 aa, Homo Sapiens
STADLPVAQ

SEQ ID NO: 874326 - protein, 9 aa, Homo Sapiens
QQGCWDAEE

SEQ ID NO: 874327 - protein, 9 aa, Homo Sapiens
CLLLMSTLG

SEQ ID NO: 874328 - protein, 9 aa, Homo Sapiens
RSASHLQTH

SEQ ID NO: 874329 - protein, 9 aa, Homo Sapiens
EISQRHREE

SEQ ID NO: 874330 - protein, 9 aa, Homo Sapiens
AEDLSVQLA

SEQ ID NO: 874331 - protein, 9 aa, Homo Sapiens
PRRHTRSTE

SEQ ID NO: 874332 - protein, 9 aa, Homo Sapiens
ETLRKGADS

SEQ ID NO: 874333 - protein, 9 aa, Homo Sapiens
HGLYKDHYA

SEQ ID NO: 874334 - protein, 9 aa, Homo Sapiens
KDLYICPNI

SEQ ID NO: 874335 - protein, 9 aa, Homo Sapiens
HTHYLHQRP

SEQ ID NO: 874336 - protein, 9 aa, Homo Sapiens
AVVADVMCR

SEQ ID NO: 874337 - protein, 9 aa, Homo Sapiens
LKKWPMRSC

SEQ ID NO: 874338 - protein, 9 aa, Homo Sapiens
KYKLTYAET

SEQ ID NO: 874339 - protein, 9 aa, Homo Sapiens
DMQEGGTCN

SEQ ID NO: 874340 - protein, 9 aa, Homo Sapiens
ALHAAECLQ

SEQ ID NO: 874341 - protein, 9 aa, Homo Sapiens
ATEIKDGQT

SEQ ID NO: 874342 - protein, 9 aa, Homo Sapiens
WLVENSVLL

SEQ ID NO: 874343 - protein, 9 aa, Homo Sapiens
PHPSSRTTK

SEQ ID NO: 874344 - protein, 9 aa, Homo Sapiens
LANLTLGSL

SEQ ID NO: 874345 - protein, 9 aa, Homo Sapiens
VHLAHHQQI

SEQ ID NO: 874346 - protein, 9 aa, Homo Sapiens
PDLTIKKRL

SEQ ID NO: 874347 - protein, 9 aa, Homo Sapiens
GDFNGMPVI

SEQ ID NO: 874348 - protein, 9 aa, Homo Sapiens
VSCEDQDKC

SEQ ID NO: 874349 - protein, 9 aa, Homo Sapiens
QCHGAPCNP

SEQ ID NO: 874350 - protein, 9 aa, Homo Sapiens
PVPKETPAR

SEQ ID NO: 874351 - protein, 9 aa, Homo Sapiens
DISNAPHNY

SEQ ID NO: 874352 - protein, 9 aa, Homo Sapiens
DCECGSPKE

SEQ ID NO: 874353 - protein, 9 aa, Homo Sapiens
KFKSSSHAI

SEQ ID NO: 874354 - protein, 9 aa, Homo Sapiens
SGKTPSSIR

SEQ ID NO: 874355 - protein, 9 aa, Homo Sapiens
GNEDDINAS

SEQ ID NO: 874356 - protein, 9 aa, Homo Sapiens
RGISVLLLS

SEQ ID NO: 874357 - protein, 9 aa, Homo Sapiens
GSIKSLRTF

SEQ ID NO: 874358 - protein, 9 aa, Homo Sapiens
DHINQTPGF

SEQ ID NO: 874359 - protein, 9 aa, Homo Sapiens
VTKQAFNIT

SEQ ID NO: 874360 - protein, 9 aa, Homo Sapiens
SLGILFRGQ

SEQ ID NO: 874361 - protein, 9 aa, Homo Sapiens
DGIIIKGVG

SEQ ID NO: 874362 - protein, 9 aa, Homo Sapiens
KCGECGKFF

SEQ ID NO: 874363 - protein, 9 aa, Homo Sapiens
VALGFYCLW

SEQ ID NO: 874364 - protein, 9 aa, Homo Sapiens
TLSYVQICI

SEQ ID NO: 874365 - protein, 9 aa, Homo Sapiens
APPCPSIPL

SEQ ID NO: 874366 - protein, 9 aa, Homo Sapiens
HGKNVPKYQ

SEQ ID NO: 874367 - protein, 9 aa, Homo Sapiens
DAHRQIMLL

SEQ ID NO: 874368 - protein, 9 aa, Homo Sapiens
LYHSSEVRL

SEQ ID NO: 874369 - protein, 9 aa, Homo Sapiens
AEHAAFLRT

SEQ ID NO: 874370 - protein, 9 aa, Homo Sapiens
KMEGMARSD

SEQ ID NO: 874371 - protein, 9 aa, Homo Sapiens
LPSTPVTLF

SEQ ID NO: 874372 - protein, 9 aa, Homo Sapiens
KFSRLFELF

SEQ ID NO: 874373 - protein, 9 aa, Homo Sapiens
RIKRLCNPS

SEQ ID NO: 874374 - protein, 9 aa, Homo Sapiens
TTCGQNATK

SEQ ID NO: 874375 - protein, 9 aa, Homo Sapiens
LLVKYPKRR

SEQ ID NO: 874376 - protein, 9 aa, Homo Sapiens
LDLQSHGET

SEQ ID NO: 874377 - protein, 9 aa, Homo Sapiens
DYLRLNKEL

SEQ ID NO: 874378 - protein, 9 aa, Homo Sapiens
LQPVTIVFR

SEQ ID NO: 874379 - protein, 9 aa, Homo Sapiens
TAHSYRMGF

SEQ ID NO: 874380 - protein, 9 aa, Homo Sapiens
LNYCKGGIT

SEQ ID NO: 874381 - protein, 9 aa, Homo Sapiens
NGAGSLVIN

SEQ ID NO: 874382 - protein, 9 aa, Homo Sapiens
NYHTNSCNR

SEQ ID NO: 874383 - protein, 9 aa, Homo Sapiens
YPPGHHSVT

SEQ ID NO: 874384 - protein, 9 aa, Homo Sapiens
PKVWILRLK

SEQ ID NO: 874385 - protein, 9 aa, Homo Sapiens
ASTEATKLL

SEQ ID NO: 874386 - protein, 9 aa, Homo Sapiens
TDIVQQMEQ

SEQ ID NO: 874387 - protein, 9 aa, Homo Sapiens
THGDTCECD

SEQ ID NO: 874388 - protein, 9 aa, Homo Sapiens
SEQSIKDYF

SEQ ID NO: 874389 - protein, 9 aa, Homo Sapiens
LDLLKEYPV

SEQ ID NO: 874390 - protein, 9 aa, Homo Sapiens
TYVTSVLCK

SEQ ID NO: 874391 - protein, 9 aa, Homo Sapiens
CAITLGHGH

SEQ ID NO: 874392 - protein, 9 aa, Homo Sapiens
IMCSPVCGL

SEQ ID NO: 874393 - protein, 9 aa, Homo Sapiens
FQNHIRIHT

SEQ ID NO: 874394 - protein, 9 aa, Homo Sapiens
QKAWWRHVA

SEQ ID NO: 874395 - protein, 9 aa, Homo Sapiens
FPCQFIKIV

SEQ ID NO: 874396 - protein, 9 aa, Homo Sapiens
SFLALTSHF

SEQ ID NO: 874397 - protein, 9 aa, Homo Sapiens
AFETLIINL

SEQ ID NO: 874398 - protein, 9 aa, Homo Sapiens
FQSQKSILY

SEQ ID NO: 874399 - protein, 9 aa, Homo Sapiens
CRAGAKSRS

SEQ ID NO: 874400 - protein, 9 aa, Homo Sapiens
PQNLLLSGA

SEQ ID NO: 874401 - protein, 9 aa, Homo Sapiens
AKGFHGKIE

SEQ ID NO: 874402 - protein, 9 aa, Homo Sapiens
DGRNQEKLN

SEQ ID NO: 874403 - protein, 9 aa, Homo Sapiens
EKMVDALLF

SEQ ID NO: 874404 - protein, 9 aa, Homo Sapiens
YLRLNKELD

SEQ ID NO: 874405 - protein, 9 aa, Homo Sapiens
STIPEELGH

SEQ ID NO: 874406 - protein, 9 aa, Homo Sapiens
KKIQTALSN

SEQ ID NO: 874407 - protein, 9 aa, Homo Sapiens
QILATLEDG

SEQ ID NO: 874408 - protein, 9 aa, Homo Sapiens
EKTQIGLAQ

SEQ ID NO: 874409 - protein, 9 aa, Homo Sapiens
RLCGDKLPE

SEQ ID NO: 874410 - protein, 9 aa, Homo Sapiens
IWRPANVPI

SEQ ID NO: 874411 - protein, 9 aa, Homo Sapiens
GIFTSPTNF

SEQ ID NO: 874412 - protein, 9 aa, Homo Sapiens
VCYFFHRSP

SEQ ID NO: 874413 - protein, 9 aa, Homo Sapiens
KGFTECKMT

SEQ ID NO: 874414 - protein, 9 aa, Homo Sapiens
LAREFDQFG

SEQ ID NO: 874415 - protein, 9 aa, Homo Sapiens
EELNRVQLS

SEQ ID NO: 874416 - protein, 9 aa, Homo Sapiens
MPINLVIDE

SEQ ID NO: 874417 - protein, 9 aa, Homo Sapiens
WKPLNGFKS

SEQ ID NO: 874418 - protein, 9 aa, Homo Sapiens
PMREIIRRL

SEQ ID NO: 874419 - protein, 9 aa, Homo Sapiens
KIQQEERKV

SEQ ID NO: 874420 - protein, 9 aa, Homo Sapiens
SGTFCTCAT

SEQ ID NO: 874421 - protein, 9 aa, Homo Sapiens
ILKGLKKDY

SEQ ID NO: 874422 - protein, 9 aa, Homo Sapiens
VLLDGGLLT

SEQ ID NO: 874423 - protein, 9 aa, Homo Sapiens
EEFWRGFYK

SEQ ID NO: 874424 - protein, 9 aa, Homo Sapiens
EWLFLDQHM

SEQ ID NO: 874425 - protein, 9 aa, Homo Sapiens
PAEIRRSWS

SEQ ID NO: 874426 - protein, 9 aa, Homo Sapiens
QCIPVKRPI

SEQ ID NO: 874427 - protein, 9 aa, Homo Sapiens
SGINVINYY

SEQ ID NO: 874428 - protein, 9 aa, Homo Sapiens
MGDLTHRVA

SEQ ID NO: 874429 - protein, 9 aa, Homo Sapiens
TSVERVRST

SEQ ID NO: 874430 - protein, 9 aa, Homo Sapiens
ATMINFVRA

SEQ ID NO: 874431 - protein, 9 aa, Homo Sapiens
VFFPNNQEI

SEQ ID NO: 874432 - protein, 9 aa, Homo Sapiens
GRMGVLAFL

SEQ ID NO: 874433 - protein, 9 aa, Homo Sapiens
QDKPLLRAL

SEQ ID NO: 874434 - protein, 9 aa, Homo Sapiens
TVNEVIEEV

SEQ ID NO: 874435 - protein, 9 aa, Homo Sapiens
FAVNMFQTL

SEQ ID NO: 874436 - protein, 9 aa, Homo Sapiens
PKHHLEEHV

SEQ ID NO: 874437 - protein, 9 aa, Homo Sapiens
HCWEDIWQV

SEQ ID NO: 874438 - protein, 9 aa, Homo Sapiens
DRIQVLHNM

SEQ ID NO: 874439 - protein, 9 aa, Homo Sapiens
VQKLKNSLK

SEQ ID NO: 874440 - protein, 9 aa, Homo Sapiens
AIELSQEEW

SEQ ID NO: 874441 - protein, 9 aa, Homo Sapiens
ETIIIMLEL

SEQ ID NO: 874442 - protein, 9 aa, Homo Sapiens
HDCNLLREQ

SEQ ID NO: 874443 - protein, 9 aa, Homo Sapiens
EPSYPQERM

SEQ ID NO: 874444 - protein, 9 aa, Homo Sapiens
YPSQKEVKI

SEQ ID NO: 874445 - protein, 9 aa, Homo Sapiens
RWYKNRKSK

SEQ ID NO: 874446 - protein, 9 aa, Homo Sapiens
MIEFCDALV

SEQ ID NO: 874447 - protein, 9 aa, Homo Sapiens
CWCPGPVRG

SEQ ID NO: 874448 - protein, 9 aa, Homo Sapiens
PLWTLLQSN

SEQ ID NO: 874449 - protein, 9 aa, Homo Sapiens
DYLRELSQK

SEQ ID NO: 874450 - protein, 9 aa, Homo Sapiens
CVGENLSAG

SEQ ID NO: 874451 - protein, 9 aa, Homo Sapiens
KKEDANRKT

SEQ ID NO: 874452 - protein, 9 aa, Homo Sapiens
IKTNAQINK

SEQ ID NO: 874453 - protein, 9 aa, Homo Sapiens
LVLVPDRHP

SEQ ID NO: 874454 - protein, 9 aa, Homo Sapiens
ENNGDNATA

SEQ ID NO: 874455 - protein, 9 aa, Homo Sapiens
VVQLLLDRQ

SEQ ID NO: 874456 - protein, 9 aa, Homo Sapiens
EARREYPFS

SEQ ID NO: 874457 - protein, 9 aa, Homo Sapiens
VFQNALEIG

SEQ ID NO: 874458 - protein, 9 aa, Homo Sapiens
AMGHFADRF

SEQ ID NO: 874459 - protein, 9 aa, Homo Sapiens
VNNIPFLQN

SEQ ID NO: 874460 - protein, 9 aa, Homo Sapiens
PLVFLLQFS

SEQ ID NO: 874461 - protein, 9 aa, Homo Sapiens
YFIKIEKNG

SEQ ID NO: 874462 - protein, 9 aa, Homo Sapiens
SSTTGYKHF

SEQ ID NO: 874463 - protein, 9 aa, Homo Sapiens
DDSKMEDEA

SEQ ID NO: 874464 - protein, 9 aa, Homo Sapiens
AKRLCKRVG

SEQ ID NO: 874465 - protein, 9 aa, Homo Sapiens
INQQTGQRN

SEQ ID NO: 874466 - protein, 9 aa, Homo Sapiens
CLLRITAFC

SEQ ID NO: 874467 - protein, 9 aa, Homo Sapiens
GGKIWRPAN

SEQ ID NO: 874468 - protein, 9 aa, Homo Sapiens
GPTQKGLCE

SEQ ID NO: 874469 - protein, 9 aa, Homo Sapiens
KWDYIATQG

SEQ ID NO: 874470 - protein, 9 aa, Homo Sapiens
AVYYCLHRR

SEQ ID NO: 874471 - protein, 9 aa, Homo Sapiens
INSCQSEYH

SEQ ID NO: 874472 - protein, 9 aa, Homo Sapiens
VDIKFTGDP

SEQ ID NO: 874473 - protein, 9 aa, Homo Sapiens
DRILASYAT

SEQ ID NO: 874474 - protein, 9 aa, Homo Sapiens
RTLANNQRN

SEQ ID NO: 874475 - protein, 9 aa, Homo Sapiens
VCDDGWNIK

SEQ ID NO: 874476 - protein, 9 aa, Homo Sapiens
ESLLEESLC

SEQ ID NO: 874477 - protein, 9 aa, Homo Sapiens
KILNVTTDM

SEQ ID NO: 874478 - protein, 9 aa, Homo Sapiens
EHLESQLRA

SEQ ID NO: 874479 - protein, 9 aa, Homo Sapiens
LRKNLCCQS

SEQ ID NO: 874480 - protein, 9 aa, Homo Sapiens
KSKETLNLD

SEQ ID NO: 874481 - protein, 9 aa, Homo Sapiens
KESDFEEPM

SEQ ID NO: 874482 - protein, 9 aa, Homo Sapiens
LLIEEIERL

SEQ ID NO: 874483 - protein, 9 aa, Homo Sapiens
EAVNKYFKL

SEQ ID NO: 874484 - protein, 9 aa, Homo Sapiens
ETYCYLTDI

SEQ ID NO: 874485 - protein, 9 aa, Homo Sapiens
ICLACSYEG

SEQ ID NO: 874486 - protein, 9 aa, Homo Sapiens
CMYQNATGE

SEQ ID NO: 874487 - protein, 9 aa, Homo Sapiens
IEWMAGGLV

SEQ ID NO: 874488 - protein, 9 aa, Homo Sapiens
YQPKIDTVM

SEQ ID NO: 874489 - protein, 9 aa, Homo Sapiens
TKVENGQIN

SEQ ID NO: 874490 - protein, 9 aa, Homo Sapiens
CLCCKRGNV

SEQ ID NO: 874491 - protein, 9 aa, Homo Sapiens
IVQKVILVI

SEQ ID NO: 874492 - protein, 9 aa, Homo Sapiens
IIDFQNKQT

SEQ ID NO: 874493 - protein, 9 aa, Homo Sapiens
RHLLIHTSE

SEQ ID NO: 874494 - protein, 9 aa, Homo Sapiens
PSQGAVSSL

SEQ ID NO: 874495 - protein, 9 aa, Homo Sapiens
EEMINNQNK

SEQ ID NO: 874496 - protein, 9 aa, Homo Sapiens
KRKKYPSKG

SEQ ID NO: 874497 - protein, 9 aa, Homo Sapiens
HRVGHYLKD

SEQ ID NO: 874498 - protein, 9 aa, Homo Sapiens
KVFLQRLAA

SEQ ID NO: 874499 - protein, 9 aa, Homo Sapiens
KQAQDNLHD

SEQ ID NO: 874500 - protein, 9 aa, Homo Sapiens
HQKKLQLAL

SEQ ID NO: 874501 - protein, 9 aa, Homo Sapiens
SYVSWDLFR

SEQ ID NO: 874502 - protein, 9 aa, Homo Sapiens
DFTKVENGQ

SEQ ID NO: 874503 - protein, 9 aa, Homo Sapiens
SLGRAVRVL

SEQ ID NO: 874504 - protein, 9 aa, Homo Sapiens
NKLSVNNKS

SEQ ID NO: 874505 - protein, 9 aa, Homo Sapiens
EMGTERVMG

SEQ ID NO: 874506 - protein, 9 aa, Homo Sapiens
GYVGSEPQA

SEQ ID NO: 874507 - protein, 9 aa, Homo Sapiens
LVTYMFQEP

SEQ ID NO: 874508 - protein, 9 aa, Homo Sapiens
SLLMECLSV

SEQ ID NO: 874509 - protein, 9 aa, Homo Sapiens
VCLLREELQ

SEQ ID NO: 874510 - protein, 9 aa, Homo Sapiens
RQCHQQMQQ

SEQ ID NO: 874511 - protein, 9 aa, Homo Sapiens
NKFNHYDTA

SEQ ID NO: 874512 - protein, 9 aa, Homo Sapiens
EICAQTFFK

SEQ ID NO: 874513 - protein, 9 aa, Homo Sapiens
SHAIAMQHA

SEQ ID NO: 874514 - protein, 9 aa, Homo Sapiens
GTFGSSKWV

SEQ ID NO: 874515 - protein, 9 aa, Homo Sapiens
TEEDNKEDP

SEQ ID NO: 874516 - protein, 9 aa, Homo Sapiens
DLSRLNDKL

SEQ ID NO: 874517 - protein, 9 aa, Homo Sapiens
RQKQKIMKY

SEQ ID NO: 874518 - protein, 9 aa, Homo Sapiens
TWVLYHNLC

SEQ ID NO: 874519 - protein, 9 aa, Homo Sapiens
CLRCLCQQH

SEQ ID NO: 874520 - protein, 9 aa, Homo Sapiens
ANPQLQMAS

SEQ ID NO: 874521 - protein, 9 aa, Homo Sapiens
SIVGTGLVG

SEQ ID NO: 874522 - protein, 9 aa, Homo Sapiens
MLAEDMTLC

SEQ ID NO: 874523 - protein, 9 aa, Homo Sapiens
FTETSVVFE

SEQ ID NO: 874524 - protein, 9 aa, Homo Sapiens
GKALTSKIN

SEQ ID NO: 874525 - protein, 9 aa, Homo Sapiens
VKDVSVRLH

SEQ ID NO: 874526 - protein, 9 aa, Homo Sapiens
VAEQNSTAA

SEQ ID NO: 874527 - protein, 9 aa, Homo Sapiens
QNAVVFQEA

SEQ ID NO: 874528 - protein, 9 aa, Homo Sapiens
DRMSELSGC

SEQ ID NO: 874529 - protein, 9 aa, Homo Sapiens
GIIVFQKDD

SEQ ID NO: 874530 - protein, 9 aa, Homo Sapiens
NLNMLRALK

SEQ ID NO: 874531 - protein, 9 aa, Homo Sapiens
KRSTQTRLS

SEQ ID NO: 874532 - protein, 9 aa, Homo Sapiens
MTFDRDGEK

SEQ ID NO: 874533 - protein, 9 aa, Homo Sapiens
CPSSEKITL

SEQ ID NO: 874534 - protein, 9 aa, Homo Sapiens
ARQGLKRKS

SEQ ID NO: 874535 - protein, 9 aa, Homo Sapiens
MHLVLRAGA

SEQ ID NO: 874536 - protein, 9 aa, Homo Sapiens
QYPDAKPVC

SEQ ID NO: 874537 - protein, 9 aa, Homo Sapiens
PIQKGAVPI

SEQ ID NO: 874538 - protein, 9 aa, Homo Sapiens
LHSKFIWQL

SEQ ID NO: 874539 - protein, 9 aa, Homo Sapiens
KFWNHIVAC

SEQ ID NO: 874540 - protein, 9 aa, Homo Sapiens
VDQVNCKDA

SEQ ID NO: 874541 - protein, 9 aa, Homo Sapiens
LYKAMVLAL

SEQ ID NO: 874542 - protein, 9 aa, Homo Sapiens
FQIGASTLL

SEQ ID NO: 874543 - protein, 9 aa, Homo Sapiens
LIYWLFIIL

SEQ ID NO: 874544 - protein, 9 aa, Homo Sapiens
MQIYKKGDI

SEQ ID NO: 874545 - protein, 9 aa, Homo Sapiens
GDNATASSN

SEQ ID NO: 874546 - protein, 9 aa, Homo Sapiens
GFQWDFLPQ

SEQ ID NO: 874547 - protein, 9 aa, Homo Sapiens
PHTGKAAST

SEQ ID NO: 874548 - protein, 9 aa, Homo Sapiens
FQIKYLIPQ

SEQ ID NO: 874549 - protein, 9 aa, Homo Sapiens
DPDHKASTQ

SEQ ID NO: 874550 - protein, 9 aa, Homo Sapiens
KGQPRTAPL

SEQ ID NO: 874551 - protein, 9 aa, Homo Sapiens
KLDEYLKSP

SEQ ID NO: 874552 - protein, 9 aa, Homo Sapiens
GTWGPRGDP

SEQ ID NO: 874553 - protein, 9 aa, Homo Sapiens
LSSNEHLSL

SEQ ID NO: 874554 - protein, 9 aa, Homo Sapiens
ATHQDIDLL

SEQ ID NO: 874555 - protein, 9 aa, Homo Sapiens
LAAALNLPK

SEQ ID NO: 874556 - protein, 9 aa, Homo Sapiens
LLNGICLYG

SEQ ID NO: 874557 - protein, 9 aa, Homo Sapiens
YWSEVDKIV

SEQ ID NO: 874558 - protein, 9 aa, Homo Sapiens
TVTCDPPPP

SEQ ID NO: 874559 - protein, 9 aa, Homo Sapiens
AGGTSVSLL

SEQ ID NO: 874560 - protein, 9 aa, Homo Sapiens
TLKGQRLVF

SEQ ID NO: 874561 - protein, 9 aa, Homo Sapiens
YFPPGLCWG

SEQ ID NO: 874562 - protein, 9 aa, Homo Sapiens
GAGADSELV

SEQ ID NO: 874563 - protein, 9 aa, Homo Sapiens
CYEGTDWLG

SEQ ID NO: 874564 - protein, 9 aa, Homo Sapiens
ERLPVLPKK

SEQ ID NO: 874565 - protein, 9 aa, Homo Sapiens
VNEVIEEVN

SEQ ID NO: 874566 - protein, 9 aa, Homo Sapiens
LRAHREALA

SEQ ID NO: 874567 - protein, 9 aa, Homo Sapiens
TLVKYLDPN

SEQ ID NO: 874568 - protein, 9 aa, Homo Sapiens
KDGKANPLG

SEQ ID NO: 874569 - protein, 9 aa, Homo Sapiens
PYADHHYGA

SEQ ID NO: 874570 - protein, 9 aa, Homo Sapiens
GVFRSDSAV

SEQ ID NO: 874571 - protein, 9 aa, Homo Sapiens
RRQVGKAQM

SEQ ID NO: 874572 - protein, 9 aa, Homo Sapiens
SNRKDKYNA

SEQ ID NO: 874573 - protein, 9 aa, Homo Sapiens
LMTLGEVEQ

SEQ ID NO: 874574 - protein, 9 aa, Homo Sapiens
SDGAVLRMD

SEQ ID NO: 874575 - protein, 9 aa, Homo Sapiens
ITINTTICA

SEQ ID NO: 874576 - protein, 9 aa, Homo Sapiens
EERRKIKQR

SEQ ID NO: 874577 - protein, 9 aa, Homo Sapiens
NRNVTDIKC

SEQ ID NO: 874578 - protein, 9 aa, Homo Sapiens
VTSGSSKLE

SEQ ID NO: 874579 - protein, 9 aa, Homo Sapiens
KLEKLTNIR

SEQ ID NO: 874580 - protein, 9 aa, Homo Sapiens
VAVSITITT

SEQ ID NO: 874581 - protein, 9 aa, Homo Sapiens
HSAEVQVCL

SEQ ID NO: 874582 - protein, 9 aa, Homo Sapiens
NTCGLEQID

SEQ ID NO: 874583 - protein, 9 aa, Homo Sapiens
GKISFQEFL

SEQ ID NO: 874584 - protein, 9 aa, Homo Sapiens
ISRPIPMSI

SEQ ID NO: 874585 - protein, 9 aa, Homo Sapiens
TTLMPHNYT

SEQ ID NO: 874586 - protein, 9 aa, Homo Sapiens
QNGIDILVG

SEQ ID NO: 874587 - protein, 9 aa, Homo Sapiens
IRIPVICQG

SEQ ID NO: 874588 - protein, 9 aa, Homo Sapiens
KTATITKPR

SEQ ID NO: 874589 - protein, 9 aa, Homo Sapiens
ACDQPLDDI

SEQ ID NO: 874590 - protein, 9 aa, Homo Sapiens
LEKIQKELK

SEQ ID NO: 874591 - protein, 9 aa, Homo Sapiens
FFPTNSTSQ

SEQ ID NO: 874592 - protein, 9 aa, Homo Sapiens
EIRRSWSEA

SEQ ID NO: 874593 - protein, 9 aa, Homo Sapiens
RTPINNLYA

SEQ ID NO: 874594 - protein, 9 aa, Homo Sapiens
PSEEVLCSL

SEQ ID NO: 874595 - protein, 9 aa, Homo Sapiens
ALITIAVVA

SEQ ID NO: 874596 - protein, 9 aa, Homo Sapiens
CLENIAESI

SEQ ID NO: 874597 - protein, 9 aa, Homo Sapiens
PGVQWPCPG

SEQ ID NO: 874598 - protein, 9 aa, Homo Sapiens
FPKAIKTND

SEQ ID NO: 874599 - protein, 9 aa, Homo Sapiens
DNNKDIDSE

SEQ ID NO: 874600 - protein, 9 aa, Homo Sapiens
SCTTRLCQD

SEQ ID NO: 874601 - protein, 9 aa, Homo Sapiens
SNDTYWELQ

SEQ ID NO: 874602 - protein, 9 aa, Homo Sapiens
LHISQHEAK

SEQ ID NO: 874603 - protein, 9 aa, Homo Sapiens
TGATVLGTA

SEQ ID NO: 874604 - protein, 9 aa, Homo Sapiens
LQNYYAANS

SEQ ID NO: 874605 - protein, 9 aa, Homo Sapiens
LTEICHEVS

SEQ ID NO: 874606 - protein, 9 aa, Homo Sapiens
ELFRTEGAE

SEQ ID NO: 874607 - protein, 9 aa, Homo Sapiens
EVFKEIIGY

SEQ ID NO: 874608 - protein, 9 aa, Homo Sapiens
VYSKVAVSI

SEQ ID NO: 874609 - protein, 9 aa, Homo Sapiens
CNLCILGES

SEQ ID NO: 874610 - protein, 9 aa, Homo Sapiens
PEPDCGYPP

SEQ ID NO: 874611 - protein, 9 aa, Homo Sapiens
RWDNSVKKY

SEQ ID NO: 874612 - protein, 9 aa, Homo Sapiens
IGYLNYHDA

SEQ ID NO: 874613 - protein, 9 aa, Homo Sapiens
EHWSSFAVL

SEQ ID NO: 874614 - protein, 9 aa, Homo Sapiens
QSKFTNFKR

SEQ ID NO: 874615 - protein, 9 aa, Homo Sapiens
PPQNLMGSS

SEQ ID NO: 874616 - protein, 9 aa, Homo Sapiens
FVERREKIK

SEQ ID NO: 874617 - protein, 9 aa, Homo Sapiens
KLLGLEVTG

SEQ ID NO: 874618 - protein, 9 aa, Homo Sapiens
VNELYKEKA

SEQ ID NO: 874619 - protein, 9 aa, Homo Sapiens
RFNLRFEER

SEQ ID NO: 874620 - protein, 9 aa, Homo Sapiens
RAVCCVLER

SEQ ID NO: 874621 - protein, 9 aa, Homo Sapiens
DCLEKTSQM

SEQ ID NO: 874622 - protein, 9 aa, Homo Sapiens
HVRDHCVAH

SEQ ID NO: 874623 - protein, 9 aa, Homo Sapiens
VMLFDEPTS

SEQ ID NO: 874624 - protein, 9 aa, Homo Sapiens
YLSLLQDNG

SEQ ID NO: 874625 - protein, 9 aa, Homo Sapiens
APYPSAYPV

SEQ ID NO: 874626 - protein, 9 aa, Homo Sapiens
KIITEHRVF

SEQ ID NO: 874627 - protein, 9 aa, Homo Sapiens
PEPQKKISE

SEQ ID NO: 874628 - protein, 9 aa, Homo Sapiens
RERFNNETF

SEQ ID NO: 874629 - protein, 9 aa, Homo Sapiens
VKVVEESLP

SEQ ID NO: 874630 - protein, 9 aa, Homo Sapiens
QCWVFAYVM

SEQ ID NO: 874631 - protein, 9 aa, Homo Sapiens
VNTDILFLR

SEQ ID NO: 874632 - protein, 9 aa, Homo Sapiens
HHLLPLSLQ

SEQ ID NO: 874633 - protein, 9 aa, Homo Sapiens
KGKCLPEVY

SEQ ID NO: 874634 - protein, 9 aa, Homo Sapiens
ENYCQNPRG

SEQ ID NO: 874635 - protein, 9 aa, Homo Sapiens
HTNNWRPQL

SEQ ID NO: 874636 - protein, 9 aa, Homo Sapiens
KLSPLHKRI

SEQ ID NO: 874637 - protein, 9 aa, Homo Sapiens
RADNIISKT

SEQ ID NO: 874638 - protein, 9 aa, Homo Sapiens
ANILLYVVG

SEQ ID NO: 874639 - protein, 9 aa, Homo Sapiens
CVFDGDKHS

SEQ ID NO: 874640 - protein, 9 aa, Homo Sapiens
LNYLWNLAK

SEQ ID NO: 874641 - protein, 9 aa, Homo Sapiens
NGTVIPNGY

SEQ ID NO: 874642 - protein, 9 aa, Homo Sapiens
YVAVEEFPR

SEQ ID NO: 874643 - protein, 9 aa, Homo Sapiens
YRMGFTSRK

SEQ ID NO: 874644 - protein, 9 aa, Homo Sapiens
NSKVIDVKP

SEQ ID NO: 874645 - protein, 9 aa, Homo Sapiens
SIKSSERDC

SEQ ID NO: 874646 - protein, 9 aa, Homo Sapiens
EIHRALHKA

SEQ ID NO: 874647 - protein, 9 aa, Homo Sapiens
YPDAKPVCC

SEQ ID NO: 874648 - protein, 9 aa, Homo Sapiens
SVLLIALEG

SEQ ID NO: 874649 - protein, 9 aa, Homo Sapiens
CCPCCAWQR

SEQ ID NO: 874650 - protein, 9 aa, Homo Sapiens
LPVPTPPGE

SEQ ID NO: 874651 - protein, 9 aa, Homo Sapiens
PGKSSIIQH

SEQ ID NO: 874652 - protein, 9 aa, Homo Sapiens
ICRANCLCY

SEQ ID NO: 874653 - protein, 9 aa, Homo Sapiens
TDQKYSKPP

SEQ ID NO: 874654 - protein, 9 aa, Homo Sapiens
YECRASNNP

SEQ ID NO: 874655 - protein, 9 aa, Homo Sapiens
QRRQVGKAQ

SEQ ID NO: 874656 - protein, 9 aa, Homo Sapiens
ILQDKHNSI

SEQ ID NO: 874657 - protein, 9 aa, Homo Sapiens
PNYGYTSFY

SEQ ID NO: 874658 - protein, 9 aa, Homo Sapiens
LFDFLHVRD

SEQ ID NO: 874659 - protein, 9 aa, Homo Sapiens
YKPFVCKFC

SEQ ID NO: 874660 - protein, 9 aa, Homo Sapiens
DEQLRSHEN

SEQ ID NO: 874661 - protein, 9 aa, Homo Sapiens
AWAMYFKKE

SEQ ID NO: 874662 - protein, 9 aa, Homo Sapiens
LAGQTAFTS

SEQ ID NO: 874663 - protein, 9 aa, Homo Sapiens
PNFTVRDNQ

SEQ ID NO: 874664 - protein, 9 aa, Homo Sapiens
PATGWTKSM

SEQ ID NO: 874665 - protein, 9 aa, Homo Sapiens
TKKEVNQAR

SEQ ID NO: 874666 - protein, 9 aa, Homo Sapiens
KMPINLVID

SEQ ID NO: 874667 - protein, 9 aa, Homo Sapiens
TNVWVALYN

SEQ ID NO: 874668 - protein, 9 aa, Homo Sapiens
NTAQVFARY

SEQ ID NO: 874669 - protein, 9 aa, Homo Sapiens
KNKVASALG

SEQ ID NO: 874670 - protein, 9 aa, Homo Sapiens
RKTFCVKTS

SEQ ID NO: 874671 - protein, 9 aa, Homo Sapiens
WLHLQLDDS

SEQ ID NO: 874672 - protein, 9 aa, Homo Sapiens
HFFTVTDPQ

SEQ ID NO: 874673 - protein, 9 aa, Homo Sapiens
EDNKRQTLQ

SEQ ID NO: 874674 - protein, 9 aa, Homo Sapiens
KIFLNDSAT

SEQ ID NO: 874675 - protein, 9 aa, Homo Sapiens
DRGRVCMAG

SEQ ID NO: 874676 - protein, 9 aa, Homo Sapiens
TYKTIKQYQ

SEQ ID NO: 874677 - protein, 9 aa, Homo Sapiens
QTLKSHLQI

SEQ ID NO: 874678 - protein, 9 aa, Homo Sapiens
VTWILFQYP

SEQ ID NO: 874679 - protein, 9 aa, Homo Sapiens
HNGRMLLHF

SEQ ID NO: 874680 - protein, 9 aa, Homo Sapiens
ATIQDFWDN

SEQ ID NO: 874681 - protein, 9 aa, Homo Sapiens
VACQTPVLA

SEQ ID NO: 874682 - protein, 9 aa, Homo Sapiens
AEDMTLCVA

SEQ ID NO: 874683 - protein, 9 aa, Homo Sapiens
YINFMLRRH

SEQ ID NO: 874684 - protein, 9 aa, Homo Sapiens
VLPDTPFWL

SEQ ID NO: 874685 - protein, 9 aa, Homo Sapiens
DLIAYVSND

SEQ ID NO: 874686 - protein, 9 aa, Homo Sapiens
ICRLNWSDS

SEQ ID NO: 874687 - protein, 9 aa, Homo Sapiens
NRTSFTQET

SEQ ID NO: 874688 - protein, 9 aa, Homo Sapiens
LENMLFTSF

SEQ ID NO: 874689 - protein, 9 aa, Homo Sapiens
LPKKLKKDP

SEQ ID NO: 874690 - protein, 9 aa, Homo Sapiens
KTFLNQSSL

SEQ ID NO: 874691 - protein, 9 aa, Homo Sapiens
SKKLIKKDL

SEQ ID NO: 874692 - protein, 9 aa, Homo Sapiens
IGVCIAHSN

SEQ ID NO: 874693 - protein, 9 aa, Homo Sapiens
EKSRLPEQI

SEQ ID NO: 874694 - protein, 9 aa, Homo Sapiens
DSAACCNYS

SEQ ID NO: 874695 - protein, 9 aa, Homo Sapiens
MQYRSHMPY

SEQ ID NO: 874696 - protein, 9 aa, Homo Sapiens
AINVLDSPQ

SEQ ID NO: 874697 - protein, 9 aa, Homo Sapiens
EKQQKVEFC

SEQ ID NO: 874698 - protein, 9 aa, Homo Sapiens
TRLKPHKAQ

SEQ ID NO: 874699 - protein, 9 aa, Homo Sapiens
IQMYKSNGY

SEQ ID NO: 874700 - protein, 9 aa, Homo Sapiens
RQIPGGYSA

SEQ ID NO: 874701 - protein, 9 aa, Homo Sapiens
ETSVVFEDG

SEQ ID NO: 874702 - protein, 9 aa, Homo Sapiens
LPVRSKFEL

SEQ ID NO: 874703 - protein, 9 aa, Homo Sapiens
FMKGAYKQV

SEQ ID NO: 874704 - protein, 9 aa, Homo Sapiens
KEEWKGAAQ

SEQ ID NO: 874705 - protein, 9 aa, Homo Sapiens
WSQMLKDNK

SEQ ID NO: 874706 - protein, 9 aa, Homo Sapiens
TTSYSLYTD

SEQ ID NO: 874707 - protein, 9 aa, Homo Sapiens
PVMLFDEPT

SEQ ID NO: 874708 - protein, 9 aa, Homo Sapiens
SSSMPLQRC

SEQ ID NO: 874709 - protein, 9 aa, Homo Sapiens
LWGGPPPPP

SEQ ID NO: 874710 - protein, 9 aa, Homo Sapiens
LKKCHQCVK

SEQ ID NO: 874711 - protein, 9 aa, Homo Sapiens
SKSDDKNKN

SEQ ID NO: 874712 - protein, 9 aa, Homo Sapiens
QLALSTAIA

SEQ ID NO: 874713 - protein, 9 aa, Homo Sapiens
NLTVCGGTV

SEQ ID NO: 874714 - protein, 9 aa, Homo Sapiens
LKEISDDKV

SEQ ID NO: 874715 - protein, 9 aa, Homo Sapiens
YYFCRWYKN

SEQ ID NO: 874716 - protein, 9 aa, Homo Sapiens
PVYCLLPYC

SEQ ID NO: 874717 - protein, 9 aa, Homo Sapiens
LDNNLKPIK

SEQ ID NO: 874718 - protein, 9 aa, Homo Sapiens
KQDDKSSGK

SEQ ID NO: 874719 - protein, 9 aa, Homo Sapiens
KTQLEQEIA

SEQ ID NO: 874720 - protein, 9 aa, Homo Sapiens
CAQCCECKC

SEQ ID NO: 874721 - protein, 9 aa, Homo Sapiens
TVDSETFST

SEQ ID NO: 874722 - protein, 9 aa, Homo Sapiens
YIEHLKENV

SEQ ID NO: 874723 - protein, 9 aa, Homo Sapiens
NTNKLLAYT

SEQ ID NO: 874724 - protein, 9 aa, Homo Sapiens
YLLTRNDHG

SEQ ID NO: 874725 - protein, 9 aa, Homo Sapiens
AIILKKNEI

SEQ ID NO: 874726 - protein, 9 aa, Homo Sapiens
VFQTYGTWW

SEQ ID NO: 874727 - protein, 9 aa, Homo Sapiens
LSEKTEVKQ

SEQ ID NO: 874728 - protein, 9 aa, Homo Sapiens
VYQITTAAA

SEQ ID NO: 874729 - protein, 9 aa, Homo Sapiens
RFYQIDRSQ

SEQ ID NO: 874730 - protein, 9 aa, Homo Sapiens
EGNDGNNGG

SEQ ID NO: 874731 - protein, 9 aa, Homo Sapiens
SGSLALMCE

SEQ ID NO: 874732 - protein, 9 aa, Homo Sapiens
IKHRTSDQR

SEQ ID NO: 874733 - protein, 9 aa, Homo Sapiens
ELEKLFKDW

SEQ ID NO: 874734 - protein, 9 aa, Homo Sapiens
ELRDTGHYG

SEQ ID NO: 874735 - protein, 9 aa, Homo Sapiens
DKEPWLVDL

SEQ ID NO: 874736 - protein, 9 aa, Homo Sapiens
LRKTGQEVA

SEQ ID NO: 874737 - protein, 9 aa, Homo Sapiens
ILFQRRRRG

SEQ ID NO: 874738 - protein, 9 aa, Homo Sapiens
TCDLKICGF

SEQ ID NO: 874739 - protein, 9 aa, Homo Sapiens
KQKLQQLFK

SEQ ID NO: 874740 - protein, 9 aa, Homo Sapiens
VQLYKMQNG

SEQ ID NO: 874741 - protein, 9 aa, Homo Sapiens
YSRWARLNL

SEQ ID NO: 874742 - protein, 9 aa, Homo Sapiens
ITWSTVPKD

SEQ ID NO: 874743 - protein, 9 aa, Homo Sapiens
CHPEGIINI

SEQ ID NO: 874744 - protein, 9 aa, Homo Sapiens
WAQGEQARA

SEQ ID NO: 874745 - protein, 9 aa, Homo Sapiens
SRSYSQDYR

SEQ ID NO: 874746 - protein, 9 aa, Homo Sapiens
ALTSHFLFG

SEQ ID NO: 874747 - protein, 9 aa, Homo Sapiens
CLKAEWDQH

SEQ ID NO: 874748 - protein, 9 aa, Homo Sapiens
KVWPNEENN

SEQ ID NO: 874749 - protein, 9 aa, Homo Sapiens
NGSNLIKGR

SEQ ID NO: 874750 - protein, 9 aa, Homo Sapiens
FYKINTLYY

SEQ ID NO: 874751 - protein, 9 aa, Homo Sapiens
EASPVDTTS

SEQ ID NO: 874752 - protein, 9 aa, Homo Sapiens
KYLFICEFF

SEQ ID NO: 874753 - protein, 9 aa, Homo Sapiens
GFPGLQLFN

SEQ ID NO: 874754 - protein, 9 aa, Homo Sapiens
LMMTTALMS

SEQ ID NO: 874755 - protein, 9 aa, Homo Sapiens
PFEINTITG

SEQ ID NO: 874756 - protein, 9 aa, Homo Sapiens
CMAGALLRT

SEQ ID NO: 874757 - protein, 9 aa, Homo Sapiens
MVTKVPCSL

SEQ ID NO: 874758 - protein, 9 aa, Homo Sapiens
YCIYGLVIY

SEQ ID NO: 874759 - protein, 9 aa, Homo Sapiens
FRSASHLQT

SEQ ID NO: 874760 - protein, 9 aa, Homo Sapiens
IFYYLHVLC

SEQ ID NO: 874761 - protein, 9 aa, Homo Sapiens
MNRTNPKSL

SEQ ID NO: 874762 - protein, 9 aa, Homo Sapiens
TVMYKHMDP

SEQ ID NO: 874763 - protein, 9 aa, Homo Sapiens
DKIQILATL

SEQ ID NO: 874764 - protein, 9 aa, Homo Sapiens
LAEKQNYVA

SEQ ID NO: 874765 - protein, 9 aa, Homo Sapiens
SYLNSSGSY

SEQ ID NO: 874766 - protein, 9 aa, Homo Sapiens
EATAAAAMA

SEQ ID NO: 874767 - protein, 9 aa, Homo Sapiens
DGKRLPPFK

SEQ ID NO: 874768 - protein, 9 aa, Homo Sapiens
SDLGGSNSQ

SEQ ID NO: 874769 - protein, 9 aa, Homo Sapiens
PSLAVTSQS

SEQ ID NO: 874770 - protein, 9 aa, Homo Sapiens
KLNFYSNGV

SEQ ID NO: 874771 - protein, 9 aa, Homo Sapiens
WLKTSLLVA

SEQ ID NO: 874772 - protein, 9 aa, Homo Sapiens
ASPMNFHPE

SEQ ID NO: 874773 - protein, 9 aa, Homo Sapiens
MYSQDSIYL

SEQ ID NO: 874774 - protein, 9 aa, Homo Sapiens
YQKPLSDKL

SEQ ID NO: 874775 - protein, 9 aa, Homo Sapiens
VHTGERSYE

SEQ ID NO: 874776 - protein, 9 aa, Homo Sapiens
EVVIPLATS

SEQ ID NO: 874777 - protein, 9 aa, Homo Sapiens
LLPLSLQWL

SEQ ID NO: 874778 - protein, 9 aa, Homo Sapiens
KKKKKKHQK

SEQ ID NO: 874779 - protein, 9 aa, Homo Sapiens
MSPRDCAYL

SEQ ID NO: 874780 - protein, 9 aa, Homo Sapiens
LYERDCRRH

SEQ ID NO: 874781 - protein, 9 aa, Homo Sapiens
ALHVCFITL

SEQ ID NO: 874782 - protein, 9 aa, Homo Sapiens
TYAETKAVC

SEQ ID NO: 874783 - protein, 9 aa, Homo Sapiens
DLGDVMKMN

SEQ ID NO: 874784 - protein, 9 aa, Homo Sapiens
LLLSLNLSD

SEQ ID NO: 874785 - protein, 9 aa, Homo Sapiens
FFTTPSAVC

SEQ ID NO: 874786 - protein, 9 aa, Homo Sapiens
TSILCYRKQ

SEQ ID NO: 874787 - protein, 9 aa, Homo Sapiens
SPSWTFKHL

SEQ ID NO: 874788 - protein, 9 aa, Homo Sapiens
RCALNKHSL

SEQ ID NO: 874789 - protein, 9 aa, Homo Sapiens
AEGHHWHMK

SEQ ID NO: 874790 - protein, 9 aa, Homo Sapiens
QIMAVKRIW

SEQ ID NO: 874791 - protein, 9 aa, Homo Sapiens
CTLKNAQMK

SEQ ID NO: 874792 - protein, 9 aa, Homo Sapiens
DNVELPPWA

SEQ ID NO: 874793 - protein, 9 aa, Homo Sapiens
TSQNEVLQN

SEQ ID NO: 874794 - protein, 9 aa, Homo Sapiens
KLQNYYAAN

SEQ ID NO: 874795 - protein, 9 aa, Homo Sapiens
VFLLQFSLE

SEQ ID NO: 874796 - protein, 9 aa, Homo Sapiens
ASVLESGTV

SEQ ID NO: 874797 - protein, 9 aa, Homo Sapiens
GGSRMCCQQ

SEQ ID NO: 874798 - protein, 9 aa, Homo Sapiens
EFQEEAKHR

SEQ ID NO: 874799 - protein, 9 aa, Homo Sapiens
MEGEGAINL

SEQ ID NO: 874800 - protein, 9 aa, Homo Sapiens
VGLAMGLIC

SEQ ID NO: 874801 - protein, 9 aa, Homo Sapiens
GLDFLSSST

SEQ ID NO: 874802 - protein, 9 aa, Homo Sapiens
IGCRCVLKD

SEQ ID NO: 874803 - protein, 9 aa, Homo Sapiens
GLIEKNIKL

SEQ ID NO: 874804 - protein, 9 aa, Homo Sapiens
YFASLNKSA

SEQ ID NO: 874805 - protein, 9 aa, Homo Sapiens
EQERTQQCI

SEQ ID NO: 874806 - protein, 9 aa, Homo Sapiens
VLKYFSLAG

SEQ ID NO: 874807 - protein, 9 aa, Homo Sapiens
LNEARDKFT

SEQ ID NO: 874808 - protein, 9 aa, Homo Sapiens
TKNHPVQFG

SEQ ID NO: 874809 - protein, 9 aa, Homo Sapiens
ILCTKTENS

SEQ ID NO: 874810 - protein, 9 aa, Homo Sapiens
FMWGVNHSI

SEQ ID NO: 874811 - protein, 9 aa, Homo Sapiens
NCETCRGQV

SEQ ID NO: 874812 - protein, 9 aa, Homo Sapiens
ERMRRGQNT

SEQ ID NO: 874813 - protein, 9 aa, Homo Sapiens
NEIWKVLTS

SEQ ID NO: 874814 - protein, 9 aa, Homo Sapiens
EHQIIHTGE

SEQ ID NO: 874815 - protein, 9 aa, Homo Sapiens
EELQSKGES

SEQ ID NO: 874816 - protein, 9 aa, Homo Sapiens
VWEHFDCLT

SEQ ID NO: 874817 - protein, 9 aa, Homo Sapiens
NCNKAKTQD

SEQ ID NO: 874818 - protein, 9 aa, Homo Sapiens
LAVKDYIQT

SEQ ID NO: 874819 - protein, 9 aa, Homo Sapiens
AVLSVPDDV

SEQ ID NO: 874820 - protein, 9 aa, Homo Sapiens
KEAALSWLA

SEQ ID NO: 874821 - protein, 9 aa, Homo Sapiens
FSYLNSFQT

SEQ ID NO: 874822 - protein, 9 aa, Homo Sapiens
NVGRNPFRC

SEQ ID NO: 874823 - protein, 9 aa, Homo Sapiens
QRDLEPKQS

SEQ ID NO: 874824 - protein, 9 aa, Homo Sapiens
ARVLGMMAQ

SEQ ID NO: 874825 - protein, 9 aa, Homo Sapiens
QSFQGVTGY

SEQ ID NO: 874826 - protein, 9 aa, Homo Sapiens
FSSRKKTPN

SEQ ID NO: 874827 - protein, 9 aa, Homo Sapiens
TRKSQLQVE

SEQ ID NO: 874828 - protein, 9 aa, Homo Sapiens
CISHSYAEI

SEQ ID NO: 874829 - protein, 9 aa, Homo Sapiens
CILSLSWHP

SEQ ID NO: 874830 - protein, 9 aa, Homo Sapiens
KQDNYIPDE

SEQ ID NO: 874831 - protein, 9 aa, Homo Sapiens
ETSLQITAS

SEQ ID NO: 874832 - protein, 9 aa, Homo Sapiens
QQGGNMLGL

SEQ ID NO: 874833 - protein, 9 aa, Homo Sapiens
KIDLPPTIS

SEQ ID NO: 874834 - protein, 9 aa, Homo Sapiens
IVTASVGHC

SEQ ID NO: 874835 - protein, 9 aa, Homo Sapiens
KKKSCWPFS

SEQ ID NO: 874836 - protein, 9 aa, Homo Sapiens
KENYGHIYN

SEQ ID NO: 874837 - protein, 9 aa, Homo Sapiens
WIGSDISNF

SEQ ID NO: 874838 - protein, 9 aa, Homo Sapiens
SDNYVQAVE

SEQ ID NO: 874839 - protein, 9 aa, Homo Sapiens
QEQDQELCK

SEQ ID NO: 874840 - protein, 9 aa, Homo Sapiens
EHNFSTYSD

SEQ ID NO: 874841 - protein, 9 aa, Homo Sapiens
LAQFSMFQT

SEQ ID NO: 874842 - protein, 9 aa, Homo Sapiens
MMMGIIKRN

SEQ ID NO: 874843 - protein, 9 aa, Homo Sapiens
CSICKHKID

SEQ ID NO: 874844 - protein, 9 aa, Homo Sapiens
GAGSLVINL

SEQ ID NO: 874845 - protein, 9 aa, Homo Sapiens
VKGFASDCF

SEQ ID NO: 874846 - protein, 9 aa, Homo Sapiens
KKYSRVMDL

SEQ ID NO: 874847 - protein, 9 aa, Homo Sapiens
LIIVLVSYL

SEQ ID NO: 874848 - protein, 9 aa, Homo Sapiens
PSSARNTLM

SEQ ID NO: 874849 - protein, 9 aa, Homo Sapiens
NQSLTLAKH

SEQ ID NO: 874850 - protein, 9 aa, Homo Sapiens
LSVMYRFCT

SEQ ID NO: 874851 - protein, 9 aa, Homo Sapiens
QESLEISLS

SEQ ID NO: 874852 - protein, 9 aa, Homo Sapiens
RVCMAGALL

SEQ ID NO: 874853 - protein, 9 aa, Homo Sapiens
ENMRKKRRI

SEQ ID NO: 874854 - protein, 9 aa, Homo Sapiens
DGDKNPMSS

SEQ ID NO: 874855 - protein, 9 aa, Homo Sapiens
VSTVWGTEH

SEQ ID NO: 874856 - protein, 9 aa, Homo Sapiens
ALHHLTSRH

SEQ ID NO: 874857 - protein, 9 aa, Homo Sapiens
QNLHQLGSK

SEQ ID NO: 874858 - protein, 9 aa, Homo Sapiens
IAMEPFKIN

SEQ ID NO: 874859 - protein, 9 aa, Homo Sapiens
SAADHKPES

SEQ ID NO: 874860 - protein, 9 aa, Homo Sapiens
MISNHQHSN

SEQ ID NO: 874861 - protein, 9 aa, Homo Sapiens
QTFQAFILD

SEQ ID NO: 874862 - protein, 9 aa, Homo Sapiens
LCLTISSDT

SEQ ID NO: 874863 - protein, 9 aa, Homo Sapiens
LLKRLPSLI

SEQ ID NO: 874864 - protein, 9 aa, Homo Sapiens
DGREFNLQR

SEQ ID NO: 874865 - protein, 9 aa, Homo Sapiens
GEAGNESGL

SEQ ID NO: 874866 - protein, 9 aa, Homo Sapiens
KKPLVKRDK

SEQ ID NO: 874867 - protein, 9 aa, Homo Sapiens
LCLKHGAKL

SEQ ID NO: 874868 - protein, 9 aa, Homo Sapiens
CAKSKSCHD

SEQ ID NO: 874869 - protein, 9 aa, Homo Sapiens
QRNSVSPVL

SEQ ID NO: 874870 - protein, 9 aa, Homo Sapiens
ATLANTQLV

SEQ ID NO: 874871 - protein, 9 aa, Homo Sapiens
GSGDIVSVL

SEQ ID NO: 874872 - protein, 9 aa, Homo Sapiens
LPVSGRLPP

SEQ ID NO: 874873 - protein, 9 aa, Homo Sapiens
SVPKEVVDC

SEQ ID NO: 874874 - protein, 9 aa, Homo Sapiens
KRSCASTDV

SEQ ID NO: 874875 - protein, 9 aa, Homo Sapiens
QLNQSVHTG

SEQ ID NO: 874876 - protein, 9 aa, Homo Sapiens
CKGGITFFR

SEQ ID NO: 874877 - protein, 9 aa, Homo Sapiens
FLSSSTEKP

SEQ ID NO: 874878 - protein, 9 aa, Homo Sapiens
DDKLTEKEC

SEQ ID NO: 874879 - protein, 9 aa, Homo Sapiens
PMSSSFNLD

SEQ ID NO: 874880 - protein, 9 aa, Homo Sapiens
LLEGFELMD

SEQ ID NO: 874881 - protein, 9 aa, Homo Sapiens
PYPCLMARE

SEQ ID NO: 874882 - protein, 9 aa, Homo Sapiens
PSLYFTMTS

SEQ ID NO: 874883 - protein, 9 aa, Homo Sapiens
DVVQLHAPQ

SEQ ID NO: 874884 - protein, 9 aa, Homo Sapiens
LIQFLSEPT

SEQ ID NO: 874885 - protein, 9 aa, Homo Sapiens
YTLRGHSAK

SEQ ID NO: 874886 - protein, 9 aa, Homo Sapiens
PLGLNAREE

SEQ ID NO: 874887 - protein, 9 aa, Homo Sapiens
LNQTLKDKA

SEQ ID NO: 874888 - protein, 9 aa, Homo Sapiens
ISSVAVDAI

SEQ ID NO: 874889 - protein, 9 aa, Homo Sapiens
TYVRPRSLQ

SEQ ID NO: 874890 - protein, 9 aa, Homo Sapiens
YSKVAVSIT

SEQ ID NO: 874891 - protein, 9 aa, Homo Sapiens
QVCLQFLTC

SEQ ID NO: 874892 - protein, 9 aa, Homo Sapiens
GLTTVSVGI

SEQ ID NO: 874893 - protein, 9 aa, Homo Sapiens
LAIVLRLRR

SEQ ID NO: 874894 - protein, 9 aa, Homo Sapiens
LALLTDGII

SEQ ID NO: 874895 - protein, 9 aa, Homo Sapiens
LVKRDKQDE

SEQ ID NO: 874896 - protein, 9 aa, Homo Sapiens
HIQLPNTVI

SEQ ID NO: 874897 - protein, 9 aa, Homo Sapiens
RKEKLGTHL

SEQ ID NO: 874898 - protein, 9 aa, Homo Sapiens
CRDGAAAVG

SEQ ID NO: 874899 - protein, 9 aa, Homo Sapiens
MKILWDTGV

SEQ ID NO: 874900 - protein, 9 aa, Homo Sapiens
QGIYAISAP

SEQ ID NO: 874901 - protein, 9 aa, Homo Sapiens
ELPLLCAAL

SEQ ID NO: 874902 - protein, 9 aa, Homo Sapiens
STKNWNHVV

SEQ ID NO: 874903 - protein, 9 aa, Homo Sapiens
TFNPSGPSV

SEQ ID NO: 874904 - protein, 9 aa, Homo Sapiens
FLSEELDSE

SEQ ID NO: 874905 - protein, 9 aa, Homo Sapiens
RRYVDKYRN

SEQ ID NO: 874906 - protein, 9 aa, Homo Sapiens
AAHQTNKQE

SEQ ID NO: 874907 - protein, 9 aa, Homo Sapiens
FKHEEIILI

SEQ ID NO: 874908 - protein, 9 aa, Homo Sapiens
FCLQNPKAR

SEQ ID NO: 874909 - protein, 9 aa, Homo Sapiens
RQNTSLGIE

SEQ ID NO: 874910 - protein, 9 aa, Homo Sapiens
SCHPEGIIN

SEQ ID NO: 874911 - protein, 9 aa, Homo Sapiens
NKPVSPLLL

SEQ ID NO: 874912 - protein, 9 aa, Homo Sapiens
CQSQLTSNR

SEQ ID NO: 874913 - protein, 9 aa, Homo Sapiens
ENECMKIKI

SEQ ID NO: 874914 - protein, 9 aa, Homo Sapiens
RYTVWAKRG

SEQ ID NO: 874915 - protein, 9 aa, Homo Sapiens
ESKLKISSS

SEQ ID NO: 874916 - protein, 9 aa, Homo Sapiens
KKLQNYYAA

SEQ ID NO: 874917 - protein, 9 aa, Homo Sapiens
IYIRKKKLK

SEQ ID NO: 874918 - protein, 9 aa, Homo Sapiens
VVRKQEKEG

SEQ ID NO: 874919 - protein, 9 aa, Homo Sapiens
QREELKEEF

SEQ ID NO: 874920 - protein, 9 aa, Homo Sapiens
ERQSKFTNF

SEQ ID NO: 874921 - protein, 9 aa, Homo Sapiens
MEVCNLCIL

SEQ ID NO: 874922 - protein, 9 aa, Homo Sapiens
WILNAQHIN

SEQ ID NO: 874923 - protein, 9 aa, Homo Sapiens
SLNTRHMVK

SEQ ID NO: 874924 - protein, 9 aa, Homo Sapiens
QLRYCAGHI

SEQ ID NO: 874925 - protein, 9 aa, Homo Sapiens
FLPEEMESL

SEQ ID NO: 874926 - protein, 9 aa, Homo Sapiens
MIEHIDACL

SEQ ID NO: 874927 - protein, 9 aa, Homo Sapiens
SETNQVLNS

SEQ ID NO: 874928 - protein, 9 aa, Homo Sapiens
DLENTASTN

SEQ ID NO: 874929 - protein, 9 aa, Homo Sapiens
QHCNICCMN

SEQ ID NO: 874930 - protein, 9 aa, Homo Sapiens
KGKRGPPGP

SEQ ID NO: 874931 - protein, 9 aa, Homo Sapiens
CQAFYFALR

SEQ ID NO: 874932 - protein, 9 aa, Homo Sapiens
EEEEAEGGQ

SEQ ID NO: 874933 - protein, 9 aa, Homo Sapiens
LRLELAKMK

SEQ ID NO: 874934 - protein, 9 aa, Homo Sapiens
YVGSEPQAF

SEQ ID NO: 874935 - protein, 9 aa, Homo Sapiens
PWLQIARRA

SEQ ID NO: 874936 - protein, 9 aa, Homo Sapiens
EQSHIFSSF

SEQ ID NO: 874937 - protein, 9 aa, Homo Sapiens
NLESLNFSV

SEQ ID NO: 874938 - protein, 9 aa, Homo Sapiens
TIARKLLPK

SEQ ID NO: 874939 - protein, 9 aa, Homo Sapiens
MEAMQNKFL

SEQ ID NO: 874940 - protein, 9 aa, Homo Sapiens
KNHIVWGSG

SEQ ID NO: 874941 - protein, 9 aa, Homo Sapiens
QREVKILEN

SEQ ID NO: 874942 - protein, 9 aa, Homo Sapiens
FKFVRPFPL

SEQ ID NO: 874943 - protein, 9 aa, Homo Sapiens
NLKSVDDVK

SEQ ID NO: 874944 - protein, 9 aa, Homo Sapiens
TNKLLAYTN

SEQ ID NO: 874945 - protein, 9 aa, Homo Sapiens
LQARSCWVL

SEQ ID NO: 874946 - protein, 9 aa, Homo Sapiens
QRRRRGFRQ

SEQ ID NO: 874947 - protein, 9 aa, Homo Sapiens
RFLEIKEQI

SEQ ID NO: 874948 - protein, 9 aa, Homo Sapiens
MEENEPYPV

SEQ ID NO: 874949 - protein, 9 aa, Homo Sapiens
DGQTSGTVS

SEQ ID NO: 874950 - protein, 9 aa, Homo Sapiens
ELKLWDLSS

SEQ ID NO: 874951 - protein, 9 aa, Homo Sapiens
MTTALMSSM

SEQ ID NO: 874952 - protein, 9 aa, Homo Sapiens
NRQQRDRAA

SEQ ID NO: 874953 - protein, 9 aa, Homo Sapiens
NQEIRLCQL

SEQ ID NO: 874954 - protein, 9 aa, Homo Sapiens
GYKPFVCKF

SEQ ID NO: 874955 - protein, 9 aa, Homo Sapiens
LKIIRVDAP

SEQ ID NO: 874956 - protein, 9 aa, Homo Sapiens
SHADYAGGD

SEQ ID NO: 874957 - protein, 9 aa, Homo Sapiens
SQVKYTEEY

SEQ ID NO: 874958 - protein, 9 aa, Homo Sapiens
KANPLGLEA

SEQ ID NO: 874959 - protein, 9 aa, Homo Sapiens
VRTAAAPRC

SEQ ID NO: 874960 - protein, 9 aa, Homo Sapiens
KNRKTRRYG

SEQ ID NO: 874961 - protein, 9 aa, Homo Sapiens
NISLSSSGV

SEQ ID NO: 874962 - protein, 9 aa, Homo Sapiens
VKMTFDRDG

SEQ ID NO: 874963 - protein, 9 aa, Homo Sapiens
GSKFIIDLI

SEQ ID NO: 874964 - protein, 9 aa, Homo Sapiens
LKDELQKRK

SEQ ID NO: 874965 - protein, 9 aa, Homo Sapiens
TEQRCASLN

SEQ ID NO: 874966 - protein, 9 aa, Homo Sapiens
VFNQASCLT

SEQ ID NO: 874967 - protein, 9 aa, Homo Sapiens
VCKLDENNT

SEQ ID NO: 874968 - protein, 9 aa, Homo Sapiens
TLIQLSVGL

SEQ ID NO: 874969 - protein, 9 aa, Homo Sapiens
LFCHLQLAQ

SEQ ID NO: 874970 - protein, 9 aa, Homo Sapiens
FFWLKSKWM

SEQ ID NO: 874971 - protein, 9 aa, Homo Sapiens
WDNSIPDII

SEQ ID NO: 874972 - protein, 9 aa, Homo Sapiens
DIKRICVGE

SEQ ID NO: 874973 - protein, 9 aa, Homo Sapiens
YKQKFICGF

SEQ ID NO: 874974 - protein, 9 aa, Homo Sapiens
RVVKILHKN

SEQ ID NO: 874975 - protein, 9 aa, Homo Sapiens
LLFYFIPSQ

SEQ ID NO: 874976 - protein, 9 aa, Homo Sapiens
ENGGTEPPG

SEQ ID NO: 874977 - protein, 9 aa, Homo Sapiens
RLVNISVYA

SEQ ID NO: 874978 - protein, 9 aa, Homo Sapiens
RRTFNQTAE

SEQ ID NO: 874979 - protein, 9 aa, Homo Sapiens
KKLEEAEIK

SEQ ID NO: 874980 - protein, 9 aa, Homo Sapiens
FLIISMCLI

SEQ ID NO: 874981 - protein, 9 aa, Homo Sapiens
DETRYHNEI

SEQ ID NO: 874982 - protein, 9 aa, Homo Sapiens
LWNFLLAVV

SEQ ID NO: 874983 - protein, 9 aa, Homo Sapiens
TPPVLTWRP

SEQ ID NO: 874984 - protein, 9 aa, Homo Sapiens
STDQKYSKP

SEQ ID NO: 874985 - protein, 9 aa, Homo Sapiens
MFCITNIEF

SEQ ID NO: 874986 - protein, 9 aa, Homo Sapiens
QRHMVMHSG

SEQ ID NO: 874987 - protein, 9 aa, Homo Sapiens
TRLRLLRSG

SEQ ID NO: 874988 - protein, 9 aa, Homo Sapiens
AFFIYKRCL

SEQ ID NO: 874989 - protein, 9 aa, Homo Sapiens
THPIHWAVV

SEQ ID NO: 874990 - protein, 9 aa, Homo Sapiens
LLDHRMTKV

SEQ ID NO: 874991 - protein, 9 aa, Homo Sapiens
LATLMINFN

SEQ ID NO: 874992 - protein, 9 aa, Homo Sapiens
PQPRSISES

SEQ ID NO: 874993 - protein, 9 aa, Homo Sapiens
QPPNHPNHS

SEQ ID NO: 874994 - protein, 9 aa, Homo Sapiens
DKYYMLISL

SEQ ID NO: 874995 - protein, 9 aa, Homo Sapiens
LRCPLSRNI

SEQ ID NO: 874996 - protein, 9 aa, Homo Sapiens
FYQTLITLL

SEQ ID NO: 874997 - protein, 9 aa, Homo Sapiens
LHYFRNQRP

SEQ ID NO: 874998 - protein, 9 aa, Homo Sapiens
ECEIWNPVS

SEQ ID NO: 874999 - protein, 9 aa, Homo Sapiens
EVPKIYALM

SEQ ID NO: 875000 - protein, 9 aa, Homo Sapiens
LTAPYRTQS

SEQ ID NO: 875001 - protein, 9 aa, Homo Sapiens
ITLSFPVDT

SEQ ID NO: 875002 - protein, 9 aa, Homo Sapiens
LKGAFQSSE

SEQ ID NO: 875003 - protein, 9 aa, Homo Sapiens
VCSCFQQNN

SEQ ID NO: 875004 - protein, 9 aa, Homo Sapiens
DPVQLISGF

SEQ ID NO: 875005 - protein, 9 aa, Homo Sapiens
QSQTDGVLF

SEQ ID NO: 875006 - protein, 9 aa, Homo Sapiens
VLDISLIEN

SEQ ID NO: 875007 - protein, 9 aa, Homo Sapiens
SYLSVHKII

SEQ ID NO: 875008 - protein, 9 aa, Homo Sapiens
GLSCHRRVH

SEQ ID NO: 875009 - protein, 9 aa, Homo Sapiens
GKNSNEVAK

SEQ ID NO: 875010 - protein, 9 aa, Homo Sapiens
AQISAGTYF

SEQ ID NO: 875011 - protein, 9 aa, Homo Sapiens
SHSQSRLPG

SEQ ID NO: 875012 - protein, 9 aa, Homo Sapiens
VYKDANLYL

SEQ ID NO: 875013 - protein, 9 aa, Homo Sapiens
KKKDEEFQQ

SEQ ID NO: 875014 - protein, 9 aa, Homo Sapiens
SQLNALNSL

SEQ ID NO: 875015 - protein, 9 aa, Homo Sapiens
KVVFTENTT

SEQ ID NO: 875016 - protein, 9 aa, Homo Sapiens
SSLPIHKLG

SEQ ID NO: 875017 - protein, 9 aa, Homo Sapiens
PQIAHDIFD

SEQ ID NO: 875018 - protein, 9 aa, Homo Sapiens
RDYMERNNI

SEQ ID NO: 875019 - protein, 9 aa, Homo Sapiens
APAFAQPKY

SEQ ID NO: 875020 - protein, 9 aa, Homo Sapiens
PEEILELLG

SEQ ID NO: 875021 - protein, 9 aa, Homo Sapiens
ALEDKLENV

SEQ ID NO: 875022 - protein, 9 aa, Homo Sapiens
VEEKGKYPV

SEQ ID NO: 875023 - protein, 9 aa, Homo Sapiens
GNIRIWFIR

SEQ ID NO: 875024 - protein, 9 aa, Homo Sapiens
GLAMGLICM

SEQ ID NO: 875025 - protein, 9 aa, Homo Sapiens
PGTLLINSS

SEQ ID NO: 875026 - protein, 9 aa, Homo Sapiens
VQDDDVPLS

SEQ ID NO: 875027 - protein, 9 aa, Homo Sapiens
DVSVRLHHK

SEQ ID NO: 875028 - protein, 9 aa, Homo Sapiens
FTKYFIKIE

SEQ ID NO: 875029 - protein, 9 aa, Homo Sapiens
IIIVLLRHT

SEQ ID NO: 875030 - protein, 9 aa, Homo Sapiens
KVNNIETQL

SEQ ID NO: 875031 - protein, 9 aa, Homo Sapiens
TALHLAVEA

SEQ ID NO: 875032 - protein, 9 aa, Homo Sapiens
TVKVHPKYL

SEQ ID NO: 875033 - protein, 9 aa, Homo Sapiens
LALEAEIQT

SEQ ID NO: 875034 - protein, 9 aa, Homo Sapiens
ISERMAGNK

SEQ ID NO: 875035 - protein, 9 aa, Homo Sapiens
HIQNHTGEK

SEQ ID NO: 875036 - protein, 9 aa, Homo Sapiens
GVRVFRPQT

SEQ ID NO: 875037 - protein, 9 aa, Homo Sapiens
NIGKFCGKQ

SEQ ID NO: 875038 - protein, 9 aa, Homo Sapiens
DTSTPRRSC

SEQ ID NO: 875039 - protein, 9 aa, Homo Sapiens
QDNGEVPED

SEQ ID NO: 875040 - protein, 9 aa, Homo Sapiens
KVRQLEQDN

SEQ ID NO: 875041 - protein, 9 aa, Homo Sapiens
KLSPPQPLF

SEQ ID NO: 875042 - protein, 9 aa, Homo Sapiens
KTGTLTQNQ

SEQ ID NO: 875043 - protein, 9 aa, Homo Sapiens
KEHLKRHTA

SEQ ID NO: 875044 - protein, 9 aa, Homo Sapiens
QCSRLTVHW

SEQ ID NO: 875045 - protein, 9 aa, Homo Sapiens
KLHFWRKIC

SEQ ID NO: 875046 - protein, 9 aa, Homo Sapiens
NQFCEFKLS

SEQ ID NO: 875047 - protein, 9 aa, Homo Sapiens
NYRQIYPPE

SEQ ID NO: 875048 - protein, 9 aa, Homo Sapiens
HFGVFLVIY

SEQ ID NO: 875049 - protein, 9 aa, Homo Sapiens
DEAQSLKNK

SEQ ID NO: 875050 - protein, 9 aa, Homo Sapiens
KEDANRKTF

SEQ ID NO: 875051 - protein, 9 aa, Homo Sapiens
NASYIMDYY

SEQ ID NO: 875052 - protein, 9 aa, Homo Sapiens
DNNPPGSCG

SEQ ID NO: 875053 - protein, 9 aa, Homo Sapiens
NQTAETVPK

SEQ ID NO: 875054 - protein, 9 aa, Homo Sapiens
TSVSVYGRA

SEQ ID NO: 875055 - protein, 9 aa, Homo Sapiens
PPVLTTAKT

SEQ ID NO: 875056 - protein, 9 aa, Homo Sapiens
SQSISASSA

SEQ ID NO: 875057 - protein, 9 aa, Homo Sapiens
CPFFLYYAS

SEQ ID NO: 875058 - protein, 9 aa, Homo Sapiens
KYIQIHTGI

SEQ ID NO: 875059 - protein, 9 aa, Homo Sapiens
GSERYYQLW

SEQ ID NO: 875060 - protein, 9 aa, Homo Sapiens
TPSSTTHIT

SEQ ID NO: 875061 - protein, 9 aa, Homo Sapiens
APGKNKAQY

SEQ ID NO: 875062 - protein, 9 aa, Homo Sapiens
QTKLLNGPG

SEQ ID NO: 875063 - protein, 9 aa, Homo Sapiens
EGRRSVTGI

SEQ ID NO: 875064 - protein, 9 aa, Homo Sapiens
ENEVVGSYL

SEQ ID NO: 875065 - protein, 9 aa, Homo Sapiens
NIPGSKLMS

SEQ ID NO: 875066 - protein, 9 aa, Homo Sapiens
TDFQSQKSI

SEQ ID NO: 875067 - protein, 9 aa, Homo Sapiens
HRHCSRRRL

SEQ ID NO: 875068 - protein, 9 aa, Homo Sapiens
VNLPYYTVV

SEQ ID NO: 875069 - protein, 9 aa, Homo Sapiens
CSSLQRHEM

SEQ ID NO: 875070 - protein, 9 aa, Homo Sapiens
QREVLWNLS

SEQ ID NO: 875071 - protein, 9 aa, Homo Sapiens
SADPGMPRM

SEQ ID NO: 875072 - protein, 9 aa, Homo Sapiens
VNQARLECD

SEQ ID NO: 875073 - protein, 9 aa, Homo Sapiens
MLETINKGG

SEQ ID NO: 875074 - protein, 9 aa, Homo Sapiens
TEGELPTHK

SEQ ID NO: 875075 - protein, 9 aa, Homo Sapiens
SALCRHKKA

SEQ ID NO: 875076 - protein, 9 aa, Homo Sapiens
ILYCNSSGA

SEQ ID NO: 875077 - protein, 9 aa, Homo Sapiens
SSTMANNKG

SEQ ID NO: 875078 - protein, 9 aa, Homo Sapiens
QEATFEEIE

SEQ ID NO: 875079 - protein, 9 aa, Homo Sapiens
MGHKENEKV

SEQ ID NO: 875080 - protein, 9 aa, Homo Sapiens
DACNAKDPT

SEQ ID NO: 875081 - protein, 9 aa, Homo Sapiens
RQGLQTPGP

SEQ ID NO: 875082 - protein, 9 aa, Homo Sapiens
SMLDAEPDS

SEQ ID NO: 875083 - protein, 9 aa, Homo Sapiens
FSDISEMQA

SEQ ID NO: 875084 - protein, 9 aa, Homo Sapiens
GLLYETAEN

SEQ ID NO: 875085 - protein, 9 aa, Homo Sapiens
PMPIKKTKL

SEQ ID NO: 875086 - protein, 9 aa, Homo Sapiens
PSRPLSQRQ

SEQ ID NO: 875087 - protein, 9 aa, Homo Sapiens
IYKSFTNAI

SEQ ID NO: 875088 - protein, 9 aa, Homo Sapiens
DTWSNPLEK

SEQ ID NO: 875089 - protein, 9 aa, Homo Sapiens
VKASISSAE

SEQ ID NO: 875090 - protein, 9 aa, Homo Sapiens
YRCVYKVQS

SEQ ID NO: 875091 - protein, 9 aa, Homo Sapiens
HSLDVAKAP

SEQ ID NO: 875092 - protein, 9 aa, Homo Sapiens
SGFIIFGDN

SEQ ID NO: 875093 - protein, 9 aa, Homo Sapiens
HICNLFDFD

SEQ ID NO: 875094 - protein, 9 aa, Homo Sapiens
IDKISKEFL

SEQ ID NO: 875095 - protein, 9 aa, Homo Sapiens
MNLCTLISA

SEQ ID NO: 875096 - protein, 9 aa, Homo Sapiens
YNVYGTKSI

SEQ ID NO: 875097 - protein, 9 aa, Homo Sapiens
LGNIRIWFI

SEQ ID NO: 875098 - protein, 9 aa, Homo Sapiens
MALCQNARE

SEQ ID NO: 875099 - protein, 9 aa, Homo Sapiens
AAFKTYSNI

SEQ ID NO: 875100 - protein, 9 aa, Homo Sapiens
RFVPRHEDK

SEQ ID NO: 875101 - protein, 9 aa, Homo Sapiens
SLQTLAMVV

SEQ ID NO: 875102 - protein, 9 aa, Homo Sapiens
NSRKMAFCA

SEQ ID NO: 875103 - protein, 9 aa, Homo Sapiens
VLLYVQKES

SEQ ID NO: 875104 - protein, 9 aa, Homo Sapiens
VANVNDNAP

SEQ ID NO: 875105 - protein, 9 aa, Homo Sapiens
LSLAPEGLS

SEQ ID NO: 875106 - protein, 9 aa, Homo Sapiens
KYTVFVKEN

SEQ ID NO: 875107 - protein, 9 aa, Homo Sapiens
NPPPAPFKS

SEQ ID NO: 875108 - protein, 9 aa, Homo Sapiens
RNTFQHSVV

SEQ ID NO: 875109 - protein, 9 aa, Homo Sapiens
QFQLQELDN

SEQ ID NO: 875110 - protein, 9 aa, Homo Sapiens
TYDGSITIP

SEQ ID NO: 875111 - protein, 9 aa, Homo Sapiens
FIKWGLPGT

SEQ ID NO: 875112 - protein, 9 aa, Homo Sapiens
GLRLKHMKF

SEQ ID NO: 875113 - protein, 9 aa, Homo Sapiens
GCYPQENKG

SEQ ID NO: 875114 - protein, 9 aa, Homo Sapiens
VLANYPDAD

SEQ ID NO: 875115 - protein, 9 aa, Homo Sapiens
LPRSRSLSD

SEQ ID NO: 875116 - protein, 9 aa, Homo Sapiens
RQVFEGQNC

SEQ ID NO: 875117 - protein, 9 aa, Homo Sapiens
SKSKLHKFK

SEQ ID NO: 875118 - protein, 9 aa, Homo Sapiens
LTVGKSIVL

SEQ ID NO: 875119 - protein, 9 aa, Homo Sapiens
SVFSLGSGS

SEQ ID NO: 875120 - protein, 9 aa, Homo Sapiens
DFSQEEWIL

SEQ ID NO: 875121 - protein, 9 aa, Homo Sapiens
EFKIIIKIF

SEQ ID NO: 875122 - protein, 9 aa, Homo Sapiens
YWALGYVIS

SEQ ID NO: 875123 - protein, 9 aa, Homo Sapiens
INLGEQQKD

SEQ ID NO: 875124 - protein, 9 aa, Homo Sapiens
GIQVTPDKD

SEQ ID NO: 875125 - protein, 9 aa, Homo Sapiens
GAGIQILFS

SEQ ID NO: 875126 - protein, 9 aa, Homo Sapiens
DLPWSYTIE

SEQ ID NO: 875127 - protein, 9 aa, Homo Sapiens
TWKIIIKNF

SEQ ID NO: 875128 - protein, 9 aa, Homo Sapiens
VVLGAMAIW

SEQ ID NO: 875129 - protein, 9 aa, Homo Sapiens
YPTLWIEKN

SEQ ID NO: 875130 - protein, 9 aa, Homo Sapiens
SCGNGFKLE

SEQ ID NO: 875131 - protein, 9 aa, Homo Sapiens
NAPPVVTTL

SEQ ID NO: 875132 - protein, 9 aa, Homo Sapiens
FCTNHEIPH

SEQ ID NO: 875133 - protein, 9 aa, Homo Sapiens
RTGGDKLPI

SEQ ID NO: 875134 - protein, 9 aa, Homo Sapiens
GLAVGDIAD

SEQ ID NO: 875135 - protein, 9 aa, Homo Sapiens
WYHAQMPDL

SEQ ID NO: 875136 - protein, 9 aa, Homo Sapiens
YKCCQCSFT

SEQ ID NO: 875137 - protein, 9 aa, Homo Sapiens
NGLFCKTLT

SEQ ID NO: 875138 - protein, 9 aa, Homo Sapiens
DRKEKSTKD

SEQ ID NO: 875139 - protein, 9 aa, Homo Sapiens
INDNDTTEP

SEQ ID NO: 875140 - protein, 9 aa, Homo Sapiens
QKGLCEARE

SEQ ID NO: 875141 - protein, 9 aa, Homo Sapiens
WHSQYKFCP

SEQ ID NO: 875142 - protein, 9 aa, Homo Sapiens
YSQDYRRRH

SEQ ID NO: 875143 - protein, 9 aa, Homo Sapiens
CGFVRSMAM

SEQ ID NO: 875144 - protein, 9 aa, Homo Sapiens
HRHYKHFDW

SEQ ID NO: 875145 - protein, 9 aa, Homo Sapiens
VPNASHSPV

SEQ ID NO: 875146 - protein, 9 aa, Homo Sapiens
HGKIEDLQQ

SEQ ID NO: 875147 - protein, 9 aa, Homo Sapiens
APAFLKAFA

SEQ ID NO: 875148 - protein, 9 aa, Homo Sapiens
FRVEYVIGC

SEQ ID NO: 875149 - protein, 9 aa, Homo Sapiens
DEDSTNVAS

SEQ ID NO: 875150 - protein, 9 aa, Homo Sapiens
PFKSPEEMR

SEQ ID NO: 875151 - protein, 9 aa, Homo Sapiens
KCFSSRKKT

SEQ ID NO: 875152 - protein, 9 aa, Homo Sapiens
KKKKIQREV

SEQ ID NO: 875153 - protein, 9 aa, Homo Sapiens
PKAVTAAET

SEQ ID NO: 875154 - protein, 9 aa, Homo Sapiens
AIKEAKGLL

SEQ ID NO: 875155 - protein, 9 aa, Homo Sapiens
VQAPCGATS

SEQ ID NO: 875156 - protein, 9 aa, Homo Sapiens
HGGDKSYKC

SEQ ID NO: 875157 - protein, 9 aa, Homo Sapiens
IHGKLCICC

SEQ ID NO: 875158 - protein, 9 aa, Homo Sapiens
WNFSSGFIK

SEQ ID NO: 875159 - protein, 9 aa, Homo Sapiens
REGFDKNEI

SEQ ID NO: 875160 - protein, 9 aa, Homo Sapiens
KADKPSSEE

SEQ ID NO: 875161 - protein, 9 aa, Homo Sapiens
IRYTHEGVR

SEQ ID NO: 875162 - protein, 9 aa, Homo Sapiens
HYTYSANDA

SEQ ID NO: 875163 - protein, 9 aa, Homo Sapiens
AALTKCAAS

SEQ ID NO: 875164 - protein, 9 aa, Homo Sapiens
TLPSTPVTL

SEQ ID NO: 875165 - protein, 9 aa, Homo Sapiens
ERDLCQLPG

SEQ ID NO: 875166 - protein, 9 aa, Homo Sapiens
PEQITKFMV

SEQ ID NO: 875167 - protein, 9 aa, Homo Sapiens
CARRSMDEA

SEQ ID NO: 875168 - protein, 9 aa, Homo Sapiens
KTENKEKLA

SEQ ID NO: 875169 - protein, 9 aa, Homo Sapiens
SLIAENNCW

SEQ ID NO: 875170 - protein, 9 aa, Homo Sapiens
FNWTAVLAQ

SEQ ID NO: 875171 - protein, 9 aa, Homo Sapiens
EQICLAGDS

SEQ ID NO: 875172 - protein, 9 aa, Homo Sapiens
STQTRLSTE

SEQ ID NO: 875173 - protein, 9 aa, Homo Sapiens
YGNPIEASL

SEQ ID NO: 875174 - protein, 9 aa, Homo Sapiens
HISQHEAKI

SEQ ID NO: 875175 - protein, 9 aa, Homo Sapiens
MYCDNCNLK

SEQ ID NO: 875176 - protein, 9 aa, Homo Sapiens
PFKFSSGSE

SEQ ID NO: 875177 - protein, 9 aa, Homo Sapiens
NVYGTKSIK

SEQ ID NO: 875178 - protein, 9 aa, Homo Sapiens
ELFDFLHVR

SEQ ID NO: 875179 - protein, 9 aa, Homo Sapiens
QVVAVTFGD

SEQ ID NO: 875180 - protein, 9 aa, Homo Sapiens
WTDDSKKSM

SEQ ID NO: 875181 - protein, 9 aa, Homo Sapiens
THRIHKITH

SEQ ID NO: 875182 - protein, 9 aa, Homo Sapiens
GEVYVECLS

SEQ ID NO: 875183 - protein, 9 aa, Homo Sapiens
PTQKGLCEA

SEQ ID NO: 875184 - protein, 9 aa, Homo Sapiens
EARGDMLEA

SEQ ID NO: 875185 - protein, 9 aa, Homo Sapiens
QKEDTWALD

SEQ ID NO: 875186 - protein, 9 aa, Homo Sapiens
IQELFKHIS

SEQ ID NO: 875187 - protein, 9 aa, Homo Sapiens
QLPSPQHYL

SEQ ID NO: 875188 - protein, 9 aa, Homo Sapiens
KQILINKNV

SEQ ID NO: 875189 - protein, 9 aa, Homo Sapiens
QHGSSRKSS

SEQ ID NO: 875190 - protein, 9 aa, Homo Sapiens
QKKPPSSQT

SEQ ID NO: 875191 - protein, 9 aa, Homo Sapiens
VTQQRGNMV

SEQ ID NO: 875192 - protein, 9 aa, Homo Sapiens
VAMHKVFLQ

SEQ ID NO: 875193 - protein, 9 aa, Homo Sapiens
TFLRGKVCI

SEQ ID NO: 875194 - protein, 9 aa, Homo Sapiens
PEKMRHELN

SEQ ID NO: 875195 - protein, 9 aa, Homo Sapiens
KYHTETDEK

SEQ ID NO: 875196 - protein, 9 aa, Homo Sapiens
ICCKKVEQD

SEQ ID NO: 875197 - protein, 9 aa, Homo Sapiens
KNIHLWTSY

SEQ ID NO: 875198 - protein, 9 aa, Homo Sapiens
GAWGCFDEC

SEQ ID NO: 875199 - protein, 9 aa, Homo Sapiens
FRICFHDPS

SEQ ID NO: 875200 - protein, 9 aa, Homo Sapiens
DNFITQIET

SEQ ID NO: 875201 - protein, 9 aa, Homo Sapiens
LIGIQERTR

SEQ ID NO: 875202 - protein, 9 aa, Homo Sapiens
LSLGRRVRV

SEQ ID NO: 875203 - protein, 9 aa, Homo Sapiens
HKMNVPEMM

SEQ ID NO: 875204 - protein, 9 aa, Homo Sapiens
SILALNPQT

SEQ ID NO: 875205 - protein, 9 aa, Homo Sapiens
IQLSVPAPP

SEQ ID NO: 875206 - protein, 9 aa, Homo Sapiens
NNPRFGKME

SEQ ID NO: 875207 - protein, 9 aa, Homo Sapiens
VIEQPNVKW

SEQ ID NO: 875208 - protein, 9 aa, Homo Sapiens
NLRSPAEVK

SEQ ID NO: 875209 - protein, 9 aa, Homo Sapiens
CSNGLFCKT

SEQ ID NO: 875210 - protein, 9 aa, Homo Sapiens
IPRRDIGNS

SEQ ID NO: 875211 - protein, 9 aa, Homo Sapiens
EKVICLVRQ

SEQ ID NO: 875212 - protein, 9 aa, Homo Sapiens
DKIQVDSEE

SEQ ID NO: 875213 - protein, 9 aa, Homo Sapiens
QNFPSSDSE

SEQ ID NO: 875214 - protein, 9 aa, Homo Sapiens
AINTEERLK

SEQ ID NO: 875215 - protein, 9 aa, Homo Sapiens
ELCPEEQHH

SEQ ID NO: 875216 - protein, 9 aa, Homo Sapiens
LAQNQFIAN

SEQ ID NO: 875217 - protein, 9 aa, Homo Sapiens
GKNIGKFCG

SEQ ID NO: 875218 - protein, 9 aa, Homo Sapiens
CRNNRCNNL

SEQ ID NO: 875219 - protein, 9 aa, Homo Sapiens
SDLQVYLYR

SEQ ID NO: 875220 - protein, 9 aa, Homo Sapiens
RHIHNFQLD

SEQ ID NO: 875221 - protein, 9 aa, Homo Sapiens
ILDFNTMPE

SEQ ID NO: 875222 - protein, 9 aa, Homo Sapiens
LIIGLVSVI

SEQ ID NO: 875223 - protein, 9 aa, Homo Sapiens
VKYLATLDT

SEQ ID NO: 875224 - protein, 9 aa, Homo Sapiens
FKVNKIWDL

SEQ ID NO: 875225 - protein, 9 aa, Homo Sapiens
NVADDDSGM

SEQ ID NO: 875226 - protein, 9 aa, Homo Sapiens
STISMLLGN

SEQ ID NO: 875227 - protein, 9 aa, Homo Sapiens
EQSRKRLIK

SEQ ID NO: 875228 - protein, 9 aa, Homo Sapiens
YLTSTQSLS

SEQ ID NO: 875229 - protein, 9 aa, Homo Sapiens
HRNKSELDF

SEQ ID NO: 875230 - protein, 9 aa, Homo Sapiens
WQNENEQIH

SEQ ID NO: 875231 - protein, 9 aa, Homo Sapiens
LTKAQIVKL

SEQ ID NO: 875232 - protein, 9 aa, Homo Sapiens
RGLIKNGEQ

SEQ ID NO: 875233 - protein, 9 aa, Homo Sapiens
AYHTDDCHP

SEQ ID NO: 875234 - protein, 9 aa, Homo Sapiens
LLDGDQLTL

SEQ ID NO: 875235 - protein, 9 aa, Homo Sapiens
RACNPQECF

SEQ ID NO: 875236 - protein, 9 aa, Homo Sapiens
IRIYPDMSV

SEQ ID NO: 875237 - protein, 9 aa, Homo Sapiens
IWAFMMCLH

SEQ ID NO: 875238 - protein, 9 aa, Homo Sapiens
DFGPHDNSS

SEQ ID NO: 875239 - protein, 9 aa, Homo Sapiens
TWALDDILV

SEQ ID NO: 875240 - protein, 9 aa, Homo Sapiens
SNPVRHLST

SEQ ID NO: 875241 - protein, 9 aa, Homo Sapiens
FPFHHTTAN

SEQ ID NO: 875242 - protein, 9 aa, Homo Sapiens
HKCAALRIQ

SEQ ID NO: 875243 - protein, 9 aa, Homo Sapiens
HCFLEENFT

SEQ ID NO: 875244 - protein, 9 aa, Homo Sapiens
TETSVVFED

SEQ ID NO: 875245 - protein, 9 aa, Homo Sapiens
YQVMCRNAC

SEQ ID NO: 875246 - protein, 9 aa, Homo Sapiens
IESVITATL

SEQ ID NO: 875247 - protein, 9 aa, Homo Sapiens
DIVQEKHLS

SEQ ID NO: 875248 - protein, 9 aa, Homo Sapiens
LFWKSKDWP

SEQ ID NO: 875249 - protein, 9 aa, Homo Sapiens
FQLYKEFID

SEQ ID NO: 875250 - protein, 9 aa, Homo Sapiens
DKYNAIKKY

SEQ ID NO: 875251 - protein, 9 aa, Homo Sapiens
CPKDVVYPE

SEQ ID NO: 875252 - protein, 9 aa, Homo Sapiens
PVPASPMNF

SEQ ID NO: 875253 - protein, 9 aa, Homo Sapiens
NLMGLAEEP

SEQ ID NO: 875254 - protein, 9 aa, Homo Sapiens
TGTLLMDVK

SEQ ID NO: 875255 - protein, 9 aa, Homo Sapiens
AIIDFQNKQ

SEQ ID NO: 875256 - protein, 9 aa, Homo Sapiens
NHNNMVWYR

SEQ ID NO: 875257 - protein, 9 aa, Homo Sapiens
ILDYHNQVW

SEQ ID NO: 875258 - protein, 9 aa, Homo Sapiens
QKAEEVLLL

SEQ ID NO: 875259 - protein, 9 aa, Homo Sapiens
LLHSLVLRV

SEQ ID NO: 875260 - protein, 9 aa, Homo Sapiens
RKKYPSKGR

SEQ ID NO: 875261 - protein, 9 aa, Homo Sapiens
MSVQSERSG

SEQ ID NO: 875262 - protein, 9 aa, Homo Sapiens
ISCSLSQSL

SEQ ID NO: 875263 - protein, 9 aa, Homo Sapiens
FKLARQTYP

SEQ ID NO: 875264 - protein, 9 aa, Homo Sapiens
VESMKALPI

SEQ ID NO: 875265 - protein, 9 aa, Homo Sapiens
GLIKNGEQQ

SEQ ID NO: 875266 - protein, 9 aa, Homo Sapiens
ARAVYKDAN

SEQ ID NO: 875267 - protein, 9 aa, Homo Sapiens
KEFLQKEQN

SEQ ID NO: 875268 - protein, 9 aa, Homo Sapiens
HLGRAVFPG

SEQ ID NO: 875269 - protein, 9 aa, Homo Sapiens
IELIRNTLY

SEQ ID NO: 875270 - protein, 9 aa, Homo Sapiens
DNQMRMADL

SEQ ID NO: 875271 - protein, 9 aa, Homo Sapiens
KFKAKHRIA

SEQ ID NO: 875272 - protein, 9 aa, Homo Sapiens
HVISVNPND

SEQ ID NO: 875273 - protein, 9 aa, Homo Sapiens
SGAPWLQIA

SEQ ID NO: 875274 - protein, 9 aa, Homo Sapiens
GLKLCSLEN

SEQ ID NO: 875275 - protein, 9 aa, Homo Sapiens
SCILSLSWH

SEQ ID NO: 875276 - protein, 9 aa, Homo Sapiens
HACRSGFYK

SEQ ID NO: 875277 - protein, 9 aa, Homo Sapiens
HPKGGYIHL

SEQ ID NO: 875278 - protein, 9 aa, Homo Sapiens
SVLLPALRK

SEQ ID NO: 875279 - protein, 9 aa, Homo Sapiens
RSPNKERQR

SEQ ID NO: 875280 - protein, 9 aa, Homo Sapiens
RRVEPQTPW

SEQ ID NO: 875281 - protein, 9 aa, Homo Sapiens
PPYLTSTQS

SEQ ID NO: 875282 - protein, 9 aa, Homo Sapiens
HYNSDSYDS

SEQ ID NO: 875283 - protein, 9 aa, Homo Sapiens
SLISSSSGV

SEQ ID NO: 875284 - protein, 9 aa, Homo Sapiens
FVPNASHSP

SEQ ID NO: 875285 - protein, 9 aa, Homo Sapiens
FLKGFWVIL

SEQ ID NO: 875286 - protein, 9 aa, Homo Sapiens
WGEFKIIIK

SEQ ID NO: 875287 - protein, 9 aa, Homo Sapiens
NGITIPLPS

SEQ ID NO: 875288 - protein, 9 aa, Homo Sapiens
QSQPESDKY

SEQ ID NO: 875289 - protein, 9 aa, Homo Sapiens
PLLFSWFAF

SEQ ID NO: 875290 - protein, 9 aa, Homo Sapiens
PHPCILSAF

SEQ ID NO: 875291 - protein, 9 aa, Homo Sapiens
LLLQAVLWA

SEQ ID NO: 875292 - protein, 9 aa, Homo Sapiens
EEEAEGGQN

SEQ ID NO: 875293 - protein, 9 aa, Homo Sapiens
VFVERREKI

SEQ ID NO: 875294 - protein, 9 aa, Homo Sapiens
HKQAEIECK

SEQ ID NO: 875295 - protein, 9 aa, Homo Sapiens
LDALLGHAV

SEQ ID NO: 875296 - protein, 9 aa, Homo Sapiens
EKVATHAPL

SEQ ID NO: 875297 - protein, 9 aa, Homo Sapiens
MSSLSYLAA

SEQ ID NO: 875298 - protein, 9 aa, Homo Sapiens
VGFKLNAQT

SEQ ID NO: 875299 - protein, 9 aa, Homo Sapiens
QAIFKGSES

SEQ ID NO: 875300 - protein, 9 aa, Homo Sapiens
DHRTLLESS

SEQ ID NO: 875301 - protein, 9 aa, Homo Sapiens
DDYTSSELQ

SEQ ID NO: 875302 - protein, 9 aa, Homo Sapiens
NKITKIKDG

SEQ ID NO: 875303 - protein, 9 aa, Homo Sapiens
RHLFQIKHL

SEQ ID NO: 875304 - protein, 9 aa, Homo Sapiens
LQLGAVFPG

SEQ ID NO: 875305 - protein, 9 aa, Homo Sapiens
TALLGLMLY

SEQ ID NO: 875306 - protein, 9 aa, Homo Sapiens
CCMNGGSCS

SEQ ID NO: 875307 - protein, 9 aa, Homo Sapiens
GSHSQSRLP

SEQ ID NO: 875308 - protein, 9 aa, Homo Sapiens
TVAFGTGSS

SEQ ID NO: 875309 - protein, 9 aa, Homo Sapiens
IEGNVVAAA

SEQ ID NO: 875310 - protein, 9 aa, Homo Sapiens
IVMTLKQAF

SEQ ID NO: 875311 - protein, 9 aa, Homo Sapiens
HYKICKLDN

SEQ ID NO: 875312 - protein, 9 aa, Homo Sapiens
VPSPEVVQI

SEQ ID NO: 875313 - protein, 9 aa, Homo Sapiens
MVPLQILLP

SEQ ID NO: 875314 - protein, 9 aa, Homo Sapiens
ITFFRPGAA

SEQ ID NO: 875315 - protein, 9 aa, Homo Sapiens
PKNCPDDLW

SEQ ID NO: 875316 - protein, 9 aa, Homo Sapiens
EPPASAYPG

SEQ ID NO: 875317 - protein, 9 aa, Homo Sapiens
VGNWFKNRQ

SEQ ID NO: 875318 - protein, 9 aa, Homo Sapiens
DKITDPKKE

SEQ ID NO: 875319 - protein, 9 aa, Homo Sapiens
ETLKFIVGH

SEQ ID NO: 875320 - protein, 9 aa, Homo Sapiens
QHPGASTSP

SEQ ID NO: 875321 - protein, 9 aa, Homo Sapiens
GNAGGFHSR

SEQ ID NO: 875322 - protein, 9 aa, Homo Sapiens
KPPFDIGFK

SEQ ID NO: 875323 - protein, 9 aa, Homo Sapiens
VMWLGGFIH

SEQ ID NO: 875324 - protein, 9 aa, Homo Sapiens
PQDYAQIFQ

SEQ ID NO: 875325 - protein, 9 aa, Homo Sapiens
PTRVCADVT

SEQ ID NO: 875326 - protein, 9 aa, Homo Sapiens
EWMFCGFLF

SEQ ID NO: 875327 - protein, 9 aa, Homo Sapiens
HGVRVENAN

SEQ ID NO: 875328 - protein, 9 aa, Homo Sapiens
LCPMRWEHV

SEQ ID NO: 875329 - protein, 9 aa, Homo Sapiens
RTPFQIGIK

SEQ ID NO: 875330 - protein, 9 aa, Homo Sapiens
EDNSDSQDS

SEQ ID NO: 875331 - protein, 9 aa, Homo Sapiens
GRAVFPGAP

SEQ ID NO: 875332 - protein, 9 aa, Homo Sapiens
TNGSQIEIN

SEQ ID NO: 875333 - protein, 9 aa, Homo Sapiens
KEDKCQGKG

SEQ ID NO: 875334 - protein, 9 aa, Homo Sapiens
DYFTEVKVD

SEQ ID NO: 875335 - protein, 9 aa, Homo Sapiens
QQLQIRGLP

SEQ ID NO: 875336 - protein, 9 aa, Homo Sapiens
TCFNQLCLS

SEQ ID NO: 875337 - protein, 9 aa, Homo Sapiens
RDEAKHIKG

SEQ ID NO: 875338 - protein, 9 aa, Homo Sapiens
CPESLQKEA

SEQ ID NO: 875339 - protein, 9 aa, Homo Sapiens
LAATCSTIG

SEQ ID NO: 875340 - protein, 9 aa, Homo Sapiens
EPKNFIHGL

SEQ ID NO: 875341 - protein, 9 aa, Homo Sapiens
THCGQMKQK

SEQ ID NO: 875342 - protein, 9 aa, Homo Sapiens
RQHKHRPAP

SEQ ID NO: 875343 - protein, 9 aa, Homo Sapiens
VPAISDLGG

SEQ ID NO: 875344 - protein, 9 aa, Homo Sapiens
LRNGQVDIK

SEQ ID NO: 875345 - protein, 9 aa, Homo Sapiens
VECFSQEVQ

SEQ ID NO: 875346 - protein, 9 aa, Homo Sapiens
SYFLATNMI

SEQ ID NO: 875347 - protein, 9 aa, Homo Sapiens
ESDKDKSDY

SEQ ID NO: 875348 - protein, 9 aa, Homo Sapiens
EGERDLCQL

SEQ ID NO: 875349 - protein, 9 aa, Homo Sapiens
DTSNVTYNN

SEQ ID NO: 875350 - protein, 9 aa, Homo Sapiens
VYECKQCSK

SEQ ID NO: 875351 - protein, 9 aa, Homo Sapiens
LGLIDLCLT

SEQ ID NO: 875352 - protein, 9 aa, Homo Sapiens
WQDKDLPRP

SEQ ID NO: 875353 - protein, 9 aa, Homo Sapiens
PGYYESGYF

SEQ ID NO: 875354 - protein, 9 aa, Homo Sapiens
SPVEPSCKG

SEQ ID NO: 875355 - protein, 9 aa, Homo Sapiens
ECMKTEAES

SEQ ID NO: 875356 - protein, 9 aa, Homo Sapiens
YQEDIRDLL

SEQ ID NO: 875357 - protein, 9 aa, Homo Sapiens
WVSFWISQV

SEQ ID NO: 875358 - protein, 9 aa, Homo Sapiens
GILPGVYPL

SEQ ID NO: 875359 - protein, 9 aa, Homo Sapiens
YSIWTNEHL

SEQ ID NO: 875360 - protein, 9 aa, Homo Sapiens
NIKRIIKAR

SEQ ID NO: 875361 - protein, 9 aa, Homo Sapiens
IYVAHLLAA

SEQ ID NO: 875362 - protein, 9 aa, Homo Sapiens
YTQYLDKVM

SEQ ID NO: 875363 - protein, 9 aa, Homo Sapiens
IWIEIIALS

SEQ ID NO: 875364 - protein, 9 aa, Homo Sapiens
ASLQLGAVF

SEQ ID NO: 875365 - protein, 9 aa, Homo Sapiens
MYQNATGES

SEQ ID NO: 875366 - protein, 9 aa, Homo Sapiens
EALRPSNQG

SEQ ID NO: 875367 - protein, 9 aa, Homo Sapiens
RHTRSTEDD

SEQ ID NO: 875368 - protein, 9 aa, Homo Sapiens
FIKTAQPYQ

SEQ ID NO: 875369 - protein, 9 aa, Homo Sapiens
LLVAMCRTA

SEQ ID NO: 875370 - protein, 9 aa, Homo Sapiens
KNVSESLGE

SEQ ID NO: 875371 - protein, 9 aa, Homo Sapiens
KEIVDDAKV

SEQ ID NO: 875372 - protein, 9 aa, Homo Sapiens
KQCGLGARP

SEQ ID NO: 875373 - protein, 9 aa, Homo Sapiens
AEYKLNICP

SEQ ID NO: 875374 - protein, 9 aa, Homo Sapiens
TFDGKQMRK

SEQ ID NO: 875375 - protein, 9 aa, Homo Sapiens
CKTGVHDAD

SEQ ID NO: 875376 - protein, 9 aa, Homo Sapiens
LVSLLRQRT

SEQ ID NO: 875377 - protein, 9 aa, Homo Sapiens
HQAEYKLNI

SEQ ID NO: 875378 - protein, 9 aa, Homo Sapiens
SYSGDALYK

SEQ ID NO: 875379 - protein, 9 aa, Homo Sapiens
KECIEGTLA

SEQ ID NO: 875380 - protein, 9 aa, Homo Sapiens
LGSFSVILH

SEQ ID NO: 875381 - protein, 9 aa, Homo Sapiens
NQTEESPYM

SEQ ID NO: 875382 - protein, 9 aa, Homo Sapiens
YPYVQHKID

SEQ ID NO: 875383 - protein, 9 aa, Homo Sapiens
VSFRRYSCS

SEQ ID NO: 875384 - protein, 9 aa, Homo Sapiens
MGMPNNKFL

SEQ ID NO: 875385 - protein, 9 aa, Homo Sapiens
QFIGGLLAA

SEQ ID NO: 875386 - protein, 9 aa, Homo Sapiens
VFSEYLHSS

SEQ ID NO: 875387 - protein, 9 aa, Homo Sapiens
YLACTKLTE

SEQ ID NO: 875388 - protein, 9 aa, Homo Sapiens
MLQNLTMSY

SEQ ID NO: 875389 - protein, 9 aa, Homo Sapiens
NGQPVSTVW

SEQ ID NO: 875390 - protein, 9 aa, Homo Sapiens
HNEFQSLIL

SEQ ID NO: 875391 - protein, 9 aa, Homo Sapiens
VSQASLGFK

SEQ ID NO: 875392 - protein, 9 aa, Homo Sapiens
FSYKINLIV

SEQ ID NO: 875393 - protein, 9 aa, Homo Sapiens
RINMVVDDD

SEQ ID NO: 875394 - protein, 9 aa, Homo Sapiens
QLQLEGLLC

SEQ ID NO: 875395 - protein, 9 aa, Homo Sapiens
QVLNSNGLQ

SEQ ID NO: 875396 - protein, 9 aa, Homo Sapiens
GSMARKKPQ

SEQ ID NO: 875397 - protein, 9 aa, Homo Sapiens
RNLKLFWTL

SEQ ID NO: 875398 - protein, 9 aa, Homo Sapiens
LMPLTPLWT

SEQ ID NO: 875399 - protein, 9 aa, Homo Sapiens
NEQPSLLAS

SEQ ID NO: 875400 - protein, 9 aa, Homo Sapiens
NTINTFWIK

SEQ ID NO: 875401 - protein, 9 aa, Homo Sapiens
ELSSKKNQC

SEQ ID NO: 875402 - protein, 9 aa, Homo Sapiens
KKEIVDDAK

SEQ ID NO: 875403 - protein, 9 aa, Homo Sapiens
KWELICGQE

SEQ ID NO: 875404 - protein, 9 aa, Homo Sapiens
GDSTVGKSK

SEQ ID NO: 875405 - protein, 9 aa, Homo Sapiens
PLLCAALKE

SEQ ID NO: 875406 - protein, 9 aa, Homo Sapiens
ALKNGAGSL

SEQ ID NO: 875407 - protein, 9 aa, Homo Sapiens
SQGASHFDK

SEQ ID NO: 875408 - protein, 9 aa, Homo Sapiens
LSAHSSDEN

SEQ ID NO: 875409 - protein, 9 aa, Homo Sapiens
VAVVRIKCP

SEQ ID NO: 875410 - protein, 9 aa, Homo Sapiens
IPEGIQIDL

SEQ ID NO: 875411 - protein, 9 aa, Homo Sapiens
GKYHRASSE

SEQ ID NO: 875412 - protein, 9 aa, Homo Sapiens
HKLQGMGKP

SEQ ID NO: 875413 - protein, 9 aa, Homo Sapiens
NSLKEAKQQ

SEQ ID NO: 875414 - protein, 9 aa, Homo Sapiens
KINKQNLTL

SEQ ID NO: 875415 - protein, 9 aa, Homo Sapiens
TISRPIPMS

SEQ ID NO: 875416 - protein, 9 aa, Homo Sapiens
KDTMTTFEC

SEQ ID NO: 875417 - protein, 9 aa, Homo Sapiens
TSIWLLQTD

SEQ ID NO: 875418 - protein, 9 aa, Homo Sapiens
LAPEGLSNG

SEQ ID NO: 875419 - protein, 9 aa, Homo Sapiens
GMDLVDILS

SEQ ID NO: 875420 - protein, 9 aa, Homo Sapiens
EKLCEIKES

SEQ ID NO: 875421 - protein, 9 aa, Homo Sapiens
FSTVLIIPS

SEQ ID NO: 875422 - protein, 9 aa, Homo Sapiens
AFFSPCLPV

SEQ ID NO: 875423 - protein, 9 aa, Homo Sapiens
HGRPVVLKS

SEQ ID NO: 875424 - protein, 9 aa, Homo Sapiens
SEWLFLDQH

SEQ ID NO: 875425 - protein, 9 aa, Homo Sapiens
VQVCLQFLT

SEQ ID NO: 875426 - protein, 9 aa, Homo Sapiens
KAIIDFQNK

SEQ ID NO: 875427 - protein, 9 aa, Homo Sapiens
SGILTPEFC

SEQ ID NO: 875428 - protein, 9 aa, Homo Sapiens
AIELEKMKA

SEQ ID NO: 875429 - protein, 9 aa, Homo Sapiens
NLREFFSVL

SEQ ID NO: 875430 - protein, 9 aa, Homo Sapiens
NFLSLIVSI

SEQ ID NO: 875431 - protein, 9 aa, Homo Sapiens
ERDQYDEEA

SEQ ID NO: 875432 - protein, 9 aa, Homo Sapiens
FNNLFMRGF

SEQ ID NO: 875433 - protein, 9 aa, Homo Sapiens
IIYFKNMRT

SEQ ID NO: 875434 - protein, 9 aa, Homo Sapiens
PQNASQKEI

SEQ ID NO: 875435 - protein, 9 aa, Homo Sapiens
VNQKEDTWA

SEQ ID NO: 875436 - protein, 9 aa, Homo Sapiens
VLSPKTTIY

SEQ ID NO: 875437 - protein, 9 aa, Homo Sapiens
KDPEKFLNI

SEQ ID NO: 875438 - protein, 9 aa, Homo Sapiens
KVCCLTINL

SEQ ID NO: 875439 - protein, 9 aa, Homo Sapiens
MQIIFRHLR

SEQ ID NO: 875440 - protein, 9 aa, Homo Sapiens
AVGKRGVHE

SEQ ID NO: 875441 - protein, 9 aa, Homo Sapiens
ATELPLDNI

SEQ ID NO: 875442 - protein, 9 aa, Homo Sapiens
GNITVYETT

SEQ ID NO: 875443 - protein, 9 aa, Homo Sapiens
NSINTLRRT

SEQ ID NO: 875444 - protein, 9 aa, Homo Sapiens
NSSFHHQIN

SEQ ID NO: 875445 - protein, 9 aa, Homo Sapiens
KTKQVITFL

SEQ ID NO: 875446 - protein, 9 aa, Homo Sapiens
SDAECKAHE

SEQ ID NO: 875447 - protein, 9 aa, Homo Sapiens
NAPAFAQPK

SEQ ID NO: 875448 - protein, 9 aa, Homo Sapiens
SLMLYHKHL

SEQ ID NO: 875449 - protein, 9 aa, Homo Sapiens
CCKKVEQDA

SEQ ID NO: 875450 - protein, 9 aa, Homo Sapiens
FQYAVEILT

SEQ ID NO: 875451 - protein, 9 aa, Homo Sapiens
PRFCHQEHK

SEQ ID NO: 875452 - protein, 9 aa, Homo Sapiens
SRDAGPSGR

SEQ ID NO: 875453 - protein, 9 aa, Homo Sapiens
GFGIQIQWD

SEQ ID NO: 875454 - protein, 9 aa, Homo Sapiens
TASAAGSSS

SEQ ID NO: 875455 - protein, 9 aa, Homo Sapiens
SFSLAPFIS

SEQ ID NO: 875456 - protein, 9 aa, Homo Sapiens
NAVLRLIFN

SEQ ID NO: 875457 - protein, 9 aa, Homo Sapiens
RQHAARRLD

SEQ ID NO: 875458 - protein, 9 aa, Homo Sapiens
RSVNGAKIT

SEQ ID NO: 875459 - protein, 9 aa, Homo Sapiens
LRWLQNWQK

SEQ ID NO: 875460 - protein, 9 aa, Homo Sapiens
AKLNTAPDG

SEQ ID NO: 875461 - protein, 9 aa, Homo Sapiens
GSDNPSKNH

SEQ ID NO: 875462 - protein, 9 aa, Homo Sapiens
RRRSRSPRI

SEQ ID NO: 875463 - protein, 9 aa, Homo Sapiens
AVHLFCNYE

SEQ ID NO: 875464 - protein, 9 aa, Homo Sapiens
NSTQLPVAY

SEQ ID NO: 875465 - protein, 9 aa, Homo Sapiens
AAKNLMNVV

SEQ ID NO: 875466 - protein, 9 aa, Homo Sapiens
SEDKKDKMK

SEQ ID NO: 875467 - protein, 9 aa, Homo Sapiens
WWSFDKCQE

SEQ ID NO: 875468 - protein, 9 aa, Homo Sapiens
EGCFFRRKQ

SEQ ID NO: 875469 - protein, 9 aa, Homo Sapiens
ITQFTSQFL

SEQ ID NO: 875470 - protein, 9 aa, Homo Sapiens
AAAAPAFLK

SEQ ID NO: 875471 - protein, 9 aa, Homo Sapiens
TCHFSCGNG

SEQ ID NO: 875472 - protein, 9 aa, Homo Sapiens
DECTEAEGH

SEQ ID NO: 875473 - protein, 9 aa, Homo Sapiens
LIIHKIIHT

SEQ ID NO: 875474 - protein, 9 aa, Homo Sapiens
WIMLLERTL

SEQ ID NO: 875475 - protein, 9 aa, Homo Sapiens
MYIRPTSDC

SEQ ID NO: 875476 - protein, 9 aa, Homo Sapiens
PYRLCQFHL

SEQ ID NO: 875477 - protein, 9 aa, Homo Sapiens
EQNLKAEIE

SEQ ID NO: 875478 - protein, 9 aa, Homo Sapiens
AKHGIEYQD

SEQ ID NO: 875479 - protein, 9 aa, Homo Sapiens
EQNDSISSK

SEQ ID NO: 875480 - protein, 9 aa, Homo Sapiens
ATGVNTKIG

SEQ ID NO: 875481 - protein, 9 aa, Homo Sapiens
QKYFDVCAD

SEQ ID NO: 875482 - protein, 9 aa, Homo Sapiens
SISFQHPVN

SEQ ID NO: 875483 - protein, 9 aa, Homo Sapiens
DEDKQLLYD

SEQ ID NO: 875484 - protein, 9 aa, Homo Sapiens
QEGCANLLD

SEQ ID NO: 875485 - protein, 9 aa, Homo Sapiens
VPKEVVDCI

SEQ ID NO: 875486 - protein, 9 aa, Homo Sapiens
LGSEQLFED

SEQ ID NO: 875487 - protein, 9 aa, Homo Sapiens
LGNGITIPL

SEQ ID NO: 875488 - protein, 9 aa, Homo Sapiens
SFCLMNYFS

SEQ ID NO: 875489 - protein, 9 aa, Homo Sapiens
HVTLRCHYC

SEQ ID NO: 875490 - protein, 9 aa, Homo Sapiens
PCMFMYARP

SEQ ID NO: 875491 - protein, 9 aa, Homo Sapiens
QKESEEVFD

SEQ ID NO: 875492 - protein, 9 aa, Homo Sapiens
KEIRRKFEE

SEQ ID NO: 875493 - protein, 9 aa, Homo Sapiens
PPKAWHKDI

SEQ ID NO: 875494 - protein, 9 aa, Homo Sapiens
AEDIKQFLL

SEQ ID NO: 875495 - protein, 9 aa, Homo Sapiens
AIWLYLGYV

SEQ ID NO: 875496 - protein, 9 aa, Homo Sapiens
RDVSPTSCD

SEQ ID NO: 875497 - protein, 9 aa, Homo Sapiens
CRIVALDLQ

SEQ ID NO: 875498 - protein, 9 aa, Homo Sapiens
AAFKPSFIH

SEQ ID NO: 875499 - protein, 9 aa, Homo Sapiens
DALHISQNF

SEQ ID NO: 875500 - protein, 9 aa, Homo Sapiens
QRVCKNHRS

SEQ ID NO: 875501 - protein, 9 aa, Homo Sapiens
FLRRDTERI

SEQ ID NO: 875502 - protein, 9 aa, Homo Sapiens
NQTSLMALA

SEQ ID NO: 875503 - protein, 9 aa, Homo Sapiens
YLEKTANKG

SEQ ID NO: 875504 - protein, 9 aa, Homo Sapiens
WAATEILLC

SEQ ID NO: 875505 - protein, 9 aa, Homo Sapiens
YLGEIVRTI

SEQ ID NO: 875506 - protein, 9 aa, Homo Sapiens
MSQFPKVWI

SEQ ID NO: 875507 - protein, 9 aa, Homo Sapiens
NLSGMLQER

SEQ ID NO: 875508 - protein, 9 aa, Homo Sapiens
RRLLLDGDQ

SEQ ID NO: 875509 - protein, 9 aa, Homo Sapiens
ILPGVYPLA

SEQ ID NO: 875510 - protein, 9 aa, Homo Sapiens
SGCGKVYGT

SEQ ID NO: 875511 - protein, 9 aa, Homo Sapiens
PRSRSLSDL

SEQ ID NO: 875512 - protein, 9 aa, Homo Sapiens
LQPVTVYVL

SEQ ID NO: 875513 - protein, 9 aa, Homo Sapiens
EEDSHWEQD

SEQ ID NO: 875514 - protein, 9 aa, Homo Sapiens
INLKDYKCI

SEQ ID NO: 875515 - protein, 9 aa, Homo Sapiens
IPDSQKLLQ

SEQ ID NO: 875516 - protein, 9 aa, Homo Sapiens
GYDKIVGLR

SEQ ID NO: 875517 - protein, 9 aa, Homo Sapiens
PGGKGKCLP

SEQ ID NO: 875518 - protein, 9 aa, Homo Sapiens
TKNNKEEAA

SEQ ID NO: 875519 - protein, 9 aa, Homo Sapiens
QLAVVDGGQ

SEQ ID NO: 875520 - protein, 9 aa, Homo Sapiens
PANRPSFAE

SEQ ID NO: 875521 - protein, 9 aa, Homo Sapiens
LERNPINVI

SEQ ID NO: 875522 - protein, 9 aa, Homo Sapiens
FQENPLWTS

SEQ ID NO: 875523 - protein, 9 aa, Homo Sapiens
FKFMHETHD

SEQ ID NO: 875524 - protein, 9 aa, Homo Sapiens
YKEPTLALK

SEQ ID NO: 875525 - protein, 9 aa, Homo Sapiens
SFLLVFWTP

SEQ ID NO: 875526 - protein, 9 aa, Homo Sapiens
PQPEASGLW

SEQ ID NO: 875527 - protein, 9 aa, Homo Sapiens
FNITIMILI

SEQ ID NO: 875528 - protein, 9 aa, Homo Sapiens
GAKLNDFAV

SEQ ID NO: 875529 - protein, 9 aa, Homo Sapiens
HAPERLGKA

SEQ ID NO: 875530 - protein, 9 aa, Homo Sapiens
VVKQCSAGC

SEQ ID NO: 875531 - protein, 9 aa, Homo Sapiens
LVPVEDDAN

SEQ ID NO: 875532 - protein, 9 aa, Homo Sapiens
TDIFLCYII

SEQ ID NO: 875533 - protein, 9 aa, Homo Sapiens
PVCEAFKVS

SEQ ID NO: 875534 - protein, 9 aa, Homo Sapiens
NPSAGAFCK

SEQ ID NO: 875535 - protein, 9 aa, Homo Sapiens
HYITRHIMK

SEQ ID NO: 875536 - protein, 9 aa, Homo Sapiens
LFVDDFEEL

SEQ ID NO: 875537 - protein, 9 aa, Homo Sapiens
IRWIGSDIS

SEQ ID NO: 875538 - protein, 9 aa, Homo Sapiens
RQLGPVLRF

SEQ ID NO: 875539 - protein, 9 aa, Homo Sapiens
NNKIIKPAK

SEQ ID NO: 875540 - protein, 9 aa, Homo Sapiens
SSSYSSSSS

SEQ ID NO: 875541 - protein, 9 aa, Homo Sapiens
ETEVELYNK

SEQ ID NO: 875542 - protein, 9 aa, Homo Sapiens
RFVCDKHYY

SEQ ID NO: 875543 - protein, 9 aa, Homo Sapiens
RELDALGHK

SEQ ID NO: 875544 - protein, 9 aa, Homo Sapiens
PGKNKAQYE

SEQ ID NO: 875545 - protein, 9 aa, Homo Sapiens
SDCLHGNKS

SEQ ID NO: 875546 - protein, 9 aa, Homo Sapiens
IKQEQISYT

SEQ ID NO: 875547 - protein, 9 aa, Homo Sapiens
QIRYRFRRF

SEQ ID NO: 875548 - protein, 9 aa, Homo Sapiens
TLSQRFIPE

SEQ ID NO: 875549 - protein, 9 aa, Homo Sapiens
KQIQSVLNK

SEQ ID NO: 875550 - protein, 9 aa, Homo Sapiens
VEKQLMKEK

SEQ ID NO: 875551 - protein, 9 aa, Homo Sapiens
GFSQSLHLQ

SEQ ID NO: 875552 - protein, 9 aa, Homo Sapiens
RRQQKEKRK

SEQ ID NO: 875553 - protein, 9 aa, Homo Sapiens
NVTYNNWHG

SEQ ID NO: 875554 - protein, 9 aa, Homo Sapiens
VISVNPNDQ

SEQ ID NO: 875555 - protein, 9 aa, Homo Sapiens
KGAKIEVDE

SEQ ID NO: 875556 - protein, 9 aa, Homo Sapiens
EQFCQEMIA

SEQ ID NO: 875557 - protein, 9 aa, Homo Sapiens
LSLMASLAA

SEQ ID NO: 875558 - protein, 9 aa, Homo Sapiens
MRNLKLFWT

SEQ ID NO: 875559 - protein, 9 aa, Homo Sapiens
AITLHKAGR

SEQ ID NO: 875560 - protein, 9 aa, Homo Sapiens
KTLKKYLEE

SEQ ID NO: 875561 - protein, 9 aa, Homo Sapiens
DFSAGVANC

SEQ ID NO: 875562 - protein, 9 aa, Homo Sapiens
CKLDENNTP

SEQ ID NO: 875563 - protein, 9 aa, Homo Sapiens
PKHQLSQYF

SEQ ID NO: 875564 - protein, 9 aa, Homo Sapiens
EVNYSPRAA

SEQ ID NO: 875565 - protein, 9 aa, Homo Sapiens
LTEGCFFRR

SEQ ID NO: 875566 - protein, 9 aa, Homo Sapiens
AVVVGITWI

SEQ ID NO: 875567 - protein, 9 aa, Homo Sapiens
DLRTQFRTQ

SEQ ID NO: 875568 - protein, 9 aa, Homo Sapiens
KLNNLNTLL

SEQ ID NO: 875569 - protein, 9 aa, Homo Sapiens
TINYAGLGP

SEQ ID NO: 875570 - protein, 9 aa, Homo Sapiens
EHLSLMMDK

SEQ ID NO: 875571 - protein, 9 aa, Homo Sapiens
LDQDGRTSF

SEQ ID NO: 875572 - protein, 9 aa, Homo Sapiens
DPGFSGKLC

SEQ ID NO: 875573 - protein, 9 aa, Homo Sapiens
KAFETLIIN

SEQ ID NO: 875574 - protein, 9 aa, Homo Sapiens
WIGWVCQMP

SEQ ID NO: 875575 - protein, 9 aa, Homo Sapiens
VVYVDPRKY

SEQ ID NO: 875576 - protein, 9 aa, Homo Sapiens
NELKNMWKF

SEQ ID NO: 875577 - protein, 9 aa, Homo Sapiens
SVITATLAN

SEQ ID NO: 875578 - protein, 9 aa, Homo Sapiens
RSVTGIPRE

SEQ ID NO: 875579 - protein, 9 aa, Homo Sapiens
SSHIFQDLQ

SEQ ID NO: 875580 - protein, 9 aa, Homo Sapiens
TKMAFICAA

SEQ ID NO: 875581 - protein, 9 aa, Homo Sapiens
KICEQEKKE

SEQ ID NO: 875582 - protein, 9 aa, Homo Sapiens
DILRSQSMN

SEQ ID NO: 875583 - protein, 9 aa, Homo Sapiens
QILNPYNLF

SEQ ID NO: 875584 - protein, 9 aa, Homo Sapiens
SSPHLRLAS

SEQ ID NO: 875585 - protein, 9 aa, Homo Sapiens
AFYKINTLY

SEQ ID NO: 875586 - protein, 9 aa, Homo Sapiens
MLELIANLP

SEQ ID NO: 875587 - protein, 9 aa, Homo Sapiens
AQQSAGGRG

SEQ ID NO: 875588 - protein, 9 aa, Homo Sapiens
LQGQTANKD

SEQ ID NO: 875589 - protein, 9 aa, Homo Sapiens
VSYLNIVLS

SEQ ID NO: 875590 - protein, 9 aa, Homo Sapiens
NSQTKLQDK

SEQ ID NO: 875591 - protein, 9 aa, Homo Sapiens
WLLLYRNNF

SEQ ID NO: 875592 - protein, 9 aa, Homo Sapiens
KINDEEIKS

SEQ ID NO: 875593 - protein, 9 aa, Homo Sapiens
HIMENYCLM

SEQ ID NO: 875594 - protein, 9 aa, Homo Sapiens
SRPTKQEVK

SEQ ID NO: 875595 - protein, 9 aa, Homo Sapiens
SRGEKTTVA

SEQ ID NO: 875596 - protein, 9 aa, Homo Sapiens
TNVIAQAVP

SEQ ID NO: 875597 - protein, 9 aa, Homo Sapiens
TIGPPAVEA

SEQ ID NO: 875598 - protein, 9 aa, Homo Sapiens
QNSFRDQVR

SEQ ID NO: 875599 - protein, 9 aa, Homo Sapiens
MEEKTILLC

SEQ ID NO: 875600 - protein, 9 aa, Homo Sapiens
PASCRRPGV

SEQ ID NO: 875601 - protein, 9 aa, Homo Sapiens
VINHVISVN

SEQ ID NO: 875602 - protein, 9 aa, Homo Sapiens
MSIDKFWDR

SEQ ID NO: 875603 - protein, 9 aa, Homo Sapiens
MSLLVDGNM

SEQ ID NO: 875604 - protein, 9 aa, Homo Sapiens
VPLSPMLYS

SEQ ID NO: 875605 - protein, 9 aa, Homo Sapiens
SNSQVQFTG

SEQ ID NO: 875606 - protein, 9 aa, Homo Sapiens
VLVVFLEKA

SEQ ID NO: 875607 - protein, 9 aa, Homo Sapiens
PMGHRPQTC

SEQ ID NO: 875608 - protein, 9 aa, Homo Sapiens
YACKECGKC

SEQ ID NO: 875609 - protein, 9 aa, Homo Sapiens
TLKSHLQIH

SEQ ID NO: 875610 - protein, 9 aa, Homo Sapiens
AAITNIAKY

SEQ ID NO: 875611 - protein, 9 aa, Homo Sapiens
NKHSSRSHC

SEQ ID NO: 875612 - protein, 9 aa, Homo Sapiens
SLQLNQSVH

SEQ ID NO: 875613 - protein, 9 aa, Homo Sapiens
QTRIWFMLE

SEQ ID NO: 875614 - protein, 9 aa, Homo Sapiens
GFYVFYILI

SEQ ID NO: 875615 - protein, 9 aa, Homo Sapiens
RVKPGFPKA

SEQ ID NO: 875616 - protein, 9 aa, Homo Sapiens
LWDHSTLLK

SEQ ID NO: 875617 - protein, 9 aa, Homo Sapiens
VSMAKPHMV

SEQ ID NO: 875618 - protein, 9 aa, Homo Sapiens
EFRRFSLEI

SEQ ID NO: 875619 - protein, 9 aa, Homo Sapiens
ANGKNIGKF

SEQ ID NO: 875620 - protein, 9 aa, Homo Sapiens
ETLELLYII

SEQ ID NO: 875621 - protein, 9 aa, Homo Sapiens
VQLIPQTTA

SEQ ID NO: 875622 - protein, 9 aa, Homo Sapiens
VSADRNFIK

SEQ ID NO: 875623 - protein, 9 aa, Homo Sapiens
FICRSTLSQ

SEQ ID NO: 875624 - protein, 9 aa, Homo Sapiens
SQPIDLGAM

SEQ ID NO: 875625 - protein, 9 aa, Homo Sapiens
PFAKLNTAP

SEQ ID NO: 875626 - protein, 9 aa, Homo Sapiens
AVYPVQSAY

SEQ ID NO: 875627 - protein, 9 aa, Homo Sapiens
TYNNWHGGQ

SEQ ID NO: 875628 - protein, 9 aa, Homo Sapiens
RGYHHGRPQ

SEQ ID NO: 875629 - protein, 9 aa, Homo Sapiens
TVKNLLKHC

SEQ ID NO: 875630 - protein, 9 aa, Homo Sapiens
LPLLCAALK

SEQ ID NO: 875631 - protein, 9 aa, Homo Sapiens
KKARALKQI

SEQ ID NO: 875632 - protein, 9 aa, Homo Sapiens
DNLVIHAPP

SEQ ID NO: 875633 - protein, 9 aa, Homo Sapiens
KTPSPNKHS

SEQ ID NO: 875634 - protein, 9 aa, Homo Sapiens
LEGFKGKNC

SEQ ID NO: 875635 - protein, 9 aa, Homo Sapiens
LNNYLSEAT

SEQ ID NO: 875636 - protein, 9 aa, Homo Sapiens
IQNTRNHFE

SEQ ID NO: 875637 - protein, 9 aa, Homo Sapiens
GNRYYIDHV

SEQ ID NO: 875638 - protein, 9 aa, Homo Sapiens
KQGCTVADK

SEQ ID NO: 875639 - protein, 9 aa, Homo Sapiens
PQTPPEAIA

SEQ ID NO: 875640 - protein, 9 aa, Homo Sapiens
DFMGAMPFG

SEQ ID NO: 875641 - protein, 9 aa, Homo Sapiens
HKVAQAKHK

SEQ ID NO: 875642 - protein, 9 aa, Homo Sapiens
KVIFKNSQG

SEQ ID NO: 875643 - protein, 9 aa, Homo Sapiens
PATIFEPVY

SEQ ID NO: 875644 - protein, 9 aa, Homo Sapiens
SFQTHEMIH

SEQ ID NO: 875645 - protein, 9 aa, Homo Sapiens
SRWARLNLN

SEQ ID NO: 875646 - protein, 9 aa, Homo Sapiens
KPLPSADTV

SEQ ID NO: 875647 - protein, 9 aa, Homo Sapiens
WNFRGQKRK

SEQ ID NO: 875648 - protein, 9 aa, Homo Sapiens
LPTAQPLLG

SEQ ID NO: 875649 - protein, 9 aa, Homo Sapiens
KTILRLKLE

SEQ ID NO: 875650 - protein, 9 aa, Homo Sapiens
IFHLTIIPP

SEQ ID NO: 875651 - protein, 9 aa, Homo Sapiens
RYDPSISVS

SEQ ID NO: 875652 - protein, 9 aa, Homo Sapiens
LGILFRGQQ

SEQ ID NO: 875653 - protein, 9 aa, Homo Sapiens
SRLPEQITK

SEQ ID NO: 875654 - protein, 9 aa, Homo Sapiens
AKKRKRDNN

SEQ ID NO: 875655 - protein, 9 aa, Homo Sapiens
IKNKIEDAS

SEQ ID NO: 875656 - protein, 9 aa, Homo Sapiens
INASYIMDY

SEQ ID NO: 875657 - protein, 9 aa, Homo Sapiens
QLEGGLVLP

SEQ ID NO: 875658 - protein, 9 aa, Homo Sapiens
KYYMLISLV

SEQ ID NO: 875659 - protein, 9 aa, Homo Sapiens
ISSLNELNP

SEQ ID NO: 875660 - protein, 9 aa, Homo Sapiens
DRSATKMSG

SEQ ID NO: 875661 - protein, 9 aa, Homo Sapiens
DCILCDTSE

SEQ ID NO: 875662 - protein, 9 aa, Homo Sapiens
LFQCNICGK

SEQ ID NO: 875663 - protein, 9 aa, Homo Sapiens
QLKDTKRNS

SEQ ID NO: 875664 - protein, 9 aa, Homo Sapiens
DCSQGLRIF

SEQ ID NO: 875665 - protein, 9 aa, Homo Sapiens
ANLFQILLE

SEQ ID NO: 875666 - protein, 9 aa, Homo Sapiens
RLALEELQS

SEQ ID NO: 875667 - protein, 9 aa, Homo Sapiens
ETDFLIDIN

SEQ ID NO: 875668 - protein, 9 aa, Homo Sapiens
IIPQIAHDI

SEQ ID NO: 875669 - protein, 9 aa, Homo Sapiens
AAPVATGSV

SEQ ID NO: 875670 - protein, 9 aa, Homo Sapiens
RKQIRYRFR

SEQ ID NO: 875671 - protein, 9 aa, Homo Sapiens
IQKHTGSGI

SEQ ID NO: 875672 - protein, 9 aa, Homo Sapiens
EWKQKHHYD

SEQ ID NO: 875673 - protein, 9 aa, Homo Sapiens
FDLAVNKTP

SEQ ID NO: 875674 - protein, 9 aa, Homo Sapiens
VELVCCPLA

SEQ ID NO: 875675 - protein, 9 aa, Homo Sapiens
NPKRNDLRQ

SEQ ID NO: 875676 - protein, 9 aa, Homo Sapiens
WREKQQLLD

SEQ ID NO: 875677 - protein, 9 aa, Homo Sapiens
SDLDCKRRE

SEQ ID NO: 875678 - protein, 9 aa, Homo Sapiens
AAYFFWLKS

SEQ ID NO: 875679 - protein, 9 aa, Homo Sapiens
LDNSCRKYL

SEQ ID NO: 875680 - protein, 9 aa, Homo Sapiens
MDNCSAAST

SEQ ID NO: 875681 - protein, 9 aa, Homo Sapiens
GMFIMVVCM

SEQ ID NO: 875682 - protein, 9 aa, Homo Sapiens
SDRMSTKNA

SEQ ID NO: 875683 - protein, 9 aa, Homo Sapiens
SSSPCCGGA

SEQ ID NO: 875684 - protein, 9 aa, Homo Sapiens
GEVRLGDTM

SEQ ID NO: 875685 - protein, 9 aa, Homo Sapiens
KKNYFSLSS

SEQ ID NO: 875686 - protein, 9 aa, Homo Sapiens
LGGSMVLLG

SEQ ID NO: 875687 - protein, 9 aa, Homo Sapiens
VWILRLKER

SEQ ID NO: 875688 - protein, 9 aa, Homo Sapiens
FPTDGGPFA

SEQ ID NO: 875689 - protein, 9 aa, Homo Sapiens
YQCFDRINW

SEQ ID NO: 875690 - protein, 9 aa, Homo Sapiens
NWIFHLTII

SEQ ID NO: 875691 - protein, 9 aa, Homo Sapiens
QQEEQKQQQ

SEQ ID NO: 875692 - protein, 9 aa, Homo Sapiens
VRLCHNPKL

SEQ ID NO: 875693 - protein, 9 aa, Homo Sapiens
RVMIGHISK

SEQ ID NO: 875694 - protein, 9 aa, Homo Sapiens
ENQLLTLPV

SEQ ID NO: 875695 - protein, 9 aa, Homo Sapiens
SYERLWPIH

SEQ ID NO: 875696 - protein, 9 aa, Homo Sapiens
DTYDTLHMQ

SEQ ID NO: 875697 - protein, 9 aa, Homo Sapiens
THKQVFLQP

SEQ ID NO: 875698 - protein, 9 aa, Homo Sapiens
VQDRNELKN

SEQ ID NO: 875699 - protein, 9 aa, Homo Sapiens
RKYKHQSHS

SEQ ID NO: 875700 - protein, 9 aa, Homo Sapiens
VDFASELTA

SEQ ID NO: 875701 - protein, 9 aa, Homo Sapiens
VYSTRLVNP

SEQ ID NO: 875702 - protein, 9 aa, Homo Sapiens
HPTLASQSI

SEQ ID NO: 875703 - protein, 9 aa, Homo Sapiens
WTFVSKHAV

SEQ ID NO: 875704 - protein, 9 aa, Homo Sapiens
KFGADDTNE

SEQ ID NO: 875705 - protein, 9 aa, Homo Sapiens
PPPDQKARS

SEQ ID NO: 875706 - protein, 9 aa, Homo Sapiens
PSPIKKEDS

SEQ ID NO: 875707 - protein, 9 aa, Homo Sapiens
KTNQCKECP

SEQ ID NO: 875708 - protein, 9 aa, Homo Sapiens
LDGFYNSHS

SEQ ID NO: 875709 - protein, 9 aa, Homo Sapiens
KHLQGLTRF

SEQ ID NO: 875710 - protein, 9 aa, Homo Sapiens
HGMEDEDIP

SEQ ID NO: 875711 - protein, 9 aa, Homo Sapiens
QKQLAAEVT

SEQ ID NO: 875712 - protein, 9 aa, Homo Sapiens
QKGEKPCAL

SEQ ID NO: 875713 - protein, 9 aa, Homo Sapiens
LLKRHEKSH

SEQ ID NO: 875714 - protein, 9 aa, Homo Sapiens
SEDPNNCLI

SEQ ID NO: 875715 - protein, 9 aa, Homo Sapiens
FVHPLNINP

SEQ ID NO: 875716 - protein, 9 aa, Homo Sapiens
FKILVATYI

SEQ ID NO: 875717 - protein, 9 aa, Homo Sapiens
RHQRQSGVV

SEQ ID NO: 875718 - protein, 9 aa, Homo Sapiens
TARFYPLQM

SEQ ID NO: 875719 - protein, 9 aa, Homo Sapiens
VMFGCNMES

SEQ ID NO: 875720 - protein, 9 aa, Homo Sapiens
RNFLQSHMI

SEQ ID NO: 875721 - protein, 9 aa, Homo Sapiens
SPRTPMLWS

SEQ ID NO: 875722 - protein, 9 aa, Homo Sapiens
CLVTISVDG

SEQ ID NO: 875723 - protein, 9 aa, Homo Sapiens
GGQDPVQLI

SEQ ID NO: 875724 - protein, 9 aa, Homo Sapiens
DLHHCFYRG

SEQ ID NO: 875725 - protein, 9 aa, Homo Sapiens
VEPGIICLS

SEQ ID NO: 875726 - protein, 9 aa, Homo Sapiens
SLQKRSVRD

SEQ ID NO: 875727 - protein, 9 aa, Homo Sapiens
GHLLACLQC

SEQ ID NO: 875728 - protein, 9 aa, Homo Sapiens
LIKKMIAKF

SEQ ID NO: 875729 - protein, 9 aa, Homo Sapiens
EVNVEMDAT

SEQ ID NO: 875730 - protein, 9 aa, Homo Sapiens
TENQCLKQL

SEQ ID NO: 875731 - protein, 9 aa, Homo Sapiens
VFPGAPGEG

SEQ ID NO: 875732 - protein, 9 aa, Homo Sapiens
YSASEDSSF

SEQ ID NO: 875733 - protein, 9 aa, Homo Sapiens
QSAKPKPAN

SEQ ID NO: 875734 - protein, 9 aa, Homo Sapiens
YLLANSGLQ

SEQ ID NO: 875735 - protein, 9 aa, Homo Sapiens
YVRVPNFND

SEQ ID NO: 875736 - protein, 9 aa, Homo Sapiens
LKDSQWDSA

SEQ ID NO: 875737 - protein, 9 aa, Homo Sapiens
NSVSPVLPQ

SEQ ID NO: 875738 - protein, 9 aa, Homo Sapiens
EELCRLSGL

SEQ ID NO: 875739 - protein, 9 aa, Homo Sapiens
VHSTEVANG

SEQ ID NO: 875740 - protein, 9 aa, Homo Sapiens
NSFVNDIFK

SEQ ID NO: 875741 - protein, 9 aa, Homo Sapiens
SRYDNLVSR

SEQ ID NO: 875742 - protein, 9 aa, Homo Sapiens
EEEGVPDKE

SEQ ID NO: 875743 - protein, 9 aa, Homo Sapiens
EGHGSHKLF

SEQ ID NO: 875744 - protein, 9 aa, Homo Sapiens
SKKELNDIQ

SEQ ID NO: 875745 - protein, 9 aa, Homo Sapiens
LKYLIDPKD

SEQ ID NO: 875746 - protein, 9 aa, Homo Sapiens
YLILSAASI

SEQ ID NO: 875747 - protein, 9 aa, Homo Sapiens
NKCKIKNIL

SEQ ID NO: 875748 - protein, 9 aa, Homo Sapiens
KINQLQPKE

SEQ ID NO: 875749 - protein, 9 aa, Homo Sapiens
ETATDLSAH

SEQ ID NO: 875750 - protein, 9 aa, Homo Sapiens
ADSTGSPIQ

SEQ ID NO: 875751 - protein, 9 aa, Homo Sapiens
PKNIDVGNK

SEQ ID NO: 875752 - protein, 9 aa, Homo Sapiens
FCSITTPKM

SEQ ID NO: 875753 - protein, 9 aa, Homo Sapiens
VWEPNDPSL

SEQ ID NO: 875754 - protein, 9 aa, Homo Sapiens
ITNIAKYQE

SEQ ID NO: 875755 - protein, 9 aa, Homo Sapiens
EGIQIDLRC

SEQ ID NO: 875756 - protein, 9 aa, Homo Sapiens
DFSAIYLAC

SEQ ID NO: 875757 - protein, 9 aa, Homo Sapiens
ASTPPKAWH

SEQ ID NO: 875758 - protein, 9 aa, Homo Sapiens
MNVVVLTVK

SEQ ID NO: 875759 - protein, 9 aa, Homo Sapiens
SLNKSADDF

SEQ ID NO: 875760 - protein, 9 aa, Homo Sapiens
GDHGIIQTL

SEQ ID NO: 875761 - protein, 9 aa, Homo Sapiens
SRHPCITNT

SEQ ID NO: 875762 - protein, 9 aa, Homo Sapiens
WNLISSVAV

SEQ ID NO: 875763 - protein, 9 aa, Homo Sapiens
TNEVKNKPA

SEQ ID NO: 875764 - protein, 9 aa, Homo Sapiens
HLMVFTIFF

SEQ ID NO: 875765 - protein, 9 aa, Homo Sapiens
RNPLTLFRG

SEQ ID NO: 875766 - protein, 9 aa, Homo Sapiens
GVPENCNKA

SEQ ID NO: 875767 - protein, 9 aa, Homo Sapiens
YSLYTDKVV

SEQ ID NO: 875768 - protein, 9 aa, Homo Sapiens
HLESQLRAL

SEQ ID NO: 875769 - protein, 9 aa, Homo Sapiens
VLCHPSTPL

SEQ ID NO: 875770 - protein, 9 aa, Homo Sapiens
WMDTHPKYL

SEQ ID NO: 875771 - protein, 9 aa, Homo Sapiens
DVWVAFNIM

SEQ ID NO: 875772 - protein, 9 aa, Homo Sapiens
HHTTANNKK

SEQ ID NO: 875773 - protein, 9 aa, Homo Sapiens
SAANQKTLY

SEQ ID NO: 875774 - protein, 9 aa, Homo Sapiens
VGKYINCDV

SEQ ID NO: 875775 - protein, 9 aa, Homo Sapiens
RLKQFISHK

SEQ ID NO: 875776 - protein, 9 aa, Homo Sapiens
PAGSTKNWN

SEQ ID NO: 875777 - protein, 9 aa, Homo Sapiens
NYFIEKENY

SEQ ID NO: 875778 - protein, 9 aa, Homo Sapiens
RQLEDRNTL

SEQ ID NO: 875779 - protein, 9 aa, Homo Sapiens
ICYERECKL

SEQ ID NO: 875780 - protein, 9 aa, Homo Sapiens
KDQEGGEEN

SEQ ID NO: 875781 - protein, 9 aa, Homo Sapiens
QWDFLPQFL

SEQ ID NO: 875782 - protein, 9 aa, Homo Sapiens
PLAPPAEDR

SEQ ID NO: 875783 - protein, 9 aa, Homo Sapiens
AVEVWWSFD

SEQ ID NO: 875784 - protein, 9 aa, Homo Sapiens
GKLCICCLL

SEQ ID NO: 875785 - protein, 9 aa, Homo Sapiens
KQAIFKGSE

SEQ ID NO: 875786 - protein, 9 aa, Homo Sapiens
RSFKHILFQ

SEQ ID NO: 875787 - protein, 9 aa, Homo Sapiens
GEGRKKAFS

SEQ ID NO: 875788 - protein, 9 aa, Homo Sapiens
QPKLGNIAN

SEQ ID NO: 875789 - protein, 9 aa, Homo Sapiens
SNVTYNNWH

SEQ ID NO: 875790 - protein, 9 aa, Homo Sapiens
RQSHFQAGV

SEQ ID NO: 875791 - protein, 9 aa, Homo Sapiens
TELFTTTMR

SEQ ID NO: 875792 - protein, 9 aa, Homo Sapiens
VTTKYFKKQ

SEQ ID NO: 875793 - protein, 9 aa, Homo Sapiens
LHKCQVTNF

SEQ ID NO: 875794 - protein, 9 aa, Homo Sapiens
RTKQLQERI

SEQ ID NO: 875795 - protein, 9 aa, Homo Sapiens
RCLKKAIDI

SEQ ID NO: 875796 - protein, 9 aa, Homo Sapiens
KTDNGKDKE

SEQ ID NO: 875797 - protein, 9 aa, Homo Sapiens
LQRTWNNLC

SEQ ID NO: 875798 - protein, 9 aa, Homo Sapiens
DEIIRVVIS

SEQ ID NO: 875799 - protein, 9 aa, Homo Sapiens
KKQHDTFDI

SEQ ID NO: 875800 - protein, 9 aa, Homo Sapiens
SMPTFSPGP

SEQ ID NO: 875801 - protein, 9 aa, Homo Sapiens
ILYDHENAS

SEQ ID NO: 875802 - protein, 9 aa, Homo Sapiens
DLQAKEEGE

SEQ ID NO: 875803 - protein, 9 aa, Homo Sapiens
EYYNPATDK

SEQ ID NO: 875804 - protein, 9 aa, Homo Sapiens
MQKHFLPHN

SEQ ID NO: 875805 - protein, 9 aa, Homo Sapiens
VITGNCDGF

SEQ ID NO: 875806 - protein, 9 aa, Homo Sapiens
GKPFKAKCK

SEQ ID NO: 875807 - protein, 9 aa, Homo Sapiens
KNLEHHLNE

SEQ ID NO: 875808 - protein, 9 aa, Homo Sapiens
HFRALSTGE

SEQ ID NO: 875809 - protein, 9 aa, Homo Sapiens
CLKIFLNDS

SEQ ID NO: 875810 - protein, 9 aa, Homo Sapiens
LASLQQGCW

SEQ ID NO: 875811 - protein, 9 aa, Homo Sapiens
CFGGRDYAF

SEQ ID NO: 875812 - protein, 9 aa, Homo Sapiens
KQYPKFNSV

SEQ ID NO: 875813 - protein, 9 aa, Homo Sapiens
RHRRSHSAG

SEQ ID NO: 875814 - protein, 9 aa, Homo Sapiens
QKNKYRVLG

SEQ ID NO: 875815 - protein, 9 aa, Homo Sapiens
SSLSVNSNI

SEQ ID NO: 875816 - protein, 9 aa, Homo Sapiens
GPRLPQTVI

SEQ ID NO: 875817 - protein, 9 aa, Homo Sapiens
SLCGTSIIV

SEQ ID NO: 875818 - protein, 9 aa, Homo Sapiens
LLNKLCQAP

SEQ ID NO: 875819 - protein, 9 aa, Homo Sapiens
MVFLQLALS

SEQ ID NO: 875820 - protein, 9 aa, Homo Sapiens
FLDLIFQLE

SEQ ID NO: 875821 - protein, 9 aa, Homo Sapiens
PENVLPLLM

SEQ ID NO: 875822 - protein, 9 aa, Homo Sapiens
DNAMLLKGK

SEQ ID NO: 875823 - protein, 9 aa, Homo Sapiens
SRRCRTAFT

SEQ ID NO: 875824 - protein, 9 aa, Homo Sapiens
FEKDQGSTH

SEQ ID NO: 875825 - protein, 9 aa, Homo Sapiens
ALVLANLTT

SEQ ID NO: 875826 - protein, 9 aa, Homo Sapiens
DNFGIWDNH

SEQ ID NO: 875827 - protein, 9 aa, Homo Sapiens
EGRQVAGPH

SEQ ID NO: 875828 - protein, 9 aa, Homo Sapiens
GKSFSYNSN

SEQ ID NO: 875829 - protein, 9 aa, Homo Sapiens
TNPLVFLLQ

SEQ ID NO: 875830 - protein, 9 aa, Homo Sapiens
EAVCLLTKQ

SEQ ID NO: 875831 - protein, 9 aa, Homo Sapiens
LQSSDLKTI

SEQ ID NO: 875832 - protein, 9 aa, Homo Sapiens
GFNRPHAFD

SEQ ID NO: 875833 - protein, 9 aa, Homo Sapiens
MERNNIDVN

SEQ ID NO: 875834 - protein, 9 aa, Homo Sapiens
PRMHYPGPM

SEQ ID NO: 875835 - protein, 9 aa, Homo Sapiens
PILRLLCTD

SEQ ID NO: 875836 - protein, 9 aa, Homo Sapiens
FSFSVNFSL

SEQ ID NO: 875837 - protein, 9 aa, Homo Sapiens
GDGKISFQE

SEQ ID NO: 875838 - protein, 9 aa, Homo Sapiens
GFDQLQLEG

SEQ ID NO: 875839 - protein, 9 aa, Homo Sapiens
QVTESGTFH

SEQ ID NO: 875840 - protein, 9 aa, Homo Sapiens
KNEIQKLGV

SEQ ID NO: 875841 - protein, 9 aa, Homo Sapiens
LWEEATPIW

SEQ ID NO: 875842 - protein, 9 aa, Homo Sapiens
GGQESALPM

SEQ ID NO: 875843 - protein, 9 aa, Homo Sapiens
NEQIHAQET

SEQ ID NO: 875844 - protein, 9 aa, Homo Sapiens
VNSNISKKS

SEQ ID NO: 875845 - protein, 9 aa, Homo Sapiens
FEQGKLYLR

SEQ ID NO: 875846 - protein, 9 aa, Homo Sapiens
NPQNSVTVQ

SEQ ID NO: 875847 - protein, 9 aa, Homo Sapiens
LDKAQPFPL

SEQ ID NO: 875848 - protein, 9 aa, Homo Sapiens
AVENSDNPL

SEQ ID NO: 875849 - protein, 9 aa, Homo Sapiens
LGPEPLLAA

SEQ ID NO: 875850 - protein, 9 aa, Homo Sapiens
STGKLGKIQ

SEQ ID NO: 875851 - protein, 9 aa, Homo Sapiens
KSKNKHGLT

SEQ ID NO: 875852 - protein, 9 aa, Homo Sapiens
QNLTKLMSD

SEQ ID NO: 875853 - protein, 9 aa, Homo Sapiens
LQHISQSED

SEQ ID NO: 875854 - protein, 9 aa, Homo Sapiens
SKSQTNVRE

SEQ ID NO: 875855 - protein, 9 aa, Homo Sapiens
APLNPALFS

SEQ ID NO: 875856 - protein, 9 aa, Homo Sapiens
EGSEDGDNY

SEQ ID NO: 875857 - protein, 9 aa, Homo Sapiens
VHKSFDLRP

SEQ ID NO: 875858 - protein, 9 aa, Homo Sapiens
KVLKMFTNF

SEQ ID NO: 875859 - protein, 9 aa, Homo Sapiens
QVAENQHFD

SEQ ID NO: 875860 - protein, 9 aa, Homo Sapiens
DHSCTLANN

SEQ ID NO: 875861 - protein, 9 aa, Homo Sapiens
ELKVTMKKT

SEQ ID NO: 875862 - protein, 9 aa, Homo Sapiens
PKGYVGSEP

SEQ ID NO: 875863 - protein, 9 aa, Homo Sapiens
EEDPVLSVE

SEQ ID NO: 875864 - protein, 9 aa, Homo Sapiens
LISSSSGVS

SEQ ID NO: 875865 - protein, 9 aa, Homo Sapiens
IQEVHTHYL

SEQ ID NO: 875866 - protein, 9 aa, Homo Sapiens
STNSLMWTL

SEQ ID NO: 875867 - protein, 9 aa, Homo Sapiens
AENQLLTLP

SEQ ID NO: 875868 - protein, 9 aa, Homo Sapiens
ALQTFRVLR

SEQ ID NO: 875869 - protein, 9 aa, Homo Sapiens
LHFTCDLNT

SEQ ID NO: 875870 - protein, 9 aa, Homo Sapiens
GLWGGPPPP

SEQ ID NO: 875871 - protein, 9 aa, Homo Sapiens
YTALMHPRF

SEQ ID NO: 875872 - protein, 9 aa, Homo Sapiens
INTLQRCIE

SEQ ID NO: 875873 - protein, 9 aa, Homo Sapiens
GMNQTRIID

SEQ ID NO: 875874 - protein, 9 aa, Homo Sapiens
NKSELDFKT

SEQ ID NO: 875875 - protein, 9 aa, Homo Sapiens
PLKDSGACK

SEQ ID NO: 875876 - protein, 9 aa, Homo Sapiens
KRNKSCEMS

SEQ ID NO: 875877 - protein, 9 aa, Homo Sapiens
TFPSLLEDN

SEQ ID NO: 875878 - protein, 9 aa, Homo Sapiens
LKKKLKAIK

SEQ ID NO: 875879 - protein, 9 aa, Homo Sapiens
INILEVRGV

SEQ ID NO: 875880 - protein, 9 aa, Homo Sapiens
ADLLQTFQA

SEQ ID NO: 875881 - protein, 9 aa, Homo Sapiens
PGPRTEPPA

SEQ ID NO: 875882 - protein, 9 aa, Homo Sapiens
EHCFLKRRL

SEQ ID NO: 875883 - protein, 9 aa, Homo Sapiens
GSKPSQQGQ

SEQ ID NO: 875884 - protein, 9 aa, Homo Sapiens
RDILPYDAT

SEQ ID NO: 875885 - protein, 9 aa, Homo Sapiens
FSIEARDYS

SEQ ID NO: 875886 - protein, 9 aa, Homo Sapiens
DDDDDKGYG

SEQ ID NO: 875887 - protein, 9 aa, Homo Sapiens
LRCLCQQHD

SEQ ID NO: 875888 - protein, 9 aa, Homo Sapiens
VDVDCCKKD

SEQ ID NO: 875889 - protein, 9 aa, Homo Sapiens
GAVLRMDAK

SEQ ID NO: 875890 - protein, 9 aa, Homo Sapiens
DEVIAKVLT

SEQ ID NO: 875891 - protein, 9 aa, Homo Sapiens
KAMGNKMSA

SEQ ID NO: 875892 - protein, 9 aa, Homo Sapiens
VCLKCVMPN

SEQ ID NO: 875893 - protein, 9 aa, Homo Sapiens
FPISHICYW

SEQ ID NO: 875894 - protein, 9 aa, Homo Sapiens
VKTIVKAKD

SEQ ID NO: 875895 - protein, 9 aa, Homo Sapiens
GDKSYKCKV

SEQ ID NO: 875896 - protein, 9 aa, Homo Sapiens
DFPESWVIS

SEQ ID NO: 875897 - protein, 9 aa, Homo Sapiens
AISTSTDKS

SEQ ID NO: 875898 - protein, 9 aa, Homo Sapiens
TSVVFEDGT

SEQ ID NO: 875899 - protein, 9 aa, Homo Sapiens
QYYCCMASE

SEQ ID NO: 875900 - protein, 9 aa, Homo Sapiens
QILNFISAQ

SEQ ID NO: 875901 - protein, 9 aa, Homo Sapiens
KSVLQNQDN

SEQ ID NO: 875902 - protein, 9 aa, Homo Sapiens
CHRFIPCEN

SEQ ID NO: 875903 - protein, 9 aa, Homo Sapiens
SMWSVAHAA

SEQ ID NO: 875904 - protein, 9 aa, Homo Sapiens
TSKTHPKQE

SEQ ID NO: 875905 - protein, 9 aa, Homo Sapiens
PDLPWSYTI

SEQ ID NO: 875906 - protein, 9 aa, Homo Sapiens
NNYIVNKCG

SEQ ID NO: 875907 - protein, 9 aa, Homo Sapiens
NIWSHLAAL

SEQ ID NO: 875908 - protein, 9 aa, Homo Sapiens
TGRNFDEII

SEQ ID NO: 875909 - protein, 9 aa, Homo Sapiens
AIAVVLSFF

SEQ ID NO: 875910 - protein, 9 aa, Homo Sapiens
VTAPVEVCV

SEQ ID NO: 875911 - protein, 9 aa, Homo Sapiens
TTSVSTGNL

SEQ ID NO: 875912 - protein, 9 aa, Homo Sapiens
DIVLWNFLL

SEQ ID NO: 875913 - protein, 9 aa, Homo Sapiens
PSPNKHSIY

SEQ ID NO: 875914 - protein, 9 aa, Homo Sapiens
AKVFILVLK

SEQ ID NO: 875915 - protein, 9 aa, Homo Sapiens
QNVSLSAVR

SEQ ID NO: 875916 - protein, 9 aa, Homo Sapiens
NEVVGSYLS

SEQ ID NO: 875917 - protein, 9 aa, Homo Sapiens
GAKIVFLAT

SEQ ID NO: 875918 - protein, 9 aa, Homo Sapiens
GVAASNAAD

SEQ ID NO: 875919 - protein, 9 aa, Homo Sapiens
IRRDFFLDE

SEQ ID NO: 875920 - protein, 9 aa, Homo Sapiens
GRVVLNQHN

SEQ ID NO: 875921 - protein, 9 aa, Homo Sapiens
EGINSPSVL

SEQ ID NO: 875922 - protein, 9 aa, Homo Sapiens
VVNKESLAI

SEQ ID NO: 875923 - protein, 9 aa, Homo Sapiens
EPSNSHSRR

SEQ ID NO: 875924 - protein, 9 aa, Homo Sapiens
QHECVSTDD

SEQ ID NO: 875925 - protein, 9 aa, Homo Sapiens
DELLSEKTE

SEQ ID NO: 875926 - protein, 9 aa, Homo Sapiens
VLYWIFTVN

SEQ ID NO: 875927 - protein, 9 aa, Homo Sapiens
KPDEEEGTF

SEQ ID NO: 875928 - protein, 9 aa, Homo Sapiens
SGAGLQNGP

SEQ ID NO: 875929 - protein, 9 aa, Homo Sapiens
TIQHGVHMM

SEQ ID NO: 875930 - protein, 9 aa, Homo Sapiens
GDSSKLRPD

SEQ ID NO: 875931 - protein, 9 aa, Homo Sapiens
DDNFEKISE

SEQ ID NO: 875932 - protein, 9 aa, Homo Sapiens
GINDNDTTE

SEQ ID NO: 875933 - protein, 9 aa, Homo Sapiens
CRGGVRTAA

SEQ ID NO: 875934 - protein, 9 aa, Homo Sapiens
QFLRTLFLH

SEQ ID NO: 875935 - protein, 9 aa, Homo Sapiens
LAKIWWKYM

SEQ ID NO: 875936 - protein, 9 aa, Homo Sapiens
IDDKLYTVH

SEQ ID NO: 875937 - protein, 9 aa, Homo Sapiens
LGLPALYYV

SEQ ID NO: 875938 - protein, 9 aa, Homo Sapiens
SVLVKRRDN

SEQ ID NO: 875939 - protein, 9 aa, Homo Sapiens
GGELLYYKY

SEQ ID NO: 875940 - protein, 9 aa, Homo Sapiens
QTAVYPVQS

SEQ ID NO: 875941 - protein, 9 aa, Homo Sapiens
FFDLMRKIR

SEQ ID NO: 875942 - protein, 9 aa, Homo Sapiens
ETPKFSTFR

SEQ ID NO: 875943 - protein, 9 aa, Homo Sapiens
KTKKCIFQI

SEQ ID NO: 875944 - protein, 9 aa, Homo Sapiens
PINGLQDKH

SEQ ID NO: 875945 - protein, 9 aa, Homo Sapiens
VALVGGTTM

SEQ ID NO: 875946 - protein, 9 aa, Homo Sapiens
LGSGSENVP

SEQ ID NO: 875947 - protein, 9 aa, Homo Sapiens
IILMTNNHA

SEQ ID NO: 875948 - protein, 9 aa, Homo Sapiens
MVAHHIVET

SEQ ID NO: 875949 - protein, 9 aa, Homo Sapiens
DVPDVNIEA

SEQ ID NO: 875950 - protein, 9 aa, Homo Sapiens
LGIKHSLHQ

SEQ ID NO: 875951 - protein, 9 aa, Homo Sapiens
IKNCSSTTA

SEQ ID NO: 875952 - protein, 9 aa, Homo Sapiens
FKHILFQRR

SEQ ID NO: 875953 - protein, 9 aa, Homo Sapiens
VVFFFVPCM

SEQ ID NO: 875954 - protein, 9 aa, Homo Sapiens
RHIHSHTGE

SEQ ID NO: 875955 - protein, 9 aa, Homo Sapiens
GDKPFGCAH

SEQ ID NO: 875956 - protein, 9 aa, Homo Sapiens
QPLWEVLPG

SEQ ID NO: 875957 - protein, 9 aa, Homo Sapiens
DEDCKLNNG

SEQ ID NO: 875958 - protein, 9 aa, Homo Sapiens
KHIKGEQEK

SEQ ID NO: 875959 - protein, 9 aa, Homo Sapiens
ICFGRHYDH

SEQ ID NO: 875960 - protein, 9 aa, Homo Sapiens
EMAPRNLKA

SEQ ID NO: 875961 - protein, 9 aa, Homo Sapiens
LQKEAAAAE

SEQ ID NO: 875962 - protein, 9 aa, Homo Sapiens
QCGKAFNQS

SEQ ID NO: 875963 - protein, 9 aa, Homo Sapiens
FILLCLKVD

SEQ ID NO: 875964 - protein, 9 aa, Homo Sapiens
LQSAFKADE

SEQ ID NO: 875965 - protein, 9 aa, Homo Sapiens
KDEDEDGSG

SEQ ID NO: 875966 - protein, 9 aa, Homo Sapiens
ILVMYYLNT

SEQ ID NO: 875967 - protein, 9 aa, Homo Sapiens
QVAVVRIKC

SEQ ID NO: 875968 - protein, 9 aa, Homo Sapiens
CSAPQLANL

SEQ ID NO: 875969 - protein, 9 aa, Homo Sapiens
STTNILWLS

SEQ ID NO: 875970 - protein, 9 aa, Homo Sapiens
CIKIADFGF

SEQ ID NO: 875971 - protein, 9 aa, Homo Sapiens
GMAFQYHYQ

SEQ ID NO: 875972 - protein, 9 aa, Homo Sapiens
NYTVGRKIV

SEQ ID NO: 875973 - protein, 9 aa, Homo Sapiens
LSQSLVQEG

SEQ ID NO: 875974 - protein, 9 aa, Homo Sapiens
ANYLDGFAQ

SEQ ID NO: 875975 - protein, 9 aa, Homo Sapiens
GECQLAVVD

SEQ ID NO: 875976 - protein, 9 aa, Homo Sapiens
NCIAGGTSQ

SEQ ID NO: 875977 - protein, 9 aa, Homo Sapiens
FLDIPGQDS

SEQ ID NO: 875978 - protein, 9 aa, Homo Sapiens
LFFKFYHLL

SEQ ID NO: 875979 - protein, 9 aa, Homo Sapiens
QRQIKLGFT

SEQ ID NO: 875980 - protein, 9 aa, Homo Sapiens
AKTFKQRQI

SEQ ID NO: 875981 - protein, 9 aa, Homo Sapiens
LDFLYFTDL

SEQ ID NO: 875982 - protein, 9 aa, Homo Sapiens
QSLYKICVC

SEQ ID NO: 875983 - protein, 9 aa, Homo Sapiens
TQTCTTKFL

SEQ ID NO: 875984 - protein, 9 aa, Homo Sapiens
VFSVLIEFA

SEQ ID NO: 875985 - protein, 9 aa, Homo Sapiens
GCCKVICHS

SEQ ID NO: 875986 - protein, 9 aa, Homo Sapiens
EQAAKPAGP

SEQ ID NO: 875987 - protein, 9 aa, Homo Sapiens
WHVSKVLRI

SEQ ID NO: 875988 - protein, 9 aa, Homo Sapiens
KEFQRGQYS

SEQ ID NO: 875989 - protein, 9 aa, Homo Sapiens
CSVPEGPFS

SEQ ID NO: 875990 - protein, 9 aa, Homo Sapiens
YFMYTMNKF

SEQ ID NO: 875991 - protein, 9 aa, Homo Sapiens
RQKQQEEQK

SEQ ID NO: 875992 - protein, 9 aa, Homo Sapiens
PGLEQSLLN

SEQ ID NO: 875993 - protein, 9 aa, Homo Sapiens
LLLSADWPT

SEQ ID NO: 875994 - protein, 9 aa, Homo Sapiens
SERSKVIHL

SEQ ID NO: 875995 - protein, 9 aa, Homo Sapiens
PYVDRQNHI

SEQ ID NO: 875996 - protein, 9 aa, Homo Sapiens
RNADMKNQG

SEQ ID NO: 875997 - protein, 9 aa, Homo Sapiens
NLRFVGRSG

SEQ ID NO: 875998 - protein, 9 aa, Homo Sapiens
LEIDHTQYQ

SEQ ID NO: 875999 - protein, 9 aa, Homo Sapiens
VCMTLYTLT

SEQ ID NO: 876000 - protein, 9 aa, Homo Sapiens
FFIQSCRCK

SEQ ID NO: 876001 - protein, 9 aa, Homo Sapiens
RNYLEEAVS

SEQ ID NO: 876002 - protein, 9 aa, Homo Sapiens
YLWTCPAVG

SEQ ID NO: 876003 - protein, 9 aa, Homo Sapiens
DEFVTVNEV

SEQ ID NO: 876004 - protein, 9 aa, Homo Sapiens
YPVEYEVIN

SEQ ID NO: 876005 - protein, 9 aa, Homo Sapiens
KNKKEENAR

SEQ ID NO: 876006 - protein, 9 aa, Homo Sapiens
SSTTHITQG

SEQ ID NO: 876007 - protein, 9 aa, Homo Sapiens
GQWGTICDN

SEQ ID NO: 876008 - protein, 9 aa, Homo Sapiens
FESGSKIWA

SEQ ID NO: 876009 - protein, 9 aa, Homo Sapiens
LVSRKSIPK

SEQ ID NO: 876010 - protein, 9 aa, Homo Sapiens
TIKNKQKHR

SEQ ID NO: 876011 - protein, 9 aa, Homo Sapiens
PETMQTTTP

SEQ ID NO: 876012 - protein, 9 aa, Homo Sapiens
VSPTSCDNL

SEQ ID NO: 876013 - protein, 9 aa, Homo Sapiens
GARQSVIGS

SEQ ID NO: 876014 - protein, 9 aa, Homo Sapiens
EKTKKCIFQ

SEQ ID NO: 876015 - protein, 9 aa, Homo Sapiens
WTKLTLDYL

SEQ ID NO: 876016 - protein, 9 aa, Homo Sapiens
IIASLINER

SEQ ID NO: 876017 - protein, 9 aa, Homo Sapiens
PHVANPQLQ

SEQ ID NO: 876018 - protein, 9 aa, Homo Sapiens
PSDVMSFNQ

SEQ ID NO: 876019 - protein, 9 aa, Homo Sapiens
SCLRSAKDI

SEQ ID NO: 876020 - protein, 9 aa, Homo Sapiens
GLPLQDVWH

SEQ ID NO: 876021 - protein, 9 aa, Homo Sapiens
AYDGVSLCH

SEQ ID NO: 876022 - protein, 9 aa, Homo Sapiens
PQTQTHATL

SEQ ID NO: 876023 - protein, 9 aa, Homo Sapiens
PVLALCVIY

SEQ ID NO: 876024 - protein, 9 aa, Homo Sapiens
RMWNQSFQG

SEQ ID NO: 876025 - protein, 9 aa, Homo Sapiens
LVSLDLGLL

SEQ ID NO: 876026 - protein, 9 aa, Homo Sapiens
QKQKQMKYS

SEQ ID NO: 876027 - protein, 9 aa, Homo Sapiens
NKETQSPEQ

SEQ ID NO: 876028 - protein, 9 aa, Homo Sapiens
HYGARPPPT

SEQ ID NO: 876029 - protein, 9 aa, Homo Sapiens
SKKRNKSCE

SEQ ID NO: 876030 - protein, 9 aa, Homo Sapiens
SFLQKNQKH

SEQ ID NO: 876031 - protein, 9 aa, Homo Sapiens
VPVHRHYKH

SEQ ID NO: 876032 - protein, 9 aa, Homo Sapiens
VKVYKTDNN

SEQ ID NO: 876033 - protein, 9 aa, Homo Sapiens
FFKDWRKDM

SEQ ID NO: 876034 - protein, 9 aa, Homo Sapiens
LKSPLPDEI

SEQ ID NO: 876035 - protein, 9 aa, Homo Sapiens
QDLNTTSRQ

SEQ ID NO: 876036 - protein, 9 aa, Homo Sapiens
EHNEQVKNF

SEQ ID NO: 876037 - protein, 9 aa, Homo Sapiens
AAAPSHWVV

SEQ ID NO: 876038 - protein, 9 aa, Homo Sapiens
KKESGSCTG

SEQ ID NO: 876039 - protein, 9 aa, Homo Sapiens
FRRRLNLTQ

SEQ ID NO: 876040 - protein, 9 aa, Homo Sapiens
ILSVQMEGE

SEQ ID NO: 876041 - protein, 9 aa, Homo Sapiens
KNRINHAPE

SEQ ID NO: 876042 - protein, 9 aa, Homo Sapiens
GFLKFCFYS

SEQ ID NO: 876043 - protein, 9 aa, Homo Sapiens
AHCPFYSWE

SEQ ID NO: 876044 - protein, 9 aa, Homo Sapiens
EDRDTMNFS

SEQ ID NO: 876045 - protein, 9 aa, Homo Sapiens
TKGWKEVNE

SEQ ID NO: 876046 - protein, 9 aa, Homo Sapiens
LKEKEGANF

SEQ ID NO: 876047 - protein, 9 aa, Homo Sapiens
IWFQTYLHS

SEQ ID NO: 876048 - protein, 9 aa, Homo Sapiens
WCGFVRSMA

SEQ ID NO: 876049 - protein, 9 aa, Homo Sapiens
QHVFRGQPG

SEQ ID NO: 876050 - protein, 9 aa, Homo Sapiens
ALPSEEVLC

SEQ ID NO: 876051 - protein, 9 aa, Homo Sapiens
QLSSNEHLS

SEQ ID NO: 876052 - protein, 9 aa, Homo Sapiens
CALNKHSLE

SEQ ID NO: 876053 - protein, 9 aa, Homo Sapiens
KLALEDLEN

SEQ ID NO: 876054 - protein, 9 aa, Homo Sapiens
VQTWSLHPL

SEQ ID NO: 876055 - protein, 9 aa, Homo Sapiens
TTNPPPAPF

SEQ ID NO: 876056 - protein, 9 aa, Homo Sapiens
AARAGTMAL

SEQ ID NO: 876057 - protein, 9 aa, Homo Sapiens
VPPQNLMGS

SEQ ID NO: 876058 - protein, 9 aa, Homo Sapiens
TAFNTNDGR

SEQ ID NO: 876059 - protein, 9 aa, Homo Sapiens
SNNSFHSMP

SEQ ID NO: 876060 - protein, 9 aa, Homo Sapiens
EDHSILWDT

SEQ ID NO: 876061 - protein, 9 aa, Homo Sapiens
FNHEKSLGL

SEQ ID NO: 876062 - protein, 9 aa, Homo Sapiens
KEGERDLCQ

SEQ ID NO: 876063 - protein, 9 aa, Homo Sapiens
NQASCLTRH

SEQ ID NO: 876064 - protein, 9 aa, Homo Sapiens
GREGYVSSN

SEQ ID NO: 876065 - protein, 9 aa, Homo Sapiens
HFLEEINEQ

SEQ ID NO: 876066 - protein, 9 aa, Homo Sapiens
EDVKVIFKN

SEQ ID NO: 876067 - protein, 9 aa, Homo Sapiens
PAFLKAFAA

SEQ ID NO: 876068 - protein, 9 aa, Homo Sapiens
QHKIDLPPT

SEQ ID NO: 876069 - protein, 9 aa, Homo Sapiens
FIVTQMAGF

SEQ ID NO: 876070 - protein, 9 aa, Homo Sapiens
LLCIHGGHT

SEQ ID NO: 876071 - protein, 9 aa, Homo Sapiens
PLQDVWHIY

SEQ ID NO: 876072 - protein, 9 aa, Homo Sapiens
AEGLSQEIW

SEQ ID NO: 876073 - protein, 9 aa, Homo Sapiens
RRNFDNSFQ

SEQ ID NO: 876074 - protein, 9 aa, Homo Sapiens
LLPDKPRNN

SEQ ID NO: 876075 - protein, 9 aa, Homo Sapiens
KGGNMTRVF

SEQ ID NO: 876076 - protein, 9 aa, Homo Sapiens
VGGLIYWIG

SEQ ID NO: 876077 - protein, 9 aa, Homo Sapiens
PKMLKEETR

SEQ ID NO: 876078 - protein, 9 aa, Homo Sapiens
CTDMFVAEL

SEQ ID NO: 876079 - protein, 9 aa, Homo Sapiens
SLCMFFEPL

SEQ ID NO: 876080 - protein, 9 aa, Homo Sapiens
VFYTMITYM

SEQ ID NO: 876081 - protein, 9 aa, Homo Sapiens
LIKPRLSDY

SEQ ID NO: 876082 - protein, 9 aa, Homo Sapiens
KLKSLDFLY

SEQ ID NO: 876083 - protein, 9 aa, Homo Sapiens
WSKCSQKYI

SEQ ID NO: 876084 - protein, 9 aa, Homo Sapiens
SIWLLQTDF

SEQ ID NO: 876085 - protein, 9 aa, Homo Sapiens
LLLWVLLDG

SEQ ID NO: 876086 - protein, 9 aa, Homo Sapiens
DILSFLFQL

SEQ ID NO: 876087 - protein, 9 aa, Homo Sapiens
FKFQLAEFK

SEQ ID NO: 876088 - protein, 9 aa, Homo Sapiens
NFLQSHMIL

SEQ ID NO: 876089 - protein, 9 aa, Homo Sapiens
VWSYYEVFL

SEQ ID NO: 876090 - protein, 9 aa, Homo Sapiens
NNLGNWKEE

SEQ ID NO: 876091 - protein, 9 aa, Homo Sapiens
QPDINKNVQ

SEQ ID NO: 876092 - protein, 9 aa, Homo Sapiens
FQRHMRMHT

SEQ ID NO: 876093 - protein, 9 aa, Homo Sapiens
AHNTFLKCG

SEQ ID NO: 876094 - protein, 9 aa, Homo Sapiens
RQDCPFFLY

SEQ ID NO: 876095 - protein, 9 aa, Homo Sapiens
KAETTLLST

SEQ ID NO: 876096 - protein, 9 aa, Homo Sapiens
GNKMSAHQY

SEQ ID NO: 876097 - protein, 9 aa, Homo Sapiens
LQTLAMVVA

SEQ ID NO: 876098 - protein, 9 aa, Homo Sapiens
CPMRWEHVL

SEQ ID NO: 876099 - protein, 9 aa, Homo Sapiens
NNLETERIP

SEQ ID NO: 876100 - protein, 9 aa, Homo Sapiens
ASSKKAIED

SEQ ID NO: 876101 - protein, 9 aa, Homo Sapiens
STWCVLQGH

SEQ ID NO: 876102 - protein, 9 aa, Homo Sapiens
VSSSYLAVQ

SEQ ID NO: 876103 - protein, 9 aa, Homo Sapiens
RMHTGEKSY

SEQ ID NO: 876104 - protein, 9 aa, Homo Sapiens
TKLWGGQGS

SEQ ID NO: 876105 - protein, 9 aa, Homo Sapiens
HPQMLGFNP

SEQ ID NO: 876106 - protein, 9 aa, Homo Sapiens
YLLSALNEE

SEQ ID NO: 876107 - protein, 9 aa, Homo Sapiens
QCLDNMGHK

SEQ ID NO: 876108 - protein, 9 aa, Homo Sapiens
STKNINFSR

SEQ ID NO: 876109 - protein, 9 aa, Homo Sapiens
EYPNTALKL

SEQ ID NO: 876110 - protein, 9 aa, Homo Sapiens
LLEREEAVC

SEQ ID NO: 876111 - protein, 9 aa, Homo Sapiens
LYNNNVPAT

SEQ ID NO: 876112 - protein, 9 aa, Homo Sapiens
GSDDSKMED

SEQ ID NO: 876113 - protein, 9 aa, Homo Sapiens
SPLLGRLCG

SEQ ID NO: 876114 - protein, 9 aa, Homo Sapiens
PSLISKAVY

SEQ ID NO: 876115 - protein, 9 aa, Homo Sapiens
KFDDENLIQ

SEQ ID NO: 876116 - protein, 9 aa, Homo Sapiens
LHLTSLGIL

SEQ ID NO: 876117 - protein, 9 aa, Homo Sapiens
MSLCKRFWD

SEQ ID NO: 876118 - protein, 9 aa, Homo Sapiens
LAPQSDSFP

SEQ ID NO: 876119 - protein, 9 aa, Homo Sapiens
TNLYHYITS

SEQ ID NO: 876120 - protein, 9 aa, Homo Sapiens
FNKIGNAIA

SEQ ID NO: 876121 - protein, 9 aa, Homo Sapiens
QVFFLFDNL

SEQ ID NO: 876122 - protein, 9 aa, Homo Sapiens
ICPGNTYHL

SEQ ID NO: 876123 - protein, 9 aa, Homo Sapiens
EQAPPYPPG

SEQ ID NO: 876124 - protein, 9 aa, Homo Sapiens
FSAMKMAHY

SEQ ID NO: 876125 - protein, 9 aa, Homo Sapiens
ESSKRSWLQ

SEQ ID NO: 876126 - protein, 9 aa, Homo Sapiens
FAQTEVMQK

SEQ ID NO: 876127 - protein, 9 aa, Homo Sapiens
LGRRCREIK

SEQ ID NO: 876128 - protein, 9 aa, Homo Sapiens
AFKPWLDIQ

SEQ ID NO: 876129 - protein, 9 aa, Homo Sapiens
SNLFQLHER

SEQ ID NO: 876130 - protein, 9 aa, Homo Sapiens
LSLLDHLGN

SEQ ID NO: 876131 - protein, 9 aa, Homo Sapiens
TIYNNMLCA

SEQ ID NO: 876132 - protein, 9 aa, Homo Sapiens
NGIRGLSLS

SEQ ID NO: 876133 - protein, 9 aa, Homo Sapiens
TKKLLLCLK

SEQ ID NO: 876134 - protein, 9 aa, Homo Sapiens
NTASLQRRP

SEQ ID NO: 876135 - protein, 9 aa, Homo Sapiens
ELTSKQGGC

SEQ ID NO: 876136 - protein, 9 aa, Homo Sapiens
WEALNLKKG

SEQ ID NO: 876137 - protein, 9 aa, Homo Sapiens
KKTFIGLES

SEQ ID NO: 876138 - protein, 9 aa, Homo Sapiens
APHRRWRTE

SEQ ID NO: 876139 - protein, 9 aa, Homo Sapiens
CVLSEPIGP

SEQ ID NO: 876140 - protein, 9 aa, Homo Sapiens
SVQLLSEKI

SEQ ID NO: 876141 - protein, 9 aa, Homo Sapiens
AVYSEMIYL

SEQ ID NO: 876142 - protein, 9 aa, Homo Sapiens
SNLYLPSCA

SEQ ID NO: 876143 - protein, 9 aa, Homo Sapiens
HILLDIKTQ

SEQ ID NO: 876144 - protein, 9 aa, Homo Sapiens
SFLSLEPQD

SEQ ID NO: 876145 - protein, 9 aa, Homo Sapiens
ADKEFWQKV

SEQ ID NO: 876146 - protein, 9 aa, Homo Sapiens
LFQKRWFQF

SEQ ID NO: 876147 - protein, 9 aa, Homo Sapiens
VQSRLLACK

SEQ ID NO: 876148 - protein, 9 aa, Homo Sapiens
VNLGVGAYH

SEQ ID NO: 876149 - protein, 9 aa, Homo Sapiens
LMGTNVRFS

SEQ ID NO: 876150 - protein, 9 aa, Homo Sapiens
YRMCTLENV

SEQ ID NO: 876151 - protein, 9 aa, Homo Sapiens
TRCYTCQVS

SEQ ID NO: 876152 - protein, 9 aa, Homo Sapiens
RSNGYRWCA

SEQ ID NO: 876153 - protein, 9 aa, Homo Sapiens
ASFLMPSDL

SEQ ID NO: 876154 - protein, 9 aa, Homo Sapiens
LLVPDTGET

SEQ ID NO: 876155 - protein, 9 aa, Homo Sapiens
SQNFPSSDS

SEQ ID NO: 876156 - protein, 9 aa, Homo Sapiens
KDYIQTQII

SEQ ID NO: 876157 - protein, 9 aa, Homo Sapiens
LFQPTEMAS

SEQ ID NO: 876158 - protein, 9 aa, Homo Sapiens
PTAMQLLWF

SEQ ID NO: 876159 - protein, 9 aa, Homo Sapiens
TTTAEDIKQ

SEQ ID NO: 876160 - protein, 9 aa, Homo Sapiens
AICHPLCYP

SEQ ID NO: 876161 - protein, 9 aa, Homo Sapiens
RMVRTDYLW

SEQ ID NO: 876162 - protein, 9 aa, Homo Sapiens
WKSKDWPRR

SEQ ID NO: 876163 - protein, 9 aa, Homo Sapiens
KHGIEYQDK

SEQ ID NO: 876164 - protein, 9 aa, Homo Sapiens
NKLHVDPDN

SEQ ID NO: 876165 - protein, 9 aa, Homo Sapiens
EKENYPKRR

SEQ ID NO: 876166 - protein, 9 aa, Homo Sapiens
SEDGDNYDT

SEQ ID NO: 876167 - protein, 9 aa, Homo Sapiens
LTQADHLAL

SEQ ID NO: 876168 - protein, 9 aa, Homo Sapiens
QPRYSWEWH

SEQ ID NO: 876169 - protein, 9 aa, Homo Sapiens
CMDLLVRRR

SEQ ID NO: 876170 - protein, 9 aa, Homo Sapiens
EMSKYANFG

SEQ ID NO: 876171 - protein, 9 aa, Homo Sapiens
NQDDSSDNG

SEQ ID NO: 876172 - protein, 9 aa, Homo Sapiens
NYYNHLYKG

SEQ ID NO: 876173 - protein, 9 aa, Homo Sapiens
WVFAYVMCT

SEQ ID NO: 876174 - protein, 9 aa, Homo Sapiens
SQVFEFTKP

SEQ ID NO: 876175 - protein, 9 aa, Homo Sapiens
ILHYLSFYC

SEQ ID NO: 876176 - protein, 9 aa, Homo Sapiens
IKKRLPFSS

SEQ ID NO: 876177 - protein, 9 aa, Homo Sapiens
VLCYVTFIL

SEQ ID NO: 876178 - protein, 9 aa, Homo Sapiens
SSLMTHMII

SEQ ID NO: 876179 - protein, 9 aa, Homo Sapiens
EIKLPVENS

SEQ ID NO: 876180 - protein, 9 aa, Homo Sapiens
RIKLGHTQT

SEQ ID NO: 876181 - protein, 9 aa, Homo Sapiens
QAEEEETKK

SEQ ID NO: 876182 - protein, 9 aa, Homo Sapiens
RDLHHWINL

SEQ ID NO: 876183 - protein, 9 aa, Homo Sapiens
SADEQLFSV

SEQ ID NO: 876184 - protein, 9 aa, Homo Sapiens
SDYLYFASL

SEQ ID NO: 876185 - protein, 9 aa, Homo Sapiens
KDWPRRIRM

SEQ ID NO: 876186 - protein, 9 aa, Homo Sapiens
LTDYFTEVK

SEQ ID NO: 876187 - protein, 9 aa, Homo Sapiens
LNIIYFKNM

SEQ ID NO: 876188 - protein, 9 aa, Homo Sapiens
SPEVKGYWS

SEQ ID NO: 876189 - protein, 9 aa, Homo Sapiens
YYGLRDSHS

SEQ ID NO: 876190 - protein, 9 aa, Homo Sapiens
PGGHNRDDG

SEQ ID NO: 876191 - protein, 9 aa, Homo Sapiens
FNQSLTLAK

SEQ ID NO: 876192 - protein, 9 aa, Homo Sapiens
EKQNYVAPL

SEQ ID NO: 876193 - protein, 9 aa, Homo Sapiens
LQGNEDDIN

SEQ ID NO: 876194 - protein, 9 aa, Homo Sapiens
VFAQMVQLH

SEQ ID NO: 876195 - protein, 9 aa, Homo Sapiens
KKLIKKDLR

SEQ ID NO: 876196 - protein, 9 aa, Homo Sapiens
FAKHKKIHT

SEQ ID NO: 876197 - protein, 9 aa, Homo Sapiens
SSIDKDAKE

SEQ ID NO: 876198 - protein, 9 aa, Homo Sapiens
ECVSTDDSY

SEQ ID NO: 876199 - protein, 9 aa, Homo Sapiens
TIFEPVYPI

SEQ ID NO: 876200 - protein, 9 aa, Homo Sapiens
VYTLLTEGA

SEQ ID NO: 876201 - protein, 9 aa, Homo Sapiens
VEESLPYFK

SEQ ID NO: 876202 - protein, 9 aa, Homo Sapiens
KLLSSDQNP

SEQ ID NO: 876203 - protein, 9 aa, Homo Sapiens
FDKLPINGE

SEQ ID NO: 876204 - protein, 9 aa, Homo Sapiens
ENYPKRRSC

SEQ ID NO: 876205 - protein, 9 aa, Homo Sapiens
ETKTKDKLT

SEQ ID NO: 876206 - protein, 9 aa, Homo Sapiens
MSDPTVNAQ

SEQ ID NO: 876207 - protein, 9 aa, Homo Sapiens
LCETNAQMS

SEQ ID NO: 876208 - protein, 9 aa, Homo Sapiens
QTSGTVSSQ

SEQ ID NO: 876209 - protein, 9 aa, Homo Sapiens
ETKSQFDKF

SEQ ID NO: 876210 - protein, 9 aa, Homo Sapiens
QQVYKTKMR

SEQ ID NO: 876211 - protein, 9 aa, Homo Sapiens
RCASLNTRT

SEQ ID NO: 876212 - protein, 9 aa, Homo Sapiens
YRHRHCSRR

SEQ ID NO: 876213 - protein, 9 aa, Homo Sapiens
IDRRMPGKV

SEQ ID NO: 876214 - protein, 9 aa, Homo Sapiens
QVQRGPAQK

SEQ ID NO: 876215 - protein, 9 aa, Homo Sapiens
WITGTDGVM

SEQ ID NO: 876216 - protein, 9 aa, Homo Sapiens
DNLEIYTFL

SEQ ID NO: 876217 - protein, 9 aa, Homo Sapiens
SIMVMKING

SEQ ID NO: 876218 - protein, 9 aa, Homo Sapiens
EDLENTAST

SEQ ID NO: 876219 - protein, 9 aa, Homo Sapiens
DKSYKCKVC

SEQ ID NO: 876220 - protein, 9 aa, Homo Sapiens
AKRMSFCLA

SEQ ID NO: 876221 - protein, 9 aa, Homo Sapiens
EFQQTKLLN

SEQ ID NO: 876222 - protein, 9 aa, Homo Sapiens
TSSDCQDSR

SEQ ID NO: 876223 - protein, 9 aa, Homo Sapiens
RKRTKEPDR

SEQ ID NO: 876224 - protein, 9 aa, Homo Sapiens
SGKVQTTTF

SEQ ID NO: 876225 - protein, 9 aa, Homo Sapiens
VLPTNVLQP

SEQ ID NO: 876226 - protein, 9 aa, Homo Sapiens
AWNFRGQKR

SEQ ID NO: 876227 - protein, 9 aa, Homo Sapiens
SQENDNSTI

SEQ ID NO: 876228 - protein, 9 aa, Homo Sapiens
FDQLAFIKE

SEQ ID NO: 876229 - protein, 9 aa, Homo Sapiens
AIMAIDIFF

SEQ ID NO: 876230 - protein, 9 aa, Homo Sapiens
KAFQIDAKE

SEQ ID NO: 876231 - protein, 9 aa, Homo Sapiens
AYPAIQYLL

SEQ ID NO: 876232 - protein, 9 aa, Homo Sapiens
ILLEKGSIK

SEQ ID NO: 876233 - protein, 9 aa, Homo Sapiens
EEDQEEDNN

SEQ ID NO: 876234 - protein, 9 aa, Homo Sapiens
IEQQSEQNM

SEQ ID NO: 876235 - protein, 9 aa, Homo Sapiens
AFMLKLINH

SEQ ID NO: 876236 - protein, 9 aa, Homo Sapiens
QSQVFEFTK

SEQ ID NO: 876237 - protein, 9 aa, Homo Sapiens
SSRQYLTIC

SEQ ID NO: 876238 - protein, 9 aa, Homo Sapiens
KASNDGPTL

SEQ ID NO: 876239 - protein, 9 aa, Homo Sapiens
DKNKNKNDP

SEQ ID NO: 876240 - protein, 9 aa, Homo Sapiens
LQVAMVFGL

SEQ ID NO: 876241 - protein, 9 aa, Homo Sapiens
GYIHLIQMA

SEQ ID NO: 876242 - protein, 9 aa, Homo Sapiens
TKKIGLETV

SEQ ID NO: 876243 - protein, 9 aa, Homo Sapiens
LKHMKFDEI

SEQ ID NO: 876244 - protein, 9 aa, Homo Sapiens
HPMGHRPQT

SEQ ID NO: 876245 - protein, 9 aa, Homo Sapiens
KVLDVGSGS

SEQ ID NO: 876246 - protein, 9 aa, Homo Sapiens
YLSPETSPA

SEQ ID NO: 876247 - protein, 9 aa, Homo Sapiens
ENGPVEIVV

SEQ ID NO: 876248 - protein, 9 aa, Homo Sapiens
DYIRERFNN

SEQ ID NO: 876249 - protein, 9 aa, Homo Sapiens
GQDGQAVVW

SEQ ID NO: 876250 - protein, 9 aa, Homo Sapiens
GLEEKSSSL

SEQ ID NO: 876251 - protein, 9 aa, Homo Sapiens
QIFPLMLSK

SEQ ID NO: 876252 - protein, 9 aa, Homo Sapiens
ISQGENPKG

SEQ ID NO: 876253 - protein, 9 aa, Homo Sapiens
LNNTGNLAQ

SEQ ID NO: 876254 - protein, 9 aa, Homo Sapiens
WFKNRQQRD

SEQ ID NO: 876255 - protein, 9 aa, Homo Sapiens
YTMITYMLN

SEQ ID NO: 876256 - protein, 9 aa, Homo Sapiens
RQSVIGSGP

SEQ ID NO: 876257 - protein, 9 aa, Homo Sapiens
ELKKKPRRL

SEQ ID NO: 876258 - protein, 9 aa, Homo Sapiens
VNNQLSGTL

SEQ ID NO: 876259 - protein, 9 aa, Homo Sapiens
AGIFRFRLW

SEQ ID NO: 876260 - protein, 9 aa, Homo Sapiens
NTDANILLY

SEQ ID NO: 876261 - protein, 9 aa, Homo Sapiens
DAWKYNGNV

SEQ ID NO: 876262 - protein, 9 aa, Homo Sapiens
QTLKHKFKT

SEQ ID NO: 876263 - protein, 9 aa, Homo Sapiens
SVPAISDLG

SEQ ID NO: 876264 - protein, 9 aa, Homo Sapiens
WNHNNMVWY

SEQ ID NO: 876265 - protein, 9 aa, Homo Sapiens
PATLGKNEG

SEQ ID NO: 876266 - protein, 9 aa, Homo Sapiens
AEIRRSWSE

SEQ ID NO: 876267 - protein, 9 aa, Homo Sapiens
DPSYKYEHT

SEQ ID NO: 876268 - protein, 9 aa, Homo Sapiens
RKKPQNTSR

SEQ ID NO: 876269 - protein, 9 aa, Homo Sapiens
QHLLLIQND

SEQ ID NO: 876270 - protein, 9 aa, Homo Sapiens
SKCPQLREI

SEQ ID NO: 876271 - protein, 9 aa, Homo Sapiens
VTLFPGIPD

SEQ ID NO: 876272 - protein, 9 aa, Homo Sapiens
AAKDSPGVA

SEQ ID NO: 876273 - protein, 9 aa, Homo Sapiens
IRRKQIVGG

SEQ ID NO: 876274 - protein, 9 aa, Homo Sapiens
PTEDEVDAN

SEQ ID NO: 876275 - protein, 9 aa, Homo Sapiens
NILRALDVE

SEQ ID NO: 876276 - protein, 9 aa, Homo Sapiens
SDFAKHKKI

SEQ ID NO: 876277 - protein, 9 aa, Homo Sapiens
STFHLCLTI

SEQ ID NO: 876278 - protein, 9 aa, Homo Sapiens
KSPRWRRSH

SEQ ID NO: 876279 - protein, 9 aa, Homo Sapiens
LYEIVSNKI

SEQ ID NO: 876280 - protein, 9 aa, Homo Sapiens
GPFAKLNTA

SEQ ID NO: 876281 - protein, 9 aa, Homo Sapiens
HSVLRHNYQ

SEQ ID NO: 876282 - protein, 9 aa, Homo Sapiens
ANRAAGKDY

SEQ ID NO: 876283 - protein, 9 aa, Homo Sapiens
ATAVNTRQH

SEQ ID NO: 876284 - protein, 9 aa, Homo Sapiens
EKIRECLKK

SEQ ID NO: 876285 - protein, 9 aa, Homo Sapiens
DQQNILAAL

SEQ ID NO: 876286 - protein, 9 aa, Homo Sapiens
GRSRLIKGD

SEQ ID NO: 876287 - protein, 9 aa, Homo Sapiens
KKELQEPQF

SEQ ID NO: 876288 - protein, 9 aa, Homo Sapiens
VFILVLKRF

SEQ ID NO: 876289 - protein, 9 aa, Homo Sapiens
LSLSEKNNL

SEQ ID NO: 876290 - protein, 9 aa, Homo Sapiens
MEKICFKSL

SEQ ID NO: 876291 - protein, 9 aa, Homo Sapiens
LIRQIECLP

SEQ ID NO: 876292 - protein, 9 aa, Homo Sapiens
SENMLLQQQ

SEQ ID NO: 876293 - protein, 9 aa, Homo Sapiens
RDGPFGLSP

SEQ ID NO: 876294 - protein, 9 aa, Homo Sapiens
VPEKMRHEL

SEQ ID NO: 876295 - protein, 9 aa, Homo Sapiens
SNIEPSVCS

SEQ ID NO: 876296 - protein, 9 aa, Homo Sapiens
RQHYRNELV

SEQ ID NO: 876297 - protein, 9 aa, Homo Sapiens
DNATASSNP

SEQ ID NO: 876298 - protein, 9 aa, Homo Sapiens
TSADRFYQI

SEQ ID NO: 876299 - protein, 9 aa, Homo Sapiens
AGFKASKSQ

SEQ ID NO: 876300 - protein, 9 aa, Homo Sapiens
VTYENLKFQ

SEQ ID NO: 876301 - protein, 9 aa, Homo Sapiens
LSFHGRHSS

SEQ ID NO: 876302 - protein, 9 aa, Homo Sapiens
LPIREEDHS

SEQ ID NO: 876303 - protein, 9 aa, Homo Sapiens
CRRHFTPED

SEQ ID NO: 876304 - protein, 9 aa, Homo Sapiens
NNIWKALSF

SEQ ID NO: 876305 - protein, 9 aa, Homo Sapiens
WSKKRRHQR

SEQ ID NO: 876306 - protein, 9 aa, Homo Sapiens
PPFKTFSQG

SEQ ID NO: 876307 - protein, 9 aa, Homo Sapiens
SFIHPPTDQ

SEQ ID NO: 876308 - protein, 9 aa, Homo Sapiens
AKVKEEPPI

SEQ ID NO: 876309 - protein, 9 aa, Homo Sapiens
EISNTIEQL

SEQ ID NO: 876310 - protein, 9 aa, Homo Sapiens
FKASKSQLQ

SEQ ID NO: 876311 - protein, 9 aa, Homo Sapiens
VLLLHCGPW

SEQ ID NO: 876312 - protein, 9 aa, Homo Sapiens
LQNRPRKHR

SEQ ID NO: 876313 - protein, 9 aa, Homo Sapiens
SSNRKDKYN

SEQ ID NO: 876314 - protein, 9 aa, Homo Sapiens
KRLHINMEA

SEQ ID NO: 876315 - protein, 9 aa, Homo Sapiens
KSWHRLKHK

SEQ ID NO: 876316 - protein, 9 aa, Homo Sapiens
LTLVPVEDD

SEQ ID NO: 876317 - protein, 9 aa, Homo Sapiens
MDNYLSKMQ

SEQ ID NO: 876318 - protein, 9 aa, Homo Sapiens
QILLLGTAV

SEQ ID NO: 876319 - protein, 9 aa, Homo Sapiens
QTEQEERRK

SEQ ID NO: 876320 - protein, 9 aa, Homo Sapiens
ATYIHLGFM

SEQ ID NO: 876321 - protein, 9 aa, Homo Sapiens
DPQHEIIIT

SEQ ID NO: 876322 - protein, 9 aa, Homo Sapiens
AQTTAGCNY

SEQ ID NO: 876323 - protein, 9 aa, Homo Sapiens
DLGGSNSQV

SEQ ID NO: 876324 - protein, 9 aa, Homo Sapiens
PKVPAIEEK

SEQ ID NO: 876325 - protein, 9 aa, Homo Sapiens
EKTTKSKIT

SEQ ID NO: 876326 - protein, 9 aa, Homo Sapiens
GQPRTAPLK

SEQ ID NO: 876327 - protein, 9 aa, Homo Sapiens
VYRRVLCMY

SEQ ID NO: 876328 - protein, 9 aa, Homo Sapiens
CIAHSNVGI

SEQ ID NO: 876329 - protein, 9 aa, Homo Sapiens
SYLNSFQTH

SEQ ID NO: 876330 - protein, 9 aa, Homo Sapiens
NPCELYQVM

SEQ ID NO: 876331 - protein, 9 aa, Homo Sapiens
LPTVLPTNV

SEQ ID NO: 876332 - protein, 9 aa, Homo Sapiens
TEFQGKQMH

SEQ ID NO: 876333 - protein, 9 aa, Homo Sapiens
VLPGLTSHA

SEQ ID NO: 876334 - protein, 9 aa, Homo Sapiens
YPGPMSAAF

SEQ ID NO: 876335 - protein, 9 aa, Homo Sapiens
RYLKPENLI

SEQ ID NO: 876336 - protein, 9 aa, Homo Sapiens
QLPAADGVA

SEQ ID NO: 876337 - protein, 9 aa, Homo Sapiens
PQKLWLGTT

SEQ ID NO: 876338 - protein, 9 aa, Homo Sapiens
HYQNQRFRS

SEQ ID NO: 876339 - protein, 9 aa, Homo Sapiens
FSHAIAMQH

SEQ ID NO: 876340 - protein, 9 aa, Homo Sapiens
VQSYDPKTN

SEQ ID NO: 876341 - protein, 9 aa, Homo Sapiens
IDSFKPPQQ

SEQ ID NO: 876342 - protein, 9 aa, Homo Sapiens
ELDKFANQI

SEQ ID NO: 876343 - protein, 9 aa, Homo Sapiens
PVHRHYKHF

SEQ ID NO: 876344 - protein, 9 aa, Homo Sapiens
HSSIASGET

SEQ ID NO: 876345 - protein, 9 aa, Homo Sapiens
CVGEKNQRL

SEQ ID NO: 876346 - protein, 9 aa, Homo Sapiens
NNNVPATYT

SEQ ID NO: 876347 - protein, 9 aa, Homo Sapiens
LKSRSVKLM

SEQ ID NO: 876348 - protein, 9 aa, Homo Sapiens
IVCVLNLWQ

SEQ ID NO: 876349 - protein, 9 aa, Homo Sapiens
KSHLQIHTG

SEQ ID NO: 876350 - protein, 9 aa, Homo Sapiens
LDMRNLYQE

SEQ ID NO: 876351 - protein, 9 aa, Homo Sapiens
GATSSSGTS

SEQ ID NO: 876352 - protein, 9 aa, Homo Sapiens
TKMDLLYSK

SEQ ID NO: 876353 - protein, 9 aa, Homo Sapiens
LIESTAKFT

SEQ ID NO: 876354 - protein, 9 aa, Homo Sapiens
TIRTVRARR

SEQ ID NO: 876355 - protein, 9 aa, Homo Sapiens
QLINLSTTL

SEQ ID NO: 876356 - protein, 9 aa, Homo Sapiens
HFDLAVNKT

SEQ ID NO: 876357 - protein, 9 aa, Homo Sapiens
MCVKMICRV

SEQ ID NO: 876358 - protein, 9 aa, Homo Sapiens
IPLFAPPAP

SEQ ID NO: 876359 - protein, 9 aa, Homo Sapiens
ETCRGQVLL

SEQ ID NO: 876360 - protein, 9 aa, Homo Sapiens
DGSKSVRPD

SEQ ID NO: 876361 - protein, 9 aa, Homo Sapiens
LSNVKSFYQ

SEQ ID NO: 876362 - protein, 9 aa, Homo Sapiens
LKTLSFLFN

SEQ ID NO: 876363 - protein, 9 aa, Homo Sapiens
AKDAGQITT

SEQ ID NO: 876364 - protein, 9 aa, Homo Sapiens
SQFRGPQAL

SEQ ID NO: 876365 - protein, 9 aa, Homo Sapiens
ILLCILRHF

SEQ ID NO: 876366 - protein, 9 aa, Homo Sapiens
ISLSPRRSP

SEQ ID NO: 876367 - protein, 9 aa, Homo Sapiens
CLSGFLKFC

SEQ ID NO: 876368 - protein, 9 aa, Homo Sapiens
PTARSPVTV

SEQ ID NO: 876369 - protein, 9 aa, Homo Sapiens
HDLDHFDKL

SEQ ID NO: 876370 - protein, 9 aa, Homo Sapiens
CTLGQIVFQ

SEQ ID NO: 876371 - protein, 9 aa, Homo Sapiens
LENTSDLLR

SEQ ID NO: 876372 - protein, 9 aa, Homo Sapiens
IAGSLIINK

SEQ ID NO: 876373 - protein, 9 aa, Homo Sapiens
LLVVHQQTH

SEQ ID NO: 876374 - protein, 9 aa, Homo Sapiens
NSWKASLLR

SEQ ID NO: 876375 - protein, 9 aa, Homo Sapiens
CQLFPSWHR

SEQ ID NO: 876376 - protein, 9 aa, Homo Sapiens
SVGKLLGPR

SEQ ID NO: 876377 - protein, 9 aa, Homo Sapiens
CDVVKGKQM

SEQ ID NO: 876378 - protein, 9 aa, Homo Sapiens
YVGGEVYVE

SEQ ID NO: 876379 - protein, 9 aa, Homo Sapiens
KPQELKEIE

SEQ ID NO: 876380 - protein, 9 aa, Homo Sapiens
EKKPLVKRD

SEQ ID NO: 876381 - protein, 9 aa, Homo Sapiens
LLFINHCLV

SEQ ID NO: 876382 - protein, 9 aa, Homo Sapiens
DKDEDEDGS

SEQ ID NO: 876383 - protein, 9 aa, Homo Sapiens
AALIINKTI

SEQ ID NO: 876384 - protein, 9 aa, Homo Sapiens
GTAFQTWMD

SEQ ID NO: 876385 - protein, 9 aa, Homo Sapiens
RSPAEVKIL

SEQ ID NO: 876386 - protein, 9 aa, Homo Sapiens
AHRQIMLLN

SEQ ID NO: 876387 - protein, 9 aa, Homo Sapiens
RQGLKRKSL

SEQ ID NO: 876388 - protein, 9 aa, Homo Sapiens
CLTVEQAVL

SEQ ID NO: 876389 - protein, 9 aa, Homo Sapiens
LKPDNQTSL

SEQ ID NO: 876390 - protein, 9 aa, Homo Sapiens
LCTKMAFIC

SEQ ID NO: 876391 - protein, 9 aa, Homo Sapiens
KTLSDYEVA

SEQ ID NO: 876392 - protein, 9 aa, Homo Sapiens
LIAVEEERQ

SEQ ID NO: 876393 - protein, 9 aa, Homo Sapiens
ASTIRTSSA

SEQ ID NO: 876394 - protein, 9 aa, Homo Sapiens
SLETLCTPS

SEQ ID NO: 876395 - protein, 9 aa, Homo Sapiens
FVLLVWDPA

SEQ ID NO: 876396 - protein, 9 aa, Homo Sapiens
FDFGPHDNS

SEQ ID NO: 876397 - protein, 9 aa, Homo Sapiens
PTNFQQLYR

SEQ ID NO: 876398 - protein, 9 aa, Homo Sapiens
QIHQFDYGE

SEQ ID NO: 876399 - protein, 9 aa, Homo Sapiens
KEAEKQEDK

SEQ ID NO: 876400 - protein, 9 aa, Homo Sapiens
LRMLQSENK

SEQ ID NO: 876401 - protein, 9 aa, Homo Sapiens
IEAIWLYLG

SEQ ID NO: 876402 - protein, 9 aa, Homo Sapiens
CYDELLAYG

SEQ ID NO: 876403 - protein, 9 aa, Homo Sapiens
TKLSTQVKG

SEQ ID NO: 876404 - protein, 9 aa, Homo Sapiens
FVFSVLIEF

SEQ ID NO: 876405 - protein, 9 aa, Homo Sapiens
NTKIGKIRD

SEQ ID NO: 876406 - protein, 9 aa, Homo Sapiens
KRKNKLPDS

SEQ ID NO: 876407 - protein, 9 aa, Homo Sapiens
DSTNVASTI

SEQ ID NO: 876408 - protein, 9 aa, Homo Sapiens
NNFLNFLPE

SEQ ID NO: 876409 - protein, 9 aa, Homo Sapiens
CSYSVGISV

SEQ ID NO: 876410 - protein, 9 aa, Homo Sapiens
QHTGLHTGD

SEQ ID NO: 876411 - protein, 9 aa, Homo Sapiens
LVLQDFIGV

SEQ ID NO: 876412 - protein, 9 aa, Homo Sapiens
EHLRKYLAL

SEQ ID NO: 876413 - protein, 9 aa, Homo Sapiens
LEIFNVISG

SEQ ID NO: 876414 - protein, 9 aa, Homo Sapiens
GILENTSDL

SEQ ID NO: 876415 - protein, 9 aa, Homo Sapiens
YSTPRCTQQ

SEQ ID NO: 876416 - protein, 9 aa, Homo Sapiens
ACQQFCVRD

SEQ ID NO: 876417 - protein, 9 aa, Homo Sapiens
IKKCSELYE

SEQ ID NO: 876418 - protein, 9 aa, Homo Sapiens
GDPDHKAST

SEQ ID NO: 876419 - protein, 9 aa, Homo Sapiens
EKECIEGTL

SEQ ID NO: 876420 - protein, 9 aa, Homo Sapiens
LPCSICKHK

SEQ ID NO: 876421 - protein, 9 aa, Homo Sapiens
RAIQRLQGE

SEQ ID NO: 876422 - protein, 9 aa, Homo Sapiens
SCLYAGGLG

SEQ ID NO: 876423 - protein, 9 aa, Homo Sapiens
DYISQGENP

SEQ ID NO: 876424 - protein, 9 aa, Homo Sapiens
GPFNLVYGA

SEQ ID NO: 876425 - protein, 9 aa, Homo Sapiens
AGRNKHGHK

SEQ ID NO: 876426 - protein, 9 aa, Homo Sapiens
SKLATCPLN

SEQ ID NO: 876427 - protein, 9 aa, Homo Sapiens
ISHKRSHTR

SEQ ID NO: 876428 - protein, 9 aa, Homo Sapiens
TALDGGNPP

SEQ ID NO: 876429 - protein, 9 aa, Homo Sapiens
SEAQLQEIW

SEQ ID NO: 876430 - protein, 9 aa, Homo Sapiens
YFIIINCGA

SEQ ID NO: 876431 - protein, 9 aa, Homo Sapiens
TSFMSVNPS

SEQ ID NO: 876432 - protein, 9 aa, Homo Sapiens
FKSYNPDKL

SEQ ID NO: 876433 - protein, 9 aa, Homo Sapiens
GLLARRLQN

SEQ ID NO: 876434 - protein, 9 aa, Homo Sapiens
IQELDKFAN

SEQ ID NO: 876435 - protein, 9 aa, Homo Sapiens
SPKFVCEGC

SEQ ID NO: 876436 - protein, 9 aa, Homo Sapiens
GGARQSVIG

SEQ ID NO: 876437 - protein, 9 aa, Homo Sapiens
TPKMICDIF

SEQ ID NO: 876438 - protein, 9 aa, Homo Sapiens
TKILHSLLN

SEQ ID NO: 876439 - protein, 9 aa, Homo Sapiens
ASNNSMDNY

SEQ ID NO: 876440 - protein, 9 aa, Homo Sapiens
IHIPQIDVH

SEQ ID NO: 876441 - protein, 9 aa, Homo Sapiens
WEVLPGNRR

SEQ ID NO: 876442 - protein, 9 aa, Homo Sapiens
SYFGVIPPP

SEQ ID NO: 876443 - protein, 9 aa, Homo Sapiens
EEKVATHAP

SEQ ID NO: 876444 - protein, 9 aa, Homo Sapiens
PVWEPNDPS

SEQ ID NO: 876445 - protein, 9 aa, Homo Sapiens
GKIEDLQQW

SEQ ID NO: 876446 - protein, 9 aa, Homo Sapiens
KEGHYSLYL

SEQ ID NO: 876447 - protein, 9 aa, Homo Sapiens
EAALIINKT

SEQ ID NO: 876448 - protein, 9 aa, Homo Sapiens
NKGKECRDL

SEQ ID NO: 876449 - protein, 9 aa, Homo Sapiens
LQNMGKEDA

SEQ ID NO: 876450 - protein, 9 aa, Homo Sapiens
NAQINKLPI

SEQ ID NO: 876451 - protein, 9 aa, Homo Sapiens
GTQYTLSVT

SEQ ID NO: 876452 - protein, 9 aa, Homo Sapiens
PCLGTEKQP

SEQ ID NO: 876453 - protein, 9 aa, Homo Sapiens
GREGGGCSD

SEQ ID NO: 876454 - protein, 9 aa, Homo Sapiens
GNIQEQVFF

SEQ ID NO: 876455 - protein, 9 aa, Homo Sapiens
QEDIRDLLS

SEQ ID NO: 876456 - protein, 9 aa, Homo Sapiens
LIGEQLHVN

SEQ ID NO: 876457 - protein, 9 aa, Homo Sapiens
NFFLYSLNQ

SEQ ID NO: 876458 - protein, 9 aa, Homo Sapiens
RETGTLLMD

SEQ ID NO: 876459 - protein, 9 aa, Homo Sapiens
EKCEGFKLH

SEQ ID NO: 876460 - protein, 9 aa, Homo Sapiens
GRHKEIQDL

SEQ ID NO: 876461 - protein, 9 aa, Homo Sapiens
IHRVLSQPG

SEQ ID NO: 876462 - protein, 9 aa, Homo Sapiens
EDLKADKPS

SEQ ID NO: 876463 - protein, 9 aa, Homo Sapiens
PFRSLEAID

SEQ ID NO: 876464 - protein, 9 aa, Homo Sapiens
GTLTHGDRR

SEQ ID NO: 876465 - protein, 9 aa, Homo Sapiens
YTRNLYMQI

SEQ ID NO: 876466 - protein, 9 aa, Homo Sapiens
QPGGASGPG

SEQ ID NO: 876467 - protein, 9 aa, Homo Sapiens
YHTETDEKQ

SEQ ID NO: 876468 - protein, 9 aa, Homo Sapiens
VLAYVLASR

SEQ ID NO: 876469 - protein, 9 aa, Homo Sapiens
ETVTYENLK

SEQ ID NO: 876470 - protein, 9 aa, Homo Sapiens
PTCRNQTRH

SEQ ID NO: 876471 - protein, 9 aa, Homo Sapiens
VPQNASQKE

SEQ ID NO: 876472 - protein, 9 aa, Homo Sapiens
KSMLDAEPD

SEQ ID NO: 876473 - protein, 9 aa, Homo Sapiens
YSGSCPEDK

SEQ ID NO: 876474 - protein, 9 aa, Homo Sapiens
PTTKLNSIN

SEQ ID NO: 876475 - protein, 9 aa, Homo Sapiens
SPRRIPKKG

SEQ ID NO: 876476 - protein, 9 aa, Homo Sapiens
AEVQVCLQF

SEQ ID NO: 876477 - protein, 9 aa, Homo Sapiens
SAYPVRPEL

SEQ ID NO: 876478 - protein, 9 aa, Homo Sapiens
NLSQNQLSA

SEQ ID NO: 876479 - protein, 9 aa, Homo Sapiens
NKELSLICA

SEQ ID NO: 876480 - protein, 9 aa, Homo Sapiens
RRIKRLCNP

SEQ ID NO: 876481 - protein, 9 aa, Homo Sapiens
SPNDTRLSP

SEQ ID NO: 876482 - protein, 9 aa, Homo Sapiens
KPESKVECT

SEQ ID NO: 876483 - protein, 9 aa, Homo Sapiens
SFDVENGPV

SEQ ID NO: 876484 - protein, 9 aa, Homo Sapiens
DNRIYGGSS

SEQ ID NO: 876485 - protein, 9 aa, Homo Sapiens
FGTASYLIC

SEQ ID NO: 876486 - protein, 9 aa, Homo Sapiens
HKLKTVEEK

SEQ ID NO: 876487 - protein, 9 aa, Homo Sapiens
NKGETSRTP

SEQ ID NO: 876488 - protein, 9 aa, Homo Sapiens
PGSRYDNLV

SEQ ID NO: 876489 - protein, 9 aa, Homo Sapiens
MEEGKYSEI

SEQ ID NO: 876490 - protein, 9 aa, Homo Sapiens
SQKSILYDH

SEQ ID NO: 876491 - protein, 9 aa, Homo Sapiens
TQFTSQFLS

SEQ ID NO: 876492 - protein, 9 aa, Homo Sapiens
PPVVTTLHS

SEQ ID NO: 876493 - protein, 9 aa, Homo Sapiens
VVSIIMFCL

SEQ ID NO: 876494 - protein, 9 aa, Homo Sapiens
PVTRASKGF

SEQ ID NO: 876495 - protein, 9 aa, Homo Sapiens
ELTVGKSIV

SEQ ID NO: 876496 - protein, 9 aa, Homo Sapiens
TGKENKGET

SEQ ID NO: 876497 - protein, 9 aa, Homo Sapiens
YTSSELQRL

SEQ ID NO: 876498 - protein, 9 aa, Homo Sapiens
AQINKLPIE

SEQ ID NO: 876499 - protein, 9 aa, Homo Sapiens
DIDLLIEEI

SEQ ID NO: 876500 - protein, 9 aa, Homo Sapiens
IPLSQAKVI

SEQ ID NO: 876501 - protein, 9 aa, Homo Sapiens
LETFGNAKT

SEQ ID NO: 876502 - protein, 9 aa, Homo Sapiens
HLFCSSGTG

SEQ ID NO: 876503 - protein, 9 aa, Homo Sapiens
QIEDLQGQT

SEQ ID NO: 876504 - protein, 9 aa, Homo Sapiens
LRELFVDDF

SEQ ID NO: 876505 - protein, 9 aa, Homo Sapiens
EITHIGEKP

SEQ ID NO: 876506 - protein, 9 aa, Homo Sapiens
YFNDTLVVL

SEQ ID NO: 876507 - protein, 9 aa, Homo Sapiens
EVKTLNVGR

SEQ ID NO: 876508 - protein, 9 aa, Homo Sapiens
SQFDKFVRF

SEQ ID NO: 876509 - protein, 9 aa, Homo Sapiens
ALSISPLLD

SEQ ID NO: 876510 - protein, 9 aa, Homo Sapiens
RLHINMEAK

SEQ ID NO: 876511 - protein, 9 aa, Homo Sapiens
QSELERIFE

SEQ ID NO: 876512 - protein, 9 aa, Homo Sapiens
YPNTALKLR

SEQ ID NO: 876513 - protein, 9 aa, Homo Sapiens
YANYSYASS

SEQ ID NO: 876514 - protein, 9 aa, Homo Sapiens
ITLSYVQIC

SEQ ID NO: 876515 - protein, 9 aa, Homo Sapiens
QIRIETRQA

SEQ ID NO: 876516 - protein, 9 aa, Homo Sapiens
LLALKEVFN

SEQ ID NO: 876517 - protein, 9 aa, Homo Sapiens
YIIQKGEIK

SEQ ID NO: 876518 - protein, 9 aa, Homo Sapiens
PQNTSRLPL

SEQ ID NO: 876519 - protein, 9 aa, Homo Sapiens
RLESLGTLT

SEQ ID NO: 876520 - protein, 9 aa, Homo Sapiens
GVIVYQITT

SEQ ID NO: 876521 - protein, 9 aa, Homo Sapiens
SSQTKVLSS

SEQ ID NO: 876522 - protein, 9 aa, Homo Sapiens
IATATQSNI

SEQ ID NO: 876523 - protein, 9 aa, Homo Sapiens
VTVTCDPPP

SEQ ID NO: 876524 - protein, 9 aa, Homo Sapiens
KISKEFLTK

SEQ ID NO: 876525 - protein, 9 aa, Homo Sapiens
PVAQISAGT

SEQ ID NO: 876526 - protein, 9 aa, Homo Sapiens
LLRITAFCC

SEQ ID NO: 876527 - protein, 9 aa, Homo Sapiens
FCEFKLSKV

SEQ ID NO: 876528 - protein, 9 aa, Homo Sapiens
YKQDGGLEN

SEQ ID NO: 876529 - protein, 9 aa, Homo Sapiens
LYLENSFSN

SEQ ID NO: 876530 - protein, 9 aa, Homo Sapiens
ANYSKTFTT

SEQ ID NO: 876531 - protein, 9 aa, Homo Sapiens
SYIKYWLSE

SEQ ID NO: 876532 - protein, 9 aa, Homo Sapiens
QLNLEDKDI

SEQ ID NO: 876533 - protein, 9 aa, Homo Sapiens
SYSLYTDKV

SEQ ID NO: 876534 - protein, 9 aa, Homo Sapiens
VNNLAVEKR

SEQ ID NO: 876535 - protein, 9 aa, Homo Sapiens
SWNQFSTMS

SEQ ID NO: 876536 - protein, 9 aa, Homo Sapiens
GKFILHVFQ

SEQ ID NO: 876537 - protein, 9 aa, Homo Sapiens
KDYLRELSQ

SEQ ID NO: 876538 - protein, 9 aa, Homo Sapiens
KNKNYLIEM

SEQ ID NO: 876539 - protein, 9 aa, Homo Sapiens
EAFQIIRGN

SEQ ID NO: 876540 - protein, 9 aa, Homo Sapiens
NEAGGRGCG

SEQ ID NO: 876541 - protein, 9 aa, Homo Sapiens
KKKIKRGIK

SEQ ID NO: 876542 - protein, 9 aa, Homo Sapiens
LQDKHNSID

SEQ ID NO: 876543 - protein, 9 aa, Homo Sapiens
GQKRKQSTQ

SEQ ID NO: 876544 - protein, 9 aa, Homo Sapiens
IELFIYLPF

SEQ ID NO: 876545 - protein, 9 aa, Homo Sapiens
NPEEIEKEE

SEQ ID NO: 876546 - protein, 9 aa, Homo Sapiens
VVFNKIGNA

SEQ ID NO: 876547 - protein, 9 aa, Homo Sapiens
RDNQDNTAG

SEQ ID NO: 876548 - protein, 9 aa, Homo Sapiens
RNLYIKNGQ

SEQ ID NO: 876549 - protein, 9 aa, Homo Sapiens
TITVVYAQG

SEQ ID NO: 876550 - protein, 9 aa, Homo Sapiens
QIFQFQNFT

SEQ ID NO: 876551 - protein, 9 aa, Homo Sapiens
YCGIWQLYH

SEQ ID NO: 876552 - protein, 9 aa, Homo Sapiens
AATGQEVKL

SEQ ID NO: 876553 - protein, 9 aa, Homo Sapiens
RHRRQRKQR

SEQ ID NO: 876554 - protein, 9 aa, Homo Sapiens
HYQRAKTYF

SEQ ID NO: 876555 - protein, 9 aa, Homo Sapiens
DGMRRKAFW

SEQ ID NO: 876556 - protein, 9 aa, Homo Sapiens
LLVLGIVGF

SEQ ID NO: 876557 - protein, 9 aa, Homo Sapiens
PSNAQDLPQ

SEQ ID NO: 876558 - protein, 9 aa, Homo Sapiens
LCCWTFVSK

SEQ ID NO: 876559 - protein, 9 aa, Homo Sapiens
AQSQLTATS

SEQ ID NO: 876560 - protein, 9 aa, Homo Sapiens
PSMGIKEVA

SEQ ID NO: 876561 - protein, 9 aa, Homo Sapiens
LEVQEETAW

SEQ ID NO: 876562 - protein, 9 aa, Homo Sapiens
IWRFQPNTR

SEQ ID NO: 876563 - protein, 9 aa, Homo Sapiens
LQEVRCGIE

SEQ ID NO: 876564 - protein, 9 aa, Homo Sapiens
PHLRLASLW

SEQ ID NO: 876565 - protein, 9 aa, Homo Sapiens
WLRNNPIKS

SEQ ID NO: 876566 - protein, 9 aa, Homo Sapiens
CGEWPWQVT

SEQ ID NO: 876567 - protein, 9 aa, Homo Sapiens
PNSSASKFL

SEQ ID NO: 876568 - protein, 9 aa, Homo Sapiens
RQLYDDRNE

SEQ ID NO: 876569 - protein, 9 aa, Homo Sapiens
QLLLPVLDI

SEQ ID NO: 876570 - protein, 9 aa, Homo Sapiens
WPMRSCLYA

SEQ ID NO: 876571 - protein, 9 aa, Homo Sapiens
FFSVKTHTF

SEQ ID NO: 876572 - protein, 9 aa, Homo Sapiens
DSIGLAGEW

SEQ ID NO: 876573 - protein, 9 aa, Homo Sapiens
DKCLMGAHD

SEQ ID NO: 876574 - protein, 9 aa, Homo Sapiens
LTADSQKSH

SEQ ID NO: 876575 - protein, 9 aa, Homo Sapiens
IWNCEAPYI

SEQ ID NO: 876576 - protein, 9 aa, Homo Sapiens
CNDIDEGND

SEQ ID NO: 876577 - protein, 9 aa, Homo Sapiens
DTTSVSVYG

SEQ ID NO: 876578 - protein, 9 aa, Homo Sapiens
SSSKSRAFI

SEQ ID NO: 876579 - protein, 9 aa, Homo Sapiens
RVQLSRHKL

SEQ ID NO: 876580 - protein, 9 aa, Homo Sapiens
GKTNKQSPH

SEQ ID NO: 876581 - protein, 9 aa, Homo Sapiens
GAVHKFLAS

SEQ ID NO: 876582 - protein, 9 aa, Homo Sapiens
NLLISNVAD

SEQ ID NO: 876583 - protein, 9 aa, Homo Sapiens
VRPFPLNQQ

SEQ ID NO: 876584 - protein, 9 aa, Homo Sapiens
TLRSLQELD

SEQ ID NO: 876585 - protein, 9 aa, Homo Sapiens
EDSHWEQDI

SEQ ID NO: 876586 - protein, 9 aa, Homo Sapiens
AMVNKLHCL

SEQ ID NO: 876587 - protein, 9 aa, Homo Sapiens
ITRHCCQCR

SEQ ID NO: 876588 - protein, 9 aa, Homo Sapiens
CLCQQHDDF

SEQ ID NO: 876589 - protein, 9 aa, Homo Sapiens
DFFLDEANG

SEQ ID NO: 876590 - protein, 9 aa, Homo Sapiens
RAISVGSGL

SEQ ID NO: 876591 - protein, 9 aa, Homo Sapiens
RKQIVGGKR

SEQ ID NO: 876592 - protein, 9 aa, Homo Sapiens
NNIDVNEIS

SEQ ID NO: 876593 - protein, 9 aa, Homo Sapiens
QALKEHLKR

SEQ ID NO: 876594 - protein, 9 aa, Homo Sapiens
SLKNKLGQM

SEQ ID NO: 876595 - protein, 9 aa, Homo Sapiens
PSRGGTLLF

SEQ ID NO: 876596 - protein, 9 aa, Homo Sapiens
VPEGPFSRH

SEQ ID NO: 876597 - protein, 9 aa, Homo Sapiens
GPGGATGPK

SEQ ID NO: 876598 - protein, 9 aa, Homo Sapiens
DFLGMACGL

SEQ ID NO: 876599 - protein, 9 aa, Homo Sapiens
SSGPSTSQL

SEQ ID NO: 876600 - protein, 9 aa, Homo Sapiens
RYQSDPNLA

SEQ ID NO: 876601 - protein, 9 aa, Homo Sapiens
ILQPLGMEP

SEQ ID NO: 876602 - protein, 9 aa, Homo Sapiens
VMELMDANI

SEQ ID NO: 876603 - protein, 9 aa, Homo Sapiens
ADGIWLYNS

SEQ ID NO: 876604 - protein, 9 aa, Homo Sapiens
LIKVGSFKV

SEQ ID NO: 876605 - protein, 9 aa, Homo Sapiens
VNYFIEKEN

SEQ ID NO: 876606 - protein, 9 aa, Homo Sapiens
KHCRTVTQQ

SEQ ID NO: 876607 - protein, 9 aa, Homo Sapiens
CRDLDDLKK

SEQ ID NO: 876608 - protein, 9 aa, Homo Sapiens
ITGNCDGFN

SEQ ID NO: 876609 - protein, 9 aa, Homo Sapiens
KEYCGIWQL

SEQ ID NO: 876610 - protein, 9 aa, Homo Sapiens
ANICQVIQM

SEQ ID NO: 876611 - protein, 9 aa, Homo Sapiens
MFPSITPFV

SEQ ID NO: 876612 - protein, 9 aa, Homo Sapiens
HHWHMKHFC

SEQ ID NO: 876613 - protein, 9 aa, Homo Sapiens
YLFLGGLAV

SEQ ID NO: 876614 - protein, 9 aa, Homo Sapiens
RLKCIAIDN

SEQ ID NO: 876615 - protein, 9 aa, Homo Sapiens
QWKTFEEEN

SEQ ID NO: 876616 - protein, 9 aa, Homo Sapiens
LLMRIGNKE

SEQ ID NO: 876617 - protein, 9 aa, Homo Sapiens
VKGNLRKTG

SEQ ID NO: 876618 - protein, 9 aa, Homo Sapiens
EEVKCTPSP

SEQ ID NO: 876619 - protein, 9 aa, Homo Sapiens
YKHHLKKHL

SEQ ID NO: 876620 - protein, 9 aa, Homo Sapiens
TFKCFSYLT

SEQ ID NO: 876621 - protein, 9 aa, Homo Sapiens
KIISLSFNT

SEQ ID NO: 876622 - protein, 9 aa, Homo Sapiens
PEWFWGRDV

SEQ ID NO: 876623 - protein, 9 aa, Homo Sapiens
DAECKAHEL

SEQ ID NO: 876624 - protein, 9 aa, Homo Sapiens
IFLPQMNPF

SEQ ID NO: 876625 - protein, 9 aa, Homo Sapiens
STLLCFDSR

SEQ ID NO: 876626 - protein, 9 aa, Homo Sapiens
SAFKKLNNL

SEQ ID NO: 876627 - protein, 9 aa, Homo Sapiens
FASMRNLYI

SEQ ID NO: 876628 - protein, 9 aa, Homo Sapiens
PTVNAQLDG

SEQ ID NO: 876629 - protein, 9 aa, Homo Sapiens
LSSTEYQPR

SEQ ID NO: 876630 - protein, 9 aa, Homo Sapiens
GIMENISDN

SEQ ID NO: 876631 - protein, 9 aa, Homo Sapiens
NSEGKISVK

SEQ ID NO: 876632 - protein, 9 aa, Homo Sapiens
EPDPFKFSS

SEQ ID NO: 876633 - protein, 9 aa, Homo Sapiens
RAANIAEAL

SEQ ID NO: 876634 - protein, 9 aa, Homo Sapiens
DSFKPPQQS

SEQ ID NO: 876635 - protein, 9 aa, Homo Sapiens
NLSRHVCSH

SEQ ID NO: 876636 - protein, 9 aa, Homo Sapiens
QLEGLLCDV

SEQ ID NO: 876637 - protein, 9 aa, Homo Sapiens
KGEIFQIIN

SEQ ID NO: 876638 - protein, 9 aa, Homo Sapiens
LITDTYKTI

SEQ ID NO: 876639 - protein, 9 aa, Homo Sapiens
GIENIKNKI

SEQ ID NO: 876640 - protein, 9 aa, Homo Sapiens
LTKATDVYI

SEQ ID NO: 876641 - protein, 9 aa, Homo Sapiens
KVKVYKTDN

SEQ ID NO: 876642 - protein, 9 aa, Homo Sapiens
YYQSGGKIW

SEQ ID NO: 876643 - protein, 9 aa, Homo Sapiens
NQRQKQKIM

SEQ ID NO: 876644 - protein, 9 aa, Homo Sapiens
GLELKTINY

SEQ ID NO: 876645 - protein, 9 aa, Homo Sapiens
VSSVVNNSQ

SEQ ID NO: 876646 - protein, 9 aa, Homo Sapiens
GEEECRPQP

SEQ ID NO: 876647 - protein, 9 aa, Homo Sapiens
GLRQREVLW

SEQ ID NO: 876648 - protein, 9 aa, Homo Sapiens
NLALKNGAG

SEQ ID NO: 876649 - protein, 9 aa, Homo Sapiens
NKSSEMGIE

SEQ ID NO: 876650 - protein, 9 aa, Homo Sapiens
SIVMGSGQV

SEQ ID NO: 876651 - protein, 9 aa, Homo Sapiens
MARKKPQNT

SEQ ID NO: 876652 - protein, 9 aa, Homo Sapiens
TVHGLYKDH

SEQ ID NO: 876653 - protein, 9 aa, Homo Sapiens
RIPKKGLIK

SEQ ID NO: 876654 - protein, 9 aa, Homo Sapiens
IERCCKLDV

SEQ ID NO: 876655 - protein, 9 aa, Homo Sapiens
QYRNAYVWA

SEQ ID NO: 876656 - protein, 9 aa, Homo Sapiens
NFVEEKLGS

SEQ ID NO: 876657 - protein, 9 aa, Homo Sapiens
VGKWMNKFS

SEQ ID NO: 876658 - protein, 9 aa, Homo Sapiens
RCQNEKKRH

SEQ ID NO: 876659 - protein, 9 aa, Homo Sapiens
SSDEEKVIC

SEQ ID NO: 876660 - protein, 9 aa, Homo Sapiens
DLQNNKITK

SEQ ID NO: 876661 - protein, 9 aa, Homo Sapiens
NEPWNIYIS

SEQ ID NO: 876662 - protein, 9 aa, Homo Sapiens
LLVFADMQE

SEQ ID NO: 876663 - protein, 9 aa, Homo Sapiens
LLSADWPTV

SEQ ID NO: 876664 - protein, 9 aa, Homo Sapiens
SVEEKNKIG

SEQ ID NO: 876665 - protein, 9 aa, Homo Sapiens
QKGTKKYPD

SEQ ID NO: 876666 - protein, 9 aa, Homo Sapiens
RLLDMRNLY

SEQ ID NO: 876667 - protein, 9 aa, Homo Sapiens
RRMPGKVRR

SEQ ID NO: 876668 - protein, 9 aa, Homo Sapiens
KISVKNFFQ

SEQ ID NO: 876669 - protein, 9 aa, Homo Sapiens
PNKSHGSCA

SEQ ID NO: 876670 - protein, 9 aa, Homo Sapiens
EEGPPHTNN

SEQ ID NO: 876671 - protein, 9 aa, Homo Sapiens
HLLNCIMGM

SEQ ID NO: 876672 - protein, 9 aa, Homo Sapiens
NAQRAGFKA

SEQ ID NO: 876673 - protein, 9 aa, Homo Sapiens
MWSVAHAAI

SEQ ID NO: 876674 - protein, 9 aa, Homo Sapiens
VNTSKTHPK

SEQ ID NO: 876675 - protein, 9 aa, Homo Sapiens
GYTSFYTFS

SEQ ID NO: 876676 - protein, 9 aa, Homo Sapiens
TTNIQIWLA

SEQ ID NO: 876677 - protein, 9 aa, Homo Sapiens
GKFCGKQRP

SEQ ID NO: 876678 - protein, 9 aa, Homo Sapiens
RNIRKNLYV

SEQ ID NO: 876679 - protein, 9 aa, Homo Sapiens
GSVAQKETT

SEQ ID NO: 876680 - protein, 9 aa, Homo Sapiens
PPPAEKNVK

SEQ ID NO: 876681 - protein, 9 aa, Homo Sapiens
HNLHSWHAE

SEQ ID NO: 876682 - protein, 9 aa, Homo Sapiens
LPVFNVLKL

SEQ ID NO: 876683 - protein, 9 aa, Homo Sapiens
AHRIQEQLC

SEQ ID NO: 876684 - protein, 9 aa, Homo Sapiens
RLFFKFYHL

SEQ ID NO: 876685 - protein, 9 aa, Homo Sapiens
DRDTMNFSG

SEQ ID NO: 876686 - protein, 9 aa, Homo Sapiens
SGVKKCCLN

SEQ ID NO: 876687 - protein, 9 aa, Homo Sapiens
SLIINKMLL

SEQ ID NO: 876688 - protein, 9 aa, Homo Sapiens
FFRQSIQKN

SEQ ID NO: 876689 - protein, 9 aa, Homo Sapiens
EVSHPNALE

SEQ ID NO: 876690 - protein, 9 aa, Homo Sapiens
EYYRRFLKD

SEQ ID NO: 876691 - protein, 9 aa, Homo Sapiens
PKEKPPKTT

SEQ ID NO: 876692 - protein, 9 aa, Homo Sapiens
PKHALPVSG

SEQ ID NO: 876693 - protein, 9 aa, Homo Sapiens
HKKLEHRIK

SEQ ID NO: 876694 - protein, 9 aa, Homo Sapiens
KLQNPYSID

SEQ ID NO: 876695 - protein, 9 aa, Homo Sapiens
YTYPARCWC

SEQ ID NO: 876696 - protein, 9 aa, Homo Sapiens
ICQQEMAEK

SEQ ID NO: 876697 - protein, 9 aa, Homo Sapiens
QYIRSEVME

SEQ ID NO: 876698 - protein, 9 aa, Homo Sapiens
LNFLPEEME

SEQ ID NO: 876699 - protein, 9 aa, Homo Sapiens
NTTADEILQ

SEQ ID NO: 876700 - protein, 9 aa, Homo Sapiens
KEEKVATHA

SEQ ID NO: 876701 - protein, 9 aa, Homo Sapiens
VILLAAALQ

SEQ ID NO: 876702 - protein, 9 aa, Homo Sapiens
LCVADFGLS

SEQ ID NO: 876703 - protein, 9 aa, Homo Sapiens
CAFIILLFI

SEQ ID NO: 876704 - protein, 9 aa, Homo Sapiens
WGDTHGDTC

SEQ ID NO: 876705 - protein, 9 aa, Homo Sapiens
SFCTNHEIP

SEQ ID NO: 876706 - protein, 8 aa, Homo Sapiens
SDLGMEEN

SEQ ID NO: 876707 - protein, 9 aa, Homo Sapiens
SSVRWATHI

SEQ ID NO: 876708 - protein, 9 aa, Homo Sapiens
RAMGPAGVG

SEQ ID NO: 876709 - protein, 9 aa, Homo Sapiens
LVKITWSTV

SEQ ID NO: 876710 - protein, 9 aa, Homo Sapiens
DGNYLFLVA

SEQ ID NO: 876711 - protein, 9 aa, Homo Sapiens
KERSTRSAL

SEQ ID NO: 876712 - protein, 9 aa, Homo Sapiens
SPETPKFST

SEQ ID NO: 876713 - protein, 9 aa, Homo Sapiens
YDCFFEKKI

SEQ ID NO: 876714 - protein, 9 aa, Homo Sapiens
AEGHLLACL

SEQ ID NO: 876715 - protein, 9 aa, Homo Sapiens
IKTKVNKHV

SEQ ID NO: 876716 - protein, 9 aa, Homo Sapiens
TLLQDFFNG

SEQ ID NO: 876717 - protein, 9 aa, Homo Sapiens
ADHHYGARP

SEQ ID NO: 876718 - protein, 9 aa, Homo Sapiens
IELKSRSVK

SEQ ID NO: 876719 - protein, 9 aa, Homo Sapiens
ILYIRLSTT

SEQ ID NO: 876720 - protein, 9 aa, Homo Sapiens
QKKPRIKDT

SEQ ID NO: 876721 - protein, 9 aa, Homo Sapiens
VNNIETQLP

SEQ ID NO: 876722 - protein, 9 aa, Homo Sapiens
PRPQDHDTN

SEQ ID NO: 876723 - protein, 9 aa, Homo Sapiens
RNELNAKVC

SEQ ID NO: 876724 - protein, 9 aa, Homo Sapiens
VKELCETNA

SEQ ID NO: 876725 - protein, 9 aa, Homo Sapiens
RKLRHNLDA

SEQ ID NO: 876726 - protein, 9 aa, Homo Sapiens
KVSHQAEYK

SEQ ID NO: 876727 - protein, 9 aa, Homo Sapiens
ITSFQPVQV

SEQ ID NO: 876728 - protein, 9 aa, Homo Sapiens
LLDNSCRKY

SEQ ID NO: 876729 - protein, 9 aa, Homo Sapiens
QLEQEIATY

SEQ ID NO: 876730 - protein, 9 aa, Homo Sapiens
ILTTRQYKL

SEQ ID NO: 876731 - protein, 9 aa, Homo Sapiens
QASLGFKLT

SEQ ID NO: 876732 - protein, 9 aa, Homo Sapiens
KVKYLATLD

SEQ ID NO: 876733 - protein, 9 aa, Homo Sapiens
LAVNGVDYS

SEQ ID NO: 876734 - protein, 9 aa, Homo Sapiens
IIFRHLRRV

SEQ ID NO: 876735 - protein, 9 aa, Homo Sapiens
NRIDWPVGS

SEQ ID NO: 876736 - protein, 9 aa, Homo Sapiens
DQSVTSRKK

SEQ ID NO: 876737 - protein, 9 aa, Homo Sapiens
VDILVTVKN

SEQ ID NO: 876738 - protein, 9 aa, Homo Sapiens
RGSITALGG

SEQ ID NO: 876739 - protein, 9 aa, Homo Sapiens
MLGGSMVLL

SEQ ID NO: 876740 - protein, 9 aa, Homo Sapiens
ADTISKSKL

SEQ ID NO: 876741 - protein, 9 aa, Homo Sapiens
GNVLSSLQG

SEQ ID NO: 876742 - protein, 9 aa, Homo Sapiens
EKQEDKQIG

SEQ ID NO: 876743 - protein, 9 aa, Homo Sapiens
IYQELAQLK

SEQ ID NO: 876744 - protein, 9 aa, Homo Sapiens
AAITADIQD

SEQ ID NO: 876745 - protein, 9 aa, Homo Sapiens
CTEAEGHHW

SEQ ID NO: 876746 - protein, 9 aa, Homo Sapiens
WMERGISVL

SEQ ID NO: 876747 - protein, 9 aa, Homo Sapiens
KYCEDIDEC

SEQ ID NO: 876748 - protein, 9 aa, Homo Sapiens
KMTVNTELL

SEQ ID NO: 876749 - protein, 9 aa, Homo Sapiens
QSAYPQQSP

SEQ ID NO: 876750 - protein, 9 aa, Homo Sapiens
VPDKDGKAN

SEQ ID NO: 876751 - protein, 9 aa, Homo Sapiens
CNICCMNGG

SEQ ID NO: 876752 - protein, 9 aa, Homo Sapiens
KTQVDTQLQ

SEQ ID NO: 876753 - protein, 9 aa, Homo Sapiens
ARHFFLQGD

SEQ ID NO: 876754 - protein, 9 aa, Homo Sapiens
NNDALPLLY

SEQ ID NO: 876755 - protein, 9 aa, Homo Sapiens
PRGNGYRIL

SEQ ID NO: 876756 - protein, 9 aa, Homo Sapiens
ENDSSCHGR

SEQ ID NO: 876757 - protein, 9 aa, Homo Sapiens
SEPDYLKVL

SEQ ID NO: 876758 - protein, 9 aa, Homo Sapiens
MYFKKEDVK

SEQ ID NO: 876759 - protein, 9 aa, Homo Sapiens
AANQKTLYF

SEQ ID NO: 876760 - protein, 9 aa, Homo Sapiens
DFNSNTGGS

SEQ ID NO: 876761 - protein, 9 aa, Homo Sapiens
EAQSLKNKL

SEQ ID NO: 876762 - protein, 9 aa, Homo Sapiens
QSDPNLARY

SEQ ID NO: 876763 - protein, 9 aa, Homo Sapiens
EFQRKGSQM

SEQ ID NO: 876764 - protein, 9 aa, Homo Sapiens
LERLLIENC

SEQ ID NO: 876765 - protein, 9 aa, Homo Sapiens
FPNLDNTSA

SEQ ID NO: 876766 - protein, 9 aa, Homo Sapiens
HKICFPIPT

SEQ ID NO: 876767 - protein, 9 aa, Homo Sapiens
EVLCSLNIN

SEQ ID NO: 876768 - protein, 9 aa, Homo Sapiens
QMLYTNHLT

SEQ ID NO: 876769 - protein, 9 aa, Homo Sapiens
GRVQALRRL

SEQ ID NO: 876770 - protein, 9 aa, Homo Sapiens
TAEPITVKF

SEQ ID NO: 876771 - protein, 9 aa, Homo Sapiens
YVSLAVLQR

SEQ ID NO: 876772 - protein, 9 aa, Homo Sapiens
AKGLLYETA

SEQ ID NO: 876773 - protein, 9 aa, Homo Sapiens
ILKYLDQRL

SEQ ID NO: 876774 - protein, 9 aa, Homo Sapiens
TEPAICALH

SEQ ID NO: 876775 - protein, 9 aa, Homo Sapiens
ARGSQPGIF

SEQ ID NO: 876776 - protein, 9 aa, Homo Sapiens
QQDEESLGG

SEQ ID NO: 876777 - protein, 9 aa, Homo Sapiens
STCRDLVND

SEQ ID NO: 876778 - protein, 9 aa, Homo Sapiens
YPLVGSYSP

SEQ ID NO: 876779 - protein, 9 aa, Homo Sapiens
SDNSLDSLH

SEQ ID NO: 876780 - protein, 9 aa, Homo Sapiens
YLIRNVDTT

SEQ ID NO: 876781 - protein, 9 aa, Homo Sapiens
KDKKKILFS

SEQ ID NO: 876782 - protein, 9 aa, Homo Sapiens
SSPSRDKKP

SEQ ID NO: 876783 - protein, 9 aa, Homo Sapiens
QAMDNHMEL

SEQ ID NO: 876784 - protein, 9 aa, Homo Sapiens
MKLLHGEFS

SEQ ID NO: 876785 - protein, 9 aa, Homo Sapiens
LSQDYSQIQ

SEQ ID NO: 876786 - protein, 9 aa, Homo Sapiens
NVVALWECL

SEQ ID NO: 876787 - protein, 9 aa, Homo Sapiens
ENLPQDYAQ

SEQ ID NO: 876788 - protein, 9 aa, Homo Sapiens
LSSGCDYSK

SEQ ID NO: 876789 - protein, 9 aa, Homo Sapiens
EELGHLVYL

SEQ ID NO: 876790 - protein, 9 aa, Homo Sapiens
ILLQRCEKT

SEQ ID NO: 876791 - protein, 9 aa, Homo Sapiens
NRKIGFAIG

SEQ ID NO: 876792 - protein, 9 aa, Homo Sapiens
CELISQLRT

SEQ ID NO: 876793 - protein, 9 aa, Homo Sapiens
DDHLSRRAD

SEQ ID NO: 876794 - protein, 9 aa, Homo Sapiens
AVHHSSLEN

SEQ ID NO: 876795 - protein, 9 aa, Homo Sapiens
VRNINTLQR

SEQ ID NO: 876796 - protein, 9 aa, Homo Sapiens
FNLRFEERD

SEQ ID NO: 876797 - protein, 9 aa, Homo Sapiens
LSNITNHKI

SEQ ID NO: 876798 - protein, 9 aa, Homo Sapiens
DINKNVQKI

SEQ ID NO: 876799 - protein, 9 aa, Homo Sapiens
TNHLTQEQW

SEQ ID NO: 876800 - protein, 9 aa, Homo Sapiens
LVVIGVLLL

SEQ ID NO: 876801 - protein, 9 aa, Homo Sapiens
SRQYLTICY

SEQ ID NO: 876802 - protein, 9 aa, Homo Sapiens
TEEYEKNKG

SEQ ID NO: 876803 - protein, 9 aa, Homo Sapiens
FSFCDGDCS

SEQ ID NO: 876804 - protein, 9 aa, Homo Sapiens
AQPSATLTA

SEQ ID NO: 876805 - protein, 9 aa, Homo Sapiens
HELNKAYCG

SEQ ID NO: 876806 - protein, 9 aa, Homo Sapiens
DKRIEESSE

SEQ ID NO: 876807 - protein, 9 aa, Homo Sapiens
FQTDLLSLQ

SEQ ID NO: 876808 - protein, 9 aa, Homo Sapiens
AIQNIAAIK

SEQ ID NO: 876809 - protein, 9 aa, Homo Sapiens
RYVTTAEDK

SEQ ID NO: 876810 - protein, 9 aa, Homo Sapiens
SDYKYFYIC

SEQ ID NO: 876811 - protein, 9 aa, Homo Sapiens
LEKLFKDWE

SEQ ID NO: 876812 - protein, 9 aa, Homo Sapiens
NTSPYCLTR

SEQ ID NO: 876813 - protein, 9 aa, Homo Sapiens
TPDLCPLPG

SEQ ID NO: 876814 - protein, 9 aa, Homo Sapiens
RNDHGLFGL

SEQ ID NO: 876815 - protein, 9 aa, Homo Sapiens
SENQGSYFG

SEQ ID NO: 876816 - protein, 9 aa, Homo Sapiens
NCEKMFGNG

SEQ ID NO: 876817 - protein, 9 aa, Homo Sapiens
PLVKRDKQD

SEQ ID NO: 876818 - protein, 9 aa, Homo Sapiens
SQSLYKICV

SEQ ID NO: 876819 - protein, 9 aa, Homo Sapiens
EKISFVSAA

SEQ ID NO: 876820 - protein, 9 aa, Homo Sapiens
INAGIDFGS

SEQ ID NO: 876821 - protein, 9 aa, Homo Sapiens
DLLQTFQAF

SEQ ID NO: 876822 - protein, 9 aa, Homo Sapiens
AGHNYVLDL

SEQ ID NO: 876823 - protein, 9 aa, Homo Sapiens
NEILHLVPN

SEQ ID NO: 876824 - protein, 9 aa, Homo Sapiens
GYVDVAVGV

SEQ ID NO: 876825 - protein, 9 aa, Homo Sapiens
NLVDKISET

SEQ ID NO: 876826 - protein, 9 aa, Homo Sapiens
FKCFSYLTK

SEQ ID NO: 876827 - protein, 9 aa, Homo Sapiens
IPILYRMCT

SEQ ID NO: 876828 - protein, 9 aa, Homo Sapiens
QASTGPPWE

SEQ ID NO: 876829 - protein, 9 aa, Homo Sapiens
VCADVTINL

SEQ ID NO: 876830 - protein, 9 aa, Homo Sapiens
ALEQAGCLN

SEQ ID NO: 876831 - protein, 9 aa, Homo Sapiens
KDLYEYKNI

SEQ ID NO: 876832 - protein, 9 aa, Homo Sapiens
EPNLMSPTR

SEQ ID NO: 876833 - protein, 9 aa, Homo Sapiens
QSQKSILYD

SEQ ID NO: 876834 - protein, 9 aa, Homo Sapiens
RSTEDDSER

SEQ ID NO: 876835 - protein, 9 aa, Homo Sapiens
ILLHNLEWL

SEQ ID NO: 876836 - protein, 9 aa, Homo Sapiens
LKTINYAGL

SEQ ID NO: 876837 - protein, 9 aa, Homo Sapiens
LMRIGNKEV

SEQ ID NO: 876838 - protein, 9 aa, Homo Sapiens
TFSTYFTHC

SEQ ID NO: 876839 - protein, 9 aa, Homo Sapiens
AKEEGEGLV

SEQ ID NO: 876840 - protein, 9 aa, Homo Sapiens
WVLPDTPFW

SEQ ID NO: 876841 - protein, 9 aa, Homo Sapiens
NPEFESSSG

SEQ ID NO: 876842 - protein, 9 aa, Homo Sapiens
GYIIQKGEI

SEQ ID NO: 876843 - protein, 9 aa, Homo Sapiens
VSQKEKRNF

SEQ ID NO: 876844 - protein, 9 aa, Homo Sapiens
DATTASHFY

SEQ ID NO: 876845 - protein, 9 aa, Homo Sapiens
QTGNDVLKA

SEQ ID NO: 876846 - protein, 9 aa, Homo Sapiens
GENIENRTE

SEQ ID NO: 876847 - protein, 9 aa, Homo Sapiens
HNKFWKYGK

SEQ ID NO: 876848 - protein, 9 aa, Homo Sapiens
QSIACPFVE

SEQ ID NO: 876849 - protein, 9 aa, Homo Sapiens
LWKAIIDFQ

SEQ ID NO: 876850 - protein, 9 aa, Homo Sapiens
NYQVVRFCL

SEQ ID NO: 876851 - protein, 9 aa, Homo Sapiens
HEWKQKHHY

SEQ ID NO: 876852 - protein, 9 aa, Homo Sapiens
ASCRRPGVQ

SEQ ID NO: 876853 - protein, 9 aa, Homo Sapiens
RVWGRLYPW

SEQ ID NO: 876854 - protein, 9 aa, Homo Sapiens
KQNNSWTAE

SEQ ID NO: 876855 - protein, 9 aa, Homo Sapiens
GPCMFIYVW

SEQ ID NO: 876856 - protein, 9 aa, Homo Sapiens
ETNNSPLME

SEQ ID NO: 876857 - protein, 9 aa, Homo Sapiens
MQQIGNANI

SEQ ID NO: 876858 - protein, 9 aa, Homo Sapiens
QNENYNRVQ

SEQ ID NO: 876859 - protein, 9 aa, Homo Sapiens
PSISVSGMS

SEQ ID NO: 876860 - protein, 9 aa, Homo Sapiens
KLGKIQVTE

SEQ ID NO: 876861 - protein, 9 aa, Homo Sapiens
RFLKDNCRP

SEQ ID NO: 876862 - protein, 9 aa, Homo Sapiens
LADGEPDQT

SEQ ID NO: 876863 - protein, 9 aa, Homo Sapiens
LGYHGLLGS

SEQ ID NO: 876864 - protein, 9 aa, Homo Sapiens
RKIEGAQSV

SEQ ID NO: 876865 - protein, 9 aa, Homo Sapiens
VLLGITYLP

SEQ ID NO: 876866 - protein, 9 aa, Homo Sapiens
DDNKFTETK

SEQ ID NO: 876867 - protein, 9 aa, Homo Sapiens
LEHHLNEME

SEQ ID NO: 876868 - protein, 9 aa, Homo Sapiens
EERQRLIQN

SEQ ID NO: 876869 - protein, 9 aa, Homo Sapiens
ITRHYIDSP

SEQ ID NO: 876870 - protein, 9 aa, Homo Sapiens
ILDGIPETC

SEQ ID NO: 876871 - protein, 9 aa, Homo Sapiens
CLDVTLSPG

SEQ ID NO: 876872 - protein, 9 aa, Homo Sapiens
SVDEMIHKA

SEQ ID NO: 876873 - protein, 9 aa, Homo Sapiens
VLKMDSLSS

SEQ ID NO: 876874 - protein, 9 aa, Homo Sapiens
IGGADQELF

SEQ ID NO: 876875 - protein, 9 aa, Homo Sapiens
VQAYIQMKS

SEQ ID NO: 876876 - protein, 9 aa, Homo Sapiens
IKNFQTILH

SEQ ID NO: 876877 - protein, 9 aa, Homo Sapiens
MVETQMKKL

SEQ ID NO: 876878 - protein, 9 aa, Homo Sapiens
IGANQVSVE

SEQ ID NO: 876879 - protein, 9 aa, Homo Sapiens
DNNLKPIKP

SEQ ID NO: 876880 - protein, 9 aa, Homo Sapiens
LTFNLMEDR

SEQ ID NO: 876881 - protein, 9 aa, Homo Sapiens
KHSLHQKKL

SEQ ID NO: 876882 - protein, 9 aa, Homo Sapiens
PTKDMKATC

SEQ ID NO: 876883 - protein, 9 aa, Homo Sapiens
VSSIKVLEG

SEQ ID NO: 876884 - protein, 9 aa, Homo Sapiens
NPRWMMMPS

SEQ ID NO: 876885 - protein, 9 aa, Homo Sapiens
SEFFEQGDW

SEQ ID NO: 876886 - protein, 9 aa, Homo Sapiens
CQDINKCRH

SEQ ID NO: 876887 - protein, 9 aa, Homo Sapiens
FCRRGKLYL

SEQ ID NO: 876888 - protein, 9 aa, Homo Sapiens
FASLNKSAD

SEQ ID NO: 876889 - protein, 9 aa, Homo Sapiens
KNKAQYEEP

SEQ ID NO: 876890 - protein, 9 aa, Homo Sapiens
TSQNGAFIW

SEQ ID NO: 876891 - protein, 9 aa, Homo Sapiens
SPNKERQRR

SEQ ID NO: 876892 - protein, 9 aa, Homo Sapiens
FIKELFSLM

SEQ ID NO: 876893 - protein, 9 aa, Homo Sapiens
QTSFQDHAV

SEQ ID NO: 876894 - protein, 9 aa, Homo Sapiens
IWRFAYLWL

SEQ ID NO: 876895 - protein, 9 aa, Homo Sapiens
VGQLKRVPQ

SEQ ID NO: 876896 - protein, 9 aa, Homo Sapiens
TEKECIEGT

SEQ ID NO: 876897 - protein, 9 aa, Homo Sapiens
NIKTNAQIN

SEQ ID NO: 876898 - protein, 9 aa, Homo Sapiens
VSASKGLEK

SEQ ID NO: 876899 - protein, 9 aa, Homo Sapiens
NTNGRRTSS

SEQ ID NO: 876900 - protein, 9 aa, Homo Sapiens
SRHDCNLLR

SEQ ID NO: 876901 - protein, 9 aa, Homo Sapiens
CNFRCIPDE

SEQ ID NO: 876902 - protein, 9 aa, Homo Sapiens
NKIWDLWRI

SEQ ID NO: 876903 - protein, 9 aa, Homo Sapiens
DHYAYRDSM

SEQ ID NO: 876904 - protein, 9 aa, Homo Sapiens
RGENRQKHF

SEQ ID NO: 876905 - protein, 9 aa, Homo Sapiens
WNKALQVRF

SEQ ID NO: 876906 - protein, 9 aa, Homo Sapiens
KAQTYLKVH

SEQ ID NO: 876907 - protein, 9 aa, Homo Sapiens
LEREEAVCL

SEQ ID NO: 876908 - protein, 9 aa, Homo Sapiens
LSQAKVIQE

SEQ ID NO: 876909 - protein, 9 aa, Homo Sapiens
SFHHQINIY

SEQ ID NO: 876910 - protein, 9 aa, Homo Sapiens
TNAQINKLP

SEQ ID NO: 876911 - protein, 9 aa, Homo Sapiens
YTYQIFREK

SEQ ID NO: 876912 - protein, 9 aa, Homo Sapiens
GVLLLLCGL

SEQ ID NO: 876913 - protein, 9 aa, Homo Sapiens
NNPRELHRR

SEQ ID NO: 876914 - protein, 9 aa, Homo Sapiens
SSHSRGSIT

SEQ ID NO: 876915 - protein, 9 aa, Homo Sapiens
IMFIVNSAS

SEQ ID NO: 876916 - protein, 9 aa, Homo Sapiens
QEYYRGQNN

SEQ ID NO: 876917 - protein, 9 aa, Homo Sapiens
DEKTKKCIF

SEQ ID NO: 876918 - protein, 9 aa, Homo Sapiens
HKPNTLTDT

SEQ ID NO: 876919 - protein, 9 aa, Homo Sapiens
FEINTITGE

SEQ ID NO: 876920 - protein, 9 aa, Homo Sapiens
CKLCCWTFV

SEQ ID NO: 876921 - protein, 9 aa, Homo Sapiens
DEWESIFYF

SEQ ID NO: 876922 - protein, 9 aa, Homo Sapiens
VRGKQHGSS

SEQ ID NO: 876923 - protein, 9 aa, Homo Sapiens
RKYLFICEF

SEQ ID NO: 876924 - protein, 9 aa, Homo Sapiens
YTLSVTALY

SEQ ID NO: 876925 - protein, 9 aa, Homo Sapiens
PVSRRLLLD

SEQ ID NO: 876926 - protein, 9 aa, Homo Sapiens
IRRTDQLTN

SEQ ID NO: 876927 - protein, 9 aa, Homo Sapiens
SKEDQCKIN

SEQ ID NO: 876928 - protein, 9 aa, Homo Sapiens
LYSKTAKQC

SEQ ID NO: 876929 - protein, 9 aa, Homo Sapiens
EASRQTLMD

SEQ ID NO: 876930 - protein, 9 aa, Homo Sapiens
RTKGYSTSS

SEQ ID NO: 876931 - protein, 9 aa, Homo Sapiens
ENKPTHAGG

SEQ ID NO: 876932 - protein, 9 aa, Homo Sapiens
WQKSRTEGE

SEQ ID NO: 876933 - protein, 9 aa, Homo Sapiens
GSSKLRFQL

SEQ ID NO: 876934 - protein, 9 aa, Homo Sapiens
VVVGITWIL

SEQ ID NO: 876935 - protein, 9 aa, Homo Sapiens
KWFIDALEK

SEQ ID NO: 876936 - protein, 9 aa, Homo Sapiens
CQMQKLPQL

SEQ ID NO: 876937 - protein, 9 aa, Homo Sapiens
STPLDPVST

SEQ ID NO: 876938 - protein, 9 aa, Homo Sapiens
QRTPFQIGI

SEQ ID NO: 876939 - protein, 9 aa, Homo Sapiens
DSEVLNLLT

SEQ ID NO: 876940 - protein, 9 aa, Homo Sapiens
PDLYFYRNP

SEQ ID NO: 876941 - protein, 9 aa, Homo Sapiens
PETATDLSA

SEQ ID NO: 876942 - protein, 9 aa, Homo Sapiens
EEMQENYQK

SEQ ID NO: 876943 - protein, 9 aa, Homo Sapiens
MNCLIQFDD

SEQ ID NO: 876944 - protein, 9 aa, Homo Sapiens
SLGKNGVVK

SEQ ID NO: 876945 - protein, 9 aa, Homo Sapiens
RSAKDIKHR

SEQ ID NO: 876946 - protein, 9 aa, Homo Sapiens
DTQNRIIIV

SEQ ID NO: 876947 - protein, 9 aa, Homo Sapiens
RKPPNYNVA

SEQ ID NO: 876948 - protein, 9 aa, Homo Sapiens
QMLTKENSR

SEQ ID NO: 876949 - protein, 9 aa, Homo Sapiens
RNQCQYCRF

SEQ ID NO: 876950 - protein, 9 aa, Homo Sapiens
DIATNKAYL

SEQ ID NO: 876951 - protein, 9 aa, Homo Sapiens
YKSNGYTMV

SEQ ID NO: 876952 - protein, 9 aa, Homo Sapiens
REIIQEVAD

SEQ ID NO: 876953 - protein, 9 aa, Homo Sapiens
AEGRQVAGP

SEQ ID NO: 876954 - protein, 9 aa, Homo Sapiens
GLACFRSLV

SEQ ID NO: 876955 - protein, 9 aa, Homo Sapiens
LAIYLVHGG

SEQ ID NO: 876956 - protein, 9 aa, Homo Sapiens
LVDKISETA

SEQ ID NO: 876957 - protein, 9 aa, Homo Sapiens
FQGFCVDLP

SEQ ID NO: 876958 - protein, 9 aa, Homo Sapiens
TNWIYYGDS

SEQ ID NO: 876959 - protein, 9 aa, Homo Sapiens
DHVISVWDW

SEQ ID NO: 876960 - protein, 9 aa, Homo Sapiens
QEPQFRDAE

SEQ ID NO: 876961 - protein, 9 aa, Homo Sapiens
SFQNHIRIH

SEQ ID NO: 876962 - protein, 9 aa, Homo Sapiens
YLRELSQKP

SEQ ID NO: 876963 - protein, 9 aa, Homo Sapiens
NLVYGATPP

SEQ ID NO: 876964 - protein, 9 aa, Homo Sapiens
SYVQICITV

SEQ ID NO: 876965 - protein, 9 aa, Homo Sapiens
ISHQKFAIT

SEQ ID NO: 876966 - protein, 9 aa, Homo Sapiens
GICSSSWET

SEQ ID NO: 876967 - protein, 9 aa, Homo Sapiens
TELQTELVR

SEQ ID NO: 876968 - protein, 9 aa, Homo Sapiens
REKTPKLNL

SEQ ID NO: 876969 - protein, 9 aa, Homo Sapiens
AIAITKEKR

SEQ ID NO: 876970 - protein, 9 aa, Homo Sapiens
QIGNANISL

SEQ ID NO: 876971 - protein, 9 aa, Homo Sapiens
VSTFQYDCF

SEQ ID NO: 876972 - protein, 9 aa, Homo Sapiens
LKVYLQRNM

SEQ ID NO: 876973 - protein, 9 aa, Homo Sapiens
NEVIHISRG

SEQ ID NO: 876974 - protein, 9 aa, Homo Sapiens
LKQFISHKL

SEQ ID NO: 876975 - protein, 9 aa, Homo Sapiens
KYKHHLKKH

SEQ ID NO: 876976 - protein, 9 aa, Homo Sapiens
AALQIQNMV

SEQ ID NO: 876977 - protein, 9 aa, Homo Sapiens
VGRLDKSNP

SEQ ID NO: 876978 - protein, 9 aa, Homo Sapiens
NDCDKYVFC

SEQ ID NO: 876979 - protein, 9 aa, Homo Sapiens
LNFYVQTYQ

SEQ ID NO: 876980 - protein, 9 aa, Homo Sapiens
DMDGMNQTR

SEQ ID NO: 876981 - protein, 9 aa, Homo Sapiens
EFLHRVGHY

SEQ ID NO: 876982 - protein, 9 aa, Homo Sapiens
EVDKVTGRC

SEQ ID NO: 876983 - protein, 9 aa, Homo Sapiens
QLHYFRNQR

SEQ ID NO: 876984 - protein, 9 aa, Homo Sapiens
PDVGVNLLQ

SEQ ID NO: 876985 - protein, 9 aa, Homo Sapiens
ARDKKLRKE

SEQ ID NO: 876986 - protein, 9 aa, Homo Sapiens
ACLDETAVM

SEQ ID NO: 876987 - protein, 9 aa, Homo Sapiens
FASDCFLYA

SEQ ID NO: 876988 - protein, 9 aa, Homo Sapiens
GLNTTTAYV

SEQ ID NO: 876989 - protein, 9 aa, Homo Sapiens
PVALPHTPL

SEQ ID NO: 876990 - protein, 9 aa, Homo Sapiens
CDREDIPIC

SEQ ID NO: 876991 - protein, 9 aa, Homo Sapiens
LLIENCNLT

SEQ ID NO: 876992 - protein, 9 aa, Homo Sapiens
EENGNSNKK

SEQ ID NO: 876993 - protein, 9 aa, Homo Sapiens
TGKIQIAAE

SEQ ID NO: 876994 - protein, 9 aa, Homo Sapiens
QIQHKGKDY

SEQ ID NO: 876995 - protein, 9 aa, Homo Sapiens
CVTGLGKVT

SEQ ID NO: 876996 - protein, 9 aa, Homo Sapiens
WVNEIWKVL

SEQ ID NO: 876997 - protein, 9 aa, Homo Sapiens
LIGAGIQIL

SEQ ID NO: 876998 - protein, 9 aa, Homo Sapiens
GAVSSLGDL

SEQ ID NO: 876999 - protein, 9 aa, Homo Sapiens
CPDLPWSYT

SEQ ID NO: 877000 - protein, 9 aa, Homo Sapiens
RHRDKEYPN

SEQ ID NO: 877001 - protein, 9 aa, Homo Sapiens
IHNFQLDMD

SEQ ID NO: 877002 - protein, 9 aa, Homo Sapiens
AWCGFVRSM

SEQ ID NO: 877003 - protein, 9 aa, Homo Sapiens
NCSASIRIP

SEQ ID NO: 877004 - protein, 9 aa, Homo Sapiens
PIFWIQTET

SEQ ID NO: 877005 - protein, 9 aa, Homo Sapiens
CSDCGQFFT

SEQ ID NO: 877006 - protein, 9 aa, Homo Sapiens
GKLCEQESE

SEQ ID NO: 877007 - protein, 9 aa, Homo Sapiens
LGDVMKMNE

SEQ ID NO: 877008 - protein, 9 aa, Homo Sapiens
RSVCPTDSN

SEQ ID NO: 877009 - protein, 9 aa, Homo Sapiens
HLPKYKQVH

SEQ ID NO: 877010 - protein, 9 aa, Homo Sapiens
AQRIISLSQ

SEQ ID NO: 877011 - protein, 9 aa, Homo Sapiens
SPYMNGRYY

SEQ ID NO: 877012 - protein, 9 aa, Homo Sapiens
LNTTSRQQI

SEQ ID NO: 877013 - protein, 9 aa, Homo Sapiens
FQFQNLHQL

SEQ ID NO: 877014 - protein, 9 aa, Homo Sapiens
DFETSLQIT

SEQ ID NO: 877015 - protein, 9 aa, Homo Sapiens
VICHSLWGT

SEQ ID NO: 877016 - protein, 9 aa, Homo Sapiens
VFNASDRFK

SEQ ID NO: 877017 - protein, 9 aa, Homo Sapiens
YDNLVSRLL

SEQ ID NO: 877018 - protein, 9 aa, Homo Sapiens
NSINVVYSR

SEQ ID NO: 877019 - protein, 9 aa, Homo Sapiens
VFQENPLWT

SEQ ID NO: 877020 - protein, 9 aa, Homo Sapiens
DNKVKDGLP

SEQ ID NO: 877021 - protein, 9 aa, Homo Sapiens
SAYPGGCGP

SEQ ID NO: 877022 - protein, 9 aa, Homo Sapiens
IYQQFSECM

SEQ ID NO: 877023 - protein, 9 aa, Homo Sapiens
QALAELLGP

SEQ ID NO: 877024 - protein, 9 aa, Homo Sapiens
NGMPVISEL

SEQ ID NO: 877025 - protein, 9 aa, Homo Sapiens
LLARACCYG

SEQ ID NO: 877026 - protein, 9 aa, Homo Sapiens
EVLWEGAEG

SEQ ID NO: 877027 - protein, 9 aa, Homo Sapiens
EDLSVQLAL

SEQ ID NO: 877028 - protein, 9 aa, Homo Sapiens
LWNLAKSLD

SEQ ID NO: 877029 - protein, 9 aa, Homo Sapiens
WLIEREKER

SEQ ID NO: 877030 - protein, 9 aa, Homo Sapiens
RDVAIQLSL

SEQ ID NO: 877031 - protein, 9 aa, Homo Sapiens
EWVIHKLNV

SEQ ID NO: 877032 - protein, 9 aa, Homo Sapiens
VFLEKAADS

SEQ ID NO: 877033 - protein, 9 aa, Homo Sapiens
RIDVLLWAS

SEQ ID NO: 877034 - protein, 9 aa, Homo Sapiens
AYKQVIKYC

SEQ ID NO: 877035 - protein, 9 aa, Homo Sapiens
WLRCALNKH

SEQ ID NO: 877036 - protein, 9 aa, Homo Sapiens
VAAHCVTGL

SEQ ID NO: 877037 - protein, 9 aa, Homo Sapiens
QYDEEARRE

SEQ ID NO: 877038 - protein, 9 aa, Homo Sapiens
NPGEDPRFK

SEQ ID NO: 877039 - protein, 9 aa, Homo Sapiens
TGEKVYECK

SEQ ID NO: 877040 - protein, 9 aa, Homo Sapiens
THKQTHIKN

SEQ ID NO: 877041 - protein, 9 aa, Homo Sapiens
LHMLNRLRE

SEQ ID NO: 877042 - protein, 9 aa, Homo Sapiens
CQDEQLRSH

SEQ ID NO: 877043 - protein, 9 aa, Homo Sapiens
DIKTDLSFG

SEQ ID NO: 877044 - protein, 9 aa, Homo Sapiens
LYETAVKFS

SEQ ID NO: 877045 - protein, 9 aa, Homo Sapiens
FGERQTDKT

SEQ ID NO: 877046 - protein, 9 aa, Homo Sapiens
IRVILKYLD

SEQ ID NO: 877047 - protein, 9 aa, Homo Sapiens
ISVSGMSLS

SEQ ID NO: 877048 - protein, 9 aa, Homo Sapiens
LRAAWDTVS

SEQ ID NO: 877049 - protein, 9 aa, Homo Sapiens
RLEITEGSE

SEQ ID NO: 877050 - protein, 9 aa, Homo Sapiens
STSNKSGDQ

SEQ ID NO: 877051 - protein, 9 aa, Homo Sapiens
LKVEYKRGG

SEQ ID NO: 877052 - protein, 9 aa, Homo Sapiens
NVPEMMNEV

SEQ ID NO: 877053 - protein, 9 aa, Homo Sapiens
ADLYKLVQY

SEQ ID NO: 877054 - protein, 9 aa, Homo Sapiens
PEFYFNIHP

SEQ ID NO: 877055 - protein, 9 aa, Homo Sapiens
ISELNRAIQ

SEQ ID NO: 877056 - protein, 9 aa, Homo Sapiens
LGSGPFSKI

SEQ ID NO: 877057 - protein, 9 aa, Homo Sapiens
AQVQTKAKA

SEQ ID NO: 877058 - protein, 9 aa, Homo Sapiens
NLFSPLNPI

SEQ ID NO: 877059 - protein, 9 aa, Homo Sapiens
LLKEISDDK

SEQ ID NO: 877060 - protein, 9 aa, Homo Sapiens
TVCGGTVTA

SEQ ID NO: 877061 - protein, 9 aa, Homo Sapiens
IHVNQNIMD

SEQ ID NO: 877062 - protein, 9 aa, Homo Sapiens
LFMSVWDQD

SEQ ID NO: 877063 - protein, 9 aa, Homo Sapiens
YPARCWCKK

SEQ ID NO: 877064 - protein, 9 aa, Homo Sapiens
DHSNNLLRV

SEQ ID NO: 877065 - protein, 9 aa, Homo Sapiens
VGISLPKVL

SEQ ID NO: 877066 - protein, 9 aa, Homo Sapiens
AYFFWLKSK

SEQ ID NO: 877067 - protein, 9 aa, Homo Sapiens
PSLLKRHEK

SEQ ID NO: 877068 - protein, 9 aa, Homo Sapiens
DDRNLLQIR

SEQ ID NO: 877069 - protein, 9 aa, Homo Sapiens
EDMKIRSMY

SEQ ID NO: 877070 - protein, 9 aa, Homo Sapiens
DMGNRTSLR

SEQ ID NO: 877071 - protein, 9 aa, Homo Sapiens
YQRAKTYFF

SEQ ID NO: 877072 - protein, 9 aa, Homo Sapiens
LNRQVQMEY

SEQ ID NO: 877073 - protein, 9 aa, Homo Sapiens
VFQRKLSKS

SEQ ID NO: 877074 - protein, 9 aa, Homo Sapiens
HTRSTEDDS

SEQ ID NO: 877075 - protein, 9 aa, Homo Sapiens
SLRQLVLNN

SEQ ID NO: 877076 - protein, 9 aa, Homo Sapiens
TDSCVQRRL

SEQ ID NO: 877077 - protein, 9 aa, Homo Sapiens
HNYQVFNGS

SEQ ID NO: 877078 - protein, 9 aa, Homo Sapiens
EKQRHQLHK

SEQ ID NO: 877079 - protein, 9 aa, Homo Sapiens
PTVWAINQY

SEQ ID NO: 877080 - protein, 9 aa, Homo Sapiens
NPQQLTQIM

SEQ ID NO: 877081 - protein, 9 aa, Homo Sapiens
DSDKLSQLQ

SEQ ID NO: 877082 - protein, 9 aa, Homo Sapiens
QNQRFRSKP

SEQ ID NO: 877083 - protein, 9 aa, Homo Sapiens
NGDNATASS

SEQ ID NO: 877084 - protein, 9 aa, Homo Sapiens
SFTKYFIKI

SEQ ID NO: 877085 - protein, 9 aa, Homo Sapiens
GESESGQLL

SEQ ID NO: 877086 - protein, 9 aa, Homo Sapiens
CHESYNQTF

SEQ ID NO: 877087 - protein, 9 aa, Homo Sapiens
DSNDFTKVE

SEQ ID NO: 877088 - protein, 9 aa, Homo Sapiens
NFFHFILAL

SEQ ID NO: 877089 - protein, 9 aa, Homo Sapiens
GISVLHWLQ

SEQ ID NO: 877090 - protein, 9 aa, Homo Sapiens
QLSKEQKEL

SEQ ID NO: 877091 - protein, 9 aa, Homo Sapiens
KDDFNWGKY

SEQ ID NO: 877092 - protein, 9 aa, Homo Sapiens
IKYLIPQFQ

SEQ ID NO: 877093 - protein, 9 aa, Homo Sapiens
EPWLVDLFA

SEQ ID NO: 877094 - protein, 9 aa, Homo Sapiens
GAIVIEQPN

SEQ ID NO: 877095 - protein, 9 aa, Homo Sapiens
EVEAAGEID

SEQ ID NO: 877096 - protein, 9 aa, Homo Sapiens
LTEKECIEG

SEQ ID NO: 877097 - protein, 9 aa, Homo Sapiens
TALMSSMAP

SEQ ID NO: 877098 - protein, 9 aa, Homo Sapiens
LWEGAEGRQ

SEQ ID NO: 877099 - protein, 9 aa, Homo Sapiens
RFWDCGLVA

SEQ ID NO: 877100 - protein, 9 aa, Homo Sapiens
SVWIGQLMH

SEQ ID NO: 877101 - protein, 9 aa, Homo Sapiens
KSKDDDEPD

SEQ ID NO: 877102 - protein, 9 aa, Homo Sapiens
KFPYTRRQN

SEQ ID NO: 877103 - protein, 9 aa, Homo Sapiens
QKNNGTVWS

SEQ ID NO: 877104 - protein, 9 aa, Homo Sapiens
PGSASSTGG

SEQ ID NO: 877105 - protein, 9 aa, Homo Sapiens
MEDNDPKPG

SEQ ID NO: 877106 - protein, 9 aa, Homo Sapiens
NTFGSTLLC

SEQ ID NO: 877107 - protein, 9 aa, Homo Sapiens
LSVENSGRD

SEQ ID NO: 877108 - protein, 9 aa, Homo Sapiens
FCHKPCRPL

SEQ ID NO: 877109 - protein, 9 aa, Homo Sapiens
DGSGKGVAL

SEQ ID NO: 877110 - protein, 9 aa, Homo Sapiens
GDKTKTPTL

SEQ ID NO: 877111 - protein, 9 aa, Homo Sapiens
LYKQKFICG

SEQ ID NO: 877112 - protein, 9 aa, Homo Sapiens
NLWLTLLLG

SEQ ID NO: 877113 - protein, 9 aa, Homo Sapiens
VLKPEWFWG

SEQ ID NO: 877114 - protein, 9 aa, Homo Sapiens
MVTRKLETH

SEQ ID NO: 877115 - protein, 9 aa, Homo Sapiens
IHRALHKAN

SEQ ID NO: 877116 - protein, 9 aa, Homo Sapiens
KFTCSVGKS

SEQ ID NO: 877117 - protein, 9 aa, Homo Sapiens
PAMGHFADR

SEQ ID NO: 877118 - protein, 9 aa, Homo Sapiens
HMDCLRWLK

SEQ ID NO: 877119 - protein, 9 aa, Homo Sapiens
ESEKKAHTQ

SEQ ID NO: 877120 - protein, 9 aa, Homo Sapiens
IVKKIIGKM

SEQ ID NO: 877121 - protein, 9 aa, Homo Sapiens
FEVPKIYAL

SEQ ID NO: 877122 - protein, 9 aa, Homo Sapiens
DLDCKRRET

SEQ ID NO: 877123 - protein, 9 aa, Homo Sapiens
ALNKHSLER

SEQ ID NO: 877124 - protein, 9 aa, Homo Sapiens
GGSQSISAS

SEQ ID NO: 877125 - protein, 9 aa, Homo Sapiens
PQDQESPRC

SEQ ID NO: 877126 - protein, 9 aa, Homo Sapiens
IRECLKKVS

SEQ ID NO: 877127 - protein, 9 aa, Homo Sapiens
EDLEWYEPQ

SEQ ID NO: 877128 - protein, 9 aa, Homo Sapiens
PQERPDWEE

SEQ ID NO: 877129 - protein, 9 aa, Homo Sapiens
FNLSSERNV

SEQ ID NO: 877130 - protein, 9 aa, Homo Sapiens
LYRGCVRAS

SEQ ID NO: 877131 - protein, 9 aa, Homo Sapiens
ESQPIDLGA

SEQ ID NO: 877132 - protein, 9 aa, Homo Sapiens
TRHCCQCRP

SEQ ID NO: 877133 - protein, 9 aa, Homo Sapiens
ELFVDDFEE

SEQ ID NO: 877134 - protein, 9 aa, Homo Sapiens
ATPKKSINK

SEQ ID NO: 877135 - protein, 9 aa, Homo Sapiens
GQSLPVSSR

SEQ ID NO: 877136 - protein, 9 aa, Homo Sapiens
QNRFNLRFE

SEQ ID NO: 877137 - protein, 9 aa, Homo Sapiens
HSMKWSARA

SEQ ID NO: 877138 - protein, 9 aa, Homo Sapiens
AVPLGLNAR

SEQ ID NO: 877139 - protein, 9 aa, Homo Sapiens
EEVPGKVKA

SEQ ID NO: 877140 - protein, 9 aa, Homo Sapiens
TTFKNGLKD

SEQ ID NO: 877141 - protein, 9 aa, Homo Sapiens
ELLNIIYFK

SEQ ID NO: 877142 - protein, 9 aa, Homo Sapiens
CHGHADACN

SEQ ID NO: 877143 - protein, 9 aa, Homo Sapiens
TNKDALIEI

SEQ ID NO: 877144 - protein, 9 aa, Homo Sapiens
KQRNFLQSH

SEQ ID NO: 877145 - protein, 9 aa, Homo Sapiens
QTGIFCVLL

SEQ ID NO: 877146 - protein, 9 aa, Homo Sapiens
QEHGSDSFI

SEQ ID NO: 877147 - protein, 9 aa, Homo Sapiens
QLRHIHLEN

SEQ ID NO: 877148 - protein, 9 aa, Homo Sapiens
ATLRNRVCI

SEQ ID NO: 877149 - protein, 9 aa, Homo Sapiens
MWIINNFSF

SEQ ID NO: 877150 - protein, 9 aa, Homo Sapiens
HESYNQTFM

SEQ ID NO: 877151 - protein, 9 aa, Homo Sapiens
NQMVQNENY

SEQ ID NO: 877152 - protein, 9 aa, Homo Sapiens
CCLMKIEKF

SEQ ID NO: 877153 - protein, 9 aa, Homo Sapiens
KDGVQQIPI

SEQ ID NO: 877154 - protein, 9 aa, Homo Sapiens
SSPETPKFS

SEQ ID NO: 877155 - protein, 9 aa, Homo Sapiens
QLQVEEEDI

SEQ ID NO: 877156 - protein, 9 aa, Homo Sapiens
QAGLRTGGF

SEQ ID NO: 877157 - protein, 9 aa, Homo Sapiens
MASNNTTSI

SEQ ID NO: 877158 - protein, 9 aa, Homo Sapiens
RVILGQQLP

SEQ ID NO: 877159 - protein, 9 aa, Homo Sapiens
FIYDEKVFW

SEQ ID NO: 877160 - protein, 9 aa, Homo Sapiens
PRMLPFLLL

SEQ ID NO: 877161 - protein, 9 aa, Homo Sapiens
EKICQAFYF

SEQ ID NO: 877162 - protein, 9 aa, Homo Sapiens
SKTVSTMRC

SEQ ID NO: 877163 - protein, 9 aa, Homo Sapiens
NPLAHYNTT

SEQ ID NO: 877164 - protein, 9 aa, Homo Sapiens
FYSWERVFL

SEQ ID NO: 877165 - protein, 9 aa, Homo Sapiens
PWGDYDNSA

SEQ ID NO: 877166 - protein, 9 aa, Homo Sapiens
EDYILPDTC

SEQ ID NO: 877167 - protein, 9 aa, Homo Sapiens
CDDLEEAQE

SEQ ID NO: 877168 - protein, 9 aa, Homo Sapiens
EQLCSLMES

SEQ ID NO: 877169 - protein, 9 aa, Homo Sapiens
LITKKEVNQ

SEQ ID NO: 877170 - protein, 9 aa, Homo Sapiens
EDKQIGKSV

SEQ ID NO: 877171 - protein, 9 aa, Homo Sapiens
AEGGQNSFE

SEQ ID NO: 877172 - protein, 9 aa, Homo Sapiens
GYLSLLQDN

SEQ ID NO: 877173 - protein, 9 aa, Homo Sapiens
SRGGTLLFC

SEQ ID NO: 877174 - protein, 9 aa, Homo Sapiens
LLITIHDQK

SEQ ID NO: 877175 - protein, 9 aa, Homo Sapiens
LCGWMKWPK

SEQ ID NO: 877176 - protein, 9 aa, Homo Sapiens
KSKHVLLKN

SEQ ID NO: 877177 - protein, 9 aa, Homo Sapiens
SKYMSERSK

SEQ ID NO: 877178 - protein, 9 aa, Homo Sapiens
SLINERNSG

SEQ ID NO: 877179 - protein, 9 aa, Homo Sapiens
NCYRRLDLF

SEQ ID NO: 877180 - protein, 9 aa, Homo Sapiens
QRIISLSQN

SEQ ID NO: 877181 - protein, 9 aa, Homo Sapiens
ASHLQTHGR

SEQ ID NO: 877182 - protein, 9 aa, Homo Sapiens
AALDSIHYI

SEQ ID NO: 877183 - protein, 9 aa, Homo Sapiens
SLSFCTNHE

SEQ ID NO: 877184 - protein, 9 aa, Homo Sapiens
IVLQTYFLL

SEQ ID NO: 877185 - protein, 9 aa, Homo Sapiens
DLEWYEPQI

SEQ ID NO: 877186 - protein, 9 aa, Homo Sapiens
ILGVPQNAS

SEQ ID NO: 877187 - protein, 9 aa, Homo Sapiens
DGFYKVDYA

SEQ ID NO: 877188 - protein, 9 aa, Homo Sapiens
GMIIDNMTM

SEQ ID NO: 877189 - protein, 9 aa, Homo Sapiens
FHTSIEQDK

SEQ ID NO: 877190 - protein, 9 aa, Homo Sapiens
THRVANVFT

SEQ ID NO: 877191 - protein, 9 aa, Homo Sapiens
VVRIKCPLP

SEQ ID NO: 877192 - protein, 9 aa, Homo Sapiens
FTKLGFEIF

SEQ ID NO: 877193 - protein, 9 aa, Homo Sapiens
KQIEDLQGQ

SEQ ID NO: 877194 - protein, 9 aa, Homo Sapiens
REKLCEIKE

SEQ ID NO: 877195 - protein, 9 aa, Homo Sapiens
DGENSVSSS

SEQ ID NO: 877196 - protein, 9 aa, Homo Sapiens
KIIHTERET

SEQ ID NO: 877197 - protein, 9 aa, Homo Sapiens
LTCRLGEQL

SEQ ID NO: 877198 - protein, 9 aa, Homo Sapiens
AHCFRDDND

SEQ ID NO: 877199 - protein, 9 aa, Homo Sapiens
VDLATLMIN

SEQ ID NO: 877200 - protein, 9 aa, Homo Sapiens
DKQRQKQQE

SEQ ID NO: 877201 - protein, 9 aa, Homo Sapiens
ISLPLICLH

SEQ ID NO: 877202 - protein, 9 aa, Homo Sapiens
LIFKLEELC

SEQ ID NO: 877203 - protein, 9 aa, Homo Sapiens
PVTVMESNP

SEQ ID NO: 877204 - protein, 9 aa, Homo Sapiens
MFESGSKIW

SEQ ID NO: 877205 - protein, 9 aa, Homo Sapiens
LVLPSRVQK

SEQ ID NO: 877206 - protein, 9 aa, Homo Sapiens
RPTRFLCSQ

SEQ ID NO: 877207 - protein, 9 aa, Homo Sapiens
IHRRVYTGE

SEQ ID NO: 877208 - protein, 9 aa, Homo Sapiens
SETRTHQVV

SEQ ID NO: 877209 - protein, 9 aa, Homo Sapiens
CNAKDPTDP

SEQ ID NO: 877210 - protein, 9 aa, Homo Sapiens
AKFETKAQK

SEQ ID NO: 877211 - protein, 9 aa, Homo Sapiens
LDNMGHKEN

SEQ ID NO: 877212 - protein, 9 aa, Homo Sapiens
NTYRLCDNV

SEQ ID NO: 877213 - protein, 9 aa, Homo Sapiens
ERMVRTDYL

SEQ ID NO: 877214 - protein, 9 aa, Homo Sapiens
ARGIDPPPC

SEQ ID NO: 877215 - protein, 9 aa, Homo Sapiens
KGGPQGNSS

SEQ ID NO: 877216 - protein, 9 aa, Homo Sapiens
VSAPDLTIK

SEQ ID NO: 877217 - protein, 9 aa, Homo Sapiens
AQSLSYAFT

SEQ ID NO: 877218 - protein, 9 aa, Homo Sapiens
FAVLPWGCL

SEQ ID NO: 877219 - protein, 9 aa, Homo Sapiens
CFHDPSPAQ

SEQ ID NO: 877220 - protein, 9 aa, Homo Sapiens
TRIWFMLET

SEQ ID NO: 877221 - protein, 9 aa, Homo Sapiens
PAQTKNTAS

SEQ ID NO: 877222 - protein, 9 aa, Homo Sapiens
GNESGLELE

SEQ ID NO: 877223 - protein, 9 aa, Homo Sapiens
DELVEQSHI

SEQ ID NO: 877224 - protein, 9 aa, Homo Sapiens
KICFKSLAK

SEQ ID NO: 877225 - protein, 9 aa, Homo Sapiens
LTSHFLFGL

SEQ ID NO: 877226 - protein, 9 aa, Homo Sapiens
RQREVLWNL

SEQ ID NO: 877227 - protein, 9 aa, Homo Sapiens
ISRYEGILT

SEQ ID NO: 877228 - protein, 9 aa, Homo Sapiens
MARLEGELK

SEQ ID NO: 877229 - protein, 9 aa, Homo Sapiens
QASSLQLNQ

SEQ ID NO: 877230 - protein, 9 aa, Homo Sapiens
ETSDKITAV

SEQ ID NO: 877231 - protein, 9 aa, Homo Sapiens
LVHHTYPQD

SEQ ID NO: 877232 - protein, 9 aa, Homo Sapiens
KVRNQCYFH

SEQ ID NO: 877233 - protein, 9 aa, Homo Sapiens
SVNNKSPSD

SEQ ID NO: 877234 - protein, 9 aa, Homo Sapiens
WLQYVNWAC

SEQ ID NO: 877235 - protein, 9 aa, Homo Sapiens
LLSGNDIIL

SEQ ID NO: 877236 - protein, 9 aa, Homo Sapiens
GLRAISVGS

SEQ ID NO: 877237 - protein, 9 aa, Homo Sapiens
RQLEQDNAS

SEQ ID NO: 877238 - protein, 9 aa, Homo Sapiens
DKTVLLLVT

SEQ ID NO: 877239 - protein, 9 aa, Homo Sapiens
AKDSEDIDI

SEQ ID NO: 877240 - protein, 9 aa, Homo Sapiens
AIIFCQTRQ

SEQ ID NO: 877241 - protein, 9 aa, Homo Sapiens
EYKNRDAIL

SEQ ID NO: 877242 - protein, 9 aa, Homo Sapiens
LDKIERSKT

SEQ ID NO: 877243 - protein, 9 aa, Homo Sapiens
SLNTYRLCD

SEQ ID NO: 877244 - protein, 9 aa, Homo Sapiens
FLLQFSLEK

SEQ ID NO: 877245 - protein, 9 aa, Homo Sapiens
LLKVISSPH

SEQ ID NO: 877246 - protein, 9 aa, Homo Sapiens
VPASPMNFH

SEQ ID NO: 877247 - protein, 9 aa, Homo Sapiens
RAKEEAEQL

SEQ ID NO: 877248 - protein, 9 aa, Homo Sapiens
QLTITRHCC

SEQ ID NO: 877249 - protein, 9 aa, Homo Sapiens
NDALPLLYG

SEQ ID NO: 877250 - protein, 9 aa, Homo Sapiens
SKSVRPDNF

SEQ ID NO: 877251 - protein, 9 aa, Homo Sapiens
NHQHSNRYL

SEQ ID NO: 877252 - protein, 9 aa, Homo Sapiens
VQYSDIGIL

SEQ ID NO: 877253 - protein, 9 aa, Homo Sapiens
SDIHRDLDN

SEQ ID NO: 877254 - protein, 9 aa, Homo Sapiens
LKEISVVIF

SEQ ID NO: 877255 - protein, 9 aa, Homo Sapiens
SAETQSSSN

SEQ ID NO: 877256 - protein, 9 aa, Homo Sapiens
KSRLPEQIT

SEQ ID NO: 877257 - protein, 9 aa, Homo Sapiens
DESSELRFL

SEQ ID NO: 877258 - protein, 9 aa, Homo Sapiens
GGKGKCLPE

SEQ ID NO: 877259 - protein, 9 aa, Homo Sapiens
RNQKESGLN

SEQ ID NO: 877260 - protein, 9 aa, Homo Sapiens
LQVLTFNLM

SEQ ID NO: 877261 - protein, 9 aa, Homo Sapiens
RPQTPPEAI

SEQ ID NO: 877262 - protein, 9 aa, Homo Sapiens
PFKSYNPDK

SEQ ID NO: 877263 - protein, 9 aa, Homo Sapiens
IVKTATITK

SEQ ID NO: 877264 - protein, 9 aa, Homo Sapiens
TFASMTKDD

SEQ ID NO: 877265 - protein, 9 aa, Homo Sapiens
EDIFILLCL

SEQ ID NO: 877266 - protein, 9 aa, Homo Sapiens
HTIYYGEQQ

SEQ ID NO: 877267 - protein, 9 aa, Homo Sapiens
NFILENPDY

SEQ ID NO: 877268 - protein, 9 aa, Homo Sapiens
LIEMMGPRM

SEQ ID NO: 877269 - protein, 9 aa, Homo Sapiens
AEMPDMKAE

SEQ ID NO: 877270 - protein, 9 aa, Homo Sapiens
YQKQESLEI

SEQ ID NO: 877271 - protein, 9 aa, Homo Sapiens
HGIEYQDKP

SEQ ID NO: 877272 - protein, 9 aa, Homo Sapiens
EARDYSQGM

SEQ ID NO: 877273 - protein, 9 aa, Homo Sapiens
LGPVIQFFG

SEQ ID NO: 877274 - protein, 9 aa, Homo Sapiens
IESTAKFTH

SEQ ID NO: 877275 - protein, 9 aa, Homo Sapiens
DPVEDRNVY

SEQ ID NO: 877276 - protein, 9 aa, Homo Sapiens
SFKKGEIFQ

SEQ ID NO: 877277 - protein, 9 aa, Homo Sapiens
LNKHKIVHT

SEQ ID NO: 877278 - protein, 9 aa, Homo Sapiens
LARACCYGF

SEQ ID NO: 877279 - protein, 9 aa, Homo Sapiens
QCCGLVHHR

SEQ ID NO: 877280 - protein, 9 aa, Homo Sapiens
QSCKERNLR

SEQ ID NO: 877281 - protein, 9 aa, Homo Sapiens
ASDASHVLE

SEQ ID NO: 877282 - protein, 9 aa, Homo Sapiens
YSGSQTPHI

SEQ ID NO: 877283 - protein, 9 aa, Homo Sapiens
IKRELAKYS

SEQ ID NO: 877284 - protein, 9 aa, Homo Sapiens
FDGKQMRKA

SEQ ID NO: 877285 - protein, 9 aa, Homo Sapiens
TMYLQQYVE

SEQ ID NO: 877286 - protein, 9 aa, Homo Sapiens
VQKEGMQKQ

SEQ ID NO: 877287 - protein, 9 aa, Homo Sapiens
LPKLGQSIA

SEQ ID NO: 877288 - protein, 9 aa, Homo Sapiens
PIQFEPPML

SEQ ID NO: 877289 - protein, 9 aa, Homo Sapiens
LCGVTVMMQ

SEQ ID NO: 877290 - protein, 9 aa, Homo Sapiens
LLVFWTPSC

SEQ ID NO: 877291 - protein, 9 aa, Homo Sapiens
ICHLYNEDN

SEQ ID NO: 877292 - protein, 9 aa, Homo Sapiens
IFLPGYDKI

SEQ ID NO: 877293 - protein, 9 aa, Homo Sapiens
WRQGFNISY

SEQ ID NO: 877294 - protein, 9 aa, Homo Sapiens
LGSSDHPTL

SEQ ID NO: 877295 - protein, 9 aa, Homo Sapiens
LDRQRTLVL

SEQ ID NO: 877296 - protein, 9 aa, Homo Sapiens
KSSQGASHF

SEQ ID NO: 877297 - protein, 9 aa, Homo Sapiens
TAEKWFIDA

SEQ ID NO: 877298 - protein, 9 aa, Homo Sapiens
IKVGSFKVA

SEQ ID NO: 877299 - protein, 9 aa, Homo Sapiens
ARLTEGCFF

SEQ ID NO: 877300 - protein, 9 aa, Homo Sapiens
QDSIYLLAN

SEQ ID NO: 877301 - protein, 9 aa, Homo Sapiens
KTFQIHTPP

SEQ ID NO: 877302 - protein, 9 aa, Homo Sapiens
FTVAFGTGS

SEQ ID NO: 877303 - protein, 9 aa, Homo Sapiens
TDTNMHSHT

SEQ ID NO: 877304 - protein, 9 aa, Homo Sapiens
IPHPHLGPV

SEQ ID NO: 877305 - protein, 9 aa, Homo Sapiens
EENPEEDTE

SEQ ID NO: 877306 - protein, 9 aa, Homo Sapiens
THSPFQTLN

SEQ ID NO: 877307 - protein, 9 aa, Homo Sapiens
TGRNIRKNL

SEQ ID NO: 877308 - protein, 9 aa, Homo Sapiens
SQEENPEED

SEQ ID NO: 877309 - protein, 9 aa, Homo Sapiens
HNNILYRQF

SEQ ID NO: 877310 - protein, 9 aa, Homo Sapiens
DKPYECSDC

SEQ ID NO: 877311 - protein, 9 aa, Homo Sapiens
LPMREIIRR

SEQ ID NO: 877312 - protein, 9 aa, Homo Sapiens
SIYLLANSG

SEQ ID NO: 877313 - protein, 9 aa, Homo Sapiens
DGSQGFKQH

SEQ ID NO: 877314 - protein, 9 aa, Homo Sapiens
QYRTEQYQS

SEQ ID NO: 877315 - protein, 9 aa, Homo Sapiens
YQHHEIYLS

SEQ ID NO: 877316 - protein, 9 aa, Homo Sapiens
IVISMGFGH

SEQ ID NO: 877317 - protein, 9 aa, Homo Sapiens
SNLSRHVCS

SEQ ID NO: 877318 - protein, 9 aa, Homo Sapiens
QQKVEFCKR

SEQ ID NO: 877319 - protein, 9 aa, Homo Sapiens
ENFDQFFTR

SEQ ID NO: 877320 - protein, 9 aa, Homo Sapiens
ICGFCHLCD

SEQ ID NO: 877321 - protein, 9 aa, Homo Sapiens
AIDNPVHLK

SEQ ID NO: 877322 - protein, 9 aa, Homo Sapiens
ALVVATIAN

SEQ ID NO: 877323 - protein, 9 aa, Homo Sapiens
VSHLNQIHQ

SEQ ID NO: 877324 - protein, 9 aa, Homo Sapiens
MPFGVSELL

SEQ ID NO: 877325 - protein, 9 aa, Homo Sapiens
MWNQSFQGV

SEQ ID NO: 877326 - protein, 9 aa, Homo Sapiens
IETELSSSS

SEQ ID NO: 877327 - protein, 9 aa, Homo Sapiens
ARHLPKLGQ

SEQ ID NO: 877328 - protein, 9 aa, Homo Sapiens
GFHSRSSSV

SEQ ID NO: 877329 - protein, 9 aa, Homo Sapiens
VKVKDEKIC

SEQ ID NO: 877330 - protein, 9 aa, Homo Sapiens
QKEKLWQRL

SEQ ID NO: 877331 - protein, 9 aa, Homo Sapiens
NRVQLSRHK

SEQ ID NO: 877332 - protein, 9 aa, Homo Sapiens
PEEGKFILH

SEQ ID NO: 877333 - protein, 9 aa, Homo Sapiens
VENGPVEIV

SEQ ID NO: 877334 - protein, 9 aa, Homo Sapiens
ETYSRLMGT

SEQ ID NO: 877335 - protein, 9 aa, Homo Sapiens
ATDMRPLEA

SEQ ID NO: 877336 - protein, 9 aa, Homo Sapiens
LLDGKQSQT

SEQ ID NO: 877337 - protein, 9 aa, Homo Sapiens
VEDRNVYIT

SEQ ID NO: 877338 - protein, 9 aa, Homo Sapiens
MLPVITGNC

SEQ ID NO: 877339 - protein, 9 aa, Homo Sapiens
YPVKKTLIT

SEQ ID NO: 877340 - protein, 9 aa, Homo Sapiens
AQVQDNQQA

SEQ ID NO: 877341 - protein, 9 aa, Homo Sapiens
TFRDVAIQL

SEQ ID NO: 877342 - protein, 9 aa, Homo Sapiens
KGLCEAREQ

SEQ ID NO: 877343 - protein, 9 aa, Homo Sapiens
EEAEGGQNS

SEQ ID NO: 877344 - protein, 9 aa, Homo Sapiens
QVLLANSAH

SEQ ID NO: 877345 - protein, 9 aa, Homo Sapiens
NVVMLVPLP

SEQ ID NO: 877346 - protein, 9 aa, Homo Sapiens
QRMEDTFQF

SEQ ID NO: 877347 - protein, 9 aa, Homo Sapiens
HLLPLSLQW

SEQ ID NO: 877348 - protein, 9 aa, Homo Sapiens
IERYSRKTT

SEQ ID NO: 877349 - protein, 9 aa, Homo Sapiens
GQIHMYKQD

SEQ ID NO: 877350 - protein, 9 aa, Homo Sapiens
QSLSYAFTS

SEQ ID NO: 877351 - protein, 9 aa, Homo Sapiens
LKIKYRAAM

SEQ ID NO: 877352 - protein, 9 aa, Homo Sapiens
QNISYTPYD

SEQ ID NO: 877353 - protein, 9 aa, Homo Sapiens
AGTMALAFF

SEQ ID NO: 877354 - protein, 9 aa, Homo Sapiens
ENNCYRRLD

SEQ ID NO: 877355 - protein, 9 aa, Homo Sapiens
RHEICLSDP

SEQ ID NO: 877356 - protein, 9 aa, Homo Sapiens
YFSSPNVSS

SEQ ID NO: 877357 - protein, 9 aa, Homo Sapiens
SSYPVKKTL

SEQ ID NO: 877358 - protein, 9 aa, Homo Sapiens
KDVDNILLI

SEQ ID NO: 877359 - protein, 9 aa, Homo Sapiens
AIASERHSI

SEQ ID NO: 877360 - protein, 9 aa, Homo Sapiens
NREIYPGSK

SEQ ID NO: 877361 - protein, 9 aa, Homo Sapiens
ATAAFKTYS

SEQ ID NO: 877362 - protein, 9 aa, Homo Sapiens
HFQARSKKL

SEQ ID NO: 877363 - protein, 9 aa, Homo Sapiens
IFQDLQSSD

SEQ ID NO: 877364 - protein, 9 aa, Homo Sapiens
LILLSFLLV

SEQ ID NO: 877365 - protein, 9 aa, Homo Sapiens
EKQKLAYKL

SEQ ID NO: 877366 - protein, 9 aa, Homo Sapiens
EELCAALVL

SEQ ID NO: 877367 - protein, 9 aa, Homo Sapiens
TLLFCTVGI

SEQ ID NO: 877368 - protein, 9 aa, Homo Sapiens
RELDTDISY

SEQ ID NO: 877369 - protein, 9 aa, Homo Sapiens
FLQNAIMSY

SEQ ID NO: 877370 - protein, 9 aa, Homo Sapiens
PFKAKCKLV

SEQ ID NO: 877371 - protein, 9 aa, Homo Sapiens
DRRYVDKYR

SEQ ID NO: 877372 - protein, 9 aa, Homo Sapiens
DMGRINAGI

SEQ ID NO: 877373 - protein, 9 aa, Homo Sapiens
ITFKHIMAL

SEQ ID NO: 877374 - protein, 9 aa, Homo Sapiens
VLFQKRWFQ

SEQ ID NO: 877375 - protein, 9 aa, Homo Sapiens
SLNFSVSNF

SEQ ID NO: 877376 - protein, 9 aa, Homo Sapiens
SSVFSLGSG

SEQ ID NO: 877377 - protein, 9 aa, Homo Sapiens
KLFQIHLKL

SEQ ID NO: 877378 - protein, 9 aa, Homo Sapiens
WFIDALEKI

SEQ ID NO: 877379 - protein, 9 aa, Homo Sapiens
VDERDQYDE

SEQ ID NO: 877380 - protein, 9 aa, Homo Sapiens
FHLTIIPPN

SEQ ID NO: 877381 - protein, 9 aa, Homo Sapiens
FIMVVCMFS

SEQ ID NO: 877382 - protein, 9 aa, Homo Sapiens
EICNELEKQ

SEQ ID NO: 877383 - protein, 9 aa, Homo Sapiens
LFGKDAQQR

SEQ ID NO: 877384 - protein, 9 aa, Homo Sapiens
CGKVYGTSS

SEQ ID NO: 877385 - protein, 9 aa, Homo Sapiens
LHTLATDSN

SEQ ID NO: 877386 - protein, 9 aa, Homo Sapiens
LWIEKNDLR

SEQ ID NO: 877387 - protein, 9 aa, Homo Sapiens
FSETRTHQV

SEQ ID NO: 877388 - protein, 9 aa, Homo Sapiens
ARVMIGHIS

SEQ ID NO: 877389 - protein, 9 aa, Homo Sapiens
DKLTPLHCA

SEQ ID NO: 877390 - protein, 9 aa, Homo Sapiens
MAMVRSIIL

SEQ ID NO: 877391 - protein, 9 aa, Homo Sapiens
QRMWNQSFQ

SEQ ID NO: 877392 - protein, 9 aa, Homo Sapiens
AKNRINHAP

SEQ ID NO: 877393 - protein, 9 aa, Homo Sapiens
FWKSKDWPR

SEQ ID NO: 877394 - protein, 9 aa, Homo Sapiens
FGIQIQWDK

SEQ ID NO: 877395 - protein, 9 aa, Homo Sapiens
NNKEEAAEY

SEQ ID NO: 877396 - protein, 9 aa, Homo Sapiens
VTSRKKQEL

SEQ ID NO: 877397 - protein, 9 aa, Homo Sapiens
HQLFCDIPS

SEQ ID NO: 877398 - protein, 9 aa, Homo Sapiens
HRDKEYPNT

SEQ ID NO: 877399 - protein, 9 aa, Homo Sapiens
TFSSCVSDP

SEQ ID NO: 877400 - protein, 9 aa, Homo Sapiens
ISSPVNKVC

SEQ ID NO: 877401 - protein, 9 aa, Homo Sapiens
NPEGQKTMY

SEQ ID NO: 877402 - protein, 9 aa, Homo Sapiens
ARDYSQGMK

SEQ ID NO: 877403 - protein, 9 aa, Homo Sapiens
RVGHYLKDM

SEQ ID NO: 877404 - protein, 9 aa, Homo Sapiens
LKEYPVAFE

SEQ ID NO: 877405 - protein, 9 aa, Homo Sapiens
ESYNQTFMK

SEQ ID NO: 877406 - protein, 9 aa, Homo Sapiens
MVNSEDIFI

SEQ ID NO: 877407 - protein, 9 aa, Homo Sapiens
RITSSVVDF

SEQ ID NO: 877408 - protein, 9 aa, Homo Sapiens
CKRMEKEVS

SEQ ID NO: 877409 - protein, 9 aa, Homo Sapiens
DEAKHIKGE

SEQ ID NO: 877410 - protein, 9 aa, Homo Sapiens
NHIGMGVCY

SEQ ID NO: 877411 - protein, 9 aa, Homo Sapiens
NVQVNKAFL

SEQ ID NO: 877412 - protein, 9 aa, Homo Sapiens
WSLHPLALI

SEQ ID NO: 877413 - protein, 9 aa, Homo Sapiens
GSLELCGFK

SEQ ID NO: 877414 - protein, 9 aa, Homo Sapiens
GGGGSQSIS

SEQ ID NO: 877415 - protein, 9 aa, Homo Sapiens
DANQHCVCR

SEQ ID NO: 877416 - protein, 9 aa, Homo Sapiens
CQLHISQHE

SEQ ID NO: 877417 - protein, 9 aa, Homo Sapiens
IETKCFKEL

SEQ ID NO: 877418 - protein, 9 aa, Homo Sapiens
KVWILRLKE

SEQ ID NO: 877419 - protein, 9 aa, Homo Sapiens
IDKEENSDT

SEQ ID NO: 877420 - protein, 9 aa, Homo Sapiens
LFFKKGKKI

SEQ ID NO: 877421 - protein, 9 aa, Homo Sapiens
PDMKAEDEV

SEQ ID NO: 877422 - protein, 9 aa, Homo Sapiens
CKECGMAFQ

SEQ ID NO: 877423 - protein, 9 aa, Homo Sapiens
NLFINPGIL

SEQ ID NO: 877424 - protein, 9 aa, Homo Sapiens
VQLDNVFRQ

SEQ ID NO: 877425 - protein, 9 aa, Homo Sapiens
THTGDKPFE

SEQ ID NO: 877426 - protein, 9 aa, Homo Sapiens
AKPVCCKCG

SEQ ID NO: 877427 - protein, 9 aa, Homo Sapiens
CDSACDSLL

SEQ ID NO: 877428 - protein, 9 aa, Homo Sapiens
VGRMMQTFL

SEQ ID NO: 877429 - protein, 9 aa, Homo Sapiens
NISYDPHDW

SEQ ID NO: 877430 - protein, 9 aa, Homo Sapiens
KLETPSDSE

SEQ ID NO: 877431 - protein, 9 aa, Homo Sapiens
FAYVMCTVM

SEQ ID NO: 877432 - protein, 9 aa, Homo Sapiens
SPQERLPVL

SEQ ID NO: 877433 - protein, 9 aa, Homo Sapiens
GSKLMSSFA

SEQ ID NO: 877434 - protein, 9 aa, Homo Sapiens
KKKHQKSSS

SEQ ID NO: 877435 - protein, 9 aa, Homo Sapiens
AIHVIERCC

SEQ ID NO: 877436 - protein, 9 aa, Homo Sapiens
SRRGDTGVC

SEQ ID NO: 877437 - protein, 9 aa, Homo Sapiens
YNKSKDDDE

SEQ ID NO: 877438 - protein, 9 aa, Homo Sapiens
LRLAYYSAG

SEQ ID NO: 877439 - protein, 9 aa, Homo Sapiens
ICQGDTSKV

SEQ ID NO: 877440 - protein, 9 aa, Homo Sapiens
NWAGTGHYL

SEQ ID NO: 877441 - protein, 9 aa, Homo Sapiens
QTYLHSSKT

SEQ ID NO: 877442 - protein, 9 aa, Homo Sapiens
NPNDQKKTA

SEQ ID NO: 877443 - protein, 9 aa, Homo Sapiens
FILFQLYKE

SEQ ID NO: 877444 - protein, 9 aa, Homo Sapiens
SSVSHAWDS

SEQ ID NO: 877445 - protein, 9 aa, Homo Sapiens
ALRPSNQGE

SEQ ID NO: 877446 - protein, 9 aa, Homo Sapiens
TDLSAHSSD

SEQ ID NO: 877447 - protein, 9 aa, Homo Sapiens
TFEEIEKLV

SEQ ID NO: 877448 - protein, 9 aa, Homo Sapiens
SQAKVIQEG

SEQ ID NO: 877449 - protein, 9 aa, Homo Sapiens
RTVTQQRGN

SEQ ID NO: 877450 - protein, 9 aa, Homo Sapiens
TPSPTAPDA

SEQ ID NO: 877451 - protein, 9 aa, Homo Sapiens
LQALMLQRP

SEQ ID NO: 877452 - protein, 9 aa, Homo Sapiens
RRLFCHLQL

SEQ ID NO: 877453 - protein, 9 aa, Homo Sapiens
LGNRYYIDH

SEQ ID NO: 877454 - protein, 9 aa, Homo Sapiens
SYWVSLPGK

SEQ ID NO: 877455 - protein, 9 aa, Homo Sapiens
FDVCWHNKG

SEQ ID NO: 877456 - protein, 9 aa, Homo Sapiens
KFQKSVDAG

SEQ ID NO: 877457 - protein, 9 aa, Homo Sapiens
VGENFLHTY

SEQ ID NO: 877458 - protein, 9 aa, Homo Sapiens
PPRFCHQEH

SEQ ID NO: 877459 - protein, 9 aa, Homo Sapiens
LYEDTLIDE

SEQ ID NO: 877460 - protein, 9 aa, Homo Sapiens
QTLAYIPTP

SEQ ID NO: 877461 - protein, 9 aa, Homo Sapiens
AASSRSDME

SEQ ID NO: 877462 - protein, 9 aa, Homo Sapiens
SARNCYPPL

SEQ ID NO: 877463 - protein, 9 aa, Homo Sapiens
YAYYLSAFS

SEQ ID NO: 877464 - protein, 9 aa, Homo Sapiens
LHFGQMPAC

SEQ ID NO: 877465 - protein, 9 aa, Homo Sapiens
LTASAAGSS

SEQ ID NO: 877466 - protein, 9 aa, Homo Sapiens
PQSYPEGDD

SEQ ID NO: 877467 - protein, 9 aa, Homo Sapiens
ENDLTLLIA

SEQ ID NO: 877468 - protein, 9 aa, Homo Sapiens
CNSFLQEKT

SEQ ID NO: 877469 - protein, 9 aa, Homo Sapiens
KQHIGEQFY

SEQ ID NO: 877470 - protein, 9 aa, Homo Sapiens
LLGIIICSC

SEQ ID NO: 877471 - protein, 9 aa, Homo Sapiens
NFYHTGRLH

SEQ ID NO: 877472 - protein, 9 aa, Homo Sapiens
RVRKPNNLE

SEQ ID NO: 877473 - protein, 9 aa, Homo Sapiens
ALPMREIIR

SEQ ID NO: 877474 - protein, 9 aa, Homo Sapiens
GVPFACFKE

SEQ ID NO: 877475 - protein, 9 aa, Homo Sapiens
DRVQWDLLT

SEQ ID NO: 877476 - protein, 9 aa, Homo Sapiens
SGGLQPVTI

SEQ ID NO: 877477 - protein, 9 aa, Homo Sapiens
VLFSFCDGD

SEQ ID NO: 877478 - protein, 9 aa, Homo Sapiens
LGYPTLWIE

SEQ ID NO: 877479 - protein, 9 aa, Homo Sapiens
YANGKNIGK

SEQ ID NO: 877480 - protein, 9 aa, Homo Sapiens
ANADEGFGL

SEQ ID NO: 877481 - protein, 9 aa, Homo Sapiens
KCIAIDNPV

SEQ ID NO: 877482 - protein, 9 aa, Homo Sapiens
PKDLVVQQA

SEQ ID NO: 877483 - protein, 9 aa, Homo Sapiens
CGSTFFRYL

SEQ ID NO: 877484 - protein, 9 aa, Homo Sapiens
PIHKLGSTH

SEQ ID NO: 877485 - protein, 9 aa, Homo Sapiens
SSDHRTLLE

SEQ ID NO: 877486 - protein, 9 aa, Homo Sapiens
GNAIAQRIL

SEQ ID NO: 877487 - protein, 9 aa, Homo Sapiens
TISSDTFVI

SEQ ID NO: 877488 - protein, 9 aa, Homo Sapiens
NSLKYTFFE

SEQ ID NO: 877489 - protein, 9 aa, Homo Sapiens
EAGNESGLE

SEQ ID NO: 877490 - protein, 9 aa, Homo Sapiens
CQLLHEKIR

SEQ ID NO: 877491 - protein, 9 aa, Homo Sapiens
RGLRAISVG

SEQ ID NO: 877492 - protein, 9 aa, Homo Sapiens
VATEELLSF

SEQ ID NO: 877493 - protein, 9 aa, Homo Sapiens
KLCEQESEC

SEQ ID NO: 877494 - protein, 9 aa, Homo Sapiens
NMTLVILIQ

SEQ ID NO: 877495 - protein, 9 aa, Homo Sapiens
FELYHSSEV

SEQ ID NO: 877496 - protein, 9 aa, Homo Sapiens
EALVDITKI

SEQ ID NO: 877497 - protein, 9 aa, Homo Sapiens
RSKRCCVLE

SEQ ID NO: 877498 - protein, 9 aa, Homo Sapiens
QENYQKNGT

SEQ ID NO: 877499 - protein, 9 aa, Homo Sapiens
TLLQSPVAL

SEQ ID NO: 877500 - protein, 9 aa, Homo Sapiens
LKKRRWAQG

SEQ ID NO: 877501 - protein, 9 aa, Homo Sapiens
LFWEINWEE

SEQ ID NO: 877502 - protein, 9 aa, Homo Sapiens
KKSQEEIEK

SEQ ID NO: 877503 - protein, 9 aa, Homo Sapiens
KLFLKRNNL

SEQ ID NO: 877504 - protein, 9 aa, Homo Sapiens
LRMYYFDQG

SEQ ID NO: 877505 - protein, 9 aa, Homo Sapiens
RKAGISDYL

SEQ ID NO: 877506 - protein, 9 aa, Homo Sapiens
HVMIFVGVG

SEQ ID NO: 877507 - protein, 9 aa, Homo Sapiens
DECNRIDAS

SEQ ID NO: 877508 - protein, 9 aa, Homo Sapiens
CNKYMVTDG

SEQ ID NO: 877509 - protein, 9 aa, Homo Sapiens
ELENNIWKA

SEQ ID NO: 877510 - protein, 9 aa, Homo Sapiens
WHIYSGILN

SEQ ID NO: 877511 - protein, 9 aa, Homo Sapiens
GQMKQKYRV

SEQ ID NO: 877512 - protein, 9 aa, Homo Sapiens
NIHTGLSGS

SEQ ID NO: 877513 - protein, 9 aa, Homo Sapiens
VTQLAINTE

SEQ ID NO: 877514 - protein, 9 aa, Homo Sapiens
AYPNAFCIA

SEQ ID NO: 877515 - protein, 9 aa, Homo Sapiens
GAESVTEET

SEQ ID NO: 877516 - protein, 9 aa, Homo Sapiens
TFGSRVCIK

SEQ ID NO: 877517 - protein, 9 aa, Homo Sapiens
QIRLIGTTL

SEQ ID NO: 877518 - protein, 9 aa, Homo Sapiens
RKKKLKFPS

SEQ ID NO: 877519 - protein, 9 aa, Homo Sapiens
NYNVALQRS

SEQ ID NO: 877520 - protein, 9 aa, Homo Sapiens
HPGASTSPP

SEQ ID NO: 877521 - protein, 9 aa, Homo Sapiens
FGAKSKVSV

SEQ ID NO: 877522 - protein, 9 aa, Homo Sapiens
VCCVLERGE

SEQ ID NO: 877523 - protein, 9 aa, Homo Sapiens
PLQECISHS

SEQ ID NO: 877524 - protein, 9 aa, Homo Sapiens
HWVRRECDK

SEQ ID NO: 877525 - protein, 9 aa, Homo Sapiens
DQLAFIKEL

SEQ ID NO: 877526 - protein, 9 aa, Homo Sapiens
FLMIFKLTM

SEQ ID NO: 877527 - protein, 9 aa, Homo Sapiens
IALLGLKDL

SEQ ID NO: 877528 - protein, 9 aa, Homo Sapiens
LDMGQSGSY

SEQ ID NO: 877529 - protein, 9 aa, Homo Sapiens
VFICSSSFR

SEQ ID NO: 877530 - protein, 9 aa, Homo Sapiens
KKIGLETVG

SEQ ID NO: 877531 - protein, 9 aa, Homo Sapiens
KVSQKEKRN

SEQ ID NO: 877532 - protein, 9 aa, Homo Sapiens
PSGPYESDK

SEQ ID NO: 877533 - protein, 9 aa, Homo Sapiens
IEDLQGQTA

SEQ ID NO: 877534 - protein, 9 aa, Homo Sapiens
RSTSSDCQD

SEQ ID NO: 877535 - protein, 9 aa, Homo Sapiens
VKTATITKP

SEQ ID NO: 877536 - protein, 9 aa, Homo Sapiens
RSLVASSPS

SEQ ID NO: 877537 - protein, 9 aa, Homo Sapiens
YAISAPSIY

SEQ ID NO: 877538 - protein, 9 aa, Homo Sapiens
YGGGKGSGS

SEQ ID NO: 877539 - protein, 9 aa, Homo Sapiens
NDLTLLIAM

SEQ ID NO: 877540 - protein, 9 aa, Homo Sapiens
WGRGAKCGA

SEQ ID NO: 877541 - protein, 9 aa, Homo Sapiens
QNVLKVLTN

SEQ ID NO: 877542 - protein, 9 aa, Homo Sapiens
LEEQKTDNG

SEQ ID NO: 877543 - protein, 9 aa, Homo Sapiens
IATNKAYLD

SEQ ID NO: 877544 - protein, 9 aa, Homo Sapiens
CVYCSYVSW

SEQ ID NO: 877545 - protein, 9 aa, Homo Sapiens
NELYKEKAL

SEQ ID NO: 877546 - protein, 9 aa, Homo Sapiens
HKVCDGEGV

SEQ ID NO: 877547 - protein, 9 aa, Homo Sapiens
EKHLNYLWN

SEQ ID NO: 877548 - protein, 9 aa, Homo Sapiens
ANLTLGSLL

SEQ ID NO: 877549 - protein, 9 aa, Homo Sapiens
NISKLHLET

SEQ ID NO: 877550 - protein, 9 aa, Homo Sapiens
GFLGLWQGV

SEQ ID NO: 877551 - protein, 9 aa, Homo Sapiens
YEDIQNVVL

SEQ ID NO: 877552 - protein, 9 aa, Homo Sapiens
CQCHGAPCN

SEQ ID NO: 877553 - protein, 9 aa, Homo Sapiens
SGLQKGTKK

SEQ ID NO: 877554 - protein, 9 aa, Homo Sapiens
KVVFYTWAD

SEQ ID NO: 877555 - protein, 9 aa, Homo Sapiens
GPKSLPVPT

SEQ ID NO: 877556 - protein, 9 aa, Homo Sapiens
TLSPQTLQS

SEQ ID NO: 877557 - protein, 9 aa, Homo Sapiens
DAKPDNFIT

SEQ ID NO: 877558 - protein, 9 aa, Homo Sapiens
KQSQTVGIL

SEQ ID NO: 877559 - protein, 9 aa, Homo Sapiens
KTFEEENQT

SEQ ID NO: 877560 - protein, 9 aa, Homo Sapiens
EFQSLILVP

SEQ ID NO: 877561 - protein, 9 aa, Homo Sapiens
FTHISTGEL

SEQ ID NO: 877562 - protein, 9 aa, Homo Sapiens
SAYFRLQEL

SEQ ID NO: 877563 - protein, 9 aa, Homo Sapiens
LEGYYAYYL

SEQ ID NO: 877564 - protein, 9 aa, Homo Sapiens
KLTNDHVQF

SEQ ID NO: 877565 - protein, 9 aa, Homo Sapiens
EAWLRHEVQ

SEQ ID NO: 877566 - protein, 9 aa, Homo Sapiens
MFIMVVCMF

SEQ ID NO: 877567 - protein, 9 aa, Homo Sapiens
PFRKNKMKE

SEQ ID NO: 877568 - protein, 9 aa, Homo Sapiens
KLTGKECED

SEQ ID NO: 877569 - protein, 9 aa, Homo Sapiens
LICAKKRSD

SEQ ID NO: 877570 - protein, 9 aa, Homo Sapiens
HFHPDKDPF

SEQ ID NO: 877571 - protein, 9 aa, Homo Sapiens
KPDNLLYYS

SEQ ID NO: 877572 - protein, 9 aa, Homo Sapiens
NEKKQHDTF

SEQ ID NO: 877573 - protein, 9 aa, Homo Sapiens
IHCKAGKGQ

SEQ ID NO: 877574 - protein, 9 aa, Homo Sapiens
QEGDRILVV

SEQ ID NO: 877575 - protein, 9 aa, Homo Sapiens
KALLETSDK

SEQ ID NO: 877576 - protein, 9 aa, Homo Sapiens
AEFRVFCLQ

SEQ ID NO: 877577 - protein, 9 aa, Homo Sapiens
QLQQDDLGT

SEQ ID NO: 877578 - protein, 9 aa, Homo Sapiens
ETGAMVCCN

SEQ ID NO: 877579 - protein, 9 aa, Homo Sapiens
AKEVFKEII

SEQ ID NO: 877580 - protein, 9 aa, Homo Sapiens
LCMFFEPLL

SEQ ID NO: 877581 - protein, 9 aa, Homo Sapiens
AGLRTGGFL

SEQ ID NO: 877582 - protein, 9 aa, Homo Sapiens
PIGFHRVVK

SEQ ID NO: 877583 - protein, 9 aa, Homo Sapiens
ESLAISGLR

SEQ ID NO: 877584 - protein, 9 aa, Homo Sapiens
INTLKSTAS

SEQ ID NO: 877585 - protein, 9 aa, Homo Sapiens
EEWQKSRTE

SEQ ID NO: 877586 - protein, 9 aa, Homo Sapiens
KAFAEARIN

SEQ ID NO: 877587 - protein, 9 aa, Homo Sapiens
TSFAYPAIQ

SEQ ID NO: 877588 - protein, 9 aa, Homo Sapiens
GSSAANTLT

SEQ ID NO: 877589 - protein, 9 aa, Homo Sapiens
SLFALQTLQ

SEQ ID NO: 877590 - protein, 9 aa, Homo Sapiens
KEGKDEHPQ

SEQ ID NO: 877591 - protein, 9 aa, Homo Sapiens
MPGKVRRRS

SEQ ID NO: 877592 - protein, 9 aa, Homo Sapiens
WFVPLFGEN

SEQ ID NO: 877593 - protein, 9 aa, Homo Sapiens
LTSKIVSSI

SEQ ID NO: 877594 - protein, 9 aa, Homo Sapiens
PGTPFLPIQ

SEQ ID NO: 877595 - protein, 9 aa, Homo Sapiens
DRDNVRIPG

SEQ ID NO: 877596 - protein, 9 aa, Homo Sapiens
KSRAFIIEE

SEQ ID NO: 877597 - protein, 9 aa, Homo Sapiens
HNKGKNAQP

SEQ ID NO: 877598 - protein, 9 aa, Homo Sapiens
LEKHNHQSL

SEQ ID NO: 877599 - protein, 9 aa, Homo Sapiens
LEKAQTYLK

SEQ ID NO: 877600 - protein, 9 aa, Homo Sapiens
EEYFMRQQR

SEQ ID NO: 877601 - protein, 9 aa, Homo Sapiens
KLELEVDDP

SEQ ID NO: 877602 - protein, 9 aa, Homo Sapiens
LLIHTSERT

SEQ ID NO: 877603 - protein, 9 aa, Homo Sapiens
KITSFQPVQ

SEQ ID NO: 877604 - protein, 9 aa, Homo Sapiens
LKFCFYSEI

SEQ ID NO: 877605 - protein, 9 aa, Homo Sapiens
WLDRRALCA

SEQ ID NO: 877606 - protein, 9 aa, Homo Sapiens
ECKDCWKTF

SEQ ID NO: 877607 - protein, 9 aa, Homo Sapiens
VIPLATSLG

SEQ ID NO: 877608 - protein, 9 aa, Homo Sapiens
RLKHMKFDE

SEQ ID NO: 877609 - protein, 9 aa, Homo Sapiens
EQLQMDGAP

SEQ ID NO: 877610 - protein, 9 aa, Homo Sapiens
CSPSSSVSH

SEQ ID NO: 877611 - protein, 9 aa, Homo Sapiens
VPMVPLQIL

SEQ ID NO: 877612 - protein, 9 aa, Homo Sapiens
HKHLAFLLG

SEQ ID NO: 877613 - protein, 9 aa, Homo Sapiens
TIATVINLS

SEQ ID NO: 877614 - protein, 9 aa, Homo Sapiens
GSPKTCNRK

SEQ ID NO: 877615 - protein, 9 aa, Homo Sapiens
LIHTGFDWL

SEQ ID NO: 877616 - protein, 9 aa, Homo Sapiens
AFKKLNNLN

SEQ ID NO: 877617 - protein, 9 aa, Homo Sapiens
NSLSFCTNH

SEQ ID NO: 877618 - protein, 9 aa, Homo Sapiens
PQRVRKPNN

SEQ ID NO: 877619 - protein, 9 aa, Homo Sapiens
ALHAAITAD

SEQ ID NO: 877620 - protein, 9 aa, Homo Sapiens
SKDWPRRIR

SEQ ID NO: 877621 - protein, 9 aa, Homo Sapiens
FTEFFLMIF

SEQ ID NO: 877622 - protein, 9 aa, Homo Sapiens
FFMVVKQCS

SEQ ID NO: 877623 - protein, 9 aa, Homo Sapiens
ARLECSDNN

SEQ ID NO: 877624 - protein, 9 aa, Homo Sapiens
QHSRDHGLP

SEQ ID NO: 877625 - protein, 9 aa, Homo Sapiens
HKYFLIGEG

SEQ ID NO: 877626 - protein, 9 aa, Homo Sapiens
YSREELNLM

SEQ ID NO: 877627 - protein, 9 aa, Homo Sapiens
LGISCFFLW

SEQ ID NO: 877628 - protein, 9 aa, Homo Sapiens
AKANYCQCH

SEQ ID NO: 877629 - protein, 9 aa, Homo Sapiens
YVSLPVPDL

SEQ ID NO: 877630 - protein, 9 aa, Homo Sapiens
DNKYYDAYL

SEQ ID NO: 877631 - protein, 9 aa, Homo Sapiens
KPCECNVCG

SEQ ID NO: 877632 - protein, 9 aa, Homo Sapiens
DLFNLPHNR

SEQ ID NO: 877633 - protein, 9 aa, Homo Sapiens
SYFFWLERG

SEQ ID NO: 877634 - protein, 9 aa, Homo Sapiens
CSKEDQCKI

SEQ ID NO: 877635 - protein, 9 aa, Homo Sapiens
PPLRELFVD

SEQ ID NO: 877636 - protein, 9 aa, Homo Sapiens
SQRHREELS

SEQ ID NO: 877637 - protein, 9 aa, Homo Sapiens
NNMLCAGFH

SEQ ID NO: 877638 - protein, 9 aa, Homo Sapiens
STGLDSIGL

SEQ ID NO: 877639 - protein, 9 aa, Homo Sapiens
MTLLPENGY

SEQ ID NO: 877640 - protein, 9 aa, Homo Sapiens
KKGEIFQII

SEQ ID NO: 877641 - protein, 9 aa, Homo Sapiens
NFGIWDNHI

SEQ ID NO: 877642 - protein, 9 aa, Homo Sapiens
KGYKFMFDE

SEQ ID NO: 877643 - protein, 9 aa, Homo Sapiens
CKLHPDLVS

SEQ ID NO: 877644 - protein, 9 aa, Homo Sapiens
IFKNADNGT

SEQ ID NO: 877645 - protein, 9 aa, Homo Sapiens
DPETMQTTT

SEQ ID NO: 877646 - protein, 9 aa, Homo Sapiens
EKKAHTQNQ

SEQ ID NO: 877647 - protein, 9 aa, Homo Sapiens
GYWSEVDKI

SEQ ID NO: 877648 - protein, 9 aa, Homo Sapiens
ELMNMLWSQ

SEQ ID NO: 877649 - protein, 9 aa, Homo Sapiens
DDIQKARQH

SEQ ID NO: 877650 - protein, 9 aa, Homo Sapiens
VILALVIVI

SEQ ID NO: 877651 - protein, 9 aa, Homo Sapiens
IQGSITRHY

SEQ ID NO: 877652 - protein, 9 aa, Homo Sapiens
CKFCGKGFH

SEQ ID NO: 877653 - protein, 9 aa, Homo Sapiens
KTIINKSSE

SEQ ID NO: 877654 - protein, 9 aa, Homo Sapiens
QLKETLTTQ

SEQ ID NO: 877655 - protein, 9 aa, Homo Sapiens
IGSDISNFG

SEQ ID NO: 877656 - protein, 9 aa, Homo Sapiens
PTNVLQPTP

SEQ ID NO: 877657 - protein, 9 aa, Homo Sapiens
ENQCLKQLQ

SEQ ID NO: 877658 - protein, 9 aa, Homo Sapiens
VPASDSRPT

SEQ ID NO: 877659 - protein, 9 aa, Homo Sapiens
RVCADVTIN

SEQ ID NO: 877660 - protein, 9 aa, Homo Sapiens
LWDLSSSIN

SEQ ID NO: 877661 - protein, 9 aa, Homo Sapiens
VLCGGGEQL

SEQ ID NO: 877662 - protein, 9 aa, Homo Sapiens
TAIDIFEDI

SEQ ID NO: 877663 - protein, 9 aa, Homo Sapiens
CYQLYQGIN

SEQ ID NO: 877664 - protein, 9 aa, Homo Sapiens
RTLGVAKLF

SEQ ID NO: 877665 - protein, 9 aa, Homo Sapiens
SNCLENIAE

SEQ ID NO: 877666 - protein, 9 aa, Homo Sapiens
ETYSHCLIS

SEQ ID NO: 877667 - protein, 9 aa, Homo Sapiens
QYIENSDSE

SEQ ID NO: 877668 - protein, 9 aa, Homo Sapiens
KKDYLRELS

SEQ ID NO: 877669 - protein, 9 aa, Homo Sapiens
SPAIDTPPQ

SEQ ID NO: 877670 - protein, 9 aa, Homo Sapiens
PGLGHQVPE

SEQ ID NO: 877671 - protein, 9 aa, Homo Sapiens
TFDLQIIGF

SEQ ID NO: 877672 - protein, 9 aa, Homo Sapiens
WYKNRKSKE

SEQ ID NO: 877673 - protein, 9 aa, Homo Sapiens
LFCRSGWTA

SEQ ID NO: 877674 - protein, 9 aa, Homo Sapiens
KLKTKDSGL

SEQ ID NO: 877675 - protein, 9 aa, Homo Sapiens
VLIVQRWMR

SEQ ID NO: 877676 - protein, 9 aa, Homo Sapiens
HADCITQIK

SEQ ID NO: 877677 - protein, 9 aa, Homo Sapiens
YSQNHLQQA

SEQ ID NO: 877678 - protein, 9 aa, Homo Sapiens
VDPQGIYAI

SEQ ID NO: 877679 - protein, 9 aa, Homo Sapiens
FKGKNCELF

SEQ ID NO: 877680 - protein, 9 aa, Homo Sapiens
CVRASYDTG

SEQ ID NO: 877681 - protein, 9 aa, Homo Sapiens
DQLSWFTAL

SEQ ID NO: 877682 - protein, 9 aa, Homo Sapiens
IKYRAAMLE

SEQ ID NO: 877683 - protein, 9 aa, Homo Sapiens
GRSQTPGLK

SEQ ID NO: 877684 - protein, 9 aa, Homo Sapiens
YQNQRFRSK

SEQ ID NO: 877685 - protein, 9 aa, Homo Sapiens
MRKIRTKKM

SEQ ID NO: 877686 - protein, 9 aa, Homo Sapiens
TCQLPSICL

SEQ ID NO: 877687 - protein, 9 aa, Homo Sapiens
IQNSNKNIL

SEQ ID NO: 877688 - protein, 9 aa, Homo Sapiens
DYSQGMKNQ

SEQ ID NO: 877689 - protein, 9 aa, Homo Sapiens
IQYLLYGEK

SEQ ID NO: 877690 - protein, 9 aa, Homo Sapiens
VGLLLFYFI

SEQ ID NO: 877691 - protein, 9 aa, Homo Sapiens
APFIECNGR

SEQ ID NO: 877692 - protein, 9 aa, Homo Sapiens
RTVRARRPP

SEQ ID NO: 877693 - protein, 9 aa, Homo Sapiens
AVCMHNLKT

SEQ ID NO: 877694 - protein, 9 aa, Homo Sapiens
FDDFANVNA

SEQ ID NO: 877695 - protein, 9 aa, Homo Sapiens
EGFELMDDY

SEQ ID NO: 877696 - protein, 9 aa, Homo Sapiens
SVPSVPHKL

SEQ ID NO: 877697 - protein, 9 aa, Homo Sapiens
RCDPNFHLV

SEQ ID NO: 877698 - protein, 9 aa, Homo Sapiens
AGLQNGPRC

SEQ ID NO: 877699 - protein, 9 aa, Homo Sapiens
IKSITKKTF

SEQ ID NO: 877700 - protein, 9 aa, Homo Sapiens
KEICAQTFF

SEQ ID NO: 877701 - protein, 9 aa, Homo Sapiens
MQEGGTCNA

SEQ ID NO: 877702 - protein, 9 aa, Homo Sapiens
HNRDSILNP

SEQ ID NO: 877703 - protein, 9 aa, Homo Sapiens
VTTLHSAPA

SEQ ID NO: 877704 - protein, 9 aa, Homo Sapiens
LKSQKRYHK

SEQ ID NO: 877705 - protein, 9 aa, Homo Sapiens
YHDALNIIN

SEQ ID NO: 877706 - protein, 9 aa, Homo Sapiens
LVITYQTVA

SEQ ID NO: 877707 - protein, 9 aa, Homo Sapiens
LDSMKAKIT

SEQ ID NO: 877708 - protein, 9 aa, Homo Sapiens
LNTTTAYVL

SEQ ID NO: 877709 - protein, 9 aa, Homo Sapiens
AKTTSVSTG

SEQ ID NO: 877710 - protein, 9 aa, Homo Sapiens
FDQADTFCP

SEQ ID NO: 877711 - protein, 9 aa, Homo Sapiens
SPRNSPQPS

SEQ ID NO: 877712 - protein, 9 aa, Homo Sapiens
NYSPRAADK

SEQ ID NO: 877713 - protein, 9 aa, Homo Sapiens
PKMLADVLS

SEQ ID NO: 877714 - protein, 9 aa, Homo Sapiens
LVPATLGKN

SEQ ID NO: 877715 - protein, 9 aa, Homo Sapiens
CKRNQVVFS

SEQ ID NO: 877716 - protein, 9 aa, Homo Sapiens
NGFLADDNC

SEQ ID NO: 877717 - protein, 9 aa, Homo Sapiens
STFNLFNIC

SEQ ID NO: 877718 - protein, 9 aa, Homo Sapiens
LRFGVQVLQ

SEQ ID NO: 877719 - protein, 9 aa, Homo Sapiens
LCSLGRAVR

SEQ ID NO: 877720 - protein, 9 aa, Homo Sapiens
TMKYVFDLI

SEQ ID NO: 877721 - protein, 9 aa, Homo Sapiens
SEREQFCQE

SEQ ID NO: 877722 - protein, 9 aa, Homo Sapiens
IKAHKVAQA

SEQ ID NO: 877723 - protein, 9 aa, Homo Sapiens
TLCTPSTTS

SEQ ID NO: 877724 - protein, 9 aa, Homo Sapiens
SHKLQGMGK

SEQ ID NO: 877725 - protein, 9 aa, Homo Sapiens
DKNALESIL

SEQ ID NO: 877726 - protein, 9 aa, Homo Sapiens
SVREKRDVQ

SEQ ID NO: 877727 - protein, 9 aa, Homo Sapiens
PFREARKIT

SEQ ID NO: 877728 - protein, 9 aa, Homo Sapiens
AQSLKNKLG

SEQ ID NO: 877729 - protein, 9 aa, Homo Sapiens
PPQQSIDKP

SEQ ID NO: 877730 - protein, 9 aa, Homo Sapiens
AHKWMPDQI

SEQ ID NO: 877731 - protein, 9 aa, Homo Sapiens
YISQGENPK

SEQ ID NO: 877732 - protein, 9 aa, Homo Sapiens
CQLAVVDGG

SEQ ID NO: 877733 - protein, 9 aa, Homo Sapiens
HTNQTEAFQ

SEQ ID NO: 877734 - protein, 9 aa, Homo Sapiens
GRETSGRFP

SEQ ID NO: 877735 - protein, 9 aa, Homo Sapiens
IQAAAAVCL

SEQ ID NO: 877736 - protein, 9 aa, Homo Sapiens
SCQPNNPRE

SEQ ID NO: 877737 - protein, 9 aa, Homo Sapiens
SCQAADYDN

SEQ ID NO: 877738 - protein, 9 aa, Homo Sapiens
APPAEDRLA

SEQ ID NO: 877739 - protein, 9 aa, Homo Sapiens
VYVRVPNFN

SEQ ID NO: 877740 - protein, 9 aa, Homo Sapiens
LPNYRTFLG

SEQ ID NO: 877741 - protein, 9 aa, Homo Sapiens
TKVPCSLEV

SEQ ID NO: 877742 - protein, 9 aa, Homo Sapiens
EITFNTSVY

SEQ ID NO: 877743 - protein, 9 aa, Homo Sapiens
MKPFKDALR

SEQ ID NO: 877744 - protein, 9 aa, Homo Sapiens
LQELLQFHR

SEQ ID NO: 877745 - protein, 9 aa, Homo Sapiens
EKLDWLATA

SEQ ID NO: 877746 - protein, 9 aa, Homo Sapiens
PASILRAVP

SEQ ID NO: 877747 - protein, 9 aa, Homo Sapiens
QIKELVNAG

SEQ ID NO: 877748 - protein, 9 aa, Homo Sapiens
NYYRKQRQK

SEQ ID NO: 877749 - protein, 9 aa, Homo Sapiens
QNNKITKIK

SEQ ID NO: 877750 - protein, 9 aa, Homo Sapiens
RLGRTALIL

SEQ ID NO: 877751 - protein, 9 aa, Homo Sapiens
LPSDRMSTK

SEQ ID NO: 877752 - protein, 9 aa, Homo Sapiens
YIQTQIISK

SEQ ID NO: 877753 - protein, 9 aa, Homo Sapiens
SSPSLAVTS

SEQ ID NO: 877754 - protein, 9 aa, Homo Sapiens
ELTSKIVSS

SEQ ID NO: 877755 - protein, 9 aa, Homo Sapiens
HPGSVAQKE

SEQ ID NO: 877756 - protein, 9 aa, Homo Sapiens
NSVGNTCGL

SEQ ID NO: 877757 - protein, 9 aa, Homo Sapiens
ELVNASCEE

SEQ ID NO: 877758 - protein, 9 aa, Homo Sapiens
EITQDFKTD

SEQ ID NO: 877759 - protein, 9 aa, Homo Sapiens
YGNSINVVY

SEQ ID NO: 877760 - protein, 9 aa, Homo Sapiens
GMGVCYNAE

SEQ ID NO: 877761 - protein, 9 aa, Homo Sapiens
WEDCSVLCG

SEQ ID NO: 877762 - protein, 9 aa, Homo Sapiens
GTEPPGSSS

SEQ ID NO: 877763 - protein, 9 aa, Homo Sapiens
DDSESRWRL

SEQ ID NO: 877764 - protein, 9 aa, Homo Sapiens
ARKLLSSDQ

SEQ ID NO: 877765 - protein, 9 aa, Homo Sapiens
DLTPILRLL

SEQ ID NO: 877766 - protein, 9 aa, Homo Sapiens
KILAILYLC

SEQ ID NO: 877767 - protein, 9 aa, Homo Sapiens
VCMAGALLR

SEQ ID NO: 877768 - protein, 9 aa, Homo Sapiens
MSALSLSNV

SEQ ID NO: 877769 - protein, 9 aa, Homo Sapiens
LCCYLCKQS

SEQ ID NO: 877770 - protein, 9 aa, Homo Sapiens
LSPEQTKLW

SEQ ID NO: 877771 - protein, 9 aa, Homo Sapiens
LAPPAEDRL

SEQ ID NO: 877772 - protein, 9 aa, Homo Sapiens
HNRPYFKRS

SEQ ID NO: 877773 - protein, 9 aa, Homo Sapiens
IHQLFCDIP

SEQ ID NO: 877774 - protein, 9 aa, Homo Sapiens
KEPSAWKWM

SEQ ID NO: 877775 - protein, 9 aa, Homo Sapiens
PEELPELSC

SEQ ID NO: 877776 - protein, 9 aa, Homo Sapiens
ISYIDAEDV

SEQ ID NO: 877777 - protein, 9 aa, Homo Sapiens
MKESVQLLS

SEQ ID NO: 877778 - protein, 9 aa, Homo Sapiens
RHDSSGEGE

SEQ ID NO: 877779 - protein, 9 aa, Homo Sapiens
YVFYILIVD

SEQ ID NO: 877780 - protein, 9 aa, Homo Sapiens
KKIQREVKI

SEQ ID NO: 877781 - protein, 9 aa, Homo Sapiens
VYLQRNMGN

SEQ ID NO: 877782 - protein, 9 aa, Homo Sapiens
AGYLILSAA

SEQ ID NO: 877783 - protein, 9 aa, Homo Sapiens
ATGIARMFP

SEQ ID NO: 877784 - protein, 9 aa, Homo Sapiens
QEWTLENNP

SEQ ID NO: 877785 - protein, 9 aa, Homo Sapiens
ASAAVEKGT

SEQ ID NO: 877786 - protein, 9 aa, Homo Sapiens
SVSKTLIFI

SEQ ID NO: 877787 - protein, 9 aa, Homo Sapiens
EGQPLHTKL

SEQ ID NO: 877788 - protein, 9 aa, Homo Sapiens
QSQQTLDTP

SEQ ID NO: 877789 - protein, 9 aa, Homo Sapiens
PYPSAYPVR

SEQ ID NO: 877790 - protein, 9 aa, Homo Sapiens
PRKYSEKYA

SEQ ID NO: 877791 - protein, 9 aa, Homo Sapiens
RTRAETEEL

SEQ ID NO: 877792 - protein, 9 aa, Homo Sapiens
HSNRYLYAR

SEQ ID NO: 877793 - protein, 9 aa, Homo Sapiens
PCSICKHKI

SEQ ID NO: 877794 - protein, 9 aa, Homo Sapiens
IFWLNAADT

SEQ ID NO: 877795 - protein, 9 aa, Homo Sapiens
LAQPADNHE

SEQ ID NO: 877796 - protein, 9 aa, Homo Sapiens
HWLTGEGMD

SEQ ID NO: 877797 - protein, 9 aa, Homo Sapiens
QRHREELSD

SEQ ID NO: 877798 - protein, 9 aa, Homo Sapiens
VLRLRRSLS

SEQ ID NO: 877799 - protein, 9 aa, Homo Sapiens
QLPLVTDKS

SEQ ID NO: 877800 - protein, 9 aa, Homo Sapiens
IGMGVCYNA

SEQ ID NO: 877801 - protein, 9 aa, Homo Sapiens
EIIITVSTN

SEQ ID NO: 877802 - protein, 9 aa, Homo Sapiens
MFCLILLIL

SEQ ID NO: 877803 - protein, 9 aa, Homo Sapiens
GLRTGGFLI

SEQ ID NO: 877804 - protein, 9 aa, Homo Sapiens
SELVSWYLK

SEQ ID NO: 877805 - protein, 9 aa, Homo Sapiens
IITEHRVFF

SEQ ID NO: 877806 - protein, 9 aa, Homo Sapiens
HDLTSVQAL

SEQ ID NO: 877807 - protein, 9 aa, Homo Sapiens
THSGDLESE

SEQ ID NO: 877808 - protein, 9 aa, Homo Sapiens
QREKIKYIS

SEQ ID NO: 877809 - protein, 9 aa, Homo Sapiens
YLNIVLSIL

SEQ ID NO: 877810 - protein, 9 aa, Homo Sapiens
GFTRTKGYS

SEQ ID NO: 877811 - protein, 9 aa, Homo Sapiens
VSQVDDIFI

SEQ ID NO: 877812 - protein, 9 aa, Homo Sapiens
VSIEVANVN

SEQ ID NO: 877813 - protein, 9 aa, Homo Sapiens
KQPSHVIYT

SEQ ID NO: 877814 - protein, 9 aa, Homo Sapiens
SDLEYRISQ

SEQ ID NO: 877815 - protein, 9 aa, Homo Sapiens
GKVVFYTWA

SEQ ID NO: 877816 - protein, 9 aa, Homo Sapiens
RTYEKCFGL

SEQ ID NO: 877817 - protein, 9 aa, Homo Sapiens
ATPYEAFNP

SEQ ID NO: 877818 - protein, 9 aa, Homo Sapiens
PERAKLAAS

SEQ ID NO: 877819 - protein, 9 aa, Homo Sapiens
EKAFQLQEQ

SEQ ID NO: 877820 - protein, 9 aa, Homo Sapiens
CNELEKQMN

SEQ ID NO: 877821 - protein, 9 aa, Homo Sapiens
SSREERLWF

SEQ ID NO: 877822 - protein, 9 aa, Homo Sapiens
TLNGHEKDT

SEQ ID NO: 877823 - protein, 9 aa, Homo Sapiens
LTENQCLKQ

SEQ ID NO: 877824 - protein, 9 aa, Homo Sapiens
MYRFCTKNR

SEQ ID NO: 877825 - protein, 9 aa, Homo Sapiens
SHSTLKQKE

SEQ ID NO: 877826 - protein, 9 aa, Homo Sapiens
LLDHLGNSV

SEQ ID NO: 877827 - protein, 9 aa, Homo Sapiens
SNNFPLRAQ

SEQ ID NO: 877828 - protein, 9 aa, Homo Sapiens
TEGIIKAKE

SEQ ID NO: 877829 - protein, 9 aa, Homo Sapiens
KPAQPEGQK

SEQ ID NO: 877830 - protein, 9 aa, Homo Sapiens
IFEPVYPIK

SEQ ID NO: 877831 - protein, 9 aa, Homo Sapiens
NLLEKIQKE

SEQ ID NO: 877832 - protein, 9 aa, Homo Sapiens
IICLLLMST

SEQ ID NO: 877833 - protein, 9 aa, Homo Sapiens
TRVTGDHVN

SEQ ID NO: 877834 - protein, 9 aa, Homo Sapiens
LRFTKLGFE

SEQ ID NO: 877835 - protein, 9 aa, Homo Sapiens
VCTCTSQKA

SEQ ID NO: 877836 - protein, 9 aa, Homo Sapiens
NPQLQMASP

SEQ ID NO: 877837 - protein, 9 aa, Homo Sapiens
LKLLGHLTS

SEQ ID NO: 877838 - protein, 9 aa, Homo Sapiens
KQKYRVCNV

SEQ ID NO: 877839 - protein, 9 aa, Homo Sapiens
TLIINLGEQ

SEQ ID NO: 877840 - protein, 9 aa, Homo Sapiens
KGQRLVFDN

SEQ ID NO: 877841 - protein, 9 aa, Homo Sapiens
LLLIQNDYF

SEQ ID NO: 877842 - protein, 9 aa, Homo Sapiens
RLFELFDRT

SEQ ID NO: 877843 - protein, 9 aa, Homo Sapiens
SEAAIMTNS

SEQ ID NO: 877844 - protein, 9 aa, Homo Sapiens
KFTNFKRIR

SEQ ID NO: 877845 - protein, 9 aa, Homo Sapiens
KGDKLQLFC

SEQ ID NO: 877846 - protein, 9 aa, Homo Sapiens
KFETKAQKG

SEQ ID NO: 877847 - protein, 9 aa, Homo Sapiens
WTLENNPSY

SEQ ID NO: 877848 - protein, 9 aa, Homo Sapiens
SVSLIIDIK

SEQ ID NO: 877849 - protein, 9 aa, Homo Sapiens
GREHNFSTY

SEQ ID NO: 877850 - protein, 9 aa, Homo Sapiens
ARKKPQNTS

SEQ ID NO: 877851 - protein, 9 aa, Homo Sapiens
HHLNEMERT

SEQ ID NO: 877852 - protein, 9 aa, Homo Sapiens
HGRHSSYCS

SEQ ID NO: 877853 - protein, 9 aa, Homo Sapiens
FSCGNGFKL

SEQ ID NO: 877854 - protein, 9 aa, Homo Sapiens
GRRQHYRNE

SEQ ID NO: 877855 - protein, 9 aa, Homo Sapiens
FDPYTLAIN

SEQ ID NO: 877856 - protein, 9 aa, Homo Sapiens
QQANGNMQL

SEQ ID NO: 877857 - protein, 9 aa, Homo Sapiens
PNDSACASW

SEQ ID NO: 877858 - protein, 9 aa, Homo Sapiens
IVSSIKVLE

SEQ ID NO: 877859 - protein, 9 aa, Homo Sapiens
QLCSLMESL

SEQ ID NO: 877860 - protein, 9 aa, Homo Sapiens
GVLFCRSGW

SEQ ID NO: 877861 - protein, 9 aa, Homo Sapiens
QGGQMVDNV

SEQ ID NO: 877862 - protein, 9 aa, Homo Sapiens
SKTGETVVE

SEQ ID NO: 877863 - protein, 9 aa, Homo Sapiens
EIETELQTE

SEQ ID NO: 877864 - protein, 9 aa, Homo Sapiens
KGFWRPLRG

SEQ ID NO: 877865 - protein, 9 aa, Homo Sapiens
KFVCEGCQR

SEQ ID NO: 877866 - protein, 9 aa, Homo Sapiens
VHDIRQNES

SEQ ID NO: 877867 - protein, 9 aa, Homo Sapiens
TFHISPEGF

SEQ ID NO: 877868 - protein, 9 aa, Homo Sapiens
QDNTPGQKR

SEQ ID NO: 877869 - protein, 9 aa, Homo Sapiens
KINSIFNRS

SEQ ID NO: 877870 - protein, 9 aa, Homo Sapiens
QKEICFMIS

SEQ ID NO: 877871 - protein, 9 aa, Homo Sapiens
GNGITIPLP

SEQ ID NO: 877872 - protein, 9 aa, Homo Sapiens
SNKINGIDV

SEQ ID NO: 877873 - protein, 9 aa, Homo Sapiens
RGQLQALML

SEQ ID NO: 877874 - protein, 9 aa, Homo Sapiens
VPLAATSYF

SEQ ID NO: 877875 - protein, 9 aa, Homo Sapiens
GTYVTSVLC

SEQ ID NO: 877876 - protein, 9 aa, Homo Sapiens
TEVKQKWAS

SEQ ID NO: 877877 - protein, 9 aa, Homo Sapiens
YIHLIQMAV

SEQ ID NO: 877878 - protein, 9 aa, Homo Sapiens
AGGRGTRFL

SEQ ID NO: 877879 - protein, 9 aa, Homo Sapiens
KTEVKQKWA

SEQ ID NO: 877880 - protein, 9 aa, Homo Sapiens
IVGTGLVGV

SEQ ID NO: 877881 - protein, 9 aa, Homo Sapiens
SQNATLPSL

SEQ ID NO: 877882 - protein, 9 aa, Homo Sapiens
RKTFICRST

SEQ ID NO: 877883 - protein, 9 aa, Homo Sapiens
VLSFFRIAY

SEQ ID NO: 877884 - protein, 9 aa, Homo Sapiens
ESRTEKHNQ

SEQ ID NO: 877885 - protein, 9 aa, Homo Sapiens
LGFPGLQLF

SEQ ID NO: 877886 - protein, 9 aa, Homo Sapiens
DCGQFFTFN

SEQ ID NO: 877887 - protein, 9 aa, Homo Sapiens
REYPFSPDG

SEQ ID NO: 877888 - protein, 9 aa, Homo Sapiens
EADYSYWAL

SEQ ID NO: 877889 - protein, 9 aa, Homo Sapiens
YRLCQFHLH

SEQ ID NO: 877890 - protein, 9 aa, Homo Sapiens
AASPPASSP

SEQ ID NO: 877891 - protein, 9 aa, Homo Sapiens
ILNVTTDML

SEQ ID NO: 877892 - protein, 9 aa, Homo Sapiens
NSYIKYWLS

SEQ ID NO: 877893 - protein, 9 aa, Homo Sapiens
AKDSSTPYP

SEQ ID NO: 877894 - protein, 9 aa, Homo Sapiens
VACNTEGFV

SEQ ID NO: 877895 - protein, 9 aa, Homo Sapiens
LAITLHKAG

SEQ ID NO: 877896 - protein, 9 aa, Homo Sapiens
EIIQEVADE

SEQ ID NO: 877897 - protein, 9 aa, Homo Sapiens
CICCLLCEA

SEQ ID NO: 877898 - protein, 9 aa, Homo Sapiens
EWLEQRQAC

SEQ ID NO: 877899 - protein, 9 aa, Homo Sapiens
GFQSNPVRH

SEQ ID NO: 877900 - protein, 9 aa, Homo Sapiens
TNGQWNDVP

SEQ ID NO: 877901 - protein, 9 aa, Homo Sapiens
EIWRLHQYV

SEQ ID NO: 877902 - protein, 9 aa, Homo Sapiens
PLWEVLPGN

SEQ ID NO: 877903 - protein, 9 aa, Homo Sapiens
WCSSLQRHE

SEQ ID NO: 877904 - protein, 9 aa, Homo Sapiens
LPGYPDSYP

SEQ ID NO: 877905 - protein, 9 aa, Homo Sapiens
ESVTFQINL

SEQ ID NO: 877906 - protein, 9 aa, Homo Sapiens
LGDLINQLA

SEQ ID NO: 877907 - protein, 9 aa, Homo Sapiens
TLSLDKDNQ

SEQ ID NO: 877908 - protein, 9 aa, Homo Sapiens
TDNNTQNGD

SEQ ID NO: 877909 - protein, 9 aa, Homo Sapiens
PEASGLWGG

SEQ ID NO: 877910 - protein, 9 aa, Homo Sapiens
KYLIDPKDL

SEQ ID NO: 877911 - protein, 9 aa, Homo Sapiens
NAQHINLTT

SEQ ID NO: 877912 - protein, 9 aa, Homo Sapiens
RRLNLTQHI

SEQ ID NO: 877913 - protein, 9 aa, Homo Sapiens
INTISPTLG

SEQ ID NO: 877914 - protein, 9 aa, Homo Sapiens
TVTNILLSG

SEQ ID NO: 877915 - protein, 9 aa, Homo Sapiens
VIAQAVPHI

SEQ ID NO: 877916 - protein, 9 aa, Homo Sapiens
SDRFKGITT

SEQ ID NO: 877917 - protein, 9 aa, Homo Sapiens
ESDNYVQAV

SEQ ID NO: 877918 - protein, 9 aa, Homo Sapiens
FWNPPTTTE

SEQ ID NO: 877919 - protein, 9 aa, Homo Sapiens
LCNFILENP

SEQ ID NO: 877920 - protein, 9 aa, Homo Sapiens
KMWRLEEMM

SEQ ID NO: 877921 - protein, 9 aa, Homo Sapiens
TGGRLEPPK

SEQ ID NO: 877922 - protein, 9 aa, Homo Sapiens
QRRHNEFQS

SEQ ID NO: 877923 - protein, 9 aa, Homo Sapiens
KQRHQLHKF

SEQ ID NO: 877924 - protein, 9 aa, Homo Sapiens
RCRGKIVRQ

SEQ ID NO: 877925 - protein, 9 aa, Homo Sapiens
TLSQIQNSI

SEQ ID NO: 877926 - protein, 9 aa, Homo Sapiens
DDDVPLSPM

SEQ ID NO: 877927 - protein, 9 aa, Homo Sapiens
YYKLQYGPM

SEQ ID NO: 877928 - protein, 9 aa, Homo Sapiens
QILLEKRSA

SEQ ID NO: 877929 - protein, 9 aa, Homo Sapiens
YNQAVSLDS

SEQ ID NO: 877930 - protein, 9 aa, Homo Sapiens
SGKTRFKKT

SEQ ID NO: 877931 - protein, 9 aa, Homo Sapiens
FLKQLDQQA

SEQ ID NO: 877932 - protein, 9 aa, Homo Sapiens
TGVSADPTD

SEQ ID NO: 877933 - protein, 9 aa, Homo Sapiens
LATYMQIYK

SEQ ID NO: 877934 - protein, 9 aa, Homo Sapiens
RFILTIYQQ

SEQ ID NO: 877935 - protein, 9 aa, Homo Sapiens
NTVKFCCPA

SEQ ID NO: 877936 - protein, 9 aa, Homo Sapiens
VQELARKNI

SEQ ID NO: 877937 - protein, 9 aa, Homo Sapiens
EEIKCDFKF

SEQ ID NO: 877938 - protein, 9 aa, Homo Sapiens
PEVVQILYQ

SEQ ID NO: 877939 - protein, 9 aa, Homo Sapiens
LKSPVGNPQ

SEQ ID NO: 877940 - protein, 9 aa, Homo Sapiens
LFQYPLTIS

SEQ ID NO: 877941 - protein, 9 aa, Homo Sapiens
LLQSNEQPS

SEQ ID NO: 877942 - protein, 9 aa, Homo Sapiens
YPAIQYLLY

SEQ ID NO: 877943 - protein, 9 aa, Homo Sapiens
QSIKDYFQK

SEQ ID NO: 877944 - protein, 9 aa, Homo Sapiens
VKTHTFNNY

SEQ ID NO: 877945 - protein, 9 aa, Homo Sapiens
RTGLGVIHM

SEQ ID NO: 877946 - protein, 9 aa, Homo Sapiens
NLDEDKQLL

SEQ ID NO: 877947 - protein, 9 aa, Homo Sapiens
PEFCQLIVN

SEQ ID NO: 877948 - protein, 9 aa, Homo Sapiens
QTKVLSSKL

SEQ ID NO: 877949 - protein, 9 aa, Homo Sapiens
LSCFKDGVQ

SEQ ID NO: 877950 - protein, 9 aa, Homo Sapiens
KAKTINQRE

SEQ ID NO: 877951 - protein, 9 aa, Homo Sapiens
GQNATKLYC

SEQ ID NO: 877952 - protein, 9 aa, Homo Sapiens
GEIFQIINN

SEQ ID NO: 877953 - protein, 9 aa, Homo Sapiens
TDFVHPLNI

SEQ ID NO: 877954 - protein, 9 aa, Homo Sapiens
DILQGAKIV

SEQ ID NO: 877955 - protein, 9 aa, Homo Sapiens
KKAFAEARI

SEQ ID NO: 877956 - protein, 9 aa, Homo Sapiens
QLHAPQYQS

SEQ ID NO: 877957 - protein, 9 aa, Homo Sapiens
QIIGFAAEQ

SEQ ID NO: 877958 - protein, 9 aa, Homo Sapiens
LYATQYYQC

SEQ ID NO: 877959 - protein, 9 aa, Homo Sapiens
FSTLIMWCR

SEQ ID NO: 877960 - protein, 9 aa, Homo Sapiens
YDVIWRFQP

SEQ ID NO: 877961 - protein, 9 aa, Homo Sapiens
QDPDVGVNL

SEQ ID NO: 877962 - protein, 9 aa, Homo Sapiens
RIHKITHTG

SEQ ID NO: 877963 - protein, 9 aa, Homo Sapiens
CHSVELQNM

SEQ ID NO: 877964 - protein, 9 aa, Homo Sapiens
ATQYYQCFD

SEQ ID NO: 877965 - protein, 9 aa, Homo Sapiens
PFSKIVLSA

SEQ ID NO: 877966 - protein, 9 aa, Homo Sapiens
QMEYKKWFS

SEQ ID NO: 877967 - protein, 9 aa, Homo Sapiens
AQRGSESKS

SEQ ID NO: 877968 - protein, 9 aa, Homo Sapiens
WIINGSKVF

SEQ ID NO: 877969 - protein, 9 aa, Homo Sapiens
YLAPEVQSS

SEQ ID NO: 877970 - protein, 9 aa, Homo Sapiens
QVKASISSA

SEQ ID NO: 877971 - protein, 9 aa, Homo Sapiens
TLLESSKRS

SEQ ID NO: 877972 - protein, 9 aa, Homo Sapiens
SLFNRLCSQ

SEQ ID NO: 877973 - protein, 9 aa, Homo Sapiens
RKMIQLPSE

SEQ ID NO: 877974 - protein, 9 aa, Homo Sapiens
GSDKLLSGS

SEQ ID NO: 877975 - protein, 9 aa, Homo Sapiens
KKLKAIKQL

SEQ ID NO: 877976 - protein, 9 aa, Homo Sapiens
DYCFSIRAD

SEQ ID NO: 877977 - protein, 9 aa, Homo Sapiens
DVKVIFKNS

SEQ ID NO: 877978 - protein, 9 aa, Homo Sapiens
QIHAQETIR

SEQ ID NO: 877979 - protein, 9 aa, Homo Sapiens
GINVINYYA

SEQ ID NO: 877980 - protein, 9 aa, Homo Sapiens
KEGTQYTLS

SEQ ID NO: 877981 - protein, 9 aa, Homo Sapiens
FVNDIFKRI

SEQ ID NO: 877982 - protein, 9 aa, Homo Sapiens
NNTQNGDVG

SEQ ID NO: 877983 - protein, 9 aa, Homo Sapiens
YRQFLDDHQ

SEQ ID NO: 877984 - protein, 9 aa, Homo Sapiens
NKESDFEEP

SEQ ID NO: 877985 - protein, 9 aa, Homo Sapiens
ITVKQVYFH

SEQ ID NO: 877986 - protein, 9 aa, Homo Sapiens
TAVLHQMWR

SEQ ID NO: 877987 - protein, 9 aa, Homo Sapiens
KKMVERICK

SEQ ID NO: 877988 - protein, 9 aa, Homo Sapiens
YSKPPEKAT

SEQ ID NO: 877989 - protein, 9 aa, Homo Sapiens
QNGYELSPT

SEQ ID NO: 877990 - protein, 9 aa, Homo Sapiens
AEVWEKYSK

SEQ ID NO: 877991 - protein, 9 aa, Homo Sapiens
LFTSKLLRQ

SEQ ID NO: 877992 - protein, 9 aa, Homo Sapiens
MWPDPQKAS

SEQ ID NO: 877993 - protein, 9 aa, Homo Sapiens
GPMPNLREF

SEQ ID NO: 877994 - protein, 9 aa, Homo Sapiens
YVMCTVMRC

SEQ ID NO: 877995 - protein, 9 aa, Homo Sapiens
NGLCIWLLI

SEQ ID NO: 877996 - protein, 9 aa, Homo Sapiens
DQELFVDIG

SEQ ID NO: 877997 - protein, 9 aa, Homo Sapiens
NKASILLIR

SEQ ID NO: 877998 - protein, 9 aa, Homo Sapiens
LDRDTRLIM

SEQ ID NO: 877999 - protein, 9 aa, Homo Sapiens
FCAKSKSCH

SEQ ID NO: 878000 - protein, 9 aa, Homo Sapiens
RGPVTTIPI

SEQ ID NO: 878001 - protein, 9 aa, Homo Sapiens
AAVCLSMRL

SEQ ID NO: 878002 - protein, 9 aa, Homo Sapiens
YLDHMEKKD

SEQ ID NO: 878003 - protein, 9 aa, Homo Sapiens
EPQRDLEPK

SEQ ID NO: 878004 - protein, 9 aa, Homo Sapiens
WAGTGHYLQ

SEQ ID NO: 878005 - protein, 9 aa, Homo Sapiens
CVKELCETN

SEQ ID NO: 878006 - protein, 9 aa, Homo Sapiens
QDKCLMGAH

SEQ ID NO: 878007 - protein, 9 aa, Homo Sapiens
CAYLVACTW

SEQ ID NO: 878008 - protein, 9 aa, Homo Sapiens
NKLHCLVTI

SEQ ID NO: 878009 - protein, 9 aa, Homo Sapiens
TEGYLDWSV

SEQ ID NO: 878010 - protein, 9 aa, Homo Sapiens
NDHFSDIYA

SEQ ID NO: 878011 - protein, 9 aa, Homo Sapiens
GVGAYHTDD

SEQ ID NO: 878012 - protein, 9 aa, Homo Sapiens
FLEYVTLSQ

SEQ ID NO: 878013 - protein, 9 aa, Homo Sapiens
TEAGCEYIS

SEQ ID NO: 878014 - protein, 9 aa, Homo Sapiens
NILWLSCFC

SEQ ID NO: 878015 - protein, 9 aa, Homo Sapiens
SKPDVFIKL

SEQ ID NO: 878016 - protein, 9 aa, Homo Sapiens
NVYSKVAVS

SEQ ID NO: 878017 - protein, 9 aa, Homo Sapiens
VHKRSPLRQ

SEQ ID NO: 878018 - protein, 9 aa, Homo Sapiens
AIAEKSQEL

SEQ ID NO: 878019 - protein, 9 aa, Homo Sapiens
YQILGVPQN

SEQ ID NO: 878020 - protein, 9 aa, Homo Sapiens
TCVVGRPGP

SEQ ID NO: 878021 - protein, 9 aa, Homo Sapiens
SKLMSSFAK

SEQ ID NO: 878022 - protein, 9 aa, Homo Sapiens
LLPLIISKY

SEQ ID NO: 878023 - protein, 9 aa, Homo Sapiens
LQTFQAFIL

SEQ ID NO: 878024 - protein, 9 aa, Homo Sapiens
DTKRNSRLG

SEQ ID NO: 878025 - protein, 9 aa, Homo Sapiens
KSPLLGRLC

SEQ ID NO: 878026 - protein, 9 aa, Homo Sapiens
DEEFQQTKL

SEQ ID NO: 878027 - protein, 9 aa, Homo Sapiens
SHSEEDNSD

SEQ ID NO: 878028 - protein, 9 aa, Homo Sapiens
NHAPERLGK

SEQ ID NO: 878029 - protein, 9 aa, Homo Sapiens
KIEPMKVFD

SEQ ID NO: 878030 - protein, 9 aa, Homo Sapiens
EATSRTFTT

SEQ ID NO: 878031 - protein, 9 aa, Homo Sapiens
FRKFYNKSK

SEQ ID NO: 878032 - protein, 9 aa, Homo Sapiens
YVIGCYPQE

SEQ ID NO: 878033 - protein, 9 aa, Homo Sapiens
VWKDRTIQI

SEQ ID NO: 878034 - protein, 9 aa, Homo Sapiens
DWFGLGQPG

SEQ ID NO: 878035 - protein, 9 aa, Homo Sapiens
CVLLLTNGQ

SEQ ID NO: 878036 - protein, 9 aa, Homo Sapiens
HTQPSEKIW

SEQ ID NO: 878037 - protein, 9 aa, Homo Sapiens
SITALGGAS

SEQ ID NO: 878038 - protein, 9 aa, Homo Sapiens
EGANFILLN

SEQ ID NO: 878039 - protein, 9 aa, Homo Sapiens
LVTIRNVLL

SEQ ID NO: 878040 - protein, 9 aa, Homo Sapiens
PRKLRHNLD

SEQ ID NO: 878041 - protein, 9 aa, Homo Sapiens
YYFGERQTD

SEQ ID NO: 878042 - protein, 9 aa, Homo Sapiens
LWSQTPELK

SEQ ID NO: 878043 - protein, 9 aa, Homo Sapiens
VVKILHKNN

SEQ ID NO: 878044 - protein, 9 aa, Homo Sapiens
KFIYLFYSI

SEQ ID NO: 878045 - protein, 9 aa, Homo Sapiens
QIIHTMEKQ

SEQ ID NO: 878046 - protein, 9 aa, Homo Sapiens
QIARRALRF

SEQ ID NO: 878047 - protein, 9 aa, Homo Sapiens
QIPGGYSAP

SEQ ID NO: 878048 - protein, 9 aa, Homo Sapiens
TRQMKITKC

SEQ ID NO: 878049 - protein, 9 aa, Homo Sapiens
HRRSHSAGD

SEQ ID NO: 878050 - protein, 9 aa, Homo Sapiens
GVPIGAIIF

SEQ ID NO: 878051 - protein, 9 aa, Homo Sapiens
VFARYLVNR

SEQ ID NO: 878052 - protein, 9 aa, Homo Sapiens
KGYGFVEGL

SEQ ID NO: 878053 - protein, 9 aa, Homo Sapiens
LIHSLNLWT

SEQ ID NO: 878054 - protein, 9 aa, Homo Sapiens
TSHFLFGLL

SEQ ID NO: 878055 - protein, 9 aa, Homo Sapiens
FDDSPFFPQ

SEQ ID NO: 878056 - protein, 9 aa, Homo Sapiens
MANRAAGKD

SEQ ID NO: 878057 - protein, 9 aa, Homo Sapiens
LHPGVIGYI

SEQ ID NO: 878058 - protein, 9 aa, Homo Sapiens
QRKKICEQE

SEQ ID NO: 878059 - protein, 9 aa, Homo Sapiens
FSPCLPVFN

SEQ ID NO: 878060 - protein, 9 aa, Homo Sapiens
EQLCTYQEG

SEQ ID NO: 878061 - protein, 9 aa, Homo Sapiens
IQFFGVPYA

SEQ ID NO: 878062 - protein, 9 aa, Homo Sapiens
CLLEKHQQL

SEQ ID NO: 878063 - protein, 9 aa, Homo Sapiens
FTCDLNTSP

SEQ ID NO: 878064 - protein, 9 aa, Homo Sapiens
HQIHTGEKP

SEQ ID NO: 878065 - protein, 9 aa, Homo Sapiens
LYSTPRCTQ

SEQ ID NO: 878066 - protein, 9 aa, Homo Sapiens
LVGSGYRML

SEQ ID NO: 878067 - protein, 9 aa, Homo Sapiens
EKAQTYLKV

SEQ ID NO: 878068 - protein, 9 aa, Homo Sapiens
YTNAIQWMS

SEQ ID NO: 878069 - protein, 9 aa, Homo Sapiens
HTNASFNTF

SEQ ID NO: 878070 - protein, 9 aa, Homo Sapiens
GQADDERVC

SEQ ID NO: 878071 - protein, 9 aa, Homo Sapiens
QIYKEDFKK

SEQ ID NO: 878072 - protein, 9 aa, Homo Sapiens
SFSFDVENG

SEQ ID NO: 878073 - protein, 9 aa, Homo Sapiens
LQTDFVLDY

SEQ ID NO: 878074 - protein, 9 aa, Homo Sapiens
RDNLPLKLE

SEQ ID NO: 878075 - protein, 9 aa, Homo Sapiens
MVKEDIDAK

SEQ ID NO: 878076 - protein, 9 aa, Homo Sapiens
LYQILKAYT

SEQ ID NO: 878077 - protein, 9 aa, Homo Sapiens
ITDLVHFAE

SEQ ID NO: 878078 - protein, 9 aa, Homo Sapiens
PEDAEEVVK

SEQ ID NO: 878079 - protein, 9 aa, Homo Sapiens
SQRYQKQME

SEQ ID NO: 878080 - protein, 9 aa, Homo Sapiens
AREQARVCK

SEQ ID NO: 878081 - protein, 9 aa, Homo Sapiens
TFTTGIVST

SEQ ID NO: 878082 - protein, 9 aa, Homo Sapiens
LITIAVVAG

SEQ ID NO: 878083 - protein, 9 aa, Homo Sapiens
EIRQDGNQF

SEQ ID NO: 878084 - protein, 9 aa, Homo Sapiens
YQENLAVIT

SEQ ID NO: 878085 - protein, 9 aa, Homo Sapiens
IAYSNYNWF

SEQ ID NO: 878086 - protein, 9 aa, Homo Sapiens
ATHRIHKIT

SEQ ID NO: 878087 - protein, 9 aa, Homo Sapiens
PTRKPTVIQ

SEQ ID NO: 878088 - protein, 9 aa, Homo Sapiens
QSQINHIQN

SEQ ID NO: 878089 - protein, 9 aa, Homo Sapiens
EDGSGKGVA

SEQ ID NO: 878090 - protein, 9 aa, Homo Sapiens
VYVNNQLSG

SEQ ID NO: 878091 - protein, 9 aa, Homo Sapiens
LQSENKRLQ

SEQ ID NO: 878092 - protein, 9 aa, Homo Sapiens
WIWENPNLN

SEQ ID NO: 878093 - protein, 9 aa, Homo Sapiens
VLENIKLNK

SEQ ID NO: 878094 - protein, 9 aa, Homo Sapiens
LSTSLLLSA

SEQ ID NO: 878095 - protein, 9 aa, Homo Sapiens
PVACQTPVL

SEQ ID NO: 878096 - protein, 9 aa, Homo Sapiens
RPIPMSIRS

SEQ ID NO: 878097 - protein, 9 aa, Homo Sapiens
LQFESQIIS

SEQ ID NO: 878098 - protein, 9 aa, Homo Sapiens
NPRFGKMEG

SEQ ID NO: 878099 - protein, 9 aa, Homo Sapiens
NWTAVLAQE

SEQ ID NO: 878100 - protein, 9 aa, Homo Sapiens
YSEKYAEEN

SEQ ID NO: 878101 - protein, 9 aa, Homo Sapiens
EPDYLKVLE

SEQ ID NO: 878102 - protein, 9 aa, Homo Sapiens
HNLFTKDVT

SEQ ID NO: 878103 - protein, 9 aa, Homo Sapiens
TKDMKATCV

SEQ ID NO: 878104 - protein, 9 aa, Homo Sapiens
EPGIICLSS

SEQ ID NO: 878105 - protein, 9 aa, Homo Sapiens
HFLFNKPVS

SEQ ID NO: 878106 - protein, 9 aa, Homo Sapiens
VIRTFAVGK

SEQ ID NO: 878107 - protein, 9 aa, Homo Sapiens
HHSIYCIIV

SEQ ID NO: 878108 - protein, 9 aa, Homo Sapiens
KNKGKECRD

SEQ ID NO: 878109 - protein, 9 aa, Homo Sapiens
LVFADMQEG

SEQ ID NO: 878110 - protein, 9 aa, Homo Sapiens
LRCHYCRGF

SEQ ID NO: 878111 - protein, 9 aa, Homo Sapiens
DPTFNPSGP

SEQ ID NO: 878112 - protein, 9 aa, Homo Sapiens
ADLGNIRIW

SEQ ID NO: 878113 - protein, 9 aa, Homo Sapiens
ITLCWEVPD

SEQ ID NO: 878114 - protein, 9 aa, Homo Sapiens
LNKSADDFH

SEQ ID NO: 878115 - protein, 9 aa, Homo Sapiens
NPGSLVSPL

SEQ ID NO: 878116 - protein, 9 aa, Homo Sapiens
KKHQRCYDE

SEQ ID NO: 878117 - protein, 9 aa, Homo Sapiens
GWPGPGQLR

SEQ ID NO: 878118 - protein, 9 aa, Homo Sapiens
QRGRPRVNK

SEQ ID NO: 878119 - protein, 9 aa, Homo Sapiens
ICKFHCELV

SEQ ID NO: 878120 - protein, 9 aa, Homo Sapiens
RYTNAIQWM

SEQ ID NO: 878121 - protein, 9 aa, Homo Sapiens
FNAGQTFVA

SEQ ID NO: 878122 - protein, 9 aa, Homo Sapiens
DDDKDEAAA

SEQ ID NO: 878123 - protein, 9 aa, Homo Sapiens
HSVELQNMF

SEQ ID NO: 878124 - protein, 9 aa, Homo Sapiens
WNPCELYQV

SEQ ID NO: 878125 - protein, 9 aa, Homo Sapiens
TTQASMEFQ

SEQ ID NO: 878126 - protein, 9 aa, Homo Sapiens
ELLEADNRQ

SEQ ID NO: 878127 - protein, 9 aa, Homo Sapiens
SKFIIDLIL

SEQ ID NO: 878128 - protein, 9 aa, Homo Sapiens
AFDRQLYQP

SEQ ID NO: 878129 - protein, 9 aa, Homo Sapiens
YTLVFNLSS

SEQ ID NO: 878130 - protein, 9 aa, Homo Sapiens
SGIALGGRL

SEQ ID NO: 878131 - protein, 9 aa, Homo Sapiens
KISELIEQN

SEQ ID NO: 878132 - protein, 9 aa, Homo Sapiens
KDMKRGLHK

SEQ ID NO: 878133 - protein, 9 aa, Homo Sapiens
AAATKVSLS

SEQ ID NO: 878134 - protein, 9 aa, Homo Sapiens
AVCGFQPIE

SEQ ID NO: 878135 - protein, 9 aa, Homo Sapiens
AALTLLGSD

SEQ ID NO: 878136 - protein, 9 aa, Homo Sapiens
FFKKGKKIS

SEQ ID NO: 878137 - protein, 9 aa, Homo Sapiens
KCGFCFHTD

SEQ ID NO: 878138 - protein, 9 aa, Homo Sapiens
CLIQFDDFA

SEQ ID NO: 878139 - protein, 9 aa, Homo Sapiens
SYPQERMFT

SEQ ID NO: 878140 - protein, 9 aa, Homo Sapiens
SNDSNDFTK

SEQ ID NO: 878141 - protein, 9 aa, Homo Sapiens
MGSGQVVLG

SEQ ID NO: 878142 - protein, 9 aa, Homo Sapiens
GLQRTIRLA

SEQ ID NO: 878143 - protein, 9 aa, Homo Sapiens
NNKSPSDPE

SEQ ID NO: 878144 - protein, 9 aa, Homo Sapiens
ESLSSRTSY

SEQ ID NO: 878145 - protein, 9 aa, Homo Sapiens
YSTCTKGNS

SEQ ID NO: 878146 - protein, 9 aa, Homo Sapiens
AQNISKLHL

SEQ ID NO: 878147 - protein, 9 aa, Homo Sapiens
QDYSTGYVI

SEQ ID NO: 878148 - protein, 9 aa, Homo Sapiens
TEAEGHHWH

SEQ ID NO: 878149 - protein, 9 aa, Homo Sapiens
YSFRTEQST

SEQ ID NO: 878150 - protein, 9 aa, Homo Sapiens
LMKEKKRKK

SEQ ID NO: 878151 - protein, 9 aa, Homo Sapiens
QKNTFGSTL

SEQ ID NO: 878152 - protein, 9 aa, Homo Sapiens
HRWEYENEL

SEQ ID NO: 878153 - protein, 9 aa, Homo Sapiens
EAFGSKFII

SEQ ID NO: 878154 - protein, 9 aa, Homo Sapiens
QGQTANKDP

SEQ ID NO: 878155 - protein, 9 aa, Homo Sapiens
VDLDEEDSS

SEQ ID NO: 878156 - protein, 9 aa, Homo Sapiens
IKELFSLMV

SEQ ID NO: 878157 - protein, 9 aa, Homo Sapiens
ANYQKQESL

SEQ ID NO: 878158 - protein, 9 aa, Homo Sapiens
VNIEAPEGK

SEQ ID NO: 878159 - protein, 9 aa, Homo Sapiens
TEETFTILF

SEQ ID NO: 878160 - protein, 9 aa, Homo Sapiens
EKGGNMTRV

SEQ ID NO: 878161 - protein, 9 aa, Homo Sapiens
KILWDTGVF

SEQ ID NO: 878162 - protein, 9 aa, Homo Sapiens
QDQTRIWFM

SEQ ID NO: 878163 - protein, 9 aa, Homo Sapiens
VVDTTFKNG

SEQ ID NO: 878164 - protein, 9 aa, Homo Sapiens
RAMCISHKK

SEQ ID NO: 878165 - protein, 9 aa, Homo Sapiens
FNLFNICQR

SEQ ID NO: 878166 - protein, 9 aa, Homo Sapiens
ESVEEISFA

SEQ ID NO: 878167 - protein, 9 aa, Homo Sapiens
GLVVGIYLK

SEQ ID NO: 878168 - protein, 9 aa, Homo Sapiens
IDWDNIWNC

SEQ ID NO: 878169 - protein, 9 aa, Homo Sapiens
KPRIKDTPA

SEQ ID NO: 878170 - protein, 9 aa, Homo Sapiens
KAWNFRGQK

SEQ ID NO: 878171 - protein, 9 aa, Homo Sapiens
SLKEAKQQE

SEQ ID NO: 878172 - protein, 9 aa, Homo Sapiens
QRCASLNTR

SEQ ID NO: 878173 - protein, 9 aa, Homo Sapiens
QAFPISHIC

SEQ ID NO: 878174 - protein, 9 aa, Homo Sapiens
YYTVQQLEL

SEQ ID NO: 878175 - protein, 9 aa, Homo Sapiens
KWKNKVASA

SEQ ID NO: 878176 - protein, 9 aa, Homo Sapiens
NDTRLSPIA

SEQ ID NO: 878177 - protein, 9 aa, Homo Sapiens
EDNPSICAI

SEQ ID NO: 878178 - protein, 9 aa, Homo Sapiens
QEKTAAATG

SEQ ID NO: 878179 - protein, 9 aa, Homo Sapiens
QPCFLGMKS

SEQ ID NO: 878180 - protein, 9 aa, Homo Sapiens
SKQPSEDPN

SEQ ID NO: 878181 - protein, 9 aa, Homo Sapiens
VALPHTPLT

SEQ ID NO: 878182 - protein, 9 aa, Homo Sapiens
RFYPLQMHC

SEQ ID NO: 878183 - protein, 9 aa, Homo Sapiens
TCPLNARHQ

SEQ ID NO: 878184 - protein, 9 aa, Homo Sapiens
GQNNFKKIM

SEQ ID NO: 878185 - protein, 9 aa, Homo Sapiens
RQSKFTNFK

SEQ ID NO: 878186 - protein, 9 aa, Homo Sapiens
HSGINIKTV

SEQ ID NO: 878187 - protein, 9 aa, Homo Sapiens
LIPCNLMDG

SEQ ID NO: 878188 - protein, 9 aa, Homo Sapiens
ETIQHGVHM

SEQ ID NO: 878189 - protein, 9 aa, Homo Sapiens
IIIASLINE

SEQ ID NO: 878190 - protein, 9 aa, Homo Sapiens
AIDTPPQSE

SEQ ID NO: 878191 - protein, 9 aa, Homo Sapiens
EWTLENNPS

SEQ ID NO: 878192 - protein, 9 aa, Homo Sapiens
LLSGKYVAV

SEQ ID NO: 878193 - protein, 9 aa, Homo Sapiens
DSNDHVISV

SEQ ID NO: 878194 - protein, 9 aa, Homo Sapiens
PYFFWTVPS

SEQ ID NO: 878195 - protein, 9 aa, Homo Sapiens
KPKRSQSPF

SEQ ID NO: 878196 - protein, 9 aa, Homo Sapiens
LVTDNAIDI

SEQ ID NO: 878197 - protein, 9 aa, Homo Sapiens
IVRVLARYI

SEQ ID NO: 878198 - protein, 9 aa, Homo Sapiens
KNFLSLIVS

SEQ ID NO: 878199 - protein, 9 aa, Homo Sapiens
DKLSPLHKR

SEQ ID NO: 878200 - protein, 9 aa, Homo Sapiens
REGGGCSDV

SEQ ID NO: 878201 - protein, 9 aa, Homo Sapiens
KGILPGVYP

SEQ ID NO: 878202 - protein, 9 aa, Homo Sapiens
HLHQLTLQG

SEQ ID NO: 878203 - protein, 9 aa, Homo Sapiens
IQNIAAIKS

SEQ ID NO: 878204 - protein, 9 aa, Homo Sapiens
KDEAAAQPG

SEQ ID NO: 878205 - protein, 9 aa, Homo Sapiens
FNLVYGATP

SEQ ID NO: 878206 - protein, 9 aa, Homo Sapiens
CTDFEQMKE

SEQ ID NO: 878207 - protein, 9 aa, Homo Sapiens
VQRYTNAIQ

SEQ ID NO: 878208 - protein, 9 aa, Homo Sapiens
LLDREVKLR

SEQ ID NO: 878209 - protein, 9 aa, Homo Sapiens
RLRHRRSHS

SEQ ID NO: 878210 - protein, 9 aa, Homo Sapiens
RMKLLQFVT

SEQ ID NO: 878211 - protein, 9 aa, Homo Sapiens
LDIYQKAFE

SEQ ID NO: 878212 - protein, 9 aa, Homo Sapiens
VTVIDNKLY

SEQ ID NO: 878213 - protein, 9 aa, Homo Sapiens
TKDNAMLLK

SEQ ID NO: 878214 - protein, 9 aa, Homo Sapiens
KTSILSLFR

SEQ ID NO: 878215 - protein, 9 aa, Homo Sapiens
FLFMQYCVA

SEQ ID NO: 878216 - protein, 9 aa, Homo Sapiens
DVAVGVFRS

SEQ ID NO: 878217 - protein, 9 aa, Homo Sapiens
HISQNFLSS

SEQ ID NO: 878218 - protein, 9 aa, Homo Sapiens
GHKHELLTK

SEQ ID NO: 878219 - protein, 9 aa, Homo Sapiens
GSKMQQNIG

SEQ ID NO: 878220 - protein, 9 aa, Homo Sapiens
LSLVHHTYP

SEQ ID NO: 878221 - protein, 9 aa, Homo Sapiens
ETLCTPSTT

SEQ ID NO: 878222 - protein, 9 aa, Homo Sapiens
VTASSTGCV

SEQ ID NO: 878223 - protein, 9 aa, Homo Sapiens
ARGALRFTK

SEQ ID NO: 878224 - protein, 9 aa, Homo Sapiens
VRCINLART

SEQ ID NO: 878225 - protein, 9 aa, Homo Sapiens
NSGFMEQLC

SEQ ID NO: 878226 - protein, 9 aa, Homo Sapiens
VWHIYSGIL

SEQ ID NO: 878227 - protein, 9 aa, Homo Sapiens
LQIPQSYPE

SEQ ID NO: 878228 - protein, 9 aa, Homo Sapiens
ALCVIYYFV

SEQ ID NO: 878229 - protein, 9 aa, Homo Sapiens
SGMEKICFK

SEQ ID NO: 878230 - protein, 9 aa, Homo Sapiens
KPSSEESDL

SEQ ID NO: 878231 - protein, 9 aa, Homo Sapiens
TMDKWKAIE

SEQ ID NO: 878232 - protein, 9 aa, Homo Sapiens
CHCWEDIWQ

SEQ ID NO: 878233 - protein, 9 aa, Homo Sapiens
PSVDVEDGK

SEQ ID NO: 878234 - protein, 9 aa, Homo Sapiens
NPRGPSPAP

SEQ ID NO: 878235 - protein, 9 aa, Homo Sapiens
FYRNPEEIE

SEQ ID NO: 878236 - protein, 9 aa, Homo Sapiens
FHKLWCRQI

SEQ ID NO: 878237 - protein, 9 aa, Homo Sapiens
YLNEVHSTE

SEQ ID NO: 878238 - protein, 9 aa, Homo Sapiens
LDTQNRIII

SEQ ID NO: 878239 - protein, 9 aa, Homo Sapiens
DPFCSIECY

SEQ ID NO: 878240 - protein, 9 aa, Homo Sapiens
WDTVSNAEK

SEQ ID NO: 878241 - protein, 9 aa, Homo Sapiens
NLIARKTKQ

SEQ ID NO: 878242 - protein, 9 aa, Homo Sapiens
LASLPPTNK

SEQ ID NO: 878243 - protein, 9 aa, Homo Sapiens
SISCSLSQS

SEQ ID NO: 878244 - protein, 9 aa, Homo Sapiens
ALAEKLDWL

SEQ ID NO: 878245 - protein, 9 aa, Homo Sapiens
TVLESLPIL

SEQ ID NO: 878246 - protein, 9 aa, Homo Sapiens
ALSGSLSMI

SEQ ID NO: 878247 - protein, 9 aa, Homo Sapiens
KSHSQIKHQ

SEQ ID NO: 878248 - protein, 9 aa, Homo Sapiens
RGGGHCSIP

SEQ ID NO: 878249 - protein, 9 aa, Homo Sapiens
CLQCSQCYH

SEQ ID NO: 878250 - protein, 9 aa, Homo Sapiens
DMMSVQAST

SEQ ID NO: 878251 - protein, 9 aa, Homo Sapiens
TDFLIDINE

SEQ ID NO: 878252 - protein, 9 aa, Homo Sapiens
AFGNVLSSL

SEQ ID NO: 878253 - protein, 9 aa, Homo Sapiens
FSKIVLSAP

SEQ ID NO: 878254 - protein, 9 aa, Homo Sapiens
WPIHNYQVF

SEQ ID NO: 878255 - protein, 9 aa, Homo Sapiens
PLMITCKTK

SEQ ID NO: 878256 - protein, 9 aa, Homo Sapiens
TEDKKRQLQ

SEQ ID NO: 878257 - protein, 9 aa, Homo Sapiens
CDLKICGFG

SEQ ID NO: 878258 - protein, 9 aa, Homo Sapiens
GELKLWDLS

SEQ ID NO: 878259 - protein, 9 aa, Homo Sapiens
RSLPIVFNE

SEQ ID NO: 878260 - protein, 9 aa, Homo Sapiens
LTKNSVWIG

SEQ ID NO: 878261 - protein, 9 aa, Homo Sapiens
PITSSTLIH

SEQ ID NO: 878262 - protein, 9 aa, Homo Sapiens
LYWTDDSKK

SEQ ID NO: 878263 - protein, 9 aa, Homo Sapiens
QKTDNGKDK

SEQ ID NO: 878264 - protein, 9 aa, Homo Sapiens
QVQIYKEDF

SEQ ID NO: 878265 - protein, 9 aa, Homo Sapiens
TEDNKRQTL

SEQ ID NO: 878266 - protein, 9 aa, Homo Sapiens
GEPSITLQP

SEQ ID NO: 878267 - protein, 9 aa, Homo Sapiens
TKSCRQSTH

SEQ ID NO: 878268 - protein, 9 aa, Homo Sapiens
NTEFQGKQM

SEQ ID NO: 878269 - protein, 9 aa, Homo Sapiens
KIGRGELQR

SEQ ID NO: 878270 - protein, 9 aa, Homo Sapiens
RHLRVDQIT

SEQ ID NO: 878271 - protein, 9 aa, Homo Sapiens
KDKMSALSL

SEQ ID NO: 878272 - protein, 9 aa, Homo Sapiens
QLQKNKYRV

SEQ ID NO: 878273 - protein, 9 aa, Homo Sapiens
TAAHQTNKQ

SEQ ID NO: 878274 - protein, 9 aa, Homo Sapiens
LTPEFCQLI

SEQ ID NO: 878275 - protein, 9 aa, Homo Sapiens
TELSHYRQC

SEQ ID NO: 878276 - protein, 9 aa, Homo Sapiens
TLSFLFNTI

SEQ ID NO: 878277 - protein, 9 aa, Homo Sapiens
EISELNRAI

SEQ ID NO: 878278 - protein, 9 aa, Homo Sapiens
VKNLLKHCV

SEQ ID NO: 878279 - protein, 9 aa, Homo Sapiens
LPVNTSKTH

SEQ ID NO: 878280 - protein, 9 aa, Homo Sapiens
TKRSINKEI

SEQ ID NO: 878281 - protein, 9 aa, Homo Sapiens
GELCCYLCK

SEQ ID NO: 878282 - protein, 9 aa, Homo Sapiens
KTDTEGIIK

SEQ ID NO: 878283 - protein, 9 aa, Homo Sapiens
GHYQRAKTY

SEQ ID NO: 878284 - protein, 9 aa, Homo Sapiens
TTKPGSLTQ

SEQ ID NO: 878285 - protein, 9 aa, Homo Sapiens
YTMNKFLIS

SEQ ID NO: 878286 - protein, 9 aa, Homo Sapiens
TEDKITDPK

SEQ ID NO: 878287 - protein, 9 aa, Homo Sapiens
FTTMGLEWE

SEQ ID NO: 878288 - protein, 9 aa, Homo Sapiens
LFNICQRRR

SEQ ID NO: 878289 - protein, 9 aa, Homo Sapiens
THPCNLKGI

SEQ ID NO: 878290 - protein, 9 aa, Homo Sapiens
PLGLKLCSL

SEQ ID NO: 878291 - protein, 9 aa, Homo Sapiens
RARRPPKGK

SEQ ID NO: 878292 - protein, 9 aa, Homo Sapiens
LCQSQLTSN

SEQ ID NO: 878293 - protein, 9 aa, Homo Sapiens
SFWISQVAV

SEQ ID NO: 878294 - protein, 9 aa, Homo Sapiens
LQYVNWACS

SEQ ID NO: 878295 - protein, 9 aa, Homo Sapiens
HCGQMKQKY

SEQ ID NO: 878296 - protein, 9 aa, Homo Sapiens
MKPSCIWRF

SEQ ID NO: 878297 - protein, 9 aa, Homo Sapiens
LLNTFQELF

SEQ ID NO: 878298 - protein, 9 aa, Homo Sapiens
NEQFLLHLL

SEQ ID NO: 878299 - protein, 9 aa, Homo Sapiens
AVHKFLASV

SEQ ID NO: 878300 - protein, 9 aa, Homo Sapiens
AAGSSSFSG

SEQ ID NO: 878301 - protein, 9 aa, Homo Sapiens
FWCTFEGCG

SEQ ID NO: 878302 - protein, 9 aa, Homo Sapiens
NGVLCKSGR

SEQ ID NO: 878303 - protein, 9 aa, Homo Sapiens
LIALEGNID

SEQ ID NO: 878304 - protein, 9 aa, Homo Sapiens
IMAHKWMPD

SEQ ID NO: 878305 - protein, 9 aa, Homo Sapiens
PTSDCSPMQ

SEQ ID NO: 878306 - protein, 9 aa, Homo Sapiens
ENYLRIVPK

SEQ ID NO: 878307 - protein, 9 aa, Homo Sapiens
PTFNPSGPS

SEQ ID NO: 878308 - protein, 9 aa, Homo Sapiens
ETDNWDGPG

SEQ ID NO: 878309 - protein, 9 aa, Homo Sapiens
KNSERITVN

SEQ ID NO: 878310 - protein, 9 aa, Homo Sapiens
PWEHNEQVK

SEQ ID NO: 878311 - protein, 9 aa, Homo Sapiens
KHSGEISEI

SEQ ID NO: 878312 - protein, 9 aa, Homo Sapiens
DEDQKVWPN

SEQ ID NO: 878313 - protein, 9 aa, Homo Sapiens
LQKDPGFSK

SEQ ID NO: 878314 - protein, 9 aa, Homo Sapiens
SSDSGHSMK

SEQ ID NO: 878315 - protein, 9 aa, Homo Sapiens
QEIWNEICY

SEQ ID NO: 878316 - protein, 9 aa, Homo Sapiens
SYKTSKRFS

SEQ ID NO: 878317 - protein, 9 aa, Homo Sapiens
HGDAQVVLL

SEQ ID NO: 878318 - protein, 9 aa, Homo Sapiens
TRHQIIHTM

SEQ ID NO: 878319 - protein, 9 aa, Homo Sapiens
VEEEEEHCQ

SEQ ID NO: 878320 - protein, 9 aa, Homo Sapiens
KKNRELEKE

SEQ ID NO: 878321 - protein, 9 aa, Homo Sapiens
NKLFKFMHE

SEQ ID NO: 878322 - protein, 9 aa, Homo Sapiens
SSKLRPDDT

SEQ ID NO: 878323 - protein, 9 aa, Homo Sapiens
FPTIHLRIS

SEQ ID NO: 878324 - protein, 9 aa, Homo Sapiens
CNNMPVCLC

SEQ ID NO: 878325 - protein, 9 aa, Homo Sapiens
KEEQIDTPP

SEQ ID NO: 878326 - protein, 9 aa, Homo Sapiens
TELPLLCAA

SEQ ID NO: 878327 - protein, 9 aa, Homo Sapiens
YFSLSSFLE

SEQ ID NO: 878328 - protein, 9 aa, Homo Sapiens
LPSADTVPW

SEQ ID NO: 878329 - protein, 9 aa, Homo Sapiens
QDYSQIQGG

SEQ ID NO: 878330 - protein, 9 aa, Homo Sapiens
RSFNTFFPL

SEQ ID NO: 878331 - protein, 9 aa, Homo Sapiens
VIKSVFLSR

SEQ ID NO: 878332 - protein, 9 aa, Homo Sapiens
SHTRERPFK

SEQ ID NO: 878333 - protein, 9 aa, Homo Sapiens
RLVGKTPIK

SEQ ID NO: 878334 - protein, 9 aa, Homo Sapiens
PVEPSCKGM

SEQ ID NO: 878335 - protein, 9 aa, Homo Sapiens
VQIIRDWLY

SEQ ID NO: 878336 - protein, 9 aa, Homo Sapiens
VMVLLGFPG

SEQ ID NO: 878337 - protein, 9 aa, Homo Sapiens
KAQPFPLPF

SEQ ID NO: 878338 - protein, 9 aa, Homo Sapiens
ANPTANTEQ

SEQ ID NO: 878339 - protein, 9 aa, Homo Sapiens
CPLNARHQV

SEQ ID NO: 878340 - protein, 9 aa, Homo Sapiens
LKEKQRHQL

SEQ ID NO: 878341 - protein, 9 aa, Homo Sapiens
SYPEGDDTQ

SEQ ID NO: 878342 - protein, 9 aa, Homo Sapiens
KQDPKHHLE

SEQ ID NO: 878343 - protein, 9 aa, Homo Sapiens
LPPGKVVFY

SEQ ID NO: 878344 - protein, 9 aa, Homo Sapiens
SSKVKVKVQ

SEQ ID NO: 878345 - protein, 9 aa, Homo Sapiens
KEENSDTEF

SEQ ID NO: 878346 - protein, 9 aa, Homo Sapiens
VQTAIEGNF

SEQ ID NO: 878347 - protein, 9 aa, Homo Sapiens
EFGICVLYQ

SEQ ID NO: 878348 - protein, 9 aa, Homo Sapiens
VILIQTDSH

SEQ ID NO: 878349 - protein, 9 aa, Homo Sapiens
LNNLNLGGA

SEQ ID NO: 878350 - protein, 9 aa, Homo Sapiens
ASDELVEQS

SEQ ID NO: 878351 - protein, 9 aa, Homo Sapiens
WGDYNDSAF

SEQ ID NO: 878352 - protein, 9 aa, Homo Sapiens
KMFTNFLSF

SEQ ID NO: 878353 - protein, 9 aa, Homo Sapiens
QRTRPYLFS

SEQ ID NO: 878354 - protein, 9 aa, Homo Sapiens
GFIIFGDNL

SEQ ID NO: 878355 - protein, 9 aa, Homo Sapiens
NQCLKQLQL

SEQ ID NO: 878356 - protein, 9 aa, Homo Sapiens
FTSLIGVCI

SEQ ID NO: 878357 - protein, 9 aa, Homo Sapiens
HFTCDLNTS

SEQ ID NO: 878358 - protein, 9 aa, Homo Sapiens
QKILCTKTE

SEQ ID NO: 878359 - protein, 9 aa, Homo Sapiens
SAFKSLEEV

SEQ ID NO: 878360 - protein, 9 aa, Homo Sapiens
SLAQNCGKL

SEQ ID NO: 878361 - protein, 9 aa, Homo Sapiens
AALGLPESL

SEQ ID NO: 878362 - protein, 9 aa, Homo Sapiens
MANRIRKYQ

SEQ ID NO: 878363 - protein, 9 aa, Homo Sapiens
YHKDIFGAV

SEQ ID NO: 878364 - protein, 9 aa, Homo Sapiens
PIVYELDNN

SEQ ID NO: 878365 - protein, 9 aa, Homo Sapiens
INVLDSPQA

SEQ ID NO: 878366 - protein, 9 aa, Homo Sapiens
DKYKVYEEQ

SEQ ID NO: 878367 - protein, 9 aa, Homo Sapiens
EAQERGLVQ

SEQ ID NO: 878368 - protein, 9 aa, Homo Sapiens
GHGQQDLYQ

SEQ ID NO: 878369 - protein, 9 aa, Homo Sapiens
NVLDSPQAV

SEQ ID NO: 878370 - protein, 9 aa, Homo Sapiens
KAVSDAECK

SEQ ID NO: 878371 - protein, 9 aa, Homo Sapiens
TFAVGKRGV

SEQ ID NO: 878372 - protein, 9 aa, Homo Sapiens
LIAYVSNDS

SEQ ID NO: 878373 - protein, 9 aa, Homo Sapiens
QEHLRKYLA

SEQ ID NO: 878374 - protein, 9 aa, Homo Sapiens
CHATHTRDC

SEQ ID NO: 878375 - protein, 9 aa, Homo Sapiens
NALQRVCKN

SEQ ID NO: 878376 - protein, 9 aa, Homo Sapiens
QMQQVQTHF

SEQ ID NO: 878377 - protein, 9 aa, Homo Sapiens
WKTFLNQSS

SEQ ID NO: 878378 - protein, 9 aa, Homo Sapiens
DEELCNGHG

SEQ ID NO: 878379 - protein, 9 aa, Homo Sapiens
AGGESESGQ

SEQ ID NO: 878380 - protein, 9 aa, Homo Sapiens
IYTLCNKEV

SEQ ID NO: 878381 - protein, 9 aa, Homo Sapiens
MICINQQTG

SEQ ID NO: 878382 - protein, 9 aa, Homo Sapiens
QTDGVLFCR

SEQ ID NO: 878383 - protein, 9 aa, Homo Sapiens
QQVKASISS

SEQ ID NO: 878384 - protein, 9 aa, Homo Sapiens
MLILIGQKL

SEQ ID NO: 878385 - protein, 9 aa, Homo Sapiens
NHIVWGSGI

SEQ ID NO: 878386 - protein, 9 aa, Homo Sapiens
QARVAELEH

SEQ ID NO: 878387 - protein, 9 aa, Homo Sapiens
TAVYPVQSA

SEQ ID NO: 878388 - protein, 9 aa, Homo Sapiens
FNWGKYLME

SEQ ID NO: 878389 - protein, 9 aa, Homo Sapiens
AVNMFQTLP

SEQ ID NO: 878390 - protein, 9 aa, Homo Sapiens
DKGRVARGS

SEQ ID NO: 878391 - protein, 9 aa, Homo Sapiens
SDYSQSSRK

SEQ ID NO: 878392 - protein, 9 aa, Homo Sapiens
YTYSANDAI

SEQ ID NO: 878393 - protein, 9 aa, Homo Sapiens
QEALEDKLE

SEQ ID NO: 878394 - protein, 9 aa, Homo Sapiens
HQSYSQNTL

SEQ ID NO: 878395 - protein, 9 aa, Homo Sapiens
HQIIHTKEE

SEQ ID NO: 878396 - protein, 9 aa, Homo Sapiens
EIKDGQTSG

SEQ ID NO: 878397 - protein, 9 aa, Homo Sapiens
KSQIKELVN

SEQ ID NO: 878398 - protein, 9 aa, Homo Sapiens
LVACQPPSE

SEQ ID NO: 878399 - protein, 9 aa, Homo Sapiens
HQRFHTGNT

SEQ ID NO: 878400 - protein, 9 aa, Homo Sapiens
PTKLFPPLF

SEQ ID NO: 878401 - protein, 9 aa, Homo Sapiens
EVWWSFDKC

SEQ ID NO: 878402 - protein, 9 aa, Homo Sapiens
LQNTFTTGI

SEQ ID NO: 878403 - protein, 9 aa, Homo Sapiens
EIDPSLMRR

SEQ ID NO: 878404 - protein, 9 aa, Homo Sapiens
SALIRHQII

SEQ ID NO: 878405 - protein, 9 aa, Homo Sapiens
KEKESIART

SEQ ID NO: 878406 - protein, 9 aa, Homo Sapiens
ESLPILTLL

SEQ ID NO: 878407 - protein, 9 aa, Homo Sapiens
AVENLCYYK

SEQ ID NO: 878408 - protein, 9 aa, Homo Sapiens
VYVDPRKYS

SEQ ID NO: 878409 - protein, 9 aa, Homo Sapiens
REYECMKTE

SEQ ID NO: 878410 - protein, 9 aa, Homo Sapiens
VGKSIVLNC

SEQ ID NO: 878411 - protein, 9 aa, Homo Sapiens
SAGGTSVSL

SEQ ID NO: 878412 - protein, 9 aa, Homo Sapiens
VQIYKEDFK

SEQ ID NO: 878413 - protein, 9 aa, Homo Sapiens
SCAPPAPCT

SEQ ID NO: 878414 - protein, 9 aa, Homo Sapiens
SKLEKVGSI

SEQ ID NO: 878415 - protein, 9 aa, Homo Sapiens
YYLHVLCYV

SEQ ID NO: 878416 - protein, 9 aa, Homo Sapiens
SALILHQII

SEQ ID NO: 878417 - protein, 9 aa, Homo Sapiens
NTFLKCGAL

SEQ ID NO: 878418 - protein, 9 aa, Homo Sapiens
AEQNSTAAE

SEQ ID NO: 878419 - protein, 9 aa, Homo Sapiens
KYHRASSEN

SEQ ID NO: 878420 - protein, 9 aa, Homo Sapiens
KLTAQLKDT

SEQ ID NO: 878421 - protein, 9 aa, Homo Sapiens
ELFGLNNCS

SEQ ID NO: 878422 - protein, 9 aa, Homo Sapiens
LEELSLVVH

SEQ ID NO: 878423 - protein, 9 aa, Homo Sapiens
SSSLMTHMI

SEQ ID NO: 878424 - protein, 9 aa, Homo Sapiens
YDTLHMQAL

SEQ ID NO: 878425 - protein, 9 aa, Homo Sapiens
VETTYFCPV

SEQ ID NO: 878426 - protein, 9 aa, Homo Sapiens
IPIHLFLTN

SEQ ID NO: 878427 - protein, 9 aa, Homo Sapiens
DDKVEPGII

SEQ ID NO: 878428 - protein, 9 aa, Homo Sapiens
EVCNLCILG

SEQ ID NO: 878429 - protein, 9 aa, Homo Sapiens
VIYYFVMMG

SEQ ID NO: 878430 - protein, 9 aa, Homo Sapiens
PGSTVLYWI

SEQ ID NO: 878431 - protein, 9 aa, Homo Sapiens
YGMRTKQLQ

SEQ ID NO: 878432 - protein, 9 aa, Homo Sapiens
KIQTWIANE

SEQ ID NO: 878433 - protein, 9 aa, Homo Sapiens
PRCPPPRGT

SEQ ID NO: 878434 - protein, 9 aa, Homo Sapiens
GCTVADKSF

SEQ ID NO: 878435 - protein, 9 aa, Homo Sapiens
IDTDGLWLV

SEQ ID NO: 878436 - protein, 9 aa, Homo Sapiens
QKPLGTAEP

SEQ ID NO: 878437 - protein, 9 aa, Homo Sapiens
LCSLMESLP

SEQ ID NO: 878438 - protein, 9 aa, Homo Sapiens
KTQIISHVW

SEQ ID NO: 878439 - protein, 9 aa, Homo Sapiens
ICHQISHTG

SEQ ID NO: 878440 - protein, 9 aa, Homo Sapiens
QRMLNEFSH

SEQ ID NO: 878441 - protein, 9 aa, Homo Sapiens
ASISSAEKT

SEQ ID NO: 878442 - protein, 9 aa, Homo Sapiens
YIMANYFSG

SEQ ID NO: 878443 - protein, 9 aa, Homo Sapiens
AFEKLIHFK

SEQ ID NO: 878444 - protein, 9 aa, Homo Sapiens
SSAVYVNNQ

SEQ ID NO: 878445 - protein, 9 aa, Homo Sapiens
LYRMCTLEN

SEQ ID NO: 878446 - protein, 9 aa, Homo Sapiens
EKVRQLEQD

SEQ ID NO: 878447 - protein, 9 aa, Homo Sapiens
HHIIHSGEK

SEQ ID NO: 878448 - protein, 9 aa, Homo Sapiens
GIIKAKEYC

SEQ ID NO: 878449 - protein, 9 aa, Homo Sapiens
TWERKYYIL

SEQ ID NO: 878450 - protein, 9 aa, Homo Sapiens
RLWQCGQWV

SEQ ID NO: 878451 - protein, 9 aa, Homo Sapiens
QLNSSGPST

SEQ ID NO: 878452 - protein, 9 aa, Homo Sapiens
ELCRLSGLS

SEQ ID NO: 878453 - protein, 9 aa, Homo Sapiens
LKEIERLPL

SEQ ID NO: 878454 - protein, 9 aa, Homo Sapiens
FEILLPHRR

SEQ ID NO: 878455 - protein, 9 aa, Homo Sapiens
LRSPAEVKI

SEQ ID NO: 878456 - protein, 9 aa, Homo Sapiens
DMAFCSITT

SEQ ID NO: 878457 - protein, 9 aa, Homo Sapiens
FNQSKGMGS

SEQ ID NO: 878458 - protein, 9 aa, Homo Sapiens
GAGSDIGYG

SEQ ID NO: 878459 - protein, 9 aa, Homo Sapiens
WFFINLIAA

SEQ ID NO: 878460 - protein, 9 aa, Homo Sapiens
PGSLKSSPG

SEQ ID NO: 878461 - protein, 9 aa, Homo Sapiens
QIIDEFESM

SEQ ID NO: 878462 - protein, 9 aa, Homo Sapiens
SDQILLHNL

SEQ ID NO: 878463 - protein, 9 aa, Homo Sapiens
SQLAQTTCV

SEQ ID NO: 878464 - protein, 9 aa, Homo Sapiens
CIIFGTVIQ

SEQ ID NO: 878465 - protein, 9 aa, Homo Sapiens
GEENKSVQK

SEQ ID NO: 878466 - protein, 9 aa, Homo Sapiens
EDINTISPT

SEQ ID NO: 878467 - protein, 9 aa, Homo Sapiens
GPREPQRHR

SEQ ID NO: 878468 - protein, 9 aa, Homo Sapiens
HITQGAPHP

SEQ ID NO: 878469 - protein, 9 aa, Homo Sapiens
PEKSQEENP

SEQ ID NO: 878470 - protein, 9 aa, Homo Sapiens
LNDIQFEFT

SEQ ID NO: 878471 - protein, 9 aa, Homo Sapiens
SMCPSLDKA

SEQ ID NO: 878472 - protein, 9 aa, Homo Sapiens
QGSSLAQNC

SEQ ID NO: 878473 - protein, 9 aa, Homo Sapiens
KSKDWPRRI

SEQ ID NO: 878474 - protein, 9 aa, Homo Sapiens
LNRRAIHDK

SEQ ID NO: 878475 - protein, 9 aa, Homo Sapiens
PNNKFLVKQ

SEQ ID NO: 878476 - protein, 9 aa, Homo Sapiens
NQDNKLLKQ

SEQ ID NO: 878477 - protein, 9 aa, Homo Sapiens
TAEYILRAV

SEQ ID NO: 878478 - protein, 9 aa, Homo Sapiens
VNAANESRK

SEQ ID NO: 878479 - protein, 9 aa, Homo Sapiens
WPADIPDRF

SEQ ID NO: 878480 - protein, 9 aa, Homo Sapiens
RPQNGNTYK

SEQ ID NO: 878481 - protein, 9 aa, Homo Sapiens
KDICENFQD

SEQ ID NO: 878482 - protein, 9 aa, Homo Sapiens
FFEQGDWER

SEQ ID NO: 878483 - protein, 9 aa, Homo Sapiens
VYITIDHNL

SEQ ID NO: 878484 - protein, 9 aa, Homo Sapiens
NIPLIPVFL

SEQ ID NO: 878485 - protein, 9 aa, Homo Sapiens
VNTRQHYYP

SEQ ID NO: 878486 - protein, 9 aa, Homo Sapiens
KKRLCLPQV

SEQ ID NO: 878487 - protein, 9 aa, Homo Sapiens
LTYDKVKAR

SEQ ID NO: 878488 - protein, 9 aa, Homo Sapiens
EVQSELERI

SEQ ID NO: 878489 - protein, 9 aa, Homo Sapiens
SAANTLTSL

SEQ ID NO: 878490 - protein, 9 aa, Homo Sapiens
HILFQRRRR

SEQ ID NO: 878491 - protein, 9 aa, Homo Sapiens
RRSVTGIPR

SEQ ID NO: 878492 - protein, 9 aa, Homo Sapiens
KSPPSPGTT

SEQ ID NO: 878493 - protein, 9 aa, Homo Sapiens
AYPVRPELQ

SEQ ID NO: 878494 - protein, 9 aa, Homo Sapiens
LAILYLCYT

SEQ ID NO: 878495 - protein, 9 aa, Homo Sapiens
SHNKFWKYG

SEQ ID NO: 878496 - protein, 9 aa, Homo Sapiens
LDNAYTGSG

SEQ ID NO: 878497 - protein, 9 aa, Homo Sapiens
VTSKEICNE

SEQ ID NO: 878498 - protein, 9 aa, Homo Sapiens
KTPIKTLIR

SEQ ID NO: 878499 - protein, 9 aa, Homo Sapiens
NKINGIDVD

SEQ ID NO: 878500 - protein, 9 aa, Homo Sapiens
EIINAAVKD

SEQ ID NO: 878501 - protein, 9 aa, Homo Sapiens
KYLALQQEE

SEQ ID NO: 878502 - protein, 9 aa, Homo Sapiens
LSVNNKSPS

SEQ ID NO: 878503 - protein, 9 aa, Homo Sapiens
IITNAQNIT

SEQ ID NO: 878504 - protein, 9 aa, Homo Sapiens
FFPPNKSHG

SEQ ID NO: 878505 - protein, 9 aa, Homo Sapiens
SGLWGGPPP

SEQ ID NO: 878506 - protein, 9 aa, Homo Sapiens
ENVYTLLTE

SEQ ID NO: 878507 - protein, 9 aa, Homo Sapiens
NKFTKKLQN

SEQ ID NO: 878508 - protein, 9 aa, Homo Sapiens
EASGLWGGP

SEQ ID NO: 878509 - protein, 9 aa, Homo Sapiens
GKNGVVKLM

SEQ ID NO: 878510 - protein, 9 aa, Homo Sapiens
TSDCSPMQD

SEQ ID NO: 878511 - protein, 9 aa, Homo Sapiens
GQPQIQPFQ

SEQ ID NO: 878512 - protein, 9 aa, Homo Sapiens
FCLLEKHQQ

SEQ ID NO: 878513 - protein, 9 aa, Homo Sapiens
FDCLEKTSQ

SEQ ID NO: 878514 - protein, 9 aa, Homo Sapiens
DCPESLQKE

SEQ ID NO: 878515 - protein, 9 aa, Homo Sapiens
LRFEERDFV

SEQ ID NO: 878516 - protein, 9 aa, Homo Sapiens
LYRKLLNYQ

SEQ ID NO: 878517 - protein, 9 aa, Homo Sapiens
VLPLLMAPP

SEQ ID NO: 878518 - protein, 9 aa, Homo Sapiens
GRCMWYCLR

SEQ ID NO: 878519 - protein, 9 aa, Homo Sapiens
AFIKELFSL

SEQ ID NO: 878520 - protein, 9 aa, Homo Sapiens
GLKRLHINM

SEQ ID NO: 878521 - protein, 9 aa, Homo Sapiens
NANPTANTE

SEQ ID NO: 878522 - protein, 9 aa, Homo Sapiens
LPGYDKIVG

SEQ ID NO: 878523 - protein, 9 aa, Homo Sapiens
PPSSARNTL

SEQ ID NO: 878524 - protein, 9 aa, Homo Sapiens
RVEPGSLKS

SEQ ID NO: 878525 - protein, 9 aa, Homo Sapiens
CRWYKNRKS

SEQ ID NO: 878526 - protein, 9 aa, Homo Sapiens
NKARINAKA

SEQ ID NO: 878527 - protein, 9 aa, Homo Sapiens
DSRFWPRYV

SEQ ID NO: 878528 - protein, 9 aa, Homo Sapiens
LFVLLGITY

SEQ ID NO: 878529 - protein, 9 aa, Homo Sapiens
NGDRGENRQ

SEQ ID NO: 878530 - protein, 9 aa, Homo Sapiens
TVIQIPAKP

SEQ ID NO: 878531 - protein, 9 aa, Homo Sapiens
EPNNYFTNS

SEQ ID NO: 878532 - protein, 9 aa, Homo Sapiens
TTHKNIHTG

SEQ ID NO: 878533 - protein, 9 aa, Homo Sapiens
LSKSQTNVR

SEQ ID NO: 878534 - protein, 9 aa, Homo Sapiens
VVIYFQGFC

SEQ ID NO: 878535 - protein, 9 aa, Homo Sapiens
LALAGQTAF

SEQ ID NO: 878536 - protein, 9 aa, Homo Sapiens
ADSMCKRNQ

SEQ ID NO: 878537 - protein, 9 aa, Homo Sapiens
CDKAFSWSS

SEQ ID NO: 878538 - protein, 9 aa, Homo Sapiens
TVCSNLTIH

SEQ ID NO: 878539 - protein, 9 aa, Homo Sapiens
CDKGRKGIY

SEQ ID NO: 878540 - protein, 9 aa, Homo Sapiens
IEPSVCSCF

SEQ ID NO: 878541 - protein, 9 aa, Homo Sapiens
INQLALPQT

SEQ ID NO: 878542 - protein, 9 aa, Homo Sapiens
QAGPVITVQ

SEQ ID NO: 878543 - protein, 9 aa, Homo Sapiens
YTNHLTQEQ

SEQ ID NO: 878544 - protein, 9 aa, Homo Sapiens
TTKNNYNPT

SEQ ID NO: 878545 - protein, 9 aa, Homo Sapiens
DAQVVLLGL

SEQ ID NO: 878546 - protein, 9 aa, Homo Sapiens
VFVEPNRNK

SEQ ID NO: 878547 - protein, 9 aa, Homo Sapiens
KLIKSQNIF

SEQ ID NO: 878548 - protein, 9 aa, Homo Sapiens
QRAKTYFFS

SEQ ID NO: 878549 - protein, 9 aa, Homo Sapiens
CLNPQEYLT

SEQ ID NO: 878550 - protein, 9 aa, Homo Sapiens
FCPAEFHWK

SEQ ID NO: 878551 - protein, 9 aa, Homo Sapiens
VVQLHAPQY

SEQ ID NO: 878552 - protein, 9 aa, Homo Sapiens
PAEKNVKKK

SEQ ID NO: 878553 - protein, 9 aa, Homo Sapiens
DENKPTHAG

SEQ ID NO: 878554 - protein, 9 aa, Homo Sapiens
VESQVLKIN

SEQ ID NO: 878555 - protein, 9 aa, Homo Sapiens
SNSVSSCGQ

SEQ ID NO: 878556 - protein, 9 aa, Homo Sapiens
YHILTRKQI

SEQ ID NO: 878557 - protein, 9 aa, Homo Sapiens
SPIKKEDSG

SEQ ID NO: 878558 - protein, 9 aa, Homo Sapiens
CLQDWASFI

SEQ ID NO: 878559 - protein, 9 aa, Homo Sapiens
CANLLDFWF

SEQ ID NO: 878560 - protein, 9 aa, Homo Sapiens
EKCDIFFEE

SEQ ID NO: 878561 - protein, 9 aa, Homo Sapiens
LEGIQCAIR

SEQ ID NO: 878562 - protein, 9 aa, Homo Sapiens
DVQFVRMIK

SEQ ID NO: 878563 - protein, 9 aa, Homo Sapiens
LARDKKLRK

SEQ ID NO: 878564 - protein, 9 aa, Homo Sapiens
CEGFKLHFW

SEQ ID NO: 878565 - protein, 9 aa, Homo Sapiens
PGYESAYGG

SEQ ID NO: 878566 - protein, 9 aa, Homo Sapiens
AENDLTLLI

SEQ ID NO: 878567 - protein, 9 aa, Homo Sapiens
PLLSTTNIL

SEQ ID NO: 878568 - protein, 9 aa, Homo Sapiens
EDSDDVPQK

SEQ ID NO: 878569 - protein, 9 aa, Homo Sapiens
KTFSQGPTL

SEQ ID NO: 878570 - protein, 9 aa, Homo Sapiens
VIDVKPFLD

SEQ ID NO: 878571 - protein, 9 aa, Homo Sapiens
EPGTMDLVR

SEQ ID NO: 878572 - protein, 9 aa, Homo Sapiens
FIRRDFFLD

SEQ ID NO: 878573 - protein, 9 aa, Homo Sapiens
LMTHMIIHT

SEQ ID NO: 878574 - protein, 9 aa, Homo Sapiens
PFHHTTANN

SEQ ID NO: 878575 - protein, 9 aa, Homo Sapiens
FKDIKSLLR

SEQ ID NO: 878576 - protein, 9 aa, Homo Sapiens
KQKFICGFC

SEQ ID NO: 878577 - protein, 9 aa, Homo Sapiens
SAWKNMSNI

SEQ ID NO: 878578 - protein, 9 aa, Homo Sapiens
TSAVSMAKP

SEQ ID NO: 878579 - protein, 9 aa, Homo Sapiens
QLSVPAPPS

SEQ ID NO: 878580 - protein, 9 aa, Homo Sapiens
DSQQPHPRI

SEQ ID NO: 878581 - protein, 9 aa, Homo Sapiens
RLRDEAKHI

SEQ ID NO: 878582 - protein, 9 aa, Homo Sapiens
PWNIYISAE

SEQ ID NO: 878583 - protein, 9 aa, Homo Sapiens
LYLQQQIFP

SEQ ID NO: 878584 - protein, 9 aa, Homo Sapiens
TSVLCKSVL

SEQ ID NO: 878585 - protein, 9 aa, Homo Sapiens
ITKLCKFFH

SEQ ID NO: 878586 - protein, 9 aa, Homo Sapiens
KHKIINTGE

SEQ ID NO: 878587 - protein, 9 aa, Homo Sapiens
ITIAVVAGL

SEQ ID NO: 878588 - protein, 9 aa, Homo Sapiens
YINASYIMD

SEQ ID NO: 878589 - protein, 9 aa, Homo Sapiens
KKKKIKRGI

SEQ ID NO: 878590 - protein, 9 aa, Homo Sapiens
LTSSAASPP

SEQ ID NO: 878591 - protein, 9 aa, Homo Sapiens
DSQPFHPSD

SEQ ID NO: 878592 - protein, 9 aa, Homo Sapiens
LAITSFVAA

SEQ ID NO: 878593 - protein, 9 aa, Homo Sapiens
SVLIEFAAV

SEQ ID NO: 878594 - protein, 9 aa, Homo Sapiens
FSSSKSRAF

SEQ ID NO: 878595 - protein, 9 aa, Homo Sapiens
FIIDLILNN

SEQ ID NO: 878596 - protein, 9 aa, Homo Sapiens
DKISALEQV

SEQ ID NO: 878597 - protein, 9 aa, Homo Sapiens
KNQCLLYKT

SEQ ID NO: 878598 - protein, 9 aa, Homo Sapiens
CKIKNILEW

SEQ ID NO: 878599 - protein, 9 aa, Homo Sapiens
KVLCTYMAS

SEQ ID NO: 878600 - protein, 9 aa, Homo Sapiens
MRIFYYLHV

SEQ ID NO: 878601 - protein, 9 aa, Homo Sapiens
EKIKYISRE

SEQ ID NO: 878602 - protein, 9 aa, Homo Sapiens
PPVVSPNDT

SEQ ID NO: 878603 - protein, 9 aa, Homo Sapiens
YACQIHHPS

SEQ ID NO: 878604 - protein, 9 aa, Homo Sapiens
LAAYDDSDS

SEQ ID NO: 878605 - protein, 9 aa, Homo Sapiens
QTGWVYRNV

SEQ ID NO: 878606 - protein, 9 aa, Homo Sapiens
PKEVNYSPR

SEQ ID NO: 878607 - protein, 9 aa, Homo Sapiens
IVGHGNGTF

SEQ ID NO: 878608 - protein, 9 aa, Homo Sapiens
ELLALSNSS

SEQ ID NO: 878609 - protein, 9 aa, Homo Sapiens
AEASPVDTT

SEQ ID NO: 878610 - protein, 9 aa, Homo Sapiens
QLYKMQNGY

SEQ ID NO: 878611 - protein, 9 aa, Homo Sapiens
DYMERNNID

SEQ ID NO: 878612 - protein, 9 aa, Homo Sapiens
KMKMATNIY

SEQ ID NO: 878613 - protein, 9 aa, Homo Sapiens
FMFQNHLCL

SEQ ID NO: 878614 - protein, 9 aa, Homo Sapiens
DVTISYIDA

SEQ ID NO: 878615 - protein, 9 aa, Homo Sapiens
IQKGAVPIR

SEQ ID NO: 878616 - protein, 9 aa, Homo Sapiens
EEAVCLLTK

SEQ ID NO: 878617 - protein, 9 aa, Homo Sapiens
EMLLKQRNF

SEQ ID NO: 878618 - protein, 9 aa, Homo Sapiens
LIHFKSVIH

SEQ ID NO: 878619 - protein, 9 aa, Homo Sapiens
YQVWQRTLS

SEQ ID NO: 878620 - protein, 9 aa, Homo Sapiens
EVDANLINA

SEQ ID NO: 878621 - protein, 9 aa, Homo Sapiens
MCPKSLSEN

SEQ ID NO: 878622 - protein, 9 aa, Homo Sapiens
DTPPQSETI

SEQ ID NO: 878623 - protein, 9 aa, Homo Sapiens
DYTTKKYRE

SEQ ID NO: 878624 - protein, 9 aa, Homo Sapiens
LHEGAKVLD

SEQ ID NO: 878625 - protein, 9 aa, Homo Sapiens
EVKKKNPKL

SEQ ID NO: 878626 - protein, 9 aa, Homo Sapiens
AADTVVFLL

SEQ ID NO: 878627 - protein, 9 aa, Homo Sapiens
ICKHKIDLT

SEQ ID NO: 878628 - protein, 9 aa, Homo Sapiens
HASQAKYVK

SEQ ID NO: 878629 - protein, 9 aa, Homo Sapiens
LDYLETVAK

SEQ ID NO: 878630 - protein, 9 aa, Homo Sapiens
TLITEETEK

SEQ ID NO: 878631 - protein, 9 aa, Homo Sapiens
PGRPRYPNT

SEQ ID NO: 878632 - protein, 9 aa, Homo Sapiens
YDKIVGLRD

SEQ ID NO: 878633 - protein, 9 aa, Homo Sapiens
PLSRIKLTG

SEQ ID NO: 878634 - protein, 9 aa, Homo Sapiens
GPGLLCQSQ

SEQ ID NO: 878635 - protein, 9 aa, Homo Sapiens
AVLAVASQW

SEQ ID NO: 878636 - protein, 9 aa, Homo Sapiens
IDTWSPSAW

SEQ ID NO: 878637 - protein, 9 aa, Homo Sapiens
HGPNLESHS

SEQ ID NO: 878638 - protein, 9 aa, Homo Sapiens
DKTVMYKHM

SEQ ID NO: 878639 - protein, 9 aa, Homo Sapiens
DLGTAFQTW

SEQ ID NO: 878640 - protein, 9 aa, Homo Sapiens
QIDRSQEHL

SEQ ID NO: 878641 - protein, 9 aa, Homo Sapiens
YEVPITMKY

SEQ ID NO: 878642 - protein, 9 aa, Homo Sapiens
LIITLASRS

SEQ ID NO: 878643 - protein, 9 aa, Homo Sapiens
TTIQSVLME

SEQ ID NO: 878644 - protein, 9 aa, Homo Sapiens
AIWNQRHSG

SEQ ID NO: 878645 - protein, 9 aa, Homo Sapiens
VAGVNQDCH

SEQ ID NO: 878646 - protein, 9 aa, Homo Sapiens
EEVKMPEEG

SEQ ID NO: 878647 - protein, 9 aa, Homo Sapiens
ALARDKKLR

SEQ ID NO: 878648 - protein, 9 aa, Homo Sapiens
AGGADSNNF

SEQ ID NO: 878649 - protein, 9 aa, Homo Sapiens
TQASMEFQR

SEQ ID NO: 878650 - protein, 9 aa, Homo Sapiens
AISDLGGSN

SEQ ID NO: 878651 - protein, 9 aa, Homo Sapiens
KKYREKSLY

SEQ ID NO: 878652 - protein, 9 aa, Homo Sapiens
HKYIITSLC

SEQ ID NO: 878653 - protein, 9 aa, Homo Sapiens
NLTFEQLCS

SEQ ID NO: 878654 - protein, 9 aa, Homo Sapiens
HKVIQDEEL

SEQ ID NO: 878655 - protein, 9 aa, Homo Sapiens
NLDILTCIE

SEQ ID NO: 878656 - protein, 9 aa, Homo Sapiens
MKITKCADI

SEQ ID NO: 878657 - protein, 9 aa, Homo Sapiens
PGRSVQFLK

SEQ ID NO: 878658 - protein, 9 aa, Homo Sapiens
NRCRQAGSS

SEQ ID NO: 878659 - protein, 9 aa, Homo Sapiens
SACASWIYY

SEQ ID NO: 878660 - protein, 9 aa, Homo Sapiens
NQSINLNHN

SEQ ID NO: 878661 - protein, 9 aa, Homo Sapiens
KFICGFCHL

SEQ ID NO: 878662 - protein, 9 aa, Homo Sapiens
PVTIVFRGP

SEQ ID NO: 878663 - protein, 9 aa, Homo Sapiens
HYTEEEQKT

SEQ ID NO: 878664 - protein, 9 aa, Homo Sapiens
GQQRDLIRQ

SEQ ID NO: 878665 - protein, 9 aa, Homo Sapiens
TLPALVWHQ

SEQ ID NO: 878666 - protein, 9 aa, Homo Sapiens
GRSVQFLKS

SEQ ID NO: 878667 - protein, 9 aa, Homo Sapiens
RVEPQTPWV

SEQ ID NO: 878668 - protein, 9 aa, Homo Sapiens
GSEAMKSKL

SEQ ID NO: 878669 - protein, 9 aa, Homo Sapiens
LGLKLCSLE

SEQ ID NO: 878670 - protein, 9 aa, Homo Sapiens
HPCITNTFF

SEQ ID NO: 878671 - protein, 9 aa, Homo Sapiens
KLYLEDSPL

SEQ ID NO: 878672 - protein, 9 aa, Homo Sapiens
TYNNTVIFA

SEQ ID NO: 878673 - protein, 9 aa, Homo Sapiens
DDAKVKEEP

SEQ ID NO: 878674 - protein, 9 aa, Homo Sapiens
NTPGQKRED

SEQ ID NO: 878675 - protein, 9 aa, Homo Sapiens
DPHPDRTHT

SEQ ID NO: 878676 - protein, 9 aa, Homo Sapiens
RIEKLESKI

SEQ ID NO: 878677 - protein, 9 aa, Homo Sapiens
MFCGFLFSG

SEQ ID NO: 878678 - protein, 9 aa, Homo Sapiens
EDFNWTAVL

SEQ ID NO: 878679 - protein, 9 aa, Homo Sapiens
RNVYITIDH

SEQ ID NO: 878680 - protein, 9 aa, Homo Sapiens
KLWEEATPI

SEQ ID NO: 878681 - protein, 9 aa, Homo Sapiens
GDPVYCLLP

SEQ ID NO: 878682 - protein, 9 aa, Homo Sapiens
DDPECMRLR

SEQ ID NO: 878683 - protein, 9 aa, Homo Sapiens
ECIEGTLAN

SEQ ID NO: 878684 - protein, 9 aa, Homo Sapiens
LSVRDSARP

SEQ ID NO: 878685 - protein, 9 aa, Homo Sapiens
LSILCSLFF

SEQ ID NO: 878686 - protein, 9 aa, Homo Sapiens
AKVLDVGSG

SEQ ID NO: 878687 - protein, 9 aa, Homo Sapiens
KAESNLFLA

SEQ ID NO: 878688 - protein, 9 aa, Homo Sapiens
KYQMDGDVA

SEQ ID NO: 878689 - protein, 9 aa, Homo Sapiens
VNKDSGAVA

SEQ ID NO: 878690 - protein, 9 aa, Homo Sapiens
RHQIIHIGK

SEQ ID NO: 878691 - protein, 9 aa, Homo Sapiens
KKQLALSTA

SEQ ID NO: 878692 - protein, 9 aa, Homo Sapiens
LHAKGAKIE

SEQ ID NO: 878693 - protein, 9 aa, Homo Sapiens
YNKFNHYDT

SEQ ID NO: 878694 - protein, 9 aa, Homo Sapiens
DLPQNQKEH

SEQ ID NO: 878695 - protein, 9 aa, Homo Sapiens
FQEGVEMLL

SEQ ID NO: 878696 - protein, 9 aa, Homo Sapiens
YTDRIQVLH

SEQ ID NO: 878697 - protein, 9 aa, Homo Sapiens
VMNGAVADR

SEQ ID NO: 878698 - protein, 9 aa, Homo Sapiens
FDLVVSILG

SEQ ID NO: 878699 - protein, 9 aa, Homo Sapiens
EARINMVVD

SEQ ID NO: 878700 - protein, 9 aa, Homo Sapiens
KAKDAGQIT

SEQ ID NO: 878701 - protein, 9 aa, Homo Sapiens
LFSRGLSFS

SEQ ID NO: 878702 - protein, 9 aa, Homo Sapiens
NRQVQMEYK

SEQ ID NO: 878703 - protein, 9 aa, Homo Sapiens
SLLQDNGEV

SEQ ID NO: 878704 - protein, 9 aa, Homo Sapiens
WASFIRLAI

SEQ ID NO: 878705 - protein, 9 aa, Homo Sapiens
DIQFEFTPG

SEQ ID NO: 878706 - protein, 9 aa, Homo Sapiens
DALLGHAVQ

SEQ ID NO: 878707 - protein, 9 aa, Homo Sapiens
FIDCLKIFL

SEQ ID NO: 878708 - protein, 9 aa, Homo Sapiens
SQIKHQNLA

SEQ ID NO: 878709 - protein, 9 aa, Homo Sapiens
APHNYAVRL

SEQ ID NO: 878710 - protein, 9 aa, Homo Sapiens
RTIQKAWWR

SEQ ID NO: 878711 - protein, 9 aa, Homo Sapiens
QKEIPFYLH

SEQ ID NO: 878712 - protein, 9 aa, Homo Sapiens
GDDSDLLLN

SEQ ID NO: 878713 - protein, 9 aa, Homo Sapiens
NIDVGNKDG

SEQ ID NO: 878714 - protein, 9 aa, Homo Sapiens
KLCLECIEW

SEQ ID NO: 878715 - protein, 9 aa, Homo Sapiens
RPHSAADDY

SEQ ID NO: 878716 - protein, 9 aa, Homo Sapiens
AKKIMVESP

SEQ ID NO: 878717 - protein, 9 aa, Homo Sapiens
LLLGLQDVV

SEQ ID NO: 878718 - protein, 9 aa, Homo Sapiens
QSVWVLTDH

SEQ ID NO: 878719 - protein, 9 aa, Homo Sapiens
CRPLTVICD

SEQ ID NO: 878720 - protein, 9 aa, Homo Sapiens
GSTKNWNHV

SEQ ID NO: 878721 - protein, 9 aa, Homo Sapiens
TVVWCRSKK

SEQ ID NO: 878722 - protein, 9 aa, Homo Sapiens
EDFNGKLSF

SEQ ID NO: 878723 - protein, 9 aa, Homo Sapiens
TLLHSERPP

SEQ ID NO: 878724 - protein, 9 aa, Homo Sapiens
HCLLNRQVQ

SEQ ID NO: 878725 - protein, 9 aa, Homo Sapiens
EFKAPLEAV

SEQ ID NO: 878726 - protein, 9 aa, Homo Sapiens
DSAWKNMSN

SEQ ID NO: 878727 - protein, 9 aa, Homo Sapiens
SKINLHQHQ

SEQ ID NO: 878728 - protein, 9 aa, Homo Sapiens
SENKRKMEF

SEQ ID NO: 878729 - protein, 9 aa, Homo Sapiens
DWHGRPVVL

SEQ ID NO: 878730 - protein, 9 aa, Homo Sapiens
LSYVQICIT

SEQ ID NO: 878731 - protein, 9 aa, Homo Sapiens
VLLLTNGQW

SEQ ID NO: 878732 - protein, 9 aa, Homo Sapiens
TARDMKTCH

SEQ ID NO: 878733 - protein, 9 aa, Homo Sapiens
RLNTRFSRP

SEQ ID NO: 878734 - protein, 9 aa, Homo Sapiens
QAFGEYAND

SEQ ID NO: 878735 - protein, 9 aa, Homo Sapiens
KDVLEIFNV

SEQ ID NO: 878736 - protein, 9 aa, Homo Sapiens
QYNMTYERF

SEQ ID NO: 878737 - protein, 9 aa, Homo Sapiens
IPVICQGDT

SEQ ID NO: 878738 - protein, 9 aa, Homo Sapiens
QDQETYSHC

SEQ ID NO: 878739 - protein, 9 aa, Homo Sapiens
ATKMSGRGS

SEQ ID NO: 878740 - protein, 9 aa, Homo Sapiens
MNIWSHLAA

SEQ ID NO: 878741 - protein, 9 aa, Homo Sapiens
AHCHKPYLW

SEQ ID NO: 878742 - protein, 9 aa, Homo Sapiens
IHISRGERA

SEQ ID NO: 878743 - protein, 9 aa, Homo Sapiens
LNMQHSRDH

SEQ ID NO: 878744 - protein, 9 aa, Homo Sapiens
MLDAEPDSW

SEQ ID NO: 878745 - protein, 9 aa, Homo Sapiens
AYSNYNWFY

SEQ ID NO: 878746 - protein, 9 aa, Homo Sapiens
PTPELSSKK

SEQ ID NO: 878747 - protein, 9 aa, Homo Sapiens
FDQLQLEGL

SEQ ID NO: 878748 - protein, 9 aa, Homo Sapiens
GRVMLQNLT

SEQ ID NO: 878749 - protein, 9 aa, Homo Sapiens
SGEVLCHPS

SEQ ID NO: 878750 - protein, 9 aa, Homo Sapiens
VMLVPLPVP

SEQ ID NO: 878751 - protein, 9 aa, Homo Sapiens
WAVQNIQNV

SEQ ID NO: 878752 - protein, 9 aa, Homo Sapiens
RHIHLENND

SEQ ID NO: 878753 - protein, 9 aa, Homo Sapiens
DVDIENVVR

SEQ ID NO: 878754 - protein, 9 aa, Homo Sapiens
LEITDNHDC

SEQ ID NO: 878755 - protein, 9 aa, Homo Sapiens
NMLFTSFYL

SEQ ID NO: 878756 - protein, 9 aa, Homo Sapiens
CSRTLNKHK

SEQ ID NO: 878757 - protein, 9 aa, Homo Sapiens
CCPAGGNPM

SEQ ID NO: 878758 - protein, 9 aa, Homo Sapiens
PQKKSDVTS

SEQ ID NO: 878759 - protein, 9 aa, Homo Sapiens
IPEKNRHLK

SEQ ID NO: 878760 - protein, 9 aa, Homo Sapiens
YQQWVAGVN

SEQ ID NO: 878761 - protein, 9 aa, Homo Sapiens
EASNSVSSC

SEQ ID NO: 878762 - protein, 9 aa, Homo Sapiens
KFLSEREAS

SEQ ID NO: 878763 - protein, 9 aa, Homo Sapiens
VRICSVTCA

SEQ ID NO: 878764 - protein, 9 aa, Homo Sapiens
LCIWLLILS

SEQ ID NO: 878765 - protein, 9 aa, Homo Sapiens
HRQIMLLNH

SEQ ID NO: 878766 - protein, 9 aa, Homo Sapiens
VRTVRMRRK

SEQ ID NO: 878767 - protein, 9 aa, Homo Sapiens
EDNDPKPGE

SEQ ID NO: 878768 - protein, 9 aa, Homo Sapiens
DWDIAAASL

SEQ ID NO: 878769 - protein, 9 aa, Homo Sapiens
SDHRTLLES

SEQ ID NO: 878770 - protein, 9 aa, Homo Sapiens
QIKLYSSIT

SEQ ID NO: 878771 - protein, 9 aa, Homo Sapiens
YQIITDPGD

SEQ ID NO: 878772 - protein, 9 aa, Homo Sapiens
DKLSKSLWL

SEQ ID NO: 878773 - protein, 9 aa, Homo Sapiens
HFAKGRQKA

SEQ ID NO: 878774 - protein, 9 aa, Homo Sapiens
AQIFQFQNF

SEQ ID NO: 878775 - protein, 9 aa, Homo Sapiens
DAGCRPADT

SEQ ID NO: 878776 - protein, 9 aa, Homo Sapiens
NYSLHVDIT

SEQ ID NO: 878777 - protein, 9 aa, Homo Sapiens
MAIDIFFHF

SEQ ID NO: 878778 - protein, 9 aa, Homo Sapiens
EEHFIQKVE

SEQ ID NO: 878779 - protein, 9 aa, Homo Sapiens
YNRLYINFM

SEQ ID NO: 878780 - protein, 9 aa, Homo Sapiens
VYGTSSHLK

SEQ ID NO: 878781 - protein, 9 aa, Homo Sapiens
SPFFPQEQK

SEQ ID NO: 878782 - protein, 9 aa, Homo Sapiens
CLGDSTVGK

SEQ ID NO: 878783 - protein, 9 aa, Homo Sapiens
RGKKCQEAP

SEQ ID NO: 878784 - protein, 9 aa, Homo Sapiens
YNPDKLTLE

SEQ ID NO: 878785 - protein, 9 aa, Homo Sapiens
VMAYFFTIF

SEQ ID NO: 878786 - protein, 9 aa, Homo Sapiens
GETPLMITC

SEQ ID NO: 878787 - protein, 9 aa, Homo Sapiens
GVGLNSTGY

SEQ ID NO: 878788 - protein, 9 aa, Homo Sapiens
KGKECRDLD

SEQ ID NO: 878789 - protein, 9 aa, Homo Sapiens
TQLINLSTT

SEQ ID NO: 878790 - protein, 9 aa, Homo Sapiens
HITNDESIP

SEQ ID NO: 878791 - protein, 9 aa, Homo Sapiens
YGRDMGNRT

SEQ ID NO: 878792 - protein, 9 aa, Homo Sapiens
PSYTLGMKL

SEQ ID NO: 878793 - protein, 9 aa, Homo Sapiens
LFVDIGPVC

SEQ ID NO: 878794 - protein, 9 aa, Homo Sapiens
CPIAVTHFI

SEQ ID NO: 878795 - protein, 9 aa, Homo Sapiens
VLIQHQIIH

SEQ ID NO: 878796 - protein, 9 aa, Homo Sapiens
RCHRFIPCE

SEQ ID NO: 878797 - protein, 9 aa, Homo Sapiens
GEIKPSLEA

SEQ ID NO: 878798 - protein, 9 aa, Homo Sapiens
GNCIEDLQK

SEQ ID NO: 878799 - protein, 9 aa, Homo Sapiens
TVVDKKNLT

SEQ ID NO: 878800 - protein, 9 aa, Homo Sapiens
CIEDLQKNV

SEQ ID NO: 878801 - protein, 9 aa, Homo Sapiens
CDDGWNIKD

SEQ ID NO: 878802 - protein, 9 aa, Homo Sapiens
WRLDKDSGF

SEQ ID NO: 878803 - protein, 9 aa, Homo Sapiens
TDSEYTDGS

SEQ ID NO: 878804 - protein, 9 aa, Homo Sapiens
WRKVSGVSG

SEQ ID NO: 878805 - protein, 9 aa, Homo Sapiens
KKKNPKLTI

SEQ ID NO: 878806 - protein, 9 aa, Homo Sapiens
RLCRALLSA

SEQ ID NO: 878807 - protein, 9 aa, Homo Sapiens
IFKYDMWDR

SEQ ID NO: 878808 - protein, 9 aa, Homo Sapiens
DCWKTFLNQ

SEQ ID NO: 878809 - protein, 9 aa, Homo Sapiens
STGPPWESK

SEQ ID NO: 878810 - protein, 9 aa, Homo Sapiens
PDLLLAKVD

SEQ ID NO: 878811 - protein, 9 aa, Homo Sapiens
QMHCIRALT

SEQ ID NO: 878812 - protein, 9 aa, Homo Sapiens
QSQVKIRNR

SEQ ID NO: 878813 - protein, 9 aa, Homo Sapiens
DNVSFLMKH

SEQ ID NO: 878814 - protein, 9 aa, Homo Sapiens
NNLNPVCEA

SEQ ID NO: 878815 - protein, 9 aa, Homo Sapiens
SDLEIDKLE

SEQ ID NO: 878816 - protein, 9 aa, Homo Sapiens
MFGQIQLPG

SEQ ID NO: 878817 - protein, 9 aa, Homo Sapiens
CPSLDKAQP

SEQ ID NO: 878818 - protein, 9 aa, Homo Sapiens
AFFTVAGTL

SEQ ID NO: 878819 - protein, 9 aa, Homo Sapiens
EQPNVKWSD

SEQ ID NO: 878820 - protein, 9 aa, Homo Sapiens
LLALSNSSA

SEQ ID NO: 878821 - protein, 9 aa, Homo Sapiens
CYNAEKKKV

SEQ ID NO: 878822 - protein, 9 aa, Homo Sapiens
NYVQERKNL

SEQ ID NO: 878823 - protein, 9 aa, Homo Sapiens
THEGVRYFV

SEQ ID NO: 878824 - protein, 9 aa, Homo Sapiens
DANLINAGK

SEQ ID NO: 878825 - protein, 9 aa, Homo Sapiens
RSPCMQYRS

SEQ ID NO: 878826 - protein, 9 aa, Homo Sapiens
ALIRHQQIH

SEQ ID NO: 878827 - protein, 9 aa, Homo Sapiens
QSRGMDLVD

SEQ ID NO: 878828 - protein, 9 aa, Homo Sapiens
TISTYDGSK

SEQ ID NO: 878829 - protein, 9 aa, Homo Sapiens
NPFIYTLCN

SEQ ID NO: 878830 - protein, 9 aa, Homo Sapiens
DFLHVRDHC

SEQ ID NO: 878831 - protein, 9 aa, Homo Sapiens
TRNLYMQIR

SEQ ID NO: 878832 - protein, 9 aa, Homo Sapiens
NVINYYADT

SEQ ID NO: 878833 - protein, 9 aa, Homo Sapiens
SFSYKINLI

SEQ ID NO: 878834 - protein, 9 aa, Homo Sapiens
LDNTSAEWL

SEQ ID NO: 878835 - protein, 9 aa, Homo Sapiens
GLLGHNNTD

SEQ ID NO: 878836 - protein, 9 aa, Homo Sapiens
HGNVRETYC

SEQ ID NO: 878837 - protein, 9 aa, Homo Sapiens
KFQFIVSLP

SEQ ID NO: 878838 - protein, 9 aa, Homo Sapiens
LDSVRQFSG

SEQ ID NO: 878839 - protein, 9 aa, Homo Sapiens
DKHILAKIW

SEQ ID NO: 878840 - protein, 9 aa, Homo Sapiens
KGQTGVMIC

SEQ ID NO: 878841 - protein, 9 aa, Homo Sapiens
NLMASELDD

SEQ ID NO: 878842 - protein, 9 aa, Homo Sapiens
KKIIGKMLN

SEQ ID NO: 878843 - protein, 9 aa, Homo Sapiens
GKTFTVCSN

SEQ ID NO: 878844 - protein, 9 aa, Homo Sapiens
MKVFDSRFT

SEQ ID NO: 878845 - protein, 9 aa, Homo Sapiens
EGMQKQGLF

SEQ ID NO: 878846 - protein, 9 aa, Homo Sapiens
RPDSMFKDQ

SEQ ID NO: 878847 - protein, 9 aa, Homo Sapiens
SYTLGMKLL

SEQ ID NO: 878848 - protein, 9 aa, Homo Sapiens
VREAAALVL

SEQ ID NO: 878849 - protein, 9 aa, Homo Sapiens
EKEATGYKK

SEQ ID NO: 878850 - protein, 9 aa, Homo Sapiens
NYNPTAAGT

SEQ ID NO: 878851 - protein, 9 aa, Homo Sapiens
LMECLSVDY

SEQ ID NO: 878852 - protein, 9 aa, Homo Sapiens
KDEHPQCLN

SEQ ID NO: 878853 - protein, 9 aa, Homo Sapiens
CCNNEAKDV

SEQ ID NO: 878854 - protein, 9 aa, Homo Sapiens
ESAANQKTL

SEQ ID NO: 878855 - protein, 9 aa, Homo Sapiens
WIIRKMIQL

SEQ ID NO: 878856 - protein, 9 aa, Homo Sapiens
PLQRCRASF

SEQ ID NO: 878857 - protein, 9 aa, Homo Sapiens
HEYCRNLPM

SEQ ID NO: 878858 - protein, 9 aa, Homo Sapiens
GMVEKTRRS

SEQ ID NO: 878859 - protein, 9 aa, Homo Sapiens
VNVTLRQIA

SEQ ID NO: 878860 - protein, 9 aa, Homo Sapiens
KRDLAKYIT

SEQ ID NO: 878861 - protein, 9 aa, Homo Sapiens
INKFTKKLQ

SEQ ID NO: 878862 - protein, 9 aa, Homo Sapiens
QRIRSKQKE

SEQ ID NO: 878863 - protein, 9 aa, Homo Sapiens
FGAWLLLYR

SEQ ID NO: 878864 - protein, 9 aa, Homo Sapiens
VLQVAMVFG

SEQ ID NO: 878865 - protein, 9 aa, Homo Sapiens
QPEGQKAMN

SEQ ID NO: 878866 - protein, 9 aa, Homo Sapiens
NQPFEINTI

SEQ ID NO: 878867 - protein, 9 aa, Homo Sapiens
ATSSSGTSY

SEQ ID NO: 878868 - protein, 9 aa, Homo Sapiens
WNNQSINLN

SEQ ID NO: 878869 - protein, 9 aa, Homo Sapiens
KVEFCKRME

SEQ ID NO: 878870 - protein, 9 aa, Homo Sapiens
KTPQTPRLQ

SEQ ID NO: 878871 - protein, 9 aa, Homo Sapiens
HDYGRITLF

SEQ ID NO: 878872 - protein, 9 aa, Homo Sapiens
ADQELFVDI

SEQ ID NO: 878873 - protein, 9 aa, Homo Sapiens
VSTDDSYSC

SEQ ID NO: 878874 - protein, 9 aa, Homo Sapiens
RTRNIFYLS

SEQ ID NO: 878875 - protein, 9 aa, Homo Sapiens
WQSPFLRIT

SEQ ID NO: 878876 - protein, 9 aa, Homo Sapiens
EEAAPEICC

SEQ ID NO: 878877 - protein, 9 aa, Homo Sapiens
KDDDEPDMK

SEQ ID NO: 878878 - protein, 9 aa, Homo Sapiens
KGTMKDICE

SEQ ID NO: 878879 - protein, 9 aa, Homo Sapiens
ETLVKYLDP

SEQ ID NO: 878880 - protein, 9 aa, Homo Sapiens
WYCRRQNGY

SEQ ID NO: 878881 - protein, 9 aa, Homo Sapiens
QEQRTQINV

SEQ ID NO: 878882 - protein, 9 aa, Homo Sapiens
LAINVLDSP

SEQ ID NO: 878883 - protein, 9 aa, Homo Sapiens
FWTVPSDNA

SEQ ID NO: 878884 - protein, 9 aa, Homo Sapiens
KRLLLKEDS

SEQ ID NO: 878885 - protein, 9 aa, Homo Sapiens
CSICKASGA

SEQ ID NO: 878886 - protein, 9 aa, Homo Sapiens
YKLFHDPSE

SEQ ID NO: 878887 - protein, 9 aa, Homo Sapiens
KFIKIDQAW

SEQ ID NO: 878888 - protein, 9 aa, Homo Sapiens
ISSPHLRLA

SEQ ID NO: 878889 - protein, 9 aa, Homo Sapiens
KEQERTQQC

SEQ ID NO: 878890 - protein, 9 aa, Homo Sapiens
PNEITLDLI

SEQ ID NO: 878891 - protein, 9 aa, Homo Sapiens
QNDEYENLF

SEQ ID NO: 878892 - protein, 9 aa, Homo Sapiens
LSTNLDILT

SEQ ID NO: 878893 - protein, 9 aa, Homo Sapiens
DDKGYGFVE

SEQ ID NO: 878894 - protein, 9 aa, Homo Sapiens
EWKGAAQEK

SEQ ID NO: 878895 - protein, 9 aa, Homo Sapiens
LTVICDMDT

SEQ ID NO: 878896 - protein, 9 aa, Homo Sapiens
PESKKAEND

SEQ ID NO: 878897 - protein, 9 aa, Homo Sapiens
LLASGSLLG

SEQ ID NO: 878898 - protein, 9 aa, Homo Sapiens
RRSWSEAAP

SEQ ID NO: 878899 - protein, 9 aa, Homo Sapiens
DMSSLSYLA

SEQ ID NO: 878900 - protein, 9 aa, Homo Sapiens
VVQQANGNM

SEQ ID NO: 878901 - protein, 9 aa, Homo Sapiens
RSLQSPTED

SEQ ID NO: 878902 - protein, 9 aa, Homo Sapiens
ENKGETSRT

SEQ ID NO: 878903 - protein, 9 aa, Homo Sapiens
EISEIKEIE

SEQ ID NO: 878904 - protein, 9 aa, Homo Sapiens
RSKVIHLTS

SEQ ID NO: 878905 - protein, 9 aa, Homo Sapiens
YLDITDCLC

SEQ ID NO: 878906 - protein, 9 aa, Homo Sapiens
IEGSDSPDL

SEQ ID NO: 878907 - protein, 9 aa, Homo Sapiens
GKDFNRRIQ

SEQ ID NO: 878908 - protein, 9 aa, Homo Sapiens
SLLCVYVWL

SEQ ID NO: 878909 - protein, 9 aa, Homo Sapiens
YDINKSLVK

SEQ ID NO: 878910 - protein, 9 aa, Homo Sapiens
ITYIQQEYE

SEQ ID NO: 878911 - protein, 9 aa, Homo Sapiens
INKYPTKDM

SEQ ID NO: 878912 - protein, 9 aa, Homo Sapiens
YSTCTDFEQ

SEQ ID NO: 878913 - protein, 9 aa, Homo Sapiens
KLPAGSTKN

SEQ ID NO: 878914 - protein, 9 aa, Homo Sapiens
NVVQQANGN

SEQ ID NO: 878915 - protein, 9 aa, Homo Sapiens
EAVLVIQTD

SEQ ID NO: 878916 - protein, 9 aa, Homo Sapiens
FHGKIEDLQ

SEQ ID NO: 878917 - protein, 9 aa, Homo Sapiens
DLLQAQLIN

SEQ ID NO: 878918 - protein, 9 aa, Homo Sapiens
YKAMVLALQ

SEQ ID NO: 878919 - protein, 9 aa, Homo Sapiens
AGEVSTPSY

SEQ ID NO: 878920 - protein, 9 aa, Homo Sapiens
RLGKKDTSL

SEQ ID NO: 878921 - protein, 9 aa, Homo Sapiens
PTAGGADSN

SEQ ID NO: 878922 - protein, 9 aa, Homo Sapiens
DSMVNNNVR

SEQ ID NO: 878923 - protein, 9 aa, Homo Sapiens
DSKMEDEAE

SEQ ID NO: 878924 - protein, 9 aa, Homo Sapiens
PELTFSNLT

SEQ ID NO: 878925 - protein, 9 aa, Homo Sapiens
WLPDNRIGR

SEQ ID NO: 878926 - protein, 9 aa, Homo Sapiens
DLCPLPGPG

SEQ ID NO: 878927 - protein, 9 aa, Homo Sapiens
PDVFIKLQV

SEQ ID NO: 878928 - protein, 9 aa, Homo Sapiens
REAGGHNEV

SEQ ID NO: 878929 - protein, 9 aa, Homo Sapiens
SYLICARRS

SEQ ID NO: 878930 - protein, 9 aa, Homo Sapiens
WPAPDAAAK

SEQ ID NO: 878931 - protein, 9 aa, Homo Sapiens
RRHAASPAR

SEQ ID NO: 878932 - protein, 9 aa, Homo Sapiens
LYHILSQLQ

SEQ ID NO: 878933 - protein, 9 aa, Homo Sapiens
FNLDPDVIG

SEQ ID NO: 878934 - protein, 9 aa, Homo Sapiens
VVMLVPLPV

SEQ ID NO: 878935 - protein, 9 aa, Homo Sapiens
GDLINQLAL

SEQ ID NO: 878936 - protein, 9 aa, Homo Sapiens
TNLDILTCI

SEQ ID NO: 878937 - protein, 9 aa, Homo Sapiens
TSSIDYLRL

SEQ ID NO: 878938 - protein, 9 aa, Homo Sapiens
AHSSGEERD

SEQ ID NO: 878939 - protein, 9 aa, Homo Sapiens
WEYSMPCLG

SEQ ID NO: 878940 - protein, 9 aa, Homo Sapiens
EDADAMDND

SEQ ID NO: 878941 - protein, 9 aa, Homo Sapiens
QEVKLCLEC

SEQ ID NO: 878942 - protein, 9 aa, Homo Sapiens
AVSDCGHRG

SEQ ID NO: 878943 - protein, 9 aa, Homo Sapiens
ISVVIFKNL

SEQ ID NO: 878944 - protein, 9 aa, Homo Sapiens
HLQTHGRTH

SEQ ID NO: 878945 - protein, 9 aa, Homo Sapiens
CIQKFKRKE

SEQ ID NO: 878946 - protein, 9 aa, Homo Sapiens
FEQMKEYRV

SEQ ID NO: 878947 - protein, 9 aa, Homo Sapiens
YEEFWRGFY

SEQ ID NO: 878948 - protein, 9 aa, Homo Sapiens
DFKDKTKSP

SEQ ID NO: 878949 - protein, 9 aa, Homo Sapiens
KNRHLKNRI

SEQ ID NO: 878950 - protein, 9 aa, Homo Sapiens
NHPVQFGSD

SEQ ID NO: 878951 - protein, 9 aa, Homo Sapiens
CVYVWLERT

SEQ ID NO: 878952 - protein, 9 aa, Homo Sapiens
KNMSNISIW

SEQ ID NO: 878953 - protein, 9 aa, Homo Sapiens
EGSKMQQNI

SEQ ID NO: 878954 - protein, 9 aa, Homo Sapiens
LLLSSTEYQ

SEQ ID NO: 878955 - protein, 9 aa, Homo Sapiens
PKFVCEGCQ

SEQ ID NO: 878956 - protein, 9 aa, Homo Sapiens
SIIKRDSLQ

SEQ ID NO: 878957 - protein, 9 aa, Homo Sapiens
NYSCFCNPE

SEQ ID NO: 878958 - protein, 9 aa, Homo Sapiens
AQSNSALIL

SEQ ID NO: 878959 - protein, 9 aa, Homo Sapiens
LEAVACNTE

SEQ ID NO: 878960 - protein, 9 aa, Homo Sapiens
QLQTSFQDH

SEQ ID NO: 878961 - protein, 9 aa, Homo Sapiens
TQADHLALY

SEQ ID NO: 878962 - protein, 9 aa, Homo Sapiens
HYSLYLGTV

SEQ ID NO: 878963 - protein, 9 aa, Homo Sapiens
EWEQNDTFI

SEQ ID NO: 878964 - protein, 9 aa, Homo Sapiens
KLFHVITSS

SEQ ID NO: 878965 - protein, 9 aa, Homo Sapiens
PPGECLIQF

SEQ ID NO: 878966 - protein, 9 aa, Homo Sapiens
AVYKDANLY

SEQ ID NO: 878967 - protein, 9 aa, Homo Sapiens
RVREQQINI

SEQ ID NO: 878968 - protein, 9 aa, Homo Sapiens
KPVSYSFLF

SEQ ID NO: 878969 - protein, 9 aa, Homo Sapiens
KFQLAEFKA

SEQ ID NO: 878970 - protein, 9 aa, Homo Sapiens
IHLENNDNK

SEQ ID NO: 878971 - protein, 9 aa, Homo Sapiens
VMPPLEDDN

SEQ ID NO: 878972 - protein, 9 aa, Homo Sapiens
QCWKLKGRI

SEQ ID NO: 878973 - protein, 9 aa, Homo Sapiens
NSLDGYYLV

SEQ ID NO: 878974 - protein, 9 aa, Homo Sapiens
EDELDNAYT

SEQ ID NO: 878975 - protein, 9 aa, Homo Sapiens
LKAIKQLKE

SEQ ID NO: 878976 - protein, 9 aa, Homo Sapiens
KGAGTNKDA

SEQ ID NO: 878977 - protein, 9 aa, Homo Sapiens
VLHWLQQHP

SEQ ID NO: 878978 - protein, 9 aa, Homo Sapiens
YIITNAQNI

SEQ ID NO: 878979 - protein, 9 aa, Homo Sapiens
HTDMSSLSY

SEQ ID NO: 878980 - protein, 9 aa, Homo Sapiens
RGFWSTKSE

SEQ ID NO: 878981 - protein, 9 aa, Homo Sapiens
LKTALFPQY

SEQ ID NO: 878982 - protein, 9 aa, Homo Sapiens
SVSPVLPQR

SEQ ID NO: 878983 - protein, 9 aa, Homo Sapiens
YANNKYLAK

SEQ ID NO: 878984 - protein, 9 aa, Homo Sapiens
PQSCKERNL

SEQ ID NO: 878985 - protein, 9 aa, Homo Sapiens
EPDSWGSDA

SEQ ID NO: 878986 - protein, 9 aa, Homo Sapiens
NVSLQMDSN

SEQ ID NO: 878987 - protein, 9 aa, Homo Sapiens
PNWPMVLGW

SEQ ID NO: 878988 - protein, 9 aa, Homo Sapiens
FTKALMHFG

SEQ ID NO: 878989 - protein, 9 aa, Homo Sapiens
GCRPADTQS

SEQ ID NO: 878990 - protein, 9 aa, Homo Sapiens
YLHVLCYVT

SEQ ID NO: 878991 - protein, 9 aa, Homo Sapiens
LQQGGRIMC

SEQ ID NO: 878992 - protein, 9 aa, Homo Sapiens
TQPPVMPQA

SEQ ID NO: 878993 - protein, 9 aa, Homo Sapiens
KSQELLEAD

SEQ ID NO: 878994 - protein, 9 aa, Homo Sapiens
NWPTRVCAD

SEQ ID NO: 878995 - protein, 9 aa, Homo Sapiens
NIEPSVCSC

SEQ ID NO: 878996 - protein, 9 aa, Homo Sapiens
INLWLTLLL

SEQ ID NO: 878997 - protein, 9 aa, Homo Sapiens
TLPNDSDNI

SEQ ID NO: 878998 - protein, 9 aa, Homo Sapiens
KAKNIFRIC

SEQ ID NO: 878999 - protein, 9 aa, Homo Sapiens
PNYRTFLGS

SEQ ID NO: 879000 - protein, 9 aa, Homo Sapiens
QIKHQNLAA

SEQ ID NO: 879001 - protein, 9 aa, Homo Sapiens
AFQSVWVLT

SEQ ID NO: 879002 - protein, 9 aa, Homo Sapiens
SGSKDKMSA

SEQ ID NO: 879003 - protein, 9 aa, Homo Sapiens
DTSNLNIKQ

SEQ ID NO: 879004 - protein, 9 aa, Homo Sapiens
HHCFYRGQV

SEQ ID NO: 879005 - protein, 9 aa, Homo Sapiens
INSPSVLPS

SEQ ID NO: 879006 - protein, 9 aa, Homo Sapiens
LPIQALPFS

SEQ ID NO: 879007 - protein, 9 aa, Homo Sapiens
WRSPIPVSP

SEQ ID NO: 879008 - protein, 9 aa, Homo Sapiens
EYEIQFGSE

SEQ ID NO: 879009 - protein, 9 aa, Homo Sapiens
GKQAPKGQP

SEQ ID NO: 879010 - protein, 9 aa, Homo Sapiens
YFLKSSKEY

SEQ ID NO: 879011 - protein, 9 aa, Homo Sapiens
GELRTAHLV

SEQ ID NO: 879012 - protein, 9 aa, Homo Sapiens
WDCKSAENG

SEQ ID NO: 879013 - protein, 9 aa, Homo Sapiens
TDMLKMATR

SEQ ID NO: 879014 - protein, 9 aa, Homo Sapiens
TSFEHHVNA

SEQ ID NO: 879015 - protein, 9 aa, Homo Sapiens
DCSAPQLAN

SEQ ID NO: 879016 - protein, 9 aa, Homo Sapiens
GKVQTTTFQ

SEQ ID NO: 879017 - protein, 9 aa, Homo Sapiens
RYTLVFNLS

SEQ ID NO: 879018 - protein, 9 aa, Homo Sapiens
ESMQLPLVT

SEQ ID NO: 879019 - protein, 9 aa, Homo Sapiens
WKVLTSQLQ

SEQ ID NO: 879020 - protein, 9 aa, Homo Sapiens
KDAGQITTI

SEQ ID NO: 879021 - protein, 9 aa, Homo Sapiens
QFQNLHQLG

SEQ ID NO: 879022 - protein, 9 aa, Homo Sapiens
STAARLPPS

SEQ ID NO: 879023 - protein, 9 aa, Homo Sapiens
GQRHWSSKI

SEQ ID NO: 879024 - protein, 9 aa, Homo Sapiens
AINELFRTE

SEQ ID NO: 879025 - protein, 9 aa, Homo Sapiens
KLERLTAKF

SEQ ID NO: 879026 - protein, 9 aa, Homo Sapiens
RMCANERTM

SEQ ID NO: 879027 - protein, 9 aa, Homo Sapiens
EMKTLKKYL

SEQ ID NO: 879028 - protein, 9 aa, Homo Sapiens
GSLALMCEL

SEQ ID NO: 879029 - protein, 9 aa, Homo Sapiens
SAERMCDIE

SEQ ID NO: 879030 - protein, 9 aa, Homo Sapiens
HLTQEQWVR

SEQ ID NO: 879031 - protein, 9 aa, Homo Sapiens
LRTQFRTQN

SEQ ID NO: 879032 - protein, 9 aa, Homo Sapiens
TSLSDKTVL

SEQ ID NO: 879033 - protein, 9 aa, Homo Sapiens
GWMEAMQNK

SEQ ID NO: 879034 - protein, 9 aa, Homo Sapiens
QVTILYINC

SEQ ID NO: 879035 - protein, 9 aa, Homo Sapiens
PEALARDKK

SEQ ID NO: 879036 - protein, 9 aa, Homo Sapiens
SKQVDNRFG

SEQ ID NO: 879037 - protein, 9 aa, Homo Sapiens
KQKIMKYSA

SEQ ID NO: 879038 - protein, 9 aa, Homo Sapiens
SKHQKEICF

SEQ ID NO: 879039 - protein, 9 aa, Homo Sapiens
CPCSLCVSN

SEQ ID NO: 879040 - protein, 9 aa, Homo Sapiens
LRPSNQGEY

SEQ ID NO: 879041 - protein, 9 aa, Homo Sapiens
SCRKYLFIC

SEQ ID NO: 879042 - protein, 9 aa, Homo Sapiens
ATLTAPYRT

SEQ ID NO: 879043 - protein, 9 aa, Homo Sapiens
QVMCRNACR

SEQ ID NO: 879044 - protein, 9 aa, Homo Sapiens
KGKDARALI

SEQ ID NO: 879045 - protein, 9 aa, Homo Sapiens
SGDPFCSIE

SEQ ID NO: 879046 - protein, 9 aa, Homo Sapiens
INKLPIEEL

SEQ ID NO: 879047 - protein, 9 aa, Homo Sapiens
LLPHRRGLG

SEQ ID NO: 879048 - protein, 9 aa, Homo Sapiens
NERNSGLIG

SEQ ID NO: 879049 - protein, 9 aa, Homo Sapiens
HRLHGGDKS

SEQ ID NO: 879050 - protein, 9 aa, Homo Sapiens
FHLCLTISS

SEQ ID NO: 879051 - protein, 9 aa, Homo Sapiens
YSELRSQSW

SEQ ID NO: 879052 - protein, 9 aa, Homo Sapiens
AWEYSMPCL

SEQ ID NO: 879053 - protein, 9 aa, Homo Sapiens
FLCKRRDTL

SEQ ID NO: 879054 - protein, 9 aa, Homo Sapiens
IPAALLDRI

SEQ ID NO: 879055 - protein, 9 aa, Homo Sapiens
RLGVVKFPP

SEQ ID NO: 879056 - protein, 9 aa, Homo Sapiens
NRMHIRRKQ

SEQ ID NO: 879057 - protein, 9 aa, Homo Sapiens
KNHIFKHGT

SEQ ID NO: 879058 - protein, 9 aa, Homo Sapiens
VPEWNLISS

SEQ ID NO: 879059 - protein, 9 aa, Homo Sapiens
YDNCLTYHR

SEQ ID NO: 879060 - protein, 9 aa, Homo Sapiens
VDDGIDLNQ

SEQ ID NO: 879061 - protein, 9 aa, Homo Sapiens
AGQINKLCV

SEQ ID NO: 879062 - protein, 9 aa, Homo Sapiens
GKSKYKFWN

SEQ ID NO: 879063 - protein, 9 aa, Homo Sapiens
ETRVNLCDD

SEQ ID NO: 879064 - protein, 9 aa, Homo Sapiens
IWRLHQYVK

SEQ ID NO: 879065 - protein, 9 aa, Homo Sapiens
IEGAQSVLR

SEQ ID NO: 879066 - protein, 9 aa, Homo Sapiens
CRTALESPR

SEQ ID NO: 879067 - protein, 9 aa, Homo Sapiens
VILTTRQYK

SEQ ID NO: 879068 - protein, 9 aa, Homo Sapiens
PKRVLLYVQ

SEQ ID NO: 879069 - protein, 9 aa, Homo Sapiens
TAAHCFRDD

SEQ ID NO: 879070 - protein, 9 aa, Homo Sapiens
QIAHGADAV

SEQ ID NO: 879071 - protein, 9 aa, Homo Sapiens
CPVLPHVQK

SEQ ID NO: 879072 - protein, 9 aa, Homo Sapiens
KTINYAGLG

SEQ ID NO: 879073 - protein, 9 aa, Homo Sapiens
PTYPYVQHK

SEQ ID NO: 879074 - protein, 9 aa, Homo Sapiens
LSACQSLDL

SEQ ID NO: 879075 - protein, 9 aa, Homo Sapiens
TSNKSGDQL

SEQ ID NO: 879076 - protein, 9 aa, Homo Sapiens
DNWDGPGEL

SEQ ID NO: 879077 - protein, 9 aa, Homo Sapiens
RPQSPGSNS

SEQ ID NO: 879078 - protein, 9 aa, Homo Sapiens
KHHLEEHVD

SEQ ID NO: 879079 - protein, 9 aa, Homo Sapiens
QYLDKVMSA

SEQ ID NO: 879080 - protein, 9 aa, Homo Sapiens
ESLQKEAAA

SEQ ID NO: 879081 - protein, 9 aa, Homo Sapiens
NMTLLPENG

SEQ ID NO: 879082 - protein, 9 aa, Homo Sapiens
SLPLICLHA

SEQ ID NO: 879083 - protein, 9 aa, Homo Sapiens
YLPFSILGC

SEQ ID NO: 879084 - protein, 9 aa, Homo Sapiens
NADMKNQGE

SEQ ID NO: 879085 - protein, 9 aa, Homo Sapiens
RTKELTLEL

SEQ ID NO: 879086 - protein, 9 aa, Homo Sapiens
DLDRDTRLI

SEQ ID NO: 879087 - protein, 9 aa, Homo Sapiens
LYHNLCIMI

SEQ ID NO: 879088 - protein, 9 aa, Homo Sapiens
CVCREEFEG

SEQ ID NO: 879089 - protein, 9 aa, Homo Sapiens
FQRLMREIT

SEQ ID NO: 879090 - protein, 9 aa, Homo Sapiens
TLLDIENAV

SEQ ID NO: 879091 - protein, 9 aa, Homo Sapiens
WLNAADTWV

SEQ ID NO: 879092 - protein, 9 aa, Homo Sapiens
SDWSSRPKN

SEQ ID NO: 879093 - protein, 9 aa, Homo Sapiens
RAFKHVFES

SEQ ID NO: 879094 - protein, 9 aa, Homo Sapiens
YRAPNHDKV

SEQ ID NO: 879095 - protein, 9 aa, Homo Sapiens
KSVRPDNFE

SEQ ID NO: 879096 - protein, 9 aa, Homo Sapiens
PAFKPWLDI

SEQ ID NO: 879097 - protein, 9 aa, Homo Sapiens
AIFLHGRNS

SEQ ID NO: 879098 - protein, 9 aa, Homo Sapiens
HVQLHIMEN

SEQ ID NO: 879099 - protein, 9 aa, Homo Sapiens
NPDKLTLEL

SEQ ID NO: 879100 - protein, 9 aa, Homo Sapiens
DIAQQFKMQ

SEQ ID NO: 879101 - protein, 9 aa, Homo Sapiens
FLQGDKQFL

SEQ ID NO: 879102 - protein, 9 aa, Homo Sapiens
LNEKSKAQM

SEQ ID NO: 879103 - protein, 9 aa, Homo Sapiens
DSGFIIFGD

SEQ ID NO: 879104 - protein, 9 aa, Homo Sapiens
QYDCFFEKK

SEQ ID NO: 879105 - protein, 9 aa, Homo Sapiens
ITLASRSQP

SEQ ID NO: 879106 - protein, 9 aa, Homo Sapiens
FSRDYIVLD

SEQ ID NO: 879107 - protein, 9 aa, Homo Sapiens
LEISKPGKF

SEQ ID NO: 879108 - protein, 9 aa, Homo Sapiens
LWDTFSCDC

SEQ ID NO: 879109 - protein, 9 aa, Homo Sapiens
KHSVMSIQD

SEQ ID NO: 879110 - protein, 9 aa, Homo Sapiens
DNLLYYSLD

SEQ ID NO: 879111 - protein, 9 aa, Homo Sapiens
FLNIVMFIV

SEQ ID NO: 879112 - protein, 9 aa, Homo Sapiens
LCSRTLNKH

SEQ ID NO: 879113 - protein, 9 aa, Homo Sapiens
CLMKIEKFF

SEQ ID NO: 879114 - protein, 9 aa, Homo Sapiens
LEDWRNKWA

SEQ ID NO: 879115 - protein, 9 aa, Homo Sapiens
EHTNASFNT

SEQ ID NO: 879116 - protein, 9 aa, Homo Sapiens
LTTLPTAMQ

SEQ ID NO: 879117 - protein, 9 aa, Homo Sapiens
ANLALLTDG

SEQ ID NO: 879118 - protein, 9 aa, Homo Sapiens
LSAFSAVFF

SEQ ID NO: 879119 - protein, 9 aa, Homo Sapiens
KQEDKQIGK

SEQ ID NO: 879120 - protein, 9 aa, Homo Sapiens
TVCWHFGDH

SEQ ID NO: 879121 - protein, 9 aa, Homo Sapiens
YLNYHDAVT

SEQ ID NO: 879122 - protein, 9 aa, Homo Sapiens
KSNGPGLQY

SEQ ID NO: 879123 - protein, 9 aa, Homo Sapiens
GFSMKPSCI

SEQ ID NO: 879124 - protein, 9 aa, Homo Sapiens
DESSEIQEV

SEQ ID NO: 879125 - protein, 9 aa, Homo Sapiens
EDIDIMLGV

SEQ ID NO: 879126 - protein, 9 aa, Homo Sapiens
IAGGTSQNG

SEQ ID NO: 879127 - protein, 9 aa, Homo Sapiens
PAFKPGRQS

SEQ ID NO: 879128 - protein, 9 aa, Homo Sapiens
ESELSVPYK

SEQ ID NO: 879129 - protein, 9 aa, Homo Sapiens
QLSQYFLKS

SEQ ID NO: 879130 - protein, 9 aa, Homo Sapiens
PIEASLYGL

SEQ ID NO: 879131 - protein, 9 aa, Homo Sapiens
YFKKEDVKV

SEQ ID NO: 879132 - protein, 9 aa, Homo Sapiens
CDGMPLDYV

SEQ ID NO: 879133 - protein, 9 aa, Homo Sapiens
LEEAPIVKP

SEQ ID NO: 879134 - protein, 9 aa, Homo Sapiens
IRNVDTTVD

SEQ ID NO: 879135 - protein, 9 aa, Homo Sapiens
CRQAGSSGP

SEQ ID NO: 879136 - protein, 9 aa, Homo Sapiens
QSDSFPYGR

SEQ ID NO: 879137 - protein, 9 aa, Homo Sapiens
AFENTYKGS

SEQ ID NO: 879138 - protein, 9 aa, Homo Sapiens
IFQILLLGT

SEQ ID NO: 879139 - protein, 9 aa, Homo Sapiens
NHLYKGEFK

SEQ ID NO: 879140 - protein, 9 aa, Homo Sapiens
LEWSNIKSI

SEQ ID NO: 879141 - protein, 9 aa, Homo Sapiens
FQIDAKEQG

SEQ ID NO: 879142 - protein, 9 aa, Homo Sapiens
QLYKQKFIC

SEQ ID NO: 879143 - protein, 9 aa, Homo Sapiens
LTSQNEVLQ

SEQ ID NO: 879144 - protein, 9 aa, Homo Sapiens
TTIATVINL

SEQ ID NO: 879145 - protein, 9 aa, Homo Sapiens
FKTLKGHSN

SEQ ID NO: 879146 - protein, 9 aa, Homo Sapiens
TTASHFYRI

SEQ ID NO: 879147 - protein, 9 aa, Homo Sapiens
PHPHLGPVE

SEQ ID NO: 879148 - protein, 9 aa, Homo Sapiens
RMCTLENVK

SEQ ID NO: 879149 - protein, 9 aa, Homo Sapiens
SAVSDCGHR

SEQ ID NO: 879150 - protein, 9 aa, Homo Sapiens
QPNNPRELH

SEQ ID NO: 879151 - protein, 9 aa, Homo Sapiens
VMIGHISKK

SEQ ID NO: 879152 - protein, 9 aa, Homo Sapiens
FNGKLSFRE

SEQ ID NO: 879153 - protein, 9 aa, Homo Sapiens
AVCLSMRLA

SEQ ID NO: 879154 - protein, 9 aa, Homo Sapiens
LRWPCCLVL

SEQ ID NO: 879155 - protein, 9 aa, Homo Sapiens
DSQWDSALH

SEQ ID NO: 879156 - protein, 9 aa, Homo Sapiens
VSLDLGLLN

SEQ ID NO: 879157 - protein, 9 aa, Homo Sapiens
GSLLFLVCH

SEQ ID NO: 879158 - protein, 9 aa, Homo Sapiens
PCGVGTCKE

SEQ ID NO: 879159 - protein, 9 aa, Homo Sapiens
ETSPLREEA

SEQ ID NO: 879160 - protein, 9 aa, Homo Sapiens
CGQDLNTTS

SEQ ID NO: 879161 - protein, 9 aa, Homo Sapiens
AELAAQILL

SEQ ID NO: 879162 - protein, 9 aa, Homo Sapiens
PNHPDVLVL

SEQ ID NO: 879163 - protein, 9 aa, Homo Sapiens
MKIRSMYDL

SEQ ID NO: 879164 - protein, 9 aa, Homo Sapiens
DIGNRMLQN

SEQ ID NO: 879165 - protein, 9 aa, Homo Sapiens
VFCQMQKLP

SEQ ID NO: 879166 - protein, 9 aa, Homo Sapiens
MNGHGGGQS

SEQ ID NO: 879167 - protein, 9 aa, Homo Sapiens
ATKLLQNIR

SEQ ID NO: 879168 - protein, 9 aa, Homo Sapiens
LWLGTTKPG

SEQ ID NO: 879169 - protein, 9 aa, Homo Sapiens
MNLLLDARS

SEQ ID NO: 879170 - protein, 9 aa, Homo Sapiens
LHQIQHKGK

SEQ ID NO: 879171 - protein, 9 aa, Homo Sapiens
PEIAWVSTL

SEQ ID NO: 879172 - protein, 9 aa, Homo Sapiens
SDKDKSDYN

SEQ ID NO: 879173 - protein, 9 aa, Homo Sapiens
DKNVINNFF

SEQ ID NO: 879174 - protein, 9 aa, Homo Sapiens
NNMFGQIQL

SEQ ID NO: 879175 - protein, 9 aa, Homo Sapiens
GNVGFKEFE

SEQ ID NO: 879176 - protein, 9 aa, Homo Sapiens
DDKLQNRPR

SEQ ID NO: 879177 - protein, 9 aa, Homo Sapiens
ENCVEFHKL

SEQ ID NO: 879178 - protein, 9 aa, Homo Sapiens
DHRGKVLSS

SEQ ID NO: 879179 - protein, 9 aa, Homo Sapiens
VLFEIHNYN

SEQ ID NO: 879180 - protein, 9 aa, Homo Sapiens
AVVQPTTVN

SEQ ID NO: 879181 - protein, 9 aa, Homo Sapiens
QERPDWEET

SEQ ID NO: 879182 - protein, 9 aa, Homo Sapiens
KTCNRKKDE

SEQ ID NO: 879183 - protein, 9 aa, Homo Sapiens
TDGIIIKGV

SEQ ID NO: 879184 - protein, 9 aa, Homo Sapiens
MPGLASFLM

SEQ ID NO: 879185 - protein, 9 aa, Homo Sapiens
LPYYTVVKV

SEQ ID NO: 879186 - protein, 9 aa, Homo Sapiens
LTLVALSWV

SEQ ID NO: 879187 - protein, 9 aa, Homo Sapiens
VIELDKYLY

SEQ ID NO: 879188 - protein, 9 aa, Homo Sapiens
QTGNTREAL

SEQ ID NO: 879189 - protein, 9 aa, Homo Sapiens
LAKRTFRLL

SEQ ID NO: 879190 - protein, 9 aa, Homo Sapiens
GIWDNHIDE

SEQ ID NO: 879191 - protein, 9 aa, Homo Sapiens
FGKMEGNPI

SEQ ID NO: 879192 - protein, 9 aa, Homo Sapiens
LPTTKLNSI

SEQ ID NO: 879193 - protein, 9 aa, Homo Sapiens
LWQEAVSRK

SEQ ID NO: 879194 - protein, 9 aa, Homo Sapiens
KYRLPINIA

SEQ ID NO: 879195 - protein, 9 aa, Homo Sapiens
INHCLVEST

SEQ ID NO: 879196 - protein, 9 aa, Homo Sapiens
IIHVAITST

SEQ ID NO: 879197 - protein, 9 aa, Homo Sapiens
CSVLHTLAT

SEQ ID NO: 879198 - protein, 9 aa, Homo Sapiens
KAIEDRNIK

SEQ ID NO: 879199 - protein, 9 aa, Homo Sapiens
EKMWRLEEM

SEQ ID NO: 879200 - protein, 9 aa, Homo Sapiens
DSLLHHSDR

SEQ ID NO: 879201 - protein, 9 aa, Homo Sapiens
LSVPYKQLM

SEQ ID NO: 879202 - protein, 9 aa, Homo Sapiens
TCRSASCRN

SEQ ID NO: 879203 - protein, 9 aa, Homo Sapiens
LESSASTGR

SEQ ID NO: 879204 - protein, 9 aa, Homo Sapiens
RAVEVWWSF

SEQ ID NO: 879205 - protein, 9 aa, Homo Sapiens
LINKNVSES

SEQ ID NO: 879206 - protein, 9 aa, Homo Sapiens
ASEEPECLP

SEQ ID NO: 879207 - protein, 9 aa, Homo Sapiens
TNAIQWMSP

SEQ ID NO: 879208 - protein, 9 aa, Homo Sapiens
YGRITLFRE

SEQ ID NO: 879209 - protein, 9 aa, Homo Sapiens
DTTGVSADP

SEQ ID NO: 879210 - protein, 9 aa, Homo Sapiens
IQNEWGTNQ

SEQ ID NO: 879211 - protein, 9 aa, Homo Sapiens
QFFGVPYAA

SEQ ID NO: 879212 - protein, 9 aa, Homo Sapiens
RSQTATECD

SEQ ID NO: 879213 - protein, 9 aa, Homo Sapiens
DMGQSGSYL

SEQ ID NO: 879214 - protein, 9 aa, Homo Sapiens
GSYFGVIPP

SEQ ID NO: 879215 - protein, 9 aa, Homo Sapiens
DHKVHFTCN

SEQ ID NO: 879216 - protein, 9 aa, Homo Sapiens
YSENSIEMY

SEQ ID NO: 879217 - protein, 9 aa, Homo Sapiens
HRVANVFTQ

SEQ ID NO: 879218 - protein, 9 aa, Homo Sapiens
TLKTQVDTQ

SEQ ID NO: 879219 - protein, 9 aa, Homo Sapiens
DQYRTEQYQ

SEQ ID NO: 879220 - protein, 9 aa, Homo Sapiens
LLDVVHKSF

SEQ ID NO: 879221 - protein, 9 aa, Homo Sapiens
SNAKCKKSW

SEQ ID NO: 879222 - protein, 9 aa, Homo Sapiens
KIRNRTEAR

SEQ ID NO: 879223 - protein, 9 aa, Homo Sapiens
LNQHFCKNH

SEQ ID NO: 879224 - protein, 9 aa, Homo Sapiens
YLATLDTLT

SEQ ID NO: 879225 - protein, 9 aa, Homo Sapiens
EENSDTEFG

SEQ ID NO: 879226 - protein, 9 aa, Homo Sapiens
REEKILNRK

SEQ ID NO: 879227 - protein, 9 aa, Homo Sapiens
VSAAERIII

SEQ ID NO: 879228 - protein, 9 aa, Homo Sapiens
KKRRHQRQS

SEQ ID NO: 879229 - protein, 9 aa, Homo Sapiens
PDVNIEAPE

SEQ ID NO: 879230 - protein, 9 aa, Homo Sapiens
YNKCKIKNI

SEQ ID NO: 879231 - protein, 9 aa, Homo Sapiens
VERSVCPTD

SEQ ID NO: 879232 - protein, 9 aa, Homo Sapiens
RMLQSENKR

SEQ ID NO: 879233 - protein, 9 aa, Homo Sapiens
FVVAFNTSH

SEQ ID NO: 879234 - protein, 9 aa, Homo Sapiens
RIMAHKWMP

SEQ ID NO: 879235 - protein, 9 aa, Homo Sapiens
FIYTLCNKE

SEQ ID NO: 879236 - protein, 9 aa, Homo Sapiens
IFHKLWCRQ

SEQ ID NO: 879237 - protein, 9 aa, Homo Sapiens
LDDLDATDK

SEQ ID NO: 879238 - protein, 9 aa, Homo Sapiens
RRFSLEISK

SEQ ID NO: 879239 - protein, 9 aa, Homo Sapiens
VIVPHKPNT

SEQ ID NO: 879240 - protein, 9 aa, Homo Sapiens
LITHKQTHI

SEQ ID NO: 879241 - protein, 9 aa, Homo Sapiens
LRSRSGTDL

SEQ ID NO: 879242 - protein, 9 aa, Homo Sapiens
GEITRLTLS

SEQ ID NO: 879243 - protein, 9 aa, Homo Sapiens
FREDLELYY

SEQ ID NO: 879244 - protein, 9 aa, Homo Sapiens
MQKQGLFQW

SEQ ID NO: 879245 - protein, 9 aa, Homo Sapiens
HFSYPSQKE

SEQ ID NO: 879246 - protein, 9 aa, Homo Sapiens
TATLANTQL

SEQ ID NO: 879247 - protein, 9 aa, Homo Sapiens
YIKNKLFFK

SEQ ID NO: 879248 - protein, 9 aa, Homo Sapiens
QNSNTTSNI

SEQ ID NO: 879249 - protein, 9 aa, Homo Sapiens
QRCRASFRG

SEQ ID NO: 879250 - protein, 9 aa, Homo Sapiens
LLEKIQKEL

SEQ ID NO: 879251 - protein, 9 aa, Homo Sapiens
VISSPHLRL

SEQ ID NO: 879252 - protein, 9 aa, Homo Sapiens
VAGLSYFYG

SEQ ID NO: 879253 - protein, 9 aa, Homo Sapiens
QDGQAVVWE

SEQ ID NO: 879254 - protein, 9 aa, Homo Sapiens
TQESFAEHQ

SEQ ID NO: 879255 - protein, 9 aa, Homo Sapiens
LIRKEKLGT

SEQ ID NO: 879256 - protein, 9 aa, Homo Sapiens
ALMHPRFCH

SEQ ID NO: 879257 - protein, 9 aa, Homo Sapiens
EKLIHFKSV

SEQ ID NO: 879258 - protein, 9 aa, Homo Sapiens
RGHYEQILN

SEQ ID NO: 879259 - protein, 9 aa, Homo Sapiens
KTLYLQQQI

SEQ ID NO: 879260 - protein, 9 aa, Homo Sapiens
KCDFKFKAK

SEQ ID NO: 879261 - protein, 9 aa, Homo Sapiens
TTTAGRDHL

SEQ ID NO: 879262 - protein, 9 aa, Homo Sapiens
QNSRTSLFS

SEQ ID NO: 879263 - protein, 9 aa, Homo Sapiens
DRAGSLELC

SEQ ID NO: 879264 - protein, 9 aa, Homo Sapiens
AEITFNTSV

SEQ ID NO: 879265 - protein, 9 aa, Homo Sapiens
ITCCLLRIT

SEQ ID NO: 879266 - protein, 9 aa, Homo Sapiens
IWLLQTDFV

SEQ ID NO: 879267 - protein, 9 aa, Homo Sapiens
IAALLFEAS

SEQ ID NO: 879268 - protein, 9 aa, Homo Sapiens
LTVHWRIHS

SEQ ID NO: 879269 - protein, 9 aa, Homo Sapiens
SSELYEAVN

SEQ ID NO: 879270 - protein, 9 aa, Homo Sapiens
GNNTWITDI

SEQ ID NO: 879271 - protein, 9 aa, Homo Sapiens
HIPQIDVHR

SEQ ID NO: 879272 - protein, 9 aa, Homo Sapiens
LGFGAGSDI

SEQ ID NO: 879273 - protein, 9 aa, Homo Sapiens
QGTWQKRFS

SEQ ID NO: 879274 - protein, 9 aa, Homo Sapiens
LKHKRDLNS

SEQ ID NO: 879275 - protein, 9 aa, Homo Sapiens
IMTKAKYLC

SEQ ID NO: 879276 - protein, 9 aa, Homo Sapiens
ISVLLLSPD

SEQ ID NO: 879277 - protein, 9 aa, Homo Sapiens
EHQIICPGE

SEQ ID NO: 879278 - protein, 9 aa, Homo Sapiens
TDGAHNTFL

SEQ ID NO: 879279 - protein, 9 aa, Homo Sapiens
LQRGDRLLL

SEQ ID NO: 879280 - protein, 9 aa, Homo Sapiens
QDTIQNQVR

SEQ ID NO: 879281 - protein, 9 aa, Homo Sapiens
KIRECLKKV

SEQ ID NO: 879282 - protein, 9 aa, Homo Sapiens
IYLLSALNE

SEQ ID NO: 879283 - protein, 9 aa, Homo Sapiens
NIAQGSDHE

SEQ ID NO: 879284 - protein, 9 aa, Homo Sapiens
DFTQTAVFQ

SEQ ID NO: 879285 - protein, 9 aa, Homo Sapiens
IYTSQEEII

SEQ ID NO: 879286 - protein, 9 aa, Homo Sapiens
METEEAWLR

SEQ ID NO: 879287 - protein, 9 aa, Homo Sapiens
DTYCLNPQE

SEQ ID NO: 879288 - protein, 9 aa, Homo Sapiens
VQVENVKGA

SEQ ID NO: 879289 - protein, 9 aa, Homo Sapiens
LKETLTTQE

SEQ ID NO: 879290 - protein, 9 aa, Homo Sapiens
SMEEVLTKF

SEQ ID NO: 879291 - protein, 9 aa, Homo Sapiens
GWTKSMAPR

SEQ ID NO: 879292 - protein, 9 aa, Homo Sapiens
HWEQDISLQ

SEQ ID NO: 879293 - protein, 9 aa, Homo Sapiens
ESQIISHYE

SEQ ID NO: 879294 - protein, 9 aa, Homo Sapiens
YCQVWKILA

SEQ ID NO: 879295 - protein, 9 aa, Homo Sapiens
GKGYIIQKG

SEQ ID NO: 879296 - protein, 9 aa, Homo Sapiens
SDNEYGQGS

SEQ ID NO: 879297 - protein, 9 aa, Homo Sapiens
ILSSVDDIQ

SEQ ID NO: 879298 - protein, 9 aa, Homo Sapiens
NVDTTVDED

SEQ ID NO: 879299 - protein, 9 aa, Homo Sapiens
SNVIHQLFC

SEQ ID NO: 879300 - protein, 9 aa, Homo Sapiens
ELSCGSPLT

SEQ ID NO: 879301 - protein, 9 aa, Homo Sapiens
MRTILFDIP

SEQ ID NO: 879302 - protein, 9 aa, Homo Sapiens
IQNISYTPY

SEQ ID NO: 879303 - protein, 9 aa, Homo Sapiens
QNLKAEIEK

SEQ ID NO: 879304 - protein, 9 aa, Homo Sapiens
VLFCRSGWT

SEQ ID NO: 879305 - protein, 9 aa, Homo Sapiens
YLSCQACAG

SEQ ID NO: 879306 - protein, 9 aa, Homo Sapiens
EWGNGIRGL

SEQ ID NO: 879307 - protein, 9 aa, Homo Sapiens
IPMSIRSAS

SEQ ID NO: 879308 - protein, 9 aa, Homo Sapiens
EAASKGDFI

SEQ ID NO: 879309 - protein, 9 aa, Homo Sapiens
GADSTGSPI

SEQ ID NO: 879310 - protein, 9 aa, Homo Sapiens
QFLKSTDVG

SEQ ID NO: 879311 - protein, 9 aa, Homo Sapiens
KDLPRPLPE

SEQ ID NO: 879312 - protein, 9 aa, Homo Sapiens
NQTLKDKAD

SEQ ID NO: 879313 - protein, 9 aa, Homo Sapiens
SLSALNHAV

SEQ ID NO: 879314 - protein, 9 aa, Homo Sapiens
EEGHELDLT

SEQ ID NO: 879315 - protein, 9 aa, Homo Sapiens
WIINNFSFC

SEQ ID NO: 879316 - protein, 9 aa, Homo Sapiens
TGDGHNLFT

SEQ ID NO: 879317 - protein, 9 aa, Homo Sapiens
REQFCQEMI

SEQ ID NO: 879318 - protein, 9 aa, Homo Sapiens
GIFWLNAAD

SEQ ID NO: 879319 - protein, 9 aa, Homo Sapiens
KAYANYSYA

SEQ ID NO: 879320 - protein, 9 aa, Homo Sapiens
QRTSTSNKS

SEQ ID NO: 879321 - protein, 9 aa, Homo Sapiens
LNSINSSSV

SEQ ID NO: 879322 - protein, 9 aa, Homo Sapiens
EFIQAAAAV

SEQ ID NO: 879323 - protein, 9 aa, Homo Sapiens
FLVALFISL

SEQ ID NO: 879324 - protein, 9 aa, Homo Sapiens
GSLVINLGS

SEQ ID NO: 879325 - protein, 9 aa, Homo Sapiens
ALGEGCKAM

SEQ ID NO: 879326 - protein, 9 aa, Homo Sapiens
GMHLPPPRP

SEQ ID NO: 879327 - protein, 9 aa, Homo Sapiens
PYRNHICNL

SEQ ID NO: 879328 - protein, 9 aa, Homo Sapiens
YNERVGNLN

SEQ ID NO: 879329 - protein, 9 aa, Homo Sapiens
PEEVKMPEE

SEQ ID NO: 879330 - protein, 9 aa, Homo Sapiens
TSCICQSSR

SEQ ID NO: 879331 - protein, 9 aa, Homo Sapiens
AQILLDQGQ

SEQ ID NO: 879332 - protein, 9 aa, Homo Sapiens
FELRDTGHY

SEQ ID NO: 879333 - protein, 9 aa, Homo Sapiens
RETQESEHK

SEQ ID NO: 879334 - protein, 9 aa, Homo Sapiens
PKRPQSPGS

SEQ ID NO: 879335 - protein, 9 aa, Homo Sapiens
KRSPLRQNQ

SEQ ID NO: 879336 - protein, 9 aa, Homo Sapiens
TSSQENDNS

SEQ ID NO: 879337 - protein, 9 aa, Homo Sapiens
EDHHWPADI

SEQ ID NO: 879338 - protein, 9 aa, Homo Sapiens
CITNIEFLP

SEQ ID NO: 879339 - protein, 9 aa, Homo Sapiens
LNYQVVRFC

SEQ ID NO: 879340 - protein, 9 aa, Homo Sapiens
TLELLYIIT

SEQ ID NO: 879341 - protein, 9 aa, Homo Sapiens
LVPEPDHLE

SEQ ID NO: 879342 - protein, 9 aa, Homo Sapiens
KKPHDHKAT

SEQ ID NO: 879343 - protein, 9 aa, Homo Sapiens
NTFFCETRA

SEQ ID NO: 879344 - protein, 9 aa, Homo Sapiens
LQLKETLTT

SEQ ID NO: 879345 - protein, 9 aa, Homo Sapiens
VYEIIELCR

SEQ ID NO: 879346 - protein, 9 aa, Homo Sapiens
GRAVEVWWS

SEQ ID NO: 879347 - protein, 9 aa, Homo Sapiens
PPAGSPKLS

SEQ ID NO: 879348 - protein, 9 aa, Homo Sapiens
VGRNPFRCT

SEQ ID NO: 879349 - protein, 9 aa, Homo Sapiens
NVKSASRQN

SEQ ID NO: 879350 - protein, 9 aa, Homo Sapiens
LAGSDDSKM

SEQ ID NO: 879351 - protein, 9 aa, Homo Sapiens
PSLLKNHIV

SEQ ID NO: 879352 - protein, 9 aa, Homo Sapiens
SCIWRFAYL

SEQ ID NO: 879353 - protein, 9 aa, Homo Sapiens
QIQNILTEE

SEQ ID NO: 879354 - protein, 9 aa, Homo Sapiens
RDTGHYGFL

SEQ ID NO: 879355 - protein, 9 aa, Homo Sapiens
VENSVLLIA

SEQ ID NO: 879356 - protein, 9 aa, Homo Sapiens
VVMFGCNME

SEQ ID NO: 879357 - protein, 9 aa, Homo Sapiens
KLPRVPSFA

SEQ ID NO: 879358 - protein, 9 aa, Homo Sapiens
KKCIFQIHT

SEQ ID NO: 879359 - protein, 9 aa, Homo Sapiens
RPLTQLSCQ

SEQ ID NO: 879360 - protein, 9 aa, Homo Sapiens
QGSTHSGDL

SEQ ID NO: 879361 - protein, 9 aa, Homo Sapiens
GTLLFCTVG

SEQ ID NO: 879362 - protein, 9 aa, Homo Sapiens
ERYYQLWVN

SEQ ID NO: 879363 - protein, 9 aa, Homo Sapiens
GFLFSGANS

SEQ ID NO: 879364 - protein, 9 aa, Homo Sapiens
NSESRTEKH

SEQ ID NO: 879365 - protein, 9 aa, Homo Sapiens
RLPPFKTFS

SEQ ID NO: 879366 - protein, 9 aa, Homo Sapiens
CLLNRQVQM

SEQ ID NO: 879367 - protein, 9 aa, Homo Sapiens
GLKEGTQYT

SEQ ID NO: 879368 - protein, 9 aa, Homo Sapiens
LTTVSVGIV

SEQ ID NO: 879369 - protein, 9 aa, Homo Sapiens
NLGEQQKDA

SEQ ID NO: 879370 - protein, 9 aa, Homo Sapiens
VCDPGFSGK

SEQ ID NO: 879371 - protein, 9 aa, Homo Sapiens
LIQLSVGLE

SEQ ID NO: 879372 - protein, 9 aa, Homo Sapiens
TSVLDTSNE

SEQ ID NO: 879373 - protein, 9 aa, Homo Sapiens
FSLIVTTVC

SEQ ID NO: 879374 - protein, 9 aa, Homo Sapiens
NLNGAPLCG

SEQ ID NO: 879375 - protein, 9 aa, Homo Sapiens
VQKFIKIDQ

SEQ ID NO: 879376 - protein, 9 aa, Homo Sapiens
PAIDTPPQS

SEQ ID NO: 879377 - protein, 9 aa, Homo Sapiens
PSWHRSSLS

SEQ ID NO: 879378 - protein, 9 aa, Homo Sapiens
LIQKYNTGK

SEQ ID NO: 879379 - protein, 9 aa, Homo Sapiens
FKTHNKHLA

SEQ ID NO: 879380 - protein, 9 aa, Homo Sapiens
NDLLQAQLI

SEQ ID NO: 879381 - protein, 9 aa, Homo Sapiens
TLLVPDTGE

SEQ ID NO: 879382 - protein, 9 aa, Homo Sapiens
QGDLAGCAE

SEQ ID NO: 879383 - protein, 9 aa, Homo Sapiens
WICEGLEKM

SEQ ID NO: 879384 - protein, 9 aa, Homo Sapiens
SLIGIQERT

SEQ ID NO: 879385 - protein, 9 aa, Homo Sapiens
SGKCFKTLK

SEQ ID NO: 879386 - protein, 9 aa, Homo Sapiens
FFGPCMFIY

SEQ ID NO: 879387 - protein, 9 aa, Homo Sapiens
TKHQCIHTD

SEQ ID NO: 879388 - protein, 9 aa, Homo Sapiens
GITFFRPGA

SEQ ID NO: 879389 - protein, 9 aa, Homo Sapiens
KCFRHHTSL

SEQ ID NO: 879390 - protein, 9 aa, Homo Sapiens
EVCYFFHRS

SEQ ID NO: 879391 - protein, 9 aa, Homo Sapiens
IGRDACTKK

SEQ ID NO: 879392 - protein, 9 aa, Homo Sapiens
LPMLWALLD

SEQ ID NO: 879393 - protein, 9 aa, Homo Sapiens
NEYGQGSQE

SEQ ID NO: 879394 - protein, 9 aa, Homo Sapiens
LIRHHQIHT

SEQ ID NO: 879395 - protein, 9 aa, Homo Sapiens
RRIPKKGLI

SEQ ID NO: 879396 - protein, 9 aa, Homo Sapiens
ENLIQKHTG

SEQ ID NO: 879397 - protein, 9 aa, Homo Sapiens
SICRANCLC

SEQ ID NO: 879398 - protein, 9 aa, Homo Sapiens
CSITTPKMI

SEQ ID NO: 879399 - protein, 9 aa, Homo Sapiens
TVKKIHPCK

SEQ ID NO: 879400 - protein, 9 aa, Homo Sapiens
CTHKRIHTG

SEQ ID NO: 879401 - protein, 9 aa, Homo Sapiens
RQFLDDHQN

SEQ ID NO: 879402 - protein, 9 aa, Homo Sapiens
IYNRTRLDC

SEQ ID NO: 879403 - protein, 9 aa, Homo Sapiens
STAQATVTN

SEQ ID NO: 879404 - protein, 9 aa, Homo Sapiens
SVTMDKWKA

SEQ ID NO: 879405 - protein, 9 aa, Homo Sapiens
LPVLPKKLK

SEQ ID NO: 879406 - protein, 9 aa, Homo Sapiens
EGLQTVLGL

SEQ ID NO: 879407 - protein, 9 aa, Homo Sapiens
QMLLGIIIC

SEQ ID NO: 879408 - protein, 9 aa, Homo Sapiens
VENNCYRRL

SEQ ID NO: 879409 - protein, 9 aa, Homo Sapiens
DPRKYSEKY

SEQ ID NO: 879410 - protein, 9 aa, Homo Sapiens
LNMVVALKE

SEQ ID NO: 879411 - protein, 9 aa, Homo Sapiens
VNFFIQSCR

SEQ ID NO: 879412 - protein, 9 aa, Homo Sapiens
KDVKSYFSQ

SEQ ID NO: 879413 - protein, 9 aa, Homo Sapiens
AFCRRGKLY

SEQ ID NO: 879414 - protein, 9 aa, Homo Sapiens
LTKCAASGD

SEQ ID NO: 879415 - protein, 9 aa, Homo Sapiens
EVLCHPSTP

SEQ ID NO: 879416 - protein, 9 aa, Homo Sapiens
SFVEKQLMK

SEQ ID NO: 879417 - protein, 9 aa, Homo Sapiens
VLPEIAWVS

SEQ ID NO: 879418 - protein, 9 aa, Homo Sapiens
NVNQMGEEN

SEQ ID NO: 879419 - protein, 9 aa, Homo Sapiens
QILIFGAHN

SEQ ID NO: 879420 - protein, 9 aa, Homo Sapiens
AQGNLTACG

SEQ ID NO: 879421 - protein, 9 aa, Homo Sapiens
HIAIGVFTE

SEQ ID NO: 879422 - protein, 9 aa, Homo Sapiens
MLKLINHTK

SEQ ID NO: 879423 - protein, 9 aa, Homo Sapiens
LKETAGDKL

SEQ ID NO: 879424 - protein, 9 aa, Homo Sapiens
FGHQPYWWV

SEQ ID NO: 879425 - protein, 9 aa, Homo Sapiens
FLQDYDIQT

SEQ ID NO: 879426 - protein, 9 aa, Homo Sapiens
QQPLPFGTV

SEQ ID NO: 879427 - protein, 9 aa, Homo Sapiens
NFMLRRHIF

SEQ ID NO: 879428 - protein, 9 aa, Homo Sapiens
WNAAGEDQK

SEQ ID NO: 879429 - protein, 9 aa, Homo Sapiens
VRFLDKKHQ

SEQ ID NO: 879430 - protein, 9 aa, Homo Sapiens
SYQPETNSY

SEQ ID NO: 879431 - protein, 9 aa, Homo Sapiens
RHFQARSKK

SEQ ID NO: 879432 - protein, 9 aa, Homo Sapiens
VVKFPPDIY

SEQ ID NO: 879433 - protein, 9 aa, Homo Sapiens
AFGWCSSLQ

SEQ ID NO: 879434 - protein, 9 aa, Homo Sapiens
MDATPGVDL

SEQ ID NO: 879435 - protein, 9 aa, Homo Sapiens
LQSPVALCG

SEQ ID NO: 879436 - protein, 9 aa, Homo Sapiens
ENIKNKIED

SEQ ID NO: 879437 - protein, 9 aa, Homo Sapiens
PPHRKHMVF

SEQ ID NO: 879438 - protein, 9 aa, Homo Sapiens
TNGRSLTTS

SEQ ID NO: 879439 - protein, 9 aa, Homo Sapiens
TSKLLRQEQ

SEQ ID NO: 879440 - protein, 9 aa, Homo Sapiens
KDDSKLIAL

SEQ ID NO: 879441 - protein, 9 aa, Homo Sapiens
FYYLHVLCY

SEQ ID NO: 879442 - protein, 9 aa, Homo Sapiens
QLQNMGKED

SEQ ID NO: 879443 - protein, 9 aa, Homo Sapiens
ISIVGTGLV

SEQ ID NO: 879444 - protein, 9 aa, Homo Sapiens
LQAKKIMVE

SEQ ID NO: 879445 - protein, 9 aa, Homo Sapiens
IYSSMVPQL

SEQ ID NO: 879446 - protein, 9 aa, Homo Sapiens
SLLDREVKL

SEQ ID NO: 879447 - protein, 9 aa, Homo Sapiens
KEGSKQAQK

SEQ ID NO: 879448 - protein, 9 aa, Homo Sapiens
KITITVVYA

SEQ ID NO: 879449 - protein, 9 aa, Homo Sapiens
FLRTLFLHT

SEQ ID NO: 879450 - protein, 9 aa, Homo Sapiens
PFKCPCSLC

SEQ ID NO: 879451 - protein, 9 aa, Homo Sapiens
RMEEMGNCI

SEQ ID NO: 879452 - protein, 9 aa, Homo Sapiens
DGDSENGGT

SEQ ID NO: 879453 - protein, 9 aa, Homo Sapiens
LFMQYCVAA

SEQ ID NO: 879454 - protein, 9 aa, Homo Sapiens
HNYTRCYTC

SEQ ID NO: 879455 - protein, 9 aa, Homo Sapiens
GPTSQDTIQ

SEQ ID NO: 879456 - protein, 9 aa, Homo Sapiens
DSGLEEKSS

SEQ ID NO: 879457 - protein, 9 aa, Homo Sapiens
IAQFRKEKD

SEQ ID NO: 879458 - protein, 9 aa, Homo Sapiens
RVCTVDSYD

SEQ ID NO: 879459 - protein, 9 aa, Homo Sapiens
VSYLHCKWA

SEQ ID NO: 879460 - protein, 9 aa, Homo Sapiens
DPDVGENFL

SEQ ID NO: 879461 - protein, 9 aa, Homo Sapiens
WDFLPQFLQ

SEQ ID NO: 879462 - protein, 9 aa, Homo Sapiens
LANNQRNVW

SEQ ID NO: 879463 - protein, 9 aa, Homo Sapiens
RAAWDTVSN

SEQ ID NO: 879464 - protein, 9 aa, Homo Sapiens
ADPHNAHRG

SEQ ID NO: 879465 - protein, 9 aa, Homo Sapiens
PRHLFQIKH

SEQ ID NO: 879466 - protein, 9 aa, Homo Sapiens
KICFPIPTE

SEQ ID NO: 879467 - protein, 9 aa, Homo Sapiens
PPFDIGFKG

SEQ ID NO: 879468 - protein, 9 aa, Homo Sapiens
VRTLYTQIC

SEQ ID NO: 879469 - protein, 9 aa, Homo Sapiens
KVSLSTFED

SEQ ID NO: 879470 - protein, 9 aa, Homo Sapiens
MLFTSFYLL

SEQ ID NO: 879471 - protein, 9 aa, Homo Sapiens
VYAQGLQAK

SEQ ID NO: 879472 - protein, 9 aa, Homo Sapiens
VTRKDTEEE

SEQ ID NO: 879473 - protein, 9 aa, Homo Sapiens
RVCEYYLLH

SEQ ID NO: 879474 - protein, 9 aa, Homo Sapiens
QYITQFTSQ

SEQ ID NO: 879475 - protein, 9 aa, Homo Sapiens
YECQACQKT

SEQ ID NO: 879476 - protein, 9 aa, Homo Sapiens
VKLSVCMTL

SEQ ID NO: 879477 - protein, 9 aa, Homo Sapiens
KSINSLNKL

SEQ ID NO: 879478 - protein, 9 aa, Homo Sapiens
AGIVFWLHS

SEQ ID NO: 879479 - protein, 9 aa, Homo Sapiens
YWELQKDPG

SEQ ID NO: 879480 - protein, 9 aa, Homo Sapiens
SYIMDYYQS

SEQ ID NO: 879481 - protein, 9 aa, Homo Sapiens
LQVHTGEKP

SEQ ID NO: 879482 - protein, 9 aa, Homo Sapiens
AHSGEKPHE

SEQ ID NO: 879483 - protein, 9 aa, Homo Sapiens
SILNIVKNH

SEQ ID NO: 879484 - protein, 9 aa, Homo Sapiens
ELLCIHGGH

SEQ ID NO: 879485 - protein, 9 aa, Homo Sapiens
IMQQGQFRY

SEQ ID NO: 879486 - protein, 9 aa, Homo Sapiens
LDTTAASAV

SEQ ID NO: 879487 - protein, 9 aa, Homo Sapiens
QDRNELKNM

SEQ ID NO: 879488 - protein, 9 aa, Homo Sapiens
LKLQKKDFL

SEQ ID NO: 879489 - protein, 9 aa, Homo Sapiens
QRTWNNLCN

SEQ ID NO: 879490 - protein, 9 aa, Homo Sapiens
VPDTGETTT

SEQ ID NO: 879491 - protein, 9 aa, Homo Sapiens
SPVDTTSVS

SEQ ID NO: 879492 - protein, 9 aa, Homo Sapiens
RFDLVVSIL

SEQ ID NO: 879493 - protein, 9 aa, Homo Sapiens
MRPLEALSS

SEQ ID NO: 879494 - protein, 9 aa, Homo Sapiens
RNVSYLHCK

SEQ ID NO: 879495 - protein, 9 aa, Homo Sapiens
ITSKFVCRD

SEQ ID NO: 879496 - protein, 9 aa, Homo Sapiens
QNMFGETLH

SEQ ID NO: 879497 - protein, 9 aa, Homo Sapiens
MLLHLIQHK

SEQ ID NO: 879498 - protein, 9 aa, Homo Sapiens
GSSVLSLLR

SEQ ID NO: 879499 - protein, 9 aa, Homo Sapiens
QRSFIGNSD

SEQ ID NO: 879500 - protein, 9 aa, Homo Sapiens
FWNHIVACV

SEQ ID NO: 879501 - protein, 9 aa, Homo Sapiens
QEVHTHYLH

SEQ ID NO: 879502 - protein, 9 aa, Homo Sapiens
SDTEFGDTD

SEQ ID NO: 879503 - protein, 9 aa, Homo Sapiens
ELQQRNSKA

SEQ ID NO: 879504 - protein, 9 aa, Homo Sapiens
GSGSHPDLS

SEQ ID NO: 879505 - protein, 9 aa, Homo Sapiens
LKRDSYLPV

SEQ ID NO: 879506 - protein, 9 aa, Homo Sapiens
EECNGLEEE

SEQ ID NO: 879507 - protein, 9 aa, Homo Sapiens
LVDCILCDT

SEQ ID NO: 879508 - protein, 9 aa, Homo Sapiens
SGDALYKLF

SEQ ID NO: 879509 - protein, 9 aa, Homo Sapiens
FVAPDYVLC

SEQ ID NO: 879510 - protein, 9 aa, Homo Sapiens
GKYVAVEEF

SEQ ID NO: 879511 - protein, 9 aa, Homo Sapiens
VNAPPVVTT

SEQ ID NO: 879512 - protein, 9 aa, Homo Sapiens
VQTNMQYVF

SEQ ID NO: 879513 - protein, 9 aa, Homo Sapiens
TLQKYFDVC

SEQ ID NO: 879514 - protein, 9 aa, Homo Sapiens
EVYDAKSKY

SEQ ID NO: 879515 - protein, 9 aa, Homo Sapiens
PDEIIEEII

SEQ ID NO: 879516 - protein, 9 aa, Homo Sapiens
NPINVIYVG

SEQ ID NO: 879517 - protein, 9 aa, Homo Sapiens
TKAVCEFEG

SEQ ID NO: 879518 - protein, 9 aa, Homo Sapiens
TPSFLKGTT

SEQ ID NO: 879519 - protein, 9 aa, Homo Sapiens
DLALFVDIQ

SEQ ID NO: 879520 - protein, 9 aa, Homo Sapiens
VQWPCPGVP

SEQ ID NO: 879521 - protein, 9 aa, Homo Sapiens
NTYKGSEEE

SEQ ID NO: 879522 - protein, 9 aa, Homo Sapiens
EVPEAYVNI

SEQ ID NO: 879523 - protein, 9 aa, Homo Sapiens
ELSDSGLEE

SEQ ID NO: 879524 - protein, 9 aa, Homo Sapiens
TVLDHYTYS

SEQ ID NO: 879525 - protein, 9 aa, Homo Sapiens
RAVVPSCIP

SEQ ID NO: 879526 - protein, 9 aa, Homo Sapiens
NKELKVTMK

SEQ ID NO: 879527 - protein, 9 aa, Homo Sapiens
NLNPVCEAF

SEQ ID NO: 879528 - protein, 9 aa, Homo Sapiens
ASRQTLMDN

SEQ ID NO: 879529 - protein, 9 aa, Homo Sapiens
STPSYPGYL

SEQ ID NO: 879530 - protein, 9 aa, Homo Sapiens
ISTKTQCSK

SEQ ID NO: 879531 - protein, 9 aa, Homo Sapiens
HIRWIGSDI

SEQ ID NO: 879532 - protein, 9 aa, Homo Sapiens
RGKVCIYRG

SEQ ID NO: 879533 - protein, 9 aa, Homo Sapiens
KKERICKLS

SEQ ID NO: 879534 - protein, 9 aa, Homo Sapiens
FQRMEDTFQ

SEQ ID NO: 879535 - protein, 9 aa, Homo Sapiens
LVSYLNIVL

SEQ ID NO: 879536 - protein, 9 aa, Homo Sapiens
LVKDCDADV

SEQ ID NO: 879537 - protein, 9 aa, Homo Sapiens
SMLETINKG

SEQ ID NO: 879538 - protein, 9 aa, Homo Sapiens
EMIYLAPEV

SEQ ID NO: 879539 - protein, 9 aa, Homo Sapiens
VTDFQTRLR

SEQ ID NO: 879540 - protein, 9 aa, Homo Sapiens
KLDNILVWS

SEQ ID NO: 879541 - protein, 9 aa, Homo Sapiens
LSQNQLSAL

SEQ ID NO: 879542 - protein, 9 aa, Homo Sapiens
LKDDNFEKI

SEQ ID NO: 879543 - protein, 9 aa, Homo Sapiens
EDKKPKEKK

SEQ ID NO: 879544 - protein, 9 aa, Homo Sapiens
LYVVPGPVQ

SEQ ID NO: 879545 - protein, 9 aa, Homo Sapiens
SHYRHRHCS

SEQ ID NO: 879546 - protein, 9 aa, Homo Sapiens
ACFRSLVAS

SEQ ID NO: 879547 - protein, 9 aa, Homo Sapiens
CGFQPIEIQ

SEQ ID NO: 879548 - protein, 9 aa, Homo Sapiens
ELDNFFDES

SEQ ID NO: 879549 - protein, 9 aa, Homo Sapiens
VPITMKYVF

SEQ ID NO: 879550 - protein, 9 aa, Homo Sapiens
EKSQEENPE

SEQ ID NO: 879551 - protein, 9 aa, Homo Sapiens
MVFTIFFGS

SEQ ID NO: 879552 - protein, 9 aa, Homo Sapiens
NVRGKQHGS

SEQ ID NO: 879553 - protein, 9 aa, Homo Sapiens
QDCVFENED

SEQ ID NO: 879554 - protein, 9 aa, Homo Sapiens
INEQEALED

SEQ ID NO: 879555 - protein, 9 aa, Homo Sapiens
SKDDLIAYV

SEQ ID NO: 879556 - protein, 9 aa, Homo Sapiens
KYLGTNAQI

SEQ ID NO: 879557 - protein, 9 aa, Homo Sapiens
VKVQVNVHG

SEQ ID NO: 879558 - protein, 9 aa, Homo Sapiens
CSLSMWSVA

SEQ ID NO: 879559 - protein, 9 aa, Homo Sapiens
DAKEAITAL

SEQ ID NO: 879560 - protein, 9 aa, Homo Sapiens
HLEEQLPWL

SEQ ID NO: 879561 - protein, 9 aa, Homo Sapiens
QFEFTPGRD

SEQ ID NO: 879562 - protein, 9 aa, Homo Sapiens
FRHHTSLIQ

SEQ ID NO: 879563 - protein, 9 aa, Homo Sapiens
GSEKTQIGL

SEQ ID NO: 879564 - protein, 9 aa, Homo Sapiens
STKQAKRNA

SEQ ID NO: 879565 - protein, 9 aa, Homo Sapiens
FHHQINIYE

SEQ ID NO: 879566 - protein, 9 aa, Homo Sapiens
TEGAVDAML

SEQ ID NO: 879567 - protein, 9 aa, Homo Sapiens
GVNQDCHFN

SEQ ID NO: 879568 - protein, 9 aa, Homo Sapiens
EPSTRVRCI

SEQ ID NO: 879569 - protein, 9 aa, Homo Sapiens
IHNSANVPF

SEQ ID NO: 879570 - protein, 9 aa, Homo Sapiens
ACKFIPPVE

SEQ ID NO: 879571 - protein, 9 aa, Homo Sapiens
ICHPLCYPV

SEQ ID NO: 879572 - protein, 9 aa, Homo Sapiens
LKEAEKQED

SEQ ID NO: 879573 - protein, 9 aa, Homo Sapiens
AATHIVHPL

SEQ ID NO: 879574 - protein, 9 aa, Homo Sapiens
FQDLQSSDL

SEQ ID NO: 879575 - protein, 9 aa, Homo Sapiens
DFHRKFHSI

SEQ ID NO: 879576 - protein, 9 aa, Homo Sapiens
NRYYIDHVS

SEQ ID NO: 879577 - protein, 9 aa, Homo Sapiens
ATCPLNARH

SEQ ID NO: 879578 - protein, 9 aa, Homo Sapiens
PYKPFHRSS

SEQ ID NO: 879579 - protein, 9 aa, Homo Sapiens
MVLLGFPGL

SEQ ID NO: 879580 - protein, 9 aa, Homo Sapiens
EARYGNSIN

SEQ ID NO: 879581 - protein, 9 aa, Homo Sapiens
ILNAQHINL

SEQ ID NO: 879582 - protein, 9 aa, Homo Sapiens
ENYSIYKQT

SEQ ID NO: 879583 - protein, 9 aa, Homo Sapiens
LSDSGLEEK

SEQ ID NO: 879584 - protein, 9 aa, Homo Sapiens
AIIIASLIN

SEQ ID NO: 879585 - protein, 9 aa, Homo Sapiens
LEHYKDPSL

SEQ ID NO: 879586 - protein, 9 aa, Homo Sapiens
KRIYCALSG

SEQ ID NO: 879587 - protein, 9 aa, Homo Sapiens
QMWRDQVTD

SEQ ID NO: 879588 - protein, 9 aa, Homo Sapiens
KPESSYPVK

SEQ ID NO: 879589 - protein, 9 aa, Homo Sapiens
SALIRHQQI

SEQ ID NO: 879590 - protein, 9 aa, Homo Sapiens
EHYEKAENE

SEQ ID NO: 879591 - protein, 9 aa, Homo Sapiens
DKITNGSQI

SEQ ID NO: 879592 - protein, 9 aa, Homo Sapiens
RNRVCIAET

SEQ ID NO: 879593 - protein, 9 aa, Homo Sapiens
AKNDRSKSK

SEQ ID NO: 879594 - protein, 9 aa, Homo Sapiens
YYQLWVNSG

SEQ ID NO: 879595 - protein, 9 aa, Homo Sapiens
ATLCPQSCK

SEQ ID NO: 879596 - protein, 9 aa, Homo Sapiens
GREFNLQRG

SEQ ID NO: 879597 - protein, 9 aa, Homo Sapiens
FTFLSIYNQ

SEQ ID NO: 879598 - protein, 9 aa, Homo Sapiens
SSWHFDKVR

SEQ ID NO: 879599 - protein, 9 aa, Homo Sapiens
PPPAPFKSP

SEQ ID NO: 879600 - protein, 9 aa, Homo Sapiens
ETNSYFQPN

SEQ ID NO: 879601 - protein, 9 aa, Homo Sapiens
FKDKTKSPP

SEQ ID NO: 879602 - protein, 9 aa, Homo Sapiens
DIPFEQSFS

SEQ ID NO: 879603 - protein, 9 aa, Homo Sapiens
HVEIRQDGN

SEQ ID NO: 879604 - protein, 9 aa, Homo Sapiens
CQNEKKRHR

SEQ ID NO: 879605 - protein, 9 aa, Homo Sapiens
MNKHSSRSH

SEQ ID NO: 879606 - protein, 9 aa, Homo Sapiens
HGYGGLVCM

SEQ ID NO: 879607 - protein, 9 aa, Homo Sapiens
LLNIIRKKN

SEQ ID NO: 879608 - protein, 9 aa, Homo Sapiens
PVFNVLKLI

SEQ ID NO: 879609 - protein, 9 aa, Homo Sapiens
KQQEEQKQQ

SEQ ID NO: 879610 - protein, 9 aa, Homo Sapiens
MREIIRRLE

SEQ ID NO: 879611 - protein, 9 aa, Homo Sapiens
GPGFLLSSL

SEQ ID NO: 879612 - protein, 9 aa, Homo Sapiens
EVDEDFNGK

SEQ ID NO: 879613 - protein, 9 aa, Homo Sapiens
KRAKEEAEQ

SEQ ID NO: 879614 - protein, 9 aa, Homo Sapiens
MYPASFVFN

SEQ ID NO: 879615 - protein, 9 aa, Homo Sapiens
MTKLSTQVK

SEQ ID NO: 879616 - protein, 9 aa, Homo Sapiens
LICARRSMD

SEQ ID NO: 879617 - protein, 9 aa, Homo Sapiens
SMQSLNGDS

SEQ ID NO: 879618 - protein, 9 aa, Homo Sapiens
VLKINECYK

SEQ ID NO: 879619 - protein, 9 aa, Homo Sapiens
LGMMAQTHS

SEQ ID NO: 879620 - protein, 9 aa, Homo Sapiens
ENEKQRQNG

SEQ ID NO: 879621 - protein, 9 aa, Homo Sapiens
GLAIHIQNH

SEQ ID NO: 879622 - protein, 9 aa, Homo Sapiens
RYTHEGVRY

SEQ ID NO: 879623 - protein, 9 aa, Homo Sapiens
QNPCHNGST

SEQ ID NO: 879624 - protein, 9 aa, Homo Sapiens
WINLTFGYK

SEQ ID NO: 879625 - protein, 9 aa, Homo Sapiens
DSIEEEEAE

SEQ ID NO: 879626 - protein, 9 aa, Homo Sapiens
HWSSFAVLP

SEQ ID NO: 879627 - protein, 9 aa, Homo Sapiens
QQQLFCQAQ

SEQ ID NO: 879628 - protein, 9 aa, Homo Sapiens
KAINELFRT

SEQ ID NO: 879629 - protein, 9 aa, Homo Sapiens
ANPGSRYDN

SEQ ID NO: 879630 - protein, 9 aa, Homo Sapiens
ITIHDQKEF

SEQ ID NO: 879631 - protein, 9 aa, Homo Sapiens
LKCIAIDNP

SEQ ID NO: 879632 - protein, 9 aa, Homo Sapiens
HATHTRDCL

SEQ ID NO: 879633 - protein, 9 aa, Homo Sapiens
SETRGGETQ

SEQ ID NO: 879634 - protein, 9 aa, Homo Sapiens
YFIPSQLCE

SEQ ID NO: 879635 - protein, 9 aa, Homo Sapiens
LIPQTTARR

SEQ ID NO: 879636 - protein, 9 aa, Homo Sapiens
TVSTMRCKT

SEQ ID NO: 879637 - protein, 9 aa, Homo Sapiens
AEYTFLFAL

SEQ ID NO: 879638 - protein, 9 aa, Homo Sapiens
NFFKDWRKD

SEQ ID NO: 879639 - protein, 9 aa, Homo Sapiens
KKLQNPYSI

SEQ ID NO: 879640 - protein, 9 aa, Homo Sapiens
DLVDILSFL

SEQ ID NO: 879641 - protein, 9 aa, Homo Sapiens
TARIWQFKQ

SEQ ID NO: 879642 - protein, 9 aa, Homo Sapiens
LLRNHCFLE

SEQ ID NO: 879643 - protein, 9 aa, Homo Sapiens
VCMHNLKTR

SEQ ID NO: 879644 - protein, 9 aa, Homo Sapiens
IIFCDLKLD

SEQ ID NO: 879645 - protein, 9 aa, Homo Sapiens
FRQSIQKNM

SEQ ID NO: 879646 - protein, 9 aa, Homo Sapiens
PNWGRGAKC

SEQ ID NO: 879647 - protein, 9 aa, Homo Sapiens
QYICRLNWS

SEQ ID NO: 879648 - protein, 9 aa, Homo Sapiens
MAGLIQKYN

SEQ ID NO: 879649 - protein, 9 aa, Homo Sapiens
NPPRLGTVG

SEQ ID NO: 879650 - protein, 9 aa, Homo Sapiens
WQFFVKWQG

SEQ ID NO: 879651 - protein, 9 aa, Homo Sapiens
QVPESVELT

SEQ ID NO: 879652 - protein, 9 aa, Homo Sapiens
AIDIFEDII

SEQ ID NO: 879653 - protein, 9 aa, Homo Sapiens
EGVSPQNSL

SEQ ID NO: 879654 - protein, 9 aa, Homo Sapiens
DLKETAGDK

SEQ ID NO: 879655 - protein, 9 aa, Homo Sapiens
TYLPSVSNA

SEQ ID NO: 879656 - protein, 9 aa, Homo Sapiens
VAVYQPLHY

SEQ ID NO: 879657 - protein, 9 aa, Homo Sapiens
SSAVCMHNL

SEQ ID NO: 879658 - protein, 9 aa, Homo Sapiens
HTAWCGFVR

SEQ ID NO: 879659 - protein, 9 aa, Homo Sapiens
LQENYCQNP

SEQ ID NO: 879660 - protein, 9 aa, Homo Sapiens
LQRCEKTGN

SEQ ID NO: 879661 - protein, 9 aa, Homo Sapiens
LKQKEISNT

SEQ ID NO: 879662 - protein, 9 aa, Homo Sapiens
TTDMLKMAT

SEQ ID NO: 879663 - protein, 9 aa, Homo Sapiens
EKRRLNTRF

SEQ ID NO: 879664 - protein, 9 aa, Homo Sapiens
HHAGLIELL

SEQ ID NO: 879665 - protein, 9 aa, Homo Sapiens
VIWRFQPNT

SEQ ID NO: 879666 - protein, 9 aa, Homo Sapiens
LSSQLRYCA

SEQ ID NO: 879667 - protein, 9 aa, Homo Sapiens
ASPHRNAYQ

SEQ ID NO: 879668 - protein, 9 aa, Homo Sapiens
SVVNYFIEK

SEQ ID NO: 879669 - protein, 9 aa, Homo Sapiens
GYINFDKWR

SEQ ID NO: 879670 - protein, 9 aa, Homo Sapiens
QYDNFFNYV

SEQ ID NO: 879671 - protein, 9 aa, Homo Sapiens
LAERAGDIG

SEQ ID NO: 879672 - protein, 9 aa, Homo Sapiens
RDTLSIQES

SEQ ID NO: 879673 - protein, 9 aa, Homo Sapiens
GPWGDCLRT

SEQ ID NO: 879674 - protein, 9 aa, Homo Sapiens
SSSSGVWAT

SEQ ID NO: 879675 - protein, 9 aa, Homo Sapiens
QFFTFNSNL

SEQ ID NO: 879676 - protein, 9 aa, Homo Sapiens
QLEQQRLTV

SEQ ID NO: 879677 - protein, 9 aa, Homo Sapiens
VFRRYTDLS

SEQ ID NO: 879678 - protein, 9 aa, Homo Sapiens
QPETNSYFQ

SEQ ID NO: 879679 - protein, 9 aa, Homo Sapiens
KARITSSVV

SEQ ID NO: 879680 - protein, 9 aa, Homo Sapiens
LSNPCTSCA

SEQ ID NO: 879681 - protein, 9 aa, Homo Sapiens
CLAVKDYIQ

SEQ ID NO: 879682 - protein, 9 aa, Homo Sapiens
LKKRSCAST

SEQ ID NO: 879683 - protein, 9 aa, Homo Sapiens
LWDAKNKKE

SEQ ID NO: 879684 - protein, 9 aa, Homo Sapiens
ENGNSNKKK

SEQ ID NO: 879685 - protein, 9 aa, Homo Sapiens
SLNGHEFNF

SEQ ID NO: 879686 - protein, 9 aa, Homo Sapiens
KAQDNTWKI

SEQ ID NO: 879687 - protein, 9 aa, Homo Sapiens
LPKYKQVHI

SEQ ID NO: 879688 - protein, 9 aa, Homo Sapiens
VKFSSNYRA

SEQ ID NO: 879689 - protein, 9 aa, Homo Sapiens
PLGTAEPIT

SEQ ID NO: 879690 - protein, 9 aa, Homo Sapiens
MVRTDYLWR

SEQ ID NO: 879691 - protein, 9 aa, Homo Sapiens
SEIKEIEEL

SEQ ID NO: 879692 - protein, 9 aa, Homo Sapiens
LDRQCQLNV

SEQ ID NO: 879693 - protein, 9 aa, Homo Sapiens
HELCPEEQH

SEQ ID NO: 879694 - protein, 9 aa, Homo Sapiens
VRVENANPT

SEQ ID NO: 879695 - protein, 9 aa, Homo Sapiens
RAPNHDKVA

SEQ ID NO: 879696 - protein, 9 aa, Homo Sapiens
ARCLIHSLL

SEQ ID NO: 879697 - protein, 9 aa, Homo Sapiens
GLYSRSNPV

SEQ ID NO: 879698 - protein, 9 aa, Homo Sapiens
SLYKICVCP

SEQ ID NO: 879699 - protein, 9 aa, Homo Sapiens
FWIKSGNEN

SEQ ID NO: 879700 - protein, 9 aa, Homo Sapiens
VHPQRYLVI

SEQ ID NO: 879701 - protein, 9 aa, Homo Sapiens
QLFQSHDYP

SEQ ID NO: 879702 - protein, 9 aa, Homo Sapiens
CKFIPPVEG

SEQ ID NO: 879703 - protein, 9 aa, Homo Sapiens
TPFRVLACM

SEQ ID NO: 879704 - protein, 9 aa, Homo Sapiens
KKLHIPLKT

SEQ ID NO: 879705 - protein, 9 aa, Homo Sapiens
FALPSVVFA

SEQ ID NO: 879706 - protein, 9 aa, Homo Sapiens
IVDFASELT

SEQ ID NO: 879707 - protein, 9 aa, Homo Sapiens
LIFLPGYDK

SEQ ID NO: 879708 - protein, 9 aa, Homo Sapiens
DWERLELKL

SEQ ID NO: 879709 - protein, 9 aa, Homo Sapiens
TAVKFSSNY

SEQ ID NO: 879710 - protein, 9 aa, Homo Sapiens
DAKPVCCKC

SEQ ID NO: 879711 - protein, 9 aa, Homo Sapiens
EKMSTPLRR

SEQ ID NO: 879712 - protein, 9 aa, Homo Sapiens
VSWDLFREA

SEQ ID NO: 879713 - protein, 9 aa, Homo Sapiens
LLFSWFAFL

SEQ ID NO: 879714 - protein, 9 aa, Homo Sapiens
FVAVKILLT

SEQ ID NO: 879715 - protein, 9 aa, Homo Sapiens
GKKVADTLT

SEQ ID NO: 879716 - protein, 9 aa, Homo Sapiens
HYAYRDSMT

SEQ ID NO: 879717 - protein, 9 aa, Homo Sapiens
IAAFYGGKP

SEQ ID NO: 879718 - protein, 9 aa, Homo Sapiens
CRKYLFICE

SEQ ID NO: 879719 - protein, 9 aa, Homo Sapiens
HFEHIIYQM

SEQ ID NO: 879720 - protein, 9 aa, Homo Sapiens
SHQRIHTGD

SEQ ID NO: 879721 - protein, 9 aa, Homo Sapiens
IIYNRTRLD

SEQ ID NO: 879722 - protein, 9 aa, Homo Sapiens
SPTSKQIRK

SEQ ID NO: 879723 - protein, 9 aa, Homo Sapiens
IVYTYQIFR

SEQ ID NO: 879724 - protein, 9 aa, Homo Sapiens
PDTCVWEGE

SEQ ID NO: 879725 - protein, 9 aa, Homo Sapiens
NKQEKSPQD

SEQ ID NO: 879726 - protein, 9 aa, Homo Sapiens
ADCITQIKC

SEQ ID NO: 879727 - protein, 9 aa, Homo Sapiens
KFNSVGKLL

SEQ ID NO: 879728 - protein, 9 aa, Homo Sapiens
QERIWSYLM

SEQ ID NO: 879729 - protein, 9 aa, Homo Sapiens
PDTPFWLLS

SEQ ID NO: 879730 - protein, 9 aa, Homo Sapiens
YEDFLSALR

SEQ ID NO: 879731 - protein, 9 aa, Homo Sapiens
KIKENEFFP

SEQ ID NO: 879732 - protein, 9 aa, Homo Sapiens
HRDLDNKLR

SEQ ID NO: 879733 - protein, 9 aa, Homo Sapiens
CFKTLKGHS

SEQ ID NO: 879734 - protein, 9 aa, Homo Sapiens
LGTTGLFLQ

SEQ ID NO: 879735 - protein, 9 aa, Homo Sapiens
GSPQMLTKE

SEQ ID NO: 879736 - protein, 9 aa, Homo Sapiens
GLLLLQAVL

SEQ ID NO: 879737 - protein, 9 aa, Homo Sapiens
CLQNPKARV

SEQ ID NO: 879738 - protein, 9 aa, Homo Sapiens
GNKALSPTS

SEQ ID NO: 879739 - protein, 9 aa, Homo Sapiens
LGQSIACPF

SEQ ID NO: 879740 - protein, 9 aa, Homo Sapiens
RFNTIHEEF

SEQ ID NO: 879741 - protein, 9 aa, Homo Sapiens
TLGAADKQG

SEQ ID NO: 879742 - protein, 9 aa, Homo Sapiens
SNKKKKAKR

SEQ ID NO: 879743 - protein, 9 aa, Homo Sapiens
LRRDIPVTR

SEQ ID NO: 879744 - protein, 9 aa, Homo Sapiens
VKGKQMHVQ

SEQ ID NO: 879745 - protein, 9 aa, Homo Sapiens
VYTYQIFRE

SEQ ID NO: 879746 - protein, 9 aa, Homo Sapiens
HLLIHTSER

SEQ ID NO: 879747 - protein, 9 aa, Homo Sapiens
SYYTVQQLE

SEQ ID NO: 879748 - protein, 9 aa, Homo Sapiens
SQEAFQIIR

SEQ ID NO: 879749 - protein, 9 aa, Homo Sapiens
NRTEARGHT

SEQ ID NO: 879750 - protein, 9 aa, Homo Sapiens
SSVAVDAIA

SEQ ID NO: 879751 - protein, 9 aa, Homo Sapiens
LNLMTLGEV

SEQ ID NO: 879752 - protein, 9 aa, Homo Sapiens
SRTSYYEIS

SEQ ID NO: 879753 - protein, 9 aa, Homo Sapiens
IESHEYCRN

SEQ ID NO: 879754 - protein, 9 aa, Homo Sapiens
SGFYKAFAG

SEQ ID NO: 879755 - protein, 9 aa, Homo Sapiens
VNGMDISNA

SEQ ID NO: 879756 - protein, 9 aa, Homo Sapiens
LDPKPFVDC

SEQ ID NO: 879757 - protein, 9 aa, Homo Sapiens
IAGGCAGGS

SEQ ID NO: 879758 - protein, 9 aa, Homo Sapiens
AILNMVVAL

SEQ ID NO: 879759 - protein, 9 aa, Homo Sapiens
SGVYAWFWH

SEQ ID NO: 879760 - protein, 9 aa, Homo Sapiens
KVLAEKQNY

SEQ ID NO: 879761 - protein, 9 aa, Homo Sapiens
DVLCKMTVN

SEQ ID NO: 879762 - protein, 9 aa, Homo Sapiens
VKRTHYYET

SEQ ID NO: 879763 - protein, 9 aa, Homo Sapiens
QMRKAVNRK

SEQ ID NO: 879764 - protein, 9 aa, Homo Sapiens
KEGTEVSAS

SEQ ID NO: 879765 - protein, 9 aa, Homo Sapiens
EQDGICSSS

SEQ ID NO: 879766 - protein, 9 aa, Homo Sapiens
KDFGAKSKV

SEQ ID NO: 879767 - protein, 9 aa, Homo Sapiens
FVEKQLMKE

SEQ ID NO: 879768 - protein, 9 aa, Homo Sapiens
GHEFNFIHD

SEQ ID NO: 879769 - protein, 9 aa, Homo Sapiens
SKIVSSIKV

SEQ ID NO: 879770 - protein, 9 aa, Homo Sapiens
LSPQTLQSL

SEQ ID NO: 879771 - protein, 9 aa, Homo Sapiens
LDVVHKSFD

SEQ ID NO: 879772 - protein, 9 aa, Homo Sapiens
KRMHADCIT

SEQ ID NO: 879773 - protein, 9 aa, Homo Sapiens
KKNKNRSYK

SEQ ID NO: 879774 - protein, 9 aa, Homo Sapiens
TQRFKVNKI

SEQ ID NO: 879775 - protein, 9 aa, Homo Sapiens
LALKLRRGD

SEQ ID NO: 879776 - protein, 9 aa, Homo Sapiens
RRYTDLSRL

SEQ ID NO: 879777 - protein, 9 aa, Homo Sapiens
CRLAEVGSV

SEQ ID NO: 879778 - protein, 9 aa, Homo Sapiens
LKNSLKEAK

SEQ ID NO: 879779 - protein, 9 aa, Homo Sapiens
PGRLRSRTL

SEQ ID NO: 879780 - protein, 9 aa, Homo Sapiens
RLLCTDTSV

SEQ ID NO: 879781 - protein, 9 aa, Homo Sapiens
GVLCKSGRC

SEQ ID NO: 879782 - protein, 9 aa, Homo Sapiens
NQIEIIDQL

SEQ ID NO: 879783 - protein, 9 aa, Homo Sapiens
AGSSKLRFQ

SEQ ID NO: 879784 - protein, 9 aa, Homo Sapiens
PVDTTSVSV

SEQ ID NO: 879785 - protein, 9 aa, Homo Sapiens
KMDLLYSKT

SEQ ID NO: 879786 - protein, 9 aa, Homo Sapiens
VSETNQVLN

SEQ ID NO: 879787 - protein, 9 aa, Homo Sapiens
RTKGFWRPL

SEQ ID NO: 879788 - protein, 9 aa, Homo Sapiens
GIVKAAKSI

SEQ ID NO: 879789 - protein, 9 aa, Homo Sapiens
EELVNASCE

SEQ ID NO: 879790 - protein, 9 aa, Homo Sapiens
QFGITKVFF

SEQ ID NO: 879791 - protein, 9 aa, Homo Sapiens
SEGKISVKN

SEQ ID NO: 879792 - protein, 9 aa, Homo Sapiens
YDPGYESAY

SEQ ID NO: 879793 - protein, 9 aa, Homo Sapiens
VTVKNLLKH

SEQ ID NO: 879794 - protein, 9 aa, Homo Sapiens
TKNINFSRL

SEQ ID NO: 879795 - protein, 9 aa, Homo Sapiens
SVFKKESGS

SEQ ID NO: 879796 - protein, 9 aa, Homo Sapiens
KWMNKFSES

SEQ ID NO: 879797 - protein, 9 aa, Homo Sapiens
KDMKGALKK

SEQ ID NO: 879798 - protein, 9 aa, Homo Sapiens
TGSVCQLLH

SEQ ID NO: 879799 - protein, 9 aa, Homo Sapiens
RNHEITHSG

SEQ ID NO: 879800 - protein, 9 aa, Homo Sapiens
LDNIKRIIK

SEQ ID NO: 879801 - protein, 9 aa, Homo Sapiens
FDFLHVRDH

SEQ ID NO: 879802 - protein, 9 aa, Homo Sapiens
EEIDHRGKV

SEQ ID NO: 879803 - protein, 9 aa, Homo Sapiens
LIIKVQDIN

SEQ ID NO: 879804 - protein, 9 aa, Homo Sapiens
SVIVGLIKK

SEQ ID NO: 879805 - protein, 9 aa, Homo Sapiens
ISNNSFHSM

SEQ ID NO: 879806 - protein, 9 aa, Homo Sapiens
GEEVETLVK

SEQ ID NO: 879807 - protein, 9 aa, Homo Sapiens
TSLIGVCIA

SEQ ID NO: 879808 - protein, 9 aa, Homo Sapiens
PRTIQELDK

SEQ ID NO: 879809 - protein, 9 aa, Homo Sapiens
RCCLMKIEK

SEQ ID NO: 879810 - protein, 9 aa, Homo Sapiens
ARFGARRLQ

SEQ ID NO: 879811 - protein, 9 aa, Homo Sapiens
CLLLRFKVS

SEQ ID NO: 879812 - protein, 9 aa, Homo Sapiens
TVSLLTAAS

SEQ ID NO: 879813 - protein, 9 aa, Homo Sapiens
LDDKEEWPS

SEQ ID NO: 879814 - protein, 9 aa, Homo Sapiens
SGLSFITCI

SEQ ID NO: 879815 - protein, 9 aa, Homo Sapiens
ETTVQVISS

SEQ ID NO: 879816 - protein, 9 aa, Homo Sapiens
CHNGSTCRD

SEQ ID NO: 879817 - protein, 9 aa, Homo Sapiens
KRHRRQRKQ

SEQ ID NO: 879818 - protein, 9 aa, Homo Sapiens
VKKYSRVMD
